United States Patent 10,968,269 (MHC MULTIMERS IN BORRELIA DIAGNOSTICS AND DISEASE) - sequence listing, part 2

SEQ ID NO: 5324 - protein, 11 aa, Borrelia burgdorferi B31
AGAKYANSNIK

SEQ ID NO: 5325 - protein, 11 aa, Borrelia burgdorferi B31
GAKYANSNIKV

SEQ ID NO: 5326 - protein, 11 aa, Borrelia burgdorferi B31
AKYANSNIKVV

SEQ ID NO: 5327 - protein, 11 aa, Borrelia burgdorferi B31
KYANSNIKVVS

SEQ ID NO: 5328 - protein, 11 aa, Borrelia burgdorferi B31
YANSNIKVVSQ

SEQ ID NO: 5329 - protein, 11 aa, Borrelia burgdorferi B31
ANSNIKVVSQY

SEQ ID NO: 5330 - protein, 11 aa, Borrelia burgdorferi B31
NSNIKVVSQYV

SEQ ID NO: 5331 - protein, 11 aa, Borrelia burgdorferi B31
SNIKVVSQYVG

SEQ ID NO: 5332 - protein, 11 aa, Borrelia burgdorferi B31
NIKVVSQYVGT

SEQ ID NO: 5333 - protein, 11 aa, Borrelia burgdorferi B31
IKVVSQYVGTF

SEQ ID NO: 5334 - protein, 11 aa, Borrelia burgdorferi B31
KVVSQYVGTFG

SEQ ID NO: 5335 - protein, 11 aa, Borrelia burgdorferi B31
VVSQYVGTFGD

SEQ ID NO: 5336 - protein, 11 aa, Borrelia burgdorferi B31
VSQYVGTFGDF

SEQ ID NO: 5337 - protein, 11 aa, Borrelia burgdorferi B31
SQYVGTFGDFG

SEQ ID NO: 5338 - protein, 11 aa, Borrelia burgdorferi B31
QYVGTFGDFGL

SEQ ID NO: 5339 - protein, 11 aa, Borrelia burgdorferi B31
YVGTFGDFGLG

SEQ ID NO: 5340 - protein, 11 aa, Borrelia burgdorferi B31
VGTFGDFGLGR

SEQ ID NO: 5341 - protein, 11 aa, Borrelia burgdorferi B31
GTFGDFGLGRS

SEQ ID NO: 5342 - protein, 11 aa, Borrelia burgdorferi B31
TFGDFGLGRST

SEQ ID NO: 5343 - protein, 11 aa, Borrelia burgdorferi B31
FGDFGLGRSTA

SEQ ID NO: 5344 - protein, 11 aa, Borrelia burgdorferi B31
GDFGLGRSTAS

SEQ ID NO: 5345 - protein, 11 aa, Borrelia burgdorferi B31
DFGLGRSTASN

SEQ ID NO: 5346 - protein, 11 aa, Borrelia burgdorferi B31
FGLGRSTASNM

SEQ ID NO: 5347 - protein, 11 aa, Borrelia burgdorferi B31
GLGRSTASNMY

SEQ ID NO: 5348 - protein, 11 aa, Borrelia burgdorferi B31
LGRSTASNMYR

SEQ ID NO: 5349 - protein, 11 aa, Borrelia burgdorferi B31
GRSTASNMYRD

SEQ ID NO: 5350 - protein, 11 aa, Borrelia burgdorferi B31
RSTASNMYRDG

SEQ ID NO: 5351 - protein, 11 aa, Borrelia burgdorferi B31
STASNMYRDGV

SEQ ID NO: 5352 - protein, 11 aa, Borrelia burgdorferi B31
TASNMYRDGVD

SEQ ID NO: 5353 - protein, 11 aa, Borrelia burgdorferi B31
ASNMYRDGVDI

SEQ ID NO: 5354 - protein, 11 aa, Borrelia burgdorferi B31
SNMYRDGVDII

SEQ ID NO: 5355 - protein, 11 aa, Borrelia burgdorferi B31
NMYRDGVDIIF

SEQ ID NO: 5356 - protein, 11 aa, Borrelia burgdorferi B31
MYRDGVDIIFA

SEQ ID NO: 5357 - protein, 11 aa, Borrelia burgdorferi B31
YRDGVDIIFAA

SEQ ID NO: 5358 - protein, 11 aa, Borrelia burgdorferi B31
RDGVDIIFAAA

SEQ ID NO: 5359 - protein, 11 aa, Borrelia burgdorferi B31
DGVDIIFAAAG

SEQ ID NO: 5360 - protein, 11 aa, Borrelia burgdorferi B31
GVDIIFAAAGL

SEQ ID NO: 5361 - protein, 11 aa, Borrelia burgdorferi B31
VDIIFAAAGLS

SEQ ID NO: 5362 - protein, 11 aa, Borrelia burgdorferi B31
DIIFAAAGLSG

SEQ ID NO: 5363 - protein, 11 aa, Borrelia burgdorferi B31
IIFAAAGLSGI

SEQ ID NO: 5364 - protein, 11 aa, Borrelia burgdorferi B31
IFAAAGLSGIG

SEQ ID NO: 5365 - protein, 11 aa, Borrelia burgdorferi B31
FAAAGLSGIGV

SEQ ID NO: 5366 - protein, 11 aa, Borrelia burgdorferi B31
AAAGLSGIGVI

SEQ ID NO: 5367 - protein, 11 aa, Borrelia burgdorferi B31
AAGLSGIGVIE

SEQ ID NO: 5368 - protein, 11 aa, Borrelia burgdorferi B31
AGLSGIGVIEA

SEQ ID NO: 5369 - protein, 11 aa, Borrelia burgdorferi B31
GLSGIGVIEAA

SEQ ID NO: 5370 - protein, 11 aa, Borrelia burgdorferi B31
LSGIGVIEAAK

SEQ ID NO: 5371 - protein, 11 aa, Borrelia burgdorferi B31
SGIGVIEAAKE

SEQ ID NO: 5372 - protein, 11 aa, Borrelia burgdorferi B31
GIGVIEAAKEL

SEQ ID NO: 5373 - protein, 11 aa, Borrelia burgdorferi B31
IGVIEAAKELG

SEQ ID NO: 5374 - protein, 11 aa, Borrelia burgdorferi B31
GVIEAAKELGP

SEQ ID NO: 5375 - protein, 11 aa, Borrelia burgdorferi B31
VIEAAKELGPD

SEQ ID NO: 5376 - protein, 11 aa, Borrelia burgdorferi B31
IEAAKELGPDH

SEQ ID NO: 5377 - protein, 11 aa, Borrelia burgdorferi B31
EAAKELGPDHY

SEQ ID NO: 5378 - protein, 11 aa, Borrelia burgdorferi B31
AAKELGPDHYI

SEQ ID NO: 5379 - protein, 11 aa, Borrelia burgdorferi B31
AKELGPDHYII

SEQ ID NO: 5380 - protein, 11 aa, Borrelia burgdorferi B31
KELGPDHYIIG

SEQ ID NO: 5381 - protein, 11 aa, Borrelia burgdorferi B31
ELGPDHYIIGV

SEQ ID NO: 5382 - protein, 11 aa, Borrelia burgdorferi B31
LGPDHYIIGVD

SEQ ID NO: 5383 - protein, 11 aa, Borrelia burgdorferi B31
GPDHYIIGVDQ

SEQ ID NO: 5384 - protein, 11 aa, Borrelia burgdorferi B31
PDHYIIGVDQD

SEQ ID NO: 5385 - protein, 11 aa, Borrelia burgdorferi B31
DHYIIGVDQDQ

SEQ ID NO: 5386 - protein, 11 aa, Borrelia burgdorferi B31
HYIIGVDQDQS

SEQ ID NO: 5387 - protein, 11 aa, Borrelia burgdorferi B31
YIIGVDQDQSY

SEQ ID NO: 5388 - protein, 11 aa, Borrelia burgdorferi B31
IIGVDQDQSYL

SEQ ID NO: 5389 - protein, 11 aa, Borrelia burgdorferi B31
IGVDQDQSYLA

SEQ ID NO: 5390 - protein, 11 aa, Borrelia burgdorferi B31
GVDQDQSYLAP

SEQ ID NO: 5391 - protein, 11 aa, Borrelia burgdorferi B31
VDQDQSYLAPN

SEQ ID NO: 5392 - protein, 11 aa, Borrelia burgdorferi B31
DQDQSYLAPNN

SEQ ID NO: 5393 - protein, 11 aa, Borrelia burgdorferi B31
QDQSYLAPNNV

SEQ ID NO: 5394 - protein, 11 aa, Borrelia burgdorferi B31
DQSYLAPNNVI

SEQ ID NO: 5395 - protein, 11 aa, Borrelia burgdorferi B31
QSYLAPNNVIV

SEQ ID NO: 5396 - protein, 11 aa, Borrelia burgdorferi B31
SYLAPNNVIVS

SEQ ID NO: 5397 - protein, 11 aa, Borrelia burgdorferi B31
YLAPNNVIVSA

SEQ ID NO: 5398 - protein, 11 aa, Borrelia burgdorferi B31
LAPNNVIVSAV

SEQ ID NO: 5399 - protein, 11 aa, Borrelia burgdorferi B31
APNNVIVSAVK

SEQ ID NO: 5400 - protein, 11 aa, Borrelia burgdorferi B31
PNNVIVSAVKK

SEQ ID NO: 5401 - protein, 11 aa, Borrelia burgdorferi B31
NNVIVSAVKKV

SEQ ID NO: 5402 - protein, 11 aa, Borrelia burgdorferi B31
NVIVSAVKKVD

SEQ ID NO: 5403 - protein, 11 aa, Borrelia burgdorferi B31
VIVSAVKKVDS

SEQ ID NO: 5404 - protein, 11 aa, Borrelia burgdorferi B31
IVSAVKKVDSL

SEQ ID NO: 5405 - protein, 11 aa, Borrelia burgdorferi B31
VSAVKKVDSLM

SEQ ID NO: 5406 - protein, 11 aa, Borrelia burgdorferi B31
SAVKKVDSLMY

SEQ ID NO: 5407 - protein, 11 aa, Borrelia burgdorferi B31
AVKKVDSLMYS

SEQ ID NO: 5408 - protein, 11 aa, Borrelia burgdorferi B31
VKKVDSLMYSL

SEQ ID NO: 5409 - protein, 11 aa, Borrelia burgdorferi B31
KKVDSLMYSLT

SEQ ID NO: 5410 - protein, 11 aa, Borrelia burgdorferi B31
KVDSLMYSLTK

SEQ ID NO: 5411 - protein, 11 aa, Borrelia burgdorferi B31
VDSLMYSLTKK

SEQ ID NO: 5412 - protein, 11 aa, Borrelia burgdorferi B31
DSLMYSLTKKY

SEQ ID NO: 5413 - protein, 11 aa, Borrelia burgdorferi B31
SLMYSLTKKYL

SEQ ID NO: 5414 - protein, 11 aa, Borrelia burgdorferi B31
LMYSLTKKYLE

SEQ ID NO: 5415 - protein, 11 aa, Borrelia burgdorferi B31
MYSLTKKYLET

SEQ ID NO: 5416 - protein, 11 aa, Borrelia burgdorferi B31
YSLTKKYLETG

SEQ ID NO: 5417 - protein, 11 aa, Borrelia burgdorferi B31
SLTKKYLETGV

SEQ ID NO: 5418 - protein, 11 aa, Borrelia burgdorferi B31
LTKKYLETGVL

SEQ ID NO: 5419 - protein, 11 aa, Borrelia burgdorferi B31
TKKYLETGVLD

SEQ ID NO: 5420 - protein, 11 aa, Borrelia burgdorferi B31
KKYLETGVLDG

SEQ ID NO: 5421 - protein, 11 aa, Borrelia burgdorferi B31
KYLETGVLDGG

SEQ ID NO: 5422 - protein, 11 aa, Borrelia burgdorferi B31
YLETGVLDGGK

SEQ ID NO: 5423 - protein, 11 aa, Borrelia burgdorferi B31
LETGVLDGGKT

SEQ ID NO: 5424 - protein, 11 aa, Borrelia burgdorferi B31
ETGVLDGGKTM

SEQ ID NO: 5425 - protein, 11 aa, Borrelia burgdorferi B31
TGVLDGGKTMF

SEQ ID NO: 5426 - protein, 11 aa, Borrelia burgdorferi B31
GVLDGGKTMFL

SEQ ID NO: 5427 - protein, 11 aa, Borrelia burgdorferi B31
VLDGGKTMFLG

SEQ ID NO: 5428 - protein, 11 aa, Borrelia burgdorferi B31
LDGGKTMFLGL

SEQ ID NO: 5429 - protein, 11 aa, Borrelia burgdorferi B31
DGGKTMFLGLK

SEQ ID NO: 5430 - protein, 11 aa, Borrelia burgdorferi B31
GGKTMFLGLKE

SEQ ID NO: 5431 - protein, 11 aa, Borrelia burgdorferi B31
GKTMFLGLKED

SEQ ID NO: 5432 - protein, 11 aa, Borrelia burgdorferi B31
KTMFLGLKEDG

SEQ ID NO: 5433 - protein, 11 aa, Borrelia burgdorferi B31
TMFLGLKEDGL

SEQ ID NO: 5434 - protein, 11 aa, Borrelia burgdorferi B31
MFLGLKEDGLG

SEQ ID NO: 5435 - protein, 11 aa, Borrelia burgdorferi B31
FLGLKEDGLGL

SEQ ID NO: 5436 - protein, 11 aa, Borrelia burgdorferi B31
LGLKEDGLGLV

SEQ ID NO: 5437 - protein, 11 aa, Borrelia burgdorferi B31
GLKEDGLGLVL

SEQ ID NO: 5438 - protein, 11 aa, Borrelia burgdorferi B31
LKEDGLGLVLN

SEQ ID NO: 5439 - protein, 11 aa, Borrelia burgdorferi B31
KEDGLGLVLNE

SEQ ID NO: 5440 - protein, 11 aa, Borrelia burgdorferi B31
EDGLGLVLNEN

SEQ ID NO: 5441 - protein, 11 aa, Borrelia burgdorferi B31
DGLGLVLNENL

SEQ ID NO: 5442 - protein, 11 aa, Borrelia burgdorferi B31
GLGLVLNENLK

SEQ ID NO: 5443 - protein, 11 aa, Borrelia burgdorferi B31
LGLVLNENLKS

SEQ ID NO: 5444 - protein, 11 aa, Borrelia burgdorferi B31
GLVLNENLKSN

SEQ ID NO: 5445 - protein, 11 aa, Borrelia burgdorferi B31
LVLNENLKSNY

SEQ ID NO: 5446 - protein, 11 aa, Borrelia burgdorferi B31
VLNENLKSNYS

SEQ ID NO: 5447 - protein, 11 aa, Borrelia burgdorferi B31
LNENLKSNYSE

SEQ ID NO: 5448 - protein, 11 aa, Borrelia burgdorferi B31
NENLKSNYSEI

SEQ ID NO: 5449 - protein, 11 aa, Borrelia burgdorferi B31
ENLKSNYSEIY

SEQ ID NO: 5450 - protein, 11 aa, Borrelia burgdorferi B31
NLKSNYSEIYN

SEQ ID NO: 5451 - protein, 11 aa, Borrelia burgdorferi B31
LKSNYSEIYNK

SEQ ID NO: 5452 - protein, 11 aa, Borrelia burgdorferi B31
KSNYSEIYNKS

SEQ ID NO: 5453 - protein, 11 aa, Borrelia burgdorferi B31
SNYSEIYNKSL

SEQ ID NO: 5454 - protein, 11 aa, Borrelia burgdorferi B31
NYSEIYNKSLK

SEQ ID NO: 5455 - protein, 11 aa, Borrelia burgdorferi B31
YSEIYNKSLKI

SEQ ID NO: 5456 - protein, 11 aa, Borrelia burgdorferi B31
SEIYNKSLKIG

SEQ ID NO: 5457 - protein, 11 aa, Borrelia burgdorferi B31
EIYNKSLKIGQ

SEQ ID NO: 5458 - protein, 11 aa, Borrelia burgdorferi B31
IYNKSLKIGQS

SEQ ID NO: 5459 - protein, 11 aa, Borrelia burgdorferi B31
YNKSLKIGQSI

SEQ ID NO: 5460 - protein, 11 aa, Borrelia burgdorferi B31
NKSLKIGQSIM

SEQ ID NO: 5461 - protein, 11 aa, Borrelia burgdorferi B31
KSLKIGQSIMN

SEQ ID NO: 5462 - protein, 11 aa, Borrelia burgdorferi B31
SLKIGQSIMNG

SEQ ID NO: 5463 - protein, 11 aa, Borrelia burgdorferi B31
LKIGQSIMNGI

SEQ ID NO: 5464 - protein, 11 aa, Borrelia burgdorferi B31
KIGQSIMNGII

SEQ ID NO: 5465 - protein, 11 aa, Borrelia burgdorferi B31
IGQSIMNGIIK

SEQ ID NO: 5466 - protein, 11 aa, Borrelia burgdorferi B31
GQSIMNGIIKV

SEQ ID NO: 5467 - protein, 11 aa, Borrelia burgdorferi B31
QSIMNGIIKVP

SEQ ID NO: 5468 - protein, 11 aa, Borrelia burgdorferi B31
SIMNGIIKVPY

SEQ ID NO: 5469 - protein, 11 aa, Borrelia burgdorferi B31
IMNGIIKVPYD

SEQ ID NO: 5470 - protein, 11 aa, Borrelia burgdorferi B31
MNGIIKVPYDK

SEQ ID NO: 5471 - protein, 11 aa, Borrelia burgdorferi B31
NGIIKVPYDKV

SEQ ID NO: 5472 - protein, 11 aa, Borrelia burgdorferi B31
GIIKVPYDKVS

SEQ ID NO: 5473 - protein, 11 aa, Borrelia burgdorferi B31
IIKVPYDKVSY

SEQ ID NO: 5474 - protein, 11 aa, Borrelia burgdorferi B31
IKVPYDKVSYF

SEQ ID NO: 5475 - protein, 11 aa, Borrelia burgdorferi B31
KVPYDKVSYFV

SEQ ID NO: 5476 - protein, 11 aa, Borrelia burgdorferi B31
VPYDKVSYFVL

SEQ ID NO: 5477 - protein, 11 aa, Borrelia burgdorferi B31
PYDKVSYFVLQ

SEQ ID NO: 5478 - protein, 11 aa, Borrelia burgdorferi B31
YDKVSYFVLQM

SEQ ID NO: 5479 - protein, 11 aa, Borrelia burgdorferi B31
DKVSYFVLQME

SEQ ID NO: 5480 - protein, 11 aa, Borrelia burgdorferi B31
KVSYFVLQMEN

SEQ ID NO: 5481 - protein, 8 aa, Borrelia afzelii
MIKYNKII

SEQ ID NO: 5482 - protein, 8 aa, Borrelia afzelii
IKYNKIIL

SEQ ID NO: 5483 - protein, 8 aa, Borrelia afzelii
KYNKIILT

SEQ ID NO: 5484 - protein, 8 aa, Borrelia afzelii
YNKIILTL

SEQ ID NO: 5485 - protein, 8 aa, Borrelia afzelii
NKIILTLT

SEQ ID NO: 5486 - protein, 8 aa, Borrelia afzelii
KIILTLTL

SEQ ID NO: 5487 - protein, 8 aa, Borrelia afzelii
IILTLTLL

SEQ ID NO: 5488 - protein, 8 aa, Borrelia afzelii
ILTLTLLA

SEQ ID NO: 5489 - protein, 8 aa, Borrelia afzelii
LTLTLLAS

SEQ ID NO: 5490 - protein, 8 aa, Borrelia afzelii
TLTLLASL

SEQ ID NO: 5491 - protein, 8 aa, Borrelia afzelii
LTLLASLL

SEQ ID NO: 5492 - protein, 8 aa, Borrelia afzelii
TLLASLLA

SEQ ID NO: 5493 - protein, 8 aa, Borrelia afzelii
LLASLLAA

SEQ ID NO: 5494 - protein, 8 aa, Borrelia afzelii
LASLLAAC

SEQ ID NO: 5495 - protein, 8 aa, Borrelia afzelii
ASLLAACS

SEQ ID NO: 5496 - protein, 8 aa, Borrelia afzelii
SLLAACSL

SEQ ID NO: 5497 - protein, 8 aa, Borrelia afzelii
LLAACSLT

SEQ ID NO: 5498 - protein, 8 aa, Borrelia afzelii
LAACSLTG

SEQ ID NO: 5499 - protein, 8 aa, Borrelia afzelii
AACSLTGK

SEQ ID NO: 5500 - protein, 8 aa, Borrelia afzelii
ACSLTGKA

SEQ ID NO: 5501 - protein, 8 aa, Borrelia afzelii
CSLTGKAR

SEQ ID NO: 5502 - protein, 8 aa, Borrelia afzelii
SLTGKARL

SEQ ID NO: 5503 - protein, 8 aa, Borrelia afzelii
LTGKARLE

SEQ ID NO: 5504 - protein, 8 aa, Borrelia afzelii
TGKARLES

SEQ ID NO: 5505 - protein, 8 aa, Borrelia afzelii
GKARLESS

SEQ ID NO: 5506 - protein, 8 aa, Borrelia afzelii
KARLESSV

SEQ ID NO: 5507 - protein, 8 aa, Borrelia afzelii
ARLESSVK

SEQ ID NO: 5508 - protein, 8 aa, Borrelia afzelii
RLESSVKD

SEQ ID NO: 5509 - protein, 8 aa, Borrelia afzelii
LESSVKDI

SEQ ID NO: 5510 - protein, 8 aa, Borrelia afzelii
ESSVKDIT

SEQ ID NO: 5511 - protein, 8 aa, Borrelia afzelii
SSVKDITN

SEQ ID NO: 5512 - protein, 8 aa, Borrelia afzelii
SVKDITNE

SEQ ID NO: 5513 - protein, 8 aa, Borrelia afzelii
VKDITNEI

SEQ ID NO: 5514 - protein, 8 aa, Borrelia afzelii
KDITNEIE

SEQ ID NO: 5515 - protein, 8 aa, Borrelia afzelii
DITNEIEK

SEQ ID NO: 5516 - protein, 8 aa, Borrelia afzelii
ITNEIEKA

SEQ ID NO: 5517 - protein, 8 aa, Borrelia afzelii
TNEIEKAI

SEQ ID NO: 5518 - protein, 8 aa, Borrelia afzelii
NEIEKAIK

SEQ ID NO: 5519 - protein, 8 aa, Borrelia afzelii
EIEKAIKE

SEQ ID NO: 5520 - protein, 8 aa, Borrelia afzelii
IEKAIKEA

SEQ ID NO: 5521 - protein, 8 aa, Borrelia afzelii
EKAIKEAE

SEQ ID NO: 5522 - protein, 8 aa, Borrelia afzelii
KAIKEAED

SEQ ID NO: 5523 - protein, 8 aa, Borrelia afzelii
AIKEAEDA

SEQ ID NO: 5524 - protein, 8 aa, Borrelia afzelii
IKEAEDAG

SEQ ID NO: 5525 - protein, 8 aa, Borrelia afzelii
KEAEDAGV

SEQ ID NO: 5526 - protein, 8 aa, Borrelia afzelii
EAEDAGVK

SEQ ID NO: 5527 - protein, 8 aa, Borrelia afzelii
AEDAGVKT

SEQ ID NO: 5528 - protein, 8 aa, Borrelia afzelii
EDAGVKTD

SEQ ID NO: 5529 - protein, 8 aa, Borrelia afzelii
DAGVKTDA

SEQ ID NO: 5530 - protein, 8 aa, Borrelia afzelii
AGVKTDAF

SEQ ID NO: 5531 - protein, 8 aa, Borrelia afzelii
GVKTDAFT

SEQ ID NO: 5532 - protein, 8 aa, Borrelia afzelii
VKTDAFTE

SEQ ID NO: 5533 - protein, 8 aa, Borrelia afzelii
KTDAFTET

SEQ ID NO: 5534 - protein, 8 aa, Borrelia afzelii
TDAFTETQ

SEQ ID NO: 5535 - protein, 8 aa, Borrelia afzelii
DAFTETQT

SEQ ID NO: 5536 - protein, 8 aa, Borrelia afzelii
AFTETQTG

SEQ ID NO: 5537 - protein, 8 aa, Borrelia afzelii
FTETQTGG

SEQ ID NO: 5538 - protein, 8 aa, Borrelia afzelii
TETQTGGK

SEQ ID NO: 5539 - protein, 8 aa, Borrelia afzelii
ETQTGGKV

SEQ ID NO: 5540 - protein, 8 aa, Borrelia afzelii
TQTGGKVG

SEQ ID NO: 5541 - protein, 8 aa, Borrelia afzelii
QTGGKVGG

SEQ ID NO: 5542 - protein, 8 aa, Borrelia afzelii
TGGKVGGS

SEQ ID NO: 5543 - protein, 8 aa, Borrelia afzelii
GGKVGGSQ

SEQ ID NO: 5544 - protein, 8 aa, Borrelia afzelii
GKVGGSQI

SEQ ID NO: 5545 - protein, 8 aa, Borrelia afzelii
KVGGSQIR

SEQ ID NO: 5546 - protein, 8 aa, Borrelia afzelii
VGGSQIRA

SEQ ID NO: 5547 - protein, 8 aa, Borrelia afzelii
GGSQIRAA

SEQ ID NO: 5548 - protein, 8 aa, Borrelia afzelii
GSQIRAAK

SEQ ID NO: 5549 - protein, 8 aa, Borrelia afzelii
SQIRAAKI

SEQ ID NO: 5550 - protein, 8 aa, Borrelia afzelii
QIRAAKIR

SEQ ID NO: 5551 - protein, 8 aa, Borrelia afzelii
IRAAKIRV

SEQ ID NO: 5552 - protein, 8 aa, Borrelia afzelii
RAAKIRVA

SEQ ID NO: 5553 - protein, 8 aa, Borrelia afzelii
AAKIRVAD

SEQ ID NO: 5554 - protein, 8 aa, Borrelia afzelii
AKIRVADL

SEQ ID NO: 5555 - protein, 8 aa, Borrelia afzelii
KIRVADLT

SEQ ID NO: 5556 - protein, 8 aa, Borrelia afzelii
IRVADLTI

SEQ ID NO: 5557 - protein, 8 aa, Borrelia afzelii
RVADLTIK

SEQ ID NO: 5558 - protein, 8 aa, Borrelia afzelii
VADLTIKF

SEQ ID NO: 5559 - protein, 8 aa, Borrelia afzelii
ADLTIKFL

SEQ ID NO: 5560 - protein, 8 aa, Borrelia afzelii
DLTIKFLE

SEQ ID NO: 5561 - protein, 8 aa, Borrelia afzelii
LTIKFLEA

SEQ ID NO: 5562 - protein, 8 aa, Borrelia afzelii
TIKFLEAT

SEQ ID NO: 5563 - protein, 8 aa, Borrelia afzelii
IKFLEATE

SEQ ID NO: 5564 - protein, 8 aa, Borrelia afzelii
KFLEATEE

SEQ ID NO: 5565 - protein, 8 aa, Borrelia afzelii
FLEATEEE

SEQ ID NO: 5566 - protein, 8 aa, Borrelia afzelii
LEATEEET

SEQ ID NO: 5567 - protein, 8 aa, Borrelia afzelii
EATEEETI

SEQ ID NO: 5568 - protein, 8 aa, Borrelia afzelii
ATEEETIT

SEQ ID NO: 5569 - protein, 8 aa, Borrelia afzelii
TEEETITF

SEQ ID NO: 5570 - protein, 8 aa, Borrelia afzelii
EEETITFK

SEQ ID NO: 5571 - protein, 8 aa, Borrelia afzelii
EETITFKE

SEQ ID NO: 5572 - protein, 8 aa, Borrelia afzelii
ETITFKEN

SEQ ID NO: 5573 - protein, 8 aa, Borrelia afzelii
TITFKENG

SEQ ID NO: 5574 - protein, 8 aa, Borrelia afzelii
ITFKENGA

SEQ ID NO: 5575 - protein, 8 aa, Borrelia afzelii
TFKENGAG

SEQ ID NO: 5576 - protein, 8 aa, Borrelia afzelii
FKENGAGE

SEQ ID NO: 5577 - protein, 8 aa, Borrelia afzelii
KENGAGEE

SEQ ID NO: 5578 - protein, 8 aa, Borrelia afzelii
ENGAGEED

SEQ ID NO: 5579 - protein, 8 aa, Borrelia afzelii
NGAGEEDF

SEQ ID NO: 5580 - protein, 8 aa, Borrelia afzelii
GAGEEDFS

SEQ ID NO: 5581 - protein, 8 aa, Borrelia afzelii
AGEEDFSG

SEQ ID NO: 5582 - protein, 8 aa, Borrelia afzelii
GEEDFSGI

SEQ ID NO: 5583 - protein, 8 aa, Borrelia afzelii
EEDFSGIY

SEQ ID NO: 5584 - protein, 8 aa, Borrelia afzelii
EDFSGIYD

SEQ ID NO: 5585 - protein, 8 aa, Borrelia afzelii
DFSGIYDL

SEQ ID NO: 5586 - protein, 8 aa, Borrelia afzelii
FSGIYDLI

SEQ ID NO: 5587 - protein, 8 aa, Borrelia afzelii
SGIYDLIL

SEQ ID NO: 5588 - protein, 8 aa, Borrelia afzelii
GIYDLILN

SEQ ID NO: 5589 - protein, 8 aa, Borrelia afzelii
IYDLILNA

SEQ ID NO: 5590 - protein, 8 aa, Borrelia afzelii
YDLILNAA

SEQ ID NO: 5591 - protein, 8 aa, Borrelia afzelii
DLILNAAK

SEQ ID NO: 5592 - protein, 8 aa, Borrelia afzelii
LILNAAKA

SEQ ID NO: 5593 - protein, 8 aa, Borrelia afzelii
ILNAAKAV

SEQ ID NO: 5594 - protein, 8 aa, Borrelia afzelii
LNAAKAVE

SEQ ID NO: 5595 - protein, 8 aa, Borrelia afzelii
NAAKAVEK

SEQ ID NO: 5596 - protein, 8 aa, Borrelia afzelii
AAKAVEKI

SEQ ID NO: 5597 - protein, 8 aa, Borrelia afzelii
AKAVEKIG

SEQ ID NO: 5598 - protein, 8 aa, Borrelia afzelii
KAVEKIGM

SEQ ID NO: 5599 - protein, 8 aa, Borrelia afzelii
AVEKIGMQ

SEQ ID NO: 5600 - protein, 8 aa, Borrelia afzelii
VEKIGMQG

SEQ ID NO: 5601 - protein, 8 aa, Borrelia afzelii
EKIGMQGM

SEQ ID NO: 5602 - protein, 8 aa, Borrelia afzelii
KIGMQGMK

SEQ ID NO: 5603 - protein, 8 aa, Borrelia afzelii
IGMQGMKQ

SEQ ID NO: 5604 - protein, 8 aa, Borrelia afzelii
GMQGMKQA

SEQ ID NO: 5605 - protein, 8 aa, Borrelia afzelii
MQGMKQAV

SEQ ID NO: 5606 - protein, 8 aa, Borrelia afzelii
QGMKQAVE

SEQ ID NO: 5607 - protein, 8 aa, Borrelia afzelii
GMKQAVEE

SEQ ID NO: 5608 - protein, 8 aa, Borrelia afzelii
MKQAVEEA

SEQ ID NO: 5609 - protein, 8 aa, Borrelia afzelii
KQAVEEAA

SEQ ID NO: 5610 - protein, 8 aa, Borrelia afzelii
QAVEEAAK

SEQ ID NO: 5611 - protein, 8 aa, Borrelia afzelii
AVEEAAKE

SEQ ID NO: 5612 - protein, 8 aa, Borrelia afzelii
VEEAAKEK

SEQ ID NO: 5613 - protein, 8 aa, Borrelia afzelii
EEAAKEKP

SEQ ID NO: 5614 - protein, 8 aa, Borrelia afzelii
EAAKEKPK

SEQ ID NO: 5615 - protein, 8 aa, Borrelia afzelii
AAKEKPKT

SEQ ID NO: 5616 - protein, 8 aa, Borrelia afzelii
AKEKPKTT

SEQ ID NO: 5617 - protein, 8 aa, Borrelia afzelii
KEKPKTTA

SEQ ID NO: 5618 - protein, 8 aa, Borrelia afzelii
EKPKTTAD

SEQ ID NO: 5619 - protein, 8 aa, Borrelia afzelii
KPKTTADG

SEQ ID NO: 5620 - protein, 8 aa, Borrelia afzelii
PKTTADGI

SEQ ID NO: 5621 - protein, 8 aa, Borrelia afzelii
KTTADGII

SEQ ID NO: 5622 - protein, 8 aa, Borrelia afzelii
TTADGIIA

SEQ ID NO: 5623 - protein, 8 aa, Borrelia afzelii
TADGIIAI

SEQ ID NO: 5624 - protein, 8 aa, Borrelia afzelii
ADGIIAIV

SEQ ID NO: 5625 - protein, 8 aa, Borrelia afzelii
DGIIAIVK

SEQ ID NO: 5626 - protein, 8 aa, Borrelia afzelii
GIIAIVKV

SEQ ID NO: 5627 - protein, 8 aa, Borrelia afzelii
IIAIVKVM

SEQ ID NO: 5628 - protein, 8 aa, Borrelia afzelii
IAIVKVMK

SEQ ID NO: 5629 - protein, 8 aa, Borrelia afzelii
AIVKVMKA

SEQ ID NO: 5630 - protein, 8 aa, Borrelia afzelii
IVKVMKAK

SEQ ID NO: 5631 - protein, 8 aa, Borrelia afzelii
VKVMKAKV

SEQ ID NO: 5632 - protein, 8 aa, Borrelia afzelii
KVMKAKVE

SEQ ID NO: 5633 - protein, 8 aa, Borrelia afzelii
VMKAKVEN

SEQ ID NO: 5634 - protein, 8 aa, Borrelia afzelii
MKAKVENI

SEQ ID NO: 5635 - protein, 8 aa, Borrelia afzelii
KAKVENIK

SEQ ID NO: 5636 - protein, 8 aa, Borrelia afzelii
AKVENIKE

SEQ ID NO: 5637 - protein, 8 aa, Borrelia afzelii
KVENIKEK

SEQ ID NO: 5638 - protein, 8 aa, Borrelia afzelii
VENIKEKQ

SEQ ID NO: 5639 - protein, 8 aa, Borrelia afzelii
ENIKEKQT

SEQ ID NO: 5640 - protein, 8 aa, Borrelia afzelii
NIKEKQTK

SEQ ID NO: 5641 - protein, 8 aa, Borrelia afzelii
IKEKQTKN

SEQ ID NO: 5642 - protein, 8 aa, Borrelia afzelii
KEKQTKNQ

SEQ ID NO: 5643 - protein, 8 aa, Borrelia afzelii
EKQTKNQK

SEQ ID NO: 5644 - protein, 9 aa, Borrelia afzelii
MIKYNKIIL

SEQ ID NO: 5645 - protein, 9 aa, Borrelia afzelii
IKYNKIILT

SEQ ID NO: 5646 - protein, 9 aa, Borrelia afzelii
KYNKIILTL

SEQ ID NO: 5647 - protein, 9 aa, Borrelia afzelii
YNKIILTLT

SEQ ID NO: 5648 - protein, 9 aa, Borrelia afzelii
NKIILTLTL

SEQ ID NO: 5649 - protein, 9 aa, Borrelia afzelii
KIILTLTLL

SEQ ID NO: 5650 - protein, 9 aa, Borrelia afzelii
IILTLTLLA

SEQ ID NO: 5651 - protein, 9 aa, Borrelia afzelii
ILTLTLLAS

SEQ ID NO: 5652 - protein, 9 aa, Borrelia afzelii
LTLTLLASL

SEQ ID NO: 5653 - protein, 9 aa, Borrelia afzelii
TLTLLASLL

SEQ ID NO: 5654 - protein, 9 aa, Borrelia afzelii
LTLLASLLA

SEQ ID NO: 5655 - protein, 9 aa, Borrelia afzelii
TLLASLLAA

SEQ ID NO: 5656 - protein, 9 aa, Borrelia afzelii
LLASLLAAC

SEQ ID NO: 5657 - protein, 9 aa, Borrelia afzelii
LASLLAACS

SEQ ID NO: 5658 - protein, 9 aa, Borrelia afzelii
ASLLAACSL

SEQ ID NO: 5659 - protein, 9 aa, Borrelia afzelii
SLLAACSLT

SEQ ID NO: 5660 - protein, 9 aa, Borrelia afzelii
LLAACSLTG

SEQ ID NO: 5661 - protein, 9 aa, Borrelia afzelii
LAACSLTGK

SEQ ID NO: 5662 - protein, 9 aa, Borrelia afzelii
AACSLTGKA

SEQ ID NO: 5663 - protein, 9 aa, Borrelia afzelii
ACSLTGKAR

SEQ ID NO: 5664 - protein, 9 aa, Borrelia afzelii
CSLTGKARL

SEQ ID NO: 5665 - protein, 9 aa, Borrelia afzelii
SLTGKARLE

SEQ ID NO: 5666 - protein, 9 aa, Borrelia afzelii
LTGKARLES

SEQ ID NO: 5667 - protein, 9 aa, Borrelia afzelii
TGKARLESS

SEQ ID NO: 5668 - protein, 9 aa, Borrelia afzelii
GKARLESSV

SEQ ID NO: 5669 - protein, 9 aa, Borrelia afzelii
KARLESSVK

SEQ ID NO: 5670 - protein, 9 aa, Borrelia afzelii
ARLESSVKD

SEQ ID NO: 5671 - protein, 9 aa, Borrelia afzelii
RLESSVKDI

SEQ ID NO: 5672 - protein, 9 aa, Borrelia afzelii
LESSVKDIT

SEQ ID NO: 5673 - protein, 9 aa, Borrelia afzelii
ESSVKDITN

SEQ ID NO: 5674 - protein, 9 aa, Borrelia afzelii
SSVKDITNE

SEQ ID NO: 5675 - protein, 9 aa, Borrelia afzelii
SVKDITNEI

SEQ ID NO: 5676 - protein, 9 aa, Borrelia afzelii
VKDITNEIE

SEQ ID NO: 5677 - protein, 9 aa, Borrelia afzelii
KDITNEIEK

SEQ ID NO: 5678 - protein, 9 aa, Borrelia afzelii
DITNEIEKA

SEQ ID NO: 5679 - protein, 9 aa, Borrelia afzelii
ITNEIEKAI

SEQ ID NO: 5680 - protein, 9 aa, Borrelia afzelii
TNEIEKAIK

SEQ ID NO: 5681 - protein, 9 aa, Borrelia afzelii
NEIEKAIKE

SEQ ID NO: 5682 - protein, 9 aa, Borrelia afzelii
EIEKAIKEA

SEQ ID NO: 5683 - protein, 9 aa, Borrelia afzelii
IEKAIKEAE

SEQ ID NO: 5684 - protein, 9 aa, Borrelia afzelii
EKAIKEAED

SEQ ID NO: 5685 - protein, 9 aa, Borrelia afzelii
KAIKEAEDA

SEQ ID NO: 5686 - protein, 9 aa, Borrelia afzelii
AIKEAEDAG

SEQ ID NO: 5687 - protein, 9 aa, Borrelia afzelii
IKEAEDAGV

SEQ ID NO: 5688 - protein, 9 aa, Borrelia afzelii
KEAEDAGVK

SEQ ID NO: 5689 - protein, 9 aa, Borrelia afzelii
EAEDAGVKT

SEQ ID NO: 5690 - protein, 9 aa, Borrelia afzelii
AEDAGVKTD

SEQ ID NO: 5691 - protein, 9 aa, Borrelia afzelii
EDAGVKTDA

SEQ ID NO: 5692 - protein, 9 aa, Borrelia afzelii
DAGVKTDAF

SEQ ID NO: 5693 - protein, 9 aa, Borrelia afzelii
AGVKTDAFT

SEQ ID NO: 5694 - protein, 9 aa, Borrelia afzelii
GVKTDAFTE

SEQ ID NO: 5695 - protein, 9 aa, Borrelia afzelii
VKTDAFTET

SEQ ID NO: 5696 - protein, 9 aa, Borrelia afzelii
KTDAFTETQ

SEQ ID NO: 5697 - protein, 9 aa, Borrelia afzelii
TDAFTETQT

SEQ ID NO: 5698 - protein, 9 aa, Borrelia afzelii
DAFTETQTG

SEQ ID NO: 5699 - protein, 9 aa, Borrelia afzelii
AFTETQTGG

SEQ ID NO: 5700 - protein, 9 aa, Borrelia afzelii
FTETQTGGK

SEQ ID NO: 5701 - protein, 9 aa, Borrelia afzelii
TETQTGGKV

SEQ ID NO: 5702 - protein, 9 aa, Borrelia afzelii
ETQTGGKVG

SEQ ID NO: 5703 - protein, 9 aa, Borrelia afzelii
TQTGGKVGG

SEQ ID NO: 5704 - protein, 9 aa, Borrelia afzelii
QTGGKVGGS

SEQ ID NO: 5705 - protein, 9 aa, Borrelia afzelii
TGGKVGGSQ

SEQ ID NO: 5706 - protein, 9 aa, Borrelia afzelii
GGKVGGSQI

SEQ ID NO: 5707 - protein, 9 aa, Borrelia afzelii
GKVGGSQIR

SEQ ID NO: 5708 - protein, 9 aa, Borrelia afzelii
KVGGSQIRA

SEQ ID NO: 5709 - protein, 9 aa, Borrelia afzelii
VGGSQIRAA

SEQ ID NO: 5710 - protein, 9 aa, Borrelia afzelii
GGSQIRAAK

SEQ ID NO: 5711 - protein, 9 aa, Borrelia afzelii
GSQIRAAKI

SEQ ID NO: 5712 - protein, 9 aa, Borrelia afzelii
SQIRAAKIR

SEQ ID NO: 5713 - protein, 9 aa, Borrelia afzelii
QIRAAKIRV

SEQ ID NO: 5714 - protein, 9 aa, Borrelia afzelii
IRAAKIRVA

SEQ ID NO: 5715 - protein, 9 aa, Borrelia afzelii
RAAKIRVAD

SEQ ID NO: 5716 - protein, 9 aa, Borrelia afzelii
AAKIRVADL

SEQ ID NO: 5717 - protein, 9 aa, Borrelia afzelii
AKIRVADLT

SEQ ID NO: 5718 - protein, 9 aa, Borrelia afzelii
KIRVADLTI

SEQ ID NO: 5719 - protein, 9 aa, Borrelia afzelii
IRVADLTIK

SEQ ID NO: 5720 - protein, 9 aa, Borrelia afzelii
RVADLTIKF

SEQ ID NO: 5721 - protein, 9 aa, Borrelia afzelii
VADLTIKFL

SEQ ID NO: 5722 - protein, 9 aa, Borrelia afzelii
ADLTIKFLE

SEQ ID NO: 5723 - protein, 9 aa, Borrelia afzelii
DLTIKFLEA

SEQ ID NO: 5724 - protein, 9 aa, Borrelia afzelii
LTIKFLEAT

SEQ ID NO: 5725 - protein, 9 aa, Borrelia afzelii
TIKFLEATE

SEQ ID NO: 5726 - protein, 9 aa, Borrelia afzelii
IKFLEATEE

SEQ ID NO: 5727 - protein, 9 aa, Borrelia afzelii
KFLEATEEE

SEQ ID NO: 5728 - protein, 9 aa, Borrelia afzelii
FLEATEEET

SEQ ID NO: 5729 - protein, 9 aa, Borrelia afzelii
LEATEEETI

SEQ ID NO: 5730 - protein, 9 aa, Borrelia afzelii
EATEEETIT

SEQ ID NO: 5731 - protein, 9 aa, Borrelia afzelii
ATEEETITF

SEQ ID NO: 5732 - protein, 9 aa, Borrelia afzelii
TEEETITFK

SEQ ID NO: 5733 - protein, 9 aa, Borrelia afzelii
EEETITFKE

SEQ ID NO: 5734 - protein, 9 aa, Borrelia afzelii
EETITFKEN

SEQ ID NO: 5735 - protein, 9 aa, Borrelia afzelii
ETITFKENG

SEQ ID NO: 5736 - protein, 9 aa, Borrelia afzelii
TITFKENGA

SEQ ID NO: 5737 - protein, 9 aa, Borrelia afzelii
ITFKENGAG

SEQ ID NO: 5738 - protein, 9 aa, Borrelia afzelii
TFKENGAGE

SEQ ID NO: 5739 - protein, 9 aa, Borrelia afzelii
FKENGAGEE

SEQ ID NO: 5740 - protein, 9 aa, Borrelia afzelii
KENGAGEED

SEQ ID NO: 5741 - protein, 9 aa, Borrelia afzelii
ENGAGEEDF

SEQ ID NO: 5742 - protein, 9 aa, Borrelia afzelii
NGAGEEDFS

SEQ ID NO: 5743 - protein, 9 aa, Borrelia afzelii
GAGEEDFSG

SEQ ID NO: 5744 - protein, 9 aa, Borrelia afzelii
AGEEDFSGI

SEQ ID NO: 5745 - protein, 9 aa, Borrelia afzelii
GEEDFSGIY

SEQ ID NO: 5746 - protein, 9 aa, Borrelia afzelii
EEDFSGIYD

SEQ ID NO: 5747 - protein, 9 aa, Borrelia afzelii
EDFSGIYDL

SEQ ID NO: 5748 - protein, 9 aa, Borrelia afzelii
DFSGIYDLI

SEQ ID NO: 5749 - protein, 9 aa, Borrelia afzelii
FSGIYDLIL

SEQ ID NO: 5750 - protein, 9 aa, Borrelia afzelii
SGIYDLILN

SEQ ID NO: 5751 - protein, 9 aa, Borrelia afzelii
GIYDLILNA

SEQ ID NO: 5752 - protein, 9 aa, Borrelia afzelii
IYDLILNAA

SEQ ID NO: 5753 - protein, 9 aa, Borrelia afzelii
YDLILNAAK

SEQ ID NO: 5754 - protein, 9 aa, Borrelia afzelii
DLILNAAKA

SEQ ID NO: 5755 - protein, 9 aa, Borrelia afzelii
LILNAAKAV

SEQ ID NO: 5756 - protein, 9 aa, Borrelia afzelii
ILNAAKAVE

SEQ ID NO: 5757 - protein, 9 aa, Borrelia afzelii
LNAAKAVEK

SEQ ID NO: 5758 - protein, 9 aa, Borrelia afzelii
NAAKAVEKI

SEQ ID NO: 5759 - protein, 9 aa, Borrelia afzelii
AAKAVEKIG

SEQ ID NO: 5760 - protein, 9 aa, Borrelia afzelii
AKAVEKIGM

SEQ ID NO: 5761 - protein, 9 aa, Borrelia afzelii
KAVEKIGMQ

SEQ ID NO: 5762 - protein, 9 aa, Borrelia afzelii
AVEKIGMQG

SEQ ID NO: 5763 - protein, 9 aa, Borrelia afzelii
VEKIGMQGM

SEQ ID NO: 5764 - protein, 9 aa, Borrelia afzelii
EKIGMQGMK

SEQ ID NO: 5765 - protein, 9 aa, Borrelia afzelii
KIGMQGMKQ

SEQ ID NO: 5766 - protein, 9 aa, Borrelia afzelii
IGMQGMKQA

SEQ ID NO: 5767 - protein, 9 aa, Borrelia afzelii
GMQGMKQAV

SEQ ID NO: 5768 - protein, 9 aa, Borrelia afzelii
MQGMKQAVE

SEQ ID NO: 5769 - protein, 9 aa, Borrelia afzelii
QGMKQAVEE

SEQ ID NO: 5770 - protein, 9 aa, Borrelia afzelii
GMKQAVEEA

SEQ ID NO: 5771 - protein, 9 aa, Borrelia afzelii
MKQAVEEAA

SEQ ID NO: 5772 - protein, 9 aa, Borrelia afzelii
KQAVEEAAK

SEQ ID NO: 5773 - protein, 9 aa, Borrelia afzelii
QAVEEAAKE

SEQ ID NO: 5774 - protein, 9 aa, Borrelia afzelii
AVEEAAKEK

SEQ ID NO: 5775 - protein, 9 aa, Borrelia afzelii
VEEAAKEKP

SEQ ID NO: 5776 - protein, 9 aa, Borrelia afzelii
EEAAKEKPK

SEQ ID NO: 5777 - protein, 9 aa, Borrelia afzelii
EAAKEKPKT

SEQ ID NO: 5778 - protein, 9 aa, Borrelia afzelii
AAKEKPKTT

SEQ ID NO: 5779 - protein, 9 aa, Borrelia afzelii
AKEKPKTTA

SEQ ID NO: 5780 - protein, 9 aa, Borrelia afzelii
KEKPKTTAD

SEQ ID NO: 5781 - protein, 9 aa, Borrelia afzelii
EKPKTTADG

SEQ ID NO: 5782 - protein, 9 aa, Borrelia afzelii
KPKTTADGI

SEQ ID NO: 5783 - protein, 9 aa, Borrelia afzelii
PKTTADGII

SEQ ID NO: 5784 - protein, 9 aa, Borrelia afzelii
KTTADGIIA

SEQ ID NO: 5785 - protein, 9 aa, Borrelia afzelii
TTADGIIAI

SEQ ID NO: 5786 - protein, 9 aa, Borrelia afzelii
TADGIIAIV

SEQ ID NO: 5787 - protein, 9 aa, Borrelia afzelii
ADGIIAIVK

SEQ ID NO: 5788 - protein, 9 aa, Borrelia afzelii
DGIIAIVKV

SEQ ID NO: 5789 - protein, 9 aa, Borrelia afzelii
GIIAIVKVM

SEQ ID NO: 5790 - protein, 9 aa, Borrelia afzelii
IIAIVKVMK

SEQ ID NO: 5791 - protein, 9 aa, Borrelia afzelii
IAIVKVMKA

SEQ ID NO: 5792 - protein, 9 aa, Borrelia afzelii
AIVKVMKAK

SEQ ID NO: 5793 - protein, 9 aa, Borrelia afzelii
IVKVMKAKV

SEQ ID NO: 5794 - protein, 9 aa, Borrelia afzelii
VKVMKAKVE

SEQ ID NO: 5795 - protein, 9 aa, Borrelia afzelii
KVMKAKVEN

SEQ ID NO: 5796 - protein, 9 aa, Borrelia afzelii
VMKAKVENI

SEQ ID NO: 5797 - protein, 9 aa, Borrelia afzelii
MKAKVENIK

SEQ ID NO: 5798 - protein, 9 aa, Borrelia afzelii
KAKVENIKE

SEQ ID NO: 5799 - protein, 9 aa, Borrelia afzelii
AKVENIKEK

SEQ ID NO: 5800 - protein, 9 aa, Borrelia afzelii
KVENIKEKQ

SEQ ID NO: 5801 - protein, 9 aa, Borrelia afzelii
VENIKEKQT

SEQ ID NO: 5802 - protein, 9 aa, Borrelia afzelii
ENIKEKQTK

SEQ ID NO: 5803 - protein, 9 aa, Borrelia afzelii
NIKEKQTKN

SEQ ID NO: 5804 - protein, 9 aa, Borrelia afzelii
IKEKQTKNQ

SEQ ID NO: 5805 - protein, 9 aa, Borrelia afzelii
KEKQTKNQK

SEQ ID NO: 5806 - protein, 10 aa, Borrelia afzelii
MIKYNKIILT

SEQ ID NO: 5807 - protein, 10 aa, Borrelia afzelii
IKYNKIILTL

SEQ ID NO: 5808 - protein, 10 aa, Borrelia afzelii
KYNKIILTLT

SEQ ID NO: 5809 - protein, 10 aa, Borrelia afzelii
YNKIILTLTL

SEQ ID NO: 5810 - protein, 10 aa, Borrelia afzelii
NKIILTLTLL

SEQ ID NO: 5811 - protein, 10 aa, Borrelia afzelii
KIILTLTLLA

SEQ ID NO: 5812 - protein, 10 aa, Borrelia afzelii
IILTLTLLAS

SEQ ID NO: 5813 - protein, 10 aa, Borrelia afzelii
ILTLTLLASL

SEQ ID NO: 5814 - protein, 10 aa, Borrelia afzelii
LTLTLLASLL

SEQ ID NO: 5815 - protein, 10 aa, Borrelia afzelii
TLTLLASLLA

SEQ ID NO: 5816 - protein, 10 aa, Borrelia afzelii
LTLLASLLAA

SEQ ID NO: 5817 - protein, 10 aa, Borrelia afzelii
TLLASLLAAC

SEQ ID NO: 5818 - protein, 10 aa, Borrelia afzelii
LLASLLAACS

SEQ ID NO: 5819 - protein, 10 aa, Borrelia afzelii
LASLLAACSL

SEQ ID NO: 5820 - protein, 10 aa, Borrelia afzelii
ASLLAACSLT

SEQ ID NO: 5821 - protein, 10 aa, Borrelia afzelii
SLLAACSLTG

SEQ ID NO: 5822 - protein, 10 aa, Borrelia afzelii
LLAACSLTGK

SEQ ID NO: 5823 - protein, 10 aa, Borrelia afzelii
LAACSLTGKA

SEQ ID NO: 5824 - protein, 10 aa, Borrelia afzelii
AACSLTGKAR

SEQ ID NO: 5825 - protein, 10 aa, Borrelia afzelii
ACSLTGKARL

SEQ ID NO: 5826 - protein, 10 aa, Borrelia afzelii
CSLTGKARLE

SEQ ID NO: 5827 - protein, 10 aa, Borrelia afzelii
SLTGKARLES

SEQ ID NO: 5828 - protein, 10 aa, Borrelia afzelii
LTGKARLESS

SEQ ID NO: 5829 - protein, 10 aa, Borrelia afzelii
TGKARLESSV

SEQ ID NO: 5830 - protein, 10 aa, Borrelia afzelii
GKARLESSVK

SEQ ID NO: 5831 - protein, 10 aa, Borrelia afzelii
KARLESSVKD

SEQ ID NO: 5832 - protein, 10 aa, Borrelia afzelii
ARLESSVKDI

SEQ ID NO: 5833 - protein, 10 aa, Borrelia afzelii
RLESSVKDIT

SEQ ID NO: 5834 - protein, 10 aa, Borrelia afzelii
LESSVKDITN

SEQ ID NO: 5835 - protein, 10 aa, Borrelia afzelii
ESSVKDITNE

SEQ ID NO: 5836 - protein, 10 aa, Borrelia afzelii
SSVKDITNEI

SEQ ID NO: 5837 - protein, 10 aa, Borrelia afzelii
SVKDITNEIE

SEQ ID NO: 5838 - protein, 10 aa, Borrelia afzelii
VKDITNEIEK

SEQ ID NO: 5839 - protein, 10 aa, Borrelia afzelii
KDITNEIEKA

SEQ ID NO: 5840 - protein, 10 aa, Borrelia afzelii
DITNEIEKAI

SEQ ID NO: 5841 - protein, 10 aa, Borrelia afzelii
ITNEIEKAIK

SEQ ID NO: 5842 - protein, 10 aa, Borrelia afzelii
TNEIEKAIKE

SEQ ID NO: 5843 - protein, 10 aa, Borrelia afzelii
NEIEKAIKEA

SEQ ID NO: 5844 - protein, 10 aa, Borrelia afzelii
EIEKAIKEAE

SEQ ID NO: 5845 - protein, 10 aa, Borrelia afzelii
IEKAIKEAED

SEQ ID NO: 5846 - protein, 10 aa, Borrelia afzelii
EKAIKEAEDA

SEQ ID NO: 5847 - protein, 10 aa, Borrelia afzelii
KAIKEAEDAG

SEQ ID NO: 5848 - protein, 10 aa, Borrelia afzelii
AIKEAEDAGV

SEQ ID NO: 5849 - protein, 10 aa, Borrelia afzelii
IKEAEDAGVK

SEQ ID NO: 5850 - protein, 10 aa, Borrelia afzelii
KEAEDAGVKT

SEQ ID NO: 5851 - protein, 10 aa, Borrelia afzelii
EAEDAGVKTD

SEQ ID NO: 5852 - protein, 10 aa, Borrelia afzelii
AEDAGVKTDA

SEQ ID NO: 5853 - protein, 10 aa, Borrelia afzelii
EDAGVKTDAF

SEQ ID NO: 5854 - protein, 10 aa, Borrelia afzelii
DAGVKTDAFT

SEQ ID NO: 5855 - protein, 10 aa, Borrelia afzelii
AGVKTDAFTE

SEQ ID NO: 5856 - protein, 10 aa, Borrelia afzelii
GVKTDAFTET

SEQ ID NO: 5857 - protein, 10 aa, Borrelia afzelii
VKTDAFTETQ

SEQ ID NO: 5858 - protein, 10 aa, Borrelia afzelii
KTDAFTETQT

SEQ ID NO: 5859 - protein, 10 aa, Borrelia afzelii
TDAFTETQTG

SEQ ID NO: 5860 - protein, 10 aa, Borrelia afzelii
DAFTETQTGG

SEQ ID NO: 5861 - protein, 10 aa, Borrelia afzelii
AFTETQTGGK

SEQ ID NO: 5862 - protein, 10 aa, Borrelia afzelii
FTETQTGGKV

SEQ ID NO: 5863 - protein, 10 aa, Borrelia afzelii
TETQTGGKVG

SEQ ID NO: 5864 - protein, 10 aa, Borrelia afzelii
ETQTGGKVGG

SEQ ID NO: 5865 - protein, 10 aa, Borrelia afzelii
TQTGGKVGGS

SEQ ID NO: 5866 - protein, 10 aa, Borrelia afzelii
QTGGKVGGSQ

SEQ ID NO: 5867 - protein, 10 aa, Borrelia afzelii
TGGKVGGSQI

SEQ ID NO: 5868 - protein, 10 aa, Borrelia afzelii
GGKVGGSQIR

SEQ ID NO: 5869 - protein, 10 aa, Borrelia afzelii
GKVGGSQIRA

SEQ ID NO: 5870 - protein, 10 aa, Borrelia afzelii
KVGGSQIRAA

SEQ ID NO: 5871 - protein, 10 aa, Borrelia afzelii
VGGSQIRAAK

SEQ ID NO: 5872 - protein, 10 aa, Borrelia afzelii
GGSQIRAAKI

SEQ ID NO: 5873 - protein, 10 aa, Borrelia afzelii
GSQIRAAKIR

SEQ ID NO: 5874 - protein, 10 aa, Borrelia afzelii
SQIRAAKIRV

SEQ ID NO: 5875 - protein, 10 aa, Borrelia afzelii
QIRAAKIRVA

SEQ ID NO: 5876 - protein, 10 aa, Borrelia afzelii
IRAAKIRVAD

SEQ ID NO: 5877 - protein, 10 aa, Borrelia afzelii
RAAKIRVADL

SEQ ID NO: 5878 - protein, 10 aa, Borrelia afzelii
AAKIRVADLT

SEQ ID NO: 5879 - protein, 10 aa, Borrelia afzelii
AKIRVADLTI

SEQ ID NO: 5880 - protein, 10 aa, Borrelia afzelii
KIRVADLTIK

SEQ ID NO: 5881 - protein, 10 aa, Borrelia afzelii
IRVADLTIKF

SEQ ID NO: 5882 - protein, 10 aa, Borrelia afzelii
RVADLTIKFL

SEQ ID NO: 5883 - protein, 10 aa, Borrelia afzelii
VADLTIKFLE

SEQ ID NO: 5884 - protein, 10 aa, Borrelia afzelii
ADLTIKFLEA

SEQ ID NO: 5885 - protein, 10 aa, Borrelia afzelii
DLTIKFLEAT

SEQ ID NO: 5886 - protein, 10 aa, Borrelia afzelii
LTIKFLEATE

SEQ ID NO: 5887 - protein, 10 aa, Borrelia afzelii
TIKFLEATEE

SEQ ID NO: 5888 - protein, 10 aa, Borrelia afzelii
IKFLEATEEE

SEQ ID NO: 5889 - protein, 10 aa, Borrelia afzelii
KFLEATEEET

SEQ ID NO: 5890 - protein, 10 aa, Borrelia afzelii
FLEATEEETI

SEQ ID NO: 5891 - protein, 10 aa, Borrelia afzelii
LEATEEETIT

SEQ ID NO: 5892 - protein, 10 aa, Borrelia afzelii
EATEEETITF

SEQ ID NO: 5893 - protein, 10 aa, Borrelia afzelii
ATEEETITFK

SEQ ID NO: 5894 - protein, 10 aa, Borrelia afzelii
TEEETITFKE

SEQ ID NO: 5895 - protein, 10 aa, Borrelia afzelii
EEETITFKEN

SEQ ID NO: 5896 - protein, 10 aa, Borrelia afzelii
EETITFKENG

SEQ ID NO: 5897 - protein, 10 aa, Borrelia afzelii
ETITFKENGA

SEQ ID NO: 5898 - protein, 10 aa, Borrelia afzelii
TITFKENGAG

SEQ ID NO: 5899 - protein, 10 aa, Borrelia afzelii
ITFKENGAGE

SEQ ID NO: 5900 - protein, 10 aa, Borrelia afzelii
TFKENGAGEE

SEQ ID NO: 5901 - protein, 10 aa, Borrelia afzelii
FKENGAGEED

SEQ ID NO: 5902 - protein, 10 aa, Borrelia afzelii
KENGAGEEDF

SEQ ID NO: 5903 - protein, 10 aa, Borrelia afzelii
ENGAGEEDFS

SEQ ID NO: 5904 - protein, 10 aa, Borrelia afzelii
NGAGEEDFSG

SEQ ID NO: 5905 - protein, 10 aa, Borrelia afzelii
GAGEEDFSGI

SEQ ID NO: 5906 - protein, 10 aa, Borrelia afzelii
AGEEDFSGIY

SEQ ID NO: 5907 - protein, 10 aa, Borrelia afzelii
GEEDFSGIYD

SEQ ID NO: 5908 - protein, 10 aa, Borrelia afzelii
EEDFSGIYDL

SEQ ID NO: 5909 - protein, 10 aa, Borrelia afzelii
EDFSGIYDLI

SEQ ID NO: 5910 - protein, 10 aa, Borrelia afzelii
DFSGIYDLIL

SEQ ID NO: 5911 - protein, 10 aa, Borrelia afzelii
FSGIYDLILN

SEQ ID NO: 5912 - protein, 10 aa, Borrelia afzelii
SGIYDLILNA

SEQ ID NO: 5913 - protein, 10 aa, Borrelia afzelii
GIYDLILNAA

SEQ ID NO: 5914 - protein, 10 aa, Borrelia afzelii
IYDLILNAAK

SEQ ID NO: 5915 - protein, 10 aa, Borrelia afzelii
YDLILNAAKA

SEQ ID NO: 5916 - protein, 10 aa, Borrelia afzelii
DLILNAAKAV

SEQ ID NO: 5917 - protein, 10 aa, Borrelia afzelii
LILNAAKAVE

SEQ ID NO: 5918 - protein, 10 aa, Borrelia afzelii
ILNAAKAVEK

SEQ ID NO: 5919 - protein, 10 aa, Borrelia afzelii
LNAAKAVEKI

SEQ ID NO: 5920 - protein, 10 aa, Borrelia afzelii
NAAKAVEKIG

SEQ ID NO: 5921 - protein, 10 aa, Borrelia afzelii
AAKAVEKIGM

SEQ ID NO: 5922 - protein, 10 aa, Borrelia afzelii
AKAVEKIGMQ

SEQ ID NO: 5923 - protein, 10 aa, Borrelia afzelii
KAVEKIGMQG

SEQ ID NO: 5924 - protein, 10 aa, Borrelia afzelii
AVEKIGMQGM

SEQ ID NO: 5925 - protein, 10 aa, Borrelia afzelii
VEKIGMQGMK

SEQ ID NO: 5926 - protein, 10 aa, Borrelia afzelii
EKIGMQGMKQ

SEQ ID NO: 5927 - protein, 10 aa, Borrelia afzelii
KIGMQGMKQA

SEQ ID NO: 5928 - protein, 10 aa, Borrelia afzelii
IGMQGMKQAV

SEQ ID NO: 5929 - protein, 10 aa, Borrelia afzelii
GMQGMKQAVE

SEQ ID NO: 5930 - protein, 10 aa, Borrelia afzelii
MQGMKQAVEE

SEQ ID NO: 5931 - protein, 10 aa, Borrelia afzelii
QGMKQAVEEA

SEQ ID NO: 5932 - protein, 10 aa, Borrelia afzelii
GMKQAVEEAA

SEQ ID NO: 5933 - protein, 10 aa, Borrelia afzelii
MKQAVEEAAK

SEQ ID NO: 5934 - protein, 10 aa, Borrelia afzelii
KQAVEEAAKE

SEQ ID NO: 5935 - protein, 10 aa, Borrelia afzelii
QAVEEAAKEK

SEQ ID NO: 5936 - protein, 10 aa, Borrelia afzelii
AVEEAAKEKP

SEQ ID NO: 5937 - protein, 10 aa, Borrelia afzelii
VEEAAKEKPK

SEQ ID NO: 5938 - protein, 10 aa, Borrelia afzelii
EEAAKEKPKT

SEQ ID NO: 5939 - protein, 10 aa, Borrelia afzelii
EAAKEKPKTT

SEQ ID NO: 5940 - protein, 10 aa, Borrelia afzelii
AAKEKPKTTA

SEQ ID NO: 5941 - protein, 10 aa, Borrelia afzelii
AKEKPKTTAD

SEQ ID NO: 5942 - protein, 10 aa, Borrelia afzelii
KEKPKTTADG

SEQ ID NO: 5943 - protein, 10 aa, Borrelia afzelii
EKPKTTADGI

SEQ ID NO: 5944 - protein, 10 aa, Borrelia afzelii
KPKTTADGII

SEQ ID NO: 5945 - protein, 10 aa, Borrelia afzelii
PKTTADGIIA

SEQ ID NO: 5946 - protein, 10 aa, Borrelia afzelii
KTTADGIIAI

SEQ ID NO: 5947 - protein, 10 aa, Borrelia afzelii
TTADGIIAIV

SEQ ID NO: 5948 - protein, 10 aa, Borrelia afzelii
TADGIIAIVK

SEQ ID NO: 5949 - protein, 10 aa, Borrelia afzelii
ADGIIAIVKV

SEQ ID NO: 5950 - protein, 10 aa, Borrelia afzelii
DGIIAIVKVM

SEQ ID NO: 5951 - protein, 10 aa, Borrelia afzelii
GIIAIVKVMK

SEQ ID NO: 5952 - protein, 10 aa, Borrelia afzelii
IIAIVKVMKA

SEQ ID NO: 5953 - protein, 10 aa, Borrelia afzelii
IAIVKVMKAK

SEQ ID NO: 5954 - protein, 10 aa, Borrelia afzelii
AIVKVMKAKV

SEQ ID NO: 5955 - protein, 10 aa, Borrelia afzelii
IVKVMKAKVE

SEQ ID NO: 5956 - protein, 10 aa, Borrelia afzelii
VKVMKAKVEN

SEQ ID NO: 5957 - protein, 10 aa, Borrelia afzelii
KVMKAKVENI

SEQ ID NO: 5958 - protein, 10 aa, Borrelia afzelii
VMKAKVENIK

SEQ ID NO: 5959 - protein, 10 aa, Borrelia afzelii
MKAKVENIKE

SEQ ID NO: 5960 - protein, 10 aa, Borrelia afzelii
KAKVENIKEK

SEQ ID NO: 5961 - protein, 10 aa, Borrelia afzelii
AKVENIKEKQ

SEQ ID NO: 5962 - protein, 10 aa, Borrelia afzelii
KVENIKEKQT

SEQ ID NO: 5963 - protein, 10 aa, Borrelia afzelii
VENIKEKQTK

SEQ ID NO: 5964 - protein, 10 aa, Borrelia afzelii
ENIKEKQTKN

SEQ ID NO: 5965 - protein, 10 aa, Borrelia afzelii
NIKEKQTKNQ

SEQ ID NO: 5966 - protein, 10 aa, Borrelia afzelii
IKEKQTKNQK

SEQ ID NO: 5967 - protein, 11 aa, Borrelia afzelii
MIKYNKIILTL

SEQ ID NO: 5968 - protein, 11 aa, Borrelia afzelii
IKYNKIILTLT

SEQ ID NO: 5969 - protein, 11 aa, Borrelia afzelii
KYNKIILTLTL

SEQ ID NO: 5970 - protein, 11 aa, Borrelia afzelii
YNKIILTLTLL

SEQ ID NO: 5971 - protein, 11 aa, Borrelia afzelii
NKIILTLTLLA

SEQ ID NO: 5972 - protein, 11 aa, Borrelia afzelii
KIILTLTLLAS

SEQ ID NO: 5973 - protein, 11 aa, Borrelia afzelii
IILTLTLLASL

SEQ ID NO: 5974 - protein, 11 aa, Borrelia afzelii
ILTLTLLASLL

SEQ ID NO: 5975 - protein, 11 aa, Borrelia afzelii
LTLTLLASLLA

SEQ ID NO: 5976 - protein, 11 aa, Borrelia afzelii
TLTLLASLLAA

SEQ ID NO: 5977 - protein, 11 aa, Borrelia afzelii
LTLLASLLAAC

SEQ ID NO: 5978 - protein, 11 aa, Borrelia afzelii
TLLASLLAACS

SEQ ID NO: 5979 - protein, 11 aa, Borrelia afzelii
LLASLLAACSL

SEQ ID NO: 5980 - protein, 11 aa, Borrelia afzelii
LASLLAACSLT

SEQ ID NO: 5981 - protein, 11 aa, Borrelia afzelii
ASLLAACSLTG

SEQ ID NO: 5982 - protein, 11 aa, Borrelia afzelii
SLLAACSLTGK

SEQ ID NO: 5983 - protein, 11 aa, Borrelia afzelii
LLAACSLTGKA

SEQ ID NO: 5984 - protein, 11 aa, Borrelia afzelii
LAACSLTGKAR

SEQ ID NO: 5985 - protein, 11 aa, Borrelia afzelii
AACSLTGKARL

SEQ ID NO: 5986 - protein, 11 aa, Borrelia afzelii
ACSLTGKARLE

SEQ ID NO: 5987 - protein, 11 aa, Borrelia afzelii
CSLTGKARLES

SEQ ID NO: 5988 - protein, 11 aa, Borrelia afzelii
SLTGKARLESS

SEQ ID NO: 5989 - protein, 11 aa, Borrelia afzelii
LTGKARLESSV

SEQ ID NO: 5990 - protein, 11 aa, Borrelia afzelii
TGKARLESSVK

SEQ ID NO: 5991 - protein, 11 aa, Borrelia afzelii
GKARLESSVKD

SEQ ID NO: 5992 - protein, 11 aa, Borrelia afzelii
KARLESSVKDI

SEQ ID NO: 5993 - protein, 11 aa, Borrelia afzelii
ARLESSVKDIT

SEQ ID NO: 5994 - protein, 11 aa, Borrelia afzelii
RLESSVKDITN

SEQ ID NO: 5995 - protein, 11 aa, Borrelia afzelii
LESSVKDITNE

SEQ ID NO: 5996 - protein, 11 aa, Borrelia afzelii
ESSVKDITNEI

SEQ ID NO: 5997 - protein, 11 aa, Borrelia afzelii
SSVKDITNEIE

SEQ ID NO: 5998 - protein, 11 aa, Borrelia afzelii
SVKDITNEIEK

SEQ ID NO: 5999 - protein, 11 aa, Borrelia afzelii
VKDITNEIEKA

SEQ ID NO: 6000 - protein, 11 aa, Borrelia afzelii
KDITNEIEKAI

SEQ ID NO: 6001 - protein, 11 aa, Borrelia afzelii
DITNEIEKAIK

SEQ ID NO: 6002 - protein, 11 aa, Borrelia afzelii
ITNEIEKAIKE

SEQ ID NO: 6003 - protein, 11 aa, Borrelia afzelii
TNEIEKAIKEA

SEQ ID NO: 6004 - protein, 11 aa, Borrelia afzelii
NEIEKAIKEAE

SEQ ID NO: 6005 - protein, 11 aa, Borrelia afzelii
EIEKAIKEAED

SEQ ID NO: 6006 - protein, 11 aa, Borrelia afzelii
IEKAIKEAEDA

SEQ ID NO: 6007 - protein, 11 aa, Borrelia afzelii
EKAIKEAEDAG

SEQ ID NO: 6008 - protein, 11 aa, Borrelia afzelii
KAIKEAEDAGV

SEQ ID NO: 6009 - protein, 11 aa, Borrelia afzelii
AIKEAEDAGVK

SEQ ID NO: 6010 - protein, 11 aa, Borrelia afzelii
IKEAEDAGVKT

SEQ ID NO: 6011 - protein, 11 aa, Borrelia afzelii
KEAEDAGVKTD

SEQ ID NO: 6012 - protein, 11 aa, Borrelia afzelii
EAEDAGVKTDA

SEQ ID NO: 6013 - protein, 11 aa, Borrelia afzelii
AEDAGVKTDAF

SEQ ID NO: 6014 - protein, 11 aa, Borrelia afzelii
EDAGVKTDAFT

SEQ ID NO: 6015 - protein, 11 aa, Borrelia afzelii
DAGVKTDAFTE

SEQ ID NO: 6016 - protein, 11 aa, Borrelia afzelii
AGVKTDAFTET

SEQ ID NO: 6017 - protein, 11 aa, Borrelia afzelii
GVKTDAFTETQ

SEQ ID NO: 6018 - protein, 11 aa, Borrelia afzelii
VKTDAFTETQT

SEQ ID NO: 6019 - protein, 11 aa, Borrelia afzelii
KTDAFTETQTG

SEQ ID NO: 6020 - protein, 11 aa, Borrelia afzelii
TDAFTETQTGG

SEQ ID NO: 6021 - protein, 11 aa, Borrelia afzelii
DAFTETQTGGK

SEQ ID NO: 6022 - protein, 11 aa, Borrelia afzelii
AFTETQTGGKV

SEQ ID NO: 6023 - protein, 11 aa, Borrelia afzelii
FTETQTGGKVG

SEQ ID NO: 6024 - protein, 11 aa, Borrelia afzelii
TETQTGGKVGG

SEQ ID NO: 6025 - protein, 11 aa, Borrelia afzelii
ETQTGGKVGGS

SEQ ID NO: 6026 - protein, 11 aa, Borrelia afzelii
TQTGGKVGGSQ

SEQ ID NO: 6027 - protein, 11 aa, Borrelia afzelii
QTGGKVGGSQI

SEQ ID NO: 6028 - protein, 11 aa, Borrelia afzelii
TGGKVGGSQIR

SEQ ID NO: 6029 - protein, 11 aa, Borrelia afzelii
GGKVGGSQIRA

SEQ ID NO: 6030 - protein, 11 aa, Borrelia afzelii
GKVGGSQIRAA

SEQ ID NO: 6031 - protein, 11 aa, Borrelia afzelii
KVGGSQIRAAK

SEQ ID NO: 6032 - protein, 11 aa, Borrelia afzelii
VGGSQIRAAKI

SEQ ID NO: 6033 - protein, 11 aa, Borrelia afzelii
GGSQIRAAKIR

SEQ ID NO: 6034 - protein, 11 aa, Borrelia afzelii
GSQIRAAKIRV

SEQ ID NO: 6035 - protein, 11 aa, Borrelia afzelii
SQIRAAKIRVA

SEQ ID NO: 6036 - protein, 11 aa, Borrelia afzelii
QIRAAKIRVAD

SEQ ID NO: 6037 - protein, 11 aa, Borrelia afzelii
IRAAKIRVADL

SEQ ID NO: 6038 - protein, 11 aa, Borrelia afzelii
RAAKIRVADLT

SEQ ID NO: 6039 - protein, 11 aa, Borrelia afzelii
AAKIRVADLTI

SEQ ID NO: 6040 - protein, 11 aa, Borrelia afzelii
AKIRVADLTIK

SEQ ID NO: 6041 - protein, 11 aa, Borrelia afzelii
KIRVADLTIKF

SEQ ID NO: 6042 - protein, 11 aa, Borrelia afzelii
IRVADLTIKFL

SEQ ID NO: 6043 - protein, 11 aa, Borrelia afzelii
RVADLTIKFLE

SEQ ID NO: 6044 - protein, 11 aa, Borrelia afzelii
VADLTIKFLEA

SEQ ID NO: 6045 - protein, 11 aa, Borrelia afzelii
ADLTIKFLEAT

SEQ ID NO: 6046 - protein, 11 aa, Borrelia afzelii
DLTIKFLEATE

SEQ ID NO: 6047 - protein, 11 aa, Borrelia afzelii
LTIKFLEATEE

SEQ ID NO: 6048 - protein, 11 aa, Borrelia afzelii
TIKFLEATEEE

SEQ ID NO: 6049 - protein, 11 aa, Borrelia afzelii
IKFLEATEEET

SEQ ID NO: 6050 - protein, 11 aa, Borrelia afzelii
KFLEATEEETI

SEQ ID NO: 6051 - protein, 11 aa, Borrelia afzelii
FLEATEEETIT

SEQ ID NO: 6052 - protein, 11 aa, Borrelia afzelii
LEATEEETITF

SEQ ID NO: 6053 - protein, 11 aa, Borrelia afzelii
EATEEETITFK

SEQ ID NO: 6054 - protein, 11 aa, Borrelia afzelii
ATEEETITFKE

SEQ ID NO: 6055 - protein, 11 aa, Borrelia afzelii
TEEETITFKEN

SEQ ID NO: 6056 - protein, 11 aa, Borrelia afzelii
EEETITFKENG

SEQ ID NO: 6057 - protein, 11 aa, Borrelia afzelii
EETITFKENGA

SEQ ID NO: 6058 - protein, 11 aa, Borrelia afzelii
ETITFKENGAG

SEQ ID NO: 6059 - protein, 11 aa, Borrelia afzelii
TITFKENGAGE

SEQ ID NO: 6060 - protein, 11 aa, Borrelia afzelii
ITFKENGAGEE

SEQ ID NO: 6061 - protein, 11 aa, Borrelia afzelii
TFKENGAGEED

SEQ ID NO: 6062 - protein, 11 aa, Borrelia afzelii
FKENGAGEEDF

SEQ ID NO: 6063 - protein, 11 aa, Borrelia afzelii
KENGAGEEDFS

SEQ ID NO: 6064 - protein, 11 aa, Borrelia afzelii
ENGAGEEDFSG

SEQ ID NO: 6065 - protein, 11 aa, Borrelia afzelii
NGAGEEDFSGI

SEQ ID NO: 6066 - protein, 11 aa, Borrelia afzelii
GAGEEDFSGIY

SEQ ID NO: 6067 - protein, 11 aa, Borrelia afzelii
AGEEDFSGIYD

SEQ ID NO: 6068 - protein, 11 aa, Borrelia afzelii
GEEDFSGIYDL

SEQ ID NO: 6069 - protein, 11 aa, Borrelia afzelii
EEDFSGIYDLI

SEQ ID NO: 6070 - protein, 11 aa, Borrelia afzelii
EDFSGIYDLIL

SEQ ID NO: 6071 - protein, 11 aa, Borrelia afzelii
DFSGIYDLILN

SEQ ID NO: 6072 - protein, 11 aa, Borrelia afzelii
FSGIYDLILNA

SEQ ID NO: 6073 - protein, 11 aa, Borrelia afzelii
SGIYDLILNAA

SEQ ID NO: 6074 - protein, 11 aa, Borrelia afzelii
GIYDLILNAAK

SEQ ID NO: 6075 - protein, 11 aa, Borrelia afzelii
IYDLILNAAKA

SEQ ID NO: 6076 - protein, 11 aa, Borrelia afzelii
YDLILNAAKAV

SEQ ID NO: 6077 - protein, 11 aa, Borrelia afzelii
DLILNAAKAVE

SEQ ID NO: 6078 - protein, 11 aa, Borrelia afzelii
LILNAAKAVEK

SEQ ID NO: 6079 - protein, 11 aa, Borrelia afzelii
ILNAAKAVEKI

SEQ ID NO: 6080 - protein, 11 aa, Borrelia afzelii
LNAAKAVEKIG

SEQ ID NO: 6081 - protein, 11 aa, Borrelia afzelii
NAAKAVEKIGM

SEQ ID NO: 6082 - protein, 11 aa, Borrelia afzelii
AAKAVEKIGMQ

SEQ ID NO: 6083 - protein, 11 aa, Borrelia afzelii
AKAVEKIGMQG

SEQ ID NO: 6084 - protein, 11 aa, Borrelia afzelii
KAVEKIGMQGM

SEQ ID NO: 6085 - protein, 11 aa, Borrelia afzelii
AVEKIGMQGMK

SEQ ID NO: 6086 - protein, 11 aa, Borrelia afzelii
VEKIGMQGMKQ

SEQ ID NO: 6087 - protein, 11 aa, Borrelia afzelii
EKIGMQGMKQA

SEQ ID NO: 6088 - protein, 11 aa, Borrelia afzelii
KIGMQGMKQAV

SEQ ID NO: 6089 - protein, 11 aa, Borrelia afzelii
IGMQGMKQAVE

SEQ ID NO: 6090 - protein, 11 aa, Borrelia afzelii
GMQGMKQAVEE

SEQ ID NO: 6091 - protein, 11 aa, Borrelia afzelii
MQGMKQAVEEA

SEQ ID NO: 6092 - protein, 11 aa, Borrelia afzelii
QGMKQAVEEAA

SEQ ID NO: 6093 - protein, 11 aa, Borrelia afzelii
GMKQAVEEAAK

SEQ ID NO: 6094 - protein, 11 aa, Borrelia afzelii
MKQAVEEAAKE

SEQ ID NO: 6095 - protein, 11 aa, Borrelia afzelii
KQAVEEAAKEK

SEQ ID NO: 6096 - protein, 11 aa, Borrelia afzelii
QAVEEAAKEKP

SEQ ID NO: 6097 - protein, 11 aa, Borrelia afzelii
AVEEAAKEKPK

SEQ ID NO: 6098 - protein, 11 aa, Borrelia afzelii
VEEAAKEKPKT

SEQ ID NO: 6099 - protein, 11 aa, Borrelia afzelii
EEAAKEKPKTT

SEQ ID NO: 6100 - protein, 11 aa, Borrelia afzelii
EAAKEKPKTTA

SEQ ID NO: 6101 - protein, 11 aa, Borrelia afzelii
AAKEKPKTTAD

SEQ ID NO: 6102 - protein, 11 aa, Borrelia afzelii
AKEKPKTTADG

SEQ ID NO: 6103 - protein, 11 aa, Borrelia afzelii
KEKPKTTADGI

SEQ ID NO: 6104 - protein, 11 aa, Borrelia afzelii
EKPKTTADGII

SEQ ID NO: 6105 - protein, 11 aa, Borrelia afzelii
KPKTTADGIIA

SEQ ID NO: 6106 - protein, 11 aa, Borrelia afzelii
PKTTADGIIAI

SEQ ID NO: 6107 - protein, 11 aa, Borrelia afzelii
KTTADGIIAIV

SEQ ID NO: 6108 - protein, 11 aa, Borrelia afzelii
TTADGIIAIVK

SEQ ID NO: 6109 - protein, 11 aa, Borrelia afzelii
TADGIIAIVKV

SEQ ID NO: 6110 - protein, 11 aa, Borrelia afzelii
ADGIIAIVKVM

SEQ ID NO: 6111 - protein, 11 aa, Borrelia afzelii
DGIIAIVKVMK

SEQ ID NO: 6112 - protein, 11 aa, Borrelia afzelii
GIIAIVKVMKA

SEQ ID NO: 6113 - protein, 11 aa, Borrelia afzelii
IIAIVKVMKAK

SEQ ID NO: 6114 - protein, 11 aa, Borrelia afzelii
IAIVKVMKAKV

SEQ ID NO: 6115 - protein, 11 aa, Borrelia afzelii
AIVKVMKAKVE

SEQ ID NO: 6116 - protein, 11 aa, Borrelia afzelii
IVKVMKAKVEN

SEQ ID NO: 6117 - protein, 11 aa, Borrelia afzelii
VKVMKAKVENI

SEQ ID NO: 6118 - protein, 11 aa, Borrelia afzelii
KVMKAKVENIK

SEQ ID NO: 6119 - protein, 11 aa, Borrelia afzelii
VMKAKVENIKE

SEQ ID NO: 6120 - protein, 11 aa, Borrelia afzelii
MKAKVENIKEK

SEQ ID NO: 6121 - protein, 11 aa, Borrelia afzelii
KAKVENIKEKQ

SEQ ID NO: 6122 - protein, 11 aa, Borrelia afzelii
AKVENIKEKQT

SEQ ID NO: 6123 - protein, 11 aa, Borrelia afzelii
KVENIKEKQTK

SEQ ID NO: 6124 - protein, 11 aa, Borrelia afzelii
VENIKEKQTKN

SEQ ID NO: 6125 - protein, 11 aa, Borrelia afzelii
ENIKEKQTKNQ

SEQ ID NO: 6126 - protein, 11 aa, Borrelia afzelii
NIKEKQTKNQK

SEQ ID NO: 6127 - protein, 8 aa, Borrelia garinii
MIKYNKIL

SEQ ID NO: 6128 - protein, 8 aa, Borrelia garinii
IKYNKILL

SEQ ID NO: 6129 - protein, 8 aa, Borrelia garinii
KYNKILLK

SEQ ID NO: 6130 - protein, 8 aa, Borrelia garinii
YNKILLKL

SEQ ID NO: 6131 - protein, 8 aa, Borrelia garinii
NKILLKLS

SEQ ID NO: 6132 - protein, 8 aa, Borrelia garinii
KILLKLSL

SEQ ID NO: 6133 - protein, 8 aa, Borrelia garinii
ILLKLSLI

SEQ ID NO: 6134 - protein, 8 aa, Borrelia garinii
LLKLSLIV

SEQ ID NO: 6135 - protein, 8 aa, Borrelia garinii
LKLSLIVS

SEQ ID NO: 6136 - protein, 8 aa, Borrelia garinii
KLSLIVSL

SEQ ID NO: 6137 - protein, 8 aa, Borrelia garinii
LSLIVSLL

SEQ ID NO: 6138 - protein, 8 aa, Borrelia garinii
SLIVSLLV

SEQ ID NO: 6139 - protein, 8 aa, Borrelia garinii
LIVSLLVA

SEQ ID NO: 6140 - protein, 8 aa, Borrelia garinii
IVSLLVAC

SEQ ID NO: 6141 - protein, 8 aa, Borrelia garinii
VSLLVACG

SEQ ID NO: 6142 - protein, 8 aa, Borrelia garinii
SLLVACGL

SEQ ID NO: 6143 - protein, 8 aa, Borrelia garinii
LLVACGLT

SEQ ID NO: 6144 - protein, 8 aa, Borrelia garinii
LVACGLTG

SEQ ID NO: 6145 - protein, 8 aa, Borrelia garinii
VACGLTGE

SEQ ID NO: 6146 - protein, 8 aa, Borrelia garinii
ACGLTGET

SEQ ID NO: 6147 - protein, 8 aa, Borrelia garinii
CGLTGETK

SEQ ID NO: 6148 - protein, 8 aa, Borrelia garinii
GLTGETKI

SEQ ID NO: 6149 - protein, 8 aa, Borrelia garinii
LTGETKIR

SEQ ID NO: 6150 - protein, 8 aa, Borrelia garinii
TGETKIRL

SEQ ID NO: 6151 - protein, 8 aa, Borrelia garinii
GETKIRLE

SEQ ID NO: 6152 - protein, 8 aa, Borrelia garinii
ETKIRLES

SEQ ID NO: 6153 - protein, 8 aa, Borrelia garinii
TKIRLESS

SEQ ID NO: 6154 - protein, 8 aa, Borrelia garinii
KIRLESSA

SEQ ID NO: 6155 - protein, 8 aa, Borrelia garinii
IRLESSAQ

SEQ ID NO: 6156 - protein, 8 aa, Borrelia garinii
RLESSAQE

SEQ ID NO: 6157 - protein, 8 aa, Borrelia garinii
LESSAQEI

SEQ ID NO: 6158 - protein, 8 aa, Borrelia garinii
ESSAQEIK

SEQ ID NO: 6159 - protein, 8 aa, Borrelia garinii
SSAQEIKD

SEQ ID NO: 6160 - protein, 8 aa, Borrelia garinii
SAQEIKDE

SEQ ID NO: 6161 - protein, 8 aa, Borrelia garinii
AQEIKDEI

SEQ ID NO: 6162 - protein, 8 aa, Borrelia garinii
QEIKDEIN

SEQ ID NO: 6163 - protein, 8 aa, Borrelia garinii
EIKDEINK

SEQ ID NO: 6164 - protein, 8 aa, Borrelia garinii
IKDEINKI

SEQ ID NO: 6165 - protein, 8 aa, Borrelia garinii
KDEINKIK

SEQ ID NO: 6166 - protein, 8 aa, Borrelia garinii
DEINKIKA

SEQ ID NO: 6167 - protein, 8 aa, Borrelia garinii
EINKIKAN

SEQ ID NO: 6168 - protein, 8 aa, Borrelia garinii
INKIKANA

SEQ ID NO: 6169 - protein, 8 aa, Borrelia garinii
NKIKANAK

SEQ ID NO: 6170 - protein, 8 aa, Borrelia garinii
KIKANAKK

SEQ ID NO: 6171 - protein, 8 aa, Borrelia garinii
IKANAKKE

SEQ ID NO: 6172 - protein, 8 aa, Borrelia garinii
KANAKKEG

SEQ ID NO: 6173 - protein, 8 aa, Borrelia garinii
ANAKKEGV

SEQ ID NO: 6174 - protein, 8 aa, Borrelia garinii
NAKKEGVK

SEQ ID NO: 6175 - protein, 8 aa, Borrelia garinii
AKKEGVKF

SEQ ID NO: 6176 - protein, 8 aa, Borrelia garinii
KKEGVKFE

SEQ ID NO: 6177 - protein, 8 aa, Borrelia garinii
KEGVKFEA

SEQ ID NO: 6178 - protein, 8 aa, Borrelia garinii
EGVKFEAF

SEQ ID NO: 6179 - protein, 8 aa, Borrelia garinii
GVKFEAFT

SEQ ID NO: 6180 - protein, 8 aa, Borrelia garinii
VKFEAFTN

SEQ ID NO: 6181 - protein, 8 aa, Borrelia garinii
KFEAFTNT

SEQ ID NO: 6182 - protein, 8 aa, Borrelia garinii
FEAFTNTQ

SEQ ID NO: 6183 - protein, 8 aa, Borrelia garinii
EAFTNTQT

SEQ ID NO: 6184 - protein, 8 aa, Borrelia garinii
AFTNTQTG

SEQ ID NO: 6185 - protein, 8 aa, Borrelia garinii
FTNTQTGS

SEQ ID NO: 6186 - protein, 8 aa, Borrelia garinii
TNTQTGSK

SEQ ID NO: 6187 - protein, 8 aa, Borrelia garinii
NTQTGSKI

SEQ ID NO: 6188 - protein, 8 aa, Borrelia garinii
TQTGSKIS

SEQ ID NO: 6189 - protein, 8 aa, Borrelia garinii
QTGSKISE

SEQ ID NO: 6190 - protein, 8 aa, Borrelia garinii
TGSKISEK

SEQ ID NO: 6191 - protein, 8 aa, Borrelia garinii
GSKISEKP

SEQ ID NO: 6192 - protein, 8 aa, Borrelia garinii
SKISEKPE

SEQ ID NO: 6193 - protein, 8 aa, Borrelia garinii
KISEKPEF

SEQ ID NO: 6194 - protein, 8 aa, Borrelia garinii
ISEKPEFI

SEQ ID NO: 6195 - protein, 8 aa, Borrelia garinii
SEKPEFIL

SEQ ID NO: 6196 - protein, 8 aa, Borrelia garinii
EKPEFILK

SEQ ID NO: 6197 - protein, 8 aa, Borrelia garinii
KPEFILKA

SEQ ID NO: 6198 - protein, 8 aa, Borrelia garinii
PEFILKAK

SEQ ID NO: 6199 - protein, 8 aa, Borrelia garinii
EFILKAKI

SEQ ID NO: 6200 - protein, 8 aa, Borrelia garinii
FILKAKIK

SEQ ID NO: 6201 - protein, 8 aa, Borrelia garinii
ILKAKIKA

SEQ ID NO: 6202 - protein, 8 aa, Borrelia garinii
LKAKIKAI

SEQ ID NO: 6203 - protein, 8 aa, Borrelia garinii
KAKIKAIQ

SEQ ID NO: 6204 - protein, 8 aa, Borrelia garinii
AKIKAIQV

SEQ ID NO: 6205 - protein, 8 aa, Borrelia garinii
KIKAIQVA

SEQ ID NO: 6206 - protein, 8 aa, Borrelia garinii
IKAIQVAE

SEQ ID NO: 6207 - protein, 8 aa, Borrelia garinii
KAIQVAER

SEQ ID NO: 6208 - protein, 8 aa, Borrelia garinii
AIQVAERF

SEQ ID NO: 6209 - protein, 8 aa, Borrelia garinii
IQVAERFV

SEQ ID NO: 6210 - protein, 8 aa, Borrelia garinii
QVAERFVK

SEQ ID NO: 6211 - protein, 8 aa, Borrelia garinii
VAERFVKA

SEQ ID NO: 6212 - protein, 8 aa, Borrelia garinii
AERFVKAI

SEQ ID NO: 6213 - protein, 8 aa, Borrelia garinii
ERFVKAIK

SEQ ID NO: 6214 - protein, 8 aa, Borrelia garinii
RFVKAIKE

SEQ ID NO: 6215 - protein, 8 aa, Borrelia garinii
FVKAIKEE

SEQ ID NO: 6216 - protein, 8 aa, Borrelia garinii
VKAIKEEA

SEQ ID NO: 6217 - protein, 8 aa, Borrelia garinii
KAIKEEAE

SEQ ID NO: 6218 - protein, 8 aa, Borrelia garinii
AIKEEAEK

SEQ ID NO: 6219 - protein, 8 aa, Borrelia garinii
IKEEAEKL

SEQ ID NO: 6220 - protein, 8 aa, Borrelia garinii
KEEAEKLK

SEQ ID NO: 6221 - protein, 8 aa, Borrelia garinii
EEAEKLKK

SEQ ID NO: 6222 - protein, 8 aa, Borrelia garinii
EAEKLKKS

SEQ ID NO: 6223 - protein, 8 aa, Borrelia garinii
AEKLKKSG

SEQ ID NO: 6224 - protein, 8 aa, Borrelia garinii
EKLKKSGS

SEQ ID NO: 6225 - protein, 8 aa, Borrelia garinii
KLKKSGSS

SEQ ID NO: 6226 - protein, 8 aa, Borrelia garinii
LKKSGSSG

SEQ ID NO: 6227 - protein, 8 aa, Borrelia garinii
KKSGSSGA

SEQ ID NO: 6228 - protein, 8 aa, Borrelia garinii
KSGSSGAF

SEQ ID NO: 6229 - protein, 8 aa, Borrelia garinii
SGSSGAFS

SEQ ID NO: 6230 - protein, 8 aa, Borrelia garinii
GSSGAFSA

SEQ ID NO: 6231 - protein, 8 aa, Borrelia garinii
SSGAFSAM

SEQ ID NO: 6232 - protein, 8 aa, Borrelia garinii
SGAFSAMY

SEQ ID NO: 6233 - protein, 8 aa, Borrelia garinii
GAFSAMYD

SEQ ID NO: 6234 - protein, 8 aa, Borrelia garinii
AFSAMYDL

SEQ ID NO: 6235 - protein, 8 aa, Borrelia garinii
FSAMYDLM

SEQ ID NO: 6236 - protein, 8 aa, Borrelia garinii
SAMYDLMI

SEQ ID NO: 6237 - protein, 8 aa, Borrelia garinii
AMYDLMID

SEQ ID NO: 6238 - protein, 8 aa, Borrelia garinii
MYDLMIDV

SEQ ID NO: 6239 - protein, 8 aa, Borrelia garinii
YDLMIDVS

SEQ ID NO: 6240 - protein, 8 aa, Borrelia garinii
DLMIDVSK

SEQ ID NO: 6241 - protein, 8 aa, Borrelia garinii
LMIDVSKP

SEQ ID NO: 6242 - protein, 8 aa, Borrelia garinii
MIDVSKPL

SEQ ID NO: 6243 - protein, 8 aa, Borrelia garinii
IDVSKPLE

SEQ ID NO: 6244 - protein, 8 aa, Borrelia garinii
DVSKPLEE

SEQ ID NO: 6245 - protein, 8 aa, Borrelia garinii
VSKPLEEI

SEQ ID NO: 6246 - protein, 8 aa, Borrelia garinii
SKPLEEIG

SEQ ID NO: 6247 - protein, 8 aa, Borrelia garinii
KPLEEIGI

SEQ ID NO: 6248 - protein, 8 aa, Borrelia garinii
PLEEIGIQ

SEQ ID NO: 6249 - protein, 8 aa, Borrelia garinii
LEEIGIQK

SEQ ID NO: 6250 - protein, 8 aa, Borrelia garinii
EEIGIQKM

SEQ ID NO: 6251 - protein, 8 aa, Borrelia garinii
EIGIQKMT

SEQ ID NO: 6252 - protein, 8 aa, Borrelia garinii
IGIQKMTG

SEQ ID NO: 6253 - protein, 8 aa, Borrelia garinii
GIQKMTGT

SEQ ID NO: 6254 - protein, 8 aa, Borrelia garinii
IQKMTGTV

SEQ ID NO: 6255 - protein, 8 aa, Borrelia garinii
QKMTGTVT

SEQ ID NO: 6256 - protein, 8 aa, Borrelia garinii
KMTGTVTK

SEQ ID NO: 6257 - protein, 8 aa, Borrelia garinii
MTGTVTKE

SEQ ID NO: 6258 - protein, 8 aa, Borrelia garinii
TGTVTKEA

SEQ ID NO: 6259 - protein, 8 aa, Borrelia garinii
GTVTKEAE

SEQ ID NO: 6260 - protein, 8 aa, Borrelia garinii
TVTKEAEK

SEQ ID NO: 6261 - protein, 8 aa, Borrelia garinii
VTKEAEKT

SEQ ID NO: 6262 - protein, 8 aa, Borrelia garinii
TKEAEKTP

SEQ ID NO: 6263 - protein, 8 aa, Borrelia garinii
KEAEKTPP

SEQ ID NO: 6264 - protein, 8 aa, Borrelia garinii
EAEKTPPT

SEQ ID NO: 6265 - protein, 8 aa, Borrelia garinii
AEKTPPTT

SEQ ID NO: 6266 - protein, 8 aa, Borrelia garinii
EKTPPTTA

SEQ ID NO: 6267 - protein, 8 aa, Borrelia garinii
KTPPTTAD

SEQ ID NO: 6268 - protein, 8 aa, Borrelia garinii
TPPTTADG

SEQ ID NO: 6269 - protein, 8 aa, Borrelia garinii
PPTTADGI

SEQ ID NO: 6270 - protein, 8 aa, Borrelia garinii
PTTADGII

SEQ ID NO: 6271 - protein, 8 aa, Borrelia garinii
TTADGIIA

SEQ ID NO: 6272 - protein, 8 aa, Borrelia garinii
TADGIIAI

SEQ ID NO: 6273 - protein, 8 aa, Borrelia garinii
ADGIIAIA

SEQ ID NO: 6274 - protein, 8 aa, Borrelia garinii
DGIIAIAQ

SEQ ID NO: 6275 - protein, 8 aa, Borrelia garinii
GIIAIAQA

SEQ ID NO: 6276 - protein, 8 aa, Borrelia garinii
IIAIAQAM

SEQ ID NO: 6277 - protein, 8 aa, Borrelia garinii
IAIAQAME

SEQ ID NO: 6278 - protein, 8 aa, Borrelia garinii
AIAQAMEE

SEQ ID NO: 6279 - protein, 8 aa, Borrelia garinii
IAQAMEEK

SEQ ID NO: 6280 - protein, 8 aa, Borrelia garinii
AQAMEEKL

SEQ ID NO: 6281 - protein, 8 aa, Borrelia garinii
QAMEEKLN

SEQ ID NO: 6282 - protein, 8 aa, Borrelia garinii
AMEEKLNN

SEQ ID NO: 6283 - protein, 8 aa, Borrelia garinii
MEEKLNNV

SEQ ID NO: 6284 - protein, 8 aa, Borrelia garinii
EEKLNNVN

SEQ ID NO: 6285 - protein, 8 aa, Borrelia garinii
EKLNNVNK

SEQ ID NO: 6286 - protein, 8 aa, Borrelia garinii
KLNNVNKK

SEQ ID NO: 6287 - protein, 8 aa, Borrelia garinii
LNNVNKKQ

SEQ ID NO: 6288 - protein, 8 aa, Borrelia garinii
NNVNKKQH

SEQ ID NO: 6289 - protein, 8 aa, Borrelia garinii
NVNKKQHD

SEQ ID NO: 6290 - protein, 8 aa, Borrelia garinii
VNKKQHDA

SEQ ID NO: 6291 - protein, 8 aa, Borrelia garinii
NKKQHDAL

SEQ ID NO: 6292 - protein, 8 aa, Borrelia garinii
KKQHDALK

SEQ ID NO: 6293 - protein, 8 aa, Borrelia garinii
KQHDALKN

SEQ ID NO: 6294 - protein, 8 aa, Borrelia garinii
QHDALKNL

SEQ ID NO: 6295 - protein, 8 aa, Borrelia garinii
HDALKNLE

SEQ ID NO: 6296 - protein, 8 aa, Borrelia garinii
DALKNLEE

SEQ ID NO: 6297 - protein, 8 aa, Borrelia garinii
ALKNLEEK

SEQ ID NO: 6298 - protein, 8 aa, Borrelia garinii
LKNLEEKA

SEQ ID NO: 6299 - protein, 8 aa, Borrelia garinii
KNLEEKAN

SEQ ID NO: 6300 - protein, 8 aa, Borrelia garinii
NLEEKANT

SEQ ID NO: 6301 - protein, 8 aa, Borrelia garinii
LEEKANTA

SEQ ID NO: 6302 - protein, 8 aa, Borrelia garinii
EEKANTAA

SEQ ID NO: 6303 - protein, 8 aa, Borrelia garinii
EKANTAAT

SEQ ID NO: 6304 - protein, 8 aa, Borrelia garinii
KANTAATT

SEQ ID NO: 6305 - protein, 8 aa, Borrelia garinii
ANTAATTT

SEQ ID NO: 6306 - protein, 9 aa, Borrelia garinii
MIKYNKILL

SEQ ID NO: 6307 - protein, 9 aa, Borrelia garinii
IKYNKILLK

SEQ ID NO: 6308 - protein, 9 aa, Borrelia garinii
KYNKILLKL

SEQ ID NO: 6309 - protein, 9 aa, Borrelia garinii
YNKILLKLS

SEQ ID NO: 6310 - protein, 9 aa, Borrelia garinii
NKILLKLSL

SEQ ID NO: 6311 - protein, 9 aa, Borrelia garinii
KILLKLSLI

SEQ ID NO: 6312 - protein, 9 aa, Borrelia garinii
ILLKLSLIV

SEQ ID NO: 6313 - protein, 9 aa, Borrelia garinii
LLKLSLIVS

SEQ ID NO: 6314 - protein, 9 aa, Borrelia garinii
LKLSLIVSL

SEQ ID NO: 6315 - protein, 9 aa, Borrelia garinii
KLSLIVSLL

SEQ ID NO: 6316 - protein, 9 aa, Borrelia garinii
LSLIVSLLV

SEQ ID NO: 6317 - protein, 9 aa, Borrelia garinii
SLIVSLLVA

SEQ ID NO: 6318 - protein, 9 aa, Borrelia garinii
LIVSLLVAC

SEQ ID NO: 6319 - protein, 9 aa, Borrelia garinii
IVSLLVACG

SEQ ID NO: 6320 - protein, 9 aa, Borrelia garinii
VSLLVACGL

SEQ ID NO: 6321 - protein, 9 aa, Borrelia garinii
SLLVACGLT

SEQ ID NO: 6322 - protein, 9 aa, Borrelia garinii
LLVACGLTG

SEQ ID NO: 6323 - protein, 9 aa, Borrelia garinii
LVACGLTGE

SEQ ID NO: 6324 - protein, 9 aa, Borrelia garinii
VACGLTGET

SEQ ID NO: 6325 - protein, 9 aa, Borrelia garinii
ACGLTGETK

SEQ ID NO: 6326 - protein, 9 aa, Borrelia garinii
CGLTGETKI

SEQ ID NO: 6327 - protein, 9 aa, Borrelia garinii
GLTGETKIR

SEQ ID NO: 6328 - protein, 9 aa, Borrelia garinii
LTGETKIRL

SEQ ID NO: 6329 - protein, 9 aa, Borrelia garinii
TGETKIRLE

SEQ ID NO: 6330 - protein, 9 aa, Borrelia garinii
GETKIRLES

SEQ ID NO: 6331 - protein, 9 aa, Borrelia garinii
ETKIRLESS

SEQ ID NO: 6332 - protein, 9 aa, Borrelia garinii
TKIRLESSA

SEQ ID NO: 6333 - protein, 9 aa, Borrelia garinii
KIRLESSAQ

SEQ ID NO: 6334 - protein, 9 aa, Borrelia garinii
IRLESSAQE

SEQ ID NO: 6335 - protein, 9 aa, Borrelia garinii
RLESSAQEI

SEQ ID NO: 6336 - protein, 9 aa, Borrelia garinii
LESSAQEIK

SEQ ID NO: 6337 - protein, 9 aa, Borrelia garinii
ESSAQEIKD

SEQ ID NO: 6338 - protein, 9 aa, Borrelia garinii
SSAQEIKDE

SEQ ID NO: 6339 - protein, 9 aa, Borrelia garinii
SAQEIKDEI

SEQ ID NO: 6340 - protein, 9 aa, Borrelia garinii
AQEIKDEIN

SEQ ID NO: 6341 - protein, 9 aa, Borrelia garinii
QEIKDEINK

SEQ ID NO: 6342 - protein, 9 aa, Borrelia garinii
EIKDEINKI

SEQ ID NO: 6343 - protein, 9 aa, Borrelia garinii
IKDEINKIK

SEQ ID NO: 6344 - protein, 9 aa, Borrelia garinii
KDEINKIKA

SEQ ID NO: 6345 - protein, 9 aa, Borrelia garinii
DEINKIKAN

SEQ ID NO: 6346 - protein, 9 aa, Borrelia garinii
EINKIKANA

SEQ ID NO: 6347 - protein, 9 aa, Borrelia garinii
INKIKANAK

SEQ ID NO: 6348 - protein, 9 aa, Borrelia garinii
NKIKANAKK

SEQ ID NO: 6349 - protein, 9 aa, Borrelia garinii
KIKANAKKE

SEQ ID NO: 6350 - protein, 9 aa, Borrelia garinii
IKANAKKEG

SEQ ID NO: 6351 - protein, 9 aa, Borrelia garinii
KANAKKEGV

SEQ ID NO: 6352 - protein, 9 aa, Borrelia garinii
ANAKKEGVK

SEQ ID NO: 6353 - protein, 9 aa, Borrelia garinii
NAKKEGVKF

SEQ ID NO: 6354 - protein, 9 aa, Borrelia garinii
AKKEGVKFE

SEQ ID NO: 6355 - protein, 9 aa, Borrelia garinii
KKEGVKFEA

SEQ ID NO: 6356 - protein, 9 aa, Borrelia garinii
KEGVKFEAF

SEQ ID NO: 6357 - protein, 9 aa, Borrelia garinii
EGVKFEAFT

SEQ ID NO: 6358 - protein, 9 aa, Borrelia garinii
GVKFEAFTN

SEQ ID NO: 6359 - protein, 9 aa, Borrelia garinii
VKFEAFTNT

SEQ ID NO: 6360 - protein, 9 aa, Borrelia garinii
KFEAFTNTQ

SEQ ID NO: 6361 - protein, 9 aa, Borrelia garinii
FEAFTNTQT

SEQ ID NO: 6362 - protein, 9 aa, Borrelia garinii
EAFTNTQTG

SEQ ID NO: 6363 - protein, 9 aa, Borrelia garinii
AFTNTQTGS

SEQ ID NO: 6364 - protein, 9 aa, Borrelia garinii
FTNTQTGSK

SEQ ID NO: 6365 - protein, 9 aa, Borrelia garinii
TNTQTGSKI

SEQ ID NO: 6366 - protein, 9 aa, Borrelia garinii
NTQTGSKIS

SEQ ID NO: 6367 - protein, 9 aa, Borrelia garinii
TQTGSKISE

SEQ ID NO: 6368 - protein, 9 aa, Borrelia garinii
QTGSKISEK

SEQ ID NO: 6369 - protein, 9 aa, Borrelia garinii
TGSKISEKP

SEQ ID NO: 6370 - protein, 9 aa, Borrelia garinii
GSKISEKPE

SEQ ID NO: 6371 - protein, 9 aa, Borrelia garinii
SKISEKPEF

SEQ ID NO: 6372 - protein, 9 aa, Borrelia garinii
KISEKPEFI

SEQ ID NO: 6373 - protein, 9 aa, Borrelia garinii
ISEKPEFIL

SEQ ID NO: 6374 - protein, 9 aa, Borrelia garinii
SEKPEFILK

SEQ ID NO: 6375 - protein, 9 aa, Borrelia garinii
EKPEFILKA

SEQ ID NO: 6376 - protein, 9 aa, Borrelia garinii
KPEFILKAK

SEQ ID NO: 6377 - protein, 9 aa, Borrelia garinii
PEFILKAKI

SEQ ID NO: 6378 - protein, 9 aa, Borrelia garinii
EFILKAKIK

SEQ ID NO: 6379 - protein, 9 aa, Borrelia garinii
FILKAKIKA

SEQ ID NO: 6380 - protein, 9 aa, Borrelia garinii
ILKAKIKAI

SEQ ID NO: 6381 - protein, 9 aa, Borrelia garinii
LKAKIKAIQ

SEQ ID NO: 6382 - protein, 9 aa, Borrelia garinii
KAKIKAIQV

SEQ ID NO: 6383 - protein, 9 aa, Borrelia garinii
AKIKAIQVA

SEQ ID NO: 6384 - protein, 9 aa, Borrelia garinii
KIKAIQVAE

SEQ ID NO: 6385 - protein, 9 aa, Borrelia garinii
IKAIQVAER

SEQ ID NO: 6386 - protein, 9 aa, Borrelia garinii
KAIQVAERF

SEQ ID NO: 6387 - protein, 9 aa, Borrelia garinii
AIQVAERFV

SEQ ID NO: 6388 - protein, 9 aa, Borrelia garinii
IQVAERFVK

SEQ ID NO: 6389 - protein, 9 aa, Borrelia garinii
QVAERFVKA

SEQ ID NO: 6390 - protein, 9 aa, Borrelia garinii
VAERFVKAI

SEQ ID NO: 6391 - protein, 9 aa, Borrelia garinii
AERFVKAIK

SEQ ID NO: 6392 - protein, 9 aa, Borrelia garinii
ERFVKAIKE

SEQ ID NO: 6393 - protein, 9 aa, Borrelia garinii
RFVKAIKEE

SEQ ID NO: 6394 - protein, 9 aa, Borrelia garinii
FVKAIKEEA

SEQ ID NO: 6395 - protein, 9 aa, Borrelia garinii
VKAIKEEAE

SEQ ID NO: 6396 - protein, 9 aa, Borrelia garinii
KAIKEEAEK

SEQ ID NO: 6397 - protein, 9 aa, Borrelia garinii
AIKEEAEKL

SEQ ID NO: 6398 - protein, 9 aa, Borrelia garinii
IKEEAEKLK

SEQ ID NO: 6399 - protein, 9 aa, Borrelia garinii
KEEAEKLKK

SEQ ID NO: 6400 - protein, 9 aa, Borrelia garinii
EEAEKLKKS

SEQ ID NO: 6401 - protein, 9 aa, Borrelia garinii
EAEKLKKSG

SEQ ID NO: 6402 - protein, 9 aa, Borrelia garinii
AEKLKKSGS

SEQ ID NO: 6403 - protein, 9 aa, Borrelia garinii
EKLKKSGSS

SEQ ID NO: 6404 - protein, 9 aa, Borrelia garinii
KLKKSGSSG

SEQ ID NO: 6405 - protein, 9 aa, Borrelia garinii
LKKSGSSGA

SEQ ID NO: 6406 - protein, 9 aa, Borrelia garinii
KKSGSSGAF

SEQ ID NO: 6407 - protein, 9 aa, Borrelia garinii
KSGSSGAFS

SEQ ID NO: 6408 - protein, 9 aa, Borrelia garinii
SGSSGAFSA

SEQ ID NO: 6409 - protein, 9 aa, Borrelia garinii
GSSGAFSAM

SEQ ID NO: 6410 - protein, 9 aa, Borrelia garinii
SSGAFSAMY

SEQ ID NO: 6411 - protein, 9 aa, Borrelia garinii
SGAFSAMYD

SEQ ID NO: 6412 - protein, 9 aa, Borrelia garinii
GAFSAMYDL

SEQ ID NO: 6413 - protein, 9 aa, Borrelia garinii
AFSAMYDLM

SEQ ID NO: 6414 - protein, 9 aa, Borrelia garinii
FSAMYDLMI

SEQ ID NO: 6415 - protein, 9 aa, Borrelia garinii
SAMYDLMID

SEQ ID NO: 6416 - protein, 9 aa, Borrelia garinii
AMYDLMIDV

SEQ ID NO: 6417 - protein, 9 aa, Borrelia garinii
MYDLMIDVS

SEQ ID NO: 6418 - protein, 9 aa, Borrelia garinii
YDLMIDVSK

SEQ ID NO: 6419 - protein, 9 aa, Borrelia garinii
DLMIDVSKP

SEQ ID NO: 6420 - protein, 9 aa, Borrelia garinii
LMIDVSKPL

SEQ ID NO: 6421 - protein, 9 aa, Borrelia garinii
MIDVSKPLE

SEQ ID NO: 6422 - protein, 9 aa, Borrelia garinii
IDVSKPLEE

SEQ ID NO: 6423 - protein, 9 aa, Borrelia garinii
DVSKPLEEI

SEQ ID NO: 6424 - protein, 9 aa, Borrelia garinii
VSKPLEEIG

SEQ ID NO: 6425 - protein, 9 aa, Borrelia garinii
SKPLEEIGI

SEQ ID NO: 6426 - protein, 9 aa, Borrelia garinii
KPLEEIGIQ

SEQ ID NO: 6427 - protein, 9 aa, Borrelia garinii
PLEEIGIQK

SEQ ID NO: 6428 - protein, 9 aa, Borrelia garinii
LEEIGIQKM

SEQ ID NO: 6429 - protein, 9 aa, Borrelia garinii
EEIGIQKMT

SEQ ID NO: 6430 - protein, 9 aa, Borrelia garinii
EIGIQKMTG

SEQ ID NO: 6431 - protein, 9 aa, Borrelia garinii
IGIQKMTGT

SEQ ID NO: 6432 - protein, 9 aa, Borrelia garinii
GIQKMTGTV

SEQ ID NO: 6433 - protein, 9 aa, Borrelia garinii
IQKMTGTVT

SEQ ID NO: 6434 - protein, 9 aa, Borrelia garinii
QKMTGTVTK

SEQ ID NO: 6435 - protein, 9 aa, Borrelia garinii
KMTGTVTKE

SEQ ID NO: 6436 - protein, 9 aa, Borrelia garinii
MTGTVTKEA

SEQ ID NO: 6437 - protein, 9 aa, Borrelia garinii
TGTVTKEAE

SEQ ID NO: 6438 - protein, 9 aa, Borrelia garinii
GTVTKEAEK

SEQ ID NO: 6439 - protein, 9 aa, Borrelia garinii
TVTKEAEKT

SEQ ID NO: 6440 - protein, 9 aa, Borrelia garinii
VTKEAEKTP

SEQ ID NO: 6441 - protein, 9 aa, Borrelia garinii
TKEAEKTPP

SEQ ID NO: 6442 - protein, 9 aa, Borrelia garinii
KEAEKTPPT

SEQ ID NO: 6443 - protein, 9 aa, Borrelia garinii
EAEKTPPTT

SEQ ID NO: 6444 - protein, 9 aa, Borrelia garinii
AEKTPPTTA

SEQ ID NO: 6445 - protein, 9 aa, Borrelia garinii
EKTPPTTAD

SEQ ID NO: 6446 - protein, 9 aa, Borrelia garinii
KTPPTTADG

SEQ ID NO: 6447 - protein, 9 aa, Borrelia garinii
TPPTTADGI

SEQ ID NO: 6448 - protein, 9 aa, Borrelia garinii
PPTTADGII

SEQ ID NO: 6449 - protein, 9 aa, Borrelia garinii
PTTADGIIA

SEQ ID NO: 6450 - protein, 9 aa, Borrelia garinii
TTADGIIAI

SEQ ID NO: 6451 - protein, 9 aa, Borrelia garinii
TADGIIAIA

SEQ ID NO: 6452 - protein, 9 aa, Borrelia garinii
ADGIIAIAQ

SEQ ID NO: 6453 - protein, 9 aa, Borrelia garinii
DGIIAIAQA

SEQ ID NO: 6454 - protein, 9 aa, Borrelia garinii
GIIAIAQAM

SEQ ID NO: 6455 - protein, 9 aa, Borrelia garinii
IIAIAQAME

SEQ ID NO: 6456 - protein, 9 aa, Borrelia garinii
IAIAQAMEE

SEQ ID NO: 6457 - protein, 9 aa, Borrelia garinii
AIAQAMEEK

SEQ ID NO: 6458 - protein, 9 aa, Borrelia garinii
IAQAMEEKL

SEQ ID NO: 6459 - protein, 9 aa, Borrelia garinii
AQAMEEKLN

SEQ ID NO: 6460 - protein, 9 aa, Borrelia garinii
QAMEEKLNN

SEQ ID NO: 6461 - protein, 9 aa, Borrelia garinii
AMEEKLNNV

SEQ ID NO: 6462 - protein, 9 aa, Borrelia garinii
MEEKLNNVN

SEQ ID NO: 6463 - protein, 9 aa, Borrelia garinii
EEKLNNVNK

SEQ ID NO: 6464 - protein, 9 aa, Borrelia garinii
EKLNNVNKK

SEQ ID NO: 6465 - protein, 9 aa, Borrelia garinii
KLNNVNKKQ

SEQ ID NO: 6466 - protein, 9 aa, Borrelia garinii
LNNVNKKQH

SEQ ID NO: 6467 - protein, 9 aa, Borrelia garinii
NNVNKKQHD

SEQ ID NO: 6468 - protein, 9 aa, Borrelia garinii
NVNKKQHDA

SEQ ID NO: 6469 - protein, 9 aa, Borrelia garinii
VNKKQHDAL

SEQ ID NO: 6470 - protein, 9 aa, Borrelia garinii
NKKQHDALK

SEQ ID NO: 6471 - protein, 9 aa, Borrelia garinii
KKQHDALKN

SEQ ID NO: 6472 - protein, 9 aa, Borrelia garinii
KQHDALKNL

SEQ ID NO: 6473 - protein, 9 aa, Borrelia garinii
QHDALKNLE

SEQ ID NO: 6474 - protein, 9 aa, Borrelia garinii
HDALKNLEE

SEQ ID NO: 6475 - protein, 9 aa, Borrelia garinii
DALKNLEEK

SEQ ID NO: 6476 - protein, 9 aa, Borrelia garinii
ALKNLEEKA

SEQ ID NO: 6477 - protein, 9 aa, Borrelia garinii
LKNLEEKAN

SEQ ID NO: 6478 - protein, 9 aa, Borrelia garinii
KNLEEKANT

SEQ ID NO: 6479 - protein, 9 aa, Borrelia garinii
NLEEKANTA

SEQ ID NO: 6480 - protein, 9 aa, Borrelia garinii
LEEKANTAA

SEQ ID NO: 6481 - protein, 9 aa, Borrelia garinii
EEKANTAAT

SEQ ID NO: 6482 - protein, 9 aa, Borrelia garinii
EKANTAATT

SEQ ID NO: 6483 - protein, 9 aa, Borrelia garinii
KANTAATTT

SEQ ID NO: 6484 - protein, 10 aa, Borrelia garinii
MIKYNKILLK

SEQ ID NO: 6485 - protein, 10 aa, Borrelia garinii
IKYNKILLKL

SEQ ID NO: 6486 - protein, 10 aa, Borrelia garinii
KYNKILLKLS

SEQ ID NO: 6487 - protein, 10 aa, Borrelia garinii
YNKILLKLSL

SEQ ID NO: 6488 - protein, 10 aa, Borrelia garinii
NKILLKLSLI

SEQ ID NO: 6489 - protein, 10 aa, Borrelia garinii
KILLKLSLIV

SEQ ID NO: 6490 - protein, 10 aa, Borrelia garinii
ILLKLSLIVS

SEQ ID NO: 6491 - protein, 10 aa, Borrelia garinii
LLKLSLIVSL

SEQ ID NO: 6492 - protein, 10 aa, Borrelia garinii
LKLSLIVSLL

SEQ ID NO: 6493 - protein, 10 aa, Borrelia garinii
KLSLIVSLLV

SEQ ID NO: 6494 - protein, 10 aa, Borrelia garinii
LSLIVSLLVA

SEQ ID NO: 6495 - protein, 10 aa, Borrelia garinii
SLIVSLLVAC

SEQ ID NO: 6496 - protein, 10 aa, Borrelia garinii
LIVSLLVACG

SEQ ID NO: 6497 - protein, 10 aa, Borrelia garinii
IVSLLVACGL

SEQ ID NO: 6498 - protein, 10 aa, Borrelia garinii
VSLLVACGLT

SEQ ID NO: 6499 - protein, 10 aa, Borrelia garinii
SLLVACGLTG

SEQ ID NO: 6500 - protein, 10 aa, Borrelia garinii
LLVACGLTGE

SEQ ID NO: 6501 - protein, 10 aa, Borrelia garinii
LVACGLTGET

SEQ ID NO: 6502 - protein, 10 aa, Borrelia garinii
VACGLTGETK

SEQ ID NO: 6503 - protein, 10 aa, Borrelia garinii
ACGLTGETKI

SEQ ID NO: 6504 - protein, 10 aa, Borrelia garinii
CGLTGETKIR

SEQ ID NO: 6505 - protein, 10 aa, Borrelia garinii
GLTGETKIRL

SEQ ID NO: 6506 - protein, 10 aa, Borrelia garinii
LTGETKIRLE

SEQ ID NO: 6507 - protein, 10 aa, Borrelia garinii
TGETKIRLES

SEQ ID NO: 6508 - protein, 10 aa, Borrelia garinii
GETKIRLESS

SEQ ID NO: 6509 - protein, 10 aa, Borrelia garinii
ETKIRLESSA

SEQ ID NO: 6510 - protein, 10 aa, Borrelia garinii
TKIRLESSAQ

SEQ ID NO: 6511 - protein, 10 aa, Borrelia garinii
KIRLESSAQE

SEQ ID NO: 6512 - protein, 10 aa, Borrelia garinii
IRLESSAQEI

SEQ ID NO: 6513 - protein, 10 aa, Borrelia garinii
RLESSAQEIK

SEQ ID NO: 6514 - protein, 10 aa, Borrelia garinii
LESSAQEIKD

SEQ ID NO: 6515 - protein, 10 aa, Borrelia garinii
ESSAQEIKDE

SEQ ID NO: 6516 - protein, 10 aa, Borrelia garinii
SSAQEIKDEI

SEQ ID NO: 6517 - protein, 10 aa, Borrelia garinii
SAQEIKDEIN

SEQ ID NO: 6518 - protein, 10 aa, Borrelia garinii
AQEIKDEINK

SEQ ID NO: 6519 - protein, 10 aa, Borrelia garinii
QEIKDEINKI

SEQ ID NO: 6520 - protein, 10 aa, Borrelia garinii
EIKDEINKIK

SEQ ID NO: 6521 - protein, 10 aa, Borrelia garinii
IKDEINKIKA

SEQ ID NO: 6522 - protein, 10 aa, Borrelia garinii
KDEINKIKAN

SEQ ID NO: 6523 - protein, 10 aa, Borrelia garinii
DEINKIKANA

SEQ ID NO: 6524 - protein, 10 aa, Borrelia garinii
EINKIKANAK

SEQ ID NO: 6525 - protein, 10 aa, Borrelia garinii
INKIKANAKK

SEQ ID NO: 6526 - protein, 10 aa, Borrelia garinii
NKIKANAKKE

SEQ ID NO: 6527 - protein, 10 aa, Borrelia garinii
KIKANAKKEG

SEQ ID NO: 6528 - protein, 10 aa, Borrelia garinii
IKANAKKEGV

SEQ ID NO: 6529 - protein, 10 aa, Borrelia garinii
KANAKKEGVK

SEQ ID NO: 6530 - protein, 10 aa, Borrelia garinii
ANAKKEGVKF

SEQ ID NO: 6531 - protein, 10 aa, Borrelia garinii
NAKKEGVKFE

SEQ ID NO: 6532 - protein, 10 aa, Borrelia garinii
AKKEGVKFEA

SEQ ID NO: 6533 - protein, 10 aa, Borrelia garinii
KKEGVKFEAF

SEQ ID NO: 6534 - protein, 10 aa, Borrelia garinii
KEGVKFEAFT

SEQ ID NO: 6535 - protein, 10 aa, Borrelia garinii
EGVKFEAFTN

SEQ ID NO: 6536 - protein, 10 aa, Borrelia garinii
GVKFEAFTNT

SEQ ID NO: 6537 - protein, 10 aa, Borrelia garinii
VKFEAFTNTQ

SEQ ID NO: 6538 - protein, 10 aa, Borrelia garinii
KFEAFTNTQT

SEQ ID NO: 6539 - protein, 10 aa, Borrelia garinii
FEAFTNTQTG

SEQ ID NO: 6540 - protein, 10 aa, Borrelia garinii
EAFTNTQTGS

SEQ ID NO: 6541 - protein, 10 aa, Borrelia garinii
AFTNTQTGSK

SEQ ID NO: 6542 - protein, 10 aa, Borrelia garinii
FTNTQTGSKI

SEQ ID NO: 6543 - protein, 10 aa, Borrelia garinii
TNTQTGSKIS

SEQ ID NO: 6544 - protein, 10 aa, Borrelia garinii
NTQTGSKISE

SEQ ID NO: 6545 - protein, 10 aa, Borrelia garinii
TQTGSKISEK

SEQ ID NO: 6546 - protein, 10 aa, Borrelia garinii
QTGSKISEKP

SEQ ID NO: 6547 - protein, 10 aa, Borrelia garinii
TGSKISEKPE

SEQ ID NO: 6548 - protein, 10 aa, Borrelia garinii
GSKISEKPEF

SEQ ID NO: 6549 - protein, 10 aa, Borrelia garinii
SKISEKPEFI

SEQ ID NO: 6550 - protein, 10 aa, Borrelia garinii
KISEKPEFIL

SEQ ID NO: 6551 - protein, 10 aa, Borrelia garinii
ISEKPEFILK

SEQ ID NO: 6552 - protein, 10 aa, Borrelia garinii
SEKPEFILKA

SEQ ID NO: 6553 - protein, 10 aa, Borrelia garinii
EKPEFILKAK

SEQ ID NO: 6554 - protein, 10 aa, Borrelia garinii
KPEFILKAKI

SEQ ID NO: 6555 - protein, 10 aa, Borrelia garinii
PEFILKAKIK

SEQ ID NO: 6556 - protein, 10 aa, Borrelia garinii
EFILKAKIKA

SEQ ID NO: 6557 - protein, 10 aa, Borrelia garinii
FILKAKIKAI

SEQ ID NO: 6558 - protein, 10 aa, Borrelia garinii
ILKAKIKAIQ

SEQ ID NO: 6559 - protein, 10 aa, Borrelia garinii
LKAKIKAIQV

SEQ ID NO: 6560 - protein, 10 aa, Borrelia garinii
KAKIKAIQVA

SEQ ID NO: 6561 - protein, 10 aa, Borrelia garinii
AKIKAIQVAE

SEQ ID NO: 6562 - protein, 10 aa, Borrelia garinii
KIKAIQVAER

SEQ ID NO: 6563 - protein, 10 aa, Borrelia garinii
IKAIQVAERF

SEQ ID NO: 6564 - protein, 10 aa, Borrelia garinii
KAIQVAERFV

SEQ ID NO: 6565 - protein, 10 aa, Borrelia garinii
AIQVAERFVK

SEQ ID NO: 6566 - protein, 10 aa, Borrelia garinii
IQVAERFVKA

SEQ ID NO: 6567 - protein, 10 aa, Borrelia garinii
QVAERFVKAI

SEQ ID NO: 6568 - protein, 10 aa, Borrelia garinii
VAERFVKAIK

SEQ ID NO: 6569 - protein, 10 aa, Borrelia garinii
AERFVKAIKE

SEQ ID NO: 6570 - protein, 10 aa, Borrelia garinii
ERFVKAIKEE

SEQ ID NO: 6571 - protein, 10 aa, Borrelia garinii
RFVKAIKEEA

SEQ ID NO: 6572 - protein, 10 aa, Borrelia garinii
FVKAIKEEAE

SEQ ID NO: 6573 - protein, 10 aa, Borrelia garinii
VKAIKEEAEK

SEQ ID NO: 6574 - protein, 10 aa, Borrelia garinii
KAIKEEAEKL

SEQ ID NO: 6575 - protein, 10 aa, Borrelia garinii
AIKEEAEKLK

SEQ ID NO: 6576 - protein, 10 aa, Borrelia garinii
IKEEAEKLKK

SEQ ID NO: 6577 - protein, 10 aa, Borrelia garinii
KEEAEKLKKS

SEQ ID NO: 6578 - protein, 10 aa, Borrelia garinii
EEAEKLKKSG

SEQ ID NO: 6579 - protein, 10 aa, Borrelia garinii
EAEKLKKSGS

SEQ ID NO: 6580 - protein, 10 aa, Borrelia garinii
AEKLKKSGSS

SEQ ID NO: 6581 - protein, 10 aa, Borrelia garinii
EKLKKSGSSG

SEQ ID NO: 6582 - protein, 10 aa, Borrelia garinii
KLKKSGSSGA

SEQ ID NO: 6583 - protein, 10 aa, Borrelia garinii
LKKSGSSGAF

SEQ ID NO: 6584 - protein, 10 aa, Borrelia garinii
KKSGSSGAFS

SEQ ID NO: 6585 - protein, 10 aa, Borrelia garinii
KSGSSGAFSA

SEQ ID NO: 6586 - protein, 10 aa, Borrelia garinii
SGSSGAFSAM

SEQ ID NO: 6587 - protein, 10 aa, Borrelia garinii
GSSGAFSAMY

SEQ ID NO: 6588 - protein, 10 aa, Borrelia garinii
SSGAFSAMYD

SEQ ID NO: 6589 - protein, 10 aa, Borrelia garinii
SGAFSAMYDL

SEQ ID NO: 6590 - protein, 10 aa, Borrelia garinii
GAFSAMYDLM

SEQ ID NO: 6591 - protein, 10 aa, Borrelia garinii
AFSAMYDLMI

SEQ ID NO: 6592 - protein, 10 aa, Borrelia garinii
FSAMYDLMID

SEQ ID NO: 6593 - protein, 10 aa, Borrelia garinii
SAMYDLMIDV

SEQ ID NO: 6594 - protein, 10 aa, Borrelia garinii
AMYDLMIDVS

SEQ ID NO: 6595 - protein, 10 aa, Borrelia garinii
MYDLMIDVSK

SEQ ID NO: 6596 - protein, 10 aa, Borrelia garinii
YDLMIDVSKP

SEQ ID NO: 6597 - protein, 10 aa, Borrelia garinii
DLMIDVSKPL

SEQ ID NO: 6598 - protein, 10 aa, Borrelia garinii
LMIDVSKPLE

SEQ ID NO: 6599 - protein, 10 aa, Borrelia garinii
MIDVSKPLEE

SEQ ID NO: 6600 - protein, 10 aa, Borrelia garinii
IDVSKPLEEI

SEQ ID NO: 6601 - protein, 10 aa, Borrelia garinii
DVSKPLEEIG

SEQ ID NO: 6602 - protein, 10 aa, Borrelia garinii
VSKPLEEIGI

SEQ ID NO: 6603 - protein, 10 aa, Borrelia garinii
SKPLEEIGIQ

SEQ ID NO: 6604 - protein, 10 aa, Borrelia garinii
KPLEEIGIQK

SEQ ID NO: 6605 - protein, 10 aa, Borrelia garinii
PLEEIGIQKM

SEQ ID NO: 6606 - protein, 10 aa, Borrelia garinii
LEEIGIQKMT

SEQ ID NO: 6607 - protein, 10 aa, Borrelia garinii
EEIGIQKMTG

SEQ ID NO: 6608 - protein, 10 aa, Borrelia garinii
EIGIQKMTGT

SEQ ID NO: 6609 - protein, 10 aa, Borrelia garinii
IGIQKMTGTV

SEQ ID NO: 6610 - protein, 10 aa, Borrelia garinii
GIQKMTGTVT

SEQ ID NO: 6611 - protein, 10 aa, Borrelia garinii
IQKMTGTVTK

SEQ ID NO: 6612 - protein, 10 aa, Borrelia garinii
QKMTGTVTKE

SEQ ID NO: 6613 - protein, 10 aa, Borrelia garinii
KMTGTVTKEA

SEQ ID NO: 6614 - protein, 10 aa, Borrelia garinii
MTGTVTKEAE

SEQ ID NO: 6615 - protein, 10 aa, Borrelia garinii
TGTVTKEAEK

SEQ ID NO: 6616 - protein, 10 aa, Borrelia garinii
GTVTKEAEKT

SEQ ID NO: 6617 - protein, 10 aa, Borrelia garinii
TVTKEAEKTP

SEQ ID NO: 6618 - protein, 10 aa, Borrelia garinii
VTKEAEKTPP

SEQ ID NO: 6619 - protein, 10 aa, Borrelia garinii
TKEAEKTPPT

SEQ ID NO: 6620 - protein, 10 aa, Borrelia garinii
KEAEKTPPTT

SEQ ID NO: 6621 - protein, 10 aa, Borrelia garinii
EAEKTPPTTA

SEQ ID NO: 6622 - protein, 10 aa, Borrelia garinii
AEKTPPTTAD

SEQ ID NO: 6623 - protein, 10 aa, Borrelia garinii
EKTPPTTADG

SEQ ID NO: 6624 - protein, 10 aa, Borrelia garinii
KTPPTTADGI

SEQ ID NO: 6625 - protein, 10 aa, Borrelia garinii
TPPTTADGII

SEQ ID NO: 6626 - protein, 10 aa, Borrelia garinii
PPTTADGIIA

SEQ ID NO: 6627 - protein, 10 aa, Borrelia garinii
PTTADGIIAI

SEQ ID NO: 6628 - protein, 10 aa, Borrelia garinii
TTADGIIAIA

SEQ ID NO: 6629 - protein, 10 aa, Borrelia garinii
TADGIIAIAQ

SEQ ID NO: 6630 - protein, 10 aa, Borrelia garinii
ADGIIAIAQA

SEQ ID NO: 6631 - protein, 10 aa, Borrelia garinii
DGIIAIAQAM

SEQ ID NO: 6632 - protein, 10 aa, Borrelia garinii
GIIAIAQAME

SEQ ID NO: 6633 - protein, 10 aa, Borrelia garinii
IIAIAQAMEE

SEQ ID NO: 6634 - protein, 10 aa, Borrelia garinii
IAIAQAMEEK

SEQ ID NO: 6635 - protein, 10 aa, Borrelia garinii
AIAQAMEEKL

SEQ ID NO: 6636 - protein, 10 aa, Borrelia garinii
IAQAMEEKLN

SEQ ID NO: 6637 - protein, 10 aa, Borrelia garinii
AQAMEEKLNN

SEQ ID NO: 6638 - protein, 10 aa, Borrelia garinii
QAMEEKLNNV

SEQ ID NO: 6639 - protein, 10 aa, Borrelia garinii
AMEEKLNNVN

SEQ ID NO: 6640 - protein, 10 aa, Borrelia garinii
MEEKLNNVNK

SEQ ID NO: 6641 - protein, 10 aa, Borrelia garinii
EEKLNNVNKK

SEQ ID NO: 6642 - protein, 10 aa, Borrelia garinii
EKLNNVNKKQ

SEQ ID NO: 6643 - protein, 10 aa, Borrelia garinii
KLNNVNKKQH

SEQ ID NO: 6644 - protein, 10 aa, Borrelia garinii
LNNVNKKQHD

SEQ ID NO: 6645 - protein, 10 aa, Borrelia garinii
NNVNKKQHDA

SEQ ID NO: 6646 - protein, 10 aa, Borrelia garinii
NVNKKQHDAL

SEQ ID NO: 6647 - protein, 10 aa, Borrelia garinii
VNKKQHDALK

SEQ ID NO: 6648 - protein, 10 aa, Borrelia garinii
NKKQHDALKN

SEQ ID NO: 6649 - protein, 10 aa, Borrelia garinii
KKQHDALKNL

SEQ ID NO: 6650 - protein, 10 aa, Borrelia garinii
KQHDALKNLE

SEQ ID NO: 6651 - protein, 10 aa, Borrelia garinii
QHDALKNLEE

SEQ ID NO: 6652 - protein, 10 aa, Borrelia garinii
HDALKNLEEK

SEQ ID NO: 6653 - protein, 10 aa, Borrelia garinii
DALKNLEEKA

SEQ ID NO: 6654 - protein, 10 aa, Borrelia garinii
ALKNLEEKAN

SEQ ID NO: 6655 - protein, 10 aa, Borrelia garinii
LKNLEEKANT

SEQ ID NO: 6656 - protein, 10 aa, Borrelia garinii
KNLEEKANTA

SEQ ID NO: 6657 - protein, 10 aa, Borrelia garinii
NLEEKANTAA

SEQ ID NO: 6658 - protein, 10 aa, Borrelia garinii
LEEKANTAAT

SEQ ID NO: 6659 - protein, 10 aa, Borrelia garinii
EEKANTAATT

SEQ ID NO: 6660 - protein, 10 aa, Borrelia garinii
EKANTAATTT

SEQ ID NO: 6661 - protein, 11 aa, Borrelia garinii
MIKYNKILLKL

SEQ ID NO: 6662 - protein, 11 aa, Borrelia garinii
IKYNKILLKLS

SEQ ID NO: 6663 - protein, 11 aa, Borrelia garinii
KYNKILLKLSL

SEQ ID NO: 6664 - protein, 11 aa, Borrelia garinii
YNKILLKLSLI

SEQ ID NO: 6665 - protein, 11 aa, Borrelia garinii
NKILLKLSLIV

SEQ ID NO: 6666 - protein, 11 aa, Borrelia garinii
KILLKLSLIVS

SEQ ID NO: 6667 - protein, 11 aa, Borrelia garinii
ILLKLSLIVSL

SEQ ID NO: 6668 - protein, 11 aa, Borrelia garinii
LLKLSLIVSLL

SEQ ID NO: 6669 - protein, 11 aa, Borrelia garinii
LKLSLIVSLLV

SEQ ID NO: 6670 - protein, 11 aa, Borrelia garinii
KLSLIVSLLVA

SEQ ID NO: 6671 - protein, 11 aa, Borrelia garinii
LSLIVSLLVAC

SEQ ID NO: 6672 - protein, 11 aa, Borrelia garinii
SLIVSLLVACG

SEQ ID NO: 6673 - protein, 11 aa, Borrelia garinii
LIVSLLVACGL

SEQ ID NO: 6674 - protein, 11 aa, Borrelia garinii
IVSLLVACGLT

SEQ ID NO: 6675 - protein, 11 aa, Borrelia garinii
VSLLVACGLTG

SEQ ID NO: 6676 - protein, 11 aa, Borrelia garinii
SLLVACGLTGE

SEQ ID NO: 6677 - protein, 11 aa, Borrelia garinii
LLVACGLTGET

SEQ ID NO: 6678 - protein, 11 aa, Borrelia garinii
LVACGLTGETK

SEQ ID NO: 6679 - protein, 11 aa, Borrelia garinii
VACGLTGETKI

SEQ ID NO: 6680 - protein, 11 aa, Borrelia garinii
ACGLTGETKIR

SEQ ID NO: 6681 - protein, 11 aa, Borrelia garinii
CGLTGETKIRL

SEQ ID NO: 6682 - protein, 11 aa, Borrelia garinii
GLTGETKIRLE

SEQ ID NO: 6683 - protein, 11 aa, Borrelia garinii
LTGETKIRLES

SEQ ID NO: 6684 - protein, 11 aa, Borrelia garinii
TGETKIRLESS

SEQ ID NO: 6685 - protein, 11 aa, Borrelia garinii
GETKIRLESSA

SEQ ID NO: 6686 - protein, 11 aa, Borrelia garinii
ETKIRLESSAQ

SEQ ID NO: 6687 - protein, 11 aa, Borrelia garinii
TKIRLESSAQE

SEQ ID NO: 6688 - protein, 11 aa, Borrelia garinii
KIRLESSAQEI

SEQ ID NO: 6689 - protein, 11 aa, Borrelia garinii
IRLESSAQEIK

SEQ ID NO: 6690 - protein, 11 aa, Borrelia garinii
RLESSAQEIKD

SEQ ID NO: 6691 - protein, 11 aa, Borrelia garinii
LESSAQEIKDE

SEQ ID NO: 6692 - protein, 11 aa, Borrelia garinii
ESSAQEIKDEI

SEQ ID NO: 6693 - protein, 11 aa, Borrelia garinii
SSAQEIKDEIN

SEQ ID NO: 6694 - protein, 11 aa, Borrelia garinii
SAQEIKDEINK

SEQ ID NO: 6695 - protein, 11 aa, Borrelia garinii
AQEIKDEINKI

SEQ ID NO: 6696 - protein, 11 aa, Borrelia garinii
QEIKDEINKIK

SEQ ID NO: 6697 - protein, 11 aa, Borrelia garinii
EIKDEINKIKA

SEQ ID NO: 6698 - protein, 11 aa, Borrelia garinii
IKDEINKIKAN

SEQ ID NO: 6699 - protein, 11 aa, Borrelia garinii
KDEINKIKANA

SEQ ID NO: 6700 - protein, 11 aa, Borrelia garinii
DEINKIKANAK

SEQ ID NO: 6701 - protein, 11 aa, Borrelia garinii
EINKIKANAKK

SEQ ID NO: 6702 - protein, 11 aa, Borrelia garinii
INKIKANAKKE

SEQ ID NO: 6703 - protein, 11 aa, Borrelia garinii
NKIKANAKKEG

SEQ ID NO: 6704 - protein, 11 aa, Borrelia garinii
KIKANAKKEGV

SEQ ID NO: 6705 - protein, 11 aa, Borrelia garinii
IKANAKKEGVK

SEQ ID NO: 6706 - protein, 11 aa, Borrelia garinii
KANAKKEGVKF

SEQ ID NO: 6707 - protein, 11 aa, Borrelia garinii
ANAKKEGVKFE

SEQ ID NO: 6708 - protein, 11 aa, Borrelia garinii
NAKKEGVKFEA

SEQ ID NO: 6709 - protein, 11 aa, Borrelia garinii
AKKEGVKFEAF

SEQ ID NO: 6710 - protein, 11 aa, Borrelia garinii
KKEGVKFEAFT

SEQ ID NO: 6711 - protein, 11 aa, Borrelia garinii
KEGVKFEAFTN

SEQ ID NO: 6712 - protein, 11 aa, Borrelia garinii
EGVKFEAFTNT

SEQ ID NO: 6713 - protein, 11 aa, Borrelia garinii
GVKFEAFTNTQ

SEQ ID NO: 6714 - protein, 11 aa, Borrelia garinii
VKFEAFTNTQT

SEQ ID NO: 6715 - protein, 11 aa, Borrelia garinii
KFEAFTNTQTG

SEQ ID NO: 6716 - protein, 11 aa, Borrelia garinii
FEAFTNTQTGS

SEQ ID NO: 6717 - protein, 11 aa, Borrelia garinii
EAFTNTQTGSK

SEQ ID NO: 6718 - protein, 11 aa, Borrelia garinii
AFTNTQTGSKI

SEQ ID NO: 6719 - protein, 11 aa, Borrelia garinii
FTNTQTGSKIS

SEQ ID NO: 6720 - protein, 11 aa, Borrelia garinii
TNTQTGSKISE

SEQ ID NO: 6721 - protein, 11 aa, Borrelia garinii
NTQTGSKISEK

SEQ ID NO: 6722 - protein, 11 aa, Borrelia garinii
TQTGSKISEKP

SEQ ID NO: 6723 - protein, 11 aa, Borrelia garinii
QTGSKISEKPE

SEQ ID NO: 6724 - protein, 11 aa, Borrelia garinii
TGSKISEKPEF

SEQ ID NO: 6725 - protein, 11 aa, Borrelia garinii
GSKISEKPEFI

SEQ ID NO: 6726 - protein, 11 aa, Borrelia garinii
SKISEKPEFIL

SEQ ID NO: 6727 - protein, 11 aa, Borrelia garinii
KISEKPEFILK

SEQ ID NO: 6728 - protein, 11 aa, Borrelia garinii
ISEKPEFILKA

SEQ ID NO: 6729 - protein, 11 aa, Borrelia garinii
SEKPEFILKAK

SEQ ID NO: 6730 - protein, 11 aa, Borrelia garinii
EKPEFILKAKI

SEQ ID NO: 6731 - protein, 11 aa, Borrelia garinii
KPEFILKAKIK

SEQ ID NO: 6732 - protein, 11 aa, Borrelia garinii
PEFILKAKIKA

SEQ ID NO: 6733 - protein, 11 aa, Borrelia garinii
EFILKAKIKAI

SEQ ID NO: 6734 - protein, 11 aa, Borrelia garinii
FILKAKIKAIQ

SEQ ID NO: 6735 - protein, 11 aa, Borrelia garinii
ILKAKIKAIQV

SEQ ID NO: 6736 - protein, 11 aa, Borrelia garinii
LKAKIKAIQVA

SEQ ID NO: 6737 - protein, 11 aa, Borrelia garinii
KAKIKAIQVAE

SEQ ID NO: 6738 - protein, 11 aa, Borrelia garinii
AKIKAIQVAER

SEQ ID NO: 6739 - protein, 11 aa, Borrelia garinii
KIKAIQVAERF

SEQ ID NO: 6740 - protein, 11 aa, Borrelia garinii
IKAIQVAERFV

SEQ ID NO: 6741 - protein, 11 aa, Borrelia garinii
KAIQVAERFVK

SEQ ID NO: 6742 - protein, 11 aa, Borrelia garinii
AIQVAERFVKA

SEQ ID NO: 6743 - protein, 11 aa, Borrelia garinii
IQVAERFVKAI

SEQ ID NO: 6744 - protein, 11 aa, Borrelia garinii
QVAERFVKAIK

SEQ ID NO: 6745 - protein, 11 aa, Borrelia garinii
VAERFVKAIKE

SEQ ID NO: 6746 - protein, 11 aa, Borrelia garinii
AERFVKAIKEE

SEQ ID NO: 6747 - protein, 11 aa, Borrelia garinii
ERFVKAIKEEA

SEQ ID NO: 6748 - protein, 11 aa, Borrelia garinii
RFVKAIKEEAE

SEQ ID NO: 6749 - protein, 11 aa, Borrelia garinii
FVKAIKEEAEK

SEQ ID NO: 6750 - protein, 11 aa, Borrelia garinii
VKAIKEEAEKL

SEQ ID NO: 6751 - protein, 11 aa, Borrelia garinii
KAIKEEAEKLK

SEQ ID NO: 6752 - protein, 11 aa, Borrelia garinii
AIKEEAEKLKK

SEQ ID NO: 6753 - protein, 11 aa, Borrelia garinii
IKEEAEKLKKS

SEQ ID NO: 6754 - protein, 11 aa, Borrelia garinii
KEEAEKLKKSG

SEQ ID NO: 6755 - protein, 11 aa, Borrelia garinii
EEAEKLKKSGS

SEQ ID NO: 6756 - protein, 11 aa, Borrelia garinii
EAEKLKKSGSS

SEQ ID NO: 6757 - protein, 11 aa, Borrelia garinii
AEKLKKSGSSG

SEQ ID NO: 6758 - protein, 11 aa, Borrelia garinii
EKLKKSGSSGA

SEQ ID NO: 6759 - protein, 11 aa, Borrelia garinii
KLKKSGSSGAF

SEQ ID NO: 6760 - protein, 11 aa, Borrelia garinii
LKKSGSSGAFS

SEQ ID NO: 6761 - protein, 11 aa, Borrelia garinii
KKSGSSGAFSA

SEQ ID NO: 6762 - protein, 11 aa, Borrelia garinii
KSGSSGAFSAM

SEQ ID NO: 6763 - protein, 11 aa, Borrelia garinii
SGSSGAFSAMY

SEQ ID NO: 6764 - protein, 11 aa, Borrelia garinii
GSSGAFSAMYD

SEQ ID NO: 6765 - protein, 11 aa, Borrelia garinii
SSGAFSAMYDL

SEQ ID NO: 6766 - protein, 11 aa, Borrelia garinii
SGAFSAMYDLM

SEQ ID NO: 6767 - protein, 11 aa, Borrelia garinii
GAFSAMYDLMI

SEQ ID NO: 6768 - protein, 11 aa, Borrelia garinii
AFSAMYDLMID

SEQ ID NO: 6769 - protein, 11 aa, Borrelia garinii
FSAMYDLMIDV

SEQ ID NO: 6770 - protein, 11 aa, Borrelia garinii
SAMYDLMIDVS

SEQ ID NO: 6771 - protein, 11 aa, Borrelia garinii
AMYDLMIDVSK

SEQ ID NO: 6772 - protein, 11 aa, Borrelia garinii
MYDLMIDVSKP

SEQ ID NO: 6773 - protein, 11 aa, Borrelia garinii
YDLMIDVSKPL

SEQ ID NO: 6774 - protein, 11 aa, Borrelia garinii
DLMIDVSKPLE

SEQ ID NO: 6775 - protein, 11 aa, Borrelia garinii
LMIDVSKPLEE

SEQ ID NO: 6776 - protein, 11 aa, Borrelia garinii
MIDVSKPLEEI

SEQ ID NO: 6777 - protein, 11 aa, Borrelia garinii
IDVSKPLEEIG

SEQ ID NO: 6778 - protein, 11 aa, Borrelia garinii
DVSKPLEEIGI

SEQ ID NO: 6779 - protein, 11 aa, Borrelia garinii
VSKPLEEIGIQ

SEQ ID NO: 6780 - protein, 11 aa, Borrelia garinii
SKPLEEIGIQK

SEQ ID NO: 6781 - protein, 11 aa, Borrelia garinii
KPLEEIGIQKM

SEQ ID NO: 6782 - protein, 11 aa, Borrelia garinii
PLEEIGIQKMT

SEQ ID NO: 6783 - protein, 11 aa, Borrelia garinii
LEEIGIQKMTG

SEQ ID NO: 6784 - protein, 11 aa, Borrelia garinii
EEIGIQKMTGT

SEQ ID NO: 6785 - protein, 11 aa, Borrelia garinii
EIGIQKMTGTV

SEQ ID NO: 6786 - protein, 11 aa, Borrelia garinii
IGIQKMTGTVT

SEQ ID NO: 6787 - protein, 11 aa, Borrelia garinii
GIQKMTGTVTK

SEQ ID NO: 6788 - protein, 11 aa, Borrelia garinii
IQKMTGTVTKE

SEQ ID NO: 6789 - protein, 11 aa, Borrelia garinii
QKMTGTVTKEA

SEQ ID NO: 6790 - protein, 11 aa, Borrelia garinii
KMTGTVTKEAE

SEQ ID NO: 6791 - protein, 11 aa, Borrelia garinii
MTGTVTKEAEK

SEQ ID NO: 6792 - protein, 11 aa, Borrelia garinii
TGTVTKEAEKT

SEQ ID NO: 6793 - protein, 11 aa, Borrelia garinii
GTVTKEAEKTP

SEQ ID NO: 6794 - protein, 11 aa, Borrelia garinii
TVTKEAEKTPP

SEQ ID NO: 6795 - protein, 11 aa, Borrelia garinii
VTKEAEKTPPT

SEQ ID NO: 6796 - protein, 11 aa, Borrelia garinii
TKEAEKTPPTT

SEQ ID NO: 6797 - protein, 11 aa, Borrelia garinii
KEAEKTPPTTA

SEQ ID NO: 6798 - protein, 11 aa, Borrelia garinii
EAEKTPPTTAD

SEQ ID NO: 6799 - protein, 11 aa, Borrelia garinii
AEKTPPTTADG

SEQ ID NO: 6800 - protein, 11 aa, Borrelia garinii
EKTPPTTADGI

SEQ ID NO: 6801 - protein, 11 aa, Borrelia garinii
KTPPTTADGII

SEQ ID NO: 6802 - protein, 11 aa, Borrelia garinii
TPPTTADGIIA

SEQ ID NO: 6803 - protein, 11 aa, Borrelia garinii
PPTTADGIIAI

SEQ ID NO: 6804 - protein, 11 aa, Borrelia garinii
PTTADGIIAIA

SEQ ID NO: 6805 - protein, 11 aa, Borrelia garinii
TTADGIIAIAQ

SEQ ID NO: 6806 - protein, 11 aa, Borrelia garinii
TADGIIAIAQA

SEQ ID NO: 6807 - protein, 11 aa, Borrelia garinii
ADGIIAIAQAM

SEQ ID NO: 6808 - protein, 11 aa, Borrelia garinii
DGIIAIAQAME

SEQ ID NO: 6809 - protein, 11 aa, Borrelia garinii
GIIAIAQAMEE

SEQ ID NO: 6810 - protein, 11 aa, Borrelia garinii
IIAIAQAMEEK

SEQ ID NO: 6811 - protein, 11 aa, Borrelia garinii
IAIAQAMEEKL

SEQ ID NO: 6812 - protein, 11 aa, Borrelia garinii
AIAQAMEEKLN

SEQ ID NO: 6813 - protein, 11 aa, Borrelia garinii
IAQAMEEKLNN

SEQ ID NO: 6814 - protein, 11 aa, Borrelia garinii
AQAMEEKLNNV

SEQ ID NO: 6815 - protein, 11 aa, Borrelia garinii
QAMEEKLNNVN

SEQ ID NO: 6816 - protein, 11 aa, Borrelia garinii
AMEEKLNNVNK

SEQ ID NO: 6817 - protein, 11 aa, Borrelia garinii
MEEKLNNVNKK

SEQ ID NO: 6818 - protein, 11 aa, Borrelia garinii
EEKLNNVNKKQ

SEQ ID NO: 6819 - protein, 11 aa, Borrelia garinii
EKLNNVNKKQH

SEQ ID NO: 6820 - protein, 11 aa, Borrelia garinii
KLNNVNKKQHD

SEQ ID NO: 6821 - protein, 11 aa, Borrelia garinii
LNNVNKKQHDA

SEQ ID NO: 6822 - protein, 11 aa, Borrelia garinii
NNVNKKQHDAL

SEQ ID NO: 6823 - protein, 11 aa, Borrelia garinii
NVNKKQHDALK

SEQ ID NO: 6824 - protein, 11 aa, Borrelia garinii
VNKKQHDALKN

SEQ ID NO: 6825 - protein, 11 aa, Borrelia garinii
NKKQHDALKNL

SEQ ID NO: 6826 - protein, 11 aa, Borrelia garinii
KKQHDALKNLE

SEQ ID NO: 6827 - protein, 11 aa, Borrelia garinii
KQHDALKNLEE

SEQ ID NO: 6828 - protein, 11 aa, Borrelia garinii
QHDALKNLEEK

SEQ ID NO: 6829 - protein, 11 aa, Borrelia garinii
HDALKNLEEKA

SEQ ID NO: 6830 - protein, 11 aa, Borrelia garinii
DALKNLEEKAN

SEQ ID NO: 6831 - protein, 11 aa, Borrelia garinii
ALKNLEEKANT

SEQ ID NO: 6832 - protein, 11 aa, Borrelia garinii
LKNLEEKANTA

SEQ ID NO: 6833 - protein, 11 aa, Borrelia garinii
KNLEEKANTAA

SEQ ID NO: 6834 - protein, 11 aa, Borrelia garinii
NLEEKANTAAT

SEQ ID NO: 6835 - protein, 11 aa, Borrelia garinii
LEEKANTAATT

SEQ ID NO: 6836 - protein, 11 aa, Borrelia garinii
EEKANTAATTT

SEQ ID NO: 6837 - protein, 8 aa, Borrelia burgdorferi
SIVIALFF

SEQ ID NO: 6838 - protein, 8 aa, Borrelia burgdorferi
IVIALFFK

SEQ ID NO: 6839 - protein, 8 aa, Borrelia burgdorferi
VIALFFKL

SEQ ID NO: 6840 - protein, 8 aa, Borrelia burgdorferi
IALFFKLL

SEQ ID NO: 6841 - protein, 8 aa, Borrelia burgdorferi
ALFFKLLV

SEQ ID NO: 6842 - protein, 8 aa, Borrelia burgdorferi
LFFKLLVA

SEQ ID NO: 6843 - protein, 8 aa, Borrelia burgdorferi
FFKLLVAC

SEQ ID NO: 6844 - protein, 8 aa, Borrelia burgdorferi
FKLLVACS

SEQ ID NO: 6845 - protein, 8 aa, Borrelia burgdorferi
KLLVACSI

SEQ ID NO: 6846 - protein, 8 aa, Borrelia burgdorferi
LLVACSIG

SEQ ID NO: 6847 - protein, 8 aa, Borrelia burgdorferi
LVACSIGL

SEQ ID NO: 6848 - protein, 8 aa, Borrelia burgdorferi
VACSIGLV

SEQ ID NO: 6849 - protein, 8 aa, Borrelia burgdorferi
ACSIGLVE

SEQ ID NO: 6850 - protein, 8 aa, Borrelia burgdorferi
CSIGLVER

SEQ ID NO: 6851 - protein, 8 aa, Borrelia burgdorferi
SIGLVERT

SEQ ID NO: 6852 - protein, 8 aa, Borrelia burgdorferi
IGLVERTN

SEQ ID NO: 6853 - protein, 8 aa, Borrelia burgdorferi
GLVERTNA

SEQ ID NO: 6854 - protein, 8 aa, Borrelia burgdorferi
LVERTNAA

SEQ ID NO: 6855 - protein, 8 aa, Borrelia burgdorferi
VERTNAAL

SEQ ID NO: 6856 - protein, 8 aa, Borrelia burgdorferi
ERTNAALE

SEQ ID NO: 6857 - protein, 8 aa, Borrelia burgdorferi
RTNAALES

SEQ ID NO: 6858 - protein, 8 aa, Borrelia burgdorferi
TNAALESS

SEQ ID NO: 6859 - protein, 8 aa, Borrelia burgdorferi
NAALESSS

SEQ ID NO: 6860 - protein, 8 aa, Borrelia burgdorferi
AALESSSK

SEQ ID NO: 6861 - protein, 8 aa, Borrelia burgdorferi
ALESSSKD

SEQ ID NO: 6862 - protein, 8 aa, Borrelia burgdorferi
LESSSKDL

SEQ ID NO: 6863 - protein, 8 aa, Borrelia burgdorferi
ESSSKDLK

SEQ ID NO: 6864 - protein, 8 aa, Borrelia burgdorferi
SSSKDLKN

SEQ ID NO: 6865 - protein, 8 aa, Borrelia burgdorferi
SSKDLKNK

SEQ ID NO: 6866 - protein, 8 aa, Borrelia burgdorferi
SKDLKNKI

SEQ ID NO: 6867 - protein, 8 aa, Borrelia burgdorferi
KDLKNKIL

SEQ ID NO: 6868 - protein, 8 aa, Borrelia burgdorferi
DLKNKILK

SEQ ID NO: 6869 - protein, 8 aa, Borrelia burgdorferi
LKNKILKI

SEQ ID NO: 6870 - protein, 8 aa, Borrelia burgdorferi
KNKILKIK

SEQ ID NO: 6871 - protein, 8 aa, Borrelia burgdorferi
NKILKIKK

SEQ ID NO: 6872 - protein, 8 aa, Borrelia burgdorferi
KILKIKKE

SEQ ID NO: 6873 - protein, 8 aa, Borrelia burgdorferi
ILKIKKEA

SEQ ID NO: 6874 - protein, 8 aa, Borrelia burgdorferi
LKIKKEAT

SEQ ID NO: 6875 - protein, 8 aa, Borrelia burgdorferi
KIKKEATG

SEQ ID NO: 6876 - protein, 8 aa, Borrelia burgdorferi
IKKEATGK

SEQ ID NO: 6877 - protein, 8 aa, Borrelia burgdorferi
KKEATGKG

SEQ ID NO: 6878 - protein, 8 aa, Borrelia burgdorferi
KEATGKGV

SEQ ID NO: 6879 - protein, 8 aa, Borrelia burgdorferi
EATGKGVL

SEQ ID NO: 6880 - protein, 8 aa, Borrelia burgdorferi
ATGKGVLF

SEQ ID NO: 6881 - protein, 8 aa, Borrelia burgdorferi
TGKGVLFE

SEQ ID NO: 6882 - protein, 8 aa, Borrelia burgdorferi
GKGVLFEA

SEQ ID NO: 6883 - protein, 8 aa, Borrelia burgdorferi
KGVLFEAF

SEQ ID NO: 6884 - protein, 8 aa, Borrelia burgdorferi
GVLFEAFT

SEQ ID NO: 6885 - protein, 8 aa, Borrelia burgdorferi
VLFEAFTG

SEQ ID NO: 6886 - protein, 8 aa, Borrelia burgdorferi
LFEAFTGL

SEQ ID NO: 6887 - protein, 8 aa, Borrelia burgdorferi
FEAFTGLK

SEQ ID NO: 6888 - protein, 8 aa, Borrelia burgdorferi
EAFTGLKT

SEQ ID NO: 6889 - protein, 8 aa, Borrelia burgdorferi
AFTGLKTG

SEQ ID NO: 6890 - protein, 8 aa, Borrelia burgdorferi
FTGLKTGS

SEQ ID NO: 6891 - protein, 8 aa, Borrelia burgdorferi
TGLKTGSK

SEQ ID NO: 6892 - protein, 8 aa, Borrelia burgdorferi
GLKTGSKV

SEQ ID NO: 6893 - protein, 8 aa, Borrelia burgdorferi
LKTGSKVT

SEQ ID NO: 6894 - protein, 8 aa, Borrelia burgdorferi
KTGSKVTS

SEQ ID NO: 6895 - protein, 8 aa, Borrelia burgdorferi
TGSKVTSG

SEQ ID NO: 6896 - protein, 8 aa, Borrelia burgdorferi
GSKVTSGG

SEQ ID NO: 6897 - protein, 8 aa, Borrelia burgdorferi
SKVTSGGL

SEQ ID NO: 6898 - protein, 8 aa, Borrelia burgdorferi
KVTSGGLA

SEQ ID NO: 6899 - protein, 8 aa, Borrelia burgdorferi
VTSGGLAL

SEQ ID NO: 6900 - protein, 8 aa, Borrelia burgdorferi
TSGGLALR

SEQ ID NO: 6901 - protein, 8 aa, Borrelia burgdorferi
SGGLALRE

SEQ ID NO: 6902 - protein, 8 aa, Borrelia burgdorferi
GGLALREA

SEQ ID NO: 6903 - protein, 8 aa, Borrelia burgdorferi
GLALREAK

SEQ ID NO: 6904 - protein, 8 aa, Borrelia burgdorferi
LALREAKV

SEQ ID NO: 6905 - protein, 8 aa, Borrelia burgdorferi
ALREAKVQ

SEQ ID NO: 6906 - protein, 8 aa, Borrelia burgdorferi
LREAKVQA

SEQ ID NO: 6907 - protein, 8 aa, Borrelia burgdorferi
REAKVQAI

SEQ ID NO: 6908 - protein, 8 aa, Borrelia burgdorferi
EAKVQAIV

SEQ ID NO: 6909 - protein, 8 aa, Borrelia burgdorferi
AKVQAIVE

SEQ ID NO: 6910 - protein, 8 aa, Borrelia burgdorferi
KVQAIVET

SEQ ID NO: 6911 - protein, 8 aa, Borrelia burgdorferi
VQAIVETG

SEQ ID NO: 6912 - protein, 8 aa, Borrelia burgdorferi
QAIVETGK

SEQ ID NO: 6913 - protein, 8 aa, Borrelia burgdorferi
AIVETGKF

SEQ ID NO: 6914 - protein, 8 aa, Borrelia burgdorferi
IVETGKFL

SEQ ID NO: 6915 - protein, 8 aa, Borrelia burgdorferi
VETGKFLK

SEQ ID NO: 6916 - protein, 8 aa, Borrelia burgdorferi
ETGKFLKI

SEQ ID NO: 6917 - protein, 8 aa, Borrelia burgdorferi
TGKFLKII

SEQ ID NO: 6918 - protein, 8 aa, Borrelia burgdorferi
GKFLKIIE

SEQ ID NO: 6919 - protein, 8 aa, Borrelia burgdorferi
KFLKIIEE

SEQ ID NO: 6920 - protein, 8 aa, Borrelia burgdorferi
FLKIIEEE

SEQ ID NO: 6921 - protein, 8 aa, Borrelia burgdorferi
LKIIEEEA

SEQ ID NO: 6922 - protein, 8 aa, Borrelia burgdorferi
KIIEEEAL

SEQ ID NO: 6923 - protein, 8 aa, Borrelia burgdorferi
IIEEEALK

SEQ ID NO: 6924 - protein, 8 aa, Borrelia burgdorferi
IEEEALKL

SEQ ID NO: 6925 - protein, 8 aa, Borrelia burgdorferi
EEEALKLK

SEQ ID NO: 6926 - protein, 8 aa, Borrelia burgdorferi
EEALKLKE

SEQ ID NO: 6927 - protein, 8 aa, Borrelia burgdorferi
EALKLKET

SEQ ID NO: 6928 - protein, 8 aa, Borrelia burgdorferi
ALKLKETG

SEQ ID NO: 6929 - protein, 8 aa, Borrelia burgdorferi
LKLKETGN

SEQ ID NO: 6930 - protein, 8 aa, Borrelia burgdorferi
KLKETGNS

SEQ ID NO: 6931 - protein, 8 aa, Borrelia burgdorferi
LKETGNSG

SEQ ID NO: 6932 - protein, 8 aa, Borrelia burgdorferi
KETGNSGQ

SEQ ID NO: 6933 - protein, 8 aa, Borrelia burgdorferi
ETGNSGQF

SEQ ID NO: 6934 - protein, 8 aa, Borrelia burgdorferi
TGNSGQFL

SEQ ID NO: 6935 - protein, 8 aa, Borrelia burgdorferi
GNSGQFLA

SEQ ID NO: 6936 - protein, 8 aa, Borrelia burgdorferi
NSGQFLAM

SEQ ID NO: 6937 - protein, 8 aa, Borrelia burgdorferi
SGQFLAMF

SEQ ID NO: 6938 - protein, 8 aa, Borrelia burgdorferi
GQFLAMFD

SEQ ID NO: 6939 - protein, 8 aa, Borrelia burgdorferi
QFLAMFDL

SEQ ID NO: 6940 - protein, 8 aa, Borrelia burgdorferi
FLAMFDLM

SEQ ID NO: 6941 - protein, 8 aa, Borrelia burgdorferi
LAMFDLML

SEQ ID NO: 6942 - protein, 8 aa, Borrelia burgdorferi
AMFDLMLE

SEQ ID NO: 6943 - protein, 8 aa, Borrelia burgdorferi
MFDLMLEV

SEQ ID NO: 6944 - protein, 8 aa, Borrelia burgdorferi
FDLMLEVV

SEQ ID NO: 6945 - protein, 8 aa, Borrelia burgdorferi
DLMLEVVE

SEQ ID NO: 6946 - protein, 8 aa, Borrelia burgdorferi
LMLEVVES

SEQ ID NO: 6947 - protein, 8 aa, Borrelia burgdorferi
MLEVVESL

SEQ ID NO: 6948 - protein, 8 aa, Borrelia burgdorferi
LEVVESLE

SEQ ID NO: 6949 - protein, 8 aa, Borrelia burgdorferi
EVVESLED

SEQ ID NO: 6950 - protein, 8 aa, Borrelia burgdorferi
VVESLEDV

SEQ ID NO: 6951 - protein, 8 aa, Borrelia burgdorferi
VESLEDVG

SEQ ID NO: 6952 - protein, 8 aa, Borrelia burgdorferi
ESLEDVGI

SEQ ID NO: 6953 - protein, 8 aa, Borrelia burgdorferi
SLEDVGII

SEQ ID NO: 6954 - protein, 8 aa, Borrelia burgdorferi
LEDVGIIG

SEQ ID NO: 6955 - protein, 8 aa, Borrelia burgdorferi
EDVGIIGL

SEQ ID NO: 6956 - protein, 8 aa, Borrelia burgdorferi
DVGIIGLK

SEQ ID NO: 6957 - protein, 8 aa, Borrelia burgdorferi
VGIIGLKA

SEQ ID NO: 6958 - protein, 8 aa, Borrelia burgdorferi
GIIGLKAR

SEQ ID NO: 6959 - protein, 8 aa, Borrelia burgdorferi
IIGLKARV

SEQ ID NO: 6960 - protein, 8 aa, Borrelia burgdorferi
IGLKARVL

SEQ ID NO: 6961 - protein, 8 aa, Borrelia burgdorferi
GLKARVLE

SEQ ID NO: 6962 - protein, 8 aa, Borrelia burgdorferi
LKARVLEE

SEQ ID NO: 6963 - protein, 8 aa, Borrelia burgdorferi
KARVLEES

SEQ ID NO: 6964 - protein, 8 aa, Borrelia burgdorferi
ARVLEESK

SEQ ID NO: 6965 - protein, 8 aa, Borrelia burgdorferi
RVLEESKN

SEQ ID NO: 6966 - protein, 8 aa, Borrelia burgdorferi
VLEESKNN

SEQ ID NO: 6967 - protein, 8 aa, Borrelia burgdorferi
LEESKNNP

SEQ ID NO: 6968 - protein, 8 aa, Borrelia burgdorferi
EESKNNPI

SEQ ID NO: 6969 - protein, 8 aa, Borrelia burgdorferi
ESKNNPIN

SEQ ID NO: 6970 - protein, 8 aa, Borrelia burgdorferi
SKNNPINT

SEQ ID NO: 6971 - protein, 8 aa, Borrelia burgdorferi
KNNPINTA

SEQ ID NO: 6972 - protein, 8 aa, Borrelia burgdorferi
NNPINTAE

SEQ ID NO: 6973 - protein, 8 aa, Borrelia burgdorferi
NPINTAER

SEQ ID NO: 6974 - protein, 8 aa, Borrelia burgdorferi
PINTAERL

SEQ ID NO: 6975 - protein, 8 aa, Borrelia burgdorferi
INTAERLL

SEQ ID NO: 6976 - protein, 8 aa, Borrelia burgdorferi
NTAERLLA

SEQ ID NO: 6977 - protein, 8 aa, Borrelia burgdorferi
TAERLLAA

SEQ ID NO: 6978 - protein, 8 aa, Borrelia burgdorferi
AERLLAAK

SEQ ID NO: 6979 - protein, 8 aa, Borrelia burgdorferi
ERLLAAKA

SEQ ID NO: 6980 - protein, 8 aa, Borrelia burgdorferi
RLLAAKAQ

SEQ ID NO: 6981 - protein, 8 aa, Borrelia burgdorferi
LLAAKAQI

SEQ ID NO: 6982 - protein, 8 aa, Borrelia burgdorferi
LAAKAQIE

SEQ ID NO: 6983 - protein, 8 aa, Borrelia burgdorferi
AAKAQIEN

SEQ ID NO: 6984 - protein, 8 aa, Borrelia burgdorferi
AKAQIENQ

SEQ ID NO: 6985 - protein, 8 aa, Borrelia burgdorferi
KAQIENQL

SEQ ID NO: 6986 - protein, 8 aa, Borrelia burgdorferi
AQIENQLK

SEQ ID NO: 6987 - protein, 8 aa, Borrelia burgdorferi
QIENQLKV

SEQ ID NO: 6988 - protein, 8 aa, Borrelia burgdorferi
IENQLKVV

SEQ ID NO: 6989 - protein, 8 aa, Borrelia burgdorferi
ENQLKVVK

SEQ ID NO: 6990 - protein, 8 aa, Borrelia burgdorferi
NQLKVVKE

SEQ ID NO: 6991 - protein, 8 aa, Borrelia burgdorferi
QLKVVKEK

SEQ ID NO: 6992 - protein, 8 aa, Borrelia burgdorferi
LKVVKEKQ

SEQ ID NO: 6993 - protein, 8 aa, Borrelia burgdorferi
KVVKEKQN

SEQ ID NO: 6994 - protein, 8 aa, Borrelia burgdorferi
VVKEKQNI

SEQ ID NO: 6995 - protein, 8 aa, Borrelia burgdorferi
VKEKQNIE

SEQ ID NO: 6996 - protein, 8 aa, Borrelia burgdorferi
KEKQNIEN

SEQ ID NO: 6997 - protein, 8 aa, Borrelia burgdorferi
EKQNIENG

SEQ ID NO: 6998 - protein, 8 aa, Borrelia burgdorferi
KQNIENGG

SEQ ID NO: 6999 - protein, 8 aa, Borrelia burgdorferi
QNIENGGE

SEQ ID NO: 7000 - protein, 8 aa, Borrelia burgdorferi
NIENGGEK

SEQ ID NO: 7001 - protein, 8 aa, Borrelia burgdorferi
IENGGEKK

SEQ ID NO: 7002 - protein, 8 aa, Borrelia burgdorferi
ENGGEKKN

SEQ ID NO: 7003 - protein, 8 aa, Borrelia burgdorferi
NGGEKKNN

SEQ ID NO: 7004 - protein, 8 aa, Borrelia burgdorferi
GGEKKNNK

SEQ ID NO: 7005 - protein, 8 aa, Borrelia burgdorferi
GEKKNNKS

SEQ ID NO: 7006 - protein, 8 aa, Borrelia burgdorferi
EKKNNKSK

SEQ ID NO: 7007 - protein, 8 aa, Borrelia burgdorferi
KKNNKSKK

SEQ ID NO: 7008 - protein, 8 aa, Borrelia burgdorferi
KNNKSKKK

SEQ ID NO: 7009 - protein, 8 aa, Borrelia burgdorferi
NNKSKKKK

SEQ ID NO: 7010 - protein, 9 aa, Borrelia burgdorferi
SIVIALFFK

SEQ ID NO: 7011 - protein, 9 aa, Borrelia burgdorferi
IVIALFFKL

SEQ ID NO: 7012 - protein, 9 aa, Borrelia burgdorferi
VIALFFKLL

SEQ ID NO: 7013 - protein, 9 aa, Borrelia burgdorferi
IALFFKLLV

SEQ ID NO: 7014 - protein, 9 aa, Borrelia burgdorferi
ALFFKLLVA

SEQ ID NO: 7015 - protein, 9 aa, Borrelia burgdorferi
LFFKLLVAC

SEQ ID NO: 7016 - protein, 9 aa, Borrelia burgdorferi
FFKLLVACS

SEQ ID NO: 7017 - protein, 9 aa, Borrelia burgdorferi
FKLLVACSI

SEQ ID NO: 7018 - protein, 9 aa, Borrelia burgdorferi
KLLVACSIG

SEQ ID NO: 7019 - protein, 9 aa, Borrelia burgdorferi
LLVACSIGL

SEQ ID NO: 7020 - protein, 9 aa, Borrelia burgdorferi
LVACSIGLV

SEQ ID NO: 7021 - protein, 9 aa, Borrelia burgdorferi
VACSIGLVE

SEQ ID NO: 7022 - protein, 9 aa, Borrelia burgdorferi
ACSIGLVER

SEQ ID NO: 7023 - protein, 9 aa, Borrelia burgdorferi
CSIGLVERT

SEQ ID NO: 7024 - protein, 9 aa, Borrelia burgdorferi
SIGLVERTN

SEQ ID NO: 7025 - protein, 9 aa, Borrelia burgdorferi
IGLVERTNA

SEQ ID NO: 7026 - protein, 9 aa, Borrelia burgdorferi
GLVERTNAA

SEQ ID NO: 7027 - protein, 9 aa, Borrelia burgdorferi
LVERTNAAL

SEQ ID NO: 7028 - protein, 9 aa, Borrelia burgdorferi
VERTNAALE

SEQ ID NO: 7029 - protein, 9 aa, Borrelia burgdorferi
ERTNAALES

SEQ ID NO: 7030 - protein, 9 aa, Borrelia burgdorferi
RTNAALESS

SEQ ID NO: 7031 - protein, 9 aa, Borrelia burgdorferi
TNAALESSS

SEQ ID NO: 7032 - protein, 9 aa, Borrelia burgdorferi
NAALESSSK

SEQ ID NO: 7033 - protein, 9 aa, Borrelia burgdorferi
AALESSSKD

SEQ ID NO: 7034 - protein, 9 aa, Borrelia burgdorferi
ALESSSKDL

SEQ ID NO: 7035 - protein, 9 aa, Borrelia burgdorferi
LESSSKDLK

SEQ ID NO: 7036 - protein, 9 aa, Borrelia burgdorferi
ESSSKDLKN

SEQ ID NO: 7037 - protein, 9 aa, Borrelia burgdorferi
SSSKDLKNK

SEQ ID NO: 7038 - protein, 9 aa, Borrelia burgdorferi
SSKDLKNKI

SEQ ID NO: 7039 - protein, 9 aa, Borrelia burgdorferi
SKDLKNKIL

SEQ ID NO: 7040 - protein, 9 aa, Borrelia burgdorferi
KDLKNKILK

SEQ ID NO: 7041 - protein, 9 aa, Borrelia burgdorferi
DLKNKILKI

SEQ ID NO: 7042 - protein, 9 aa, Borrelia burgdorferi
LKNKILKIK

SEQ ID NO: 7043 - protein, 9 aa, Borrelia burgdorferi
KNKILKIKK

SEQ ID NO: 7044 - protein, 9 aa, Borrelia burgdorferi
NKILKIKKE

SEQ ID NO: 7045 - protein, 9 aa, Borrelia burgdorferi
KILKIKKEA

SEQ ID NO: 7046 - protein, 9 aa, Borrelia burgdorferi
ILKIKKEAT

SEQ ID NO: 7047 - protein, 9 aa, Borrelia burgdorferi
LKIKKEATG

SEQ ID NO: 7048 - protein, 9 aa, Borrelia burgdorferi
KIKKEATGK

SEQ ID NO: 7049 - protein, 9 aa, Borrelia burgdorferi
IKKEATGKG

SEQ ID NO: 7050 - protein, 9 aa, Borrelia burgdorferi
KKEATGKGV

SEQ ID NO: 7051 - protein, 9 aa, Borrelia burgdorferi
KEATGKGVL

SEQ ID NO: 7052 - protein, 9 aa, Borrelia burgdorferi
EATGKGVLF

SEQ ID NO: 7053 - protein, 9 aa, Borrelia burgdorferi
ATGKGVLFE

SEQ ID NO: 7054 - protein, 9 aa, Borrelia burgdorferi
TGKGVLFEA

SEQ ID NO: 7055 - protein, 9 aa, Borrelia burgdorferi
GKGVLFEAF

SEQ ID NO: 7056 - protein, 9 aa, Borrelia burgdorferi
KGVLFEAFT

SEQ ID NO: 7057 - protein, 9 aa, Borrelia burgdorferi
GVLFEAFTG

SEQ ID NO: 7058 - protein, 9 aa, Borrelia burgdorferi
VLFEAFTGL

SEQ ID NO: 7059 - protein, 9 aa, Borrelia burgdorferi
LFEAFTGLK

SEQ ID NO: 7060 - protein, 9 aa, Borrelia burgdorferi
FEAFTGLKT

SEQ ID NO: 7061 - protein, 9 aa, Borrelia burgdorferi
EAFTGLKTG

SEQ ID NO: 7062 - protein, 9 aa, Borrelia burgdorferi
AFTGLKTGS

SEQ ID NO: 7063 - protein, 9 aa, Borrelia burgdorferi
FTGLKTGSK

SEQ ID NO: 7064 - protein, 9 aa, Borrelia burgdorferi
TGLKTGSKV

SEQ ID NO: 7065 - protein, 9 aa, Borrelia burgdorferi
GLKTGSKVT

SEQ ID NO: 7066 - protein, 9 aa, Borrelia burgdorferi
LKTGSKVTS

SEQ ID NO: 7067 - protein, 9 aa, Borrelia burgdorferi
KTGSKVTSG

SEQ ID NO: 7068 - protein, 9 aa, Borrelia burgdorferi
TGSKVTSGG

SEQ ID NO: 7069 - protein, 9 aa, Borrelia burgdorferi
GSKVTSGGL

SEQ ID NO: 7070 - protein, 9 aa, Borrelia burgdorferi
SKVTSGGLA

SEQ ID NO: 7071 - protein, 9 aa, Borrelia burgdorferi
KVTSGGLAL

SEQ ID NO: 7072 - protein, 9 aa, Borrelia burgdorferi
VTSGGLALR

SEQ ID NO: 7073 - protein, 9 aa, Borrelia burgdorferi
TSGGLALRE

SEQ ID NO: 7074 - protein, 9 aa, Borrelia burgdorferi
SGGLALREA

SEQ ID NO: 7075 - protein, 9 aa, Borrelia burgdorferi
GGLALREAK

SEQ ID NO: 7076 - protein, 9 aa, Borrelia burgdorferi
GLALREAKV

SEQ ID NO: 7077 - protein, 9 aa, Borrelia burgdorferi
LALREAKVQ

SEQ ID NO: 7078 - protein, 9 aa, Borrelia burgdorferi
ALREAKVQA

SEQ ID NO: 7079 - protein, 9 aa, Borrelia burgdorferi
LREAKVQAI

SEQ ID NO: 7080 - protein, 9 aa, Borrelia burgdorferi
REAKVQAIV

SEQ ID NO: 7081 - protein, 9 aa, Borrelia burgdorferi
EAKVQAIVE

SEQ ID NO: 7082 - protein, 9 aa, Borrelia burgdorferi
AKVQAIVET

SEQ ID NO: 7083 - protein, 9 aa, Borrelia burgdorferi
KVQAIVETG

SEQ ID NO: 7084 - protein, 9 aa, Borrelia burgdorferi
VQAIVETGK

SEQ ID NO: 7085 - protein, 9 aa, Borrelia burgdorferi
QAIVETGKF

SEQ ID NO: 7086 - protein, 9 aa, Borrelia burgdorferi
AIVETGKFL

SEQ ID NO: 7087 - protein, 9 aa, Borrelia burgdorferi
IVETGKFLK

SEQ ID NO: 7088 - protein, 9 aa, Borrelia burgdorferi
VETGKFLKI

SEQ ID NO: 7089 - protein, 9 aa, Borrelia burgdorferi
ETGKFLKII

SEQ ID NO: 7090 - protein, 9 aa, Borrelia burgdorferi
TGKFLKIIE

SEQ ID NO: 7091 - protein, 9 aa, Borrelia burgdorferi
GKFLKIIEE

SEQ ID NO: 7092 - protein, 9 aa, Borrelia burgdorferi
KFLKIIEEE

SEQ ID NO: 7093 - protein, 9 aa, Borrelia burgdorferi
FLKIIEEEA

SEQ ID NO: 7094 - protein, 9 aa, Borrelia burgdorferi
LKIIEEEAL

SEQ ID NO: 7095 - protein, 9 aa, Borrelia burgdorferi
KIIEEEALK

SEQ ID NO: 7096 - protein, 9 aa, Borrelia burgdorferi
IIEEEALKL

SEQ ID NO: 7097 - protein, 9 aa, Borrelia burgdorferi
IEEEALKLK

SEQ ID NO: 7098 - protein, 9 aa, Borrelia burgdorferi
EEEALKLKE

SEQ ID NO: 7099 - protein, 9 aa, Borrelia burgdorferi
EEALKLKET

SEQ ID NO: 7100 - protein, 9 aa, Borrelia burgdorferi
EALKLKETG

SEQ ID NO: 7101 - protein, 9 aa, Borrelia burgdorferi
ALKLKETGN

SEQ ID NO: 7102 - protein, 9 aa, Borrelia burgdorferi
LKLKETGNS

SEQ ID NO: 7103 - protein, 9 aa, Borrelia burgdorferi
KLKETGNSG

SEQ ID NO: 7104 - protein, 9 aa, Borrelia burgdorferi
LKETGNSGQ

SEQ ID NO: 7105 - protein, 9 aa, Borrelia burgdorferi
KETGNSGQF

SEQ ID NO: 7106 - protein, 9 aa, Borrelia burgdorferi
ETGNSGQFL

SEQ ID NO: 7107 - protein, 9 aa, Borrelia burgdorferi
TGNSGQFLA

SEQ ID NO: 7108 - protein, 9 aa, Borrelia burgdorferi
GNSGQFLAM

SEQ ID NO: 7109 - protein, 9 aa, Borrelia burgdorferi
NSGQFLAMF

SEQ ID NO: 7110 - protein, 9 aa, Borrelia burgdorferi
SGQFLAMFD

SEQ ID NO: 7111 - protein, 9 aa, Borrelia burgdorferi
GQFLAMFDL

SEQ ID NO: 7112 - protein, 9 aa, Borrelia burgdorferi
QFLAMFDLM

SEQ ID NO: 7113 - protein, 9 aa, Borrelia burgdorferi
FLAMFDLML

SEQ ID NO: 7114 - protein, 9 aa, Borrelia burgdorferi
LAMFDLMLE

SEQ ID NO: 7115 - protein, 9 aa, Borrelia burgdorferi
AMFDLMLEV

SEQ ID NO: 7116 - protein, 9 aa, Borrelia burgdorferi
MFDLMLEVV

SEQ ID NO: 7117 - protein, 9 aa, Borrelia burgdorferi
FDLMLEVVE

SEQ ID NO: 7118 - protein, 9 aa, Borrelia burgdorferi
DLMLEVVES

SEQ ID NO: 7119 - protein, 9 aa, Borrelia burgdorferi
LMLEVVESL

SEQ ID NO: 7120 - protein, 9 aa, Borrelia burgdorferi
MLEVVESLE

SEQ ID NO: 7121 - protein, 9 aa, Borrelia burgdorferi
LEVVESLED

SEQ ID NO: 7122 - protein, 9 aa, Borrelia burgdorferi
EVVESLEDV

SEQ ID NO: 7123 - protein, 9 aa, Borrelia burgdorferi
VVESLEDVG

SEQ ID NO: 7124 - protein, 9 aa, Borrelia burgdorferi
VESLEDVGI

SEQ ID NO: 7125 - protein, 9 aa, Borrelia burgdorferi
ESLEDVGII

SEQ ID NO: 7126 - protein, 9 aa, Borrelia burgdorferi
SLEDVGIIG

SEQ ID NO: 7127 - protein, 9 aa, Borrelia burgdorferi
LEDVGIIGL

SEQ ID NO: 7128 - protein, 9 aa, Borrelia burgdorferi
EDVGIIGLK

SEQ ID NO: 7129 - protein, 9 aa, Borrelia burgdorferi
DVGIIGLKA

SEQ ID NO: 7130 - protein, 9 aa, Borrelia burgdorferi
VGIIGLKAR

SEQ ID NO: 7131 - protein, 9 aa, Borrelia burgdorferi
GIIGLKARV

SEQ ID NO: 7132 - protein, 9 aa, Borrelia burgdorferi
IIGLKARVL

SEQ ID NO: 7133 - protein, 9 aa, Borrelia burgdorferi
IGLKARVLE

SEQ ID NO: 7134 - protein, 9 aa, Borrelia burgdorferi
GLKARVLEE

SEQ ID NO: 7135 - protein, 9 aa, Borrelia burgdorferi
LKARVLEES

SEQ ID NO: 7136 - protein, 9 aa, Borrelia burgdorferi
KARVLEESK

SEQ ID NO: 7137 - protein, 9 aa, Borrelia burgdorferi
ARVLEESKN

SEQ ID NO: 7138 - protein, 9 aa, Borrelia burgdorferi
RVLEESKNN

SEQ ID NO: 7139 - protein, 9 aa, Borrelia burgdorferi
VLEESKNNP

SEQ ID NO: 7140 - protein, 9 aa, Borrelia burgdorferi
LEESKNNPI

SEQ ID NO: 7141 - protein, 9 aa, Borrelia burgdorferi
EESKNNPIN

SEQ ID NO: 7142 - protein, 9 aa, Borrelia burgdorferi
ESKNNPINT

SEQ ID NO: 7143 - protein, 9 aa, Borrelia burgdorferi
SKNNPINTA

SEQ ID NO: 7144 - protein, 9 aa, Borrelia burgdorferi
KNNPINTAE

SEQ ID NO: 7145 - protein, 9 aa, Borrelia burgdorferi
NNPINTAER

SEQ ID NO: 7146 - protein, 9 aa, Borrelia burgdorferi
NPINTAERL

SEQ ID NO: 7147 - protein, 9 aa, Borrelia burgdorferi
PINTAERLL

SEQ ID NO: 7148 - protein, 9 aa, Borrelia burgdorferi
INTAERLLA

SEQ ID NO: 7149 - protein, 9 aa, Borrelia burgdorferi
NTAERLLAA

SEQ ID NO: 7150 - protein, 9 aa, Borrelia burgdorferi
TAERLLAAK

SEQ ID NO: 7151 - protein, 9 aa, Borrelia burgdorferi
AERLLAAKA

SEQ ID NO: 7152 - protein, 9 aa, Borrelia burgdorferi
ERLLAAKAQ

SEQ ID NO: 7153 - protein, 9 aa, Borrelia burgdorferi
RLLAAKAQI

SEQ ID NO: 7154 - protein, 9 aa, Borrelia burgdorferi
LLAAKAQIE

SEQ ID NO: 7155 - protein, 9 aa, Borrelia burgdorferi
LAAKAQIEN

SEQ ID NO: 7156 - protein, 9 aa, Borrelia burgdorferi
AAKAQIENQ

SEQ ID NO: 7157 - protein, 9 aa, Borrelia burgdorferi
AKAQIENQL

SEQ ID NO: 7158 - protein, 9 aa, Borrelia burgdorferi
KAQIENQLK

SEQ ID NO: 7159 - protein, 9 aa, Borrelia burgdorferi
AQIENQLKV

SEQ ID NO: 7160 - protein, 9 aa, Borrelia burgdorferi
QIENQLKVV

SEQ ID NO: 7161 - protein, 9 aa, Borrelia burgdorferi
IENQLKVVK

SEQ ID NO: 7162 - protein, 9 aa, Borrelia burgdorferi
ENQLKVVKE

SEQ ID NO: 7163 - protein, 9 aa, Borrelia burgdorferi
NQLKVVKEK

SEQ ID NO: 7164 - protein, 9 aa, Borrelia burgdorferi
QLKVVKEKQ

SEQ ID NO: 7165 - protein, 9 aa, Borrelia burgdorferi
LKVVKEKQN

SEQ ID NO: 7166 - protein, 9 aa, Borrelia burgdorferi
KVVKEKQNI

SEQ ID NO: 7167 - protein, 9 aa, Borrelia burgdorferi
VVKEKQNIE

SEQ ID NO: 7168 - protein, 9 aa, Borrelia burgdorferi
VKEKQNIEN

SEQ ID NO: 7169 - protein, 9 aa, Borrelia burgdorferi
KEKQNIENG

SEQ ID NO: 7170 - protein, 9 aa, Borrelia burgdorferi
EKQNIENGG

SEQ ID NO: 7171 - protein, 9 aa, Borrelia burgdorferi
KQNIENGGE

SEQ ID NO: 7172 - protein, 9 aa, Borrelia burgdorferi
QNIENGGEK

SEQ ID NO: 7173 - protein, 9 aa, Borrelia burgdorferi
NIENGGEKK

SEQ ID NO: 7174 - protein, 9 aa, Borrelia burgdorferi
IENGGEKKN

SEQ ID NO: 7175 - protein, 9 aa, Borrelia burgdorferi
ENGGEKKNN

SEQ ID NO: 7176 - protein, 9 aa, Borrelia burgdorferi
NGGEKKNNK

SEQ ID NO: 7177 - protein, 9 aa, Borrelia burgdorferi
GGEKKNNKS

SEQ ID NO: 7178 - protein, 9 aa, Borrelia burgdorferi
GEKKNNKSK

SEQ ID NO: 7179 - protein, 9 aa, Borrelia burgdorferi
EKKNNKSKK

SEQ ID NO: 7180 - protein, 9 aa, Borrelia burgdorferi
KKNNKSKKK

SEQ ID NO: 7181 - protein, 9 aa, Borrelia burgdorferi
KNNKSKKKK

SEQ ID NO: 7182 - protein, 10 aa, Borrelia burgdorferi
SIVIALFFKL

SEQ ID NO: 7183 - protein, 10 aa, Borrelia burgdorferi
IVIALFFKLL

SEQ ID NO: 7184 - protein, 10 aa, Borrelia burgdorferi
VIALFFKLLV

SEQ ID NO: 7185 - protein, 10 aa, Borrelia burgdorferi
IALFFKLLVA

SEQ ID NO: 7186 - protein, 10 aa, Borrelia burgdorferi
ALFFKLLVAC

SEQ ID NO: 7187 - protein, 10 aa, Borrelia burgdorferi
LFFKLLVACS

SEQ ID NO: 7188 - protein, 10 aa, Borrelia burgdorferi
FFKLLVACSI

SEQ ID NO: 7189 - protein, 10 aa, Borrelia burgdorferi
FKLLVACSIG

SEQ ID NO: 7190 - protein, 10 aa, Borrelia burgdorferi
KLLVACSIGL

SEQ ID NO: 7191 - protein, 10 aa, Borrelia burgdorferi
LLVACSIGLV

SEQ ID NO: 7192 - protein, 10 aa, Borrelia burgdorferi
LVACSIGLVE

SEQ ID NO: 7193 - protein, 10 aa, Borrelia burgdorferi
VACSIGLVER

SEQ ID NO: 7194 - protein, 10 aa, Borrelia burgdorferi
ACSIGLVERT

SEQ ID NO: 7195 - protein, 10 aa, Borrelia burgdorferi
CSIGLVERTN

SEQ ID NO: 7196 - protein, 10 aa, Borrelia burgdorferi
SIGLVERTNA

SEQ ID NO: 7197 - protein, 10 aa, Borrelia burgdorferi
IGLVERTNAA

SEQ ID NO: 7198 - protein, 10 aa, Borrelia burgdorferi
GLVERTNAAL

SEQ ID NO: 7199 - protein, 10 aa, Borrelia burgdorferi
LVERTNAALE

SEQ ID NO: 7200 - protein, 10 aa, Borrelia burgdorferi
VERTNAALES

SEQ ID NO: 7201 - protein, 10 aa, Borrelia burgdorferi
ERTNAALESS

SEQ ID NO: 7202 - protein, 10 aa, Borrelia burgdorferi
RTNAALESSS

SEQ ID NO: 7203 - protein, 10 aa, Borrelia burgdorferi
TNAALESSSK

SEQ ID NO: 7204 - protein, 10 aa, Borrelia burgdorferi
NAALESSSKD

SEQ ID NO: 7205 - protein, 10 aa, Borrelia burgdorferi
AALESSSKDL

SEQ ID NO: 7206 - protein, 10 aa, Borrelia burgdorferi
ALESSSKDLK

SEQ ID NO: 7207 - protein, 10 aa, Borrelia burgdorferi
LESSSKDLKN

SEQ ID NO: 7208 - protein, 10 aa, Borrelia burgdorferi
ESSSKDLKNK

SEQ ID NO: 7209 - protein, 10 aa, Borrelia burgdorferi
SSSKDLKNKI

SEQ ID NO: 7210 - protein, 10 aa, Borrelia burgdorferi
SSKDLKNKIL

SEQ ID NO: 7211 - protein, 10 aa, Borrelia burgdorferi
SKDLKNKILK

SEQ ID NO: 7212 - protein, 10 aa, Borrelia burgdorferi
KDLKNKILKI

SEQ ID NO: 7213 - protein, 10 aa, Borrelia burgdorferi
DLKNKILKIK

SEQ ID NO: 7214 - protein, 10 aa, Borrelia burgdorferi
LKNKILKIKK

SEQ ID NO: 7215 - protein, 10 aa, Borrelia burgdorferi
KNKILKIKKE

SEQ ID NO: 7216 - protein, 10 aa, Borrelia burgdorferi
NKILKIKKEA

SEQ ID NO: 7217 - protein, 10 aa, Borrelia burgdorferi
KILKIKKEAT

SEQ ID NO: 7218 - protein, 10 aa, Borrelia burgdorferi
ILKIKKEATG

SEQ ID NO: 7219 - protein, 10 aa, Borrelia burgdorferi
LKIKKEATGK

SEQ ID NO: 7220 - protein, 10 aa, Borrelia burgdorferi
KIKKEATGKG

SEQ ID NO: 7221 - protein, 10 aa, Borrelia burgdorferi
IKKEATGKGV

SEQ ID NO: 7222 - protein, 10 aa, Borrelia burgdorferi
KKEATGKGVL

SEQ ID NO: 7223 - protein, 10 aa, Borrelia burgdorferi
KEATGKGVLF

SEQ ID NO: 7224 - protein, 10 aa, Borrelia burgdorferi
EATGKGVLFE

SEQ ID NO: 7225 - protein, 10 aa, Borrelia burgdorferi
ATGKGVLFEA

SEQ ID NO: 7226 - protein, 10 aa, Borrelia burgdorferi
TGKGVLFEAF

SEQ ID NO: 7227 - protein, 10 aa, Borrelia burgdorferi
GKGVLFEAFT

SEQ ID NO: 7228 - protein, 10 aa, Borrelia burgdorferi
KGVLFEAFTG

SEQ ID NO: 7229 - protein, 10 aa, Borrelia burgdorferi
GVLFEAFTGL

SEQ ID NO: 7230 - protein, 10 aa, Borrelia burgdorferi
VLFEAFTGLK

SEQ ID NO: 7231 - protein, 10 aa, Borrelia burgdorferi
LFEAFTGLKT

SEQ ID NO: 7232 - protein, 10 aa, Borrelia burgdorferi
FEAFTGLKTG

SEQ ID NO: 7233 - protein, 10 aa, Borrelia burgdorferi
EAFTGLKTGS

SEQ ID NO: 7234 - protein, 10 aa, Borrelia burgdorferi
AFTGLKTGSK

SEQ ID NO: 7235 - protein, 10 aa, Borrelia burgdorferi
FTGLKTGSKV

SEQ ID NO: 7236 - protein, 10 aa, Borrelia burgdorferi
TGLKTGSKVT

SEQ ID NO: 7237 - protein, 10 aa, Borrelia burgdorferi
GLKTGSKVTS

SEQ ID NO: 7238 - protein, 10 aa, Borrelia burgdorferi
LKTGSKVTSG

SEQ ID NO: 7239 - protein, 10 aa, Borrelia burgdorferi
KTGSKVTSGG

SEQ ID NO: 7240 - protein, 10 aa, Borrelia burgdorferi
TGSKVTSGGL

SEQ ID NO: 7241 - protein, 10 aa, Borrelia burgdorferi
GSKVTSGGLA

SEQ ID NO: 7242 - protein, 10 aa, Borrelia burgdorferi
SKVTSGGLAL

SEQ ID NO: 7243 - protein, 10 aa, Borrelia burgdorferi
KVTSGGLALR

SEQ ID NO: 7244 - protein, 10 aa, Borrelia burgdorferi
VTSGGLALRE

SEQ ID NO: 7245 - protein, 10 aa, Borrelia burgdorferi
TSGGLALREA

SEQ ID NO: 7246 - protein, 10 aa, Borrelia burgdorferi
SGGLALREAK

SEQ ID NO: 7247 - protein, 10 aa, Borrelia burgdorferi
GGLALREAKV

SEQ ID NO: 7248 - protein, 10 aa, Borrelia burgdorferi
GLALREAKVQ

SEQ ID NO: 7249 - protein, 10 aa, Borrelia burgdorferi
LALREAKVQA

SEQ ID NO: 7250 - protein, 10 aa, Borrelia burgdorferi
ALREAKVQAI

SEQ ID NO: 7251 - protein, 10 aa, Borrelia burgdorferi
LREAKVQAIV

SEQ ID NO: 7252 - protein, 10 aa, Borrelia burgdorferi
REAKVQAIVE

SEQ ID NO: 7253 - protein, 10 aa, Borrelia burgdorferi
EAKVQAIVET

SEQ ID NO: 7254 - protein, 10 aa, Borrelia burgdorferi
AKVQAIVETG

SEQ ID NO: 7255 - protein, 10 aa, Borrelia burgdorferi
KVQAIVETGK

SEQ ID NO: 7256 - protein, 10 aa, Borrelia burgdorferi
VQAIVETGKF

SEQ ID NO: 7257 - protein, 10 aa, Borrelia burgdorferi
QAIVETGKFL

SEQ ID NO: 7258 - protein, 10 aa, Borrelia burgdorferi
AIVETGKFLK

SEQ ID NO: 7259 - protein, 10 aa, Borrelia burgdorferi
IVETGKFLKI

SEQ ID NO: 7260 - protein, 10 aa, Borrelia burgdorferi
VETGKFLKII

SEQ ID NO: 7261 - protein, 10 aa, Borrelia burgdorferi
ETGKFLKIIE

SEQ ID NO: 7262 - protein, 10 aa, Borrelia burgdorferi
TGKFLKIIEE

SEQ ID NO: 7263 - protein, 10 aa, Borrelia burgdorferi
GKFLKIIEEE

SEQ ID NO: 7264 - protein, 10 aa, Borrelia burgdorferi
KFLKIIEEEA

SEQ ID NO: 7265 - protein, 10 aa, Borrelia burgdorferi
FLKIIEEEAL

SEQ ID NO: 7266 - protein, 10 aa, Borrelia burgdorferi
LKIIEEEALK

SEQ ID NO: 7267 - protein, 10 aa, Borrelia burgdorferi
KIIEEEALKL

SEQ ID NO: 7268 - protein, 10 aa, Borrelia burgdorferi
IIEEEALKLK

SEQ ID NO: 7269 - protein, 10 aa, Borrelia burgdorferi
IEEEALKLKE

SEQ ID NO: 7270 - protein, 10 aa, Borrelia burgdorferi
EEEALKLKET

SEQ ID NO: 7271 - protein, 10 aa, Borrelia burgdorferi
EEALKLKETG

SEQ ID NO: 7272 - protein, 10 aa, Borrelia burgdorferi
EALKLKETGN

SEQ ID NO: 7273 - protein, 10 aa, Borrelia burgdorferi
ALKLKETGNS

SEQ ID NO: 7274 - protein, 10 aa, Borrelia burgdorferi
LKLKETGNSG

SEQ ID NO: 7275 - protein, 10 aa, Borrelia burgdorferi
KLKETGNSGQ

SEQ ID NO: 7276 - protein, 10 aa, Borrelia burgdorferi
LKETGNSGQF

SEQ ID NO: 7277 - protein, 10 aa, Borrelia burgdorferi
KETGNSGQFL

SEQ ID NO: 7278 - protein, 10 aa, Borrelia burgdorferi
ETGNSGQFLA

SEQ ID NO: 7279 - protein, 10 aa, Borrelia burgdorferi
TGNSGQFLAM

SEQ ID NO: 7280 - protein, 10 aa, Borrelia burgdorferi
GNSGQFLAMF

SEQ ID NO: 7281 - protein, 10 aa, Borrelia burgdorferi
NSGQFLAMFD

SEQ ID NO: 7282 - protein, 10 aa, Borrelia burgdorferi
SGQFLAMFDL

SEQ ID NO: 7283 - protein, 10 aa, Borrelia burgdorferi
GQFLAMFDLM

SEQ ID NO: 7284 - protein, 10 aa, Borrelia burgdorferi
QFLAMFDLML

SEQ ID NO: 7285 - protein, 10 aa, Borrelia burgdorferi
FLAMFDLMLE

SEQ ID NO: 7286 - protein, 10 aa, Borrelia burgdorferi
LAMFDLMLEV

SEQ ID NO: 7287 - protein, 10 aa, Borrelia burgdorferi
AMFDLMLEVV

SEQ ID NO: 7288 - protein, 10 aa, Borrelia burgdorferi
MFDLMLEVVE

SEQ ID NO: 7289 - protein, 10 aa, Borrelia burgdorferi
FDLMLEVVES

SEQ ID NO: 7290 - protein, 10 aa, Borrelia burgdorferi
DLMLEVVESL

SEQ ID NO: 7291 - protein, 10 aa, Borrelia burgdorferi
LMLEVVESLE

SEQ ID NO: 7292 - protein, 10 aa, Borrelia burgdorferi
MLEVVESLED

SEQ ID NO: 7293 - protein, 10 aa, Borrelia burgdorferi
LEVVESLEDV

SEQ ID NO: 7294 - protein, 10 aa, Borrelia burgdorferi
EVVESLEDVG

SEQ ID NO: 7295 - protein, 10 aa, Borrelia burgdorferi
VVESLEDVGI

SEQ ID NO: 7296 - protein, 10 aa, Borrelia burgdorferi
VESLEDVGII

SEQ ID NO: 7297 - protein, 10 aa, Borrelia burgdorferi
ESLEDVGIIG

SEQ ID NO: 7298 - protein, 10 aa, Borrelia burgdorferi
SLEDVGIIGL

SEQ ID NO: 7299 - protein, 10 aa, Borrelia burgdorferi
LEDVGIIGLK

SEQ ID NO: 7300 - protein, 10 aa, Borrelia burgdorferi
EDVGIIGLKA

SEQ ID NO: 7301 - protein, 10 aa, Borrelia burgdorferi
DVGIIGLKAR

SEQ ID NO: 7302 - protein, 10 aa, Borrelia burgdorferi
VGIIGLKARV

SEQ ID NO: 7303 - protein, 10 aa, Borrelia burgdorferi
GIIGLKARVL

SEQ ID NO: 7304 - protein, 10 aa, Borrelia burgdorferi
IIGLKARVLE

SEQ ID NO: 7305 - protein, 10 aa, Borrelia burgdorferi
IGLKARVLEE

SEQ ID NO: 7306 - protein, 10 aa, Borrelia burgdorferi
GLKARVLEES

SEQ ID NO: 7307 - protein, 10 aa, Borrelia burgdorferi
LKARVLEESK

SEQ ID NO: 7308 - protein, 10 aa, Borrelia burgdorferi
KARVLEESKN

SEQ ID NO: 7309 - protein, 10 aa, Borrelia burgdorferi
ARVLEESKNN

SEQ ID NO: 7310 - protein, 10 aa, Borrelia burgdorferi
RVLEESKNNP

SEQ ID NO: 7311 - protein, 10 aa, Borrelia burgdorferi
VLEESKNNPI

SEQ ID NO: 7312 - protein, 10 aa, Borrelia burgdorferi
LEESKNNPIN

SEQ ID NO: 7313 - protein, 10 aa, Borrelia burgdorferi
EESKNNPINT

SEQ ID NO: 7314 - protein, 10 aa, Borrelia burgdorferi
ESKNNPINTA

SEQ ID NO: 7315 - protein, 10 aa, Borrelia burgdorferi
SKNNPINTAE

SEQ ID NO: 7316 - protein, 10 aa, Borrelia burgdorferi
KNNPINTAER

SEQ ID NO: 7317 - protein, 10 aa, Borrelia burgdorferi
NNPINTAERL

SEQ ID NO: 7318 - protein, 10 aa, Borrelia burgdorferi
NPINTAERLL

SEQ ID NO: 7319 - protein, 10 aa, Borrelia burgdorferi
PINTAERLLA

SEQ ID NO: 7320 - protein, 10 aa, Borrelia burgdorferi
INTAERLLAA

SEQ ID NO: 7321 - protein, 10 aa, Borrelia burgdorferi
NTAERLLAAK

SEQ ID NO: 7322 - protein, 10 aa, Borrelia burgdorferi
TAERLLAAKA

SEQ ID NO: 7323 - protein, 10 aa, Borrelia burgdorferi
AERLLAAKAQ

SEQ ID NO: 7324 - protein, 10 aa, Borrelia burgdorferi
ERLLAAKAQI

SEQ ID NO: 7325 - protein, 10 aa, Borrelia burgdorferi
RLLAAKAQIE

SEQ ID NO: 7326 - protein, 10 aa, Borrelia burgdorferi
LLAAKAQIEN

SEQ ID NO: 7327 - protein, 10 aa, Borrelia burgdorferi
LAAKAQIENQ

SEQ ID NO: 7328 - protein, 10 aa, Borrelia burgdorferi
AAKAQIENQL

SEQ ID NO: 7329 - protein, 10 aa, Borrelia burgdorferi
AKAQIENQLK

SEQ ID NO: 7330 - protein, 10 aa, Borrelia burgdorferi
KAQIENQLKV

SEQ ID NO: 7331 - protein, 10 aa, Borrelia burgdorferi
AQIENQLKVV

SEQ ID NO: 7332 - protein, 10 aa, Borrelia burgdorferi
QIENQLKVVK

SEQ ID NO: 7333 - protein, 10 aa, Borrelia burgdorferi
IENQLKVVKE

SEQ ID NO: 7334 - protein, 10 aa, Borrelia burgdorferi
ENQLKVVKEK

SEQ ID NO: 7335 - protein, 10 aa, Borrelia burgdorferi
NQLKVVKEKQ

SEQ ID NO: 7336 - protein, 10 aa, Borrelia burgdorferi
QLKVVKEKQN

SEQ ID NO: 7337 - protein, 10 aa, Borrelia burgdorferi
LKVVKEKQNI

SEQ ID NO: 7338 - protein, 10 aa, Borrelia burgdorferi
KVVKEKQNIE

SEQ ID NO: 7339 - protein, 10 aa, Borrelia burgdorferi
VVKEKQNIEN

SEQ ID NO: 7340 - protein, 10 aa, Borrelia burgdorferi
VKEKQNIENG

SEQ ID NO: 7341 - protein, 10 aa, Borrelia burgdorferi
KEKQNIENGG

SEQ ID NO: 7342 - protein, 10 aa, Borrelia burgdorferi
EKQNIENGGE

SEQ ID NO: 7343 - protein, 10 aa, Borrelia burgdorferi
KQNIENGGEK

SEQ ID NO: 7344 - protein, 10 aa, Borrelia burgdorferi
QNIENGGEKK

SEQ ID NO: 7345 - protein, 10 aa, Borrelia burgdorferi
NIENGGEKKN

SEQ ID NO: 7346 - protein, 10 aa, Borrelia burgdorferi
IENGGEKKNN

SEQ ID NO: 7347 - protein, 10 aa, Borrelia burgdorferi
ENGGEKKNNK

SEQ ID NO: 7348 - protein, 10 aa, Borrelia burgdorferi
NGGEKKNNKS

SEQ ID NO: 7349 - protein, 10 aa, Borrelia burgdorferi
GGEKKNNKSK

SEQ ID NO: 7350 - protein, 10 aa, Borrelia burgdorferi
GEKKNNKSKK

SEQ ID NO: 7351 - protein, 10 aa, Borrelia burgdorferi
EKKNNKSKKK

SEQ ID NO: 7352 - protein, 10 aa, Borrelia burgdorferi
KKNNKSKKKK

SEQ ID NO: 7353 - protein, 11 aa, Borrelia burgdorferi
SIVIALFFKLL

SEQ ID NO: 7354 - protein, 11 aa, Borrelia burgdorferi
IVIALFFKLLV

SEQ ID NO: 7355 - protein, 11 aa, Borrelia burgdorferi
VIALFFKLLVA

SEQ ID NO: 7356 - protein, 11 aa, Borrelia burgdorferi
IALFFKLLVAC

SEQ ID NO: 7357 - protein, 11 aa, Borrelia burgdorferi
ALFFKLLVACS

SEQ ID NO: 7358 - protein, 11 aa, Borrelia burgdorferi
LFFKLLVACSI

SEQ ID NO: 7359 - protein, 11 aa, Borrelia burgdorferi
FFKLLVACSIG

SEQ ID NO: 7360 - protein, 11 aa, Borrelia burgdorferi
FKLLVACSIGL

SEQ ID NO: 7361 - protein, 11 aa, Borrelia burgdorferi
KLLVACSIGLV

SEQ ID NO: 7362 - protein, 11 aa, Borrelia burgdorferi
LLVACSIGLVE

SEQ ID NO: 7363 - protein, 11 aa, Borrelia burgdorferi
LVACSIGLVER

SEQ ID NO: 7364 - protein, 11 aa, Borrelia burgdorferi
VACSIGLVERT

SEQ ID NO: 7365 - protein, 11 aa, Borrelia burgdorferi
ACSIGLVERTN

SEQ ID NO: 7366 - protein, 11 aa, Borrelia burgdorferi
CSIGLVERTNA

SEQ ID NO: 7367 - protein, 11 aa, Borrelia burgdorferi
SIGLVERTNAA

SEQ ID NO: 7368 - protein, 11 aa, Borrelia burgdorferi
IGLVERTNAAL

SEQ ID NO: 7369 - protein, 11 aa, Borrelia burgdorferi
GLVERTNAALE

SEQ ID NO: 7370 - protein, 11 aa, Borrelia burgdorferi
LVERTNAALES

SEQ ID NO: 7371 - protein, 11 aa, Borrelia burgdorferi
VERTNAALESS

SEQ ID NO: 7372 - protein, 11 aa, Borrelia burgdorferi
ERTNAALESSS

SEQ ID NO: 7373 - protein, 11 aa, Borrelia burgdorferi
RTNAALESSSK

SEQ ID NO: 7374 - protein, 11 aa, Borrelia burgdorferi
TNAALESSSKD

SEQ ID NO: 7375 - protein, 11 aa, Borrelia burgdorferi
NAALESSSKDL

SEQ ID NO: 7376 - protein, 11 aa, Borrelia burgdorferi
AALESSSKDLK

SEQ ID NO: 7377 - protein, 11 aa, Borrelia burgdorferi
ALESSSKDLKN

SEQ ID NO: 7378 - protein, 11 aa, Borrelia burgdorferi
LESSSKDLKNK

SEQ ID NO: 7379 - protein, 11 aa, Borrelia burgdorferi
ESSSKDLKNKI

SEQ ID NO: 7380 - protein, 11 aa, Borrelia burgdorferi
SSSKDLKNKIL

SEQ ID NO: 7381 - protein, 11 aa, Borrelia burgdorferi
SSKDLKNKILK

SEQ ID NO: 7382 - protein, 11 aa, Borrelia burgdorferi
SKDLKNKILKI

SEQ ID NO: 7383 - protein, 11 aa, Borrelia burgdorferi
KDLKNKILKIK

SEQ ID NO: 7384 - protein, 11 aa, Borrelia burgdorferi
DLKNKILKIKK

SEQ ID NO: 7385 - protein, 11 aa, Borrelia burgdorferi
LKNKILKIKKE

SEQ ID NO: 7386 - protein, 11 aa, Borrelia burgdorferi
KNKILKIKKEA

SEQ ID NO: 7387 - protein, 11 aa, Borrelia burgdorferi
NKILKIKKEAT

SEQ ID NO: 7388 - protein, 11 aa, Borrelia burgdorferi
KILKIKKEATG

SEQ ID NO: 7389 - protein, 11 aa, Borrelia burgdorferi
ILKIKKEATGK

SEQ ID NO: 7390 - protein, 11 aa, Borrelia burgdorferi
LKIKKEATGKG

SEQ ID NO: 7391 - protein, 11 aa, Borrelia burgdorferi
KIKKEATGKGV

SEQ ID NO: 7392 - protein, 11 aa, Borrelia burgdorferi
IKKEATGKGVL

SEQ ID NO: 7393 - protein, 11 aa, Borrelia burgdorferi
KKEATGKGVLF

SEQ ID NO: 7394 - protein, 11 aa, Borrelia burgdorferi
KEATGKGVLFE

SEQ ID NO: 7395 - protein, 11 aa, Borrelia burgdorferi
EATGKGVLFEA

SEQ ID NO: 7396 - protein, 11 aa, Borrelia burgdorferi
ATGKGVLFEAF

SEQ ID NO: 7397 - protein, 11 aa, Borrelia burgdorferi
TGKGVLFEAFT

SEQ ID NO: 7398 - protein, 11 aa, Borrelia burgdorferi
GKGVLFEAFTG

SEQ ID NO: 7399 - protein, 11 aa, Borrelia burgdorferi
KGVLFEAFTGL

SEQ ID NO: 7400 - protein, 11 aa, Borrelia burgdorferi
GVLFEAFTGLK

SEQ ID NO: 7401 - protein, 11 aa, Borrelia burgdorferi
VLFEAFTGLKT

SEQ ID NO: 7402 - protein, 11 aa, Borrelia burgdorferi
LFEAFTGLKTG

SEQ ID NO: 7403 - protein, 11 aa, Borrelia burgdorferi
FEAFTGLKTGS

SEQ ID NO: 7404 - protein, 11 aa, Borrelia burgdorferi
EAFTGLKTGSK

SEQ ID NO: 7405 - protein, 11 aa, Borrelia burgdorferi
AFTGLKTGSKV

SEQ ID NO: 7406 - protein, 11 aa, Borrelia burgdorferi
FTGLKTGSKVT

SEQ ID NO: 7407 - protein, 11 aa, Borrelia burgdorferi
TGLKTGSKVTS

SEQ ID NO: 7408 - protein, 11 aa, Borrelia burgdorferi
GLKTGSKVTSG

SEQ ID NO: 7409 - protein, 11 aa, Borrelia burgdorferi
LKTGSKVTSGG

SEQ ID NO: 7410 - protein, 11 aa, Borrelia burgdorferi
KTGSKVTSGGL

SEQ ID NO: 7411 - protein, 11 aa, Borrelia burgdorferi
TGSKVTSGGLA

SEQ ID NO: 7412 - protein, 11 aa, Borrelia burgdorferi
GSKVTSGGLAL

SEQ ID NO: 7413 - protein, 11 aa, Borrelia burgdorferi
SKVTSGGLALR

SEQ ID NO: 7414 - protein, 11 aa, Borrelia burgdorferi
KVTSGGLALRE

SEQ ID NO: 7415 - protein, 11 aa, Borrelia burgdorferi
VTSGGLALREA

SEQ ID NO: 7416 - protein, 11 aa, Borrelia burgdorferi
TSGGLALREAK

SEQ ID NO: 7417 - protein, 11 aa, Borrelia burgdorferi
SGGLALREAKV

SEQ ID NO: 7418 - protein, 11 aa, Borrelia burgdorferi
GGLALREAKVQ

SEQ ID NO: 7419 - protein, 11 aa, Borrelia burgdorferi
GLALREAKVQA

SEQ ID NO: 7420 - protein, 11 aa, Borrelia burgdorferi
LALREAKVQAI

SEQ ID NO: 7421 - protein, 11 aa, Borrelia burgdorferi
ALREAKVQAIV

SEQ ID NO: 7422 - protein, 11 aa, Borrelia burgdorferi
LREAKVQAIVE

SEQ ID NO: 7423 - protein, 11 aa, Borrelia burgdorferi
REAKVQAIVET

SEQ ID NO: 7424 - protein, 11 aa, Borrelia burgdorferi
EAKVQAIVETG

SEQ ID NO: 7425 - protein, 11 aa, Borrelia burgdorferi
AKVQAIVETGK

SEQ ID NO: 7426 - protein, 11 aa, Borrelia burgdorferi
KVQAIVETGKF

SEQ ID NO: 7427 - protein, 11 aa, Borrelia burgdorferi
VQAIVETGKFL

SEQ ID NO: 7428 - protein, 11 aa, Borrelia burgdorferi
QAIVETGKFLK

SEQ ID NO: 7429 - protein, 11 aa, Borrelia burgdorferi
AIVETGKFLKI

SEQ ID NO: 7430 - protein, 11 aa, Borrelia burgdorferi
IVETGKFLKII

SEQ ID NO: 7431 - protein, 11 aa, Borrelia burgdorferi
VETGKFLKIIE

SEQ ID NO: 7432 - protein, 11 aa, Borrelia burgdorferi
ETGKFLKIIEE

SEQ ID NO: 7433 - protein, 11 aa, Borrelia burgdorferi
TGKFLKIIEEE

SEQ ID NO: 7434 - protein, 11 aa, Borrelia burgdorferi
GKFLKIIEEEA

SEQ ID NO: 7435 - protein, 11 aa, Borrelia burgdorferi
KFLKIIEEEAL

SEQ ID NO: 7436 - protein, 11 aa, Borrelia burgdorferi
FLKIIEEEALK

SEQ ID NO: 7437 - protein, 11 aa, Borrelia burgdorferi
LKIIEEEALKL

SEQ ID NO: 7438 - protein, 11 aa, Borrelia burgdorferi
KIIEEEALKLK

SEQ ID NO: 7439 - protein, 11 aa, Borrelia burgdorferi
IIEEEALKLKE

SEQ ID NO: 7440 - protein, 11 aa, Borrelia burgdorferi
IEEEALKLKET

SEQ ID NO: 7441 - protein, 11 aa, Borrelia burgdorferi
EEEALKLKETG

SEQ ID NO: 7442 - protein, 11 aa, Borrelia burgdorferi
EEALKLKETGN

SEQ ID NO: 7443 - protein, 11 aa, Borrelia burgdorferi
EALKLKETGNS

SEQ ID NO: 7444 - protein, 11 aa, Borrelia burgdorferi
ALKLKETGNSG

SEQ ID NO: 7445 - protein, 11 aa, Borrelia burgdorferi
LKLKETGNSGQ

SEQ ID NO: 7446 - protein, 11 aa, Borrelia burgdorferi
KLKETGNSGQF

SEQ ID NO: 7447 - protein, 11 aa, Borrelia burgdorferi
LKETGNSGQFL

SEQ ID NO: 7448 - protein, 11 aa, Borrelia burgdorferi
KETGNSGQFLA

SEQ ID NO: 7449 - protein, 11 aa, Borrelia burgdorferi
ETGNSGQFLAM

SEQ ID NO: 7450 - protein, 11 aa, Borrelia burgdorferi
TGNSGQFLAMF

SEQ ID NO: 7451 - protein, 11 aa, Borrelia burgdorferi
GNSGQFLAMFD

SEQ ID NO: 7452 - protein, 11 aa, Borrelia burgdorferi
NSGQFLAMFDL

SEQ ID NO: 7453 - protein, 11 aa, Borrelia burgdorferi
SGQFLAMFDLM

SEQ ID NO: 7454 - protein, 11 aa, Borrelia burgdorferi
GQFLAMFDLML

SEQ ID NO: 7455 - protein, 11 aa, Borrelia burgdorferi
QFLAMFDLMLE

SEQ ID NO: 7456 - protein, 11 aa, Borrelia burgdorferi
FLAMFDLMLEV

SEQ ID NO: 7457 - protein, 11 aa, Borrelia burgdorferi
LAMFDLMLEVV

SEQ ID NO: 7458 - protein, 11 aa, Borrelia burgdorferi
AMFDLMLEVVE

SEQ ID NO: 7459 - protein, 11 aa, Borrelia burgdorferi
MFDLMLEVVES

SEQ ID NO: 7460 - protein, 11 aa, Borrelia burgdorferi
FDLMLEVVESL

SEQ ID NO: 7461 - protein, 11 aa, Borrelia burgdorferi
DLMLEVVESLE

SEQ ID NO: 7462 - protein, 11 aa, Borrelia burgdorferi
LMLEVVESLED

SEQ ID NO: 7463 - protein, 11 aa, Borrelia burgdorferi
MLEVVESLEDV

SEQ ID NO: 7464 - protein, 11 aa, Borrelia burgdorferi
LEVVESLEDVG

SEQ ID NO: 7465 - protein, 11 aa, Borrelia burgdorferi
EVVESLEDVGI

SEQ ID NO: 7466 - protein, 11 aa, Borrelia burgdorferi
VVESLEDVGII

SEQ ID NO: 7467 - protein, 11 aa, Borrelia burgdorferi
VESLEDVGIIG

SEQ ID NO: 7468 - protein, 11 aa, Borrelia burgdorferi
ESLEDVGIIGL

SEQ ID NO: 7469 - protein, 11 aa, Borrelia burgdorferi
SLEDVGIIGLK

SEQ ID NO: 7470 - protein, 11 aa, Borrelia burgdorferi
LEDVGIIGLKA

SEQ ID NO: 7471 - protein, 11 aa, Borrelia burgdorferi
EDVGIIGLKAR

SEQ ID NO: 7472 - protein, 11 aa, Borrelia burgdorferi
DVGIIGLKARV

SEQ ID NO: 7473 - protein, 11 aa, Borrelia burgdorferi
VGIIGLKARVL

SEQ ID NO: 7474 - protein, 11 aa, Borrelia burgdorferi
GIIGLKARVLE

SEQ ID NO: 7475 - protein, 11 aa, Borrelia burgdorferi
IIGLKARVLEE

SEQ ID NO: 7476 - protein, 11 aa, Borrelia burgdorferi
IGLKARVLEES

SEQ ID NO: 7477 - protein, 11 aa, Borrelia burgdorferi
GLKARVLEESK

SEQ ID NO: 7478 - protein, 11 aa, Borrelia burgdorferi
LKARVLEESKN

SEQ ID NO: 7479 - protein, 11 aa, Borrelia burgdorferi
KARVLEESKNN

SEQ ID NO: 7480 - protein, 11 aa, Borrelia burgdorferi
ARVLEESKNNP

SEQ ID NO: 7481 - protein, 11 aa, Borrelia burgdorferi
RVLEESKNNPI

SEQ ID NO: 7482 - protein, 11 aa, Borrelia burgdorferi
VLEESKNNPIN

SEQ ID NO: 7483 - protein, 11 aa, Borrelia burgdorferi
LEESKNNPINT

SEQ ID NO: 7484 - protein, 11 aa, Borrelia burgdorferi
EESKNNPINTA

SEQ ID NO: 7485 - protein, 11 aa, Borrelia burgdorferi
ESKNNPINTAE

SEQ ID NO: 7486 - protein, 11 aa, Borrelia burgdorferi
SKNNPINTAER

SEQ ID NO: 7487 - protein, 11 aa, Borrelia burgdorferi
KNNPINTAERL

SEQ ID NO: 7488 - protein, 11 aa, Borrelia burgdorferi
NNPINTAERLL

SEQ ID NO: 7489 - protein, 11 aa, Borrelia burgdorferi
NPINTAERLLA

SEQ ID NO: 7490 - protein, 11 aa, Borrelia burgdorferi
PINTAERLLAA

SEQ ID NO: 7491 - protein, 11 aa, Borrelia burgdorferi
INTAERLLAAK

SEQ ID NO: 7492 - protein, 11 aa, Borrelia burgdorferi
NTAERLLAAKA

SEQ ID NO: 7493 - protein, 11 aa, Borrelia burgdorferi
TAERLLAAKAQ

SEQ ID NO: 7494 - protein, 11 aa, Borrelia burgdorferi
AERLLAAKAQI

SEQ ID NO: 7495 - protein, 11 aa, Borrelia burgdorferi
ERLLAAKAQIE

SEQ ID NO: 7496 - protein, 11 aa, Borrelia burgdorferi
RLLAAKAQIEN

SEQ ID NO: 7497 - protein, 11 aa, Borrelia burgdorferi
LLAAKAQIENQ

SEQ ID NO: 7498 - protein, 11 aa, Borrelia burgdorferi
LAAKAQIENQL

SEQ ID NO: 7499 - protein, 11 aa, Borrelia burgdorferi
AAKAQIENQLK

SEQ ID NO: 7500 - protein, 11 aa, Borrelia burgdorferi
AKAQIENQLKV

SEQ ID NO: 7501 - protein, 11 aa, Borrelia burgdorferi
KAQIENQLKVV

SEQ ID NO: 7502 - protein, 11 aa, Borrelia burgdorferi
AQIENQLKVVK

SEQ ID NO: 7503 - protein, 11 aa, Borrelia burgdorferi
QIENQLKVVKE

SEQ ID NO: 7504 - protein, 11 aa, Borrelia burgdorferi
IENQLKVVKEK

SEQ ID NO: 7505 - protein, 11 aa, Borrelia burgdorferi
ENQLKVVKEKQ

SEQ ID NO: 7506 - protein, 11 aa, Borrelia burgdorferi
NQLKVVKEKQN

SEQ ID NO: 7507 - protein, 11 aa, Borrelia burgdorferi
QLKVVKEKQNI

SEQ ID NO: 7508 - protein, 11 aa, Borrelia burgdorferi
LKVVKEKQNIE

SEQ ID NO: 7509 - protein, 11 aa, Borrelia burgdorferi
KVVKEKQNIEN

SEQ ID NO: 7510 - protein, 11 aa, Borrelia burgdorferi
VVKEKQNIENG

SEQ ID NO: 7511 - protein, 11 aa, Borrelia burgdorferi
VKEKQNIENGG

SEQ ID NO: 7512 - protein, 11 aa, Borrelia burgdorferi
KEKQNIENGGE

SEQ ID NO: 7513 - protein, 11 aa, Borrelia burgdorferi
EKQNIENGGEK

SEQ ID NO: 7514 - protein, 11 aa, Borrelia burgdorferi
KQNIENGGEKK

SEQ ID NO: 7515 - protein, 11 aa, Borrelia burgdorferi
QNIENGGEKKN

SEQ ID NO: 7516 - protein, 11 aa, Borrelia burgdorferi
NIENGGEKKNN

SEQ ID NO: 7517 - protein, 11 aa, Borrelia burgdorferi
IENGGEKKNNK

SEQ ID NO: 7518 - protein, 11 aa, Borrelia burgdorferi
ENGGEKKNNKS

SEQ ID NO: 7519 - protein, 11 aa, Borrelia burgdorferi
NGGEKKNNKSK

SEQ ID NO: 7520 - protein, 11 aa, Borrelia burgdorferi
GGEKKNNKSKK

SEQ ID NO: 7521 - protein, 11 aa, Borrelia burgdorferi
GEKKNNKSKKK

SEQ ID NO: 7522 - protein, 11 aa, Borrelia burgdorferi
EKKNNKSKKKK

SEQ ID NO: 7523 - protein, 8 aa, Borrelia burgdorferi B31
MILIFYFK

SEQ ID NO: 7524 - protein, 8 aa, Borrelia burgdorferi B31
ILIFYFKQ

SEQ ID NO: 7525 - protein, 8 aa, Borrelia burgdorferi B31
LIFYFKQI

SEQ ID NO: 7526 - protein, 8 aa, Borrelia burgdorferi B31
IFYFKQIA

SEQ ID NO: 7527 - protein, 8 aa, Borrelia burgdorferi B31
FYFKQIAL

SEQ ID NO: 7528 - protein, 8 aa, Borrelia burgdorferi B31
YFKQIALF

SEQ ID NO: 7529 - protein, 8 aa, Borrelia burgdorferi B31
FKQIALFI

SEQ ID NO: 7530 - protein, 8 aa, Borrelia burgdorferi B31
KQIALFII

SEQ ID NO: 7531 - protein, 8 aa, Borrelia burgdorferi B31
QIALFIIF

SEQ ID NO: 7532 - protein, 8 aa, Borrelia burgdorferi B31
IALFIIFR

SEQ ID NO: 7533 - protein, 8 aa, Borrelia burgdorferi B31
ALFIIFRL

SEQ ID NO: 7534 - protein, 8 aa, Borrelia burgdorferi B31
LFIIFRLC

SEQ ID NO: 7535 - protein, 8 aa, Borrelia burgdorferi B31
FIIFRLCY

SEQ ID NO: 7536 - protein, 8 aa, Borrelia burgdorferi B31
IIFRLCYI

SEQ ID NO: 7537 - protein, 8 aa, Borrelia burgdorferi B31
IFRLCYII

SEQ ID NO: 7538 - protein, 8 aa, Borrelia burgdorferi B31
FRLCYIIK

SEQ ID NO: 7539 - protein, 8 aa, Borrelia burgdorferi B31
RLCYIIKK

SEQ ID NO: 7540 - protein, 8 aa, Borrelia burgdorferi B31
LCYIIKKV

SEQ ID NO: 7541 - protein, 8 aa, Borrelia burgdorferi B31
CYIIKKVK

SEQ ID NO: 7542 - protein, 8 aa, Borrelia burgdorferi B31
YIIKKVKI

SEQ ID NO: 7543 - protein, 8 aa, Borrelia burgdorferi B31
IIKKVKIK

SEQ ID NO: 7544 - protein, 8 aa, Borrelia burgdorferi B31
IKKVKIKL

SEQ ID NO: 7545 - protein, 8 aa, Borrelia burgdorferi B31
KKVKIKLK

SEQ ID NO: 7546 - protein, 8 aa, Borrelia burgdorferi B31
KVKIKLKR

SEQ ID NO: 7547 - protein, 8 aa, Borrelia burgdorferi B31
VKIKLKRK

SEQ ID NO: 7548 - protein, 8 aa, Borrelia burgdorferi B31
KIKLKRKS

SEQ ID NO: 7549 - protein, 8 aa, Borrelia burgdorferi B31
IKLKRKSC

SEQ ID NO: 7550 - protein, 8 aa, Borrelia burgdorferi B31
KLKRKSCM

SEQ ID NO: 7551 - protein, 8 aa, Borrelia burgdorferi B31
LKRKSCMK

SEQ ID NO: 7552 - protein, 8 aa, Borrelia burgdorferi B31
KRKSCMKK

SEQ ID NO: 7553 - protein, 8 aa, Borrelia burgdorferi B31
RKSCMKKQ

SEQ ID NO: 7554 - protein, 8 aa, Borrelia burgdorferi B31
KSCMKKQF

SEQ ID NO: 7555 - protein, 8 aa, Borrelia burgdorferi B31
SCMKKQFD

SEQ ID NO: 7556 - protein, 8 aa, Borrelia burgdorferi B31
CMKKQFDT

SEQ ID NO: 7557 - protein, 8 aa, Borrelia burgdorferi B31
MKKQFDTE

SEQ ID NO: 7558 - protein, 8 aa, Borrelia burgdorferi B31
KKQFDTEV

SEQ ID NO: 7559 - protein, 8 aa, Borrelia burgdorferi B31
KQFDTEVN

SEQ ID NO: 7560 - protein, 8 aa, Borrelia burgdorferi B31
QFDTEVND

SEQ ID NO: 7561 - protein, 8 aa, Borrelia burgdorferi B31
FDTEVNDL

SEQ ID NO: 7562 - protein, 8 aa, Borrelia burgdorferi B31
DTEVNDLL

SEQ ID NO: 7563 - protein, 8 aa, Borrelia burgdorferi B31
TEVNDLLY

SEQ ID NO: 7564 - protein, 8 aa, Borrelia burgdorferi B31
EVNDLLYL

SEQ ID NO: 7565 - protein, 8 aa, Borrelia burgdorferi B31
VNDLLYLI

SEQ ID NO: 7566 - protein, 8 aa, Borrelia burgdorferi B31
NDLLYLII

SEQ ID NO: 7567 - protein, 8 aa, Borrelia burgdorferi B31
DLLYLIIH

SEQ ID NO: 7568 - protein, 8 aa, Borrelia burgdorferi B31
LLYLIIHS

SEQ ID NO: 7569 - protein, 8 aa, Borrelia burgdorferi B31
LYLIIHSL

SEQ ID NO: 7570 - protein, 8 aa, Borrelia burgdorferi B31
YLIIHSLY

SEQ ID NO: 7571 - protein, 8 aa, Borrelia burgdorferi B31
LIIHSLYS

SEQ ID NO: 7572 - protein, 8 aa, Borrelia burgdorferi B31
IIHSLYSH

SEQ ID NO: 7573 - protein, 8 aa, Borrelia burgdorferi B31
IHSLYSHK

SEQ ID NO: 7574 - protein, 8 aa, Borrelia burgdorferi B31
HSLYSHKE

SEQ ID NO: 7575 - protein, 8 aa, Borrelia burgdorferi B31
SLYSHKEI

SEQ ID NO: 7576 - protein, 8 aa, Borrelia burgdorferi B31
LYSHKEIF

SEQ ID NO: 7577 - protein, 8 aa, Borrelia burgdorferi B31
YSHKEIFL

SEQ ID NO: 7578 - protein, 8 aa, Borrelia burgdorferi B31
SHKEIFLR

SEQ ID NO: 7579 - protein, 8 aa, Borrelia burgdorferi B31
HKEIFLRE

SEQ ID NO: 7580 - protein, 8 aa, Borrelia burgdorferi B31
KEIFLREL

SEQ ID NO: 7581 - protein, 8 aa, Borrelia burgdorferi B31
EIFLRELI

SEQ ID NO: 7582 - protein, 8 aa, Borrelia burgdorferi B31
IFLRELIS

SEQ ID NO: 7583 - protein, 8 aa, Borrelia burgdorferi B31
FLRELISN

SEQ ID NO: 7584 - protein, 8 aa, Borrelia burgdorferi B31
LRELISNA

SEQ ID NO: 7585 - protein, 8 aa, Borrelia burgdorferi B31
RELISNAS

SEQ ID NO: 7586 - protein, 8 aa, Borrelia burgdorferi B31
ELISNASD

SEQ ID NO: 7587 - protein, 8 aa, Borrelia burgdorferi B31
LISNASDA

SEQ ID NO: 7588 - protein, 8 aa, Borrelia burgdorferi B31
ISNASDAI

SEQ ID NO: 7589 - protein, 8 aa, Borrelia burgdorferi B31
SNASDAID

SEQ ID NO: 7590 - protein, 8 aa, Borrelia burgdorferi B31
NASDAIDK

SEQ ID NO: 7591 - protein, 8 aa, Borrelia burgdorferi B31
ASDAIDKL

SEQ ID NO: 7592 - protein, 8 aa, Borrelia burgdorferi B31
SDAIDKLK

SEQ ID NO: 7593 - protein, 8 aa, Borrelia burgdorferi B31
DAIDKLKF

SEQ ID NO: 7594 - protein, 8 aa, Borrelia burgdorferi B31
AIDKLKFL

SEQ ID NO: 7595 - protein, 8 aa, Borrelia burgdorferi B31
IDKLKFLS

SEQ ID NO: 7596 - protein, 8 aa, Borrelia burgdorferi B31
DKLKFLSL

SEQ ID NO: 7597 - protein, 8 aa, Borrelia burgdorferi B31
KLKFLSLT

SEQ ID NO: 7598 - protein, 8 aa, Borrelia burgdorferi B31
LKFLSLTN

SEQ ID NO: 7599 - protein, 8 aa, Borrelia burgdorferi B31
KFLSLTNE

SEQ ID NO: 7600 - protein, 8 aa, Borrelia burgdorferi B31
FLSLTNEK

SEQ ID NO: 7601 - protein, 8 aa, Borrelia burgdorferi B31
LSLTNEKF

SEQ ID NO: 7602 - protein, 8 aa, Borrelia burgdorferi B31
SLTNEKFK

SEQ ID NO: 7603 - protein, 8 aa, Borrelia burgdorferi B31
LTNEKFKN

SEQ ID NO: 7604 - protein, 8 aa, Borrelia burgdorferi B31
TNEKFKNI

SEQ ID NO: 7605 - protein, 8 aa, Borrelia burgdorferi B31
NEKFKNIA

SEQ ID NO: 7606 - protein, 8 aa, Borrelia burgdorferi B31
EKFKNIAL

SEQ ID NO: 7607 - protein, 8 aa, Borrelia burgdorferi B31
KFKNIALE

SEQ ID NO: 7608 - protein, 8 aa, Borrelia burgdorferi B31
FKNIALEP

SEQ ID NO: 7609 - protein, 8 aa, Borrelia burgdorferi B31
KNIALEPK

SEQ ID NO: 7610 - protein, 8 aa, Borrelia burgdorferi B31
NIALEPKI

SEQ ID NO: 7611 - protein, 8 aa, Borrelia burgdorferi B31
IALEPKIE

SEQ ID NO: 7612 - protein, 8 aa, Borrelia burgdorferi B31
ALEPKIEI

SEQ ID NO: 7613 - protein, 8 aa, Borrelia burgdorferi B31
LEPKIEIS

SEQ ID NO: 7614 - protein, 8 aa, Borrelia burgdorferi B31
EPKIEISF

SEQ ID NO: 7615 - protein, 8 aa, Borrelia burgdorferi B31
PKIEISFD

SEQ ID NO: 7616 - protein, 8 aa, Borrelia burgdorferi B31
KIEISFDD

SEQ ID NO: 7617 - protein, 8 aa, Borrelia burgdorferi B31
IEISFDDK

SEQ ID NO: 7618 - protein, 8 aa, Borrelia burgdorferi B31
EISFDDKS

SEQ ID NO: 7619 - protein, 8 aa, Borrelia burgdorferi B31
ISFDDKSI

SEQ ID NO: 7620 - protein, 8 aa, Borrelia burgdorferi B31
SFDDKSIL

SEQ ID NO: 7621 - protein, 8 aa, Borrelia burgdorferi B31
FDDKSILI

SEQ ID NO: 7622 - protein, 8 aa, Borrelia burgdorferi B31
DDKSILIK

SEQ ID NO: 7623 - protein, 8 aa, Borrelia burgdorferi B31
DKSILIKD

SEQ ID NO: 7624 - protein, 8 aa, Borrelia burgdorferi B31
KSILIKDN

SEQ ID NO: 7625 - protein, 8 aa, Borrelia burgdorferi B31
SILIKDNG

SEQ ID NO: 7626 - protein, 8 aa, Borrelia burgdorferi B31
ILIKDNGI

SEQ ID NO: 7627 - protein, 8 aa, Borrelia burgdorferi B31
LIKDNGIG

SEQ ID NO: 7628 - protein, 8 aa, Borrelia burgdorferi B31
IKDNGIGM

SEQ ID NO: 7629 - protein, 8 aa, Borrelia burgdorferi B31
KDNGIGMD

SEQ ID NO: 7630 - protein, 8 aa, Borrelia burgdorferi B31
DNGIGMDE

SEQ ID NO: 7631 - protein, 8 aa, Borrelia burgdorferi B31
NGIGMDEQ

SEQ ID NO: 7632 - protein, 8 aa, Borrelia burgdorferi B31
GIGMDEQD

SEQ ID NO: 7633 - protein, 8 aa, Borrelia burgdorferi B31
IGMDEQDL

SEQ ID NO: 7634 - protein, 8 aa, Borrelia burgdorferi B31
GMDEQDLT

SEQ ID NO: 7635 - protein, 8 aa, Borrelia burgdorferi B31
MDEQDLTN

SEQ ID NO: 7636 - protein, 8 aa, Borrelia burgdorferi B31
DEQDLTNH

SEQ ID NO: 7637 - protein, 8 aa, Borrelia burgdorferi B31
EQDLTNHL

SEQ ID NO: 7638 - protein, 8 aa, Borrelia burgdorferi B31
QDLTNHLG

SEQ ID NO: 7639 - protein, 8 aa, Borrelia burgdorferi B31
DLTNHLGV

SEQ ID NO: 7640 - protein, 8 aa, Borrelia burgdorferi B31
LTNHLGVI

SEQ ID NO: 7641 - protein, 8 aa, Borrelia burgdorferi B31
TNHLGVIA

SEQ ID NO: 7642 - protein, 8 aa, Borrelia burgdorferi B31
NHLGVIAK

SEQ ID NO: 7643 - protein, 8 aa, Borrelia burgdorferi B31
HLGVIAKS

SEQ ID NO: 7644 - protein, 8 aa, Borrelia burgdorferi B31
LGVIAKSG

SEQ ID NO: 7645 - protein, 8 aa, Borrelia burgdorferi B31
GVIAKSGT

SEQ ID NO: 7646 - protein, 8 aa, Borrelia burgdorferi B31
VIAKSGTK

SEQ ID NO: 7647 - protein, 8 aa, Borrelia burgdorferi B31
IAKSGTKE

SEQ ID NO: 7648 - protein, 8 aa, Borrelia burgdorferi B31
AKSGTKEF

SEQ ID NO: 7649 - protein, 8 aa, Borrelia burgdorferi B31
KSGTKEFI

SEQ ID NO: 7650 - protein, 8 aa, Borrelia burgdorferi B31
SGTKEFIN

SEQ ID NO: 7651 - protein, 8 aa, Borrelia burgdorferi B31
GTKEFINN

SEQ ID NO: 7652 - protein, 8 aa, Borrelia burgdorferi B31
TKEFINNL

SEQ ID NO: 7653 - protein, 8 aa, Borrelia burgdorferi B31
KEFINNLK

SEQ ID NO: 7654 - protein, 8 aa, Borrelia burgdorferi B31
EFINNLKQ

SEQ ID NO: 7655 - protein, 8 aa, Borrelia burgdorferi B31
FINNLKQD

SEQ ID NO: 7656 - protein, 8 aa, Borrelia burgdorferi B31
INNLKQDE

SEQ ID NO: 7657 - protein, 8 aa, Borrelia burgdorferi B31
NNLKQDEK

SEQ ID NO: 7658 - protein, 8 aa, Borrelia burgdorferi B31
NLKQDEKK

SEQ ID NO: 7659 - protein, 8 aa, Borrelia burgdorferi B31
LKQDEKKS

SEQ ID NO: 7660 - protein, 8 aa, Borrelia burgdorferi B31
KQDEKKSA

SEQ ID NO: 7661 - protein, 8 aa, Borrelia burgdorferi B31
QDEKKSAS

SEQ ID NO: 7662 - protein, 8 aa, Borrelia burgdorferi B31
DEKKSASL

SEQ ID NO: 7663 - protein, 8 aa, Borrelia burgdorferi B31
EKKSASLI

SEQ ID NO: 7664 - protein, 8 aa, Borrelia burgdorferi B31
KKSASLIG

SEQ ID NO: 7665 - protein, 8 aa, Borrelia burgdorferi B31
KSASLIGQ

SEQ ID NO: 7666 - protein, 8 aa, Borrelia burgdorferi B31
SASLIGQF

SEQ ID NO: 7667 - protein, 8 aa, Borrelia burgdorferi B31
ASLIGQFG

SEQ ID NO: 7668 - protein, 8 aa, Borrelia burgdorferi B31
SLIGQFGV

SEQ ID NO: 7669 - protein, 8 aa, Borrelia burgdorferi B31
LIGQFGVG

SEQ ID NO: 7670 - protein, 8 aa, Borrelia burgdorferi B31
IGQFGVGF

SEQ ID NO: 7671 - protein, 8 aa, Borrelia burgdorferi B31
GQFGVGFY

SEQ ID NO: 7672 - protein, 8 aa, Borrelia burgdorferi B31
QFGVGFYS

SEQ ID NO: 7673 - protein, 8 aa, Borrelia burgdorferi B31
FGVGFYSA

SEQ ID NO: 7674 - protein, 8 aa, Borrelia burgdorferi B31
GVGFYSAF

SEQ ID NO: 7675 - protein, 8 aa, Borrelia burgdorferi B31
VGFYSAFI

SEQ ID NO: 7676 - protein, 8 aa, Borrelia burgdorferi B31
GFYSAFIV

SEQ ID NO: 7677 - protein, 8 aa, Borrelia burgdorferi B31
FYSAFIVS

SEQ ID NO: 7678 - protein, 8 aa, Borrelia burgdorferi B31
YSAFIVSE

SEQ ID NO: 7679 - protein, 8 aa, Borrelia burgdorferi B31
SAFIVSEK

SEQ ID NO: 7680 - protein, 8 aa, Borrelia burgdorferi B31
AFIVSEKV

SEQ ID NO: 7681 - protein, 8 aa, Borrelia burgdorferi B31
FIVSEKVE

SEQ ID NO: 7682 - protein, 8 aa, Borrelia burgdorferi B31
IVSEKVEV

SEQ ID NO: 7683 - protein, 8 aa, Borrelia burgdorferi B31
VSEKVEVT

SEQ ID NO: 7684 - protein, 8 aa, Borrelia burgdorferi B31
SEKVEVTS

SEQ ID NO: 7685 - protein, 8 aa, Borrelia burgdorferi B31
EKVEVTSK

SEQ ID NO: 7686 - protein, 8 aa, Borrelia burgdorferi B31
KVEVTSKK

SEQ ID NO: 7687 - protein, 8 aa, Borrelia burgdorferi B31
VEVTSKKA

SEQ ID NO: 7688 - protein, 8 aa, Borrelia burgdorferi B31
EVTSKKAL

SEQ ID NO: 7689 - protein, 8 aa, Borrelia burgdorferi B31
VTSKKALE

SEQ ID NO: 7690 - protein, 8 aa, Borrelia burgdorferi B31
TSKKALES

SEQ ID NO: 7691 - protein, 8 aa, Borrelia burgdorferi B31
SKKALESD

SEQ ID NO: 7692 - protein, 8 aa, Borrelia burgdorferi B31
KKALESDA

SEQ ID NO: 7693 - protein, 8 aa, Borrelia burgdorferi B31
KALESDAY

SEQ ID NO: 7694 - protein, 8 aa, Borrelia burgdorferi B31
ALESDAYI

SEQ ID NO: 7695 - protein, 8 aa, Borrelia burgdorferi B31
LESDAYIW

SEQ ID NO: 7696 - protein, 8 aa, Borrelia burgdorferi B31
ESDAYIWS

SEQ ID NO: 7697 - protein, 8 aa, Borrelia burgdorferi B31
SDAYIWSS

SEQ ID NO: 7698 - protein, 8 aa, Borrelia burgdorferi B31
DAYIWSSD

SEQ ID NO: 7699 - protein, 8 aa, Borrelia burgdorferi B31
AYIWSSDG

SEQ ID NO: 7700 - protein, 8 aa, Borrelia burgdorferi B31
YIWSSDGK

SEQ ID NO: 7701 - protein, 8 aa, Borrelia burgdorferi B31
IWSSDGKT

SEQ ID NO: 7702 - protein, 8 aa, Borrelia burgdorferi B31
WSSDGKTG

SEQ ID NO: 7703 - protein, 8 aa, Borrelia burgdorferi B31
SSDGKTGY

SEQ ID NO: 7704 - protein, 8 aa, Borrelia burgdorferi B31
SDGKTGYE

SEQ ID NO: 7705 - protein, 8 aa, Borrelia burgdorferi B31
DGKTGYEI

SEQ ID NO: 7706 - protein, 8 aa, Borrelia burgdorferi B31
GKTGYEIE

SEQ ID NO: 7707 - protein, 8 aa, Borrelia burgdorferi B31
KTGYEIEK

SEQ ID NO: 7708 - protein, 8 aa, Borrelia burgdorferi B31
TGYEIEKA

SEQ ID NO: 7709 - protein, 8 aa, Borrelia burgdorferi B31
GYEIEKAK

SEQ ID NO: 7710 - protein, 8 aa, Borrelia burgdorferi B31
YEIEKAKK

SEQ ID NO: 7711 - protein, 8 aa, Borrelia burgdorferi B31
EIEKAKKE

SEQ ID NO: 7712 - protein, 8 aa, Borrelia burgdorferi B31
IEKAKKEE

SEQ ID NO: 7713 - protein, 8 aa, Borrelia burgdorferi B31
EKAKKEES

SEQ ID NO: 7714 - protein, 8 aa, Borrelia burgdorferi B31
KAKKEESG

SEQ ID NO: 7715 - protein, 8 aa, Borrelia burgdorferi B31
AKKEESGT

SEQ ID NO: 7716 - protein, 8 aa, Borrelia burgdorferi B31
KKEESGTE

SEQ ID NO: 7717 - protein, 8 aa, Borrelia burgdorferi B31
KEESGTEI

SEQ ID NO: 7718 - protein, 8 aa, Borrelia burgdorferi B31
EESGTEIK

SEQ ID NO: 7719 - protein, 8 aa, Borrelia burgdorferi B31
ESGTEIKL

SEQ ID NO: 7720 - protein, 8 aa, Borrelia burgdorferi B31
SGTEIKLY

SEQ ID NO: 7721 - protein, 8 aa, Borrelia burgdorferi B31
GTEIKLYL

SEQ ID NO: 7722 - protein, 8 aa, Borrelia burgdorferi B31
TEIKLYLN

SEQ ID NO: 7723 - protein, 8 aa, Borrelia burgdorferi B31
EIKLYLNK

SEQ ID NO: 7724 - protein, 8 aa, Borrelia burgdorferi B31
IKLYLNKE

SEQ ID NO: 7725 - protein, 8 aa, Borrelia burgdorferi B31
KLYLNKEG

SEQ ID NO: 7726 - protein, 8 aa, Borrelia burgdorferi B31
LYLNKEGL

SEQ ID NO: 7727 - protein, 8 aa, Borrelia burgdorferi B31
YLNKEGLE

SEQ ID NO: 7728 - protein, 8 aa, Borrelia burgdorferi B31
LNKEGLEY

SEQ ID NO: 7729 - protein, 8 aa, Borrelia burgdorferi B31
NKEGLEYA

SEQ ID NO: 7730 - protein, 8 aa, Borrelia burgdorferi B31
KEGLEYAN

SEQ ID NO: 7731 - protein, 8 aa, Borrelia burgdorferi B31
EGLEYANK

SEQ ID NO: 7732 - protein, 8 aa, Borrelia burgdorferi B31
GLEYANKW

SEQ ID NO: 7733 - protein, 8 aa, Borrelia burgdorferi B31
LEYANKWK

SEQ ID NO: 7734 - protein, 8 aa, Borrelia burgdorferi B31
EYANKWKI

SEQ ID NO: 7735 - protein, 8 aa, Borrelia burgdorferi B31
YANKWKIQ

SEQ ID NO: 7736 - protein, 8 aa, Borrelia burgdorferi B31
ANKWKIQE

SEQ ID NO: 7737 - protein, 8 aa, Borrelia burgdorferi B31
NKWKIQEI

SEQ ID NO: 7738 - protein, 8 aa, Borrelia burgdorferi B31
KWKIQEII

SEQ ID NO: 7739 - protein, 8 aa, Borrelia burgdorferi B31
WKIQEIIK

SEQ ID NO: 7740 - protein, 8 aa, Borrelia burgdorferi B31
KIQEIIKK

SEQ ID NO: 7741 - protein, 8 aa, Borrelia burgdorferi B31
IQEIIKKY

SEQ ID NO: 7742 - protein, 8 aa, Borrelia burgdorferi B31
QEIIKKYS

SEQ ID NO: 7743 - protein, 8 aa, Borrelia burgdorferi B31
EIIKKYSN

SEQ ID NO: 7744 - protein, 8 aa, Borrelia burgdorferi B31
IIKKYSNH

SEQ ID NO: 7745 - protein, 8 aa, Borrelia burgdorferi B31
IKKYSNHI

SEQ ID NO: 7746 - protein, 8 aa, Borrelia burgdorferi B31
KKYSNHIN

SEQ ID NO: 7747 - protein, 8 aa, Borrelia burgdorferi B31
KYSNHINY

SEQ ID NO: 7748 - protein, 8 aa, Borrelia burgdorferi B31
YSNHINYP

SEQ ID NO: 7749 - protein, 8 aa, Borrelia burgdorferi B31
SNHINYPI

SEQ ID NO: 7750 - protein, 8 aa, Borrelia burgdorferi B31
NHINYPIY

SEQ ID NO: 7751 - protein, 8 aa, Borrelia burgdorferi B31
HINYPIYI

SEQ ID NO: 7752 - protein, 8 aa, Borrelia burgdorferi B31
INYPIYIK

SEQ ID NO: 7753 - protein, 8 aa, Borrelia burgdorferi B31
NYPIYIKY

SEQ ID NO: 7754 - protein, 8 aa, Borrelia burgdorferi B31
YPIYIKYS

SEQ ID NO: 7755 - protein, 8 aa, Borrelia burgdorferi B31
PIYIKYSE

SEQ ID NO: 7756 - protein, 8 aa, Borrelia burgdorferi B31
IYIKYSEP

SEQ ID NO: 7757 - protein, 8 aa, Borrelia burgdorferi B31
YIKYSEPI

SEQ ID NO: 7758 - protein, 8 aa, Borrelia burgdorferi B31
IKYSEPIM

SEQ ID NO: 7759 - protein, 8 aa, Borrelia burgdorferi B31
KYSEPIMK

SEQ ID NO: 7760 - protein, 8 aa, Borrelia burgdorferi B31
YSEPIMKD

SEQ ID NO: 7761 - protein, 8 aa, Borrelia burgdorferi B31
SEPIMKDG

SEQ ID NO: 7762 - protein, 8 aa, Borrelia burgdorferi B31
EPIMKDGK

SEQ ID NO: 7763 - protein, 8 aa, Borrelia burgdorferi B31
PIMKDGKQ

SEQ ID NO: 7764 - protein, 8 aa, Borrelia burgdorferi B31
IMKDGKQE

SEQ ID NO: 7765 - protein, 8 aa, Borrelia burgdorferi B31
MKDGKQEG

SEQ ID NO: 7766 - protein, 8 aa, Borrelia burgdorferi B31
KDGKQEGI

SEQ ID NO: 7767 - protein, 8 aa, Borrelia burgdorferi B31
DGKQEGIE

SEQ ID NO: 7768 - protein, 8 aa, Borrelia burgdorferi B31
GKQEGIEE

SEQ ID NO: 7769 - protein, 8 aa, Borrelia burgdorferi B31
KQEGIEEK

SEQ ID NO: 7770 - protein, 8 aa, Borrelia burgdorferi B31
QEGIEEKE

SEQ ID NO: 7771 - protein, 8 aa, Borrelia burgdorferi B31
EGIEEKEE

SEQ ID NO: 7772 - protein, 8 aa, Borrelia burgdorferi B31
GIEEKEEK

SEQ ID NO: 7773 - protein, 8 aa, Borrelia burgdorferi B31
IEEKEEKL

SEQ ID NO: 7774 - protein, 8 aa, Borrelia burgdorferi B31
EEKEEKLN

SEQ ID NO: 7775 - protein, 8 aa, Borrelia burgdorferi B31
EKEEKLNE

SEQ ID NO: 7776 - protein, 8 aa, Borrelia burgdorferi B31
KEEKLNET

SEQ ID NO: 7777 - protein, 8 aa, Borrelia burgdorferi B31
EEKLNETT

SEQ ID NO: 7778 - protein, 8 aa, Borrelia burgdorferi B31
EKLNETTA

SEQ ID NO: 7779 - protein, 8 aa, Borrelia burgdorferi B31
KLNETTAL

SEQ ID NO: 7780 - protein, 8 aa, Borrelia burgdorferi B31
LNETTALW

SEQ ID NO: 7781 - protein, 8 aa, Borrelia burgdorferi B31
NETTALWT

SEQ ID NO: 7782 - protein, 8 aa, Borrelia burgdorferi B31
ETTALWTK

SEQ ID NO: 7783 - protein, 8 aa, Borrelia burgdorferi B31
TTALWTKN

SEQ ID NO: 7784 - protein, 8 aa, Borrelia burgdorferi B31
TALWTKNK

SEQ ID NO: 7785 - protein, 8 aa, Borrelia burgdorferi B31
ALWTKNKS

SEQ ID NO: 7786 - protein, 8 aa, Borrelia burgdorferi B31
LWTKNKSE

SEQ ID NO: 7787 - protein, 8 aa, Borrelia burgdorferi B31
WTKNKSEI

SEQ ID NO: 7788 - protein, 8 aa, Borrelia burgdorferi B31
TKNKSEIK

SEQ ID NO: 7789 - protein, 8 aa, Borrelia burgdorferi B31
KNKSEIKA

SEQ ID NO: 7790 - protein, 8 aa, Borrelia burgdorferi B31
NKSEIKAE

SEQ ID NO: 7791 - protein, 8 aa, Borrelia burgdorferi B31
KSEIKAEE

SEQ ID NO: 7792 - protein, 8 aa, Borrelia burgdorferi B31
SEIKAEEY

SEQ ID NO: 7793 - protein, 8 aa, Borrelia burgdorferi B31
EIKAEEYN

SEQ ID NO: 7794 - protein, 8 aa, Borrelia burgdorferi B31
IKAEEYNE

SEQ ID NO: 7795 - protein, 8 aa, Borrelia burgdorferi B31
KAEEYNEF

SEQ ID NO: 7796 - protein, 8 aa, Borrelia burgdorferi B31
AEEYNEFY

SEQ ID NO: 7797 - protein, 8 aa, Borrelia burgdorferi B31
EEYNEFYK

SEQ ID NO: 7798 - protein, 8 aa, Borrelia burgdorferi B31
EYNEFYKN

SEQ ID NO: 7799 - protein, 8 aa, Borrelia burgdorferi B31
YNEFYKNT

SEQ ID NO: 7800 - protein, 8 aa, Borrelia burgdorferi B31
NEFYKNTT

SEQ ID NO: 7801 - protein, 8 aa, Borrelia burgdorferi B31
EFYKNTTF

SEQ ID NO: 7802 - protein, 8 aa, Borrelia burgdorferi B31
FYKNTTFD

SEQ ID NO: 7803 - protein, 8 aa, Borrelia burgdorferi B31
YKNTTFDY

SEQ ID NO: 7804 - protein, 8 aa, Borrelia burgdorferi B31
KNTTFDYE

SEQ ID NO: 7805 - protein, 8 aa, Borrelia burgdorferi B31
NTTFDYEN

SEQ ID NO: 7806 - protein, 8 aa, Borrelia burgdorferi B31
TTFDYENP

SEQ ID NO: 7807 - protein, 8 aa, Borrelia burgdorferi B31
TFDYENPL

SEQ ID NO: 7808 - protein, 8 aa, Borrelia burgdorferi B31
FDYENPLM

SEQ ID NO: 7809 - protein, 8 aa, Borrelia burgdorferi B31
DYENPLMH

SEQ ID NO: 7810 - protein, 8 aa, Borrelia burgdorferi B31
YENPLMHI

SEQ ID NO: 7811 - protein, 8 aa, Borrelia burgdorferi B31
ENPLMHIH

SEQ ID NO: 7812 - protein, 8 aa, Borrelia burgdorferi B31
NPLMHIHT

SEQ ID NO: 7813 - protein, 8 aa, Borrelia burgdorferi B31
PLMHIHTK

SEQ ID NO: 7814 - protein, 8 aa, Borrelia burgdorferi B31
LMHIHTKA

SEQ ID NO: 7815 - protein, 8 aa, Borrelia burgdorferi B31
MHIHTKAE

SEQ ID NO: 7816 - protein, 8 aa, Borrelia burgdorferi B31
HIHTKAEG

SEQ ID NO: 7817 - protein, 8 aa, Borrelia burgdorferi B31
IHTKAEGN

SEQ ID NO: 7818 - protein, 8 aa, Borrelia burgdorferi B31
HTKAEGNL

SEQ ID NO: 7819 - protein, 8 aa, Borrelia burgdorferi B31
TKAEGNLE

SEQ ID NO: 7820 - protein, 8 aa, Borrelia burgdorferi B31
KAEGNLEY

SEQ ID NO: 7821 - protein, 8 aa, Borrelia burgdorferi B31
AEGNLEYT

SEQ ID NO: 7822 - protein, 8 aa, Borrelia burgdorferi B31
EGNLEYTN

SEQ ID NO: 7823 - protein, 8 aa, Borrelia burgdorferi B31
GNLEYTNL

SEQ ID NO: 7824 - protein, 8 aa, Borrelia burgdorferi B31
NLEYTNLF

SEQ ID NO: 7825 - protein, 8 aa, Borrelia burgdorferi B31
LEYTNLFY

SEQ ID NO: 7826 - protein, 8 aa, Borrelia burgdorferi B31
EYTNLFYV

SEQ ID NO: 7827 - protein, 8 aa, Borrelia burgdorferi B31
YTNLFYVP

SEQ ID NO: 7828 - protein, 8 aa, Borrelia burgdorferi B31
TNLFYVPS

SEQ ID NO: 7829 - protein, 8 aa, Borrelia burgdorferi B31
NLFYVPSK

SEQ ID NO: 7830 - protein, 8 aa, Borrelia burgdorferi B31
LFYVPSKA

SEQ ID NO: 7831 - protein, 8 aa, Borrelia burgdorferi B31
FYVPSKAP

SEQ ID NO: 7832 - protein, 8 aa, Borrelia burgdorferi B31
YVPSKAPY

SEQ ID NO: 7833 - protein, 8 aa, Borrelia burgdorferi B31
VPSKAPYD

SEQ ID NO: 7834 - protein, 8 aa, Borrelia burgdorferi B31
PSKAPYDL

SEQ ID NO: 7835 - protein, 8 aa, Borrelia burgdorferi B31
SKAPYDLY

SEQ ID NO: 7836 - protein, 8 aa, Borrelia burgdorferi B31
KAPYDLYY

SEQ ID NO: 7837 - protein, 8 aa, Borrelia burgdorferi B31
APYDLYYP

SEQ ID NO: 7838 - protein, 8 aa, Borrelia burgdorferi B31
PYDLYYPN

SEQ ID NO: 7839 - protein, 8 aa, Borrelia burgdorferi B31
YDLYYPNT

SEQ ID NO: 7840 - protein, 8 aa, Borrelia burgdorferi B31
DLYYPNTK

SEQ ID NO: 7841 - protein, 8 aa, Borrelia burgdorferi B31
LYYPNTKP

SEQ ID NO: 7842 - protein, 8 aa, Borrelia burgdorferi B31
YYPNTKPG

SEQ ID NO: 7843 - protein, 8 aa, Borrelia burgdorferi B31
YPNTKPGV

SEQ ID NO: 7844 - protein, 8 aa, Borrelia burgdorferi B31
PNTKPGVK

SEQ ID NO: 7845 - protein, 8 aa, Borrelia burgdorferi B31
NTKPGVKL

SEQ ID NO: 7846 - protein, 8 aa, Borrelia burgdorferi B31
TKPGVKLF

SEQ ID NO: 7847 - protein, 8 aa, Borrelia burgdorferi B31
KPGVKLFI

SEQ ID NO: 7848 - protein, 8 aa, Borrelia burgdorferi B31
PGVKLFIN

SEQ ID NO: 7849 - protein, 8 aa, Borrelia burgdorferi B31
GVKLFINR

SEQ ID NO: 7850 - protein, 8 aa, Borrelia burgdorferi B31
VKLFINRI

SEQ ID NO: 7851 - protein, 8 aa, Borrelia burgdorferi B31
KLFINRIF

SEQ ID NO: 7852 - protein, 8 aa, Borrelia burgdorferi B31
LFINRIFI

SEQ ID NO: 7853 - protein, 8 aa, Borrelia burgdorferi B31
FINRIFIT

SEQ ID NO: 7854 - protein, 8 aa, Borrelia burgdorferi B31
INRIFITD

SEQ ID NO: 7855 - protein, 8 aa, Borrelia burgdorferi B31
NRIFITDS

SEQ ID NO: 7856 - protein, 8 aa, Borrelia burgdorferi B31
RIFITDSE

SEQ ID NO: 7857 - protein, 8 aa, Borrelia burgdorferi B31
IFITDSEG

SEQ ID NO: 7858 - protein, 8 aa, Borrelia burgdorferi B31
FITDSEGS

SEQ ID NO: 7859 - protein, 8 aa, Borrelia burgdorferi B31
ITDSEGSL

SEQ ID NO: 7860 - protein, 8 aa, Borrelia burgdorferi B31
TDSEGSLL

SEQ ID NO: 7861 - protein, 8 aa, Borrelia burgdorferi B31
DSEGSLLP

SEQ ID NO: 7862 - protein, 8 aa, Borrelia burgdorferi B31
SEGSLLPN

SEQ ID NO: 7863 - protein, 8 aa, Borrelia burgdorferi B31
EGSLLPNY

SEQ ID NO: 7864 - protein, 8 aa, Borrelia burgdorferi B31
GSLLPNYL

SEQ ID NO: 7865 - protein, 8 aa, Borrelia burgdorferi B31
SLLPNYLR

SEQ ID NO: 7866 - protein, 8 aa, Borrelia burgdorferi B31
LLPNYLRF

SEQ ID NO: 7867 - protein, 8 aa, Borrelia burgdorferi B31
LPNYLRFI

SEQ ID NO: 7868 - protein, 8 aa, Borrelia burgdorferi B31
PNYLRFIK

SEQ ID NO: 7869 - protein, 8 aa, Borrelia burgdorferi B31
NYLRFIKG

SEQ ID NO: 7870 - protein, 8 aa, Borrelia burgdorferi B31
YLRFIKGI

SEQ ID NO: 7871 - protein, 8 aa, Borrelia burgdorferi B31
LRFIKGII

SEQ ID NO: 7872 - protein, 8 aa, Borrelia burgdorferi B31
RFIKGIID

SEQ ID NO: 7873 - protein, 8 aa, Borrelia burgdorferi B31
FIKGIIDC

SEQ ID NO: 7874 - protein, 8 aa, Borrelia burgdorferi B31
IKGIIDCQ

SEQ ID NO: 7875 - protein, 8 aa, Borrelia burgdorferi B31
KGIIDCQD

SEQ ID NO: 7876 - protein, 8 aa, Borrelia burgdorferi B31
GIIDCQDL

SEQ ID NO: 7877 - protein, 8 aa, Borrelia burgdorferi B31
IIDCQDLP

SEQ ID NO: 7878 - protein, 8 aa, Borrelia burgdorferi B31
IDCQDLPL

SEQ ID NO: 7879 - protein, 8 aa, Borrelia burgdorferi B31
DCQDLPLN

SEQ ID NO: 7880 - protein, 8 aa, Borrelia burgdorferi B31
CQDLPLNV

SEQ ID NO: 7881 - protein, 8 aa, Borrelia burgdorferi B31
QDLPLNVS

SEQ ID NO: 7882 - protein, 8 aa, Borrelia burgdorferi B31
DLPLNVSR

SEQ ID NO: 7883 - protein, 8 aa, Borrelia burgdorferi B31
LPLNVSRE

SEQ ID NO: 7884 - protein, 8 aa, Borrelia burgdorferi B31
PLNVSREI

SEQ ID NO: 7885 - protein, 8 aa, Borrelia burgdorferi B31
LNVSREIL

SEQ ID NO: 7886 - protein, 8 aa, Borrelia burgdorferi B31
NVSREILQ

SEQ ID NO: 7887 - protein, 8 aa, Borrelia burgdorferi B31
VSREILQQ

SEQ ID NO: 7888 - protein, 8 aa, Borrelia burgdorferi B31
SREILQQN

SEQ ID NO: 7889 - protein, 8 aa, Borrelia burgdorferi B31
REILQQNK

SEQ ID NO: 7890 - protein, 8 aa, Borrelia burgdorferi B31
EILQQNKI

SEQ ID NO: 7891 - protein, 8 aa, Borrelia burgdorferi B31
ILQQNKIL

SEQ ID NO: 7892 - protein, 8 aa, Borrelia burgdorferi B31
LQQNKILS

SEQ ID NO: 7893 - protein, 8 aa, Borrelia burgdorferi B31
QQNKILSK

SEQ ID NO: 7894 - protein, 8 aa, Borrelia burgdorferi B31
QNKILSKI

SEQ ID NO: 7895 - protein, 8 aa, Borrelia burgdorferi B31
NKILSKIK

SEQ ID NO: 7896 - protein, 8 aa, Borrelia burgdorferi B31
KILSKIKS

SEQ ID NO: 7897 - protein, 8 aa, Borrelia burgdorferi B31
ILSKIKSS

SEQ ID NO: 7898 - protein, 8 aa, Borrelia burgdorferi B31
LSKIKSSS

SEQ ID NO: 7899 - protein, 8 aa, Borrelia burgdorferi B31
SKIKSSSV

SEQ ID NO: 7900 - protein, 8 aa, Borrelia burgdorferi B31
KIKSSSVK

SEQ ID NO: 7901 - protein, 8 aa, Borrelia burgdorferi B31
IKSSSVKK

SEQ ID NO: 7902 - protein, 8 aa, Borrelia burgdorferi B31
KSSSVKKI

SEQ ID NO: 7903 - protein, 8 aa, Borrelia burgdorferi B31
SSSVKKIL

SEQ ID NO: 7904 - protein, 8 aa, Borrelia burgdorferi B31
SSVKKILS

SEQ ID NO: 7905 - protein, 8 aa, Borrelia burgdorferi B31
SVKKILSE

SEQ ID NO: 7906 - protein, 8 aa, Borrelia burgdorferi B31
VKKILSEL

SEQ ID NO: 7907 - protein, 8 aa, Borrelia burgdorferi B31
KKILSELE

SEQ ID NO: 7908 - protein, 8 aa, Borrelia burgdorferi B31
KILSELEK

SEQ ID NO: 7909 - protein, 8 aa, Borrelia burgdorferi B31
ILSELEKL

SEQ ID NO: 7910 - protein, 8 aa, Borrelia burgdorferi B31
LSELEKLS

SEQ ID NO: 7911 - protein, 8 aa, Borrelia burgdorferi B31
SELEKLSK

SEQ ID NO: 7912 - protein, 8 aa, Borrelia burgdorferi B31
ELEKLSKK

SEQ ID NO: 7913 - protein, 8 aa, Borrelia burgdorferi B31
LEKLSKKN

SEQ ID NO: 7914 - protein, 8 aa, Borrelia burgdorferi B31
EKLSKKNP

SEQ ID NO: 7915 - protein, 8 aa, Borrelia burgdorferi B31
KLSKKNPE

SEQ ID NO: 7916 - protein, 8 aa, Borrelia burgdorferi B31
LSKKNPEK

SEQ ID NO: 7917 - protein, 8 aa, Borrelia burgdorferi B31
SKKNPEKF

SEQ ID NO: 7918 - protein, 8 aa, Borrelia burgdorferi B31
KKNPEKFS

SEQ ID NO: 7919 - protein, 8 aa, Borrelia burgdorferi B31
KNPEKFSE

SEQ ID NO: 7920 - protein, 8 aa, Borrelia burgdorferi B31
NPEKFSEF

SEQ ID NO: 7921 - protein, 8 aa, Borrelia burgdorferi B31
PEKFSEFS

SEQ ID NO: 7922 - protein, 8 aa, Borrelia burgdorferi B31
EKFSEFSK

SEQ ID NO: 7923 - protein, 8 aa, Borrelia burgdorferi B31
KFSEFSKE

SEQ ID NO: 7924 - protein, 8 aa, Borrelia burgdorferi B31
FSEFSKEF

SEQ ID NO: 7925 - protein, 8 aa, Borrelia burgdorferi B31
SEFSKEFG

SEQ ID NO: 7926 - protein, 8 aa, Borrelia burgdorferi B31
EFSKEFGR

SEQ ID NO: 7927 - protein, 8 aa, Borrelia burgdorferi B31
FSKEFGRC

SEQ ID NO: 7928 - protein, 8 aa, Borrelia burgdorferi B31
SKEFGRCI

SEQ ID NO: 7929 - protein, 8 aa, Borrelia burgdorferi B31
KEFGRCIK

SEQ ID NO: 7930 - protein, 8 aa, Borrelia burgdorferi B31
EFGRCIKE

SEQ ID NO: 7931 - protein, 8 aa, Borrelia burgdorferi B31
FGRCIKEG

SEQ ID NO: 7932 - protein, 8 aa, Borrelia burgdorferi B31
GRCIKEGV

SEQ ID NO: 7933 - protein, 8 aa, Borrelia burgdorferi B31
RCIKEGVY

SEQ ID NO: 7934 - protein, 8 aa, Borrelia burgdorferi B31
CIKEGVYS

SEQ ID NO: 7935 - protein, 8 aa, Borrelia burgdorferi B31
IKEGVYSD

SEQ ID NO: 7936 - protein, 8 aa, Borrelia burgdorferi B31
KEGVYSDF

SEQ ID NO: 7937 - protein, 8 aa, Borrelia burgdorferi B31
EGVYSDFE

SEQ ID NO: 7938 - protein, 8 aa, Borrelia burgdorferi B31
GVYSDFEN

SEQ ID NO: 7939 - protein, 8 aa, Borrelia burgdorferi B31
VYSDFENR

SEQ ID NO: 7940 - protein, 8 aa, Borrelia burgdorferi B31
YSDFENRE

SEQ ID NO: 7941 - protein, 8 aa, Borrelia burgdorferi B31
SDFENREK

SEQ ID NO: 7942 - protein, 8 aa, Borrelia burgdorferi B31
DFENREKL

SEQ ID NO: 7943 - protein, 8 aa, Borrelia burgdorferi B31
FENREKLI

SEQ ID NO: 7944 - protein, 8 aa, Borrelia burgdorferi B31
ENREKLIS

SEQ ID NO: 7945 - protein, 8 aa, Borrelia burgdorferi B31
NREKLISL

SEQ ID NO: 7946 - protein, 8 aa, Borrelia burgdorferi B31
REKLISLI

SEQ ID NO: 7947 - protein, 8 aa, Borrelia burgdorferi B31
EKLISLIR

SEQ ID NO: 7948 - protein, 8 aa, Borrelia burgdorferi B31
KLISLIRF

SEQ ID NO: 7949 - protein, 8 aa, Borrelia burgdorferi B31
LISLIRFK

SEQ ID NO: 7950 - protein, 8 aa, Borrelia burgdorferi B31
ISLIRFKS

SEQ ID NO: 7951 - protein, 8 aa, Borrelia burgdorferi B31
SLIRFKSS

SEQ ID NO: 7952 - protein, 8 aa, Borrelia burgdorferi B31
LIRFKSSS

SEQ ID NO: 7953 - protein, 8 aa, Borrelia burgdorferi B31
IRFKSSSV

SEQ ID NO: 7954 - protein, 8 aa, Borrelia burgdorferi B31
RFKSSSVD

SEQ ID NO: 7955 - protein, 8 aa, Borrelia burgdorferi B31
FKSSSVDG

SEQ ID NO: 7956 - protein, 8 aa, Borrelia burgdorferi B31
KSSSVDGF

SEQ ID NO: 7957 - protein, 8 aa, Borrelia burgdorferi B31
SSSVDGFV

SEQ ID NO: 7958 - protein, 8 aa, Borrelia burgdorferi B31
SSVDGFVS

SEQ ID NO: 7959 - protein, 8 aa, Borrelia burgdorferi B31
SVDGFVSF

SEQ ID NO: 7960 - protein, 8 aa, Borrelia burgdorferi B31
VDGFVSFK

SEQ ID NO: 7961 - protein, 8 aa, Borrelia burgdorferi B31
DGFVSFKE

SEQ ID NO: 7962 - protein, 8 aa, Borrelia burgdorferi B31
GFVSFKEY

SEQ ID NO: 7963 - protein, 8 aa, Borrelia burgdorferi B31
FVSFKEYK

SEQ ID NO: 7964 - protein, 8 aa, Borrelia burgdorferi B31
VSFKEYKE

SEQ ID NO: 7965 - protein, 8 aa, Borrelia burgdorferi B31
SFKEYKER

SEQ ID NO: 7966 - protein, 8 aa, Borrelia burgdorferi B31
FKEYKERM

SEQ ID NO: 7967 - protein, 8 aa, Borrelia burgdorferi B31
KEYKERMN

SEQ ID NO: 7968 - protein, 8 aa, Borrelia burgdorferi B31
EYKERMNE

SEQ ID NO: 7969 - protein, 8 aa, Borrelia burgdorferi B31
YKERMNES

SEQ ID NO: 7970 - protein, 8 aa, Borrelia burgdorferi B31
KERMNESQ

SEQ ID NO: 7971 - protein, 8 aa, Borrelia burgdorferi B31
ERMNESQK

SEQ ID NO: 7972 - protein, 8 aa, Borrelia burgdorferi B31
RMNESQKS

SEQ ID NO: 7973 - protein, 8 aa, Borrelia burgdorferi B31
MNESQKSI

SEQ ID NO: 7974 - protein, 8 aa, Borrelia burgdorferi B31
NESQKSIY

SEQ ID NO: 7975 - protein, 8 aa, Borrelia burgdorferi B31
ESQKSIYY

SEQ ID NO: 7976 - protein, 8 aa, Borrelia burgdorferi B31
SQKSIYYI

SEQ ID NO: 7977 - protein, 8 aa, Borrelia burgdorferi B31
QKSIYYIT

SEQ ID NO: 7978 - protein, 8 aa, Borrelia burgdorferi B31
KSIYYITG

SEQ ID NO: 7979 - protein, 8 aa, Borrelia burgdorferi B31
SIYYITGG

SEQ ID NO: 7980 - protein, 8 aa, Borrelia burgdorferi B31
IYYITGGK

SEQ ID NO: 7981 - protein, 8 aa, Borrelia burgdorferi B31
YYITGGKE

SEQ ID NO: 7982 - protein, 8 aa, Borrelia burgdorferi B31
YITGGKEN

SEQ ID NO: 7983 - protein, 8 aa, Borrelia burgdorferi B31
ITGGKENI

SEQ ID NO: 7984 - protein, 8 aa, Borrelia burgdorferi B31
TGGKENIL

SEQ ID NO: 7985 - protein, 8 aa, Borrelia burgdorferi B31
GGKENILK

SEQ ID NO: 7986 - protein, 8 aa, Borrelia burgdorferi B31
GKENILKE

SEQ ID NO: 7987 - protein, 8 aa, Borrelia burgdorferi B31
KENILKEN

SEQ ID NO: 7988 - protein, 8 aa, Borrelia burgdorferi B31
ENILKENP

SEQ ID NO: 7989 - protein, 8 aa, Borrelia burgdorferi B31
NILKENPI

SEQ ID NO: 7990 - protein, 8 aa, Borrelia burgdorferi B31
ILKENPIV

SEQ ID NO: 7991 - protein, 8 aa, Borrelia burgdorferi B31
LKENPIVA

SEQ ID NO: 7992 - protein, 8 aa, Borrelia burgdorferi B31
KENPIVAA

SEQ ID NO: 7993 - protein, 8 aa, Borrelia burgdorferi B31
ENPIVAAY

SEQ ID NO: 7994 - protein, 8 aa, Borrelia burgdorferi B31
NPIVAAYK

SEQ ID NO: 7995 - protein, 8 aa, Borrelia burgdorferi B31
PIVAAYKE

SEQ ID NO: 7996 - protein, 8 aa, Borrelia burgdorferi B31
IVAAYKEK

SEQ ID NO: 7997 - protein, 8 aa, Borrelia burgdorferi B31
VAAYKEKG

SEQ ID NO: 7998 - protein, 8 aa, Borrelia burgdorferi B31
AAYKEKGF

SEQ ID NO: 7999 - protein, 8 aa, Borrelia burgdorferi B31
AYKEKGFE

SEQ ID NO: 8000 - protein, 8 aa, Borrelia burgdorferi B31
YKEKGFEI

SEQ ID NO: 8001 - protein, 8 aa, Borrelia burgdorferi B31
KEKGFEIL

SEQ ID NO: 8002 - protein, 8 aa, Borrelia burgdorferi B31
EKGFEILI

SEQ ID NO: 8003 - protein, 8 aa, Borrelia burgdorferi B31
KGFEILIM

SEQ ID NO: 8004 - protein, 8 aa, Borrelia burgdorferi B31
GFEILIMD

SEQ ID NO: 8005 - protein, 8 aa, Borrelia burgdorferi B31
FEILIMDD

SEQ ID NO: 8006 - protein, 8 aa, Borrelia burgdorferi B31
EILIMDDE

SEQ ID NO: 8007 - protein, 8 aa, Borrelia burgdorferi B31
ILIMDDEL

SEQ ID NO: 8008 - protein, 8 aa, Borrelia burgdorferi B31
LIMDDELD

SEQ ID NO: 8009 - protein, 8 aa, Borrelia burgdorferi B31
IMDDELDE

SEQ ID NO: 8010 - protein, 8 aa, Borrelia burgdorferi B31
MDDELDEA

SEQ ID NO: 8011 - protein, 8 aa, Borrelia burgdorferi B31
DDELDEAI

SEQ ID NO: 8012 - protein, 8 aa, Borrelia burgdorferi B31
DELDEAIL

SEQ ID NO: 8013 - protein, 8 aa, Borrelia burgdorferi B31
ELDEAILN

SEQ ID NO: 8014 - protein, 8 aa, Borrelia burgdorferi B31
LDEAILNL

SEQ ID NO: 8015 - protein, 8 aa, Borrelia burgdorferi B31
DEAILNLI

SEQ ID NO: 8016 - protein, 8 aa, Borrelia burgdorferi B31
EAILNLIP

SEQ ID NO: 8017 - protein, 8 aa, Borrelia burgdorferi B31
AILNLIPE

SEQ ID NO: 8018 - protein, 8 aa, Borrelia burgdorferi B31
ILNLIPEY

SEQ ID NO: 8019 - protein, 8 aa, Borrelia burgdorferi B31
LNLIPEYE

SEQ ID NO: 8020 - protein, 8 aa, Borrelia burgdorferi B31
NLIPEYEG

SEQ ID NO: 8021 - protein, 8 aa, Borrelia burgdorferi B31
LIPEYEGL

SEQ ID NO: 8022 - protein, 8 aa, Borrelia burgdorferi B31
IPEYEGLK

SEQ ID NO: 8023 - protein, 8 aa, Borrelia burgdorferi B31
PEYEGLKL

SEQ ID NO: 8024 - protein, 8 aa, Borrelia burgdorferi B31
EYEGLKLK

SEQ ID NO: 8025 - protein, 8 aa, Borrelia burgdorferi B31
YEGLKLKA

SEQ ID NO: 8026 - protein, 8 aa, Borrelia burgdorferi B31
EGLKLKAI

SEQ ID NO: 8027 - protein, 8 aa, Borrelia burgdorferi B31
GLKLKAIN

SEQ ID NO: 8028 - protein, 8 aa, Borrelia burgdorferi B31
LKLKAINK

SEQ ID NO: 8029 - protein, 8 aa, Borrelia burgdorferi B31
KLKAINKN

SEQ ID NO: 8030 - protein, 8 aa, Borrelia burgdorferi B31
LKAINKNE

SEQ ID NO: 8031 - protein, 8 aa, Borrelia burgdorferi B31
KAINKNET

SEQ ID NO: 8032 - protein, 8 aa, Borrelia burgdorferi B31
AINKNETS

SEQ ID NO: 8033 - protein, 8 aa, Borrelia burgdorferi B31
INKNETSN

SEQ ID NO: 8034 - protein, 8 aa, Borrelia burgdorferi B31
NKNETSNE

SEQ ID NO: 8035 - protein, 8 aa, Borrelia burgdorferi B31
KNETSNEL

SEQ ID NO: 8036 - protein, 8 aa, Borrelia burgdorferi B31
NETSNELK

SEQ ID NO: 8037 - protein, 8 aa, Borrelia burgdorferi B31
ETSNELKD

SEQ ID NO: 8038 - protein, 8 aa, Borrelia burgdorferi B31
TSNELKDE

SEQ ID NO: 8039 - protein, 8 aa, Borrelia burgdorferi B31
SNELKDEN

SEQ ID NO: 8040 - protein, 8 aa, Borrelia burgdorferi B31
NELKDENF

SEQ ID NO: 8041 - protein, 8 aa, Borrelia burgdorferi B31
ELKDENFK

SEQ ID NO: 8042 - protein, 8 aa, Borrelia burgdorferi B31
LKDENFKK

SEQ ID NO: 8043 - protein, 8 aa, Borrelia burgdorferi B31
KDENFKKI

SEQ ID NO: 8044 - protein, 8 aa, Borrelia burgdorferi B31
DENFKKIE

SEQ ID NO: 8045 - protein, 8 aa, Borrelia burgdorferi B31
ENFKKIEE

SEQ ID NO: 8046 - protein, 8 aa, Borrelia burgdorferi B31
NFKKIEEE

SEQ ID NO: 8047 - protein, 8 aa, Borrelia burgdorferi B31
FKKIEEEF

SEQ ID NO: 8048 - protein, 8 aa, Borrelia burgdorferi B31
KKIEEEFK

SEQ ID NO: 8049 - protein, 8 aa, Borrelia burgdorferi B31
KIEEEFKD

SEQ ID NO: 8050 - protein, 8 aa, Borrelia burgdorferi B31
IEEEFKDT

SEQ ID NO: 8051 - protein, 8 aa, Borrelia burgdorferi B31
EEEFKDTL

SEQ ID NO: 8052 - protein, 8 aa, Borrelia burgdorferi B31
EEFKDTLT

SEQ ID NO: 8053 - protein, 8 aa, Borrelia burgdorferi B31
EFKDTLTK

SEQ ID NO: 8054 - protein, 8 aa, Borrelia burgdorferi B31
FKDTLTKV

SEQ ID NO: 8055 - protein, 8 aa, Borrelia burgdorferi B31
KDTLTKVK

SEQ ID NO: 8056 - protein, 8 aa, Borrelia burgdorferi B31
DTLTKVKE

SEQ ID NO: 8057 - protein, 8 aa, Borrelia burgdorferi B31
TLTKVKEI

SEQ ID NO: 8058 - protein, 8 aa, Borrelia burgdorferi B31
LTKVKEIL

SEQ ID NO: 8059 - protein, 8 aa, Borrelia burgdorferi B31
TKVKEILK

SEQ ID NO: 8060 - protein, 8 aa, Borrelia burgdorferi B31
KVKEILKD

SEQ ID NO: 8061 - protein, 8 aa, Borrelia burgdorferi B31
VKEILKDH

SEQ ID NO: 8062 - protein, 8 aa, Borrelia burgdorferi B31
KEILKDHI

SEQ ID NO: 8063 - protein, 8 aa, Borrelia burgdorferi B31
EILKDHIK

SEQ ID NO: 8064 - protein, 8 aa, Borrelia burgdorferi B31
ILKDHIKE

SEQ ID NO: 8065 - protein, 8 aa, Borrelia burgdorferi B31
LKDHIKEV

SEQ ID NO: 8066 - protein, 8 aa, Borrelia burgdorferi B31
KDHIKEVN

SEQ ID NO: 8067 - protein, 8 aa, Borrelia burgdorferi B31
DHIKEVNL

SEQ ID NO: 8068 - protein, 8 aa, Borrelia burgdorferi B31
HIKEVNLS

SEQ ID NO: 8069 - protein, 8 aa, Borrelia burgdorferi B31
IKEVNLSA

SEQ ID NO: 8070 - protein, 8 aa, Borrelia burgdorferi B31
KEVNLSAT

SEQ ID NO: 8071 - protein, 8 aa, Borrelia burgdorferi B31
EVNLSATL

SEQ ID NO: 8072 - protein, 8 aa, Borrelia burgdorferi B31
VNLSATLI

SEQ ID NO: 8073 - protein, 8 aa, Borrelia burgdorferi B31
NLSATLIK

SEQ ID NO: 8074 - protein, 8 aa, Borrelia burgdorferi B31
LSATLIKE

SEQ ID NO: 8075 - protein, 8 aa, Borrelia burgdorferi B31
SATLIKEP

SEQ ID NO: 8076 - protein, 8 aa, Borrelia burgdorferi B31
ATLIKEPS

SEQ ID NO: 8077 - protein, 8 aa, Borrelia burgdorferi B31
TLIKEPSA

SEQ ID NO: 8078 - protein, 8 aa, Borrelia burgdorferi B31
LIKEPSAI

SEQ ID NO: 8079 - protein, 8 aa, Borrelia burgdorferi B31
IKEPSAII

SEQ ID NO: 8080 - protein, 8 aa, Borrelia burgdorferi B31
KEPSAIII

SEQ ID NO: 8081 - protein, 8 aa, Borrelia burgdorferi B31
EPSAIIID

SEQ ID NO: 8082 - protein, 8 aa, Borrelia burgdorferi B31
PSAIIIDS

SEQ ID NO: 8083 - protein, 8 aa, Borrelia burgdorferi B31
SAIIIDSN

SEQ ID NO: 8084 - protein, 8 aa, Borrelia burgdorferi B31
AIIIDSND

SEQ ID NO: 8085 - protein, 8 aa, Borrelia burgdorferi B31
IIIDSNDP

SEQ ID NO: 8086 - protein, 8 aa, Borrelia burgdorferi B31
IIDSNDPT

SEQ ID NO: 8087 - protein, 8 aa, Borrelia burgdorferi B31
IDSNDPTY

SEQ ID NO: 8088 - protein, 8 aa, Borrelia burgdorferi B31
DSNDPTYQ

SEQ ID NO: 8089 - protein, 8 aa, Borrelia burgdorferi B31
SNDPTYQM

SEQ ID NO: 8090 - protein, 8 aa, Borrelia burgdorferi B31
NDPTYQMQ

SEQ ID NO: 8091 - protein, 8 aa, Borrelia burgdorferi B31
DPTYQMQK

SEQ ID NO: 8092 - protein, 8 aa, Borrelia burgdorferi B31
PTYQMQKI

SEQ ID NO: 8093 - protein, 8 aa, Borrelia burgdorferi B31
TYQMQKIM

SEQ ID NO: 8094 - protein, 8 aa, Borrelia burgdorferi B31
YQMQKIML

SEQ ID NO: 8095 - protein, 8 aa, Borrelia burgdorferi B31
QMQKIMLS

SEQ ID NO: 8096 - protein, 8 aa, Borrelia burgdorferi B31
MQKIMLSM

SEQ ID NO: 8097 - protein, 8 aa, Borrelia burgdorferi B31
QKIMLSMG

SEQ ID NO: 8098 - protein, 8 aa, Borrelia burgdorferi B31
KIMLSMGQ

SEQ ID NO: 8099 - protein, 8 aa, Borrelia burgdorferi B31
IMLSMGQE

SEQ ID NO: 8100 - protein, 8 aa, Borrelia burgdorferi B31
MLSMGQEV

SEQ ID NO: 8101 - protein, 8 aa, Borrelia burgdorferi B31
LSMGQEVK

SEQ ID NO: 8102 - protein, 8 aa, Borrelia burgdorferi B31
SMGQEVKE

SEQ ID NO: 8103 - protein, 8 aa, Borrelia burgdorferi B31
MGQEVKEI

SEQ ID NO: 8104 - protein, 8 aa, Borrelia burgdorferi B31
GQEVKEIK

SEQ ID NO: 8105 - protein, 8 aa, Borrelia burgdorferi B31
QEVKEIKP

SEQ ID NO: 8106 - protein, 8 aa, Borrelia burgdorferi B31
EVKEIKPI

SEQ ID NO: 8107 - protein, 8 aa, Borrelia burgdorferi B31
VKEIKPIL

SEQ ID NO: 8108 - protein, 8 aa, Borrelia burgdorferi B31
KEIKPILE

SEQ ID NO: 8109 - protein, 8 aa, Borrelia burgdorferi B31
EIKPILEL

SEQ ID NO: 8110 - protein, 8 aa, Borrelia burgdorferi B31
IKPILELN

SEQ ID NO: 8111 - protein, 8 aa, Borrelia burgdorferi B31
KPILELNP

SEQ ID NO: 8112 - protein, 8 aa, Borrelia burgdorferi B31
PILELNPN

SEQ ID NO: 8113 - protein, 8 aa, Borrelia burgdorferi B31
ILELNPNN

SEQ ID NO: 8114 - protein, 8 aa, Borrelia burgdorferi B31
LELNPNNK

SEQ ID NO: 8115 - protein, 8 aa, Borrelia burgdorferi B31
ELNPNNKI

SEQ ID NO: 8116 - protein, 8 aa, Borrelia burgdorferi B31
LNPNNKIV

SEQ ID NO: 8117 - protein, 8 aa, Borrelia burgdorferi B31
NPNNKIVQ

SEQ ID NO: 8118 - protein, 8 aa, Borrelia burgdorferi B31
PNNKIVQN

SEQ ID NO: 8119 - protein, 8 aa, Borrelia burgdorferi B31
NNKIVQNL

SEQ ID NO: 8120 - protein, 8 aa, Borrelia burgdorferi B31
NKIVQNLK

SEQ ID NO: 8121 - protein, 8 aa, Borrelia burgdorferi B31
KIVQNLKN

SEQ ID NO: 8122 - protein, 8 aa, Borrelia burgdorferi B31
IVQNLKNL

SEQ ID NO: 8123 - protein, 8 aa, Borrelia burgdorferi B31
VQNLKNLE

SEQ ID NO: 8124 - protein, 8 aa, Borrelia burgdorferi B31
QNLKNLEP

SEQ ID NO: 8125 - protein, 8 aa, Borrelia burgdorferi B31
NLKNLEPE

SEQ ID NO: 8126 - protein, 8 aa, Borrelia burgdorferi B31
LKNLEPEK

SEQ ID NO: 8127 - protein, 8 aa, Borrelia burgdorferi B31
KNLEPEKL

SEQ ID NO: 8128 - protein, 8 aa, Borrelia burgdorferi B31
NLEPEKLE

SEQ ID NO: 8129 - protein, 8 aa, Borrelia burgdorferi B31
LEPEKLEK

SEQ ID NO: 8130 - protein, 8 aa, Borrelia burgdorferi B31
EPEKLEKI

SEQ ID NO: 8131 - protein, 8 aa, Borrelia burgdorferi B31
PEKLEKIS

SEQ ID NO: 8132 - protein, 8 aa, Borrelia burgdorferi B31
EKLEKISI

SEQ ID NO: 8133 - protein, 8 aa, Borrelia burgdorferi B31
KLEKISIL

SEQ ID NO: 8134 - protein, 8 aa, Borrelia burgdorferi B31
LEKISILL

SEQ ID NO: 8135 - protein, 8 aa, Borrelia burgdorferi B31
EKISILLF

SEQ ID NO: 8136 - protein, 8 aa, Borrelia burgdorferi B31
KISILLFE

SEQ ID NO: 8137 - protein, 8 aa, Borrelia burgdorferi B31
ISILLFEE

SEQ ID NO: 8138 - protein, 8 aa, Borrelia burgdorferi B31
SILLFEEA

SEQ ID NO: 8139 - protein, 8 aa, Borrelia burgdorferi B31
ILLFEEAM

SEQ ID NO: 8140 - protein, 8 aa, Borrelia burgdorferi B31
LLFEEAML

SEQ ID NO: 8141 - protein, 8 aa, Borrelia burgdorferi B31
LFEEAMLT

SEQ ID NO: 8142 - protein, 8 aa, Borrelia burgdorferi B31
FEEAMLTS

SEQ ID NO: 8143 - protein, 8 aa, Borrelia burgdorferi B31
EEAMLTSG

SEQ ID NO: 8144 - protein, 8 aa, Borrelia burgdorferi B31
EAMLTSGM

SEQ ID NO: 8145 - protein, 8 aa, Borrelia burgdorferi B31
AMLTSGMP

SEQ ID NO: 8146 - protein, 8 aa, Borrelia burgdorferi B31
MLTSGMPS

SEQ ID NO: 8147 - protein, 8 aa, Borrelia burgdorferi B31
LTSGMPSK

SEQ ID NO: 8148 - protein, 8 aa, Borrelia burgdorferi B31
TSGMPSKN

SEQ ID NO: 8149 - protein, 8 aa, Borrelia burgdorferi B31
SGMPSKNP

SEQ ID NO: 8150 - protein, 8 aa, Borrelia burgdorferi B31
GMPSKNPG

SEQ ID NO: 8151 - protein, 8 aa, Borrelia burgdorferi B31
MPSKNPGK

SEQ ID NO: 8152 - protein, 8 aa, Borrelia burgdorferi B31
PSKNPGKF

SEQ ID NO: 8153 - protein, 8 aa, Borrelia burgdorferi B31
SKNPGKFI

SEQ ID NO: 8154 - protein, 8 aa, Borrelia burgdorferi B31
KNPGKFIN

SEQ ID NO: 8155 - protein, 8 aa, Borrelia burgdorferi B31
NPGKFINI

SEQ ID NO: 8156 - protein, 8 aa, Borrelia burgdorferi B31
PGKFINII

SEQ ID NO: 8157 - protein, 8 aa, Borrelia burgdorferi B31
GKFINIIN

SEQ ID NO: 8158 - protein, 8 aa, Borrelia burgdorferi B31
KFINIINE

SEQ ID NO: 8159 - protein, 8 aa, Borrelia burgdorferi B31
FINIINEF

SEQ ID NO: 8160 - protein, 8 aa, Borrelia burgdorferi B31
INIINEFI

SEQ ID NO: 8161 - protein, 8 aa, Borrelia burgdorferi B31
NIINEFIE

SEQ ID NO: 8162 - protein, 8 aa, Borrelia burgdorferi B31
IINEFIEK

SEQ ID NO: 8163 - protein, 8 aa, Borrelia burgdorferi B31
INEFIEKD

SEQ ID NO: 8164 - protein, 8 aa, Borrelia burgdorferi B31
NEFIEKDF

SEQ ID NO: 8165 - protein, 8 aa, Borrelia burgdorferi B31
EFIEKDFL

SEQ ID NO: 8166 - protein, 9 aa, Borrelia burgdorferi B31
MILIFYFKQ

SEQ ID NO: 8167 - protein, 9 aa, Borrelia burgdorferi B31
ILIFYFKQI

SEQ ID NO: 8168 - protein, 9 aa, Borrelia burgdorferi B31
LIFYFKQIA

SEQ ID NO: 8169 - protein, 9 aa, Borrelia burgdorferi B31
IFYFKQIAL

SEQ ID NO: 8170 - protein, 9 aa, Borrelia burgdorferi B31
FYFKQIALF

SEQ ID NO: 8171 - protein, 9 aa, Borrelia burgdorferi B31
YFKQIALFI

SEQ ID NO: 8172 - protein, 9 aa, Borrelia burgdorferi B31
FKQIALFII

SEQ ID NO: 8173 - protein, 9 aa, Borrelia burgdorferi B31
KQIALFIIF

SEQ ID NO: 8174 - protein, 9 aa, Borrelia burgdorferi B31
QIALFIIFR

SEQ ID NO: 8175 - protein, 9 aa, Borrelia burgdorferi B31
IALFIIFRL

SEQ ID NO: 8176 - protein, 9 aa, Borrelia burgdorferi B31
ALFIIFRLC

SEQ ID NO: 8177 - protein, 9 aa, Borrelia burgdorferi B31
LFIIFRLCY

SEQ ID NO: 8178 - protein, 9 aa, Borrelia burgdorferi B31
FIIFRLCYI

SEQ ID NO: 8179 - protein, 9 aa, Borrelia burgdorferi B31
IIFRLCYII

SEQ ID NO: 8180 - protein, 9 aa, Borrelia burgdorferi B31
IFRLCYIIK

SEQ ID NO: 8181 - protein, 9 aa, Borrelia burgdorferi B31
FRLCYIIKK

SEQ ID NO: 8182 - protein, 9 aa, Borrelia burgdorferi B31
RLCYIIKKV

SEQ ID NO: 8183 - protein, 9 aa, Borrelia burgdorferi B31
LCYIIKKVK

SEQ ID NO: 8184 - protein, 9 aa, Borrelia burgdorferi B31
CYIIKKVKI

SEQ ID NO: 8185 - protein, 9 aa, Borrelia burgdorferi B31
YIIKKVKIK

SEQ ID NO: 8186 - protein, 9 aa, Borrelia burgdorferi B31
IIKKVKIKL

SEQ ID NO: 8187 - protein, 9 aa, Borrelia burgdorferi B31
IKKVKIKLK

SEQ ID NO: 8188 - protein, 9 aa, Borrelia burgdorferi B31
KKVKIKLKR

SEQ ID NO: 8189 - protein, 9 aa, Borrelia burgdorferi B31
KVKIKLKRK

SEQ ID NO: 8190 - protein, 9 aa, Borrelia burgdorferi B31
VKIKLKRKS

SEQ ID NO: 8191 - protein, 9 aa, Borrelia burgdorferi B31
KIKLKRKSC

SEQ ID NO: 8192 - protein, 9 aa, Borrelia burgdorferi B31
IKLKRKSCM

SEQ ID NO: 8193 - protein, 9 aa, Borrelia burgdorferi B31
KLKRKSCMK

SEQ ID NO: 8194 - protein, 9 aa, Borrelia burgdorferi B31
LKRKSCMKK

SEQ ID NO: 8195 - protein, 9 aa, Borrelia burgdorferi B31
KRKSCMKKQ

SEQ ID NO: 8196 - protein, 9 aa, Borrelia burgdorferi B31
RKSCMKKQF

SEQ ID NO: 8197 - protein, 9 aa, Borrelia burgdorferi B31
KSCMKKQFD

SEQ ID NO: 8198 - protein, 9 aa, Borrelia burgdorferi B31
SCMKKQFDT

SEQ ID NO: 8199 - protein, 9 aa, Borrelia burgdorferi B31
CMKKQFDTE

SEQ ID NO: 8200 - protein, 9 aa, Borrelia burgdorferi B31
MKKQFDTEV

SEQ ID NO: 8201 - protein, 9 aa, Borrelia burgdorferi B31
KKQFDTEVN

SEQ ID NO: 8202 - protein, 9 aa, Borrelia burgdorferi B31
KQFDTEVND

SEQ ID NO: 8203 - protein, 9 aa, Borrelia burgdorferi B31
QFDTEVNDL

SEQ ID NO: 8204 - protein, 9 aa, Borrelia burgdorferi B31
FDTEVNDLL

SEQ ID NO: 8205 - protein, 9 aa, Borrelia burgdorferi B31
DTEVNDLLY

SEQ ID NO: 8206 - protein, 9 aa, Borrelia burgdorferi B31
TEVNDLLYL

SEQ ID NO: 8207 - protein, 9 aa, Borrelia burgdorferi B31
EVNDLLYLI

SEQ ID NO: 8208 - protein, 9 aa, Borrelia burgdorferi B31
VNDLLYLII

SEQ ID NO: 8209 - protein, 9 aa, Borrelia burgdorferi B31
NDLLYLIIH

SEQ ID NO: 8210 - protein, 9 aa, Borrelia burgdorferi B31
DLLYLIIHS

SEQ ID NO: 8211 - protein, 9 aa, Borrelia burgdorferi B31
LLYLIIHSL

SEQ ID NO: 8212 - protein, 9 aa, Borrelia burgdorferi B31
LYLIIHSLY

SEQ ID NO: 8213 - protein, 9 aa, Borrelia burgdorferi B31
YLIIHSLYS

SEQ ID NO: 8214 - protein, 9 aa, Borrelia burgdorferi B31
LIIHSLYSH

SEQ ID NO: 8215 - protein, 9 aa, Borrelia burgdorferi B31
IIHSLYSHK

SEQ ID NO: 8216 - protein, 9 aa, Borrelia burgdorferi B31
IHSLYSHKE

SEQ ID NO: 8217 - protein, 9 aa, Borrelia burgdorferi B31
HSLYSHKEI

SEQ ID NO: 8218 - protein, 9 aa, Borrelia burgdorferi B31
SLYSHKEIF

SEQ ID NO: 8219 - protein, 9 aa, Borrelia burgdorferi B31
LYSHKEIFL

SEQ ID NO: 8220 - protein, 9 aa, Borrelia burgdorferi B31
YSHKEIFLR

SEQ ID NO: 8221 - protein, 9 aa, Borrelia burgdorferi B31
SHKEIFLRE

SEQ ID NO: 8222 - protein, 9 aa, Borrelia burgdorferi B31
HKEIFLREL

SEQ ID NO: 8223 - protein, 9 aa, Borrelia burgdorferi B31
KEIFLRELI

SEQ ID NO: 8224 - protein, 9 aa, Borrelia burgdorferi B31
EIFLRELIS

SEQ ID NO: 8225 - protein, 9 aa, Borrelia burgdorferi B31
IFLRELISN

SEQ ID NO: 8226 - protein, 9 aa, Borrelia burgdorferi B31
FLRELISNA

SEQ ID NO: 8227 - protein, 9 aa, Borrelia burgdorferi B31
LRELISNAS

SEQ ID NO: 8228 - protein, 9 aa, Borrelia burgdorferi B31
RELISNASD

SEQ ID NO: 8229 - protein, 9 aa, Borrelia burgdorferi B31
ELISNASDA

SEQ ID NO: 8230 - protein, 9 aa, Borrelia burgdorferi B31
LISNASDAI

SEQ ID NO: 8231 - protein, 9 aa, Borrelia burgdorferi B31
ISNASDAID

SEQ ID NO: 8232 - protein, 9 aa, Borrelia burgdorferi B31
SNASDAIDK

SEQ ID NO: 8233 - protein, 9 aa, Borrelia burgdorferi B31
NASDAIDKL

SEQ ID NO: 8234 - protein, 9 aa, Borrelia burgdorferi B31
ASDAIDKLK

SEQ ID NO: 8235 - protein, 9 aa, Borrelia burgdorferi B31
SDAIDKLKF

SEQ ID NO: 8236 - protein, 9 aa, Borrelia burgdorferi B31
DAIDKLKFL

SEQ ID NO: 8237 - protein, 9 aa, Borrelia burgdorferi B31
AIDKLKFLS

SEQ ID NO: 8238 - protein, 9 aa, Borrelia burgdorferi B31
IDKLKFLSL

SEQ ID NO: 8239 - protein, 9 aa, Borrelia burgdorferi B31
DKLKFLSLT

SEQ ID NO: 8240 - protein, 9 aa, Borrelia burgdorferi B31
KLKFLSLTN

SEQ ID NO: 8241 - protein, 9 aa, Borrelia burgdorferi B31
LKFLSLTNE

SEQ ID NO: 8242 - protein, 9 aa, Borrelia burgdorferi B31
KFLSLTNEK

SEQ ID NO: 8243 - protein, 9 aa, Borrelia burgdorferi B31
FLSLTNEKF

SEQ ID NO: 8244 - protein, 9 aa, Borrelia burgdorferi B31
LSLTNEKFK

SEQ ID NO: 8245 - protein, 9 aa, Borrelia burgdorferi B31
SLTNEKFKN

SEQ ID NO: 8246 - protein, 9 aa, Borrelia burgdorferi B31
LTNEKFKNI

SEQ ID NO: 8247 - protein, 9 aa, Borrelia burgdorferi B31
TNEKFKNIA

SEQ ID NO: 8248 - protein, 9 aa, Borrelia burgdorferi B31
NEKFKNIAL

SEQ ID NO: 8249 - protein, 9 aa, Borrelia burgdorferi B31
EKFKNIALE

SEQ ID NO: 8250 - protein, 9 aa, Borrelia burgdorferi B31
KFKNIALEP

SEQ ID NO: 8251 - protein, 9 aa, Borrelia burgdorferi B31
FKNIALEPK

SEQ ID NO: 8252 - protein, 9 aa, Borrelia burgdorferi B31
KNIALEPKI

SEQ ID NO: 8253 - protein, 9 aa, Borrelia burgdorferi B31
NIALEPKIE

SEQ ID NO: 8254 - protein, 9 aa, Borrelia burgdorferi B31
IALEPKIEI

SEQ ID NO: 8255 - protein, 9 aa, Borrelia burgdorferi B31
ALEPKIEIS

SEQ ID NO: 8256 - protein, 9 aa, Borrelia burgdorferi B31
LEPKIEISF

SEQ ID NO: 8257 - protein, 9 aa, Borrelia burgdorferi B31
EPKIEISFD

SEQ ID NO: 8258 - protein, 9 aa, Borrelia burgdorferi B31
PKIEISFDD

SEQ ID NO: 8259 - protein, 9 aa, Borrelia burgdorferi B31
KIEISFDDK

SEQ ID NO: 8260 - protein, 9 aa, Borrelia burgdorferi B31
IEISFDDKS

SEQ ID NO: 8261 - protein, 9 aa, Borrelia burgdorferi B31
EISFDDKSI

SEQ ID NO: 8262 - protein, 9 aa, Borrelia burgdorferi B31
ISFDDKSIL

SEQ ID NO: 8263 - protein, 9 aa, Borrelia burgdorferi B31
SFDDKSILI

SEQ ID NO: 8264 - protein, 9 aa, Borrelia burgdorferi B31
FDDKSILIK

SEQ ID NO: 8265 - protein, 9 aa, Borrelia burgdorferi B31
DDKSILIKD

SEQ ID NO: 8266 - protein, 9 aa, Borrelia burgdorferi B31
DKSILIKDN

SEQ ID NO: 8267 - protein, 9 aa, Borrelia burgdorferi B31
KSILIKDNG

SEQ ID NO: 8268 - protein, 9 aa, Borrelia burgdorferi B31
SILIKDNGI

SEQ ID NO: 8269 - protein, 9 aa, Borrelia burgdorferi B31
ILIKDNGIG

SEQ ID NO: 8270 - protein, 9 aa, Borrelia burgdorferi B31
LIKDNGIGM

SEQ ID NO: 8271 - protein, 9 aa, Borrelia burgdorferi B31
IKDNGIGMD

SEQ ID NO: 8272 - protein, 9 aa, Borrelia burgdorferi B31
KDNGIGMDE

SEQ ID NO: 8273 - protein, 9 aa, Borrelia burgdorferi B31
DNGIGMDEQ

SEQ ID NO: 8274 - protein, 9 aa, Borrelia burgdorferi B31
NGIGMDEQD

SEQ ID NO: 8275 - protein, 9 aa, Borrelia burgdorferi B31
GIGMDEQDL

SEQ ID NO: 8276 - protein, 9 aa, Borrelia burgdorferi B31
IGMDEQDLT

SEQ ID NO: 8277 - protein, 9 aa, Borrelia burgdorferi B31
GMDEQDLTN

SEQ ID NO: 8278 - protein, 9 aa, Borrelia burgdorferi B31
MDEQDLTNH

SEQ ID NO: 8279 - protein, 9 aa, Borrelia burgdorferi B31
DEQDLTNHL

SEQ ID NO: 8280 - protein, 9 aa, Borrelia burgdorferi B31
EQDLTNHLG

SEQ ID NO: 8281 - protein, 9 aa, Borrelia burgdorferi B31
QDLTNHLGV

SEQ ID NO: 8282 - protein, 9 aa, Borrelia burgdorferi B31
DLTNHLGVI

SEQ ID NO: 8283 - protein, 9 aa, Borrelia burgdorferi B31
LTNHLGVIA

SEQ ID NO: 8284 - protein, 9 aa, Borrelia burgdorferi B31
TNHLGVIAK

SEQ ID NO: 8285 - protein, 9 aa, Borrelia burgdorferi B31
NHLGVIAKS

SEQ ID NO: 8286 - protein, 9 aa, Borrelia burgdorferi B31
HLGVIAKSG

SEQ ID NO: 8287 - protein, 9 aa, Borrelia burgdorferi B31
LGVIAKSGT

SEQ ID NO: 8288 - protein, 9 aa, Borrelia burgdorferi B31
GVIAKSGTK

SEQ ID NO: 8289 - protein, 9 aa, Borrelia burgdorferi B31
VIAKSGTKE

SEQ ID NO: 8290 - protein, 9 aa, Borrelia burgdorferi B31
IAKSGTKEF

SEQ ID NO: 8291 - protein, 9 aa, Borrelia burgdorferi B31
AKSGTKEFI

SEQ ID NO: 8292 - protein, 9 aa, Borrelia burgdorferi B31
KSGTKEFIN

SEQ ID NO: 8293 - protein, 9 aa, Borrelia burgdorferi B31
SGTKEFINN

SEQ ID NO: 8294 - protein, 9 aa, Borrelia burgdorferi B31
GTKEFINNL

SEQ ID NO: 8295 - protein, 9 aa, Borrelia burgdorferi B31
TKEFINNLK

SEQ ID NO: 8296 - protein, 9 aa, Borrelia burgdorferi B31
KEFINNLKQ

SEQ ID NO: 8297 - protein, 9 aa, Borrelia burgdorferi B31
EFINNLKQD

SEQ ID NO: 8298 - protein, 9 aa, Borrelia burgdorferi B31
FINNLKQDE

SEQ ID NO: 8299 - protein, 9 aa, Borrelia burgdorferi B31
INNLKQDEK

SEQ ID NO: 8300 - protein, 9 aa, Borrelia burgdorferi B31
NNLKQDEKK

SEQ ID NO: 8301 - protein, 9 aa, Borrelia burgdorferi B31
NLKQDEKKS

SEQ ID NO: 8302 - protein, 9 aa, Borrelia burgdorferi B31
LKQDEKKSA

SEQ ID NO: 8303 - protein, 9 aa, Borrelia burgdorferi B31
KQDEKKSAS

SEQ ID NO: 8304 - protein, 9 aa, Borrelia burgdorferi B31
QDEKKSASL

SEQ ID NO: 8305 - protein, 9 aa, Borrelia burgdorferi B31
DEKKSASLI

SEQ ID NO: 8306 - protein, 9 aa, Borrelia burgdorferi B31
EKKSASLIG

SEQ ID NO: 8307 - protein, 9 aa, Borrelia burgdorferi B31
KKSASLIGQ

SEQ ID NO: 8308 - protein, 9 aa, Borrelia burgdorferi B31
KSASLIGQF

SEQ ID NO: 8309 - protein, 9 aa, Borrelia burgdorferi B31
SASLIGQFG

SEQ ID NO: 8310 - protein, 9 aa, Borrelia burgdorferi B31
ASLIGQFGV

SEQ ID NO: 8311 - protein, 9 aa, Borrelia burgdorferi B31
SLIGQFGVG

SEQ ID NO: 8312 - protein, 9 aa, Borrelia burgdorferi B31
LIGQFGVGF

SEQ ID NO: 8313 - protein, 9 aa, Borrelia burgdorferi B31
IGQFGVGFY

SEQ ID NO: 8314 - protein, 9 aa, Borrelia burgdorferi B31
GQFGVGFYS

SEQ ID NO: 8315 - protein, 9 aa, Borrelia burgdorferi B31
QFGVGFYSA

SEQ ID NO: 8316 - protein, 9 aa, Borrelia burgdorferi B31
FGVGFYSAF

SEQ ID NO: 8317 - protein, 9 aa, Borrelia burgdorferi B31
GVGFYSAFI

SEQ ID NO: 8318 - protein, 9 aa, Borrelia burgdorferi B31
VGFYSAFIV

SEQ ID NO: 8319 - protein, 9 aa, Borrelia burgdorferi B31
GFYSAFIVS

SEQ ID NO: 8320 - protein, 9 aa, Borrelia burgdorferi B31
FYSAFIVSE

SEQ ID NO: 8321 - protein, 9 aa, Borrelia burgdorferi B31
YSAFIVSEK

SEQ ID NO: 8322 - protein, 9 aa, Borrelia burgdorferi B31
SAFIVSEKV

SEQ ID NO: 8323 - protein, 9 aa, Borrelia burgdorferi B31
AFIVSEKVE

SEQ ID NO: 8324 - protein, 9 aa, Borrelia burgdorferi B31
FIVSEKVEV

SEQ ID NO: 8325 - protein, 9 aa, Borrelia burgdorferi B31
IVSEKVEVT

SEQ ID NO: 8326 - protein, 9 aa, Borrelia burgdorferi B31
VSEKVEVTS

SEQ ID NO: 8327 - protein, 9 aa, Borrelia burgdorferi B31
SEKVEVTSK

SEQ ID NO: 8328 - protein, 9 aa, Borrelia burgdorferi B31
EKVEVTSKK

SEQ ID NO: 8329 - protein, 9 aa, Borrelia burgdorferi B31
KVEVTSKKA

SEQ ID NO: 8330 - protein, 9 aa, Borrelia burgdorferi B31
VEVTSKKAL

SEQ ID NO: 8331 - protein, 9 aa, Borrelia burgdorferi B31
EVTSKKALE

SEQ ID NO: 8332 - protein, 9 aa, Borrelia burgdorferi B31
VTSKKALES

SEQ ID NO: 8333 - protein, 9 aa, Borrelia burgdorferi B31
TSKKALESD

SEQ ID NO: 8334 - protein, 9 aa, Borrelia burgdorferi B31
SKKALESDA

SEQ ID NO: 8335 - protein, 9 aa, Borrelia burgdorferi B31
KKALESDAY

SEQ ID NO: 8336 - protein, 9 aa, Borrelia burgdorferi B31
KALESDAYI

SEQ ID NO: 8337 - protein, 9 aa, Borrelia burgdorferi B31
ALESDAYIW

SEQ ID NO: 8338 - protein, 9 aa, Borrelia burgdorferi B31
LESDAYIWS

SEQ ID NO: 8339 - protein, 9 aa, Borrelia burgdorferi B31
ESDAYIWSS

SEQ ID NO: 8340 - protein, 9 aa, Borrelia burgdorferi B31
SDAYIWSSD

SEQ ID NO: 8341 - protein, 9 aa, Borrelia burgdorferi B31
DAYIWSSDG

SEQ ID NO: 8342 - protein, 9 aa, Borrelia burgdorferi B31
AYIWSSDGK

SEQ ID NO: 8343 - protein, 9 aa, Borrelia burgdorferi B31
YIWSSDGKT

SEQ ID NO: 8344 - protein, 9 aa, Borrelia burgdorferi B31
IWSSDGKTG

SEQ ID NO: 8345 - protein, 9 aa, Borrelia burgdorferi B31
WSSDGKTGY

SEQ ID NO: 8346 - protein, 9 aa, Borrelia burgdorferi B31
SSDGKTGYE

SEQ ID NO: 8347 - protein, 9 aa, Borrelia burgdorferi B31
SDGKTGYEI

SEQ ID NO: 8348 - protein, 9 aa, Borrelia burgdorferi B31
DGKTGYEIE

SEQ ID NO: 8349 - protein, 9 aa, Borrelia burgdorferi B31
GKTGYEIEK

SEQ ID NO: 8350 - protein, 9 aa, Borrelia burgdorferi B31
KTGYEIEKA

SEQ ID NO: 8351 - protein, 9 aa, Borrelia burgdorferi B31
TGYEIEKAK

SEQ ID NO: 8352 - protein, 9 aa, Borrelia burgdorferi B31
GYEIEKAKK

SEQ ID NO: 8353 - protein, 9 aa, Borrelia burgdorferi B31
YEIEKAKKE

SEQ ID NO: 8354 - protein, 9 aa, Borrelia burgdorferi B31
EIEKAKKEE

SEQ ID NO: 8355 - protein, 9 aa, Borrelia burgdorferi B31
IEKAKKEES

SEQ ID NO: 8356 - protein, 9 aa, Borrelia burgdorferi B31
EKAKKEESG

SEQ ID NO: 8357 - protein, 9 aa, Borrelia burgdorferi B31
KAKKEESGT

SEQ ID NO: 8358 - protein, 9 aa, Borrelia burgdorferi B31
AKKEESGTE

SEQ ID NO: 8359 - protein, 9 aa, Borrelia burgdorferi B31
KKEESGTEI

SEQ ID NO: 8360 - protein, 9 aa, Borrelia burgdorferi B31
KEESGTEIK

SEQ ID NO: 8361 - protein, 9 aa, Borrelia burgdorferi B31
EESGTEIKL

SEQ ID NO: 8362 - protein, 9 aa, Borrelia burgdorferi B31
ESGTEIKLY

SEQ ID NO: 8363 - protein, 9 aa, Borrelia burgdorferi B31
SGTEIKLYL

SEQ ID NO: 8364 - protein, 9 aa, Borrelia burgdorferi B31
GTEIKLYLN

SEQ ID NO: 8365 - protein, 9 aa, Borrelia burgdorferi B31
TEIKLYLNK

SEQ ID NO: 8366 - protein, 9 aa, Borrelia burgdorferi B31
EIKLYLNKE

SEQ ID NO: 8367 - protein, 9 aa, Borrelia burgdorferi B31
IKLYLNKEG

SEQ ID NO: 8368 - protein, 9 aa, Borrelia burgdorferi B31
KLYLNKEGL

SEQ ID NO: 8369 - protein, 9 aa, Borrelia burgdorferi B31
LYLNKEGLE

SEQ ID NO: 8370 - protein, 9 aa, Borrelia burgdorferi B31
YLNKEGLEY

SEQ ID NO: 8371 - protein, 9 aa, Borrelia burgdorferi B31
LNKEGLEYA

SEQ ID NO: 8372 - protein, 9 aa, Borrelia burgdorferi B31
NKEGLEYAN

SEQ ID NO: 8373 - protein, 9 aa, Borrelia burgdorferi B31
KEGLEYANK

SEQ ID NO: 8374 - protein, 9 aa, Borrelia burgdorferi B31
EGLEYANKW

SEQ ID NO: 8375 - protein, 9 aa, Borrelia burgdorferi B31
GLEYANKWK

SEQ ID NO: 8376 - protein, 9 aa, Borrelia burgdorferi B31
LEYANKWKI

SEQ ID NO: 8377 - protein, 9 aa, Borrelia burgdorferi B31
EYANKWKIQ

SEQ ID NO: 8378 - protein, 9 aa, Borrelia burgdorferi B31
YANKWKIQE

SEQ ID NO: 8379 - protein, 9 aa, Borrelia burgdorferi B31
ANKWKIQEI

SEQ ID NO: 8380 - protein, 9 aa, Borrelia burgdorferi B31
NKWKIQEII

SEQ ID NO: 8381 - protein, 9 aa, Borrelia burgdorferi B31
KWKIQEIIK

SEQ ID NO: 8382 - protein, 9 aa, Borrelia burgdorferi B31
WKIQEIIKK

SEQ ID NO: 8383 - protein, 9 aa, Borrelia burgdorferi B31
KIQEIIKKY

SEQ ID NO: 8384 - protein, 9 aa, Borrelia burgdorferi B31
IQEIIKKYS

SEQ ID NO: 8385 - protein, 9 aa, Borrelia burgdorferi B31
QEIIKKYSN

SEQ ID NO: 8386 - protein, 9 aa, Borrelia burgdorferi B31
EIIKKYSNH

SEQ ID NO: 8387 - protein, 9 aa, Borrelia burgdorferi B31
IIKKYSNHI

SEQ ID NO: 8388 - protein, 9 aa, Borrelia burgdorferi B31
IKKYSNHIN

SEQ ID NO: 8389 - protein, 9 aa, Borrelia burgdorferi B31
KKYSNHINY

SEQ ID NO: 8390 - protein, 9 aa, Borrelia burgdorferi B31
KYSNHINYP

SEQ ID NO: 8391 - protein, 9 aa, Borrelia burgdorferi B31
YSNHINYPI

SEQ ID NO: 8392 - protein, 9 aa, Borrelia burgdorferi B31
SNHINYPIY

SEQ ID NO: 8393 - protein, 9 aa, Borrelia burgdorferi B31
NHINYPIYI

SEQ ID NO: 8394 - protein, 9 aa, Borrelia burgdorferi B31
HINYPIYIK

SEQ ID NO: 8395 - protein, 9 aa, Borrelia burgdorferi B31
INYPIYIKY

SEQ ID NO: 8396 - protein, 9 aa, Borrelia burgdorferi B31
NYPIYIKYS

SEQ ID NO: 8397 - protein, 9 aa, Borrelia burgdorferi B31
YPIYIKYSE

SEQ ID NO: 8398 - protein, 9 aa, Borrelia burgdorferi B31
PIYIKYSEP

SEQ ID NO: 8399 - protein, 9 aa, Borrelia burgdorferi B31
IYIKYSEPI

SEQ ID NO: 8400 - protein, 9 aa, Borrelia burgdorferi B31
YIKYSEPIM

SEQ ID NO: 8401 - protein, 9 aa, Borrelia burgdorferi B31
IKYSEPIMK

SEQ ID NO: 8402 - protein, 9 aa, Borrelia burgdorferi B31
KYSEPIMKD

SEQ ID NO: 8403 - protein, 9 aa, Borrelia burgdorferi B31
YSEPIMKDG

SEQ ID NO: 8404 - protein, 9 aa, Borrelia burgdorferi B31
SEPIMKDGK

SEQ ID NO: 8405 - protein, 9 aa, Borrelia burgdorferi B31
EPIMKDGKQ

SEQ ID NO: 8406 - protein, 9 aa, Borrelia burgdorferi B31
PIMKDGKQE

SEQ ID NO: 8407 - protein, 9 aa, Borrelia burgdorferi B31
IMKDGKQEG

SEQ ID NO: 8408 - protein, 9 aa, Borrelia burgdorferi B31
MKDGKQEGI

SEQ ID NO: 8409 - protein, 9 aa, Borrelia burgdorferi B31
KDGKQEGIE

SEQ ID NO: 8410 - protein, 9 aa, Borrelia burgdorferi B31
DGKQEGIEE

SEQ ID NO: 8411 - protein, 9 aa, Borrelia burgdorferi B31
GKQEGIEEK

SEQ ID NO: 8412 - protein, 9 aa, Borrelia burgdorferi B31
KQEGIEEKE

SEQ ID NO: 8413 - protein, 9 aa, Borrelia burgdorferi B31
QEGIEEKEE

SEQ ID NO: 8414 - protein, 9 aa, Borrelia burgdorferi B31
EGIEEKEEK

SEQ ID NO: 8415 - protein, 9 aa, Borrelia burgdorferi B31
GIEEKEEKL

SEQ ID NO: 8416 - protein, 9 aa, Borrelia burgdorferi B31
IEEKEEKLN

SEQ ID NO: 8417 - protein, 9 aa, Borrelia burgdorferi B31
EEKEEKLNE

SEQ ID NO: 8418 - protein, 9 aa, Borrelia burgdorferi B31
EKEEKLNET

SEQ ID NO: 8419 - protein, 9 aa, Borrelia burgdorferi B31
KEEKLNETT

SEQ ID NO: 8420 - protein, 9 aa, Borrelia burgdorferi B31
EEKLNETTA

SEQ ID NO: 8421 - protein, 9 aa, Borrelia burgdorferi B31
EKLNETTAL

SEQ ID NO: 8422 - protein, 9 aa, Borrelia burgdorferi B31
KLNETTALW

SEQ ID NO: 8423 - protein, 9 aa, Borrelia burgdorferi B31
LNETTALWT

SEQ ID NO: 8424 - protein, 9 aa, Borrelia burgdorferi B31
NETTALWTK

SEQ ID NO: 8425 - protein, 9 aa, Borrelia burgdorferi B31
ETTALWTKN

SEQ ID NO: 8426 - protein, 9 aa, Borrelia burgdorferi B31
TTALWTKNK

SEQ ID NO: 8427 - protein, 9 aa, Borrelia burgdorferi B31
TALWTKNKS

SEQ ID NO: 8428 - protein, 9 aa, Borrelia burgdorferi B31
ALWTKNKSE

SEQ ID NO: 8429 - protein, 9 aa, Borrelia burgdorferi B31
LWTKNKSEI

SEQ ID NO: 8430 - protein, 9 aa, Borrelia burgdorferi B31
WTKNKSEIK

SEQ ID NO: 8431 - protein, 9 aa, Borrelia burgdorferi B31
TKNKSEIKA

SEQ ID NO: 8432 - protein, 9 aa, Borrelia burgdorferi B31
KNKSEIKAE

SEQ ID NO: 8433 - protein, 9 aa, Borrelia burgdorferi B31
NKSEIKAEE

SEQ ID NO: 8434 - protein, 9 aa, Borrelia burgdorferi B31
KSEIKAEEY

SEQ ID NO: 8435 - protein, 9 aa, Borrelia burgdorferi B31
SEIKAEEYN

SEQ ID NO: 8436 - protein, 9 aa, Borrelia burgdorferi B31
EIKAEEYNE

SEQ ID NO: 8437 - protein, 9 aa, Borrelia burgdorferi B31
IKAEEYNEF

SEQ ID NO: 8438 - protein, 9 aa, Borrelia burgdorferi B31
KAEEYNEFY

SEQ ID NO: 8439 - protein, 9 aa, Borrelia burgdorferi B31
AEEYNEFYK

SEQ ID NO: 8440 - protein, 9 aa, Borrelia burgdorferi B31
EEYNEFYKN

SEQ ID NO: 8441 - protein, 9 aa, Borrelia burgdorferi B31
EYNEFYKNT

SEQ ID NO: 8442 - protein, 9 aa, Borrelia burgdorferi B31
YNEFYKNTT

SEQ ID NO: 8443 - protein, 9 aa, Borrelia burgdorferi B31
NEFYKNTTF

SEQ ID NO: 8444 - protein, 9 aa, Borrelia burgdorferi B31
EFYKNTTFD

SEQ ID NO: 8445 - protein, 9 aa, Borrelia burgdorferi B31
FYKNTTFDY

SEQ ID NO: 8446 - protein, 9 aa, Borrelia burgdorferi B31
YKNTTFDYE

SEQ ID NO: 8447 - protein, 9 aa, Borrelia burgdorferi B31
KNTTFDYEN

SEQ ID NO: 8448 - protein, 9 aa, Borrelia burgdorferi B31
NTTFDYENP

SEQ ID NO: 8449 - protein, 9 aa, Borrelia burgdorferi B31
TTFDYENPL

SEQ ID NO: 8450 - protein, 9 aa, Borrelia burgdorferi B31
TFDYENPLM

SEQ ID NO: 8451 - protein, 9 aa, Borrelia burgdorferi B31
FDYENPLMH

SEQ ID NO: 8452 - protein, 9 aa, Borrelia burgdorferi B31
DYENPLMHI

SEQ ID NO: 8453 - protein, 9 aa, Borrelia burgdorferi B31
YENPLMHIH

SEQ ID NO: 8454 - protein, 9 aa, Borrelia burgdorferi B31
ENPLMHIHT

SEQ ID NO: 8455 - protein, 9 aa, Borrelia burgdorferi B31
NPLMHIHTK

SEQ ID NO: 8456 - protein, 9 aa, Borrelia burgdorferi B31
PLMHIHTKA

SEQ ID NO: 8457 - protein, 9 aa, Borrelia burgdorferi B31
LMHIHTKAE

SEQ ID NO: 8458 - protein, 9 aa, Borrelia burgdorferi B31
MHIHTKAEG

SEQ ID NO: 8459 - protein, 9 aa, Borrelia burgdorferi B31
HIHTKAEGN

SEQ ID NO: 8460 - protein, 9 aa, Borrelia burgdorferi B31
IHTKAEGNL

SEQ ID NO: 8461 - protein, 9 aa, Borrelia burgdorferi B31
HTKAEGNLE

SEQ ID NO: 8462 - protein, 9 aa, Borrelia burgdorferi B31
TKAEGNLEY

SEQ ID NO: 8463 - protein, 9 aa, Borrelia burgdorferi B31
KAEGNLEYT

SEQ ID NO: 8464 - protein, 9 aa, Borrelia burgdorferi B31
AEGNLEYTN

SEQ ID NO: 8465 - protein, 9 aa, Borrelia burgdorferi B31
EGNLEYTNL

SEQ ID NO: 8466 - protein, 9 aa, Borrelia burgdorferi B31
GNLEYTNLF

SEQ ID NO: 8467 - protein, 9 aa, Borrelia burgdorferi B31
NLEYTNLFY

SEQ ID NO: 8468 - protein, 9 aa, Borrelia burgdorferi B31
LEYTNLFYV

SEQ ID NO: 8469 - protein, 9 aa, Borrelia burgdorferi B31
EYTNLFYVP

SEQ ID NO: 8470 - protein, 9 aa, Borrelia burgdorferi B31
YTNLFYVPS

SEQ ID NO: 8471 - protein, 9 aa, Borrelia burgdorferi B31
TNLFYVPSK

SEQ ID NO: 8472 - protein, 9 aa, Borrelia burgdorferi B31
NLFYVPSKA

SEQ ID NO: 8473 - protein, 9 aa, Borrelia burgdorferi B31
LFYVPSKAP

SEQ ID NO: 8474 - protein, 9 aa, Borrelia burgdorferi B31
FYVPSKAPY

SEQ ID NO: 8475 - protein, 9 aa, Borrelia burgdorferi B31
YVPSKAPYD

SEQ ID NO: 8476 - protein, 9 aa, Borrelia burgdorferi B31
VPSKAPYDL

SEQ ID NO: 8477 - protein, 9 aa, Borrelia burgdorferi B31
PSKAPYDLY

SEQ ID NO: 8478 - protein, 9 aa, Borrelia burgdorferi B31
SKAPYDLYY

SEQ ID NO: 8479 - protein, 9 aa, Borrelia burgdorferi B31
KAPYDLYYP

SEQ ID NO: 8480 - protein, 9 aa, Borrelia burgdorferi B31
APYDLYYPN

SEQ ID NO: 8481 - protein, 9 aa, Borrelia burgdorferi B31
PYDLYYPNT

SEQ ID NO: 8482 - protein, 9 aa, Borrelia burgdorferi B31
YDLYYPNTK

SEQ ID NO: 8483 - protein, 9 aa, Borrelia burgdorferi B31
DLYYPNTKP

SEQ ID NO: 8484 - protein, 9 aa, Borrelia burgdorferi B31
LYYPNTKPG

SEQ ID NO: 8485 - protein, 9 aa, Borrelia burgdorferi B31
YYPNTKPGV

SEQ ID NO: 8486 - protein, 9 aa, Borrelia burgdorferi B31
YPNTKPGVK

SEQ ID NO: 8487 - protein, 9 aa, Borrelia burgdorferi B31
PNTKPGVKL

SEQ ID NO: 8488 - protein, 9 aa, Borrelia burgdorferi B31
NTKPGVKLF

SEQ ID NO: 8489 - protein, 9 aa, Borrelia burgdorferi B31
TKPGVKLFI

SEQ ID NO: 8490 - protein, 9 aa, Borrelia burgdorferi B31
KPGVKLFIN

SEQ ID NO: 8491 - protein, 9 aa, Borrelia burgdorferi B31
PGVKLFINR

SEQ ID NO: 8492 - protein, 9 aa, Borrelia burgdorferi B31
GVKLFINRI

SEQ ID NO: 8493 - protein, 9 aa, Borrelia burgdorferi B31
VKLFINRIF

SEQ ID NO: 8494 - protein, 9 aa, Borrelia burgdorferi B31
KLFINRIFI

SEQ ID NO: 8495 - protein, 9 aa, Borrelia burgdorferi B31
LFINRIFIT

SEQ ID NO: 8496 - protein, 9 aa, Borrelia burgdorferi B31
FINRIFITD

SEQ ID NO: 8497 - protein, 9 aa, Borrelia burgdorferi B31
INRIFITDS

SEQ ID NO: 8498 - protein, 9 aa, Borrelia burgdorferi B31
NRIFITDSE

SEQ ID NO: 8499 - protein, 9 aa, Borrelia burgdorferi B31
RIFITDSEG

SEQ ID NO: 8500 - protein, 9 aa, Borrelia burgdorferi B31
IFITDSEGS

SEQ ID NO: 8501 - protein, 9 aa, Borrelia burgdorferi B31
FITDSEGSL

SEQ ID NO: 8502 - protein, 9 aa, Borrelia burgdorferi B31
ITDSEGSLL

SEQ ID NO: 8503 - protein, 9 aa, Borrelia burgdorferi B31
TDSEGSLLP

SEQ ID NO: 8504 - protein, 9 aa, Borrelia burgdorferi B31
DSEGSLLPN

SEQ ID NO: 8505 - protein, 9 aa, Borrelia burgdorferi B31
SEGSLLPNY

SEQ ID NO: 8506 - protein, 9 aa, Borrelia burgdorferi B31
EGSLLPNYL

SEQ ID NO: 8507 - protein, 9 aa, Borrelia burgdorferi B31
GSLLPNYLR

SEQ ID NO: 8508 - protein, 9 aa, Borrelia burgdorferi B31
SLLPNYLRF

SEQ ID NO: 8509 - protein, 9 aa, Borrelia burgdorferi B31
LLPNYLRFI

SEQ ID NO: 8510 - protein, 9 aa, Borrelia burgdorferi B31
LPNYLRFIK

SEQ ID NO: 8511 - protein, 9 aa, Borrelia burgdorferi B31
PNYLRFIKG

SEQ ID NO: 8512 - protein, 9 aa, Borrelia burgdorferi B31
NYLRFIKGI

SEQ ID NO: 8513 - protein, 9 aa, Borrelia burgdorferi B31
YLRFIKGII

SEQ ID NO: 8514 - protein, 9 aa, Borrelia burgdorferi B31
LRFIKGIID

SEQ ID NO: 8515 - protein, 9 aa, Borrelia burgdorferi B31
RFIKGIIDC

SEQ ID NO: 8516 - protein, 9 aa, Borrelia burgdorferi B31
FIKGIIDCQ

SEQ ID NO: 8517 - protein, 9 aa, Borrelia burgdorferi B31
IKGIIDCQD

SEQ ID NO: 8518 - protein, 9 aa, Borrelia burgdorferi B31
KGIIDCQDL

SEQ ID NO: 8519 - protein, 9 aa, Borrelia burgdorferi B31
GIIDCQDLP

SEQ ID NO: 8520 - protein, 9 aa, Borrelia burgdorferi B31
IIDCQDLPL

SEQ ID NO: 8521 - protein, 9 aa, Borrelia burgdorferi B31
IDCQDLPLN

SEQ ID NO: 8522 - protein, 9 aa, Borrelia burgdorferi B31
DCQDLPLNV

SEQ ID NO: 8523 - protein, 9 aa, Borrelia burgdorferi B31
CQDLPLNVS

SEQ ID NO: 8524 - protein, 9 aa, Borrelia burgdorferi B31
QDLPLNVSR

SEQ ID NO: 8525 - protein, 9 aa, Borrelia burgdorferi B31
DLPLNVSRE

SEQ ID NO: 8526 - protein, 9 aa, Borrelia burgdorferi B31
LPLNVSREI

SEQ ID NO: 8527 - protein, 9 aa, Borrelia burgdorferi B31
PLNVSREIL

SEQ ID NO: 8528 - protein, 9 aa, Borrelia burgdorferi B31
LNVSREILQ

SEQ ID NO: 8529 - protein, 9 aa, Borrelia burgdorferi B31
NVSREILQQ

SEQ ID NO: 8530 - protein, 9 aa, Borrelia burgdorferi B31
VSREILQQN

SEQ ID NO: 8531 - protein, 9 aa, Borrelia burgdorferi B31
SREILQQNK

SEQ ID NO: 8532 - protein, 9 aa, Borrelia burgdorferi B31
REILQQNKI

SEQ ID NO: 8533 - protein, 9 aa, Borrelia burgdorferi B31
EILQQNKIL

SEQ ID NO: 8534 - protein, 9 aa, Borrelia burgdorferi B31
ILQQNKILS

SEQ ID NO: 8535 - protein, 9 aa, Borrelia burgdorferi B31
LQQNKILSK

SEQ ID NO: 8536 - protein, 9 aa, Borrelia burgdorferi B31
QQNKILSKI

SEQ ID NO: 8537 - protein, 9 aa, Borrelia burgdorferi B31
QNKILSKIK

SEQ ID NO: 8538 - protein, 9 aa, Borrelia burgdorferi B31
NKILSKIKS

SEQ ID NO: 8539 - protein, 9 aa, Borrelia burgdorferi B31
KILSKIKSS

SEQ ID NO: 8540 - protein, 9 aa, Borrelia burgdorferi B31
ILSKIKSSS

SEQ ID NO: 8541 - protein, 9 aa, Borrelia burgdorferi B31
LSKIKSSSV

SEQ ID NO: 8542 - protein, 9 aa, Borrelia burgdorferi B31
SKIKSSSVK

SEQ ID NO: 8543 - protein, 9 aa, Borrelia burgdorferi B31
KIKSSSVKK

SEQ ID NO: 8544 - protein, 9 aa, Borrelia burgdorferi B31
IKSSSVKKI

SEQ ID NO: 8545 - protein, 9 aa, Borrelia burgdorferi B31
KSSSVKKIL

SEQ ID NO: 8546 - protein, 9 aa, Borrelia burgdorferi B31
SSSVKKILS

SEQ ID NO: 8547 - protein, 9 aa, Borrelia burgdorferi B31
SSVKKILSE

SEQ ID NO: 8548 - protein, 9 aa, Borrelia burgdorferi B31
SVKKILSEL

SEQ ID NO: 8549 - protein, 9 aa, Borrelia burgdorferi B31
VKKILSELE

SEQ ID NO: 8550 - protein, 9 aa, Borrelia burgdorferi B31
KKILSELEK

SEQ ID NO: 8551 - protein, 9 aa, Borrelia burgdorferi B31
KILSELEKL

SEQ ID NO: 8552 - protein, 9 aa, Borrelia burgdorferi B31
ILSELEKLS

SEQ ID NO: 8553 - protein, 9 aa, Borrelia burgdorferi B31
LSELEKLSK

SEQ ID NO: 8554 - protein, 9 aa, Borrelia burgdorferi B31
SELEKLSKK

SEQ ID NO: 8555 - protein, 9 aa, Borrelia burgdorferi B31
ELEKLSKKN

SEQ ID NO: 8556 - protein, 9 aa, Borrelia burgdorferi B31
LEKLSKKNP

SEQ ID NO: 8557 - protein, 9 aa, Borrelia burgdorferi B31
EKLSKKNPE

SEQ ID NO: 8558 - protein, 9 aa, Borrelia burgdorferi B31
KLSKKNPEK

SEQ ID NO: 8559 - protein, 9 aa, Borrelia burgdorferi B31
LSKKNPEKF

SEQ ID NO: 8560 - protein, 9 aa, Borrelia burgdorferi B31
SKKNPEKFS

SEQ ID NO: 8561 - protein, 9 aa, Borrelia burgdorferi B31
KKNPEKFSE

SEQ ID NO: 8562 - protein, 9 aa, Borrelia burgdorferi B31
KNPEKFSEF

SEQ ID NO: 8563 - protein, 9 aa, Borrelia burgdorferi B31
NPEKFSEFS

SEQ ID NO: 8564 - protein, 9 aa, Borrelia burgdorferi B31
PEKFSEFSK

SEQ ID NO: 8565 - protein, 9 aa, Borrelia burgdorferi B31
EKFSEFSKE

SEQ ID NO: 8566 - protein, 9 aa, Borrelia burgdorferi B31
KFSEFSKEF

SEQ ID NO: 8567 - protein, 9 aa, Borrelia burgdorferi B31
FSEFSKEFG

SEQ ID NO: 8568 - protein, 9 aa, Borrelia burgdorferi B31
SEFSKEFGR

SEQ ID NO: 8569 - protein, 9 aa, Borrelia burgdorferi B31
EFSKEFGRC

SEQ ID NO: 8570 - protein, 9 aa, Borrelia burgdorferi B31
FSKEFGRCI

SEQ ID NO: 8571 - protein, 9 aa, Borrelia burgdorferi B31
SKEFGRCIK

SEQ ID NO: 8572 - protein, 9 aa, Borrelia burgdorferi B31
KEFGRCIKE

SEQ ID NO: 8573 - protein, 9 aa, Borrelia burgdorferi B31
EFGRCIKEG

SEQ ID NO: 8574 - protein, 9 aa, Borrelia burgdorferi B31
FGRCIKEGV

SEQ ID NO: 8575 - protein, 9 aa, Borrelia burgdorferi B31
GRCIKEGVY

SEQ ID NO: 8576 - protein, 9 aa, Borrelia burgdorferi B31
RCIKEGVYS

SEQ ID NO: 8577 - protein, 9 aa, Borrelia burgdorferi B31
CIKEGVYSD

SEQ ID NO: 8578 - protein, 9 aa, Borrelia burgdorferi B31
IKEGVYSDF

SEQ ID NO: 8579 - protein, 9 aa, Borrelia burgdorferi B31
KEGVYSDFE

SEQ ID NO: 8580 - protein, 9 aa, Borrelia burgdorferi B31
EGVYSDFEN

SEQ ID NO: 8581 - protein, 9 aa, Borrelia burgdorferi B31
GVYSDFENR

SEQ ID NO: 8582 - protein, 9 aa, Borrelia burgdorferi B31
VYSDFENRE

SEQ ID NO: 8583 - protein, 9 aa, Borrelia burgdorferi B31
YSDFENREK

SEQ ID NO: 8584 - protein, 9 aa, Borrelia burgdorferi B31
SDFENREKL

SEQ ID NO: 8585 - protein, 9 aa, Borrelia burgdorferi B31
DFENREKLI

SEQ ID NO: 8586 - protein, 9 aa, Borrelia burgdorferi B31
FENREKLIS

SEQ ID NO: 8587 - protein, 9 aa, Borrelia burgdorferi B31
ENREKLISL

SEQ ID NO: 8588 - protein, 9 aa, Borrelia burgdorferi B31
NREKLISLI

SEQ ID NO: 8589 - protein, 9 aa, Borrelia burgdorferi B31
REKLISLIR

SEQ ID NO: 8590 - protein, 9 aa, Borrelia burgdorferi B31
EKLISLIRF

SEQ ID NO: 8591 - protein, 9 aa, Borrelia burgdorferi B31
KLISLIRFK

SEQ ID NO: 8592 - protein, 9 aa, Borrelia burgdorferi B31
LISLIRFKS

SEQ ID NO: 8593 - protein, 9 aa, Borrelia burgdorferi B31
ISLIRFKSS

SEQ ID NO: 8594 - protein, 9 aa, Borrelia burgdorferi B31
SLIRFKSSS

SEQ ID NO: 8595 - protein, 9 aa, Borrelia burgdorferi B31
LIRFKSSSV

SEQ ID NO: 8596 - protein, 9 aa, Borrelia burgdorferi B31
IRFKSSSVD

SEQ ID NO: 8597 - protein, 9 aa, Borrelia burgdorferi B31
RFKSSSVDG

SEQ ID NO: 8598 - protein, 9 aa, Borrelia burgdorferi B31
FKSSSVDGF

SEQ ID NO: 8599 - protein, 9 aa, Borrelia burgdorferi B31
KSSSVDGFV

SEQ ID NO: 8600 - protein, 9 aa, Borrelia burgdorferi B31
SSSVDGFVS

SEQ ID NO: 8601 - protein, 9 aa, Borrelia burgdorferi B31
SSVDGFVSF

SEQ ID NO: 8602 - protein, 9 aa, Borrelia burgdorferi B31
SVDGFVSFK

SEQ ID NO: 8603 - protein, 9 aa, Borrelia burgdorferi B31
VDGFVSFKE

SEQ ID NO: 8604 - protein, 9 aa, Borrelia burgdorferi B31
DGFVSFKEY

SEQ ID NO: 8605 - protein, 9 aa, Borrelia burgdorferi B31
GFVSFKEYK

SEQ ID NO: 8606 - protein, 9 aa, Borrelia burgdorferi B31
FVSFKEYKE

SEQ ID NO: 8607 - protein, 9 aa, Borrelia burgdorferi B31
VSFKEYKER

SEQ ID NO: 8608 - protein, 9 aa, Borrelia burgdorferi B31
SFKEYKERM

SEQ ID NO: 8609 - protein, 9 aa, Borrelia burgdorferi B31
FKEYKERMN

SEQ ID NO: 8610 - protein, 9 aa, Borrelia burgdorferi B31
KEYKERMNE

SEQ ID NO: 8611 - protein, 9 aa, Borrelia burgdorferi B31
EYKERMNES

SEQ ID NO: 8612 - protein, 9 aa, Borrelia burgdorferi B31
YKERMNESQ

SEQ ID NO: 8613 - protein, 9 aa, Borrelia burgdorferi B31
KERMNESQK

SEQ ID NO: 8614 - protein, 9 aa, Borrelia burgdorferi B31
ERMNESQKS

SEQ ID NO: 8615 - protein, 9 aa, Borrelia burgdorferi B31
RMNESQKSI

SEQ ID NO: 8616 - protein, 9 aa, Borrelia burgdorferi B31
MNESQKSIY

SEQ ID NO: 8617 - protein, 9 aa, Borrelia burgdorferi B31
NESQKSIYY

SEQ ID NO: 8618 - protein, 9 aa, Borrelia burgdorferi B31
ESQKSIYYI

SEQ ID NO: 8619 - protein, 9 aa, Borrelia burgdorferi B31
SQKSIYYIT

SEQ ID NO: 8620 - protein, 9 aa, Borrelia burgdorferi B31
QKSIYYITG

SEQ ID NO: 8621 - protein, 9 aa, Borrelia burgdorferi B31
KSIYYITGG

SEQ ID NO: 8622 - protein, 9 aa, Borrelia burgdorferi B31
SIYYITGGK

SEQ ID NO: 8623 - protein, 9 aa, Borrelia burgdorferi B31
IYYITGGKE

SEQ ID NO: 8624 - protein, 9 aa, Borrelia burgdorferi B31
YYITGGKEN

SEQ ID NO: 8625 - protein, 9 aa, Borrelia burgdorferi B31
YITGGKENI

SEQ ID NO: 8626 - protein, 9 aa, Borrelia burgdorferi B31
ITGGKENIL

SEQ ID NO: 8627 - protein, 9 aa, Borrelia burgdorferi B31
TGGKENILK

SEQ ID NO: 8628 - protein, 9 aa, Borrelia burgdorferi B31
GGKENILKE

SEQ ID NO: 8629 - protein, 9 aa, Borrelia burgdorferi B31
GKENILKEN

SEQ ID NO: 8630 - protein, 9 aa, Borrelia burgdorferi B31
KENILKENP

SEQ ID NO: 8631 - protein, 9 aa, Borrelia burgdorferi B31
ENILKENPI

SEQ ID NO: 8632 - protein, 9 aa, Borrelia burgdorferi B31
NILKENPIV

SEQ ID NO: 8633 - protein, 9 aa, Borrelia burgdorferi B31
ILKENPIVA

SEQ ID NO: 8634 - protein, 9 aa, Borrelia burgdorferi B31
LKENPIVAA

SEQ ID NO: 8635 - protein, 9 aa, Borrelia burgdorferi B31
KENPIVAAY

SEQ ID NO: 8636 - protein, 9 aa, Borrelia burgdorferi B31
ENPIVAAYK

SEQ ID NO: 8637 - protein, 9 aa, Borrelia burgdorferi B31
NPIVAAYKE

SEQ ID NO: 8638 - protein, 9 aa, Borrelia burgdorferi B31
PIVAAYKEK

SEQ ID NO: 8639 - protein, 9 aa, Borrelia burgdorferi B31
IVAAYKEKG

SEQ ID NO: 8640 - protein, 9 aa, Borrelia burgdorferi B31
VAAYKEKGF

SEQ ID NO: 8641 - protein, 9 aa, Borrelia burgdorferi B31
AAYKEKGFE

SEQ ID NO: 8642 - protein, 9 aa, Borrelia burgdorferi B31
AYKEKGFEI

SEQ ID NO: 8643 - protein, 9 aa, Borrelia burgdorferi B31
YKEKGFEIL

SEQ ID NO: 8644 - protein, 9 aa, Borrelia burgdorferi B31
KEKGFEILI

SEQ ID NO: 8645 - protein, 9 aa, Borrelia burgdorferi B31
EKGFEILIM

SEQ ID NO: 8646 - protein, 9 aa, Borrelia burgdorferi B31
KGFEILIMD

SEQ ID NO: 8647 - protein, 9 aa, Borrelia burgdorferi B31
GFEILIMDD

SEQ ID NO: 8648 - protein, 9 aa, Borrelia burgdorferi B31
FEILIMDDE

SEQ ID NO: 8649 - protein, 9 aa, Borrelia burgdorferi B31
EILIMDDEL

SEQ ID NO: 8650 - protein, 9 aa, Borrelia burgdorferi B31
ILIMDDELD

SEQ ID NO: 8651 - protein, 9 aa, Borrelia burgdorferi B31
LIMDDELDE

SEQ ID NO: 8652 - protein, 9 aa, Borrelia burgdorferi B31
IMDDELDEA

SEQ ID NO: 8653 - protein, 9 aa, Borrelia burgdorferi B31
MDDELDEAI

SEQ ID NO: 8654 - protein, 9 aa, Borrelia burgdorferi B31
DDELDEAIL

SEQ ID NO: 8655 - protein, 9 aa, Borrelia burgdorferi B31
DELDEAILN

SEQ ID NO: 8656 - protein, 9 aa, Borrelia burgdorferi B31
ELDEAILNL

SEQ ID NO: 8657 - protein, 9 aa, Borrelia burgdorferi B31
LDEAILNLI

SEQ ID NO: 8658 - protein, 9 aa, Borrelia burgdorferi B31
DEAILNLIP

SEQ ID NO: 8659 - protein, 9 aa, Borrelia burgdorferi B31
EAILNLIPE

SEQ ID NO: 8660 - protein, 9 aa, Borrelia burgdorferi B31
AILNLIPEY

SEQ ID NO: 8661 - protein, 9 aa, Borrelia burgdorferi B31
ILNLIPEYE

SEQ ID NO: 8662 - protein, 9 aa, Borrelia burgdorferi B31
LNLIPEYEG

SEQ ID NO: 8663 - protein, 9 aa, Borrelia burgdorferi B31
NLIPEYEGL

SEQ ID NO: 8664 - protein, 9 aa, Borrelia burgdorferi B31
LIPEYEGLK

SEQ ID NO: 8665 - protein, 9 aa, Borrelia burgdorferi B31
IPEYEGLKL

SEQ ID NO: 8666 - protein, 9 aa, Borrelia burgdorferi B31
PEYEGLKLK

SEQ ID NO: 8667 - protein, 9 aa, Borrelia burgdorferi B31
EYEGLKLKA

SEQ ID NO: 8668 - protein, 9 aa, Borrelia burgdorferi B31
YEGLKLKAI

SEQ ID NO: 8669 - protein, 9 aa, Borrelia burgdorferi B31
EGLKLKAIN

SEQ ID NO: 8670 - protein, 9 aa, Borrelia burgdorferi B31
GLKLKAINK

SEQ ID NO: 8671 - protein, 9 aa, Borrelia burgdorferi B31
LKLKAINKN

SEQ ID NO: 8672 - protein, 9 aa, Borrelia burgdorferi B31
KLKAINKNE

SEQ ID NO: 8673 - protein, 9 aa, Borrelia burgdorferi B31
LKAINKNET

SEQ ID NO: 8674 - protein, 9 aa, Borrelia burgdorferi B31
KAINKNETS

SEQ ID NO: 8675 - protein, 9 aa, Borrelia burgdorferi B31
AINKNETSN

SEQ ID NO: 8676 - protein, 9 aa, Borrelia burgdorferi B31
INKNETSNE

SEQ ID NO: 8677 - protein, 9 aa, Borrelia burgdorferi B31
NKNETSNEL

SEQ ID NO: 8678 - protein, 9 aa, Borrelia burgdorferi B31
KNETSNELK

SEQ ID NO: 8679 - protein, 9 aa, Borrelia burgdorferi B31
NETSNELKD

SEQ ID NO: 8680 - protein, 9 aa, Borrelia burgdorferi B31
ETSNELKDE

SEQ ID NO: 8681 - protein, 9 aa, Borrelia burgdorferi B31
TSNELKDEN

SEQ ID NO: 8682 - protein, 9 aa, Borrelia burgdorferi B31
SNELKDENF

SEQ ID NO: 8683 - protein, 9 aa, Borrelia burgdorferi B31
NELKDENFK

SEQ ID NO: 8684 - protein, 9 aa, Borrelia burgdorferi B31
ELKDENFKK

SEQ ID NO: 8685 - protein, 9 aa, Borrelia burgdorferi B31
LKDENFKKI

SEQ ID NO: 8686 - protein, 9 aa, Borrelia burgdorferi B31
KDENFKKIE

SEQ ID NO: 8687 - protein, 9 aa, Borrelia burgdorferi B31
DENFKKIEE

SEQ ID NO: 8688 - protein, 9 aa, Borrelia burgdorferi B31
ENFKKIEEE

SEQ ID NO: 8689 - protein, 9 aa, Borrelia burgdorferi B31
NFKKIEEEF

SEQ ID NO: 8690 - protein, 9 aa, Borrelia burgdorferi B31
FKKIEEEFK

SEQ ID NO: 8691 - protein, 9 aa, Borrelia burgdorferi B31
KKIEEEFKD

SEQ ID NO: 8692 - protein, 9 aa, Borrelia burgdorferi B31
KIEEEFKDT

SEQ ID NO: 8693 - protein, 9 aa, Borrelia burgdorferi B31
IEEEFKDTL

SEQ ID NO: 8694 - protein, 9 aa, Borrelia burgdorferi B31
EEEFKDTLT

SEQ ID NO: 8695 - protein, 9 aa, Borrelia burgdorferi B31
EEFKDTLTK

SEQ ID NO: 8696 - protein, 9 aa, Borrelia burgdorferi B31
EFKDTLTKV

SEQ ID NO: 8697 - protein, 9 aa, Borrelia burgdorferi B31
FKDTLTKVK

SEQ ID NO: 8698 - protein, 9 aa, Borrelia burgdorferi B31
KDTLTKVKE

SEQ ID NO: 8699 - protein, 9 aa, Borrelia burgdorferi B31
DTLTKVKEI

SEQ ID NO: 8700 - protein, 9 aa, Borrelia burgdorferi B31
TLTKVKEIL

SEQ ID NO: 8701 - protein, 9 aa, Borrelia burgdorferi B31
LTKVKEILK

SEQ ID NO: 8702 - protein, 9 aa, Borrelia burgdorferi B31
TKVKEILKD

SEQ ID NO: 8703 - protein, 9 aa, Borrelia burgdorferi B31
KVKEILKDH

SEQ ID NO: 8704 - protein, 9 aa, Borrelia burgdorferi B31
VKEILKDHI

SEQ ID NO: 8705 - protein, 9 aa, Borrelia burgdorferi B31
KEILKDHIK

SEQ ID NO: 8706 - protein, 9 aa, Borrelia burgdorferi B31
EILKDHIKE

SEQ ID NO: 8707 - protein, 9 aa, Borrelia burgdorferi B31
ILKDHIKEV

SEQ ID NO: 8708 - protein, 9 aa, Borrelia burgdorferi B31
LKDHIKEVN

SEQ ID NO: 8709 - protein, 9 aa, Borrelia burgdorferi B31
KDHIKEVNL

SEQ ID NO: 8710 - protein, 9 aa, Borrelia burgdorferi B31
DHIKEVNLS

SEQ ID NO: 8711 - protein, 9 aa, Borrelia burgdorferi B31
HIKEVNLSA

SEQ ID NO: 8712 - protein, 9 aa, Borrelia burgdorferi B31
IKEVNLSAT

SEQ ID NO: 8713 - protein, 9 aa, Borrelia burgdorferi B31
KEVNLSATL

SEQ ID NO: 8714 - protein, 9 aa, Borrelia burgdorferi B31
EVNLSATLI

SEQ ID NO: 8715 - protein, 9 aa, Borrelia burgdorferi B31
VNLSATLIK

SEQ ID NO: 8716 - protein, 9 aa, Borrelia burgdorferi B31
NLSATLIKE

SEQ ID NO: 8717 - protein, 9 aa, Borrelia burgdorferi B31
LSATLIKEP

SEQ ID NO: 8718 - protein, 9 aa, Borrelia burgdorferi B31
SATLIKEPS

SEQ ID NO: 8719 - protein, 9 aa, Borrelia burgdorferi B31
ATLIKEPSA

SEQ ID NO: 8720 - protein, 9 aa, Borrelia burgdorferi B31
TLIKEPSAI

SEQ ID NO: 8721 - protein, 9 aa, Borrelia burgdorferi B31
LIKEPSAII

SEQ ID NO: 8722 - protein, 9 aa, Borrelia burgdorferi B31
IKEPSAIII

SEQ ID NO: 8723 - protein, 9 aa, Borrelia burgdorferi B31
KEPSAIIID

SEQ ID NO: 8724 - protein, 9 aa, Borrelia burgdorferi B31
EPSAIIIDS

SEQ ID NO: 8725 - protein, 9 aa, Borrelia burgdorferi B31
PSAIIIDSN

SEQ ID NO: 8726 - protein, 9 aa, Borrelia burgdorferi B31
SAIIIDSND

SEQ ID NO: 8727 - protein, 9 aa, Borrelia burgdorferi B31
AIIIDSNDP

SEQ ID NO: 8728 - protein, 9 aa, Borrelia burgdorferi B31
IIIDSNDPT

SEQ ID NO: 8729 - protein, 9 aa, Borrelia burgdorferi B31
IIDSNDPTY

SEQ ID NO: 8730 - protein, 9 aa, Borrelia burgdorferi B31
IDSNDPTYQ

SEQ ID NO: 8731 - protein, 9 aa, Borrelia burgdorferi B31
DSNDPTYQM

SEQ ID NO: 8732 - protein, 9 aa, Borrelia burgdorferi B31
SNDPTYQMQ

SEQ ID NO: 8733 - protein, 9 aa, Borrelia burgdorferi B31
NDPTYQMQK

SEQ ID NO: 8734 - protein, 9 aa, Borrelia burgdorferi B31
DPTYQMQKI

SEQ ID NO: 8735 - protein, 9 aa, Borrelia burgdorferi B31
PTYQMQKIM

SEQ ID NO: 8736 - protein, 9 aa, Borrelia burgdorferi B31
TYQMQKIML

SEQ ID NO: 8737 - protein, 9 aa, Borrelia burgdorferi B31
YQMQKIMLS

SEQ ID NO: 8738 - protein, 9 aa, Borrelia burgdorferi B31
QMQKIMLSM

SEQ ID NO: 8739 - protein, 9 aa, Borrelia burgdorferi B31
MQKIMLSMG

SEQ ID NO: 8740 - protein, 9 aa, Borrelia burgdorferi B31
QKIMLSMGQ

SEQ ID NO: 8741 - protein, 9 aa, Borrelia burgdorferi B31
KIMLSMGQE

SEQ ID NO: 8742 - protein, 9 aa, Borrelia burgdorferi B31
IMLSMGQEV

SEQ ID NO: 8743 - protein, 9 aa, Borrelia burgdorferi B31
MLSMGQEVK

SEQ ID NO: 8744 - protein, 9 aa, Borrelia burgdorferi B31
LSMGQEVKE

SEQ ID NO: 8745 - protein, 9 aa, Borrelia burgdorferi B31
SMGQEVKEI

SEQ ID NO: 8746 - protein, 9 aa, Borrelia burgdorferi B31
MGQEVKEIK

SEQ ID NO: 8747 - protein, 9 aa, Borrelia burgdorferi B31
GQEVKEIKP

SEQ ID NO: 8748 - protein, 9 aa, Borrelia burgdorferi B31
QEVKEIKPI

SEQ ID NO: 8749 - protein, 9 aa, Borrelia burgdorferi B31
EVKEIKPIL

SEQ ID NO: 8750 - protein, 9 aa, Borrelia burgdorferi B31
VKEIKPILE

SEQ ID NO: 8751 - protein, 9 aa, Borrelia burgdorferi B31
KEIKPILEL

SEQ ID NO: 8752 - protein, 9 aa, Borrelia burgdorferi B31
EIKPILELN

SEQ ID NO: 8753 - protein, 9 aa, Borrelia burgdorferi B31
IKPILELNP

SEQ ID NO: 8754 - protein, 9 aa, Borrelia burgdorferi B31
KPILELNPN

SEQ ID NO: 8755 - protein, 9 aa, Borrelia burgdorferi B31
PILELNPNN

SEQ ID NO: 8756 - protein, 9 aa, Borrelia burgdorferi B31
ILELNPNNK

SEQ ID NO: 8757 - protein, 9 aa, Borrelia burgdorferi B31
LELNPNNKI

SEQ ID NO: 8758 - protein, 9 aa, Borrelia burgdorferi B31
ELNPNNKIV

SEQ ID NO: 8759 - protein, 9 aa, Borrelia burgdorferi B31
LNPNNKIVQ

SEQ ID NO: 8760 - protein, 9 aa, Borrelia burgdorferi B31
NPNNKIVQN

SEQ ID NO: 8761 - protein, 9 aa, Borrelia burgdorferi B31
PNNKIVQNL

SEQ ID NO: 8762 - protein, 9 aa, Borrelia burgdorferi B31
NNKIVQNLK

SEQ ID NO: 8763 - protein, 9 aa, Borrelia burgdorferi B31
NKIVQNLKN

SEQ ID NO: 8764 - protein, 9 aa, Borrelia burgdorferi B31
KIVQNLKNL

SEQ ID NO: 8765 - protein, 9 aa, Borrelia burgdorferi B31
IVQNLKNLE

SEQ ID NO: 8766 - protein, 9 aa, Borrelia burgdorferi B31
VQNLKNLEP

SEQ ID NO: 8767 - protein, 9 aa, Borrelia burgdorferi B31
QNLKNLEPE

SEQ ID NO: 8768 - protein, 9 aa, Borrelia burgdorferi B31
NLKNLEPEK

SEQ ID NO: 8769 - protein, 9 aa, Borrelia burgdorferi B31
LKNLEPEKL

SEQ ID NO: 8770 - protein, 9 aa, Borrelia burgdorferi B31
KNLEPEKLE

SEQ ID NO: 8771 - protein, 9 aa, Borrelia burgdorferi B31
NLEPEKLEK

SEQ ID NO: 8772 - protein, 9 aa, Borrelia burgdorferi B31
LEPEKLEKI

SEQ ID NO: 8773 - protein, 9 aa, Borrelia burgdorferi B31
EPEKLEKIS

SEQ ID NO: 8774 - protein, 9 aa, Borrelia burgdorferi B31
PEKLEKISI

SEQ ID NO: 8775 - protein, 9 aa, Borrelia burgdorferi B31
EKLEKISIL

SEQ ID NO: 8776 - protein, 9 aa, Borrelia burgdorferi B31
KLEKISILL

SEQ ID NO: 8777 - protein, 9 aa, Borrelia burgdorferi B31
LEKISILLF

SEQ ID NO: 8778 - protein, 9 aa, Borrelia burgdorferi B31
EKISILLFE

SEQ ID NO: 8779 - protein, 9 aa, Borrelia burgdorferi B31
KISILLFEE

SEQ ID NO: 8780 - protein, 9 aa, Borrelia burgdorferi B31
ISILLFEEA

SEQ ID NO: 8781 - protein, 9 aa, Borrelia burgdorferi B31
SILLFEEAM

SEQ ID NO: 8782 - protein, 9 aa, Borrelia burgdorferi B31
ILLFEEAML

SEQ ID NO: 8783 - protein, 9 aa, Borrelia burgdorferi B31
LLFEEAMLT

SEQ ID NO: 8784 - protein, 9 aa, Borrelia burgdorferi B31
LFEEAMLTS

SEQ ID NO: 8785 - protein, 9 aa, Borrelia burgdorferi B31
FEEAMLTSG

SEQ ID NO: 8786 - protein, 9 aa, Borrelia burgdorferi B31
EEAMLTSGM

SEQ ID NO: 8787 - protein, 9 aa, Borrelia burgdorferi B31
EAMLTSGMP

SEQ ID NO: 8788 - protein, 9 aa, Borrelia burgdorferi B31
AMLTSGMPS

SEQ ID NO: 8789 - protein, 9 aa, Borrelia burgdorferi B31
MLTSGMPSK

SEQ ID NO: 8790 - protein, 9 aa, Borrelia burgdorferi B31
LTSGMPSKN

SEQ ID NO: 8791 - protein, 9 aa, Borrelia burgdorferi B31
TSGMPSKNP

SEQ ID NO: 8792 - protein, 9 aa, Borrelia burgdorferi B31
SGMPSKNPG

SEQ ID NO: 8793 - protein, 9 aa, Borrelia burgdorferi B31
GMPSKNPGK

SEQ ID NO: 8794 - protein, 9 aa, Borrelia burgdorferi B31
MPSKNPGKF

SEQ ID NO: 8795 - protein, 9 aa, Borrelia burgdorferi B31
PSKNPGKFI

SEQ ID NO: 8796 - protein, 9 aa, Borrelia burgdorferi B31
SKNPGKFIN

SEQ ID NO: 8797 - protein, 9 aa, Borrelia burgdorferi B31
KNPGKFINI

SEQ ID NO: 8798 - protein, 9 aa, Borrelia burgdorferi B31
NPGKFINII

SEQ ID NO: 8799 - protein, 9 aa, Borrelia burgdorferi B31
PGKFINIIN

SEQ ID NO: 8800 - protein, 9 aa, Borrelia burgdorferi B31
GKFINIINE

SEQ ID NO: 8801 - protein, 9 aa, Borrelia burgdorferi B31
KFINIINEF

SEQ ID NO: 8802 - protein, 9 aa, Borrelia burgdorferi B31
FINIINEFI

SEQ ID NO: 8803 - protein, 9 aa, Borrelia burgdorferi B31
INIINEFIE

SEQ ID NO: 8804 - protein, 9 aa, Borrelia burgdorferi B31
NIINEFIEK

SEQ ID NO: 8805 - protein, 9 aa, Borrelia burgdorferi B31
IINEFIEKD

SEQ ID NO: 8806 - protein, 9 aa, Borrelia burgdorferi B31
INEFIEKDF

SEQ ID NO: 8807 - protein, 10 aa, Borrelia burgdorferi B31
MILIFYFKQI

SEQ ID NO: 8808 - protein, 10 aa, Borrelia burgdorferi B31
ILIFYFKQIA

SEQ ID NO: 8809 - protein, 10 aa, Borrelia burgdorferi B31
LIFYFKQIAL

SEQ ID NO: 8810 - protein, 10 aa, Borrelia burgdorferi B31
IFYFKQIALF

SEQ ID NO: 8811 - protein, 10 aa, Borrelia burgdorferi B31
FYFKQIALFI

SEQ ID NO: 8812 - protein, 10 aa, Borrelia burgdorferi B31
YFKQIALFII

SEQ ID NO: 8813 - protein, 10 aa, Borrelia burgdorferi B31
FKQIALFIIF

SEQ ID NO: 8814 - protein, 10 aa, Borrelia burgdorferi B31
KQIALFIIFR

SEQ ID NO: 8815 - protein, 10 aa, Borrelia burgdorferi B31
QIALFIIFRL

SEQ ID NO: 8816 - protein, 10 aa, Borrelia burgdorferi B31
IALFIIFRLC

SEQ ID NO: 8817 - protein, 10 aa, Borrelia burgdorferi B31
ALFIIFRLCY

SEQ ID NO: 8818 - protein, 10 aa, Borrelia burgdorferi B31
LFIIFRLCYI

SEQ ID NO: 8819 - protein, 10 aa, Borrelia burgdorferi B31
FIIFRLCYII

SEQ ID NO: 8820 - protein, 10 aa, Borrelia burgdorferi B31
IIFRLCYIIK

SEQ ID NO: 8821 - protein, 10 aa, Borrelia burgdorferi B31
IFRLCYIIKK

SEQ ID NO: 8822 - protein, 10 aa, Borrelia burgdorferi B31
FRLCYIIKKV

SEQ ID NO: 8823 - protein, 10 aa, Borrelia burgdorferi B31
RLCYIIKKVK

SEQ ID NO: 8824 - protein, 10 aa, Borrelia burgdorferi B31
LCYIIKKVKI

SEQ ID NO: 8825 - protein, 10 aa, Borrelia burgdorferi B31
CYIIKKVKIK

SEQ ID NO: 8826 - protein, 10 aa, Borrelia burgdorferi B31
YIIKKVKIKL

SEQ ID NO: 8827 - protein, 10 aa, Borrelia burgdorferi B31
IIKKVKIKLK

SEQ ID NO: 8828 - protein, 10 aa, Borrelia burgdorferi B31
IKKVKIKLKR

SEQ ID NO: 8829 - protein, 10 aa, Borrelia burgdorferi B31
KKVKIKLKRK

SEQ ID NO: 8830 - protein, 10 aa, Borrelia burgdorferi B31
KVKIKLKRKS

SEQ ID NO: 8831 - protein, 10 aa, Borrelia burgdorferi B31
VKIKLKRKSC

SEQ ID NO: 8832 - protein, 10 aa, Borrelia burgdorferi B31
KIKLKRKSCM

SEQ ID NO: 8833 - protein, 10 aa, Borrelia burgdorferi B31
IKLKRKSCMK

SEQ ID NO: 8834 - protein, 10 aa, Borrelia burgdorferi B31
KLKRKSCMKK

SEQ ID NO: 8835 - protein, 10 aa, Borrelia burgdorferi B31
LKRKSCMKKQ

SEQ ID NO: 8836 - protein, 10 aa, Borrelia burgdorferi B31
KRKSCMKKQF

SEQ ID NO: 8837 - protein, 10 aa, Borrelia burgdorferi B31
RKSCMKKQFD

SEQ ID NO: 8838 - protein, 10 aa, Borrelia burgdorferi B31
KSCMKKQFDT

SEQ ID NO: 8839 - protein, 10 aa, Borrelia burgdorferi B31
SCMKKQFDTE

SEQ ID NO: 8840 - protein, 10 aa, Borrelia burgdorferi B31
CMKKQFDTEV

SEQ ID NO: 8841 - protein, 10 aa, Borrelia burgdorferi B31
MKKQFDTEVN

SEQ ID NO: 8842 - protein, 10 aa, Borrelia burgdorferi B31
KKQFDTEVND

SEQ ID NO: 8843 - protein, 10 aa, Borrelia burgdorferi B31
KQFDTEVNDL

SEQ ID NO: 8844 - protein, 10 aa, Borrelia burgdorferi B31
QFDTEVNDLL

SEQ ID NO: 8845 - protein, 10 aa, Borrelia burgdorferi B31
FDTEVNDLLY

SEQ ID NO: 8846 - protein, 10 aa, Borrelia burgdorferi B31
DTEVNDLLYL

SEQ ID NO: 8847 - protein, 10 aa, Borrelia burgdorferi B31
TEVNDLLYLI

SEQ ID NO: 8848 - protein, 10 aa, Borrelia burgdorferi B31
EVNDLLYLII

SEQ ID NO: 8849 - protein, 10 aa, Borrelia burgdorferi B31
VNDLLYLIIH

SEQ ID NO: 8850 - protein, 10 aa, Borrelia burgdorferi B31
NDLLYLIIHS

SEQ ID NO: 8851 - protein, 10 aa, Borrelia burgdorferi B31
DLLYLIIHSL

SEQ ID NO: 8852 - protein, 10 aa, Borrelia burgdorferi B31
LLYLIIHSLY

SEQ ID NO: 8853 - protein, 10 aa, Borrelia burgdorferi B31
LYLIIHSLYS

SEQ ID NO: 8854 - protein, 10 aa, Borrelia burgdorferi B31
YLIIHSLYSH

SEQ ID NO: 8855 - protein, 10 aa, Borrelia burgdorferi B31
LIIHSLYSHK

SEQ ID NO: 8856 - protein, 10 aa, Borrelia burgdorferi B31
IIHSLYSHKE

SEQ ID NO: 8857 - protein, 10 aa, Borrelia burgdorferi B31
IHSLYSHKEI

SEQ ID NO: 8858 - protein, 10 aa, Borrelia burgdorferi B31
HSLYSHKEIF

SEQ ID NO: 8859 - protein, 10 aa, Borrelia burgdorferi B31
SLYSHKEIFL

SEQ ID NO: 8860 - protein, 10 aa, Borrelia burgdorferi B31
LYSHKEIFLR

SEQ ID NO: 8861 - protein, 10 aa, Borrelia burgdorferi B31
YSHKEIFLRE

SEQ ID NO: 8862 - protein, 10 aa, Borrelia burgdorferi B31
SHKEIFLREL

SEQ ID NO: 8863 - protein, 10 aa, Borrelia burgdorferi B31
HKEIFLRELI

SEQ ID NO: 8864 - protein, 10 aa, Borrelia burgdorferi B31
KEIFLRELIS

SEQ ID NO: 8865 - protein, 10 aa, Borrelia burgdorferi B31
EIFLRELISN

SEQ ID NO: 8866 - protein, 10 aa, Borrelia burgdorferi B31
IFLRELISNA

SEQ ID NO: 8867 - protein, 10 aa, Borrelia burgdorferi B31
FLRELISNAS

SEQ ID NO: 8868 - protein, 10 aa, Borrelia burgdorferi B31
LRELISNASD

SEQ ID NO: 8869 - protein, 10 aa, Borrelia burgdorferi B31
RELISNASDA

SEQ ID NO: 8870 - protein, 10 aa, Borrelia burgdorferi B31
ELISNASDAI

SEQ ID NO: 8871 - protein, 10 aa, Borrelia burgdorferi B31
LISNASDAID

SEQ ID NO: 8872 - protein, 10 aa, Borrelia burgdorferi B31
ISNASDAIDK

SEQ ID NO: 8873 - protein, 10 aa, Borrelia burgdorferi B31
SNASDAIDKL

SEQ ID NO: 8874 - protein, 10 aa, Borrelia burgdorferi B31
NASDAIDKLK

SEQ ID NO: 8875 - protein, 10 aa, Borrelia burgdorferi B31
ASDAIDKLKF

SEQ ID NO: 8876 - protein, 10 aa, Borrelia burgdorferi B31
SDAIDKLKFL

SEQ ID NO: 8877 - protein, 10 aa, Borrelia burgdorferi B31
DAIDKLKFLS

SEQ ID NO: 8878 - protein, 10 aa, Borrelia burgdorferi B31
AIDKLKFLSL

SEQ ID NO: 8879 - protein, 10 aa, Borrelia burgdorferi B31
IDKLKFLSLT

SEQ ID NO: 8880 - protein, 10 aa, Borrelia burgdorferi B31
DKLKFLSLTN

SEQ ID NO: 8881 - protein, 10 aa, Borrelia burgdorferi B31
KLKFLSLTNE

SEQ ID NO: 8882 - protein, 10 aa, Borrelia burgdorferi B31
LKFLSLTNEK

SEQ ID NO: 8883 - protein, 10 aa, Borrelia burgdorferi B31
KFLSLTNEKF

SEQ ID NO: 8884 - protein, 10 aa, Borrelia burgdorferi B31
FLSLTNEKFK

SEQ ID NO: 8885 - protein, 10 aa, Borrelia burgdorferi B31
LSLTNEKFKN

SEQ ID NO: 8886 - protein, 10 aa, Borrelia burgdorferi B31
SLTNEKFKNI

SEQ ID NO: 8887 - protein, 10 aa, Borrelia burgdorferi B31
LTNEKFKNIA

SEQ ID NO: 8888 - protein, 10 aa, Borrelia burgdorferi B31
TNEKFKNIAL

SEQ ID NO: 8889 - protein, 10 aa, Borrelia burgdorferi B31
NEKFKNIALE

SEQ ID NO: 8890 - protein, 10 aa, Borrelia burgdorferi B31
EKFKNIALEP

SEQ ID NO: 8891 - protein, 10 aa, Borrelia burgdorferi B31
KFKNIALEPK

SEQ ID NO: 8892 - protein, 10 aa, Borrelia burgdorferi B31
FKNIALEPKI

SEQ ID NO: 8893 - protein, 10 aa, Borrelia burgdorferi B31
KNIALEPKIE

SEQ ID NO: 8894 - protein, 10 aa, Borrelia burgdorferi B31
NIALEPKIEI

SEQ ID NO: 8895 - protein, 10 aa, Borrelia burgdorferi B31
IALEPKIEIS

SEQ ID NO: 8896 - protein, 10 aa, Borrelia burgdorferi B31
ALEPKIEISF

SEQ ID NO: 8897 - protein, 10 aa, Borrelia burgdorferi B31
LEPKIEISFD

SEQ ID NO: 8898 - protein, 10 aa, Borrelia burgdorferi B31
EPKIEISFDD

SEQ ID NO: 8899 - protein, 10 aa, Borrelia burgdorferi B31
PKIEISFDDK

SEQ ID NO: 8900 - protein, 10 aa, Borrelia burgdorferi B31
KIEISFDDKS

SEQ ID NO: 8901 - protein, 10 aa, Borrelia burgdorferi B31
IEISFDDKSI

SEQ ID NO: 8902 - protein, 10 aa, Borrelia burgdorferi B31
EISFDDKSIL

SEQ ID NO: 8903 - protein, 10 aa, Borrelia burgdorferi B31
ISFDDKSILI

SEQ ID NO: 8904 - protein, 10 aa, Borrelia burgdorferi B31
SFDDKSILIK

SEQ ID NO: 8905 - protein, 10 aa, Borrelia burgdorferi B31
FDDKSILIKD

SEQ ID NO: 8906 - protein, 10 aa, Borrelia burgdorferi B31
DDKSILIKDN

SEQ ID NO: 8907 - protein, 10 aa, Borrelia burgdorferi B31
DKSILIKDNG

SEQ ID NO: 8908 - protein, 10 aa, Borrelia burgdorferi B31
KSILIKDNGI

SEQ ID NO: 8909 - protein, 10 aa, Borrelia burgdorferi B31
SILIKDNGIG

SEQ ID NO: 8910 - protein, 10 aa, Borrelia burgdorferi B31
ILIKDNGIGM

SEQ ID NO: 8911 - protein, 10 aa, Borrelia burgdorferi B31
LIKDNGIGMD

SEQ ID NO: 8912 - protein, 10 aa, Borrelia burgdorferi B31
IKDNGIGMDE

SEQ ID NO: 8913 - protein, 10 aa, Borrelia burgdorferi B31
KDNGIGMDEQ

SEQ ID NO: 8914 - protein, 10 aa, Borrelia burgdorferi B31
DNGIGMDEQD

SEQ ID NO: 8915 - protein, 10 aa, Borrelia burgdorferi B31
NGIGMDEQDL

SEQ ID NO: 8916 - protein, 10 aa, Borrelia burgdorferi B31
GIGMDEQDLT

SEQ ID NO: 8917 - protein, 10 aa, Borrelia burgdorferi B31
IGMDEQDLTN

SEQ ID NO: 8918 - protein, 10 aa, Borrelia burgdorferi B31
GMDEQDLTNH

SEQ ID NO: 8919 - protein, 10 aa, Borrelia burgdorferi B31
MDEQDLTNHL

SEQ ID NO: 8920 - protein, 10 aa, Borrelia burgdorferi B31
DEQDLTNHLG

SEQ ID NO: 8921 - protein, 10 aa, Borrelia burgdorferi B31
EQDLTNHLGV

SEQ ID NO: 8922 - protein, 10 aa, Borrelia burgdorferi B31
QDLTNHLGVI

SEQ ID NO: 8923 - protein, 10 aa, Borrelia burgdorferi B31
DLTNHLGVIA

SEQ ID NO: 8924 - protein, 10 aa, Borrelia burgdorferi B31
LTNHLGVIAK

SEQ ID NO: 8925 - protein, 10 aa, Borrelia burgdorferi B31
TNHLGVIAKS

SEQ ID NO: 8926 - protein, 10 aa, Borrelia burgdorferi B31
NHLGVIAKSG

SEQ ID NO: 8927 - protein, 10 aa, Borrelia burgdorferi B31
HLGVIAKSGT

SEQ ID NO: 8928 - protein, 10 aa, Borrelia burgdorferi B31
LGVIAKSGTK

SEQ ID NO: 8929 - protein, 10 aa, Borrelia burgdorferi B31
GVIAKSGTKE

SEQ ID NO: 8930 - protein, 10 aa, Borrelia burgdorferi B31
VIAKSGTKEF

SEQ ID NO: 8931 - protein, 10 aa, Borrelia burgdorferi B31
IAKSGTKEFI

SEQ ID NO: 8932 - protein, 10 aa, Borrelia burgdorferi B31
AKSGTKEFIN

SEQ ID NO: 8933 - protein, 10 aa, Borrelia burgdorferi B31
KSGTKEFINN

SEQ ID NO: 8934 - protein, 10 aa, Borrelia burgdorferi B31
SGTKEFINNL

SEQ ID NO: 8935 - protein, 10 aa, Borrelia burgdorferi B31
GTKEFINNLK

SEQ ID NO: 8936 - protein, 10 aa, Borrelia burgdorferi B31
TKEFINNLKQ

SEQ ID NO: 8937 - protein, 10 aa, Borrelia burgdorferi B31
KEFINNLKQD

SEQ ID NO: 8938 - protein, 10 aa, Borrelia burgdorferi B31
EFINNLKQDE

SEQ ID NO: 8939 - protein, 10 aa, Borrelia burgdorferi B31
FINNLKQDEK

SEQ ID NO: 8940 - protein, 10 aa, Borrelia burgdorferi B31
INNLKQDEKK

SEQ ID NO: 8941 - protein, 10 aa, Borrelia burgdorferi B31
NNLKQDEKKS

SEQ ID NO: 8942 - protein, 10 aa, Borrelia burgdorferi B31
NLKQDEKKSA

SEQ ID NO: 8943 - protein, 10 aa, Borrelia burgdorferi B31
LKQDEKKSAS

SEQ ID NO: 8944 - protein, 10 aa, Borrelia burgdorferi B31
KQDEKKSASL

SEQ ID NO: 8945 - protein, 10 aa, Borrelia burgdorferi B31
QDEKKSASLI

SEQ ID NO: 8946 - protein, 10 aa, Borrelia burgdorferi B31
DEKKSASLIG

SEQ ID NO: 8947 - protein, 10 aa, Borrelia burgdorferi B31
EKKSASLIGQ

SEQ ID NO: 8948 - protein, 10 aa, Borrelia burgdorferi B31
KKSASLIGQF

SEQ ID NO: 8949 - protein, 10 aa, Borrelia burgdorferi B31
KSASLIGQFG

SEQ ID NO: 8950 - protein, 10 aa, Borrelia burgdorferi B31
SASLIGQFGV

SEQ ID NO: 8951 - protein, 10 aa, Borrelia burgdorferi B31
ASLIGQFGVG

SEQ ID NO: 8952 - protein, 10 aa, Borrelia burgdorferi B31
SLIGQFGVGF

SEQ ID NO: 8953 - protein, 10 aa, Borrelia burgdorferi B31
LIGQFGVGFY

SEQ ID NO: 8954 - protein, 10 aa, Borrelia burgdorferi B31
IGQFGVGFYS

SEQ ID NO: 8955 - protein, 10 aa, Borrelia burgdorferi B31
GQFGVGFYSA

SEQ ID NO: 8956 - protein, 10 aa, Borrelia burgdorferi B31
QFGVGFYSAF

SEQ ID NO: 8957 - protein, 10 aa, Borrelia burgdorferi B31
FGVGFYSAFI

SEQ ID NO: 8958 - protein, 10 aa, Borrelia burgdorferi B31
GVGFYSAFIV

SEQ ID NO: 8959 - protein, 10 aa, Borrelia burgdorferi B31
VGFYSAFIVS

SEQ ID NO: 8960 - protein, 10 aa, Borrelia burgdorferi B31
GFYSAFIVSE

SEQ ID NO: 8961 - protein, 10 aa, Borrelia burgdorferi B31
FYSAFIVSEK

SEQ ID NO: 8962 - protein, 10 aa, Borrelia burgdorferi B31
YSAFIVSEKV

SEQ ID NO: 8963 - protein, 10 aa, Borrelia burgdorferi B31
SAFIVSEKVE

SEQ ID NO: 8964 - protein, 10 aa, Borrelia burgdorferi B31
AFIVSEKVEV

SEQ ID NO: 8965 - protein, 10 aa, Borrelia burgdorferi B31
FIVSEKVEVT

SEQ ID NO: 8966 - protein, 10 aa, Borrelia burgdorferi B31
IVSEKVEVTS

SEQ ID NO: 8967 - protein, 10 aa, Borrelia burgdorferi B31
VSEKVEVTSK

SEQ ID NO: 8968 - protein, 10 aa, Borrelia burgdorferi B31
SEKVEVTSKK

SEQ ID NO: 8969 - protein, 10 aa, Borrelia burgdorferi B31
EKVEVTSKKA

SEQ ID NO: 8970 - protein, 10 aa, Borrelia burgdorferi B31
KVEVTSKKAL

SEQ ID NO: 8971 - protein, 10 aa, Borrelia burgdorferi B31
VEVTSKKALE

SEQ ID NO: 8972 - protein, 10 aa, Borrelia burgdorferi B31
EVTSKKALES

SEQ ID NO: 8973 - protein, 10 aa, Borrelia burgdorferi B31
VTSKKALESD

SEQ ID NO: 8974 - protein, 10 aa, Borrelia burgdorferi B31
TSKKALESDA

SEQ ID NO: 8975 - protein, 10 aa, Borrelia burgdorferi B31
SKKALESDAY

SEQ ID NO: 8976 - protein, 10 aa, Borrelia burgdorferi B31
KKALESDAYI

SEQ ID NO: 8977 - protein, 10 aa, Borrelia burgdorferi B31
KALESDAYIW

SEQ ID NO: 8978 - protein, 10 aa, Borrelia burgdorferi B31
ALESDAYIWS

SEQ ID NO: 8979 - protein, 10 aa, Borrelia burgdorferi B31
LESDAYIWSS

SEQ ID NO: 8980 - protein, 10 aa, Borrelia burgdorferi B31
ESDAYIWSSD

SEQ ID NO: 8981 - protein, 10 aa, Borrelia burgdorferi B31
SDAYIWSSDG

SEQ ID NO: 8982 - protein, 10 aa, Borrelia burgdorferi B31
DAYIWSSDGK

SEQ ID NO: 8983 - protein, 10 aa, Borrelia burgdorferi B31
AYIWSSDGKT

SEQ ID NO: 8984 - protein, 10 aa, Borrelia burgdorferi B31
YIWSSDGKTG

SEQ ID NO: 8985 - protein, 10 aa, Borrelia burgdorferi B31
IWSSDGKTGY

SEQ ID NO: 8986 - protein, 10 aa, Borrelia burgdorferi B31
WSSDGKTGYE

SEQ ID NO: 8987 - protein, 10 aa, Borrelia burgdorferi B31
SSDGKTGYEI

SEQ ID NO: 8988 - protein, 10 aa, Borrelia burgdorferi B31
SDGKTGYEIE

SEQ ID NO: 8989 - protein, 10 aa, Borrelia burgdorferi B31
DGKTGYEIEK

SEQ ID NO: 8990 - protein, 10 aa, Borrelia burgdorferi B31
GKTGYEIEKA

SEQ ID NO: 8991 - protein, 10 aa, Borrelia burgdorferi B31
KTGYEIEKAK

SEQ ID NO: 8992 - protein, 10 aa, Borrelia burgdorferi B31
TGYEIEKAKK

SEQ ID NO: 8993 - protein, 10 aa, Borrelia burgdorferi B31
GYEIEKAKKE

SEQ ID NO: 8994 - protein, 10 aa, Borrelia burgdorferi B31
YEIEKAKKEE

SEQ ID NO: 8995 - protein, 10 aa, Borrelia burgdorferi B31
EIEKAKKEES

SEQ ID NO: 8996 - protein, 10 aa, Borrelia burgdorferi B31
IEKAKKEESG

SEQ ID NO: 8997 - protein, 10 aa, Borrelia burgdorferi B31
EKAKKEESGT

SEQ ID NO: 8998 - protein, 10 aa, Borrelia burgdorferi B31
KAKKEESGTE

SEQ ID NO: 8999 - protein, 10 aa, Borrelia burgdorferi B31
AKKEESGTEI

SEQ ID NO: 9000 - protein, 10 aa, Borrelia burgdorferi B31
KKEESGTEIK

SEQ ID NO: 9001 - protein, 10 aa, Borrelia burgdorferi B31
KEESGTEIKL

SEQ ID NO: 9002 - protein, 10 aa, Borrelia burgdorferi B31
EESGTEIKLY

SEQ ID NO: 9003 - protein, 10 aa, Borrelia burgdorferi B31
ESGTEIKLYL

SEQ ID NO: 9004 - protein, 10 aa, Borrelia burgdorferi B31
SGTEIKLYLN

SEQ ID NO: 9005 - protein, 10 aa, Borrelia burgdorferi B31
GTEIKLYLNK

SEQ ID NO: 9006 - protein, 10 aa, Borrelia burgdorferi B31
TEIKLYLNKE

SEQ ID NO: 9007 - protein, 10 aa, Borrelia burgdorferi B31
EIKLYLNKEG

SEQ ID NO: 9008 - protein, 10 aa, Borrelia burgdorferi B31
IKLYLNKEGL

SEQ ID NO: 9009 - protein, 10 aa, Borrelia burgdorferi B31
KLYLNKEGLE

SEQ ID NO: 9010 - protein, 10 aa, Borrelia burgdorferi B31
LYLNKEGLEY

SEQ ID NO: 9011 - protein, 10 aa, Borrelia burgdorferi B31
YLNKEGLEYA

SEQ ID NO: 9012 - protein, 10 aa, Borrelia burgdorferi B31
LNKEGLEYAN

SEQ ID NO: 9013 - protein, 10 aa, Borrelia burgdorferi B31
NKEGLEYANK

SEQ ID NO: 9014 - protein, 10 aa, Borrelia burgdorferi B31
KEGLEYANKW

SEQ ID NO: 9015 - protein, 10 aa, Borrelia burgdorferi B31
EGLEYANKWK

SEQ ID NO: 9016 - protein, 10 aa, Borrelia burgdorferi B31
GLEYANKWKI

SEQ ID NO: 9017 - protein, 10 aa, Borrelia burgdorferi B31
LEYANKWKIQ

SEQ ID NO: 9018 - protein, 10 aa, Borrelia burgdorferi B31
EYANKWKIQE

SEQ ID NO: 9019 - protein, 10 aa, Borrelia burgdorferi B31
YANKWKIQEI

SEQ ID NO: 9020 - protein, 10 aa, Borrelia burgdorferi B31
ANKWKIQEII

SEQ ID NO: 9021 - protein, 10 aa, Borrelia burgdorferi B31
NKWKIQEIIK

SEQ ID NO: 9022 - protein, 10 aa, Borrelia burgdorferi B31
KWKIQEIIKK

SEQ ID NO: 9023 - protein, 10 aa, Borrelia burgdorferi B31
WKIQEIIKKY

SEQ ID NO: 9024 - protein, 10 aa, Borrelia burgdorferi B31
KIQEIIKKYS

SEQ ID NO: 9025 - protein, 10 aa, Borrelia burgdorferi B31
IQEIIKKYSN

SEQ ID NO: 9026 - protein, 10 aa, Borrelia burgdorferi B31
QEIIKKYSNH

SEQ ID NO: 9027 - protein, 10 aa, Borrelia burgdorferi B31
EIIKKYSNHI

SEQ ID NO: 9028 - protein, 10 aa, Borrelia burgdorferi B31
IIKKYSNHIN

SEQ ID NO: 9029 - protein, 10 aa, Borrelia burgdorferi B31
IKKYSNHINY

SEQ ID NO: 9030 - protein, 10 aa, Borrelia burgdorferi B31
KKYSNHINYP

SEQ ID NO: 9031 - protein, 10 aa, Borrelia burgdorferi B31
KYSNHINYPI

SEQ ID NO: 9032 - protein, 10 aa, Borrelia burgdorferi B31
YSNHINYPIY

SEQ ID NO: 9033 - protein, 10 aa, Borrelia burgdorferi B31
SNHINYPIYI

SEQ ID NO: 9034 - protein, 10 aa, Borrelia burgdorferi B31
NHINYPIYIK

SEQ ID NO: 9035 - protein, 10 aa, Borrelia burgdorferi B31
HINYPIYIKY

SEQ ID NO: 9036 - protein, 10 aa, Borrelia burgdorferi B31
INYPIYIKYS

SEQ ID NO: 9037 - protein, 10 aa, Borrelia burgdorferi B31
NYPIYIKYSE

SEQ ID NO: 9038 - protein, 10 aa, Borrelia burgdorferi B31
YPIYIKYSEP

SEQ ID NO: 9039 - protein, 10 aa, Borrelia burgdorferi B31
PIYIKYSEPI

SEQ ID NO: 9040 - protein, 10 aa, Borrelia burgdorferi B31
IYIKYSEPIM

SEQ ID NO: 9041 - protein, 10 aa, Borrelia burgdorferi B31
YIKYSEPIMK

SEQ ID NO: 9042 - protein, 10 aa, Borrelia burgdorferi B31
IKYSEPIMKD

SEQ ID NO: 9043 - protein, 10 aa, Borrelia burgdorferi B31
KYSEPIMKDG

SEQ ID NO: 9044 - protein, 10 aa, Borrelia burgdorferi B31
YSEPIMKDGK

SEQ ID NO: 9045 - protein, 10 aa, Borrelia burgdorferi B31
SEPIMKDGKQ

SEQ ID NO: 9046 - protein, 10 aa, Borrelia burgdorferi B31
EPIMKDGKQE

SEQ ID NO: 9047 - protein, 10 aa, Borrelia burgdorferi B31
PIMKDGKQEG

SEQ ID NO: 9048 - protein, 10 aa, Borrelia burgdorferi B31
IMKDGKQEGI

SEQ ID NO: 9049 - protein, 10 aa, Borrelia burgdorferi B31
MKDGKQEGIE

SEQ ID NO: 9050 - protein, 10 aa, Borrelia burgdorferi B31
KDGKQEGIEE

SEQ ID NO: 9051 - protein, 10 aa, Borrelia burgdorferi B31
DGKQEGIEEK

SEQ ID NO: 9052 - protein, 10 aa, Borrelia burgdorferi B31
GKQEGIEEKE

SEQ ID NO: 9053 - protein, 10 aa, Borrelia burgdorferi B31
KQEGIEEKEE

SEQ ID NO: 9054 - protein, 10 aa, Borrelia burgdorferi B31
QEGIEEKEEK

SEQ ID NO: 9055 - protein, 10 aa, Borrelia burgdorferi B31
EGIEEKEEKL

SEQ ID NO: 9056 - protein, 10 aa, Borrelia burgdorferi B31
GIEEKEEKLN

SEQ ID NO: 9057 - protein, 10 aa, Borrelia burgdorferi B31
IEEKEEKLNE

SEQ ID NO: 9058 - protein, 10 aa, Borrelia burgdorferi B31
EEKEEKLNET

SEQ ID NO: 9059 - protein, 10 aa, Borrelia burgdorferi B31
EKEEKLNETT

SEQ ID NO: 9060 - protein, 10 aa, Borrelia burgdorferi B31
KEEKLNETTA

SEQ ID NO: 9061 - protein, 10 aa, Borrelia burgdorferi B31
EEKLNETTAL

SEQ ID NO: 9062 - protein, 10 aa, Borrelia burgdorferi B31
EKLNETTALW

SEQ ID NO: 9063 - protein, 10 aa, Borrelia burgdorferi B31
KLNETTALWT

SEQ ID NO: 9064 - protein, 10 aa, Borrelia burgdorferi B31
LNETTALWTK

SEQ ID NO: 9065 - protein, 10 aa, Borrelia burgdorferi B31
NETTALWTKN

SEQ ID NO: 9066 - protein, 10 aa, Borrelia burgdorferi B31
ETTALWTKNK

SEQ ID NO: 9067 - protein, 10 aa, Borrelia burgdorferi B31
TTALWTKNKS

SEQ ID NO: 9068 - protein, 10 aa, Borrelia burgdorferi B31
TALWTKNKSE

SEQ ID NO: 9069 - protein, 10 aa, Borrelia burgdorferi B31
ALWTKNKSEI

SEQ ID NO: 9070 - protein, 10 aa, Borrelia burgdorferi B31
LWTKNKSEIK

SEQ ID NO: 9071 - protein, 10 aa, Borrelia burgdorferi B31
WTKNKSEIKA

SEQ ID NO: 9072 - protein, 10 aa, Borrelia burgdorferi B31
TKNKSEIKAE

SEQ ID NO: 9073 - protein, 10 aa, Borrelia burgdorferi B31
KNKSEIKAEE

SEQ ID NO: 9074 - protein, 10 aa, Borrelia burgdorferi B31
NKSEIKAEEY

SEQ ID NO: 9075 - protein, 10 aa, Borrelia burgdorferi B31
KSEIKAEEYN

SEQ ID NO: 9076 - protein, 10 aa, Borrelia burgdorferi B31
SEIKAEEYNE

SEQ ID NO: 9077 - protein, 10 aa, Borrelia burgdorferi B31
EIKAEEYNEF

SEQ ID NO: 9078 - protein, 10 aa, Borrelia burgdorferi B31
IKAEEYNEFY

SEQ ID NO: 9079 - protein, 10 aa, Borrelia burgdorferi B31
KAEEYNEFYK

SEQ ID NO: 9080 - protein, 10 aa, Borrelia burgdorferi B31
AEEYNEFYKN

SEQ ID NO: 9081 - protein, 10 aa, Borrelia burgdorferi B31
EEYNEFYKNT

SEQ ID NO: 9082 - protein, 10 aa, Borrelia burgdorferi B31
EYNEFYKNTT

SEQ ID NO: 9083 - protein, 10 aa, Borrelia burgdorferi B31
YNEFYKNTTF

SEQ ID NO: 9084 - protein, 10 aa, Borrelia burgdorferi B31
NEFYKNTTFD

SEQ ID NO: 9085 - protein, 10 aa, Borrelia burgdorferi B31
EFYKNTTFDY

SEQ ID NO: 9086 - protein, 10 aa, Borrelia burgdorferi B31
FYKNTTFDYE

SEQ ID NO: 9087 - protein, 10 aa, Borrelia burgdorferi B31
YKNTTFDYEN

SEQ ID NO: 9088 - protein, 10 aa, Borrelia burgdorferi B31
KNTTFDYENP

SEQ ID NO: 9089 - protein, 10 aa, Borrelia burgdorferi B31
NTTFDYENPL

SEQ ID NO: 9090 - protein, 10 aa, Borrelia burgdorferi B31
TTFDYENPLM

SEQ ID NO: 9091 - protein, 10 aa, Borrelia burgdorferi B31
TFDYENPLMH

SEQ ID NO: 9092 - protein, 10 aa, Borrelia burgdorferi B31
FDYENPLMHI

SEQ ID NO: 9093 - protein, 10 aa, Borrelia burgdorferi B31
DYENPLMHIH

SEQ ID NO: 9094 - protein, 10 aa, Borrelia burgdorferi B31
YENPLMHIHT

SEQ ID NO: 9095 - protein, 10 aa, Borrelia burgdorferi B31
ENPLMHIHTK

SEQ ID NO: 9096 - protein, 10 aa, Borrelia burgdorferi B31
NPLMHIHTKA

SEQ ID NO: 9097 - protein, 10 aa, Borrelia burgdorferi B31
PLMHIHTKAE

SEQ ID NO: 9098 - protein, 10 aa, Borrelia burgdorferi B31
LMHIHTKAEG

SEQ ID NO: 9099 - protein, 10 aa, Borrelia burgdorferi B31
MHIHTKAEGN

SEQ ID NO: 9100 - protein, 10 aa, Borrelia burgdorferi B31
HIHTKAEGNL

SEQ ID NO: 9101 - protein, 10 aa, Borrelia burgdorferi B31
IHTKAEGNLE

SEQ ID NO: 9102 - protein, 10 aa, Borrelia burgdorferi B31
HTKAEGNLEY

SEQ ID NO: 9103 - protein, 10 aa, Borrelia burgdorferi B31
TKAEGNLEYT

SEQ ID NO: 9104 - protein, 10 aa, Borrelia burgdorferi B31
KAEGNLEYTN

SEQ ID NO: 9105 - protein, 10 aa, Borrelia burgdorferi B31
AEGNLEYTNL

SEQ ID NO: 9106 - protein, 10 aa, Borrelia burgdorferi B31
EGNLEYTNLF

SEQ ID NO: 9107 - protein, 10 aa, Borrelia burgdorferi B31
GNLEYTNLFY

SEQ ID NO: 9108 - protein, 10 aa, Borrelia burgdorferi B31
NLEYTNLFYV

SEQ ID NO: 9109 - protein, 10 aa, Borrelia burgdorferi B31
LEYTNLFYVP

SEQ ID NO: 9110 - protein, 10 aa, Borrelia burgdorferi B31
EYTNLFYVPS

SEQ ID NO: 9111 - protein, 10 aa, Borrelia burgdorferi B31
YTNLFYVPSK

SEQ ID NO: 9112 - protein, 10 aa, Borrelia burgdorferi B31
TNLFYVPSKA

SEQ ID NO: 9113 - protein, 10 aa, Borrelia burgdorferi B31
NLFYVPSKAP

SEQ ID NO: 9114 - protein, 10 aa, Borrelia burgdorferi B31
LFYVPSKAPY

SEQ ID NO: 9115 - protein, 10 aa, Borrelia burgdorferi B31
FYVPSKAPYD

SEQ ID NO: 9116 - protein, 10 aa, Borrelia burgdorferi B31
YVPSKAPYDL

SEQ ID NO: 9117 - protein, 10 aa, Borrelia burgdorferi B31
VPSKAPYDLY

SEQ ID NO: 9118 - protein, 10 aa, Borrelia burgdorferi B31
PSKAPYDLYY

SEQ ID NO: 9119 - protein, 10 aa, Borrelia burgdorferi B31
SKAPYDLYYP

SEQ ID NO: 9120 - protein, 10 aa, Borrelia burgdorferi B31
KAPYDLYYPN

SEQ ID NO: 9121 - protein, 10 aa, Borrelia burgdorferi B31
APYDLYYPNT

SEQ ID NO: 9122 - protein, 10 aa, Borrelia burgdorferi B31
PYDLYYPNTK

SEQ ID NO: 9123 - protein, 10 aa, Borrelia burgdorferi B31
YDLYYPNTKP

SEQ ID NO: 9124 - protein, 10 aa, Borrelia burgdorferi B31
DLYYPNTKPG

SEQ ID NO: 9125 - protein, 10 aa, Borrelia burgdorferi B31
LYYPNTKPGV

SEQ ID NO: 9126 - protein, 10 aa, Borrelia burgdorferi B31
YYPNTKPGVK

SEQ ID NO: 9127 - protein, 10 aa, Borrelia burgdorferi B31
YPNTKPGVKL

SEQ ID NO: 9128 - protein, 10 aa, Borrelia burgdorferi B31
PNTKPGVKLF

SEQ ID NO: 9129 - protein, 10 aa, Borrelia burgdorferi B31
NTKPGVKLFI

SEQ ID NO: 9130 - protein, 10 aa, Borrelia burgdorferi B31
TKPGVKLFIN

SEQ ID NO: 9131 - protein, 10 aa, Borrelia burgdorferi B31
KPGVKLFINR

SEQ ID NO: 9132 - protein, 10 aa, Borrelia burgdorferi B31
PGVKLFINRI

SEQ ID NO: 9133 - protein, 10 aa, Borrelia burgdorferi B31
GVKLFINRIF

SEQ ID NO: 9134 - protein, 10 aa, Borrelia burgdorferi B31
VKLFINRIFI

SEQ ID NO: 9135 - protein, 10 aa, Borrelia burgdorferi B31
KLFINRIFIT

SEQ ID NO: 9136 - protein, 10 aa, Borrelia burgdorferi B31
LFINRIFITD

SEQ ID NO: 9137 - protein, 10 aa, Borrelia burgdorferi B31
FINRIFITDS

SEQ ID NO: 9138 - protein, 10 aa, Borrelia burgdorferi B31
INRIFITDSE

SEQ ID NO: 9139 - protein, 10 aa, Borrelia burgdorferi B31
NRIFITDSEG

SEQ ID NO: 9140 - protein, 10 aa, Borrelia burgdorferi B31
RIFITDSEGS

SEQ ID NO: 9141 - protein, 10 aa, Borrelia burgdorferi B31
IFITDSEGSL

SEQ ID NO: 9142 - protein, 10 aa, Borrelia burgdorferi B31
FITDSEGSLL

SEQ ID NO: 9143 - protein, 10 aa, Borrelia burgdorferi B31
ITDSEGSLLP

SEQ ID NO: 9144 - protein, 10 aa, Borrelia burgdorferi B31
TDSEGSLLPN

SEQ ID NO: 9145 - protein, 10 aa, Borrelia burgdorferi B31
DSEGSLLPNY

SEQ ID NO: 9146 - protein, 10 aa, Borrelia burgdorferi B31
SEGSLLPNYL

SEQ ID NO: 9147 - protein, 10 aa, Borrelia burgdorferi B31
EGSLLPNYLR

SEQ ID NO: 9148 - protein, 10 aa, Borrelia burgdorferi B31
GSLLPNYLRF

SEQ ID NO: 9149 - protein, 10 aa, Borrelia burgdorferi B31
SLLPNYLRFI

SEQ ID NO: 9150 - protein, 10 aa, Borrelia burgdorferi B31
LLPNYLRFIK

SEQ ID NO: 9151 - protein, 10 aa, Borrelia burgdorferi B31
LPNYLRFIKG

SEQ ID NO: 9152 - protein, 10 aa, Borrelia burgdorferi B31
PNYLRFIKGI

SEQ ID NO: 9153 - protein, 10 aa, Borrelia burgdorferi B31
NYLRFIKGII

SEQ ID NO: 9154 - protein, 10 aa, Borrelia burgdorferi B31
YLRFIKGIID

SEQ ID NO: 9155 - protein, 10 aa, Borrelia burgdorferi B31
LRFIKGIIDC

SEQ ID NO: 9156 - protein, 10 aa, Borrelia burgdorferi B31
RFIKGIIDCQ

SEQ ID NO: 9157 - protein, 10 aa, Borrelia burgdorferi B31
FIKGIIDCQD

SEQ ID NO: 9158 - protein, 10 aa, Borrelia burgdorferi B31
IKGIIDCQDL

SEQ ID NO: 9159 - protein, 10 aa, Borrelia burgdorferi B31
KGIIDCQDLP

SEQ ID NO: 9160 - protein, 10 aa, Borrelia burgdorferi B31
GIIDCQDLPL

SEQ ID NO: 9161 - protein, 10 aa, Borrelia burgdorferi B31
IIDCQDLPLN

SEQ ID NO: 9162 - protein, 10 aa, Borrelia burgdorferi B31
IDCQDLPLNV

SEQ ID NO: 9163 - protein, 10 aa, Borrelia burgdorferi B31
DCQDLPLNVS

SEQ ID NO: 9164 - protein, 10 aa, Borrelia burgdorferi B31
CQDLPLNVSR

SEQ ID NO: 9165 - protein, 10 aa, Borrelia burgdorferi B31
QDLPLNVSRE

SEQ ID NO: 9166 - protein, 10 aa, Borrelia burgdorferi B31
DLPLNVSREI

SEQ ID NO: 9167 - protein, 10 aa, Borrelia burgdorferi B31
LPLNVSREIL

SEQ ID NO: 9168 - protein, 10 aa, Borrelia burgdorferi B31
PLNVSREILQ

SEQ ID NO: 9169 - protein, 10 aa, Borrelia burgdorferi B31
LNVSREILQQ

SEQ ID NO: 9170 - protein, 10 aa, Borrelia burgdorferi B31
NVSREILQQN

SEQ ID NO: 9171 - protein, 10 aa, Borrelia burgdorferi B31
VSREILQQNK

SEQ ID NO: 9172 - protein, 10 aa, Borrelia burgdorferi B31
SREILQQNKI

SEQ ID NO: 9173 - protein, 10 aa, Borrelia burgdorferi B31
REILQQNKIL

SEQ ID NO: 9174 - protein, 10 aa, Borrelia burgdorferi B31
EILQQNKILS

SEQ ID NO: 9175 - protein, 10 aa, Borrelia burgdorferi B31
ILQQNKILSK

SEQ ID NO: 9176 - protein, 10 aa, Borrelia burgdorferi B31
LQQNKILSKI

SEQ ID NO: 9177 - protein, 10 aa, Borrelia burgdorferi B31
QQNKILSKIK

SEQ ID NO: 9178 - protein, 10 aa, Borrelia burgdorferi B31
QNKILSKIKS

SEQ ID NO: 9179 - protein, 10 aa, Borrelia burgdorferi B31
NKILSKIKSS

SEQ ID NO: 9180 - protein, 10 aa, Borrelia burgdorferi B31
KILSKIKSSS

SEQ ID NO: 9181 - protein, 10 aa, Borrelia burgdorferi B31
ILSKIKSSSV

SEQ ID NO: 9182 - protein, 10 aa, Borrelia burgdorferi B31
LSKIKSSSVK

SEQ ID NO: 9183 - protein, 10 aa, Borrelia burgdorferi B31
SKIKSSSVKK

SEQ ID NO: 9184 - protein, 10 aa, Borrelia burgdorferi B31
KIKSSSVKKI

SEQ ID NO: 9185 - protein, 10 aa, Borrelia burgdorferi B31
IKSSSVKKIL

SEQ ID NO: 9186 - protein, 10 aa, Borrelia burgdorferi B31
KSSSVKKILS

SEQ ID NO: 9187 - protein, 10 aa, Borrelia burgdorferi B31
SSSVKKILSE

SEQ ID NO: 9188 - protein, 10 aa, Borrelia burgdorferi B31
SSVKKILSEL

SEQ ID NO: 9189 - protein, 10 aa, Borrelia burgdorferi B31
SVKKILSELE

SEQ ID NO: 9190 - protein, 10 aa, Borrelia burgdorferi B31
VKKILSELEK

SEQ ID NO: 9191 - protein, 10 aa, Borrelia burgdorferi B31
KKILSELEKL

SEQ ID NO: 9192 - protein, 10 aa, Borrelia burgdorferi B31
KILSELEKLS

SEQ ID NO: 9193 - protein, 10 aa, Borrelia burgdorferi B31
ILSELEKLSK

SEQ ID NO: 9194 - protein, 10 aa, Borrelia burgdorferi B31
LSELEKLSKK

SEQ ID NO: 9195 - protein, 10 aa, Borrelia burgdorferi B31
SELEKLSKKN

SEQ ID NO: 9196 - protein, 10 aa, Borrelia burgdorferi B31
ELEKLSKKNP

SEQ ID NO: 9197 - protein, 10 aa, Borrelia burgdorferi B31
LEKLSKKNPE

SEQ ID NO: 9198 - protein, 10 aa, Borrelia burgdorferi B31
EKLSKKNPEK

SEQ ID NO: 9199 - protein, 10 aa, Borrelia burgdorferi B31
KLSKKNPEKF

SEQ ID NO: 9200 - protein, 10 aa, Borrelia burgdorferi B31
LSKKNPEKFS

SEQ ID NO: 9201 - protein, 10 aa, Borrelia burgdorferi B31
SKKNPEKFSE

SEQ ID NO: 9202 - protein, 10 aa, Borrelia burgdorferi B31
KKNPEKFSEF

SEQ ID NO: 9203 - protein, 10 aa, Borrelia burgdorferi B31
KNPEKFSEFS

SEQ ID NO: 9204 - protein, 10 aa, Borrelia burgdorferi B31
NPEKFSEFSK

SEQ ID NO: 9205 - protein, 10 aa, Borrelia burgdorferi B31
PEKFSEFSKE

SEQ ID NO: 9206 - protein, 10 aa, Borrelia burgdorferi B31
EKFSEFSKEF

SEQ ID NO: 9207 - protein, 10 aa, Borrelia burgdorferi B31
KFSEFSKEFG

SEQ ID NO: 9208 - protein, 10 aa, Borrelia burgdorferi B31
FSEFSKEFGR

SEQ ID NO: 9209 - protein, 10 aa, Borrelia burgdorferi B31
SEFSKEFGRC

SEQ ID NO: 9210 - protein, 10 aa, Borrelia burgdorferi B31
EFSKEFGRCI

SEQ ID NO: 9211 - protein, 10 aa, Borrelia burgdorferi B31
FSKEFGRCIK

SEQ ID NO: 9212 - protein, 10 aa, Borrelia burgdorferi B31
SKEFGRCIKE

SEQ ID NO: 9213 - protein, 10 aa, Borrelia burgdorferi B31
KEFGRCIKEG

SEQ ID NO: 9214 - protein, 10 aa, Borrelia burgdorferi B31
EFGRCIKEGV

SEQ ID NO: 9215 - protein, 10 aa, Borrelia burgdorferi B31
FGRCIKEGVY

SEQ ID NO: 9216 - protein, 10 aa, Borrelia burgdorferi B31
GRCIKEGVYS

SEQ ID NO: 9217 - protein, 10 aa, Borrelia burgdorferi B31
RCIKEGVYSD

SEQ ID NO: 9218 - protein, 10 aa, Borrelia burgdorferi B31
CIKEGVYSDF

SEQ ID NO: 9219 - protein, 10 aa, Borrelia burgdorferi B31
IKEGVYSDFE

SEQ ID NO: 9220 - protein, 10 aa, Borrelia burgdorferi B31
KEGVYSDFEN

SEQ ID NO: 9221 - protein, 10 aa, Borrelia burgdorferi B31
EGVYSDFENR

SEQ ID NO: 9222 - protein, 10 aa, Borrelia burgdorferi B31
GVYSDFENRE

SEQ ID NO: 9223 - protein, 10 aa, Borrelia burgdorferi B31
VYSDFENREK

SEQ ID NO: 9224 - protein, 10 aa, Borrelia burgdorferi B31
YSDFENREKL

SEQ ID NO: 9225 - protein, 10 aa, Borrelia burgdorferi B31
SDFENREKLI

SEQ ID NO: 9226 - protein, 10 aa, Borrelia burgdorferi B31
DFENREKLIS

SEQ ID NO: 9227 - protein, 10 aa, Borrelia burgdorferi B31
FENREKLISL

SEQ ID NO: 9228 - protein, 10 aa, Borrelia burgdorferi B31
ENREKLISLI

SEQ ID NO: 9229 - protein, 10 aa, Borrelia burgdorferi B31
NREKLISLIR

SEQ ID NO: 9230 - protein, 10 aa, Borrelia burgdorferi B31
REKLISLIRF

SEQ ID NO: 9231 - protein, 10 aa, Borrelia burgdorferi B31
EKLISLIRFK

SEQ ID NO: 9232 - protein, 10 aa, Borrelia burgdorferi B31
KLISLIRFKS

SEQ ID NO: 9233 - protein, 10 aa, Borrelia burgdorferi B31
LISLIRFKSS

SEQ ID NO: 9234 - protein, 10 aa, Borrelia burgdorferi B31
ISLIRFKSSS

SEQ ID NO: 9235 - protein, 10 aa, Borrelia burgdorferi B31
SLIRFKSSSV

SEQ ID NO: 9236 - protein, 10 aa, Borrelia burgdorferi B31
LIRFKSSSVD

SEQ ID NO: 9237 - protein, 10 aa, Borrelia burgdorferi B31
IRFKSSSVDG

SEQ ID NO: 9238 - protein, 10 aa, Borrelia burgdorferi B31
RFKSSSVDGF

SEQ ID NO: 9239 - protein, 10 aa, Borrelia burgdorferi B31
FKSSSVDGFV

SEQ ID NO: 9240 - protein, 10 aa, Borrelia burgdorferi B31
KSSSVDGFVS

SEQ ID NO: 9241 - protein, 10 aa, Borrelia burgdorferi B31
SSSVDGFVSF

SEQ ID NO: 9242 - protein, 10 aa, Borrelia burgdorferi B31
SSVDGFVSFK

SEQ ID NO: 9243 - protein, 10 aa, Borrelia burgdorferi B31
SVDGFVSFKE

SEQ ID NO: 9244 - protein, 10 aa, Borrelia burgdorferi B31
VDGFVSFKEY

SEQ ID NO: 9245 - protein, 10 aa, Borrelia burgdorferi B31
DGFVSFKEYK

SEQ ID NO: 9246 - protein, 10 aa, Borrelia burgdorferi B31
GFVSFKEYKE

SEQ ID NO: 9247 - protein, 10 aa, Borrelia burgdorferi B31
FVSFKEYKER

SEQ ID NO: 9248 - protein, 10 aa, Borrelia burgdorferi B31
VSFKEYKERM

SEQ ID NO: 9249 - protein, 10 aa, Borrelia burgdorferi B31
SFKEYKERMN

SEQ ID NO: 9250 - protein, 10 aa, Borrelia burgdorferi B31
FKEYKERMNE

SEQ ID NO: 9251 - protein, 10 aa, Borrelia burgdorferi B31
KEYKERMNES

SEQ ID NO: 9252 - protein, 10 aa, Borrelia burgdorferi B31
EYKERMNESQ

SEQ ID NO: 9253 - protein, 10 aa, Borrelia burgdorferi B31
YKERMNESQK

SEQ ID NO: 9254 - protein, 10 aa, Borrelia burgdorferi B31
KERMNESQKS

SEQ ID NO: 9255 - protein, 10 aa, Borrelia burgdorferi B31
ERMNESQKSI

SEQ ID NO: 9256 - protein, 10 aa, Borrelia burgdorferi B31
RMNESQKSIY

SEQ ID NO: 9257 - protein, 10 aa, Borrelia burgdorferi B31
MNESQKSIYY

SEQ ID NO: 9258 - protein, 10 aa, Borrelia burgdorferi B31
NESQKSIYYI

SEQ ID NO: 9259 - protein, 10 aa, Borrelia burgdorferi B31
ESQKSIYYIT

SEQ ID NO: 9260 - protein, 10 aa, Borrelia burgdorferi B31
SQKSIYYITG

SEQ ID NO: 9261 - protein, 10 aa, Borrelia burgdorferi B31
QKSIYYITGG

SEQ ID NO: 9262 - protein, 10 aa, Borrelia burgdorferi B31
KSIYYITGGK

SEQ ID NO: 9263 - protein, 10 aa, Borrelia burgdorferi B31
SIYYITGGKE

SEQ ID NO: 9264 - protein, 10 aa, Borrelia burgdorferi B31
IYYITGGKEN

SEQ ID NO: 9265 - protein, 10 aa, Borrelia burgdorferi B31
YYITGGKENI

SEQ ID NO: 9266 - protein, 10 aa, Borrelia burgdorferi B31
YITGGKENIL

SEQ ID NO: 9267 - protein, 10 aa, Borrelia burgdorferi B31
ITGGKENILK

SEQ ID NO: 9268 - protein, 10 aa, Borrelia burgdorferi B31
TGGKENILKE

SEQ ID NO: 9269 - protein, 10 aa, Borrelia burgdorferi B31
GGKENILKEN

SEQ ID NO: 9270 - protein, 10 aa, Borrelia burgdorferi B31
GKENILKENP

SEQ ID NO: 9271 - protein, 10 aa, Borrelia burgdorferi B31
KENILKENPI

SEQ ID NO: 9272 - protein, 10 aa, Borrelia burgdorferi B31
ENILKENPIV

SEQ ID NO: 9273 - protein, 10 aa, Borrelia burgdorferi B31
NILKENPIVA

SEQ ID NO: 9274 - protein, 10 aa, Borrelia burgdorferi B31
ILKENPIVAA

SEQ ID NO: 9275 - protein, 10 aa, Borrelia burgdorferi B31
LKENPIVAAY

SEQ ID NO: 9276 - protein, 10 aa, Borrelia burgdorferi B31
KENPIVAAYK

SEQ ID NO: 9277 - protein, 10 aa, Borrelia burgdorferi B31
ENPIVAAYKE

SEQ ID NO: 9278 - protein, 10 aa, Borrelia burgdorferi B31
NPIVAAYKEK

SEQ ID NO: 9279 - protein, 10 aa, Borrelia burgdorferi B31
PIVAAYKEKG

SEQ ID NO: 9280 - protein, 10 aa, Borrelia burgdorferi B31
IVAAYKEKGF

SEQ ID NO: 9281 - protein, 10 aa, Borrelia burgdorferi B31
VAAYKEKGFE

SEQ ID NO: 9282 - protein, 10 aa, Borrelia burgdorferi B31
AAYKEKGFEI

SEQ ID NO: 9283 - protein, 10 aa, Borrelia burgdorferi B31
AYKEKGFEIL

SEQ ID NO: 9284 - protein, 10 aa, Borrelia burgdorferi B31
YKEKGFEILI

SEQ ID NO: 9285 - protein, 10 aa, Borrelia burgdorferi B31
KEKGFEILIM

SEQ ID NO: 9286 - protein, 10 aa, Borrelia burgdorferi B31
EKGFEILIMD

SEQ ID NO: 9287 - protein, 10 aa, Borrelia burgdorferi B31
KGFEILIMDD

SEQ ID NO: 9288 - protein, 10 aa, Borrelia burgdorferi B31
GFEILIMDDE

SEQ ID NO: 9289 - protein, 10 aa, Borrelia burgdorferi B31
FEILIMDDEL

SEQ ID NO: 9290 - protein, 10 aa, Borrelia burgdorferi B31
EILIMDDELD

SEQ ID NO: 9291 - protein, 10 aa, Borrelia burgdorferi B31
ILIMDDELDE

SEQ ID NO: 9292 - protein, 10 aa, Borrelia burgdorferi B31
LIMDDELDEA

SEQ ID NO: 9293 - protein, 10 aa, Borrelia burgdorferi B31
IMDDELDEAI

SEQ ID NO: 9294 - protein, 10 aa, Borrelia burgdorferi B31
MDDELDEAIL

SEQ ID NO: 9295 - protein, 10 aa, Borrelia burgdorferi B31
DDELDEAILN

SEQ ID NO: 9296 - protein, 10 aa, Borrelia burgdorferi B31
DELDEAILNL

SEQ ID NO: 9297 - protein, 10 aa, Borrelia burgdorferi B31
ELDEAILNLI

SEQ ID NO: 9298 - protein, 10 aa, Borrelia burgdorferi B31
LDEAILNLIP

SEQ ID NO: 9299 - protein, 10 aa, Borrelia burgdorferi B31
DEAILNLIPE

SEQ ID NO: 9300 - protein, 10 aa, Borrelia burgdorferi B31
EAILNLIPEY

SEQ ID NO: 9301 - protein, 10 aa, Borrelia burgdorferi B31
AILNLIPEYE

SEQ ID NO: 9302 - protein, 10 aa, Borrelia burgdorferi B31
ILNLIPEYEG

SEQ ID NO: 9303 - protein, 10 aa, Borrelia burgdorferi B31
LNLIPEYEGL

SEQ ID NO: 9304 - protein, 10 aa, Borrelia burgdorferi B31
NLIPEYEGLK

SEQ ID NO: 9305 - protein, 10 aa, Borrelia burgdorferi B31
LIPEYEGLKL

SEQ ID NO: 9306 - protein, 10 aa, Borrelia burgdorferi B31
IPEYEGLKLK

SEQ ID NO: 9307 - protein, 10 aa, Borrelia burgdorferi B31
PEYEGLKLKA

SEQ ID NO: 9308 - protein, 10 aa, Borrelia burgdorferi B31
EYEGLKLKAI

SEQ ID NO: 9309 - protein, 10 aa, Borrelia burgdorferi B31
YEGLKLKAIN

SEQ ID NO: 9310 - protein, 10 aa, Borrelia burgdorferi B31
EGLKLKAINK

SEQ ID NO: 9311 - protein, 10 aa, Borrelia burgdorferi B31
GLKLKAINKN

SEQ ID NO: 9312 - protein, 10 aa, Borrelia burgdorferi B31
LKLKAINKNE

SEQ ID NO: 9313 - protein, 10 aa, Borrelia burgdorferi B31
KLKAINKNET

SEQ ID NO: 9314 - protein, 10 aa, Borrelia burgdorferi B31
LKAINKNETS

SEQ ID NO: 9315 - protein, 10 aa, Borrelia burgdorferi B31
KAINKNETSN

SEQ ID NO: 9316 - protein, 10 aa, Borrelia burgdorferi B31
AINKNETSNE

SEQ ID NO: 9317 - protein, 10 aa, Borrelia burgdorferi B31
INKNETSNEL

SEQ ID NO: 9318 - protein, 10 aa, Borrelia burgdorferi B31
NKNETSNELK

SEQ ID NO: 9319 - protein, 10 aa, Borrelia burgdorferi B31
KNETSNELKD

SEQ ID NO: 9320 - protein, 10 aa, Borrelia burgdorferi B31
NETSNELKDE

SEQ ID NO: 9321 - protein, 10 aa, Borrelia burgdorferi B31
ETSNELKDEN

SEQ ID NO: 9322 - protein, 10 aa, Borrelia burgdorferi B31
TSNELKDENF

SEQ ID NO: 9323 - protein, 10 aa, Borrelia burgdorferi B31
SNELKDENFK

SEQ ID NO: 9324 - protein, 10 aa, Borrelia burgdorferi B31
NELKDENFKK

SEQ ID NO: 9325 - protein, 10 aa, Borrelia burgdorferi B31
ELKDENFKKI

SEQ ID NO: 9326 - protein, 10 aa, Borrelia burgdorferi B31
LKDENFKKIE

SEQ ID NO: 9327 - protein, 10 aa, Borrelia burgdorferi B31
KDENFKKIEE

SEQ ID NO: 9328 - protein, 10 aa, Borrelia burgdorferi B31
DENFKKIEEE

SEQ ID NO: 9329 - protein, 10 aa, Borrelia burgdorferi B31
ENFKKIEEEF

SEQ ID NO: 9330 - protein, 10 aa, Borrelia burgdorferi B31
NFKKIEEEFK

SEQ ID NO: 9331 - protein, 10 aa, Borrelia burgdorferi B31
FKKIEEEFKD

SEQ ID NO: 9332 - protein, 10 aa, Borrelia burgdorferi B31
KKIEEEFKDT

SEQ ID NO: 9333 - protein, 10 aa, Borrelia burgdorferi B31
KIEEEFKDTL

SEQ ID NO: 9334 - protein, 10 aa, Borrelia burgdorferi B31
IEEEFKDTLT

SEQ ID NO: 9335 - protein, 10 aa, Borrelia burgdorferi B31
EEEFKDTLTK

SEQ ID NO: 9336 - protein, 10 aa, Borrelia burgdorferi B31
EEFKDTLTKV

SEQ ID NO: 9337 - protein, 10 aa, Borrelia burgdorferi B31
EFKDTLTKVK

SEQ ID NO: 9338 - protein, 10 aa, Borrelia burgdorferi B31
FKDTLTKVKE

SEQ ID NO: 9339 - protein, 10 aa, Borrelia burgdorferi B31
KDTLTKVKEI

SEQ ID NO: 9340 - protein, 10 aa, Borrelia burgdorferi B31
DTLTKVKEIL

SEQ ID NO: 9341 - protein, 10 aa, Borrelia burgdorferi B31
TLTKVKEILK

SEQ ID NO: 9342 - protein, 10 aa, Borrelia burgdorferi B31
LTKVKEILKD

SEQ ID NO: 9343 - protein, 10 aa, Borrelia burgdorferi B31
TKVKEILKDH

SEQ ID NO: 9344 - protein, 10 aa, Borrelia burgdorferi B31
KVKEILKDHI

SEQ ID NO: 9345 - protein, 10 aa, Borrelia burgdorferi B31
VKEILKDHIK

SEQ ID NO: 9346 - protein, 10 aa, Borrelia burgdorferi B31
KEILKDHIKE

SEQ ID NO: 9347 - protein, 10 aa, Borrelia burgdorferi B31
EILKDHIKEV

SEQ ID NO: 9348 - protein, 10 aa, Borrelia burgdorferi B31
ILKDHIKEVN

SEQ ID NO: 9349 - protein, 10 aa, Borrelia burgdorferi B31
LKDHIKEVNL

SEQ ID NO: 9350 - protein, 10 aa, Borrelia burgdorferi B31
KDHIKEVNLS

SEQ ID NO: 9351 - protein, 10 aa, Borrelia burgdorferi B31
DHIKEVNLSA

SEQ ID NO: 9352 - protein, 10 aa, Borrelia burgdorferi B31
HIKEVNLSAT

SEQ ID NO: 9353 - protein, 10 aa, Borrelia burgdorferi B31
IKEVNLSATL

SEQ ID NO: 9354 - protein, 10 aa, Borrelia burgdorferi B31
KEVNLSATLI

SEQ ID NO: 9355 - protein, 10 aa, Borrelia burgdorferi B31
EVNLSATLIK

SEQ ID NO: 9356 - protein, 10 aa, Borrelia burgdorferi B31
VNLSATLIKE

SEQ ID NO: 9357 - protein, 10 aa, Borrelia burgdorferi B31
NLSATLIKEP

SEQ ID NO: 9358 - protein, 10 aa, Borrelia burgdorferi B31
LSATLIKEPS

SEQ ID NO: 9359 - protein, 10 aa, Borrelia burgdorferi B31
SATLIKEPSA

SEQ ID NO: 9360 - protein, 10 aa, Borrelia burgdorferi B31
ATLIKEPSAI

SEQ ID NO: 9361 - protein, 10 aa, Borrelia burgdorferi B31
TLIKEPSAII

SEQ ID NO: 9362 - protein, 10 aa, Borrelia burgdorferi B31
LIKEPSAIII

SEQ ID NO: 9363 - protein, 10 aa, Borrelia burgdorferi B31
IKEPSAIIID

SEQ ID NO: 9364 - protein, 10 aa, Borrelia burgdorferi B31
KEPSAIIIDS

SEQ ID NO: 9365 - protein, 10 aa, Borrelia burgdorferi B31
EPSAIIIDSN

SEQ ID NO: 9366 - protein, 10 aa, Borrelia burgdorferi B31
PSAIIIDSND

SEQ ID NO: 9367 - protein, 10 aa, Borrelia burgdorferi B31
SAIIIDSNDP

SEQ ID NO: 9368 - protein, 10 aa, Borrelia burgdorferi B31
AIIIDSNDPT

SEQ ID NO: 9369 - protein, 10 aa, Borrelia burgdorferi B31
IIIDSNDPTY

SEQ ID NO: 9370 - protein, 10 aa, Borrelia burgdorferi B31
IIDSNDPTYQ

SEQ ID NO: 9371 - protein, 10 aa, Borrelia burgdorferi B31
IDSNDPTYQM

SEQ ID NO: 9372 - protein, 10 aa, Borrelia burgdorferi B31
DSNDPTYQMQ

SEQ ID NO: 9373 - protein, 10 aa, Borrelia burgdorferi B31
SNDPTYQMQK

SEQ ID NO: 9374 - protein, 10 aa, Borrelia burgdorferi B31
NDPTYQMQKI

SEQ ID NO: 9375 - protein, 10 aa, Borrelia burgdorferi B31
DPTYQMQKIM

SEQ ID NO: 9376 - protein, 10 aa, Borrelia burgdorferi B31
PTYQMQKIML

SEQ ID NO: 9377 - protein, 10 aa, Borrelia burgdorferi B31
TYQMQKIMLS

SEQ ID NO: 9378 - protein, 10 aa, Borrelia burgdorferi B31
YQMQKIMLSM

SEQ ID NO: 9379 - protein, 10 aa, Borrelia burgdorferi B31
QMQKIMLSMG

SEQ ID NO: 9380 - protein, 10 aa, Borrelia burgdorferi B31
MQKIMLSMGQ

SEQ ID NO: 9381 - protein, 10 aa, Borrelia burgdorferi B31
QKIMLSMGQE

SEQ ID NO: 9382 - protein, 10 aa, Borrelia burgdorferi B31
KIMLSMGQEV

SEQ ID NO: 9383 - protein, 10 aa, Borrelia burgdorferi B31
IMLSMGQEVK

SEQ ID NO: 9384 - protein, 10 aa, Borrelia burgdorferi B31
MLSMGQEVKE

SEQ ID NO: 9385 - protein, 10 aa, Borrelia burgdorferi B31
LSMGQEVKEI

SEQ ID NO: 9386 - protein, 10 aa, Borrelia burgdorferi B31
SMGQEVKEIK

SEQ ID NO: 9387 - protein, 10 aa, Borrelia burgdorferi B31
MGQEVKEIKP

SEQ ID NO: 9388 - protein, 10 aa, Borrelia burgdorferi B31
GQEVKEIKPI

SEQ ID NO: 9389 - protein, 10 aa, Borrelia burgdorferi B31
QEVKEIKPIL

SEQ ID NO: 9390 - protein, 10 aa, Borrelia burgdorferi B31
EVKEIKPILE

SEQ ID NO: 9391 - protein, 10 aa, Borrelia burgdorferi B31
VKEIKPILEL

SEQ ID NO: 9392 - protein, 10 aa, Borrelia burgdorferi B31
KEIKPILELN

SEQ ID NO: 9393 - protein, 10 aa, Borrelia burgdorferi B31
EIKPILELNP

SEQ ID NO: 9394 - protein, 10 aa, Borrelia burgdorferi B31
IKPILELNPN

SEQ ID NO: 9395 - protein, 10 aa, Borrelia burgdorferi B31
KPILELNPNN

SEQ ID NO: 9396 - protein, 10 aa, Borrelia burgdorferi B31
PILELNPNNK

SEQ ID NO: 9397 - protein, 10 aa, Borrelia burgdorferi B31
ILELNPNNKI

SEQ ID NO: 9398 - protein, 10 aa, Borrelia burgdorferi B31
LELNPNNKIV

SEQ ID NO: 9399 - protein, 10 aa, Borrelia burgdorferi B31
ELNPNNKIVQ

SEQ ID NO: 9400 - protein, 10 aa, Borrelia burgdorferi B31
LNPNNKIVQN

SEQ ID NO: 9401 - protein, 10 aa, Borrelia burgdorferi B31
NPNNKIVQNL

SEQ ID NO: 9402 - protein, 10 aa, Borrelia burgdorferi B31
PNNKIVQNLK

SEQ ID NO: 9403 - protein, 10 aa, Borrelia burgdorferi B31
NNKIVQNLKN

SEQ ID NO: 9404 - protein, 10 aa, Borrelia burgdorferi B31
NKIVQNLKNL

SEQ ID NO: 9405 - protein, 10 aa, Borrelia burgdorferi B31
KIVQNLKNLE

SEQ ID NO: 9406 - protein, 10 aa, Borrelia burgdorferi B31
IVQNLKNLEP

SEQ ID NO: 9407 - protein, 10 aa, Borrelia burgdorferi B31
VQNLKNLEPE

SEQ ID NO: 9408 - protein, 10 aa, Borrelia burgdorferi B31
QNLKNLEPEK

SEQ ID NO: 9409 - protein, 10 aa, Borrelia burgdorferi B31
NLKNLEPEKL

SEQ ID NO: 9410 - protein, 10 aa, Borrelia burgdorferi B31
LKNLEPEKLE

SEQ ID NO: 9411 - protein, 10 aa, Borrelia burgdorferi B31
KNLEPEKLEK

SEQ ID NO: 9412 - protein, 10 aa, Borrelia burgdorferi B31
NLEPEKLEKI

SEQ ID NO: 9413 - protein, 10 aa, Borrelia burgdorferi B31
LEPEKLEKIS

SEQ ID NO: 9414 - protein, 10 aa, Borrelia burgdorferi B31
EPEKLEKISI

SEQ ID NO: 9415 - protein, 10 aa, Borrelia burgdorferi B31
PEKLEKISIL

SEQ ID NO: 9416 - protein, 10 aa, Borrelia burgdorferi B31
EKLEKISILL

SEQ ID NO: 9417 - protein, 10 aa, Borrelia burgdorferi B31
KLEKISILLF

SEQ ID NO: 9418 - protein, 10 aa, Borrelia burgdorferi B31
LEKISILLFE

SEQ ID NO: 9419 - protein, 10 aa, Borrelia burgdorferi B31
EKISILLFEE

SEQ ID NO: 9420 - protein, 10 aa, Borrelia burgdorferi B31
KISILLFEEA

SEQ ID NO: 9421 - protein, 10 aa, Borrelia burgdorferi B31
ISILLFEEAM

SEQ ID NO: 9422 - protein, 10 aa, Borrelia burgdorferi B31
SILLFEEAML

SEQ ID NO: 9423 - protein, 10 aa, Borrelia burgdorferi B31
ILLFEEAMLT

SEQ ID NO: 9424 - protein, 10 aa, Borrelia burgdorferi B31
LLFEEAMLTS

SEQ ID NO: 9425 - protein, 10 aa, Borrelia burgdorferi B31
LFEEAMLTSG

SEQ ID NO: 9426 - protein, 10 aa, Borrelia burgdorferi B31
FEEAMLTSGM

SEQ ID NO: 9427 - protein, 10 aa, Borrelia burgdorferi B31
EEAMLTSGMP

SEQ ID NO: 9428 - protein, 10 aa, Borrelia burgdorferi B31
EAMLTSGMPS

SEQ ID NO: 9429 - protein, 10 aa, Borrelia burgdorferi B31
AMLTSGMPSK

SEQ ID NO: 9430 - protein, 10 aa, Borrelia burgdorferi B31
MLTSGMPSKN

SEQ ID NO: 9431 - protein, 10 aa, Borrelia burgdorferi B31
LTSGMPSKNP

SEQ ID NO: 9432 - protein, 10 aa, Borrelia burgdorferi B31
TSGMPSKNPG

SEQ ID NO: 9433 - protein, 10 aa, Borrelia burgdorferi B31
SGMPSKNPGK

SEQ ID NO: 9434 - protein, 10 aa, Borrelia burgdorferi B31
GMPSKNPGKF

SEQ ID NO: 9435 - protein, 10 aa, Borrelia burgdorferi B31
MPSKNPGKFI

SEQ ID NO: 9436 - protein, 10 aa, Borrelia burgdorferi B31
PSKNPGKFIN

SEQ ID NO: 9437 - protein, 10 aa, Borrelia burgdorferi B31
SKNPGKFINI

SEQ ID NO: 9438 - protein, 10 aa, Borrelia burgdorferi B31
KNPGKFINII

SEQ ID NO: 9439 - protein, 10 aa, Borrelia burgdorferi B31
NPGKFINIIN

SEQ ID NO: 9440 - protein, 10 aa, Borrelia burgdorferi B31
PGKFINIINE

SEQ ID NO: 9441 - protein, 10 aa, Borrelia burgdorferi B31
GKFINIINEF

SEQ ID NO: 9442 - protein, 10 aa, Borrelia burgdorferi B31
KFINIINEFI

SEQ ID NO: 9443 - protein, 10 aa, Borrelia burgdorferi B31
FINIINEFIE

SEQ ID NO: 9444 - protein, 10 aa, Borrelia burgdorferi B31
INIINEFIEK

SEQ ID NO: 9445 - protein, 10 aa, Borrelia burgdorferi B31
NIINEFIEKD

SEQ ID NO: 9446 - protein, 10 aa, Borrelia burgdorferi B31
IINEFIEKDF

SEQ ID NO: 9447 - protein, 10 aa, Borrelia burgdorferi B31
INEFIEKDFL

SEQ ID NO: 9448 - protein, 11 aa, Borrelia burgdorferi B31
MILIFYFKQIA

SEQ ID NO: 9449 - protein, 11 aa, Borrelia burgdorferi B31
ILIFYFKQIAL

SEQ ID NO: 9450 - protein, 11 aa, Borrelia burgdorferi B31
LIFYFKQIALF

SEQ ID NO: 9451 - protein, 11 aa, Borrelia burgdorferi B31
IFYFKQIALFI

SEQ ID NO: 9452 - protein, 11 aa, Borrelia burgdorferi B31
FYFKQIALFII

SEQ ID NO: 9453 - protein, 11 aa, Borrelia burgdorferi B31
YFKQIALFIIF

SEQ ID NO: 9454 - protein, 11 aa, Borrelia burgdorferi B31
FKQIALFIIFR

SEQ ID NO: 9455 - protein, 11 aa, Borrelia burgdorferi B31
KQIALFIIFRL

SEQ ID NO: 9456 - protein, 11 aa, Borrelia burgdorferi B31
QIALFIIFRLC

SEQ ID NO: 9457 - protein, 11 aa, Borrelia burgdorferi B31
IALFIIFRLCY

SEQ ID NO: 9458 - protein, 11 aa, Borrelia burgdorferi B31
ALFIIFRLCYI

SEQ ID NO: 9459 - protein, 11 aa, Borrelia burgdorferi B31
LFIIFRLCYII

SEQ ID NO: 9460 - protein, 11 aa, Borrelia burgdorferi B31
FIIFRLCYIIK

SEQ ID NO: 9461 - protein, 11 aa, Borrelia burgdorferi B31
IIFRLCYIIKK

SEQ ID NO: 9462 - protein, 11 aa, Borrelia burgdorferi B31
IFRLCYIIKKV

SEQ ID NO: 9463 - protein, 11 aa, Borrelia burgdorferi B31
FRLCYIIKKVK

SEQ ID NO: 9464 - protein, 11 aa, Borrelia burgdorferi B31
RLCYIIKKVKI

SEQ ID NO: 9465 - protein, 11 aa, Borrelia burgdorferi B31
LCYIIKKVKIK

SEQ ID NO: 9466 - protein, 11 aa, Borrelia burgdorferi B31
CYIIKKVKIKL

SEQ ID NO: 9467 - protein, 11 aa, Borrelia burgdorferi B31
YIIKKVKIKLK

SEQ ID NO: 9468 - protein, 11 aa, Borrelia burgdorferi B31
IIKKVKIKLKR

SEQ ID NO: 9469 - protein, 11 aa, Borrelia burgdorferi B31
IKKVKIKLKRK

SEQ ID NO: 9470 - protein, 11 aa, Borrelia burgdorferi B31
KKVKIKLKRKS

SEQ ID NO: 9471 - protein, 11 aa, Borrelia burgdorferi B31
KVKIKLKRKSC

SEQ ID NO: 9472 - protein, 11 aa, Borrelia burgdorferi B31
VKIKLKRKSCM

SEQ ID NO: 9473 - protein, 11 aa, Borrelia burgdorferi B31
KIKLKRKSCMK

SEQ ID NO: 9474 - protein, 11 aa, Borrelia burgdorferi B31
IKLKRKSCMKK

SEQ ID NO: 9475 - protein, 11 aa, Borrelia burgdorferi B31
KLKRKSCMKKQ

SEQ ID NO: 9476 - protein, 11 aa, Borrelia burgdorferi B31
LKRKSCMKKQF

SEQ ID NO: 9477 - protein, 11 aa, Borrelia burgdorferi B31
KRKSCMKKQFD

SEQ ID NO: 9478 - protein, 11 aa, Borrelia burgdorferi B31
RKSCMKKQFDT

SEQ ID NO: 9479 - protein, 11 aa, Borrelia burgdorferi B31
KSCMKKQFDTE

SEQ ID NO: 9480 - protein, 11 aa, Borrelia burgdorferi B31
SCMKKQFDTEV

SEQ ID NO: 9481 - protein, 11 aa, Borrelia burgdorferi B31
CMKKQFDTEVN

SEQ ID NO: 9482 - protein, 11 aa, Borrelia burgdorferi B31
MKKQFDTEVND

SEQ ID NO: 9483 - protein, 11 aa, Borrelia burgdorferi B31
KKQFDTEVNDL

SEQ ID NO: 9484 - protein, 11 aa, Borrelia burgdorferi B31
KQFDTEVNDLL

SEQ ID NO: 9485 - protein, 11 aa, Borrelia burgdorferi B31
QFDTEVNDLLY

SEQ ID NO: 9486 - protein, 11 aa, Borrelia burgdorferi B31
FDTEVNDLLYL

SEQ ID NO: 9487 - protein, 11 aa, Borrelia burgdorferi B31
DTEVNDLLYLI

SEQ ID NO: 9488 - protein, 11 aa, Borrelia burgdorferi B31
TEVNDLLYLII

SEQ ID NO: 9489 - protein, 11 aa, Borrelia burgdorferi B31
EVNDLLYLIIH

SEQ ID NO: 9490 - protein, 11 aa, Borrelia burgdorferi B31
VNDLLYLIIHS

SEQ ID NO: 9491 - protein, 11 aa, Borrelia burgdorferi B31
NDLLYLIIHSL

SEQ ID NO: 9492 - protein, 11 aa, Borrelia burgdorferi B31
DLLYLIIHSLY

SEQ ID NO: 9493 - protein, 11 aa, Borrelia burgdorferi B31
LLYLIIHSLYS

SEQ ID NO: 9494 - protein, 11 aa, Borrelia burgdorferi B31
LYLIIHSLYSH

SEQ ID NO: 9495 - protein, 11 aa, Borrelia burgdorferi B31
YLIIHSLYSHK

SEQ ID NO: 9496 - protein, 11 aa, Borrelia burgdorferi B31
LIIHSLYSHKE

SEQ ID NO: 9497 - protein, 11 aa, Borrelia burgdorferi B31
IIHSLYSHKEI

SEQ ID NO: 9498 - protein, 11 aa, Borrelia burgdorferi B31
IHSLYSHKEIF

SEQ ID NO: 9499 - protein, 11 aa, Borrelia burgdorferi B31
HSLYSHKEIFL

SEQ ID NO: 9500 - protein, 11 aa, Borrelia burgdorferi B31
SLYSHKEIFLR

SEQ ID NO: 9501 - protein, 11 aa, Borrelia burgdorferi B31
LYSHKEIFLRE

SEQ ID NO: 9502 - protein, 11 aa, Borrelia burgdorferi B31
YSHKEIFLREL

SEQ ID NO: 9503 - protein, 11 aa, Borrelia burgdorferi B31
SHKEIFLRELI

SEQ ID NO: 9504 - protein, 11 aa, Borrelia burgdorferi B31
HKEIFLRELIS

SEQ ID NO: 9505 - protein, 11 aa, Borrelia burgdorferi B31
KEIFLRELISN

SEQ ID NO: 9506 - protein, 11 aa, Borrelia burgdorferi B31
EIFLRELISNA

SEQ ID NO: 9507 - protein, 11 aa, Borrelia burgdorferi B31
IFLRELISNAS

SEQ ID NO: 9508 - protein, 11 aa, Borrelia burgdorferi B31
FLRELISNASD

SEQ ID NO: 9509 - protein, 11 aa, Borrelia burgdorferi B31
LRELISNASDA

SEQ ID NO: 9510 - protein, 11 aa, Borrelia burgdorferi B31
RELISNASDAI

SEQ ID NO: 9511 - protein, 11 aa, Borrelia burgdorferi B31
ELISNASDAID

SEQ ID NO: 9512 - protein, 11 aa, Borrelia burgdorferi B31
LISNASDAIDK

SEQ ID NO: 9513 - protein, 11 aa, Borrelia burgdorferi B31
ISNASDAIDKL

SEQ ID NO: 9514 - protein, 11 aa, Borrelia burgdorferi B31
SNASDAIDKLK

SEQ ID NO: 9515 - protein, 11 aa, Borrelia burgdorferi B31
NASDAIDKLKF

SEQ ID NO: 9516 - protein, 11 aa, Borrelia burgdorferi B31
ASDAIDKLKFL

SEQ ID NO: 9517 - protein, 11 aa, Borrelia burgdorferi B31
SDAIDKLKFLS

SEQ ID NO: 9518 - protein, 11 aa, Borrelia burgdorferi B31
DAIDKLKFLSL

SEQ ID NO: 9519 - protein, 11 aa, Borrelia burgdorferi B31
AIDKLKFLSLT

SEQ ID NO: 9520 - protein, 11 aa, Borrelia burgdorferi B31
IDKLKFLSLTN

SEQ ID NO: 9521 - protein, 11 aa, Borrelia burgdorferi B31
DKLKFLSLTNE

SEQ ID NO: 9522 - protein, 11 aa, Borrelia burgdorferi B31
KLKFLSLTNEK

SEQ ID NO: 9523 - protein, 11 aa, Borrelia burgdorferi B31
LKFLSLTNEKF

SEQ ID NO: 9524 - protein, 11 aa, Borrelia burgdorferi B31
KFLSLTNEKFK

SEQ ID NO: 9525 - protein, 11 aa, Borrelia burgdorferi B31
FLSLTNEKFKN

SEQ ID NO: 9526 - protein, 11 aa, Borrelia burgdorferi B31
LSLTNEKFKNI

SEQ ID NO: 9527 - protein, 11 aa, Borrelia burgdorferi B31
SLTNEKFKNIA

SEQ ID NO: 9528 - protein, 11 aa, Borrelia burgdorferi B31
LTNEKFKNIAL

SEQ ID NO: 9529 - protein, 11 aa, Borrelia burgdorferi B31
TNEKFKNIALE

SEQ ID NO: 9530 - protein, 11 aa, Borrelia burgdorferi B31
NEKFKNIALEP

SEQ ID NO: 9531 - protein, 11 aa, Borrelia burgdorferi B31
EKFKNIALEPK

SEQ ID NO: 9532 - protein, 11 aa, Borrelia burgdorferi B31
KFKNIALEPKI

SEQ ID NO: 9533 - protein, 11 aa, Borrelia burgdorferi B31
FKNIALEPKIE

SEQ ID NO: 9534 - protein, 11 aa, Borrelia burgdorferi B31
KNIALEPKIEI

SEQ ID NO: 9535 - protein, 11 aa, Borrelia burgdorferi B31
NIALEPKIEIS

SEQ ID NO: 9536 - protein, 11 aa, Borrelia burgdorferi B31
IALEPKIEISF

SEQ ID NO: 9537 - protein, 11 aa, Borrelia burgdorferi B31
ALEPKIEISFD

SEQ ID NO: 9538 - protein, 11 aa, Borrelia burgdorferi B31
LEPKIEISFDD

SEQ ID NO: 9539 - protein, 11 aa, Borrelia burgdorferi B31
EPKIEISFDDK

SEQ ID NO: 9540 - protein, 11 aa, Borrelia burgdorferi B31
PKIEISFDDKS

SEQ ID NO: 9541 - protein, 11 aa, Borrelia burgdorferi B31
KIEISFDDKSI

SEQ ID NO: 9542 - protein, 11 aa, Borrelia burgdorferi B31
IEISFDDKSIL

SEQ ID NO: 9543 - protein, 11 aa, Borrelia burgdorferi B31
EISFDDKSILI

SEQ ID NO: 9544 - protein, 11 aa, Borrelia burgdorferi B31
ISFDDKSILIK

SEQ ID NO: 9545 - protein, 11 aa, Borrelia burgdorferi B31
SFDDKSILIKD

SEQ ID NO: 9546 - protein, 11 aa, Borrelia burgdorferi B31
FDDKSILIKDN

SEQ ID NO: 9547 - protein, 11 aa, Borrelia burgdorferi B31
DDKSILIKDNG

SEQ ID NO: 9548 - protein, 11 aa, Borrelia burgdorferi B31
DKSILIKDNGI

SEQ ID NO: 9549 - protein, 11 aa, Borrelia burgdorferi B31
KSILIKDNGIG

SEQ ID NO: 9550 - protein, 11 aa, Borrelia burgdorferi B31
SILIKDNGIGM

SEQ ID NO: 9551 - protein, 11 aa, Borrelia burgdorferi B31
ILIKDNGIGMD

SEQ ID NO: 9552 - protein, 11 aa, Borrelia burgdorferi B31
LIKDNGIGMDE

SEQ ID NO: 9553 - protein, 11 aa, Borrelia burgdorferi B31
IKDNGIGMDEQ

SEQ ID NO: 9554 - protein, 11 aa, Borrelia burgdorferi B31
KDNGIGMDEQD

SEQ ID NO: 9555 - protein, 11 aa, Borrelia burgdorferi B31
DNGIGMDEQDL

SEQ ID NO: 9556 - protein, 11 aa, Borrelia burgdorferi B31
NGIGMDEQDLT

SEQ ID NO: 9557 - protein, 11 aa, Borrelia burgdorferi B31
GIGMDEQDLTN

SEQ ID NO: 9558 - protein, 11 aa, Borrelia burgdorferi B31
IGMDEQDLTNH

SEQ ID NO: 9559 - protein, 11 aa, Borrelia burgdorferi B31
GMDEQDLTNHL

SEQ ID NO: 9560 - protein, 11 aa, Borrelia burgdorferi B31
MDEQDLTNHLG

SEQ ID NO: 9561 - protein, 11 aa, Borrelia burgdorferi B31
DEQDLTNHLGV

SEQ ID NO: 9562 - protein, 11 aa, Borrelia burgdorferi B31
EQDLTNHLGVI

SEQ ID NO: 9563 - protein, 11 aa, Borrelia burgdorferi B31
QDLTNHLGVIA

SEQ ID NO: 9564 - protein, 11 aa, Borrelia burgdorferi B31
DLTNHLGVIAK

SEQ ID NO: 9565 - protein, 11 aa, Borrelia burgdorferi B31
LTNHLGVIAKS

SEQ ID NO: 9566 - protein, 11 aa, Borrelia burgdorferi B31
TNHLGVIAKSG

SEQ ID NO: 9567 - protein, 11 aa, Borrelia burgdorferi B31
NHLGVIAKSGT

SEQ ID NO: 9568 - protein, 11 aa, Borrelia burgdorferi B31
HLGVIAKSGTK

SEQ ID NO: 9569 - protein, 11 aa, Borrelia burgdorferi B31
LGVIAKSGTKE

SEQ ID NO: 9570 - protein, 11 aa, Borrelia burgdorferi B31
GVIAKSGTKEF

SEQ ID NO: 9571 - protein, 11 aa, Borrelia burgdorferi B31
VIAKSGTKEFI

SEQ ID NO: 9572 - protein, 11 aa, Borrelia burgdorferi B31
IAKSGTKEFIN

SEQ ID NO: 9573 - protein, 11 aa, Borrelia burgdorferi B31
AKSGTKEFINN

SEQ ID NO: 9574 - protein, 11 aa, Borrelia burgdorferi B31
KSGTKEFINNL

SEQ ID NO: 9575 - protein, 11 aa, Borrelia burgdorferi B31
SGTKEFINNLK

SEQ ID NO: 9576 - protein, 11 aa, Borrelia burgdorferi B31
GTKEFINNLKQ

SEQ ID NO: 9577 - protein, 11 aa, Borrelia burgdorferi B31
TKEFINNLKQD

SEQ ID NO: 9578 - protein, 11 aa, Borrelia burgdorferi B31
KEFINNLKQDE

SEQ ID NO: 9579 - protein, 11 aa, Borrelia burgdorferi B31
EFINNLKQDEK

SEQ ID NO: 9580 - protein, 11 aa, Borrelia burgdorferi B31
FINNLKQDEKK

SEQ ID NO: 9581 - protein, 11 aa, Borrelia burgdorferi B31
INNLKQDEKKS

SEQ ID NO: 9582 - protein, 11 aa, Borrelia burgdorferi B31
NNLKQDEKKSA

SEQ ID NO: 9583 - protein, 11 aa, Borrelia burgdorferi B31
NLKQDEKKSAS

SEQ ID NO: 9584 - protein, 11 aa, Borrelia burgdorferi B31
LKQDEKKSASL

SEQ ID NO: 9585 - protein, 11 aa, Borrelia burgdorferi B31
KQDEKKSASLI

SEQ ID NO: 9586 - protein, 11 aa, Borrelia burgdorferi B31
QDEKKSASLIG

SEQ ID NO: 9587 - protein, 11 aa, Borrelia burgdorferi B31
DEKKSASLIGQ

SEQ ID NO: 9588 - protein, 11 aa, Borrelia burgdorferi B31
EKKSASLIGQF

SEQ ID NO: 9589 - protein, 11 aa, Borrelia burgdorferi B31
KKSASLIGQFG

SEQ ID NO: 9590 - protein, 11 aa, Borrelia burgdorferi B31
KSASLIGQFGV

SEQ ID NO: 9591 - protein, 11 aa, Borrelia burgdorferi B31
SASLIGQFGVG

SEQ ID NO: 9592 - protein, 11 aa, Borrelia burgdorferi B31
ASLIGQFGVGF

SEQ ID NO: 9593 - protein, 11 aa, Borrelia burgdorferi B31
SLIGQFGVGFY

SEQ ID NO: 9594 - protein, 11 aa, Borrelia burgdorferi B31
LIGQFGVGFYS

SEQ ID NO: 9595 - protein, 11 aa, Borrelia burgdorferi B31
IGQFGVGFYSA

SEQ ID NO: 9596 - protein, 11 aa, Borrelia burgdorferi B31
GQFGVGFYSAF

SEQ ID NO: 9597 - protein, 11 aa, Borrelia burgdorferi B31
QFGVGFYSAFI

SEQ ID NO: 9598 - protein, 11 aa, Borrelia burgdorferi B31
FGVGFYSAFIV

SEQ ID NO: 9599 - protein, 11 aa, Borrelia burgdorferi B31
GVGFYSAFIVS

SEQ ID NO: 9600 - protein, 11 aa, Borrelia burgdorferi B31
VGFYSAFIVSE

SEQ ID NO: 9601 - protein, 11 aa, Borrelia burgdorferi B31
GFYSAFIVSEK

SEQ ID NO: 9602 - protein, 11 aa, Borrelia burgdorferi B31
FYSAFIVSEKV

SEQ ID NO: 9603 - protein, 11 aa, Borrelia burgdorferi B31
YSAFIVSEKVE

SEQ ID NO: 9604 - protein, 11 aa, Borrelia burgdorferi B31
SAFIVSEKVEV

SEQ ID NO: 9605 - protein, 11 aa, Borrelia burgdorferi B31
AFIVSEKVEVT

SEQ ID NO: 9606 - protein, 11 aa, Borrelia burgdorferi B31
FIVSEKVEVTS

SEQ ID NO: 9607 - protein, 11 aa, Borrelia burgdorferi B31
IVSEKVEVTSK

SEQ ID NO: 9608 - protein, 11 aa, Borrelia burgdorferi B31
VSEKVEVTSKK

SEQ ID NO: 9609 - protein, 11 aa, Borrelia burgdorferi B31
SEKVEVTSKKA

SEQ ID NO: 9610 - protein, 11 aa, Borrelia burgdorferi B31
EKVEVTSKKAL

SEQ ID NO: 9611 - protein, 11 aa, Borrelia burgdorferi B31
KVEVTSKKALE

SEQ ID NO: 9612 - protein, 11 aa, Borrelia burgdorferi B31
VEVTSKKALES

SEQ ID NO: 9613 - protein, 11 aa, Borrelia burgdorferi B31
EVTSKKALESD

SEQ ID NO: 9614 - protein, 11 aa, Borrelia burgdorferi B31
VTSKKALESDA

SEQ ID NO: 9615 - protein, 11 aa, Borrelia burgdorferi B31
TSKKALESDAY

SEQ ID NO: 9616 - protein, 11 aa, Borrelia burgdorferi B31
SKKALESDAYI

SEQ ID NO: 9617 - protein, 11 aa, Borrelia burgdorferi B31
KKALESDAYIW

SEQ ID NO: 9618 - protein, 11 aa, Borrelia burgdorferi B31
KALESDAYIWS

SEQ ID NO: 9619 - protein, 11 aa, Borrelia burgdorferi B31
ALESDAYIWSS

SEQ ID NO: 9620 - protein, 11 aa, Borrelia burgdorferi B31
LESDAYIWSSD

SEQ ID NO: 9621 - protein, 11 aa, Borrelia burgdorferi B31
ESDAYIWSSDG

SEQ ID NO: 9622 - protein, 11 aa, Borrelia burgdorferi B31
SDAYIWSSDGK

SEQ ID NO: 9623 - protein, 11 aa, Borrelia burgdorferi B31
DAYIWSSDGKT

SEQ ID NO: 9624 - protein, 11 aa, Borrelia burgdorferi B31
AYIWSSDGKTG

SEQ ID NO: 9625 - protein, 11 aa, Borrelia burgdorferi B31
YIWSSDGKTGY

SEQ ID NO: 9626 - protein, 11 aa, Borrelia burgdorferi B31
IWSSDGKTGYE

SEQ ID NO: 9627 - protein, 11 aa, Borrelia burgdorferi B31
WSSDGKTGYEI

SEQ ID NO: 9628 - protein, 11 aa, Borrelia burgdorferi B31
SSDGKTGYEIE

SEQ ID NO: 9629 - protein, 11 aa, Borrelia burgdorferi B31
SDGKTGYEIEK

SEQ ID NO: 9630 - protein, 11 aa, Borrelia burgdorferi B31
DGKTGYEIEKA

SEQ ID NO: 9631 - protein, 11 aa, Borrelia burgdorferi B31
GKTGYEIEKAK

SEQ ID NO: 9632 - protein, 11 aa, Borrelia burgdorferi B31
KTGYEIEKAKK

SEQ ID NO: 9633 - protein, 11 aa, Borrelia burgdorferi B31
TGYEIEKAKKE

SEQ ID NO: 9634 - protein, 11 aa, Borrelia burgdorferi B31
GYEIEKAKKEE

SEQ ID NO: 9635 - protein, 11 aa, Borrelia burgdorferi B31
YEIEKAKKEES

SEQ ID NO: 9636 - protein, 11 aa, Borrelia burgdorferi B31
EIEKAKKEESG

SEQ ID NO: 9637 - protein, 11 aa, Borrelia burgdorferi B31
IEKAKKEESGT

SEQ ID NO: 9638 - protein, 11 aa, Borrelia burgdorferi B31
EKAKKEESGTE

SEQ ID NO: 9639 - protein, 11 aa, Borrelia burgdorferi B31
KAKKEESGTEI

SEQ ID NO: 9640 - protein, 11 aa, Borrelia burgdorferi B31
AKKEESGTEIK

SEQ ID NO: 9641 - protein, 11 aa, Borrelia burgdorferi B31
KKEESGTEIKL

SEQ ID NO: 9642 - protein, 11 aa, Borrelia burgdorferi B31
KEESGTEIKLY

SEQ ID NO: 9643 - protein, 11 aa, Borrelia burgdorferi B31
EESGTEIKLYL

SEQ ID NO: 9644 - protein, 11 aa, Borrelia burgdorferi B31
ESGTEIKLYLN

SEQ ID NO: 9645 - protein, 11 aa, Borrelia burgdorferi B31
SGTEIKLYLNK

SEQ ID NO: 9646 - protein, 11 aa, Borrelia burgdorferi B31
GTEIKLYLNKE

SEQ ID NO: 9647 - protein, 11 aa, Borrelia burgdorferi B31
TEIKLYLNKEG

SEQ ID NO: 9648 - protein, 11 aa, Borrelia burgdorferi B31
EIKLYLNKEGL

SEQ ID NO: 9649 - protein, 11 aa, Borrelia burgdorferi B31
IKLYLNKEGLE

SEQ ID NO: 9650 - protein, 11 aa, Borrelia burgdorferi B31
KLYLNKEGLEY

SEQ ID NO: 9651 - protein, 11 aa, Borrelia burgdorferi B31
LYLNKEGLEYA

SEQ ID NO: 9652 - protein, 11 aa, Borrelia burgdorferi B31
YLNKEGLEYAN

SEQ ID NO: 9653 - protein, 11 aa, Borrelia burgdorferi B31
LNKEGLEYANK

SEQ ID NO: 9654 - protein, 11 aa, Borrelia burgdorferi B31
NKEGLEYANKW

SEQ ID NO: 9655 - protein, 11 aa, Borrelia burgdorferi B31
KEGLEYANKWK

SEQ ID NO: 9656 - protein, 11 aa, Borrelia burgdorferi B31
EGLEYANKWKI

SEQ ID NO: 9657 - protein, 11 aa, Borrelia burgdorferi B31
GLEYANKWKIQ

SEQ ID NO: 9658 - protein, 11 aa, Borrelia burgdorferi B31
LEYANKWKIQE

SEQ ID NO: 9659 - protein, 11 aa, Borrelia burgdorferi B31
EYANKWKIQEI

SEQ ID NO: 9660 - protein, 11 aa, Borrelia burgdorferi B31
YANKWKIQEII

SEQ ID NO: 9661 - protein, 11 aa, Borrelia burgdorferi B31
ANKWKIQEIIK

SEQ ID NO: 9662 - protein, 11 aa, Borrelia burgdorferi B31
NKWKIQEIIKK

SEQ ID NO: 9663 - protein, 11 aa, Borrelia burgdorferi B31
KWKIQEIIKKY

SEQ ID NO: 9664 - protein, 11 aa, Borrelia burgdorferi B31
WKIQEIIKKYS

SEQ ID NO: 9665 - protein, 11 aa, Borrelia burgdorferi B31
KIQEIIKKYSN

SEQ ID NO: 9666 - protein, 11 aa, Borrelia burgdorferi B31
IQEIIKKYSNH

SEQ ID NO: 9667 - protein, 11 aa, Borrelia burgdorferi B31
QEIIKKYSNHI

SEQ ID NO: 9668 - protein, 11 aa, Borrelia burgdorferi B31
EIIKKYSNHIN

SEQ ID NO: 9669 - protein, 11 aa, Borrelia burgdorferi B31
IIKKYSNHINY

SEQ ID NO: 9670 - protein, 11 aa, Borrelia burgdorferi B31
IKKYSNHINYP

SEQ ID NO: 9671 - protein, 11 aa, Borrelia burgdorferi B31
KKYSNHINYPI

SEQ ID NO: 9672 - protein, 11 aa, Borrelia burgdorferi B31
KYSNHINYPIY

SEQ ID NO: 9673 - protein, 11 aa, Borrelia burgdorferi B31
YSNHINYPIYI

SEQ ID NO: 9674 - protein, 11 aa, Borrelia burgdorferi B31
SNHINYPIYIK

SEQ ID NO: 9675 - protein, 11 aa, Borrelia burgdorferi B31
NHINYPIYIKY

SEQ ID NO: 9676 - protein, 11 aa, Borrelia burgdorferi B31
HINYPIYIKYS

SEQ ID NO: 9677 - protein, 11 aa, Borrelia burgdorferi B31
INYPIYIKYSE

SEQ ID NO: 9678 - protein, 11 aa, Borrelia burgdorferi B31
NYPIYIKYSEP

SEQ ID NO: 9679 - protein, 11 aa, Borrelia burgdorferi B31
YPIYIKYSEPI

SEQ ID NO: 9680 - protein, 11 aa, Borrelia burgdorferi B31
PIYIKYSEPIM

SEQ ID NO: 9681 - protein, 11 aa, Borrelia burgdorferi B31
IYIKYSEPIMK

SEQ ID NO: 9682 - protein, 11 aa, Borrelia burgdorferi B31
YIKYSEPIMKD

SEQ ID NO: 9683 - protein, 11 aa, Borrelia burgdorferi B31
IKYSEPIMKDG

SEQ ID NO: 9684 - protein, 11 aa, Borrelia burgdorferi B31
KYSEPIMKDGK

SEQ ID NO: 9685 - protein, 11 aa, Borrelia burgdorferi B31
YSEPIMKDGKQ

SEQ ID NO: 9686 - protein, 11 aa, Borrelia burgdorferi B31
SEPIMKDGKQE

SEQ ID NO: 9687 - protein, 11 aa, Borrelia burgdorferi B31
EPIMKDGKQEG

SEQ ID NO: 9688 - protein, 11 aa, Borrelia burgdorferi B31
PIMKDGKQEGI

SEQ ID NO: 9689 - protein, 11 aa, Borrelia burgdorferi B31
IMKDGKQEGIE

SEQ ID NO: 9690 - protein, 11 aa, Borrelia burgdorferi B31
MKDGKQEGIEE

SEQ ID NO: 9691 - protein, 11 aa, Borrelia burgdorferi B31
KDGKQEGIEEK

SEQ ID NO: 9692 - protein, 11 aa, Borrelia burgdorferi B31
DGKQEGIEEKE

SEQ ID NO: 9693 - protein, 11 aa, Borrelia burgdorferi B31
GKQEGIEEKEE

SEQ ID NO: 9694 - protein, 11 aa, Borrelia burgdorferi B31
KQEGIEEKEEK

SEQ ID NO: 9695 - protein, 11 aa, Borrelia burgdorferi B31
QEGIEEKEEKL

SEQ ID NO: 9696 - protein, 11 aa, Borrelia burgdorferi B31
EGIEEKEEKLN

SEQ ID NO: 9697 - protein, 11 aa, Borrelia burgdorferi B31
GIEEKEEKLNE

SEQ ID NO: 9698 - protein, 11 aa, Borrelia burgdorferi B31
IEEKEEKLNET

SEQ ID NO: 9699 - protein, 11 aa, Borrelia burgdorferi B31
EEKEEKLNETT

SEQ ID NO: 9700 - protein, 11 aa, Borrelia burgdorferi B31
EKEEKLNETTA

SEQ ID NO: 9701 - protein, 11 aa, Borrelia burgdorferi B31
KEEKLNETTAL

SEQ ID NO: 9702 - protein, 11 aa, Borrelia burgdorferi B31
EEKLNETTALW

SEQ ID NO: 9703 - protein, 11 aa, Borrelia burgdorferi B31
EKLNETTALWT

SEQ ID NO: 9704 - protein, 11 aa, Borrelia burgdorferi B31
KLNETTALWTK

SEQ ID NO: 9705 - protein, 11 aa, Borrelia burgdorferi B31
LNETTALWTKN

SEQ ID NO: 9706 - protein, 11 aa, Borrelia burgdorferi B31
NETTALWTKNK

SEQ ID NO: 9707 - protein, 11 aa, Borrelia burgdorferi B31
ETTALWTKNKS

SEQ ID NO: 9708 - protein, 11 aa, Borrelia burgdorferi B31
TTALWTKNKSE

SEQ ID NO: 9709 - protein, 11 aa, Borrelia burgdorferi B31
TALWTKNKSEI

SEQ ID NO: 9710 - protein, 11 aa, Borrelia burgdorferi B31
ALWTKNKSEIK

SEQ ID NO: 9711 - protein, 11 aa, Borrelia burgdorferi B31
LWTKNKSEIKA

SEQ ID NO: 9712 - protein, 11 aa, Borrelia burgdorferi B31
WTKNKSEIKAE

SEQ ID NO: 9713 - protein, 11 aa, Borrelia burgdorferi B31
TKNKSEIKAEE

SEQ ID NO: 9714 - protein, 11 aa, Borrelia burgdorferi B31
KNKSEIKAEEY

SEQ ID NO: 9715 - protein, 11 aa, Borrelia burgdorferi B31
NKSEIKAEEYN

SEQ ID NO: 9716 - protein, 11 aa, Borrelia burgdorferi B31
KSEIKAEEYNE

SEQ ID NO: 9717 - protein, 11 aa, Borrelia burgdorferi B31
SEIKAEEYNEF

SEQ ID NO: 9718 - protein, 11 aa, Borrelia burgdorferi B31
EIKAEEYNEFY

SEQ ID NO: 9719 - protein, 11 aa, Borrelia burgdorferi B31
IKAEEYNEFYK

SEQ ID NO: 9720 - protein, 11 aa, Borrelia burgdorferi B31
KAEEYNEFYKN

SEQ ID NO: 9721 - protein, 11 aa, Borrelia burgdorferi B31
AEEYNEFYKNT

SEQ ID NO: 9722 - protein, 11 aa, Borrelia burgdorferi B31
EEYNEFYKNTT

SEQ ID NO: 9723 - protein, 11 aa, Borrelia burgdorferi B31
EYNEFYKNTTF

SEQ ID NO: 9724 - protein, 11 aa, Borrelia burgdorferi B31
YNEFYKNTTFD

SEQ ID NO: 9725 - protein, 11 aa, Borrelia burgdorferi B31
NEFYKNTTFDY

SEQ ID NO: 9726 - protein, 11 aa, Borrelia burgdorferi B31
EFYKNTTFDYE

SEQ ID NO: 9727 - protein, 11 aa, Borrelia burgdorferi B31
FYKNTTFDYEN

SEQ ID NO: 9728 - protein, 11 aa, Borrelia burgdorferi B31
YKNTTFDYENP

SEQ ID NO: 9729 - protein, 11 aa, Borrelia burgdorferi B31
KNTTFDYENPL

SEQ ID NO: 9730 - protein, 11 aa, Borrelia burgdorferi B31
NTTFDYENPLM

SEQ ID NO: 9731 - protein, 11 aa, Borrelia burgdorferi B31
TTFDYENPLMH

SEQ ID NO: 9732 - protein, 11 aa, Borrelia burgdorferi B31
TFDYENPLMHI

SEQ ID NO: 9733 - protein, 11 aa, Borrelia burgdorferi B31
FDYENPLMHIH

SEQ ID NO: 9734 - protein, 11 aa, Borrelia burgdorferi B31
DYENPLMHIHT

SEQ ID NO: 9735 - protein, 11 aa, Borrelia burgdorferi B31
YENPLMHIHTK

SEQ ID NO: 9736 - protein, 11 aa, Borrelia burgdorferi B31
ENPLMHIHTKA

SEQ ID NO: 9737 - protein, 11 aa, Borrelia burgdorferi B31
NPLMHIHTKAE

SEQ ID NO: 9738 - protein, 11 aa, Borrelia burgdorferi B31
PLMHIHTKAEG

SEQ ID NO: 9739 - protein, 11 aa, Borrelia burgdorferi B31
LMHIHTKAEGN

SEQ ID NO: 9740 - protein, 11 aa, Borrelia burgdorferi B31
MHIHTKAEGNL

SEQ ID NO: 9741 - protein, 11 aa, Borrelia burgdorferi B31
HIHTKAEGNLE

SEQ ID NO: 9742 - protein, 11 aa, Borrelia burgdorferi B31
IHTKAEGNLEY

SEQ ID NO: 9743 - protein, 11 aa, Borrelia burgdorferi B31
HTKAEGNLEYT

SEQ ID NO: 9744 - protein, 11 aa, Borrelia burgdorferi B31
TKAEGNLEYTN

SEQ ID NO: 9745 - protein, 11 aa, Borrelia burgdorferi B31
KAEGNLEYTNL

SEQ ID NO: 9746 - protein, 11 aa, Borrelia burgdorferi B31
AEGNLEYTNLF

SEQ ID NO: 9747 - protein, 11 aa, Borrelia burgdorferi B31
EGNLEYTNLFY

SEQ ID NO: 9748 - protein, 11 aa, Borrelia burgdorferi B31
GNLEYTNLFYV

SEQ ID NO: 9749 - protein, 11 aa, Borrelia burgdorferi B31
NLEYTNLFYVP

SEQ ID NO: 9750 - protein, 11 aa, Borrelia burgdorferi B31
LEYTNLFYVPS

SEQ ID NO: 9751 - protein, 11 aa, Borrelia burgdorferi B31
EYTNLFYVPSK

SEQ ID NO: 9752 - protein, 11 aa, Borrelia burgdorferi B31
YTNLFYVPSKA

SEQ ID NO: 9753 - protein, 11 aa, Borrelia burgdorferi B31
TNLFYVPSKAP

SEQ ID NO: 9754 - protein, 11 aa, Borrelia burgdorferi B31
NLFYVPSKAPY

SEQ ID NO: 9755 - protein, 11 aa, Borrelia burgdorferi B31
LFYVPSKAPYD

SEQ ID NO: 9756 - protein, 11 aa, Borrelia burgdorferi B31
FYVPSKAPYDL

SEQ ID NO: 9757 - protein, 11 aa, Borrelia burgdorferi B31
YVPSKAPYDLY

SEQ ID NO: 9758 - protein, 11 aa, Borrelia burgdorferi B31
VPSKAPYDLYY

SEQ ID NO: 9759 - protein, 11 aa, Borrelia burgdorferi B31
PSKAPYDLYYP

SEQ ID NO: 9760 - protein, 11 aa, Borrelia burgdorferi B31
SKAPYDLYYPN

SEQ ID NO: 9761 - protein, 11 aa, Borrelia burgdorferi B31
KAPYDLYYPNT

SEQ ID NO: 9762 - protein, 11 aa, Borrelia burgdorferi B31
APYDLYYPNTK

SEQ ID NO: 9763 - protein, 11 aa, Borrelia burgdorferi B31
PYDLYYPNTKP

SEQ ID NO: 9764 - protein, 11 aa, Borrelia burgdorferi B31
YDLYYPNTKPG

SEQ ID NO: 9765 - protein, 11 aa, Borrelia burgdorferi B31
DLYYPNTKPGV

SEQ ID NO: 9766 - protein, 11 aa, Borrelia burgdorferi B31
LYYPNTKPGVK

SEQ ID NO: 9767 - protein, 11 aa, Borrelia burgdorferi B31
YYPNTKPGVKL

SEQ ID NO: 9768 - protein, 11 aa, Borrelia burgdorferi B31
YPNTKPGVKLF

SEQ ID NO: 9769 - protein, 11 aa, Borrelia burgdorferi B31
PNTKPGVKLFI

SEQ ID NO: 9770 - protein, 11 aa, Borrelia burgdorferi B31
NTKPGVKLFIN

SEQ ID NO: 9771 - protein, 11 aa, Borrelia burgdorferi B31
TKPGVKLFINR

SEQ ID NO: 9772 - protein, 11 aa, Borrelia burgdorferi B31
KPGVKLFINRI

SEQ ID NO: 9773 - protein, 11 aa, Borrelia burgdorferi B31
PGVKLFINRIF

SEQ ID NO: 9774 - protein, 11 aa, Borrelia burgdorferi B31
GVKLFINRIFI

SEQ ID NO: 9775 - protein, 11 aa, Borrelia burgdorferi B31
VKLFINRIFIT

SEQ ID NO: 9776 - protein, 11 aa, Borrelia burgdorferi B31
KLFINRIFITD

SEQ ID NO: 9777 - protein, 11 aa, Borrelia burgdorferi B31
LFINRIFITDS

SEQ ID NO: 9778 - protein, 11 aa, Borrelia burgdorferi B31
FINRIFITDSE

SEQ ID NO: 9779 - protein, 11 aa, Borrelia burgdorferi B31
INRIFITDSEG

SEQ ID NO: 9780 - protein, 11 aa, Borrelia burgdorferi B31
NRIFITDSEGS

SEQ ID NO: 9781 - protein, 11 aa, Borrelia burgdorferi B31
RIFITDSEGSL

SEQ ID NO: 9782 - protein, 11 aa, Borrelia burgdorferi B31
IFITDSEGSLL

SEQ ID NO: 9783 - protein, 11 aa, Borrelia burgdorferi B31
FITDSEGSLLP

SEQ ID NO: 9784 - protein, 11 aa, Borrelia burgdorferi B31
ITDSEGSLLPN

SEQ ID NO: 9785 - protein, 11 aa, Borrelia burgdorferi B31
TDSEGSLLPNY

SEQ ID NO: 9786 - protein, 11 aa, Borrelia burgdorferi B31
DSEGSLLPNYL

SEQ ID NO: 9787 - protein, 11 aa, Borrelia burgdorferi B31
SEGSLLPNYLR

SEQ ID NO: 9788 - protein, 11 aa, Borrelia burgdorferi B31
EGSLLPNYLRF

SEQ ID NO: 9789 - protein, 11 aa, Borrelia burgdorferi B31
GSLLPNYLRFI

SEQ ID NO: 9790 - protein, 11 aa, Borrelia burgdorferi B31
SLLPNYLRFIK

SEQ ID NO: 9791 - protein, 11 aa, Borrelia burgdorferi B31
LLPNYLRFIKG

SEQ ID NO: 9792 - protein, 11 aa, Borrelia burgdorferi B31
LPNYLRFIKGI

SEQ ID NO: 9793 - protein, 11 aa, Borrelia burgdorferi B31
PNYLRFIKGII

SEQ ID NO: 9794 - protein, 11 aa, Borrelia burgdorferi B31
NYLRFIKGIID

SEQ ID NO: 9795 - protein, 11 aa, Borrelia burgdorferi B31
YLRFIKGIIDC

SEQ ID NO: 9796 - protein, 11 aa, Borrelia burgdorferi B31
LRFIKGIIDCQ

SEQ ID NO: 9797 - protein, 11 aa, Borrelia burgdorferi B31
RFIKGIIDCQD

SEQ ID NO: 9798 - protein, 11 aa, Borrelia burgdorferi B31
FIKGIIDCQDL

SEQ ID NO: 9799 - protein, 11 aa, Borrelia burgdorferi B31
IKGIIDCQDLP

SEQ ID NO: 9800 - protein, 11 aa, Borrelia burgdorferi B31
KGIIDCQDLPL

SEQ ID NO: 9801 - protein, 11 aa, Borrelia burgdorferi B31
GIIDCQDLPLN

SEQ ID NO: 9802 - protein, 11 aa, Borrelia burgdorferi B31
IIDCQDLPLNV

SEQ ID NO: 9803 - protein, 11 aa, Borrelia burgdorferi B31
IDCQDLPLNVS

SEQ ID NO: 9804 - protein, 11 aa, Borrelia burgdorferi B31
DCQDLPLNVSR

SEQ ID NO: 9805 - protein, 11 aa, Borrelia burgdorferi B31
CQDLPLNVSRE

SEQ ID NO: 9806 - protein, 11 aa, Borrelia burgdorferi B31
QDLPLNVSREI

SEQ ID NO: 9807 - protein, 11 aa, Borrelia burgdorferi B31
DLPLNVSREIL

SEQ ID NO: 9808 - protein, 11 aa, Borrelia burgdorferi B31
LPLNVSREILQ

SEQ ID NO: 9809 - protein, 11 aa, Borrelia burgdorferi B31
PLNVSREILQQ

SEQ ID NO: 9810 - protein, 11 aa, Borrelia burgdorferi B31
LNVSREILQQN

SEQ ID NO: 9811 - protein, 11 aa, Borrelia burgdorferi B31
NVSREILQQNK

SEQ ID NO: 9812 - protein, 11 aa, Borrelia burgdorferi B31
VSREILQQNKI

SEQ ID NO: 9813 - protein, 11 aa, Borrelia burgdorferi B31
SREILQQNKIL

SEQ ID NO: 9814 - protein, 11 aa, Borrelia burgdorferi B31
REILQQNKILS

SEQ ID NO: 9815 - protein, 11 aa, Borrelia burgdorferi B31
EILQQNKILSK

SEQ ID NO: 9816 - protein, 11 aa, Borrelia burgdorferi B31
ILQQNKILSKI

SEQ ID NO: 9817 - protein, 11 aa, Borrelia burgdorferi B31
LQQNKILSKIK

SEQ ID NO: 9818 - protein, 11 aa, Borrelia burgdorferi B31
QQNKILSKIKS

SEQ ID NO: 9819 - protein, 11 aa, Borrelia burgdorferi B31
QNKILSKIKSS

SEQ ID NO: 9820 - protein, 11 aa, Borrelia burgdorferi B31
NKILSKIKSSS

SEQ ID NO: 9821 - protein, 11 aa, Borrelia burgdorferi B31
KILSKIKSSSV

SEQ ID NO: 9822 - protein, 11 aa, Borrelia burgdorferi B31
ILSKIKSSSVK

SEQ ID NO: 9823 - protein, 11 aa, Borrelia burgdorferi B31
LSKIKSSSVKK

SEQ ID NO: 9824 - protein, 11 aa, Borrelia burgdorferi B31
SKIKSSSVKKI

SEQ ID NO: 9825 - protein, 11 aa, Borrelia burgdorferi B31
KIKSSSVKKIL

SEQ ID NO: 9826 - protein, 11 aa, Borrelia burgdorferi B31
IKSSSVKKILS

SEQ ID NO: 9827 - protein, 11 aa, Borrelia burgdorferi B31
KSSSVKKILSE

SEQ ID NO: 9828 - protein, 11 aa, Borrelia burgdorferi B31
SSSVKKILSEL

SEQ ID NO: 9829 - protein, 11 aa, Borrelia burgdorferi B31
SSVKKILSELE

SEQ ID NO: 9830 - protein, 11 aa, Borrelia burgdorferi B31
SVKKILSELEK

SEQ ID NO: 9831 - protein, 11 aa, Borrelia burgdorferi B31
VKKILSELEKL

SEQ ID NO: 9832 - protein, 11 aa, Borrelia burgdorferi B31
KKILSELEKLS

SEQ ID NO: 9833 - protein, 11 aa, Borrelia burgdorferi B31
KILSELEKLSK

SEQ ID NO: 9834 - protein, 11 aa, Borrelia burgdorferi B31
ILSELEKLSKK

SEQ ID NO: 9835 - protein, 11 aa, Borrelia burgdorferi B31
LSELEKLSKKN

SEQ ID NO: 9836 - protein, 11 aa, Borrelia burgdorferi B31
SELEKLSKKNP

SEQ ID NO: 9837 - protein, 11 aa, Borrelia burgdorferi B31
ELEKLSKKNPE

SEQ ID NO: 9838 - protein, 11 aa, Borrelia burgdorferi B31
LEKLSKKNPEK

SEQ ID NO: 9839 - protein, 11 aa, Borrelia burgdorferi B31
EKLSKKNPEKF

SEQ ID NO: 9840 - protein, 11 aa, Borrelia burgdorferi B31
KLSKKNPEKFS

SEQ ID NO: 9841 - protein, 11 aa, Borrelia burgdorferi B31
LSKKNPEKFSE

SEQ ID NO: 9842 - protein, 11 aa, Borrelia burgdorferi B31
SKKNPEKFSEF

SEQ ID NO: 9843 - protein, 11 aa, Borrelia burgdorferi B31
KKNPEKFSEFS

SEQ ID NO: 9844 - protein, 11 aa, Borrelia burgdorferi B31
KNPEKFSEFSK

SEQ ID NO: 9845 - protein, 11 aa, Borrelia burgdorferi B31
NPEKFSEFSKE

SEQ ID NO: 9846 - protein, 11 aa, Borrelia burgdorferi B31
PEKFSEFSKEF

SEQ ID NO: 9847 - protein, 11 aa, Borrelia burgdorferi B31
EKFSEFSKEFG

SEQ ID NO: 9848 - protein, 11 aa, Borrelia burgdorferi B31
KFSEFSKEFGR

SEQ ID NO: 9849 - protein, 11 aa, Borrelia burgdorferi B31
FSEFSKEFGRC

SEQ ID NO: 9850 - protein, 11 aa, Borrelia burgdorferi B31
SEFSKEFGRCI

SEQ ID NO: 9851 - protein, 11 aa, Borrelia burgdorferi B31
EFSKEFGRCIK

SEQ ID NO: 9852 - protein, 11 aa, Borrelia burgdorferi B31
FSKEFGRCIKE

SEQ ID NO: 9853 - protein, 11 aa, Borrelia burgdorferi B31
SKEFGRCIKEG

SEQ ID NO: 9854 - protein, 11 aa, Borrelia burgdorferi B31
KEFGRCIKEGV

SEQ ID NO: 9855 - protein, 11 aa, Borrelia burgdorferi B31
EFGRCIKEGVY

SEQ ID NO: 9856 - protein, 11 aa, Borrelia burgdorferi B31
FGRCIKEGVYS

SEQ ID NO: 9857 - protein, 11 aa, Borrelia burgdorferi B31
GRCIKEGVYSD

SEQ ID NO: 9858 - protein, 11 aa, Borrelia burgdorferi B31
RCIKEGVYSDF

SEQ ID NO: 9859 - protein, 11 aa, Borrelia burgdorferi B31
CIKEGVYSDFE

SEQ ID NO: 9860 - protein, 11 aa, Borrelia burgdorferi B31
IKEGVYSDFEN

SEQ ID NO: 9861 - protein, 11 aa, Borrelia burgdorferi B31
KEGVYSDFENR

SEQ ID NO: 9862 - protein, 11 aa, Borrelia burgdorferi B31
EGVYSDFENRE

SEQ ID NO: 9863 - protein, 11 aa, Borrelia burgdorferi B31
GVYSDFENREK

SEQ ID NO: 9864 - protein, 11 aa, Borrelia burgdorferi B31
VYSDFENREKL

SEQ ID NO: 9865 - protein, 11 aa, Borrelia burgdorferi B31
YSDFENREKLI

SEQ ID NO: 9866 - protein, 11 aa, Borrelia burgdorferi B31
SDFENREKLIS

SEQ ID NO: 9867 - protein, 11 aa, Borrelia burgdorferi B31
DFENREKLISL

SEQ ID NO: 9868 - protein, 11 aa, Borrelia burgdorferi B31
FENREKLISLI

SEQ ID NO: 9869 - protein, 11 aa, Borrelia burgdorferi B31
ENREKLISLIR

SEQ ID NO: 9870 - protein, 11 aa, Borrelia burgdorferi B31
NREKLISLIRF

SEQ ID NO: 9871 - protein, 11 aa, Borrelia burgdorferi B31
REKLISLIRFK

SEQ ID NO: 9872 - protein, 11 aa, Borrelia burgdorferi B31
EKLISLIRFKS

SEQ ID NO: 9873 - protein, 11 aa, Borrelia burgdorferi B31
KLISLIRFKSS

SEQ ID NO: 9874 - protein, 11 aa, Borrelia burgdorferi B31
LISLIRFKSSS

SEQ ID NO: 9875 - protein, 11 aa, Borrelia burgdorferi B31
ISLIRFKSSSV

SEQ ID NO: 9876 - protein, 11 aa, Borrelia burgdorferi B31
SLIRFKSSSVD

SEQ ID NO: 9877 - protein, 11 aa, Borrelia burgdorferi B31
LIRFKSSSVDG

SEQ ID NO: 9878 - protein, 11 aa, Borrelia burgdorferi B31
IRFKSSSVDGF

SEQ ID NO: 9879 - protein, 11 aa, Borrelia burgdorferi B31
RFKSSSVDGFV

SEQ ID NO: 9880 - protein, 11 aa, Borrelia burgdorferi B31
FKSSSVDGFVS

SEQ ID NO: 9881 - protein, 11 aa, Borrelia burgdorferi B31
KSSSVDGFVSF

SEQ ID NO: 9882 - protein, 11 aa, Borrelia burgdorferi B31
SSSVDGFVSFK

SEQ ID NO: 9883 - protein, 11 aa, Borrelia burgdorferi B31
SSVDGFVSFKE

SEQ ID NO: 9884 - protein, 11 aa, Borrelia burgdorferi B31
SVDGFVSFKEY

SEQ ID NO: 9885 - protein, 11 aa, Borrelia burgdorferi B31
VDGFVSFKEYK

SEQ ID NO: 9886 - protein, 11 aa, Borrelia burgdorferi B31
DGFVSFKEYKE

SEQ ID NO: 9887 - protein, 11 aa, Borrelia burgdorferi B31
GFVSFKEYKER

SEQ ID NO: 9888 - protein, 11 aa, Borrelia burgdorferi B31
FVSFKEYKERM

SEQ ID NO: 9889 - protein, 11 aa, Borrelia burgdorferi B31
VSFKEYKERMN

SEQ ID NO: 9890 - protein, 11 aa, Borrelia burgdorferi B31
SFKEYKERMNE

SEQ ID NO: 9891 - protein, 11 aa, Borrelia burgdorferi B31
FKEYKERMNES

SEQ ID NO: 9892 - protein, 11 aa, Borrelia burgdorferi B31
KEYKERMNESQ

SEQ ID NO: 9893 - protein, 11 aa, Borrelia burgdorferi B31
EYKERMNESQK

SEQ ID NO: 9894 - protein, 11 aa, Borrelia burgdorferi B31
YKERMNESQKS

SEQ ID NO: 9895 - protein, 11 aa, Borrelia burgdorferi B31
KERMNESQKSI

SEQ ID NO: 9896 - protein, 11 aa, Borrelia burgdorferi B31
ERMNESQKSIY

SEQ ID NO: 9897 - protein, 11 aa, Borrelia burgdorferi B31
RMNESQKSIYY

SEQ ID NO: 9898 - protein, 11 aa, Borrelia burgdorferi B31
MNESQKSIYYI

SEQ ID NO: 9899 - protein, 11 aa, Borrelia burgdorferi B31
NESQKSIYYIT

SEQ ID NO: 9900 - protein, 11 aa, Borrelia burgdorferi B31
ESQKSIYYITG

SEQ ID NO: 9901 - protein, 11 aa, Borrelia burgdorferi B31
SQKSIYYITGG

SEQ ID NO: 9902 - protein, 11 aa, Borrelia burgdorferi B31
QKSIYYITGGK

SEQ ID NO: 9903 - protein, 11 aa, Borrelia burgdorferi B31
KSIYYITGGKE

SEQ ID NO: 9904 - protein, 11 aa, Borrelia burgdorferi B31
SIYYITGGKEN

SEQ ID NO: 9905 - protein, 11 aa, Borrelia burgdorferi B31
IYYITGGKENI

SEQ ID NO: 9906 - protein, 11 aa, Borrelia burgdorferi B31
YYITGGKENIL

SEQ ID NO: 9907 - protein, 11 aa, Borrelia burgdorferi B31
YITGGKENILK

SEQ ID NO: 9908 - protein, 11 aa, Borrelia burgdorferi B31
ITGGKENILKE

SEQ ID NO: 9909 - protein, 11 aa, Borrelia burgdorferi B31
TGGKENILKEN

SEQ ID NO: 9910 - protein, 11 aa, Borrelia burgdorferi B31
GGKENILKENP

SEQ ID NO: 9911 - protein, 11 aa, Borrelia burgdorferi B31
GKENILKENPI

SEQ ID NO: 9912 - protein, 11 aa, Borrelia burgdorferi B31
KENILKENPIV

SEQ ID NO: 9913 - protein, 11 aa, Borrelia burgdorferi B31
ENILKENPIVA

SEQ ID NO: 9914 - protein, 11 aa, Borrelia burgdorferi B31
NILKENPIVAA

SEQ ID NO: 9915 - protein, 11 aa, Borrelia burgdorferi B31
ILKENPIVAAY

SEQ ID NO: 9916 - protein, 11 aa, Borrelia burgdorferi B31
LKENPIVAAYK

SEQ ID NO: 9917 - protein, 11 aa, Borrelia burgdorferi B31
KENPIVAAYKE

SEQ ID NO: 9918 - protein, 11 aa, Borrelia burgdorferi B31
ENPIVAAYKEK

SEQ ID NO: 9919 - protein, 11 aa, Borrelia burgdorferi B31
NPIVAAYKEKG

SEQ ID NO: 9920 - protein, 11 aa, Borrelia burgdorferi B31
PIVAAYKEKGF

SEQ ID NO: 9921 - protein, 11 aa, Borrelia burgdorferi B31
IVAAYKEKGFE

SEQ ID NO: 9922 - protein, 11 aa, Borrelia burgdorferi B31
VAAYKEKGFEI

SEQ ID NO: 9923 - protein, 11 aa, Borrelia burgdorferi B31
AAYKEKGFEIL

SEQ ID NO: 9924 - protein, 11 aa, Borrelia burgdorferi B31
AYKEKGFEILI

SEQ ID NO: 9925 - protein, 11 aa, Borrelia burgdorferi B31
YKEKGFEILIM

SEQ ID NO: 9926 - protein, 11 aa, Borrelia burgdorferi B31
KEKGFEILIMD

SEQ ID NO: 9927 - protein, 11 aa, Borrelia burgdorferi B31
EKGFEILIMDD

SEQ ID NO: 9928 - protein, 11 aa, Borrelia burgdorferi B31
KGFEILIMDDE

SEQ ID NO: 9929 - protein, 11 aa, Borrelia burgdorferi B31
GFEILIMDDEL

SEQ ID NO: 9930 - protein, 11 aa, Borrelia burgdorferi B31
FEILIMDDELD

SEQ ID NO: 9931 - protein, 11 aa, Borrelia burgdorferi B31
EILIMDDELDE

SEQ ID NO: 9932 - protein, 11 aa, Borrelia burgdorferi B31
ILIMDDELDEA

SEQ ID NO: 9933 - protein, 11 aa, Borrelia burgdorferi B31
LIMDDELDEAI

SEQ ID NO: 9934 - protein, 11 aa, Borrelia burgdorferi B31
IMDDELDEAIL

SEQ ID NO: 9935 - protein, 11 aa, Borrelia burgdorferi B31
MDDELDEAILN

SEQ ID NO: 9936 - protein, 11 aa, Borrelia burgdorferi B31
DDELDEAILNL

SEQ ID NO: 9937 - protein, 11 aa, Borrelia burgdorferi B31
DELDEAILNLI

SEQ ID NO: 9938 - protein, 11 aa, Borrelia burgdorferi B31
ELDEAILNLIP

SEQ ID NO: 9939 - protein, 11 aa, Borrelia burgdorferi B31
LDEAILNLIPE

SEQ ID NO: 9940 - protein, 11 aa, Borrelia burgdorferi B31
DEAILNLIPEY

SEQ ID NO: 9941 - protein, 11 aa, Borrelia burgdorferi B31
EAILNLIPEYE

SEQ ID NO: 9942 - protein, 11 aa, Borrelia burgdorferi B31
AILNLIPEYEG

SEQ ID NO: 9943 - protein, 11 aa, Borrelia burgdorferi B31
ILNLIPEYEGL

SEQ ID NO: 9944 - protein, 11 aa, Borrelia burgdorferi B31
LNLIPEYEGLK

SEQ ID NO: 9945 - protein, 11 aa, Borrelia burgdorferi B31
NLIPEYEGLKL

SEQ ID NO: 9946 - protein, 11 aa, Borrelia burgdorferi B31
LIPEYEGLKLK

SEQ ID NO: 9947 - protein, 11 aa, Borrelia burgdorferi B31
IPEYEGLKLKA

SEQ ID NO: 9948 - protein, 11 aa, Borrelia burgdorferi B31
PEYEGLKLKAI

SEQ ID NO: 9949 - protein, 11 aa, Borrelia burgdorferi B31
EYEGLKLKAIN

SEQ ID NO: 9950 - protein, 11 aa, Borrelia burgdorferi B31
YEGLKLKAINK

SEQ ID NO: 9951 - protein, 11 aa, Borrelia burgdorferi B31
EGLKLKAINKN

SEQ ID NO: 9952 - protein, 11 aa, Borrelia burgdorferi B31
GLKLKAINKNE

SEQ ID NO: 9953 - protein, 11 aa, Borrelia burgdorferi B31
LKLKAINKNET

SEQ ID NO: 9954 - protein, 11 aa, Borrelia burgdorferi B31
KLKAINKNETS

SEQ ID NO: 9955 - protein, 11 aa, Borrelia burgdorferi B31
LKAINKNETSN

SEQ ID NO: 9956 - protein, 11 aa, Borrelia burgdorferi B31
KAINKNETSNE

SEQ ID NO: 9957 - protein, 11 aa, Borrelia burgdorferi B31
AINKNETSNEL

SEQ ID NO: 9958 - protein, 11 aa, Borrelia burgdorferi B31
INKNETSNELK

SEQ ID NO: 9959 - protein, 11 aa, Borrelia burgdorferi B31
NKNETSNELKD

SEQ ID NO: 9960 - protein, 11 aa, Borrelia burgdorferi B31
KNETSNELKDE

SEQ ID NO: 9961 - protein, 11 aa, Borrelia burgdorferi B31
NETSNELKDEN

SEQ ID NO: 9962 - protein, 11 aa, Borrelia burgdorferi B31
ETSNELKDENF

SEQ ID NO: 9963 - protein, 11 aa, Borrelia burgdorferi B31
TSNELKDENFK

SEQ ID NO: 9964 - protein, 11 aa, Borrelia burgdorferi B31
SNELKDENFKK

SEQ ID NO: 9965 - protein, 11 aa, Borrelia burgdorferi B31
NELKDENFKKI

SEQ ID NO: 9966 - protein, 11 aa, Borrelia burgdorferi B31
ELKDENFKKIE

SEQ ID NO: 9967 - protein, 11 aa, Borrelia burgdorferi B31
LKDENFKKIEE

SEQ ID NO: 9968 - protein, 11 aa, Borrelia burgdorferi B31
KDENFKKIEEE

SEQ ID NO: 9969 - protein, 11 aa, Borrelia burgdorferi B31
DENFKKIEEEF

SEQ ID NO: 9970 - protein, 11 aa, Borrelia burgdorferi B31
ENFKKIEEEFK

SEQ ID NO: 9971 - protein, 11 aa, Borrelia burgdorferi B31
NFKKIEEEFKD

SEQ ID NO: 9972 - protein, 11 aa, Borrelia burgdorferi B31
FKKIEEEFKDT

SEQ ID NO: 9973 - protein, 11 aa, Borrelia burgdorferi B31
KKIEEEFKDTL

SEQ ID NO: 9974 - protein, 11 aa, Borrelia burgdorferi B31
KIEEEFKDTLT

SEQ ID NO: 9975 - protein, 11 aa, Borrelia burgdorferi B31
IEEEFKDTLTK

SEQ ID NO: 9976 - protein, 11 aa, Borrelia burgdorferi B31
EEEFKDTLTKV

SEQ ID NO: 9977 - protein, 11 aa, Borrelia burgdorferi B31
EEFKDTLTKVK

SEQ ID NO: 9978 - protein, 11 aa, Borrelia burgdorferi B31
EFKDTLTKVKE

SEQ ID NO: 9979 - protein, 11 aa, Borrelia burgdorferi B31
FKDTLTKVKEI

SEQ ID NO: 9980 - protein, 11 aa, Borrelia burgdorferi B31
KDTLTKVKEIL

SEQ ID NO: 9981 - protein, 11 aa, Borrelia burgdorferi B31
DTLTKVKEILK

SEQ ID NO: 9982 - protein, 11 aa, Borrelia burgdorferi B31
TLTKVKEILKD

SEQ ID NO: 9983 - protein, 11 aa, Borrelia burgdorferi B31
LTKVKEILKDH

SEQ ID NO: 9984 - protein, 11 aa, Borrelia burgdorferi B31
TKVKEILKDHI

SEQ ID NO: 9985 - protein, 11 aa, Borrelia burgdorferi B31
KVKEILKDHIK

SEQ ID NO: 9986 - protein, 11 aa, Borrelia burgdorferi B31
VKEILKDHIKE

SEQ ID NO: 9987 - protein, 11 aa, Borrelia burgdorferi B31
KEILKDHIKEV

SEQ ID NO: 9988 - protein, 11 aa, Borrelia burgdorferi B31
EILKDHIKEVN

SEQ ID NO: 9989 - protein, 11 aa, Borrelia burgdorferi B31
ILKDHIKEVNL

SEQ ID NO: 9990 - protein, 11 aa, Borrelia burgdorferi B31
LKDHIKEVNLS

SEQ ID NO: 9991 - protein, 11 aa, Borrelia burgdorferi B31
KDHIKEVNLSA

SEQ ID NO: 9992 - protein, 11 aa, Borrelia burgdorferi B31
DHIKEVNLSAT

SEQ ID NO: 9993 - protein, 11 aa, Borrelia burgdorferi B31
HIKEVNLSATL

SEQ ID NO: 9994 - protein, 11 aa, Borrelia burgdorferi B31
IKEVNLSATLI

SEQ ID NO: 9995 - protein, 11 aa, Borrelia burgdorferi B31
KEVNLSATLIK

SEQ ID NO: 9996 - protein, 11 aa, Borrelia burgdorferi B31
EVNLSATLIKE

SEQ ID NO: 9997 - protein, 11 aa, Borrelia burgdorferi B31
VNLSATLIKEP

SEQ ID NO: 9998 - protein, 11 aa, Borrelia burgdorferi B31
NLSATLIKEPS

SEQ ID NO: 9999 - protein, 11 aa, Borrelia burgdorferi B31
LSATLIKEPSA

SEQ ID NO: 10000 - protein, 11 aa, Borrelia burgdorferi B31
SATLIKEPSAI

SEQ ID NO: 10001 - protein, 11 aa, Borrelia burgdorferi B31
ATLIKEPSAII

SEQ ID NO: 10002 - protein, 11 aa, Borrelia burgdorferi B31
TLIKEPSAIII

SEQ ID NO: 10003 - protein, 11 aa, Borrelia burgdorferi B31
LIKEPSAIIID

SEQ ID NO: 10004 - protein, 11 aa, Borrelia burgdorferi B31
IKEPSAIIIDS

SEQ ID NO: 10005 - protein, 11 aa, Borrelia burgdorferi B31
KEPSAIIIDSN

SEQ ID NO: 10006 - protein, 11 aa, Borrelia burgdorferi B31
EPSAIIIDSND

SEQ ID NO: 10007 - protein, 11 aa, Borrelia burgdorferi B31
PSAIIIDSNDP

SEQ ID NO: 10008 - protein, 11 aa, Borrelia burgdorferi B31
SAIIIDSNDPT

SEQ ID NO: 10009 - protein, 11 aa, Borrelia burgdorferi B31
AIIIDSNDPTY

SEQ ID NO: 10010 - protein, 11 aa, Borrelia burgdorferi B31
IIIDSNDPTYQ

SEQ ID NO: 10011 - protein, 11 aa, Borrelia burgdorferi B31
IIDSNDPTYQM

SEQ ID NO: 10012 - protein, 11 aa, Borrelia burgdorferi B31
IDSNDPTYQMQ

SEQ ID NO: 10013 - protein, 11 aa, Borrelia burgdorferi B31
DSNDPTYQMQK

SEQ ID NO: 10014 - protein, 11 aa, Borrelia burgdorferi B31
SNDPTYQMQKI

SEQ ID NO: 10015 - protein, 11 aa, Borrelia burgdorferi B31
NDPTYQMQKIM

SEQ ID NO: 10016 - protein, 11 aa, Borrelia burgdorferi B31
DPTYQMQKIML

SEQ ID NO: 10017 - protein, 11 aa, Borrelia burgdorferi B31
PTYQMQKIMLS

SEQ ID NO: 10018 - protein, 11 aa, Borrelia burgdorferi B31
TYQMQKIMLSM

SEQ ID NO: 10019 - protein, 11 aa, Borrelia burgdorferi B31
YQMQKIMLSMG

SEQ ID NO: 10020 - protein, 11 aa, Borrelia burgdorferi B31
QMQKIMLSMGQ

SEQ ID NO: 10021 - protein, 11 aa, Borrelia burgdorferi B31
MQKIMLSMGQE

SEQ ID NO: 10022 - protein, 11 aa, Borrelia burgdorferi B31
QKIMLSMGQEV

SEQ ID NO: 10023 - protein, 11 aa, Borrelia burgdorferi B31
KIMLSMGQEVK

SEQ ID NO: 10024 - protein, 11 aa, Borrelia burgdorferi B31
IMLSMGQEVKE

SEQ ID NO: 10025 - protein, 11 aa, Borrelia burgdorferi B31
MLSMGQEVKEI

SEQ ID NO: 10026 - protein, 11 aa, Borrelia burgdorferi B31
LSMGQEVKEIK

SEQ ID NO: 10027 - protein, 11 aa, Borrelia burgdorferi B31
SMGQEVKEIKP

SEQ ID NO: 10028 - protein, 11 aa, Borrelia burgdorferi B31
MGQEVKEIKPI

SEQ ID NO: 10029 - protein, 11 aa, Borrelia burgdorferi B31
GQEVKEIKPIL

SEQ ID NO: 10030 - protein, 11 aa, Borrelia burgdorferi B31
QEVKEIKPILE

SEQ ID NO: 10031 - protein, 11 aa, Borrelia burgdorferi B31
EVKEIKPILEL

SEQ ID NO: 10032 - protein, 11 aa, Borrelia burgdorferi B31
VKEIKPILELN

SEQ ID NO: 10033 - protein, 11 aa, Borrelia burgdorferi B31
KEIKPILELNP

SEQ ID NO: 10034 - protein, 11 aa, Borrelia burgdorferi B31
EIKPILELNPN

SEQ ID NO: 10035 - protein, 11 aa, Borrelia burgdorferi B31
IKPILELNPNN

SEQ ID NO: 10036 - protein, 11 aa, Borrelia burgdorferi B31
KPILELNPNNK

SEQ ID NO: 10037 - protein, 11 aa, Borrelia burgdorferi B31
PILELNPNNKI

SEQ ID NO: 10038 - protein, 11 aa, Borrelia burgdorferi B31
ILELNPNNKIV

SEQ ID NO: 10039 - protein, 11 aa, Borrelia burgdorferi B31
LELNPNNKIVQ

SEQ ID NO: 10040 - protein, 11 aa, Borrelia burgdorferi B31
ELNPNNKIVQN

SEQ ID NO: 10041 - protein, 11 aa, Borrelia burgdorferi B31
LNPNNKIVQNL

SEQ ID NO: 10042 - protein, 11 aa, Borrelia burgdorferi B31
NPNNKIVQNLK

SEQ ID NO: 10043 - protein, 11 aa, Borrelia burgdorferi B31
PNNKIVQNLKN

SEQ ID NO: 10044 - protein, 11 aa, Borrelia burgdorferi B31
NNKIVQNLKNL

SEQ ID NO: 10045 - protein, 11 aa, Borrelia burgdorferi B31
NKIVQNLKNLE

SEQ ID NO: 10046 - protein, 11 aa, Borrelia burgdorferi B31
KIVQNLKNLEP

SEQ ID NO: 10047 - protein, 11 aa, Borrelia burgdorferi B31
IVQNLKNLEPE

SEQ ID NO: 10048 - protein, 11 aa, Borrelia burgdorferi B31
VQNLKNLEPEK

SEQ ID NO: 10049 - protein, 11 aa, Borrelia burgdorferi B31
QNLKNLEPEKL

SEQ ID NO: 10050 - protein, 11 aa, Borrelia burgdorferi B31
NLKNLEPEKLE

SEQ ID NO: 10051 - protein, 11 aa, Borrelia burgdorferi B31
LKNLEPEKLEK

SEQ ID NO: 10052 - protein, 11 aa, Borrelia burgdorferi B31
KNLEPEKLEKI

SEQ ID NO: 10053 - protein, 11 aa, Borrelia burgdorferi B31
NLEPEKLEKIS

SEQ ID NO: 10054 - protein, 11 aa, Borrelia burgdorferi B31
LEPEKLEKISI

SEQ ID NO: 10055 - protein, 11 aa, Borrelia burgdorferi B31
EPEKLEKISIL

SEQ ID NO: 10056 - protein, 11 aa, Borrelia burgdorferi B31
PEKLEKISILL

SEQ ID NO: 10057 - protein, 11 aa, Borrelia burgdorferi B31
EKLEKISILLF

SEQ ID NO: 10058 - protein, 11 aa, Borrelia burgdorferi B31
KLEKISILLFE

SEQ ID NO: 10059 - protein, 11 aa, Borrelia burgdorferi B31
LEKISILLFEE

SEQ ID NO: 10060 - protein, 11 aa, Borrelia burgdorferi B31
EKISILLFEEA

SEQ ID NO: 10061 - protein, 11 aa, Borrelia burgdorferi B31
KISILLFEEAM

SEQ ID NO: 10062 - protein, 11 aa, Borrelia burgdorferi B31
ISILLFEEAML

SEQ ID NO: 10063 - protein, 11 aa, Borrelia burgdorferi B31
SILLFEEAMLT

SEQ ID NO: 10064 - protein, 11 aa, Borrelia burgdorferi B31
ILLFEEAMLTS

SEQ ID NO: 10065 - protein, 11 aa, Borrelia burgdorferi B31
LLFEEAMLTSG

SEQ ID NO: 10066 - protein, 11 aa, Borrelia burgdorferi B31
LFEEAMLTSGM

SEQ ID NO: 10067 - protein, 11 aa, Borrelia burgdorferi B31
FEEAMLTSGMP

SEQ ID NO: 10068 - protein, 11 aa, Borrelia burgdorferi B31
EEAMLTSGMPS

SEQ ID NO: 10069 - protein, 11 aa, Borrelia burgdorferi B31
EAMLTSGMPSK

SEQ ID NO: 10070 - protein, 11 aa, Borrelia burgdorferi B31
AMLTSGMPSKN

SEQ ID NO: 10071 - protein, 11 aa, Borrelia burgdorferi B31
MLTSGMPSKNP

SEQ ID NO: 10072 - protein, 11 aa, Borrelia burgdorferi B31
LTSGMPSKNPG

SEQ ID NO: 10073 - protein, 11 aa, Borrelia burgdorferi B31
TSGMPSKNPGK

SEQ ID NO: 10074 - protein, 11 aa, Borrelia burgdorferi B31
SGMPSKNPGKF

SEQ ID NO: 10075 - protein, 11 aa, Borrelia burgdorferi B31
GMPSKNPGKFI

SEQ ID NO: 10076 - protein, 11 aa, Borrelia burgdorferi B31
MPSKNPGKFIN

SEQ ID NO: 10077 - protein, 11 aa, Borrelia burgdorferi B31
PSKNPGKFINI

SEQ ID NO: 10078 - protein, 11 aa, Borrelia burgdorferi B31
SKNPGKFINII

SEQ ID NO: 10079 - protein, 11 aa, Borrelia burgdorferi B31
KNPGKFINIIN

SEQ ID NO: 10080 - protein, 11 aa, Borrelia burgdorferi B31
NPGKFINIINE

SEQ ID NO: 10081 - protein, 11 aa, Borrelia burgdorferi B31
PGKFINIINEF

SEQ ID NO: 10082 - protein, 11 aa, Borrelia burgdorferi B31
GKFINIINEFI

SEQ ID NO: 10083 - protein, 11 aa, Borrelia burgdorferi B31
KFINIINEFIE

SEQ ID NO: 10084 - protein, 11 aa, Borrelia burgdorferi B31
FINIINEFIEK

SEQ ID NO: 10085 - protein, 11 aa, Borrelia burgdorferi B31
INIINEFIEKD

SEQ ID NO: 10086 - protein, 11 aa, Borrelia burgdorferi B31
NIINEFIEKDF

SEQ ID NO: 10087 - protein, 11 aa, Borrelia burgdorferi B31
IINEFIEKDFL

SEQ ID NO: 10088 - protein, 8 aa, Borrelia burgdorferi
MKKYLLGI

SEQ ID NO: 10089 - protein, 8 aa, Borrelia burgdorferi
KKYLLGIG

SEQ ID NO: 10090 - protein, 8 aa, Borrelia burgdorferi
KYLLGIGL

SEQ ID NO: 10091 - protein, 8 aa, Borrelia burgdorferi
YLLGIGLI

SEQ ID NO: 10092 - protein, 8 aa, Borrelia burgdorferi
LLGIGLIL

SEQ ID NO: 10093 - protein, 8 aa, Borrelia burgdorferi
LGIGLILA

SEQ ID NO: 10094 - protein, 8 aa, Borrelia burgdorferi
GIGLILAL

SEQ ID NO: 10095 - protein, 8 aa, Borrelia burgdorferi
IGLILALI

SEQ ID NO: 10096 - protein, 8 aa, Borrelia burgdorferi
GLILALIA

SEQ ID NO: 10097 - protein, 8 aa, Borrelia burgdorferi
LILALIAC

SEQ ID NO: 10098 - protein, 8 aa, Borrelia burgdorferi
ILALIACK

SEQ ID NO: 10099 - protein, 8 aa, Borrelia burgdorferi
LALIACKQ

SEQ ID NO: 10100 - protein, 8 aa, Borrelia burgdorferi
ALIACKQN

SEQ ID NO: 10101 - protein, 8 aa, Borrelia burgdorferi
LIACKQNV

SEQ ID NO: 10102 - protein, 8 aa, Borrelia burgdorferi
IACKQNVS

SEQ ID NO: 10103 - protein, 8 aa, Borrelia burgdorferi
ACKQNVST

SEQ ID NO: 10104 - protein, 8 aa, Borrelia burgdorferi
CKQNVSTL

SEQ ID NO: 10105 - protein, 8 aa, Borrelia burgdorferi
KQNVSTLD

SEQ ID NO: 10106 - protein, 8 aa, Borrelia burgdorferi
QNVSTLDE

SEQ ID NO: 10107 - protein, 8 aa, Borrelia burgdorferi
NVSTLDEK

SEQ ID NO: 10108 - protein, 8 aa, Borrelia burgdorferi
VSTLDEKN

SEQ ID NO: 10109 - protein, 8 aa, Borrelia burgdorferi
STLDEKNS

SEQ ID NO: 10110 - protein, 8 aa, Borrelia burgdorferi
TLDEKNSV

SEQ ID NO: 10111 - protein, 8 aa, Borrelia burgdorferi
LDEKNSVS

SEQ ID NO: 10112 - protein, 8 aa, Borrelia burgdorferi
DEKNSVSV

SEQ ID NO: 10113 - protein, 8 aa, Borrelia burgdorferi
EKNSVSVD

SEQ ID NO: 10114 - protein, 8 aa, Borrelia burgdorferi
KNSVSVDL

SEQ ID NO: 10115 - protein, 8 aa, Borrelia burgdorferi
NSVSVDLP

SEQ ID NO: 10116 - protein, 8 aa, Borrelia burgdorferi
SVSVDLPG

SEQ ID NO: 10117 - protein, 8 aa, Borrelia burgdorferi
VSVDLPGG

SEQ ID NO: 10118 - protein, 8 aa, Borrelia burgdorferi
SVDLPGGM

SEQ ID NO: 10119 - protein, 8 aa, Borrelia burgdorferi
VDLPGGMT

SEQ ID NO: 10120 - protein, 8 aa, Borrelia burgdorferi
DLPGGMTE

SEQ ID NO: 10121 - protein, 8 aa, Borrelia burgdorferi
LPGGMTEL

SEQ ID NO: 10122 - protein, 8 aa, Borrelia burgdorferi
PGGMTELV

SEQ ID NO: 10123 - protein, 8 aa, Borrelia burgdorferi
GGMTELVS

SEQ ID NO: 10124 - protein, 8 aa, Borrelia burgdorferi
GMTELVSK

SEQ ID NO: 10125 - protein, 8 aa, Borrelia burgdorferi
MTELVSKE

SEQ ID NO: 10126 - protein, 8 aa, Borrelia burgdorferi
TELVSKEK

SEQ ID NO: 10127 - protein, 8 aa, Borrelia burgdorferi
ELVSKEKD

SEQ ID NO: 10128 - protein, 8 aa, Borrelia burgdorferi
LVSKEKDK

SEQ ID NO: 10129 - protein, 8 aa, Borrelia burgdorferi
VSKEKDKD

SEQ ID NO: 10130 - protein, 8 aa, Borrelia burgdorferi
SKEKDKDG

SEQ ID NO: 10131 - protein, 8 aa, Borrelia burgdorferi
KEKDKDGK

SEQ ID NO: 10132 - protein, 8 aa, Borrelia burgdorferi
EKDKDGKY

SEQ ID NO: 10133 - protein, 8 aa, Borrelia burgdorferi
KDKDGKYS

SEQ ID NO: 10134 - protein, 8 aa, Borrelia burgdorferi
DKDGKYSL

SEQ ID NO: 10135 - protein, 8 aa, Borrelia burgdorferi
KDGKYSLE

SEQ ID NO: 10136 - protein, 8 aa, Borrelia burgdorferi
DGKYSLEA

SEQ ID NO: 10137 - protein, 8 aa, Borrelia burgdorferi
GKYSLEAT

SEQ ID NO: 10138 - protein, 8 aa, Borrelia burgdorferi
KYSLEATV

SEQ ID NO: 10139 - protein, 8 aa, Borrelia burgdorferi
YSLEATVD

SEQ ID NO: 10140 - protein, 8 aa, Borrelia burgdorferi
SLEATVDK

SEQ ID NO: 10141 - protein, 8 aa, Borrelia burgdorferi
LEATVDKL

SEQ ID NO: 10142 - protein, 8 aa, Borrelia burgdorferi
EATVDKLE

SEQ ID NO: 10143 - protein, 8 aa, Borrelia burgdorferi
ATVDKLEL

SEQ ID NO: 10144 - protein, 8 aa, Borrelia burgdorferi
TVDKLELK

SEQ ID NO: 10145 - protein, 8 aa, Borrelia burgdorferi
VDKLELKG

SEQ ID NO: 10146 - protein, 8 aa, Borrelia burgdorferi
DKLELKGT

SEQ ID NO: 10147 - protein, 8 aa, Borrelia burgdorferi
KLELKGTS

SEQ ID NO: 10148 - protein, 8 aa, Borrelia burgdorferi
LELKGTSD

SEQ ID NO: 10149 - protein, 8 aa, Borrelia burgdorferi
ELKGTSDK

SEQ ID NO: 10150 - protein, 8 aa, Borrelia burgdorferi
LKGTSDKN

SEQ ID NO: 10151 - protein, 8 aa, Borrelia burgdorferi
KGTSDKNN

SEQ ID NO: 10152 - protein, 8 aa, Borrelia burgdorferi
GTSDKNNG

SEQ ID NO: 10153 - protein, 8 aa, Borrelia burgdorferi
TSDKNNGS

SEQ ID NO: 10154 - protein, 8 aa, Borrelia burgdorferi
SDKNNGSG

SEQ ID NO: 10155 - protein, 8 aa, Borrelia burgdorferi
DKNNGSGT

SEQ ID NO: 10156 - protein, 8 aa, Borrelia burgdorferi
KNNGSGTL

SEQ ID NO: 10157 - protein, 8 aa, Borrelia burgdorferi
NNGSGTLE

SEQ ID NO: 10158 - protein, 8 aa, Borrelia burgdorferi
NGSGTLEG

SEQ ID NO: 10159 - protein, 8 aa, Borrelia burgdorferi
GSGTLEGE

SEQ ID NO: 10160 - protein, 8 aa, Borrelia burgdorferi
SGTLEGEK

SEQ ID NO: 10161 - protein, 8 aa, Borrelia burgdorferi
GTLEGEKT

SEQ ID NO: 10162 - protein, 8 aa, Borrelia burgdorferi
TLEGEKTD

SEQ ID NO: 10163 - protein, 8 aa, Borrelia burgdorferi
LEGEKTDK

SEQ ID NO: 10164 - protein, 8 aa, Borrelia burgdorferi
EGEKTDKS

SEQ ID NO: 10165 - protein, 8 aa, Borrelia burgdorferi
GEKTDKSK

SEQ ID NO: 10166 - protein, 8 aa, Borrelia burgdorferi
EKTDKSKV

SEQ ID NO: 10167 - protein, 8 aa, Borrelia burgdorferi
KTDKSKVK

SEQ ID NO: 10168 - protein, 8 aa, Borrelia burgdorferi
TDKSKVKL

SEQ ID NO: 10169 - protein, 8 aa, Borrelia burgdorferi
DKSKVKLT

SEQ ID NO: 10170 - protein, 8 aa, Borrelia burgdorferi
KSKVKLTI

SEQ ID NO: 10171 - protein, 8 aa, Borrelia burgdorferi
SKVKLTIA

SEQ ID NO: 10172 - protein, 8 aa, Borrelia burgdorferi
KVKLTIAD

SEQ ID NO: 10173 - protein, 8 aa, Borrelia burgdorferi
VKLTIADD

SEQ ID NO: 10174 - protein, 8 aa, Borrelia burgdorferi
KLTIADDL

SEQ ID NO: 10175 - protein, 8 aa, Borrelia burgdorferi
LTIADDLS

SEQ ID NO: 10176 - protein, 8 aa, Borrelia burgdorferi
TIADDLSQ

SEQ ID NO: 10177 - protein, 8 aa, Borrelia burgdorferi
IADDLSQT

SEQ ID NO: 10178 - protein, 8 aa, Borrelia burgdorferi
ADDLSQTK

SEQ ID NO: 10179 - protein, 8 aa, Borrelia burgdorferi
DDLSQTKF

SEQ ID NO: 10180 - protein, 8 aa, Borrelia burgdorferi
DLSQTKFE

SEQ ID NO: 10181 - protein, 8 aa, Borrelia burgdorferi
LSQTKFEI

SEQ ID NO: 10182 - protein, 8 aa, Borrelia burgdorferi
SQTKFEIF

SEQ ID NO: 10183 - protein, 8 aa, Borrelia burgdorferi
QTKFEIFK

SEQ ID NO: 10184 - protein, 8 aa, Borrelia burgdorferi
TKFEIFKE

SEQ ID NO: 10185 - protein, 8 aa, Borrelia burgdorferi
KFEIFKED

SEQ ID NO: 10186 - protein, 8 aa, Borrelia burgdorferi
FEIFKEDA

SEQ ID NO: 10187 - protein, 8 aa, Borrelia burgdorferi
EIFKEDAK

SEQ ID NO: 10188 - protein, 8 aa, Borrelia burgdorferi
IFKEDAKT

SEQ ID NO: 10189 - protein, 8 aa, Borrelia burgdorferi
FKEDAKTL

SEQ ID NO: 10190 - protein, 8 aa, Borrelia burgdorferi
KEDAKTLV

SEQ ID NO: 10191 - protein, 8 aa, Borrelia burgdorferi
EDAKTLVS

SEQ ID NO: 10192 - protein, 8 aa, Borrelia burgdorferi
DAKTLVSK

SEQ ID NO: 10193 - protein, 8 aa, Borrelia burgdorferi
AKTLVSKK

SEQ ID NO: 10194 - protein, 8 aa, Borrelia burgdorferi
KTLVSKKV

SEQ ID NO: 10195 - protein, 8 aa, Borrelia burgdorferi
TLVSKKVT

SEQ ID NO: 10196 - protein, 8 aa, Borrelia burgdorferi
LVSKKVTL

SEQ ID NO: 10197 - protein, 8 aa, Borrelia burgdorferi
VSKKVTLK

SEQ ID NO: 10198 - protein, 8 aa, Borrelia burgdorferi
SKKVTLKD

SEQ ID NO: 10199 - protein, 8 aa, Borrelia burgdorferi
KKVTLKDK

SEQ ID NO: 10200 - protein, 8 aa, Borrelia burgdorferi
KVTLKDKS

SEQ ID NO: 10201 - protein, 8 aa, Borrelia burgdorferi
VTLKDKSS

SEQ ID NO: 10202 - protein, 8 aa, Borrelia burgdorferi
TLKDKSST

SEQ ID NO: 10203 - protein, 8 aa, Borrelia burgdorferi
LKDKSSTE

SEQ ID NO: 10204 - protein, 8 aa, Borrelia burgdorferi
KDKSSTEE

SEQ ID NO: 10205 - protein, 8 aa, Borrelia burgdorferi
DKSSTEEK

SEQ ID NO: 10206 - protein, 8 aa, Borrelia burgdorferi
KSSTEEKF

SEQ ID NO: 10207 - protein, 8 aa, Borrelia burgdorferi
SSTEEKFN

SEQ ID NO: 10208 - protein, 8 aa, Borrelia burgdorferi
STEEKFNE

SEQ ID NO: 10209 - protein, 8 aa, Borrelia burgdorferi
TEEKFNEK

SEQ ID NO: 10210 - protein, 8 aa, Borrelia burgdorferi
EEKFNEKG

SEQ ID NO: 10211 - protein, 8 aa, Borrelia burgdorferi
EKFNEKGE

SEQ ID NO: 10212 - protein, 8 aa, Borrelia burgdorferi
KFNEKGET

SEQ ID NO: 10213 - protein, 8 aa, Borrelia burgdorferi
FNEKGETS

SEQ ID NO: 10214 - protein, 8 aa, Borrelia burgdorferi
NEKGETSE

SEQ ID NO: 10215 - protein, 8 aa, Borrelia burgdorferi
EKGETSEK

SEQ ID NO: 10216 - protein, 8 aa, Borrelia burgdorferi
KGETSEKT

SEQ ID NO: 10217 - protein, 8 aa, Borrelia burgdorferi
GETSEKTI

SEQ ID NO: 10218 - protein, 8 aa, Borrelia burgdorferi
ETSEKTIV

SEQ ID NO: 10219 - protein, 8 aa, Borrelia burgdorferi
TSEKTIVR

SEQ ID NO: 10220 - protein, 8 aa, Borrelia burgdorferi
SEKTIVRA

SEQ ID NO: 10221 - protein, 8 aa, Borrelia burgdorferi
EKTIVRAN

SEQ ID NO: 10222 - protein, 8 aa, Borrelia burgdorferi
KTIVRANG

SEQ ID NO: 10223 - protein, 8 aa, Borrelia burgdorferi
TIVRANGT

SEQ ID NO: 10224 - protein, 8 aa, Borrelia burgdorferi
IVRANGTR

SEQ ID NO: 10225 - protein, 8 aa, Borrelia burgdorferi
VRANGTRL

SEQ ID NO: 10226 - protein, 8 aa, Borrelia burgdorferi
RANGTRLE

SEQ ID NO: 10227 - protein, 8 aa, Borrelia burgdorferi
ANGTRLEY

SEQ ID NO: 10228 - protein, 8 aa, Borrelia burgdorferi
NGTRLEYT

SEQ ID NO: 10229 - protein, 8 aa, Borrelia burgdorferi
GTRLEYTD

SEQ ID NO: 10230 - protein, 8 aa, Borrelia burgdorferi
TRLEYTDI

SEQ ID NO: 10231 - protein, 8 aa, Borrelia burgdorferi
RLEYTDIK

SEQ ID NO: 10232 - protein, 8 aa, Borrelia burgdorferi
LEYTDIKS

SEQ ID NO: 10233 - protein, 8 aa, Borrelia burgdorferi
EYTDIKSD

SEQ ID NO: 10234 - protein, 8 aa, Borrelia burgdorferi
YTDIKSDG

SEQ ID NO: 10235 - protein, 8 aa, Borrelia burgdorferi
TDIKSDGS

SEQ ID NO: 10236 - protein, 8 aa, Borrelia burgdorferi
DIKSDGSG

SEQ ID NO: 10237 - protein, 8 aa, Borrelia burgdorferi
IKSDGSGK

SEQ ID NO: 10238 - protein, 8 aa, Borrelia burgdorferi
KSDGSGKA

SEQ ID NO: 10239 - protein, 8 aa, Borrelia burgdorferi
SDGSGKAK

SEQ ID NO: 10240 - protein, 8 aa, Borrelia burgdorferi
DGSGKAKE

SEQ ID NO: 10241 - protein, 8 aa, Borrelia burgdorferi
GSGKAKEV

SEQ ID NO: 10242 - protein, 8 aa, Borrelia burgdorferi
SGKAKEVL

SEQ ID NO: 10243 - protein, 8 aa, Borrelia burgdorferi
GKAKEVLK

SEQ ID NO: 10244 - protein, 8 aa, Borrelia burgdorferi
KAKEVLKD

SEQ ID NO: 10245 - protein, 8 aa, Borrelia burgdorferi
AKEVLKDF

SEQ ID NO: 10246 - protein, 8 aa, Borrelia burgdorferi
KEVLKDFT

SEQ ID NO: 10247 - protein, 8 aa, Borrelia burgdorferi
EVLKDFTL

SEQ ID NO: 10248 - protein, 8 aa, Borrelia burgdorferi
VLKDFTLE

SEQ ID NO: 10249 - protein, 8 aa, Borrelia burgdorferi
LKDFTLEG

SEQ ID NO: 10250 - protein, 8 aa, Borrelia burgdorferi
KDFTLEGT

SEQ ID NO: 10251 - protein, 8 aa, Borrelia burgdorferi
DFTLEGTL

SEQ ID NO: 10252 - protein, 8 aa, Borrelia burgdorferi
FTLEGTLA

SEQ ID NO: 10253 - protein, 8 aa, Borrelia burgdorferi
TLEGTLAA

SEQ ID NO: 10254 - protein, 8 aa, Borrelia burgdorferi
LEGTLAAD

SEQ ID NO: 10255 - protein, 8 aa, Borrelia burgdorferi
EGTLAADG

SEQ ID NO: 10256 - protein, 8 aa, Borrelia burgdorferi
GTLAADGK

SEQ ID NO: 10257 - protein, 8 aa, Borrelia burgdorferi
TLAADGKT

SEQ ID NO: 10258 - protein, 8 aa, Borrelia burgdorferi
LAADGKTT

SEQ ID NO: 10259 - protein, 8 aa, Borrelia burgdorferi
AADGKTTL

SEQ ID NO: 10260 - protein, 8 aa, Borrelia burgdorferi
ADGKTTLK

SEQ ID NO: 10261 - protein, 8 aa, Borrelia burgdorferi
DGKTTLKV

SEQ ID NO: 10262 - protein, 8 aa, Borrelia burgdorferi
GKTTLKVT

SEQ ID NO: 10263 - protein, 8 aa, Borrelia burgdorferi
KTTLKVTE

SEQ ID NO: 10264 - protein, 8 aa, Borrelia burgdorferi
TTLKVTEG

SEQ ID NO: 10265 - protein, 8 aa, Borrelia burgdorferi
TLKVTEGT

SEQ ID NO: 10266 - protein, 8 aa, Borrelia burgdorferi
LKVTEGTV

SEQ ID NO: 10267 - protein, 8 aa, Borrelia burgdorferi
KVTEGTVV

SEQ ID NO: 10268 - protein, 8 aa, Borrelia burgdorferi
VTEGTVVL

SEQ ID NO: 10269 - protein, 8 aa, Borrelia burgdorferi
TEGTVVLS

SEQ ID NO: 10270 - protein, 8 aa, Borrelia burgdorferi
EGTVVLSK

SEQ ID NO: 10271 - protein, 8 aa, Borrelia burgdorferi
GTVVLSKN

SEQ ID NO: 10272 - protein, 8 aa, Borrelia burgdorferi
TVVLSKNI

SEQ ID NO: 10273 - protein, 8 aa, Borrelia burgdorferi
VVLSKNIL

SEQ ID NO: 10274 - protein, 8 aa, Borrelia burgdorferi
VLSKNILK

SEQ ID NO: 10275 - protein, 8 aa, Borrelia burgdorferi
LSKNILKS

SEQ ID NO: 10276 - protein, 8 aa, Borrelia burgdorferi
SKNILKSG

SEQ ID NO: 10277 - protein, 8 aa, Borrelia burgdorferi
KNILKSGE

SEQ ID NO: 10278 - protein, 8 aa, Borrelia burgdorferi
NILKSGEI

SEQ ID NO: 10279 - protein, 8 aa, Borrelia burgdorferi
ILKSGEIT

SEQ ID NO: 10280 - protein, 8 aa, Borrelia burgdorferi
LKSGEITV

SEQ ID NO: 10281 - protein, 8 aa, Borrelia burgdorferi
KSGEITVA

SEQ ID NO: 10282 - protein, 8 aa, Borrelia burgdorferi
SGEITVAL

SEQ ID NO: 10283 - protein, 8 aa, Borrelia burgdorferi
GEITVALD

SEQ ID NO: 10284 - protein, 8 aa, Borrelia burgdorferi
EITVALDD

SEQ ID NO: 10285 - protein, 8 aa, Borrelia burgdorferi
ITVALDDS

SEQ ID NO: 10286 - protein, 8 aa, Borrelia burgdorferi
TVALDDSD

SEQ ID NO: 10287 - protein, 8 aa, Borrelia burgdorferi
VALDDSDT

SEQ ID NO: 10288 - protein, 8 aa, Borrelia burgdorferi
ALDDSDTT

SEQ ID NO: 10289 - protein, 8 aa, Borrelia burgdorferi
LDDSDTTQ

SEQ ID NO: 10290 - protein, 8 aa, Borrelia burgdorferi
DDSDTTQA

SEQ ID NO: 10291 - protein, 8 aa, Borrelia burgdorferi
DSDTTQAT

SEQ ID NO: 10292 - protein, 8 aa, Borrelia burgdorferi
SDTTQATK

SEQ ID NO: 10293 - protein, 8 aa, Borrelia burgdorferi
DTTQATKK

SEQ ID NO: 10294 - protein, 8 aa, Borrelia burgdorferi
TTQATKKT

SEQ ID NO: 10295 - protein, 8 aa, Borrelia burgdorferi
TQATKKTG

SEQ ID NO: 10296 - protein, 8 aa, Borrelia burgdorferi
QATKKTGK

SEQ ID NO: 10297 - protein, 8 aa, Borrelia burgdorferi
ATKKTGKW

SEQ ID NO: 10298 - protein, 8 aa, Borrelia burgdorferi
TKKTGKWD

SEQ ID NO: 10299 - protein, 8 aa, Borrelia burgdorferi
KKTGKWDS

SEQ ID NO: 10300 - protein, 8 aa, Borrelia burgdorferi
KTGKWDSK

SEQ ID NO: 10301 - protein, 8 aa, Borrelia burgdorferi
TGKWDSKT

SEQ ID NO: 10302 - protein, 8 aa, Borrelia burgdorferi
GKWDSKTS

SEQ ID NO: 10303 - protein, 8 aa, Borrelia burgdorferi
KWDSKTST

SEQ ID NO: 10304 - protein, 8 aa, Borrelia burgdorferi
WDSKTSTL

SEQ ID NO: 10305 - protein, 8 aa, Borrelia burgdorferi
DSKTSTLT

SEQ ID NO: 10306 - protein, 8 aa, Borrelia burgdorferi
SKTSTLTI

SEQ ID NO: 10307 - protein, 8 aa, Borrelia burgdorferi
KTSTLTIS

SEQ ID NO: 10308 - protein, 8 aa, Borrelia burgdorferi
TSTLTISV

SEQ ID NO: 10309 - protein, 8 aa, Borrelia burgdorferi
STLTISVN

SEQ ID NO: 10310 - protein, 8 aa, Borrelia burgdorferi
TLTISVNS

SEQ ID NO: 10311 - protein, 8 aa, Borrelia burgdorferi
LTISVNSQ

SEQ ID NO: 10312 - protein, 8 aa, Borrelia burgdorferi
TISVNSQK

SEQ ID NO: 10313 - protein, 8 aa, Borrelia burgdorferi
ISVNSQKT

SEQ ID NO: 10314 - protein, 8 aa, Borrelia burgdorferi
SVNSQKTK

SEQ ID NO: 10315 - protein, 8 aa, Borrelia burgdorferi
VNSQKTKN

SEQ ID NO: 10316 - protein, 8 aa, Borrelia burgdorferi
NSQKTKNL

SEQ ID NO: 10317 - protein, 8 aa, Borrelia burgdorferi
SQKTKNLV

SEQ ID NO: 10318 - protein, 8 aa, Borrelia burgdorferi
QKTKNLVF

SEQ ID NO: 10319 - protein, 8 aa, Borrelia burgdorferi
KTKNLVFT

SEQ ID NO: 10320 - protein, 8 aa, Borrelia burgdorferi
TKNLVFTK

SEQ ID NO: 10321 - protein, 8 aa, Borrelia burgdorferi
KNLVFTKE

SEQ ID NO: 10322 - protein, 8 aa, Borrelia burgdorferi
NLVFTKED

SEQ ID NO: 10323 - protein, 8 aa, Borrelia burgdorferi
LVFTKEDT

SEQ ID NO: 10324 - protein, 8 aa, Borrelia burgdorferi
VFTKEDTI

SEQ ID NO: 10325 - protein, 8 aa, Borrelia burgdorferi
FTKEDTIT

SEQ ID NO: 10326 - protein, 8 aa, Borrelia burgdorferi
TKEDTITV

SEQ ID NO: 10327 - protein, 8 aa, Borrelia burgdorferi
KEDTITVQ

SEQ ID NO: 10328 - protein, 8 aa, Borrelia burgdorferi
EDTITVQK

SEQ ID NO: 10329 - protein, 8 aa, Borrelia burgdorferi
DTITVQKY

SEQ ID NO: 10330 - protein, 8 aa, Borrelia burgdorferi
TITVQKYD

SEQ ID NO: 10331 - protein, 8 aa, Borrelia burgdorferi
ITVQKYDS

SEQ ID NO: 10332 - protein, 8 aa, Borrelia burgdorferi
TVQKYDSA

SEQ ID NO: 10333 - protein, 8 aa, Borrelia burgdorferi
VQKYDSAG

SEQ ID NO: 10334 - protein, 8 aa, Borrelia burgdorferi
QKYDSAGT

SEQ ID NO: 10335 - protein, 8 aa, Borrelia burgdorferi
KYDSAGTN

SEQ ID NO: 10336 - protein, 8 aa, Borrelia burgdorferi
YDSAGTNL

SEQ ID NO: 10337 - protein, 8 aa, Borrelia burgdorferi
DSAGTNLE

SEQ ID NO: 10338 - protein, 8 aa, Borrelia burgdorferi
SAGTNLEG

SEQ ID NO: 10339 - protein, 8 aa, Borrelia burgdorferi
AGTNLEGK

SEQ ID NO: 10340 - protein, 8 aa, Borrelia burgdorferi
GTNLEGKA

SEQ ID NO: 10341 - protein, 8 aa, Borrelia burgdorferi
TNLEGKAV

SEQ ID NO: 10342 - protein, 8 aa, Borrelia burgdorferi
NLEGKAVE

SEQ ID NO: 10343 - protein, 8 aa, Borrelia burgdorferi
LEGKAVEI

SEQ ID NO: 10344 - protein, 8 aa, Borrelia burgdorferi
EGKAVEIT

SEQ ID NO: 10345 - protein, 8 aa, Borrelia burgdorferi
GKAVEITT

SEQ ID NO: 10346 - protein, 8 aa, Borrelia burgdorferi
KAVEITTL

SEQ ID NO: 10347 - protein, 8 aa, Borrelia burgdorferi
AVEITTLK

SEQ ID NO: 10348 - protein, 8 aa, Borrelia burgdorferi
VEITTLKE

SEQ ID NO: 10349 - protein, 8 aa, Borrelia burgdorferi
EITTLKEL

SEQ ID NO: 10350 - protein, 8 aa, Borrelia burgdorferi
ITTLKELK

SEQ ID NO: 10351 - protein, 8 aa, Borrelia burgdorferi
TTLKELKN

SEQ ID NO: 10352 - protein, 8 aa, Borrelia burgdorferi
TLKELKNA

SEQ ID NO: 10353 - protein, 8 aa, Borrelia burgdorferi
LKELKNAL

SEQ ID NO: 10354 - protein, 8 aa, Borrelia burgdorferi
KELKNALK

SEQ ID NO: 10355 - protein, 9 aa, Borrelia burgdorferi
MKKYLLGIG

SEQ ID NO: 10356 - protein, 9 aa, Borrelia burgdorferi
KKYLLGIGL

SEQ ID NO: 10357 - protein, 9 aa, Borrelia burgdorferi
KYLLGIGLI

SEQ ID NO: 10358 - protein, 9 aa, Borrelia burgdorferi
YLLGIGLIL

SEQ ID NO: 10359 - protein, 9 aa, Borrelia burgdorferi
LLGIGLILA

SEQ ID NO: 10360 - protein, 9 aa, Borrelia burgdorferi
LGIGLILAL

SEQ ID NO: 10361 - protein, 9 aa, Borrelia burgdorferi
GIGLILALI

SEQ ID NO: 10362 - protein, 9 aa, Borrelia burgdorferi
IGLILALIA

SEQ ID NO: 10363 - protein, 9 aa, Borrelia burgdorferi
GLILALIAC

SEQ ID NO: 10364 - protein, 9 aa, Borrelia burgdorferi
LILALIACK

SEQ ID NO: 10365 - protein, 9 aa, Borrelia burgdorferi
ILALIACKQ

SEQ ID NO: 10366 - protein, 9 aa, Borrelia burgdorferi
LALIACKQN

SEQ ID NO: 10367 - protein, 9 aa, Borrelia burgdorferi
ALIACKQNV

SEQ ID NO: 10368 - protein, 9 aa, Borrelia burgdorferi
LIACKQNVS

SEQ ID NO: 10369 - protein, 9 aa, Borrelia burgdorferi
IACKQNVST

SEQ ID NO: 10370 - protein, 9 aa, Borrelia burgdorferi
ACKQNVSTL

SEQ ID NO: 10371 - protein, 9 aa, Borrelia burgdorferi
CKQNVSTLD

SEQ ID NO: 10372 - protein, 9 aa, Borrelia burgdorferi
KQNVSTLDE

SEQ ID NO: 10373 - protein, 9 aa, Borrelia burgdorferi
QNVSTLDEK

SEQ ID NO: 10374 - protein, 9 aa, Borrelia burgdorferi
NVSTLDEKN

SEQ ID NO: 10375 - protein, 9 aa, Borrelia burgdorferi
VSTLDEKNS

SEQ ID NO: 10376 - protein, 9 aa, Borrelia burgdorferi
STLDEKNSV

SEQ ID NO: 10377 - protein, 9 aa, Borrelia burgdorferi
TLDEKNSVS

SEQ ID NO: 10378 - protein, 9 aa, Borrelia burgdorferi
LDEKNSVSV

SEQ ID NO: 10379 - protein, 9 aa, Borrelia burgdorferi
DEKNSVSVD

SEQ ID NO: 10380 - protein, 9 aa, Borrelia burgdorferi
EKNSVSVDL

SEQ ID NO: 10381 - protein, 9 aa, Borrelia burgdorferi
KNSVSVDLP

SEQ ID NO: 10382 - protein, 9 aa, Borrelia burgdorferi
NSVSVDLPG

SEQ ID NO: 10383 - protein, 9 aa, Borrelia burgdorferi
SVSVDLPGG

SEQ ID NO: 10384 - protein, 9 aa, Borrelia burgdorferi
VSVDLPGGM

SEQ ID NO: 10385 - protein, 9 aa, Borrelia burgdorferi
SVDLPGGMT

SEQ ID NO: 10386 - protein, 9 aa, Borrelia burgdorferi
VDLPGGMTE

SEQ ID NO: 10387 - protein, 9 aa, Borrelia burgdorferi
DLPGGMTEL

SEQ ID NO: 10388 - protein, 9 aa, Borrelia burgdorferi
LPGGMTELV

SEQ ID NO: 10389 - protein, 9 aa, Borrelia burgdorferi
PGGMTELVS

SEQ ID NO: 10390 - protein, 9 aa, Borrelia burgdorferi
GGMTELVSK

SEQ ID NO: 10391 - protein, 9 aa, Borrelia burgdorferi
GMTELVSKE

SEQ ID NO: 10392 - protein, 9 aa, Borrelia burgdorferi
MTELVSKEK

SEQ ID NO: 10393 - protein, 9 aa, Borrelia burgdorferi
TELVSKEKD

SEQ ID NO: 10394 - protein, 9 aa, Borrelia burgdorferi
ELVSKEKDK

SEQ ID NO: 10395 - protein, 9 aa, Borrelia burgdorferi
LVSKEKDKD

SEQ ID NO: 10396 - protein, 9 aa, Borrelia burgdorferi
VSKEKDKDG

SEQ ID NO: 10397 - protein, 9 aa, Borrelia burgdorferi
SKEKDKDGK

SEQ ID NO: 10398 - protein, 9 aa, Borrelia burgdorferi
KEKDKDGKY

SEQ ID NO: 10399 - protein, 9 aa, Borrelia burgdorferi
EKDKDGKYS

SEQ ID NO: 10400 - protein, 9 aa, Borrelia burgdorferi
KDKDGKYSL

SEQ ID NO: 10401 - protein, 9 aa, Borrelia burgdorferi
DKDGKYSLE

SEQ ID NO: 10402 - protein, 9 aa, Borrelia burgdorferi
KDGKYSLEA

SEQ ID NO: 10403 - protein, 9 aa, Borrelia burgdorferi
DGKYSLEAT

SEQ ID NO: 10404 - protein, 9 aa, Borrelia burgdorferi
GKYSLEATV

SEQ ID NO: 10405 - protein, 9 aa, Borrelia burgdorferi
KYSLEATVD

SEQ ID NO: 10406 - protein, 9 aa, Borrelia burgdorferi
YSLEATVDK

SEQ ID NO: 10407 - protein, 9 aa, Borrelia burgdorferi
SLEATVDKL

SEQ ID NO: 10408 - protein, 9 aa, Borrelia burgdorferi
LEATVDKLE

SEQ ID NO: 10409 - protein, 9 aa, Borrelia burgdorferi
EATVDKLEL

SEQ ID NO: 10410 - protein, 9 aa, Borrelia burgdorferi
ATVDKLELK

SEQ ID NO: 10411 - protein, 9 aa, Borrelia burgdorferi
TVDKLELKG

SEQ ID NO: 10412 - protein, 9 aa, Borrelia burgdorferi
VDKLELKGT

SEQ ID NO: 10413 - protein, 9 aa, Borrelia burgdorferi
DKLELKGTS

SEQ ID NO: 10414 - protein, 9 aa, Borrelia burgdorferi
KLELKGTSD

SEQ ID NO: 10415 - protein, 9 aa, Borrelia burgdorferi
LELKGTSDK

SEQ ID NO: 10416 - protein, 9 aa, Borrelia burgdorferi
ELKGTSDKN

SEQ ID NO: 10417 - protein, 9 aa, Borrelia burgdorferi
LKGTSDKNN

SEQ ID NO: 10418 - protein, 9 aa, Borrelia burgdorferi
KGTSDKNNG

SEQ ID NO: 10419 - protein, 9 aa, Borrelia burgdorferi
GTSDKNNGS

SEQ ID NO: 10420 - protein, 9 aa, Borrelia burgdorferi
TSDKNNGSG

SEQ ID NO: 10421 - protein, 9 aa, Borrelia burgdorferi
SDKNNGSGT

SEQ ID NO: 10422 - protein, 9 aa, Borrelia burgdorferi
DKNNGSGTL

SEQ ID NO: 10423 - protein, 9 aa, Borrelia burgdorferi
KNNGSGTLE

SEQ ID NO: 10424 - protein, 9 aa, Borrelia burgdorferi
NNGSGTLEG

SEQ ID NO: 10425 - protein, 9 aa, Borrelia burgdorferi
NGSGTLEGE

SEQ ID NO: 10426 - protein, 9 aa, Borrelia burgdorferi
GSGTLEGEK

SEQ ID NO: 10427 - protein, 9 aa, Borrelia burgdorferi
SGTLEGEKT

SEQ ID NO: 10428 - protein, 9 aa, Borrelia burgdorferi
GTLEGEKTD

SEQ ID NO: 10429 - protein, 9 aa, Borrelia burgdorferi
TLEGEKTDK

SEQ ID NO: 10430 - protein, 9 aa, Borrelia burgdorferi
LEGEKTDKS

SEQ ID NO: 10431 - protein, 9 aa, Borrelia burgdorferi
EGEKTDKSK

SEQ ID NO: 10432 - protein, 9 aa, Borrelia burgdorferi
GEKTDKSKV

SEQ ID NO: 10433 - protein, 9 aa, Borrelia burgdorferi
EKTDKSKVK

SEQ ID NO: 10434 - protein, 9 aa, Borrelia burgdorferi
KTDKSKVKL

SEQ ID NO: 10435 - protein, 9 aa, Borrelia burgdorferi
TDKSKVKLT

SEQ ID NO: 10436 - protein, 9 aa, Borrelia burgdorferi
DKSKVKLTI

SEQ ID NO: 10437 - protein, 9 aa, Borrelia burgdorferi
KSKVKLTIA

SEQ ID NO: 10438 - protein, 9 aa, Borrelia burgdorferi
SKVKLTIAD

SEQ ID NO: 10439 - protein, 9 aa, Borrelia burgdorferi
KVKLTIADD

SEQ ID NO: 10440 - protein, 9 aa, Borrelia burgdorferi
VKLTIADDL

SEQ ID NO: 10441 - protein, 9 aa, Borrelia burgdorferi
KLTIADDLS

SEQ ID NO: 10442 - protein, 9 aa, Borrelia burgdorferi
LTIADDLSQ

SEQ ID NO: 10443 - protein, 9 aa, Borrelia burgdorferi
TIADDLSQT

SEQ ID NO: 10444 - protein, 9 aa, Borrelia burgdorferi
IADDLSQTK

SEQ ID NO: 10445 - protein, 9 aa, Borrelia burgdorferi
ADDLSQTKF

SEQ ID NO: 10446 - protein, 9 aa, Borrelia burgdorferi
DDLSQTKFE

SEQ ID NO: 10447 - protein, 9 aa, Borrelia burgdorferi
DLSQTKFEI

SEQ ID NO: 10448 - protein, 9 aa, Borrelia burgdorferi
LSQTKFEIF

SEQ ID NO: 10449 - protein, 9 aa, Borrelia burgdorferi
SQTKFEIFK

SEQ ID NO: 10450 - protein, 9 aa, Borrelia burgdorferi
QTKFEIFKE

SEQ ID NO: 10451 - protein, 9 aa, Borrelia burgdorferi
TKFEIFKED

SEQ ID NO: 10452 - protein, 9 aa, Borrelia burgdorferi
KFEIFKEDA

SEQ ID NO: 10453 - protein, 9 aa, Borrelia burgdorferi
FEIFKEDAK

SEQ ID NO: 10454 - protein, 9 aa, Borrelia burgdorferi
EIFKEDAKT

SEQ ID NO: 10455 - protein, 9 aa, Borrelia burgdorferi
IFKEDAKTL

SEQ ID NO: 10456 - protein, 9 aa, Borrelia burgdorferi
FKEDAKTLV

SEQ ID NO: 10457 - protein, 9 aa, Borrelia burgdorferi
KEDAKTLVS

SEQ ID NO: 10458 - protein, 9 aa, Borrelia burgdorferi
EDAKTLVSK

SEQ ID NO: 10459 - protein, 9 aa, Borrelia burgdorferi
DAKTLVSKK

SEQ ID NO: 10460 - protein, 9 aa, Borrelia burgdorferi
AKTLVSKKV

SEQ ID NO: 10461 - protein, 9 aa, Borrelia burgdorferi
KTLVSKKVT

SEQ ID NO: 10462 - protein, 9 aa, Borrelia burgdorferi
TLVSKKVTL

SEQ ID NO: 10463 - protein, 9 aa, Borrelia burgdorferi
LVSKKVTLK

SEQ ID NO: 10464 - protein, 9 aa, Borrelia burgdorferi
VSKKVTLKD

SEQ ID NO: 10465 - protein, 9 aa, Borrelia burgdorferi
SKKVTLKDK

SEQ ID NO: 10466 - protein, 9 aa, Borrelia burgdorferi
KKVTLKDKS

SEQ ID NO: 10467 - protein, 9 aa, Borrelia burgdorferi
KVTLKDKSS

SEQ ID NO: 10468 - protein, 9 aa, Borrelia burgdorferi
VTLKDKSST

SEQ ID NO: 10469 - protein, 9 aa, Borrelia burgdorferi
TLKDKSSTE

SEQ ID NO: 10470 - protein, 9 aa, Borrelia burgdorferi
LKDKSSTEE

SEQ ID NO: 10471 - protein, 9 aa, Borrelia burgdorferi
KDKSSTEEK

SEQ ID NO: 10472 - protein, 9 aa, Borrelia burgdorferi
DKSSTEEKF

SEQ ID NO: 10473 - protein, 9 aa, Borrelia burgdorferi
KSSTEEKFN

SEQ ID NO: 10474 - protein, 9 aa, Borrelia burgdorferi
SSTEEKFNE

SEQ ID NO: 10475 - protein, 9 aa, Borrelia burgdorferi
STEEKFNEK

SEQ ID NO: 10476 - protein, 9 aa, Borrelia burgdorferi
TEEKFNEKG

SEQ ID NO: 10477 - protein, 9 aa, Borrelia burgdorferi
EEKFNEKGE

SEQ ID NO: 10478 - protein, 9 aa, Borrelia burgdorferi
EKFNEKGET

SEQ ID NO: 10479 - protein, 9 aa, Borrelia burgdorferi
KFNEKGETS

SEQ ID NO: 10480 - protein, 9 aa, Borrelia burgdorferi
FNEKGETSE

SEQ ID NO: 10481 - protein, 9 aa, Borrelia burgdorferi
NEKGETSEK

SEQ ID NO: 10482 - protein, 9 aa, Borrelia burgdorferi
EKGETSEKT

SEQ ID NO: 10483 - protein, 9 aa, Borrelia burgdorferi
KGETSEKTI

SEQ ID NO: 10484 - protein, 9 aa, Borrelia burgdorferi
GETSEKTIV

SEQ ID NO: 10485 - protein, 9 aa, Borrelia burgdorferi
ETSEKTIVR

SEQ ID NO: 10486 - protein, 9 aa, Borrelia burgdorferi
TSEKTIVRA

SEQ ID NO: 10487 - protein, 9 aa, Borrelia burgdorferi
SEKTIVRAN

SEQ ID NO: 10488 - protein, 9 aa, Borrelia burgdorferi
EKTIVRANG

SEQ ID NO: 10489 - protein, 9 aa, Borrelia burgdorferi
KTIVRANGT

SEQ ID NO: 10490 - protein, 9 aa, Borrelia burgdorferi
TIVRANGTR

SEQ ID NO: 10491 - protein, 9 aa, Borrelia burgdorferi
IVRANGTRL

SEQ ID NO: 10492 - protein, 9 aa, Borrelia burgdorferi
VRANGTRLE

SEQ ID NO: 10493 - protein, 9 aa, Borrelia burgdorferi
RANGTRLEY

SEQ ID NO: 10494 - protein, 9 aa, Borrelia burgdorferi
ANGTRLEYT

SEQ ID NO: 10495 - protein, 9 aa, Borrelia burgdorferi
NGTRLEYTD

SEQ ID NO: 10496 - protein, 9 aa, Borrelia burgdorferi
GTRLEYTDI

SEQ ID NO: 10497 - protein, 9 aa, Borrelia burgdorferi
TRLEYTDIK

SEQ ID NO: 10498 - protein, 9 aa, Borrelia burgdorferi
RLEYTDIKS

SEQ ID NO: 10499 - protein, 9 aa, Borrelia burgdorferi
LEYTDIKSD

SEQ ID NO: 10500 - protein, 9 aa, Borrelia burgdorferi
EYTDIKSDG

SEQ ID NO: 10501 - protein, 9 aa, Borrelia burgdorferi
YTDIKSDGS

SEQ ID NO: 10502 - protein, 9 aa, Borrelia burgdorferi
TDIKSDGSG

SEQ ID NO: 10503 - protein, 9 aa, Borrelia burgdorferi
DIKSDGSGK

SEQ ID NO: 10504 - protein, 9 aa, Borrelia burgdorferi
IKSDGSGKA

SEQ ID NO: 10505 - protein, 9 aa, Borrelia burgdorferi
KSDGSGKAK

SEQ ID NO: 10506 - protein, 9 aa, Borrelia burgdorferi
SDGSGKAKE

SEQ ID NO: 10507 - protein, 9 aa, Borrelia burgdorferi
DGSGKAKEV

SEQ ID NO: 10508 - protein, 9 aa, Borrelia burgdorferi
GSGKAKEVL

SEQ ID NO: 10509 - protein, 9 aa, Borrelia burgdorferi
SGKAKEVLK

SEQ ID NO: 10510 - protein, 9 aa, Borrelia burgdorferi
GKAKEVLKD

SEQ ID NO: 10511 - protein, 9 aa, Borrelia burgdorferi
KAKEVLKDF

SEQ ID NO: 10512 - protein, 9 aa, Borrelia burgdorferi
AKEVLKDFT

SEQ ID NO: 10513 - protein, 9 aa, Borrelia burgdorferi
KEVLKDFTL

SEQ ID NO: 10514 - protein, 9 aa, Borrelia burgdorferi
EVLKDFTLE

SEQ ID NO: 10515 - protein, 9 aa, Borrelia burgdorferi
VLKDFTLEG

SEQ ID NO: 10516 - protein, 9 aa, Borrelia burgdorferi
LKDFTLEGT

SEQ ID NO: 10517 - protein, 9 aa, Borrelia burgdorferi
KDFTLEGTL

SEQ ID NO: 10518 - protein, 9 aa, Borrelia burgdorferi
DFTLEGTLA

SEQ ID NO: 10519 - protein, 9 aa, Borrelia burgdorferi
FTLEGTLAA

SEQ ID NO: 10520 - protein, 9 aa, Borrelia burgdorferi
TLEGTLAAD

SEQ ID NO: 10521 - protein, 9 aa, Borrelia burgdorferi
LEGTLAADG

SEQ ID NO: 10522 - protein, 9 aa, Borrelia burgdorferi
EGTLAADGK

SEQ ID NO: 10523 - protein, 9 aa, Borrelia burgdorferi
GTLAADGKT

SEQ ID NO: 10524 - protein, 9 aa, Borrelia burgdorferi
TLAADGKTT

SEQ ID NO: 10525 - protein, 9 aa, Borrelia burgdorferi
LAADGKTTL

SEQ ID NO: 10526 - protein, 9 aa, Borrelia burgdorferi
AADGKTTLK

SEQ ID NO: 10527 - protein, 9 aa, Borrelia burgdorferi
ADGKTTLKV

SEQ ID NO: 10528 - protein, 9 aa, Borrelia burgdorferi
DGKTTLKVT

SEQ ID NO: 10529 - protein, 9 aa, Borrelia burgdorferi
GKTTLKVTE

SEQ ID NO: 10530 - protein, 9 aa, Borrelia burgdorferi
KTTLKVTEG

SEQ ID NO: 10531 - protein, 9 aa, Borrelia burgdorferi
TTLKVTEGT

SEQ ID NO: 10532 - protein, 9 aa, Borrelia burgdorferi
TLKVTEGTV

SEQ ID NO: 10533 - protein, 9 aa, Borrelia burgdorferi
LKVTEGTVV

SEQ ID NO: 10534 - protein, 9 aa, Borrelia burgdorferi
KVTEGTVVL

SEQ ID NO: 10535 - protein, 9 aa, Borrelia burgdorferi
VTEGTVVLS

SEQ ID NO: 10536 - protein, 9 aa, Borrelia burgdorferi
TEGTVVLSK

SEQ ID NO: 10537 - protein, 9 aa, Borrelia burgdorferi
EGTVVLSKN

SEQ ID NO: 10538 - protein, 9 aa, Borrelia burgdorferi
GTVVLSKNI

SEQ ID NO: 10539 - protein, 9 aa, Borrelia burgdorferi
TVVLSKNIL

SEQ ID NO: 10540 - protein, 9 aa, Borrelia burgdorferi
VVLSKNILK

SEQ ID NO: 10541 - protein, 9 aa, Borrelia burgdorferi
VLSKNILKS

SEQ ID NO: 10542 - protein, 9 aa, Borrelia burgdorferi
LSKNILKSG

SEQ ID NO: 10543 - protein, 9 aa, Borrelia burgdorferi
SKNILKSGE

SEQ ID NO: 10544 - protein, 9 aa, Borrelia burgdorferi
KNILKSGEI

SEQ ID NO: 10545 - protein, 9 aa, Borrelia burgdorferi
NILKSGEIT

SEQ ID NO: 10546 - protein, 9 aa, Borrelia burgdorferi
ILKSGEITV

SEQ ID NO: 10547 - protein, 9 aa, Borrelia burgdorferi
LKSGEITVA

SEQ ID NO: 10548 - protein, 9 aa, Borrelia burgdorferi
KSGEITVAL

SEQ ID NO: 10549 - protein, 9 aa, Borrelia burgdorferi
SGEITVALD

SEQ ID NO: 10550 - protein, 9 aa, Borrelia burgdorferi
GEITVALDD

SEQ ID NO: 10551 - protein, 9 aa, Borrelia burgdorferi
EITVALDDS

SEQ ID NO: 10552 - protein, 9 aa, Borrelia burgdorferi
ITVALDDSD

SEQ ID NO: 10553 - protein, 9 aa, Borrelia burgdorferi
TVALDDSDT

SEQ ID NO: 10554 - protein, 9 aa, Borrelia burgdorferi
VALDDSDTT

SEQ ID NO: 10555 - protein, 9 aa, Borrelia burgdorferi
ALDDSDTTQ

SEQ ID NO: 10556 - protein, 9 aa, Borrelia burgdorferi
LDDSDTTQA

SEQ ID NO: 10557 - protein, 9 aa, Borrelia burgdorferi
DDSDTTQAT

SEQ ID NO: 10558 - protein, 9 aa, Borrelia burgdorferi
DSDTTQATK

SEQ ID NO: 10559 - protein, 9 aa, Borrelia burgdorferi
SDTTQATKK

SEQ ID NO: 10560 - protein, 9 aa, Borrelia burgdorferi
DTTQATKKT

SEQ ID NO: 10561 - protein, 9 aa, Borrelia burgdorferi
TTQATKKTG

SEQ ID NO: 10562 - protein, 9 aa, Borrelia burgdorferi
TQATKKTGK

SEQ ID NO: 10563 - protein, 9 aa, Borrelia burgdorferi
QATKKTGKW

SEQ ID NO: 10564 - protein, 9 aa, Borrelia burgdorferi
ATKKTGKWD

SEQ ID NO: 10565 - protein, 9 aa, Borrelia burgdorferi
TKKTGKWDS

SEQ ID NO: 10566 - protein, 9 aa, Borrelia burgdorferi
KKTGKWDSK

SEQ ID NO: 10567 - protein, 9 aa, Borrelia burgdorferi
KTGKWDSKT

SEQ ID NO: 10568 - protein, 9 aa, Borrelia burgdorferi
TGKWDSKTS

SEQ ID NO: 10569 - protein, 9 aa, Borrelia burgdorferi
GKWDSKTST

SEQ ID NO: 10570 - protein, 9 aa, Borrelia burgdorferi
KWDSKTSTL

SEQ ID NO: 10571 - protein, 9 aa, Borrelia burgdorferi
WDSKTSTLT

SEQ ID NO: 10572 - protein, 9 aa, Borrelia burgdorferi
DSKTSTLTI

SEQ ID NO: 10573 - protein, 9 aa, Borrelia burgdorferi
SKTSTLTIS

SEQ ID NO: 10574 - protein, 9 aa, Borrelia burgdorferi
KTSTLTISV

SEQ ID NO: 10575 - protein, 9 aa, Borrelia burgdorferi
TSTLTISVN

SEQ ID NO: 10576 - protein, 9 aa, Borrelia burgdorferi
STLTISVNS

SEQ ID NO: 10577 - protein, 9 aa, Borrelia burgdorferi
TLTISVNSQ

SEQ ID NO: 10578 - protein, 9 aa, Borrelia burgdorferi
LTISVNSQK

SEQ ID NO: 10579 - protein, 9 aa, Borrelia burgdorferi
TISVNSQKT

SEQ ID NO: 10580 - protein, 9 aa, Borrelia burgdorferi
ISVNSQKTK

SEQ ID NO: 10581 - protein, 9 aa, Borrelia burgdorferi
SVNSQKTKN

SEQ ID NO: 10582 - protein, 9 aa, Borrelia burgdorferi
VNSQKTKNL

SEQ ID NO: 10583 - protein, 9 aa, Borrelia burgdorferi
NSQKTKNLV

SEQ ID NO: 10584 - protein, 9 aa, Borrelia burgdorferi
SQKTKNLVF

SEQ ID NO: 10585 - protein, 9 aa, Borrelia burgdorferi
QKTKNLVFT

SEQ ID NO: 10586 - protein, 9 aa, Borrelia burgdorferi
KTKNLVFTK

SEQ ID NO: 10587 - protein, 9 aa, Borrelia burgdorferi
TKNLVFTKE

SEQ ID NO: 10588 - protein, 9 aa, Borrelia burgdorferi
KNLVFTKED

SEQ ID NO: 10589 - protein, 9 aa, Borrelia burgdorferi
NLVFTKEDT

SEQ ID NO: 10590 - protein, 9 aa, Borrelia burgdorferi
LVFTKEDTI

SEQ ID NO: 10591 - protein, 9 aa, Borrelia burgdorferi
VFTKEDTIT

SEQ ID NO: 10592 - protein, 9 aa, Borrelia burgdorferi
FTKEDTITV

SEQ ID NO: 10593 - protein, 9 aa, Borrelia burgdorferi
TKEDTITVQ

SEQ ID NO: 10594 - protein, 9 aa, Borrelia burgdorferi
KEDTITVQK

SEQ ID NO: 10595 - protein, 9 aa, Borrelia burgdorferi
EDTITVQKY

SEQ ID NO: 10596 - protein, 9 aa, Borrelia burgdorferi
DTITVQKYD

SEQ ID NO: 10597 - protein, 9 aa, Borrelia burgdorferi
TITVQKYDS

SEQ ID NO: 10598 - protein, 9 aa, Borrelia burgdorferi
ITVQKYDSA

SEQ ID NO: 10599 - protein, 9 aa, Borrelia burgdorferi
TVQKYDSAG

SEQ ID NO: 10600 - protein, 9 aa, Borrelia burgdorferi
VQKYDSAGT

SEQ ID NO: 10601 - protein, 9 aa, Borrelia burgdorferi
QKYDSAGTN

SEQ ID NO: 10602 - protein, 9 aa, Borrelia burgdorferi
KYDSAGTNL

SEQ ID NO: 10603 - protein, 9 aa, Borrelia burgdorferi
YDSAGTNLE

SEQ ID NO: 10604 - protein, 9 aa, Borrelia burgdorferi
DSAGTNLEG

SEQ ID NO: 10605 - protein, 9 aa, Borrelia burgdorferi
SAGTNLEGK

SEQ ID NO: 10606 - protein, 9 aa, Borrelia burgdorferi
AGTNLEGKA

SEQ ID NO: 10607 - protein, 9 aa, Borrelia burgdorferi
GTNLEGKAV

SEQ ID NO: 10608 - protein, 9 aa, Borrelia burgdorferi
TNLEGKAVE

SEQ ID NO: 10609 - protein, 9 aa, Borrelia burgdorferi
NLEGKAVEI

SEQ ID NO: 10610 - protein, 9 aa, Borrelia burgdorferi
LEGKAVEIT

SEQ ID NO: 10611 - protein, 9 aa, Borrelia burgdorferi
EGKAVEITT

SEQ ID NO: 10612 - protein, 9 aa, Borrelia burgdorferi
GKAVEITTL

SEQ ID NO: 10613 - protein, 9 aa, Borrelia burgdorferi
KAVEITTLK

SEQ ID NO: 10614 - protein, 9 aa, Borrelia burgdorferi
AVEITTLKE

SEQ ID NO: 10615 - protein, 9 aa, Borrelia burgdorferi
VEITTLKEL

SEQ ID NO: 10616 - protein, 9 aa, Borrelia burgdorferi
EITTLKELK

SEQ ID NO: 10617 - protein, 9 aa, Borrelia burgdorferi
ITTLKELKN

SEQ ID NO: 10618 - protein, 9 aa, Borrelia burgdorferi
TTLKELKNA

SEQ ID NO: 10619 - protein, 9 aa, Borrelia burgdorferi
TLKELKNAL

SEQ ID NO: 10620 - protein, 9 aa, Borrelia burgdorferi
LKELKNALK

SEQ ID NO: 10621 - protein, 10 aa, Borrelia burgdorferi
MKKYLLGIGL

SEQ ID NO: 10622 - protein, 10 aa, Borrelia burgdorferi
KKYLLGIGLI

SEQ ID NO: 10623 - protein, 10 aa, Borrelia burgdorferi
KYLLGIGLIL

SEQ ID NO: 10624 - protein, 10 aa, Borrelia burgdorferi
YLLGIGLILA

SEQ ID NO: 10625 - protein, 10 aa, Borrelia burgdorferi
LLGIGLILAL

SEQ ID NO: 10626 - protein, 10 aa, Borrelia burgdorferi
LGIGLILALI

SEQ ID NO: 10627 - protein, 10 aa, Borrelia burgdorferi
GIGLILALIA

SEQ ID NO: 10628 - protein, 10 aa, Borrelia burgdorferi
IGLILALIAC

SEQ ID NO: 10629 - protein, 10 aa, Borrelia burgdorferi
GLILALIACK

SEQ ID NO: 10630 - protein, 10 aa, Borrelia burgdorferi
LILALIACKQ

SEQ ID NO: 10631 - protein, 10 aa, Borrelia burgdorferi
ILALIACKQN

SEQ ID NO: 10632 - protein, 10 aa, Borrelia burgdorferi
LALIACKQNV

SEQ ID NO: 10633 - protein, 10 aa, Borrelia burgdorferi
ALIACKQNVS

SEQ ID NO: 10634 - protein, 10 aa, Borrelia burgdorferi
LIACKQNVST

SEQ ID NO: 10635 - protein, 10 aa, Borrelia burgdorferi
IACKQNVSTL

SEQ ID NO: 10636 - protein, 10 aa, Borrelia burgdorferi
ACKQNVSTLD

SEQ ID NO: 10637 - protein, 10 aa, Borrelia burgdorferi
CKQNVSTLDE

SEQ ID NO: 10638 - protein, 10 aa, Borrelia burgdorferi
KQNVSTLDEK

SEQ ID NO: 10639 - protein, 10 aa, Borrelia burgdorferi
QNVSTLDEKN

SEQ ID NO: 10640 - protein, 10 aa, Borrelia burgdorferi
NVSTLDEKNS

SEQ ID NO: 10641 - protein, 10 aa, Borrelia burgdorferi
VSTLDEKNSV

SEQ ID NO: 10642 - protein, 10 aa, Borrelia burgdorferi
STLDEKNSVS

SEQ ID NO: 10643 - protein, 10 aa, Borrelia burgdorferi
TLDEKNSVSV

SEQ ID NO: 10644 - protein, 10 aa, Borrelia burgdorferi
LDEKNSVSVD

SEQ ID NO: 10645 - protein, 10 aa, Borrelia burgdorferi
DEKNSVSVDL

SEQ ID NO: 10646 - protein, 10 aa, Borrelia burgdorferi
EKNSVSVDLP

SEQ ID NO: 10647 - protein, 10 aa, Borrelia burgdorferi
KNSVSVDLPG

SEQ ID NO: 10648 - protein, 10 aa, Borrelia burgdorferi
NSVSVDLPGG

SEQ ID NO: 10649 - protein, 10 aa, Borrelia burgdorferi
SVSVDLPGGM

SEQ ID NO: 10650 - protein, 10 aa, Borrelia burgdorferi
VSVDLPGGMT

SEQ ID NO: 10651 - protein, 10 aa, Borrelia burgdorferi
SVDLPGGMTE

SEQ ID NO: 10652 - protein, 10 aa, Borrelia burgdorferi
VDLPGGMTEL

SEQ ID NO: 10653 - protein, 10 aa, Borrelia burgdorferi
DLPGGMTELV

SEQ ID NO: 10654 - protein, 10 aa, Borrelia burgdorferi
LPGGMTELVS

SEQ ID NO: 10655 - protein, 10 aa, Borrelia burgdorferi
PGGMTELVSK

SEQ ID NO: 10656 - protein, 10 aa, Borrelia burgdorferi
GGMTELVSKE

SEQ ID NO: 10657 - protein, 10 aa, Borrelia burgdorferi
GMTELVSKEK

SEQ ID NO: 10658 - protein, 10 aa, Borrelia burgdorferi
MTELVSKEKD

SEQ ID NO: 10659 - protein, 10 aa, Borrelia burgdorferi
TELVSKEKDK

SEQ ID NO: 10660 - protein, 10 aa, Borrelia burgdorferi
ELVSKEKDKD

SEQ ID NO: 10661 - protein, 10 aa, Borrelia burgdorferi
LVSKEKDKDG

SEQ ID NO: 10662 - protein, 10 aa, Borrelia burgdorferi
VSKEKDKDGK

SEQ ID NO: 10663 - protein, 10 aa, Borrelia burgdorferi
SKEKDKDGKY

SEQ ID NO: 10664 - protein, 10 aa, Borrelia burgdorferi
KEKDKDGKYS

SEQ ID NO: 10665 - protein, 10 aa, Borrelia burgdorferi
EKDKDGKYSL

SEQ ID NO: 10666 - protein, 10 aa, Borrelia burgdorferi
KDKDGKYSLE

SEQ ID NO: 10667 - protein, 10 aa, Borrelia burgdorferi
DKDGKYSLEA

SEQ ID NO: 10668 - protein, 10 aa, Borrelia burgdorferi
KDGKYSLEAT

SEQ ID NO: 10669 - protein, 10 aa, Borrelia burgdorferi
DGKYSLEATV

SEQ ID NO: 10670 - protein, 10 aa, Borrelia burgdorferi
GKYSLEATVD

SEQ ID NO: 10671 - protein, 10 aa, Borrelia burgdorferi
KYSLEATVDK

SEQ ID NO: 10672 - protein, 10 aa, Borrelia burgdorferi
YSLEATVDKL

SEQ ID NO: 10673 - protein, 10 aa, Borrelia burgdorferi
SLEATVDKLE

SEQ ID NO: 10674 - protein, 10 aa, Borrelia burgdorferi
LEATVDKLEL

SEQ ID NO: 10675 - protein, 10 aa, Borrelia burgdorferi
EATVDKLELK

SEQ ID NO: 10676 - protein, 10 aa, Borrelia burgdorferi
ATVDKLELKG

SEQ ID NO: 10677 - protein, 10 aa, Borrelia burgdorferi
TVDKLELKGT

SEQ ID NO: 10678 - protein, 10 aa, Borrelia burgdorferi
VDKLELKGTS

SEQ ID NO: 10679 - protein, 10 aa, Borrelia burgdorferi
DKLELKGTSD

SEQ ID NO: 10680 - protein, 10 aa, Borrelia burgdorferi
KLELKGTSDK

SEQ ID NO: 10681 - protein, 10 aa, Borrelia burgdorferi
LELKGTSDKN

SEQ ID NO: 10682 - protein, 10 aa, Borrelia burgdorferi
ELKGTSDKNN

SEQ ID NO: 10683 - protein, 10 aa, Borrelia burgdorferi
LKGTSDKNNG

SEQ ID NO: 10684 - protein, 10 aa, Borrelia burgdorferi
KGTSDKNNGS

SEQ ID NO: 10685 - protein, 10 aa, Borrelia burgdorferi
GTSDKNNGSG

SEQ ID NO: 10686 - protein, 10 aa, Borrelia burgdorferi
TSDKNNGSGT

SEQ ID NO: 10687 - protein, 10 aa, Borrelia burgdorferi
SDKNNGSGTL

SEQ ID NO: 10688 - protein, 10 aa, Borrelia burgdorferi
DKNNGSGTLE

SEQ ID NO: 10689 - protein, 10 aa, Borrelia burgdorferi
KNNGSGTLEG

SEQ ID NO: 10690 - protein, 10 aa, Borrelia burgdorferi
NNGSGTLEGE

SEQ ID NO: 10691 - protein, 10 aa, Borrelia burgdorferi
NGSGTLEGEK

SEQ ID NO: 10692 - protein, 10 aa, Borrelia burgdorferi
GSGTLEGEKT

SEQ ID NO: 10693 - protein, 10 aa, Borrelia burgdorferi
SGTLEGEKTD

SEQ ID NO: 10694 - protein, 10 aa, Borrelia burgdorferi
GTLEGEKTDK

SEQ ID NO: 10695 - protein, 10 aa, Borrelia burgdorferi
TLEGEKTDKS

SEQ ID NO: 10696 - protein, 10 aa, Borrelia burgdorferi
LEGEKTDKSK

SEQ ID NO: 10697 - protein, 10 aa, Borrelia burgdorferi
EGEKTDKSKV

SEQ ID NO: 10698 - protein, 10 aa, Borrelia burgdorferi
GEKTDKSKVK

SEQ ID NO: 10699 - protein, 10 aa, Borrelia burgdorferi
EKTDKSKVKL

SEQ ID NO: 10700 - protein, 10 aa, Borrelia burgdorferi
KTDKSKVKLT

SEQ ID NO: 10701 - protein, 10 aa, Borrelia burgdorferi
TDKSKVKLTI

SEQ ID NO: 10702 - protein, 10 aa, Borrelia burgdorferi
DKSKVKLTIA

SEQ ID NO: 10703 - protein, 10 aa, Borrelia burgdorferi
KSKVKLTIAD

SEQ ID NO: 10704 - protein, 10 aa, Borrelia burgdorferi
SKVKLTIADD

SEQ ID NO: 10705 - protein, 10 aa, Borrelia burgdorferi
KVKLTIADDL

SEQ ID NO: 10706 - protein, 10 aa, Borrelia burgdorferi
VKLTIADDLS

SEQ ID NO: 10707 - protein, 10 aa, Borrelia burgdorferi
KLTIADDLSQ

SEQ ID NO: 10708 - protein, 10 aa, Borrelia burgdorferi
LTIADDLSQT

SEQ ID NO: 10709 - protein, 10 aa, Borrelia burgdorferi
TIADDLSQTK

SEQ ID NO: 10710 - protein, 10 aa, Borrelia burgdorferi
IADDLSQTKF

SEQ ID NO: 10711 - protein, 10 aa, Borrelia burgdorferi
ADDLSQTKFE

SEQ ID NO: 10712 - protein, 10 aa, Borrelia burgdorferi
DDLSQTKFEI

SEQ ID NO: 10713 - protein, 10 aa, Borrelia burgdorferi
DLSQTKFEIF

SEQ ID NO: 10714 - protein, 10 aa, Borrelia burgdorferi
LSQTKFEIFK

SEQ ID NO: 10715 - protein, 10 aa, Borrelia burgdorferi
SQTKFEIFKE

SEQ ID NO: 10716 - protein, 10 aa, Borrelia burgdorferi
QTKFEIFKED

SEQ ID NO: 10717 - protein, 10 aa, Borrelia burgdorferi
TKFEIFKEDA

SEQ ID NO: 10718 - protein, 10 aa, Borrelia burgdorferi
KFEIFKEDAK

SEQ ID NO: 10719 - protein, 10 aa, Borrelia burgdorferi
FEIFKEDAKT

SEQ ID NO: 10720 - protein, 10 aa, Borrelia burgdorferi
EIFKEDAKTL

SEQ ID NO: 10721 - protein, 10 aa, Borrelia burgdorferi
IFKEDAKTLV

SEQ ID NO: 10722 - protein, 10 aa, Borrelia burgdorferi
FKEDAKTLVS

SEQ ID NO: 10723 - protein, 10 aa, Borrelia burgdorferi
KEDAKTLVSK

SEQ ID NO: 10724 - protein, 10 aa, Borrelia burgdorferi
EDAKTLVSKK

SEQ ID NO: 10725 - protein, 10 aa, Borrelia burgdorferi
DAKTLVSKKV

SEQ ID NO: 10726 - protein, 10 aa, Borrelia burgdorferi
AKTLVSKKVT

SEQ ID NO: 10727 - protein, 10 aa, Borrelia burgdorferi
KTLVSKKVTL

SEQ ID NO: 10728 - protein, 10 aa, Borrelia burgdorferi
TLVSKKVTLK

SEQ ID NO: 10729 - protein, 10 aa, Borrelia burgdorferi
LVSKKVTLKD

SEQ ID NO: 10730 - protein, 10 aa, Borrelia burgdorferi
VSKKVTLKDK

SEQ ID NO: 10731 - protein, 10 aa, Borrelia burgdorferi
SKKVTLKDKS

SEQ ID NO: 10732 - protein, 10 aa, Borrelia burgdorferi
KKVTLKDKSS

SEQ ID NO: 10733 - protein, 10 aa, Borrelia burgdorferi
KVTLKDKSST

SEQ ID NO: 10734 - protein, 10 aa, Borrelia burgdorferi
VTLKDKSSTE

SEQ ID NO: 10735 - protein, 10 aa, Borrelia burgdorferi
TLKDKSSTEE

SEQ ID NO: 10736 - protein, 10 aa, Borrelia burgdorferi
LKDKSSTEEK

SEQ ID NO: 10737 - protein, 10 aa, Borrelia burgdorferi
KDKSSTEEKF

SEQ ID NO: 10738 - protein, 10 aa, Borrelia burgdorferi
DKSSTEEKFN

SEQ ID NO: 10739 - protein, 10 aa, Borrelia burgdorferi
KSSTEEKFNE

SEQ ID NO: 10740 - protein, 10 aa, Borrelia burgdorferi
SSTEEKFNEK

SEQ ID NO: 10741 - protein, 10 aa, Borrelia burgdorferi
STEEKFNEKG

SEQ ID NO: 10742 - protein, 10 aa, Borrelia burgdorferi
TEEKFNEKGE

SEQ ID NO: 10743 - protein, 10 aa, Borrelia burgdorferi
EEKFNEKGET

SEQ ID NO: 10744 - protein, 10 aa, Borrelia burgdorferi
EKFNEKGETS

SEQ ID NO: 10745 - protein, 10 aa, Borrelia burgdorferi
KFNEKGETSE

SEQ ID NO: 10746 - protein, 10 aa, Borrelia burgdorferi
FNEKGETSEK

SEQ ID NO: 10747 - protein, 10 aa, Borrelia burgdorferi
NEKGETSEKT

SEQ ID NO: 10748 - protein, 10 aa, Borrelia burgdorferi
EKGETSEKTI

SEQ ID NO: 10749 - protein, 10 aa, Borrelia burgdorferi
KGETSEKTIV

SEQ ID NO: 10750 - protein, 10 aa, Borrelia burgdorferi
GETSEKTIVR

SEQ ID NO: 10751 - protein, 10 aa, Borrelia burgdorferi
ETSEKTIVRA

SEQ ID NO: 10752 - protein, 10 aa, Borrelia burgdorferi
TSEKTIVRAN

SEQ ID NO: 10753 - protein, 10 aa, Borrelia burgdorferi
SEKTIVRANG

SEQ ID NO: 10754 - protein, 10 aa, Borrelia burgdorferi
EKTIVRANGT

SEQ ID NO: 10755 - protein, 10 aa, Borrelia burgdorferi
KTIVRANGTR

SEQ ID NO: 10756 - protein, 10 aa, Borrelia burgdorferi
TIVRANGTRL

SEQ ID NO: 10757 - protein, 10 aa, Borrelia burgdorferi
IVRANGTRLE

SEQ ID NO: 10758 - protein, 10 aa, Borrelia burgdorferi
VRANGTRLEY

SEQ ID NO: 10759 - protein, 10 aa, Borrelia burgdorferi
RANGTRLEYT

SEQ ID NO: 10760 - protein, 10 aa, Borrelia burgdorferi
ANGTRLEYTD

SEQ ID NO: 10761 - protein, 10 aa, Borrelia burgdorferi
NGTRLEYTDI

SEQ ID NO: 10762 - protein, 10 aa, Borrelia burgdorferi
GTRLEYTDIK

SEQ ID NO: 10763 - protein, 10 aa, Borrelia burgdorferi
TRLEYTDIKS

SEQ ID NO: 10764 - protein, 10 aa, Borrelia burgdorferi
RLEYTDIKSD

SEQ ID NO: 10765 - protein, 10 aa, Borrelia burgdorferi
LEYTDIKSDG

SEQ ID NO: 10766 - protein, 10 aa, Borrelia burgdorferi
EYTDIKSDGS

SEQ ID NO: 10767 - protein, 10 aa, Borrelia burgdorferi
YTDIKSDGSG

SEQ ID NO: 10768 - protein, 10 aa, Borrelia burgdorferi
TDIKSDGSGK

SEQ ID NO: 10769 - protein, 10 aa, Borrelia burgdorferi
DIKSDGSGKA

SEQ ID NO: 10770 - protein, 10 aa, Borrelia burgdorferi
IKSDGSGKAK

SEQ ID NO: 10771 - protein, 10 aa, Borrelia burgdorferi
KSDGSGKAKE

SEQ ID NO: 10772 - protein, 10 aa, Borrelia burgdorferi
SDGSGKAKEV

SEQ ID NO: 10773 - protein, 10 aa, Borrelia burgdorferi
DGSGKAKEVL

SEQ ID NO: 10774 - protein, 10 aa, Borrelia burgdorferi
GSGKAKEVLK

SEQ ID NO: 10775 - protein, 10 aa, Borrelia burgdorferi
SGKAKEVLKD

SEQ ID NO: 10776 - protein, 10 aa, Borrelia burgdorferi
GKAKEVLKDF

SEQ ID NO: 10777 - protein, 10 aa, Borrelia burgdorferi
KAKEVLKDFT

SEQ ID NO: 10778 - protein, 10 aa, Borrelia burgdorferi
AKEVLKDFTL

SEQ ID NO: 10779 - protein, 10 aa, Borrelia burgdorferi
KEVLKDFTLE

SEQ ID NO: 10780 - protein, 10 aa, Borrelia burgdorferi
EVLKDFTLEG

SEQ ID NO: 10781 - protein, 10 aa, Borrelia burgdorferi
VLKDFTLEGT

SEQ ID NO: 10782 - protein, 10 aa, Borrelia burgdorferi
LKDFTLEGTL

SEQ ID NO: 10783 - protein, 10 aa, Borrelia burgdorferi
KDFTLEGTLA

SEQ ID NO: 10784 - protein, 10 aa, Borrelia burgdorferi
DFTLEGTLAA

SEQ ID NO: 10785 - protein, 10 aa, Borrelia burgdorferi
FTLEGTLAAD

SEQ ID NO: 10786 - protein, 10 aa, Borrelia burgdorferi
TLEGTLAADG

SEQ ID NO: 10787 - protein, 10 aa, Borrelia burgdorferi
LEGTLAADGK

SEQ ID NO: 10788 - protein, 10 aa, Borrelia burgdorferi
EGTLAADGKT

SEQ ID NO: 10789 - protein, 10 aa, Borrelia burgdorferi
GTLAADGKTT

SEQ ID NO: 10790 - protein, 10 aa, Borrelia burgdorferi
TLAADGKTTL

SEQ ID NO: 10791 - protein, 10 aa, Borrelia burgdorferi
LAADGKTTLK

SEQ ID NO: 10792 - protein, 10 aa, Borrelia burgdorferi
AADGKTTLKV

SEQ ID NO: 10793 - protein, 10 aa, Borrelia burgdorferi
ADGKTTLKVT

SEQ ID NO: 10794 - protein, 10 aa, Borrelia burgdorferi
DGKTTLKVTE

SEQ ID NO: 10795 - protein, 10 aa, Borrelia burgdorferi
GKTTLKVTEG

SEQ ID NO: 10796 - protein, 10 aa, Borrelia burgdorferi
KTTLKVTEGT

SEQ ID NO: 10797 - protein, 10 aa, Borrelia burgdorferi
TTLKVTEGTV

SEQ ID NO: 10798 - protein, 10 aa, Borrelia burgdorferi
TLKVTEGTVV

SEQ ID NO: 10799 - protein, 10 aa, Borrelia burgdorferi
LKVTEGTVVL

SEQ ID NO: 10800 - protein, 10 aa, Borrelia burgdorferi
KVTEGTVVLS

SEQ ID NO: 10801 - protein, 10 aa, Borrelia burgdorferi
VTEGTVVLSK

SEQ ID NO: 10802 - protein, 10 aa, Borrelia burgdorferi
TEGTVVLSKN

SEQ ID NO: 10803 - protein, 10 aa, Borrelia burgdorferi
EGTVVLSKNI

SEQ ID NO: 10804 - protein, 10 aa, Borrelia burgdorferi
GTVVLSKNIL

SEQ ID NO: 10805 - protein, 10 aa, Borrelia burgdorferi
TVVLSKNILK

SEQ ID NO: 10806 - protein, 10 aa, Borrelia burgdorferi
VVLSKNILKS

SEQ ID NO: 10807 - protein, 10 aa, Borrelia burgdorferi
VLSKNILKSG

SEQ ID NO: 10808 - protein, 10 aa, Borrelia burgdorferi
LSKNILKSGE

SEQ ID NO: 10809 - protein, 10 aa, Borrelia burgdorferi
SKNILKSGEI

SEQ ID NO: 10810 - protein, 10 aa, Borrelia burgdorferi
KNILKSGEIT

SEQ ID NO: 10811 - protein, 10 aa, Borrelia burgdorferi
NILKSGEITV

SEQ ID NO: 10812 - protein, 10 aa, Borrelia burgdorferi
ILKSGEITVA

SEQ ID NO: 10813 - protein, 10 aa, Borrelia burgdorferi
LKSGEITVAL

SEQ ID NO: 10814 - protein, 10 aa, Borrelia burgdorferi
KSGEITVALD

SEQ ID NO: 10815 - protein, 10 aa, Borrelia burgdorferi
SGEITVALDD

SEQ ID NO: 10816 - protein, 10 aa, Borrelia burgdorferi
GEITVALDDS

SEQ ID NO: 10817 - protein, 10 aa, Borrelia burgdorferi
EITVALDDSD

SEQ ID NO: 10818 - protein, 10 aa, Borrelia burgdorferi
ITVALDDSDT

SEQ ID NO: 10819 - protein, 10 aa, Borrelia burgdorferi
TVALDDSDTT

SEQ ID NO: 10820 - protein, 10 aa, Borrelia burgdorferi
VALDDSDTTQ

SEQ ID NO: 10821 - protein, 10 aa, Borrelia burgdorferi
ALDDSDTTQA

SEQ ID NO: 10822 - protein, 10 aa, Borrelia burgdorferi
LDDSDTTQAT

SEQ ID NO: 10823 - protein, 10 aa, Borrelia burgdorferi
DDSDTTQATK

SEQ ID NO: 10824 - protein, 10 aa, Borrelia burgdorferi
DSDTTQATKK

SEQ ID NO: 10825 - protein, 10 aa, Borrelia burgdorferi
SDTTQATKKT

SEQ ID NO: 10826 - protein, 10 aa, Borrelia burgdorferi
DTTQATKKTG

SEQ ID NO: 10827 - protein, 10 aa, Borrelia burgdorferi
TTQATKKTGK

SEQ ID NO: 10828 - protein, 10 aa, Borrelia burgdorferi
TQATKKTGKW

SEQ ID NO: 10829 - protein, 10 aa, Borrelia burgdorferi
QATKKTGKWD

SEQ ID NO: 10830 - protein, 10 aa, Borrelia burgdorferi
ATKKTGKWDS

SEQ ID NO: 10831 - protein, 10 aa, Borrelia burgdorferi
TKKTGKWDSK

SEQ ID NO: 10832 - protein, 10 aa, Borrelia burgdorferi
KKTGKWDSKT

SEQ ID NO: 10833 - protein, 10 aa, Borrelia burgdorferi
KTGKWDSKTS

SEQ ID NO: 10834 - protein, 10 aa, Borrelia burgdorferi
TGKWDSKTST

SEQ ID NO: 10835 - protein, 10 aa, Borrelia burgdorferi
GKWDSKTSTL

SEQ ID NO: 10836 - protein, 10 aa, Borrelia burgdorferi
KWDSKTSTLT

SEQ ID NO: 10837 - protein, 10 aa, Borrelia burgdorferi
WDSKTSTLTI

SEQ ID NO: 10838 - protein, 10 aa, Borrelia burgdorferi
DSKTSTLTIS

SEQ ID NO: 10839 - protein, 10 aa, Borrelia burgdorferi
SKTSTLTISV

SEQ ID NO: 10840 - protein, 10 aa, Borrelia burgdorferi
KTSTLTISVN

SEQ ID NO: 10841 - protein, 10 aa, Borrelia burgdorferi
TSTLTISVNS

SEQ ID NO: 10842 - protein, 10 aa, Borrelia burgdorferi
STLTISVNSQ

SEQ ID NO: 10843 - protein, 10 aa, Borrelia burgdorferi
TLTISVNSQK

SEQ ID NO: 10844 - protein, 10 aa, Borrelia burgdorferi
LTISVNSQKT

SEQ ID NO: 10845 - protein, 10 aa, Borrelia burgdorferi
TISVNSQKTK

SEQ ID NO: 10846 - protein, 10 aa, Borrelia burgdorferi
ISVNSQKTKN

SEQ ID NO: 10847 - protein, 10 aa, Borrelia burgdorferi
SVNSQKTKNL

SEQ ID NO: 10848 - protein, 10 aa, Borrelia burgdorferi
VNSQKTKNLV

SEQ ID NO: 10849 - protein, 10 aa, Borrelia burgdorferi
NSQKTKNLVF

SEQ ID NO: 10850 - protein, 10 aa, Borrelia burgdorferi
SQKTKNLVFT

SEQ ID NO: 10851 - protein, 10 aa, Borrelia burgdorferi
QKTKNLVFTK

SEQ ID NO: 10852 - protein, 10 aa, Borrelia burgdorferi
KTKNLVFTKE

SEQ ID NO: 10853 - protein, 10 aa, Borrelia burgdorferi
TKNLVFTKED

SEQ ID NO: 10854 - protein, 10 aa, Borrelia burgdorferi
KNLVFTKEDT

SEQ ID NO: 10855 - protein, 10 aa, Borrelia burgdorferi
NLVFTKEDTI

SEQ ID NO: 10856 - protein, 10 aa, Borrelia burgdorferi
LVFTKEDTIT

SEQ ID NO: 10857 - protein, 10 aa, Borrelia burgdorferi
VFTKEDTITV

SEQ ID NO: 10858 - protein, 10 aa, Borrelia burgdorferi
FTKEDTITVQ

SEQ ID NO: 10859 - protein, 10 aa, Borrelia burgdorferi
TKEDTITVQK

SEQ ID NO: 10860 - protein, 10 aa, Borrelia burgdorferi
KEDTITVQKY

SEQ ID NO: 10861 - protein, 10 aa, Borrelia burgdorferi
EDTITVQKYD

SEQ ID NO: 10862 - protein, 10 aa, Borrelia burgdorferi
DTITVQKYDS

SEQ ID NO: 10863 - protein, 10 aa, Borrelia burgdorferi
TITVQKYDSA

SEQ ID NO: 10864 - protein, 10 aa, Borrelia burgdorferi
ITVQKYDSAG

SEQ ID NO: 10865 - protein, 10 aa, Borrelia burgdorferi
TVQKYDSAGT

SEQ ID NO: 10866 - protein, 10 aa, Borrelia burgdorferi
VQKYDSAGTN

SEQ ID NO: 10867 - protein, 10 aa, Borrelia burgdorferi
QKYDSAGTNL

SEQ ID NO: 10868 - protein, 10 aa, Borrelia burgdorferi
KYDSAGTNLE

SEQ ID NO: 10869 - protein, 10 aa, Borrelia burgdorferi
YDSAGTNLEG

SEQ ID NO: 10870 - protein, 10 aa, Borrelia burgdorferi
DSAGTNLEGK

SEQ ID NO: 10871 - protein, 10 aa, Borrelia burgdorferi
SAGTNLEGKA

SEQ ID NO: 10872 - protein, 10 aa, Borrelia burgdorferi
AGTNLEGKAV

SEQ ID NO: 10873 - protein, 10 aa, Borrelia burgdorferi
GTNLEGKAVE

SEQ ID NO: 10874 - protein, 10 aa, Borrelia burgdorferi
TNLEGKAVEI

SEQ ID NO: 10875 - protein, 10 aa, Borrelia burgdorferi
NLEGKAVEIT

SEQ ID NO: 10876 - protein, 10 aa, Borrelia burgdorferi
LEGKAVEITT

SEQ ID NO: 10877 - protein, 10 aa, Borrelia burgdorferi
EGKAVEITTL

SEQ ID NO: 10878 - protein, 10 aa, Borrelia burgdorferi
GKAVEITTLK

SEQ ID NO: 10879 - protein, 10 aa, Borrelia burgdorferi
KAVEITTLKE

SEQ ID NO: 10880 - protein, 10 aa, Borrelia burgdorferi
AVEITTLKEL

SEQ ID NO: 10881 - protein, 10 aa, Borrelia burgdorferi
VEITTLKELK

SEQ ID NO: 10882 - protein, 10 aa, Borrelia burgdorferi
EITTLKELKN

SEQ ID NO: 10883 - protein, 10 aa, Borrelia burgdorferi
ITTLKELKNA

SEQ ID NO: 10884 - protein, 10 aa, Borrelia burgdorferi
TTLKELKNAL

SEQ ID NO: 10885 - protein, 10 aa, Borrelia burgdorferi
TLKELKNALK

SEQ ID NO: 10886 - protein, 11 aa, Borrelia burgdorferi
MKKYLLGIGLI

SEQ ID NO: 10887 - protein, 11 aa, Borrelia burgdorferi
KKYLLGIGLIL

SEQ ID NO: 10888 - protein, 11 aa, Borrelia burgdorferi
KYLLGIGLILA

SEQ ID NO: 10889 - protein, 11 aa, Borrelia burgdorferi
YLLGIGLILAL

SEQ ID NO: 10890 - protein, 11 aa, Borrelia burgdorferi
LLGIGLILALI

SEQ ID NO: 10891 - protein, 11 aa, Borrelia burgdorferi
LGIGLILALIA

SEQ ID NO: 10892 - protein, 11 aa, Borrelia burgdorferi
GIGLILALIAC

SEQ ID NO: 10893 - protein, 11 aa, Borrelia burgdorferi
IGLILALIACK

SEQ ID NO: 10894 - protein, 11 aa, Borrelia burgdorferi
GLILALIACKQ

SEQ ID NO: 10895 - protein, 11 aa, Borrelia burgdorferi
LILALIACKQN

SEQ ID NO: 10896 - protein, 11 aa, Borrelia burgdorferi
ILALIACKQNV

SEQ ID NO: 10897 - protein, 11 aa, Borrelia burgdorferi
LALIACKQNVS

SEQ ID NO: 10898 - protein, 11 aa, Borrelia burgdorferi
ALIACKQNVST

SEQ ID NO: 10899 - protein, 11 aa, Borrelia burgdorferi
LIACKQNVSTL

SEQ ID NO: 10900 - protein, 11 aa, Borrelia burgdorferi
IACKQNVSTLD

SEQ ID NO: 10901 - protein, 11 aa, Borrelia burgdorferi
ACKQNVSTLDE

SEQ ID NO: 10902 - protein, 11 aa, Borrelia burgdorferi
CKQNVSTLDEK

SEQ ID NO: 10903 - protein, 11 aa, Borrelia burgdorferi
KQNVSTLDEKN

SEQ ID NO: 10904 - protein, 11 aa, Borrelia burgdorferi
QNVSTLDEKNS

SEQ ID NO: 10905 - protein, 11 aa, Borrelia burgdorferi
NVSTLDEKNSV

SEQ ID NO: 10906 - protein, 11 aa, Borrelia burgdorferi
VSTLDEKNSVS

SEQ ID NO: 10907 - protein, 11 aa, Borrelia burgdorferi
STLDEKNSVSV

SEQ ID NO: 10908 - protein, 11 aa, Borrelia burgdorferi
TLDEKNSVSVD

SEQ ID NO: 10909 - protein, 11 aa, Borrelia burgdorferi
LDEKNSVSVDL

SEQ ID NO: 10910 - protein, 11 aa, Borrelia burgdorferi
DEKNSVSVDLP

SEQ ID NO: 10911 - protein, 11 aa, Borrelia burgdorferi
EKNSVSVDLPG

SEQ ID NO: 10912 - protein, 11 aa, Borrelia burgdorferi
KNSVSVDLPGG

SEQ ID NO: 10913 - protein, 11 aa, Borrelia burgdorferi
NSVSVDLPGGM

SEQ ID NO: 10914 - protein, 11 aa, Borrelia burgdorferi
SVSVDLPGGMT

SEQ ID NO: 10915 - protein, 11 aa, Borrelia burgdorferi
VSVDLPGGMTE

SEQ ID NO: 10916 - protein, 11 aa, Borrelia burgdorferi
SVDLPGGMTEL

SEQ ID NO: 10917 - protein, 11 aa, Borrelia burgdorferi
VDLPGGMTELV

SEQ ID NO: 10918 - protein, 11 aa, Borrelia burgdorferi
DLPGGMTELVS

SEQ ID NO: 10919 - protein, 11 aa, Borrelia burgdorferi
LPGGMTELVSK

SEQ ID NO: 10920 - protein, 11 aa, Borrelia burgdorferi
PGGMTELVSKE

SEQ ID NO: 10921 - protein, 11 aa, Borrelia burgdorferi
GGMTELVSKEK

SEQ ID NO: 10922 - protein, 11 aa, Borrelia burgdorferi
GMTELVSKEKD

SEQ ID NO: 10923 - protein, 11 aa, Borrelia burgdorferi
MTELVSKEKDK

SEQ ID NO: 10924 - protein, 11 aa, Borrelia burgdorferi
TELVSKEKDKD

SEQ ID NO: 10925 - protein, 11 aa, Borrelia burgdorferi
ELVSKEKDKDG

SEQ ID NO: 10926 - protein, 11 aa, Borrelia burgdorferi
LVSKEKDKDGK

SEQ ID NO: 10927 - protein, 11 aa, Borrelia burgdorferi
VSKEKDKDGKY

SEQ ID NO: 10928 - protein, 11 aa, Borrelia burgdorferi
SKEKDKDGKYS

SEQ ID NO: 10929 - protein, 11 aa, Borrelia burgdorferi
KEKDKDGKYSL

SEQ ID NO: 10930 - protein, 11 aa, Borrelia burgdorferi
EKDKDGKYSLE

SEQ ID NO: 10931 - protein, 11 aa, Borrelia burgdorferi
KDKDGKYSLEA

SEQ ID NO: 10932 - protein, 11 aa, Borrelia burgdorferi
DKDGKYSLEAT

SEQ ID NO: 10933 - protein, 11 aa, Borrelia burgdorferi
KDGKYSLEATV

SEQ ID NO: 10934 - protein, 11 aa, Borrelia burgdorferi
DGKYSLEATVD

SEQ ID NO: 10935 - protein, 11 aa, Borrelia burgdorferi
GKYSLEATVDK

SEQ ID NO: 10936 - protein, 11 aa, Borrelia burgdorferi
KYSLEATVDKL

SEQ ID NO: 10937 - protein, 11 aa, Borrelia burgdorferi
YSLEATVDKLE

SEQ ID NO: 10938 - protein, 11 aa, Borrelia burgdorferi
SLEATVDKLEL

SEQ ID NO: 10939 - protein, 11 aa, Borrelia burgdorferi
LEATVDKLELK

SEQ ID NO: 10940 - protein, 11 aa, Borrelia burgdorferi
EATVDKLELKG

SEQ ID NO: 10941 - protein, 11 aa, Borrelia burgdorferi
ATVDKLELKGT

SEQ ID NO: 10942 - protein, 11 aa, Borrelia burgdorferi
TVDKLELKGTS

SEQ ID NO: 10943 - protein, 11 aa, Borrelia burgdorferi
VDKLELKGTSD

SEQ ID NO: 10944 - protein, 11 aa, Borrelia burgdorferi
DKLELKGTSDK

SEQ ID NO: 10945 - protein, 11 aa, Borrelia burgdorferi
KLELKGTSDKN

SEQ ID NO: 10946 - protein, 11 aa, Borrelia burgdorferi
LELKGTSDKNN

SEQ ID NO: 10947 - protein, 11 aa, Borrelia burgdorferi
ELKGTSDKNNG

SEQ ID NO: 10948 - protein, 11 aa, Borrelia burgdorferi
LKGTSDKNNGS

SEQ ID NO: 10949 - protein, 11 aa, Borrelia burgdorferi
KGTSDKNNGSG

SEQ ID NO: 10950 - protein, 11 aa, Borrelia burgdorferi
GTSDKNNGSGT

SEQ ID NO: 10951 - protein, 11 aa, Borrelia burgdorferi
TSDKNNGSGTL

SEQ ID NO: 10952 - protein, 11 aa, Borrelia burgdorferi
SDKNNGSGTLE

SEQ ID NO: 10953 - protein, 11 aa, Borrelia burgdorferi
DKNNGSGTLEG

SEQ ID NO: 10954 - protein, 11 aa, Borrelia burgdorferi
KNNGSGTLEGE

SEQ ID NO: 10955 - protein, 11 aa, Borrelia burgdorferi
NNGSGTLEGEK

SEQ ID NO: 10956 - protein, 11 aa, Borrelia burgdorferi
NGSGTLEGEKT

SEQ ID NO: 10957 - protein, 11 aa, Borrelia burgdorferi
GSGTLEGEKTD

SEQ ID NO: 10958 - protein, 11 aa, Borrelia burgdorferi
SGTLEGEKTDK

SEQ ID NO: 10959 - protein, 11 aa, Borrelia burgdorferi
GTLEGEKTDKS

SEQ ID NO: 10960 - protein, 11 aa, Borrelia burgdorferi
TLEGEKTDKSK

SEQ ID NO: 10961 - protein, 11 aa, Borrelia burgdorferi
LEGEKTDKSKV

SEQ ID NO: 10962 - protein, 11 aa, Borrelia burgdorferi
EGEKTDKSKVK

SEQ ID NO: 10963 - protein, 11 aa, Borrelia burgdorferi
GEKTDKSKVKL

SEQ ID NO: 10964 - protein, 11 aa, Borrelia burgdorferi
EKTDKSKVKLT

SEQ ID NO: 10965 - protein, 11 aa, Borrelia burgdorferi
KTDKSKVKLTI

SEQ ID NO: 10966 - protein, 11 aa, Borrelia burgdorferi
TDKSKVKLTIA

SEQ ID NO: 10967 - protein, 11 aa, Borrelia burgdorferi
DKSKVKLTIAD

SEQ ID NO: 10968 - protein, 11 aa, Borrelia burgdorferi
KSKVKLTIADD

SEQ ID NO: 10969 - protein, 11 aa, Borrelia burgdorferi
SKVKLTIADDL

SEQ ID NO: 10970 - protein, 11 aa, Borrelia burgdorferi
KVKLTIADDLS

SEQ ID NO: 10971 - protein, 11 aa, Borrelia burgdorferi
VKLTIADDLSQ

SEQ ID NO: 10972 - protein, 11 aa, Borrelia burgdorferi
KLTIADDLSQT

SEQ ID NO: 10973 - protein, 11 aa, Borrelia burgdorferi
LTIADDLSQTK

SEQ ID NO: 10974 - protein, 11 aa, Borrelia burgdorferi
TIADDLSQTKF

SEQ ID NO: 10975 - protein, 11 aa, Borrelia burgdorferi
IADDLSQTKFE

SEQ ID NO: 10976 - protein, 11 aa, Borrelia burgdorferi
ADDLSQTKFEI

SEQ ID NO: 10977 - protein, 11 aa, Borrelia burgdorferi
DDLSQTKFEIF

SEQ ID NO: 10978 - protein, 11 aa, Borrelia burgdorferi
DLSQTKFEIFK

SEQ ID NO: 10979 - protein, 11 aa, Borrelia burgdorferi
LSQTKFEIFKE

SEQ ID NO: 10980 - protein, 11 aa, Borrelia burgdorferi
SQTKFEIFKED

SEQ ID NO: 10981 - protein, 11 aa, Borrelia burgdorferi
QTKFEIFKEDA

SEQ ID NO: 10982 - protein, 11 aa, Borrelia burgdorferi
TKFEIFKEDAK

SEQ ID NO: 10983 - protein, 11 aa, Borrelia burgdorferi
KFEIFKEDAKT

SEQ ID NO: 10984 - protein, 11 aa, Borrelia burgdorferi
FEIFKEDAKTL

SEQ ID NO: 10985 - protein, 11 aa, Borrelia burgdorferi
EIFKEDAKTLV

SEQ ID NO: 10986 - protein, 11 aa, Borrelia burgdorferi
IFKEDAKTLVS

SEQ ID NO: 10987 - protein, 11 aa, Borrelia burgdorferi
FKEDAKTLVSK

SEQ ID NO: 10988 - protein, 11 aa, Borrelia burgdorferi
KEDAKTLVSKK

SEQ ID NO: 10989 - protein, 11 aa, Borrelia burgdorferi
EDAKTLVSKKV

SEQ ID NO: 10990 - protein, 11 aa, Borrelia burgdorferi
DAKTLVSKKVT

SEQ ID NO: 10991 - protein, 11 aa, Borrelia burgdorferi
AKTLVSKKVTL

SEQ ID NO: 10992 - protein, 11 aa, Borrelia burgdorferi
KTLVSKKVTLK

SEQ ID NO: 10993 - protein, 11 aa, Borrelia burgdorferi
TLVSKKVTLKD

SEQ ID NO: 10994 - protein, 11 aa, Borrelia burgdorferi
LVSKKVTLKDK

SEQ ID NO: 10995 - protein, 11 aa, Borrelia burgdorferi
VSKKVTLKDKS

SEQ ID NO: 10996 - protein, 11 aa, Borrelia burgdorferi
SKKVTLKDKSS

SEQ ID NO: 10997 - protein, 11 aa, Borrelia burgdorferi
KKVTLKDKSST

SEQ ID NO: 10998 - protein, 11 aa, Borrelia burgdorferi
KVTLKDKSSTE

SEQ ID NO: 10999 - protein, 11 aa, Borrelia burgdorferi
VTLKDKSSTEE

SEQ ID NO: 11000 - protein, 11 aa, Borrelia burgdorferi
TLKDKSSTEEK

SEQ ID NO: 11001 - protein, 11 aa, Borrelia burgdorferi
LKDKSSTEEKF

SEQ ID NO: 11002 - protein, 11 aa, Borrelia burgdorferi
KDKSSTEEKFN

SEQ ID NO: 11003 - protein, 11 aa, Borrelia burgdorferi
DKSSTEEKFNE

SEQ ID NO: 11004 - protein, 11 aa, Borrelia burgdorferi
KSSTEEKFNEK

SEQ ID NO: 11005 - protein, 11 aa, Borrelia burgdorferi
SSTEEKFNEKG

SEQ ID NO: 11006 - protein, 11 aa, Borrelia burgdorferi
STEEKFNEKGE

SEQ ID NO: 11007 - protein, 11 aa, Borrelia burgdorferi
TEEKFNEKGET

SEQ ID NO: 11008 - protein, 11 aa, Borrelia burgdorferi
EEKFNEKGETS

SEQ ID NO: 11009 - protein, 11 aa, Borrelia burgdorferi
EKFNEKGETSE

SEQ ID NO: 11010 - protein, 11 aa, Borrelia burgdorferi
KFNEKGETSEK

SEQ ID NO: 11011 - protein, 11 aa, Borrelia burgdorferi
FNEKGETSEKT

SEQ ID NO: 11012 - protein, 11 aa, Borrelia burgdorferi
NEKGETSEKTI

SEQ ID NO: 11013 - protein, 11 aa, Borrelia burgdorferi
EKGETSEKTIV

SEQ ID NO: 11014 - protein, 11 aa, Borrelia burgdorferi
KGETSEKTIVR

SEQ ID NO: 11015 - protein, 11 aa, Borrelia burgdorferi
GETSEKTIVRA

SEQ ID NO: 11016 - protein, 11 aa, Borrelia burgdorferi
ETSEKTIVRAN

SEQ ID NO: 11017 - protein, 11 aa, Borrelia burgdorferi
TSEKTIVRANG

SEQ ID NO: 11018 - protein, 11 aa, Borrelia burgdorferi
SEKTIVRANGT

SEQ ID NO: 11019 - protein, 11 aa, Borrelia burgdorferi
EKTIVRANGTR

SEQ ID NO: 11020 - protein, 11 aa, Borrelia burgdorferi
KTIVRANGTRL

SEQ ID NO: 11021 - protein, 11 aa, Borrelia burgdorferi
TIVRANGTRLE

SEQ ID NO: 11022 - protein, 11 aa, Borrelia burgdorferi
IVRANGTRLEY

SEQ ID NO: 11023 - protein, 11 aa, Borrelia burgdorferi
VRANGTRLEYT

SEQ ID NO: 11024 - protein, 11 aa, Borrelia burgdorferi
RANGTRLEYTD

SEQ ID NO: 11025 - protein, 11 aa, Borrelia burgdorferi
ANGTRLEYTDI

SEQ ID NO: 11026 - protein, 11 aa, Borrelia burgdorferi
NGTRLEYTDIK

SEQ ID NO: 11027 - protein, 11 aa, Borrelia burgdorferi
GTRLEYTDIKS

SEQ ID NO: 11028 - protein, 11 aa, Borrelia burgdorferi
TRLEYTDIKSD

SEQ ID NO: 11029 - protein, 11 aa, Borrelia burgdorferi
RLEYTDIKSDG

SEQ ID NO: 11030 - protein, 11 aa, Borrelia burgdorferi
LEYTDIKSDGS

SEQ ID NO: 11031 - protein, 11 aa, Borrelia burgdorferi
EYTDIKSDGSG

SEQ ID NO: 11032 - protein, 11 aa, Borrelia burgdorferi
YTDIKSDGSGK

SEQ ID NO: 11033 - protein, 11 aa, Borrelia burgdorferi
TDIKSDGSGKA

SEQ ID NO: 11034 - protein, 11 aa, Borrelia burgdorferi
DIKSDGSGKAK

SEQ ID NO: 11035 - protein, 11 aa, Borrelia burgdorferi
IKSDGSGKAKE

SEQ ID NO: 11036 - protein, 11 aa, Borrelia burgdorferi
KSDGSGKAKEV

SEQ ID NO: 11037 - protein, 11 aa, Borrelia burgdorferi
SDGSGKAKEVL

SEQ ID NO: 11038 - protein, 11 aa, Borrelia burgdorferi
DGSGKAKEVLK

SEQ ID NO: 11039 - protein, 11 aa, Borrelia burgdorferi
GSGKAKEVLKD

SEQ ID NO: 11040 - protein, 11 aa, Borrelia burgdorferi
SGKAKEVLKDF

SEQ ID NO: 11041 - protein, 11 aa, Borrelia burgdorferi
GKAKEVLKDFT

SEQ ID NO: 11042 - protein, 11 aa, Borrelia burgdorferi
KAKEVLKDFTL

SEQ ID NO: 11043 - protein, 11 aa, Borrelia burgdorferi
AKEVLKDFTLE

SEQ ID NO: 11044 - protein, 11 aa, Borrelia burgdorferi
KEVLKDFTLEG

SEQ ID NO: 11045 - protein, 11 aa, Borrelia burgdorferi
EVLKDFTLEGT

SEQ ID NO: 11046 - protein, 11 aa, Borrelia burgdorferi
VLKDFTLEGTL

SEQ ID NO: 11047 - protein, 11 aa, Borrelia burgdorferi
LKDFTLEGTLA

SEQ ID NO: 11048 - protein, 11 aa, Borrelia burgdorferi
KDFTLEGTLAA

SEQ ID NO: 11049 - protein, 11 aa, Borrelia burgdorferi
DFTLEGTLAAD

SEQ ID NO: 11050 - protein, 11 aa, Borrelia burgdorferi
FTLEGTLAADG

SEQ ID NO: 11051 - protein, 11 aa, Borrelia burgdorferi
TLEGTLAADGK

SEQ ID NO: 11052 - protein, 11 aa, Borrelia burgdorferi
LEGTLAADGKT

SEQ ID NO: 11053 - protein, 11 aa, Borrelia burgdorferi
EGTLAADGKTT

SEQ ID NO: 11054 - protein, 11 aa, Borrelia burgdorferi
GTLAADGKTTL

SEQ ID NO: 11055 - protein, 11 aa, Borrelia burgdorferi
TLAADGKTTLK

SEQ ID NO: 11056 - protein, 11 aa, Borrelia burgdorferi
LAADGKTTLKV

SEQ ID NO: 11057 - protein, 11 aa, Borrelia burgdorferi
AADGKTTLKVT

SEQ ID NO: 11058 - protein, 11 aa, Borrelia burgdorferi
ADGKTTLKVTE

SEQ ID NO: 11059 - protein, 11 aa, Borrelia burgdorferi
DGKTTLKVTEG

SEQ ID NO: 11060 - protein, 11 aa, Borrelia burgdorferi
GKTTLKVTEGT

SEQ ID NO: 11061 - protein, 11 aa, Borrelia burgdorferi
KTTLKVTEGTV

SEQ ID NO: 11062 - protein, 11 aa, Borrelia burgdorferi
TTLKVTEGTVV

SEQ ID NO: 11063 - protein, 11 aa, Borrelia burgdorferi
TLKVTEGTVVL

SEQ ID NO: 11064 - protein, 11 aa, Borrelia burgdorferi
LKVTEGTVVLS

SEQ ID NO: 11065 - protein, 11 aa, Borrelia burgdorferi
KVTEGTVVLSK

SEQ ID NO: 11066 - protein, 11 aa, Borrelia burgdorferi
VTEGTVVLSKN

SEQ ID NO: 11067 - protein, 11 aa, Borrelia burgdorferi
TEGTVVLSKNI

SEQ ID NO: 11068 - protein, 11 aa, Borrelia burgdorferi
EGTVVLSKNIL

SEQ ID NO: 11069 - protein, 11 aa, Borrelia burgdorferi
GTVVLSKNILK

SEQ ID NO: 11070 - protein, 11 aa, Borrelia burgdorferi
TVVLSKNILKS

SEQ ID NO: 11071 - protein, 11 aa, Borrelia burgdorferi
VVLSKNILKSG

SEQ ID NO: 11072 - protein, 11 aa, Borrelia burgdorferi
VLSKNILKSGE

SEQ ID NO: 11073 - protein, 11 aa, Borrelia burgdorferi
LSKNILKSGEI

SEQ ID NO: 11074 - protein, 11 aa, Borrelia burgdorferi
SKNILKSGEIT

SEQ ID NO: 11075 - protein, 11 aa, Borrelia burgdorferi
KNILKSGEITV

SEQ ID NO: 11076 - protein, 11 aa, Borrelia burgdorferi
NILKSGEITVA

SEQ ID NO: 11077 - protein, 11 aa, Borrelia burgdorferi
ILKSGEITVAL

SEQ ID NO: 11078 - protein, 11 aa, Borrelia burgdorferi
LKSGEITVALD

SEQ ID NO: 11079 - protein, 11 aa, Borrelia burgdorferi
KSGEITVALDD

SEQ ID NO: 11080 - protein, 11 aa, Borrelia burgdorferi
SGEITVALDDS

SEQ ID NO: 11081 - protein, 11 aa, Borrelia burgdorferi
GEITVALDDSD

SEQ ID NO: 11082 - protein, 11 aa, Borrelia burgdorferi
EITVALDDSDT

SEQ ID NO: 11083 - protein, 11 aa, Borrelia burgdorferi
ITVALDDSDTT

SEQ ID NO: 11084 - protein, 11 aa, Borrelia burgdorferi
TVALDDSDTTQ

SEQ ID NO: 11085 - protein, 11 aa, Borrelia burgdorferi
VALDDSDTTQA

SEQ ID NO: 11086 - protein, 11 aa, Borrelia burgdorferi
ALDDSDTTQAT

SEQ ID NO: 11087 - protein, 11 aa, Borrelia burgdorferi
LDDSDTTQATK

SEQ ID NO: 11088 - protein, 11 aa, Borrelia burgdorferi
DDSDTTQATKK

SEQ ID NO: 11089 - protein, 11 aa, Borrelia burgdorferi
DSDTTQATKKT

SEQ ID NO: 11090 - protein, 11 aa, Borrelia burgdorferi
SDTTQATKKTG

SEQ ID NO: 11091 - protein, 11 aa, Borrelia burgdorferi
DTTQATKKTGK

SEQ ID NO: 11092 - protein, 11 aa, Borrelia burgdorferi
TTQATKKTGKW

SEQ ID NO: 11093 - protein, 11 aa, Borrelia burgdorferi
TQATKKTGKWD

SEQ ID NO: 11094 - protein, 11 aa, Borrelia burgdorferi
QATKKTGKWDS

SEQ ID NO: 11095 - protein, 11 aa, Borrelia burgdorferi
ATKKTGKWDSK

SEQ ID NO: 11096 - protein, 11 aa, Borrelia burgdorferi
TKKTGKWDSKT

SEQ ID NO: 11097 - protein, 11 aa, Borrelia burgdorferi
KKTGKWDSKTS

SEQ ID NO: 11098 - protein, 11 aa, Borrelia burgdorferi
KTGKWDSKTST

SEQ ID NO: 11099 - protein, 11 aa, Borrelia burgdorferi
TGKWDSKTSTL

SEQ ID NO: 11100 - protein, 11 aa, Borrelia burgdorferi
GKWDSKTSTLT

SEQ ID NO: 11101 - protein, 11 aa, Borrelia burgdorferi
KWDSKTSTLTI

SEQ ID NO: 11102 - protein, 11 aa, Borrelia burgdorferi
WDSKTSTLTIS

SEQ ID NO: 11103 - protein, 11 aa, Borrelia burgdorferi
DSKTSTLTISV

SEQ ID NO: 11104 - protein, 11 aa, Borrelia burgdorferi
SKTSTLTISVN

SEQ ID NO: 11105 - protein, 11 aa, Borrelia burgdorferi
KTSTLTISVNS

SEQ ID NO: 11106 - protein, 11 aa, Borrelia burgdorferi
TSTLTISVNSQ

SEQ ID NO: 11107 - protein, 11 aa, Borrelia burgdorferi
STLTISVNSQK

SEQ ID NO: 11108 - protein, 11 aa, Borrelia burgdorferi
TLTISVNSQKT

SEQ ID NO: 11109 - protein, 11 aa, Borrelia burgdorferi
LTISVNSQKTK

SEQ ID NO: 11110 - protein, 11 aa, Borrelia burgdorferi
TISVNSQKTKN

SEQ ID NO: 11111 - protein, 11 aa, Borrelia burgdorferi
ISVNSQKTKNL

SEQ ID NO: 11112 - protein, 11 aa, Borrelia burgdorferi
SVNSQKTKNLV

SEQ ID NO: 11113 - protein, 11 aa, Borrelia burgdorferi
VNSQKTKNLVF

SEQ ID NO: 11114 - protein, 11 aa, Borrelia burgdorferi
NSQKTKNLVFT

SEQ ID NO: 11115 - protein, 11 aa, Borrelia burgdorferi
SQKTKNLVFTK

SEQ ID NO: 11116 - protein, 11 aa, Borrelia burgdorferi
QKTKNLVFTKE

SEQ ID NO: 11117 - protein, 11 aa, Borrelia burgdorferi
KTKNLVFTKED

SEQ ID NO: 11118 - protein, 11 aa, Borrelia burgdorferi
TKNLVFTKEDT

SEQ ID NO: 11119 - protein, 11 aa, Borrelia burgdorferi
KNLVFTKEDTI

SEQ ID NO: 11120 - protein, 11 aa, Borrelia burgdorferi
NLVFTKEDTIT

SEQ ID NO: 11121 - protein, 11 aa, Borrelia burgdorferi
LVFTKEDTITV

SEQ ID NO: 11122 - protein, 11 aa, Borrelia burgdorferi
VFTKEDTITVQ

SEQ ID NO: 11123 - protein, 11 aa, Borrelia burgdorferi
FTKEDTITVQK

SEQ ID NO: 11124 - protein, 11 aa, Borrelia burgdorferi
TKEDTITVQKY

SEQ ID NO: 11125 - protein, 11 aa, Borrelia burgdorferi
KEDTITVQKYD

SEQ ID NO: 11126 - protein, 11 aa, Borrelia burgdorferi
EDTITVQKYDS

SEQ ID NO: 11127 - protein, 11 aa, Borrelia burgdorferi
DTITVQKYDSA

SEQ ID NO: 11128 - protein, 11 aa, Borrelia burgdorferi
TITVQKYDSAG

SEQ ID NO: 11129 - protein, 11 aa, Borrelia burgdorferi
ITVQKYDSAGT

SEQ ID NO: 11130 - protein, 11 aa, Borrelia burgdorferi
TVQKYDSAGTN

SEQ ID NO: 11131 - protein, 11 aa, Borrelia burgdorferi
VQKYDSAGTNL

SEQ ID NO: 11132 - protein, 11 aa, Borrelia burgdorferi
QKYDSAGTNLE

SEQ ID NO: 11133 - protein, 11 aa, Borrelia burgdorferi
KYDSAGTNLEG

SEQ ID NO: 11134 - protein, 11 aa, Borrelia burgdorferi
YDSAGTNLEGK

SEQ ID NO: 11135 - protein, 11 aa, Borrelia burgdorferi
DSAGTNLEGKA

SEQ ID NO: 11136 - protein, 11 aa, Borrelia burgdorferi
SAGTNLEGKAV

SEQ ID NO: 11137 - protein, 11 aa, Borrelia burgdorferi
AGTNLEGKAVE

SEQ ID NO: 11138 - protein, 11 aa, Borrelia burgdorferi
GTNLEGKAVEI

SEQ ID NO: 11139 - protein, 11 aa, Borrelia burgdorferi
TNLEGKAVEIT

SEQ ID NO: 11140 - protein, 11 aa, Borrelia burgdorferi
NLEGKAVEITT

SEQ ID NO: 11141 - protein, 11 aa, Borrelia burgdorferi
LEGKAVEITTL

SEQ ID NO: 11142 - protein, 11 aa, Borrelia burgdorferi
EGKAVEITTLK

SEQ ID NO: 11143 - protein, 11 aa, Borrelia burgdorferi
GKAVEITTLKE

SEQ ID NO: 11144 - protein, 11 aa, Borrelia burgdorferi
KAVEITTLKEL

SEQ ID NO: 11145 - protein, 11 aa, Borrelia burgdorferi
AVEITTLKELK

SEQ ID NO: 11146 - protein, 11 aa, Borrelia burgdorferi
VEITTLKELKN

SEQ ID NO: 11147 - protein, 11 aa, Borrelia burgdorferi
EITTLKELKNA

SEQ ID NO: 11148 - protein, 11 aa, Borrelia burgdorferi
ITTLKELKNAL

SEQ ID NO: 11149 - protein, 11 aa, Borrelia burgdorferi
TTLKELKNALK

SEQ ID NO: 11150 - protein, 8 aa, Borrelia garinii
MKKYLLGF

SEQ ID NO: 11151 - protein, 8 aa, Borrelia garinii
KKYLLGFA

SEQ ID NO: 11152 - protein, 8 aa, Borrelia garinii
KYLLGFAL

SEQ ID NO: 11153 - protein, 8 aa, Borrelia garinii
YLLGFALV

SEQ ID NO: 11154 - protein, 8 aa, Borrelia garinii
LLGFALVL

SEQ ID NO: 11155 - protein, 8 aa, Borrelia garinii
LGFALVLA

SEQ ID NO: 11156 - protein, 8 aa, Borrelia garinii
GFALVLAL

SEQ ID NO: 11157 - protein, 8 aa, Borrelia garinii
FALVLALI

SEQ ID NO: 11158 - protein, 8 aa, Borrelia garinii
ALVLALIA

SEQ ID NO: 11159 - protein, 8 aa, Borrelia garinii
LVLALIAC

SEQ ID NO: 11160 - protein, 8 aa, Borrelia garinii
VLALIACG

SEQ ID NO: 11161 - protein, 8 aa, Borrelia garinii
LALIACGQ

SEQ ID NO: 11162 - protein, 8 aa, Borrelia garinii
ALIACGQK

SEQ ID NO: 11163 - protein, 8 aa, Borrelia garinii
LIACGQKG

SEQ ID NO: 11164 - protein, 8 aa, Borrelia garinii
IACGQKGA

SEQ ID NO: 11165 - protein, 8 aa, Borrelia garinii
ACGQKGAE

SEQ ID NO: 11166 - protein, 8 aa, Borrelia garinii
CGQKGAEP

SEQ ID NO: 11167 - protein, 8 aa, Borrelia garinii
GQKGAEPK

SEQ ID NO: 11168 - protein, 8 aa, Borrelia garinii
QKGAEPKH

SEQ ID NO: 11169 - protein, 8 aa, Borrelia garinii
KGAEPKHN

SEQ ID NO: 11170 - protein, 8 aa, Borrelia garinii
GAEPKHND

SEQ ID NO: 11171 - protein, 8 aa, Borrelia garinii
AEPKHNDQ

SEQ ID NO: 11172 - protein, 8 aa, Borrelia garinii
EPKHNDQE

SEQ ID NO: 11173 - protein, 8 aa, Borrelia garinii
PKHNDQEV

SEQ ID NO: 11174 - protein, 8 aa, Borrelia garinii
KHNDQEVE

SEQ ID NO: 11175 - protein, 8 aa, Borrelia garinii
HNDQEVED

SEQ ID NO: 11176 - protein, 8 aa, Borrelia garinii
NDQEVEDS

SEQ ID NO: 11177 - protein, 8 aa, Borrelia garinii
DQEVEDSK

SEQ ID NO: 11178 - protein, 8 aa, Borrelia garinii
QEVEDSKK

SEQ ID NO: 11179 - protein, 8 aa, Borrelia garinii
EVEDSKKD

SEQ ID NO: 11180 - protein, 8 aa, Borrelia garinii
VEDSKKDQ

SEQ ID NO: 11181 - protein, 8 aa, Borrelia garinii
EDSKKDQK

SEQ ID NO: 11182 - protein, 8 aa, Borrelia garinii
DSKKDQKD

SEQ ID NO: 11183 - protein, 8 aa, Borrelia garinii
SKKDQKDA

SEQ ID NO: 11184 - protein, 8 aa, Borrelia garinii
KKDQKDAS

SEQ ID NO: 11185 - protein, 8 aa, Borrelia garinii
KDQKDASK

SEQ ID NO: 11186 - protein, 8 aa, Borrelia garinii
DQKDASKK

SEQ ID NO: 11187 - protein, 8 aa, Borrelia garinii
QKDASKKD

SEQ ID NO: 11188 - protein, 8 aa, Borrelia garinii
KDASKKDL

SEQ ID NO: 11189 - protein, 8 aa, Borrelia garinii
DASKKDLP

SEQ ID NO: 11190 - protein, 8 aa, Borrelia garinii
ASKKDLPL

SEQ ID NO: 11191 - protein, 8 aa, Borrelia garinii
SKKDLPLV

SEQ ID NO: 11192 - protein, 8 aa, Borrelia garinii
KKDLPLVT

SEQ ID NO: 11193 - protein, 8 aa, Borrelia garinii
KDLPLVTE

SEQ ID NO: 11194 - protein, 8 aa, Borrelia garinii
DLPLVTED

SEQ ID NO: 11195 - protein, 8 aa, Borrelia garinii
LPLVTEDT

SEQ ID NO: 11196 - protein, 8 aa, Borrelia garinii
PLVTEDTV

SEQ ID NO: 11197 - protein, 8 aa, Borrelia garinii
LVTEDTVK

SEQ ID NO: 11198 - protein, 8 aa, Borrelia garinii
VTEDTVKL

SEQ ID NO: 11199 - protein, 8 aa, Borrelia garinii
TEDTVKLF

SEQ ID NO: 11200 - protein, 8 aa, Borrelia garinii
EDTVKLFN

SEQ ID NO: 11201 - protein, 8 aa, Borrelia garinii
DTVKLFND

SEQ ID NO: 11202 - protein, 8 aa, Borrelia garinii
TVKLFNDT

SEQ ID NO: 11203 - protein, 8 aa, Borrelia garinii
VKLFNDTK

SEQ ID NO: 11204 - protein, 8 aa, Borrelia garinii
KLFNDTKI

SEQ ID NO: 11205 - protein, 8 aa, Borrelia garinii
LFNDTKIF

SEQ ID NO: 11206 - protein, 8 aa, Borrelia garinii
FNDTKIFI

SEQ ID NO: 11207 - protein, 8 aa, Borrelia garinii
NDTKIFIS

SEQ ID NO: 11208 - protein, 8 aa, Borrelia garinii
DTKIFISK

SEQ ID NO: 11209 - protein, 8 aa, Borrelia garinii
TKIFISKE

SEQ ID NO: 11210 - protein, 8 aa, Borrelia garinii
KIFISKEK

SEQ ID NO: 11211 - protein, 8 aa, Borrelia garinii
IFISKEKN

SEQ ID NO: 11212 - protein, 8 aa, Borrelia garinii
FISKEKNK

SEQ ID NO: 11213 - protein, 8 aa, Borrelia garinii
ISKEKNKD

SEQ ID NO: 11214 - protein, 8 aa, Borrelia garinii
SKEKNKDG

SEQ ID NO: 11215 - protein, 8 aa, Borrelia garinii
KEKNKDGK

SEQ ID NO: 11216 - protein, 8 aa, Borrelia garinii
EKNKDGKY

SEQ ID NO: 11217 - protein, 8 aa, Borrelia garinii
KNKDGKYE

SEQ ID NO: 11218 - protein, 8 aa, Borrelia garinii
NKDGKYEL

SEQ ID NO: 11219 - protein, 8 aa, Borrelia garinii
KDGKYELR

SEQ ID NO: 11220 - protein, 8 aa, Borrelia garinii
DGKYELRA

SEQ ID NO: 11221 - protein, 8 aa, Borrelia garinii
GKYELRAT

SEQ ID NO: 11222 - protein, 8 aa, Borrelia garinii
KYELRATV

SEQ ID NO: 11223 - protein, 8 aa, Borrelia garinii
YELRATVD

SEQ ID NO: 11224 - protein, 8 aa, Borrelia garinii
ELRATVDT

SEQ ID NO: 11225 - protein, 8 aa, Borrelia garinii
LRATVDTV

SEQ ID NO: 11226 - protein, 8 aa, Borrelia garinii
RATVDTVE

SEQ ID NO: 11227 - protein, 8 aa, Borrelia garinii
ATVDTVEL

SEQ ID NO: 11228 - protein, 8 aa, Borrelia garinii
TVDTVELK

SEQ ID NO: 11229 - protein, 8 aa, Borrelia garinii
VDTVELKG

SEQ ID NO: 11230 - protein, 8 aa, Borrelia garinii
DTVELKGV

SEQ ID NO: 11231 - protein, 8 aa, Borrelia garinii
TVELKGVA

SEQ ID NO: 11232 - protein, 8 aa, Borrelia garinii
VELKGVAD

SEQ ID NO: 11233 - protein, 8 aa, Borrelia garinii
ELKGVADK

SEQ ID NO: 11234 - protein, 8 aa, Borrelia garinii
LKGVADKN

SEQ ID NO: 11235 - protein, 8 aa, Borrelia garinii
KGVADKND

SEQ ID NO: 11236 - protein, 8 aa, Borrelia garinii
GVADKNDG

SEQ ID NO: 11237 - protein, 8 aa, Borrelia garinii
VADKNDGS

SEQ ID NO: 11238 - protein, 8 aa, Borrelia garinii
ADKNDGSG

SEQ ID NO: 11239 - protein, 8 aa, Borrelia garinii
DKNDGSGG

SEQ ID NO: 11240 - protein, 8 aa, Borrelia garinii
KNDGSGGK

SEQ ID NO: 11241 - protein, 8 aa, Borrelia garinii
NDGSGGKL

SEQ ID NO: 11242 - protein, 8 aa, Borrelia garinii
DGSGGKLE

SEQ ID NO: 11243 - protein, 8 aa, Borrelia garinii
GSGGKLEG

SEQ ID NO: 11244 - protein, 8 aa, Borrelia garinii
SGGKLEGV

SEQ ID NO: 11245 - protein, 8 aa, Borrelia garinii
GGKLEGVK

SEQ ID NO: 11246 - protein, 8 aa, Borrelia garinii
GKLEGVKS

SEQ ID NO: 11247 - protein, 8 aa, Borrelia garinii
KLEGVKSD

SEQ ID NO: 11248 - protein, 8 aa, Borrelia garinii
LEGVKSDQ

SEQ ID NO: 11249 - protein, 8 aa, Borrelia garinii
EGVKSDQS

SEQ ID NO: 11250 - protein, 8 aa, Borrelia garinii
GVKSDQSK

SEQ ID NO: 11251 - protein, 8 aa, Borrelia garinii
VKSDQSKV

SEQ ID NO: 11252 - protein, 8 aa, Borrelia garinii
KSDQSKVT

SEQ ID NO: 11253 - protein, 8 aa, Borrelia garinii
SDQSKVTM

SEQ ID NO: 11254 - protein, 8 aa, Borrelia garinii
DQSKVTMS

SEQ ID NO: 11255 - protein, 8 aa, Borrelia garinii
QSKVTMSI

SEQ ID NO: 11256 - protein, 8 aa, Borrelia garinii
SKVTMSIT

SEQ ID NO: 11257 - protein, 8 aa, Borrelia garinii
KVTMSITD

SEQ ID NO: 11258 - protein, 8 aa, Borrelia garinii
VTMSITDD

SEQ ID NO: 11259 - protein, 8 aa, Borrelia garinii
TMSITDDL

SEQ ID NO: 11260 - protein, 8 aa, Borrelia garinii
MSITDDLN

SEQ ID NO: 11261 - protein, 8 aa, Borrelia garinii
SITDDLNT

SEQ ID NO: 11262 - protein, 8 aa, Borrelia garinii
ITDDLNTI

SEQ ID NO: 11263 - protein, 8 aa, Borrelia garinii
TDDLNTIT

SEQ ID NO: 11264 - protein, 8 aa, Borrelia garinii
DDLNTITV

SEQ ID NO: 11265 - protein, 8 aa, Borrelia garinii
DLNTITVE

SEQ ID NO: 11266 - protein, 8 aa, Borrelia garinii
LNTITVET

SEQ ID NO: 11267 - protein, 8 aa, Borrelia garinii
NTITVETY

SEQ ID NO: 11268 - protein, 8 aa, Borrelia garinii
TITVETYD

SEQ ID NO: 11269 - protein, 8 aa, Borrelia garinii
ITVETYDS

SEQ ID NO: 11270 - protein, 8 aa, Borrelia garinii
TVETYDSS

SEQ ID NO: 11271 - protein, 8 aa, Borrelia garinii
VETYDSSN

SEQ ID NO: 11272 - protein, 8 aa, Borrelia garinii
ETYDSSNT

SEQ ID NO: 11273 - protein, 8 aa, Borrelia garinii
TYDSSNTK

SEQ ID NO: 11274 - protein, 8 aa, Borrelia garinii
YDSSNTKV

SEQ ID NO: 11275 - protein, 8 aa, Borrelia garinii
DSSNTKVA

SEQ ID NO: 11276 - protein, 8 aa, Borrelia garinii
SSNTKVAS

SEQ ID NO: 11277 - protein, 8 aa, Borrelia garinii
SNTKVASK

SEQ ID NO: 11278 - protein, 8 aa, Borrelia garinii
NTKVASKV

SEQ ID NO: 11279 - protein, 8 aa, Borrelia garinii
TKVASKVF

SEQ ID NO: 11280 - protein, 8 aa, Borrelia garinii
KVASKVFK

SEQ ID NO: 11281 - protein, 8 aa, Borrelia garinii
VASKVFKK

SEQ ID NO: 11282 - protein, 8 aa, Borrelia garinii
ASKVFKKQ

SEQ ID NO: 11283 - protein, 8 aa, Borrelia garinii
SKVFKKQG

SEQ ID NO: 11284 - protein, 8 aa, Borrelia garinii
KVFKKQGS

SEQ ID NO: 11285 - protein, 8 aa, Borrelia garinii
VFKKQGSL

SEQ ID NO: 11286 - protein, 8 aa, Borrelia garinii
FKKQGSLT

SEQ ID NO: 11287 - protein, 8 aa, Borrelia garinii
KKQGSLTE

SEQ ID NO: 11288 - protein, 8 aa, Borrelia garinii
KQGSLTEE

SEQ ID NO: 11289 - protein, 8 aa, Borrelia garinii
QGSLTEET

SEQ ID NO: 11290 - protein, 8 aa, Borrelia garinii
GSLTEETE

SEQ ID NO: 11291 - protein, 8 aa, Borrelia garinii
SLTEETEE

SEQ ID NO: 11292 - protein, 8 aa, Borrelia garinii
LTEETEET

SEQ ID NO: 11293 - protein, 8 aa, Borrelia garinii
TEETEETY

SEQ ID NO: 11294 - protein, 8 aa, Borrelia garinii
EETEETYK

SEQ ID NO: 11295 - protein, 8 aa, Borrelia garinii
ETEETYKT

SEQ ID NO: 11296 - protein, 8 aa, Borrelia garinii
TEETYKTG

SEQ ID NO: 11297 - protein, 8 aa, Borrelia garinii
EETYKTGK

SEQ ID NO: 11298 - protein, 8 aa, Borrelia garinii
ETYKTGKL

SEQ ID NO: 11299 - protein, 8 aa, Borrelia garinii
TYKTGKLS

SEQ ID NO: 11300 - protein, 8 aa, Borrelia garinii
YKTGKLST

SEQ ID NO: 11301 - protein, 8 aa, Borrelia garinii
KTGKLSTK

SEQ ID NO: 11302 - protein, 8 aa, Borrelia garinii
TGKLSTKK

SEQ ID NO: 11303 - protein, 8 aa, Borrelia garinii
GKLSTKKI

SEQ ID NO: 11304 - protein, 8 aa, Borrelia garinii
KLSTKKIT

SEQ ID NO: 11305 - protein, 8 aa, Borrelia garinii
LSTKKITR

SEQ ID NO: 11306 - protein, 8 aa, Borrelia garinii
STKKITRT

SEQ ID NO: 11307 - protein, 8 aa, Borrelia garinii
TKKITRTN

SEQ ID NO: 11308 - protein, 8 aa, Borrelia garinii
KKITRTNG

SEQ ID NO: 11309 - protein, 8 aa, Borrelia garinii
KITRTNGT

SEQ ID NO: 11310 - protein, 8 aa, Borrelia garinii
ITRTNGTT

SEQ ID NO: 11311 - protein, 8 aa, Borrelia garinii
TRTNGTTL

SEQ ID NO: 11312 - protein, 8 aa, Borrelia garinii
RTNGTTLE

SEQ ID NO: 11313 - protein, 8 aa, Borrelia garinii
TNGTTLEY

SEQ ID NO: 11314 - protein, 8 aa, Borrelia garinii
NGTTLEYS

SEQ ID NO: 11315 - protein, 8 aa, Borrelia garinii
GTTLEYSD

SEQ ID NO: 11316 - protein, 8 aa, Borrelia garinii
TTLEYSDM

SEQ ID NO: 11317 - protein, 8 aa, Borrelia garinii
TLEYSDMT

SEQ ID NO: 11318 - protein, 8 aa, Borrelia garinii
LEYSDMTN

SEQ ID NO: 11319 - protein, 8 aa, Borrelia garinii
EYSDMTND

SEQ ID NO: 11320 - protein, 8 aa, Borrelia garinii
YSDMTNDE

SEQ ID NO: 11321 - protein, 8 aa, Borrelia garinii
SDMTNDEN

SEQ ID NO: 11322 - protein, 8 aa, Borrelia garinii
DMTNDENA

SEQ ID NO: 11323 - protein, 8 aa, Borrelia garinii
MTNDENAT

SEQ ID NO: 11324 - protein, 8 aa, Borrelia garinii
TNDENATK

SEQ ID NO: 11325 - protein, 8 aa, Borrelia garinii
NDENATKA

SEQ ID NO: 11326 - protein, 8 aa, Borrelia garinii
DENATKAV

SEQ ID NO: 11327 - protein, 8 aa, Borrelia garinii
ENATKAVE

SEQ ID NO: 11328 - protein, 8 aa, Borrelia garinii
NATKAVET

SEQ ID NO: 11329 - protein, 8 aa, Borrelia garinii
ATKAVETL

SEQ ID NO: 11330 - protein, 8 aa, Borrelia garinii
TKAVETLK

SEQ ID NO: 11331 - protein, 8 aa, Borrelia garinii
KAVETLKN

SEQ ID NO: 11332 - protein, 8 aa, Borrelia garinii
AVETLKNG

SEQ ID NO: 11333 - protein, 8 aa, Borrelia garinii
VETLKNGI

SEQ ID NO: 11334 - protein, 8 aa, Borrelia garinii
ETLKNGIM

SEQ ID NO: 11335 - protein, 8 aa, Borrelia garinii
TLKNGIML

SEQ ID NO: 11336 - protein, 8 aa, Borrelia garinii
LKNGIMLE

SEQ ID NO: 11337 - protein, 8 aa, Borrelia garinii
KNGIMLEG

SEQ ID NO: 11338 - protein, 8 aa, Borrelia garinii
NGIMLEGN

SEQ ID NO: 11339 - protein, 8 aa, Borrelia garinii
GIMLEGNL

SEQ ID NO: 11340 - protein, 8 aa, Borrelia garinii
IMLEGNLV

SEQ ID NO: 11341 - protein, 8 aa, Borrelia garinii
MLEGNLVG

SEQ ID NO: 11342 - protein, 8 aa, Borrelia garinii
LEGNLVGG

SEQ ID NO: 11343 - protein, 8 aa, Borrelia garinii
EGNLVGGK

SEQ ID NO: 11344 - protein, 8 aa, Borrelia garinii
GNLVGGKT

SEQ ID NO: 11345 - protein, 8 aa, Borrelia garinii
NLVGGKTS

SEQ ID NO: 11346 - protein, 8 aa, Borrelia garinii
LVGGKTSV

SEQ ID NO: 11347 - protein, 8 aa, Borrelia garinii
VGGKTSVE

SEQ ID NO: 11348 - protein, 8 aa, Borrelia garinii
GGKTSVEI

SEQ ID NO: 11349 - protein, 8 aa, Borrelia garinii
GKTSVEIK

SEQ ID NO: 11350 - protein, 8 aa, Borrelia garinii
KTSVEIKE

SEQ ID NO: 11351 - protein, 8 aa, Borrelia garinii
TSVEIKEG

SEQ ID NO: 11352 - protein, 8 aa, Borrelia garinii
SVEIKEGT

SEQ ID NO: 11353 - protein, 8 aa, Borrelia garinii
VEIKEGTV

SEQ ID NO: 11354 - protein, 8 aa, Borrelia garinii
EIKEGTVT

SEQ ID NO: 11355 - protein, 8 aa, Borrelia garinii
IKEGTVTL

SEQ ID NO: 11356 - protein, 8 aa, Borrelia garinii
KEGTVTLK

SEQ ID NO: 11357 - protein, 8 aa, Borrelia garinii
EGTVTLKK

SEQ ID NO: 11358 - protein, 8 aa, Borrelia garinii
GTVTLKKE

SEQ ID NO: 11359 - protein, 8 aa, Borrelia garinii
TVTLKKEI

SEQ ID NO: 11360 - protein, 8 aa, Borrelia garinii
VTLKKEIE

SEQ ID NO: 11361 - protein, 8 aa, Borrelia garinii
TLKKEIEK

SEQ ID NO: 11362 - protein, 8 aa, Borrelia garinii
LKKEIEKA

SEQ ID NO: 11363 - protein, 8 aa, Borrelia garinii
KKEIEKAG

SEQ ID NO: 11364 - protein, 8 aa, Borrelia garinii
KEIEKAGT

SEQ ID NO: 11365 - protein, 8 aa, Borrelia garinii
EIEKAGTV

SEQ ID NO: 11366 - protein, 8 aa, Borrelia garinii
IEKAGTVK

SEQ ID NO: 11367 - protein, 8 aa, Borrelia garinii
EKAGTVKL

SEQ ID NO: 11368 - protein, 8 aa, Borrelia garinii
KAGTVKLF

SEQ ID NO: 11369 - protein, 8 aa, Borrelia garinii
AGTVKLFL

SEQ ID NO: 11370 - protein, 8 aa, Borrelia garinii
GTVKLFLD

SEQ ID NO: 11371 - protein, 8 aa, Borrelia garinii
TVKLFLDD

SEQ ID NO: 11372 - protein, 8 aa, Borrelia garinii
VKLFLDDT

SEQ ID NO: 11373 - protein, 8 aa, Borrelia garinii
KLFLDDTS

SEQ ID NO: 11374 - protein, 8 aa, Borrelia garinii
LFLDDTSS

SEQ ID NO: 11375 - protein, 8 aa, Borrelia garinii
FLDDTSSG

SEQ ID NO: 11376 - protein, 8 aa, Borrelia garinii
LDDTSSGS

SEQ ID NO: 11377 - protein, 8 aa, Borrelia garinii
DDTSSGST

SEQ ID NO: 11378 - protein, 8 aa, Borrelia garinii
DTSSGSTK

SEQ ID NO: 11379 - protein, 8 aa, Borrelia garinii
TSSGSTKK

SEQ ID NO: 11380 - protein, 8 aa, Borrelia garinii
SSGSTKKT

SEQ ID NO: 11381 - protein, 8 aa, Borrelia garinii
SGSTKKTA

SEQ ID NO: 11382 - protein, 8 aa, Borrelia garinii
GSTKKTAV

SEQ ID NO: 11383 - protein, 8 aa, Borrelia garinii
STKKTAVW

SEQ ID NO: 11384 - protein, 8 aa, Borrelia garinii
TKKTAVWS

SEQ ID NO: 11385 - protein, 8 aa, Borrelia garinii
KKTAVWSD

SEQ ID NO: 11386 - protein, 8 aa, Borrelia garinii
KTAVWSDT

SEQ ID NO: 11387 - protein, 8 aa, Borrelia garinii
TAVWSDTS

SEQ ID NO: 11388 - protein, 8 aa, Borrelia garinii
AVWSDTSN

SEQ ID NO: 11389 - protein, 8 aa, Borrelia garinii
VWSDTSNT

SEQ ID NO: 11390 - protein, 8 aa, Borrelia garinii
WSDTSNTL

SEQ ID NO: 11391 - protein, 8 aa, Borrelia garinii
SDTSNTLT

SEQ ID NO: 11392 - protein, 8 aa, Borrelia garinii
DTSNTLTV

SEQ ID NO: 11393 - protein, 8 aa, Borrelia garinii
TSNTLTVS

SEQ ID NO: 11394 - protein, 8 aa, Borrelia garinii
SNTLTVSA

SEQ ID NO: 11395 - protein, 8 aa, Borrelia garinii
NTLTVSAD

SEQ ID NO: 11396 - protein, 8 aa, Borrelia garinii
TLTVSADS

SEQ ID NO: 11397 - protein, 8 aa, Borrelia garinii
LTVSADSK

SEQ ID NO: 11398 - protein, 8 aa, Borrelia garinii
TVSADSKK

SEQ ID NO: 11399 - protein, 8 aa, Borrelia garinii
VSADSKKI

SEQ ID NO: 11400 - protein, 8 aa, Borrelia garinii
SADSKKIK

SEQ ID NO: 11401 - protein, 8 aa, Borrelia garinii
ADSKKIKD

SEQ ID NO: 11402 - protein, 8 aa, Borrelia garinii
DSKKIKDF

SEQ ID NO: 11403 - protein, 8 aa, Borrelia garinii
SKKIKDFV

SEQ ID NO: 11404 - protein, 8 aa, Borrelia garinii
KKIKDFVF

SEQ ID NO: 11405 - protein, 8 aa, Borrelia garinii
KIKDFVFL

SEQ ID NO: 11406 - protein, 8 aa, Borrelia garinii
IKDFVFLT

SEQ ID NO: 11407 - protein, 8 aa, Borrelia garinii
KDFVFLTD

SEQ ID NO: 11408 - protein, 8 aa, Borrelia garinii
DFVFLTDG

SEQ ID NO: 11409 - protein, 8 aa, Borrelia garinii
FVFLTDGT

SEQ ID NO: 11410 - protein, 8 aa, Borrelia garinii
VFLTDGTI

SEQ ID NO: 11411 - protein, 8 aa, Borrelia garinii
FLTDGTIT

SEQ ID NO: 11412 - protein, 8 aa, Borrelia garinii
LTDGTITV

SEQ ID NO: 11413 - protein, 8 aa, Borrelia garinii
TDGTITVQ

SEQ ID NO: 11414 - protein, 8 aa, Borrelia garinii
DGTITVQN

SEQ ID NO: 11415 - protein, 8 aa, Borrelia garinii
GTITVQNY

SEQ ID NO: 11416 - protein, 8 aa, Borrelia garinii
TITVQNYD

SEQ ID NO: 11417 - protein, 8 aa, Borrelia garinii
ITVQNYDT

SEQ ID NO: 11418 - protein, 8 aa, Borrelia garinii
TVQNYDTA

SEQ ID NO: 11419 - protein, 8 aa, Borrelia garinii
VQNYDTAG

SEQ ID NO: 11420 - protein, 8 aa, Borrelia garinii
QNYDTAGT

SEQ ID NO: 11421 - protein, 8 aa, Borrelia garinii
NYDTAGTK

SEQ ID NO: 11422 - protein, 8 aa, Borrelia garinii
YDTAGTKL

SEQ ID NO: 11423 - protein, 8 aa, Borrelia garinii
DTAGTKLA

SEQ ID NO: 11424 - protein, 8 aa, Borrelia garinii
TAGTKLAG

SEQ ID NO: 11425 - protein, 8 aa, Borrelia garinii
AGTKLAGT

SEQ ID NO: 11426 - protein, 8 aa, Borrelia garinii
GTKLAGTA

SEQ ID NO: 11427 - protein, 8 aa, Borrelia garinii
TKLAGTAT

SEQ ID NO: 11428 - protein, 8 aa, Borrelia garinii
KLAGTATE

SEQ ID NO: 11429 - protein, 8 aa, Borrelia garinii
LAGTATEI

SEQ ID NO: 11430 - protein, 8 aa, Borrelia garinii
AGTATEIK

SEQ ID NO: 11431 - protein, 8 aa, Borrelia garinii
GTATEIKD

SEQ ID NO: 11432 - protein, 8 aa, Borrelia garinii
TATEIKDL

SEQ ID NO: 11433 - protein, 8 aa, Borrelia garinii
ATEIKDLE

SEQ ID NO: 11434 - protein, 8 aa, Borrelia garinii
TEIKDLEA

SEQ ID NO: 11435 - protein, 8 aa, Borrelia garinii
EIKDLEAL

SEQ ID NO: 11436 - protein, 8 aa, Borrelia garinii
IKDLEALK

SEQ ID NO: 11437 - protein, 8 aa, Borrelia garinii
KDLEALKA

SEQ ID NO: 11438 - protein, 8 aa, Borrelia garinii
DLEALKAA

SEQ ID NO: 11439 - protein, 8 aa, Borrelia garinii
LEALKAAL

SEQ ID NO: 11440 - protein, 8 aa, Borrelia garinii
EALKAALK

SEQ ID NO: 11441 - protein, 9 aa, Borrelia garinii
MKKYLLGFA

SEQ ID NO: 11442 - protein, 9 aa, Borrelia garinii
KKYLLGFAL

SEQ ID NO: 11443 - protein, 9 aa, Borrelia garinii
KYLLGFALV

SEQ ID NO: 11444 - protein, 9 aa, Borrelia garinii
YLLGFALVL

SEQ ID NO: 11445 - protein, 9 aa, Borrelia garinii
LLGFALVLA

SEQ ID NO: 11446 - protein, 9 aa, Borrelia garinii
LGFALVLAL

SEQ ID NO: 11447 - protein, 9 aa, Borrelia garinii
GFALVLALI

SEQ ID NO: 11448 - protein, 9 aa, Borrelia garinii
FALVLALIA

SEQ ID NO: 11449 - protein, 9 aa, Borrelia garinii
ALVLALIAC

SEQ ID NO: 11450 - protein, 9 aa, Borrelia garinii
LVLALIACG

SEQ ID NO: 11451 - protein, 9 aa, Borrelia garinii
VLALIACGQ

SEQ ID NO: 11452 - protein, 9 aa, Borrelia garinii
LALIACGQK

SEQ ID NO: 11453 - protein, 9 aa, Borrelia garinii
ALIACGQKG

SEQ ID NO: 11454 - protein, 9 aa, Borrelia garinii
LIACGQKGA

SEQ ID NO: 11455 - protein, 9 aa, Borrelia garinii
IACGQKGAE

SEQ ID NO: 11456 - protein, 9 aa, Borrelia garinii
ACGQKGAEP

SEQ ID NO: 11457 - protein, 9 aa, Borrelia garinii
CGQKGAEPK

SEQ ID NO: 11458 - protein, 9 aa, Borrelia garinii
GQKGAEPKH

SEQ ID NO: 11459 - protein, 9 aa, Borrelia garinii
QKGAEPKHN

SEQ ID NO: 11460 - protein, 9 aa, Borrelia garinii
KGAEPKHND

SEQ ID NO: 11461 - protein, 9 aa, Borrelia garinii
GAEPKHNDQ

SEQ ID NO: 11462 - protein, 9 aa, Borrelia garinii
AEPKHNDQE

SEQ ID NO: 11463 - protein, 9 aa, Borrelia garinii
EPKHNDQEV

SEQ ID NO: 11464 - protein, 9 aa, Borrelia garinii
PKHNDQEVE

SEQ ID NO: 11465 - protein, 9 aa, Borrelia garinii
KHNDQEVED

SEQ ID NO: 11466 - protein, 9 aa, Borrelia garinii
HNDQEVEDS

SEQ ID NO: 11467 - protein, 9 aa, Borrelia garinii
NDQEVEDSK

SEQ ID NO: 11468 - protein, 9 aa, Borrelia garinii
DQEVEDSKK

SEQ ID NO: 11469 - protein, 9 aa, Borrelia garinii
QEVEDSKKD

SEQ ID NO: 11470 - protein, 9 aa, Borrelia garinii
EVEDSKKDQ

SEQ ID NO: 11471 - protein, 9 aa, Borrelia garinii
VEDSKKDQK

SEQ ID NO: 11472 - protein, 9 aa, Borrelia garinii
EDSKKDQKD

SEQ ID NO: 11473 - protein, 9 aa, Borrelia garinii
DSKKDQKDA

SEQ ID NO: 11474 - protein, 9 aa, Borrelia garinii
SKKDQKDAS

SEQ ID NO: 11475 - protein, 9 aa, Borrelia garinii
KKDQKDASK

SEQ ID NO: 11476 - protein, 9 aa, Borrelia garinii
KDQKDASKK

SEQ ID NO: 11477 - protein, 9 aa, Borrelia garinii
DQKDASKKD

SEQ ID NO: 11478 - protein, 9 aa, Borrelia garinii
QKDASKKDL

SEQ ID NO: 11479 - protein, 9 aa, Borrelia garinii
KDASKKDLP

SEQ ID NO: 11480 - protein, 9 aa, Borrelia garinii
DASKKDLPL

SEQ ID NO: 11481 - protein, 9 aa, Borrelia garinii
ASKKDLPLV

SEQ ID NO: 11482 - protein, 9 aa, Borrelia garinii
SKKDLPLVT

SEQ ID NO: 11483 - protein, 9 aa, Borrelia garinii
KKDLPLVTE

SEQ ID NO: 11484 - protein, 9 aa, Borrelia garinii
KDLPLVTED

SEQ ID NO: 11485 - protein, 9 aa, Borrelia garinii
DLPLVTEDT

SEQ ID NO: 11486 - protein, 9 aa, Borrelia garinii
LPLVTEDTV

SEQ ID NO: 11487 - protein, 9 aa, Borrelia garinii
PLVTEDTVK

SEQ ID NO: 11488 - protein, 9 aa, Borrelia garinii
LVTEDTVKL

SEQ ID NO: 11489 - protein, 9 aa, Borrelia garinii
VTEDTVKLF

SEQ ID NO: 11490 - protein, 9 aa, Borrelia garinii
TEDTVKLFN

SEQ ID NO: 11491 - protein, 9 aa, Borrelia garinii
EDTVKLFND

SEQ ID NO: 11492 - protein, 9 aa, Borrelia garinii
DTVKLFNDT

SEQ ID NO: 11493 - protein, 9 aa, Borrelia garinii
TVKLFNDTK

SEQ ID NO: 11494 - protein, 9 aa, Borrelia garinii
VKLFNDTKI

SEQ ID NO: 11495 - protein, 9 aa, Borrelia garinii
KLFNDTKIF

SEQ ID NO: 11496 - protein, 9 aa, Borrelia garinii
LFNDTKIFI

SEQ ID NO: 11497 - protein, 9 aa, Borrelia garinii
FNDTKIFIS

SEQ ID NO: 11498 - protein, 9 aa, Borrelia garinii
NDTKIFISK

SEQ ID NO: 11499 - protein, 9 aa, Borrelia garinii
DTKIFISKE

SEQ ID NO: 11500 - protein, 9 aa, Borrelia garinii
TKIFISKEK

SEQ ID NO: 11501 - protein, 9 aa, Borrelia garinii
KIFISKEKN

SEQ ID NO: 11502 - protein, 9 aa, Borrelia garinii
IFISKEKNK

SEQ ID NO: 11503 - protein, 9 aa, Borrelia garinii
FISKEKNKD

SEQ ID NO: 11504 - protein, 9 aa, Borrelia garinii
ISKEKNKDG

SEQ ID NO: 11505 - protein, 9 aa, Borrelia garinii
SKEKNKDGK

SEQ ID NO: 11506 - protein, 9 aa, Borrelia garinii
KEKNKDGKY

SEQ ID NO: 11507 - protein, 9 aa, Borrelia garinii
EKNKDGKYE

SEQ ID NO: 11508 - protein, 9 aa, Borrelia garinii
KNKDGKYEL

SEQ ID NO: 11509 - protein, 9 aa, Borrelia garinii
NKDGKYELR

SEQ ID NO: 11510 - protein, 9 aa, Borrelia garinii
KDGKYELRA

SEQ ID NO: 11511 - protein, 9 aa, Borrelia garinii
DGKYELRAT

SEQ ID NO: 11512 - protein, 9 aa, Borrelia garinii
GKYELRATV

SEQ ID NO: 11513 - protein, 9 aa, Borrelia garinii
KYELRATVD

SEQ ID NO: 11514 - protein, 9 aa, Borrelia garinii
YELRATVDT

SEQ ID NO: 11515 - protein, 9 aa, Borrelia garinii
ELRATVDTV

SEQ ID NO: 11516 - protein, 9 aa, Borrelia garinii
LRATVDTVE

SEQ ID NO: 11517 - protein, 9 aa, Borrelia garinii
RATVDTVEL

SEQ ID NO: 11518 - protein, 9 aa, Borrelia garinii
ATVDTVELK

SEQ ID NO: 11519 - protein, 9 aa, Borrelia garinii
TVDTVELKG

SEQ ID NO: 11520 - protein, 9 aa, Borrelia garinii
VDTVELKGV

SEQ ID NO: 11521 - protein, 9 aa, Borrelia garinii
DTVELKGVA

SEQ ID NO: 11522 - protein, 9 aa, Borrelia garinii
TVELKGVAD

SEQ ID NO: 11523 - protein, 9 aa, Borrelia garinii
VELKGVADK

SEQ ID NO: 11524 - protein, 9 aa, Borrelia garinii
ELKGVADKN

SEQ ID NO: 11525 - protein, 9 aa, Borrelia garinii
LKGVADKND

SEQ ID NO: 11526 - protein, 9 aa, Borrelia garinii
KGVADKNDG

SEQ ID NO: 11527 - protein, 9 aa, Borrelia garinii
GVADKNDGS

SEQ ID NO: 11528 - protein, 9 aa, Borrelia garinii
VADKNDGSG

SEQ ID NO: 11529 - protein, 9 aa, Borrelia garinii
ADKNDGSGG

SEQ ID NO: 11530 - protein, 9 aa, Borrelia garinii
DKNDGSGGK

SEQ ID NO: 11531 - protein, 9 aa, Borrelia garinii
KNDGSGGKL

SEQ ID NO: 11532 - protein, 9 aa, Borrelia garinii
NDGSGGKLE

SEQ ID NO: 11533 - protein, 9 aa, Borrelia garinii
DGSGGKLEG

SEQ ID NO: 11534 - protein, 9 aa, Borrelia garinii
GSGGKLEGV

SEQ ID NO: 11535 - protein, 9 aa, Borrelia garinii
SGGKLEGVK

SEQ ID NO: 11536 - protein, 9 aa, Borrelia garinii
GGKLEGVKS

SEQ ID NO: 11537 - protein, 9 aa, Borrelia garinii
GKLEGVKSD

SEQ ID NO: 11538 - protein, 9 aa, Borrelia garinii
KLEGVKSDQ

SEQ ID NO: 11539 - protein, 9 aa, Borrelia garinii
LEGVKSDQS

SEQ ID NO: 11540 - protein, 9 aa, Borrelia garinii
EGVKSDQSK

SEQ ID NO: 11541 - protein, 9 aa, Borrelia garinii
GVKSDQSKV

SEQ ID NO: 11542 - protein, 9 aa, Borrelia garinii
VKSDQSKVT

SEQ ID NO: 11543 - protein, 9 aa, Borrelia garinii
KSDQSKVTM

SEQ ID NO: 11544 - protein, 9 aa, Borrelia garinii
SDQSKVTMS

SEQ ID NO: 11545 - protein, 9 aa, Borrelia garinii
DQSKVTMSI

SEQ ID NO: 11546 - protein, 9 aa, Borrelia garinii
QSKVTMSIT

SEQ ID NO: 11547 - protein, 9 aa, Borrelia garinii
SKVTMSITD

SEQ ID NO: 11548 - protein, 9 aa, Borrelia garinii
KVTMSITDD

SEQ ID NO: 11549 - protein, 9 aa, Borrelia garinii
VTMSITDDL

SEQ ID NO: 11550 - protein, 9 aa, Borrelia garinii
TMSITDDLN

SEQ ID NO: 11551 - protein, 9 aa, Borrelia garinii
MSITDDLNT

SEQ ID NO: 11552 - protein, 9 aa, Borrelia garinii
SITDDLNTI

SEQ ID NO: 11553 - protein, 9 aa, Borrelia garinii
ITDDLNTIT

SEQ ID NO: 11554 - protein, 9 aa, Borrelia garinii
TDDLNTITV

SEQ ID NO: 11555 - protein, 9 aa, Borrelia garinii
DDLNTITVE

SEQ ID NO: 11556 - protein, 9 aa, Borrelia garinii
DLNTITVET

SEQ ID NO: 11557 - protein, 9 aa, Borrelia garinii
LNTITVETY

SEQ ID NO: 11558 - protein, 9 aa, Borrelia garinii
NTITVETYD

SEQ ID NO: 11559 - protein, 9 aa, Borrelia garinii
TITVETYDS

SEQ ID NO: 11560 - protein, 9 aa, Borrelia garinii
ITVETYDSS

SEQ ID NO: 11561 - protein, 9 aa, Borrelia garinii
TVETYDSSN

SEQ ID NO: 11562 - protein, 9 aa, Borrelia garinii
VETYDSSNT

SEQ ID NO: 11563 - protein, 9 aa, Borrelia garinii
ETYDSSNTK

SEQ ID NO: 11564 - protein, 9 aa, Borrelia garinii
TYDSSNTKV

SEQ ID NO: 11565 - protein, 9 aa, Borrelia garinii
YDSSNTKVA

SEQ ID NO: 11566 - protein, 9 aa, Borrelia garinii
DSSNTKVAS

SEQ ID NO: 11567 - protein, 9 aa, Borrelia garinii
SSNTKVASK

SEQ ID NO: 11568 - protein, 9 aa, Borrelia garinii
SNTKVASKV

SEQ ID NO: 11569 - protein, 9 aa, Borrelia garinii
NTKVASKVF

SEQ ID NO: 11570 - protein, 9 aa, Borrelia garinii
TKVASKVFK

SEQ ID NO: 11571 - protein, 9 aa, Borrelia garinii
KVASKVFKK

SEQ ID NO: 11572 - protein, 9 aa, Borrelia garinii
VASKVFKKQ

SEQ ID NO: 11573 - protein, 9 aa, Borrelia garinii
ASKVFKKQG

SEQ ID NO: 11574 - protein, 9 aa, Borrelia garinii
SKVFKKQGS

SEQ ID NO: 11575 - protein, 9 aa, Borrelia garinii
KVFKKQGSL

SEQ ID NO: 11576 - protein, 9 aa, Borrelia garinii
VFKKQGSLT

SEQ ID NO: 11577 - protein, 9 aa, Borrelia garinii
FKKQGSLTE

SEQ ID NO: 11578 - protein, 9 aa, Borrelia garinii
KKQGSLTEE

SEQ ID NO: 11579 - protein, 9 aa, Borrelia garinii
KQGSLTEET

SEQ ID NO: 11580 - protein, 9 aa, Borrelia garinii
QGSLTEETE

SEQ ID NO: 11581 - protein, 9 aa, Borrelia garinii
GSLTEETEE

SEQ ID NO: 11582 - protein, 9 aa, Borrelia garinii
SLTEETEET

SEQ ID NO: 11583 - protein, 9 aa, Borrelia garinii
LTEETEETY

SEQ ID NO: 11584 - protein, 9 aa, Borrelia garinii
TEETEETYK

SEQ ID NO: 11585 - protein, 9 aa, Borrelia garinii
EETEETYKT

SEQ ID NO: 11586 - protein, 9 aa, Borrelia garinii
ETEETYKTG

SEQ ID NO: 11587 - protein, 9 aa, Borrelia garinii
TEETYKTGK

SEQ ID NO: 11588 - protein, 9 aa, Borrelia garinii
EETYKTGKL

SEQ ID NO: 11589 - protein, 9 aa, Borrelia garinii
ETYKTGKLS

SEQ ID NO: 11590 - protein, 9 aa, Borrelia garinii
TYKTGKLST

SEQ ID NO: 11591 - protein, 9 aa, Borrelia garinii
YKTGKLSTK

SEQ ID NO: 11592 - protein, 9 aa, Borrelia garinii
KTGKLSTKK

SEQ ID NO: 11593 - protein, 9 aa, Borrelia garinii
TGKLSTKKI

SEQ ID NO: 11594 - protein, 9 aa, Borrelia garinii
GKLSTKKIT

SEQ ID NO: 11595 - protein, 9 aa, Borrelia garinii
KLSTKKITR

SEQ ID NO: 11596 - protein, 9 aa, Borrelia garinii
LSTKKITRT

SEQ ID NO: 11597 - protein, 9 aa, Borrelia garinii
STKKITRTN

SEQ ID NO: 11598 - protein, 9 aa, Borrelia garinii
TKKITRTNG

SEQ ID NO: 11599 - protein, 9 aa, Borrelia garinii
KKITRTNGT

SEQ ID NO: 11600 - protein, 9 aa, Borrelia garinii
KITRTNGTT

SEQ ID NO: 11601 - protein, 9 aa, Borrelia garinii
ITRTNGTTL

SEQ ID NO: 11602 - protein, 9 aa, Borrelia garinii
TRTNGTTLE

SEQ ID NO: 11603 - protein, 9 aa, Borrelia garinii
RTNGTTLEY

SEQ ID NO: 11604 - protein, 9 aa, Borrelia garinii
TNGTTLEYS

SEQ ID NO: 11605 - protein, 9 aa, Borrelia garinii
NGTTLEYSD

SEQ ID NO: 11606 - protein, 9 aa, Borrelia garinii
GTTLEYSDM

SEQ ID NO: 11607 - protein, 9 aa, Borrelia garinii
TTLEYSDMT

SEQ ID NO: 11608 - protein, 9 aa, Borrelia garinii
TLEYSDMTN

SEQ ID NO: 11609 - protein, 9 aa, Borrelia garinii
LEYSDMTND

SEQ ID NO: 11610 - protein, 9 aa, Borrelia garinii
EYSDMTNDE

SEQ ID NO: 11611 - protein, 9 aa, Borrelia garinii
YSDMTNDEN

SEQ ID NO: 11612 - protein, 9 aa, Borrelia garinii
SDMTNDENA

SEQ ID NO: 11613 - protein, 9 aa, Borrelia garinii
DMTNDENAT

SEQ ID NO: 11614 - protein, 9 aa, Borrelia garinii
MTNDENATK

SEQ ID NO: 11615 - protein, 9 aa, Borrelia garinii
TNDENATKA

SEQ ID NO: 11616 - protein, 9 aa, Borrelia garinii
NDENATKAV

SEQ ID NO: 11617 - protein, 9 aa, Borrelia garinii
DENATKAVE

SEQ ID NO: 11618 - protein, 9 aa, Borrelia garinii
ENATKAVET

SEQ ID NO: 11619 - protein, 9 aa, Borrelia garinii
NATKAVETL

SEQ ID NO: 11620 - protein, 9 aa, Borrelia garinii
ATKAVETLK

SEQ ID NO: 11621 - protein, 9 aa, Borrelia garinii
TKAVETLKN

SEQ ID NO: 11622 - protein, 9 aa, Borrelia garinii
KAVETLKNG

SEQ ID NO: 11623 - protein, 9 aa, Borrelia garinii
AVETLKNGI

SEQ ID NO: 11624 - protein, 9 aa, Borrelia garinii
VETLKNGIM

SEQ ID NO: 11625 - protein, 9 aa, Borrelia garinii
ETLKNGIML

SEQ ID NO: 11626 - protein, 9 aa, Borrelia garinii
TLKNGIMLE

SEQ ID NO: 11627 - protein, 9 aa, Borrelia garinii
LKNGIMLEG

SEQ ID NO: 11628 - protein, 9 aa, Borrelia garinii
KNGIMLEGN

SEQ ID NO: 11629 - protein, 9 aa, Borrelia garinii
NGIMLEGNL

SEQ ID NO: 11630 - protein, 9 aa, Borrelia garinii
GIMLEGNLV

SEQ ID NO: 11631 - protein, 9 aa, Borrelia garinii
IMLEGNLVG

SEQ ID NO: 11632 - protein, 9 aa, Borrelia garinii
MLEGNLVGG

SEQ ID NO: 11633 - protein, 9 aa, Borrelia garinii
LEGNLVGGK

SEQ ID NO: 11634 - protein, 9 aa, Borrelia garinii
EGNLVGGKT

SEQ ID NO: 11635 - protein, 9 aa, Borrelia garinii
GNLVGGKTS

SEQ ID NO: 11636 - protein, 9 aa, Borrelia garinii
NLVGGKTSV

SEQ ID NO: 11637 - protein, 9 aa, Borrelia garinii
LVGGKTSVE

SEQ ID NO: 11638 - protein, 9 aa, Borrelia garinii
VGGKTSVEI

SEQ ID NO: 11639 - protein, 9 aa, Borrelia garinii
GGKTSVEIK

SEQ ID NO: 11640 - protein, 9 aa, Borrelia garinii
GKTSVEIKE

SEQ ID NO: 11641 - protein, 9 aa, Borrelia garinii
KTSVEIKEG

SEQ ID NO: 11642 - protein, 9 aa, Borrelia garinii
TSVEIKEGT

SEQ ID NO: 11643 - protein, 9 aa, Borrelia garinii
SVEIKEGTV

SEQ ID NO: 11644 - protein, 9 aa, Borrelia garinii
VEIKEGTVT

SEQ ID NO: 11645 - protein, 9 aa, Borrelia garinii
EIKEGTVTL

SEQ ID NO: 11646 - protein, 9 aa, Borrelia garinii
IKEGTVTLK

SEQ ID NO: 11647 - protein, 9 aa, Borrelia garinii
KEGTVTLKK

SEQ ID NO: 11648 - protein, 9 aa, Borrelia garinii
EGTVTLKKE

SEQ ID NO: 11649 - protein, 9 aa, Borrelia garinii
GTVTLKKEI

SEQ ID NO: 11650 - protein, 9 aa, Borrelia garinii
TVTLKKEIE

SEQ ID NO: 11651 - protein, 9 aa, Borrelia garinii
VTLKKEIEK

SEQ ID NO: 11652 - protein, 9 aa, Borrelia garinii
TLKKEIEKA

SEQ ID NO: 11653 - protein, 9 aa, Borrelia garinii
LKKEIEKAG

SEQ ID NO: 11654 - protein, 9 aa, Borrelia garinii
KKEIEKAGT

SEQ ID NO: 11655 - protein, 9 aa, Borrelia garinii
KEIEKAGTV

SEQ ID NO: 11656 - protein, 9 aa, Borrelia garinii
EIEKAGTVK

SEQ ID NO: 11657 - protein, 9 aa, Borrelia garinii
IEKAGTVKL

SEQ ID NO: 11658 - protein, 9 aa, Borrelia garinii
EKAGTVKLF

SEQ ID NO: 11659 - protein, 9 aa, Borrelia garinii
KAGTVKLFL

SEQ ID NO: 11660 - protein, 9 aa, Borrelia garinii
AGTVKLFLD

SEQ ID NO: 11661 - protein, 9 aa, Borrelia garinii
GTVKLFLDD

SEQ ID NO: 11662 - protein, 9 aa, Borrelia garinii
TVKLFLDDT

SEQ ID NO: 11663 - protein, 9 aa, Borrelia garinii
VKLFLDDTS

SEQ ID NO: 11664 - protein, 9 aa, Borrelia garinii
KLFLDDTSS

SEQ ID NO: 11665 - protein, 9 aa, Borrelia garinii
LFLDDTSSG

SEQ ID NO: 11666 - protein, 9 aa, Borrelia garinii
FLDDTSSGS

SEQ ID NO: 11667 - protein, 9 aa, Borrelia garinii
LDDTSSGST

SEQ ID NO: 11668 - protein, 9 aa, Borrelia garinii
DDTSSGSTK

SEQ ID NO: 11669 - protein, 9 aa, Borrelia garinii
DTSSGSTKK

SEQ ID NO: 11670 - protein, 9 aa, Borrelia garinii
TSSGSTKKT

SEQ ID NO: 11671 - protein, 9 aa, Borrelia garinii
SSGSTKKTA

SEQ ID NO: 11672 - protein, 9 aa, Borrelia garinii
SGSTKKTAV

SEQ ID NO: 11673 - protein, 9 aa, Borrelia garinii
GSTKKTAVW

SEQ ID NO: 11674 - protein, 9 aa, Borrelia garinii
STKKTAVWS

SEQ ID NO: 11675 - protein, 9 aa, Borrelia garinii
TKKTAVWSD

SEQ ID NO: 11676 - protein, 9 aa, Borrelia garinii
KKTAVWSDT

SEQ ID NO: 11677 - protein, 9 aa, Borrelia garinii
KTAVWSDTS

SEQ ID NO: 11678 - protein, 9 aa, Borrelia garinii
TAVWSDTSN

SEQ ID NO: 11679 - protein, 9 aa, Borrelia garinii
AVWSDTSNT

SEQ ID NO: 11680 - protein, 9 aa, Borrelia garinii
VWSDTSNTL

SEQ ID NO: 11681 - protein, 9 aa, Borrelia garinii
WSDTSNTLT

SEQ ID NO: 11682 - protein, 9 aa, Borrelia garinii
SDTSNTLTV

SEQ ID NO: 11683 - protein, 9 aa, Borrelia garinii
DTSNTLTVS

SEQ ID NO: 11684 - protein, 9 aa, Borrelia garinii
TSNTLTVSA

SEQ ID NO: 11685 - protein, 9 aa, Borrelia garinii
SNTLTVSAD

SEQ ID NO: 11686 - protein, 9 aa, Borrelia garinii
NTLTVSADS

SEQ ID NO: 11687 - protein, 9 aa, Borrelia garinii
TLTVSADSK

SEQ ID NO: 11688 - protein, 9 aa, Borrelia garinii
LTVSADSKK

SEQ ID NO: 11689 - protein, 9 aa, Borrelia garinii
TVSADSKKI

SEQ ID NO: 11690 - protein, 9 aa, Borrelia garinii
VSADSKKIK

SEQ ID NO: 11691 - protein, 9 aa, Borrelia garinii
SADSKKIKD

SEQ ID NO: 11692 - protein, 9 aa, Borrelia garinii
ADSKKIKDF

SEQ ID NO: 11693 - protein, 9 aa, Borrelia garinii
DSKKIKDFV

SEQ ID NO: 11694 - protein, 9 aa, Borrelia garinii
SKKIKDFVF

SEQ ID NO: 11695 - protein, 9 aa, Borrelia garinii
KKIKDFVFL

SEQ ID NO: 11696 - protein, 9 aa, Borrelia garinii
KIKDFVFLT

SEQ ID NO: 11697 - protein, 9 aa, Borrelia garinii
IKDFVFLTD

SEQ ID NO: 11698 - protein, 9 aa, Borrelia garinii
KDFVFLTDG

SEQ ID NO: 11699 - protein, 9 aa, Borrelia garinii
DFVFLTDGT

SEQ ID NO: 11700 - protein, 9 aa, Borrelia garinii
FVFLTDGTI

SEQ ID NO: 11701 - protein, 9 aa, Borrelia garinii
VFLTDGTIT

SEQ ID NO: 11702 - protein, 9 aa, Borrelia garinii
FLTDGTITV

SEQ ID NO: 11703 - protein, 9 aa, Borrelia garinii
LTDGTITVQ

SEQ ID NO: 11704 - protein, 9 aa, Borrelia garinii
TDGTITVQN

SEQ ID NO: 11705 - protein, 9 aa, Borrelia garinii
DGTITVQNY

SEQ ID NO: 11706 - protein, 9 aa, Borrelia garinii
GTITVQNYD

SEQ ID NO: 11707 - protein, 9 aa, Borrelia garinii
TITVQNYDT

SEQ ID NO: 11708 - protein, 9 aa, Borrelia garinii
ITVQNYDTA

SEQ ID NO: 11709 - protein, 9 aa, Borrelia garinii
TVQNYDTAG

SEQ ID NO: 11710 - protein, 9 aa, Borrelia garinii
VQNYDTAGT

SEQ ID NO: 11711 - protein, 9 aa, Borrelia garinii
QNYDTAGTK

SEQ ID NO: 11712 - protein, 9 aa, Borrelia garinii
NYDTAGTKL

SEQ ID NO: 11713 - protein, 9 aa, Borrelia garinii
YDTAGTKLA

SEQ ID NO: 11714 - protein, 9 aa, Borrelia garinii
DTAGTKLAG

SEQ ID NO: 11715 - protein, 9 aa, Borrelia garinii
TAGTKLAGT

SEQ ID NO: 11716 - protein, 9 aa, Borrelia garinii
AGTKLAGTA

SEQ ID NO: 11717 - protein, 9 aa, Borrelia garinii
GTKLAGTAT

SEQ ID NO: 11718 - protein, 9 aa, Borrelia garinii
TKLAGTATE

SEQ ID NO: 11719 - protein, 9 aa, Borrelia garinii
KLAGTATEI

SEQ ID NO: 11720 - protein, 9 aa, Borrelia garinii
LAGTATEIK

SEQ ID NO: 11721 - protein, 9 aa, Borrelia garinii
AGTATEIKD

SEQ ID NO: 11722 - protein, 9 aa, Borrelia garinii
GTATEIKDL

SEQ ID NO: 11723 - protein, 9 aa, Borrelia garinii
TATEIKDLE

SEQ ID NO: 11724 - protein, 9 aa, Borrelia garinii
ATEIKDLEA

SEQ ID NO: 11725 - protein, 9 aa, Borrelia garinii
TEIKDLEAL

SEQ ID NO: 11726 - protein, 9 aa, Borrelia garinii
EIKDLEALK

SEQ ID NO: 11727 - protein, 9 aa, Borrelia garinii
IKDLEALKA

SEQ ID NO: 11728 - protein, 9 aa, Borrelia garinii
KDLEALKAA

SEQ ID NO: 11729 - protein, 9 aa, Borrelia garinii
DLEALKAAL

SEQ ID NO: 11730 - protein, 9 aa, Borrelia garinii
LEALKAALK

SEQ ID NO: 11731 - protein, 10 aa, Borrelia garinii
MKKYLLGFAL

SEQ ID NO: 11732 - protein, 10 aa, Borrelia garinii
KKYLLGFALV

SEQ ID NO: 11733 - protein, 10 aa, Borrelia garinii
KYLLGFALVL

SEQ ID NO: 11734 - protein, 10 aa, Borrelia garinii
YLLGFALVLA

SEQ ID NO: 11735 - protein, 10 aa, Borrelia garinii
LLGFALVLAL

SEQ ID NO: 11736 - protein, 10 aa, Borrelia garinii
LGFALVLALI

SEQ ID NO: 11737 - protein, 10 aa, Borrelia garinii
GFALVLALIA

SEQ ID NO: 11738 - protein, 10 aa, Borrelia garinii
FALVLALIAC

SEQ ID NO: 11739 - protein, 10 aa, Borrelia garinii
ALVLALIACG

SEQ ID NO: 11740 - protein, 10 aa, Borrelia garinii
LVLALIACGQ

SEQ ID NO: 11741 - protein, 10 aa, Borrelia garinii
VLALIACGQK

SEQ ID NO: 11742 - protein, 10 aa, Borrelia garinii
LALIACGQKG

SEQ ID NO: 11743 - protein, 10 aa, Borrelia garinii
ALIACGQKGA

SEQ ID NO: 11744 - protein, 10 aa, Borrelia garinii
LIACGQKGAE

SEQ ID NO: 11745 - protein, 10 aa, Borrelia garinii
IACGQKGAEP

SEQ ID NO: 11746 - protein, 10 aa, Borrelia garinii
ACGQKGAEPK

SEQ ID NO: 11747 - protein, 10 aa, Borrelia garinii
CGQKGAEPKH

SEQ ID NO: 11748 - protein, 10 aa, Borrelia garinii
GQKGAEPKHN

SEQ ID NO: 11749 - protein, 10 aa, Borrelia garinii
QKGAEPKHND

SEQ ID NO: 11750 - protein, 10 aa, Borrelia garinii
KGAEPKHNDQ

SEQ ID NO: 11751 - protein, 10 aa, Borrelia garinii
GAEPKHNDQE

SEQ ID NO: 11752 - protein, 10 aa, Borrelia garinii
AEPKHNDQEV

SEQ ID NO: 11753 - protein, 10 aa, Borrelia garinii
EPKHNDQEVE

SEQ ID NO: 11754 - protein, 10 aa, Borrelia garinii
PKHNDQEVED

SEQ ID NO: 11755 - protein, 10 aa, Borrelia garinii
KHNDQEVEDS

SEQ ID NO: 11756 - protein, 10 aa, Borrelia garinii
HNDQEVEDSK

SEQ ID NO: 11757 - protein, 10 aa, Borrelia garinii
NDQEVEDSKK

SEQ ID NO: 11758 - protein, 10 aa, Borrelia garinii
DQEVEDSKKD

SEQ ID NO: 11759 - protein, 10 aa, Borrelia garinii
QEVEDSKKDQ

SEQ ID NO: 11760 - protein, 10 aa, Borrelia garinii
EVEDSKKDQK

SEQ ID NO: 11761 - protein, 10 aa, Borrelia garinii
VEDSKKDQKD

SEQ ID NO: 11762 - protein, 10 aa, Borrelia garinii
EDSKKDQKDA

SEQ ID NO: 11763 - protein, 10 aa, Borrelia garinii
DSKKDQKDAS

SEQ ID NO: 11764 - protein, 10 aa, Borrelia garinii
SKKDQKDASK

SEQ ID NO: 11765 - protein, 10 aa, Borrelia garinii
KKDQKDASKK

SEQ ID NO: 11766 - protein, 10 aa, Borrelia garinii
KDQKDASKKD

SEQ ID NO: 11767 - protein, 10 aa, Borrelia garinii
DQKDASKKDL

SEQ ID NO: 11768 - protein, 10 aa, Borrelia garinii
QKDASKKDLP

SEQ ID NO: 11769 - protein, 10 aa, Borrelia garinii
KDASKKDLPL

SEQ ID NO: 11770 - protein, 10 aa, Borrelia garinii
DASKKDLPLV

SEQ ID NO: 11771 - protein, 10 aa, Borrelia garinii
ASKKDLPLVT

SEQ ID NO: 11772 - protein, 10 aa, Borrelia garinii
SKKDLPLVTE

SEQ ID NO: 11773 - protein, 10 aa, Borrelia garinii
KKDLPLVTED

SEQ ID NO: 11774 - protein, 10 aa, Borrelia garinii
KDLPLVTEDT

SEQ ID NO: 11775 - protein, 10 aa, Borrelia garinii
DLPLVTEDTV

SEQ ID NO: 11776 - protein, 10 aa, Borrelia garinii
LPLVTEDTVK

SEQ ID NO: 11777 - protein, 10 aa, Borrelia garinii
PLVTEDTVKL

SEQ ID NO: 11778 - protein, 10 aa, Borrelia garinii
LVTEDTVKLF

SEQ ID NO: 11779 - protein, 10 aa, Borrelia garinii
VTEDTVKLFN

SEQ ID NO: 11780 - protein, 10 aa, Borrelia garinii
TEDTVKLFND

SEQ ID NO: 11781 - protein, 10 aa, Borrelia garinii
EDTVKLFNDT

SEQ ID NO: 11782 - protein, 10 aa, Borrelia garinii
DTVKLFNDTK

SEQ ID NO: 11783 - protein, 10 aa, Borrelia garinii
TVKLFNDTKI

SEQ ID NO: 11784 - protein, 10 aa, Borrelia garinii
VKLFNDTKIF

SEQ ID NO: 11785 - protein, 10 aa, Borrelia garinii
KLFNDTKIFI

SEQ ID NO: 11786 - protein, 10 aa, Borrelia garinii
LFNDTKIFIS

SEQ ID NO: 11787 - protein, 10 aa, Borrelia garinii
FNDTKIFISK

SEQ ID NO: 11788 - protein, 10 aa, Borrelia garinii
NDTKIFISKE

SEQ ID NO: 11789 - protein, 10 aa, Borrelia garinii
DTKIFISKEK

SEQ ID NO: 11790 - protein, 10 aa, Borrelia garinii
TKIFISKEKN

SEQ ID NO: 11791 - protein, 10 aa, Borrelia garinii
KIFISKEKNK

SEQ ID NO: 11792 - protein, 10 aa, Borrelia garinii
IFISKEKNKD

SEQ ID NO: 11793 - protein, 10 aa, Borrelia garinii
FISKEKNKDG

SEQ ID NO: 11794 - protein, 10 aa, Borrelia garinii
ISKEKNKDGK

SEQ ID NO: 11795 - protein, 10 aa, Borrelia garinii
SKEKNKDGKY

SEQ ID NO: 11796 - protein, 10 aa, Borrelia garinii
KEKNKDGKYE

SEQ ID NO: 11797 - protein, 10 aa, Borrelia garinii
EKNKDGKYEL

SEQ ID NO: 11798 - protein, 10 aa, Borrelia garinii
KNKDGKYELR

SEQ ID NO: 11799 - protein, 10 aa, Borrelia garinii
NKDGKYELRA

SEQ ID NO: 11800 - protein, 10 aa, Borrelia garinii
KDGKYELRAT

SEQ ID NO: 11801 - protein, 10 aa, Borrelia garinii
DGKYELRATV

SEQ ID NO: 11802 - protein, 10 aa, Borrelia garinii
GKYELRATVD

SEQ ID NO: 11803 - protein, 10 aa, Borrelia garinii
KYELRATVDT

SEQ ID NO: 11804 - protein, 10 aa, Borrelia garinii
YELRATVDTV

SEQ ID NO: 11805 - protein, 10 aa, Borrelia garinii
ELRATVDTVE

SEQ ID NO: 11806 - protein, 10 aa, Borrelia garinii
LRATVDTVEL

SEQ ID NO: 11807 - protein, 10 aa, Borrelia garinii
RATVDTVELK

SEQ ID NO: 11808 - protein, 10 aa, Borrelia garinii
ATVDTVELKG

SEQ ID NO: 11809 - protein, 10 aa, Borrelia garinii
TVDTVELKGV

SEQ ID NO: 11810 - protein, 10 aa, Borrelia garinii
VDTVELKGVA

SEQ ID NO: 11811 - protein, 10 aa, Borrelia garinii
DTVELKGVAD

SEQ ID NO: 11812 - protein, 10 aa, Borrelia garinii
TVELKGVADK

SEQ ID NO: 11813 - protein, 10 aa, Borrelia garinii
VELKGVADKN

SEQ ID NO: 11814 - protein, 10 aa, Borrelia garinii
ELKGVADKND

SEQ ID NO: 11815 - protein, 10 aa, Borrelia garinii
LKGVADKNDG

SEQ ID NO: 11816 - protein, 10 aa, Borrelia garinii
KGVADKNDGS

SEQ ID NO: 11817 - protein, 10 aa, Borrelia garinii
GVADKNDGSG

SEQ ID NO: 11818 - protein, 10 aa, Borrelia garinii
VADKNDGSGG

SEQ ID NO: 11819 - protein, 10 aa, Borrelia garinii
ADKNDGSGGK

SEQ ID NO: 11820 - protein, 10 aa, Borrelia garinii
DKNDGSGGKL

SEQ ID NO: 11821 - protein, 10 aa, Borrelia garinii
KNDGSGGKLE

SEQ ID NO: 11822 - protein, 10 aa, Borrelia garinii
NDGSGGKLEG

SEQ ID NO: 11823 - protein, 10 aa, Borrelia garinii
DGSGGKLEGV

SEQ ID NO: 11824 - protein, 10 aa, Borrelia garinii
GSGGKLEGVK

SEQ ID NO: 11825 - protein, 10 aa, Borrelia garinii
SGGKLEGVKS

SEQ ID NO: 11826 - protein, 10 aa, Borrelia garinii
GGKLEGVKSD

SEQ ID NO: 11827 - protein, 10 aa, Borrelia garinii
GKLEGVKSDQ

SEQ ID NO: 11828 - protein, 10 aa, Borrelia garinii
KLEGVKSDQS

SEQ ID NO: 11829 - protein, 10 aa, Borrelia garinii
LEGVKSDQSK

SEQ ID NO: 11830 - protein, 10 aa, Borrelia garinii
EGVKSDQSKV

SEQ ID NO: 11831 - protein, 10 aa, Borrelia garinii
GVKSDQSKVT

SEQ ID NO: 11832 - protein, 10 aa, Borrelia garinii
VKSDQSKVTM

SEQ ID NO: 11833 - protein, 10 aa, Borrelia garinii
KSDQSKVTMS

SEQ ID NO: 11834 - protein, 10 aa, Borrelia garinii
SDQSKVTMSI

SEQ ID NO: 11835 - protein, 10 aa, Borrelia garinii
DQSKVTMSIT

SEQ ID NO: 11836 - protein, 10 aa, Borrelia garinii
QSKVTMSITD

SEQ ID NO: 11837 - protein, 10 aa, Borrelia garinii
SKVTMSITDD

SEQ ID NO: 11838 - protein, 10 aa, Borrelia garinii
KVTMSITDDL

SEQ ID NO: 11839 - protein, 10 aa, Borrelia garinii
VTMSITDDLN

SEQ ID NO: 11840 - protein, 10 aa, Borrelia garinii
TMSITDDLNT

SEQ ID NO: 11841 - protein, 10 aa, Borrelia garinii
MSITDDLNTI

SEQ ID NO: 11842 - protein, 10 aa, Borrelia garinii
SITDDLNTIT

SEQ ID NO: 11843 - protein, 10 aa, Borrelia garinii
ITDDLNTITV

SEQ ID NO: 11844 - protein, 10 aa, Borrelia garinii
TDDLNTITVE

SEQ ID NO: 11845 - protein, 10 aa, Borrelia garinii
DDLNTITVET

SEQ ID NO: 11846 - protein, 10 aa, Borrelia garinii
DLNTITVETY

SEQ ID NO: 11847 - protein, 10 aa, Borrelia garinii
LNTITVETYD

SEQ ID NO: 11848 - protein, 10 aa, Borrelia garinii
NTITVETYDS

SEQ ID NO: 11849 - protein, 10 aa, Borrelia garinii
TITVETYDSS

SEQ ID NO: 11850 - protein, 10 aa, Borrelia garinii
ITVETYDSSN

SEQ ID NO: 11851 - protein, 10 aa, Borrelia garinii
TVETYDSSNT

SEQ ID NO: 11852 - protein, 10 aa, Borrelia garinii
VETYDSSNTK

SEQ ID NO: 11853 - protein, 10 aa, Borrelia garinii
ETYDSSNTKV

SEQ ID NO: 11854 - protein, 10 aa, Borrelia garinii
TYDSSNTKVA

SEQ ID NO: 11855 - protein, 10 aa, Borrelia garinii
YDSSNTKVAS

SEQ ID NO: 11856 - protein, 10 aa, Borrelia garinii
DSSNTKVASK

SEQ ID NO: 11857 - protein, 10 aa, Borrelia garinii
SSNTKVASKV

SEQ ID NO: 11858 - protein, 10 aa, Borrelia garinii
SNTKVASKVF

SEQ ID NO: 11859 - protein, 10 aa, Borrelia garinii
NTKVASKVFK

SEQ ID NO: 11860 - protein, 10 aa, Borrelia garinii
TKVASKVFKK

SEQ ID NO: 11861 - protein, 10 aa, Borrelia garinii
KVASKVFKKQ

SEQ ID NO: 11862 - protein, 10 aa, Borrelia garinii
VASKVFKKQG

SEQ ID NO: 11863 - protein, 10 aa, Borrelia garinii
ASKVFKKQGS

SEQ ID NO: 11864 - protein, 10 aa, Borrelia garinii
SKVFKKQGSL

SEQ ID NO: 11865 - protein, 10 aa, Borrelia garinii
KVFKKQGSLT

SEQ ID NO: 11866 - protein, 10 aa, Borrelia garinii
VFKKQGSLTE

SEQ ID NO: 11867 - protein, 10 aa, Borrelia garinii
FKKQGSLTEE

SEQ ID NO: 11868 - protein, 10 aa, Borrelia garinii
KKQGSLTEET

SEQ ID NO: 11869 - protein, 10 aa, Borrelia garinii
KQGSLTEETE

SEQ ID NO: 11870 - protein, 10 aa, Borrelia garinii
QGSLTEETEE

SEQ ID NO: 11871 - protein, 10 aa, Borrelia garinii
GSLTEETEET

SEQ ID NO: 11872 - protein, 10 aa, Borrelia garinii
SLTEETEETY

SEQ ID NO: 11873 - protein, 10 aa, Borrelia garinii
LTEETEETYK

SEQ ID NO: 11874 - protein, 10 aa, Borrelia garinii
TEETEETYKT

SEQ ID NO: 11875 - protein, 10 aa, Borrelia garinii
EETEETYKTG

SEQ ID NO: 11876 - protein, 10 aa, Borrelia garinii
ETEETYKTGK

SEQ ID NO: 11877 - protein, 10 aa, Borrelia garinii
TEETYKTGKL

SEQ ID NO: 11878 - protein, 10 aa, Borrelia garinii
EETYKTGKLS

SEQ ID NO: 11879 - protein, 10 aa, Borrelia garinii
ETYKTGKLST

SEQ ID NO: 11880 - protein, 10 aa, Borrelia garinii
TYKTGKLSTK

SEQ ID NO: 11881 - protein, 10 aa, Borrelia garinii
YKTGKLSTKK

SEQ ID NO: 11882 - protein, 10 aa, Borrelia garinii
KTGKLSTKKI

SEQ ID NO: 11883 - protein, 10 aa, Borrelia garinii
TGKLSTKKIT

SEQ ID NO: 11884 - protein, 10 aa, Borrelia garinii
GKLSTKKITR

SEQ ID NO: 11885 - protein, 10 aa, Borrelia garinii
KLSTKKITRT

SEQ ID NO: 11886 - protein, 10 aa, Borrelia garinii
LSTKKITRTN

SEQ ID NO: 11887 - protein, 10 aa, Borrelia garinii
STKKITRTNG

SEQ ID NO: 11888 - protein, 10 aa, Borrelia garinii
TKKITRTNGT

SEQ ID NO: 11889 - protein, 10 aa, Borrelia garinii
KKITRTNGTT

SEQ ID NO: 11890 - protein, 10 aa, Borrelia garinii
KITRTNGTTL

SEQ ID NO: 11891 - protein, 10 aa, Borrelia garinii
ITRTNGTTLE

SEQ ID NO: 11892 - protein, 10 aa, Borrelia garinii
TRTNGTTLEY

SEQ ID NO: 11893 - protein, 10 aa, Borrelia garinii
RTNGTTLEYS

SEQ ID NO: 11894 - protein, 10 aa, Borrelia garinii
TNGTTLEYSD

SEQ ID NO: 11895 - protein, 10 aa, Borrelia garinii
NGTTLEYSDM

SEQ ID NO: 11896 - protein, 10 aa, Borrelia garinii
GTTLEYSDMT

SEQ ID NO: 11897 - protein, 10 aa, Borrelia garinii
TTLEYSDMTN

SEQ ID NO: 11898 - protein, 10 aa, Borrelia garinii
TLEYSDMTND

SEQ ID NO: 11899 - protein, 10 aa, Borrelia garinii
LEYSDMTNDE

SEQ ID NO: 11900 - protein, 10 aa, Borrelia garinii
EYSDMTNDEN

SEQ ID NO: 11901 - protein, 10 aa, Borrelia garinii
YSDMTNDENA

SEQ ID NO: 11902 - protein, 10 aa, Borrelia garinii
SDMTNDENAT

SEQ ID NO: 11903 - protein, 10 aa, Borrelia garinii
DMTNDENATK

SEQ ID NO: 11904 - protein, 10 aa, Borrelia garinii
MTNDENATKA

SEQ ID NO: 11905 - protein, 10 aa, Borrelia garinii
TNDENATKAV

SEQ ID NO: 11906 - protein, 10 aa, Borrelia garinii
NDENATKAVE

SEQ ID NO: 11907 - protein, 10 aa, Borrelia garinii
DENATKAVET

SEQ ID NO: 11908 - protein, 10 aa, Borrelia garinii
ENATKAVETL

SEQ ID NO: 11909 - protein, 10 aa, Borrelia garinii
NATKAVETLK

SEQ ID NO: 11910 - protein, 10 aa, Borrelia garinii
ATKAVETLKN

SEQ ID NO: 11911 - protein, 10 aa, Borrelia garinii
TKAVETLKNG

SEQ ID NO: 11912 - protein, 10 aa, Borrelia garinii
KAVETLKNGI

SEQ ID NO: 11913 - protein, 10 aa, Borrelia garinii
AVETLKNGIM

SEQ ID NO: 11914 - protein, 10 aa, Borrelia garinii
VETLKNGIML

SEQ ID NO: 11915 - protein, 10 aa, Borrelia garinii
ETLKNGIMLE

SEQ ID NO: 11916 - protein, 10 aa, Borrelia garinii
TLKNGIMLEG

SEQ ID NO: 11917 - protein, 10 aa, Borrelia garinii
LKNGIMLEGN

SEQ ID NO: 11918 - protein, 10 aa, Borrelia garinii
KNGIMLEGNL

SEQ ID NO: 11919 - protein, 10 aa, Borrelia garinii
NGIMLEGNLV

SEQ ID NO: 11920 - protein, 10 aa, Borrelia garinii
GIMLEGNLVG

SEQ ID NO: 11921 - protein, 10 aa, Borrelia garinii
IMLEGNLVGG

SEQ ID NO: 11922 - protein, 10 aa, Borrelia garinii
MLEGNLVGGK

SEQ ID NO: 11923 - protein, 10 aa, Borrelia garinii
LEGNLVGGKT

SEQ ID NO: 11924 - protein, 10 aa, Borrelia garinii
EGNLVGGKTS

SEQ ID NO: 11925 - protein, 10 aa, Borrelia garinii
GNLVGGKTSV

SEQ ID NO: 11926 - protein, 10 aa, Borrelia garinii
NLVGGKTSVE

SEQ ID NO: 11927 - protein, 10 aa, Borrelia garinii
LVGGKTSVEI

SEQ ID NO: 11928 - protein, 10 aa, Borrelia garinii
VGGKTSVEIK

SEQ ID NO: 11929 - protein, 10 aa, Borrelia garinii
GGKTSVEIKE

SEQ ID NO: 11930 - protein, 10 aa, Borrelia garinii
GKTSVEIKEG

SEQ ID NO: 11931 - protein, 10 aa, Borrelia garinii
KTSVEIKEGT

SEQ ID NO: 11932 - protein, 10 aa, Borrelia garinii
TSVEIKEGTV

SEQ ID NO: 11933 - protein, 10 aa, Borrelia garinii
SVEIKEGTVT

SEQ ID NO: 11934 - protein, 10 aa, Borrelia garinii
VEIKEGTVTL

SEQ ID NO: 11935 - protein, 10 aa, Borrelia garinii
EIKEGTVTLK

SEQ ID NO: 11936 - protein, 10 aa, Borrelia garinii
IKEGTVTLKK

SEQ ID NO: 11937 - protein, 10 aa, Borrelia garinii
KEGTVTLKKE

SEQ ID NO: 11938 - protein, 10 aa, Borrelia garinii
EGTVTLKKEI

SEQ ID NO: 11939 - protein, 10 aa, Borrelia garinii
GTVTLKKEIE

SEQ ID NO: 11940 - protein, 10 aa, Borrelia garinii
TVTLKKEIEK

SEQ ID NO: 11941 - protein, 10 aa, Borrelia garinii
VTLKKEIEKA

SEQ ID NO: 11942 - protein, 10 aa, Borrelia garinii
TLKKEIEKAG

SEQ ID NO: 11943 - protein, 10 aa, Borrelia garinii
LKKEIEKAGT

SEQ ID NO: 11944 - protein, 10 aa, Borrelia garinii
KKEIEKAGTV

SEQ ID NO: 11945 - protein, 10 aa, Borrelia garinii
KEIEKAGTVK

SEQ ID NO: 11946 - protein, 10 aa, Borrelia garinii
EIEKAGTVKL

SEQ ID NO: 11947 - protein, 10 aa, Borrelia garinii
IEKAGTVKLF

SEQ ID NO: 11948 - protein, 10 aa, Borrelia garinii
EKAGTVKLFL

SEQ ID NO: 11949 - protein, 10 aa, Borrelia garinii
KAGTVKLFLD

SEQ ID NO: 11950 - protein, 10 aa, Borrelia garinii
AGTVKLFLDD

SEQ ID NO: 11951 - protein, 10 aa, Borrelia garinii
GTVKLFLDDT

SEQ ID NO: 11952 - protein, 10 aa, Borrelia garinii
TVKLFLDDTS

SEQ ID NO: 11953 - protein, 10 aa, Borrelia garinii
VKLFLDDTSS

SEQ ID NO: 11954 - protein, 10 aa, Borrelia garinii
KLFLDDTSSG

SEQ ID NO: 11955 - protein, 10 aa, Borrelia garinii
LFLDDTSSGS

SEQ ID NO: 11956 - protein, 10 aa, Borrelia garinii
FLDDTSSGST

SEQ ID NO: 11957 - protein, 10 aa, Borrelia garinii
LDDTSSGSTK

SEQ ID NO: 11958 - protein, 10 aa, Borrelia garinii
DDTSSGSTKK

SEQ ID NO: 11959 - protein, 10 aa, Borrelia garinii
DTSSGSTKKT

SEQ ID NO: 11960 - protein, 10 aa, Borrelia garinii
TSSGSTKKTA

SEQ ID NO: 11961 - protein, 10 aa, Borrelia garinii
SSGSTKKTAV

SEQ ID NO: 11962 - protein, 10 aa, Borrelia garinii
SGSTKKTAVW

SEQ ID NO: 11963 - protein, 10 aa, Borrelia garinii
GSTKKTAVWS

SEQ ID NO: 11964 - protein, 10 aa, Borrelia garinii
STKKTAVWSD

SEQ ID NO: 11965 - protein, 10 aa, Borrelia garinii
TKKTAVWSDT

SEQ ID NO: 11966 - protein, 10 aa, Borrelia garinii
KKTAVWSDTS

SEQ ID NO: 11967 - protein, 10 aa, Borrelia garinii
KTAVWSDTSN

SEQ ID NO: 11968 - protein, 10 aa, Borrelia garinii
TAVWSDTSNT

SEQ ID NO: 11969 - protein, 10 aa, Borrelia garinii
AVWSDTSNTL

SEQ ID NO: 11970 - protein, 10 aa, Borrelia garinii
VWSDTSNTLT

SEQ ID NO: 11971 - protein, 10 aa, Borrelia garinii
WSDTSNTLTV

SEQ ID NO: 11972 - protein, 10 aa, Borrelia garinii
SDTSNTLTVS

SEQ ID NO: 11973 - protein, 10 aa, Borrelia garinii
DTSNTLTVSA

SEQ ID NO: 11974 - protein, 10 aa, Borrelia garinii
TSNTLTVSAD

SEQ ID NO: 11975 - protein, 10 aa, Borrelia garinii
SNTLTVSADS

SEQ ID NO: 11976 - protein, 10 aa, Borrelia garinii
NTLTVSADSK

SEQ ID NO: 11977 - protein, 10 aa, Borrelia garinii
TLTVSADSKK

SEQ ID NO: 11978 - protein, 10 aa, Borrelia garinii
LTVSADSKKI

SEQ ID NO: 11979 - protein, 10 aa, Borrelia garinii
TVSADSKKIK

SEQ ID NO: 11980 - protein, 10 aa, Borrelia garinii
VSADSKKIKD

SEQ ID NO: 11981 - protein, 10 aa, Borrelia garinii
SADSKKIKDF

SEQ ID NO: 11982 - protein, 10 aa, Borrelia garinii
ADSKKIKDFV

SEQ ID NO: 11983 - protein, 10 aa, Borrelia garinii
DSKKIKDFVF

SEQ ID NO: 11984 - protein, 10 aa, Borrelia garinii
SKKIKDFVFL

SEQ ID NO: 11985 - protein, 10 aa, Borrelia garinii
KKIKDFVFLT

SEQ ID NO: 11986 - protein, 10 aa, Borrelia garinii
KIKDFVFLTD

SEQ ID NO: 11987 - protein, 10 aa, Borrelia garinii
IKDFVFLTDG

SEQ ID NO: 11988 - protein, 10 aa, Borrelia garinii
KDFVFLTDGT

SEQ ID NO: 11989 - protein, 10 aa, Borrelia garinii
DFVFLTDGTI

SEQ ID NO: 11990 - protein, 10 aa, Borrelia garinii
FVFLTDGTIT

SEQ ID NO: 11991 - protein, 10 aa, Borrelia garinii
VFLTDGTITV

SEQ ID NO: 11992 - protein, 10 aa, Borrelia garinii
FLTDGTITVQ

SEQ ID NO: 11993 - protein, 10 aa, Borrelia garinii
LTDGTITVQN

SEQ ID NO: 11994 - protein, 10 aa, Borrelia garinii
TDGTITVQNY

SEQ ID NO: 11995 - protein, 10 aa, Borrelia garinii
DGTITVQNYD

SEQ ID NO: 11996 - protein, 10 aa, Borrelia garinii
GTITVQNYDT

SEQ ID NO: 11997 - protein, 10 aa, Borrelia garinii
TITVQNYDTA

SEQ ID NO: 11998 - protein, 10 aa, Borrelia garinii
ITVQNYDTAG

SEQ ID NO: 11999 - protein, 10 aa, Borrelia garinii
TVQNYDTAGT

SEQ ID NO: 12000 - protein, 10 aa, Borrelia garinii
VQNYDTAGTK

SEQ ID NO: 12001 - protein, 10 aa, Borrelia garinii
QNYDTAGTKL

SEQ ID NO: 12002 - protein, 10 aa, Borrelia garinii
NYDTAGTKLA

SEQ ID NO: 12003 - protein, 10 aa, Borrelia garinii
YDTAGTKLAG

SEQ ID NO: 12004 - protein, 10 aa, Borrelia garinii
DTAGTKLAGT

SEQ ID NO: 12005 - protein, 10 aa, Borrelia garinii
TAGTKLAGTA

SEQ ID NO: 12006 - protein, 10 aa, Borrelia garinii
AGTKLAGTAT

SEQ ID NO: 12007 - protein, 10 aa, Borrelia garinii
GTKLAGTATE

SEQ ID NO: 12008 - protein, 10 aa, Borrelia garinii
TKLAGTATEI

SEQ ID NO: 12009 - protein, 10 aa, Borrelia garinii
KLAGTATEIK

SEQ ID NO: 12010 - protein, 10 aa, Borrelia garinii
LAGTATEIKD

SEQ ID NO: 12011 - protein, 10 aa, Borrelia garinii
AGTATEIKDL

SEQ ID NO: 12012 - protein, 10 aa, Borrelia garinii
GTATEIKDLE

SEQ ID NO: 12013 - protein, 10 aa, Borrelia garinii
TATEIKDLEA

SEQ ID NO: 12014 - protein, 10 aa, Borrelia garinii
ATEIKDLEAL

SEQ ID NO: 12015 - protein, 10 aa, Borrelia garinii
TEIKDLEALK

SEQ ID NO: 12016 - protein, 10 aa, Borrelia garinii
EIKDLEALKA

SEQ ID NO: 12017 - protein, 10 aa, Borrelia garinii
IKDLEALKAA

SEQ ID NO: 12018 - protein, 10 aa, Borrelia garinii
KDLEALKAAL

SEQ ID NO: 12019 - protein, 10 aa, Borrelia garinii
DLEALKAALK

SEQ ID NO: 12020 - protein, 11 aa, Borrelia garinii
MKKYLLGFALV

SEQ ID NO: 12021 - protein, 11 aa, Borrelia garinii
KKYLLGFALVL

SEQ ID NO: 12022 - protein, 11 aa, Borrelia garinii
KYLLGFALVLA

SEQ ID NO: 12023 - protein, 11 aa, Borrelia garinii
YLLGFALVLAL

SEQ ID NO: 12024 - protein, 11 aa, Borrelia garinii
LLGFALVLALI

SEQ ID NO: 12025 - protein, 11 aa, Borrelia garinii
LGFALVLALIA

SEQ ID NO: 12026 - protein, 11 aa, Borrelia garinii
GFALVLALIAC

SEQ ID NO: 12027 - protein, 11 aa, Borrelia garinii
FALVLALIACG

SEQ ID NO: 12028 - protein, 11 aa, Borrelia garinii
ALVLALIACGQ

SEQ ID NO: 12029 - protein, 11 aa, Borrelia garinii
LVLALIACGQK

SEQ ID NO: 12030 - protein, 11 aa, Borrelia garinii
VLALIACGQKG

SEQ ID NO: 12031 - protein, 11 aa, Borrelia garinii
LALIACGQKGA

SEQ ID NO: 12032 - protein, 11 aa, Borrelia garinii
ALIACGQKGAE

SEQ ID NO: 12033 - protein, 11 aa, Borrelia garinii
LIACGQKGAEP

SEQ ID NO: 12034 - protein, 11 aa, Borrelia garinii
IACGQKGAEPK

SEQ ID NO: 12035 - protein, 11 aa, Borrelia garinii
ACGQKGAEPKH

SEQ ID NO: 12036 - protein, 11 aa, Borrelia garinii
CGQKGAEPKHN

SEQ ID NO: 12037 - protein, 11 aa, Borrelia garinii
GQKGAEPKHND

SEQ ID NO: 12038 - protein, 11 aa, Borrelia garinii
QKGAEPKHNDQ

SEQ ID NO: 12039 - protein, 11 aa, Borrelia garinii
KGAEPKHNDQE

SEQ ID NO: 12040 - protein, 11 aa, Borrelia garinii
GAEPKHNDQEV

SEQ ID NO: 12041 - protein, 11 aa, Borrelia garinii
AEPKHNDQEVE

SEQ ID NO: 12042 - protein, 11 aa, Borrelia garinii
EPKHNDQEVED

SEQ ID NO: 12043 - protein, 11 aa, Borrelia garinii
PKHNDQEVEDS

SEQ ID NO: 12044 - protein, 11 aa, Borrelia garinii
KHNDQEVEDSK

SEQ ID NO: 12045 - protein, 11 aa, Borrelia garinii
HNDQEVEDSKK

SEQ ID NO: 12046 - protein, 11 aa, Borrelia garinii
NDQEVEDSKKD

SEQ ID NO: 12047 - protein, 11 aa, Borrelia garinii
DQEVEDSKKDQ

SEQ ID NO: 12048 - protein, 11 aa, Borrelia garinii
QEVEDSKKDQK

SEQ ID NO: 12049 - protein, 11 aa, Borrelia garinii
EVEDSKKDQKD

SEQ ID NO: 12050 - protein, 11 aa, Borrelia garinii
VEDSKKDQKDA

SEQ ID NO: 12051 - protein, 11 aa, Borrelia garinii
EDSKKDQKDAS

SEQ ID NO: 12052 - protein, 11 aa, Borrelia garinii
DSKKDQKDASK

SEQ ID NO: 12053 - protein, 11 aa, Borrelia garinii
SKKDQKDASKK

SEQ ID NO: 12054 - protein, 11 aa, Borrelia garinii
KKDQKDASKKD

SEQ ID NO: 12055 - protein, 11 aa, Borrelia garinii
KDQKDASKKDL

SEQ ID NO: 12056 - protein, 11 aa, Borrelia garinii
DQKDASKKDLP

SEQ ID NO: 12057 - protein, 11 aa, Borrelia garinii
QKDASKKDLPL

SEQ ID NO: 12058 - protein, 11 aa, Borrelia garinii
KDASKKDLPLV

SEQ ID NO: 12059 - protein, 11 aa, Borrelia garinii
DASKKDLPLVT

SEQ ID NO: 12060 - protein, 11 aa, Borrelia garinii
ASKKDLPLVTE

SEQ ID NO: 12061 - protein, 11 aa, Borrelia garinii
SKKDLPLVTED

SEQ ID NO: 12062 - protein, 11 aa, Borrelia garinii
KKDLPLVTEDT

SEQ ID NO: 12063 - protein, 11 aa, Borrelia garinii
KDLPLVTEDTV

SEQ ID NO: 12064 - protein, 11 aa, Borrelia garinii
DLPLVTEDTVK

SEQ ID NO: 12065 - protein, 11 aa, Borrelia garinii
LPLVTEDTVKL

SEQ ID NO: 12066 - protein, 11 aa, Borrelia garinii
PLVTEDTVKLF

SEQ ID NO: 12067 - protein, 11 aa, Borrelia garinii
LVTEDTVKLFN

SEQ ID NO: 12068 - protein, 11 aa, Borrelia garinii
VTEDTVKLFND

SEQ ID NO: 12069 - protein, 11 aa, Borrelia garinii
TEDTVKLFNDT

SEQ ID NO: 12070 - protein, 11 aa, Borrelia garinii
EDTVKLFNDTK

SEQ ID NO: 12071 - protein, 11 aa, Borrelia garinii
DTVKLFNDTKI

SEQ ID NO: 12072 - protein, 11 aa, Borrelia garinii
TVKLFNDTKIF

SEQ ID NO: 12073 - protein, 11 aa, Borrelia garinii
VKLFNDTKIFI

SEQ ID NO: 12074 - protein, 11 aa, Borrelia garinii
KLFNDTKIFIS

SEQ ID NO: 12075 - protein, 11 aa, Borrelia garinii
LFNDTKIFISK

SEQ ID NO: 12076 - protein, 11 aa, Borrelia garinii
FNDTKIFISKE

SEQ ID NO: 12077 - protein, 11 aa, Borrelia garinii
NDTKIFISKEK

SEQ ID NO: 12078 - protein, 11 aa, Borrelia garinii
DTKIFISKEKN

SEQ ID NO: 12079 - protein, 11 aa, Borrelia garinii
TKIFISKEKNK

SEQ ID NO: 12080 - protein, 11 aa, Borrelia garinii
KIFISKEKNKD

SEQ ID NO: 12081 - protein, 11 aa, Borrelia garinii
IFISKEKNKDG

SEQ ID NO: 12082 - protein, 11 aa, Borrelia garinii
FISKEKNKDGK

SEQ ID NO: 12083 - protein, 11 aa, Borrelia garinii
ISKEKNKDGKY

SEQ ID NO: 12084 - protein, 11 aa, Borrelia garinii
SKEKNKDGKYE

SEQ ID NO: 12085 - protein, 11 aa, Borrelia garinii
KEKNKDGKYEL

SEQ ID NO: 12086 - protein, 11 aa, Borrelia garinii
EKNKDGKYELR

SEQ ID NO: 12087 - protein, 11 aa, Borrelia garinii
KNKDGKYELRA

SEQ ID NO: 12088 - protein, 11 aa, Borrelia garinii
NKDGKYELRAT

SEQ ID NO: 12089 - protein, 11 aa, Borrelia garinii
KDGKYELRATV

SEQ ID NO: 12090 - protein, 11 aa, Borrelia garinii
DGKYELRATVD

SEQ ID NO: 12091 - protein, 11 aa, Borrelia garinii
GKYELRATVDT

SEQ ID NO: 12092 - protein, 11 aa, Borrelia garinii
KYELRATVDTV

SEQ ID NO: 12093 - protein, 11 aa, Borrelia garinii
YELRATVDTVE

SEQ ID NO: 12094 - protein, 11 aa, Borrelia garinii
ELRATVDTVEL

SEQ ID NO: 12095 - protein, 11 aa, Borrelia garinii
LRATVDTVELK

SEQ ID NO: 12096 - protein, 11 aa, Borrelia garinii
RATVDTVELKG

SEQ ID NO: 12097 - protein, 11 aa, Borrelia garinii
ATVDTVELKGV

SEQ ID NO: 12098 - protein, 11 aa, Borrelia garinii
TVDTVELKGVA

SEQ ID NO: 12099 - protein, 11 aa, Borrelia garinii
VDTVELKGVAD

SEQ ID NO: 12100 - protein, 11 aa, Borrelia garinii
DTVELKGVADK

SEQ ID NO: 12101 - protein, 11 aa, Borrelia garinii
TVELKGVADKN

SEQ ID NO: 12102 - protein, 11 aa, Borrelia garinii
VELKGVADKND

SEQ ID NO: 12103 - protein, 11 aa, Borrelia garinii
ELKGVADKNDG

SEQ ID NO: 12104 - protein, 11 aa, Borrelia garinii
LKGVADKNDGS

SEQ ID NO: 12105 - protein, 11 aa, Borrelia garinii
KGVADKNDGSG

SEQ ID NO: 12106 - protein, 11 aa, Borrelia garinii
GVADKNDGSGG

SEQ ID NO: 12107 - protein, 11 aa, Borrelia garinii
VADKNDGSGGK

SEQ ID NO: 12108 - protein, 11 aa, Borrelia garinii
ADKNDGSGGKL

SEQ ID NO: 12109 - protein, 11 aa, Borrelia garinii
DKNDGSGGKLE

SEQ ID NO: 12110 - protein, 11 aa, Borrelia garinii
KNDGSGGKLEG

SEQ ID NO: 12111 - protein, 11 aa, Borrelia garinii
NDGSGGKLEGV

SEQ ID NO: 12112 - protein, 11 aa, Borrelia garinii
DGSGGKLEGVK

SEQ ID NO: 12113 - protein, 11 aa, Borrelia garinii
GSGGKLEGVKS

SEQ ID NO: 12114 - protein, 11 aa, Borrelia garinii
SGGKLEGVKSD

SEQ ID NO: 12115 - protein, 11 aa, Borrelia garinii
GGKLEGVKSDQ

SEQ ID NO: 12116 - protein, 11 aa, Borrelia garinii
GKLEGVKSDQS

SEQ ID NO: 12117 - protein, 11 aa, Borrelia garinii
KLEGVKSDQSK

SEQ ID NO: 12118 - protein, 11 aa, Borrelia garinii
LEGVKSDQSKV

SEQ ID NO: 12119 - protein, 11 aa, Borrelia garinii
EGVKSDQSKVT

SEQ ID NO: 12120 - protein, 11 aa, Borrelia garinii
GVKSDQSKVTM

SEQ ID NO: 12121 - protein, 11 aa, Borrelia garinii
VKSDQSKVTMS

SEQ ID NO: 12122 - protein, 11 aa, Borrelia garinii
KSDQSKVTMSI

SEQ ID NO: 12123 - protein, 11 aa, Borrelia garinii
SDQSKVTMSIT

SEQ ID NO: 12124 - protein, 11 aa, Borrelia garinii
DQSKVTMSITD

SEQ ID NO: 12125 - protein, 11 aa, Borrelia garinii
QSKVTMSITDD

SEQ ID NO: 12126 - protein, 11 aa, Borrelia garinii
SKVTMSITDDL

SEQ ID NO: 12127 - protein, 11 aa, Borrelia garinii
KVTMSITDDLN

SEQ ID NO: 12128 - protein, 11 aa, Borrelia garinii
VTMSITDDLNT

SEQ ID NO: 12129 - protein, 11 aa, Borrelia garinii
TMSITDDLNTI

SEQ ID NO: 12130 - protein, 11 aa, Borrelia garinii
MSITDDLNTIT

SEQ ID NO: 12131 - protein, 11 aa, Borrelia garinii
SITDDLNTITV

SEQ ID NO: 12132 - protein, 11 aa, Borrelia garinii
ITDDLNTITVE

SEQ ID NO: 12133 - protein, 11 aa, Borrelia garinii
TDDLNTITVET

SEQ ID NO: 12134 - protein, 11 aa, Borrelia garinii
DDLNTITVETY

SEQ ID NO: 12135 - protein, 11 aa, Borrelia garinii
DLNTITVETYD

SEQ ID NO: 12136 - protein, 11 aa, Borrelia garinii
LNTITVETYDS

SEQ ID NO: 12137 - protein, 11 aa, Borrelia garinii
NTITVETYDSS

SEQ ID NO: 12138 - protein, 11 aa, Borrelia garinii
TITVETYDSSN

SEQ ID NO: 12139 - protein, 11 aa, Borrelia garinii
ITVETYDSSNT

SEQ ID NO: 12140 - protein, 11 aa, Borrelia garinii
TVETYDSSNTK

SEQ ID NO: 12141 - protein, 11 aa, Borrelia garinii
VETYDSSNTKV

SEQ ID NO: 12142 - protein, 11 aa, Borrelia garinii
ETYDSSNTKVA

SEQ ID NO: 12143 - protein, 11 aa, Borrelia garinii
TYDSSNTKVAS

SEQ ID NO: 12144 - protein, 11 aa, Borrelia garinii
YDSSNTKVASK

SEQ ID NO: 12145 - protein, 11 aa, Borrelia garinii
DSSNTKVASKV

SEQ ID NO: 12146 - protein, 11 aa, Borrelia garinii
SSNTKVASKVF

SEQ ID NO: 12147 - protein, 11 aa, Borrelia garinii
SNTKVASKVFK

SEQ ID NO: 12148 - protein, 11 aa, Borrelia garinii
NTKVASKVFKK

SEQ ID NO: 12149 - protein, 11 aa, Borrelia garinii
TKVASKVFKKQ

SEQ ID NO: 12150 - protein, 11 aa, Borrelia garinii
KVASKVFKKQG

SEQ ID NO: 12151 - protein, 11 aa, Borrelia garinii
VASKVFKKQGS

SEQ ID NO: 12152 - protein, 11 aa, Borrelia garinii
ASKVFKKQGSL

SEQ ID NO: 12153 - protein, 11 aa, Borrelia garinii
SKVFKKQGSLT

SEQ ID NO: 12154 - protein, 11 aa, Borrelia garinii
KVFKKQGSLTE

SEQ ID NO: 12155 - protein, 11 aa, Borrelia garinii
VFKKQGSLTEE

SEQ ID NO: 12156 - protein, 11 aa, Borrelia garinii
FKKQGSLTEET

SEQ ID NO: 12157 - protein, 11 aa, Borrelia garinii
KKQGSLTEETE

SEQ ID NO: 12158 - protein, 11 aa, Borrelia garinii
KQGSLTEETEE

SEQ ID NO: 12159 - protein, 11 aa, Borrelia garinii
QGSLTEETEET

SEQ ID NO: 12160 - protein, 11 aa, Borrelia garinii
GSLTEETEETY

SEQ ID NO: 12161 - protein, 11 aa, Borrelia garinii
SLTEETEETYK

SEQ ID NO: 12162 - protein, 11 aa, Borrelia garinii
LTEETEETYKT

SEQ ID NO: 12163 - protein, 11 aa, Borrelia garinii
TEETEETYKTG

SEQ ID NO: 12164 - protein, 11 aa, Borrelia garinii
EETEETYKTGK

SEQ ID NO: 12165 - protein, 11 aa, Borrelia garinii
ETEETYKTGKL

SEQ ID NO: 12166 - protein, 11 aa, Borrelia garinii
TEETYKTGKLS

SEQ ID NO: 12167 - protein, 11 aa, Borrelia garinii
EETYKTGKLST

SEQ ID NO: 12168 - protein, 11 aa, Borrelia garinii
ETYKTGKLSTK

SEQ ID NO: 12169 - protein, 11 aa, Borrelia garinii
TYKTGKLSTKK

SEQ ID NO: 12170 - protein, 11 aa, Borrelia garinii
YKTGKLSTKKI

SEQ ID NO: 12171 - protein, 11 aa, Borrelia garinii
KTGKLSTKKIT

SEQ ID NO: 12172 - protein, 11 aa, Borrelia garinii
TGKLSTKKITR

SEQ ID NO: 12173 - protein, 11 aa, Borrelia garinii
GKLSTKKITRT

SEQ ID NO: 12174 - protein, 11 aa, Borrelia garinii
KLSTKKITRTN

SEQ ID NO: 12175 - protein, 11 aa, Borrelia garinii
LSTKKITRTNG

SEQ ID NO: 12176 - protein, 11 aa, Borrelia garinii
STKKITRTNGT

SEQ ID NO: 12177 - protein, 11 aa, Borrelia garinii
TKKITRTNGTT

SEQ ID NO: 12178 - protein, 11 aa, Borrelia garinii
KKITRTNGTTL

SEQ ID NO: 12179 - protein, 11 aa, Borrelia garinii
KITRTNGTTLE

SEQ ID NO: 12180 - protein, 11 aa, Borrelia garinii
ITRTNGTTLEY

SEQ ID NO: 12181 - protein, 11 aa, Borrelia garinii
TRTNGTTLEYS

SEQ ID NO: 12182 - protein, 11 aa, Borrelia garinii
RTNGTTLEYSD

SEQ ID NO: 12183 - protein, 11 aa, Borrelia garinii
TNGTTLEYSDM

SEQ ID NO: 12184 - protein, 11 aa, Borrelia garinii
NGTTLEYSDMT

SEQ ID NO: 12185 - protein, 11 aa, Borrelia garinii
GTTLEYSDMTN

SEQ ID NO: 12186 - protein, 11 aa, Borrelia garinii
TTLEYSDMTND

SEQ ID NO: 12187 - protein, 11 aa, Borrelia garinii
TLEYSDMTNDE

SEQ ID NO: 12188 - protein, 11 aa, Borrelia garinii
LEYSDMTNDEN

SEQ ID NO: 12189 - protein, 11 aa, Borrelia garinii
EYSDMTNDENA

SEQ ID NO: 12190 - protein, 11 aa, Borrelia garinii
YSDMTNDENAT

SEQ ID NO: 12191 - protein, 11 aa, Borrelia garinii
SDMTNDENATK

SEQ ID NO: 12192 - protein, 11 aa, Borrelia garinii
DMTNDENATKA

SEQ ID NO: 12193 - protein, 11 aa, Borrelia garinii
MTNDENATKAV

SEQ ID NO: 12194 - protein, 11 aa, Borrelia garinii
TNDENATKAVE

SEQ ID NO: 12195 - protein, 11 aa, Borrelia garinii
NDENATKAVET

SEQ ID NO: 12196 - protein, 11 aa, Borrelia garinii
DENATKAVETL

SEQ ID NO: 12197 - protein, 11 aa, Borrelia garinii
ENATKAVETLK

SEQ ID NO: 12198 - protein, 11 aa, Borrelia garinii
NATKAVETLKN

SEQ ID NO: 12199 - protein, 11 aa, Borrelia garinii
ATKAVETLKNG

SEQ ID NO: 12200 - protein, 11 aa, Borrelia garinii
TKAVETLKNGI

SEQ ID NO: 12201 - protein, 11 aa, Borrelia garinii
KAVETLKNGIM

SEQ ID NO: 12202 - protein, 11 aa, Borrelia garinii
AVETLKNGIML

SEQ ID NO: 12203 - protein, 11 aa, Borrelia garinii
VETLKNGIMLE

SEQ ID NO: 12204 - protein, 11 aa, Borrelia garinii
ETLKNGIMLEG

SEQ ID NO: 12205 - protein, 11 aa, Borrelia garinii
TLKNGIMLEGN

SEQ ID NO: 12206 - protein, 11 aa, Borrelia garinii
LKNGIMLEGNL

SEQ ID NO: 12207 - protein, 11 aa, Borrelia garinii
KNGIMLEGNLV

SEQ ID NO: 12208 - protein, 11 aa, Borrelia garinii
NGIMLEGNLVG

SEQ ID NO: 12209 - protein, 11 aa, Borrelia garinii
GIMLEGNLVGG

SEQ ID NO: 12210 - protein, 11 aa, Borrelia garinii
IMLEGNLVGGK

SEQ ID NO: 12211 - protein, 11 aa, Borrelia garinii
MLEGNLVGGKT

SEQ ID NO: 12212 - protein, 11 aa, Borrelia garinii
LEGNLVGGKTS

SEQ ID NO: 12213 - protein, 11 aa, Borrelia garinii
EGNLVGGKTSV

SEQ ID NO: 12214 - protein, 11 aa, Borrelia garinii
GNLVGGKTSVE

SEQ ID NO: 12215 - protein, 11 aa, Borrelia garinii
NLVGGKTSVEI

SEQ ID NO: 12216 - protein, 11 aa, Borrelia garinii
LVGGKTSVEIK

SEQ ID NO: 12217 - protein, 11 aa, Borrelia garinii
VGGKTSVEIKE

SEQ ID NO: 12218 - protein, 11 aa, Borrelia garinii
GGKTSVEIKEG

SEQ ID NO: 12219 - protein, 11 aa, Borrelia garinii
GKTSVEIKEGT

SEQ ID NO: 12220 - protein, 11 aa, Borrelia garinii
KTSVEIKEGTV

SEQ ID NO: 12221 - protein, 11 aa, Borrelia garinii
TSVEIKEGTVT

SEQ ID NO: 12222 - protein, 11 aa, Borrelia garinii
SVEIKEGTVTL

SEQ ID NO: 12223 - protein, 11 aa, Borrelia garinii
VEIKEGTVTLK

SEQ ID NO: 12224 - protein, 11 aa, Borrelia garinii
EIKEGTVTLKK

SEQ ID NO: 12225 - protein, 11 aa, Borrelia garinii
IKEGTVTLKKE

SEQ ID NO: 12226 - protein, 11 aa, Borrelia garinii
KEGTVTLKKEI

SEQ ID NO: 12227 - protein, 11 aa, Borrelia garinii
EGTVTLKKEIE

SEQ ID NO: 12228 - protein, 11 aa, Borrelia garinii
GTVTLKKEIEK

SEQ ID NO: 12229 - protein, 11 aa, Borrelia garinii
TVTLKKEIEKA

SEQ ID NO: 12230 - protein, 11 aa, Borrelia garinii
VTLKKEIEKAG

SEQ ID NO: 12231 - protein, 11 aa, Borrelia garinii
TLKKEIEKAGT

SEQ ID NO: 12232 - protein, 11 aa, Borrelia garinii
LKKEIEKAGTV

SEQ ID NO: 12233 - protein, 11 aa, Borrelia garinii
KKEIEKAGTVK

SEQ ID NO: 12234 - protein, 11 aa, Borrelia garinii
KEIEKAGTVKL

SEQ ID NO: 12235 - protein, 11 aa, Borrelia garinii
EIEKAGTVKLF

SEQ ID NO: 12236 - protein, 11 aa, Borrelia garinii
IEKAGTVKLFL

SEQ ID NO: 12237 - protein, 11 aa, Borrelia garinii
EKAGTVKLFLD

SEQ ID NO: 12238 - protein, 11 aa, Borrelia garinii
KAGTVKLFLDD

SEQ ID NO: 12239 - protein, 11 aa, Borrelia garinii
AGTVKLFLDDT

SEQ ID NO: 12240 - protein, 11 aa, Borrelia garinii
GTVKLFLDDTS

SEQ ID NO: 12241 - protein, 11 aa, Borrelia garinii
TVKLFLDDTSS

SEQ ID NO: 12242 - protein, 11 aa, Borrelia garinii
VKLFLDDTSSG

SEQ ID NO: 12243 - protein, 11 aa, Borrelia garinii
KLFLDDTSSGS

SEQ ID NO: 12244 - protein, 11 aa, Borrelia garinii
LFLDDTSSGST

SEQ ID NO: 12245 - protein, 11 aa, Borrelia garinii
FLDDTSSGSTK

SEQ ID NO: 12246 - protein, 11 aa, Borrelia garinii
LDDTSSGSTKK

SEQ ID NO: 12247 - protein, 11 aa, Borrelia garinii
DDTSSGSTKKT

SEQ ID NO: 12248 - protein, 11 aa, Borrelia garinii
DTSSGSTKKTA

SEQ ID NO: 12249 - protein, 11 aa, Borrelia garinii
TSSGSTKKTAV

SEQ ID NO: 12250 - protein, 11 aa, Borrelia garinii
SSGSTKKTAVW

SEQ ID NO: 12251 - protein, 11 aa, Borrelia garinii
SGSTKKTAVWS

SEQ ID NO: 12252 - protein, 11 aa, Borrelia garinii
GSTKKTAVWSD

SEQ ID NO: 12253 - protein, 11 aa, Borrelia garinii
STKKTAVWSDT

SEQ ID NO: 12254 - protein, 11 aa, Borrelia garinii
TKKTAVWSDTS

SEQ ID NO: 12255 - protein, 11 aa, Borrelia garinii
KKTAVWSDTSN

SEQ ID NO: 12256 - protein, 11 aa, Borrelia garinii
KTAVWSDTSNT

SEQ ID NO: 12257 - protein, 11 aa, Borrelia garinii
TAVWSDTSNTL

SEQ ID NO: 12258 - protein, 11 aa, Borrelia garinii
AVWSDTSNTLT

SEQ ID NO: 12259 - protein, 11 aa, Borrelia garinii
VWSDTSNTLTV

SEQ ID NO: 12260 - protein, 11 aa, Borrelia garinii
WSDTSNTLTVS

SEQ ID NO: 12261 - protein, 11 aa, Borrelia garinii
SDTSNTLTVSA

SEQ ID NO: 12262 - protein, 11 aa, Borrelia garinii
DTSNTLTVSAD

SEQ ID NO: 12263 - protein, 11 aa, Borrelia garinii
TSNTLTVSADS

SEQ ID NO: 12264 - protein, 11 aa, Borrelia garinii
SNTLTVSADSK

SEQ ID NO: 12265 - protein, 11 aa, Borrelia garinii
NTLTVSADSKK

SEQ ID NO: 12266 - protein, 11 aa, Borrelia garinii
TLTVSADSKKI

SEQ ID NO: 12267 - protein, 11 aa, Borrelia garinii
LTVSADSKKIK

SEQ ID NO: 12268 - protein, 11 aa, Borrelia garinii
TVSADSKKIKD

SEQ ID NO: 12269 - protein, 11 aa, Borrelia garinii
VSADSKKIKDF

SEQ ID NO: 12270 - protein, 11 aa, Borrelia garinii
SADSKKIKDFV

SEQ ID NO: 12271 - protein, 11 aa, Borrelia garinii
ADSKKIKDFVF

SEQ ID NO: 12272 - protein, 11 aa, Borrelia garinii
DSKKIKDFVFL

SEQ ID NO: 12273 - protein, 11 aa, Borrelia garinii
SKKIKDFVFLT

SEQ ID NO: 12274 - protein, 11 aa, Borrelia garinii
KKIKDFVFLTD

SEQ ID NO: 12275 - protein, 11 aa, Borrelia garinii
KIKDFVFLTDG

SEQ ID NO: 12276 - protein, 11 aa, Borrelia garinii
IKDFVFLTDGT

SEQ ID NO: 12277 - protein, 11 aa, Borrelia garinii
KDFVFLTDGTI

SEQ ID NO: 12278 - protein, 11 aa, Borrelia garinii
DFVFLTDGTIT

SEQ ID NO: 12279 - protein, 11 aa, Borrelia garinii
FVFLTDGTITV

SEQ ID NO: 12280 - protein, 11 aa, Borrelia garinii
VFLTDGTITVQ

SEQ ID NO: 12281 - protein, 11 aa, Borrelia garinii
FLTDGTITVQN

SEQ ID NO: 12282 - protein, 11 aa, Borrelia garinii
LTDGTITVQNY

SEQ ID NO: 12283 - protein, 11 aa, Borrelia garinii
TDGTITVQNYD

SEQ ID NO: 12284 - protein, 11 aa, Borrelia garinii
DGTITVQNYDT

SEQ ID NO: 12285 - protein, 11 aa, Borrelia garinii
GTITVQNYDTA

SEQ ID NO: 12286 - protein, 11 aa, Borrelia garinii
TITVQNYDTAG

SEQ ID NO: 12287 - protein, 11 aa, Borrelia garinii
ITVQNYDTAGT

SEQ ID NO: 12288 - protein, 11 aa, Borrelia garinii
TVQNYDTAGTK

SEQ ID NO: 12289 - protein, 11 aa, Borrelia garinii
VQNYDTAGTKL

SEQ ID NO: 12290 - protein, 11 aa, Borrelia garinii
QNYDTAGTKLA

SEQ ID NO: 12291 - protein, 11 aa, Borrelia garinii
NYDTAGTKLAG

SEQ ID NO: 12292 - protein, 11 aa, Borrelia garinii
YDTAGTKLAGT

SEQ ID NO: 12293 - protein, 11 aa, Borrelia garinii
DTAGTKLAGTA

SEQ ID NO: 12294 - protein, 11 aa, Borrelia garinii
TAGTKLAGTAT

SEQ ID NO: 12295 - protein, 11 aa, Borrelia garinii
AGTKLAGTATE

SEQ ID NO: 12296 - protein, 11 aa, Borrelia garinii
GTKLAGTATEI

SEQ ID NO: 12297 - protein, 11 aa, Borrelia garinii
TKLAGTATEIK

SEQ ID NO: 12298 - protein, 11 aa, Borrelia garinii
KLAGTATEIKD

SEQ ID NO: 12299 - protein, 11 aa, Borrelia garinii
LAGTATEIKDL

SEQ ID NO: 12300 - protein, 11 aa, Borrelia garinii
AGTATEIKDLE

SEQ ID NO: 12301 - protein, 11 aa, Borrelia garinii
GTATEIKDLEA

SEQ ID NO: 12302 - protein, 11 aa, Borrelia garinii
TATEIKDLEAL

SEQ ID NO: 12303 - protein, 11 aa, Borrelia garinii
ATEIKDLEALK

SEQ ID NO: 12304 - protein, 11 aa, Borrelia garinii
TEIKDLEALKA

SEQ ID NO: 12305 - protein, 11 aa, Borrelia garinii
EIKDLEALKAA

SEQ ID NO: 12306 - protein, 11 aa, Borrelia garinii
IKDLEALKAAL

SEQ ID NO: 12307 - protein, 11 aa, Borrelia garinii
KDLEALKAALK

SEQ ID NO: 12308 - protein, 8 aa, Borrelia afzelii
MKKNTLSA

SEQ ID NO: 12309 - protein, 8 aa, Borrelia afzelii
KKNTLSAI

SEQ ID NO: 12310 - protein, 8 aa, Borrelia afzelii
KNTLSAIL

SEQ ID NO: 12311 - protein, 8 aa, Borrelia afzelii
NTLSAILM

SEQ ID NO: 12312 - protein, 8 aa, Borrelia afzelii
TLSAILMT

SEQ ID NO: 12313 - protein, 8 aa, Borrelia afzelii
LSAILMTL

SEQ ID NO: 12314 - protein, 8 aa, Borrelia afzelii
SAILMTLF

SEQ ID NO: 12315 - protein, 8 aa, Borrelia afzelii
AILMTLFL

SEQ ID NO: 12316 - protein, 8 aa, Borrelia afzelii
ILMTLFLF

SEQ ID NO: 12317 - protein, 8 aa, Borrelia afzelii
LMTLFLFI

SEQ ID NO: 12318 - protein, 8 aa, Borrelia afzelii
MTLFLFIS

SEQ ID NO: 12319 - protein, 8 aa, Borrelia afzelii
TLFLFISC

SEQ ID NO: 12320 - protein, 8 aa, Borrelia afzelii
LFLFISCN

SEQ ID NO: 12321 - protein, 8 aa, Borrelia afzelii
FLFISCNN

SEQ ID NO: 12322 - protein, 8 aa, Borrelia afzelii
LFISCNNS

SEQ ID NO: 12323 - protein, 8 aa, Borrelia afzelii
FISCNNSG

SEQ ID NO: 12324 - protein, 8 aa, Borrelia afzelii
ISCNNSGK

SEQ ID NO: 12325 - protein, 8 aa, Borrelia afzelii
SCNNSGKG

SEQ ID NO: 12326 - protein, 8 aa, Borrelia afzelii
CNNSGKGG

SEQ ID NO: 12327 - protein, 8 aa, Borrelia afzelii
NNSGKGGD

SEQ ID NO: 12328 - protein, 8 aa, Borrelia afzelii
NSGKGGDS

SEQ ID NO: 12329 - protein, 8 aa, Borrelia afzelii
SGKGGDSA

SEQ ID NO: 12330 - protein, 8 aa, Borrelia afzelii
GKGGDSAS

SEQ ID NO: 12331 - protein, 8 aa, Borrelia afzelii
KGGDSAST

SEQ ID NO: 12332 - protein, 8 aa, Borrelia afzelii
GGDSASTN

SEQ ID NO: 12333 - protein, 8 aa, Borrelia afzelii
GDSASTNP

SEQ ID NO: 12334 - protein, 8 aa, Borrelia afzelii
DSASTNPA

SEQ ID NO: 12335 - protein, 8 aa, Borrelia afzelii
SASTNPAD

SEQ ID NO: 12336 - protein, 8 aa, Borrelia afzelii
ASTNPADE

SEQ ID NO: 12337 - protein, 8 aa, Borrelia afzelii
STNPADES

SEQ ID NO: 12338 - protein, 8 aa, Borrelia afzelii
TNPADESA

SEQ ID NO: 12339 - protein, 8 aa, Borrelia afzelii
NPADESAK

SEQ ID NO: 12340 - protein, 8 aa, Borrelia afzelii
PADESAKG

SEQ ID NO: 12341 - protein, 8 aa, Borrelia afzelii
ADESAKGP

SEQ ID NO: 12342 - protein, 8 aa, Borrelia afzelii
DESAKGPN

SEQ ID NO: 12343 - protein, 8 aa, Borrelia afzelii
ESAKGPNL

SEQ ID NO: 12344 - protein, 8 aa, Borrelia afzelii
SAKGPNLT

SEQ ID NO: 12345 - protein, 8 aa, Borrelia afzelii
AKGPNLTE

SEQ ID NO: 12346 - protein, 8 aa, Borrelia afzelii
KGPNLTEI

SEQ ID NO: 12347 - protein, 8 aa, Borrelia afzelii
GPNLTEIS

SEQ ID NO: 12348 - protein, 8 aa, Borrelia afzelii
PNLTEISK

SEQ ID NO: 12349 - protein, 8 aa, Borrelia afzelii
NLTEISKK

SEQ ID NO: 12350 - protein, 8 aa, Borrelia afzelii
LTEISKKI

SEQ ID NO: 12351 - protein, 8 aa, Borrelia afzelii
TEISKKIT

SEQ ID NO: 12352 - protein, 8 aa, Borrelia afzelii
EISKKITD

SEQ ID NO: 12353 - protein, 8 aa, Borrelia afzelii
ISKKITDS

SEQ ID NO: 12354 - protein, 8 aa, Borrelia afzelii
SKKITDSN

SEQ ID NO: 12355 - protein, 8 aa, Borrelia afzelii
KKITDSNA

SEQ ID NO: 12356 - protein, 8 aa, Borrelia afzelii
KITDSNAF

SEQ ID NO: 12357 - protein, 8 aa, Borrelia afzelii
ITDSNAFV

SEQ ID NO: 12358 - protein, 8 aa, Borrelia afzelii
TDSNAFVL

SEQ ID NO: 12359 - protein, 8 aa, Borrelia afzelii
DSNAFVLA

SEQ ID NO: 12360 - protein, 8 aa, Borrelia afzelii
SNAFVLAV

SEQ ID NO: 12361 - protein, 8 aa, Borrelia afzelii
NAFVLAVK

SEQ ID NO: 12362 - protein, 8 aa, Borrelia afzelii
AFVLAVKE

SEQ ID NO: 12363 - protein, 8 aa, Borrelia afzelii
FVLAVKEV

SEQ ID NO: 12364 - protein, 8 aa, Borrelia afzelii
VLAVKEVE

SEQ ID NO: 12365 - protein, 8 aa, Borrelia afzelii
LAVKEVET

SEQ ID NO: 12366 - protein, 8 aa, Borrelia afzelii
AVKEVETL

SEQ ID NO: 12367 - protein, 8 aa, Borrelia afzelii
VKEVETLV

SEQ ID NO: 12368 - protein, 8 aa, Borrelia afzelii
KEVETLVS

SEQ ID NO: 12369 - protein, 8 aa, Borrelia afzelii
EVETLVSS

SEQ ID NO: 12370 - protein, 8 aa, Borrelia afzelii
VETLVSSI

SEQ ID NO: 12371 - protein, 8 aa, Borrelia afzelii
ETLVSSID

SEQ ID NO: 12372 - protein, 8 aa, Borrelia afzelii
TLVSSIDE

SEQ ID NO: 12373 - protein, 8 aa, Borrelia afzelii
LVSSIDEL

SEQ ID NO: 12374 - protein, 8 aa, Borrelia afzelii
VSSIDELA

SEQ ID NO: 12375 - protein, 8 aa, Borrelia afzelii
SSIDELAN

SEQ ID NO: 12376 - protein, 8 aa, Borrelia afzelii
SIDELANK

SEQ ID NO: 12377 - protein, 8 aa, Borrelia afzelii
IDELANKA

SEQ ID NO: 12378 - protein, 8 aa, Borrelia afzelii
DELANKAI

SEQ ID NO: 12379 - protein, 8 aa, Borrelia afzelii
ELANKAIG

SEQ ID NO: 12380 - protein, 8 aa, Borrelia afzelii
LANKAIGK

SEQ ID NO: 12381 - protein, 8 aa, Borrelia afzelii
ANKAIGKK

SEQ ID NO: 12382 - protein, 8 aa, Borrelia afzelii
NKAIGKKI

SEQ ID NO: 12383 - protein, 8 aa, Borrelia afzelii
KAIGKKIQ

SEQ ID NO: 12384 - protein, 8 aa, Borrelia afzelii
AIGKKIQQ

SEQ ID NO: 12385 - protein, 8 aa, Borrelia afzelii
IGKKIQQN

SEQ ID NO: 12386 - protein, 8 aa, Borrelia afzelii
GKKIQQNG

SEQ ID NO: 12387 - protein, 8 aa, Borrelia afzelii
KKIQQNGL

SEQ ID NO: 12388 - protein, 8 aa, Borrelia afzelii
KIQQNGLG

SEQ ID NO: 12389 - protein, 8 aa, Borrelia afzelii
IQQNGLGA

SEQ ID NO: 12390 - protein, 8 aa, Borrelia afzelii
QQNGLGAE

SEQ ID NO: 12391 - protein, 8 aa, Borrelia afzelii
QNGLGAEA

SEQ ID NO: 12392 - protein, 8 aa, Borrelia afzelii
NGLGAEAN

SEQ ID NO: 12393 - protein, 8 aa, Borrelia afzelii
GLGAEANR

SEQ ID NO: 12394 - protein, 8 aa, Borrelia afzelii
LGAEANRN

SEQ ID NO: 12395 - protein, 8 aa, Borrelia afzelii
GAEANRNE

SEQ ID NO: 12396 - protein, 8 aa, Borrelia afzelii
AEANRNES

SEQ ID NO: 12397 - protein, 8 aa, Borrelia afzelii
EANRNESL

SEQ ID NO: 12398 - protein, 8 aa, Borrelia afzelii
ANRNESLL

SEQ ID NO: 12399 - protein, 8 aa, Borrelia afzelii
NRNESLLA

SEQ ID NO: 12400 - protein, 8 aa, Borrelia afzelii
RNESLLAG

SEQ ID NO: 12401 - protein, 8 aa, Borrelia afzelii
NESLLAGV

SEQ ID NO: 12402 - protein, 8 aa, Borrelia afzelii
ESLLAGVH

SEQ ID NO: 12403 - protein, 8 aa, Borrelia afzelii
SLLAGVHE

SEQ ID NO: 12404 - protein, 8 aa, Borrelia afzelii
LLAGVHEI

SEQ ID NO: 12405 - protein, 8 aa, Borrelia afzelii
LAGVHEIS

SEQ ID NO: 12406 - protein, 8 aa, Borrelia afzelii
AGVHEIST

SEQ ID NO: 12407 - protein, 8 aa, Borrelia afzelii
GVHEISTL

SEQ ID NO: 12408 - protein, 8 aa, Borrelia afzelii
VHEISTLI

SEQ ID NO: 12409 - protein, 8 aa, Borrelia afzelii
HEISTLIT

SEQ ID NO: 12410 - protein, 8 aa, Borrelia afzelii
EISTLITE

SEQ ID NO: 12411 - protein, 8 aa, Borrelia afzelii
ISTLITEK

SEQ ID NO: 12412 - protein, 8 aa, Borrelia afzelii
STLITEKL

SEQ ID NO: 12413 - protein, 8 aa, Borrelia afzelii
TLITEKLS

SEQ ID NO: 12414 - protein, 8 aa, Borrelia afzelii
LITEKLSK

SEQ ID NO: 12415 - protein, 8 aa, Borrelia afzelii
ITEKLSKL

SEQ ID NO: 12416 - protein, 8 aa, Borrelia afzelii
TEKLSKLK

SEQ ID NO: 12417 - protein, 8 aa, Borrelia afzelii
EKLSKLKN

SEQ ID NO: 12418 - protein, 8 aa, Borrelia afzelii
KLSKLKNS

SEQ ID NO: 12419 - protein, 8 aa, Borrelia afzelii
LSKLKNSG

SEQ ID NO: 12420 - protein, 8 aa, Borrelia afzelii
SKLKNSGE

SEQ ID NO: 12421 - protein, 8 aa, Borrelia afzelii
KLKNSGEL

SEQ ID NO: 12422 - protein, 8 aa, Borrelia afzelii
LKNSGELK

SEQ ID NO: 12423 - protein, 8 aa, Borrelia afzelii
KNSGELKA

SEQ ID NO: 12424 - protein, 8 aa, Borrelia afzelii
NSGELKAK

SEQ ID NO: 12425 - protein, 8 aa, Borrelia afzelii
SGELKAKI

SEQ ID NO: 12426 - protein, 8 aa, Borrelia afzelii
GELKAKIE

SEQ ID NO: 12427 - protein, 8 aa, Borrelia afzelii
ELKAKIED

SEQ ID NO: 12428 - protein, 8 aa, Borrelia afzelii
LKAKIEDA

SEQ ID NO: 12429 - protein, 8 aa, Borrelia afzelii
KAKIEDAK

SEQ ID NO: 12430 - protein, 8 aa, Borrelia afzelii
AKIEDAKK

SEQ ID NO: 12431 - protein, 8 aa, Borrelia afzelii
KIEDAKKC

SEQ ID NO: 12432 - protein, 8 aa, Borrelia afzelii
IEDAKKCS

SEQ ID NO: 12433 - protein, 8 aa, Borrelia afzelii
EDAKKCSE

SEQ ID NO: 12434 - protein, 8 aa, Borrelia afzelii
DAKKCSEE

SEQ ID NO: 12435 - protein, 8 aa, Borrelia afzelii
AKKCSEEF

SEQ ID NO: 12436 - protein, 8 aa, Borrelia afzelii
KKCSEEFT

SEQ ID NO: 12437 - protein, 8 aa, Borrelia afzelii
KCSEEFTN

SEQ ID NO: 12438 - protein, 8 aa, Borrelia afzelii
CSEEFTNK

SEQ ID NO: 12439 - protein, 8 aa, Borrelia afzelii
SEEFTNKL

SEQ ID NO: 12440 - protein, 8 aa, Borrelia afzelii
EEFTNKLR

SEQ ID NO: 12441 - protein, 8 aa, Borrelia afzelii
EFTNKLRV

SEQ ID NO: 12442 - protein, 8 aa, Borrelia afzelii
FTNKLRVS

SEQ ID NO: 12443 - protein, 8 aa, Borrelia afzelii
TNKLRVSH

SEQ ID NO: 12444 - protein, 8 aa, Borrelia afzelii
NKLRVSHA

SEQ ID NO: 12445 - protein, 8 aa, Borrelia afzelii
KLRVSHAD

SEQ ID NO: 12446 - protein, 8 aa, Borrelia afzelii
LRVSHADL

SEQ ID NO: 12447 - protein, 8 aa, Borrelia afzelii
RVSHADLG

SEQ ID NO: 12448 - protein, 8 aa, Borrelia afzelii
VSHADLGK

SEQ ID NO: 12449 - protein, 8 aa, Borrelia afzelii
SHADLGKQ

SEQ ID NO: 12450 - protein, 8 aa, Borrelia afzelii
HADLGKQG

SEQ ID NO: 12451 - protein, 8 aa, Borrelia afzelii
ADLGKQGV

SEQ ID NO: 12452 - protein, 8 aa, Borrelia afzelii
DLGKQGVN

SEQ ID NO: 12453 - protein, 8 aa, Borrelia afzelii
LGKQGVND

SEQ ID NO: 12454 - protein, 8 aa, Borrelia afzelii
GKQGVNDD

SEQ ID NO: 12455 - protein, 8 aa, Borrelia afzelii
KQGVNDDD

SEQ ID NO: 12456 - protein, 8 aa, Borrelia afzelii
QGVNDDDA

SEQ ID NO: 12457 - protein, 8 aa, Borrelia afzelii
GVNDDDAK

SEQ ID NO: 12458 - protein, 8 aa, Borrelia afzelii
VNDDDAKK

SEQ ID NO: 12459 - protein, 8 aa, Borrelia afzelii
NDDDAKKA

SEQ ID NO: 12460 - protein, 8 aa, Borrelia afzelii
DDDAKKAI

SEQ ID NO: 12461 - protein, 8 aa, Borrelia afzelii
DDAKKAIL

SEQ ID NO: 12462 - protein, 8 aa, Borrelia afzelii
DAKKAILK

SEQ ID NO: 12463 - protein, 8 aa, Borrelia afzelii
AKKAILKT

SEQ ID NO: 12464 - protein, 8 aa, Borrelia afzelii
KKAILKTN

SEQ ID NO: 12465 - protein, 8 aa, Borrelia afzelii
KAILKTNA

SEQ ID NO: 12466 - protein, 8 aa, Borrelia afzelii
AILKTNAD

SEQ ID NO: 12467 - protein, 8 aa, Borrelia afzelii
ILKTNADK

SEQ ID NO: 12468 - protein, 8 aa, Borrelia afzelii
LKTNADKT

SEQ ID NO: 12469 - protein, 8 aa, Borrelia afzelii
KTNADKTK

SEQ ID NO: 12470 - protein, 8 aa, Borrelia afzelii
TNADKTKG

SEQ ID NO: 12471 - protein, 8 aa, Borrelia afzelii
NADKTKGA

SEQ ID NO: 12472 - protein, 8 aa, Borrelia afzelii
ADKTKGAE

SEQ ID NO: 12473 - protein, 8 aa, Borrelia afzelii
DKTKGAEE

SEQ ID NO: 12474 - protein, 8 aa, Borrelia afzelii
KTKGAEEL

SEQ ID NO: 12475 - protein, 8 aa, Borrelia afzelii
TKGAEELG

SEQ ID NO: 12476 - protein, 8 aa, Borrelia afzelii
KGAEELGK

SEQ ID NO: 12477 - protein, 8 aa, Borrelia afzelii
GAEELGKL

SEQ ID NO: 12478 - protein, 8 aa, Borrelia afzelii
AEELGKLF

SEQ ID NO: 12479 - protein, 8 aa, Borrelia afzelii
EELGKLFK

SEQ ID NO: 12480 - protein, 8 aa, Borrelia afzelii
ELGKLFKS

SEQ ID NO: 12481 - protein, 8 aa, Borrelia afzelii
LGKLFKSV

SEQ ID NO: 12482 - protein, 8 aa, Borrelia afzelii
GKLFKSVE

SEQ ID NO: 12483 - protein, 8 aa, Borrelia afzelii
KLFKSVEG

SEQ ID NO: 12484 - protein, 8 aa, Borrelia afzelii
LFKSVEGL

SEQ ID NO: 12485 - protein, 8 aa, Borrelia afzelii
FKSVEGLV

SEQ ID NO: 12486 - protein, 8 aa, Borrelia afzelii
KSVEGLVK

SEQ ID NO: 12487 - protein, 8 aa, Borrelia afzelii
SVEGLVKA

SEQ ID NO: 12488 - protein, 8 aa, Borrelia afzelii
VEGLVKAA

SEQ ID NO: 12489 - protein, 8 aa, Borrelia afzelii
EGLVKAAQ

SEQ ID NO: 12490 - protein, 8 aa, Borrelia afzelii
GLVKAAQE

SEQ ID NO: 12491 - protein, 8 aa, Borrelia afzelii
LVKAAQEA

SEQ ID NO: 12492 - protein, 8 aa, Borrelia afzelii
VKAAQEAL

SEQ ID NO: 12493 - protein, 8 aa, Borrelia afzelii
KAAQEALT

SEQ ID NO: 12494 - protein, 8 aa, Borrelia afzelii
AAQEALTN

SEQ ID NO: 12495 - protein, 8 aa, Borrelia afzelii
AQEALTNS

SEQ ID NO: 12496 - protein, 8 aa, Borrelia afzelii
QEALTNSV

SEQ ID NO: 12497 - protein, 8 aa, Borrelia afzelii
EALTNSVK

SEQ ID NO: 12498 - protein, 8 aa, Borrelia afzelii
ALTNSVKE

SEQ ID NO: 12499 - protein, 8 aa, Borrelia afzelii
LTNSVKEL

SEQ ID NO: 12500 - protein, 8 aa, Borrelia afzelii
TNSVKELT

SEQ ID NO: 12501 - protein, 8 aa, Borrelia afzelii
NSVKELTS

SEQ ID NO: 12502 - protein, 8 aa, Borrelia afzelii
SVKELTSP

SEQ ID NO: 12503 - protein, 8 aa, Borrelia afzelii
VKELTSPV

SEQ ID NO: 12504 - protein, 8 aa, Borrelia afzelii
KELTSPVV

SEQ ID NO: 12505 - protein, 8 aa, Borrelia afzelii
ELTSPVVA

SEQ ID NO: 12506 - protein, 8 aa, Borrelia afzelii
LTSPVVAE

SEQ ID NO: 12507 - protein, 8 aa, Borrelia afzelii
TSPVVAES

SEQ ID NO: 12508 - protein, 8 aa, Borrelia afzelii
SPVVAESP

SEQ ID NO: 12509 - protein, 8 aa, Borrelia afzelii
PVVAESPK

SEQ ID NO: 12510 - protein, 8 aa, Borrelia afzelii
VVAESPKK

SEQ ID NO: 12511 - protein, 8 aa, Borrelia afzelii
VAESPKKP

SEQ ID NO: 12512 - protein, 9 aa, Borrelia afzelii
MKKNTLSAI

SEQ ID NO: 12513 - protein, 9 aa, Borrelia afzelii
KKNTLSAIL

SEQ ID NO: 12514 - protein, 9 aa, Borrelia afzelii
KNTLSAILM

SEQ ID NO: 12515 - protein, 9 aa, Borrelia afzelii
NTLSAILMT

SEQ ID NO: 12516 - protein, 9 aa, Borrelia afzelii
TLSAILMTL

SEQ ID NO: 12517 - protein, 9 aa, Borrelia afzelii
LSAILMTLF

SEQ ID NO: 12518 - protein, 9 aa, Borrelia afzelii
SAILMTLFL

SEQ ID NO: 12519 - protein, 9 aa, Borrelia afzelii
AILMTLFLF

SEQ ID NO: 12520 - protein, 9 aa, Borrelia afzelii
ILMTLFLFI

SEQ ID NO: 12521 - protein, 9 aa, Borrelia afzelii
LMTLFLFIS

SEQ ID NO: 12522 - protein, 9 aa, Borrelia afzelii
MTLFLFISC

SEQ ID NO: 12523 - protein, 9 aa, Borrelia afzelii
TLFLFISCN

SEQ ID NO: 12524 - protein, 9 aa, Borrelia afzelii
LFLFISCNN

SEQ ID NO: 12525 - protein, 9 aa, Borrelia afzelii
FLFISCNNS

SEQ ID NO: 12526 - protein, 9 aa, Borrelia afzelii
LFISCNNSG

SEQ ID NO: 12527 - protein, 9 aa, Borrelia afzelii
FISCNNSGK

SEQ ID NO: 12528 - protein, 9 aa, Borrelia afzelii
ISCNNSGKG

SEQ ID NO: 12529 - protein, 9 aa, Borrelia afzelii
SCNNSGKGG

SEQ ID NO: 12530 - protein, 9 aa, Borrelia afzelii
CNNSGKGGD

SEQ ID NO: 12531 - protein, 9 aa, Borrelia afzelii
NNSGKGGDS

SEQ ID NO: 12532 - protein, 9 aa, Borrelia afzelii
NSGKGGDSA

SEQ ID NO: 12533 - protein, 9 aa, Borrelia afzelii
SGKGGDSAS

SEQ ID NO: 12534 - protein, 9 aa, Borrelia afzelii
GKGGDSAST

SEQ ID NO: 12535 - protein, 9 aa, Borrelia afzelii
KGGDSASTN

SEQ ID NO: 12536 - protein, 9 aa, Borrelia afzelii
GGDSASTNP

SEQ ID NO: 12537 - protein, 9 aa, Borrelia afzelii
GDSASTNPA

SEQ ID NO: 12538 - protein, 9 aa, Borrelia afzelii
DSASTNPAD

SEQ ID NO: 12539 - protein, 9 aa, Borrelia afzelii
SASTNPADE

SEQ ID NO: 12540 - protein, 9 aa, Borrelia afzelii
ASTNPADES

SEQ ID NO: 12541 - protein, 9 aa, Borrelia afzelii
STNPADESA

SEQ ID NO: 12542 - protein, 9 aa, Borrelia afzelii
TNPADESAK

SEQ ID NO: 12543 - protein, 9 aa, Borrelia afzelii
NPADESAKG

SEQ ID NO: 12544 - protein, 9 aa, Borrelia afzelii
PADESAKGP

SEQ ID NO: 12545 - protein, 9 aa, Borrelia afzelii
ADESAKGPN

SEQ ID NO: 12546 - protein, 9 aa, Borrelia afzelii
DESAKGPNL

SEQ ID NO: 12547 - protein, 9 aa, Borrelia afzelii
ESAKGPNLT

SEQ ID NO: 12548 - protein, 9 aa, Borrelia afzelii
SAKGPNLTE

SEQ ID NO: 12549 - protein, 9 aa, Borrelia afzelii
AKGPNLTEI

SEQ ID NO: 12550 - protein, 9 aa, Borrelia afzelii
KGPNLTEIS

SEQ ID NO: 12551 - protein, 9 aa, Borrelia afzelii
GPNLTEISK

SEQ ID NO: 12552 - protein, 9 aa, Borrelia afzelii
PNLTEISKK

SEQ ID NO: 12553 - protein, 9 aa, Borrelia afzelii
NLTEISKKI

SEQ ID NO: 12554 - protein, 9 aa, Borrelia afzelii
LTEISKKIT

SEQ ID NO: 12555 - protein, 9 aa, Borrelia afzelii
TEISKKITD

SEQ ID NO: 12556 - protein, 9 aa, Borrelia afzelii
EISKKITDS

SEQ ID NO: 12557 - protein, 9 aa, Borrelia afzelii
ISKKITDSN

SEQ ID NO: 12558 - protein, 9 aa, Borrelia afzelii
SKKITDSNA

SEQ ID NO: 12559 - protein, 9 aa, Borrelia afzelii
KKITDSNAF

SEQ ID NO: 12560 - protein, 9 aa, Borrelia afzelii
KITDSNAFV

SEQ ID NO: 12561 - protein, 9 aa, Borrelia afzelii
ITDSNAFVL

SEQ ID NO: 12562 - protein, 9 aa, Borrelia afzelii
TDSNAFVLA

SEQ ID NO: 12563 - protein, 9 aa, Borrelia afzelii
DSNAFVLAV

SEQ ID NO: 12564 - protein, 9 aa, Borrelia afzelii
SNAFVLAVK

SEQ ID NO: 12565 - protein, 9 aa, Borrelia afzelii
NAFVLAVKE

SEQ ID NO: 12566 - protein, 9 aa, Borrelia afzelii
AFVLAVKEV

SEQ ID NO: 12567 - protein, 9 aa, Borrelia afzelii
FVLAVKEVE

SEQ ID NO: 12568 - protein, 9 aa, Borrelia afzelii
VLAVKEVET

SEQ ID NO: 12569 - protein, 9 aa, Borrelia afzelii
LAVKEVETL

SEQ ID NO: 12570 - protein, 9 aa, Borrelia afzelii
AVKEVETLV

SEQ ID NO: 12571 - protein, 9 aa, Borrelia afzelii
VKEVETLVS

SEQ ID NO: 12572 - protein, 9 aa, Borrelia afzelii
KEVETLVSS

SEQ ID NO: 12573 - protein, 9 aa, Borrelia afzelii
EVETLVSSI

SEQ ID NO: 12574 - protein, 9 aa, Borrelia afzelii
VETLVSSID

SEQ ID NO: 12575 - protein, 9 aa, Borrelia afzelii
ETLVSSIDE

SEQ ID NO: 12576 - protein, 9 aa, Borrelia afzelii
TLVSSIDEL

SEQ ID NO: 12577 - protein, 9 aa, Borrelia afzelii
LVSSIDELA

SEQ ID NO: 12578 - protein, 9 aa, Borrelia afzelii
VSSIDELAN

SEQ ID NO: 12579 - protein, 9 aa, Borrelia afzelii
SSIDELANK

SEQ ID NO: 12580 - protein, 9 aa, Borrelia afzelii
SIDELANKA

SEQ ID NO: 12581 - protein, 9 aa, Borrelia afzelii
IDELANKAI

SEQ ID NO: 12582 - protein, 9 aa, Borrelia afzelii
DELANKAIG

SEQ ID NO: 12583 - protein, 9 aa, Borrelia afzelii
ELANKAIGK

SEQ ID NO: 12584 - protein, 9 aa, Borrelia afzelii
LANKAIGKK

SEQ ID NO: 12585 - protein, 9 aa, Borrelia afzelii
ANKAIGKKI

SEQ ID NO: 12586 - protein, 9 aa, Borrelia afzelii
NKAIGKKIQ

SEQ ID NO: 12587 - protein, 9 aa, Borrelia afzelii
KAIGKKIQQ

SEQ ID NO: 12588 - protein, 9 aa, Borrelia afzelii
AIGKKIQQN

SEQ ID NO: 12589 - protein, 9 aa, Borrelia afzelii
IGKKIQQNG

SEQ ID NO: 12590 - protein, 9 aa, Borrelia afzelii
GKKIQQNGL

SEQ ID NO: 12591 - protein, 9 aa, Borrelia afzelii
KKIQQNGLG

SEQ ID NO: 12592 - protein, 9 aa, Borrelia afzelii
KIQQNGLGA

SEQ ID NO: 12593 - protein, 9 aa, Borrelia afzelii
IQQNGLGAE

SEQ ID NO: 12594 - protein, 9 aa, Borrelia afzelii
QQNGLGAEA

SEQ ID NO: 12595 - protein, 9 aa, Borrelia afzelii
QNGLGAEAN

SEQ ID NO: 12596 - protein, 9 aa, Borrelia afzelii
NGLGAEANR

SEQ ID NO: 12597 - protein, 9 aa, Borrelia afzelii
GLGAEANRN

SEQ ID NO: 12598 - protein, 9 aa, Borrelia afzelii
LGAEANRNE

SEQ ID NO: 12599 - protein, 9 aa, Borrelia afzelii
GAEANRNES

SEQ ID NO: 12600 - protein, 9 aa, Borrelia afzelii
AEANRNESL

SEQ ID NO: 12601 - protein, 9 aa, Borrelia afzelii
EANRNESLL

SEQ ID NO: 12602 - protein, 9 aa, Borrelia afzelii
ANRNESLLA

SEQ ID NO: 12603 - protein, 9 aa, Borrelia afzelii
NRNESLLAG

SEQ ID NO: 12604 - protein, 9 aa, Borrelia afzelii
RNESLLAGV

SEQ ID NO: 12605 - protein, 9 aa, Borrelia afzelii
NESLLAGVH

SEQ ID NO: 12606 - protein, 9 aa, Borrelia afzelii
ESLLAGVHE

SEQ ID NO: 12607 - protein, 9 aa, Borrelia afzelii
SLLAGVHEI

SEQ ID NO: 12608 - protein, 9 aa, Borrelia afzelii
LLAGVHEIS

SEQ ID NO: 12609 - protein, 9 aa, Borrelia afzelii
LAGVHEIST

SEQ ID NO: 12610 - protein, 9 aa, Borrelia afzelii
AGVHEISTL

SEQ ID NO: 12611 - protein, 9 aa, Borrelia afzelii
GVHEISTLI

SEQ ID NO: 12612 - protein, 9 aa, Borrelia afzelii
VHEISTLIT

SEQ ID NO: 12613 - protein, 9 aa, Borrelia afzelii
HEISTLITE

SEQ ID NO: 12614 - protein, 9 aa, Borrelia afzelii
EISTLITEK

SEQ ID NO: 12615 - protein, 9 aa, Borrelia afzelii
ISTLITEKL

SEQ ID NO: 12616 - protein, 9 aa, Borrelia afzelii
STLITEKLS

SEQ ID NO: 12617 - protein, 9 aa, Borrelia afzelii
TLITEKLSK

SEQ ID NO: 12618 - protein, 9 aa, Borrelia afzelii
LITEKLSKL

SEQ ID NO: 12619 - protein, 9 aa, Borrelia afzelii
ITEKLSKLK

SEQ ID NO: 12620 - protein, 9 aa, Borrelia afzelii
TEKLSKLKN

SEQ ID NO: 12621 - protein, 9 aa, Borrelia afzelii
EKLSKLKNS

SEQ ID NO: 12622 - protein, 9 aa, Borrelia afzelii
KLSKLKNSG

SEQ ID NO: 12623 - protein, 9 aa, Borrelia afzelii
LSKLKNSGE

SEQ ID NO: 12624 - protein, 9 aa, Borrelia afzelii
SKLKNSGEL

SEQ ID NO: 12625 - protein, 9 aa, Borrelia afzelii
KLKNSGELK

SEQ ID NO: 12626 - protein, 9 aa, Borrelia afzelii
LKNSGELKA

SEQ ID NO: 12627 - protein, 9 aa, Borrelia afzelii
KNSGELKAK

SEQ ID NO: 12628 - protein, 9 aa, Borrelia afzelii
NSGELKAKI

SEQ ID NO: 12629 - protein, 9 aa, Borrelia afzelii
SGELKAKIE

SEQ ID NO: 12630 - protein, 9 aa, Borrelia afzelii
GELKAKIED

SEQ ID NO: 12631 - protein, 9 aa, Borrelia afzelii
ELKAKIEDA

SEQ ID NO: 12632 - protein, 9 aa, Borrelia afzelii
LKAKIEDAK

SEQ ID NO: 12633 - protein, 9 aa, Borrelia afzelii
KAKIEDAKK

SEQ ID NO: 12634 - protein, 9 aa, Borrelia afzelii
AKIEDAKKC

SEQ ID NO: 12635 - protein, 9 aa, Borrelia afzelii
KIEDAKKCS

SEQ ID NO: 12636 - protein, 9 aa, Borrelia afzelii
IEDAKKCSE

SEQ ID NO: 12637 - protein, 9 aa, Borrelia afzelii
EDAKKCSEE

SEQ ID NO: 12638 - protein, 9 aa, Borrelia afzelii
DAKKCSEEF

SEQ ID NO: 12639 - protein, 9 aa, Borrelia afzelii
AKKCSEEFT

SEQ ID NO: 12640 - protein, 9 aa, Borrelia afzelii
KKCSEEFTN

SEQ ID NO: 12641 - protein, 9 aa, Borrelia afzelii
KCSEEFTNK

SEQ ID NO: 12642 - protein, 9 aa, Borrelia afzelii
CSEEFTNKL

SEQ ID NO: 12643 - protein, 9 aa, Borrelia afzelii
SEEFTNKLR

SEQ ID NO: 12644 - protein, 9 aa, Borrelia afzelii
EEFTNKLRV

SEQ ID NO: 12645 - protein, 9 aa, Borrelia afzelii
EFTNKLRVS

SEQ ID NO: 12646 - protein, 9 aa, Borrelia afzelii
FTNKLRVSH

SEQ ID NO: 12647 - protein, 9 aa, Borrelia afzelii
TNKLRVSHA

SEQ ID NO: 12648 - protein, 9 aa, Borrelia afzelii
NKLRVSHAD

SEQ ID NO: 12649 - protein, 9 aa, Borrelia afzelii
KLRVSHADL

SEQ ID NO: 12650 - protein, 9 aa, Borrelia afzelii
LRVSHADLG

SEQ ID NO: 12651 - protein, 9 aa, Borrelia afzelii
RVSHADLGK

SEQ ID NO: 12652 - protein, 9 aa, Borrelia afzelii
VSHADLGKQ

SEQ ID NO: 12653 - protein, 9 aa, Borrelia afzelii
SHADLGKQG

SEQ ID NO: 12654 - protein, 9 aa, Borrelia afzelii
HADLGKQGV

SEQ ID NO: 12655 - protein, 9 aa, Borrelia afzelii
ADLGKQGVN

SEQ ID NO: 12656 - protein, 9 aa, Borrelia afzelii
DLGKQGVND

SEQ ID NO: 12657 - protein, 9 aa, Borrelia afzelii
LGKQGVNDD

SEQ ID NO: 12658 - protein, 9 aa, Borrelia afzelii
GKQGVNDDD

SEQ ID NO: 12659 - protein, 9 aa, Borrelia afzelii
KQGVNDDDA

SEQ ID NO: 12660 - protein, 9 aa, Borrelia afzelii
QGVNDDDAK

SEQ ID NO: 12661 - protein, 9 aa, Borrelia afzelii
GVNDDDAKK

SEQ ID NO: 12662 - protein, 9 aa, Borrelia afzelii
VNDDDAKKA

SEQ ID NO: 12663 - protein, 9 aa, Borrelia afzelii
NDDDAKKAI

SEQ ID NO: 12664 - protein, 9 aa, Borrelia afzelii
DDDAKKAIL

SEQ ID NO: 12665 - protein, 9 aa, Borrelia afzelii
DDAKKAILK

SEQ ID NO: 12666 - protein, 9 aa, Borrelia afzelii
DAKKAILKT

SEQ ID NO: 12667 - protein, 9 aa, Borrelia afzelii
AKKAILKTN

SEQ ID NO: 12668 - protein, 9 aa, Borrelia afzelii
KKAILKTNA

SEQ ID NO: 12669 - protein, 9 aa, Borrelia afzelii
KAILKTNAD

SEQ ID NO: 12670 - protein, 9 aa, Borrelia afzelii
AILKTNADK

SEQ ID NO: 12671 - protein, 9 aa, Borrelia afzelii
ILKTNADKT

SEQ ID NO: 12672 - protein, 9 aa, Borrelia afzelii
LKTNADKTK

SEQ ID NO: 12673 - protein, 9 aa, Borrelia afzelii
KTNADKTKG

SEQ ID NO: 12674 - protein, 9 aa, Borrelia afzelii
TNADKTKGA

SEQ ID NO: 12675 - protein, 9 aa, Borrelia afzelii
NADKTKGAE

SEQ ID NO: 12676 - protein, 9 aa, Borrelia afzelii
ADKTKGAEE

SEQ ID NO: 12677 - protein, 9 aa, Borrelia afzelii
DKTKGAEEL

SEQ ID NO: 12678 - protein, 9 aa, Borrelia afzelii
KTKGAEELG

SEQ ID NO: 12679 - protein, 9 aa, Borrelia afzelii
TKGAEELGK

SEQ ID NO: 12680 - protein, 9 aa, Borrelia afzelii
KGAEELGKL

SEQ ID NO: 12681 - protein, 9 aa, Borrelia afzelii
GAEELGKLF

SEQ ID NO: 12682 - protein, 9 aa, Borrelia afzelii
AEELGKLFK

SEQ ID NO: 12683 - protein, 9 aa, Borrelia afzelii
EELGKLFKS

SEQ ID NO: 12684 - protein, 9 aa, Borrelia afzelii
ELGKLFKSV

SEQ ID NO: 12685 - protein, 9 aa, Borrelia afzelii
LGKLFKSVE

SEQ ID NO: 12686 - protein, 9 aa, Borrelia afzelii
GKLFKSVEG

SEQ ID NO: 12687 - protein, 9 aa, Borrelia afzelii
KLFKSVEGL

SEQ ID NO: 12688 - protein, 9 aa, Borrelia afzelii
LFKSVEGLV

SEQ ID NO: 12689 - protein, 9 aa, Borrelia afzelii
FKSVEGLVK

SEQ ID NO: 12690 - protein, 9 aa, Borrelia afzelii
KSVEGLVKA

SEQ ID NO: 12691 - protein, 9 aa, Borrelia afzelii
SVEGLVKAA

SEQ ID NO: 12692 - protein, 9 aa, Borrelia afzelii
VEGLVKAAQ

SEQ ID NO: 12693 - protein, 9 aa, Borrelia afzelii
EGLVKAAQE

SEQ ID NO: 12694 - protein, 9 aa, Borrelia afzelii
GLVKAAQEA

SEQ ID NO: 12695 - protein, 9 aa, Borrelia afzelii
LVKAAQEAL

SEQ ID NO: 12696 - protein, 9 aa, Borrelia afzelii
VKAAQEALT

SEQ ID NO: 12697 - protein, 9 aa, Borrelia afzelii
KAAQEALTN

SEQ ID NO: 12698 - protein, 9 aa, Borrelia afzelii
AAQEALTNS

SEQ ID NO: 12699 - protein, 9 aa, Borrelia afzelii
AQEALTNSV

SEQ ID NO: 12700 - protein, 9 aa, Borrelia afzelii
QEALTNSVK

SEQ ID NO: 12701 - protein, 9 aa, Borrelia afzelii
EALTNSVKE

SEQ ID NO: 12702 - protein, 9 aa, Borrelia afzelii
ALTNSVKEL

SEQ ID NO: 12703 - protein, 9 aa, Borrelia afzelii
LTNSVKELT

SEQ ID NO: 12704 - protein, 9 aa, Borrelia afzelii
TNSVKELTS

SEQ ID NO: 12705 - protein, 9 aa, Borrelia afzelii
NSVKELTSP

SEQ ID NO: 12706 - protein, 9 aa, Borrelia afzelii
SVKELTSPV

SEQ ID NO: 12707 - protein, 9 aa, Borrelia afzelii
VKELTSPVV

SEQ ID NO: 12708 - protein, 9 aa, Borrelia afzelii
KELTSPVVA

SEQ ID NO: 12709 - protein, 9 aa, Borrelia afzelii
ELTSPVVAE

SEQ ID NO: 12710 - protein, 9 aa, Borrelia afzelii
LTSPVVAES

SEQ ID NO: 12711 - protein, 9 aa, Borrelia afzelii
TSPVVAESP

SEQ ID NO: 12712 - protein, 9 aa, Borrelia afzelii
SPVVAESPK

SEQ ID NO: 12713 - protein, 9 aa, Borrelia afzelii
PVVAESPKK

SEQ ID NO: 12714 - protein, 9 aa, Borrelia afzelii
VVAESPKKP

SEQ ID NO: 12715 - protein, 10 aa, Borrelia afzelii
MKKNTLSAIL

SEQ ID NO: 12716 - protein, 10 aa, Borrelia afzelii
KKNTLSAILM

SEQ ID NO: 12717 - protein, 10 aa, Borrelia afzelii
KNTLSAILMT

SEQ ID NO: 12718 - protein, 10 aa, Borrelia afzelii
NTLSAILMTL

SEQ ID NO: 12719 - protein, 10 aa, Borrelia afzelii
TLSAILMTLF

SEQ ID NO: 12720 - protein, 10 aa, Borrelia afzelii
LSAILMTLFL

SEQ ID NO: 12721 - protein, 10 aa, Borrelia afzelii
SAILMTLFLF

SEQ ID NO: 12722 - protein, 10 aa, Borrelia afzelii
AILMTLFLFI

SEQ ID NO: 12723 - protein, 10 aa, Borrelia afzelii
ILMTLFLFIS

SEQ ID NO: 12724 - protein, 10 aa, Borrelia afzelii
LMTLFLFISC

SEQ ID NO: 12725 - protein, 10 aa, Borrelia afzelii
MTLFLFISCN

SEQ ID NO: 12726 - protein, 10 aa, Borrelia afzelii
TLFLFISCNN

SEQ ID NO: 12727 - protein, 10 aa, Borrelia afzelii
LFLFISCNNS

SEQ ID NO: 12728 - protein, 10 aa, Borrelia afzelii
FLFISCNNSG

SEQ ID NO: 12729 - protein, 10 aa, Borrelia afzelii
LFISCNNSGK

SEQ ID NO: 12730 - protein, 10 aa, Borrelia afzelii
FISCNNSGKG

SEQ ID NO: 12731 - protein, 10 aa, Borrelia afzelii
ISCNNSGKGG

SEQ ID NO: 12732 - protein, 10 aa, Borrelia afzelii
SCNNSGKGGD

SEQ ID NO: 12733 - protein, 10 aa, Borrelia afzelii
CNNSGKGGDS

SEQ ID NO: 12734 - protein, 10 aa, Borrelia afzelii
NNSGKGGDSA

SEQ ID NO: 12735 - protein, 10 aa, Borrelia afzelii
NSGKGGDSAS

SEQ ID NO: 12736 - protein, 10 aa, Borrelia afzelii
SGKGGDSAST

SEQ ID NO: 12737 - protein, 10 aa, Borrelia afzelii
GKGGDSASTN

SEQ ID NO: 12738 - protein, 10 aa, Borrelia afzelii
KGGDSASTNP

SEQ ID NO: 12739 - protein, 10 aa, Borrelia afzelii
GGDSASTNPA

SEQ ID NO: 12740 - protein, 10 aa, Borrelia afzelii
GDSASTNPAD

SEQ ID NO: 12741 - protein, 10 aa, Borrelia afzelii
DSASTNPADE

SEQ ID NO: 12742 - protein, 10 aa, Borrelia afzelii
SASTNPADES

SEQ ID NO: 12743 - protein, 10 aa, Borrelia afzelii
ASTNPADESA

SEQ ID NO: 12744 - protein, 10 aa, Borrelia afzelii
STNPADESAK

SEQ ID NO: 12745 - protein, 10 aa, Borrelia afzelii
TNPADESAKG

SEQ ID NO: 12746 - protein, 10 aa, Borrelia afzelii
NPADESAKGP

SEQ ID NO: 12747 - protein, 10 aa, Borrelia afzelii
PADESAKGPN

SEQ ID NO: 12748 - protein, 10 aa, Borrelia afzelii
ADESAKGPNL

SEQ ID NO: 12749 - protein, 10 aa, Borrelia afzelii
DESAKGPNLT

SEQ ID NO: 12750 - protein, 10 aa, Borrelia afzelii
ESAKGPNLTE

SEQ ID NO: 12751 - protein, 10 aa, Borrelia afzelii
SAKGPNLTEI

SEQ ID NO: 12752 - protein, 10 aa, Borrelia afzelii
AKGPNLTEIS

SEQ ID NO: 12753 - protein, 10 aa, Borrelia afzelii
KGPNLTEISK

SEQ ID NO: 12754 - protein, 10 aa, Borrelia afzelii
GPNLTEISKK

SEQ ID NO: 12755 - protein, 10 aa, Borrelia afzelii
PNLTEISKKI

SEQ ID NO: 12756 - protein, 10 aa, Borrelia afzelii
NLTEISKKIT

SEQ ID NO: 12757 - protein, 10 aa, Borrelia afzelii
LTEISKKITD

SEQ ID NO: 12758 - protein, 10 aa, Borrelia afzelii
TEISKKITDS

SEQ ID NO: 12759 - protein, 10 aa, Borrelia afzelii
EISKKITDSN

SEQ ID NO: 12760 - protein, 10 aa, Borrelia afzelii
ISKKITDSNA

SEQ ID NO: 12761 - protein, 10 aa, Borrelia afzelii
SKKITDSNAF

SEQ ID NO: 12762 - protein, 10 aa, Borrelia afzelii
KKITDSNAFV

SEQ ID NO: 12763 - protein, 10 aa, Borrelia afzelii
KITDSNAFVL

SEQ ID NO: 12764 - protein, 10 aa, Borrelia afzelii
ITDSNAFVLA

SEQ ID NO: 12765 - protein, 10 aa, Borrelia afzelii
TDSNAFVLAV

SEQ ID NO: 12766 - protein, 10 aa, Borrelia afzelii
DSNAFVLAVK

SEQ ID NO: 12767 - protein, 10 aa, Borrelia afzelii
SNAFVLAVKE

SEQ ID NO: 12768 - protein, 10 aa, Borrelia afzelii
NAFVLAVKEV

SEQ ID NO: 12769 - protein, 10 aa, Borrelia afzelii
AFVLAVKEVE

SEQ ID NO: 12770 - protein, 10 aa, Borrelia afzelii
FVLAVKEVET

SEQ ID NO: 12771 - protein, 10 aa, Borrelia afzelii
VLAVKEVETL

SEQ ID NO: 12772 - protein, 10 aa, Borrelia afzelii
LAVKEVETLV

SEQ ID NO: 12773 - protein, 10 aa, Borrelia afzelii
AVKEVETLVS

SEQ ID NO: 12774 - protein, 10 aa, Borrelia afzelii
VKEVETLVSS

SEQ ID NO: 12775 - protein, 10 aa, Borrelia afzelii
KEVETLVSSI

SEQ ID NO: 12776 - protein, 10 aa, Borrelia afzelii
EVETLVSSID

SEQ ID NO: 12777 - protein, 10 aa, Borrelia afzelii
VETLVSSIDE

SEQ ID NO: 12778 - protein, 10 aa, Borrelia afzelii
ETLVSSIDEL

SEQ ID NO: 12779 - protein, 10 aa, Borrelia afzelii
TLVSSIDELA

SEQ ID NO: 12780 - protein, 10 aa, Borrelia afzelii
LVSSIDELAN

SEQ ID NO: 12781 - protein, 10 aa, Borrelia afzelii
VSSIDELANK

SEQ ID NO: 12782 - protein, 10 aa, Borrelia afzelii
SSIDELANKA

SEQ ID NO: 12783 - protein, 10 aa, Borrelia afzelii
SIDELANKAI

SEQ ID NO: 12784 - protein, 10 aa, Borrelia afzelii
IDELANKAIG

SEQ ID NO: 12785 - protein, 10 aa, Borrelia afzelii
DELANKAIGK

SEQ ID NO: 12786 - protein, 10 aa, Borrelia afzelii
ELANKAIGKK

SEQ ID NO: 12787 - protein, 10 aa, Borrelia afzelii
LANKAIGKKI

SEQ ID NO: 12788 - protein, 10 aa, Borrelia afzelii
ANKAIGKKIQ

SEQ ID NO: 12789 - protein, 10 aa, Borrelia afzelii
NKAIGKKIQQ

SEQ ID NO: 12790 - protein, 10 aa, Borrelia afzelii
KAIGKKIQQN

SEQ ID NO: 12791 - protein, 10 aa, Borrelia afzelii
AIGKKIQQNG

SEQ ID NO: 12792 - protein, 10 aa, Borrelia afzelii
IGKKIQQNGL

SEQ ID NO: 12793 - protein, 10 aa, Borrelia afzelii
GKKIQQNGLG

SEQ ID NO: 12794 - protein, 10 aa, Borrelia afzelii
KKIQQNGLGA

SEQ ID NO: 12795 - protein, 10 aa, Borrelia afzelii
KIQQNGLGAE

SEQ ID NO: 12796 - protein, 10 aa, Borrelia afzelii
IQQNGLGAEA

SEQ ID NO: 12797 - protein, 10 aa, Borrelia afzelii
QQNGLGAEAN

SEQ ID NO: 12798 - protein, 10 aa, Borrelia afzelii
QNGLGAEANR

SEQ ID NO: 12799 - protein, 10 aa, Borrelia afzelii
NGLGAEANRN

SEQ ID NO: 12800 - protein, 10 aa, Borrelia afzelii
GLGAEANRNE

SEQ ID NO: 12801 - protein, 10 aa, Borrelia afzelii
LGAEANRNES

SEQ ID NO: 12802 - protein, 10 aa, Borrelia afzelii
GAEANRNESL

SEQ ID NO: 12803 - protein, 10 aa, Borrelia afzelii
AEANRNESLL

SEQ ID NO: 12804 - protein, 10 aa, Borrelia afzelii
EANRNESLLA

SEQ ID NO: 12805 - protein, 10 aa, Borrelia afzelii
ANRNESLLAG

SEQ ID NO: 12806 - protein, 10 aa, Borrelia afzelii
NRNESLLAGV

SEQ ID NO: 12807 - protein, 10 aa, Borrelia afzelii
RNESLLAGVH

SEQ ID NO: 12808 - protein, 10 aa, Borrelia afzelii
NESLLAGVHE

SEQ ID NO: 12809 - protein, 10 aa, Borrelia afzelii
ESLLAGVHEI

SEQ ID NO: 12810 - protein, 10 aa, Borrelia afzelii
SLLAGVHEIS

SEQ ID NO: 12811 - protein, 10 aa, Borrelia afzelii
LLAGVHEIST

SEQ ID NO: 12812 - protein, 10 aa, Borrelia afzelii
LAGVHEISTL

SEQ ID NO: 12813 - protein, 10 aa, Borrelia afzelii
AGVHEISTLI

SEQ ID NO: 12814 - protein, 10 aa, Borrelia afzelii
GVHEISTLIT

SEQ ID NO: 12815 - protein, 10 aa, Borrelia afzelii
VHEISTLITE

SEQ ID NO: 12816 - protein, 10 aa, Borrelia afzelii
HEISTLITEK

SEQ ID NO: 12817 - protein, 10 aa, Borrelia afzelii
EISTLITEKL

SEQ ID NO: 12818 - protein, 10 aa, Borrelia afzelii
ISTLITEKLS

SEQ ID NO: 12819 - protein, 10 aa, Borrelia afzelii
STLITEKLSK

SEQ ID NO: 12820 - protein, 10 aa, Borrelia afzelii
TLITEKLSKL

SEQ ID NO: 12821 - protein, 10 aa, Borrelia afzelii
LITEKLSKLK

SEQ ID NO: 12822 - protein, 10 aa, Borrelia afzelii
ITEKLSKLKN

SEQ ID NO: 12823 - protein, 10 aa, Borrelia afzelii
TEKLSKLKNS

SEQ ID NO: 12824 - protein, 10 aa, Borrelia afzelii
EKLSKLKNSG

SEQ ID NO: 12825 - protein, 10 aa, Borrelia afzelii
KLSKLKNSGE

SEQ ID NO: 12826 - protein, 10 aa, Borrelia afzelii
LSKLKNSGEL

SEQ ID NO: 12827 - protein, 10 aa, Borrelia afzelii
SKLKNSGELK

SEQ ID NO: 12828 - protein, 10 aa, Borrelia afzelii
KLKNSGELKA

SEQ ID NO: 12829 - protein, 10 aa, Borrelia afzelii
LKNSGELKAK

SEQ ID NO: 12830 - protein, 10 aa, Borrelia afzelii
KNSGELKAKI

SEQ ID NO: 12831 - protein, 10 aa, Borrelia afzelii
NSGELKAKIE

SEQ ID NO: 12832 - protein, 10 aa, Borrelia afzelii
SGELKAKIED

SEQ ID NO: 12833 - protein, 10 aa, Borrelia afzelii
GELKAKIEDA

SEQ ID NO: 12834 - protein, 10 aa, Borrelia afzelii
ELKAKIEDAK

SEQ ID NO: 12835 - protein, 10 aa, Borrelia afzelii
LKAKIEDAKK

SEQ ID NO: 12836 - protein, 10 aa, Borrelia afzelii
KAKIEDAKKC

SEQ ID NO: 12837 - protein, 10 aa, Borrelia afzelii
AKIEDAKKCS

SEQ ID NO: 12838 - protein, 10 aa, Borrelia afzelii
KIEDAKKCSE

SEQ ID NO: 12839 - protein, 10 aa, Borrelia afzelii
IEDAKKCSEE

SEQ ID NO: 12840 - protein, 10 aa, Borrelia afzelii
EDAKKCSEEF

SEQ ID NO: 12841 - protein, 10 aa, Borrelia afzelii
DAKKCSEEFT

SEQ ID NO: 12842 - protein, 10 aa, Borrelia afzelii
AKKCSEEFTN

SEQ ID NO: 12843 - protein, 10 aa, Borrelia afzelii
KKCSEEFTNK

SEQ ID NO: 12844 - protein, 10 aa, Borrelia afzelii
KCSEEFTNKL

SEQ ID NO: 12845 - protein, 10 aa, Borrelia afzelii
CSEEFTNKLR

SEQ ID NO: 12846 - protein, 10 aa, Borrelia afzelii
SEEFTNKLRV

SEQ ID NO: 12847 - protein, 10 aa, Borrelia afzelii
EEFTNKLRVS

SEQ ID NO: 12848 - protein, 10 aa, Borrelia afzelii
EFTNKLRVSH

SEQ ID NO: 12849 - protein, 10 aa, Borrelia afzelii
FTNKLRVSHA

SEQ ID NO: 12850 - protein, 10 aa, Borrelia afzelii
TNKLRVSHAD

SEQ ID NO: 12851 - protein, 10 aa, Borrelia afzelii
NKLRVSHADL

SEQ ID NO: 12852 - protein, 10 aa, Borrelia afzelii
KLRVSHADLG

SEQ ID NO: 12853 - protein, 10 aa, Borrelia afzelii
LRVSHADLGK

SEQ ID NO: 12854 - protein, 10 aa, Borrelia afzelii
RVSHADLGKQ

SEQ ID NO: 12855 - protein, 10 aa, Borrelia afzelii
VSHADLGKQG

SEQ ID NO: 12856 - protein, 10 aa, Borrelia afzelii
SHADLGKQGV

SEQ ID NO: 12857 - protein, 10 aa, Borrelia afzelii
HADLGKQGVN

SEQ ID NO: 12858 - protein, 10 aa, Borrelia afzelii
ADLGKQGVND

SEQ ID NO: 12859 - protein, 10 aa, Borrelia afzelii
DLGKQGVNDD

SEQ ID NO: 12860 - protein, 10 aa, Borrelia afzelii
LGKQGVNDDD

SEQ ID NO: 12861 - protein, 10 aa, Borrelia afzelii
GKQGVNDDDA

SEQ ID NO: 12862 - protein, 10 aa, Borrelia afzelii
KQGVNDDDAK

SEQ ID NO: 12863 - protein, 10 aa, Borrelia afzelii
QGVNDDDAKK

SEQ ID NO: 12864 - protein, 10 aa, Borrelia afzelii
GVNDDDAKKA

SEQ ID NO: 12865 - protein, 10 aa, Borrelia afzelii
VNDDDAKKAI

SEQ ID NO: 12866 - protein, 10 aa, Borrelia afzelii
NDDDAKKAIL

SEQ ID NO: 12867 - protein, 10 aa, Borrelia afzelii
DDDAKKAILK

SEQ ID NO: 12868 - protein, 10 aa, Borrelia afzelii
DDAKKAILKT

SEQ ID NO: 12869 - protein, 10 aa, Borrelia afzelii
DAKKAILKTN

SEQ ID NO: 12870 - protein, 10 aa, Borrelia afzelii
AKKAILKTNA

SEQ ID NO: 12871 - protein, 10 aa, Borrelia afzelii
KKAILKTNAD

SEQ ID NO: 12872 - protein, 10 aa, Borrelia afzelii
KAILKTNADK

SEQ ID NO: 12873 - protein, 10 aa, Borrelia afzelii
AILKTNADKT

SEQ ID NO: 12874 - protein, 10 aa, Borrelia afzelii
ILKTNADKTK

SEQ ID NO: 12875 - protein, 10 aa, Borrelia afzelii
LKTNADKTKG

SEQ ID NO: 12876 - protein, 10 aa, Borrelia afzelii
KTNADKTKGA

SEQ ID NO: 12877 - protein, 10 aa, Borrelia afzelii
TNADKTKGAE

SEQ ID NO: 12878 - protein, 10 aa, Borrelia afzelii
NADKTKGAEE

SEQ ID NO: 12879 - protein, 10 aa, Borrelia afzelii
ADKTKGAEEL

SEQ ID NO: 12880 - protein, 10 aa, Borrelia afzelii
DKTKGAEELG

SEQ ID NO: 12881 - protein, 10 aa, Borrelia afzelii
KTKGAEELGK

SEQ ID NO: 12882 - protein, 10 aa, Borrelia afzelii
TKGAEELGKL

SEQ ID NO: 12883 - protein, 10 aa, Borrelia afzelii
KGAEELGKLF

SEQ ID NO: 12884 - protein, 10 aa, Borrelia afzelii
GAEELGKLFK

SEQ ID NO: 12885 - protein, 10 aa, Borrelia afzelii
AEELGKLFKS

SEQ ID NO: 12886 - protein, 10 aa, Borrelia afzelii
EELGKLFKSV

SEQ ID NO: 12887 - protein, 10 aa, Borrelia afzelii
ELGKLFKSVE

SEQ ID NO: 12888 - protein, 10 aa, Borrelia afzelii
LGKLFKSVEG

SEQ ID NO: 12889 - protein, 10 aa, Borrelia afzelii
GKLFKSVEGL

SEQ ID NO: 12890 - protein, 10 aa, Borrelia afzelii
KLFKSVEGLV

SEQ ID NO: 12891 - protein, 10 aa, Borrelia afzelii
LFKSVEGLVK

SEQ ID NO: 12892 - protein, 10 aa, Borrelia afzelii
FKSVEGLVKA

SEQ ID NO: 12893 - protein, 10 aa, Borrelia afzelii
KSVEGLVKAA

SEQ ID NO: 12894 - protein, 10 aa, Borrelia afzelii
SVEGLVKAAQ

SEQ ID NO: 12895 - protein, 10 aa, Borrelia afzelii
VEGLVKAAQE

SEQ ID NO: 12896 - protein, 10 aa, Borrelia afzelii
EGLVKAAQEA

SEQ ID NO: 12897 - protein, 10 aa, Borrelia afzelii
GLVKAAQEAL

SEQ ID NO: 12898 - protein, 10 aa, Borrelia afzelii
LVKAAQEALT

SEQ ID NO: 12899 - protein, 10 aa, Borrelia afzelii
VKAAQEALTN

SEQ ID NO: 12900 - protein, 10 aa, Borrelia afzelii
KAAQEALTNS

SEQ ID NO: 12901 - protein, 10 aa, Borrelia afzelii
AAQEALTNSV

SEQ ID NO: 12902 - protein, 10 aa, Borrelia afzelii
AQEALTNSVK

SEQ ID NO: 12903 - protein, 10 aa, Borrelia afzelii
QEALTNSVKE

SEQ ID NO: 12904 - protein, 10 aa, Borrelia afzelii
EALTNSVKEL

SEQ ID NO: 12905 - protein, 10 aa, Borrelia afzelii
ALTNSVKELT

SEQ ID NO: 12906 - protein, 10 aa, Borrelia afzelii
LTNSVKELTS

SEQ ID NO: 12907 - protein, 10 aa, Borrelia afzelii
TNSVKELTSP

SEQ ID NO: 12908 - protein, 10 aa, Borrelia afzelii
NSVKELTSPV

SEQ ID NO: 12909 - protein, 10 aa, Borrelia afzelii
SVKELTSPVV

SEQ ID NO: 12910 - protein, 10 aa, Borrelia afzelii
VKELTSPVVA

SEQ ID NO: 12911 - protein, 10 aa, Borrelia afzelii
KELTSPVVAE

SEQ ID NO: 12912 - protein, 10 aa, Borrelia afzelii
ELTSPVVAES

SEQ ID NO: 12913 - protein, 10 aa, Borrelia afzelii
LTSPVVAESP

SEQ ID NO: 12914 - protein, 10 aa, Borrelia afzelii
TSPVVAESPK

SEQ ID NO: 12915 - protein, 10 aa, Borrelia afzelii
SPVVAESPKK

SEQ ID NO: 12916 - protein, 10 aa, Borrelia afzelii
PVVAESPKKP

SEQ ID NO: 12917 - protein, 11 aa, Borrelia afzelii
MKKNTLSAILM

SEQ ID NO: 12918 - protein, 11 aa, Borrelia afzelii
KKNTLSAILMT

SEQ ID NO: 12919 - protein, 11 aa, Borrelia afzelii
KNTLSAILMTL

SEQ ID NO: 12920 - protein, 11 aa, Borrelia afzelii
NTLSAILMTLF

SEQ ID NO: 12921 - protein, 11 aa, Borrelia afzelii
TLSAILMTLFL

SEQ ID NO: 12922 - protein, 11 aa, Borrelia afzelii
LSAILMTLFLF

SEQ ID NO: 12923 - protein, 11 aa, Borrelia afzelii
SAILMTLFLFI

SEQ ID NO: 12924 - protein, 11 aa, Borrelia afzelii
AILMTLFLFIS

SEQ ID NO: 12925 - protein, 11 aa, Borrelia afzelii
ILMTLFLFISC

SEQ ID NO: 12926 - protein, 11 aa, Borrelia afzelii
LMTLFLFISCN

SEQ ID NO: 12927 - protein, 11 aa, Borrelia afzelii
MTLFLFISCNN

SEQ ID NO: 12928 - protein, 11 aa, Borrelia afzelii
TLFLFISCNNS

SEQ ID NO: 12929 - protein, 11 aa, Borrelia afzelii
LFLFISCNNSG

SEQ ID NO: 12930 - protein, 11 aa, Borrelia afzelii
FLFISCNNSGK

SEQ ID NO: 12931 - protein, 11 aa, Borrelia afzelii
LFISCNNSGKG

SEQ ID NO: 12932 - protein, 11 aa, Borrelia afzelii
FISCNNSGKGG

SEQ ID NO: 12933 - protein, 11 aa, Borrelia afzelii
ISCNNSGKGGD

SEQ ID NO: 12934 - protein, 11 aa, Borrelia afzelii
SCNNSGKGGDS

SEQ ID NO: 12935 - protein, 11 aa, Borrelia afzelii
CNNSGKGGDSA

SEQ ID NO: 12936 - protein, 11 aa, Borrelia afzelii
NNSGKGGDSAS

SEQ ID NO: 12937 - protein, 11 aa, Borrelia afzelii
NSGKGGDSAST

SEQ ID NO: 12938 - protein, 11 aa, Borrelia afzelii
SGKGGDSASTN

SEQ ID NO: 12939 - protein, 11 aa, Borrelia afzelii
GKGGDSASTNP

SEQ ID NO: 12940 - protein, 11 aa, Borrelia afzelii
KGGDSASTNPA

SEQ ID NO: 12941 - protein, 11 aa, Borrelia afzelii
GGDSASTNPAD

SEQ ID NO: 12942 - protein, 11 aa, Borrelia afzelii
GDSASTNPADE

SEQ ID NO: 12943 - protein, 11 aa, Borrelia afzelii
DSASTNPADES

SEQ ID NO: 12944 - protein, 11 aa, Borrelia afzelii
SASTNPADESA

SEQ ID NO: 12945 - protein, 11 aa, Borrelia afzelii
ASTNPADESAK

SEQ ID NO: 12946 - protein, 11 aa, Borrelia afzelii
STNPADESAKG

SEQ ID NO: 12947 - protein, 11 aa, Borrelia afzelii
TNPADESAKGP

SEQ ID NO: 12948 - protein, 11 aa, Borrelia afzelii
NPADESAKGPN

SEQ ID NO: 12949 - protein, 11 aa, Borrelia afzelii
PADESAKGPNL

SEQ ID NO: 12950 - protein, 11 aa, Borrelia afzelii
ADESAKGPNLT

SEQ ID NO: 12951 - protein, 11 aa, Borrelia afzelii
DESAKGPNLTE

SEQ ID NO: 12952 - protein, 11 aa, Borrelia afzelii
ESAKGPNLTEI

SEQ ID NO: 12953 - protein, 11 aa, Borrelia afzelii
SAKGPNLTEIS

SEQ ID NO: 12954 - protein, 11 aa, Borrelia afzelii
AKGPNLTEISK

SEQ ID NO: 12955 - protein, 11 aa, Borrelia afzelii
KGPNLTEISKK

SEQ ID NO: 12956 - protein, 11 aa, Borrelia afzelii
GPNLTEISKKI

SEQ ID NO: 12957 - protein, 11 aa, Borrelia afzelii
PNLTEISKKIT

SEQ ID NO: 12958 - protein, 11 aa, Borrelia afzelii
NLTEISKKITD

SEQ ID NO: 12959 - protein, 11 aa, Borrelia afzelii
LTEISKKITDS

SEQ ID NO: 12960 - protein, 11 aa, Borrelia afzelii
TEISKKITDSN

SEQ ID NO: 12961 - protein, 11 aa, Borrelia afzelii
EISKKITDSNA

SEQ ID NO: 12962 - protein, 11 aa, Borrelia afzelii
ISKKITDSNAF

SEQ ID NO: 12963 - protein, 11 aa, Borrelia afzelii
SKKITDSNAFV

SEQ ID NO: 12964 - protein, 11 aa, Borrelia afzelii
KKITDSNAFVL

SEQ ID NO: 12965 - protein, 11 aa, Borrelia afzelii
KITDSNAFVLA

SEQ ID NO: 12966 - protein, 11 aa, Borrelia afzelii
ITDSNAFVLAV

SEQ ID NO: 12967 - protein, 11 aa, Borrelia afzelii
TDSNAFVLAVK

SEQ ID NO: 12968 - protein, 11 aa, Borrelia afzelii
DSNAFVLAVKE

SEQ ID NO: 12969 - protein, 11 aa, Borrelia afzelii
SNAFVLAVKEV

SEQ ID NO: 12970 - protein, 11 aa, Borrelia afzelii
NAFVLAVKEVE

SEQ ID NO: 12971 - protein, 11 aa, Borrelia afzelii
AFVLAVKEVET

SEQ ID NO: 12972 - protein, 11 aa, Borrelia afzelii
FVLAVKEVETL

SEQ ID NO: 12973 - protein, 11 aa, Borrelia afzelii
VLAVKEVETLV

SEQ ID NO: 12974 - protein, 11 aa, Borrelia afzelii
LAVKEVETLVS

SEQ ID NO: 12975 - protein, 11 aa, Borrelia afzelii
AVKEVETLVSS

SEQ ID NO: 12976 - protein, 11 aa, Borrelia afzelii
VKEVETLVSSI

SEQ ID NO: 12977 - protein, 11 aa, Borrelia afzelii
KEVETLVSSID

SEQ ID NO: 12978 - protein, 11 aa, Borrelia afzelii
EVETLVSSIDE

SEQ ID NO: 12979 - protein, 11 aa, Borrelia afzelii
VETLVSSIDEL

SEQ ID NO: 12980 - protein, 11 aa, Borrelia afzelii
ETLVSSIDELA

SEQ ID NO: 12981 - protein, 11 aa, Borrelia afzelii
TLVSSIDELAN

SEQ ID NO: 12982 - protein, 11 aa, Borrelia afzelii
LVSSIDELANK

SEQ ID NO: 12983 - protein, 11 aa, Borrelia afzelii
VSSIDELANKA

SEQ ID NO: 12984 - protein, 11 aa, Borrelia afzelii
SSIDELANKAI

SEQ ID NO: 12985 - protein, 11 aa, Borrelia afzelii
SIDELANKAIG

SEQ ID NO: 12986 - protein, 11 aa, Borrelia afzelii
IDELANKAIGK

SEQ ID NO: 12987 - protein, 11 aa, Borrelia afzelii
DELANKAIGKK

SEQ ID NO: 12988 - protein, 11 aa, Borrelia afzelii
ELANKAIGKKI

SEQ ID NO: 12989 - protein, 11 aa, Borrelia afzelii
LANKAIGKKIQ

SEQ ID NO: 12990 - protein, 11 aa, Borrelia afzelii
ANKAIGKKIQQ

SEQ ID NO: 12991 - protein, 11 aa, Borrelia afzelii
NKAIGKKIQQN

SEQ ID NO: 12992 - protein, 11 aa, Borrelia afzelii
KAIGKKIQQNG

SEQ ID NO: 12993 - protein, 11 aa, Borrelia afzelii
AIGKKIQQNGL

SEQ ID NO: 12994 - protein, 11 aa, Borrelia afzelii
IGKKIQQNGLG

SEQ ID NO: 12995 - protein, 11 aa, Borrelia afzelii
GKKIQQNGLGA

SEQ ID NO: 12996 - protein, 11 aa, Borrelia afzelii
KKIQQNGLGAE

SEQ ID NO: 12997 - protein, 11 aa, Borrelia afzelii
KIQQNGLGAEA

SEQ ID NO: 12998 - protein, 11 aa, Borrelia afzelii
IQQNGLGAEAN

SEQ ID NO: 12999 - protein, 11 aa, Borrelia afzelii
QQNGLGAEANR

SEQ ID NO: 13000 - protein, 11 aa, Borrelia afzelii
QNGLGAEANRN

SEQ ID NO: 13001 - protein, 11 aa, Borrelia afzelii
NGLGAEANRNE

SEQ ID NO: 13002 - protein, 11 aa, Borrelia afzelii
GLGAEANRNES

SEQ ID NO: 13003 - protein, 11 aa, Borrelia afzelii
LGAEANRNESL

SEQ ID NO: 13004 - protein, 11 aa, Borrelia afzelii
GAEANRNESLL

SEQ ID NO: 13005 - protein, 11 aa, Borrelia afzelii
AEANRNESLLA

SEQ ID NO: 13006 - protein, 11 aa, Borrelia afzelii
EANRNESLLAG

SEQ ID NO: 13007 - protein, 11 aa, Borrelia afzelii
ANRNESLLAGV

SEQ ID NO: 13008 - protein, 11 aa, Borrelia afzelii
NRNESLLAGVH

SEQ ID NO: 13009 - protein, 11 aa, Borrelia afzelii
RNESLLAGVHE

SEQ ID NO: 13010 - protein, 11 aa, Borrelia afzelii
NESLLAGVHEI

SEQ ID NO: 13011 - protein, 11 aa, Borrelia afzelii
ESLLAGVHEIS

SEQ ID NO: 13012 - protein, 11 aa, Borrelia afzelii
SLLAGVHEIST

SEQ ID NO: 13013 - protein, 11 aa, Borrelia afzelii
LLAGVHEISTL

SEQ ID NO: 13014 - protein, 11 aa, Borrelia afzelii
LAGVHEISTLI

SEQ ID NO: 13015 - protein, 11 aa, Borrelia afzelii
AGVHEISTLIT

SEQ ID NO: 13016 - protein, 11 aa, Borrelia afzelii
GVHEISTLITE

SEQ ID NO: 13017 - protein, 11 aa, Borrelia afzelii
VHEISTLITEK

SEQ ID NO: 13018 - protein, 11 aa, Borrelia afzelii
HEISTLITEKL

SEQ ID NO: 13019 - protein, 11 aa, Borrelia afzelii
EISTLITEKLS

SEQ ID NO: 13020 - protein, 11 aa, Borrelia afzelii
ISTLITEKLSK

SEQ ID NO: 13021 - protein, 11 aa, Borrelia afzelii
STLITEKLSKL

SEQ ID NO: 13022 - protein, 11 aa, Borrelia afzelii
TLITEKLSKLK

SEQ ID NO: 13023 - protein, 11 aa, Borrelia afzelii
LITEKLSKLKN

SEQ ID NO: 13024 - protein, 11 aa, Borrelia afzelii
ITEKLSKLKNS

SEQ ID NO: 13025 - protein, 11 aa, Borrelia afzelii
TEKLSKLKNSG

SEQ ID NO: 13026 - protein, 11 aa, Borrelia afzelii
EKLSKLKNSGE

SEQ ID NO: 13027 - protein, 11 aa, Borrelia afzelii
KLSKLKNSGEL

SEQ ID NO: 13028 - protein, 11 aa, Borrelia afzelii
LSKLKNSGELK

SEQ ID NO: 13029 - protein, 11 aa, Borrelia afzelii
SKLKNSGELKA

SEQ ID NO: 13030 - protein, 11 aa, Borrelia afzelii
KLKNSGELKAK

SEQ ID NO: 13031 - protein, 11 aa, Borrelia afzelii
LKNSGELKAKI

SEQ ID NO: 13032 - protein, 11 aa, Borrelia afzelii
KNSGELKAKIE

SEQ ID NO: 13033 - protein, 11 aa, Borrelia afzelii
NSGELKAKIED

SEQ ID NO: 13034 - protein, 11 aa, Borrelia afzelii
SGELKAKIEDA

SEQ ID NO: 13035 - protein, 11 aa, Borrelia afzelii
GELKAKIEDAK

SEQ ID NO: 13036 - protein, 11 aa, Borrelia afzelii
ELKAKIEDAKK

SEQ ID NO: 13037 - protein, 11 aa, Borrelia afzelii
LKAKIEDAKKC

SEQ ID NO: 13038 - protein, 11 aa, Borrelia afzelii
KAKIEDAKKCS

SEQ ID NO: 13039 - protein, 11 aa, Borrelia afzelii
AKIEDAKKCSE

SEQ ID NO: 13040 - protein, 11 aa, Borrelia afzelii
KIEDAKKCSEE

SEQ ID NO: 13041 - protein, 11 aa, Borrelia afzelii
IEDAKKCSEEF

SEQ ID NO: 13042 - protein, 11 aa, Borrelia afzelii
EDAKKCSEEFT

SEQ ID NO: 13043 - protein, 11 aa, Borrelia afzelii
DAKKCSEEFTN

SEQ ID NO: 13044 - protein, 11 aa, Borrelia afzelii
AKKCSEEFTNK

SEQ ID NO: 13045 - protein, 11 aa, Borrelia afzelii
KKCSEEFTNKL

SEQ ID NO: 13046 - protein, 11 aa, Borrelia afzelii
KCSEEFTNKLR

SEQ ID NO: 13047 - protein, 11 aa, Borrelia afzelii
CSEEFTNKLRV

SEQ ID NO: 13048 - protein, 11 aa, Borrelia afzelii
SEEFTNKLRVS

SEQ ID NO: 13049 - protein, 11 aa, Borrelia afzelii
EEFTNKLRVSH

SEQ ID NO: 13050 - protein, 11 aa, Borrelia afzelii
EFTNKLRVSHA

SEQ ID NO: 13051 - protein, 11 aa, Borrelia afzelii
FTNKLRVSHAD

SEQ ID NO: 13052 - protein, 11 aa, Borrelia afzelii
TNKLRVSHADL

SEQ ID NO: 13053 - protein, 11 aa, Borrelia afzelii
NKLRVSHADLG

SEQ ID NO: 13054 - protein, 11 aa, Borrelia afzelii
KLRVSHADLGK

SEQ ID NO: 13055 - protein, 11 aa, Borrelia afzelii
LRVSHADLGKQ

SEQ ID NO: 13056 - protein, 11 aa, Borrelia afzelii
RVSHADLGKQG

SEQ ID NO: 13057 - protein, 11 aa, Borrelia afzelii
VSHADLGKQGV

SEQ ID NO: 13058 - protein, 11 aa, Borrelia afzelii
SHADLGKQGVN

SEQ ID NO: 13059 - protein, 11 aa, Borrelia afzelii
HADLGKQGVND

SEQ ID NO: 13060 - protein, 11 aa, Borrelia afzelii
ADLGKQGVNDD

SEQ ID NO: 13061 - protein, 11 aa, Borrelia afzelii
DLGKQGVNDDD

SEQ ID NO: 13062 - protein, 11 aa, Borrelia afzelii
LGKQGVNDDDA

SEQ ID NO: 13063 - protein, 11 aa, Borrelia afzelii
GKQGVNDDDAK

SEQ ID NO: 13064 - protein, 11 aa, Borrelia afzelii
KQGVNDDDAKK

SEQ ID NO: 13065 - protein, 11 aa, Borrelia afzelii
QGVNDDDAKKA

SEQ ID NO: 13066 - protein, 11 aa, Borrelia afzelii
GVNDDDAKKAI

SEQ ID NO: 13067 - protein, 11 aa, Borrelia afzelii
VNDDDAKKAIL

SEQ ID NO: 13068 - protein, 11 aa, Borrelia afzelii
NDDDAKKAILK

SEQ ID NO: 13069 - protein, 11 aa, Borrelia afzelii
DDDAKKAILKT

SEQ ID NO: 13070 - protein, 11 aa, Borrelia afzelii
DDAKKAILKTN

SEQ ID NO: 13071 - protein, 11 aa, Borrelia afzelii
DAKKAILKTNA

SEQ ID NO: 13072 - protein, 11 aa, Borrelia afzelii
AKKAILKTNAD

SEQ ID NO: 13073 - protein, 11 aa, Borrelia afzelii
KKAILKTNADK

SEQ ID NO: 13074 - protein, 11 aa, Borrelia afzelii
KAILKTNADKT

SEQ ID NO: 13075 - protein, 11 aa, Borrelia afzelii
AILKTNADKTK

SEQ ID NO: 13076 - protein, 11 aa, Borrelia afzelii
ILKTNADKTKG

SEQ ID NO: 13077 - protein, 11 aa, Borrelia afzelii
LKTNADKTKGA

SEQ ID NO: 13078 - protein, 11 aa, Borrelia afzelii
KTNADKTKGAE

SEQ ID NO: 13079 - protein, 11 aa, Borrelia afzelii
TNADKTKGAEE

SEQ ID NO: 13080 - protein, 11 aa, Borrelia afzelii
NADKTKGAEEL

SEQ ID NO: 13081 - protein, 11 aa, Borrelia afzelii
ADKTKGAEELG

SEQ ID NO: 13082 - protein, 11 aa, Borrelia afzelii
DKTKGAEELGK

SEQ ID NO: 13083 - protein, 11 aa, Borrelia afzelii
KTKGAEELGKL

SEQ ID NO: 13084 - protein, 11 aa, Borrelia afzelii
TKGAEELGKLF

SEQ ID NO: 13085 - protein, 11 aa, Borrelia afzelii
KGAEELGKLFK

SEQ ID NO: 13086 - protein, 11 aa, Borrelia afzelii
GAEELGKLFKS

SEQ ID NO: 13087 - protein, 11 aa, Borrelia afzelii
AEELGKLFKSV

SEQ ID NO: 13088 - protein, 11 aa, Borrelia afzelii
EELGKLFKSVE

SEQ ID NO: 13089 - protein, 11 aa, Borrelia afzelii
ELGKLFKSVEG

SEQ ID NO: 13090 - protein, 11 aa, Borrelia afzelii
LGKLFKSVEGL

SEQ ID NO: 13091 - protein, 11 aa, Borrelia afzelii
GKLFKSVEGLV

SEQ ID NO: 13092 - protein, 11 aa, Borrelia afzelii
KLFKSVEGLVK

SEQ ID NO: 13093 - protein, 11 aa, Borrelia afzelii
LFKSVEGLVKA

SEQ ID NO: 13094 - protein, 11 aa, Borrelia afzelii
FKSVEGLVKAA

SEQ ID NO: 13095 - protein, 11 aa, Borrelia afzelii
KSVEGLVKAAQ

SEQ ID NO: 13096 - protein, 11 aa, Borrelia afzelii
SVEGLVKAAQE

SEQ ID NO: 13097 - protein, 11 aa, Borrelia afzelii
VEGLVKAAQEA

SEQ ID NO: 13098 - protein, 11 aa, Borrelia afzelii
EGLVKAAQEAL

SEQ ID NO: 13099 - protein, 11 aa, Borrelia afzelii
GLVKAAQEALT

SEQ ID NO: 13100 - protein, 11 aa, Borrelia afzelii
LVKAAQEALTN

SEQ ID NO: 13101 - protein, 11 aa, Borrelia afzelii
VKAAQEALTNS

SEQ ID NO: 13102 - protein, 11 aa, Borrelia afzelii
KAAQEALTNSV

SEQ ID NO: 13103 - protein, 11 aa, Borrelia afzelii
AAQEALTNSVK

SEQ ID NO: 13104 - protein, 11 aa, Borrelia afzelii
AQEALTNSVKE

SEQ ID NO: 13105 - protein, 11 aa, Borrelia afzelii
QEALTNSVKEL

SEQ ID NO: 13106 - protein, 11 aa, Borrelia afzelii
EALTNSVKELT

SEQ ID NO: 13107 - protein, 11 aa, Borrelia afzelii
ALTNSVKELTS

SEQ ID NO: 13108 - protein, 11 aa, Borrelia afzelii
LTNSVKELTSP

SEQ ID NO: 13109 - protein, 11 aa, Borrelia afzelii
TNSVKELTSPV

SEQ ID NO: 13110 - protein, 11 aa, Borrelia afzelii
NSVKELTSPVV

SEQ ID NO: 13111 - protein, 11 aa, Borrelia afzelii
SVKELTSPVVA

SEQ ID NO: 13112 - protein, 11 aa, Borrelia afzelii
VKELTSPVVAE

SEQ ID NO: 13113 - protein, 11 aa, Borrelia afzelii
KELTSPVVAES

SEQ ID NO: 13114 - protein, 11 aa, Borrelia afzelii
ELTSPVVAESP

SEQ ID NO: 13115 - protein, 11 aa, Borrelia afzelii
LTSPVVAESPK

SEQ ID NO: 13116 - protein, 11 aa, Borrelia afzelii
TSPVVAESPKK

SEQ ID NO: 13117 - protein, 11 aa, Borrelia afzelii
SPVVAESPKKP

SEQ ID NO: 13118 - protein, 8 aa, Borrelia garinii
MNKKMKMF

SEQ ID NO: 13119 - protein, 8 aa, Borrelia garinii
NKKMKMFI

SEQ ID NO: 13120 - protein, 8 aa, Borrelia garinii
KKMKMFII

SEQ ID NO: 13121 - protein, 8 aa, Borrelia garinii
KMKMFIIC

SEQ ID NO: 13122 - protein, 8 aa, Borrelia garinii
MKMFIICA

SEQ ID NO: 13123 - protein, 8 aa, Borrelia garinii
KMFIICAV

SEQ ID NO: 13124 - protein, 8 aa, Borrelia garinii
MFIICAVF

SEQ ID NO: 13125 - protein, 8 aa, Borrelia garinii
FIICAVFV

SEQ ID NO: 13126 - protein, 8 aa, Borrelia garinii
IICAVFVL

SEQ ID NO: 13127 - protein, 8 aa, Borrelia garinii
ICAVFVLI

SEQ ID NO: 13128 - protein, 8 aa, Borrelia garinii
CAVFVLIS

SEQ ID NO: 13129 - protein, 8 aa, Borrelia garinii
AVFVLISS

SEQ ID NO: 13130 - protein, 8 aa, Borrelia garinii
VFVLISSC

SEQ ID NO: 13131 - protein, 8 aa, Borrelia garinii
FVLISSCG

SEQ ID NO: 13132 - protein, 8 aa, Borrelia garinii
VLISSCGN

SEQ ID NO: 13133 - protein, 8 aa, Borrelia garinii
LISSCGNF

SEQ ID NO: 13134 - protein, 8 aa, Borrelia garinii
ISSCGNFR

SEQ ID NO: 13135 - protein, 8 aa, Borrelia garinii
SSCGNFRS

SEQ ID NO: 13136 - protein, 8 aa, Borrelia garinii
SCGNFRSS

SEQ ID NO: 13137 - protein, 8 aa, Borrelia garinii
CGNFRSSL

SEQ ID NO: 13138 - protein, 8 aa, Borrelia garinii
GNFRSSLS

SEQ ID NO: 13139 - protein, 8 aa, Borrelia garinii
NFRSSLSD

SEQ ID NO: 13140 - protein, 8 aa, Borrelia garinii
FRSSLSDQ

SEQ ID NO: 13141 - protein, 8 aa, Borrelia garinii
RSSLSDQG

SEQ ID NO: 13142 - protein, 8 aa, Borrelia garinii
SSLSDQGS

SEQ ID NO: 13143 - protein, 8 aa, Borrelia garinii
SLSDQGSL

SEQ ID NO: 13144 - protein, 8 aa, Borrelia garinii
LSDQGSLS

SEQ ID NO: 13145 - protein, 8 aa, Borrelia garinii
SDQGSLSD

SEQ ID NO: 13146 - protein, 8 aa, Borrelia garinii
DQGSLSDQ

SEQ ID NO: 13147 - protein, 8 aa, Borrelia garinii
QGSLSDQG

SEQ ID NO: 13148 - protein, 8 aa, Borrelia garinii
GSLSDQGS

SEQ ID NO: 13149 - protein, 8 aa, Borrelia garinii
SLSDQGSL

SEQ ID NO: 13150 - protein, 8 aa, Borrelia garinii
LSDQGSLS

SEQ ID NO: 13151 - protein, 8 aa, Borrelia garinii
SDQGSLSD

SEQ ID NO: 13152 - protein, 8 aa, Borrelia garinii
DQGSLSDQ

SEQ ID NO: 13153 - protein, 8 aa, Borrelia garinii
QGSLSDQG

SEQ ID NO: 13154 - protein, 8 aa, Borrelia garinii
GSLSDQGS

SEQ ID NO: 13155 - protein, 8 aa, Borrelia garinii
SLSDQGSL

SEQ ID NO: 13156 - protein, 8 aa, Borrelia garinii
LSDQGSLS

SEQ ID NO: 13157 - protein, 8 aa, Borrelia garinii
SDQGSLSD

SEQ ID NO: 13158 - protein, 8 aa, Borrelia garinii
DQGSLSDQ

SEQ ID NO: 13159 - protein, 8 aa, Borrelia garinii
QGSLSDQG

SEQ ID NO: 13160 - protein, 8 aa, Borrelia garinii
GSLSDQGG

SEQ ID NO: 13161 - protein, 8 aa, Borrelia garinii
SLSDQGGL

SEQ ID NO: 13162 - protein, 8 aa, Borrelia garinii
LSDQGGLS

SEQ ID NO: 13163 - protein, 8 aa, Borrelia garinii
SDQGGLSG

SEQ ID NO: 13164 - protein, 8 aa, Borrelia garinii
DQGGLSGQ

SEQ ID NO: 13165 - protein, 8 aa, Borrelia garinii
QGGLSGQA

SEQ ID NO: 13166 - protein, 8 aa, Borrelia garinii
GGLSGQAS

SEQ ID NO: 13167 - protein, 8 aa, Borrelia garinii
GLSGQASS

SEQ ID NO: 13168 - protein, 8 aa, Borrelia garinii
LSGQASSD

SEQ ID NO: 13169 - protein, 8 aa, Borrelia garinii
SGQASSDT

SEQ ID NO: 13170 - protein, 8 aa, Borrelia garinii
GQASSDTI

SEQ ID NO: 13171 - protein, 8 aa, Borrelia garinii
QASSDTIK

SEQ ID NO: 13172 - protein, 8 aa, Borrelia garinii
ASSDTIKF

SEQ ID NO: 13173 - protein, 8 aa, Borrelia garinii
SSDTIKFS

SEQ ID NO: 13174 - protein, 8 aa, Borrelia garinii
SDTIKFSE

SEQ ID NO: 13175 - protein, 8 aa, Borrelia garinii
DTIKFSEF

SEQ ID NO: 13176 - protein, 8 aa, Borrelia garinii
TIKFSEFT

SEQ ID NO: 13177 - protein, 8 aa, Borrelia garinii
IKFSEFTV

SEQ ID NO: 13178 - protein, 8 aa, Borrelia garinii
KFSEFTVN

SEQ ID NO: 13179 - protein, 8 aa, Borrelia garinii
FSEFTVNI

SEQ ID NO: 13180 - protein, 8 aa, Borrelia garinii
SEFTVNIK

SEQ ID NO: 13181 - protein, 8 aa, Borrelia garinii
EFTVNIKN

SEQ ID NO: 13182 - protein, 8 aa, Borrelia garinii
FTVNIKNK

SEQ ID NO: 13183 - protein, 8 aa, Borrelia garinii
TVNIKNKK

SEQ ID NO: 13184 - protein, 8 aa, Borrelia garinii
VNIKNKKD

SEQ ID NO: 13185 - protein, 8 aa, Borrelia garinii
NIKNKKDN

SEQ ID NO: 13186 - protein, 8 aa, Borrelia garinii
IKNKKDNN

SEQ ID NO: 13187 - protein, 8 aa, Borrelia garinii
KNKKDNNG

SEQ ID NO: 13188 - protein, 8 aa, Borrelia garinii
NKKDNNGD

SEQ ID NO: 13189 - protein, 8 aa, Borrelia garinii
KKDNNGDW

SEQ ID NO: 13190 - protein, 8 aa, Borrelia garinii
KDNNGDWS

SEQ ID NO: 13191 - protein, 8 aa, Borrelia garinii
DNNGDWSN

SEQ ID NO: 13192 - protein, 8 aa, Borrelia garinii
NNGDWSNL

SEQ ID NO: 13193 - protein, 8 aa, Borrelia garinii
NGDWSNLG

SEQ ID NO: 13194 - protein, 8 aa, Borrelia garinii
GDWSNLGT

SEQ ID NO: 13195 - protein, 8 aa, Borrelia garinii
DWSNLGTL

SEQ ID NO: 13196 - protein, 8 aa, Borrelia garinii
WSNLGTLV

SEQ ID NO: 13197 - protein, 8 aa, Borrelia garinii
SNLGTLVI

SEQ ID NO: 13198 - protein, 8 aa, Borrelia garinii
NLGTLVIR

SEQ ID NO: 13199 - protein, 8 aa, Borrelia garinii
LGTLVIRK

SEQ ID NO: 13200 - protein, 8 aa, Borrelia garinii
GTLVIRKE

SEQ ID NO: 13201 - protein, 8 aa, Borrelia garinii
TLVIRKEQ

SEQ ID NO: 13202 - protein, 8 aa, Borrelia garinii
LVIRKEQD

SEQ ID NO: 13203 - protein, 8 aa, Borrelia garinii
VIRKEQDG

SEQ ID NO: 13204 - protein, 8 aa, Borrelia garinii
IRKEQDGV

SEQ ID NO: 13205 - protein, 8 aa, Borrelia garinii
RKEQDGVE

SEQ ID NO: 13206 - protein, 8 aa, Borrelia garinii
KEQDGVET

SEQ ID NO: 13207 - protein, 8 aa, Borrelia garinii
EQDGVETG

SEQ ID NO: 13208 - protein, 8 aa, Borrelia garinii
QDGVETGL

SEQ ID NO: 13209 - protein, 8 aa, Borrelia garinii
DGVETGLN

SEQ ID NO: 13210 - protein, 8 aa, Borrelia garinii
GVETGLNV

SEQ ID NO: 13211 - protein, 8 aa, Borrelia garinii
VETGLNVI

SEQ ID NO: 13212 - protein, 8 aa, Borrelia garinii
ETGLNVIG

SEQ ID NO: 13213 - protein, 8 aa, Borrelia garinii
TGLNVIGT

SEQ ID NO: 13214 - protein, 8 aa, Borrelia garinii
GLNVIGTI

SEQ ID NO: 13215 - protein, 8 aa, Borrelia garinii
LNVIGTIN

SEQ ID NO: 13216 - protein, 8 aa, Borrelia garinii
NVIGTING

SEQ ID NO: 13217 - protein, 8 aa, Borrelia garinii
VIGTINGQ

SEQ ID NO: 13218 - protein, 8 aa, Borrelia garinii
IGTINGQL

SEQ ID NO: 13219 - protein, 8 aa, Borrelia garinii
GTINGQLR

SEQ ID NO: 13220 - protein, 8 aa, Borrelia garinii
TINGQLRG

SEQ ID NO: 13221 - protein, 8 aa, Borrelia garinii
INGQLRGH

SEQ ID NO: 13222 - protein, 8 aa, Borrelia garinii
NGQLRGHS

SEQ ID NO: 13223 - protein, 8 aa, Borrelia garinii
GQLRGHSA

SEQ ID NO: 13224 - protein, 8 aa, Borrelia garinii
QLRGHSAT

SEQ ID NO: 13225 - protein, 8 aa, Borrelia garinii
LRGHSATF

SEQ ID NO: 13226 - protein, 8 aa, Borrelia garinii
RGHSATFF

SEQ ID NO: 13227 - protein, 8 aa, Borrelia garinii
GHSATFFC

SEQ ID NO: 13228 - protein, 8 aa, Borrelia garinii
HSATFFCI

SEQ ID NO: 13229 - protein, 8 aa, Borrelia garinii
SATFFCIE

SEQ ID NO: 13230 - protein, 8 aa, Borrelia garinii
ATFFCIEE

SEQ ID NO: 13231 - protein, 8 aa, Borrelia garinii
TFFCIEEA

SEQ ID NO: 13232 - protein, 8 aa, Borrelia garinii
FFCIEEAE

SEQ ID NO: 13233 - protein, 8 aa, Borrelia garinii
FCIEEAEV

SEQ ID NO: 13234 - protein, 8 aa, Borrelia garinii
CIEEAEVN

SEQ ID NO: 13235 - protein, 8 aa, Borrelia garinii
IEEAEVNN

SEQ ID NO: 13236 - protein, 8 aa, Borrelia garinii
EEAEVNNF

SEQ ID NO: 13237 - protein, 8 aa, Borrelia garinii
EAEVNNFV

SEQ ID NO: 13238 - protein, 8 aa, Borrelia garinii
AEVNNFVK

SEQ ID NO: 13239 - protein, 8 aa, Borrelia garinii
EVNNFVKA

SEQ ID NO: 13240 - protein, 8 aa, Borrelia garinii
VNNFVKAM

SEQ ID NO: 13241 - protein, 8 aa, Borrelia garinii
NNFVKAMT

SEQ ID NO: 13242 - protein, 8 aa, Borrelia garinii
NFVKAMTN

SEQ ID NO: 13243 - protein, 8 aa, Borrelia garinii
FVKAMTNV

SEQ ID NO: 13244 - protein, 8 aa, Borrelia garinii
VKAMTNVG

SEQ ID NO: 13245 - protein, 8 aa, Borrelia garinii
KAMTNVGS

SEQ ID NO: 13246 - protein, 8 aa, Borrelia garinii
AMTNVGSF

SEQ ID NO: 13247 - protein, 8 aa, Borrelia garinii
MTNVGSFK

SEQ ID NO: 13248 - protein, 8 aa, Borrelia garinii
TNVGSFKT

SEQ ID NO: 13249 - protein, 8 aa, Borrelia garinii
NVGSFKTS

SEQ ID NO: 13250 - protein, 8 aa, Borrelia garinii
VGSFKTSL

SEQ ID NO: 13251 - protein, 8 aa, Borrelia garinii
GSFKTSLY

SEQ ID NO: 13252 - protein, 8 aa, Borrelia garinii
SFKTSLYY

SEQ ID NO: 13253 - protein, 8 aa, Borrelia garinii
FKTSLYYG

SEQ ID NO: 13254 - protein, 8 aa, Borrelia garinii
KTSLYYGY

SEQ ID NO: 13255 - protein, 8 aa, Borrelia garinii
TSLYYGYK

SEQ ID NO: 13256 - protein, 8 aa, Borrelia garinii
SLYYGYKE

SEQ ID NO: 13257 - protein, 8 aa, Borrelia garinii
LYYGYKEE

SEQ ID NO: 13258 - protein, 8 aa, Borrelia garinii
YYGYKEEQ

SEQ ID NO: 13259 - protein, 8 aa, Borrelia garinii
YGYKEEQS

SEQ ID NO: 13260 - protein, 8 aa, Borrelia garinii
GYKEEQSS

SEQ ID NO: 13261 - protein, 8 aa, Borrelia garinii
YKEEQSST

SEQ ID NO: 13262 - protein, 8 aa, Borrelia garinii
KEEQSSTN

SEQ ID NO: 13263 - protein, 8 aa, Borrelia garinii
EEQSSTNG

SEQ ID NO: 13264 - protein, 8 aa, Borrelia garinii
EQSSTNGI

SEQ ID NO: 13265 - protein, 8 aa, Borrelia garinii
QSSTNGIK

SEQ ID NO: 13266 - protein, 8 aa, Borrelia garinii
SSTNGIKG

SEQ ID NO: 13267 - protein, 8 aa, Borrelia garinii
STNGIKGK

SEQ ID NO: 13268 - protein, 8 aa, Borrelia garinii
TNGIKGKE

SEQ ID NO: 13269 - protein, 8 aa, Borrelia garinii
NGIKGKEI

SEQ ID NO: 13270 - protein, 8 aa, Borrelia garinii
GIKGKEIT

SEQ ID NO: 13271 - protein, 8 aa, Borrelia garinii
IKGKEITT

SEQ ID NO: 13272 - protein, 8 aa, Borrelia garinii
KGKEITTK

SEQ ID NO: 13273 - protein, 8 aa, Borrelia garinii
GKEITTKI

SEQ ID NO: 13274 - protein, 8 aa, Borrelia garinii
KEITTKIE

SEQ ID NO: 13275 - protein, 8 aa, Borrelia garinii
EITTKIET

SEQ ID NO: 13276 - protein, 8 aa, Borrelia garinii
ITTKIETI

SEQ ID NO: 13277 - protein, 8 aa, Borrelia garinii
TTKIETIN

SEQ ID NO: 13278 - protein, 8 aa, Borrelia garinii
TKIETINN

SEQ ID NO: 13279 - protein, 8 aa, Borrelia garinii
KIETINNS

SEQ ID NO: 13280 - protein, 8 aa, Borrelia garinii
IETINNSE

SEQ ID NO: 13281 - protein, 8 aa, Borrelia garinii
ETINNSEH

SEQ ID NO: 13282 - protein, 8 aa, Borrelia garinii
TINNSEHI

SEQ ID NO: 13283 - protein, 8 aa, Borrelia garinii
INNSEHIT

SEQ ID NO: 13284 - protein, 8 aa, Borrelia garinii
NNSEHITF

SEQ ID NO: 13285 - protein, 8 aa, Borrelia garinii
NSEHITFS

SEQ ID NO: 13286 - protein, 8 aa, Borrelia garinii
SEHITFSG

SEQ ID NO: 13287 - protein, 8 aa, Borrelia garinii
EHITFSGD

SEQ ID NO: 13288 - protein, 8 aa, Borrelia garinii
HITFSGDK

SEQ ID NO: 13289 - protein, 8 aa, Borrelia garinii
ITFSGDKI

SEQ ID NO: 13290 - protein, 9 aa, Borrelia garinii
MNKKMKMFI

SEQ ID NO: 13291 - protein, 9 aa, Borrelia garinii
NKKMKMFII

SEQ ID NO: 13292 - protein, 9 aa, Borrelia garinii
KKMKMFIIC

SEQ ID NO: 13293 - protein, 9 aa, Borrelia garinii
KMKMFIICA

SEQ ID NO: 13294 - protein, 9 aa, Borrelia garinii
MKMFIICAV

SEQ ID NO: 13295 - protein, 9 aa, Borrelia garinii
KMFIICAVF

SEQ ID NO: 13296 - protein, 9 aa, Borrelia garinii
MFIICAVFV

SEQ ID NO: 13297 - protein, 9 aa, Borrelia garinii
FIICAVFVL

SEQ ID NO: 13298 - protein, 9 aa, Borrelia garinii
IICAVFVLI

SEQ ID NO: 13299 - protein, 9 aa, Borrelia garinii
ICAVFVLIS

SEQ ID NO: 13300 - protein, 9 aa, Borrelia garinii
CAVFVLISS

SEQ ID NO: 13301 - protein, 9 aa, Borrelia garinii
AVFVLISSC

SEQ ID NO: 13302 - protein, 9 aa, Borrelia garinii
VFVLISSCG

SEQ ID NO: 13303 - protein, 9 aa, Borrelia garinii
FVLISSCGN

SEQ ID NO: 13304 - protein, 9 aa, Borrelia garinii
VLISSCGNF

SEQ ID NO: 13305 - protein, 9 aa, Borrelia garinii
LISSCGNFR

SEQ ID NO: 13306 - protein, 9 aa, Borrelia garinii
ISSCGNFRS

SEQ ID NO: 13307 - protein, 9 aa, Borrelia garinii
SSCGNFRSS

SEQ ID NO: 13308 - protein, 9 aa, Borrelia garinii
SCGNFRSSL

SEQ ID NO: 13309 - protein, 9 aa, Borrelia garinii
CGNFRSSLS

SEQ ID NO: 13310 - protein, 9 aa, Borrelia garinii
GNFRSSLSD

SEQ ID NO: 13311 - protein, 9 aa, Borrelia garinii
NFRSSLSDQ

SEQ ID NO: 13312 - protein, 9 aa, Borrelia garinii
FRSSLSDQG

SEQ ID NO: 13313 - protein, 9 aa, Borrelia garinii
RSSLSDQGS

SEQ ID NO: 13314 - protein, 9 aa, Borrelia garinii
SSLSDQGSL

SEQ ID NO: 13315 - protein, 9 aa, Borrelia garinii
SLSDQGSLS

SEQ ID NO: 13316 - protein, 9 aa, Borrelia garinii
LSDQGSLSD

SEQ ID NO: 13317 - protein, 9 aa, Borrelia garinii
SDQGSLSDQ

SEQ ID NO: 13318 - protein, 9 aa, Borrelia garinii
DQGSLSDQG

SEQ ID NO: 13319 - protein, 9 aa, Borrelia garinii
QGSLSDQGS

SEQ ID NO: 13320 - protein, 9 aa, Borrelia garinii
GSLSDQGSL

SEQ ID NO: 13321 - protein, 9 aa, Borrelia garinii
SLSDQGSLS

SEQ ID NO: 13322 - protein, 9 aa, Borrelia garinii
LSDQGSLSD

SEQ ID NO: 13323 - protein, 9 aa, Borrelia garinii
SDQGSLSDQ

SEQ ID NO: 13324 - protein, 9 aa, Borrelia garinii
DQGSLSDQG

SEQ ID NO: 13325 - protein, 9 aa, Borrelia garinii
QGSLSDQGS

SEQ ID NO: 13326 - protein, 9 aa, Borrelia garinii
GSLSDQGSL

SEQ ID NO: 13327 - protein, 9 aa, Borrelia garinii
SLSDQGSLS

SEQ ID NO: 13328 - protein, 9 aa, Borrelia garinii
LSDQGSLSD

SEQ ID NO: 13329 - protein, 9 aa, Borrelia garinii
SDQGSLSDQ

SEQ ID NO: 13330 - protein, 9 aa, Borrelia garinii
DQGSLSDQG

SEQ ID NO: 13331 - protein, 9 aa, Borrelia garinii
QGSLSDQGG

SEQ ID NO: 13332 - protein, 9 aa, Borrelia garinii
GSLSDQGGL

SEQ ID NO: 13333 - protein, 9 aa, Borrelia garinii
SLSDQGGLS

SEQ ID NO: 13334 - protein, 9 aa, Borrelia garinii
LSDQGGLSG

SEQ ID NO: 13335 - protein, 9 aa, Borrelia garinii
SDQGGLSGQ

SEQ ID NO: 13336 - protein, 9 aa, Borrelia garinii
DQGGLSGQA

SEQ ID NO: 13337 - protein, 9 aa, Borrelia garinii
QGGLSGQAS

SEQ ID NO: 13338 - protein, 9 aa, Borrelia garinii
GGLSGQASS

SEQ ID NO: 13339 - protein, 9 aa, Borrelia garinii
GLSGQASSD

SEQ ID NO: 13340 - protein, 9 aa, Borrelia garinii
LSGQASSDT

SEQ ID NO: 13341 - protein, 9 aa, Borrelia garinii
SGQASSDTI

SEQ ID NO: 13342 - protein, 9 aa, Borrelia garinii
GQASSDTIK

SEQ ID NO: 13343 - protein, 9 aa, Borrelia garinii
QASSDTIKF

SEQ ID NO: 13344 - protein, 9 aa, Borrelia garinii
ASSDTIKFS

SEQ ID NO: 13345 - protein, 9 aa, Borrelia garinii
SSDTIKFSE

SEQ ID NO: 13346 - protein, 9 aa, Borrelia garinii
SDTIKFSEF

SEQ ID NO: 13347 - protein, 9 aa, Borrelia garinii
DTIKFSEFT

SEQ ID NO: 13348 - protein, 9 aa, Borrelia garinii
TIKFSEFTV

SEQ ID NO: 13349 - protein, 9 aa, Borrelia garinii
IKFSEFTVN

SEQ ID NO: 13350 - protein, 9 aa, Borrelia garinii
KFSEFTVNI

SEQ ID NO: 13351 - protein, 9 aa, Borrelia garinii
FSEFTVNIK

SEQ ID NO: 13352 - protein, 9 aa, Borrelia garinii
SEFTVNIKN

SEQ ID NO: 13353 - protein, 9 aa, Borrelia garinii
EFTVNIKNK

SEQ ID NO: 13354 - protein, 9 aa, Borrelia garinii
FTVNIKNKK

SEQ ID NO: 13355 - protein, 9 aa, Borrelia garinii
TVNIKNKKD

SEQ ID NO: 13356 - protein, 9 aa, Borrelia garinii
VNIKNKKDN

SEQ ID NO: 13357 - protein, 9 aa, Borrelia garinii
NIKNKKDNN

SEQ ID NO: 13358 - protein, 9 aa, Borrelia garinii
IKNKKDNNG

SEQ ID NO: 13359 - protein, 9 aa, Borrelia garinii
KNKKDNNGD

SEQ ID NO: 13360 - protein, 9 aa, Borrelia garinii
NKKDNNGDW

SEQ ID NO: 13361 - protein, 9 aa, Borrelia garinii
KKDNNGDWS

SEQ ID NO: 13362 - protein, 9 aa, Borrelia garinii
KDNNGDWSN

SEQ ID NO: 13363 - protein, 9 aa, Borrelia garinii
DNNGDWSNL

SEQ ID NO: 13364 - protein, 9 aa, Borrelia garinii
NNGDWSNLG

SEQ ID NO: 13365 - protein, 9 aa, Borrelia garinii
NGDWSNLGT

SEQ ID NO: 13366 - protein, 9 aa, Borrelia garinii
GDWSNLGTL

SEQ ID NO: 13367 - protein, 9 aa, Borrelia garinii
DWSNLGTLV

SEQ ID NO: 13368 - protein, 9 aa, Borrelia garinii
WSNLGTLVI

SEQ ID NO: 13369 - protein, 9 aa, Borrelia garinii
SNLGTLVIR

SEQ ID NO: 13370 - protein, 9 aa, Borrelia garinii
NLGTLVIRK

SEQ ID NO: 13371 - protein, 9 aa, Borrelia garinii
LGTLVIRKE

SEQ ID NO: 13372 - protein, 9 aa, Borrelia garinii
GTLVIRKEQ

SEQ ID NO: 13373 - protein, 9 aa, Borrelia garinii
TLVIRKEQD

SEQ ID NO: 13374 - protein, 9 aa, Borrelia garinii
LVIRKEQDG

SEQ ID NO: 13375 - protein, 9 aa, Borrelia garinii
VIRKEQDGV

SEQ ID NO: 13376 - protein, 9 aa, Borrelia garinii
IRKEQDGVE

SEQ ID NO: 13377 - protein, 9 aa, Borrelia garinii
RKEQDGVET

SEQ ID NO: 13378 - protein, 9 aa, Borrelia garinii
KEQDGVETG

SEQ ID NO: 13379 - protein, 9 aa, Borrelia garinii
EQDGVETGL

SEQ ID NO: 13380 - protein, 9 aa, Borrelia garinii
QDGVETGLN

SEQ ID NO: 13381 - protein, 9 aa, Borrelia garinii
DGVETGLNV

SEQ ID NO: 13382 - protein, 9 aa, Borrelia garinii
GVETGLNVI

SEQ ID NO: 13383 - protein, 9 aa, Borrelia garinii
VETGLNVIG

SEQ ID NO: 13384 - protein, 9 aa, Borrelia garinii
ETGLNVIGT

SEQ ID NO: 13385 - protein, 9 aa, Borrelia garinii
TGLNVIGTI

SEQ ID NO: 13386 - protein, 9 aa, Borrelia garinii
GLNVIGTIN

SEQ ID NO: 13387 - protein, 9 aa, Borrelia garinii
LNVIGTING

SEQ ID NO: 13388 - protein, 9 aa, Borrelia garinii
NVIGTINGQ

SEQ ID NO: 13389 - protein, 9 aa, Borrelia garinii
VIGTINGQL

SEQ ID NO: 13390 - protein, 9 aa, Borrelia garinii
IGTINGQLR

SEQ ID NO: 13391 - protein, 9 aa, Borrelia garinii
GTINGQLRG

SEQ ID NO: 13392 - protein, 9 aa, Borrelia garinii
TINGQLRGH

SEQ ID NO: 13393 - protein, 9 aa, Borrelia garinii
INGQLRGHS

SEQ ID NO: 13394 - protein, 9 aa, Borrelia garinii
NGQLRGHSA

SEQ ID NO: 13395 - protein, 9 aa, Borrelia garinii
GQLRGHSAT

SEQ ID NO: 13396 - protein, 9 aa, Borrelia garinii
QLRGHSATF

SEQ ID NO: 13397 - protein, 9 aa, Borrelia garinii
LRGHSATFF

SEQ ID NO: 13398 - protein, 9 aa, Borrelia garinii
RGHSATFFC

SEQ ID NO: 13399 - protein, 9 aa, Borrelia garinii
GHSATFFCI

SEQ ID NO: 13400 - protein, 9 aa, Borrelia garinii
HSATFFCIE

SEQ ID NO: 13401 - protein, 9 aa, Borrelia garinii
SATFFCIEE

SEQ ID NO: 13402 - protein, 9 aa, Borrelia garinii
ATFFCIEEA

SEQ ID NO: 13403 - protein, 9 aa, Borrelia garinii
TFFCIEEAE

SEQ ID NO: 13404 - protein, 9 aa, Borrelia garinii
FFCIEEAEV

SEQ ID NO: 13405 - protein, 9 aa, Borrelia garinii
FCIEEAEVN

SEQ ID NO: 13406 - protein, 9 aa, Borrelia garinii
CIEEAEVNN

SEQ ID NO: 13407 - protein, 9 aa, Borrelia garinii
IEEAEVNNF

SEQ ID NO: 13408 - protein, 9 aa, Borrelia garinii
EEAEVNNFV

SEQ ID NO: 13409 - protein, 9 aa, Borrelia garinii
EAEVNNFVK

SEQ ID NO: 13410 - protein, 9 aa, Borrelia garinii
AEVNNFVKA

SEQ ID NO: 13411 - protein, 9 aa, Borrelia garinii
EVNNFVKAM

SEQ ID NO: 13412 - protein, 9 aa, Borrelia garinii
VNNFVKAMT

SEQ ID NO: 13413 - protein, 9 aa, Borrelia garinii
NNFVKAMTN

SEQ ID NO: 13414 - protein, 9 aa, Borrelia garinii
NFVKAMTNV

SEQ ID NO: 13415 - protein, 9 aa, Borrelia garinii
FVKAMTNVG

SEQ ID NO: 13416 - protein, 9 aa, Borrelia garinii
VKAMTNVGS

SEQ ID NO: 13417 - protein, 9 aa, Borrelia garinii
KAMTNVGSF

SEQ ID NO: 13418 - protein, 9 aa, Borrelia garinii
AMTNVGSFK

SEQ ID NO: 13419 - protein, 9 aa, Borrelia garinii
MTNVGSFKT

SEQ ID NO: 13420 - protein, 9 aa, Borrelia garinii
TNVGSFKTS

SEQ ID NO: 13421 - protein, 9 aa, Borrelia garinii
NVGSFKTSL

SEQ ID NO: 13422 - protein, 9 aa, Borrelia garinii
VGSFKTSLY

SEQ ID NO: 13423 - protein, 9 aa, Borrelia garinii
GSFKTSLYY

SEQ ID NO: 13424 - protein, 9 aa, Borrelia garinii
SFKTSLYYG

SEQ ID NO: 13425 - protein, 9 aa, Borrelia garinii
FKTSLYYGY

SEQ ID NO: 13426 - protein, 9 aa, Borrelia garinii
KTSLYYGYK

SEQ ID NO: 13427 - protein, 9 aa, Borrelia garinii
TSLYYGYKE

SEQ ID NO: 13428 - protein, 9 aa, Borrelia garinii
SLYYGYKEE

SEQ ID NO: 13429 - protein, 9 aa, Borrelia garinii
LYYGYKEEQ

SEQ ID NO: 13430 - protein, 9 aa, Borrelia garinii
YYGYKEEQS

SEQ ID NO: 13431 - protein, 9 aa, Borrelia garinii
YGYKEEQSS

SEQ ID NO: 13432 - protein, 9 aa, Borrelia garinii
GYKEEQSST

SEQ ID NO: 13433 - protein, 9 aa, Borrelia garinii
YKEEQSSTN

SEQ ID NO: 13434 - protein, 9 aa, Borrelia garinii
KEEQSSTNG

SEQ ID NO: 13435 - protein, 9 aa, Borrelia garinii
EEQSSTNGI

SEQ ID NO: 13436 - protein, 9 aa, Borrelia garinii
EQSSTNGIK

SEQ ID NO: 13437 - protein, 9 aa, Borrelia garinii
QSSTNGIKG

SEQ ID NO: 13438 - protein, 9 aa, Borrelia garinii
SSTNGIKGK

SEQ ID NO: 13439 - protein, 9 aa, Borrelia garinii
STNGIKGKE

SEQ ID NO: 13440 - protein, 9 aa, Borrelia garinii
TNGIKGKEI

SEQ ID NO: 13441 - protein, 9 aa, Borrelia garinii
NGIKGKEIT

SEQ ID NO: 13442 - protein, 9 aa, Borrelia garinii
GIKGKEITT

SEQ ID NO: 13443 - protein, 9 aa, Borrelia garinii
IKGKEITTK

SEQ ID NO: 13444 - protein, 9 aa, Borrelia garinii
KGKEITTKI

SEQ ID NO: 13445 - protein, 9 aa, Borrelia garinii
GKEITTKIE

SEQ ID NO: 13446 - protein, 9 aa, Borrelia garinii
KEITTKIET

SEQ ID NO: 13447 - protein, 9 aa, Borrelia garinii
EITTKIETI

SEQ ID NO: 13448 - protein, 9 aa, Borrelia garinii
ITTKIETIN

SEQ ID NO: 13449 - protein, 9 aa, Borrelia garinii
TTKIETINN

SEQ ID NO: 13450 - protein, 9 aa, Borrelia garinii
TKIETINNS

SEQ ID NO: 13451 - protein, 9 aa, Borrelia garinii
KIETINNSE

SEQ ID NO: 13452 - protein, 9 aa, Borrelia garinii
IETINNSEH

SEQ ID NO: 13453 - protein, 9 aa, Borrelia garinii
ETINNSEHI

SEQ ID NO: 13454 - protein, 9 aa, Borrelia garinii
TINNSEHIT

SEQ ID NO: 13455 - protein, 9 aa, Borrelia garinii
INNSEHITF

SEQ ID NO: 13456 - protein, 9 aa, Borrelia garinii
NNSEHITFS

SEQ ID NO: 13457 - protein, 9 aa, Borrelia garinii
NSEHITFSG

SEQ ID NO: 13458 - protein, 9 aa, Borrelia garinii
SEHITFSGD

SEQ ID NO: 13459 - protein, 9 aa, Borrelia garinii
EHITFSGDK

SEQ ID NO: 13460 - protein, 9 aa, Borrelia garinii
HITFSGDKI

SEQ ID NO: 13461 - protein, 10 aa, Borrelia garinii
MNKKMKMFII

SEQ ID NO: 13462 - protein, 10 aa, Borrelia garinii
NKKMKMFIIC

SEQ ID NO: 13463 - protein, 10 aa, Borrelia garinii
KKMKMFIICA

SEQ ID NO: 13464 - protein, 10 aa, Borrelia garinii
KMKMFIICAV

SEQ ID NO: 13465 - protein, 10 aa, Borrelia garinii
MKMFIICAVF

SEQ ID NO: 13466 - protein, 10 aa, Borrelia garinii
KMFIICAVFV

SEQ ID NO: 13467 - protein, 10 aa, Borrelia garinii
MFIICAVFVL

SEQ ID NO: 13468 - protein, 10 aa, Borrelia garinii
FIICAVFVLI

SEQ ID NO: 13469 - protein, 10 aa, Borrelia garinii
IICAVFVLIS

SEQ ID NO: 13470 - protein, 10 aa, Borrelia garinii
ICAVFVLISS

SEQ ID NO: 13471 - protein, 10 aa, Borrelia garinii
CAVFVLISSC

SEQ ID NO: 13472 - protein, 10 aa, Borrelia garinii
AVFVLISSCG

SEQ ID NO: 13473 - protein, 10 aa, Borrelia garinii
VFVLISSCGN

SEQ ID NO: 13474 - protein, 10 aa, Borrelia garinii
FVLISSCGNF

SEQ ID NO: 13475 - protein, 10 aa, Borrelia garinii
VLISSCGNFR

SEQ ID NO: 13476 - protein, 10 aa, Borrelia garinii
LISSCGNFRS

SEQ ID NO: 13477 - protein, 10 aa, Borrelia garinii
ISSCGNFRSS

SEQ ID NO: 13478 - protein, 10 aa, Borrelia garinii
SSCGNFRSSL

SEQ ID NO: 13479 - protein, 10 aa, Borrelia garinii
SCGNFRSSLS

SEQ ID NO: 13480 - protein, 10 aa, Borrelia garinii
CGNFRSSLSD

SEQ ID NO: 13481 - protein, 10 aa, Borrelia garinii
GNFRSSLSDQ

SEQ ID NO: 13482 - protein, 10 aa, Borrelia garinii
NFRSSLSDQG

SEQ ID NO: 13483 - protein, 10 aa, Borrelia garinii
FRSSLSDQGS

SEQ ID NO: 13484 - protein, 10 aa, Borrelia garinii
RSSLSDQGSL

SEQ ID NO: 13485 - protein, 10 aa, Borrelia garinii
SSLSDQGSLS

SEQ ID NO: 13486 - protein, 10 aa, Borrelia garinii
SLSDQGSLSD

SEQ ID NO: 13487 - protein, 10 aa, Borrelia garinii
LSDQGSLSDQ

SEQ ID NO: 13488 - protein, 10 aa, Borrelia garinii
SDQGSLSDQG

SEQ ID NO: 13489 - protein, 10 aa, Borrelia garinii
DQGSLSDQGS

SEQ ID NO: 13490 - protein, 10 aa, Borrelia garinii
QGSLSDQGSL

SEQ ID NO: 13491 - protein, 10 aa, Borrelia garinii
GSLSDQGSLS

SEQ ID NO: 13492 - protein, 10 aa, Borrelia garinii
SLSDQGSLSD

SEQ ID NO: 13493 - protein, 10 aa, Borrelia garinii
LSDQGSLSDQ

SEQ ID NO: 13494 - protein, 10 aa, Borrelia garinii
SDQGSLSDQG

SEQ ID NO: 13495 - protein, 10 aa, Borrelia garinii
DQGSLSDQGS

SEQ ID NO: 13496 - protein, 10 aa, Borrelia garinii
QGSLSDQGSL

SEQ ID NO: 13497 - protein, 10 aa, Borrelia garinii
GSLSDQGSLS

SEQ ID NO: 13498 - protein, 10 aa, Borrelia garinii
SLSDQGSLSD

SEQ ID NO: 13499 - protein, 10 aa, Borrelia garinii
LSDQGSLSDQ

SEQ ID NO: 13500 - protein, 10 aa, Borrelia garinii
SDQGSLSDQG

SEQ ID NO: 13501 - protein, 10 aa, Borrelia garinii
DQGSLSDQGG

SEQ ID NO: 13502 - protein, 10 aa, Borrelia garinii
QGSLSDQGGL

SEQ ID NO: 13503 - protein, 10 aa, Borrelia garinii
GSLSDQGGLS

SEQ ID NO: 13504 - protein, 10 aa, Borrelia garinii
SLSDQGGLSG

SEQ ID NO: 13505 - protein, 10 aa, Borrelia garinii
LSDQGGLSGQ

SEQ ID NO: 13506 - protein, 10 aa, Borrelia garinii
SDQGGLSGQA

SEQ ID NO: 13507 - protein, 10 aa, Borrelia garinii
DQGGLSGQAS

SEQ ID NO: 13508 - protein, 10 aa, Borrelia garinii
QGGLSGQASS

SEQ ID NO: 13509 - protein, 10 aa, Borrelia garinii
GGLSGQASSD

SEQ ID NO: 13510 - protein, 10 aa, Borrelia garinii
GLSGQASSDT

SEQ ID NO: 13511 - protein, 10 aa, Borrelia garinii
LSGQASSDTI

SEQ ID NO: 13512 - protein, 10 aa, Borrelia garinii
SGQASSDTIK

SEQ ID NO: 13513 - protein, 10 aa, Borrelia garinii
GQASSDTIKF

SEQ ID NO: 13514 - protein, 10 aa, Borrelia garinii
QASSDTIKFS

SEQ ID NO: 13515 - protein, 10 aa, Borrelia garinii
ASSDTIKFSE

SEQ ID NO: 13516 - protein, 10 aa, Borrelia garinii
SSDTIKFSEF

SEQ ID NO: 13517 - protein, 10 aa, Borrelia garinii
SDTIKFSEFT

SEQ ID NO: 13518 - protein, 10 aa, Borrelia garinii
DTIKFSEFTV

SEQ ID NO: 13519 - protein, 10 aa, Borrelia garinii
TIKFSEFTVN

SEQ ID NO: 13520 - protein, 10 aa, Borrelia garinii
IKFSEFTVNI

SEQ ID NO: 13521 - protein, 10 aa, Borrelia garinii
KFSEFTVNIK

SEQ ID NO: 13522 - protein, 10 aa, Borrelia garinii
FSEFTVNIKN

SEQ ID NO: 13523 - protein, 10 aa, Borrelia garinii
SEFTVNIKNK

SEQ ID NO: 13524 - protein, 10 aa, Borrelia garinii
EFTVNIKNKK

SEQ ID NO: 13525 - protein, 10 aa, Borrelia garinii
FTVNIKNKKD

SEQ ID NO: 13526 - protein, 10 aa, Borrelia garinii
TVNIKNKKDN

SEQ ID NO: 13527 - protein, 10 aa, Borrelia garinii
VNIKNKKDNN

SEQ ID NO: 13528 - protein, 10 aa, Borrelia garinii
NIKNKKDNNG

SEQ ID NO: 13529 - protein, 10 aa, Borrelia garinii
IKNKKDNNGD

SEQ ID NO: 13530 - protein, 10 aa, Borrelia garinii
KNKKDNNGDW

SEQ ID NO: 13531 - protein, 10 aa, Borrelia garinii
NKKDNNGDWS

SEQ ID NO: 13532 - protein, 10 aa, Borrelia garinii
KKDNNGDWSN

SEQ ID NO: 13533 - protein, 10 aa, Borrelia garinii
KDNNGDWSNL

SEQ ID NO: 13534 - protein, 10 aa, Borrelia garinii
DNNGDWSNLG

SEQ ID NO: 13535 - protein, 10 aa, Borrelia garinii
NNGDWSNLGT

SEQ ID NO: 13536 - protein, 10 aa, Borrelia garinii
NGDWSNLGTL

SEQ ID NO: 13537 - protein, 10 aa, Borrelia garinii
GDWSNLGTLV

SEQ ID NO: 13538 - protein, 10 aa, Borrelia garinii
DWSNLGTLVI

SEQ ID NO: 13539 - protein, 10 aa, Borrelia garinii
WSNLGTLVIR

SEQ ID NO: 13540 - protein, 10 aa, Borrelia garinii
SNLGTLVIRK

SEQ ID NO: 13541 - protein, 10 aa, Borrelia garinii
NLGTLVIRKE

SEQ ID NO: 13542 - protein, 10 aa, Borrelia garinii
LGTLVIRKEQ

SEQ ID NO: 13543 - protein, 10 aa, Borrelia garinii
GTLVIRKEQD

SEQ ID NO: 13544 - protein, 10 aa, Borrelia garinii
TLVIRKEQDG

SEQ ID NO: 13545 - protein, 10 aa, Borrelia garinii
LVIRKEQDGV

SEQ ID NO: 13546 - protein, 10 aa, Borrelia garinii
VIRKEQDGVE

SEQ ID NO: 13547 - protein, 10 aa, Borrelia garinii
IRKEQDGVET

SEQ ID NO: 13548 - protein, 10 aa, Borrelia garinii
RKEQDGVETG

SEQ ID NO: 13549 - protein, 10 aa, Borrelia garinii
KEQDGVETGL

SEQ ID NO: 13550 - protein, 10 aa, Borrelia garinii
EQDGVETGLN

SEQ ID NO: 13551 - protein, 10 aa, Borrelia garinii
QDGVETGLNV

SEQ ID NO: 13552 - protein, 10 aa, Borrelia garinii
DGVETGLNVI

SEQ ID NO: 13553 - protein, 10 aa, Borrelia garinii
GVETGLNVIG

SEQ ID NO: 13554 - protein, 10 aa, Borrelia garinii
VETGLNVIGT

SEQ ID NO: 13555 - protein, 10 aa, Borrelia garinii
ETGLNVIGTI

SEQ ID NO: 13556 - protein, 10 aa, Borrelia garinii
TGLNVIGTIN

SEQ ID NO: 13557 - protein, 10 aa, Borrelia garinii
GLNVIGTING

SEQ ID NO: 13558 - protein, 10 aa, Borrelia garinii
LNVIGTINGQ

SEQ ID NO: 13559 - protein, 10 aa, Borrelia garinii
NVIGTINGQL

SEQ ID NO: 13560 - protein, 10 aa, Borrelia garinii
VIGTINGQLR

SEQ ID NO: 13561 - protein, 10 aa, Borrelia garinii
IGTINGQLRG

SEQ ID NO: 13562 - protein, 10 aa, Borrelia garinii
GTINGQLRGH

SEQ ID NO: 13563 - protein, 10 aa, Borrelia garinii
TINGQLRGHS

SEQ ID NO: 13564 - protein, 10 aa, Borrelia garinii
INGQLRGHSA

SEQ ID NO: 13565 - protein, 10 aa, Borrelia garinii
NGQLRGHSAT

SEQ ID NO: 13566 - protein, 10 aa, Borrelia garinii
GQLRGHSATF

SEQ ID NO: 13567 - protein, 10 aa, Borrelia garinii
QLRGHSATFF

SEQ ID NO: 13568 - protein, 10 aa, Borrelia garinii
LRGHSATFFC

SEQ ID NO: 13569 - protein, 10 aa, Borrelia garinii
RGHSATFFCI

SEQ ID NO: 13570 - protein, 10 aa, Borrelia garinii
GHSATFFCIE

SEQ ID NO: 13571 - protein, 10 aa, Borrelia garinii
HSATFFCIEE

SEQ ID NO: 13572 - protein, 10 aa, Borrelia garinii
SATFFCIEEA

SEQ ID NO: 13573 - protein, 10 aa, Borrelia garinii
ATFFCIEEAE

SEQ ID NO: 13574 - protein, 10 aa, Borrelia garinii
TFFCIEEAEV

SEQ ID NO: 13575 - protein, 10 aa, Borrelia garinii
FFCIEEAEVN

SEQ ID NO: 13576 - protein, 10 aa, Borrelia garinii
FCIEEAEVNN

SEQ ID NO: 13577 - protein, 10 aa, Borrelia garinii
CIEEAEVNNF

SEQ ID NO: 13578 - protein, 10 aa, Borrelia garinii
IEEAEVNNFV

SEQ ID NO: 13579 - protein, 10 aa, Borrelia garinii
EEAEVNNFVK

SEQ ID NO: 13580 - protein, 10 aa, Borrelia garinii
EAEVNNFVKA

SEQ ID NO: 13581 - protein, 10 aa, Borrelia garinii
AEVNNFVKAM

SEQ ID NO: 13582 - protein, 10 aa, Borrelia garinii
EVNNFVKAMT

SEQ ID NO: 13583 - protein, 10 aa, Borrelia garinii
VNNFVKAMTN

SEQ ID NO: 13584 - protein, 10 aa, Borrelia garinii
NNFVKAMTNV

SEQ ID NO: 13585 - protein, 10 aa, Borrelia garinii
NFVKAMTNVG

SEQ ID NO: 13586 - protein, 10 aa, Borrelia garinii
FVKAMTNVGS

SEQ ID NO: 13587 - protein, 10 aa, Borrelia garinii
VKAMTNVGSF

SEQ ID NO: 13588 - protein, 10 aa, Borrelia garinii
KAMTNVGSFK

SEQ ID NO: 13589 - protein, 10 aa, Borrelia garinii
AMTNVGSFKT

SEQ ID NO: 13590 - protein, 10 aa, Borrelia garinii
MTNVGSFKTS

SEQ ID NO: 13591 - protein, 10 aa, Borrelia garinii
TNVGSFKTSL

SEQ ID NO: 13592 - protein, 10 aa, Borrelia garinii
NVGSFKTSLY

SEQ ID NO: 13593 - protein, 10 aa, Borrelia garinii
VGSFKTSLYY

SEQ ID NO: 13594 - protein, 10 aa, Borrelia garinii
GSFKTSLYYG

SEQ ID NO: 13595 - protein, 10 aa, Borrelia garinii
SFKTSLYYGY

SEQ ID NO: 13596 - protein, 10 aa, Borrelia garinii
FKTSLYYGYK

SEQ ID NO: 13597 - protein, 10 aa, Borrelia garinii
KTSLYYGYKE

SEQ ID NO: 13598 - protein, 10 aa, Borrelia garinii
TSLYYGYKEE

SEQ ID NO: 13599 - protein, 10 aa, Borrelia garinii
SLYYGYKEEQ

SEQ ID NO: 13600 - protein, 10 aa, Borrelia garinii
LYYGYKEEQS

SEQ ID NO: 13601 - protein, 10 aa, Borrelia garinii
YYGYKEEQSS

SEQ ID NO: 13602 - protein, 10 aa, Borrelia garinii
YGYKEEQSST

SEQ ID NO: 13603 - protein, 10 aa, Borrelia garinii
GYKEEQSSTN

SEQ ID NO: 13604 - protein, 10 aa, Borrelia garinii
YKEEQSSTNG

SEQ ID NO: 13605 - protein, 10 aa, Borrelia garinii
KEEQSSTNGI

SEQ ID NO: 13606 - protein, 10 aa, Borrelia garinii
EEQSSTNGIK

SEQ ID NO: 13607 - protein, 10 aa, Borrelia garinii
EQSSTNGIKG

SEQ ID NO: 13608 - protein, 10 aa, Borrelia garinii
QSSTNGIKGK

SEQ ID NO: 13609 - protein, 10 aa, Borrelia garinii
SSTNGIKGKE

SEQ ID NO: 13610 - protein, 10 aa, Borrelia garinii
STNGIKGKEI

SEQ ID NO: 13611 - protein, 10 aa, Borrelia garinii
TNGIKGKEIT

SEQ ID NO: 13612 - protein, 10 aa, Borrelia garinii
NGIKGKEITT

SEQ ID NO: 13613 - protein, 10 aa, Borrelia garinii
GIKGKEITTK

SEQ ID NO: 13614 - protein, 10 aa, Borrelia garinii
IKGKEITTKI

SEQ ID NO: 13615 - protein, 10 aa, Borrelia garinii
KGKEITTKIE

SEQ ID NO: 13616 - protein, 10 aa, Borrelia garinii
GKEITTKIET

SEQ ID NO: 13617 - protein, 10 aa, Borrelia garinii
KEITTKIETI

SEQ ID NO: 13618 - protein, 10 aa, Borrelia garinii
EITTKIETIN

SEQ ID NO: 13619 - protein, 10 aa, Borrelia garinii
ITTKIETINN

SEQ ID NO: 13620 - protein, 10 aa, Borrelia garinii
TTKIETINNS

SEQ ID NO: 13621 - protein, 10 aa, Borrelia garinii
TKIETINNSE

SEQ ID NO: 13622 - protein, 10 aa, Borrelia garinii
KIETINNSEH

SEQ ID NO: 13623 - protein, 10 aa, Borrelia garinii
IETINNSEHI

SEQ ID NO: 13624 - protein, 10 aa, Borrelia garinii
ETINNSEHIT

SEQ ID NO: 13625 - protein, 10 aa, Borrelia garinii
TINNSEHITF

SEQ ID NO: 13626 - protein, 10 aa, Borrelia garinii
INNSEHITFS

SEQ ID NO: 13627 - protein, 10 aa, Borrelia garinii
NNSEHITFSG

SEQ ID NO: 13628 - protein, 10 aa, Borrelia garinii
NSEHITFSGD

SEQ ID NO: 13629 - protein, 10 aa, Borrelia garinii
SEHITFSGDK

SEQ ID NO: 13630 - protein, 10 aa, Borrelia garinii
EHITFSGDKI

SEQ ID NO: 13631 - protein, 11 aa, Borrelia garinii
MNKKMKMFIIC

SEQ ID NO: 13632 - protein, 11 aa, Borrelia garinii
NKKMKMFIICA

SEQ ID NO: 13633 - protein, 11 aa, Borrelia garinii
KKMKMFIICAV

SEQ ID NO: 13634 - protein, 11 aa, Borrelia garinii
KMKMFIICAVF

SEQ ID NO: 13635 - protein, 11 aa, Borrelia garinii
MKMFIICAVFV

SEQ ID NO: 13636 - protein, 11 aa, Borrelia garinii
KMFIICAVFVL

SEQ ID NO: 13637 - protein, 11 aa, Borrelia garinii
MFIICAVFVLI

SEQ ID NO: 13638 - protein, 11 aa, Borrelia garinii
FIICAVFVLIS

SEQ ID NO: 13639 - protein, 11 aa, Borrelia garinii
IICAVFVLISS

SEQ ID NO: 13640 - protein, 11 aa, Borrelia garinii
ICAVFVLISSC

SEQ ID NO: 13641 - protein, 11 aa, Borrelia garinii
CAVFVLISSCG

SEQ ID NO: 13642 - protein, 11 aa, Borrelia garinii
AVFVLISSCGN

SEQ ID NO: 13643 - protein, 11 aa, Borrelia garinii
VFVLISSCGNF

SEQ ID NO: 13644 - protein, 11 aa, Borrelia garinii
FVLISSCGNFR

SEQ ID NO: 13645 - protein, 11 aa, Borrelia garinii
VLISSCGNFRS

SEQ ID NO: 13646 - protein, 11 aa, Borrelia garinii
LISSCGNFRSS

SEQ ID NO: 13647 - protein, 11 aa, Borrelia garinii
ISSCGNFRSSL

SEQ ID NO: 13648 - protein, 11 aa, Borrelia garinii
SSCGNFRSSLS

SEQ ID NO: 13649 - protein, 11 aa, Borrelia garinii
SCGNFRSSLSD

SEQ ID NO: 13650 - protein, 11 aa, Borrelia garinii
CGNFRSSLSDQ

SEQ ID NO: 13651 - protein, 11 aa, Borrelia garinii
GNFRSSLSDQG

SEQ ID NO: 13652 - protein, 11 aa, Borrelia garinii
NFRSSLSDQGS

SEQ ID NO: 13653 - protein, 11 aa, Borrelia garinii
FRSSLSDQGSL

SEQ ID NO: 13654 - protein, 11 aa, Borrelia garinii
RSSLSDQGSLS

SEQ ID NO: 13655 - protein, 11 aa, Borrelia garinii
SSLSDQGSLSD

SEQ ID NO: 13656 - protein, 11 aa, Borrelia garinii
SLSDQGSLSDQ

SEQ ID NO: 13657 - protein, 11 aa, Borrelia garinii
LSDQGSLSDQG

SEQ ID NO: 13658 - protein, 11 aa, Borrelia garinii
SDQGSLSDQGS

SEQ ID NO: 13659 - protein, 11 aa, Borrelia garinii
DQGSLSDQGSL

SEQ ID NO: 13660 - protein, 11 aa, Borrelia garinii
QGSLSDQGSLS

SEQ ID NO: 13661 - protein, 11 aa, Borrelia garinii
GSLSDQGSLSD

SEQ ID NO: 13662 - protein, 11 aa, Borrelia garinii
SLSDQGSLSDQ

SEQ ID NO: 13663 - protein, 11 aa, Borrelia garinii
LSDQGSLSDQG

SEQ ID NO: 13664 - protein, 11 aa, Borrelia garinii
SDQGSLSDQGS

SEQ ID NO: 13665 - protein, 11 aa, Borrelia garinii
DQGSLSDQGSL

SEQ ID NO: 13666 - protein, 11 aa, Borrelia garinii
QGSLSDQGSLS

SEQ ID NO: 13667 - protein, 11 aa, Borrelia garinii
GSLSDQGSLSD

SEQ ID NO: 13668 - protein, 11 aa, Borrelia garinii
SLSDQGSLSDQ

SEQ ID NO: 13669 - protein, 11 aa, Borrelia garinii
LSDQGSLSDQG

SEQ ID NO: 13670 - protein, 11 aa, Borrelia garinii
SDQGSLSDQGG

SEQ ID NO: 13671 - protein, 11 aa, Borrelia garinii
DQGSLSDQGGL

SEQ ID NO: 13672 - protein, 11 aa, Borrelia garinii
QGSLSDQGGLS

SEQ ID NO: 13673 - protein, 11 aa, Borrelia garinii
GSLSDQGGLSG

SEQ ID NO: 13674 - protein, 11 aa, Borrelia garinii
SLSDQGGLSGQ

SEQ ID NO: 13675 - protein, 11 aa, Borrelia garinii
LSDQGGLSGQA

SEQ ID NO: 13676 - protein, 11 aa, Borrelia garinii
SDQGGLSGQAS

SEQ ID NO: 13677 - protein, 11 aa, Borrelia garinii
DQGGLSGQASS

SEQ ID NO: 13678 - protein, 11 aa, Borrelia garinii
QGGLSGQASSD

SEQ ID NO: 13679 - protein, 11 aa, Borrelia garinii
GGLSGQASSDT

SEQ ID NO: 13680 - protein, 11 aa, Borrelia garinii
GLSGQASSDTI

SEQ ID NO: 13681 - protein, 11 aa, Borrelia garinii
LSGQASSDTIK

SEQ ID NO: 13682 - protein, 11 aa, Borrelia garinii
SGQASSDTIKF

SEQ ID NO: 13683 - protein, 11 aa, Borrelia garinii
GQASSDTIKFS

SEQ ID NO: 13684 - protein, 11 aa, Borrelia garinii
QASSDTIKFSE

SEQ ID NO: 13685 - protein, 11 aa, Borrelia garinii
ASSDTIKFSEF

SEQ ID NO: 13686 - protein, 11 aa, Borrelia garinii
SSDTIKFSEFT

SEQ ID NO: 13687 - protein, 11 aa, Borrelia garinii
SDTIKFSEFTV

SEQ ID NO: 13688 - protein, 11 aa, Borrelia garinii
DTIKFSEFTVN

SEQ ID NO: 13689 - protein, 11 aa, Borrelia garinii
TIKFSEFTVNI

SEQ ID NO: 13690 - protein, 11 aa, Borrelia garinii
IKFSEFTVNIK

SEQ ID NO: 13691 - protein, 11 aa, Borrelia garinii
KFSEFTVNIKN

SEQ ID NO: 13692 - protein, 11 aa, Borrelia garinii
FSEFTVNIKNK

SEQ ID NO: 13693 - protein, 11 aa, Borrelia garinii
SEFTVNIKNKK

SEQ ID NO: 13694 - protein, 11 aa, Borrelia garinii
EFTVNIKNKKD

SEQ ID NO: 13695 - protein, 11 aa, Borrelia garinii
FTVNIKNKKDN

SEQ ID NO: 13696 - protein, 11 aa, Borrelia garinii
TVNIKNKKDNN

SEQ ID NO: 13697 - protein, 11 aa, Borrelia garinii
VNIKNKKDNNG

SEQ ID NO: 13698 - protein, 11 aa, Borrelia garinii
NIKNKKDNNGD

SEQ ID NO: 13699 - protein, 11 aa, Borrelia garinii
IKNKKDNNGDW

SEQ ID NO: 13700 - protein, 11 aa, Borrelia garinii
KNKKDNNGDWS

SEQ ID NO: 13701 - protein, 11 aa, Borrelia garinii
NKKDNNGDWSN

SEQ ID NO: 13702 - protein, 11 aa, Borrelia garinii
KKDNNGDWSNL

SEQ ID NO: 13703 - protein, 11 aa, Borrelia garinii
KDNNGDWSNLG

SEQ ID NO: 13704 - protein, 11 aa, Borrelia garinii
DNNGDWSNLGT

SEQ ID NO: 13705 - protein, 11 aa, Borrelia garinii
NNGDWSNLGTL

SEQ ID NO: 13706 - protein, 11 aa, Borrelia garinii
NGDWSNLGTLV

SEQ ID NO: 13707 - protein, 11 aa, Borrelia garinii
GDWSNLGTLVI

SEQ ID NO: 13708 - protein, 11 aa, Borrelia garinii
DWSNLGTLVIR

SEQ ID NO: 13709 - protein, 11 aa, Borrelia garinii
WSNLGTLVIRK

SEQ ID NO: 13710 - protein, 11 aa, Borrelia garinii
SNLGTLVIRKE

SEQ ID NO: 13711 - protein, 11 aa, Borrelia garinii
NLGTLVIRKEQ

SEQ ID NO: 13712 - protein, 11 aa, Borrelia garinii
LGTLVIRKEQD

SEQ ID NO: 13713 - protein, 11 aa, Borrelia garinii
GTLVIRKEQDG

SEQ ID NO: 13714 - protein, 11 aa, Borrelia garinii
TLVIRKEQDGV

SEQ ID NO: 13715 - protein, 11 aa, Borrelia garinii
LVIRKEQDGVE

SEQ ID NO: 13716 - protein, 11 aa, Borrelia garinii
VIRKEQDGVET

SEQ ID NO: 13717 - protein, 11 aa, Borrelia garinii
IRKEQDGVETG

SEQ ID NO: 13718 - protein, 11 aa, Borrelia garinii
RKEQDGVETGL

SEQ ID NO: 13719 - protein, 11 aa, Borrelia garinii
KEQDGVETGLN

SEQ ID NO: 13720 - protein, 11 aa, Borrelia garinii
EQDGVETGLNV

SEQ ID NO: 13721 - protein, 11 aa, Borrelia garinii
QDGVETGLNVI

SEQ ID NO: 13722 - protein, 11 aa, Borrelia garinii
DGVETGLNVIG

SEQ ID NO: 13723 - protein, 11 aa, Borrelia garinii
GVETGLNVIGT

SEQ ID NO: 13724 - protein, 11 aa, Borrelia garinii
VETGLNVIGTI

SEQ ID NO: 13725 - protein, 11 aa, Borrelia garinii
ETGLNVIGTIN

SEQ ID NO: 13726 - protein, 11 aa, Borrelia garinii
TGLNVIGTING

SEQ ID NO: 13727 - protein, 11 aa, Borrelia garinii
GLNVIGTINGQ

SEQ ID NO: 13728 - protein, 11 aa, Borrelia garinii
LNVIGTINGQL

SEQ ID NO: 13729 - protein, 11 aa, Borrelia garinii
NVIGTINGQLR

SEQ ID NO: 13730 - protein, 11 aa, Borrelia garinii
VIGTINGQLRG

SEQ ID NO: 13731 - protein, 11 aa, Borrelia garinii
IGTINGQLRGH

SEQ ID NO: 13732 - protein, 11 aa, Borrelia garinii
GTINGQLRGHS

SEQ ID NO: 13733 - protein, 11 aa, Borrelia garinii
TINGQLRGHSA

SEQ ID NO: 13734 - protein, 11 aa, Borrelia garinii
INGQLRGHSAT

SEQ ID NO: 13735 - protein, 11 aa, Borrelia garinii
NGQLRGHSATF

SEQ ID NO: 13736 - protein, 11 aa, Borrelia garinii
GQLRGHSATFF

SEQ ID NO: 13737 - protein, 11 aa, Borrelia garinii
QLRGHSATFFC

SEQ ID NO: 13738 - protein, 11 aa, Borrelia garinii
LRGHSATFFCI

SEQ ID NO: 13739 - protein, 11 aa, Borrelia garinii
RGHSATFFCIE

SEQ ID NO: 13740 - protein, 11 aa, Borrelia garinii
GHSATFFCIEE

SEQ ID NO: 13741 - protein, 11 aa, Borrelia garinii
HSATFFCIEEA

SEQ ID NO: 13742 - protein, 11 aa, Borrelia garinii
SATFFCIEEAE

SEQ ID NO: 13743 - protein, 11 aa, Borrelia garinii
ATFFCIEEAEV

SEQ ID NO: 13744 - protein, 11 aa, Borrelia garinii
TFFCIEEAEVN

SEQ ID NO: 13745 - protein, 11 aa, Borrelia garinii
FFCIEEAEVNN

SEQ ID NO: 13746 - protein, 11 aa, Borrelia garinii
FCIEEAEVNNF

SEQ ID NO: 13747 - protein, 11 aa, Borrelia garinii
CIEEAEVNNFV

SEQ ID NO: 13748 - protein, 11 aa, Borrelia garinii
IEEAEVNNFVK

SEQ ID NO: 13749 - protein, 11 aa, Borrelia garinii
EEAEVNNFVKA

SEQ ID NO: 13750 - protein, 11 aa, Borrelia garinii
EAEVNNFVKAM

SEQ ID NO: 13751 - protein, 11 aa, Borrelia garinii
AEVNNFVKAMT

SEQ ID NO: 13752 - protein, 11 aa, Borrelia garinii
EVNNFVKAMTN

SEQ ID NO: 13753 - protein, 11 aa, Borrelia garinii
VNNFVKAMTNV

SEQ ID NO: 13754 - protein, 11 aa, Borrelia garinii
NNFVKAMTNVG

SEQ ID NO: 13755 - protein, 11 aa, Borrelia garinii
NFVKAMTNVGS

SEQ ID NO: 13756 - protein, 11 aa, Borrelia garinii
FVKAMTNVGSF

SEQ ID NO: 13757 - protein, 11 aa, Borrelia garinii
VKAMTNVGSFK

SEQ ID NO: 13758 - protein, 11 aa, Borrelia garinii
KAMTNVGSFKT

SEQ ID NO: 13759 - protein, 11 aa, Borrelia garinii
AMTNVGSFKTS

SEQ ID NO: 13760 - protein, 11 aa, Borrelia garinii
MTNVGSFKTSL

SEQ ID NO: 13761 - protein, 11 aa, Borrelia garinii
TNVGSFKTSLY

SEQ ID NO: 13762 - protein, 11 aa, Borrelia garinii
NVGSFKTSLYY

SEQ ID NO: 13763 - protein, 11 aa, Borrelia garinii
VGSFKTSLYYG

SEQ ID NO: 13764 - protein, 11 aa, Borrelia garinii
GSFKTSLYYGY

SEQ ID NO: 13765 - protein, 11 aa, Borrelia garinii
SFKTSLYYGYK

SEQ ID NO: 13766 - protein, 11 aa, Borrelia garinii
FKTSLYYGYKE

SEQ ID NO: 13767 - protein, 11 aa, Borrelia garinii
KTSLYYGYKEE

SEQ ID NO: 13768 - protein, 11 aa, Borrelia garinii
TSLYYGYKEEQ

SEQ ID NO: 13769 - protein, 11 aa, Borrelia garinii
SLYYGYKEEQS

SEQ ID NO: 13770 - protein, 11 aa, Borrelia garinii
LYYGYKEEQSS

SEQ ID NO: 13771 - protein, 11 aa, Borrelia garinii
YYGYKEEQSST

SEQ ID NO: 13772 - protein, 11 aa, Borrelia garinii
YGYKEEQSSTN

SEQ ID NO: 13773 - protein, 11 aa, Borrelia garinii
GYKEEQSSTNG

SEQ ID NO: 13774 - protein, 11 aa, Borrelia garinii
YKEEQSSTNGI

SEQ ID NO: 13775 - protein, 11 aa, Borrelia garinii
KEEQSSTNGIK

SEQ ID NO: 13776 - protein, 11 aa, Borrelia garinii
EEQSSTNGIKG

SEQ ID NO: 13777 - protein, 11 aa, Borrelia garinii
EQSSTNGIKGK

SEQ ID NO: 13778 - protein, 11 aa, Borrelia garinii
QSSTNGIKGKE

SEQ ID NO: 13779 - protein, 11 aa, Borrelia garinii
SSTNGIKGKEI

SEQ ID NO: 13780 - protein, 11 aa, Borrelia garinii
STNGIKGKEIT

SEQ ID NO: 13781 - protein, 11 aa, Borrelia garinii
TNGIKGKEITT

SEQ ID NO: 13782 - protein, 11 aa, Borrelia garinii
NGIKGKEITTK

SEQ ID NO: 13783 - protein, 11 aa, Borrelia garinii
GIKGKEITTKI

SEQ ID NO: 13784 - protein, 11 aa, Borrelia garinii
IKGKEITTKIE

SEQ ID NO: 13785 - protein, 11 aa, Borrelia garinii
KGKEITTKIET

SEQ ID NO: 13786 - protein, 11 aa, Borrelia garinii
GKEITTKIETI

SEQ ID NO: 13787 - protein, 11 aa, Borrelia garinii
KEITTKIETIN

SEQ ID NO: 13788 - protein, 11 aa, Borrelia garinii
EITTKIETINN

SEQ ID NO: 13789 - protein, 11 aa, Borrelia garinii
ITTKIETINNS

SEQ ID NO: 13790 - protein, 11 aa, Borrelia garinii
TTKIETINNSE

SEQ ID NO: 13791 - protein, 11 aa, Borrelia garinii
TKIETINNSEH

SEQ ID NO: 13792 - protein, 11 aa, Borrelia garinii
KIETINNSEHI

SEQ ID NO: 13793 - protein, 11 aa, Borrelia garinii
IETINNSEHIT

SEQ ID NO: 13794 - protein, 11 aa, Borrelia garinii
ETINNSEHITF

SEQ ID NO: 13795 - protein, 11 aa, Borrelia garinii
TINNSEHITFS

SEQ ID NO: 13796 - protein, 11 aa, Borrelia garinii
INNSEHITFSG

SEQ ID NO: 13797 - protein, 11 aa, Borrelia garinii
NNSEHITFSGD

SEQ ID NO: 13798 - protein, 11 aa, Borrelia garinii
NSEHITFSGDK

SEQ ID NO: 13799 - protein, 11 aa, Borrelia garinii
SEHITFSGDKI

SEQ ID NO: 13800 - protein, 8 aa, Borrelia burgdorferi
MNKKMKNL

SEQ ID NO: 13801 - protein, 8 aa, Borrelia burgdorferi
NKKMKNLI

SEQ ID NO: 13802 - protein, 8 aa, Borrelia burgdorferi
KKMKNLII

SEQ ID NO: 13803 - protein, 8 aa, Borrelia burgdorferi
KMKNLIIC

SEQ ID NO: 13804 - protein, 8 aa, Borrelia burgdorferi
MKNLIICA

SEQ ID NO: 13805 - protein, 8 aa, Borrelia burgdorferi
KNLIICAV

SEQ ID NO: 13806 - protein, 8 aa, Borrelia burgdorferi
NLIICAVF

SEQ ID NO: 13807 - protein, 8 aa, Borrelia burgdorferi
LIICAVFV

SEQ ID NO: 13808 - protein, 8 aa, Borrelia burgdorferi
IICAVFVL

SEQ ID NO: 13809 - protein, 8 aa, Borrelia burgdorferi
ICAVFVLI

SEQ ID NO: 13810 - protein, 8 aa, Borrelia burgdorferi
CAVFVLII

SEQ ID NO: 13811 - protein, 8 aa, Borrelia burgdorferi
AVFVLIIS

SEQ ID NO: 13812 - protein, 8 aa, Borrelia burgdorferi
VFVLIISC

SEQ ID NO: 13813 - protein, 8 aa, Borrelia burgdorferi
FVLIISCK

SEQ ID NO: 13814 - protein, 8 aa, Borrelia burgdorferi
VLIISCKI

SEQ ID NO: 13815 - protein, 8 aa, Borrelia burgdorferi
LIISCKID

SEQ ID NO: 13816 - protein, 8 aa, Borrelia burgdorferi
IISCKIDA

SEQ ID NO: 13817 - protein, 8 aa, Borrelia burgdorferi
ISCKIDAS

SEQ ID NO: 13818 - protein, 8 aa, Borrelia burgdorferi
SCKIDASS

SEQ ID NO: 13819 - protein, 8 aa, Borrelia burgdorferi
CKIDASSE

SEQ ID NO: 13820 - protein, 8 aa, Borrelia burgdorferi
KIDASSED

SEQ ID NO: 13821 - protein, 8 aa, Borrelia burgdorferi
IDASSEDL

SEQ ID NO: 13822 - protein, 8 aa, Borrelia burgdorferi
DASSEDLK

SEQ ID NO: 13823 - protein, 8 aa, Borrelia burgdorferi
ASSEDLKQ

SEQ ID NO: 13824 - protein, 8 aa, Borrelia burgdorferi
SSEDLKQN

SEQ ID NO: 13825 - protein, 8 aa, Borrelia burgdorferi
SEDLKQNV

SEQ ID NO: 13826 - protein, 8 aa, Borrelia burgdorferi
EDLKQNVK

SEQ ID NO: 13827 - protein, 8 aa, Borrelia burgdorferi
DLKQNVKE

SEQ ID NO: 13828 - protein, 8 aa, Borrelia burgdorferi
LKQNVKEK

SEQ ID NO: 13829 - protein, 8 aa, Borrelia burgdorferi
KQNVKEKV

SEQ ID NO: 13830 - protein, 8 aa, Borrelia burgdorferi
QNVKEKVE

SEQ ID NO: 13831 - protein, 8 aa, Borrelia burgdorferi
NVKEKVEG

SEQ ID NO: 13832 - protein, 8 aa, Borrelia burgdorferi
VKEKVEGF

SEQ ID NO: 13833 - protein, 8 aa, Borrelia burgdorferi
KEKVEGFL

SEQ ID NO: 13834 - protein, 8 aa, Borrelia burgdorferi
EKVEGFLD

SEQ ID NO: 13835 - protein, 8 aa, Borrelia burgdorferi
KVEGFLDK

SEQ ID NO: 13836 - protein, 8 aa, Borrelia burgdorferi
VEGFLDKE

SEQ ID NO: 13837 - protein, 8 aa, Borrelia burgdorferi
EGFLDKEL

SEQ ID NO: 13838 - protein, 8 aa, Borrelia burgdorferi
GFLDKELM

SEQ ID NO: 13839 - protein, 8 aa, Borrelia burgdorferi
FLDKELMQ

SEQ ID NO: 13840 - protein, 8 aa, Borrelia burgdorferi
LDKELMQG

SEQ ID NO: 13841 - protein, 8 aa, Borrelia burgdorferi
DKELMQGD

SEQ ID NO: 13842 - protein, 8 aa, Borrelia burgdorferi
KELMQGDD

SEQ ID NO: 13843 - protein, 8 aa, Borrelia burgdorferi
ELMQGDDP

SEQ ID NO: 13844 - protein, 8 aa, Borrelia burgdorferi
LMQGDDPN

SEQ ID NO: 13845 - protein, 8 aa, Borrelia burgdorferi
MQGDDPNN

SEQ ID NO: 13846 - protein, 8 aa, Borrelia burgdorferi
QGDDPNNS

SEQ ID NO: 13847 - protein, 8 aa, Borrelia burgdorferi
GDDPNNSL

SEQ ID NO: 13848 - protein, 8 aa, Borrelia burgdorferi
DDPNNSLF

SEQ ID NO: 13849 - protein, 8 aa, Borrelia burgdorferi
DPNNSLFN

SEQ ID NO: 13850 - protein, 8 aa, Borrelia burgdorferi
PNNSLFNP

SEQ ID NO: 13851 - protein, 8 aa, Borrelia burgdorferi
NNSLFNPP

SEQ ID NO: 13852 - protein, 8 aa, Borrelia burgdorferi
NSLFNPPP

SEQ ID NO: 13853 - protein, 8 aa, Borrelia burgdorferi
SLFNPPPV

SEQ ID NO: 13854 - protein, 8 aa, Borrelia burgdorferi
LFNPPPVL

SEQ ID NO: 13855 - protein, 8 aa, Borrelia burgdorferi
FNPPPVLP

SEQ ID NO: 13856 - protein, 8 aa, Borrelia burgdorferi
NPPPVLPA

SEQ ID NO: 13857 - protein, 8 aa, Borrelia burgdorferi
PPPVLPAS

SEQ ID NO: 13858 - protein, 8 aa, Borrelia burgdorferi
PPVLPASS

SEQ ID NO: 13859 - protein, 8 aa, Borrelia burgdorferi
PVLPASSH

SEQ ID NO: 13860 - protein, 8 aa, Borrelia burgdorferi
VLPASSHD

SEQ ID NO: 13861 - protein, 8 aa, Borrelia burgdorferi
LPASSHDN

SEQ ID NO: 13862 - protein, 8 aa, Borrelia burgdorferi
PASSHDNT

SEQ ID NO: 13863 - protein, 8 aa, Borrelia burgdorferi
ASSHDNTP

SEQ ID NO: 13864 - protein, 8 aa, Borrelia burgdorferi
SSHDNTPV

SEQ ID NO: 13865 - protein, 8 aa, Borrelia burgdorferi
SHDNTPVL

SEQ ID NO: 13866 - protein, 8 aa, Borrelia burgdorferi
HDNTPVLK

SEQ ID NO: 13867 - protein, 8 aa, Borrelia burgdorferi
DNTPVLKA

SEQ ID NO: 13868 - protein, 8 aa, Borrelia burgdorferi
NTPVLKAV

SEQ ID NO: 13869 - protein, 8 aa, Borrelia burgdorferi
TPVLKAVQ

SEQ ID NO: 13870 - protein, 8 aa, Borrelia burgdorferi
PVLKAVQA

SEQ ID NO: 13871 - protein, 8 aa, Borrelia burgdorferi
VLKAVQAK

SEQ ID NO: 13872 - protein, 8 aa, Borrelia burgdorferi
LKAVQAKD

SEQ ID NO: 13873 - protein, 8 aa, Borrelia burgdorferi
KAVQAKDG

SEQ ID NO: 13874 - protein, 8 aa, Borrelia burgdorferi
AVQAKDGG

SEQ ID NO: 13875 - protein, 8 aa, Borrelia burgdorferi
VQAKDGGQ

SEQ ID NO: 13876 - protein, 8 aa, Borrelia burgdorferi
QAKDGGQQ

SEQ ID NO: 13877 - protein, 8 aa, Borrelia burgdorferi
AKDGGQQE

SEQ ID NO: 13878 - protein, 8 aa, Borrelia burgdorferi
KDGGQQEG

SEQ ID NO: 13879 - protein, 8 aa, Borrelia burgdorferi
DGGQQEGK

SEQ ID NO: 13880 - protein, 8 aa, Borrelia burgdorferi
GGQQEGKE

SEQ ID NO: 13881 - protein, 8 aa, Borrelia burgdorferi
GQQEGKEE

SEQ ID NO: 13882 - protein, 8 aa, Borrelia burgdorferi
QQEGKEEK

SEQ ID NO: 13883 - protein, 8 aa, Borrelia burgdorferi
QEGKEEKE

SEQ ID NO: 13884 - protein, 8 aa, Borrelia burgdorferi
EGKEEKEK

SEQ ID NO: 13885 - protein, 8 aa, Borrelia burgdorferi
GKEEKEKE

SEQ ID NO: 13886 - protein, 8 aa, Borrelia burgdorferi
KEEKEKEI

SEQ ID NO: 13887 - protein, 8 aa, Borrelia burgdorferi
EEKEKEIQ

SEQ ID NO: 13888 - protein, 8 aa, Borrelia burgdorferi
EKEKEIQE

SEQ ID NO: 13889 - protein, 8 aa, Borrelia burgdorferi
KEKEIQEL

SEQ ID NO: 13890 - protein, 8 aa, Borrelia burgdorferi
EKEIQELK

SEQ ID NO: 13891 - protein, 8 aa, Borrelia burgdorferi
KEIQELKD

SEQ ID NO: 13892 - protein, 8 aa, Borrelia burgdorferi
EIQELKDK

SEQ ID NO: 13893 - protein, 8 aa, Borrelia burgdorferi
IQELKDKI

SEQ ID NO: 13894 - protein, 8 aa, Borrelia burgdorferi
QELKDKID

SEQ ID NO: 13895 - protein, 8 aa, Borrelia burgdorferi
ELKDKIDK

SEQ ID NO: 13896 - protein, 8 aa, Borrelia burgdorferi
LKDKIDKR

SEQ ID NO: 13897 - protein, 8 aa, Borrelia burgdorferi
KDKIDKRK

SEQ ID NO: 13898 - protein, 8 aa, Borrelia burgdorferi
DKIDKRKK

SEQ ID NO: 13899 - protein, 8 aa, Borrelia burgdorferi
KIDKRKKE

SEQ ID NO: 13900 - protein, 8 aa, Borrelia burgdorferi
IDKRKKEL

SEQ ID NO: 13901 - protein, 8 aa, Borrelia burgdorferi
DKRKKELE

SEQ ID NO: 13902 - protein, 8 aa, Borrelia burgdorferi
KRKKELEE

SEQ ID NO: 13903 - protein, 8 aa, Borrelia burgdorferi
RKKELEEA

SEQ ID NO: 13904 - protein, 8 aa, Borrelia burgdorferi
KKELEEAR

SEQ ID NO: 13905 - protein, 8 aa, Borrelia burgdorferi
KELEEARK

SEQ ID NO: 13906 - protein, 8 aa, Borrelia burgdorferi
ELEEARKK

SEQ ID NO: 13907 - protein, 8 aa, Borrelia burgdorferi
LEEARKKF

SEQ ID NO: 13908 - protein, 8 aa, Borrelia burgdorferi
EEARKKFQ

SEQ ID NO: 13909 - protein, 8 aa, Borrelia burgdorferi
EARKKFQE

SEQ ID NO: 13910 - protein, 8 aa, Borrelia burgdorferi
ARKKFQEF

SEQ ID NO: 13911 - protein, 8 aa, Borrelia burgdorferi
RKKFQEFK

SEQ ID NO: 13912 - protein, 8 aa, Borrelia burgdorferi
KKFQEFKE

SEQ ID NO: 13913 - protein, 8 aa, Borrelia burgdorferi
KFQEFKEQ

SEQ ID NO: 13914 - protein, 8 aa, Borrelia burgdorferi
FQEFKEQV

SEQ ID NO: 13915 - protein, 8 aa, Borrelia burgdorferi
QEFKEQVE

SEQ ID NO: 13916 - protein, 8 aa, Borrelia burgdorferi
EFKEQVES

SEQ ID NO: 13917 - protein, 8 aa, Borrelia burgdorferi
FKEQVESA

SEQ ID NO: 13918 - protein, 8 aa, Borrelia burgdorferi
KEQVESAT

SEQ ID NO: 13919 - protein, 8 aa, Borrelia burgdorferi
EQVESATG

SEQ ID NO: 13920 - protein, 8 aa, Borrelia burgdorferi
QVESATGE

SEQ ID NO: 13921 - protein, 8 aa, Borrelia burgdorferi
VESATGES

SEQ ID NO: 13922 - protein, 8 aa, Borrelia burgdorferi
ESATGEST

SEQ ID NO: 13923 - protein, 8 aa, Borrelia burgdorferi
SATGESTE

SEQ ID NO: 13924 - protein, 8 aa, Borrelia burgdorferi
ATGESTEK

SEQ ID NO: 13925 - protein, 8 aa, Borrelia burgdorferi
TGESTEKV

SEQ ID NO: 13926 - protein, 8 aa, Borrelia burgdorferi
GESTEKVK

SEQ ID NO: 13927 - protein, 8 aa, Borrelia burgdorferi
ESTEKVKK

SEQ ID NO: 13928 - protein, 8 aa, Borrelia burgdorferi
STEKVKKQ

SEQ ID NO: 13929 - protein, 8 aa, Borrelia burgdorferi
TEKVKKQG

SEQ ID NO: 13930 - protein, 8 aa, Borrelia burgdorferi
EKVKKQGN

SEQ ID NO: 13931 - protein, 8 aa, Borrelia burgdorferi
KVKKQGNI

SEQ ID NO: 13932 - protein, 8 aa, Borrelia burgdorferi
VKKQGNIG

SEQ ID NO: 13933 - protein, 8 aa, Borrelia burgdorferi
KKQGNIGQ

SEQ ID NO: 13934 - protein, 8 aa, Borrelia burgdorferi
KQGNIGQK

SEQ ID NO: 13935 - protein, 8 aa, Borrelia burgdorferi
QGNIGQKA

SEQ ID NO: 13936 - protein, 8 aa, Borrelia burgdorferi
GNIGQKAL

SEQ ID NO: 13937 - protein, 8 aa, Borrelia burgdorferi
NIGQKALK

SEQ ID NO: 13938 - protein, 8 aa, Borrelia burgdorferi
IGQKALKY

SEQ ID NO: 13939 - protein, 8 aa, Borrelia burgdorferi
GQKALKYA

SEQ ID NO: 13940 - protein, 8 aa, Borrelia burgdorferi
QKALKYAK

SEQ ID NO: 13941 - protein, 8 aa, Borrelia burgdorferi
KALKYAKE

SEQ ID NO: 13942 - protein, 8 aa, Borrelia burgdorferi
ALKYAKEL

SEQ ID NO: 13943 - protein, 8 aa, Borrelia burgdorferi
LKYAKELG

SEQ ID NO: 13944 - protein, 8 aa, Borrelia burgdorferi
KYAKELGV

SEQ ID NO: 13945 - protein, 8 aa, Borrelia burgdorferi
YAKELGVN

SEQ ID NO: 13946 - protein, 8 aa, Borrelia burgdorferi
AKELGVNG

SEQ ID NO: 13947 - protein, 8 aa, Borrelia burgdorferi
KELGVNGS

SEQ ID NO: 13948 - protein, 8 aa, Borrelia burgdorferi
ELGVNGSY

SEQ ID NO: 13949 - protein, 8 aa, Borrelia burgdorferi
LGVNGSYS

SEQ ID NO: 13950 - protein, 8 aa, Borrelia burgdorferi
GVNGSYSV

SEQ ID NO: 13951 - protein, 8 aa, Borrelia burgdorferi
VNGSYSVN

SEQ ID NO: 13952 - protein, 8 aa, Borrelia burgdorferi
NGSYSVND

SEQ ID NO: 13953 - protein, 8 aa, Borrelia burgdorferi
GSYSVNDG

SEQ ID NO: 13954 - protein, 8 aa, Borrelia burgdorferi
SYSVNDGT

SEQ ID NO: 13955 - protein, 8 aa, Borrelia burgdorferi
YSVNDGTN

SEQ ID NO: 13956 - protein, 8 aa, Borrelia burgdorferi
SVNDGTNT

SEQ ID NO: 13957 - protein, 8 aa, Borrelia burgdorferi
VNDGTNTN

SEQ ID NO: 13958 - protein, 8 aa, Borrelia burgdorferi
NDGTNTND

SEQ ID NO: 13959 - protein, 8 aa, Borrelia burgdorferi
DGTNTNDF

SEQ ID NO: 13960 - protein, 8 aa, Borrelia burgdorferi
GTNTNDFV

SEQ ID NO: 13961 - protein, 8 aa, Borrelia burgdorferi
TNTNDFVK

SEQ ID NO: 13962 - protein, 8 aa, Borrelia burgdorferi
NTNDFVKK

SEQ ID NO: 13963 - protein, 8 aa, Borrelia burgdorferi
TNDFVKKV

SEQ ID NO: 13964 - protein, 8 aa, Borrelia burgdorferi
NDFVKKVI

SEQ ID NO: 13965 - protein, 8 aa, Borrelia burgdorferi
DFVKKVID

SEQ ID NO: 13966 - protein, 8 aa, Borrelia burgdorferi
FVKKVIDD

SEQ ID NO: 13967 - protein, 8 aa, Borrelia burgdorferi
VKKVIDDA

SEQ ID NO: 13968 - protein, 8 aa, Borrelia burgdorferi
KKVIDDAL

SEQ ID NO: 13969 - protein, 8 aa, Borrelia burgdorferi
KVIDDALK

SEQ ID NO: 13970 - protein, 8 aa, Borrelia burgdorferi
VIDDALKN

SEQ ID NO: 13971 - protein, 8 aa, Borrelia burgdorferi
IDDALKNI

SEQ ID NO: 13972 - protein, 8 aa, Borrelia burgdorferi
DDALKNIE

SEQ ID NO: 13973 - protein, 8 aa, Borrelia burgdorferi
DALKNIEE

SEQ ID NO: 13974 - protein, 8 aa, Borrelia burgdorferi
ALKNIEEE

SEQ ID NO: 13975 - protein, 8 aa, Borrelia burgdorferi
LKNIEEEL

SEQ ID NO: 13976 - protein, 8 aa, Borrelia burgdorferi
KNIEEELE

SEQ ID NO: 13977 - protein, 8 aa, Borrelia burgdorferi
NIEEELEK

SEQ ID NO: 13978 - protein, 8 aa, Borrelia burgdorferi
IEEELEKL

SEQ ID NO: 13979 - protein, 8 aa, Borrelia burgdorferi
EEELEKLA

SEQ ID NO: 13980 - protein, 8 aa, Borrelia burgdorferi
EELEKLAE

SEQ ID NO: 13981 - protein, 8 aa, Borrelia burgdorferi
ELEKLAEP

SEQ ID NO: 13982 - protein, 8 aa, Borrelia burgdorferi
LEKLAEPQ

SEQ ID NO: 13983 - protein, 8 aa, Borrelia burgdorferi
EKLAEPQN

SEQ ID NO: 13984 - protein, 8 aa, Borrelia burgdorferi
KLAEPQNI

SEQ ID NO: 13985 - protein, 8 aa, Borrelia burgdorferi
LAEPQNIE

SEQ ID NO: 13986 - protein, 8 aa, Borrelia burgdorferi
AEPQNIED

SEQ ID NO: 13987 - protein, 8 aa, Borrelia burgdorferi
EPQNIEDK

SEQ ID NO: 13988 - protein, 8 aa, Borrelia burgdorferi
PQNIEDKK

SEQ ID NO: 13989 - protein, 9 aa, Borrelia burgdorferi
MNKKMKNLI

SEQ ID NO: 13990 - protein, 9 aa, Borrelia burgdorferi
NKKMKNLII

SEQ ID NO: 13991 - protein, 9 aa, Borrelia burgdorferi
KKMKNLIIC

SEQ ID NO: 13992 - protein, 9 aa, Borrelia burgdorferi
KMKNLIICA

SEQ ID NO: 13993 - protein, 9 aa, Borrelia burgdorferi
MKNLIICAV

SEQ ID NO: 13994 - protein, 9 aa, Borrelia burgdorferi
KNLIICAVF

SEQ ID NO: 13995 - protein, 9 aa, Borrelia burgdorferi
NLIICAVFV

SEQ ID NO: 13996 - protein, 9 aa, Borrelia burgdorferi
LIICAVFVL

SEQ ID NO: 13997 - protein, 9 aa, Borrelia burgdorferi
IICAVFVLI

SEQ ID NO: 13998 - protein, 9 aa, Borrelia burgdorferi
ICAVFVLII

SEQ ID NO: 13999 - protein, 9 aa, Borrelia burgdorferi
CAVFVLIIS

SEQ ID NO: 14000 - protein, 9 aa, Borrelia burgdorferi
AVFVLIISC

SEQ ID NO: 14001 - protein, 9 aa, Borrelia burgdorferi
VFVLIISCK

SEQ ID NO: 14002 - protein, 9 aa, Borrelia burgdorferi
FVLIISCKI

SEQ ID NO: 14003 - protein, 9 aa, Borrelia burgdorferi
VLIISCKID

SEQ ID NO: 14004 - protein, 9 aa, Borrelia burgdorferi
LIISCKIDA

SEQ ID NO: 14005 - protein, 9 aa, Borrelia burgdorferi
IISCKIDAS

SEQ ID NO: 14006 - protein, 9 aa, Borrelia burgdorferi
ISCKIDASS

SEQ ID NO: 14007 - protein, 9 aa, Borrelia burgdorferi
SCKIDASSE

SEQ ID NO: 14008 - protein, 9 aa, Borrelia burgdorferi
CKIDASSED

SEQ ID NO: 14009 - protein, 9 aa, Borrelia burgdorferi
KIDASSEDL

SEQ ID NO: 14010 - protein, 9 aa, Borrelia burgdorferi
IDASSEDLK

SEQ ID NO: 14011 - protein, 9 aa, Borrelia burgdorferi
DASSEDLKQ

SEQ ID NO: 14012 - protein, 9 aa, Borrelia burgdorferi
ASSEDLKQN

SEQ ID NO: 14013 - protein, 9 aa, Borrelia burgdorferi
SSEDLKQNV

SEQ ID NO: 14014 - protein, 9 aa, Borrelia burgdorferi
SEDLKQNVK

SEQ ID NO: 14015 - protein, 9 aa, Borrelia burgdorferi
EDLKQNVKE

SEQ ID NO: 14016 - protein, 9 aa, Borrelia burgdorferi
DLKQNVKEK

SEQ ID NO: 14017 - protein, 9 aa, Borrelia burgdorferi
LKQNVKEKV

SEQ ID NO: 14018 - protein, 9 aa, Borrelia burgdorferi
KQNVKEKVE

SEQ ID NO: 14019 - protein, 9 aa, Borrelia burgdorferi
QNVKEKVEG

SEQ ID NO: 14020 - protein, 9 aa, Borrelia burgdorferi
NVKEKVEGF

SEQ ID NO: 14021 - protein, 9 aa, Borrelia burgdorferi
VKEKVEGFL

SEQ ID NO: 14022 - protein, 9 aa, Borrelia burgdorferi
KEKVEGFLD

SEQ ID NO: 14023 - protein, 9 aa, Borrelia burgdorferi
EKVEGFLDK

SEQ ID NO: 14024 - protein, 9 aa, Borrelia burgdorferi
KVEGFLDKE

SEQ ID NO: 14025 - protein, 9 aa, Borrelia burgdorferi
VEGFLDKEL

SEQ ID NO: 14026 - protein, 9 aa, Borrelia burgdorferi
EGFLDKELM

SEQ ID NO: 14027 - protein, 9 aa, Borrelia burgdorferi
GFLDKELMQ

SEQ ID NO: 14028 - protein, 9 aa, Borrelia burgdorferi
FLDKELMQG

SEQ ID NO: 14029 - protein, 9 aa, Borrelia burgdorferi
LDKELMQGD

SEQ ID NO: 14030 - protein, 9 aa, Borrelia burgdorferi
DKELMQGDD

SEQ ID NO: 14031 - protein, 9 aa, Borrelia burgdorferi
KELMQGDDP

SEQ ID NO: 14032 - protein, 9 aa, Borrelia burgdorferi
ELMQGDDPN

SEQ ID NO: 14033 - protein, 9 aa, Borrelia burgdorferi
LMQGDDPNN

SEQ ID NO: 14034 - protein, 9 aa, Borrelia burgdorferi
MQGDDPNNS

SEQ ID NO: 14035 - protein, 9 aa, Borrelia burgdorferi
QGDDPNNSL

SEQ ID NO: 14036 - protein, 9 aa, Borrelia burgdorferi
GDDPNNSLF

SEQ ID NO: 14037 - protein, 9 aa, Borrelia burgdorferi
DDPNNSLFN

SEQ ID NO: 14038 - protein, 9 aa, Borrelia burgdorferi
DPNNSLFNP

SEQ ID NO: 14039 - protein, 9 aa, Borrelia burgdorferi
PNNSLFNPP

SEQ ID NO: 14040 - protein, 9 aa, Borrelia burgdorferi
NNSLFNPPP

SEQ ID NO: 14041 - protein, 9 aa, Borrelia burgdorferi
NSLFNPPPV

SEQ ID NO: 14042 - protein, 9 aa, Borrelia burgdorferi
SLFNPPPVL

SEQ ID NO: 14043 - protein, 9 aa, Borrelia burgdorferi
LFNPPPVLP

SEQ ID NO: 14044 - protein, 9 aa, Borrelia burgdorferi
FNPPPVLPA

SEQ ID NO: 14045 - protein, 9 aa, Borrelia burgdorferi
NPPPVLPAS

SEQ ID NO: 14046 - protein, 9 aa, Borrelia burgdorferi
PPPVLPASS

SEQ ID NO: 14047 - protein, 9 aa, Borrelia burgdorferi
PPVLPASSH

SEQ ID NO: 14048 - protein, 9 aa, Borrelia burgdorferi
PVLPASSHD

SEQ ID NO: 14049 - protein, 9 aa, Borrelia burgdorferi
VLPASSHDN

SEQ ID NO: 14050 - protein, 9 aa, Borrelia burgdorferi
LPASSHDNT

SEQ ID NO: 14051 - protein, 9 aa, Borrelia burgdorferi
PASSHDNTP

SEQ ID NO: 14052 - protein, 9 aa, Borrelia burgdorferi
ASSHDNTPV

SEQ ID NO: 14053 - protein, 9 aa, Borrelia burgdorferi
SSHDNTPVL

SEQ ID NO: 14054 - protein, 9 aa, Borrelia burgdorferi
SHDNTPVLK

SEQ ID NO: 14055 - protein, 9 aa, Borrelia burgdorferi
HDNTPVLKA

SEQ ID NO: 14056 - protein, 9 aa, Borrelia burgdorferi
DNTPVLKAV

SEQ ID NO: 14057 - protein, 9 aa, Borrelia burgdorferi
NTPVLKAVQ

SEQ ID NO: 14058 - protein, 9 aa, Borrelia burgdorferi
TPVLKAVQA

SEQ ID NO: 14059 - protein, 9 aa, Borrelia burgdorferi
PVLKAVQAK

SEQ ID NO: 14060 - protein, 9 aa, Borrelia burgdorferi
VLKAVQAKD

SEQ ID NO: 14061 - protein, 9 aa, Borrelia burgdorferi
LKAVQAKDG

SEQ ID NO: 14062 - protein, 9 aa, Borrelia burgdorferi
KAVQAKDGG

SEQ ID NO: 14063 - protein, 9 aa, Borrelia burgdorferi
AVQAKDGGQ

SEQ ID NO: 14064 - protein, 9 aa, Borrelia burgdorferi
VQAKDGGQQ

SEQ ID NO: 14065 - protein, 9 aa, Borrelia burgdorferi
QAKDGGQQE

SEQ ID NO: 14066 - protein, 9 aa, Borrelia burgdorferi
AKDGGQQEG

SEQ ID NO: 14067 - protein, 9 aa, Borrelia burgdorferi
KDGGQQEGK

SEQ ID NO: 14068 - protein, 9 aa, Borrelia burgdorferi
DGGQQEGKE

SEQ ID NO: 14069 - protein, 9 aa, Borrelia burgdorferi
GGQQEGKEE

SEQ ID NO: 14070 - protein, 9 aa, Borrelia burgdorferi
GQQEGKEEK

SEQ ID NO: 14071 - protein, 9 aa, Borrelia burgdorferi
QQEGKEEKE

SEQ ID NO: 14072 - protein, 9 aa, Borrelia burgdorferi
QEGKEEKEK

SEQ ID NO: 14073 - protein, 9 aa, Borrelia burgdorferi
EGKEEKEKE

SEQ ID NO: 14074 - protein, 9 aa, Borrelia burgdorferi
GKEEKEKEI

SEQ ID NO: 14075 - protein, 9 aa, Borrelia burgdorferi
KEEKEKEIQ

SEQ ID NO: 14076 - protein, 9 aa, Borrelia burgdorferi
EEKEKEIQE

SEQ ID NO: 14077 - protein, 9 aa, Borrelia burgdorferi
EKEKEIQEL

SEQ ID NO: 14078 - protein, 9 aa, Borrelia burgdorferi
KEKEIQELK

SEQ ID NO: 14079 - protein, 9 aa, Borrelia burgdorferi
EKEIQELKD

SEQ ID NO: 14080 - protein, 9 aa, Borrelia burgdorferi
KEIQELKDK

SEQ ID NO: 14081 - protein, 9 aa, Borrelia burgdorferi
EIQELKDKI

SEQ ID NO: 14082 - protein, 9 aa, Borrelia burgdorferi
IQELKDKID

SEQ ID NO: 14083 - protein, 9 aa, Borrelia burgdorferi
QELKDKIDK

SEQ ID NO: 14084 - protein, 9 aa, Borrelia burgdorferi
ELKDKIDKR

SEQ ID NO: 14085 - protein, 9 aa, Borrelia burgdorferi
LKDKIDKRK

SEQ ID NO: 14086 - protein, 9 aa, Borrelia burgdorferi
KDKIDKRKK

SEQ ID NO: 14087 - protein, 9 aa, Borrelia burgdorferi
DKIDKRKKE

SEQ ID NO: 14088 - protein, 9 aa, Borrelia burgdorferi
KIDKRKKEL

SEQ ID NO: 14089 - protein, 9 aa, Borrelia burgdorferi
IDKRKKELE

SEQ ID NO: 14090 - protein, 9 aa, Borrelia burgdorferi
DKRKKELEE

SEQ ID NO: 14091 - protein, 9 aa, Borrelia burgdorferi
KRKKELEEA

SEQ ID NO: 14092 - protein, 9 aa, Borrelia burgdorferi
RKKELEEAR

SEQ ID NO: 14093 - protein, 9 aa, Borrelia burgdorferi
KKELEEARK

SEQ ID NO: 14094 - protein, 9 aa, Borrelia burgdorferi
KELEEARKK

SEQ ID NO: 14095 - protein, 9 aa, Borrelia burgdorferi
ELEEARKKF

SEQ ID NO: 14096 - protein, 9 aa, Borrelia burgdorferi
LEEARKKFQ

SEQ ID NO: 14097 - protein, 9 aa, Borrelia burgdorferi
EEARKKFQE

SEQ ID NO: 14098 - protein, 9 aa, Borrelia burgdorferi
EARKKFQEF

SEQ ID NO: 14099 - protein, 9 aa, Borrelia burgdorferi
ARKKFQEFK

SEQ ID NO: 14100 - protein, 9 aa, Borrelia burgdorferi
RKKFQEFKE

SEQ ID NO: 14101 - protein, 9 aa, Borrelia burgdorferi
KKFQEFKEQ

SEQ ID NO: 14102 - protein, 9 aa, Borrelia burgdorferi
KFQEFKEQV

SEQ ID NO: 14103 - protein, 9 aa, Borrelia burgdorferi
FQEFKEQVE

SEQ ID NO: 14104 - protein, 9 aa, Borrelia burgdorferi
QEFKEQVES

SEQ ID NO: 14105 - protein, 9 aa, Borrelia burgdorferi
EFKEQVESA

SEQ ID NO: 14106 - protein, 9 aa, Borrelia burgdorferi
FKEQVESAT

SEQ ID NO: 14107 - protein, 9 aa, Borrelia burgdorferi
KEQVESATG

SEQ ID NO: 14108 - protein, 9 aa, Borrelia burgdorferi
EQVESATGE

SEQ ID NO: 14109 - protein, 9 aa, Borrelia burgdorferi
QVESATGES

SEQ ID NO: 14110 - protein, 9 aa, Borrelia burgdorferi
VESATGEST

SEQ ID NO: 14111 - protein, 9 aa, Borrelia burgdorferi
ESATGESTE

SEQ ID NO: 14112 - protein, 9 aa, Borrelia burgdorferi
SATGESTEK

SEQ ID NO: 14113 - protein, 9 aa, Borrelia burgdorferi
ATGESTEKV

SEQ ID NO: 14114 - protein, 9 aa, Borrelia burgdorferi
TGESTEKVK

SEQ ID NO: 14115 - protein, 9 aa, Borrelia burgdorferi
GESTEKVKK

SEQ ID NO: 14116 - protein, 9 aa, Borrelia burgdorferi
ESTEKVKKQ

SEQ ID NO: 14117 - protein, 9 aa, Borrelia burgdorferi
STEKVKKQG

SEQ ID NO: 14118 - protein, 9 aa, Borrelia burgdorferi
TEKVKKQGN

SEQ ID NO: 14119 - protein, 9 aa, Borrelia burgdorferi
EKVKKQGNI

SEQ ID NO: 14120 - protein, 9 aa, Borrelia burgdorferi
KVKKQGNIG

SEQ ID NO: 14121 - protein, 9 aa, Borrelia burgdorferi
VKKQGNIGQ

SEQ ID NO: 14122 - protein, 9 aa, Borrelia burgdorferi
KKQGNIGQK

SEQ ID NO: 14123 - protein, 9 aa, Borrelia burgdorferi
KQGNIGQKA

SEQ ID NO: 14124 - protein, 9 aa, Borrelia burgdorferi
QGNIGQKAL

SEQ ID NO: 14125 - protein, 9 aa, Borrelia burgdorferi
GNIGQKALK

SEQ ID NO: 14126 - protein, 9 aa, Borrelia burgdorferi
NIGQKALKY

SEQ ID NO: 14127 - protein, 9 aa, Borrelia burgdorferi
IGQKALKYA

SEQ ID NO: 14128 - protein, 9 aa, Borrelia burgdorferi
GQKALKYAK

SEQ ID NO: 14129 - protein, 9 aa, Borrelia burgdorferi
QKALKYAKE

SEQ ID NO: 14130 - protein, 9 aa, Borrelia burgdorferi
KALKYAKEL

SEQ ID NO: 14131 - protein, 9 aa, Borrelia burgdorferi
ALKYAKELG

SEQ ID NO: 14132 - protein, 9 aa, Borrelia burgdorferi
LKYAKELGV

SEQ ID NO: 14133 - protein, 9 aa, Borrelia burgdorferi
KYAKELGVN

SEQ ID NO: 14134 - protein, 9 aa, Borrelia burgdorferi
YAKELGVNG

SEQ ID NO: 14135 - protein, 9 aa, Borrelia burgdorferi
AKELGVNGS

SEQ ID NO: 14136 - protein, 9 aa, Borrelia burgdorferi
KELGVNGSY

SEQ ID NO: 14137 - protein, 9 aa, Borrelia burgdorferi
ELGVNGSYS

SEQ ID NO: 14138 - protein, 9 aa, Borrelia burgdorferi
LGVNGSYSV

SEQ ID NO: 14139 - protein, 9 aa, Borrelia burgdorferi
GVNGSYSVN

SEQ ID NO: 14140 - protein, 9 aa, Borrelia burgdorferi
VNGSYSVND

SEQ ID NO: 14141 - protein, 9 aa, Borrelia burgdorferi
NGSYSVNDG

SEQ ID NO: 14142 - protein, 9 aa, Borrelia burgdorferi
GSYSVNDGT

SEQ ID NO: 14143 - protein, 9 aa, Borrelia burgdorferi
SYSVNDGTN

SEQ ID NO: 14144 - protein, 9 aa, Borrelia burgdorferi
YSVNDGTNT

SEQ ID NO: 14145 - protein, 9 aa, Borrelia burgdorferi
SVNDGTNTN

SEQ ID NO: 14146 - protein, 9 aa, Borrelia burgdorferi
VNDGTNTND

SEQ ID NO: 14147 - protein, 9 aa, Borrelia burgdorferi
NDGTNTNDF

SEQ ID NO: 14148 - protein, 9 aa, Borrelia burgdorferi
DGTNTNDFV

SEQ ID NO: 14149 - protein, 9 aa, Borrelia burgdorferi
GTNTNDFVK

SEQ ID NO: 14150 - protein, 9 aa, Borrelia burgdorferi
TNTNDFVKK

SEQ ID NO: 14151 - protein, 9 aa, Borrelia burgdorferi
NTNDFVKKV

SEQ ID NO: 14152 - protein, 9 aa, Borrelia burgdorferi
TNDFVKKVI

SEQ ID NO: 14153 - protein, 9 aa, Borrelia burgdorferi
NDFVKKVID

SEQ ID NO: 14154 - protein, 9 aa, Borrelia burgdorferi
DFVKKVIDD

SEQ ID NO: 14155 - protein, 9 aa, Borrelia burgdorferi
FVKKVIDDA

SEQ ID NO: 14156 - protein, 9 aa, Borrelia burgdorferi
VKKVIDDAL

SEQ ID NO: 14157 - protein, 9 aa, Borrelia burgdorferi
KKVIDDALK

SEQ ID NO: 14158 - protein, 9 aa, Borrelia burgdorferi
KVIDDALKN

SEQ ID NO: 14159 - protein, 9 aa, Borrelia burgdorferi
VIDDALKNI

SEQ ID NO: 14160 - protein, 9 aa, Borrelia burgdorferi
IDDALKNIE

SEQ ID NO: 14161 - protein, 9 aa, Borrelia burgdorferi
DDALKNIEE

SEQ ID NO: 14162 - protein, 9 aa, Borrelia burgdorferi
DALKNIEEE

SEQ ID NO: 14163 - protein, 9 aa, Borrelia burgdorferi
ALKNIEEEL

SEQ ID NO: 14164 - protein, 9 aa, Borrelia burgdorferi
LKNIEEELE

SEQ ID NO: 14165 - protein, 9 aa, Borrelia burgdorferi
KNIEEELEK

SEQ ID NO: 14166 - protein, 9 aa, Borrelia burgdorferi
NIEEELEKL

SEQ ID NO: 14167 - protein, 9 aa, Borrelia burgdorferi
IEEELEKLA

SEQ ID NO: 14168 - protein, 9 aa, Borrelia burgdorferi
EEELEKLAE

SEQ ID NO: 14169 - protein, 9 aa, Borrelia burgdorferi
EELEKLAEP

SEQ ID NO: 14170 - protein, 9 aa, Borrelia burgdorferi
ELEKLAEPQ

SEQ ID NO: 14171 - protein, 9 aa, Borrelia burgdorferi
LEKLAEPQN

SEQ ID NO: 14172 - protein, 9 aa, Borrelia burgdorferi
EKLAEPQNI

SEQ ID NO: 14173 - protein, 9 aa, Borrelia burgdorferi
KLAEPQNIE

SEQ ID NO: 14174 - protein, 9 aa, Borrelia burgdorferi
LAEPQNIED

SEQ ID NO: 14175 - protein, 9 aa, Borrelia burgdorferi
AEPQNIEDK

SEQ ID NO: 14176 - protein, 9 aa, Borrelia burgdorferi
EPQNIEDKK

SEQ ID NO: 14177 - protein, 10 aa, Borrelia burgdorferi
MNKKMKNLII

SEQ ID NO: 14178 - protein, 10 aa, Borrelia burgdorferi
NKKMKNLIIC

SEQ ID NO: 14179 - protein, 10 aa, Borrelia burgdorferi
KKMKNLIICA

SEQ ID NO: 14180 - protein, 10 aa, Borrelia burgdorferi
KMKNLIICAV

SEQ ID NO: 14181 - protein, 10 aa, Borrelia burgdorferi
MKNLIICAVF

SEQ ID NO: 14182 - protein, 10 aa, Borrelia burgdorferi
KNLIICAVFV

SEQ ID NO: 14183 - protein, 10 aa, Borrelia burgdorferi
NLIICAVFVL

SEQ ID NO: 14184 - protein, 10 aa, Borrelia burgdorferi
LIICAVFVLI

SEQ ID NO: 14185 - protein, 10 aa, Borrelia burgdorferi
IICAVFVLII

SEQ ID NO: 14186 - protein, 10 aa, Borrelia burgdorferi
ICAVFVLIIS

SEQ ID NO: 14187 - protein, 10 aa, Borrelia burgdorferi
CAVFVLIISC

SEQ ID NO: 14188 - protein, 10 aa, Borrelia burgdorferi
AVFVLIISCK

SEQ ID NO: 14189 - protein, 10 aa, Borrelia burgdorferi
VFVLIISCKI

SEQ ID NO: 14190 - protein, 10 aa, Borrelia burgdorferi
FVLIISCKID

SEQ ID NO: 14191 - protein, 10 aa, Borrelia burgdorferi
VLIISCKIDA

SEQ ID NO: 14192 - protein, 10 aa, Borrelia burgdorferi
LIISCKIDAS

SEQ ID NO: 14193 - protein, 10 aa, Borrelia burgdorferi
IISCKIDASS

SEQ ID NO: 14194 - protein, 10 aa, Borrelia burgdorferi
ISCKIDASSE

SEQ ID NO: 14195 - protein, 10 aa, Borrelia burgdorferi
SCKIDASSED

SEQ ID NO: 14196 - protein, 10 aa, Borrelia burgdorferi
CKIDASSEDL

SEQ ID NO: 14197 - protein, 10 aa, Borrelia burgdorferi
KIDASSEDLK

SEQ ID NO: 14198 - protein, 10 aa, Borrelia burgdorferi
IDASSEDLKQ

SEQ ID NO: 14199 - protein, 10 aa, Borrelia burgdorferi
DASSEDLKQN

SEQ ID NO: 14200 - protein, 10 aa, Borrelia burgdorferi
ASSEDLKQNV

SEQ ID NO: 14201 - protein, 10 aa, Borrelia burgdorferi
SSEDLKQNVK

SEQ ID NO: 14202 - protein, 10 aa, Borrelia burgdorferi
SEDLKQNVKE

SEQ ID NO: 14203 - protein, 10 aa, Borrelia burgdorferi
EDLKQNVKEK

SEQ ID NO: 14204 - protein, 10 aa, Borrelia burgdorferi
DLKQNVKEKV

SEQ ID NO: 14205 - protein, 10 aa, Borrelia burgdorferi
LKQNVKEKVE

SEQ ID NO: 14206 - protein, 10 aa, Borrelia burgdorferi
KQNVKEKVEG

SEQ ID NO: 14207 - protein, 10 aa, Borrelia burgdorferi
QNVKEKVEGF

SEQ ID NO: 14208 - protein, 10 aa, Borrelia burgdorferi
NVKEKVEGFL

SEQ ID NO: 14209 - protein, 10 aa, Borrelia burgdorferi
VKEKVEGFLD

SEQ ID NO: 14210 - protein, 10 aa, Borrelia burgdorferi
KEKVEGFLDK

SEQ ID NO: 14211 - protein, 10 aa, Borrelia burgdorferi
EKVEGFLDKE

SEQ ID NO: 14212 - protein, 10 aa, Borrelia burgdorferi
KVEGFLDKEL

SEQ ID NO: 14213 - protein, 10 aa, Borrelia burgdorferi
VEGFLDKELM

SEQ ID NO: 14214 - protein, 10 aa, Borrelia burgdorferi
EGFLDKELMQ

SEQ ID NO: 14215 - protein, 10 aa, Borrelia burgdorferi
GFLDKELMQG

SEQ ID NO: 14216 - protein, 10 aa, Borrelia burgdorferi
FLDKELMQGD

SEQ ID NO: 14217 - protein, 10 aa, Borrelia burgdorferi
LDKELMQGDD

SEQ ID NO: 14218 - protein, 10 aa, Borrelia burgdorferi
DKELMQGDDP

SEQ ID NO: 14219 - protein, 10 aa, Borrelia burgdorferi
KELMQGDDPN

SEQ ID NO: 14220 - protein, 10 aa, Borrelia burgdorferi
ELMQGDDPNN

SEQ ID NO: 14221 - protein, 10 aa, Borrelia burgdorferi
LMQGDDPNNS

SEQ ID NO: 14222 - protein, 10 aa, Borrelia burgdorferi
MQGDDPNNSL

SEQ ID NO: 14223 - protein, 10 aa, Borrelia burgdorferi
QGDDPNNSLF

SEQ ID NO: 14224 - protein, 10 aa, Borrelia burgdorferi
GDDPNNSLFN

SEQ ID NO: 14225 - protein, 10 aa, Borrelia burgdorferi
DDPNNSLFNP

SEQ ID NO: 14226 - protein, 10 aa, Borrelia burgdorferi
DPNNSLFNPP

SEQ ID NO: 14227 - protein, 10 aa, Borrelia burgdorferi
PNNSLFNPPP

SEQ ID NO: 14228 - protein, 10 aa, Borrelia burgdorferi
NNSLFNPPPV

SEQ ID NO: 14229 - protein, 10 aa, Borrelia burgdorferi
NSLFNPPPVL

SEQ ID NO: 14230 - protein, 10 aa, Borrelia burgdorferi
SLFNPPPVLP

SEQ ID NO: 14231 - protein, 10 aa, Borrelia burgdorferi
LFNPPPVLPA

SEQ ID NO: 14232 - protein, 10 aa, Borrelia burgdorferi
FNPPPVLPAS

SEQ ID NO: 14233 - protein, 10 aa, Borrelia burgdorferi
NPPPVLPASS

SEQ ID NO: 14234 - protein, 10 aa, Borrelia burgdorferi
PPPVLPASSH

SEQ ID NO: 14235 - protein, 10 aa, Borrelia burgdorferi
PPVLPASSHD

SEQ ID NO: 14236 - protein, 10 aa, Borrelia burgdorferi
PVLPASSHDN

SEQ ID NO: 14237 - protein, 10 aa, Borrelia burgdorferi
VLPASSHDNT

SEQ ID NO: 14238 - protein, 10 aa, Borrelia burgdorferi
LPASSHDNTP

SEQ ID NO: 14239 - protein, 10 aa, Borrelia burgdorferi
PASSHDNTPV

SEQ ID NO: 14240 - protein, 10 aa, Borrelia burgdorferi
ASSHDNTPVL

SEQ ID NO: 14241 - protein, 10 aa, Borrelia burgdorferi
SSHDNTPVLK

SEQ ID NO: 14242 - protein, 10 aa, Borrelia burgdorferi
SHDNTPVLKA

SEQ ID NO: 14243 - protein, 10 aa, Borrelia burgdorferi
HDNTPVLKAV

SEQ ID NO: 14244 - protein, 10 aa, Borrelia burgdorferi
DNTPVLKAVQ

SEQ ID NO: 14245 - protein, 10 aa, Borrelia burgdorferi
NTPVLKAVQA

SEQ ID NO: 14246 - protein, 10 aa, Borrelia burgdorferi
TPVLKAVQAK

SEQ ID NO: 14247 - protein, 10 aa, Borrelia burgdorferi
PVLKAVQAKD

SEQ ID NO: 14248 - protein, 10 aa, Borrelia burgdorferi
VLKAVQAKDG

SEQ ID NO: 14249 - protein, 10 aa, Borrelia burgdorferi
LKAVQAKDGG

SEQ ID NO: 14250 - protein, 10 aa, Borrelia burgdorferi
KAVQAKDGGQ

SEQ ID NO: 14251 - protein, 10 aa, Borrelia burgdorferi
AVQAKDGGQQ

SEQ ID NO: 14252 - protein, 10 aa, Borrelia burgdorferi
VQAKDGGQQE

SEQ ID NO: 14253 - protein, 10 aa, Borrelia burgdorferi
QAKDGGQQEG

SEQ ID NO: 14254 - protein, 10 aa, Borrelia burgdorferi
AKDGGQQEGK

SEQ ID NO: 14255 - protein, 10 aa, Borrelia burgdorferi
KDGGQQEGKE

SEQ ID NO: 14256 - protein, 10 aa, Borrelia burgdorferi
DGGQQEGKEE

SEQ ID NO: 14257 - protein, 10 aa, Borrelia burgdorferi
GGQQEGKEEK

SEQ ID NO: 14258 - protein, 10 aa, Borrelia burgdorferi
GQQEGKEEKE

SEQ ID NO: 14259 - protein, 10 aa, Borrelia burgdorferi
QQEGKEEKEK

SEQ ID NO: 14260 - protein, 10 aa, Borrelia burgdorferi
QEGKEEKEKE

SEQ ID NO: 14261 - protein, 10 aa, Borrelia burgdorferi
EGKEEKEKEI

SEQ ID NO: 14262 - protein, 10 aa, Borrelia burgdorferi
GKEEKEKEIQ

SEQ ID NO: 14263 - protein, 10 aa, Borrelia burgdorferi
KEEKEKEIQE

SEQ ID NO: 14264 - protein, 10 aa, Borrelia burgdorferi
EEKEKEIQEL

SEQ ID NO: 14265 - protein, 10 aa, Borrelia burgdorferi
EKEKEIQELK

SEQ ID NO: 14266 - protein, 10 aa, Borrelia burgdorferi
KEKEIQELKD

SEQ ID NO: 14267 - protein, 10 aa, Borrelia burgdorferi
EKEIQELKDK

SEQ ID NO: 14268 - protein, 10 aa, Borrelia burgdorferi
KEIQELKDKI

SEQ ID NO: 14269 - protein, 10 aa, Borrelia burgdorferi
EIQELKDKID

SEQ ID NO: 14270 - protein, 10 aa, Borrelia burgdorferi
IQELKDKIDK

SEQ ID NO: 14271 - protein, 10 aa, Borrelia burgdorferi
QELKDKIDKR

SEQ ID NO: 14272 - protein, 10 aa, Borrelia burgdorferi
ELKDKIDKRK

SEQ ID NO: 14273 - protein, 10 aa, Borrelia burgdorferi
LKDKIDKRKK

SEQ ID NO: 14274 - protein, 10 aa, Borrelia burgdorferi
KDKIDKRKKE

SEQ ID NO: 14275 - protein, 10 aa, Borrelia burgdorferi
DKIDKRKKEL

SEQ ID NO: 14276 - protein, 10 aa, Borrelia burgdorferi
KIDKRKKELE

SEQ ID NO: 14277 - protein, 10 aa, Borrelia burgdorferi
IDKRKKELEE

SEQ ID NO: 14278 - protein, 10 aa, Borrelia burgdorferi
DKRKKELEEA

SEQ ID NO: 14279 - protein, 10 aa, Borrelia burgdorferi
KRKKELEEAR

SEQ ID NO: 14280 - protein, 10 aa, Borrelia burgdorferi
RKKELEEARK

SEQ ID NO: 14281 - protein, 10 aa, Borrelia burgdorferi
KKELEEARKK

SEQ ID NO: 14282 - protein, 10 aa, Borrelia burgdorferi
KELEEARKKF

SEQ ID NO: 14283 - protein, 10 aa, Borrelia burgdorferi
ELEEARKKFQ

SEQ ID NO: 14284 - protein, 10 aa, Borrelia burgdorferi
LEEARKKFQE

SEQ ID NO: 14285 - protein, 10 aa, Borrelia burgdorferi
EEARKKFQEF

SEQ ID NO: 14286 - protein, 10 aa, Borrelia burgdorferi
EARKKFQEFK

SEQ ID NO: 14287 - protein, 10 aa, Borrelia burgdorferi
ARKKFQEFKE

SEQ ID NO: 14288 - protein, 10 aa, Borrelia burgdorferi
RKKFQEFKEQ

SEQ ID NO: 14289 - protein, 10 aa, Borrelia burgdorferi
KKFQEFKEQV

SEQ ID NO: 14290 - protein, 10 aa, Borrelia burgdorferi
KFQEFKEQVE

SEQ ID NO: 14291 - protein, 10 aa, Borrelia burgdorferi
FQEFKEQVES

SEQ ID NO: 14292 - protein, 10 aa, Borrelia burgdorferi
QEFKEQVESA

SEQ ID NO: 14293 - protein, 10 aa, Borrelia burgdorferi
EFKEQVESAT

SEQ ID NO: 14294 - protein, 10 aa, Borrelia burgdorferi
FKEQVESATG

SEQ ID NO: 14295 - protein, 10 aa, Borrelia burgdorferi
KEQVESATGE

SEQ ID NO: 14296 - protein, 10 aa, Borrelia burgdorferi
EQVESATGES

SEQ ID NO: 14297 - protein, 10 aa, Borrelia burgdorferi
QVESATGEST

SEQ ID NO: 14298 - protein, 10 aa, Borrelia burgdorferi
VESATGESTE

SEQ ID NO: 14299 - protein, 10 aa, Borrelia burgdorferi
ESATGESTEK

SEQ ID NO: 14300 - protein, 10 aa, Borrelia burgdorferi
SATGESTEKV

SEQ ID NO: 14301 - protein, 10 aa, Borrelia burgdorferi
ATGESTEKVK

SEQ ID NO: 14302 - protein, 10 aa, Borrelia burgdorferi
TGESTEKVKK

SEQ ID NO: 14303 - protein, 10 aa, Borrelia burgdorferi
GESTEKVKKQ

SEQ ID NO: 14304 - protein, 10 aa, Borrelia burgdorferi
ESTEKVKKQG

SEQ ID NO: 14305 - protein, 10 aa, Borrelia burgdorferi
STEKVKKQGN

SEQ ID NO: 14306 - protein, 10 aa, Borrelia burgdorferi
TEKVKKQGNI

SEQ ID NO: 14307 - protein, 10 aa, Borrelia burgdorferi
EKVKKQGNIG

SEQ ID NO: 14308 - protein, 10 aa, Borrelia burgdorferi
KVKKQGNIGQ

SEQ ID NO: 14309 - protein, 10 aa, Borrelia burgdorferi
VKKQGNIGQK

SEQ ID NO: 14310 - protein, 10 aa, Borrelia burgdorferi
KKQGNIGQKA

SEQ ID NO: 14311 - protein, 10 aa, Borrelia burgdorferi
KQGNIGQKAL

SEQ ID NO: 14312 - protein, 10 aa, Borrelia burgdorferi
QGNIGQKALK

SEQ ID NO: 14313 - protein, 10 aa, Borrelia burgdorferi
GNIGQKALKY

SEQ ID NO: 14314 - protein, 10 aa, Borrelia burgdorferi
NIGQKALKYA

SEQ ID NO: 14315 - protein, 10 aa, Borrelia burgdorferi
IGQKALKYAK

SEQ ID NO: 14316 - protein, 10 aa, Borrelia burgdorferi
GQKALKYAKE

SEQ ID NO: 14317 - protein, 10 aa, Borrelia burgdorferi
QKALKYAKEL

SEQ ID NO: 14318 - protein, 10 aa, Borrelia burgdorferi
KALKYAKELG

SEQ ID NO: 14319 - protein, 10 aa, Borrelia burgdorferi
ALKYAKELGV

SEQ ID NO: 14320 - protein, 10 aa, Borrelia burgdorferi
LKYAKELGVN

SEQ ID NO: 14321 - protein, 10 aa, Borrelia burgdorferi
KYAKELGVNG

SEQ ID NO: 14322 - protein, 10 aa, Borrelia burgdorferi
YAKELGVNGS

SEQ ID NO: 14323 - protein, 10 aa, Borrelia burgdorferi
AKELGVNGSY

SEQ ID NO: 14324 - protein, 10 aa, Borrelia burgdorferi
KELGVNGSYS

SEQ ID NO: 14325 - protein, 10 aa, Borrelia burgdorferi
ELGVNGSYSV

SEQ ID NO: 14326 - protein, 10 aa, Borrelia burgdorferi
LGVNGSYSVN

SEQ ID NO: 14327 - protein, 10 aa, Borrelia burgdorferi
GVNGSYSVND

SEQ ID NO: 14328 - protein, 10 aa, Borrelia burgdorferi
VNGSYSVNDG

SEQ ID NO: 14329 - protein, 10 aa, Borrelia burgdorferi
NGSYSVNDGT

SEQ ID NO: 14330 - protein, 10 aa, Borrelia burgdorferi
GSYSVNDGTN

SEQ ID NO: 14331 - protein, 10 aa, Borrelia burgdorferi
SYSVNDGTNT

SEQ ID NO: 14332 - protein, 10 aa, Borrelia burgdorferi
YSVNDGTNTN

SEQ ID NO: 14333 - protein, 10 aa, Borrelia burgdorferi
SVNDGTNTND

SEQ ID NO: 14334 - protein, 10 aa, Borrelia burgdorferi
VNDGTNTNDF

SEQ ID NO: 14335 - protein, 10 aa, Borrelia burgdorferi
NDGTNTNDFV

SEQ ID NO: 14336 - protein, 10 aa, Borrelia burgdorferi
DGTNTNDFVK

SEQ ID NO: 14337 - protein, 10 aa, Borrelia burgdorferi
GTNTNDFVKK

SEQ ID NO: 14338 - protein, 10 aa, Borrelia burgdorferi
TNTNDFVKKV

SEQ ID NO: 14339 - protein, 10 aa, Borrelia burgdorferi
NTNDFVKKVI

SEQ ID NO: 14340 - protein, 10 aa, Borrelia burgdorferi
TNDFVKKVID

SEQ ID NO: 14341 - protein, 10 aa, Borrelia burgdorferi
NDFVKKVIDD

SEQ ID NO: 14342 - protein, 10 aa, Borrelia burgdorferi
DFVKKVIDDA

SEQ ID NO: 14343 - protein, 10 aa, Borrelia burgdorferi
FVKKVIDDAL

SEQ ID NO: 14344 - protein, 10 aa, Borrelia burgdorferi
VKKVIDDALK

SEQ ID NO: 14345 - protein, 10 aa, Borrelia burgdorferi
KKVIDDALKN

SEQ ID NO: 14346 - protein, 10 aa, Borrelia burgdorferi
KVIDDALKNI

SEQ ID NO: 14347 - protein, 10 aa, Borrelia burgdorferi
VIDDALKNIE

SEQ ID NO: 14348 - protein, 10 aa, Borrelia burgdorferi
IDDALKNIEE

SEQ ID NO: 14349 - protein, 10 aa, Borrelia burgdorferi
DDALKNIEEE

SEQ ID NO: 14350 - protein, 10 aa, Borrelia burgdorferi
DALKNIEEEL

SEQ ID NO: 14351 - protein, 10 aa, Borrelia burgdorferi
ALKNIEEELE

SEQ ID NO: 14352 - protein, 10 aa, Borrelia burgdorferi
LKNIEEELEK

SEQ ID NO: 14353 - protein, 10 aa, Borrelia burgdorferi
KNIEEELEKL

SEQ ID NO: 14354 - protein, 10 aa, Borrelia burgdorferi
NIEEELEKLA

SEQ ID NO: 14355 - protein, 10 aa, Borrelia burgdorferi
IEEELEKLAE

SEQ ID NO: 14356 - protein, 10 aa, Borrelia burgdorferi
EEELEKLAEP

SEQ ID NO: 14357 - protein, 10 aa, Borrelia burgdorferi
EELEKLAEPQ

SEQ ID NO: 14358 - protein, 10 aa, Borrelia burgdorferi
ELEKLAEPQN

SEQ ID NO: 14359 - protein, 10 aa, Borrelia burgdorferi
LEKLAEPQNI

SEQ ID NO: 14360 - protein, 10 aa, Borrelia burgdorferi
EKLAEPQNIE

SEQ ID NO: 14361 - protein, 10 aa, Borrelia burgdorferi
KLAEPQNIED

SEQ ID NO: 14362 - protein, 10 aa, Borrelia burgdorferi
LAEPQNIEDK

SEQ ID NO: 14363 - protein, 10 aa, Borrelia burgdorferi
AEPQNIEDKK

SEQ ID NO: 14364 - protein, 11 aa, Borrelia burgdorferi
MNKKMKNLIIC

SEQ ID NO: 14365 - protein, 11 aa, Borrelia burgdorferi
NKKMKNLIICA

SEQ ID NO: 14366 - protein, 11 aa, Borrelia burgdorferi
KKMKNLIICAV

SEQ ID NO: 14367 - protein, 11 aa, Borrelia burgdorferi
KMKNLIICAVF

SEQ ID NO: 14368 - protein, 11 aa, Borrelia burgdorferi
MKNLIICAVFV

SEQ ID NO: 14369 - protein, 11 aa, Borrelia burgdorferi
KNLIICAVFVL

SEQ ID NO: 14370 - protein, 11 aa, Borrelia burgdorferi
NLIICAVFVLI

SEQ ID NO: 14371 - protein, 11 aa, Borrelia burgdorferi
LIICAVFVLII

SEQ ID NO: 14372 - protein, 11 aa, Borrelia burgdorferi
IICAVFVLIIS

SEQ ID NO: 14373 - protein, 11 aa, Borrelia burgdorferi
ICAVFVLIISC

SEQ ID NO: 14374 - protein, 11 aa, Borrelia burgdorferi
CAVFVLIISCK

SEQ ID NO: 14375 - protein, 11 aa, Borrelia burgdorferi
AVFVLIISCKI

SEQ ID NO: 14376 - protein, 11 aa, Borrelia burgdorferi
VFVLIISCKID

SEQ ID NO: 14377 - protein, 11 aa, Borrelia burgdorferi
FVLIISCKIDA

SEQ ID NO: 14378 - protein, 11 aa, Borrelia burgdorferi
VLIISCKIDAS

SEQ ID NO: 14379 - protein, 11 aa, Borrelia burgdorferi
LIISCKIDASS

SEQ ID NO: 14380 - protein, 11 aa, Borrelia burgdorferi
IISCKIDASSE

SEQ ID NO: 14381 - protein, 11 aa, Borrelia burgdorferi
ISCKIDASSED

SEQ ID NO: 14382 - protein, 11 aa, Borrelia burgdorferi
SCKIDASSEDL

SEQ ID NO: 14383 - protein, 11 aa, Borrelia burgdorferi
CKIDASSEDLK

SEQ ID NO: 14384 - protein, 11 aa, Borrelia burgdorferi
KIDASSEDLKQ

SEQ ID NO: 14385 - protein, 11 aa, Borrelia burgdorferi
IDASSEDLKQN

SEQ ID NO: 14386 - protein, 11 aa, Borrelia burgdorferi
DASSEDLKQNV

SEQ ID NO: 14387 - protein, 11 aa, Borrelia burgdorferi
ASSEDLKQNVK

SEQ ID NO: 14388 - protein, 11 aa, Borrelia burgdorferi
SSEDLKQNVKE

SEQ ID NO: 14389 - protein, 11 aa, Borrelia burgdorferi
SEDLKQNVKEK

SEQ ID NO: 14390 - protein, 11 aa, Borrelia burgdorferi
EDLKQNVKEKV

SEQ ID NO: 14391 - protein, 11 aa, Borrelia burgdorferi
DLKQNVKEKVE

SEQ ID NO: 14392 - protein, 11 aa, Borrelia burgdorferi
LKQNVKEKVEG

SEQ ID NO: 14393 - protein, 11 aa, Borrelia burgdorferi
KQNVKEKVEGF

SEQ ID NO: 14394 - protein, 11 aa, Borrelia burgdorferi
QNVKEKVEGFL

SEQ ID NO: 14395 - protein, 11 aa, Borrelia burgdorferi
NVKEKVEGFLD

SEQ ID NO: 14396 - protein, 11 aa, Borrelia burgdorferi
VKEKVEGFLDK

SEQ ID NO: 14397 - protein, 11 aa, Borrelia burgdorferi
KEKVEGFLDKE

SEQ ID NO: 14398 - protein, 11 aa, Borrelia burgdorferi
EKVEGFLDKEL

SEQ ID NO: 14399 - protein, 11 aa, Borrelia burgdorferi
KVEGFLDKELM

SEQ ID NO: 14400 - protein, 11 aa, Borrelia burgdorferi
VEGFLDKELMQ

SEQ ID NO: 14401 - protein, 11 aa, Borrelia burgdorferi
EGFLDKELMQG

SEQ ID NO: 14402 - protein, 11 aa, Borrelia burgdorferi
GFLDKELMQGD

SEQ ID NO: 14403 - protein, 11 aa, Borrelia burgdorferi
FLDKELMQGDD

SEQ ID NO: 14404 - protein, 11 aa, Borrelia burgdorferi
LDKELMQGDDP

SEQ ID NO: 14405 - protein, 11 aa, Borrelia burgdorferi
DKELMQGDDPN

SEQ ID NO: 14406 - protein, 11 aa, Borrelia burgdorferi
KELMQGDDPNN

SEQ ID NO: 14407 - protein, 11 aa, Borrelia burgdorferi
ELMQGDDPNNS

SEQ ID NO: 14408 - protein, 11 aa, Borrelia burgdorferi
LMQGDDPNNSL

SEQ ID NO: 14409 - protein, 11 aa, Borrelia burgdorferi
MQGDDPNNSLF

SEQ ID NO: 14410 - protein, 11 aa, Borrelia burgdorferi
QGDDPNNSLFN

SEQ ID NO: 14411 - protein, 11 aa, Borrelia burgdorferi
GDDPNNSLFNP

SEQ ID NO: 14412 - protein, 11 aa, Borrelia burgdorferi
DDPNNSLFNPP

SEQ ID NO: 14413 - protein, 11 aa, Borrelia burgdorferi
DPNNSLFNPPP

SEQ ID NO: 14414 - protein, 11 aa, Borrelia burgdorferi
PNNSLFNPPPV

SEQ ID NO: 14415 - protein, 11 aa, Borrelia burgdorferi
NNSLFNPPPVL

SEQ ID NO: 14416 - protein, 11 aa, Borrelia burgdorferi
NSLFNPPPVLP

SEQ ID NO: 14417 - protein, 11 aa, Borrelia burgdorferi
SLFNPPPVLPA

SEQ ID NO: 14418 - protein, 11 aa, Borrelia burgdorferi
LFNPPPVLPAS

SEQ ID NO: 14419 - protein, 11 aa, Borrelia burgdorferi
FNPPPVLPASS

SEQ ID NO: 14420 - protein, 11 aa, Borrelia burgdorferi
NPPPVLPASSH

SEQ ID NO: 14421 - protein, 11 aa, Borrelia burgdorferi
PPPVLPASSHD

SEQ ID NO: 14422 - protein, 11 aa, Borrelia burgdorferi
PPVLPASSHDN

SEQ ID NO: 14423 - protein, 11 aa, Borrelia burgdorferi
PVLPASSHDNT

SEQ ID NO: 14424 - protein, 11 aa, Borrelia burgdorferi
VLPASSHDNTP

SEQ ID NO: 14425 - protein, 11 aa, Borrelia burgdorferi
LPASSHDNTPV

SEQ ID NO: 14426 - protein, 11 aa, Borrelia burgdorferi
PASSHDNTPVL

SEQ ID NO: 14427 - protein, 11 aa, Borrelia burgdorferi
ASSHDNTPVLK

SEQ ID NO: 14428 - protein, 11 aa, Borrelia burgdorferi
SSHDNTPVLKA

SEQ ID NO: 14429 - protein, 11 aa, Borrelia burgdorferi
SHDNTPVLKAV

SEQ ID NO: 14430 - protein, 11 aa, Borrelia burgdorferi
HDNTPVLKAVQ

SEQ ID NO: 14431 - protein, 11 aa, Borrelia burgdorferi
DNTPVLKAVQA

SEQ ID NO: 14432 - protein, 11 aa, Borrelia burgdorferi
NTPVLKAVQAK

SEQ ID NO: 14433 - protein, 11 aa, Borrelia burgdorferi
TPVLKAVQAKD

SEQ ID NO: 14434 - protein, 11 aa, Borrelia burgdorferi
PVLKAVQAKDG

SEQ ID NO: 14435 - protein, 11 aa, Borrelia burgdorferi
VLKAVQAKDGG

SEQ ID NO: 14436 - protein, 11 aa, Borrelia burgdorferi
LKAVQAKDGGQ

SEQ ID NO: 14437 - protein, 11 aa, Borrelia burgdorferi
KAVQAKDGGQQ

SEQ ID NO: 14438 - protein, 11 aa, Borrelia burgdorferi
AVQAKDGGQQE

SEQ ID NO: 14439 - protein, 11 aa, Borrelia burgdorferi
VQAKDGGQQEG

SEQ ID NO: 14440 - protein, 11 aa, Borrelia burgdorferi
QAKDGGQQEGK

SEQ ID NO: 14441 - protein, 11 aa, Borrelia burgdorferi
AKDGGQQEGKE

SEQ ID NO: 14442 - protein, 11 aa, Borrelia burgdorferi
KDGGQQEGKEE

SEQ ID NO: 14443 - protein, 11 aa, Borrelia burgdorferi
DGGQQEGKEEK

SEQ ID NO: 14444 - protein, 11 aa, Borrelia burgdorferi
GGQQEGKEEKE

SEQ ID NO: 14445 - protein, 11 aa, Borrelia burgdorferi
GQQEGKEEKEK

SEQ ID NO: 14446 - protein, 11 aa, Borrelia burgdorferi
QQEGKEEKEKE

SEQ ID NO: 14447 - protein, 11 aa, Borrelia burgdorferi
QEGKEEKEKEI

SEQ ID NO: 14448 - protein, 11 aa, Borrelia burgdorferi
EGKEEKEKEIQ

SEQ ID NO: 14449 - protein, 11 aa, Borrelia burgdorferi
GKEEKEKEIQE

SEQ ID NO: 14450 - protein, 11 aa, Borrelia burgdorferi
KEEKEKEIQEL

SEQ ID NO: 14451 - protein, 11 aa, Borrelia burgdorferi
EEKEKEIQELK

SEQ ID NO: 14452 - protein, 11 aa, Borrelia burgdorferi
EKEKEIQELKD

SEQ ID NO: 14453 - protein, 11 aa, Borrelia burgdorferi
KEKEIQELKDK

SEQ ID NO: 14454 - protein, 11 aa, Borrelia burgdorferi
EKEIQELKDKI

SEQ ID NO: 14455 - protein, 11 aa, Borrelia burgdorferi
KEIQELKDKID

SEQ ID NO: 14456 - protein, 11 aa, Borrelia burgdorferi
EIQELKDKIDK

SEQ ID NO: 14457 - protein, 11 aa, Borrelia burgdorferi
IQELKDKIDKR

SEQ ID NO: 14458 - protein, 11 aa, Borrelia burgdorferi
QELKDKIDKRK

SEQ ID NO: 14459 - protein, 11 aa, Borrelia burgdorferi
ELKDKIDKRKK

SEQ ID NO: 14460 - protein, 11 aa, Borrelia burgdorferi
LKDKIDKRKKE

SEQ ID NO: 14461 - protein, 11 aa, Borrelia burgdorferi
KDKIDKRKKEL

SEQ ID NO: 14462 - protein, 11 aa, Borrelia burgdorferi
DKIDKRKKELE

SEQ ID NO: 14463 - protein, 11 aa, Borrelia burgdorferi
KIDKRKKELEE

SEQ ID NO: 14464 - protein, 11 aa, Borrelia burgdorferi
IDKRKKELEEA

SEQ ID NO: 14465 - protein, 11 aa, Borrelia burgdorferi
DKRKKELEEAR

SEQ ID NO: 14466 - protein, 11 aa, Borrelia burgdorferi
KRKKELEEARK

SEQ ID NO: 14467 - protein, 11 aa, Borrelia burgdorferi
RKKELEEARKK

SEQ ID NO: 14468 - protein, 11 aa, Borrelia burgdorferi
KKELEEARKKF

SEQ ID NO: 14469 - protein, 11 aa, Borrelia burgdorferi
KELEEARKKFQ

SEQ ID NO: 14470 - protein, 11 aa, Borrelia burgdorferi
ELEEARKKFQE

SEQ ID NO: 14471 - protein, 11 aa, Borrelia burgdorferi
LEEARKKFQEF

SEQ ID NO: 14472 - protein, 11 aa, Borrelia burgdorferi
EEARKKFQEFK

SEQ ID NO: 14473 - protein, 11 aa, Borrelia burgdorferi
EARKKFQEFKE

SEQ ID NO: 14474 - protein, 11 aa, Borrelia burgdorferi
ARKKFQEFKEQ

SEQ ID NO: 14475 - protein, 11 aa, Borrelia burgdorferi
RKKFQEFKEQV

SEQ ID NO: 14476 - protein, 11 aa, Borrelia burgdorferi
KKFQEFKEQVE

SEQ ID NO: 14477 - protein, 11 aa, Borrelia burgdorferi
KFQEFKEQVES

SEQ ID NO: 14478 - protein, 11 aa, Borrelia burgdorferi
FQEFKEQVESA

SEQ ID NO: 14479 - protein, 11 aa, Borrelia burgdorferi
QEFKEQVESAT

SEQ ID NO: 14480 - protein, 11 aa, Borrelia burgdorferi
EFKEQVESATG

SEQ ID NO: 14481 - protein, 11 aa, Borrelia burgdorferi
FKEQVESATGE

SEQ ID NO: 14482 - protein, 11 aa, Borrelia burgdorferi
KEQVESATGES

SEQ ID NO: 14483 - protein, 11 aa, Borrelia burgdorferi
EQVESATGEST

SEQ ID NO: 14484 - protein, 11 aa, Borrelia burgdorferi
QVESATGESTE

SEQ ID NO: 14485 - protein, 11 aa, Borrelia burgdorferi
VESATGESTEK

SEQ ID NO: 14486 - protein, 11 aa, Borrelia burgdorferi
ESATGESTEKV

SEQ ID NO: 14487 - protein, 11 aa, Borrelia burgdorferi
SATGESTEKVK

SEQ ID NO: 14488 - protein, 11 aa, Borrelia burgdorferi
ATGESTEKVKK

SEQ ID NO: 14489 - protein, 11 aa, Borrelia burgdorferi
TGESTEKVKKQ

SEQ ID NO: 14490 - protein, 11 aa, Borrelia burgdorferi
GESTEKVKKQG

SEQ ID NO: 14491 - protein, 11 aa, Borrelia burgdorferi
ESTEKVKKQGN

SEQ ID NO: 14492 - protein, 11 aa, Borrelia burgdorferi
STEKVKKQGNI

SEQ ID NO: 14493 - protein, 11 aa, Borrelia burgdorferi
TEKVKKQGNIG

SEQ ID NO: 14494 - protein, 11 aa, Borrelia burgdorferi
EKVKKQGNIGQ

SEQ ID NO: 14495 - protein, 11 aa, Borrelia burgdorferi
KVKKQGNIGQK

SEQ ID NO: 14496 - protein, 11 aa, Borrelia burgdorferi
VKKQGNIGQKA

SEQ ID NO: 14497 - protein, 11 aa, Borrelia burgdorferi
KKQGNIGQKAL

SEQ ID NO: 14498 - protein, 11 aa, Borrelia burgdorferi
KQGNIGQKALK

SEQ ID NO: 14499 - protein, 11 aa, Borrelia burgdorferi
QGNIGQKALKY

SEQ ID NO: 14500 - protein, 11 aa, Borrelia burgdorferi
GNIGQKALKYA

SEQ ID NO: 14501 - protein, 11 aa, Borrelia burgdorferi
NIGQKALKYAK

SEQ ID NO: 14502 - protein, 11 aa, Borrelia burgdorferi
IGQKALKYAKE

SEQ ID NO: 14503 - protein, 11 aa, Borrelia burgdorferi
GQKALKYAKEL

SEQ ID NO: 14504 - protein, 11 aa, Borrelia burgdorferi
QKALKYAKELG

SEQ ID NO: 14505 - protein, 11 aa, Borrelia burgdorferi
KALKYAKELGV

SEQ ID NO: 14506 - protein, 11 aa, Borrelia burgdorferi
ALKYAKELGVN

SEQ ID NO: 14507 - protein, 11 aa, Borrelia burgdorferi
LKYAKELGVNG

SEQ ID NO: 14508 - protein, 11 aa, Borrelia burgdorferi
KYAKELGVNGS

SEQ ID NO: 14509 - protein, 11 aa, Borrelia burgdorferi
YAKELGVNGSY

SEQ ID NO: 14510 - protein, 11 aa, Borrelia burgdorferi
AKELGVNGSYS

SEQ ID NO: 14511 - protein, 11 aa, Borrelia burgdorferi
KELGVNGSYSV

SEQ ID NO: 14512 - protein, 11 aa, Borrelia burgdorferi
ELGVNGSYSVN

SEQ ID NO: 14513 - protein, 11 aa, Borrelia burgdorferi
LGVNGSYSVND

SEQ ID NO: 14514 - protein, 11 aa, Borrelia burgdorferi
GVNGSYSVNDG

SEQ ID NO: 14515 - protein, 11 aa, Borrelia burgdorferi
VNGSYSVNDGT

SEQ ID NO: 14516 - protein, 11 aa, Borrelia burgdorferi
NGSYSVNDGTN

SEQ ID NO: 14517 - protein, 11 aa, Borrelia burgdorferi
GSYSVNDGTNT

SEQ ID NO: 14518 - protein, 11 aa, Borrelia burgdorferi
SYSVNDGTNTN

SEQ ID NO: 14519 - protein, 11 aa, Borrelia burgdorferi
YSVNDGTNTND

SEQ ID NO: 14520 - protein, 11 aa, Borrelia burgdorferi
SVNDGTNTNDF

SEQ ID NO: 14521 - protein, 11 aa, Borrelia burgdorferi
VNDGTNTNDFV

SEQ ID NO: 14522 - protein, 11 aa, Borrelia burgdorferi
NDGTNTNDFVK

SEQ ID NO: 14523 - protein, 11 aa, Borrelia burgdorferi
DGTNTNDFVKK

SEQ ID NO: 14524 - protein, 11 aa, Borrelia burgdorferi
GTNTNDFVKKV

SEQ ID NO: 14525 - protein, 11 aa, Borrelia burgdorferi
TNTNDFVKKVI

SEQ ID NO: 14526 - protein, 11 aa, Borrelia burgdorferi
NTNDFVKKVID

SEQ ID NO: 14527 - protein, 11 aa, Borrelia burgdorferi
TNDFVKKVIDD

SEQ ID NO: 14528 - protein, 11 aa, Borrelia burgdorferi
NDFVKKVIDDA

SEQ ID NO: 14529 - protein, 11 aa, Borrelia burgdorferi
DFVKKVIDDAL

SEQ ID NO: 14530 - protein, 11 aa, Borrelia burgdorferi
FVKKVIDDALK

SEQ ID NO: 14531 - protein, 11 aa, Borrelia burgdorferi
VKKVIDDALKN

SEQ ID NO: 14532 - protein, 11 aa, Borrelia burgdorferi
KKVIDDALKNI

SEQ ID NO: 14533 - protein, 11 aa, Borrelia burgdorferi
KVIDDALKNIE

SEQ ID NO: 14534 - protein, 11 aa, Borrelia burgdorferi
VIDDALKNIEE

SEQ ID NO: 14535 - protein, 11 aa, Borrelia burgdorferi
IDDALKNIEEE

SEQ ID NO: 14536 - protein, 11 aa, Borrelia burgdorferi
DDALKNIEEEL

SEQ ID NO: 14537 - protein, 11 aa, Borrelia burgdorferi
DALKNIEEELE

SEQ ID NO: 14538 - protein, 11 aa, Borrelia burgdorferi
ALKNIEEELEK

SEQ ID NO: 14539 - protein, 11 aa, Borrelia burgdorferi
LKNIEEELEKL

SEQ ID NO: 14540 - protein, 11 aa, Borrelia burgdorferi
KNIEEELEKLA

SEQ ID NO: 14541 - protein, 11 aa, Borrelia burgdorferi
NIEEELEKLAE

SEQ ID NO: 14542 - protein, 11 aa, Borrelia burgdorferi
IEEELEKLAEP

SEQ ID NO: 14543 - protein, 11 aa, Borrelia burgdorferi
EEELEKLAEPQ

SEQ ID NO: 14544 - protein, 11 aa, Borrelia burgdorferi
EELEKLAEPQN

SEQ ID NO: 14545 - protein, 11 aa, Borrelia burgdorferi
ELEKLAEPQNI

SEQ ID NO: 14546 - protein, 11 aa, Borrelia burgdorferi
LEKLAEPQNIE

SEQ ID NO: 14547 - protein, 11 aa, Borrelia burgdorferi
EKLAEPQNIED

SEQ ID NO: 14548 - protein, 11 aa, Borrelia burgdorferi
KLAEPQNIEDK

SEQ ID NO: 14549 - protein, 11 aa, Borrelia burgdorferi
LAEPQNIEDKK

SEQ ID NO: 14550 - protein, 8 aa, Borrelia burgdorferi
MKRKAKSI

SEQ ID NO: 14551 - protein, 8 aa, Borrelia burgdorferi
KRKAKSIL

SEQ ID NO: 14552 - protein, 8 aa, Borrelia burgdorferi
RKAKSILF

SEQ ID NO: 14553 - protein, 8 aa, Borrelia burgdorferi
KAKSILFF

SEQ ID NO: 14554 - protein, 8 aa, Borrelia burgdorferi
AKSILFFL

SEQ ID NO: 14555 - protein, 8 aa, Borrelia burgdorferi
KSILFFLL

SEQ ID NO: 14556 - protein, 8 aa, Borrelia burgdorferi
SILFFLLS

SEQ ID NO: 14557 - protein, 8 aa, Borrelia burgdorferi
ILFFLLST

SEQ ID NO: 14558 - protein, 8 aa, Borrelia burgdorferi
LFFLLSTV

SEQ ID NO: 14559 - protein, 8 aa, Borrelia burgdorferi
FFLLSTVL

SEQ ID NO: 14560 - protein, 8 aa, Borrelia burgdorferi
FLLSTVLF

SEQ ID NO: 14561 - protein, 8 aa, Borrelia burgdorferi
LLSTVLFA

SEQ ID NO: 14562 - protein, 8 aa, Borrelia burgdorferi
LSTVLFAQ

SEQ ID NO: 14563 - protein, 8 aa, Borrelia burgdorferi
STVLFAQE

SEQ ID NO: 14564 - protein, 8 aa, Borrelia burgdorferi
TVLFAQET

SEQ ID NO: 14565 - protein, 8 aa, Borrelia burgdorferi
VLFAQETD

SEQ ID NO: 14566 - protein, 8 aa, Borrelia burgdorferi
LFAQETDG

SEQ ID NO: 14567 - protein, 8 aa, Borrelia burgdorferi
FAQETDGL

SEQ ID NO: 14568 - protein, 8 aa, Borrelia burgdorferi
AQETDGLA

SEQ ID NO: 14569 - protein, 8 aa, Borrelia burgdorferi
QETDGLAE

SEQ ID NO: 14570 - protein, 8 aa, Borrelia burgdorferi
ETDGLAEG

SEQ ID NO: 14571 - protein, 8 aa, Borrelia burgdorferi
TDGLAEGS

SEQ ID NO: 14572 - protein, 8 aa, Borrelia burgdorferi
DGLAEGSK

SEQ ID NO: 14573 - protein, 8 aa, Borrelia burgdorferi
GLAEGSKR

SEQ ID NO: 14574 - protein, 8 aa, Borrelia burgdorferi
LAEGSKRA

SEQ ID NO: 14575 - protein, 8 aa, Borrelia burgdorferi
AEGSKRAE

SEQ ID NO: 14576 - protein, 8 aa, Borrelia burgdorferi
EGSKRAEP

SEQ ID NO: 14577 - protein, 8 aa, Borrelia burgdorferi
GSKRAEPG

SEQ ID NO: 14578 - protein, 8 aa, Borrelia burgdorferi
SKRAEPGE

SEQ ID NO: 14579 - protein, 8 aa, Borrelia burgdorferi
KRAEPGEL

SEQ ID NO: 14580 - protein, 8 aa, Borrelia burgdorferi
RAEPGELV

SEQ ID NO: 14581 - protein, 8 aa, Borrelia burgdorferi
AEPGELVL

SEQ ID NO: 14582 - protein, 8 aa, Borrelia burgdorferi
EPGELVLD

SEQ ID NO: 14583 - protein, 8 aa, Borrelia burgdorferi
PGELVLDF

SEQ ID NO: 14584 - protein, 8 aa, Borrelia burgdorferi
GELVLDFA

SEQ ID NO: 14585 - protein, 8 aa, Borrelia burgdorferi
ELVLDFAE

SEQ ID NO: 14586 - protein, 8 aa, Borrelia burgdorferi
LVLDFAEL

SEQ ID NO: 14587 - protein, 8 aa, Borrelia burgdorferi
VLDFAELA

SEQ ID NO: 14588 - protein, 8 aa, Borrelia burgdorferi
LDFAELAR

SEQ ID NO: 14589 - protein, 8 aa, Borrelia burgdorferi
DFAELARD

SEQ ID NO: 14590 - protein, 8 aa, Borrelia burgdorferi
FAELARDP

SEQ ID NO: 14591 - protein, 8 aa, Borrelia burgdorferi
AELARDPS

SEQ ID NO: 14592 - protein, 8 aa, Borrelia burgdorferi
ELARDPSS

SEQ ID NO: 14593 - protein, 8 aa, Borrelia burgdorferi
LARDPSST

SEQ ID NO: 14594 - protein, 8 aa, Borrelia burgdorferi
ARDPSSTR

SEQ ID NO: 14595 - protein, 8 aa, Borrelia burgdorferi
RDPSSTRL

SEQ ID NO: 14596 - protein, 8 aa, Borrelia burgdorferi
DPSSTRLD

SEQ ID NO: 14597 - protein, 8 aa, Borrelia burgdorferi
PSSTRLDL

SEQ ID NO: 14598 - protein, 8 aa, Borrelia burgdorferi
SSTRLDLT

SEQ ID NO: 14599 - protein, 8 aa, Borrelia burgdorferi
STRLDLTN

SEQ ID NO: 14600 - protein, 8 aa, Borrelia burgdorferi
TRLDLTNY

SEQ ID NO: 14601 - protein, 8 aa, Borrelia burgdorferi
RLDLTNYV

SEQ ID NO: 14602 - protein, 8 aa, Borrelia burgdorferi
LDLTNYVD

SEQ ID NO: 14603 - protein, 8 aa, Borrelia burgdorferi
DLTNYVDY

SEQ ID NO: 14604 - protein, 8 aa, Borrelia burgdorferi
LTNYVDYV

SEQ ID NO: 14605 - protein, 8 aa, Borrelia burgdorferi
TNYVDYVY

SEQ ID NO: 14606 - protein, 8 aa, Borrelia burgdorferi
NYVDYVYS

SEQ ID NO: 14607 - protein, 8 aa, Borrelia burgdorferi
YVDYVYSG

SEQ ID NO: 14608 - protein, 8 aa, Borrelia burgdorferi
VDYVYSGA

SEQ ID NO: 14609 - protein, 8 aa, Borrelia burgdorferi
DYVYSGAS

SEQ ID NO: 14610 - protein, 8 aa, Borrelia burgdorferi
YVYSGASG

SEQ ID NO: 14611 - protein, 8 aa, Borrelia burgdorferi
VYSGASGI

SEQ ID NO: 14612 - protein, 8 aa, Borrelia burgdorferi
YSGASGIV

SEQ ID NO: 14613 - protein, 8 aa, Borrelia burgdorferi
SGASGIVK

SEQ ID NO: 14614 - protein, 8 aa, Borrelia burgdorferi
GASGIVKP

SEQ ID NO: 14615 - protein, 8 aa, Borrelia burgdorferi
ASGIVKPE

SEQ ID NO: 14616 - protein, 8 aa, Borrelia burgdorferi
SGIVKPED

SEQ ID NO: 14617 - protein, 8 aa, Borrelia burgdorferi
GIVKPEDM

SEQ ID NO: 14618 - protein, 8 aa, Borrelia burgdorferi
IVKPEDMV

SEQ ID NO: 14619 - protein, 8 aa, Borrelia burgdorferi
VKPEDMVV

SEQ ID NO: 14620 - protein, 8 aa, Borrelia burgdorferi
KPEDMVVD

SEQ ID NO: 14621 - protein, 8 aa, Borrelia burgdorferi
PEDMVVDL

SEQ ID NO: 14622 - protein, 8 aa, Borrelia burgdorferi
EDMVVDLG

SEQ ID NO: 14623 - protein, 8 aa, Borrelia burgdorferi
DMVVDLGI

SEQ ID NO: 14624 - protein, 8 aa, Borrelia burgdorferi
MVVDLGIN

SEQ ID NO: 14625 - protein, 8 aa, Borrelia burgdorferi
VVDLGINN

SEQ ID NO: 14626 - protein, 8 aa, Borrelia burgdorferi
VDLGINNW

SEQ ID NO: 14627 - protein, 8 aa, Borrelia burgdorferi
DLGINNWS

SEQ ID NO: 14628 - protein, 8 aa, Borrelia burgdorferi
LGINNWSV

SEQ ID NO: 14629 - protein, 8 aa, Borrelia burgdorferi
GINNWSVL

SEQ ID NO: 14630 - protein, 8 aa, Borrelia burgdorferi
INNWSVLL

SEQ ID NO: 14631 - protein, 8 aa, Borrelia burgdorferi
NNWSVLLT

SEQ ID NO: 14632 - protein, 8 aa, Borrelia burgdorferi
NWSVLLTP

SEQ ID NO: 14633 - protein, 8 aa, Borrelia burgdorferi
WSVLLTPS

SEQ ID NO: 14634 - protein, 8 aa, Borrelia burgdorferi
SVLLTPSA

SEQ ID NO: 14635 - protein, 8 aa, Borrelia burgdorferi
VLLTPSAR

SEQ ID NO: 14636 - protein, 8 aa, Borrelia burgdorferi
LLTPSARL

SEQ ID NO: 14637 - protein, 8 aa, Borrelia burgdorferi
LTPSARLQ

SEQ ID NO: 14638 - protein, 8 aa, Borrelia burgdorferi
TPSARLQA

SEQ ID NO: 14639 - protein, 8 aa, Borrelia burgdorferi
PSARLQAY

SEQ ID NO: 14640 - protein, 8 aa, Borrelia burgdorferi
SARLQAYV

SEQ ID NO: 14641 - protein, 8 aa, Borrelia burgdorferi
ARLQAYVK

SEQ ID NO: 14642 - protein, 8 aa, Borrelia burgdorferi
RLQAYVKN

SEQ ID NO: 14643 - protein, 8 aa, Borrelia burgdorferi
LQAYVKNS

SEQ ID NO: 14644 - protein, 8 aa, Borrelia burgdorferi
QAYVKNSV

SEQ ID NO: 14645 - protein, 8 aa, Borrelia burgdorferi
AYVKNSVV

SEQ ID NO: 14646 - protein, 8 aa, Borrelia burgdorferi
YVKNSVVA

SEQ ID NO: 14647 - protein, 8 aa, Borrelia burgdorferi
VKNSVVAP

SEQ ID NO: 14648 - protein, 8 aa, Borrelia burgdorferi
KNSVVAPA

SEQ ID NO: 14649 - protein, 8 aa, Borrelia burgdorferi
NSVVAPAV

SEQ ID NO: 14650 - protein, 8 aa, Borrelia burgdorferi
SVVAPAVV

SEQ ID NO: 14651 - protein, 8 aa, Borrelia burgdorferi
VVAPAVVK

SEQ ID NO: 14652 - protein, 8 aa, Borrelia burgdorferi
VAPAVVKS

SEQ ID NO: 14653 - protein, 8 aa, Borrelia burgdorferi
APAVVKSE

SEQ ID NO: 14654 - protein, 8 aa, Borrelia burgdorferi
PAVVKSES

SEQ ID NO: 14655 - protein, 8 aa, Borrelia burgdorferi
AVVKSESK

SEQ ID NO: 14656 - protein, 8 aa, Borrelia burgdorferi
VVKSESKR

SEQ ID NO: 14657 - protein, 8 aa, Borrelia burgdorferi
VKSESKRY

SEQ ID NO: 14658 - protein, 8 aa, Borrelia burgdorferi
KSESKRYA

SEQ ID NO: 14659 - protein, 8 aa, Borrelia burgdorferi
SESKRYAG

SEQ ID NO: 14660 - protein, 8 aa, Borrelia burgdorferi
ESKRYAGD

SEQ ID NO: 14661 - protein, 8 aa, Borrelia burgdorferi
SKRYAGDT

SEQ ID NO: 14662 - protein, 8 aa, Borrelia burgdorferi
KRYAGDTI

SEQ ID NO: 14663 - protein, 8 aa, Borrelia burgdorferi
RYAGDTIL

SEQ ID NO: 14664 - protein, 8 aa, Borrelia burgdorferi
YAGDTILG

SEQ ID NO: 14665 - protein, 8 aa, Borrelia burgdorferi
AGDTILGV

SEQ ID NO: 14666 - protein, 8 aa, Borrelia burgdorferi
GDTILGVR

SEQ ID NO: 14667 - protein, 8 aa, Borrelia burgdorferi
DTILGVRV

SEQ ID NO: 14668 - protein, 8 aa, Borrelia burgdorferi
TILGVRVL

SEQ ID NO: 14669 - protein, 8 aa, Borrelia burgdorferi
ILGVRVLF

SEQ ID NO: 14670 - protein, 8 aa, Borrelia burgdorferi
LGVRVLFP

SEQ ID NO: 14671 - protein, 8 aa, Borrelia burgdorferi
GVRVLFPS

SEQ ID NO: 14672 - protein, 8 aa, Borrelia burgdorferi
VRVLFPSY

SEQ ID NO: 14673 - protein, 8 aa, Borrelia burgdorferi
RVLFPSYS

SEQ ID NO: 14674 - protein, 8 aa, Borrelia burgdorferi
VLFPSYSQ

SEQ ID NO: 14675 - protein, 8 aa, Borrelia burgdorferi
LFPSYSQS

SEQ ID NO: 14676 - protein, 8 aa, Borrelia burgdorferi
FPSYSQSS

SEQ ID NO: 14677 - protein, 8 aa, Borrelia burgdorferi
PSYSQSSA

SEQ ID NO: 14678 - protein, 8 aa, Borrelia burgdorferi
SYSQSSAM

SEQ ID NO: 14679 - protein, 8 aa, Borrelia burgdorferi
YSQSSAMI

SEQ ID NO: 14680 - protein, 8 aa, Borrelia burgdorferi
SQSSAMIM

SEQ ID NO: 14681 - protein, 8 aa, Borrelia burgdorferi
QSSAMIMP

SEQ ID NO: 14682 - protein, 8 aa, Borrelia burgdorferi
SSAMIMPP

SEQ ID NO: 14683 - protein, 8 aa, Borrelia burgdorferi
SAMIMPPF

SEQ ID NO: 14684 - protein, 8 aa, Borrelia burgdorferi
AMIMPPFK

SEQ ID NO: 14685 - protein, 8 aa, Borrelia burgdorferi
MIMPPFKI

SEQ ID NO: 14686 - protein, 8 aa, Borrelia burgdorferi
IMPPFKIP

SEQ ID NO: 14687 - protein, 8 aa, Borrelia burgdorferi
MPPFKIPF

SEQ ID NO: 14688 - protein, 8 aa, Borrelia burgdorferi
PPFKIPFY

SEQ ID NO: 14689 - protein, 8 aa, Borrelia burgdorferi
PFKIPFYS

SEQ ID NO: 14690 - protein, 8 aa, Borrelia burgdorferi
FKIPFYSG

SEQ ID NO: 14691 - protein, 8 aa, Borrelia burgdorferi
KIPFYSGE

SEQ ID NO: 14692 - protein, 8 aa, Borrelia burgdorferi
IPFYSGES

SEQ ID NO: 14693 - protein, 8 aa, Borrelia burgdorferi
PFYSGESG

SEQ ID NO: 14694 - protein, 8 aa, Borrelia burgdorferi
FYSGESGN

SEQ ID NO: 14695 - protein, 8 aa, Borrelia burgdorferi
YSGESGNQ

SEQ ID NO: 14696 - protein, 8 aa, Borrelia burgdorferi
SGESGNQF

SEQ ID NO: 14697 - protein, 8 aa, Borrelia burgdorferi
GESGNQFL

SEQ ID NO: 14698 - protein, 8 aa, Borrelia burgdorferi
ESGNQFLG

SEQ ID NO: 14699 - protein, 8 aa, Borrelia burgdorferi
SGNQFLGK

SEQ ID NO: 14700 - protein, 8 aa, Borrelia burgdorferi
GNQFLGKG

SEQ ID NO: 14701 - protein, 8 aa, Borrelia burgdorferi
NQFLGKGL

SEQ ID NO: 14702 - protein, 8 aa, Borrelia burgdorferi
QFLGKGLI

SEQ ID NO: 14703 - protein, 8 aa, Borrelia burgdorferi
FLGKGLID

SEQ ID NO: 14704 - protein, 8 aa, Borrelia burgdorferi
LGKGLIDN

SEQ ID NO: 14705 - protein, 8 aa, Borrelia burgdorferi
GKGLIDNI

SEQ ID NO: 14706 - protein, 8 aa, Borrelia burgdorferi
KGLIDNIK

SEQ ID NO: 14707 - protein, 8 aa, Borrelia burgdorferi
GLIDNIKT

SEQ ID NO: 14708 - protein, 8 aa, Borrelia burgdorferi
LIDNIKTM

SEQ ID NO: 14709 - protein, 8 aa, Borrelia burgdorferi
IDNIKTMK

SEQ ID NO: 14710 - protein, 8 aa, Borrelia burgdorferi
DNIKTMKE

SEQ ID NO: 14711 - protein, 8 aa, Borrelia burgdorferi
NIKTMKEI

SEQ ID NO: 14712 - protein, 8 aa, Borrelia burgdorferi
IKTMKEIK

SEQ ID NO: 14713 - protein, 8 aa, Borrelia burgdorferi
KTMKEIKV

SEQ ID NO: 14714 - protein, 8 aa, Borrelia burgdorferi
TMKEIKVS

SEQ ID NO: 14715 - protein, 8 aa, Borrelia burgdorferi
MKEIKVSV

SEQ ID NO: 14716 - protein, 8 aa, Borrelia burgdorferi
KEIKVSVY

SEQ ID NO: 14717 - protein, 8 aa, Borrelia burgdorferi
EIKVSVYS

SEQ ID NO: 14718 - protein, 8 aa, Borrelia burgdorferi
IKVSVYSL

SEQ ID NO: 14719 - protein, 8 aa, Borrelia burgdorferi
KVSVYSLG

SEQ ID NO: 14720 - protein, 8 aa, Borrelia burgdorferi
VSVYSLGY

SEQ ID NO: 14721 - protein, 8 aa, Borrelia burgdorferi
SVYSLGYE

SEQ ID NO: 14722 - protein, 8 aa, Borrelia burgdorferi
VYSLGYEI

SEQ ID NO: 14723 - protein, 8 aa, Borrelia burgdorferi
YSLGYEID

SEQ ID NO: 14724 - protein, 8 aa, Borrelia burgdorferi
SLGYEIDL

SEQ ID NO: 14725 - protein, 8 aa, Borrelia burgdorferi
LGYEIDLE

SEQ ID NO: 14726 - protein, 8 aa, Borrelia burgdorferi
GYEIDLEV

SEQ ID NO: 14727 - protein, 8 aa, Borrelia burgdorferi
YEIDLEVL

SEQ ID NO: 14728 - protein, 8 aa, Borrelia burgdorferi
EIDLEVLF

SEQ ID NO: 14729 - protein, 8 aa, Borrelia burgdorferi
IDLEVLFE

SEQ ID NO: 14730 - protein, 8 aa, Borrelia burgdorferi
DLEVLFED

SEQ ID NO: 14731 - protein, 8 aa, Borrelia burgdorferi
LEVLFEDM

SEQ ID NO: 14732 - protein, 8 aa, Borrelia burgdorferi
EVLFEDMN

SEQ ID NO: 14733 - protein, 8 aa, Borrelia burgdorferi
VLFEDMNG

SEQ ID NO: 14734 - protein, 8 aa, Borrelia burgdorferi
LFEDMNGM

SEQ ID NO: 14735 - protein, 8 aa, Borrelia burgdorferi
FEDMNGME

SEQ ID NO: 14736 - protein, 8 aa, Borrelia burgdorferi
EDMNGMEY

SEQ ID NO: 14737 - protein, 8 aa, Borrelia burgdorferi
DMNGMEYA

SEQ ID NO: 14738 - protein, 8 aa, Borrelia burgdorferi
MNGMEYAY

SEQ ID NO: 14739 - protein, 8 aa, Borrelia burgdorferi
NGMEYAYS

SEQ ID NO: 14740 - protein, 8 aa, Borrelia burgdorferi
GMEYAYSM

SEQ ID NO: 14741 - protein, 8 aa, Borrelia burgdorferi
MEYAYSMG

SEQ ID NO: 14742 - protein, 8 aa, Borrelia burgdorferi
EYAYSMGT

SEQ ID NO: 14743 - protein, 8 aa, Borrelia burgdorferi
YAYSMGTL

SEQ ID NO: 14744 - protein, 8 aa, Borrelia burgdorferi
AYSMGTLK

SEQ ID NO: 14745 - protein, 8 aa, Borrelia burgdorferi
YSMGTLKF

SEQ ID NO: 14746 - protein, 8 aa, Borrelia burgdorferi
SMGTLKFK

SEQ ID NO: 14747 - protein, 8 aa, Borrelia burgdorferi
MGTLKFKG

SEQ ID NO: 14748 - protein, 8 aa, Borrelia burgdorferi
GTLKFKGW

SEQ ID NO: 14749 - protein, 8 aa, Borrelia burgdorferi
TLKFKGWA

SEQ ID NO: 14750 - protein, 8 aa, Borrelia burgdorferi
LKFKGWAD

SEQ ID NO: 14751 - protein, 8 aa, Borrelia burgdorferi
KFKGWADL

SEQ ID NO: 14752 - protein, 8 aa, Borrelia burgdorferi
FKGWADLI

SEQ ID NO: 14753 - protein, 8 aa, Borrelia burgdorferi
KGWADLIW

SEQ ID NO: 14754 - protein, 8 aa, Borrelia burgdorferi
GWADLIWS

SEQ ID NO: 14755 - protein, 8 aa, Borrelia burgdorferi
WADLIWSN

SEQ ID NO: 14756 - protein, 8 aa, Borrelia burgdorferi
ADLIWSNP

SEQ ID NO: 14757 - protein, 8 aa, Borrelia burgdorferi
DLIWSNPN

SEQ ID NO: 14758 - protein, 8 aa, Borrelia burgdorferi
LIWSNPNY

SEQ ID NO: 14759 - protein, 8 aa, Borrelia burgdorferi
IWSNPNYI

SEQ ID NO: 14760 - protein, 8 aa, Borrelia burgdorferi
WSNPNYIP

SEQ ID NO: 14761 - protein, 8 aa, Borrelia burgdorferi
SNPNYIPN

SEQ ID NO: 14762 - protein, 8 aa, Borrelia burgdorferi
NPNYIPNI

SEQ ID NO: 14763 - protein, 8 aa, Borrelia burgdorferi
PNYIPNIS

SEQ ID NO: 14764 - protein, 8 aa, Borrelia burgdorferi
NYIPNISS

SEQ ID NO: 14765 - protein, 8 aa, Borrelia burgdorferi
YIPNISSR

SEQ ID NO: 14766 - protein, 8 aa, Borrelia burgdorferi
IPNISSRI

SEQ ID NO: 14767 - protein, 8 aa, Borrelia burgdorferi
PNISSRII

SEQ ID NO: 14768 - protein, 8 aa, Borrelia burgdorferi
NISSRIIK

SEQ ID NO: 14769 - protein, 8 aa, Borrelia burgdorferi
ISSRIIKD

SEQ ID NO: 14770 - protein, 8 aa, Borrelia burgdorferi
SSRIIKDD

SEQ ID NO: 14771 - protein, 8 aa, Borrelia burgdorferi
SRIIKDDV

SEQ ID NO: 14772 - protein, 8 aa, Borrelia burgdorferi
RIIKDDVP

SEQ ID NO: 14773 - protein, 8 aa, Borrelia burgdorferi
IIKDDVPN

SEQ ID NO: 14774 - protein, 8 aa, Borrelia burgdorferi
IKDDVPNY

SEQ ID NO: 14775 - protein, 8 aa, Borrelia burgdorferi
KDDVPNYP

SEQ ID NO: 14776 - protein, 8 aa, Borrelia burgdorferi
DDVPNYPL

SEQ ID NO: 14777 - protein, 8 aa, Borrelia burgdorferi
DVPNYPLA

SEQ ID NO: 14778 - protein, 8 aa, Borrelia burgdorferi
VPNYPLAS

SEQ ID NO: 14779 - protein, 8 aa, Borrelia burgdorferi
PNYPLASS

SEQ ID NO: 14780 - protein, 8 aa, Borrelia burgdorferi
NYPLASSK

SEQ ID NO: 14781 - protein, 8 aa, Borrelia burgdorferi
YPLASSKM

SEQ ID NO: 14782 - protein, 8 aa, Borrelia burgdorferi
PLASSKMR

SEQ ID NO: 14783 - protein, 8 aa, Borrelia burgdorferi
LASSKMRF

SEQ ID NO: 14784 - protein, 8 aa, Borrelia burgdorferi
ASSKMRFK

SEQ ID NO: 14785 - protein, 8 aa, Borrelia burgdorferi
SSKMRFKA

SEQ ID NO: 14786 - protein, 8 aa, Borrelia burgdorferi
SKMRFKAF

SEQ ID NO: 14787 - protein, 8 aa, Borrelia burgdorferi
KMRFKAFR

SEQ ID NO: 14788 - protein, 8 aa, Borrelia burgdorferi
MRFKAFRV

SEQ ID NO: 14789 - protein, 8 aa, Borrelia burgdorferi
RFKAFRVS

SEQ ID NO: 14790 - protein, 8 aa, Borrelia burgdorferi
FKAFRVSK

SEQ ID NO: 14791 - protein, 8 aa, Borrelia burgdorferi
KAFRVSKS

SEQ ID NO: 14792 - protein, 8 aa, Borrelia burgdorferi
AFRVSKSH

SEQ ID NO: 14793 - protein, 8 aa, Borrelia burgdorferi
FRVSKSHS

SEQ ID NO: 14794 - protein, 8 aa, Borrelia burgdorferi
RVSKSHSS

SEQ ID NO: 14795 - protein, 8 aa, Borrelia burgdorferi
VSKSHSSK

SEQ ID NO: 14796 - protein, 8 aa, Borrelia burgdorferi
SKSHSSKV

SEQ ID NO: 14797 - protein, 8 aa, Borrelia burgdorferi
KSHSSKVK

SEQ ID NO: 14798 - protein, 8 aa, Borrelia burgdorferi
SHSSKVKN

SEQ ID NO: 14799 - protein, 8 aa, Borrelia burgdorferi
HSSKVKNF

SEQ ID NO: 14800 - protein, 8 aa, Borrelia burgdorferi
SSKVKNFI

SEQ ID NO: 14801 - protein, 8 aa, Borrelia burgdorferi
SKVKNFIF

SEQ ID NO: 14802 - protein, 8 aa, Borrelia burgdorferi
KVKNFIFY

SEQ ID NO: 14803 - protein, 8 aa, Borrelia burgdorferi
VKNFIFYV

SEQ ID NO: 14804 - protein, 8 aa, Borrelia burgdorferi
KNFIFYVK

SEQ ID NO: 14805 - protein, 8 aa, Borrelia burgdorferi
NFIFYVKD

SEQ ID NO: 14806 - protein, 8 aa, Borrelia burgdorferi
FIFYVKDL

SEQ ID NO: 14807 - protein, 8 aa, Borrelia burgdorferi
IFYVKDLR

SEQ ID NO: 14808 - protein, 8 aa, Borrelia burgdorferi
FYVKDLRV

SEQ ID NO: 14809 - protein, 8 aa, Borrelia burgdorferi
YVKDLRVL

SEQ ID NO: 14810 - protein, 8 aa, Borrelia burgdorferi
VKDLRVLY

SEQ ID NO: 14811 - protein, 8 aa, Borrelia burgdorferi
KDLRVLYD

SEQ ID NO: 14812 - protein, 8 aa, Borrelia burgdorferi
DLRVLYDK

SEQ ID NO: 14813 - protein, 8 aa, Borrelia burgdorferi
LRVLYDKL

SEQ ID NO: 14814 - protein, 8 aa, Borrelia burgdorferi
RVLYDKLS

SEQ ID NO: 14815 - protein, 8 aa, Borrelia burgdorferi
VLYDKLSV

SEQ ID NO: 14816 - protein, 8 aa, Borrelia burgdorferi
LYDKLSVS

SEQ ID NO: 14817 - protein, 8 aa, Borrelia burgdorferi
YDKLSVSI

SEQ ID NO: 14818 - protein, 8 aa, Borrelia burgdorferi
DKLSVSID

SEQ ID NO: 14819 - protein, 8 aa, Borrelia burgdorferi
KLSVSIDS

SEQ ID NO: 14820 - protein, 8 aa, Borrelia burgdorferi
LSVSIDSD

SEQ ID NO: 14821 - protein, 8 aa, Borrelia burgdorferi
SVSIDSDI

SEQ ID NO: 14822 - protein, 8 aa, Borrelia burgdorferi
VSIDSDID

SEQ ID NO: 14823 - protein, 8 aa, Borrelia burgdorferi
SIDSDIDS

SEQ ID NO: 14824 - protein, 8 aa, Borrelia burgdorferi
IDSDIDSE

SEQ ID NO: 14825 - protein, 8 aa, Borrelia burgdorferi
DSDIDSES

SEQ ID NO: 14826 - protein, 8 aa, Borrelia burgdorferi
SDIDSESV

SEQ ID NO: 14827 - protein, 8 aa, Borrelia burgdorferi
DIDSESVF

SEQ ID NO: 14828 - protein, 8 aa, Borrelia burgdorferi
IDSESVFK

SEQ ID NO: 14829 - protein, 8 aa, Borrelia burgdorferi
DSESVFKV

SEQ ID NO: 14830 - protein, 8 aa, Borrelia burgdorferi
SESVFKVY

SEQ ID NO: 14831 - protein, 8 aa, Borrelia burgdorferi
ESVFKVYE

SEQ ID NO: 14832 - protein, 8 aa, Borrelia burgdorferi
SVFKVYET

SEQ ID NO: 14833 - protein, 8 aa, Borrelia burgdorferi
VFKVYETS

SEQ ID NO: 14834 - protein, 8 aa, Borrelia burgdorferi
FKVYETSG

SEQ ID NO: 14835 - protein, 8 aa, Borrelia burgdorferi
KVYETSGT

SEQ ID NO: 14836 - protein, 8 aa, Borrelia burgdorferi
VYETSGTE

SEQ ID NO: 14837 - protein, 8 aa, Borrelia burgdorferi
YETSGTES

SEQ ID NO: 14838 - protein, 8 aa, Borrelia burgdorferi
ETSGTESL

SEQ ID NO: 14839 - protein, 8 aa, Borrelia burgdorferi
TSGTESLR

SEQ ID NO: 14840 - protein, 8 aa, Borrelia burgdorferi
SGTESLRK

SEQ ID NO: 14841 - protein, 8 aa, Borrelia burgdorferi
GTESLRKL

SEQ ID NO: 14842 - protein, 8 aa, Borrelia burgdorferi
TESLRKLK

SEQ ID NO: 14843 - protein, 8 aa, Borrelia burgdorferi
ESLRKLKA

SEQ ID NO: 14844 - protein, 8 aa, Borrelia burgdorferi
SLRKLKAH

SEQ ID NO: 14845 - protein, 8 aa, Borrelia burgdorferi
LRKLKAHE

SEQ ID NO: 14846 - protein, 8 aa, Borrelia burgdorferi
RKLKAHET

SEQ ID NO: 14847 - protein, 8 aa, Borrelia burgdorferi
KLKAHETF

SEQ ID NO: 14848 - protein, 8 aa, Borrelia burgdorferi
LKAHETFK

SEQ ID NO: 14849 - protein, 8 aa, Borrelia burgdorferi
KAHETFKR

SEQ ID NO: 14850 - protein, 8 aa, Borrelia burgdorferi
AHETFKRV

SEQ ID NO: 14851 - protein, 8 aa, Borrelia burgdorferi
HETFKRVL

SEQ ID NO: 14852 - protein, 8 aa, Borrelia burgdorferi
ETFKRVLK

SEQ ID NO: 14853 - protein, 8 aa, Borrelia burgdorferi
TFKRVLKL

SEQ ID NO: 14854 - protein, 8 aa, Borrelia burgdorferi
FKRVLKLR

SEQ ID NO: 14855 - protein, 8 aa, Borrelia burgdorferi
KRVLKLRE

SEQ ID NO: 14856 - protein, 8 aa, Borrelia burgdorferi
RVLKLREK

SEQ ID NO: 14857 - protein, 8 aa, Borrelia burgdorferi
VLKLREKI

SEQ ID NO: 14858 - protein, 8 aa, Borrelia burgdorferi
LKLREKIS

SEQ ID NO: 14859 - protein, 8 aa, Borrelia burgdorferi
KLREKISI

SEQ ID NO: 14860 - protein, 8 aa, Borrelia burgdorferi
LREKISIA

SEQ ID NO: 14861 - protein, 8 aa, Borrelia burgdorferi
REKISIAE

SEQ ID NO: 14862 - protein, 8 aa, Borrelia burgdorferi
EKISIAEG

SEQ ID NO: 14863 - protein, 8 aa, Borrelia burgdorferi
KISIAEGS

SEQ ID NO: 14864 - protein, 8 aa, Borrelia burgdorferi
ISIAEGSF

SEQ ID NO: 14865 - protein, 8 aa, Borrelia burgdorferi
SIAEGSFQ

SEQ ID NO: 14866 - protein, 8 aa, Borrelia burgdorferi
IAEGSFQN

SEQ ID NO: 14867 - protein, 8 aa, Borrelia burgdorferi
AEGSFQNF

SEQ ID NO: 14868 - protein, 8 aa, Borrelia burgdorferi
EGSFQNFV

SEQ ID NO: 14869 - protein, 8 aa, Borrelia burgdorferi
GSFQNFVE

SEQ ID NO: 14870 - protein, 8 aa, Borrelia burgdorferi
SFQNFVEK

SEQ ID NO: 14871 - protein, 8 aa, Borrelia burgdorferi
FQNFVEKI

SEQ ID NO: 14872 - protein, 8 aa, Borrelia burgdorferi
QNFVEKIE

SEQ ID NO: 14873 - protein, 8 aa, Borrelia burgdorferi
NFVEKIES

SEQ ID NO: 14874 - protein, 8 aa, Borrelia burgdorferi
FVEKIESE

SEQ ID NO: 14875 - protein, 8 aa, Borrelia burgdorferi
VEKIESEK

SEQ ID NO: 14876 - protein, 8 aa, Borrelia burgdorferi
EKIESEKP

SEQ ID NO: 14877 - protein, 8 aa, Borrelia burgdorferi
KIESEKPE

SEQ ID NO: 14878 - protein, 8 aa, Borrelia burgdorferi
IESEKPEE

SEQ ID NO: 14879 - protein, 8 aa, Borrelia burgdorferi
ESEKPEES

SEQ ID NO: 14880 - protein, 8 aa, Borrelia burgdorferi
SEKPEESS

SEQ ID NO: 14881 - protein, 8 aa, Borrelia burgdorferi
EKPEESSP

SEQ ID NO: 14882 - protein, 8 aa, Borrelia burgdorferi
KPEESSPK

SEQ ID NO: 14883 - protein, 8 aa, Borrelia burgdorferi
PEESSPKN

SEQ ID NO: 14884 - protein, 9 aa, Borrelia burgdorferi
MKRKAKSIL

SEQ ID NO: 14885 - protein, 9 aa, Borrelia burgdorferi
KRKAKSILF

SEQ ID NO: 14886 - protein, 9 aa, Borrelia burgdorferi
RKAKSILFF

SEQ ID NO: 14887 - protein, 9 aa, Borrelia burgdorferi
KAKSILFFL

SEQ ID NO: 14888 - protein, 9 aa, Borrelia burgdorferi
AKSILFFLL

SEQ ID NO: 14889 - protein, 9 aa, Borrelia burgdorferi
KSILFFLLS

SEQ ID NO: 14890 - protein, 9 aa, Borrelia burgdorferi
SILFFLLST

SEQ ID NO: 14891 - protein, 9 aa, Borrelia burgdorferi
ILFFLLSTV

SEQ ID NO: 14892 - protein, 9 aa, Borrelia burgdorferi
LFFLLSTVL

SEQ ID NO: 14893 - protein, 9 aa, Borrelia burgdorferi
FFLLSTVLF

SEQ ID NO: 14894 - protein, 9 aa, Borrelia burgdorferi
FLLSTVLFA

SEQ ID NO: 14895 - protein, 9 aa, Borrelia burgdorferi
LLSTVLFAQ

SEQ ID NO: 14896 - protein, 9 aa, Borrelia burgdorferi
LSTVLFAQE

SEQ ID NO: 14897 - protein, 9 aa, Borrelia burgdorferi
STVLFAQET

SEQ ID NO: 14898 - protein, 9 aa, Borrelia burgdorferi
TVLFAQETD

SEQ ID NO: 14899 - protein, 9 aa, Borrelia burgdorferi
VLFAQETDG

SEQ ID NO: 14900 - protein, 9 aa, Borrelia burgdorferi
LFAQETDGL

SEQ ID NO: 14901 - protein, 9 aa, Borrelia burgdorferi
FAQETDGLA

SEQ ID NO: 14902 - protein, 9 aa, Borrelia burgdorferi
AQETDGLAE

SEQ ID NO: 14903 - protein, 9 aa, Borrelia burgdorferi
QETDGLAEG

SEQ ID NO: 14904 - protein, 9 aa, Borrelia burgdorferi
ETDGLAEGS

SEQ ID NO: 14905 - protein, 9 aa, Borrelia burgdorferi
TDGLAEGSK

SEQ ID NO: 14906 - protein, 9 aa, Borrelia burgdorferi
DGLAEGSKR

SEQ ID NO: 14907 - protein, 9 aa, Borrelia burgdorferi
GLAEGSKRA

SEQ ID NO: 14908 - protein, 9 aa, Borrelia burgdorferi
LAEGSKRAE

SEQ ID NO: 14909 - protein, 9 aa, Borrelia burgdorferi
AEGSKRAEP

SEQ ID NO: 14910 - protein, 9 aa, Borrelia burgdorferi
EGSKRAEPG

SEQ ID NO: 14911 - protein, 9 aa, Borrelia burgdorferi
GSKRAEPGE

SEQ ID NO: 14912 - protein, 9 aa, Borrelia burgdorferi
SKRAEPGEL

SEQ ID NO: 14913 - protein, 9 aa, Borrelia burgdorferi
KRAEPGELV

SEQ ID NO: 14914 - protein, 9 aa, Borrelia burgdorferi
RAEPGELVL

SEQ ID NO: 14915 - protein, 9 aa, Borrelia burgdorferi
AEPGELVLD

SEQ ID NO: 14916 - protein, 9 aa, Borrelia burgdorferi
EPGELVLDF

SEQ ID NO: 14917 - protein, 9 aa, Borrelia burgdorferi
PGELVLDFA

SEQ ID NO: 14918 - protein, 9 aa, Borrelia burgdorferi
GELVLDFAE

SEQ ID NO: 14919 - protein, 9 aa, Borrelia burgdorferi
ELVLDFAEL

SEQ ID NO: 14920 - protein, 9 aa, Borrelia burgdorferi
LVLDFAELA

SEQ ID NO: 14921 - protein, 9 aa, Borrelia burgdorferi
VLDFAELAR

SEQ ID NO: 14922 - protein, 9 aa, Borrelia burgdorferi
LDFAELARD

SEQ ID NO: 14923 - protein, 9 aa, Borrelia burgdorferi
DFAELARDP

SEQ ID NO: 14924 - protein, 9 aa, Borrelia burgdorferi
FAELARDPS

SEQ ID NO: 14925 - protein, 9 aa, Borrelia burgdorferi
AELARDPSS

SEQ ID NO: 14926 - protein, 9 aa, Borrelia burgdorferi
ELARDPSST

SEQ ID NO: 14927 - protein, 9 aa, Borrelia burgdorferi
LARDPSSTR

SEQ ID NO: 14928 - protein, 9 aa, Borrelia burgdorferi
ARDPSSTRL

SEQ ID NO: 14929 - protein, 9 aa, Borrelia burgdorferi
RDPSSTRLD

SEQ ID NO: 14930 - protein, 9 aa, Borrelia burgdorferi
DPSSTRLDL

SEQ ID NO: 14931 - protein, 9 aa, Borrelia burgdorferi
PSSTRLDLT

SEQ ID NO: 14932 - protein, 9 aa, Borrelia burgdorferi
SSTRLDLTN

SEQ ID NO: 14933 - protein, 9 aa, Borrelia burgdorferi
STRLDLTNY

SEQ ID NO: 14934 - protein, 9 aa, Borrelia burgdorferi
TRLDLTNYV

SEQ ID NO: 14935 - protein, 9 aa, Borrelia burgdorferi
RLDLTNYVD

SEQ ID NO: 14936 - protein, 9 aa, Borrelia burgdorferi
LDLTNYVDY

SEQ ID NO: 14937 - protein, 9 aa, Borrelia burgdorferi
DLTNYVDYV

SEQ ID NO: 14938 - protein, 9 aa, Borrelia burgdorferi
LTNYVDYVY

SEQ ID NO: 14939 - protein, 9 aa, Borrelia burgdorferi
TNYVDYVYS

SEQ ID NO: 14940 - protein, 9 aa, Borrelia burgdorferi
NYVDYVYSG

SEQ ID NO: 14941 - protein, 9 aa, Borrelia burgdorferi
YVDYVYSGA

SEQ ID NO: 14942 - protein, 9 aa, Borrelia burgdorferi
VDYVYSGAS

SEQ ID NO: 14943 - protein, 9 aa, Borrelia burgdorferi
DYVYSGASG

SEQ ID NO: 14944 - protein, 9 aa, Borrelia burgdorferi
YVYSGASGI

SEQ ID NO: 14945 - protein, 9 aa, Borrelia burgdorferi
VYSGASGIV

SEQ ID NO: 14946 - protein, 9 aa, Borrelia burgdorferi
YSGASGIVK

SEQ ID NO: 14947 - protein, 9 aa, Borrelia burgdorferi
SGASGIVKP

SEQ ID NO: 14948 - protein, 9 aa, Borrelia burgdorferi
GASGIVKPE

SEQ ID NO: 14949 - protein, 9 aa, Borrelia burgdorferi
ASGIVKPED

SEQ ID NO: 14950 - protein, 9 aa, Borrelia burgdorferi
SGIVKPEDM

SEQ ID NO: 14951 - protein, 9 aa, Borrelia burgdorferi
GIVKPEDMV

SEQ ID NO: 14952 - protein, 9 aa, Borrelia burgdorferi
IVKPEDMVV

SEQ ID NO: 14953 - protein, 9 aa, Borrelia burgdorferi
VKPEDMVVD

SEQ ID NO: 14954 - protein, 9 aa, Borrelia burgdorferi
KPEDMVVDL

SEQ ID NO: 14955 - protein, 9 aa, Borrelia burgdorferi
PEDMVVDLG

SEQ ID NO: 14956 - protein, 9 aa, Borrelia burgdorferi
EDMVVDLGI

SEQ ID NO: 14957 - protein, 9 aa, Borrelia burgdorferi
DMVVDLGIN

SEQ ID NO: 14958 - protein, 9 aa, Borrelia burgdorferi
MVVDLGINN

SEQ ID NO: 14959 - protein, 9 aa, Borrelia burgdorferi
VVDLGINNW

SEQ ID NO: 14960 - protein, 9 aa, Borrelia burgdorferi
VDLGINNWS

SEQ ID NO: 14961 - protein, 9 aa, Borrelia burgdorferi
DLGINNWSV

SEQ ID NO: 14962 - protein, 9 aa, Borrelia burgdorferi
LGINNWSVL

SEQ ID NO: 14963 - protein, 9 aa, Borrelia burgdorferi
GINNWSVLL

SEQ ID NO: 14964 - protein, 9 aa, Borrelia burgdorferi
INNWSVLLT

SEQ ID NO: 14965 - protein, 9 aa, Borrelia burgdorferi
NNWSVLLTP

SEQ ID NO: 14966 - protein, 9 aa, Borrelia burgdorferi
NWSVLLTPS

SEQ ID NO: 14967 - protein, 9 aa, Borrelia burgdorferi
WSVLLTPSA

SEQ ID NO: 14968 - protein, 9 aa, Borrelia burgdorferi
SVLLTPSAR

SEQ ID NO: 14969 - protein, 9 aa, Borrelia burgdorferi
VLLTPSARL

SEQ ID NO: 14970 - protein, 9 aa, Borrelia burgdorferi
LLTPSARLQ

SEQ ID NO: 14971 - protein, 9 aa, Borrelia burgdorferi
LTPSARLQA

SEQ ID NO: 14972 - protein, 9 aa, Borrelia burgdorferi
TPSARLQAY

SEQ ID NO: 14973 - protein, 9 aa, Borrelia burgdorferi
PSARLQAYV

SEQ ID NO: 14974 - protein, 9 aa, Borrelia burgdorferi
SARLQAYVK

SEQ ID NO: 14975 - protein, 9 aa, Borrelia burgdorferi
ARLQAYVKN

SEQ ID NO: 14976 - protein, 9 aa, Borrelia burgdorferi
RLQAYVKNS

SEQ ID NO: 14977 - protein, 9 aa, Borrelia burgdorferi
LQAYVKNSV

SEQ ID NO: 14978 - protein, 9 aa, Borrelia burgdorferi
QAYVKNSVV

SEQ ID NO: 14979 - protein, 9 aa, Borrelia burgdorferi
AYVKNSVVA

SEQ ID NO: 14980 - protein, 9 aa, Borrelia burgdorferi
YVKNSVVAP

SEQ ID NO: 14981 - protein, 9 aa, Borrelia burgdorferi
VKNSVVAPA

SEQ ID NO: 14982 - protein, 9 aa, Borrelia burgdorferi
KNSVVAPAV

SEQ ID NO: 14983 - protein, 9 aa, Borrelia burgdorferi
NSVVAPAVV

SEQ ID NO: 14984 - protein, 9 aa, Borrelia burgdorferi
SVVAPAVVK

SEQ ID NO: 14985 - protein, 9 aa, Borrelia burgdorferi
VVAPAVVKS

SEQ ID NO: 14986 - protein, 9 aa, Borrelia burgdorferi
VAPAVVKSE

SEQ ID NO: 14987 - protein, 9 aa, Borrelia burgdorferi
APAVVKSES

SEQ ID NO: 14988 - protein, 9 aa, Borrelia burgdorferi
PAVVKSESK

SEQ ID NO: 14989 - protein, 9 aa, Borrelia burgdorferi
AVVKSESKR

SEQ ID NO: 14990 - protein, 9 aa, Borrelia burgdorferi
VVKSESKRY

SEQ ID NO: 14991 - protein, 9 aa, Borrelia burgdorferi
VKSESKRYA

SEQ ID NO: 14992 - protein, 9 aa, Borrelia burgdorferi
KSESKRYAG

SEQ ID NO: 14993 - protein, 9 aa, Borrelia burgdorferi
SESKRYAGD

SEQ ID NO: 14994 - protein, 9 aa, Borrelia burgdorferi
ESKRYAGDT

SEQ ID NO: 14995 - protein, 9 aa, Borrelia burgdorferi
SKRYAGDTI

SEQ ID NO: 14996 - protein, 9 aa, Borrelia burgdorferi
KRYAGDTIL

SEQ ID NO: 14997 - protein, 9 aa, Borrelia burgdorferi
RYAGDTILG

SEQ ID NO: 14998 - protein, 9 aa, Borrelia burgdorferi
YAGDTILGV

SEQ ID NO: 14999 - protein, 9 aa, Borrelia burgdorferi
AGDTILGVR

SEQ ID NO: 15000 - protein, 9 aa, Borrelia burgdorferi
GDTILGVRV

SEQ ID NO: 15001 - protein, 9 aa, Borrelia burgdorferi
DTILGVRVL

SEQ ID NO: 15002 - protein, 9 aa, Borrelia burgdorferi
TILGVRVLF

SEQ ID NO: 15003 - protein, 9 aa, Borrelia burgdorferi
ILGVRVLFP

SEQ ID NO: 15004 - protein, 9 aa, Borrelia burgdorferi
LGVRVLFPS

SEQ ID NO: 15005 - protein, 9 aa, Borrelia burgdorferi
GVRVLFPSY

SEQ ID NO: 15006 - protein, 9 aa, Borrelia burgdorferi
VRVLFPSYS

SEQ ID NO: 15007 - protein, 9 aa, Borrelia burgdorferi
RVLFPSYSQ

SEQ ID NO: 15008 - protein, 9 aa, Borrelia burgdorferi
VLFPSYSQS

SEQ ID NO: 15009 - protein, 9 aa, Borrelia burgdorferi
LFPSYSQSS

SEQ ID NO: 15010 - protein, 9 aa, Borrelia burgdorferi
FPSYSQSSA

SEQ ID NO: 15011 - protein, 9 aa, Borrelia burgdorferi
PSYSQSSAM

SEQ ID NO: 15012 - protein, 9 aa, Borrelia burgdorferi
SYSQSSAMI

SEQ ID NO: 15013 - protein, 9 aa, Borrelia burgdorferi
YSQSSAMIM

SEQ ID NO: 15014 - protein, 9 aa, Borrelia burgdorferi
SQSSAMIMP

SEQ ID NO: 15015 - protein, 9 aa, Borrelia burgdorferi
QSSAMIMPP

SEQ ID NO: 15016 - protein, 9 aa, Borrelia burgdorferi
SSAMIMPPF

SEQ ID NO: 15017 - protein, 9 aa, Borrelia burgdorferi
SAMIMPPFK

SEQ ID NO: 15018 - protein, 9 aa, Borrelia burgdorferi
AMIMPPFKI

SEQ ID NO: 15019 - protein, 9 aa, Borrelia burgdorferi
MIMPPFKIP

SEQ ID NO: 15020 - protein, 9 aa, Borrelia burgdorferi
IMPPFKIPF

SEQ ID NO: 15021 - protein, 9 aa, Borrelia burgdorferi
MPPFKIPFY

SEQ ID NO: 15022 - protein, 9 aa, Borrelia burgdorferi
PPFKIPFYS

SEQ ID NO: 15023 - protein, 9 aa, Borrelia burgdorferi
PFKIPFYSG

SEQ ID NO: 15024 - protein, 9 aa, Borrelia burgdorferi
FKIPFYSGE

SEQ ID NO: 15025 - protein, 9 aa, Borrelia burgdorferi
KIPFYSGES

SEQ ID NO: 15026 - protein, 9 aa, Borrelia burgdorferi
IPFYSGESG

SEQ ID NO: 15027 - protein, 9 aa, Borrelia burgdorferi
PFYSGESGN

SEQ ID NO: 15028 - protein, 9 aa, Borrelia burgdorferi
FYSGESGNQ

SEQ ID NO: 15029 - protein, 9 aa, Borrelia burgdorferi
YSGESGNQF

SEQ ID NO: 15030 - protein, 9 aa, Borrelia burgdorferi
SGESGNQFL

SEQ ID NO: 15031 - protein, 9 aa, Borrelia burgdorferi
GESGNQFLG

SEQ ID NO: 15032 - protein, 9 aa, Borrelia burgdorferi
ESGNQFLGK

SEQ ID NO: 15033 - protein, 9 aa, Borrelia burgdorferi
SGNQFLGKG

SEQ ID NO: 15034 - protein, 9 aa, Borrelia burgdorferi
GNQFLGKGL

SEQ ID NO: 15035 - protein, 9 aa, Borrelia burgdorferi
NQFLGKGLI

SEQ ID NO: 15036 - protein, 9 aa, Borrelia burgdorferi
QFLGKGLID

SEQ ID NO: 15037 - protein, 9 aa, Borrelia burgdorferi
FLGKGLIDN

SEQ ID NO: 15038 - protein, 9 aa, Borrelia burgdorferi
LGKGLIDNI

SEQ ID NO: 15039 - protein, 9 aa, Borrelia burgdorferi
GKGLIDNIK

SEQ ID NO: 15040 - protein, 9 aa, Borrelia burgdorferi
KGLIDNIKT

SEQ ID NO: 15041 - protein, 9 aa, Borrelia burgdorferi
GLIDNIKTM

SEQ ID NO: 15042 - protein, 9 aa, Borrelia burgdorferi
LIDNIKTMK

SEQ ID NO: 15043 - protein, 9 aa, Borrelia burgdorferi
IDNIKTMKE

SEQ ID NO: 15044 - protein, 9 aa, Borrelia burgdorferi
DNIKTMKEI

SEQ ID NO: 15045 - protein, 9 aa, Borrelia burgdorferi
NIKTMKEIK

SEQ ID NO: 15046 - protein, 9 aa, Borrelia burgdorferi
IKTMKEIKV

SEQ ID NO: 15047 - protein, 9 aa, Borrelia burgdorferi
KTMKEIKVS

SEQ ID NO: 15048 - protein, 9 aa, Borrelia burgdorferi
TMKEIKVSV

SEQ ID NO: 15049 - protein, 9 aa, Borrelia burgdorferi
MKEIKVSVY

SEQ ID NO: 15050 - protein, 9 aa, Borrelia burgdorferi
KEIKVSVYS

SEQ ID NO: 15051 - protein, 9 aa, Borrelia burgdorferi
EIKVSVYSL

SEQ ID NO: 15052 - protein, 9 aa, Borrelia burgdorferi
IKVSVYSLG

SEQ ID NO: 15053 - protein, 9 aa, Borrelia burgdorferi
KVSVYSLGY

SEQ ID NO: 15054 - protein, 9 aa, Borrelia burgdorferi
VSVYSLGYE

SEQ ID NO: 15055 - protein, 9 aa, Borrelia burgdorferi
SVYSLGYEI

SEQ ID NO: 15056 - protein, 9 aa, Borrelia burgdorferi
VYSLGYEID

SEQ ID NO: 15057 - protein, 9 aa, Borrelia burgdorferi
YSLGYEIDL

SEQ ID NO: 15058 - protein, 9 aa, Borrelia burgdorferi
SLGYEIDLE

SEQ ID NO: 15059 - protein, 9 aa, Borrelia burgdorferi
LGYEIDLEV

SEQ ID NO: 15060 - protein, 9 aa, Borrelia burgdorferi
GYEIDLEVL

SEQ ID NO: 15061 - protein, 9 aa, Borrelia burgdorferi
YEIDLEVLF

SEQ ID NO: 15062 - protein, 9 aa, Borrelia burgdorferi
EIDLEVLFE

SEQ ID NO: 15063 - protein, 9 aa, Borrelia burgdorferi
IDLEVLFED

SEQ ID NO: 15064 - protein, 9 aa, Borrelia burgdorferi
DLEVLFEDM

SEQ ID NO: 15065 - protein, 9 aa, Borrelia burgdorferi
LEVLFEDMN

SEQ ID NO: 15066 - protein, 9 aa, Borrelia burgdorferi
EVLFEDMNG

SEQ ID NO: 15067 - protein, 9 aa, Borrelia burgdorferi
VLFEDMNGM

SEQ ID NO: 15068 - protein, 9 aa, Borrelia burgdorferi
LFEDMNGME

SEQ ID NO: 15069 - protein, 9 aa, Borrelia burgdorferi
FEDMNGMEY

SEQ ID NO: 15070 - protein, 9 aa, Borrelia burgdorferi
EDMNGMEYA

SEQ ID NO: 15071 - protein, 9 aa, Borrelia burgdorferi
DMNGMEYAY

SEQ ID NO: 15072 - protein, 9 aa, Borrelia burgdorferi
MNGMEYAYS

SEQ ID NO: 15073 - protein, 9 aa, Borrelia burgdorferi
NGMEYAYSM

SEQ ID NO: 15074 - protein, 9 aa, Borrelia burgdorferi
GMEYAYSMG

SEQ ID NO: 15075 - protein, 9 aa, Borrelia burgdorferi
MEYAYSMGT

SEQ ID NO: 15076 - protein, 9 aa, Borrelia burgdorferi
EYAYSMGTL

SEQ ID NO: 15077 - protein, 9 aa, Borrelia burgdorferi
YAYSMGTLK

SEQ ID NO: 15078 - protein, 9 aa, Borrelia burgdorferi
AYSMGTLKF

SEQ ID NO: 15079 - protein, 9 aa, Borrelia burgdorferi
YSMGTLKFK

SEQ ID NO: 15080 - protein, 9 aa, Borrelia burgdorferi
SMGTLKFKG

SEQ ID NO: 15081 - protein, 9 aa, Borrelia burgdorferi
MGTLKFKGW

SEQ ID NO: 15082 - protein, 9 aa, Borrelia burgdorferi
GTLKFKGWA

SEQ ID NO: 15083 - protein, 9 aa, Borrelia burgdorferi
TLKFKGWAD

SEQ ID NO: 15084 - protein, 9 aa, Borrelia burgdorferi
LKFKGWADL

SEQ ID NO: 15085 - protein, 9 aa, Borrelia burgdorferi
KFKGWADLI

SEQ ID NO: 15086 - protein, 9 aa, Borrelia burgdorferi
FKGWADLIW

SEQ ID NO: 15087 - protein, 9 aa, Borrelia burgdorferi
KGWADLIWS

SEQ ID NO: 15088 - protein, 9 aa, Borrelia burgdorferi
GWADLIWSN

SEQ ID NO: 15089 - protein, 9 aa, Borrelia burgdorferi
WADLIWSNP

SEQ ID NO: 15090 - protein, 9 aa, Borrelia burgdorferi
ADLIWSNPN

SEQ ID NO: 15091 - protein, 9 aa, Borrelia burgdorferi
DLIWSNPNY

SEQ ID NO: 15092 - protein, 9 aa, Borrelia burgdorferi
LIWSNPNYI

SEQ ID NO: 15093 - protein, 9 aa, Borrelia burgdorferi
IWSNPNYIP

SEQ ID NO: 15094 - protein, 9 aa, Borrelia burgdorferi
WSNPNYIPN

SEQ ID NO: 15095 - protein, 9 aa, Borrelia burgdorferi
SNPNYIPNI

SEQ ID NO: 15096 - protein, 9 aa, Borrelia burgdorferi
NPNYIPNIS

SEQ ID NO: 15097 - protein, 9 aa, Borrelia burgdorferi
PNYIPNISS

SEQ ID NO: 15098 - protein, 9 aa, Borrelia burgdorferi
NYIPNISSR

SEQ ID NO: 15099 - protein, 9 aa, Borrelia burgdorferi
YIPNISSRI

SEQ ID NO: 15100 - protein, 9 aa, Borrelia burgdorferi
IPNISSRII

SEQ ID NO: 15101 - protein, 9 aa, Borrelia burgdorferi
PNISSRIIK

SEQ ID NO: 15102 - protein, 9 aa, Borrelia burgdorferi
NISSRIIKD

SEQ ID NO: 15103 - protein, 9 aa, Borrelia burgdorferi
ISSRIIKDD

SEQ ID NO: 15104 - protein, 9 aa, Borrelia burgdorferi
SSRIIKDDV

SEQ ID NO: 15105 - protein, 9 aa, Borrelia burgdorferi
SRIIKDDVP

SEQ ID NO: 15106 - protein, 9 aa, Borrelia burgdorferi
RIIKDDVPN

SEQ ID NO: 15107 - protein, 9 aa, Borrelia burgdorferi
IIKDDVPNY

SEQ ID NO: 15108 - protein, 9 aa, Borrelia burgdorferi
IKDDVPNYP

SEQ ID NO: 15109 - protein, 9 aa, Borrelia burgdorferi
KDDVPNYPL

SEQ ID NO: 15110 - protein, 9 aa, Borrelia burgdorferi
DDVPNYPLA

SEQ ID NO: 15111 - protein, 9 aa, Borrelia burgdorferi
DVPNYPLAS

SEQ ID NO: 15112 - protein, 9 aa, Borrelia burgdorferi
VPNYPLASS

SEQ ID NO: 15113 - protein, 9 aa, Borrelia burgdorferi
PNYPLASSK

SEQ ID NO: 15114 - protein, 9 aa, Borrelia burgdorferi
NYPLASSKM

SEQ ID NO: 15115 - protein, 9 aa, Borrelia burgdorferi
YPLASSKMR

SEQ ID NO: 15116 - protein, 9 aa, Borrelia burgdorferi
PLASSKMRF

SEQ ID NO: 15117 - protein, 9 aa, Borrelia burgdorferi
LASSKMRFK

SEQ ID NO: 15118 - protein, 9 aa, Borrelia burgdorferi
ASSKMRFKA

SEQ ID NO: 15119 - protein, 9 aa, Borrelia burgdorferi
SSKMRFKAF

SEQ ID NO: 15120 - protein, 9 aa, Borrelia burgdorferi
SKMRFKAFR

SEQ ID NO: 15121 - protein, 9 aa, Borrelia burgdorferi
KMRFKAFRV

SEQ ID NO: 15122 - protein, 9 aa, Borrelia burgdorferi
MRFKAFRVS

SEQ ID NO: 15123 - protein, 9 aa, Borrelia burgdorferi
RFKAFRVSK

SEQ ID NO: 15124 - protein, 9 aa, Borrelia burgdorferi
FKAFRVSKS

SEQ ID NO: 15125 - protein, 9 aa, Borrelia burgdorferi
KAFRVSKSH

SEQ ID NO: 15126 - protein, 9 aa, Borrelia burgdorferi
AFRVSKSHS

SEQ ID NO: 15127 - protein, 9 aa, Borrelia burgdorferi
FRVSKSHSS

SEQ ID NO: 15128 - protein, 9 aa, Borrelia burgdorferi
RVSKSHSSK

SEQ ID NO: 15129 - protein, 9 aa, Borrelia burgdorferi
VSKSHSSKV

SEQ ID NO: 15130 - protein, 9 aa, Borrelia burgdorferi
SKSHSSKVK

SEQ ID NO: 15131 - protein, 9 aa, Borrelia burgdorferi
KSHSSKVKN

SEQ ID NO: 15132 - protein, 9 aa, Borrelia burgdorferi
SHSSKVKNF

SEQ ID NO: 15133 - protein, 9 aa, Borrelia burgdorferi
HSSKVKNFI

SEQ ID NO: 15134 - protein, 9 aa, Borrelia burgdorferi
SSKVKNFIF

SEQ ID NO: 15135 - protein, 9 aa, Borrelia burgdorferi
SKVKNFIFY

SEQ ID NO: 15136 - protein, 9 aa, Borrelia burgdorferi
KVKNFIFYV

SEQ ID NO: 15137 - protein, 9 aa, Borrelia burgdorferi
VKNFIFYVK

SEQ ID NO: 15138 - protein, 9 aa, Borrelia burgdorferi
KNFIFYVKD

SEQ ID NO: 15139 - protein, 9 aa, Borrelia burgdorferi
NFIFYVKDL

SEQ ID NO: 15140 - protein, 9 aa, Borrelia burgdorferi
FIFYVKDLR

SEQ ID NO: 15141 - protein, 9 aa, Borrelia burgdorferi
IFYVKDLRV

SEQ ID NO: 15142 - protein, 9 aa, Borrelia burgdorferi
FYVKDLRVL

SEQ ID NO: 15143 - protein, 9 aa, Borrelia burgdorferi
YVKDLRVLY

SEQ ID NO: 15144 - protein, 9 aa, Borrelia burgdorferi
VKDLRVLYD

SEQ ID NO: 15145 - protein, 9 aa, Borrelia burgdorferi
KDLRVLYDK

SEQ ID NO: 15146 - protein, 9 aa, Borrelia burgdorferi
DLRVLYDKL

SEQ ID NO: 15147 - protein, 9 aa, Borrelia burgdorferi
LRVLYDKLS

SEQ ID NO: 15148 - protein, 9 aa, Borrelia burgdorferi
RVLYDKLSV

SEQ ID NO: 15149 - protein, 9 aa, Borrelia burgdorferi
VLYDKLSVS

SEQ ID NO: 15150 - protein, 9 aa, Borrelia burgdorferi
LYDKLSVSI

SEQ ID NO: 15151 - protein, 9 aa, Borrelia burgdorferi
YDKLSVSID

SEQ ID NO: 15152 - protein, 9 aa, Borrelia burgdorferi
DKLSVSIDS

SEQ ID NO: 15153 - protein, 9 aa, Borrelia burgdorferi
KLSVSIDSD

SEQ ID NO: 15154 - protein, 9 aa, Borrelia burgdorferi
LSVSIDSDI

SEQ ID NO: 15155 - protein, 9 aa, Borrelia burgdorferi
SVSIDSDID

SEQ ID NO: 15156 - protein, 9 aa, Borrelia burgdorferi
VSIDSDIDS

SEQ ID NO: 15157 - protein, 9 aa, Borrelia burgdorferi
SIDSDIDSE

SEQ ID NO: 15158 - protein, 9 aa, Borrelia burgdorferi
IDSDIDSES

SEQ ID NO: 15159 - protein, 9 aa, Borrelia burgdorferi
DSDIDSESV

SEQ ID NO: 15160 - protein, 9 aa, Borrelia burgdorferi
SDIDSESVF

SEQ ID NO: 15161 - protein, 9 aa, Borrelia burgdorferi
DIDSESVFK

SEQ ID NO: 15162 - protein, 9 aa, Borrelia burgdorferi
IDSESVFKV

SEQ ID NO: 15163 - protein, 9 aa, Borrelia burgdorferi
DSESVFKVY

SEQ ID NO: 15164 - protein, 9 aa, Borrelia burgdorferi
SESVFKVYE

SEQ ID NO: 15165 - protein, 9 aa, Borrelia burgdorferi
ESVFKVYET

SEQ ID NO: 15166 - protein, 9 aa, Borrelia burgdorferi
SVFKVYETS

SEQ ID NO: 15167 - protein, 9 aa, Borrelia burgdorferi
VFKVYETSG

SEQ ID NO: 15168 - protein, 9 aa, Borrelia burgdorferi
FKVYETSGT

SEQ ID NO: 15169 - protein, 9 aa, Borrelia burgdorferi
KVYETSGTE

SEQ ID NO: 15170 - protein, 9 aa, Borrelia burgdorferi
VYETSGTES

SEQ ID NO: 15171 - protein, 9 aa, Borrelia burgdorferi
YETSGTESL

SEQ ID NO: 15172 - protein, 9 aa, Borrelia burgdorferi
ETSGTESLR

SEQ ID NO: 15173 - protein, 9 aa, Borrelia burgdorferi
TSGTESLRK

SEQ ID NO: 15174 - protein, 9 aa, Borrelia burgdorferi
SGTESLRKL

SEQ ID NO: 15175 - protein, 9 aa, Borrelia burgdorferi
GTESLRKLK

SEQ ID NO: 15176 - protein, 9 aa, Borrelia burgdorferi
TESLRKLKA

SEQ ID NO: 15177 - protein, 9 aa, Borrelia burgdorferi
ESLRKLKAH

SEQ ID NO: 15178 - protein, 9 aa, Borrelia burgdorferi
SLRKLKAHE

SEQ ID NO: 15179 - protein, 9 aa, Borrelia burgdorferi
LRKLKAHET

SEQ ID NO: 15180 - protein, 9 aa, Borrelia burgdorferi
RKLKAHETF

SEQ ID NO: 15181 - protein, 9 aa, Borrelia burgdorferi
KLKAHETFK

SEQ ID NO: 15182 - protein, 9 aa, Borrelia burgdorferi
LKAHETFKR

SEQ ID NO: 15183 - protein, 9 aa, Borrelia burgdorferi
KAHETFKRV

SEQ ID NO: 15184 - protein, 9 aa, Borrelia burgdorferi
AHETFKRVL

SEQ ID NO: 15185 - protein, 9 aa, Borrelia burgdorferi
HETFKRVLK

SEQ ID NO: 15186 - protein, 9 aa, Borrelia burgdorferi
ETFKRVLKL

SEQ ID NO: 15187 - protein, 9 aa, Borrelia burgdorferi
TFKRVLKLR

SEQ ID NO: 15188 - protein, 9 aa, Borrelia burgdorferi
FKRVLKLRE

SEQ ID NO: 15189 - protein, 9 aa, Borrelia burgdorferi
KRVLKLREK

SEQ ID NO: 15190 - protein, 9 aa, Borrelia burgdorferi
RVLKLREKI

SEQ ID NO: 15191 - protein, 9 aa, Borrelia burgdorferi
VLKLREKIS

SEQ ID NO: 15192 - protein, 9 aa, Borrelia burgdorferi
LKLREKISI

SEQ ID NO: 15193 - protein, 9 aa, Borrelia burgdorferi
KLREKISIA

SEQ ID NO: 15194 - protein, 9 aa, Borrelia burgdorferi
LREKISIAE

SEQ ID NO: 15195 - protein, 9 aa, Borrelia burgdorferi
REKISIAEG

SEQ ID NO: 15196 - protein, 9 aa, Borrelia burgdorferi
EKISIAEGS

SEQ ID NO: 15197 - protein, 9 aa, Borrelia burgdorferi
KISIAEGSF

SEQ ID NO: 15198 - protein, 9 aa, Borrelia burgdorferi
ISIAEGSFQ

SEQ ID NO: 15199 - protein, 9 aa, Borrelia burgdorferi
SIAEGSFQN

SEQ ID NO: 15200 - protein, 9 aa, Borrelia burgdorferi
IAEGSFQNF

SEQ ID NO: 15201 - protein, 9 aa, Borrelia burgdorferi
AEGSFQNFV

SEQ ID NO: 15202 - protein, 9 aa, Borrelia burgdorferi
EGSFQNFVE

SEQ ID NO: 15203 - protein, 9 aa, Borrelia burgdorferi
GSFQNFVEK

SEQ ID NO: 15204 - protein, 9 aa, Borrelia burgdorferi
SFQNFVEKI

SEQ ID NO: 15205 - protein, 9 aa, Borrelia burgdorferi
FQNFVEKIE

SEQ ID NO: 15206 - protein, 9 aa, Borrelia burgdorferi
QNFVEKIES

SEQ ID NO: 15207 - protein, 9 aa, Borrelia burgdorferi
NFVEKIESE

SEQ ID NO: 15208 - protein, 9 aa, Borrelia burgdorferi
FVEKIESEK

SEQ ID NO: 15209 - protein, 9 aa, Borrelia burgdorferi
VEKIESEKP

SEQ ID NO: 15210 - protein, 9 aa, Borrelia burgdorferi
EKIESEKPE

SEQ ID NO: 15211 - protein, 9 aa, Borrelia burgdorferi
KIESEKPEE

SEQ ID NO: 15212 - protein, 9 aa, Borrelia burgdorferi
IESEKPEES

SEQ ID NO: 15213 - protein, 9 aa, Borrelia burgdorferi
ESEKPEESS

SEQ ID NO: 15214 - protein, 9 aa, Borrelia burgdorferi
SEKPEESSP

SEQ ID NO: 15215 - protein, 9 aa, Borrelia burgdorferi
EKPEESSPK

SEQ ID NO: 15216 - protein, 9 aa, Borrelia burgdorferi
KPEESSPKN

SEQ ID NO: 15217 - protein, 10 aa, Borrelia burgdorferi
MKRKAKSILF

SEQ ID NO: 15218 - protein, 10 aa, Borrelia burgdorferi
KRKAKSILFF

SEQ ID NO: 15219 - protein, 10 aa, Borrelia burgdorferi
RKAKSILFFL

SEQ ID NO: 15220 - protein, 10 aa, Borrelia burgdorferi
KAKSILFFLL

SEQ ID NO: 15221 - protein, 10 aa, Borrelia burgdorferi
AKSILFFLLS

SEQ ID NO: 15222 - protein, 10 aa, Borrelia burgdorferi
KSILFFLLST

SEQ ID NO: 15223 - protein, 10 aa, Borrelia burgdorferi
SILFFLLSTV

SEQ ID NO: 15224 - protein, 10 aa, Borrelia burgdorferi
ILFFLLSTVL

SEQ ID NO: 15225 - protein, 10 aa, Borrelia burgdorferi
LFFLLSTVLF

SEQ ID NO: 15226 - protein, 10 aa, Borrelia burgdorferi
FFLLSTVLFA

SEQ ID NO: 15227 - protein, 10 aa, Borrelia burgdorferi
FLLSTVLFAQ

SEQ ID NO: 15228 - protein, 10 aa, Borrelia burgdorferi
LLSTVLFAQE

SEQ ID NO: 15229 - protein, 10 aa, Borrelia burgdorferi
LSTVLFAQET

SEQ ID NO: 15230 - protein, 10 aa, Borrelia burgdorferi
STVLFAQETD

SEQ ID NO: 15231 - protein, 10 aa, Borrelia burgdorferi
TVLFAQETDG

SEQ ID NO: 15232 - protein, 10 aa, Borrelia burgdorferi
VLFAQETDGL

SEQ ID NO: 15233 - protein, 10 aa, Borrelia burgdorferi
LFAQETDGLA

SEQ ID NO: 15234 - protein, 10 aa, Borrelia burgdorferi
FAQETDGLAE

SEQ ID NO: 15235 - protein, 10 aa, Borrelia burgdorferi
AQETDGLAEG

SEQ ID NO: 15236 - protein, 10 aa, Borrelia burgdorferi
QETDGLAEGS

SEQ ID NO: 15237 - protein, 10 aa, Borrelia burgdorferi
ETDGLAEGSK

SEQ ID NO: 15238 - protein, 10 aa, Borrelia burgdorferi
TDGLAEGSKR

SEQ ID NO: 15239 - protein, 10 aa, Borrelia burgdorferi
DGLAEGSKRA

SEQ ID NO: 15240 - protein, 10 aa, Borrelia burgdorferi
GLAEGSKRAE

SEQ ID NO: 15241 - protein, 10 aa, Borrelia burgdorferi
LAEGSKRAEP

SEQ ID NO: 15242 - protein, 10 aa, Borrelia burgdorferi
AEGSKRAEPG

SEQ ID NO: 15243 - protein, 10 aa, Borrelia burgdorferi
EGSKRAEPGE

SEQ ID NO: 15244 - protein, 10 aa, Borrelia burgdorferi
GSKRAEPGEL

SEQ ID NO: 15245 - protein, 10 aa, Borrelia burgdorferi
SKRAEPGELV

SEQ ID NO: 15246 - protein, 10 aa, Borrelia burgdorferi
KRAEPGELVL

SEQ ID NO: 15247 - protein, 10 aa, Borrelia burgdorferi
RAEPGELVLD

SEQ ID NO: 15248 - protein, 10 aa, Borrelia burgdorferi
AEPGELVLDF

SEQ ID NO: 15249 - protein, 10 aa, Borrelia burgdorferi
EPGELVLDFA

SEQ ID NO: 15250 - protein, 10 aa, Borrelia burgdorferi
PGELVLDFAE

SEQ ID NO: 15251 - protein, 10 aa, Borrelia burgdorferi
GELVLDFAEL

SEQ ID NO: 15252 - protein, 10 aa, Borrelia burgdorferi
ELVLDFAELA

SEQ ID NO: 15253 - protein, 10 aa, Borrelia burgdorferi
LVLDFAELAR

SEQ ID NO: 15254 - protein, 10 aa, Borrelia burgdorferi
VLDFAELARD

SEQ ID NO: 15255 - protein, 10 aa, Borrelia burgdorferi
LDFAELARDP

SEQ ID NO: 15256 - protein, 10 aa, Borrelia burgdorferi
DFAELARDPS

SEQ ID NO: 15257 - protein, 10 aa, Borrelia burgdorferi
FAELARDPSS

SEQ ID NO: 15258 - protein, 10 aa, Borrelia burgdorferi
AELARDPSST

SEQ ID NO: 15259 - protein, 10 aa, Borrelia burgdorferi
ELARDPSSTR

SEQ ID NO: 15260 - protein, 10 aa, Borrelia burgdorferi
LARDPSSTRL

SEQ ID NO: 15261 - protein, 10 aa, Borrelia burgdorferi
ARDPSSTRLD

SEQ ID NO: 15262 - protein, 10 aa, Borrelia burgdorferi
RDPSSTRLDL

SEQ ID NO: 15263 - protein, 10 aa, Borrelia burgdorferi
DPSSTRLDLT

SEQ ID NO: 15264 - protein, 10 aa, Borrelia burgdorferi
PSSTRLDLTN

SEQ ID NO: 15265 - protein, 10 aa, Borrelia burgdorferi
SSTRLDLTNY

SEQ ID NO: 15266 - protein, 10 aa, Borrelia burgdorferi
STRLDLTNYV

SEQ ID NO: 15267 - protein, 10 aa, Borrelia burgdorferi
TRLDLTNYVD

SEQ ID NO: 15268 - protein, 10 aa, Borrelia burgdorferi
RLDLTNYVDY

SEQ ID NO: 15269 - protein, 10 aa, Borrelia burgdorferi
LDLTNYVDYV

SEQ ID NO: 15270 - protein, 10 aa, Borrelia burgdorferi
DLTNYVDYVY

SEQ ID NO: 15271 - protein, 10 aa, Borrelia burgdorferi
LTNYVDYVYS

SEQ ID NO: 15272 - protein, 10 aa, Borrelia burgdorferi
TNYVDYVYSG

SEQ ID NO: 15273 - protein, 10 aa, Borrelia burgdorferi
NYVDYVYSGA

SEQ ID NO: 15274 - protein, 10 aa, Borrelia burgdorferi
YVDYVYSGAS

SEQ ID NO: 15275 - protein, 10 aa, Borrelia burgdorferi
VDYVYSGASG

SEQ ID NO: 15276 - protein, 10 aa, Borrelia burgdorferi
DYVYSGASGI

SEQ ID NO: 15277 - protein, 10 aa, Borrelia burgdorferi
YVYSGASGIV

SEQ ID NO: 15278 - protein, 10 aa, Borrelia burgdorferi
VYSGASGIVK

SEQ ID NO: 15279 - protein, 10 aa, Borrelia burgdorferi
YSGASGIVKP

SEQ ID NO: 15280 - protein, 10 aa, Borrelia burgdorferi
SGASGIVKPE

SEQ ID NO: 15281 - protein, 10 aa, Borrelia burgdorferi
GASGIVKPED

SEQ ID NO: 15282 - protein, 10 aa, Borrelia burgdorferi
ASGIVKPEDM

SEQ ID NO: 15283 - protein, 10 aa, Borrelia burgdorferi
SGIVKPEDMV

SEQ ID NO: 15284 - protein, 10 aa, Borrelia burgdorferi
GIVKPEDMVV

SEQ ID NO: 15285 - protein, 10 aa, Borrelia burgdorferi
IVKPEDMVVD

SEQ ID NO: 15286 - protein, 10 aa, Borrelia burgdorferi
VKPEDMVVDL

SEQ ID NO: 15287 - protein, 10 aa, Borrelia burgdorferi
KPEDMVVDLG

SEQ ID NO: 15288 - protein, 10 aa, Borrelia burgdorferi
PEDMVVDLGI

SEQ ID NO: 15289 - protein, 10 aa, Borrelia burgdorferi
EDMVVDLGIN

SEQ ID NO: 15290 - protein, 10 aa, Borrelia burgdorferi
DMVVDLGINN

SEQ ID NO: 15291 - protein, 10 aa, Borrelia burgdorferi
MVVDLGINNW

SEQ ID NO: 15292 - protein, 10 aa, Borrelia burgdorferi
VVDLGINNWS

SEQ ID NO: 15293 - protein, 10 aa, Borrelia burgdorferi
VDLGINNWSV

SEQ ID NO: 15294 - protein, 10 aa, Borrelia burgdorferi
DLGINNWSVL

SEQ ID NO: 15295 - protein, 10 aa, Borrelia burgdorferi
LGINNWSVLL

SEQ ID NO: 15296 - protein, 10 aa, Borrelia burgdorferi
GINNWSVLLT

SEQ ID NO: 15297 - protein, 10 aa, Borrelia burgdorferi
INNWSVLLTP

SEQ ID NO: 15298 - protein, 10 aa, Borrelia burgdorferi
NNWSVLLTPS

SEQ ID NO: 15299 - protein, 10 aa, Borrelia burgdorferi
NWSVLLTPSA

SEQ ID NO: 15300 - protein, 10 aa, Borrelia burgdorferi
WSVLLTPSAR

SEQ ID NO: 15301 - protein, 10 aa, Borrelia burgdorferi
SVLLTPSARL

SEQ ID NO: 15302 - protein, 10 aa, Borrelia burgdorferi
VLLTPSARLQ

SEQ ID NO: 15303 - protein, 10 aa, Borrelia burgdorferi
LLTPSARLQA

SEQ ID NO: 15304 - protein, 10 aa, Borrelia burgdorferi
LTPSARLQAY

SEQ ID NO: 15305 - protein, 10 aa, Borrelia burgdorferi
TPSARLQAYV

SEQ ID NO: 15306 - protein, 10 aa, Borrelia burgdorferi
PSARLQAYVK

SEQ ID NO: 15307 - protein, 10 aa, Borrelia burgdorferi
SARLQAYVKN

SEQ ID NO: 15308 - protein, 10 aa, Borrelia burgdorferi
ARLQAYVKNS

SEQ ID NO: 15309 - protein, 10 aa, Borrelia burgdorferi
RLQAYVKNSV

SEQ ID NO: 15310 - protein, 10 aa, Borrelia burgdorferi
LQAYVKNSVV

SEQ ID NO: 15311 - protein, 10 aa, Borrelia burgdorferi
QAYVKNSVVA

SEQ ID NO: 15312 - protein, 10 aa, Borrelia burgdorferi
AYVKNSVVAP

SEQ ID NO: 15313 - protein, 10 aa, Borrelia burgdorferi
YVKNSVVAPA

SEQ ID NO: 15314 - protein, 10 aa, Borrelia burgdorferi
VKNSVVAPAV

SEQ ID NO: 15315 - protein, 10 aa, Borrelia burgdorferi
KNSVVAPAVV

SEQ ID NO: 15316 - protein, 10 aa, Borrelia burgdorferi
NSVVAPAVVK

SEQ ID NO: 15317 - protein, 10 aa, Borrelia burgdorferi
SVVAPAVVKS

SEQ ID NO: 15318 - protein, 10 aa, Borrelia burgdorferi
VVAPAVVKSE

SEQ ID NO: 15319 - protein, 10 aa, Borrelia burgdorferi
VAPAVVKSES

SEQ ID NO: 15320 - protein, 10 aa, Borrelia burgdorferi
APAVVKSESK

SEQ ID NO: 15321 - protein, 10 aa, Borrelia burgdorferi
PAVVKSESKR

SEQ ID NO: 15322 - protein, 10 aa, Borrelia burgdorferi
AVVKSESKRY

SEQ ID NO: 15323 - protein, 10 aa, Borrelia burgdorferi
VVKSESKRYA

SEQ ID NO: 15324 - protein, 10 aa, Borrelia burgdorferi
VKSESKRYAG

SEQ ID NO: 15325 - protein, 10 aa, Borrelia burgdorferi
KSESKRYAGD

SEQ ID NO: 15326 - protein, 10 aa, Borrelia burgdorferi
SESKRYAGDT

SEQ ID NO: 15327 - protein, 10 aa, Borrelia burgdorferi
ESKRYAGDTI

SEQ ID NO: 15328 - protein, 10 aa, Borrelia burgdorferi
SKRYAGDTIL

SEQ ID NO: 15329 - protein, 10 aa, Borrelia burgdorferi
KRYAGDTILG

SEQ ID NO: 15330 - protein, 10 aa, Borrelia burgdorferi
RYAGDTILGV

SEQ ID NO: 15331 - protein, 10 aa, Borrelia burgdorferi
YAGDTILGVR

SEQ ID NO: 15332 - protein, 10 aa, Borrelia burgdorferi
AGDTILGVRV

SEQ ID NO: 15333 - protein, 10 aa, Borrelia burgdorferi
GDTILGVRVL

SEQ ID NO: 15334 - protein, 10 aa, Borrelia burgdorferi
DTILGVRVLF

SEQ ID NO: 15335 - protein, 10 aa, Borrelia burgdorferi
TILGVRVLFP

SEQ ID NO: 15336 - protein, 10 aa, Borrelia burgdorferi
ILGVRVLFPS

SEQ ID NO: 15337 - protein, 10 aa, Borrelia burgdorferi
LGVRVLFPSY

SEQ ID NO: 15338 - protein, 10 aa, Borrelia burgdorferi
GVRVLFPSYS

SEQ ID NO: 15339 - protein, 10 aa, Borrelia burgdorferi
VRVLFPSYSQ

SEQ ID NO: 15340 - protein, 10 aa, Borrelia burgdorferi
RVLFPSYSQS

SEQ ID NO: 15341 - protein, 10 aa, Borrelia burgdorferi
VLFPSYSQSS

SEQ ID NO: 15342 - protein, 10 aa, Borrelia burgdorferi
LFPSYSQSSA

SEQ ID NO: 15343 - protein, 10 aa, Borrelia burgdorferi
FPSYSQSSAM

SEQ ID NO: 15344 - protein, 10 aa, Borrelia burgdorferi
PSYSQSSAMI

SEQ ID NO: 15345 - protein, 10 aa, Borrelia burgdorferi
SYSQSSAMIM

SEQ ID NO: 15346 - protein, 10 aa, Borrelia burgdorferi
YSQSSAMIMP

SEQ ID NO: 15347 - protein, 10 aa, Borrelia burgdorferi
SQSSAMIMPP

SEQ ID NO: 15348 - protein, 10 aa, Borrelia burgdorferi
QSSAMIMPPF

SEQ ID NO: 15349 - protein, 10 aa, Borrelia burgdorferi
SSAMIMPPFK

SEQ ID NO: 15350 - protein, 10 aa, Borrelia burgdorferi
SAMIMPPFKI

SEQ ID NO: 15351 - protein, 10 aa, Borrelia burgdorferi
AMIMPPFKIP

SEQ ID NO: 15352 - protein, 10 aa, Borrelia burgdorferi
MIMPPFKIPF

SEQ ID NO: 15353 - protein, 10 aa, Borrelia burgdorferi
IMPPFKIPFY

SEQ ID NO: 15354 - protein, 10 aa, Borrelia burgdorferi
MPPFKIPFYS

SEQ ID NO: 15355 - protein, 10 aa, Borrelia burgdorferi
PPFKIPFYSG

SEQ ID NO: 15356 - protein, 10 aa, Borrelia burgdorferi
PFKIPFYSGE

SEQ ID NO: 15357 - protein, 10 aa, Borrelia burgdorferi
FKIPFYSGES

SEQ ID NO: 15358 - protein, 10 aa, Borrelia burgdorferi
KIPFYSGESG

SEQ ID NO: 15359 - protein, 10 aa, Borrelia burgdorferi
IPFYSGESGN

SEQ ID NO: 15360 - protein, 10 aa, Borrelia burgdorferi
PFYSGESGNQ

SEQ ID NO: 15361 - protein, 10 aa, Borrelia burgdorferi
FYSGESGNQF

SEQ ID NO: 15362 - protein, 10 aa, Borrelia burgdorferi
YSGESGNQFL

SEQ ID NO: 15363 - protein, 10 aa, Borrelia burgdorferi
SGESGNQFLG

SEQ ID NO: 15364 - protein, 10 aa, Borrelia burgdorferi
GESGNQFLGK

SEQ ID NO: 15365 - protein, 10 aa, Borrelia burgdorferi
ESGNQFLGKG

SEQ ID NO: 15366 - protein, 10 aa, Borrelia burgdorferi
SGNQFLGKGL

SEQ ID NO: 15367 - protein, 10 aa, Borrelia burgdorferi
GNQFLGKGLI

SEQ ID NO: 15368 - protein, 10 aa, Borrelia burgdorferi
NQFLGKGLID

SEQ ID NO: 15369 - protein, 10 aa, Borrelia burgdorferi
QFLGKGLIDN

SEQ ID NO: 15370 - protein, 10 aa, Borrelia burgdorferi
FLGKGLIDNI

SEQ ID NO: 15371 - protein, 10 aa, Borrelia burgdorferi
LGKGLIDNIK

SEQ ID NO: 15372 - protein, 10 aa, Borrelia burgdorferi
GKGLIDNIKT

SEQ ID NO: 15373 - protein, 10 aa, Borrelia burgdorferi
KGLIDNIKTM

SEQ ID NO: 15374 - protein, 10 aa, Borrelia burgdorferi
GLIDNIKTMK

SEQ ID NO: 15375 - protein, 10 aa, Borrelia burgdorferi
LIDNIKTMKE

SEQ ID NO: 15376 - protein, 10 aa, Borrelia burgdorferi
IDNIKTMKEI

SEQ ID NO: 15377 - protein, 10 aa, Borrelia burgdorferi
DNIKTMKEIK

SEQ ID NO: 15378 - protein, 10 aa, Borrelia burgdorferi
NIKTMKEIKV

SEQ ID NO: 15379 - protein, 10 aa, Borrelia burgdorferi
IKTMKEIKVS

SEQ ID NO: 15380 - protein, 10 aa, Borrelia burgdorferi
KTMKEIKVSV

SEQ ID NO: 15381 - protein, 10 aa, Borrelia burgdorferi
TMKEIKVSVY

SEQ ID NO: 15382 - protein, 10 aa, Borrelia burgdorferi
MKEIKVSVYS

SEQ ID NO: 15383 - protein, 10 aa, Borrelia burgdorferi
KEIKVSVYSL

SEQ ID NO: 15384 - protein, 10 aa, Borrelia burgdorferi
EIKVSVYSLG

SEQ ID NO: 15385 - protein, 10 aa, Borrelia burgdorferi
IKVSVYSLGY

SEQ ID NO: 15386 - protein, 10 aa, Borrelia burgdorferi
KVSVYSLGYE

SEQ ID NO: 15387 - protein, 10 aa, Borrelia burgdorferi
VSVYSLGYEI

SEQ ID NO: 15388 - protein, 10 aa, Borrelia burgdorferi
SVYSLGYEID

SEQ ID NO: 15389 - protein, 10 aa, Borrelia burgdorferi
VYSLGYEIDL

SEQ ID NO: 15390 - protein, 10 aa, Borrelia burgdorferi
YSLGYEIDLE

SEQ ID NO: 15391 - protein, 10 aa, Borrelia burgdorferi
SLGYEIDLEV

SEQ ID NO: 15392 - protein, 10 aa, Borrelia burgdorferi
LGYEIDLEVL

SEQ ID NO: 15393 - protein, 10 aa, Borrelia burgdorferi
GYEIDLEVLF

SEQ ID NO: 15394 - protein, 10 aa, Borrelia burgdorferi
YEIDLEVLFE

SEQ ID NO: 15395 - protein, 10 aa, Borrelia burgdorferi
EIDLEVLFED

SEQ ID NO: 15396 - protein, 10 aa, Borrelia burgdorferi
IDLEVLFEDM

SEQ ID NO: 15397 - protein, 10 aa, Borrelia burgdorferi
DLEVLFEDMN

SEQ ID NO: 15398 - protein, 10 aa, Borrelia burgdorferi
LEVLFEDMNG

SEQ ID NO: 15399 - protein, 10 aa, Borrelia burgdorferi
EVLFEDMNGM

SEQ ID NO: 15400 - protein, 10 aa, Borrelia burgdorferi
VLFEDMNGME

SEQ ID NO: 15401 - protein, 10 aa, Borrelia burgdorferi
LFEDMNGMEY

SEQ ID NO: 15402 - protein, 10 aa, Borrelia burgdorferi
FEDMNGMEYA

SEQ ID NO: 15403 - protein, 10 aa, Borrelia burgdorferi
EDMNGMEYAY

SEQ ID NO: 15404 - protein, 10 aa, Borrelia burgdorferi
DMNGMEYAYS

SEQ ID NO: 15405 - protein, 10 aa, Borrelia burgdorferi
MNGMEYAYSM

SEQ ID NO: 15406 - protein, 10 aa, Borrelia burgdorferi
NGMEYAYSMG

SEQ ID NO: 15407 - protein, 10 aa, Borrelia burgdorferi
GMEYAYSMGT

SEQ ID NO: 15408 - protein, 10 aa, Borrelia burgdorferi
MEYAYSMGTL

SEQ ID NO: 15409 - protein, 10 aa, Borrelia burgdorferi
EYAYSMGTLK

SEQ ID NO: 15410 - protein, 10 aa, Borrelia burgdorferi
YAYSMGTLKF

SEQ ID NO: 15411 - protein, 10 aa, Borrelia burgdorferi
AYSMGTLKFK

SEQ ID NO: 15412 - protein, 10 aa, Borrelia burgdorferi
YSMGTLKFKG

SEQ ID NO: 15413 - protein, 10 aa, Borrelia burgdorferi
SMGTLKFKGW

SEQ ID NO: 15414 - protein, 10 aa, Borrelia burgdorferi
MGTLKFKGWA

SEQ ID NO: 15415 - protein, 10 aa, Borrelia burgdorferi
GTLKFKGWAD

SEQ ID NO: 15416 - protein, 10 aa, Borrelia burgdorferi
TLKFKGWADL

SEQ ID NO: 15417 - protein, 10 aa, Borrelia burgdorferi
LKFKGWADLI

SEQ ID NO: 15418 - protein, 10 aa, Borrelia burgdorferi
KFKGWADLIW

SEQ ID NO: 15419 - protein, 10 aa, Borrelia burgdorferi
FKGWADLIWS

SEQ ID NO: 15420 - protein, 10 aa, Borrelia burgdorferi
KGWADLIWSN

SEQ ID NO: 15421 - protein, 10 aa, Borrelia burgdorferi
GWADLIWSNP

SEQ ID NO: 15422 - protein, 10 aa, Borrelia burgdorferi
WADLIWSNPN

SEQ ID NO: 15423 - protein, 10 aa, Borrelia burgdorferi
ADLIWSNPNY

SEQ ID NO: 15424 - protein, 10 aa, Borrelia burgdorferi
DLIWSNPNYI

SEQ ID NO: 15425 - protein, 10 aa, Borrelia burgdorferi
LIWSNPNYIP

SEQ ID NO: 15426 - protein, 10 aa, Borrelia burgdorferi
IWSNPNYIPN

SEQ ID NO: 15427 - protein, 10 aa, Borrelia burgdorferi
WSNPNYIPNI

SEQ ID NO: 15428 - protein, 10 aa, Borrelia burgdorferi
SNPNYIPNIS

SEQ ID NO: 15429 - protein, 10 aa, Borrelia burgdorferi
NPNYIPNISS

SEQ ID NO: 15430 - protein, 10 aa, Borrelia burgdorferi
PNYIPNISSR

SEQ ID NO: 15431 - protein, 10 aa, Borrelia burgdorferi
NYIPNISSRI

SEQ ID NO: 15432 - protein, 10 aa, Borrelia burgdorferi
YIPNISSRII

SEQ ID NO: 15433 - protein, 10 aa, Borrelia burgdorferi
IPNISSRIIK

SEQ ID NO: 15434 - protein, 10 aa, Borrelia burgdorferi
PNISSRIIKD

SEQ ID NO: 15435 - protein, 10 aa, Borrelia burgdorferi
NISSRIIKDD

SEQ ID NO: 15436 - protein, 10 aa, Borrelia burgdorferi
ISSRIIKDDV

SEQ ID NO: 15437 - protein, 10 aa, Borrelia burgdorferi
SSRIIKDDVP

SEQ ID NO: 15438 - protein, 10 aa, Borrelia burgdorferi
SRIIKDDVPN

SEQ ID NO: 15439 - protein, 10 aa, Borrelia burgdorferi
RIIKDDVPNY

SEQ ID NO: 15440 - protein, 10 aa, Borrelia burgdorferi
IIKDDVPNYP

SEQ ID NO: 15441 - protein, 10 aa, Borrelia burgdorferi
IKDDVPNYPL

SEQ ID NO: 15442 - protein, 10 aa, Borrelia burgdorferi
KDDVPNYPLA

SEQ ID NO: 15443 - protein, 10 aa, Borrelia burgdorferi
DDVPNYPLAS

SEQ ID NO: 15444 - protein, 10 aa, Borrelia burgdorferi
DVPNYPLASS

SEQ ID NO: 15445 - protein, 10 aa, Borrelia burgdorferi
VPNYPLASSK

SEQ ID NO: 15446 - protein, 10 aa, Borrelia burgdorferi
PNYPLASSKM

SEQ ID NO: 15447 - protein, 10 aa, Borrelia burgdorferi
NYPLASSKMR

SEQ ID NO: 15448 - protein, 10 aa, Borrelia burgdorferi
YPLASSKMRF

SEQ ID NO: 15449 - protein, 10 aa, Borrelia burgdorferi
PLASSKMRFK

SEQ ID NO: 15450 - protein, 10 aa, Borrelia burgdorferi
LASSKMRFKA

SEQ ID NO: 15451 - protein, 10 aa, Borrelia burgdorferi
ASSKMRFKAF

SEQ ID NO: 15452 - protein, 10 aa, Borrelia burgdorferi
SSKMRFKAFR

SEQ ID NO: 15453 - protein, 10 aa, Borrelia burgdorferi
SKMRFKAFRV

SEQ ID NO: 15454 - protein, 10 aa, Borrelia burgdorferi
KMRFKAFRVS

SEQ ID NO: 15455 - protein, 10 aa, Borrelia burgdorferi
MRFKAFRVSK

SEQ ID NO: 15456 - protein, 10 aa, Borrelia burgdorferi
RFKAFRVSKS

SEQ ID NO: 15457 - protein, 10 aa, Borrelia burgdorferi
FKAFRVSKSH

SEQ ID NO: 15458 - protein, 10 aa, Borrelia burgdorferi
KAFRVSKSHS

SEQ ID NO: 15459 - protein, 10 aa, Borrelia burgdorferi
AFRVSKSHSS

SEQ ID NO: 15460 - protein, 10 aa, Borrelia burgdorferi
FRVSKSHSSK

SEQ ID NO: 15461 - protein, 10 aa, Borrelia burgdorferi
RVSKSHSSKV

SEQ ID NO: 15462 - protein, 10 aa, Borrelia burgdorferi
VSKSHSSKVK

SEQ ID NO: 15463 - protein, 10 aa, Borrelia burgdorferi
SKSHSSKVKN

SEQ ID NO: 15464 - protein, 10 aa, Borrelia burgdorferi
KSHSSKVKNF

SEQ ID NO: 15465 - protein, 10 aa, Borrelia burgdorferi
SHSSKVKNFI

SEQ ID NO: 15466 - protein, 10 aa, Borrelia burgdorferi
HSSKVKNFIF

SEQ ID NO: 15467 - protein, 10 aa, Borrelia burgdorferi
SSKVKNFIFY

SEQ ID NO: 15468 - protein, 10 aa, Borrelia burgdorferi
SKVKNFIFYV

SEQ ID NO: 15469 - protein, 10 aa, Borrelia burgdorferi
KVKNFIFYVK

SEQ ID NO: 15470 - protein, 10 aa, Borrelia burgdorferi
VKNFIFYVKD

SEQ ID NO: 15471 - protein, 10 aa, Borrelia burgdorferi
KNFIFYVKDL

SEQ ID NO: 15472 - protein, 10 aa, Borrelia burgdorferi
NFIFYVKDLR

SEQ ID NO: 15473 - protein, 10 aa, Borrelia burgdorferi
FIFYVKDLRV

SEQ ID NO: 15474 - protein, 10 aa, Borrelia burgdorferi
IFYVKDLRVL

SEQ ID NO: 15475 - protein, 10 aa, Borrelia burgdorferi
FYVKDLRVLY

SEQ ID NO: 15476 - protein, 10 aa, Borrelia burgdorferi
YVKDLRVLYD

SEQ ID NO: 15477 - protein, 10 aa, Borrelia burgdorferi
VKDLRVLYDK

SEQ ID NO: 15478 - protein, 10 aa, Borrelia burgdorferi
KDLRVLYDKL

SEQ ID NO: 15479 - protein, 10 aa, Borrelia burgdorferi
DLRVLYDKLS

SEQ ID NO: 15480 - protein, 10 aa, Borrelia burgdorferi
LRVLYDKLSV

SEQ ID NO: 15481 - protein, 10 aa, Borrelia burgdorferi
RVLYDKLSVS

SEQ ID NO: 15482 - protein, 10 aa, Borrelia burgdorferi
VLYDKLSVSI

SEQ ID NO: 15483 - protein, 10 aa, Borrelia burgdorferi
LYDKLSVSID

SEQ ID NO: 15484 - protein, 10 aa, Borrelia burgdorferi
YDKLSVSIDS

SEQ ID NO: 15485 - protein, 10 aa, Borrelia burgdorferi
DKLSVSIDSD

SEQ ID NO: 15486 - protein, 10 aa, Borrelia burgdorferi
KLSVSIDSDI

SEQ ID NO: 15487 - protein, 10 aa, Borrelia burgdorferi
LSVSIDSDID

SEQ ID NO: 15488 - protein, 10 aa, Borrelia burgdorferi
SVSIDSDIDS

SEQ ID NO: 15489 - protein, 10 aa, Borrelia burgdorferi
VSIDSDIDSE

SEQ ID NO: 15490 - protein, 10 aa, Borrelia burgdorferi
SIDSDIDSES

SEQ ID NO: 15491 - protein, 10 aa, Borrelia burgdorferi
IDSDIDSESV

SEQ ID NO: 15492 - protein, 10 aa, Borrelia burgdorferi
DSDIDSESVF

SEQ ID NO: 15493 - protein, 10 aa, Borrelia burgdorferi
SDIDSESVFK

SEQ ID NO: 15494 - protein, 10 aa, Borrelia burgdorferi
DIDSESVFKV

SEQ ID NO: 15495 - protein, 10 aa, Borrelia burgdorferi
IDSESVFKVY

SEQ ID NO: 15496 - protein, 10 aa, Borrelia burgdorferi
DSESVFKVYE

SEQ ID NO: 15497 - protein, 10 aa, Borrelia burgdorferi
SESVFKVYET

SEQ ID NO: 15498 - protein, 10 aa, Borrelia burgdorferi
ESVFKVYETS

SEQ ID NO: 15499 - protein, 10 aa, Borrelia burgdorferi
SVFKVYETSG

SEQ ID NO: 15500 - protein, 10 aa, Borrelia burgdorferi
VFKVYETSGT

SEQ ID NO: 15501 - protein, 10 aa, Borrelia burgdorferi
FKVYETSGTE

SEQ ID NO: 15502 - protein, 10 aa, Borrelia burgdorferi
KVYETSGTES

SEQ ID NO: 15503 - protein, 10 aa, Borrelia burgdorferi
VYETSGTESL

SEQ ID NO: 15504 - protein, 10 aa, Borrelia burgdorferi
YETSGTESLR

SEQ ID NO: 15505 - protein, 10 aa, Borrelia burgdorferi
ETSGTESLRK

SEQ ID NO: 15506 - protein, 10 aa, Borrelia burgdorferi
TSGTESLRKL

SEQ ID NO: 15507 - protein, 10 aa, Borrelia burgdorferi
SGTESLRKLK

SEQ ID NO: 15508 - protein, 10 aa, Borrelia burgdorferi
GTESLRKLKA

SEQ ID NO: 15509 - protein, 10 aa, Borrelia burgdorferi
TESLRKLKAH

SEQ ID NO: 15510 - protein, 10 aa, Borrelia burgdorferi
ESLRKLKAHE

SEQ ID NO: 15511 - protein, 10 aa, Borrelia burgdorferi
SLRKLKAHET

SEQ ID NO: 15512 - protein, 10 aa, Borrelia burgdorferi
LRKLKAHETF

SEQ ID NO: 15513 - protein, 10 aa, Borrelia burgdorferi
RKLKAHETFK

SEQ ID NO: 15514 - protein, 10 aa, Borrelia burgdorferi
KLKAHETFKR

SEQ ID NO: 15515 - protein, 10 aa, Borrelia burgdorferi
LKAHETFKRV

SEQ ID NO: 15516 - protein, 10 aa, Borrelia burgdorferi
KAHETFKRVL

SEQ ID NO: 15517 - protein, 10 aa, Borrelia burgdorferi
AHETFKRVLK

SEQ ID NO: 15518 - protein, 10 aa, Borrelia burgdorferi
HETFKRVLKL

SEQ ID NO: 15519 - protein, 10 aa, Borrelia burgdorferi
ETFKRVLKLR

SEQ ID NO: 15520 - protein, 10 aa, Borrelia burgdorferi
TFKRVLKLRE

SEQ ID NO: 15521 - protein, 10 aa, Borrelia burgdorferi
FKRVLKLREK

SEQ ID NO: 15522 - protein, 10 aa, Borrelia burgdorferi
KRVLKLREKI

SEQ ID NO: 15523 - protein, 10 aa, Borrelia burgdorferi
RVLKLREKIS

SEQ ID NO: 15524 - protein, 10 aa, Borrelia burgdorferi
VLKLREKISI

SEQ ID NO: 15525 - protein, 10 aa, Borrelia burgdorferi
LKLREKISIA

SEQ ID NO: 15526 - protein, 10 aa, Borrelia burgdorferi
KLREKISIAE

SEQ ID NO: 15527 - protein, 10 aa, Borrelia burgdorferi
LREKISIAEG

SEQ ID NO: 15528 - protein, 10 aa, Borrelia burgdorferi
REKISIAEGS

SEQ ID NO: 15529 - protein, 10 aa, Borrelia burgdorferi
EKISIAEGSF

SEQ ID NO: 15530 - protein, 10 aa, Borrelia burgdorferi
KISIAEGSFQ

SEQ ID NO: 15531 - protein, 10 aa, Borrelia burgdorferi
ISIAEGSFQN

SEQ ID NO: 15532 - protein, 10 aa, Borrelia burgdorferi
SIAEGSFQNF

SEQ ID NO: 15533 - protein, 10 aa, Borrelia burgdorferi
IAEGSFQNFV

SEQ ID NO: 15534 - protein, 10 aa, Borrelia burgdorferi
AEGSFQNFVE

SEQ ID NO: 15535 - protein, 10 aa, Borrelia burgdorferi
EGSFQNFVEK

SEQ ID NO: 15536 - protein, 10 aa, Borrelia burgdorferi
GSFQNFVEKI

SEQ ID NO: 15537 - protein, 10 aa, Borrelia burgdorferi
SFQNFVEKIE

SEQ ID NO: 15538 - protein, 10 aa, Borrelia burgdorferi
FQNFVEKIES

SEQ ID NO: 15539 - protein, 10 aa, Borrelia burgdorferi
QNFVEKIESE

SEQ ID NO: 15540 - protein, 10 aa, Borrelia burgdorferi
NFVEKIESEK

SEQ ID NO: 15541 - protein, 10 aa, Borrelia burgdorferi
FVEKIESEKP

SEQ ID NO: 15542 - protein, 10 aa, Borrelia burgdorferi
VEKIESEKPE

SEQ ID NO: 15543 - protein, 10 aa, Borrelia burgdorferi
EKIESEKPEE

SEQ ID NO: 15544 - protein, 10 aa, Borrelia burgdorferi
KIESEKPEES

SEQ ID NO: 15545 - protein, 10 aa, Borrelia burgdorferi
IESEKPEESS

SEQ ID NO: 15546 - protein, 10 aa, Borrelia burgdorferi
ESEKPEESSP

SEQ ID NO: 15547 - protein, 10 aa, Borrelia burgdorferi
SEKPEESSPK

SEQ ID NO: 15548 - protein, 10 aa, Borrelia burgdorferi
EKPEESSPKN

SEQ ID NO: 15549 - protein, 11 aa, Borrelia burgdorferi
MKRKAKSILFF

SEQ ID NO: 15550 - protein, 11 aa, Borrelia burgdorferi
KRKAKSILFFL

SEQ ID NO: 15551 - protein, 11 aa, Borrelia burgdorferi
RKAKSILFFLL

SEQ ID NO: 15552 - protein, 11 aa, Borrelia burgdorferi
KAKSILFFLLS

SEQ ID NO: 15553 - protein, 11 aa, Borrelia burgdorferi
AKSILFFLLST

SEQ ID NO: 15554 - protein, 11 aa, Borrelia burgdorferi
KSILFFLLSTV

SEQ ID NO: 15555 - protein, 11 aa, Borrelia burgdorferi
SILFFLLSTVL

SEQ ID NO: 15556 - protein, 11 aa, Borrelia burgdorferi
ILFFLLSTVLF

SEQ ID NO: 15557 - protein, 11 aa, Borrelia burgdorferi
LFFLLSTVLFA

SEQ ID NO: 15558 - protein, 11 aa, Borrelia burgdorferi
FFLLSTVLFAQ

SEQ ID NO: 15559 - protein, 11 aa, Borrelia burgdorferi
FLLSTVLFAQE

SEQ ID NO: 15560 - protein, 11 aa, Borrelia burgdorferi
LLSTVLFAQET

SEQ ID NO: 15561 - protein, 11 aa, Borrelia burgdorferi
LSTVLFAQETD

SEQ ID NO: 15562 - protein, 11 aa, Borrelia burgdorferi
STVLFAQETDG

SEQ ID NO: 15563 - protein, 11 aa, Borrelia burgdorferi
TVLFAQETDGL

SEQ ID NO: 15564 - protein, 11 aa, Borrelia burgdorferi
VLFAQETDGLA

SEQ ID NO: 15565 - protein, 11 aa, Borrelia burgdorferi
LFAQETDGLAE

SEQ ID NO: 15566 - protein, 11 aa, Borrelia burgdorferi
FAQETDGLAEG

SEQ ID NO: 15567 - protein, 11 aa, Borrelia burgdorferi
AQETDGLAEGS

SEQ ID NO: 15568 - protein, 11 aa, Borrelia burgdorferi
QETDGLAEGSK

SEQ ID NO: 15569 - protein, 11 aa, Borrelia burgdorferi
ETDGLAEGSKR

SEQ ID NO: 15570 - protein, 11 aa, Borrelia burgdorferi
TDGLAEGSKRA

SEQ ID NO: 15571 - protein, 11 aa, Borrelia burgdorferi
DGLAEGSKRAE

SEQ ID NO: 15572 - protein, 11 aa, Borrelia burgdorferi
GLAEGSKRAEP

SEQ ID NO: 15573 - protein, 11 aa, Borrelia burgdorferi
LAEGSKRAEPG

SEQ ID NO: 15574 - protein, 11 aa, Borrelia burgdorferi
AEGSKRAEPGE

SEQ ID NO: 15575 - protein, 11 aa, Borrelia burgdorferi
EGSKRAEPGEL

SEQ ID NO: 15576 - protein, 11 aa, Borrelia burgdorferi
GSKRAEPGELV

SEQ ID NO: 15577 - protein, 11 aa, Borrelia burgdorferi
SKRAEPGELVL

SEQ ID NO: 15578 - protein, 11 aa, Borrelia burgdorferi
KRAEPGELVLD

SEQ ID NO: 15579 - protein, 11 aa, Borrelia burgdorferi
RAEPGELVLDF

SEQ ID NO: 15580 - protein, 11 aa, Borrelia burgdorferi
AEPGELVLDFA

SEQ ID NO: 15581 - protein, 11 aa, Borrelia burgdorferi
EPGELVLDFAE

SEQ ID NO: 15582 - protein, 11 aa, Borrelia burgdorferi
PGELVLDFAEL

SEQ ID NO: 15583 - protein, 11 aa, Borrelia burgdorferi
GELVLDFAELA

SEQ ID NO: 15584 - protein, 11 aa, Borrelia burgdorferi
ELVLDFAELAR

SEQ ID NO: 15585 - protein, 11 aa, Borrelia burgdorferi
LVLDFAELARD

SEQ ID NO: 15586 - protein, 11 aa, Borrelia burgdorferi
VLDFAELARDP

SEQ ID NO: 15587 - protein, 11 aa, Borrelia burgdorferi
LDFAELARDPS

SEQ ID NO: 15588 - protein, 11 aa, Borrelia burgdorferi
DFAELARDPSS

SEQ ID NO: 15589 - protein, 11 aa, Borrelia burgdorferi
FAELARDPSST

SEQ ID NO: 15590 - protein, 11 aa, Borrelia burgdorferi
AELARDPSSTR

SEQ ID NO: 15591 - protein, 11 aa, Borrelia burgdorferi
ELARDPSSTRL

SEQ ID NO: 15592 - protein, 11 aa, Borrelia burgdorferi
LARDPSSTRLD

SEQ ID NO: 15593 - protein, 11 aa, Borrelia burgdorferi
ARDPSSTRLDL

SEQ ID NO: 15594 - protein, 11 aa, Borrelia burgdorferi
RDPSSTRLDLT

SEQ ID NO: 15595 - protein, 11 aa, Borrelia burgdorferi
DPSSTRLDLTN

SEQ ID NO: 15596 - protein, 11 aa, Borrelia burgdorferi
PSSTRLDLTNY

SEQ ID NO: 15597 - protein, 11 aa, Borrelia burgdorferi
SSTRLDLTNYV

SEQ ID NO: 15598 - protein, 11 aa, Borrelia burgdorferi
STRLDLTNYVD

SEQ ID NO: 15599 - protein, 11 aa, Borrelia burgdorferi
TRLDLTNYVDY

SEQ ID NO: 15600 - protein, 11 aa, Borrelia burgdorferi
RLDLTNYVDYV

SEQ ID NO: 15601 - protein, 11 aa, Borrelia burgdorferi
LDLTNYVDYVY

SEQ ID NO: 15602 - protein, 11 aa, Borrelia burgdorferi
DLTNYVDYVYS

SEQ ID NO: 15603 - protein, 11 aa, Borrelia burgdorferi
LTNYVDYVYSG

SEQ ID NO: 15604 - protein, 11 aa, Borrelia burgdorferi
TNYVDYVYSGA

SEQ ID NO: 15605 - protein, 11 aa, Borrelia burgdorferi
NYVDYVYSGAS

SEQ ID NO: 15606 - protein, 11 aa, Borrelia burgdorferi
YVDYVYSGASG

SEQ ID NO: 15607 - protein, 11 aa, Borrelia burgdorferi
VDYVYSGASGI

SEQ ID NO: 15608 - protein, 11 aa, Borrelia burgdorferi
DYVYSGASGIV

SEQ ID NO: 15609 - protein, 11 aa, Borrelia burgdorferi
YVYSGASGIVK

SEQ ID NO: 15610 - protein, 11 aa, Borrelia burgdorferi
VYSGASGIVKP

SEQ ID NO: 15611 - protein, 11 aa, Borrelia burgdorferi
YSGASGIVKPE

SEQ ID NO: 15612 - protein, 11 aa, Borrelia burgdorferi
SGASGIVKPED

SEQ ID NO: 15613 - protein, 11 aa, Borrelia burgdorferi
GASGIVKPEDM

SEQ ID NO: 15614 - protein, 11 aa, Borrelia burgdorferi
ASGIVKPEDMV

SEQ ID NO: 15615 - protein, 11 aa, Borrelia burgdorferi
SGIVKPEDMVV

SEQ ID NO: 15616 - protein, 11 aa, Borrelia burgdorferi
GIVKPEDMVVD

SEQ ID NO: 15617 - protein, 11 aa, Borrelia burgdorferi
IVKPEDMVVDL

SEQ ID NO: 15618 - protein, 11 aa, Borrelia burgdorferi
VKPEDMVVDLG

SEQ ID NO: 15619 - protein, 11 aa, Borrelia burgdorferi
KPEDMVVDLGI

SEQ ID NO: 15620 - protein, 11 aa, Borrelia burgdorferi
PEDMVVDLGIN

SEQ ID NO: 15621 - protein, 11 aa, Borrelia burgdorferi
EDMVVDLGINN

SEQ ID NO: 15622 - protein, 11 aa, Borrelia burgdorferi
DMVVDLGINNW

SEQ ID NO: 15623 - protein, 11 aa, Borrelia burgdorferi
MVVDLGINNWS

SEQ ID NO: 15624 - protein, 11 aa, Borrelia burgdorferi
VVDLGINNWSV

SEQ ID NO: 15625 - protein, 11 aa, Borrelia burgdorferi
VDLGINNWSVL

SEQ ID NO: 15626 - protein, 11 aa, Borrelia burgdorferi
DLGINNWSVLL

SEQ ID NO: 15627 - protein, 11 aa, Borrelia burgdorferi
LGINNWSVLLT

SEQ ID NO: 15628 - protein, 11 aa, Borrelia burgdorferi
GINNWSVLLTP

SEQ ID NO: 15629 - protein, 11 aa, Borrelia burgdorferi
INNWSVLLTPS

SEQ ID NO: 15630 - protein, 11 aa, Borrelia burgdorferi
NNWSVLLTPSA

SEQ ID NO: 15631 - protein, 11 aa, Borrelia burgdorferi
NWSVLLTPSAR

SEQ ID NO: 15632 - protein, 11 aa, Borrelia burgdorferi
WSVLLTPSARL

SEQ ID NO: 15633 - protein, 11 aa, Borrelia burgdorferi
SVLLTPSARLQ

SEQ ID NO: 15634 - protein, 11 aa, Borrelia burgdorferi
VLLTPSARLQA

SEQ ID NO: 15635 - protein, 11 aa, Borrelia burgdorferi
LLTPSARLQAY

SEQ ID NO: 15636 - protein, 11 aa, Borrelia burgdorferi
LTPSARLQAYV

SEQ ID NO: 15637 - protein, 11 aa, Borrelia burgdorferi
TPSARLQAYVK

SEQ ID NO: 15638 - protein, 11 aa, Borrelia burgdorferi
PSARLQAYVKN

SEQ ID NO: 15639 - protein, 11 aa, Borrelia burgdorferi
SARLQAYVKNS

SEQ ID NO: 15640 - protein, 11 aa, Borrelia burgdorferi
ARLQAYVKNSV

SEQ ID NO: 15641 - protein, 11 aa, Borrelia burgdorferi
RLQAYVKNSVV

SEQ ID NO: 15642 - protein, 11 aa, Borrelia burgdorferi
LQAYVKNSVVA

SEQ ID NO: 15643 - protein, 11 aa, Borrelia burgdorferi
QAYVKNSVVAP

SEQ ID NO: 15644 - protein, 11 aa, Borrelia burgdorferi
AYVKNSVVAPA

SEQ ID NO: 15645 - protein, 11 aa, Borrelia burgdorferi
YVKNSVVAPAV

SEQ ID NO: 15646 - protein, 11 aa, Borrelia burgdorferi
VKNSVVAPAVV

SEQ ID NO: 15647 - protein, 11 aa, Borrelia burgdorferi
KNSVVAPAVVK

SEQ ID NO: 15648 - protein, 11 aa, Borrelia burgdorferi
NSVVAPAVVKS

SEQ ID NO: 15649 - protein, 11 aa, Borrelia burgdorferi
SVVAPAVVKSE

SEQ ID NO: 15650 - protein, 11 aa, Borrelia burgdorferi
VVAPAVVKSES

SEQ ID NO: 15651 - protein, 11 aa, Borrelia burgdorferi
VAPAVVKSESK

SEQ ID NO: 15652 - protein, 11 aa, Borrelia burgdorferi
APAVVKSESKR

SEQ ID NO: 15653 - protein, 11 aa, Borrelia burgdorferi
PAVVKSESKRY

SEQ ID NO: 15654 - protein, 11 aa, Borrelia burgdorferi
AVVKSESKRYA

SEQ ID NO: 15655 - protein, 11 aa, Borrelia burgdorferi
VVKSESKRYAG

SEQ ID NO: 15656 - protein, 11 aa, Borrelia burgdorferi
VKSESKRYAGD

SEQ ID NO: 15657 - protein, 11 aa, Borrelia burgdorferi
KSESKRYAGDT

SEQ ID NO: 15658 - protein, 11 aa, Borrelia burgdorferi
SESKRYAGDTI

SEQ ID NO: 15659 - protein, 11 aa, Borrelia burgdorferi
ESKRYAGDTIL

SEQ ID NO: 15660 - protein, 11 aa, Borrelia burgdorferi
SKRYAGDTILG

SEQ ID NO: 15661 - protein, 11 aa, Borrelia burgdorferi
KRYAGDTILGV

SEQ ID NO: 15662 - protein, 11 aa, Borrelia burgdorferi
RYAGDTILGVR

SEQ ID NO: 15663 - protein, 11 aa, Borrelia burgdorferi
YAGDTILGVRV

SEQ ID NO: 15664 - protein, 11 aa, Borrelia burgdorferi
AGDTILGVRVL

SEQ ID NO: 15665 - protein, 11 aa, Borrelia burgdorferi
GDTILGVRVLF

SEQ ID NO: 15666 - protein, 11 aa, Borrelia burgdorferi
DTILGVRVLFP

SEQ ID NO: 15667 - protein, 11 aa, Borrelia burgdorferi
TILGVRVLFPS

SEQ ID NO: 15668 - protein, 11 aa, Borrelia burgdorferi
ILGVRVLFPSY

SEQ ID NO: 15669 - protein, 11 aa, Borrelia burgdorferi
LGVRVLFPSYS

SEQ ID NO: 15670 - protein, 11 aa, Borrelia burgdorferi
GVRVLFPSYSQ

SEQ ID NO: 15671 - protein, 11 aa, Borrelia burgdorferi
VRVLFPSYSQS

SEQ ID NO: 15672 - protein, 11 aa, Borrelia burgdorferi
RVLFPSYSQSS

SEQ ID NO: 15673 - protein, 11 aa, Borrelia burgdorferi
VLFPSYSQSSA

SEQ ID NO: 15674 - protein, 11 aa, Borrelia burgdorferi
LFPSYSQSSAM

SEQ ID NO: 15675 - protein, 11 aa, Borrelia burgdorferi
FPSYSQSSAMI

SEQ ID NO: 15676 - protein, 11 aa, Borrelia burgdorferi
PSYSQSSAMIM

SEQ ID NO: 15677 - protein, 11 aa, Borrelia burgdorferi
SYSQSSAMIMP

SEQ ID NO: 15678 - protein, 11 aa, Borrelia burgdorferi
YSQSSAMIMPP

SEQ ID NO: 15679 - protein, 11 aa, Borrelia burgdorferi
SQSSAMIMPPF

SEQ ID NO: 15680 - protein, 11 aa, Borrelia burgdorferi
QSSAMIMPPFK

SEQ ID NO: 15681 - protein, 11 aa, Borrelia burgdorferi
SSAMIMPPFKI

SEQ ID NO: 15682 - protein, 11 aa, Borrelia burgdorferi
SAMIMPPFKIP

SEQ ID NO: 15683 - protein, 11 aa, Borrelia burgdorferi
AMIMPPFKIPF

SEQ ID NO: 15684 - protein, 11 aa, Borrelia burgdorferi
MIMPPFKIPFY

SEQ ID NO: 15685 - protein, 11 aa, Borrelia burgdorferi
IMPPFKIPFYS

SEQ ID NO: 15686 - protein, 11 aa, Borrelia burgdorferi
MPPFKIPFYSG

SEQ ID NO: 15687 - protein, 11 aa, Borrelia burgdorferi
PPFKIPFYSGE

SEQ ID NO: 15688 - protein, 11 aa, Borrelia burgdorferi
PFKIPFYSGES

SEQ ID NO: 15689 - protein, 11 aa, Borrelia burgdorferi
FKIPFYSGESG

SEQ ID NO: 15690 - protein, 11 aa, Borrelia burgdorferi
KIPFYSGESGN

SEQ ID NO: 15691 - protein, 11 aa, Borrelia burgdorferi
IPFYSGESGNQ

SEQ ID NO: 15692 - protein, 11 aa, Borrelia burgdorferi
PFYSGESGNQF

SEQ ID NO: 15693 - protein, 11 aa, Borrelia burgdorferi
FYSGESGNQFL

SEQ ID NO: 15694 - protein, 11 aa, Borrelia burgdorferi
YSGESGNQFLG

SEQ ID NO: 15695 - protein, 11 aa, Borrelia burgdorferi
SGESGNQFLGK

SEQ ID NO: 15696 - protein, 11 aa, Borrelia burgdorferi
GESGNQFLGKG

SEQ ID NO: 15697 - protein, 11 aa, Borrelia burgdorferi
ESGNQFLGKGL

SEQ ID NO: 15698 - protein, 11 aa, Borrelia burgdorferi
SGNQFLGKGLI

SEQ ID NO: 15699 - protein, 11 aa, Borrelia burgdorferi
GNQFLGKGLID

SEQ ID NO: 15700 - protein, 11 aa, Borrelia burgdorferi
NQFLGKGLIDN

SEQ ID NO: 15701 - protein, 11 aa, Borrelia burgdorferi
QFLGKGLIDNI

SEQ ID NO: 15702 - protein, 11 aa, Borrelia burgdorferi
FLGKGLIDNIK

SEQ ID NO: 15703 - protein, 11 aa, Borrelia burgdorferi
LGKGLIDNIKT

SEQ ID NO: 15704 - protein, 11 aa, Borrelia burgdorferi
GKGLIDNIKTM

SEQ ID NO: 15705 - protein, 11 aa, Borrelia burgdorferi
KGLIDNIKTMK

SEQ ID NO: 15706 - protein, 11 aa, Borrelia burgdorferi
GLIDNIKTMKE

SEQ ID NO: 15707 - protein, 11 aa, Borrelia burgdorferi
LIDNIKTMKEI

SEQ ID NO: 15708 - protein, 11 aa, Borrelia burgdorferi
IDNIKTMKEIK

SEQ ID NO: 15709 - protein, 11 aa, Borrelia burgdorferi
DNIKTMKEIKV

SEQ ID NO: 15710 - protein, 11 aa, Borrelia burgdorferi
NIKTMKEIKVS

SEQ ID NO: 15711 - protein, 11 aa, Borrelia burgdorferi
IKTMKEIKVSV

SEQ ID NO: 15712 - protein, 11 aa, Borrelia burgdorferi
KTMKEIKVSVY

SEQ ID NO: 15713 - protein, 11 aa, Borrelia burgdorferi
TMKEIKVSVYS

SEQ ID NO: 15714 - protein, 11 aa, Borrelia burgdorferi
MKEIKVSVYSL

SEQ ID NO: 15715 - protein, 11 aa, Borrelia burgdorferi
KEIKVSVYSLG

SEQ ID NO: 15716 - protein, 11 aa, Borrelia burgdorferi
EIKVSVYSLGY

SEQ ID NO: 15717 - protein, 11 aa, Borrelia burgdorferi
IKVSVYSLGYE

SEQ ID NO: 15718 - protein, 11 aa, Borrelia burgdorferi
KVSVYSLGYEI

SEQ ID NO: 15719 - protein, 11 aa, Borrelia burgdorferi
VSVYSLGYEID

SEQ ID NO: 15720 - protein, 11 aa, Borrelia burgdorferi
SVYSLGYEIDL

SEQ ID NO: 15721 - protein, 11 aa, Borrelia burgdorferi
VYSLGYEIDLE

SEQ ID NO: 15722 - protein, 11 aa, Borrelia burgdorferi
YSLGYEIDLEV

SEQ ID NO: 15723 - protein, 11 aa, Borrelia burgdorferi
SLGYEIDLEVL

SEQ ID NO: 15724 - protein, 11 aa, Borrelia burgdorferi
LGYEIDLEVLF

SEQ ID NO: 15725 - protein, 11 aa, Borrelia burgdorferi
GYEIDLEVLFE

SEQ ID NO: 15726 - protein, 11 aa, Borrelia burgdorferi
YEIDLEVLFED

SEQ ID NO: 15727 - protein, 11 aa, Borrelia burgdorferi
EIDLEVLFEDM

SEQ ID NO: 15728 - protein, 11 aa, Borrelia burgdorferi
IDLEVLFEDMN

SEQ ID NO: 15729 - protein, 11 aa, Borrelia burgdorferi
DLEVLFEDMNG

SEQ ID NO: 15730 - protein, 11 aa, Borrelia burgdorferi
LEVLFEDMNGM

SEQ ID NO: 15731 - protein, 11 aa, Borrelia burgdorferi
EVLFEDMNGME

SEQ ID NO: 15732 - protein, 11 aa, Borrelia burgdorferi
VLFEDMNGMEY

SEQ ID NO: 15733 - protein, 11 aa, Borrelia burgdorferi
LFEDMNGMEYA

SEQ ID NO: 15734 - protein, 11 aa, Borrelia burgdorferi
FEDMNGMEYAY

SEQ ID NO: 15735 - protein, 11 aa, Borrelia burgdorferi
EDMNGMEYAYS

SEQ ID NO: 15736 - protein, 11 aa, Borrelia burgdorferi
DMNGMEYAYSM

SEQ ID NO: 15737 - protein, 11 aa, Borrelia burgdorferi
MNGMEYAYSMG

SEQ ID NO: 15738 - protein, 11 aa, Borrelia burgdorferi
NGMEYAYSMGT

SEQ ID NO: 15739 - protein, 11 aa, Borrelia burgdorferi
GMEYAYSMGTL

SEQ ID NO: 15740 - protein, 11 aa, Borrelia burgdorferi
MEYAYSMGTLK

SEQ ID NO: 15741 - protein, 11 aa, Borrelia burgdorferi
EYAYSMGTLKF

SEQ ID NO: 15742 - protein, 11 aa, Borrelia burgdorferi
YAYSMGTLKFK

SEQ ID NO: 15743 - protein, 11 aa, Borrelia burgdorferi
AYSMGTLKFKG

SEQ ID NO: 15744 - protein, 11 aa, Borrelia burgdorferi
YSMGTLKFKGW

SEQ ID NO: 15745 - protein, 11 aa, Borrelia burgdorferi
SMGTLKFKGWA

SEQ ID NO: 15746 - protein, 11 aa, Borrelia burgdorferi
MGTLKFKGWAD

SEQ ID NO: 15747 - protein, 11 aa, Borrelia burgdorferi
GTLKFKGWADL

SEQ ID NO: 15748 - protein, 11 aa, Borrelia burgdorferi
TLKFKGWADLI

SEQ ID NO: 15749 - protein, 11 aa, Borrelia burgdorferi
LKFKGWADLIW

SEQ ID NO: 15750 - protein, 11 aa, Borrelia burgdorferi
KFKGWADLIWS

SEQ ID NO: 15751 - protein, 11 aa, Borrelia burgdorferi
FKGWADLIWSN

SEQ ID NO: 15752 - protein, 11 aa, Borrelia burgdorferi
KGWADLIWSNP

SEQ ID NO: 15753 - protein, 11 aa, Borrelia burgdorferi
GWADLIWSNPN

SEQ ID NO: 15754 - protein, 11 aa, Borrelia burgdorferi
WADLIWSNPNY

SEQ ID NO: 15755 - protein, 11 aa, Borrelia burgdorferi
ADLIWSNPNYI

SEQ ID NO: 15756 - protein, 11 aa, Borrelia burgdorferi
DLIWSNPNYIP

SEQ ID NO: 15757 - protein, 11 aa, Borrelia burgdorferi
LIWSNPNYIPN

SEQ ID NO: 15758 - protein, 11 aa, Borrelia burgdorferi
IWSNPNYIPNI

SEQ ID NO: 15759 - protein, 11 aa, Borrelia burgdorferi
WSNPNYIPNIS

SEQ ID NO: 15760 - protein, 11 aa, Borrelia burgdorferi
SNPNYIPNISS

SEQ ID NO: 15761 - protein, 11 aa, Borrelia burgdorferi
NPNYIPNISSR

SEQ ID NO: 15762 - protein, 11 aa, Borrelia burgdorferi
PNYIPNISSRI

SEQ ID NO: 15763 - protein, 11 aa, Borrelia burgdorferi
NYIPNISSRII

SEQ ID NO: 15764 - protein, 11 aa, Borrelia burgdorferi
YIPNISSRIIK

SEQ ID NO: 15765 - protein, 11 aa, Borrelia burgdorferi
IPNISSRIIKD

SEQ ID NO: 15766 - protein, 11 aa, Borrelia burgdorferi
PNISSRIIKDD

SEQ ID NO: 15767 - protein, 11 aa, Borrelia burgdorferi
NISSRIIKDDV

SEQ ID NO: 15768 - protein, 11 aa, Borrelia burgdorferi
ISSRIIKDDVP

SEQ ID NO: 15769 - protein, 11 aa, Borrelia burgdorferi
SSRIIKDDVPN

SEQ ID NO: 15770 - protein, 11 aa, Borrelia burgdorferi
SRIIKDDVPNY

SEQ ID NO: 15771 - protein, 11 aa, Borrelia burgdorferi
RIIKDDVPNYP

SEQ ID NO: 15772 - protein, 11 aa, Borrelia burgdorferi
IIKDDVPNYPL

SEQ ID NO: 15773 - protein, 11 aa, Borrelia burgdorferi
IKDDVPNYPLA

SEQ ID NO: 15774 - protein, 11 aa, Borrelia burgdorferi
KDDVPNYPLAS

SEQ ID NO: 15775 - protein, 11 aa, Borrelia burgdorferi
DDVPNYPLASS

SEQ ID NO: 15776 - protein, 11 aa, Borrelia burgdorferi
DVPNYPLASSK

SEQ ID NO: 15777 - protein, 11 aa, Borrelia burgdorferi
VPNYPLASSKM

SEQ ID NO: 15778 - protein, 11 aa, Borrelia burgdorferi
PNYPLASSKMR

SEQ ID NO: 15779 - protein, 11 aa, Borrelia burgdorferi
NYPLASSKMRF

SEQ ID NO: 15780 - protein, 11 aa, Borrelia burgdorferi
YPLASSKMRFK

SEQ ID NO: 15781 - protein, 11 aa, Borrelia burgdorferi
PLASSKMRFKA

SEQ ID NO: 15782 - protein, 11 aa, Borrelia burgdorferi
LASSKMRFKAF

SEQ ID NO: 15783 - protein, 11 aa, Borrelia burgdorferi
ASSKMRFKAFR

SEQ ID NO: 15784 - protein, 11 aa, Borrelia burgdorferi
SSKMRFKAFRV

SEQ ID NO: 15785 - protein, 11 aa, Borrelia burgdorferi
SKMRFKAFRVS

SEQ ID NO: 15786 - protein, 11 aa, Borrelia burgdorferi
KMRFKAFRVSK

SEQ ID NO: 15787 - protein, 11 aa, Borrelia burgdorferi
MRFKAFRVSKS

SEQ ID NO: 15788 - protein, 11 aa, Borrelia burgdorferi
RFKAFRVSKSH

SEQ ID NO: 15789 - protein, 11 aa, Borrelia burgdorferi
FKAFRVSKSHS

SEQ ID NO: 15790 - protein, 11 aa, Borrelia burgdorferi
KAFRVSKSHSS

SEQ ID NO: 15791 - protein, 11 aa, Borrelia burgdorferi
AFRVSKSHSSK

SEQ ID NO: 15792 - protein, 11 aa, Borrelia burgdorferi
FRVSKSHSSKV

SEQ ID NO: 15793 - protein, 11 aa, Borrelia burgdorferi
RVSKSHSSKVK

SEQ ID NO: 15794 - protein, 11 aa, Borrelia burgdorferi
VSKSHSSKVKN

SEQ ID NO: 15795 - protein, 11 aa, Borrelia burgdorferi
SKSHSSKVKNF

SEQ ID NO: 15796 - protein, 11 aa, Borrelia burgdorferi
KSHSSKVKNFI

SEQ ID NO: 15797 - protein, 11 aa, Borrelia burgdorferi
SHSSKVKNFIF

SEQ ID NO: 15798 - protein, 11 aa, Borrelia burgdorferi
HSSKVKNFIFY

SEQ ID NO: 15799 - protein, 11 aa, Borrelia burgdorferi
SSKVKNFIFYV

SEQ ID NO: 15800 - protein, 11 aa, Borrelia burgdorferi
SKVKNFIFYVK

SEQ ID NO: 15801 - protein, 11 aa, Borrelia burgdorferi
KVKNFIFYVKD

SEQ ID NO: 15802 - protein, 11 aa, Borrelia burgdorferi
VKNFIFYVKDL

SEQ ID NO: 15803 - protein, 11 aa, Borrelia burgdorferi
KNFIFYVKDLR

SEQ ID NO: 15804 - protein, 11 aa, Borrelia burgdorferi
NFIFYVKDLRV

SEQ ID NO: 15805 - protein, 11 aa, Borrelia burgdorferi
FIFYVKDLRVL

SEQ ID NO: 15806 - protein, 11 aa, Borrelia burgdorferi
IFYVKDLRVLY

SEQ ID NO: 15807 - protein, 11 aa, Borrelia burgdorferi
FYVKDLRVLYD

SEQ ID NO: 15808 - protein, 11 aa, Borrelia burgdorferi
YVKDLRVLYDK

SEQ ID NO: 15809 - protein, 11 aa, Borrelia burgdorferi
VKDLRVLYDKL

SEQ ID NO: 15810 - protein, 11 aa, Borrelia burgdorferi
KDLRVLYDKLS

SEQ ID NO: 15811 - protein, 11 aa, Borrelia burgdorferi
DLRVLYDKLSV

SEQ ID NO: 15812 - protein, 11 aa, Borrelia burgdorferi
LRVLYDKLSVS

SEQ ID NO: 15813 - protein, 11 aa, Borrelia burgdorferi
RVLYDKLSVSI

SEQ ID NO: 15814 - protein, 11 aa, Borrelia burgdorferi
VLYDKLSVSID

SEQ ID NO: 15815 - protein, 11 aa, Borrelia burgdorferi
LYDKLSVSIDS

SEQ ID NO: 15816 - protein, 11 aa, Borrelia burgdorferi
YDKLSVSIDSD

SEQ ID NO: 15817 - protein, 11 aa, Borrelia burgdorferi
DKLSVSIDSDI

SEQ ID NO: 15818 - protein, 11 aa, Borrelia burgdorferi
KLSVSIDSDID

SEQ ID NO: 15819 - protein, 11 aa, Borrelia burgdorferi
LSVSIDSDIDS

SEQ ID NO: 15820 - protein, 11 aa, Borrelia burgdorferi
SVSIDSDIDSE

SEQ ID NO: 15821 - protein, 11 aa, Borrelia burgdorferi
VSIDSDIDSES

SEQ ID NO: 15822 - protein, 11 aa, Borrelia burgdorferi
SIDSDIDSESV

SEQ ID NO: 15823 - protein, 11 aa, Borrelia burgdorferi
IDSDIDSESVF

SEQ ID NO: 15824 - protein, 11 aa, Borrelia burgdorferi
DSDIDSESVFK

SEQ ID NO: 15825 - protein, 11 aa, Borrelia burgdorferi
SDIDSESVFKV

SEQ ID NO: 15826 - protein, 11 aa, Borrelia burgdorferi
DIDSESVFKVY

SEQ ID NO: 15827 - protein, 11 aa, Borrelia burgdorferi
IDSESVFKVYE

SEQ ID NO: 15828 - protein, 11 aa, Borrelia burgdorferi
DSESVFKVYET

SEQ ID NO: 15829 - protein, 11 aa, Borrelia burgdorferi
SESVFKVYETS

SEQ ID NO: 15830 - protein, 11 aa, Borrelia burgdorferi
ESVFKVYETSG

SEQ ID NO: 15831 - protein, 11 aa, Borrelia burgdorferi
SVFKVYETSGT

SEQ ID NO: 15832 - protein, 11 aa, Borrelia burgdorferi
VFKVYETSGTE

SEQ ID NO: 15833 - protein, 11 aa, Borrelia burgdorferi
FKVYETSGTES

SEQ ID NO: 15834 - protein, 11 aa, Borrelia burgdorferi
KVYETSGTESL

SEQ ID NO: 15835 - protein, 11 aa, Borrelia burgdorferi
VYETSGTESLR

SEQ ID NO: 15836 - protein, 11 aa, Borrelia burgdorferi
YETSGTESLRK

SEQ ID NO: 15837 - protein, 11 aa, Borrelia burgdorferi
ETSGTESLRKL

SEQ ID NO: 15838 - protein, 11 aa, Borrelia burgdorferi
TSGTESLRKLK

SEQ ID NO: 15839 - protein, 11 aa, Borrelia burgdorferi
SGTESLRKLKA

SEQ ID NO: 15840 - protein, 11 aa, Borrelia burgdorferi
GTESLRKLKAH

SEQ ID NO: 15841 - protein, 11 aa, Borrelia burgdorferi
TESLRKLKAHE

SEQ ID NO: 15842 - protein, 11 aa, Borrelia burgdorferi
ESLRKLKAHET

SEQ ID NO: 15843 - protein, 11 aa, Borrelia burgdorferi
SLRKLKAHETF

SEQ ID NO: 15844 - protein, 11 aa, Borrelia burgdorferi
LRKLKAHETFK

SEQ ID NO: 15845 - protein, 11 aa, Borrelia burgdorferi
RKLKAHETFKR

SEQ ID NO: 15846 - protein, 11 aa, Borrelia burgdorferi
KLKAHETFKRV

SEQ ID NO: 15847 - protein, 11 aa, Borrelia burgdorferi
LKAHETFKRVL

SEQ ID NO: 15848 - protein, 11 aa, Borrelia burgdorferi
KAHETFKRVLK

SEQ ID NO: 15849 - protein, 11 aa, Borrelia burgdorferi
AHETFKRVLKL

SEQ ID NO: 15850 - protein, 11 aa, Borrelia burgdorferi
HETFKRVLKLR

SEQ ID NO: 15851 - protein, 11 aa, Borrelia burgdorferi
ETFKRVLKLRE

SEQ ID NO: 15852 - protein, 11 aa, Borrelia burgdorferi
TFKRVLKLREK

SEQ ID NO: 15853 - protein, 11 aa, Borrelia burgdorferi
FKRVLKLREKI

SEQ ID NO: 15854 - protein, 11 aa, Borrelia burgdorferi
KRVLKLREKIS

SEQ ID NO: 15855 - protein, 11 aa, Borrelia burgdorferi
RVLKLREKISI

SEQ ID NO: 15856 - protein, 11 aa, Borrelia burgdorferi
VLKLREKISIA

SEQ ID NO: 15857 - protein, 11 aa, Borrelia burgdorferi
LKLREKISIAE

SEQ ID NO: 15858 - protein, 11 aa, Borrelia burgdorferi
KLREKISIAEG

SEQ ID NO: 15859 - protein, 11 aa, Borrelia burgdorferi
LREKISIAEGS

SEQ ID NO: 15860 - protein, 11 aa, Borrelia burgdorferi
REKISIAEGSF

SEQ ID NO: 15861 - protein, 11 aa, Borrelia burgdorferi
EKISIAEGSFQ

SEQ ID NO: 15862 - protein, 11 aa, Borrelia burgdorferi
KISIAEGSFQN

SEQ ID NO: 15863 - protein, 11 aa, Borrelia burgdorferi
ISIAEGSFQNF

SEQ ID NO: 15864 - protein, 11 aa, Borrelia burgdorferi
SIAEGSFQNFV

SEQ ID NO: 15865 - protein, 11 aa, Borrelia burgdorferi
IAEGSFQNFVE

SEQ ID NO: 15866 - protein, 11 aa, Borrelia burgdorferi
AEGSFQNFVEK

SEQ ID NO: 15867 - protein, 11 aa, Borrelia burgdorferi
EGSFQNFVEKI

SEQ ID NO: 15868 - protein, 11 aa, Borrelia burgdorferi
GSFQNFVEKIE

SEQ ID NO: 15869 - protein, 11 aa, Borrelia burgdorferi
SFQNFVEKIES

SEQ ID NO: 15870 - protein, 11 aa, Borrelia burgdorferi
FQNFVEKIESE

SEQ ID NO: 15871 - protein, 11 aa, Borrelia burgdorferi
QNFVEKIESEK

SEQ ID NO: 15872 - protein, 11 aa, Borrelia burgdorferi
NFVEKIESEKP

SEQ ID NO: 15873 - protein, 11 aa, Borrelia burgdorferi
FVEKIESEKPE

SEQ ID NO: 15874 - protein, 11 aa, Borrelia burgdorferi
VEKIESEKPEE

SEQ ID NO: 15875 - protein, 11 aa, Borrelia burgdorferi
EKIESEKPEES

SEQ ID NO: 15876 - protein, 11 aa, Borrelia burgdorferi
KIESEKPEESS

SEQ ID NO: 15877 - protein, 11 aa, Borrelia burgdorferi
IESEKPEESSP

SEQ ID NO: 15878 - protein, 11 aa, Borrelia burgdorferi
ESEKPEESSPK

SEQ ID NO: 15879 - protein, 11 aa, Borrelia burgdorferi
SEKPEESSPKN

SEQ ID NO: 15880 - protein, 8 aa, Borrelia garinii PBi
MIINHNTS

SEQ ID NO: 15881 - protein, 8 aa, Borrelia garinii PBi
IINHNTSA

SEQ ID NO: 15882 - protein, 8 aa, Borrelia garinii PBi
INHNTSAI

SEQ ID NO: 15883 - protein, 8 aa, Borrelia garinii PBi
NHNTSAIN

SEQ ID NO: 15884 - protein, 8 aa, Borrelia garinii PBi
HNTSAINA

SEQ ID NO: 15885 - protein, 8 aa, Borrelia garinii PBi
NTSAINAS

SEQ ID NO: 15886 - protein, 8 aa, Borrelia garinii PBi
TSAINASR

SEQ ID NO: 15887 - protein, 8 aa, Borrelia garinii PBi
SAINASRN

SEQ ID NO: 15888 - protein, 8 aa, Borrelia garinii PBi
AINASRNN

SEQ ID NO: 15889 - protein, 8 aa, Borrelia garinii PBi
INASRNNS

SEQ ID NO: 15890 - protein, 8 aa, Borrelia garinii PBi
NASRNNSI

SEQ ID NO: 15891 - protein, 8 aa, Borrelia garinii PBi
ASRNNSIN

SEQ ID NO: 15892 - protein, 8 aa, Borrelia garinii PBi
SRNNSINA

SEQ ID NO: 15893 - protein, 8 aa, Borrelia garinii PBi
RNNSINAA

SEQ ID NO: 15894 - protein, 8 aa, Borrelia garinii PBi
NNSINAAN

SEQ ID NO: 15895 - protein, 8 aa, Borrelia garinii PBi
NSINAANL

SEQ ID NO: 15896 - protein, 8 aa, Borrelia garinii PBi
SINAANLS

SEQ ID NO: 15897 - protein, 8 aa, Borrelia garinii PBi
INAANLSK

SEQ ID NO: 15898 - protein, 8 aa, Borrelia garinii PBi
NAANLSKT

SEQ ID NO: 15899 - protein, 8 aa, Borrelia garinii PBi
AANLSKTQ

SEQ ID NO: 15900 - protein, 8 aa, Borrelia garinii PBi
ANLSKTQE

SEQ ID NO: 15901 - protein, 8 aa, Borrelia garinii PBi
NLSKTQEK

SEQ ID NO: 15902 - protein, 8 aa, Borrelia garinii PBi
LSKTQEKL

SEQ ID NO: 15903 - protein, 8 aa, Borrelia garinii PBi
SKTQEKLS

SEQ ID NO: 15904 - protein, 8 aa, Borrelia garinii PBi
KTQEKLSS

SEQ ID NO: 15905 - protein, 8 aa, Borrelia garinii PBi
TQEKLSSG

SEQ ID NO: 15906 - protein, 8 aa, Borrelia garinii PBi
QEKLSSGY

SEQ ID NO: 15907 - protein, 8 aa, Borrelia garinii PBi
EKLSSGYR

SEQ ID NO: 15908 - protein, 8 aa, Borrelia garinii PBi
KLSSGYRI

SEQ ID NO: 15909 - protein, 8 aa, Borrelia garinii PBi
LSSGYRIN

SEQ ID NO: 15910 - protein, 8 aa, Borrelia garinii PBi
SSGYRINR

SEQ ID NO: 15911 - protein, 8 aa, Borrelia garinii PBi
SGYRINRA

SEQ ID NO: 15912 - protein, 8 aa, Borrelia garinii PBi
GYRINRAS

SEQ ID NO: 15913 - protein, 8 aa, Borrelia garinii PBi
YRINRASD

SEQ ID NO: 15914 - protein, 8 aa, Borrelia garinii PBi
RINRASDD

SEQ ID NO: 15915 - protein, 8 aa, Borrelia garinii PBi
INRASDDA

SEQ ID NO: 15916 - protein, 8 aa, Borrelia garinii PBi
NRASDDAA

SEQ ID NO: 15917 - protein, 8 aa, Borrelia garinii PBi
RASDDAAG

SEQ ID NO: 15918 - protein, 8 aa, Borrelia garinii PBi
ASDDAAGM

SEQ ID NO: 15919 - protein, 8 aa, Borrelia garinii PBi
SDDAAGMG

SEQ ID NO: 15920 - protein, 8 aa, Borrelia garinii PBi
DDAAGMGV

SEQ ID NO: 15921 - protein, 8 aa, Borrelia garinii PBi
DAAGMGVS

SEQ ID NO: 15922 - protein, 8 aa, Borrelia garinii PBi
AAGMGVSG

SEQ ID NO: 15923 - protein, 8 aa, Borrelia garinii PBi
AGMGVSGK

SEQ ID NO: 15924 - protein, 8 aa, Borrelia garinii PBi
GMGVSGKI

SEQ ID NO: 15925 - protein, 8 aa, Borrelia garinii PBi
MGVSGKIN

SEQ ID NO: 15926 - protein, 8 aa, Borrelia garinii PBi
GVSGKINA

SEQ ID NO: 15927 - protein, 8 aa, Borrelia garinii PBi
VSGKINAQ

SEQ ID NO: 15928 - protein, 8 aa, Borrelia garinii PBi
SGKINAQI

SEQ ID NO: 15929 - protein, 8 aa, Borrelia garinii PBi
GKINAQIR

SEQ ID NO: 15930 - protein, 8 aa, Borrelia garinii PBi
KINAQIRG

SEQ ID NO: 15931 - protein, 8 aa, Borrelia garinii PBi
INAQIRGL

SEQ ID NO: 15932 - protein, 8 aa, Borrelia garinii PBi
NAQIRGLS

SEQ ID NO: 15933 - protein, 8 aa, Borrelia garinii PBi
AQIRGLSQ

SEQ ID NO: 15934 - protein, 8 aa, Borrelia garinii PBi
QIRGLSQA

SEQ ID NO: 15935 - protein, 8 aa, Borrelia garinii PBi
IRGLSQAS

SEQ ID NO: 15936 - protein, 8 aa, Borrelia garinii PBi
RGLSQASR

SEQ ID NO: 15937 - protein, 8 aa, Borrelia garinii PBi
GLSQASRN

SEQ ID NO: 15938 - protein, 8 aa, Borrelia garinii PBi
LSQASRNT

SEQ ID NO: 15939 - protein, 8 aa, Borrelia garinii PBi
SQASRNTS

SEQ ID NO: 15940 - protein, 8 aa, Borrelia garinii PBi
QASRNTSK

SEQ ID NO: 15941 - protein, 8 aa, Borrelia garinii PBi
ASRNTSKA

SEQ ID NO: 15942 - protein, 8 aa, Borrelia garinii PBi
SRNTSKAI

SEQ ID NO: 15943 - protein, 8 aa, Borrelia garinii PBi
RNTSKAIN

SEQ ID NO: 15944 - protein, 8 aa, Borrelia garinii PBi
NTSKAINF

SEQ ID NO: 15945 - protein, 8 aa, Borrelia garinii PBi
TSKAINFI

SEQ ID NO: 15946 - protein, 8 aa, Borrelia garinii PBi
SKAINFIQ

SEQ ID NO: 15947 - protein, 8 aa, Borrelia garinii PBi
KAINFIQT

SEQ ID NO: 15948 - protein, 8 aa, Borrelia garinii PBi
AINFIQTT

SEQ ID NO: 15949 - protein, 8 aa, Borrelia garinii PBi
INFIQTTE

SEQ ID NO: 15950 - protein, 8 aa, Borrelia garinii PBi
NFIQTTEG

SEQ ID NO: 15951 - protein, 8 aa, Borrelia garinii PBi
FIQTTEGN

SEQ ID NO: 15952 - protein, 8 aa, Borrelia garinii PBi
IQTTEGNL

SEQ ID NO: 15953 - protein, 8 aa, Borrelia garinii PBi
QTTEGNLN

SEQ ID NO: 15954 - protein, 8 aa, Borrelia garinii PBi
TTEGNLNE

SEQ ID NO: 15955 - protein, 8 aa, Borrelia garinii PBi
TEGNLNEV

SEQ ID NO: 15956 - protein, 8 aa, Borrelia garinii PBi
EGNLNEVE

SEQ ID NO: 15957 - protein, 8 aa, Borrelia garinii PBi
GNLNEVEK

SEQ ID NO: 15958 - protein, 8 aa, Borrelia garinii PBi
NLNEVEKV

SEQ ID NO: 15959 - protein, 8 aa, Borrelia garinii PBi
LNEVEKVL

SEQ ID NO: 15960 - protein, 8 aa, Borrelia garinii PBi
NEVEKVLV

SEQ ID NO: 15961 - protein, 8 aa, Borrelia garinii PBi
EVEKVLVR

SEQ ID NO: 15962 - protein, 8 aa, Borrelia garinii PBi
VEKVLVRM

SEQ ID NO: 15963 - protein, 8 aa, Borrelia garinii PBi
EKVLVRMK

SEQ ID NO: 15964 - protein, 8 aa, Borrelia garinii PBi
KVLVRMKE

SEQ ID NO: 15965 - protein, 8 aa, Borrelia garinii PBi
VLVRMKEL

SEQ ID NO: 15966 - protein, 8 aa, Borrelia garinii PBi
LVRMKELA

SEQ ID NO: 15967 - protein, 8 aa, Borrelia garinii PBi
VRMKELAV

SEQ ID NO: 15968 - protein, 8 aa, Borrelia garinii PBi
RMKELAVQ

SEQ ID NO: 15969 - protein, 8 aa, Borrelia garinii PBi
MKELAVQS

SEQ ID NO: 15970 - protein, 8 aa, Borrelia garinii PBi
KELAVQSG

SEQ ID NO: 15971 - protein, 8 aa, Borrelia garinii PBi
ELAVQSGN

SEQ ID NO: 15972 - protein, 8 aa, Borrelia garinii PBi
LAVQSGNG

SEQ ID NO: 15973 - protein, 8 aa, Borrelia garinii PBi
AVQSGNGT

SEQ ID NO: 15974 - protein, 8 aa, Borrelia garinii PBi
VQSGNGTY

SEQ ID NO: 15975 - protein, 8 aa, Borrelia garinii PBi
QSGNGTYS

SEQ ID NO: 15976 - protein, 8 aa, Borrelia garinii PBi
SGNGTYSD

SEQ ID NO: 15977 - protein, 8 aa, Borrelia garinii PBi
GNGTYSDA

SEQ ID NO: 15978 - protein, 8 aa, Borrelia garinii PBi
NGTYSDAD

SEQ ID NO: 15979 - protein, 8 aa, Borrelia garinii PBi
GTYSDADR

SEQ ID NO: 15980 - protein, 8 aa, Borrelia garinii PBi
TYSDADRG

SEQ ID NO: 15981 - protein, 8 aa, Borrelia garinii PBi
YSDADRGS

SEQ ID NO: 15982 - protein, 8 aa, Borrelia garinii PBi
SDADRGSI

SEQ ID NO: 15983 - protein, 8 aa, Borrelia garinii PBi
DADRGSIQ

SEQ ID NO: 15984 - protein, 8 aa, Borrelia garinii PBi
ADRGSIQI

SEQ ID NO: 15985 - protein, 8 aa, Borrelia garinii PBi
DRGSIQIE

SEQ ID NO: 15986 - protein, 8 aa, Borrelia garinii PBi
RGSIQIEI

SEQ ID NO: 15987 - protein, 8 aa, Borrelia garinii PBi
GSIQIEIE

SEQ ID NO: 15988 - protein, 8 aa, Borrelia garinii PBi
SIQIEIEQ

SEQ ID NO: 15989 - protein, 8 aa, Borrelia garinii PBi
IQIEIEQL

SEQ ID NO: 15990 - protein, 8 aa, Borrelia garinii PBi
QIEIEQLT

SEQ ID NO: 15991 - protein, 8 aa, Borrelia garinii PBi
IEIEQLTD

SEQ ID NO: 15992 - protein, 8 aa, Borrelia garinii PBi
EIEQLTDE

SEQ ID NO: 15993 - protein, 8 aa, Borrelia garinii PBi
IEQLTDEI

SEQ ID NO: 15994 - protein, 8 aa, Borrelia garinii PBi
EQLTDEIN

SEQ ID NO: 15995 - protein, 8 aa, Borrelia garinii PBi
QLTDEINR

SEQ ID NO: 15996 - protein, 8 aa, Borrelia garinii PBi
LTDEINRI

SEQ ID NO: 15997 - protein, 8 aa, Borrelia garinii PBi
TDEINRIA

SEQ ID NO: 15998 - protein, 8 aa, Borrelia garinii PBi
DEINRIAD

SEQ ID NO: 15999 - protein, 8 aa, Borrelia garinii PBi
EINRIADQ

SEQ ID NO: 16000 - protein, 8 aa, Borrelia garinii PBi
INRIADQA

SEQ ID NO: 16001 - protein, 8 aa, Borrelia garinii PBi
NRIADQAQ

SEQ ID NO: 16002 - protein, 8 aa, Borrelia garinii PBi
RIADQAQY

SEQ ID NO: 16003 - protein, 8 aa, Borrelia garinii PBi
IADQAQYN

SEQ ID NO: 16004 - protein, 8 aa, Borrelia garinii PBi
ADQAQYNQ

SEQ ID NO: 16005 - protein, 8 aa, Borrelia garinii PBi
DQAQYNQM

SEQ ID NO: 16006 - protein, 8 aa, Borrelia garinii PBi
QAQYNQMH

SEQ ID NO: 16007 - protein, 8 aa, Borrelia garinii PBi
AQYNQMHM

SEQ ID NO: 16008 - protein, 8 aa, Borrelia garinii PBi
QYNQMHML

SEQ ID NO: 16009 - protein, 8 aa, Borrelia garinii PBi
YNQMHMLS

SEQ ID NO: 16010 - protein, 8 aa, Borrelia garinii PBi
NQMHMLSN

SEQ ID NO: 16011 - protein, 8 aa, Borrelia garinii PBi
QMHMLSNK

SEQ ID NO: 16012 - protein, 8 aa, Borrelia garinii PBi
MHMLSNKS

SEQ ID NO: 16013 - protein, 8 aa, Borrelia garinii PBi
HMLSNKSA

SEQ ID NO: 16014 - protein, 8 aa, Borrelia garinii PBi
MLSNKSAS

SEQ ID NO: 16015 - protein, 8 aa, Borrelia garinii PBi
LSNKSASQ

SEQ ID NO: 16016 - protein, 8 aa, Borrelia garinii PBi
SNKSASQN

SEQ ID NO: 16017 - protein, 8 aa, Borrelia garinii PBi
NKSASQNV

SEQ ID NO: 16018 - protein, 8 aa, Borrelia garinii PBi
KSASQNVR

SEQ ID NO: 16019 - protein, 8 aa, Borrelia garinii PBi
SASQNVRT

SEQ ID NO: 16020 - protein, 8 aa, Borrelia garinii PBi
ASQNVRTA

SEQ ID NO: 16021 - protein, 8 aa, Borrelia garinii PBi
SQNVRTAE

SEQ ID NO: 16022 - protein, 8 aa, Borrelia garinii PBi
QNVRTAEE

SEQ ID NO: 16023 - protein, 8 aa, Borrelia garinii PBi
NVRTAEEL

SEQ ID NO: 16024 - protein, 8 aa, Borrelia garinii PBi
VRTAEELG

SEQ ID NO: 16025 - protein, 8 aa, Borrelia garinii PBi
RTAEELGM

SEQ ID NO: 16026 - protein, 8 aa, Borrelia garinii PBi
TAEELGMQ

SEQ ID NO: 16027 - protein, 8 aa, Borrelia garinii PBi
AEELGMQP

SEQ ID NO: 16028 - protein, 8 aa, Borrelia garinii PBi
EELGMQPA

SEQ ID NO: 16029 - protein, 8 aa, Borrelia garinii PBi
ELGMQPAK

SEQ ID NO: 16030 - protein, 8 aa, Borrelia garinii PBi
LGMQPAKI

SEQ ID NO: 16031 - protein, 8 aa, Borrelia garinii PBi
GMQPAKIN

SEQ ID NO: 16032 - protein, 8 aa, Borrelia garinii PBi
MQPAKINT

SEQ ID NO: 16033 - protein, 8 aa, Borrelia garinii PBi
QPAKINTP

SEQ ID NO: 16034 - protein, 8 aa, Borrelia garinii PBi
PAKINTPA

SEQ ID NO: 16035 - protein, 8 aa, Borrelia garinii PBi
AKINTPAS

SEQ ID NO: 16036 - protein, 8 aa, Borrelia garinii PBi
KINTPASL

SEQ ID NO: 16037 - protein, 8 aa, Borrelia garinii PBi
INTPASLS

SEQ ID NO: 16038 - protein, 8 aa, Borrelia garinii PBi
NTPASLSG

SEQ ID NO: 16039 - protein, 8 aa, Borrelia garinii PBi
TPASLSGS

SEQ ID NO: 16040 - protein, 8 aa, Borrelia garinii PBi
PASLSGSQ

SEQ ID NO: 16041 - protein, 8 aa, Borrelia garinii PBi
ASLSGSQA

SEQ ID NO: 16042 - protein, 8 aa, Borrelia garinii PBi
SLSGSQAS

SEQ ID NO: 16043 - protein, 8 aa, Borrelia garinii PBi
LSGSQASW

SEQ ID NO: 16044 - protein, 8 aa, Borrelia garinii PBi
SGSQASWT

SEQ ID NO: 16045 - protein, 8 aa, Borrelia garinii PBi
GSQASWTL

SEQ ID NO: 16046 - protein, 8 aa, Borrelia garinii PBi
SQASWTLR

SEQ ID NO: 16047 - protein, 8 aa, Borrelia garinii PBi
QASWTLRV

SEQ ID NO: 16048 - protein, 8 aa, Borrelia garinii PBi
ASWTLRVH

SEQ ID NO: 16049 - protein, 8 aa, Borrelia garinii PBi
SWTLRVHV

SEQ ID NO: 16050 - protein, 8 aa, Borrelia garinii PBi
WTLRVHVG

SEQ ID NO: 16051 - protein, 8 aa, Borrelia garinii PBi
TLRVHVGA

SEQ ID NO: 16052 - protein, 8 aa, Borrelia garinii PBi
LRVHVGAN

SEQ ID NO: 16053 - protein, 8 aa, Borrelia garinii PBi
RVHVGANQ

SEQ ID NO: 16054 - protein, 8 aa, Borrelia garinii PBi
VHVGANQD

SEQ ID NO: 16055 - protein, 8 aa, Borrelia garinii PBi
HVGANQDE

SEQ ID NO: 16056 - protein, 8 aa, Borrelia garinii PBi
VGANQDEA

SEQ ID NO: 16057 - protein, 8 aa, Borrelia garinii PBi
GANQDEAI

SEQ ID NO: 16058 - protein, 8 aa, Borrelia garinii PBi
ANQDEAIA

SEQ ID NO: 16059 - protein, 8 aa, Borrelia garinii PBi
NQDEAIAV

SEQ ID NO: 16060 - protein, 8 aa, Borrelia garinii PBi
QDEAIAVN

SEQ ID NO: 16061 - protein, 8 aa, Borrelia garinii PBi
DEAIAVNI

SEQ ID NO: 16062 - protein, 8 aa, Borrelia garinii PBi
EAIAVNIY

SEQ ID NO: 16063 - protein, 8 aa, Borrelia garinii PBi
AIAVNIYA

SEQ ID NO: 16064 - protein, 8 aa, Borrelia garinii PBi
IAVNIYAA

SEQ ID NO: 16065 - protein, 8 aa, Borrelia garinii PBi
AVNIYAAN

SEQ ID NO: 16066 - protein, 8 aa, Borrelia garinii PBi
VNIYAANV

SEQ ID NO: 16067 - protein, 8 aa, Borrelia garinii PBi
NIYAANVA

SEQ ID NO: 16068 - protein, 8 aa, Borrelia garinii PBi
IYAANVAN

SEQ ID NO: 16069 - protein, 8 aa, Borrelia garinii PBi
YAANVANL

SEQ ID NO: 16070 - protein, 8 aa, Borrelia garinii PBi
AANVANLF

SEQ ID NO: 16071 - protein, 8 aa, Borrelia garinii PBi
ANVANLFS

SEQ ID NO: 16072 - protein, 8 aa, Borrelia garinii PBi
NVANLFSG

SEQ ID NO: 16073 - protein, 8 aa, Borrelia garinii PBi
VANLFSGE

SEQ ID NO: 16074 - protein, 8 aa, Borrelia garinii PBi
ANLFSGEG

SEQ ID NO: 16075 - protein, 8 aa, Borrelia garinii PBi
NLFSGEGS

SEQ ID NO: 16076 - protein, 8 aa, Borrelia garinii PBi
LFSGEGSQ

SEQ ID NO: 16077 - protein, 8 aa, Borrelia garinii PBi
FSGEGSQA

SEQ ID NO: 16078 - protein, 8 aa, Borrelia garinii PBi
SGEGSQAA

SEQ ID NO: 16079 - protein, 8 aa, Borrelia garinii PBi
GEGSQAAQ

SEQ ID NO: 16080 - protein, 8 aa, Borrelia garinii PBi
EGSQAAQT

SEQ ID NO: 16081 - protein, 8 aa, Borrelia garinii PBi
GSQAAQTA

SEQ ID NO: 16082 - protein, 8 aa, Borrelia garinii PBi
SQAAQTAP

SEQ ID NO: 16083 - protein, 8 aa, Borrelia garinii PBi
QAAQTAPV

SEQ ID NO: 16084 - protein, 8 aa, Borrelia garinii PBi
AAQTAPVQ

SEQ ID NO: 16085 - protein, 8 aa, Borrelia garinii PBi
AQTAPVQE

SEQ ID NO: 16086 - protein, 8 aa, Borrelia garinii PBi
QTAPVQEG

SEQ ID NO: 16087 - protein, 8 aa, Borrelia garinii PBi
TAPVQEGA

SEQ ID NO: 16088 - protein, 8 aa, Borrelia garinii PBi
APVQEGAQ

SEQ ID NO: 16089 - protein, 8 aa, Borrelia garinii PBi
PVQEGAQQ

SEQ ID NO: 16090 - protein, 8 aa, Borrelia garinii PBi
VQEGAQQE

SEQ ID NO: 16091 - protein, 8 aa, Borrelia garinii PBi
QEGAQQEG

SEQ ID NO: 16092 - protein, 8 aa, Borrelia garinii PBi
EGAQQEGA

SEQ ID NO: 16093 - protein, 8 aa, Borrelia garinii PBi
GAQQEGAQ

SEQ ID NO: 16094 - protein, 8 aa, Borrelia garinii PBi
AQQEGAQQ

SEQ ID NO: 16095 - protein, 8 aa, Borrelia garinii PBi
QQEGAQQP

SEQ ID NO: 16096 - protein, 8 aa, Borrelia garinii PBi
QEGAQQPA

SEQ ID NO: 16097 - protein, 8 aa, Borrelia garinii PBi
EGAQQPAP

SEQ ID NO: 16098 - protein, 8 aa, Borrelia garinii PBi
GAQQPAPA

SEQ ID NO: 16099 - protein, 8 aa, Borrelia garinii PBi
AQQPAPAT

SEQ ID NO: 16100 - protein, 8 aa, Borrelia garinii PBi
QQPAPATA

SEQ ID NO: 16101 - protein, 8 aa, Borrelia garinii PBi
QPAPATAP

SEQ ID NO: 16102 - protein, 8 aa, Borrelia garinii PBi
PAPATAPS

SEQ ID NO: 16103 - protein, 8 aa, Borrelia garinii PBi
APATAPSQ

SEQ ID NO: 16104 - protein, 8 aa, Borrelia garinii PBi
PATAPSQG

SEQ ID NO: 16105 - protein, 8 aa, Borrelia garinii PBi
ATAPSQGG

SEQ ID NO: 16106 - protein, 8 aa, Borrelia garinii PBi
TAPSQGGV

SEQ ID NO: 16107 - protein, 8 aa, Borrelia garinii PBi
APSQGGVN

SEQ ID NO: 16108 - protein, 8 aa, Borrelia garinii PBi
PSQGGVNS

SEQ ID NO: 16109 - protein, 8 aa, Borrelia garinii PBi
SQGGVNSP

SEQ ID NO: 16110 - protein, 8 aa, Borrelia garinii PBi
QGGVNSPV

SEQ ID NO: 16111 - protein, 8 aa, Borrelia garinii PBi
GGVNSPVN

SEQ ID NO: 16112 - protein, 8 aa, Borrelia garinii PBi
GVNSPVNV

SEQ ID NO: 16113 - protein, 8 aa, Borrelia garinii PBi
VNSPVNVT

SEQ ID NO: 16114 - protein, 8 aa, Borrelia garinii PBi
NSPVNVTT

SEQ ID NO: 16115 - protein, 8 aa, Borrelia garinii PBi
SPVNVTTT

SEQ ID NO: 16116 - protein, 8 aa, Borrelia garinii PBi
PVNVTTTV

SEQ ID NO: 16117 - protein, 8 aa, Borrelia garinii PBi
VNVTTTVD

SEQ ID NO: 16118 - protein, 8 aa, Borrelia garinii PBi
NVTTTVDA

SEQ ID NO: 16119 - protein, 8 aa, Borrelia garinii PBi
VTTTVDAN

SEQ ID NO: 16120 - protein, 8 aa, Borrelia garinii PBi
TTTVDANT

SEQ ID NO: 16121 - protein, 8 aa, Borrelia garinii PBi
TTVDANTS

SEQ ID NO: 16122 - protein, 8 aa, Borrelia garinii PBi
TVDANTSL

SEQ ID NO: 16123 - protein, 8 aa, Borrelia garinii PBi
VDANTSLA

SEQ ID NO: 16124 - protein, 8 aa, Borrelia garinii PBi
DANTSLAK

SEQ ID NO: 16125 - protein, 8 aa, Borrelia garinii PBi
ANTSLAKI

SEQ ID NO: 16126 - protein, 8 aa, Borrelia garinii PBi
NTSLAKIE

SEQ ID NO: 16127 - protein, 8 aa, Borrelia garinii PBi
TSLAKIEN

SEQ ID NO: 16128 - protein, 8 aa, Borrelia garinii PBi
SLAKIENA

SEQ ID NO: 16129 - protein, 8 aa, Borrelia garinii PBi
LAKIENAI

SEQ ID NO: 16130 - protein, 8 aa, Borrelia garinii PBi
AKIENAIR

SEQ ID NO: 16131 - protein, 8 aa, Borrelia garinii PBi
KIENAIRM

SEQ ID NO: 16132 - protein, 8 aa, Borrelia garinii PBi
IENAIRMI

SEQ ID NO: 16133 - protein, 8 aa, Borrelia garinii PBi
ENAIRMIS

SEQ ID NO: 16134 - protein, 8 aa, Borrelia garinii PBi
NAIRMISD

SEQ ID NO: 16135 - protein, 8 aa, Borrelia garinii PBi
AIRMISDQ

SEQ ID NO: 16136 - protein, 8 aa, Borrelia garinii PBi
IRMISDQR

SEQ ID NO: 16137 - protein, 8 aa, Borrelia garinii PBi
RMISDQRA

SEQ ID NO: 16138 - protein, 8 aa, Borrelia garinii PBi
MISDQRAN

SEQ ID NO: 16139 - protein, 8 aa, Borrelia garinii PBi
ISDQRANL

SEQ ID NO: 16140 - protein, 8 aa, Borrelia garinii PBi
SDQRANLG

SEQ ID NO: 16141 - protein, 8 aa, Borrelia garinii PBi
DQRANLGA

SEQ ID NO: 16142 - protein, 8 aa, Borrelia garinii PBi
QRANLGAF

SEQ ID NO: 16143 - protein, 8 aa, Borrelia garinii PBi
RANLGAFQ

SEQ ID NO: 16144 - protein, 8 aa, Borrelia garinii PBi
ANLGAFQN

SEQ ID NO: 16145 - protein, 8 aa, Borrelia garinii PBi
NLGAFQNR

SEQ ID NO: 16146 - protein, 8 aa, Borrelia garinii PBi
LGAFQNRL

SEQ ID NO: 16147 - protein, 8 aa, Borrelia garinii PBi
GAFQNRLE

SEQ ID NO: 16148 - protein, 8 aa, Borrelia garinii PBi
AFQNRLES

SEQ ID NO: 16149 - protein, 8 aa, Borrelia garinii PBi
FQNRLESI

SEQ ID NO: 16150 - protein, 8 aa, Borrelia garinii PBi
QNRLESIK

SEQ ID NO: 16151 - protein, 8 aa, Borrelia garinii PBi
NRLESIKD

SEQ ID NO: 16152 - protein, 8 aa, Borrelia garinii PBi
RLESIKDS

SEQ ID NO: 16153 - protein, 8 aa, Borrelia garinii PBi
LESIKDST

SEQ ID NO: 16154 - protein, 8 aa, Borrelia garinii PBi
ESIKDSTE

SEQ ID NO: 16155 - protein, 8 aa, Borrelia garinii PBi
SIKDSTEY

SEQ ID NO: 16156 - protein, 8 aa, Borrelia garinii PBi
IKDSTEYA

SEQ ID NO: 16157 - protein, 8 aa, Borrelia garinii PBi
KDSTEYAI

SEQ ID NO: 16158 - protein, 8 aa, Borrelia garinii PBi
DSTEYAIE

SEQ ID NO: 16159 - protein, 8 aa, Borrelia garinii PBi
STEYAIEN

SEQ ID NO: 16160 - protein, 8 aa, Borrelia garinii PBi
TEYAIENL

SEQ ID NO: 16161 - protein, 8 aa, Borrelia garinii PBi
EYAIENLK

SEQ ID NO: 16162 - protein, 8 aa, Borrelia garinii PBi
YAIENLKA

SEQ ID NO: 16163 - protein, 8 aa, Borrelia garinii PBi
AIENLKAS

SEQ ID NO: 16164 - protein, 8 aa, Borrelia garinii PBi
IENLKASY

SEQ ID NO: 16165 - protein, 8 aa, Borrelia garinii PBi
ENLKASYA

SEQ ID NO: 16166 - protein, 8 aa, Borrelia garinii PBi
NLKASYAQ

SEQ ID NO: 16167 - protein, 8 aa, Borrelia garinii PBi
LKASYAQI

SEQ ID NO: 16168 - protein, 8 aa, Borrelia garinii PBi
KASYAQIK

SEQ ID NO: 16169 - protein, 8 aa, Borrelia garinii PBi
ASYAQIKD

SEQ ID NO: 16170 - protein, 8 aa, Borrelia garinii PBi
SYAQIKDA

SEQ ID NO: 16171 - protein, 8 aa, Borrelia garinii PBi
YAQIKDAT

SEQ ID NO: 16172 - protein, 8 aa, Borrelia garinii PBi
AQIKDATM

SEQ ID NO: 16173 - protein, 8 aa, Borrelia garinii PBi
QIKDATMT

SEQ ID NO: 16174 - protein, 8 aa, Borrelia garinii PBi
IKDATMTD

SEQ ID NO: 16175 - protein, 8 aa, Borrelia garinii PBi
KDATMTDE

SEQ ID NO: 16176 - protein, 8 aa, Borrelia garinii PBi
DATMTDEV

SEQ ID NO: 16177 - protein, 8 aa, Borrelia garinii PBi
ATMTDEVV

SEQ ID NO: 16178 - protein, 8 aa, Borrelia garinii PBi
TMTDEVVA

SEQ ID NO: 16179 - protein, 8 aa, Borrelia garinii PBi
MTDEVVAS

SEQ ID NO: 16180 - protein, 8 aa, Borrelia garinii PBi
TDEVVAST

SEQ ID NO: 16181 - protein, 8 aa, Borrelia garinii PBi
DEVVASTT

SEQ ID NO: 16182 - protein, 8 aa, Borrelia garinii PBi
EVVASTTN

SEQ ID NO: 16183 - protein, 8 aa, Borrelia garinii PBi
VVASTTNS

SEQ ID NO: 16184 - protein, 8 aa, Borrelia garinii PBi
VASTTNSI

SEQ ID NO: 16185 - protein, 8 aa, Borrelia garinii PBi
ASTTNSIL

SEQ ID NO: 16186 - protein, 8 aa, Borrelia garinii PBi
STTNSILT

SEQ ID NO: 16187 - protein, 8 aa, Borrelia garinii PBi
TTNSILTQ

SEQ ID NO: 16188 - protein, 8 aa, Borrelia garinii PBi
TNSILTQS

SEQ ID NO: 16189 - protein, 8 aa, Borrelia garinii PBi
NSILTQSA

SEQ ID NO: 16190 - protein, 8 aa, Borrelia garinii PBi
SILTQSAM

SEQ ID NO: 16191 - protein, 8 aa, Borrelia garinii PBi
ILTQSAMA

SEQ ID NO: 16192 - protein, 8 aa, Borrelia garinii PBi
LTQSAMAM

SEQ ID NO: 16193 - protein, 8 aa, Borrelia garinii PBi
TQSAMAMI

SEQ ID NO: 16194 - protein, 8 aa, Borrelia garinii PBi
QSAMAMIA

SEQ ID NO: 16195 - protein, 8 aa, Borrelia garinii PBi
SAMAMIAQ

SEQ ID NO: 16196 - protein, 8 aa, Borrelia garinii PBi
AMAMIAQA

SEQ ID NO: 16197 - protein, 8 aa, Borrelia garinii PBi
MAMIAQAN

SEQ ID NO: 16198 - protein, 8 aa, Borrelia garinii PBi
AMIAQANQ

SEQ ID NO: 16199 - protein, 8 aa, Borrelia garinii PBi
MIAQANQV

SEQ ID NO: 16200 - protein, 8 aa, Borrelia garinii PBi
IAQANQVP

SEQ ID NO: 16201 - protein, 8 aa, Borrelia garinii PBi
AQANQVPQ

SEQ ID NO: 16202 - protein, 8 aa, Borrelia garinii PBi
QANQVPQY

SEQ ID NO: 16203 - protein, 8 aa, Borrelia garinii PBi
ANQVPQYV

SEQ ID NO: 16204 - protein, 8 aa, Borrelia garinii PBi
NQVPQYVL

SEQ ID NO: 16205 - protein, 8 aa, Borrelia garinii PBi
QVPQYVLS

SEQ ID NO: 16206 - protein, 8 aa, Borrelia garinii PBi
VPQYVLSL

SEQ ID NO: 16207 - protein, 8 aa, Borrelia garinii PBi
PQYVLSLL

SEQ ID NO: 16208 - protein, 8 aa, Borrelia garinii PBi
QYVLSLLR

SEQ ID NO: 16209 - protein, 9 aa, Borrelia garinii PBi
MIINHNTSA

SEQ ID NO: 16210 - protein, 9 aa, Borrelia garinii PBi
IINHNTSAI

SEQ ID NO: 16211 - protein, 9 aa, Borrelia garinii PBi
INHNTSAIN

SEQ ID NO: 16212 - protein, 9 aa, Borrelia garinii PBi
NHNTSAINA

SEQ ID NO: 16213 - protein, 9 aa, Borrelia garinii PBi
HNTSAINAS

SEQ ID NO: 16214 - protein, 9 aa, Borrelia garinii PBi
NTSAINASR

SEQ ID NO: 16215 - protein, 9 aa, Borrelia garinii PBi
TSAINASRN

SEQ ID NO: 16216 - protein, 9 aa, Borrelia garinii PBi
SAINASRNN

SEQ ID NO: 16217 - protein, 9 aa, Borrelia garinii PBi
AINASRNNS

SEQ ID NO: 16218 - protein, 9 aa, Borrelia garinii PBi
INASRNNSI

SEQ ID NO: 16219 - protein, 9 aa, Borrelia garinii PBi
NASRNNSIN

SEQ ID NO: 16220 - protein, 9 aa, Borrelia garinii PBi
ASRNNSINA

SEQ ID NO: 16221 - protein, 9 aa, Borrelia garinii PBi
SRNNSINAA

SEQ ID NO: 16222 - protein, 9 aa, Borrelia garinii PBi
RNNSINAAN

SEQ ID NO: 16223 - protein, 9 aa, Borrelia garinii PBi
NNSINAANL

SEQ ID NO: 16224 - protein, 9 aa, Borrelia garinii PBi
NSINAANLS

SEQ ID NO: 16225 - protein, 9 aa, Borrelia garinii PBi
SINAANLSK

SEQ ID NO: 16226 - protein, 9 aa, Borrelia garinii PBi
INAANLSKT

SEQ ID NO: 16227 - protein, 9 aa, Borrelia garinii PBi
NAANLSKTQ

SEQ ID NO: 16228 - protein, 9 aa, Borrelia garinii PBi
AANLSKTQE

SEQ ID NO: 16229 - protein, 9 aa, Borrelia garinii PBi
ANLSKTQEK

SEQ ID NO: 16230 - protein, 9 aa, Borrelia garinii PBi
NLSKTQEKL

SEQ ID NO: 16231 - protein, 9 aa, Borrelia garinii PBi
LSKTQEKLS

SEQ ID NO: 16232 - protein, 9 aa, Borrelia garinii PBi
SKTQEKLSS

SEQ ID NO: 16233 - protein, 9 aa, Borrelia garinii PBi
KTQEKLSSG

SEQ ID NO: 16234 - protein, 9 aa, Borrelia garinii PBi
TQEKLSSGY

SEQ ID NO: 16235 - protein, 9 aa, Borrelia garinii PBi
QEKLSSGYR

SEQ ID NO: 16236 - protein, 9 aa, Borrelia garinii PBi
EKLSSGYRI

SEQ ID NO: 16237 - protein, 9 aa, Borrelia garinii PBi
KLSSGYRIN

SEQ ID NO: 16238 - protein, 9 aa, Borrelia garinii PBi
LSSGYRINR

SEQ ID NO: 16239 - protein, 9 aa, Borrelia garinii PBi
SSGYRINRA

SEQ ID NO: 16240 - protein, 9 aa, Borrelia garinii PBi
SGYRINRAS

SEQ ID NO: 16241 - protein, 9 aa, Borrelia garinii PBi
GYRINRASD

SEQ ID NO: 16242 - protein, 9 aa, Borrelia garinii PBi
YRINRASDD

SEQ ID NO: 16243 - protein, 9 aa, Borrelia garinii PBi
RINRASDDA

SEQ ID NO: 16244 - protein, 9 aa, Borrelia garinii PBi
INRASDDAA

SEQ ID NO: 16245 - protein, 9 aa, Borrelia garinii PBi
NRASDDAAG

SEQ ID NO: 16246 - protein, 9 aa, Borrelia garinii PBi
RASDDAAGM

SEQ ID NO: 16247 - protein, 9 aa, Borrelia garinii PBi
ASDDAAGMG

SEQ ID NO: 16248 - protein, 9 aa, Borrelia garinii PBi
SDDAAGMGV

SEQ ID NO: 16249 - protein, 9 aa, Borrelia garinii PBi
DDAAGMGVS

SEQ ID NO: 16250 - protein, 9 aa, Borrelia garinii PBi
DAAGMGVSG

SEQ ID NO: 16251 - protein, 9 aa, Borrelia garinii PBi
AAGMGVSGK

SEQ ID NO: 16252 - protein, 9 aa, Borrelia garinii PBi
AGMGVSGKI

SEQ ID NO: 16253 - protein, 9 aa, Borrelia garinii PBi
GMGVSGKIN

SEQ ID NO: 16254 - protein, 9 aa, Borrelia garinii PBi
MGVSGKINA

SEQ ID NO: 16255 - protein, 9 aa, Borrelia garinii PBi
GVSGKINAQ

SEQ ID NO: 16256 - protein, 9 aa, Borrelia garinii PBi
VSGKINAQI

SEQ ID NO: 16257 - protein, 9 aa, Borrelia garinii PBi
SGKINAQIR

SEQ ID NO: 16258 - protein, 9 aa, Borrelia garinii PBi
GKINAQIRG

SEQ ID NO: 16259 - protein, 9 aa, Borrelia garinii PBi
KINAQIRGL

SEQ ID NO: 16260 - protein, 9 aa, Borrelia garinii PBi
INAQIRGLS

SEQ ID NO: 16261 - protein, 9 aa, Borrelia garinii PBi
NAQIRGLSQ

SEQ ID NO: 16262 - protein, 9 aa, Borrelia garinii PBi
AQIRGLSQA

SEQ ID NO: 16263 - protein, 9 aa, Borrelia garinii PBi
QIRGLSQAS

SEQ ID NO: 16264 - protein, 9 aa, Borrelia garinii PBi
IRGLSQASR

SEQ ID NO: 16265 - protein, 9 aa, Borrelia garinii PBi
RGLSQASRN

SEQ ID NO: 16266 - protein, 9 aa, Borrelia garinii PBi
GLSQASRNT

SEQ ID NO: 16267 - protein, 9 aa, Borrelia garinii PBi
LSQASRNTS

SEQ ID NO: 16268 - protein, 9 aa, Borrelia garinii PBi
SQASRNTSK

SEQ ID NO: 16269 - protein, 9 aa, Borrelia garinii PBi
QASRNTSKA

SEQ ID NO: 16270 - protein, 9 aa, Borrelia garinii PBi
ASRNTSKAI

SEQ ID NO: 16271 - protein, 9 aa, Borrelia garinii PBi
SRNTSKAIN

SEQ ID NO: 16272 - protein, 9 aa, Borrelia garinii PBi
RNTSKAINF

SEQ ID NO: 16273 - protein, 9 aa, Borrelia garinii PBi
NTSKAINFI

SEQ ID NO: 16274 - protein, 9 aa, Borrelia garinii PBi
TSKAINFIQ

SEQ ID NO: 16275 - protein, 9 aa, Borrelia garinii PBi
SKAINFIQT

SEQ ID NO: 16276 - protein, 9 aa, Borrelia garinii PBi
KAINFIQTT

SEQ ID NO: 16277 - protein, 9 aa, Borrelia garinii PBi
AINFIQTTE

SEQ ID NO: 16278 - protein, 9 aa, Borrelia garinii PBi
INFIQTTEG

SEQ ID NO: 16279 - protein, 9 aa, Borrelia garinii PBi
NFIQTTEGN

SEQ ID NO: 16280 - protein, 9 aa, Borrelia garinii PBi
FIQTTEGNL

SEQ ID NO: 16281 - protein, 9 aa, Borrelia garinii PBi
IQTTEGNLN

SEQ ID NO: 16282 - protein, 9 aa, Borrelia garinii PBi
QTTEGNLNE

SEQ ID NO: 16283 - protein, 9 aa, Borrelia garinii PBi
TTEGNLNEV

SEQ ID NO: 16284 - protein, 9 aa, Borrelia garinii PBi
TEGNLNEVE

SEQ ID NO: 16285 - protein, 9 aa, Borrelia garinii PBi
EGNLNEVEK

SEQ ID NO: 16286 - protein, 9 aa, Borrelia garinii PBi
GNLNEVEKV

SEQ ID NO: 16287 - protein, 9 aa, Borrelia garinii PBi
NLNEVEKVL

SEQ ID NO: 16288 - protein, 9 aa, Borrelia garinii PBi
LNEVEKVLV

SEQ ID NO: 16289 - protein, 9 aa, Borrelia garinii PBi
NEVEKVLVR

SEQ ID NO: 16290 - protein, 9 aa, Borrelia garinii PBi
EVEKVLVRM

SEQ ID NO: 16291 - protein, 9 aa, Borrelia garinii PBi
VEKVLVRMK

SEQ ID NO: 16292 - protein, 9 aa, Borrelia garinii PBi
EKVLVRMKE

SEQ ID NO: 16293 - protein, 9 aa, Borrelia garinii PBi
KVLVRMKEL

SEQ ID NO: 16294 - protein, 9 aa, Borrelia garinii PBi
VLVRMKELA

SEQ ID NO: 16295 - protein, 9 aa, Borrelia garinii PBi
LVRMKELAV

SEQ ID NO: 16296 - protein, 9 aa, Borrelia garinii PBi
VRMKELAVQ

SEQ ID NO: 16297 - protein, 9 aa, Borrelia garinii PBi
RMKELAVQS

SEQ ID NO: 16298 - protein, 9 aa, Borrelia garinii PBi
MKELAVQSG

SEQ ID NO: 16299 - protein, 9 aa, Borrelia garinii PBi
KELAVQSGN

SEQ ID NO: 16300 - protein, 9 aa, Borrelia garinii PBi
ELAVQSGNG

SEQ ID NO: 16301 - protein, 9 aa, Borrelia garinii PBi
LAVQSGNGT

SEQ ID NO: 16302 - protein, 9 aa, Borrelia garinii PBi
AVQSGNGTY

SEQ ID NO: 16303 - protein, 9 aa, Borrelia garinii PBi
VQSGNGTYS

SEQ ID NO: 16304 - protein, 9 aa, Borrelia garinii PBi
QSGNGTYSD

SEQ ID NO: 16305 - protein, 9 aa, Borrelia garinii PBi
SGNGTYSDA

SEQ ID NO: 16306 - protein, 9 aa, Borrelia garinii PBi
GNGTYSDAD

SEQ ID NO: 16307 - protein, 9 aa, Borrelia garinii PBi
NGTYSDADR

SEQ ID NO: 16308 - protein, 9 aa, Borrelia garinii PBi
GTYSDADRG

SEQ ID NO: 16309 - protein, 9 aa, Borrelia garinii PBi
TYSDADRGS

SEQ ID NO: 16310 - protein, 9 aa, Borrelia garinii PBi
YSDADRGSI

SEQ ID NO: 16311 - protein, 9 aa, Borrelia garinii PBi
SDADRGSIQ

SEQ ID NO: 16312 - protein, 9 aa, Borrelia garinii PBi
DADRGSIQI

SEQ ID NO: 16313 - protein, 9 aa, Borrelia garinii PBi
ADRGSIQIE

SEQ ID NO: 16314 - protein, 9 aa, Borrelia garinii PBi
DRGSIQIEI

SEQ ID NO: 16315 - protein, 9 aa, Borrelia garinii PBi
RGSIQIEIE

SEQ ID NO: 16316 - protein, 9 aa, Borrelia garinii PBi
GSIQIEIEQ

SEQ ID NO: 16317 - protein, 9 aa, Borrelia garinii PBi
SIQIEIEQL

SEQ ID NO: 16318 - protein, 9 aa, Borrelia garinii PBi
IQIEIEQLT

SEQ ID NO: 16319 - protein, 9 aa, Borrelia garinii PBi
QIEIEQLTD

SEQ ID NO: 16320 - protein, 9 aa, Borrelia garinii PBi
IEIEQLTDE

SEQ ID NO: 16321 - protein, 9 aa, Borrelia garinii PBi
EIEQLTDEI

SEQ ID NO: 16322 - protein, 9 aa, Borrelia garinii PBi
IEQLTDEIN

SEQ ID NO: 16323 - protein, 9 aa, Borrelia garinii PBi
EQLTDEINR

SEQ ID NO: 16324 - protein, 9 aa, Borrelia garinii PBi
QLTDEINRI

SEQ ID NO: 16325 - protein, 9 aa, Borrelia garinii PBi
LTDEINRIA

SEQ ID NO: 16326 - protein, 9 aa, Borrelia garinii PBi
TDEINRIAD

SEQ ID NO: 16327 - protein, 9 aa, Borrelia garinii PBi
DEINRIADQ

SEQ ID NO: 16328 - protein, 9 aa, Borrelia garinii PBi
EINRIADQA

SEQ ID NO: 16329 - protein, 9 aa, Borrelia garinii PBi
INRIADQAQ

SEQ ID NO: 16330 - protein, 9 aa, Borrelia garinii PBi
NRIADQAQY

SEQ ID NO: 16331 - protein, 9 aa, Borrelia garinii PBi
RIADQAQYN

SEQ ID NO: 16332 - protein, 9 aa, Borrelia garinii PBi
IADQAQYNQ

SEQ ID NO: 16333 - protein, 9 aa, Borrelia garinii PBi
ADQAQYNQM

SEQ ID NO: 16334 - protein, 9 aa, Borrelia garinii PBi
DQAQYNQMH

SEQ ID NO: 16335 - protein, 9 aa, Borrelia garinii PBi
QAQYNQMHM

SEQ ID NO: 16336 - protein, 9 aa, Borrelia garinii PBi
AQYNQMHML

SEQ ID NO: 16337 - protein, 9 aa, Borrelia garinii PBi
QYNQMHMLS

SEQ ID NO: 16338 - protein, 9 aa, Borrelia garinii PBi
YNQMHMLSN

SEQ ID NO: 16339 - protein, 9 aa, Borrelia garinii PBi
NQMHMLSNK

SEQ ID NO: 16340 - protein, 9 aa, Borrelia garinii PBi
QMHMLSNKS

SEQ ID NO: 16341 - protein, 9 aa, Borrelia garinii PBi
MHMLSNKSA

SEQ ID NO: 16342 - protein, 9 aa, Borrelia garinii PBi
HMLSNKSAS

SEQ ID NO: 16343 - protein, 9 aa, Borrelia garinii PBi
MLSNKSASQ

SEQ ID NO: 16344 - protein, 9 aa, Borrelia garinii PBi
LSNKSASQN

SEQ ID NO: 16345 - protein, 9 aa, Borrelia garinii PBi
SNKSASQNV

SEQ ID NO: 16346 - protein, 9 aa, Borrelia garinii PBi
NKSASQNVR

SEQ ID NO: 16347 - protein, 9 aa, Borrelia garinii PBi
KSASQNVRT

SEQ ID NO: 16348 - protein, 9 aa, Borrelia garinii PBi
SASQNVRTA

SEQ ID NO: 16349 - protein, 9 aa, Borrelia garinii PBi
ASQNVRTAE

SEQ ID NO: 16350 - protein, 9 aa, Borrelia garinii PBi
SQNVRTAEE

SEQ ID NO: 16351 - protein, 9 aa, Borrelia garinii PBi
QNVRTAEEL

SEQ ID NO: 16352 - protein, 9 aa, Borrelia garinii PBi
NVRTAEELG

SEQ ID NO: 16353 - protein, 9 aa, Borrelia garinii PBi
VRTAEELGM

SEQ ID NO: 16354 - protein, 9 aa, Borrelia garinii PBi
RTAEELGMQ

SEQ ID NO: 16355 - protein, 9 aa, Borrelia garinii PBi
TAEELGMQP

SEQ ID NO: 16356 - protein, 9 aa, Borrelia garinii PBi
AEELGMQPA

SEQ ID NO: 16357 - protein, 9 aa, Borrelia garinii PBi
EELGMQPAK

SEQ ID NO: 16358 - protein, 9 aa, Borrelia garinii PBi
ELGMQPAKI

SEQ ID NO: 16359 - protein, 9 aa, Borrelia garinii PBi
LGMQPAKIN

SEQ ID NO: 16360 - protein, 9 aa, Borrelia garinii PBi
GMQPAKINT

SEQ ID NO: 16361 - protein, 9 aa, Borrelia garinii PBi
MQPAKINTP

SEQ ID NO: 16362 - protein, 9 aa, Borrelia garinii PBi
QPAKINTPA

SEQ ID NO: 16363 - protein, 9 aa, Borrelia garinii PBi
PAKINTPAS

SEQ ID NO: 16364 - protein, 9 aa, Borrelia garinii PBi
AKINTPASL

SEQ ID NO: 16365 - protein, 9 aa, Borrelia garinii PBi
KINTPASLS

SEQ ID NO: 16366 - protein, 9 aa, Borrelia garinii PBi
INTPASLSG

SEQ ID NO: 16367 - protein, 9 aa, Borrelia garinii PBi
NTPASLSGS

SEQ ID NO: 16368 - protein, 9 aa, Borrelia garinii PBi
TPASLSGSQ

SEQ ID NO: 16369 - protein, 9 aa, Borrelia garinii PBi
PASLSGSQA

SEQ ID NO: 16370 - protein, 9 aa, Borrelia garinii PBi
ASLSGSQAS

SEQ ID NO: 16371 - protein, 9 aa, Borrelia garinii PBi
SLSGSQASW

SEQ ID NO: 16372 - protein, 9 aa, Borrelia garinii PBi
LSGSQASWT

SEQ ID NO: 16373 - protein, 9 aa, Borrelia garinii PBi
SGSQASWTL

SEQ ID NO: 16374 - protein, 9 aa, Borrelia garinii PBi
GSQASWTLR

SEQ ID NO: 16375 - protein, 9 aa, Borrelia garinii PBi
SQASWTLRV

SEQ ID NO: 16376 - protein, 9 aa, Borrelia garinii PBi
QASWTLRVH

SEQ ID NO: 16377 - protein, 9 aa, Borrelia garinii PBi
ASWTLRVHV

SEQ ID NO: 16378 - protein, 9 aa, Borrelia garinii PBi
SWTLRVHVG

SEQ ID NO: 16379 - protein, 9 aa, Borrelia garinii PBi
WTLRVHVGA

SEQ ID NO: 16380 - protein, 9 aa, Borrelia garinii PBi
TLRVHVGAN

SEQ ID NO: 16381 - protein, 9 aa, Borrelia garinii PBi
LRVHVGANQ

SEQ ID NO: 16382 - protein, 9 aa, Borrelia garinii PBi
RVHVGANQD

SEQ ID NO: 16383 - protein, 9 aa, Borrelia garinii PBi
VHVGANQDE

SEQ ID NO: 16384 - protein, 9 aa, Borrelia garinii PBi
HVGANQDEA

SEQ ID NO: 16385 - protein, 9 aa, Borrelia garinii PBi
VGANQDEAI

SEQ ID NO: 16386 - protein, 9 aa, Borrelia garinii PBi
GANQDEAIA

SEQ ID NO: 16387 - protein, 9 aa, Borrelia garinii PBi
ANQDEAIAV

SEQ ID NO: 16388 - protein, 9 aa, Borrelia garinii PBi
NQDEAIAVN

SEQ ID NO: 16389 - protein, 9 aa, Borrelia garinii PBi
QDEAIAVNI

SEQ ID NO: 16390 - protein, 9 aa, Borrelia garinii PBi
DEAIAVNIY

SEQ ID NO: 16391 - protein, 9 aa, Borrelia garinii PBi
EAIAVNIYA

SEQ ID NO: 16392 - protein, 9 aa, Borrelia garinii PBi
AIAVNIYAA

SEQ ID NO: 16393 - protein, 9 aa, Borrelia garinii PBi
IAVNIYAAN

SEQ ID NO: 16394 - protein, 9 aa, Borrelia garinii PBi
AVNIYAANV

SEQ ID NO: 16395 - protein, 9 aa, Borrelia garinii PBi
VNIYAANVA

SEQ ID NO: 16396 - protein, 9 aa, Borrelia garinii PBi
NIYAANVAN

SEQ ID NO: 16397 - protein, 9 aa, Borrelia garinii PBi
IYAANVANL

SEQ ID NO: 16398 - protein, 9 aa, Borrelia garinii PBi
YAANVANLF

SEQ ID NO: 16399 - protein, 9 aa, Borrelia garinii PBi
AANVANLFS

SEQ ID NO: 16400 - protein, 9 aa, Borrelia garinii PBi
ANVANLFSG

SEQ ID NO: 16401 - protein, 9 aa, Borrelia garinii PBi
NVANLFSGE

SEQ ID NO: 16402 - protein, 9 aa, Borrelia garinii PBi
VANLFSGEG

SEQ ID NO: 16403 - protein, 9 aa, Borrelia garinii PBi
ANLFSGEGS

SEQ ID NO: 16404 - protein, 9 aa, Borrelia garinii PBi
NLFSGEGSQ

SEQ ID NO: 16405 - protein, 9 aa, Borrelia garinii PBi
LFSGEGSQA

SEQ ID NO: 16406 - protein, 9 aa, Borrelia garinii PBi
FSGEGSQAA

SEQ ID NO: 16407 - protein, 9 aa, Borrelia garinii PBi
SGEGSQAAQ

SEQ ID NO: 16408 - protein, 9 aa, Borrelia garinii PBi
GEGSQAAQT

SEQ ID NO: 16409 - protein, 9 aa, Borrelia garinii PBi
EGSQAAQTA

SEQ ID NO: 16410 - protein, 9 aa, Borrelia garinii PBi
GSQAAQTAP

SEQ ID NO: 16411 - protein, 9 aa, Borrelia garinii PBi
SQAAQTAPV

SEQ ID NO: 16412 - protein, 9 aa, Borrelia garinii PBi
QAAQTAPVQ

SEQ ID NO: 16413 - protein, 9 aa, Borrelia garinii PBi
AAQTAPVQE

SEQ ID NO: 16414 - protein, 9 aa, Borrelia garinii PBi
AQTAPVQEG

SEQ ID NO: 16415 - protein, 9 aa, Borrelia garinii PBi
QTAPVQEGA

SEQ ID NO: 16416 - protein, 9 aa, Borrelia garinii PBi
TAPVQEGAQ

SEQ ID NO: 16417 - protein, 9 aa, Borrelia garinii PBi
APVQEGAQQ

SEQ ID NO: 16418 - protein, 9 aa, Borrelia garinii PBi
PVQEGAQQE

SEQ ID NO: 16419 - protein, 9 aa, Borrelia garinii PBi
VQEGAQQEG

SEQ ID NO: 16420 - protein, 9 aa, Borrelia garinii PBi
QEGAQQEGA

SEQ ID NO: 16421 - protein, 9 aa, Borrelia garinii PBi
EGAQQEGAQ

SEQ ID NO: 16422 - protein, 9 aa, Borrelia garinii PBi
GAQQEGAQQ

SEQ ID NO: 16423 - protein, 9 aa, Borrelia garinii PBi
AQQEGAQQP

SEQ ID NO: 16424 - protein, 9 aa, Borrelia garinii PBi
QQEGAQQPA

SEQ ID NO: 16425 - protein, 9 aa, Borrelia garinii PBi
QEGAQQPAP

SEQ ID NO: 16426 - protein, 9 aa, Borrelia garinii PBi
EGAQQPAPA

SEQ ID NO: 16427 - protein, 9 aa, Borrelia garinii PBi
GAQQPAPAT

SEQ ID NO: 16428 - protein, 9 aa, Borrelia garinii PBi
AQQPAPATA

SEQ ID NO: 16429 - protein, 9 aa, Borrelia garinii PBi
QQPAPATAP

SEQ ID NO: 16430 - protein, 9 aa, Borrelia garinii PBi
QPAPATAPS

SEQ ID NO: 16431 - protein, 9 aa, Borrelia garinii PBi
PAPATAPSQ

SEQ ID NO: 16432 - protein, 9 aa, Borrelia garinii PBi
APATAPSQG

SEQ ID NO: 16433 - protein, 9 aa, Borrelia garinii PBi
PATAPSQGG

SEQ ID NO: 16434 - protein, 9 aa, Borrelia garinii PBi
ATAPSQGGV

SEQ ID NO: 16435 - protein, 9 aa, Borrelia garinii PBi
TAPSQGGVN

SEQ ID NO: 16436 - protein, 9 aa, Borrelia garinii PBi
APSQGGVNS

SEQ ID NO: 16437 - protein, 9 aa, Borrelia garinii PBi
PSQGGVNSP

SEQ ID NO: 16438 - protein, 9 aa, Borrelia garinii PBi
SQGGVNSPV

SEQ ID NO: 16439 - protein, 9 aa, Borrelia garinii PBi
QGGVNSPVN

SEQ ID NO: 16440 - protein, 9 aa, Borrelia garinii PBi
GGVNSPVNV

SEQ ID NO: 16441 - protein, 9 aa, Borrelia garinii PBi
GVNSPVNVT

SEQ ID NO: 16442 - protein, 9 aa, Borrelia garinii PBi
VNSPVNVTT

SEQ ID NO: 16443 - protein, 9 aa, Borrelia garinii PBi
NSPVNVTTT

SEQ ID NO: 16444 - protein, 9 aa, Borrelia garinii PBi
SPVNVTTTV

SEQ ID NO: 16445 - protein, 9 aa, Borrelia garinii PBi
PVNVTTTVD

SEQ ID NO: 16446 - protein, 9 aa, Borrelia garinii PBi
VNVTTTVDA

SEQ ID NO: 16447 - protein, 9 aa, Borrelia garinii PBi
NVTTTVDAN

SEQ ID NO: 16448 - protein, 9 aa, Borrelia garinii PBi
VTTTVDANT

SEQ ID NO: 16449 - protein, 9 aa, Borrelia garinii PBi
TTTVDANTS

SEQ ID NO: 16450 - protein, 9 aa, Borrelia garinii PBi
TTVDANTSL

SEQ ID NO: 16451 - protein, 9 aa, Borrelia garinii PBi
TVDANTSLA

SEQ ID NO: 16452 - protein, 9 aa, Borrelia garinii PBi
VDANTSLAK

SEQ ID NO: 16453 - protein, 9 aa, Borrelia garinii PBi
DANTSLAKI

SEQ ID NO: 16454 - protein, 9 aa, Borrelia garinii PBi
ANTSLAKIE

SEQ ID NO: 16455 - protein, 9 aa, Borrelia garinii PBi
NTSLAKIEN

SEQ ID NO: 16456 - protein, 9 aa, Borrelia garinii PBi
TSLAKIENA

SEQ ID NO: 16457 - protein, 9 aa, Borrelia garinii PBi
SLAKIENAI

SEQ ID NO: 16458 - protein, 9 aa, Borrelia garinii PBi
LAKIENAIR

SEQ ID NO: 16459 - protein, 9 aa, Borrelia garinii PBi
AKIENAIRM

SEQ ID NO: 16460 - protein, 9 aa, Borrelia garinii PBi
KIENAIRMI

SEQ ID NO: 16461 - protein, 9 aa, Borrelia garinii PBi
IENAIRMIS

SEQ ID NO: 16462 - protein, 9 aa, Borrelia garinii PBi
ENAIRMISD

SEQ ID NO: 16463 - protein, 9 aa, Borrelia garinii PBi
NAIRMISDQ

SEQ ID NO: 16464 - protein, 9 aa, Borrelia garinii PBi
AIRMISDQR

SEQ ID NO: 16465 - protein, 9 aa, Borrelia garinii PBi
IRMISDQRA

SEQ ID NO: 16466 - protein, 9 aa, Borrelia garinii PBi
RMISDQRAN

SEQ ID NO: 16467 - protein, 9 aa, Borrelia garinii PBi
MISDQRANL

SEQ ID NO: 16468 - protein, 9 aa, Borrelia garinii PBi
ISDQRANLG

SEQ ID NO: 16469 - protein, 9 aa, Borrelia garinii PBi
SDQRANLGA

SEQ ID NO: 16470 - protein, 9 aa, Borrelia garinii PBi
DQRANLGAF

SEQ ID NO: 16471 - protein, 9 aa, Borrelia garinii PBi
QRANLGAFQ

SEQ ID NO: 16472 - protein, 9 aa, Borrelia garinii PBi
RANLGAFQN

SEQ ID NO: 16473 - protein, 9 aa, Borrelia garinii PBi
ANLGAFQNR

SEQ ID NO: 16474 - protein, 9 aa, Borrelia garinii PBi
NLGAFQNRL

SEQ ID NO: 16475 - protein, 9 aa, Borrelia garinii PBi
LGAFQNRLE

SEQ ID NO: 16476 - protein, 9 aa, Borrelia garinii PBi
GAFQNRLES

SEQ ID NO: 16477 - protein, 9 aa, Borrelia garinii PBi
AFQNRLESI

SEQ ID NO: 16478 - protein, 9 aa, Borrelia garinii PBi
FQNRLESIK

SEQ ID NO: 16479 - protein, 9 aa, Borrelia garinii PBi
QNRLESIKD

SEQ ID NO: 16480 - protein, 9 aa, Borrelia garinii PBi
NRLESIKDS

SEQ ID NO: 16481 - protein, 9 aa, Borrelia garinii PBi
RLESIKDST

SEQ ID NO: 16482 - protein, 9 aa, Borrelia garinii PBi
LESIKDSTE

SEQ ID NO: 16483 - protein, 9 aa, Borrelia garinii PBi
ESIKDSTEY

SEQ ID NO: 16484 - protein, 9 aa, Borrelia garinii PBi
SIKDSTEYA

SEQ ID NO: 16485 - protein, 9 aa, Borrelia garinii PBi
IKDSTEYAI

SEQ ID NO: 16486 - protein, 9 aa, Borrelia garinii PBi
KDSTEYAIE

SEQ ID NO: 16487 - protein, 9 aa, Borrelia garinii PBi
DSTEYAIEN

SEQ ID NO: 16488 - protein, 9 aa, Borrelia garinii PBi
STEYAIENL

SEQ ID NO: 16489 - protein, 9 aa, Borrelia garinii PBi
TEYAIENLK

SEQ ID NO: 16490 - protein, 9 aa, Borrelia garinii PBi
EYAIENLKA

SEQ ID NO: 16491 - protein, 9 aa, Borrelia garinii PBi
YAIENLKAS

SEQ ID NO: 16492 - protein, 9 aa, Borrelia garinii PBi
AIENLKASY

SEQ ID NO: 16493 - protein, 9 aa, Borrelia garinii PBi
IENLKASYA

SEQ ID NO: 16494 - protein, 9 aa, Borrelia garinii PBi
ENLKASYAQ

SEQ ID NO: 16495 - protein, 9 aa, Borrelia garinii PBi
NLKASYAQI

SEQ ID NO: 16496 - protein, 9 aa, Borrelia garinii PBi
LKASYAQIK

SEQ ID NO: 16497 - protein, 9 aa, Borrelia garinii PBi
KASYAQIKD

SEQ ID NO: 16498 - protein, 9 aa, Borrelia garinii PBi
ASYAQIKDA

SEQ ID NO: 16499 - protein, 9 aa, Borrelia garinii PBi
SYAQIKDAT

SEQ ID NO: 16500 - protein, 9 aa, Borrelia garinii PBi
YAQIKDATM

SEQ ID NO: 16501 - protein, 9 aa, Borrelia garinii PBi
AQIKDATMT

SEQ ID NO: 16502 - protein, 9 aa, Borrelia garinii PBi
QIKDATMTD

SEQ ID NO: 16503 - protein, 9 aa, Borrelia garinii PBi
IKDATMTDE

SEQ ID NO: 16504 - protein, 9 aa, Borrelia garinii PBi
KDATMTDEV

SEQ ID NO: 16505 - protein, 9 aa, Borrelia garinii PBi
DATMTDEVV

SEQ ID NO: 16506 - protein, 9 aa, Borrelia garinii PBi
ATMTDEVVA

SEQ ID NO: 16507 - protein, 9 aa, Borrelia garinii PBi
TMTDEVVAS

SEQ ID NO: 16508 - protein, 9 aa, Borrelia garinii PBi
MTDEVVAST

SEQ ID NO: 16509 - protein, 9 aa, Borrelia garinii PBi
TDEVVASTT

SEQ ID NO: 16510 - protein, 9 aa, Borrelia garinii PBi
DEVVASTTN

SEQ ID NO: 16511 - protein, 9 aa, Borrelia garinii PBi
EVVASTTNS

SEQ ID NO: 16512 - protein, 9 aa, Borrelia garinii PBi
VVASTTNSI

SEQ ID NO: 16513 - protein, 9 aa, Borrelia garinii PBi
VASTTNSIL

SEQ ID NO: 16514 - protein, 9 aa, Borrelia garinii PBi
ASTTNSILT

SEQ ID NO: 16515 - protein, 9 aa, Borrelia garinii PBi
STTNSILTQ

SEQ ID NO: 16516 - protein, 9 aa, Borrelia garinii PBi
TTNSILTQS

SEQ ID NO: 16517 - protein, 9 aa, Borrelia garinii PBi
TNSILTQSA

SEQ ID NO: 16518 - protein, 9 aa, Borrelia garinii PBi
NSILTQSAM

SEQ ID NO: 16519 - protein, 9 aa, Borrelia garinii PBi
SILTQSAMA

SEQ ID NO: 16520 - protein, 9 aa, Borrelia garinii PBi
ILTQSAMAM

SEQ ID NO: 16521 - protein, 9 aa, Borrelia garinii PBi
LTQSAMAMI

SEQ ID NO: 16522 - protein, 9 aa, Borrelia garinii PBi
TQSAMAMIA

SEQ ID NO: 16523 - protein, 9 aa, Borrelia garinii PBi
QSAMAMIAQ

SEQ ID NO: 16524 - protein, 9 aa, Borrelia garinii PBi
SAMAMIAQA

SEQ ID NO: 16525 - protein, 9 aa, Borrelia garinii PBi
AMAMIAQAN

SEQ ID NO: 16526 - protein, 9 aa, Borrelia garinii PBi
MAMIAQANQ

SEQ ID NO: 16527 - protein, 9 aa, Borrelia garinii PBi
AMIAQANQV

SEQ ID NO: 16528 - protein, 9 aa, Borrelia garinii PBi
MIAQANQVP

SEQ ID NO: 16529 - protein, 9 aa, Borrelia garinii PBi
IAQANQVPQ

SEQ ID NO: 16530 - protein, 9 aa, Borrelia garinii PBi
AQANQVPQY

SEQ ID NO: 16531 - protein, 9 aa, Borrelia garinii PBi
QANQVPQYV

SEQ ID NO: 16532 - protein, 9 aa, Borrelia garinii PBi
ANQVPQYVL

SEQ ID NO: 16533 - protein, 9 aa, Borrelia garinii PBi
NQVPQYVLS

SEQ ID NO: 16534 - protein, 9 aa, Borrelia garinii PBi
QVPQYVLSL

SEQ ID NO: 16535 - protein, 9 aa, Borrelia garinii PBi
VPQYVLSLL

SEQ ID NO: 16536 - protein, 9 aa, Borrelia garinii PBi
PQYVLSLLR

SEQ ID NO: 16537 - protein, 10 aa, Borrelia garinii PBi
MIINHNTSAI

SEQ ID NO: 16538 - protein, 10 aa, Borrelia garinii PBi
IINHNTSAIN

SEQ ID NO: 16539 - protein, 10 aa, Borrelia garinii PBi
INHNTSAINA

SEQ ID NO: 16540 - protein, 10 aa, Borrelia garinii PBi
NHNTSAINAS

SEQ ID NO: 16541 - protein, 10 aa, Borrelia garinii PBi
HNTSAINASR

SEQ ID NO: 16542 - protein, 10 aa, Borrelia garinii PBi
NTSAINASRN

SEQ ID NO: 16543 - protein, 10 aa, Borrelia garinii PBi
TSAINASRNN

SEQ ID NO: 16544 - protein, 10 aa, Borrelia garinii PBi
SAINASRNNS

SEQ ID NO: 16545 - protein, 10 aa, Borrelia garinii PBi
AINASRNNSI

SEQ ID NO: 16546 - protein, 10 aa, Borrelia garinii PBi
INASRNNSIN

SEQ ID NO: 16547 - protein, 10 aa, Borrelia garinii PBi
NASRNNSINA

SEQ ID NO: 16548 - protein, 10 aa, Borrelia garinii PBi
ASRNNSINAA

SEQ ID NO: 16549 - protein, 10 aa, Borrelia garinii PBi
SRNNSINAAN

SEQ ID NO: 16550 - protein, 10 aa, Borrelia garinii PBi
RNNSINAANL

SEQ ID NO: 16551 - protein, 10 aa, Borrelia garinii PBi
NNSINAANLS

SEQ ID NO: 16552 - protein, 10 aa, Borrelia garinii PBi
NSINAANLSK

SEQ ID NO: 16553 - protein, 10 aa, Borrelia garinii PBi
SINAANLSKT

SEQ ID NO: 16554 - protein, 10 aa, Borrelia garinii PBi
INAANLSKTQ

SEQ ID NO: 16555 - protein, 10 aa, Borrelia garinii PBi
NAANLSKTQE

SEQ ID NO: 16556 - protein, 10 aa, Borrelia garinii PBi
AANLSKTQEK

SEQ ID NO: 16557 - protein, 10 aa, Borrelia garinii PBi
ANLSKTQEKL

SEQ ID NO: 16558 - protein, 10 aa, Borrelia garinii PBi
NLSKTQEKLS

SEQ ID NO: 16559 - protein, 10 aa, Borrelia garinii PBi
LSKTQEKLSS

SEQ ID NO: 16560 - protein, 10 aa, Borrelia garinii PBi
SKTQEKLSSG

SEQ ID NO: 16561 - protein, 10 aa, Borrelia garinii PBi
KTQEKLSSGY

SEQ ID NO: 16562 - protein, 10 aa, Borrelia garinii PBi
TQEKLSSGYR

SEQ ID NO: 16563 - protein, 10 aa, Borrelia garinii PBi
QEKLSSGYRI

SEQ ID NO: 16564 - protein, 10 aa, Borrelia garinii PBi
EKLSSGYRIN

SEQ ID NO: 16565 - protein, 10 aa, Borrelia garinii PBi
KLSSGYRINR

SEQ ID NO: 16566 - protein, 10 aa, Borrelia garinii PBi
LSSGYRINRA

SEQ ID NO: 16567 - protein, 10 aa, Borrelia garinii PBi
SSGYRINRAS

SEQ ID NO: 16568 - protein, 10 aa, Borrelia garinii PBi
SGYRINRASD

SEQ ID NO: 16569 - protein, 10 aa, Borrelia garinii PBi
GYRINRASDD

SEQ ID NO: 16570 - protein, 10 aa, Borrelia garinii PBi
YRINRASDDA

SEQ ID NO: 16571 - protein, 10 aa, Borrelia garinii PBi
RINRASDDAA

SEQ ID NO: 16572 - protein, 10 aa, Borrelia garinii PBi
INRASDDAAG

SEQ ID NO: 16573 - protein, 10 aa, Borrelia garinii PBi
NRASDDAAGM

SEQ ID NO: 16574 - protein, 10 aa, Borrelia garinii PBi
RASDDAAGMG

SEQ ID NO: 16575 - protein, 10 aa, Borrelia garinii PBi
ASDDAAGMGV

SEQ ID NO: 16576 - protein, 10 aa, Borrelia garinii PBi
SDDAAGMGVS

SEQ ID NO: 16577 - protein, 10 aa, Borrelia garinii PBi
DDAAGMGVSG

SEQ ID NO: 16578 - protein, 10 aa, Borrelia garinii PBi
DAAGMGVSGK

SEQ ID NO: 16579 - protein, 10 aa, Borrelia garinii PBi
AAGMGVSGKI

SEQ ID NO: 16580 - protein, 10 aa, Borrelia garinii PBi
AGMGVSGKIN

SEQ ID NO: 16581 - protein, 10 aa, Borrelia garinii PBi
GMGVSGKINA

SEQ ID NO: 16582 - protein, 10 aa, Borrelia garinii PBi
MGVSGKINAQ

SEQ ID NO: 16583 - protein, 10 aa, Borrelia garinii PBi
GVSGKINAQI

SEQ ID NO: 16584 - protein, 10 aa, Borrelia garinii PBi
VSGKINAQIR

SEQ ID NO: 16585 - protein, 10 aa, Borrelia garinii PBi
SGKINAQIRG

SEQ ID NO: 16586 - protein, 10 aa, Borrelia garinii PBi
GKINAQIRGL

SEQ ID NO: 16587 - protein, 10 aa, Borrelia garinii PBi
KINAQIRGLS

SEQ ID NO: 16588 - protein, 10 aa, Borrelia garinii PBi
INAQIRGLSQ

SEQ ID NO: 16589 - protein, 10 aa, Borrelia garinii PBi
NAQIRGLSQA

SEQ ID NO: 16590 - protein, 10 aa, Borrelia garinii PBi
AQIRGLSQAS

SEQ ID NO: 16591 - protein, 10 aa, Borrelia garinii PBi
QIRGLSQASR

SEQ ID NO: 16592 - protein, 10 aa, Borrelia garinii PBi
IRGLSQASRN

SEQ ID NO: 16593 - protein, 10 aa, Borrelia garinii PBi
RGLSQASRNT

SEQ ID NO: 16594 - protein, 10 aa, Borrelia garinii PBi
GLSQASRNTS

SEQ ID NO: 16595 - protein, 10 aa, Borrelia garinii PBi
LSQASRNTSK

SEQ ID NO: 16596 - protein, 10 aa, Borrelia garinii PBi
SQASRNTSKA

SEQ ID NO: 16597 - protein, 10 aa, Borrelia garinii PBi
QASRNTSKAI

SEQ ID NO: 16598 - protein, 10 aa, Borrelia garinii PBi
ASRNTSKAIN

SEQ ID NO: 16599 - protein, 10 aa, Borrelia garinii PBi
SRNTSKAINF

SEQ ID NO: 16600 - protein, 10 aa, Borrelia garinii PBi
RNTSKAINFI

SEQ ID NO: 16601 - protein, 10 aa, Borrelia garinii PBi
NTSKAINFIQ

SEQ ID NO: 16602 - protein, 10 aa, Borrelia garinii PBi
TSKAINFIQT

SEQ ID NO: 16603 - protein, 10 aa, Borrelia garinii PBi
SKAINFIQTT

SEQ ID NO: 16604 - protein, 10 aa, Borrelia garinii PBi
KAINFIQTTE

SEQ ID NO: 16605 - protein, 10 aa, Borrelia garinii PBi
AINFIQTTEG

SEQ ID NO: 16606 - protein, 10 aa, Borrelia garinii PBi
INFIQTTEGN

SEQ ID NO: 16607 - protein, 10 aa, Borrelia garinii PBi
NFIQTTEGNL

SEQ ID NO: 16608 - protein, 10 aa, Borrelia garinii PBi
FIQTTEGNLN

SEQ ID NO: 16609 - protein, 10 aa, Borrelia garinii PBi
IQTTEGNLNE

SEQ ID NO: 16610 - protein, 10 aa, Borrelia garinii PBi
QTTEGNLNEV

SEQ ID NO: 16611 - protein, 10 aa, Borrelia garinii PBi
TTEGNLNEVE

SEQ ID NO: 16612 - protein, 10 aa, Borrelia garinii PBi
TEGNLNEVEK

SEQ ID NO: 16613 - protein, 10 aa, Borrelia garinii PBi
EGNLNEVEKV

SEQ ID NO: 16614 - protein, 10 aa, Borrelia garinii PBi
GNLNEVEKVL

SEQ ID NO: 16615 - protein, 10 aa, Borrelia garinii PBi
NLNEVEKVLV

SEQ ID NO: 16616 - protein, 10 aa, Borrelia garinii PBi
LNEVEKVLVR

SEQ ID NO: 16617 - protein, 10 aa, Borrelia garinii PBi
NEVEKVLVRM

SEQ ID NO: 16618 - protein, 10 aa, Borrelia garinii PBi
EVEKVLVRMK

SEQ ID NO: 16619 - protein, 10 aa, Borrelia garinii PBi
VEKVLVRMKE

SEQ ID NO: 16620 - protein, 10 aa, Borrelia garinii PBi
EKVLVRMKEL

SEQ ID NO: 16621 - protein, 10 aa, Borrelia garinii PBi
KVLVRMKELA

SEQ ID NO: 16622 - protein, 10 aa, Borrelia garinii PBi
VLVRMKELAV

SEQ ID NO: 16623 - protein, 10 aa, Borrelia garinii PBi
LVRMKELAVQ

SEQ ID NO: 16624 - protein, 10 aa, Borrelia garinii PBi
VRMKELAVQS

SEQ ID NO: 16625 - protein, 10 aa, Borrelia garinii PBi
RMKELAVQSG

SEQ ID NO: 16626 - protein, 10 aa, Borrelia garinii PBi
MKELAVQSGN

SEQ ID NO: 16627 - protein, 10 aa, Borrelia garinii PBi
KELAVQSGNG

SEQ ID NO: 16628 - protein, 10 aa, Borrelia garinii PBi
ELAVQSGNGT

SEQ ID NO: 16629 - protein, 10 aa, Borrelia garinii PBi
LAVQSGNGTY

SEQ ID NO: 16630 - protein, 10 aa, Borrelia garinii PBi
AVQSGNGTYS

SEQ ID NO: 16631 - protein, 10 aa, Borrelia garinii PBi
VQSGNGTYSD

SEQ ID NO: 16632 - protein, 10 aa, Borrelia garinii PBi
QSGNGTYSDA

SEQ ID NO: 16633 - protein, 10 aa, Borrelia garinii PBi
SGNGTYSDAD

SEQ ID NO: 16634 - protein, 10 aa, Borrelia garinii PBi
GNGTYSDADR

SEQ ID NO: 16635 - protein, 10 aa, Borrelia garinii PBi
NGTYSDADRG

SEQ ID NO: 16636 - protein, 10 aa, Borrelia garinii PBi
GTYSDADRGS

SEQ ID NO: 16637 - protein, 10 aa, Borrelia garinii PBi
TYSDADRGSI

SEQ ID NO: 16638 - protein, 10 aa, Borrelia garinii PBi
YSDADRGSIQ

SEQ ID NO: 16639 - protein, 10 aa, Borrelia garinii PBi
SDADRGSIQI

SEQ ID NO: 16640 - protein, 10 aa, Borrelia garinii PBi
DADRGSIQIE

SEQ ID NO: 16641 - protein, 10 aa, Borrelia garinii PBi
ADRGSIQIEI

SEQ ID NO: 16642 - protein, 10 aa, Borrelia garinii PBi
DRGSIQIEIE

SEQ ID NO: 16643 - protein, 10 aa, Borrelia garinii PBi
RGSIQIEIEQ

SEQ ID NO: 16644 - protein, 10 aa, Borrelia garinii PBi
GSIQIEIEQL

SEQ ID NO: 16645 - protein, 10 aa, Borrelia garinii PBi
SIQIEIEQLT

SEQ ID NO: 16646 - protein, 10 aa, Borrelia garinii PBi
IQIEIEQLTD

SEQ ID NO: 16647 - protein, 10 aa, Borrelia garinii PBi
QIEIEQLTDE

SEQ ID NO: 16648 - protein, 10 aa, Borrelia garinii PBi
IEIEQLTDEI

SEQ ID NO: 16649 - protein, 10 aa, Borrelia garinii PBi
EIEQLTDEIN

SEQ ID NO: 16650 - protein, 10 aa, Borrelia garinii PBi
IEQLTDEINR

SEQ ID NO: 16651 - protein, 10 aa, Borrelia garinii PBi
EQLTDEINRI

SEQ ID NO: 16652 - protein, 10 aa, Borrelia garinii PBi
QLTDEINRIA

SEQ ID NO: 16653 - protein, 10 aa, Borrelia garinii PBi
LTDEINRIAD

SEQ ID NO: 16654 - protein, 10 aa, Borrelia garinii PBi
TDEINRIADQ

SEQ ID NO: 16655 - protein, 10 aa, Borrelia garinii PBi
DEINRIADQA

SEQ ID NO: 16656 - protein, 10 aa, Borrelia garinii PBi
EINRIADQAQ

SEQ ID NO: 16657 - protein, 10 aa, Borrelia garinii PBi
INRIADQAQY

SEQ ID NO: 16658 - protein, 10 aa, Borrelia garinii PBi
NRIADQAQYN

SEQ ID NO: 16659 - protein, 10 aa, Borrelia garinii PBi
RIADQAQYNQ

SEQ ID NO: 16660 - protein, 10 aa, Borrelia garinii PBi
IADQAQYNQM

SEQ ID NO: 16661 - protein, 10 aa, Borrelia garinii PBi
ADQAQYNQMH

SEQ ID NO: 16662 - protein, 10 aa, Borrelia garinii PBi
DQAQYNQMHM

SEQ ID NO: 16663 - protein, 10 aa, Borrelia garinii PBi
QAQYNQMHML

SEQ ID NO: 16664 - protein, 10 aa, Borrelia garinii PBi
AQYNQMHMLS

SEQ ID NO: 16665 - protein, 10 aa, Borrelia garinii PBi
QYNQMHMLSN

SEQ ID NO: 16666 - protein, 10 aa, Borrelia garinii PBi
YNQMHMLSNK

SEQ ID NO: 16667 - protein, 10 aa, Borrelia garinii PBi
NQMHMLSNKS

SEQ ID NO: 16668 - protein, 10 aa, Borrelia garinii PBi
QMHMLSNKSA

SEQ ID NO: 16669 - protein, 10 aa, Borrelia garinii PBi
MHMLSNKSAS

SEQ ID NO: 16670 - protein, 10 aa, Borrelia garinii PBi
HMLSNKSASQ

SEQ ID NO: 16671 - protein, 10 aa, Borrelia garinii PBi
MLSNKSASQN

SEQ ID NO: 16672 - protein, 10 aa, Borrelia garinii PBi
LSNKSASQNV

SEQ ID NO: 16673 - protein, 10 aa, Borrelia garinii PBi
SNKSASQNVR

SEQ ID NO: 16674 - protein, 10 aa, Borrelia garinii PBi
NKSASQNVRT

SEQ ID NO: 16675 - protein, 10 aa, Borrelia garinii PBi
KSASQNVRTA

SEQ ID NO: 16676 - protein, 10 aa, Borrelia garinii PBi
SASQNVRTAE

SEQ ID NO: 16677 - protein, 10 aa, Borrelia garinii PBi
ASQNVRTAEE

SEQ ID NO: 16678 - protein, 10 aa, Borrelia garinii PBi
SQNVRTAEEL

SEQ ID NO: 16679 - protein, 10 aa, Borrelia garinii PBi
QNVRTAEELG

SEQ ID NO: 16680 - protein, 10 aa, Borrelia garinii PBi
NVRTAEELGM

SEQ ID NO: 16681 - protein, 10 aa, Borrelia garinii PBi
VRTAEELGMQ

SEQ ID NO: 16682 - protein, 10 aa, Borrelia garinii PBi
RTAEELGMQP

SEQ ID NO: 16683 - protein, 10 aa, Borrelia garinii PBi
TAEELGMQPA

SEQ ID NO: 16684 - protein, 10 aa, Borrelia garinii PBi
AEELGMQPAK

SEQ ID NO: 16685 - protein, 10 aa, Borrelia garinii PBi
EELGMQPAKI

SEQ ID NO: 16686 - protein, 10 aa, Borrelia garinii PBi
ELGMQPAKIN

SEQ ID NO: 16687 - protein, 10 aa, Borrelia garinii PBi
LGMQPAKINT

SEQ ID NO: 16688 - protein, 10 aa, Borrelia garinii PBi
GMQPAKINTP

SEQ ID NO: 16689 - protein, 10 aa, Borrelia garinii PBi
MQPAKINTPA

SEQ ID NO: 16690 - protein, 10 aa, Borrelia garinii PBi
QPAKINTPAS

SEQ ID NO: 16691 - protein, 10 aa, Borrelia garinii PBi
PAKINTPASL

SEQ ID NO: 16692 - protein, 10 aa, Borrelia garinii PBi
AKINTPASLS

SEQ ID NO: 16693 - protein, 10 aa, Borrelia garinii PBi
KINTPASLSG

SEQ ID NO: 16694 - protein, 10 aa, Borrelia garinii PBi
INTPASLSGS

SEQ ID NO: 16695 - protein, 10 aa, Borrelia garinii PBi
NTPASLSGSQ

SEQ ID NO: 16696 - protein, 10 aa, Borrelia garinii PBi
TPASLSGSQA

SEQ ID NO: 16697 - protein, 10 aa, Borrelia garinii PBi
PASLSGSQAS

SEQ ID NO: 16698 - protein, 10 aa, Borrelia garinii PBi
ASLSGSQASW

SEQ ID NO: 16699 - protein, 10 aa, Borrelia garinii PBi
SLSGSQASWT

SEQ ID NO: 16700 - protein, 10 aa, Borrelia garinii PBi
LSGSQASWTL

SEQ ID NO: 16701 - protein, 10 aa, Borrelia garinii PBi
SGSQASWTLR

SEQ ID NO: 16702 - protein, 10 aa, Borrelia garinii PBi
GSQASWTLRV

SEQ ID NO: 16703 - protein, 10 aa, Borrelia garinii PBi
SQASWTLRVH

SEQ ID NO: 16704 - protein, 10 aa, Borrelia garinii PBi
QASWTLRVHV

SEQ ID NO: 16705 - protein, 10 aa, Borrelia garinii PBi
ASWTLRVHVG

SEQ ID NO: 16706 - protein, 10 aa, Borrelia garinii PBi
SWTLRVHVGA

SEQ ID NO: 16707 - protein, 10 aa, Borrelia garinii PBi
WTLRVHVGAN

SEQ ID NO: 16708 - protein, 10 aa, Borrelia garinii PBi
TLRVHVGANQ

SEQ ID NO: 16709 - protein, 10 aa, Borrelia garinii PBi
LRVHVGANQD

SEQ ID NO: 16710 - protein, 10 aa, Borrelia garinii PBi
RVHVGANQDE

SEQ ID NO: 16711 - protein, 10 aa, Borrelia garinii PBi
VHVGANQDEA

SEQ ID NO: 16712 - protein, 10 aa, Borrelia garinii PBi
HVGANQDEAI

SEQ ID NO: 16713 - protein, 10 aa, Borrelia garinii PBi
VGANQDEAIA

SEQ ID NO: 16714 - protein, 10 aa, Borrelia garinii PBi
GANQDEAIAV

SEQ ID NO: 16715 - protein, 10 aa, Borrelia garinii PBi
ANQDEAIAVN

SEQ ID NO: 16716 - protein, 10 aa, Borrelia garinii PBi
NQDEAIAVNI

SEQ ID NO: 16717 - protein, 10 aa, Borrelia garinii PBi
QDEAIAVNIY

SEQ ID NO: 16718 - protein, 10 aa, Borrelia garinii PBi
DEAIAVNIYA

SEQ ID NO: 16719 - protein, 10 aa, Borrelia garinii PBi
EAIAVNIYAA

SEQ ID NO: 16720 - protein, 10 aa, Borrelia garinii PBi
AIAVNIYAAN

SEQ ID NO: 16721 - protein, 10 aa, Borrelia garinii PBi
IAVNIYAANV

SEQ ID NO: 16722 - protein, 10 aa, Borrelia garinii PBi
AVNIYAANVA

SEQ ID NO: 16723 - protein, 10 aa, Borrelia garinii PBi
VNIYAANVAN

SEQ ID NO: 16724 - protein, 10 aa, Borrelia garinii PBi
NIYAANVANL

SEQ ID NO: 16725 - protein, 10 aa, Borrelia garinii PBi
IYAANVANLF

SEQ ID NO: 16726 - protein, 10 aa, Borrelia garinii PBi
YAANVANLFS

SEQ ID NO: 16727 - protein, 10 aa, Borrelia garinii PBi
AANVANLFSG

SEQ ID NO: 16728 - protein, 10 aa, Borrelia garinii PBi
ANVANLFSGE

SEQ ID NO: 16729 - protein, 10 aa, Borrelia garinii PBi
NVANLFSGEG

SEQ ID NO: 16730 - protein, 10 aa, Borrelia garinii PBi
VANLFSGEGS

SEQ ID NO: 16731 - protein, 10 aa, Borrelia garinii PBi
ANLFSGEGSQ

SEQ ID NO: 16732 - protein, 10 aa, Borrelia garinii PBi
NLFSGEGSQA

SEQ ID NO: 16733 - protein, 10 aa, Borrelia garinii PBi
LFSGEGSQAA

SEQ ID NO: 16734 - protein, 10 aa, Borrelia garinii PBi
FSGEGSQAAQ

SEQ ID NO: 16735 - protein, 10 aa, Borrelia garinii PBi
SGEGSQAAQT

SEQ ID NO: 16736 - protein, 10 aa, Borrelia garinii PBi
GEGSQAAQTA

SEQ ID NO: 16737 - protein, 10 aa, Borrelia garinii PBi
EGSQAAQTAP

SEQ ID NO: 16738 - protein, 10 aa, Borrelia garinii PBi
GSQAAQTAPV

SEQ ID NO: 16739 - protein, 10 aa, Borrelia garinii PBi
SQAAQTAPVQ

SEQ ID NO: 16740 - protein, 10 aa, Borrelia garinii PBi
QAAQTAPVQE

SEQ ID NO: 16741 - protein, 10 aa, Borrelia garinii PBi
AAQTAPVQEG

SEQ ID NO: 16742 - protein, 10 aa, Borrelia garinii PBi
AQTAPVQEGA

SEQ ID NO: 16743 - protein, 10 aa, Borrelia garinii PBi
QTAPVQEGAQ

SEQ ID NO: 16744 - protein, 10 aa, Borrelia garinii PBi
TAPVQEGAQQ

SEQ ID NO: 16745 - protein, 10 aa, Borrelia garinii PBi
APVQEGAQQE

SEQ ID NO: 16746 - protein, 10 aa, Borrelia garinii PBi
PVQEGAQQEG

SEQ ID NO: 16747 - protein, 10 aa, Borrelia garinii PBi
VQEGAQQEGA

SEQ ID NO: 16748 - protein, 10 aa, Borrelia garinii PBi
QEGAQQEGAQ

SEQ ID NO: 16749 - protein, 10 aa, Borrelia garinii PBi
EGAQQEGAQQ

SEQ ID NO: 16750 - protein, 10 aa, Borrelia garinii PBi
GAQQEGAQQP

SEQ ID NO: 16751 - protein, 10 aa, Borrelia garinii PBi
AQQEGAQQPA

SEQ ID NO: 16752 - protein, 10 aa, Borrelia garinii PBi
QQEGAQQPAP

SEQ ID NO: 16753 - protein, 10 aa, Borrelia garinii PBi
QEGAQQPAPA

SEQ ID NO: 16754 - protein, 10 aa, Borrelia garinii PBi
EGAQQPAPAT

SEQ ID NO: 16755 - protein, 10 aa, Borrelia garinii PBi
GAQQPAPATA

SEQ ID NO: 16756 - protein, 10 aa, Borrelia garinii PBi
AQQPAPATAP

SEQ ID NO: 16757 - protein, 10 aa, Borrelia garinii PBi
QQPAPATAPS

SEQ ID NO: 16758 - protein, 10 aa, Borrelia garinii PBi
QPAPATAPSQ

SEQ ID NO: 16759 - protein, 10 aa, Borrelia garinii PBi
PAPATAPSQG

SEQ ID NO: 16760 - protein, 10 aa, Borrelia garinii PBi
APATAPSQGG

SEQ ID NO: 16761 - protein, 10 aa, Borrelia garinii PBi
PATAPSQGGV

SEQ ID NO: 16762 - protein, 10 aa, Borrelia garinii PBi
ATAPSQGGVN

SEQ ID NO: 16763 - protein, 10 aa, Borrelia garinii PBi
TAPSQGGVNS

SEQ ID NO: 16764 - protein, 10 aa, Borrelia garinii PBi
APSQGGVNSP

SEQ ID NO: 16765 - protein, 10 aa, Borrelia garinii PBi
PSQGGVNSPV

SEQ ID NO: 16766 - protein, 10 aa, Borrelia garinii PBi
SQGGVNSPVN

SEQ ID NO: 16767 - protein, 10 aa, Borrelia garinii PBi
QGGVNSPVNV

SEQ ID NO: 16768 - protein, 10 aa, Borrelia garinii PBi
GGVNSPVNVT

SEQ ID NO: 16769 - protein, 10 aa, Borrelia garinii PBi
GVNSPVNVTT

SEQ ID NO: 16770 - protein, 10 aa, Borrelia garinii PBi
VNSPVNVTTT

SEQ ID NO: 16771 - protein, 10 aa, Borrelia garinii PBi
NSPVNVTTTV

SEQ ID NO: 16772 - protein, 10 aa, Borrelia garinii PBi
SPVNVTTTVD

SEQ ID NO: 16773 - protein, 10 aa, Borrelia garinii PBi
PVNVTTTVDA

SEQ ID NO: 16774 - protein, 10 aa, Borrelia garinii PBi
VNVTTTVDAN

SEQ ID NO: 16775 - protein, 10 aa, Borrelia garinii PBi
NVTTTVDANT

SEQ ID NO: 16776 - protein, 10 aa, Borrelia garinii PBi
VTTTVDANTS

SEQ ID NO: 16777 - protein, 10 aa, Borrelia garinii PBi
TTTVDANTSL

SEQ ID NO: 16778 - protein, 10 aa, Borrelia garinii PBi
TTVDANTSLA

SEQ ID NO: 16779 - protein, 10 aa, Borrelia garinii PBi
TVDANTSLAK

SEQ ID NO: 16780 - protein, 10 aa, Borrelia garinii PBi
VDANTSLAKI

SEQ ID NO: 16781 - protein, 10 aa, Borrelia garinii PBi
DANTSLAKIE

SEQ ID NO: 16782 - protein, 10 aa, Borrelia garinii PBi
ANTSLAKIEN

SEQ ID NO: 16783 - protein, 10 aa, Borrelia garinii PBi
NTSLAKIENA

SEQ ID NO: 16784 - protein, 10 aa, Borrelia garinii PBi
TSLAKIENAI

SEQ ID NO: 16785 - protein, 10 aa, Borrelia garinii PBi
SLAKIENAIR

SEQ ID NO: 16786 - protein, 10 aa, Borrelia garinii PBi
LAKIENAIRM

SEQ ID NO: 16787 - protein, 10 aa, Borrelia garinii PBi
AKIENAIRMI

SEQ ID NO: 16788 - protein, 10 aa, Borrelia garinii PBi
KIENAIRMIS

SEQ ID NO: 16789 - protein, 10 aa, Borrelia garinii PBi
IENAIRMISD

SEQ ID NO: 16790 - protein, 10 aa, Borrelia garinii PBi
ENAIRMISDQ

SEQ ID NO: 16791 - protein, 10 aa, Borrelia garinii PBi
NAIRMISDQR

SEQ ID NO: 16792 - protein, 10 aa, Borrelia garinii PBi
AIRMISDQRA

SEQ ID NO: 16793 - protein, 10 aa, Borrelia garinii PBi
IRMISDQRAN

SEQ ID NO: 16794 - protein, 10 aa, Borrelia garinii PBi
RMISDQRANL

SEQ ID NO: 16795 - protein, 10 aa, Borrelia garinii PBi
MISDQRANLG

SEQ ID NO: 16796 - protein, 10 aa, Borrelia garinii PBi
ISDQRANLGA

SEQ ID NO: 16797 - protein, 10 aa, Borrelia garinii PBi
SDQRANLGAF

SEQ ID NO: 16798 - protein, 10 aa, Borrelia garinii PBi
DQRANLGAFQ

SEQ ID NO: 16799 - protein, 10 aa, Borrelia garinii PBi
QRANLGAFQN

SEQ ID NO: 16800 - protein, 10 aa, Borrelia garinii PBi
RANLGAFQNR

SEQ ID NO: 16801 - protein, 10 aa, Borrelia garinii PBi
ANLGAFQNRL

SEQ ID NO: 16802 - protein, 10 aa, Borrelia garinii PBi
NLGAFQNRLE

SEQ ID NO: 16803 - protein, 10 aa, Borrelia garinii PBi
LGAFQNRLES

SEQ ID NO: 16804 - protein, 10 aa, Borrelia garinii PBi
GAFQNRLESI

SEQ ID NO: 16805 - protein, 10 aa, Borrelia garinii PBi
AFQNRLESIK

SEQ ID NO: 16806 - protein, 10 aa, Borrelia garinii PBi
FQNRLESIKD

SEQ ID NO: 16807 - protein, 10 aa, Borrelia garinii PBi
QNRLESIKDS

SEQ ID NO: 16808 - protein, 10 aa, Borrelia garinii PBi
NRLESIKDST

SEQ ID NO: 16809 - protein, 10 aa, Borrelia garinii PBi
RLESIKDSTE

SEQ ID NO: 16810 - protein, 10 aa, Borrelia garinii PBi
LESIKDSTEY

SEQ ID NO: 16811 - protein, 10 aa, Borrelia garinii PBi
ESIKDSTEYA

SEQ ID NO: 16812 - protein, 10 aa, Borrelia garinii PBi
SIKDSTEYAI

SEQ ID NO: 16813 - protein, 10 aa, Borrelia garinii PBi
IKDSTEYAIE

SEQ ID NO: 16814 - protein, 10 aa, Borrelia garinii PBi
KDSTEYAIEN

SEQ ID NO: 16815 - protein, 10 aa, Borrelia garinii PBi
DSTEYAIENL

SEQ ID NO: 16816 - protein, 10 aa, Borrelia garinii PBi
STEYAIENLK

SEQ ID NO: 16817 - protein, 10 aa, Borrelia garinii PBi
TEYAIENLKA

SEQ ID NO: 16818 - protein, 10 aa, Borrelia garinii PBi
EYAIENLKAS

SEQ ID NO: 16819 - protein, 10 aa, Borrelia garinii PBi
YAIENLKASY

SEQ ID NO: 16820 - protein, 10 aa, Borrelia garinii PBi
AIENLKASYA

SEQ ID NO: 16821 - protein, 10 aa, Borrelia garinii PBi
IENLKASYAQ

SEQ ID NO: 16822 - protein, 10 aa, Borrelia garinii PBi
ENLKASYAQI

SEQ ID NO: 16823 - protein, 10 aa, Borrelia garinii PBi
NLKASYAQIK

SEQ ID NO: 16824 - protein, 10 aa, Borrelia garinii PBi
LKASYAQIKD

SEQ ID NO: 16825 - protein, 10 aa, Borrelia garinii PBi
KASYAQIKDA

SEQ ID NO: 16826 - protein, 10 aa, Borrelia garinii PBi
ASYAQIKDAT

SEQ ID NO: 16827 - protein, 10 aa, Borrelia garinii PBi
SYAQIKDATM

SEQ ID NO: 16828 - protein, 10 aa, Borrelia garinii PBi
YAQIKDATMT

SEQ ID NO: 16829 - protein, 10 aa, Borrelia garinii PBi
AQIKDATMTD

SEQ ID NO: 16830 - protein, 10 aa, Borrelia garinii PBi
QIKDATMTDE

SEQ ID NO: 16831 - protein, 10 aa, Borrelia garinii PBi
IKDATMTDEV

SEQ ID NO: 16832 - protein, 10 aa, Borrelia garinii PBi
KDATMTDEVV

SEQ ID NO: 16833 - protein, 10 aa, Borrelia garinii PBi
DATMTDEVVA

SEQ ID NO: 16834 - protein, 10 aa, Borrelia garinii PBi
ATMTDEVVAS

SEQ ID NO: 16835 - protein, 10 aa, Borrelia garinii PBi
TMTDEVVAST

SEQ ID NO: 16836 - protein, 10 aa, Borrelia garinii PBi
MTDEVVASTT

SEQ ID NO: 16837 - protein, 10 aa, Borrelia garinii PBi
TDEVVASTTN

SEQ ID NO: 16838 - protein, 10 aa, Borrelia garinii PBi
DEVVASTTNS

SEQ ID NO: 16839 - protein, 10 aa, Borrelia garinii PBi
EVVASTTNSI

SEQ ID NO: 16840 - protein, 10 aa, Borrelia garinii PBi
VVASTTNSIL

SEQ ID NO: 16841 - protein, 10 aa, Borrelia garinii PBi
VASTTNSILT

SEQ ID NO: 16842 - protein, 10 aa, Borrelia garinii PBi
ASTTNSILTQ

SEQ ID NO: 16843 - protein, 10 aa, Borrelia garinii PBi
STTNSILTQS

SEQ ID NO: 16844 - protein, 10 aa, Borrelia garinii PBi
TTNSILTQSA

SEQ ID NO: 16845 - protein, 10 aa, Borrelia garinii PBi
TNSILTQSAM

SEQ ID NO: 16846 - protein, 10 aa, Borrelia garinii PBi
NSILTQSAMA

SEQ ID NO: 16847 - protein, 10 aa, Borrelia garinii PBi
SILTQSAMAM

SEQ ID NO: 16848 - protein, 10 aa, Borrelia garinii PBi
ILTQSAMAMI

SEQ ID NO: 16849 - protein, 10 aa, Borrelia garinii PBi
LTQSAMAMIA

SEQ ID NO: 16850 - protein, 10 aa, Borrelia garinii PBi
TQSAMAMIAQ

SEQ ID NO: 16851 - protein, 10 aa, Borrelia garinii PBi
QSAMAMIAQA

SEQ ID NO: 16852 - protein, 10 aa, Borrelia garinii PBi
SAMAMIAQAN

SEQ ID NO: 16853 - protein, 10 aa, Borrelia garinii PBi
AMAMIAQANQ

SEQ ID NO: 16854 - protein, 10 aa, Borrelia garinii PBi
MAMIAQANQV

SEQ ID NO: 16855 - protein, 10 aa, Borrelia garinii PBi
AMIAQANQVP

SEQ ID NO: 16856 - protein, 10 aa, Borrelia garinii PBi
MIAQANQVPQ

SEQ ID NO: 16857 - protein, 10 aa, Borrelia garinii PBi
IAQANQVPQY

SEQ ID NO: 16858 - protein, 10 aa, Borrelia garinii PBi
AQANQVPQYV

SEQ ID NO: 16859 - protein, 10 aa, Borrelia garinii PBi
QANQVPQYVL

SEQ ID NO: 16860 - protein, 10 aa, Borrelia garinii PBi
ANQVPQYVLS

SEQ ID NO: 16861 - protein, 10 aa, Borrelia garinii PBi
NQVPQYVLSL

SEQ ID NO: 16862 - protein, 10 aa, Borrelia garinii PBi
QVPQYVLSLL

SEQ ID NO: 16863 - protein, 10 aa, Borrelia garinii PBi
VPQYVLSLLR

SEQ ID NO: 16864 - protein, 11 aa, Borrelia garinii PBi
MIINHNTSAIN

SEQ ID NO: 16865 - protein, 11 aa, Borrelia garinii PBi
IINHNTSAINA

SEQ ID NO: 16866 - protein, 11 aa, Borrelia garinii PBi
INHNTSAINAS

SEQ ID NO: 16867 - protein, 11 aa, Borrelia garinii PBi
NHNTSAINASR

SEQ ID NO: 16868 - protein, 11 aa, Borrelia garinii PBi
HNTSAINASRN

SEQ ID NO: 16869 - protein, 11 aa, Borrelia garinii PBi
NTSAINASRNN

SEQ ID NO: 16870 - protein, 11 aa, Borrelia garinii PBi
TSAINASRNNS

SEQ ID NO: 16871 - protein, 11 aa, Borrelia garinii PBi
SAINASRNNSI

SEQ ID NO: 16872 - protein, 11 aa, Borrelia garinii PBi
AINASRNNSIN

SEQ ID NO: 16873 - protein, 11 aa, Borrelia garinii PBi
INASRNNSINA

SEQ ID NO: 16874 - protein, 11 aa, Borrelia garinii PBi
NASRNNSINAA

SEQ ID NO: 16875 - protein, 11 aa, Borrelia garinii PBi
ASRNNSINAAN

SEQ ID NO: 16876 - protein, 11 aa, Borrelia garinii PBi
SRNNSINAANL

SEQ ID NO: 16877 - protein, 11 aa, Borrelia garinii PBi
RNNSINAANLS

SEQ ID NO: 16878 - protein, 11 aa, Borrelia garinii PBi
NNSINAANLSK

SEQ ID NO: 16879 - protein, 11 aa, Borrelia garinii PBi
NSINAANLSKT

SEQ ID NO: 16880 - protein, 11 aa, Borrelia garinii PBi
SINAANLSKTQ

SEQ ID NO: 16881 - protein, 11 aa, Borrelia garinii PBi
INAANLSKTQE

SEQ ID NO: 16882 - protein, 11 aa, Borrelia garinii PBi
NAANLSKTQEK

SEQ ID NO: 16883 - protein, 11 aa, Borrelia garinii PBi
AANLSKTQEKL

SEQ ID NO: 16884 - protein, 11 aa, Borrelia garinii PBi
ANLSKTQEKLS

SEQ ID NO: 16885 - protein, 11 aa, Borrelia garinii PBi
NLSKTQEKLSS

SEQ ID NO: 16886 - protein, 11 aa, Borrelia garinii PBi
LSKTQEKLSSG

SEQ ID NO: 16887 - protein, 11 aa, Borrelia garinii PBi
SKTQEKLSSGY

SEQ ID NO: 16888 - protein, 11 aa, Borrelia garinii PBi
KTQEKLSSGYR

SEQ ID NO: 16889 - protein, 11 aa, Borrelia garinii PBi
TQEKLSSGYRI

SEQ ID NO: 16890 - protein, 11 aa, Borrelia garinii PBi
QEKLSSGYRIN

SEQ ID NO: 16891 - protein, 11 aa, Borrelia garinii PBi
EKLSSGYRINR

SEQ ID NO: 16892 - protein, 11 aa, Borrelia garinii PBi
KLSSGYRINRA

SEQ ID NO: 16893 - protein, 11 aa, Borrelia garinii PBi
LSSGYRINRAS

SEQ ID NO: 16894 - protein, 11 aa, Borrelia garinii PBi
SSGYRINRASD

SEQ ID NO: 16895 - protein, 11 aa, Borrelia garinii PBi
SGYRINRASDD

SEQ ID NO: 16896 - protein, 11 aa, Borrelia garinii PBi
GYRINRASDDA

SEQ ID NO: 16897 - protein, 11 aa, Borrelia garinii PBi
YRINRASDDAA

SEQ ID NO: 16898 - protein, 11 aa, Borrelia garinii PBi
RINRASDDAAG

SEQ ID NO: 16899 - protein, 11 aa, Borrelia garinii PBi
INRASDDAAGM

SEQ ID NO: 16900 - protein, 11 aa, Borrelia garinii PBi
NRASDDAAGMG

SEQ ID NO: 16901 - protein, 11 aa, Borrelia garinii PBi
RASDDAAGMGV

SEQ ID NO: 16902 - protein, 11 aa, Borrelia garinii PBi
ASDDAAGMGVS

SEQ ID NO: 16903 - protein, 11 aa, Borrelia garinii PBi
SDDAAGMGVSG

SEQ ID NO: 16904 - protein, 11 aa, Borrelia garinii PBi
DDAAGMGVSGK

SEQ ID NO: 16905 - protein, 11 aa, Borrelia garinii PBi
DAAGMGVSGKI

SEQ ID NO: 16906 - protein, 11 aa, Borrelia garinii PBi
AAGMGVSGKIN

SEQ ID NO: 16907 - protein, 11 aa, Borrelia garinii PBi
AGMGVSGKINA

SEQ ID NO: 16908 - protein, 11 aa, Borrelia garinii PBi
GMGVSGKINAQ

SEQ ID NO: 16909 - protein, 11 aa, Borrelia garinii PBi
MGVSGKINAQI

SEQ ID NO: 16910 - protein, 11 aa, Borrelia garinii PBi
GVSGKINAQIR

SEQ ID NO: 16911 - protein, 11 aa, Borrelia garinii PBi
VSGKINAQIRG

SEQ ID NO: 16912 - protein, 11 aa, Borrelia garinii PBi
SGKINAQIRGL

SEQ ID NO: 16913 - protein, 11 aa, Borrelia garinii PBi
GKINAQIRGLS

SEQ ID NO: 16914 - protein, 11 aa, Borrelia garinii PBi
KINAQIRGLSQ

SEQ ID NO: 16915 - protein, 11 aa, Borrelia garinii PBi
INAQIRGLSQA

SEQ ID NO: 16916 - protein, 11 aa, Borrelia garinii PBi
NAQIRGLSQAS

SEQ ID NO: 16917 - protein, 11 aa, Borrelia garinii PBi
AQIRGLSQASR

SEQ ID NO: 16918 - protein, 11 aa, Borrelia garinii PBi
QIRGLSQASRN

SEQ ID NO: 16919 - protein, 11 aa, Borrelia garinii PBi
IRGLSQASRNT

SEQ ID NO: 16920 - protein, 11 aa, Borrelia garinii PBi
RGLSQASRNTS

SEQ ID NO: 16921 - protein, 11 aa, Borrelia garinii PBi
GLSQASRNTSK

SEQ ID NO: 16922 - protein, 11 aa, Borrelia garinii PBi
LSQASRNTSKA

SEQ ID NO: 16923 - protein, 11 aa, Borrelia garinii PBi
SQASRNTSKAI

SEQ ID NO: 16924 - protein, 11 aa, Borrelia garinii PBi
QASRNTSKAIN

SEQ ID NO: 16925 - protein, 11 aa, Borrelia garinii PBi
ASRNTSKAINF

SEQ ID NO: 16926 - protein, 11 aa, Borrelia garinii PBi
SRNTSKAINFI

SEQ ID NO: 16927 - protein, 11 aa, Borrelia garinii PBi
RNTSKAINFIQ

SEQ ID NO: 16928 - protein, 11 aa, Borrelia garinii PBi
NTSKAINFIQT

SEQ ID NO: 16929 - protein, 11 aa, Borrelia garinii PBi
TSKAINFIQTT

SEQ ID NO: 16930 - protein, 11 aa, Borrelia garinii PBi
SKAINFIQTTE

SEQ ID NO: 16931 - protein, 11 aa, Borrelia garinii PBi
KAINFIQTTEG

SEQ ID NO: 16932 - protein, 11 aa, Borrelia garinii PBi
AINFIQTTEGN

SEQ ID NO: 16933 - protein, 11 aa, Borrelia garinii PBi
INFIQTTEGNL

SEQ ID NO: 16934 - protein, 11 aa, Borrelia garinii PBi
NFIQTTEGNLN

SEQ ID NO: 16935 - protein, 11 aa, Borrelia garinii PBi
FIQTTEGNLNE

SEQ ID NO: 16936 - protein, 11 aa, Borrelia garinii PBi
IQTTEGNLNEV

SEQ ID NO: 16937 - protein, 11 aa, Borrelia garinii PBi
QTTEGNLNEVE

SEQ ID NO: 16938 - protein, 11 aa, Borrelia garinii PBi
TTEGNLNEVEK

SEQ ID NO: 16939 - protein, 11 aa, Borrelia garinii PBi
TEGNLNEVEKV

SEQ ID NO: 16940 - protein, 11 aa, Borrelia garinii PBi
EGNLNEVEKVL

SEQ ID NO: 16941 - protein, 11 aa, Borrelia garinii PBi
GNLNEVEKVLV

SEQ ID NO: 16942 - protein, 11 aa, Borrelia garinii PBi
NLNEVEKVLVR

SEQ ID NO: 16943 - protein, 11 aa, Borrelia garinii PBi
LNEVEKVLVRM

SEQ ID NO: 16944 - protein, 11 aa, Borrelia garinii PBi
NEVEKVLVRMK

SEQ ID NO: 16945 - protein, 11 aa, Borrelia garinii PBi
EVEKVLVRMKE

SEQ ID NO: 16946 - protein, 11 aa, Borrelia garinii PBi
VEKVLVRMKEL

SEQ ID NO: 16947 - protein, 11 aa, Borrelia garinii PBi
EKVLVRMKELA

SEQ ID NO: 16948 - protein, 11 aa, Borrelia garinii PBi
KVLVRMKELAV

SEQ ID NO: 16949 - protein, 11 aa, Borrelia garinii PBi
VLVRMKELAVQ

SEQ ID NO: 16950 - protein, 11 aa, Borrelia garinii PBi
LVRMKELAVQS

SEQ ID NO: 16951 - protein, 11 aa, Borrelia garinii PBi
VRMKELAVQSG

SEQ ID NO: 16952 - protein, 11 aa, Borrelia garinii PBi
RMKELAVQSGN

SEQ ID NO: 16953 - protein, 11 aa, Borrelia garinii PBi
MKELAVQSGNG

SEQ ID NO: 16954 - protein, 11 aa, Borrelia garinii PBi
KELAVQSGNGT

SEQ ID NO: 16955 - protein, 11 aa, Borrelia garinii PBi
ELAVQSGNGTY

SEQ ID NO: 16956 - protein, 11 aa, Borrelia garinii PBi
LAVQSGNGTYS

SEQ ID NO: 16957 - protein, 11 aa, Borrelia garinii PBi
AVQSGNGTYSD

SEQ ID NO: 16958 - protein, 11 aa, Borrelia garinii PBi
VQSGNGTYSDA

SEQ ID NO: 16959 - protein, 11 aa, Borrelia garinii PBi
QSGNGTYSDAD

SEQ ID NO: 16960 - protein, 11 aa, Borrelia garinii PBi
SGNGTYSDADR

SEQ ID NO: 16961 - protein, 11 aa, Borrelia garinii PBi
GNGTYSDADRG

SEQ ID NO: 16962 - protein, 11 aa, Borrelia garinii PBi
NGTYSDADRGS

SEQ ID NO: 16963 - protein, 11 aa, Borrelia garinii PBi
GTYSDADRGSI

SEQ ID NO: 16964 - protein, 11 aa, Borrelia garinii PBi
TYSDADRGSIQ

SEQ ID NO: 16965 - protein, 11 aa, Borrelia garinii PBi
YSDADRGSIQI

SEQ ID NO: 16966 - protein, 11 aa, Borrelia garinii PBi
SDADRGSIQIE

SEQ ID NO: 16967 - protein, 11 aa, Borrelia garinii PBi
DADRGSIQIEI

SEQ ID NO: 16968 - protein, 11 aa, Borrelia garinii PBi
ADRGSIQIEIE

SEQ ID NO: 16969 - protein, 11 aa, Borrelia garinii PBi
DRGSIQIEIEQ

SEQ ID NO: 16970 - protein, 11 aa, Borrelia garinii PBi
RGSIQIEIEQL

SEQ ID NO: 16971 - protein, 11 aa, Borrelia garinii PBi
GSIQIEIEQLT

SEQ ID NO: 16972 - protein, 11 aa, Borrelia garinii PBi
SIQIEIEQLTD

SEQ ID NO: 16973 - protein, 11 aa, Borrelia garinii PBi
IQIEIEQLTDE

SEQ ID NO: 16974 - protein, 11 aa, Borrelia garinii PBi
QIEIEQLTDEI

SEQ ID NO: 16975 - protein, 11 aa, Borrelia garinii PBi
IEIEQLTDEIN

SEQ ID NO: 16976 - protein, 11 aa, Borrelia garinii PBi
EIEQLTDEINR

SEQ ID NO: 16977 - protein, 11 aa, Borrelia garinii PBi
IEQLTDEINRI

SEQ ID NO: 16978 - protein, 11 aa, Borrelia garinii PBi
EQLTDEINRIA

SEQ ID NO: 16979 - protein, 11 aa, Borrelia garinii PBi
QLTDEINRIAD

SEQ ID NO: 16980 - protein, 11 aa, Borrelia garinii PBi
LTDEINRIADQ

SEQ ID NO: 16981 - protein, 11 aa, Borrelia garinii PBi
TDEINRIADQA

SEQ ID NO: 16982 - protein, 11 aa, Borrelia garinii PBi
DEINRIADQAQ

SEQ ID NO: 16983 - protein, 11 aa, Borrelia garinii PBi
EINRIADQAQY

SEQ ID NO: 16984 - protein, 11 aa, Borrelia garinii PBi
INRIADQAQYN

SEQ ID NO: 16985 - protein, 11 aa, Borrelia garinii PBi
NRIADQAQYNQ

SEQ ID NO: 16986 - protein, 11 aa, Borrelia garinii PBi
RIADQAQYNQM

SEQ ID NO: 16987 - protein, 11 aa, Borrelia garinii PBi
IADQAQYNQMH

SEQ ID NO: 16988 - protein, 11 aa, Borrelia garinii PBi
ADQAQYNQMHM

SEQ ID NO: 16989 - protein, 11 aa, Borrelia garinii PBi
DQAQYNQMHML

SEQ ID NO: 16990 - protein, 11 aa, Borrelia garinii PBi
QAQYNQMHMLS

SEQ ID NO: 16991 - protein, 11 aa, Borrelia garinii PBi
AQYNQMHMLSN

SEQ ID NO: 16992 - protein, 11 aa, Borrelia garinii PBi
QYNQMHMLSNK

SEQ ID NO: 16993 - protein, 11 aa, Borrelia garinii PBi
YNQMHMLSNKS

SEQ ID NO: 16994 - protein, 11 aa, Borrelia garinii PBi
NQMHMLSNKSA

SEQ ID NO: 16995 - protein, 11 aa, Borrelia garinii PBi
QMHMLSNKSAS

SEQ ID NO: 16996 - protein, 11 aa, Borrelia garinii PBi
MHMLSNKSASQ

SEQ ID NO: 16997 - protein, 11 aa, Borrelia garinii PBi
HMLSNKSASQN

SEQ ID NO: 16998 - protein, 11 aa, Borrelia garinii PBi
MLSNKSASQNV

SEQ ID NO: 16999 - protein, 11 aa, Borrelia garinii PBi
LSNKSASQNVR

SEQ ID NO: 17000 - protein, 11 aa, Borrelia garinii PBi
SNKSASQNVRT

SEQ ID NO: 17001 - protein, 11 aa, Borrelia garinii PBi
NKSASQNVRTA

SEQ ID NO: 17002 - protein, 11 aa, Borrelia garinii PBi
KSASQNVRTAE

SEQ ID NO: 17003 - protein, 11 aa, Borrelia garinii PBi
SASQNVRTAEE

SEQ ID NO: 17004 - protein, 11 aa, Borrelia garinii PBi
ASQNVRTAEEL

SEQ ID NO: 17005 - protein, 11 aa, Borrelia garinii PBi
SQNVRTAEELG

SEQ ID NO: 17006 - protein, 11 aa, Borrelia garinii PBi
QNVRTAEELGM

SEQ ID NO: 17007 - protein, 11 aa, Borrelia garinii PBi
NVRTAEELGMQ

SEQ ID NO: 17008 - protein, 11 aa, Borrelia garinii PBi
VRTAEELGMQP

SEQ ID NO: 17009 - protein, 11 aa, Borrelia garinii PBi
RTAEELGMQPA

SEQ ID NO: 17010 - protein, 11 aa, Borrelia garinii PBi
TAEELGMQPAK

SEQ ID NO: 17011 - protein, 11 aa, Borrelia garinii PBi
AEELGMQPAKI

SEQ ID NO: 17012 - protein, 11 aa, Borrelia garinii PBi
EELGMQPAKIN

SEQ ID NO: 17013 - protein, 11 aa, Borrelia garinii PBi
ELGMQPAKINT

SEQ ID NO: 17014 - protein, 11 aa, Borrelia garinii PBi
LGMQPAKINTP

SEQ ID NO: 17015 - protein, 11 aa, Borrelia garinii PBi
GMQPAKINTPA

SEQ ID NO: 17016 - protein, 11 aa, Borrelia garinii PBi
MQPAKINTPAS

SEQ ID NO: 17017 - protein, 11 aa, Borrelia garinii PBi
QPAKINTPASL

SEQ ID NO: 17018 - protein, 11 aa, Borrelia garinii PBi
PAKINTPASLS

SEQ ID NO: 17019 - protein, 11 aa, Borrelia garinii PBi
AKINTPASLSG

SEQ ID NO: 17020 - protein, 11 aa, Borrelia garinii PBi
KINTPASLSGS

SEQ ID NO: 17021 - protein, 11 aa, Borrelia garinii PBi
INTPASLSGSQ

SEQ ID NO: 17022 - protein, 11 aa, Borrelia garinii PBi
NTPASLSGSQA

SEQ ID NO: 17023 - protein, 11 aa, Borrelia garinii PBi
TPASLSGSQAS

SEQ ID NO: 17024 - protein, 11 aa, Borrelia garinii PBi
PASLSGSQASW

SEQ ID NO: 17025 - protein, 11 aa, Borrelia garinii PBi
ASLSGSQASWT

SEQ ID NO: 17026 - protein, 11 aa, Borrelia garinii PBi
SLSGSQASWTL

SEQ ID NO: 17027 - protein, 11 aa, Borrelia garinii PBi
LSGSQASWTLR

SEQ ID NO: 17028 - protein, 11 aa, Borrelia garinii PBi
SGSQASWTLRV

SEQ ID NO: 17029 - protein, 11 aa, Borrelia garinii PBi
GSQASWTLRVH

SEQ ID NO: 17030 - protein, 11 aa, Borrelia garinii PBi
SQASWTLRVHV

SEQ ID NO: 17031 - protein, 11 aa, Borrelia garinii PBi
QASWTLRVHVG

SEQ ID NO: 17032 - protein, 11 aa, Borrelia garinii PBi
ASWTLRVHVGA

SEQ ID NO: 17033 - protein, 11 aa, Borrelia garinii PBi
SWTLRVHVGAN

SEQ ID NO: 17034 - protein, 11 aa, Borrelia garinii PBi
WTLRVHVGANQ

SEQ ID NO: 17035 - protein, 11 aa, Borrelia garinii PBi
TLRVHVGANQD

SEQ ID NO: 17036 - protein, 11 aa, Borrelia garinii PBi
LRVHVGANQDE

SEQ ID NO: 17037 - protein, 11 aa, Borrelia garinii PBi
RVHVGANQDEA

SEQ ID NO: 17038 - protein, 11 aa, Borrelia garinii PBi
VHVGANQDEAI

SEQ ID NO: 17039 - protein, 11 aa, Borrelia garinii PBi
HVGANQDEAIA

SEQ ID NO: 17040 - protein, 11 aa, Borrelia garinii PBi
VGANQDEAIAV

SEQ ID NO: 17041 - protein, 11 aa, Borrelia garinii PBi
GANQDEAIAVN

SEQ ID NO: 17042 - protein, 11 aa, Borrelia garinii PBi
ANQDEAIAVNI

SEQ ID NO: 17043 - protein, 11 aa, Borrelia garinii PBi
NQDEAIAVNIY

SEQ ID NO: 17044 - protein, 11 aa, Borrelia garinii PBi
QDEAIAVNIYA

SEQ ID NO: 17045 - protein, 11 aa, Borrelia garinii PBi
DEAIAVNIYAA

SEQ ID NO: 17046 - protein, 11 aa, Borrelia garinii PBi
EAIAVNIYAAN

SEQ ID NO: 17047 - protein, 11 aa, Borrelia garinii PBi
AIAVNIYAANV

SEQ ID NO: 17048 - protein, 11 aa, Borrelia garinii PBi
IAVNIYAANVA

SEQ ID NO: 17049 - protein, 11 aa, Borrelia garinii PBi
AVNIYAANVAN

SEQ ID NO: 17050 - protein, 11 aa, Borrelia garinii PBi
VNIYAANVANL

SEQ ID NO: 17051 - protein, 11 aa, Borrelia garinii PBi
NIYAANVANLF

SEQ ID NO: 17052 - protein, 11 aa, Borrelia garinii PBi
IYAANVANLFS

SEQ ID NO: 17053 - protein, 11 aa, Borrelia garinii PBi
YAANVANLFSG

SEQ ID NO: 17054 - protein, 11 aa, Borrelia garinii PBi
AANVANLFSGE

SEQ ID NO: 17055 - protein, 11 aa, Borrelia garinii PBi
ANVANLFSGEG

SEQ ID NO: 17056 - protein, 11 aa, Borrelia garinii PBi
NVANLFSGEGS

SEQ ID NO: 17057 - protein, 11 aa, Borrelia garinii PBi
VANLFSGEGSQ

SEQ ID NO: 17058 - protein, 11 aa, Borrelia garinii PBi
ANLFSGEGSQA

SEQ ID NO: 17059 - protein, 11 aa, Borrelia garinii PBi
NLFSGEGSQAA

SEQ ID NO: 17060 - protein, 11 aa, Borrelia garinii PBi
LFSGEGSQAAQ

SEQ ID NO: 17061 - protein, 11 aa, Borrelia garinii PBi
FSGEGSQAAQT

SEQ ID NO: 17062 - protein, 11 aa, Borrelia garinii PBi
SGEGSQAAQTA

SEQ ID NO: 17063 - protein, 11 aa, Borrelia garinii PBi
GEGSQAAQTAP

SEQ ID NO: 17064 - protein, 11 aa, Borrelia garinii PBi
EGSQAAQTAPV

SEQ ID NO: 17065 - protein, 11 aa, Borrelia garinii PBi
GSQAAQTAPVQ

SEQ ID NO: 17066 - protein, 11 aa, Borrelia garinii PBi
SQAAQTAPVQE

SEQ ID NO: 17067 - protein, 11 aa, Borrelia garinii PBi
QAAQTAPVQEG

SEQ ID NO: 17068 - protein, 11 aa, Borrelia garinii PBi
AAQTAPVQEGA

SEQ ID NO: 17069 - protein, 11 aa, Borrelia garinii PBi
AQTAPVQEGAQ

SEQ ID NO: 17070 - protein, 11 aa, Borrelia garinii PBi
QTAPVQEGAQQ

SEQ ID NO: 17071 - protein, 11 aa, Borrelia garinii PBi
TAPVQEGAQQE

SEQ ID NO: 17072 - protein, 11 aa, Borrelia garinii PBi
APVQEGAQQEG

SEQ ID NO: 17073 - protein, 11 aa, Borrelia garinii PBi
PVQEGAQQEGA

SEQ ID NO: 17074 - protein, 11 aa, Borrelia garinii PBi
VQEGAQQEGAQ

SEQ ID NO: 17075 - protein, 11 aa, Borrelia garinii PBi
QEGAQQEGAQQ

SEQ ID NO: 17076 - protein, 11 aa, Borrelia garinii PBi
EGAQQEGAQQP

SEQ ID NO: 17077 - protein, 11 aa, Borrelia garinii PBi
GAQQEGAQQPA

SEQ ID NO: 17078 - protein, 11 aa, Borrelia garinii PBi
AQQEGAQQPAP

SEQ ID NO: 17079 - protein, 11 aa, Borrelia garinii PBi
QQEGAQQPAPA

SEQ ID NO: 17080 - protein, 11 aa, Borrelia garinii PBi
QEGAQQPAPAT

SEQ ID NO: 17081 - protein, 11 aa, Borrelia garinii PBi
EGAQQPAPATA

SEQ ID NO: 17082 - protein, 11 aa, Borrelia garinii PBi
GAQQPAPATAP

SEQ ID NO: 17083 - protein, 11 aa, Borrelia garinii PBi
AQQPAPATAPS

SEQ ID NO: 17084 - protein, 11 aa, Borrelia garinii PBi
QQPAPATAPSQ

SEQ ID NO: 17085 - protein, 11 aa, Borrelia garinii PBi
QPAPATAPSQG

SEQ ID NO: 17086 - protein, 11 aa, Borrelia garinii PBi
PAPATAPSQGG

SEQ ID NO: 17087 - protein, 11 aa, Borrelia garinii PBi
APATAPSQGGV

SEQ ID NO: 17088 - protein, 11 aa, Borrelia garinii PBi
PATAPSQGGVN

SEQ ID NO: 17089 - protein, 11 aa, Borrelia garinii PBi
ATAPSQGGVNS

SEQ ID NO: 17090 - protein, 11 aa, Borrelia garinii PBi
TAPSQGGVNSP

SEQ ID NO: 17091 - protein, 11 aa, Borrelia garinii PBi
APSQGGVNSPV

SEQ ID NO: 17092 - protein, 11 aa, Borrelia garinii PBi
PSQGGVNSPVN

SEQ ID NO: 17093 - protein, 11 aa, Borrelia garinii PBi
SQGGVNSPVNV

SEQ ID NO: 17094 - protein, 11 aa, Borrelia garinii PBi
QGGVNSPVNVT

SEQ ID NO: 17095 - protein, 11 aa, Borrelia garinii PBi
GGVNSPVNVTT

SEQ ID NO: 17096 - protein, 11 aa, Borrelia garinii PBi
GVNSPVNVTTT

SEQ ID NO: 17097 - protein, 11 aa, Borrelia garinii PBi
VNSPVNVTTTV

SEQ ID NO: 17098 - protein, 11 aa, Borrelia garinii PBi
NSPVNVTTTVD

SEQ ID NO: 17099 - protein, 11 aa, Borrelia garinii PBi
SPVNVTTTVDA

SEQ ID NO: 17100 - protein, 11 aa, Borrelia garinii PBi
PVNVTTTVDAN

SEQ ID NO: 17101 - protein, 11 aa, Borrelia garinii PBi
VNVTTTVDANT

SEQ ID NO: 17102 - protein, 11 aa, Borrelia garinii PBi
NVTTTVDANTS

SEQ ID NO: 17103 - protein, 11 aa, Borrelia garinii PBi
VTTTVDANTSL

SEQ ID NO: 17104 - protein, 11 aa, Borrelia garinii PBi
TTTVDANTSLA

SEQ ID NO: 17105 - protein, 11 aa, Borrelia garinii PBi
TTVDANTSLAK

SEQ ID NO: 17106 - protein, 11 aa, Borrelia garinii PBi
TVDANTSLAKI

SEQ ID NO: 17107 - protein, 11 aa, Borrelia garinii PBi
VDANTSLAKIE

SEQ ID NO: 17108 - protein, 11 aa, Borrelia garinii PBi
DANTSLAKIEN

SEQ ID NO: 17109 - protein, 11 aa, Borrelia garinii PBi
ANTSLAKIENA

SEQ ID NO: 17110 - protein, 11 aa, Borrelia garinii PBi
NTSLAKIENAI

SEQ ID NO: 17111 - protein, 11 aa, Borrelia garinii PBi
TSLAKIENAIR

SEQ ID NO: 17112 - protein, 11 aa, Borrelia garinii PBi
SLAKIENAIRM

SEQ ID NO: 17113 - protein, 11 aa, Borrelia garinii PBi
LAKIENAIRMI

SEQ ID NO: 17114 - protein, 11 aa, Borrelia garinii PBi
AKIENAIRMIS

SEQ ID NO: 17115 - protein, 11 aa, Borrelia garinii PBi
KIENAIRMISD

SEQ ID NO: 17116 - protein, 11 aa, Borrelia garinii PBi
IENAIRMISDQ

SEQ ID NO: 17117 - protein, 11 aa, Borrelia garinii PBi
ENAIRMISDQR

SEQ ID NO: 17118 - protein, 11 aa, Borrelia garinii PBi
NAIRMISDQRA

SEQ ID NO: 17119 - protein, 11 aa, Borrelia garinii PBi
AIRMISDQRAN

SEQ ID NO: 17120 - protein, 11 aa, Borrelia garinii PBi
IRMISDQRANL

SEQ ID NO: 17121 - protein, 11 aa, Borrelia garinii PBi
RMISDQRANLG

SEQ ID NO: 17122 - protein, 11 aa, Borrelia garinii PBi
MISDQRANLGA

SEQ ID NO: 17123 - protein, 11 aa, Borrelia garinii PBi
ISDQRANLGAF

SEQ ID NO: 17124 - protein, 11 aa, Borrelia garinii PBi
SDQRANLGAFQ

SEQ ID NO: 17125 - protein, 11 aa, Borrelia garinii PBi
DQRANLGAFQN

SEQ ID NO: 17126 - protein, 11 aa, Borrelia garinii PBi
QRANLGAFQNR

SEQ ID NO: 17127 - protein, 11 aa, Borrelia garinii PBi
RANLGAFQNRL

SEQ ID NO: 17128 - protein, 11 aa, Borrelia garinii PBi
ANLGAFQNRLE

SEQ ID NO: 17129 - protein, 11 aa, Borrelia garinii PBi
NLGAFQNRLES

SEQ ID NO: 17130 - protein, 11 aa, Borrelia garinii PBi
LGAFQNRLESI

SEQ ID NO: 17131 - protein, 11 aa, Borrelia garinii PBi
GAFQNRLESIK

SEQ ID NO: 17132 - protein, 11 aa, Borrelia garinii PBi
AFQNRLESIKD

SEQ ID NO: 17133 - protein, 11 aa, Borrelia garinii PBi
FQNRLESIKDS

SEQ ID NO: 17134 - protein, 11 aa, Borrelia garinii PBi
QNRLESIKDST

SEQ ID NO: 17135 - protein, 11 aa, Borrelia garinii PBi
NRLESIKDSTE

SEQ ID NO: 17136 - protein, 11 aa, Borrelia garinii PBi
RLESIKDSTEY

SEQ ID NO: 17137 - protein, 11 aa, Borrelia garinii PBi
LESIKDSTEYA

SEQ ID NO: 17138 - protein, 11 aa, Borrelia garinii PBi
ESIKDSTEYAI

SEQ ID NO: 17139 - protein, 11 aa, Borrelia garinii PBi
SIKDSTEYAIE

SEQ ID NO: 17140 - protein, 11 aa, Borrelia garinii PBi
IKDSTEYAIEN

SEQ ID NO: 17141 - protein, 11 aa, Borrelia garinii PBi
KDSTEYAIENL

SEQ ID NO: 17142 - protein, 11 aa, Borrelia garinii PBi
DSTEYAIENLK

SEQ ID NO: 17143 - protein, 11 aa, Borrelia garinii PBi
STEYAIENLKA

SEQ ID NO: 17144 - protein, 11 aa, Borrelia garinii PBi
TEYAIENLKAS

SEQ ID NO: 17145 - protein, 11 aa, Borrelia garinii PBi
EYAIENLKASY

SEQ ID NO: 17146 - protein, 11 aa, Borrelia garinii PBi
YAIENLKASYA

SEQ ID NO: 17147 - protein, 11 aa, Borrelia garinii PBi
AIENLKASYAQ

SEQ ID NO: 17148 - protein, 11 aa, Borrelia garinii PBi
IENLKASYAQI

SEQ ID NO: 17149 - protein, 11 aa, Borrelia garinii PBi
ENLKASYAQIK

SEQ ID NO: 17150 - protein, 11 aa, Borrelia garinii PBi
NLKASYAQIKD

SEQ ID NO: 17151 - protein, 11 aa, Borrelia garinii PBi
LKASYAQIKDA

SEQ ID NO: 17152 - protein, 11 aa, Borrelia garinii PBi
KASYAQIKDAT

SEQ ID NO: 17153 - protein, 11 aa, Borrelia garinii PBi
ASYAQIKDATM

SEQ ID NO: 17154 - protein, 11 aa, Borrelia garinii PBi
SYAQIKDATMT

SEQ ID NO: 17155 - protein, 11 aa, Borrelia garinii PBi
YAQIKDATMTD

SEQ ID NO: 17156 - protein, 11 aa, Borrelia garinii PBi
AQIKDATMTDE

SEQ ID NO: 17157 - protein, 11 aa, Borrelia garinii PBi
QIKDATMTDEV

SEQ ID NO: 17158 - protein, 11 aa, Borrelia garinii PBi
IKDATMTDEVV

SEQ ID NO: 17159 - protein, 11 aa, Borrelia garinii PBi
KDATMTDEVVA

SEQ ID NO: 17160 - protein, 11 aa, Borrelia garinii PBi
DATMTDEVVAS

SEQ ID NO: 17161 - protein, 11 aa, Borrelia garinii PBi
ATMTDEVVAST

SEQ ID NO: 17162 - protein, 11 aa, Borrelia garinii PBi
TMTDEVVASTT

SEQ ID NO: 17163 - protein, 11 aa, Borrelia garinii PBi
MTDEVVASTTN

SEQ ID NO: 17164 - protein, 11 aa, Borrelia garinii PBi
TDEVVASTTNS

SEQ ID NO: 17165 - protein, 11 aa, Borrelia garinii PBi
DEVVASTTNSI

SEQ ID NO: 17166 - protein, 11 aa, Borrelia garinii PBi
EVVASTTNSIL

SEQ ID NO: 17167 - protein, 11 aa, Borrelia garinii PBi
VVASTTNSILT

SEQ ID NO: 17168 - protein, 11 aa, Borrelia garinii PBi
VASTTNSILTQ

SEQ ID NO: 17169 - protein, 11 aa, Borrelia garinii PBi
ASTTNSILTQS

SEQ ID NO: 17170 - protein, 11 aa, Borrelia garinii PBi
STTNSILTQSA

SEQ ID NO: 17171 - protein, 11 aa, Borrelia garinii PBi
TTNSILTQSAM

SEQ ID NO: 17172 - protein, 11 aa, Borrelia garinii PBi
TNSILTQSAMA

SEQ ID NO: 17173 - protein, 11 aa, Borrelia garinii PBi
NSILTQSAMAM

SEQ ID NO: 17174 - protein, 11 aa, Borrelia garinii PBi
SILTQSAMAMI

SEQ ID NO: 17175 - protein, 11 aa, Borrelia garinii PBi
ILTQSAMAMIA

SEQ ID NO: 17176 - protein, 11 aa, Borrelia garinii PBi
LTQSAMAMIAQ

SEQ ID NO: 17177 - protein, 11 aa, Borrelia garinii PBi
TQSAMAMIAQA

SEQ ID NO: 17178 - protein, 11 aa, Borrelia garinii PBi
QSAMAMIAQAN

SEQ ID NO: 17179 - protein, 11 aa, Borrelia garinii PBi
SAMAMIAQANQ

SEQ ID NO: 17180 - protein, 11 aa, Borrelia garinii PBi
AMAMIAQANQV

SEQ ID NO: 17181 - protein, 11 aa, Borrelia garinii PBi
MAMIAQANQVP

SEQ ID NO: 17182 - protein, 11 aa, Borrelia garinii PBi
AMIAQANQVPQ

SEQ ID NO: 17183 - protein, 11 aa, Borrelia garinii PBi
MIAQANQVPQY

SEQ ID NO: 17184 - protein, 11 aa, Borrelia garinii PBi
IAQANQVPQYV

SEQ ID NO: 17185 - protein, 11 aa, Borrelia garinii PBi
AQANQVPQYVL

SEQ ID NO: 17186 - protein, 11 aa, Borrelia garinii PBi
QANQVPQYVLS

SEQ ID NO: 17187 - protein, 11 aa, Borrelia garinii PBi
ANQVPQYVLSL

SEQ ID NO: 17188 - protein, 11 aa, Borrelia garinii PBi
NQVPQYVLSLL

SEQ ID NO: 17189 - protein, 11 aa, Borrelia garinii PBi
QVPQYVLSLLR

SEQ ID NO: 17190 - protein, 8 aa, Borrelia Burgdorferi
MRGSHHHH

SEQ ID NO: 17191 - protein, 8 aa, Borrelia Burgdorferi
RGSHHHHH

SEQ ID NO: 17192 - protein, 8 aa, Borrelia Burgdorferi
GSHHHHHH

SEQ ID NO: 17193 - protein, 8 aa, Borrelia Burgdorferi
SHHHHHHG

SEQ ID NO: 17194 - protein, 8 aa, Borrelia Burgdorferi
HHHHHHGS

SEQ ID NO: 17195 - protein, 8 aa, Borrelia Burgdorferi
HHHHHGSS

SEQ ID NO: 17196 - protein, 8 aa, Borrelia Burgdorferi
HHHHGSSQ

SEQ ID NO: 17197 - protein, 8 aa, Borrelia Burgdorferi
HHHGSSQV

SEQ ID NO: 17198 - protein, 8 aa, Borrelia Burgdorferi
HHGSSQVA

SEQ ID NO: 17199 - protein, 8 aa, Borrelia Burgdorferi
HGSSQVAD

SEQ ID NO: 17200 - protein, 8 aa, Borrelia Burgdorferi
GSSQVADK

SEQ ID NO: 17201 - protein, 8 aa, Borrelia Burgdorferi
SSQVADKD

SEQ ID NO: 17202 - protein, 8 aa, Borrelia Burgdorferi
SQVADKDD

SEQ ID NO: 17203 - protein, 8 aa, Borrelia Burgdorferi
QVADKDDP

SEQ ID NO: 17204 - protein, 8 aa, Borrelia Burgdorferi
VADKDDPT

SEQ ID NO: 17205 - protein, 8 aa, Borrelia Burgdorferi
ADKDDPTN

SEQ ID NO: 17206 - protein, 8 aa, Borrelia Burgdorferi
DKDDPTNK

SEQ ID NO: 17207 - protein, 8 aa, Borrelia Burgdorferi
KDDPTNKF

SEQ ID NO: 17208 - protein, 8 aa, Borrelia Burgdorferi
DDPTNKFY

SEQ ID NO: 17209 - protein, 8 aa, Borrelia Burgdorferi
DPTNKFYQ

SEQ ID NO: 17210 - protein, 8 aa, Borrelia Burgdorferi
PTNKFYQS

SEQ ID NO: 17211 - protein, 8 aa, Borrelia Burgdorferi
TNKFYQSV

SEQ ID NO: 17212 - protein, 8 aa, Borrelia Burgdorferi
NKFYQSVI

SEQ ID NO: 17213 - protein, 8 aa, Borrelia Burgdorferi
KFYQSVIQ

SEQ ID NO: 17214 - protein, 8 aa, Borrelia Burgdorferi
FYQSVIQL

SEQ ID NO: 17215 - protein, 8 aa, Borrelia Burgdorferi
YQSVIQLG

SEQ ID NO: 17216 - protein, 8 aa, Borrelia Burgdorferi
QSVIQLGN

SEQ ID NO: 17217 - protein, 8 aa, Borrelia Burgdorferi
SVIQLGNG

SEQ ID NO: 17218 - protein, 8 aa, Borrelia Burgdorferi
VIQLGNGF

SEQ ID NO: 17219 - protein, 8 aa, Borrelia Burgdorferi
IQLGNGFL

SEQ ID NO: 17220 - protein, 8 aa, Borrelia Burgdorferi
QLGNGFLD

SEQ ID NO: 17221 - protein, 8 aa, Borrelia Burgdorferi
LGNGFLDV

SEQ ID NO: 17222 - protein, 8 aa, Borrelia Burgdorferi
GNGFLDVF

SEQ ID NO: 17223 - protein, 8 aa, Borrelia Burgdorferi
NGFLDVFT

SEQ ID NO: 17224 - protein, 8 aa, Borrelia Burgdorferi
GFLDVFTS

SEQ ID NO: 17225 - protein, 8 aa, Borrelia Burgdorferi
FLDVFTSF

SEQ ID NO: 17226 - protein, 8 aa, Borrelia Burgdorferi
LDVFTSFG

SEQ ID NO: 17227 - protein, 8 aa, Borrelia Burgdorferi
DVFTSFGG

SEQ ID NO: 17228 - protein, 8 aa, Borrelia Burgdorferi
VFTSFGGL

SEQ ID NO: 17229 - protein, 8 aa, Borrelia Burgdorferi
FTSFGGLV

SEQ ID NO: 17230 - protein, 8 aa, Borrelia Burgdorferi
TSFGGLVA

SEQ ID NO: 17231 - protein, 8 aa, Borrelia Burgdorferi
SFGGLVAE

SEQ ID NO: 17232 - protein, 8 aa, Borrelia Burgdorferi
FGGLVAEA

SEQ ID NO: 17233 - protein, 8 aa, Borrelia Burgdorferi
GGLVAEAF

SEQ ID NO: 17234 - protein, 8 aa, Borrelia Burgdorferi
GLVAEAFG

SEQ ID NO: 17235 - protein, 8 aa, Borrelia Burgdorferi
LVAEAFGF

SEQ ID NO: 17236 - protein, 8 aa, Borrelia Burgdorferi
VAEAFGFK

SEQ ID NO: 17237 - protein, 8 aa, Borrelia Burgdorferi
AEAFGFKS

SEQ ID NO: 17238 - protein, 8 aa, Borrelia Burgdorferi
EAFGFKSD

SEQ ID NO: 17239 - protein, 8 aa, Borrelia Burgdorferi
AFGFKSDP

SEQ ID NO: 17240 - protein, 8 aa, Borrelia Burgdorferi
FGFKSDPK

SEQ ID NO: 17241 - protein, 8 aa, Borrelia Burgdorferi
GFKSDPKK

SEQ ID NO: 17242 - protein, 8 aa, Borrelia Burgdorferi
FKSDPKKS

SEQ ID NO: 17243 - protein, 8 aa, Borrelia Burgdorferi
KSDPKKSD

SEQ ID NO: 17244 - protein, 8 aa, Borrelia Burgdorferi
SDPKKSDV

SEQ ID NO: 17245 - protein, 8 aa, Borrelia Burgdorferi
DPKKSDVK

SEQ ID NO: 17246 - protein, 8 aa, Borrelia Burgdorferi
PKKSDVKT

SEQ ID NO: 17247 - protein, 8 aa, Borrelia Burgdorferi
KKSDVKTY

SEQ ID NO: 17248 - protein, 8 aa, Borrelia Burgdorferi
KSDVKTYF

SEQ ID NO: 17249 - protein, 8 aa, Borrelia Burgdorferi
SDVKTYFT

SEQ ID NO: 17250 - protein, 8 aa, Borrelia Burgdorferi
DVKTYFTT

SEQ ID NO: 17251 - protein, 8 aa, Borrelia Burgdorferi
VKTYFTTV

SEQ ID NO: 17252 - protein, 8 aa, Borrelia Burgdorferi
KTYFTTVA

SEQ ID NO: 17253 - protein, 8 aa, Borrelia Burgdorferi
TYFTTVAA

SEQ ID NO: 17254 - protein, 8 aa, Borrelia Burgdorferi
YFTTVAAK

SEQ ID NO: 17255 - protein, 8 aa, Borrelia Burgdorferi
FTTVAAKL

SEQ ID NO: 17256 - protein, 8 aa, Borrelia Burgdorferi
TTVAAKLE

SEQ ID NO: 17257 - protein, 8 aa, Borrelia Burgdorferi
TVAAKLEK

SEQ ID NO: 17258 - protein, 8 aa, Borrelia Burgdorferi
VAAKLEKT

SEQ ID NO: 17259 - protein, 8 aa, Borrelia Burgdorferi
AAKLEKTK

SEQ ID NO: 17260 - protein, 8 aa, Borrelia Burgdorferi
AKLEKTKT

SEQ ID NO: 17261 - protein, 8 aa, Borrelia Burgdorferi
KLEKTKTD

SEQ ID NO: 17262 - protein, 8 aa, Borrelia Burgdorferi
LEKTKTDL

SEQ ID NO: 17263 - protein, 8 aa, Borrelia Burgdorferi
EKTKTDLN

SEQ ID NO: 17264 - protein, 8 aa, Borrelia Burgdorferi
KTKTDLNS

SEQ ID NO: 17265 - protein, 8 aa, Borrelia Burgdorferi
TKTDLNSL

SEQ ID NO: 17266 - protein, 8 aa, Borrelia Burgdorferi
KTDLNSLP

SEQ ID NO: 17267 - protein, 8 aa, Borrelia Burgdorferi
TDLNSLPK

SEQ ID NO: 17268 - protein, 8 aa, Borrelia Burgdorferi
DLNSLPKE

SEQ ID NO: 17269 - protein, 8 aa, Borrelia Burgdorferi
LNSLPKEK

SEQ ID NO: 17270 - protein, 8 aa, Borrelia Burgdorferi
NSLPKEKS

SEQ ID NO: 17271 - protein, 8 aa, Borrelia Burgdorferi
SLPKEKSD

SEQ ID NO: 17272 - protein, 8 aa, Borrelia Burgdorferi
LPKEKSDI

SEQ ID NO: 17273 - protein, 8 aa, Borrelia Burgdorferi
PKEKSDIS

SEQ ID NO: 17274 - protein, 8 aa, Borrelia Burgdorferi
KEKSDISS

SEQ ID NO: 17275 - protein, 8 aa, Borrelia Burgdorferi
EKSDISST

SEQ ID NO: 17276 - protein, 8 aa, Borrelia Burgdorferi
KSDISSTT

SEQ ID NO: 17277 - protein, 8 aa, Borrelia Burgdorferi
SDISSTTG

SEQ ID NO: 17278 - protein, 8 aa, Borrelia Burgdorferi
DISSTTGK

SEQ ID NO: 17279 - protein, 8 aa, Borrelia Burgdorferi
ISSTTGKP

SEQ ID NO: 17280 - protein, 8 aa, Borrelia Burgdorferi
SSTTGKPD

SEQ ID NO: 17281 - protein, 8 aa, Borrelia Burgdorferi
STTGKPDS

SEQ ID NO: 17282 - protein, 8 aa, Borrelia Burgdorferi
TTGKPDST

SEQ ID NO: 17283 - protein, 8 aa, Borrelia Burgdorferi
TGKPDSTG

SEQ ID NO: 17284 - protein, 8 aa, Borrelia Burgdorferi
GKPDSTGS

SEQ ID NO: 17285 - protein, 8 aa, Borrelia Burgdorferi
KPDSTGSV

SEQ ID NO: 17286 - protein, 8 aa, Borrelia Burgdorferi
PDSTGSVG

SEQ ID NO: 17287 - protein, 8 aa, Borrelia Burgdorferi
DSTGSVGT

SEQ ID NO: 17288 - protein, 8 aa, Borrelia Burgdorferi
STGSVGTA

SEQ ID NO: 17289 - protein, 8 aa, Borrelia Burgdorferi
TGSVGTAV

SEQ ID NO: 17290 - protein, 8 aa, Borrelia Burgdorferi
GSVGTAVE

SEQ ID NO: 17291 - protein, 8 aa, Borrelia Burgdorferi
SVGTAVEG

SEQ ID NO: 17292 - protein, 8 aa, Borrelia Burgdorferi
VGTAVEGA

SEQ ID NO: 17293 - protein, 8 aa, Borrelia Burgdorferi
GTAVEGAI

SEQ ID NO: 17294 - protein, 8 aa, Borrelia Burgdorferi
TAVEGAIK

SEQ ID NO: 17295 - protein, 8 aa, Borrelia Burgdorferi
AVEGAIKE

SEQ ID NO: 17296 - protein, 8 aa, Borrelia Burgdorferi
VEGAIKEV

SEQ ID NO: 17297 - protein, 8 aa, Borrelia Burgdorferi
EGAIKEVS

SEQ ID NO: 17298 - protein, 8 aa, Borrelia Burgdorferi
GAIKEVSE

SEQ ID NO: 17299 - protein, 8 aa, Borrelia Burgdorferi
AIKEVSEL

SEQ ID NO: 17300 - protein, 8 aa, Borrelia Burgdorferi
IKEVSELL

SEQ ID NO: 17301 - protein, 8 aa, Borrelia Burgdorferi
KEVSELLD

SEQ ID NO: 17302 - protein, 8 aa, Borrelia Burgdorferi
EVSELLDK

SEQ ID NO: 17303 - protein, 8 aa, Borrelia Burgdorferi
VSELLDKL

SEQ ID NO: 17304 - protein, 8 aa, Borrelia Burgdorferi
SELLDKLV

SEQ ID NO: 17305 - protein, 8 aa, Borrelia Burgdorferi
ELLDKLVK

SEQ ID NO: 17306 - protein, 8 aa, Borrelia Burgdorferi
LLDKLVKA

SEQ ID NO: 17307 - protein, 8 aa, Borrelia Burgdorferi
LDKLVKAV

SEQ ID NO: 17308 - protein, 8 aa, Borrelia Burgdorferi
DKLVKAVK

SEQ ID NO: 17309 - protein, 8 aa, Borrelia Burgdorferi
KLVKAVKT

SEQ ID NO: 17310 - protein, 8 aa, Borrelia Burgdorferi
LVKAVKTA

SEQ ID NO: 17311 - protein, 8 aa, Borrelia Burgdorferi
VKAVKTAE

SEQ ID NO: 17312 - protein, 8 aa, Borrelia Burgdorferi
KAVKTAEG

SEQ ID NO: 17313 - protein, 8 aa, Borrelia Burgdorferi
AVKTAEGA

SEQ ID NO: 17314 - protein, 8 aa, Borrelia Burgdorferi
VKTAEGAS

SEQ ID NO: 17315 - protein, 8 aa, Borrelia Burgdorferi
KTAEGASS

SEQ ID NO: 17316 - protein, 8 aa, Borrelia Burgdorferi
TAEGASSG

SEQ ID NO: 17317 - protein, 8 aa, Borrelia Burgdorferi
AEGASSGT

SEQ ID NO: 17318 - protein, 8 aa, Borrelia Burgdorferi
EGASSGTA

SEQ ID NO: 17319 - protein, 8 aa, Borrelia Burgdorferi
GASSGTAA

SEQ ID NO: 17320 - protein, 8 aa, Borrelia Burgdorferi
ASSGTAAI

SEQ ID NO: 17321 - protein, 8 aa, Borrelia Burgdorferi
SSGTAAIG

SEQ ID NO: 17322 - protein, 8 aa, Borrelia Burgdorferi
SGTAAIGE

SEQ ID NO: 17323 - protein, 8 aa, Borrelia Burgdorferi
GTAAIGEV

SEQ ID NO: 17324 - protein, 8 aa, Borrelia Burgdorferi
TAAIGEVV

SEQ ID NO: 17325 - protein, 8 aa, Borrelia Burgdorferi
AAIGEVVA

SEQ ID NO: 17326 - protein, 8 aa, Borrelia Burgdorferi
AIGEVVAD

SEQ ID NO: 17327 - protein, 8 aa, Borrelia Burgdorferi
IGEVVADA

SEQ ID NO: 17328 - protein, 8 aa, Borrelia Burgdorferi
GEVVADAD

SEQ ID NO: 17329 - protein, 8 aa, Borrelia Burgdorferi
EVVADADA

SEQ ID NO: 17330 - protein, 8 aa, Borrelia Burgdorferi
VVADADAA

SEQ ID NO: 17331 - protein, 8 aa, Borrelia Burgdorferi
VADADAAK

SEQ ID NO: 17332 - protein, 8 aa, Borrelia Burgdorferi
ADADAAKV

SEQ ID NO: 17333 - protein, 8 aa, Borrelia Burgdorferi
DADAAKVA

SEQ ID NO: 17334 - protein, 8 aa, Borrelia Burgdorferi
ADAAKVAD

SEQ ID NO: 17335 - protein, 8 aa, Borrelia Burgdorferi
DAAKVADK

SEQ ID NO: 17336 - protein, 8 aa, Borrelia Burgdorferi
AAKVADKA

SEQ ID NO: 17337 - protein, 8 aa, Borrelia Burgdorferi
AKVADKAS

SEQ ID NO: 17338 - protein, 8 aa, Borrelia Burgdorferi
KVADKASV

SEQ ID NO: 17339 - protein, 8 aa, Borrelia Burgdorferi
VADKASVK

SEQ ID NO: 17340 - protein, 8 aa, Borrelia Burgdorferi
ADKASVKG

SEQ ID NO: 17341 - protein, 8 aa, Borrelia Burgdorferi
DKASVKGI

SEQ ID NO: 17342 - protein, 8 aa, Borrelia Burgdorferi
KASVKGIA

SEQ ID NO: 17343 - protein, 8 aa, Borrelia Burgdorferi
ASVKGIAK

SEQ ID NO: 17344 - protein, 8 aa, Borrelia Burgdorferi
SVKGIAKG

SEQ ID NO: 17345 - protein, 8 aa, Borrelia Burgdorferi
VKGIAKGI

SEQ ID NO: 17346 - protein, 8 aa, Borrelia Burgdorferi
KGIAKGIK

SEQ ID NO: 17347 - protein, 8 aa, Borrelia Burgdorferi
GIAKGIKE

SEQ ID NO: 17348 - protein, 8 aa, Borrelia Burgdorferi
IAKGIKEI

SEQ ID NO: 17349 - protein, 8 aa, Borrelia Burgdorferi
AKGIKEIV

SEQ ID NO: 17350 - protein, 8 aa, Borrelia Burgdorferi
KGIKEIVE

SEQ ID NO: 17351 - protein, 8 aa, Borrelia Burgdorferi
GIKEIVEA

SEQ ID NO: 17352 - protein, 8 aa, Borrelia Burgdorferi
IKEIVEAA

SEQ ID NO: 17353 - protein, 8 aa, Borrelia Burgdorferi
KEIVEAAG

SEQ ID NO: 17354 - protein, 8 aa, Borrelia Burgdorferi
EIVEAAGG

SEQ ID NO: 17355 - protein, 8 aa, Borrelia Burgdorferi
IVEAAGGS

SEQ ID NO: 17356 - protein, 8 aa, Borrelia Burgdorferi
VEAAGGSE

SEQ ID NO: 17357 - protein, 8 aa, Borrelia Burgdorferi
EAAGGSEK

SEQ ID NO: 17358 - protein, 8 aa, Borrelia Burgdorferi
AAGGSEKL

SEQ ID NO: 17359 - protein, 8 aa, Borrelia Burgdorferi
AGGSEKLK

SEQ ID NO: 17360 - protein, 8 aa, Borrelia Burgdorferi
GGSEKLKA

SEQ ID NO: 17361 - protein, 8 aa, Borrelia Burgdorferi
GSEKLKAV

SEQ ID NO: 17362 - protein, 8 aa, Borrelia Burgdorferi
SEKLKAVA

SEQ ID NO: 17363 - protein, 8 aa, Borrelia Burgdorferi
EKLKAVAA

SEQ ID NO: 17364 - protein, 8 aa, Borrelia Burgdorferi
KLKAVAAA

SEQ ID NO: 17365 - protein, 8 aa, Borrelia Burgdorferi
LKAVAAAK

SEQ ID NO: 17366 - protein, 8 aa, Borrelia Burgdorferi
KAVAAAKG

SEQ ID NO: 17367 - protein, 8 aa, Borrelia Burgdorferi
AVAAAKGE

SEQ ID NO: 17368 - protein, 8 aa, Borrelia Burgdorferi
VAAAKGEN

SEQ ID NO: 17369 - protein, 8 aa, Borrelia Burgdorferi
AAAKGENN

SEQ ID NO: 17370 - protein, 8 aa, Borrelia Burgdorferi
AAKGENNK

SEQ ID NO: 17371 - protein, 8 aa, Borrelia Burgdorferi
AKGENNKG

SEQ ID NO: 17372 - protein, 8 aa, Borrelia Burgdorferi
KGENNKGA

SEQ ID NO: 17373 - protein, 8 aa, Borrelia Burgdorferi
GENNKGAG

SEQ ID NO: 17374 - protein, 8 aa, Borrelia Burgdorferi
ENNKGAGK

SEQ ID NO: 17375 - protein, 8 aa, Borrelia Burgdorferi
NNKGAGKL

SEQ ID NO: 17376 - protein, 8 aa, Borrelia Burgdorferi
NKGAGKLF

SEQ ID NO: 17377 - protein, 8 aa, Borrelia Burgdorferi
KGAGKLFG

SEQ ID NO: 17378 - protein, 8 aa, Borrelia Burgdorferi
GAGKLFGK

SEQ ID NO: 17379 - protein, 8 aa, Borrelia Burgdorferi
AGKLFGKA

SEQ ID NO: 17380 - protein, 8 aa, Borrelia Burgdorferi
GKLFGKAG

SEQ ID NO: 17381 - protein, 8 aa, Borrelia Burgdorferi
KLFGKAGA

SEQ ID NO: 17382 - protein, 8 aa, Borrelia Burgdorferi
LFGKAGAA

SEQ ID NO: 17383 - protein, 8 aa, Borrelia Burgdorferi
FGKAGAAA

SEQ ID NO: 17384 - protein, 8 aa, Borrelia Burgdorferi
GKAGAAAH

SEQ ID NO: 17385 - protein, 8 aa, Borrelia Burgdorferi
KAGAAAHG

SEQ ID NO: 17386 - protein, 8 aa, Borrelia Burgdorferi
AGAAAHGD

SEQ ID NO: 17387 - protein, 8 aa, Borrelia Burgdorferi
GAAAHGDS

SEQ ID NO: 17388 - protein, 8 aa, Borrelia Burgdorferi
AAAHGDSE

SEQ ID NO: 17389 - protein, 8 aa, Borrelia Burgdorferi
AAHGDSEA

SEQ ID NO: 17390 - protein, 8 aa, Borrelia Burgdorferi
AHGDSEAA

SEQ ID NO: 17391 - protein, 8 aa, Borrelia Burgdorferi
HGDSEAAS

SEQ ID NO: 17392 - protein, 8 aa, Borrelia Burgdorferi
GDSEAASK

SEQ ID NO: 17393 - protein, 8 aa, Borrelia Burgdorferi
DSEAASKA

SEQ ID NO: 17394 - protein, 8 aa, Borrelia Burgdorferi
SEAASKAA

SEQ ID NO: 17395 - protein, 8 aa, Borrelia Burgdorferi
EAASKAAG

SEQ ID NO: 17396 - protein, 8 aa, Borrelia Burgdorferi
AASKAAGA

SEQ ID NO: 17397 - protein, 8 aa, Borrelia Burgdorferi
ASKAAGAV

SEQ ID NO: 17398 - protein, 8 aa, Borrelia Burgdorferi
SKAAGAVS

SEQ ID NO: 17399 - protein, 8 aa, Borrelia Burgdorferi
KAAGAVSA

SEQ ID NO: 17400 - protein, 8 aa, Borrelia Burgdorferi
AAGAVSAV

SEQ ID NO: 17401 - protein, 8 aa, Borrelia Burgdorferi
AGAVSAVS

SEQ ID NO: 17402 - protein, 8 aa, Borrelia Burgdorferi
GAVSAVSG

SEQ ID NO: 17403 - protein, 8 aa, Borrelia Burgdorferi
AVSAVSGE

SEQ ID NO: 17404 - protein, 8 aa, Borrelia Burgdorferi
VSAVSGEQ

SEQ ID NO: 17405 - protein, 8 aa, Borrelia Burgdorferi
SAVSGEQI

SEQ ID NO: 17406 - protein, 8 aa, Borrelia Burgdorferi
AVSGEQIL

SEQ ID NO: 17407 - protein, 8 aa, Borrelia Burgdorferi
VSGEQILS

SEQ ID NO: 17408 - protein, 8 aa, Borrelia Burgdorferi
SGEQILSA

SEQ ID NO: 17409 - protein, 8 aa, Borrelia Burgdorferi
GEQILSAI

SEQ ID NO: 17410 - protein, 8 aa, Borrelia Burgdorferi
EQILSAIV

SEQ ID NO: 17411 - protein, 8 aa, Borrelia Burgdorferi
QILSAIVT

SEQ ID NO: 17412 - protein, 8 aa, Borrelia Burgdorferi
ILSAIVTA

SEQ ID NO: 17413 - protein, 8 aa, Borrelia Burgdorferi
LSAIVTAA

SEQ ID NO: 17414 - protein, 8 aa, Borrelia Burgdorferi
SAIVTAAD

SEQ ID NO: 17415 - protein, 8 aa, Borrelia Burgdorferi
AIVTAADA

SEQ ID NO: 17416 - protein, 8 aa, Borrelia Burgdorferi
IVTAADAA

SEQ ID NO: 17417 - protein, 8 aa, Borrelia Burgdorferi
VTAADAAE

SEQ ID NO: 17418 - protein, 8 aa, Borrelia Burgdorferi
TAADAAEQ

SEQ ID NO: 17419 - protein, 8 aa, Borrelia Burgdorferi
AADAAEQD

SEQ ID NO: 17420 - protein, 8 aa, Borrelia Burgdorferi
ADAAEQDG

SEQ ID NO: 17421 - protein, 8 aa, Borrelia Burgdorferi
DAAEQDGK

SEQ ID NO: 17422 - protein, 8 aa, Borrelia Burgdorferi
AAEQDGKK

SEQ ID NO: 17423 - protein, 8 aa, Borrelia Burgdorferi
AEQDGKKP

SEQ ID NO: 17424 - protein, 8 aa, Borrelia Burgdorferi
EQDGKKPE

SEQ ID NO: 17425 - protein, 8 aa, Borrelia Burgdorferi
QDGKKPEE

SEQ ID NO: 17426 - protein, 8 aa, Borrelia Burgdorferi
DGKKPEEA

SEQ ID NO: 17427 - protein, 8 aa, Borrelia Burgdorferi
GKKPEEAK

SEQ ID NO: 17428 - protein, 8 aa, Borrelia Burgdorferi
KKPEEAKN

SEQ ID NO: 17429 - protein, 8 aa, Borrelia Burgdorferi
KPEEAKNP

SEQ ID NO: 17430 - protein, 8 aa, Borrelia Burgdorferi
PEEAKNPI

SEQ ID NO: 17431 - protein, 8 aa, Borrelia Burgdorferi
EEAKNPIA

SEQ ID NO: 17432 - protein, 8 aa, Borrelia Burgdorferi
EAKNPIAA

SEQ ID NO: 17433 - protein, 8 aa, Borrelia Burgdorferi
AKNPIAAA

SEQ ID NO: 17434 - protein, 8 aa, Borrelia Burgdorferi
KNPIAAAI

SEQ ID NO: 17435 - protein, 8 aa, Borrelia Burgdorferi
NPIAAAIG

SEQ ID NO: 17436 - protein, 8 aa, Borrelia Burgdorferi
PIAAAIGD

SEQ ID NO: 17437 - protein, 8 aa, Borrelia Burgdorferi
IAAAIGDK

SEQ ID NO: 17438 - protein, 8 aa, Borrelia Burgdorferi
AAAIGDKD

SEQ ID NO: 17439 - protein, 8 aa, Borrelia Burgdorferi
AAIGDKDG

SEQ ID NO: 17440 - protein, 8 aa, Borrelia Burgdorferi
AIGDKDGG

SEQ ID NO: 17441 - protein, 8 aa, Borrelia Burgdorferi
IGDKDGGA

SEQ ID NO: 17442 - protein, 8 aa, Borrelia Burgdorferi
GDKDGGAE

SEQ ID NO: 17443 - protein, 8 aa, Borrelia Burgdorferi
DKDGGAEF

SEQ ID NO: 17444 - protein, 8 aa, Borrelia Burgdorferi
KDGGAEFG

SEQ ID NO: 17445 - protein, 8 aa, Borrelia Burgdorferi
DGGAEFGQ

SEQ ID NO: 17446 - protein, 8 aa, Borrelia Burgdorferi
GGAEFGQD

SEQ ID NO: 17447 - protein, 8 aa, Borrelia Burgdorferi
GAEFGQDE

SEQ ID NO: 17448 - protein, 8 aa, Borrelia Burgdorferi
  VARIANT 8: Xaa = Any Amino Acid
AEFGQDEX

SEQ ID NO: 17449 - protein, 8 aa, Borrelia Burgdorferi
  Xaa can be any naturally occurring amino acid
  VARIANT 7: Xaa = Any Amino Acid
EFGQDEXK

SEQ ID NO: 17450 - protein, 8 aa, Borrelia Burgdorferi
  Xaa can be any naturally occurring amino acid
  VARIANT 6: Xaa = Any Amino Acid
FGQDEXKK

SEQ ID NO: 17451 - protein, 8 aa, Borrelia Burgdorferi
  Xaa can be any naturally occurring amino acid
  VARIANT 5: Xaa = Any Amino Acid
GQDEXKKD

SEQ ID NO: 17452 - protein, 8 aa, Borrelia Burgdorferi
  Xaa can be any naturally occurring amino acid
  VARIANT 4: Xaa = Any Amino Acid
QDEXKKDD

SEQ ID NO: 17453 - protein, 8 aa, Borrelia Burgdorferi
  Xaa can be any naturally occurring amino acid
  VARIANT 3: Xaa = Any Amino Acid
DEXKKDDQ

SEQ ID NO: 17454 - protein, 8 aa, Borrelia Burgdorferi
  Xaa can be any naturally occurring amino acid
  VARIANT 2: Xaa = Any Amino Acid
EXKKDDQI

SEQ ID NO: 17455 - protein, 8 aa, Borrelia Burgdorferi
  Xaa can be any naturally occurring amino acid
  VARIANT 1: Xaa = Any Amino Acid
XKKDDQIA

SEQ ID NO: 17456 - protein, 8 aa, Borrelia Burgdorferi
KKDDQIAA

SEQ ID NO: 17457 - protein, 8 aa, Borrelia Burgdorferi
KDDQIAAA

SEQ ID NO: 17458 - protein, 8 aa, Borrelia Burgdorferi
DDQIAAAI

SEQ ID NO: 17459 - protein, 8 aa, Borrelia Burgdorferi
DQIAAAIA

SEQ ID NO: 17460 - protein, 8 aa, Borrelia Burgdorferi
QIAAAIAL

SEQ ID NO: 17461 - protein, 8 aa, Borrelia Burgdorferi
IAAAIALR

SEQ ID NO: 17462 - protein, 8 aa, Borrelia Burgdorferi
AAAIALRG

SEQ ID NO: 17463 - protein, 8 aa, Borrelia Burgdorferi
  VARIANT 8: Xaa = Any Amino Acid
AAIALRGX

SEQ ID NO: 17464 - protein, 8 aa, Borrelia Burgdorferi
  Xaa can be any naturally occurring amino acid
  VARIANT 7: Xaa = Any Amino Acid
AIALRGXA

SEQ ID NO: 17465 - protein, 8 aa, Borrelia Burgdorferi
  Xaa can be any naturally occurring amino acid
  VARIANT 6: Xaa = Any Amino Acid
IALRGXAK

SEQ ID NO: 17466 - protein, 8 aa, Borrelia Burgdorferi
  Xaa can be any naturally occurring amino acid
  VARIANT 5: Xaa = Any Amino Acid
ALRGXAKD

SEQ ID NO: 17467 - protein, 8 aa, Borrelia Burgdorferi
  Xaa can be any naturally occurring amino acid
  VARIANT 4: Xaa = Any Amino Acid
LRGXAKDG

SEQ ID NO: 17468 - protein, 8 aa, Borrelia Burgdorferi
  Xaa can be any naturally occurring amino acid
  VARIANT 3: Xaa = Any Amino Acid
RGXAKDGK

SEQ ID NO: 17469 - protein, 8 aa, Borrelia Burgdorferi
  Xaa can be any naturally occurring amino acid
  VARIANT 2: Xaa = Any Amino Acid
GXAKDGKF

SEQ ID NO: 17470 - protein, 8 aa, Borrelia Burgdorferi
  Xaa can be any naturally occurring amino acid
  VARIANT 1: Xaa = Any Amino Acid
XAKDGKFA

SEQ ID NO: 17471 - protein, 8 aa, Borrelia Burgdorferi
AKDGKFAV

SEQ ID NO: 17472 - protein, 8 aa, Borrelia Burgdorferi
KDGKFAVK

SEQ ID NO: 17473 - protein, 8 aa, Borrelia Burgdorferi
DGKFAVKD

SEQ ID NO: 17474 - protein, 8 aa, Borrelia Burgdorferi
GKFAVKDG

SEQ ID NO: 17475 - protein, 8 aa, Borrelia Burgdorferi
KFAVKDGE

SEQ ID NO: 17476 - protein, 8 aa, Borrelia Burgdorferi
FAVKDGEK

SEQ ID NO: 17477 - protein, 8 aa, Borrelia Burgdorferi
AVKDGEKE

SEQ ID NO: 17478 - protein, 8 aa, Borrelia Burgdorferi
VKDGEKEK

SEQ ID NO: 17479 - protein, 8 aa, Borrelia Burgdorferi
KDGEKEKA

SEQ ID NO: 17480 - protein, 8 aa, Borrelia Burgdorferi
DGEKEKAE

SEQ ID NO: 17481 - protein, 8 aa, Borrelia Burgdorferi
GEKEKAEG

SEQ ID NO: 17482 - protein, 8 aa, Borrelia Burgdorferi
EKEKAEGA

SEQ ID NO: 17483 - protein, 8 aa, Borrelia Burgdorferi
KEKAEGAI

SEQ ID NO: 17484 - protein, 8 aa, Borrelia Burgdorferi
EKAEGAIK

SEQ ID NO: 17485 - protein, 8 aa, Borrelia Burgdorferi
KAEGAIKG

SEQ ID NO: 17486 - protein, 8 aa, Borrelia Burgdorferi
AEGAIKGA

SEQ ID NO: 17487 - protein, 8 aa, Borrelia Burgdorferi
EGAIKGAA

SEQ ID NO: 17488 - protein, 8 aa, Borrelia Burgdorferi
GAIKGAAE

SEQ ID NO: 17489 - protein, 8 aa, Borrelia Burgdorferi
AIKGAAES

SEQ ID NO: 17490 - protein, 8 aa, Borrelia Burgdorferi
IKGAAESA

SEQ ID NO: 17491 - protein, 8 aa, Borrelia Burgdorferi
KGAAESAV

SEQ ID NO: 17492 - protein, 8 aa, Borrelia Burgdorferi
GAAESAVR

SEQ ID NO: 17493 - protein, 8 aa, Borrelia Burgdorferi
AAESAVRK

SEQ ID NO: 17494 - protein, 8 aa, Borrelia Burgdorferi
AESAVRKV

SEQ ID NO: 17495 - protein, 8 aa, Borrelia Burgdorferi
ESAVRKVL

SEQ ID NO: 17496 - protein, 8 aa, Borrelia Burgdorferi
SAVRKVLG

SEQ ID NO: 17497 - protein, 8 aa, Borrelia Burgdorferi
AVRKVLGA

SEQ ID NO: 17498 - protein, 8 aa, Borrelia Burgdorferi
VRKVLGAI

SEQ ID NO: 17499 - protein, 8 aa, Borrelia Burgdorferi
RKVLGAIT

SEQ ID NO: 17500 - protein, 8 aa, Borrelia Burgdorferi
KVLGAITG

SEQ ID NO: 17501 - protein, 8 aa, Borrelia Burgdorferi
VLGAITGL

SEQ ID NO: 17502 - protein, 8 aa, Borrelia Burgdorferi
LGAITGLI

SEQ ID NO: 17503 - protein, 8 aa, Borrelia Burgdorferi
GAITGLIG

SEQ ID NO: 17504 - protein, 8 aa, Borrelia Burgdorferi
AITGLIGD

SEQ ID NO: 17505 - protein, 8 aa, Borrelia Burgdorferi
ITGLIGDA

SEQ ID NO: 17506 - protein, 8 aa, Borrelia Burgdorferi
TGLIGDAV

SEQ ID NO: 17507 - protein, 8 aa, Borrelia Burgdorferi
GLIGDAVS

SEQ ID NO: 17508 - protein, 8 aa, Borrelia Burgdorferi
LIGDAVSS

SEQ ID NO: 17509 - protein, 8 aa, Borrelia Burgdorferi
IGDAVSSG

SEQ ID NO: 17510 - protein, 8 aa, Borrelia Burgdorferi
GDAVSSGL

SEQ ID NO: 17511 - protein, 8 aa, Borrelia Burgdorferi
DAVSSGLR

SEQ ID NO: 17512 - protein, 8 aa, Borrelia Burgdorferi
AVSSGLRK

SEQ ID NO: 17513 - protein, 8 aa, Borrelia Burgdorferi
VSSGLRKV

SEQ ID NO: 17514 - protein, 8 aa, Borrelia Burgdorferi
SSGLRKVG

SEQ ID NO: 17515 - protein, 8 aa, Borrelia Burgdorferi
SGLRKVGD

SEQ ID NO: 17516 - protein, 8 aa, Borrelia Burgdorferi
GLRKVGDS

SEQ ID NO: 17517 - protein, 8 aa, Borrelia Burgdorferi
LRKVGDSV

SEQ ID NO: 17518 - protein, 8 aa, Borrelia Burgdorferi
RKVGDSVK

SEQ ID NO: 17519 - protein, 8 aa, Borrelia Burgdorferi
KVGDSVKA

SEQ ID NO: 17520 - protein, 8 aa, Borrelia Burgdorferi
VGDSVKAA

SEQ ID NO: 17521 - protein, 8 aa, Borrelia Burgdorferi
GDSVKAAS

SEQ ID NO: 17522 - protein, 8 aa, Borrelia Burgdorferi
DSVKAASK

SEQ ID NO: 17523 - protein, 8 aa, Borrelia Burgdorferi
SVKAASKE

SEQ ID NO: 17524 - protein, 8 aa, Borrelia Burgdorferi
VKAASKET

SEQ ID NO: 17525 - protein, 8 aa, Borrelia Burgdorferi
KAASKETP

SEQ ID NO: 17526 - protein, 8 aa, Borrelia Burgdorferi
AASKETPP

SEQ ID NO: 17527 - protein, 8 aa, Borrelia Burgdorferi
ASKETPPA

SEQ ID NO: 17528 - protein, 8 aa, Borrelia Burgdorferi
SKETPPAL

SEQ ID NO: 17529 - protein, 8 aa, Borrelia Burgdorferi
KETPPALN

SEQ ID NO: 17530 - protein, 8 aa, Borrelia Burgdorferi
ETPPALNK

SEQ ID NO: 17531 - protein, 9 aa, Borrelia Burgdorferi
MRGSHHHHH

SEQ ID NO: 17532 - protein, 9 aa, Borrelia Burgdorferi
RGSHHHHHH

SEQ ID NO: 17533 - protein, 9 aa, Borrelia Burgdorferi
GSHHHHHHG

SEQ ID NO: 17534 - protein, 9 aa, Borrelia Burgdorferi
SHHHHHHGS

SEQ ID NO: 17535 - protein, 9 aa, Borrelia Burgdorferi
HHHHHHGSS

SEQ ID NO: 17536 - protein, 9 aa, Borrelia Burgdorferi
HHHHHGSSQ

SEQ ID NO: 17537 - protein, 9 aa, Borrelia Burgdorferi
HHHHGSSQV

SEQ ID NO: 17538 - protein, 9 aa, Borrelia Burgdorferi
HHHGSSQVA

SEQ ID NO: 17539 - protein, 9 aa, Borrelia Burgdorferi
HHGSSQVAD

SEQ ID NO: 17540 - protein, 9 aa, Borrelia Burgdorferi
HGSSQVADK

SEQ ID NO: 17541 - protein, 9 aa, Borrelia Burgdorferi
GSSQVADKD

SEQ ID NO: 17542 - protein, 9 aa, Borrelia Burgdorferi
SSQVADKDD

SEQ ID NO: 17543 - protein, 9 aa, Borrelia Burgdorferi
SQVADKDDP

SEQ ID NO: 17544 - protein, 9 aa, Borrelia Burgdorferi
QVADKDDPT

SEQ ID NO: 17545 - protein, 9 aa, Borrelia Burgdorferi
VADKDDPTN

SEQ ID NO: 17546 - protein, 9 aa, Borrelia Burgdorferi
ADKDDPTNK

SEQ ID NO: 17547 - protein, 9 aa, Borrelia Burgdorferi
DKDDPTNKF

SEQ ID NO: 17548 - protein, 9 aa, Borrelia Burgdorferi
KDDPTNKFY

SEQ ID NO: 17549 - protein, 9 aa, Borrelia Burgdorferi
DDPTNKFYQ

SEQ ID NO: 17550 - protein, 9 aa, Borrelia Burgdorferi
DPTNKFYQS

SEQ ID NO: 17551 - protein, 9 aa, Borrelia Burgdorferi
PTNKFYQSV

SEQ ID NO: 17552 - protein, 9 aa, Borrelia Burgdorferi
TNKFYQSVI

SEQ ID NO: 17553 - protein, 9 aa, Borrelia Burgdorferi
NKFYQSVIQ

SEQ ID NO: 17554 - protein, 9 aa, Borrelia Burgdorferi
KFYQSVIQL

SEQ ID NO: 17555 - protein, 9 aa, Borrelia Burgdorferi
FYQSVIQLG

SEQ ID NO: 17556 - protein, 9 aa, Borrelia Burgdorferi
YQSVIQLGN

SEQ ID NO: 17557 - protein, 9 aa, Borrelia Burgdorferi
QSVIQLGNG

SEQ ID NO: 17558 - protein, 9 aa, Borrelia Burgdorferi
SVIQLGNGF

SEQ ID NO: 17559 - protein, 9 aa, Borrelia Burgdorferi
VIQLGNGFL

SEQ ID NO: 17560 - protein, 9 aa, Borrelia Burgdorferi
IQLGNGFLD

SEQ ID NO: 17561 - protein, 9 aa, Borrelia Burgdorferi
QLGNGFLDV

SEQ ID NO: 17562 - protein, 9 aa, Borrelia Burgdorferi
LGNGFLDVF

SEQ ID NO: 17563 - protein, 9 aa, Borrelia Burgdorferi
GNGFLDVFT

SEQ ID NO: 17564 - protein, 9 aa, Borrelia Burgdorferi
NGFLDVFTS

SEQ ID NO: 17565 - protein, 9 aa, Borrelia Burgdorferi
GFLDVFTSF

SEQ ID NO: 17566 - protein, 9 aa, Borrelia Burgdorferi
FLDVFTSFG

SEQ ID NO: 17567 - protein, 9 aa, Borrelia Burgdorferi
LDVFTSFGG

SEQ ID NO: 17568 - protein, 9 aa, Borrelia Burgdorferi
DVFTSFGGL

SEQ ID NO: 17569 - protein, 9 aa, Borrelia Burgdorferi
VFTSFGGLV

SEQ ID NO: 17570 - protein, 9 aa, Borrelia Burgdorferi
FTSFGGLVA

SEQ ID NO: 17571 - protein, 9 aa, Borrelia Burgdorferi
TSFGGLVAE

SEQ ID NO: 17572 - protein, 9 aa, Borrelia Burgdorferi
SFGGLVAEA

SEQ ID NO: 17573 - protein, 9 aa, Borrelia Burgdorferi
FGGLVAEAF

SEQ ID NO: 17574 - protein, 9 aa, Borrelia Burgdorferi
GGLVAEAFG

SEQ ID NO: 17575 - protein, 9 aa, Borrelia Burgdorferi
GLVAEAFGF

SEQ ID NO: 17576 - protein, 9 aa, Borrelia Burgdorferi
LVAEAFGFK

SEQ ID NO: 17577 - protein, 9 aa, Borrelia Burgdorferi
VAEAFGFKS

SEQ ID NO: 17578 - protein, 9 aa, Borrelia Burgdorferi
AEAFGFKSD

SEQ ID NO: 17579 - protein, 9 aa, Borrelia Burgdorferi
EAFGFKSDP

SEQ ID NO: 17580 - protein, 9 aa, Borrelia Burgdorferi
AFGFKSDPK

SEQ ID NO: 17581 - protein, 9 aa, Borrelia Burgdorferi
FGFKSDPKK

SEQ ID NO: 17582 - protein, 9 aa, Borrelia Burgdorferi
GFKSDPKKS

SEQ ID NO: 17583 - protein, 9 aa, Borrelia Burgdorferi
FKSDPKKSD

SEQ ID NO: 17584 - protein, 9 aa, Borrelia Burgdorferi
KSDPKKSDV

SEQ ID NO: 17585 - protein, 9 aa, Borrelia Burgdorferi
SDPKKSDVK

SEQ ID NO: 17586 - protein, 9 aa, Borrelia Burgdorferi
DPKKSDVKT

SEQ ID NO: 17587 - protein, 9 aa, Borrelia Burgdorferi
PKKSDVKTY

SEQ ID NO: 17588 - protein, 9 aa, Borrelia Burgdorferi
KKSDVKTYF

SEQ ID NO: 17589 - protein, 9 aa, Borrelia Burgdorferi
KSDVKTYFT

SEQ ID NO: 17590 - protein, 9 aa, Borrelia Burgdorferi
SDVKTYFTT

SEQ ID NO: 17591 - protein, 9 aa, Borrelia Burgdorferi
DVKTYFTTV

SEQ ID NO: 17592 - protein, 9 aa, Borrelia Burgdorferi
VKTYFTTVA

SEQ ID NO: 17593 - protein, 9 aa, Borrelia Burgdorferi
KTYFTTVAA

SEQ ID NO: 17594 - protein, 9 aa, Borrelia Burgdorferi
TYFTTVAAK

SEQ ID NO: 17595 - protein, 9 aa, Borrelia Burgdorferi
YFTTVAAKL

SEQ ID NO: 17596 - protein, 9 aa, Borrelia Burgdorferi
FTTVAAKLE

SEQ ID NO: 17597 - protein, 9 aa, Borrelia Burgdorferi
TTVAAKLEK

SEQ ID NO: 17598 - protein, 9 aa, Borrelia Burgdorferi
TVAAKLEKT

SEQ ID NO: 17599 - protein, 9 aa, Borrelia Burgdorferi
VAAKLEKTK

SEQ ID NO: 17600 - protein, 9 aa, Borrelia Burgdorferi
AAKLEKTKT

SEQ ID NO: 17601 - protein, 9 aa, Borrelia Burgdorferi
AKLEKTKTD

SEQ ID NO: 17602 - protein, 9 aa, Borrelia Burgdorferi
KLEKTKTDL

SEQ ID NO: 17603 - protein, 9 aa, Borrelia Burgdorferi
LEKTKTDLN

SEQ ID NO: 17604 - protein, 9 aa, Borrelia Burgdorferi
EKTKTDLNS

SEQ ID NO: 17605 - protein, 9 aa, Borrelia Burgdorferi
KTKTDLNSL

SEQ ID NO: 17606 - protein, 9 aa, Borrelia Burgdorferi
TKTDLNSLP

SEQ ID NO: 17607 - protein, 9 aa, Borrelia Burgdorferi
KTDLNSLPK

SEQ ID NO: 17608 - protein, 9 aa, Borrelia Burgdorferi
TDLNSLPKE

SEQ ID NO: 17609 - protein, 9 aa, Borrelia Burgdorferi
DLNSLPKEK

SEQ ID NO: 17610 - protein, 9 aa, Borrelia Burgdorferi
LNSLPKEKS

SEQ ID NO: 17611 - protein, 9 aa, Borrelia Burgdorferi
NSLPKEKSD

SEQ ID NO: 17612 - protein, 9 aa, Borrelia Burgdorferi
SLPKEKSDI

SEQ ID NO: 17613 - protein, 9 aa, Borrelia Burgdorferi
LPKEKSDIS

SEQ ID NO: 17614 - protein, 9 aa, Borrelia Burgdorferi
PKEKSDISS

SEQ ID NO: 17615 - protein, 9 aa, Borrelia Burgdorferi
KEKSDISST

SEQ ID NO: 17616 - protein, 9 aa, Borrelia Burgdorferi
EKSDISSTT

SEQ ID NO: 17617 - protein, 9 aa, Borrelia Burgdorferi
KSDISSTTG

SEQ ID NO: 17618 - protein, 9 aa, Borrelia Burgdorferi
SDISSTTGK

SEQ ID NO: 17619 - protein, 9 aa, Borrelia Burgdorferi
DISSTTGKP

SEQ ID NO: 17620 - protein, 9 aa, Borrelia Burgdorferi
ISSTTGKPD

SEQ ID NO: 17621 - protein, 9 aa, Borrelia Burgdorferi
SSTTGKPDS

SEQ ID NO: 17622 - protein, 9 aa, Borrelia Burgdorferi
STTGKPDST

SEQ ID NO: 17623 - protein, 9 aa, Borrelia Burgdorferi
TTGKPDSTG

SEQ ID NO: 17624 - protein, 9 aa, Borrelia Burgdorferi
TGKPDSTGS

SEQ ID NO: 17625 - protein, 9 aa, Borrelia Burgdorferi
GKPDSTGSV

SEQ ID NO: 17626 - protein, 9 aa, Borrelia Burgdorferi
KPDSTGSVG

SEQ ID NO: 17627 - protein, 9 aa, Borrelia Burgdorferi
PDSTGSVGT

SEQ ID NO: 17628 - protein, 9 aa, Borrelia Burgdorferi
DSTGSVGTA

SEQ ID NO: 17629 - protein, 9 aa, Borrelia Burgdorferi
STGSVGTAV

SEQ ID NO: 17630 - protein, 9 aa, Borrelia Burgdorferi
TGSVGTAVE

SEQ ID NO: 17631 - protein, 9 aa, Borrelia Burgdorferi
GSVGTAVEG

SEQ ID NO: 17632 - protein, 9 aa, Borrelia Burgdorferi
SVGTAVEGA

SEQ ID NO: 17633 - protein, 9 aa, Borrelia Burgdorferi
VGTAVEGAI

SEQ ID NO: 17634 - protein, 9 aa, Borrelia Burgdorferi
GTAVEGAIK

SEQ ID NO: 17635 - protein, 9 aa, Borrelia Burgdorferi
TAVEGAIKE

SEQ ID NO: 17636 - protein, 9 aa, Borrelia Burgdorferi
AVEGAIKEV

SEQ ID NO: 17637 - protein, 9 aa, Borrelia Burgdorferi
VEGAIKEVS

SEQ ID NO: 17638 - protein, 9 aa, Borrelia Burgdorferi
EGAIKEVSE

SEQ ID NO: 17639 - protein, 9 aa, Borrelia Burgdorferi
GAIKEVSEL

SEQ ID NO: 17640 - protein, 9 aa, Borrelia Burgdorferi
AIKEVSELL

SEQ ID NO: 17641 - protein, 9 aa, Borrelia Burgdorferi
IKEVSELLD

SEQ ID NO: 17642 - protein, 9 aa, Borrelia Burgdorferi
KEVSELLDK

SEQ ID NO: 17643 - protein, 9 aa, Borrelia Burgdorferi
EVSELLDKL

SEQ ID NO: 17644 - protein, 9 aa, Borrelia Burgdorferi
VSELLDKLV

SEQ ID NO: 17645 - protein, 9 aa, Borrelia Burgdorferi
SELLDKLVK

SEQ ID NO: 17646 - protein, 9 aa, Borrelia Burgdorferi
ELLDKLVKA

SEQ ID NO: 17647 - protein, 9 aa, Borrelia Burgdorferi
LLDKLVKAV

SEQ ID NO: 17648 - protein, 9 aa, Borrelia Burgdorferi
LDKLVKAVK

SEQ ID NO: 17649 - protein, 9 aa, Borrelia Burgdorferi
DKLVKAVKT

SEQ ID NO: 17650 - protein, 9 aa, Borrelia Burgdorferi
KLVKAVKTA

SEQ ID NO: 17651 - protein, 9 aa, Borrelia Burgdorferi
LVKAVKTAE

SEQ ID NO: 17652 - protein, 9 aa, Borrelia Burgdorferi
VKAVKTAEG

SEQ ID NO: 17653 - protein, 9 aa, Borrelia Burgdorferi
KAVKTAEGA

SEQ ID NO: 17654 - protein, 9 aa, Borrelia Burgdorferi
AVKTAEGAS

SEQ ID NO: 17655 - protein, 9 aa, Borrelia Burgdorferi
VKTAEGASS

SEQ ID NO: 17656 - protein, 9 aa, Borrelia Burgdorferi
KTAEGASSG

SEQ ID NO: 17657 - protein, 9 aa, Borrelia Burgdorferi
TAEGASSGT

SEQ ID NO: 17658 - protein, 9 aa, Borrelia Burgdorferi
AEGASSGTA

SEQ ID NO: 17659 - protein, 9 aa, Borrelia Burgdorferi
EGASSGTAA

SEQ ID NO: 17660 - protein, 9 aa, Borrelia Burgdorferi
GASSGTAAI

SEQ ID NO: 17661 - protein, 9 aa, Borrelia Burgdorferi
ASSGTAAIG

SEQ ID NO: 17662 - protein, 9 aa, Borrelia Burgdorferi
SSGTAAIGE

SEQ ID NO: 17663 - protein, 9 aa, Borrelia Burgdorferi
SGTAAIGEV

SEQ ID NO: 17664 - protein, 9 aa, Borrelia Burgdorferi
GTAAIGEVV

SEQ ID NO: 17665 - protein, 9 aa, Borrelia Burgdorferi
TAAIGEVVA

SEQ ID NO: 17666 - protein, 9 aa, Borrelia Burgdorferi
AAIGEVVAD

SEQ ID NO: 17667 - protein, 9 aa, Borrelia Burgdorferi
AIGEVVADA

SEQ ID NO: 17668 - protein, 9 aa, Borrelia Burgdorferi
IGEVVADAD

SEQ ID NO: 17669 - protein, 9 aa, Borrelia Burgdorferi
GEVVADADA

SEQ ID NO: 17670 - protein, 9 aa, Borrelia Burgdorferi
EVVADADAA

SEQ ID NO: 17671 - protein, 9 aa, Borrelia Burgdorferi
VVADADAAK

SEQ ID NO: 17672 - protein, 9 aa, Borrelia Burgdorferi
VADADAAKV

SEQ ID NO: 17673 - protein, 9 aa, Borrelia Burgdorferi
ADADAAKVA

SEQ ID NO: 17674 - protein, 9 aa, Borrelia Burgdorferi
DADAAKVAD

SEQ ID NO: 17675 - protein, 9 aa, Borrelia Burgdorferi
ADAAKVADK

SEQ ID NO: 17676 - protein, 9 aa, Borrelia Burgdorferi
DAAKVADKA

SEQ ID NO: 17677 - protein, 9 aa, Borrelia Burgdorferi
AAKVADKAS

SEQ ID NO: 17678 - protein, 9 aa, Borrelia Burgdorferi
AKVADKASV

SEQ ID NO: 17679 - protein, 9 aa, Borrelia Burgdorferi
KVADKASVK

SEQ ID NO: 17680 - protein, 9 aa, Borrelia Burgdorferi
VADKASVKG

SEQ ID NO: 17681 - protein, 9 aa, Borrelia Burgdorferi
ADKASVKGI

SEQ ID NO: 17682 - protein, 9 aa, Borrelia Burgdorferi
DKASVKGIA

SEQ ID NO: 17683 - protein, 9 aa, Borrelia Burgdorferi
KASVKGIAK

SEQ ID NO: 17684 - protein, 9 aa, Borrelia Burgdorferi
ASVKGIAKG

SEQ ID NO: 17685 - protein, 9 aa, Borrelia Burgdorferi
SVKGIAKGI

SEQ ID NO: 17686 - protein, 9 aa, Borrelia Burgdorferi
VKGIAKGIK

SEQ ID NO: 17687 - protein, 9 aa, Borrelia Burgdorferi
KGIAKGIKE

SEQ ID NO: 17688 - protein, 9 aa, Borrelia Burgdorferi
GIAKGIKEI

SEQ ID NO: 17689 - protein, 9 aa, Borrelia Burgdorferi
IAKGIKEIV

SEQ ID NO: 17690 - protein, 9 aa, Borrelia Burgdorferi
AKGIKEIVE

SEQ ID NO: 17691 - protein, 9 aa, Borrelia Burgdorferi
KGIKEIVEA

SEQ ID NO: 17692 - protein, 9 aa, Borrelia Burgdorferi
GIKEIVEAA

SEQ ID NO: 17693 - protein, 9 aa, Borrelia Burgdorferi
IKEIVEAAG

SEQ ID NO: 17694 - protein, 9 aa, Borrelia Burgdorferi
KEIVEAAGG

SEQ ID NO: 17695 - protein, 9 aa, Borrelia Burgdorferi
EIVEAAGGS

SEQ ID NO: 17696 - protein, 9 aa, Borrelia Burgdorferi
IVEAAGGSE

SEQ ID NO: 17697 - protein, 9 aa, Borrelia Burgdorferi
VEAAGGSEK

SEQ ID NO: 17698 - protein, 9 aa, Borrelia Burgdorferi
EAAGGSEKL

SEQ ID NO: 17699 - protein, 9 aa, Borrelia Burgdorferi
AAGGSEKLK

SEQ ID NO: 17700 - protein, 9 aa, Borrelia Burgdorferi
AGGSEKLKA

SEQ ID NO: 17701 - protein, 9 aa, Borrelia Burgdorferi
GGSEKLKAV

SEQ ID NO: 17702 - protein, 9 aa, Borrelia Burgdorferi
GSEKLKAVA

SEQ ID NO: 17703 - protein, 9 aa, Borrelia Burgdorferi
SEKLKAVAA

SEQ ID NO: 17704 - protein, 9 aa, Borrelia Burgdorferi
EKLKAVAAA

SEQ ID NO: 17705 - protein, 9 aa, Borrelia Burgdorferi
KLKAVAAAK

SEQ ID NO: 17706 - protein, 9 aa, Borrelia Burgdorferi
LKAVAAAKG

SEQ ID NO: 17707 - protein, 9 aa, Borrelia Burgdorferi
KAVAAAKGE

SEQ ID NO: 17708 - protein, 9 aa, Borrelia Burgdorferi
AVAAAKGEN

SEQ ID NO: 17709 - protein, 9 aa, Borrelia Burgdorferi
VAAAKGENN

SEQ ID NO: 17710 - protein, 9 aa, Borrelia Burgdorferi
AAAKGENNK

SEQ ID NO: 17711 - protein, 9 aa, Borrelia Burgdorferi
AAKGENNKG

SEQ ID NO: 17712 - protein, 9 aa, Borrelia Burgdorferi
AKGENNKGA

SEQ ID NO: 17713 - protein, 9 aa, Borrelia Burgdorferi
KGENNKGAG

SEQ ID NO: 17714 - protein, 9 aa, Borrelia Burgdorferi
GENNKGAGK

SEQ ID NO: 17715 - protein, 9 aa, Borrelia Burgdorferi
ENNKGAGKL

SEQ ID NO: 17716 - protein, 9 aa, Borrelia Burgdorferi
NNKGAGKLF

SEQ ID NO: 17717 - protein, 9 aa, Borrelia Burgdorferi
NKGAGKLFG

SEQ ID NO: 17718 - protein, 9 aa, Borrelia Burgdorferi
KGAGKLFGK

SEQ ID NO: 17719 - protein, 9 aa, Borrelia Burgdorferi
GAGKLFGKA

SEQ ID NO: 17720 - protein, 9 aa, Borrelia Burgdorferi
AGKLFGKAG

SEQ ID NO: 17721 - protein, 9 aa, Borrelia Burgdorferi
GKLFGKAGA

SEQ ID NO: 17722 - protein, 9 aa, Borrelia Burgdorferi
KLFGKAGAA

SEQ ID NO: 17723 - protein, 9 aa, Borrelia Burgdorferi
LFGKAGAAA

SEQ ID NO: 17724 - protein, 9 aa, Borrelia Burgdorferi
FGKAGAAAH

SEQ ID NO: 17725 - protein, 9 aa, Borrelia Burgdorferi
GKAGAAAHG

SEQ ID NO: 17726 - protein, 9 aa, Borrelia Burgdorferi
KAGAAAHGD

SEQ ID NO: 17727 - protein, 9 aa, Borrelia Burgdorferi
AGAAAHGDS

SEQ ID NO: 17728 - protein, 9 aa, Borrelia Burgdorferi
GAAAHGDSE

SEQ ID NO: 17729 - protein, 9 aa, Borrelia Burgdorferi
AAAHGDSEA

SEQ ID NO: 17730 - protein, 9 aa, Borrelia Burgdorferi
AAHGDSEAA

SEQ ID NO: 17731 - protein, 9 aa, Borrelia Burgdorferi
AHGDSEAAS

SEQ ID NO: 17732 - protein, 9 aa, Borrelia Burgdorferi
HGDSEAASK

SEQ ID NO: 17733 - protein, 9 aa, Borrelia Burgdorferi
GDSEAASKA

SEQ ID NO: 17734 - protein, 9 aa, Borrelia Burgdorferi
DSEAASKAA

SEQ ID NO: 17735 - protein, 9 aa, Borrelia Burgdorferi
SEAASKAAG

SEQ ID NO: 17736 - protein, 9 aa, Borrelia Burgdorferi
EAASKAAGA

SEQ ID NO: 17737 - protein, 9 aa, Borrelia Burgdorferi
AASKAAGAV

SEQ ID NO: 17738 - protein, 9 aa, Borrelia Burgdorferi
ASKAAGAVS

SEQ ID NO: 17739 - protein, 9 aa, Borrelia Burgdorferi
SKAAGAVSA

SEQ ID NO: 17740 - protein, 9 aa, Borrelia Burgdorferi
KAAGAVSAV

SEQ ID NO: 17741 - protein, 9 aa, Borrelia Burgdorferi
AAGAVSAVS

SEQ ID NO: 17742 - protein, 9 aa, Borrelia Burgdorferi
AGAVSAVSG

SEQ ID NO: 17743 - protein, 9 aa, Borrelia Burgdorferi
GAVSAVSGE

SEQ ID NO: 17744 - protein, 9 aa, Borrelia Burgdorferi
AVSAVSGEQ

SEQ ID NO: 17745 - protein, 9 aa, Borrelia Burgdorferi
VSAVSGEQI

SEQ ID NO: 17746 - protein, 9 aa, Borrelia Burgdorferi
SAVSGEQIL

SEQ ID NO: 17747 - protein, 9 aa, Borrelia Burgdorferi
AVSGEQILS

SEQ ID NO: 17748 - protein, 9 aa, Borrelia Burgdorferi
VSGEQILSA

SEQ ID NO: 17749 - protein, 9 aa, Borrelia Burgdorferi
SGEQILSAI

SEQ ID NO: 17750 - protein, 9 aa, Borrelia Burgdorferi
GEQILSAIV

SEQ ID NO: 17751 - protein, 9 aa, Borrelia Burgdorferi
EQILSAIVT

SEQ ID NO: 17752 - protein, 9 aa, Borrelia Burgdorferi
QILSAIVTA

SEQ ID NO: 17753 - protein, 9 aa, Borrelia Burgdorferi
ILSAIVTAA

SEQ ID NO: 17754 - protein, 9 aa, Borrelia Burgdorferi
LSAIVTAAD

SEQ ID NO: 17755 - protein, 9 aa, Borrelia Burgdorferi
SAIVTAADA

SEQ ID NO: 17756 - protein, 9 aa, Borrelia Burgdorferi
AIVTAADAA

SEQ ID NO: 17757 - protein, 9 aa, Borrelia Burgdorferi
IVTAADAAE

SEQ ID NO: 17758 - protein, 9 aa, Borrelia Burgdorferi
VTAADAAEQ

SEQ ID NO: 17759 - protein, 9 aa, Borrelia Burgdorferi
TAADAAEQD

SEQ ID NO: 17760 - protein, 9 aa, Borrelia Burgdorferi
AADAAEQDG

SEQ ID NO: 17761 - protein, 9 aa, Borrelia Burgdorferi
ADAAEQDGK

SEQ ID NO: 17762 - protein, 9 aa, Borrelia Burgdorferi
DAAEQDGKK

SEQ ID NO: 17763 - protein, 9 aa, Borrelia Burgdorferi
AAEQDGKKP

SEQ ID NO: 17764 - protein, 9 aa, Borrelia Burgdorferi
AEQDGKKPE

SEQ ID NO: 17765 - protein, 9 aa, Borrelia Burgdorferi
EQDGKKPEE

SEQ ID NO: 17766 - protein, 9 aa, Borrelia Burgdorferi
QDGKKPEEA

SEQ ID NO: 17767 - protein, 9 aa, Borrelia Burgdorferi
DGKKPEEAK

SEQ ID NO: 17768 - protein, 9 aa, Borrelia Burgdorferi
GKKPEEAKN

SEQ ID NO: 17769 - protein, 9 aa, Borrelia Burgdorferi
KKPEEAKNP

SEQ ID NO: 17770 - protein, 9 aa, Borrelia Burgdorferi
KPEEAKNPI

SEQ ID NO: 17771 - protein, 9 aa, Borrelia Burgdorferi
PEEAKNPIA

SEQ ID NO: 17772 - protein, 9 aa, Borrelia Burgdorferi
EEAKNPIAA

SEQ ID NO: 17773 - protein, 9 aa, Borrelia Burgdorferi
EAKNPIAAA

SEQ ID NO: 17774 - protein, 9 aa, Borrelia Burgdorferi
AKNPIAAAI

SEQ ID NO: 17775 - protein, 9 aa, Borrelia Burgdorferi
KNPIAAAIG

SEQ ID NO: 17776 - protein, 9 aa, Borrelia Burgdorferi
NPIAAAIGD

SEQ ID NO: 17777 - protein, 9 aa, Borrelia Burgdorferi
PIAAAIGDK

SEQ ID NO: 17778 - protein, 9 aa, Borrelia Burgdorferi
IAAAIGDKD

SEQ ID NO: 17779 - protein, 9 aa, Borrelia Burgdorferi
AAAIGDKDG

SEQ ID NO: 17780 - protein, 9 aa, Borrelia Burgdorferi
AAIGDKDGG

SEQ ID NO: 17781 - protein, 9 aa, Borrelia Burgdorferi
AIGDKDGGA

SEQ ID NO: 17782 - protein, 9 aa, Borrelia Burgdorferi
IGDKDGGAE

SEQ ID NO: 17783 - protein, 9 aa, Borrelia Burgdorferi
GDKDGGAEF

SEQ ID NO: 17784 - protein, 9 aa, Borrelia Burgdorferi
DKDGGAEFG

SEQ ID NO: 17785 - protein, 9 aa, Borrelia Burgdorferi
KDGGAEFGQ

SEQ ID NO: 17786 - protein, 9 aa, Borrelia Burgdorferi
DGGAEFGQD

SEQ ID NO: 17787 - protein, 9 aa, Borrelia Burgdorferi
GGAEFGQDE

SEQ ID NO: 17788 - protein, 9 aa, Borrelia Burgdorferi
  VARIANT 9: Xaa = Any Amino Acid
GAEFGQDEX

SEQ ID NO: 17789 - protein, 9 aa, Borrelia Burgdorferi
  Xaa can be any naturally occurring amino acid
  VARIANT 8: Xaa = Any Amino Acid
AEFGQDEXK

SEQ ID NO: 17790 - protein, 9 aa, Borrelia Burgdorferi
  Xaa can be any naturally occurring amino acid
  VARIANT 7: Xaa = Any Amino Acid
EFGQDEXKK

SEQ ID NO: 17791 - protein, 9 aa, Borrelia Burgdorferi
  Xaa can be any naturally occurring amino acid
  VARIANT 6: Xaa = Any Amino Acid
FGQDEXKKD

SEQ ID NO: 17792 - protein, 9 aa, Borrelia Burgdorferi
  Xaa can be any naturally occurring amino acid
  VARIANT 5: Xaa = Any Amino Acid
GQDEXKKDD

SEQ ID NO: 17793 - protein, 9 aa, Borrelia Burgdorferi
  Xaa can be any naturally occurring amino acid
  VARIANT 4: Xaa = Any Amino Acid
QDEXKKDDQ

SEQ ID NO: 17794 - protein, 9 aa, Borrelia Burgdorferi
  Xaa can be any naturally occurring amino acid
  VARIANT 3: Xaa = Any Amino Acid
DEXKKDDQI

SEQ ID NO: 17795 - protein, 9 aa, Borrelia Burgdorferi
  Xaa can be any naturally occurring amino acid
  VARIANT 2: Xaa = Any Amino Acid
EXKKDDQIA

SEQ ID NO: 17796 - protein, 9 aa, Borrelia Burgdorferi
  Xaa can be any naturally occurring amino acid
  VARIANT 1: Xaa = Any Amino Acid
XKKDDQIAA

SEQ ID NO: 17797 - protein, 9 aa, Borrelia Burgdorferi
KKDDQIAAA

SEQ ID NO: 17798 - protein, 9 aa, Borrelia Burgdorferi
KDDQIAAAI

SEQ ID NO: 17799 - protein, 9 aa, Borrelia Burgdorferi
DDQIAAAIA

SEQ ID NO: 17800 - protein, 9 aa, Borrelia Burgdorferi
DQIAAAIAL

SEQ ID NO: 17801 - protein, 9 aa, Borrelia Burgdorferi
QIAAAIALR

SEQ ID NO: 17802 - protein, 9 aa, Borrelia Burgdorferi
IAAAIALRG

SEQ ID NO: 17803 - protein, 9 aa, Borrelia Burgdorferi
  Xaa can be any naturally occurring amino acid
  VARIANT 9: Xaa = Any Amino Acid
AAAIALRGX

SEQ ID NO: 17804 - protein, 9 aa, Borrelia Burgdorferi
  Xaa can be any naturally occurring amino acid
  VARIANT 8: Xaa = Any Amino Acid
AAIALRGXA

SEQ ID NO: 17805 - protein, 9 aa, Borrelia Burgdorferi
  Xaa can be any naturally occurring amino acid
  VARIANT 7: Xaa = Any Amino Acid
AIALRGXAK

SEQ ID NO: 17806 - protein, 9 aa, Borrelia Burgdorferi
  Xaa can be any naturally occurring amino acid
  VARIANT 6: Xaa = Any Amino Acid
IALRGXAKD

SEQ ID NO: 17807 - protein, 9 aa, Borrelia Burgdorferi
  Xaa can be any naturally occurring amino acid
  VARIANT 5: Xaa = Any Amino Acid
ALRGXAKDG

SEQ ID NO: 17808 - protein, 9 aa, Borrelia Burgdorferi
  Xaa can be any naturally occurring amino acid
  VARIANT 4: Xaa = Any Amino Acid
LRGXAKDGK

SEQ ID NO: 17809 - protein, 9 aa, Borrelia Burgdorferi
  Xaa can be any naturally occurring amino acid
  VARIANT 3: Xaa = Any Amino Acid
RGXAKDGKF

SEQ ID NO: 17810 - protein, 9 aa, Borrelia Burgdorferi
  Xaa can be any naturally occurring amino acid
  VARIANT 2: Xaa = Any Amino Acid
GXAKDGKFA

SEQ ID NO: 17811 - protein, 9 aa, Borrelia Burgdorferi
  Xaa can be any naturally occurring amino acid
  VARIANT 1: Xaa = Any Amino Acid
XAKDGKFAV

SEQ ID NO: 17812 - protein, 9 aa, Borrelia Burgdorferi
AKDGKFAVK

SEQ ID NO: 17813 - protein, 9 aa, Borrelia Burgdorferi
KDGKFAVKD

SEQ ID NO: 17814 - protein, 9 aa, Borrelia Burgdorferi
DGKFAVKDG

SEQ ID NO: 17815 - protein, 9 aa, Borrelia Burgdorferi
GKFAVKDGE

SEQ ID NO: 17816 - protein, 9 aa, Borrelia Burgdorferi
KFAVKDGEK

SEQ ID NO: 17817 - protein, 9 aa, Borrelia Burgdorferi
FAVKDGEKE

SEQ ID NO: 17818 - protein, 9 aa, Borrelia Burgdorferi
AVKDGEKEK

SEQ ID NO: 17819 - protein, 9 aa, Borrelia Burgdorferi
VKDGEKEKA

SEQ ID NO: 17820 - protein, 9 aa, Borrelia Burgdorferi
KDGEKEKAE

SEQ ID NO: 17821 - protein, 9 aa, Borrelia Burgdorferi
DGEKEKAEG

SEQ ID NO: 17822 - protein, 9 aa, Borrelia Burgdorferi
GEKEKAEGA

SEQ ID NO: 17823 - protein, 9 aa, Borrelia Burgdorferi
EKEKAEGAI

SEQ ID NO: 17824 - protein, 9 aa, Borrelia Burgdorferi
KEKAEGAIK

SEQ ID NO: 17825 - protein, 9 aa, Borrelia Burgdorferi
EKAEGAIKG

SEQ ID NO: 17826 - protein, 9 aa, Borrelia Burgdorferi
KAEGAIKGA

SEQ ID NO: 17827 - protein, 9 aa, Borrelia Burgdorferi
AEGAIKGAA

SEQ ID NO: 17828 - protein, 9 aa, Borrelia Burgdorferi
EGAIKGAAE

SEQ ID NO: 17829 - protein, 9 aa, Borrelia Burgdorferi
GAIKGAAES

SEQ ID NO: 17830 - protein, 9 aa, Borrelia Burgdorferi
AIKGAAESA

SEQ ID NO: 17831 - protein, 9 aa, Borrelia Burgdorferi
IKGAAESAV

SEQ ID NO: 17832 - protein, 9 aa, Borrelia Burgdorferi
KGAAESAVR

SEQ ID NO: 17833 - protein, 9 aa, Borrelia Burgdorferi
GAAESAVRK

SEQ ID NO: 17834 - protein, 9 aa, Borrelia Burgdorferi
AAESAVRKV

SEQ ID NO: 17835 - protein, 9 aa, Borrelia Burgdorferi
AESAVRKVL

SEQ ID NO: 17836 - protein, 9 aa, Borrelia Burgdorferi
ESAVRKVLG

SEQ ID NO: 17837 - protein, 9 aa, Borrelia Burgdorferi
SAVRKVLGA

SEQ ID NO: 17838 - protein, 9 aa, Borrelia Burgdorferi
AVRKVLGAI

SEQ ID NO: 17839 - protein, 9 aa, Borrelia Burgdorferi
VRKVLGAIT

SEQ ID NO: 17840 - protein, 9 aa, Borrelia Burgdorferi
RKVLGAITG

SEQ ID NO: 17841 - protein, 9 aa, Borrelia Burgdorferi
KVLGAITGL

SEQ ID NO: 17842 - protein, 9 aa, Borrelia Burgdorferi
VLGAITGLI

SEQ ID NO: 17843 - protein, 9 aa, Borrelia Burgdorferi
LGAITGLIG

SEQ ID NO: 17844 - protein, 9 aa, Borrelia Burgdorferi
GAITGLIGD

SEQ ID NO: 17845 - protein, 9 aa, Borrelia Burgdorferi
AITGLIGDA

SEQ ID NO: 17846 - protein, 9 aa, Borrelia Burgdorferi
ITGLIGDAV

SEQ ID NO: 17847 - protein, 9 aa, Borrelia Burgdorferi
TGLIGDAVS

SEQ ID NO: 17848 - protein, 9 aa, Borrelia Burgdorferi
GLIGDAVSS

SEQ ID NO: 17849 - protein, 9 aa, Borrelia Burgdorferi
LIGDAVSSG

SEQ ID NO: 17850 - protein, 9 aa, Borrelia Burgdorferi
IGDAVSSGL

SEQ ID NO: 17851 - protein, 9 aa, Borrelia Burgdorferi
GDAVSSGLR

SEQ ID NO: 17852 - protein, 9 aa, Borrelia Burgdorferi
DAVSSGLRK

SEQ ID NO: 17853 - protein, 9 aa, Borrelia Burgdorferi
AVSSGLRKV

SEQ ID NO: 17854 - protein, 9 aa, Borrelia Burgdorferi
VSSGLRKVG

SEQ ID NO: 17855 - protein, 9 aa, Borrelia Burgdorferi
SSGLRKVGD

SEQ ID NO: 17856 - protein, 9 aa, Borrelia Burgdorferi
SGLRKVGDS

SEQ ID NO: 17857 - protein, 9 aa, Borrelia Burgdorferi
GLRKVGDSV

SEQ ID NO: 17858 - protein, 9 aa, Borrelia Burgdorferi
LRKVGDSVK

SEQ ID NO: 17859 - protein, 9 aa, Borrelia Burgdorferi
RKVGDSVKA

SEQ ID NO: 17860 - protein, 9 aa, Borrelia Burgdorferi
KVGDSVKAA

SEQ ID NO: 17861 - protein, 9 aa, Borrelia Burgdorferi
VGDSVKAAS

SEQ ID NO: 17862 - protein, 9 aa, Borrelia Burgdorferi
GDSVKAASK

SEQ ID NO: 17863 - protein, 9 aa, Borrelia Burgdorferi
DSVKAASKE

SEQ ID NO: 17864 - protein, 9 aa, Borrelia Burgdorferi
SVKAASKET

SEQ ID NO: 17865 - protein, 9 aa, Borrelia Burgdorferi
VKAASKETP

SEQ ID NO: 17866 - protein, 9 aa, Borrelia Burgdorferi
KAASKETPP

SEQ ID NO: 17867 - protein, 9 aa, Borrelia Burgdorferi
AASKETPPA

SEQ ID NO: 17868 - protein, 9 aa, Borrelia Burgdorferi
ASKETPPAL

SEQ ID NO: 17869 - protein, 9 aa, Borrelia Burgdorferi
SKETPPALN

SEQ ID NO: 17870 - protein, 9 aa, Borrelia Burgdorferi
KETPPALNK

SEQ ID NO: 17871 - protein, 10 aa, Borrelia Burgdorferi
MRGSHHHHHH

SEQ ID NO: 17872 - protein, 10 aa, Borrelia Burgdorferi
RGSHHHHHHG

SEQ ID NO: 17873 - protein, 10 aa, Borrelia Burgdorferi
GSHHHHHHGS

SEQ ID NO: 17874 - protein, 10 aa, Borrelia Burgdorferi
SHHHHHHGSS

SEQ ID NO: 17875 - protein, 10 aa, Borrelia Burgdorferi
HHHHHHGSSQ

SEQ ID NO: 17876 - protein, 10 aa, Borrelia Burgdorferi
HHHHHGSSQV

SEQ ID NO: 17877 - protein, 10 aa, Borrelia Burgdorferi
HHHHGSSQVA

SEQ ID NO: 17878 - protein, 10 aa, Borrelia Burgdorferi
HHHGSSQVAD

SEQ ID NO: 17879 - protein, 10 aa, Borrelia Burgdorferi
HHGSSQVADK

SEQ ID NO: 17880 - protein, 10 aa, Borrelia Burgdorferi
HGSSQVADKD

SEQ ID NO: 17881 - protein, 10 aa, Borrelia Burgdorferi
GSSQVADKDD

SEQ ID NO: 17882 - protein, 10 aa, Borrelia Burgdorferi
SSQVADKDDP

SEQ ID NO: 17883 - protein, 10 aa, Borrelia Burgdorferi
SQVADKDDPT

SEQ ID NO: 17884 - protein, 10 aa, Borrelia Burgdorferi
QVADKDDPTN

SEQ ID NO: 17885 - protein, 10 aa, Borrelia Burgdorferi
VADKDDPTNK

SEQ ID NO: 17886 - protein, 10 aa, Borrelia Burgdorferi
ADKDDPTNKF

SEQ ID NO: 17887 - protein, 10 aa, Borrelia Burgdorferi
DKDDPTNKFY

SEQ ID NO: 17888 - protein, 10 aa, Borrelia Burgdorferi
KDDPTNKFYQ

SEQ ID NO: 17889 - protein, 10 aa, Borrelia Burgdorferi
DDPTNKFYQS

SEQ ID NO: 17890 - protein, 10 aa, Borrelia Burgdorferi
DPTNKFYQSV

SEQ ID NO: 17891 - protein, 10 aa, Borrelia Burgdorferi
PTNKFYQSVI

SEQ ID NO: 17892 - protein, 10 aa, Borrelia Burgdorferi
TNKFYQSVIQ

SEQ ID NO: 17893 - protein, 10 aa, Borrelia Burgdorferi
NKFYQSVIQL

SEQ ID NO: 17894 - protein, 10 aa, Borrelia Burgdorferi
KFYQSVIQLG

SEQ ID NO: 17895 - protein, 10 aa, Borrelia Burgdorferi
FYQSVIQLGN

SEQ ID NO: 17896 - protein, 10 aa, Borrelia Burgdorferi
YQSVIQLGNG

SEQ ID NO: 17897 - protein, 10 aa, Borrelia Burgdorferi
QSVIQLGNGF

SEQ ID NO: 17898 - protein, 10 aa, Borrelia Burgdorferi
SVIQLGNGFL

SEQ ID NO: 17899 - protein, 10 aa, Borrelia Burgdorferi
VIQLGNGFLD

SEQ ID NO: 17900 - protein, 10 aa, Borrelia Burgdorferi
IQLGNGFLDV

SEQ ID NO: 17901 - protein, 10 aa, Borrelia Burgdorferi
QLGNGFLDVF

SEQ ID NO: 17902 - protein, 10 aa, Borrelia Burgdorferi
LGNGFLDVFT

SEQ ID NO: 17903 - protein, 10 aa, Borrelia Burgdorferi
GNGFLDVFTS

SEQ ID NO: 17904 - protein, 10 aa, Borrelia Burgdorferi
NGFLDVFTSF

SEQ ID NO: 17905 - protein, 10 aa, Borrelia Burgdorferi
GFLDVFTSFG

SEQ ID NO: 17906 - protein, 10 aa, Borrelia Burgdorferi
FLDVFTSFGG

SEQ ID NO: 17907 - protein, 10 aa, Borrelia Burgdorferi
LDVFTSFGGL

SEQ ID NO: 17908 - protein, 10 aa, Borrelia Burgdorferi
DVFTSFGGLV

SEQ ID NO: 17909 - protein, 10 aa, Borrelia Burgdorferi
VFTSFGGLVA

SEQ ID NO: 17910 - protein, 10 aa, Borrelia Burgdorferi
FTSFGGLVAE

SEQ ID NO: 17911 - protein, 10 aa, Borrelia Burgdorferi
TSFGGLVAEA

SEQ ID NO: 17912 - protein, 10 aa, Borrelia Burgdorferi
SFGGLVAEAF

SEQ ID NO: 17913 - protein, 10 aa, Borrelia Burgdorferi
FGGLVAEAFG

SEQ ID NO: 17914 - protein, 10 aa, Borrelia Burgdorferi
GGLVAEAFGF

SEQ ID NO: 17915 - protein, 10 aa, Borrelia Burgdorferi
GLVAEAFGFK

SEQ ID NO: 17916 - protein, 10 aa, Borrelia Burgdorferi
LVAEAFGFKS

SEQ ID NO: 17917 - protein, 10 aa, Borrelia Burgdorferi
VAEAFGFKSD

SEQ ID NO: 17918 - protein, 10 aa, Borrelia Burgdorferi
AEAFGFKSDP

SEQ ID NO: 17919 - protein, 10 aa, Borrelia Burgdorferi
EAFGFKSDPK

SEQ ID NO: 17920 - protein, 10 aa, Borrelia Burgdorferi
AFGFKSDPKK

SEQ ID NO: 17921 - protein, 10 aa, Borrelia Burgdorferi
FGFKSDPKKS

SEQ ID NO: 17922 - protein, 10 aa, Borrelia Burgdorferi
GFKSDPKKSD

SEQ ID NO: 17923 - protein, 10 aa, Borrelia Burgdorferi
FKSDPKKSDV

SEQ ID NO: 17924 - protein, 10 aa, Borrelia Burgdorferi
KSDPKKSDVK

SEQ ID NO: 17925 - protein, 10 aa, Borrelia Burgdorferi
SDPKKSDVKT

SEQ ID NO: 17926 - protein, 10 aa, Borrelia Burgdorferi
DPKKSDVKTY

SEQ ID NO: 17927 - protein, 10 aa, Borrelia Burgdorferi
PKKSDVKTYF

SEQ ID NO: 17928 - protein, 10 aa, Borrelia Burgdorferi
KKSDVKTYFT

SEQ ID NO: 17929 - protein, 10 aa, Borrelia Burgdorferi
KSDVKTYFTT

SEQ ID NO: 17930 - protein, 10 aa, Borrelia Burgdorferi
SDVKTYFTTV

SEQ ID NO: 17931 - protein, 10 aa, Borrelia Burgdorferi
DVKTYFTTVA

SEQ ID NO: 17932 - protein, 10 aa, Borrelia Burgdorferi
VKTYFTTVAA

SEQ ID NO: 17933 - protein, 10 aa, Borrelia Burgdorferi
KTYFTTVAAK

SEQ ID NO: 17934 - protein, 10 aa, Borrelia Burgdorferi
TYFTTVAAKL

SEQ ID NO: 17935 - protein, 10 aa, Borrelia Burgdorferi
YFTTVAAKLE

SEQ ID NO: 17936 - protein, 10 aa, Borrelia Burgdorferi
FTTVAAKLEK

SEQ ID NO: 17937 - protein, 10 aa, Borrelia Burgdorferi
TTVAAKLEKT

SEQ ID NO: 17938 - protein, 10 aa, Borrelia Burgdorferi
TVAAKLEKTK

SEQ ID NO: 17939 - protein, 10 aa, Borrelia Burgdorferi
VAAKLEKTKT

SEQ ID NO: 17940 - protein, 10 aa, Borrelia Burgdorferi
AAKLEKTKTD

SEQ ID NO: 17941 - protein, 10 aa, Borrelia Burgdorferi
AKLEKTKTDL

SEQ ID NO: 17942 - protein, 10 aa, Borrelia Burgdorferi
KLEKTKTDLN

SEQ ID NO: 17943 - protein, 10 aa, Borrelia Burgdorferi
LEKTKTDLNS

SEQ ID NO: 17944 - protein, 10 aa, Borrelia Burgdorferi
EKTKTDLNSL

SEQ ID NO: 17945 - protein, 10 aa, Borrelia Burgdorferi
KTKTDLNSLP

SEQ ID NO: 17946 - protein, 10 aa, Borrelia Burgdorferi
TKTDLNSLPK

SEQ ID NO: 17947 - protein, 10 aa, Borrelia Burgdorferi
KTDLNSLPKE

SEQ ID NO: 17948 - protein, 10 aa, Borrelia Burgdorferi
TDLNSLPKEK

SEQ ID NO: 17949 - protein, 10 aa, Borrelia Burgdorferi
DLNSLPKEKS

SEQ ID NO: 17950 - protein, 10 aa, Borrelia Burgdorferi
LNSLPKEKSD

SEQ ID NO: 17951 - protein, 10 aa, Borrelia Burgdorferi
NSLPKEKSDI

SEQ ID NO: 17952 - protein, 10 aa, Borrelia Burgdorferi
SLPKEKSDIS

SEQ ID NO: 17953 - protein, 10 aa, Borrelia Burgdorferi
LPKEKSDISS

SEQ ID NO: 17954 - protein, 10 aa, Borrelia Burgdorferi
PKEKSDISST

SEQ ID NO: 17955 - protein, 10 aa, Borrelia Burgdorferi
KEKSDISSTT

SEQ ID NO: 17956 - protein, 10 aa, Borrelia Burgdorferi
EKSDISSTTG

SEQ ID NO: 17957 - protein, 10 aa, Borrelia Burgdorferi
KSDISSTTGK

SEQ ID NO: 17958 - protein, 10 aa, Borrelia Burgdorferi
SDISSTTGKP

SEQ ID NO: 17959 - protein, 10 aa, Borrelia Burgdorferi
DISSTTGKPD

SEQ ID NO: 17960 - protein, 10 aa, Borrelia Burgdorferi
ISSTTGKPDS

SEQ ID NO: 17961 - protein, 10 aa, Borrelia Burgdorferi
SSTTGKPDST

SEQ ID NO: 17962 - protein, 10 aa, Borrelia Burgdorferi
STTGKPDSTG

SEQ ID NO: 17963 - protein, 10 aa, Borrelia Burgdorferi
TTGKPDSTGS

SEQ ID NO: 17964 - protein, 10 aa, Borrelia Burgdorferi
TGKPDSTGSV

SEQ ID NO: 17965 - protein, 10 aa, Borrelia Burgdorferi
GKPDSTGSVG

SEQ ID NO: 17966 - protein, 10 aa, Borrelia Burgdorferi
KPDSTGSVGT

SEQ ID NO: 17967 - protein, 10 aa, Borrelia Burgdorferi
PDSTGSVGTA

SEQ ID NO: 17968 - protein, 10 aa, Borrelia Burgdorferi
DSTGSVGTAV

SEQ ID NO: 17969 - protein, 10 aa, Borrelia Burgdorferi
STGSVGTAVE

SEQ ID NO: 17970 - protein, 10 aa, Borrelia Burgdorferi
TGSVGTAVEG

SEQ ID NO: 17971 - protein, 10 aa, Borrelia Burgdorferi
GSVGTAVEGA

SEQ ID NO: 17972 - protein, 10 aa, Borrelia Burgdorferi
SVGTAVEGAI

SEQ ID NO: 17973 - protein, 10 aa, Borrelia Burgdorferi
VGTAVEGAIK

SEQ ID NO: 17974 - protein, 10 aa, Borrelia Burgdorferi
GTAVEGAIKE

SEQ ID NO: 17975 - protein, 10 aa, Borrelia Burgdorferi
TAVEGAIKEV

SEQ ID NO: 17976 - protein, 10 aa, Borrelia Burgdorferi
AVEGAIKEVS

SEQ ID NO: 17977 - protein, 10 aa, Borrelia Burgdorferi
VEGAIKEVSE

SEQ ID NO: 17978 - protein, 10 aa, Borrelia Burgdorferi
EGAIKEVSEL

SEQ ID NO: 17979 - protein, 10 aa, Borrelia Burgdorferi
GAIKEVSELL

SEQ ID NO: 17980 - protein, 10 aa, Borrelia Burgdorferi
AIKEVSELLD

SEQ ID NO: 17981 - protein, 10 aa, Borrelia Burgdorferi
IKEVSELLDK

SEQ ID NO: 17982 - protein, 10 aa, Borrelia Burgdorferi
KEVSELLDKL

SEQ ID NO: 17983 - protein, 10 aa, Borrelia Burgdorferi
EVSELLDKLV

SEQ ID NO: 17984 - protein, 10 aa, Borrelia Burgdorferi
VSELLDKLVK

SEQ ID NO: 17985 - protein, 10 aa, Borrelia Burgdorferi
SELLDKLVKA

SEQ ID NO: 17986 - protein, 10 aa, Borrelia Burgdorferi
ELLDKLVKAV

SEQ ID NO: 17987 - protein, 10 aa, Borrelia Burgdorferi
LLDKLVKAVK

SEQ ID NO: 17988 - protein, 10 aa, Borrelia Burgdorferi
LDKLVKAVKT

SEQ ID NO: 17989 - protein, 10 aa, Borrelia Burgdorferi
DKLVKAVKTA

SEQ ID NO: 17990 - protein, 10 aa, Borrelia Burgdorferi
KLVKAVKTAE

SEQ ID NO: 17991 - protein, 10 aa, Borrelia Burgdorferi
LVKAVKTAEG

SEQ ID NO: 17992 - protein, 10 aa, Borrelia Burgdorferi
VKAVKTAEGA

SEQ ID NO: 17993 - protein, 10 aa, Borrelia Burgdorferi
KAVKTAEGAS

SEQ ID NO: 17994 - protein, 10 aa, Borrelia Burgdorferi
AVKTAEGASS

SEQ ID NO: 17995 - protein, 10 aa, Borrelia Burgdorferi
VKTAEGASSG

SEQ ID NO: 17996 - protein, 10 aa, Borrelia Burgdorferi
KTAEGASSGT

SEQ ID NO: 17997 - protein, 10 aa, Borrelia Burgdorferi
TAEGASSGTA

SEQ ID NO: 17998 - protein, 10 aa, Borrelia Burgdorferi
AEGASSGTAA

SEQ ID NO: 17999 - protein, 10 aa, Borrelia Burgdorferi
EGASSGTAAI

SEQ ID NO: 18000 - protein, 10 aa, Borrelia Burgdorferi
GASSGTAAIG

SEQ ID NO: 18001 - protein, 10 aa, Borrelia Burgdorferi
ASSGTAAIGE

SEQ ID NO: 18002 - protein, 10 aa, Borrelia Burgdorferi
SSGTAAIGEV

SEQ ID NO: 18003 - protein, 10 aa, Borrelia Burgdorferi
SGTAAIGEVV

SEQ ID NO: 18004 - protein, 10 aa, Borrelia Burgdorferi
GTAAIGEVVA

SEQ ID NO: 18005 - protein, 10 aa, Borrelia Burgdorferi
TAAIGEVVAD

SEQ ID NO: 18006 - protein, 10 aa, Borrelia Burgdorferi
AAIGEVVADA

SEQ ID NO: 18007 - protein, 10 aa, Borrelia Burgdorferi
AIGEVVADAD

SEQ ID NO: 18008 - protein, 10 aa, Borrelia Burgdorferi
IGEVVADADA

SEQ ID NO: 18009 - protein, 10 aa, Borrelia Burgdorferi
GEVVADADAA

SEQ ID NO: 18010 - protein, 10 aa, Borrelia Burgdorferi
EVVADADAAK

SEQ ID NO: 18011 - protein, 10 aa, Borrelia Burgdorferi
VVADADAAKV

SEQ ID NO: 18012 - protein, 10 aa, Borrelia Burgdorferi
VADADAAKVA

SEQ ID NO: 18013 - protein, 10 aa, Borrelia Burgdorferi
ADADAAKVAD

SEQ ID NO: 18014 - protein, 10 aa, Borrelia Burgdorferi
DADAAKVADK

SEQ ID NO: 18015 - protein, 10 aa, Borrelia Burgdorferi
ADAAKVADKA

SEQ ID NO: 18016 - protein, 10 aa, Borrelia Burgdorferi
DAAKVADKAS

SEQ ID NO: 18017 - protein, 10 aa, Borrelia Burgdorferi
AAKVADKASV

SEQ ID NO: 18018 - protein, 10 aa, Borrelia Burgdorferi
AKVADKASVK

SEQ ID NO: 18019 - protein, 10 aa, Borrelia Burgdorferi
KVADKASVKG

SEQ ID NO: 18020 - protein, 10 aa, Borrelia Burgdorferi
VADKASVKGI

SEQ ID NO: 18021 - protein, 10 aa, Borrelia Burgdorferi
ADKASVKGIA

SEQ ID NO: 18022 - protein, 10 aa, Borrelia Burgdorferi
DKASVKGIAK

SEQ ID NO: 18023 - protein, 10 aa, Borrelia Burgdorferi
KASVKGIAKG

SEQ ID NO: 18024 - protein, 10 aa, Borrelia Burgdorferi
ASVKGIAKGI

SEQ ID NO: 18025 - protein, 10 aa, Borrelia Burgdorferi
SVKGIAKGIK

SEQ ID NO: 18026 - protein, 10 aa, Borrelia Burgdorferi
VKGIAKGIKE

SEQ ID NO: 18027 - protein, 10 aa, Borrelia Burgdorferi
KGIAKGIKEI

SEQ ID NO: 18028 - protein, 10 aa, Borrelia Burgdorferi
GIAKGIKEIV

SEQ ID NO: 18029 - protein, 10 aa, Borrelia Burgdorferi
IAKGIKEIVE

SEQ ID NO: 18030 - protein, 10 aa, Borrelia Burgdorferi
AKGIKEIVEA

SEQ ID NO: 18031 - protein, 10 aa, Borrelia Burgdorferi
KGIKEIVEAA

SEQ ID NO: 18032 - protein, 10 aa, Borrelia Burgdorferi
GIKEIVEAAG

SEQ ID NO: 18033 - protein, 10 aa, Borrelia Burgdorferi
IKEIVEAAGG

SEQ ID NO: 18034 - protein, 10 aa, Borrelia Burgdorferi
KEIVEAAGGS

SEQ ID NO: 18035 - protein, 10 aa, Borrelia Burgdorferi
EIVEAAGGSE

SEQ ID NO: 18036 - protein, 10 aa, Borrelia Burgdorferi
IVEAAGGSEK

SEQ ID NO: 18037 - protein, 10 aa, Borrelia Burgdorferi
VEAAGGSEKL

SEQ ID NO: 18038 - protein, 10 aa, Borrelia Burgdorferi
EAAGGSEKLK

SEQ ID NO: 18039 - protein, 10 aa, Borrelia Burgdorferi
AAGGSEKLKA

SEQ ID NO: 18040 - protein, 10 aa, Borrelia Burgdorferi
AGGSEKLKAV

SEQ ID NO: 18041 - protein, 10 aa, Borrelia Burgdorferi
GGSEKLKAVA

SEQ ID NO: 18042 - protein, 10 aa, Borrelia Burgdorferi
GSEKLKAVAA

SEQ ID NO: 18043 - protein, 10 aa, Borrelia Burgdorferi
SEKLKAVAAA

SEQ ID NO: 18044 - protein, 10 aa, Borrelia Burgdorferi
EKLKAVAAAK

SEQ ID NO: 18045 - protein, 10 aa, Borrelia Burgdorferi
KLKAVAAAKG

SEQ ID NO: 18046 - protein, 10 aa, Borrelia Burgdorferi
LKAVAAAKGE

SEQ ID NO: 18047 - protein, 10 aa, Borrelia Burgdorferi
KAVAAAKGEN

SEQ ID NO: 18048 - protein, 10 aa, Borrelia Burgdorferi
AVAAAKGENN

SEQ ID NO: 18049 - protein, 10 aa, Borrelia Burgdorferi
VAAAKGENNK

SEQ ID NO: 18050 - protein, 10 aa, Borrelia Burgdorferi
AAAKGENNKG

SEQ ID NO: 18051 - protein, 10 aa, Borrelia Burgdorferi
AAKGENNKGA

SEQ ID NO: 18052 - protein, 10 aa, Borrelia Burgdorferi
AKGENNKGAG

SEQ ID NO: 18053 - protein, 10 aa, Borrelia Burgdorferi
KGENNKGAGK

SEQ ID NO: 18054 - protein, 10 aa, Borrelia Burgdorferi
GENNKGAGKL

SEQ ID NO: 18055 - protein, 10 aa, Borrelia Burgdorferi
ENNKGAGKLF

SEQ ID NO: 18056 - protein, 10 aa, Borrelia Burgdorferi
NNKGAGKLFG

SEQ ID NO: 18057 - protein, 10 aa, Borrelia Burgdorferi
NKGAGKLFGK

SEQ ID NO: 18058 - protein, 10 aa, Borrelia Burgdorferi
KGAGKLFGKA

SEQ ID NO: 18059 - protein, 10 aa, Borrelia Burgdorferi
GAGKLFGKAG

SEQ ID NO: 18060 - protein, 10 aa, Borrelia Burgdorferi
AGKLFGKAGA

SEQ ID NO: 18061 - protein, 10 aa, Borrelia Burgdorferi
GKLFGKAGAA

SEQ ID NO: 18062 - protein, 10 aa, Borrelia Burgdorferi
KLFGKAGAAA

SEQ ID NO: 18063 - protein, 10 aa, Borrelia Burgdorferi
LFGKAGAAAH

SEQ ID NO: 18064 - protein, 10 aa, Borrelia Burgdorferi
FGKAGAAAHG

SEQ ID NO: 18065 - protein, 10 aa, Borrelia Burgdorferi
GKAGAAAHGD

SEQ ID NO: 18066 - protein, 10 aa, Borrelia Burgdorferi
KAGAAAHGDS

SEQ ID NO: 18067 - protein, 10 aa, Borrelia Burgdorferi
AGAAAHGDSE

SEQ ID NO: 18068 - protein, 10 aa, Borrelia Burgdorferi
GAAAHGDSEA

SEQ ID NO: 18069 - protein, 10 aa, Borrelia Burgdorferi
AAAHGDSEAA

SEQ ID NO: 18070 - protein, 10 aa, Borrelia Burgdorferi
AAHGDSEAAS

SEQ ID NO: 18071 - protein, 10 aa, Borrelia Burgdorferi
AHGDSEAASK

SEQ ID NO: 18072 - protein, 10 aa, Borrelia Burgdorferi
HGDSEAASKA

SEQ ID NO: 18073 - protein, 10 aa, Borrelia Burgdorferi
GDSEAASKAA

SEQ ID NO: 18074 - protein, 10 aa, Borrelia Burgdorferi
DSEAASKAAG

SEQ ID NO: 18075 - protein, 10 aa, Borrelia Burgdorferi
SEAASKAAGA

SEQ ID NO: 18076 - protein, 10 aa, Borrelia Burgdorferi
EAASKAAGAV

SEQ ID NO: 18077 - protein, 10 aa, Borrelia Burgdorferi
AASKAAGAVS

SEQ ID NO: 18078 - protein, 10 aa, Borrelia Burgdorferi
ASKAAGAVSA

SEQ ID NO: 18079 - protein, 10 aa, Borrelia Burgdorferi
SKAAGAVSAV

SEQ ID NO: 18080 - protein, 10 aa, Borrelia Burgdorferi
KAAGAVSAVS

SEQ ID NO: 18081 - protein, 10 aa, Borrelia Burgdorferi
AAGAVSAVSG

SEQ ID NO: 18082 - protein, 10 aa, Borrelia Burgdorferi
AGAVSAVSGE

SEQ ID NO: 18083 - protein, 10 aa, Borrelia Burgdorferi
GAVSAVSGEQ

SEQ ID NO: 18084 - protein, 10 aa, Borrelia Burgdorferi
AVSAVSGEQI

SEQ ID NO: 18085 - protein, 10 aa, Borrelia Burgdorferi
VSAVSGEQIL

SEQ ID NO: 18086 - protein, 10 aa, Borrelia Burgdorferi
SAVSGEQILS

SEQ ID NO: 18087 - protein, 10 aa, Borrelia Burgdorferi
AVSGEQILSA

SEQ ID NO: 18088 - protein, 10 aa, Borrelia Burgdorferi
VSGEQILSAI

SEQ ID NO: 18089 - protein, 10 aa, Borrelia Burgdorferi
SGEQILSAIV

SEQ ID NO: 18090 - protein, 10 aa, Borrelia Burgdorferi
GEQILSAIVT

SEQ ID NO: 18091 - protein, 10 aa, Borrelia Burgdorferi
EQILSAIVTA

SEQ ID NO: 18092 - protein, 10 aa, Borrelia Burgdorferi
QILSAIVTAA

SEQ ID NO: 18093 - protein, 10 aa, Borrelia Burgdorferi
ILSAIVTAAD

SEQ ID NO: 18094 - protein, 10 aa, Borrelia Burgdorferi
LSAIVTAADA

SEQ ID NO: 18095 - protein, 10 aa, Borrelia Burgdorferi
SAIVTAADAA

SEQ ID NO: 18096 - protein, 10 aa, Borrelia Burgdorferi
AIVTAADAAE

SEQ ID NO: 18097 - protein, 10 aa, Borrelia Burgdorferi
IVTAADAAEQ

SEQ ID NO: 18098 - protein, 10 aa, Borrelia Burgdorferi
VTAADAAEQD

SEQ ID NO: 18099 - protein, 10 aa, Borrelia Burgdorferi
TAADAAEQDG

SEQ ID NO: 18100 - protein, 10 aa, Borrelia Burgdorferi
AADAAEQDGK

SEQ ID NO: 18101 - protein, 10 aa, Borrelia Burgdorferi
ADAAEQDGKK

SEQ ID NO: 18102 - protein, 10 aa, Borrelia Burgdorferi
DAAEQDGKKP

SEQ ID NO: 18103 - protein, 10 aa, Borrelia Burgdorferi
AAEQDGKKPE

SEQ ID NO: 18104 - protein, 10 aa, Borrelia Burgdorferi
AEQDGKKPEE

SEQ ID NO: 18105 - protein, 10 aa, Borrelia Burgdorferi
EQDGKKPEEA

SEQ ID NO: 18106 - protein, 10 aa, Borrelia Burgdorferi
QDGKKPEEAK

SEQ ID NO: 18107 - protein, 10 aa, Borrelia Burgdorferi
DGKKPEEAKN

SEQ ID NO: 18108 - protein, 10 aa, Borrelia Burgdorferi
GKKPEEAKNP

SEQ ID NO: 18109 - protein, 10 aa, Borrelia Burgdorferi
KKPEEAKNPI

SEQ ID NO: 18110 - protein, 10 aa, Borrelia Burgdorferi
KPEEAKNPIA

SEQ ID NO: 18111 - protein, 10 aa, Borrelia Burgdorferi
PEEAKNPIAA

SEQ ID NO: 18112 - protein, 10 aa, Borrelia Burgdorferi
EEAKNPIAAA

SEQ ID NO: 18113 - protein, 10 aa, Borrelia Burgdorferi
EAKNPIAAAI

SEQ ID NO: 18114 - protein, 10 aa, Borrelia Burgdorferi
AKNPIAAAIG

SEQ ID NO: 18115 - protein, 10 aa, Borrelia Burgdorferi
KNPIAAAIGD

SEQ ID NO: 18116 - protein, 10 aa, Borrelia Burgdorferi
NPIAAAIGDK

SEQ ID NO: 18117 - protein, 10 aa, Borrelia Burgdorferi
PIAAAIGDKD

SEQ ID NO: 18118 - protein, 10 aa, Borrelia Burgdorferi
IAAAIGDKDG

SEQ ID NO: 18119 - protein, 10 aa, Borrelia Burgdorferi
AAAIGDKDGG

SEQ ID NO: 18120 - protein, 10 aa, Borrelia Burgdorferi
AAIGDKDGGA

SEQ ID NO: 18121 - protein, 10 aa, Borrelia Burgdorferi
AIGDKDGGAE

SEQ ID NO: 18122 - protein, 10 aa, Borrelia Burgdorferi
IGDKDGGAEF

SEQ ID NO: 18123 - protein, 10 aa, Borrelia Burgdorferi
GDKDGGAEFG

SEQ ID NO: 18124 - protein, 10 aa, Borrelia Burgdorferi
DKDGGAEFGQ

SEQ ID NO: 18125 - protein, 10 aa, Borrelia Burgdorferi
KDGGAEFGQD

SEQ ID NO: 18126 - protein, 10 aa, Borrelia Burgdorferi
DGGAEFGQDE

SEQ ID NO: 18127 - protein, 10 aa, Borrelia Burgdorferi
  Xaa can be any naturally occurring amino acid
  VARIANT 10: Xaa = Any Amino Acid
GGAEFGQDEX

SEQ ID NO: 18128 - protein, 10 aa, Borrelia Burgdorferi
  Xaa can be any naturally occurring amino acid
  VARIANT 9: Xaa = Any Amino Acid
GAEFGQDEXK

SEQ ID NO: 18129 - protein, 10 aa, Borrelia Burgdorferi
  Xaa can be any naturally occurring amino acid
  VARIANT 8: Xaa = Any Amino Acid
AEFGQDEXKK

SEQ ID NO: 18130 - protein, 10 aa, Borrelia Burgdorferi
  Xaa can be any naturally occurring amino acid
  VARIANT 7: Xaa = Any Amino Acid
EFGQDEXKKD

SEQ ID NO: 18131 - protein, 10 aa, Borrelia Burgdorferi
  Xaa can be any naturally occurring amino acid
  VARIANT 6: Xaa = Any Amino Acid
FGQDEXKKDD

SEQ ID NO: 18132 - protein, 10 aa, Borrelia Burgdorferi
  Xaa can be any naturally occurring amino acid
  VARIANT 5: Xaa = Any Amino Acid
GQDEXKKDDQ

SEQ ID NO: 18133 - protein, 10 aa, Borrelia Burgdorferi
  Xaa can be any naturally occurring amino acid
  VARIANT 4: Xaa = Any Amino Acid
QDEXKKDDQI

SEQ ID NO: 18134 - protein, 10 aa, Borrelia Burgdorferi
  Xaa can be any naturally occurring amino acid
  VARIANT 3: Xaa = Any Amino Acid
DEXKKDDQIA

SEQ ID NO: 18135 - protein, 10 aa, Borrelia Burgdorferi
  Xaa can be any naturally occurring amino acid
  VARIANT 2: Xaa = Any Amino Acid
EXKKDDQIAA

SEQ ID NO: 18136 - protein, 10 aa, Borrelia Burgdorferi
  Xaa can be any naturally occurring amino acid
  VARIANT 1: Xaa = Any Amino Acid
XKKDDQIAAA

SEQ ID NO: 18137 - protein, 10 aa, Borrelia Burgdorferi
KKDDQIAAAI

SEQ ID NO: 18138 - protein, 10 aa, Borrelia Burgdorferi
KDDQIAAAIA

SEQ ID NO: 18139 - protein, 10 aa, Borrelia Burgdorferi
DDQIAAAIAL

SEQ ID NO: 18140 - protein, 10 aa, Borrelia Burgdorferi
DQIAAAIALR

SEQ ID NO: 18141 - protein, 10 aa, Borrelia Burgdorferi
QIAAAIALRG

SEQ ID NO: 18142 - protein, 10 aa, Borrelia Burgdorferi
  Xaa can be any naturally occurring amino acid
  VARIANT 10: Xaa = Any Amino Acid
IAAAIALRGX

SEQ ID NO: 18143 - protein, 10 aa, Borrelia Burgdorferi
  Xaa can be any naturally occurring amino acid
  VARIANT 9: Xaa = Any Amino Acid
AAAIALRGXA

SEQ ID NO: 18144 - protein, 10 aa, Borrelia Burgdorferi
  Xaa can be any naturally occurring amino acid
  VARIANT 8: Xaa = Any Amino Acid
AAIALRGXAK

SEQ ID NO: 18145 - protein, 10 aa, Borrelia Burgdorferi
  Xaa can be any naturally occurring amino acid
  VARIANT 7: Xaa = Any Amino Acid
AIALRGXAKD

SEQ ID NO: 18146 - protein, 10 aa, Borrelia Burgdorferi
  Xaa can be any naturally occurring amino acid
  VARIANT 6: Xaa = Any Amino Acid
IALRGXAKDG

SEQ ID NO: 18147 - protein, 10 aa, Borrelia Burgdorferi
  Xaa can be any naturally occurring amino acid
  VARIANT 5: Xaa = Any Amino Acid
ALRGXAKDGK

SEQ ID NO: 18148 - protein, 10 aa, Borrelia Burgdorferi
  Xaa can be any naturally occurring amino acid
  VARIANT 4: Xaa = Any Amino Acid
LRGXAKDGKF

SEQ ID NO: 18149 - protein, 10 aa, Borrelia Burgdorferi
  Xaa can be any naturally occurring amino acid
  VARIANT 3: Xaa = Any Amino Acid
RGXAKDGKFA

SEQ ID NO: 18150 - protein, 10 aa, Borrelia Burgdorferi
  Xaa can be any naturally occurring amino acid
  VARIANT 2: Xaa = Any Amino Acid
GXAKDGKFAV

SEQ ID NO: 18151 - protein, 10 aa, Borrelia Burgdorferi
  Xaa can be any naturally occurring amino acid
  VARIANT 1: Xaa = Any Amino Acid
XAKDGKFAVK

SEQ ID NO: 18152 - protein, 10 aa, Borrelia Burgdorferi
AKDGKFAVKD

SEQ ID NO: 18153 - protein, 10 aa, Borrelia Burgdorferi
KDGKFAVKDG

SEQ ID NO: 18154 - protein, 10 aa, Borrelia Burgdorferi
DGKFAVKDGE

SEQ ID NO: 18155 - protein, 10 aa, Borrelia Burgdorferi
GKFAVKDGEK

SEQ ID NO: 18156 - protein, 10 aa, Borrelia Burgdorferi
KFAVKDGEKE

SEQ ID NO: 18157 - protein, 10 aa, Borrelia Burgdorferi
FAVKDGEKEK

SEQ ID NO: 18158 - protein, 10 aa, Borrelia Burgdorferi
AVKDGEKEKA

SEQ ID NO: 18159 - protein, 10 aa, Borrelia Burgdorferi
VKDGEKEKAE

SEQ ID NO: 18160 - protein, 10 aa, Borrelia Burgdorferi
KDGEKEKAEG

SEQ ID NO: 18161 - protein, 10 aa, Borrelia Burgdorferi
DGEKEKAEGA

SEQ ID NO: 18162 - protein, 10 aa, Borrelia Burgdorferi
GEKEKAEGAI

SEQ ID NO: 18163 - protein, 10 aa, Borrelia Burgdorferi
EKEKAEGAIK

SEQ ID NO: 18164 - protein, 10 aa, Borrelia Burgdorferi
KEKAEGAIKG

SEQ ID NO: 18165 - protein, 10 aa, Borrelia Burgdorferi
EKAEGAIKGA

SEQ ID NO: 18166 - protein, 10 aa, Borrelia Burgdorferi
KAEGAIKGAA

SEQ ID NO: 18167 - protein, 10 aa, Borrelia Burgdorferi
AEGAIKGAAE

SEQ ID NO: 18168 - protein, 10 aa, Borrelia Burgdorferi
EGAIKGAAES

SEQ ID NO: 18169 - protein, 10 aa, Borrelia Burgdorferi
GAIKGAAESA

SEQ ID NO: 18170 - protein, 10 aa, Borrelia Burgdorferi
AIKGAAESAV

SEQ ID NO: 18171 - protein, 10 aa, Borrelia Burgdorferi
IKGAAESAVR

SEQ ID NO: 18172 - protein, 10 aa, Borrelia Burgdorferi
KGAAESAVRK

SEQ ID NO: 18173 - protein, 10 aa, Borrelia Burgdorferi
GAAESAVRKV

SEQ ID NO: 18174 - protein, 10 aa, Borrelia Burgdorferi
AAESAVRKVL

SEQ ID NO: 18175 - protein, 10 aa, Borrelia Burgdorferi
AESAVRKVLG

SEQ ID NO: 18176 - protein, 10 aa, Borrelia Burgdorferi
ESAVRKVLGA

SEQ ID NO: 18177 - protein, 10 aa, Borrelia Burgdorferi
SAVRKVLGAI

SEQ ID NO: 18178 - protein, 10 aa, Borrelia Burgdorferi
AVRKVLGAIT

SEQ ID NO: 18179 - protein, 10 aa, Borrelia Burgdorferi
VRKVLGAITG

SEQ ID NO: 18180 - protein, 10 aa, Borrelia Burgdorferi
RKVLGAITGL

SEQ ID NO: 18181 - protein, 10 aa, Borrelia Burgdorferi
KVLGAITGLI

SEQ ID NO: 18182 - protein, 10 aa, Borrelia Burgdorferi
VLGAITGLIG

SEQ ID NO: 18183 - protein, 10 aa, Borrelia Burgdorferi
LGAITGLIGD

SEQ ID NO: 18184 - protein, 10 aa, Borrelia Burgdorferi
GAITGLIGDA

SEQ ID NO: 18185 - protein, 10 aa, Borrelia Burgdorferi
AITGLIGDAV

SEQ ID NO: 18186 - protein, 10 aa, Borrelia Burgdorferi
ITGLIGDAVS

SEQ ID NO: 18187 - protein, 10 aa, Borrelia Burgdorferi
TGLIGDAVSS

SEQ ID NO: 18188 - protein, 10 aa, Borrelia Burgdorferi
GLIGDAVSSG

SEQ ID NO: 18189 - protein, 10 aa, Borrelia Burgdorferi
LIGDAVSSGL

SEQ ID NO: 18190 - protein, 10 aa, Borrelia Burgdorferi
IGDAVSSGLR

SEQ ID NO: 18191 - protein, 10 aa, Borrelia Burgdorferi
GDAVSSGLRK

SEQ ID NO: 18192 - protein, 10 aa, Borrelia Burgdorferi
DAVSSGLRKV

SEQ ID NO: 18193 - protein, 10 aa, Borrelia Burgdorferi
AVSSGLRKVG

SEQ ID NO: 18194 - protein, 10 aa, Borrelia Burgdorferi
VSSGLRKVGD

SEQ ID NO: 18195 - protein, 10 aa, Borrelia Burgdorferi
SSGLRKVGDS

SEQ ID NO: 18196 - protein, 10 aa, Borrelia Burgdorferi
SGLRKVGDSV

SEQ ID NO: 18197 - protein, 10 aa, Borrelia Burgdorferi
GLRKVGDSVK

SEQ ID NO: 18198 - protein, 10 aa, Borrelia Burgdorferi
LRKVGDSVKA

SEQ ID NO: 18199 - protein, 10 aa, Borrelia Burgdorferi
RKVGDSVKAA

SEQ ID NO: 18200 - protein, 10 aa, Borrelia Burgdorferi
KVGDSVKAAS

SEQ ID NO: 18201 - protein, 10 aa, Borrelia Burgdorferi
VGDSVKAASK

SEQ ID NO: 18202 - protein, 10 aa, Borrelia Burgdorferi
GDSVKAASKE

SEQ ID NO: 18203 - protein, 10 aa, Borrelia Burgdorferi
DSVKAASKET

SEQ ID NO: 18204 - protein, 10 aa, Borrelia Burgdorferi
SVKAASKETP

SEQ ID NO: 18205 - protein, 10 aa, Borrelia Burgdorferi
VKAASKETPP

SEQ ID NO: 18206 - protein, 10 aa, Borrelia Burgdorferi
KAASKETPPA

SEQ ID NO: 18207 - protein, 10 aa, Borrelia Burgdorferi
AASKETPPAL

SEQ ID NO: 18208 - protein, 10 aa, Borrelia Burgdorferi
ASKETPPALN

SEQ ID NO: 18209 - protein, 10 aa, Borrelia Burgdorferi
SKETPPALNK

SEQ ID NO: 18210 - protein, 11 aa, Borrelia Burgdorferi
MRGSHHHHHHG

SEQ ID NO: 18211 - protein, 11 aa, Borrelia Burgdorferi
RGSHHHHHHGS

SEQ ID NO: 18212 - protein, 11 aa, Borrelia Burgdorferi
GSHHHHHHGSS

SEQ ID NO: 18213 - protein, 11 aa, Borrelia Burgdorferi
SHHHHHHGSSQ

SEQ ID NO: 18214 - protein, 11 aa, Borrelia Burgdorferi
HHHHHHGSSQV

SEQ ID NO: 18215 - protein, 11 aa, Borrelia Burgdorferi
HHHHHGSSQVA

SEQ ID NO: 18216 - protein, 11 aa, Borrelia Burgdorferi
HHHHGSSQVAD

SEQ ID NO: 18217 - protein, 11 aa, Borrelia Burgdorferi
HHHGSSQVADK

SEQ ID NO: 18218 - protein, 11 aa, Borrelia Burgdorferi
HHGSSQVADKD

SEQ ID NO: 18219 - protein, 11 aa, Borrelia Burgdorferi
HGSSQVADKDD

SEQ ID NO: 18220 - protein, 11 aa, Borrelia Burgdorferi
GSSQVADKDDP

SEQ ID NO: 18221 - protein, 11 aa, Borrelia Burgdorferi
SSQVADKDDPT

SEQ ID NO: 18222 - protein, 11 aa, Borrelia Burgdorferi
SQVADKDDPTN

SEQ ID NO: 18223 - protein, 11 aa, Borrelia Burgdorferi
QVADKDDPTNK

SEQ ID NO: 18224 - protein, 11 aa, Borrelia Burgdorferi
VADKDDPTNKF

SEQ ID NO: 18225 - protein, 11 aa, Borrelia Burgdorferi
ADKDDPTNKFY

SEQ ID NO: 18226 - protein, 11 aa, Borrelia Burgdorferi
DKDDPTNKFYQ

SEQ ID NO: 18227 - protein, 11 aa, Borrelia Burgdorferi
KDDPTNKFYQS

SEQ ID NO: 18228 - protein, 11 aa, Borrelia Burgdorferi
DDPTNKFYQSV

SEQ ID NO: 18229 - protein, 11 aa, Borrelia Burgdorferi
DPTNKFYQSVI

SEQ ID NO: 18230 - protein, 11 aa, Borrelia Burgdorferi
PTNKFYQSVIQ

SEQ ID NO: 18231 - protein, 11 aa, Borrelia Burgdorferi
TNKFYQSVIQL

SEQ ID NO: 18232 - protein, 11 aa, Borrelia Burgdorferi
NKFYQSVIQLG

SEQ ID NO: 18233 - protein, 11 aa, Borrelia Burgdorferi
KFYQSVIQLGN

SEQ ID NO: 18234 - protein, 11 aa, Borrelia Burgdorferi
FYQSVIQLGNG

SEQ ID NO: 18235 - protein, 11 aa, Borrelia Burgdorferi
YQSVIQLGNGF

SEQ ID NO: 18236 - protein, 11 aa, Borrelia Burgdorferi
QSVIQLGNGFL

SEQ ID NO: 18237 - protein, 11 aa, Borrelia Burgdorferi
SVIQLGNGFLD

SEQ ID NO: 18238 - protein, 11 aa, Borrelia Burgdorferi
VIQLGNGFLDV

SEQ ID NO: 18239 - protein, 11 aa, Borrelia Burgdorferi
IQLGNGFLDVF

SEQ ID NO: 18240 - protein, 11 aa, Borrelia Burgdorferi
QLGNGFLDVFT

SEQ ID NO: 18241 - protein, 11 aa, Borrelia Burgdorferi
LGNGFLDVFTS

SEQ ID NO: 18242 - protein, 11 aa, Borrelia Burgdorferi
GNGFLDVFTSF

SEQ ID NO: 18243 - protein, 11 aa, Borrelia Burgdorferi
NGFLDVFTSFG

SEQ ID NO: 18244 - protein, 11 aa, Borrelia Burgdorferi
GFLDVFTSFGG

SEQ ID NO: 18245 - protein, 11 aa, Borrelia Burgdorferi
FLDVFTSFGGL

SEQ ID NO: 18246 - protein, 11 aa, Borrelia Burgdorferi
LDVFTSFGGLV

SEQ ID NO: 18247 - protein, 11 aa, Borrelia Burgdorferi
DVFTSFGGLVA

SEQ ID NO: 18248 - protein, 11 aa, Borrelia Burgdorferi
VFTSFGGLVAE

SEQ ID NO: 18249 - protein, 11 aa, Borrelia Burgdorferi
FTSFGGLVAEA

SEQ ID NO: 18250 - protein, 11 aa, Borrelia Burgdorferi
TSFGGLVAEAF

SEQ ID NO: 18251 - protein, 11 aa, Borrelia Burgdorferi
SFGGLVAEAFG

SEQ ID NO: 18252 - protein, 11 aa, Borrelia Burgdorferi
FGGLVAEAFGF

SEQ ID NO: 18253 - protein, 11 aa, Borrelia Burgdorferi
GGLVAEAFGFK

SEQ ID NO: 18254 - protein, 11 aa, Borrelia Burgdorferi
GLVAEAFGFKS

SEQ ID NO: 18255 - protein, 11 aa, Borrelia Burgdorferi
LVAEAFGFKSD

SEQ ID NO: 18256 - protein, 11 aa, Borrelia Burgdorferi
VAEAFGFKSDP

SEQ ID NO: 18257 - protein, 11 aa, Borrelia Burgdorferi
AEAFGFKSDPK

SEQ ID NO: 18258 - protein, 11 aa, Borrelia Burgdorferi
EAFGFKSDPKK

SEQ ID NO: 18259 - protein, 11 aa, Borrelia Burgdorferi
AFGFKSDPKKS

SEQ ID NO: 18260 - protein, 11 aa, Borrelia Burgdorferi
FGFKSDPKKSD

SEQ ID NO: 18261 - protein, 11 aa, Borrelia Burgdorferi
GFKSDPKKSDV

SEQ ID NO: 18262 - protein, 11 aa, Borrelia Burgdorferi
FKSDPKKSDVK

SEQ ID NO: 18263 - protein, 11 aa, Borrelia Burgdorferi
KSDPKKSDVKT

SEQ ID NO: 18264 - protein, 11 aa, Borrelia Burgdorferi
SDPKKSDVKTY

SEQ ID NO: 18265 - protein, 11 aa, Borrelia Burgdorferi
DPKKSDVKTYF

SEQ ID NO: 18266 - protein, 11 aa, Borrelia Burgdorferi
PKKSDVKTYFT

SEQ ID NO: 18267 - protein, 11 aa, Borrelia Burgdorferi
KKSDVKTYFTT

SEQ ID NO: 18268 - protein, 11 aa, Borrelia Burgdorferi
KSDVKTYFTTV

SEQ ID NO: 18269 - protein, 11 aa, Borrelia Burgdorferi
SDVKTYFTTVA

SEQ ID NO: 18270 - protein, 11 aa, Borrelia Burgdorferi
DVKTYFTTVAA

SEQ ID NO: 18271 - protein, 11 aa, Borrelia Burgdorferi
VKTYFTTVAAK

SEQ ID NO: 18272 - protein, 11 aa, Borrelia Burgdorferi
KTYFTTVAAKL

SEQ ID NO: 18273 - protein, 11 aa, Borrelia Burgdorferi
TYFTTVAAKLE

SEQ ID NO: 18274 - protein, 11 aa, Borrelia Burgdorferi
YFTTVAAKLEK

SEQ ID NO: 18275 - protein, 11 aa, Borrelia Burgdorferi
FTTVAAKLEKT

SEQ ID NO: 18276 - protein, 11 aa, Borrelia Burgdorferi
TTVAAKLEKTK

SEQ ID NO: 18277 - protein, 11 aa, Borrelia Burgdorferi
TVAAKLEKTKT

SEQ ID NO: 18278 - protein, 11 aa, Borrelia Burgdorferi
VAAKLEKTKTD

SEQ ID NO: 18279 - protein, 11 aa, Borrelia Burgdorferi
AAKLEKTKTDL

SEQ ID NO: 18280 - protein, 11 aa, Borrelia Burgdorferi
AKLEKTKTDLN

SEQ ID NO: 18281 - protein, 11 aa, Borrelia Burgdorferi
KLEKTKTDLNS

SEQ ID NO: 18282 - protein, 11 aa, Borrelia Burgdorferi
LEKTKTDLNSL

SEQ ID NO: 18283 - protein, 11 aa, Borrelia Burgdorferi
EKTKTDLNSLP

SEQ ID NO: 18284 - protein, 11 aa, Borrelia Burgdorferi
KTKTDLNSLPK

SEQ ID NO: 18285 - protein, 11 aa, Borrelia Burgdorferi
TKTDLNSLPKE

SEQ ID NO: 18286 - protein, 11 aa, Borrelia Burgdorferi
KTDLNSLPKEK

SEQ ID NO: 18287 - protein, 11 aa, Borrelia Burgdorferi
TDLNSLPKEKS

SEQ ID NO: 18288 - protein, 11 aa, Borrelia Burgdorferi
DLNSLPKEKSD

SEQ ID NO: 18289 - protein, 11 aa, Borrelia Burgdorferi
LNSLPKEKSDI

SEQ ID NO: 18290 - protein, 11 aa, Borrelia Burgdorferi
NSLPKEKSDIS

SEQ ID NO: 18291 - protein, 11 aa, Borrelia Burgdorferi
SLPKEKSDISS

SEQ ID NO: 18292 - protein, 11 aa, Borrelia Burgdorferi
LPKEKSDISST

SEQ ID NO: 18293 - protein, 11 aa, Borrelia Burgdorferi
PKEKSDISSTT

SEQ ID NO: 18294 - protein, 11 aa, Borrelia Burgdorferi
KEKSDISSTTG

SEQ ID NO: 18295 - protein, 11 aa, Borrelia Burgdorferi
EKSDISSTTGK

SEQ ID NO: 18296 - protein, 11 aa, Borrelia Burgdorferi
KSDISSTTGKP

SEQ ID NO: 18297 - protein, 11 aa, Borrelia Burgdorferi
SDISSTTGKPD

SEQ ID NO: 18298 - protein, 11 aa, Borrelia Burgdorferi
DISSTTGKPDS

SEQ ID NO: 18299 - protein, 11 aa, Borrelia Burgdorferi
ISSTTGKPDST

SEQ ID NO: 18300 - protein, 11 aa, Borrelia Burgdorferi
SSTTGKPDSTG

SEQ ID NO: 18301 - protein, 11 aa, Borrelia Burgdorferi
STTGKPDSTGS

SEQ ID NO: 18302 - protein, 11 aa, Borrelia Burgdorferi
TTGKPDSTGSV

SEQ ID NO: 18303 - protein, 11 aa, Borrelia Burgdorferi
TGKPDSTGSVG

SEQ ID NO: 18304 - protein, 11 aa, Borrelia Burgdorferi
GKPDSTGSVGT

SEQ ID NO: 18305 - protein, 11 aa, Borrelia Burgdorferi
KPDSTGSVGTA

SEQ ID NO: 18306 - protein, 11 aa, Borrelia Burgdorferi
PDSTGSVGTAV

SEQ ID NO: 18307 - protein, 11 aa, Borrelia Burgdorferi
DSTGSVGTAVE

SEQ ID NO: 18308 - protein, 11 aa, Borrelia Burgdorferi
STGSVGTAVEG

SEQ ID NO: 18309 - protein, 11 aa, Borrelia Burgdorferi
TGSVGTAVEGA

SEQ ID NO: 18310 - protein, 11 aa, Borrelia Burgdorferi
GSVGTAVEGAI

SEQ ID NO: 18311 - protein, 11 aa, Borrelia Burgdorferi
SVGTAVEGAIK

SEQ ID NO: 18312 - protein, 11 aa, Borrelia Burgdorferi
VGTAVEGAIKE

SEQ ID NO: 18313 - protein, 11 aa, Borrelia Burgdorferi
GTAVEGAIKEV

SEQ ID NO: 18314 - protein, 11 aa, Borrelia Burgdorferi
TAVEGAIKEVS

SEQ ID NO: 18315 - protein, 11 aa, Borrelia Burgdorferi
AVEGAIKEVSE

SEQ ID NO: 18316 - protein, 11 aa, Borrelia Burgdorferi
VEGAIKEVSEL

SEQ ID NO: 18317 - protein, 11 aa, Borrelia Burgdorferi
EGAIKEVSELL

SEQ ID NO: 18318 - protein, 11 aa, Borrelia Burgdorferi
GAIKEVSELLD

SEQ ID NO: 18319 - protein, 11 aa, Borrelia Burgdorferi
AIKEVSELLDK

SEQ ID NO: 18320 - protein, 11 aa, Borrelia Burgdorferi
IKEVSELLDKL

SEQ ID NO: 18321 - protein, 11 aa, Borrelia Burgdorferi
KEVSELLDKLV

SEQ ID NO: 18322 - protein, 11 aa, Borrelia Burgdorferi
EVSELLDKLVK

SEQ ID NO: 18323 - protein, 11 aa, Borrelia Burgdorferi
VSELLDKLVKA

SEQ ID NO: 18324 - protein, 11 aa, Borrelia Burgdorferi
SELLDKLVKAV

SEQ ID NO: 18325 - protein, 11 aa, Borrelia Burgdorferi
ELLDKLVKAVK

SEQ ID NO: 18326 - protein, 11 aa, Borrelia Burgdorferi
LLDKLVKAVKT

SEQ ID NO: 18327 - protein, 11 aa, Borrelia Burgdorferi
LDKLVKAVKTA

SEQ ID NO: 18328 - protein, 11 aa, Borrelia Burgdorferi
DKLVKAVKTAE

SEQ ID NO: 18329 - protein, 11 aa, Borrelia Burgdorferi
KLVKAVKTAEG

SEQ ID NO: 18330 - protein, 11 aa, Borrelia Burgdorferi
LVKAVKTAEGA

SEQ ID NO: 18331 - protein, 11 aa, Borrelia Burgdorferi
VKAVKTAEGAS

SEQ ID NO: 18332 - protein, 11 aa, Borrelia Burgdorferi
KAVKTAEGASS

SEQ ID NO: 18333 - protein, 11 aa, Borrelia Burgdorferi
AVKTAEGASSG

SEQ ID NO: 18334 - protein, 11 aa, Borrelia Burgdorferi
VKTAEGASSGT

SEQ ID NO: 18335 - protein, 11 aa, Borrelia Burgdorferi
KTAEGASSGTA

SEQ ID NO: 18336 - protein, 11 aa, Borrelia Burgdorferi
TAEGASSGTAA

SEQ ID NO: 18337 - protein, 11 aa, Borrelia Burgdorferi
AEGASSGTAAI

SEQ ID NO: 18338 - protein, 11 aa, Borrelia Burgdorferi
EGASSGTAAIG

SEQ ID NO: 18339 - protein, 11 aa, Borrelia Burgdorferi
GASSGTAAIGE

SEQ ID NO: 18340 - protein, 11 aa, Borrelia Burgdorferi
ASSGTAAIGEV

SEQ ID NO: 18341 - protein, 11 aa, Borrelia Burgdorferi
SSGTAAIGEVV

SEQ ID NO: 18342 - protein, 11 aa, Borrelia Burgdorferi
SGTAAIGEVVA

SEQ ID NO: 18343 - protein, 11 aa, Borrelia Burgdorferi
GTAAIGEVVAD

SEQ ID NO: 18344 - protein, 11 aa, Borrelia Burgdorferi
TAAIGEVVADA

SEQ ID NO: 18345 - protein, 11 aa, Borrelia Burgdorferi
AAIGEVVADAD

SEQ ID NO: 18346 - protein, 11 aa, Borrelia Burgdorferi
AIGEVVADADA

SEQ ID NO: 18347 - protein, 11 aa, Borrelia Burgdorferi
IGEVVADADAA

SEQ ID NO: 18348 - protein, 11 aa, Borrelia Burgdorferi
GEVVADADAAK

SEQ ID NO: 18349 - protein, 11 aa, Borrelia Burgdorferi
EVVADADAAKV

SEQ ID NO: 18350 - protein, 11 aa, Borrelia Burgdorferi
VVADADAAKVA

SEQ ID NO: 18351 - protein, 11 aa, Borrelia Burgdorferi
VADADAAKVAD

SEQ ID NO: 18352 - protein, 11 aa, Borrelia Burgdorferi
ADADAAKVADK

SEQ ID NO: 18353 - protein, 11 aa, Borrelia Burgdorferi
DADAAKVADKA

SEQ ID NO: 18354 - protein, 11 aa, Borrelia Burgdorferi
ADAAKVADKAS

SEQ ID NO: 18355 - protein, 11 aa, Borrelia Burgdorferi
DAAKVADKASV

SEQ ID NO: 18356 - protein, 11 aa, Borrelia Burgdorferi
AAKVADKASVK

SEQ ID NO: 18357 - protein, 11 aa, Borrelia Burgdorferi
AKVADKASVKG

SEQ ID NO: 18358 - protein, 11 aa, Borrelia Burgdorferi
KVADKASVKGI

SEQ ID NO: 18359 - protein, 11 aa, Borrelia Burgdorferi
VADKASVKGIA

SEQ ID NO: 18360 - protein, 11 aa, Borrelia Burgdorferi
ADKASVKGIAK

SEQ ID NO: 18361 - protein, 11 aa, Borrelia Burgdorferi
DKASVKGIAKG

SEQ ID NO: 18362 - protein, 11 aa, Borrelia Burgdorferi
KASVKGIAKGI

SEQ ID NO: 18363 - protein, 11 aa, Borrelia Burgdorferi
ASVKGIAKGIK

SEQ ID NO: 18364 - protein, 11 aa, Borrelia Burgdorferi
SVKGIAKGIKE

SEQ ID NO: 18365 - protein, 11 aa, Borrelia Burgdorferi
VKGIAKGIKEI

SEQ ID NO: 18366 - protein, 11 aa, Borrelia Burgdorferi
KGIAKGIKEIV

SEQ ID NO: 18367 - protein, 11 aa, Borrelia Burgdorferi
GIAKGIKEIVE

SEQ ID NO: 18368 - protein, 11 aa, Borrelia Burgdorferi
IAKGIKEIVEA

SEQ ID NO: 18369 - protein, 11 aa, Borrelia Burgdorferi
AKGIKEIVEAA

SEQ ID NO: 18370 - protein, 11 aa, Borrelia Burgdorferi
KGIKEIVEAAG

SEQ ID NO: 18371 - protein, 11 aa, Borrelia Burgdorferi
GIKEIVEAAGG

SEQ ID NO: 18372 - protein, 11 aa, Borrelia Burgdorferi
IKEIVEAAGGS

SEQ ID NO: 18373 - protein, 11 aa, Borrelia Burgdorferi
KEIVEAAGGSE

SEQ ID NO: 18374 - protein, 11 aa, Borrelia Burgdorferi
EIVEAAGGSEK

SEQ ID NO: 18375 - protein, 11 aa, Borrelia Burgdorferi
IVEAAGGSEKL

SEQ ID NO: 18376 - protein, 11 aa, Borrelia Burgdorferi
VEAAGGSEKLK

SEQ ID NO: 18377 - protein, 11 aa, Borrelia Burgdorferi
EAAGGSEKLKA

SEQ ID NO: 18378 - protein, 11 aa, Borrelia Burgdorferi
AAGGSEKLKAV

SEQ ID NO: 18379 - protein, 11 aa, Borrelia Burgdorferi
AGGSEKLKAVA

SEQ ID NO: 18380 - protein, 11 aa, Borrelia Burgdorferi
GGSEKLKAVAA

SEQ ID NO: 18381 - protein, 11 aa, Borrelia Burgdorferi
GSEKLKAVAAA

SEQ ID NO: 18382 - protein, 11 aa, Borrelia Burgdorferi
SEKLKAVAAAK

SEQ ID NO: 18383 - protein, 11 aa, Borrelia Burgdorferi
EKLKAVAAAKG

SEQ ID NO: 18384 - protein, 11 aa, Borrelia Burgdorferi
KLKAVAAAKGE

SEQ ID NO: 18385 - protein, 11 aa, Borrelia Burgdorferi
LKAVAAAKGEN

SEQ ID NO: 18386 - protein, 11 aa, Borrelia Burgdorferi
KAVAAAKGENN

SEQ ID NO: 18387 - protein, 11 aa, Borrelia Burgdorferi
AVAAAKGENNK

SEQ ID NO: 18388 - protein, 11 aa, Borrelia Burgdorferi
VAAAKGENNKG

SEQ ID NO: 18389 - protein, 11 aa, Borrelia Burgdorferi
AAAKGENNKGA

SEQ ID NO: 18390 - protein, 11 aa, Borrelia Burgdorferi
AAKGENNKGAG

SEQ ID NO: 18391 - protein, 11 aa, Borrelia Burgdorferi
AKGENNKGAGK

SEQ ID NO: 18392 - protein, 11 aa, Borrelia Burgdorferi
KGENNKGAGKL

SEQ ID NO: 18393 - protein, 11 aa, Borrelia Burgdorferi
GENNKGAGKLF

SEQ ID NO: 18394 - protein, 11 aa, Borrelia Burgdorferi
ENNKGAGKLFG

SEQ ID NO: 18395 - protein, 11 aa, Borrelia Burgdorferi
NNKGAGKLFGK

SEQ ID NO: 18396 - protein, 11 aa, Borrelia Burgdorferi
NKGAGKLFGKA

SEQ ID NO: 18397 - protein, 11 aa, Borrelia Burgdorferi
KGAGKLFGKAG

SEQ ID NO: 18398 - protein, 11 aa, Borrelia Burgdorferi
GAGKLFGKAGA

SEQ ID NO: 18399 - protein, 11 aa, Borrelia Burgdorferi
AGKLFGKAGAA

SEQ ID NO: 18400 - protein, 11 aa, Borrelia Burgdorferi
GKLFGKAGAAA

SEQ ID NO: 18401 - protein, 11 aa, Borrelia Burgdorferi
KLFGKAGAAAH

SEQ ID NO: 18402 - protein, 11 aa, Borrelia Burgdorferi
LFGKAGAAAHG

SEQ ID NO: 18403 - protein, 11 aa, Borrelia Burgdorferi
FGKAGAAAHGD

SEQ ID NO: 18404 - protein, 11 aa, Borrelia Burgdorferi
GKAGAAAHGDS

SEQ ID NO: 18405 - protein, 11 aa, Borrelia Burgdorferi
KAGAAAHGDSE

SEQ ID NO: 18406 - protein, 11 aa, Borrelia Burgdorferi
AGAAAHGDSEA

SEQ ID NO: 18407 - protein, 11 aa, Borrelia Burgdorferi
GAAAHGDSEAA

SEQ ID NO: 18408 - protein, 11 aa, Borrelia Burgdorferi
AAAHGDSEAAS

SEQ ID NO: 18409 - protein, 11 aa, Borrelia Burgdorferi
AAHGDSEAASK

SEQ ID NO: 18410 - protein, 11 aa, Borrelia Burgdorferi
AHGDSEAASKA

SEQ ID NO: 18411 - protein, 11 aa, Borrelia Burgdorferi
HGDSEAASKAA

SEQ ID NO: 18412 - protein, 11 aa, Borrelia Burgdorferi
GDSEAASKAAG

SEQ ID NO: 18413 - protein, 11 aa, Borrelia Burgdorferi
DSEAASKAAGA

SEQ ID NO: 18414 - protein, 11 aa, Borrelia Burgdorferi
SEAASKAAGAV

SEQ ID NO: 18415 - protein, 11 aa, Borrelia Burgdorferi
EAASKAAGAVS

SEQ ID NO: 18416 - protein, 11 aa, Borrelia Burgdorferi
AASKAAGAVSA

SEQ ID NO: 18417 - protein, 11 aa, Borrelia Burgdorferi
ASKAAGAVSAV

SEQ ID NO: 18418 - protein, 11 aa, Borrelia Burgdorferi
SKAAGAVSAVS

SEQ ID NO: 18419 - protein, 11 aa, Borrelia Burgdorferi
KAAGAVSAVSG

SEQ ID NO: 18420 - protein, 11 aa, Borrelia Burgdorferi
AAGAVSAVSGE

SEQ ID NO: 18421 - protein, 11 aa, Borrelia Burgdorferi
AGAVSAVSGEQ

SEQ ID NO: 18422 - protein, 11 aa, Borrelia Burgdorferi
GAVSAVSGEQI

SEQ ID NO: 18423 - protein, 11 aa, Borrelia Burgdorferi
AVSAVSGEQIL

SEQ ID NO: 18424 - protein, 11 aa, Borrelia Burgdorferi
VSAVSGEQILS

SEQ ID NO: 18425 - protein, 11 aa, Borrelia Burgdorferi
SAVSGEQILSA

SEQ ID NO: 18426 - protein, 11 aa, Borrelia Burgdorferi
AVSGEQILSAI

SEQ ID NO: 18427 - protein, 11 aa, Borrelia Burgdorferi
VSGEQILSAIV

SEQ ID NO: 18428 - protein, 11 aa, Borrelia Burgdorferi
SGEQILSAIVT

SEQ ID NO: 18429 - protein, 11 aa, Borrelia Burgdorferi
GEQILSAIVTA

SEQ ID NO: 18430 - protein, 11 aa, Borrelia Burgdorferi
EQILSAIVTAA

SEQ ID NO: 18431 - protein, 11 aa, Borrelia Burgdorferi
QILSAIVTAAD

SEQ ID NO: 18432 - protein, 11 aa, Borrelia Burgdorferi
ILSAIVTAADA

SEQ ID NO: 18433 - protein, 11 aa, Borrelia Burgdorferi
LSAIVTAADAA

SEQ ID NO: 18434 - protein, 11 aa, Borrelia Burgdorferi
SAIVTAADAAE

SEQ ID NO: 18435 - protein, 11 aa, Borrelia Burgdorferi
AIVTAADAAEQ

SEQ ID NO: 18436 - protein, 11 aa, Borrelia Burgdorferi
IVTAADAAEQD

SEQ ID NO: 18437 - protein, 11 aa, Borrelia Burgdorferi
VTAADAAEQDG

SEQ ID NO: 18438 - protein, 11 aa, Borrelia Burgdorferi
TAADAAEQDGK

SEQ ID NO: 18439 - protein, 11 aa, Borrelia Burgdorferi
AADAAEQDGKK

SEQ ID NO: 18440 - protein, 11 aa, Borrelia Burgdorferi
ADAAEQDGKKP

SEQ ID NO: 18441 - protein, 11 aa, Borrelia Burgdorferi
DAAEQDGKKPE

SEQ ID NO: 18442 - protein, 11 aa, Borrelia Burgdorferi
AAEQDGKKPEE

SEQ ID NO: 18443 - protein, 11 aa, Borrelia Burgdorferi
AEQDGKKPEEA

SEQ ID NO: 18444 - protein, 11 aa, Borrelia Burgdorferi
EQDGKKPEEAK

SEQ ID NO: 18445 - protein, 11 aa, Borrelia Burgdorferi
QDGKKPEEAKN

SEQ ID NO: 18446 - protein, 11 aa, Borrelia Burgdorferi
DGKKPEEAKNP

SEQ ID NO: 18447 - protein, 11 aa, Borrelia Burgdorferi
GKKPEEAKNPI

SEQ ID NO: 18448 - protein, 11 aa, Borrelia Burgdorferi
KKPEEAKNPIA

SEQ ID NO: 18449 - protein, 11 aa, Borrelia Burgdorferi
KPEEAKNPIAA

SEQ ID NO: 18450 - protein, 11 aa, Borrelia Burgdorferi
PEEAKNPIAAA

SEQ ID NO: 18451 - protein, 11 aa, Borrelia Burgdorferi
EEAKNPIAAAI

SEQ ID NO: 18452 - protein, 11 aa, Borrelia Burgdorferi
EAKNPIAAAIG

SEQ ID NO: 18453 - protein, 11 aa, Borrelia Burgdorferi
AKNPIAAAIGD

SEQ ID NO: 18454 - protein, 11 aa, Borrelia Burgdorferi
KNPIAAAIGDK

SEQ ID NO: 18455 - protein, 11 aa, Borrelia Burgdorferi
NPIAAAIGDKD

SEQ ID NO: 18456 - protein, 11 aa, Borrelia Burgdorferi
PIAAAIGDKDG

SEQ ID NO: 18457 - protein, 11 aa, Borrelia Burgdorferi
IAAAIGDKDGG

SEQ ID NO: 18458 - protein, 11 aa, Borrelia Burgdorferi
AAAIGDKDGGA

SEQ ID NO: 18459 - protein, 11 aa, Borrelia Burgdorferi
AAIGDKDGGAE

SEQ ID NO: 18460 - protein, 11 aa, Borrelia Burgdorferi
AIGDKDGGAEF

SEQ ID NO: 18461 - protein, 11 aa, Borrelia Burgdorferi
IGDKDGGAEFG

SEQ ID NO: 18462 - protein, 11 aa, Borrelia Burgdorferi
GDKDGGAEFGQ

SEQ ID NO: 18463 - protein, 11 aa, Borrelia Burgdorferi
DKDGGAEFGQD

SEQ ID NO: 18464 - protein, 11 aa, Borrelia Burgdorferi
KDGGAEFGQDE

SEQ ID NO: 18465 - protein, 11 aa, Borrelia Burgdorferi
  Xaa can be any naturally occurring amino acid
  VARIANT 11: Xaa = Any Amino Acid
DGGAEFGQDEX

SEQ ID NO: 18466 - protein, 11 aa, Borrelia Burgdorferi
  Xaa can be any naturally occurring amino acid
  VARIANT 10: Xaa = Any Amino Acid
GGAEFGQDEXK

SEQ ID NO: 18467 - protein, 11 aa, Borrelia Burgdorferi
  Xaa can be any naturally occurring amino acid
  VARIANT 9: Xaa = Any Amino Acid
GAEFGQDEXKK

SEQ ID NO: 18468 - protein, 11 aa, Borrelia Burgdorferi
  Xaa can be any naturally occurring amino acid
  VARIANT 8: Xaa = Any Amino Acid
AEFGQDEXKKD

SEQ ID NO: 18469 - protein, 11 aa, Borrelia Burgdorferi
  Xaa can be any naturally occurring amino acid
  VARIANT 7: Xaa = Any Amino Acid
EFGQDEXKKDD

SEQ ID NO: 18470 - protein, 11 aa, Borrelia Burgdorferi
  Xaa can be any naturally occurring amino acid
  VARIANT 6: Xaa = Any Amino Acid
FGQDEXKKDDQ

SEQ ID NO: 18471 - protein, 11 aa, Borrelia Burgdorferi
  Xaa can be any naturally occurring amino acid
  VARIANT 5: Xaa = Any Amino Acid
GQDEXKKDDQI

SEQ ID NO: 18472 - protein, 11 aa, Borrelia Burgdorferi
  Xaa can be any naturally occurring amino acid
  VARIANT 4: Xaa = Any Amino Acid
QDEXKKDDQIA

SEQ ID NO: 18473 - protein, 11 aa, Borrelia Burgdorferi
  Xaa can be any naturally occurring amino acid
  VARIANT 3: Xaa = Any Amino Acid
DEXKKDDQIAA

SEQ ID NO: 18474 - protein, 11 aa, Borrelia Burgdorferi
  Xaa can be any naturally occurring amino acid
  VARIANT 2: Xaa = Any Amino Acid
EXKKDDQIAAA

SEQ ID NO: 18475 - protein, 11 aa, Borrelia Burgdorferi
  Xaa can be any naturally occurring amino acid
  VARIANT 1: Xaa = Any Amino Acid
XKKDDQIAAAI

SEQ ID NO: 18476 - protein, 11 aa, Borrelia Burgdorferi
KKDDQIAAAIA

SEQ ID NO: 18477 - protein, 11 aa, Borrelia Burgdorferi
KDDQIAAAIAL

SEQ ID NO: 18478 - protein, 11 aa, Borrelia Burgdorferi
DDQIAAAIALR

SEQ ID NO: 18479 - protein, 11 aa, Borrelia Burgdorferi
DQIAAAIALRG

SEQ ID NO: 18480 - protein, 11 aa, Borrelia Burgdorferi
  Xaa can be any naturally occurring amino acid
  VARIANT 11: Xaa = Any Amino Acid
QIAAAIALRGX

SEQ ID NO: 18481 - protein, 11 aa, Borrelia Burgdorferi
  Xaa can be any naturally occurring amino acid
  VARIANT 10: Xaa = Any Amino Acid
IAAAIALRGXA

SEQ ID NO: 18482 - protein, 11 aa, Borrelia Burgdorferi
  Xaa can be any naturally occurring amino acid
  VARIANT 9: Xaa = Any Amino Acid
AAAIALRGXAK

SEQ ID NO: 18483 - protein, 11 aa, Borrelia Burgdorferi
  Xaa can be any naturally occurring amino acid
  VARIANT 8: Xaa = Any Amino Acid
AAIALRGXAKD

SEQ ID NO: 18484 - protein, 11 aa, Borrelia Burgdorferi
  Xaa can be any naturally occurring amino acid
  VARIANT 7: Xaa = Any Amino Acid
AIALRGXAKDG

SEQ ID NO: 18485 - protein, 11 aa, Borrelia Burgdorferi
  Xaa can be any naturally occurring amino acid
  VARIANT 6: Xaa = Any Amino Acid
IALRGXAKDGK

SEQ ID NO: 18486 - protein, 11 aa, Borrelia Burgdorferi
  Xaa can be any naturally occurring amino acid
  VARIANT 5: Xaa = Any Amino Acid
ALRGXAKDGKF

SEQ ID NO: 18487 - protein, 11 aa, Borrelia Burgdorferi
  Xaa can be any naturally occurring amino acid
  VARIANT 4: Xaa = Any Amino Acid
LRGXAKDGKFA

SEQ ID NO: 18488 - protein, 11 aa, Borrelia Burgdorferi
  Xaa can be any naturally occurring amino acid
  VARIANT 3: Xaa = Any Amino Acid
RGXAKDGKFAV

SEQ ID NO: 18489 - protein, 11 aa, Borrelia Burgdorferi
  Xaa can be any naturally occurring amino acid
  VARIANT 2: Xaa = Any Amino Acid
GXAKDGKFAVK

SEQ ID NO: 18490 - protein, 11 aa, Borrelia Burgdorferi
  Xaa can be any naturally occurring amino acid
  VARIANT 1: Xaa = Any Amino Acid
XAKDGKFAVKD

SEQ ID NO: 18491 - protein, 11 aa, Borrelia Burgdorferi
AKDGKFAVKDG

SEQ ID NO: 18492 - protein, 11 aa, Borrelia Burgdorferi
KDGKFAVKDGE

SEQ ID NO: 18493 - protein, 11 aa, Borrelia Burgdorferi
DGKFAVKDGEK

SEQ ID NO: 18494 - protein, 11 aa, Borrelia Burgdorferi
GKFAVKDGEKE

SEQ ID NO: 18495 - protein, 11 aa, Borrelia Burgdorferi
KFAVKDGEKEK

SEQ ID NO: 18496 - protein, 11 aa, Borrelia Burgdorferi
FAVKDGEKEKA

SEQ ID NO: 18497 - protein, 11 aa, Borrelia Burgdorferi
AVKDGEKEKAE

SEQ ID NO: 18498 - protein, 11 aa, Borrelia Burgdorferi
VKDGEKEKAEG

SEQ ID NO: 18499 - protein, 11 aa, Borrelia Burgdorferi
KDGEKEKAEGA

SEQ ID NO: 18500 - protein, 11 aa, Borrelia Burgdorferi
DGEKEKAEGAI

SEQ ID NO: 18501 - protein, 11 aa, Borrelia Burgdorferi
GEKEKAEGAIK

SEQ ID NO: 18502 - protein, 11 aa, Borrelia Burgdorferi
EKEKAEGAIKG

SEQ ID NO: 18503 - protein, 11 aa, Borrelia Burgdorferi
KEKAEGAIKGA

SEQ ID NO: 18504 - protein, 11 aa, Borrelia Burgdorferi
EKAEGAIKGAA

SEQ ID NO: 18505 - protein, 11 aa, Borrelia Burgdorferi
KAEGAIKGAAE

SEQ ID NO: 18506 - protein, 11 aa, Borrelia Burgdorferi
AEGAIKGAAES

SEQ ID NO: 18507 - protein, 11 aa, Borrelia Burgdorferi
EGAIKGAAESA

SEQ ID NO: 18508 - protein, 11 aa, Borrelia Burgdorferi
GAIKGAAESAV

SEQ ID NO: 18509 - protein, 11 aa, Borrelia Burgdorferi
AIKGAAESAVR

SEQ ID NO: 18510 - protein, 11 aa, Borrelia Burgdorferi
IKGAAESAVRK

SEQ ID NO: 18511 - protein, 11 aa, Borrelia Burgdorferi
KGAAESAVRKV

SEQ ID NO: 18512 - protein, 11 aa, Borrelia Burgdorferi
GAAESAVRKVL

SEQ ID NO: 18513 - protein, 11 aa, Borrelia Burgdorferi
AAESAVRKVLG

SEQ ID NO: 18514 - protein, 11 aa, Borrelia Burgdorferi
AESAVRKVLGA

SEQ ID NO: 18515 - protein, 11 aa, Borrelia Burgdorferi
ESAVRKVLGAI

SEQ ID NO: 18516 - protein, 11 aa, Borrelia Burgdorferi
SAVRKVLGAIT

SEQ ID NO: 18517 - protein, 11 aa, Borrelia Burgdorferi
AVRKVLGAITG

SEQ ID NO: 18518 - protein, 11 aa, Borrelia Burgdorferi
VRKVLGAITGL

SEQ ID NO: 18519 - protein, 11 aa, Borrelia Burgdorferi
RKVLGAITGLI

SEQ ID NO: 18520 - protein, 11 aa, Borrelia Burgdorferi
KVLGAITGLIG

SEQ ID NO: 18521 - protein, 11 aa, Borrelia Burgdorferi
VLGAITGLIGD

SEQ ID NO: 18522 - protein, 11 aa, Borrelia Burgdorferi
LGAITGLIGDA

SEQ ID NO: 18523 - protein, 11 aa, Borrelia Burgdorferi
GAITGLIGDAV

SEQ ID NO: 18524 - protein, 11 aa, Borrelia Burgdorferi
AITGLIGDAVS

SEQ ID NO: 18525 - protein, 11 aa, Borrelia Burgdorferi
ITGLIGDAVSS

SEQ ID NO: 18526 - protein, 11 aa, Borrelia Burgdorferi
TGLIGDAVSSG

SEQ ID NO: 18527 - protein, 11 aa, Borrelia Burgdorferi
GLIGDAVSSGL

SEQ ID NO: 18528 - protein, 11 aa, Borrelia Burgdorferi
LIGDAVSSGLR

SEQ ID NO: 18529 - protein, 11 aa, Borrelia Burgdorferi
IGDAVSSGLRK

SEQ ID NO: 18530 - protein, 11 aa, Borrelia Burgdorferi
GDAVSSGLRKV

SEQ ID NO: 18531 - protein, 11 aa, Borrelia Burgdorferi
DAVSSGLRKVG

SEQ ID NO: 18532 - protein, 11 aa, Borrelia Burgdorferi
AVSSGLRKVGD

SEQ ID NO: 18533 - protein, 11 aa, Borrelia Burgdorferi
VSSGLRKVGDS

SEQ ID NO: 18534 - protein, 11 aa, Borrelia Burgdorferi
SSGLRKVGDSV

SEQ ID NO: 18535 - protein, 11 aa, Borrelia Burgdorferi
SGLRKVGDSVK

SEQ ID NO: 18536 - protein, 11 aa, Borrelia Burgdorferi
GLRKVGDSVKA

SEQ ID NO: 18537 - protein, 11 aa, Borrelia Burgdorferi
LRKVGDSVKAA

SEQ ID NO: 18538 - protein, 11 aa, Borrelia Burgdorferi
RKVGDSVKAAS

SEQ ID NO: 18539 - protein, 11 aa, Borrelia Burgdorferi
KVGDSVKAASK

SEQ ID NO: 18540 - protein, 11 aa, Borrelia Burgdorferi
VGDSVKAASKE

SEQ ID NO: 18541 - protein, 11 aa, Borrelia Burgdorferi
GDSVKAASKET

SEQ ID NO: 18542 - protein, 11 aa, Borrelia Burgdorferi
DSVKAASKETP

SEQ ID NO: 18543 - protein, 11 aa, Borrelia Burgdorferi
SVKAASKETPP

SEQ ID NO: 18544 - protein, 11 aa, Borrelia Burgdorferi
VKAASKETPPA

SEQ ID NO: 18545 - protein, 11 aa, Borrelia Burgdorferi
KAASKETPPAL

SEQ ID NO: 18546 - protein, 11 aa, Borrelia Burgdorferi
AASKETPPALN

SEQ ID NO: 18547 - protein, 11 aa, Borrelia Burgdorferi
ASKETPPALNK

SEQ ID NO: 18548 - protein, 8 aa, Borrelia burgdorferi
MKKISLLI

SEQ ID NO: 18549 - protein, 8 aa, Borrelia burgdorferi
KKISLLIF

SEQ ID NO: 18550 - protein, 8 aa, Borrelia burgdorferi
KISLLIFL

SEQ ID NO: 18551 - protein, 8 aa, Borrelia burgdorferi
ISLLIFLF

SEQ ID NO: 18552 - protein, 8 aa, Borrelia burgdorferi
SLLIFLFL

SEQ ID NO: 18553 - protein, 8 aa, Borrelia burgdorferi
LLIFLFLF

SEQ ID NO: 18554 - protein, 8 aa, Borrelia burgdorferi
LIFLFLFV

SEQ ID NO: 18555 - protein, 8 aa, Borrelia burgdorferi
IFLFLFVV

SEQ ID NO: 18556 - protein, 8 aa, Borrelia burgdorferi
FLFLFVVS

SEQ ID NO: 18557 - protein, 8 aa, Borrelia burgdorferi
LFLFVVSL

SEQ ID NO: 18558 - protein, 8 aa, Borrelia burgdorferi
FLFVVSLS

SEQ ID NO: 18559 - protein, 8 aa, Borrelia burgdorferi
LFVVSLSA

SEQ ID NO: 18560 - protein, 8 aa, Borrelia burgdorferi
FVVSLSAN

SEQ ID NO: 18561 - protein, 8 aa, Borrelia burgdorferi
VVSLSANI

SEQ ID NO: 18562 - protein, 8 aa, Borrelia burgdorferi
VSLSANIE

SEQ ID NO: 18563 - protein, 8 aa, Borrelia burgdorferi
SLSANIEE

SEQ ID NO: 18564 - protein, 8 aa, Borrelia burgdorferi
LSANIEEN

SEQ ID NO: 18565 - protein, 8 aa, Borrelia burgdorferi
SANIEENY

SEQ ID NO: 18566 - protein, 8 aa, Borrelia burgdorferi
ANIEENYT

SEQ ID NO: 18567 - protein, 8 aa, Borrelia burgdorferi
NIEENYTE

SEQ ID NO: 18568 - protein, 8 aa, Borrelia burgdorferi
IEENYTET

SEQ ID NO: 18569 - protein, 8 aa, Borrelia burgdorferi
EENYTETK

SEQ ID NO: 18570 - protein, 8 aa, Borrelia burgdorferi
ENYTETKR

SEQ ID NO: 18571 - protein, 8 aa, Borrelia burgdorferi
NYTETKRA

SEQ ID NO: 18572 - protein, 8 aa, Borrelia burgdorferi
YTETKRAF

SEQ ID NO: 18573 - protein, 8 aa, Borrelia burgdorferi
TETKRAFS

SEQ ID NO: 18574 - protein, 8 aa, Borrelia burgdorferi
ETKRAFSK

SEQ ID NO: 18575 - protein, 8 aa, Borrelia burgdorferi
TKRAFSKE

SEQ ID NO: 18576 - protein, 8 aa, Borrelia burgdorferi
KRAFSKED

SEQ ID NO: 18577 - protein, 8 aa, Borrelia burgdorferi
RAFSKEDF

SEQ ID NO: 18578 - protein, 8 aa, Borrelia burgdorferi
AFSKEDFN

SEQ ID NO: 18579 - protein, 8 aa, Borrelia burgdorferi
FSKEDFNL

SEQ ID NO: 18580 - protein, 8 aa, Borrelia burgdorferi
SKEDFNLI

SEQ ID NO: 18581 - protein, 8 aa, Borrelia burgdorferi
KEDFNLIN

SEQ ID NO: 18582 - protein, 8 aa, Borrelia burgdorferi
EDFNLINK

SEQ ID NO: 18583 - protein, 8 aa, Borrelia burgdorferi
DFNLINKR

SEQ ID NO: 18584 - protein, 8 aa, Borrelia burgdorferi
FNLINKRL

SEQ ID NO: 18585 - protein, 8 aa, Borrelia burgdorferi
NLINKRLD

SEQ ID NO: 18586 - protein, 8 aa, Borrelia burgdorferi
LINKRLDN

SEQ ID NO: 18587 - protein, 8 aa, Borrelia burgdorferi
INKRLDNY

SEQ ID NO: 18588 - protein, 8 aa, Borrelia burgdorferi
NKRLDNYD

SEQ ID NO: 18589 - protein, 8 aa, Borrelia burgdorferi
KRLDNYDF

SEQ ID NO: 18590 - protein, 8 aa, Borrelia burgdorferi
RLDNYDFK

SEQ ID NO: 18591 - protein, 8 aa, Borrelia burgdorferi
LDNYDFKN

SEQ ID NO: 18592 - protein, 8 aa, Borrelia burgdorferi
DNYDFKNE

SEQ ID NO: 18593 - protein, 8 aa, Borrelia burgdorferi
NYDFKNEY

SEQ ID NO: 18594 - protein, 8 aa, Borrelia burgdorferi
YDFKNEYE

SEQ ID NO: 18595 - protein, 8 aa, Borrelia burgdorferi
DFKNEYEK

SEQ ID NO: 18596 - protein, 8 aa, Borrelia burgdorferi
FKNEYEKS

SEQ ID NO: 18597 - protein, 8 aa, Borrelia burgdorferi
KNEYEKSH

SEQ ID NO: 18598 - protein, 8 aa, Borrelia burgdorferi
NEYEKSHV

SEQ ID NO: 18599 - protein, 8 aa, Borrelia burgdorferi
EYEKSHVF

SEQ ID NO: 18600 - protein, 8 aa, Borrelia burgdorferi
YEKSHVFS

SEQ ID NO: 18601 - protein, 8 aa, Borrelia burgdorferi
EKSHVFSD

SEQ ID NO: 18602 - protein, 8 aa, Borrelia burgdorferi
KSHVFSDA

SEQ ID NO: 18603 - protein, 8 aa, Borrelia burgdorferi
SHVFSDAP

SEQ ID NO: 18604 - protein, 8 aa, Borrelia burgdorferi
HVFSDAPR

SEQ ID NO: 18605 - protein, 8 aa, Borrelia burgdorferi
VFSDAPRI

SEQ ID NO: 18606 - protein, 8 aa, Borrelia burgdorferi
FSDAPRIR

SEQ ID NO: 18607 - protein, 8 aa, Borrelia burgdorferi
SDAPRIRG

SEQ ID NO: 18608 - protein, 8 aa, Borrelia burgdorferi
DAPRIRGD

SEQ ID NO: 18609 - protein, 8 aa, Borrelia burgdorferi
APRIRGDL

SEQ ID NO: 18610 - protein, 8 aa, Borrelia burgdorferi
PRIRGDLR

SEQ ID NO: 18611 - protein, 8 aa, Borrelia burgdorferi
RIRGDLRK

SEQ ID NO: 18612 - protein, 8 aa, Borrelia burgdorferi
IRGDLRKI

SEQ ID NO: 18613 - protein, 8 aa, Borrelia burgdorferi
RGDLRKIG

SEQ ID NO: 18614 - protein, 8 aa, Borrelia burgdorferi
GDLRKIGI

SEQ ID NO: 18615 - protein, 8 aa, Borrelia burgdorferi
DLRKIGIK

SEQ ID NO: 18616 - protein, 8 aa, Borrelia burgdorferi
LRKIGIKE

SEQ ID NO: 18617 - protein, 8 aa, Borrelia burgdorferi
RKIGIKEK

SEQ ID NO: 18618 - protein, 8 aa, Borrelia burgdorferi
KIGIKEKS

SEQ ID NO: 18619 - protein, 8 aa, Borrelia burgdorferi
IGIKEKSV

SEQ ID NO: 18620 - protein, 8 aa, Borrelia burgdorferi
GIKEKSVF

SEQ ID NO: 18621 - protein, 8 aa, Borrelia burgdorferi
IKEKSVFL

SEQ ID NO: 18622 - protein, 8 aa, Borrelia burgdorferi
KEKSVFLD

SEQ ID NO: 18623 - protein, 8 aa, Borrelia burgdorferi
EKSVFLDA

SEQ ID NO: 18624 - protein, 8 aa, Borrelia burgdorferi
KSVFLDAL

SEQ ID NO: 18625 - protein, 8 aa, Borrelia burgdorferi
SVFLDALE

SEQ ID NO: 18626 - protein, 8 aa, Borrelia burgdorferi
VFLDALEA

SEQ ID NO: 18627 - protein, 8 aa, Borrelia burgdorferi
FLDALEAI

SEQ ID NO: 18628 - protein, 8 aa, Borrelia burgdorferi
LDALEAIE

SEQ ID NO: 18629 - protein, 8 aa, Borrelia burgdorferi
DALEAIEY

SEQ ID NO: 18630 - protein, 8 aa, Borrelia burgdorferi
ALEAIEYL

SEQ ID NO: 18631 - protein, 8 aa, Borrelia burgdorferi
LEAIEYLI

SEQ ID NO: 18632 - protein, 8 aa, Borrelia burgdorferi
EAIEYLIK

SEQ ID NO: 18633 - protein, 8 aa, Borrelia burgdorferi
AIEYLIKI

SEQ ID NO: 18634 - protein, 8 aa, Borrelia burgdorferi
IEYLIKIK

SEQ ID NO: 18635 - protein, 8 aa, Borrelia burgdorferi
EYLIKIKI

SEQ ID NO: 18636 - protein, 8 aa, Borrelia burgdorferi
YLIKIKIS

SEQ ID NO: 18637 - protein, 8 aa, Borrelia burgdorferi
LIKIKIST

SEQ ID NO: 18638 - protein, 8 aa, Borrelia burgdorferi
IKIKISTD

SEQ ID NO: 18639 - protein, 8 aa, Borrelia burgdorferi
KIKISTDS

SEQ ID NO: 18640 - protein, 8 aa, Borrelia burgdorferi
IKISTDSI

SEQ ID NO: 18641 - protein, 8 aa, Borrelia burgdorferi
KISTDSIF

SEQ ID NO: 18642 - protein, 8 aa, Borrelia burgdorferi
ISTDSIFL

SEQ ID NO: 18643 - protein, 8 aa, Borrelia burgdorferi
STDSIFLS

SEQ ID NO: 18644 - protein, 8 aa, Borrelia burgdorferi
TDSIFLSE

SEQ ID NO: 18645 - protein, 8 aa, Borrelia burgdorferi
DSIFLSED

SEQ ID NO: 18646 - protein, 8 aa, Borrelia burgdorferi
SIFLSEDM

SEQ ID NO: 18647 - protein, 8 aa, Borrelia burgdorferi
IFLSEDMI

SEQ ID NO: 18648 - protein, 8 aa, Borrelia burgdorferi
FLSEDMIR

SEQ ID NO: 18649 - protein, 8 aa, Borrelia burgdorferi
LSEDMIRL

SEQ ID NO: 18650 - protein, 8 aa, Borrelia burgdorferi
SEDMIRLI

SEQ ID NO: 18651 - protein, 8 aa, Borrelia burgdorferi
EDMIRLIG

SEQ ID NO: 18652 - protein, 8 aa, Borrelia burgdorferi
DMIRLIGS

SEQ ID NO: 18653 - protein, 8 aa, Borrelia burgdorferi
MIRLIGSY

SEQ ID NO: 18654 - protein, 8 aa, Borrelia burgdorferi
IRLIGSYP

SEQ ID NO: 18655 - protein, 8 aa, Borrelia burgdorferi
RLIGSYPD

SEQ ID NO: 18656 - protein, 8 aa, Borrelia burgdorferi
LIGSYPDS

SEQ ID NO: 18657 - protein, 8 aa, Borrelia burgdorferi
IGSYPDSI

SEQ ID NO: 18658 - protein, 8 aa, Borrelia burgdorferi
GSYPDSIF

SEQ ID NO: 18659 - protein, 8 aa, Borrelia burgdorferi
SYPDSIFN

SEQ ID NO: 18660 - protein, 8 aa, Borrelia burgdorferi
YPDSIFNY

SEQ ID NO: 18661 - protein, 8 aa, Borrelia burgdorferi
PDSIFNYL

SEQ ID NO: 18662 - protein, 8 aa, Borrelia burgdorferi
DSIFNYLI

SEQ ID NO: 18663 - protein, 8 aa, Borrelia burgdorferi
SIFNYLIQ

SEQ ID NO: 18664 - protein, 8 aa, Borrelia burgdorferi
IFNYLIQL

SEQ ID NO: 18665 - protein, 8 aa, Borrelia burgdorferi
FNYLIQLN

SEQ ID NO: 18666 - protein, 8 aa, Borrelia burgdorferi
NYLIQLNS

SEQ ID NO: 18667 - protein, 8 aa, Borrelia burgdorferi
YLIQLNSD

SEQ ID NO: 18668 - protein, 8 aa, Borrelia burgdorferi
LIQLNSDK

SEQ ID NO: 18669 - protein, 8 aa, Borrelia burgdorferi
IQLNSDKI

SEQ ID NO: 18670 - protein, 8 aa, Borrelia burgdorferi
QLNSDKID

SEQ ID NO: 18671 - protein, 8 aa, Borrelia burgdorferi
LNSDKIDY

SEQ ID NO: 18672 - protein, 8 aa, Borrelia burgdorferi
NSDKIDYA

SEQ ID NO: 18673 - protein, 8 aa, Borrelia burgdorferi
SDKIDYAE

SEQ ID NO: 18674 - protein, 8 aa, Borrelia burgdorferi
DKIDYAEK

SEQ ID NO: 18675 - protein, 8 aa, Borrelia burgdorferi
KIDYAEKY

SEQ ID NO: 18676 - protein, 8 aa, Borrelia burgdorferi
IDYAEKYG

SEQ ID NO: 18677 - protein, 8 aa, Borrelia burgdorferi
DYAEKYGD

SEQ ID NO: 18678 - protein, 8 aa, Borrelia burgdorferi
YAEKYGDN

SEQ ID NO: 18679 - protein, 8 aa, Borrelia burgdorferi
AEKYGDNA

SEQ ID NO: 18680 - protein, 8 aa, Borrelia burgdorferi
EKYGDNAR

SEQ ID NO: 18681 - protein, 8 aa, Borrelia burgdorferi
KYGDNARN

SEQ ID NO: 18682 - protein, 8 aa, Borrelia burgdorferi
YGDNARNN

SEQ ID NO: 18683 - protein, 8 aa, Borrelia burgdorferi
GDNARNNF

SEQ ID NO: 18684 - protein, 8 aa, Borrelia burgdorferi
DNARNNFK

SEQ ID NO: 18685 - protein, 8 aa, Borrelia burgdorferi
NARNNFKK

SEQ ID NO: 18686 - protein, 8 aa, Borrelia burgdorferi
ARNNFKKD

SEQ ID NO: 18687 - protein, 8 aa, Borrelia burgdorferi
RNNFKKDY

SEQ ID NO: 18688 - protein, 8 aa, Borrelia burgdorferi
NNFKKDYS

SEQ ID NO: 18689 - protein, 8 aa, Borrelia burgdorferi
NFKKDYSE

SEQ ID NO: 18690 - protein, 8 aa, Borrelia burgdorferi
FKKDYSED

SEQ ID NO: 18691 - protein, 8 aa, Borrelia burgdorferi
KKDYSEDK

SEQ ID NO: 18692 - protein, 8 aa, Borrelia burgdorferi
KDYSEDKA

SEQ ID NO: 18693 - protein, 8 aa, Borrelia burgdorferi
DYSEDKAN

SEQ ID NO: 18694 - protein, 8 aa, Borrelia burgdorferi
YSEDKANT

SEQ ID NO: 18695 - protein, 8 aa, Borrelia burgdorferi
SEDKANTV

SEQ ID NO: 18696 - protein, 8 aa, Borrelia burgdorferi
EDKANTVK

SEQ ID NO: 18697 - protein, 8 aa, Borrelia burgdorferi
DKANTVKQ

SEQ ID NO: 18698 - protein, 8 aa, Borrelia burgdorferi
KANTVKQI

SEQ ID NO: 18699 - protein, 8 aa, Borrelia burgdorferi
ANTVKQIL

SEQ ID NO: 18700 - protein, 8 aa, Borrelia burgdorferi
NTVKQILK

SEQ ID NO: 18701 - protein, 8 aa, Borrelia burgdorferi
TVKQILKQ

SEQ ID NO: 18702 - protein, 8 aa, Borrelia burgdorferi
VKQILKQI

SEQ ID NO: 18703 - protein, 8 aa, Borrelia burgdorferi
KQILKQIL

SEQ ID NO: 18704 - protein, 8 aa, Borrelia burgdorferi
QILKQILA

SEQ ID NO: 18705 - protein, 8 aa, Borrelia burgdorferi
ILKQILAD

SEQ ID NO: 18706 - protein, 8 aa, Borrelia burgdorferi
LKQILADL

SEQ ID NO: 18707 - protein, 8 aa, Borrelia burgdorferi
KQILADLP

SEQ ID NO: 18708 - protein, 8 aa, Borrelia burgdorferi
QILADLPK

SEQ ID NO: 18709 - protein, 8 aa, Borrelia burgdorferi
ILADLPKD

SEQ ID NO: 18710 - protein, 9 aa, Borrelia burgdorferi
MKKISLLIF

SEQ ID NO: 18711 - protein, 9 aa, Borrelia burgdorferi
KKISLLIFL

SEQ ID NO: 18712 - protein, 9 aa, Borrelia burgdorferi
KISLLIFLF

SEQ ID NO: 18713 - protein, 9 aa, Borrelia burgdorferi
ISLLIFLFL

SEQ ID NO: 18714 - protein, 9 aa, Borrelia burgdorferi
SLLIFLFLF

SEQ ID NO: 18715 - protein, 9 aa, Borrelia burgdorferi
LLIFLFLFV

SEQ ID NO: 18716 - protein, 9 aa, Borrelia burgdorferi
LIFLFLFVV

SEQ ID NO: 18717 - protein, 9 aa, Borrelia burgdorferi
IFLFLFVVS

SEQ ID NO: 18718 - protein, 9 aa, Borrelia burgdorferi
FLFLFVVSL

SEQ ID NO: 18719 - protein, 9 aa, Borrelia burgdorferi
LFLFVVSLS

SEQ ID NO: 18720 - protein, 9 aa, Borrelia burgdorferi
FLFVVSLSA

SEQ ID NO: 18721 - protein, 9 aa, Borrelia burgdorferi
LFVVSLSAN

SEQ ID NO: 18722 - protein, 9 aa, Borrelia burgdorferi
FVVSLSANI

SEQ ID NO: 18723 - protein, 9 aa, Borrelia burgdorferi
VVSLSANIE

SEQ ID NO: 18724 - protein, 9 aa, Borrelia burgdorferi
VSLSANIEE

SEQ ID NO: 18725 - protein, 9 aa, Borrelia burgdorferi
SLSANIEEN

SEQ ID NO: 18726 - protein, 9 aa, Borrelia burgdorferi
LSANIEENY

SEQ ID NO: 18727 - protein, 9 aa, Borrelia burgdorferi
SANIEENYT

SEQ ID NO: 18728 - protein, 9 aa, Borrelia burgdorferi
ANIEENYTE

SEQ ID NO: 18729 - protein, 9 aa, Borrelia burgdorferi
NIEENYTET

SEQ ID NO: 18730 - protein, 9 aa, Borrelia burgdorferi
IEENYTETK

SEQ ID NO: 18731 - protein, 9 aa, Borrelia burgdorferi
EENYTETKR

SEQ ID NO: 18732 - protein, 9 aa, Borrelia burgdorferi
ENYTETKRA

SEQ ID NO: 18733 - protein, 9 aa, Borrelia burgdorferi
NYTETKRAF

SEQ ID NO: 18734 - protein, 9 aa, Borrelia burgdorferi
YTETKRAFS

SEQ ID NO: 18735 - protein, 9 aa, Borrelia burgdorferi
TETKRAFSK

SEQ ID NO: 18736 - protein, 9 aa, Borrelia burgdorferi
ETKRAFSKE

SEQ ID NO: 18737 - protein, 9 aa, Borrelia burgdorferi
TKRAFSKED

SEQ ID NO: 18738 - protein, 9 aa, Borrelia burgdorferi
KRAFSKEDF

SEQ ID NO: 18739 - protein, 9 aa, Borrelia burgdorferi
RAFSKEDFN

SEQ ID NO: 18740 - protein, 9 aa, Borrelia burgdorferi
AFSKEDFNL

SEQ ID NO: 18741 - protein, 9 aa, Borrelia burgdorferi
FSKEDFNLI

SEQ ID NO: 18742 - protein, 9 aa, Borrelia burgdorferi
SKEDFNLIN

SEQ ID NO: 18743 - protein, 9 aa, Borrelia burgdorferi
KEDFNLINK

SEQ ID NO: 18744 - protein, 9 aa, Borrelia burgdorferi
EDFNLINKR

SEQ ID NO: 18745 - protein, 9 aa, Borrelia burgdorferi
DFNLINKRL

SEQ ID NO: 18746 - protein, 9 aa, Borrelia burgdorferi
FNLINKRLD

SEQ ID NO: 18747 - protein, 9 aa, Borrelia burgdorferi
NLINKRLDN

SEQ ID NO: 18748 - protein, 9 aa, Borrelia burgdorferi
LINKRLDNY

SEQ ID NO: 18749 - protein, 9 aa, Borrelia burgdorferi
INKRLDNYD

SEQ ID NO: 18750 - protein, 9 aa, Borrelia burgdorferi
NKRLDNYDF

SEQ ID NO: 18751 - protein, 9 aa, Borrelia burgdorferi
KRLDNYDFK

SEQ ID NO: 18752 - protein, 9 aa, Borrelia burgdorferi
RLDNYDFKN

SEQ ID NO: 18753 - protein, 9 aa, Borrelia burgdorferi
LDNYDFKNE

SEQ ID NO: 18754 - protein, 9 aa, Borrelia burgdorferi
DNYDFKNEY

SEQ ID NO: 18755 - protein, 9 aa, Borrelia burgdorferi
NYDFKNEYE

SEQ ID NO: 18756 - protein, 9 aa, Borrelia burgdorferi
YDFKNEYEK

SEQ ID NO: 18757 - protein, 9 aa, Borrelia burgdorferi
DFKNEYEKS

SEQ ID NO: 18758 - protein, 9 aa, Borrelia burgdorferi
FKNEYEKSH

SEQ ID NO: 18759 - protein, 9 aa, Borrelia burgdorferi
KNEYEKSHV

SEQ ID NO: 18760 - protein, 9 aa, Borrelia burgdorferi
NEYEKSHVF

SEQ ID NO: 18761 - protein, 9 aa, Borrelia burgdorferi
EYEKSHVFS

SEQ ID NO: 18762 - protein, 9 aa, Borrelia burgdorferi
YEKSHVFSD

SEQ ID NO: 18763 - protein, 9 aa, Borrelia burgdorferi
EKSHVFSDA

SEQ ID NO: 18764 - protein, 9 aa, Borrelia burgdorferi
KSHVFSDAP

SEQ ID NO: 18765 - protein, 9 aa, Borrelia burgdorferi
SHVFSDAPR

SEQ ID NO: 18766 - protein, 9 aa, Borrelia burgdorferi
HVFSDAPRI

SEQ ID NO: 18767 - protein, 9 aa, Borrelia burgdorferi
VFSDAPRIR

SEQ ID NO: 18768 - protein, 9 aa, Borrelia burgdorferi
FSDAPRIRG

SEQ ID NO: 18769 - protein, 9 aa, Borrelia burgdorferi
SDAPRIRGD

SEQ ID NO: 18770 - protein, 9 aa, Borrelia burgdorferi
DAPRIRGDL

SEQ ID NO: 18771 - protein, 9 aa, Borrelia burgdorferi
APRIRGDLR

SEQ ID NO: 18772 - protein, 9 aa, Borrelia burgdorferi
PRIRGDLRK

SEQ ID NO: 18773 - protein, 9 aa, Borrelia burgdorferi
RIRGDLRKI

SEQ ID NO: 18774 - protein, 9 aa, Borrelia burgdorferi
IRGDLRKIG

SEQ ID NO: 18775 - protein, 9 aa, Borrelia burgdorferi
RGDLRKIGI

SEQ ID NO: 18776 - protein, 9 aa, Borrelia burgdorferi
GDLRKIGIK

SEQ ID NO: 18777 - protein, 9 aa, Borrelia burgdorferi
DLRKIGIKE

SEQ ID NO: 18778 - protein, 9 aa, Borrelia burgdorferi
LRKIGIKEK

SEQ ID NO: 18779 - protein, 9 aa, Borrelia burgdorferi
RKIGIKEKS

SEQ ID NO: 18780 - protein, 9 aa, Borrelia burgdorferi
KIGIKEKSV

SEQ ID NO: 18781 - protein, 9 aa, Borrelia burgdorferi
IGIKEKSVF

SEQ ID NO: 18782 - protein, 9 aa, Borrelia burgdorferi
GIKEKSVFL

SEQ ID NO: 18783 - protein, 9 aa, Borrelia burgdorferi
IKEKSVFLD

SEQ ID NO: 18784 - protein, 9 aa, Borrelia burgdorferi
KEKSVFLDA

SEQ ID NO: 18785 - protein, 9 aa, Borrelia burgdorferi
EKSVFLDAL

SEQ ID NO: 18786 - protein, 9 aa, Borrelia burgdorferi
KSVFLDALE

SEQ ID NO: 18787 - protein, 9 aa, Borrelia burgdorferi
SVFLDALEA

SEQ ID NO: 18788 - protein, 9 aa, Borrelia burgdorferi
VFLDALEAI

SEQ ID NO: 18789 - protein, 9 aa, Borrelia burgdorferi
FLDALEAIE

SEQ ID NO: 18790 - protein, 9 aa, Borrelia burgdorferi
LDALEAIEY

SEQ ID NO: 18791 - protein, 9 aa, Borrelia burgdorferi
DALEAIEYL

SEQ ID NO: 18792 - protein, 9 aa, Borrelia burgdorferi
ALEAIEYLI

SEQ ID NO: 18793 - protein, 9 aa, Borrelia burgdorferi
LEAIEYLIK

SEQ ID NO: 18794 - protein, 9 aa, Borrelia burgdorferi
EAIEYLIKI

SEQ ID NO: 18795 - protein, 9 aa, Borrelia burgdorferi
AIEYLIKIK

SEQ ID NO: 18796 - protein, 9 aa, Borrelia burgdorferi
IEYLIKIKI

SEQ ID NO: 18797 - protein, 9 aa, Borrelia burgdorferi
EYLIKIKIS

SEQ ID NO: 18798 - protein, 9 aa, Borrelia burgdorferi
YLIKIKIST

SEQ ID NO: 18799 - protein, 9 aa, Borrelia burgdorferi
LIKIKISTD

SEQ ID NO: 18800 - protein, 9 aa, Borrelia burgdorferi
IKIKISTDS

SEQ ID NO: 18801 - protein, 9 aa, Borrelia burgdorferi
KIKISTDSI

SEQ ID NO: 18802 - protein, 9 aa, Borrelia burgdorferi
IKISTDSIF

SEQ ID NO: 18803 - protein, 9 aa, Borrelia burgdorferi
KISTDSIFL

SEQ ID NO: 18804 - protein, 9 aa, Borrelia burgdorferi
ISTDSIFLS

SEQ ID NO: 18805 - protein, 9 aa, Borrelia burgdorferi
STDSIFLSE

SEQ ID NO: 18806 - protein, 9 aa, Borrelia burgdorferi
TDSIFLSED

SEQ ID NO: 18807 - protein, 9 aa, Borrelia burgdorferi
DSIFLSEDM

SEQ ID NO: 18808 - protein, 9 aa, Borrelia burgdorferi
SIFLSEDMI

SEQ ID NO: 18809 - protein, 9 aa, Borrelia burgdorferi
IFLSEDMIR

SEQ ID NO: 18810 - protein, 9 aa, Borrelia burgdorferi
FLSEDMIRL

SEQ ID NO: 18811 - protein, 9 aa, Borrelia burgdorferi
LSEDMIRLI

SEQ ID NO: 18812 - protein, 9 aa, Borrelia burgdorferi
SEDMIRLIG

SEQ ID NO: 18813 - protein, 9 aa, Borrelia burgdorferi
EDMIRLIGS

SEQ ID NO: 18814 - protein, 9 aa, Borrelia burgdorferi
DMIRLIGSY

SEQ ID NO: 18815 - protein, 9 aa, Borrelia burgdorferi
MIRLIGSYP

SEQ ID NO: 18816 - protein, 9 aa, Borrelia burgdorferi
IRLIGSYPD

SEQ ID NO: 18817 - protein, 9 aa, Borrelia burgdorferi
RLIGSYPDS

SEQ ID NO: 18818 - protein, 9 aa, Borrelia burgdorferi
LIGSYPDSI

SEQ ID NO: 18819 - protein, 9 aa, Borrelia burgdorferi
IGSYPDSIF

SEQ ID NO: 18820 - protein, 9 aa, Borrelia burgdorferi
GSYPDSIFN

SEQ ID NO: 18821 - protein, 9 aa, Borrelia burgdorferi
SYPDSIFNY

SEQ ID NO: 18822 - protein, 9 aa, Borrelia burgdorferi
YPDSIFNYL

SEQ ID NO: 18823 - protein, 9 aa, Borrelia burgdorferi
PDSIFNYLI

SEQ ID NO: 18824 - protein, 9 aa, Borrelia burgdorferi
DSIFNYLIQ

SEQ ID NO: 18825 - protein, 9 aa, Borrelia burgdorferi
SIFNYLIQL

SEQ ID NO: 18826 - protein, 9 aa, Borrelia burgdorferi
IFNYLIQLN

SEQ ID NO: 18827 - protein, 9 aa, Borrelia burgdorferi
FNYLIQLNS

SEQ ID NO: 18828 - protein, 9 aa, Borrelia burgdorferi
NYLIQLNSD

SEQ ID NO: 18829 - protein, 9 aa, Borrelia burgdorferi
YLIQLNSDK

SEQ ID NO: 18830 - protein, 9 aa, Borrelia burgdorferi
LIQLNSDKI

SEQ ID NO: 18831 - protein, 9 aa, Borrelia burgdorferi
IQLNSDKID

SEQ ID NO: 18832 - protein, 9 aa, Borrelia burgdorferi
QLNSDKIDY

SEQ ID NO: 18833 - protein, 9 aa, Borrelia burgdorferi
LNSDKIDYA

SEQ ID NO: 18834 - protein, 9 aa, Borrelia burgdorferi
NSDKIDYAE

SEQ ID NO: 18835 - protein, 9 aa, Borrelia burgdorferi
SDKIDYAEK

SEQ ID NO: 18836 - protein, 9 aa, Borrelia burgdorferi
DKIDYAEKY

SEQ ID NO: 18837 - protein, 9 aa, Borrelia burgdorferi
KIDYAEKYG

SEQ ID NO: 18838 - protein, 9 aa, Borrelia burgdorferi
IDYAEKYGD

SEQ ID NO: 18839 - protein, 9 aa, Borrelia burgdorferi
DYAEKYGDN

SEQ ID NO: 18840 - protein, 9 aa, Borrelia burgdorferi
YAEKYGDNA

SEQ ID NO: 18841 - protein, 9 aa, Borrelia burgdorferi
AEKYGDNAR

SEQ ID NO: 18842 - protein, 9 aa, Borrelia burgdorferi
EKYGDNARN

SEQ ID NO: 18843 - protein, 9 aa, Borrelia burgdorferi
KYGDNARNN

SEQ ID NO: 18844 - protein, 9 aa, Borrelia burgdorferi
YGDNARNNF

SEQ ID NO: 18845 - protein, 9 aa, Borrelia burgdorferi
GDNARNNFK

SEQ ID NO: 18846 - protein, 9 aa, Borrelia burgdorferi
DNARNNFKK

SEQ ID NO: 18847 - protein, 9 aa, Borrelia burgdorferi
NARNNFKKD

SEQ ID NO: 18848 - protein, 9 aa, Borrelia burgdorferi
ARNNFKKDY

SEQ ID NO: 18849 - protein, 9 aa, Borrelia burgdorferi
RNNFKKDYS

SEQ ID NO: 18850 - protein, 9 aa, Borrelia burgdorferi
NNFKKDYSE

SEQ ID NO: 18851 - protein, 9 aa, Borrelia burgdorferi
NFKKDYSED

SEQ ID NO: 18852 - protein, 9 aa, Borrelia burgdorferi
FKKDYSEDK

SEQ ID NO: 18853 - protein, 9 aa, Borrelia burgdorferi
KKDYSEDKA

SEQ ID NO: 18854 - protein, 9 aa, Borrelia burgdorferi
KDYSEDKAN

SEQ ID NO: 18855 - protein, 9 aa, Borrelia burgdorferi
DYSEDKANT

SEQ ID NO: 18856 - protein, 9 aa, Borrelia burgdorferi
YSEDKANTV

SEQ ID NO: 18857 - protein, 9 aa, Borrelia burgdorferi
SEDKANTVK

SEQ ID NO: 18858 - protein, 9 aa, Borrelia burgdorferi
EDKANTVKQ

SEQ ID NO: 18859 - protein, 9 aa, Borrelia burgdorferi
DKANTVKQI

SEQ ID NO: 18860 - protein, 9 aa, Borrelia burgdorferi
KANTVKQIL

SEQ ID NO: 18861 - protein, 9 aa, Borrelia burgdorferi
ANTVKQILK

SEQ ID NO: 18862 - protein, 9 aa, Borrelia burgdorferi
NTVKQILKQ

SEQ ID NO: 18863 - protein, 9 aa, Borrelia burgdorferi
TVKQILKQI

SEQ ID NO: 18864 - protein, 9 aa, Borrelia burgdorferi
VKQILKQIL

SEQ ID NO: 18865 - protein, 9 aa, Borrelia burgdorferi
KQILKQILA

SEQ ID NO: 18866 - protein, 9 aa, Borrelia burgdorferi
QILKQILAD

SEQ ID NO: 18867 - protein, 9 aa, Borrelia burgdorferi
ILKQILADL

SEQ ID NO: 18868 - protein, 9 aa, Borrelia burgdorferi
LKQILADLP

SEQ ID NO: 18869 - protein, 9 aa, Borrelia burgdorferi
KQILADLPK

SEQ ID NO: 18870 - protein, 9 aa, Borrelia burgdorferi
QILADLPKD

SEQ ID NO: 18871 - protein, 10 aa, Borrelia burgdorferi
MKKISLLIFL

SEQ ID NO: 18872 - protein, 10 aa, Borrelia burgdorferi
KKISLLIFLF

SEQ ID NO: 18873 - protein, 10 aa, Borrelia burgdorferi
KISLLIFLFL

SEQ ID NO: 18874 - protein, 10 aa, Borrelia burgdorferi
ISLLIFLFLF

SEQ ID NO: 18875 - protein, 10 aa, Borrelia burgdorferi
SLLIFLFLFV

SEQ ID NO: 18876 - protein, 10 aa, Borrelia burgdorferi
LLIFLFLFVV

SEQ ID NO: 18877 - protein, 10 aa, Borrelia burgdorferi
LIFLFLFVVS

SEQ ID NO: 18878 - protein, 10 aa, Borrelia burgdorferi
IFLFLFVVSL

SEQ ID NO: 18879 - protein, 10 aa, Borrelia burgdorferi
FLFLFVVSLS

SEQ ID NO: 18880 - protein, 10 aa, Borrelia burgdorferi
LFLFVVSLSA

SEQ ID NO: 18881 - protein, 10 aa, Borrelia burgdorferi
FLFVVSLSAN

SEQ ID NO: 18882 - protein, 10 aa, Borrelia burgdorferi
LFVVSLSANI

SEQ ID NO: 18883 - protein, 10 aa, Borrelia burgdorferi
FVVSLSANIE

SEQ ID NO: 18884 - protein, 10 aa, Borrelia burgdorferi
VVSLSANIEE

SEQ ID NO: 18885 - protein, 10 aa, Borrelia burgdorferi
VSLSANIEEN

SEQ ID NO: 18886 - protein, 10 aa, Borrelia burgdorferi
SLSANIEENY

SEQ ID NO: 18887 - protein, 10 aa, Borrelia burgdorferi
LSANIEENYT

SEQ ID NO: 18888 - protein, 10 aa, Borrelia burgdorferi
SANIEENYTE

SEQ ID NO: 18889 - protein, 10 aa, Borrelia burgdorferi
ANIEENYTET

SEQ ID NO: 18890 - protein, 10 aa, Borrelia burgdorferi
NIEENYTETK

SEQ ID NO: 18891 - protein, 10 aa, Borrelia burgdorferi
IEENYTETKR

SEQ ID NO: 18892 - protein, 10 aa, Borrelia burgdorferi
EENYTETKRA

SEQ ID NO: 18893 - protein, 10 aa, Borrelia burgdorferi
ENYTETKRAF

SEQ ID NO: 18894 - protein, 10 aa, Borrelia burgdorferi
NYTETKRAFS

SEQ ID NO: 18895 - protein, 10 aa, Borrelia burgdorferi
YTETKRAFSK

SEQ ID NO: 18896 - protein, 10 aa, Borrelia burgdorferi
TETKRAFSKE

SEQ ID NO: 18897 - protein, 10 aa, Borrelia burgdorferi
ETKRAFSKED

SEQ ID NO: 18898 - protein, 10 aa, Borrelia burgdorferi
TKRAFSKEDF

SEQ ID NO: 18899 - protein, 10 aa, Borrelia burgdorferi
KRAFSKEDFN

SEQ ID NO: 18900 - protein, 10 aa, Borrelia burgdorferi
RAFSKEDFNL

SEQ ID NO: 18901 - protein, 10 aa, Borrelia burgdorferi
AFSKEDFNLI

SEQ ID NO: 18902 - protein, 10 aa, Borrelia burgdorferi
FSKEDFNLIN

SEQ ID NO: 18903 - protein, 10 aa, Borrelia burgdorferi
SKEDFNLINK

SEQ ID NO: 18904 - protein, 10 aa, Borrelia burgdorferi
KEDFNLINKR

SEQ ID NO: 18905 - protein, 10 aa, Borrelia burgdorferi
EDFNLINKRL

SEQ ID NO: 18906 - protein, 10 aa, Borrelia burgdorferi
DFNLINKRLD

SEQ ID NO: 18907 - protein, 10 aa, Borrelia burgdorferi
FNLINKRLDN

SEQ ID NO: 18908 - protein, 10 aa, Borrelia burgdorferi
NLINKRLDNY

SEQ ID NO: 18909 - protein, 10 aa, Borrelia burgdorferi
LINKRLDNYD

SEQ ID NO: 18910 - protein, 10 aa, Borrelia burgdorferi
INKRLDNYDF

SEQ ID NO: 18911 - protein, 10 aa, Borrelia burgdorferi
NKRLDNYDFK

SEQ ID NO: 18912 - protein, 10 aa, Borrelia burgdorferi
KRLDNYDFKN

SEQ ID NO: 18913 - protein, 10 aa, Borrelia burgdorferi
RLDNYDFKNE

SEQ ID NO: 18914 - protein, 10 aa, Borrelia burgdorferi
LDNYDFKNEY

SEQ ID NO: 18915 - protein, 10 aa, Borrelia burgdorferi
DNYDFKNEYE

SEQ ID NO: 18916 - protein, 10 aa, Borrelia burgdorferi
NYDFKNEYEK

SEQ ID NO: 18917 - protein, 10 aa, Borrelia burgdorferi
YDFKNEYEKS

SEQ ID NO: 18918 - protein, 10 aa, Borrelia burgdorferi
DFKNEYEKSH

SEQ ID NO: 18919 - protein, 10 aa, Borrelia burgdorferi
FKNEYEKSHV

SEQ ID NO: 18920 - protein, 10 aa, Borrelia burgdorferi
KNEYEKSHVF

SEQ ID NO: 18921 - protein, 10 aa, Borrelia burgdorferi
NEYEKSHVFS

SEQ ID NO: 18922 - protein, 10 aa, Borrelia burgdorferi
EYEKSHVFSD

SEQ ID NO: 18923 - protein, 10 aa, Borrelia burgdorferi
YEKSHVFSDA

SEQ ID NO: 18924 - protein, 10 aa, Borrelia burgdorferi
EKSHVFSDAP

SEQ ID NO: 18925 - protein, 10 aa, Borrelia burgdorferi
KSHVFSDAPR

SEQ ID NO: 18926 - protein, 10 aa, Borrelia burgdorferi
SHVFSDAPRI

SEQ ID NO: 18927 - protein, 10 aa, Borrelia burgdorferi
HVFSDAPRIR

SEQ ID NO: 18928 - protein, 10 aa, Borrelia burgdorferi
VFSDAPRIRG

SEQ ID NO: 18929 - protein, 10 aa, Borrelia burgdorferi
FSDAPRIRGD

SEQ ID NO: 18930 - protein, 10 aa, Borrelia burgdorferi
SDAPRIRGDL

SEQ ID NO: 18931 - protein, 10 aa, Borrelia burgdorferi
DAPRIRGDLR

SEQ ID NO: 18932 - protein, 10 aa, Borrelia burgdorferi
APRIRGDLRK

SEQ ID NO: 18933 - protein, 10 aa, Borrelia burgdorferi
PRIRGDLRKI

SEQ ID NO: 18934 - protein, 10 aa, Borrelia burgdorferi
RIRGDLRKIG

SEQ ID NO: 18935 - protein, 10 aa, Borrelia burgdorferi
IRGDLRKIGI

SEQ ID NO: 18936 - protein, 10 aa, Borrelia burgdorferi
RGDLRKIGIK

SEQ ID NO: 18937 - protein, 10 aa, Borrelia burgdorferi
GDLRKIGIKE

SEQ ID NO: 18938 - protein, 10 aa, Borrelia burgdorferi
DLRKIGIKEK

SEQ ID NO: 18939 - protein, 10 aa, Borrelia burgdorferi
LRKIGIKEKS

SEQ ID NO: 18940 - protein, 10 aa, Borrelia burgdorferi
RKIGIKEKSV

SEQ ID NO: 18941 - protein, 10 aa, Borrelia burgdorferi
KIGIKEKSVF

SEQ ID NO: 18942 - protein, 10 aa, Borrelia burgdorferi
IGIKEKSVFL

SEQ ID NO: 18943 - protein, 10 aa, Borrelia burgdorferi
GIKEKSVFLD

SEQ ID NO: 18944 - protein, 10 aa, Borrelia burgdorferi
IKEKSVFLDA

SEQ ID NO: 18945 - protein, 10 aa, Borrelia burgdorferi
KEKSVFLDAL

SEQ ID NO: 18946 - protein, 10 aa, Borrelia burgdorferi
EKSVFLDALE

SEQ ID NO: 18947 - protein, 10 aa, Borrelia burgdorferi
KSVFLDALEA

SEQ ID NO: 18948 - protein, 10 aa, Borrelia burgdorferi
SVFLDALEAI

SEQ ID NO: 18949 - protein, 10 aa, Borrelia burgdorferi
VFLDALEAIE

SEQ ID NO: 18950 - protein, 10 aa, Borrelia burgdorferi
FLDALEAIEY

SEQ ID NO: 18951 - protein, 10 aa, Borrelia burgdorferi
LDALEAIEYL

SEQ ID NO: 18952 - protein, 10 aa, Borrelia burgdorferi
DALEAIEYLI

SEQ ID NO: 18953 - protein, 10 aa, Borrelia burgdorferi
ALEAIEYLIK

SEQ ID NO: 18954 - protein, 10 aa, Borrelia burgdorferi
LEAIEYLIKI

SEQ ID NO: 18955 - protein, 10 aa, Borrelia burgdorferi
EAIEYLIKIK

SEQ ID NO: 18956 - protein, 10 aa, Borrelia burgdorferi
AIEYLIKIKI

SEQ ID NO: 18957 - protein, 10 aa, Borrelia burgdorferi
IEYLIKIKIS

SEQ ID NO: 18958 - protein, 10 aa, Borrelia burgdorferi
EYLIKIKIST

SEQ ID NO: 18959 - protein, 10 aa, Borrelia burgdorferi
YLIKIKISTD

SEQ ID NO: 18960 - protein, 10 aa, Borrelia burgdorferi
LIKIKISTDS

SEQ ID NO: 18961 - protein, 10 aa, Borrelia burgdorferi
IKIKISTDSI

SEQ ID NO: 18962 - protein, 10 aa, Borrelia burgdorferi
KIKISTDSIF

SEQ ID NO: 18963 - protein, 10 aa, Borrelia burgdorferi
IKISTDSIFL

SEQ ID NO: 18964 - protein, 10 aa, Borrelia burgdorferi
KISTDSIFLS

SEQ ID NO: 18965 - protein, 10 aa, Borrelia burgdorferi
ISTDSIFLSE

SEQ ID NO: 18966 - protein, 10 aa, Borrelia burgdorferi
STDSIFLSED

SEQ ID NO: 18967 - protein, 10 aa, Borrelia burgdorferi
TDSIFLSEDM

SEQ ID NO: 18968 - protein, 10 aa, Borrelia burgdorferi
DSIFLSEDMI

SEQ ID NO: 18969 - protein, 10 aa, Borrelia burgdorferi
SIFLSEDMIR

SEQ ID NO: 18970 - protein, 10 aa, Borrelia burgdorferi
IFLSEDMIRL

SEQ ID NO: 18971 - protein, 10 aa, Borrelia burgdorferi
FLSEDMIRLI

SEQ ID NO: 18972 - protein, 10 aa, Borrelia burgdorferi
LSEDMIRLIG

SEQ ID NO: 18973 - protein, 10 aa, Borrelia burgdorferi
SEDMIRLIGS

SEQ ID NO: 18974 - protein, 10 aa, Borrelia burgdorferi
EDMIRLIGSY

SEQ ID NO: 18975 - protein, 10 aa, Borrelia burgdorferi
DMIRLIGSYP

SEQ ID NO: 18976 - protein, 10 aa, Borrelia burgdorferi
MIRLIGSYPD

SEQ ID NO: 18977 - protein, 10 aa, Borrelia burgdorferi
IRLIGSYPDS

SEQ ID NO: 18978 - protein, 10 aa, Borrelia burgdorferi
RLIGSYPDSI

SEQ ID NO: 18979 - protein, 10 aa, Borrelia burgdorferi
LIGSYPDSIF

SEQ ID NO: 18980 - protein, 10 aa, Borrelia burgdorferi
IGSYPDSIFN

SEQ ID NO: 18981 - protein, 10 aa, Borrelia burgdorferi
GSYPDSIFNY

SEQ ID NO: 18982 - protein, 10 aa, Borrelia burgdorferi
SYPDSIFNYL

SEQ ID NO: 18983 - protein, 10 aa, Borrelia burgdorferi
YPDSIFNYLI

SEQ ID NO: 18984 - protein, 10 aa, Borrelia burgdorferi
PDSIFNYLIQ

SEQ ID NO: 18985 - protein, 10 aa, Borrelia burgdorferi
DSIFNYLIQL

SEQ ID NO: 18986 - protein, 10 aa, Borrelia burgdorferi
SIFNYLIQLN

SEQ ID NO: 18987 - protein, 10 aa, Borrelia burgdorferi
IFNYLIQLNS

SEQ ID NO: 18988 - protein, 10 aa, Borrelia burgdorferi
FNYLIQLNSD

SEQ ID NO: 18989 - protein, 10 aa, Borrelia burgdorferi
NYLIQLNSDK

SEQ ID NO: 18990 - protein, 10 aa, Borrelia burgdorferi
YLIQLNSDKI

SEQ ID NO: 18991 - protein, 10 aa, Borrelia burgdorferi
LIQLNSDKID

SEQ ID NO: 18992 - protein, 10 aa, Borrelia burgdorferi
IQLNSDKIDY

SEQ ID NO: 18993 - protein, 10 aa, Borrelia burgdorferi
QLNSDKIDYA

SEQ ID NO: 18994 - protein, 10 aa, Borrelia burgdorferi
LNSDKIDYAE

SEQ ID NO: 18995 - protein, 10 aa, Borrelia burgdorferi
NSDKIDYAEK

SEQ ID NO: 18996 - protein, 10 aa, Borrelia burgdorferi
SDKIDYAEKY

SEQ ID NO: 18997 - protein, 10 aa, Borrelia burgdorferi
DKIDYAEKYG

SEQ ID NO: 18998 - protein, 10 aa, Borrelia burgdorferi
KIDYAEKYGD

SEQ ID NO: 18999 - protein, 10 aa, Borrelia burgdorferi
IDYAEKYGDN

SEQ ID NO: 19000 - protein, 10 aa, Borrelia burgdorferi
DYAEKYGDNA

SEQ ID NO: 19001 - protein, 10 aa, Borrelia burgdorferi
YAEKYGDNAR

SEQ ID NO: 19002 - protein, 10 aa, Borrelia burgdorferi
AEKYGDNARN

SEQ ID NO: 19003 - protein, 10 aa, Borrelia burgdorferi
EKYGDNARNN

SEQ ID NO: 19004 - protein, 10 aa, Borrelia burgdorferi
KYGDNARNNF

SEQ ID NO: 19005 - protein, 10 aa, Borrelia burgdorferi
YGDNARNNFK

SEQ ID NO: 19006 - protein, 10 aa, Borrelia burgdorferi
GDNARNNFKK

SEQ ID NO: 19007 - protein, 10 aa, Borrelia burgdorferi
DNARNNFKKD

SEQ ID NO: 19008 - protein, 10 aa, Borrelia burgdorferi
NARNNFKKDY

SEQ ID NO: 19009 - protein, 10 aa, Borrelia burgdorferi
ARNNFKKDYS

SEQ ID NO: 19010 - protein, 10 aa, Borrelia burgdorferi
RNNFKKDYSE

SEQ ID NO: 19011 - protein, 10 aa, Borrelia burgdorferi
NNFKKDYSED

SEQ ID NO: 19012 - protein, 10 aa, Borrelia burgdorferi
NFKKDYSEDK

SEQ ID NO: 19013 - protein, 10 aa, Borrelia burgdorferi
FKKDYSEDKA

SEQ ID NO: 19014 - protein, 10 aa, Borrelia burgdorferi
KKDYSEDKAN

SEQ ID NO: 19015 - protein, 10 aa, Borrelia burgdorferi
KDYSEDKANT

SEQ ID NO: 19016 - protein, 10 aa, Borrelia burgdorferi
DYSEDKANTV

SEQ ID NO: 19017 - protein, 10 aa, Borrelia burgdorferi
YSEDKANTVK

SEQ ID NO: 19018 - protein, 10 aa, Borrelia burgdorferi
SEDKANTVKQ

SEQ ID NO: 19019 - protein, 10 aa, Borrelia burgdorferi
EDKANTVKQI

SEQ ID NO: 19020 - protein, 10 aa, Borrelia burgdorferi
DKANTVKQIL

SEQ ID NO: 19021 - protein, 10 aa, Borrelia burgdorferi
KANTVKQILK

SEQ ID NO: 19022 - protein, 10 aa, Borrelia burgdorferi
ANTVKQILKQ

SEQ ID NO: 19023 - protein, 10 aa, Borrelia burgdorferi
NTVKQILKQI

SEQ ID NO: 19024 - protein, 10 aa, Borrelia burgdorferi
TVKQILKQIL

SEQ ID NO: 19025 - protein, 10 aa, Borrelia burgdorferi
VKQILKQILA

SEQ ID NO: 19026 - protein, 10 aa, Borrelia burgdorferi
KQILKQILAD

SEQ ID NO: 19027 - protein, 10 aa, Borrelia burgdorferi
QILKQILADL

SEQ ID NO: 19028 - protein, 10 aa, Borrelia burgdorferi
ILKQILADLP

SEQ ID NO: 19029 - protein, 10 aa, Borrelia burgdorferi
LKQILADLPK

SEQ ID NO: 19030 - protein, 10 aa, Borrelia burgdorferi
KQILADLPKD

SEQ ID NO: 19031 - protein, 11 aa, Borrelia burgdorferi
MKKISLLIFLF

SEQ ID NO: 19032 - protein, 11 aa, Borrelia burgdorferi
KKISLLIFLFL

SEQ ID NO: 19033 - protein, 11 aa, Borrelia burgdorferi
KISLLIFLFLF

SEQ ID NO: 19034 - protein, 11 aa, Borrelia burgdorferi
ISLLIFLFLFV

SEQ ID NO: 19035 - protein, 11 aa, Borrelia burgdorferi
SLLIFLFLFVV

SEQ ID NO: 19036 - protein, 11 aa, Borrelia burgdorferi
LLIFLFLFVVS

SEQ ID NO: 19037 - protein, 11 aa, Borrelia burgdorferi
LIFLFLFVVSL

SEQ ID NO: 19038 - protein, 11 aa, Borrelia burgdorferi
IFLFLFVVSLS

SEQ ID NO: 19039 - protein, 11 aa, Borrelia burgdorferi
FLFLFVVSLSA

SEQ ID NO: 19040 - protein, 11 aa, Borrelia burgdorferi
LFLFVVSLSAN

SEQ ID NO: 19041 - protein, 11 aa, Borrelia burgdorferi
FLFVVSLSANI

SEQ ID NO: 19042 - protein, 11 aa, Borrelia burgdorferi
LFVVSLSANIE

SEQ ID NO: 19043 - protein, 11 aa, Borrelia burgdorferi
FVVSLSANIEE

SEQ ID NO: 19044 - protein, 11 aa, Borrelia burgdorferi
VVSLSANIEEN

SEQ ID NO: 19045 - protein, 11 aa, Borrelia burgdorferi
VSLSANIEENY

SEQ ID NO: 19046 - protein, 11 aa, Borrelia burgdorferi
SLSANIEENYT

SEQ ID NO: 19047 - protein, 11 aa, Borrelia burgdorferi
LSANIEENYTE

SEQ ID NO: 19048 - protein, 11 aa, Borrelia burgdorferi
SANIEENYTET

SEQ ID NO: 19049 - protein, 11 aa, Borrelia burgdorferi
ANIEENYTETK

SEQ ID NO: 19050 - protein, 11 aa, Borrelia burgdorferi
NIEENYTETKR

SEQ ID NO: 19051 - protein, 11 aa, Borrelia burgdorferi
IEENYTETKRA

SEQ ID NO: 19052 - protein, 11 aa, Borrelia burgdorferi
EENYTETKRAF

SEQ ID NO: 19053 - protein, 11 aa, Borrelia burgdorferi
ENYTETKRAFS

SEQ ID NO: 19054 - protein, 11 aa, Borrelia burgdorferi
NYTETKRAFSK

SEQ ID NO: 19055 - protein, 11 aa, Borrelia burgdorferi
YTETKRAFSKE

SEQ ID NO: 19056 - protein, 11 aa, Borrelia burgdorferi
TETKRAFSKED

SEQ ID NO: 19057 - protein, 11 aa, Borrelia burgdorferi
ETKRAFSKEDF

SEQ ID NO: 19058 - protein, 11 aa, Borrelia burgdorferi
TKRAFSKEDFN

SEQ ID NO: 19059 - protein, 11 aa, Borrelia burgdorferi
KRAFSKEDFNL

SEQ ID NO: 19060 - protein, 11 aa, Borrelia burgdorferi
RAFSKEDFNLI

SEQ ID NO: 19061 - protein, 11 aa, Borrelia burgdorferi
AFSKEDFNLIN

SEQ ID NO: 19062 - protein, 11 aa, Borrelia burgdorferi
FSKEDFNLINK

SEQ ID NO: 19063 - protein, 11 aa, Borrelia burgdorferi
SKEDFNLINKR

SEQ ID NO: 19064 - protein, 11 aa, Borrelia burgdorferi
KEDFNLINKRL

SEQ ID NO: 19065 - protein, 11 aa, Borrelia burgdorferi
EDFNLINKRLD

SEQ ID NO: 19066 - protein, 11 aa, Borrelia burgdorferi
DFNLINKRLDN

SEQ ID NO: 19067 - protein, 11 aa, Borrelia burgdorferi
FNLINKRLDNY

SEQ ID NO: 19068 - protein, 11 aa, Borrelia burgdorferi
NLINKRLDNYD

SEQ ID NO: 19069 - protein, 11 aa, Borrelia burgdorferi
LINKRLDNYDF

SEQ ID NO: 19070 - protein, 11 aa, Borrelia burgdorferi
INKRLDNYDFK

SEQ ID NO: 19071 - protein, 11 aa, Borrelia burgdorferi
NKRLDNYDFKN

SEQ ID NO: 19072 - protein, 11 aa, Borrelia burgdorferi
KRLDNYDFKNE

SEQ ID NO: 19073 - protein, 11 aa, Borrelia burgdorferi
RLDNYDFKNEY

SEQ ID NO: 19074 - protein, 11 aa, Borrelia burgdorferi
LDNYDFKNEYE

SEQ ID NO: 19075 - protein, 11 aa, Borrelia burgdorferi
DNYDFKNEYEK

SEQ ID NO: 19076 - protein, 11 aa, Borrelia burgdorferi
NYDFKNEYEKS

SEQ ID NO: 19077 - protein, 11 aa, Borrelia burgdorferi
YDFKNEYEKSH

SEQ ID NO: 19078 - protein, 11 aa, Borrelia burgdorferi
DFKNEYEKSHV

SEQ ID NO: 19079 - protein, 11 aa, Borrelia burgdorferi
FKNEYEKSHVF

SEQ ID NO: 19080 - protein, 11 aa, Borrelia burgdorferi
KNEYEKSHVFS

SEQ ID NO: 19081 - protein, 11 aa, Borrelia burgdorferi
NEYEKSHVFSD

SEQ ID NO: 19082 - protein, 11 aa, Borrelia burgdorferi
EYEKSHVFSDA

SEQ ID NO: 19083 - protein, 11 aa, Borrelia burgdorferi
YEKSHVFSDAP

SEQ ID NO: 19084 - protein, 11 aa, Borrelia burgdorferi
EKSHVFSDAPR

SEQ ID NO: 19085 - protein, 11 aa, Borrelia burgdorferi
KSHVFSDAPRI

SEQ ID NO: 19086 - protein, 11 aa, Borrelia burgdorferi
SHVFSDAPRIR

SEQ ID NO: 19087 - protein, 11 aa, Borrelia burgdorferi
HVFSDAPRIRG

SEQ ID NO: 19088 - protein, 11 aa, Borrelia burgdorferi
VFSDAPRIRGD

SEQ ID NO: 19089 - protein, 11 aa, Borrelia burgdorferi
FSDAPRIRGDL

SEQ ID NO: 19090 - protein, 11 aa, Borrelia burgdorferi
SDAPRIRGDLR

SEQ ID NO: 19091 - protein, 11 aa, Borrelia burgdorferi
DAPRIRGDLRK

SEQ ID NO: 19092 - protein, 11 aa, Borrelia burgdorferi
APRIRGDLRKI

SEQ ID NO: 19093 - protein, 11 aa, Borrelia burgdorferi
PRIRGDLRKIG

SEQ ID NO: 19094 - protein, 11 aa, Borrelia burgdorferi
RIRGDLRKIGI

SEQ ID NO: 19095 - protein, 11 aa, Borrelia burgdorferi
IRGDLRKIGIK

SEQ ID NO: 19096 - protein, 11 aa, Borrelia burgdorferi
RGDLRKIGIKE

SEQ ID NO: 19097 - protein, 11 aa, Borrelia burgdorferi
GDLRKIGIKEK

SEQ ID NO: 19098 - protein, 11 aa, Borrelia burgdorferi
DLRKIGIKEKS

SEQ ID NO: 19099 - protein, 11 aa, Borrelia burgdorferi
LRKIGIKEKSV

SEQ ID NO: 19100 - protein, 11 aa, Borrelia burgdorferi
RKIGIKEKSVF

SEQ ID NO: 19101 - protein, 11 aa, Borrelia burgdorferi
KIGIKEKSVFL

SEQ ID NO: 19102 - protein, 11 aa, Borrelia burgdorferi
IGIKEKSVFLD

SEQ ID NO: 19103 - protein, 11 aa, Borrelia burgdorferi
GIKEKSVFLDA

SEQ ID NO: 19104 - protein, 11 aa, Borrelia burgdorferi
IKEKSVFLDAL

SEQ ID NO: 19105 - protein, 11 aa, Borrelia burgdorferi
KEKSVFLDALE

SEQ ID NO: 19106 - protein, 11 aa, Borrelia burgdorferi
EKSVFLDALEA

SEQ ID NO: 19107 - protein, 11 aa, Borrelia burgdorferi
KSVFLDALEAI

SEQ ID NO: 19108 - protein, 11 aa, Borrelia burgdorferi
SVFLDALEAIE

SEQ ID NO: 19109 - protein, 11 aa, Borrelia burgdorferi
VFLDALEAIEY

SEQ ID NO: 19110 - protein, 11 aa, Borrelia burgdorferi
FLDALEAIEYL

SEQ ID NO: 19111 - protein, 11 aa, Borrelia burgdorferi
LDALEAIEYLI

SEQ ID NO: 19112 - protein, 11 aa, Borrelia burgdorferi
DALEAIEYLIK

SEQ ID NO: 19113 - protein, 11 aa, Borrelia burgdorferi
ALEAIEYLIKI

SEQ ID NO: 19114 - protein, 11 aa, Borrelia burgdorferi
LEAIEYLIKIK

SEQ ID NO: 19115 - protein, 11 aa, Borrelia burgdorferi
EAIEYLIKIKI

SEQ ID NO: 19116 - protein, 11 aa, Borrelia burgdorferi
AIEYLIKIKIS

SEQ ID NO: 19117 - protein, 11 aa, Borrelia burgdorferi
IEYLIKIKIST

SEQ ID NO: 19118 - protein, 11 aa, Borrelia burgdorferi
EYLIKIKISTD

SEQ ID NO: 19119 - protein, 11 aa, Borrelia burgdorferi
YLIKIKISTDS

SEQ ID NO: 19120 - protein, 11 aa, Borrelia burgdorferi
LIKIKISTDSI

SEQ ID NO: 19121 - protein, 11 aa, Borrelia burgdorferi
IKIKISTDSIF

SEQ ID NO: 19122 - protein, 11 aa, Borrelia burgdorferi
KIKISTDSIFL

SEQ ID NO: 19123 - protein, 11 aa, Borrelia burgdorferi
IKISTDSIFLS

SEQ ID NO: 19124 - protein, 11 aa, Borrelia burgdorferi
KISTDSIFLSE

SEQ ID NO: 19125 - protein, 11 aa, Borrelia burgdorferi
ISTDSIFLSED

SEQ ID NO: 19126 - protein, 11 aa, Borrelia burgdorferi
STDSIFLSEDM

SEQ ID NO: 19127 - protein, 11 aa, Borrelia burgdorferi
TDSIFLSEDMI

SEQ ID NO: 19128 - protein, 11 aa, Borrelia burgdorferi
DSIFLSEDMIR

SEQ ID NO: 19129 - protein, 11 aa, Borrelia burgdorferi
SIFLSEDMIRL

SEQ ID NO: 19130 - protein, 11 aa, Borrelia burgdorferi
IFLSEDMIRLI

SEQ ID NO: 19131 - protein, 11 aa, Borrelia burgdorferi
FLSEDMIRLIG

SEQ ID NO: 19132 - protein, 11 aa, Borrelia burgdorferi
LSEDMIRLIGS

SEQ ID NO: 19133 - protein, 11 aa, Borrelia burgdorferi
SEDMIRLIGSY

SEQ ID NO: 19134 - protein, 11 aa, Borrelia burgdorferi
EDMIRLIGSYP

SEQ ID NO: 19135 - protein, 11 aa, Borrelia burgdorferi
DMIRLIGSYPD

SEQ ID NO: 19136 - protein, 11 aa, Borrelia burgdorferi
MIRLIGSYPDS

SEQ ID NO: 19137 - protein, 11 aa, Borrelia burgdorferi
IRLIGSYPDSI

SEQ ID NO: 19138 - protein, 11 aa, Borrelia burgdorferi
RLIGSYPDSIF

SEQ ID NO: 19139 - protein, 11 aa, Borrelia burgdorferi
LIGSYPDSIFN

SEQ ID NO: 19140 - protein, 11 aa, Borrelia burgdorferi
IGSYPDSIFNY

SEQ ID NO: 19141 - protein, 11 aa, Borrelia burgdorferi
GSYPDSIFNYL

SEQ ID NO: 19142 - protein, 11 aa, Borrelia burgdorferi
SYPDSIFNYLI

SEQ ID NO: 19143 - protein, 11 aa, Borrelia burgdorferi
YPDSIFNYLIQ

SEQ ID NO: 19144 - protein, 11 aa, Borrelia burgdorferi
PDSIFNYLIQL

SEQ ID NO: 19145 - protein, 11 aa, Borrelia burgdorferi
DSIFNYLIQLN

SEQ ID NO: 19146 - protein, 11 aa, Borrelia burgdorferi
SIFNYLIQLNS

SEQ ID NO: 19147 - protein, 11 aa, Borrelia burgdorferi
IFNYLIQLNSD

SEQ ID NO: 19148 - protein, 11 aa, Borrelia burgdorferi
FNYLIQLNSDK

SEQ ID NO: 19149 - protein, 11 aa, Borrelia burgdorferi
NYLIQLNSDKI

SEQ ID NO: 19150 - protein, 11 aa, Borrelia burgdorferi
YLIQLNSDKID

SEQ ID NO: 19151 - protein, 11 aa, Borrelia burgdorferi
LIQLNSDKIDY

SEQ ID NO: 19152 - protein, 11 aa, Borrelia burgdorferi
IQLNSDKIDYA

SEQ ID NO: 19153 - protein, 11 aa, Borrelia burgdorferi
QLNSDKIDYAE

SEQ ID NO: 19154 - protein, 11 aa, Borrelia burgdorferi
LNSDKIDYAEK

SEQ ID NO: 19155 - protein, 11 aa, Borrelia burgdorferi
NSDKIDYAEKY

SEQ ID NO: 19156 - protein, 11 aa, Borrelia burgdorferi
SDKIDYAEKYG

SEQ ID NO: 19157 - protein, 11 aa, Borrelia burgdorferi
DKIDYAEKYGD

SEQ ID NO: 19158 - protein, 11 aa, Borrelia burgdorferi
KIDYAEKYGDN

SEQ ID NO: 19159 - protein, 11 aa, Borrelia burgdorferi
IDYAEKYGDNA

SEQ ID NO: 19160 - protein, 11 aa, Borrelia burgdorferi
DYAEKYGDNAR

SEQ ID NO: 19161 - protein, 11 aa, Borrelia burgdorferi
YAEKYGDNARN

SEQ ID NO: 19162 - protein, 11 aa, Borrelia burgdorferi
AEKYGDNARNN

SEQ ID NO: 19163 - protein, 11 aa, Borrelia burgdorferi
EKYGDNARNNF

SEQ ID NO: 19164 - protein, 11 aa, Borrelia burgdorferi
KYGDNARNNFK

SEQ ID NO: 19165 - protein, 11 aa, Borrelia burgdorferi
YGDNARNNFKK

SEQ ID NO: 19166 - protein, 11 aa, Borrelia burgdorferi
GDNARNNFKKD

SEQ ID NO: 19167 - protein, 11 aa, Borrelia burgdorferi
DNARNNFKKDY

SEQ ID NO: 19168 - protein, 11 aa, Borrelia burgdorferi
NARNNFKKDYS

SEQ ID NO: 19169 - protein, 11 aa, Borrelia burgdorferi
ARNNFKKDYSE

SEQ ID NO: 19170 - protein, 11 aa, Borrelia burgdorferi
RNNFKKDYSED

SEQ ID NO: 19171 - protein, 11 aa, Borrelia burgdorferi
NNFKKDYSEDK

SEQ ID NO: 19172 - protein, 11 aa, Borrelia burgdorferi
NFKKDYSEDKA

SEQ ID NO: 19173 - protein, 11 aa, Borrelia burgdorferi
FKKDYSEDKAN

SEQ ID NO: 19174 - protein, 11 aa, Borrelia burgdorferi
KKDYSEDKANT

SEQ ID NO: 19175 - protein, 11 aa, Borrelia burgdorferi
KDYSEDKANTV

SEQ ID NO: 19176 - protein, 11 aa, Borrelia burgdorferi
DYSEDKANTVK

SEQ ID NO: 19177 - protein, 11 aa, Borrelia burgdorferi
YSEDKANTVKQ

SEQ ID NO: 19178 - protein, 11 aa, Borrelia burgdorferi
SEDKANTVKQI

SEQ ID NO: 19179 - protein, 11 aa, Borrelia burgdorferi
EDKANTVKQIL

SEQ ID NO: 19180 - protein, 11 aa, Borrelia burgdorferi
DKANTVKQILK

SEQ ID NO: 19181 - protein, 11 aa, Borrelia burgdorferi
KANTVKQILKQ

SEQ ID NO: 19182 - protein, 11 aa, Borrelia burgdorferi
ANTVKQILKQI

SEQ ID NO: 19183 - protein, 11 aa, Borrelia burgdorferi
NTVKQILKQIL

SEQ ID NO: 19184 - protein, 11 aa, Borrelia burgdorferi
TVKQILKQILA

SEQ ID NO: 19185 - protein, 11 aa, Borrelia burgdorferi
VKQILKQILAD

SEQ ID NO: 19186 - protein, 11 aa, Borrelia burgdorferi
KQILKQILADL

SEQ ID NO: 19187 - protein, 11 aa, Borrelia burgdorferi
QILKQILADLP

SEQ ID NO: 19188 - protein, 11 aa, Borrelia burgdorferi
ILKQILADLPK

SEQ ID NO: 19189 - protein, 11 aa, Borrelia burgdorferi
LKQILADLPKD

SEQ ID NO: 19190 - protein, 8 aa, Borrelia burgdorferi
MCAFLLLN

SEQ ID NO: 19191 - protein, 8 aa, Borrelia burgdorferi
CAFLLLNL

SEQ ID NO: 19192 - protein, 8 aa, Borrelia burgdorferi
AFLLLNLV

SEQ ID NO: 19193 - protein, 8 aa, Borrelia burgdorferi
FLLLNLVN

SEQ ID NO: 19194 - protein, 8 aa, Borrelia burgdorferi
LLLNLVNC

SEQ ID NO: 19195 - protein, 8 aa, Borrelia burgdorferi
LLNLVNCK

SEQ ID NO: 19196 - protein, 8 aa, Borrelia burgdorferi
LNLVNCKF

SEQ ID NO: 19197 - protein, 8 aa, Borrelia burgdorferi
NLVNCKFD

SEQ ID NO: 19198 - protein, 8 aa, Borrelia burgdorferi
LVNCKFDS

SEQ ID NO: 19199 - protein, 8 aa, Borrelia burgdorferi
VNCKFDSL

SEQ ID NO: 19200 - protein, 8 aa, Borrelia burgdorferi
NCKFDSLN

SEQ ID NO: 19201 - protein, 8 aa, Borrelia burgdorferi
CKFDSLNL

SEQ ID NO: 19202 - protein, 8 aa, Borrelia burgdorferi
KFDSLNLS

SEQ ID NO: 19203 - protein, 8 aa, Borrelia burgdorferi
FDSLNLST

SEQ ID NO: 19204 - protein, 8 aa, Borrelia burgdorferi
DSLNLSTK

SEQ ID NO: 19205 - protein, 8 aa, Borrelia burgdorferi
SLNLSTKS

SEQ ID NO: 19206 - protein, 8 aa, Borrelia burgdorferi
LNLSTKSV

SEQ ID NO: 19207 - protein, 8 aa, Borrelia burgdorferi
NLSTKSVD

SEQ ID NO: 19208 - protein, 8 aa, Borrelia burgdorferi
LSTKSVDD

SEQ ID NO: 19209 - protein, 8 aa, Borrelia burgdorferi
STKSVDDK

SEQ ID NO: 19210 - protein, 8 aa, Borrelia burgdorferi
TKSVDDKN

SEQ ID NO: 19211 - protein, 8 aa, Borrelia burgdorferi
KSVDDKNN

SEQ ID NO: 19212 - protein, 8 aa, Borrelia burgdorferi
SVDDKNNS

SEQ ID NO: 19213 - protein, 8 aa, Borrelia burgdorferi
VDDKNNSI

SEQ ID NO: 19214 - protein, 8 aa, Borrelia burgdorferi
DDKNNSIA

SEQ ID NO: 19215 - protein, 8 aa, Borrelia burgdorferi
DKNNSIAK

SEQ ID NO: 19216 - protein, 8 aa, Borrelia burgdorferi
KNNSIAKL

SEQ ID NO: 19217 - protein, 8 aa, Borrelia burgdorferi
NNSIAKLL

SEQ ID NO: 19218 - protein, 8 aa, Borrelia burgdorferi
NSIAKLLQ

SEQ ID NO: 19219 - protein, 8 aa, Borrelia burgdorferi
SIAKLLQH

SEQ ID NO: 19220 - protein, 8 aa, Borrelia burgdorferi
IAKLLQHL

SEQ ID NO: 19221 - protein, 8 aa, Borrelia burgdorferi
AKLLQHLS

SEQ ID NO: 19222 - protein, 8 aa, Borrelia burgdorferi
KLLQHLSK

SEQ ID NO: 19223 - protein, 8 aa, Borrelia burgdorferi
LLQHLSKS

SEQ ID NO: 19224 - protein, 8 aa, Borrelia burgdorferi
LQHLSKSE

SEQ ID NO: 19225 - protein, 8 aa, Borrelia burgdorferi
QHLSKSED

SEQ ID NO: 19226 - protein, 8 aa, Borrelia burgdorferi
HLSKSEDQ

SEQ ID NO: 19227 - protein, 8 aa, Borrelia burgdorferi
LSKSEDQA

SEQ ID NO: 19228 - protein, 8 aa, Borrelia burgdorferi
SKSEDQAN

SEQ ID NO: 19229 - protein, 8 aa, Borrelia burgdorferi
KSEDQANK

SEQ ID NO: 19230 - protein, 8 aa, Borrelia burgdorferi
SEDQANKT

SEQ ID NO: 19231 - protein, 8 aa, Borrelia burgdorferi
EDQANKTS

SEQ ID NO: 19232 - protein, 8 aa, Borrelia burgdorferi
DQANKTST

SEQ ID NO: 19233 - protein, 8 aa, Borrelia burgdorferi
QANKTSTS

SEQ ID NO: 19234 - protein, 8 aa, Borrelia burgdorferi
ANKTSTSE

SEQ ID NO: 19235 - protein, 8 aa, Borrelia burgdorferi
NKTSTSED

SEQ ID NO: 19236 - protein, 8 aa, Borrelia burgdorferi
KTSTSEDQ

SEQ ID NO: 19237 - protein, 8 aa, Borrelia burgdorferi
TSTSEDQK

SEQ ID NO: 19238 - protein, 8 aa, Borrelia burgdorferi
STSEDQKE

SEQ ID NO: 19239 - protein, 8 aa, Borrelia burgdorferi
TSEDQKEL

SEQ ID NO: 19240 - protein, 8 aa, Borrelia burgdorferi
SEDQKELE

SEQ ID NO: 19241 - protein, 8 aa, Borrelia burgdorferi
EDQKELEI

SEQ ID NO: 19242 - protein, 8 aa, Borrelia burgdorferi
DQKELEIT

SEQ ID NO: 19243 - protein, 8 aa, Borrelia burgdorferi
QKELEITE

SEQ ID NO: 19244 - protein, 8 aa, Borrelia burgdorferi
KELEITEN

SEQ ID NO: 19245 - protein, 8 aa, Borrelia burgdorferi
ELEITENK

SEQ ID NO: 19246 - protein, 8 aa, Borrelia burgdorferi
LEITENKE

SEQ ID NO: 19247 - protein, 8 aa, Borrelia burgdorferi
EITENKEQ

SEQ ID NO: 19248 - protein, 8 aa, Borrelia burgdorferi
ITENKEQE

SEQ ID NO: 19249 - protein, 8 aa, Borrelia burgdorferi
TENKEQEH

SEQ ID NO: 19250 - protein, 8 aa, Borrelia burgdorferi
ENKEQEHE

SEQ ID NO: 19251 - protein, 8 aa, Borrelia burgdorferi
NKEQEHEK

SEQ ID NO: 19252 - protein, 8 aa, Borrelia burgdorferi
KEQEHEKL

SEQ ID NO: 19253 - protein, 8 aa, Borrelia burgdorferi
EQEHEKLS

SEQ ID NO: 19254 - protein, 8 aa, Borrelia burgdorferi
QEHEKLSQ

SEQ ID NO: 19255 - protein, 8 aa, Borrelia burgdorferi
EHEKLSQV

SEQ ID NO: 19256 - protein, 8 aa, Borrelia burgdorferi
HEKLSQVA

SEQ ID NO: 19257 - protein, 8 aa, Borrelia burgdorferi
EKLSQVAQ

SEQ ID NO: 19258 - protein, 8 aa, Borrelia burgdorferi
KLSQVAQH

SEQ ID NO: 19259 - protein, 8 aa, Borrelia burgdorferi
LSQVAQHA

SEQ ID NO: 19260 - protein, 8 aa, Borrelia burgdorferi
SQVAQHAP

SEQ ID NO: 19261 - protein, 8 aa, Borrelia burgdorferi
QVAQHAPN

SEQ ID NO: 19262 - protein, 8 aa, Borrelia burgdorferi
VAQHAPNS

SEQ ID NO: 19263 - protein, 8 aa, Borrelia burgdorferi
AQHAPNSK

SEQ ID NO: 19264 - protein, 8 aa, Borrelia burgdorferi
QHAPNSKI

SEQ ID NO: 19265 - protein, 8 aa, Borrelia burgdorferi
HAPNSKIE

SEQ ID NO: 19266 - protein, 8 aa, Borrelia burgdorferi
APNSKIEK

SEQ ID NO: 19267 - protein, 8 aa, Borrelia burgdorferi
PNSKIEKV

SEQ ID NO: 19268 - protein, 8 aa, Borrelia burgdorferi
NSKIEKVK

SEQ ID NO: 19269 - protein, 8 aa, Borrelia burgdorferi
SKIEKVKS

SEQ ID NO: 19270 - protein, 8 aa, Borrelia burgdorferi
KIEKVKSD

SEQ ID NO: 19271 - protein, 8 aa, Borrelia burgdorferi
IEKVKSDG

SEQ ID NO: 19272 - protein, 8 aa, Borrelia burgdorferi
EKVKSDGK

SEQ ID NO: 19273 - protein, 8 aa, Borrelia burgdorferi
KVKSDGKP

SEQ ID NO: 19274 - protein, 8 aa, Borrelia burgdorferi
VKSDGKPV

SEQ ID NO: 19275 - protein, 8 aa, Borrelia burgdorferi
KSDGKPVP

SEQ ID NO: 19276 - protein, 8 aa, Borrelia burgdorferi
SDGKPVPG

SEQ ID NO: 19277 - protein, 8 aa, Borrelia burgdorferi
DGKPVPGD

SEQ ID NO: 19278 - protein, 8 aa, Borrelia burgdorferi
GKPVPGDK

SEQ ID NO: 19279 - protein, 8 aa, Borrelia burgdorferi
KPVPGDKI

SEQ ID NO: 19280 - protein, 8 aa, Borrelia burgdorferi
PVPGDKIL

SEQ ID NO: 19281 - protein, 8 aa, Borrelia burgdorferi
VPGDKILS

SEQ ID NO: 19282 - protein, 8 aa, Borrelia burgdorferi
PGDKILSS

SEQ ID NO: 19283 - protein, 8 aa, Borrelia burgdorferi
GDKILSSN

SEQ ID NO: 19284 - protein, 8 aa, Borrelia burgdorferi
DKILSSNK

SEQ ID NO: 19285 - protein, 8 aa, Borrelia burgdorferi
KILSSNKD

SEQ ID NO: 19286 - protein, 8 aa, Borrelia burgdorferi
ILSSNKDI

SEQ ID NO: 19287 - protein, 8 aa, Borrelia burgdorferi
LSSNKDIY

SEQ ID NO: 19288 - protein, 8 aa, Borrelia burgdorferi
SSNKDIYN

SEQ ID NO: 19289 - protein, 8 aa, Borrelia burgdorferi
SNKDIYNS

SEQ ID NO: 19290 - protein, 8 aa, Borrelia burgdorferi
NKDIYNSY

SEQ ID NO: 19291 - protein, 8 aa, Borrelia burgdorferi
KDIYNSYI

SEQ ID NO: 19292 - protein, 8 aa, Borrelia burgdorferi
DIYNSYIP

SEQ ID NO: 19293 - protein, 8 aa, Borrelia burgdorferi
IYNSYIPE

SEQ ID NO: 19294 - protein, 8 aa, Borrelia burgdorferi
YNSYIPEV

SEQ ID NO: 19295 - protein, 8 aa, Borrelia burgdorferi
NSYIPEVK

SEQ ID NO: 19296 - protein, 8 aa, Borrelia burgdorferi
SYIPEVKE

SEQ ID NO: 19297 - protein, 8 aa, Borrelia burgdorferi
YIPEVKEE

SEQ ID NO: 19298 - protein, 8 aa, Borrelia burgdorferi
IPEVKEEI

SEQ ID NO: 19299 - protein, 8 aa, Borrelia burgdorferi
PEVKEEIV

SEQ ID NO: 19300 - protein, 8 aa, Borrelia burgdorferi
EVKEEIVY

SEQ ID NO: 19301 - protein, 8 aa, Borrelia burgdorferi
VKEEIVYE

SEQ ID NO: 19302 - protein, 8 aa, Borrelia burgdorferi
KEEIVYEI

SEQ ID NO: 19303 - protein, 8 aa, Borrelia burgdorferi
EEIVYEIL

SEQ ID NO: 19304 - protein, 8 aa, Borrelia burgdorferi
EIVYEILE

SEQ ID NO: 19305 - protein, 8 aa, Borrelia burgdorferi
IVYEILEE

SEQ ID NO: 19306 - protein, 8 aa, Borrelia burgdorferi
VYEILEEV

SEQ ID NO: 19307 - protein, 8 aa, Borrelia burgdorferi
YEILEEVI

SEQ ID NO: 19308 - protein, 8 aa, Borrelia burgdorferi
EILEEVII

SEQ ID NO: 19309 - protein, 8 aa, Borrelia burgdorferi
ILEEVIIP

SEQ ID NO: 19310 - protein, 8 aa, Borrelia burgdorferi
LEEVIIPE

SEQ ID NO: 19311 - protein, 8 aa, Borrelia burgdorferi
EEVIIPET

SEQ ID NO: 19312 - protein, 8 aa, Borrelia burgdorferi
EVIIPETK

SEQ ID NO: 19313 - protein, 8 aa, Borrelia burgdorferi
VIIPETKI

SEQ ID NO: 19314 - protein, 8 aa, Borrelia burgdorferi
IIPETKIP

SEQ ID NO: 19315 - protein, 8 aa, Borrelia burgdorferi
IPETKIPE

SEQ ID NO: 19316 - protein, 8 aa, Borrelia burgdorferi
PETKIPEI

SEQ ID NO: 19317 - protein, 8 aa, Borrelia burgdorferi
ETKIPEIT

SEQ ID NO: 19318 - protein, 8 aa, Borrelia burgdorferi
TKIPEITE

SEQ ID NO: 19319 - protein, 8 aa, Borrelia burgdorferi
KIPEITEE

SEQ ID NO: 19320 - protein, 8 aa, Borrelia burgdorferi
IPEITEEV

SEQ ID NO: 19321 - protein, 8 aa, Borrelia burgdorferi
PEITEEVI

SEQ ID NO: 19322 - protein, 8 aa, Borrelia burgdorferi
EITEEVIM

SEQ ID NO: 19323 - protein, 8 aa, Borrelia burgdorferi
ITEEVIMP

SEQ ID NO: 19324 - protein, 8 aa, Borrelia burgdorferi
TEEVIMPI

SEQ ID NO: 19325 - protein, 8 aa, Borrelia burgdorferi
EEVIMPIP

SEQ ID NO: 19326 - protein, 8 aa, Borrelia burgdorferi
EVIMPIPQ

SEQ ID NO: 19327 - protein, 8 aa, Borrelia burgdorferi
VIMPIPQT

SEQ ID NO: 19328 - protein, 8 aa, Borrelia burgdorferi
IMPIPQTI

SEQ ID NO: 19329 - protein, 8 aa, Borrelia burgdorferi
MPIPQTID

SEQ ID NO: 19330 - protein, 8 aa, Borrelia burgdorferi
PIPQTIDF

SEQ ID NO: 19331 - protein, 8 aa, Borrelia burgdorferi
IPQTIDFY

SEQ ID NO: 19332 - protein, 8 aa, Borrelia burgdorferi
PQTIDFYI

SEQ ID NO: 19333 - protein, 8 aa, Borrelia burgdorferi
QTIDFYIE

SEQ ID NO: 19334 - protein, 8 aa, Borrelia burgdorferi
TIDFYIEP

SEQ ID NO: 19335 - protein, 8 aa, Borrelia burgdorferi
IDFYIEPR

SEQ ID NO: 19336 - protein, 8 aa, Borrelia burgdorferi
DFYIEPRP

SEQ ID NO: 19337 - protein, 8 aa, Borrelia burgdorferi
FYIEPRPI

SEQ ID NO: 19338 - protein, 8 aa, Borrelia burgdorferi
YIEPRPIS

SEQ ID NO: 19339 - protein, 8 aa, Borrelia burgdorferi
IEPRPISS

SEQ ID NO: 19340 - protein, 8 aa, Borrelia burgdorferi
EPRPISSF

SEQ ID NO: 19341 - protein, 8 aa, Borrelia burgdorferi
PRPISSFL

SEQ ID NO: 19342 - protein, 8 aa, Borrelia burgdorferi
RPISSFLT

SEQ ID NO: 19343 - protein, 8 aa, Borrelia burgdorferi
PISSFLTQ

SEQ ID NO: 19344 - protein, 8 aa, Borrelia burgdorferi
ISSFLTQG

SEQ ID NO: 19345 - protein, 8 aa, Borrelia burgdorferi
SSFLTQGT

SEQ ID NO: 19346 - protein, 8 aa, Borrelia burgdorferi
SFLTQGTS

SEQ ID NO: 19347 - protein, 8 aa, Borrelia burgdorferi
FLTQGTSP

SEQ ID NO: 19348 - protein, 8 aa, Borrelia burgdorferi
LTQGTSPS

SEQ ID NO: 19349 - protein, 8 aa, Borrelia burgdorferi
TQGTSPSI

SEQ ID NO: 19350 - protein, 8 aa, Borrelia burgdorferi
QGTSPSIT

SEQ ID NO: 19351 - protein, 8 aa, Borrelia burgdorferi
GTSPSITS

SEQ ID NO: 19352 - protein, 8 aa, Borrelia burgdorferi
TSPSITST

SEQ ID NO: 19353 - protein, 8 aa, Borrelia burgdorferi
SPSITSTI

SEQ ID NO: 19354 - protein, 8 aa, Borrelia burgdorferi
PSITSTIK

SEQ ID NO: 19355 - protein, 8 aa, Borrelia burgdorferi
SITSTIKS

SEQ ID NO: 19356 - protein, 8 aa, Borrelia burgdorferi
ITSTIKSY

SEQ ID NO: 19357 - protein, 8 aa, Borrelia burgdorferi
TSTIKSYK

SEQ ID NO: 19358 - protein, 8 aa, Borrelia burgdorferi
STIKSYKE

SEQ ID NO: 19359 - protein, 8 aa, Borrelia burgdorferi
TIKSYKEL

SEQ ID NO: 19360 - protein, 8 aa, Borrelia burgdorferi
IKSYKELA

SEQ ID NO: 19361 - protein, 8 aa, Borrelia burgdorferi
KSYKELAK

SEQ ID NO: 19362 - protein, 8 aa, Borrelia burgdorferi
SYKELAKE

SEQ ID NO: 19363 - protein, 8 aa, Borrelia burgdorferi
YKELAKEK

SEQ ID NO: 19364 - protein, 8 aa, Borrelia burgdorferi
KELAKEKI

SEQ ID NO: 19365 - protein, 8 aa, Borrelia burgdorferi
ELAKEKIN

SEQ ID NO: 19366 - protein, 8 aa, Borrelia burgdorferi
LAKEKINN

SEQ ID NO: 19367 - protein, 8 aa, Borrelia burgdorferi
AKEKINNG

SEQ ID NO: 19368 - protein, 8 aa, Borrelia burgdorferi
KEKINNGL

SEQ ID NO: 19369 - protein, 8 aa, Borrelia burgdorferi
EKINNGLN

SEQ ID NO: 19370 - protein, 8 aa, Borrelia burgdorferi
KINNGLNI

SEQ ID NO: 19371 - protein, 8 aa, Borrelia burgdorferi
INNGLNIV

SEQ ID NO: 19372 - protein, 8 aa, Borrelia burgdorferi
NNGLNIVQ

SEQ ID NO: 19373 - protein, 8 aa, Borrelia burgdorferi
NGLNIVQK

SEQ ID NO: 19374 - protein, 8 aa, Borrelia burgdorferi
GLNIVQKI

SEQ ID NO: 19375 - protein, 8 aa, Borrelia burgdorferi
LNIVQKIT

SEQ ID NO: 19376 - protein, 8 aa, Borrelia burgdorferi
NIVQKITQ

SEQ ID NO: 19377 - protein, 8 aa, Borrelia burgdorferi
IVQKITQN

SEQ ID NO: 19378 - protein, 8 aa, Borrelia burgdorferi
VQKITQNI

SEQ ID NO: 19379 - protein, 8 aa, Borrelia burgdorferi
QKITQNID

SEQ ID NO: 19380 - protein, 8 aa, Borrelia burgdorferi
KITQNIDN

SEQ ID NO: 19381 - protein, 8 aa, Borrelia burgdorferi
ITQNIDNI

SEQ ID NO: 19382 - protein, 8 aa, Borrelia burgdorferi
TQNIDNIT

SEQ ID NO: 19383 - protein, 8 aa, Borrelia burgdorferi
QNIDNITE

SEQ ID NO: 19384 - protein, 8 aa, Borrelia burgdorferi
NIDNITEN

SEQ ID NO: 19385 - protein, 8 aa, Borrelia burgdorferi
IDNITENL

SEQ ID NO: 19386 - protein, 8 aa, Borrelia burgdorferi
DNITENLN

SEQ ID NO: 19387 - protein, 8 aa, Borrelia burgdorferi
NITENLNS

SEQ ID NO: 19388 - protein, 8 aa, Borrelia burgdorferi
ITENLNSK

SEQ ID NO: 19389 - protein, 8 aa, Borrelia burgdorferi
TENLNSKE

SEQ ID NO: 19390 - protein, 8 aa, Borrelia burgdorferi
ENLNSKET

SEQ ID NO: 19391 - protein, 8 aa, Borrelia burgdorferi
NLNSKETP

SEQ ID NO: 19392 - protein, 8 aa, Borrelia burgdorferi
LNSKETPK

SEQ ID NO: 19393 - protein, 8 aa, Borrelia burgdorferi
NSKETPKE

SEQ ID NO: 19394 - protein, 8 aa, Borrelia burgdorferi
SKETPKEI

SEQ ID NO: 19395 - protein, 8 aa, Borrelia burgdorferi
KETPKEIS

SEQ ID NO: 19396 - protein, 8 aa, Borrelia burgdorferi
ETPKEISG

SEQ ID NO: 19397 - protein, 8 aa, Borrelia burgdorferi
TPKEISGK

SEQ ID NO: 19398 - protein, 8 aa, Borrelia burgdorferi
PKEISGKE

SEQ ID NO: 19399 - protein, 8 aa, Borrelia burgdorferi
KEISGKEV

SEQ ID NO: 19400 - protein, 8 aa, Borrelia burgdorferi
EISGKEVE

SEQ ID NO: 19401 - protein, 8 aa, Borrelia burgdorferi
ISGKEVEE

SEQ ID NO: 19402 - protein, 8 aa, Borrelia burgdorferi
SGKEVEEK

SEQ ID NO: 19403 - protein, 8 aa, Borrelia burgdorferi
GKEVEEKI

SEQ ID NO: 19404 - protein, 8 aa, Borrelia burgdorferi
KEVEEKIT

SEQ ID NO: 19405 - protein, 8 aa, Borrelia burgdorferi
EVEEKITH

SEQ ID NO: 19406 - protein, 8 aa, Borrelia burgdorferi
VEEKITHP

SEQ ID NO: 19407 - protein, 8 aa, Borrelia burgdorferi
EEKITHPI

SEQ ID NO: 19408 - protein, 8 aa, Borrelia burgdorferi
EKITHPIF

SEQ ID NO: 19409 - protein, 8 aa, Borrelia burgdorferi
KITHPIFD

SEQ ID NO: 19410 - protein, 8 aa, Borrelia burgdorferi
ITHPIFDH

SEQ ID NO: 19411 - protein, 8 aa, Borrelia burgdorferi
THPIFDHI

SEQ ID NO: 19412 - protein, 8 aa, Borrelia burgdorferi
HPIFDHIT

SEQ ID NO: 19413 - protein, 8 aa, Borrelia burgdorferi
PIFDHITG

SEQ ID NO: 19414 - protein, 8 aa, Borrelia burgdorferi
IFDHITGS

SEQ ID NO: 19415 - protein, 8 aa, Borrelia burgdorferi
FDHITGSG

SEQ ID NO: 19416 - protein, 8 aa, Borrelia burgdorferi
DHITGSGN

SEQ ID NO: 19417 - protein, 8 aa, Borrelia burgdorferi
HITGSGNN

SEQ ID NO: 19418 - protein, 8 aa, Borrelia burgdorferi
ITGSGNNP

SEQ ID NO: 19419 - protein, 8 aa, Borrelia burgdorferi
TGSGNNPG

SEQ ID NO: 19420 - protein, 8 aa, Borrelia burgdorferi
GSGNNPGQ

SEQ ID NO: 19421 - protein, 8 aa, Borrelia burgdorferi
SGNNPGQD

SEQ ID NO: 19422 - protein, 8 aa, Borrelia burgdorferi
GNNPGQDS

SEQ ID NO: 19423 - protein, 8 aa, Borrelia burgdorferi
NNPGQDSI

SEQ ID NO: 19424 - protein, 8 aa, Borrelia burgdorferi
NPGQDSIS

SEQ ID NO: 19425 - protein, 8 aa, Borrelia burgdorferi
PGQDSISN

SEQ ID NO: 19426 - protein, 8 aa, Borrelia burgdorferi
GQDSISNT

SEQ ID NO: 19427 - protein, 8 aa, Borrelia burgdorferi
QDSISNTW

SEQ ID NO: 19428 - protein, 8 aa, Borrelia burgdorferi
DSISNTWG

SEQ ID NO: 19429 - protein, 8 aa, Borrelia burgdorferi
SISNTWGE

SEQ ID NO: 19430 - protein, 8 aa, Borrelia burgdorferi
ISNTWGEG

SEQ ID NO: 19431 - protein, 8 aa, Borrelia burgdorferi
SNTWGEGL

SEQ ID NO: 19432 - protein, 8 aa, Borrelia burgdorferi
NTWGEGLE

SEQ ID NO: 19433 - protein, 8 aa, Borrelia burgdorferi
TWGEGLEI

SEQ ID NO: 19434 - protein, 8 aa, Borrelia burgdorferi
WGEGLEIG

SEQ ID NO: 19435 - protein, 8 aa, Borrelia burgdorferi
GEGLEIGG

SEQ ID NO: 19436 - protein, 8 aa, Borrelia burgdorferi
EGLEIGGD

SEQ ID NO: 19437 - protein, 8 aa, Borrelia burgdorferi
GLEIGGDS

SEQ ID NO: 19438 - protein, 8 aa, Borrelia burgdorferi
LEIGGDSN

SEQ ID NO: 19439 - protein, 8 aa, Borrelia burgdorferi
EIGGDSNF

SEQ ID NO: 19440 - protein, 8 aa, Borrelia burgdorferi
IGGDSNFF

SEQ ID NO: 19441 - protein, 8 aa, Borrelia burgdorferi
GGDSNFFT

SEQ ID NO: 19442 - protein, 8 aa, Borrelia burgdorferi
GDSNFFTN

SEQ ID NO: 19443 - protein, 8 aa, Borrelia burgdorferi
DSNFFTNL

SEQ ID NO: 19444 - protein, 8 aa, Borrelia burgdorferi
SNFFTNLE

SEQ ID NO: 19445 - protein, 8 aa, Borrelia burgdorferi
NFFTNLEE

SEQ ID NO: 19446 - protein, 8 aa, Borrelia burgdorferi
FFTNLEEV

SEQ ID NO: 19447 - protein, 8 aa, Borrelia burgdorferi
FTNLEEVR

SEQ ID NO: 19448 - protein, 8 aa, Borrelia burgdorferi
TNLEEVRS

SEQ ID NO: 19449 - protein, 8 aa, Borrelia burgdorferi
NLEEVRSS

SEQ ID NO: 19450 - protein, 8 aa, Borrelia burgdorferi
LEEVRSSI

SEQ ID NO: 19451 - protein, 8 aa, Borrelia burgdorferi
EEVRSSIR

SEQ ID NO: 19452 - protein, 8 aa, Borrelia burgdorferi
EVRSSIRT

SEQ ID NO: 19453 - protein, 8 aa, Borrelia burgdorferi
VRSSIRTK

SEQ ID NO: 19454 - protein, 8 aa, Borrelia burgdorferi
RSSIRTKI

SEQ ID NO: 19455 - protein, 8 aa, Borrelia burgdorferi
SSIRTKIK

SEQ ID NO: 19456 - protein, 8 aa, Borrelia burgdorferi
SIRTKIKV

SEQ ID NO: 19457 - protein, 8 aa, Borrelia burgdorferi
IRTKIKVS

SEQ ID NO: 19458 - protein, 8 aa, Borrelia burgdorferi
RTKIKVSD

SEQ ID NO: 19459 - protein, 8 aa, Borrelia burgdorferi
TKIKVSDG

SEQ ID NO: 19460 - protein, 8 aa, Borrelia burgdorferi
KIKVSDGT

SEQ ID NO: 19461 - protein, 8 aa, Borrelia burgdorferi
IKVSDGTE

SEQ ID NO: 19462 - protein, 8 aa, Borrelia burgdorferi
KVSDGTEQ

SEQ ID NO: 19463 - protein, 8 aa, Borrelia burgdorferi
VSDGTEQT

SEQ ID NO: 19464 - protein, 8 aa, Borrelia burgdorferi
SDGTEQTK

SEQ ID NO: 19465 - protein, 8 aa, Borrelia burgdorferi
DGTEQTKD

SEQ ID NO: 19466 - protein, 8 aa, Borrelia burgdorferi
GTEQTKDK

SEQ ID NO: 19467 - protein, 8 aa, Borrelia burgdorferi
TEQTKDKV

SEQ ID NO: 19468 - protein, 8 aa, Borrelia burgdorferi
EQTKDKVE

SEQ ID NO: 19469 - protein, 8 aa, Borrelia burgdorferi
QTKDKVEI

SEQ ID NO: 19470 - protein, 8 aa, Borrelia burgdorferi
TKDKVEID

SEQ ID NO: 19471 - protein, 8 aa, Borrelia burgdorferi
KDKVEIDE

SEQ ID NO: 19472 - protein, 8 aa, Borrelia burgdorferi
DKVEIDEI

SEQ ID NO: 19473 - protein, 8 aa, Borrelia burgdorferi
KVEIDEII

SEQ ID NO: 19474 - protein, 8 aa, Borrelia burgdorferi
VEIDEIIE

SEQ ID NO: 19475 - protein, 8 aa, Borrelia burgdorferi
EIDEIIED

SEQ ID NO: 19476 - protein, 8 aa, Borrelia burgdorferi
IDEIIEDL

SEQ ID NO: 19477 - protein, 8 aa, Borrelia burgdorferi
DEIIEDLQ

SEQ ID NO: 19478 - protein, 8 aa, Borrelia burgdorferi
EIIEDLQK

SEQ ID NO: 19479 - protein, 8 aa, Borrelia burgdorferi
IIEDLQKL

SEQ ID NO: 19480 - protein, 8 aa, Borrelia burgdorferi
IEDLQKLK

SEQ ID NO: 19481 - protein, 8 aa, Borrelia burgdorferi
EDLQKLKE

SEQ ID NO: 19482 - protein, 8 aa, Borrelia burgdorferi
DLQKLKEF

SEQ ID NO: 19483 - protein, 8 aa, Borrelia burgdorferi
LQKLKEFL

SEQ ID NO: 19484 - protein, 8 aa, Borrelia burgdorferi
QKLKEFLE

SEQ ID NO: 19485 - protein, 8 aa, Borrelia burgdorferi
KLKEFLEK

SEQ ID NO: 19486 - protein, 8 aa, Borrelia burgdorferi
LKEFLEKL

SEQ ID NO: 19487 - protein, 8 aa, Borrelia burgdorferi
KEFLEKLK

SEQ ID NO: 19488 - protein, 8 aa, Borrelia burgdorferi
EFLEKLKK

SEQ ID NO: 19489 - protein, 8 aa, Borrelia burgdorferi
FLEKLKKY

SEQ ID NO: 19490 - protein, 8 aa, Borrelia burgdorferi
LEKLKKYL

SEQ ID NO: 19491 - protein, 8 aa, Borrelia burgdorferi
EKLKKYLK

SEQ ID NO: 19492 - protein, 8 aa, Borrelia burgdorferi
KLKKYLKD

SEQ ID NO: 19493 - protein, 8 aa, Borrelia burgdorferi
LKKYLKDT

SEQ ID NO: 19494 - protein, 8 aa, Borrelia burgdorferi
KKYLKDTN

SEQ ID NO: 19495 - protein, 8 aa, Borrelia burgdorferi
KYLKDTNN

SEQ ID NO: 19496 - protein, 8 aa, Borrelia burgdorferi
YLKDTNNL

SEQ ID NO: 19497 - protein, 8 aa, Borrelia burgdorferi
LKDTNNLS

SEQ ID NO: 19498 - protein, 8 aa, Borrelia burgdorferi
KDTNNLSA

SEQ ID NO: 19499 - protein, 8 aa, Borrelia burgdorferi
DTNNLSAI

SEQ ID NO: 19500 - protein, 8 aa, Borrelia burgdorferi
TNNLSAIE

SEQ ID NO: 19501 - protein, 8 aa, Borrelia burgdorferi
NNLSAIEE

SEQ ID NO: 19502 - protein, 8 aa, Borrelia burgdorferi
NLSAIEES

SEQ ID NO: 19503 - protein, 8 aa, Borrelia burgdorferi
LSAIEESV

SEQ ID NO: 19504 - protein, 8 aa, Borrelia burgdorferi
SAIEESVK

SEQ ID NO: 19505 - protein, 8 aa, Borrelia burgdorferi
AIEESVKG

SEQ ID NO: 19506 - protein, 8 aa, Borrelia burgdorferi
IEESVKGL

SEQ ID NO: 19507 - protein, 8 aa, Borrelia burgdorferi
EESVKGLS

SEQ ID NO: 19508 - protein, 9 aa, Borrelia burgdorferi
MCAFLLLNL

SEQ ID NO: 19509 - protein, 9 aa, Borrelia burgdorferi
CAFLLLNLV

SEQ ID NO: 19510 - protein, 9 aa, Borrelia burgdorferi
AFLLLNLVN

SEQ ID NO: 19511 - protein, 9 aa, Borrelia burgdorferi
FLLLNLVNC

SEQ ID NO: 19512 - protein, 9 aa, Borrelia burgdorferi
LLLNLVNCK

SEQ ID NO: 19513 - protein, 9 aa, Borrelia burgdorferi
LLNLVNCKF

SEQ ID NO: 19514 - protein, 9 aa, Borrelia burgdorferi
LNLVNCKFD

SEQ ID NO: 19515 - protein, 9 aa, Borrelia burgdorferi
NLVNCKFDS

SEQ ID NO: 19516 - protein, 9 aa, Borrelia burgdorferi
LVNCKFDSL

SEQ ID NO: 19517 - protein, 9 aa, Borrelia burgdorferi
VNCKFDSLN

SEQ ID NO: 19518 - protein, 9 aa, Borrelia burgdorferi
NCKFDSLNL

SEQ ID NO: 19519 - protein, 9 aa, Borrelia burgdorferi
CKFDSLNLS

SEQ ID NO: 19520 - protein, 9 aa, Borrelia burgdorferi
KFDSLNLST

SEQ ID NO: 19521 - protein, 9 aa, Borrelia burgdorferi
FDSLNLSTK

SEQ ID NO: 19522 - protein, 9 aa, Borrelia burgdorferi
DSLNLSTKS

SEQ ID NO: 19523 - protein, 9 aa, Borrelia burgdorferi
SLNLSTKSV

SEQ ID NO: 19524 - protein, 9 aa, Borrelia burgdorferi
LNLSTKSVD

SEQ ID NO: 19525 - protein, 9 aa, Borrelia burgdorferi
NLSTKSVDD

SEQ ID NO: 19526 - protein, 9 aa, Borrelia burgdorferi
LSTKSVDDK

SEQ ID NO: 19527 - protein, 9 aa, Borrelia burgdorferi
STKSVDDKN

SEQ ID NO: 19528 - protein, 9 aa, Borrelia burgdorferi
TKSVDDKNN

SEQ ID NO: 19529 - protein, 9 aa, Borrelia burgdorferi
KSVDDKNNS

SEQ ID NO: 19530 - protein, 9 aa, Borrelia burgdorferi
SVDDKNNSI

SEQ ID NO: 19531 - protein, 9 aa, Borrelia burgdorferi
VDDKNNSIA

SEQ ID NO: 19532 - protein, 9 aa, Borrelia burgdorferi
DDKNNSIAK

SEQ ID NO: 19533 - protein, 9 aa, Borrelia burgdorferi
DKNNSIAKL

SEQ ID NO: 19534 - protein, 9 aa, Borrelia burgdorferi
KNNSIAKLL

SEQ ID NO: 19535 - protein, 9 aa, Borrelia burgdorferi
NNSIAKLLQ

SEQ ID NO: 19536 - protein, 9 aa, Borrelia burgdorferi
NSIAKLLQH

SEQ ID NO: 19537 - protein, 9 aa, Borrelia burgdorferi
SIAKLLQHL

SEQ ID NO: 19538 - protein, 9 aa, Borrelia burgdorferi
IAKLLQHLS

SEQ ID NO: 19539 - protein, 9 aa, Borrelia burgdorferi
AKLLQHLSK

SEQ ID NO: 19540 - protein, 9 aa, Borrelia burgdorferi
KLLQHLSKS

SEQ ID NO: 19541 - protein, 9 aa, Borrelia burgdorferi
LLQHLSKSE

SEQ ID NO: 19542 - protein, 9 aa, Borrelia burgdorferi
LQHLSKSED

SEQ ID NO: 19543 - protein, 9 aa, Borrelia burgdorferi
QHLSKSEDQ

SEQ ID NO: 19544 - protein, 9 aa, Borrelia burgdorferi
HLSKSEDQA

SEQ ID NO: 19545 - protein, 9 aa, Borrelia burgdorferi
LSKSEDQAN

SEQ ID NO: 19546 - protein, 9 aa, Borrelia burgdorferi
SKSEDQANK

SEQ ID NO: 19547 - protein, 9 aa, Borrelia burgdorferi
KSEDQANKT

SEQ ID NO: 19548 - protein, 9 aa, Borrelia burgdorferi
SEDQANKTS

SEQ ID NO: 19549 - protein, 9 aa, Borrelia burgdorferi
EDQANKTST

SEQ ID NO: 19550 - protein, 9 aa, Borrelia burgdorferi
DQANKTSTS

SEQ ID NO: 19551 - protein, 9 aa, Borrelia burgdorferi
QANKTSTSE

SEQ ID NO: 19552 - protein, 9 aa, Borrelia burgdorferi
ANKTSTSED

SEQ ID NO: 19553 - protein, 9 aa, Borrelia burgdorferi
NKTSTSEDQ

SEQ ID NO: 19554 - protein, 9 aa, Borrelia burgdorferi
KTSTSEDQK

SEQ ID NO: 19555 - protein, 9 aa, Borrelia burgdorferi
TSTSEDQKE

SEQ ID NO: 19556 - protein, 9 aa, Borrelia burgdorferi
STSEDQKEL

SEQ ID NO: 19557 - protein, 9 aa, Borrelia burgdorferi
TSEDQKELE

SEQ ID NO: 19558 - protein, 9 aa, Borrelia burgdorferi
SEDQKELEI

SEQ ID NO: 19559 - protein, 9 aa, Borrelia burgdorferi
EDQKELEIT

SEQ ID NO: 19560 - protein, 9 aa, Borrelia burgdorferi
DQKELEITE

SEQ ID NO: 19561 - protein, 9 aa, Borrelia burgdorferi
QKELEITEN

SEQ ID NO: 19562 - protein, 9 aa, Borrelia burgdorferi
KELEITENK

SEQ ID NO: 19563 - protein, 9 aa, Borrelia burgdorferi
ELEITENKE

SEQ ID NO: 19564 - protein, 9 aa, Borrelia burgdorferi
LEITENKEQ

SEQ ID NO: 19565 - protein, 9 aa, Borrelia burgdorferi
EITENKEQE

SEQ ID NO: 19566 - protein, 9 aa, Borrelia burgdorferi
ITENKEQEH

SEQ ID NO: 19567 - protein, 9 aa, Borrelia burgdorferi
TENKEQEHE

SEQ ID NO: 19568 - protein, 9 aa, Borrelia burgdorferi
ENKEQEHEK

SEQ ID NO: 19569 - protein, 9 aa, Borrelia burgdorferi
NKEQEHEKL

SEQ ID NO: 19570 - protein, 9 aa, Borrelia burgdorferi
KEQEHEKLS

SEQ ID NO: 19571 - protein, 9 aa, Borrelia burgdorferi
EQEHEKLSQ

SEQ ID NO: 19572 - protein, 9 aa, Borrelia burgdorferi
QEHEKLSQV

SEQ ID NO: 19573 - protein, 9 aa, Borrelia burgdorferi
EHEKLSQVA

SEQ ID NO: 19574 - protein, 9 aa, Borrelia burgdorferi
HEKLSQVAQ

SEQ ID NO: 19575 - protein, 9 aa, Borrelia burgdorferi
EKLSQVAQH

SEQ ID NO: 19576 - protein, 9 aa, Borrelia burgdorferi
KLSQVAQHA

SEQ ID NO: 19577 - protein, 9 aa, Borrelia burgdorferi
LSQVAQHAP

SEQ ID NO: 19578 - protein, 9 aa, Borrelia burgdorferi
SQVAQHAPN

SEQ ID NO: 19579 - protein, 9 aa, Borrelia burgdorferi
QVAQHAPNS

SEQ ID NO: 19580 - protein, 9 aa, Borrelia burgdorferi
VAQHAPNSK

SEQ ID NO: 19581 - protein, 9 aa, Borrelia burgdorferi
AQHAPNSKI

SEQ ID NO: 19582 - protein, 9 aa, Borrelia burgdorferi
QHAPNSKIE

SEQ ID NO: 19583 - protein, 9 aa, Borrelia burgdorferi
HAPNSKIEK

SEQ ID NO: 19584 - protein, 9 aa, Borrelia burgdorferi
APNSKIEKV

SEQ ID NO: 19585 - protein, 9 aa, Borrelia burgdorferi
PNSKIEKVK

SEQ ID NO: 19586 - protein, 9 aa, Borrelia burgdorferi
NSKIEKVKS

SEQ ID NO: 19587 - protein, 9 aa, Borrelia burgdorferi
SKIEKVKSD

SEQ ID NO: 19588 - protein, 9 aa, Borrelia burgdorferi
KIEKVKSDG

SEQ ID NO: 19589 - protein, 9 aa, Borrelia burgdorferi
IEKVKSDGK

SEQ ID NO: 19590 - protein, 9 aa, Borrelia burgdorferi
EKVKSDGKP

SEQ ID NO: 19591 - protein, 9 aa, Borrelia burgdorferi
KVKSDGKPV

SEQ ID NO: 19592 - protein, 9 aa, Borrelia burgdorferi
VKSDGKPVP

SEQ ID NO: 19593 - protein, 9 aa, Borrelia burgdorferi
KSDGKPVPG

SEQ ID NO: 19594 - protein, 9 aa, Borrelia burgdorferi
SDGKPVPGD

SEQ ID NO: 19595 - protein, 9 aa, Borrelia burgdorferi
DGKPVPGDK

SEQ ID NO: 19596 - protein, 9 aa, Borrelia burgdorferi
GKPVPGDKI

SEQ ID NO: 19597 - protein, 9 aa, Borrelia burgdorferi
KPVPGDKIL

SEQ ID NO: 19598 - protein, 9 aa, Borrelia burgdorferi
PVPGDKILS

SEQ ID NO: 19599 - protein, 9 aa, Borrelia burgdorferi
VPGDKILSS

SEQ ID NO: 19600 - protein, 9 aa, Borrelia burgdorferi
PGDKILSSN

SEQ ID NO: 19601 - protein, 9 aa, Borrelia burgdorferi
GDKILSSNK

SEQ ID NO: 19602 - protein, 9 aa, Borrelia burgdorferi
DKILSSNKD

SEQ ID NO: 19603 - protein, 9 aa, Borrelia burgdorferi
KILSSNKDI

SEQ ID NO: 19604 - protein, 9 aa, Borrelia burgdorferi
ILSSNKDIY

SEQ ID NO: 19605 - protein, 9 aa, Borrelia burgdorferi
LSSNKDIYN

SEQ ID NO: 19606 - protein, 9 aa, Borrelia burgdorferi
SSNKDIYNS

SEQ ID NO: 19607 - protein, 9 aa, Borrelia burgdorferi
SNKDIYNSY

SEQ ID NO: 19608 - protein, 9 aa, Borrelia burgdorferi
NKDIYNSYI

SEQ ID NO: 19609 - protein, 9 aa, Borrelia burgdorferi
KDIYNSYIP

SEQ ID NO: 19610 - protein, 9 aa, Borrelia burgdorferi
DIYNSYIPE

SEQ ID NO: 19611 - protein, 9 aa, Borrelia burgdorferi
IYNSYIPEV

SEQ ID NO: 19612 - protein, 9 aa, Borrelia burgdorferi
YNSYIPEVK

SEQ ID NO: 19613 - protein, 9 aa, Borrelia burgdorferi
NSYIPEVKE

SEQ ID NO: 19614 - protein, 9 aa, Borrelia burgdorferi
SYIPEVKEE

SEQ ID NO: 19615 - protein, 9 aa, Borrelia burgdorferi
YIPEVKEEI

SEQ ID NO: 19616 - protein, 9 aa, Borrelia burgdorferi
IPEVKEEIV

SEQ ID NO: 19617 - protein, 9 aa, Borrelia burgdorferi
PEVKEEIVY

SEQ ID NO: 19618 - protein, 9 aa, Borrelia burgdorferi
EVKEEIVYE

SEQ ID NO: 19619 - protein, 9 aa, Borrelia burgdorferi
VKEEIVYEI

SEQ ID NO: 19620 - protein, 9 aa, Borrelia burgdorferi
KEEIVYEIL

SEQ ID NO: 19621 - protein, 9 aa, Borrelia burgdorferi
EEIVYEILE

SEQ ID NO: 19622 - protein, 9 aa, Borrelia burgdorferi
EIVYEILEE

SEQ ID NO: 19623 - protein, 9 aa, Borrelia burgdorferi
IVYEILEEV

SEQ ID NO: 19624 - protein, 9 aa, Borrelia burgdorferi
VYEILEEVI

SEQ ID NO: 19625 - protein, 9 aa, Borrelia burgdorferi
YEILEEVII

SEQ ID NO: 19626 - protein, 9 aa, Borrelia burgdorferi
EILEEVIIP

SEQ ID NO: 19627 - protein, 9 aa, Borrelia burgdorferi
ILEEVIIPE

SEQ ID NO: 19628 - protein, 9 aa, Borrelia burgdorferi
LEEVIIPET

SEQ ID NO: 19629 - protein, 9 aa, Borrelia burgdorferi
EEVIIPETK

SEQ ID NO: 19630 - protein, 9 aa, Borrelia burgdorferi
EVIIPETKI

SEQ ID NO: 19631 - protein, 9 aa, Borrelia burgdorferi
VIIPETKIP

SEQ ID NO: 19632 - protein, 9 aa, Borrelia burgdorferi
IIPETKIPE

SEQ ID NO: 19633 - protein, 9 aa, Borrelia burgdorferi
IPETKIPEI

SEQ ID NO: 19634 - protein, 9 aa, Borrelia burgdorferi
PETKIPEIT

SEQ ID NO: 19635 - protein, 9 aa, Borrelia burgdorferi
ETKIPEITE

SEQ ID NO: 19636 - protein, 9 aa, Borrelia burgdorferi
TKIPEITEE

SEQ ID NO: 19637 - protein, 9 aa, Borrelia burgdorferi
KIPEITEEV

SEQ ID NO: 19638 - protein, 9 aa, Borrelia burgdorferi
IPEITEEVI

SEQ ID NO: 19639 - protein, 9 aa, Borrelia burgdorferi
PEITEEVIM

SEQ ID NO: 19640 - protein, 9 aa, Borrelia burgdorferi
EITEEVIMP

SEQ ID NO: 19641 - protein, 9 aa, Borrelia burgdorferi
ITEEVIMPI

SEQ ID NO: 19642 - protein, 9 aa, Borrelia burgdorferi
TEEVIMPIP

SEQ ID NO: 19643 - protein, 9 aa, Borrelia burgdorferi
EEVIMPIPQ

SEQ ID NO: 19644 - protein, 9 aa, Borrelia burgdorferi
EVIMPIPQT

SEQ ID NO: 19645 - protein, 9 aa, Borrelia burgdorferi
VIMPIPQTI

SEQ ID NO: 19646 - protein, 9 aa, Borrelia burgdorferi
IMPIPQTID

SEQ ID NO: 19647 - protein, 9 aa, Borrelia burgdorferi
MPIPQTIDF

SEQ ID NO: 19648 - protein, 9 aa, Borrelia burgdorferi
PIPQTIDFY

SEQ ID NO: 19649 - protein, 9 aa, Borrelia burgdorferi
IPQTIDFYI

SEQ ID NO: 19650 - protein, 9 aa, Borrelia burgdorferi
PQTIDFYIE

SEQ ID NO: 19651 - protein, 9 aa, Borrelia burgdorferi
QTIDFYIEP

SEQ ID NO: 19652 - protein, 9 aa, Borrelia burgdorferi
TIDFYIEPR

SEQ ID NO: 19653 - protein, 9 aa, Borrelia burgdorferi
IDFYIEPRP

SEQ ID NO: 19654 - protein, 9 aa, Borrelia burgdorferi
DFYIEPRPI

SEQ ID NO: 19655 - protein, 9 aa, Borrelia burgdorferi
FYIEPRPIS

SEQ ID NO: 19656 - protein, 9 aa, Borrelia burgdorferi
YIEPRPISS

SEQ ID NO: 19657 - protein, 9 aa, Borrelia burgdorferi
IEPRPISSF

SEQ ID NO: 19658 - protein, 9 aa, Borrelia burgdorferi
EPRPISSFL

SEQ ID NO: 19659 - protein, 9 aa, Borrelia burgdorferi
PRPISSFLT

SEQ ID NO: 19660 - protein, 9 aa, Borrelia burgdorferi
RPISSFLTQ

SEQ ID NO: 19661 - protein, 9 aa, Borrelia burgdorferi
PISSFLTQG

SEQ ID NO: 19662 - protein, 9 aa, Borrelia burgdorferi
ISSFLTQGT

SEQ ID NO: 19663 - protein, 9 aa, Borrelia burgdorferi
SSFLTQGTS

SEQ ID NO: 19664 - protein, 9 aa, Borrelia burgdorferi
SFLTQGTSP

SEQ ID NO: 19665 - protein, 9 aa, Borrelia burgdorferi
FLTQGTSPS

SEQ ID NO: 19666 - protein, 9 aa, Borrelia burgdorferi
LTQGTSPSI

SEQ ID NO: 19667 - protein, 9 aa, Borrelia burgdorferi
TQGTSPSIT

SEQ ID NO: 19668 - protein, 9 aa, Borrelia burgdorferi
QGTSPSITS

SEQ ID NO: 19669 - protein, 9 aa, Borrelia burgdorferi
GTSPSITST

SEQ ID NO: 19670 - protein, 9 aa, Borrelia burgdorferi
TSPSITSTI

SEQ ID NO: 19671 - protein, 9 aa, Borrelia burgdorferi
SPSITSTIK

SEQ ID NO: 19672 - protein, 9 aa, Borrelia burgdorferi
PSITSTIKS

SEQ ID NO: 19673 - protein, 9 aa, Borrelia burgdorferi
SITSTIKSY

SEQ ID NO: 19674 - protein, 9 aa, Borrelia burgdorferi
ITSTIKSYK

SEQ ID NO: 19675 - protein, 9 aa, Borrelia burgdorferi
TSTIKSYKE

SEQ ID NO: 19676 - protein, 9 aa, Borrelia burgdorferi
STIKSYKEL

SEQ ID NO: 19677 - protein, 9 aa, Borrelia burgdorferi
TIKSYKELA

SEQ ID NO: 19678 - protein, 9 aa, Borrelia burgdorferi
IKSYKELAK

SEQ ID NO: 19679 - protein, 9 aa, Borrelia burgdorferi
KSYKELAKE

SEQ ID NO: 19680 - protein, 9 aa, Borrelia burgdorferi
SYKELAKEK

SEQ ID NO: 19681 - protein, 9 aa, Borrelia burgdorferi
YKELAKEKI

SEQ ID NO: 19682 - protein, 9 aa, Borrelia burgdorferi
KELAKEKIN

SEQ ID NO: 19683 - protein, 9 aa, Borrelia burgdorferi
ELAKEKINN

SEQ ID NO: 19684 - protein, 9 aa, Borrelia burgdorferi
LAKEKINNG

SEQ ID NO: 19685 - protein, 9 aa, Borrelia burgdorferi
AKEKINNGL

SEQ ID NO: 19686 - protein, 9 aa, Borrelia burgdorferi
KEKINNGLN

SEQ ID NO: 19687 - protein, 9 aa, Borrelia burgdorferi
EKINNGLNI

SEQ ID NO: 19688 - protein, 9 aa, Borrelia burgdorferi
KINNGLNIV

SEQ ID NO: 19689 - protein, 9 aa, Borrelia burgdorferi
INNGLNIVQ

SEQ ID NO: 19690 - protein, 9 aa, Borrelia burgdorferi
NNGLNIVQK

SEQ ID NO: 19691 - protein, 9 aa, Borrelia burgdorferi
NGLNIVQKI

SEQ ID NO: 19692 - protein, 9 aa, Borrelia burgdorferi
GLNIVQKIT

SEQ ID NO: 19693 - protein, 9 aa, Borrelia burgdorferi
LNIVQKITQ

SEQ ID NO: 19694 - protein, 9 aa, Borrelia burgdorferi
NIVQKITQN

SEQ ID NO: 19695 - protein, 9 aa, Borrelia burgdorferi
IVQKITQNI

SEQ ID NO: 19696 - protein, 9 aa, Borrelia burgdorferi
VQKITQNID

SEQ ID NO: 19697 - protein, 9 aa, Borrelia burgdorferi
QKITQNIDN

SEQ ID NO: 19698 - protein, 9 aa, Borrelia burgdorferi
KITQNIDNI

SEQ ID NO: 19699 - protein, 9 aa, Borrelia burgdorferi
ITQNIDNIT

SEQ ID NO: 19700 - protein, 9 aa, Borrelia burgdorferi
TQNIDNITE

SEQ ID NO: 19701 - protein, 9 aa, Borrelia burgdorferi
QNIDNITEN

SEQ ID NO: 19702 - protein, 9 aa, Borrelia burgdorferi
NIDNITENL

SEQ ID NO: 19703 - protein, 9 aa, Borrelia burgdorferi
IDNITENLN

SEQ ID NO: 19704 - protein, 9 aa, Borrelia burgdorferi
DNITENLNS

SEQ ID NO: 19705 - protein, 9 aa, Borrelia burgdorferi
NITENLNSK

SEQ ID NO: 19706 - protein, 9 aa, Borrelia burgdorferi
ITENLNSKE

SEQ ID NO: 19707 - protein, 9 aa, Borrelia burgdorferi
TENLNSKET

SEQ ID NO: 19708 - protein, 9 aa, Borrelia burgdorferi
ENLNSKETP

SEQ ID NO: 19709 - protein, 9 aa, Borrelia burgdorferi
NLNSKETPK

SEQ ID NO: 19710 - protein, 9 aa, Borrelia burgdorferi
LNSKETPKE

SEQ ID NO: 19711 - protein, 9 aa, Borrelia burgdorferi
NSKETPKEI

SEQ ID NO: 19712 - protein, 9 aa, Borrelia burgdorferi
SKETPKEIS

SEQ ID NO: 19713 - protein, 9 aa, Borrelia burgdorferi
KETPKEISG

SEQ ID NO: 19714 - protein, 9 aa, Borrelia burgdorferi
ETPKEISGK

SEQ ID NO: 19715 - protein, 9 aa, Borrelia burgdorferi
TPKEISGKE

SEQ ID NO: 19716 - protein, 9 aa, Borrelia burgdorferi
PKEISGKEV

SEQ ID NO: 19717 - protein, 9 aa, Borrelia burgdorferi
KEISGKEVE

SEQ ID NO: 19718 - protein, 9 aa, Borrelia burgdorferi
EISGKEVEE

SEQ ID NO: 19719 - protein, 9 aa, Borrelia burgdorferi
ISGKEVEEK

SEQ ID NO: 19720 - protein, 9 aa, Borrelia burgdorferi
SGKEVEEKI

SEQ ID NO: 19721 - protein, 9 aa, Borrelia burgdorferi
GKEVEEKIT

SEQ ID NO: 19722 - protein, 9 aa, Borrelia burgdorferi
KEVEEKITH

SEQ ID NO: 19723 - protein, 9 aa, Borrelia burgdorferi
EVEEKITHP

SEQ ID NO: 19724 - protein, 9 aa, Borrelia burgdorferi
VEEKITHPI

SEQ ID NO: 19725 - protein, 9 aa, Borrelia burgdorferi
EEKITHPIF

SEQ ID NO: 19726 - protein, 9 aa, Borrelia burgdorferi
EKITHPIFD

SEQ ID NO: 19727 - protein, 9 aa, Borrelia burgdorferi
KITHPIFDH

SEQ ID NO: 19728 - protein, 9 aa, Borrelia burgdorferi
ITHPIFDHI

SEQ ID NO: 19729 - protein, 9 aa, Borrelia burgdorferi
THPIFDHIT

SEQ ID NO: 19730 - protein, 9 aa, Borrelia burgdorferi
HPIFDHITG

SEQ ID NO: 19731 - protein, 9 aa, Borrelia burgdorferi
PIFDHITGS

SEQ ID NO: 19732 - protein, 9 aa, Borrelia burgdorferi
IFDHITGSG

SEQ ID NO: 19733 - protein, 9 aa, Borrelia burgdorferi
FDHITGSGN

SEQ ID NO: 19734 - protein, 9 aa, Borrelia burgdorferi
DHITGSGNN

SEQ ID NO: 19735 - protein, 9 aa, Borrelia burgdorferi
HITGSGNNP

SEQ ID NO: 19736 - protein, 9 aa, Borrelia burgdorferi
ITGSGNNPG

SEQ ID NO: 19737 - protein, 9 aa, Borrelia burgdorferi
TGSGNNPGQ

SEQ ID NO: 19738 - protein, 9 aa, Borrelia burgdorferi
GSGNNPGQD

SEQ ID NO: 19739 - protein, 9 aa, Borrelia burgdorferi
SGNNPGQDS

SEQ ID NO: 19740 - protein, 9 aa, Borrelia burgdorferi
GNNPGQDSI

SEQ ID NO: 19741 - protein, 9 aa, Borrelia burgdorferi
NNPGQDSIS

SEQ ID NO: 19742 - protein, 9 aa, Borrelia burgdorferi
NPGQDSISN

SEQ ID NO: 19743 - protein, 9 aa, Borrelia burgdorferi
PGQDSISNT

SEQ ID NO: 19744 - protein, 9 aa, Borrelia burgdorferi
GQDSISNTW

SEQ ID NO: 19745 - protein, 9 aa, Borrelia burgdorferi
QDSISNTWG

SEQ ID NO: 19746 - protein, 9 aa, Borrelia burgdorferi
DSISNTWGE

SEQ ID NO: 19747 - protein, 9 aa, Borrelia burgdorferi
SISNTWGEG

SEQ ID NO: 19748 - protein, 9 aa, Borrelia burgdorferi
ISNTWGEGL

SEQ ID NO: 19749 - protein, 9 aa, Borrelia burgdorferi
SNTWGEGLE

SEQ ID NO: 19750 - protein, 9 aa, Borrelia burgdorferi
NTWGEGLEI

SEQ ID NO: 19751 - protein, 9 aa, Borrelia burgdorferi
TWGEGLEIG

SEQ ID NO: 19752 - protein, 9 aa, Borrelia burgdorferi
WGEGLEIGG

SEQ ID NO: 19753 - protein, 9 aa, Borrelia burgdorferi
GEGLEIGGD

SEQ ID NO: 19754 - protein, 9 aa, Borrelia burgdorferi
EGLEIGGDS

SEQ ID NO: 19755 - protein, 9 aa, Borrelia burgdorferi
GLEIGGDSN

SEQ ID NO: 19756 - protein, 9 aa, Borrelia burgdorferi
LEIGGDSNF

SEQ ID NO: 19757 - protein, 9 aa, Borrelia burgdorferi
EIGGDSNFF

SEQ ID NO: 19758 - protein, 9 aa, Borrelia burgdorferi
IGGDSNFFT

SEQ ID NO: 19759 - protein, 9 aa, Borrelia burgdorferi
GGDSNFFTN

SEQ ID NO: 19760 - protein, 9 aa, Borrelia burgdorferi
GDSNFFTNL

SEQ ID NO: 19761 - protein, 9 aa, Borrelia burgdorferi
DSNFFTNLE

SEQ ID NO: 19762 - protein, 9 aa, Borrelia burgdorferi
SNFFTNLEE

SEQ ID NO: 19763 - protein, 9 aa, Borrelia burgdorferi
NFFTNLEEV

SEQ ID NO: 19764 - protein, 9 aa, Borrelia burgdorferi
FFTNLEEVR

SEQ ID NO: 19765 - protein, 9 aa, Borrelia burgdorferi
FTNLEEVRS

SEQ ID NO: 19766 - protein, 9 aa, Borrelia burgdorferi
TNLEEVRSS

SEQ ID NO: 19767 - protein, 9 aa, Borrelia burgdorferi
NLEEVRSSI

SEQ ID NO: 19768 - protein, 9 aa, Borrelia burgdorferi
LEEVRSSIR

SEQ ID NO: 19769 - protein, 9 aa, Borrelia burgdorferi
EEVRSSIRT

SEQ ID NO: 19770 - protein, 9 aa, Borrelia burgdorferi
EVRSSIRTK

SEQ ID NO: 19771 - protein, 9 aa, Borrelia burgdorferi
VRSSIRTKI

SEQ ID NO: 19772 - protein, 9 aa, Borrelia burgdorferi
RSSIRTKIK

SEQ ID NO: 19773 - protein, 9 aa, Borrelia burgdorferi
SSIRTKIKV

SEQ ID NO: 19774 - protein, 9 aa, Borrelia burgdorferi
SIRTKIKVS

SEQ ID NO: 19775 - protein, 9 aa, Borrelia burgdorferi
IRTKIKVSD

SEQ ID NO: 19776 - protein, 9 aa, Borrelia burgdorferi
RTKIKVSDG

SEQ ID NO: 19777 - protein, 9 aa, Borrelia burgdorferi
TKIKVSDGT

SEQ ID NO: 19778 - protein, 9 aa, Borrelia burgdorferi
KIKVSDGTE

SEQ ID NO: 19779 - protein, 9 aa, Borrelia burgdorferi
IKVSDGTEQ

SEQ ID NO: 19780 - protein, 9 aa, Borrelia burgdorferi
KVSDGTEQT

SEQ ID NO: 19781 - protein, 9 aa, Borrelia burgdorferi
VSDGTEQTK

SEQ ID NO: 19782 - protein, 9 aa, Borrelia burgdorferi
SDGTEQTKD

SEQ ID NO: 19783 - protein, 9 aa, Borrelia burgdorferi
DGTEQTKDK

SEQ ID NO: 19784 - protein, 9 aa, Borrelia burgdorferi
GTEQTKDKV

SEQ ID NO: 19785 - protein, 9 aa, Borrelia burgdorferi
TEQTKDKVE

SEQ ID NO: 19786 - protein, 9 aa, Borrelia burgdorferi
EQTKDKVEI

SEQ ID NO: 19787 - protein, 9 aa, Borrelia burgdorferi
QTKDKVEID

SEQ ID NO: 19788 - protein, 9 aa, Borrelia burgdorferi
TKDKVEIDE

SEQ ID NO: 19789 - protein, 9 aa, Borrelia burgdorferi
KDKVEIDEI

SEQ ID NO: 19790 - protein, 9 aa, Borrelia burgdorferi
DKVEIDEII

SEQ ID NO: 19791 - protein, 9 aa, Borrelia burgdorferi
KVEIDEIIE

SEQ ID NO: 19792 - protein, 9 aa, Borrelia burgdorferi
VEIDEIIED

SEQ ID NO: 19793 - protein, 9 aa, Borrelia burgdorferi
EIDEIIEDL

SEQ ID NO: 19794 - protein, 9 aa, Borrelia burgdorferi
IDEIIEDLQ

SEQ ID NO: 19795 - protein, 9 aa, Borrelia burgdorferi
DEIIEDLQK

SEQ ID NO: 19796 - protein, 9 aa, Borrelia burgdorferi
EIIEDLQKL

SEQ ID NO: 19797 - protein, 9 aa, Borrelia burgdorferi
IIEDLQKLK

SEQ ID NO: 19798 - protein, 9 aa, Borrelia burgdorferi
IEDLQKLKE

SEQ ID NO: 19799 - protein, 9 aa, Borrelia burgdorferi
EDLQKLKEF

SEQ ID NO: 19800 - protein, 9 aa, Borrelia burgdorferi
DLQKLKEFL

SEQ ID NO: 19801 - protein, 9 aa, Borrelia burgdorferi
LQKLKEFLE

SEQ ID NO: 19802 - protein, 9 aa, Borrelia burgdorferi
QKLKEFLEK

SEQ ID NO: 19803 - protein, 9 aa, Borrelia burgdorferi
KLKEFLEKL

SEQ ID NO: 19804 - protein, 9 aa, Borrelia burgdorferi
LKEFLEKLK

SEQ ID NO: 19805 - protein, 9 aa, Borrelia burgdorferi
KEFLEKLKK

SEQ ID NO: 19806 - protein, 9 aa, Borrelia burgdorferi
EFLEKLKKY

SEQ ID NO: 19807 - protein, 9 aa, Borrelia burgdorferi
FLEKLKKYL

SEQ ID NO: 19808 - protein, 9 aa, Borrelia burgdorferi
LEKLKKYLK

SEQ ID NO: 19809 - protein, 9 aa, Borrelia burgdorferi
EKLKKYLKD

SEQ ID NO: 19810 - protein, 9 aa, Borrelia burgdorferi
KLKKYLKDT

SEQ ID NO: 19811 - protein, 9 aa, Borrelia burgdorferi
LKKYLKDTN

SEQ ID NO: 19812 - protein, 9 aa, Borrelia burgdorferi
KKYLKDTNN

SEQ ID NO: 19813 - protein, 9 aa, Borrelia burgdorferi
KYLKDTNNL

SEQ ID NO: 19814 - protein, 9 aa, Borrelia burgdorferi
YLKDTNNLS

SEQ ID NO: 19815 - protein, 9 aa, Borrelia burgdorferi
LKDTNNLSA

SEQ ID NO: 19816 - protein, 9 aa, Borrelia burgdorferi
KDTNNLSAI

SEQ ID NO: 19817 - protein, 9 aa, Borrelia burgdorferi
DTNNLSAIE

SEQ ID NO: 19818 - protein, 9 aa, Borrelia burgdorferi
TNNLSAIEE

SEQ ID NO: 19819 - protein, 9 aa, Borrelia burgdorferi
NNLSAIEES

SEQ ID NO: 19820 - protein, 9 aa, Borrelia burgdorferi
NLSAIEESV

SEQ ID NO: 19821 - protein, 9 aa, Borrelia burgdorferi
LSAIEESVK

SEQ ID NO: 19822 - protein, 9 aa, Borrelia burgdorferi
SAIEESVKG

SEQ ID NO: 19823 - protein, 9 aa, Borrelia burgdorferi
AIEESVKGL

SEQ ID NO: 19824 - protein, 9 aa, Borrelia burgdorferi
IEESVKGLS

SEQ ID NO: 19825 - protein, 10 aa, Borrelia burgdorferi
MCAFLLLNLV

SEQ ID NO: 19826 - protein, 10 aa, Borrelia burgdorferi
CAFLLLNLVN

SEQ ID NO: 19827 - protein, 10 aa, Borrelia burgdorferi
AFLLLNLVNC

SEQ ID NO: 19828 - protein, 10 aa, Borrelia burgdorferi
FLLLNLVNCK

SEQ ID NO: 19829 - protein, 10 aa, Borrelia burgdorferi
LLLNLVNCKF

SEQ ID NO: 19830 - protein, 10 aa, Borrelia burgdorferi
LLNLVNCKFD

SEQ ID NO: 19831 - protein, 10 aa, Borrelia burgdorferi
LNLVNCKFDS

SEQ ID NO: 19832 - protein, 10 aa, Borrelia burgdorferi
NLVNCKFDSL

SEQ ID NO: 19833 - protein, 10 aa, Borrelia burgdorferi
LVNCKFDSLN

SEQ ID NO: 19834 - protein, 10 aa, Borrelia burgdorferi
VNCKFDSLNL

SEQ ID NO: 19835 - protein, 10 aa, Borrelia burgdorferi
NCKFDSLNLS

SEQ ID NO: 19836 - protein, 10 aa, Borrelia burgdorferi
CKFDSLNLST

SEQ ID NO: 19837 - protein, 10 aa, Borrelia burgdorferi
KFDSLNLSTK

SEQ ID NO: 19838 - protein, 10 aa, Borrelia burgdorferi
FDSLNLSTKS

SEQ ID NO: 19839 - protein, 10 aa, Borrelia burgdorferi
DSLNLSTKSV

SEQ ID NO: 19840 - protein, 10 aa, Borrelia burgdorferi
SLNLSTKSVD

SEQ ID NO: 19841 - protein, 10 aa, Borrelia burgdorferi
LNLSTKSVDD

SEQ ID NO: 19842 - protein, 10 aa, Borrelia burgdorferi
NLSTKSVDDK

SEQ ID NO: 19843 - protein, 10 aa, Borrelia burgdorferi
LSTKSVDDKN

SEQ ID NO: 19844 - protein, 10 aa, Borrelia burgdorferi
STKSVDDKNN

SEQ ID NO: 19845 - protein, 10 aa, Borrelia burgdorferi
TKSVDDKNNS

SEQ ID NO: 19846 - protein, 10 aa, Borrelia burgdorferi
KSVDDKNNSI

SEQ ID NO: 19847 - protein, 10 aa, Borrelia burgdorferi
SVDDKNNSIA

SEQ ID NO: 19848 - protein, 10 aa, Borrelia burgdorferi
VDDKNNSIAK

SEQ ID NO: 19849 - protein, 10 aa, Borrelia burgdorferi
DDKNNSIAKL

SEQ ID NO: 19850 - protein, 10 aa, Borrelia burgdorferi
DKNNSIAKLL

SEQ ID NO: 19851 - protein, 10 aa, Borrelia burgdorferi
KNNSIAKLLQ

SEQ ID NO: 19852 - protein, 10 aa, Borrelia burgdorferi
NNSIAKLLQH

SEQ ID NO: 19853 - protein, 10 aa, Borrelia burgdorferi
NSIAKLLQHL

SEQ ID NO: 19854 - protein, 10 aa, Borrelia burgdorferi
SIAKLLQHLS

SEQ ID NO: 19855 - protein, 10 aa, Borrelia burgdorferi
IAKLLQHLSK

SEQ ID NO: 19856 - protein, 10 aa, Borrelia burgdorferi
AKLLQHLSKS

SEQ ID NO: 19857 - protein, 10 aa, Borrelia burgdorferi
KLLQHLSKSE

SEQ ID NO: 19858 - protein, 10 aa, Borrelia burgdorferi
LLQHLSKSED

SEQ ID NO: 19859 - protein, 10 aa, Borrelia burgdorferi
LQHLSKSEDQ

SEQ ID NO: 19860 - protein, 10 aa, Borrelia burgdorferi
QHLSKSEDQA

SEQ ID NO: 19861 - protein, 10 aa, Borrelia burgdorferi
HLSKSEDQAN

SEQ ID NO: 19862 - protein, 10 aa, Borrelia burgdorferi
LSKSEDQANK

SEQ ID NO: 19863 - protein, 10 aa, Borrelia burgdorferi
SKSEDQANKT

SEQ ID NO: 19864 - protein, 10 aa, Borrelia burgdorferi
KSEDQANKTS

SEQ ID NO: 19865 - protein, 10 aa, Borrelia burgdorferi
SEDQANKTST

SEQ ID NO: 19866 - protein, 10 aa, Borrelia burgdorferi
EDQANKTSTS

SEQ ID NO: 19867 - protein, 10 aa, Borrelia burgdorferi
DQANKTSTSE

SEQ ID NO: 19868 - protein, 10 aa, Borrelia burgdorferi
QANKTSTSED

SEQ ID NO: 19869 - protein, 10 aa, Borrelia burgdorferi
ANKTSTSEDQ

SEQ ID NO: 19870 - protein, 10 aa, Borrelia burgdorferi
NKTSTSEDQK

SEQ ID NO: 19871 - protein, 10 aa, Borrelia burgdorferi
KTSTSEDQKE

SEQ ID NO: 19872 - protein, 10 aa, Borrelia burgdorferi
TSTSEDQKEL

SEQ ID NO: 19873 - protein, 10 aa, Borrelia burgdorferi
STSEDQKELE

SEQ ID NO: 19874 - protein, 10 aa, Borrelia burgdorferi
TSEDQKELEI

SEQ ID NO: 19875 - protein, 10 aa, Borrelia burgdorferi
SEDQKELEIT

SEQ ID NO: 19876 - protein, 10 aa, Borrelia burgdorferi
EDQKELEITE

SEQ ID NO: 19877 - protein, 10 aa, Borrelia burgdorferi
DQKELEITEN

SEQ ID NO: 19878 - protein, 10 aa, Borrelia burgdorferi
QKELEITENK

SEQ ID NO: 19879 - protein, 10 aa, Borrelia burgdorferi
KELEITENKE

SEQ ID NO: 19880 - protein, 10 aa, Borrelia burgdorferi
ELEITENKEQ

SEQ ID NO: 19881 - protein, 10 aa, Borrelia burgdorferi
LEITENKEQE

SEQ ID NO: 19882 - protein, 10 aa, Borrelia burgdorferi
EITENKEQEH

SEQ ID NO: 19883 - protein, 10 aa, Borrelia burgdorferi
ITENKEQEHE

SEQ ID NO: 19884 - protein, 10 aa, Borrelia burgdorferi
TENKEQEHEK

SEQ ID NO: 19885 - protein, 10 aa, Borrelia burgdorferi
ENKEQEHEKL

SEQ ID NO: 19886 - protein, 10 aa, Borrelia burgdorferi
NKEQEHEKLS

SEQ ID NO: 19887 - protein, 10 aa, Borrelia burgdorferi
KEQEHEKLSQ

SEQ ID NO: 19888 - protein, 10 aa, Borrelia burgdorferi
EQEHEKLSQV

SEQ ID NO: 19889 - protein, 10 aa, Borrelia burgdorferi
QEHEKLSQVA

SEQ ID NO: 19890 - protein, 10 aa, Borrelia burgdorferi
EHEKLSQVAQ

SEQ ID NO: 19891 - protein, 10 aa, Borrelia burgdorferi
HEKLSQVAQH

SEQ ID NO: 19892 - protein, 10 aa, Borrelia burgdorferi
EKLSQVAQHA

SEQ ID NO: 19893 - protein, 10 aa, Borrelia burgdorferi
KLSQVAQHAP

SEQ ID NO: 19894 - protein, 10 aa, Borrelia burgdorferi
LSQVAQHAPN

SEQ ID NO: 19895 - protein, 10 aa, Borrelia burgdorferi
SQVAQHAPNS

SEQ ID NO: 19896 - protein, 10 aa, Borrelia burgdorferi
QVAQHAPNSK

SEQ ID NO: 19897 - protein, 10 aa, Borrelia burgdorferi
VAQHAPNSKI

SEQ ID NO: 19898 - protein, 10 aa, Borrelia burgdorferi
AQHAPNSKIE

SEQ ID NO: 19899 - protein, 10 aa, Borrelia burgdorferi
QHAPNSKIEK

SEQ ID NO: 19900 - protein, 10 aa, Borrelia burgdorferi
HAPNSKIEKV

SEQ ID NO: 19901 - protein, 10 aa, Borrelia burgdorferi
APNSKIEKVK

SEQ ID NO: 19902 - protein, 10 aa, Borrelia burgdorferi
PNSKIEKVKS

SEQ ID NO: 19903 - protein, 10 aa, Borrelia burgdorferi
NSKIEKVKSD

SEQ ID NO: 19904 - protein, 10 aa, Borrelia burgdorferi
SKIEKVKSDG

SEQ ID NO: 19905 - protein, 10 aa, Borrelia burgdorferi
KIEKVKSDGK

SEQ ID NO: 19906 - protein, 10 aa, Borrelia burgdorferi
IEKVKSDGKP

SEQ ID NO: 19907 - protein, 10 aa, Borrelia burgdorferi
EKVKSDGKPV

SEQ ID NO: 19908 - protein, 10 aa, Borrelia burgdorferi
KVKSDGKPVP

SEQ ID NO: 19909 - protein, 10 aa, Borrelia burgdorferi
VKSDGKPVPG

SEQ ID NO: 19910 - protein, 10 aa, Borrelia burgdorferi
KSDGKPVPGD

SEQ ID NO: 19911 - protein, 10 aa, Borrelia burgdorferi
SDGKPVPGDK

SEQ ID NO: 19912 - protein, 10 aa, Borrelia burgdorferi
DGKPVPGDKI

SEQ ID NO: 19913 - protein, 10 aa, Borrelia burgdorferi
GKPVPGDKIL

SEQ ID NO: 19914 - protein, 10 aa, Borrelia burgdorferi
KPVPGDKILS

SEQ ID NO: 19915 - protein, 10 aa, Borrelia burgdorferi
PVPGDKILSS

SEQ ID NO: 19916 - protein, 10 aa, Borrelia burgdorferi
VPGDKILSSN

SEQ ID NO: 19917 - protein, 10 aa, Borrelia burgdorferi
PGDKILSSNK

SEQ ID NO: 19918 - protein, 10 aa, Borrelia burgdorferi
GDKILSSNKD

SEQ ID NO: 19919 - protein, 10 aa, Borrelia burgdorferi
DKILSSNKDI

SEQ ID NO: 19920 - protein, 10 aa, Borrelia burgdorferi
KILSSNKDIY

SEQ ID NO: 19921 - protein, 10 aa, Borrelia burgdorferi
ILSSNKDIYN

SEQ ID NO: 19922 - protein, 10 aa, Borrelia burgdorferi
LSSNKDIYNS

SEQ ID NO: 19923 - protein, 10 aa, Borrelia burgdorferi
SSNKDIYNSY

SEQ ID NO: 19924 - protein, 10 aa, Borrelia burgdorferi
SNKDIYNSYI

SEQ ID NO: 19925 - protein, 10 aa, Borrelia burgdorferi
NKDIYNSYIP

SEQ ID NO: 19926 - protein, 10 aa, Borrelia burgdorferi
KDIYNSYIPE

SEQ ID NO: 19927 - protein, 10 aa, Borrelia burgdorferi
DIYNSYIPEV

SEQ ID NO: 19928 - protein, 10 aa, Borrelia burgdorferi
IYNSYIPEVK

SEQ ID NO: 19929 - protein, 10 aa, Borrelia burgdorferi
YNSYIPEVKE

SEQ ID NO: 19930 - protein, 10 aa, Borrelia burgdorferi
NSYIPEVKEE

SEQ ID NO: 19931 - protein, 10 aa, Borrelia burgdorferi
SYIPEVKEEI

SEQ ID NO: 19932 - protein, 10 aa, Borrelia burgdorferi
YIPEVKEEIV

SEQ ID NO: 19933 - protein, 10 aa, Borrelia burgdorferi
IPEVKEEIVY

SEQ ID NO: 19934 - protein, 10 aa, Borrelia burgdorferi
PEVKEEIVYE

SEQ ID NO: 19935 - protein, 10 aa, Borrelia burgdorferi
EVKEEIVYEI

SEQ ID NO: 19936 - protein, 10 aa, Borrelia burgdorferi
VKEEIVYEIL

SEQ ID NO: 19937 - protein, 10 aa, Borrelia burgdorferi
KEEIVYEILE

SEQ ID NO: 19938 - protein, 10 aa, Borrelia burgdorferi
EEIVYEILEE

SEQ ID NO: 19939 - protein, 10 aa, Borrelia burgdorferi
EIVYEILEEV

SEQ ID NO: 19940 - protein, 10 aa, Borrelia burgdorferi
IVYEILEEVI

SEQ ID NO: 19941 - protein, 10 aa, Borrelia burgdorferi
VYEILEEVII

SEQ ID NO: 19942 - protein, 10 aa, Borrelia burgdorferi
YEILEEVIIP

SEQ ID NO: 19943 - protein, 10 aa, Borrelia burgdorferi
EILEEVIIPE

SEQ ID NO: 19944 - protein, 10 aa, Borrelia burgdorferi
ILEEVIIPET

SEQ ID NO: 19945 - protein, 10 aa, Borrelia burgdorferi
LEEVIIPETK

SEQ ID NO: 19946 - protein, 10 aa, Borrelia burgdorferi
EEVIIPETKI

SEQ ID NO: 19947 - protein, 10 aa, Borrelia burgdorferi
EVIIPETKIP

SEQ ID NO: 19948 - protein, 10 aa, Borrelia burgdorferi
VIIPETKIPE

SEQ ID NO: 19949 - protein, 10 aa, Borrelia burgdorferi
IIPETKIPEI

SEQ ID NO: 19950 - protein, 10 aa, Borrelia burgdorferi
IPETKIPEIT

SEQ ID NO: 19951 - protein, 10 aa, Borrelia burgdorferi
PETKIPEITE

SEQ ID NO: 19952 - protein, 10 aa, Borrelia burgdorferi
ETKIPEITEE

SEQ ID NO: 19953 - protein, 10 aa, Borrelia burgdorferi
TKIPEITEEV

SEQ ID NO: 19954 - protein, 10 aa, Borrelia burgdorferi
KIPEITEEVI

SEQ ID NO: 19955 - protein, 10 aa, Borrelia burgdorferi
IPEITEEVIM

SEQ ID NO: 19956 - protein, 10 aa, Borrelia burgdorferi
PEITEEVIMP

SEQ ID NO: 19957 - protein, 10 aa, Borrelia burgdorferi
EITEEVIMPI

SEQ ID NO: 19958 - protein, 10 aa, Borrelia burgdorferi
ITEEVIMPIP

SEQ ID NO: 19959 - protein, 10 aa, Borrelia burgdorferi
TEEVIMPIPQ

SEQ ID NO: 19960 - protein, 10 aa, Borrelia burgdorferi
EEVIMPIPQT

SEQ ID NO: 19961 - protein, 10 aa, Borrelia burgdorferi
EVIMPIPQTI

SEQ ID NO: 19962 - protein, 10 aa, Borrelia burgdorferi
VIMPIPQTID

SEQ ID NO: 19963 - protein, 10 aa, Borrelia burgdorferi
IMPIPQTIDF

SEQ ID NO: 19964 - protein, 10 aa, Borrelia burgdorferi
MPIPQTIDFY

SEQ ID NO: 19965 - protein, 10 aa, Borrelia burgdorferi
PIPQTIDFYI

SEQ ID NO: 19966 - protein, 10 aa, Borrelia burgdorferi
IPQTIDFYIE

SEQ ID NO: 19967 - protein, 10 aa, Borrelia burgdorferi
PQTIDFYIEP

SEQ ID NO: 19968 - protein, 10 aa, Borrelia burgdorferi
QTIDFYIEPR

SEQ ID NO: 19969 - protein, 10 aa, Borrelia burgdorferi
TIDFYIEPRP

SEQ ID NO: 19970 - protein, 10 aa, Borrelia burgdorferi
IDFYIEPRPI

SEQ ID NO: 19971 - protein, 10 aa, Borrelia burgdorferi
DFYIEPRPIS

SEQ ID NO: 19972 - protein, 10 aa, Borrelia burgdorferi
FYIEPRPISS

SEQ ID NO: 19973 - protein, 10 aa, Borrelia burgdorferi
YIEPRPISSF

SEQ ID NO: 19974 - protein, 10 aa, Borrelia burgdorferi
IEPRPISSFL

SEQ ID NO: 19975 - protein, 10 aa, Borrelia burgdorferi
EPRPISSFLT

SEQ ID NO: 19976 - protein, 10 aa, Borrelia burgdorferi
PRPISSFLTQ

SEQ ID NO: 19977 - protein, 10 aa, Borrelia burgdorferi
RPISSFLTQG

SEQ ID NO: 19978 - protein, 10 aa, Borrelia burgdorferi
PISSFLTQGT

SEQ ID NO: 19979 - protein, 10 aa, Borrelia burgdorferi
ISSFLTQGTS

SEQ ID NO: 19980 - protein, 10 aa, Borrelia burgdorferi
SSFLTQGTSP

SEQ ID NO: 19981 - protein, 10 aa, Borrelia burgdorferi
SFLTQGTSPS

SEQ ID NO: 19982 - protein, 10 aa, Borrelia burgdorferi
FLTQGTSPSI

SEQ ID NO: 19983 - protein, 10 aa, Borrelia burgdorferi
LTQGTSPSIT

SEQ ID NO: 19984 - protein, 10 aa, Borrelia burgdorferi
TQGTSPSITS

SEQ ID NO: 19985 - protein, 10 aa, Borrelia burgdorferi
QGTSPSITST

SEQ ID NO: 19986 - protein, 10 aa, Borrelia burgdorferi
GTSPSITSTI

SEQ ID NO: 19987 - protein, 10 aa, Borrelia burgdorferi
TSPSITSTIK

SEQ ID NO: 19988 - protein, 10 aa, Borrelia burgdorferi
SPSITSTIKS

SEQ ID NO: 19989 - protein, 10 aa, Borrelia burgdorferi
PSITSTIKSY

SEQ ID NO: 19990 - protein, 10 aa, Borrelia burgdorferi
SITSTIKSYK

SEQ ID NO: 19991 - protein, 10 aa, Borrelia burgdorferi
ITSTIKSYKE

SEQ ID NO: 19992 - protein, 10 aa, Borrelia burgdorferi
TSTIKSYKEL

SEQ ID NO: 19993 - protein, 10 aa, Borrelia burgdorferi
STIKSYKELA

SEQ ID NO: 19994 - protein, 10 aa, Borrelia burgdorferi
TIKSYKELAK

SEQ ID NO: 19995 - protein, 10 aa, Borrelia burgdorferi
IKSYKELAKE

SEQ ID NO: 19996 - protein, 10 aa, Borrelia burgdorferi
KSYKELAKEK

SEQ ID NO: 19997 - protein, 10 aa, Borrelia burgdorferi
SYKELAKEKI

SEQ ID NO: 19998 - protein, 10 aa, Borrelia burgdorferi
YKELAKEKIN

SEQ ID NO: 19999 - protein, 10 aa, Borrelia burgdorferi
KELAKEKINN

SEQ ID NO: 20000 - protein, 10 aa, Borrelia burgdorferi
ELAKEKINNG

SEQ ID NO: 20001 - protein, 10 aa, Borrelia burgdorferi
LAKEKINNGL

SEQ ID NO: 20002 - protein, 10 aa, Borrelia burgdorferi
AKEKINNGLN

SEQ ID NO: 20003 - protein, 10 aa, Borrelia burgdorferi
KEKINNGLNI

SEQ ID NO: 20004 - protein, 10 aa, Borrelia burgdorferi
EKINNGLNIV

SEQ ID NO: 20005 - protein, 10 aa, Borrelia burgdorferi
KINNGLNIVQ

SEQ ID NO: 20006 - protein, 10 aa, Borrelia burgdorferi
INNGLNIVQK

SEQ ID NO: 20007 - protein, 10 aa, Borrelia burgdorferi
NNGLNIVQKI

SEQ ID NO: 20008 - protein, 10 aa, Borrelia burgdorferi
NGLNIVQKIT

SEQ ID NO: 20009 - protein, 10 aa, Borrelia burgdorferi
GLNIVQKITQ

SEQ ID NO: 20010 - protein, 10 aa, Borrelia burgdorferi
LNIVQKITQN

SEQ ID NO: 20011 - protein, 10 aa, Borrelia burgdorferi
NIVQKITQNI

SEQ ID NO: 20012 - protein, 10 aa, Borrelia burgdorferi
IVQKITQNID

SEQ ID NO: 20013 - protein, 10 aa, Borrelia burgdorferi
VQKITQNIDN

SEQ ID NO: 20014 - protein, 10 aa, Borrelia burgdorferi
QKITQNIDNI

SEQ ID NO: 20015 - protein, 10 aa, Borrelia burgdorferi
KITQNIDNIT

SEQ ID NO: 20016 - protein, 10 aa, Borrelia burgdorferi
ITQNIDNITE

SEQ ID NO: 20017 - protein, 10 aa, Borrelia burgdorferi
TQNIDNITEN

SEQ ID NO: 20018 - protein, 10 aa, Borrelia burgdorferi
QNIDNITENL

SEQ ID NO: 20019 - protein, 10 aa, Borrelia burgdorferi
NIDNITENLN

SEQ ID NO: 20020 - protein, 10 aa, Borrelia burgdorferi
IDNITENLNS

SEQ ID NO: 20021 - protein, 10 aa, Borrelia burgdorferi
DNITENLNSK

SEQ ID NO: 20022 - protein, 10 aa, Borrelia burgdorferi
NITENLNSKE

SEQ ID NO: 20023 - protein, 10 aa, Borrelia burgdorferi
ITENLNSKET

SEQ ID NO: 20024 - protein, 10 aa, Borrelia burgdorferi
TENLNSKETP

SEQ ID NO: 20025 - protein, 10 aa, Borrelia burgdorferi
ENLNSKETPK

SEQ ID NO: 20026 - protein, 10 aa, Borrelia burgdorferi
NLNSKETPKE

SEQ ID NO: 20027 - protein, 10 aa, Borrelia burgdorferi
LNSKETPKEI

SEQ ID NO: 20028 - protein, 10 aa, Borrelia burgdorferi
NSKETPKEIS

SEQ ID NO: 20029 - protein, 10 aa, Borrelia burgdorferi
SKETPKEISG

SEQ ID NO: 20030 - protein, 10 aa, Borrelia burgdorferi
KETPKEISGK

SEQ ID NO: 20031 - protein, 10 aa, Borrelia burgdorferi
ETPKEISGKE

SEQ ID NO: 20032 - protein, 10 aa, Borrelia burgdorferi
TPKEISGKEV

SEQ ID NO: 20033 - protein, 10 aa, Borrelia burgdorferi
PKEISGKEVE

SEQ ID NO: 20034 - protein, 10 aa, Borrelia burgdorferi
KEISGKEVEE

SEQ ID NO: 20035 - protein, 10 aa, Borrelia burgdorferi
EISGKEVEEK

SEQ ID NO: 20036 - protein, 10 aa, Borrelia burgdorferi
ISGKEVEEKI

SEQ ID NO: 20037 - protein, 10 aa, Borrelia burgdorferi
SGKEVEEKIT

SEQ ID NO: 20038 - protein, 10 aa, Borrelia burgdorferi
GKEVEEKITH

SEQ ID NO: 20039 - protein, 10 aa, Borrelia burgdorferi
KEVEEKITHP

SEQ ID NO: 20040 - protein, 10 aa, Borrelia burgdorferi
EVEEKITHPI

SEQ ID NO: 20041 - protein, 10 aa, Borrelia burgdorferi
VEEKITHPIF

SEQ ID NO: 20042 - protein, 10 aa, Borrelia burgdorferi
EEKITHPIFD

SEQ ID NO: 20043 - protein, 10 aa, Borrelia burgdorferi
EKITHPIFDH

SEQ ID NO: 20044 - protein, 10 aa, Borrelia burgdorferi
KITHPIFDHI

SEQ ID NO: 20045 - protein, 10 aa, Borrelia burgdorferi
ITHPIFDHIT

SEQ ID NO: 20046 - protein, 10 aa, Borrelia burgdorferi
THPIFDHITG

SEQ ID NO: 20047 - protein, 10 aa, Borrelia burgdorferi
HPIFDHITGS

SEQ ID NO: 20048 - protein, 10 aa, Borrelia burgdorferi
PIFDHITGSG

SEQ ID NO: 20049 - protein, 10 aa, Borrelia burgdorferi
IFDHITGSGN

SEQ ID NO: 20050 - protein, 10 aa, Borrelia burgdorferi
FDHITGSGNN

SEQ ID NO: 20051 - protein, 10 aa, Borrelia burgdorferi
DHITGSGNNP

SEQ ID NO: 20052 - protein, 10 aa, Borrelia burgdorferi
HITGSGNNPG

SEQ ID NO: 20053 - protein, 10 aa, Borrelia burgdorferi
ITGSGNNPGQ

SEQ ID NO: 20054 - protein, 10 aa, Borrelia burgdorferi
TGSGNNPGQD

SEQ ID NO: 20055 - protein, 10 aa, Borrelia burgdorferi
GSGNNPGQDS

SEQ ID NO: 20056 - protein, 10 aa, Borrelia burgdorferi
SGNNPGQDSI

SEQ ID NO: 20057 - protein, 10 aa, Borrelia burgdorferi
GNNPGQDSIS

SEQ ID NO: 20058 - protein, 10 aa, Borrelia burgdorferi
NNPGQDSISN

SEQ ID NO: 20059 - protein, 10 aa, Borrelia burgdorferi
NPGQDSISNT

SEQ ID NO: 20060 - protein, 10 aa, Borrelia burgdorferi
PGQDSISNTW

SEQ ID NO: 20061 - protein, 10 aa, Borrelia burgdorferi
GQDSISNTWG

SEQ ID NO: 20062 - protein, 10 aa, Borrelia burgdorferi
QDSISNTWGE

SEQ ID NO: 20063 - protein, 10 aa, Borrelia burgdorferi
DSISNTWGEG

SEQ ID NO: 20064 - protein, 10 aa, Borrelia burgdorferi
SISNTWGEGL

SEQ ID NO: 20065 - protein, 10 aa, Borrelia burgdorferi
ISNTWGEGLE

SEQ ID NO: 20066 - protein, 10 aa, Borrelia burgdorferi
SNTWGEGLEI

SEQ ID NO: 20067 - protein, 10 aa, Borrelia burgdorferi
NTWGEGLEIG

SEQ ID NO: 20068 - protein, 10 aa, Borrelia burgdorferi
TWGEGLEIGG

SEQ ID NO: 20069 - protein, 10 aa, Borrelia burgdorferi
WGEGLEIGGD

SEQ ID NO: 20070 - protein, 10 aa, Borrelia burgdorferi
GEGLEIGGDS

SEQ ID NO: 20071 - protein, 10 aa, Borrelia burgdorferi
EGLEIGGDSN

SEQ ID NO: 20072 - protein, 10 aa, Borrelia burgdorferi
GLEIGGDSNF

SEQ ID NO: 20073 - protein, 10 aa, Borrelia burgdorferi
LEIGGDSNFF

SEQ ID NO: 20074 - protein, 10 aa, Borrelia burgdorferi
EIGGDSNFFT

SEQ ID NO: 20075 - protein, 10 aa, Borrelia burgdorferi
IGGDSNFFTN

SEQ ID NO: 20076 - protein, 10 aa, Borrelia burgdorferi
GGDSNFFTNL

SEQ ID NO: 20077 - protein, 10 aa, Borrelia burgdorferi
GDSNFFTNLE

SEQ ID NO: 20078 - protein, 10 aa, Borrelia burgdorferi
DSNFFTNLEE

SEQ ID NO: 20079 - protein, 10 aa, Borrelia burgdorferi
SNFFTNLEEV

SEQ ID NO: 20080 - protein, 10 aa, Borrelia burgdorferi
NFFTNLEEVR

SEQ ID NO: 20081 - protein, 10 aa, Borrelia burgdorferi
FFTNLEEVRS

SEQ ID NO: 20082 - protein, 10 aa, Borrelia burgdorferi
FTNLEEVRSS

SEQ ID NO: 20083 - protein, 10 aa, Borrelia burgdorferi
TNLEEVRSSI

SEQ ID NO: 20084 - protein, 10 aa, Borrelia burgdorferi
NLEEVRSSIR

SEQ ID NO: 20085 - protein, 10 aa, Borrelia burgdorferi
LEEVRSSIRT

SEQ ID NO: 20086 - protein, 10 aa, Borrelia burgdorferi
EEVRSSIRTK

SEQ ID NO: 20087 - protein, 10 aa, Borrelia burgdorferi
EVRSSIRTKI

SEQ ID NO: 20088 - protein, 10 aa, Borrelia burgdorferi
VRSSIRTKIK

SEQ ID NO: 20089 - protein, 10 aa, Borrelia burgdorferi
RSSIRTKIKV

SEQ ID NO: 20090 - protein, 10 aa, Borrelia burgdorferi
SSIRTKIKVS

SEQ ID NO: 20091 - protein, 10 aa, Borrelia burgdorferi
SIRTKIKVSD

SEQ ID NO: 20092 - protein, 10 aa, Borrelia burgdorferi
IRTKIKVSDG

SEQ ID NO: 20093 - protein, 10 aa, Borrelia burgdorferi
RTKIKVSDGT

SEQ ID NO: 20094 - protein, 10 aa, Borrelia burgdorferi
TKIKVSDGTE

SEQ ID NO: 20095 - protein, 10 aa, Borrelia burgdorferi
KIKVSDGTEQ

SEQ ID NO: 20096 - protein, 10 aa, Borrelia burgdorferi
IKVSDGTEQT

SEQ ID NO: 20097 - protein, 10 aa, Borrelia burgdorferi
KVSDGTEQTK

SEQ ID NO: 20098 - protein, 10 aa, Borrelia burgdorferi
VSDGTEQTKD

SEQ ID NO: 20099 - protein, 10 aa, Borrelia burgdorferi
SDGTEQTKDK

SEQ ID NO: 20100 - protein, 10 aa, Borrelia burgdorferi
DGTEQTKDKV

SEQ ID NO: 20101 - protein, 10 aa, Borrelia burgdorferi
GTEQTKDKVE

SEQ ID NO: 20102 - protein, 10 aa, Borrelia burgdorferi
TEQTKDKVEI

SEQ ID NO: 20103 - protein, 10 aa, Borrelia burgdorferi
EQTKDKVEID

SEQ ID NO: 20104 - protein, 10 aa, Borrelia burgdorferi
QTKDKVEIDE

SEQ ID NO: 20105 - protein, 10 aa, Borrelia burgdorferi
TKDKVEIDEI

SEQ ID NO: 20106 - protein, 10 aa, Borrelia burgdorferi
KDKVEIDEII

SEQ ID NO: 20107 - protein, 10 aa, Borrelia burgdorferi
DKVEIDEIIE

SEQ ID NO: 20108 - protein, 10 aa, Borrelia burgdorferi
KVEIDEIIED

SEQ ID NO: 20109 - protein, 10 aa, Borrelia burgdorferi
VEIDEIIEDL

SEQ ID NO: 20110 - protein, 10 aa, Borrelia burgdorferi
EIDEIIEDLQ

SEQ ID NO: 20111 - protein, 10 aa, Borrelia burgdorferi
IDEIIEDLQK

SEQ ID NO: 20112 - protein, 10 aa, Borrelia burgdorferi
DEIIEDLQKL

SEQ ID NO: 20113 - protein, 10 aa, Borrelia burgdorferi
EIIEDLQKLK

SEQ ID NO: 20114 - protein, 10 aa, Borrelia burgdorferi
IIEDLQKLKE

SEQ ID NO: 20115 - protein, 10 aa, Borrelia burgdorferi
IEDLQKLKEF

SEQ ID NO: 20116 - protein, 10 aa, Borrelia burgdorferi
EDLQKLKEFL

SEQ ID NO: 20117 - protein, 10 aa, Borrelia burgdorferi
DLQKLKEFLE

SEQ ID NO: 20118 - protein, 10 aa, Borrelia burgdorferi
LQKLKEFLEK

SEQ ID NO: 20119 - protein, 10 aa, Borrelia burgdorferi
QKLKEFLEKL

SEQ ID NO: 20120 - protein, 10 aa, Borrelia burgdorferi
KLKEFLEKLK

SEQ ID NO: 20121 - protein, 10 aa, Borrelia burgdorferi
LKEFLEKLKK

SEQ ID NO: 20122 - protein, 10 aa, Borrelia burgdorferi
KEFLEKLKKY

SEQ ID NO: 20123 - protein, 10 aa, Borrelia burgdorferi
EFLEKLKKYL

SEQ ID NO: 20124 - protein, 10 aa, Borrelia burgdorferi
FLEKLKKYLK

SEQ ID NO: 20125 - protein, 10 aa, Borrelia burgdorferi
LEKLKKYLKD

SEQ ID NO: 20126 - protein, 10 aa, Borrelia burgdorferi
EKLKKYLKDT

SEQ ID NO: 20127 - protein, 10 aa, Borrelia burgdorferi
KLKKYLKDTN

SEQ ID NO: 20128 - protein, 10 aa, Borrelia burgdorferi
LKKYLKDTNN

SEQ ID NO: 20129 - protein, 10 aa, Borrelia burgdorferi
KKYLKDTNNL

SEQ ID NO: 20130 - protein, 10 aa, Borrelia burgdorferi
KYLKDTNNLS

SEQ ID NO: 20131 - protein, 10 aa, Borrelia burgdorferi
YLKDTNNLSA

SEQ ID NO: 20132 - protein, 10 aa, Borrelia burgdorferi
LKDTNNLSAI

SEQ ID NO: 20133 - protein, 10 aa, Borrelia burgdorferi
KDTNNLSAIE

SEQ ID NO: 20134 - protein, 10 aa, Borrelia burgdorferi
DTNNLSAIEE

SEQ ID NO: 20135 - protein, 10 aa, Borrelia burgdorferi
TNNLSAIEES

SEQ ID NO: 20136 - protein, 10 aa, Borrelia burgdorferi
NNLSAIEESV

SEQ ID NO: 20137 - protein, 10 aa, Borrelia burgdorferi
NLSAIEESVK

SEQ ID NO: 20138 - protein, 10 aa, Borrelia burgdorferi
LSAIEESVKG

SEQ ID NO: 20139 - protein, 10 aa, Borrelia burgdorferi
SAIEESVKGL

SEQ ID NO: 20140 - protein, 10 aa, Borrelia burgdorferi
AIEESVKGLS

SEQ ID NO: 20141 - protein, 11 aa, Borrelia burgdorferi
MCAFLLLNLVN

SEQ ID NO: 20142 - protein, 11 aa, Borrelia burgdorferi
CAFLLLNLVNC

SEQ ID NO: 20143 - protein, 11 aa, Borrelia burgdorferi
AFLLLNLVNCK

SEQ ID NO: 20144 - protein, 11 aa, Borrelia burgdorferi
FLLLNLVNCKF

SEQ ID NO: 20145 - protein, 11 aa, Borrelia burgdorferi
LLLNLVNCKFD

SEQ ID NO: 20146 - protein, 11 aa, Borrelia burgdorferi
LLNLVNCKFDS

SEQ ID NO: 20147 - protein, 11 aa, Borrelia burgdorferi
LNLVNCKFDSL

SEQ ID NO: 20148 - protein, 11 aa, Borrelia burgdorferi
NLVNCKFDSLN

SEQ ID NO: 20149 - protein, 11 aa, Borrelia burgdorferi
LVNCKFDSLNL

SEQ ID NO: 20150 - protein, 11 aa, Borrelia burgdorferi
VNCKFDSLNLS

SEQ ID NO: 20151 - protein, 11 aa, Borrelia burgdorferi
NCKFDSLNLST

SEQ ID NO: 20152 - protein, 11 aa, Borrelia burgdorferi
CKFDSLNLSTK

SEQ ID NO: 20153 - protein, 11 aa, Borrelia burgdorferi
KFDSLNLSTKS

SEQ ID NO: 20154 - protein, 11 aa, Borrelia burgdorferi
FDSLNLSTKSV

SEQ ID NO: 20155 - protein, 11 aa, Borrelia burgdorferi
DSLNLSTKSVD

SEQ ID NO: 20156 - protein, 11 aa, Borrelia burgdorferi
SLNLSTKSVDD

SEQ ID NO: 20157 - protein, 11 aa, Borrelia burgdorferi
LNLSTKSVDDK

SEQ ID NO: 20158 - protein, 11 aa, Borrelia burgdorferi
NLSTKSVDDKN

SEQ ID NO: 20159 - protein, 11 aa, Borrelia burgdorferi
LSTKSVDDKNN

SEQ ID NO: 20160 - protein, 11 aa, Borrelia burgdorferi
STKSVDDKNNS

SEQ ID NO: 20161 - protein, 11 aa, Borrelia burgdorferi
TKSVDDKNNSI

SEQ ID NO: 20162 - protein, 11 aa, Borrelia burgdorferi
KSVDDKNNSIA

SEQ ID NO: 20163 - protein, 11 aa, Borrelia burgdorferi
SVDDKNNSIAK

SEQ ID NO: 20164 - protein, 11 aa, Borrelia burgdorferi
VDDKNNSIAKL

SEQ ID NO: 20165 - protein, 11 aa, Borrelia burgdorferi
DDKNNSIAKLL

SEQ ID NO: 20166 - protein, 11 aa, Borrelia burgdorferi
DKNNSIAKLLQ

SEQ ID NO: 20167 - protein, 11 aa, Borrelia burgdorferi
KNNSIAKLLQH

SEQ ID NO: 20168 - protein, 11 aa, Borrelia burgdorferi
NNSIAKLLQHL

SEQ ID NO: 20169 - protein, 11 aa, Borrelia burgdorferi
NSIAKLLQHLS

SEQ ID NO: 20170 - protein, 11 aa, Borrelia burgdorferi
SIAKLLQHLSK

SEQ ID NO: 20171 - protein, 11 aa, Borrelia burgdorferi
IAKLLQHLSKS

SEQ ID NO: 20172 - protein, 11 aa, Borrelia burgdorferi
AKLLQHLSKSE

SEQ ID NO: 20173 - protein, 11 aa, Borrelia burgdorferi
KLLQHLSKSED

SEQ ID NO: 20174 - protein, 11 aa, Borrelia burgdorferi
LLQHLSKSEDQ

SEQ ID NO: 20175 - protein, 11 aa, Borrelia burgdorferi
LQHLSKSEDQA

SEQ ID NO: 20176 - protein, 11 aa, Borrelia burgdorferi
QHLSKSEDQAN

SEQ ID NO: 20177 - protein, 11 aa, Borrelia burgdorferi
HLSKSEDQANK

SEQ ID NO: 20178 - protein, 11 aa, Borrelia burgdorferi
LSKSEDQANKT

SEQ ID NO: 20179 - protein, 11 aa, Borrelia burgdorferi
SKSEDQANKTS

SEQ ID NO: 20180 - protein, 11 aa, Borrelia burgdorferi
KSEDQANKTST

SEQ ID NO: 20181 - protein, 11 aa, Borrelia burgdorferi
SEDQANKTSTS

SEQ ID NO: 20182 - protein, 11 aa, Borrelia burgdorferi
EDQANKTSTSE

SEQ ID NO: 20183 - protein, 11 aa, Borrelia burgdorferi
DQANKTSTSED

SEQ ID NO: 20184 - protein, 11 aa, Borrelia burgdorferi
QANKTSTSEDQ

SEQ ID NO: 20185 - protein, 11 aa, Borrelia burgdorferi
ANKTSTSEDQK

SEQ ID NO: 20186 - protein, 11 aa, Borrelia burgdorferi
NKTSTSEDQKE

SEQ ID NO: 20187 - protein, 11 aa, Borrelia burgdorferi
KTSTSEDQKEL

SEQ ID NO: 20188 - protein, 11 aa, Borrelia burgdorferi
TSTSEDQKELE

SEQ ID NO: 20189 - protein, 11 aa, Borrelia burgdorferi
STSEDQKELEI

SEQ ID NO: 20190 - protein, 11 aa, Borrelia burgdorferi
TSEDQKELEIT

SEQ ID NO: 20191 - protein, 11 aa, Borrelia burgdorferi
SEDQKELEITE

SEQ ID NO: 20192 - protein, 11 aa, Borrelia burgdorferi
EDQKELEITEN

SEQ ID NO: 20193 - protein, 11 aa, Borrelia burgdorferi
DQKELEITENK

SEQ ID NO: 20194 - protein, 11 aa, Borrelia burgdorferi
QKELEITENKE

SEQ ID NO: 20195 - protein, 11 aa, Borrelia burgdorferi
KELEITENKEQ

SEQ ID NO: 20196 - protein, 11 aa, Borrelia burgdorferi
ELEITENKEQE

SEQ ID NO: 20197 - protein, 11 aa, Borrelia burgdorferi
LEITENKEQEH

SEQ ID NO: 20198 - protein, 11 aa, Borrelia burgdorferi
EITENKEQEHE

SEQ ID NO: 20199 - protein, 11 aa, Borrelia burgdorferi
ITENKEQEHEK

SEQ ID NO: 20200 - protein, 11 aa, Borrelia burgdorferi
TENKEQEHEKL

SEQ ID NO: 20201 - protein, 11 aa, Borrelia burgdorferi
ENKEQEHEKLS

SEQ ID NO: 20202 - protein, 11 aa, Borrelia burgdorferi
NKEQEHEKLSQ

SEQ ID NO: 20203 - protein, 11 aa, Borrelia burgdorferi
KEQEHEKLSQV

SEQ ID NO: 20204 - protein, 11 aa, Borrelia burgdorferi
EQEHEKLSQVA

SEQ ID NO: 20205 - protein, 11 aa, Borrelia burgdorferi
QEHEKLSQVAQ

SEQ ID NO: 20206 - protein, 11 aa, Borrelia burgdorferi
EHEKLSQVAQH

SEQ ID NO: 20207 - protein, 11 aa, Borrelia burgdorferi
HEKLSQVAQHA

SEQ ID NO: 20208 - protein, 11 aa, Borrelia burgdorferi
EKLSQVAQHAP

SEQ ID NO: 20209 - protein, 11 aa, Borrelia burgdorferi
KLSQVAQHAPN

SEQ ID NO: 20210 - protein, 11 aa, Borrelia burgdorferi
LSQVAQHAPNS

SEQ ID NO: 20211 - protein, 11 aa, Borrelia burgdorferi
SQVAQHAPNSK

SEQ ID NO: 20212 - protein, 11 aa, Borrelia burgdorferi
QVAQHAPNSKI

SEQ ID NO: 20213 - protein, 11 aa, Borrelia burgdorferi
VAQHAPNSKIE

SEQ ID NO: 20214 - protein, 11 aa, Borrelia burgdorferi
AQHAPNSKIEK

SEQ ID NO: 20215 - protein, 11 aa, Borrelia burgdorferi
QHAPNSKIEKV

SEQ ID NO: 20216 - protein, 11 aa, Borrelia burgdorferi
HAPNSKIEKVK

SEQ ID NO: 20217 - protein, 11 aa, Borrelia burgdorferi
APNSKIEKVKS

SEQ ID NO: 20218 - protein, 11 aa, Borrelia burgdorferi
PNSKIEKVKSD

SEQ ID NO: 20219 - protein, 11 aa, Borrelia burgdorferi
NSKIEKVKSDG

SEQ ID NO: 20220 - protein, 11 aa, Borrelia burgdorferi
SKIEKVKSDGK

SEQ ID NO: 20221 - protein, 11 aa, Borrelia burgdorferi
KIEKVKSDGKP

SEQ ID NO: 20222 - protein, 11 aa, Borrelia burgdorferi
IEKVKSDGKPV

SEQ ID NO: 20223 - protein, 11 aa, Borrelia burgdorferi
EKVKSDGKPVP

SEQ ID NO: 20224 - protein, 11 aa, Borrelia burgdorferi
KVKSDGKPVPG

SEQ ID NO: 20225 - protein, 11 aa, Borrelia burgdorferi
VKSDGKPVPGD

SEQ ID NO: 20226 - protein, 11 aa, Borrelia burgdorferi
KSDGKPVPGDK

SEQ ID NO: 20227 - protein, 11 aa, Borrelia burgdorferi
SDGKPVPGDKI

SEQ ID NO: 20228 - protein, 11 aa, Borrelia burgdorferi
DGKPVPGDKIL

SEQ ID NO: 20229 - protein, 11 aa, Borrelia burgdorferi
GKPVPGDKILS

SEQ ID NO: 20230 - protein, 11 aa, Borrelia burgdorferi
KPVPGDKILSS

SEQ ID NO: 20231 - protein, 11 aa, Borrelia burgdorferi
PVPGDKILSSN

SEQ ID NO: 20232 - protein, 11 aa, Borrelia burgdorferi
VPGDKILSSNK

SEQ ID NO: 20233 - protein, 11 aa, Borrelia burgdorferi
PGDKILSSNKD

SEQ ID NO: 20234 - protein, 11 aa, Borrelia burgdorferi
GDKILSSNKDI

SEQ ID NO: 20235 - protein, 11 aa, Borrelia burgdorferi
DKILSSNKDIY

SEQ ID NO: 20236 - protein, 11 aa, Borrelia burgdorferi
KILSSNKDIYN

SEQ ID NO: 20237 - protein, 11 aa, Borrelia burgdorferi
ILSSNKDIYNS

SEQ ID NO: 20238 - protein, 11 aa, Borrelia burgdorferi
LSSNKDIYNSY

SEQ ID NO: 20239 - protein, 11 aa, Borrelia burgdorferi
SSNKDIYNSYI

SEQ ID NO: 20240 - protein, 11 aa, Borrelia burgdorferi
SNKDIYNSYIP

SEQ ID NO: 20241 - protein, 11 aa, Borrelia burgdorferi
NKDIYNSYIPE

SEQ ID NO: 20242 - protein, 11 aa, Borrelia burgdorferi
KDIYNSYIPEV

SEQ ID NO: 20243 - protein, 11 aa, Borrelia burgdorferi
DIYNSYIPEVK

SEQ ID NO: 20244 - protein, 11 aa, Borrelia burgdorferi
IYNSYIPEVKE

SEQ ID NO: 20245 - protein, 11 aa, Borrelia burgdorferi
YNSYIPEVKEE

SEQ ID NO: 20246 - protein, 11 aa, Borrelia burgdorferi
NSYIPEVKEEI

SEQ ID NO: 20247 - protein, 11 aa, Borrelia burgdorferi
SYIPEVKEEIV

SEQ ID NO: 20248 - protein, 11 aa, Borrelia burgdorferi
YIPEVKEEIVY

SEQ ID NO: 20249 - protein, 11 aa, Borrelia burgdorferi
IPEVKEEIVYE

SEQ ID NO: 20250 - protein, 11 aa, Borrelia burgdorferi
PEVKEEIVYEI

SEQ ID NO: 20251 - protein, 11 aa, Borrelia burgdorferi
EVKEEIVYEIL

SEQ ID NO: 20252 - protein, 11 aa, Borrelia burgdorferi
VKEEIVYEILE

SEQ ID NO: 20253 - protein, 11 aa, Borrelia burgdorferi
KEEIVYEILEE

SEQ ID NO: 20254 - protein, 11 aa, Borrelia burgdorferi
EEIVYEILEEV

SEQ ID NO: 20255 - protein, 11 aa, Borrelia burgdorferi
EIVYEILEEVI

SEQ ID NO: 20256 - protein, 11 aa, Borrelia burgdorferi
IVYEILEEVII

SEQ ID NO: 20257 - protein, 11 aa, Borrelia burgdorferi
VYEILEEVIIP

SEQ ID NO: 20258 - protein, 11 aa, Borrelia burgdorferi
YEILEEVIIPE

SEQ ID NO: 20259 - protein, 11 aa, Borrelia burgdorferi
EILEEVIIPET

SEQ ID NO: 20260 - protein, 11 aa, Borrelia burgdorferi
ILEEVIIPETK

SEQ ID NO: 20261 - protein, 11 aa, Borrelia burgdorferi
LEEVIIPETKI

SEQ ID NO: 20262 - protein, 11 aa, Borrelia burgdorferi
EEVIIPETKIP

SEQ ID NO: 20263 - protein, 11 aa, Borrelia burgdorferi
EVIIPETKIPE

SEQ ID NO: 20264 - protein, 11 aa, Borrelia burgdorferi
VIIPETKIPEI

SEQ ID NO: 20265 - protein, 11 aa, Borrelia burgdorferi
IIPETKIPEIT

SEQ ID NO: 20266 - protein, 11 aa, Borrelia burgdorferi
IPETKIPEITE

SEQ ID NO: 20267 - protein, 11 aa, Borrelia burgdorferi
PETKIPEITEE

SEQ ID NO: 20268 - protein, 11 aa, Borrelia burgdorferi
ETKIPEITEEV

SEQ ID NO: 20269 - protein, 11 aa, Borrelia burgdorferi
TKIPEITEEVI

SEQ ID NO: 20270 - protein, 11 aa, Borrelia burgdorferi
KIPEITEEVIM

SEQ ID NO: 20271 - protein, 11 aa, Borrelia burgdorferi
IPEITEEVIMP

SEQ ID NO: 20272 - protein, 11 aa, Borrelia burgdorferi
PEITEEVIMPI

SEQ ID NO: 20273 - protein, 11 aa, Borrelia burgdorferi
EITEEVIMPIP

SEQ ID NO: 20274 - protein, 11 aa, Borrelia burgdorferi
ITEEVIMPIPQ

SEQ ID NO: 20275 - protein, 11 aa, Borrelia burgdorferi
TEEVIMPIPQT

SEQ ID NO: 20276 - protein, 11 aa, Borrelia burgdorferi
EEVIMPIPQTI

SEQ ID NO: 20277 - protein, 11 aa, Borrelia burgdorferi
EVIMPIPQTID

SEQ ID NO: 20278 - protein, 11 aa, Borrelia burgdorferi
VIMPIPQTIDF

SEQ ID NO: 20279 - protein, 11 aa, Borrelia burgdorferi
IMPIPQTIDFY

SEQ ID NO: 20280 - protein, 11 aa, Borrelia burgdorferi
MPIPQTIDFYI

SEQ ID NO: 20281 - protein, 11 aa, Borrelia burgdorferi
PIPQTIDFYIE

SEQ ID NO: 20282 - protein, 11 aa, Borrelia burgdorferi
IPQTIDFYIEP

SEQ ID NO: 20283 - protein, 11 aa, Borrelia burgdorferi
PQTIDFYIEPR

SEQ ID NO: 20284 - protein, 11 aa, Borrelia burgdorferi
QTIDFYIEPRP

SEQ ID NO: 20285 - protein, 11 aa, Borrelia burgdorferi
TIDFYIEPRPI

SEQ ID NO: 20286 - protein, 11 aa, Borrelia burgdorferi
IDFYIEPRPIS

SEQ ID NO: 20287 - protein, 11 aa, Borrelia burgdorferi
DFYIEPRPISS

SEQ ID NO: 20288 - protein, 11 aa, Borrelia burgdorferi
FYIEPRPISSF

SEQ ID NO: 20289 - protein, 11 aa, Borrelia burgdorferi
YIEPRPISSFL

SEQ ID NO: 20290 - protein, 11 aa, Borrelia burgdorferi
IEPRPISSFLT

SEQ ID NO: 20291 - protein, 11 aa, Borrelia burgdorferi
EPRPISSFLTQ

SEQ ID NO: 20292 - protein, 11 aa, Borrelia burgdorferi
PRPISSFLTQG

SEQ ID NO: 20293 - protein, 11 aa, Borrelia burgdorferi
RPISSFLTQGT

SEQ ID NO: 20294 - protein, 11 aa, Borrelia burgdorferi
PISSFLTQGTS

SEQ ID NO: 20295 - protein, 11 aa, Borrelia burgdorferi
ISSFLTQGTSP

SEQ ID NO: 20296 - protein, 11 aa, Borrelia burgdorferi
SSFLTQGTSPS

SEQ ID NO: 20297 - protein, 11 aa, Borrelia burgdorferi
SFLTQGTSPSI

SEQ ID NO: 20298 - protein, 11 aa, Borrelia burgdorferi
FLTQGTSPSIT

SEQ ID NO: 20299 - protein, 11 aa, Borrelia burgdorferi
LTQGTSPSITS

SEQ ID NO: 20300 - protein, 11 aa, Borrelia burgdorferi
TQGTSPSITST

SEQ ID NO: 20301 - protein, 11 aa, Borrelia burgdorferi
QGTSPSITSTI

SEQ ID NO: 20302 - protein, 11 aa, Borrelia burgdorferi
GTSPSITSTIK

SEQ ID NO: 20303 - protein, 11 aa, Borrelia burgdorferi
TSPSITSTIKS

SEQ ID NO: 20304 - protein, 11 aa, Borrelia burgdorferi
SPSITSTIKSY

SEQ ID NO: 20305 - protein, 11 aa, Borrelia burgdorferi
PSITSTIKSYK

SEQ ID NO: 20306 - protein, 11 aa, Borrelia burgdorferi
SITSTIKSYKE

SEQ ID NO: 20307 - protein, 11 aa, Borrelia burgdorferi
ITSTIKSYKEL

SEQ ID NO: 20308 - protein, 11 aa, Borrelia burgdorferi
TSTIKSYKELA

SEQ ID NO: 20309 - protein, 11 aa, Borrelia burgdorferi
STIKSYKELAK

SEQ ID NO: 20310 - protein, 11 aa, Borrelia burgdorferi
TIKSYKELAKE

SEQ ID NO: 20311 - protein, 11 aa, Borrelia burgdorferi
IKSYKELAKEK

SEQ ID NO: 20312 - protein, 11 aa, Borrelia burgdorferi
KSYKELAKEKI

SEQ ID NO: 20313 - protein, 11 aa, Borrelia burgdorferi
SYKELAKEKIN

SEQ ID NO: 20314 - protein, 11 aa, Borrelia burgdorferi
YKELAKEKINN

SEQ ID NO: 20315 - protein, 11 aa, Borrelia burgdorferi
KELAKEKINNG

SEQ ID NO: 20316 - protein, 11 aa, Borrelia burgdorferi
ELAKEKINNGL

SEQ ID NO: 20317 - protein, 11 aa, Borrelia burgdorferi
LAKEKINNGLN

SEQ ID NO: 20318 - protein, 11 aa, Borrelia burgdorferi
AKEKINNGLNI

SEQ ID NO: 20319 - protein, 11 aa, Borrelia burgdorferi
KEKINNGLNIV

SEQ ID NO: 20320 - protein, 11 aa, Borrelia burgdorferi
EKINNGLNIVQ

SEQ ID NO: 20321 - protein, 11 aa, Borrelia burgdorferi
KINNGLNIVQK

SEQ ID NO: 20322 - protein, 11 aa, Borrelia burgdorferi
INNGLNIVQKI

SEQ ID NO: 20323 - protein, 11 aa, Borrelia burgdorferi
NNGLNIVQKIT

SEQ ID NO: 20324 - protein, 11 aa, Borrelia burgdorferi
NGLNIVQKITQ

SEQ ID NO: 20325 - protein, 11 aa, Borrelia burgdorferi
GLNIVQKITQN

SEQ ID NO: 20326 - protein, 11 aa, Borrelia burgdorferi
LNIVQKITQNI

SEQ ID NO: 20327 - protein, 11 aa, Borrelia burgdorferi
NIVQKITQNID

SEQ ID NO: 20328 - protein, 11 aa, Borrelia burgdorferi
IVQKITQNIDN

SEQ ID NO: 20329 - protein, 11 aa, Borrelia burgdorferi
VQKITQNIDNI

SEQ ID NO: 20330 - protein, 11 aa, Borrelia burgdorferi
QKITQNIDNIT

SEQ ID NO: 20331 - protein, 11 aa, Borrelia burgdorferi
KITQNIDNITE

SEQ ID NO: 20332 - protein, 11 aa, Borrelia burgdorferi
ITQNIDNITEN

SEQ ID NO: 20333 - protein, 11 aa, Borrelia burgdorferi
TQNIDNITENL

SEQ ID NO: 20334 - protein, 11 aa, Borrelia burgdorferi
QNIDNITENLN

SEQ ID NO: 20335 - protein, 11 aa, Borrelia burgdorferi
NIDNITENLNS

SEQ ID NO: 20336 - protein, 11 aa, Borrelia burgdorferi
IDNITENLNSK

SEQ ID NO: 20337 - protein, 11 aa, Borrelia burgdorferi
DNITENLNSKE

SEQ ID NO: 20338 - protein, 11 aa, Borrelia burgdorferi
NITENLNSKET

SEQ ID NO: 20339 - protein, 11 aa, Borrelia burgdorferi
ITENLNSKETP

SEQ ID NO: 20340 - protein, 11 aa, Borrelia burgdorferi
TENLNSKETPK

SEQ ID NO: 20341 - protein, 11 aa, Borrelia burgdorferi
ENLNSKETPKE

SEQ ID NO: 20342 - protein, 11 aa, Borrelia burgdorferi
NLNSKETPKEI

SEQ ID NO: 20343 - protein, 11 aa, Borrelia burgdorferi
LNSKETPKEIS

SEQ ID NO: 20344 - protein, 11 aa, Borrelia burgdorferi
NSKETPKEISG

SEQ ID NO: 20345 - protein, 11 aa, Borrelia burgdorferi
SKETPKEISGK

SEQ ID NO: 20346 - protein, 11 aa, Borrelia burgdorferi
KETPKEISGKE

SEQ ID NO: 20347 - protein, 11 aa, Borrelia burgdorferi
ETPKEISGKEV

SEQ ID NO: 20348 - protein, 11 aa, Borrelia burgdorferi
TPKEISGKEVE

SEQ ID NO: 20349 - protein, 11 aa, Borrelia burgdorferi
PKEISGKEVEE

SEQ ID NO: 20350 - protein, 11 aa, Borrelia burgdorferi
KEISGKEVEEK

SEQ ID NO: 20351 - protein, 11 aa, Borrelia burgdorferi
EISGKEVEEKI

SEQ ID NO: 20352 - protein, 11 aa, Borrelia burgdorferi
ISGKEVEEKIT

SEQ ID NO: 20353 - protein, 11 aa, Borrelia burgdorferi
SGKEVEEKITH

SEQ ID NO: 20354 - protein, 11 aa, Borrelia burgdorferi
GKEVEEKITHP

SEQ ID NO: 20355 - protein, 11 aa, Borrelia burgdorferi
KEVEEKITHPI

SEQ ID NO: 20356 - protein, 11 aa, Borrelia burgdorferi
EVEEKITHPIF

SEQ ID NO: 20357 - protein, 11 aa, Borrelia burgdorferi
VEEKITHPIFD

SEQ ID NO: 20358 - protein, 11 aa, Borrelia burgdorferi
EEKITHPIFDH

SEQ ID NO: 20359 - protein, 11 aa, Borrelia burgdorferi
EKITHPIFDHI

SEQ ID NO: 20360 - protein, 11 aa, Borrelia burgdorferi
KITHPIFDHIT

SEQ ID NO: 20361 - protein, 11 aa, Borrelia burgdorferi
ITHPIFDHITG

SEQ ID NO: 20362 - protein, 11 aa, Borrelia burgdorferi
THPIFDHITGS

SEQ ID NO: 20363 - protein, 11 aa, Borrelia burgdorferi
HPIFDHITGSG

SEQ ID NO: 20364 - protein, 11 aa, Borrelia burgdorferi
PIFDHITGSGN

SEQ ID NO: 20365 - protein, 11 aa, Borrelia burgdorferi
IFDHITGSGNN

SEQ ID NO: 20366 - protein, 11 aa, Borrelia burgdorferi
FDHITGSGNNP

SEQ ID NO: 20367 - protein, 11 aa, Borrelia burgdorferi
DHITGSGNNPG

SEQ ID NO: 20368 - protein, 11 aa, Borrelia burgdorferi
HITGSGNNPGQ

SEQ ID NO: 20369 - protein, 11 aa, Borrelia burgdorferi
ITGSGNNPGQD

SEQ ID NO: 20370 - protein, 11 aa, Borrelia burgdorferi
TGSGNNPGQDS

SEQ ID NO: 20371 - protein, 11 aa, Borrelia burgdorferi
GSGNNPGQDSI

SEQ ID NO: 20372 - protein, 11 aa, Borrelia burgdorferi
SGNNPGQDSIS

SEQ ID NO: 20373 - protein, 11 aa, Borrelia burgdorferi
GNNPGQDSISN

SEQ ID NO: 20374 - protein, 11 aa, Borrelia burgdorferi
NNPGQDSISNT

SEQ ID NO: 20375 - protein, 11 aa, Borrelia burgdorferi
NPGQDSISNTW

SEQ ID NO: 20376 - protein, 11 aa, Borrelia burgdorferi
PGQDSISNTWG

SEQ ID NO: 20377 - protein, 11 aa, Borrelia burgdorferi
GQDSISNTWGE

SEQ ID NO: 20378 - protein, 11 aa, Borrelia burgdorferi
QDSISNTWGEG

SEQ ID NO: 20379 - protein, 11 aa, Borrelia burgdorferi
DSISNTWGEGL

SEQ ID NO: 20380 - protein, 11 aa, Borrelia burgdorferi
SISNTWGEGLE

SEQ ID NO: 20381 - protein, 11 aa, Borrelia burgdorferi
ISNTWGEGLEI

SEQ ID NO: 20382 - protein, 11 aa, Borrelia burgdorferi
SNTWGEGLEIG

SEQ ID NO: 20383 - protein, 11 aa, Borrelia burgdorferi
NTWGEGLEIGG

SEQ ID NO: 20384 - protein, 11 aa, Borrelia burgdorferi
TWGEGLEIGGD

SEQ ID NO: 20385 - protein, 11 aa, Borrelia burgdorferi
WGEGLEIGGDS

SEQ ID NO: 20386 - protein, 11 aa, Borrelia burgdorferi
GEGLEIGGDSN

SEQ ID NO: 20387 - protein, 11 aa, Borrelia burgdorferi
EGLEIGGDSNF

SEQ ID NO: 20388 - protein, 11 aa, Borrelia burgdorferi
GLEIGGDSNFF

SEQ ID NO: 20389 - protein, 11 aa, Borrelia burgdorferi
LEIGGDSNFFT

SEQ ID NO: 20390 - protein, 11 aa, Borrelia burgdorferi
EIGGDSNFFTN

SEQ ID NO: 20391 - protein, 11 aa, Borrelia burgdorferi
IGGDSNFFTNL

SEQ ID NO: 20392 - protein, 11 aa, Borrelia burgdorferi
GGDSNFFTNLE

SEQ ID NO: 20393 - protein, 11 aa, Borrelia burgdorferi
GDSNFFTNLEE

SEQ ID NO: 20394 - protein, 11 aa, Borrelia burgdorferi
DSNFFTNLEEV

SEQ ID NO: 20395 - protein, 11 aa, Borrelia burgdorferi
SNFFTNLEEVR

SEQ ID NO: 20396 - protein, 11 aa, Borrelia burgdorferi
NFFTNLEEVRS

SEQ ID NO: 20397 - protein, 11 aa, Borrelia burgdorferi
FFTNLEEVRSS

SEQ ID NO: 20398 - protein, 11 aa, Borrelia burgdorferi
FTNLEEVRSSI

SEQ ID NO: 20399 - protein, 11 aa, Borrelia burgdorferi
TNLEEVRSSIR

SEQ ID NO: 20400 - protein, 11 aa, Borrelia burgdorferi
NLEEVRSSIRT

SEQ ID NO: 20401 - protein, 11 aa, Borrelia burgdorferi
LEEVRSSIRTK

SEQ ID NO: 20402 - protein, 11 aa, Borrelia burgdorferi
EEVRSSIRTKI

SEQ ID NO: 20403 - protein, 11 aa, Borrelia burgdorferi
EVRSSIRTKIK

SEQ ID NO: 20404 - protein, 11 aa, Borrelia burgdorferi
VRSSIRTKIKV

SEQ ID NO: 20405 - protein, 11 aa, Borrelia burgdorferi
RSSIRTKIKVS

SEQ ID NO: 20406 - protein, 11 aa, Borrelia burgdorferi
SSIRTKIKVSD

SEQ ID NO: 20407 - protein, 11 aa, Borrelia burgdorferi
SIRTKIKVSDG

SEQ ID NO: 20408 - protein, 11 aa, Borrelia burgdorferi
IRTKIKVSDGT

SEQ ID NO: 20409 - protein, 11 aa, Borrelia burgdorferi
RTKIKVSDGTE

SEQ ID NO: 20410 - protein, 11 aa, Borrelia burgdorferi
TKIKVSDGTEQ

SEQ ID NO: 20411 - protein, 11 aa, Borrelia burgdorferi
KIKVSDGTEQT

SEQ ID NO: 20412 - protein, 11 aa, Borrelia burgdorferi
IKVSDGTEQTK

SEQ ID NO: 20413 - protein, 11 aa, Borrelia burgdorferi
KVSDGTEQTKD

SEQ ID NO: 20414 - protein, 11 aa, Borrelia burgdorferi
VSDGTEQTKDK

SEQ ID NO: 20415 - protein, 11 aa, Borrelia burgdorferi
SDGTEQTKDKV

SEQ ID NO: 20416 - protein, 11 aa, Borrelia burgdorferi
DGTEQTKDKVE

SEQ ID NO: 20417 - protein, 11 aa, Borrelia burgdorferi
GTEQTKDKVEI

SEQ ID NO: 20418 - protein, 11 aa, Borrelia burgdorferi
TEQTKDKVEID

SEQ ID NO: 20419 - protein, 11 aa, Borrelia burgdorferi
EQTKDKVEIDE

SEQ ID NO: 20420 - protein, 11 aa, Borrelia burgdorferi
QTKDKVEIDEI

SEQ ID NO: 20421 - protein, 11 aa, Borrelia burgdorferi
TKDKVEIDEII

SEQ ID NO: 20422 - protein, 11 aa, Borrelia burgdorferi
KDKVEIDEIIE

SEQ ID NO: 20423 - protein, 11 aa, Borrelia burgdorferi
DKVEIDEIIED

SEQ ID NO: 20424 - protein, 11 aa, Borrelia burgdorferi
KVEIDEIIEDL

SEQ ID NO: 20425 - protein, 11 aa, Borrelia burgdorferi
VEIDEIIEDLQ

SEQ ID NO: 20426 - protein, 11 aa, Borrelia burgdorferi
EIDEIIEDLQK

SEQ ID NO: 20427 - protein, 11 aa, Borrelia burgdorferi
IDEIIEDLQKL

SEQ ID NO: 20428 - protein, 11 aa, Borrelia burgdorferi
DEIIEDLQKLK

SEQ ID NO: 20429 - protein, 11 aa, Borrelia burgdorferi
EIIEDLQKLKE

SEQ ID NO: 20430 - protein, 11 aa, Borrelia burgdorferi
IIEDLQKLKEF

SEQ ID NO: 20431 - protein, 11 aa, Borrelia burgdorferi
IEDLQKLKEFL

SEQ ID NO: 20432 - protein, 11 aa, Borrelia burgdorferi
EDLQKLKEFLE

SEQ ID NO: 20433 - protein, 11 aa, Borrelia burgdorferi
DLQKLKEFLEK

SEQ ID NO: 20434 - protein, 11 aa, Borrelia burgdorferi
LQKLKEFLEKL

SEQ ID NO: 20435 - protein, 11 aa, Borrelia burgdorferi
QKLKEFLEKLK

SEQ ID NO: 20436 - protein, 11 aa, Borrelia burgdorferi
KLKEFLEKLKK

SEQ ID NO: 20437 - protein, 11 aa, Borrelia burgdorferi
LKEFLEKLKKY

SEQ ID NO: 20438 - protein, 11 aa, Borrelia burgdorferi
KEFLEKLKKYL

SEQ ID NO: 20439 - protein, 11 aa, Borrelia burgdorferi
EFLEKLKKYLK

SEQ ID NO: 20440 - protein, 11 aa, Borrelia burgdorferi
FLEKLKKYLKD

SEQ ID NO: 20441 - protein, 11 aa, Borrelia burgdorferi
LEKLKKYLKDT

SEQ ID NO: 20442 - protein, 11 aa, Borrelia burgdorferi
EKLKKYLKDTN

SEQ ID NO: 20443 - protein, 11 aa, Borrelia burgdorferi
KLKKYLKDTNN

SEQ ID NO: 20444 - protein, 11 aa, Borrelia burgdorferi
LKKYLKDTNNL

SEQ ID NO: 20445 - protein, 11 aa, Borrelia burgdorferi
KKYLKDTNNLS

SEQ ID NO: 20446 - protein, 11 aa, Borrelia burgdorferi
KYLKDTNNLSA

SEQ ID NO: 20447 - protein, 11 aa, Borrelia burgdorferi
YLKDTNNLSAI

SEQ ID NO: 20448 - protein, 11 aa, Borrelia burgdorferi
LKDTNNLSAIE

SEQ ID NO: 20449 - protein, 11 aa, Borrelia burgdorferi
KDTNNLSAIEE

SEQ ID NO: 20450 - protein, 11 aa, Borrelia burgdorferi
DTNNLSAIEES

SEQ ID NO: 20451 - protein, 11 aa, Borrelia burgdorferi
TNNLSAIEESV

SEQ ID NO: 20452 - protein, 11 aa, Borrelia burgdorferi
NNLSAIEESVK

SEQ ID NO: 20453 - protein, 11 aa, Borrelia burgdorferi
NLSAIEESVKG

SEQ ID NO: 20454 - protein, 11 aa, Borrelia burgdorferi
LSAIEESVKGL

SEQ ID NO: 20455 - protein, 11 aa, Borrelia burgdorferi
SAIEESVKGLS

SEQ ID NO: 20456 - protein, 8 aa, Borrelia burgdorferi B31
MIKMSLNY

SEQ ID NO: 20457 - protein, 8 aa, Borrelia burgdorferi B31
IKMSLNYT

SEQ ID NO: 20458 - protein, 8 aa, Borrelia burgdorferi B31
KMSLNYTE

SEQ ID NO: 20459 - protein, 8 aa, Borrelia burgdorferi B31
MSLNYTEI

SEQ ID NO: 20460 - protein, 8 aa, Borrelia burgdorferi B31
SLNYTEIN

SEQ ID NO: 20461 - protein, 8 aa, Borrelia burgdorferi B31
LNYTEINT

SEQ ID NO: 20462 - protein, 8 aa, Borrelia burgdorferi B31
NYTEINTL

SEQ ID NO: 20463 - protein, 8 aa, Borrelia burgdorferi B31
YTEINTLI

SEQ ID NO: 20464 - protein, 8 aa, Borrelia burgdorferi B31
TEINTLIK

SEQ ID NO: 20465 - protein, 8 aa, Borrelia burgdorferi B31
EINTLIKE

SEQ ID NO: 20466 - protein, 8 aa, Borrelia burgdorferi B31
INTLIKEI

SEQ ID NO: 20467 - protein, 8 aa, Borrelia burgdorferi B31
NTLIKEIP

SEQ ID NO: 20468 - protein, 8 aa, Borrelia burgdorferi B31
TLIKEIPF

SEQ ID NO: 20469 - protein, 8 aa, Borrelia burgdorferi B31
LIKEIPFT

SEQ ID NO: 20470 - protein, 8 aa, Borrelia burgdorferi B31
IKEIPFTN

SEQ ID NO: 20471 - protein, 8 aa, Borrelia burgdorferi B31
KEIPFTNS

SEQ ID NO: 20472 - protein, 8 aa, Borrelia burgdorferi B31
EIPFTNSL

SEQ ID NO: 20473 - protein, 8 aa, Borrelia burgdorferi B31
IPFTNSLI

SEQ ID NO: 20474 - protein, 8 aa, Borrelia burgdorferi B31
PFTNSLIT

SEQ ID NO: 20475 - protein, 8 aa, Borrelia burgdorferi B31
FTNSLITK

SEQ ID NO: 20476 - protein, 8 aa, Borrelia burgdorferi B31
TNSLITKI

SEQ ID NO: 20477 - protein, 8 aa, Borrelia burgdorferi B31
NSLITKII

SEQ ID NO: 20478 - protein, 8 aa, Borrelia burgdorferi B31
SLITKIIQ

SEQ ID NO: 20479 - protein, 8 aa, Borrelia burgdorferi B31
LITKIIQP

SEQ ID NO: 20480 - protein, 8 aa, Borrelia burgdorferi B31
ITKIIQPD

SEQ ID NO: 20481 - protein, 8 aa, Borrelia burgdorferi B31
TKIIQPDY

SEQ ID NO: 20482 - protein, 8 aa, Borrelia burgdorferi B31
KIIQPDYK

SEQ ID NO: 20483 - protein, 8 aa, Borrelia burgdorferi B31
IIQPDYKS

SEQ ID NO: 20484 - protein, 8 aa, Borrelia burgdorferi B31
IQPDYKSL

SEQ ID NO: 20485 - protein, 8 aa, Borrelia burgdorferi B31
QPDYKSLV

SEQ ID NO: 20486 - protein, 8 aa, Borrelia burgdorferi B31
PDYKSLVL

SEQ ID NO: 20487 - protein, 8 aa, Borrelia burgdorferi B31
DYKSLVLE

SEQ ID NO: 20488 - protein, 8 aa, Borrelia burgdorferi B31
YKSLVLEI

SEQ ID NO: 20489 - protein, 8 aa, Borrelia burgdorferi B31
KSLVLEIY

SEQ ID NO: 20490 - protein, 8 aa, Borrelia burgdorferi B31
SLVLEIYN

SEQ ID NO: 20491 - protein, 8 aa, Borrelia burgdorferi B31
LVLEIYNK

SEQ ID NO: 20492 - protein, 8 aa, Borrelia burgdorferi B31
VLEIYNKI

SEQ ID NO: 20493 - protein, 8 aa, Borrelia burgdorferi B31
LEIYNKID

SEQ ID NO: 20494 - protein, 8 aa, Borrelia burgdorferi B31
EIYNKIDN

SEQ ID NO: 20495 - protein, 8 aa, Borrelia burgdorferi B31
IYNKIDNK

SEQ ID NO: 20496 - protein, 8 aa, Borrelia burgdorferi B31
YNKIDNKK

SEQ ID NO: 20497 - protein, 8 aa, Borrelia burgdorferi B31
NKIDNKKF

SEQ ID NO: 20498 - protein, 8 aa, Borrelia burgdorferi B31
KIDNKKFK

SEQ ID NO: 20499 - protein, 8 aa, Borrelia burgdorferi B31
IDNKKFKI

SEQ ID NO: 20500 - protein, 8 aa, Borrelia burgdorferi B31
DNKKFKIL

SEQ ID NO: 20501 - protein, 8 aa, Borrelia burgdorferi B31
NKKFKILI

SEQ ID NO: 20502 - protein, 8 aa, Borrelia burgdorferi B31
KKFKILIC

SEQ ID NO: 20503 - protein, 8 aa, Borrelia burgdorferi B31
KFKILICL

SEQ ID NO: 20504 - protein, 8 aa, Borrelia burgdorferi B31
FKILICLN

SEQ ID NO: 20505 - protein, 8 aa, Borrelia burgdorferi B31
KILICLNP

SEQ ID NO: 20506 - protein, 8 aa, Borrelia burgdorferi B31
ILICLNPN

SEQ ID NO: 20507 - protein, 8 aa, Borrelia burgdorferi B31
LICLNPNT

SEQ ID NO: 20508 - protein, 8 aa, Borrelia burgdorferi B31
ICLNPNTT

SEQ ID NO: 20509 - protein, 8 aa, Borrelia burgdorferi B31
CLNPNTTR

SEQ ID NO: 20510 - protein, 8 aa, Borrelia burgdorferi B31
LNPNTTRF

SEQ ID NO: 20511 - protein, 8 aa, Borrelia burgdorferi B31
NPNTTRFH

SEQ ID NO: 20512 - protein, 8 aa, Borrelia burgdorferi B31
PNTTRFHI

SEQ ID NO: 20513 - protein, 8 aa, Borrelia burgdorferi B31
NTTRFHIT

SEQ ID NO: 20514 - protein, 8 aa, Borrelia burgdorferi B31
TTRFHITK

SEQ ID NO: 20515 - protein, 8 aa, Borrelia burgdorferi B31
TRFHITKK

SEQ ID NO: 20516 - protein, 8 aa, Borrelia burgdorferi B31
RFHITKKN

SEQ ID NO: 20517 - protein, 8 aa, Borrelia burgdorferi B31
FHITKKNF

SEQ ID NO: 20518 - protein, 8 aa, Borrelia burgdorferi B31
HITKKNFK

SEQ ID NO: 20519 - protein, 8 aa, Borrelia burgdorferi B31
ITKKNFKK

SEQ ID NO: 20520 - protein, 8 aa, Borrelia burgdorferi B31
TKKNFKKN

SEQ ID NO: 20521 - protein, 8 aa, Borrelia burgdorferi B31
KKNFKKNA

SEQ ID NO: 20522 - protein, 8 aa, Borrelia burgdorferi B31
KNFKKNAL

SEQ ID NO: 20523 - protein, 8 aa, Borrelia burgdorferi B31
NFKKNALK

SEQ ID NO: 20524 - protein, 8 aa, Borrelia burgdorferi B31
FKKNALKL

SEQ ID NO: 20525 - protein, 8 aa, Borrelia burgdorferi B31
KKNALKLR

SEQ ID NO: 20526 - protein, 8 aa, Borrelia burgdorferi B31
KNALKLRF

SEQ ID NO: 20527 - protein, 8 aa, Borrelia burgdorferi B31
NALKLRFS

SEQ ID NO: 20528 - protein, 8 aa, Borrelia burgdorferi B31
ALKLRFSD

SEQ ID NO: 20529 - protein, 8 aa, Borrelia burgdorferi B31
LKLRFSDF

SEQ ID NO: 20530 - protein, 8 aa, Borrelia burgdorferi B31
KLRFSDFL

SEQ ID NO: 20531 - protein, 8 aa, Borrelia burgdorferi B31
LRFSDFLK

SEQ ID NO: 20532 - protein, 8 aa, Borrelia burgdorferi B31
RFSDFLKS

SEQ ID NO: 20533 - protein, 8 aa, Borrelia burgdorferi B31
FSDFLKSK

SEQ ID NO: 20534 - protein, 8 aa, Borrelia burgdorferi B31
SDFLKSKI

SEQ ID NO: 20535 - protein, 8 aa, Borrelia burgdorferi B31
DFLKSKIQ

SEQ ID NO: 20536 - protein, 8 aa, Borrelia burgdorferi B31
FLKSKIQN

SEQ ID NO: 20537 - protein, 8 aa, Borrelia burgdorferi B31
LKSKIQNG

SEQ ID NO: 20538 - protein, 8 aa, Borrelia burgdorferi B31
KSKIQNGK

SEQ ID NO: 20539 - protein, 8 aa, Borrelia burgdorferi B31
SKIQNGKI

SEQ ID NO: 20540 - protein, 8 aa, Borrelia burgdorferi B31
KIQNGKII

SEQ ID NO: 20541 - protein, 8 aa, Borrelia burgdorferi B31
IQNGKIIK

SEQ ID NO: 20542 - protein, 8 aa, Borrelia burgdorferi B31
QNGKIIKA

SEQ ID NO: 20543 - protein, 8 aa, Borrelia burgdorferi B31
NGKIIKAF

SEQ ID NO: 20544 - protein, 8 aa, Borrelia burgdorferi B31
GKIIKAFQ

SEQ ID NO: 20545 - protein, 8 aa, Borrelia burgdorferi B31
KIIKAFQM

SEQ ID NO: 20546 - protein, 8 aa, Borrelia burgdorferi B31
IIKAFQMK

SEQ ID NO: 20547 - protein, 8 aa, Borrelia burgdorferi B31
IKAFQMKN

SEQ ID NO: 20548 - protein, 8 aa, Borrelia burgdorferi B31
KAFQMKNE

SEQ ID NO: 20549 - protein, 8 aa, Borrelia burgdorferi B31
AFQMKNER

SEQ ID NO: 20550 - protein, 8 aa, Borrelia burgdorferi B31
FQMKNERI

SEQ ID NO: 20551 - protein, 8 aa, Borrelia burgdorferi B31
QMKNERII

SEQ ID NO: 20552 - protein, 8 aa, Borrelia burgdorferi B31
MKNERIIS

SEQ ID NO: 20553 - protein, 8 aa, Borrelia burgdorferi B31
KNERIISL

SEQ ID NO: 20554 - protein, 8 aa, Borrelia burgdorferi B31
NERIISLE

SEQ ID NO: 20555 - protein, 8 aa, Borrelia burgdorferi B31
ERIISLEI

SEQ ID NO: 20556 - protein, 8 aa, Borrelia burgdorferi B31
RIISLEIL

SEQ ID NO: 20557 - protein, 8 aa, Borrelia burgdorferi B31
IISLEILQ

SEQ ID NO: 20558 - protein, 8 aa, Borrelia burgdorferi B31
ISLEILQK

SEQ ID NO: 20559 - protein, 8 aa, Borrelia burgdorferi B31
SLEILQKD

SEQ ID NO: 20560 - protein, 8 aa, Borrelia burgdorferi B31
LEILQKDM

SEQ ID NO: 20561 - protein, 8 aa, Borrelia burgdorferi B31
EILQKDMI

SEQ ID NO: 20562 - protein, 8 aa, Borrelia burgdorferi B31
ILQKDMII

SEQ ID NO: 20563 - protein, 8 aa, Borrelia burgdorferi B31
LQKDMIIL

SEQ ID NO: 20564 - protein, 8 aa, Borrelia burgdorferi B31
QKDMIILF

SEQ ID NO: 20565 - protein, 8 aa, Borrelia burgdorferi B31
KDMIILFI

SEQ ID NO: 20566 - protein, 8 aa, Borrelia burgdorferi B31
DMIILFIK

SEQ ID NO: 20567 - protein, 8 aa, Borrelia burgdorferi B31
MIILFIKL

SEQ ID NO: 20568 - protein, 8 aa, Borrelia burgdorferi B31
IILFIKLW

SEQ ID NO: 20569 - protein, 8 aa, Borrelia burgdorferi B31
ILFIKLWP

SEQ ID NO: 20570 - protein, 8 aa, Borrelia burgdorferi B31
LFIKLWPS

SEQ ID NO: 20571 - protein, 8 aa, Borrelia burgdorferi B31
FIKLWPSS

SEQ ID NO: 20572 - protein, 8 aa, Borrelia burgdorferi B31
IKLWPSSP

SEQ ID NO: 20573 - protein, 8 aa, Borrelia burgdorferi B31
KLWPSSPN

SEQ ID NO: 20574 - protein, 8 aa, Borrelia burgdorferi B31
LWPSSPNI

SEQ ID NO: 20575 - protein, 8 aa, Borrelia burgdorferi B31
WPSSPNII

SEQ ID NO: 20576 - protein, 8 aa, Borrelia burgdorferi B31
PSSPNIIA

SEQ ID NO: 20577 - protein, 8 aa, Borrelia burgdorferi B31
SSPNIIAT

SEQ ID NO: 20578 - protein, 8 aa, Borrelia burgdorferi B31
SPNIIATN

SEQ ID NO: 20579 - protein, 8 aa, Borrelia burgdorferi B31
PNIIATNS

SEQ ID NO: 20580 - protein, 8 aa, Borrelia burgdorferi B31
NIIATNSN

SEQ ID NO: 20581 - protein, 8 aa, Borrelia burgdorferi B31
IIATNSNF

SEQ ID NO: 20582 - protein, 8 aa, Borrelia burgdorferi B31
IATNSNFK

SEQ ID NO: 20583 - protein, 8 aa, Borrelia burgdorferi B31
ATNSNFKI

SEQ ID NO: 20584 - protein, 8 aa, Borrelia burgdorferi B31
TNSNFKIL

SEQ ID NO: 20585 - protein, 8 aa, Borrelia burgdorferi B31
NSNFKILD

SEQ ID NO: 20586 - protein, 8 aa, Borrelia burgdorferi B31
SNFKILDA

SEQ ID NO: 20587 - protein, 8 aa, Borrelia burgdorferi B31
NFKILDAY

SEQ ID NO: 20588 - protein, 8 aa, Borrelia burgdorferi B31
FKILDAYY

SEQ ID NO: 20589 - protein, 8 aa, Borrelia burgdorferi B31
KILDAYYR

SEQ ID NO: 20590 - protein, 8 aa, Borrelia burgdorferi B31
ILDAYYRR

SEQ ID NO: 20591 - protein, 8 aa, Borrelia burgdorferi B31
LDAYYRRP

SEQ ID NO: 20592 - protein, 8 aa, Borrelia burgdorferi B31
DAYYRRPK

SEQ ID NO: 20593 - protein, 8 aa, Borrelia burgdorferi B31
AYYRRPKI

SEQ ID NO: 20594 - protein, 8 aa, Borrelia burgdorferi B31
YYRRPKIK

SEQ ID NO: 20595 - protein, 8 aa, Borrelia burgdorferi B31
YRRPKIKE

SEQ ID NO: 20596 - protein, 8 aa, Borrelia burgdorferi B31
RRPKIKET

SEQ ID NO: 20597 - protein, 8 aa, Borrelia burgdorferi B31
RPKIKETT

SEQ ID NO: 20598 - protein, 8 aa, Borrelia burgdorferi B31
PKIKETTG

SEQ ID NO: 20599 - protein, 8 aa, Borrelia burgdorferi B31
KIKETTGE

SEQ ID NO: 20600 - protein, 8 aa, Borrelia burgdorferi B31
IKETTGEI

SEQ ID NO: 20601 - protein, 8 aa, Borrelia burgdorferi B31
KETTGEIF

SEQ ID NO: 20602 - protein, 8 aa, Borrelia burgdorferi B31
ETTGEIFL

SEQ ID NO: 20603 - protein, 8 aa, Borrelia burgdorferi B31
TTGEIFLK

SEQ ID NO: 20604 - protein, 8 aa, Borrelia burgdorferi B31
TGEIFLKA

SEQ ID NO: 20605 - protein, 8 aa, Borrelia burgdorferi B31
GEIFLKAK

SEQ ID NO: 20606 - protein, 8 aa, Borrelia burgdorferi B31
EIFLKAKE

SEQ ID NO: 20607 - protein, 8 aa, Borrelia burgdorferi B31
IFLKAKEI

SEQ ID NO: 20608 - protein, 8 aa, Borrelia burgdorferi B31
FLKAKEIH

SEQ ID NO: 20609 - protein, 8 aa, Borrelia burgdorferi B31
LKAKEIHE

SEQ ID NO: 20610 - protein, 8 aa, Borrelia burgdorferi B31
KAKEIHES

SEQ ID NO: 20611 - protein, 8 aa, Borrelia burgdorferi B31
AKEIHESN

SEQ ID NO: 20612 - protein, 8 aa, Borrelia burgdorferi B31
KEIHESNK

SEQ ID NO: 20613 - protein, 8 aa, Borrelia burgdorferi B31
EIHESNKM

SEQ ID NO: 20614 - protein, 8 aa, Borrelia burgdorferi B31
IHESNKMS

SEQ ID NO: 20615 - protein, 8 aa, Borrelia burgdorferi B31
HESNKMSD

SEQ ID NO: 20616 - protein, 8 aa, Borrelia burgdorferi B31
ESNKMSDK

SEQ ID NO: 20617 - protein, 8 aa, Borrelia burgdorferi B31
SNKMSDKK

SEQ ID NO: 20618 - protein, 8 aa, Borrelia burgdorferi B31
NKMSDKKI

SEQ ID NO: 20619 - protein, 8 aa, Borrelia burgdorferi B31
KMSDKKIM

SEQ ID NO: 20620 - protein, 8 aa, Borrelia burgdorferi B31
MSDKKIME

SEQ ID NO: 20621 - protein, 8 aa, Borrelia burgdorferi B31
SDKKIMEL

SEQ ID NO: 20622 - protein, 8 aa, Borrelia burgdorferi B31
DKKIMELK

SEQ ID NO: 20623 - protein, 8 aa, Borrelia burgdorferi B31
KKIMELKE

SEQ ID NO: 20624 - protein, 8 aa, Borrelia burgdorferi B31
KIMELKEE

SEQ ID NO: 20625 - protein, 8 aa, Borrelia burgdorferi B31
IMELKEEY

SEQ ID NO: 20626 - protein, 8 aa, Borrelia burgdorferi B31
MELKEEYN

SEQ ID NO: 20627 - protein, 8 aa, Borrelia burgdorferi B31
ELKEEYNN

SEQ ID NO: 20628 - protein, 8 aa, Borrelia burgdorferi B31
LKEEYNNT

SEQ ID NO: 20629 - protein, 8 aa, Borrelia burgdorferi B31
KEEYNNTS

SEQ ID NO: 20630 - protein, 8 aa, Borrelia burgdorferi B31
EEYNNTSY

SEQ ID NO: 20631 - protein, 8 aa, Borrelia burgdorferi B31
EYNNTSYT

SEQ ID NO: 20632 - protein, 8 aa, Borrelia burgdorferi B31
YNNTSYTS

SEQ ID NO: 20633 - protein, 8 aa, Borrelia burgdorferi B31
NNTSYTSY

SEQ ID NO: 20634 - protein, 8 aa, Borrelia burgdorferi B31
NTSYTSYS

SEQ ID NO: 20635 - protein, 8 aa, Borrelia burgdorferi B31
TSYTSYSE

SEQ ID NO: 20636 - protein, 8 aa, Borrelia burgdorferi B31
SYTSYSEF

SEQ ID NO: 20637 - protein, 8 aa, Borrelia burgdorferi B31
YTSYSEFL

SEQ ID NO: 20638 - protein, 8 aa, Borrelia burgdorferi B31
TSYSEFLE

SEQ ID NO: 20639 - protein, 8 aa, Borrelia burgdorferi B31
SYSEFLEN

SEQ ID NO: 20640 - protein, 8 aa, Borrelia burgdorferi B31
YSEFLENY

SEQ ID NO: 20641 - protein, 8 aa, Borrelia burgdorferi B31
SEFLENYY

SEQ ID NO: 20642 - protein, 8 aa, Borrelia burgdorferi B31
EFLENYYE

SEQ ID NO: 20643 - protein, 8 aa, Borrelia burgdorferi B31
FLENYYES

SEQ ID NO: 20644 - protein, 8 aa, Borrelia burgdorferi B31
LENYYESL

SEQ ID NO: 20645 - protein, 8 aa, Borrelia burgdorferi B31
ENYYESLN

SEQ ID NO: 20646 - protein, 8 aa, Borrelia burgdorferi B31
NYYESLND

SEQ ID NO: 20647 - protein, 8 aa, Borrelia burgdorferi B31
YYESLNDQ

SEQ ID NO: 20648 - protein, 8 aa, Borrelia burgdorferi B31
YESLNDQI

SEQ ID NO: 20649 - protein, 8 aa, Borrelia burgdorferi B31
ESLNDQIK

SEQ ID NO: 20650 - protein, 8 aa, Borrelia burgdorferi B31
SLNDQIKK

SEQ ID NO: 20651 - protein, 8 aa, Borrelia burgdorferi B31
LNDQIKKT

SEQ ID NO: 20652 - protein, 8 aa, Borrelia burgdorferi B31
NDQIKKTN

SEQ ID NO: 20653 - protein, 8 aa, Borrelia burgdorferi B31
DQIKKTNI

SEQ ID NO: 20654 - protein, 8 aa, Borrelia burgdorferi B31
QIKKTNIK

SEQ ID NO: 20655 - protein, 8 aa, Borrelia burgdorferi B31
IKKTNIKE

SEQ ID NO: 20656 - protein, 8 aa, Borrelia burgdorferi B31
KKTNIKEL

SEQ ID NO: 20657 - protein, 8 aa, Borrelia burgdorferi B31
KTNIKELL

SEQ ID NO: 20658 - protein, 8 aa, Borrelia burgdorferi B31
TNIKELLI

SEQ ID NO: 20659 - protein, 8 aa, Borrelia burgdorferi B31
NIKELLIE

SEQ ID NO: 20660 - protein, 8 aa, Borrelia burgdorferi B31
IKELLIEK

SEQ ID NO: 20661 - protein, 8 aa, Borrelia burgdorferi B31
KELLIEKY

SEQ ID NO: 20662 - protein, 8 aa, Borrelia burgdorferi B31
ELLIEKYK

SEQ ID NO: 20663 - protein, 8 aa, Borrelia burgdorferi B31
LLIEKYKK

SEQ ID NO: 20664 - protein, 8 aa, Borrelia burgdorferi B31
LIEKYKKE

SEQ ID NO: 20665 - protein, 8 aa, Borrelia burgdorferi B31
IEKYKKEL

SEQ ID NO: 20666 - protein, 8 aa, Borrelia burgdorferi B31
EKYKKELI

SEQ ID NO: 20667 - protein, 8 aa, Borrelia burgdorferi B31
KYKKELIV

SEQ ID NO: 20668 - protein, 8 aa, Borrelia burgdorferi B31
YKKELIVL

SEQ ID NO: 20669 - protein, 8 aa, Borrelia burgdorferi B31
KKELIVLE

SEQ ID NO: 20670 - protein, 8 aa, Borrelia burgdorferi B31
KELIVLEK

SEQ ID NO: 20671 - protein, 8 aa, Borrelia burgdorferi B31
ELIVLEKR

SEQ ID NO: 20672 - protein, 8 aa, Borrelia burgdorferi B31
LIVLEKRI

SEQ ID NO: 20673 - protein, 8 aa, Borrelia burgdorferi B31
IVLEKRID

SEQ ID NO: 20674 - protein, 8 aa, Borrelia burgdorferi B31
VLEKRIDS

SEQ ID NO: 20675 - protein, 8 aa, Borrelia burgdorferi B31
LEKRIDSL

SEQ ID NO: 20676 - protein, 8 aa, Borrelia burgdorferi B31
EKRIDSLK

SEQ ID NO: 20677 - protein, 8 aa, Borrelia burgdorferi B31
KRIDSLKQ

SEQ ID NO: 20678 - protein, 8 aa, Borrelia burgdorferi B31
RIDSLKQQ

SEQ ID NO: 20679 - protein, 8 aa, Borrelia burgdorferi B31
IDSLKQQI

SEQ ID NO: 20680 - protein, 8 aa, Borrelia burgdorferi B31
DSLKQQIK

SEQ ID NO: 20681 - protein, 8 aa, Borrelia burgdorferi B31
SLKQQIKL

SEQ ID NO: 20682 - protein, 8 aa, Borrelia burgdorferi B31
LKQQIKLL

SEQ ID NO: 20683 - protein, 8 aa, Borrelia burgdorferi B31
KQQIKLLE

SEQ ID NO: 20684 - protein, 8 aa, Borrelia burgdorferi B31
QQIKLLEN

SEQ ID NO: 20685 - protein, 8 aa, Borrelia burgdorferi B31
QIKLLENI

SEQ ID NO: 20686 - protein, 8 aa, Borrelia burgdorferi B31
IKLLENIE

SEQ ID NO: 20687 - protein, 8 aa, Borrelia burgdorferi B31
KLLENIEN

SEQ ID NO: 20688 - protein, 8 aa, Borrelia burgdorferi B31
LLENIENE

SEQ ID NO: 20689 - protein, 8 aa, Borrelia burgdorferi B31
LENIENEK

SEQ ID NO: 20690 - protein, 8 aa, Borrelia burgdorferi B31
ENIENEKE

SEQ ID NO: 20691 - protein, 8 aa, Borrelia burgdorferi B31
NIENEKEK

SEQ ID NO: 20692 - protein, 8 aa, Borrelia burgdorferi B31
IENEKEKG

SEQ ID NO: 20693 - protein, 8 aa, Borrelia burgdorferi B31
ENEKEKGE

SEQ ID NO: 20694 - protein, 8 aa, Borrelia burgdorferi B31
NEKEKGEL

SEQ ID NO: 20695 - protein, 8 aa, Borrelia burgdorferi B31
EKEKGELI

SEQ ID NO: 20696 - protein, 8 aa, Borrelia burgdorferi B31
KEKGELIL

SEQ ID NO: 20697 - protein, 8 aa, Borrelia burgdorferi B31
EKGELILL

SEQ ID NO: 20698 - protein, 8 aa, Borrelia burgdorferi B31
KGELILLN

SEQ ID NO: 20699 - protein, 8 aa, Borrelia burgdorferi B31
GELILLNI

SEQ ID NO: 20700 - protein, 8 aa, Borrelia burgdorferi B31
ELILLNIN

SEQ ID NO: 20701 - protein, 8 aa, Borrelia burgdorferi B31
LILLNINK

SEQ ID NO: 20702 - protein, 8 aa, Borrelia burgdorferi B31
ILLNINKI

SEQ ID NO: 20703 - protein, 8 aa, Borrelia burgdorferi B31
LLNINKIQ

SEQ ID NO: 20704 - protein, 8 aa, Borrelia burgdorferi B31
LNINKIQK

SEQ ID NO: 20705 - protein, 8 aa, Borrelia burgdorferi B31
NINKIQKG

SEQ ID NO: 20706 - protein, 8 aa, Borrelia burgdorferi B31
INKIQKGI

SEQ ID NO: 20707 - protein, 8 aa, Borrelia burgdorferi B31
NKIQKGIK

SEQ ID NO: 20708 - protein, 8 aa, Borrelia burgdorferi B31
KIQKGIKE

SEQ ID NO: 20709 - protein, 8 aa, Borrelia burgdorferi B31
IQKGIKEI

SEQ ID NO: 20710 - protein, 8 aa, Borrelia burgdorferi B31
QKGIKEIN

SEQ ID NO: 20711 - protein, 8 aa, Borrelia burgdorferi B31
KGIKEINL

SEQ ID NO: 20712 - protein, 8 aa, Borrelia burgdorferi B31
GIKEINLL

SEQ ID NO: 20713 - protein, 8 aa, Borrelia burgdorferi B31
IKEINLLN

SEQ ID NO: 20714 - protein, 8 aa, Borrelia burgdorferi B31
KEINLLNY

SEQ ID NO: 20715 - protein, 8 aa, Borrelia burgdorferi B31
EINLLNYK

SEQ ID NO: 20716 - protein, 8 aa, Borrelia burgdorferi B31
INLLNYKE

SEQ ID NO: 20717 - protein, 8 aa, Borrelia burgdorferi B31
NLLNYKEE

SEQ ID NO: 20718 - protein, 8 aa, Borrelia burgdorferi B31
LLNYKEEK

SEQ ID NO: 20719 - protein, 8 aa, Borrelia burgdorferi B31
LNYKEEKI

SEQ ID NO: 20720 - protein, 8 aa, Borrelia burgdorferi B31
NYKEEKIK

SEQ ID NO: 20721 - protein, 8 aa, Borrelia burgdorferi B31
YKEEKIKI

SEQ ID NO: 20722 - protein, 8 aa, Borrelia burgdorferi B31
KEEKIKIS

SEQ ID NO: 20723 - protein, 8 aa, Borrelia burgdorferi B31
EEKIKISL

SEQ ID NO: 20724 - protein, 8 aa, Borrelia burgdorferi B31
EKIKISLN

SEQ ID NO: 20725 - protein, 8 aa, Borrelia burgdorferi B31
KIKISLNQ

SEQ ID NO: 20726 - protein, 8 aa, Borrelia burgdorferi B31
IKISLNQS

SEQ ID NO: 20727 - protein, 8 aa, Borrelia burgdorferi B31
KISLNQSL

SEQ ID NO: 20728 - protein, 8 aa, Borrelia burgdorferi B31
ISLNQSLS

SEQ ID NO: 20729 - protein, 8 aa, Borrelia burgdorferi B31
SLNQSLSP

SEQ ID NO: 20730 - protein, 8 aa, Borrelia burgdorferi B31
LNQSLSPK

SEQ ID NO: 20731 - protein, 8 aa, Borrelia burgdorferi B31
NQSLSPKE

SEQ ID NO: 20732 - protein, 8 aa, Borrelia burgdorferi B31
QSLSPKEN

SEQ ID NO: 20733 - protein, 8 aa, Borrelia burgdorferi B31
SLSPKENA

SEQ ID NO: 20734 - protein, 8 aa, Borrelia burgdorferi B31
LSPKENAL

SEQ ID NO: 20735 - protein, 8 aa, Borrelia burgdorferi B31
SPKENALQ

SEQ ID NO: 20736 - protein, 8 aa, Borrelia burgdorferi B31
PKENALQY

SEQ ID NO: 20737 - protein, 8 aa, Borrelia burgdorferi B31
KENALQYF

SEQ ID NO: 20738 - protein, 8 aa, Borrelia burgdorferi B31
ENALQYFK

SEQ ID NO: 20739 - protein, 8 aa, Borrelia burgdorferi B31
NALQYFKA

SEQ ID NO: 20740 - protein, 8 aa, Borrelia burgdorferi B31
ALQYFKAY

SEQ ID NO: 20741 - protein, 8 aa, Borrelia burgdorferi B31
LQYFKAYK

SEQ ID NO: 20742 - protein, 8 aa, Borrelia burgdorferi B31
QYFKAYKK

SEQ ID NO: 20743 - protein, 8 aa, Borrelia burgdorferi B31
YFKAYKKG

SEQ ID NO: 20744 - protein, 8 aa, Borrelia burgdorferi B31
FKAYKKGK

SEQ ID NO: 20745 - protein, 8 aa, Borrelia burgdorferi B31
KAYKKGKN

SEQ ID NO: 20746 - protein, 8 aa, Borrelia burgdorferi B31
AYKKGKNS

SEQ ID NO: 20747 - protein, 8 aa, Borrelia burgdorferi B31
YKKGKNSF

SEQ ID NO: 20748 - protein, 8 aa, Borrelia burgdorferi B31
KKGKNSFK

SEQ ID NO: 20749 - protein, 8 aa, Borrelia burgdorferi B31
KGKNSFKT

SEQ ID NO: 20750 - protein, 8 aa, Borrelia burgdorferi B31
GKNSFKTI

SEQ ID NO: 20751 - protein, 8 aa, Borrelia burgdorferi B31
KNSFKTIQ

SEQ ID NO: 20752 - protein, 8 aa, Borrelia burgdorferi B31
NSFKTIQN

SEQ ID NO: 20753 - protein, 8 aa, Borrelia burgdorferi B31
SFKTIQNQ

SEQ ID NO: 20754 - protein, 8 aa, Borrelia burgdorferi B31
FKTIQNQL

SEQ ID NO: 20755 - protein, 8 aa, Borrelia burgdorferi B31
KTIQNQLK

SEQ ID NO: 20756 - protein, 8 aa, Borrelia burgdorferi B31
TIQNQLKD

SEQ ID NO: 20757 - protein, 8 aa, Borrelia burgdorferi B31
IQNQLKDN

SEQ ID NO: 20758 - protein, 8 aa, Borrelia burgdorferi B31
QNQLKDNL

SEQ ID NO: 20759 - protein, 8 aa, Borrelia burgdorferi B31
NQLKDNLD

SEQ ID NO: 20760 - protein, 8 aa, Borrelia burgdorferi B31
QLKDNLDK

SEQ ID NO: 20761 - protein, 8 aa, Borrelia burgdorferi B31
LKDNLDKF

SEQ ID NO: 20762 - protein, 8 aa, Borrelia burgdorferi B31
KDNLDKFN

SEQ ID NO: 20763 - protein, 8 aa, Borrelia burgdorferi B31
DNLDKFNL

SEQ ID NO: 20764 - protein, 8 aa, Borrelia burgdorferi B31
NLDKFNLI

SEQ ID NO: 20765 - protein, 8 aa, Borrelia burgdorferi B31
LDKFNLIQ

SEQ ID NO: 20766 - protein, 8 aa, Borrelia burgdorferi B31
DKFNLIQS

SEQ ID NO: 20767 - protein, 8 aa, Borrelia burgdorferi B31
KFNLIQSK

SEQ ID NO: 20768 - protein, 8 aa, Borrelia burgdorferi B31
FNLIQSKI

SEQ ID NO: 20769 - protein, 8 aa, Borrelia burgdorferi B31
NLIQSKIT

SEQ ID NO: 20770 - protein, 8 aa, Borrelia burgdorferi B31
LIQSKITM

SEQ ID NO: 20771 - protein, 8 aa, Borrelia burgdorferi B31
IQSKITML

SEQ ID NO: 20772 - protein, 8 aa, Borrelia burgdorferi B31
QSKITMLK

SEQ ID NO: 20773 - protein, 8 aa, Borrelia burgdorferi B31
SKITMLKV

SEQ ID NO: 20774 - protein, 8 aa, Borrelia burgdorferi B31
KITMLKVE

SEQ ID NO: 20775 - protein, 8 aa, Borrelia burgdorferi B31
ITMLKVEN

SEQ ID NO: 20776 - protein, 8 aa, Borrelia burgdorferi B31
TMLKVENL

SEQ ID NO: 20777 - protein, 8 aa, Borrelia burgdorferi B31
MLKVENLI

SEQ ID NO: 20778 - protein, 8 aa, Borrelia burgdorferi B31
LKVENLIP

SEQ ID NO: 20779 - protein, 8 aa, Borrelia burgdorferi B31
KVENLIPE

SEQ ID NO: 20780 - protein, 8 aa, Borrelia burgdorferi B31
VENLIPEE

SEQ ID NO: 20781 - protein, 8 aa, Borrelia burgdorferi B31
ENLIPEEE

SEQ ID NO: 20782 - protein, 8 aa, Borrelia burgdorferi B31
NLIPEEEY

SEQ ID NO: 20783 - protein, 8 aa, Borrelia burgdorferi B31
LIPEEEYN

SEQ ID NO: 20784 - protein, 8 aa, Borrelia burgdorferi B31
IPEEEYNQ

SEQ ID NO: 20785 - protein, 8 aa, Borrelia burgdorferi B31
PEEEYNQE

SEQ ID NO: 20786 - protein, 8 aa, Borrelia burgdorferi B31
EEEYNQEK

SEQ ID NO: 20787 - protein, 8 aa, Borrelia burgdorferi B31
EEYNQEKT

SEQ ID NO: 20788 - protein, 8 aa, Borrelia burgdorferi B31
EYNQEKTA

SEQ ID NO: 20789 - protein, 8 aa, Borrelia burgdorferi B31
YNQEKTAI

SEQ ID NO: 20790 - protein, 8 aa, Borrelia burgdorferi B31
NQEKTAIK

SEQ ID NO: 20791 - protein, 8 aa, Borrelia burgdorferi B31
QEKTAIKE

SEQ ID NO: 20792 - protein, 8 aa, Borrelia burgdorferi B31
EKTAIKEK

SEQ ID NO: 20793 - protein, 8 aa, Borrelia burgdorferi B31
KTAIKEKE

SEQ ID NO: 20794 - protein, 8 aa, Borrelia burgdorferi B31
TAIKEKEK

SEQ ID NO: 20795 - protein, 8 aa, Borrelia burgdorferi B31
AIKEKEKT

SEQ ID NO: 20796 - protein, 8 aa, Borrelia burgdorferi B31
IKEKEKTP

SEQ ID NO: 20797 - protein, 8 aa, Borrelia burgdorferi B31
KEKEKTPK

SEQ ID NO: 20798 - protein, 8 aa, Borrelia burgdorferi B31
EKEKTPKI

SEQ ID NO: 20799 - protein, 8 aa, Borrelia burgdorferi B31
KEKTPKIG

SEQ ID NO: 20800 - protein, 8 aa, Borrelia burgdorferi B31
EKTPKIGL

SEQ ID NO: 20801 - protein, 8 aa, Borrelia burgdorferi B31
KTPKIGLH

SEQ ID NO: 20802 - protein, 8 aa, Borrelia burgdorferi B31
TPKIGLHF

SEQ ID NO: 20803 - protein, 8 aa, Borrelia burgdorferi B31
PKIGLHFT

SEQ ID NO: 20804 - protein, 8 aa, Borrelia burgdorferi B31
KIGLHFTY

SEQ ID NO: 20805 - protein, 8 aa, Borrelia burgdorferi B31
IGLHFTYC

SEQ ID NO: 20806 - protein, 8 aa, Borrelia burgdorferi B31
GLHFTYCG

SEQ ID NO: 20807 - protein, 8 aa, Borrelia burgdorferi B31
LHFTYCGF

SEQ ID NO: 20808 - protein, 8 aa, Borrelia burgdorferi B31
HFTYCGFE

SEQ ID NO: 20809 - protein, 8 aa, Borrelia burgdorferi B31
FTYCGFEI

SEQ ID NO: 20810 - protein, 8 aa, Borrelia burgdorferi B31
TYCGFEIL

SEQ ID NO: 20811 - protein, 8 aa, Borrelia burgdorferi B31
YCGFEILI

SEQ ID NO: 20812 - protein, 8 aa, Borrelia burgdorferi B31
CGFEILIG

SEQ ID NO: 20813 - protein, 8 aa, Borrelia burgdorferi B31
GFEILIGR

SEQ ID NO: 20814 - protein, 8 aa, Borrelia burgdorferi B31
FEILIGRN

SEQ ID NO: 20815 - protein, 8 aa, Borrelia burgdorferi B31
EILIGRNA

SEQ ID NO: 20816 - protein, 8 aa, Borrelia burgdorferi B31
ILIGRNAK

SEQ ID NO: 20817 - protein, 8 aa, Borrelia burgdorferi B31
LIGRNAKE

SEQ ID NO: 20818 - protein, 8 aa, Borrelia burgdorferi B31
IGRNAKEN

SEQ ID NO: 20819 - protein, 8 aa, Borrelia burgdorferi B31
GRNAKEND

SEQ ID NO: 20820 - protein, 8 aa, Borrelia burgdorferi B31
RNAKENDK

SEQ ID NO: 20821 - protein, 8 aa, Borrelia burgdorferi B31
NAKENDKL

SEQ ID NO: 20822 - protein, 8 aa, Borrelia burgdorferi B31
AKENDKLL

SEQ ID NO: 20823 - protein, 8 aa, Borrelia burgdorferi B31
KENDKLLR

SEQ ID NO: 20824 - protein, 8 aa, Borrelia burgdorferi B31
ENDKLLRH

SEQ ID NO: 20825 - protein, 8 aa, Borrelia burgdorferi B31
NDKLLRHC

SEQ ID NO: 20826 - protein, 8 aa, Borrelia burgdorferi B31
DKLLRHCV

SEQ ID NO: 20827 - protein, 8 aa, Borrelia burgdorferi B31
KLLRHCVK

SEQ ID NO: 20828 - protein, 8 aa, Borrelia burgdorferi B31
LLRHCVKG

SEQ ID NO: 20829 - protein, 8 aa, Borrelia burgdorferi B31
LRHCVKGN

SEQ ID NO: 20830 - protein, 8 aa, Borrelia burgdorferi B31
RHCVKGND

SEQ ID NO: 20831 - protein, 8 aa, Borrelia burgdorferi B31
HCVKGNDY

SEQ ID NO: 20832 - protein, 8 aa, Borrelia burgdorferi B31
CVKGNDYW

SEQ ID NO: 20833 - protein, 8 aa, Borrelia burgdorferi B31
VKGNDYWL

SEQ ID NO: 20834 - protein, 8 aa, Borrelia burgdorferi B31
KGNDYWLH

SEQ ID NO: 20835 - protein, 8 aa, Borrelia burgdorferi B31
GNDYWLHT

SEQ ID NO: 20836 - protein, 8 aa, Borrelia burgdorferi B31
NDYWLHTR

SEQ ID NO: 20837 - protein, 8 aa, Borrelia burgdorferi B31
DYWLHTRD

SEQ ID NO: 20838 - protein, 8 aa, Borrelia burgdorferi B31
YWLHTRDY

SEQ ID NO: 20839 - protein, 8 aa, Borrelia burgdorferi B31
WLHTRDYP

SEQ ID NO: 20840 - protein, 8 aa, Borrelia burgdorferi B31
LHTRDYPG

SEQ ID NO: 20841 - protein, 8 aa, Borrelia burgdorferi B31
HTRDYPGA

SEQ ID NO: 20842 - protein, 8 aa, Borrelia burgdorferi B31
TRDYPGAY

SEQ ID NO: 20843 - protein, 8 aa, Borrelia burgdorferi B31
RDYPGAYV

SEQ ID NO: 20844 - protein, 8 aa, Borrelia burgdorferi B31
DYPGAYVF

SEQ ID NO: 20845 - protein, 8 aa, Borrelia burgdorferi B31
YPGAYVFI

SEQ ID NO: 20846 - protein, 8 aa, Borrelia burgdorferi B31
PGAYVFIK

SEQ ID NO: 20847 - protein, 8 aa, Borrelia burgdorferi B31
GAYVFIKN

SEQ ID NO: 20848 - protein, 8 aa, Borrelia burgdorferi B31
AYVFIKNQ

SEQ ID NO: 20849 - protein, 8 aa, Borrelia burgdorferi B31
YVFIKNQK

SEQ ID NO: 20850 - protein, 8 aa, Borrelia burgdorferi B31
VFIKNQKN

SEQ ID NO: 20851 - protein, 8 aa, Borrelia burgdorferi B31
FIKNQKNK

SEQ ID NO: 20852 - protein, 8 aa, Borrelia burgdorferi B31
IKNQKNKT

SEQ ID NO: 20853 - protein, 8 aa, Borrelia burgdorferi B31
KNQKNKTP

SEQ ID NO: 20854 - protein, 8 aa, Borrelia burgdorferi B31
NQKNKTPS

SEQ ID NO: 20855 - protein, 8 aa, Borrelia burgdorferi B31
QKNKTPSL

SEQ ID NO: 20856 - protein, 8 aa, Borrelia burgdorferi B31
KNKTPSLD

SEQ ID NO: 20857 - protein, 8 aa, Borrelia burgdorferi B31
NKTPSLDV

SEQ ID NO: 20858 - protein, 8 aa, Borrelia burgdorferi B31
KTPSLDVL

SEQ ID NO: 20859 - protein, 8 aa, Borrelia burgdorferi B31
TPSLDVLL

SEQ ID NO: 20860 - protein, 8 aa, Borrelia burgdorferi B31
PSLDVLLG

SEQ ID NO: 20861 - protein, 8 aa, Borrelia burgdorferi B31
SLDVLLGA

SEQ ID NO: 20862 - protein, 8 aa, Borrelia burgdorferi B31
LDVLLGAG

SEQ ID NO: 20863 - protein, 8 aa, Borrelia burgdorferi B31
DVLLGAGN

SEQ ID NO: 20864 - protein, 8 aa, Borrelia burgdorferi B31
VLLGAGNL

SEQ ID NO: 20865 - protein, 8 aa, Borrelia burgdorferi B31
LLGAGNLC

SEQ ID NO: 20866 - protein, 8 aa, Borrelia burgdorferi B31
LGAGNLCV

SEQ ID NO: 20867 - protein, 8 aa, Borrelia burgdorferi B31
GAGNLCVF

SEQ ID NO: 20868 - protein, 8 aa, Borrelia burgdorferi B31
AGNLCVFY

SEQ ID NO: 20869 - protein, 8 aa, Borrelia burgdorferi B31
GNLCVFYT

SEQ ID NO: 20870 - protein, 8 aa, Borrelia burgdorferi B31
NLCVFYTK

SEQ ID NO: 20871 - protein, 8 aa, Borrelia burgdorferi B31
LCVFYTKL

SEQ ID NO: 20872 - protein, 8 aa, Borrelia burgdorferi B31
CVFYTKLA

SEQ ID NO: 20873 - protein, 8 aa, Borrelia burgdorferi B31
VFYTKLAK

SEQ ID NO: 20874 - protein, 8 aa, Borrelia burgdorferi B31
FYTKLAKK

SEQ ID NO: 20875 - protein, 8 aa, Borrelia burgdorferi B31
YTKLAKKS

SEQ ID NO: 20876 - protein, 8 aa, Borrelia burgdorferi B31
TKLAKKSG

SEQ ID NO: 20877 - protein, 8 aa, Borrelia burgdorferi B31
KLAKKSGK

SEQ ID NO: 20878 - protein, 8 aa, Borrelia burgdorferi B31
LAKKSGKA

SEQ ID NO: 20879 - protein, 8 aa, Borrelia burgdorferi B31
AKKSGKAD

SEQ ID NO: 20880 - protein, 8 aa, Borrelia burgdorferi B31
KKSGKADL

SEQ ID NO: 20881 - protein, 8 aa, Borrelia burgdorferi B31
KSGKADLY

SEQ ID NO: 20882 - protein, 8 aa, Borrelia burgdorferi B31
SGKADLYY

SEQ ID NO: 20883 - protein, 8 aa, Borrelia burgdorferi B31
GKADLYYT

SEQ ID NO: 20884 - protein, 8 aa, Borrelia burgdorferi B31
KADLYYTQ

SEQ ID NO: 20885 - protein, 8 aa, Borrelia burgdorferi B31
ADLYYTQV

SEQ ID NO: 20886 - protein, 8 aa, Borrelia burgdorferi B31
DLYYTQVK

SEQ ID NO: 20887 - protein, 8 aa, Borrelia burgdorferi B31
LYYTQVKN

SEQ ID NO: 20888 - protein, 8 aa, Borrelia burgdorferi B31
YYTQVKNL

SEQ ID NO: 20889 - protein, 8 aa, Borrelia burgdorferi B31
YTQVKNLR

SEQ ID NO: 20890 - protein, 8 aa, Borrelia burgdorferi B31
TQVKNLRR

SEQ ID NO: 20891 - protein, 8 aa, Borrelia burgdorferi B31
QVKNLRRV

SEQ ID NO: 20892 - protein, 8 aa, Borrelia burgdorferi B31
VKNLRRVK

SEQ ID NO: 20893 - protein, 8 aa, Borrelia burgdorferi B31
KNLRRVKN

SEQ ID NO: 20894 - protein, 8 aa, Borrelia burgdorferi B31
NLRRVKNK

SEQ ID NO: 20895 - protein, 8 aa, Borrelia burgdorferi B31
LRRVKNKK

SEQ ID NO: 20896 - protein, 8 aa, Borrelia burgdorferi B31
RRVKNKKL

SEQ ID NO: 20897 - protein, 8 aa, Borrelia burgdorferi B31
RVKNKKLG

SEQ ID NO: 20898 - protein, 8 aa, Borrelia burgdorferi B31
VKNKKLGL

SEQ ID NO: 20899 - protein, 8 aa, Borrelia burgdorferi B31
KNKKLGLV

SEQ ID NO: 20900 - protein, 8 aa, Borrelia burgdorferi B31
NKKLGLVI

SEQ ID NO: 20901 - protein, 8 aa, Borrelia burgdorferi B31
KKLGLVIP

SEQ ID NO: 20902 - protein, 8 aa, Borrelia burgdorferi B31
KLGLVIPK

SEQ ID NO: 20903 - protein, 8 aa, Borrelia burgdorferi B31
LGLVIPKA

SEQ ID NO: 20904 - protein, 8 aa, Borrelia burgdorferi B31
GLVIPKAE

SEQ ID NO: 20905 - protein, 8 aa, Borrelia burgdorferi B31
LVIPKAEK

SEQ ID NO: 20906 - protein, 8 aa, Borrelia burgdorferi B31
VIPKAEKN

SEQ ID NO: 20907 - protein, 8 aa, Borrelia burgdorferi B31
IPKAEKNL

SEQ ID NO: 20908 - protein, 8 aa, Borrelia burgdorferi B31
PKAEKNLH

SEQ ID NO: 20909 - protein, 8 aa, Borrelia burgdorferi B31
KAEKNLHI

SEQ ID NO: 20910 - protein, 8 aa, Borrelia burgdorferi B31
AEKNLHIK

SEQ ID NO: 20911 - protein, 8 aa, Borrelia burgdorferi B31
EKNLHIKL

SEQ ID NO: 20912 - protein, 8 aa, Borrelia burgdorferi B31
KNLHIKLD

SEQ ID NO: 20913 - protein, 8 aa, Borrelia burgdorferi B31
NLHIKLDE

SEQ ID NO: 20914 - protein, 8 aa, Borrelia burgdorferi B31
LHIKLDEN

SEQ ID NO: 20915 - protein, 8 aa, Borrelia burgdorferi B31
HIKLDENL

SEQ ID NO: 20916 - protein, 8 aa, Borrelia burgdorferi B31
IKLDENLI

SEQ ID NO: 20917 - protein, 8 aa, Borrelia burgdorferi B31
KLDENLIK

SEQ ID NO: 20918 - protein, 8 aa, Borrelia burgdorferi B31
LDENLIKK

SEQ ID NO: 20919 - protein, 8 aa, Borrelia burgdorferi B31
DENLIKKI

SEQ ID NO: 20920 - protein, 8 aa, Borrelia burgdorferi B31
ENLIKKIK

SEQ ID NO: 20921 - protein, 8 aa, Borrelia burgdorferi B31
NLIKKIKN

SEQ ID NO: 20922 - protein, 8 aa, Borrelia burgdorferi B31
LIKKIKNQ

SEQ ID NO: 20923 - protein, 8 aa, Borrelia burgdorferi B31
IKKIKNQT

SEQ ID NO: 20924 - protein, 9 aa, Borrelia burgdorferi B31
MIKMSLNYT

SEQ ID NO: 20925 - protein, 9 aa, Borrelia burgdorferi B31
IKMSLNYTE

SEQ ID NO: 20926 - protein, 9 aa, Borrelia burgdorferi B31
KMSLNYTEI

SEQ ID NO: 20927 - protein, 9 aa, Borrelia burgdorferi B31
MSLNYTEIN

SEQ ID NO: 20928 - protein, 9 aa, Borrelia burgdorferi B31
SLNYTEINT

SEQ ID NO: 20929 - protein, 9 aa, Borrelia burgdorferi B31
LNYTEINTL

SEQ ID NO: 20930 - protein, 9 aa, Borrelia burgdorferi B31
NYTEINTLI

SEQ ID NO: 20931 - protein, 9 aa, Borrelia burgdorferi B31
YTEINTLIK

SEQ ID NO: 20932 - protein, 9 aa, Borrelia burgdorferi B31
TEINTLIKE

SEQ ID NO: 20933 - protein, 9 aa, Borrelia burgdorferi B31
EINTLIKEI

SEQ ID NO: 20934 - protein, 9 aa, Borrelia burgdorferi B31
INTLIKEIP

SEQ ID NO: 20935 - protein, 9 aa, Borrelia burgdorferi B31
NTLIKEIPF

SEQ ID NO: 20936 - protein, 9 aa, Borrelia burgdorferi B31
TLIKEIPFT

SEQ ID NO: 20937 - protein, 9 aa, Borrelia burgdorferi B31
LIKEIPFTN

SEQ ID NO: 20938 - protein, 9 aa, Borrelia burgdorferi B31
IKEIPFTNS

SEQ ID NO: 20939 - protein, 9 aa, Borrelia burgdorferi B31
KEIPFTNSL

SEQ ID NO: 20940 - protein, 9 aa, Borrelia burgdorferi B31
EIPFTNSLI

SEQ ID NO: 20941 - protein, 9 aa, Borrelia burgdorferi B31
IPFTNSLIT

SEQ ID NO: 20942 - protein, 9 aa, Borrelia burgdorferi B31
PFTNSLITK

SEQ ID NO: 20943 - protein, 9 aa, Borrelia burgdorferi B31
FTNSLITKI

SEQ ID NO: 20944 - protein, 9 aa, Borrelia burgdorferi B31
TNSLITKII

SEQ ID NO: 20945 - protein, 9 aa, Borrelia burgdorferi B31
NSLITKIIQ

SEQ ID NO: 20946 - protein, 9 aa, Borrelia burgdorferi B31
SLITKIIQP

SEQ ID NO: 20947 - protein, 9 aa, Borrelia burgdorferi B31
LITKIIQPD

SEQ ID NO: 20948 - protein, 9 aa, Borrelia burgdorferi B31
ITKIIQPDY

SEQ ID NO: 20949 - protein, 9 aa, Borrelia burgdorferi B31
TKIIQPDYK

SEQ ID NO: 20950 - protein, 9 aa, Borrelia burgdorferi B31
KIIQPDYKS

SEQ ID NO: 20951 - protein, 9 aa, Borrelia burgdorferi B31
IIQPDYKSL

SEQ ID NO: 20952 - protein, 9 aa, Borrelia burgdorferi B31
IQPDYKSLV

SEQ ID NO: 20953 - protein, 9 aa, Borrelia burgdorferi B31
QPDYKSLVL

SEQ ID NO: 20954 - protein, 9 aa, Borrelia burgdorferi B31
PDYKSLVLE

SEQ ID NO: 20955 - protein, 9 aa, Borrelia burgdorferi B31
DYKSLVLEI

SEQ ID NO: 20956 - protein, 9 aa, Borrelia burgdorferi B31
YKSLVLEIY

SEQ ID NO: 20957 - protein, 9 aa, Borrelia burgdorferi B31
KSLVLEIYN

SEQ ID NO: 20958 - protein, 9 aa, Borrelia burgdorferi B31
SLVLEIYNK

SEQ ID NO: 20959 - protein, 9 aa, Borrelia burgdorferi B31
LVLEIYNKI

SEQ ID NO: 20960 - protein, 9 aa, Borrelia burgdorferi B31
VLEIYNKID

SEQ ID NO: 20961 - protein, 9 aa, Borrelia burgdorferi B31
LEIYNKIDN

SEQ ID NO: 20962 - protein, 9 aa, Borrelia burgdorferi B31
EIYNKIDNK

SEQ ID NO: 20963 - protein, 9 aa, Borrelia burgdorferi B31
IYNKIDNKK

SEQ ID NO: 20964 - protein, 9 aa, Borrelia burgdorferi B31
YNKIDNKKF

SEQ ID NO: 20965 - protein, 9 aa, Borrelia burgdorferi B31
NKIDNKKFK

SEQ ID NO: 20966 - protein, 9 aa, Borrelia burgdorferi B31
KIDNKKFKI

SEQ ID NO: 20967 - protein, 9 aa, Borrelia burgdorferi B31
IDNKKFKIL

SEQ ID NO: 20968 - protein, 9 aa, Borrelia burgdorferi B31
DNKKFKILI

SEQ ID NO: 20969 - protein, 9 aa, Borrelia burgdorferi B31
NKKFKILIC

SEQ ID NO: 20970 - protein, 9 aa, Borrelia burgdorferi B31
KKFKILICL

SEQ ID NO: 20971 - protein, 9 aa, Borrelia burgdorferi B31
KFKILICLN

SEQ ID NO: 20972 - protein, 9 aa, Borrelia burgdorferi B31
FKILICLNP

SEQ ID NO: 20973 - protein, 9 aa, Borrelia burgdorferi B31
KILICLNPN

SEQ ID NO: 20974 - protein, 9 aa, Borrelia burgdorferi B31
ILICLNPNT

SEQ ID NO: 20975 - protein, 9 aa, Borrelia burgdorferi B31
LICLNPNTT

SEQ ID NO: 20976 - protein, 9 aa, Borrelia burgdorferi B31
ICLNPNTTR

SEQ ID NO: 20977 - protein, 9 aa, Borrelia burgdorferi B31
CLNPNTTRF

SEQ ID NO: 20978 - protein, 9 aa, Borrelia burgdorferi B31
LNPNTTRFH

SEQ ID NO: 20979 - protein, 9 aa, Borrelia burgdorferi B31
NPNTTRFHI

SEQ ID NO: 20980 - protein, 9 aa, Borrelia burgdorferi B31
PNTTRFHIT

SEQ ID NO: 20981 - protein, 9 aa, Borrelia burgdorferi B31
NTTRFHITK

SEQ ID NO: 20982 - protein, 9 aa, Borrelia burgdorferi B31
TTRFHITKK

SEQ ID NO: 20983 - protein, 9 aa, Borrelia burgdorferi B31
TRFHITKKN

SEQ ID NO: 20984 - protein, 9 aa, Borrelia burgdorferi B31
RFHITKKNF

SEQ ID NO: 20985 - protein, 9 aa, Borrelia burgdorferi B31
FHITKKNFK

SEQ ID NO: 20986 - protein, 9 aa, Borrelia burgdorferi B31
HITKKNFKK

SEQ ID NO: 20987 - protein, 9 aa, Borrelia burgdorferi B31
ITKKNFKKN

SEQ ID NO: 20988 - protein, 9 aa, Borrelia burgdorferi B31
TKKNFKKNA

SEQ ID NO: 20989 - protein, 9 aa, Borrelia burgdorferi B31
KKNFKKNAL

SEQ ID NO: 20990 - protein, 9 aa, Borrelia burgdorferi B31
KNFKKNALK

SEQ ID NO: 20991 - protein, 9 aa, Borrelia burgdorferi B31
NFKKNALKL

SEQ ID NO: 20992 - protein, 9 aa, Borrelia burgdorferi B31
FKKNALKLR

SEQ ID NO: 20993 - protein, 9 aa, Borrelia burgdorferi B31
KKNALKLRF

SEQ ID NO: 20994 - protein, 9 aa, Borrelia burgdorferi B31
KNALKLRFS

SEQ ID NO: 20995 - protein, 9 aa, Borrelia burgdorferi B31
NALKLRFSD

SEQ ID NO: 20996 - protein, 9 aa, Borrelia burgdorferi B31
ALKLRFSDF

SEQ ID NO: 20997 - protein, 9 aa, Borrelia burgdorferi B31
LKLRFSDFL

SEQ ID NO: 20998 - protein, 9 aa, Borrelia burgdorferi B31
KLRFSDFLK

SEQ ID NO: 20999 - protein, 9 aa, Borrelia burgdorferi B31
LRFSDFLKS

SEQ ID NO: 21000 - protein, 9 aa, Borrelia burgdorferi B31
RFSDFLKSK

SEQ ID NO: 21001 - protein, 9 aa, Borrelia burgdorferi B31
FSDFLKSKI

SEQ ID NO: 21002 - protein, 9 aa, Borrelia burgdorferi B31
SDFLKSKIQ

SEQ ID NO: 21003 - protein, 9 aa, Borrelia burgdorferi B31
DFLKSKIQN

SEQ ID NO: 21004 - protein, 9 aa, Borrelia burgdorferi B31
FLKSKIQNG

SEQ ID NO: 21005 - protein, 9 aa, Borrelia burgdorferi B31
LKSKIQNGK

SEQ ID NO: 21006 - protein, 9 aa, Borrelia burgdorferi B31
KSKIQNGKI

SEQ ID NO: 21007 - protein, 9 aa, Borrelia burgdorferi B31
SKIQNGKII

SEQ ID NO: 21008 - protein, 9 aa, Borrelia burgdorferi B31
KIQNGKIIK

SEQ ID NO: 21009 - protein, 9 aa, Borrelia burgdorferi B31
IQNGKIIKA

SEQ ID NO: 21010 - protein, 9 aa, Borrelia burgdorferi B31
QNGKIIKAF

SEQ ID NO: 21011 - protein, 9 aa, Borrelia burgdorferi B31
NGKIIKAFQ

SEQ ID NO: 21012 - protein, 9 aa, Borrelia burgdorferi B31
GKIIKAFQM

SEQ ID NO: 21013 - protein, 9 aa, Borrelia burgdorferi B31
KIIKAFQMK

SEQ ID NO: 21014 - protein, 9 aa, Borrelia burgdorferi B31
IIKAFQMKN

SEQ ID NO: 21015 - protein, 9 aa, Borrelia burgdorferi B31
IKAFQMKNE

SEQ ID NO: 21016 - protein, 9 aa, Borrelia burgdorferi B31
KAFQMKNER

SEQ ID NO: 21017 - protein, 9 aa, Borrelia burgdorferi B31
AFQMKNERI

SEQ ID NO: 21018 - protein, 9 aa, Borrelia burgdorferi B31
FQMKNERII

SEQ ID NO: 21019 - protein, 9 aa, Borrelia burgdorferi B31
QMKNERIIS

SEQ ID NO: 21020 - protein, 9 aa, Borrelia burgdorferi B31
MKNERIISL

SEQ ID NO: 21021 - protein, 9 aa, Borrelia burgdorferi B31
KNERIISLE

SEQ ID NO: 21022 - protein, 9 aa, Borrelia burgdorferi B31
NERIISLEI

SEQ ID NO: 21023 - protein, 9 aa, Borrelia burgdorferi B31
ERIISLEIL

SEQ ID NO: 21024 - protein, 9 aa, Borrelia burgdorferi B31
RIISLEILQ

SEQ ID NO: 21025 - protein, 9 aa, Borrelia burgdorferi B31
IISLEILQK

SEQ ID NO: 21026 - protein, 9 aa, Borrelia burgdorferi B31
ISLEILQKD

SEQ ID NO: 21027 - protein, 9 aa, Borrelia burgdorferi B31
SLEILQKDM

SEQ ID NO: 21028 - protein, 9 aa, Borrelia burgdorferi B31
LEILQKDMI

SEQ ID NO: 21029 - protein, 9 aa, Borrelia burgdorferi B31
EILQKDMII

SEQ ID NO: 21030 - protein, 9 aa, Borrelia burgdorferi B31
ILQKDMIIL

SEQ ID NO: 21031 - protein, 9 aa, Borrelia burgdorferi B31
LQKDMIILF

SEQ ID NO: 21032 - protein, 9 aa, Borrelia burgdorferi B31
QKDMIILFI

SEQ ID NO: 21033 - protein, 9 aa, Borrelia burgdorferi B31
KDMIILFIK

SEQ ID NO: 21034 - protein, 9 aa, Borrelia burgdorferi B31
DMIILFIKL

SEQ ID NO: 21035 - protein, 9 aa, Borrelia burgdorferi B31
MIILFIKLW

SEQ ID NO: 21036 - protein, 9 aa, Borrelia burgdorferi B31
IILFIKLWP

SEQ ID NO: 21037 - protein, 9 aa, Borrelia burgdorferi B31
ILFIKLWPS

SEQ ID NO: 21038 - protein, 9 aa, Borrelia burgdorferi B31
LFIKLWPSS

SEQ ID NO: 21039 - protein, 9 aa, Borrelia burgdorferi B31
FIKLWPSSP

SEQ ID NO: 21040 - protein, 9 aa, Borrelia burgdorferi B31
IKLWPSSPN

SEQ ID NO: 21041 - protein, 9 aa, Borrelia burgdorferi B31
KLWPSSPNI

SEQ ID NO: 21042 - protein, 9 aa, Borrelia burgdorferi B31
LWPSSPNII

SEQ ID NO: 21043 - protein, 9 aa, Borrelia burgdorferi B31
WPSSPNIIA

SEQ ID NO: 21044 - protein, 9 aa, Borrelia burgdorferi B31
PSSPNIIAT

SEQ ID NO: 21045 - protein, 9 aa, Borrelia burgdorferi B31
SSPNIIATN

SEQ ID NO: 21046 - protein, 9 aa, Borrelia burgdorferi B31
SPNIIATNS

SEQ ID NO: 21047 - protein, 9 aa, Borrelia burgdorferi B31
PNIIATNSN

SEQ ID NO: 21048 - protein, 9 aa, Borrelia burgdorferi B31
NIIATNSNF

SEQ ID NO: 21049 - protein, 9 aa, Borrelia burgdorferi B31
IIATNSNFK

SEQ ID NO: 21050 - protein, 9 aa, Borrelia burgdorferi B31
IATNSNFKI

SEQ ID NO: 21051 - protein, 9 aa, Borrelia burgdorferi B31
ATNSNFKIL

SEQ ID NO: 21052 - protein, 9 aa, Borrelia burgdorferi B31
TNSNFKILD

SEQ ID NO: 21053 - protein, 9 aa, Borrelia burgdorferi B31
NSNFKILDA

SEQ ID NO: 21054 - protein, 9 aa, Borrelia burgdorferi B31
SNFKILDAY

SEQ ID NO: 21055 - protein, 9 aa, Borrelia burgdorferi B31
NFKILDAYY

SEQ ID NO: 21056 - protein, 9 aa, Borrelia burgdorferi B31
FKILDAYYR

SEQ ID NO: 21057 - protein, 9 aa, Borrelia burgdorferi B31
KILDAYYRR

SEQ ID NO: 21058 - protein, 9 aa, Borrelia burgdorferi B31
ILDAYYRRP

SEQ ID NO: 21059 - protein, 9 aa, Borrelia burgdorferi B31
LDAYYRRPK

SEQ ID NO: 21060 - protein, 9 aa, Borrelia burgdorferi B31
DAYYRRPKI

SEQ ID NO: 21061 - protein, 9 aa, Borrelia burgdorferi B31
AYYRRPKIK

SEQ ID NO: 21062 - protein, 9 aa, Borrelia burgdorferi B31
YYRRPKIKE

SEQ ID NO: 21063 - protein, 9 aa, Borrelia burgdorferi B31
YRRPKIKET

SEQ ID NO: 21064 - protein, 9 aa, Borrelia burgdorferi B31
RRPKIKETT

SEQ ID NO: 21065 - protein, 9 aa, Borrelia burgdorferi B31
RPKIKETTG

SEQ ID NO: 21066 - protein, 9 aa, Borrelia burgdorferi B31
PKIKETTGE

SEQ ID NO: 21067 - protein, 9 aa, Borrelia burgdorferi B31
KIKETTGEI

SEQ ID NO: 21068 - protein, 9 aa, Borrelia burgdorferi B31
IKETTGEIF

SEQ ID NO: 21069 - protein, 9 aa, Borrelia burgdorferi B31
KETTGEIFL

SEQ ID NO: 21070 - protein, 9 aa, Borrelia burgdorferi B31
ETTGEIFLK

SEQ ID NO: 21071 - protein, 9 aa, Borrelia burgdorferi B31
TTGEIFLKA

SEQ ID NO: 21072 - protein, 9 aa, Borrelia burgdorferi B31
TGEIFLKAK

SEQ ID NO: 21073 - protein, 9 aa, Borrelia burgdorferi B31
GEIFLKAKE

SEQ ID NO: 21074 - protein, 9 aa, Borrelia burgdorferi B31
EIFLKAKEI

SEQ ID NO: 21075 - protein, 9 aa, Borrelia burgdorferi B31
IFLKAKEIH

SEQ ID NO: 21076 - protein, 9 aa, Borrelia burgdorferi B31
FLKAKEIHE

SEQ ID NO: 21077 - protein, 9 aa, Borrelia burgdorferi B31
LKAKEIHES

SEQ ID NO: 21078 - protein, 9 aa, Borrelia burgdorferi B31
KAKEIHESN

SEQ ID NO: 21079 - protein, 9 aa, Borrelia burgdorferi B31
AKEIHESNK

SEQ ID NO: 21080 - protein, 9 aa, Borrelia burgdorferi B31
KEIHESNKM

SEQ ID NO: 21081 - protein, 9 aa, Borrelia burgdorferi B31
EIHESNKMS

SEQ ID NO: 21082 - protein, 9 aa, Borrelia burgdorferi B31
IHESNKMSD

SEQ ID NO: 21083 - protein, 9 aa, Borrelia burgdorferi B31
HESNKMSDK

SEQ ID NO: 21084 - protein, 9 aa, Borrelia burgdorferi B31
ESNKMSDKK

SEQ ID NO: 21085 - protein, 9 aa, Borrelia burgdorferi B31
SNKMSDKKI

SEQ ID NO: 21086 - protein, 9 aa, Borrelia burgdorferi B31
NKMSDKKIM

SEQ ID NO: 21087 - protein, 9 aa, Borrelia burgdorferi B31
KMSDKKIME

SEQ ID NO: 21088 - protein, 9 aa, Borrelia burgdorferi B31
MSDKKIMEL

SEQ ID NO: 21089 - protein, 9 aa, Borrelia burgdorferi B31
SDKKIMELK

SEQ ID NO: 21090 - protein, 9 aa, Borrelia burgdorferi B31
DKKIMELKE

SEQ ID NO: 21091 - protein, 9 aa, Borrelia burgdorferi B31
KKIMELKEE

SEQ ID NO: 21092 - protein, 9 aa, Borrelia burgdorferi B31
KIMELKEEY

SEQ ID NO: 21093 - protein, 9 aa, Borrelia burgdorferi B31
IMELKEEYN

SEQ ID NO: 21094 - protein, 9 aa, Borrelia burgdorferi B31
MELKEEYNN

SEQ ID NO: 21095 - protein, 9 aa, Borrelia burgdorferi B31
ELKEEYNNT

SEQ ID NO: 21096 - protein, 9 aa, Borrelia burgdorferi B31
LKEEYNNTS

SEQ ID NO: 21097 - protein, 9 aa, Borrelia burgdorferi B31
KEEYNNTSY

SEQ ID NO: 21098 - protein, 9 aa, Borrelia burgdorferi B31
EEYNNTSYT

SEQ ID NO: 21099 - protein, 9 aa, Borrelia burgdorferi B31
EYNNTSYTS

SEQ ID NO: 21100 - protein, 9 aa, Borrelia burgdorferi B31
YNNTSYTSY

SEQ ID NO: 21101 - protein, 9 aa, Borrelia burgdorferi B31
NNTSYTSYS

SEQ ID NO: 21102 - protein, 9 aa, Borrelia burgdorferi B31
NTSYTSYSE

SEQ ID NO: 21103 - protein, 9 aa, Borrelia burgdorferi B31
TSYTSYSEF

SEQ ID NO: 21104 - protein, 9 aa, Borrelia burgdorferi B31
SYTSYSEFL

SEQ ID NO: 21105 - protein, 9 aa, Borrelia burgdorferi B31
YTSYSEFLE

SEQ ID NO: 21106 - protein, 9 aa, Borrelia burgdorferi B31
TSYSEFLEN

SEQ ID NO: 21107 - protein, 9 aa, Borrelia burgdorferi B31
SYSEFLENY

SEQ ID NO: 21108 - protein, 9 aa, Borrelia burgdorferi B31
YSEFLENYY

SEQ ID NO: 21109 - protein, 9 aa, Borrelia burgdorferi B31
SEFLENYYE

SEQ ID NO: 21110 - protein, 9 aa, Borrelia burgdorferi B31
EFLENYYES

SEQ ID NO: 21111 - protein, 9 aa, Borrelia burgdorferi B31
FLENYYESL

SEQ ID NO: 21112 - protein, 9 aa, Borrelia burgdorferi B31
LENYYESLN

SEQ ID NO: 21113 - protein, 9 aa, Borrelia burgdorferi B31
ENYYESLND

SEQ ID NO: 21114 - protein, 9 aa, Borrelia burgdorferi B31
NYYESLNDQ

SEQ ID NO: 21115 - protein, 9 aa, Borrelia burgdorferi B31
YYESLNDQI

SEQ ID NO: 21116 - protein, 9 aa, Borrelia burgdorferi B31
YESLNDQIK

SEQ ID NO: 21117 - protein, 9 aa, Borrelia burgdorferi B31
ESLNDQIKK

SEQ ID NO: 21118 - protein, 9 aa, Borrelia burgdorferi B31
SLNDQIKKT

SEQ ID NO: 21119 - protein, 9 aa, Borrelia burgdorferi B31
LNDQIKKTN

SEQ ID NO: 21120 - protein, 9 aa, Borrelia burgdorferi B31
NDQIKKTNI

SEQ ID NO: 21121 - protein, 9 aa, Borrelia burgdorferi B31
DQIKKTNIK

SEQ ID NO: 21122 - protein, 9 aa, Borrelia burgdorferi B31
QIKKTNIKE

SEQ ID NO: 21123 - protein, 9 aa, Borrelia burgdorferi B31
IKKTNIKEL

SEQ ID NO: 21124 - protein, 9 aa, Borrelia burgdorferi B31
KKTNIKELL

SEQ ID NO: 21125 - protein, 9 aa, Borrelia burgdorferi B31
KTNIKELLI

SEQ ID NO: 21126 - protein, 9 aa, Borrelia burgdorferi B31
TNIKELLIE

SEQ ID NO: 21127 - protein, 9 aa, Borrelia burgdorferi B31
NIKELLIEK

SEQ ID NO: 21128 - protein, 9 aa, Borrelia burgdorferi B31
IKELLIEKY

SEQ ID NO: 21129 - protein, 9 aa, Borrelia burgdorferi B31
KELLIEKYK

SEQ ID NO: 21130 - protein, 9 aa, Borrelia burgdorferi B31
ELLIEKYKK

SEQ ID NO: 21131 - protein, 9 aa, Borrelia burgdorferi B31
LLIEKYKKE

SEQ ID NO: 21132 - protein, 9 aa, Borrelia burgdorferi B31
LIEKYKKEL

SEQ ID NO: 21133 - protein, 9 aa, Borrelia burgdorferi B31
IEKYKKELI

SEQ ID NO: 21134 - protein, 9 aa, Borrelia burgdorferi B31
EKYKKELIV

SEQ ID NO: 21135 - protein, 9 aa, Borrelia burgdorferi B31
KYKKELIVL

SEQ ID NO: 21136 - protein, 9 aa, Borrelia burgdorferi B31
YKKELIVLE

SEQ ID NO: 21137 - protein, 9 aa, Borrelia burgdorferi B31
KKELIVLEK

SEQ ID NO: 21138 - protein, 9 aa, Borrelia burgdorferi B31
KELIVLEKR

SEQ ID NO: 21139 - protein, 9 aa, Borrelia burgdorferi B31
ELIVLEKRI

SEQ ID NO: 21140 - protein, 9 aa, Borrelia burgdorferi B31
LIVLEKRID

SEQ ID NO: 21141 - protein, 9 aa, Borrelia burgdorferi B31
IVLEKRIDS

SEQ ID NO: 21142 - protein, 9 aa, Borrelia burgdorferi B31
VLEKRIDSL

SEQ ID NO: 21143 - protein, 9 aa, Borrelia burgdorferi B31
LEKRIDSLK

SEQ ID NO: 21144 - protein, 9 aa, Borrelia burgdorferi B31
EKRIDSLKQ

SEQ ID NO: 21145 - protein, 9 aa, Borrelia burgdorferi B31
KRIDSLKQQ

SEQ ID NO: 21146 - protein, 9 aa, Borrelia burgdorferi B31
RIDSLKQQI

SEQ ID NO: 21147 - protein, 9 aa, Borrelia burgdorferi B31
IDSLKQQIK

SEQ ID NO: 21148 - protein, 9 aa, Borrelia burgdorferi B31
DSLKQQIKL

SEQ ID NO: 21149 - protein, 9 aa, Borrelia burgdorferi B31
SLKQQIKLL

SEQ ID NO: 21150 - protein, 9 aa, Borrelia burgdorferi B31
LKQQIKLLE

SEQ ID NO: 21151 - protein, 9 aa, Borrelia burgdorferi B31
KQQIKLLEN

SEQ ID NO: 21152 - protein, 9 aa, Borrelia burgdorferi B31
QQIKLLENI

SEQ ID NO: 21153 - protein, 9 aa, Borrelia burgdorferi B31
QIKLLENIE

SEQ ID NO: 21154 - protein, 9 aa, Borrelia burgdorferi B31
IKLLENIEN

SEQ ID NO: 21155 - protein, 9 aa, Borrelia burgdorferi B31
KLLENIENE

SEQ ID NO: 21156 - protein, 9 aa, Borrelia burgdorferi B31
LLENIENEK

SEQ ID NO: 21157 - protein, 9 aa, Borrelia burgdorferi B31
LENIENEKE

SEQ ID NO: 21158 - protein, 9 aa, Borrelia burgdorferi B31
ENIENEKEK

SEQ ID NO: 21159 - protein, 9 aa, Borrelia burgdorferi B31
NIENEKEKG

SEQ ID NO: 21160 - protein, 9 aa, Borrelia burgdorferi B31
IENEKEKGE

SEQ ID NO: 21161 - protein, 9 aa, Borrelia burgdorferi B31
ENEKEKGEL

SEQ ID NO: 21162 - protein, 9 aa, Borrelia burgdorferi B31
NEKEKGELI

SEQ ID NO: 21163 - protein, 9 aa, Borrelia burgdorferi B31
EKEKGELIL

SEQ ID NO: 21164 - protein, 9 aa, Borrelia burgdorferi B31
KEKGELILL

SEQ ID NO: 21165 - protein, 9 aa, Borrelia burgdorferi B31
EKGELILLN

SEQ ID NO: 21166 - protein, 9 aa, Borrelia burgdorferi B31
KGELILLNI

SEQ ID NO: 21167 - protein, 9 aa, Borrelia burgdorferi B31
GELILLNIN

SEQ ID NO: 21168 - protein, 9 aa, Borrelia burgdorferi B31
ELILLNINK

SEQ ID NO: 21169 - protein, 9 aa, Borrelia burgdorferi B31
LILLNINKI

SEQ ID NO: 21170 - protein, 9 aa, Borrelia burgdorferi B31
ILLNINKIQ

SEQ ID NO: 21171 - protein, 9 aa, Borrelia burgdorferi B31
LLNINKIQK

SEQ ID NO: 21172 - protein, 9 aa, Borrelia burgdorferi B31
LNINKIQKG

SEQ ID NO: 21173 - protein, 9 aa, Borrelia burgdorferi B31
NINKIQKGI

SEQ ID NO: 21174 - protein, 9 aa, Borrelia burgdorferi B31
INKIQKGIK

SEQ ID NO: 21175 - protein, 9 aa, Borrelia burgdorferi B31
NKIQKGIKE

SEQ ID NO: 21176 - protein, 9 aa, Borrelia burgdorferi B31
KIQKGIKEI

SEQ ID NO: 21177 - protein, 9 aa, Borrelia burgdorferi B31
IQKGIKEIN

SEQ ID NO: 21178 - protein, 9 aa, Borrelia burgdorferi B31
QKGIKEINL

SEQ ID NO: 21179 - protein, 9 aa, Borrelia burgdorferi B31
KGIKEINLL

SEQ ID NO: 21180 - protein, 9 aa, Borrelia burgdorferi B31
GIKEINLLN

SEQ ID NO: 21181 - protein, 9 aa, Borrelia burgdorferi B31
IKEINLLNY

SEQ ID NO: 21182 - protein, 9 aa, Borrelia burgdorferi B31
KEINLLNYK

SEQ ID NO: 21183 - protein, 9 aa, Borrelia burgdorferi B31
EINLLNYKE

SEQ ID NO: 21184 - protein, 9 aa, Borrelia burgdorferi B31
INLLNYKEE

SEQ ID NO: 21185 - protein, 9 aa, Borrelia burgdorferi B31
NLLNYKEEK

SEQ ID NO: 21186 - protein, 9 aa, Borrelia burgdorferi B31
LLNYKEEKI

SEQ ID NO: 21187 - protein, 9 aa, Borrelia burgdorferi B31
LNYKEEKIK

SEQ ID NO: 21188 - protein, 9 aa, Borrelia burgdorferi B31
NYKEEKIKI

SEQ ID NO: 21189 - protein, 9 aa, Borrelia burgdorferi B31
YKEEKIKIS

SEQ ID NO: 21190 - protein, 9 aa, Borrelia burgdorferi B31
KEEKIKISL

SEQ ID NO: 21191 - protein, 9 aa, Borrelia burgdorferi B31
EEKIKISLN

SEQ ID NO: 21192 - protein, 9 aa, Borrelia burgdorferi B31
EKIKISLNQ

SEQ ID NO: 21193 - protein, 9 aa, Borrelia burgdorferi B31
KIKISLNQS

SEQ ID NO: 21194 - protein, 9 aa, Borrelia burgdorferi B31
IKISLNQSL

SEQ ID NO: 21195 - protein, 9 aa, Borrelia burgdorferi B31
KISLNQSLS

SEQ ID NO: 21196 - protein, 9 aa, Borrelia burgdorferi B31
ISLNQSLSP

SEQ ID NO: 21197 - protein, 9 aa, Borrelia burgdorferi B31
SLNQSLSPK

SEQ ID NO: 21198 - protein, 9 aa, Borrelia burgdorferi B31
LNQSLSPKE

SEQ ID NO: 21199 - protein, 9 aa, Borrelia burgdorferi B31
NQSLSPKEN

SEQ ID NO: 21200 - protein, 9 aa, Borrelia burgdorferi B31
QSLSPKENA

SEQ ID NO: 21201 - protein, 9 aa, Borrelia burgdorferi B31
SLSPKENAL

SEQ ID NO: 21202 - protein, 9 aa, Borrelia burgdorferi B31
LSPKENALQ

SEQ ID NO: 21203 - protein, 9 aa, Borrelia burgdorferi B31
SPKENALQY

SEQ ID NO: 21204 - protein, 9 aa, Borrelia burgdorferi B31
PKENALQYF

SEQ ID NO: 21205 - protein, 9 aa, Borrelia burgdorferi B31
KENALQYFK

SEQ ID NO: 21206 - protein, 9 aa, Borrelia burgdorferi B31
ENALQYFKA

SEQ ID NO: 21207 - protein, 9 aa, Borrelia burgdorferi B31
NALQYFKAY

SEQ ID NO: 21208 - protein, 9 aa, Borrelia burgdorferi B31
ALQYFKAYK

SEQ ID NO: 21209 - protein, 9 aa, Borrelia burgdorferi B31
LQYFKAYKK

SEQ ID NO: 21210 - protein, 9 aa, Borrelia burgdorferi B31
QYFKAYKKG

SEQ ID NO: 21211 - protein, 9 aa, Borrelia burgdorferi B31
YFKAYKKGK

SEQ ID NO: 21212 - protein, 9 aa, Borrelia burgdorferi B31
FKAYKKGKN

SEQ ID NO: 21213 - protein, 9 aa, Borrelia burgdorferi B31
KAYKKGKNS

SEQ ID NO: 21214 - protein, 9 aa, Borrelia burgdorferi B31
AYKKGKNSF

SEQ ID NO: 21215 - protein, 9 aa, Borrelia burgdorferi B31
YKKGKNSFK

SEQ ID NO: 21216 - protein, 9 aa, Borrelia burgdorferi B31
KKGKNSFKT

SEQ ID NO: 21217 - protein, 9 aa, Borrelia burgdorferi B31
KGKNSFKTI

SEQ ID NO: 21218 - protein, 9 aa, Borrelia burgdorferi B31
GKNSFKTIQ

SEQ ID NO: 21219 - protein, 9 aa, Borrelia burgdorferi B31
KNSFKTIQN

SEQ ID NO: 21220 - protein, 9 aa, Borrelia burgdorferi B31
NSFKTIQNQ

SEQ ID NO: 21221 - protein, 9 aa, Borrelia burgdorferi B31
SFKTIQNQL

SEQ ID NO: 21222 - protein, 9 aa, Borrelia burgdorferi B31
FKTIQNQLK

SEQ ID NO: 21223 - protein, 9 aa, Borrelia burgdorferi B31
KTIQNQLKD

SEQ ID NO: 21224 - protein, 9 aa, Borrelia burgdorferi B31
TIQNQLKDN

SEQ ID NO: 21225 - protein, 9 aa, Borrelia burgdorferi B31
IQNQLKDNL

SEQ ID NO: 21226 - protein, 9 aa, Borrelia burgdorferi B31
QNQLKDNLD

SEQ ID NO: 21227 - protein, 9 aa, Borrelia burgdorferi B31
NQLKDNLDK

SEQ ID NO: 21228 - protein, 9 aa, Borrelia burgdorferi B31
QLKDNLDKF

SEQ ID NO: 21229 - protein, 9 aa, Borrelia burgdorferi B31
LKDNLDKFN

SEQ ID NO: 21230 - protein, 9 aa, Borrelia burgdorferi B31
KDNLDKFNL

SEQ ID NO: 21231 - protein, 9 aa, Borrelia burgdorferi B31
DNLDKFNLI

SEQ ID NO: 21232 - protein, 9 aa, Borrelia burgdorferi B31
NLDKFNLIQ

SEQ ID NO: 21233 - protein, 9 aa, Borrelia burgdorferi B31
LDKFNLIQS

SEQ ID NO: 21234 - protein, 9 aa, Borrelia burgdorferi B31
DKFNLIQSK

SEQ ID NO: 21235 - protein, 9 aa, Borrelia burgdorferi B31
KFNLIQSKI

SEQ ID NO: 21236 - protein, 9 aa, Borrelia burgdorferi B31
FNLIQSKIT

SEQ ID NO: 21237 - protein, 9 aa, Borrelia burgdorferi B31
NLIQSKITM

SEQ ID NO: 21238 - protein, 9 aa, Borrelia burgdorferi B31
LIQSKITML

SEQ ID NO: 21239 - protein, 9 aa, Borrelia burgdorferi B31
IQSKITMLK

SEQ ID NO: 21240 - protein, 9 aa, Borrelia burgdorferi B31
QSKITMLKV

SEQ ID NO: 21241 - protein, 9 aa, Borrelia burgdorferi B31
SKITMLKVE

SEQ ID NO: 21242 - protein, 9 aa, Borrelia burgdorferi B31
KITMLKVEN

SEQ ID NO: 21243 - protein, 9 aa, Borrelia burgdorferi B31
ITMLKVENL

SEQ ID NO: 21244 - protein, 9 aa, Borrelia burgdorferi B31
TMLKVENLI

SEQ ID NO: 21245 - protein, 9 aa, Borrelia burgdorferi B31
MLKVENLIP

SEQ ID NO: 21246 - protein, 9 aa, Borrelia burgdorferi B31
LKVENLIPE

SEQ ID NO: 21247 - protein, 9 aa, Borrelia burgdorferi B31
KVENLIPEE

SEQ ID NO: 21248 - protein, 9 aa, Borrelia burgdorferi B31
VENLIPEEE

SEQ ID NO: 21249 - protein, 9 aa, Borrelia burgdorferi B31
ENLIPEEEY

SEQ ID NO: 21250 - protein, 9 aa, Borrelia burgdorferi B31
NLIPEEEYN

SEQ ID NO: 21251 - protein, 9 aa, Borrelia burgdorferi B31
LIPEEEYNQ

SEQ ID NO: 21252 - protein, 9 aa, Borrelia burgdorferi B31
IPEEEYNQE

SEQ ID NO: 21253 - protein, 9 aa, Borrelia burgdorferi B31
PEEEYNQEK

SEQ ID NO: 21254 - protein, 9 aa, Borrelia burgdorferi B31
EEEYNQEKT

SEQ ID NO: 21255 - protein, 9 aa, Borrelia burgdorferi B31
EEYNQEKTA

SEQ ID NO: 21256 - protein, 9 aa, Borrelia burgdorferi B31
EYNQEKTAI

SEQ ID NO: 21257 - protein, 9 aa, Borrelia burgdorferi B31
YNQEKTAIK

SEQ ID NO: 21258 - protein, 9 aa, Borrelia burgdorferi B31
NQEKTAIKE

SEQ ID NO: 21259 - protein, 9 aa, Borrelia burgdorferi B31
QEKTAIKEK

SEQ ID NO: 21260 - protein, 9 aa, Borrelia burgdorferi B31
EKTAIKEKE

SEQ ID NO: 21261 - protein, 9 aa, Borrelia burgdorferi B31
KTAIKEKEK

SEQ ID NO: 21262 - protein, 9 aa, Borrelia burgdorferi B31
TAIKEKEKT

SEQ ID NO: 21263 - protein, 9 aa, Borrelia burgdorferi B31
AIKEKEKTP

SEQ ID NO: 21264 - protein, 9 aa, Borrelia burgdorferi B31
IKEKEKTPK

SEQ ID NO: 21265 - protein, 9 aa, Borrelia burgdorferi B31
KEKEKTPKI

SEQ ID NO: 21266 - protein, 9 aa, Borrelia burgdorferi B31
EKEKTPKIG

SEQ ID NO: 21267 - protein, 9 aa, Borrelia burgdorferi B31
KEKTPKIGL

SEQ ID NO: 21268 - protein, 9 aa, Borrelia burgdorferi B31
EKTPKIGLH

SEQ ID NO: 21269 - protein, 9 aa, Borrelia burgdorferi B31
KTPKIGLHF

SEQ ID NO: 21270 - protein, 9 aa, Borrelia burgdorferi B31
TPKIGLHFT

SEQ ID NO: 21271 - protein, 9 aa, Borrelia burgdorferi B31
PKIGLHFTY

SEQ ID NO: 21272 - protein, 9 aa, Borrelia burgdorferi B31
KIGLHFTYC

SEQ ID NO: 21273 - protein, 9 aa, Borrelia burgdorferi B31
IGLHFTYCG

SEQ ID NO: 21274 - protein, 9 aa, Borrelia burgdorferi B31
GLHFTYCGF

SEQ ID NO: 21275 - protein, 9 aa, Borrelia burgdorferi B31
LHFTYCGFE

SEQ ID NO: 21276 - protein, 9 aa, Borrelia burgdorferi B31
HFTYCGFEI

SEQ ID NO: 21277 - protein, 9 aa, Borrelia burgdorferi B31
FTYCGFEIL

SEQ ID NO: 21278 - protein, 9 aa, Borrelia burgdorferi B31
TYCGFEILI

SEQ ID NO: 21279 - protein, 9 aa, Borrelia burgdorferi B31
YCGFEILIG

SEQ ID NO: 21280 - protein, 9 aa, Borrelia burgdorferi B31
CGFEILIGR

SEQ ID NO: 21281 - protein, 9 aa, Borrelia burgdorferi B31
GFEILIGRN

SEQ ID NO: 21282 - protein, 9 aa, Borrelia burgdorferi B31
FEILIGRNA

SEQ ID NO: 21283 - protein, 9 aa, Borrelia burgdorferi B31
EILIGRNAK

SEQ ID NO: 21284 - protein, 9 aa, Borrelia burgdorferi B31
ILIGRNAKE

SEQ ID NO: 21285 - protein, 9 aa, Borrelia burgdorferi B31
LIGRNAKEN

SEQ ID NO: 21286 - protein, 9 aa, Borrelia burgdorferi B31
IGRNAKEND

SEQ ID NO: 21287 - protein, 9 aa, Borrelia burgdorferi B31
GRNAKENDK

SEQ ID NO: 21288 - protein, 9 aa, Borrelia burgdorferi B31
RNAKENDKL

SEQ ID NO: 21289 - protein, 9 aa, Borrelia burgdorferi B31
NAKENDKLL

SEQ ID NO: 21290 - protein, 9 aa, Borrelia burgdorferi B31
AKENDKLLR

SEQ ID NO: 21291 - protein, 9 aa, Borrelia burgdorferi B31
KENDKLLRH

SEQ ID NO: 21292 - protein, 9 aa, Borrelia burgdorferi B31
ENDKLLRHC

SEQ ID NO: 21293 - protein, 9 aa, Borrelia burgdorferi B31
NDKLLRHCV

SEQ ID NO: 21294 - protein, 9 aa, Borrelia burgdorferi B31
DKLLRHCVK

SEQ ID NO: 21295 - protein, 9 aa, Borrelia burgdorferi B31
KLLRHCVKG

SEQ ID NO: 21296 - protein, 9 aa, Borrelia burgdorferi B31
LLRHCVKGN

SEQ ID NO: 21297 - protein, 9 aa, Borrelia burgdorferi B31
LRHCVKGND

SEQ ID NO: 21298 - protein, 9 aa, Borrelia burgdorferi B31
RHCVKGNDY

SEQ ID NO: 21299 - protein, 9 aa, Borrelia burgdorferi B31
HCVKGNDYW

SEQ ID NO: 21300 - protein, 9 aa, Borrelia burgdorferi B31
CVKGNDYWL

SEQ ID NO: 21301 - protein, 9 aa, Borrelia burgdorferi B31
VKGNDYWLH

SEQ ID NO: 21302 - protein, 9 aa, Borrelia burgdorferi B31
KGNDYWLHT

SEQ ID NO: 21303 - protein, 9 aa, Borrelia burgdorferi B31
GNDYWLHTR

SEQ ID NO: 21304 - protein, 9 aa, Borrelia burgdorferi B31
NDYWLHTRD

SEQ ID NO: 21305 - protein, 9 aa, Borrelia burgdorferi B31
DYWLHTRDY

SEQ ID NO: 21306 - protein, 9 aa, Borrelia burgdorferi B31
YWLHTRDYP

SEQ ID NO: 21307 - protein, 9 aa, Borrelia burgdorferi B31
WLHTRDYPG

SEQ ID NO: 21308 - protein, 9 aa, Borrelia burgdorferi B31
LHTRDYPGA

SEQ ID NO: 21309 - protein, 9 aa, Borrelia burgdorferi B31
HTRDYPGAY

SEQ ID NO: 21310 - protein, 9 aa, Borrelia burgdorferi B31
TRDYPGAYV

SEQ ID NO: 21311 - protein, 9 aa, Borrelia burgdorferi B31
RDYPGAYVF

SEQ ID NO: 21312 - protein, 9 aa, Borrelia burgdorferi B31
DYPGAYVFI

SEQ ID NO: 21313 - protein, 9 aa, Borrelia burgdorferi B31
YPGAYVFIK

SEQ ID NO: 21314 - protein, 9 aa, Borrelia burgdorferi B31
PGAYVFIKN

SEQ ID NO: 21315 - protein, 9 aa, Borrelia burgdorferi B31
GAYVFIKNQ

SEQ ID NO: 21316 - protein, 9 aa, Borrelia burgdorferi B31
AYVFIKNQK

SEQ ID NO: 21317 - protein, 9 aa, Borrelia burgdorferi B31
YVFIKNQKN

SEQ ID NO: 21318 - protein, 9 aa, Borrelia burgdorferi B31
VFIKNQKNK

SEQ ID NO: 21319 - protein, 9 aa, Borrelia burgdorferi B31
FIKNQKNKT

SEQ ID NO: 21320 - protein, 9 aa, Borrelia burgdorferi B31
IKNQKNKTP

SEQ ID NO: 21321 - protein, 9 aa, Borrelia burgdorferi B31
KNQKNKTPS

SEQ ID NO: 21322 - protein, 9 aa, Borrelia burgdorferi B31
NQKNKTPSL

SEQ ID NO: 21323 - protein, 9 aa, Borrelia burgdorferi B31
QKNKTPSLD

SEQ ID NO: 21324 - protein, 9 aa, Borrelia burgdorferi B31
KNKTPSLDV

SEQ ID NO: 21325 - protein, 9 aa, Borrelia burgdorferi B31
NKTPSLDVL

SEQ ID NO: 21326 - protein, 9 aa, Borrelia burgdorferi B31
KTPSLDVLL

SEQ ID NO: 21327 - protein, 9 aa, Borrelia burgdorferi B31
TPSLDVLLG

SEQ ID NO: 21328 - protein, 9 aa, Borrelia burgdorferi B31
PSLDVLLGA

SEQ ID NO: 21329 - protein, 9 aa, Borrelia burgdorferi B31
SLDVLLGAG

SEQ ID NO: 21330 - protein, 9 aa, Borrelia burgdorferi B31
LDVLLGAGN

SEQ ID NO: 21331 - protein, 9 aa, Borrelia burgdorferi B31
DVLLGAGNL

SEQ ID NO: 21332 - protein, 9 aa, Borrelia burgdorferi B31
VLLGAGNLC

SEQ ID NO: 21333 - protein, 9 aa, Borrelia burgdorferi B31
LLGAGNLCV

SEQ ID NO: 21334 - protein, 9 aa, Borrelia burgdorferi B31
LGAGNLCVF

SEQ ID NO: 21335 - protein, 9 aa, Borrelia burgdorferi B31
GAGNLCVFY

SEQ ID NO: 21336 - protein, 9 aa, Borrelia burgdorferi B31
AGNLCVFYT

SEQ ID NO: 21337 - protein, 9 aa, Borrelia burgdorferi B31
GNLCVFYTK

SEQ ID NO: 21338 - protein, 9 aa, Borrelia burgdorferi B31
NLCVFYTKL

SEQ ID NO: 21339 - protein, 9 aa, Borrelia burgdorferi B31
LCVFYTKLA

SEQ ID NO: 21340 - protein, 9 aa, Borrelia burgdorferi B31
CVFYTKLAK

SEQ ID NO: 21341 - protein, 9 aa, Borrelia burgdorferi B31
VFYTKLAKK

SEQ ID NO: 21342 - protein, 9 aa, Borrelia burgdorferi B31
FYTKLAKKS

SEQ ID NO: 21343 - protein, 9 aa, Borrelia burgdorferi B31
YTKLAKKSG

SEQ ID NO: 21344 - protein, 9 aa, Borrelia burgdorferi B31
TKLAKKSGK

SEQ ID NO: 21345 - protein, 9 aa, Borrelia burgdorferi B31
KLAKKSGKA

SEQ ID NO: 21346 - protein, 9 aa, Borrelia burgdorferi B31
LAKKSGKAD

SEQ ID NO: 21347 - protein, 9 aa, Borrelia burgdorferi B31
AKKSGKADL

SEQ ID NO: 21348 - protein, 9 aa, Borrelia burgdorferi B31
KKSGKADLY

SEQ ID NO: 21349 - protein, 9 aa, Borrelia burgdorferi B31
KSGKADLYY

SEQ ID NO: 21350 - protein, 9 aa, Borrelia burgdorferi B31
SGKADLYYT

SEQ ID NO: 21351 - protein, 9 aa, Borrelia burgdorferi B31
GKADLYYTQ

SEQ ID NO: 21352 - protein, 9 aa, Borrelia burgdorferi B31
KADLYYTQV

SEQ ID NO: 21353 - protein, 9 aa, Borrelia burgdorferi B31
ADLYYTQVK

SEQ ID NO: 21354 - protein, 9 aa, Borrelia burgdorferi B31
DLYYTQVKN

SEQ ID NO: 21355 - protein, 9 aa, Borrelia burgdorferi B31
LYYTQVKNL

SEQ ID NO: 21356 - protein, 9 aa, Borrelia burgdorferi B31
YYTQVKNLR

SEQ ID NO: 21357 - protein, 9 aa, Borrelia burgdorferi B31
YTQVKNLRR

SEQ ID NO: 21358 - protein, 9 aa, Borrelia burgdorferi B31
TQVKNLRRV

SEQ ID NO: 21359 - protein, 9 aa, Borrelia burgdorferi B31
QVKNLRRVK

SEQ ID NO: 21360 - protein, 9 aa, Borrelia burgdorferi B31
VKNLRRVKN

SEQ ID NO: 21361 - protein, 9 aa, Borrelia burgdorferi B31
KNLRRVKNK

SEQ ID NO: 21362 - protein, 9 aa, Borrelia burgdorferi B31
NLRRVKNKK

SEQ ID NO: 21363 - protein, 9 aa, Borrelia burgdorferi B31
LRRVKNKKL

SEQ ID NO: 21364 - protein, 9 aa, Borrelia burgdorferi B31
RRVKNKKLG

SEQ ID NO: 21365 - protein, 9 aa, Borrelia burgdorferi B31
RVKNKKLGL

SEQ ID NO: 21366 - protein, 9 aa, Borrelia burgdorferi B31
VKNKKLGLV

SEQ ID NO: 21367 - protein, 9 aa, Borrelia burgdorferi B31
KNKKLGLVI

SEQ ID NO: 21368 - protein, 9 aa, Borrelia burgdorferi B31
NKKLGLVIP

SEQ ID NO: 21369 - protein, 9 aa, Borrelia burgdorferi B31
KKLGLVIPK

SEQ ID NO: 21370 - protein, 9 aa, Borrelia burgdorferi B31
KLGLVIPKA

SEQ ID NO: 21371 - protein, 9 aa, Borrelia burgdorferi B31
LGLVIPKAE

SEQ ID NO: 21372 - protein, 9 aa, Borrelia burgdorferi B31
GLVIPKAEK

SEQ ID NO: 21373 - protein, 9 aa, Borrelia burgdorferi B31
LVIPKAEKN

SEQ ID NO: 21374 - protein, 9 aa, Borrelia burgdorferi B31
VIPKAEKNL

SEQ ID NO: 21375 - protein, 9 aa, Borrelia burgdorferi B31
IPKAEKNLH

SEQ ID NO: 21376 - protein, 9 aa, Borrelia burgdorferi B31
PKAEKNLHI

SEQ ID NO: 21377 - protein, 9 aa, Borrelia burgdorferi B31
KAEKNLHIK

SEQ ID NO: 21378 - protein, 9 aa, Borrelia burgdorferi B31
AEKNLHIKL

SEQ ID NO: 21379 - protein, 9 aa, Borrelia burgdorferi B31
EKNLHIKLD

SEQ ID NO: 21380 - protein, 9 aa, Borrelia burgdorferi B31
KNLHIKLDE

SEQ ID NO: 21381 - protein, 9 aa, Borrelia burgdorferi B31
NLHIKLDEN

SEQ ID NO: 21382 - protein, 9 aa, Borrelia burgdorferi B31
LHIKLDENL

SEQ ID NO: 21383 - protein, 9 aa, Borrelia burgdorferi B31
HIKLDENLI

SEQ ID NO: 21384 - protein, 9 aa, Borrelia burgdorferi B31
IKLDENLIK

SEQ ID NO: 21385 - protein, 9 aa, Borrelia burgdorferi B31
KLDENLIKK

SEQ ID NO: 21386 - protein, 9 aa, Borrelia burgdorferi B31
LDENLIKKI

SEQ ID NO: 21387 - protein, 9 aa, Borrelia burgdorferi B31
DENLIKKIK

SEQ ID NO: 21388 - protein, 9 aa, Borrelia burgdorferi B31
ENLIKKIKN

SEQ ID NO: 21389 - protein, 9 aa, Borrelia burgdorferi B31
NLIKKIKNQ

SEQ ID NO: 21390 - protein, 9 aa, Borrelia burgdorferi B31
LIKKIKNQT

SEQ ID NO: 21391 - protein, 10 aa, Borrelia burgdorferi B31
MIKMSLNYTE

SEQ ID NO: 21392 - protein, 10 aa, Borrelia burgdorferi B31
IKMSLNYTEI

SEQ ID NO: 21393 - protein, 10 aa, Borrelia burgdorferi B31
KMSLNYTEIN

SEQ ID NO: 21394 - protein, 10 aa, Borrelia burgdorferi B31
MSLNYTEINT

SEQ ID NO: 21395 - protein, 10 aa, Borrelia burgdorferi B31
SLNYTEINTL

SEQ ID NO: 21396 - protein, 10 aa, Borrelia burgdorferi B31
LNYTEINTLI

SEQ ID NO: 21397 - protein, 10 aa, Borrelia burgdorferi B31
NYTEINTLIK

SEQ ID NO: 21398 - protein, 10 aa, Borrelia burgdorferi B31
YTEINTLIKE

SEQ ID NO: 21399 - protein, 10 aa, Borrelia burgdorferi B31
TEINTLIKEI

SEQ ID NO: 21400 - protein, 10 aa, Borrelia burgdorferi B31
EINTLIKEIP

SEQ ID NO: 21401 - protein, 10 aa, Borrelia burgdorferi B31
INTLIKEIPF

SEQ ID NO: 21402 - protein, 10 aa, Borrelia burgdorferi B31
NTLIKEIPFT

SEQ ID NO: 21403 - protein, 10 aa, Borrelia burgdorferi B31
TLIKEIPFTN

SEQ ID NO: 21404 - protein, 10 aa, Borrelia burgdorferi B31
LIKEIPFTNS

SEQ ID NO: 21405 - protein, 10 aa, Borrelia burgdorferi B31
IKEIPFTNSL

SEQ ID NO: 21406 - protein, 10 aa, Borrelia burgdorferi B31
KEIPFTNSLI

SEQ ID NO: 21407 - protein, 10 aa, Borrelia burgdorferi B31
EIPFTNSLIT

SEQ ID NO: 21408 - protein, 10 aa, Borrelia burgdorferi B31
IPFTNSLITK

SEQ ID NO: 21409 - protein, 10 aa, Borrelia burgdorferi B31
PFTNSLITKI

SEQ ID NO: 21410 - protein, 10 aa, Borrelia burgdorferi B31
FTNSLITKII

SEQ ID NO: 21411 - protein, 10 aa, Borrelia burgdorferi B31
TNSLITKIIQ

SEQ ID NO: 21412 - protein, 10 aa, Borrelia burgdorferi B31
NSLITKIIQP

SEQ ID NO: 21413 - protein, 10 aa, Borrelia burgdorferi B31
SLITKIIQPD

SEQ ID NO: 21414 - protein, 10 aa, Borrelia burgdorferi B31
LITKIIQPDY

SEQ ID NO: 21415 - protein, 10 aa, Borrelia burgdorferi B31
ITKIIQPDYK

SEQ ID NO: 21416 - protein, 10 aa, Borrelia burgdorferi B31
TKIIQPDYKS

SEQ ID NO: 21417 - protein, 10 aa, Borrelia burgdorferi B31
KIIQPDYKSL

SEQ ID NO: 21418 - protein, 10 aa, Borrelia burgdorferi B31
IIQPDYKSLV

SEQ ID NO: 21419 - protein, 10 aa, Borrelia burgdorferi B31
IQPDYKSLVL

SEQ ID NO: 21420 - protein, 10 aa, Borrelia burgdorferi B31
QPDYKSLVLE

SEQ ID NO: 21421 - protein, 10 aa, Borrelia burgdorferi B31
PDYKSLVLEI

SEQ ID NO: 21422 - protein, 10 aa, Borrelia burgdorferi B31
DYKSLVLEIY

SEQ ID NO: 21423 - protein, 10 aa, Borrelia burgdorferi B31
YKSLVLEIYN

SEQ ID NO: 21424 - protein, 10 aa, Borrelia burgdorferi B31
KSLVLEIYNK

SEQ ID NO: 21425 - protein, 10 aa, Borrelia burgdorferi B31
SLVLEIYNKI

SEQ ID NO: 21426 - protein, 10 aa, Borrelia burgdorferi B31
LVLEIYNKID

SEQ ID NO: 21427 - protein, 10 aa, Borrelia burgdorferi B31
VLEIYNKIDN

SEQ ID NO: 21428 - protein, 10 aa, Borrelia burgdorferi B31
LEIYNKIDNK

SEQ ID NO: 21429 - protein, 10 aa, Borrelia burgdorferi B31
EIYNKIDNKK

SEQ ID NO: 21430 - protein, 10 aa, Borrelia burgdorferi B31
IYNKIDNKKF

SEQ ID NO: 21431 - protein, 10 aa, Borrelia burgdorferi B31
YNKIDNKKFK

SEQ ID NO: 21432 - protein, 10 aa, Borrelia burgdorferi B31
NKIDNKKFKI

SEQ ID NO: 21433 - protein, 10 aa, Borrelia burgdorferi B31
KIDNKKFKIL

SEQ ID NO: 21434 - protein, 10 aa, Borrelia burgdorferi B31
IDNKKFKILI

SEQ ID NO: 21435 - protein, 10 aa, Borrelia burgdorferi B31
DNKKFKILIC

SEQ ID NO: 21436 - protein, 10 aa, Borrelia burgdorferi B31
NKKFKILICL

SEQ ID NO: 21437 - protein, 10 aa, Borrelia burgdorferi B31
KKFKILICLN

SEQ ID NO: 21438 - protein, 10 aa, Borrelia burgdorferi B31
KFKILICLNP

SEQ ID NO: 21439 - protein, 10 aa, Borrelia burgdorferi B31
FKILICLNPN

SEQ ID NO: 21440 - protein, 10 aa, Borrelia burgdorferi B31
KILICLNPNT

SEQ ID NO: 21441 - protein, 10 aa, Borrelia burgdorferi B31
ILICLNPNTT

SEQ ID NO: 21442 - protein, 10 aa, Borrelia burgdorferi B31
LICLNPNTTR

SEQ ID NO: 21443 - protein, 10 aa, Borrelia burgdorferi B31
ICLNPNTTRF

SEQ ID NO: 21444 - protein, 10 aa, Borrelia burgdorferi B31
CLNPNTTRFH

SEQ ID NO: 21445 - protein, 10 aa, Borrelia burgdorferi B31
LNPNTTRFHI

SEQ ID NO: 21446 - protein, 10 aa, Borrelia burgdorferi B31
NPNTTRFHIT

SEQ ID NO: 21447 - protein, 10 aa, Borrelia burgdorferi B31
PNTTRFHITK

SEQ ID NO: 21448 - protein, 10 aa, Borrelia burgdorferi B31
NTTRFHITKK

SEQ ID NO: 21449 - protein, 10 aa, Borrelia burgdorferi B31
TTRFHITKKN

SEQ ID NO: 21450 - protein, 10 aa, Borrelia burgdorferi B31
TRFHITKKNF

SEQ ID NO: 21451 - protein, 10 aa, Borrelia burgdorferi B31
RFHITKKNFK

SEQ ID NO: 21452 - protein, 10 aa, Borrelia burgdorferi B31
FHITKKNFKK

SEQ ID NO: 21453 - protein, 10 aa, Borrelia burgdorferi B31
HITKKNFKKN

SEQ ID NO: 21454 - protein, 10 aa, Borrelia burgdorferi B31
ITKKNFKKNA

SEQ ID NO: 21455 - protein, 10 aa, Borrelia burgdorferi B31
TKKNFKKNAL

SEQ ID NO: 21456 - protein, 10 aa, Borrelia burgdorferi B31
KKNFKKNALK

SEQ ID NO: 21457 - protein, 10 aa, Borrelia burgdorferi B31
KNFKKNALKL

SEQ ID NO: 21458 - protein, 10 aa, Borrelia burgdorferi B31
NFKKNALKLR

SEQ ID NO: 21459 - protein, 10 aa, Borrelia burgdorferi B31
FKKNALKLRF

SEQ ID NO: 21460 - protein, 10 aa, Borrelia burgdorferi B31
KKNALKLRFS

SEQ ID NO: 21461 - protein, 10 aa, Borrelia burgdorferi B31
KNALKLRFSD

SEQ ID NO: 21462 - protein, 10 aa, Borrelia burgdorferi B31
NALKLRFSDF

SEQ ID NO: 21463 - protein, 10 aa, Borrelia burgdorferi B31
ALKLRFSDFL

SEQ ID NO: 21464 - protein, 10 aa, Borrelia burgdorferi B31
LKLRFSDFLK

SEQ ID NO: 21465 - protein, 10 aa, Borrelia burgdorferi B31
KLRFSDFLKS

SEQ ID NO: 21466 - protein, 10 aa, Borrelia burgdorferi B31
LRFSDFLKSK

SEQ ID NO: 21467 - protein, 10 aa, Borrelia burgdorferi B31
RFSDFLKSKI

SEQ ID NO: 21468 - protein, 10 aa, Borrelia burgdorferi B31
FSDFLKSKIQ

SEQ ID NO: 21469 - protein, 10 aa, Borrelia burgdorferi B31
SDFLKSKIQN

SEQ ID NO: 21470 - protein, 10 aa, Borrelia burgdorferi B31
DFLKSKIQNG

SEQ ID NO: 21471 - protein, 10 aa, Borrelia burgdorferi B31
FLKSKIQNGK

SEQ ID NO: 21472 - protein, 10 aa, Borrelia burgdorferi B31
LKSKIQNGKI

SEQ ID NO: 21473 - protein, 10 aa, Borrelia burgdorferi B31
KSKIQNGKII

SEQ ID NO: 21474 - protein, 10 aa, Borrelia burgdorferi B31
SKIQNGKIIK

SEQ ID NO: 21475 - protein, 10 aa, Borrelia burgdorferi B31
KIQNGKIIKA

SEQ ID NO: 21476 - protein, 10 aa, Borrelia burgdorferi B31
IQNGKIIKAF

SEQ ID NO: 21477 - protein, 10 aa, Borrelia burgdorferi B31
QNGKIIKAFQ

SEQ ID NO: 21478 - protein, 10 aa, Borrelia burgdorferi B31
NGKIIKAFQM

SEQ ID NO: 21479 - protein, 10 aa, Borrelia burgdorferi B31
GKIIKAFQMK

SEQ ID NO: 21480 - protein, 10 aa, Borrelia burgdorferi B31
KIIKAFQMKN

SEQ ID NO: 21481 - protein, 10 aa, Borrelia burgdorferi B31
IIKAFQMKNE

SEQ ID NO: 21482 - protein, 10 aa, Borrelia burgdorferi B31
IKAFQMKNER

SEQ ID NO: 21483 - protein, 10 aa, Borrelia burgdorferi B31
KAFQMKNERI

SEQ ID NO: 21484 - protein, 10 aa, Borrelia burgdorferi B31
AFQMKNERII

SEQ ID NO: 21485 - protein, 10 aa, Borrelia burgdorferi B31
FQMKNERIIS

SEQ ID NO: 21486 - protein, 10 aa, Borrelia burgdorferi B31
QMKNERIISL

SEQ ID NO: 21487 - protein, 10 aa, Borrelia burgdorferi B31
MKNERIISLE

SEQ ID NO: 21488 - protein, 10 aa, Borrelia burgdorferi B31
KNERIISLEI

SEQ ID NO: 21489 - protein, 10 aa, Borrelia burgdorferi B31
NERIISLEIL

SEQ ID NO: 21490 - protein, 10 aa, Borrelia burgdorferi B31
ERIISLEILQ

SEQ ID NO: 21491 - protein, 10 aa, Borrelia burgdorferi B31
RIISLEILQK

SEQ ID NO: 21492 - protein, 10 aa, Borrelia burgdorferi B31
IISLEILQKD

SEQ ID NO: 21493 - protein, 10 aa, Borrelia burgdorferi B31
ISLEILQKDM

SEQ ID NO: 21494 - protein, 10 aa, Borrelia burgdorferi B31
SLEILQKDMI

SEQ ID NO: 21495 - protein, 10 aa, Borrelia burgdorferi B31
LEILQKDMII

SEQ ID NO: 21496 - protein, 10 aa, Borrelia burgdorferi B31
EILQKDMIIL

SEQ ID NO: 21497 - protein, 10 aa, Borrelia burgdorferi B31
ILQKDMIILF

SEQ ID NO: 21498 - protein, 10 aa, Borrelia burgdorferi B31
LQKDMIILFI

SEQ ID NO: 21499 - protein, 10 aa, Borrelia burgdorferi B31
QKDMIILFIK

SEQ ID NO: 21500 - protein, 10 aa, Borrelia burgdorferi B31
KDMIILFIKL

SEQ ID NO: 21501 - protein, 10 aa, Borrelia burgdorferi B31
DMIILFIKLW

SEQ ID NO: 21502 - protein, 10 aa, Borrelia burgdorferi B31
MIILFIKLWP

SEQ ID NO: 21503 - protein, 10 aa, Borrelia burgdorferi B31
IILFIKLWPS

SEQ ID NO: 21504 - protein, 10 aa, Borrelia burgdorferi B31
ILFIKLWPSS

SEQ ID NO: 21505 - protein, 10 aa, Borrelia burgdorferi B31
LFIKLWPSSP

SEQ ID NO: 21506 - protein, 10 aa, Borrelia burgdorferi B31
FIKLWPSSPN

SEQ ID NO: 21507 - protein, 10 aa, Borrelia burgdorferi B31
IKLWPSSPNI

SEQ ID NO: 21508 - protein, 10 aa, Borrelia burgdorferi B31
KLWPSSPNII

SEQ ID NO: 21509 - protein, 10 aa, Borrelia burgdorferi B31
LWPSSPNIIA

SEQ ID NO: 21510 - protein, 10 aa, Borrelia burgdorferi B31
WPSSPNIIAT

SEQ ID NO: 21511 - protein, 10 aa, Borrelia burgdorferi B31
PSSPNIIATN

SEQ ID NO: 21512 - protein, 10 aa, Borrelia burgdorferi B31
SSPNIIATNS

SEQ ID NO: 21513 - protein, 10 aa, Borrelia burgdorferi B31
SPNIIATNSN

SEQ ID NO: 21514 - protein, 10 aa, Borrelia burgdorferi B31
PNIIATNSNF

SEQ ID NO: 21515 - protein, 10 aa, Borrelia burgdorferi B31
NIIATNSNFK

SEQ ID NO: 21516 - protein, 10 aa, Borrelia burgdorferi B31
IIATNSNFKI

SEQ ID NO: 21517 - protein, 10 aa, Borrelia burgdorferi B31
IATNSNFKIL

SEQ ID NO: 21518 - protein, 10 aa, Borrelia burgdorferi B31
ATNSNFKILD

SEQ ID NO: 21519 - protein, 10 aa, Borrelia burgdorferi B31
TNSNFKILDA

SEQ ID NO: 21520 - protein, 10 aa, Borrelia burgdorferi B31
NSNFKILDAY

SEQ ID NO: 21521 - protein, 10 aa, Borrelia burgdorferi B31
SNFKILDAYY

SEQ ID NO: 21522 - protein, 10 aa, Borrelia burgdorferi B31
NFKILDAYYR

SEQ ID NO: 21523 - protein, 10 aa, Borrelia burgdorferi B31
FKILDAYYRR

SEQ ID NO: 21524 - protein, 10 aa, Borrelia burgdorferi B31
KILDAYYRRP

SEQ ID NO: 21525 - protein, 10 aa, Borrelia burgdorferi B31
ILDAYYRRPK

SEQ ID NO: 21526 - protein, 10 aa, Borrelia burgdorferi B31
LDAYYRRPKI

SEQ ID NO: 21527 - protein, 10 aa, Borrelia burgdorferi B31
DAYYRRPKIK

SEQ ID NO: 21528 - protein, 10 aa, Borrelia burgdorferi B31
AYYRRPKIKE

SEQ ID NO: 21529 - protein, 10 aa, Borrelia burgdorferi B31
YYRRPKIKET

SEQ ID NO: 21530 - protein, 10 aa, Borrelia burgdorferi B31
YRRPKIKETT

SEQ ID NO: 21531 - protein, 10 aa, Borrelia burgdorferi B31
RRPKIKETTG

SEQ ID NO: 21532 - protein, 10 aa, Borrelia burgdorferi B31
RPKIKETTGE

SEQ ID NO: 21533 - protein, 10 aa, Borrelia burgdorferi B31
PKIKETTGEI

SEQ ID NO: 21534 - protein, 10 aa, Borrelia burgdorferi B31
KIKETTGEIF

SEQ ID NO: 21535 - protein, 10 aa, Borrelia burgdorferi B31
IKETTGEIFL

SEQ ID NO: 21536 - protein, 10 aa, Borrelia burgdorferi B31
KETTGEIFLK

SEQ ID NO: 21537 - protein, 10 aa, Borrelia burgdorferi B31
ETTGEIFLKA

SEQ ID NO: 21538 - protein, 10 aa, Borrelia burgdorferi B31
TTGEIFLKAK

SEQ ID NO: 21539 - protein, 10 aa, Borrelia burgdorferi B31
TGEIFLKAKE

SEQ ID NO: 21540 - protein, 10 aa, Borrelia burgdorferi B31
GEIFLKAKEI

SEQ ID NO: 21541 - protein, 10 aa, Borrelia burgdorferi B31
EIFLKAKEIH

SEQ ID NO: 21542 - protein, 10 aa, Borrelia burgdorferi B31
IFLKAKEIHE

SEQ ID NO: 21543 - protein, 10 aa, Borrelia burgdorferi B31
FLKAKEIHES

SEQ ID NO: 21544 - protein, 10 aa, Borrelia burgdorferi B31
LKAKEIHESN

SEQ ID NO: 21545 - protein, 10 aa, Borrelia burgdorferi B31
KAKEIHESNK

SEQ ID NO: 21546 - protein, 10 aa, Borrelia burgdorferi B31
AKEIHESNKM

SEQ ID NO: 21547 - protein, 10 aa, Borrelia burgdorferi B31
KEIHESNKMS

SEQ ID NO: 21548 - protein, 10 aa, Borrelia burgdorferi B31
EIHESNKMSD

SEQ ID NO: 21549 - protein, 10 aa, Borrelia burgdorferi B31
IHESNKMSDK

SEQ ID NO: 21550 - protein, 10 aa, Borrelia burgdorferi B31
HESNKMSDKK

SEQ ID NO: 21551 - protein, 10 aa, Borrelia burgdorferi B31
ESNKMSDKKI

SEQ ID NO: 21552 - protein, 10 aa, Borrelia burgdorferi B31
SNKMSDKKIM

SEQ ID NO: 21553 - protein, 10 aa, Borrelia burgdorferi B31
NKMSDKKIME

SEQ ID NO: 21554 - protein, 10 aa, Borrelia burgdorferi B31
KMSDKKIMEL

SEQ ID NO: 21555 - protein, 10 aa, Borrelia burgdorferi B31
MSDKKIMELK

SEQ ID NO: 21556 - protein, 10 aa, Borrelia burgdorferi B31
SDKKIMELKE

SEQ ID NO: 21557 - protein, 10 aa, Borrelia burgdorferi B31
DKKIMELKEE

SEQ ID NO: 21558 - protein, 10 aa, Borrelia burgdorferi B31
KKIMELKEEY

SEQ ID NO: 21559 - protein, 10 aa, Borrelia burgdorferi B31
KIMELKEEYN

SEQ ID NO: 21560 - protein, 10 aa, Borrelia burgdorferi B31
IMELKEEYNN

SEQ ID NO: 21561 - protein, 10 aa, Borrelia burgdorferi B31
MELKEEYNNT

SEQ ID NO: 21562 - protein, 10 aa, Borrelia burgdorferi B31
ELKEEYNNTS

SEQ ID NO: 21563 - protein, 10 aa, Borrelia burgdorferi B31
LKEEYNNTSY

SEQ ID NO: 21564 - protein, 10 aa, Borrelia burgdorferi B31
KEEYNNTSYT

SEQ ID NO: 21565 - protein, 10 aa, Borrelia burgdorferi B31
EEYNNTSYTS

SEQ ID NO: 21566 - protein, 10 aa, Borrelia burgdorferi B31
EYNNTSYTSY

SEQ ID NO: 21567 - protein, 10 aa, Borrelia burgdorferi B31
YNNTSYTSYS

SEQ ID NO: 21568 - protein, 10 aa, Borrelia burgdorferi B31
NNTSYTSYSE

SEQ ID NO: 21569 - protein, 10 aa, Borrelia burgdorferi B31
NTSYTSYSEF

SEQ ID NO: 21570 - protein, 10 aa, Borrelia burgdorferi B31
TSYTSYSEFL

SEQ ID NO: 21571 - protein, 10 aa, Borrelia burgdorferi B31
SYTSYSEFLE

SEQ ID NO: 21572 - protein, 10 aa, Borrelia burgdorferi B31
YTSYSEFLEN

SEQ ID NO: 21573 - protein, 10 aa, Borrelia burgdorferi B31
TSYSEFLENY

SEQ ID NO: 21574 - protein, 10 aa, Borrelia burgdorferi B31
SYSEFLENYY

SEQ ID NO: 21575 - protein, 10 aa, Borrelia burgdorferi B31
YSEFLENYYE

SEQ ID NO: 21576 - protein, 10 aa, Borrelia burgdorferi B31
SEFLENYYES

SEQ ID NO: 21577 - protein, 10 aa, Borrelia burgdorferi B31
EFLENYYESL

SEQ ID NO: 21578 - protein, 10 aa, Borrelia burgdorferi B31
FLENYYESLN

SEQ ID NO: 21579 - protein, 10 aa, Borrelia burgdorferi B31
LENYYESLND

SEQ ID NO: 21580 - protein, 10 aa, Borrelia burgdorferi B31
ENYYESLNDQ

SEQ ID NO: 21581 - protein, 10 aa, Borrelia burgdorferi B31
NYYESLNDQI

SEQ ID NO: 21582 - protein, 10 aa, Borrelia burgdorferi B31
YYESLNDQIK

SEQ ID NO: 21583 - protein, 10 aa, Borrelia burgdorferi B31
YESLNDQIKK

SEQ ID NO: 21584 - protein, 10 aa, Borrelia burgdorferi B31
ESLNDQIKKT

SEQ ID NO: 21585 - protein, 10 aa, Borrelia burgdorferi B31
SLNDQIKKTN

SEQ ID NO: 21586 - protein, 10 aa, Borrelia burgdorferi B31
LNDQIKKTNI

SEQ ID NO: 21587 - protein, 10 aa, Borrelia burgdorferi B31
NDQIKKTNIK

SEQ ID NO: 21588 - protein, 10 aa, Borrelia burgdorferi B31
DQIKKTNIKE

SEQ ID NO: 21589 - protein, 10 aa, Borrelia burgdorferi B31
QIKKTNIKEL

SEQ ID NO: 21590 - protein, 10 aa, Borrelia burgdorferi B31
IKKTNIKELL

SEQ ID NO: 21591 - protein, 10 aa, Borrelia burgdorferi B31
KKTNIKELLI

SEQ ID NO: 21592 - protein, 10 aa, Borrelia burgdorferi B31
KTNIKELLIE

SEQ ID NO: 21593 - protein, 10 aa, Borrelia burgdorferi B31
TNIKELLIEK

SEQ ID NO: 21594 - protein, 10 aa, Borrelia burgdorferi B31
NIKELLIEKY

SEQ ID NO: 21595 - protein, 10 aa, Borrelia burgdorferi B31
IKELLIEKYK

SEQ ID NO: 21596 - protein, 10 aa, Borrelia burgdorferi B31
KELLIEKYKK

SEQ ID NO: 21597 - protein, 10 aa, Borrelia burgdorferi B31
ELLIEKYKKE

SEQ ID NO: 21598 - protein, 10 aa, Borrelia burgdorferi B31
LLIEKYKKEL

SEQ ID NO: 21599 - protein, 10 aa, Borrelia burgdorferi B31
LIEKYKKELI

SEQ ID NO: 21600 - protein, 10 aa, Borrelia burgdorferi B31
IEKYKKELIV

SEQ ID NO: 21601 - protein, 10 aa, Borrelia burgdorferi B31
EKYKKELIVL

SEQ ID NO: 21602 - protein, 10 aa, Borrelia burgdorferi B31
KYKKELIVLE

SEQ ID NO: 21603 - protein, 10 aa, Borrelia burgdorferi B31
YKKELIVLEK

SEQ ID NO: 21604 - protein, 10 aa, Borrelia burgdorferi B31
KKELIVLEKR

SEQ ID NO: 21605 - protein, 10 aa, Borrelia burgdorferi B31
KELIVLEKRI

SEQ ID NO: 21606 - protein, 10 aa, Borrelia burgdorferi B31
ELIVLEKRID

SEQ ID NO: 21607 - protein, 10 aa, Borrelia burgdorferi B31
LIVLEKRIDS

SEQ ID NO: 21608 - protein, 10 aa, Borrelia burgdorferi B31
IVLEKRIDSL

SEQ ID NO: 21609 - protein, 10 aa, Borrelia burgdorferi B31
VLEKRIDSLK

SEQ ID NO: 21610 - protein, 10 aa, Borrelia burgdorferi B31
LEKRIDSLKQ

SEQ ID NO: 21611 - protein, 10 aa, Borrelia burgdorferi B31
EKRIDSLKQQ

SEQ ID NO: 21612 - protein, 10 aa, Borrelia burgdorferi B31
KRIDSLKQQI

SEQ ID NO: 21613 - protein, 10 aa, Borrelia burgdorferi B31
RIDSLKQQIK

SEQ ID NO: 21614 - protein, 10 aa, Borrelia burgdorferi B31
IDSLKQQIKL

SEQ ID NO: 21615 - protein, 10 aa, Borrelia burgdorferi B31
DSLKQQIKLL

SEQ ID NO: 21616 - protein, 10 aa, Borrelia burgdorferi B31
SLKQQIKLLE

SEQ ID NO: 21617 - protein, 10 aa, Borrelia burgdorferi B31
LKQQIKLLEN

SEQ ID NO: 21618 - protein, 10 aa, Borrelia burgdorferi B31
KQQIKLLENI

SEQ ID NO: 21619 - protein, 10 aa, Borrelia burgdorferi B31
QQIKLLENIE

SEQ ID NO: 21620 - protein, 10 aa, Borrelia burgdorferi B31
QIKLLENIEN

SEQ ID NO: 21621 - protein, 10 aa, Borrelia burgdorferi B31
IKLLENIENE

SEQ ID NO: 21622 - protein, 10 aa, Borrelia burgdorferi B31
KLLENIENEK

SEQ ID NO: 21623 - protein, 10 aa, Borrelia burgdorferi B31
LLENIENEKE

SEQ ID NO: 21624 - protein, 10 aa, Borrelia burgdorferi B31
LENIENEKEK

SEQ ID NO: 21625 - protein, 10 aa, Borrelia burgdorferi B31
ENIENEKEKG

SEQ ID NO: 21626 - protein, 10 aa, Borrelia burgdorferi B31
NIENEKEKGE

SEQ ID NO: 21627 - protein, 10 aa, Borrelia burgdorferi B31
IENEKEKGEL

SEQ ID NO: 21628 - protein, 10 aa, Borrelia burgdorferi B31
ENEKEKGELI

SEQ ID NO: 21629 - protein, 10 aa, Borrelia burgdorferi B31
NEKEKGELIL

SEQ ID NO: 21630 - protein, 10 aa, Borrelia burgdorferi B31
EKEKGELILL

SEQ ID NO: 21631 - protein, 10 aa, Borrelia burgdorferi B31
KEKGELILLN

SEQ ID NO: 21632 - protein, 10 aa, Borrelia burgdorferi B31
EKGELILLNI

SEQ ID NO: 21633 - protein, 10 aa, Borrelia burgdorferi B31
KGELILLNIN

SEQ ID NO: 21634 - protein, 10 aa, Borrelia burgdorferi B31
GELILLNINK

SEQ ID NO: 21635 - protein, 10 aa, Borrelia burgdorferi B31
ELILLNINKI

SEQ ID NO: 21636 - protein, 10 aa, Borrelia burgdorferi B31
LILLNINKIQ

SEQ ID NO: 21637 - protein, 10 aa, Borrelia burgdorferi B31
ILLNINKIQK

SEQ ID NO: 21638 - protein, 10 aa, Borrelia burgdorferi B31
LLNINKIQKG

SEQ ID NO: 21639 - protein, 10 aa, Borrelia burgdorferi B31
LNINKIQKGI

SEQ ID NO: 21640 - protein, 10 aa, Borrelia burgdorferi B31
NINKIQKGIK

SEQ ID NO: 21641 - protein, 10 aa, Borrelia burgdorferi B31
INKIQKGIKE

SEQ ID NO: 21642 - protein, 10 aa, Borrelia burgdorferi B31
NKIQKGIKEI

SEQ ID NO: 21643 - protein, 10 aa, Borrelia burgdorferi B31
KIQKGIKEIN

SEQ ID NO: 21644 - protein, 10 aa, Borrelia burgdorferi B31
IQKGIKEINL

SEQ ID NO: 21645 - protein, 10 aa, Borrelia burgdorferi B31
QKGIKEINLL

SEQ ID NO: 21646 - protein, 10 aa, Borrelia burgdorferi B31
KGIKEINLLN

SEQ ID NO: 21647 - protein, 10 aa, Borrelia burgdorferi B31
GIKEINLLNY

SEQ ID NO: 21648 - protein, 10 aa, Borrelia burgdorferi B31
IKEINLLNYK

SEQ ID NO: 21649 - protein, 10 aa, Borrelia burgdorferi B31
KEINLLNYKE

SEQ ID NO: 21650 - protein, 10 aa, Borrelia burgdorferi B31
EINLLNYKEE

SEQ ID NO: 21651 - protein, 10 aa, Borrelia burgdorferi B31
INLLNYKEEK

SEQ ID NO: 21652 - protein, 10 aa, Borrelia burgdorferi B31
NLLNYKEEKI

SEQ ID NO: 21653 - protein, 10 aa, Borrelia burgdorferi B31
LLNYKEEKIK

SEQ ID NO: 21654 - protein, 10 aa, Borrelia burgdorferi B31
LNYKEEKIKI

SEQ ID NO: 21655 - protein, 10 aa, Borrelia burgdorferi B31
NYKEEKIKIS

SEQ ID NO: 21656 - protein, 10 aa, Borrelia burgdorferi B31
YKEEKIKISL

SEQ ID NO: 21657 - protein, 10 aa, Borrelia burgdorferi B31
KEEKIKISLN

SEQ ID NO: 21658 - protein, 10 aa, Borrelia burgdorferi B31
EEKIKISLNQ

SEQ ID NO: 21659 - protein, 10 aa, Borrelia burgdorferi B31
EKIKISLNQS

SEQ ID NO: 21660 - protein, 10 aa, Borrelia burgdorferi B31
KIKISLNQSL

SEQ ID NO: 21661 - protein, 10 aa, Borrelia burgdorferi B31
IKISLNQSLS

SEQ ID NO: 21662 - protein, 10 aa, Borrelia burgdorferi B31
KISLNQSLSP

SEQ ID NO: 21663 - protein, 10 aa, Borrelia burgdorferi B31
ISLNQSLSPK

SEQ ID NO: 21664 - protein, 10 aa, Borrelia burgdorferi B31
SLNQSLSPKE

SEQ ID NO: 21665 - protein, 10 aa, Borrelia burgdorferi B31
LNQSLSPKEN

SEQ ID NO: 21666 - protein, 10 aa, Borrelia burgdorferi B31
NQSLSPKENA

SEQ ID NO: 21667 - protein, 10 aa, Borrelia burgdorferi B31
QSLSPKENAL

SEQ ID NO: 21668 - protein, 10 aa, Borrelia burgdorferi B31
SLSPKENALQ

SEQ ID NO: 21669 - protein, 10 aa, Borrelia burgdorferi B31
LSPKENALQY

SEQ ID NO: 21670 - protein, 10 aa, Borrelia burgdorferi B31
SPKENALQYF

SEQ ID NO: 21671 - protein, 10 aa, Borrelia burgdorferi B31
PKENALQYFK

SEQ ID NO: 21672 - protein, 10 aa, Borrelia burgdorferi B31
KENALQYFKA

SEQ ID NO: 21673 - protein, 10 aa, Borrelia burgdorferi B31
ENALQYFKAY

SEQ ID NO: 21674 - protein, 10 aa, Borrelia burgdorferi B31
NALQYFKAYK

SEQ ID NO: 21675 - protein, 10 aa, Borrelia burgdorferi B31
ALQYFKAYKK

SEQ ID NO: 21676 - protein, 10 aa, Borrelia burgdorferi B31
LQYFKAYKKG

SEQ ID NO: 21677 - protein, 10 aa, Borrelia burgdorferi B31
QYFKAYKKGK

SEQ ID NO: 21678 - protein, 10 aa, Borrelia burgdorferi B31
YFKAYKKGKN

SEQ ID NO: 21679 - protein, 10 aa, Borrelia burgdorferi B31
FKAYKKGKNS

SEQ ID NO: 21680 - protein, 10 aa, Borrelia burgdorferi B31
KAYKKGKNSF

SEQ ID NO: 21681 - protein, 10 aa, Borrelia burgdorferi B31
AYKKGKNSFK

SEQ ID NO: 21682 - protein, 10 aa, Borrelia burgdorferi B31
YKKGKNSFKT

SEQ ID NO: 21683 - protein, 10 aa, Borrelia burgdorferi B31
KKGKNSFKTI

SEQ ID NO: 21684 - protein, 10 aa, Borrelia burgdorferi B31
KGKNSFKTIQ

SEQ ID NO: 21685 - protein, 10 aa, Borrelia burgdorferi B31
GKNSFKTIQN

SEQ ID NO: 21686 - protein, 10 aa, Borrelia burgdorferi B31
KNSFKTIQNQ

SEQ ID NO: 21687 - protein, 10 aa, Borrelia burgdorferi B31
NSFKTIQNQL

SEQ ID NO: 21688 - protein, 10 aa, Borrelia burgdorferi B31
SFKTIQNQLK

SEQ ID NO: 21689 - protein, 10 aa, Borrelia burgdorferi B31
FKTIQNQLKD

SEQ ID NO: 21690 - protein, 10 aa, Borrelia burgdorferi B31
KTIQNQLKDN

SEQ ID NO: 21691 - protein, 10 aa, Borrelia burgdorferi B31
TIQNQLKDNL

SEQ ID NO: 21692 - protein, 10 aa, Borrelia burgdorferi B31
IQNQLKDNLD

SEQ ID NO: 21693 - protein, 10 aa, Borrelia burgdorferi B31
QNQLKDNLDK

SEQ ID NO: 21694 - protein, 10 aa, Borrelia burgdorferi B31
NQLKDNLDKF

SEQ ID NO: 21695 - protein, 10 aa, Borrelia burgdorferi B31
QLKDNLDKFN

SEQ ID NO: 21696 - protein, 10 aa, Borrelia burgdorferi B31
LKDNLDKFNL

SEQ ID NO: 21697 - protein, 10 aa, Borrelia burgdorferi B31
KDNLDKFNLI

SEQ ID NO: 21698 - protein, 10 aa, Borrelia burgdorferi B31
DNLDKFNLIQ

SEQ ID NO: 21699 - protein, 10 aa, Borrelia burgdorferi B31
NLDKFNLIQS

SEQ ID NO: 21700 - protein, 10 aa, Borrelia burgdorferi B31
LDKFNLIQSK

SEQ ID NO: 21701 - protein, 10 aa, Borrelia burgdorferi B31
DKFNLIQSKI

SEQ ID NO: 21702 - protein, 10 aa, Borrelia burgdorferi B31
KFNLIQSKIT

SEQ ID NO: 21703 - protein, 10 aa, Borrelia burgdorferi B31
FNLIQSKITM

SEQ ID NO: 21704 - protein, 10 aa, Borrelia burgdorferi B31
NLIQSKITML

SEQ ID NO: 21705 - protein, 10 aa, Borrelia burgdorferi B31
LIQSKITMLK

SEQ ID NO: 21706 - protein, 10 aa, Borrelia burgdorferi B31
IQSKITMLKV

SEQ ID NO: 21707 - protein, 10 aa, Borrelia burgdorferi B31
QSKITMLKVE

SEQ ID NO: 21708 - protein, 10 aa, Borrelia burgdorferi B31
SKITMLKVEN

SEQ ID NO: 21709 - protein, 10 aa, Borrelia burgdorferi B31
KITMLKVENL

SEQ ID NO: 21710 - protein, 10 aa, Borrelia burgdorferi B31
ITMLKVENLI

SEQ ID NO: 21711 - protein, 10 aa, Borrelia burgdorferi B31
TMLKVENLIP

SEQ ID NO: 21712 - protein, 10 aa, Borrelia burgdorferi B31
MLKVENLIPE

SEQ ID NO: 21713 - protein, 10 aa, Borrelia burgdorferi B31
LKVENLIPEE

SEQ ID NO: 21714 - protein, 10 aa, Borrelia burgdorferi B31
KVENLIPEEE

SEQ ID NO: 21715 - protein, 10 aa, Borrelia burgdorferi B31
VENLIPEEEY

SEQ ID NO: 21716 - protein, 10 aa, Borrelia burgdorferi B31
ENLIPEEEYN

SEQ ID NO: 21717 - protein, 10 aa, Borrelia burgdorferi B31
NLIPEEEYNQ

SEQ ID NO: 21718 - protein, 10 aa, Borrelia burgdorferi B31
LIPEEEYNQE

SEQ ID NO: 21719 - protein, 10 aa, Borrelia burgdorferi B31
IPEEEYNQEK

SEQ ID NO: 21720 - protein, 10 aa, Borrelia burgdorferi B31
PEEEYNQEKT

SEQ ID NO: 21721 - protein, 10 aa, Borrelia burgdorferi B31
EEEYNQEKTA

SEQ ID NO: 21722 - protein, 10 aa, Borrelia burgdorferi B31
EEYNQEKTAI

SEQ ID NO: 21723 - protein, 10 aa, Borrelia burgdorferi B31
EYNQEKTAIK

SEQ ID NO: 21724 - protein, 10 aa, Borrelia burgdorferi B31
YNQEKTAIKE

SEQ ID NO: 21725 - protein, 10 aa, Borrelia burgdorferi B31
NQEKTAIKEK

SEQ ID NO: 21726 - protein, 10 aa, Borrelia burgdorferi B31
QEKTAIKEKE

SEQ ID NO: 21727 - protein, 10 aa, Borrelia burgdorferi B31
EKTAIKEKEK

SEQ ID NO: 21728 - protein, 10 aa, Borrelia burgdorferi B31
KTAIKEKEKT

SEQ ID NO: 21729 - protein, 10 aa, Borrelia burgdorferi B31
TAIKEKEKTP

SEQ ID NO: 21730 - protein, 10 aa, Borrelia burgdorferi B31
AIKEKEKTPK

SEQ ID NO: 21731 - protein, 10 aa, Borrelia burgdorferi B31
IKEKEKTPKI

SEQ ID NO: 21732 - protein, 10 aa, Borrelia burgdorferi B31
KEKEKTPKIG

SEQ ID NO: 21733 - protein, 10 aa, Borrelia burgdorferi B31
EKEKTPKIGL

SEQ ID NO: 21734 - protein, 10 aa, Borrelia burgdorferi B31
KEKTPKIGLH

SEQ ID NO: 21735 - protein, 10 aa, Borrelia burgdorferi B31
EKTPKIGLHF

SEQ ID NO: 21736 - protein, 10 aa, Borrelia burgdorferi B31
KTPKIGLHFT

SEQ ID NO: 21737 - protein, 10 aa, Borrelia burgdorferi B31
TPKIGLHFTY

SEQ ID NO: 21738 - protein, 10 aa, Borrelia burgdorferi B31
PKIGLHFTYC

SEQ ID NO: 21739 - protein, 10 aa, Borrelia burgdorferi B31
KIGLHFTYCG

SEQ ID NO: 21740 - protein, 10 aa, Borrelia burgdorferi B31
IGLHFTYCGF

SEQ ID NO: 21741 - protein, 10 aa, Borrelia burgdorferi B31
GLHFTYCGFE

SEQ ID NO: 21742 - protein, 10 aa, Borrelia burgdorferi B31
LHFTYCGFEI

SEQ ID NO: 21743 - protein, 10 aa, Borrelia burgdorferi B31
HFTYCGFEIL

SEQ ID NO: 21744 - protein, 10 aa, Borrelia burgdorferi B31
FTYCGFEILI

SEQ ID NO: 21745 - protein, 10 aa, Borrelia burgdorferi B31
TYCGFEILIG

SEQ ID NO: 21746 - protein, 10 aa, Borrelia burgdorferi B31
YCGFEILIGR

SEQ ID NO: 21747 - protein, 10 aa, Borrelia burgdorferi B31
CGFEILIGRN

SEQ ID NO: 21748 - protein, 10 aa, Borrelia burgdorferi B31
GFEILIGRNA

SEQ ID NO: 21749 - protein, 10 aa, Borrelia burgdorferi B31
FEILIGRNAK

SEQ ID NO: 21750 - protein, 10 aa, Borrelia burgdorferi B31
EILIGRNAKE

SEQ ID NO: 21751 - protein, 10 aa, Borrelia burgdorferi B31
ILIGRNAKEN

SEQ ID NO: 21752 - protein, 10 aa, Borrelia burgdorferi B31
LIGRNAKEND

SEQ ID NO: 21753 - protein, 10 aa, Borrelia burgdorferi B31
IGRNAKENDK

SEQ ID NO: 21754 - protein, 10 aa, Borrelia burgdorferi B31
GRNAKENDKL

SEQ ID NO: 21755 - protein, 10 aa, Borrelia burgdorferi B31
RNAKENDKLL

SEQ ID NO: 21756 - protein, 10 aa, Borrelia burgdorferi B31
NAKENDKLLR

SEQ ID NO: 21757 - protein, 10 aa, Borrelia burgdorferi B31
AKENDKLLRH

SEQ ID NO: 21758 - protein, 10 aa, Borrelia burgdorferi B31
KENDKLLRHC

SEQ ID NO: 21759 - protein, 10 aa, Borrelia burgdorferi B31
ENDKLLRHCV

SEQ ID NO: 21760 - protein, 10 aa, Borrelia burgdorferi B31
NDKLLRHCVK

SEQ ID NO: 21761 - protein, 10 aa, Borrelia burgdorferi B31
DKLLRHCVKG

SEQ ID NO: 21762 - protein, 10 aa, Borrelia burgdorferi B31
KLLRHCVKGN

SEQ ID NO: 21763 - protein, 10 aa, Borrelia burgdorferi B31
LLRHCVKGND

SEQ ID NO: 21764 - protein, 10 aa, Borrelia burgdorferi B31
LRHCVKGNDY

SEQ ID NO: 21765 - protein, 10 aa, Borrelia burgdorferi B31
RHCVKGNDYW

SEQ ID NO: 21766 - protein, 10 aa, Borrelia burgdorferi B31
HCVKGNDYWL

SEQ ID NO: 21767 - protein, 10 aa, Borrelia burgdorferi B31
CVKGNDYWLH

SEQ ID NO: 21768 - protein, 10 aa, Borrelia burgdorferi B31
VKGNDYWLHT

SEQ ID NO: 21769 - protein, 10 aa, Borrelia burgdorferi B31
KGNDYWLHTR

SEQ ID NO: 21770 - protein, 10 aa, Borrelia burgdorferi B31
GNDYWLHTRD

SEQ ID NO: 21771 - protein, 10 aa, Borrelia burgdorferi B31
NDYWLHTRDY

SEQ ID NO: 21772 - protein, 10 aa, Borrelia burgdorferi B31
DYWLHTRDYP

SEQ ID NO: 21773 - protein, 10 aa, Borrelia burgdorferi B31
YWLHTRDYPG

SEQ ID NO: 21774 - protein, 10 aa, Borrelia burgdorferi B31
WLHTRDYPGA

SEQ ID NO: 21775 - protein, 10 aa, Borrelia burgdorferi B31
LHTRDYPGAY

SEQ ID NO: 21776 - protein, 10 aa, Borrelia burgdorferi B31
HTRDYPGAYV

SEQ ID NO: 21777 - protein, 10 aa, Borrelia burgdorferi B31
TRDYPGAYVF

SEQ ID NO: 21778 - protein, 10 aa, Borrelia burgdorferi B31
RDYPGAYVFI

SEQ ID NO: 21779 - protein, 10 aa, Borrelia burgdorferi B31
DYPGAYVFIK

SEQ ID NO: 21780 - protein, 10 aa, Borrelia burgdorferi B31
YPGAYVFIKN

SEQ ID NO: 21781 - protein, 10 aa, Borrelia burgdorferi B31
PGAYVFIKNQ

SEQ ID NO: 21782 - protein, 10 aa, Borrelia burgdorferi B31
GAYVFIKNQK

SEQ ID NO: 21783 - protein, 10 aa, Borrelia burgdorferi B31
AYVFIKNQKN

SEQ ID NO: 21784 - protein, 10 aa, Borrelia burgdorferi B31
YVFIKNQKNK

SEQ ID NO: 21785 - protein, 10 aa, Borrelia burgdorferi B31
VFIKNQKNKT

SEQ ID NO: 21786 - protein, 10 aa, Borrelia burgdorferi B31
FIKNQKNKTP

SEQ ID NO: 21787 - protein, 10 aa, Borrelia burgdorferi B31
IKNQKNKTPS

SEQ ID NO: 21788 - protein, 10 aa, Borrelia burgdorferi B31
KNQKNKTPSL

SEQ ID NO: 21789 - protein, 10 aa, Borrelia burgdorferi B31
NQKNKTPSLD

SEQ ID NO: 21790 - protein, 10 aa, Borrelia burgdorferi B31
QKNKTPSLDV

SEQ ID NO: 21791 - protein, 10 aa, Borrelia burgdorferi B31
KNKTPSLDVL

SEQ ID NO: 21792 - protein, 10 aa, Borrelia burgdorferi B31
NKTPSLDVLL

SEQ ID NO: 21793 - protein, 10 aa, Borrelia burgdorferi B31
KTPSLDVLLG

SEQ ID NO: 21794 - protein, 10 aa, Borrelia burgdorferi B31
TPSLDVLLGA

SEQ ID NO: 21795 - protein, 10 aa, Borrelia burgdorferi B31
PSLDVLLGAG

SEQ ID NO: 21796 - protein, 10 aa, Borrelia burgdorferi B31
SLDVLLGAGN

SEQ ID NO: 21797 - protein, 10 aa, Borrelia burgdorferi B31
LDVLLGAGNL

SEQ ID NO: 21798 - protein, 10 aa, Borrelia burgdorferi B31
DVLLGAGNLC

SEQ ID NO: 21799 - protein, 10 aa, Borrelia burgdorferi B31
VLLGAGNLCV

SEQ ID NO: 21800 - protein, 10 aa, Borrelia burgdorferi B31
LLGAGNLCVF

SEQ ID NO: 21801 - protein, 10 aa, Borrelia burgdorferi B31
LGAGNLCVFY

SEQ ID NO: 21802 - protein, 10 aa, Borrelia burgdorferi B31
GAGNLCVFYT

SEQ ID NO: 21803 - protein, 10 aa, Borrelia burgdorferi B31
AGNLCVFYTK

SEQ ID NO: 21804 - protein, 10 aa, Borrelia burgdorferi B31
GNLCVFYTKL

SEQ ID NO: 21805 - protein, 10 aa, Borrelia burgdorferi B31
NLCVFYTKLA

SEQ ID NO: 21806 - protein, 10 aa, Borrelia burgdorferi B31
LCVFYTKLAK

SEQ ID NO: 21807 - protein, 10 aa, Borrelia burgdorferi B31
CVFYTKLAKK

SEQ ID NO: 21808 - protein, 10 aa, Borrelia burgdorferi B31
VFYTKLAKKS

SEQ ID NO: 21809 - protein, 10 aa, Borrelia burgdorferi B31
FYTKLAKKSG

SEQ ID NO: 21810 - protein, 10 aa, Borrelia burgdorferi B31
YTKLAKKSGK

SEQ ID NO: 21811 - protein, 10 aa, Borrelia burgdorferi B31
TKLAKKSGKA

SEQ ID NO: 21812 - protein, 10 aa, Borrelia burgdorferi B31
KLAKKSGKAD

SEQ ID NO: 21813 - protein, 10 aa, Borrelia burgdorferi B31
LAKKSGKADL

SEQ ID NO: 21814 - protein, 10 aa, Borrelia burgdorferi B31
AKKSGKADLY

SEQ ID NO: 21815 - protein, 10 aa, Borrelia burgdorferi B31
KKSGKADLYY

SEQ ID NO: 21816 - protein, 10 aa, Borrelia burgdorferi B31
KSGKADLYYT

SEQ ID NO: 21817 - protein, 10 aa, Borrelia burgdorferi B31
SGKADLYYTQ

SEQ ID NO: 21818 - protein, 10 aa, Borrelia burgdorferi B31
GKADLYYTQV

SEQ ID NO: 21819 - protein, 10 aa, Borrelia burgdorferi B31
KADLYYTQVK

SEQ ID NO: 21820 - protein, 10 aa, Borrelia burgdorferi B31
ADLYYTQVKN

SEQ ID NO: 21821 - protein, 10 aa, Borrelia burgdorferi B31
DLYYTQVKNL

SEQ ID NO: 21822 - protein, 10 aa, Borrelia burgdorferi B31
LYYTQVKNLR

SEQ ID NO: 21823 - protein, 10 aa, Borrelia burgdorferi B31
YYTQVKNLRR

SEQ ID NO: 21824 - protein, 10 aa, Borrelia burgdorferi B31
YTQVKNLRRV

SEQ ID NO: 21825 - protein, 10 aa, Borrelia burgdorferi B31
TQVKNLRRVK

SEQ ID NO: 21826 - protein, 10 aa, Borrelia burgdorferi B31
QVKNLRRVKN

SEQ ID NO: 21827 - protein, 10 aa, Borrelia burgdorferi B31
VKNLRRVKNK

SEQ ID NO: 21828 - protein, 10 aa, Borrelia burgdorferi B31
KNLRRVKNKK

SEQ ID NO: 21829 - protein, 10 aa, Borrelia burgdorferi B31
NLRRVKNKKL

SEQ ID NO: 21830 - protein, 10 aa, Borrelia burgdorferi B31
LRRVKNKKLG

SEQ ID NO: 21831 - protein, 10 aa, Borrelia burgdorferi B31
RRVKNKKLGL

SEQ ID NO: 21832 - protein, 10 aa, Borrelia burgdorferi B31
RVKNKKLGLV

SEQ ID NO: 21833 - protein, 10 aa, Borrelia burgdorferi B31
VKNKKLGLVI

SEQ ID NO: 21834 - protein, 10 aa, Borrelia burgdorferi B31
KNKKLGLVIP

SEQ ID NO: 21835 - protein, 10 aa, Borrelia burgdorferi B31
NKKLGLVIPK

SEQ ID NO: 21836 - protein, 10 aa, Borrelia burgdorferi B31
KKLGLVIPKA

SEQ ID NO: 21837 - protein, 10 aa, Borrelia burgdorferi B31
KLGLVIPKAE

SEQ ID NO: 21838 - protein, 10 aa, Borrelia burgdorferi B31
LGLVIPKAEK

SEQ ID NO: 21839 - protein, 10 aa, Borrelia burgdorferi B31
GLVIPKAEKN

SEQ ID NO: 21840 - protein, 10 aa, Borrelia burgdorferi B31
LVIPKAEKNL

SEQ ID NO: 21841 - protein, 10 aa, Borrelia burgdorferi B31
VIPKAEKNLH

SEQ ID NO: 21842 - protein, 10 aa, Borrelia burgdorferi B31
IPKAEKNLHI

SEQ ID NO: 21843 - protein, 10 aa, Borrelia burgdorferi B31
PKAEKNLHIK

SEQ ID NO: 21844 - protein, 10 aa, Borrelia burgdorferi B31
KAEKNLHIKL

SEQ ID NO: 21845 - protein, 10 aa, Borrelia burgdorferi B31
AEKNLHIKLD

SEQ ID NO: 21846 - protein, 10 aa, Borrelia burgdorferi B31
EKNLHIKLDE

SEQ ID NO: 21847 - protein, 10 aa, Borrelia burgdorferi B31
KNLHIKLDEN

SEQ ID NO: 21848 - protein, 10 aa, Borrelia burgdorferi B31
NLHIKLDENL

SEQ ID NO: 21849 - protein, 10 aa, Borrelia burgdorferi B31
LHIKLDENLI

SEQ ID NO: 21850 - protein, 10 aa, Borrelia burgdorferi B31
HIKLDENLIK

SEQ ID NO: 21851 - protein, 10 aa, Borrelia burgdorferi B31
IKLDENLIKK

SEQ ID NO: 21852 - protein, 10 aa, Borrelia burgdorferi B31
KLDENLIKKI

SEQ ID NO: 21853 - protein, 10 aa, Borrelia burgdorferi B31
LDENLIKKIK

SEQ ID NO: 21854 - protein, 10 aa, Borrelia burgdorferi B31
DENLIKKIKN

SEQ ID NO: 21855 - protein, 10 aa, Borrelia burgdorferi B31
ENLIKKIKNQ

SEQ ID NO: 21856 - protein, 10 aa, Borrelia burgdorferi B31
NLIKKIKNQT

SEQ ID NO: 21857 - protein, 11 aa, Borrelia burgdorferi B31
MIKMSLNYTEI

SEQ ID NO: 21858 - protein, 11 aa, Borrelia burgdorferi B31
IKMSLNYTEIN

SEQ ID NO: 21859 - protein, 11 aa, Borrelia burgdorferi B31
KMSLNYTEINT

SEQ ID NO: 21860 - protein, 11 aa, Borrelia burgdorferi B31
MSLNYTEINTL

SEQ ID NO: 21861 - protein, 11 aa, Borrelia burgdorferi B31
SLNYTEINTLI

SEQ ID NO: 21862 - protein, 11 aa, Borrelia burgdorferi B31
LNYTEINTLIK

SEQ ID NO: 21863 - protein, 11 aa, Borrelia burgdorferi B31
NYTEINTLIKE

SEQ ID NO: 21864 - protein, 11 aa, Borrelia burgdorferi B31
YTEINTLIKEI

SEQ ID NO: 21865 - protein, 11 aa, Borrelia burgdorferi B31
TEINTLIKEIP

SEQ ID NO: 21866 - protein, 11 aa, Borrelia burgdorferi B31
EINTLIKEIPF

SEQ ID NO: 21867 - protein, 11 aa, Borrelia burgdorferi B31
INTLIKEIPFT

SEQ ID NO: 21868 - protein, 11 aa, Borrelia burgdorferi B31
NTLIKEIPFTN

SEQ ID NO: 21869 - protein, 11 aa, Borrelia burgdorferi B31
TLIKEIPFTNS

SEQ ID NO: 21870 - protein, 11 aa, Borrelia burgdorferi B31
LIKEIPFTNSL

SEQ ID NO: 21871 - protein, 11 aa, Borrelia burgdorferi B31
IKEIPFTNSLI

SEQ ID NO: 21872 - protein, 11 aa, Borrelia burgdorferi B31
KEIPFTNSLIT

SEQ ID NO: 21873 - protein, 11 aa, Borrelia burgdorferi B31
EIPFTNSLITK

SEQ ID NO: 21874 - protein, 11 aa, Borrelia burgdorferi B31
IPFTNSLITKI

SEQ ID NO: 21875 - protein, 11 aa, Borrelia burgdorferi B31
PFTNSLITKII

SEQ ID NO: 21876 - protein, 11 aa, Borrelia burgdorferi B31
FTNSLITKIIQ

SEQ ID NO: 21877 - protein, 11 aa, Borrelia burgdorferi B31
TNSLITKIIQP

SEQ ID NO: 21878 - protein, 11 aa, Borrelia burgdorferi B31
NSLITKIIQPD

SEQ ID NO: 21879 - protein, 11 aa, Borrelia burgdorferi B31
SLITKIIQPDY

SEQ ID NO: 21880 - protein, 11 aa, Borrelia burgdorferi B31
LITKIIQPDYK

SEQ ID NO: 21881 - protein, 11 aa, Borrelia burgdorferi B31
ITKIIQPDYKS

SEQ ID NO: 21882 - protein, 11 aa, Borrelia burgdorferi B31
TKIIQPDYKSL

SEQ ID NO: 21883 - protein, 11 aa, Borrelia burgdorferi B31
KIIQPDYKSLV

SEQ ID NO: 21884 - protein, 11 aa, Borrelia burgdorferi B31
IIQPDYKSLVL

SEQ ID NO: 21885 - protein, 11 aa, Borrelia burgdorferi B31
IQPDYKSLVLE

SEQ ID NO: 21886 - protein, 11 aa, Borrelia burgdorferi B31
QPDYKSLVLEI

SEQ ID NO: 21887 - protein, 11 aa, Borrelia burgdorferi B31
PDYKSLVLEIY

SEQ ID NO: 21888 - protein, 11 aa, Borrelia burgdorferi B31
DYKSLVLEIYN

SEQ ID NO: 21889 - protein, 11 aa, Borrelia burgdorferi B31
YKSLVLEIYNK

SEQ ID NO: 21890 - protein, 11 aa, Borrelia burgdorferi B31
KSLVLEIYNKI

SEQ ID NO: 21891 - protein, 11 aa, Borrelia burgdorferi B31
SLVLEIYNKID

SEQ ID NO: 21892 - protein, 11 aa, Borrelia burgdorferi B31
LVLEIYNKIDN

SEQ ID NO: 21893 - protein, 11 aa, Borrelia burgdorferi B31
VLEIYNKIDNK

SEQ ID NO: 21894 - protein, 11 aa, Borrelia burgdorferi B31
LEIYNKIDNKK

SEQ ID NO: 21895 - protein, 11 aa, Borrelia burgdorferi B31
EIYNKIDNKKF

SEQ ID NO: 21896 - protein, 11 aa, Borrelia burgdorferi B31
IYNKIDNKKFK

SEQ ID NO: 21897 - protein, 11 aa, Borrelia burgdorferi B31
YNKIDNKKFKI

SEQ ID NO: 21898 - protein, 11 aa, Borrelia burgdorferi B31
NKIDNKKFKIL

SEQ ID NO: 21899 - protein, 11 aa, Borrelia burgdorferi B31
KIDNKKFKILI

SEQ ID NO: 21900 - protein, 11 aa, Borrelia burgdorferi B31
IDNKKFKILIC

SEQ ID NO: 21901 - protein, 11 aa, Borrelia burgdorferi B31
DNKKFKILICL

SEQ ID NO: 21902 - protein, 11 aa, Borrelia burgdorferi B31
NKKFKILICLN

SEQ ID NO: 21903 - protein, 11 aa, Borrelia burgdorferi B31
KKFKILICLNP

SEQ ID NO: 21904 - protein, 11 aa, Borrelia burgdorferi B31
KFKILICLNPN

SEQ ID NO: 21905 - protein, 11 aa, Borrelia burgdorferi B31
FKILICLNPNT

SEQ ID NO: 21906 - protein, 11 aa, Borrelia burgdorferi B31
KILICLNPNTT

SEQ ID NO: 21907 - protein, 11 aa, Borrelia burgdorferi B31
ILICLNPNTTR

SEQ ID NO: 21908 - protein, 11 aa, Borrelia burgdorferi B31
LICLNPNTTRF

SEQ ID NO: 21909 - protein, 11 aa, Borrelia burgdorferi B31
ICLNPNTTRFH

SEQ ID NO: 21910 - protein, 11 aa, Borrelia burgdorferi B31
CLNPNTTRFHI

SEQ ID NO: 21911 - protein, 11 aa, Borrelia burgdorferi B31
LNPNTTRFHIT

SEQ ID NO: 21912 - protein, 11 aa, Borrelia burgdorferi B31
NPNTTRFHITK

SEQ ID NO: 21913 - protein, 11 aa, Borrelia burgdorferi B31
PNTTRFHITKK

SEQ ID NO: 21914 - protein, 11 aa, Borrelia burgdorferi B31
NTTRFHITKKN

SEQ ID NO: 21915 - protein, 11 aa, Borrelia burgdorferi B31
TTRFHITKKNF

SEQ ID NO: 21916 - protein, 11 aa, Borrelia burgdorferi B31
TRFHITKKNFK

SEQ ID NO: 21917 - protein, 11 aa, Borrelia burgdorferi B31
RFHITKKNFKK

SEQ ID NO: 21918 - protein, 11 aa, Borrelia burgdorferi B31
FHITKKNFKKN

SEQ ID NO: 21919 - protein, 11 aa, Borrelia burgdorferi B31
HITKKNFKKNA

SEQ ID NO: 21920 - protein, 11 aa, Borrelia burgdorferi B31
ITKKNFKKNAL

SEQ ID NO: 21921 - protein, 11 aa, Borrelia burgdorferi B31
TKKNFKKNALK

SEQ ID NO: 21922 - protein, 11 aa, Borrelia burgdorferi B31
KKNFKKNALKL

SEQ ID NO: 21923 - protein, 11 aa, Borrelia burgdorferi B31
KNFKKNALKLR

SEQ ID NO: 21924 - protein, 11 aa, Borrelia burgdorferi B31
NFKKNALKLRF

SEQ ID NO: 21925 - protein, 11 aa, Borrelia burgdorferi B31
FKKNALKLRFS

SEQ ID NO: 21926 - protein, 11 aa, Borrelia burgdorferi B31
KKNALKLRFSD

SEQ ID NO: 21927 - protein, 11 aa, Borrelia burgdorferi B31
KNALKLRFSDF

SEQ ID NO: 21928 - protein, 11 aa, Borrelia burgdorferi B31
NALKLRFSDFL

SEQ ID NO: 21929 - protein, 11 aa, Borrelia burgdorferi B31
ALKLRFSDFLK

SEQ ID NO: 21930 - protein, 11 aa, Borrelia burgdorferi B31
LKLRFSDFLKS

SEQ ID NO: 21931 - protein, 11 aa, Borrelia burgdorferi B31
KLRFSDFLKSK

SEQ ID NO: 21932 - protein, 11 aa, Borrelia burgdorferi B31
LRFSDFLKSKI

SEQ ID NO: 21933 - protein, 11 aa, Borrelia burgdorferi B31
RFSDFLKSKIQ

SEQ ID NO: 21934 - protein, 11 aa, Borrelia burgdorferi B31
FSDFLKSKIQN

SEQ ID NO: 21935 - protein, 11 aa, Borrelia burgdorferi B31
SDFLKSKIQNG

SEQ ID NO: 21936 - protein, 11 aa, Borrelia burgdorferi B31
DFLKSKIQNGK

SEQ ID NO: 21937 - protein, 11 aa, Borrelia burgdorferi B31
FLKSKIQNGKI

SEQ ID NO: 21938 - protein, 11 aa, Borrelia burgdorferi B31
LKSKIQNGKII

SEQ ID NO: 21939 - protein, 11 aa, Borrelia burgdorferi B31
KSKIQNGKIIK

SEQ ID NO: 21940 - protein, 11 aa, Borrelia burgdorferi B31
SKIQNGKIIKA

SEQ ID NO: 21941 - protein, 11 aa, Borrelia burgdorferi B31
KIQNGKIIKAF

SEQ ID NO: 21942 - protein, 11 aa, Borrelia burgdorferi B31
IQNGKIIKAFQ

SEQ ID NO: 21943 - protein, 11 aa, Borrelia burgdorferi B31
QNGKIIKAFQM

SEQ ID NO: 21944 - protein, 11 aa, Borrelia burgdorferi B31
NGKIIKAFQMK

SEQ ID NO: 21945 - protein, 11 aa, Borrelia burgdorferi B31
GKIIKAFQMKN

SEQ ID NO: 21946 - protein, 11 aa, Borrelia burgdorferi B31
KIIKAFQMKNE

SEQ ID NO: 21947 - protein, 11 aa, Borrelia burgdorferi B31
IIKAFQMKNER

SEQ ID NO: 21948 - protein, 11 aa, Borrelia burgdorferi B31
IKAFQMKNERI

SEQ ID NO: 21949 - protein, 11 aa, Borrelia burgdorferi B31
KAFQMKNERII

SEQ ID NO: 21950 - protein, 11 aa, Borrelia burgdorferi B31
AFQMKNERIIS

SEQ ID NO: 21951 - protein, 11 aa, Borrelia burgdorferi B31
FQMKNERIISL

SEQ ID NO: 21952 - protein, 11 aa, Borrelia burgdorferi B31
QMKNERIISLE

SEQ ID NO: 21953 - protein, 11 aa, Borrelia burgdorferi B31
MKNERIISLEI

SEQ ID NO: 21954 - protein, 11 aa, Borrelia burgdorferi B31
KNERIISLEIL

SEQ ID NO: 21955 - protein, 11 aa, Borrelia burgdorferi B31
NERIISLEILQ

SEQ ID NO: 21956 - protein, 11 aa, Borrelia burgdorferi B31
ERIISLEILQK

SEQ ID NO: 21957 - protein, 11 aa, Borrelia burgdorferi B31
RIISLEILQKD

SEQ ID NO: 21958 - protein, 11 aa, Borrelia burgdorferi B31
IISLEILQKDM

SEQ ID NO: 21959 - protein, 11 aa, Borrelia burgdorferi B31
ISLEILQKDMI

SEQ ID NO: 21960 - protein, 11 aa, Borrelia burgdorferi B31
SLEILQKDMII

SEQ ID NO: 21961 - protein, 11 aa, Borrelia burgdorferi B31
LEILQKDMIIL

SEQ ID NO: 21962 - protein, 11 aa, Borrelia burgdorferi B31
EILQKDMIILF

SEQ ID NO: 21963 - protein, 11 aa, Borrelia burgdorferi B31
ILQKDMIILFI

SEQ ID NO: 21964 - protein, 11 aa, Borrelia burgdorferi B31
LQKDMIILFIK

SEQ ID NO: 21965 - protein, 11 aa, Borrelia burgdorferi B31
QKDMIILFIKL

SEQ ID NO: 21966 - protein, 11 aa, Borrelia burgdorferi B31
KDMIILFIKLW

SEQ ID NO: 21967 - protein, 11 aa, Borrelia burgdorferi B31
DMIILFIKLWP

SEQ ID NO: 21968 - protein, 11 aa, Borrelia burgdorferi B31
MIILFIKLWPS

SEQ ID NO: 21969 - protein, 11 aa, Borrelia burgdorferi B31
IILFIKLWPSS

SEQ ID NO: 21970 - protein, 11 aa, Borrelia burgdorferi B31
ILFIKLWPSSP

SEQ ID NO: 21971 - protein, 11 aa, Borrelia burgdorferi B31
LFIKLWPSSPN

SEQ ID NO: 21972 - protein, 11 aa, Borrelia burgdorferi B31
FIKLWPSSPNI

SEQ ID NO: 21973 - protein, 11 aa, Borrelia burgdorferi B31
IKLWPSSPNII

SEQ ID NO: 21974 - protein, 11 aa, Borrelia burgdorferi B31
KLWPSSPNIIA

SEQ ID NO: 21975 - protein, 11 aa, Borrelia burgdorferi B31
LWPSSPNIIAT

SEQ ID NO: 21976 - protein, 11 aa, Borrelia burgdorferi B31
WPSSPNIIATN

SEQ ID NO: 21977 - protein, 11 aa, Borrelia burgdorferi B31
PSSPNIIATNS

SEQ ID NO: 21978 - protein, 11 aa, Borrelia burgdorferi B31
SSPNIIATNSN

SEQ ID NO: 21979 - protein, 11 aa, Borrelia burgdorferi B31
SPNIIATNSNF

SEQ ID NO: 21980 - protein, 11 aa, Borrelia burgdorferi B31
PNIIATNSNFK

SEQ ID NO: 21981 - protein, 11 aa, Borrelia burgdorferi B31
NIIATNSNFKI

SEQ ID NO: 21982 - protein, 11 aa, Borrelia burgdorferi B31
IIATNSNFKIL

SEQ ID NO: 21983 - protein, 11 aa, Borrelia burgdorferi B31
IATNSNFKILD

SEQ ID NO: 21984 - protein, 11 aa, Borrelia burgdorferi B31
ATNSNFKILDA

SEQ ID NO: 21985 - protein, 11 aa, Borrelia burgdorferi B31
TNSNFKILDAY

SEQ ID NO: 21986 - protein, 11 aa, Borrelia burgdorferi B31
NSNFKILDAYY

SEQ ID NO: 21987 - protein, 11 aa, Borrelia burgdorferi B31
SNFKILDAYYR

SEQ ID NO: 21988 - protein, 11 aa, Borrelia burgdorferi B31
NFKILDAYYRR

SEQ ID NO: 21989 - protein, 11 aa, Borrelia burgdorferi B31
FKILDAYYRRP

SEQ ID NO: 21990 - protein, 11 aa, Borrelia burgdorferi B31
KILDAYYRRPK

SEQ ID NO: 21991 - protein, 11 aa, Borrelia burgdorferi B31
ILDAYYRRPKI

SEQ ID NO: 21992 - protein, 11 aa, Borrelia burgdorferi B31
LDAYYRRPKIK

SEQ ID NO: 21993 - protein, 11 aa, Borrelia burgdorferi B31
DAYYRRPKIKE

SEQ ID NO: 21994 - protein, 11 aa, Borrelia burgdorferi B31
AYYRRPKIKET

SEQ ID NO: 21995 - protein, 11 aa, Borrelia burgdorferi B31
YYRRPKIKETT

SEQ ID NO: 21996 - protein, 11 aa, Borrelia burgdorferi B31
YRRPKIKETTG

SEQ ID NO: 21997 - protein, 11 aa, Borrelia burgdorferi B31
RRPKIKETTGE

SEQ ID NO: 21998 - protein, 11 aa, Borrelia burgdorferi B31
RPKIKETTGEI

SEQ ID NO: 21999 - protein, 11 aa, Borrelia burgdorferi B31
PKIKETTGEIF

SEQ ID NO: 22000 - protein, 11 aa, Borrelia burgdorferi B31
KIKETTGEIFL

SEQ ID NO: 22001 - protein, 11 aa, Borrelia burgdorferi B31
IKETTGEIFLK

SEQ ID NO: 22002 - protein, 11 aa, Borrelia burgdorferi B31
KETTGEIFLKA

SEQ ID NO: 22003 - protein, 11 aa, Borrelia burgdorferi B31
ETTGEIFLKAK

SEQ ID NO: 22004 - protein, 11 aa, Borrelia burgdorferi B31
TTGEIFLKAKE

SEQ ID NO: 22005 - protein, 11 aa, Borrelia burgdorferi B31
TGEIFLKAKEI

SEQ ID NO: 22006 - protein, 11 aa, Borrelia burgdorferi B31
GEIFLKAKEIH

SEQ ID NO: 22007 - protein, 11 aa, Borrelia burgdorferi B31
EIFLKAKEIHE

SEQ ID NO: 22008 - protein, 11 aa, Borrelia burgdorferi B31
IFLKAKEIHES

SEQ ID NO: 22009 - protein, 11 aa, Borrelia burgdorferi B31
FLKAKEIHESN

SEQ ID NO: 22010 - protein, 11 aa, Borrelia burgdorferi B31
LKAKEIHESNK

SEQ ID NO: 22011 - protein, 11 aa, Borrelia burgdorferi B31
KAKEIHESNKM

SEQ ID NO: 22012 - protein, 11 aa, Borrelia burgdorferi B31
AKEIHESNKMS

SEQ ID NO: 22013 - protein, 11 aa, Borrelia burgdorferi B31
KEIHESNKMSD

SEQ ID NO: 22014 - protein, 11 aa, Borrelia burgdorferi B31
EIHESNKMSDK

SEQ ID NO: 22015 - protein, 11 aa, Borrelia burgdorferi B31
IHESNKMSDKK

SEQ ID NO: 22016 - protein, 11 aa, Borrelia burgdorferi B31
HESNKMSDKKI

SEQ ID NO: 22017 - protein, 11 aa, Borrelia burgdorferi B31
ESNKMSDKKIM

SEQ ID NO: 22018 - protein, 11 aa, Borrelia burgdorferi B31
SNKMSDKKIME

SEQ ID NO: 22019 - protein, 11 aa, Borrelia burgdorferi B31
NKMSDKKIMEL

SEQ ID NO: 22020 - protein, 11 aa, Borrelia burgdorferi B31
KMSDKKIMELK

SEQ ID NO: 22021 - protein, 11 aa, Borrelia burgdorferi B31
MSDKKIMELKE

SEQ ID NO: 22022 - protein, 11 aa, Borrelia burgdorferi B31
SDKKIMELKEE

SEQ ID NO: 22023 - protein, 11 aa, Borrelia burgdorferi B31
DKKIMELKEEY

SEQ ID NO: 22024 - protein, 11 aa, Borrelia burgdorferi B31
KKIMELKEEYN

SEQ ID NO: 22025 - protein, 11 aa, Borrelia burgdorferi B31
KIMELKEEYNN

SEQ ID NO: 22026 - protein, 11 aa, Borrelia burgdorferi B31
IMELKEEYNNT

SEQ ID NO: 22027 - protein, 11 aa, Borrelia burgdorferi B31
MELKEEYNNTS

SEQ ID NO: 22028 - protein, 11 aa, Borrelia burgdorferi B31
ELKEEYNNTSY

SEQ ID NO: 22029 - protein, 11 aa, Borrelia burgdorferi B31
LKEEYNNTSYT

SEQ ID NO: 22030 - protein, 11 aa, Borrelia burgdorferi B31
KEEYNNTSYTS

SEQ ID NO: 22031 - protein, 11 aa, Borrelia burgdorferi B31
EEYNNTSYTSY

SEQ ID NO: 22032 - protein, 11 aa, Borrelia burgdorferi B31
EYNNTSYTSYS

SEQ ID NO: 22033 - protein, 11 aa, Borrelia burgdorferi B31
YNNTSYTSYSE

SEQ ID NO: 22034 - protein, 11 aa, Borrelia burgdorferi B31
NNTSYTSYSEF

SEQ ID NO: 22035 - protein, 11 aa, Borrelia burgdorferi B31
NTSYTSYSEFL

SEQ ID NO: 22036 - protein, 11 aa, Borrelia burgdorferi B31
TSYTSYSEFLE

SEQ ID NO: 22037 - protein, 11 aa, Borrelia burgdorferi B31
SYTSYSEFLEN

SEQ ID NO: 22038 - protein, 11 aa, Borrelia burgdorferi B31
YTSYSEFLENY

SEQ ID NO: 22039 - protein, 11 aa, Borrelia burgdorferi B31
TSYSEFLENYY

SEQ ID NO: 22040 - protein, 11 aa, Borrelia burgdorferi B31
SYSEFLENYYE

SEQ ID NO: 22041 - protein, 11 aa, Borrelia burgdorferi B31
YSEFLENYYES

SEQ ID NO: 22042 - protein, 11 aa, Borrelia burgdorferi B31
SEFLENYYESL

SEQ ID NO: 22043 - protein, 11 aa, Borrelia burgdorferi B31
EFLENYYESLN

SEQ ID NO: 22044 - protein, 11 aa, Borrelia burgdorferi B31
FLENYYESLND

SEQ ID NO: 22045 - protein, 11 aa, Borrelia burgdorferi B31
LENYYESLNDQ

SEQ ID NO: 22046 - protein, 11 aa, Borrelia burgdorferi B31
ENYYESLNDQI

SEQ ID NO: 22047 - protein, 11 aa, Borrelia burgdorferi B31
NYYESLNDQIK

SEQ ID NO: 22048 - protein, 11 aa, Borrelia burgdorferi B31
YYESLNDQIKK

SEQ ID NO: 22049 - protein, 11 aa, Borrelia burgdorferi B31
YESLNDQIKKT

SEQ ID NO: 22050 - protein, 11 aa, Borrelia burgdorferi B31
ESLNDQIKKTN

SEQ ID NO: 22051 - protein, 11 aa, Borrelia burgdorferi B31
SLNDQIKKTNI

SEQ ID NO: 22052 - protein, 11 aa, Borrelia burgdorferi B31
LNDQIKKTNIK

SEQ ID NO: 22053 - protein, 11 aa, Borrelia burgdorferi B31
NDQIKKTNIKE

SEQ ID NO: 22054 - protein, 11 aa, Borrelia burgdorferi B31
DQIKKTNIKEL

SEQ ID NO: 22055 - protein, 11 aa, Borrelia burgdorferi B31
QIKKTNIKELL

SEQ ID NO: 22056 - protein, 11 aa, Borrelia burgdorferi B31
IKKTNIKELLI

SEQ ID NO: 22057 - protein, 11 aa, Borrelia burgdorferi B31
KKTNIKELLIE

SEQ ID NO: 22058 - protein, 11 aa, Borrelia burgdorferi B31
KTNIKELLIEK

SEQ ID NO: 22059 - protein, 11 aa, Borrelia burgdorferi B31
TNIKELLIEKY

SEQ ID NO: 22060 - protein, 11 aa, Borrelia burgdorferi B31
NIKELLIEKYK

SEQ ID NO: 22061 - protein, 11 aa, Borrelia burgdorferi B31
IKELLIEKYKK

SEQ ID NO: 22062 - protein, 11 aa, Borrelia burgdorferi B31
KELLIEKYKKE

SEQ ID NO: 22063 - protein, 11 aa, Borrelia burgdorferi B31
ELLIEKYKKEL

SEQ ID NO: 22064 - protein, 11 aa, Borrelia burgdorferi B31
LLIEKYKKELI

SEQ ID NO: 22065 - protein, 11 aa, Borrelia burgdorferi B31
LIEKYKKELIV

SEQ ID NO: 22066 - protein, 11 aa, Borrelia burgdorferi B31
IEKYKKELIVL

SEQ ID NO: 22067 - protein, 11 aa, Borrelia burgdorferi B31
EKYKKELIVLE

SEQ ID NO: 22068 - protein, 11 aa, Borrelia burgdorferi B31
KYKKELIVLEK

SEQ ID NO: 22069 - protein, 11 aa, Borrelia burgdorferi B31
YKKELIVLEKR

SEQ ID NO: 22070 - protein, 11 aa, Borrelia burgdorferi B31
KKELIVLEKRI

SEQ ID NO: 22071 - protein, 11 aa, Borrelia burgdorferi B31
KELIVLEKRID

SEQ ID NO: 22072 - protein, 11 aa, Borrelia burgdorferi B31
ELIVLEKRIDS

SEQ ID NO: 22073 - protein, 11 aa, Borrelia burgdorferi B31
LIVLEKRIDSL

SEQ ID NO: 22074 - protein, 11 aa, Borrelia burgdorferi B31
IVLEKRIDSLK

SEQ ID NO: 22075 - protein, 11 aa, Borrelia burgdorferi B31
VLEKRIDSLKQ

SEQ ID NO: 22076 - protein, 11 aa, Borrelia burgdorferi B31
LEKRIDSLKQQ

SEQ ID NO: 22077 - protein, 11 aa, Borrelia burgdorferi B31
EKRIDSLKQQI

SEQ ID NO: 22078 - protein, 11 aa, Borrelia burgdorferi B31
KRIDSLKQQIK

SEQ ID NO: 22079 - protein, 11 aa, Borrelia burgdorferi B31
RIDSLKQQIKL

SEQ ID NO: 22080 - protein, 11 aa, Borrelia burgdorferi B31
IDSLKQQIKLL

SEQ ID NO: 22081 - protein, 11 aa, Borrelia burgdorferi B31
DSLKQQIKLLE

SEQ ID NO: 22082 - protein, 11 aa, Borrelia burgdorferi B31
SLKQQIKLLEN

SEQ ID NO: 22083 - protein, 11 aa, Borrelia burgdorferi B31
LKQQIKLLENI

SEQ ID NO: 22084 - protein, 11 aa, Borrelia burgdorferi B31
KQQIKLLENIE

SEQ ID NO: 22085 - protein, 11 aa, Borrelia burgdorferi B31
QQIKLLENIEN

SEQ ID NO: 22086 - protein, 11 aa, Borrelia burgdorferi B31
QIKLLENIENE

SEQ ID NO: 22087 - protein, 11 aa, Borrelia burgdorferi B31
IKLLENIENEK

SEQ ID NO: 22088 - protein, 11 aa, Borrelia burgdorferi B31
KLLENIENEKE

SEQ ID NO: 22089 - protein, 11 aa, Borrelia burgdorferi B31
LLENIENEKEK

SEQ ID NO: 22090 - protein, 11 aa, Borrelia burgdorferi B31
LENIENEKEKG

SEQ ID NO: 22091 - protein, 11 aa, Borrelia burgdorferi B31
ENIENEKEKGE

SEQ ID NO: 22092 - protein, 11 aa, Borrelia burgdorferi B31
NIENEKEKGEL

SEQ ID NO: 22093 - protein, 11 aa, Borrelia burgdorferi B31
IENEKEKGELI

SEQ ID NO: 22094 - protein, 11 aa, Borrelia burgdorferi B31
ENEKEKGELIL

SEQ ID NO: 22095 - protein, 11 aa, Borrelia burgdorferi B31
NEKEKGELILL

SEQ ID NO: 22096 - protein, 11 aa, Borrelia burgdorferi B31
EKEKGELILLN

SEQ ID NO: 22097 - protein, 11 aa, Borrelia burgdorferi B31
KEKGELILLNI

SEQ ID NO: 22098 - protein, 11 aa, Borrelia burgdorferi B31
EKGELILLNIN

SEQ ID NO: 22099 - protein, 11 aa, Borrelia burgdorferi B31
KGELILLNINK

SEQ ID NO: 22100 - protein, 11 aa, Borrelia burgdorferi B31
GELILLNINKI

SEQ ID NO: 22101 - protein, 11 aa, Borrelia burgdorferi B31
ELILLNINKIQ

SEQ ID NO: 22102 - protein, 11 aa, Borrelia burgdorferi B31
LILLNINKIQK

SEQ ID NO: 22103 - protein, 11 aa, Borrelia burgdorferi B31
ILLNINKIQKG

SEQ ID NO: 22104 - protein, 11 aa, Borrelia burgdorferi B31
LLNINKIQKGI

SEQ ID NO: 22105 - protein, 11 aa, Borrelia burgdorferi B31
LNINKIQKGIK

SEQ ID NO: 22106 - protein, 11 aa, Borrelia burgdorferi B31
NINKIQKGIKE

SEQ ID NO: 22107 - protein, 11 aa, Borrelia burgdorferi B31
INKIQKGIKEI

SEQ ID NO: 22108 - protein, 11 aa, Borrelia burgdorferi B31
NKIQKGIKEIN

SEQ ID NO: 22109 - protein, 11 aa, Borrelia burgdorferi B31
KIQKGIKEINL

SEQ ID NO: 22110 - protein, 11 aa, Borrelia burgdorferi B31
IQKGIKEINLL

SEQ ID NO: 22111 - protein, 11 aa, Borrelia burgdorferi B31
QKGIKEINLLN

SEQ ID NO: 22112 - protein, 11 aa, Borrelia burgdorferi B31
KGIKEINLLNY

SEQ ID NO: 22113 - protein, 11 aa, Borrelia burgdorferi B31
GIKEINLLNYK

SEQ ID NO: 22114 - protein, 11 aa, Borrelia burgdorferi B31
IKEINLLNYKE

SEQ ID NO: 22115 - protein, 11 aa, Borrelia burgdorferi B31
KEINLLNYKEE

SEQ ID NO: 22116 - protein, 11 aa, Borrelia burgdorferi B31
EINLLNYKEEK

SEQ ID NO: 22117 - protein, 11 aa, Borrelia burgdorferi B31
INLLNYKEEKI

SEQ ID NO: 22118 - protein, 11 aa, Borrelia burgdorferi B31
NLLNYKEEKIK

SEQ ID NO: 22119 - protein, 11 aa, Borrelia burgdorferi B31
LLNYKEEKIKI

SEQ ID NO: 22120 - protein, 11 aa, Borrelia burgdorferi B31
LNYKEEKIKIS

SEQ ID NO: 22121 - protein, 11 aa, Borrelia burgdorferi B31
NYKEEKIKISL

SEQ ID NO: 22122 - protein, 11 aa, Borrelia burgdorferi B31
YKEEKIKISLN

SEQ ID NO: 22123 - protein, 11 aa, Borrelia burgdorferi B31
KEEKIKISLNQ

SEQ ID NO: 22124 - protein, 11 aa, Borrelia burgdorferi B31
EEKIKISLNQS

SEQ ID NO: 22125 - protein, 11 aa, Borrelia burgdorferi B31
EKIKISLNQSL

SEQ ID NO: 22126 - protein, 11 aa, Borrelia burgdorferi B31
KIKISLNQSLS

SEQ ID NO: 22127 - protein, 11 aa, Borrelia burgdorferi B31
IKISLNQSLSP

SEQ ID NO: 22128 - protein, 11 aa, Borrelia burgdorferi B31
KISLNQSLSPK

SEQ ID NO: 22129 - protein, 11 aa, Borrelia burgdorferi B31
ISLNQSLSPKE

SEQ ID NO: 22130 - protein, 11 aa, Borrelia burgdorferi B31
SLNQSLSPKEN

SEQ ID NO: 22131 - protein, 11 aa, Borrelia burgdorferi B31
LNQSLSPKENA

SEQ ID NO: 22132 - protein, 11 aa, Borrelia burgdorferi B31
NQSLSPKENAL

SEQ ID NO: 22133 - protein, 11 aa, Borrelia burgdorferi B31
QSLSPKENALQ

SEQ ID NO: 22134 - protein, 11 aa, Borrelia burgdorferi B31
SLSPKENALQY

SEQ ID NO: 22135 - protein, 11 aa, Borrelia burgdorferi B31
LSPKENALQYF

SEQ ID NO: 22136 - protein, 11 aa, Borrelia burgdorferi B31
SPKENALQYFK

SEQ ID NO: 22137 - protein, 11 aa, Borrelia burgdorferi B31
PKENALQYFKA

SEQ ID NO: 22138 - protein, 11 aa, Borrelia burgdorferi B31
KENALQYFKAY

SEQ ID NO: 22139 - protein, 11 aa, Borrelia burgdorferi B31
ENALQYFKAYK

SEQ ID NO: 22140 - protein, 11 aa, Borrelia burgdorferi B31
NALQYFKAYKK

SEQ ID NO: 22141 - protein, 11 aa, Borrelia burgdorferi B31
ALQYFKAYKKG

SEQ ID NO: 22142 - protein, 11 aa, Borrelia burgdorferi B31
LQYFKAYKKGK

SEQ ID NO: 22143 - protein, 11 aa, Borrelia burgdorferi B31
QYFKAYKKGKN

SEQ ID NO: 22144 - protein, 11 aa, Borrelia burgdorferi B31
YFKAYKKGKNS

SEQ ID NO: 22145 - protein, 11 aa, Borrelia burgdorferi B31
FKAYKKGKNSF

SEQ ID NO: 22146 - protein, 11 aa, Borrelia burgdorferi B31
KAYKKGKNSFK

SEQ ID NO: 22147 - protein, 11 aa, Borrelia burgdorferi B31
AYKKGKNSFKT

SEQ ID NO: 22148 - protein, 11 aa, Borrelia burgdorferi B31
YKKGKNSFKTI

SEQ ID NO: 22149 - protein, 11 aa, Borrelia burgdorferi B31
KKGKNSFKTIQ

SEQ ID NO: 22150 - protein, 11 aa, Borrelia burgdorferi B31
KGKNSFKTIQN

SEQ ID NO: 22151 - protein, 11 aa, Borrelia burgdorferi B31
GKNSFKTIQNQ

SEQ ID NO: 22152 - protein, 11 aa, Borrelia burgdorferi B31
KNSFKTIQNQL

SEQ ID NO: 22153 - protein, 11 aa, Borrelia burgdorferi B31
NSFKTIQNQLK

SEQ ID NO: 22154 - protein, 11 aa, Borrelia burgdorferi B31
SFKTIQNQLKD

SEQ ID NO: 22155 - protein, 11 aa, Borrelia burgdorferi B31
FKTIQNQLKDN

SEQ ID NO: 22156 - protein, 11 aa, Borrelia burgdorferi B31
KTIQNQLKDNL

SEQ ID NO: 22157 - protein, 11 aa, Borrelia burgdorferi B31
TIQNQLKDNLD

SEQ ID NO: 22158 - protein, 11 aa, Borrelia burgdorferi B31
IQNQLKDNLDK

SEQ ID NO: 22159 - protein, 11 aa, Borrelia burgdorferi B31
QNQLKDNLDKF

SEQ ID NO: 22160 - protein, 11 aa, Borrelia burgdorferi B31
NQLKDNLDKFN

SEQ ID NO: 22161 - protein, 11 aa, Borrelia burgdorferi B31
QLKDNLDKFNL

SEQ ID NO: 22162 - protein, 11 aa, Borrelia burgdorferi B31
LKDNLDKFNLI

SEQ ID NO: 22163 - protein, 11 aa, Borrelia burgdorferi B31
KDNLDKFNLIQ

SEQ ID NO: 22164 - protein, 11 aa, Borrelia burgdorferi B31
DNLDKFNLIQS

SEQ ID NO: 22165 - protein, 11 aa, Borrelia burgdorferi B31
NLDKFNLIQSK

SEQ ID NO: 22166 - protein, 11 aa, Borrelia burgdorferi B31
LDKFNLIQSKI

SEQ ID NO: 22167 - protein, 11 aa, Borrelia burgdorferi B31
DKFNLIQSKIT

SEQ ID NO: 22168 - protein, 11 aa, Borrelia burgdorferi B31
KFNLIQSKITM

SEQ ID NO: 22169 - protein, 11 aa, Borrelia burgdorferi B31
FNLIQSKITML

SEQ ID NO: 22170 - protein, 11 aa, Borrelia burgdorferi B31
NLIQSKITMLK

SEQ ID NO: 22171 - protein, 11 aa, Borrelia burgdorferi B31
LIQSKITMLKV

SEQ ID NO: 22172 - protein, 11 aa, Borrelia burgdorferi B31
IQSKITMLKVE

SEQ ID NO: 22173 - protein, 11 aa, Borrelia burgdorferi B31
QSKITMLKVEN

SEQ ID NO: 22174 - protein, 11 aa, Borrelia burgdorferi B31
SKITMLKVENL

SEQ ID NO: 22175 - protein, 11 aa, Borrelia burgdorferi B31
KITMLKVENLI

SEQ ID NO: 22176 - protein, 11 aa, Borrelia burgdorferi B31
ITMLKVENLIP

SEQ ID NO: 22177 - protein, 11 aa, Borrelia burgdorferi B31
TMLKVENLIPE

SEQ ID NO: 22178 - protein, 11 aa, Borrelia burgdorferi B31
MLKVENLIPEE

SEQ ID NO: 22179 - protein, 11 aa, Borrelia burgdorferi B31
LKVENLIPEEE

SEQ ID NO: 22180 - protein, 11 aa, Borrelia burgdorferi B31
KVENLIPEEEY

SEQ ID NO: 22181 - protein, 11 aa, Borrelia burgdorferi B31
VENLIPEEEYN

SEQ ID NO: 22182 - protein, 11 aa, Borrelia burgdorferi B31
ENLIPEEEYNQ

SEQ ID NO: 22183 - protein, 11 aa, Borrelia burgdorferi B31
NLIPEEEYNQE

SEQ ID NO: 22184 - protein, 11 aa, Borrelia burgdorferi B31
LIPEEEYNQEK

SEQ ID NO: 22185 - protein, 11 aa, Borrelia burgdorferi B31
IPEEEYNQEKT

SEQ ID NO: 22186 - protein, 11 aa, Borrelia burgdorferi B31
PEEEYNQEKTA

SEQ ID NO: 22187 - protein, 11 aa, Borrelia burgdorferi B31
EEEYNQEKTAI

SEQ ID NO: 22188 - protein, 11 aa, Borrelia burgdorferi B31
EEYNQEKTAIK

SEQ ID NO: 22189 - protein, 11 aa, Borrelia burgdorferi B31
EYNQEKTAIKE

SEQ ID NO: 22190 - protein, 11 aa, Borrelia burgdorferi B31
YNQEKTAIKEK

SEQ ID NO: 22191 - protein, 11 aa, Borrelia burgdorferi B31
NQEKTAIKEKE

SEQ ID NO: 22192 - protein, 11 aa, Borrelia burgdorferi B31
QEKTAIKEKEK

SEQ ID NO: 22193 - protein, 11 aa, Borrelia burgdorferi B31
EKTAIKEKEKT

SEQ ID NO: 22194 - protein, 11 aa, Borrelia burgdorferi B31
KTAIKEKEKTP

SEQ ID NO: 22195 - protein, 11 aa, Borrelia burgdorferi B31
TAIKEKEKTPK

SEQ ID NO: 22196 - protein, 11 aa, Borrelia burgdorferi B31
AIKEKEKTPKI

SEQ ID NO: 22197 - protein, 11 aa, Borrelia burgdorferi B31
IKEKEKTPKIG

SEQ ID NO: 22198 - protein, 11 aa, Borrelia burgdorferi B31
KEKEKTPKIGL

SEQ ID NO: 22199 - protein, 11 aa, Borrelia burgdorferi B31
EKEKTPKIGLH

SEQ ID NO: 22200 - protein, 11 aa, Borrelia burgdorferi B31
KEKTPKIGLHF

SEQ ID NO: 22201 - protein, 11 aa, Borrelia burgdorferi B31
EKTPKIGLHFT

SEQ ID NO: 22202 - protein, 11 aa, Borrelia burgdorferi B31
KTPKIGLHFTY

SEQ ID NO: 22203 - protein, 11 aa, Borrelia burgdorferi B31
TPKIGLHFTYC

SEQ ID NO: 22204 - protein, 11 aa, Borrelia burgdorferi B31
PKIGLHFTYCG

SEQ ID NO: 22205 - protein, 11 aa, Borrelia burgdorferi B31
KIGLHFTYCGF

SEQ ID NO: 22206 - protein, 11 aa, Borrelia burgdorferi B31
IGLHFTYCGFE

SEQ ID NO: 22207 - protein, 11 aa, Borrelia burgdorferi B31
GLHFTYCGFEI

SEQ ID NO: 22208 - protein, 11 aa, Borrelia burgdorferi B31
LHFTYCGFEIL

SEQ ID NO: 22209 - protein, 11 aa, Borrelia burgdorferi B31
HFTYCGFEILI

SEQ ID NO: 22210 - protein, 11 aa, Borrelia burgdorferi B31
FTYCGFEILIG

SEQ ID NO: 22211 - protein, 11 aa, Borrelia burgdorferi B31
TYCGFEILIGR

SEQ ID NO: 22212 - protein, 11 aa, Borrelia burgdorferi B31
YCGFEILIGRN

SEQ ID NO: 22213 - protein, 11 aa, Borrelia burgdorferi B31
CGFEILIGRNA

SEQ ID NO: 22214 - protein, 11 aa, Borrelia burgdorferi B31
GFEILIGRNAK

SEQ ID NO: 22215 - protein, 11 aa, Borrelia burgdorferi B31
FEILIGRNAKE

SEQ ID NO: 22216 - protein, 11 aa, Borrelia burgdorferi B31
EILIGRNAKEN

SEQ ID NO: 22217 - protein, 11 aa, Borrelia burgdorferi B31
ILIGRNAKEND

SEQ ID NO: 22218 - protein, 11 aa, Borrelia burgdorferi B31
LIGRNAKENDK

SEQ ID NO: 22219 - protein, 11 aa, Borrelia burgdorferi B31
IGRNAKENDKL

SEQ ID NO: 22220 - protein, 11 aa, Borrelia burgdorferi B31
GRNAKENDKLL

SEQ ID NO: 22221 - protein, 11 aa, Borrelia burgdorferi B31
RNAKENDKLLR

SEQ ID NO: 22222 - protein, 11 aa, Borrelia burgdorferi B31
NAKENDKLLRH

SEQ ID NO: 22223 - protein, 11 aa, Borrelia burgdorferi B31
AKENDKLLRHC

SEQ ID NO: 22224 - protein, 11 aa, Borrelia burgdorferi B31
KENDKLLRHCV

SEQ ID NO: 22225 - protein, 11 aa, Borrelia burgdorferi B31
ENDKLLRHCVK

SEQ ID NO: 22226 - protein, 11 aa, Borrelia burgdorferi B31
NDKLLRHCVKG

SEQ ID NO: 22227 - protein, 11 aa, Borrelia burgdorferi B31
DKLLRHCVKGN

SEQ ID NO: 22228 - protein, 11 aa, Borrelia burgdorferi B31
KLLRHCVKGND

SEQ ID NO: 22229 - protein, 11 aa, Borrelia burgdorferi B31
LLRHCVKGNDY

SEQ ID NO: 22230 - protein, 11 aa, Borrelia burgdorferi B31
LRHCVKGNDYW

SEQ ID NO: 22231 - protein, 11 aa, Borrelia burgdorferi B31
RHCVKGNDYWL

SEQ ID NO: 22232 - protein, 11 aa, Borrelia burgdorferi B31
HCVKGNDYWLH

SEQ ID NO: 22233 - protein, 11 aa, Borrelia burgdorferi B31
CVKGNDYWLHT

SEQ ID NO: 22234 - protein, 11 aa, Borrelia burgdorferi B31
VKGNDYWLHTR

SEQ ID NO: 22235 - protein, 11 aa, Borrelia burgdorferi B31
KGNDYWLHTRD

SEQ ID NO: 22236 - protein, 11 aa, Borrelia burgdorferi B31
GNDYWLHTRDY

SEQ ID NO: 22237 - protein, 11 aa, Borrelia burgdorferi B31
NDYWLHTRDYP

SEQ ID NO: 22238 - protein, 11 aa, Borrelia burgdorferi B31
DYWLHTRDYPG

SEQ ID NO: 22239 - protein, 11 aa, Borrelia burgdorferi B31
YWLHTRDYPGA

SEQ ID NO: 22240 - protein, 11 aa, Borrelia burgdorferi B31
WLHTRDYPGAY

SEQ ID NO: 22241 - protein, 11 aa, Borrelia burgdorferi B31
LHTRDYPGAYV

SEQ ID NO: 22242 - protein, 11 aa, Borrelia burgdorferi B31
HTRDYPGAYVF

SEQ ID NO: 22243 - protein, 11 aa, Borrelia burgdorferi B31
TRDYPGAYVFI

SEQ ID NO: 22244 - protein, 11 aa, Borrelia burgdorferi B31
RDYPGAYVFIK

SEQ ID NO: 22245 - protein, 11 aa, Borrelia burgdorferi B31
DYPGAYVFIKN

SEQ ID NO: 22246 - protein, 11 aa, Borrelia burgdorferi B31
YPGAYVFIKNQ

SEQ ID NO: 22247 - protein, 11 aa, Borrelia burgdorferi B31
PGAYVFIKNQK

SEQ ID NO: 22248 - protein, 11 aa, Borrelia burgdorferi B31
GAYVFIKNQKN

SEQ ID NO: 22249 - protein, 11 aa, Borrelia burgdorferi B31
AYVFIKNQKNK

SEQ ID NO: 22250 - protein, 11 aa, Borrelia burgdorferi B31
YVFIKNQKNKT

SEQ ID NO: 22251 - protein, 11 aa, Borrelia burgdorferi B31
VFIKNQKNKTP

SEQ ID NO: 22252 - protein, 11 aa, Borrelia burgdorferi B31
FIKNQKNKTPS

SEQ ID NO: 22253 - protein, 11 aa, Borrelia burgdorferi B31
IKNQKNKTPSL

SEQ ID NO: 22254 - protein, 11 aa, Borrelia burgdorferi B31
KNQKNKTPSLD

SEQ ID NO: 22255 - protein, 11 aa, Borrelia burgdorferi B31
NQKNKTPSLDV

SEQ ID NO: 22256 - protein, 11 aa, Borrelia burgdorferi B31
QKNKTPSLDVL

SEQ ID NO: 22257 - protein, 11 aa, Borrelia burgdorferi B31
KNKTPSLDVLL

SEQ ID NO: 22258 - protein, 11 aa, Borrelia burgdorferi B31
NKTPSLDVLLG

SEQ ID NO: 22259 - protein, 11 aa, Borrelia burgdorferi B31
KTPSLDVLLGA

SEQ ID NO: 22260 - protein, 11 aa, Borrelia burgdorferi B31
TPSLDVLLGAG

SEQ ID NO: 22261 - protein, 11 aa, Borrelia burgdorferi B31
PSLDVLLGAGN

SEQ ID NO: 22262 - protein, 11 aa, Borrelia burgdorferi B31
SLDVLLGAGNL

SEQ ID NO: 22263 - protein, 11 aa, Borrelia burgdorferi B31
LDVLLGAGNLC

SEQ ID NO: 22264 - protein, 11 aa, Borrelia burgdorferi B31
DVLLGAGNLCV

SEQ ID NO: 22265 - protein, 11 aa, Borrelia burgdorferi B31
VLLGAGNLCVF

SEQ ID NO: 22266 - protein, 11 aa, Borrelia burgdorferi B31
LLGAGNLCVFY

SEQ ID NO: 22267 - protein, 11 aa, Borrelia burgdorferi B31
LGAGNLCVFYT

SEQ ID NO: 22268 - protein, 11 aa, Borrelia burgdorferi B31
GAGNLCVFYTK

SEQ ID NO: 22269 - protein, 11 aa, Borrelia burgdorferi B31
AGNLCVFYTKL

SEQ ID NO: 22270 - protein, 11 aa, Borrelia burgdorferi B31
GNLCVFYTKLA

SEQ ID NO: 22271 - protein, 11 aa, Borrelia burgdorferi B31
NLCVFYTKLAK

SEQ ID NO: 22272 - protein, 11 aa, Borrelia burgdorferi B31
LCVFYTKLAKK

SEQ ID NO: 22273 - protein, 11 aa, Borrelia burgdorferi B31
CVFYTKLAKKS

SEQ ID NO: 22274 - protein, 11 aa, Borrelia burgdorferi B31
VFYTKLAKKSG

SEQ ID NO: 22275 - protein, 11 aa, Borrelia burgdorferi B31
FYTKLAKKSGK

SEQ ID NO: 22276 - protein, 11 aa, Borrelia burgdorferi B31
YTKLAKKSGKA

SEQ ID NO: 22277 - protein, 11 aa, Borrelia burgdorferi B31
TKLAKKSGKAD

SEQ ID NO: 22278 - protein, 11 aa, Borrelia burgdorferi B31
KLAKKSGKADL

SEQ ID NO: 22279 - protein, 11 aa, Borrelia burgdorferi B31
LAKKSGKADLY

SEQ ID NO: 22280 - protein, 11 aa, Borrelia burgdorferi B31
AKKSGKADLYY

SEQ ID NO: 22281 - protein, 11 aa, Borrelia burgdorferi B31
KKSGKADLYYT

SEQ ID NO: 22282 - protein, 11 aa, Borrelia burgdorferi B31
KSGKADLYYTQ

SEQ ID NO: 22283 - protein, 11 aa, Borrelia burgdorferi B31
SGKADLYYTQV

SEQ ID NO: 22284 - protein, 11 aa, Borrelia burgdorferi B31
GKADLYYTQVK

SEQ ID NO: 22285 - protein, 11 aa, Borrelia burgdorferi B31
KADLYYTQVKN

SEQ ID NO: 22286 - protein, 11 aa, Borrelia burgdorferi B31
ADLYYTQVKNL

SEQ ID NO: 22287 - protein, 11 aa, Borrelia burgdorferi B31
DLYYTQVKNLR

SEQ ID NO: 22288 - protein, 11 aa, Borrelia burgdorferi B31
LYYTQVKNLRR

SEQ ID NO: 22289 - protein, 11 aa, Borrelia burgdorferi B31
YYTQVKNLRRV

SEQ ID NO: 22290 - protein, 11 aa, Borrelia burgdorferi B31
YTQVKNLRRVK

SEQ ID NO: 22291 - protein, 11 aa, Borrelia burgdorferi B31
TQVKNLRRVKN

SEQ ID NO: 22292 - protein, 11 aa, Borrelia burgdorferi B31
QVKNLRRVKNK

SEQ ID NO: 22293 - protein, 11 aa, Borrelia burgdorferi B31
VKNLRRVKNKK

SEQ ID NO: 22294 - protein, 11 aa, Borrelia burgdorferi B31
KNLRRVKNKKL

SEQ ID NO: 22295 - protein, 11 aa, Borrelia burgdorferi B31
NLRRVKNKKLG

SEQ ID NO: 22296 - protein, 11 aa, Borrelia burgdorferi B31
LRRVKNKKLGL

SEQ ID NO: 22297 - protein, 11 aa, Borrelia burgdorferi B31
RRVKNKKLGLV

SEQ ID NO: 22298 - protein, 11 aa, Borrelia burgdorferi B31
RVKNKKLGLVI

SEQ ID NO: 22299 - protein, 11 aa, Borrelia burgdorferi B31
VKNKKLGLVIP

SEQ ID NO: 22300 - protein, 11 aa, Borrelia burgdorferi B31
KNKKLGLVIPK

SEQ ID NO: 22301 - protein, 11 aa, Borrelia burgdorferi B31
NKKLGLVIPKA

SEQ ID NO: 22302 - protein, 11 aa, Borrelia burgdorferi B31
KKLGLVIPKAE

SEQ ID NO: 22303 - protein, 11 aa, Borrelia burgdorferi B31
KLGLVIPKAEK

SEQ ID NO: 22304 - protein, 11 aa, Borrelia burgdorferi B31
LGLVIPKAEKN

SEQ ID NO: 22305 - protein, 11 aa, Borrelia burgdorferi B31
GLVIPKAEKNL

SEQ ID NO: 22306 - protein, 11 aa, Borrelia burgdorferi B31
LVIPKAEKNLH

SEQ ID NO: 22307 - protein, 11 aa, Borrelia burgdorferi B31
VIPKAEKNLHI

SEQ ID NO: 22308 - protein, 11 aa, Borrelia burgdorferi B31
IPKAEKNLHIK

SEQ ID NO: 22309 - protein, 11 aa, Borrelia burgdorferi B31
PKAEKNLHIKL

SEQ ID NO: 22310 - protein, 11 aa, Borrelia burgdorferi B31
KAEKNLHIKLD

SEQ ID NO: 22311 - protein, 11 aa, Borrelia burgdorferi B31
AEKNLHIKLDE

SEQ ID NO: 22312 - protein, 11 aa, Borrelia burgdorferi B31
EKNLHIKLDEN

SEQ ID NO: 22313 - protein, 11 aa, Borrelia burgdorferi B31
KNLHIKLDENL

SEQ ID NO: 22314 - protein, 11 aa, Borrelia burgdorferi B31
NLHIKLDENLI

SEQ ID NO: 22315 - protein, 11 aa, Borrelia burgdorferi B31
LHIKLDENLIK

SEQ ID NO: 22316 - protein, 11 aa, Borrelia burgdorferi B31
HIKLDENLIKK

SEQ ID NO: 22317 - protein, 11 aa, Borrelia burgdorferi B31
IKLDENLIKKI

SEQ ID NO: 22318 - protein, 11 aa, Borrelia burgdorferi B31
KLDENLIKKIK

SEQ ID NO: 22319 - protein, 11 aa, Borrelia burgdorferi B31
LDENLIKKIKN

SEQ ID NO: 22320 - protein, 11 aa, Borrelia burgdorferi B31
DENLIKKIKNQ

SEQ ID NO: 22321 - protein, 11 aa, Borrelia burgdorferi B31
ENLIKKIKNQT

SEQ ID NO: 22322 - protein, 8 aa, Borrelia burgdorferi
MKLQRSLS

SEQ ID NO: 22323 - protein, 8 aa, Borrelia burgdorferi
KLQRSLSL

SEQ ID NO: 22324 - protein, 8 aa, Borrelia burgdorferi
LQRSLSLI

SEQ ID NO: 22325 - protein, 8 aa, Borrelia burgdorferi
QRSLSLII

SEQ ID NO: 22326 - protein, 8 aa, Borrelia burgdorferi
RSLSLIIF

SEQ ID NO: 22327 - protein, 8 aa, Borrelia burgdorferi
SLSLIIFS

SEQ ID NO: 22328 - protein, 8 aa, Borrelia burgdorferi
LSLIIFSL

SEQ ID NO: 22329 - protein, 8 aa, Borrelia burgdorferi
SLIIFSLT

SEQ ID NO: 22330 - protein, 8 aa, Borrelia burgdorferi
LIIFSLTV

SEQ ID NO: 22331 - protein, 8 aa, Borrelia burgdorferi
IIFSLTVL

SEQ ID NO: 22332 - protein, 8 aa, Borrelia burgdorferi
IFSLTVLC

SEQ ID NO: 22333 - protein, 8 aa, Borrelia burgdorferi
FSLTVLCC

SEQ ID NO: 22334 - protein, 8 aa, Borrelia burgdorferi
SLTVLCCD

SEQ ID NO: 22335 - protein, 8 aa, Borrelia burgdorferi
LTVLCCDN

SEQ ID NO: 22336 - protein, 8 aa, Borrelia burgdorferi
TVLCCDNK

SEQ ID NO: 22337 - protein, 8 aa, Borrelia burgdorferi
VLCCDNKE

SEQ ID NO: 22338 - protein, 8 aa, Borrelia burgdorferi
LCCDNKER

SEQ ID NO: 22339 - protein, 8 aa, Borrelia burgdorferi
CCDNKERK

SEQ ID NO: 22340 - protein, 8 aa, Borrelia burgdorferi
CDNKERKE

SEQ ID NO: 22341 - protein, 8 aa, Borrelia burgdorferi
DNKERKEG

SEQ ID NO: 22342 - protein, 8 aa, Borrelia burgdorferi
NKERKEGV

SEQ ID NO: 22343 - protein, 8 aa, Borrelia burgdorferi
KERKEGVS

SEQ ID NO: 22344 - protein, 8 aa, Borrelia burgdorferi
ERKEGVST

SEQ ID NO: 22345 - protein, 8 aa, Borrelia burgdorferi
RKEGVSTK

SEQ ID NO: 22346 - protein, 8 aa, Borrelia burgdorferi
KEGVSTKI

SEQ ID NO: 22347 - protein, 8 aa, Borrelia burgdorferi
EGVSTKIS

SEQ ID NO: 22348 - protein, 8 aa, Borrelia burgdorferi
GVSTKISL

SEQ ID NO: 22349 - protein, 8 aa, Borrelia burgdorferi
VSTKISLG

SEQ ID NO: 22350 - protein, 8 aa, Borrelia burgdorferi
STKISLGA

SEQ ID NO: 22351 - protein, 8 aa, Borrelia burgdorferi
TKISLGAE

SEQ ID NO: 22352 - protein, 8 aa, Borrelia burgdorferi
KISLGAEP

SEQ ID NO: 22353 - protein, 8 aa, Borrelia burgdorferi
ISLGAEPR

SEQ ID NO: 22354 - protein, 8 aa, Borrelia burgdorferi
SLGAEPRS

SEQ ID NO: 22355 - protein, 8 aa, Borrelia burgdorferi
LGAEPRSL

SEQ ID NO: 22356 - protein, 8 aa, Borrelia burgdorferi
GAEPRSLD

SEQ ID NO: 22357 - protein, 8 aa, Borrelia burgdorferi
AEPRSLDP

SEQ ID NO: 22358 - protein, 8 aa, Borrelia burgdorferi
EPRSLDPQ

SEQ ID NO: 22359 - protein, 8 aa, Borrelia burgdorferi
PRSLDPQL

SEQ ID NO: 22360 - protein, 8 aa, Borrelia burgdorferi
RSLDPQLA

SEQ ID NO: 22361 - protein, 8 aa, Borrelia burgdorferi
SLDPQLAE

SEQ ID NO: 22362 - protein, 8 aa, Borrelia burgdorferi
LDPQLAED

SEQ ID NO: 22363 - protein, 8 aa, Borrelia burgdorferi
DPQLAEDN

SEQ ID NO: 22364 - protein, 8 aa, Borrelia burgdorferi
PQLAEDNV

SEQ ID NO: 22365 - protein, 8 aa, Borrelia burgdorferi
QLAEDNVA

SEQ ID NO: 22366 - protein, 8 aa, Borrelia burgdorferi
LAEDNVAS

SEQ ID NO: 22367 - protein, 8 aa, Borrelia burgdorferi
AEDNVASK

SEQ ID NO: 22368 - protein, 8 aa, Borrelia burgdorferi
EDNVASKM

SEQ ID NO: 22369 - protein, 8 aa, Borrelia burgdorferi
DNVASKMI

SEQ ID NO: 22370 - protein, 8 aa, Borrelia burgdorferi
NVASKMID

SEQ ID NO: 22371 - protein, 8 aa, Borrelia burgdorferi
VASKMIDT

SEQ ID NO: 22372 - protein, 8 aa, Borrelia burgdorferi
ASKMIDTL

SEQ ID NO: 22373 - protein, 8 aa, Borrelia burgdorferi
SKMIDTLY

SEQ ID NO: 22374 - protein, 8 aa, Borrelia burgdorferi
KMIDTLYR

SEQ ID NO: 22375 - protein, 8 aa, Borrelia burgdorferi
MIDTLYRG

SEQ ID NO: 22376 - protein, 8 aa, Borrelia burgdorferi
IDTLYRGI

SEQ ID NO: 22377 - protein, 8 aa, Borrelia burgdorferi
DTLYRGIV

SEQ ID NO: 22378 - protein, 8 aa, Borrelia burgdorferi
TLYRGIVT

SEQ ID NO: 22379 - protein, 8 aa, Borrelia burgdorferi
LYRGIVTG

SEQ ID NO: 22380 - protein, 8 aa, Borrelia burgdorferi
YRGIVTGD

SEQ ID NO: 22381 - protein, 8 aa, Borrelia burgdorferi
RGIVTGDP

SEQ ID NO: 22382 - protein, 8 aa, Borrelia burgdorferi
GIVTGDPN

SEQ ID NO: 22383 - protein, 8 aa, Borrelia burgdorferi
IVTGDPNT

SEQ ID NO: 22384 - protein, 8 aa, Borrelia burgdorferi
VTGDPNTG

SEQ ID NO: 22385 - protein, 8 aa, Borrelia burgdorferi
TGDPNTGG

SEQ ID NO: 22386 - protein, 8 aa, Borrelia burgdorferi
GDPNTGGH

SEQ ID NO: 22387 - protein, 8 aa, Borrelia burgdorferi
DPNTGGHK

SEQ ID NO: 22388 - protein, 8 aa, Borrelia burgdorferi
PNTGGHKP

SEQ ID NO: 22389 - protein, 8 aa, Borrelia burgdorferi
NTGGHKPG

SEQ ID NO: 22390 - protein, 8 aa, Borrelia burgdorferi
TGGHKPGL

SEQ ID NO: 22391 - protein, 8 aa, Borrelia burgdorferi
GGHKPGLA

SEQ ID NO: 22392 - protein, 8 aa, Borrelia burgdorferi
GHKPGLAK

SEQ ID NO: 22393 - protein, 8 aa, Borrelia burgdorferi
HKPGLAKG

SEQ ID NO: 22394 - protein, 8 aa, Borrelia burgdorferi
KPGLAKGW

SEQ ID NO: 22395 - protein, 8 aa, Borrelia burgdorferi
PGLAKGWE

SEQ ID NO: 22396 - protein, 8 aa, Borrelia burgdorferi
GLAKGWET

SEQ ID NO: 22397 - protein, 8 aa, Borrelia burgdorferi
LAKGWETS

SEQ ID NO: 22398 - protein, 8 aa, Borrelia burgdorferi
AKGWETSS

SEQ ID NO: 22399 - protein, 8 aa, Borrelia burgdorferi
KGWETSSD

SEQ ID NO: 22400 - protein, 8 aa, Borrelia burgdorferi
GWETSSDG

SEQ ID NO: 22401 - protein, 8 aa, Borrelia burgdorferi
WETSSDGT

SEQ ID NO: 22402 - protein, 8 aa, Borrelia burgdorferi
ETSSDGTA

SEQ ID NO: 22403 - protein, 8 aa, Borrelia burgdorferi
TSSDGTAY

SEQ ID NO: 22404 - protein, 8 aa, Borrelia burgdorferi
SSDGTAYP

SEQ ID NO: 22405 - protein, 8 aa, Borrelia burgdorferi
SDGTAYPF

SEQ ID NO: 22406 - protein, 8 aa, Borrelia burgdorferi
DGTAYPFY

SEQ ID NO: 22407 - protein, 8 aa, Borrelia burgdorferi
GTAYPFYL

SEQ ID NO: 22408 - protein, 8 aa, Borrelia burgdorferi
TAYPFYLR

SEQ ID NO: 22409 - protein, 8 aa, Borrelia burgdorferi
AYPFYLRD

SEQ ID NO: 22410 - protein, 8 aa, Borrelia burgdorferi
YPFYLRDN

SEQ ID NO: 22411 - protein, 8 aa, Borrelia burgdorferi
PFYLRDNL

SEQ ID NO: 22412 - protein, 8 aa, Borrelia burgdorferi
FYLRDNLT

SEQ ID NO: 22413 - protein, 8 aa, Borrelia burgdorferi
YLRDNLTW

SEQ ID NO: 22414 - protein, 8 aa, Borrelia burgdorferi
LRDNLTWS

SEQ ID NO: 22415 - protein, 8 aa, Borrelia burgdorferi
RDNLTWSD

SEQ ID NO: 22416 - protein, 8 aa, Borrelia burgdorferi
DNLTWSDG

SEQ ID NO: 22417 - protein, 8 aa, Borrelia burgdorferi
NLTWSDGV

SEQ ID NO: 22418 - protein, 8 aa, Borrelia burgdorferi
LTWSDGVA

SEQ ID NO: 22419 - protein, 8 aa, Borrelia burgdorferi
TWSDGVAI

SEQ ID NO: 22420 - protein, 8 aa, Borrelia burgdorferi
WSDGVAIT

SEQ ID NO: 22421 - protein, 8 aa, Borrelia burgdorferi
SDGVAITA

SEQ ID NO: 22422 - protein, 8 aa, Borrelia burgdorferi
DGVAITAE

SEQ ID NO: 22423 - protein, 8 aa, Borrelia burgdorferi
GVAITAEG

SEQ ID NO: 22424 - protein, 8 aa, Borrelia burgdorferi
VAITAEGI

SEQ ID NO: 22425 - protein, 8 aa, Borrelia burgdorferi
AITAEGIR

SEQ ID NO: 22426 - protein, 8 aa, Borrelia burgdorferi
ITAEGIRK

SEQ ID NO: 22427 - protein, 8 aa, Borrelia burgdorferi
TAEGIRKS

SEQ ID NO: 22428 - protein, 8 aa, Borrelia burgdorferi
AEGIRKSY

SEQ ID NO: 22429 - protein, 8 aa, Borrelia burgdorferi
EGIRKSYL

SEQ ID NO: 22430 - protein, 8 aa, Borrelia burgdorferi
GIRKSYLR

SEQ ID NO: 22431 - protein, 8 aa, Borrelia burgdorferi
IRKSYLRI

SEQ ID NO: 22432 - protein, 8 aa, Borrelia burgdorferi
RKSYLRIL

SEQ ID NO: 22433 - protein, 8 aa, Borrelia burgdorferi
KSYLRILN

SEQ ID NO: 22434 - protein, 8 aa, Borrelia burgdorferi
SYLRILNK

SEQ ID NO: 22435 - protein, 8 aa, Borrelia burgdorferi
YLRILNKE

SEQ ID NO: 22436 - protein, 8 aa, Borrelia burgdorferi
LRILNKET

SEQ ID NO: 22437 - protein, 8 aa, Borrelia burgdorferi
RILNKETG

SEQ ID NO: 22438 - protein, 8 aa, Borrelia burgdorferi
ILNKETGS

SEQ ID NO: 22439 - protein, 8 aa, Borrelia burgdorferi
LNKETGST

SEQ ID NO: 22440 - protein, 8 aa, Borrelia burgdorferi
NKETGSTY

SEQ ID NO: 22441 - protein, 8 aa, Borrelia burgdorferi
KETGSTYV

SEQ ID NO: 22442 - protein, 8 aa, Borrelia burgdorferi
ETGSTYVD

SEQ ID NO: 22443 - protein, 8 aa, Borrelia burgdorferi
TGSTYVDM

SEQ ID NO: 22444 - protein, 8 aa, Borrelia burgdorferi
GSTYVDMV

SEQ ID NO: 22445 - protein, 8 aa, Borrelia burgdorferi
STYVDMVK

SEQ ID NO: 22446 - protein, 8 aa, Borrelia burgdorferi
TYVDMVKS

SEQ ID NO: 22447 - protein, 8 aa, Borrelia burgdorferi
YVDMVKSI

SEQ ID NO: 22448 - protein, 8 aa, Borrelia burgdorferi
VDMVKSII

SEQ ID NO: 22449 - protein, 8 aa, Borrelia burgdorferi
DMVKSIIK

SEQ ID NO: 22450 - protein, 8 aa, Borrelia burgdorferi
MVKSIIKN

SEQ ID NO: 22451 - protein, 8 aa, Borrelia burgdorferi
VKSIIKNG

SEQ ID NO: 22452 - protein, 8 aa, Borrelia burgdorferi
KSIIKNGQ

SEQ ID NO: 22453 - protein, 8 aa, Borrelia burgdorferi
SIIKNGQE

SEQ ID NO: 22454 - protein, 8 aa, Borrelia burgdorferi
IIKNGQEY

SEQ ID NO: 22455 - protein, 8 aa, Borrelia burgdorferi
IKNGQEYF

SEQ ID NO: 22456 - protein, 8 aa, Borrelia burgdorferi
KNGQEYFD

SEQ ID NO: 22457 - protein, 8 aa, Borrelia burgdorferi
NGQEYFDG

SEQ ID NO: 22458 - protein, 8 aa, Borrelia burgdorferi
GQEYFDGQ

SEQ ID NO: 22459 - protein, 8 aa, Borrelia burgdorferi
QEYFDGQV

SEQ ID NO: 22460 - protein, 8 aa, Borrelia burgdorferi
EYFDGQVT

SEQ ID NO: 22461 - protein, 8 aa, Borrelia burgdorferi
YFDGQVTD

SEQ ID NO: 22462 - protein, 8 aa, Borrelia burgdorferi
FDGQVTDS

SEQ ID NO: 22463 - protein, 8 aa, Borrelia burgdorferi
DGQVTDSE

SEQ ID NO: 22464 - protein, 8 aa, Borrelia burgdorferi
GQVTDSEL

SEQ ID NO: 22465 - protein, 8 aa, Borrelia burgdorferi
QVTDSELG

SEQ ID NO: 22466 - protein, 8 aa, Borrelia burgdorferi
VTDSELGI

SEQ ID NO: 22467 - protein, 8 aa, Borrelia burgdorferi
TDSELGIR

SEQ ID NO: 22468 - protein, 8 aa, Borrelia burgdorferi
DSELGIRA

SEQ ID NO: 22469 - protein, 8 aa, Borrelia burgdorferi
SELGIRAI

SEQ ID NO: 22470 - protein, 8 aa, Borrelia burgdorferi
ELGIRAID

SEQ ID NO: 22471 - protein, 8 aa, Borrelia burgdorferi
LGIRAIDS

SEQ ID NO: 22472 - protein, 8 aa, Borrelia burgdorferi
GIRAIDSK

SEQ ID NO: 22473 - protein, 8 aa, Borrelia burgdorferi
IRAIDSKT

SEQ ID NO: 22474 - protein, 8 aa, Borrelia burgdorferi
RAIDSKTL

SEQ ID NO: 22475 - protein, 8 aa, Borrelia burgdorferi
AIDSKTLE

SEQ ID NO: 22476 - protein, 8 aa, Borrelia burgdorferi
IDSKTLEI

SEQ ID NO: 22477 - protein, 8 aa, Borrelia burgdorferi
DSKTLEIT

SEQ ID NO: 22478 - protein, 8 aa, Borrelia burgdorferi
SKTLEITL

SEQ ID NO: 22479 - protein, 8 aa, Borrelia burgdorferi
KTLEITLA

SEQ ID NO: 22480 - protein, 8 aa, Borrelia burgdorferi
TLEITLAS

SEQ ID NO: 22481 - protein, 8 aa, Borrelia burgdorferi
LEITLASP

SEQ ID NO: 22482 - protein, 8 aa, Borrelia burgdorferi
EITLASPK

SEQ ID NO: 22483 - protein, 8 aa, Borrelia burgdorferi
ITLASPKP

SEQ ID NO: 22484 - protein, 8 aa, Borrelia burgdorferi
TLASPKPY

SEQ ID NO: 22485 - protein, 8 aa, Borrelia burgdorferi
LASPKPYF

SEQ ID NO: 22486 - protein, 8 aa, Borrelia burgdorferi
ASPKPYFI

SEQ ID NO: 22487 - protein, 8 aa, Borrelia burgdorferi
SPKPYFID

SEQ ID NO: 22488 - protein, 8 aa, Borrelia burgdorferi
PKPYFIDL

SEQ ID NO: 22489 - protein, 8 aa, Borrelia burgdorferi
KPYFIDLL

SEQ ID NO: 22490 - protein, 8 aa, Borrelia burgdorferi
PYFIDLLV

SEQ ID NO: 22491 - protein, 8 aa, Borrelia burgdorferi
YFIDLLVH

SEQ ID NO: 22492 - protein, 8 aa, Borrelia burgdorferi
FIDLLVHQ

SEQ ID NO: 22493 - protein, 8 aa, Borrelia burgdorferi
IDLLVHQS

SEQ ID NO: 22494 - protein, 8 aa, Borrelia burgdorferi
DLLVHQSF

SEQ ID NO: 22495 - protein, 8 aa, Borrelia burgdorferi
LLVHQSFI

SEQ ID NO: 22496 - protein, 8 aa, Borrelia burgdorferi
LVHQSFIP

SEQ ID NO: 22497 - protein, 8 aa, Borrelia burgdorferi
VHQSFIPV

SEQ ID NO: 22498 - protein, 8 aa, Borrelia burgdorferi
HQSFIPVP

SEQ ID NO: 22499 - protein, 8 aa, Borrelia burgdorferi
QSFIPVPV

SEQ ID NO: 22500 - protein, 8 aa, Borrelia burgdorferi
SFIPVPVH

SEQ ID NO: 22501 - protein, 8 aa, Borrelia burgdorferi
FIPVPVHV

SEQ ID NO: 22502 - protein, 8 aa, Borrelia burgdorferi
IPVPVHVT

SEQ ID NO: 22503 - protein, 8 aa, Borrelia burgdorferi
PVPVHVTD

SEQ ID NO: 22504 - protein, 8 aa, Borrelia burgdorferi
VPVHVTDK

SEQ ID NO: 22505 - protein, 8 aa, Borrelia burgdorferi
PVHVTDKY

SEQ ID NO: 22506 - protein, 8 aa, Borrelia burgdorferi
VHVTDKYG

SEQ ID NO: 22507 - protein, 8 aa, Borrelia burgdorferi
HVTDKYGQ

SEQ ID NO: 22508 - protein, 8 aa, Borrelia burgdorferi
VTDKYGQN

SEQ ID NO: 22509 - protein, 8 aa, Borrelia burgdorferi
TDKYGQNW

SEQ ID NO: 22510 - protein, 8 aa, Borrelia burgdorferi
DKYGQNWT

SEQ ID NO: 22511 - protein, 8 aa, Borrelia burgdorferi
KYGQNWTS

SEQ ID NO: 22512 - protein, 8 aa, Borrelia burgdorferi
YGQNWTSP

SEQ ID NO: 22513 - protein, 8 aa, Borrelia burgdorferi
GQNWTSPE

SEQ ID NO: 22514 - protein, 8 aa, Borrelia burgdorferi
QNWTSPEN

SEQ ID NO: 22515 - protein, 8 aa, Borrelia burgdorferi
NWTSPENM

SEQ ID NO: 22516 - protein, 8 aa, Borrelia burgdorferi
WTSPENMV

SEQ ID NO: 22517 - protein, 8 aa, Borrelia burgdorferi
TSPENMVT

SEQ ID NO: 22518 - protein, 8 aa, Borrelia burgdorferi
SPENMVTS

SEQ ID NO: 22519 - protein, 8 aa, Borrelia burgdorferi
PENMVTSG

SEQ ID NO: 22520 - protein, 8 aa, Borrelia burgdorferi
ENMVTSGP

SEQ ID NO: 22521 - protein, 8 aa, Borrelia burgdorferi
NMVTSGPF

SEQ ID NO: 22522 - protein, 8 aa, Borrelia burgdorferi
MVTSGPFK

SEQ ID NO: 22523 - protein, 8 aa, Borrelia burgdorferi
VTSGPFKL

SEQ ID NO: 22524 - protein, 8 aa, Borrelia burgdorferi
TSGPFKLK

SEQ ID NO: 22525 - protein, 8 aa, Borrelia burgdorferi
SGPFKLKE

SEQ ID NO: 22526 - protein, 8 aa, Borrelia burgdorferi
GPFKLKER

SEQ ID NO: 22527 - protein, 8 aa, Borrelia burgdorferi
PFKLKERI

SEQ ID NO: 22528 - protein, 8 aa, Borrelia burgdorferi
FKLKERIP

SEQ ID NO: 22529 - protein, 8 aa, Borrelia burgdorferi
KLKERIPS

SEQ ID NO: 22530 - protein, 8 aa, Borrelia burgdorferi
LKERIPSE

SEQ ID NO: 22531 - protein, 8 aa, Borrelia burgdorferi
KERIPSEK

SEQ ID NO: 22532 - protein, 8 aa, Borrelia burgdorferi
ERIPSEKY

SEQ ID NO: 22533 - protein, 8 aa, Borrelia burgdorferi
RIPSEKYV

SEQ ID NO: 22534 - protein, 8 aa, Borrelia burgdorferi
IPSEKYVF

SEQ ID NO: 22535 - protein, 8 aa, Borrelia burgdorferi
PSEKYVFE

SEQ ID NO: 22536 - protein, 8 aa, Borrelia burgdorferi
SEKYVFEK

SEQ ID NO: 22537 - protein, 8 aa, Borrelia burgdorferi
EKYVFEKD

SEQ ID NO: 22538 - protein, 8 aa, Borrelia burgdorferi
KYVFEKDN

SEQ ID NO: 22539 - protein, 8 aa, Borrelia burgdorferi
YVFEKDNK

SEQ ID NO: 22540 - protein, 8 aa, Borrelia burgdorferi
VFEKDNKY

SEQ ID NO: 22541 - protein, 8 aa, Borrelia burgdorferi
FEKDNKYY

SEQ ID NO: 22542 - protein, 8 aa, Borrelia burgdorferi
EKDNKYYD

SEQ ID NO: 22543 - protein, 8 aa, Borrelia burgdorferi
KDNKYYDS

SEQ ID NO: 22544 - protein, 8 aa, Borrelia burgdorferi
DNKYYDSN

SEQ ID NO: 22545 - protein, 8 aa, Borrelia burgdorferi
NKYYDSNE

SEQ ID NO: 22546 - protein, 8 aa, Borrelia burgdorferi
KYYDSNEV

SEQ ID NO: 22547 - protein, 8 aa, Borrelia burgdorferi
YYDSNEVE

SEQ ID NO: 22548 - protein, 8 aa, Borrelia burgdorferi
YDSNEVEL

SEQ ID NO: 22549 - protein, 8 aa, Borrelia burgdorferi
DSNEVELE

SEQ ID NO: 22550 - protein, 8 aa, Borrelia burgdorferi
SNEVELEE

SEQ ID NO: 22551 - protein, 8 aa, Borrelia burgdorferi
NEVELEEI

SEQ ID NO: 22552 - protein, 8 aa, Borrelia burgdorferi
EVELEEIT

SEQ ID NO: 22553 - protein, 8 aa, Borrelia burgdorferi
VELEEITF

SEQ ID NO: 22554 - protein, 8 aa, Borrelia burgdorferi
ELEEITFY

SEQ ID NO: 22555 - protein, 8 aa, Borrelia burgdorferi
LEEITFYT

SEQ ID NO: 22556 - protein, 8 aa, Borrelia burgdorferi
EEITFYTT

SEQ ID NO: 22557 - protein, 8 aa, Borrelia burgdorferi
EITFYTTN

SEQ ID NO: 22558 - protein, 8 aa, Borrelia burgdorferi
ITFYTTND

SEQ ID NO: 22559 - protein, 8 aa, Borrelia burgdorferi
TFYTTNDS

SEQ ID NO: 22560 - protein, 8 aa, Borrelia burgdorferi
FYTTNDSS

SEQ ID NO: 22561 - protein, 8 aa, Borrelia burgdorferi
YTTNDSST

SEQ ID NO: 22562 - protein, 8 aa, Borrelia burgdorferi
TTNDSSTA

SEQ ID NO: 22563 - protein, 8 aa, Borrelia burgdorferi
TNDSSTAY

SEQ ID NO: 22564 - protein, 8 aa, Borrelia burgdorferi
NDSSTAYK

SEQ ID NO: 22565 - protein, 8 aa, Borrelia burgdorferi
DSSTAYKM

SEQ ID NO: 22566 - protein, 8 aa, Borrelia burgdorferi
SSTAYKMY

SEQ ID NO: 22567 - protein, 8 aa, Borrelia burgdorferi
STAYKMYV

SEQ ID NO: 22568 - protein, 8 aa, Borrelia burgdorferi
TAYKMYVN

SEQ ID NO: 22569 - protein, 8 aa, Borrelia burgdorferi
AYKMYVNE

SEQ ID NO: 22570 - protein, 8 aa, Borrelia burgdorferi
YKMYVNEE

SEQ ID NO: 22571 - protein, 8 aa, Borrelia burgdorferi
KMYVNEEL

SEQ ID NO: 22572 - protein, 8 aa, Borrelia burgdorferi
MYVNEELD

SEQ ID NO: 22573 - protein, 8 aa, Borrelia burgdorferi
YVNEELDA

SEQ ID NO: 22574 - protein, 8 aa, Borrelia burgdorferi
VNEELDAI

SEQ ID NO: 22575 - protein, 8 aa, Borrelia burgdorferi
NEELDAIL

SEQ ID NO: 22576 - protein, 8 aa, Borrelia burgdorferi
EELDAILV

SEQ ID NO: 22577 - protein, 8 aa, Borrelia burgdorferi
ELDAILVP

SEQ ID NO: 22578 - protein, 8 aa, Borrelia burgdorferi
LDAILVPY

SEQ ID NO: 22579 - protein, 8 aa, Borrelia burgdorferi
DAILVPYP

SEQ ID NO: 22580 - protein, 8 aa, Borrelia burgdorferi
AILVPYPQ

SEQ ID NO: 22581 - protein, 8 aa, Borrelia burgdorferi
ILVPYPQI

SEQ ID NO: 22582 - protein, 9 aa, Borrelia burgdorferi
MKLQRSLSL

SEQ ID NO: 22583 - protein, 9 aa, Borrelia burgdorferi
KLQRSLSLI

SEQ ID NO: 22584 - protein, 9 aa, Borrelia burgdorferi
LQRSLSLII

SEQ ID NO: 22585 - protein, 9 aa, Borrelia burgdorferi
QRSLSLIIF

SEQ ID NO: 22586 - protein, 9 aa, Borrelia burgdorferi
RSLSLIIFS

SEQ ID NO: 22587 - protein, 9 aa, Borrelia burgdorferi
SLSLIIFSL

SEQ ID NO: 22588 - protein, 9 aa, Borrelia burgdorferi
LSLIIFSLT

SEQ ID NO: 22589 - protein, 9 aa, Borrelia burgdorferi
SLIIFSLTV

SEQ ID NO: 22590 - protein, 9 aa, Borrelia burgdorferi
LIIFSLTVL

SEQ ID NO: 22591 - protein, 9 aa, Borrelia burgdorferi
IIFSLTVLC

SEQ ID NO: 22592 - protein, 9 aa, Borrelia burgdorferi
IFSLTVLCC

SEQ ID NO: 22593 - protein, 9 aa, Borrelia burgdorferi
FSLTVLCCD

SEQ ID NO: 22594 - protein, 9 aa, Borrelia burgdorferi
SLTVLCCDN

SEQ ID NO: 22595 - protein, 9 aa, Borrelia burgdorferi
LTVLCCDNK

SEQ ID NO: 22596 - protein, 9 aa, Borrelia burgdorferi
TVLCCDNKE

SEQ ID NO: 22597 - protein, 9 aa, Borrelia burgdorferi
VLCCDNKER

SEQ ID NO: 22598 - protein, 9 aa, Borrelia burgdorferi
LCCDNKERK

SEQ ID NO: 22599 - protein, 9 aa, Borrelia burgdorferi
CCDNKERKE

SEQ ID NO: 22600 - protein, 9 aa, Borrelia burgdorferi
CDNKERKEG

SEQ ID NO: 22601 - protein, 9 aa, Borrelia burgdorferi
DNKERKEGV

SEQ ID NO: 22602 - protein, 9 aa, Borrelia burgdorferi
NKERKEGVS

SEQ ID NO: 22603 - protein, 9 aa, Borrelia burgdorferi
KERKEGVST

SEQ ID NO: 22604 - protein, 9 aa, Borrelia burgdorferi
ERKEGVSTK

SEQ ID NO: 22605 - protein, 9 aa, Borrelia burgdorferi
RKEGVSTKI

SEQ ID NO: 22606 - protein, 9 aa, Borrelia burgdorferi
KEGVSTKIS

SEQ ID NO: 22607 - protein, 9 aa, Borrelia burgdorferi
EGVSTKISL

SEQ ID NO: 22608 - protein, 9 aa, Borrelia burgdorferi
GVSTKISLG

SEQ ID NO: 22609 - protein, 9 aa, Borrelia burgdorferi
VSTKISLGA

SEQ ID NO: 22610 - protein, 9 aa, Borrelia burgdorferi
STKISLGAE

SEQ ID NO: 22611 - protein, 9 aa, Borrelia burgdorferi
TKISLGAEP

SEQ ID NO: 22612 - protein, 9 aa, Borrelia burgdorferi
KISLGAEPR

SEQ ID NO: 22613 - protein, 9 aa, Borrelia burgdorferi
ISLGAEPRS

SEQ ID NO: 22614 - protein, 9 aa, Borrelia burgdorferi
SLGAEPRSL

SEQ ID NO: 22615 - protein, 9 aa, Borrelia burgdorferi
LGAEPRSLD

SEQ ID NO: 22616 - protein, 9 aa, Borrelia burgdorferi
GAEPRSLDP

SEQ ID NO: 22617 - protein, 9 aa, Borrelia burgdorferi
AEPRSLDPQ

SEQ ID NO: 22618 - protein, 9 aa, Borrelia burgdorferi
EPRSLDPQL

SEQ ID NO: 22619 - protein, 9 aa, Borrelia burgdorferi
PRSLDPQLA

SEQ ID NO: 22620 - protein, 9 aa, Borrelia burgdorferi
RSLDPQLAE

SEQ ID NO: 22621 - protein, 9 aa, Borrelia burgdorferi
SLDPQLAED

SEQ ID NO: 22622 - protein, 9 aa, Borrelia burgdorferi
LDPQLAEDN

SEQ ID NO: 22623 - protein, 9 aa, Borrelia burgdorferi
DPQLAEDNV

SEQ ID NO: 22624 - protein, 9 aa, Borrelia burgdorferi
PQLAEDNVA

SEQ ID NO: 22625 - protein, 9 aa, Borrelia burgdorferi
QLAEDNVAS

SEQ ID NO: 22626 - protein, 9 aa, Borrelia burgdorferi
LAEDNVASK

SEQ ID NO: 22627 - protein, 9 aa, Borrelia burgdorferi
AEDNVASKM

SEQ ID NO: 22628 - protein, 9 aa, Borrelia burgdorferi
EDNVASKMI

SEQ ID NO: 22629 - protein, 9 aa, Borrelia burgdorferi
DNVASKMID

SEQ ID NO: 22630 - protein, 9 aa, Borrelia burgdorferi
NVASKMIDT

SEQ ID NO: 22631 - protein, 9 aa, Borrelia burgdorferi
VASKMIDTL

SEQ ID NO: 22632 - protein, 9 aa, Borrelia burgdorferi
ASKMIDTLY

SEQ ID NO: 22633 - protein, 9 aa, Borrelia burgdorferi
SKMIDTLYR

SEQ ID NO: 22634 - protein, 9 aa, Borrelia burgdorferi
KMIDTLYRG

SEQ ID NO: 22635 - protein, 9 aa, Borrelia burgdorferi
MIDTLYRGI

SEQ ID NO: 22636 - protein, 9 aa, Borrelia burgdorferi
IDTLYRGIV

SEQ ID NO: 22637 - protein, 9 aa, Borrelia burgdorferi
DTLYRGIVT

SEQ ID NO: 22638 - protein, 9 aa, Borrelia burgdorferi
TLYRGIVTG

SEQ ID NO: 22639 - protein, 9 aa, Borrelia burgdorferi
LYRGIVTGD

SEQ ID NO: 22640 - protein, 9 aa, Borrelia burgdorferi
YRGIVTGDP

SEQ ID NO: 22641 - protein, 9 aa, Borrelia burgdorferi
RGIVTGDPN

SEQ ID NO: 22642 - protein, 9 aa, Borrelia burgdorferi
GIVTGDPNT

SEQ ID NO: 22643 - protein, 9 aa, Borrelia burgdorferi
IVTGDPNTG

SEQ ID NO: 22644 - protein, 9 aa, Borrelia burgdorferi
VTGDPNTGG

SEQ ID NO: 22645 - protein, 9 aa, Borrelia burgdorferi
TGDPNTGGH

SEQ ID NO: 22646 - protein, 9 aa, Borrelia burgdorferi
GDPNTGGHK

SEQ ID NO: 22647 - protein, 9 aa, Borrelia burgdorferi
DPNTGGHKP

SEQ ID NO: 22648 - protein, 9 aa, Borrelia burgdorferi
PNTGGHKPG

SEQ ID NO: 22649 - protein, 9 aa, Borrelia burgdorferi
NTGGHKPGL

SEQ ID NO: 22650 - protein, 9 aa, Borrelia burgdorferi
TGGHKPGLA

SEQ ID NO: 22651 - protein, 9 aa, Borrelia burgdorferi
GGHKPGLAK

SEQ ID NO: 22652 - protein, 9 aa, Borrelia burgdorferi
GHKPGLAKG

SEQ ID NO: 22653 - protein, 9 aa, Borrelia burgdorferi
HKPGLAKGW

SEQ ID NO: 22654 - protein, 9 aa, Borrelia burgdorferi
KPGLAKGWE

SEQ ID NO: 22655 - protein, 9 aa, Borrelia burgdorferi
PGLAKGWET

SEQ ID NO: 22656 - protein, 9 aa, Borrelia burgdorferi
GLAKGWETS

SEQ ID NO: 22657 - protein, 9 aa, Borrelia burgdorferi
LAKGWETSS

SEQ ID NO: 22658 - protein, 9 aa, Borrelia burgdorferi
AKGWETSSD

SEQ ID NO: 22659 - protein, 9 aa, Borrelia burgdorferi
KGWETSSDG

SEQ ID NO: 22660 - protein, 9 aa, Borrelia burgdorferi
GWETSSDGT

SEQ ID NO: 22661 - protein, 9 aa, Borrelia burgdorferi
WETSSDGTA

SEQ ID NO: 22662 - protein, 9 aa, Borrelia burgdorferi
ETSSDGTAY

SEQ ID NO: 22663 - protein, 9 aa, Borrelia burgdorferi
TSSDGTAYP

SEQ ID NO: 22664 - protein, 9 aa, Borrelia burgdorferi
SSDGTAYPF

SEQ ID NO: 22665 - protein, 9 aa, Borrelia burgdorferi
SDGTAYPFY

SEQ ID NO: 22666 - protein, 9 aa, Borrelia burgdorferi
DGTAYPFYL

SEQ ID NO: 22667 - protein, 9 aa, Borrelia burgdorferi
GTAYPFYLR

SEQ ID NO: 22668 - protein, 9 aa, Borrelia burgdorferi
TAYPFYLRD

SEQ ID NO: 22669 - protein, 9 aa, Borrelia burgdorferi
AYPFYLRDN

SEQ ID NO: 22670 - protein, 9 aa, Borrelia burgdorferi
YPFYLRDNL

SEQ ID NO: 22671 - protein, 9 aa, Borrelia burgdorferi
PFYLRDNLT

SEQ ID NO: 22672 - protein, 9 aa, Borrelia burgdorferi
FYLRDNLTW

SEQ ID NO: 22673 - protein, 9 aa, Borrelia burgdorferi
YLRDNLTWS

SEQ ID NO: 22674 - protein, 9 aa, Borrelia burgdorferi
LRDNLTWSD

SEQ ID NO: 22675 - protein, 9 aa, Borrelia burgdorferi
RDNLTWSDG

SEQ ID NO: 22676 - protein, 9 aa, Borrelia burgdorferi
DNLTWSDGV

SEQ ID NO: 22677 - protein, 9 aa, Borrelia burgdorferi
NLTWSDGVA

SEQ ID NO: 22678 - protein, 9 aa, Borrelia burgdorferi
LTWSDGVAI

SEQ ID NO: 22679 - protein, 9 aa, Borrelia burgdorferi
TWSDGVAIT

SEQ ID NO: 22680 - protein, 9 aa, Borrelia burgdorferi
WSDGVAITA

SEQ ID NO: 22681 - protein, 9 aa, Borrelia burgdorferi
SDGVAITAE

SEQ ID NO: 22682 - protein, 9 aa, Borrelia burgdorferi
DGVAITAEG

SEQ ID NO: 22683 - protein, 9 aa, Borrelia burgdorferi
GVAITAEGI

SEQ ID NO: 22684 - protein, 9 aa, Borrelia burgdorferi
VAITAEGIR

SEQ ID NO: 22685 - protein, 9 aa, Borrelia burgdorferi
AITAEGIRK

SEQ ID NO: 22686 - protein, 9 aa, Borrelia burgdorferi
ITAEGIRKS

SEQ ID NO: 22687 - protein, 9 aa, Borrelia burgdorferi
TAEGIRKSY

SEQ ID NO: 22688 - protein, 9 aa, Borrelia burgdorferi
AEGIRKSYL

SEQ ID NO: 22689 - protein, 9 aa, Borrelia burgdorferi
EGIRKSYLR

SEQ ID NO: 22690 - protein, 9 aa, Borrelia burgdorferi
GIRKSYLRI

SEQ ID NO: 22691 - protein, 9 aa, Borrelia burgdorferi
IRKSYLRIL

SEQ ID NO: 22692 - protein, 9 aa, Borrelia burgdorferi
RKSYLRILN

SEQ ID NO: 22693 - protein, 9 aa, Borrelia burgdorferi
KSYLRILNK

SEQ ID NO: 22694 - protein, 9 aa, Borrelia burgdorferi
SYLRILNKE

SEQ ID NO: 22695 - protein, 9 aa, Borrelia burgdorferi
YLRILNKET

SEQ ID NO: 22696 - protein, 9 aa, Borrelia burgdorferi
LRILNKETG

SEQ ID NO: 22697 - protein, 9 aa, Borrelia burgdorferi
RILNKETGS

SEQ ID NO: 22698 - protein, 9 aa, Borrelia burgdorferi
ILNKETGST

SEQ ID NO: 22699 - protein, 9 aa, Borrelia burgdorferi
LNKETGSTY

SEQ ID NO: 22700 - protein, 9 aa, Borrelia burgdorferi
NKETGSTYV

SEQ ID NO: 22701 - protein, 9 aa, Borrelia burgdorferi
KETGSTYVD

SEQ ID NO: 22702 - protein, 9 aa, Borrelia burgdorferi
ETGSTYVDM

SEQ ID NO: 22703 - protein, 9 aa, Borrelia burgdorferi
TGSTYVDMV

SEQ ID NO: 22704 - protein, 9 aa, Borrelia burgdorferi
GSTYVDMVK

SEQ ID NO: 22705 - protein, 9 aa, Borrelia burgdorferi
STYVDMVKS

SEQ ID NO: 22706 - protein, 9 aa, Borrelia burgdorferi
TYVDMVKSI

SEQ ID NO: 22707 - protein, 9 aa, Borrelia burgdorferi
YVDMVKSII

SEQ ID NO: 22708 - protein, 9 aa, Borrelia burgdorferi
VDMVKSIIK

SEQ ID NO: 22709 - protein, 9 aa, Borrelia burgdorferi
DMVKSIIKN

SEQ ID NO: 22710 - protein, 9 aa, Borrelia burgdorferi
MVKSIIKNG

SEQ ID NO: 22711 - protein, 9 aa, Borrelia burgdorferi
VKSIIKNGQ

SEQ ID NO: 22712 - protein, 9 aa, Borrelia burgdorferi
KSIIKNGQE

SEQ ID NO: 22713 - protein, 9 aa, Borrelia burgdorferi
SIIKNGQEY

SEQ ID NO: 22714 - protein, 9 aa, Borrelia burgdorferi
IIKNGQEYF

SEQ ID NO: 22715 - protein, 9 aa, Borrelia burgdorferi
IKNGQEYFD

SEQ ID NO: 22716 - protein, 9 aa, Borrelia burgdorferi
KNGQEYFDG

SEQ ID NO: 22717 - protein, 9 aa, Borrelia burgdorferi
NGQEYFDGQ

SEQ ID NO: 22718 - protein, 9 aa, Borrelia burgdorferi
GQEYFDGQV

SEQ ID NO: 22719 - protein, 9 aa, Borrelia burgdorferi
QEYFDGQVT

SEQ ID NO: 22720 - protein, 9 aa, Borrelia burgdorferi
EYFDGQVTD

SEQ ID NO: 22721 - protein, 9 aa, Borrelia burgdorferi
YFDGQVTDS

SEQ ID NO: 22722 - protein, 9 aa, Borrelia burgdorferi
FDGQVTDSE

SEQ ID NO: 22723 - protein, 9 aa, Borrelia burgdorferi
DGQVTDSEL

SEQ ID NO: 22724 - protein, 9 aa, Borrelia burgdorferi
GQVTDSELG

SEQ ID NO: 22725 - protein, 9 aa, Borrelia burgdorferi
QVTDSELGI

SEQ ID NO: 22726 - protein, 9 aa, Borrelia burgdorferi
VTDSELGIR

SEQ ID NO: 22727 - protein, 9 aa, Borrelia burgdorferi
TDSELGIRA

SEQ ID NO: 22728 - protein, 9 aa, Borrelia burgdorferi
DSELGIRAI

SEQ ID NO: 22729 - protein, 9 aa, Borrelia burgdorferi
SELGIRAID

SEQ ID NO: 22730 - protein, 9 aa, Borrelia burgdorferi
ELGIRAIDS

SEQ ID NO: 22731 - protein, 9 aa, Borrelia burgdorferi
LGIRAIDSK

SEQ ID NO: 22732 - protein, 9 aa, Borrelia burgdorferi
GIRAIDSKT

SEQ ID NO: 22733 - protein, 9 aa, Borrelia burgdorferi
IRAIDSKTL

SEQ ID NO: 22734 - protein, 9 aa, Borrelia burgdorferi
RAIDSKTLE

SEQ ID NO: 22735 - protein, 9 aa, Borrelia burgdorferi
AIDSKTLEI

SEQ ID NO: 22736 - protein, 9 aa, Borrelia burgdorferi
IDSKTLEIT

SEQ ID NO: 22737 - protein, 9 aa, Borrelia burgdorferi
DSKTLEITL

SEQ ID NO: 22738 - protein, 9 aa, Borrelia burgdorferi
SKTLEITLA

SEQ ID NO: 22739 - protein, 9 aa, Borrelia burgdorferi
KTLEITLAS

SEQ ID NO: 22740 - protein, 9 aa, Borrelia burgdorferi
TLEITLASP

SEQ ID NO: 22741 - protein, 9 aa, Borrelia burgdorferi
LEITLASPK

SEQ ID NO: 22742 - protein, 9 aa, Borrelia burgdorferi
EITLASPKP

SEQ ID NO: 22743 - protein, 9 aa, Borrelia burgdorferi
ITLASPKPY

SEQ ID NO: 22744 - protein, 9 aa, Borrelia burgdorferi
TLASPKPYF

SEQ ID NO: 22745 - protein, 9 aa, Borrelia burgdorferi
LASPKPYFI

SEQ ID NO: 22746 - protein, 9 aa, Borrelia burgdorferi
ASPKPYFID

SEQ ID NO: 22747 - protein, 9 aa, Borrelia burgdorferi
SPKPYFIDL

SEQ ID NO: 22748 - protein, 9 aa, Borrelia burgdorferi
PKPYFIDLL

SEQ ID NO: 22749 - protein, 9 aa, Borrelia burgdorferi
KPYFIDLLV

SEQ ID NO: 22750 - protein, 9 aa, Borrelia burgdorferi
PYFIDLLVH

SEQ ID NO: 22751 - protein, 9 aa, Borrelia burgdorferi
YFIDLLVHQ

SEQ ID NO: 22752 - protein, 9 aa, Borrelia burgdorferi
FIDLLVHQS

SEQ ID NO: 22753 - protein, 9 aa, Borrelia burgdorferi
IDLLVHQSF

SEQ ID NO: 22754 - protein, 9 aa, Borrelia burgdorferi
DLLVHQSFI

SEQ ID NO: 22755 - protein, 9 aa, Borrelia burgdorferi
LLVHQSFIP

SEQ ID NO: 22756 - protein, 9 aa, Borrelia burgdorferi
LVHQSFIPV

SEQ ID NO: 22757 - protein, 9 aa, Borrelia burgdorferi
VHQSFIPVP

SEQ ID NO: 22758 - protein, 9 aa, Borrelia burgdorferi
HQSFIPVPV

SEQ ID NO: 22759 - protein, 9 aa, Borrelia burgdorferi
QSFIPVPVH

SEQ ID NO: 22760 - protein, 9 aa, Borrelia burgdorferi
SFIPVPVHV

SEQ ID NO: 22761 - protein, 9 aa, Borrelia burgdorferi
FIPVPVHVT

SEQ ID NO: 22762 - protein, 9 aa, Borrelia burgdorferi
IPVPVHVTD

SEQ ID NO: 22763 - protein, 9 aa, Borrelia burgdorferi
PVPVHVTDK

SEQ ID NO: 22764 - protein, 9 aa, Borrelia burgdorferi
VPVHVTDKY

SEQ ID NO: 22765 - protein, 9 aa, Borrelia burgdorferi
PVHVTDKYG

SEQ ID NO: 22766 - protein, 9 aa, Borrelia burgdorferi
VHVTDKYGQ

SEQ ID NO: 22767 - protein, 9 aa, Borrelia burgdorferi
HVTDKYGQN

SEQ ID NO: 22768 - protein, 9 aa, Borrelia burgdorferi
VTDKYGQNW

SEQ ID NO: 22769 - protein, 9 aa, Borrelia burgdorferi
TDKYGQNWT

SEQ ID NO: 22770 - protein, 9 aa, Borrelia burgdorferi
DKYGQNWTS

SEQ ID NO: 22771 - protein, 9 aa, Borrelia burgdorferi
KYGQNWTSP

SEQ ID NO: 22772 - protein, 9 aa, Borrelia burgdorferi
YGQNWTSPE

SEQ ID NO: 22773 - protein, 9 aa, Borrelia burgdorferi
GQNWTSPEN

SEQ ID NO: 22774 - protein, 9 aa, Borrelia burgdorferi
QNWTSPENM

SEQ ID NO: 22775 - protein, 9 aa, Borrelia burgdorferi
NWTSPENMV

SEQ ID NO: 22776 - protein, 9 aa, Borrelia burgdorferi
WTSPENMVT

SEQ ID NO: 22777 - protein, 9 aa, Borrelia burgdorferi
TSPENMVTS

SEQ ID NO: 22778 - protein, 9 aa, Borrelia burgdorferi
SPENMVTSG

SEQ ID NO: 22779 - protein, 9 aa, Borrelia burgdorferi
PENMVTSGP

SEQ ID NO: 22780 - protein, 9 aa, Borrelia burgdorferi
ENMVTSGPF

SEQ ID NO: 22781 - protein, 9 aa, Borrelia burgdorferi
NMVTSGPFK

SEQ ID NO: 22782 - protein, 9 aa, Borrelia burgdorferi
MVTSGPFKL

SEQ ID NO: 22783 - protein, 9 aa, Borrelia burgdorferi
VTSGPFKLK

SEQ ID NO: 22784 - protein, 9 aa, Borrelia burgdorferi
TSGPFKLKE

SEQ ID NO: 22785 - protein, 9 aa, Borrelia burgdorferi
SGPFKLKER

SEQ ID NO: 22786 - protein, 9 aa, Borrelia burgdorferi
GPFKLKERI

SEQ ID NO: 22787 - protein, 9 aa, Borrelia burgdorferi
PFKLKERIP

SEQ ID NO: 22788 - protein, 9 aa, Borrelia burgdorferi
FKLKERIPS

SEQ ID NO: 22789 - protein, 9 aa, Borrelia burgdorferi
KLKERIPSE

SEQ ID NO: 22790 - protein, 9 aa, Borrelia burgdorferi
LKERIPSEK

SEQ ID NO: 22791 - protein, 9 aa, Borrelia burgdorferi
KERIPSEKY

SEQ ID NO: 22792 - protein, 9 aa, Borrelia burgdorferi
ERIPSEKYV

SEQ ID NO: 22793 - protein, 9 aa, Borrelia burgdorferi
RIPSEKYVF

SEQ ID NO: 22794 - protein, 9 aa, Borrelia burgdorferi
IPSEKYVFE

SEQ ID NO: 22795 - protein, 9 aa, Borrelia burgdorferi
PSEKYVFEK

SEQ ID NO: 22796 - protein, 9 aa, Borrelia burgdorferi
SEKYVFEKD

SEQ ID NO: 22797 - protein, 9 aa, Borrelia burgdorferi
EKYVFEKDN

SEQ ID NO: 22798 - protein, 9 aa, Borrelia burgdorferi
KYVFEKDNK

SEQ ID NO: 22799 - protein, 9 aa, Borrelia burgdorferi
YVFEKDNKY

SEQ ID NO: 22800 - protein, 9 aa, Borrelia burgdorferi
VFEKDNKYY

SEQ ID NO: 22801 - protein, 9 aa, Borrelia burgdorferi
FEKDNKYYD

SEQ ID NO: 22802 - protein, 9 aa, Borrelia burgdorferi
EKDNKYYDS

SEQ ID NO: 22803 - protein, 9 aa, Borrelia burgdorferi
KDNKYYDSN

SEQ ID NO: 22804 - protein, 9 aa, Borrelia burgdorferi
DNKYYDSNE

SEQ ID NO: 22805 - protein, 9 aa, Borrelia burgdorferi
NKYYDSNEV

SEQ ID NO: 22806 - protein, 9 aa, Borrelia burgdorferi
KYYDSNEVE

SEQ ID NO: 22807 - protein, 9 aa, Borrelia burgdorferi
YYDSNEVEL

SEQ ID NO: 22808 - protein, 9 aa, Borrelia burgdorferi
YDSNEVELE

SEQ ID NO: 22809 - protein, 9 aa, Borrelia burgdorferi
DSNEVELEE

SEQ ID NO: 22810 - protein, 9 aa, Borrelia burgdorferi
SNEVELEEI

SEQ ID NO: 22811 - protein, 9 aa, Borrelia burgdorferi
NEVELEEIT

SEQ ID NO: 22812 - protein, 9 aa, Borrelia burgdorferi
EVELEEITF

SEQ ID NO: 22813 - protein, 9 aa, Borrelia burgdorferi
VELEEITFY

SEQ ID NO: 22814 - protein, 9 aa, Borrelia burgdorferi
ELEEITFYT

SEQ ID NO: 22815 - protein, 9 aa, Borrelia burgdorferi
LEEITFYTT

SEQ ID NO: 22816 - protein, 9 aa, Borrelia burgdorferi
EEITFYTTN

SEQ ID NO: 22817 - protein, 9 aa, Borrelia burgdorferi
EITFYTTND

SEQ ID NO: 22818 - protein, 9 aa, Borrelia burgdorferi
ITFYTTNDS

SEQ ID NO: 22819 - protein, 9 aa, Borrelia burgdorferi
TFYTTNDSS

SEQ ID NO: 22820 - protein, 9 aa, Borrelia burgdorferi
FYTTNDSST

SEQ ID NO: 22821 - protein, 9 aa, Borrelia burgdorferi
YTTNDSSTA

SEQ ID NO: 22822 - protein, 9 aa, Borrelia burgdorferi
TTNDSSTAY

SEQ ID NO: 22823 - protein, 9 aa, Borrelia burgdorferi
TNDSSTAYK

SEQ ID NO: 22824 - protein, 9 aa, Borrelia burgdorferi
NDSSTAYKM

SEQ ID NO: 22825 - protein, 9 aa, Borrelia burgdorferi
DSSTAYKMY

SEQ ID NO: 22826 - protein, 9 aa, Borrelia burgdorferi
SSTAYKMYV

SEQ ID NO: 22827 - protein, 9 aa, Borrelia burgdorferi
STAYKMYVN

SEQ ID NO: 22828 - protein, 9 aa, Borrelia burgdorferi
TAYKMYVNE

SEQ ID NO: 22829 - protein, 9 aa, Borrelia burgdorferi
AYKMYVNEE

SEQ ID NO: 22830 - protein, 9 aa, Borrelia burgdorferi
YKMYVNEEL

SEQ ID NO: 22831 - protein, 9 aa, Borrelia burgdorferi
KMYVNEELD

SEQ ID NO: 22832 - protein, 9 aa, Borrelia burgdorferi
MYVNEELDA

SEQ ID NO: 22833 - protein, 9 aa, Borrelia burgdorferi
YVNEELDAI

SEQ ID NO: 22834 - protein, 9 aa, Borrelia burgdorferi
VNEELDAIL

SEQ ID NO: 22835 - protein, 9 aa, Borrelia burgdorferi
NEELDAILV

SEQ ID NO: 22836 - protein, 9 aa, Borrelia burgdorferi
EELDAILVP

SEQ ID NO: 22837 - protein, 9 aa, Borrelia burgdorferi
ELDAILVPY

SEQ ID NO: 22838 - protein, 9 aa, Borrelia burgdorferi
LDAILVPYP

SEQ ID NO: 22839 - protein, 9 aa, Borrelia burgdorferi
DAILVPYPQ

SEQ ID NO: 22840 - protein, 9 aa, Borrelia burgdorferi
AILVPYPQI

SEQ ID NO: 22841 - protein, 10 aa, Borrelia burgdorferi
MKLQRSLSLI

SEQ ID NO: 22842 - protein, 10 aa, Borrelia burgdorferi
KLQRSLSLII

SEQ ID NO: 22843 - protein, 10 aa, Borrelia burgdorferi
LQRSLSLIIF

SEQ ID NO: 22844 - protein, 10 aa, Borrelia burgdorferi
QRSLSLIIFS

SEQ ID NO: 22845 - protein, 10 aa, Borrelia burgdorferi
RSLSLIIFSL

SEQ ID NO: 22846 - protein, 10 aa, Borrelia burgdorferi
SLSLIIFSLT

SEQ ID NO: 22847 - protein, 10 aa, Borrelia burgdorferi
LSLIIFSLTV

SEQ ID NO: 22848 - protein, 10 aa, Borrelia burgdorferi
SLIIFSLTVL

SEQ ID NO: 22849 - protein, 10 aa, Borrelia burgdorferi
LIIFSLTVLC

SEQ ID NO: 22850 - protein, 10 aa, Borrelia burgdorferi
IIFSLTVLCC

SEQ ID NO: 22851 - protein, 10 aa, Borrelia burgdorferi
IFSLTVLCCD

SEQ ID NO: 22852 - protein, 10 aa, Borrelia burgdorferi
FSLTVLCCDN

SEQ ID NO: 22853 - protein, 10 aa, Borrelia burgdorferi
SLTVLCCDNK

SEQ ID NO: 22854 - protein, 10 aa, Borrelia burgdorferi
LTVLCCDNKE

SEQ ID NO: 22855 - protein, 10 aa, Borrelia burgdorferi
TVLCCDNKER

SEQ ID NO: 22856 - protein, 10 aa, Borrelia burgdorferi
VLCCDNKERK

SEQ ID NO: 22857 - protein, 10 aa, Borrelia burgdorferi
LCCDNKERKE

SEQ ID NO: 22858 - protein, 10 aa, Borrelia burgdorferi
CCDNKERKEG

SEQ ID NO: 22859 - protein, 10 aa, Borrelia burgdorferi
CDNKERKEGV

SEQ ID NO: 22860 - protein, 10 aa, Borrelia burgdorferi
DNKERKEGVS

SEQ ID NO: 22861 - protein, 10 aa, Borrelia burgdorferi
NKERKEGVST

SEQ ID NO: 22862 - protein, 10 aa, Borrelia burgdorferi
KERKEGVSTK

SEQ ID NO: 22863 - protein, 10 aa, Borrelia burgdorferi
ERKEGVSTKI

SEQ ID NO: 22864 - protein, 10 aa, Borrelia burgdorferi
RKEGVSTKIS

SEQ ID NO: 22865 - protein, 10 aa, Borrelia burgdorferi
KEGVSTKISL

SEQ ID NO: 22866 - protein, 10 aa, Borrelia burgdorferi
EGVSTKISLG

SEQ ID NO: 22867 - protein, 10 aa, Borrelia burgdorferi
GVSTKISLGA

SEQ ID NO: 22868 - protein, 10 aa, Borrelia burgdorferi
VSTKISLGAE

SEQ ID NO: 22869 - protein, 10 aa, Borrelia burgdorferi
STKISLGAEP

SEQ ID NO: 22870 - protein, 10 aa, Borrelia burgdorferi
TKISLGAEPR

SEQ ID NO: 22871 - protein, 10 aa, Borrelia burgdorferi
KISLGAEPRS

SEQ ID NO: 22872 - protein, 10 aa, Borrelia burgdorferi
ISLGAEPRSL

SEQ ID NO: 22873 - protein, 10 aa, Borrelia burgdorferi
SLGAEPRSLD

SEQ ID NO: 22874 - protein, 10 aa, Borrelia burgdorferi
LGAEPRSLDP

SEQ ID NO: 22875 - protein, 10 aa, Borrelia burgdorferi
GAEPRSLDPQ

SEQ ID NO: 22876 - protein, 10 aa, Borrelia burgdorferi
AEPRSLDPQL

SEQ ID NO: 22877 - protein, 10 aa, Borrelia burgdorferi
EPRSLDPQLA

SEQ ID NO: 22878 - protein, 10 aa, Borrelia burgdorferi
PRSLDPQLAE

SEQ ID NO: 22879 - protein, 10 aa, Borrelia burgdorferi
RSLDPQLAED

SEQ ID NO: 22880 - protein, 10 aa, Borrelia burgdorferi
SLDPQLAEDN

SEQ ID NO: 22881 - protein, 10 aa, Borrelia burgdorferi
LDPQLAEDNV

SEQ ID NO: 22882 - protein, 10 aa, Borrelia burgdorferi
DPQLAEDNVA

SEQ ID NO: 22883 - protein, 10 aa, Borrelia burgdorferi
PQLAEDNVAS

SEQ ID NO: 22884 - protein, 10 aa, Borrelia burgdorferi
QLAEDNVASK

SEQ ID NO: 22885 - protein, 10 aa, Borrelia burgdorferi
LAEDNVASKM

SEQ ID NO: 22886 - protein, 10 aa, Borrelia burgdorferi
AEDNVASKMI

SEQ ID NO: 22887 - protein, 10 aa, Borrelia burgdorferi
EDNVASKMID

SEQ ID NO: 22888 - protein, 10 aa, Borrelia burgdorferi
DNVASKMIDT

SEQ ID NO: 22889 - protein, 10 aa, Borrelia burgdorferi
NVASKMIDTL

SEQ ID NO: 22890 - protein, 10 aa, Borrelia burgdorferi
VASKMIDTLY

SEQ ID NO: 22891 - protein, 10 aa, Borrelia burgdorferi
ASKMIDTLYR

SEQ ID NO: 22892 - protein, 10 aa, Borrelia burgdorferi
SKMIDTLYRG

SEQ ID NO: 22893 - protein, 10 aa, Borrelia burgdorferi
KMIDTLYRGI

SEQ ID NO: 22894 - protein, 10 aa, Borrelia burgdorferi
MIDTLYRGIV

SEQ ID NO: 22895 - protein, 10 aa, Borrelia burgdorferi
IDTLYRGIVT

SEQ ID NO: 22896 - protein, 10 aa, Borrelia burgdorferi
DTLYRGIVTG

SEQ ID NO: 22897 - protein, 10 aa, Borrelia burgdorferi
TLYRGIVTGD

SEQ ID NO: 22898 - protein, 10 aa, Borrelia burgdorferi
LYRGIVTGDP

SEQ ID NO: 22899 - protein, 10 aa, Borrelia burgdorferi
YRGIVTGDPN

SEQ ID NO: 22900 - protein, 10 aa, Borrelia burgdorferi
RGIVTGDPNT

SEQ ID NO: 22901 - protein, 10 aa, Borrelia burgdorferi
GIVTGDPNTG

SEQ ID NO: 22902 - protein, 10 aa, Borrelia burgdorferi
IVTGDPNTGG

SEQ ID NO: 22903 - protein, 10 aa, Borrelia burgdorferi
VTGDPNTGGH

SEQ ID NO: 22904 - protein, 10 aa, Borrelia burgdorferi
TGDPNTGGHK

SEQ ID NO: 22905 - protein, 10 aa, Borrelia burgdorferi
GDPNTGGHKP

SEQ ID NO: 22906 - protein, 10 aa, Borrelia burgdorferi
DPNTGGHKPG

SEQ ID NO: 22907 - protein, 10 aa, Borrelia burgdorferi
PNTGGHKPGL

SEQ ID NO: 22908 - protein, 10 aa, Borrelia burgdorferi
NTGGHKPGLA

SEQ ID NO: 22909 - protein, 10 aa, Borrelia burgdorferi
TGGHKPGLAK

SEQ ID NO: 22910 - protein, 10 aa, Borrelia burgdorferi
GGHKPGLAKG

SEQ ID NO: 22911 - protein, 10 aa, Borrelia burgdorferi
GHKPGLAKGW

SEQ ID NO: 22912 - protein, 10 aa, Borrelia burgdorferi
HKPGLAKGWE

SEQ ID NO: 22913 - protein, 10 aa, Borrelia burgdorferi
KPGLAKGWET

SEQ ID NO: 22914 - protein, 10 aa, Borrelia burgdorferi
PGLAKGWETS

SEQ ID NO: 22915 - protein, 10 aa, Borrelia burgdorferi
GLAKGWETSS

SEQ ID NO: 22916 - protein, 10 aa, Borrelia burgdorferi
LAKGWETSSD

SEQ ID NO: 22917 - protein, 10 aa, Borrelia burgdorferi
AKGWETSSDG

SEQ ID NO: 22918 - protein, 10 aa, Borrelia burgdorferi
KGWETSSDGT

SEQ ID NO: 22919 - protein, 10 aa, Borrelia burgdorferi
GWETSSDGTA

SEQ ID NO: 22920 - protein, 10 aa, Borrelia burgdorferi
WETSSDGTAY

SEQ ID NO: 22921 - protein, 10 aa, Borrelia burgdorferi
ETSSDGTAYP

SEQ ID NO: 22922 - protein, 10 aa, Borrelia burgdorferi
TSSDGTAYPF

SEQ ID NO: 22923 - protein, 10 aa, Borrelia burgdorferi
SSDGTAYPFY

SEQ ID NO: 22924 - protein, 10 aa, Borrelia burgdorferi
SDGTAYPFYL

SEQ ID NO: 22925 - protein, 10 aa, Borrelia burgdorferi
DGTAYPFYLR

SEQ ID NO: 22926 - protein, 10 aa, Borrelia burgdorferi
GTAYPFYLRD

SEQ ID NO: 22927 - protein, 10 aa, Borrelia burgdorferi
TAYPFYLRDN

SEQ ID NO: 22928 - protein, 10 aa, Borrelia burgdorferi
AYPFYLRDNL

SEQ ID NO: 22929 - protein, 10 aa, Borrelia burgdorferi
YPFYLRDNLT

SEQ ID NO: 22930 - protein, 10 aa, Borrelia burgdorferi
PFYLRDNLTW

SEQ ID NO: 22931 - protein, 10 aa, Borrelia burgdorferi
FYLRDNLTWS

SEQ ID NO: 22932 - protein, 10 aa, Borrelia burgdorferi
YLRDNLTWSD

SEQ ID NO: 22933 - protein, 10 aa, Borrelia burgdorferi
LRDNLTWSDG

SEQ ID NO: 22934 - protein, 10 aa, Borrelia burgdorferi
RDNLTWSDGV

SEQ ID NO: 22935 - protein, 10 aa, Borrelia burgdorferi
DNLTWSDGVA

SEQ ID NO: 22936 - protein, 10 aa, Borrelia burgdorferi
NLTWSDGVAI

SEQ ID NO: 22937 - protein, 10 aa, Borrelia burgdorferi
LTWSDGVAIT

SEQ ID NO: 22938 - protein, 10 aa, Borrelia burgdorferi
TWSDGVAITA

SEQ ID NO: 22939 - protein, 10 aa, Borrelia burgdorferi
WSDGVAITAE

SEQ ID NO: 22940 - protein, 10 aa, Borrelia burgdorferi
SDGVAITAEG

SEQ ID NO: 22941 - protein, 10 aa, Borrelia burgdorferi
DGVAITAEGI

SEQ ID NO: 22942 - protein, 10 aa, Borrelia burgdorferi
GVAITAEGIR

SEQ ID NO: 22943 - protein, 10 aa, Borrelia burgdorferi
VAITAEGIRK

SEQ ID NO: 22944 - protein, 10 aa, Borrelia burgdorferi
AITAEGIRKS

SEQ ID NO: 22945 - protein, 10 aa, Borrelia burgdorferi
ITAEGIRKSY

SEQ ID NO: 22946 - protein, 10 aa, Borrelia burgdorferi
TAEGIRKSYL

SEQ ID NO: 22947 - protein, 10 aa, Borrelia burgdorferi
AEGIRKSYLR

SEQ ID NO: 22948 - protein, 10 aa, Borrelia burgdorferi
EGIRKSYLRI

SEQ ID NO: 22949 - protein, 10 aa, Borrelia burgdorferi
GIRKSYLRIL

SEQ ID NO: 22950 - protein, 10 aa, Borrelia burgdorferi
IRKSYLRILN

SEQ ID NO: 22951 - protein, 10 aa, Borrelia burgdorferi
RKSYLRILNK

SEQ ID NO: 22952 - protein, 10 aa, Borrelia burgdorferi
KSYLRILNKE

SEQ ID NO: 22953 - protein, 10 aa, Borrelia burgdorferi
SYLRILNKET

SEQ ID NO: 22954 - protein, 10 aa, Borrelia burgdorferi
YLRILNKETG

SEQ ID NO: 22955 - protein, 10 aa, Borrelia burgdorferi
LRILNKETGS

SEQ ID NO: 22956 - protein, 10 aa, Borrelia burgdorferi
RILNKETGST

SEQ ID NO: 22957 - protein, 10 aa, Borrelia burgdorferi
ILNKETGSTY

SEQ ID NO: 22958 - protein, 10 aa, Borrelia burgdorferi
LNKETGSTYV

SEQ ID NO: 22959 - protein, 10 aa, Borrelia burgdorferi
NKETGSTYVD

SEQ ID NO: 22960 - protein, 10 aa, Borrelia burgdorferi
KETGSTYVDM

SEQ ID NO: 22961 - protein, 10 aa, Borrelia burgdorferi
ETGSTYVDMV

SEQ ID NO: 22962 - protein, 10 aa, Borrelia burgdorferi
TGSTYVDMVK

SEQ ID NO: 22963 - protein, 10 aa, Borrelia burgdorferi
GSTYVDMVKS

SEQ ID NO: 22964 - protein, 10 aa, Borrelia burgdorferi
STYVDMVKSI

SEQ ID NO: 22965 - protein, 10 aa, Borrelia burgdorferi
TYVDMVKSII

SEQ ID NO: 22966 - protein, 10 aa, Borrelia burgdorferi
YVDMVKSIIK

SEQ ID NO: 22967 - protein, 10 aa, Borrelia burgdorferi
VDMVKSIIKN

SEQ ID NO: 22968 - protein, 10 aa, Borrelia burgdorferi
DMVKSIIKNG

SEQ ID NO: 22969 - protein, 10 aa, Borrelia burgdorferi
MVKSIIKNGQ

SEQ ID NO: 22970 - protein, 10 aa, Borrelia burgdorferi
VKSIIKNGQE

SEQ ID NO: 22971 - protein, 10 aa, Borrelia burgdorferi
KSIIKNGQEY

SEQ ID NO: 22972 - protein, 10 aa, Borrelia burgdorferi
SIIKNGQEYF

SEQ ID NO: 22973 - protein, 10 aa, Borrelia burgdorferi
IIKNGQEYFD

SEQ ID NO: 22974 - protein, 10 aa, Borrelia burgdorferi
IKNGQEYFDG

SEQ ID NO: 22975 - protein, 10 aa, Borrelia burgdorferi
KNGQEYFDGQ

SEQ ID NO: 22976 - protein, 10 aa, Borrelia burgdorferi
NGQEYFDGQV

SEQ ID NO: 22977 - protein, 10 aa, Borrelia burgdorferi
GQEYFDGQVT

SEQ ID NO: 22978 - protein, 10 aa, Borrelia burgdorferi
QEYFDGQVTD

SEQ ID NO: 22979 - protein, 10 aa, Borrelia burgdorferi
EYFDGQVTDS

SEQ ID NO: 22980 - protein, 10 aa, Borrelia burgdorferi
YFDGQVTDSE

SEQ ID NO: 22981 - protein, 10 aa, Borrelia burgdorferi
FDGQVTDSEL

SEQ ID NO: 22982 - protein, 10 aa, Borrelia burgdorferi
DGQVTDSELG

SEQ ID NO: 22983 - protein, 10 aa, Borrelia burgdorferi
GQVTDSELGI

SEQ ID NO: 22984 - protein, 10 aa, Borrelia burgdorferi
QVTDSELGIR

SEQ ID NO: 22985 - protein, 10 aa, Borrelia burgdorferi
VTDSELGIRA

SEQ ID NO: 22986 - protein, 10 aa, Borrelia burgdorferi
TDSELGIRAI

SEQ ID NO: 22987 - protein, 10 aa, Borrelia burgdorferi
DSELGIRAID

SEQ ID NO: 22988 - protein, 10 aa, Borrelia burgdorferi
SELGIRAIDS

SEQ ID NO: 22989 - protein, 10 aa, Borrelia burgdorferi
ELGIRAIDSK

SEQ ID NO: 22990 - protein, 10 aa, Borrelia burgdorferi
LGIRAIDSKT

SEQ ID NO: 22991 - protein, 10 aa, Borrelia burgdorferi
GIRAIDSKTL

SEQ ID NO: 22992 - protein, 10 aa, Borrelia burgdorferi
IRAIDSKTLE

SEQ ID NO: 22993 - protein, 10 aa, Borrelia burgdorferi
RAIDSKTLEI

SEQ ID NO: 22994 - protein, 10 aa, Borrelia burgdorferi
AIDSKTLEIT

SEQ ID NO: 22995 - protein, 10 aa, Borrelia burgdorferi
IDSKTLEITL

SEQ ID NO: 22996 - protein, 10 aa, Borrelia burgdorferi
DSKTLEITLA

SEQ ID NO: 22997 - protein, 10 aa, Borrelia burgdorferi
SKTLEITLAS

SEQ ID NO: 22998 - protein, 10 aa, Borrelia burgdorferi
KTLEITLASP

SEQ ID NO: 22999 - protein, 10 aa, Borrelia burgdorferi
TLEITLASPK

SEQ ID NO: 23000 - protein, 10 aa, Borrelia burgdorferi
LEITLASPKP

SEQ ID NO: 23001 - protein, 10 aa, Borrelia burgdorferi
EITLASPKPY

SEQ ID NO: 23002 - protein, 10 aa, Borrelia burgdorferi
ITLASPKPYF

SEQ ID NO: 23003 - protein, 10 aa, Borrelia burgdorferi
TLASPKPYFI

SEQ ID NO: 23004 - protein, 10 aa, Borrelia burgdorferi
LASPKPYFID

SEQ ID NO: 23005 - protein, 10 aa, Borrelia burgdorferi
ASPKPYFIDL

SEQ ID NO: 23006 - protein, 10 aa, Borrelia burgdorferi
SPKPYFIDLL

SEQ ID NO: 23007 - protein, 10 aa, Borrelia burgdorferi
PKPYFIDLLV

SEQ ID NO: 23008 - protein, 10 aa, Borrelia burgdorferi
KPYFIDLLVH

SEQ ID NO: 23009 - protein, 10 aa, Borrelia burgdorferi
PYFIDLLVHQ

SEQ ID NO: 23010 - protein, 10 aa, Borrelia burgdorferi
YFIDLLVHQS

SEQ ID NO: 23011 - protein, 10 aa, Borrelia burgdorferi
FIDLLVHQSF

SEQ ID NO: 23012 - protein, 10 aa, Borrelia burgdorferi
IDLLVHQSFI

SEQ ID NO: 23013 - protein, 10 aa, Borrelia burgdorferi
DLLVHQSFIP

SEQ ID NO: 23014 - protein, 10 aa, Borrelia burgdorferi
LLVHQSFIPV

SEQ ID NO: 23015 - protein, 10 aa, Borrelia burgdorferi
LVHQSFIPVP

SEQ ID NO: 23016 - protein, 10 aa, Borrelia burgdorferi
VHQSFIPVPV

SEQ ID NO: 23017 - protein, 10 aa, Borrelia burgdorferi
HQSFIPVPVH

SEQ ID NO: 23018 - protein, 10 aa, Borrelia burgdorferi
QSFIPVPVHV

SEQ ID NO: 23019 - protein, 10 aa, Borrelia burgdorferi
SFIPVPVHVT

SEQ ID NO: 23020 - protein, 10 aa, Borrelia burgdorferi
FIPVPVHVTD

SEQ ID NO: 23021 - protein, 10 aa, Borrelia burgdorferi
IPVPVHVTDK

SEQ ID NO: 23022 - protein, 10 aa, Borrelia burgdorferi
PVPVHVTDKY

SEQ ID NO: 23023 - protein, 10 aa, Borrelia burgdorferi
VPVHVTDKYG

SEQ ID NO: 23024 - protein, 10 aa, Borrelia burgdorferi
PVHVTDKYGQ

SEQ ID NO: 23025 - protein, 10 aa, Borrelia burgdorferi
VHVTDKYGQN

SEQ ID NO: 23026 - protein, 10 aa, Borrelia burgdorferi
HVTDKYGQNW

SEQ ID NO: 23027 - protein, 10 aa, Borrelia burgdorferi
VTDKYGQNWT

SEQ ID NO: 23028 - protein, 10 aa, Borrelia burgdorferi
TDKYGQNWTS

SEQ ID NO: 23029 - protein, 10 aa, Borrelia burgdorferi
DKYGQNWTSP

SEQ ID NO: 23030 - protein, 10 aa, Borrelia burgdorferi
KYGQNWTSPE

SEQ ID NO: 23031 - protein, 10 aa, Borrelia burgdorferi
YGQNWTSPEN

SEQ ID NO: 23032 - protein, 10 aa, Borrelia burgdorferi
GQNWTSPENM

SEQ ID NO: 23033 - protein, 10 aa, Borrelia burgdorferi
QNWTSPENMV

SEQ ID NO: 23034 - protein, 10 aa, Borrelia burgdorferi
NWTSPENMVT

SEQ ID NO: 23035 - protein, 10 aa, Borrelia burgdorferi
WTSPENMVTS

SEQ ID NO: 23036 - protein, 10 aa, Borrelia burgdorferi
TSPENMVTSG

SEQ ID NO: 23037 - protein, 10 aa, Borrelia burgdorferi
SPENMVTSGP

SEQ ID NO: 23038 - protein, 10 aa, Borrelia burgdorferi
PENMVTSGPF

SEQ ID NO: 23039 - protein, 10 aa, Borrelia burgdorferi
ENMVTSGPFK

SEQ ID NO: 23040 - protein, 10 aa, Borrelia burgdorferi
NMVTSGPFKL

SEQ ID NO: 23041 - protein, 10 aa, Borrelia burgdorferi
MVTSGPFKLK

SEQ ID NO: 23042 - protein, 10 aa, Borrelia burgdorferi
VTSGPFKLKE

SEQ ID NO: 23043 - protein, 10 aa, Borrelia burgdorferi
TSGPFKLKER

SEQ ID NO: 23044 - protein, 10 aa, Borrelia burgdorferi
SGPFKLKERI

SEQ ID NO: 23045 - protein, 10 aa, Borrelia burgdorferi
GPFKLKERIP

SEQ ID NO: 23046 - protein, 10 aa, Borrelia burgdorferi
PFKLKERIPS

SEQ ID NO: 23047 - protein, 10 aa, Borrelia burgdorferi
FKLKERIPSE

SEQ ID NO: 23048 - protein, 10 aa, Borrelia burgdorferi
KLKERIPSEK

SEQ ID NO: 23049 - protein, 10 aa, Borrelia burgdorferi
LKERIPSEKY

SEQ ID NO: 23050 - protein, 10 aa, Borrelia burgdorferi
KERIPSEKYV

SEQ ID NO: 23051 - protein, 10 aa, Borrelia burgdorferi
ERIPSEKYVF

SEQ ID NO: 23052 - protein, 10 aa, Borrelia burgdorferi
RIPSEKYVFE

SEQ ID NO: 23053 - protein, 10 aa, Borrelia burgdorferi
IPSEKYVFEK

SEQ ID NO: 23054 - protein, 10 aa, Borrelia burgdorferi
PSEKYVFEKD

SEQ ID NO: 23055 - protein, 10 aa, Borrelia burgdorferi
SEKYVFEKDN

SEQ ID NO: 23056 - protein, 10 aa, Borrelia burgdorferi
EKYVFEKDNK

SEQ ID NO: 23057 - protein, 10 aa, Borrelia burgdorferi
KYVFEKDNKY

SEQ ID NO: 23058 - protein, 10 aa, Borrelia burgdorferi
YVFEKDNKYY

SEQ ID NO: 23059 - protein, 10 aa, Borrelia burgdorferi
VFEKDNKYYD

SEQ ID NO: 23060 - protein, 10 aa, Borrelia burgdorferi
FEKDNKYYDS

SEQ ID NO: 23061 - protein, 10 aa, Borrelia burgdorferi
EKDNKYYDSN

SEQ ID NO: 23062 - protein, 10 aa, Borrelia burgdorferi
KDNKYYDSNE

SEQ ID NO: 23063 - protein, 10 aa, Borrelia burgdorferi
DNKYYDSNEV

SEQ ID NO: 23064 - protein, 10 aa, Borrelia burgdorferi
NKYYDSNEVE

SEQ ID NO: 23065 - protein, 10 aa, Borrelia burgdorferi
KYYDSNEVEL

SEQ ID NO: 23066 - protein, 10 aa, Borrelia burgdorferi
YYDSNEVELE

SEQ ID NO: 23067 - protein, 10 aa, Borrelia burgdorferi
YDSNEVELEE

SEQ ID NO: 23068 - protein, 10 aa, Borrelia burgdorferi
DSNEVELEEI

SEQ ID NO: 23069 - protein, 10 aa, Borrelia burgdorferi
SNEVELEEIT

SEQ ID NO: 23070 - protein, 10 aa, Borrelia burgdorferi
NEVELEEITF

SEQ ID NO: 23071 - protein, 10 aa, Borrelia burgdorferi
EVELEEITFY

SEQ ID NO: 23072 - protein, 10 aa, Borrelia burgdorferi
VELEEITFYT

SEQ ID NO: 23073 - protein, 10 aa, Borrelia burgdorferi
ELEEITFYTT

SEQ ID NO: 23074 - protein, 10 aa, Borrelia burgdorferi
LEEITFYTTN

SEQ ID NO: 23075 - protein, 10 aa, Borrelia burgdorferi
EEITFYTTND

SEQ ID NO: 23076 - protein, 10 aa, Borrelia burgdorferi
EITFYTTNDS

SEQ ID NO: 23077 - protein, 10 aa, Borrelia burgdorferi
ITFYTTNDSS

SEQ ID NO: 23078 - protein, 10 aa, Borrelia burgdorferi
TFYTTNDSST

SEQ ID NO: 23079 - protein, 10 aa, Borrelia burgdorferi
FYTTNDSSTA

SEQ ID NO: 23080 - protein, 10 aa, Borrelia burgdorferi
YTTNDSSTAY

SEQ ID NO: 23081 - protein, 10 aa, Borrelia burgdorferi
TTNDSSTAYK

SEQ ID NO: 23082 - protein, 10 aa, Borrelia burgdorferi
TNDSSTAYKM

SEQ ID NO: 23083 - protein, 10 aa, Borrelia burgdorferi
NDSSTAYKMY

SEQ ID NO: 23084 - protein, 10 aa, Borrelia burgdorferi
DSSTAYKMYV

SEQ ID NO: 23085 - protein, 10 aa, Borrelia burgdorferi
SSTAYKMYVN

SEQ ID NO: 23086 - protein, 10 aa, Borrelia burgdorferi
STAYKMYVNE

SEQ ID NO: 23087 - protein, 10 aa, Borrelia burgdorferi
TAYKMYVNEE

SEQ ID NO: 23088 - protein, 10 aa, Borrelia burgdorferi
AYKMYVNEEL

SEQ ID NO: 23089 - protein, 10 aa, Borrelia burgdorferi
YKMYVNEELD

SEQ ID NO: 23090 - protein, 10 aa, Borrelia burgdorferi
KMYVNEELDA

SEQ ID NO: 23091 - protein, 10 aa, Borrelia burgdorferi
MYVNEELDAI

SEQ ID NO: 23092 - protein, 10 aa, Borrelia burgdorferi
YVNEELDAIL

SEQ ID NO: 23093 - protein, 10 aa, Borrelia burgdorferi
VNEELDAILV

SEQ ID NO: 23094 - protein, 10 aa, Borrelia burgdorferi
NEELDAILVP

SEQ ID NO: 23095 - protein, 10 aa, Borrelia burgdorferi
EELDAILVPY

SEQ ID NO: 23096 - protein, 10 aa, Borrelia burgdorferi
ELDAILVPYP

SEQ ID NO: 23097 - protein, 10 aa, Borrelia burgdorferi
LDAILVPYPQ

SEQ ID NO: 23098 - protein, 10 aa, Borrelia burgdorferi
DAILVPYPQI

SEQ ID NO: 23099 - protein, 11 aa, Borrelia burgdorferi
MKLQRSLSLII

SEQ ID NO: 23100 - protein, 11 aa, Borrelia burgdorferi
KLQRSLSLIIF

SEQ ID NO: 23101 - protein, 11 aa, Borrelia burgdorferi
LQRSLSLIIFS

SEQ ID NO: 23102 - protein, 11 aa, Borrelia burgdorferi
QRSLSLIIFSL

SEQ ID NO: 23103 - protein, 11 aa, Borrelia burgdorferi
RSLSLIIFSLT

SEQ ID NO: 23104 - protein, 11 aa, Borrelia burgdorferi
SLSLIIFSLTV

SEQ ID NO: 23105 - protein, 11 aa, Borrelia burgdorferi
LSLIIFSLTVL

SEQ ID NO: 23106 - protein, 11 aa, Borrelia burgdorferi
SLIIFSLTVLC

SEQ ID NO: 23107 - protein, 11 aa, Borrelia burgdorferi
LIIFSLTVLCC

SEQ ID NO: 23108 - protein, 11 aa, Borrelia burgdorferi
IIFSLTVLCCD

SEQ ID NO: 23109 - protein, 11 aa, Borrelia burgdorferi
IFSLTVLCCDN

SEQ ID NO: 23110 - protein, 11 aa, Borrelia burgdorferi
FSLTVLCCDNK

SEQ ID NO: 23111 - protein, 11 aa, Borrelia burgdorferi
SLTVLCCDNKE

SEQ ID NO: 23112 - protein, 11 aa, Borrelia burgdorferi
LTVLCCDNKER

SEQ ID NO: 23113 - protein, 11 aa, Borrelia burgdorferi
TVLCCDNKERK

SEQ ID NO: 23114 - protein, 11 aa, Borrelia burgdorferi
VLCCDNKERKE

SEQ ID NO: 23115 - protein, 11 aa, Borrelia burgdorferi
LCCDNKERKEG

SEQ ID NO: 23116 - protein, 11 aa, Borrelia burgdorferi
CCDNKERKEGV

SEQ ID NO: 23117 - protein, 11 aa, Borrelia burgdorferi
CDNKERKEGVS

SEQ ID NO: 23118 - protein, 11 aa, Borrelia burgdorferi
DNKERKEGVST

SEQ ID NO: 23119 - protein, 11 aa, Borrelia burgdorferi
NKERKEGVSTK

SEQ ID NO: 23120 - protein, 11 aa, Borrelia burgdorferi
KERKEGVSTKI

SEQ ID NO: 23121 - protein, 11 aa, Borrelia burgdorferi
ERKEGVSTKIS

SEQ ID NO: 23122 - protein, 11 aa, Borrelia burgdorferi
RKEGVSTKISL

SEQ ID NO: 23123 - protein, 11 aa, Borrelia burgdorferi
KEGVSTKISLG

SEQ ID NO: 23124 - protein, 11 aa, Borrelia burgdorferi
EGVSTKISLGA

SEQ ID NO: 23125 - protein, 11 aa, Borrelia burgdorferi
GVSTKISLGAE

SEQ ID NO: 23126 - protein, 11 aa, Borrelia burgdorferi
VSTKISLGAEP

SEQ ID NO: 23127 - protein, 11 aa, Borrelia burgdorferi
STKISLGAEPR

SEQ ID NO: 23128 - protein, 11 aa, Borrelia burgdorferi
TKISLGAEPRS

SEQ ID NO: 23129 - protein, 11 aa, Borrelia burgdorferi
KISLGAEPRSL

SEQ ID NO: 23130 - protein, 11 aa, Borrelia burgdorferi
ISLGAEPRSLD

SEQ ID NO: 23131 - protein, 11 aa, Borrelia burgdorferi
SLGAEPRSLDP

SEQ ID NO: 23132 - protein, 11 aa, Borrelia burgdorferi
LGAEPRSLDPQ

SEQ ID NO: 23133 - protein, 11 aa, Borrelia burgdorferi
GAEPRSLDPQL

SEQ ID NO: 23134 - protein, 11 aa, Borrelia burgdorferi
AEPRSLDPQLA

SEQ ID NO: 23135 - protein, 11 aa, Borrelia burgdorferi
EPRSLDPQLAE

SEQ ID NO: 23136 - protein, 11 aa, Borrelia burgdorferi
PRSLDPQLAED

SEQ ID NO: 23137 - protein, 11 aa, Borrelia burgdorferi
RSLDPQLAEDN

SEQ ID NO: 23138 - protein, 11 aa, Borrelia burgdorferi
SLDPQLAEDNV

SEQ ID NO: 23139 - protein, 11 aa, Borrelia burgdorferi
LDPQLAEDNVA

SEQ ID NO: 23140 - protein, 11 aa, Borrelia burgdorferi
DPQLAEDNVAS

SEQ ID NO: 23141 - protein, 11 aa, Borrelia burgdorferi
PQLAEDNVASK

SEQ ID NO: 23142 - protein, 11 aa, Borrelia burgdorferi
QLAEDNVASKM

SEQ ID NO: 23143 - protein, 11 aa, Borrelia burgdorferi
LAEDNVASKMI

SEQ ID NO: 23144 - protein, 11 aa, Borrelia burgdorferi
AEDNVASKMID

SEQ ID NO: 23145 - protein, 11 aa, Borrelia burgdorferi
EDNVASKMIDT

SEQ ID NO: 23146 - protein, 11 aa, Borrelia burgdorferi
DNVASKMIDTL

SEQ ID NO: 23147 - protein, 11 aa, Borrelia burgdorferi
NVASKMIDTLY

SEQ ID NO: 23148 - protein, 11 aa, Borrelia burgdorferi
VASKMIDTLYR

SEQ ID NO: 23149 - protein, 11 aa, Borrelia burgdorferi
ASKMIDTLYRG

SEQ ID NO: 23150 - protein, 11 aa, Borrelia burgdorferi
SKMIDTLYRGI

SEQ ID NO: 23151 - protein, 11 aa, Borrelia burgdorferi
KMIDTLYRGIV

SEQ ID NO: 23152 - protein, 11 aa, Borrelia burgdorferi
MIDTLYRGIVT

SEQ ID NO: 23153 - protein, 11 aa, Borrelia burgdorferi
IDTLYRGIVTG

SEQ ID NO: 23154 - protein, 11 aa, Borrelia burgdorferi
DTLYRGIVTGD

SEQ ID NO: 23155 - protein, 11 aa, Borrelia burgdorferi
TLYRGIVTGDP

SEQ ID NO: 23156 - protein, 11 aa, Borrelia burgdorferi
LYRGIVTGDPN

SEQ ID NO: 23157 - protein, 11 aa, Borrelia burgdorferi
YRGIVTGDPNT

SEQ ID NO: 23158 - protein, 11 aa, Borrelia burgdorferi
RGIVTGDPNTG

SEQ ID NO: 23159 - protein, 11 aa, Borrelia burgdorferi
GIVTGDPNTGG

SEQ ID NO: 23160 - protein, 11 aa, Borrelia burgdorferi
IVTGDPNTGGH

SEQ ID NO: 23161 - protein, 11 aa, Borrelia burgdorferi
VTGDPNTGGHK

SEQ ID NO: 23162 - protein, 11 aa, Borrelia burgdorferi
TGDPNTGGHKP

SEQ ID NO: 23163 - protein, 11 aa, Borrelia burgdorferi
GDPNTGGHKPG

SEQ ID NO: 23164 - protein, 11 aa, Borrelia burgdorferi
DPNTGGHKPGL

SEQ ID NO: 23165 - protein, 11 aa, Borrelia burgdorferi
PNTGGHKPGLA

SEQ ID NO: 23166 - protein, 11 aa, Borrelia burgdorferi
NTGGHKPGLAK

SEQ ID NO: 23167 - protein, 11 aa, Borrelia burgdorferi
TGGHKPGLAKG

SEQ ID NO: 23168 - protein, 11 aa, Borrelia burgdorferi
GGHKPGLAKGW

SEQ ID NO: 23169 - protein, 11 aa, Borrelia burgdorferi
GHKPGLAKGWE

SEQ ID NO: 23170 - protein, 11 aa, Borrelia burgdorferi
HKPGLAKGWET

SEQ ID NO: 23171 - protein, 11 aa, Borrelia burgdorferi
KPGLAKGWETS

SEQ ID NO: 23172 - protein, 11 aa, Borrelia burgdorferi
PGLAKGWETSS

SEQ ID NO: 23173 - protein, 11 aa, Borrelia burgdorferi
GLAKGWETSSD

SEQ ID NO: 23174 - protein, 11 aa, Borrelia burgdorferi
LAKGWETSSDG

SEQ ID NO: 23175 - protein, 11 aa, Borrelia burgdorferi
AKGWETSSDGT

SEQ ID NO: 23176 - protein, 11 aa, Borrelia burgdorferi
KGWETSSDGTA

SEQ ID NO: 23177 - protein, 11 aa, Borrelia burgdorferi
GWETSSDGTAY

SEQ ID NO: 23178 - protein, 11 aa, Borrelia burgdorferi
WETSSDGTAYP

SEQ ID NO: 23179 - protein, 11 aa, Borrelia burgdorferi
ETSSDGTAYPF

SEQ ID NO: 23180 - protein, 11 aa, Borrelia burgdorferi
TSSDGTAYPFY

SEQ ID NO: 23181 - protein, 11 aa, Borrelia burgdorferi
SSDGTAYPFYL

SEQ ID NO: 23182 - protein, 11 aa, Borrelia burgdorferi
SDGTAYPFYLR

SEQ ID NO: 23183 - protein, 11 aa, Borrelia burgdorferi
DGTAYPFYLRD

SEQ ID NO: 23184 - protein, 11 aa, Borrelia burgdorferi
GTAYPFYLRDN

SEQ ID NO: 23185 - protein, 11 aa, Borrelia burgdorferi
TAYPFYLRDNL

SEQ ID NO: 23186 - protein, 11 aa, Borrelia burgdorferi
AYPFYLRDNLT

SEQ ID NO: 23187 - protein, 11 aa, Borrelia burgdorferi
YPFYLRDNLTW

SEQ ID NO: 23188 - protein, 11 aa, Borrelia burgdorferi
PFYLRDNLTWS

SEQ ID NO: 23189 - protein, 11 aa, Borrelia burgdorferi
FYLRDNLTWSD

SEQ ID NO: 23190 - protein, 11 aa, Borrelia burgdorferi
YLRDNLTWSDG

SEQ ID NO: 23191 - protein, 11 aa, Borrelia burgdorferi
LRDNLTWSDGV

SEQ ID NO: 23192 - protein, 11 aa, Borrelia burgdorferi
RDNLTWSDGVA

SEQ ID NO: 23193 - protein, 11 aa, Borrelia burgdorferi
DNLTWSDGVAI

SEQ ID NO: 23194 - protein, 11 aa, Borrelia burgdorferi
NLTWSDGVAIT

SEQ ID NO: 23195 - protein, 11 aa, Borrelia burgdorferi
LTWSDGVAITA

SEQ ID NO: 23196 - protein, 11 aa, Borrelia burgdorferi
TWSDGVAITAE

SEQ ID NO: 23197 - protein, 11 aa, Borrelia burgdorferi
WSDGVAITAEG

SEQ ID NO: 23198 - protein, 11 aa, Borrelia burgdorferi
SDGVAITAEGI

SEQ ID NO: 23199 - protein, 11 aa, Borrelia burgdorferi
DGVAITAEGIR

SEQ ID NO: 23200 - protein, 11 aa, Borrelia burgdorferi
GVAITAEGIRK

SEQ ID NO: 23201 - protein, 11 aa, Borrelia burgdorferi
VAITAEGIRKS

SEQ ID NO: 23202 - protein, 11 aa, Borrelia burgdorferi
AITAEGIRKSY

SEQ ID NO: 23203 - protein, 11 aa, Borrelia burgdorferi
ITAEGIRKSYL

SEQ ID NO: 23204 - protein, 11 aa, Borrelia burgdorferi
TAEGIRKSYLR

SEQ ID NO: 23205 - protein, 11 aa, Borrelia burgdorferi
AEGIRKSYLRI

SEQ ID NO: 23206 - protein, 11 aa, Borrelia burgdorferi
EGIRKSYLRIL

SEQ ID NO: 23207 - protein, 11 aa, Borrelia burgdorferi
GIRKSYLRILN

SEQ ID NO: 23208 - protein, 11 aa, Borrelia burgdorferi
IRKSYLRILNK

SEQ ID NO: 23209 - protein, 11 aa, Borrelia burgdorferi
RKSYLRILNKE

SEQ ID NO: 23210 - protein, 11 aa, Borrelia burgdorferi
KSYLRILNKET

SEQ ID NO: 23211 - protein, 11 aa, Borrelia burgdorferi
SYLRILNKETG

SEQ ID NO: 23212 - protein, 11 aa, Borrelia burgdorferi
YLRILNKETGS

SEQ ID NO: 23213 - protein, 11 aa, Borrelia burgdorferi
LRILNKETGST

SEQ ID NO: 23214 - protein, 11 aa, Borrelia burgdorferi
RILNKETGSTY

SEQ ID NO: 23215 - protein, 11 aa, Borrelia burgdorferi
ILNKETGSTYV

SEQ ID NO: 23216 - protein, 11 aa, Borrelia burgdorferi
LNKETGSTYVD

SEQ ID NO: 23217 - protein, 11 aa, Borrelia burgdorferi
NKETGSTYVDM

SEQ ID NO: 23218 - protein, 11 aa, Borrelia burgdorferi
KETGSTYVDMV

SEQ ID NO: 23219 - protein, 11 aa, Borrelia burgdorferi
ETGSTYVDMVK

SEQ ID NO: 23220 - protein, 11 aa, Borrelia burgdorferi
TGSTYVDMVKS

SEQ ID NO: 23221 - protein, 11 aa, Borrelia burgdorferi
GSTYVDMVKSI

SEQ ID NO: 23222 - protein, 11 aa, Borrelia burgdorferi
STYVDMVKSII

SEQ ID NO: 23223 - protein, 11 aa, Borrelia burgdorferi
TYVDMVKSIIK

SEQ ID NO: 23224 - protein, 11 aa, Borrelia burgdorferi
YVDMVKSIIKN

SEQ ID NO: 23225 - protein, 11 aa, Borrelia burgdorferi
VDMVKSIIKNG

SEQ ID NO: 23226 - protein, 11 aa, Borrelia burgdorferi
DMVKSIIKNGQ

SEQ ID NO: 23227 - protein, 11 aa, Borrelia burgdorferi
MVKSIIKNGQE

SEQ ID NO: 23228 - protein, 11 aa, Borrelia burgdorferi
VKSIIKNGQEY

SEQ ID NO: 23229 - protein, 11 aa, Borrelia burgdorferi
KSIIKNGQEYF

SEQ ID NO: 23230 - protein, 11 aa, Borrelia burgdorferi
SIIKNGQEYFD

SEQ ID NO: 23231 - protein, 11 aa, Borrelia burgdorferi
IIKNGQEYFDG

SEQ ID NO: 23232 - protein, 11 aa, Borrelia burgdorferi
IKNGQEYFDGQ

SEQ ID NO: 23233 - protein, 11 aa, Borrelia burgdorferi
KNGQEYFDGQV

SEQ ID NO: 23234 - protein, 11 aa, Borrelia burgdorferi
NGQEYFDGQVT

SEQ ID NO: 23235 - protein, 11 aa, Borrelia burgdorferi
GQEYFDGQVTD

SEQ ID NO: 23236 - protein, 11 aa, Borrelia burgdorferi
QEYFDGQVTDS

SEQ ID NO: 23237 - protein, 11 aa, Borrelia burgdorferi
EYFDGQVTDSE

SEQ ID NO: 23238 - protein, 11 aa, Borrelia burgdorferi
YFDGQVTDSEL

SEQ ID NO: 23239 - protein, 11 aa, Borrelia burgdorferi
FDGQVTDSELG

SEQ ID NO: 23240 - protein, 11 aa, Borrelia burgdorferi
DGQVTDSELGI

SEQ ID NO: 23241 - protein, 11 aa, Borrelia burgdorferi
GQVTDSELGIR

SEQ ID NO: 23242 - protein, 11 aa, Borrelia burgdorferi
QVTDSELGIRA

SEQ ID NO: 23243 - protein, 11 aa, Borrelia burgdorferi
VTDSELGIRAI

SEQ ID NO: 23244 - protein, 11 aa, Borrelia burgdorferi
TDSELGIRAID

SEQ ID NO: 23245 - protein, 11 aa, Borrelia burgdorferi
DSELGIRAIDS

SEQ ID NO: 23246 - protein, 11 aa, Borrelia burgdorferi
SELGIRAIDSK

SEQ ID NO: 23247 - protein, 11 aa, Borrelia burgdorferi
ELGIRAIDSKT

SEQ ID NO: 23248 - protein, 11 aa, Borrelia burgdorferi
LGIRAIDSKTL

SEQ ID NO: 23249 - protein, 11 aa, Borrelia burgdorferi
GIRAIDSKTLE

SEQ ID NO: 23250 - protein, 11 aa, Borrelia burgdorferi
IRAIDSKTLEI

SEQ ID NO: 23251 - protein, 11 aa, Borrelia burgdorferi
RAIDSKTLEIT

SEQ ID NO: 23252 - protein, 11 aa, Borrelia burgdorferi
AIDSKTLEITL

SEQ ID NO: 23253 - protein, 11 aa, Borrelia burgdorferi
IDSKTLEITLA

SEQ ID NO: 23254 - protein, 11 aa, Borrelia burgdorferi
DSKTLEITLAS

SEQ ID NO: 23255 - protein, 11 aa, Borrelia burgdorferi
SKTLEITLASP

SEQ ID NO: 23256 - protein, 11 aa, Borrelia burgdorferi
KTLEITLASPK

SEQ ID NO: 23257 - protein, 11 aa, Borrelia burgdorferi
TLEITLASPKP

SEQ ID NO: 23258 - protein, 11 aa, Borrelia burgdorferi
LEITLASPKPY

SEQ ID NO: 23259 - protein, 11 aa, Borrelia burgdorferi
EITLASPKPYF

SEQ ID NO: 23260 - protein, 11 aa, Borrelia burgdorferi
ITLASPKPYFI

SEQ ID NO: 23261 - protein, 11 aa, Borrelia burgdorferi
TLASPKPYFID

SEQ ID NO: 23262 - protein, 11 aa, Borrelia burgdorferi
LASPKPYFIDL

SEQ ID NO: 23263 - protein, 11 aa, Borrelia burgdorferi
ASPKPYFIDLL

SEQ ID NO: 23264 - protein, 11 aa, Borrelia burgdorferi
SPKPYFIDLLV

SEQ ID NO: 23265 - protein, 11 aa, Borrelia burgdorferi
PKPYFIDLLVH

SEQ ID NO: 23266 - protein, 11 aa, Borrelia burgdorferi
KPYFIDLLVHQ

SEQ ID NO: 23267 - protein, 11 aa, Borrelia burgdorferi
PYFIDLLVHQS

SEQ ID NO: 23268 - protein, 11 aa, Borrelia burgdorferi
YFIDLLVHQSF

SEQ ID NO: 23269 - protein, 11 aa, Borrelia burgdorferi
FIDLLVHQSFI

SEQ ID NO: 23270 - protein, 11 aa, Borrelia burgdorferi
IDLLVHQSFIP

SEQ ID NO: 23271 - protein, 11 aa, Borrelia burgdorferi
DLLVHQSFIPV

SEQ ID NO: 23272 - protein, 11 aa, Borrelia burgdorferi
LLVHQSFIPVP

SEQ ID NO: 23273 - protein, 11 aa, Borrelia burgdorferi
LVHQSFIPVPV

SEQ ID NO: 23274 - protein, 11 aa, Borrelia burgdorferi
VHQSFIPVPVH

SEQ ID NO: 23275 - protein, 11 aa, Borrelia burgdorferi
HQSFIPVPVHV

SEQ ID NO: 23276 - protein, 11 aa, Borrelia burgdorferi
QSFIPVPVHVT

SEQ ID NO: 23277 - protein, 11 aa, Borrelia burgdorferi
SFIPVPVHVTD

SEQ ID NO: 23278 - protein, 11 aa, Borrelia burgdorferi
FIPVPVHVTDK

SEQ ID NO: 23279 - protein, 11 aa, Borrelia burgdorferi
IPVPVHVTDKY

SEQ ID NO: 23280 - protein, 11 aa, Borrelia burgdorferi
PVPVHVTDKYG

SEQ ID NO: 23281 - protein, 11 aa, Borrelia burgdorferi
VPVHVTDKYGQ

SEQ ID NO: 23282 - protein, 11 aa, Borrelia burgdorferi
PVHVTDKYGQN

SEQ ID NO: 23283 - protein, 11 aa, Borrelia burgdorferi
VHVTDKYGQNW

SEQ ID NO: 23284 - protein, 11 aa, Borrelia burgdorferi
HVTDKYGQNWT

SEQ ID NO: 23285 - protein, 11 aa, Borrelia burgdorferi
VTDKYGQNWTS

SEQ ID NO: 23286 - protein, 11 aa, Borrelia burgdorferi
TDKYGQNWTSP

SEQ ID NO: 23287 - protein, 11 aa, Borrelia burgdorferi
DKYGQNWTSPE

SEQ ID NO: 23288 - protein, 11 aa, Borrelia burgdorferi
KYGQNWTSPEN

SEQ ID NO: 23289 - protein, 11 aa, Borrelia burgdorferi
YGQNWTSPENM

SEQ ID NO: 23290 - protein, 11 aa, Borrelia burgdorferi
GQNWTSPENMV

SEQ ID NO: 23291 - protein, 11 aa, Borrelia burgdorferi
QNWTSPENMVT

SEQ ID NO: 23292 - protein, 11 aa, Borrelia burgdorferi
NWTSPENMVTS

SEQ ID NO: 23293 - protein, 11 aa, Borrelia burgdorferi
WTSPENMVTSG

SEQ ID NO: 23294 - protein, 11 aa, Borrelia burgdorferi
TSPENMVTSGP

SEQ ID NO: 23295 - protein, 11 aa, Borrelia burgdorferi
SPENMVTSGPF

SEQ ID NO: 23296 - protein, 11 aa, Borrelia burgdorferi
PENMVTSGPFK

SEQ ID NO: 23297 - protein, 11 aa, Borrelia burgdorferi
ENMVTSGPFKL

SEQ ID NO: 23298 - protein, 11 aa, Borrelia burgdorferi
NMVTSGPFKLK

SEQ ID NO: 23299 - protein, 11 aa, Borrelia burgdorferi
MVTSGPFKLKE

SEQ ID NO: 23300 - protein, 11 aa, Borrelia burgdorferi
VTSGPFKLKER

SEQ ID NO: 23301 - protein, 11 aa, Borrelia burgdorferi
TSGPFKLKERI

SEQ ID NO: 23302 - protein, 11 aa, Borrelia burgdorferi
SGPFKLKERIP

SEQ ID NO: 23303 - protein, 11 aa, Borrelia burgdorferi
GPFKLKERIPS

SEQ ID NO: 23304 - protein, 11 aa, Borrelia burgdorferi
PFKLKERIPSE

SEQ ID NO: 23305 - protein, 11 aa, Borrelia burgdorferi
FKLKERIPSEK

SEQ ID NO: 23306 - protein, 11 aa, Borrelia burgdorferi
KLKERIPSEKY

SEQ ID NO: 23307 - protein, 11 aa, Borrelia burgdorferi
LKERIPSEKYV

SEQ ID NO: 23308 - protein, 11 aa, Borrelia burgdorferi
KERIPSEKYVF

SEQ ID NO: 23309 - protein, 11 aa, Borrelia burgdorferi
ERIPSEKYVFE

SEQ ID NO: 23310 - protein, 11 aa, Borrelia burgdorferi
RIPSEKYVFEK

SEQ ID NO: 23311 - protein, 11 aa, Borrelia burgdorferi
IPSEKYVFEKD

SEQ ID NO: 23312 - protein, 11 aa, Borrelia burgdorferi
PSEKYVFEKDN

SEQ ID NO: 23313 - protein, 11 aa, Borrelia burgdorferi
SEKYVFEKDNK

SEQ ID NO: 23314 - protein, 11 aa, Borrelia burgdorferi
EKYVFEKDNKY

SEQ ID NO: 23315 - protein, 11 aa, Borrelia burgdorferi
KYVFEKDNKYY

SEQ ID NO: 23316 - protein, 11 aa, Borrelia burgdorferi
YVFEKDNKYYD

SEQ ID NO: 23317 - protein, 11 aa, Borrelia burgdorferi
VFEKDNKYYDS

SEQ ID NO: 23318 - protein, 11 aa, Borrelia burgdorferi
FEKDNKYYDSN

SEQ ID NO: 23319 - protein, 11 aa, Borrelia burgdorferi
EKDNKYYDSNE

SEQ ID NO: 23320 - protein, 11 aa, Borrelia burgdorferi
KDNKYYDSNEV

SEQ ID NO: 23321 - protein, 11 aa, Borrelia burgdorferi
DNKYYDSNEVE

SEQ ID NO: 23322 - protein, 11 aa, Borrelia burgdorferi
NKYYDSNEVEL

SEQ ID NO: 23323 - protein, 11 aa, Borrelia burgdorferi
KYYDSNEVELE

SEQ ID NO: 23324 - protein, 11 aa, Borrelia burgdorferi
YYDSNEVELEE

SEQ ID NO: 23325 - protein, 11 aa, Borrelia burgdorferi
YDSNEVELEEI

SEQ ID NO: 23326 - protein, 11 aa, Borrelia burgdorferi
DSNEVELEEIT

SEQ ID NO: 23327 - protein, 11 aa, Borrelia burgdorferi
SNEVELEEITF

SEQ ID NO: 23328 - protein, 11 aa, Borrelia burgdorferi
NEVELEEITFY

SEQ ID NO: 23329 - protein, 11 aa, Borrelia burgdorferi
EVELEEITFYT

SEQ ID NO: 23330 - protein, 11 aa, Borrelia burgdorferi
VELEEITFYTT

SEQ ID NO: 23331 - protein, 11 aa, Borrelia burgdorferi
ELEEITFYTTN

SEQ ID NO: 23332 - protein, 11 aa, Borrelia burgdorferi
LEEITFYTTND

SEQ ID NO: 23333 - protein, 11 aa, Borrelia burgdorferi
EEITFYTTNDS

SEQ ID NO: 23334 - protein, 11 aa, Borrelia burgdorferi
EITFYTTNDSS

SEQ ID NO: 23335 - protein, 11 aa, Borrelia burgdorferi
ITFYTTNDSST

SEQ ID NO: 23336 - protein, 11 aa, Borrelia burgdorferi
TFYTTNDSSTA

SEQ ID NO: 23337 - protein, 11 aa, Borrelia burgdorferi
FYTTNDSSTAY

SEQ ID NO: 23338 - protein, 11 aa, Borrelia burgdorferi
YTTNDSSTAYK

SEQ ID NO: 23339 - protein, 11 aa, Borrelia burgdorferi
TTNDSSTAYKM

SEQ ID NO: 23340 - protein, 11 aa, Borrelia burgdorferi
TNDSSTAYKMY

SEQ ID NO: 23341 - protein, 11 aa, Borrelia burgdorferi
NDSSTAYKMYV

SEQ ID NO: 23342 - protein, 11 aa, Borrelia burgdorferi
DSSTAYKMYVN

SEQ ID NO: 23343 - protein, 11 aa, Borrelia burgdorferi
SSTAYKMYVNE

SEQ ID NO: 23344 - protein, 11 aa, Borrelia burgdorferi
STAYKMYVNEE

SEQ ID NO: 23345 - protein, 11 aa, Borrelia burgdorferi
TAYKMYVNEEL

SEQ ID NO: 23346 - protein, 11 aa, Borrelia burgdorferi
AYKMYVNEELD

SEQ ID NO: 23347 - protein, 11 aa, Borrelia burgdorferi
YKMYVNEELDA

SEQ ID NO: 23348 - protein, 11 aa, Borrelia burgdorferi
KMYVNEELDAI

SEQ ID NO: 23349 - protein, 11 aa, Borrelia burgdorferi
MYVNEELDAIL

SEQ ID NO: 23350 - protein, 11 aa, Borrelia burgdorferi
YVNEELDAILV

SEQ ID NO: 23351 - protein, 11 aa, Borrelia burgdorferi
VNEELDAILVP

SEQ ID NO: 23352 - protein, 11 aa, Borrelia burgdorferi
NEELDAILVPY

SEQ ID NO: 23353 - protein, 11 aa, Borrelia burgdorferi
EELDAILVPYP

SEQ ID NO: 23354 - protein, 11 aa, Borrelia burgdorferi
ELDAILVPYPQ

SEQ ID NO: 23355 - protein, 11 aa, Borrelia burgdorferi
LDAILVPYPQI

SEQ ID NO: 23356 - protein, 8 aa, Borrelia burgdorferi B31
MNLINKLF

SEQ ID NO: 23357 - protein, 8 aa, Borrelia burgdorferi B31
NLINKLFI

SEQ ID NO: 23358 - protein, 8 aa, Borrelia burgdorferi B31
LINKLFIL

SEQ ID NO: 23359 - protein, 8 aa, Borrelia burgdorferi B31
INKLFILT

SEQ ID NO: 23360 - protein, 8 aa, Borrelia burgdorferi B31
NKLFILTI

SEQ ID NO: 23361 - protein, 8 aa, Borrelia burgdorferi B31
KLFILTIL

SEQ ID NO: 23362 - protein, 8 aa, Borrelia burgdorferi B31
LFILTILF

SEQ ID NO: 23363 - protein, 8 aa, Borrelia burgdorferi B31
FILTILFS

SEQ ID NO: 23364 - protein, 8 aa, Borrelia burgdorferi B31
ILTILFSS

SEQ ID NO: 23365 - protein, 8 aa, Borrelia burgdorferi B31
LTILFSSV

SEQ ID NO: 23366 - protein, 8 aa, Borrelia burgdorferi B31
TILFSSVI

SEQ ID NO: 23367 - protein, 8 aa, Borrelia burgdorferi B31
ILFSSVIS

SEQ ID NO: 23368 - protein, 8 aa, Borrelia burgdorferi B31
LFSSVISC

SEQ ID NO: 23369 - protein, 8 aa, Borrelia burgdorferi B31
FSSVISCK

SEQ ID NO: 23370 - protein, 8 aa, Borrelia burgdorferi B31
SSVISCKL

SEQ ID NO: 23371 - protein, 8 aa, Borrelia burgdorferi B31
SVISCKLY

SEQ ID NO: 23372 - protein, 8 aa, Borrelia burgdorferi B31
VISCKLYK

SEQ ID NO: 23373 - protein, 8 aa, Borrelia burgdorferi B31
ISCKLYKK

SEQ ID NO: 23374 - protein, 8 aa, Borrelia burgdorferi B31
SCKLYKKI

SEQ ID NO: 23375 - protein, 8 aa, Borrelia burgdorferi B31
CKLYKKIT

SEQ ID NO: 23376 - protein, 8 aa, Borrelia burgdorferi B31
KLYKKITY

SEQ ID NO: 23377 - protein, 8 aa, Borrelia burgdorferi B31
LYKKITYN

SEQ ID NO: 23378 - protein, 8 aa, Borrelia burgdorferi B31
YKKITYNA

SEQ ID NO: 23379 - protein, 8 aa, Borrelia burgdorferi B31
KKITYNAD

SEQ ID NO: 23380 - protein, 8 aa, Borrelia burgdorferi B31
KITYNADQ

SEQ ID NO: 23381 - protein, 8 aa, Borrelia burgdorferi B31
ITYNADQV

SEQ ID NO: 23382 - protein, 8 aa, Borrelia burgdorferi B31
TYNADQVI

SEQ ID NO: 23383 - protein, 8 aa, Borrelia burgdorferi B31
YNADQVID

SEQ ID NO: 23384 - protein, 8 aa, Borrelia burgdorferi B31
NADQVIDK

SEQ ID NO: 23385 - protein, 8 aa, Borrelia burgdorferi B31
ADQVIDKL

SEQ ID NO: 23386 - protein, 8 aa, Borrelia burgdorferi B31
DQVIDKLK

SEQ ID NO: 23387 - protein, 8 aa, Borrelia burgdorferi B31
QVIDKLKS

SEQ ID NO: 23388 - protein, 8 aa, Borrelia burgdorferi B31
VIDKLKSN

SEQ ID NO: 23389 - protein, 8 aa, Borrelia burgdorferi B31
IDKLKSNN

SEQ ID NO: 23390 - protein, 8 aa, Borrelia burgdorferi B31
DKLKSNNG

SEQ ID NO: 23391 - protein, 8 aa, Borrelia burgdorferi B31
KLKSNNGS

SEQ ID NO: 23392 - protein, 8 aa, Borrelia burgdorferi B31
LKSNNGSF

SEQ ID NO: 23393 - protein, 8 aa, Borrelia burgdorferi B31
KSNNGSFN

SEQ ID NO: 23394 - protein, 8 aa, Borrelia burgdorferi B31
SNNGSFNT

SEQ ID NO: 23395 - protein, 8 aa, Borrelia burgdorferi B31
NNGSFNTL

SEQ ID NO: 23396 - protein, 8 aa, Borrelia burgdorferi B31
NGSFNTLK

SEQ ID NO: 23397 - protein, 8 aa, Borrelia burgdorferi B31
GSFNTLKS

SEQ ID NO: 23398 - protein, 8 aa, Borrelia burgdorferi B31
SFNTLKSN

SEQ ID NO: 23399 - protein, 8 aa, Borrelia burgdorferi B31
FNTLKSND

SEQ ID NO: 23400 - protein, 8 aa, Borrelia burgdorferi B31
NTLKSNDD

SEQ ID NO: 23401 - protein, 8 aa, Borrelia burgdorferi B31
TLKSNDDS

SEQ ID NO: 23402 - protein, 8 aa, Borrelia burgdorferi B31
LKSNDDSK

SEQ ID NO: 23403 - protein, 8 aa, Borrelia burgdorferi B31
KSNDDSKR

SEQ ID NO: 23404 - protein, 8 aa, Borrelia burgdorferi B31
SNDDSKRS

SEQ ID NO: 23405 - protein, 8 aa, Borrelia burgdorferi B31
NDDSKRSG

SEQ ID NO: 23406 - protein, 8 aa, Borrelia burgdorferi B31
DDSKRSGR

SEQ ID NO: 23407 - protein, 8 aa, Borrelia burgdorferi B31
DSKRSGRK

SEQ ID NO: 23408 - protein, 8 aa, Borrelia burgdorferi B31
SKRSGRKP

SEQ ID NO: 23409 - protein, 8 aa, Borrelia burgdorferi B31
KRSGRKPR

SEQ ID NO: 23410 - protein, 8 aa, Borrelia burgdorferi B31
RSGRKPRS

SEQ ID NO: 23411 - protein, 8 aa, Borrelia burgdorferi B31
SGRKPRSV

SEQ ID NO: 23412 - protein, 8 aa, Borrelia burgdorferi B31
GRKPRSVD

SEQ ID NO: 23413 - protein, 8 aa, Borrelia burgdorferi B31
RKPRSVDN

SEQ ID NO: 23414 - protein, 8 aa, Borrelia burgdorferi B31
KPRSVDNT

SEQ ID NO: 23415 - protein, 8 aa, Borrelia burgdorferi B31
PRSVDNTY

SEQ ID NO: 23416 - protein, 8 aa, Borrelia burgdorferi B31
RSVDNTYM

SEQ ID NO: 23417 - protein, 8 aa, Borrelia burgdorferi B31
SVDNTYMD

SEQ ID NO: 23418 - protein, 8 aa, Borrelia burgdorferi B31
VDNTYMDQ

SEQ ID NO: 23419 - protein, 8 aa, Borrelia burgdorferi B31
DNTYMDQD

SEQ ID NO: 23420 - protein, 8 aa, Borrelia burgdorferi B31
NTYMDQDT

SEQ ID NO: 23421 - protein, 8 aa, Borrelia burgdorferi B31
TYMDQDTG

SEQ ID NO: 23422 - protein, 8 aa, Borrelia burgdorferi B31
YMDQDTGK

SEQ ID NO: 23423 - protein, 8 aa, Borrelia burgdorferi B31
MDQDTGKK

SEQ ID NO: 23424 - protein, 8 aa, Borrelia burgdorferi B31
DQDTGKKP

SEQ ID NO: 23425 - protein, 8 aa, Borrelia burgdorferi B31
QDTGKKPL

SEQ ID NO: 23426 - protein, 8 aa, Borrelia burgdorferi B31
DTGKKPLM

SEQ ID NO: 23427 - protein, 8 aa, Borrelia burgdorferi B31
TGKKPLMA

SEQ ID NO: 23428 - protein, 8 aa, Borrelia burgdorferi B31
GKKPLMAD

SEQ ID NO: 23429 - protein, 8 aa, Borrelia burgdorferi B31
KKPLMADM

SEQ ID NO: 23430 - protein, 8 aa, Borrelia burgdorferi B31
KPLMADMQ

SEQ ID NO: 23431 - protein, 8 aa, Borrelia burgdorferi B31
PLMADMQP

SEQ ID NO: 23432 - protein, 8 aa, Borrelia burgdorferi B31
LMADMQPD

SEQ ID NO: 23433 - protein, 8 aa, Borrelia burgdorferi B31
MADMQPDM

SEQ ID NO: 23434 - protein, 8 aa, Borrelia burgdorferi B31
ADMQPDMQ

SEQ ID NO: 23435 - protein, 8 aa, Borrelia burgdorferi B31
DMQPDMQN

SEQ ID NO: 23436 - protein, 8 aa, Borrelia burgdorferi B31
MQPDMQND

SEQ ID NO: 23437 - protein, 8 aa, Borrelia burgdorferi B31
QPDMQNDN

SEQ ID NO: 23438 - protein, 8 aa, Borrelia burgdorferi B31
PDMQNDNS

SEQ ID NO: 23439 - protein, 8 aa, Borrelia burgdorferi B31
DMQNDNSS

SEQ ID NO: 23440 - protein, 8 aa, Borrelia burgdorferi B31
MQNDNSSS

SEQ ID NO: 23441 - protein, 8 aa, Borrelia burgdorferi B31
QNDNSSSN

SEQ ID NO: 23442 - protein, 8 aa, Borrelia burgdorferi B31
NDNSSSNH

SEQ ID NO: 23443 - protein, 8 aa, Borrelia burgdorferi B31
DNSSSNHT

SEQ ID NO: 23444 - protein, 8 aa, Borrelia burgdorferi B31
NSSSNHTL

SEQ ID NO: 23445 - protein, 8 aa, Borrelia burgdorferi B31
SSSNHTLQ

SEQ ID NO: 23446 - protein, 8 aa, Borrelia burgdorferi B31
SSNHTLQV

SEQ ID NO: 23447 - protein, 8 aa, Borrelia burgdorferi B31
SNHTLQVN

SEQ ID NO: 23448 - protein, 8 aa, Borrelia burgdorferi B31
NHTLQVNI

SEQ ID NO: 23449 - protein, 8 aa, Borrelia burgdorferi B31
HTLQVNIQ

SEQ ID NO: 23450 - protein, 8 aa, Borrelia burgdorferi B31
TLQVNIQD

SEQ ID NO: 23451 - protein, 8 aa, Borrelia burgdorferi B31
LQVNIQDN

SEQ ID NO: 23452 - protein, 8 aa, Borrelia burgdorferi B31
QVNIQDNE

SEQ ID NO: 23453 - protein, 8 aa, Borrelia burgdorferi B31
VNIQDNEA

SEQ ID NO: 23454 - protein, 8 aa, Borrelia burgdorferi B31
NIQDNEAS

SEQ ID NO: 23455 - protein, 8 aa, Borrelia burgdorferi B31
IQDNEASE

SEQ ID NO: 23456 - protein, 8 aa, Borrelia burgdorferi B31
QDNEASEA

SEQ ID NO: 23457 - protein, 8 aa, Borrelia burgdorferi B31
DNEASEAR

SEQ ID NO: 23458 - protein, 8 aa, Borrelia burgdorferi B31
NEASEARN

SEQ ID NO: 23459 - protein, 8 aa, Borrelia burgdorferi B31
EASEARNI

SEQ ID NO: 23460 - protein, 8 aa, Borrelia burgdorferi B31
ASEARNIM

SEQ ID NO: 23461 - protein, 8 aa, Borrelia burgdorferi B31
SEARNIMT

SEQ ID NO: 23462 - protein, 8 aa, Borrelia burgdorferi B31
EARNIMTE

SEQ ID NO: 23463 - protein, 8 aa, Borrelia burgdorferi B31
ARNIMTEI

SEQ ID NO: 23464 - protein, 8 aa, Borrelia burgdorferi B31
RNIMTEIE

SEQ ID NO: 23465 - protein, 8 aa, Borrelia burgdorferi B31
NIMTEIES

SEQ ID NO: 23466 - protein, 8 aa, Borrelia burgdorferi B31
IMTEIESS

SEQ ID NO: 23467 - protein, 8 aa, Borrelia burgdorferi B31
MTEIESSK

SEQ ID NO: 23468 - protein, 8 aa, Borrelia burgdorferi B31
TEIESSKE

SEQ ID NO: 23469 - protein, 8 aa, Borrelia burgdorferi B31
EIESSKEE

SEQ ID NO: 23470 - protein, 8 aa, Borrelia burgdorferi B31
IESSKEEY

SEQ ID NO: 23471 - protein, 8 aa, Borrelia burgdorferi B31
ESSKEEYN

SEQ ID NO: 23472 - protein, 8 aa, Borrelia burgdorferi B31
SSKEEYNR

SEQ ID NO: 23473 - protein, 8 aa, Borrelia burgdorferi B31
SKEEYNRI

SEQ ID NO: 23474 - protein, 8 aa, Borrelia burgdorferi B31
KEEYNRIN

SEQ ID NO: 23475 - protein, 8 aa, Borrelia burgdorferi B31
EEYNRINE

SEQ ID NO: 23476 - protein, 8 aa, Borrelia burgdorferi B31
EYNRINED

SEQ ID NO: 23477 - protein, 8 aa, Borrelia burgdorferi B31
YNRINEDL

SEQ ID NO: 23478 - protein, 8 aa, Borrelia burgdorferi B31
NRINEDLA

SEQ ID NO: 23479 - protein, 8 aa, Borrelia burgdorferi B31
RINEDLAK

SEQ ID NO: 23480 - protein, 8 aa, Borrelia burgdorferi B31
INEDLAKV

SEQ ID NO: 23481 - protein, 8 aa, Borrelia burgdorferi B31
NEDLAKVK

SEQ ID NO: 23482 - protein, 8 aa, Borrelia burgdorferi B31
EDLAKVKA

SEQ ID NO: 23483 - protein, 8 aa, Borrelia burgdorferi B31
DLAKVKAS

SEQ ID NO: 23484 - protein, 8 aa, Borrelia burgdorferi B31
LAKVKASL

SEQ ID NO: 23485 - protein, 8 aa, Borrelia burgdorferi B31
AKVKASLD

SEQ ID NO: 23486 - protein, 8 aa, Borrelia burgdorferi B31
KVKASLDK

SEQ ID NO: 23487 - protein, 8 aa, Borrelia burgdorferi B31
VKASLDKI

SEQ ID NO: 23488 - protein, 8 aa, Borrelia burgdorferi B31
KASLDKIK

SEQ ID NO: 23489 - protein, 8 aa, Borrelia burgdorferi B31
ASLDKIKS

SEQ ID NO: 23490 - protein, 8 aa, Borrelia burgdorferi B31
SLDKIKSL

SEQ ID NO: 23491 - protein, 8 aa, Borrelia burgdorferi B31
LDKIKSLL

SEQ ID NO: 23492 - protein, 8 aa, Borrelia burgdorferi B31
DKIKSLLS

SEQ ID NO: 23493 - protein, 8 aa, Borrelia burgdorferi B31
KIKSLLST

SEQ ID NO: 23494 - protein, 8 aa, Borrelia burgdorferi B31
IKSLLSTA

SEQ ID NO: 23495 - protein, 8 aa, Borrelia burgdorferi B31
KSLLSTAK

SEQ ID NO: 23496 - protein, 8 aa, Borrelia burgdorferi B31
SLLSTAKS

SEQ ID NO: 23497 - protein, 8 aa, Borrelia burgdorferi B31
LLSTAKSY

SEQ ID NO: 23498 - protein, 8 aa, Borrelia burgdorferi B31
LSTAKSYL

SEQ ID NO: 23499 - protein, 8 aa, Borrelia burgdorferi B31
STAKSYLE

SEQ ID NO: 23500 - protein, 8 aa, Borrelia burgdorferi B31
TAKSYLEQ

SEQ ID NO: 23501 - protein, 8 aa, Borrelia burgdorferi B31
AKSYLEQT

SEQ ID NO: 23502 - protein, 8 aa, Borrelia burgdorferi B31
KSYLEQTR

SEQ ID NO: 23503 - protein, 8 aa, Borrelia burgdorferi B31
SYLEQTRR

SEQ ID NO: 23504 - protein, 8 aa, Borrelia burgdorferi B31
YLEQTRRG

SEQ ID NO: 23505 - protein, 8 aa, Borrelia burgdorferi B31
LEQTRRGV

SEQ ID NO: 23506 - protein, 8 aa, Borrelia burgdorferi B31
EQTRRGVG

SEQ ID NO: 23507 - protein, 8 aa, Borrelia burgdorferi B31
QTRRGVGS

SEQ ID NO: 23508 - protein, 8 aa, Borrelia burgdorferi B31
TRRGVGSS

SEQ ID NO: 23509 - protein, 8 aa, Borrelia burgdorferi B31
RRGVGSSK

SEQ ID NO: 23510 - protein, 8 aa, Borrelia burgdorferi B31
RGVGSSKA

SEQ ID NO: 23511 - protein, 8 aa, Borrelia burgdorferi B31
GVGSSKAN

SEQ ID NO: 23512 - protein, 8 aa, Borrelia burgdorferi B31
VGSSKANL

SEQ ID NO: 23513 - protein, 8 aa, Borrelia burgdorferi B31
GSSKANLA

SEQ ID NO: 23514 - protein, 8 aa, Borrelia burgdorferi B31
SSKANLAL

SEQ ID NO: 23515 - protein, 8 aa, Borrelia burgdorferi B31
SKANLALL

SEQ ID NO: 23516 - protein, 8 aa, Borrelia burgdorferi B31
KANLALLP

SEQ ID NO: 23517 - protein, 8 aa, Borrelia burgdorferi B31
ANLALLPS

SEQ ID NO: 23518 - protein, 8 aa, Borrelia burgdorferi B31
NLALLPSL

SEQ ID NO: 23519 - protein, 8 aa, Borrelia burgdorferi B31
LALLPSLE

SEQ ID NO: 23520 - protein, 8 aa, Borrelia burgdorferi B31
ALLPSLEE

SEQ ID NO: 23521 - protein, 8 aa, Borrelia burgdorferi B31
LLPSLEEA

SEQ ID NO: 23522 - protein, 8 aa, Borrelia burgdorferi B31
LPSLEEAI

SEQ ID NO: 23523 - protein, 8 aa, Borrelia burgdorferi B31
PSLEEAIA

SEQ ID NO: 23524 - protein, 8 aa, Borrelia burgdorferi B31
SLEEAIAK

SEQ ID NO: 23525 - protein, 8 aa, Borrelia burgdorferi B31
LEEAIAKV

SEQ ID NO: 23526 - protein, 8 aa, Borrelia burgdorferi B31
EEAIAKVK

SEQ ID NO: 23527 - protein, 8 aa, Borrelia burgdorferi B31
EAIAKVKS

SEQ ID NO: 23528 - protein, 8 aa, Borrelia burgdorferi B31
AIAKVKSN

SEQ ID NO: 23529 - protein, 8 aa, Borrelia burgdorferi B31
IAKVKSNH

SEQ ID NO: 23530 - protein, 8 aa, Borrelia burgdorferi B31
AKVKSNHA

SEQ ID NO: 23531 - protein, 8 aa, Borrelia burgdorferi B31
KVKSNHAS

SEQ ID NO: 23532 - protein, 8 aa, Borrelia burgdorferi B31
VKSNHASA

SEQ ID NO: 23533 - protein, 8 aa, Borrelia burgdorferi B31
KSNHASAD

SEQ ID NO: 23534 - protein, 8 aa, Borrelia burgdorferi B31
SNHASADT

SEQ ID NO: 23535 - protein, 8 aa, Borrelia burgdorferi B31
NHASADTH

SEQ ID NO: 23536 - protein, 8 aa, Borrelia burgdorferi B31
HASADTHC

SEQ ID NO: 23537 - protein, 8 aa, Borrelia burgdorferi B31
ASADTHCN

SEQ ID NO: 23538 - protein, 8 aa, Borrelia burgdorferi B31
SADTHCND

SEQ ID NO: 23539 - protein, 8 aa, Borrelia burgdorferi B31
ADTHCNDA

SEQ ID NO: 23540 - protein, 8 aa, Borrelia burgdorferi B31
DTHCNDAI

SEQ ID NO: 23541 - protein, 8 aa, Borrelia burgdorferi B31
THCNDAIA

SEQ ID NO: 23542 - protein, 8 aa, Borrelia burgdorferi B31
HCNDAIAA

SEQ ID NO: 23543 - protein, 8 aa, Borrelia burgdorferi B31
CNDAIAAL

SEQ ID NO: 23544 - protein, 8 aa, Borrelia burgdorferi B31
NDAIAALK

SEQ ID NO: 23545 - protein, 8 aa, Borrelia burgdorferi B31
DAIAALKR

SEQ ID NO: 23546 - protein, 8 aa, Borrelia burgdorferi B31
AIAALKRA

SEQ ID NO: 23547 - protein, 8 aa, Borrelia burgdorferi B31
IAALKRAK

SEQ ID NO: 23548 - protein, 8 aa, Borrelia burgdorferi B31
AALKRAKN

SEQ ID NO: 23549 - protein, 8 aa, Borrelia burgdorferi B31
ALKRAKND

SEQ ID NO: 23550 - protein, 8 aa, Borrelia burgdorferi B31
LKRAKNDF

SEQ ID NO: 23551 - protein, 8 aa, Borrelia burgdorferi B31
KRAKNDFE

SEQ ID NO: 23552 - protein, 8 aa, Borrelia burgdorferi B31
RAKNDFEY

SEQ ID NO: 23553 - protein, 8 aa, Borrelia burgdorferi B31
AKNDFEYA

SEQ ID NO: 23554 - protein, 8 aa, Borrelia burgdorferi B31
KNDFEYAQ

SEQ ID NO: 23555 - protein, 8 aa, Borrelia burgdorferi B31
NDFEYAQR

SEQ ID NO: 23556 - protein, 8 aa, Borrelia burgdorferi B31
DFEYAQRK

SEQ ID NO: 23557 - protein, 8 aa, Borrelia burgdorferi B31
FEYAQRKA

SEQ ID NO: 23558 - protein, 8 aa, Borrelia burgdorferi B31
EYAQRKAD

SEQ ID NO: 23559 - protein, 8 aa, Borrelia burgdorferi B31
YAQRKADR

SEQ ID NO: 23560 - protein, 8 aa, Borrelia burgdorferi B31
AQRKADRA

SEQ ID NO: 23561 - protein, 8 aa, Borrelia burgdorferi B31
QRKADRAL

SEQ ID NO: 23562 - protein, 8 aa, Borrelia burgdorferi B31
RKADRALE

SEQ ID NO: 23563 - protein, 8 aa, Borrelia burgdorferi B31
KADRALEE

SEQ ID NO: 23564 - protein, 8 aa, Borrelia burgdorferi B31
ADRALEEA

SEQ ID NO: 23565 - protein, 8 aa, Borrelia burgdorferi B31
DRALEEAL

SEQ ID NO: 23566 - protein, 8 aa, Borrelia burgdorferi B31
RALEEALS

SEQ ID NO: 23567 - protein, 8 aa, Borrelia burgdorferi B31
ALEEALSN

SEQ ID NO: 23568 - protein, 8 aa, Borrelia burgdorferi B31
LEEALSNS

SEQ ID NO: 23569 - protein, 8 aa, Borrelia burgdorferi B31
EEALSNSN

SEQ ID NO: 23570 - protein, 8 aa, Borrelia burgdorferi B31
EALSNSNA

SEQ ID NO: 23571 - protein, 8 aa, Borrelia burgdorferi B31
ALSNSNAS

SEQ ID NO: 23572 - protein, 8 aa, Borrelia burgdorferi B31
LSNSNASR

SEQ ID NO: 23573 - protein, 8 aa, Borrelia burgdorferi B31
SNSNASRH

SEQ ID NO: 23574 - protein, 8 aa, Borrelia burgdorferi B31
NSNASRHE

SEQ ID NO: 23575 - protein, 8 aa, Borrelia burgdorferi B31
SNASRHES

SEQ ID NO: 23576 - protein, 8 aa, Borrelia burgdorferi B31
NASRHESY

SEQ ID NO: 23577 - protein, 8 aa, Borrelia burgdorferi B31
ASRHESYY

SEQ ID NO: 23578 - protein, 8 aa, Borrelia burgdorferi B31
SRHESYYY

SEQ ID NO: 23579 - protein, 8 aa, Borrelia burgdorferi B31
RHESYYYA

SEQ ID NO: 23580 - protein, 8 aa, Borrelia burgdorferi B31
HESYYYAG

SEQ ID NO: 23581 - protein, 8 aa, Borrelia burgdorferi B31
ESYYYAGY

SEQ ID NO: 23582 - protein, 8 aa, Borrelia burgdorferi B31
SYYYAGYH

SEQ ID NO: 23583 - protein, 8 aa, Borrelia burgdorferi B31
YYYAGYHQ

SEQ ID NO: 23584 - protein, 8 aa, Borrelia burgdorferi B31
YYAGYHQF

SEQ ID NO: 23585 - protein, 8 aa, Borrelia burgdorferi B31
YAGYHQFM

SEQ ID NO: 23586 - protein, 8 aa, Borrelia burgdorferi B31
AGYHQFMA

SEQ ID NO: 23587 - protein, 8 aa, Borrelia burgdorferi B31
GYHQFMAD

SEQ ID NO: 23588 - protein, 8 aa, Borrelia burgdorferi B31
YHQFMADA

SEQ ID NO: 23589 - protein, 8 aa, Borrelia burgdorferi B31
HQFMADAK

SEQ ID NO: 23590 - protein, 8 aa, Borrelia burgdorferi B31
QFMADAKA

SEQ ID NO: 23591 - protein, 8 aa, Borrelia burgdorferi B31
FMADAKAS

SEQ ID NO: 23592 - protein, 8 aa, Borrelia burgdorferi B31
MADAKASM

SEQ ID NO: 23593 - protein, 8 aa, Borrelia burgdorferi B31
ADAKASMS

SEQ ID NO: 23594 - protein, 8 aa, Borrelia burgdorferi B31
DAKASMSS

SEQ ID NO: 23595 - protein, 8 aa, Borrelia burgdorferi B31
AKASMSST

SEQ ID NO: 23596 - protein, 8 aa, Borrelia burgdorferi B31
KASMSSTK

SEQ ID NO: 23597 - protein, 8 aa, Borrelia burgdorferi B31
ASMSSTKS

SEQ ID NO: 23598 - protein, 8 aa, Borrelia burgdorferi B31
SMSSTKSL

SEQ ID NO: 23599 - protein, 8 aa, Borrelia burgdorferi B31
MSSTKSLL

SEQ ID NO: 23600 - protein, 8 aa, Borrelia burgdorferi B31
SSTKSLLE

SEQ ID NO: 23601 - protein, 8 aa, Borrelia burgdorferi B31
STKSLLEV

SEQ ID NO: 23602 - protein, 8 aa, Borrelia burgdorferi B31
TKSLLEVA

SEQ ID NO: 23603 - protein, 8 aa, Borrelia burgdorferi B31
KSLLEVAK

SEQ ID NO: 23604 - protein, 8 aa, Borrelia burgdorferi B31
SLLEVAKN

SEQ ID NO: 23605 - protein, 8 aa, Borrelia burgdorferi B31
LLEVAKNK

SEQ ID NO: 23606 - protein, 8 aa, Borrelia burgdorferi B31
LEVAKNKQ

SEQ ID NO: 23607 - protein, 8 aa, Borrelia burgdorferi B31
EVAKNKQK

SEQ ID NO: 23608 - protein, 8 aa, Borrelia burgdorferi B31
VAKNKQKE

SEQ ID NO: 23609 - protein, 8 aa, Borrelia burgdorferi B31
AKNKQKEL

SEQ ID NO: 23610 - protein, 8 aa, Borrelia burgdorferi B31
KNKQKELN

SEQ ID NO: 23611 - protein, 8 aa, Borrelia burgdorferi B31
NKQKELNE

SEQ ID NO: 23612 - protein, 8 aa, Borrelia burgdorferi B31
KQKELNEN

SEQ ID NO: 23613 - protein, 8 aa, Borrelia burgdorferi B31
QKELNENM

SEQ ID NO: 23614 - protein, 8 aa, Borrelia burgdorferi B31
KELNENMT

SEQ ID NO: 23615 - protein, 8 aa, Borrelia burgdorferi B31
ELNENMTK

SEQ ID NO: 23616 - protein, 8 aa, Borrelia burgdorferi B31
LNENMTKT

SEQ ID NO: 23617 - protein, 8 aa, Borrelia burgdorferi B31
NENMTKTN

SEQ ID NO: 23618 - protein, 8 aa, Borrelia burgdorferi B31
ENMTKTNK

SEQ ID NO: 23619 - protein, 8 aa, Borrelia burgdorferi B31
NMTKTNKD

SEQ ID NO: 23620 - protein, 8 aa, Borrelia burgdorferi B31
MTKTNKDF

SEQ ID NO: 23621 - protein, 8 aa, Borrelia burgdorferi B31
TKTNKDFQ

SEQ ID NO: 23622 - protein, 8 aa, Borrelia burgdorferi B31
KTNKDFQE

SEQ ID NO: 23623 - protein, 8 aa, Borrelia burgdorferi B31
TNKDFQEL

SEQ ID NO: 23624 - protein, 8 aa, Borrelia burgdorferi B31
NKDFQELN

SEQ ID NO: 23625 - protein, 8 aa, Borrelia burgdorferi B31
KDFQELND

SEQ ID NO: 23626 - protein, 8 aa, Borrelia burgdorferi B31
DFQELNDI

SEQ ID NO: 23627 - protein, 8 aa, Borrelia burgdorferi B31
FQELNDIY

SEQ ID NO: 23628 - protein, 8 aa, Borrelia burgdorferi B31
QELNDIYK

SEQ ID NO: 23629 - protein, 8 aa, Borrelia burgdorferi B31
ELNDIYKK

SEQ ID NO: 23630 - protein, 8 aa, Borrelia burgdorferi B31
LNDIYKKL

SEQ ID NO: 23631 - protein, 8 aa, Borrelia burgdorferi B31
NDIYKKLQ

SEQ ID NO: 23632 - protein, 8 aa, Borrelia burgdorferi B31
DIYKKLQD

SEQ ID NO: 23633 - protein, 8 aa, Borrelia burgdorferi B31
IYKKLQDM

SEQ ID NO: 23634 - protein, 8 aa, Borrelia burgdorferi B31
YKKLQDMD

SEQ ID NO: 23635 - protein, 8 aa, Borrelia burgdorferi B31
KKLQDMDS

SEQ ID NO: 23636 - protein, 8 aa, Borrelia burgdorferi B31
KLQDMDSR

SEQ ID NO: 23637 - protein, 9 aa, Borrelia burgdorferi B31
MNLINKLFI

SEQ ID NO: 23638 - protein, 9 aa, Borrelia burgdorferi B31
NLINKLFIL

SEQ ID NO: 23639 - protein, 9 aa, Borrelia burgdorferi B31
LINKLFILT

SEQ ID NO: 23640 - protein, 9 aa, Borrelia burgdorferi B31
INKLFILTI

SEQ ID NO: 23641 - protein, 9 aa, Borrelia burgdorferi B31
NKLFILTIL

SEQ ID NO: 23642 - protein, 9 aa, Borrelia burgdorferi B31
KLFILTILF

SEQ ID NO: 23643 - protein, 9 aa, Borrelia burgdorferi B31
LFILTILFS

SEQ ID NO: 23644 - protein, 9 aa, Borrelia burgdorferi B31
FILTILFSS

SEQ ID NO: 23645 - protein, 9 aa, Borrelia burgdorferi B31
ILTILFSSV

SEQ ID NO: 23646 - protein, 9 aa, Borrelia burgdorferi B31
LTILFSSVI

SEQ ID NO: 23647 - protein, 9 aa, Borrelia burgdorferi B31
TILFSSVIS

SEQ ID NO: 23648 - protein, 9 aa, Borrelia burgdorferi B31
ILFSSVISC

SEQ ID NO: 23649 - protein, 9 aa, Borrelia burgdorferi B31
LFSSVISCK

SEQ ID NO: 23650 - protein, 9 aa, Borrelia burgdorferi B31
FSSVISCKL

SEQ ID NO: 23651 - protein, 9 aa, Borrelia burgdorferi B31
SSVISCKLY

SEQ ID NO: 23652 - protein, 9 aa, Borrelia burgdorferi B31
SVISCKLYK

SEQ ID NO: 23653 - protein, 9 aa, Borrelia burgdorferi B31
VISCKLYKK

SEQ ID NO: 23654 - protein, 9 aa, Borrelia burgdorferi B31
ISCKLYKKI

SEQ ID NO: 23655 - protein, 9 aa, Borrelia burgdorferi B31
SCKLYKKIT

SEQ ID NO: 23656 - protein, 9 aa, Borrelia burgdorferi B31
CKLYKKITY

SEQ ID NO: 23657 - protein, 9 aa, Borrelia burgdorferi B31
KLYKKITYN

SEQ ID NO: 23658 - protein, 9 aa, Borrelia burgdorferi B31
LYKKITYNA

SEQ ID NO: 23659 - protein, 9 aa, Borrelia burgdorferi B31
YKKITYNAD

SEQ ID NO: 23660 - protein, 9 aa, Borrelia burgdorferi B31
KKITYNADQ

SEQ ID NO: 23661 - protein, 9 aa, Borrelia burgdorferi B31
KITYNADQV

SEQ ID NO: 23662 - protein, 9 aa, Borrelia burgdorferi B31
ITYNADQVI

SEQ ID NO: 23663 - protein, 9 aa, Borrelia burgdorferi B31
TYNADQVID

SEQ ID NO: 23664 - protein, 9 aa, Borrelia burgdorferi B31
YNADQVIDK

SEQ ID NO: 23665 - protein, 9 aa, Borrelia burgdorferi B31
NADQVIDKL

SEQ ID NO: 23666 - protein, 9 aa, Borrelia burgdorferi B31
ADQVIDKLK

SEQ ID NO: 23667 - protein, 9 aa, Borrelia burgdorferi B31
DQVIDKLKS

SEQ ID NO: 23668 - protein, 9 aa, Borrelia burgdorferi B31
QVIDKLKSN

SEQ ID NO: 23669 - protein, 9 aa, Borrelia burgdorferi B31
VIDKLKSNN

SEQ ID NO: 23670 - protein, 9 aa, Borrelia burgdorferi B31
IDKLKSNNG

SEQ ID NO: 23671 - protein, 9 aa, Borrelia burgdorferi B31
DKLKSNNGS

SEQ ID NO: 23672 - protein, 9 aa, Borrelia burgdorferi B31
KLKSNNGSF

SEQ ID NO: 23673 - protein, 9 aa, Borrelia burgdorferi B31
LKSNNGSFN

SEQ ID NO: 23674 - protein, 9 aa, Borrelia burgdorferi B31
KSNNGSFNT

SEQ ID NO: 23675 - protein, 9 aa, Borrelia burgdorferi B31
SNNGSFNTL

SEQ ID NO: 23676 - protein, 9 aa, Borrelia burgdorferi B31
NNGSFNTLK

SEQ ID NO: 23677 - protein, 9 aa, Borrelia burgdorferi B31
NGSFNTLKS

SEQ ID NO: 23678 - protein, 9 aa, Borrelia burgdorferi B31
GSFNTLKSN

SEQ ID NO: 23679 - protein, 9 aa, Borrelia burgdorferi B31
SFNTLKSND

SEQ ID NO: 23680 - protein, 9 aa, Borrelia burgdorferi B31
FNTLKSNDD

SEQ ID NO: 23681 - protein, 9 aa, Borrelia burgdorferi B31
NTLKSNDDS

SEQ ID NO: 23682 - protein, 9 aa, Borrelia burgdorferi B31
TLKSNDDSK

SEQ ID NO: 23683 - protein, 9 aa, Borrelia burgdorferi B31
LKSNDDSKR

SEQ ID NO: 23684 - protein, 9 aa, Borrelia burgdorferi B31
KSNDDSKRS

SEQ ID NO: 23685 - protein, 9 aa, Borrelia burgdorferi B31
SNDDSKRSG

SEQ ID NO: 23686 - protein, 9 aa, Borrelia burgdorferi B31
NDDSKRSGR

SEQ ID NO: 23687 - protein, 9 aa, Borrelia burgdorferi B31
DDSKRSGRK

SEQ ID NO: 23688 - protein, 9 aa, Borrelia burgdorferi B31
DSKRSGRKP

SEQ ID NO: 23689 - protein, 9 aa, Borrelia burgdorferi B31
SKRSGRKPR

SEQ ID NO: 23690 - protein, 9 aa, Borrelia burgdorferi B31
KRSGRKPRS

SEQ ID NO: 23691 - protein, 9 aa, Borrelia burgdorferi B31
RSGRKPRSV

SEQ ID NO: 23692 - protein, 9 aa, Borrelia burgdorferi B31
SGRKPRSVD

SEQ ID NO: 23693 - protein, 9 aa, Borrelia burgdorferi B31
GRKPRSVDN

SEQ ID NO: 23694 - protein, 9 aa, Borrelia burgdorferi B31
RKPRSVDNT

SEQ ID NO: 23695 - protein, 9 aa, Borrelia burgdorferi B31
KPRSVDNTY

SEQ ID NO: 23696 - protein, 9 aa, Borrelia burgdorferi B31
PRSVDNTYM

SEQ ID NO: 23697 - protein, 9 aa, Borrelia burgdorferi B31
RSVDNTYMD

SEQ ID NO: 23698 - protein, 9 aa, Borrelia burgdorferi B31
SVDNTYMDQ

SEQ ID NO: 23699 - protein, 9 aa, Borrelia burgdorferi B31
VDNTYMDQD

SEQ ID NO: 23700 - protein, 9 aa, Borrelia burgdorferi B31
DNTYMDQDT

SEQ ID NO: 23701 - protein, 9 aa, Borrelia burgdorferi B31
NTYMDQDTG

SEQ ID NO: 23702 - protein, 9 aa, Borrelia burgdorferi B31
TYMDQDTGK

SEQ ID NO: 23703 - protein, 9 aa, Borrelia burgdorferi B31
YMDQDTGKK

SEQ ID NO: 23704 - protein, 9 aa, Borrelia burgdorferi B31
MDQDTGKKP

SEQ ID NO: 23705 - protein, 9 aa, Borrelia burgdorferi B31
DQDTGKKPL

SEQ ID NO: 23706 - protein, 9 aa, Borrelia burgdorferi B31
QDTGKKPLM

SEQ ID NO: 23707 - protein, 9 aa, Borrelia burgdorferi B31
DTGKKPLMA

SEQ ID NO: 23708 - protein, 9 aa, Borrelia burgdorferi B31
TGKKPLMAD

SEQ ID NO: 23709 - protein, 9 aa, Borrelia burgdorferi B31
GKKPLMADM

SEQ ID NO: 23710 - protein, 9 aa, Borrelia burgdorferi B31
KKPLMADMQ

SEQ ID NO: 23711 - protein, 9 aa, Borrelia burgdorferi B31
KPLMADMQP

SEQ ID NO: 23712 - protein, 9 aa, Borrelia burgdorferi B31
PLMADMQPD

SEQ ID NO: 23713 - protein, 9 aa, Borrelia burgdorferi B31
LMADMQPDM

SEQ ID NO: 23714 - protein, 9 aa, Borrelia burgdorferi B31
MADMQPDMQ

SEQ ID NO: 23715 - protein, 9 aa, Borrelia burgdorferi B31
ADMQPDMQN

SEQ ID NO: 23716 - protein, 9 aa, Borrelia burgdorferi B31
DMQPDMQND

SEQ ID NO: 23717 - protein, 9 aa, Borrelia burgdorferi B31
MQPDMQNDN

SEQ ID NO: 23718 - protein, 9 aa, Borrelia burgdorferi B31
QPDMQNDNS

SEQ ID NO: 23719 - protein, 9 aa, Borrelia burgdorferi B31
PDMQNDNSS

SEQ ID NO: 23720 - protein, 9 aa, Borrelia burgdorferi B31
DMQNDNSSS

SEQ ID NO: 23721 - protein, 9 aa, Borrelia burgdorferi B31
MQNDNSSSN

SEQ ID NO: 23722 - protein, 9 aa, Borrelia burgdorferi B31
QNDNSSSNH

SEQ ID NO: 23723 - protein, 9 aa, Borrelia burgdorferi B31
NDNSSSNHT

SEQ ID NO: 23724 - protein, 9 aa, Borrelia burgdorferi B31
DNSSSNHTL

SEQ ID NO: 23725 - protein, 9 aa, Borrelia burgdorferi B31
NSSSNHTLQ

SEQ ID NO: 23726 - protein, 9 aa, Borrelia burgdorferi B31
SSSNHTLQV

SEQ ID NO: 23727 - protein, 9 aa, Borrelia burgdorferi B31
SSNHTLQVN

SEQ ID NO: 23728 - protein, 9 aa, Borrelia burgdorferi B31
SNHTLQVNI

SEQ ID NO: 23729 - protein, 9 aa, Borrelia burgdorferi B31
NHTLQVNIQ

SEQ ID NO: 23730 - protein, 9 aa, Borrelia burgdorferi B31
HTLQVNIQD

SEQ ID NO: 23731 - protein, 9 aa, Borrelia burgdorferi B31
TLQVNIQDN

SEQ ID NO: 23732 - protein, 9 aa, Borrelia burgdorferi B31
LQVNIQDNE

SEQ ID NO: 23733 - protein, 9 aa, Borrelia burgdorferi B31
QVNIQDNEA

SEQ ID NO: 23734 - protein, 9 aa, Borrelia burgdorferi B31
VNIQDNEAS

SEQ ID NO: 23735 - protein, 9 aa, Borrelia burgdorferi B31
NIQDNEASE

SEQ ID NO: 23736 - protein, 9 aa, Borrelia burgdorferi B31
IQDNEASEA

SEQ ID NO: 23737 - protein, 9 aa, Borrelia burgdorferi B31
QDNEASEAR

SEQ ID NO: 23738 - protein, 9 aa, Borrelia burgdorferi B31
DNEASEARN

SEQ ID NO: 23739 - protein, 9 aa, Borrelia burgdorferi B31
NEASEARNI

SEQ ID NO: 23740 - protein, 9 aa, Borrelia burgdorferi B31
EASEARNIM

SEQ ID NO: 23741 - protein, 9 aa, Borrelia burgdorferi B31
ASEARNIMT

SEQ ID NO: 23742 - protein, 9 aa, Borrelia burgdorferi B31
SEARNIMTE

SEQ ID NO: 23743 - protein, 9 aa, Borrelia burgdorferi B31
EARNIMTEI

SEQ ID NO: 23744 - protein, 9 aa, Borrelia burgdorferi B31
ARNIMTEIE

SEQ ID NO: 23745 - protein, 9 aa, Borrelia burgdorferi B31
RNIMTEIES

SEQ ID NO: 23746 - protein, 9 aa, Borrelia burgdorferi B31
NIMTEIESS

SEQ ID NO: 23747 - protein, 9 aa, Borrelia burgdorferi B31
IMTEIESSK

SEQ ID NO: 23748 - protein, 9 aa, Borrelia burgdorferi B31
MTEIESSKE

SEQ ID NO: 23749 - protein, 9 aa, Borrelia burgdorferi B31
TEIESSKEE

SEQ ID NO: 23750 - protein, 9 aa, Borrelia burgdorferi B31
EIESSKEEY

SEQ ID NO: 23751 - protein, 9 aa, Borrelia burgdorferi B31
IESSKEEYN

SEQ ID NO: 23752 - protein, 9 aa, Borrelia burgdorferi B31
ESSKEEYNR

SEQ ID NO: 23753 - protein, 9 aa, Borrelia burgdorferi B31
SSKEEYNRI

SEQ ID NO: 23754 - protein, 9 aa, Borrelia burgdorferi B31
SKEEYNRIN

SEQ ID NO: 23755 - protein, 9 aa, Borrelia burgdorferi B31
KEEYNRINE

SEQ ID NO: 23756 - protein, 9 aa, Borrelia burgdorferi B31
EEYNRINED

SEQ ID NO: 23757 - protein, 9 aa, Borrelia burgdorferi B31
EYNRINEDL

SEQ ID NO: 23758 - protein, 9 aa, Borrelia burgdorferi B31
YNRINEDLA

SEQ ID NO: 23759 - protein, 9 aa, Borrelia burgdorferi B31
NRINEDLAK

SEQ ID NO: 23760 - protein, 9 aa, Borrelia burgdorferi B31
RINEDLAKV

SEQ ID NO: 23761 - protein, 9 aa, Borrelia burgdorferi B31
INEDLAKVK

SEQ ID NO: 23762 - protein, 9 aa, Borrelia burgdorferi B31
NEDLAKVKA

SEQ ID NO: 23763 - protein, 9 aa, Borrelia burgdorferi B31
EDLAKVKAS

SEQ ID NO: 23764 - protein, 9 aa, Borrelia burgdorferi B31
DLAKVKASL

SEQ ID NO: 23765 - protein, 9 aa, Borrelia burgdorferi B31
LAKVKASLD

SEQ ID NO: 23766 - protein, 9 aa, Borrelia burgdorferi B31
AKVKASLDK

SEQ ID NO: 23767 - protein, 9 aa, Borrelia burgdorferi B31
KVKASLDKI

SEQ ID NO: 23768 - protein, 9 aa, Borrelia burgdorferi B31
VKASLDKIK

SEQ ID NO: 23769 - protein, 9 aa, Borrelia burgdorferi B31
KASLDKIKS

SEQ ID NO: 23770 - protein, 9 aa, Borrelia burgdorferi B31
ASLDKIKSL

SEQ ID NO: 23771 - protein, 9 aa, Borrelia burgdorferi B31
SLDKIKSLL

SEQ ID NO: 23772 - protein, 9 aa, Borrelia burgdorferi B31
LDKIKSLLS

SEQ ID NO: 23773 - protein, 9 aa, Borrelia burgdorferi B31
DKIKSLLST

SEQ ID NO: 23774 - protein, 9 aa, Borrelia burgdorferi B31
KIKSLLSTA

SEQ ID NO: 23775 - protein, 9 aa, Borrelia burgdorferi B31
IKSLLSTAK

SEQ ID NO: 23776 - protein, 9 aa, Borrelia burgdorferi B31
KSLLSTAKS

SEQ ID NO: 23777 - protein, 9 aa, Borrelia burgdorferi B31
SLLSTAKSY

SEQ ID NO: 23778 - protein, 9 aa, Borrelia burgdorferi B31
LLSTAKSYL

SEQ ID NO: 23779 - protein, 9 aa, Borrelia burgdorferi B31
LSTAKSYLE

SEQ ID NO: 23780 - protein, 9 aa, Borrelia burgdorferi B31
STAKSYLEQ

SEQ ID NO: 23781 - protein, 9 aa, Borrelia burgdorferi B31
TAKSYLEQT

SEQ ID NO: 23782 - protein, 9 aa, Borrelia burgdorferi B31
AKSYLEQTR

SEQ ID NO: 23783 - protein, 9 aa, Borrelia burgdorferi B31
KSYLEQTRR

SEQ ID NO: 23784 - protein, 9 aa, Borrelia burgdorferi B31
SYLEQTRRG

SEQ ID NO: 23785 - protein, 9 aa, Borrelia burgdorferi B31
YLEQTRRGV

SEQ ID NO: 23786 - protein, 9 aa, Borrelia burgdorferi B31
LEQTRRGVG

SEQ ID NO: 23787 - protein, 9 aa, Borrelia burgdorferi B31
EQTRRGVGS

SEQ ID NO: 23788 - protein, 9 aa, Borrelia burgdorferi B31
QTRRGVGSS

SEQ ID NO: 23789 - protein, 9 aa, Borrelia burgdorferi B31
TRRGVGSSK

SEQ ID NO: 23790 - protein, 9 aa, Borrelia burgdorferi B31
RRGVGSSKA

SEQ ID NO: 23791 - protein, 9 aa, Borrelia burgdorferi B31
RGVGSSKAN

SEQ ID NO: 23792 - protein, 9 aa, Borrelia burgdorferi B31
GVGSSKANL

SEQ ID NO: 23793 - protein, 9 aa, Borrelia burgdorferi B31
VGSSKANLA

SEQ ID NO: 23794 - protein, 9 aa, Borrelia burgdorferi B31
GSSKANLAL

SEQ ID NO: 23795 - protein, 9 aa, Borrelia burgdorferi B31
SSKANLALL

SEQ ID NO: 23796 - protein, 9 aa, Borrelia burgdorferi B31
SKANLALLP

SEQ ID NO: 23797 - protein, 9 aa, Borrelia burgdorferi B31
KANLALLPS

SEQ ID NO: 23798 - protein, 9 aa, Borrelia burgdorferi B31
ANLALLPSL

SEQ ID NO: 23799 - protein, 9 aa, Borrelia burgdorferi B31
NLALLPSLE

SEQ ID NO: 23800 - protein, 9 aa, Borrelia burgdorferi B31
LALLPSLEE

SEQ ID NO: 23801 - protein, 9 aa, Borrelia burgdorferi B31
ALLPSLEEA

SEQ ID NO: 23802 - protein, 9 aa, Borrelia burgdorferi B31
LLPSLEEAI

SEQ ID NO: 23803 - protein, 9 aa, Borrelia burgdorferi B31
LPSLEEAIA

SEQ ID NO: 23804 - protein, 9 aa, Borrelia burgdorferi B31
PSLEEAIAK

SEQ ID NO: 23805 - protein, 9 aa, Borrelia burgdorferi B31
SLEEAIAKV

SEQ ID NO: 23806 - protein, 9 aa, Borrelia burgdorferi B31
LEEAIAKVK

SEQ ID NO: 23807 - protein, 9 aa, Borrelia burgdorferi B31
EEAIAKVKS

SEQ ID NO: 23808 - protein, 9 aa, Borrelia burgdorferi B31
EAIAKVKSN

SEQ ID NO: 23809 - protein, 9 aa, Borrelia burgdorferi B31
AIAKVKSNH

SEQ ID NO: 23810 - protein, 9 aa, Borrelia burgdorferi B31
IAKVKSNHA

SEQ ID NO: 23811 - protein, 9 aa, Borrelia burgdorferi B31
AKVKSNHAS

SEQ ID NO: 23812 - protein, 9 aa, Borrelia burgdorferi B31
KVKSNHASA

SEQ ID NO: 23813 - protein, 9 aa, Borrelia burgdorferi B31
VKSNHASAD

SEQ ID NO: 23814 - protein, 9 aa, Borrelia burgdorferi B31
KSNHASADT

SEQ ID NO: 23815 - protein, 9 aa, Borrelia burgdorferi B31
SNHASADTH

SEQ ID NO: 23816 - protein, 9 aa, Borrelia burgdorferi B31
NHASADTHC

SEQ ID NO: 23817 - protein, 9 aa, Borrelia burgdorferi B31
HASADTHCN

SEQ ID NO: 23818 - protein, 9 aa, Borrelia burgdorferi B31
ASADTHCND

SEQ ID NO: 23819 - protein, 9 aa, Borrelia burgdorferi B31
SADTHCNDA

SEQ ID NO: 23820 - protein, 9 aa, Borrelia burgdorferi B31
ADTHCNDAI

SEQ ID NO: 23821 - protein, 9 aa, Borrelia burgdorferi B31
DTHCNDAIA

SEQ ID NO: 23822 - protein, 9 aa, Borrelia burgdorferi B31
THCNDAIAA

SEQ ID NO: 23823 - protein, 9 aa, Borrelia burgdorferi B31
HCNDAIAAL

SEQ ID NO: 23824 - protein, 9 aa, Borrelia burgdorferi B31
CNDAIAALK

SEQ ID NO: 23825 - protein, 9 aa, Borrelia burgdorferi B31
NDAIAALKR

SEQ ID NO: 23826 - protein, 9 aa, Borrelia burgdorferi B31
DAIAALKRA

SEQ ID NO: 23827 - protein, 9 aa, Borrelia burgdorferi B31
AIAALKRAK

SEQ ID NO: 23828 - protein, 9 aa, Borrelia burgdorferi B31
IAALKRAKN

SEQ ID NO: 23829 - protein, 9 aa, Borrelia burgdorferi B31
AALKRAKND

SEQ ID NO: 23830 - protein, 9 aa, Borrelia burgdorferi B31
ALKRAKNDF

SEQ ID NO: 23831 - protein, 9 aa, Borrelia burgdorferi B31
LKRAKNDFE

SEQ ID NO: 23832 - protein, 9 aa, Borrelia burgdorferi B31
KRAKNDFEY

SEQ ID NO: 23833 - protein, 9 aa, Borrelia burgdorferi B31
RAKNDFEYA

SEQ ID NO: 23834 - protein, 9 aa, Borrelia burgdorferi B31
AKNDFEYAQ

SEQ ID NO: 23835 - protein, 9 aa, Borrelia burgdorferi B31
KNDFEYAQR

SEQ ID NO: 23836 - protein, 9 aa, Borrelia burgdorferi B31
NDFEYAQRK

SEQ ID NO: 23837 - protein, 9 aa, Borrelia burgdorferi B31
DFEYAQRKA

SEQ ID NO: 23838 - protein, 9 aa, Borrelia burgdorferi B31
FEYAQRKAD

SEQ ID NO: 23839 - protein, 9 aa, Borrelia burgdorferi B31
EYAQRKADR

SEQ ID NO: 23840 - protein, 9 aa, Borrelia burgdorferi B31
YAQRKADRA

SEQ ID NO: 23841 - protein, 9 aa, Borrelia burgdorferi B31
AQRKADRAL

SEQ ID NO: 23842 - protein, 9 aa, Borrelia burgdorferi B31
QRKADRALE

SEQ ID NO: 23843 - protein, 9 aa, Borrelia burgdorferi B31
RKADRALEE

SEQ ID NO: 23844 - protein, 9 aa, Borrelia burgdorferi B31
KADRALEEA

SEQ ID NO: 23845 - protein, 9 aa, Borrelia burgdorferi B31
ADRALEEAL

SEQ ID NO: 23846 - protein, 9 aa, Borrelia burgdorferi B31
DRALEEALS

SEQ ID NO: 23847 - protein, 9 aa, Borrelia burgdorferi B31
RALEEALSN

SEQ ID NO: 23848 - protein, 9 aa, Borrelia burgdorferi B31
ALEEALSNS

SEQ ID NO: 23849 - protein, 9 aa, Borrelia burgdorferi B31
LEEALSNSN

SEQ ID NO: 23850 - protein, 9 aa, Borrelia burgdorferi B31
EEALSNSNA

SEQ ID NO: 23851 - protein, 9 aa, Borrelia burgdorferi B31
EALSNSNAS

SEQ ID NO: 23852 - protein, 9 aa, Borrelia burgdorferi B31
ALSNSNASR

SEQ ID NO: 23853 - protein, 9 aa, Borrelia burgdorferi B31
LSNSNASRH

SEQ ID NO: 23854 - protein, 9 aa, Borrelia burgdorferi B31
SNSNASRHE

SEQ ID NO: 23855 - protein, 9 aa, Borrelia burgdorferi B31
NSNASRHES

SEQ ID NO: 23856 - protein, 9 aa, Borrelia burgdorferi B31
SNASRHESY

SEQ ID NO: 23857 - protein, 9 aa, Borrelia burgdorferi B31
NASRHESYY

SEQ ID NO: 23858 - protein, 9 aa, Borrelia burgdorferi B31
ASRHESYYY

SEQ ID NO: 23859 - protein, 9 aa, Borrelia burgdorferi B31
SRHESYYYA

SEQ ID NO: 23860 - protein, 9 aa, Borrelia burgdorferi B31
RHESYYYAG

SEQ ID NO: 23861 - protein, 9 aa, Borrelia burgdorferi B31
HESYYYAGY

SEQ ID NO: 23862 - protein, 9 aa, Borrelia burgdorferi B31
ESYYYAGYH

SEQ ID NO: 23863 - protein, 9 aa, Borrelia burgdorferi B31
SYYYAGYHQ

SEQ ID NO: 23864 - protein, 9 aa, Borrelia burgdorferi B31
YYYAGYHQF

SEQ ID NO: 23865 - protein, 9 aa, Borrelia burgdorferi B31
YYAGYHQFM

SEQ ID NO: 23866 - protein, 9 aa, Borrelia burgdorferi B31
YAGYHQFMA

SEQ ID NO: 23867 - protein, 9 aa, Borrelia burgdorferi B31
AGYHQFMAD

SEQ ID NO: 23868 - protein, 9 aa, Borrelia burgdorferi B31
GYHQFMADA

SEQ ID NO: 23869 - protein, 9 aa, Borrelia burgdorferi B31
YHQFMADAK

SEQ ID NO: 23870 - protein, 9 aa, Borrelia burgdorferi B31
HQFMADAKA

SEQ ID NO: 23871 - protein, 9 aa, Borrelia burgdorferi B31
QFMADAKAS

SEQ ID NO: 23872 - protein, 9 aa, Borrelia burgdorferi B31
FMADAKASM

SEQ ID NO: 23873 - protein, 9 aa, Borrelia burgdorferi B31
MADAKASMS

SEQ ID NO: 23874 - protein, 9 aa, Borrelia burgdorferi B31
ADAKASMSS

SEQ ID NO: 23875 - protein, 9 aa, Borrelia burgdorferi B31
DAKASMSST

SEQ ID NO: 23876 - protein, 9 aa, Borrelia burgdorferi B31
AKASMSSTK

SEQ ID NO: 23877 - protein, 9 aa, Borrelia burgdorferi B31
KASMSSTKS

SEQ ID NO: 23878 - protein, 9 aa, Borrelia burgdorferi B31
ASMSSTKSL

SEQ ID NO: 23879 - protein, 9 aa, Borrelia burgdorferi B31
SMSSTKSLL

SEQ ID NO: 23880 - protein, 9 aa, Borrelia burgdorferi B31
MSSTKSLLE

SEQ ID NO: 23881 - protein, 9 aa, Borrelia burgdorferi B31
SSTKSLLEV

SEQ ID NO: 23882 - protein, 9 aa, Borrelia burgdorferi B31
STKSLLEVA

SEQ ID NO: 23883 - protein, 9 aa, Borrelia burgdorferi B31
TKSLLEVAK

SEQ ID NO: 23884 - protein, 9 aa, Borrelia burgdorferi B31
KSLLEVAKN

SEQ ID NO: 23885 - protein, 9 aa, Borrelia burgdorferi B31
SLLEVAKNK

SEQ ID NO: 23886 - protein, 9 aa, Borrelia burgdorferi B31
LLEVAKNKQ

SEQ ID NO: 23887 - protein, 9 aa, Borrelia burgdorferi B31
LEVAKNKQK

SEQ ID NO: 23888 - protein, 9 aa, Borrelia burgdorferi B31
EVAKNKQKE

SEQ ID NO: 23889 - protein, 9 aa, Borrelia burgdorferi B31
VAKNKQKEL

SEQ ID NO: 23890 - protein, 9 aa, Borrelia burgdorferi B31
AKNKQKELN

SEQ ID NO: 23891 - protein, 9 aa, Borrelia burgdorferi B31
KNKQKELNE

SEQ ID NO: 23892 - protein, 9 aa, Borrelia burgdorferi B31
NKQKELNEN

SEQ ID NO: 23893 - protein, 9 aa, Borrelia burgdorferi B31
KQKELNENM

SEQ ID NO: 23894 - protein, 9 aa, Borrelia burgdorferi B31
QKELNENMT

SEQ ID NO: 23895 - protein, 9 aa, Borrelia burgdorferi B31
KELNENMTK

SEQ ID NO: 23896 - protein, 9 aa, Borrelia burgdorferi B31
ELNENMTKT

SEQ ID NO: 23897 - protein, 9 aa, Borrelia burgdorferi B31
LNENMTKTN

SEQ ID NO: 23898 - protein, 9 aa, Borrelia burgdorferi B31
NENMTKTNK

SEQ ID NO: 23899 - protein, 9 aa, Borrelia burgdorferi B31
ENMTKTNKD

SEQ ID NO: 23900 - protein, 9 aa, Borrelia burgdorferi B31
NMTKTNKDF

SEQ ID NO: 23901 - protein, 9 aa, Borrelia burgdorferi B31
MTKTNKDFQ

SEQ ID NO: 23902 - protein, 9 aa, Borrelia burgdorferi B31
TKTNKDFQE

SEQ ID NO: 23903 - protein, 9 aa, Borrelia burgdorferi B31
KTNKDFQEL

SEQ ID NO: 23904 - protein, 9 aa, Borrelia burgdorferi B31
TNKDFQELN

SEQ ID NO: 23905 - protein, 9 aa, Borrelia burgdorferi B31
NKDFQELND

SEQ ID NO: 23906 - protein, 9 aa, Borrelia burgdorferi B31
KDFQELNDI

SEQ ID NO: 23907 - protein, 9 aa, Borrelia burgdorferi B31
DFQELNDIY

SEQ ID NO: 23908 - protein, 9 aa, Borrelia burgdorferi B31
FQELNDIYK

SEQ ID NO: 23909 - protein, 9 aa, Borrelia burgdorferi B31
QELNDIYKK

SEQ ID NO: 23910 - protein, 9 aa, Borrelia burgdorferi B31
ELNDIYKKL

SEQ ID NO: 23911 - protein, 9 aa, Borrelia burgdorferi B31
LNDIYKKLQ

SEQ ID NO: 23912 - protein, 9 aa, Borrelia burgdorferi B31
NDIYKKLQD

SEQ ID NO: 23913 - protein, 9 aa, Borrelia burgdorferi B31
DIYKKLQDM

SEQ ID NO: 23914 - protein, 9 aa, Borrelia burgdorferi B31
IYKKLQDMD

SEQ ID NO: 23915 - protein, 9 aa, Borrelia burgdorferi B31
YKKLQDMDS

SEQ ID NO: 23916 - protein, 9 aa, Borrelia burgdorferi B31
KKLQDMDSR

SEQ ID NO: 23917 - protein, 10 aa, Borrelia burgdorferi B31
MNLINKLFIL

SEQ ID NO: 23918 - protein, 10 aa, Borrelia burgdorferi B31
NLINKLFILT

SEQ ID NO: 23919 - protein, 10 aa, Borrelia burgdorferi B31
LINKLFILTI

SEQ ID NO: 23920 - protein, 10 aa, Borrelia burgdorferi B31
INKLFILTIL

SEQ ID NO: 23921 - protein, 10 aa, Borrelia burgdorferi B31
NKLFILTILF

SEQ ID NO: 23922 - protein, 10 aa, Borrelia burgdorferi B31
KLFILTILFS

SEQ ID NO: 23923 - protein, 10 aa, Borrelia burgdorferi B31
LFILTILFSS

SEQ ID NO: 23924 - protein, 10 aa, Borrelia burgdorferi B31
FILTILFSSV

SEQ ID NO: 23925 - protein, 10 aa, Borrelia burgdorferi B31
ILTILFSSVI

SEQ ID NO: 23926 - protein, 10 aa, Borrelia burgdorferi B31
LTILFSSVIS

SEQ ID NO: 23927 - protein, 10 aa, Borrelia burgdorferi B31
TILFSSVISC

SEQ ID NO: 23928 - protein, 10 aa, Borrelia burgdorferi B31
ILFSSVISCK

SEQ ID NO: 23929 - protein, 10 aa, Borrelia burgdorferi B31
LFSSVISCKL

SEQ ID NO: 23930 - protein, 10 aa, Borrelia burgdorferi B31
FSSVISCKLY

SEQ ID NO: 23931 - protein, 10 aa, Borrelia burgdorferi B31
SSVISCKLYK

SEQ ID NO: 23932 - protein, 10 aa, Borrelia burgdorferi B31
SVISCKLYKK

SEQ ID NO: 23933 - protein, 10 aa, Borrelia burgdorferi B31
VISCKLYKKI

SEQ ID NO: 23934 - protein, 10 aa, Borrelia burgdorferi B31
ISCKLYKKIT

SEQ ID NO: 23935 - protein, 10 aa, Borrelia burgdorferi B31
SCKLYKKITY

SEQ ID NO: 23936 - protein, 10 aa, Borrelia burgdorferi B31
CKLYKKITYN

SEQ ID NO: 23937 - protein, 10 aa, Borrelia burgdorferi B31
KLYKKITYNA

SEQ ID NO: 23938 - protein, 10 aa, Borrelia burgdorferi B31
LYKKITYNAD

SEQ ID NO: 23939 - protein, 10 aa, Borrelia burgdorferi B31
YKKITYNADQ

SEQ ID NO: 23940 - protein, 10 aa, Borrelia burgdorferi B31
KKITYNADQV

SEQ ID NO: 23941 - protein, 10 aa, Borrelia burgdorferi B31
KITYNADQVI

SEQ ID NO: 23942 - protein, 10 aa, Borrelia burgdorferi B31
ITYNADQVID

SEQ ID NO: 23943 - protein, 10 aa, Borrelia burgdorferi B31
TYNADQVIDK

SEQ ID NO: 23944 - protein, 10 aa, Borrelia burgdorferi B31
YNADQVIDKL

SEQ ID NO: 23945 - protein, 10 aa, Borrelia burgdorferi B31
NADQVIDKLK

SEQ ID NO: 23946 - protein, 10 aa, Borrelia burgdorferi B31
ADQVIDKLKS

SEQ ID NO: 23947 - protein, 10 aa, Borrelia burgdorferi B31
DQVIDKLKSN

SEQ ID NO: 23948 - protein, 10 aa, Borrelia burgdorferi B31
QVIDKLKSNN

SEQ ID NO: 23949 - protein, 10 aa, Borrelia burgdorferi B31
VIDKLKSNNG

SEQ ID NO: 23950 - protein, 10 aa, Borrelia burgdorferi B31
IDKLKSNNGS

SEQ ID NO: 23951 - protein, 10 aa, Borrelia burgdorferi B31
DKLKSNNGSF

SEQ ID NO: 23952 - protein, 10 aa, Borrelia burgdorferi B31
KLKSNNGSFN

SEQ ID NO: 23953 - protein, 10 aa, Borrelia burgdorferi B31
LKSNNGSFNT

SEQ ID NO: 23954 - protein, 10 aa, Borrelia burgdorferi B31
KSNNGSFNTL

SEQ ID NO: 23955 - protein, 10 aa, Borrelia burgdorferi B31
SNNGSFNTLK

SEQ ID NO: 23956 - protein, 10 aa, Borrelia burgdorferi B31
NNGSFNTLKS

SEQ ID NO: 23957 - protein, 10 aa, Borrelia burgdorferi B31
NGSFNTLKSN

SEQ ID NO: 23958 - protein, 10 aa, Borrelia burgdorferi B31
GSFNTLKSND

SEQ ID NO: 23959 - protein, 10 aa, Borrelia burgdorferi B31
SFNTLKSNDD

SEQ ID NO: 23960 - protein, 10 aa, Borrelia burgdorferi B31
FNTLKSNDDS

SEQ ID NO: 23961 - protein, 10 aa, Borrelia burgdorferi B31
NTLKSNDDSK

SEQ ID NO: 23962 - protein, 10 aa, Borrelia burgdorferi B31
TLKSNDDSKR

SEQ ID NO: 23963 - protein, 10 aa, Borrelia burgdorferi B31
LKSNDDSKRS

SEQ ID NO: 23964 - protein, 10 aa, Borrelia burgdorferi B31
KSNDDSKRSG

SEQ ID NO: 23965 - protein, 10 aa, Borrelia burgdorferi B31
SNDDSKRSGR

SEQ ID NO: 23966 - protein, 10 aa, Borrelia burgdorferi B31
NDDSKRSGRK

SEQ ID NO: 23967 - protein, 10 aa, Borrelia burgdorferi B31
DDSKRSGRKP

SEQ ID NO: 23968 - protein, 10 aa, Borrelia burgdorferi B31
DSKRSGRKPR

SEQ ID NO: 23969 - protein, 10 aa, Borrelia burgdorferi B31
SKRSGRKPRS

SEQ ID NO: 23970 - protein, 10 aa, Borrelia burgdorferi B31
KRSGRKPRSV

SEQ ID NO: 23971 - protein, 10 aa, Borrelia burgdorferi B31
RSGRKPRSVD

SEQ ID NO: 23972 - protein, 10 aa, Borrelia burgdorferi B31
SGRKPRSVDN

SEQ ID NO: 23973 - protein, 10 aa, Borrelia burgdorferi B31
GRKPRSVDNT

SEQ ID NO: 23974 - protein, 10 aa, Borrelia burgdorferi B31
RKPRSVDNTY

SEQ ID NO: 23975 - protein, 10 aa, Borrelia burgdorferi B31
KPRSVDNTYM

SEQ ID NO: 23976 - protein, 10 aa, Borrelia burgdorferi B31
PRSVDNTYMD

SEQ ID NO: 23977 - protein, 10 aa, Borrelia burgdorferi B31
RSVDNTYMDQ

SEQ ID NO: 23978 - protein, 10 aa, Borrelia burgdorferi B31
SVDNTYMDQD

SEQ ID NO: 23979 - protein, 10 aa, Borrelia burgdorferi B31
VDNTYMDQDT

SEQ ID NO: 23980 - protein, 10 aa, Borrelia burgdorferi B31
DNTYMDQDTG

SEQ ID NO: 23981 - protein, 10 aa, Borrelia burgdorferi B31
NTYMDQDTGK

SEQ ID NO: 23982 - protein, 10 aa, Borrelia burgdorferi B31
TYMDQDTGKK

SEQ ID NO: 23983 - protein, 10 aa, Borrelia burgdorferi B31
YMDQDTGKKP

SEQ ID NO: 23984 - protein, 10 aa, Borrelia burgdorferi B31
MDQDTGKKPL

SEQ ID NO: 23985 - protein, 10 aa, Borrelia burgdorferi B31
DQDTGKKPLM

SEQ ID NO: 23986 - protein, 10 aa, Borrelia burgdorferi B31
QDTGKKPLMA

SEQ ID NO: 23987 - protein, 10 aa, Borrelia burgdorferi B31
DTGKKPLMAD

SEQ ID NO: 23988 - protein, 10 aa, Borrelia burgdorferi B31
TGKKPLMADM

SEQ ID NO: 23989 - protein, 10 aa, Borrelia burgdorferi B31
GKKPLMADMQ

SEQ ID NO: 23990 - protein, 10 aa, Borrelia burgdorferi B31
KKPLMADMQP

SEQ ID NO: 23991 - protein, 10 aa, Borrelia burgdorferi B31
KPLMADMQPD

SEQ ID NO: 23992 - protein, 10 aa, Borrelia burgdorferi B31
PLMADMQPDM

SEQ ID NO: 23993 - protein, 10 aa, Borrelia burgdorferi B31
LMADMQPDMQ

SEQ ID NO: 23994 - protein, 10 aa, Borrelia burgdorferi B31
MADMQPDMQN

SEQ ID NO: 23995 - protein, 10 aa, Borrelia burgdorferi B31
ADMQPDMQND

SEQ ID NO: 23996 - protein, 10 aa, Borrelia burgdorferi B31
DMQPDMQNDN

SEQ ID NO: 23997 - protein, 10 aa, Borrelia burgdorferi B31
MQPDMQNDNS

SEQ ID NO: 23998 - protein, 10 aa, Borrelia burgdorferi B31
QPDMQNDNSS

SEQ ID NO: 23999 - protein, 10 aa, Borrelia burgdorferi B31
PDMQNDNSSS

SEQ ID NO: 24000 - protein, 10 aa, Borrelia burgdorferi B31
DMQNDNSSSN

SEQ ID NO: 24001 - protein, 10 aa, Borrelia burgdorferi B31
MQNDNSSSNH

SEQ ID NO: 24002 - protein, 10 aa, Borrelia burgdorferi B31
QNDNSSSNHT

SEQ ID NO: 24003 - protein, 10 aa, Borrelia burgdorferi B31
NDNSSSNHTL

SEQ ID NO: 24004 - protein, 10 aa, Borrelia burgdorferi B31
DNSSSNHTLQ

SEQ ID NO: 24005 - protein, 10 aa, Borrelia burgdorferi B31
NSSSNHTLQV

SEQ ID NO: 24006 - protein, 10 aa, Borrelia burgdorferi B31
SSSNHTLQVN

SEQ ID NO: 24007 - protein, 10 aa, Borrelia burgdorferi B31
SSNHTLQVNI

SEQ ID NO: 24008 - protein, 10 aa, Borrelia burgdorferi B31
SNHTLQVNIQ

SEQ ID NO: 24009 - protein, 10 aa, Borrelia burgdorferi B31
NHTLQVNIQD

SEQ ID NO: 24010 - protein, 10 aa, Borrelia burgdorferi B31
HTLQVNIQDN

SEQ ID NO: 24011 - protein, 10 aa, Borrelia burgdorferi B31
TLQVNIQDNE

SEQ ID NO: 24012 - protein, 10 aa, Borrelia burgdorferi B31
LQVNIQDNEA

SEQ ID NO: 24013 - protein, 10 aa, Borrelia burgdorferi B31
QVNIQDNEAS

SEQ ID NO: 24014 - protein, 10 aa, Borrelia burgdorferi B31
VNIQDNEASE

SEQ ID NO: 24015 - protein, 10 aa, Borrelia burgdorferi B31
NIQDNEASEA

SEQ ID NO: 24016 - protein, 10 aa, Borrelia burgdorferi B31
IQDNEASEAR

SEQ ID NO: 24017 - protein, 10 aa, Borrelia burgdorferi B31
QDNEASEARN

SEQ ID NO: 24018 - protein, 10 aa, Borrelia burgdorferi B31
DNEASEARNI

SEQ ID NO: 24019 - protein, 10 aa, Borrelia burgdorferi B31
NEASEARNIM

SEQ ID NO: 24020 - protein, 10 aa, Borrelia burgdorferi B31
EASEARNIMT

SEQ ID NO: 24021 - protein, 10 aa, Borrelia burgdorferi B31
ASEARNIMTE

SEQ ID NO: 24022 - protein, 10 aa, Borrelia burgdorferi B31
SEARNIMTEI

SEQ ID NO: 24023 - protein, 10 aa, Borrelia burgdorferi B31
EARNIMTEIE

SEQ ID NO: 24024 - protein, 10 aa, Borrelia burgdorferi B31
ARNIMTEIES

SEQ ID NO: 24025 - protein, 10 aa, Borrelia burgdorferi B31
RNIMTEIESS

SEQ ID NO: 24026 - protein, 10 aa, Borrelia burgdorferi B31
NIMTEIESSK

SEQ ID NO: 24027 - protein, 10 aa, Borrelia burgdorferi B31
IMTEIESSKE

SEQ ID NO: 24028 - protein, 10 aa, Borrelia burgdorferi B31
MTEIESSKEE

SEQ ID NO: 24029 - protein, 10 aa, Borrelia burgdorferi B31
TEIESSKEEY

SEQ ID NO: 24030 - protein, 10 aa, Borrelia burgdorferi B31
EIESSKEEYN

SEQ ID NO: 24031 - protein, 10 aa, Borrelia burgdorferi B31
IESSKEEYNR

SEQ ID NO: 24032 - protein, 10 aa, Borrelia burgdorferi B31
ESSKEEYNRI

SEQ ID NO: 24033 - protein, 10 aa, Borrelia burgdorferi B31
SSKEEYNRIN

SEQ ID NO: 24034 - protein, 10 aa, Borrelia burgdorferi B31
SKEEYNRINE

SEQ ID NO: 24035 - protein, 10 aa, Borrelia burgdorferi B31
KEEYNRINED

SEQ ID NO: 24036 - protein, 10 aa, Borrelia burgdorferi B31
EEYNRINEDL

SEQ ID NO: 24037 - protein, 10 aa, Borrelia burgdorferi B31
EYNRINEDLA

SEQ ID NO: 24038 - protein, 10 aa, Borrelia burgdorferi B31
YNRINEDLAK

SEQ ID NO: 24039 - protein, 10 aa, Borrelia burgdorferi B31
NRINEDLAKV

SEQ ID NO: 24040 - protein, 10 aa, Borrelia burgdorferi B31
RINEDLAKVK

SEQ ID NO: 24041 - protein, 10 aa, Borrelia burgdorferi B31
INEDLAKVKA

SEQ ID NO: 24042 - protein, 10 aa, Borrelia burgdorferi B31
NEDLAKVKAS

SEQ ID NO: 24043 - protein, 10 aa, Borrelia burgdorferi B31
EDLAKVKASL

SEQ ID NO: 24044 - protein, 10 aa, Borrelia burgdorferi B31
DLAKVKASLD

SEQ ID NO: 24045 - protein, 10 aa, Borrelia burgdorferi B31
LAKVKASLDK

SEQ ID NO: 24046 - protein, 10 aa, Borrelia burgdorferi B31
AKVKASLDKI

SEQ ID NO: 24047 - protein, 10 aa, Borrelia burgdorferi B31
KVKASLDKIK

SEQ ID NO: 24048 - protein, 10 aa, Borrelia burgdorferi B31
VKASLDKIKS

SEQ ID NO: 24049 - protein, 10 aa, Borrelia burgdorferi B31
KASLDKIKSL

SEQ ID NO: 24050 - protein, 10 aa, Borrelia burgdorferi B31
ASLDKIKSLL

SEQ ID NO: 24051 - protein, 10 aa, Borrelia burgdorferi B31
SLDKIKSLLS

SEQ ID NO: 24052 - protein, 10 aa, Borrelia burgdorferi B31
LDKIKSLLST

SEQ ID NO: 24053 - protein, 10 aa, Borrelia burgdorferi B31
DKIKSLLSTA

SEQ ID NO: 24054 - protein, 10 aa, Borrelia burgdorferi B31
KIKSLLSTAK

SEQ ID NO: 24055 - protein, 10 aa, Borrelia burgdorferi B31
IKSLLSTAKS

SEQ ID NO: 24056 - protein, 10 aa, Borrelia burgdorferi B31
KSLLSTAKSY

SEQ ID NO: 24057 - protein, 10 aa, Borrelia burgdorferi B31
SLLSTAKSYL

SEQ ID NO: 24058 - protein, 10 aa, Borrelia burgdorferi B31
LLSTAKSYLE

SEQ ID NO: 24059 - protein, 10 aa, Borrelia burgdorferi B31
LSTAKSYLEQ

SEQ ID NO: 24060 - protein, 10 aa, Borrelia burgdorferi B31
STAKSYLEQT

SEQ ID NO: 24061 - protein, 10 aa, Borrelia burgdorferi B31
TAKSYLEQTR

SEQ ID NO: 24062 - protein, 10 aa, Borrelia burgdorferi B31
AKSYLEQTRR

SEQ ID NO: 24063 - protein, 10 aa, Borrelia burgdorferi B31
KSYLEQTRRG

SEQ ID NO: 24064 - protein, 10 aa, Borrelia burgdorferi B31
SYLEQTRRGV

SEQ ID NO: 24065 - protein, 10 aa, Borrelia burgdorferi B31
YLEQTRRGVG

SEQ ID NO: 24066 - protein, 10 aa, Borrelia burgdorferi B31
LEQTRRGVGS

SEQ ID NO: 24067 - protein, 10 aa, Borrelia burgdorferi B31
EQTRRGVGSS

SEQ ID NO: 24068 - protein, 10 aa, Borrelia burgdorferi B31
QTRRGVGSSK

SEQ ID NO: 24069 - protein, 10 aa, Borrelia burgdorferi B31
TRRGVGSSKA

SEQ ID NO: 24070 - protein, 10 aa, Borrelia burgdorferi B31
RRGVGSSKAN

SEQ ID NO: 24071 - protein, 10 aa, Borrelia burgdorferi B31
RGVGSSKANL

SEQ ID NO: 24072 - protein, 10 aa, Borrelia burgdorferi B31
GVGSSKANLA

SEQ ID NO: 24073 - protein, 10 aa, Borrelia burgdorferi B31
VGSSKANLAL

SEQ ID NO: 24074 - protein, 10 aa, Borrelia burgdorferi B31
GSSKANLALL

SEQ ID NO: 24075 - protein, 10 aa, Borrelia burgdorferi B31
SSKANLALLP

SEQ ID NO: 24076 - protein, 10 aa, Borrelia burgdorferi B31
SKANLALLPS

SEQ ID NO: 24077 - protein, 10 aa, Borrelia burgdorferi B31
KANLALLPSL

SEQ ID NO: 24078 - protein, 10 aa, Borrelia burgdorferi B31
ANLALLPSLE

SEQ ID NO: 24079 - protein, 10 aa, Borrelia burgdorferi B31
NLALLPSLEE

SEQ ID NO: 24080 - protein, 10 aa, Borrelia burgdorferi B31
LALLPSLEEA

SEQ ID NO: 24081 - protein, 10 aa, Borrelia burgdorferi B31
ALLPSLEEAI

SEQ ID NO: 24082 - protein, 10 aa, Borrelia burgdorferi B31
LLPSLEEAIA

SEQ ID NO: 24083 - protein, 10 aa, Borrelia burgdorferi B31
LPSLEEAIAK

SEQ ID NO: 24084 - protein, 10 aa, Borrelia burgdorferi B31
PSLEEAIAKV

SEQ ID NO: 24085 - protein, 10 aa, Borrelia burgdorferi B31
SLEEAIAKVK

SEQ ID NO: 24086 - protein, 10 aa, Borrelia burgdorferi B31
LEEAIAKVKS

SEQ ID NO: 24087 - protein, 10 aa, Borrelia burgdorferi B31
EEAIAKVKSN

SEQ ID NO: 24088 - protein, 10 aa, Borrelia burgdorferi B31
EAIAKVKSNH

SEQ ID NO: 24089 - protein, 10 aa, Borrelia burgdorferi B31
AIAKVKSNHA

SEQ ID NO: 24090 - protein, 10 aa, Borrelia burgdorferi B31
IAKVKSNHAS

SEQ ID NO: 24091 - protein, 10 aa, Borrelia burgdorferi B31
AKVKSNHASA

SEQ ID NO: 24092 - protein, 10 aa, Borrelia burgdorferi B31
KVKSNHASAD

SEQ ID NO: 24093 - protein, 10 aa, Borrelia burgdorferi B31
VKSNHASADT

SEQ ID NO: 24094 - protein, 10 aa, Borrelia burgdorferi B31
KSNHASADTH

SEQ ID NO: 24095 - protein, 10 aa, Borrelia burgdorferi B31
SNHASADTHC

SEQ ID NO: 24096 - protein, 10 aa, Borrelia burgdorferi B31
NHASADTHCN

SEQ ID NO: 24097 - protein, 10 aa, Borrelia burgdorferi B31
HASADTHCND

SEQ ID NO: 24098 - protein, 10 aa, Borrelia burgdorferi B31
ASADTHCNDA

SEQ ID NO: 24099 - protein, 10 aa, Borrelia burgdorferi B31
SADTHCNDAI

SEQ ID NO: 24100 - protein, 10 aa, Borrelia burgdorferi B31
ADTHCNDAIA

SEQ ID NO: 24101 - protein, 10 aa, Borrelia burgdorferi B31
DTHCNDAIAA

SEQ ID NO: 24102 - protein, 10 aa, Borrelia burgdorferi B31
THCNDAIAAL

SEQ ID NO: 24103 - protein, 10 aa, Borrelia burgdorferi B31
HCNDAIAALK

SEQ ID NO: 24104 - protein, 10 aa, Borrelia burgdorferi B31
CNDAIAALKR

SEQ ID NO: 24105 - protein, 10 aa, Borrelia burgdorferi B31
NDAIAALKRA

SEQ ID NO: 24106 - protein, 10 aa, Borrelia burgdorferi B31
DAIAALKRAK

SEQ ID NO: 24107 - protein, 10 aa, Borrelia burgdorferi B31
AIAALKRAKN

SEQ ID NO: 24108 - protein, 10 aa, Borrelia burgdorferi B31
IAALKRAKND

SEQ ID NO: 24109 - protein, 10 aa, Borrelia burgdorferi B31
AALKRAKNDF

SEQ ID NO: 24110 - protein, 10 aa, Borrelia burgdorferi B31
ALKRAKNDFE

SEQ ID NO: 24111 - protein, 10 aa, Borrelia burgdorferi B31
LKRAKNDFEY

SEQ ID NO: 24112 - protein, 10 aa, Borrelia burgdorferi B31
KRAKNDFEYA

SEQ ID NO: 24113 - protein, 10 aa, Borrelia burgdorferi B31
RAKNDFEYAQ

SEQ ID NO: 24114 - protein, 10 aa, Borrelia burgdorferi B31
AKNDFEYAQR

SEQ ID NO: 24115 - protein, 10 aa, Borrelia burgdorferi B31
KNDFEYAQRK

SEQ ID NO: 24116 - protein, 10 aa, Borrelia burgdorferi B31
NDFEYAQRKA

SEQ ID NO: 24117 - protein, 10 aa, Borrelia burgdorferi B31
DFEYAQRKAD

SEQ ID NO: 24118 - protein, 10 aa, Borrelia burgdorferi B31
FEYAQRKADR

SEQ ID NO: 24119 - protein, 10 aa, Borrelia burgdorferi B31
EYAQRKADRA

SEQ ID NO: 24120 - protein, 10 aa, Borrelia burgdorferi B31
YAQRKADRAL

SEQ ID NO: 24121 - protein, 10 aa, Borrelia burgdorferi B31
AQRKADRALE

SEQ ID NO: 24122 - protein, 10 aa, Borrelia burgdorferi B31
QRKADRALEE

SEQ ID NO: 24123 - protein, 10 aa, Borrelia burgdorferi B31
RKADRALEEA

SEQ ID NO: 24124 - protein, 10 aa, Borrelia burgdorferi B31
KADRALEEAL

SEQ ID NO: 24125 - protein, 10 aa, Borrelia burgdorferi B31
ADRALEEALS

SEQ ID NO: 24126 - protein, 10 aa, Borrelia burgdorferi B31
DRALEEALSN

SEQ ID NO: 24127 - protein, 10 aa, Borrelia burgdorferi B31
RALEEALSNS

SEQ ID NO: 24128 - protein, 10 aa, Borrelia burgdorferi B31
ALEEALSNSN

SEQ ID NO: 24129 - protein, 10 aa, Borrelia burgdorferi B31
LEEALSNSNA

SEQ ID NO: 24130 - protein, 10 aa, Borrelia burgdorferi B31
EEALSNSNAS

SEQ ID NO: 24131 - protein, 10 aa, Borrelia burgdorferi B31
EALSNSNASR

SEQ ID NO: 24132 - protein, 10 aa, Borrelia burgdorferi B31
ALSNSNASRH

SEQ ID NO: 24133 - protein, 10 aa, Borrelia burgdorferi B31
LSNSNASRHE

SEQ ID NO: 24134 - protein, 10 aa, Borrelia burgdorferi B31
SNSNASRHES

SEQ ID NO: 24135 - protein, 10 aa, Borrelia burgdorferi B31
NSNASRHESY

SEQ ID NO: 24136 - protein, 10 aa, Borrelia burgdorferi B31
SNASRHESYY

SEQ ID NO: 24137 - protein, 10 aa, Borrelia burgdorferi B31
NASRHESYYY

SEQ ID NO: 24138 - protein, 10 aa, Borrelia burgdorferi B31
ASRHESYYYA

SEQ ID NO: 24139 - protein, 10 aa, Borrelia burgdorferi B31
SRHESYYYAG

SEQ ID NO: 24140 - protein, 10 aa, Borrelia burgdorferi B31
RHESYYYAGY

SEQ ID NO: 24141 - protein, 10 aa, Borrelia burgdorferi B31
HESYYYAGYH

SEQ ID NO: 24142 - protein, 10 aa, Borrelia burgdorferi B31
ESYYYAGYHQ

SEQ ID NO: 24143 - protein, 10 aa, Borrelia burgdorferi B31
SYYYAGYHQF

SEQ ID NO: 24144 - protein, 10 aa, Borrelia burgdorferi B31
YYYAGYHQFM

SEQ ID NO: 24145 - protein, 10 aa, Borrelia burgdorferi B31
YYAGYHQFMA

SEQ ID NO: 24146 - protein, 10 aa, Borrelia burgdorferi B31
YAGYHQFMAD

SEQ ID NO: 24147 - protein, 10 aa, Borrelia burgdorferi B31
AGYHQFMADA

SEQ ID NO: 24148 - protein, 10 aa, Borrelia burgdorferi B31
GYHQFMADAK

SEQ ID NO: 24149 - protein, 10 aa, Borrelia burgdorferi B31
YHQFMADAKA

SEQ ID NO: 24150 - protein, 10 aa, Borrelia burgdorferi B31
HQFMADAKAS

SEQ ID NO: 24151 - protein, 10 aa, Borrelia burgdorferi B31
QFMADAKASM

SEQ ID NO: 24152 - protein, 10 aa, Borrelia burgdorferi B31
FMADAKASMS

SEQ ID NO: 24153 - protein, 10 aa, Borrelia burgdorferi B31
MADAKASMSS

SEQ ID NO: 24154 - protein, 10 aa, Borrelia burgdorferi B31
ADAKASMSST

SEQ ID NO: 24155 - protein, 10 aa, Borrelia burgdorferi B31
DAKASMSSTK

SEQ ID NO: 24156 - protein, 10 aa, Borrelia burgdorferi B31
AKASMSSTKS

SEQ ID NO: 24157 - protein, 10 aa, Borrelia burgdorferi B31
KASMSSTKSL

SEQ ID NO: 24158 - protein, 10 aa, Borrelia burgdorferi B31
ASMSSTKSLL

SEQ ID NO: 24159 - protein, 10 aa, Borrelia burgdorferi B31
SMSSTKSLLE

SEQ ID NO: 24160 - protein, 10 aa, Borrelia burgdorferi B31
MSSTKSLLEV

SEQ ID NO: 24161 - protein, 10 aa, Borrelia burgdorferi B31
SSTKSLLEVA

SEQ ID NO: 24162 - protein, 10 aa, Borrelia burgdorferi B31
STKSLLEVAK

SEQ ID NO: 24163 - protein, 10 aa, Borrelia burgdorferi B31
TKSLLEVAKN

SEQ ID NO: 24164 - protein, 10 aa, Borrelia burgdorferi B31
KSLLEVAKNK

SEQ ID NO: 24165 - protein, 10 aa, Borrelia burgdorferi B31
SLLEVAKNKQ

SEQ ID NO: 24166 - protein, 10 aa, Borrelia burgdorferi B31
LLEVAKNKQK

SEQ ID NO: 24167 - protein, 10 aa, Borrelia burgdorferi B31
LEVAKNKQKE

SEQ ID NO: 24168 - protein, 10 aa, Borrelia burgdorferi B31
EVAKNKQKEL

SEQ ID NO: 24169 - protein, 10 aa, Borrelia burgdorferi B31
VAKNKQKELN

SEQ ID NO: 24170 - protein, 10 aa, Borrelia burgdorferi B31
AKNKQKELNE

SEQ ID NO: 24171 - protein, 10 aa, Borrelia burgdorferi B31
KNKQKELNEN

SEQ ID NO: 24172 - protein, 10 aa, Borrelia burgdorferi B31
NKQKELNENM

SEQ ID NO: 24173 - protein, 10 aa, Borrelia burgdorferi B31
KQKELNENMT

SEQ ID NO: 24174 - protein, 10 aa, Borrelia burgdorferi B31
QKELNENMTK

SEQ ID NO: 24175 - protein, 10 aa, Borrelia burgdorferi B31
KELNENMTKT

SEQ ID NO: 24176 - protein, 10 aa, Borrelia burgdorferi B31
ELNENMTKTN

SEQ ID NO: 24177 - protein, 10 aa, Borrelia burgdorferi B31
LNENMTKTNK

SEQ ID NO: 24178 - protein, 10 aa, Borrelia burgdorferi B31
NENMTKTNKD

SEQ ID NO: 24179 - protein, 10 aa, Borrelia burgdorferi B31
ENMTKTNKDF

SEQ ID NO: 24180 - protein, 10 aa, Borrelia burgdorferi B31
NMTKTNKDFQ

SEQ ID NO: 24181 - protein, 10 aa, Borrelia burgdorferi B31
MTKTNKDFQE

SEQ ID NO: 24182 - protein, 10 aa, Borrelia burgdorferi B31
TKTNKDFQEL

SEQ ID NO: 24183 - protein, 10 aa, Borrelia burgdorferi B31
KTNKDFQELN

SEQ ID NO: 24184 - protein, 10 aa, Borrelia burgdorferi B31
TNKDFQELND

SEQ ID NO: 24185 - protein, 10 aa, Borrelia burgdorferi B31
NKDFQELNDI

SEQ ID NO: 24186 - protein, 10 aa, Borrelia burgdorferi B31
KDFQELNDIY

SEQ ID NO: 24187 - protein, 10 aa, Borrelia burgdorferi B31
DFQELNDIYK

SEQ ID NO: 24188 - protein, 10 aa, Borrelia burgdorferi B31
FQELNDIYKK

SEQ ID NO: 24189 - protein, 10 aa, Borrelia burgdorferi B31
QELNDIYKKL

SEQ ID NO: 24190 - protein, 10 aa, Borrelia burgdorferi B31
ELNDIYKKLQ

SEQ ID NO: 24191 - protein, 10 aa, Borrelia burgdorferi B31
LNDIYKKLQD

SEQ ID NO: 24192 - protein, 10 aa, Borrelia burgdorferi B31
NDIYKKLQDM

SEQ ID NO: 24193 - protein, 10 aa, Borrelia burgdorferi B31
DIYKKLQDMD

SEQ ID NO: 24194 - protein, 10 aa, Borrelia burgdorferi B31
IYKKLQDMDS

SEQ ID NO: 24195 - protein, 10 aa, Borrelia burgdorferi B31
YKKLQDMDSR

SEQ ID NO: 24196 - protein, 11 aa, Borrelia burgdorferi B31
MNLINKLFILT

SEQ ID NO: 24197 - protein, 11 aa, Borrelia burgdorferi B31
NLINKLFILTI

SEQ ID NO: 24198 - protein, 11 aa, Borrelia burgdorferi B31
LINKLFILTIL

SEQ ID NO: 24199 - protein, 11 aa, Borrelia burgdorferi B31
INKLFILTILF

SEQ ID NO: 24200 - protein, 11 aa, Borrelia burgdorferi B31
NKLFILTILFS

SEQ ID NO: 24201 - protein, 11 aa, Borrelia burgdorferi B31
KLFILTILFSS

SEQ ID NO: 24202 - protein, 11 aa, Borrelia burgdorferi B31
LFILTILFSSV

SEQ ID NO: 24203 - protein, 11 aa, Borrelia burgdorferi B31
FILTILFSSVI

SEQ ID NO: 24204 - protein, 11 aa, Borrelia burgdorferi B31
ILTILFSSVIS

SEQ ID NO: 24205 - protein, 11 aa, Borrelia burgdorferi B31
LTILFSSVISC

SEQ ID NO: 24206 - protein, 11 aa, Borrelia burgdorferi B31
TILFSSVISCK

SEQ ID NO: 24207 - protein, 11 aa, Borrelia burgdorferi B31
ILFSSVISCKL

SEQ ID NO: 24208 - protein, 11 aa, Borrelia burgdorferi B31
LFSSVISCKLY

SEQ ID NO: 24209 - protein, 11 aa, Borrelia burgdorferi B31
FSSVISCKLYK

SEQ ID NO: 24210 - protein, 11 aa, Borrelia burgdorferi B31
SSVISCKLYKK

SEQ ID NO: 24211 - protein, 11 aa, Borrelia burgdorferi B31
SVISCKLYKKI

SEQ ID NO: 24212 - protein, 11 aa, Borrelia burgdorferi B31
VISCKLYKKIT

SEQ ID NO: 24213 - protein, 11 aa, Borrelia burgdorferi B31
ISCKLYKKITY

SEQ ID NO: 24214 - protein, 11 aa, Borrelia burgdorferi B31
SCKLYKKITYN

SEQ ID NO: 24215 - protein, 11 aa, Borrelia burgdorferi B31
CKLYKKITYNA

SEQ ID NO: 24216 - protein, 11 aa, Borrelia burgdorferi B31
KLYKKITYNAD

SEQ ID NO: 24217 - protein, 11 aa, Borrelia burgdorferi B31
LYKKITYNADQ

SEQ ID NO: 24218 - protein, 11 aa, Borrelia burgdorferi B31
YKKITYNADQV

SEQ ID NO: 24219 - protein, 11 aa, Borrelia burgdorferi B31
KKITYNADQVI

SEQ ID NO: 24220 - protein, 11 aa, Borrelia burgdorferi B31
KITYNADQVID

SEQ ID NO: 24221 - protein, 11 aa, Borrelia burgdorferi B31
ITYNADQVIDK

SEQ ID NO: 24222 - protein, 11 aa, Borrelia burgdorferi B31
TYNADQVIDKL

SEQ ID NO: 24223 - protein, 11 aa, Borrelia burgdorferi B31
YNADQVIDKLK

SEQ ID NO: 24224 - protein, 11 aa, Borrelia burgdorferi B31
NADQVIDKLKS

SEQ ID NO: 24225 - protein, 11 aa, Borrelia burgdorferi B31
ADQVIDKLKSN

SEQ ID NO: 24226 - protein, 11 aa, Borrelia burgdorferi B31
DQVIDKLKSNN

SEQ ID NO: 24227 - protein, 11 aa, Borrelia burgdorferi B31
QVIDKLKSNNG

SEQ ID NO: 24228 - protein, 11 aa, Borrelia burgdorferi B31
VIDKLKSNNGS

SEQ ID NO: 24229 - protein, 11 aa, Borrelia burgdorferi B31
IDKLKSNNGSF

SEQ ID NO: 24230 - protein, 11 aa, Borrelia burgdorferi B31
DKLKSNNGSFN

SEQ ID NO: 24231 - protein, 11 aa, Borrelia burgdorferi B31
KLKSNNGSFNT

SEQ ID NO: 24232 - protein, 11 aa, Borrelia burgdorferi B31
LKSNNGSFNTL

SEQ ID NO: 24233 - protein, 11 aa, Borrelia burgdorferi B31
KSNNGSFNTLK

SEQ ID NO: 24234 - protein, 11 aa, Borrelia burgdorferi B31
SNNGSFNTLKS

SEQ ID NO: 24235 - protein, 11 aa, Borrelia burgdorferi B31
NNGSFNTLKSN

SEQ ID NO: 24236 - protein, 11 aa, Borrelia burgdorferi B31
NGSFNTLKSND

SEQ ID NO: 24237 - protein, 11 aa, Borrelia burgdorferi B31
GSFNTLKSNDD

SEQ ID NO: 24238 - protein, 11 aa, Borrelia burgdorferi B31
SFNTLKSNDDS

SEQ ID NO: 24239 - protein, 11 aa, Borrelia burgdorferi B31
FNTLKSNDDSK

SEQ ID NO: 24240 - protein, 11 aa, Borrelia burgdorferi B31
NTLKSNDDSKR

SEQ ID NO: 24241 - protein, 11 aa, Borrelia burgdorferi B31
TLKSNDDSKRS

SEQ ID NO: 24242 - protein, 11 aa, Borrelia burgdorferi B31
LKSNDDSKRSG

SEQ ID NO: 24243 - protein, 11 aa, Borrelia burgdorferi B31
KSNDDSKRSGR

SEQ ID NO: 24244 - protein, 11 aa, Borrelia burgdorferi B31
SNDDSKRSGRK

SEQ ID NO: 24245 - protein, 11 aa, Borrelia burgdorferi B31
NDDSKRSGRKP

SEQ ID NO: 24246 - protein, 11 aa, Borrelia burgdorferi B31
DDSKRSGRKPR

SEQ ID NO: 24247 - protein, 11 aa, Borrelia burgdorferi B31
DSKRSGRKPRS

SEQ ID NO: 24248 - protein, 11 aa, Borrelia burgdorferi B31
SKRSGRKPRSV

SEQ ID NO: 24249 - protein, 11 aa, Borrelia burgdorferi B31
KRSGRKPRSVD

SEQ ID NO: 24250 - protein, 11 aa, Borrelia burgdorferi B31
RSGRKPRSVDN

SEQ ID NO: 24251 - protein, 11 aa, Borrelia burgdorferi B31
SGRKPRSVDNT

SEQ ID NO: 24252 - protein, 11 aa, Borrelia burgdorferi B31
GRKPRSVDNTY

SEQ ID NO: 24253 - protein, 11 aa, Borrelia burgdorferi B31
RKPRSVDNTYM

SEQ ID NO: 24254 - protein, 11 aa, Borrelia burgdorferi B31
KPRSVDNTYMD

SEQ ID NO: 24255 - protein, 11 aa, Borrelia burgdorferi B31
PRSVDNTYMDQ

SEQ ID NO: 24256 - protein, 11 aa, Borrelia burgdorferi B31
RSVDNTYMDQD

SEQ ID NO: 24257 - protein, 11 aa, Borrelia burgdorferi B31
SVDNTYMDQDT

SEQ ID NO: 24258 - protein, 11 aa, Borrelia burgdorferi B31
VDNTYMDQDTG

SEQ ID NO: 24259 - protein, 11 aa, Borrelia burgdorferi B31
DNTYMDQDTGK

SEQ ID NO: 24260 - protein, 11 aa, Borrelia burgdorferi B31
NTYMDQDTGKK

SEQ ID NO: 24261 - protein, 11 aa, Borrelia burgdorferi B31
TYMDQDTGKKP

SEQ ID NO: 24262 - protein, 11 aa, Borrelia burgdorferi B31
YMDQDTGKKPL

SEQ ID NO: 24263 - protein, 11 aa, Borrelia burgdorferi B31
MDQDTGKKPLM

SEQ ID NO: 24264 - protein, 11 aa, Borrelia burgdorferi B31
DQDTGKKPLMA

SEQ ID NO: 24265 - protein, 11 aa, Borrelia burgdorferi B31
QDTGKKPLMAD

SEQ ID NO: 24266 - protein, 11 aa, Borrelia burgdorferi B31
DTGKKPLMADM

SEQ ID NO: 24267 - protein, 11 aa, Borrelia burgdorferi B31
TGKKPLMADMQ

SEQ ID NO: 24268 - protein, 11 aa, Borrelia burgdorferi B31
GKKPLMADMQP

SEQ ID NO: 24269 - protein, 11 aa, Borrelia burgdorferi B31
KKPLMADMQPD

SEQ ID NO: 24270 - protein, 11 aa, Borrelia burgdorferi B31
KPLMADMQPDM

SEQ ID NO: 24271 - protein, 11 aa, Borrelia burgdorferi B31
PLMADMQPDMQ

SEQ ID NO: 24272 - protein, 11 aa, Borrelia burgdorferi B31
LMADMQPDMQN

SEQ ID NO: 24273 - protein, 11 aa, Borrelia burgdorferi B31
MADMQPDMQND

SEQ ID NO: 24274 - protein, 11 aa, Borrelia burgdorferi B31
ADMQPDMQNDN

SEQ ID NO: 24275 - protein, 11 aa, Borrelia burgdorferi B31
DMQPDMQNDNS

SEQ ID NO: 24276 - protein, 11 aa, Borrelia burgdorferi B31
MQPDMQNDNSS

SEQ ID NO: 24277 - protein, 11 aa, Borrelia burgdorferi B31
QPDMQNDNSSS

SEQ ID NO: 24278 - protein, 11 aa, Borrelia burgdorferi B31
PDMQNDNSSSN

SEQ ID NO: 24279 - protein, 11 aa, Borrelia burgdorferi B31
DMQNDNSSSNH

SEQ ID NO: 24280 - protein, 11 aa, Borrelia burgdorferi B31
MQNDNSSSNHT

SEQ ID NO: 24281 - protein, 11 aa, Borrelia burgdorferi B31
QNDNSSSNHTL

SEQ ID NO: 24282 - protein, 11 aa, Borrelia burgdorferi B31
NDNSSSNHTLQ

SEQ ID NO: 24283 - protein, 11 aa, Borrelia burgdorferi B31
DNSSSNHTLQV

SEQ ID NO: 24284 - protein, 11 aa, Borrelia burgdorferi B31
NSSSNHTLQVN

SEQ ID NO: 24285 - protein, 11 aa, Borrelia burgdorferi B31
SSSNHTLQVNI

SEQ ID NO: 24286 - protein, 11 aa, Borrelia burgdorferi B31
SSNHTLQVNIQ

SEQ ID NO: 24287 - protein, 11 aa, Borrelia burgdorferi B31
SNHTLQVNIQD

SEQ ID NO: 24288 - protein, 11 aa, Borrelia burgdorferi B31
NHTLQVNIQDN

SEQ ID NO: 24289 - protein, 11 aa, Borrelia burgdorferi B31
HTLQVNIQDNE

SEQ ID NO: 24290 - protein, 11 aa, Borrelia burgdorferi B31
TLQVNIQDNEA

SEQ ID NO: 24291 - protein, 11 aa, Borrelia burgdorferi B31
LQVNIQDNEAS

SEQ ID NO: 24292 - protein, 11 aa, Borrelia burgdorferi B31
QVNIQDNEASE

SEQ ID NO: 24293 - protein, 11 aa, Borrelia burgdorferi B31
VNIQDNEASEA

SEQ ID NO: 24294 - protein, 11 aa, Borrelia burgdorferi B31
NIQDNEASEAR

SEQ ID NO: 24295 - protein, 11 aa, Borrelia burgdorferi B31
IQDNEASEARN

SEQ ID NO: 24296 - protein, 11 aa, Borrelia burgdorferi B31
QDNEASEARNI

SEQ ID NO: 24297 - protein, 11 aa, Borrelia burgdorferi B31
DNEASEARNIM

SEQ ID NO: 24298 - protein, 11 aa, Borrelia burgdorferi B31
NEASEARNIMT

SEQ ID NO: 24299 - protein, 11 aa, Borrelia burgdorferi B31
EASEARNIMTE

SEQ ID NO: 24300 - protein, 11 aa, Borrelia burgdorferi B31
ASEARNIMTEI

SEQ ID NO: 24301 - protein, 11 aa, Borrelia burgdorferi B31
SEARNIMTEIE

SEQ ID NO: 24302 - protein, 11 aa, Borrelia burgdorferi B31
EARNIMTEIES

SEQ ID NO: 24303 - protein, 11 aa, Borrelia burgdorferi B31
ARNIMTEIESS

SEQ ID NO: 24304 - protein, 11 aa, Borrelia burgdorferi B31
RNIMTEIESSK

SEQ ID NO: 24305 - protein, 11 aa, Borrelia burgdorferi B31
NIMTEIESSKE

SEQ ID NO: 24306 - protein, 11 aa, Borrelia burgdorferi B31
IMTEIESSKEE

SEQ ID NO: 24307 - protein, 11 aa, Borrelia burgdorferi B31
MTEIESSKEEY

SEQ ID NO: 24308 - protein, 11 aa, Borrelia burgdorferi B31
TEIESSKEEYN

SEQ ID NO: 24309 - protein, 11 aa, Borrelia burgdorferi B31
EIESSKEEYNR

SEQ ID NO: 24310 - protein, 11 aa, Borrelia burgdorferi B31
IESSKEEYNRI

SEQ ID NO: 24311 - protein, 11 aa, Borrelia burgdorferi B31
ESSKEEYNRIN

SEQ ID NO: 24312 - protein, 11 aa, Borrelia burgdorferi B31
SSKEEYNRINE

SEQ ID NO: 24313 - protein, 11 aa, Borrelia burgdorferi B31
SKEEYNRINED

SEQ ID NO: 24314 - protein, 11 aa, Borrelia burgdorferi B31
KEEYNRINEDL

SEQ ID NO: 24315 - protein, 11 aa, Borrelia burgdorferi B31
EEYNRINEDLA

SEQ ID NO: 24316 - protein, 11 aa, Borrelia burgdorferi B31
EYNRINEDLAK

SEQ ID NO: 24317 - protein, 11 aa, Borrelia burgdorferi B31
YNRINEDLAKV

SEQ ID NO: 24318 - protein, 11 aa, Borrelia burgdorferi B31
NRINEDLAKVK

SEQ ID NO: 24319 - protein, 11 aa, Borrelia burgdorferi B31
RINEDLAKVKA

SEQ ID NO: 24320 - protein, 11 aa, Borrelia burgdorferi B31
INEDLAKVKAS

SEQ ID NO: 24321 - protein, 11 aa, Borrelia burgdorferi B31
NEDLAKVKASL

SEQ ID NO: 24322 - protein, 11 aa, Borrelia burgdorferi B31
EDLAKVKASLD

SEQ ID NO: 24323 - protein, 11 aa, Borrelia burgdorferi B31
DLAKVKASLDK

SEQ ID NO: 24324 - protein, 11 aa, Borrelia burgdorferi B31
LAKVKASLDKI

SEQ ID NO: 24325 - protein, 11 aa, Borrelia burgdorferi B31
AKVKASLDKIK

SEQ ID NO: 24326 - protein, 11 aa, Borrelia burgdorferi B31
KVKASLDKIKS

SEQ ID NO: 24327 - protein, 11 aa, Borrelia burgdorferi B31
VKASLDKIKSL

SEQ ID NO: 24328 - protein, 11 aa, Borrelia burgdorferi B31
KASLDKIKSLL

SEQ ID NO: 24329 - protein, 11 aa, Borrelia burgdorferi B31
ASLDKIKSLLS

SEQ ID NO: 24330 - protein, 11 aa, Borrelia burgdorferi B31
SLDKIKSLLST

SEQ ID NO: 24331 - protein, 11 aa, Borrelia burgdorferi B31
LDKIKSLLSTA

SEQ ID NO: 24332 - protein, 11 aa, Borrelia burgdorferi B31
DKIKSLLSTAK

SEQ ID NO: 24333 - protein, 11 aa, Borrelia burgdorferi B31
KIKSLLSTAKS

SEQ ID NO: 24334 - protein, 11 aa, Borrelia burgdorferi B31
IKSLLSTAKSY

SEQ ID NO: 24335 - protein, 11 aa, Borrelia burgdorferi B31
KSLLSTAKSYL

SEQ ID NO: 24336 - protein, 11 aa, Borrelia burgdorferi B31
SLLSTAKSYLE

SEQ ID NO: 24337 - protein, 11 aa, Borrelia burgdorferi B31
LLSTAKSYLEQ

SEQ ID NO: 24338 - protein, 11 aa, Borrelia burgdorferi B31
LSTAKSYLEQT

SEQ ID NO: 24339 - protein, 11 aa, Borrelia burgdorferi B31
STAKSYLEQTR

SEQ ID NO: 24340 - protein, 11 aa, Borrelia burgdorferi B31
TAKSYLEQTRR

SEQ ID NO: 24341 - protein, 11 aa, Borrelia burgdorferi B31
AKSYLEQTRRG

SEQ ID NO: 24342 - protein, 11 aa, Borrelia burgdorferi B31
KSYLEQTRRGV

SEQ ID NO: 24343 - protein, 11 aa, Borrelia burgdorferi B31
SYLEQTRRGVG

SEQ ID NO: 24344 - protein, 11 aa, Borrelia burgdorferi B31
YLEQTRRGVGS

SEQ ID NO: 24345 - protein, 11 aa, Borrelia burgdorferi B31
LEQTRRGVGSS

SEQ ID NO: 24346 - protein, 11 aa, Borrelia burgdorferi B31
EQTRRGVGSSK

SEQ ID NO: 24347 - protein, 11 aa, Borrelia burgdorferi B31
QTRRGVGSSKA

SEQ ID NO: 24348 - protein, 11 aa, Borrelia burgdorferi B31
TRRGVGSSKAN

SEQ ID NO: 24349 - protein, 11 aa, Borrelia burgdorferi B31
RRGVGSSKANL

SEQ ID NO: 24350 - protein, 11 aa, Borrelia burgdorferi B31
RGVGSSKANLA

SEQ ID NO: 24351 - protein, 11 aa, Borrelia burgdorferi B31
GVGSSKANLAL

SEQ ID NO: 24352 - protein, 11 aa, Borrelia burgdorferi B31
VGSSKANLALL

SEQ ID NO: 24353 - protein, 11 aa, Borrelia burgdorferi B31
GSSKANLALLP

SEQ ID NO: 24354 - protein, 11 aa, Borrelia burgdorferi B31
SSKANLALLPS

SEQ ID NO: 24355 - protein, 11 aa, Borrelia burgdorferi B31
SKANLALLPSL

SEQ ID NO: 24356 - protein, 11 aa, Borrelia burgdorferi B31
KANLALLPSLE

SEQ ID NO: 24357 - protein, 11 aa, Borrelia burgdorferi B31
ANLALLPSLEE

SEQ ID NO: 24358 - protein, 11 aa, Borrelia burgdorferi B31
NLALLPSLEEA

SEQ ID NO: 24359 - protein, 11 aa, Borrelia burgdorferi B31
LALLPSLEEAI

SEQ ID NO: 24360 - protein, 11 aa, Borrelia burgdorferi B31
ALLPSLEEAIA

SEQ ID NO: 24361 - protein, 11 aa, Borrelia burgdorferi B31
LLPSLEEAIAK

SEQ ID NO: 24362 - protein, 11 aa, Borrelia burgdorferi B31
LPSLEEAIAKV

SEQ ID NO: 24363 - protein, 11 aa, Borrelia burgdorferi B31
PSLEEAIAKVK

SEQ ID NO: 24364 - protein, 11 aa, Borrelia burgdorferi B31
SLEEAIAKVKS

SEQ ID NO: 24365 - protein, 11 aa, Borrelia burgdorferi B31
LEEAIAKVKSN

SEQ ID NO: 24366 - protein, 11 aa, Borrelia burgdorferi B31
EEAIAKVKSNH

SEQ ID NO: 24367 - protein, 11 aa, Borrelia burgdorferi B31
EAIAKVKSNHA

SEQ ID NO: 24368 - protein, 11 aa, Borrelia burgdorferi B31
AIAKVKSNHAS

SEQ ID NO: 24369 - protein, 11 aa, Borrelia burgdorferi B31
IAKVKSNHASA

SEQ ID NO: 24370 - protein, 11 aa, Borrelia burgdorferi B31
AKVKSNHASAD

SEQ ID NO: 24371 - protein, 11 aa, Borrelia burgdorferi B31
KVKSNHASADT

SEQ ID NO: 24372 - protein, 11 aa, Borrelia burgdorferi B31
VKSNHASADTH

SEQ ID NO: 24373 - protein, 11 aa, Borrelia burgdorferi B31
KSNHASADTHC

SEQ ID NO: 24374 - protein, 11 aa, Borrelia burgdorferi B31
SNHASADTHCN

SEQ ID NO: 24375 - protein, 11 aa, Borrelia burgdorferi B31
NHASADTHCND

SEQ ID NO: 24376 - protein, 11 aa, Borrelia burgdorferi B31
HASADTHCNDA

SEQ ID NO: 24377 - protein, 11 aa, Borrelia burgdorferi B31
ASADTHCNDAI

SEQ ID NO: 24378 - protein, 11 aa, Borrelia burgdorferi B31
SADTHCNDAIA

SEQ ID NO: 24379 - protein, 11 aa, Borrelia burgdorferi B31
ADTHCNDAIAA

SEQ ID NO: 24380 - protein, 11 aa, Borrelia burgdorferi B31
DTHCNDAIAAL

SEQ ID NO: 24381 - protein, 11 aa, Borrelia burgdorferi B31
THCNDAIAALK

SEQ ID NO: 24382 - protein, 11 aa, Borrelia burgdorferi B31
HCNDAIAALKR

SEQ ID NO: 24383 - protein, 11 aa, Borrelia burgdorferi B31
CNDAIAALKRA

SEQ ID NO: 24384 - protein, 11 aa, Borrelia burgdorferi B31
NDAIAALKRAK

SEQ ID NO: 24385 - protein, 11 aa, Borrelia burgdorferi B31
DAIAALKRAKN

SEQ ID NO: 24386 - protein, 11 aa, Borrelia burgdorferi B31
AIAALKRAKND

SEQ ID NO: 24387 - protein, 11 aa, Borrelia burgdorferi B31
IAALKRAKNDF

SEQ ID NO: 24388 - protein, 11 aa, Borrelia burgdorferi B31
AALKRAKNDFE

SEQ ID NO: 24389 - protein, 11 aa, Borrelia burgdorferi B31
ALKRAKNDFEY

SEQ ID NO: 24390 - protein, 11 aa, Borrelia burgdorferi B31
LKRAKNDFEYA

SEQ ID NO: 24391 - protein, 11 aa, Borrelia burgdorferi B31
KRAKNDFEYAQ

SEQ ID NO: 24392 - protein, 11 aa, Borrelia burgdorferi B31
RAKNDFEYAQR

SEQ ID NO: 24393 - protein, 11 aa, Borrelia burgdorferi B31
AKNDFEYAQRK

SEQ ID NO: 24394 - protein, 11 aa, Borrelia burgdorferi B31
KNDFEYAQRKA

SEQ ID NO: 24395 - protein, 11 aa, Borrelia burgdorferi B31
NDFEYAQRKAD

SEQ ID NO: 24396 - protein, 11 aa, Borrelia burgdorferi B31
DFEYAQRKADR

SEQ ID NO: 24397 - protein, 11 aa, Borrelia burgdorferi B31
FEYAQRKADRA

SEQ ID NO: 24398 - protein, 11 aa, Borrelia burgdorferi B31
EYAQRKADRAL

SEQ ID NO: 24399 - protein, 11 aa, Borrelia burgdorferi B31
YAQRKADRALE

SEQ ID NO: 24400 - protein, 11 aa, Borrelia burgdorferi B31
AQRKADRALEE

SEQ ID NO: 24401 - protein, 11 aa, Borrelia burgdorferi B31
QRKADRALEEA

SEQ ID NO: 24402 - protein, 11 aa, Borrelia burgdorferi B31
RKADRALEEAL

SEQ ID NO: 24403 - protein, 11 aa, Borrelia burgdorferi B31
KADRALEEALS

SEQ ID NO: 24404 - protein, 11 aa, Borrelia burgdorferi B31
ADRALEEALSN

SEQ ID NO: 24405 - protein, 11 aa, Borrelia burgdorferi B31
DRALEEALSNS

SEQ ID NO: 24406 - protein, 11 aa, Borrelia burgdorferi B31
RALEEALSNSN

SEQ ID NO: 24407 - protein, 11 aa, Borrelia burgdorferi B31
ALEEALSNSNA

SEQ ID NO: 24408 - protein, 11 aa, Borrelia burgdorferi B31
LEEALSNSNAS

SEQ ID NO: 24409 - protein, 11 aa, Borrelia burgdorferi B31
EEALSNSNASR

SEQ ID NO: 24410 - protein, 11 aa, Borrelia burgdorferi B31
EALSNSNASRH

SEQ ID NO: 24411 - protein, 11 aa, Borrelia burgdorferi B31
ALSNSNASRHE

SEQ ID NO: 24412 - protein, 11 aa, Borrelia burgdorferi B31
LSNSNASRHES

SEQ ID NO: 24413 - protein, 11 aa, Borrelia burgdorferi B31
SNSNASRHESY

SEQ ID NO: 24414 - protein, 11 aa, Borrelia burgdorferi B31
NSNASRHESYY

SEQ ID NO: 24415 - protein, 11 aa, Borrelia burgdorferi B31
SNASRHESYYY

SEQ ID NO: 24416 - protein, 11 aa, Borrelia burgdorferi B31
NASRHESYYYA

SEQ ID NO: 24417 - protein, 11 aa, Borrelia burgdorferi B31
ASRHESYYYAG

SEQ ID NO: 24418 - protein, 11 aa, Borrelia burgdorferi B31
SRHESYYYAGY

SEQ ID NO: 24419 - protein, 11 aa, Borrelia burgdorferi B31
RHESYYYAGYH

SEQ ID NO: 24420 - protein, 11 aa, Borrelia burgdorferi B31
HESYYYAGYHQ

SEQ ID NO: 24421 - protein, 11 aa, Borrelia burgdorferi B31
ESYYYAGYHQF

SEQ ID NO: 24422 - protein, 11 aa, Borrelia burgdorferi B31
SYYYAGYHQFM

SEQ ID NO: 24423 - protein, 11 aa, Borrelia burgdorferi B31
YYYAGYHQFMA

SEQ ID NO: 24424 - protein, 11 aa, Borrelia burgdorferi B31
YYAGYHQFMAD

SEQ ID NO: 24425 - protein, 11 aa, Borrelia burgdorferi B31
YAGYHQFMADA

SEQ ID NO: 24426 - protein, 11 aa, Borrelia burgdorferi B31
AGYHQFMADAK

SEQ ID NO: 24427 - protein, 11 aa, Borrelia burgdorferi B31
GYHQFMADAKA

SEQ ID NO: 24428 - protein, 11 aa, Borrelia burgdorferi B31
YHQFMADAKAS

SEQ ID NO: 24429 - protein, 11 aa, Borrelia burgdorferi B31
HQFMADAKASM

SEQ ID NO: 24430 - protein, 11 aa, Borrelia burgdorferi B31
QFMADAKASMS

SEQ ID NO: 24431 - protein, 11 aa, Borrelia burgdorferi B31
FMADAKASMSS

SEQ ID NO: 24432 - protein, 11 aa, Borrelia burgdorferi B31
MADAKASMSST

SEQ ID NO: 24433 - protein, 11 aa, Borrelia burgdorferi B31
ADAKASMSSTK

SEQ ID NO: 24434 - protein, 11 aa, Borrelia burgdorferi B31
DAKASMSSTKS

SEQ ID NO: 24435 - protein, 11 aa, Borrelia burgdorferi B31
AKASMSSTKSL

SEQ ID NO: 24436 - protein, 11 aa, Borrelia burgdorferi B31
KASMSSTKSLL

SEQ ID NO: 24437 - protein, 11 aa, Borrelia burgdorferi B31
ASMSSTKSLLE

SEQ ID NO: 24438 - protein, 11 aa, Borrelia burgdorferi B31
SMSSTKSLLEV

SEQ ID NO: 24439 - protein, 11 aa, Borrelia burgdorferi B31
MSSTKSLLEVA

SEQ ID NO: 24440 - protein, 11 aa, Borrelia burgdorferi B31
SSTKSLLEVAK

SEQ ID NO: 24441 - protein, 11 aa, Borrelia burgdorferi B31
STKSLLEVAKN

SEQ ID NO: 24442 - protein, 11 aa, Borrelia burgdorferi B31
TKSLLEVAKNK

SEQ ID NO: 24443 - protein, 11 aa, Borrelia burgdorferi B31
KSLLEVAKNKQ

SEQ ID NO: 24444 - protein, 11 aa, Borrelia burgdorferi B31
SLLEVAKNKQK

SEQ ID NO: 24445 - protein, 11 aa, Borrelia burgdorferi B31
LLEVAKNKQKE

SEQ ID NO: 24446 - protein, 11 aa, Borrelia burgdorferi B31
LEVAKNKQKEL

SEQ ID NO: 24447 - protein, 11 aa, Borrelia burgdorferi B31
EVAKNKQKELN

SEQ ID NO: 24448 - protein, 11 aa, Borrelia burgdorferi B31
VAKNKQKELNE

SEQ ID NO: 24449 - protein, 11 aa, Borrelia burgdorferi B31
AKNKQKELNEN

SEQ ID NO: 24450 - protein, 11 aa, Borrelia burgdorferi B31
KNKQKELNENM

SEQ ID NO: 24451 - protein, 11 aa, Borrelia burgdorferi B31
NKQKELNENMT

SEQ ID NO: 24452 - protein, 11 aa, Borrelia burgdorferi B31
KQKELNENMTK

SEQ ID NO: 24453 - protein, 11 aa, Borrelia burgdorferi B31
QKELNENMTKT

SEQ ID NO: 24454 - protein, 11 aa, Borrelia burgdorferi B31
KELNENMTKTN

SEQ ID NO: 24455 - protein, 11 aa, Borrelia burgdorferi B31
ELNENMTKTNK

SEQ ID NO: 24456 - protein, 11 aa, Borrelia burgdorferi B31
LNENMTKTNKD

SEQ ID NO: 24457 - protein, 11 aa, Borrelia burgdorferi B31
NENMTKTNKDF

SEQ ID NO: 24458 - protein, 11 aa, Borrelia burgdorferi B31
ENMTKTNKDFQ

SEQ ID NO: 24459 - protein, 11 aa, Borrelia burgdorferi B31
NMTKTNKDFQE

SEQ ID NO: 24460 - protein, 11 aa, Borrelia burgdorferi B31
MTKTNKDFQEL

SEQ ID NO: 24461 - protein, 11 aa, Borrelia burgdorferi B31
TKTNKDFQELN

SEQ ID NO: 24462 - protein, 11 aa, Borrelia burgdorferi B31
KTNKDFQELND

SEQ ID NO: 24463 - protein, 11 aa, Borrelia burgdorferi B31
TNKDFQELNDI

SEQ ID NO: 24464 - protein, 11 aa, Borrelia burgdorferi B31
NKDFQELNDIY

SEQ ID NO: 24465 - protein, 11 aa, Borrelia burgdorferi B31
KDFQELNDIYK

SEQ ID NO: 24466 - protein, 11 aa, Borrelia burgdorferi B31
DFQELNDIYKK

SEQ ID NO: 24467 - protein, 11 aa, Borrelia burgdorferi B31
FQELNDIYKKL

SEQ ID NO: 24468 - protein, 11 aa, Borrelia burgdorferi B31
QELNDIYKKLQ

SEQ ID NO: 24469 - protein, 11 aa, Borrelia burgdorferi B31
ELNDIYKKLQD

SEQ ID NO: 24470 - protein, 11 aa, Borrelia burgdorferi B31
LNDIYKKLQDM

SEQ ID NO: 24471 - protein, 11 aa, Borrelia burgdorferi B31
NDIYKKLQDMD

SEQ ID NO: 24472 - protein, 11 aa, Borrelia burgdorferi B31
DIYKKLQDMDS

SEQ ID NO: 24473 - protein, 11 aa, Borrelia burgdorferi B31
IYKKLQDMDSR

SEQ ID NO: 24474 - protein, 8 aa, Borrelia burgdorferi B31
MIINHNTS

SEQ ID NO: 24475 - protein, 8 aa, Borrelia burgdorferi B31
IINHNTSA

SEQ ID NO: 24476 - protein, 8 aa, Borrelia burgdorferi B31
INHNTSAI

SEQ ID NO: 24477 - protein, 8 aa, Borrelia burgdorferi B31
NHNTSAIN

SEQ ID NO: 24478 - protein, 8 aa, Borrelia burgdorferi B31
HNTSAINA

SEQ ID NO: 24479 - protein, 8 aa, Borrelia burgdorferi B31
NTSAINAS

SEQ ID NO: 24480 - protein, 8 aa, Borrelia burgdorferi B31
TSAINASR

SEQ ID NO: 24481 - protein, 8 aa, Borrelia burgdorferi B31
SAINASRN

SEQ ID NO: 24482 - protein, 8 aa, Borrelia burgdorferi B31
AINASRNN

SEQ ID NO: 24483 - protein, 8 aa, Borrelia burgdorferi B31
INASRNNG

SEQ ID NO: 24484 - protein, 8 aa, Borrelia burgdorferi B31
NASRNNGI

SEQ ID NO: 24485 - protein, 8 aa, Borrelia burgdorferi B31
ASRNNGIN

SEQ ID NO: 24486 - protein, 8 aa, Borrelia burgdorferi B31
SRNNGINA

SEQ ID NO: 24487 - protein, 8 aa, Borrelia burgdorferi B31
RNNGINAA

SEQ ID NO: 24488 - protein, 8 aa, Borrelia burgdorferi B31
NNGINAAN

SEQ ID NO: 24489 - protein, 8 aa, Borrelia burgdorferi B31
NGINAANL

SEQ ID NO: 24490 - protein, 8 aa, Borrelia burgdorferi B31
GINAANLS

SEQ ID NO: 24491 - protein, 8 aa, Borrelia burgdorferi B31
INAANLSK

SEQ ID NO: 24492 - protein, 8 aa, Borrelia burgdorferi B31
NAANLSKT

SEQ ID NO: 24493 - protein, 8 aa, Borrelia burgdorferi B31
AANLSKTQ

SEQ ID NO: 24494 - protein, 8 aa, Borrelia burgdorferi B31
ANLSKTQE

SEQ ID NO: 24495 - protein, 8 aa, Borrelia burgdorferi B31
NLSKTQEK

SEQ ID NO: 24496 - protein, 8 aa, Borrelia burgdorferi B31
LSKTQEKL

SEQ ID NO: 24497 - protein, 8 aa, Borrelia burgdorferi B31
SKTQEKLS

SEQ ID NO: 24498 - protein, 8 aa, Borrelia burgdorferi B31
KTQEKLSS

SEQ ID NO: 24499 - protein, 8 aa, Borrelia burgdorferi B31
TQEKLSSG

SEQ ID NO: 24500 - protein, 8 aa, Borrelia burgdorferi B31
QEKLSSGY

SEQ ID NO: 24501 - protein, 8 aa, Borrelia burgdorferi B31
EKLSSGYR

SEQ ID NO: 24502 - protein, 8 aa, Borrelia burgdorferi B31
KLSSGYRI

SEQ ID NO: 24503 - protein, 8 aa, Borrelia burgdorferi B31
LSSGYRIN

SEQ ID NO: 24504 - protein, 8 aa, Borrelia burgdorferi B31
SSGYRINR

SEQ ID NO: 24505 - protein, 8 aa, Borrelia burgdorferi B31
SGYRINRA

SEQ ID NO: 24506 - protein, 8 aa, Borrelia burgdorferi B31
GYRINRAS

SEQ ID NO: 24507 - protein, 8 aa, Borrelia burgdorferi B31
YRINRASD

SEQ ID NO: 24508 - protein, 8 aa, Borrelia burgdorferi B31
RINRASDD

SEQ ID NO: 24509 - protein, 8 aa, Borrelia burgdorferi B31
INRASDDA

SEQ ID NO: 24510 - protein, 8 aa, Borrelia burgdorferi B31
NRASDDAA

SEQ ID NO: 24511 - protein, 8 aa, Borrelia burgdorferi B31
RASDDAAG

SEQ ID NO: 24512 - protein, 8 aa, Borrelia burgdorferi B31
ASDDAAGM

SEQ ID NO: 24513 - protein, 8 aa, Borrelia burgdorferi B31
SDDAAGMG

SEQ ID NO: 24514 - protein, 8 aa, Borrelia burgdorferi B31
DDAAGMGV

SEQ ID NO: 24515 - protein, 8 aa, Borrelia burgdorferi B31
DAAGMGVS

SEQ ID NO: 24516 - protein, 8 aa, Borrelia burgdorferi B31
AAGMGVSG

SEQ ID NO: 24517 - protein, 8 aa, Borrelia burgdorferi B31
AGMGVSGK

SEQ ID NO: 24518 - protein, 8 aa, Borrelia burgdorferi B31
GMGVSGKI

SEQ ID NO: 24519 - protein, 8 aa, Borrelia burgdorferi B31
MGVSGKIN

SEQ ID NO: 24520 - protein, 8 aa, Borrelia burgdorferi B31
GVSGKINA

SEQ ID NO: 24521 - protein, 8 aa, Borrelia burgdorferi B31
VSGKINAQ

SEQ ID NO: 24522 - protein, 8 aa, Borrelia burgdorferi B31
SGKINAQI

SEQ ID NO: 24523 - protein, 8 aa, Borrelia burgdorferi B31
GKINAQIR

SEQ ID NO: 24524 - protein, 8 aa, Borrelia burgdorferi B31
KINAQIRG

SEQ ID NO: 24525 - protein, 8 aa, Borrelia burgdorferi B31
INAQIRGL

SEQ ID NO: 24526 - protein, 8 aa, Borrelia burgdorferi B31
NAQIRGLS

SEQ ID NO: 24527 - protein, 8 aa, Borrelia burgdorferi B31
AQIRGLSQ

SEQ ID NO: 24528 - protein, 8 aa, Borrelia burgdorferi B31
QIRGLSQA

SEQ ID NO: 24529 - protein, 8 aa, Borrelia burgdorferi B31
IRGLSQAS

SEQ ID NO: 24530 - protein, 8 aa, Borrelia burgdorferi B31
RGLSQASR

SEQ ID NO: 24531 - protein, 8 aa, Borrelia burgdorferi B31
GLSQASRN

SEQ ID NO: 24532 - protein, 8 aa, Borrelia burgdorferi B31
LSQASRNT

SEQ ID NO: 24533 - protein, 8 aa, Borrelia burgdorferi B31
SQASRNTS

SEQ ID NO: 24534 - protein, 8 aa, Borrelia burgdorferi B31
QASRNTSK

SEQ ID NO: 24535 - protein, 8 aa, Borrelia burgdorferi B31
ASRNTSKA

SEQ ID NO: 24536 - protein, 8 aa, Borrelia burgdorferi B31
SRNTSKAI

SEQ ID NO: 24537 - protein, 8 aa, Borrelia burgdorferi B31
RNTSKAIN

SEQ ID NO: 24538 - protein, 8 aa, Borrelia burgdorferi B31
NTSKAINF

SEQ ID NO: 24539 - protein, 8 aa, Borrelia burgdorferi B31
TSKAINFI

SEQ ID NO: 24540 - protein, 8 aa, Borrelia burgdorferi B31
SKAINFIQ

SEQ ID NO: 24541 - protein, 8 aa, Borrelia burgdorferi B31
KAINFIQT

SEQ ID NO: 24542 - protein, 8 aa, Borrelia burgdorferi B31
AINFIQTT

SEQ ID NO: 24543 - protein, 8 aa, Borrelia burgdorferi B31
INFIQTTE

SEQ ID NO: 24544 - protein, 8 aa, Borrelia burgdorferi B31
NFIQTTEG

SEQ ID NO: 24545 - protein, 8 aa, Borrelia burgdorferi B31
FIQTTEGN

SEQ ID NO: 24546 - protein, 8 aa, Borrelia burgdorferi B31
IQTTEGNL

SEQ ID NO: 24547 - protein, 8 aa, Borrelia burgdorferi B31
QTTEGNLN

SEQ ID NO: 24548 - protein, 8 aa, Borrelia burgdorferi B31
TTEGNLNE

SEQ ID NO: 24549 - protein, 8 aa, Borrelia burgdorferi B31
TEGNLNEV

SEQ ID NO: 24550 - protein, 8 aa, Borrelia burgdorferi B31
EGNLNEVE

SEQ ID NO: 24551 - protein, 8 aa, Borrelia burgdorferi B31
GNLNEVEK

SEQ ID NO: 24552 - protein, 8 aa, Borrelia burgdorferi B31
NLNEVEKV

SEQ ID NO: 24553 - protein, 8 aa, Borrelia burgdorferi B31
LNEVEKVL

SEQ ID NO: 24554 - protein, 8 aa, Borrelia burgdorferi B31
NEVEKVLV

SEQ ID NO: 24555 - protein, 8 aa, Borrelia burgdorferi B31
EVEKVLVR

SEQ ID NO: 24556 - protein, 8 aa, Borrelia burgdorferi B31
VEKVLVRM

SEQ ID NO: 24557 - protein, 8 aa, Borrelia burgdorferi B31
EKVLVRMK

SEQ ID NO: 24558 - protein, 8 aa, Borrelia burgdorferi B31
KVLVRMKE

SEQ ID NO: 24559 - protein, 8 aa, Borrelia burgdorferi B31
VLVRMKEL

SEQ ID NO: 24560 - protein, 8 aa, Borrelia burgdorferi B31
LVRMKELA

SEQ ID NO: 24561 - protein, 8 aa, Borrelia burgdorferi B31
VRMKELAV

SEQ ID NO: 24562 - protein, 8 aa, Borrelia burgdorferi B31
RMKELAVQ

SEQ ID NO: 24563 - protein, 8 aa, Borrelia burgdorferi B31
MKELAVQS

SEQ ID NO: 24564 - protein, 8 aa, Borrelia burgdorferi B31
KELAVQSG

SEQ ID NO: 24565 - protein, 8 aa, Borrelia burgdorferi B31
ELAVQSGN

SEQ ID NO: 24566 - protein, 8 aa, Borrelia burgdorferi B31
LAVQSGNG

SEQ ID NO: 24567 - protein, 8 aa, Borrelia burgdorferi B31
AVQSGNGT

SEQ ID NO: 24568 - protein, 8 aa, Borrelia burgdorferi B31
VQSGNGTY

SEQ ID NO: 24569 - protein, 8 aa, Borrelia burgdorferi B31
QSGNGTYS

SEQ ID NO: 24570 - protein, 8 aa, Borrelia burgdorferi B31
SGNGTYSD

SEQ ID NO: 24571 - protein, 8 aa, Borrelia burgdorferi B31
GNGTYSDA

SEQ ID NO: 24572 - protein, 8 aa, Borrelia burgdorferi B31
NGTYSDAD

SEQ ID NO: 24573 - protein, 8 aa, Borrelia burgdorferi B31
GTYSDADR

SEQ ID NO: 24574 - protein, 8 aa, Borrelia burgdorferi B31
TYSDADRG

SEQ ID NO: 24575 - protein, 8 aa, Borrelia burgdorferi B31
YSDADRGS

SEQ ID NO: 24576 - protein, 8 aa, Borrelia burgdorferi B31
SDADRGSI

SEQ ID NO: 24577 - protein, 8 aa, Borrelia burgdorferi B31
DADRGSIQ

SEQ ID NO: 24578 - protein, 8 aa, Borrelia burgdorferi B31
ADRGSIQI

SEQ ID NO: 24579 - protein, 8 aa, Borrelia burgdorferi B31
DRGSIQIE

SEQ ID NO: 24580 - protein, 8 aa, Borrelia burgdorferi B31
RGSIQIEI

SEQ ID NO: 24581 - protein, 8 aa, Borrelia burgdorferi B31
GSIQIEIE

SEQ ID NO: 24582 - protein, 8 aa, Borrelia burgdorferi B31
SIQIEIEQ

SEQ ID NO: 24583 - protein, 8 aa, Borrelia burgdorferi B31
IQIEIEQL

SEQ ID NO: 24584 - protein, 8 aa, Borrelia burgdorferi B31
QIEIEQLT

SEQ ID NO: 24585 - protein, 8 aa, Borrelia burgdorferi B31
IEIEQLTD

SEQ ID NO: 24586 - protein, 8 aa, Borrelia burgdorferi B31
EIEQLTDE

SEQ ID NO: 24587 - protein, 8 aa, Borrelia burgdorferi B31
IEQLTDEI

SEQ ID NO: 24588 - protein, 8 aa, Borrelia burgdorferi B31
EQLTDEIN

SEQ ID NO: 24589 - protein, 8 aa, Borrelia burgdorferi B31
QLTDEINR

SEQ ID NO: 24590 - protein, 8 aa, Borrelia burgdorferi B31
LTDEINRI

SEQ ID NO: 24591 - protein, 8 aa, Borrelia burgdorferi B31
TDEINRIA

SEQ ID NO: 24592 - protein, 8 aa, Borrelia burgdorferi B31
DEINRIAD

SEQ ID NO: 24593 - protein, 8 aa, Borrelia burgdorferi B31
EINRIADQ

SEQ ID NO: 24594 - protein, 8 aa, Borrelia burgdorferi B31
INRIADQA

SEQ ID NO: 24595 - protein, 8 aa, Borrelia burgdorferi B31
NRIADQAQ

SEQ ID NO: 24596 - protein, 8 aa, Borrelia burgdorferi B31
RIADQAQY

SEQ ID NO: 24597 - protein, 8 aa, Borrelia burgdorferi B31
IADQAQYN

SEQ ID NO: 24598 - protein, 8 aa, Borrelia burgdorferi B31
ADQAQYNQ

SEQ ID NO: 24599 - protein, 8 aa, Borrelia burgdorferi B31
DQAQYNQM

SEQ ID NO: 24600 - protein, 8 aa, Borrelia burgdorferi B31
QAQYNQMH

SEQ ID NO: 24601 - protein, 8 aa, Borrelia burgdorferi B31
AQYNQMHM

SEQ ID NO: 24602 - protein, 8 aa, Borrelia burgdorferi B31
QYNQMHML

SEQ ID NO: 24603 - protein, 8 aa, Borrelia burgdorferi B31
YNQMHMLS

SEQ ID NO: 24604 - protein, 8 aa, Borrelia burgdorferi B31
NQMHMLSN

SEQ ID NO: 24605 - protein, 8 aa, Borrelia burgdorferi B31
QMHMLSNK

SEQ ID NO: 24606 - protein, 8 aa, Borrelia burgdorferi B31
MHMLSNKS

SEQ ID NO: 24607 - protein, 8 aa, Borrelia burgdorferi B31
HMLSNKSA

SEQ ID NO: 24608 - protein, 8 aa, Borrelia burgdorferi B31
MLSNKSAS

SEQ ID NO: 24609 - protein, 8 aa, Borrelia burgdorferi B31
LSNKSASQ

SEQ ID NO: 24610 - protein, 8 aa, Borrelia burgdorferi B31
SNKSASQN

SEQ ID NO: 24611 - protein, 8 aa, Borrelia burgdorferi B31
NKSASQNV

SEQ ID NO: 24612 - protein, 8 aa, Borrelia burgdorferi B31
KSASQNVR

SEQ ID NO: 24613 - protein, 8 aa, Borrelia burgdorferi B31
SASQNVRT

SEQ ID NO: 24614 - protein, 8 aa, Borrelia burgdorferi B31
ASQNVRTA

SEQ ID NO: 24615 - protein, 8 aa, Borrelia burgdorferi B31
SQNVRTAE

SEQ ID NO: 24616 - protein, 8 aa, Borrelia burgdorferi B31
QNVRTAEE

SEQ ID NO: 24617 - protein, 8 aa, Borrelia burgdorferi B31
NVRTAEEL

SEQ ID NO: 24618 - protein, 8 aa, Borrelia burgdorferi B31
VRTAEELG

SEQ ID NO: 24619 - protein, 8 aa, Borrelia burgdorferi B31
RTAEELGM

SEQ ID NO: 24620 - protein, 8 aa, Borrelia burgdorferi B31
TAEELGMQ

SEQ ID NO: 24621 - protein, 8 aa, Borrelia burgdorferi B31
AEELGMQP

SEQ ID NO: 24622 - protein, 8 aa, Borrelia burgdorferi B31
EELGMQPA

SEQ ID NO: 24623 - protein, 8 aa, Borrelia burgdorferi B31
ELGMQPAK

SEQ ID NO: 24624 - protein, 8 aa, Borrelia burgdorferi B31
LGMQPAKI

SEQ ID NO: 24625 - protein, 8 aa, Borrelia burgdorferi B31
GMQPAKIN

SEQ ID NO: 24626 - protein, 8 aa, Borrelia burgdorferi B31
MQPAKINT

SEQ ID NO: 24627 - protein, 8 aa, Borrelia burgdorferi B31
QPAKINTP

SEQ ID NO: 24628 - protein, 8 aa, Borrelia burgdorferi B31
PAKINTPA

SEQ ID NO: 24629 - protein, 8 aa, Borrelia burgdorferi B31
AKINTPAS

SEQ ID NO: 24630 - protein, 8 aa, Borrelia burgdorferi B31
KINTPASL

SEQ ID NO: 24631 - protein, 8 aa, Borrelia burgdorferi B31
INTPASLS

SEQ ID NO: 24632 - protein, 8 aa, Borrelia burgdorferi B31
NTPASLSG

SEQ ID NO: 24633 - protein, 8 aa, Borrelia burgdorferi B31
TPASLSGS

SEQ ID NO: 24634 - protein, 8 aa, Borrelia burgdorferi B31
PASLSGSQ

SEQ ID NO: 24635 - protein, 8 aa, Borrelia burgdorferi B31
ASLSGSQA

SEQ ID NO: 24636 - protein, 8 aa, Borrelia burgdorferi B31
SLSGSQAS

SEQ ID NO: 24637 - protein, 8 aa, Borrelia burgdorferi B31
LSGSQASW

SEQ ID NO: 24638 - protein, 8 aa, Borrelia burgdorferi B31
SGSQASWT

SEQ ID NO: 24639 - protein, 8 aa, Borrelia burgdorferi B31
GSQASWTL

SEQ ID NO: 24640 - protein, 8 aa, Borrelia burgdorferi B31
SQASWTLR

SEQ ID NO: 24641 - protein, 8 aa, Borrelia burgdorferi B31
QASWTLRV

SEQ ID NO: 24642 - protein, 8 aa, Borrelia burgdorferi B31
ASWTLRVH

SEQ ID NO: 24643 - protein, 8 aa, Borrelia burgdorferi B31
SWTLRVHV

SEQ ID NO: 24644 - protein, 8 aa, Borrelia burgdorferi B31
WTLRVHVG

SEQ ID NO: 24645 - protein, 8 aa, Borrelia burgdorferi B31
TLRVHVGA

SEQ ID NO: 24646 - protein, 8 aa, Borrelia burgdorferi B31
LRVHVGAN

SEQ ID NO: 24647 - protein, 8 aa, Borrelia burgdorferi B31
RVHVGANQ

SEQ ID NO: 24648 - protein, 8 aa, Borrelia burgdorferi B31
VHVGANQD

SEQ ID NO: 24649 - protein, 8 aa, Borrelia burgdorferi B31
HVGANQDE

SEQ ID NO: 24650 - protein, 8 aa, Borrelia burgdorferi B31
VGANQDEA

SEQ ID NO: 24651 - protein, 8 aa, Borrelia burgdorferi B31
GANQDEAI

SEQ ID NO: 24652 - protein, 8 aa, Borrelia burgdorferi B31
ANQDEAIA

SEQ ID NO: 24653 - protein, 8 aa, Borrelia burgdorferi B31
NQDEAIAV

SEQ ID NO: 24654 - protein, 8 aa, Borrelia burgdorferi B31
QDEAIAVN

SEQ ID NO: 24655 - protein, 8 aa, Borrelia burgdorferi B31
DEAIAVNI

SEQ ID NO: 24656 - protein, 8 aa, Borrelia burgdorferi B31
EAIAVNIY

SEQ ID NO: 24657 - protein, 8 aa, Borrelia burgdorferi B31
AIAVNIYA

SEQ ID NO: 24658 - protein, 8 aa, Borrelia burgdorferi B31
IAVNIYAA

SEQ ID NO: 24659 - protein, 8 aa, Borrelia burgdorferi B31
AVNIYAAN

SEQ ID NO: 24660 - protein, 8 aa, Borrelia burgdorferi B31
VNIYAANV

SEQ ID NO: 24661 - protein, 8 aa, Borrelia burgdorferi B31
NIYAANVA

SEQ ID NO: 24662 - protein, 8 aa, Borrelia burgdorferi B31
IYAANVAN

SEQ ID NO: 24663 - protein, 8 aa, Borrelia burgdorferi B31
YAANVANL

SEQ ID NO: 24664 - protein, 8 aa, Borrelia burgdorferi B31
AANVANLF

SEQ ID NO: 24665 - protein, 8 aa, Borrelia burgdorferi B31
ANVANLFS

SEQ ID NO: 24666 - protein, 8 aa, Borrelia burgdorferi B31
NVANLFSG

SEQ ID NO: 24667 - protein, 8 aa, Borrelia burgdorferi B31
VANLFSGE

SEQ ID NO: 24668 - protein, 8 aa, Borrelia burgdorferi B31
ANLFSGEG

SEQ ID NO: 24669 - protein, 8 aa, Borrelia burgdorferi B31
NLFSGEGA

SEQ ID NO: 24670 - protein, 8 aa, Borrelia burgdorferi B31
LFSGEGAQ

SEQ ID NO: 24671 - protein, 8 aa, Borrelia burgdorferi B31
FSGEGAQT

SEQ ID NO: 24672 - protein, 8 aa, Borrelia burgdorferi B31
SGEGAQTA

SEQ ID NO: 24673 - protein, 8 aa, Borrelia burgdorferi B31
GEGAQTAQ

SEQ ID NO: 24674 - protein, 8 aa, Borrelia burgdorferi B31
EGAQTAQA

SEQ ID NO: 24675 - protein, 8 aa, Borrelia burgdorferi B31
GAQTAQAA

SEQ ID NO: 24676 - protein, 8 aa, Borrelia burgdorferi B31
AQTAQAAP

SEQ ID NO: 24677 - protein, 8 aa, Borrelia burgdorferi B31
QTAQAAPV

SEQ ID NO: 24678 - protein, 8 aa, Borrelia burgdorferi B31
TAQAAPVQ

SEQ ID NO: 24679 - protein, 8 aa, Borrelia burgdorferi B31
AQAAPVQE

SEQ ID NO: 24680 - protein, 8 aa, Borrelia burgdorferi B31
QAAPVQEG

SEQ ID NO: 24681 - protein, 8 aa, Borrelia burgdorferi B31
AAPVQEGV

SEQ ID NO: 24682 - protein, 8 aa, Borrelia burgdorferi B31
APVQEGVQ

SEQ ID NO: 24683 - protein, 8 aa, Borrelia burgdorferi B31
PVQEGVQQ

SEQ ID NO: 24684 - protein, 8 aa, Borrelia burgdorferi B31
VQEGVQQE

SEQ ID NO: 24685 - protein, 8 aa, Borrelia burgdorferi B31
QEGVQQEG

SEQ ID NO: 24686 - protein, 8 aa, Borrelia burgdorferi B31
EGVQQEGA

SEQ ID NO: 24687 - protein, 8 aa, Borrelia burgdorferi B31
GVQQEGAQ

SEQ ID NO: 24688 - protein, 8 aa, Borrelia burgdorferi B31
VQQEGAQQ

SEQ ID NO: 24689 - protein, 8 aa, Borrelia burgdorferi B31
QQEGAQQP

SEQ ID NO: 24690 - protein, 8 aa, Borrelia burgdorferi B31
QEGAQQPA

SEQ ID NO: 24691 - protein, 8 aa, Borrelia burgdorferi B31
EGAQQPAP

SEQ ID NO: 24692 - protein, 8 aa, Borrelia burgdorferi B31
GAQQPAPA

SEQ ID NO: 24693 - protein, 8 aa, Borrelia burgdorferi B31
AQQPAPAT

SEQ ID NO: 24694 - protein, 8 aa, Borrelia burgdorferi B31
QQPAPATA

SEQ ID NO: 24695 - protein, 8 aa, Borrelia burgdorferi B31
QPAPATAP

SEQ ID NO: 24696 - protein, 8 aa, Borrelia burgdorferi B31
PAPATAPS

SEQ ID NO: 24697 - protein, 8 aa, Borrelia burgdorferi B31
APATAPSQ

SEQ ID NO: 24698 - protein, 8 aa, Borrelia burgdorferi B31
PATAPSQG

SEQ ID NO: 24699 - protein, 8 aa, Borrelia burgdorferi B31
ATAPSQGG

SEQ ID NO: 24700 - protein, 8 aa, Borrelia burgdorferi B31
TAPSQGGV

SEQ ID NO: 24701 - protein, 8 aa, Borrelia burgdorferi B31
APSQGGVN

SEQ ID NO: 24702 - protein, 8 aa, Borrelia burgdorferi B31
PSQGGVNS

SEQ ID NO: 24703 - protein, 8 aa, Borrelia burgdorferi B31
SQGGVNSP

SEQ ID NO: 24704 - protein, 8 aa, Borrelia burgdorferi B31
QGGVNSPV

SEQ ID NO: 24705 - protein, 8 aa, Borrelia burgdorferi B31
GGVNSPVN

SEQ ID NO: 24706 - protein, 8 aa, Borrelia burgdorferi B31
GVNSPVNV

SEQ ID NO: 24707 - protein, 8 aa, Borrelia burgdorferi B31
VNSPVNVT

SEQ ID NO: 24708 - protein, 8 aa, Borrelia burgdorferi B31
NSPVNVTT

SEQ ID NO: 24709 - protein, 8 aa, Borrelia burgdorferi B31
SPVNVTTT

SEQ ID NO: 24710 - protein, 8 aa, Borrelia burgdorferi B31
PVNVTTTV

SEQ ID NO: 24711 - protein, 8 aa, Borrelia burgdorferi B31
VNVTTTVD

SEQ ID NO: 24712 - protein, 8 aa, Borrelia burgdorferi B31
NVTTTVDA

SEQ ID NO: 24713 - protein, 8 aa, Borrelia burgdorferi B31
VTTTVDAN

SEQ ID NO: 24714 - protein, 8 aa, Borrelia burgdorferi B31
TTTVDANT

SEQ ID NO: 24715 - protein, 8 aa, Borrelia burgdorferi B31
TTVDANTS

SEQ ID NO: 24716 - protein, 8 aa, Borrelia burgdorferi B31
TVDANTSL

SEQ ID NO: 24717 - protein, 8 aa, Borrelia burgdorferi B31
VDANTSLA

SEQ ID NO: 24718 - protein, 8 aa, Borrelia burgdorferi B31
DANTSLAK

SEQ ID NO: 24719 - protein, 8 aa, Borrelia burgdorferi B31
ANTSLAKI

SEQ ID NO: 24720 - protein, 8 aa, Borrelia burgdorferi B31
NTSLAKIE

SEQ ID NO: 24721 - protein, 8 aa, Borrelia burgdorferi B31
TSLAKIEN

SEQ ID NO: 24722 - protein, 8 aa, Borrelia burgdorferi B31
SLAKIENA

SEQ ID NO: 24723 - protein, 8 aa, Borrelia burgdorferi B31
LAKIENAI

SEQ ID NO: 24724 - protein, 8 aa, Borrelia burgdorferi B31
AKIENAIR

SEQ ID NO: 24725 - protein, 8 aa, Borrelia burgdorferi B31
KIENAIRM

SEQ ID NO: 24726 - protein, 8 aa, Borrelia burgdorferi B31
IENAIRMI

SEQ ID NO: 24727 - protein, 8 aa, Borrelia burgdorferi B31
ENAIRMIS

SEQ ID NO: 24728 - protein, 8 aa, Borrelia burgdorferi B31
NAIRMISD

SEQ ID NO: 24729 - protein, 8 aa, Borrelia burgdorferi B31
AIRMISDQ

SEQ ID NO: 24730 - protein, 8 aa, Borrelia burgdorferi B31
IRMISDQR

SEQ ID NO: 24731 - protein, 8 aa, Borrelia burgdorferi B31
RMISDQRA

SEQ ID NO: 24732 - protein, 8 aa, Borrelia burgdorferi B31
MISDQRAN

SEQ ID NO: 24733 - protein, 8 aa, Borrelia burgdorferi B31
ISDQRANL

SEQ ID NO: 24734 - protein, 8 aa, Borrelia burgdorferi B31
SDQRANLG

SEQ ID NO: 24735 - protein, 8 aa, Borrelia burgdorferi B31
DQRANLGA

SEQ ID NO: 24736 - protein, 8 aa, Borrelia burgdorferi B31
QRANLGAF

SEQ ID NO: 24737 - protein, 8 aa, Borrelia burgdorferi B31
RANLGAFQ

SEQ ID NO: 24738 - protein, 8 aa, Borrelia burgdorferi B31
ANLGAFQN

SEQ ID NO: 24739 - protein, 8 aa, Borrelia burgdorferi B31
NLGAFQNR

SEQ ID NO: 24740 - protein, 8 aa, Borrelia burgdorferi B31
LGAFQNRL

SEQ ID NO: 24741 - protein, 8 aa, Borrelia burgdorferi B31
GAFQNRLE

SEQ ID NO: 24742 - protein, 8 aa, Borrelia burgdorferi B31
AFQNRLES

SEQ ID NO: 24743 - protein, 8 aa, Borrelia burgdorferi B31
FQNRLESI

SEQ ID NO: 24744 - protein, 8 aa, Borrelia burgdorferi B31
QNRLESIK

SEQ ID NO: 24745 - protein, 8 aa, Borrelia burgdorferi B31
NRLESIKN

SEQ ID NO: 24746 - protein, 8 aa, Borrelia burgdorferi B31
RLESIKNS

SEQ ID NO: 24747 - protein, 8 aa, Borrelia burgdorferi B31
LESIKNST

SEQ ID NO: 24748 - protein, 8 aa, Borrelia burgdorferi B31
ESIKNSTE

SEQ ID NO: 24749 - protein, 8 aa, Borrelia burgdorferi B31
SIKNSTEY

SEQ ID NO: 24750 - protein, 8 aa, Borrelia burgdorferi B31
IKNSTEYA

SEQ ID NO: 24751 - protein, 8 aa, Borrelia burgdorferi B31
KNSTEYAI

SEQ ID NO: 24752 - protein, 8 aa, Borrelia burgdorferi B31
NSTEYAIE

SEQ ID NO: 24753 - protein, 8 aa, Borrelia burgdorferi B31
STEYAIEN

SEQ ID NO: 24754 - protein, 8 aa, Borrelia burgdorferi B31
TEYAIENL

SEQ ID NO: 24755 - protein, 8 aa, Borrelia burgdorferi B31
EYAIENLK

SEQ ID NO: 24756 - protein, 8 aa, Borrelia burgdorferi B31
YAIENLKA

SEQ ID NO: 24757 - protein, 8 aa, Borrelia burgdorferi B31
AIENLKAS

SEQ ID NO: 24758 - protein, 8 aa, Borrelia burgdorferi B31
IENLKASY

SEQ ID NO: 24759 - protein, 8 aa, Borrelia burgdorferi B31
ENLKASYA

SEQ ID NO: 24760 - protein, 8 aa, Borrelia burgdorferi B31
NLKASYAQ

SEQ ID NO: 24761 - protein, 8 aa, Borrelia burgdorferi B31
LKASYAQI

SEQ ID NO: 24762 - protein, 8 aa, Borrelia burgdorferi B31
KASYAQIK

SEQ ID NO: 24763 - protein, 8 aa, Borrelia burgdorferi B31
ASYAQIKD

SEQ ID NO: 24764 - protein, 8 aa, Borrelia burgdorferi B31
SYAQIKDA

SEQ ID NO: 24765 - protein, 8 aa, Borrelia burgdorferi B31
YAQIKDAT

SEQ ID NO: 24766 - protein, 8 aa, Borrelia burgdorferi B31
AQIKDATM

SEQ ID NO: 24767 - protein, 8 aa, Borrelia burgdorferi B31
QIKDATMT

SEQ ID NO: 24768 - protein, 8 aa, Borrelia burgdorferi B31
IKDATMTD

SEQ ID NO: 24769 - protein, 8 aa, Borrelia burgdorferi B31
KDATMTDE

SEQ ID NO: 24770 - protein, 8 aa, Borrelia burgdorferi B31
DATMTDEV

SEQ ID NO: 24771 - protein, 8 aa, Borrelia burgdorferi B31
ATMTDEVV

SEQ ID NO: 24772 - protein, 8 aa, Borrelia burgdorferi B31
TMTDEVVA

SEQ ID NO: 24773 - protein, 8 aa, Borrelia burgdorferi B31
MTDEVVAA

SEQ ID NO: 24774 - protein, 8 aa, Borrelia burgdorferi B31
TDEVVAAT

SEQ ID NO: 24775 - protein, 8 aa, Borrelia burgdorferi B31
DEVVAATT

SEQ ID NO: 24776 - protein, 8 aa, Borrelia burgdorferi B31
EVVAATTN

SEQ ID NO: 24777 - protein, 8 aa, Borrelia burgdorferi B31
VVAATTNS

SEQ ID NO: 24778 - protein, 8 aa, Borrelia burgdorferi B31
VAATTNSI

SEQ ID NO: 24779 - protein, 8 aa, Borrelia burgdorferi B31
AATTNSIL

SEQ ID NO: 24780 - protein, 8 aa, Borrelia burgdorferi B31
ATTNSILT

SEQ ID NO: 24781 - protein, 8 aa, Borrelia burgdorferi B31
TTNSILTQ

SEQ ID NO: 24782 - protein, 8 aa, Borrelia burgdorferi B31
TNSILTQS

SEQ ID NO: 24783 - protein, 8 aa, Borrelia burgdorferi B31
NSILTQSA

SEQ ID NO: 24784 - protein, 8 aa, Borrelia burgdorferi B31
SILTQSAM

SEQ ID NO: 24785 - protein, 8 aa, Borrelia burgdorferi B31
ILTQSAMA

SEQ ID NO: 24786 - protein, 8 aa, Borrelia burgdorferi B31
LTQSAMAM

SEQ ID NO: 24787 - protein, 8 aa, Borrelia burgdorferi B31
TQSAMAMI

SEQ ID NO: 24788 - protein, 8 aa, Borrelia burgdorferi B31
QSAMAMIA

SEQ ID NO: 24789 - protein, 8 aa, Borrelia burgdorferi B31
SAMAMIAQ

SEQ ID NO: 24790 - protein, 8 aa, Borrelia burgdorferi B31
AMAMIAQA

SEQ ID NO: 24791 - protein, 8 aa, Borrelia burgdorferi B31
MAMIAQAN

SEQ ID NO: 24792 - protein, 8 aa, Borrelia burgdorferi B31
AMIAQANQ

SEQ ID NO: 24793 - protein, 8 aa, Borrelia burgdorferi B31
MIAQANQV

SEQ ID NO: 24794 - protein, 8 aa, Borrelia burgdorferi B31
IAQANQVP

SEQ ID NO: 24795 - protein, 8 aa, Borrelia burgdorferi B31
AQANQVPQ

SEQ ID NO: 24796 - protein, 8 aa, Borrelia burgdorferi B31
QANQVPQY

SEQ ID NO: 24797 - protein, 8 aa, Borrelia burgdorferi B31
ANQVPQYV

SEQ ID NO: 24798 - protein, 8 aa, Borrelia burgdorferi B31
NQVPQYVL

SEQ ID NO: 24799 - protein, 8 aa, Borrelia burgdorferi B31
QVPQYVLS

SEQ ID NO: 24800 - protein, 8 aa, Borrelia burgdorferi B31
VPQYVLSL

SEQ ID NO: 24801 - protein, 8 aa, Borrelia burgdorferi B31
PQYVLSLL

SEQ ID NO: 24802 - protein, 8 aa, Borrelia burgdorferi B31
QYVLSLLR

SEQ ID NO: 24803 - protein, 9 aa, Borrelia burgdorferi B31
MIINHNTSA

SEQ ID NO: 24804 - protein, 9 aa, Borrelia burgdorferi B31
IINHNTSAI

SEQ ID NO: 24805 - protein, 9 aa, Borrelia burgdorferi B31
INHNTSAIN

SEQ ID NO: 24806 - protein, 9 aa, Borrelia burgdorferi B31
NHNTSAINA

SEQ ID NO: 24807 - protein, 9 aa, Borrelia burgdorferi B31
HNTSAINAS

SEQ ID NO: 24808 - protein, 9 aa, Borrelia burgdorferi B31
NTSAINASR

SEQ ID NO: 24809 - protein, 9 aa, Borrelia burgdorferi B31
TSAINASRN

SEQ ID NO: 24810 - protein, 9 aa, Borrelia burgdorferi B31
SAINASRNN

SEQ ID NO: 24811 - protein, 9 aa, Borrelia burgdorferi B31
AINASRNNG

SEQ ID NO: 24812 - protein, 9 aa, Borrelia burgdorferi B31
INASRNNGI

SEQ ID NO: 24813 - protein, 9 aa, Borrelia burgdorferi B31
NASRNNGIN

SEQ ID NO: 24814 - protein, 9 aa, Borrelia burgdorferi B31
ASRNNGINA

SEQ ID NO: 24815 - protein, 9 aa, Borrelia burgdorferi B31
SRNNGINAA

SEQ ID NO: 24816 - protein, 9 aa, Borrelia burgdorferi B31
RNNGINAAN

SEQ ID NO: 24817 - protein, 9 aa, Borrelia burgdorferi B31
NNGINAANL

SEQ ID NO: 24818 - protein, 9 aa, Borrelia burgdorferi B31
NGINAANLS

SEQ ID NO: 24819 - protein, 9 aa, Borrelia burgdorferi B31
GINAANLSK

SEQ ID NO: 24820 - protein, 9 aa, Borrelia burgdorferi B31
INAANLSKT

SEQ ID NO: 24821 - protein, 9 aa, Borrelia burgdorferi B31
NAANLSKTQ

SEQ ID NO: 24822 - protein, 9 aa, Borrelia burgdorferi B31
AANLSKTQE

SEQ ID NO: 24823 - protein, 9 aa, Borrelia burgdorferi B31
ANLSKTQEK

SEQ ID NO: 24824 - protein, 9 aa, Borrelia burgdorferi B31
NLSKTQEKL

SEQ ID NO: 24825 - protein, 9 aa, Borrelia burgdorferi B31
LSKTQEKLS

SEQ ID NO: 24826 - protein, 9 aa, Borrelia burgdorferi B31
SKTQEKLSS

SEQ ID NO: 24827 - protein, 9 aa, Borrelia burgdorferi B31
KTQEKLSSG

SEQ ID NO: 24828 - protein, 9 aa, Borrelia burgdorferi B31
TQEKLSSGY

SEQ ID NO: 24829 - protein, 9 aa, Borrelia burgdorferi B31
QEKLSSGYR

SEQ ID NO: 24830 - protein, 9 aa, Borrelia burgdorferi B31
EKLSSGYRI

SEQ ID NO: 24831 - protein, 9 aa, Borrelia burgdorferi B31
KLSSGYRIN

SEQ ID NO: 24832 - protein, 9 aa, Borrelia burgdorferi B31
LSSGYRINR

SEQ ID NO: 24833 - protein, 9 aa, Borrelia burgdorferi B31
SSGYRINRA

SEQ ID NO: 24834 - protein, 9 aa, Borrelia burgdorferi B31
SGYRINRAS

SEQ ID NO: 24835 - protein, 9 aa, Borrelia burgdorferi B31
GYRINRASD

SEQ ID NO: 24836 - protein, 9 aa, Borrelia burgdorferi B31
YRINRASDD

SEQ ID NO: 24837 - protein, 9 aa, Borrelia burgdorferi B31
RINRASDDA

SEQ ID NO: 24838 - protein, 9 aa, Borrelia burgdorferi B31
INRASDDAA

SEQ ID NO: 24839 - protein, 9 aa, Borrelia burgdorferi B31
NRASDDAAG

SEQ ID NO: 24840 - protein, 9 aa, Borrelia burgdorferi B31
RASDDAAGM

SEQ ID NO: 24841 - protein, 9 aa, Borrelia burgdorferi B31
ASDDAAGMG

SEQ ID NO: 24842 - protein, 9 aa, Borrelia burgdorferi B31
SDDAAGMGV

SEQ ID NO: 24843 - protein, 9 aa, Borrelia burgdorferi B31
DDAAGMGVS

SEQ ID NO: 24844 - protein, 9 aa, Borrelia burgdorferi B31
DAAGMGVSG

SEQ ID NO: 24845 - protein, 9 aa, Borrelia burgdorferi B31
AAGMGVSGK

SEQ ID NO: 24846 - protein, 9 aa, Borrelia burgdorferi B31
AGMGVSGKI

SEQ ID NO: 24847 - protein, 9 aa, Borrelia burgdorferi B31
GMGVSGKIN

SEQ ID NO: 24848 - protein, 9 aa, Borrelia burgdorferi B31
MGVSGKINA

SEQ ID NO: 24849 - protein, 9 aa, Borrelia burgdorferi B31
GVSGKINAQ

SEQ ID NO: 24850 - protein, 9 aa, Borrelia burgdorferi B31
VSGKINAQI

SEQ ID NO: 24851 - protein, 9 aa, Borrelia burgdorferi B31
SGKINAQIR

SEQ ID NO: 24852 - protein, 9 aa, Borrelia burgdorferi B31
GKINAQIRG

SEQ ID NO: 24853 - protein, 9 aa, Borrelia burgdorferi B31
KINAQIRGL

SEQ ID NO: 24854 - protein, 9 aa, Borrelia burgdorferi B31
INAQIRGLS

SEQ ID NO: 24855 - protein, 9 aa, Borrelia burgdorferi B31
NAQIRGLSQ

SEQ ID NO: 24856 - protein, 9 aa, Borrelia burgdorferi B31
AQIRGLSQA

SEQ ID NO: 24857 - protein, 9 aa, Borrelia burgdorferi B31
QIRGLSQAS

SEQ ID NO: 24858 - protein, 9 aa, Borrelia burgdorferi B31
IRGLSQASR

SEQ ID NO: 24859 - protein, 9 aa, Borrelia burgdorferi B31
RGLSQASRN

SEQ ID NO: 24860 - protein, 9 aa, Borrelia burgdorferi B31
GLSQASRNT

SEQ ID NO: 24861 - protein, 9 aa, Borrelia burgdorferi B31
LSQASRNTS

SEQ ID NO: 24862 - protein, 9 aa, Borrelia burgdorferi B31
SQASRNTSK

SEQ ID NO: 24863 - protein, 9 aa, Borrelia burgdorferi B31
QASRNTSKA

SEQ ID NO: 24864 - protein, 9 aa, Borrelia burgdorferi B31
ASRNTSKAI

SEQ ID NO: 24865 - protein, 9 aa, Borrelia burgdorferi B31
SRNTSKAIN

SEQ ID NO: 24866 - protein, 9 aa, Borrelia burgdorferi B31
RNTSKAINF

SEQ ID NO: 24867 - protein, 9 aa, Borrelia burgdorferi B31
NTSKAINFI

SEQ ID NO: 24868 - protein, 9 aa, Borrelia burgdorferi B31
TSKAINFIQ

SEQ ID NO: 24869 - protein, 9 aa, Borrelia burgdorferi B31
SKAINFIQT

SEQ ID NO: 24870 - protein, 9 aa, Borrelia burgdorferi B31
KAINFIQTT

SEQ ID NO: 24871 - protein, 9 aa, Borrelia burgdorferi B31
AINFIQTTE

SEQ ID NO: 24872 - protein, 9 aa, Borrelia burgdorferi B31
INFIQTTEG

SEQ ID NO: 24873 - protein, 9 aa, Borrelia burgdorferi B31
NFIQTTEGN

SEQ ID NO: 24874 - protein, 9 aa, Borrelia burgdorferi B31
FIQTTEGNL

SEQ ID NO: 24875 - protein, 9 aa, Borrelia burgdorferi B31
IQTTEGNLN

SEQ ID NO: 24876 - protein, 9 aa, Borrelia burgdorferi B31
QTTEGNLNE

SEQ ID NO: 24877 - protein, 9 aa, Borrelia burgdorferi B31
TTEGNLNEV

SEQ ID NO: 24878 - protein, 9 aa, Borrelia burgdorferi B31
TEGNLNEVE

SEQ ID NO: 24879 - protein, 9 aa, Borrelia burgdorferi B31
EGNLNEVEK

SEQ ID NO: 24880 - protein, 9 aa, Borrelia burgdorferi B31
GNLNEVEKV

SEQ ID NO: 24881 - protein, 9 aa, Borrelia burgdorferi B31
NLNEVEKVL

SEQ ID NO: 24882 - protein, 9 aa, Borrelia burgdorferi B31
LNEVEKVLV

SEQ ID NO: 24883 - protein, 9 aa, Borrelia burgdorferi B31
NEVEKVLVR

SEQ ID NO: 24884 - protein, 9 aa, Borrelia burgdorferi B31
EVEKVLVRM

SEQ ID NO: 24885 - protein, 9 aa, Borrelia burgdorferi B31
VEKVLVRMK

SEQ ID NO: 24886 - protein, 9 aa, Borrelia burgdorferi B31
EKVLVRMKE

SEQ ID NO: 24887 - protein, 9 aa, Borrelia burgdorferi B31
KVLVRMKEL

SEQ ID NO: 24888 - protein, 9 aa, Borrelia burgdorferi B31
VLVRMKELA

SEQ ID NO: 24889 - protein, 9 aa, Borrelia burgdorferi B31
LVRMKELAV

SEQ ID NO: 24890 - protein, 9 aa, Borrelia burgdorferi B31
VRMKELAVQ

SEQ ID NO: 24891 - protein, 9 aa, Borrelia burgdorferi B31
RMKELAVQS

SEQ ID NO: 24892 - protein, 9 aa, Borrelia burgdorferi B31
MKELAVQSG

SEQ ID NO: 24893 - protein, 9 aa, Borrelia burgdorferi B31
KELAVQSGN

SEQ ID NO: 24894 - protein, 9 aa, Borrelia burgdorferi B31
ELAVQSGNG

SEQ ID NO: 24895 - protein, 9 aa, Borrelia burgdorferi B31
LAVQSGNGT

SEQ ID NO: 24896 - protein, 9 aa, Borrelia burgdorferi B31
AVQSGNGTY

SEQ ID NO: 24897 - protein, 9 aa, Borrelia burgdorferi B31
VQSGNGTYS

SEQ ID NO: 24898 - protein, 9 aa, Borrelia burgdorferi B31
QSGNGTYSD

SEQ ID NO: 24899 - protein, 9 aa, Borrelia burgdorferi B31
SGNGTYSDA

SEQ ID NO: 24900 - protein, 9 aa, Borrelia burgdorferi B31
GNGTYSDAD

SEQ ID NO: 24901 - protein, 9 aa, Borrelia burgdorferi B31
NGTYSDADR

SEQ ID NO: 24902 - protein, 9 aa, Borrelia burgdorferi B31
GTYSDADRG

SEQ ID NO: 24903 - protein, 9 aa, Borrelia burgdorferi B31
TYSDADRGS

SEQ ID NO: 24904 - protein, 9 aa, Borrelia burgdorferi B31
YSDADRGSI

SEQ ID NO: 24905 - protein, 9 aa, Borrelia burgdorferi B31
SDADRGSIQ

SEQ ID NO: 24906 - protein, 9 aa, Borrelia burgdorferi B31
DADRGSIQI

SEQ ID NO: 24907 - protein, 9 aa, Borrelia burgdorferi B31
ADRGSIQIE

SEQ ID NO: 24908 - protein, 9 aa, Borrelia burgdorferi B31
DRGSIQIEI

SEQ ID NO: 24909 - protein, 9 aa, Borrelia burgdorferi B31
RGSIQIEIE

SEQ ID NO: 24910 - protein, 9 aa, Borrelia burgdorferi B31
GSIQIEIEQ

SEQ ID NO: 24911 - protein, 9 aa, Borrelia burgdorferi B31
SIQIEIEQL

SEQ ID NO: 24912 - protein, 9 aa, Borrelia burgdorferi B31
IQIEIEQLT

SEQ ID NO: 24913 - protein, 9 aa, Borrelia burgdorferi B31
QIEIEQLTD

SEQ ID NO: 24914 - protein, 9 aa, Borrelia burgdorferi B31
IEIEQLTDE

SEQ ID NO: 24915 - protein, 9 aa, Borrelia burgdorferi B31
EIEQLTDEI

SEQ ID NO: 24916 - protein, 9 aa, Borrelia burgdorferi B31
IEQLTDEIN

SEQ ID NO: 24917 - protein, 9 aa, Borrelia burgdorferi B31
EQLTDEINR

SEQ ID NO: 24918 - protein, 9 aa, Borrelia burgdorferi B31
QLTDEINRI

SEQ ID NO: 24919 - protein, 9 aa, Borrelia burgdorferi B31
LTDEINRIA

SEQ ID NO: 24920 - protein, 9 aa, Borrelia burgdorferi B31
TDEINRIAD

SEQ ID NO: 24921 - protein, 9 aa, Borrelia burgdorferi B31
DEINRIADQ

SEQ ID NO: 24922 - protein, 9 aa, Borrelia burgdorferi B31
EINRIADQA

SEQ ID NO: 24923 - protein, 9 aa, Borrelia burgdorferi B31
INRIADQAQ

SEQ ID NO: 24924 - protein, 9 aa, Borrelia burgdorferi B31
NRIADQAQY

SEQ ID NO: 24925 - protein, 9 aa, Borrelia burgdorferi B31
RIADQAQYN

SEQ ID NO: 24926 - protein, 9 aa, Borrelia burgdorferi B31
IADQAQYNQ

SEQ ID NO: 24927 - protein, 9 aa, Borrelia burgdorferi B31
ADQAQYNQM

SEQ ID NO: 24928 - protein, 9 aa, Borrelia burgdorferi B31
DQAQYNQMH

SEQ ID NO: 24929 - protein, 9 aa, Borrelia burgdorferi B31
QAQYNQMHM

SEQ ID NO: 24930 - protein, 9 aa, Borrelia burgdorferi B31
AQYNQMHML

SEQ ID NO: 24931 - protein, 9 aa, Borrelia burgdorferi B31
QYNQMHMLS

SEQ ID NO: 24932 - protein, 9 aa, Borrelia burgdorferi B31
YNQMHMLSN

SEQ ID NO: 24933 - protein, 9 aa, Borrelia burgdorferi B31
NQMHMLSNK

SEQ ID NO: 24934 - protein, 9 aa, Borrelia burgdorferi B31
QMHMLSNKS

SEQ ID NO: 24935 - protein, 9 aa, Borrelia burgdorferi B31
MHMLSNKSA

SEQ ID NO: 24936 - protein, 9 aa, Borrelia burgdorferi B31
HMLSNKSAS

SEQ ID NO: 24937 - protein, 9 aa, Borrelia burgdorferi B31
MLSNKSASQ

SEQ ID NO: 24938 - protein, 9 aa, Borrelia burgdorferi B31
LSNKSASQN

SEQ ID NO: 24939 - protein, 9 aa, Borrelia burgdorferi B31
SNKSASQNV

SEQ ID NO: 24940 - protein, 9 aa, Borrelia burgdorferi B31
NKSASQNVR

SEQ ID NO: 24941 - protein, 9 aa, Borrelia burgdorferi B31
KSASQNVRT

SEQ ID NO: 24942 - protein, 9 aa, Borrelia burgdorferi B31
SASQNVRTA

SEQ ID NO: 24943 - protein, 9 aa, Borrelia burgdorferi B31
ASQNVRTAE

SEQ ID NO: 24944 - protein, 9 aa, Borrelia burgdorferi B31
SQNVRTAEE

SEQ ID NO: 24945 - protein, 9 aa, Borrelia burgdorferi B31
QNVRTAEEL

SEQ ID NO: 24946 - protein, 9 aa, Borrelia burgdorferi B31
NVRTAEELG

SEQ ID NO: 24947 - protein, 9 aa, Borrelia burgdorferi B31
VRTAEELGM

SEQ ID NO: 24948 - protein, 9 aa, Borrelia burgdorferi B31
RTAEELGMQ

SEQ ID NO: 24949 - protein, 9 aa, Borrelia burgdorferi B31
TAEELGMQP

SEQ ID NO: 24950 - protein, 9 aa, Borrelia burgdorferi B31
AEELGMQPA

SEQ ID NO: 24951 - protein, 9 aa, Borrelia burgdorferi B31
EELGMQPAK

SEQ ID NO: 24952 - protein, 9 aa, Borrelia burgdorferi B31
ELGMQPAKI

SEQ ID NO: 24953 - protein, 9 aa, Borrelia burgdorferi B31
LGMQPAKIN

SEQ ID NO: 24954 - protein, 9 aa, Borrelia burgdorferi B31
GMQPAKINT

SEQ ID NO: 24955 - protein, 9 aa, Borrelia burgdorferi B31
MQPAKINTP

SEQ ID NO: 24956 - protein, 9 aa, Borrelia burgdorferi B31
QPAKINTPA

SEQ ID NO: 24957 - protein, 9 aa, Borrelia burgdorferi B31
PAKINTPAS

SEQ ID NO: 24958 - protein, 9 aa, Borrelia burgdorferi B31
AKINTPASL

SEQ ID NO: 24959 - protein, 9 aa, Borrelia burgdorferi B31
KINTPASLS

SEQ ID NO: 24960 - protein, 9 aa, Borrelia burgdorferi B31
INTPASLSG

SEQ ID NO: 24961 - protein, 9 aa, Borrelia burgdorferi B31
NTPASLSGS

SEQ ID NO: 24962 - protein, 9 aa, Borrelia burgdorferi B31
TPASLSGSQ

SEQ ID NO: 24963 - protein, 9 aa, Borrelia burgdorferi B31
PASLSGSQA

SEQ ID NO: 24964 - protein, 9 aa, Borrelia burgdorferi B31
ASLSGSQAS

SEQ ID NO: 24965 - protein, 9 aa, Borrelia burgdorferi B31
SLSGSQASW

SEQ ID NO: 24966 - protein, 9 aa, Borrelia burgdorferi B31
LSGSQASWT

SEQ ID NO: 24967 - protein, 9 aa, Borrelia burgdorferi B31
SGSQASWTL

SEQ ID NO: 24968 - protein, 9 aa, Borrelia burgdorferi B31
GSQASWTLR

SEQ ID NO: 24969 - protein, 9 aa, Borrelia burgdorferi B31
SQASWTLRV

SEQ ID NO: 24970 - protein, 9 aa, Borrelia burgdorferi B31
QASWTLRVH

SEQ ID NO: 24971 - protein, 9 aa, Borrelia burgdorferi B31
ASWTLRVHV

SEQ ID NO: 24972 - protein, 9 aa, Borrelia burgdorferi B31
SWTLRVHVG

SEQ ID NO: 24973 - protein, 9 aa, Borrelia burgdorferi B31
WTLRVHVGA

SEQ ID NO: 24974 - protein, 9 aa, Borrelia burgdorferi B31
TLRVHVGAN

SEQ ID NO: 24975 - protein, 9 aa, Borrelia burgdorferi B31
LRVHVGANQ

SEQ ID NO: 24976 - protein, 9 aa, Borrelia burgdorferi B31
RVHVGANQD

SEQ ID NO: 24977 - protein, 9 aa, Borrelia burgdorferi B31
VHVGANQDE

SEQ ID NO: 24978 - protein, 9 aa, Borrelia burgdorferi B31
HVGANQDEA

SEQ ID NO: 24979 - protein, 9 aa, Borrelia burgdorferi B31
VGANQDEAI

SEQ ID NO: 24980 - protein, 9 aa, Borrelia burgdorferi B31
GANQDEAIA

SEQ ID NO: 24981 - protein, 9 aa, Borrelia burgdorferi B31
ANQDEAIAV

SEQ ID NO: 24982 - protein, 9 aa, Borrelia burgdorferi B31
NQDEAIAVN

SEQ ID NO: 24983 - protein, 9 aa, Borrelia burgdorferi B31
QDEAIAVNI

SEQ ID NO: 24984 - protein, 9 aa, Borrelia burgdorferi B31
DEAIAVNIY

SEQ ID NO: 24985 - protein, 9 aa, Borrelia burgdorferi B31
EAIAVNIYA

SEQ ID NO: 24986 - protein, 9 aa, Borrelia burgdorferi B31
AIAVNIYAA

SEQ ID NO: 24987 - protein, 9 aa, Borrelia burgdorferi B31
IAVNIYAAN

SEQ ID NO: 24988 - protein, 9 aa, Borrelia burgdorferi B31
AVNIYAANV

SEQ ID NO: 24989 - protein, 9 aa, Borrelia burgdorferi B31
VNIYAANVA

SEQ ID NO: 24990 - protein, 9 aa, Borrelia burgdorferi B31
NIYAANVAN

SEQ ID NO: 24991 - protein, 9 aa, Borrelia burgdorferi B31
IYAANVANL

SEQ ID NO: 24992 - protein, 9 aa, Borrelia burgdorferi B31
YAANVANLF

SEQ ID NO: 24993 - protein, 9 aa, Borrelia burgdorferi B31
AANVANLFS

SEQ ID NO: 24994 - protein, 9 aa, Borrelia burgdorferi B31
ANVANLFSG

SEQ ID NO: 24995 - protein, 9 aa, Borrelia burgdorferi B31
NVANLFSGE

SEQ ID NO: 24996 - protein, 9 aa, Borrelia burgdorferi B31
VANLFSGEG

SEQ ID NO: 24997 - protein, 9 aa, Borrelia burgdorferi B31
ANLFSGEGA

SEQ ID NO: 24998 - protein, 9 aa, Borrelia burgdorferi B31
NLFSGEGAQ

SEQ ID NO: 24999 - protein, 9 aa, Borrelia burgdorferi B31
LFSGEGAQT

SEQ ID NO: 25000 - protein, 9 aa, Borrelia burgdorferi B31
FSGEGAQTA

SEQ ID NO: 25001 - protein, 9 aa, Borrelia burgdorferi B31
SGEGAQTAQ

SEQ ID NO: 25002 - protein, 9 aa, Borrelia burgdorferi B31
GEGAQTAQA

SEQ ID NO: 25003 - protein, 9 aa, Borrelia burgdorferi B31
EGAQTAQAA

SEQ ID NO: 25004 - protein, 9 aa, Borrelia burgdorferi B31
GAQTAQAAP

SEQ ID NO: 25005 - protein, 9 aa, Borrelia burgdorferi B31
AQTAQAAPV

SEQ ID NO: 25006 - protein, 9 aa, Borrelia burgdorferi B31
QTAQAAPVQ

SEQ ID NO: 25007 - protein, 9 aa, Borrelia burgdorferi B31
TAQAAPVQE

SEQ ID NO: 25008 - protein, 9 aa, Borrelia burgdorferi B31
AQAAPVQEG

SEQ ID NO: 25009 - protein, 9 aa, Borrelia burgdorferi B31
QAAPVQEGV

SEQ ID NO: 25010 - protein, 9 aa, Borrelia burgdorferi B31
AAPVQEGVQ

SEQ ID NO: 25011 - protein, 9 aa, Borrelia burgdorferi B31
APVQEGVQQ

SEQ ID NO: 25012 - protein, 9 aa, Borrelia burgdorferi B31
PVQEGVQQE

SEQ ID NO: 25013 - protein, 9 aa, Borrelia burgdorferi B31
VQEGVQQEG

SEQ ID NO: 25014 - protein, 9 aa, Borrelia burgdorferi B31
QEGVQQEGA

SEQ ID NO: 25015 - protein, 9 aa, Borrelia burgdorferi B31
EGVQQEGAQ

SEQ ID NO: 25016 - protein, 9 aa, Borrelia burgdorferi B31
GVQQEGAQQ

SEQ ID NO: 25017 - protein, 9 aa, Borrelia burgdorferi B31
VQQEGAQQP

SEQ ID NO: 25018 - protein, 9 aa, Borrelia burgdorferi B31
QQEGAQQPA

SEQ ID NO: 25019 - protein, 9 aa, Borrelia burgdorferi B31
QEGAQQPAP

SEQ ID NO: 25020 - protein, 9 aa, Borrelia burgdorferi B31
EGAQQPAPA

SEQ ID NO: 25021 - protein, 9 aa, Borrelia burgdorferi B31
GAQQPAPAT

SEQ ID NO: 25022 - protein, 9 aa, Borrelia burgdorferi B31
AQQPAPATA

SEQ ID NO: 25023 - protein, 9 aa, Borrelia burgdorferi B31
QQPAPATAP

SEQ ID NO: 25024 - protein, 9 aa, Borrelia burgdorferi B31
QPAPATAPS

SEQ ID NO: 25025 - protein, 9 aa, Borrelia burgdorferi B31
PAPATAPSQ

SEQ ID NO: 25026 - protein, 9 aa, Borrelia burgdorferi B31
APATAPSQG

SEQ ID NO: 25027 - protein, 9 aa, Borrelia burgdorferi B31
PATAPSQGG

SEQ ID NO: 25028 - protein, 9 aa, Borrelia burgdorferi B31
ATAPSQGGV

SEQ ID NO: 25029 - protein, 9 aa, Borrelia burgdorferi B31
TAPSQGGVN

SEQ ID NO: 25030 - protein, 9 aa, Borrelia burgdorferi B31
APSQGGVNS

SEQ ID NO: 25031 - protein, 9 aa, Borrelia burgdorferi B31
PSQGGVNSP

SEQ ID NO: 25032 - protein, 9 aa, Borrelia burgdorferi B31
SQGGVNSPV

SEQ ID NO: 25033 - protein, 9 aa, Borrelia burgdorferi B31
QGGVNSPVN

SEQ ID NO: 25034 - protein, 9 aa, Borrelia burgdorferi B31
GGVNSPVNV

SEQ ID NO: 25035 - protein, 9 aa, Borrelia burgdorferi B31
GVNSPVNVT

SEQ ID NO: 25036 - protein, 9 aa, Borrelia burgdorferi B31
VNSPVNVTT

SEQ ID NO: 25037 - protein, 9 aa, Borrelia burgdorferi B31
NSPVNVTTT

SEQ ID NO: 25038 - protein, 9 aa, Borrelia burgdorferi B31
SPVNVTTTV

SEQ ID NO: 25039 - protein, 9 aa, Borrelia burgdorferi B31
PVNVTTTVD

SEQ ID NO: 25040 - protein, 9 aa, Borrelia burgdorferi B31
VNVTTTVDA

SEQ ID NO: 25041 - protein, 9 aa, Borrelia burgdorferi B31
NVTTTVDAN

SEQ ID NO: 25042 - protein, 9 aa, Borrelia burgdorferi B31
VTTTVDANT

SEQ ID NO: 25043 - protein, 9 aa, Borrelia burgdorferi B31
TTTVDANTS

SEQ ID NO: 25044 - protein, 9 aa, Borrelia burgdorferi B31
TTVDANTSL

SEQ ID NO: 25045 - protein, 9 aa, Borrelia burgdorferi B31
TVDANTSLA

SEQ ID NO: 25046 - protein, 9 aa, Borrelia burgdorferi B31
VDANTSLAK

SEQ ID NO: 25047 - protein, 9 aa, Borrelia burgdorferi B31
DANTSLAKI

SEQ ID NO: 25048 - protein, 9 aa, Borrelia burgdorferi B31
ANTSLAKIE

SEQ ID NO: 25049 - protein, 9 aa, Borrelia burgdorferi B31
NTSLAKIEN

SEQ ID NO: 25050 - protein, 9 aa, Borrelia burgdorferi B31
TSLAKIENA

SEQ ID NO: 25051 - protein, 9 aa, Borrelia burgdorferi B31
SLAKIENAI

SEQ ID NO: 25052 - protein, 9 aa, Borrelia burgdorferi B31
LAKIENAIR

SEQ ID NO: 25053 - protein, 9 aa, Borrelia burgdorferi B31
AKIENAIRM

SEQ ID NO: 25054 - protein, 9 aa, Borrelia burgdorferi B31
KIENAIRMI

SEQ ID NO: 25055 - protein, 9 aa, Borrelia burgdorferi B31
IENAIRMIS

SEQ ID NO: 25056 - protein, 9 aa, Borrelia burgdorferi B31
ENAIRMISD

SEQ ID NO: 25057 - protein, 9 aa, Borrelia burgdorferi B31
NAIRMISDQ

SEQ ID NO: 25058 - protein, 9 aa, Borrelia burgdorferi B31
AIRMISDQR

SEQ ID NO: 25059 - protein, 9 aa, Borrelia burgdorferi B31
IRMISDQRA

SEQ ID NO: 25060 - protein, 9 aa, Borrelia burgdorferi B31
RMISDQRAN

SEQ ID NO: 25061 - protein, 9 aa, Borrelia burgdorferi B31
MISDQRANL

SEQ ID NO: 25062 - protein, 9 aa, Borrelia burgdorferi B31
ISDQRANLG

SEQ ID NO: 25063 - protein, 9 aa, Borrelia burgdorferi B31
SDQRANLGA

SEQ ID NO: 25064 - protein, 9 aa, Borrelia burgdorferi B31
DQRANLGAF

SEQ ID NO: 25065 - protein, 9 aa, Borrelia burgdorferi B31
QRANLGAFQ

SEQ ID NO: 25066 - protein, 9 aa, Borrelia burgdorferi B31
RANLGAFQN

SEQ ID NO: 25067 - protein, 9 aa, Borrelia burgdorferi B31
ANLGAFQNR

SEQ ID NO: 25068 - protein, 9 aa, Borrelia burgdorferi B31
NLGAFQNRL

SEQ ID NO: 25069 - protein, 9 aa, Borrelia burgdorferi B31
LGAFQNRLE

SEQ ID NO: 25070 - protein, 9 aa, Borrelia burgdorferi B31
GAFQNRLES

SEQ ID NO: 25071 - protein, 9 aa, Borrelia burgdorferi B31
AFQNRLESI

SEQ ID NO: 25072 - protein, 9 aa, Borrelia burgdorferi B31
FQNRLESIK

SEQ ID NO: 25073 - protein, 9 aa, Borrelia burgdorferi B31
QNRLESIKN

SEQ ID NO: 25074 - protein, 9 aa, Borrelia burgdorferi B31
NRLESIKNS

SEQ ID NO: 25075 - protein, 9 aa, Borrelia burgdorferi B31
RLESIKNST

SEQ ID NO: 25076 - protein, 9 aa, Borrelia burgdorferi B31
LESIKNSTE

SEQ ID NO: 25077 - protein, 9 aa, Borrelia burgdorferi B31
ESIKNSTEY

SEQ ID NO: 25078 - protein, 9 aa, Borrelia burgdorferi B31
SIKNSTEYA

SEQ ID NO: 25079 - protein, 9 aa, Borrelia burgdorferi B31
IKNSTEYAI

SEQ ID NO: 25080 - protein, 9 aa, Borrelia burgdorferi B31
KNSTEYAIE

SEQ ID NO: 25081 - protein, 9 aa, Borrelia burgdorferi B31
NSTEYAIEN

SEQ ID NO: 25082 - protein, 9 aa, Borrelia burgdorferi B31
STEYAIENL

SEQ ID NO: 25083 - protein, 9 aa, Borrelia burgdorferi B31
TEYAIENLK

SEQ ID NO: 25084 - protein, 9 aa, Borrelia burgdorferi B31
EYAIENLKA

SEQ ID NO: 25085 - protein, 9 aa, Borrelia burgdorferi B31
YAIENLKAS

SEQ ID NO: 25086 - protein, 9 aa, Borrelia burgdorferi B31
AIENLKASY

SEQ ID NO: 25087 - protein, 9 aa, Borrelia burgdorferi B31
IENLKASYA

SEQ ID NO: 25088 - protein, 9 aa, Borrelia burgdorferi B31
ENLKASYAQ

SEQ ID NO: 25089 - protein, 9 aa, Borrelia burgdorferi B31
NLKASYAQI

SEQ ID NO: 25090 - protein, 9 aa, Borrelia burgdorferi B31
LKASYAQIK

SEQ ID NO: 25091 - protein, 9 aa, Borrelia burgdorferi B31
KASYAQIKD

SEQ ID NO: 25092 - protein, 9 aa, Borrelia burgdorferi B31
ASYAQIKDA

SEQ ID NO: 25093 - protein, 9 aa, Borrelia burgdorferi B31
SYAQIKDAT

SEQ ID NO: 25094 - protein, 9 aa, Borrelia burgdorferi B31
YAQIKDATM

SEQ ID NO: 25095 - protein, 9 aa, Borrelia burgdorferi B31
AQIKDATMT

SEQ ID NO: 25096 - protein, 9 aa, Borrelia burgdorferi B31
QIKDATMTD

SEQ ID NO: 25097 - protein, 9 aa, Borrelia burgdorferi B31
IKDATMTDE

SEQ ID NO: 25098 - protein, 9 aa, Borrelia burgdorferi B31
KDATMTDEV

SEQ ID NO: 25099 - protein, 9 aa, Borrelia burgdorferi B31
DATMTDEVV

SEQ ID NO: 25100 - protein, 9 aa, Borrelia burgdorferi B31
ATMTDEVVA

SEQ ID NO: 25101 - protein, 9 aa, Borrelia burgdorferi B31
TMTDEVVAA

SEQ ID NO: 25102 - protein, 9 aa, Borrelia burgdorferi B31
MTDEVVAAT

SEQ ID NO: 25103 - protein, 9 aa, Borrelia burgdorferi B31
TDEVVAATT

SEQ ID NO: 25104 - protein, 9 aa, Borrelia burgdorferi B31
DEVVAATTN

SEQ ID NO: 25105 - protein, 9 aa, Borrelia burgdorferi B31
EVVAATTNS

SEQ ID NO: 25106 - protein, 9 aa, Borrelia burgdorferi B31
VVAATTNSI

SEQ ID NO: 25107 - protein, 9 aa, Borrelia burgdorferi B31
VAATTNSIL

SEQ ID NO: 25108 - protein, 9 aa, Borrelia burgdorferi B31
AATTNSILT

SEQ ID NO: 25109 - protein, 9 aa, Borrelia burgdorferi B31
ATTNSILTQ

SEQ ID NO: 25110 - protein, 9 aa, Borrelia burgdorferi B31
TTNSILTQS

SEQ ID NO: 25111 - protein, 9 aa, Borrelia burgdorferi B31
TNSILTQSA

SEQ ID NO: 25112 - protein, 9 aa, Borrelia burgdorferi B31
NSILTQSAM

SEQ ID NO: 25113 - protein, 9 aa, Borrelia burgdorferi B31
SILTQSAMA

SEQ ID NO: 25114 - protein, 9 aa, Borrelia burgdorferi B31
ILTQSAMAM

SEQ ID NO: 25115 - protein, 9 aa, Borrelia burgdorferi B31
LTQSAMAMI

SEQ ID NO: 25116 - protein, 9 aa, Borrelia burgdorferi B31
TQSAMAMIA

SEQ ID NO: 25117 - protein, 9 aa, Borrelia burgdorferi B31
QSAMAMIAQ

SEQ ID NO: 25118 - protein, 9 aa, Borrelia burgdorferi B31
SAMAMIAQA

SEQ ID NO: 25119 - protein, 9 aa, Borrelia burgdorferi B31
AMAMIAQAN

SEQ ID NO: 25120 - protein, 9 aa, Borrelia burgdorferi B31
MAMIAQANQ

SEQ ID NO: 25121 - protein, 9 aa, Borrelia burgdorferi B31
AMIAQANQV

SEQ ID NO: 25122 - protein, 9 aa, Borrelia burgdorferi B31
MIAQANQVP

SEQ ID NO: 25123 - protein, 9 aa, Borrelia burgdorferi B31
IAQANQVPQ

SEQ ID NO: 25124 - protein, 9 aa, Borrelia burgdorferi B31
AQANQVPQY

SEQ ID NO: 25125 - protein, 9 aa, Borrelia burgdorferi B31
QANQVPQYV

SEQ ID NO: 25126 - protein, 9 aa, Borrelia burgdorferi B31
ANQVPQYVL

SEQ ID NO: 25127 - protein, 9 aa, Borrelia burgdorferi B31
NQVPQYVLS

SEQ ID NO: 25128 - protein, 9 aa, Borrelia burgdorferi B31
QVPQYVLSL

SEQ ID NO: 25129 - protein, 9 aa, Borrelia burgdorferi B31
VPQYVLSLL

SEQ ID NO: 25130 - protein, 9 aa, Borrelia burgdorferi B31
PQYVLSLLR

SEQ ID NO: 25131 - protein, 10 aa, Borrelia burgdorferi B31
MIINHNTSAI

SEQ ID NO: 25132 - protein, 10 aa, Borrelia burgdorferi B31
IINHNTSAIN

SEQ ID NO: 25133 - protein, 10 aa, Borrelia burgdorferi B31
INHNTSAINA

SEQ ID NO: 25134 - protein, 10 aa, Borrelia burgdorferi B31
NHNTSAINAS

SEQ ID NO: 25135 - protein, 10 aa, Borrelia burgdorferi B31
HNTSAINASR

SEQ ID NO: 25136 - protein, 10 aa, Borrelia burgdorferi B31
NTSAINASRN

SEQ ID NO: 25137 - protein, 10 aa, Borrelia burgdorferi B31
TSAINASRNN

SEQ ID NO: 25138 - protein, 10 aa, Borrelia burgdorferi B31
SAINASRNNG

SEQ ID NO: 25139 - protein, 10 aa, Borrelia burgdorferi B31
AINASRNNGI

SEQ ID NO: 25140 - protein, 10 aa, Borrelia burgdorferi B31
INASRNNGIN

SEQ ID NO: 25141 - protein, 10 aa, Borrelia burgdorferi B31
NASRNNGINA

SEQ ID NO: 25142 - protein, 10 aa, Borrelia burgdorferi B31
ASRNNGINAA

SEQ ID NO: 25143 - protein, 10 aa, Borrelia burgdorferi B31
SRNNGINAAN

SEQ ID NO: 25144 - protein, 10 aa, Borrelia burgdorferi B31
RNNGINAANL

SEQ ID NO: 25145 - protein, 10 aa, Borrelia burgdorferi B31
NNGINAANLS

SEQ ID NO: 25146 - protein, 10 aa, Borrelia burgdorferi B31
NGINAANLSK

SEQ ID NO: 25147 - protein, 10 aa, Borrelia burgdorferi B31
GINAANLSKT

SEQ ID NO: 25148 - protein, 10 aa, Borrelia burgdorferi B31
INAANLSKTQ

SEQ ID NO: 25149 - protein, 10 aa, Borrelia burgdorferi B31
NAANLSKTQE

SEQ ID NO: 25150 - protein, 10 aa, Borrelia burgdorferi B31
AANLSKTQEK

SEQ ID NO: 25151 - protein, 10 aa, Borrelia burgdorferi B31
ANLSKTQEKL

SEQ ID NO: 25152 - protein, 10 aa, Borrelia burgdorferi B31
NLSKTQEKLS

SEQ ID NO: 25153 - protein, 10 aa, Borrelia burgdorferi B31
LSKTQEKLSS

SEQ ID NO: 25154 - protein, 10 aa, Borrelia burgdorferi B31
SKTQEKLSSG

SEQ ID NO: 25155 - protein, 10 aa, Borrelia burgdorferi B31
KTQEKLSSGY

SEQ ID NO: 25156 - protein, 10 aa, Borrelia burgdorferi B31
TQEKLSSGYR

SEQ ID NO: 25157 - protein, 10 aa, Borrelia burgdorferi B31
QEKLSSGYRI

SEQ ID NO: 25158 - protein, 10 aa, Borrelia burgdorferi B31
EKLSSGYRIN

SEQ ID NO: 25159 - protein, 10 aa, Borrelia burgdorferi B31
KLSSGYRINR

SEQ ID NO: 25160 - protein, 10 aa, Borrelia burgdorferi B31
LSSGYRINRA

SEQ ID NO: 25161 - protein, 10 aa, Borrelia burgdorferi B31
SSGYRINRAS

SEQ ID NO: 25162 - protein, 10 aa, Borrelia burgdorferi B31
SGYRINRASD

SEQ ID NO: 25163 - protein, 10 aa, Borrelia burgdorferi B31
GYRINRASDD

SEQ ID NO: 25164 - protein, 10 aa, Borrelia burgdorferi B31
YRINRASDDA

SEQ ID NO: 25165 - protein, 10 aa, Borrelia burgdorferi B31
RINRASDDAA

SEQ ID NO: 25166 - protein, 10 aa, Borrelia burgdorferi B31
INRASDDAAG

SEQ ID NO: 25167 - protein, 10 aa, Borrelia burgdorferi B31
NRASDDAAGM

SEQ ID NO: 25168 - protein, 10 aa, Borrelia burgdorferi B31
RASDDAAGMG

SEQ ID NO: 25169 - protein, 10 aa, Borrelia burgdorferi B31
ASDDAAGMGV

SEQ ID NO: 25170 - protein, 10 aa, Borrelia burgdorferi B31
SDDAAGMGVS

SEQ ID NO: 25171 - protein, 10 aa, Borrelia burgdorferi B31
DDAAGMGVSG

SEQ ID NO: 25172 - protein, 10 aa, Borrelia burgdorferi B31
DAAGMGVSGK

SEQ ID NO: 25173 - protein, 10 aa, Borrelia burgdorferi B31
AAGMGVSGKI

SEQ ID NO: 25174 - protein, 10 aa, Borrelia burgdorferi B31
AGMGVSGKIN

SEQ ID NO: 25175 - protein, 10 aa, Borrelia burgdorferi B31
GMGVSGKINA

SEQ ID NO: 25176 - protein, 10 aa, Borrelia burgdorferi B31
MGVSGKINAQ

SEQ ID NO: 25177 - protein, 10 aa, Borrelia burgdorferi B31
GVSGKINAQI

SEQ ID NO: 25178 - protein, 10 aa, Borrelia burgdorferi B31
VSGKINAQIR

SEQ ID NO: 25179 - protein, 10 aa, Borrelia burgdorferi B31
SGKINAQIRG

SEQ ID NO: 25180 - protein, 10 aa, Borrelia burgdorferi B31
GKINAQIRGL

SEQ ID NO: 25181 - protein, 10 aa, Borrelia burgdorferi B31
KINAQIRGLS

SEQ ID NO: 25182 - protein, 10 aa, Borrelia burgdorferi B31
INAQIRGLSQ

SEQ ID NO: 25183 - protein, 10 aa, Borrelia burgdorferi B31
NAQIRGLSQA

SEQ ID NO: 25184 - protein, 10 aa, Borrelia burgdorferi B31
AQIRGLSQAS

SEQ ID NO: 25185 - protein, 10 aa, Borrelia burgdorferi B31
QIRGLSQASR

SEQ ID NO: 25186 - protein, 10 aa, Borrelia burgdorferi B31
IRGLSQASRN

SEQ ID NO: 25187 - protein, 10 aa, Borrelia burgdorferi B31
RGLSQASRNT

SEQ ID NO: 25188 - protein, 10 aa, Borrelia burgdorferi B31
GLSQASRNTS

SEQ ID NO: 25189 - protein, 10 aa, Borrelia burgdorferi B31
LSQASRNTSK

SEQ ID NO: 25190 - protein, 10 aa, Borrelia burgdorferi B31
SQASRNTSKA

SEQ ID NO: 25191 - protein, 10 aa, Borrelia burgdorferi B31
QASRNTSKAI

SEQ ID NO: 25192 - protein, 10 aa, Borrelia burgdorferi B31
ASRNTSKAIN

SEQ ID NO: 25193 - protein, 10 aa, Borrelia burgdorferi B31
SRNTSKAINF

SEQ ID NO: 25194 - protein, 10 aa, Borrelia burgdorferi B31
RNTSKAINFI

SEQ ID NO: 25195 - protein, 10 aa, Borrelia burgdorferi B31
NTSKAINFIQ

SEQ ID NO: 25196 - protein, 10 aa, Borrelia burgdorferi B31
TSKAINFIQT

SEQ ID NO: 25197 - protein, 10 aa, Borrelia burgdorferi B31
SKAINFIQTT

SEQ ID NO: 25198 - protein, 10 aa, Borrelia burgdorferi B31
KAINFIQTTE

SEQ ID NO: 25199 - protein, 10 aa, Borrelia burgdorferi B31
AINFIQTTEG

SEQ ID NO: 25200 - protein, 10 aa, Borrelia burgdorferi B31
INFIQTTEGN

SEQ ID NO: 25201 - protein, 10 aa, Borrelia burgdorferi B31
NFIQTTEGNL

SEQ ID NO: 25202 - protein, 10 aa, Borrelia burgdorferi B31
FIQTTEGNLN

SEQ ID NO: 25203 - protein, 10 aa, Borrelia burgdorferi B31
IQTTEGNLNE

SEQ ID NO: 25204 - protein, 10 aa, Borrelia burgdorferi B31
QTTEGNLNEV

SEQ ID NO: 25205 - protein, 10 aa, Borrelia burgdorferi B31
TTEGNLNEVE

SEQ ID NO: 25206 - protein, 10 aa, Borrelia burgdorferi B31
TEGNLNEVEK

SEQ ID NO: 25207 - protein, 10 aa, Borrelia burgdorferi B31
EGNLNEVEKV

SEQ ID NO: 25208 - protein, 10 aa, Borrelia burgdorferi B31
GNLNEVEKVL

SEQ ID NO: 25209 - protein, 10 aa, Borrelia burgdorferi B31
NLNEVEKVLV

SEQ ID NO: 25210 - protein, 10 aa, Borrelia burgdorferi B31
LNEVEKVLVR

SEQ ID NO: 25211 - protein, 10 aa, Borrelia burgdorferi B31
NEVEKVLVRM

SEQ ID NO: 25212 - protein, 10 aa, Borrelia burgdorferi B31
EVEKVLVRMK

SEQ ID NO: 25213 - protein, 10 aa, Borrelia burgdorferi B31
VEKVLVRMKE

SEQ ID NO: 25214 - protein, 10 aa, Borrelia burgdorferi B31
EKVLVRMKEL

SEQ ID NO: 25215 - protein, 10 aa, Borrelia burgdorferi B31
KVLVRMKELA

SEQ ID NO: 25216 - protein, 10 aa, Borrelia burgdorferi B31
VLVRMKELAV

SEQ ID NO: 25217 - protein, 10 aa, Borrelia burgdorferi B31
LVRMKELAVQ

SEQ ID NO: 25218 - protein, 10 aa, Borrelia burgdorferi B31
VRMKELAVQS

SEQ ID NO: 25219 - protein, 10 aa, Borrelia burgdorferi B31
RMKELAVQSG

SEQ ID NO: 25220 - protein, 10 aa, Borrelia burgdorferi B31
MKELAVQSGN

SEQ ID NO: 25221 - protein, 10 aa, Borrelia burgdorferi B31
KELAVQSGNG

SEQ ID NO: 25222 - protein, 10 aa, Borrelia burgdorferi B31
ELAVQSGNGT

SEQ ID NO: 25223 - protein, 10 aa, Borrelia burgdorferi B31
LAVQSGNGTY

SEQ ID NO: 25224 - protein, 10 aa, Borrelia burgdorferi B31
AVQSGNGTYS

SEQ ID NO: 25225 - protein, 10 aa, Borrelia burgdorferi B31
VQSGNGTYSD

SEQ ID NO: 25226 - protein, 10 aa, Borrelia burgdorferi B31
QSGNGTYSDA

SEQ ID NO: 25227 - protein, 10 aa, Borrelia burgdorferi B31
SGNGTYSDAD

SEQ ID NO: 25228 - protein, 10 aa, Borrelia burgdorferi B31
GNGTYSDADR

SEQ ID NO: 25229 - protein, 10 aa, Borrelia burgdorferi B31
NGTYSDADRG

SEQ ID NO: 25230 - protein, 10 aa, Borrelia burgdorferi B31
GTYSDADRGS

SEQ ID NO: 25231 - protein, 10 aa, Borrelia burgdorferi B31
TYSDADRGSI

SEQ ID NO: 25232 - protein, 10 aa, Borrelia burgdorferi B31
YSDADRGSIQ

SEQ ID NO: 25233 - protein, 10 aa, Borrelia burgdorferi B31
SDADRGSIQI

SEQ ID NO: 25234 - protein, 10 aa, Borrelia burgdorferi B31
DADRGSIQIE

SEQ ID NO: 25235 - protein, 10 aa, Borrelia burgdorferi B31
ADRGSIQIEI

SEQ ID NO: 25236 - protein, 10 aa, Borrelia burgdorferi B31
DRGSIQIEIE

SEQ ID NO: 25237 - protein, 10 aa, Borrelia burgdorferi B31
RGSIQIEIEQ

SEQ ID NO: 25238 - protein, 10 aa, Borrelia burgdorferi B31
GSIQIEIEQL

SEQ ID NO: 25239 - protein, 10 aa, Borrelia burgdorferi B31
SIQIEIEQLT

SEQ ID NO: 25240 - protein, 10 aa, Borrelia burgdorferi B31
IQIEIEQLTD

SEQ ID NO: 25241 - protein, 10 aa, Borrelia burgdorferi B31
QIEIEQLTDE

SEQ ID NO: 25242 - protein, 10 aa, Borrelia burgdorferi B31
IEIEQLTDEI

SEQ ID NO: 25243 - protein, 10 aa, Borrelia burgdorferi B31
EIEQLTDEIN

SEQ ID NO: 25244 - protein, 10 aa, Borrelia burgdorferi B31
IEQLTDEINR

SEQ ID NO: 25245 - protein, 10 aa, Borrelia burgdorferi B31
EQLTDEINRI

SEQ ID NO: 25246 - protein, 10 aa, Borrelia burgdorferi B31
QLTDEINRIA

SEQ ID NO: 25247 - protein, 10 aa, Borrelia burgdorferi B31
LTDEINRIAD

SEQ ID NO: 25248 - protein, 10 aa, Borrelia burgdorferi B31
TDEINRIADQ

SEQ ID NO: 25249 - protein, 10 aa, Borrelia burgdorferi B31
DEINRIADQA

SEQ ID NO: 25250 - protein, 10 aa, Borrelia burgdorferi B31
EINRIADQAQ

SEQ ID NO: 25251 - protein, 10 aa, Borrelia burgdorferi B31
INRIADQAQY

SEQ ID NO: 25252 - protein, 10 aa, Borrelia burgdorferi B31
NRIADQAQYN

SEQ ID NO: 25253 - protein, 10 aa, Borrelia burgdorferi B31
RIADQAQYNQ

SEQ ID NO: 25254 - protein, 10 aa, Borrelia burgdorferi B31
IADQAQYNQM

SEQ ID NO: 25255 - protein, 10 aa, Borrelia burgdorferi B31
ADQAQYNQMH

SEQ ID NO: 25256 - protein, 10 aa, Borrelia burgdorferi B31
DQAQYNQMHM

SEQ ID NO: 25257 - protein, 10 aa, Borrelia burgdorferi B31
QAQYNQMHML

SEQ ID NO: 25258 - protein, 10 aa, Borrelia burgdorferi B31
AQYNQMHMLS

SEQ ID NO: 25259 - protein, 10 aa, Borrelia burgdorferi B31
QYNQMHMLSN

SEQ ID NO: 25260 - protein, 10 aa, Borrelia burgdorferi B31
YNQMHMLSNK

SEQ ID NO: 25261 - protein, 10 aa, Borrelia burgdorferi B31
NQMHMLSNKS

SEQ ID NO: 25262 - protein, 10 aa, Borrelia burgdorferi B31
QMHMLSNKSA

SEQ ID NO: 25263 - protein, 10 aa, Borrelia burgdorferi B31
MHMLSNKSAS

SEQ ID NO: 25264 - protein, 10 aa, Borrelia burgdorferi B31
HMLSNKSASQ

SEQ ID NO: 25265 - protein, 10 aa, Borrelia burgdorferi B31
MLSNKSASQN

SEQ ID NO: 25266 - protein, 10 aa, Borrelia burgdorferi B31
LSNKSASQNV

SEQ ID NO: 25267 - protein, 10 aa, Borrelia burgdorferi B31
SNKSASQNVR

SEQ ID NO: 25268 - protein, 10 aa, Borrelia burgdorferi B31
NKSASQNVRT

SEQ ID NO: 25269 - protein, 10 aa, Borrelia burgdorferi B31
KSASQNVRTA

SEQ ID NO: 25270 - protein, 10 aa, Borrelia burgdorferi B31
SASQNVRTAE

SEQ ID NO: 25271 - protein, 10 aa, Borrelia burgdorferi B31
ASQNVRTAEE

SEQ ID NO: 25272 - protein, 10 aa, Borrelia burgdorferi B31
SQNVRTAEEL

SEQ ID NO: 25273 - protein, 10 aa, Borrelia burgdorferi B31
QNVRTAEELG

SEQ ID NO: 25274 - protein, 10 aa, Borrelia burgdorferi B31
NVRTAEELGM

SEQ ID NO: 25275 - protein, 10 aa, Borrelia burgdorferi B31
VRTAEELGMQ

SEQ ID NO: 25276 - protein, 10 aa, Borrelia burgdorferi B31
RTAEELGMQP

SEQ ID NO: 25277 - protein, 10 aa, Borrelia burgdorferi B31
TAEELGMQPA

SEQ ID NO: 25278 - protein, 10 aa, Borrelia burgdorferi B31
AEELGMQPAK

SEQ ID NO: 25279 - protein, 10 aa, Borrelia burgdorferi B31
EELGMQPAKI

SEQ ID NO: 25280 - protein, 10 aa, Borrelia burgdorferi B31
ELGMQPAKIN

SEQ ID NO: 25281 - protein, 10 aa, Borrelia burgdorferi B31
LGMQPAKINT

SEQ ID NO: 25282 - protein, 10 aa, Borrelia burgdorferi B31
GMQPAKINTP

SEQ ID NO: 25283 - protein, 10 aa, Borrelia burgdorferi B31
MQPAKINTPA

SEQ ID NO: 25284 - protein, 10 aa, Borrelia burgdorferi B31
QPAKINTPAS

SEQ ID NO: 25285 - protein, 10 aa, Borrelia burgdorferi B31
PAKINTPASL

SEQ ID NO: 25286 - protein, 10 aa, Borrelia burgdorferi B31
AKINTPASLS

SEQ ID NO: 25287 - protein, 10 aa, Borrelia burgdorferi B31
KINTPASLSG

SEQ ID NO: 25288 - protein, 10 aa, Borrelia burgdorferi B31
INTPASLSGS

SEQ ID NO: 25289 - protein, 10 aa, Borrelia burgdorferi B31
NTPASLSGSQ

SEQ ID NO: 25290 - protein, 10 aa, Borrelia burgdorferi B31
TPASLSGSQA

SEQ ID NO: 25291 - protein, 10 aa, Borrelia burgdorferi B31
PASLSGSQAS

SEQ ID NO: 25292 - protein, 10 aa, Borrelia burgdorferi B31
ASLSGSQASW

SEQ ID NO: 25293 - protein, 10 aa, Borrelia burgdorferi B31
SLSGSQASWT

SEQ ID NO: 25294 - protein, 10 aa, Borrelia burgdorferi B31
LSGSQASWTL

SEQ ID NO: 25295 - protein, 10 aa, Borrelia burgdorferi B31
SGSQASWTLR

SEQ ID NO: 25296 - protein, 10 aa, Borrelia burgdorferi B31
GSQASWTLRV

SEQ ID NO: 25297 - protein, 10 aa, Borrelia burgdorferi B31
SQASWTLRVH

SEQ ID NO: 25298 - protein, 10 aa, Borrelia burgdorferi B31
QASWTLRVHV

SEQ ID NO: 25299 - protein, 10 aa, Borrelia burgdorferi B31
ASWTLRVHVG

SEQ ID NO: 25300 - protein, 10 aa, Borrelia burgdorferi B31
SWTLRVHVGA

SEQ ID NO: 25301 - protein, 10 aa, Borrelia burgdorferi B31
WTLRVHVGAN

SEQ ID NO: 25302 - protein, 10 aa, Borrelia burgdorferi B31
TLRVHVGANQ

SEQ ID NO: 25303 - protein, 10 aa, Borrelia burgdorferi B31
LRVHVGANQD

SEQ ID NO: 25304 - protein, 10 aa, Borrelia burgdorferi B31
RVHVGANQDE

SEQ ID NO: 25305 - protein, 10 aa, Borrelia burgdorferi B31
VHVGANQDEA

SEQ ID NO: 25306 - protein, 10 aa, Borrelia burgdorferi B31
HVGANQDEAI

SEQ ID NO: 25307 - protein, 10 aa, Borrelia burgdorferi B31
VGANQDEAIA

SEQ ID NO: 25308 - protein, 10 aa, Borrelia burgdorferi B31
GANQDEAIAV

SEQ ID NO: 25309 - protein, 10 aa, Borrelia burgdorferi B31
ANQDEAIAVN

SEQ ID NO: 25310 - protein, 10 aa, Borrelia burgdorferi B31
NQDEAIAVNI

SEQ ID NO: 25311 - protein, 10 aa, Borrelia burgdorferi B31
QDEAIAVNIY

SEQ ID NO: 25312 - protein, 10 aa, Borrelia burgdorferi B31
DEAIAVNIYA

SEQ ID NO: 25313 - protein, 10 aa, Borrelia burgdorferi B31
EAIAVNIYAA

SEQ ID NO: 25314 - protein, 10 aa, Borrelia burgdorferi B31
AIAVNIYAAN

SEQ ID NO: 25315 - protein, 10 aa, Borrelia burgdorferi B31
IAVNIYAANV

SEQ ID NO: 25316 - protein, 10 aa, Borrelia burgdorferi B31
AVNIYAANVA

SEQ ID NO: 25317 - protein, 10 aa, Borrelia burgdorferi B31
VNIYAANVAN

SEQ ID NO: 25318 - protein, 10 aa, Borrelia burgdorferi B31
NIYAANVANL

SEQ ID NO: 25319 - protein, 10 aa, Borrelia burgdorferi B31
IYAANVANLF

SEQ ID NO: 25320 - protein, 10 aa, Borrelia burgdorferi B31
YAANVANLFS

SEQ ID NO: 25321 - protein, 10 aa, Borrelia burgdorferi B31
AANVANLFSG

SEQ ID NO: 25322 - protein, 10 aa, Borrelia burgdorferi B31
ANVANLFSGE

SEQ ID NO: 25323 - protein, 10 aa, Borrelia burgdorferi B31
NVANLFSGEG

SEQ ID NO: 25324 - protein, 10 aa, Borrelia burgdorferi B31
VANLFSGEGA

SEQ ID NO: 25325 - protein, 10 aa, Borrelia burgdorferi B31
ANLFSGEGAQ

SEQ ID NO: 25326 - protein, 10 aa, Borrelia burgdorferi B31
NLFSGEGAQT

SEQ ID NO: 25327 - protein, 10 aa, Borrelia burgdorferi B31
LFSGEGAQTA

SEQ ID NO: 25328 - protein, 10 aa, Borrelia burgdorferi B31
FSGEGAQTAQ

SEQ ID NO: 25329 - protein, 10 aa, Borrelia burgdorferi B31
SGEGAQTAQA

SEQ ID NO: 25330 - protein, 10 aa, Borrelia burgdorferi B31
GEGAQTAQAA

SEQ ID NO: 25331 - protein, 10 aa, Borrelia burgdorferi B31
EGAQTAQAAP

SEQ ID NO: 25332 - protein, 10 aa, Borrelia burgdorferi B31
GAQTAQAAPV

SEQ ID NO: 25333 - protein, 10 aa, Borrelia burgdorferi B31
AQTAQAAPVQ

SEQ ID NO: 25334 - protein, 10 aa, Borrelia burgdorferi B31
QTAQAAPVQE

SEQ ID NO: 25335 - protein, 10 aa, Borrelia burgdorferi B31
TAQAAPVQEG

SEQ ID NO: 25336 - protein, 10 aa, Borrelia burgdorferi B31
AQAAPVQEGV

SEQ ID NO: 25337 - protein, 10 aa, Borrelia burgdorferi B31
QAAPVQEGVQ

SEQ ID NO: 25338 - protein, 10 aa, Borrelia burgdorferi B31
AAPVQEGVQQ

SEQ ID NO: 25339 - protein, 10 aa, Borrelia burgdorferi B31
APVQEGVQQE

SEQ ID NO: 25340 - protein, 10 aa, Borrelia burgdorferi B31
PVQEGVQQEG

SEQ ID NO: 25341 - protein, 10 aa, Borrelia burgdorferi B31
VQEGVQQEGA

SEQ ID NO: 25342 - protein, 10 aa, Borrelia burgdorferi B31
QEGVQQEGAQ

SEQ ID NO: 25343 - protein, 10 aa, Borrelia burgdorferi B31
EGVQQEGAQQ

SEQ ID NO: 25344 - protein, 10 aa, Borrelia burgdorferi B31
GVQQEGAQQP

SEQ ID NO: 25345 - protein, 10 aa, Borrelia burgdorferi B31
VQQEGAQQPA

SEQ ID NO: 25346 - protein, 10 aa, Borrelia burgdorferi B31
QQEGAQQPAP

SEQ ID NO: 25347 - protein, 10 aa, Borrelia burgdorferi B31
QEGAQQPAPA

SEQ ID NO: 25348 - protein, 10 aa, Borrelia burgdorferi B31
EGAQQPAPAT

SEQ ID NO: 25349 - protein, 10 aa, Borrelia burgdorferi B31
GAQQPAPATA

SEQ ID NO: 25350 - protein, 10 aa, Borrelia burgdorferi B31
AQQPAPATAP

SEQ ID NO: 25351 - protein, 10 aa, Borrelia burgdorferi B31
QQPAPATAPS

SEQ ID NO: 25352 - protein, 10 aa, Borrelia burgdorferi B31
QPAPATAPSQ

SEQ ID NO: 25353 - protein, 10 aa, Borrelia burgdorferi B31
PAPATAPSQG

SEQ ID NO: 25354 - protein, 10 aa, Borrelia burgdorferi B31
APATAPSQGG

SEQ ID NO: 25355 - protein, 10 aa, Borrelia burgdorferi B31
PATAPSQGGV

SEQ ID NO: 25356 - protein, 10 aa, Borrelia burgdorferi B31
ATAPSQGGVN

SEQ ID NO: 25357 - protein, 10 aa, Borrelia burgdorferi B31
TAPSQGGVNS

SEQ ID NO: 25358 - protein, 10 aa, Borrelia burgdorferi B31
APSQGGVNSP

SEQ ID NO: 25359 - protein, 10 aa, Borrelia burgdorferi B31
PSQGGVNSPV

SEQ ID NO: 25360 - protein, 10 aa, Borrelia burgdorferi B31
SQGGVNSPVN

SEQ ID NO: 25361 - protein, 10 aa, Borrelia burgdorferi B31
QGGVNSPVNV

SEQ ID NO: 25362 - protein, 10 aa, Borrelia burgdorferi B31
GGVNSPVNVT

SEQ ID NO: 25363 - protein, 10 aa, Borrelia burgdorferi B31
GVNSPVNVTT

SEQ ID NO: 25364 - protein, 10 aa, Borrelia burgdorferi B31
VNSPVNVTTT

SEQ ID NO: 25365 - protein, 10 aa, Borrelia burgdorferi B31
NSPVNVTTTV

SEQ ID NO: 25366 - protein, 10 aa, Borrelia burgdorferi B31
SPVNVTTTVD

SEQ ID NO: 25367 - protein, 10 aa, Borrelia burgdorferi B31
PVNVTTTVDA

SEQ ID NO: 25368 - protein, 10 aa, Borrelia burgdorferi B31
VNVTTTVDAN

SEQ ID NO: 25369 - protein, 10 aa, Borrelia burgdorferi B31
NVTTTVDANT

SEQ ID NO: 25370 - protein, 10 aa, Borrelia burgdorferi B31
VTTTVDANTS

SEQ ID NO: 25371 - protein, 10 aa, Borrelia burgdorferi B31
TTTVDANTSL

SEQ ID NO: 25372 - protein, 10 aa, Borrelia burgdorferi B31
TTVDANTSLA

SEQ ID NO: 25373 - protein, 10 aa, Borrelia burgdorferi B31
TVDANTSLAK

SEQ ID NO: 25374 - protein, 10 aa, Borrelia burgdorferi B31
VDANTSLAKI

SEQ ID NO: 25375 - protein, 10 aa, Borrelia burgdorferi B31
DANTSLAKIE

SEQ ID NO: 25376 - protein, 10 aa, Borrelia burgdorferi B31
ANTSLAKIEN

SEQ ID NO: 25377 - protein, 10 aa, Borrelia burgdorferi B31
NTSLAKIENA

SEQ ID NO: 25378 - protein, 10 aa, Borrelia burgdorferi B31
TSLAKIENAI

SEQ ID NO: 25379 - protein, 10 aa, Borrelia burgdorferi B31
SLAKIENAIR

SEQ ID NO: 25380 - protein, 10 aa, Borrelia burgdorferi B31
LAKIENAIRM

SEQ ID NO: 25381 - protein, 10 aa, Borrelia burgdorferi B31
AKIENAIRMI

SEQ ID NO: 25382 - protein, 10 aa, Borrelia burgdorferi B31
KIENAIRMIS

SEQ ID NO: 25383 - protein, 10 aa, Borrelia burgdorferi B31
IENAIRMISD

SEQ ID NO: 25384 - protein, 10 aa, Borrelia burgdorferi B31
ENAIRMISDQ

SEQ ID NO: 25385 - protein, 10 aa, Borrelia burgdorferi B31
NAIRMISDQR

SEQ ID NO: 25386 - protein, 10 aa, Borrelia burgdorferi B31
AIRMISDQRA

SEQ ID NO: 25387 - protein, 10 aa, Borrelia burgdorferi B31
IRMISDQRAN

SEQ ID NO: 25388 - protein, 10 aa, Borrelia burgdorferi B31
RMISDQRANL

SEQ ID NO: 25389 - protein, 10 aa, Borrelia burgdorferi B31
MISDQRANLG

SEQ ID NO: 25390 - protein, 10 aa, Borrelia burgdorferi B31
ISDQRANLGA

SEQ ID NO: 25391 - protein, 10 aa, Borrelia burgdorferi B31
SDQRANLGAF

SEQ ID NO: 25392 - protein, 10 aa, Borrelia burgdorferi B31
DQRANLGAFQ

SEQ ID NO: 25393 - protein, 10 aa, Borrelia burgdorferi B31
QRANLGAFQN

SEQ ID NO: 25394 - protein, 10 aa, Borrelia burgdorferi B31
RANLGAFQNR

SEQ ID NO: 25395 - protein, 10 aa, Borrelia burgdorferi B31
ANLGAFQNRL

SEQ ID NO: 25396 - protein, 10 aa, Borrelia burgdorferi B31
NLGAFQNRLE

SEQ ID NO: 25397 - protein, 10 aa, Borrelia burgdorferi B31
LGAFQNRLES

SEQ ID NO: 25398 - protein, 10 aa, Borrelia burgdorferi B31
GAFQNRLESI

SEQ ID NO: 25399 - protein, 10 aa, Borrelia burgdorferi B31
AFQNRLESIK

SEQ ID NO: 25400 - protein, 10 aa, Borrelia burgdorferi B31
FQNRLESIKN

SEQ ID NO: 25401 - protein, 10 aa, Borrelia burgdorferi B31
QNRLESIKNS

SEQ ID NO: 25402 - protein, 10 aa, Borrelia burgdorferi B31
NRLESIKNST

SEQ ID NO: 25403 - protein, 10 aa, Borrelia burgdorferi B31
RLESIKNSTE

SEQ ID NO: 25404 - protein, 10 aa, Borrelia burgdorferi B31
LESIKNSTEY

SEQ ID NO: 25405 - protein, 10 aa, Borrelia burgdorferi B31
ESIKNSTEYA

SEQ ID NO: 25406 - protein, 10 aa, Borrelia burgdorferi B31
SIKNSTEYAI

SEQ ID NO: 25407 - protein, 10 aa, Borrelia burgdorferi B31
IKNSTEYAIE

SEQ ID NO: 25408 - protein, 10 aa, Borrelia burgdorferi B31
KNSTEYAIEN

SEQ ID NO: 25409 - protein, 10 aa, Borrelia burgdorferi B31
NSTEYAIENL

SEQ ID NO: 25410 - protein, 10 aa, Borrelia burgdorferi B31
STEYAIENLK

SEQ ID NO: 25411 - protein, 10 aa, Borrelia burgdorferi B31
TEYAIENLKA

SEQ ID NO: 25412 - protein, 10 aa, Borrelia burgdorferi B31
EYAIENLKAS

SEQ ID NO: 25413 - protein, 10 aa, Borrelia burgdorferi B31
YAIENLKASY

SEQ ID NO: 25414 - protein, 10 aa, Borrelia burgdorferi B31
AIENLKASYA

SEQ ID NO: 25415 - protein, 10 aa, Borrelia burgdorferi B31
IENLKASYAQ

SEQ ID NO: 25416 - protein, 10 aa, Borrelia burgdorferi B31
ENLKASYAQI

SEQ ID NO: 25417 - protein, 10 aa, Borrelia burgdorferi B31
NLKASYAQIK

SEQ ID NO: 25418 - protein, 10 aa, Borrelia burgdorferi B31
LKASYAQIKD

SEQ ID NO: 25419 - protein, 10 aa, Borrelia burgdorferi B31
KASYAQIKDA

SEQ ID NO: 25420 - protein, 10 aa, Borrelia burgdorferi B31
ASYAQIKDAT

SEQ ID NO: 25421 - protein, 10 aa, Borrelia burgdorferi B31
SYAQIKDATM

SEQ ID NO: 25422 - protein, 10 aa, Borrelia burgdorferi B31
YAQIKDATMT

SEQ ID NO: 25423 - protein, 10 aa, Borrelia burgdorferi B31
AQIKDATMTD

SEQ ID NO: 25424 - protein, 10 aa, Borrelia burgdorferi B31
QIKDATMTDE

SEQ ID NO: 25425 - protein, 10 aa, Borrelia burgdorferi B31
IKDATMTDEV

SEQ ID NO: 25426 - protein, 10 aa, Borrelia burgdorferi B31
KDATMTDEVV

SEQ ID NO: 25427 - protein, 10 aa, Borrelia burgdorferi B31
DATMTDEVVA

SEQ ID NO: 25428 - protein, 10 aa, Borrelia burgdorferi B31
ATMTDEVVAA

SEQ ID NO: 25429 - protein, 10 aa, Borrelia burgdorferi B31
TMTDEVVAAT

SEQ ID NO: 25430 - protein, 10 aa, Borrelia burgdorferi B31
MTDEVVAATT

SEQ ID NO: 25431 - protein, 10 aa, Borrelia burgdorferi B31
TDEVVAATTN

SEQ ID NO: 25432 - protein, 10 aa, Borrelia burgdorferi B31
DEVVAATTNS

SEQ ID NO: 25433 - protein, 10 aa, Borrelia burgdorferi B31
EVVAATTNSI

SEQ ID NO: 25434 - protein, 10 aa, Borrelia burgdorferi B31
VVAATTNSIL

SEQ ID NO: 25435 - protein, 10 aa, Borrelia burgdorferi B31
VAATTNSILT

SEQ ID NO: 25436 - protein, 10 aa, Borrelia burgdorferi B31
AATTNSILTQ

SEQ ID NO: 25437 - protein, 10 aa, Borrelia burgdorferi B31
ATTNSILTQS

SEQ ID NO: 25438 - protein, 10 aa, Borrelia burgdorferi B31
TTNSILTQSA

SEQ ID NO: 25439 - protein, 10 aa, Borrelia burgdorferi B31
TNSILTQSAM

SEQ ID NO: 25440 - protein, 10 aa, Borrelia burgdorferi B31
NSILTQSAMA

SEQ ID NO: 25441 - protein, 10 aa, Borrelia burgdorferi B31
SILTQSAMAM

SEQ ID NO: 25442 - protein, 10 aa, Borrelia burgdorferi B31
ILTQSAMAMI

SEQ ID NO: 25443 - protein, 10 aa, Borrelia burgdorferi B31
LTQSAMAMIA

SEQ ID NO: 25444 - protein, 10 aa, Borrelia burgdorferi B31
TQSAMAMIAQ

SEQ ID NO: 25445 - protein, 10 aa, Borrelia burgdorferi B31
QSAMAMIAQA

SEQ ID NO: 25446 - protein, 10 aa, Borrelia burgdorferi B31
SAMAMIAQAN

SEQ ID NO: 25447 - protein, 10 aa, Borrelia burgdorferi B31
AMAMIAQANQ

SEQ ID NO: 25448 - protein, 10 aa, Borrelia burgdorferi B31
MAMIAQANQV

SEQ ID NO: 25449 - protein, 10 aa, Borrelia burgdorferi B31
AMIAQANQVP

SEQ ID NO: 25450 - protein, 10 aa, Borrelia burgdorferi B31
MIAQANQVPQ

SEQ ID NO: 25451 - protein, 10 aa, Borrelia burgdorferi B31
IAQANQVPQY

SEQ ID NO: 25452 - protein, 10 aa, Borrelia burgdorferi B31
AQANQVPQYV

SEQ ID NO: 25453 - protein, 10 aa, Borrelia burgdorferi B31
QANQVPQYVL

SEQ ID NO: 25454 - protein, 10 aa, Borrelia burgdorferi B31
ANQVPQYVLS

SEQ ID NO: 25455 - protein, 10 aa, Borrelia burgdorferi B31
NQVPQYVLSL

SEQ ID NO: 25456 - protein, 10 aa, Borrelia burgdorferi B31
QVPQYVLSLL

SEQ ID NO: 25457 - protein, 10 aa, Borrelia burgdorferi B31
VPQYVLSLLR

SEQ ID NO: 25458 - protein, 11 aa, Borrelia burgdorferi B31
MIINHNTSAIN

SEQ ID NO: 25459 - protein, 11 aa, Borrelia burgdorferi B31
IINHNTSAINA

SEQ ID NO: 25460 - protein, 11 aa, Borrelia burgdorferi B31
INHNTSAINAS

SEQ ID NO: 25461 - protein, 11 aa, Borrelia burgdorferi B31
NHNTSAINASR

SEQ ID NO: 25462 - protein, 11 aa, Borrelia burgdorferi B31
HNTSAINASRN

SEQ ID NO: 25463 - protein, 11 aa, Borrelia burgdorferi B31
NTSAINASRNN

SEQ ID NO: 25464 - protein, 11 aa, Borrelia burgdorferi B31
TSAINASRNNG

SEQ ID NO: 25465 - protein, 11 aa, Borrelia burgdorferi B31
SAINASRNNGI

SEQ ID NO: 25466 - protein, 11 aa, Borrelia burgdorferi B31
AINASRNNGIN

SEQ ID NO: 25467 - protein, 11 aa, Borrelia burgdorferi B31
INASRNNGINA

SEQ ID NO: 25468 - protein, 11 aa, Borrelia burgdorferi B31
NASRNNGINAA

SEQ ID NO: 25469 - protein, 11 aa, Borrelia burgdorferi B31
ASRNNGINAAN

SEQ ID NO: 25470 - protein, 11 aa, Borrelia burgdorferi B31
SRNNGINAANL

SEQ ID NO: 25471 - protein, 11 aa, Borrelia burgdorferi B31
RNNGINAANLS

SEQ ID NO: 25472 - protein, 11 aa, Borrelia burgdorferi B31
NNGINAANLSK

SEQ ID NO: 25473 - protein, 11 aa, Borrelia burgdorferi B31
NGINAANLSKT

SEQ ID NO: 25474 - protein, 11 aa, Borrelia burgdorferi B31
GINAANLSKTQ

SEQ ID NO: 25475 - protein, 11 aa, Borrelia burgdorferi B31
INAANLSKTQE

SEQ ID NO: 25476 - protein, 11 aa, Borrelia burgdorferi B31
NAANLSKTQEK

SEQ ID NO: 25477 - protein, 11 aa, Borrelia burgdorferi B31
AANLSKTQEKL

SEQ ID NO: 25478 - protein, 11 aa, Borrelia burgdorferi B31
ANLSKTQEKLS

SEQ ID NO: 25479 - protein, 11 aa, Borrelia burgdorferi B31
NLSKTQEKLSS

SEQ ID NO: 25480 - protein, 11 aa, Borrelia burgdorferi B31
LSKTQEKLSSG

SEQ ID NO: 25481 - protein, 11 aa, Borrelia burgdorferi B31
SKTQEKLSSGY

SEQ ID NO: 25482 - protein, 11 aa, Borrelia burgdorferi B31
KTQEKLSSGYR

SEQ ID NO: 25483 - protein, 11 aa, Borrelia burgdorferi B31
TQEKLSSGYRI

SEQ ID NO: 25484 - protein, 11 aa, Borrelia burgdorferi B31
QEKLSSGYRIN

SEQ ID NO: 25485 - protein, 11 aa, Borrelia burgdorferi B31
EKLSSGYRINR

SEQ ID NO: 25486 - protein, 11 aa, Borrelia burgdorferi B31
KLSSGYRINRA

SEQ ID NO: 25487 - protein, 11 aa, Borrelia burgdorferi B31
LSSGYRINRAS

SEQ ID NO: 25488 - protein, 11 aa, Borrelia burgdorferi B31
SSGYRINRASD

SEQ ID NO: 25489 - protein, 11 aa, Borrelia burgdorferi B31
SGYRINRASDD

SEQ ID NO: 25490 - protein, 11 aa, Borrelia burgdorferi B31
GYRINRASDDA

SEQ ID NO: 25491 - protein, 11 aa, Borrelia burgdorferi B31
YRINRASDDAA

SEQ ID NO: 25492 - protein, 11 aa, Borrelia burgdorferi B31
RINRASDDAAG

SEQ ID NO: 25493 - protein, 11 aa, Borrelia burgdorferi B31
INRASDDAAGM

SEQ ID NO: 25494 - protein, 11 aa, Borrelia burgdorferi B31
NRASDDAAGMG

SEQ ID NO: 25495 - protein, 11 aa, Borrelia burgdorferi B31
RASDDAAGMGV

SEQ ID NO: 25496 - protein, 11 aa, Borrelia burgdorferi B31
ASDDAAGMGVS

SEQ ID NO: 25497 - protein, 11 aa, Borrelia burgdorferi B31
SDDAAGMGVSG

SEQ ID NO: 25498 - protein, 11 aa, Borrelia burgdorferi B31
DDAAGMGVSGK

SEQ ID NO: 25499 - protein, 11 aa, Borrelia burgdorferi B31
DAAGMGVSGKI

SEQ ID NO: 25500 - protein, 11 aa, Borrelia burgdorferi B31
AAGMGVSGKIN

SEQ ID NO: 25501 - protein, 11 aa, Borrelia burgdorferi B31
AGMGVSGKINA

SEQ ID NO: 25502 - protein, 11 aa, Borrelia burgdorferi B31
GMGVSGKINAQ

SEQ ID NO: 25503 - protein, 11 aa, Borrelia burgdorferi B31
MGVSGKINAQI

SEQ ID NO: 25504 - protein, 11 aa, Borrelia burgdorferi B31
GVSGKINAQIR

SEQ ID NO: 25505 - protein, 11 aa, Borrelia burgdorferi B31
VSGKINAQIRG

SEQ ID NO: 25506 - protein, 11 aa, Borrelia burgdorferi B31
SGKINAQIRGL

SEQ ID NO: 25507 - protein, 11 aa, Borrelia burgdorferi B31
GKINAQIRGLS

SEQ ID NO: 25508 - protein, 11 aa, Borrelia burgdorferi B31
KINAQIRGLSQ

SEQ ID NO: 25509 - protein, 11 aa, Borrelia burgdorferi B31
INAQIRGLSQA

SEQ ID NO: 25510 - protein, 11 aa, Borrelia burgdorferi B31
NAQIRGLSQAS

SEQ ID NO: 25511 - protein, 11 aa, Borrelia burgdorferi B31
AQIRGLSQASR

SEQ ID NO: 25512 - protein, 11 aa, Borrelia burgdorferi B31
QIRGLSQASRN

SEQ ID NO: 25513 - protein, 11 aa, Borrelia burgdorferi B31
IRGLSQASRNT

SEQ ID NO: 25514 - protein, 11 aa, Borrelia burgdorferi B31
RGLSQASRNTS

SEQ ID NO: 25515 - protein, 11 aa, Borrelia burgdorferi B31
GLSQASRNTSK

SEQ ID NO: 25516 - protein, 11 aa, Borrelia burgdorferi B31
LSQASRNTSKA

SEQ ID NO: 25517 - protein, 11 aa, Borrelia burgdorferi B31
SQASRNTSKAI

SEQ ID NO: 25518 - protein, 11 aa, Borrelia burgdorferi B31
QASRNTSKAIN

SEQ ID NO: 25519 - protein, 11 aa, Borrelia burgdorferi B31
ASRNTSKAINF

SEQ ID NO: 25520 - protein, 11 aa, Borrelia burgdorferi B31
SRNTSKAINFI

SEQ ID NO: 25521 - protein, 11 aa, Borrelia burgdorferi B31
RNTSKAINFIQ

SEQ ID NO: 25522 - protein, 11 aa, Borrelia burgdorferi B31
NTSKAINFIQT

SEQ ID NO: 25523 - protein, 11 aa, Borrelia burgdorferi B31
TSKAINFIQTT

SEQ ID NO: 25524 - protein, 11 aa, Borrelia burgdorferi B31
SKAINFIQTTE

SEQ ID NO: 25525 - protein, 11 aa, Borrelia burgdorferi B31
KAINFIQTTEG

SEQ ID NO: 25526 - protein, 11 aa, Borrelia burgdorferi B31
AINFIQTTEGN

SEQ ID NO: 25527 - protein, 11 aa, Borrelia burgdorferi B31
INFIQTTEGNL

SEQ ID NO: 25528 - protein, 11 aa, Borrelia burgdorferi B31
NFIQTTEGNLN

SEQ ID NO: 25529 - protein, 11 aa, Borrelia burgdorferi B31
FIQTTEGNLNE

SEQ ID NO: 25530 - protein, 11 aa, Borrelia burgdorferi B31
IQTTEGNLNEV

SEQ ID NO: 25531 - protein, 11 aa, Borrelia burgdorferi B31
QTTEGNLNEVE

SEQ ID NO: 25532 - protein, 11 aa, Borrelia burgdorferi B31
TTEGNLNEVEK

SEQ ID NO: 25533 - protein, 11 aa, Borrelia burgdorferi B31
TEGNLNEVEKV

SEQ ID NO: 25534 - protein, 11 aa, Borrelia burgdorferi B31
EGNLNEVEKVL

SEQ ID NO: 25535 - protein, 11 aa, Borrelia burgdorferi B31
GNLNEVEKVLV

SEQ ID NO: 25536 - protein, 11 aa, Borrelia burgdorferi B31
NLNEVEKVLVR

SEQ ID NO: 25537 - protein, 11 aa, Borrelia burgdorferi B31
LNEVEKVLVRM

SEQ ID NO: 25538 - protein, 11 aa, Borrelia burgdorferi B31
NEVEKVLVRMK

SEQ ID NO: 25539 - protein, 11 aa, Borrelia burgdorferi B31
EVEKVLVRMKE

SEQ ID NO: 25540 - protein, 11 aa, Borrelia burgdorferi B31
VEKVLVRMKEL

SEQ ID NO: 25541 - protein, 11 aa, Borrelia burgdorferi B31
EKVLVRMKELA

SEQ ID NO: 25542 - protein, 11 aa, Borrelia burgdorferi B31
KVLVRMKELAV

SEQ ID NO: 25543 - protein, 11 aa, Borrelia burgdorferi B31
VLVRMKELAVQ

SEQ ID NO: 25544 - protein, 11 aa, Borrelia burgdorferi B31
LVRMKELAVQS

SEQ ID NO: 25545 - protein, 11 aa, Borrelia burgdorferi B31
VRMKELAVQSG

SEQ ID NO: 25546 - protein, 11 aa, Borrelia burgdorferi B31
RMKELAVQSGN

SEQ ID NO: 25547 - protein, 11 aa, Borrelia burgdorferi B31
MKELAVQSGNG

SEQ ID NO: 25548 - protein, 11 aa, Borrelia burgdorferi B31
KELAVQSGNGT

SEQ ID NO: 25549 - protein, 11 aa, Borrelia burgdorferi B31
ELAVQSGNGTY

SEQ ID NO: 25550 - protein, 11 aa, Borrelia burgdorferi B31
LAVQSGNGTYS

SEQ ID NO: 25551 - protein, 11 aa, Borrelia burgdorferi B31
AVQSGNGTYSD

SEQ ID NO: 25552 - protein, 11 aa, Borrelia burgdorferi B31
VQSGNGTYSDA

SEQ ID NO: 25553 - protein, 11 aa, Borrelia burgdorferi B31
QSGNGTYSDAD

SEQ ID NO: 25554 - protein, 11 aa, Borrelia burgdorferi B31
SGNGTYSDADR

SEQ ID NO: 25555 - protein, 11 aa, Borrelia burgdorferi B31
GNGTYSDADRG

SEQ ID NO: 25556 - protein, 11 aa, Borrelia burgdorferi B31
NGTYSDADRGS

SEQ ID NO: 25557 - protein, 11 aa, Borrelia burgdorferi B31
GTYSDADRGSI

SEQ ID NO: 25558 - protein, 11 aa, Borrelia burgdorferi B31
TYSDADRGSIQ

SEQ ID NO: 25559 - protein, 11 aa, Borrelia burgdorferi B31
YSDADRGSIQI

SEQ ID NO: 25560 - protein, 11 aa, Borrelia burgdorferi B31
SDADRGSIQIE

SEQ ID NO: 25561 - protein, 11 aa, Borrelia burgdorferi B31
DADRGSIQIEI

SEQ ID NO: 25562 - protein, 11 aa, Borrelia burgdorferi B31
ADRGSIQIEIE

SEQ ID NO: 25563 - protein, 11 aa, Borrelia burgdorferi B31
DRGSIQIEIEQ

SEQ ID NO: 25564 - protein, 11 aa, Borrelia burgdorferi B31
RGSIQIEIEQL

SEQ ID NO: 25565 - protein, 11 aa, Borrelia burgdorferi B31
GSIQIEIEQLT

SEQ ID NO: 25566 - protein, 11 aa, Borrelia burgdorferi B31
SIQIEIEQLTD

SEQ ID NO: 25567 - protein, 11 aa, Borrelia burgdorferi B31
IQIEIEQLTDE

SEQ ID NO: 25568 - protein, 11 aa, Borrelia burgdorferi B31
QIEIEQLTDEI

SEQ ID NO: 25569 - protein, 11 aa, Borrelia burgdorferi B31
IEIEQLTDEIN

SEQ ID NO: 25570 - protein, 11 aa, Borrelia burgdorferi B31
EIEQLTDEINR

SEQ ID NO: 25571 - protein, 11 aa, Borrelia burgdorferi B31
IEQLTDEINRI

SEQ ID NO: 25572 - protein, 11 aa, Borrelia burgdorferi B31
EQLTDEINRIA

SEQ ID NO: 25573 - protein, 11 aa, Borrelia burgdorferi B31
QLTDEINRIAD

SEQ ID NO: 25574 - protein, 11 aa, Borrelia burgdorferi B31
LTDEINRIADQ

SEQ ID NO: 25575 - protein, 11 aa, Borrelia burgdorferi B31
TDEINRIADQA

SEQ ID NO: 25576 - protein, 11 aa, Borrelia burgdorferi B31
DEINRIADQAQ

SEQ ID NO: 25577 - protein, 11 aa, Borrelia burgdorferi B31
EINRIADQAQY

SEQ ID NO: 25578 - protein, 11 aa, Borrelia burgdorferi B31
INRIADQAQYN

SEQ ID NO: 25579 - protein, 11 aa, Borrelia burgdorferi B31
NRIADQAQYNQ

SEQ ID NO: 25580 - protein, 11 aa, Borrelia burgdorferi B31
RIADQAQYNQM

SEQ ID NO: 25581 - protein, 11 aa, Borrelia burgdorferi B31
IADQAQYNQMH

SEQ ID NO: 25582 - protein, 11 aa, Borrelia burgdorferi B31
ADQAQYNQMHM

SEQ ID NO: 25583 - protein, 11 aa, Borrelia burgdorferi B31
DQAQYNQMHML

SEQ ID NO: 25584 - protein, 11 aa, Borrelia burgdorferi B31
QAQYNQMHMLS

SEQ ID NO: 25585 - protein, 11 aa, Borrelia burgdorferi B31
AQYNQMHMLSN

SEQ ID NO: 25586 - protein, 11 aa, Borrelia burgdorferi B31
QYNQMHMLSNK

SEQ ID NO: 25587 - protein, 11 aa, Borrelia burgdorferi B31
YNQMHMLSNKS

SEQ ID NO: 25588 - protein, 11 aa, Borrelia burgdorferi B31
NQMHMLSNKSA

SEQ ID NO: 25589 - protein, 11 aa, Borrelia burgdorferi B31
QMHMLSNKSAS

SEQ ID NO: 25590 - protein, 11 aa, Borrelia burgdorferi B31
MHMLSNKSASQ

SEQ ID NO: 25591 - protein, 11 aa, Borrelia burgdorferi B31
HMLSNKSASQN

SEQ ID NO: 25592 - protein, 11 aa, Borrelia burgdorferi B31
MLSNKSASQNV

SEQ ID NO: 25593 - protein, 11 aa, Borrelia burgdorferi B31
LSNKSASQNVR

SEQ ID NO: 25594 - protein, 11 aa, Borrelia burgdorferi B31
SNKSASQNVRT

SEQ ID NO: 25595 - protein, 11 aa, Borrelia burgdorferi B31
NKSASQNVRTA

SEQ ID NO: 25596 - protein, 11 aa, Borrelia burgdorferi B31
KSASQNVRTAE

SEQ ID NO: 25597 - protein, 11 aa, Borrelia burgdorferi B31
SASQNVRTAEE

SEQ ID NO: 25598 - protein, 11 aa, Borrelia burgdorferi B31
ASQNVRTAEEL

SEQ ID NO: 25599 - protein, 11 aa, Borrelia burgdorferi B31
SQNVRTAEELG

SEQ ID NO: 25600 - protein, 11 aa, Borrelia burgdorferi B31
QNVRTAEELGM

SEQ ID NO: 25601 - protein, 11 aa, Borrelia burgdorferi B31
NVRTAEELGMQ

SEQ ID NO: 25602 - protein, 11 aa, Borrelia burgdorferi B31
VRTAEELGMQP

SEQ ID NO: 25603 - protein, 11 aa, Borrelia burgdorferi B31
RTAEELGMQPA

SEQ ID NO: 25604 - protein, 11 aa, Borrelia burgdorferi B31
TAEELGMQPAK

SEQ ID NO: 25605 - protein, 11 aa, Borrelia burgdorferi B31
AEELGMQPAKI

SEQ ID NO: 25606 - protein, 11 aa, Borrelia burgdorferi B31
EELGMQPAKIN

SEQ ID NO: 25607 - protein, 11 aa, Borrelia burgdorferi B31
ELGMQPAKINT

SEQ ID NO: 25608 - protein, 11 aa, Borrelia burgdorferi B31
LGMQPAKINTP

SEQ ID NO: 25609 - protein, 11 aa, Borrelia burgdorferi B31
GMQPAKINTPA

SEQ ID NO: 25610 - protein, 11 aa, Borrelia burgdorferi B31
MQPAKINTPAS

SEQ ID NO: 25611 - protein, 11 aa, Borrelia burgdorferi B31
QPAKINTPASL

SEQ ID NO: 25612 - protein, 11 aa, Borrelia burgdorferi B31
PAKINTPASLS

SEQ ID NO: 25613 - protein, 11 aa, Borrelia burgdorferi B31
AKINTPASLSG

SEQ ID NO: 25614 - protein, 11 aa, Borrelia burgdorferi B31
KINTPASLSGS

SEQ ID NO: 25615 - protein, 11 aa, Borrelia burgdorferi B31
INTPASLSGSQ

SEQ ID NO: 25616 - protein, 11 aa, Borrelia burgdorferi B31
NTPASLSGSQA

SEQ ID NO: 25617 - protein, 11 aa, Borrelia burgdorferi B31
TPASLSGSQAS

SEQ ID NO: 25618 - protein, 11 aa, Borrelia burgdorferi B31
PASLSGSQASW

SEQ ID NO: 25619 - protein, 11 aa, Borrelia burgdorferi B31
ASLSGSQASWT

SEQ ID NO: 25620 - protein, 11 aa, Borrelia burgdorferi B31
SLSGSQASWTL

SEQ ID NO: 25621 - protein, 11 aa, Borrelia burgdorferi B31
LSGSQASWTLR

SEQ ID NO: 25622 - protein, 11 aa, Borrelia burgdorferi B31
SGSQASWTLRV

SEQ ID NO: 25623 - protein, 11 aa, Borrelia burgdorferi B31
GSQASWTLRVH

SEQ ID NO: 25624 - protein, 11 aa, Borrelia burgdorferi B31
SQASWTLRVHV

SEQ ID NO: 25625 - protein, 11 aa, Borrelia burgdorferi B31
QASWTLRVHVG

SEQ ID NO: 25626 - protein, 11 aa, Borrelia burgdorferi B31
ASWTLRVHVGA

SEQ ID NO: 25627 - protein, 11 aa, Borrelia burgdorferi B31
SWTLRVHVGAN

SEQ ID NO: 25628 - protein, 11 aa, Borrelia burgdorferi B31
WTLRVHVGANQ

SEQ ID NO: 25629 - protein, 11 aa, Borrelia burgdorferi B31
TLRVHVGANQD

SEQ ID NO: 25630 - protein, 11 aa, Borrelia burgdorferi B31
LRVHVGANQDE

SEQ ID NO: 25631 - protein, 11 aa, Borrelia burgdorferi B31
RVHVGANQDEA

SEQ ID NO: 25632 - protein, 11 aa, Borrelia burgdorferi B31
VHVGANQDEAI

SEQ ID NO: 25633 - protein, 11 aa, Borrelia burgdorferi B31
HVGANQDEAIA

SEQ ID NO: 25634 - protein, 11 aa, Borrelia burgdorferi B31
VGANQDEAIAV

SEQ ID NO: 25635 - protein, 11 aa, Borrelia burgdorferi B31
GANQDEAIAVN

SEQ ID NO: 25636 - protein, 11 aa, Borrelia burgdorferi B31
ANQDEAIAVNI

SEQ ID NO: 25637 - protein, 11 aa, Borrelia burgdorferi B31
NQDEAIAVNIY

SEQ ID NO: 25638 - protein, 11 aa, Borrelia burgdorferi B31
QDEAIAVNIYA

SEQ ID NO: 25639 - protein, 11 aa, Borrelia burgdorferi B31
DEAIAVNIYAA

SEQ ID NO: 25640 - protein, 11 aa, Borrelia burgdorferi B31
EAIAVNIYAAN

SEQ ID NO: 25641 - protein, 11 aa, Borrelia burgdorferi B31
AIAVNIYAANV

SEQ ID NO: 25642 - protein, 11 aa, Borrelia burgdorferi B31
IAVNIYAANVA

SEQ ID NO: 25643 - protein, 11 aa, Borrelia burgdorferi B31
AVNIYAANVAN

SEQ ID NO: 25644 - protein, 11 aa, Borrelia burgdorferi B31
VNIYAANVANL

SEQ ID NO: 25645 - protein, 11 aa, Borrelia burgdorferi B31
NIYAANVANLF

SEQ ID NO: 25646 - protein, 11 aa, Borrelia burgdorferi B31
IYAANVANLFS

SEQ ID NO: 25647 - protein, 11 aa, Borrelia burgdorferi B31
YAANVANLFSG

SEQ ID NO: 25648 - protein, 11 aa, Borrelia burgdorferi B31
AANVANLFSGE

SEQ ID NO: 25649 - protein, 11 aa, Borrelia burgdorferi B31
ANVANLFSGEG

SEQ ID NO: 25650 - protein, 11 aa, Borrelia burgdorferi B31
NVANLFSGEGA

SEQ ID NO: 25651 - protein, 11 aa, Borrelia burgdorferi B31
VANLFSGEGAQ

SEQ ID NO: 25652 - protein, 11 aa, Borrelia burgdorferi B31
ANLFSGEGAQT

SEQ ID NO: 25653 - protein, 11 aa, Borrelia burgdorferi B31
NLFSGEGAQTA

SEQ ID NO: 25654 - protein, 11 aa, Borrelia burgdorferi B31
LFSGEGAQTAQ

SEQ ID NO: 25655 - protein, 11 aa, Borrelia burgdorferi B31
FSGEGAQTAQA

SEQ ID NO: 25656 - protein, 11 aa, Borrelia burgdorferi B31
SGEGAQTAQAA

SEQ ID NO: 25657 - protein, 11 aa, Borrelia burgdorferi B31
GEGAQTAQAAP

SEQ ID NO: 25658 - protein, 11 aa, Borrelia burgdorferi B31
EGAQTAQAAPV

SEQ ID NO: 25659 - protein, 11 aa, Borrelia burgdorferi B31
GAQTAQAAPVQ

SEQ ID NO: 25660 - protein, 11 aa, Borrelia burgdorferi B31
AQTAQAAPVQE

SEQ ID NO: 25661 - protein, 11 aa, Borrelia burgdorferi B31
QTAQAAPVQEG

SEQ ID NO: 25662 - protein, 11 aa, Borrelia burgdorferi B31
TAQAAPVQEGV

SEQ ID NO: 25663 - protein, 11 aa, Borrelia burgdorferi B31
AQAAPVQEGVQ

SEQ ID NO: 25664 - protein, 11 aa, Borrelia burgdorferi B31
QAAPVQEGVQQ

SEQ ID NO: 25665 - protein, 11 aa, Borrelia burgdorferi B31
AAPVQEGVQQE

SEQ ID NO: 25666 - protein, 11 aa, Borrelia burgdorferi B31
APVQEGVQQEG

SEQ ID NO: 25667 - protein, 11 aa, Borrelia burgdorferi B31
PVQEGVQQEGA

SEQ ID NO: 25668 - protein, 11 aa, Borrelia burgdorferi B31
VQEGVQQEGAQ

SEQ ID NO: 25669 - protein, 11 aa, Borrelia burgdorferi B31
QEGVQQEGAQQ

SEQ ID NO: 25670 - protein, 11 aa, Borrelia burgdorferi B31
EGVQQEGAQQP

SEQ ID NO: 25671 - protein, 11 aa, Borrelia burgdorferi B31
GVQQEGAQQPA

SEQ ID NO: 25672 - protein, 11 aa, Borrelia burgdorferi B31
VQQEGAQQPAP

SEQ ID NO: 25673 - protein, 11 aa, Borrelia burgdorferi B31
QQEGAQQPAPA

SEQ ID NO: 25674 - protein, 11 aa, Borrelia burgdorferi B31
QEGAQQPAPAT

SEQ ID NO: 25675 - protein, 11 aa, Borrelia burgdorferi B31
EGAQQPAPATA

SEQ ID NO: 25676 - protein, 11 aa, Borrelia burgdorferi B31
GAQQPAPATAP

SEQ ID NO: 25677 - protein, 11 aa, Borrelia burgdorferi B31
AQQPAPATAPS

SEQ ID NO: 25678 - protein, 11 aa, Borrelia burgdorferi B31
QQPAPATAPSQ

SEQ ID NO: 25679 - protein, 11 aa, Borrelia burgdorferi B31
QPAPATAPSQG

SEQ ID NO: 25680 - protein, 11 aa, Borrelia burgdorferi B31
PAPATAPSQGG

SEQ ID NO: 25681 - protein, 11 aa, Borrelia burgdorferi B31
APATAPSQGGV

SEQ ID NO: 25682 - protein, 11 aa, Borrelia burgdorferi B31
PATAPSQGGVN

SEQ ID NO: 25683 - protein, 11 aa, Borrelia burgdorferi B31
ATAPSQGGVNS

SEQ ID NO: 25684 - protein, 11 aa, Borrelia burgdorferi B31
TAPSQGGVNSP

SEQ ID NO: 25685 - protein, 11 aa, Borrelia burgdorferi B31
APSQGGVNSPV

SEQ ID NO: 25686 - protein, 11 aa, Borrelia burgdorferi B31
PSQGGVNSPVN

SEQ ID NO: 25687 - protein, 11 aa, Borrelia burgdorferi B31
SQGGVNSPVNV

SEQ ID NO: 25688 - protein, 11 aa, Borrelia burgdorferi B31
QGGVNSPVNVT

SEQ ID NO: 25689 - protein, 11 aa, Borrelia burgdorferi B31
GGVNSPVNVTT

SEQ ID NO: 25690 - protein, 11 aa, Borrelia burgdorferi B31
GVNSPVNVTTT

SEQ ID NO: 25691 - protein, 11 aa, Borrelia burgdorferi B31
VNSPVNVTTTV

SEQ ID NO: 25692 - protein, 11 aa, Borrelia burgdorferi B31
NSPVNVTTTVD

SEQ ID NO: 25693 - protein, 11 aa, Borrelia burgdorferi B31
SPVNVTTTVDA

SEQ ID NO: 25694 - protein, 11 aa, Borrelia burgdorferi B31
PVNVTTTVDAN

SEQ ID NO: 25695 - protein, 11 aa, Borrelia burgdorferi B31
VNVTTTVDANT

SEQ ID NO: 25696 - protein, 11 aa, Borrelia burgdorferi B31
NVTTTVDANTS

SEQ ID NO: 25697 - protein, 11 aa, Borrelia burgdorferi B31
VTTTVDANTSL

SEQ ID NO: 25698 - protein, 11 aa, Borrelia burgdorferi B31
TTTVDANTSLA

SEQ ID NO: 25699 - protein, 11 aa, Borrelia burgdorferi B31
TTVDANTSLAK

SEQ ID NO: 25700 - protein, 11 aa, Borrelia burgdorferi B31
TVDANTSLAKI

SEQ ID NO: 25701 - protein, 11 aa, Borrelia burgdorferi B31
VDANTSLAKIE

SEQ ID NO: 25702 - protein, 11 aa, Borrelia burgdorferi B31
DANTSLAKIEN

SEQ ID NO: 25703 - protein, 11 aa, Borrelia burgdorferi B31
ANTSLAKIENA

SEQ ID NO: 25704 - protein, 11 aa, Borrelia burgdorferi B31
NTSLAKIENAI

SEQ ID NO: 25705 - protein, 11 aa, Borrelia burgdorferi B31
TSLAKIENAIR

SEQ ID NO: 25706 - protein, 11 aa, Borrelia burgdorferi B31
SLAKIENAIRM

SEQ ID NO: 25707 - protein, 11 aa, Borrelia burgdorferi B31
LAKIENAIRMI

SEQ ID NO: 25708 - protein, 11 aa, Borrelia burgdorferi B31
AKIENAIRMIS

SEQ ID NO: 25709 - protein, 11 aa, Borrelia burgdorferi B31
KIENAIRMISD

SEQ ID NO: 25710 - protein, 11 aa, Borrelia burgdorferi B31
IENAIRMISDQ

SEQ ID NO: 25711 - protein, 11 aa, Borrelia burgdorferi B31
ENAIRMISDQR

SEQ ID NO: 25712 - protein, 11 aa, Borrelia burgdorferi B31
NAIRMISDQRA

SEQ ID NO: 25713 - protein, 11 aa, Borrelia burgdorferi B31
AIRMISDQRAN

SEQ ID NO: 25714 - protein, 11 aa, Borrelia burgdorferi B31
IRMISDQRANL

SEQ ID NO: 25715 - protein, 11 aa, Borrelia burgdorferi B31
RMISDQRANLG

SEQ ID NO: 25716 - protein, 11 aa, Borrelia burgdorferi B31
MISDQRANLGA

SEQ ID NO: 25717 - protein, 11 aa, Borrelia burgdorferi B31
ISDQRANLGAF

SEQ ID NO: 25718 - protein, 11 aa, Borrelia burgdorferi B31
SDQRANLGAFQ

SEQ ID NO: 25719 - protein, 11 aa, Borrelia burgdorferi B31
DQRANLGAFQN

SEQ ID NO: 25720 - protein, 11 aa, Borrelia burgdorferi B31
QRANLGAFQNR

SEQ ID NO: 25721 - protein, 11 aa, Borrelia burgdorferi B31
RANLGAFQNRL

SEQ ID NO: 25722 - protein, 11 aa, Borrelia burgdorferi B31
ANLGAFQNRLE

SEQ ID NO: 25723 - protein, 11 aa, Borrelia burgdorferi B31
NLGAFQNRLES

SEQ ID NO: 25724 - protein, 11 aa, Borrelia burgdorferi B31
LGAFQNRLESI

SEQ ID NO: 25725 - protein, 11 aa, Borrelia burgdorferi B31
GAFQNRLESIK

SEQ ID NO: 25726 - protein, 11 aa, Borrelia burgdorferi B31
AFQNRLESIKN

SEQ ID NO: 25727 - protein, 11 aa, Borrelia burgdorferi B31
FQNRLESIKNS

SEQ ID NO: 25728 - protein, 11 aa, Borrelia burgdorferi B31
QNRLESIKNST

SEQ ID NO: 25729 - protein, 11 aa, Borrelia burgdorferi B31
NRLESIKNSTE

SEQ ID NO: 25730 - protein, 11 aa, Borrelia burgdorferi B31
RLESIKNSTEY

SEQ ID NO: 25731 - protein, 11 aa, Borrelia burgdorferi B31
LESIKNSTEYA

SEQ ID NO: 25732 - protein, 11 aa, Borrelia burgdorferi B31
ESIKNSTEYAI

SEQ ID NO: 25733 - protein, 11 aa, Borrelia burgdorferi B31
SIKNSTEYAIE

SEQ ID NO: 25734 - protein, 11 aa, Borrelia burgdorferi B31
IKNSTEYAIEN

SEQ ID NO: 25735 - protein, 11 aa, Borrelia burgdorferi B31
KNSTEYAIENL

SEQ ID NO: 25736 - protein, 11 aa, Borrelia burgdorferi B31
NSTEYAIENLK

SEQ ID NO: 25737 - protein, 11 aa, Borrelia burgdorferi B31
STEYAIENLKA

SEQ ID NO: 25738 - protein, 11 aa, Borrelia burgdorferi B31
TEYAIENLKAS

SEQ ID NO: 25739 - protein, 11 aa, Borrelia burgdorferi B31
EYAIENLKASY

SEQ ID NO: 25740 - protein, 11 aa, Borrelia burgdorferi B31
YAIENLKASYA

SEQ ID NO: 25741 - protein, 11 aa, Borrelia burgdorferi B31
AIENLKASYAQ

SEQ ID NO: 25742 - protein, 11 aa, Borrelia burgdorferi B31
IENLKASYAQI

SEQ ID NO: 25743 - protein, 11 aa, Borrelia burgdorferi B31
ENLKASYAQIK

SEQ ID NO: 25744 - protein, 11 aa, Borrelia burgdorferi B31
NLKASYAQIKD

SEQ ID NO: 25745 - protein, 11 aa, Borrelia burgdorferi B31
LKASYAQIKDA

SEQ ID NO: 25746 - protein, 11 aa, Borrelia burgdorferi B31
KASYAQIKDAT

SEQ ID NO: 25747 - protein, 11 aa, Borrelia burgdorferi B31
ASYAQIKDATM

SEQ ID NO: 25748 - protein, 11 aa, Borrelia burgdorferi B31
SYAQIKDATMT

SEQ ID NO: 25749 - protein, 11 aa, Borrelia burgdorferi B31
YAQIKDATMTD

SEQ ID NO: 25750 - protein, 11 aa, Borrelia burgdorferi B31
AQIKDATMTDE

SEQ ID NO: 25751 - protein, 11 aa, Borrelia burgdorferi B31
QIKDATMTDEV

SEQ ID NO: 25752 - protein, 11 aa, Borrelia burgdorferi B31
IKDATMTDEVV

SEQ ID NO: 25753 - protein, 11 aa, Borrelia burgdorferi B31
KDATMTDEVVA

SEQ ID NO: 25754 - protein, 11 aa, Borrelia burgdorferi B31
DATMTDEVVAA

SEQ ID NO: 25755 - protein, 11 aa, Borrelia burgdorferi B31
ATMTDEVVAAT

SEQ ID NO: 25756 - protein, 11 aa, Borrelia burgdorferi B31
TMTDEVVAATT

SEQ ID NO: 25757 - protein, 11 aa, Borrelia burgdorferi B31
MTDEVVAATTN

SEQ ID NO: 25758 - protein, 11 aa, Borrelia burgdorferi B31
TDEVVAATTNS

SEQ ID NO: 25759 - protein, 11 aa, Borrelia burgdorferi B31
DEVVAATTNSI

SEQ ID NO: 25760 - protein, 11 aa, Borrelia burgdorferi B31
EVVAATTNSIL

SEQ ID NO: 25761 - protein, 11 aa, Borrelia burgdorferi B31
VVAATTNSILT

SEQ ID NO: 25762 - protein, 11 aa, Borrelia burgdorferi B31
VAATTNSILTQ

SEQ ID NO: 25763 - protein, 11 aa, Borrelia burgdorferi B31
AATTNSILTQS

SEQ ID NO: 25764 - protein, 11 aa, Borrelia burgdorferi B31
ATTNSILTQSA

SEQ ID NO: 25765 - protein, 11 aa, Borrelia burgdorferi B31
TTNSILTQSAM

SEQ ID NO: 25766 - protein, 11 aa, Borrelia burgdorferi B31
TNSILTQSAMA

SEQ ID NO: 25767 - protein, 11 aa, Borrelia burgdorferi B31
NSILTQSAMAM

SEQ ID NO: 25768 - protein, 11 aa, Borrelia burgdorferi B31
SILTQSAMAMI

SEQ ID NO: 25769 - protein, 11 aa, Borrelia burgdorferi B31
ILTQSAMAMIA

SEQ ID NO: 25770 - protein, 11 aa, Borrelia burgdorferi B31
LTQSAMAMIAQ

SEQ ID NO: 25771 - protein, 11 aa, Borrelia burgdorferi B31
TQSAMAMIAQA

SEQ ID NO: 25772 - protein, 11 aa, Borrelia burgdorferi B31
QSAMAMIAQAN

SEQ ID NO: 25773 - protein, 11 aa, Borrelia burgdorferi B31
SAMAMIAQANQ

SEQ ID NO: 25774 - protein, 11 aa, Borrelia burgdorferi B31
AMAMIAQANQV

SEQ ID NO: 25775 - protein, 11 aa, Borrelia burgdorferi B31
MAMIAQANQVP

SEQ ID NO: 25776 - protein, 11 aa, Borrelia burgdorferi B31
AMIAQANQVPQ

SEQ ID NO: 25777 - protein, 11 aa, Borrelia burgdorferi B31
MIAQANQVPQY

SEQ ID NO: 25778 - protein, 11 aa, Borrelia burgdorferi B31
IAQANQVPQYV

SEQ ID NO: 25779 - protein, 11 aa, Borrelia burgdorferi B31
AQANQVPQYVL

SEQ ID NO: 25780 - protein, 11 aa, Borrelia burgdorferi B31
QANQVPQYVLS

SEQ ID NO: 25781 - protein, 11 aa, Borrelia burgdorferi B31
ANQVPQYVLSL

SEQ ID NO: 25782 - protein, 11 aa, Borrelia burgdorferi B31
NQVPQYVLSLL

SEQ ID NO: 25783 - protein, 11 aa, Borrelia burgdorferi B31
QVPQYVLSLLR

SEQ ID NO: 25784 - protein, 8 aa, Borrelia burgdorferi B31
MKLQRSLF

SEQ ID NO: 25785 - protein, 8 aa, Borrelia burgdorferi B31
KLQRSLFL

SEQ ID NO: 25786 - protein, 8 aa, Borrelia burgdorferi B31
LQRSLFLI

SEQ ID NO: 25787 - protein, 8 aa, Borrelia burgdorferi B31
QRSLFLII

SEQ ID NO: 25788 - protein, 8 aa, Borrelia burgdorferi B31
RSLFLIIF

SEQ ID NO: 25789 - protein, 8 aa, Borrelia burgdorferi B31
SLFLIIFF

SEQ ID NO: 25790 - protein, 8 aa, Borrelia burgdorferi B31
LFLIIFFL

SEQ ID NO: 25791 - protein, 8 aa, Borrelia burgdorferi B31
FLIIFFLT

SEQ ID NO: 25792 - protein, 8 aa, Borrelia burgdorferi B31
LIIFFLTF

SEQ ID NO: 25793 - protein, 8 aa, Borrelia burgdorferi B31
IIFFLTFL

SEQ ID NO: 25794 - protein, 8 aa, Borrelia burgdorferi B31
IFFLTFLC

SEQ ID NO: 25795 - protein, 8 aa, Borrelia burgdorferi B31
FFLTFLCC

SEQ ID NO: 25796 - protein, 8 aa, Borrelia burgdorferi B31
FLTFLCCN

SEQ ID NO: 25797 - protein, 8 aa, Borrelia burgdorferi B31
LTFLCCNN

SEQ ID NO: 25798 - protein, 8 aa, Borrelia burgdorferi B31
TFLCCNNK

SEQ ID NO: 25799 - protein, 8 aa, Borrelia burgdorferi B31
FLCCNNKE

SEQ ID NO: 25800 - protein, 8 aa, Borrelia burgdorferi B31
LCCNNKER

SEQ ID NO: 25801 - protein, 8 aa, Borrelia burgdorferi B31
CCNNKERK

SEQ ID NO: 25802 - protein, 8 aa, Borrelia burgdorferi B31
CNNKERKE

SEQ ID NO: 25803 - protein, 8 aa, Borrelia burgdorferi B31
NNKERKEG

SEQ ID NO: 25804 - protein, 8 aa, Borrelia burgdorferi B31
NKERKEGV

SEQ ID NO: 25805 - protein, 8 aa, Borrelia burgdorferi B31
KERKEGVS

SEQ ID NO: 25806 - protein, 8 aa, Borrelia burgdorferi B31
ERKEGVSF

SEQ ID NO: 25807 - protein, 8 aa, Borrelia burgdorferi B31
RKEGVSFK

SEQ ID NO: 25808 - protein, 8 aa, Borrelia burgdorferi B31
KEGVSFKI

SEQ ID NO: 25809 - protein, 8 aa, Borrelia burgdorferi B31
EGVSFKIS

SEQ ID NO: 25810 - protein, 8 aa, Borrelia burgdorferi B31
GVSFKISL

SEQ ID NO: 25811 - protein, 8 aa, Borrelia burgdorferi B31
VSFKISLG

SEQ ID NO: 25812 - protein, 8 aa, Borrelia burgdorferi B31
SFKISLGA

SEQ ID NO: 25813 - protein, 8 aa, Borrelia burgdorferi B31
FKISLGAE

SEQ ID NO: 25814 - protein, 8 aa, Borrelia burgdorferi B31
KISLGAEP

SEQ ID NO: 25815 - protein, 8 aa, Borrelia burgdorferi B31
ISLGAEPS

SEQ ID NO: 25816 - protein, 8 aa, Borrelia burgdorferi B31
SLGAEPSS

SEQ ID NO: 25817 - protein, 8 aa, Borrelia burgdorferi B31
LGAEPSSL

SEQ ID NO: 25818 - protein, 8 aa, Borrelia burgdorferi B31
GAEPSSLD

SEQ ID NO: 25819 - protein, 8 aa, Borrelia burgdorferi B31
AEPSSLDP

SEQ ID NO: 25820 - protein, 8 aa, Borrelia burgdorferi B31
EPSSLDPQ

SEQ ID NO: 25821 - protein, 8 aa, Borrelia burgdorferi B31
PSSLDPQL

SEQ ID NO: 25822 - protein, 8 aa, Borrelia burgdorferi B31
SSLDPQLA

SEQ ID NO: 25823 - protein, 8 aa, Borrelia burgdorferi B31
SLDPQLAE

SEQ ID NO: 25824 - protein, 8 aa, Borrelia burgdorferi B31
LDPQLAED

SEQ ID NO: 25825 - protein, 8 aa, Borrelia burgdorferi B31
DPQLAEDN

SEQ ID NO: 25826 - protein, 8 aa, Borrelia burgdorferi B31
PQLAEDNV

SEQ ID NO: 25827 - protein, 8 aa, Borrelia burgdorferi B31
QLAEDNVA

SEQ ID NO: 25828 - protein, 8 aa, Borrelia burgdorferi B31
LAEDNVAS

SEQ ID NO: 25829 - protein, 8 aa, Borrelia burgdorferi B31
AEDNVASK

SEQ ID NO: 25830 - protein, 8 aa, Borrelia burgdorferi B31
EDNVASKM

SEQ ID NO: 25831 - protein, 8 aa, Borrelia burgdorferi B31
DNVASKMI

SEQ ID NO: 25832 - protein, 8 aa, Borrelia burgdorferi B31
NVASKMID

SEQ ID NO: 25833 - protein, 8 aa, Borrelia burgdorferi B31
VASKMIDT

SEQ ID NO: 25834 - protein, 8 aa, Borrelia burgdorferi B31
ASKMIDTM

SEQ ID NO: 25835 - protein, 8 aa, Borrelia burgdorferi B31
SKMIDTMF

SEQ ID NO: 25836 - protein, 8 aa, Borrelia burgdorferi B31
KMIDTMFR

SEQ ID NO: 25837 - protein, 8 aa, Borrelia burgdorferi B31
MIDTMFRG

SEQ ID NO: 25838 - protein, 8 aa, Borrelia burgdorferi B31
IDTMFRGI

SEQ ID NO: 25839 - protein, 8 aa, Borrelia burgdorferi B31
DTMFRGIV

SEQ ID NO: 25840 - protein, 8 aa, Borrelia burgdorferi B31
TMFRGIVT

SEQ ID NO: 25841 - protein, 8 aa, Borrelia burgdorferi B31
MFRGIVTG

SEQ ID NO: 25842 - protein, 8 aa, Borrelia burgdorferi B31
FRGIVTGD

SEQ ID NO: 25843 - protein, 8 aa, Borrelia burgdorferi B31
RGIVTGDP

SEQ ID NO: 25844 - protein, 8 aa, Borrelia burgdorferi B31
GIVTGDPN

SEQ ID NO: 25845 - protein, 8 aa, Borrelia burgdorferi B31
IVTGDPNT

SEQ ID NO: 25846 - protein, 8 aa, Borrelia burgdorferi B31
VTGDPNTG

SEQ ID NO: 25847 - protein, 8 aa, Borrelia burgdorferi B31
TGDPNTGG

SEQ ID NO: 25848 - protein, 8 aa, Borrelia burgdorferi B31
GDPNTGGN

SEQ ID NO: 25849 - protein, 8 aa, Borrelia burgdorferi B31
DPNTGGNK

SEQ ID NO: 25850 - protein, 8 aa, Borrelia burgdorferi B31
PNTGGNKP

SEQ ID NO: 25851 - protein, 8 aa, Borrelia burgdorferi B31
NTGGNKPG

SEQ ID NO: 25852 - protein, 8 aa, Borrelia burgdorferi B31
TGGNKPGL

SEQ ID NO: 25853 - protein, 8 aa, Borrelia burgdorferi B31
GGNKPGLA

SEQ ID NO: 25854 - protein, 8 aa, Borrelia burgdorferi B31
GNKPGLAK

SEQ ID NO: 25855 - protein, 8 aa, Borrelia burgdorferi B31
NKPGLAKG

SEQ ID NO: 25856 - protein, 8 aa, Borrelia burgdorferi B31
KPGLAKGW

SEQ ID NO: 25857 - protein, 8 aa, Borrelia burgdorferi B31
PGLAKGWD

SEQ ID NO: 25858 - protein, 8 aa, Borrelia burgdorferi B31
GLAKGWDI

SEQ ID NO: 25859 - protein, 8 aa, Borrelia burgdorferi B31
LAKGWDIS

SEQ ID NO: 25860 - protein, 8 aa, Borrelia burgdorferi B31
AKGWDISS

SEQ ID NO: 25861 - protein, 8 aa, Borrelia burgdorferi B31
KGWDISSD

SEQ ID NO: 25862 - protein, 8 aa, Borrelia burgdorferi B31
GWDISSDG

SEQ ID NO: 25863 - protein, 8 aa, Borrelia burgdorferi B31
WDISSDGT

SEQ ID NO: 25864 - protein, 8 aa, Borrelia burgdorferi B31
DISSDGTV

SEQ ID NO: 25865 - protein, 8 aa, Borrelia burgdorferi B31
ISSDGTVY

SEQ ID NO: 25866 - protein, 8 aa, Borrelia burgdorferi B31
SSDGTVYT

SEQ ID NO: 25867 - protein, 8 aa, Borrelia burgdorferi B31
SDGTVYTF

SEQ ID NO: 25868 - protein, 8 aa, Borrelia burgdorferi B31
DGTVYTFN

SEQ ID NO: 25869 - protein, 8 aa, Borrelia burgdorferi B31
GTVYTFNL

SEQ ID NO: 25870 - protein, 8 aa, Borrelia burgdorferi B31
TVYTFNLR

SEQ ID NO: 25871 - protein, 8 aa, Borrelia burgdorferi B31
VYTFNLRE

SEQ ID NO: 25872 - protein, 8 aa, Borrelia burgdorferi B31
YTFNLREK

SEQ ID NO: 25873 - protein, 8 aa, Borrelia burgdorferi B31
TFNLREKI

SEQ ID NO: 25874 - protein, 8 aa, Borrelia burgdorferi B31
FNLREKIT

SEQ ID NO: 25875 - protein, 8 aa, Borrelia burgdorferi B31
NLREKITW

SEQ ID NO: 25876 - protein, 8 aa, Borrelia burgdorferi B31
LREKITWS

SEQ ID NO: 25877 - protein, 8 aa, Borrelia burgdorferi B31
REKITWSD

SEQ ID NO: 25878 - protein, 8 aa, Borrelia burgdorferi B31
EKITWSDG

SEQ ID NO: 25879 - protein, 8 aa, Borrelia burgdorferi B31
KITWSDGV

SEQ ID NO: 25880 - protein, 8 aa, Borrelia burgdorferi B31
ITWSDGVA

SEQ ID NO: 25881 - protein, 8 aa, Borrelia burgdorferi B31
TWSDGVAI

SEQ ID NO: 25882 - protein, 8 aa, Borrelia burgdorferi B31
WSDGVAIT

SEQ ID NO: 25883 - protein, 8 aa, Borrelia burgdorferi B31
SDGVAITA

SEQ ID NO: 25884 - protein, 8 aa, Borrelia burgdorferi B31
DGVAITAE

SEQ ID NO: 25885 - protein, 8 aa, Borrelia burgdorferi B31
GVAITAEG

SEQ ID NO: 25886 - protein, 8 aa, Borrelia burgdorferi B31
VAITAEGI

SEQ ID NO: 25887 - protein, 8 aa, Borrelia burgdorferi B31
AITAEGIR

SEQ ID NO: 25888 - protein, 8 aa, Borrelia burgdorferi B31
ITAEGIRK

SEQ ID NO: 25889 - protein, 8 aa, Borrelia burgdorferi B31
TAEGIRKS

SEQ ID NO: 25890 - protein, 8 aa, Borrelia burgdorferi B31
AEGIRKSY

SEQ ID NO: 25891 - protein, 8 aa, Borrelia burgdorferi B31
EGIRKSYL

SEQ ID NO: 25892 - protein, 8 aa, Borrelia burgdorferi B31
GIRKSYLR

SEQ ID NO: 25893 - protein, 8 aa, Borrelia burgdorferi B31
IRKSYLRI

SEQ ID NO: 25894 - protein, 8 aa, Borrelia burgdorferi B31
RKSYLRIL

SEQ ID NO: 25895 - protein, 8 aa, Borrelia burgdorferi B31
KSYLRILN

SEQ ID NO: 25896 - protein, 8 aa, Borrelia burgdorferi B31
SYLRILNK

SEQ ID NO: 25897 - protein, 8 aa, Borrelia burgdorferi B31
YLRILNKE

SEQ ID NO: 25898 - protein, 8 aa, Borrelia burgdorferi B31
LRILNKET

SEQ ID NO: 25899 - protein, 8 aa, Borrelia burgdorferi B31
RILNKETG

SEQ ID NO: 25900 - protein, 8 aa, Borrelia burgdorferi B31
ILNKETGS

SEQ ID NO: 25901 - protein, 8 aa, Borrelia burgdorferi B31
LNKETGSK

SEQ ID NO: 25902 - protein, 8 aa, Borrelia burgdorferi B31
NKETGSKY

SEQ ID NO: 25903 - protein, 8 aa, Borrelia burgdorferi B31
KETGSKYV

SEQ ID NO: 25904 - protein, 8 aa, Borrelia burgdorferi B31
ETGSKYVE

SEQ ID NO: 25905 - protein, 8 aa, Borrelia burgdorferi B31
TGSKYVEM

SEQ ID NO: 25906 - protein, 8 aa, Borrelia burgdorferi B31
GSKYVEMV

SEQ ID NO: 25907 - protein, 8 aa, Borrelia burgdorferi B31
SKYVEMVK

SEQ ID NO: 25908 - protein, 8 aa, Borrelia burgdorferi B31
KYVEMVKS

SEQ ID NO: 25909 - protein, 8 aa, Borrelia burgdorferi B31
YVEMVKSV

SEQ ID NO: 25910 - protein, 8 aa, Borrelia burgdorferi B31
VEMVKSVI

SEQ ID NO: 25911 - protein, 8 aa, Borrelia burgdorferi B31
EMVKSVIK

SEQ ID NO: 25912 - protein, 8 aa, Borrelia burgdorferi B31
MVKSVIKN

SEQ ID NO: 25913 - protein, 8 aa, Borrelia burgdorferi B31
VKSVIKNG

SEQ ID NO: 25914 - protein, 8 aa, Borrelia burgdorferi B31
KSVIKNGQ

SEQ ID NO: 25915 - protein, 8 aa, Borrelia burgdorferi B31
SVIKNGQK

SEQ ID NO: 25916 - protein, 8 aa, Borrelia burgdorferi B31
VIKNGQKY

SEQ ID NO: 25917 - protein, 8 aa, Borrelia burgdorferi B31
IKNGQKYF

SEQ ID NO: 25918 - protein, 8 aa, Borrelia burgdorferi B31
KNGQKYFD

SEQ ID NO: 25919 - protein, 8 aa, Borrelia burgdorferi B31
NGQKYFDG

SEQ ID NO: 25920 - protein, 8 aa, Borrelia burgdorferi B31
GQKYFDGQ

SEQ ID NO: 25921 - protein, 8 aa, Borrelia burgdorferi B31
QKYFDGQV

SEQ ID NO: 25922 - protein, 8 aa, Borrelia burgdorferi B31
KYFDGQVT

SEQ ID NO: 25923 - protein, 8 aa, Borrelia burgdorferi B31
YFDGQVTD

SEQ ID NO: 25924 - protein, 8 aa, Borrelia burgdorferi B31
FDGQVTDS

SEQ ID NO: 25925 - protein, 8 aa, Borrelia burgdorferi B31
DGQVTDSE

SEQ ID NO: 25926 - protein, 8 aa, Borrelia burgdorferi B31
GQVTDSEL

SEQ ID NO: 25927 - protein, 8 aa, Borrelia burgdorferi B31
QVTDSELG

SEQ ID NO: 25928 - protein, 8 aa, Borrelia burgdorferi B31
VTDSELGI

SEQ ID NO: 25929 - protein, 8 aa, Borrelia burgdorferi B31
TDSELGIR

SEQ ID NO: 25930 - protein, 8 aa, Borrelia burgdorferi B31
DSELGIRA

SEQ ID NO: 25931 - protein, 8 aa, Borrelia burgdorferi B31
SELGIRAI

SEQ ID NO: 25932 - protein, 8 aa, Borrelia burgdorferi B31
ELGIRAID

SEQ ID NO: 25933 - protein, 8 aa, Borrelia burgdorferi B31
LGIRAIDE

SEQ ID NO: 25934 - protein, 8 aa, Borrelia burgdorferi B31
GIRAIDEK

SEQ ID NO: 25935 - protein, 8 aa, Borrelia burgdorferi B31
IRAIDEKT

SEQ ID NO: 25936 - protein, 8 aa, Borrelia burgdorferi B31
RAIDEKTL

SEQ ID NO: 25937 - protein, 8 aa, Borrelia burgdorferi B31
AIDEKTLE

SEQ ID NO: 25938 - protein, 8 aa, Borrelia burgdorferi B31
IDEKTLEI

SEQ ID NO: 25939 - protein, 8 aa, Borrelia burgdorferi B31
DEKTLEIT

SEQ ID NO: 25940 - protein, 8 aa, Borrelia burgdorferi B31
EKTLEITL

SEQ ID NO: 25941 - protein, 8 aa, Borrelia burgdorferi B31
KTLEITLE

SEQ ID NO: 25942 - protein, 8 aa, Borrelia burgdorferi B31
TLEITLES

SEQ ID NO: 25943 - protein, 8 aa, Borrelia burgdorferi B31
LEITLESP

SEQ ID NO: 25944 - protein, 8 aa, Borrelia burgdorferi B31
EITLESPK

SEQ ID NO: 25945 - protein, 8 aa, Borrelia burgdorferi B31
ITLESPKP

SEQ ID NO: 25946 - protein, 8 aa, Borrelia burgdorferi B31
TLESPKPY

SEQ ID NO: 25947 - protein, 8 aa, Borrelia burgdorferi B31
LESPKPYF

SEQ ID NO: 25948 - protein, 8 aa, Borrelia burgdorferi B31
ESPKPYFI

SEQ ID NO: 25949 - protein, 8 aa, Borrelia burgdorferi B31
SPKPYFID

SEQ ID NO: 25950 - protein, 8 aa, Borrelia burgdorferi B31
PKPYFIDM

SEQ ID NO: 25951 - protein, 8 aa, Borrelia burgdorferi B31
KPYFIDML

SEQ ID NO: 25952 - protein, 8 aa, Borrelia burgdorferi B31
PYFIDMLV

SEQ ID NO: 25953 - protein, 8 aa, Borrelia burgdorferi B31
YFIDMLVH

SEQ ID NO: 25954 - protein, 8 aa, Borrelia burgdorferi B31
FIDMLVHQ

SEQ ID NO: 25955 - protein, 8 aa, Borrelia burgdorferi B31
IDMLVHQS

SEQ ID NO: 25956 - protein, 8 aa, Borrelia burgdorferi B31
DMLVHQSF

SEQ ID NO: 25957 - protein, 8 aa, Borrelia burgdorferi B31
MLVHQSFI

SEQ ID NO: 25958 - protein, 8 aa, Borrelia burgdorferi B31
LVHQSFIP

SEQ ID NO: 25959 - protein, 8 aa, Borrelia burgdorferi B31
VHQSFIPV

SEQ ID NO: 25960 - protein, 8 aa, Borrelia burgdorferi B31
HQSFIPVP

SEQ ID NO: 25961 - protein, 8 aa, Borrelia burgdorferi B31
QSFIPVPV

SEQ ID NO: 25962 - protein, 8 aa, Borrelia burgdorferi B31
SFIPVPVH

SEQ ID NO: 25963 - protein, 8 aa, Borrelia burgdorferi B31
FIPVPVHV

SEQ ID NO: 25964 - protein, 8 aa, Borrelia burgdorferi B31
IPVPVHVT

SEQ ID NO: 25965 - protein, 8 aa, Borrelia burgdorferi B31
PVPVHVTE

SEQ ID NO: 25966 - protein, 8 aa, Borrelia burgdorferi B31
VPVHVTEK

SEQ ID NO: 25967 - protein, 8 aa, Borrelia burgdorferi B31
PVHVTEKY

SEQ ID NO: 25968 - protein, 8 aa, Borrelia burgdorferi B31
VHVTEKYG

SEQ ID NO: 25969 - protein, 8 aa, Borrelia burgdorferi B31
HVTEKYGQ

SEQ ID NO: 25970 - protein, 8 aa, Borrelia burgdorferi B31
VTEKYGQN

SEQ ID NO: 25971 - protein, 8 aa, Borrelia burgdorferi B31
TEKYGQNW

SEQ ID NO: 25972 - protein, 8 aa, Borrelia burgdorferi B31
EKYGQNWT

SEQ ID NO: 25973 - protein, 8 aa, Borrelia burgdorferi B31
KYGQNWTS

SEQ ID NO: 25974 - protein, 8 aa, Borrelia burgdorferi B31
YGQNWTSP

SEQ ID NO: 25975 - protein, 8 aa, Borrelia burgdorferi B31
GQNWTSPE

SEQ ID NO: 25976 - protein, 8 aa, Borrelia burgdorferi B31
QNWTSPEN

SEQ ID NO: 25977 - protein, 8 aa, Borrelia burgdorferi B31
NWTSPENM

SEQ ID NO: 25978 - protein, 8 aa, Borrelia burgdorferi B31
WTSPENMV

SEQ ID NO: 25979 - protein, 8 aa, Borrelia burgdorferi B31
TSPENMVT

SEQ ID NO: 25980 - protein, 8 aa, Borrelia burgdorferi B31
SPENMVTS

SEQ ID NO: 25981 - protein, 8 aa, Borrelia burgdorferi B31
PENMVTSG

SEQ ID NO: 25982 - protein, 8 aa, Borrelia burgdorferi B31
ENMVTSGP

SEQ ID NO: 25983 - protein, 8 aa, Borrelia burgdorferi B31
NMVTSGPF

SEQ ID NO: 25984 - protein, 8 aa, Borrelia burgdorferi B31
MVTSGPFK

SEQ ID NO: 25985 - protein, 8 aa, Borrelia burgdorferi B31
VTSGPFKL

SEQ ID NO: 25986 - protein, 8 aa, Borrelia burgdorferi B31
TSGPFKLK

SEQ ID NO: 25987 - protein, 8 aa, Borrelia burgdorferi B31
SGPFKLKE

SEQ ID NO: 25988 - protein, 8 aa, Borrelia burgdorferi B31
GPFKLKER

SEQ ID NO: 25989 - protein, 8 aa, Borrelia burgdorferi B31
PFKLKERI

SEQ ID NO: 25990 - protein, 8 aa, Borrelia burgdorferi B31
FKLKERIP

SEQ ID NO: 25991 - protein, 8 aa, Borrelia burgdorferi B31
KLKERIPN

SEQ ID NO: 25992 - protein, 8 aa, Borrelia burgdorferi B31
LKERIPNE

SEQ ID NO: 25993 - protein, 8 aa, Borrelia burgdorferi B31
KERIPNEK

SEQ ID NO: 25994 - protein, 8 aa, Borrelia burgdorferi B31
ERIPNEKY

SEQ ID NO: 25995 - protein, 8 aa, Borrelia burgdorferi B31
RIPNEKYV

SEQ ID NO: 25996 - protein, 8 aa, Borrelia burgdorferi B31
IPNEKYVF

SEQ ID NO: 25997 - protein, 8 aa, Borrelia burgdorferi B31
PNEKYVFE

SEQ ID NO: 25998 - protein, 8 aa, Borrelia burgdorferi B31
NEKYVFEK

SEQ ID NO: 25999 - protein, 8 aa, Borrelia burgdorferi B31
EKYVFEKN

SEQ ID NO: 26000 - protein, 8 aa, Borrelia burgdorferi B31
KYVFEKNN

SEQ ID NO: 26001 - protein, 8 aa, Borrelia burgdorferi B31
YVFEKNNK

SEQ ID NO: 26002 - protein, 8 aa, Borrelia burgdorferi B31
VFEKNNKY

SEQ ID NO: 26003 - protein, 8 aa, Borrelia burgdorferi B31
FEKNNKYY

SEQ ID NO: 26004 - protein, 8 aa, Borrelia burgdorferi B31
EKNNKYYD

SEQ ID NO: 26005 - protein, 8 aa, Borrelia burgdorferi B31
KNNKYYDS

SEQ ID NO: 26006 - protein, 8 aa, Borrelia burgdorferi B31
NNKYYDSN

SEQ ID NO: 26007 - protein, 8 aa, Borrelia burgdorferi B31
NKYYDSNE

SEQ ID NO: 26008 - protein, 8 aa, Borrelia burgdorferi B31
KYYDSNEV

SEQ ID NO: 26009 - protein, 8 aa, Borrelia burgdorferi B31
YYDSNEVE

SEQ ID NO: 26010 - protein, 8 aa, Borrelia burgdorferi B31
YDSNEVEL

SEQ ID NO: 26011 - protein, 8 aa, Borrelia burgdorferi B31
DSNEVELE

SEQ ID NO: 26012 - protein, 8 aa, Borrelia burgdorferi B31
SNEVELEE

SEQ ID NO: 26013 - protein, 8 aa, Borrelia burgdorferi B31
NEVELEEI

SEQ ID NO: 26014 - protein, 8 aa, Borrelia burgdorferi B31
EVELEEIT

SEQ ID NO: 26015 - protein, 8 aa, Borrelia burgdorferi B31
VELEEITF

SEQ ID NO: 26016 - protein, 8 aa, Borrelia burgdorferi B31
ELEEITFY

SEQ ID NO: 26017 - protein, 8 aa, Borrelia burgdorferi B31
LEEITFYT

SEQ ID NO: 26018 - protein, 8 aa, Borrelia burgdorferi B31
EEITFYTT

SEQ ID NO: 26019 - protein, 8 aa, Borrelia burgdorferi B31
EITFYTTN

SEQ ID NO: 26020 - protein, 8 aa, Borrelia burgdorferi B31
ITFYTTND

SEQ ID NO: 26021 - protein, 8 aa, Borrelia burgdorferi B31
TFYTTNDS

SEQ ID NO: 26022 - protein, 8 aa, Borrelia burgdorferi B31
FYTTNDSS

SEQ ID NO: 26023 - protein, 8 aa, Borrelia burgdorferi B31
YTTNDSST

SEQ ID NO: 26024 - protein, 8 aa, Borrelia burgdorferi B31
TTNDSSTA

SEQ ID NO: 26025 - protein, 8 aa, Borrelia burgdorferi B31
TNDSSTAY

SEQ ID NO: 26026 - protein, 8 aa, Borrelia burgdorferi B31
NDSSTAYK

SEQ ID NO: 26027 - protein, 8 aa, Borrelia burgdorferi B31
DSSTAYKM

SEQ ID NO: 26028 - protein, 8 aa, Borrelia burgdorferi B31
SSTAYKMY

SEQ ID NO: 26029 - protein, 8 aa, Borrelia burgdorferi B31
STAYKMYE

SEQ ID NO: 26030 - protein, 8 aa, Borrelia burgdorferi B31
TAYKMYEN

SEQ ID NO: 26031 - protein, 8 aa, Borrelia burgdorferi B31
AYKMYENE

SEQ ID NO: 26032 - protein, 8 aa, Borrelia burgdorferi B31
YKMYENEE

SEQ ID NO: 26033 - protein, 8 aa, Borrelia burgdorferi B31
KMYENEEL

SEQ ID NO: 26034 - protein, 8 aa, Borrelia burgdorferi B31
MYENEELD

SEQ ID NO: 26035 - protein, 8 aa, Borrelia burgdorferi B31
YENEELDA

SEQ ID NO: 26036 - protein, 8 aa, Borrelia burgdorferi B31
ENEELDAI

SEQ ID NO: 26037 - protein, 8 aa, Borrelia burgdorferi B31
NEELDAIF

SEQ ID NO: 26038 - protein, 8 aa, Borrelia burgdorferi B31
EELDAIFG

SEQ ID NO: 26039 - protein, 8 aa, Borrelia burgdorferi B31
ELDAIFGS

SEQ ID NO: 26040 - protein, 8 aa, Borrelia burgdorferi B31
LDAIFGSI

SEQ ID NO: 26041 - protein, 8 aa, Borrelia burgdorferi B31
DAIFGSIP

SEQ ID NO: 26042 - protein, 8 aa, Borrelia burgdorferi B31
AIFGSIPP

SEQ ID NO: 26043 - protein, 8 aa, Borrelia burgdorferi B31
IFGSIPPD

SEQ ID NO: 26044 - protein, 8 aa, Borrelia burgdorferi B31
FGSIPPDL

SEQ ID NO: 26045 - protein, 8 aa, Borrelia burgdorferi B31
GSIPPDLI

SEQ ID NO: 26046 - protein, 8 aa, Borrelia burgdorferi B31
SIPPDLIK

SEQ ID NO: 26047 - protein, 8 aa, Borrelia burgdorferi B31
IPPDLIKN

SEQ ID NO: 26048 - protein, 8 aa, Borrelia burgdorferi B31
PPDLIKNL

SEQ ID NO: 26049 - protein, 8 aa, Borrelia burgdorferi B31
PDLIKNLK

SEQ ID NO: 26050 - protein, 8 aa, Borrelia burgdorferi B31
DLIKNLKL

SEQ ID NO: 26051 - protein, 8 aa, Borrelia burgdorferi B31
LIKNLKLR

SEQ ID NO: 26052 - protein, 8 aa, Borrelia burgdorferi B31
IKNLKLRS

SEQ ID NO: 26053 - protein, 8 aa, Borrelia burgdorferi B31
KNLKLRSD

SEQ ID NO: 26054 - protein, 8 aa, Borrelia burgdorferi B31
NLKLRSDY

SEQ ID NO: 26055 - protein, 8 aa, Borrelia burgdorferi B31
LKLRSDYY

SEQ ID NO: 26056 - protein, 8 aa, Borrelia burgdorferi B31
KLRSDYYS

SEQ ID NO: 26057 - protein, 8 aa, Borrelia burgdorferi B31
LRSDYYSS

SEQ ID NO: 26058 - protein, 8 aa, Borrelia burgdorferi B31
RSDYYSSA

SEQ ID NO: 26059 - protein, 8 aa, Borrelia burgdorferi B31
SDYYSSAV

SEQ ID NO: 26060 - protein, 8 aa, Borrelia burgdorferi B31
DYYSSAVN

SEQ ID NO: 26061 - protein, 8 aa, Borrelia burgdorferi B31
YYSSAVNA

SEQ ID NO: 26062 - protein, 8 aa, Borrelia burgdorferi B31
YSSAVNAI

SEQ ID NO: 26063 - protein, 8 aa, Borrelia burgdorferi B31
SSAVNAIY

SEQ ID NO: 26064 - protein, 8 aa, Borrelia burgdorferi B31
SAVNAIYF

SEQ ID NO: 26065 - protein, 8 aa, Borrelia burgdorferi B31
AVNAIYFY

SEQ ID NO: 26066 - protein, 8 aa, Borrelia burgdorferi B31
VNAIYFYA

SEQ ID NO: 26067 - protein, 8 aa, Borrelia burgdorferi B31
NAIYFYAF

SEQ ID NO: 26068 - protein, 8 aa, Borrelia burgdorferi B31
AIYFYAFN

SEQ ID NO: 26069 - protein, 8 aa, Borrelia burgdorferi B31
IYFYAFNT

SEQ ID NO: 26070 - protein, 8 aa, Borrelia burgdorferi B31
YFYAFNTH

SEQ ID NO: 26071 - protein, 8 aa, Borrelia burgdorferi B31
FYAFNTHI

SEQ ID NO: 26072 - protein, 8 aa, Borrelia burgdorferi B31
YAFNTHIK

SEQ ID NO: 26073 - protein, 8 aa, Borrelia burgdorferi B31
AFNTHIKP

SEQ ID NO: 26074 - protein, 8 aa, Borrelia burgdorferi B31
FNTHIKPL

SEQ ID NO: 26075 - protein, 8 aa, Borrelia burgdorferi B31
NTHIKPLD

SEQ ID NO: 26076 - protein, 8 aa, Borrelia burgdorferi B31
THIKPLDN

SEQ ID NO: 26077 - protein, 8 aa, Borrelia burgdorferi B31
HIKPLDNV

SEQ ID NO: 26078 - protein, 8 aa, Borrelia burgdorferi B31
IKPLDNVK

SEQ ID NO: 26079 - protein, 8 aa, Borrelia burgdorferi B31
KPLDNVKI

SEQ ID NO: 26080 - protein, 8 aa, Borrelia burgdorferi B31
PLDNVKIR

SEQ ID NO: 26081 - protein, 8 aa, Borrelia burgdorferi B31
LDNVKIRK

SEQ ID NO: 26082 - protein, 8 aa, Borrelia burgdorferi B31
DNVKIRKA

SEQ ID NO: 26083 - protein, 8 aa, Borrelia burgdorferi B31
NVKIRKAL

SEQ ID NO: 26084 - protein, 8 aa, Borrelia burgdorferi B31
VKIRKALT

SEQ ID NO: 26085 - protein, 8 aa, Borrelia burgdorferi B31
KIRKALTL

SEQ ID NO: 26086 - protein, 8 aa, Borrelia burgdorferi B31
IRKALTLA

SEQ ID NO: 26087 - protein, 8 aa, Borrelia burgdorferi B31
RKALTLAI

SEQ ID NO: 26088 - protein, 8 aa, Borrelia burgdorferi B31
KALTLAID

SEQ ID NO: 26089 - protein, 8 aa, Borrelia burgdorferi B31
ALTLAIDR

SEQ ID NO: 26090 - protein, 8 aa, Borrelia burgdorferi B31
LTLAIDRE

SEQ ID NO: 26091 - protein, 8 aa, Borrelia burgdorferi B31
TLAIDRET

SEQ ID NO: 26092 - protein, 8 aa, Borrelia burgdorferi B31
LAIDRETL

SEQ ID NO: 26093 - protein, 8 aa, Borrelia burgdorferi B31
AIDRETLT

SEQ ID NO: 26094 - protein, 8 aa, Borrelia burgdorferi B31
IDRETLTY

SEQ ID NO: 26095 - protein, 8 aa, Borrelia burgdorferi B31
DRETLTYK

SEQ ID NO: 26096 - protein, 8 aa, Borrelia burgdorferi B31
RETLTYKV

SEQ ID NO: 26097 - protein, 8 aa, Borrelia burgdorferi B31
ETLTYKVL

SEQ ID NO: 26098 - protein, 8 aa, Borrelia burgdorferi B31
TLTYKVLD

SEQ ID NO: 26099 - protein, 8 aa, Borrelia burgdorferi B31
LTYKVLDN

SEQ ID NO: 26100 - protein, 8 aa, Borrelia burgdorferi B31
TYKVLDNG

SEQ ID NO: 26101 - protein, 8 aa, Borrelia burgdorferi B31
YKVLDNGT

SEQ ID NO: 26102 - protein, 8 aa, Borrelia burgdorferi B31
KVLDNGTT

SEQ ID NO: 26103 - protein, 8 aa, Borrelia burgdorferi B31
VLDNGTTP

SEQ ID NO: 26104 - protein, 8 aa, Borrelia burgdorferi B31
LDNGTTPT

SEQ ID NO: 26105 - protein, 8 aa, Borrelia burgdorferi B31
DNGTTPTR

SEQ ID NO: 26106 - protein, 8 aa, Borrelia burgdorferi B31
NGTTPTRR

SEQ ID NO: 26107 - protein, 8 aa, Borrelia burgdorferi B31
GTTPTRRA

SEQ ID NO: 26108 - protein, 8 aa, Borrelia burgdorferi B31
TTPTRRAT

SEQ ID NO: 26109 - protein, 8 aa, Borrelia burgdorferi B31
TPTRRATP

SEQ ID NO: 26110 - protein, 8 aa, Borrelia burgdorferi B31
PTRRATPN

SEQ ID NO: 26111 - protein, 8 aa, Borrelia burgdorferi B31
TRRATPNF

SEQ ID NO: 26112 - protein, 8 aa, Borrelia burgdorferi B31
RRATPNFS

SEQ ID NO: 26113 - protein, 8 aa, Borrelia burgdorferi B31
RATPNFSS

SEQ ID NO: 26114 - protein, 8 aa, Borrelia burgdorferi B31
ATPNFSSY

SEQ ID NO: 26115 - protein, 8 aa, Borrelia burgdorferi B31
TPNFSSYS

SEQ ID NO: 26116 - protein, 8 aa, Borrelia burgdorferi B31
PNFSSYSY

SEQ ID NO: 26117 - protein, 8 aa, Borrelia burgdorferi B31
NFSSYSYA

SEQ ID NO: 26118 - protein, 8 aa, Borrelia burgdorferi B31
FSSYSYAK

SEQ ID NO: 26119 - protein, 8 aa, Borrelia burgdorferi B31
SSYSYAKS

SEQ ID NO: 26120 - protein, 8 aa, Borrelia burgdorferi B31
SYSYAKSL

SEQ ID NO: 26121 - protein, 8 aa, Borrelia burgdorferi B31
YSYAKSLE

SEQ ID NO: 26122 - protein, 8 aa, Borrelia burgdorferi B31
SYAKSLEL

SEQ ID NO: 26123 - protein, 8 aa, Borrelia burgdorferi B31
YAKSLELF

SEQ ID NO: 26124 - protein, 8 aa, Borrelia burgdorferi B31
AKSLELFN

SEQ ID NO: 26125 - protein, 8 aa, Borrelia burgdorferi B31
KSLELFNP

SEQ ID NO: 26126 - protein, 8 aa, Borrelia burgdorferi B31
SLELFNPE

SEQ ID NO: 26127 - protein, 8 aa, Borrelia burgdorferi B31
LELFNPEI

SEQ ID NO: 26128 - protein, 8 aa, Borrelia burgdorferi B31
ELFNPEIA

SEQ ID NO: 26129 - protein, 8 aa, Borrelia burgdorferi B31
LFNPEIAK

SEQ ID NO: 26130 - protein, 8 aa, Borrelia burgdorferi B31
FNPEIAKT

SEQ ID NO: 26131 - protein, 8 aa, Borrelia burgdorferi B31
NPEIAKTL

SEQ ID NO: 26132 - protein, 8 aa, Borrelia burgdorferi B31
PEIAKTLL

SEQ ID NO: 26133 - protein, 8 aa, Borrelia burgdorferi B31
EIAKTLLA

SEQ ID NO: 26134 - protein, 8 aa, Borrelia burgdorferi B31
IAKTLLAE

SEQ ID NO: 26135 - protein, 8 aa, Borrelia burgdorferi B31
AKTLLAEA

SEQ ID NO: 26136 - protein, 8 aa, Borrelia burgdorferi B31
KTLLAEAG

SEQ ID NO: 26137 - protein, 8 aa, Borrelia burgdorferi B31
TLLAEAGY

SEQ ID NO: 26138 - protein, 8 aa, Borrelia burgdorferi B31
LLAEAGYP

SEQ ID NO: 26139 - protein, 8 aa, Borrelia burgdorferi B31
LAEAGYPN

SEQ ID NO: 26140 - protein, 8 aa, Borrelia burgdorferi B31
AEAGYPNG

SEQ ID NO: 26141 - protein, 8 aa, Borrelia burgdorferi B31
EAGYPNGN

SEQ ID NO: 26142 - protein, 8 aa, Borrelia burgdorferi B31
AGYPNGNG

SEQ ID NO: 26143 - protein, 8 aa, Borrelia burgdorferi B31
GYPNGNGF

SEQ ID NO: 26144 - protein, 8 aa, Borrelia burgdorferi B31
YPNGNGFP

SEQ ID NO: 26145 - protein, 8 aa, Borrelia burgdorferi B31
PNGNGFPI

SEQ ID NO: 26146 - protein, 8 aa, Borrelia burgdorferi B31
NGNGFPIL

SEQ ID NO: 26147 - protein, 8 aa, Borrelia burgdorferi B31
GNGFPILK

SEQ ID NO: 26148 - protein, 8 aa, Borrelia burgdorferi B31
NGFPILKL

SEQ ID NO: 26149 - protein, 8 aa, Borrelia burgdorferi B31
GFPILKLK

SEQ ID NO: 26150 - protein, 8 aa, Borrelia burgdorferi B31
FPILKLKY

SEQ ID NO: 26151 - protein, 8 aa, Borrelia burgdorferi B31
PILKLKYN

SEQ ID NO: 26152 - protein, 8 aa, Borrelia burgdorferi B31
ILKLKYNT

SEQ ID NO: 26153 - protein, 8 aa, Borrelia burgdorferi B31
LKLKYNTN

SEQ ID NO: 26154 - protein, 8 aa, Borrelia burgdorferi B31
KLKYNTNE

SEQ ID NO: 26155 - protein, 8 aa, Borrelia burgdorferi B31
LKYNTNEA

SEQ ID NO: 26156 - protein, 8 aa, Borrelia burgdorferi B31
KYNTNEAN

SEQ ID NO: 26157 - protein, 8 aa, Borrelia burgdorferi B31
YNTNEANK

SEQ ID NO: 26158 - protein, 8 aa, Borrelia burgdorferi B31
NTNEANKK

SEQ ID NO: 26159 - protein, 8 aa, Borrelia burgdorferi B31
TNEANKKI

SEQ ID NO: 26160 - protein, 8 aa, Borrelia burgdorferi B31
NEANKKIC

SEQ ID NO: 26161 - protein, 8 aa, Borrelia burgdorferi B31
EANKKICE

SEQ ID NO: 26162 - protein, 8 aa, Borrelia burgdorferi B31
ANKKICEF

SEQ ID NO: 26163 - protein, 8 aa, Borrelia burgdorferi B31
NKKICEFI

SEQ ID NO: 26164 - protein, 8 aa, Borrelia burgdorferi B31
KKICEFIQ

SEQ ID NO: 26165 - protein, 8 aa, Borrelia burgdorferi B31
KICEFIQN

SEQ ID NO: 26166 - protein, 8 aa, Borrelia burgdorferi B31
ICEFIQNQ

SEQ ID NO: 26167 - protein, 8 aa, Borrelia burgdorferi B31
CEFIQNQW

SEQ ID NO: 26168 - protein, 8 aa, Borrelia burgdorferi B31
EFIQNQWK

SEQ ID NO: 26169 - protein, 8 aa, Borrelia burgdorferi B31
FIQNQWKK

SEQ ID NO: 26170 - protein, 8 aa, Borrelia burgdorferi B31
IQNQWKKN

SEQ ID NO: 26171 - protein, 8 aa, Borrelia burgdorferi B31
QNQWKKNL

SEQ ID NO: 26172 - protein, 8 aa, Borrelia burgdorferi B31
NQWKKNLN

SEQ ID NO: 26173 - protein, 8 aa, Borrelia burgdorferi B31
QWKKNLNI

SEQ ID NO: 26174 - protein, 8 aa, Borrelia burgdorferi B31
WKKNLNID

SEQ ID NO: 26175 - protein, 8 aa, Borrelia burgdorferi B31
KKNLNIDV

SEQ ID NO: 26176 - protein, 8 aa, Borrelia burgdorferi B31
KNLNIDVE

SEQ ID NO: 26177 - protein, 8 aa, Borrelia burgdorferi B31
NLNIDVEL

SEQ ID NO: 26178 - protein, 8 aa, Borrelia burgdorferi B31
LNIDVELE

SEQ ID NO: 26179 - protein, 8 aa, Borrelia burgdorferi B31
NIDVELEN

SEQ ID NO: 26180 - protein, 8 aa, Borrelia burgdorferi B31
IDVELENE

SEQ ID NO: 26181 - protein, 8 aa, Borrelia burgdorferi B31
DVELENEE

SEQ ID NO: 26182 - protein, 8 aa, Borrelia burgdorferi B31
VELENEEW

SEQ ID NO: 26183 - protein, 8 aa, Borrelia burgdorferi B31
ELENEEWT

SEQ ID NO: 26184 - protein, 8 aa, Borrelia burgdorferi B31
LENEEWTT

SEQ ID NO: 26185 - protein, 8 aa, Borrelia burgdorferi B31
ENEEWTTY

SEQ ID NO: 26186 - protein, 8 aa, Borrelia burgdorferi B31
NEEWTTYL

SEQ ID NO: 26187 - protein, 8 aa, Borrelia burgdorferi B31
EEWTTYLN

SEQ ID NO: 26188 - protein, 8 aa, Borrelia burgdorferi B31
EWTTYLNT

SEQ ID NO: 26189 - protein, 8 aa, Borrelia burgdorferi B31
WTTYLNTK

SEQ ID NO: 26190 - protein, 8 aa, Borrelia burgdorferi B31
TTYLNTKA

SEQ ID NO: 26191 - protein, 8 aa, Borrelia burgdorferi B31
TYLNTKAN

SEQ ID NO: 26192 - protein, 8 aa, Borrelia burgdorferi B31
YLNTKANG

SEQ ID NO: 26193 - protein, 8 aa, Borrelia burgdorferi B31
LNTKANGN

SEQ ID NO: 26194 - protein, 8 aa, Borrelia burgdorferi B31
NTKANGNY

SEQ ID NO: 26195 - protein, 8 aa, Borrelia burgdorferi B31
TKANGNYE

SEQ ID NO: 26196 - protein, 8 aa, Borrelia burgdorferi B31
KANGNYEI

SEQ ID NO: 26197 - protein, 8 aa, Borrelia burgdorferi B31
ANGNYEIA

SEQ ID NO: 26198 - protein, 8 aa, Borrelia burgdorferi B31
NGNYEIAR

SEQ ID NO: 26199 - protein, 8 aa, Borrelia burgdorferi B31
GNYEIARA

SEQ ID NO: 26200 - protein, 8 aa, Borrelia burgdorferi B31
NYEIARAG

SEQ ID NO: 26201 - protein, 8 aa, Borrelia burgdorferi B31
YEIARAGW

SEQ ID NO: 26202 - protein, 8 aa, Borrelia burgdorferi B31
EIARAGWI

SEQ ID NO: 26203 - protein, 8 aa, Borrelia burgdorferi B31
IARAGWIG

SEQ ID NO: 26204 - protein, 8 aa, Borrelia burgdorferi B31
ARAGWIGD

SEQ ID NO: 26205 - protein, 8 aa, Borrelia burgdorferi B31
RAGWIGDY

SEQ ID NO: 26206 - protein, 8 aa, Borrelia burgdorferi B31
AGWIGDYA

SEQ ID NO: 26207 - protein, 8 aa, Borrelia burgdorferi B31
GWIGDYAD

SEQ ID NO: 26208 - protein, 8 aa, Borrelia burgdorferi B31
WIGDYADP

SEQ ID NO: 26209 - protein, 8 aa, Borrelia burgdorferi B31
IGDYADPL

SEQ ID NO: 26210 - protein, 8 aa, Borrelia burgdorferi B31
GDYADPLT

SEQ ID NO: 26211 - protein, 8 aa, Borrelia burgdorferi B31
DYADPLTF

SEQ ID NO: 26212 - protein, 8 aa, Borrelia burgdorferi B31
YADPLTFL

SEQ ID NO: 26213 - protein, 8 aa, Borrelia burgdorferi B31
ADPLTFLS

SEQ ID NO: 26214 - protein, 8 aa, Borrelia burgdorferi B31
DPLTFLSI

SEQ ID NO: 26215 - protein, 8 aa, Borrelia burgdorferi B31
PLTFLSIF

SEQ ID NO: 26216 - protein, 8 aa, Borrelia burgdorferi B31
LTFLSIFT

SEQ ID NO: 26217 - protein, 8 aa, Borrelia burgdorferi B31
TFLSIFTQ

SEQ ID NO: 26218 - protein, 8 aa, Borrelia burgdorferi B31
FLSIFTQG

SEQ ID NO: 26219 - protein, 8 aa, Borrelia burgdorferi B31
LSIFTQGY

SEQ ID NO: 26220 - protein, 8 aa, Borrelia burgdorferi B31
SIFTQGYT

SEQ ID NO: 26221 - protein, 8 aa, Borrelia burgdorferi B31
IFTQGYTQ

SEQ ID NO: 26222 - protein, 8 aa, Borrelia burgdorferi B31
FTQGYTQF

SEQ ID NO: 26223 - protein, 8 aa, Borrelia burgdorferi B31
TQGYTQFS

SEQ ID NO: 26224 - protein, 8 aa, Borrelia burgdorferi B31
QGYTQFSS

SEQ ID NO: 26225 - protein, 8 aa, Borrelia burgdorferi B31
GYTQFSSH

SEQ ID NO: 26226 - protein, 8 aa, Borrelia burgdorferi B31
YTQFSSHN

SEQ ID NO: 26227 - protein, 8 aa, Borrelia burgdorferi B31
TQFSSHNY

SEQ ID NO: 26228 - protein, 8 aa, Borrelia burgdorferi B31
QFSSHNYS

SEQ ID NO: 26229 - protein, 8 aa, Borrelia burgdorferi B31
FSSHNYSN

SEQ ID NO: 26230 - protein, 8 aa, Borrelia burgdorferi B31
SSHNYSNP

SEQ ID NO: 26231 - protein, 8 aa, Borrelia burgdorferi B31
SHNYSNPE

SEQ ID NO: 26232 - protein, 8 aa, Borrelia burgdorferi B31
HNYSNPEY

SEQ ID NO: 26233 - protein, 8 aa, Borrelia burgdorferi B31
NYSNPEYN

SEQ ID NO: 26234 - protein, 8 aa, Borrelia burgdorferi B31
YSNPEYNE

SEQ ID NO: 26235 - protein, 8 aa, Borrelia burgdorferi B31
SNPEYNEL

SEQ ID NO: 26236 - protein, 8 aa, Borrelia burgdorferi B31
NPEYNELI

SEQ ID NO: 26237 - protein, 8 aa, Borrelia burgdorferi B31
PEYNELIK

SEQ ID NO: 26238 - protein, 8 aa, Borrelia burgdorferi B31
EYNELIKK

SEQ ID NO: 26239 - protein, 8 aa, Borrelia burgdorferi B31
YNELIKKS

SEQ ID NO: 26240 - protein, 8 aa, Borrelia burgdorferi B31
NELIKKSD

SEQ ID NO: 26241 - protein, 8 aa, Borrelia burgdorferi B31
ELIKKSDL

SEQ ID NO: 26242 - protein, 8 aa, Borrelia burgdorferi B31
LIKKSDLE

SEQ ID NO: 26243 - protein, 8 aa, Borrelia burgdorferi B31
IKKSDLEL

SEQ ID NO: 26244 - protein, 8 aa, Borrelia burgdorferi B31
KKSDLELD

SEQ ID NO: 26245 - protein, 8 aa, Borrelia burgdorferi B31
KSDLELDP

SEQ ID NO: 26246 - protein, 8 aa, Borrelia burgdorferi B31
SDLELDPI

SEQ ID NO: 26247 - protein, 8 aa, Borrelia burgdorferi B31
DLELDPIK

SEQ ID NO: 26248 - protein, 8 aa, Borrelia burgdorferi B31
LELDPIKR

SEQ ID NO: 26249 - protein, 8 aa, Borrelia burgdorferi B31
ELDPIKRQ

SEQ ID NO: 26250 - protein, 8 aa, Borrelia burgdorferi B31
LDPIKRQD

SEQ ID NO: 26251 - protein, 8 aa, Borrelia burgdorferi B31
DPIKRQDI

SEQ ID NO: 26252 - protein, 8 aa, Borrelia burgdorferi B31
PIKRQDIL

SEQ ID NO: 26253 - protein, 8 aa, Borrelia burgdorferi B31
IKRQDILR

SEQ ID NO: 26254 - protein, 8 aa, Borrelia burgdorferi B31
KRQDILRQ

SEQ ID NO: 26255 - protein, 8 aa, Borrelia burgdorferi B31
RQDILRQA

SEQ ID NO: 26256 - protein, 8 aa, Borrelia burgdorferi B31
QDILRQAE

SEQ ID NO: 26257 - protein, 8 aa, Borrelia burgdorferi B31
DILRQAEE

SEQ ID NO: 26258 - protein, 8 aa, Borrelia burgdorferi B31
ILRQAEEI

SEQ ID NO: 26259 - protein, 8 aa, Borrelia burgdorferi B31
LRQAEEII

SEQ ID NO: 26260 - protein, 8 aa, Borrelia burgdorferi B31
RQAEEIII

SEQ ID NO: 26261 - protein, 8 aa, Borrelia burgdorferi B31
QAEEIIIE

SEQ ID NO: 26262 - protein, 8 aa, Borrelia burgdorferi B31
AEEIIIEK

SEQ ID NO: 26263 - protein, 8 aa, Borrelia burgdorferi B31
EEIIIEKD

SEQ ID NO: 26264 - protein, 8 aa, Borrelia burgdorferi B31
EIIIEKDF

SEQ ID NO: 26265 - protein, 8 aa, Borrelia burgdorferi B31
IIIEKDFP

SEQ ID NO: 26266 - protein, 8 aa, Borrelia burgdorferi B31
IIEKDFPI

SEQ ID NO: 26267 - protein, 8 aa, Borrelia burgdorferi B31
IEKDFPIA

SEQ ID NO: 26268 - protein, 8 aa, Borrelia burgdorferi B31
EKDFPIAP

SEQ ID NO: 26269 - protein, 8 aa, Borrelia burgdorferi B31
KDFPIAPI

SEQ ID NO: 26270 - protein, 8 aa, Borrelia burgdorferi B31
DFPIAPIY

SEQ ID NO: 26271 - protein, 8 aa, Borrelia burgdorferi B31
FPIAPIYI

SEQ ID NO: 26272 - protein, 8 aa, Borrelia burgdorferi B31
PIAPIYIY

SEQ ID NO: 26273 - protein, 8 aa, Borrelia burgdorferi B31
IAPIYIYG

SEQ ID NO: 26274 - protein, 8 aa, Borrelia burgdorferi B31
APIYIYGN

SEQ ID NO: 26275 - protein, 8 aa, Borrelia burgdorferi B31
PIYIYGNS

SEQ ID NO: 26276 - protein, 8 aa, Borrelia burgdorferi B31
IYIYGNSY

SEQ ID NO: 26277 - protein, 8 aa, Borrelia burgdorferi B31
YIYGNSYL

SEQ ID NO: 26278 - protein, 8 aa, Borrelia burgdorferi B31
IYGNSYLF

SEQ ID NO: 26279 - protein, 8 aa, Borrelia burgdorferi B31
YGNSYLFR

SEQ ID NO: 26280 - protein, 8 aa, Borrelia burgdorferi B31
GNSYLFRN

SEQ ID NO: 26281 - protein, 8 aa, Borrelia burgdorferi B31
NSYLFRND

SEQ ID NO: 26282 - protein, 8 aa, Borrelia burgdorferi B31
SYLFRNDK

SEQ ID NO: 26283 - protein, 8 aa, Borrelia burgdorferi B31
YLFRNDKW

SEQ ID NO: 26284 - protein, 8 aa, Borrelia burgdorferi B31
LFRNDKWT

SEQ ID NO: 26285 - protein, 8 aa, Borrelia burgdorferi B31
FRNDKWTG

SEQ ID NO: 26286 - protein, 8 aa, Borrelia burgdorferi B31
RNDKWTGW

SEQ ID NO: 26287 - protein, 8 aa, Borrelia burgdorferi B31
NDKWTGWN

SEQ ID NO: 26288 - protein, 8 aa, Borrelia burgdorferi B31
DKWTGWNT

SEQ ID NO: 26289 - protein, 8 aa, Borrelia burgdorferi B31
KWTGWNTN

SEQ ID NO: 26290 - protein, 8 aa, Borrelia burgdorferi B31
WTGWNTNI

SEQ ID NO: 26291 - protein, 8 aa, Borrelia burgdorferi B31
TGWNTNIL

SEQ ID NO: 26292 - protein, 8 aa, Borrelia burgdorferi B31
GWNTNILE

SEQ ID NO: 26293 - protein, 8 aa, Borrelia burgdorferi B31
WNTNILER

SEQ ID NO: 26294 - protein, 8 aa, Borrelia burgdorferi B31
NTNILERF

SEQ ID NO: 26295 - protein, 8 aa, Borrelia burgdorferi B31
TNILERFD

SEQ ID NO: 26296 - protein, 8 aa, Borrelia burgdorferi B31
NILERFDL

SEQ ID NO: 26297 - protein, 8 aa, Borrelia burgdorferi B31
ILERFDLS

SEQ ID NO: 26298 - protein, 8 aa, Borrelia burgdorferi B31
LERFDLSQ

SEQ ID NO: 26299 - protein, 8 aa, Borrelia burgdorferi B31
ERFDLSQL

SEQ ID NO: 26300 - protein, 8 aa, Borrelia burgdorferi B31
RFDLSQLK

SEQ ID NO: 26301 - protein, 8 aa, Borrelia burgdorferi B31
FDLSQLKL

SEQ ID NO: 26302 - protein, 8 aa, Borrelia burgdorferi B31
DLSQLKLK

SEQ ID NO: 26303 - protein, 8 aa, Borrelia burgdorferi B31
LSQLKLKN

SEQ ID NO: 26304 - protein, 8 aa, Borrelia burgdorferi B31
SQLKLKNK

SEQ ID NO: 26305 - protein, 9 aa, Borrelia burgdorferi B31
MKLQRSLFL

SEQ ID NO: 26306 - protein, 9 aa, Borrelia burgdorferi B31
KLQRSLFLI

SEQ ID NO: 26307 - protein, 9 aa, Borrelia burgdorferi B31
LQRSLFLII

SEQ ID NO: 26308 - protein, 9 aa, Borrelia burgdorferi B31
QRSLFLIIF

SEQ ID NO: 26309 - protein, 9 aa, Borrelia burgdorferi B31
RSLFLIIFF

SEQ ID NO: 26310 - protein, 9 aa, Borrelia burgdorferi B31
SLFLIIFFL

SEQ ID NO: 26311 - protein, 9 aa, Borrelia burgdorferi B31
LFLIIFFLT

SEQ ID NO: 26312 - protein, 9 aa, Borrelia burgdorferi B31
FLIIFFLTF

SEQ ID NO: 26313 - protein, 9 aa, Borrelia burgdorferi B31
LIIFFLTFL

SEQ ID NO: 26314 - protein, 9 aa, Borrelia burgdorferi B31
IIFFLTFLC

SEQ ID NO: 26315 - protein, 9 aa, Borrelia burgdorferi B31
IFFLTFLCC

SEQ ID NO: 26316 - protein, 9 aa, Borrelia burgdorferi B31
FFLTFLCCN

SEQ ID NO: 26317 - protein, 9 aa, Borrelia burgdorferi B31
FLTFLCCNN

SEQ ID NO: 26318 - protein, 9 aa, Borrelia burgdorferi B31
LTFLCCNNK

SEQ ID NO: 26319 - protein, 9 aa, Borrelia burgdorferi B31
TFLCCNNKE

SEQ ID NO: 26320 - protein, 9 aa, Borrelia burgdorferi B31
FLCCNNKER

SEQ ID NO: 26321 - protein, 9 aa, Borrelia burgdorferi B31
LCCNNKERK

SEQ ID NO: 26322 - protein, 9 aa, Borrelia burgdorferi B31
CCNNKERKE

SEQ ID NO: 26323 - protein, 9 aa, Borrelia burgdorferi B31
CNNKERKEG

SEQ ID NO: 26324 - protein, 9 aa, Borrelia burgdorferi B31
NNKERKEGV

SEQ ID NO: 26325 - protein, 9 aa, Borrelia burgdorferi B31
NKERKEGVS

SEQ ID NO: 26326 - protein, 9 aa, Borrelia burgdorferi B31
KERKEGVSF

SEQ ID NO: 26327 - protein, 9 aa, Borrelia burgdorferi B31
ERKEGVSFK

SEQ ID NO: 26328 - protein, 9 aa, Borrelia burgdorferi B31
RKEGVSFKI

SEQ ID NO: 26329 - protein, 9 aa, Borrelia burgdorferi B31
KEGVSFKIS

SEQ ID NO: 26330 - protein, 9 aa, Borrelia burgdorferi B31
EGVSFKISL

SEQ ID NO: 26331 - protein, 9 aa, Borrelia burgdorferi B31
GVSFKISLG

SEQ ID NO: 26332 - protein, 9 aa, Borrelia burgdorferi B31
VSFKISLGA

SEQ ID NO: 26333 - protein, 9 aa, Borrelia burgdorferi B31
SFKISLGAE

SEQ ID NO: 26334 - protein, 9 aa, Borrelia burgdorferi B31
FKISLGAEP

SEQ ID NO: 26335 - protein, 9 aa, Borrelia burgdorferi B31
KISLGAEPS

SEQ ID NO: 26336 - protein, 9 aa, Borrelia burgdorferi B31
ISLGAEPSS

SEQ ID NO: 26337 - protein, 9 aa, Borrelia burgdorferi B31
SLGAEPSSL

SEQ ID NO: 26338 - protein, 9 aa, Borrelia burgdorferi B31
LGAEPSSLD

SEQ ID NO: 26339 - protein, 9 aa, Borrelia burgdorferi B31
GAEPSSLDP

SEQ ID NO: 26340 - protein, 9 aa, Borrelia burgdorferi B31
AEPSSLDPQ

SEQ ID NO: 26341 - protein, 9 aa, Borrelia burgdorferi B31
EPSSLDPQL

SEQ ID NO: 26342 - protein, 9 aa, Borrelia burgdorferi B31
PSSLDPQLA

SEQ ID NO: 26343 - protein, 9 aa, Borrelia burgdorferi B31
SSLDPQLAE

SEQ ID NO: 26344 - protein, 9 aa, Borrelia burgdorferi B31
SLDPQLAED

SEQ ID NO: 26345 - protein, 9 aa, Borrelia burgdorferi B31
LDPQLAEDN

SEQ ID NO: 26346 - protein, 9 aa, Borrelia burgdorferi B31
DPQLAEDNV

SEQ ID NO: 26347 - protein, 9 aa, Borrelia burgdorferi B31
PQLAEDNVA

SEQ ID NO: 26348 - protein, 9 aa, Borrelia burgdorferi B31
QLAEDNVAS

SEQ ID NO: 26349 - protein, 9 aa, Borrelia burgdorferi B31
LAEDNVASK

SEQ ID NO: 26350 - protein, 9 aa, Borrelia burgdorferi B31
AEDNVASKM

SEQ ID NO: 26351 - protein, 9 aa, Borrelia burgdorferi B31
EDNVASKMI

SEQ ID NO: 26352 - protein, 9 aa, Borrelia burgdorferi B31
DNVASKMID

SEQ ID NO: 26353 - protein, 9 aa, Borrelia burgdorferi B31
NVASKMIDT

SEQ ID NO: 26354 - protein, 9 aa, Borrelia burgdorferi B31
VASKMIDTM

SEQ ID NO: 26355 - protein, 9 aa, Borrelia burgdorferi B31
ASKMIDTMF

SEQ ID NO: 26356 - protein, 9 aa, Borrelia burgdorferi B31
SKMIDTMFR

SEQ ID NO: 26357 - protein, 9 aa, Borrelia burgdorferi B31
KMIDTMFRG

SEQ ID NO: 26358 - protein, 9 aa, Borrelia burgdorferi B31
MIDTMFRGI

SEQ ID NO: 26359 - protein, 9 aa, Borrelia burgdorferi B31
IDTMFRGIV

SEQ ID NO: 26360 - protein, 9 aa, Borrelia burgdorferi B31
DTMFRGIVT

SEQ ID NO: 26361 - protein, 9 aa, Borrelia burgdorferi B31
TMFRGIVTG

SEQ ID NO: 26362 - protein, 9 aa, Borrelia burgdorferi B31
MFRGIVTGD

SEQ ID NO: 26363 - protein, 9 aa, Borrelia burgdorferi B31
FRGIVTGDP

SEQ ID NO: 26364 - protein, 9 aa, Borrelia burgdorferi B31
RGIVTGDPN

SEQ ID NO: 26365 - protein, 9 aa, Borrelia burgdorferi B31
GIVTGDPNT

SEQ ID NO: 26366 - protein, 9 aa, Borrelia burgdorferi B31
IVTGDPNTG

SEQ ID NO: 26367 - protein, 9 aa, Borrelia burgdorferi B31
VTGDPNTGG

SEQ ID NO: 26368 - protein, 9 aa, Borrelia burgdorferi B31
TGDPNTGGN

SEQ ID NO: 26369 - protein, 9 aa, Borrelia burgdorferi B31
GDPNTGGNK

SEQ ID NO: 26370 - protein, 9 aa, Borrelia burgdorferi B31
DPNTGGNKP

SEQ ID NO: 26371 - protein, 9 aa, Borrelia burgdorferi B31
PNTGGNKPG

SEQ ID NO: 26372 - protein, 9 aa, Borrelia burgdorferi B31
NTGGNKPGL

SEQ ID NO: 26373 - protein, 9 aa, Borrelia burgdorferi B31
TGGNKPGLA

SEQ ID NO: 26374 - protein, 9 aa, Borrelia burgdorferi B31
GGNKPGLAK

SEQ ID NO: 26375 - protein, 9 aa, Borrelia burgdorferi B31
GNKPGLAKG

SEQ ID NO: 26376 - protein, 9 aa, Borrelia burgdorferi B31
NKPGLAKGW

SEQ ID NO: 26377 - protein, 9 aa, Borrelia burgdorferi B31
KPGLAKGWD

SEQ ID NO: 26378 - protein, 9 aa, Borrelia burgdorferi B31
PGLAKGWDI

SEQ ID NO: 26379 - protein, 9 aa, Borrelia burgdorferi B31
GLAKGWDIS

SEQ ID NO: 26380 - protein, 9 aa, Borrelia burgdorferi B31
LAKGWDISS

SEQ ID NO: 26381 - protein, 9 aa, Borrelia burgdorferi B31
AKGWDISSD

SEQ ID NO: 26382 - protein, 9 aa, Borrelia burgdorferi B31
KGWDISSDG

SEQ ID NO: 26383 - protein, 9 aa, Borrelia burgdorferi B31
GWDISSDGT

SEQ ID NO: 26384 - protein, 9 aa, Borrelia burgdorferi B31
WDISSDGTV

SEQ ID NO: 26385 - protein, 9 aa, Borrelia burgdorferi B31
DISSDGTVY

SEQ ID NO: 26386 - protein, 9 aa, Borrelia burgdorferi B31
ISSDGTVYT

SEQ ID NO: 26387 - protein, 9 aa, Borrelia burgdorferi B31
SSDGTVYTF

SEQ ID NO: 26388 - protein, 9 aa, Borrelia burgdorferi B31
SDGTVYTFN

SEQ ID NO: 26389 - protein, 9 aa, Borrelia burgdorferi B31
DGTVYTFNL

SEQ ID NO: 26390 - protein, 9 aa, Borrelia burgdorferi B31
GTVYTFNLR

SEQ ID NO: 26391 - protein, 9 aa, Borrelia burgdorferi B31
TVYTFNLRE

SEQ ID NO: 26392 - protein, 9 aa, Borrelia burgdorferi B31
VYTFNLREK

SEQ ID NO: 26393 - protein, 9 aa, Borrelia burgdorferi B31
YTFNLREKI

SEQ ID NO: 26394 - protein, 9 aa, Borrelia burgdorferi B31
TFNLREKIT

SEQ ID NO: 26395 - protein, 9 aa, Borrelia burgdorferi B31
FNLREKITW

SEQ ID NO: 26396 - protein, 9 aa, Borrelia burgdorferi B31
NLREKITWS

SEQ ID NO: 26397 - protein, 9 aa, Borrelia burgdorferi B31
LREKITWSD

SEQ ID NO: 26398 - protein, 9 aa, Borrelia burgdorferi B31
REKITWSDG

SEQ ID NO: 26399 - protein, 9 aa, Borrelia burgdorferi B31
EKITWSDGV

SEQ ID NO: 26400 - protein, 9 aa, Borrelia burgdorferi B31
KITWSDGVA

SEQ ID NO: 26401 - protein, 9 aa, Borrelia burgdorferi B31
ITWSDGVAI

SEQ ID NO: 26402 - protein, 9 aa, Borrelia burgdorferi B31
TWSDGVAIT

SEQ ID NO: 26403 - protein, 9 aa, Borrelia burgdorferi B31
WSDGVAITA

SEQ ID NO: 26404 - protein, 9 aa, Borrelia burgdorferi B31
SDGVAITAE

SEQ ID NO: 26405 - protein, 9 aa, Borrelia burgdorferi B31
DGVAITAEG

SEQ ID NO: 26406 - protein, 9 aa, Borrelia burgdorferi B31
GVAITAEGI

SEQ ID NO: 26407 - protein, 9 aa, Borrelia burgdorferi B31
VAITAEGIR

SEQ ID NO: 26408 - protein, 9 aa, Borrelia burgdorferi B31
AITAEGIRK

SEQ ID NO: 26409 - protein, 9 aa, Borrelia burgdorferi B31
ITAEGIRKS

SEQ ID NO: 26410 - protein, 9 aa, Borrelia burgdorferi B31
TAEGIRKSY

SEQ ID NO: 26411 - protein, 9 aa, Borrelia burgdorferi B31
AEGIRKSYL

SEQ ID NO: 26412 - protein, 9 aa, Borrelia burgdorferi B31
EGIRKSYLR

SEQ ID NO: 26413 - protein, 9 aa, Borrelia burgdorferi B31
GIRKSYLRI

SEQ ID NO: 26414 - protein, 9 aa, Borrelia burgdorferi B31
IRKSYLRIL

SEQ ID NO: 26415 - protein, 9 aa, Borrelia burgdorferi B31
RKSYLRILN

SEQ ID NO: 26416 - protein, 9 aa, Borrelia burgdorferi B31
KSYLRILNK

SEQ ID NO: 26417 - protein, 9 aa, Borrelia burgdorferi B31
SYLRILNKE

SEQ ID NO: 26418 - protein, 9 aa, Borrelia burgdorferi B31
YLRILNKET

SEQ ID NO: 26419 - protein, 9 aa, Borrelia burgdorferi B31
LRILNKETG

SEQ ID NO: 26420 - protein, 9 aa, Borrelia burgdorferi B31
RILNKETGS

SEQ ID NO: 26421 - protein, 9 aa, Borrelia burgdorferi B31
ILNKETGSK

SEQ ID NO: 26422 - protein, 9 aa, Borrelia burgdorferi B31
LNKETGSKY

SEQ ID NO: 26423 - protein, 9 aa, Borrelia burgdorferi B31
NKETGSKYV

SEQ ID NO: 26424 - protein, 9 aa, Borrelia burgdorferi B31
KETGSKYVE

SEQ ID NO: 26425 - protein, 9 aa, Borrelia burgdorferi B31
ETGSKYVEM

SEQ ID NO: 26426 - protein, 9 aa, Borrelia burgdorferi B31
TGSKYVEMV

SEQ ID NO: 26427 - protein, 9 aa, Borrelia burgdorferi B31
GSKYVEMVK

SEQ ID NO: 26428 - protein, 9 aa, Borrelia burgdorferi B31
SKYVEMVKS

SEQ ID NO: 26429 - protein, 9 aa, Borrelia burgdorferi B31
KYVEMVKSV

SEQ ID NO: 26430 - protein, 9 aa, Borrelia burgdorferi B31
YVEMVKSVI

SEQ ID NO: 26431 - protein, 9 aa, Borrelia burgdorferi B31
VEMVKSVIK

SEQ ID NO: 26432 - protein, 9 aa, Borrelia burgdorferi B31
EMVKSVIKN

SEQ ID NO: 26433 - protein, 9 aa, Borrelia burgdorferi B31
MVKSVIKNG

SEQ ID NO: 26434 - protein, 9 aa, Borrelia burgdorferi B31
VKSVIKNGQ

SEQ ID NO: 26435 - protein, 9 aa, Borrelia burgdorferi B31
KSVIKNGQK

SEQ ID NO: 26436 - protein, 9 aa, Borrelia burgdorferi B31
SVIKNGQKY

SEQ ID NO: 26437 - protein, 9 aa, Borrelia burgdorferi B31
VIKNGQKYF

SEQ ID NO: 26438 - protein, 9 aa, Borrelia burgdorferi B31
IKNGQKYFD

SEQ ID NO: 26439 - protein, 9 aa, Borrelia burgdorferi B31
KNGQKYFDG

SEQ ID NO: 26440 - protein, 9 aa, Borrelia burgdorferi B31
NGQKYFDGQ

SEQ ID NO: 26441 - protein, 9 aa, Borrelia burgdorferi B31
GQKYFDGQV

SEQ ID NO: 26442 - protein, 9 aa, Borrelia burgdorferi B31
QKYFDGQVT

SEQ ID NO: 26443 - protein, 9 aa, Borrelia burgdorferi B31
KYFDGQVTD

SEQ ID NO: 26444 - protein, 9 aa, Borrelia burgdorferi B31
YFDGQVTDS

SEQ ID NO: 26445 - protein, 9 aa, Borrelia burgdorferi B31
FDGQVTDSE

SEQ ID NO: 26446 - protein, 9 aa, Borrelia burgdorferi B31
DGQVTDSEL

SEQ ID NO: 26447 - protein, 9 aa, Borrelia burgdorferi B31
GQVTDSELG

SEQ ID NO: 26448 - protein, 9 aa, Borrelia burgdorferi B31
QVTDSELGI

SEQ ID NO: 26449 - protein, 9 aa, Borrelia burgdorferi B31
VTDSELGIR

SEQ ID NO: 26450 - protein, 9 aa, Borrelia burgdorferi B31
TDSELGIRA

SEQ ID NO: 26451 - protein, 9 aa, Borrelia burgdorferi B31
DSELGIRAI

SEQ ID NO: 26452 - protein, 9 aa, Borrelia burgdorferi B31
SELGIRAID

SEQ ID NO: 26453 - protein, 9 aa, Borrelia burgdorferi B31
ELGIRAIDE

SEQ ID NO: 26454 - protein, 9 aa, Borrelia burgdorferi B31
LGIRAIDEK

SEQ ID NO: 26455 - protein, 9 aa, Borrelia burgdorferi B31
GIRAIDEKT

SEQ ID NO: 26456 - protein, 9 aa, Borrelia burgdorferi B31
IRAIDEKTL

SEQ ID NO: 26457 - protein, 9 aa, Borrelia burgdorferi B31
RAIDEKTLE

SEQ ID NO: 26458 - protein, 9 aa, Borrelia burgdorferi B31
AIDEKTLEI

SEQ ID NO: 26459 - protein, 9 aa, Borrelia burgdorferi B31
IDEKTLEIT

SEQ ID NO: 26460 - protein, 9 aa, Borrelia burgdorferi B31
DEKTLEITL

SEQ ID NO: 26461 - protein, 9 aa, Borrelia burgdorferi B31
EKTLEITLE

SEQ ID NO: 26462 - protein, 9 aa, Borrelia burgdorferi B31
KTLEITLES

SEQ ID NO: 26463 - protein, 9 aa, Borrelia burgdorferi B31
TLEITLESP

SEQ ID NO: 26464 - protein, 9 aa, Borrelia burgdorferi B31
LEITLESPK

SEQ ID NO: 26465 - protein, 9 aa, Borrelia burgdorferi B31
EITLESPKP

SEQ ID NO: 26466 - protein, 9 aa, Borrelia burgdorferi B31
ITLESPKPY

SEQ ID NO: 26467 - protein, 9 aa, Borrelia burgdorferi B31
TLESPKPYF

SEQ ID NO: 26468 - protein, 9 aa, Borrelia burgdorferi B31
LESPKPYFI

SEQ ID NO: 26469 - protein, 9 aa, Borrelia burgdorferi B31
ESPKPYFID

SEQ ID NO: 26470 - protein, 9 aa, Borrelia burgdorferi B31
SPKPYFIDM

SEQ ID NO: 26471 - protein, 9 aa, Borrelia burgdorferi B31
PKPYFIDML

SEQ ID NO: 26472 - protein, 9 aa, Borrelia burgdorferi B31
KPYFIDMLV

SEQ ID NO: 26473 - protein, 9 aa, Borrelia burgdorferi B31
PYFIDMLVH

SEQ ID NO: 26474 - protein, 9 aa, Borrelia burgdorferi B31
YFIDMLVHQ

SEQ ID NO: 26475 - protein, 9 aa, Borrelia burgdorferi B31
FIDMLVHQS

SEQ ID NO: 26476 - protein, 9 aa, Borrelia burgdorferi B31
IDMLVHQSF

SEQ ID NO: 26477 - protein, 9 aa, Borrelia burgdorferi B31
DMLVHQSFI

SEQ ID NO: 26478 - protein, 9 aa, Borrelia burgdorferi B31
MLVHQSFIP

SEQ ID NO: 26479 - protein, 9 aa, Borrelia burgdorferi B31
LVHQSFIPV

SEQ ID NO: 26480 - protein, 9 aa, Borrelia burgdorferi B31
VHQSFIPVP

SEQ ID NO: 26481 - protein, 9 aa, Borrelia burgdorferi B31
HQSFIPVPV

SEQ ID NO: 26482 - protein, 9 aa, Borrelia burgdorferi B31
QSFIPVPVH

SEQ ID NO: 26483 - protein, 9 aa, Borrelia burgdorferi B31
SFIPVPVHV

SEQ ID NO: 26484 - protein, 9 aa, Borrelia burgdorferi B31
FIPVPVHVT

SEQ ID NO: 26485 - protein, 9 aa, Borrelia burgdorferi B31
IPVPVHVTE

SEQ ID NO: 26486 - protein, 9 aa, Borrelia burgdorferi B31
PVPVHVTEK

SEQ ID NO: 26487 - protein, 9 aa, Borrelia burgdorferi B31
VPVHVTEKY

SEQ ID NO: 26488 - protein, 9 aa, Borrelia burgdorferi B31
PVHVTEKYG

SEQ ID NO: 26489 - protein, 9 aa, Borrelia burgdorferi B31
VHVTEKYGQ

SEQ ID NO: 26490 - protein, 9 aa, Borrelia burgdorferi B31
HVTEKYGQN

SEQ ID NO: 26491 - protein, 9 aa, Borrelia burgdorferi B31
VTEKYGQNW

SEQ ID NO: 26492 - protein, 9 aa, Borrelia burgdorferi B31
TEKYGQNWT

SEQ ID NO: 26493 - protein, 9 aa, Borrelia burgdorferi B31
EKYGQNWTS

SEQ ID NO: 26494 - protein, 9 aa, Borrelia burgdorferi B31
KYGQNWTSP

SEQ ID NO: 26495 - protein, 9 aa, Borrelia burgdorferi B31
YGQNWTSPE

SEQ ID NO: 26496 - protein, 9 aa, Borrelia burgdorferi B31
GQNWTSPEN

SEQ ID NO: 26497 - protein, 9 aa, Borrelia burgdorferi B31
QNWTSPENM

SEQ ID NO: 26498 - protein, 9 aa, Borrelia burgdorferi B31
NWTSPENMV

SEQ ID NO: 26499 - protein, 9 aa, Borrelia burgdorferi B31
WTSPENMVT

SEQ ID NO: 26500 - protein, 9 aa, Borrelia burgdorferi B31
TSPENMVTS

SEQ ID NO: 26501 - protein, 9 aa, Borrelia burgdorferi B31
SPENMVTSG

SEQ ID NO: 26502 - protein, 9 aa, Borrelia burgdorferi B31
PENMVTSGP

SEQ ID NO: 26503 - protein, 9 aa, Borrelia burgdorferi B31
ENMVTSGPF

SEQ ID NO: 26504 - protein, 9 aa, Borrelia burgdorferi B31
NMVTSGPFK

SEQ ID NO: 26505 - protein, 9 aa, Borrelia burgdorferi B31
MVTSGPFKL

SEQ ID NO: 26506 - protein, 9 aa, Borrelia burgdorferi B31
VTSGPFKLK

SEQ ID NO: 26507 - protein, 9 aa, Borrelia burgdorferi B31
TSGPFKLKE

SEQ ID NO: 26508 - protein, 9 aa, Borrelia burgdorferi B31
SGPFKLKER

SEQ ID NO: 26509 - protein, 9 aa, Borrelia burgdorferi B31
GPFKLKERI

SEQ ID NO: 26510 - protein, 9 aa, Borrelia burgdorferi B31
PFKLKERIP

SEQ ID NO: 26511 - protein, 9 aa, Borrelia burgdorferi B31
FKLKERIPN

SEQ ID NO: 26512 - protein, 9 aa, Borrelia burgdorferi B31
KLKERIPNE

SEQ ID NO: 26513 - protein, 9 aa, Borrelia burgdorferi B31
LKERIPNEK

SEQ ID NO: 26514 - protein, 9 aa, Borrelia burgdorferi B31
KERIPNEKY

SEQ ID NO: 26515 - protein, 9 aa, Borrelia burgdorferi B31
ERIPNEKYV

SEQ ID NO: 26516 - protein, 9 aa, Borrelia burgdorferi B31
RIPNEKYVF

SEQ ID NO: 26517 - protein, 9 aa, Borrelia burgdorferi B31
IPNEKYVFE

SEQ ID NO: 26518 - protein, 9 aa, Borrelia burgdorferi B31
PNEKYVFEK

SEQ ID NO: 26519 - protein, 9 aa, Borrelia burgdorferi B31
NEKYVFEKN

SEQ ID NO: 26520 - protein, 9 aa, Borrelia burgdorferi B31
EKYVFEKNN

SEQ ID NO: 26521 - protein, 9 aa, Borrelia burgdorferi B31
KYVFEKNNK

SEQ ID NO: 26522 - protein, 9 aa, Borrelia burgdorferi B31
YVFEKNNKY

SEQ ID NO: 26523 - protein, 9 aa, Borrelia burgdorferi B31
VFEKNNKYY

SEQ ID NO: 26524 - protein, 9 aa, Borrelia burgdorferi B31
FEKNNKYYD

SEQ ID NO: 26525 - protein, 9 aa, Borrelia burgdorferi B31
EKNNKYYDS

SEQ ID NO: 26526 - protein, 9 aa, Borrelia burgdorferi B31
KNNKYYDSN

SEQ ID NO: 26527 - protein, 9 aa, Borrelia burgdorferi B31
NNKYYDSNE

SEQ ID NO: 26528 - protein, 9 aa, Borrelia burgdorferi B31
NKYYDSNEV

SEQ ID NO: 26529 - protein, 9 aa, Borrelia burgdorferi B31
KYYDSNEVE

SEQ ID NO: 26530 - protein, 9 aa, Borrelia burgdorferi B31
YYDSNEVEL

SEQ ID NO: 26531 - protein, 9 aa, Borrelia burgdorferi B31
YDSNEVELE

SEQ ID NO: 26532 - protein, 9 aa, Borrelia burgdorferi B31
DSNEVELEE

SEQ ID NO: 26533 - protein, 9 aa, Borrelia burgdorferi B31
SNEVELEEI

SEQ ID NO: 26534 - protein, 9 aa, Borrelia burgdorferi B31
NEVELEEIT

SEQ ID NO: 26535 - protein, 9 aa, Borrelia burgdorferi B31
EVELEEITF

SEQ ID NO: 26536 - protein, 9 aa, Borrelia burgdorferi B31
VELEEITFY

SEQ ID NO: 26537 - protein, 9 aa, Borrelia burgdorferi B31
ELEEITFYT

SEQ ID NO: 26538 - protein, 9 aa, Borrelia burgdorferi B31
LEEITFYTT

SEQ ID NO: 26539 - protein, 9 aa, Borrelia burgdorferi B31
EEITFYTTN

SEQ ID NO: 26540 - protein, 9 aa, Borrelia burgdorferi B31
EITFYTTND

SEQ ID NO: 26541 - protein, 9 aa, Borrelia burgdorferi B31
ITFYTTNDS

SEQ ID NO: 26542 - protein, 9 aa, Borrelia burgdorferi B31
TFYTTNDSS

SEQ ID NO: 26543 - protein, 9 aa, Borrelia burgdorferi B31
FYTTNDSST

SEQ ID NO: 26544 - protein, 9 aa, Borrelia burgdorferi B31
YTTNDSSTA

SEQ ID NO: 26545 - protein, 9 aa, Borrelia burgdorferi B31
TTNDSSTAY

SEQ ID NO: 26546 - protein, 9 aa, Borrelia burgdorferi B31
TNDSSTAYK

SEQ ID NO: 26547 - protein, 9 aa, Borrelia burgdorferi B31
NDSSTAYKM

SEQ ID NO: 26548 - protein, 9 aa, Borrelia burgdorferi B31
DSSTAYKMY

SEQ ID NO: 26549 - protein, 9 aa, Borrelia burgdorferi B31
SSTAYKMYE

SEQ ID NO: 26550 - protein, 9 aa, Borrelia burgdorferi B31
STAYKMYEN

SEQ ID NO: 26551 - protein, 9 aa, Borrelia burgdorferi B31
TAYKMYENE

SEQ ID NO: 26552 - protein, 9 aa, Borrelia burgdorferi B31
AYKMYENEE

SEQ ID NO: 26553 - protein, 9 aa, Borrelia burgdorferi B31
YKMYENEEL

SEQ ID NO: 26554 - protein, 9 aa, Borrelia burgdorferi B31
KMYENEELD

SEQ ID NO: 26555 - protein, 9 aa, Borrelia burgdorferi B31
MYENEELDA

SEQ ID NO: 26556 - protein, 9 aa, Borrelia burgdorferi B31
YENEELDAI

SEQ ID NO: 26557 - protein, 9 aa, Borrelia burgdorferi B31
ENEELDAIF

SEQ ID NO: 26558 - protein, 9 aa, Borrelia burgdorferi B31
NEELDAIFG

SEQ ID NO: 26559 - protein, 9 aa, Borrelia burgdorferi B31
EELDAIFGS

SEQ ID NO: 26560 - protein, 9 aa, Borrelia burgdorferi B31
ELDAIFGSI

SEQ ID NO: 26561 - protein, 9 aa, Borrelia burgdorferi B31
LDAIFGSIP

SEQ ID NO: 26562 - protein, 9 aa, Borrelia burgdorferi B31
DAIFGSIPP

SEQ ID NO: 26563 - protein, 9 aa, Borrelia burgdorferi B31
AIFGSIPPD

SEQ ID NO: 26564 - protein, 9 aa, Borrelia burgdorferi B31
IFGSIPPDL

SEQ ID NO: 26565 - protein, 9 aa, Borrelia burgdorferi B31
FGSIPPDLI

SEQ ID NO: 26566 - protein, 9 aa, Borrelia burgdorferi B31
GSIPPDLIK

SEQ ID NO: 26567 - protein, 9 aa, Borrelia burgdorferi B31
SIPPDLIKN

SEQ ID NO: 26568 - protein, 9 aa, Borrelia burgdorferi B31
IPPDLIKNL

SEQ ID NO: 26569 - protein, 9 aa, Borrelia burgdorferi B31
PPDLIKNLK

SEQ ID NO: 26570 - protein, 9 aa, Borrelia burgdorferi B31
PDLIKNLKL

SEQ ID NO: 26571 - protein, 9 aa, Borrelia burgdorferi B31
DLIKNLKLR

SEQ ID NO: 26572 - protein, 9 aa, Borrelia burgdorferi B31
LIKNLKLRS

SEQ ID NO: 26573 - protein, 9 aa, Borrelia burgdorferi B31
IKNLKLRSD

SEQ ID NO: 26574 - protein, 9 aa, Borrelia burgdorferi B31
KNLKLRSDY

SEQ ID NO: 26575 - protein, 9 aa, Borrelia burgdorferi B31
NLKLRSDYY

SEQ ID NO: 26576 - protein, 9 aa, Borrelia burgdorferi B31
LKLRSDYYS

SEQ ID NO: 26577 - protein, 9 aa, Borrelia burgdorferi B31
KLRSDYYSS

SEQ ID NO: 26578 - protein, 9 aa, Borrelia burgdorferi B31
LRSDYYSSA

SEQ ID NO: 26579 - protein, 9 aa, Borrelia burgdorferi B31
RSDYYSSAV

SEQ ID NO: 26580 - protein, 9 aa, Borrelia burgdorferi B31
SDYYSSAVN

SEQ ID NO: 26581 - protein, 9 aa, Borrelia burgdorferi B31
DYYSSAVNA

SEQ ID NO: 26582 - protein, 9 aa, Borrelia burgdorferi B31
YYSSAVNAI

SEQ ID NO: 26583 - protein, 9 aa, Borrelia burgdorferi B31
YSSAVNAIY

SEQ ID NO: 26584 - protein, 9 aa, Borrelia burgdorferi B31
SSAVNAIYF

SEQ ID NO: 26585 - protein, 9 aa, Borrelia burgdorferi B31
SAVNAIYFY

SEQ ID NO: 26586 - protein, 9 aa, Borrelia burgdorferi B31
AVNAIYFYA

SEQ ID NO: 26587 - protein, 9 aa, Borrelia burgdorferi B31
VNAIYFYAF

SEQ ID NO: 26588 - protein, 9 aa, Borrelia burgdorferi B31
NAIYFYAFN

SEQ ID NO: 26589 - protein, 9 aa, Borrelia burgdorferi B31
AIYFYAFNT

SEQ ID NO: 26590 - protein, 9 aa, Borrelia burgdorferi B31
IYFYAFNTH

SEQ ID NO: 26591 - protein, 9 aa, Borrelia burgdorferi B31
YFYAFNTHI

SEQ ID NO: 26592 - protein, 9 aa, Borrelia burgdorferi B31
FYAFNTHIK

SEQ ID NO: 26593 - protein, 9 aa, Borrelia burgdorferi B31
YAFNTHIKP

SEQ ID NO: 26594 - protein, 9 aa, Borrelia burgdorferi B31
AFNTHIKPL

SEQ ID NO: 26595 - protein, 9 aa, Borrelia burgdorferi B31
FNTHIKPLD

SEQ ID NO: 26596 - protein, 9 aa, Borrelia burgdorferi B31
NTHIKPLDN

SEQ ID NO: 26597 - protein, 9 aa, Borrelia burgdorferi B31
THIKPLDNV

SEQ ID NO: 26598 - protein, 9 aa, Borrelia burgdorferi B31
HIKPLDNVK

SEQ ID NO: 26599 - protein, 9 aa, Borrelia burgdorferi B31
IKPLDNVKI

SEQ ID NO: 26600 - protein, 9 aa, Borrelia burgdorferi B31
KPLDNVKIR

SEQ ID NO: 26601 - protein, 9 aa, Borrelia burgdorferi B31
PLDNVKIRK

SEQ ID NO: 26602 - protein, 9 aa, Borrelia burgdorferi B31
LDNVKIRKA

SEQ ID NO: 26603 - protein, 9 aa, Borrelia burgdorferi B31
DNVKIRKAL

SEQ ID NO: 26604 - protein, 9 aa, Borrelia burgdorferi B31
NVKIRKALT

SEQ ID NO: 26605 - protein, 9 aa, Borrelia burgdorferi B31
VKIRKALTL

SEQ ID NO: 26606 - protein, 9 aa, Borrelia burgdorferi B31
KIRKALTLA

SEQ ID NO: 26607 - protein, 9 aa, Borrelia burgdorferi B31
IRKALTLAI

SEQ ID NO: 26608 - protein, 9 aa, Borrelia burgdorferi B31
RKALTLAID

SEQ ID NO: 26609 - protein, 9 aa, Borrelia burgdorferi B31
KALTLAIDR

SEQ ID NO: 26610 - protein, 9 aa, Borrelia burgdorferi B31
ALTLAIDRE

SEQ ID NO: 26611 - protein, 9 aa, Borrelia burgdorferi B31
LTLAIDRET

SEQ ID NO: 26612 - protein, 9 aa, Borrelia burgdorferi B31
TLAIDRETL

SEQ ID NO: 26613 - protein, 9 aa, Borrelia burgdorferi B31
LAIDRETLT

SEQ ID NO: 26614 - protein, 9 aa, Borrelia burgdorferi B31
AIDRETLTY

SEQ ID NO: 26615 - protein, 9 aa, Borrelia burgdorferi B31
IDRETLTYK

SEQ ID NO: 26616 - protein, 9 aa, Borrelia burgdorferi B31
DRETLTYKV

SEQ ID NO: 26617 - protein, 9 aa, Borrelia burgdorferi B31
RETLTYKVL

SEQ ID NO: 26618 - protein, 9 aa, Borrelia burgdorferi B31
ETLTYKVLD

SEQ ID NO: 26619 - protein, 9 aa, Borrelia burgdorferi B31
TLTYKVLDN

SEQ ID NO: 26620 - protein, 9 aa, Borrelia burgdorferi B31
LTYKVLDNG

SEQ ID NO: 26621 - protein, 9 aa, Borrelia burgdorferi B31
TYKVLDNGT

SEQ ID NO: 26622 - protein, 9 aa, Borrelia burgdorferi B31
YKVLDNGTT

SEQ ID NO: 26623 - protein, 9 aa, Borrelia burgdorferi B31
KVLDNGTTP

SEQ ID NO: 26624 - protein, 9 aa, Borrelia burgdorferi B31
VLDNGTTPT

SEQ ID NO: 26625 - protein, 9 aa, Borrelia burgdorferi B31
LDNGTTPTR

SEQ ID NO: 26626 - protein, 9 aa, Borrelia burgdorferi B31
DNGTTPTRR

SEQ ID NO: 26627 - protein, 9 aa, Borrelia burgdorferi B31
NGTTPTRRA

SEQ ID NO: 26628 - protein, 9 aa, Borrelia burgdorferi B31
GTTPTRRAT

SEQ ID NO: 26629 - protein, 9 aa, Borrelia burgdorferi B31
TTPTRRATP

SEQ ID NO: 26630 - protein, 9 aa, Borrelia burgdorferi B31
TPTRRATPN

SEQ ID NO: 26631 - protein, 9 aa, Borrelia burgdorferi B31
PTRRATPNF

SEQ ID NO: 26632 - protein, 9 aa, Borrelia burgdorferi B31
TRRATPNFS

SEQ ID NO: 26633 - protein, 9 aa, Borrelia burgdorferi B31
RRATPNFSS

SEQ ID NO: 26634 - protein, 9 aa, Borrelia burgdorferi B31
RATPNFSSY

SEQ ID NO: 26635 - protein, 9 aa, Borrelia burgdorferi B31
ATPNFSSYS

SEQ ID NO: 26636 - protein, 9 aa, Borrelia burgdorferi B31
TPNFSSYSY

SEQ ID NO: 26637 - protein, 9 aa, Borrelia burgdorferi B31
PNFSSYSYA

SEQ ID NO: 26638 - protein, 9 aa, Borrelia burgdorferi B31
NFSSYSYAK

SEQ ID NO: 26639 - protein, 9 aa, Borrelia burgdorferi B31
FSSYSYAKS

SEQ ID NO: 26640 - protein, 9 aa, Borrelia burgdorferi B31
SSYSYAKSL

SEQ ID NO: 26641 - protein, 9 aa, Borrelia burgdorferi B31
SYSYAKSLE

SEQ ID NO: 26642 - protein, 9 aa, Borrelia burgdorferi B31
YSYAKSLEL

SEQ ID NO: 26643 - protein, 9 aa, Borrelia burgdorferi B31
SYAKSLELF

SEQ ID NO: 26644 - protein, 9 aa, Borrelia burgdorferi B31
YAKSLELFN

SEQ ID NO: 26645 - protein, 9 aa, Borrelia burgdorferi B31
AKSLELFNP

SEQ ID NO: 26646 - protein, 9 aa, Borrelia burgdorferi B31
KSLELFNPE

SEQ ID NO: 26647 - protein, 9 aa, Borrelia burgdorferi B31
SLELFNPEI

SEQ ID NO: 26648 - protein, 9 aa, Borrelia burgdorferi B31
LELFNPEIA

SEQ ID NO: 26649 - protein, 9 aa, Borrelia burgdorferi B31
ELFNPEIAK

SEQ ID NO: 26650 - protein, 9 aa, Borrelia burgdorferi B31
LFNPEIAKT

SEQ ID NO: 26651 - protein, 9 aa, Borrelia burgdorferi B31
FNPEIAKTL

SEQ ID NO: 26652 - protein, 9 aa, Borrelia burgdorferi B31
NPEIAKTLL

SEQ ID NO: 26653 - protein, 9 aa, Borrelia burgdorferi B31
PEIAKTLLA

SEQ ID NO: 26654 - protein, 9 aa, Borrelia burgdorferi B31
EIAKTLLAE

SEQ ID NO: 26655 - protein, 9 aa, Borrelia burgdorferi B31
IAKTLLAEA

SEQ ID NO: 26656 - protein, 9 aa, Borrelia burgdorferi B31
AKTLLAEAG

SEQ ID NO: 26657 - protein, 9 aa, Borrelia burgdorferi B31
KTLLAEAGY

SEQ ID NO: 26658 - protein, 9 aa, Borrelia burgdorferi B31
TLLAEAGYP

SEQ ID NO: 26659 - protein, 9 aa, Borrelia burgdorferi B31
LLAEAGYPN

SEQ ID NO: 26660 - protein, 9 aa, Borrelia burgdorferi B31
LAEAGYPNG

SEQ ID NO: 26661 - protein, 9 aa, Borrelia burgdorferi B31
AEAGYPNGN

SEQ ID NO: 26662 - protein, 9 aa, Borrelia burgdorferi B31
EAGYPNGNG

SEQ ID NO: 26663 - protein, 9 aa, Borrelia burgdorferi B31
AGYPNGNGF

SEQ ID NO: 26664 - protein, 9 aa, Borrelia burgdorferi B31
GYPNGNGFP

SEQ ID NO: 26665 - protein, 9 aa, Borrelia burgdorferi B31
YPNGNGFPI

SEQ ID NO: 26666 - protein, 9 aa, Borrelia burgdorferi B31
PNGNGFPIL

SEQ ID NO: 26667 - protein, 9 aa, Borrelia burgdorferi B31
NGNGFPILK

SEQ ID NO: 26668 - protein, 9 aa, Borrelia burgdorferi B31
GNGFPILKL

SEQ ID NO: 26669 - protein, 9 aa, Borrelia burgdorferi B31
NGFPILKLK

SEQ ID NO: 26670 - protein, 9 aa, Borrelia burgdorferi B31
GFPILKLKY

SEQ ID NO: 26671 - protein, 9 aa, Borrelia burgdorferi B31
FPILKLKYN

SEQ ID NO: 26672 - protein, 9 aa, Borrelia burgdorferi B31
PILKLKYNT

SEQ ID NO: 26673 - protein, 9 aa, Borrelia burgdorferi B31
ILKLKYNTN

SEQ ID NO: 26674 - protein, 9 aa, Borrelia burgdorferi B31
LKLKYNTNE

SEQ ID NO: 26675 - protein, 9 aa, Borrelia burgdorferi B31
KLKYNTNEA

SEQ ID NO: 26676 - protein, 9 aa, Borrelia burgdorferi B31
LKYNTNEAN

SEQ ID NO: 26677 - protein, 9 aa, Borrelia burgdorferi B31
KYNTNEANK

SEQ ID NO: 26678 - protein, 9 aa, Borrelia burgdorferi B31
YNTNEANKK

SEQ ID NO: 26679 - protein, 9 aa, Borrelia burgdorferi B31
NTNEANKKI

SEQ ID NO: 26680 - protein, 9 aa, Borrelia burgdorferi B31
TNEANKKIC

SEQ ID NO: 26681 - protein, 9 aa, Borrelia burgdorferi B31
NEANKKICE

SEQ ID NO: 26682 - protein, 9 aa, Borrelia burgdorferi B31
EANKKICEF

SEQ ID NO: 26683 - protein, 9 aa, Borrelia burgdorferi B31
ANKKICEFI

SEQ ID NO: 26684 - protein, 9 aa, Borrelia burgdorferi B31
NKKICEFIQ

SEQ ID NO: 26685 - protein, 9 aa, Borrelia burgdorferi B31
KKICEFIQN

SEQ ID NO: 26686 - protein, 9 aa, Borrelia burgdorferi B31
KICEFIQNQ

SEQ ID NO: 26687 - protein, 9 aa, Borrelia burgdorferi B31
ICEFIQNQW

SEQ ID NO: 26688 - protein, 9 aa, Borrelia burgdorferi B31
CEFIQNQWK

SEQ ID NO: 26689 - protein, 9 aa, Borrelia burgdorferi B31
EFIQNQWKK

SEQ ID NO: 26690 - protein, 9 aa, Borrelia burgdorferi B31
FIQNQWKKN

SEQ ID NO: 26691 - protein, 9 aa, Borrelia burgdorferi B31
IQNQWKKNL

SEQ ID NO: 26692 - protein, 9 aa, Borrelia burgdorferi B31
QNQWKKNLN

SEQ ID NO: 26693 - protein, 9 aa, Borrelia burgdorferi B31
NQWKKNLNI

SEQ ID NO: 26694 - protein, 9 aa, Borrelia burgdorferi B31
QWKKNLNID

SEQ ID NO: 26695 - protein, 9 aa, Borrelia burgdorferi B31
WKKNLNIDV

SEQ ID NO: 26696 - protein, 9 aa, Borrelia burgdorferi B31
KKNLNIDVE

SEQ ID NO: 26697 - protein, 9 aa, Borrelia burgdorferi B31
KNLNIDVEL

SEQ ID NO: 26698 - protein, 9 aa, Borrelia burgdorferi B31
NLNIDVELE

SEQ ID NO: 26699 - protein, 9 aa, Borrelia burgdorferi B31
LNIDVELEN

SEQ ID NO: 26700 - protein, 9 aa, Borrelia burgdorferi B31
NIDVELENE

SEQ ID NO: 26701 - protein, 9 aa, Borrelia burgdorferi B31
IDVELENEE

SEQ ID NO: 26702 - protein, 9 aa, Borrelia burgdorferi B31
DVELENEEW

SEQ ID NO: 26703 - protein, 9 aa, Borrelia burgdorferi B31
VELENEEWT

SEQ ID NO: 26704 - protein, 9 aa, Borrelia burgdorferi B31
ELENEEWTT

SEQ ID NO: 26705 - protein, 9 aa, Borrelia burgdorferi B31
LENEEWTTY

SEQ ID NO: 26706 - protein, 9 aa, Borrelia burgdorferi B31
ENEEWTTYL

SEQ ID NO: 26707 - protein, 9 aa, Borrelia burgdorferi B31
NEEWTTYLN

SEQ ID NO: 26708 - protein, 9 aa, Borrelia burgdorferi B31
EEWTTYLNT

SEQ ID NO: 26709 - protein, 9 aa, Borrelia burgdorferi B31
EWTTYLNTK

SEQ ID NO: 26710 - protein, 9 aa, Borrelia burgdorferi B31
WTTYLNTKA

SEQ ID NO: 26711 - protein, 9 aa, Borrelia burgdorferi B31
TTYLNTKAN

SEQ ID NO: 26712 - protein, 9 aa, Borrelia burgdorferi B31
TYLNTKANG

SEQ ID NO: 26713 - protein, 9 aa, Borrelia burgdorferi B31
YLNTKANGN

SEQ ID NO: 26714 - protein, 9 aa, Borrelia burgdorferi B31
LNTKANGNY

SEQ ID NO: 26715 - protein, 9 aa, Borrelia burgdorferi B31
NTKANGNYE

SEQ ID NO: 26716 - protein, 9 aa, Borrelia burgdorferi B31
TKANGNYEI

SEQ ID NO: 26717 - protein, 9 aa, Borrelia burgdorferi B31
KANGNYEIA

SEQ ID NO: 26718 - protein, 9 aa, Borrelia burgdorferi B31
ANGNYEIAR

SEQ ID NO: 26719 - protein, 9 aa, Borrelia burgdorferi B31
NGNYEIARA

SEQ ID NO: 26720 - protein, 9 aa, Borrelia burgdorferi B31
GNYEIARAG

SEQ ID NO: 26721 - protein, 9 aa, Borrelia burgdorferi B31
NYEIARAGW

SEQ ID NO: 26722 - protein, 9 aa, Borrelia burgdorferi B31
YEIARAGWI

SEQ ID NO: 26723 - protein, 9 aa, Borrelia burgdorferi B31
EIARAGWIG

SEQ ID NO: 26724 - protein, 9 aa, Borrelia burgdorferi B31
IARAGWIGD

SEQ ID NO: 26725 - protein, 9 aa, Borrelia burgdorferi B31
ARAGWIGDY

SEQ ID NO: 26726 - protein, 9 aa, Borrelia burgdorferi B31
RAGWIGDYA

SEQ ID NO: 26727 - protein, 9 aa, Borrelia burgdorferi B31
AGWIGDYAD

SEQ ID NO: 26728 - protein, 9 aa, Borrelia burgdorferi B31
GWIGDYADP

SEQ ID NO: 26729 - protein, 9 aa, Borrelia burgdorferi B31
WIGDYADPL

SEQ ID NO: 26730 - protein, 9 aa, Borrelia burgdorferi B31
IGDYADPLT

SEQ ID NO: 26731 - protein, 9 aa, Borrelia burgdorferi B31
GDYADPLTF

SEQ ID NO: 26732 - protein, 9 aa, Borrelia burgdorferi B31
DYADPLTFL

SEQ ID NO: 26733 - protein, 9 aa, Borrelia burgdorferi B31
YADPLTFLS

SEQ ID NO: 26734 - protein, 9 aa, Borrelia burgdorferi B31
ADPLTFLSI

SEQ ID NO: 26735 - protein, 9 aa, Borrelia burgdorferi B31
DPLTFLSIF

SEQ ID NO: 26736 - protein, 9 aa, Borrelia burgdorferi B31
PLTFLSIFT

SEQ ID NO: 26737 - protein, 9 aa, Borrelia burgdorferi B31
LTFLSIFTQ

SEQ ID NO: 26738 - protein, 9 aa, Borrelia burgdorferi B31
TFLSIFTQG

SEQ ID NO: 26739 - protein, 9 aa, Borrelia burgdorferi B31
FLSIFTQGY

SEQ ID NO: 26740 - protein, 9 aa, Borrelia burgdorferi B31
LSIFTQGYT

SEQ ID NO: 26741 - protein, 9 aa, Borrelia burgdorferi B31
SIFTQGYTQ

SEQ ID NO: 26742 - protein, 9 aa, Borrelia burgdorferi B31
IFTQGYTQF

SEQ ID NO: 26743 - protein, 9 aa, Borrelia burgdorferi B31
FTQGYTQFS

SEQ ID NO: 26744 - protein, 9 aa, Borrelia burgdorferi B31
TQGYTQFSS

SEQ ID NO: 26745 - protein, 9 aa, Borrelia burgdorferi B31
QGYTQFSSH

SEQ ID NO: 26746 - protein, 9 aa, Borrelia burgdorferi B31
GYTQFSSHN

SEQ ID NO: 26747 - protein, 9 aa, Borrelia burgdorferi B31
YTQFSSHNY

SEQ ID NO: 26748 - protein, 9 aa, Borrelia burgdorferi B31
TQFSSHNYS

SEQ ID NO: 26749 - protein, 9 aa, Borrelia burgdorferi B31
QFSSHNYSN

SEQ ID NO: 26750 - protein, 9 aa, Borrelia burgdorferi B31
FSSHNYSNP

SEQ ID NO: 26751 - protein, 9 aa, Borrelia burgdorferi B31
SSHNYSNPE

SEQ ID NO: 26752 - protein, 9 aa, Borrelia burgdorferi B31
SHNYSNPEY

SEQ ID NO: 26753 - protein, 9 aa, Borrelia burgdorferi B31
HNYSNPEYN

SEQ ID NO: 26754 - protein, 9 aa, Borrelia burgdorferi B31
NYSNPEYNE

SEQ ID NO: 26755 - protein, 9 aa, Borrelia burgdorferi B31
YSNPEYNEL

SEQ ID NO: 26756 - protein, 9 aa, Borrelia burgdorferi B31
SNPEYNELI

SEQ ID NO: 26757 - protein, 9 aa, Borrelia burgdorferi B31
NPEYNELIK

SEQ ID NO: 26758 - protein, 9 aa, Borrelia burgdorferi B31
PEYNELIKK

SEQ ID NO: 26759 - protein, 9 aa, Borrelia burgdorferi B31
EYNELIKKS

SEQ ID NO: 26760 - protein, 9 aa, Borrelia burgdorferi B31
YNELIKKSD

SEQ ID NO: 26761 - protein, 9 aa, Borrelia burgdorferi B31
NELIKKSDL

SEQ ID NO: 26762 - protein, 9 aa, Borrelia burgdorferi B31
ELIKKSDLE

SEQ ID NO: 26763 - protein, 9 aa, Borrelia burgdorferi B31
LIKKSDLEL

SEQ ID NO: 26764 - protein, 9 aa, Borrelia burgdorferi B31
IKKSDLELD

SEQ ID NO: 26765 - protein, 9 aa, Borrelia burgdorferi B31
KKSDLELDP

SEQ ID NO: 26766 - protein, 9 aa, Borrelia burgdorferi B31
KSDLELDPI

SEQ ID NO: 26767 - protein, 9 aa, Borrelia burgdorferi B31
SDLELDPIK

SEQ ID NO: 26768 - protein, 9 aa, Borrelia burgdorferi B31
DLELDPIKR

SEQ ID NO: 26769 - protein, 9 aa, Borrelia burgdorferi B31
LELDPIKRQ

SEQ ID NO: 26770 - protein, 9 aa, Borrelia burgdorferi B31
ELDPIKRQD

SEQ ID NO: 26771 - protein, 9 aa, Borrelia burgdorferi B31
LDPIKRQDI

SEQ ID NO: 26772 - protein, 9 aa, Borrelia burgdorferi B31
DPIKRQDIL

SEQ ID NO: 26773 - protein, 9 aa, Borrelia burgdorferi B31
PIKRQDILR

SEQ ID NO: 26774 - protein, 9 aa, Borrelia burgdorferi B31
IKRQDILRQ

SEQ ID NO: 26775 - protein, 9 aa, Borrelia burgdorferi B31
KRQDILRQA

SEQ ID NO: 26776 - protein, 9 aa, Borrelia burgdorferi B31
RQDILRQAE

SEQ ID NO: 26777 - protein, 9 aa, Borrelia burgdorferi B31
QDILRQAEE

SEQ ID NO: 26778 - protein, 9 aa, Borrelia burgdorferi B31
DILRQAEEI

SEQ ID NO: 26779 - protein, 9 aa, Borrelia burgdorferi B31
ILRQAEEII

SEQ ID NO: 26780 - protein, 9 aa, Borrelia burgdorferi B31
LRQAEEIII

SEQ ID NO: 26781 - protein, 9 aa, Borrelia burgdorferi B31
RQAEEIIIE

SEQ ID NO: 26782 - protein, 9 aa, Borrelia burgdorferi B31
QAEEIIIEK

SEQ ID NO: 26783 - protein, 9 aa, Borrelia burgdorferi B31
AEEIIIEKD

SEQ ID NO: 26784 - protein, 9 aa, Borrelia burgdorferi B31
EEIIIEKDF

SEQ ID NO: 26785 - protein, 9 aa, Borrelia burgdorferi B31
EIIIEKDFP

SEQ ID NO: 26786 - protein, 9 aa, Borrelia burgdorferi B31
IIIEKDFPI

SEQ ID NO: 26787 - protein, 9 aa, Borrelia burgdorferi B31
IIEKDFPIA

SEQ ID NO: 26788 - protein, 9 aa, Borrelia burgdorferi B31
IEKDFPIAP

SEQ ID NO: 26789 - protein, 9 aa, Borrelia burgdorferi B31
EKDFPIAPI

SEQ ID NO: 26790 - protein, 9 aa, Borrelia burgdorferi B31
KDFPIAPIY

SEQ ID NO: 26791 - protein, 9 aa, Borrelia burgdorferi B31
DFPIAPIYI

SEQ ID NO: 26792 - protein, 9 aa, Borrelia burgdorferi B31
FPIAPIYIY

SEQ ID NO: 26793 - protein, 9 aa, Borrelia burgdorferi B31
PIAPIYIYG

SEQ ID NO: 26794 - protein, 9 aa, Borrelia burgdorferi B31
IAPIYIYGN

SEQ ID NO: 26795 - protein, 9 aa, Borrelia burgdorferi B31
APIYIYGNS

SEQ ID NO: 26796 - protein, 9 aa, Borrelia burgdorferi B31
PIYIYGNSY

SEQ ID NO: 26797 - protein, 9 aa, Borrelia burgdorferi B31
IYIYGNSYL

SEQ ID NO: 26798 - protein, 9 aa, Borrelia burgdorferi B31
YIYGNSYLF

SEQ ID NO: 26799 - protein, 9 aa, Borrelia burgdorferi B31
IYGNSYLFR

SEQ ID NO: 26800 - protein, 9 aa, Borrelia burgdorferi B31
YGNSYLFRN

SEQ ID NO: 26801 - protein, 9 aa, Borrelia burgdorferi B31
GNSYLFRND

SEQ ID NO: 26802 - protein, 9 aa, Borrelia burgdorferi B31
NSYLFRNDK

SEQ ID NO: 26803 - protein, 9 aa, Borrelia burgdorferi B31
SYLFRNDKW

SEQ ID NO: 26804 - protein, 9 aa, Borrelia burgdorferi B31
YLFRNDKWT

SEQ ID NO: 26805 - protein, 9 aa, Borrelia burgdorferi B31
LFRNDKWTG

SEQ ID NO: 26806 - protein, 9 aa, Borrelia burgdorferi B31
FRNDKWTGW

SEQ ID NO: 26807 - protein, 9 aa, Borrelia burgdorferi B31
RNDKWTGWN

SEQ ID NO: 26808 - protein, 9 aa, Borrelia burgdorferi B31
NDKWTGWNT

SEQ ID NO: 26809 - protein, 9 aa, Borrelia burgdorferi B31
DKWTGWNTN

SEQ ID NO: 26810 - protein, 9 aa, Borrelia burgdorferi B31
KWTGWNTNI

SEQ ID NO: 26811 - protein, 9 aa, Borrelia burgdorferi B31
WTGWNTNIL

SEQ ID NO: 26812 - protein, 9 aa, Borrelia burgdorferi B31
TGWNTNILE

SEQ ID NO: 26813 - protein, 9 aa, Borrelia burgdorferi B31
GWNTNILER

SEQ ID NO: 26814 - protein, 9 aa, Borrelia burgdorferi B31
WNTNILERF

SEQ ID NO: 26815 - protein, 9 aa, Borrelia burgdorferi B31
NTNILERFD

SEQ ID NO: 26816 - protein, 9 aa, Borrelia burgdorferi B31
TNILERFDL

SEQ ID NO: 26817 - protein, 9 aa, Borrelia burgdorferi B31
NILERFDLS

SEQ ID NO: 26818 - protein, 9 aa, Borrelia burgdorferi B31
ILERFDLSQ

SEQ ID NO: 26819 - protein, 9 aa, Borrelia burgdorferi B31
LERFDLSQL

SEQ ID NO: 26820 - protein, 9 aa, Borrelia burgdorferi B31
ERFDLSQLK

SEQ ID NO: 26821 - protein, 9 aa, Borrelia burgdorferi B31
RFDLSQLKL

SEQ ID NO: 26822 - protein, 9 aa, Borrelia burgdorferi B31
FDLSQLKLK

SEQ ID NO: 26823 - protein, 9 aa, Borrelia burgdorferi B31
DLSQLKLKN

SEQ ID NO: 26824 - protein, 9 aa, Borrelia burgdorferi B31
LSQLKLKNK

SEQ ID NO: 26825 - protein, 10 aa, Borrelia burgdorferi B31
MKLQRSLFLI

SEQ ID NO: 26826 - protein, 10 aa, Borrelia burgdorferi B31
KLQRSLFLII

SEQ ID NO: 26827 - protein, 10 aa, Borrelia burgdorferi B31
LQRSLFLIIF

SEQ ID NO: 26828 - protein, 10 aa, Borrelia burgdorferi B31
QRSLFLIIFF

SEQ ID NO: 26829 - protein, 10 aa, Borrelia burgdorferi B31
RSLFLIIFFL

SEQ ID NO: 26830 - protein, 10 aa, Borrelia burgdorferi B31
SLFLIIFFLT

SEQ ID NO: 26831 - protein, 10 aa, Borrelia burgdorferi B31
LFLIIFFLTF

SEQ ID NO: 26832 - protein, 10 aa, Borrelia burgdorferi B31
FLIIFFLTFL

SEQ ID NO: 26833 - protein, 10 aa, Borrelia burgdorferi B31
LIIFFLTFLC

SEQ ID NO: 26834 - protein, 10 aa, Borrelia burgdorferi B31
IIFFLTFLCC

SEQ ID NO: 26835 - protein, 10 aa, Borrelia burgdorferi B31
IFFLTFLCCN

SEQ ID NO: 26836 - protein, 10 aa, Borrelia burgdorferi B31
FFLTFLCCNN

SEQ ID NO: 26837 - protein, 10 aa, Borrelia burgdorferi B31
FLTFLCCNNK

SEQ ID NO: 26838 - protein, 10 aa, Borrelia burgdorferi B31
LTFLCCNNKE

SEQ ID NO: 26839 - protein, 10 aa, Borrelia burgdorferi B31
TFLCCNNKER

SEQ ID NO: 26840 - protein, 10 aa, Borrelia burgdorferi B31
FLCCNNKERK

SEQ ID NO: 26841 - protein, 10 aa, Borrelia burgdorferi B31
LCCNNKERKE

SEQ ID NO: 26842 - protein, 10 aa, Borrelia burgdorferi B31
CCNNKERKEG

SEQ ID NO: 26843 - protein, 10 aa, Borrelia burgdorferi B31
CNNKERKEGV

SEQ ID NO: 26844 - protein, 10 aa, Borrelia burgdorferi B31
NNKERKEGVS

SEQ ID NO: 26845 - protein, 10 aa, Borrelia burgdorferi B31
NKERKEGVSF

SEQ ID NO: 26846 - protein, 10 aa, Borrelia burgdorferi B31
KERKEGVSFK

SEQ ID NO: 26847 - protein, 10 aa, Borrelia burgdorferi B31
ERKEGVSFKI

SEQ ID NO: 26848 - protein, 10 aa, Borrelia burgdorferi B31
RKEGVSFKIS

SEQ ID NO: 26849 - protein, 10 aa, Borrelia burgdorferi B31
KEGVSFKISL

SEQ ID NO: 26850 - protein, 10 aa, Borrelia burgdorferi B31
EGVSFKISLG

SEQ ID NO: 26851 - protein, 10 aa, Borrelia burgdorferi B31
GVSFKISLGA

SEQ ID NO: 26852 - protein, 10 aa, Borrelia burgdorferi B31
VSFKISLGAE

SEQ ID NO: 26853 - protein, 10 aa, Borrelia burgdorferi B31
SFKISLGAEP

SEQ ID NO: 26854 - protein, 10 aa, Borrelia burgdorferi B31
FKISLGAEPS

SEQ ID NO: 26855 - protein, 10 aa, Borrelia burgdorferi B31
KISLGAEPSS

SEQ ID NO: 26856 - protein, 10 aa, Borrelia burgdorferi B31
ISLGAEPSSL

SEQ ID NO: 26857 - protein, 10 aa, Borrelia burgdorferi B31
SLGAEPSSLD

SEQ ID NO: 26858 - protein, 10 aa, Borrelia burgdorferi B31
LGAEPSSLDP

SEQ ID NO: 26859 - protein, 10 aa, Borrelia burgdorferi B31
GAEPSSLDPQ

SEQ ID NO: 26860 - protein, 10 aa, Borrelia burgdorferi B31
AEPSSLDPQL

SEQ ID NO: 26861 - protein, 10 aa, Borrelia burgdorferi B31
EPSSLDPQLA

SEQ ID NO: 26862 - protein, 10 aa, Borrelia burgdorferi B31
PSSLDPQLAE

SEQ ID NO: 26863 - protein, 10 aa, Borrelia burgdorferi B31
SSLDPQLAED

SEQ ID NO: 26864 - protein, 10 aa, Borrelia burgdorferi B31
SLDPQLAEDN

SEQ ID NO: 26865 - protein, 10 aa, Borrelia burgdorferi B31
LDPQLAEDNV

SEQ ID NO: 26866 - protein, 10 aa, Borrelia burgdorferi B31
DPQLAEDNVA

SEQ ID NO: 26867 - protein, 10 aa, Borrelia burgdorferi B31
PQLAEDNVAS

SEQ ID NO: 26868 - protein, 10 aa, Borrelia burgdorferi B31
QLAEDNVASK

SEQ ID NO: 26869 - protein, 10 aa, Borrelia burgdorferi B31
LAEDNVASKM

SEQ ID NO: 26870 - protein, 10 aa, Borrelia burgdorferi B31
AEDNVASKMI

SEQ ID NO: 26871 - protein, 10 aa, Borrelia burgdorferi B31
EDNVASKMID

SEQ ID NO: 26872 - protein, 10 aa, Borrelia burgdorferi B31
DNVASKMIDT

SEQ ID NO: 26873 - protein, 10 aa, Borrelia burgdorferi B31
NVASKMIDTM

SEQ ID NO: 26874 - protein, 10 aa, Borrelia burgdorferi B31
VASKMIDTMF

SEQ ID NO: 26875 - protein, 10 aa, Borrelia burgdorferi B31
ASKMIDTMFR

SEQ ID NO: 26876 - protein, 10 aa, Borrelia burgdorferi B31
SKMIDTMFRG

SEQ ID NO: 26877 - protein, 10 aa, Borrelia burgdorferi B31
KMIDTMFRGI

SEQ ID NO: 26878 - protein, 10 aa, Borrelia burgdorferi B31
MIDTMFRGIV

SEQ ID NO: 26879 - protein, 10 aa, Borrelia burgdorferi B31
IDTMFRGIVT

SEQ ID NO: 26880 - protein, 10 aa, Borrelia burgdorferi B31
DTMFRGIVTG

SEQ ID NO: 26881 - protein, 10 aa, Borrelia burgdorferi B31
TMFRGIVTGD

SEQ ID NO: 26882 - protein, 10 aa, Borrelia burgdorferi B31
MFRGIVTGDP

SEQ ID NO: 26883 - protein, 10 aa, Borrelia burgdorferi B31
FRGIVTGDPN

SEQ ID NO: 26884 - protein, 10 aa, Borrelia burgdorferi B31
RGIVTGDPNT

SEQ ID NO: 26885 - protein, 10 aa, Borrelia burgdorferi B31
GIVTGDPNTG

SEQ ID NO: 26886 - protein, 10 aa, Borrelia burgdorferi B31
IVTGDPNTGG

SEQ ID NO: 26887 - protein, 10 aa, Borrelia burgdorferi B31
VTGDPNTGGN

SEQ ID NO: 26888 - protein, 10 aa, Borrelia burgdorferi B31
TGDPNTGGNK

SEQ ID NO: 26889 - protein, 10 aa, Borrelia burgdorferi B31
GDPNTGGNKP

SEQ ID NO: 26890 - protein, 10 aa, Borrelia burgdorferi B31
DPNTGGNKPG

SEQ ID NO: 26891 - protein, 10 aa, Borrelia burgdorferi B31
PNTGGNKPGL

SEQ ID NO: 26892 - protein, 10 aa, Borrelia burgdorferi B31
NTGGNKPGLA

SEQ ID NO: 26893 - protein, 10 aa, Borrelia burgdorferi B31
TGGNKPGLAK

SEQ ID NO: 26894 - protein, 10 aa, Borrelia burgdorferi B31
GGNKPGLAKG

SEQ ID NO: 26895 - protein, 10 aa, Borrelia burgdorferi B31
GNKPGLAKGW

SEQ ID NO: 26896 - protein, 10 aa, Borrelia burgdorferi B31
NKPGLAKGWD

SEQ ID NO: 26897 - protein, 10 aa, Borrelia burgdorferi B31
KPGLAKGWDI

SEQ ID NO: 26898 - protein, 10 aa, Borrelia burgdorferi B31
PGLAKGWDIS

SEQ ID NO: 26899 - protein, 10 aa, Borrelia burgdorferi B31
GLAKGWDISS

SEQ ID NO: 26900 - protein, 10 aa, Borrelia burgdorferi B31
LAKGWDISSD

SEQ ID NO: 26901 - protein, 10 aa, Borrelia burgdorferi B31
AKGWDISSDG

SEQ ID NO: 26902 - protein, 10 aa, Borrelia burgdorferi B31
KGWDISSDGT

SEQ ID NO: 26903 - protein, 10 aa, Borrelia burgdorferi B31
GWDISSDGTV

SEQ ID NO: 26904 - protein, 10 aa, Borrelia burgdorferi B31
WDISSDGTVY

SEQ ID NO: 26905 - protein, 10 aa, Borrelia burgdorferi B31
DISSDGTVYT

SEQ ID NO: 26906 - protein, 10 aa, Borrelia burgdorferi B31
ISSDGTVYTF

SEQ ID NO: 26907 - protein, 10 aa, Borrelia burgdorferi B31
SSDGTVYTFN

SEQ ID NO: 26908 - protein, 10 aa, Borrelia burgdorferi B31
SDGTVYTFNL

SEQ ID NO: 26909 - protein, 10 aa, Borrelia burgdorferi B31
DGTVYTFNLR

SEQ ID NO: 26910 - protein, 10 aa, Borrelia burgdorferi B31
GTVYTFNLRE

SEQ ID NO: 26911 - protein, 10 aa, Borrelia burgdorferi B31
TVYTFNLREK

SEQ ID NO: 26912 - protein, 10 aa, Borrelia burgdorferi B31
VYTFNLREKI

SEQ ID NO: 26913 - protein, 10 aa, Borrelia burgdorferi B31
YTFNLREKIT

SEQ ID NO: 26914 - protein, 10 aa, Borrelia burgdorferi B31
TFNLREKITW

SEQ ID NO: 26915 - protein, 10 aa, Borrelia burgdorferi B31
FNLREKITWS

SEQ ID NO: 26916 - protein, 10 aa, Borrelia burgdorferi B31
NLREKITWSD

SEQ ID NO: 26917 - protein, 10 aa, Borrelia burgdorferi B31
LREKITWSDG

SEQ ID NO: 26918 - protein, 10 aa, Borrelia burgdorferi B31
REKITWSDGV

SEQ ID NO: 26919 - protein, 10 aa, Borrelia burgdorferi B31
EKITWSDGVA

SEQ ID NO: 26920 - protein, 10 aa, Borrelia burgdorferi B31
KITWSDGVAI

SEQ ID NO: 26921 - protein, 10 aa, Borrelia burgdorferi B31
ITWSDGVAIT

SEQ ID NO: 26922 - protein, 10 aa, Borrelia burgdorferi B31
TWSDGVAITA

SEQ ID NO: 26923 - protein, 10 aa, Borrelia burgdorferi B31
WSDGVAITAE

SEQ ID NO: 26924 - protein, 10 aa, Borrelia burgdorferi B31
SDGVAITAEG

SEQ ID NO: 26925 - protein, 10 aa, Borrelia burgdorferi B31
DGVAITAEGI

SEQ ID NO: 26926 - protein, 10 aa, Borrelia burgdorferi B31
GVAITAEGIR

SEQ ID NO: 26927 - protein, 10 aa, Borrelia burgdorferi B31
VAITAEGIRK

SEQ ID NO: 26928 - protein, 10 aa, Borrelia burgdorferi B31
AITAEGIRKS

SEQ ID NO: 26929 - protein, 10 aa, Borrelia burgdorferi B31
ITAEGIRKSY

SEQ ID NO: 26930 - protein, 10 aa, Borrelia burgdorferi B31
TAEGIRKSYL

SEQ ID NO: 26931 - protein, 10 aa, Borrelia burgdorferi B31
AEGIRKSYLR

SEQ ID NO: 26932 - protein, 10 aa, Borrelia burgdorferi B31
EGIRKSYLRI

SEQ ID NO: 26933 - protein, 10 aa, Borrelia burgdorferi B31
GIRKSYLRIL

SEQ ID NO: 26934 - protein, 10 aa, Borrelia burgdorferi B31
IRKSYLRILN

SEQ ID NO: 26935 - protein, 10 aa, Borrelia burgdorferi B31
RKSYLRILNK

SEQ ID NO: 26936 - protein, 10 aa, Borrelia burgdorferi B31
KSYLRILNKE

SEQ ID NO: 26937 - protein, 10 aa, Borrelia burgdorferi B31
SYLRILNKET

SEQ ID NO: 26938 - protein, 10 aa, Borrelia burgdorferi B31
YLRILNKETG

SEQ ID NO: 26939 - protein, 10 aa, Borrelia burgdorferi B31
LRILNKETGS

SEQ ID NO: 26940 - protein, 10 aa, Borrelia burgdorferi B31
RILNKETGSK

SEQ ID NO: 26941 - protein, 10 aa, Borrelia burgdorferi B31
ILNKETGSKY

SEQ ID NO: 26942 - protein, 10 aa, Borrelia burgdorferi B31
LNKETGSKYV

SEQ ID NO: 26943 - protein, 10 aa, Borrelia burgdorferi B31
NKETGSKYVE

SEQ ID NO: 26944 - protein, 10 aa, Borrelia burgdorferi B31
KETGSKYVEM

SEQ ID NO: 26945 - protein, 10 aa, Borrelia burgdorferi B31
ETGSKYVEMV

SEQ ID NO: 26946 - protein, 10 aa, Borrelia burgdorferi B31
TGSKYVEMVK

SEQ ID NO: 26947 - protein, 10 aa, Borrelia burgdorferi B31
GSKYVEMVKS

SEQ ID NO: 26948 - protein, 10 aa, Borrelia burgdorferi B31
SKYVEMVKSV

SEQ ID NO: 26949 - protein, 10 aa, Borrelia burgdorferi B31
KYVEMVKSVI

SEQ ID NO: 26950 - protein, 10 aa, Borrelia burgdorferi B31
YVEMVKSVIK

SEQ ID NO: 26951 - protein, 10 aa, Borrelia burgdorferi B31
VEMVKSVIKN

SEQ ID NO: 26952 - protein, 10 aa, Borrelia burgdorferi B31
EMVKSVIKNG

SEQ ID NO: 26953 - protein, 10 aa, Borrelia burgdorferi B31
MVKSVIKNGQ

SEQ ID NO: 26954 - protein, 10 aa, Borrelia burgdorferi B31
VKSVIKNGQK

SEQ ID NO: 26955 - protein, 10 aa, Borrelia burgdorferi B31
KSVIKNGQKY

SEQ ID NO: 26956 - protein, 10 aa, Borrelia burgdorferi B31
SVIKNGQKYF

SEQ ID NO: 26957 - protein, 10 aa, Borrelia burgdorferi B31
VIKNGQKYFD

SEQ ID NO: 26958 - protein, 10 aa, Borrelia burgdorferi B31
IKNGQKYFDG

SEQ ID NO: 26959 - protein, 10 aa, Borrelia burgdorferi B31
KNGQKYFDGQ

SEQ ID NO: 26960 - protein, 10 aa, Borrelia burgdorferi B31
NGQKYFDGQV

SEQ ID NO: 26961 - protein, 10 aa, Borrelia burgdorferi B31
GQKYFDGQVT

SEQ ID NO: 26962 - protein, 10 aa, Borrelia burgdorferi B31
QKYFDGQVTD

SEQ ID NO: 26963 - protein, 10 aa, Borrelia burgdorferi B31
KYFDGQVTDS

SEQ ID NO: 26964 - protein, 10 aa, Borrelia burgdorferi B31
YFDGQVTDSE

SEQ ID NO: 26965 - protein, 10 aa, Borrelia burgdorferi B31
FDGQVTDSEL

SEQ ID NO: 26966 - protein, 10 aa, Borrelia burgdorferi B31
DGQVTDSELG

SEQ ID NO: 26967 - protein, 10 aa, Borrelia burgdorferi B31
GQVTDSELGI

SEQ ID NO: 26968 - protein, 10 aa, Borrelia burgdorferi B31
QVTDSELGIR

SEQ ID NO: 26969 - protein, 10 aa, Borrelia burgdorferi B31
VTDSELGIRA

SEQ ID NO: 26970 - protein, 10 aa, Borrelia burgdorferi B31
TDSELGIRAI

SEQ ID NO: 26971 - protein, 10 aa, Borrelia burgdorferi B31
DSELGIRAID

SEQ ID NO: 26972 - protein, 10 aa, Borrelia burgdorferi B31
SELGIRAIDE

SEQ ID NO: 26973 - protein, 10 aa, Borrelia burgdorferi B31
ELGIRAIDEK

SEQ ID NO: 26974 - protein, 10 aa, Borrelia burgdorferi B31
LGIRAIDEKT

SEQ ID NO: 26975 - protein, 10 aa, Borrelia burgdorferi B31
GIRAIDEKTL

SEQ ID NO: 26976 - protein, 10 aa, Borrelia burgdorferi B31
IRAIDEKTLE

SEQ ID NO: 26977 - protein, 10 aa, Borrelia burgdorferi B31
RAIDEKTLEI

SEQ ID NO: 26978 - protein, 10 aa, Borrelia burgdorferi B31
AIDEKTLEIT

SEQ ID NO: 26979 - protein, 10 aa, Borrelia burgdorferi B31
IDEKTLEITL

SEQ ID NO: 26980 - protein, 10 aa, Borrelia burgdorferi B31
DEKTLEITLE

SEQ ID NO: 26981 - protein, 10 aa, Borrelia burgdorferi B31
EKTLEITLES

SEQ ID NO: 26982 - protein, 10 aa, Borrelia burgdorferi B31
KTLEITLESP

SEQ ID NO: 26983 - protein, 10 aa, Borrelia burgdorferi B31
TLEITLESPK

SEQ ID NO: 26984 - protein, 10 aa, Borrelia burgdorferi B31
LEITLESPKP

SEQ ID NO: 26985 - protein, 10 aa, Borrelia burgdorferi B31
EITLESPKPY

SEQ ID NO: 26986 - protein, 10 aa, Borrelia burgdorferi B31
ITLESPKPYF

SEQ ID NO: 26987 - protein, 10 aa, Borrelia burgdorferi B31
TLESPKPYFI

SEQ ID NO: 26988 - protein, 10 aa, Borrelia burgdorferi B31
LESPKPYFID

SEQ ID NO: 26989 - protein, 10 aa, Borrelia burgdorferi B31
ESPKPYFIDM

SEQ ID NO: 26990 - protein, 10 aa, Borrelia burgdorferi B31
SPKPYFIDML

SEQ ID NO: 26991 - protein, 10 aa, Borrelia burgdorferi B31
PKPYFIDMLV

SEQ ID NO: 26992 - protein, 10 aa, Borrelia burgdorferi B31
KPYFIDMLVH

SEQ ID NO: 26993 - protein, 10 aa, Borrelia burgdorferi B31
PYFIDMLVHQ

SEQ ID NO: 26994 - protein, 10 aa, Borrelia burgdorferi B31
YFIDMLVHQS

SEQ ID NO: 26995 - protein, 10 aa, Borrelia burgdorferi B31
FIDMLVHQSF

SEQ ID NO: 26996 - protein, 10 aa, Borrelia burgdorferi B31
IDMLVHQSFI

SEQ ID NO: 26997 - protein, 10 aa, Borrelia burgdorferi B31
DMLVHQSFIP

SEQ ID NO: 26998 - protein, 10 aa, Borrelia burgdorferi B31
MLVHQSFIPV

SEQ ID NO: 26999 - protein, 10 aa, Borrelia burgdorferi B31
LVHQSFIPVP

SEQ ID NO: 27000 - protein, 10 aa, Borrelia burgdorferi B31
VHQSFIPVPV

SEQ ID NO: 27001 - protein, 10 aa, Borrelia burgdorferi B31
HQSFIPVPVH

SEQ ID NO: 27002 - protein, 10 aa, Borrelia burgdorferi B31
QSFIPVPVHV

SEQ ID NO: 27003 - protein, 10 aa, Borrelia burgdorferi B31
SFIPVPVHVT

SEQ ID NO: 27004 - protein, 10 aa, Borrelia burgdorferi B31
FIPVPVHVTE

SEQ ID NO: 27005 - protein, 10 aa, Borrelia burgdorferi B31
IPVPVHVTEK

SEQ ID NO: 27006 - protein, 10 aa, Borrelia burgdorferi B31
PVPVHVTEKY

SEQ ID NO: 27007 - protein, 10 aa, Borrelia burgdorferi B31
VPVHVTEKYG

SEQ ID NO: 27008 - protein, 10 aa, Borrelia burgdorferi B31
PVHVTEKYGQ

SEQ ID NO: 27009 - protein, 10 aa, Borrelia burgdorferi B31
VHVTEKYGQN

SEQ ID NO: 27010 - protein, 10 aa, Borrelia burgdorferi B31
HVTEKYGQNW

SEQ ID NO: 27011 - protein, 10 aa, Borrelia burgdorferi B31
VTEKYGQNWT

SEQ ID NO: 27012 - protein, 10 aa, Borrelia burgdorferi B31
TEKYGQNWTS

SEQ ID NO: 27013 - protein, 10 aa, Borrelia burgdorferi B31
EKYGQNWTSP

SEQ ID NO: 27014 - protein, 10 aa, Borrelia burgdorferi B31
KYGQNWTSPE

SEQ ID NO: 27015 - protein, 10 aa, Borrelia burgdorferi B31
YGQNWTSPEN

SEQ ID NO: 27016 - protein, 10 aa, Borrelia burgdorferi B31
GQNWTSPENM

SEQ ID NO: 27017 - protein, 10 aa, Borrelia burgdorferi B31
QNWTSPENMV

SEQ ID NO: 27018 - protein, 10 aa, Borrelia burgdorferi B31
NWTSPENMVT

SEQ ID NO: 27019 - protein, 10 aa, Borrelia burgdorferi B31
WTSPENMVTS

SEQ ID NO: 27020 - protein, 10 aa, Borrelia burgdorferi B31
TSPENMVTSG

SEQ ID NO: 27021 - protein, 10 aa, Borrelia burgdorferi B31
SPENMVTSGP

SEQ ID NO: 27022 - protein, 10 aa, Borrelia burgdorferi B31
PENMVTSGPF

SEQ ID NO: 27023 - protein, 10 aa, Borrelia burgdorferi B31
ENMVTSGPFK

SEQ ID NO: 27024 - protein, 10 aa, Borrelia burgdorferi B31
NMVTSGPFKL

SEQ ID NO: 27025 - protein, 10 aa, Borrelia burgdorferi B31
MVTSGPFKLK

SEQ ID NO: 27026 - protein, 10 aa, Borrelia burgdorferi B31
VTSGPFKLKE

SEQ ID NO: 27027 - protein, 10 aa, Borrelia burgdorferi B31
TSGPFKLKER

SEQ ID NO: 27028 - protein, 10 aa, Borrelia burgdorferi B31
SGPFKLKERI

SEQ ID NO: 27029 - protein, 10 aa, Borrelia burgdorferi B31
GPFKLKERIP

SEQ ID NO: 27030 - protein, 10 aa, Borrelia burgdorferi B31
PFKLKERIPN

SEQ ID NO: 27031 - protein, 10 aa, Borrelia burgdorferi B31
FKLKERIPNE

SEQ ID NO: 27032 - protein, 10 aa, Borrelia burgdorferi B31
KLKERIPNEK

SEQ ID NO: 27033 - protein, 10 aa, Borrelia burgdorferi B31
LKERIPNEKY

SEQ ID NO: 27034 - protein, 10 aa, Borrelia burgdorferi B31
KERIPNEKYV

SEQ ID NO: 27035 - protein, 10 aa, Borrelia burgdorferi B31
ERIPNEKYVF

SEQ ID NO: 27036 - protein, 10 aa, Borrelia burgdorferi B31
RIPNEKYVFE

SEQ ID NO: 27037 - protein, 10 aa, Borrelia burgdorferi B31
IPNEKYVFEK

SEQ ID NO: 27038 - protein, 10 aa, Borrelia burgdorferi B31
PNEKYVFEKN

SEQ ID NO: 27039 - protein, 10 aa, Borrelia burgdorferi B31
NEKYVFEKNN

SEQ ID NO: 27040 - protein, 10 aa, Borrelia burgdorferi B31
EKYVFEKNNK

SEQ ID NO: 27041 - protein, 10 aa, Borrelia burgdorferi B31
KYVFEKNNKY

SEQ ID NO: 27042 - protein, 10 aa, Borrelia burgdorferi B31
YVFEKNNKYY

SEQ ID NO: 27043 - protein, 10 aa, Borrelia burgdorferi B31
VFEKNNKYYD

SEQ ID NO: 27044 - protein, 10 aa, Borrelia burgdorferi B31
FEKNNKYYDS

SEQ ID NO: 27045 - protein, 10 aa, Borrelia burgdorferi B31
EKNNKYYDSN

SEQ ID NO: 27046 - protein, 10 aa, Borrelia burgdorferi B31
KNNKYYDSNE

SEQ ID NO: 27047 - protein, 10 aa, Borrelia burgdorferi B31
NNKYYDSNEV

SEQ ID NO: 27048 - protein, 10 aa, Borrelia burgdorferi B31
NKYYDSNEVE

SEQ ID NO: 27049 - protein, 10 aa, Borrelia burgdorferi B31
KYYDSNEVEL

SEQ ID NO: 27050 - protein, 10 aa, Borrelia burgdorferi B31
YYDSNEVELE

SEQ ID NO: 27051 - protein, 10 aa, Borrelia burgdorferi B31
YDSNEVELEE

SEQ ID NO: 27052 - protein, 10 aa, Borrelia burgdorferi B31
DSNEVELEEI

SEQ ID NO: 27053 - protein, 10 aa, Borrelia burgdorferi B31
SNEVELEEIT

SEQ ID NO: 27054 - protein, 10 aa, Borrelia burgdorferi B31
NEVELEEITF

SEQ ID NO: 27055 - protein, 10 aa, Borrelia burgdorferi B31
EVELEEITFY

SEQ ID NO: 27056 - protein, 10 aa, Borrelia burgdorferi B31
VELEEITFYT

SEQ ID NO: 27057 - protein, 10 aa, Borrelia burgdorferi B31
ELEEITFYTT

SEQ ID NO: 27058 - protein, 10 aa, Borrelia burgdorferi B31
LEEITFYTTN

SEQ ID NO: 27059 - protein, 10 aa, Borrelia burgdorferi B31
EEITFYTTND

SEQ ID NO: 27060 - protein, 10 aa, Borrelia burgdorferi B31
EITFYTTNDS

SEQ ID NO: 27061 - protein, 10 aa, Borrelia burgdorferi B31
ITFYTTNDSS

SEQ ID NO: 27062 - protein, 10 aa, Borrelia burgdorferi B31
TFYTTNDSST

SEQ ID NO: 27063 - protein, 10 aa, Borrelia burgdorferi B31
FYTTNDSSTA

SEQ ID NO: 27064 - protein, 10 aa, Borrelia burgdorferi B31
YTTNDSSTAY

SEQ ID NO: 27065 - protein, 10 aa, Borrelia burgdorferi B31
TTNDSSTAYK

SEQ ID NO: 27066 - protein, 10 aa, Borrelia burgdorferi B31
TNDSSTAYKM

SEQ ID NO: 27067 - protein, 10 aa, Borrelia burgdorferi B31
NDSSTAYKMY

SEQ ID NO: 27068 - protein, 10 aa, Borrelia burgdorferi B31
DSSTAYKMYE

SEQ ID NO: 27069 - protein, 10 aa, Borrelia burgdorferi B31
SSTAYKMYEN

SEQ ID NO: 27070 - protein, 10 aa, Borrelia burgdorferi B31
STAYKMYENE

SEQ ID NO: 27071 - protein, 10 aa, Borrelia burgdorferi B31
TAYKMYENEE

SEQ ID NO: 27072 - protein, 10 aa, Borrelia burgdorferi B31
AYKMYENEEL

SEQ ID NO: 27073 - protein, 10 aa, Borrelia burgdorferi B31
YKMYENEELD

SEQ ID NO: 27074 - protein, 10 aa, Borrelia burgdorferi B31
KMYENEELDA

SEQ ID NO: 27075 - protein, 10 aa, Borrelia burgdorferi B31
MYENEELDAI

SEQ ID NO: 27076 - protein, 10 aa, Borrelia burgdorferi B31
YENEELDAIF

SEQ ID NO: 27077 - protein, 10 aa, Borrelia burgdorferi B31
ENEELDAIFG

SEQ ID NO: 27078 - protein, 10 aa, Borrelia burgdorferi B31
NEELDAIFGS

SEQ ID NO: 27079 - protein, 10 aa, Borrelia burgdorferi B31
EELDAIFGSI

SEQ ID NO: 27080 - protein, 10 aa, Borrelia burgdorferi B31
ELDAIFGSIP

SEQ ID NO: 27081 - protein, 10 aa, Borrelia burgdorferi B31
LDAIFGSIPP

SEQ ID NO: 27082 - protein, 10 aa, Borrelia burgdorferi B31
DAIFGSIPPD

SEQ ID NO: 27083 - protein, 10 aa, Borrelia burgdorferi B31
AIFGSIPPDL

SEQ ID NO: 27084 - protein, 10 aa, Borrelia burgdorferi B31
IFGSIPPDLI

SEQ ID NO: 27085 - protein, 10 aa, Borrelia burgdorferi B31
FGSIPPDLIK

SEQ ID NO: 27086 - protein, 10 aa, Borrelia burgdorferi B31
GSIPPDLIKN

SEQ ID NO: 27087 - protein, 10 aa, Borrelia burgdorferi B31
SIPPDLIKNL

SEQ ID NO: 27088 - protein, 10 aa, Borrelia burgdorferi B31
IPPDLIKNLK

SEQ ID NO: 27089 - protein, 10 aa, Borrelia burgdorferi B31
PPDLIKNLKL

SEQ ID NO: 27090 - protein, 10 aa, Borrelia burgdorferi B31
PDLIKNLKLR

SEQ ID NO: 27091 - protein, 10 aa, Borrelia burgdorferi B31
DLIKNLKLRS

SEQ ID NO: 27092 - protein, 10 aa, Borrelia burgdorferi B31
LIKNLKLRSD

SEQ ID NO: 27093 - protein, 10 aa, Borrelia burgdorferi B31
IKNLKLRSDY

SEQ ID NO: 27094 - protein, 10 aa, Borrelia burgdorferi B31
KNLKLRSDYY

SEQ ID NO: 27095 - protein, 10 aa, Borrelia burgdorferi B31
NLKLRSDYYS

SEQ ID NO: 27096 - protein, 10 aa, Borrelia burgdorferi B31
LKLRSDYYSS

SEQ ID NO: 27097 - protein, 10 aa, Borrelia burgdorferi B31
KLRSDYYSSA

SEQ ID NO: 27098 - protein, 10 aa, Borrelia burgdorferi B31
LRSDYYSSAV

SEQ ID NO: 27099 - protein, 10 aa, Borrelia burgdorferi B31
RSDYYSSAVN

SEQ ID NO: 27100 - protein, 10 aa, Borrelia burgdorferi B31
SDYYSSAVNA

SEQ ID NO: 27101 - protein, 10 aa, Borrelia burgdorferi B31
DYYSSAVNAI

SEQ ID NO: 27102 - protein, 10 aa, Borrelia burgdorferi B31
YYSSAVNAIY

SEQ ID NO: 27103 - protein, 10 aa, Borrelia burgdorferi B31
YSSAVNAIYF

SEQ ID NO: 27104 - protein, 10 aa, Borrelia burgdorferi B31
SSAVNAIYFY

SEQ ID NO: 27105 - protein, 10 aa, Borrelia burgdorferi B31
SAVNAIYFYA

SEQ ID NO: 27106 - protein, 10 aa, Borrelia burgdorferi B31
AVNAIYFYAF

SEQ ID NO: 27107 - protein, 10 aa, Borrelia burgdorferi B31
VNAIYFYAFN

SEQ ID NO: 27108 - protein, 10 aa, Borrelia burgdorferi B31
NAIYFYAFNT

SEQ ID NO: 27109 - protein, 10 aa, Borrelia burgdorferi B31
AIYFYAFNTH

SEQ ID NO: 27110 - protein, 10 aa, Borrelia burgdorferi B31
IYFYAFNTHI

SEQ ID NO: 27111 - protein, 10 aa, Borrelia burgdorferi B31
YFYAFNTHIK

SEQ ID NO: 27112 - protein, 10 aa, Borrelia burgdorferi B31
FYAFNTHIKP

SEQ ID NO: 27113 - protein, 10 aa, Borrelia burgdorferi B31
YAFNTHIKPL

SEQ ID NO: 27114 - protein, 10 aa, Borrelia burgdorferi B31
AFNTHIKPLD

SEQ ID NO: 27115 - protein, 10 aa, Borrelia burgdorferi B31
FNTHIKPLDN

SEQ ID NO: 27116 - protein, 10 aa, Borrelia burgdorferi B31
NTHIKPLDNV

SEQ ID NO: 27117 - protein, 10 aa, Borrelia burgdorferi B31
THIKPLDNVK

SEQ ID NO: 27118 - protein, 10 aa, Borrelia burgdorferi B31
HIKPLDNVKI

SEQ ID NO: 27119 - protein, 10 aa, Borrelia burgdorferi B31
IKPLDNVKIR

SEQ ID NO: 27120 - protein, 10 aa, Borrelia burgdorferi B31
KPLDNVKIRK

SEQ ID NO: 27121 - protein, 10 aa, Borrelia burgdorferi B31
PLDNVKIRKA

SEQ ID NO: 27122 - protein, 10 aa, Borrelia burgdorferi B31
LDNVKIRKAL

SEQ ID NO: 27123 - protein, 10 aa, Borrelia burgdorferi B31
DNVKIRKALT

SEQ ID NO: 27124 - protein, 10 aa, Borrelia burgdorferi B31
NVKIRKALTL

SEQ ID NO: 27125 - protein, 10 aa, Borrelia burgdorferi B31
VKIRKALTLA

SEQ ID NO: 27126 - protein, 10 aa, Borrelia burgdorferi B31
KIRKALTLAI

SEQ ID NO: 27127 - protein, 10 aa, Borrelia burgdorferi B31
IRKALTLAID

SEQ ID NO: 27128 - protein, 10 aa, Borrelia burgdorferi B31
RKALTLAIDR

SEQ ID NO: 27129 - protein, 10 aa, Borrelia burgdorferi B31
KALTLAIDRE

SEQ ID NO: 27130 - protein, 10 aa, Borrelia burgdorferi B31
ALTLAIDRET

SEQ ID NO: 27131 - protein, 10 aa, Borrelia burgdorferi B31
LTLAIDRETL

SEQ ID NO: 27132 - protein, 10 aa, Borrelia burgdorferi B31
TLAIDRETLT

SEQ ID NO: 27133 - protein, 10 aa, Borrelia burgdorferi B31
LAIDRETLTY

SEQ ID NO: 27134 - protein, 10 aa, Borrelia burgdorferi B31
AIDRETLTYK

SEQ ID NO: 27135 - protein, 10 aa, Borrelia burgdorferi B31
IDRETLTYKV

SEQ ID NO: 27136 - protein, 10 aa, Borrelia burgdorferi B31
DRETLTYKVL

SEQ ID NO: 27137 - protein, 10 aa, Borrelia burgdorferi B31
RETLTYKVLD

SEQ ID NO: 27138 - protein, 10 aa, Borrelia burgdorferi B31
ETLTYKVLDN

SEQ ID NO: 27139 - protein, 10 aa, Borrelia burgdorferi B31
TLTYKVLDNG

SEQ ID NO: 27140 - protein, 10 aa, Borrelia burgdorferi B31
LTYKVLDNGT

SEQ ID NO: 27141 - protein, 10 aa, Borrelia burgdorferi B31
TYKVLDNGTT

SEQ ID NO: 27142 - protein, 10 aa, Borrelia burgdorferi B31
YKVLDNGTTP

SEQ ID NO: 27143 - protein, 10 aa, Borrelia burgdorferi B31
KVLDNGTTPT

SEQ ID NO: 27144 - protein, 10 aa, Borrelia burgdorferi B31
VLDNGTTPTR

SEQ ID NO: 27145 - protein, 10 aa, Borrelia burgdorferi B31
LDNGTTPTRR

SEQ ID NO: 27146 - protein, 10 aa, Borrelia burgdorferi B31
DNGTTPTRRA

SEQ ID NO: 27147 - protein, 10 aa, Borrelia burgdorferi B31
NGTTPTRRAT

SEQ ID NO: 27148 - protein, 10 aa, Borrelia burgdorferi B31
GTTPTRRATP

SEQ ID NO: 27149 - protein, 10 aa, Borrelia burgdorferi B31
TTPTRRATPN

SEQ ID NO: 27150 - protein, 10 aa, Borrelia burgdorferi B31
TPTRRATPNF

SEQ ID NO: 27151 - protein, 10 aa, Borrelia burgdorferi B31
PTRRATPNFS

SEQ ID NO: 27152 - protein, 10 aa, Borrelia burgdorferi B31
TRRATPNFSS

SEQ ID NO: 27153 - protein, 10 aa, Borrelia burgdorferi B31
RRATPNFSSY

SEQ ID NO: 27154 - protein, 10 aa, Borrelia burgdorferi B31
RATPNFSSYS

SEQ ID NO: 27155 - protein, 10 aa, Borrelia burgdorferi B31
ATPNFSSYSY

SEQ ID NO: 27156 - protein, 10 aa, Borrelia burgdorferi B31
TPNFSSYSYA

SEQ ID NO: 27157 - protein, 10 aa, Borrelia burgdorferi B31
PNFSSYSYAK

SEQ ID NO: 27158 - protein, 10 aa, Borrelia burgdorferi B31
NFSSYSYAKS

SEQ ID NO: 27159 - protein, 10 aa, Borrelia burgdorferi B31
FSSYSYAKSL

SEQ ID NO: 27160 - protein, 10 aa, Borrelia burgdorferi B31
SSYSYAKSLE

SEQ ID NO: 27161 - protein, 10 aa, Borrelia burgdorferi B31
SYSYAKSLEL

SEQ ID NO: 27162 - protein, 10 aa, Borrelia burgdorferi B31
YSYAKSLELF

SEQ ID NO: 27163 - protein, 10 aa, Borrelia burgdorferi B31
SYAKSLELFN

SEQ ID NO: 27164 - protein, 10 aa, Borrelia burgdorferi B31
YAKSLELFNP

SEQ ID NO: 27165 - protein, 10 aa, Borrelia burgdorferi B31
AKSLELFNPE

SEQ ID NO: 27166 - protein, 10 aa, Borrelia burgdorferi B31
KSLELFNPEI

SEQ ID NO: 27167 - protein, 10 aa, Borrelia burgdorferi B31
SLELFNPEIA

SEQ ID NO: 27168 - protein, 10 aa, Borrelia burgdorferi B31
LELFNPEIAK

SEQ ID NO: 27169 - protein, 10 aa, Borrelia burgdorferi B31
ELFNPEIAKT

SEQ ID NO: 27170 - protein, 10 aa, Borrelia burgdorferi B31
LFNPEIAKTL

SEQ ID NO: 27171 - protein, 10 aa, Borrelia burgdorferi B31
FNPEIAKTLL

SEQ ID NO: 27172 - protein, 10 aa, Borrelia burgdorferi B31
NPEIAKTLLA

SEQ ID NO: 27173 - protein, 10 aa, Borrelia burgdorferi B31
PEIAKTLLAE

SEQ ID NO: 27174 - protein, 10 aa, Borrelia burgdorferi B31
EIAKTLLAEA

SEQ ID NO: 27175 - protein, 10 aa, Borrelia burgdorferi B31
IAKTLLAEAG

SEQ ID NO: 27176 - protein, 10 aa, Borrelia burgdorferi B31
AKTLLAEAGY

SEQ ID NO: 27177 - protein, 10 aa, Borrelia burgdorferi B31
KTLLAEAGYP

SEQ ID NO: 27178 - protein, 10 aa, Borrelia burgdorferi B31
TLLAEAGYPN

SEQ ID NO: 27179 - protein, 10 aa, Borrelia burgdorferi B31
LLAEAGYPNG

SEQ ID NO: 27180 - protein, 10 aa, Borrelia burgdorferi B31
LAEAGYPNGN

SEQ ID NO: 27181 - protein, 10 aa, Borrelia burgdorferi B31
AEAGYPNGNG

SEQ ID NO: 27182 - protein, 10 aa, Borrelia burgdorferi B31
EAGYPNGNGF

SEQ ID NO: 27183 - protein, 10 aa, Borrelia burgdorferi B31
AGYPNGNGFP

SEQ ID NO: 27184 - protein, 10 aa, Borrelia burgdorferi B31
GYPNGNGFPI

SEQ ID NO: 27185 - protein, 10 aa, Borrelia burgdorferi B31
YPNGNGFPIL

SEQ ID NO: 27186 - protein, 10 aa, Borrelia burgdorferi B31
PNGNGFPILK

SEQ ID NO: 27187 - protein, 10 aa, Borrelia burgdorferi B31
NGNGFPILKL

SEQ ID NO: 27188 - protein, 10 aa, Borrelia burgdorferi B31
GNGFPILKLK

SEQ ID NO: 27189 - protein, 10 aa, Borrelia burgdorferi B31
NGFPILKLKY

SEQ ID NO: 27190 - protein, 10 aa, Borrelia burgdorferi B31
GFPILKLKYN

SEQ ID NO: 27191 - protein, 10 aa, Borrelia burgdorferi B31
FPILKLKYNT

SEQ ID NO: 27192 - protein, 10 aa, Borrelia burgdorferi B31
PILKLKYNTN

SEQ ID NO: 27193 - protein, 10 aa, Borrelia burgdorferi B31
ILKLKYNTNE

SEQ ID NO: 27194 - protein, 10 aa, Borrelia burgdorferi B31
LKLKYNTNEA

SEQ ID NO: 27195 - protein, 10 aa, Borrelia burgdorferi B31
KLKYNTNEAN

SEQ ID NO: 27196 - protein, 10 aa, Borrelia burgdorferi B31
LKYNTNEANK

SEQ ID NO: 27197 - protein, 10 aa, Borrelia burgdorferi B31
KYNTNEANKK

SEQ ID NO: 27198 - protein, 10 aa, Borrelia burgdorferi B31
YNTNEANKKI

SEQ ID NO: 27199 - protein, 10 aa, Borrelia burgdorferi B31
NTNEANKKIC

SEQ ID NO: 27200 - protein, 10 aa, Borrelia burgdorferi B31
TNEANKKICE

SEQ ID NO: 27201 - protein, 10 aa, Borrelia burgdorferi B31
NEANKKICEF

SEQ ID NO: 27202 - protein, 10 aa, Borrelia burgdorferi B31
EANKKICEFI

SEQ ID NO: 27203 - protein, 10 aa, Borrelia burgdorferi B31
ANKKICEFIQ

SEQ ID NO: 27204 - protein, 10 aa, Borrelia burgdorferi B31
NKKICEFIQN

SEQ ID NO: 27205 - protein, 10 aa, Borrelia burgdorferi B31
KKICEFIQNQ

SEQ ID NO: 27206 - protein, 10 aa, Borrelia burgdorferi B31
KICEFIQNQW

SEQ ID NO: 27207 - protein, 10 aa, Borrelia burgdorferi B31
ICEFIQNQWK

SEQ ID NO: 27208 - protein, 10 aa, Borrelia burgdorferi B31
CEFIQNQWKK

SEQ ID NO: 27209 - protein, 10 aa, Borrelia burgdorferi B31
EFIQNQWKKN

SEQ ID NO: 27210 - protein, 10 aa, Borrelia burgdorferi B31
FIQNQWKKNL

SEQ ID NO: 27211 - protein, 10 aa, Borrelia burgdorferi B31
IQNQWKKNLN

SEQ ID NO: 27212 - protein, 10 aa, Borrelia burgdorferi B31
QNQWKKNLNI

SEQ ID NO: 27213 - protein, 10 aa, Borrelia burgdorferi B31
NQWKKNLNID

SEQ ID NO: 27214 - protein, 10 aa, Borrelia burgdorferi B31
QWKKNLNIDV

SEQ ID NO: 27215 - protein, 10 aa, Borrelia burgdorferi B31
WKKNLNIDVE

SEQ ID NO: 27216 - protein, 10 aa, Borrelia burgdorferi B31
KKNLNIDVEL

SEQ ID NO: 27217 - protein, 10 aa, Borrelia burgdorferi B31
KNLNIDVELE

SEQ ID NO: 27218 - protein, 10 aa, Borrelia burgdorferi B31
NLNIDVELEN

SEQ ID NO: 27219 - protein, 10 aa, Borrelia burgdorferi B31
LNIDVELENE

SEQ ID NO: 27220 - protein, 10 aa, Borrelia burgdorferi B31
NIDVELENEE

SEQ ID NO: 27221 - protein, 10 aa, Borrelia burgdorferi B31
IDVELENEEW

SEQ ID NO: 27222 - protein, 10 aa, Borrelia burgdorferi B31
DVELENEEWT

SEQ ID NO: 27223 - protein, 10 aa, Borrelia burgdorferi B31
VELENEEWTT

SEQ ID NO: 27224 - protein, 10 aa, Borrelia burgdorferi B31
ELENEEWTTY

SEQ ID NO: 27225 - protein, 10 aa, Borrelia burgdorferi B31
LENEEWTTYL

SEQ ID NO: 27226 - protein, 10 aa, Borrelia burgdorferi B31
ENEEWTTYLN

SEQ ID NO: 27227 - protein, 10 aa, Borrelia burgdorferi B31
NEEWTTYLNT

SEQ ID NO: 27228 - protein, 10 aa, Borrelia burgdorferi B31
EEWTTYLNTK

SEQ ID NO: 27229 - protein, 10 aa, Borrelia burgdorferi B31
EWTTYLNTKA

SEQ ID NO: 27230 - protein, 10 aa, Borrelia burgdorferi B31
WTTYLNTKAN

SEQ ID NO: 27231 - protein, 10 aa, Borrelia burgdorferi B31
TTYLNTKANG

SEQ ID NO: 27232 - protein, 10 aa, Borrelia burgdorferi B31
TYLNTKANGN

SEQ ID NO: 27233 - protein, 10 aa, Borrelia burgdorferi B31
YLNTKANGNY

SEQ ID NO: 27234 - protein, 10 aa, Borrelia burgdorferi B31
LNTKANGNYE

SEQ ID NO: 27235 - protein, 10 aa, Borrelia burgdorferi B31
NTKANGNYEI

SEQ ID NO: 27236 - protein, 10 aa, Borrelia burgdorferi B31
TKANGNYEIA

SEQ ID NO: 27237 - protein, 10 aa, Borrelia burgdorferi B31
KANGNYEIAR

SEQ ID NO: 27238 - protein, 10 aa, Borrelia burgdorferi B31
ANGNYEIARA

SEQ ID NO: 27239 - protein, 10 aa, Borrelia burgdorferi B31
NGNYEIARAG

SEQ ID NO: 27240 - protein, 10 aa, Borrelia burgdorferi B31
GNYEIARAGW

SEQ ID NO: 27241 - protein, 10 aa, Borrelia burgdorferi B31
NYEIARAGWI

SEQ ID NO: 27242 - protein, 10 aa, Borrelia burgdorferi B31
YEIARAGWIG

SEQ ID NO: 27243 - protein, 10 aa, Borrelia burgdorferi B31
EIARAGWIGD

SEQ ID NO: 27244 - protein, 10 aa, Borrelia burgdorferi B31
IARAGWIGDY

SEQ ID NO: 27245 - protein, 10 aa, Borrelia burgdorferi B31
ARAGWIGDYA

SEQ ID NO: 27246 - protein, 10 aa, Borrelia burgdorferi B31
RAGWIGDYAD

SEQ ID NO: 27247 - protein, 10 aa, Borrelia burgdorferi B31
AGWIGDYADP

SEQ ID NO: 27248 - protein, 10 aa, Borrelia burgdorferi B31
GWIGDYADPL

SEQ ID NO: 27249 - protein, 10 aa, Borrelia burgdorferi B31
WIGDYADPLT

SEQ ID NO: 27250 - protein, 10 aa, Borrelia burgdorferi B31
IGDYADPLTF

SEQ ID NO: 27251 - protein, 10 aa, Borrelia burgdorferi B31
GDYADPLTFL

SEQ ID NO: 27252 - protein, 10 aa, Borrelia burgdorferi B31
DYADPLTFLS

SEQ ID NO: 27253 - protein, 10 aa, Borrelia burgdorferi B31
YADPLTFLSI

SEQ ID NO: 27254 - protein, 10 aa, Borrelia burgdorferi B31
ADPLTFLSIF

SEQ ID NO: 27255 - protein, 10 aa, Borrelia burgdorferi B31
DPLTFLSIFT

SEQ ID NO: 27256 - protein, 10 aa, Borrelia burgdorferi B31
PLTFLSIFTQ

SEQ ID NO: 27257 - protein, 10 aa, Borrelia burgdorferi B31
LTFLSIFTQG

SEQ ID NO: 27258 - protein, 10 aa, Borrelia burgdorferi B31
TFLSIFTQGY

SEQ ID NO: 27259 - protein, 10 aa, Borrelia burgdorferi B31
FLSIFTQGYT

SEQ ID NO: 27260 - protein, 10 aa, Borrelia burgdorferi B31
LSIFTQGYTQ

SEQ ID NO: 27261 - protein, 10 aa, Borrelia burgdorferi B31
SIFTQGYTQF

SEQ ID NO: 27262 - protein, 10 aa, Borrelia burgdorferi B31
IFTQGYTQFS

SEQ ID NO: 27263 - protein, 10 aa, Borrelia burgdorferi B31
FTQGYTQFSS

SEQ ID NO: 27264 - protein, 10 aa, Borrelia burgdorferi B31
TQGYTQFSSH

SEQ ID NO: 27265 - protein, 10 aa, Borrelia burgdorferi B31
QGYTQFSSHN

SEQ ID NO: 27266 - protein, 10 aa, Borrelia burgdorferi B31
GYTQFSSHNY

SEQ ID NO: 27267 - protein, 10 aa, Borrelia burgdorferi B31
YTQFSSHNYS

SEQ ID NO: 27268 - protein, 10 aa, Borrelia burgdorferi B31
TQFSSHNYSN

SEQ ID NO: 27269 - protein, 10 aa, Borrelia burgdorferi B31
QFSSHNYSNP

SEQ ID NO: 27270 - protein, 10 aa, Borrelia burgdorferi B31
FSSHNYSNPE

SEQ ID NO: 27271 - protein, 10 aa, Borrelia burgdorferi B31
SSHNYSNPEY

SEQ ID NO: 27272 - protein, 10 aa, Borrelia burgdorferi B31
SHNYSNPEYN

SEQ ID NO: 27273 - protein, 10 aa, Borrelia burgdorferi B31
HNYSNPEYNE

SEQ ID NO: 27274 - protein, 10 aa, Borrelia burgdorferi B31
NYSNPEYNEL

SEQ ID NO: 27275 - protein, 10 aa, Borrelia burgdorferi B31
YSNPEYNELI

SEQ ID NO: 27276 - protein, 10 aa, Borrelia burgdorferi B31
SNPEYNELIK

SEQ ID NO: 27277 - protein, 10 aa, Borrelia burgdorferi B31
NPEYNELIKK

SEQ ID NO: 27278 - protein, 10 aa, Borrelia burgdorferi B31
PEYNELIKKS

SEQ ID NO: 27279 - protein, 10 aa, Borrelia burgdorferi B31
EYNELIKKSD

SEQ ID NO: 27280 - protein, 10 aa, Borrelia burgdorferi B31
YNELIKKSDL

SEQ ID NO: 27281 - protein, 10 aa, Borrelia burgdorferi B31
NELIKKSDLE

SEQ ID NO: 27282 - protein, 10 aa, Borrelia burgdorferi B31
ELIKKSDLEL

SEQ ID NO: 27283 - protein, 10 aa, Borrelia burgdorferi B31
LIKKSDLELD

SEQ ID NO: 27284 - protein, 10 aa, Borrelia burgdorferi B31
IKKSDLELDP

SEQ ID NO: 27285 - protein, 10 aa, Borrelia burgdorferi B31
KKSDLELDPI

SEQ ID NO: 27286 - protein, 10 aa, Borrelia burgdorferi B31
KSDLELDPIK

SEQ ID NO: 27287 - protein, 10 aa, Borrelia burgdorferi B31
SDLELDPIKR

SEQ ID NO: 27288 - protein, 10 aa, Borrelia burgdorferi B31
DLELDPIKRQ

SEQ ID NO: 27289 - protein, 10 aa, Borrelia burgdorferi B31
LELDPIKRQD

SEQ ID NO: 27290 - protein, 10 aa, Borrelia burgdorferi B31
ELDPIKRQDI

SEQ ID NO: 27291 - protein, 10 aa, Borrelia burgdorferi B31
LDPIKRQDIL

SEQ ID NO: 27292 - protein, 10 aa, Borrelia burgdorferi B31
DPIKRQDILR

SEQ ID NO: 27293 - protein, 10 aa, Borrelia burgdorferi B31
PIKRQDILRQ

SEQ ID NO: 27294 - protein, 10 aa, Borrelia burgdorferi B31
IKRQDILRQA

SEQ ID NO: 27295 - protein, 10 aa, Borrelia burgdorferi B31
KRQDILRQAE

SEQ ID NO: 27296 - protein, 10 aa, Borrelia burgdorferi B31
RQDILRQAEE

SEQ ID NO: 27297 - protein, 10 aa, Borrelia burgdorferi B31
QDILRQAEEI

SEQ ID NO: 27298 - protein, 10 aa, Borrelia burgdorferi B31
DILRQAEEII

SEQ ID NO: 27299 - protein, 10 aa, Borrelia burgdorferi B31
ILRQAEEIII

SEQ ID NO: 27300 - protein, 10 aa, Borrelia burgdorferi B31
LRQAEEIIIE

SEQ ID NO: 27301 - protein, 10 aa, Borrelia burgdorferi B31
RQAEEIIIEK

SEQ ID NO: 27302 - protein, 10 aa, Borrelia burgdorferi B31
QAEEIIIEKD

SEQ ID NO: 27303 - protein, 10 aa, Borrelia burgdorferi B31
AEEIIIEKDF

SEQ ID NO: 27304 - protein, 10 aa, Borrelia burgdorferi B31
EEIIIEKDFP

SEQ ID NO: 27305 - protein, 10 aa, Borrelia burgdorferi B31
EIIIEKDFPI

SEQ ID NO: 27306 - protein, 10 aa, Borrelia burgdorferi B31
IIIEKDFPIA

SEQ ID NO: 27307 - protein, 10 aa, Borrelia burgdorferi B31
IIEKDFPIAP

SEQ ID NO: 27308 - protein, 10 aa, Borrelia burgdorferi B31
IEKDFPIAPI

SEQ ID NO: 27309 - protein, 10 aa, Borrelia burgdorferi B31
EKDFPIAPIY

SEQ ID NO: 27310 - protein, 10 aa, Borrelia burgdorferi B31
KDFPIAPIYI

SEQ ID NO: 27311 - protein, 10 aa, Borrelia burgdorferi B31
DFPIAPIYIY

SEQ ID NO: 27312 - protein, 10 aa, Borrelia burgdorferi B31
FPIAPIYIYG

SEQ ID NO: 27313 - protein, 10 aa, Borrelia burgdorferi B31
PIAPIYIYGN

SEQ ID NO: 27314 - protein, 10 aa, Borrelia burgdorferi B31
IAPIYIYGNS

SEQ ID NO: 27315 - protein, 10 aa, Borrelia burgdorferi B31
APIYIYGNSY

SEQ ID NO: 27316 - protein, 10 aa, Borrelia burgdorferi B31
PIYIYGNSYL

SEQ ID NO: 27317 - protein, 10 aa, Borrelia burgdorferi B31
IYIYGNSYLF

SEQ ID NO: 27318 - protein, 10 aa, Borrelia burgdorferi B31
YIYGNSYLFR

SEQ ID NO: 27319 - protein, 10 aa, Borrelia burgdorferi B31
IYGNSYLFRN

SEQ ID NO: 27320 - protein, 10 aa, Borrelia burgdorferi B31
YGNSYLFRND

SEQ ID NO: 27321 - protein, 10 aa, Borrelia burgdorferi B31
GNSYLFRNDK

SEQ ID NO: 27322 - protein, 10 aa, Borrelia burgdorferi B31
NSYLFRNDKW

SEQ ID NO: 27323 - protein, 10 aa, Borrelia burgdorferi B31
SYLFRNDKWT

SEQ ID NO: 27324 - protein, 10 aa, Borrelia burgdorferi B31
YLFRNDKWTG

SEQ ID NO: 27325 - protein, 10 aa, Borrelia burgdorferi B31
LFRNDKWTGW

SEQ ID NO: 27326 - protein, 10 aa, Borrelia burgdorferi B31
FRNDKWTGWN

SEQ ID NO: 27327 - protein, 10 aa, Borrelia burgdorferi B31
RNDKWTGWNT

SEQ ID NO: 27328 - protein, 10 aa, Borrelia burgdorferi B31
NDKWTGWNTN

SEQ ID NO: 27329 - protein, 10 aa, Borrelia burgdorferi B31
DKWTGWNTNI

SEQ ID NO: 27330 - protein, 10 aa, Borrelia burgdorferi B31
KWTGWNTNIL

SEQ ID NO: 27331 - protein, 10 aa, Borrelia burgdorferi B31
WTGWNTNILE

SEQ ID NO: 27332 - protein, 10 aa, Borrelia burgdorferi B31
TGWNTNILER

SEQ ID NO: 27333 - protein, 10 aa, Borrelia burgdorferi B31
GWNTNILERF

SEQ ID NO: 27334 - protein, 10 aa, Borrelia burgdorferi B31
WNTNILERFD

SEQ ID NO: 27335 - protein, 10 aa, Borrelia burgdorferi B31
NTNILERFDL

SEQ ID NO: 27336 - protein, 10 aa, Borrelia burgdorferi B31
TNILERFDLS

SEQ ID NO: 27337 - protein, 10 aa, Borrelia burgdorferi B31
NILERFDLSQ

SEQ ID NO: 27338 - protein, 10 aa, Borrelia burgdorferi B31
ILERFDLSQL

SEQ ID NO: 27339 - protein, 10 aa, Borrelia burgdorferi B31
LERFDLSQLK

SEQ ID NO: 27340 - protein, 10 aa, Borrelia burgdorferi B31
ERFDLSQLKL

SEQ ID NO: 27341 - protein, 10 aa, Borrelia burgdorferi B31
RFDLSQLKLK

SEQ ID NO: 27342 - protein, 10 aa, Borrelia burgdorferi B31
FDLSQLKLKN

SEQ ID NO: 27343 - protein, 10 aa, Borrelia burgdorferi B31
DLSQLKLKNK

SEQ ID NO: 27344 - protein, 11 aa, Borrelia burgdorferi B31
MKLQRSLFLII

SEQ ID NO: 27345 - protein, 11 aa, Borrelia burgdorferi B31
KLQRSLFLIIF

SEQ ID NO: 27346 - protein, 11 aa, Borrelia burgdorferi B31
LQRSLFLIIFF

SEQ ID NO: 27347 - protein, 11 aa, Borrelia burgdorferi B31
QRSLFLIIFFL

SEQ ID NO: 27348 - protein, 11 aa, Borrelia burgdorferi B31
RSLFLIIFFLT

SEQ ID NO: 27349 - protein, 11 aa, Borrelia burgdorferi B31
SLFLIIFFLTF

SEQ ID NO: 27350 - protein, 11 aa, Borrelia burgdorferi B31
LFLIIFFLTFL

SEQ ID NO: 27351 - protein, 11 aa, Borrelia burgdorferi B31
FLIIFFLTFLC

SEQ ID NO: 27352 - protein, 11 aa, Borrelia burgdorferi B31
LIIFFLTFLCC

SEQ ID NO: 27353 - protein, 11 aa, Borrelia burgdorferi B31
IIFFLTFLCCN

SEQ ID NO: 27354 - protein, 11 aa, Borrelia burgdorferi B31
IFFLTFLCCNN

SEQ ID NO: 27355 - protein, 11 aa, Borrelia burgdorferi B31
FFLTFLCCNNK

SEQ ID NO: 27356 - protein, 11 aa, Borrelia burgdorferi B31
FLTFLCCNNKE

SEQ ID NO: 27357 - protein, 11 aa, Borrelia burgdorferi B31
LTFLCCNNKER

SEQ ID NO: 27358 - protein, 11 aa, Borrelia burgdorferi B31
TFLCCNNKERK

SEQ ID NO: 27359 - protein, 11 aa, Borrelia burgdorferi B31
FLCCNNKERKE

SEQ ID NO: 27360 - protein, 11 aa, Borrelia burgdorferi B31
LCCNNKERKEG

SEQ ID NO: 27361 - protein, 11 aa, Borrelia burgdorferi B31
CCNNKERKEGV

SEQ ID NO: 27362 - protein, 11 aa, Borrelia burgdorferi B31
CNNKERKEGVS

SEQ ID NO: 27363 - protein, 11 aa, Borrelia burgdorferi B31
NNKERKEGVSF

SEQ ID NO: 27364 - protein, 11 aa, Borrelia burgdorferi B31
NKERKEGVSFK

SEQ ID NO: 27365 - protein, 11 aa, Borrelia burgdorferi B31
KERKEGVSFKI

SEQ ID NO: 27366 - protein, 11 aa, Borrelia burgdorferi B31
ERKEGVSFKIS

SEQ ID NO: 27367 - protein, 11 aa, Borrelia burgdorferi B31
RKEGVSFKISL

SEQ ID NO: 27368 - protein, 11 aa, Borrelia burgdorferi B31
KEGVSFKISLG

SEQ ID NO: 27369 - protein, 11 aa, Borrelia burgdorferi B31
EGVSFKISLGA

SEQ ID NO: 27370 - protein, 11 aa, Borrelia burgdorferi B31
GVSFKISLGAE

SEQ ID NO: 27371 - protein, 11 aa, Borrelia burgdorferi B31
VSFKISLGAEP

SEQ ID NO: 27372 - protein, 11 aa, Borrelia burgdorferi B31
SFKISLGAEPS

SEQ ID NO: 27373 - protein, 11 aa, Borrelia burgdorferi B31
FKISLGAEPSS

SEQ ID NO: 27374 - protein, 11 aa, Borrelia burgdorferi B31
KISLGAEPSSL

SEQ ID NO: 27375 - protein, 11 aa, Borrelia burgdorferi B31
ISLGAEPSSLD

SEQ ID NO: 27376 - protein, 11 aa, Borrelia burgdorferi B31
SLGAEPSSLDP

SEQ ID NO: 27377 - protein, 11 aa, Borrelia burgdorferi B31
LGAEPSSLDPQ

SEQ ID NO: 27378 - protein, 11 aa, Borrelia burgdorferi B31
GAEPSSLDPQL

SEQ ID NO: 27379 - protein, 11 aa, Borrelia burgdorferi B31
AEPSSLDPQLA

SEQ ID NO: 27380 - protein, 11 aa, Borrelia burgdorferi B31
EPSSLDPQLAE

SEQ ID NO: 27381 - protein, 11 aa, Borrelia burgdorferi B31
PSSLDPQLAED

SEQ ID NO: 27382 - protein, 11 aa, Borrelia burgdorferi B31
SSLDPQLAEDN

SEQ ID NO: 27383 - protein, 11 aa, Borrelia burgdorferi B31
SLDPQLAEDNV

SEQ ID NO: 27384 - protein, 11 aa, Borrelia burgdorferi B31
LDPQLAEDNVA

SEQ ID NO: 27385 - protein, 11 aa, Borrelia burgdorferi B31
DPQLAEDNVAS

SEQ ID NO: 27386 - protein, 11 aa, Borrelia burgdorferi B31
PQLAEDNVASK

SEQ ID NO: 27387 - protein, 11 aa, Borrelia burgdorferi B31
QLAEDNVASKM

SEQ ID NO: 27388 - protein, 11 aa, Borrelia burgdorferi B31
LAEDNVASKMI

SEQ ID NO: 27389 - protein, 11 aa, Borrelia burgdorferi B31
AEDNVASKMID

SEQ ID NO: 27390 - protein, 11 aa, Borrelia burgdorferi B31
EDNVASKMIDT

SEQ ID NO: 27391 - protein, 11 aa, Borrelia burgdorferi B31
DNVASKMIDTM

SEQ ID NO: 27392 - protein, 11 aa, Borrelia burgdorferi B31
NVASKMIDTMF

SEQ ID NO: 27393 - protein, 11 aa, Borrelia burgdorferi B31
VASKMIDTMFR

SEQ ID NO: 27394 - protein, 11 aa, Borrelia burgdorferi B31
ASKMIDTMFRG

SEQ ID NO: 27395 - protein, 11 aa, Borrelia burgdorferi B31
SKMIDTMFRGI

SEQ ID NO: 27396 - protein, 11 aa, Borrelia burgdorferi B31
KMIDTMFRGIV

SEQ ID NO: 27397 - protein, 11 aa, Borrelia burgdorferi B31
MIDTMFRGIVT

SEQ ID NO: 27398 - protein, 11 aa, Borrelia burgdorferi B31
IDTMFRGIVTG

SEQ ID NO: 27399 - protein, 11 aa, Borrelia burgdorferi B31
DTMFRGIVTGD

SEQ ID NO: 27400 - protein, 11 aa, Borrelia burgdorferi B31
TMFRGIVTGDP

SEQ ID NO: 27401 - protein, 11 aa, Borrelia burgdorferi B31
MFRGIVTGDPN

SEQ ID NO: 27402 - protein, 11 aa, Borrelia burgdorferi B31
FRGIVTGDPNT

SEQ ID NO: 27403 - protein, 11 aa, Borrelia burgdorferi B31
RGIVTGDPNTG

SEQ ID NO: 27404 - protein, 11 aa, Borrelia burgdorferi B31
GIVTGDPNTGG

SEQ ID NO: 27405 - protein, 11 aa, Borrelia burgdorferi B31
IVTGDPNTGGN

SEQ ID NO: 27406 - protein, 11 aa, Borrelia burgdorferi B31
VTGDPNTGGNK

SEQ ID NO: 27407 - protein, 11 aa, Borrelia burgdorferi B31
TGDPNTGGNKP

SEQ ID NO: 27408 - protein, 11 aa, Borrelia burgdorferi B31
GDPNTGGNKPG

SEQ ID NO: 27409 - protein, 11 aa, Borrelia burgdorferi B31
DPNTGGNKPGL

SEQ ID NO: 27410 - protein, 11 aa, Borrelia burgdorferi B31
PNTGGNKPGLA

SEQ ID NO: 27411 - protein, 11 aa, Borrelia burgdorferi B31
NTGGNKPGLAK

SEQ ID NO: 27412 - protein, 11 aa, Borrelia burgdorferi B31
TGGNKPGLAKG

SEQ ID NO: 27413 - protein, 11 aa, Borrelia burgdorferi B31
GGNKPGLAKGW

SEQ ID NO: 27414 - protein, 11 aa, Borrelia burgdorferi B31
GNKPGLAKGWD

SEQ ID NO: 27415 - protein, 11 aa, Borrelia burgdorferi B31
NKPGLAKGWDI

SEQ ID NO: 27416 - protein, 11 aa, Borrelia burgdorferi B31
KPGLAKGWDIS

SEQ ID NO: 27417 - protein, 11 aa, Borrelia burgdorferi B31
PGLAKGWDISS

SEQ ID NO: 27418 - protein, 11 aa, Borrelia burgdorferi B31
GLAKGWDISSD

SEQ ID NO: 27419 - protein, 11 aa, Borrelia burgdorferi B31
LAKGWDISSDG

SEQ ID NO: 27420 - protein, 11 aa, Borrelia burgdorferi B31
AKGWDISSDGT

SEQ ID NO: 27421 - protein, 11 aa, Borrelia burgdorferi B31
KGWDISSDGTV

SEQ ID NO: 27422 - protein, 11 aa, Borrelia burgdorferi B31
GWDISSDGTVY

SEQ ID NO: 27423 - protein, 11 aa, Borrelia burgdorferi B31
WDISSDGTVYT

SEQ ID NO: 27424 - protein, 11 aa, Borrelia burgdorferi B31
DISSDGTVYTF

SEQ ID NO: 27425 - protein, 11 aa, Borrelia burgdorferi B31
ISSDGTVYTFN

SEQ ID NO: 27426 - protein, 11 aa, Borrelia burgdorferi B31
SSDGTVYTFNL

SEQ ID NO: 27427 - protein, 11 aa, Borrelia burgdorferi B31
SDGTVYTFNLR

SEQ ID NO: 27428 - protein, 11 aa, Borrelia burgdorferi B31
DGTVYTFNLRE

SEQ ID NO: 27429 - protein, 11 aa, Borrelia burgdorferi B31
GTVYTFNLREK

SEQ ID NO: 27430 - protein, 11 aa, Borrelia burgdorferi B31
TVYTFNLREKI

SEQ ID NO: 27431 - protein, 11 aa, Borrelia burgdorferi B31
VYTFNLREKIT

SEQ ID NO: 27432 - protein, 11 aa, Borrelia burgdorferi B31
YTFNLREKITW

SEQ ID NO: 27433 - protein, 11 aa, Borrelia burgdorferi B31
TFNLREKITWS

SEQ ID NO: 27434 - protein, 11 aa, Borrelia burgdorferi B31
FNLREKITWSD

SEQ ID NO: 27435 - protein, 11 aa, Borrelia burgdorferi B31
NLREKITWSDG

SEQ ID NO: 27436 - protein, 11 aa, Borrelia burgdorferi B31
LREKITWSDGV

SEQ ID NO: 27437 - protein, 11 aa, Borrelia burgdorferi B31
REKITWSDGVA

SEQ ID NO: 27438 - protein, 11 aa, Borrelia burgdorferi B31
EKITWSDGVAI

SEQ ID NO: 27439 - protein, 11 aa, Borrelia burgdorferi B31
KITWSDGVAIT

SEQ ID NO: 27440 - protein, 11 aa, Borrelia burgdorferi B31
ITWSDGVAITA

SEQ ID NO: 27441 - protein, 11 aa, Borrelia burgdorferi B31
TWSDGVAITAE

SEQ ID NO: 27442 - protein, 11 aa, Borrelia burgdorferi B31
WSDGVAITAEG

SEQ ID NO: 27443 - protein, 11 aa, Borrelia burgdorferi B31
SDGVAITAEGI

SEQ ID NO: 27444 - protein, 11 aa, Borrelia burgdorferi B31
DGVAITAEGIR

SEQ ID NO: 27445 - protein, 11 aa, Borrelia burgdorferi B31
GVAITAEGIRK

SEQ ID NO: 27446 - protein, 11 aa, Borrelia burgdorferi B31
VAITAEGIRKS

SEQ ID NO: 27447 - protein, 11 aa, Borrelia burgdorferi B31
AITAEGIRKSY

SEQ ID NO: 27448 - protein, 11 aa, Borrelia burgdorferi B31
ITAEGIRKSYL

SEQ ID NO: 27449 - protein, 11 aa, Borrelia burgdorferi B31
TAEGIRKSYLR

SEQ ID NO: 27450 - protein, 11 aa, Borrelia burgdorferi B31
AEGIRKSYLRI

SEQ ID NO: 27451 - protein, 11 aa, Borrelia burgdorferi B31
EGIRKSYLRIL

SEQ ID NO: 27452 - protein, 11 aa, Borrelia burgdorferi B31
GIRKSYLRILN

SEQ ID NO: 27453 - protein, 11 aa, Borrelia burgdorferi B31
IRKSYLRILNK

SEQ ID NO: 27454 - protein, 11 aa, Borrelia burgdorferi B31
RKSYLRILNKE

SEQ ID NO: 27455 - protein, 11 aa, Borrelia burgdorferi B31
KSYLRILNKET

SEQ ID NO: 27456 - protein, 11 aa, Borrelia burgdorferi B31
SYLRILNKETG

SEQ ID NO: 27457 - protein, 11 aa, Borrelia burgdorferi B31
YLRILNKETGS

SEQ ID NO: 27458 - protein, 11 aa, Borrelia burgdorferi B31
LRILNKETGSK

SEQ ID NO: 27459 - protein, 11 aa, Borrelia burgdorferi B31
RILNKETGSKY

SEQ ID NO: 27460 - protein, 11 aa, Borrelia burgdorferi B31
ILNKETGSKYV

SEQ ID NO: 27461 - protein, 11 aa, Borrelia burgdorferi B31
LNKETGSKYVE

SEQ ID NO: 27462 - protein, 11 aa, Borrelia burgdorferi B31
NKETGSKYVEM

SEQ ID NO: 27463 - protein, 11 aa, Borrelia burgdorferi B31
KETGSKYVEMV

SEQ ID NO: 27464 - protein, 11 aa, Borrelia burgdorferi B31
ETGSKYVEMVK

SEQ ID NO: 27465 - protein, 11 aa, Borrelia burgdorferi B31
TGSKYVEMVKS

SEQ ID NO: 27466 - protein, 11 aa, Borrelia burgdorferi B31
GSKYVEMVKSV

SEQ ID NO: 27467 - protein, 11 aa, Borrelia burgdorferi B31
SKYVEMVKSVI

SEQ ID NO: 27468 - protein, 11 aa, Borrelia burgdorferi B31
KYVEMVKSVIK

SEQ ID NO: 27469 - protein, 11 aa, Borrelia burgdorferi B31
YVEMVKSVIKN

SEQ ID NO: 27470 - protein, 11 aa, Borrelia burgdorferi B31
VEMVKSVIKNG

SEQ ID NO: 27471 - protein, 11 aa, Borrelia burgdorferi B31
EMVKSVIKNGQ

SEQ ID NO: 27472 - protein, 11 aa, Borrelia burgdorferi B31
MVKSVIKNGQK

SEQ ID NO: 27473 - protein, 11 aa, Borrelia burgdorferi B31
VKSVIKNGQKY

SEQ ID NO: 27474 - protein, 11 aa, Borrelia burgdorferi B31
KSVIKNGQKYF

SEQ ID NO: 27475 - protein, 11 aa, Borrelia burgdorferi B31
SVIKNGQKYFD

SEQ ID NO: 27476 - protein, 11 aa, Borrelia burgdorferi B31
VIKNGQKYFDG

SEQ ID NO: 27477 - protein, 11 aa, Borrelia burgdorferi B31
IKNGQKYFDGQ

SEQ ID NO: 27478 - protein, 11 aa, Borrelia burgdorferi B31
KNGQKYFDGQV

SEQ ID NO: 27479 - protein, 11 aa, Borrelia burgdorferi B31
NGQKYFDGQVT

SEQ ID NO: 27480 - protein, 11 aa, Borrelia burgdorferi B31
GQKYFDGQVTD

SEQ ID NO: 27481 - protein, 11 aa, Borrelia burgdorferi B31
QKYFDGQVTDS

SEQ ID NO: 27482 - protein, 11 aa, Borrelia burgdorferi B31
KYFDGQVTDSE

SEQ ID NO: 27483 - protein, 11 aa, Borrelia burgdorferi B31
YFDGQVTDSEL

SEQ ID NO: 27484 - protein, 11 aa, Borrelia burgdorferi B31
FDGQVTDSELG

SEQ ID NO: 27485 - protein, 11 aa, Borrelia burgdorferi B31
DGQVTDSELGI

SEQ ID NO: 27486 - protein, 11 aa, Borrelia burgdorferi B31
GQVTDSELGIR

SEQ ID NO: 27487 - protein, 11 aa, Borrelia burgdorferi B31
QVTDSELGIRA

SEQ ID NO: 27488 - protein, 11 aa, Borrelia burgdorferi B31
VTDSELGIRAI

SEQ ID NO: 27489 - protein, 11 aa, Borrelia burgdorferi B31
TDSELGIRAID

SEQ ID NO: 27490 - protein, 11 aa, Borrelia burgdorferi B31
DSELGIRAIDE

SEQ ID NO: 27491 - protein, 11 aa, Borrelia burgdorferi B31
SELGIRAIDEK

SEQ ID NO: 27492 - protein, 11 aa, Borrelia burgdorferi B31
ELGIRAIDEKT

SEQ ID NO: 27493 - protein, 11 aa, Borrelia burgdorferi B31
LGIRAIDEKTL

SEQ ID NO: 27494 - protein, 11 aa, Borrelia burgdorferi B31
GIRAIDEKTLE

SEQ ID NO: 27495 - protein, 11 aa, Borrelia burgdorferi B31
IRAIDEKTLEI

SEQ ID NO: 27496 - protein, 11 aa, Borrelia burgdorferi B31
RAIDEKTLEIT

SEQ ID NO: 27497 - protein, 11 aa, Borrelia burgdorferi B31
AIDEKTLEITL

SEQ ID NO: 27498 - protein, 11 aa, Borrelia burgdorferi B31
IDEKTLEITLE

SEQ ID NO: 27499 - protein, 11 aa, Borrelia burgdorferi B31
DEKTLEITLES

SEQ ID NO: 27500 - protein, 11 aa, Borrelia burgdorferi B31
EKTLEITLESP

SEQ ID NO: 27501 - protein, 11 aa, Borrelia burgdorferi B31
KTLEITLESPK

SEQ ID NO: 27502 - protein, 11 aa, Borrelia burgdorferi B31
TLEITLESPKP

SEQ ID NO: 27503 - protein, 11 aa, Borrelia burgdorferi B31
LEITLESPKPY

SEQ ID NO: 27504 - protein, 11 aa, Borrelia burgdorferi B31
EITLESPKPYF

SEQ ID NO: 27505 - protein, 11 aa, Borrelia burgdorferi B31
ITLESPKPYFI

SEQ ID NO: 27506 - protein, 11 aa, Borrelia burgdorferi B31
TLESPKPYFID

SEQ ID NO: 27507 - protein, 11 aa, Borrelia burgdorferi B31
LESPKPYFIDM

SEQ ID NO: 27508 - protein, 11 aa, Borrelia burgdorferi B31
ESPKPYFIDML

SEQ ID NO: 27509 - protein, 11 aa, Borrelia burgdorferi B31
SPKPYFIDMLV

SEQ ID NO: 27510 - protein, 11 aa, Borrelia burgdorferi B31
PKPYFIDMLVH

SEQ ID NO: 27511 - protein, 11 aa, Borrelia burgdorferi B31
KPYFIDMLVHQ

SEQ ID NO: 27512 - protein, 11 aa, Borrelia burgdorferi B31
PYFIDMLVHQS

SEQ ID NO: 27513 - protein, 11 aa, Borrelia burgdorferi B31
YFIDMLVHQSF

SEQ ID NO: 27514 - protein, 11 aa, Borrelia burgdorferi B31
FIDMLVHQSFI

SEQ ID NO: 27515 - protein, 11 aa, Borrelia burgdorferi B31
IDMLVHQSFIP

SEQ ID NO: 27516 - protein, 11 aa, Borrelia burgdorferi B31
DMLVHQSFIPV

SEQ ID NO: 27517 - protein, 11 aa, Borrelia burgdorferi B31
MLVHQSFIPVP

SEQ ID NO: 27518 - protein, 11 aa, Borrelia burgdorferi B31
LVHQSFIPVPV

SEQ ID NO: 27519 - protein, 11 aa, Borrelia burgdorferi B31
VHQSFIPVPVH

SEQ ID NO: 27520 - protein, 11 aa, Borrelia burgdorferi B31
HQSFIPVPVHV

SEQ ID NO: 27521 - protein, 11 aa, Borrelia burgdorferi B31
QSFIPVPVHVT

SEQ ID NO: 27522 - protein, 11 aa, Borrelia burgdorferi B31
SFIPVPVHVTE

SEQ ID NO: 27523 - protein, 11 aa, Borrelia burgdorferi B31
FIPVPVHVTEK

SEQ ID NO: 27524 - protein, 11 aa, Borrelia burgdorferi B31
IPVPVHVTEKY

SEQ ID NO: 27525 - protein, 11 aa, Borrelia burgdorferi B31
PVPVHVTEKYG

SEQ ID NO: 27526 - protein, 11 aa, Borrelia burgdorferi B31
VPVHVTEKYGQ

SEQ ID NO: 27527 - protein, 11 aa, Borrelia burgdorferi B31
PVHVTEKYGQN

SEQ ID NO: 27528 - protein, 11 aa, Borrelia burgdorferi B31
VHVTEKYGQNW

SEQ ID NO: 27529 - protein, 11 aa, Borrelia burgdorferi B31
HVTEKYGQNWT

SEQ ID NO: 27530 - protein, 11 aa, Borrelia burgdorferi B31
VTEKYGQNWTS

SEQ ID NO: 27531 - protein, 11 aa, Borrelia burgdorferi B31
TEKYGQNWTSP

SEQ ID NO: 27532 - protein, 11 aa, Borrelia burgdorferi B31
EKYGQNWTSPE

SEQ ID NO: 27533 - protein, 11 aa, Borrelia burgdorferi B31
KYGQNWTSPEN

SEQ ID NO: 27534 - protein, 11 aa, Borrelia burgdorferi B31
YGQNWTSPENM

SEQ ID NO: 27535 - protein, 11 aa, Borrelia burgdorferi B31
GQNWTSPENMV

SEQ ID NO: 27536 - protein, 11 aa, Borrelia burgdorferi B31
QNWTSPENMVT

SEQ ID NO: 27537 - protein, 11 aa, Borrelia burgdorferi B31
NWTSPENMVTS

SEQ ID NO: 27538 - protein, 11 aa, Borrelia burgdorferi B31
WTSPENMVTSG

SEQ ID NO: 27539 - protein, 11 aa, Borrelia burgdorferi B31
TSPENMVTSGP

SEQ ID NO: 27540 - protein, 11 aa, Borrelia burgdorferi B31
SPENMVTSGPF

SEQ ID NO: 27541 - protein, 11 aa, Borrelia burgdorferi B31
PENMVTSGPFK

SEQ ID NO: 27542 - protein, 11 aa, Borrelia burgdorferi B31
ENMVTSGPFKL

SEQ ID NO: 27543 - protein, 11 aa, Borrelia burgdorferi B31
NMVTSGPFKLK

SEQ ID NO: 27544 - protein, 11 aa, Borrelia burgdorferi B31
MVTSGPFKLKE

SEQ ID NO: 27545 - protein, 11 aa, Borrelia burgdorferi B31
VTSGPFKLKER

SEQ ID NO: 27546 - protein, 11 aa, Borrelia burgdorferi B31
TSGPFKLKERI

SEQ ID NO: 27547 - protein, 11 aa, Borrelia burgdorferi B31
SGPFKLKERIP

SEQ ID NO: 27548 - protein, 11 aa, Borrelia burgdorferi B31
GPFKLKERIPN

SEQ ID NO: 27549 - protein, 11 aa, Borrelia burgdorferi B31
PFKLKERIPNE

SEQ ID NO: 27550 - protein, 11 aa, Borrelia burgdorferi B31
FKLKERIPNEK

SEQ ID NO: 27551 - protein, 11 aa, Borrelia burgdorferi B31
KLKERIPNEKY

SEQ ID NO: 27552 - protein, 11 aa, Borrelia burgdorferi B31
LKERIPNEKYV

SEQ ID NO: 27553 - protein, 11 aa, Borrelia burgdorferi B31
KERIPNEKYVF

SEQ ID NO: 27554 - protein, 11 aa, Borrelia burgdorferi B31
ERIPNEKYVFE

SEQ ID NO: 27555 - protein, 11 aa, Borrelia burgdorferi B31
RIPNEKYVFEK

SEQ ID NO: 27556 - protein, 11 aa, Borrelia burgdorferi B31
IPNEKYVFEKN

SEQ ID NO: 27557 - protein, 11 aa, Borrelia burgdorferi B31
PNEKYVFEKNN

SEQ ID NO: 27558 - protein, 11 aa, Borrelia burgdorferi B31
NEKYVFEKNNK

SEQ ID NO: 27559 - protein, 11 aa, Borrelia burgdorferi B31
EKYVFEKNNKY

SEQ ID NO: 27560 - protein, 11 aa, Borrelia burgdorferi B31
KYVFEKNNKYY

SEQ ID NO: 27561 - protein, 11 aa, Borrelia burgdorferi B31
YVFEKNNKYYD

SEQ ID NO: 27562 - protein, 11 aa, Borrelia burgdorferi B31
VFEKNNKYYDS

SEQ ID NO: 27563 - protein, 11 aa, Borrelia burgdorferi B31
FEKNNKYYDSN

SEQ ID NO: 27564 - protein, 11 aa, Borrelia burgdorferi B31
EKNNKYYDSNE

SEQ ID NO: 27565 - protein, 11 aa, Borrelia burgdorferi B31
KNNKYYDSNEV

SEQ ID NO: 27566 - protein, 11 aa, Borrelia burgdorferi B31
NNKYYDSNEVE

SEQ ID NO: 27567 - protein, 11 aa, Borrelia burgdorferi B31
NKYYDSNEVEL

SEQ ID NO: 27568 - protein, 11 aa, Borrelia burgdorferi B31
KYYDSNEVELE

SEQ ID NO: 27569 - protein, 11 aa, Borrelia burgdorferi B31
YYDSNEVELEE

SEQ ID NO: 27570 - protein, 11 aa, Borrelia burgdorferi B31
YDSNEVELEEI

SEQ ID NO: 27571 - protein, 11 aa, Borrelia burgdorferi B31
DSNEVELEEIT

SEQ ID NO: 27572 - protein, 11 aa, Borrelia burgdorferi B31
SNEVELEEITF

SEQ ID NO: 27573 - protein, 11 aa, Borrelia burgdorferi B31
NEVELEEITFY

SEQ ID NO: 27574 - protein, 11 aa, Borrelia burgdorferi B31
EVELEEITFYT

SEQ ID NO: 27575 - protein, 11 aa, Borrelia burgdorferi B31
VELEEITFYTT

SEQ ID NO: 27576 - protein, 11 aa, Borrelia burgdorferi B31
ELEEITFYTTN

SEQ ID NO: 27577 - protein, 11 aa, Borrelia burgdorferi B31
LEEITFYTTND

SEQ ID NO: 27578 - protein, 11 aa, Borrelia burgdorferi B31
EEITFYTTNDS

SEQ ID NO: 27579 - protein, 11 aa, Borrelia burgdorferi B31
EITFYTTNDSS

SEQ ID NO: 27580 - protein, 11 aa, Borrelia burgdorferi B31
ITFYTTNDSST

SEQ ID NO: 27581 - protein, 11 aa, Borrelia burgdorferi B31
TFYTTNDSSTA

SEQ ID NO: 27582 - protein, 11 aa, Borrelia burgdorferi B31
FYTTNDSSTAY

SEQ ID NO: 27583 - protein, 11 aa, Borrelia burgdorferi B31
YTTNDSSTAYK

SEQ ID NO: 27584 - protein, 11 aa, Borrelia burgdorferi B31
TTNDSSTAYKM

SEQ ID NO: 27585 - protein, 11 aa, Borrelia burgdorferi B31
TNDSSTAYKMY

SEQ ID NO: 27586 - protein, 11 aa, Borrelia burgdorferi B31
NDSSTAYKMYE

SEQ ID NO: 27587 - protein, 11 aa, Borrelia burgdorferi B31
DSSTAYKMYEN

SEQ ID NO: 27588 - protein, 11 aa, Borrelia burgdorferi B31
SSTAYKMYENE

SEQ ID NO: 27589 - protein, 11 aa, Borrelia burgdorferi B31
STAYKMYENEE

SEQ ID NO: 27590 - protein, 11 aa, Borrelia burgdorferi B31
TAYKMYENEEL

SEQ ID NO: 27591 - protein, 11 aa, Borrelia burgdorferi B31
AYKMYENEELD

SEQ ID NO: 27592 - protein, 11 aa, Borrelia burgdorferi B31
YKMYENEELDA

SEQ ID NO: 27593 - protein, 11 aa, Borrelia burgdorferi B31
KMYENEELDAI

SEQ ID NO: 27594 - protein, 11 aa, Borrelia burgdorferi B31
MYENEELDAIF

SEQ ID NO: 27595 - protein, 11 aa, Borrelia burgdorferi B31
YENEELDAIFG

SEQ ID NO: 27596 - protein, 11 aa, Borrelia burgdorferi B31
ENEELDAIFGS

SEQ ID NO: 27597 - protein, 11 aa, Borrelia burgdorferi B31
NEELDAIFGSI

SEQ ID NO: 27598 - protein, 11 aa, Borrelia burgdorferi B31
EELDAIFGSIP

SEQ ID NO: 27599 - protein, 11 aa, Borrelia burgdorferi B31
ELDAIFGSIPP

SEQ ID NO: 27600 - protein, 11 aa, Borrelia burgdorferi B31
LDAIFGSIPPD

SEQ ID NO: 27601 - protein, 11 aa, Borrelia burgdorferi B31
DAIFGSIPPDL

SEQ ID NO: 27602 - protein, 11 aa, Borrelia burgdorferi B31
AIFGSIPPDLI

SEQ ID NO: 27603 - protein, 11 aa, Borrelia burgdorferi B31
IFGSIPPDLIK

SEQ ID NO: 27604 - protein, 11 aa, Borrelia burgdorferi B31
FGSIPPDLIKN

SEQ ID NO: 27605 - protein, 11 aa, Borrelia burgdorferi B31
GSIPPDLIKNL

SEQ ID NO: 27606 - protein, 11 aa, Borrelia burgdorferi B31
SIPPDLIKNLK

SEQ ID NO: 27607 - protein, 11 aa, Borrelia burgdorferi B31
IPPDLIKNLKL

SEQ ID NO: 27608 - protein, 11 aa, Borrelia burgdorferi B31
PPDLIKNLKLR

SEQ ID NO: 27609 - protein, 11 aa, Borrelia burgdorferi B31
PDLIKNLKLRS

SEQ ID NO: 27610 - protein, 11 aa, Borrelia burgdorferi B31
DLIKNLKLRSD

SEQ ID NO: 27611 - protein, 11 aa, Borrelia burgdorferi B31
LIKNLKLRSDY

SEQ ID NO: 27612 - protein, 11 aa, Borrelia burgdorferi B31
IKNLKLRSDYY

SEQ ID NO: 27613 - protein, 11 aa, Borrelia burgdorferi B31
KNLKLRSDYYS

SEQ ID NO: 27614 - protein, 11 aa, Borrelia burgdorferi B31
NLKLRSDYYSS

SEQ ID NO: 27615 - protein, 11 aa, Borrelia burgdorferi B31
LKLRSDYYSSA

SEQ ID NO: 27616 - protein, 11 aa, Borrelia burgdorferi B31
KLRSDYYSSAV

SEQ ID NO: 27617 - protein, 11 aa, Borrelia burgdorferi B31
LRSDYYSSAVN

SEQ ID NO: 27618 - protein, 11 aa, Borrelia burgdorferi B31
RSDYYSSAVNA

SEQ ID NO: 27619 - protein, 11 aa, Borrelia burgdorferi B31
SDYYSSAVNAI

SEQ ID NO: 27620 - protein, 11 aa, Borrelia burgdorferi B31
DYYSSAVNAIY

SEQ ID NO: 27621 - protein, 11 aa, Borrelia burgdorferi B31
YYSSAVNAIYF

SEQ ID NO: 27622 - protein, 11 aa, Borrelia burgdorferi B31
YSSAVNAIYFY

SEQ ID NO: 27623 - protein, 11 aa, Borrelia burgdorferi B31
SSAVNAIYFYA

SEQ ID NO: 27624 - protein, 11 aa, Borrelia burgdorferi B31
SAVNAIYFYAF

SEQ ID NO: 27625 - protein, 11 aa, Borrelia burgdorferi B31
AVNAIYFYAFN

SEQ ID NO: 27626 - protein, 11 aa, Borrelia burgdorferi B31
VNAIYFYAFNT

SEQ ID NO: 27627 - protein, 11 aa, Borrelia burgdorferi B31
NAIYFYAFNTH

SEQ ID NO: 27628 - protein, 11 aa, Borrelia burgdorferi B31
AIYFYAFNTHI

SEQ ID NO: 27629 - protein, 11 aa, Borrelia burgdorferi B31
IYFYAFNTHIK

SEQ ID NO: 27630 - protein, 11 aa, Borrelia burgdorferi B31
YFYAFNTHIKP

SEQ ID NO: 27631 - protein, 11 aa, Borrelia burgdorferi B31
FYAFNTHIKPL

SEQ ID NO: 27632 - protein, 11 aa, Borrelia burgdorferi B31
YAFNTHIKPLD

SEQ ID NO: 27633 - protein, 11 aa, Borrelia burgdorferi B31
AFNTHIKPLDN

SEQ ID NO: 27634 - protein, 11 aa, Borrelia burgdorferi B31
FNTHIKPLDNV

SEQ ID NO: 27635 - protein, 11 aa, Borrelia burgdorferi B31
NTHIKPLDNVK

SEQ ID NO: 27636 - protein, 11 aa, Borrelia burgdorferi B31
THIKPLDNVKI

SEQ ID NO: 27637 - protein, 11 aa, Borrelia burgdorferi B31
HIKPLDNVKIR

SEQ ID NO: 27638 - protein, 11 aa, Borrelia burgdorferi B31
IKPLDNVKIRK

SEQ ID NO: 27639 - protein, 11 aa, Borrelia burgdorferi B31
KPLDNVKIRKA

SEQ ID NO: 27640 - protein, 11 aa, Borrelia burgdorferi B31
PLDNVKIRKAL

SEQ ID NO: 27641 - protein, 11 aa, Borrelia burgdorferi B31
LDNVKIRKALT

SEQ ID NO: 27642 - protein, 11 aa, Borrelia burgdorferi B31
DNVKIRKALTL

SEQ ID NO: 27643 - protein, 11 aa, Borrelia burgdorferi B31
NVKIRKALTLA

SEQ ID NO: 27644 - protein, 11 aa, Borrelia burgdorferi B31
VKIRKALTLAI

SEQ ID NO: 27645 - protein, 11 aa, Borrelia burgdorferi B31
KIRKALTLAID

SEQ ID NO: 27646 - protein, 11 aa, Borrelia burgdorferi B31
IRKALTLAIDR

SEQ ID NO: 27647 - protein, 11 aa, Borrelia burgdorferi B31
RKALTLAIDRE

SEQ ID NO: 27648 - protein, 11 aa, Borrelia burgdorferi B31
KALTLAIDRET

SEQ ID NO: 27649 - protein, 11 aa, Borrelia burgdorferi B31
ALTLAIDRETL

SEQ ID NO: 27650 - protein, 11 aa, Borrelia burgdorferi B31
LTLAIDRETLT

SEQ ID NO: 27651 - protein, 11 aa, Borrelia burgdorferi B31
TLAIDRETLTY

SEQ ID NO: 27652 - protein, 11 aa, Borrelia burgdorferi B31
LAIDRETLTYK

SEQ ID NO: 27653 - protein, 11 aa, Borrelia burgdorferi B31
AIDRETLTYKV

SEQ ID NO: 27654 - protein, 11 aa, Borrelia burgdorferi B31
IDRETLTYKVL

SEQ ID NO: 27655 - protein, 11 aa, Borrelia burgdorferi B31
DRETLTYKVLD

SEQ ID NO: 27656 - protein, 11 aa, Borrelia burgdorferi B31
RETLTYKVLDN

SEQ ID NO: 27657 - protein, 11 aa, Borrelia burgdorferi B31
ETLTYKVLDNG

SEQ ID NO: 27658 - protein, 11 aa, Borrelia burgdorferi B31
TLTYKVLDNGT

SEQ ID NO: 27659 - protein, 11 aa, Borrelia burgdorferi B31
LTYKVLDNGTT

SEQ ID NO: 27660 - protein, 11 aa, Borrelia burgdorferi B31
TYKVLDNGTTP

SEQ ID NO: 27661 - protein, 11 aa, Borrelia burgdorferi B31
YKVLDNGTTPT

SEQ ID NO: 27662 - protein, 11 aa, Borrelia burgdorferi B31
KVLDNGTTPTR

SEQ ID NO: 27663 - protein, 11 aa, Borrelia burgdorferi B31
VLDNGTTPTRR

SEQ ID NO: 27664 - protein, 11 aa, Borrelia burgdorferi B31
LDNGTTPTRRA

SEQ ID NO: 27665 - protein, 11 aa, Borrelia burgdorferi B31
DNGTTPTRRAT

SEQ ID NO: 27666 - protein, 11 aa, Borrelia burgdorferi B31
NGTTPTRRATP

SEQ ID NO: 27667 - protein, 11 aa, Borrelia burgdorferi B31
GTTPTRRATPN

SEQ ID NO: 27668 - protein, 11 aa, Borrelia burgdorferi B31
TTPTRRATPNF

SEQ ID NO: 27669 - protein, 11 aa, Borrelia burgdorferi B31
TPTRRATPNFS

SEQ ID NO: 27670 - protein, 11 aa, Borrelia burgdorferi B31
PTRRATPNFSS

SEQ ID NO: 27671 - protein, 11 aa, Borrelia burgdorferi B31
TRRATPNFSSY

SEQ ID NO: 27672 - protein, 11 aa, Borrelia burgdorferi B31
RRATPNFSSYS

SEQ ID NO: 27673 - protein, 11 aa, Borrelia burgdorferi B31
RATPNFSSYSY

SEQ ID NO: 27674 - protein, 11 aa, Borrelia burgdorferi B31
ATPNFSSYSYA

SEQ ID NO: 27675 - protein, 11 aa, Borrelia burgdorferi B31
TPNFSSYSYAK

SEQ ID NO: 27676 - protein, 11 aa, Borrelia burgdorferi B31
PNFSSYSYAKS

SEQ ID NO: 27677 - protein, 11 aa, Borrelia burgdorferi B31
NFSSYSYAKSL

SEQ ID NO: 27678 - protein, 11 aa, Borrelia burgdorferi B31
FSSYSYAKSLE

SEQ ID NO: 27679 - protein, 11 aa, Borrelia burgdorferi B31
SSYSYAKSLEL

SEQ ID NO: 27680 - protein, 11 aa, Borrelia burgdorferi B31
SYSYAKSLELF

SEQ ID NO: 27681 - protein, 11 aa, Borrelia burgdorferi B31
YSYAKSLELFN

SEQ ID NO: 27682 - protein, 11 aa, Borrelia burgdorferi B31
SYAKSLELFNP

SEQ ID NO: 27683 - protein, 11 aa, Borrelia burgdorferi B31
YAKSLELFNPE

SEQ ID NO: 27684 - protein, 11 aa, Borrelia burgdorferi B31
AKSLELFNPEI

SEQ ID NO: 27685 - protein, 11 aa, Borrelia burgdorferi B31
KSLELFNPEIA

SEQ ID NO: 27686 - protein, 11 aa, Borrelia burgdorferi B31
SLELFNPEIAK

SEQ ID NO: 27687 - protein, 11 aa, Borrelia burgdorferi B31
LELFNPEIAKT

SEQ ID NO: 27688 - protein, 11 aa, Borrelia burgdorferi B31
ELFNPEIAKTL

SEQ ID NO: 27689 - protein, 11 aa, Borrelia burgdorferi B31
LFNPEIAKTLL

SEQ ID NO: 27690 - protein, 11 aa, Borrelia burgdorferi B31
FNPEIAKTLLA

SEQ ID NO: 27691 - protein, 11 aa, Borrelia burgdorferi B31
NPEIAKTLLAE

SEQ ID NO: 27692 - protein, 11 aa, Borrelia burgdorferi B31
PEIAKTLLAEA

SEQ ID NO: 27693 - protein, 11 aa, Borrelia burgdorferi B31
EIAKTLLAEAG

SEQ ID NO: 27694 - protein, 11 aa, Borrelia burgdorferi B31
IAKTLLAEAGY

SEQ ID NO: 27695 - protein, 11 aa, Borrelia burgdorferi B31
AKTLLAEAGYP

SEQ ID NO: 27696 - protein, 11 aa, Borrelia burgdorferi B31
KTLLAEAGYPN

SEQ ID NO: 27697 - protein, 11 aa, Borrelia burgdorferi B31
TLLAEAGYPNG

SEQ ID NO: 27698 - protein, 11 aa, Borrelia burgdorferi B31
LLAEAGYPNGN

SEQ ID NO: 27699 - protein, 11 aa, Borrelia burgdorferi B31
LAEAGYPNGNG

SEQ ID NO: 27700 - protein, 11 aa, Borrelia burgdorferi B31
AEAGYPNGNGF

SEQ ID NO: 27701 - protein, 11 aa, Borrelia burgdorferi B31
EAGYPNGNGFP

SEQ ID NO: 27702 - protein, 11 aa, Borrelia burgdorferi B31
AGYPNGNGFPI

SEQ ID NO: 27703 - protein, 11 aa, Borrelia burgdorferi B31
GYPNGNGFPIL

SEQ ID NO: 27704 - protein, 11 aa, Borrelia burgdorferi B31
YPNGNGFPILK

SEQ ID NO: 27705 - protein, 11 aa, Borrelia burgdorferi B31
PNGNGFPILKL

SEQ ID NO: 27706 - protein, 11 aa, Borrelia burgdorferi B31
NGNGFPILKLK

SEQ ID NO: 27707 - protein, 11 aa, Borrelia burgdorferi B31
GNGFPILKLKY

SEQ ID NO: 27708 - protein, 11 aa, Borrelia burgdorferi B31
NGFPILKLKYN

SEQ ID NO: 27709 - protein, 11 aa, Borrelia burgdorferi B31
GFPILKLKYNT

SEQ ID NO: 27710 - protein, 11 aa, Borrelia burgdorferi B31
FPILKLKYNTN

SEQ ID NO: 27711 - protein, 11 aa, Borrelia burgdorferi B31
PILKLKYNTNE

SEQ ID NO: 27712 - protein, 11 aa, Borrelia burgdorferi B31
ILKLKYNTNEA

SEQ ID NO: 27713 - protein, 11 aa, Borrelia burgdorferi B31
LKLKYNTNEAN

SEQ ID NO: 27714 - protein, 11 aa, Borrelia burgdorferi B31
KLKYNTNEANK

SEQ ID NO: 27715 - protein, 11 aa, Borrelia burgdorferi B31
LKYNTNEANKK

SEQ ID NO: 27716 - protein, 11 aa, Borrelia burgdorferi B31
KYNTNEANKKI

SEQ ID NO: 27717 - protein, 11 aa, Borrelia burgdorferi B31
YNTNEANKKIC

SEQ ID NO: 27718 - protein, 11 aa, Borrelia burgdorferi B31
NTNEANKKICE

SEQ ID NO: 27719 - protein, 11 aa, Borrelia burgdorferi B31
TNEANKKICEF

SEQ ID NO: 27720 - protein, 11 aa, Borrelia burgdorferi B31
NEANKKICEFI

SEQ ID NO: 27721 - protein, 11 aa, Borrelia burgdorferi B31
EANKKICEFIQ

SEQ ID NO: 27722 - protein, 11 aa, Borrelia burgdorferi B31
ANKKICEFIQN

SEQ ID NO: 27723 - protein, 11 aa, Borrelia burgdorferi B31
NKKICEFIQNQ

SEQ ID NO: 27724 - protein, 11 aa, Borrelia burgdorferi B31
KKICEFIQNQW

SEQ ID NO: 27725 - protein, 11 aa, Borrelia burgdorferi B31
KICEFIQNQWK

SEQ ID NO: 27726 - protein, 11 aa, Borrelia burgdorferi B31
ICEFIQNQWKK

SEQ ID NO: 27727 - protein, 11 aa, Borrelia burgdorferi B31
CEFIQNQWKKN

SEQ ID NO: 27728 - protein, 11 aa, Borrelia burgdorferi B31
EFIQNQWKKNL

SEQ ID NO: 27729 - protein, 11 aa, Borrelia burgdorferi B31
FIQNQWKKNLN

SEQ ID NO: 27730 - protein, 11 aa, Borrelia burgdorferi B31
IQNQWKKNLNI

SEQ ID NO: 27731 - protein, 11 aa, Borrelia burgdorferi B31
QNQWKKNLNID

SEQ ID NO: 27732 - protein, 11 aa, Borrelia burgdorferi B31
NQWKKNLNIDV

SEQ ID NO: 27733 - protein, 11 aa, Borrelia burgdorferi B31
QWKKNLNIDVE

SEQ ID NO: 27734 - protein, 11 aa, Borrelia burgdorferi B31
WKKNLNIDVEL

SEQ ID NO: 27735 - protein, 11 aa, Borrelia burgdorferi B31
KKNLNIDVELE

SEQ ID NO: 27736 - protein, 11 aa, Borrelia burgdorferi B31
KNLNIDVELEN

SEQ ID NO: 27737 - protein, 11 aa, Borrelia burgdorferi B31
NLNIDVELENE

SEQ ID NO: 27738 - protein, 11 aa, Borrelia burgdorferi B31
LNIDVELENEE

SEQ ID NO: 27739 - protein, 11 aa, Borrelia burgdorferi B31
NIDVELENEEW

SEQ ID NO: 27740 - protein, 11 aa, Borrelia burgdorferi B31
IDVELENEEWT

SEQ ID NO: 27741 - protein, 11 aa, Borrelia burgdorferi B31
DVELENEEWTT

SEQ ID NO: 27742 - protein, 11 aa, Borrelia burgdorferi B31
VELENEEWTTY

SEQ ID NO: 27743 - protein, 11 aa, Borrelia burgdorferi B31
ELENEEWTTYL

SEQ ID NO: 27744 - protein, 11 aa, Borrelia burgdorferi B31
LENEEWTTYLN

SEQ ID NO: 27745 - protein, 11 aa, Borrelia burgdorferi B31
ENEEWTTYLNT

SEQ ID NO: 27746 - protein, 11 aa, Borrelia burgdorferi B31
NEEWTTYLNTK

SEQ ID NO: 27747 - protein, 11 aa, Borrelia burgdorferi B31
EEWTTYLNTKA

SEQ ID NO: 27748 - protein, 11 aa, Borrelia burgdorferi B31
EWTTYLNTKAN

SEQ ID NO: 27749 - protein, 11 aa, Borrelia burgdorferi B31
WTTYLNTKANG

SEQ ID NO: 27750 - protein, 11 aa, Borrelia burgdorferi B31
TTYLNTKANGN

SEQ ID NO: 27751 - protein, 11 aa, Borrelia burgdorferi B31
TYLNTKANGNY

SEQ ID NO: 27752 - protein, 11 aa, Borrelia burgdorferi B31
YLNTKANGNYE

SEQ ID NO: 27753 - protein, 11 aa, Borrelia burgdorferi B31
LNTKANGNYEI

SEQ ID NO: 27754 - protein, 11 aa, Borrelia burgdorferi B31
NTKANGNYEIA

SEQ ID NO: 27755 - protein, 11 aa, Borrelia burgdorferi B31
TKANGNYEIAR

SEQ ID NO: 27756 - protein, 11 aa, Borrelia burgdorferi B31
KANGNYEIARA

SEQ ID NO: 27757 - protein, 11 aa, Borrelia burgdorferi B31
ANGNYEIARAG

SEQ ID NO: 27758 - protein, 11 aa, Borrelia burgdorferi B31
NGNYEIARAGW

SEQ ID NO: 27759 - protein, 11 aa, Borrelia burgdorferi B31
GNYEIARAGWI

SEQ ID NO: 27760 - protein, 11 aa, Borrelia burgdorferi B31
NYEIARAGWIG

SEQ ID NO: 27761 - protein, 11 aa, Borrelia burgdorferi B31
YEIARAGWIGD

SEQ ID NO: 27762 - protein, 11 aa, Borrelia burgdorferi B31
EIARAGWIGDY

SEQ ID NO: 27763 - protein, 11 aa, Borrelia burgdorferi B31
IARAGWIGDYA

SEQ ID NO: 27764 - protein, 11 aa, Borrelia burgdorferi B31
ARAGWIGDYAD

SEQ ID NO: 27765 - protein, 11 aa, Borrelia burgdorferi B31
RAGWIGDYADP

SEQ ID NO: 27766 - protein, 11 aa, Borrelia burgdorferi B31
AGWIGDYADPL

SEQ ID NO: 27767 - protein, 11 aa, Borrelia burgdorferi B31
GWIGDYADPLT

SEQ ID NO: 27768 - protein, 11 aa, Borrelia burgdorferi B31
WIGDYADPLTF

SEQ ID NO: 27769 - protein, 11 aa, Borrelia burgdorferi B31
IGDYADPLTFL

SEQ ID NO: 27770 - protein, 11 aa, Borrelia burgdorferi B31
GDYADPLTFLS

SEQ ID NO: 27771 - protein, 11 aa, Borrelia burgdorferi B31
DYADPLTFLSI

SEQ ID NO: 27772 - protein, 11 aa, Borrelia burgdorferi B31
YADPLTFLSIF

SEQ ID NO: 27773 - protein, 11 aa, Borrelia burgdorferi B31
ADPLTFLSIFT

SEQ ID NO: 27774 - protein, 11 aa, Borrelia burgdorferi B31
DPLTFLSIFTQ

SEQ ID NO: 27775 - protein, 11 aa, Borrelia burgdorferi B31
PLTFLSIFTQG

SEQ ID NO: 27776 - protein, 11 aa, Borrelia burgdorferi B31
LTFLSIFTQGY

SEQ ID NO: 27777 - protein, 11 aa, Borrelia burgdorferi B31
TFLSIFTQGYT

SEQ ID NO: 27778 - protein, 11 aa, Borrelia burgdorferi B31
FLSIFTQGYTQ

SEQ ID NO: 27779 - protein, 11 aa, Borrelia burgdorferi B31
LSIFTQGYTQF

SEQ ID NO: 27780 - protein, 11 aa, Borrelia burgdorferi B31
SIFTQGYTQFS

SEQ ID NO: 27781 - protein, 11 aa, Borrelia burgdorferi B31
IFTQGYTQFSS

SEQ ID NO: 27782 - protein, 11 aa, Borrelia burgdorferi B31
FTQGYTQFSSH

SEQ ID NO: 27783 - protein, 11 aa, Borrelia burgdorferi B31
TQGYTQFSSHN

SEQ ID NO: 27784 - protein, 11 aa, Borrelia burgdorferi B31
QGYTQFSSHNY

SEQ ID NO: 27785 - protein, 11 aa, Borrelia burgdorferi B31
GYTQFSSHNYS

SEQ ID NO: 27786 - protein, 11 aa, Borrelia burgdorferi B31
YTQFSSHNYSN

SEQ ID NO: 27787 - protein, 11 aa, Borrelia burgdorferi B31
TQFSSHNYSNP

SEQ ID NO: 27788 - protein, 11 aa, Borrelia burgdorferi B31
QFSSHNYSNPE

SEQ ID NO: 27789 - protein, 11 aa, Borrelia burgdorferi B31
FSSHNYSNPEY

SEQ ID NO: 27790 - protein, 11 aa, Borrelia burgdorferi B31
SSHNYSNPEYN

SEQ ID NO: 27791 - protein, 11 aa, Borrelia burgdorferi B31
SHNYSNPEYNE

SEQ ID NO: 27792 - protein, 11 aa, Borrelia burgdorferi B31
HNYSNPEYNEL

SEQ ID NO: 27793 - protein, 11 aa, Borrelia burgdorferi B31
NYSNPEYNELI

SEQ ID NO: 27794 - protein, 11 aa, Borrelia burgdorferi B31
YSNPEYNELIK

SEQ ID NO: 27795 - protein, 11 aa, Borrelia burgdorferi B31
SNPEYNELIKK

SEQ ID NO: 27796 - protein, 11 aa, Borrelia burgdorferi B31
NPEYNELIKKS

SEQ ID NO: 27797 - protein, 11 aa, Borrelia burgdorferi B31
PEYNELIKKSD

SEQ ID NO: 27798 - protein, 11 aa, Borrelia burgdorferi B31
EYNELIKKSDL

SEQ ID NO: 27799 - protein, 11 aa, Borrelia burgdorferi B31
YNELIKKSDLE

SEQ ID NO: 27800 - protein, 11 aa, Borrelia burgdorferi B31
NELIKKSDLEL

SEQ ID NO: 27801 - protein, 11 aa, Borrelia burgdorferi B31
ELIKKSDLELD

SEQ ID NO: 27802 - protein, 11 aa, Borrelia burgdorferi B31
LIKKSDLELDP

SEQ ID NO: 27803 - protein, 11 aa, Borrelia burgdorferi B31
IKKSDLELDPI

SEQ ID NO: 27804 - protein, 11 aa, Borrelia burgdorferi B31
KKSDLELDPIK

SEQ ID NO: 27805 - protein, 11 aa, Borrelia burgdorferi B31
KSDLELDPIKR

SEQ ID NO: 27806 - protein, 11 aa, Borrelia burgdorferi B31
SDLELDPIKRQ

SEQ ID NO: 27807 - protein, 11 aa, Borrelia burgdorferi B31
DLELDPIKRQD

SEQ ID NO: 27808 - protein, 11 aa, Borrelia burgdorferi B31
LELDPIKRQDI

SEQ ID NO: 27809 - protein, 11 aa, Borrelia burgdorferi B31
ELDPIKRQDIL

SEQ ID NO: 27810 - protein, 11 aa, Borrelia burgdorferi B31
LDPIKRQDILR

SEQ ID NO: 27811 - protein, 11 aa, Borrelia burgdorferi B31
DPIKRQDILRQ

SEQ ID NO: 27812 - protein, 11 aa, Borrelia burgdorferi B31
PIKRQDILRQA

SEQ ID NO: 27813 - protein, 11 aa, Borrelia burgdorferi B31
IKRQDILRQAE

SEQ ID NO: 27814 - protein, 11 aa, Borrelia burgdorferi B31
KRQDILRQAEE

SEQ ID NO: 27815 - protein, 11 aa, Borrelia burgdorferi B31
RQDILRQAEEI

SEQ ID NO: 27816 - protein, 11 aa, Borrelia burgdorferi B31
QDILRQAEEII

SEQ ID NO: 27817 - protein, 11 aa, Borrelia burgdorferi B31
DILRQAEEIII

SEQ ID NO: 27818 - protein, 11 aa, Borrelia burgdorferi B31
ILRQAEEIIIE

SEQ ID NO: 27819 - protein, 11 aa, Borrelia burgdorferi B31
LRQAEEIIIEK

SEQ ID NO: 27820 - protein, 11 aa, Borrelia burgdorferi B31
RQAEEIIIEKD

SEQ ID NO: 27821 - protein, 11 aa, Borrelia burgdorferi B31
QAEEIIIEKDF

SEQ ID NO: 27822 - protein, 11 aa, Borrelia burgdorferi B31
AEEIIIEKDFP

SEQ ID NO: 27823 - protein, 11 aa, Borrelia burgdorferi B31
EEIIIEKDFPI

SEQ ID NO: 27824 - protein, 11 aa, Borrelia burgdorferi B31
EIIIEKDFPIA

SEQ ID NO: 27825 - protein, 11 aa, Borrelia burgdorferi B31
IIIEKDFPIAP

SEQ ID NO: 27826 - protein, 11 aa, Borrelia burgdorferi B31
IIEKDFPIAPI

SEQ ID NO: 27827 - protein, 11 aa, Borrelia burgdorferi B31
IEKDFPIAPIY

SEQ ID NO: 27828 - protein, 11 aa, Borrelia burgdorferi B31
EKDFPIAPIYI

SEQ ID NO: 27829 - protein, 11 aa, Borrelia burgdorferi B31
KDFPIAPIYIY

SEQ ID NO: 27830 - protein, 11 aa, Borrelia burgdorferi B31
DFPIAPIYIYG

SEQ ID NO: 27831 - protein, 11 aa, Borrelia burgdorferi B31
FPIAPIYIYGN

SEQ ID NO: 27832 - protein, 11 aa, Borrelia burgdorferi B31
PIAPIYIYGNS

SEQ ID NO: 27833 - protein, 11 aa, Borrelia burgdorferi B31
IAPIYIYGNSY

SEQ ID NO: 27834 - protein, 11 aa, Borrelia burgdorferi B31
APIYIYGNSYL

SEQ ID NO: 27835 - protein, 11 aa, Borrelia burgdorferi B31
PIYIYGNSYLF

SEQ ID NO: 27836 - protein, 11 aa, Borrelia burgdorferi B31
IYIYGNSYLFR

SEQ ID NO: 27837 - protein, 11 aa, Borrelia burgdorferi B31
YIYGNSYLFRN

SEQ ID NO: 27838 - protein, 11 aa, Borrelia burgdorferi B31
IYGNSYLFRND

SEQ ID NO: 27839 - protein, 11 aa, Borrelia burgdorferi B31
YGNSYLFRNDK

SEQ ID NO: 27840 - protein, 11 aa, Borrelia burgdorferi B31
GNSYLFRNDKW

SEQ ID NO: 27841 - protein, 11 aa, Borrelia burgdorferi B31
NSYLFRNDKWT

SEQ ID NO: 27842 - protein, 11 aa, Borrelia burgdorferi B31
SYLFRNDKWTG

SEQ ID NO: 27843 - protein, 11 aa, Borrelia burgdorferi B31
YLFRNDKWTGW

SEQ ID NO: 27844 - protein, 11 aa, Borrelia burgdorferi B31
LFRNDKWTGWN

SEQ ID NO: 27845 - protein, 11 aa, Borrelia burgdorferi B31
FRNDKWTGWNT

SEQ ID NO: 27846 - protein, 11 aa, Borrelia burgdorferi B31
RNDKWTGWNTN

SEQ ID NO: 27847 - protein, 11 aa, Borrelia burgdorferi B31
NDKWTGWNTNI

SEQ ID NO: 27848 - protein, 11 aa, Borrelia burgdorferi B31
DKWTGWNTNIL

SEQ ID NO: 27849 - protein, 11 aa, Borrelia burgdorferi B31
KWTGWNTNILE

SEQ ID NO: 27850 - protein, 11 aa, Borrelia burgdorferi B31
WTGWNTNILER

SEQ ID NO: 27851 - protein, 11 aa, Borrelia burgdorferi B31
TGWNTNILERF

SEQ ID NO: 27852 - protein, 11 aa, Borrelia burgdorferi B31
GWNTNILERFD

SEQ ID NO: 27853 - protein, 11 aa, Borrelia burgdorferi B31
WNTNILERFDL

SEQ ID NO: 27854 - protein, 11 aa, Borrelia burgdorferi B31
NTNILERFDLS

SEQ ID NO: 27855 - protein, 11 aa, Borrelia burgdorferi B31
TNILERFDLSQ

SEQ ID NO: 27856 - protein, 11 aa, Borrelia burgdorferi B31
NILERFDLSQL

SEQ ID NO: 27857 - protein, 11 aa, Borrelia burgdorferi B31
ILERFDLSQLK

SEQ ID NO: 27858 - protein, 11 aa, Borrelia burgdorferi B31
LERFDLSQLKL

SEQ ID NO: 27859 - protein, 11 aa, Borrelia burgdorferi B31
ERFDLSQLKLK

SEQ ID NO: 27860 - protein, 11 aa, Borrelia burgdorferi B31
RFDLSQLKLKN

SEQ ID NO: 27861 - protein, 11 aa, Borrelia burgdorferi B31
FDLSQLKLKNK

SEQ ID NO: 27862 - protein, 8 aa, Borrelia
MTKIFSNL

SEQ ID NO: 27863 - protein, 8 aa, Borrelia
TKIFSNLI

SEQ ID NO: 27864 - protein, 8 aa, Borrelia
KIFSNLII

SEQ ID NO: 27865 - protein, 8 aa, Borrelia
IFSNLIIN

SEQ ID NO: 27866 - protein, 8 aa, Borrelia
FSNLIING

SEQ ID NO: 27867 - protein, 8 aa, Borrelia
SNLIINGL

SEQ ID NO: 27868 - protein, 8 aa, Borrelia
NLIINGLL

SEQ ID NO: 27869 - protein, 8 aa, Borrelia
LIINGLLF

SEQ ID NO: 27870 - protein, 8 aa, Borrelia
IINGLLFG

SEQ ID NO: 27871 - protein, 8 aa, Borrelia
INGLLFGF

SEQ ID NO: 27872 - protein, 8 aa, Borrelia
NGLLFGFV

SEQ ID NO: 27873 - protein, 8 aa, Borrelia
GLLFGFVS

SEQ ID NO: 27874 - protein, 8 aa, Borrelia
LLFGFVSL

SEQ ID NO: 27875 - protein, 8 aa, Borrelia
LFGFVSLN

SEQ ID NO: 27876 - protein, 8 aa, Borrelia
FGFVSLNV

SEQ ID NO: 27877 - protein, 8 aa, Borrelia
GFVSLNVF

SEQ ID NO: 27878 - protein, 8 aa, Borrelia
FVSLNVFA

SEQ ID NO: 27879 - protein, 8 aa, Borrelia
VSLNVFAD

SEQ ID NO: 27880 - protein, 8 aa, Borrelia
SLNVFADS

SEQ ID NO: 27881 - protein, 8 aa, Borrelia
LNVFADSN

SEQ ID NO: 27882 - protein, 8 aa, Borrelia
NVFADSNN

SEQ ID NO: 27883 - protein, 8 aa, Borrelia
VFADSNNA

SEQ ID NO: 27884 - protein, 8 aa, Borrelia
FADSNNAN

SEQ ID NO: 27885 - protein, 8 aa, Borrelia
ADSNNANI

SEQ ID NO: 27886 - protein, 8 aa, Borrelia
DSNNANIL

SEQ ID NO: 27887 - protein, 8 aa, Borrelia
SNNANILK

SEQ ID NO: 27888 - protein, 8 aa, Borrelia
NNANILKP

SEQ ID NO: 27889 - protein, 8 aa, Borrelia
NANILKPQ

SEQ ID NO: 27890 - protein, 8 aa, Borrelia
ANILKPQS

SEQ ID NO: 27891 - protein, 8 aa, Borrelia
NILKPQSN

SEQ ID NO: 27892 - protein, 8 aa, Borrelia
ILKPQSNV

SEQ ID NO: 27893 - protein, 8 aa, Borrelia
LKPQSNVL

SEQ ID NO: 27894 - protein, 8 aa, Borrelia
KPQSNVLE

SEQ ID NO: 27895 - protein, 8 aa, Borrelia
PQSNVLEH

SEQ ID NO: 27896 - protein, 8 aa, Borrelia
QSNVLEHS

SEQ ID NO: 27897 - protein, 8 aa, Borrelia
SNVLEHSD

SEQ ID NO: 27898 - protein, 8 aa, Borrelia
NVLEHSDQ

SEQ ID NO: 27899 - protein, 8 aa, Borrelia
VLEHSDQK

SEQ ID NO: 27900 - protein, 8 aa, Borrelia
LEHSDQKD

SEQ ID NO: 27901 - protein, 8 aa, Borrelia
EHSDQKDN

SEQ ID NO: 27902 - protein, 8 aa, Borrelia
HSDQKDNK

SEQ ID NO: 27903 - protein, 8 aa, Borrelia
SDQKDNKK

SEQ ID NO: 27904 - protein, 8 aa, Borrelia
DQKDNKKL

SEQ ID NO: 27905 - protein, 8 aa, Borrelia
QKDNKKLD

SEQ ID NO: 27906 - protein, 8 aa, Borrelia
KDNKKLDQ

SEQ ID NO: 27907 - protein, 8 aa, Borrelia
DNKKLDQK

SEQ ID NO: 27908 - protein, 8 aa, Borrelia
NKKLDQKD

SEQ ID NO: 27909 - protein, 8 aa, Borrelia
KKLDQKDQ

SEQ ID NO: 27910 - protein, 8 aa, Borrelia
KLDQKDQV

SEQ ID NO: 27911 - protein, 8 aa, Borrelia
LDQKDQVN

SEQ ID NO: 27912 - protein, 8 aa, Borrelia
DQKDQVNQ

SEQ ID NO: 27913 - protein, 8 aa, Borrelia
QKDQVNQA

SEQ ID NO: 27914 - protein, 8 aa, Borrelia
KDQVNQAL

SEQ ID NO: 27915 - protein, 8 aa, Borrelia
DQVNQALD

SEQ ID NO: 27916 - protein, 8 aa, Borrelia
QVNQALDT

SEQ ID NO: 27917 - protein, 8 aa, Borrelia
VNQALDTI

SEQ ID NO: 27918 - protein, 8 aa, Borrelia
NQALDTIN

SEQ ID NO: 27919 - protein, 8 aa, Borrelia
QALDTINK

SEQ ID NO: 27920 - protein, 8 aa, Borrelia
ALDTINKV

SEQ ID NO: 27921 - protein, 8 aa, Borrelia
LDTINKVT

SEQ ID NO: 27922 - protein, 8 aa, Borrelia
DTINKVTE

SEQ ID NO: 27923 - protein, 8 aa, Borrelia
TINKVTED

SEQ ID NO: 27924 - protein, 8 aa, Borrelia
INKVTEDV

SEQ ID NO: 27925 - protein, 8 aa, Borrelia
NKVTEDVS

SEQ ID NO: 27926 - protein, 8 aa, Borrelia
KVTEDVSS

SEQ ID NO: 27927 - protein, 8 aa, Borrelia
VTEDVSSK

SEQ ID NO: 27928 - protein, 8 aa, Borrelia
TEDVSSKL

SEQ ID NO: 27929 - protein, 8 aa, Borrelia
EDVSSKLE

SEQ ID NO: 27930 - protein, 8 aa, Borrelia
DVSSKLEG

SEQ ID NO: 27931 - protein, 8 aa, Borrelia
VSSKLEGV

SEQ ID NO: 27932 - protein, 8 aa, Borrelia
SSKLEGVR

SEQ ID NO: 27933 - protein, 8 aa, Borrelia
SKLEGVRE

SEQ ID NO: 27934 - protein, 8 aa, Borrelia
KLEGVRES

SEQ ID NO: 27935 - protein, 8 aa, Borrelia
LEGVRESS

SEQ ID NO: 27936 - protein, 8 aa, Borrelia
EGVRESSL

SEQ ID NO: 27937 - protein, 8 aa, Borrelia
GVRESSLE

SEQ ID NO: 27938 - protein, 8 aa, Borrelia
VRESSLEL

SEQ ID NO: 27939 - protein, 8 aa, Borrelia
RESSLELV

SEQ ID NO: 27940 - protein, 8 aa, Borrelia
ESSLELVE

SEQ ID NO: 27941 - protein, 8 aa, Borrelia
SSLELVES

SEQ ID NO: 27942 - protein, 8 aa, Borrelia
SLELVESN

SEQ ID NO: 27943 - protein, 8 aa, Borrelia
LELVESND

SEQ ID NO: 27944 - protein, 8 aa, Borrelia
ELVESNDA

SEQ ID NO: 27945 - protein, 8 aa, Borrelia
LVESNDAG

SEQ ID NO: 27946 - protein, 8 aa, Borrelia
VESNDAGV

SEQ ID NO: 27947 - protein, 8 aa, Borrelia
ESNDAGVV

SEQ ID NO: 27948 - protein, 8 aa, Borrelia
SNDAGVVK

SEQ ID NO: 27949 - protein, 8 aa, Borrelia
NDAGVVKK

SEQ ID NO: 27950 - protein, 8 aa, Borrelia
DAGVVKKF

SEQ ID NO: 27951 - protein, 8 aa, Borrelia
AGVVKKFV

SEQ ID NO: 27952 - protein, 8 aa, Borrelia
GVVKKFVG

SEQ ID NO: 27953 - protein, 8 aa, Borrelia
VVKKFVGS

SEQ ID NO: 27954 - protein, 8 aa, Borrelia
VKKFVGSM

SEQ ID NO: 27955 - protein, 8 aa, Borrelia
KKFVGSMS

SEQ ID NO: 27956 - protein, 8 aa, Borrelia
KFVGSMSL

SEQ ID NO: 27957 - protein, 8 aa, Borrelia
FVGSMSLM

SEQ ID NO: 27958 - protein, 8 aa, Borrelia
VGSMSLMS

SEQ ID NO: 27959 - protein, 8 aa, Borrelia
GSMSLMSD

SEQ ID NO: 27960 - protein, 8 aa, Borrelia
SMSLMSDV

SEQ ID NO: 27961 - protein, 8 aa, Borrelia
MSLMSDVA

SEQ ID NO: 27962 - protein, 8 aa, Borrelia
SLMSDVAK

SEQ ID NO: 27963 - protein, 8 aa, Borrelia
LMSDVAKG

SEQ ID NO: 27964 - protein, 8 aa, Borrelia
MSDVAKGT

SEQ ID NO: 27965 - protein, 8 aa, Borrelia
SDVAKGTV

SEQ ID NO: 27966 - protein, 8 aa, Borrelia
DVAKGTVV

SEQ ID NO: 27967 - protein, 8 aa, Borrelia
VAKGTVVA

SEQ ID NO: 27968 - protein, 8 aa, Borrelia
AKGTVVAS

SEQ ID NO: 27969 - protein, 8 aa, Borrelia
KGTVVASQ

SEQ ID NO: 27970 - protein, 8 aa, Borrelia
GTVVASQE

SEQ ID NO: 27971 - protein, 8 aa, Borrelia
TVVASQEA

SEQ ID NO: 27972 - protein, 8 aa, Borrelia
VVASQEAT

SEQ ID NO: 27973 - protein, 8 aa, Borrelia
VASQEATI

SEQ ID NO: 27974 - protein, 8 aa, Borrelia
ASQEATIV

SEQ ID NO: 27975 - protein, 8 aa, Borrelia
SQEATIVA

SEQ ID NO: 27976 - protein, 8 aa, Borrelia
QEATIVAK

SEQ ID NO: 27977 - protein, 8 aa, Borrelia
EATIVAKC

SEQ ID NO: 27978 - protein, 8 aa, Borrelia
ATIVAKCS

SEQ ID NO: 27979 - protein, 8 aa, Borrelia
TIVAKCSG

SEQ ID NO: 27980 - protein, 8 aa, Borrelia
IVAKCSGM

SEQ ID NO: 27981 - protein, 8 aa, Borrelia
VAKCSGMV

SEQ ID NO: 27982 - protein, 8 aa, Borrelia
AKCSGMVA

SEQ ID NO: 27983 - protein, 8 aa, Borrelia
KCSGMVAE

SEQ ID NO: 27984 - protein, 8 aa, Borrelia
CSGMVAEG

SEQ ID NO: 27985 - protein, 8 aa, Borrelia
SGMVAEGA

SEQ ID NO: 27986 - protein, 8 aa, Borrelia
GMVAEGAN

SEQ ID NO: 27987 - protein, 8 aa, Borrelia
MVAEGANK

SEQ ID NO: 27988 - protein, 8 aa, Borrelia
VAEGANKV

SEQ ID NO: 27989 - protein, 8 aa, Borrelia
AEGANKVV

SEQ ID NO: 27990 - protein, 8 aa, Borrelia
EGANKVVE

SEQ ID NO: 27991 - protein, 8 aa, Borrelia
GANKVVEM

SEQ ID NO: 27992 - protein, 8 aa, Borrelia
ANKVVEMS

SEQ ID NO: 27993 - protein, 8 aa, Borrelia
NKVVEMSK

SEQ ID NO: 27994 - protein, 8 aa, Borrelia
KVVEMSKK

SEQ ID NO: 27995 - protein, 8 aa, Borrelia
VVEMSKKA

SEQ ID NO: 27996 - protein, 8 aa, Borrelia
VEMSKKAV

SEQ ID NO: 27997 - protein, 8 aa, Borrelia
EMSKKAVQ

SEQ ID NO: 27998 - protein, 8 aa, Borrelia
MSKKAVQE

SEQ ID NO: 27999 - protein, 8 aa, Borrelia
SKKAVQET

SEQ ID NO: 28000 - protein, 8 aa, Borrelia
KKAVQETQ

SEQ ID NO: 28001 - protein, 8 aa, Borrelia
KAVQETQK

SEQ ID NO: 28002 - protein, 8 aa, Borrelia
AVQETQKA

SEQ ID NO: 28003 - protein, 8 aa, Borrelia
VQETQKAV

SEQ ID NO: 28004 - protein, 8 aa, Borrelia
QETQKAVS

SEQ ID NO: 28005 - protein, 8 aa, Borrelia
ETQKAVSV

SEQ ID NO: 28006 - protein, 8 aa, Borrelia
TQKAVSVA

SEQ ID NO: 28007 - protein, 8 aa, Borrelia
QKAVSVAG

SEQ ID NO: 28008 - protein, 8 aa, Borrelia
KAVSVAGE

SEQ ID NO: 28009 - protein, 8 aa, Borrelia
AVSVAGEA

SEQ ID NO: 28010 - protein, 8 aa, Borrelia
VSVAGEAT

SEQ ID NO: 28011 - protein, 8 aa, Borrelia
SVAGEATF

SEQ ID NO: 28012 - protein, 8 aa, Borrelia
VAGEATFL

SEQ ID NO: 28013 - protein, 8 aa, Borrelia
AGEATFLI

SEQ ID NO: 28014 - protein, 8 aa, Borrelia
GEATFLIE

SEQ ID NO: 28015 - protein, 8 aa, Borrelia
EATFLIEK

SEQ ID NO: 28016 - protein, 8 aa, Borrelia
ATFLIEKQ

SEQ ID NO: 28017 - protein, 8 aa, Borrelia
TFLIEKQI

SEQ ID NO: 28018 - protein, 8 aa, Borrelia
FLIEKQIM

SEQ ID NO: 28019 - protein, 8 aa, Borrelia
LIEKQIML

SEQ ID NO: 28020 - protein, 8 aa, Borrelia
IEKQIMLN

SEQ ID NO: 28021 - protein, 8 aa, Borrelia
EKQIMLNK

SEQ ID NO: 28022 - protein, 8 aa, Borrelia
KQIMLNKS

SEQ ID NO: 28023 - protein, 8 aa, Borrelia
QIMLNKSP

SEQ ID NO: 28024 - protein, 8 aa, Borrelia
IMLNKSPN

SEQ ID NO: 28025 - protein, 8 aa, Borrelia
MLNKSPNN

SEQ ID NO: 28026 - protein, 8 aa, Borrelia
LNKSPNNK

SEQ ID NO: 28027 - protein, 8 aa, Borrelia
NKSPNNKE

SEQ ID NO: 28028 - protein, 8 aa, Borrelia
KSPNNKEL

SEQ ID NO: 28029 - protein, 8 aa, Borrelia
SPNNKELE

SEQ ID NO: 28030 - protein, 8 aa, Borrelia
PNNKELEL

SEQ ID NO: 28031 - protein, 8 aa, Borrelia
NNKELELT

SEQ ID NO: 28032 - protein, 8 aa, Borrelia
NKELELTK

SEQ ID NO: 28033 - protein, 8 aa, Borrelia
KELELTKE

SEQ ID NO: 28034 - protein, 8 aa, Borrelia
ELELTKEE

SEQ ID NO: 28035 - protein, 8 aa, Borrelia
LELTKEEF

SEQ ID NO: 28036 - protein, 8 aa, Borrelia
ELTKEEFA

SEQ ID NO: 28037 - protein, 8 aa, Borrelia
LTKEEFAK

SEQ ID NO: 28038 - protein, 8 aa, Borrelia
TKEEFAKV

SEQ ID NO: 28039 - protein, 8 aa, Borrelia
KEEFAKVD

SEQ ID NO: 28040 - protein, 8 aa, Borrelia
EEFAKVDE

SEQ ID NO: 28041 - protein, 8 aa, Borrelia
EFAKVDEV

SEQ ID NO: 28042 - protein, 8 aa, Borrelia
FAKVDEVK

SEQ ID NO: 28043 - protein, 8 aa, Borrelia
AKVDEVKE

SEQ ID NO: 28044 - protein, 8 aa, Borrelia
KVDEVKET

SEQ ID NO: 28045 - protein, 8 aa, Borrelia
VDEVKETL

SEQ ID NO: 28046 - protein, 8 aa, Borrelia
DEVKETLM

SEQ ID NO: 28047 - protein, 8 aa, Borrelia
EVKETLMA

SEQ ID NO: 28048 - protein, 8 aa, Borrelia
VKETLMAS

SEQ ID NO: 28049 - protein, 8 aa, Borrelia
KETLMASE

SEQ ID NO: 28050 - protein, 8 aa, Borrelia
ETLMASER

SEQ ID NO: 28051 - protein, 8 aa, Borrelia
TLMASERA

SEQ ID NO: 28052 - protein, 8 aa, Borrelia
LMASERAL

SEQ ID NO: 28053 - protein, 8 aa, Borrelia
MASERALD

SEQ ID NO: 28054 - protein, 8 aa, Borrelia
ASERALDE

SEQ ID NO: 28055 - protein, 8 aa, Borrelia
SERALDET

SEQ ID NO: 28056 - protein, 8 aa, Borrelia
ERALDETV

SEQ ID NO: 28057 - protein, 8 aa, Borrelia
RALDETVQ

SEQ ID NO: 28058 - protein, 8 aa, Borrelia
ALDETVQE

SEQ ID NO: 28059 - protein, 8 aa, Borrelia
LDETVQEA

SEQ ID NO: 28060 - protein, 8 aa, Borrelia
DETVQEAQ

SEQ ID NO: 28061 - protein, 8 aa, Borrelia
ETVQEAQK

SEQ ID NO: 28062 - protein, 8 aa, Borrelia
TVQEAQKV

SEQ ID NO: 28063 - protein, 8 aa, Borrelia
VQEAQKVL

SEQ ID NO: 28064 - protein, 8 aa, Borrelia
QEAQKVLN

SEQ ID NO: 28065 - protein, 8 aa, Borrelia
EAQKVLNM

SEQ ID NO: 28066 - protein, 8 aa, Borrelia
AQKVLNMV

SEQ ID NO: 28067 - protein, 8 aa, Borrelia
QKVLNMVN

SEQ ID NO: 28068 - protein, 8 aa, Borrelia
KVLNMVNG

SEQ ID NO: 28069 - protein, 8 aa, Borrelia
VLNMVNGL

SEQ ID NO: 28070 - protein, 8 aa, Borrelia
LNMVNGLN

SEQ ID NO: 28071 - protein, 8 aa, Borrelia
NMVNGLNP

SEQ ID NO: 28072 - protein, 8 aa, Borrelia
MVNGLNPS

SEQ ID NO: 28073 - protein, 8 aa, Borrelia
VNGLNPSN

SEQ ID NO: 28074 - protein, 8 aa, Borrelia
NGLNPSNK

SEQ ID NO: 28075 - protein, 8 aa, Borrelia
GLNPSNKD

SEQ ID NO: 28076 - protein, 8 aa, Borrelia
LNPSNKDQ

SEQ ID NO: 28077 - protein, 8 aa, Borrelia
NPSNKDQV

SEQ ID NO: 28078 - protein, 8 aa, Borrelia
PSNKDQVL

SEQ ID NO: 28079 - protein, 8 aa, Borrelia
SNKDQVLA

SEQ ID NO: 28080 - protein, 8 aa, Borrelia
NKDQVLAK

SEQ ID NO: 28081 - protein, 8 aa, Borrelia
KDQVLAKK

SEQ ID NO: 28082 - protein, 8 aa, Borrelia
DQVLAKKD

SEQ ID NO: 28083 - protein, 8 aa, Borrelia
QVLAKKDV

SEQ ID NO: 28084 - protein, 8 aa, Borrelia
VLAKKDVR

SEQ ID NO: 28085 - protein, 8 aa, Borrelia
LAKKDVRK

SEQ ID NO: 28086 - protein, 8 aa, Borrelia
AKKDVRKA

SEQ ID NO: 28087 - protein, 8 aa, Borrelia
KKDVRKAI

SEQ ID NO: 28088 - protein, 8 aa, Borrelia
KDVRKAIS

SEQ ID NO: 28089 - protein, 8 aa, Borrelia
DVRKAISN

SEQ ID NO: 28090 - protein, 8 aa, Borrelia
VRKAISNV

SEQ ID NO: 28091 - protein, 8 aa, Borrelia
RKAISNVV

SEQ ID NO: 28092 - protein, 8 aa, Borrelia
KAISNVVK

SEQ ID NO: 28093 - protein, 8 aa, Borrelia
AISNVVKV

SEQ ID NO: 28094 - protein, 8 aa, Borrelia
ISNVVKVA

SEQ ID NO: 28095 - protein, 8 aa, Borrelia
SNVVKVAQ

SEQ ID NO: 28096 - protein, 8 aa, Borrelia
NVVKVAQG

SEQ ID NO: 28097 - protein, 8 aa, Borrelia
VVKVAQGA

SEQ ID NO: 28098 - protein, 8 aa, Borrelia
VKVAQGAR

SEQ ID NO: 28099 - protein, 8 aa, Borrelia
KVAQGARD

SEQ ID NO: 28100 - protein, 8 aa, Borrelia
VAQGARDL

SEQ ID NO: 28101 - protein, 8 aa, Borrelia
AQGARDLT

SEQ ID NO: 28102 - protein, 8 aa, Borrelia
QGARDLTK

SEQ ID NO: 28103 - protein, 8 aa, Borrelia
GARDLTKV

SEQ ID NO: 28104 - protein, 8 aa, Borrelia
ARDLTKVM

SEQ ID NO: 28105 - protein, 8 aa, Borrelia
RDLTKVMA

SEQ ID NO: 28106 - protein, 8 aa, Borrelia
DLTKVMAI

SEQ ID NO: 28107 - protein, 8 aa, Borrelia
LTKVMAIS

SEQ ID NO: 28108 - protein, 8 aa, Borrelia
TKVMAISL

SEQ ID NO: 28109 - protein, 8 aa, Borrelia
KVMAISLY

SEQ ID NO: 28110 - protein, 8 aa, Borrelia
VMAISLYM

SEQ ID NO: 28111 - protein, 8 aa, Borrelia
MAISLYMR

SEQ ID NO: 28112 - protein, 9 aa, Borrelia
MTKIFSNLI

SEQ ID NO: 28113 - protein, 9 aa, Borrelia
TKIFSNLII

SEQ ID NO: 28114 - protein, 9 aa, Borrelia
KIFSNLIIN

SEQ ID NO: 28115 - protein, 9 aa, Borrelia
IFSNLIING

SEQ ID NO: 28116 - protein, 9 aa, Borrelia
FSNLIINGL

SEQ ID NO: 28117 - protein, 9 aa, Borrelia
SNLIINGLL

SEQ ID NO: 28118 - protein, 9 aa, Borrelia
NLIINGLLF

SEQ ID NO: 28119 - protein, 9 aa, Borrelia
LIINGLLFG

SEQ ID NO: 28120 - protein, 9 aa, Borrelia
IINGLLFGF

SEQ ID NO: 28121 - protein, 9 aa, Borrelia
INGLLFGFV

SEQ ID NO: 28122 - protein, 9 aa, Borrelia
NGLLFGFVS

SEQ ID NO: 28123 - protein, 9 aa, Borrelia
GLLFGFVSL

SEQ ID NO: 28124 - protein, 9 aa, Borrelia
LLFGFVSLN

SEQ ID NO: 28125 - protein, 9 aa, Borrelia
LFGFVSLNV

SEQ ID NO: 28126 - protein, 9 aa, Borrelia
FGFVSLNVF

SEQ ID NO: 28127 - protein, 9 aa, Borrelia
GFVSLNVFA

SEQ ID NO: 28128 - protein, 9 aa, Borrelia
FVSLNVFAD

SEQ ID NO: 28129 - protein, 9 aa, Borrelia
VSLNVFADS

SEQ ID NO: 28130 - protein, 9 aa, Borrelia
SLNVFADSN

SEQ ID NO: 28131 - protein, 9 aa, Borrelia
LNVFADSNN

SEQ ID NO: 28132 - protein, 9 aa, Borrelia
NVFADSNNA

SEQ ID NO: 28133 - protein, 9 aa, Borrelia
VFADSNNAN

SEQ ID NO: 28134 - protein, 9 aa, Borrelia
FADSNNANI

SEQ ID NO: 28135 - protein, 9 aa, Borrelia
ADSNNANIL

SEQ ID NO: 28136 - protein, 9 aa, Borrelia
DSNNANILK

SEQ ID NO: 28137 - protein, 9 aa, Borrelia
SNNANILKP

SEQ ID NO: 28138 - protein, 9 aa, Borrelia
NNANILKPQ

SEQ ID NO: 28139 - protein, 9 aa, Borrelia
NANILKPQS

SEQ ID NO: 28140 - protein, 9 aa, Borrelia
ANILKPQSN

SEQ ID NO: 28141 - protein, 9 aa, Borrelia
NILKPQSNV

SEQ ID NO: 28142 - protein, 9 aa, Borrelia
ILKPQSNVL

SEQ ID NO: 28143 - protein, 9 aa, Borrelia
LKPQSNVLE

SEQ ID NO: 28144 - protein, 9 aa, Borrelia
KPQSNVLEH

SEQ ID NO: 28145 - protein, 9 aa, Borrelia
PQSNVLEHS

SEQ ID NO: 28146 - protein, 9 aa, Borrelia
QSNVLEHSD

SEQ ID NO: 28147 - protein, 9 aa, Borrelia
SNVLEHSDQ

SEQ ID NO: 28148 - protein, 9 aa, Borrelia
NVLEHSDQK

SEQ ID NO: 28149 - protein, 9 aa, Borrelia
VLEHSDQKD

SEQ ID NO: 28150 - protein, 9 aa, Borrelia
LEHSDQKDN

SEQ ID NO: 28151 - protein, 9 aa, Borrelia
EHSDQKDNK

SEQ ID NO: 28152 - protein, 9 aa, Borrelia
HSDQKDNKK

SEQ ID NO: 28153 - protein, 9 aa, Borrelia
SDQKDNKKL

SEQ ID NO: 28154 - protein, 9 aa, Borrelia
DQKDNKKLD

SEQ ID NO: 28155 - protein, 9 aa, Borrelia
QKDNKKLDQ

SEQ ID NO: 28156 - protein, 9 aa, Borrelia
KDNKKLDQK

SEQ ID NO: 28157 - protein, 9 aa, Borrelia
DNKKLDQKD

SEQ ID NO: 28158 - protein, 9 aa, Borrelia
NKKLDQKDQ

SEQ ID NO: 28159 - protein, 9 aa, Borrelia
KKLDQKDQV

SEQ ID NO: 28160 - protein, 9 aa, Borrelia
KLDQKDQVN

SEQ ID NO: 28161 - protein, 9 aa, Borrelia
LDQKDQVNQ

SEQ ID NO: 28162 - protein, 9 aa, Borrelia
DQKDQVNQA

SEQ ID NO: 28163 - protein, 9 aa, Borrelia
QKDQVNQAL

SEQ ID NO: 28164 - protein, 9 aa, Borrelia
KDQVNQALD

SEQ ID NO: 28165 - protein, 9 aa, Borrelia
DQVNQALDT

SEQ ID NO: 28166 - protein, 9 aa, Borrelia
QVNQALDTI

SEQ ID NO: 28167 - protein, 9 aa, Borrelia
VNQALDTIN

SEQ ID NO: 28168 - protein, 9 aa, Borrelia
NQALDTINK

SEQ ID NO: 28169 - protein, 9 aa, Borrelia
QALDTINKV

SEQ ID NO: 28170 - protein, 9 aa, Borrelia
ALDTINKVT

SEQ ID NO: 28171 - protein, 9 aa, Borrelia
LDTINKVTE

SEQ ID NO: 28172 - protein, 9 aa, Borrelia
DTINKVTED

SEQ ID NO: 28173 - protein, 9 aa, Borrelia
TINKVTEDV

SEQ ID NO: 28174 - protein, 9 aa, Borrelia
INKVTEDVS

SEQ ID NO: 28175 - protein, 9 aa, Borrelia
NKVTEDVSS

SEQ ID NO: 28176 - protein, 9 aa, Borrelia
KVTEDVSSK

SEQ ID NO: 28177 - protein, 9 aa, Borrelia
VTEDVSSKL

SEQ ID NO: 28178 - protein, 9 aa, Borrelia
TEDVSSKLE

SEQ ID NO: 28179 - protein, 9 aa, Borrelia
EDVSSKLEG

SEQ ID NO: 28180 - protein, 9 aa, Borrelia
DVSSKLEGV

SEQ ID NO: 28181 - protein, 9 aa, Borrelia
VSSKLEGVR

SEQ ID NO: 28182 - protein, 9 aa, Borrelia
SSKLEGVRE

SEQ ID NO: 28183 - protein, 9 aa, Borrelia
SKLEGVRES

SEQ ID NO: 28184 - protein, 9 aa, Borrelia
KLEGVRESS

SEQ ID NO: 28185 - protein, 9 aa, Borrelia
LEGVRESSL

SEQ ID NO: 28186 - protein, 9 aa, Borrelia
EGVRESSLE

SEQ ID NO: 28187 - protein, 9 aa, Borrelia
GVRESSLEL

SEQ ID NO: 28188 - protein, 9 aa, Borrelia
VRESSLELV

SEQ ID NO: 28189 - protein, 9 aa, Borrelia
RESSLELVE

SEQ ID NO: 28190 - protein, 9 aa, Borrelia
ESSLELVES

SEQ ID NO: 28191 - protein, 9 aa, Borrelia
SSLELVESN

SEQ ID NO: 28192 - protein, 9 aa, Borrelia
SLELVESND

SEQ ID NO: 28193 - protein, 9 aa, Borrelia
LELVESNDA

SEQ ID NO: 28194 - protein, 9 aa, Borrelia
ELVESNDAG

SEQ ID NO: 28195 - protein, 9 aa, Borrelia
LVESNDAGV

SEQ ID NO: 28196 - protein, 9 aa, Borrelia
VESNDAGVV

SEQ ID NO: 28197 - protein, 9 aa, Borrelia
ESNDAGVVK

SEQ ID NO: 28198 - protein, 9 aa, Borrelia
SNDAGVVKK

SEQ ID NO: 28199 - protein, 9 aa, Borrelia
NDAGVVKKF

SEQ ID NO: 28200 - protein, 9 aa, Borrelia
DAGVVKKFV

SEQ ID NO: 28201 - protein, 9 aa, Borrelia
AGVVKKFVG

SEQ ID NO: 28202 - protein, 9 aa, Borrelia
GVVKKFVGS

SEQ ID NO: 28203 - protein, 9 aa, Borrelia
VVKKFVGSM

SEQ ID NO: 28204 - protein, 9 aa, Borrelia
VKKFVGSMS

SEQ ID NO: 28205 - protein, 9 aa, Borrelia
KKFVGSMSL

SEQ ID NO: 28206 - protein, 9 aa, Borrelia
KFVGSMSLM

SEQ ID NO: 28207 - protein, 9 aa, Borrelia
FVGSMSLMS

SEQ ID NO: 28208 - protein, 9 aa, Borrelia
VGSMSLMSD

SEQ ID NO: 28209 - protein, 9 aa, Borrelia
GSMSLMSDV

SEQ ID NO: 28210 - protein, 9 aa, Borrelia
SMSLMSDVA

SEQ ID NO: 28211 - protein, 9 aa, Borrelia
MSLMSDVAK

SEQ ID NO: 28212 - protein, 9 aa, Borrelia
SLMSDVAKG

SEQ ID NO: 28213 - protein, 9 aa, Borrelia
LMSDVAKGT

SEQ ID NO: 28214 - protein, 9 aa, Borrelia
MSDVAKGTV

SEQ ID NO: 28215 - protein, 9 aa, Borrelia
SDVAKGTVV

SEQ ID NO: 28216 - protein, 9 aa, Borrelia
DVAKGTVVA

SEQ ID NO: 28217 - protein, 9 aa, Borrelia
VAKGTVVAS

SEQ ID NO: 28218 - protein, 9 aa, Borrelia
AKGTVVASQ

SEQ ID NO: 28219 - protein, 9 aa, Borrelia
KGTVVASQE

SEQ ID NO: 28220 - protein, 9 aa, Borrelia
GTVVASQEA

SEQ ID NO: 28221 - protein, 9 aa, Borrelia
TVVASQEAT

SEQ ID NO: 28222 - protein, 9 aa, Borrelia
VVASQEATI

SEQ ID NO: 28223 - protein, 9 aa, Borrelia
VASQEATIV

SEQ ID NO: 28224 - protein, 9 aa, Borrelia
ASQEATIVA

SEQ ID NO: 28225 - protein, 9 aa, Borrelia
SQEATIVAK

SEQ ID NO: 28226 - protein, 9 aa, Borrelia
QEATIVAKC

SEQ ID NO: 28227 - protein, 9 aa, Borrelia
EATIVAKCS

SEQ ID NO: 28228 - protein, 9 aa, Borrelia
ATIVAKCSG

SEQ ID NO: 28229 - protein, 9 aa, Borrelia
TIVAKCSGM

SEQ ID NO: 28230 - protein, 9 aa, Borrelia
IVAKCSGMV

SEQ ID NO: 28231 - protein, 9 aa, Borrelia
VAKCSGMVA

SEQ ID NO: 28232 - protein, 9 aa, Borrelia
AKCSGMVAE

SEQ ID NO: 28233 - protein, 9 aa, Borrelia
KCSGMVAEG

SEQ ID NO: 28234 - protein, 9 aa, Borrelia
CSGMVAEGA

SEQ ID NO: 28235 - protein, 9 aa, Borrelia
SGMVAEGAN

SEQ ID NO: 28236 - protein, 9 aa, Borrelia
GMVAEGANK

SEQ ID NO: 28237 - protein, 9 aa, Borrelia
MVAEGANKV

SEQ ID NO: 28238 - protein, 9 aa, Borrelia
VAEGANKVV

SEQ ID NO: 28239 - protein, 9 aa, Borrelia
AEGANKVVE

SEQ ID NO: 28240 - protein, 9 aa, Borrelia
EGANKVVEM

SEQ ID NO: 28241 - protein, 9 aa, Borrelia
GANKVVEMS

SEQ ID NO: 28242 - protein, 9 aa, Borrelia
ANKVVEMSK

SEQ ID NO: 28243 - protein, 9 aa, Borrelia
NKVVEMSKK

SEQ ID NO: 28244 - protein, 9 aa, Borrelia
KVVEMSKKA

SEQ ID NO: 28245 - protein, 9 aa, Borrelia
VVEMSKKAV

SEQ ID NO: 28246 - protein, 9 aa, Borrelia
VEMSKKAVQ

SEQ ID NO: 28247 - protein, 9 aa, Borrelia
EMSKKAVQE

SEQ ID NO: 28248 - protein, 9 aa, Borrelia
MSKKAVQET

SEQ ID NO: 28249 - protein, 9 aa, Borrelia
SKKAVQETQ

SEQ ID NO: 28250 - protein, 9 aa, Borrelia
KKAVQETQK

SEQ ID NO: 28251 - protein, 9 aa, Borrelia
KAVQETQKA

SEQ ID NO: 28252 - protein, 9 aa, Borrelia
AVQETQKAV

SEQ ID NO: 28253 - protein, 9 aa, Borrelia
VQETQKAVS

SEQ ID NO: 28254 - protein, 9 aa, Borrelia
QETQKAVSV

SEQ ID NO: 28255 - protein, 9 aa, Borrelia
ETQKAVSVA

SEQ ID NO: 28256 - protein, 9 aa, Borrelia
TQKAVSVAG

SEQ ID NO: 28257 - protein, 9 aa, Borrelia
QKAVSVAGE

SEQ ID NO: 28258 - protein, 9 aa, Borrelia
KAVSVAGEA

SEQ ID NO: 28259 - protein, 9 aa, Borrelia
AVSVAGEAT

SEQ ID NO: 28260 - protein, 9 aa, Borrelia
VSVAGEATF

SEQ ID NO: 28261 - protein, 9 aa, Borrelia
SVAGEATFL

SEQ ID NO: 28262 - protein, 9 aa, Borrelia
VAGEATFLI

SEQ ID NO: 28263 - protein, 9 aa, Borrelia
AGEATFLIE

SEQ ID NO: 28264 - protein, 9 aa, Borrelia
GEATFLIEK

SEQ ID NO: 28265 - protein, 9 aa, Borrelia
EATFLIEKQ

SEQ ID NO: 28266 - protein, 9 aa, Borrelia
ATFLIEKQI

SEQ ID NO: 28267 - protein, 9 aa, Borrelia
TFLIEKQIM

SEQ ID NO: 28268 - protein, 9 aa, Borrelia
FLIEKQIML

SEQ ID NO: 28269 - protein, 9 aa, Borrelia
LIEKQIMLN

SEQ ID NO: 28270 - protein, 9 aa, Borrelia
IEKQIMLNK

SEQ ID NO: 28271 - protein, 9 aa, Borrelia
EKQIMLNKS

SEQ ID NO: 28272 - protein, 9 aa, Borrelia
KQIMLNKSP

SEQ ID NO: 28273 - protein, 9 aa, Borrelia
QIMLNKSPN

SEQ ID NO: 28274 - protein, 9 aa, Borrelia
IMLNKSPNN

SEQ ID NO: 28275 - protein, 9 aa, Borrelia
MLNKSPNNK

SEQ ID NO: 28276 - protein, 9 aa, Borrelia
LNKSPNNKE

SEQ ID NO: 28277 - protein, 9 aa, Borrelia
NKSPNNKEL

SEQ ID NO: 28278 - protein, 9 aa, Borrelia
KSPNNKELE

SEQ ID NO: 28279 - protein, 9 aa, Borrelia
SPNNKELEL

SEQ ID NO: 28280 - protein, 9 aa, Borrelia
PNNKELELT

SEQ ID NO: 28281 - protein, 9 aa, Borrelia
NNKELELTK

SEQ ID NO: 28282 - protein, 9 aa, Borrelia
NKELELTKE

SEQ ID NO: 28283 - protein, 9 aa, Borrelia
KELELTKEE

SEQ ID NO: 28284 - protein, 9 aa, Borrelia
ELELTKEEF

SEQ ID NO: 28285 - protein, 9 aa, Borrelia
LELTKEEFA

SEQ ID NO: 28286 - protein, 9 aa, Borrelia
ELTKEEFAK

SEQ ID NO: 28287 - protein, 9 aa, Borrelia
LTKEEFAKV

SEQ ID NO: 28288 - protein, 9 aa, Borrelia
TKEEFAKVD

SEQ ID NO: 28289 - protein, 9 aa, Borrelia
KEEFAKVDE

SEQ ID NO: 28290 - protein, 9 aa, Borrelia
EEFAKVDEV

SEQ ID NO: 28291 - protein, 9 aa, Borrelia
EFAKVDEVK

SEQ ID NO: 28292 - protein, 9 aa, Borrelia
FAKVDEVKE

SEQ ID NO: 28293 - protein, 9 aa, Borrelia
AKVDEVKET

SEQ ID NO: 28294 - protein, 9 aa, Borrelia
KVDEVKETL

SEQ ID NO: 28295 - protein, 9 aa, Borrelia
VDEVKETLM

SEQ ID NO: 28296 - protein, 9 aa, Borrelia
DEVKETLMA

SEQ ID NO: 28297 - protein, 9 aa, Borrelia
EVKETLMAS

SEQ ID NO: 28298 - protein, 9 aa, Borrelia
VKETLMASE

SEQ ID NO: 28299 - protein, 9 aa, Borrelia
KETLMASER

SEQ ID NO: 28300 - protein, 9 aa, Borrelia
ETLMASERA

SEQ ID NO: 28301 - protein, 9 aa, Borrelia
TLMASERAL

SEQ ID NO: 28302 - protein, 9 aa, Borrelia
LMASERALD

SEQ ID NO: 28303 - protein, 9 aa, Borrelia
MASERALDE

SEQ ID NO: 28304 - protein, 9 aa, Borrelia
ASERALDET

SEQ ID NO: 28305 - protein, 9 aa, Borrelia
SERALDETV

SEQ ID NO: 28306 - protein, 9 aa, Borrelia
ERALDETVQ

SEQ ID NO: 28307 - protein, 9 aa, Borrelia
RALDETVQE

SEQ ID NO: 28308 - protein, 9 aa, Borrelia
ALDETVQEA

SEQ ID NO: 28309 - protein, 9 aa, Borrelia
LDETVQEAQ

SEQ ID NO: 28310 - protein, 9 aa, Borrelia
DETVQEAQK

SEQ ID NO: 28311 - protein, 9 aa, Borrelia
ETVQEAQKV

SEQ ID NO: 28312 - protein, 9 aa, Borrelia
TVQEAQKVL

SEQ ID NO: 28313 - protein, 9 aa, Borrelia
VQEAQKVLN

SEQ ID NO: 28314 - protein, 9 aa, Borrelia
QEAQKVLNM

SEQ ID NO: 28315 - protein, 9 aa, Borrelia
EAQKVLNMV

SEQ ID NO: 28316 - protein, 9 aa, Borrelia
AQKVLNMVN

SEQ ID NO: 28317 - protein, 9 aa, Borrelia
QKVLNMVNG

SEQ ID NO: 28318 - protein, 9 aa, Borrelia
KVLNMVNGL

SEQ ID NO: 28319 - protein, 9 aa, Borrelia
VLNMVNGLN

SEQ ID NO: 28320 - protein, 9 aa, Borrelia
LNMVNGLNP

SEQ ID NO: 28321 - protein, 9 aa, Borrelia
NMVNGLNPS

SEQ ID NO: 28322 - protein, 9 aa, Borrelia
MVNGLNPSN

SEQ ID NO: 28323 - protein, 9 aa, Borrelia
VNGLNPSNK

SEQ ID NO: 28324 - protein, 9 aa, Borrelia
NGLNPSNKD

SEQ ID NO: 28325 - protein, 9 aa, Borrelia
GLNPSNKDQ

SEQ ID NO: 28326 - protein, 9 aa, Borrelia
LNPSNKDQV

SEQ ID NO: 28327 - protein, 9 aa, Borrelia
NPSNKDQVL

SEQ ID NO: 28328 - protein, 9 aa, Borrelia
PSNKDQVLA

SEQ ID NO: 28329 - protein, 9 aa, Borrelia
SNKDQVLAK

SEQ ID NO: 28330 - protein, 9 aa, Borrelia
NKDQVLAKK

SEQ ID NO: 28331 - protein, 9 aa, Borrelia
KDQVLAKKD

SEQ ID NO: 28332 - protein, 9 aa, Borrelia
DQVLAKKDV

SEQ ID NO: 28333 - protein, 9 aa, Borrelia
QVLAKKDVR

SEQ ID NO: 28334 - protein, 9 aa, Borrelia
VLAKKDVRK

SEQ ID NO: 28335 - protein, 9 aa, Borrelia
LAKKDVRKA

SEQ ID NO: 28336 - protein, 9 aa, Borrelia
AKKDVRKAI

SEQ ID NO: 28337 - protein, 9 aa, Borrelia
KKDVRKAIS

SEQ ID NO: 28338 - protein, 9 aa, Borrelia
KDVRKAISN

SEQ ID NO: 28339 - protein, 9 aa, Borrelia
DVRKAISNV

SEQ ID NO: 28340 - protein, 9 aa, Borrelia
VRKAISNVV

SEQ ID NO: 28341 - protein, 9 aa, Borrelia
RKAISNVVK

SEQ ID NO: 28342 - protein, 9 aa, Borrelia
KAISNVVKV

SEQ ID NO: 28343 - protein, 9 aa, Borrelia
AISNVVKVA

SEQ ID NO: 28344 - protein, 9 aa, Borrelia
ISNVVKVAQ

SEQ ID NO: 28345 - protein, 9 aa, Borrelia
SNVVKVAQG

SEQ ID NO: 28346 - protein, 9 aa, Borrelia
NVVKVAQGA

SEQ ID NO: 28347 - protein, 9 aa, Borrelia
VVKVAQGAR

SEQ ID NO: 28348 - protein, 9 aa, Borrelia
VKVAQGARD

SEQ ID NO: 28349 - protein, 9 aa, Borrelia
KVAQGARDL

SEQ ID NO: 28350 - protein, 9 aa, Borrelia
VAQGARDLT

SEQ ID NO: 28351 - protein, 9 aa, Borrelia
AQGARDLTK

SEQ ID NO: 28352 - protein, 9 aa, Borrelia
QGARDLTKV

SEQ ID NO: 28353 - protein, 9 aa, Borrelia
GARDLTKVM

SEQ ID NO: 28354 - protein, 9 aa, Borrelia
ARDLTKVMA

SEQ ID NO: 28355 - protein, 9 aa, Borrelia
RDLTKVMAI

SEQ ID NO: 28356 - protein, 9 aa, Borrelia
DLTKVMAIS

SEQ ID NO: 28357 - protein, 9 aa, Borrelia
LTKVMAISL

SEQ ID NO: 28358 - protein, 9 aa, Borrelia
TKVMAISLY

SEQ ID NO: 28359 - protein, 9 aa, Borrelia
KVMAISLYM

SEQ ID NO: 28360 - protein, 9 aa, Borrelia
VMAISLYMR

SEQ ID NO: 28361 - protein, 10 aa, Borrelia
MTKIFSNLII

SEQ ID NO: 28362 - protein, 10 aa, Borrelia
TKIFSNLIIN

SEQ ID NO: 28363 - protein, 10 aa, Borrelia
KIFSNLIING

SEQ ID NO: 28364 - protein, 10 aa, Borrelia
IFSNLIINGL

SEQ ID NO: 28365 - protein, 10 aa, Borrelia
FSNLIINGLL

SEQ ID NO: 28366 - protein, 10 aa, Borrelia
SNLIINGLLF

SEQ ID NO: 28367 - protein, 10 aa, Borrelia
NLIINGLLFG

SEQ ID NO: 28368 - protein, 10 aa, Borrelia
LIINGLLFGF

SEQ ID NO: 28369 - protein, 10 aa, Borrelia
IINGLLFGFV

SEQ ID NO: 28370 - protein, 10 aa, Borrelia
INGLLFGFVS

SEQ ID NO: 28371 - protein, 10 aa, Borrelia
NGLLFGFVSL

SEQ ID NO: 28372 - protein, 10 aa, Borrelia
GLLFGFVSLN

SEQ ID NO: 28373 - protein, 10 aa, Borrelia
LLFGFVSLNV

SEQ ID NO: 28374 - protein, 10 aa, Borrelia
LFGFVSLNVF

SEQ ID NO: 28375 - protein, 10 aa, Borrelia
FGFVSLNVFA

SEQ ID NO: 28376 - protein, 10 aa, Borrelia
GFVSLNVFAD

SEQ ID NO: 28377 - protein, 10 aa, Borrelia
FVSLNVFADS

SEQ ID NO: 28378 - protein, 10 aa, Borrelia
VSLNVFADSN

SEQ ID NO: 28379 - protein, 10 aa, Borrelia
SLNVFADSNN

SEQ ID NO: 28380 - protein, 10 aa, Borrelia
LNVFADSNNA

SEQ ID NO: 28381 - protein, 10 aa, Borrelia
NVFADSNNAN

SEQ ID NO: 28382 - protein, 10 aa, Borrelia
VFADSNNANI

SEQ ID NO: 28383 - protein, 10 aa, Borrelia
FADSNNANIL

SEQ ID NO: 28384 - protein, 10 aa, Borrelia
ADSNNANILK

SEQ ID NO: 28385 - protein, 10 aa, Borrelia
DSNNANILKP

SEQ ID NO: 28386 - protein, 10 aa, Borrelia
SNNANILKPQ

SEQ ID NO: 28387 - protein, 10 aa, Borrelia
NNANILKPQS

SEQ ID NO: 28388 - protein, 10 aa, Borrelia
NANILKPQSN

SEQ ID NO: 28389 - protein, 10 aa, Borrelia
ANILKPQSNV

SEQ ID NO: 28390 - protein, 10 aa, Borrelia
NILKPQSNVL

SEQ ID NO: 28391 - protein, 10 aa, Borrelia
ILKPQSNVLE

SEQ ID NO: 28392 - protein, 10 aa, Borrelia
LKPQSNVLEH

SEQ ID NO: 28393 - protein, 10 aa, Borrelia
KPQSNVLEHS

SEQ ID NO: 28394 - protein, 10 aa, Borrelia
PQSNVLEHSD

SEQ ID NO: 28395 - protein, 10 aa, Borrelia
QSNVLEHSDQ

SEQ ID NO: 28396 - protein, 10 aa, Borrelia
SNVLEHSDQK

SEQ ID NO: 28397 - protein, 10 aa, Borrelia
NVLEHSDQKD

SEQ ID NO: 28398 - protein, 10 aa, Borrelia
VLEHSDQKDN

SEQ ID NO: 28399 - protein, 10 aa, Borrelia
LEHSDQKDNK

SEQ ID NO: 28400 - protein, 10 aa, Borrelia
EHSDQKDNKK

SEQ ID NO: 28401 - protein, 10 aa, Borrelia
HSDQKDNKKL

SEQ ID NO: 28402 - protein, 10 aa, Borrelia
SDQKDNKKLD

SEQ ID NO: 28403 - protein, 10 aa, Borrelia
DQKDNKKLDQ

SEQ ID NO: 28404 - protein, 10 aa, Borrelia
QKDNKKLDQK

SEQ ID NO: 28405 - protein, 10 aa, Borrelia
KDNKKLDQKD

SEQ ID NO: 28406 - protein, 10 aa, Borrelia
DNKKLDQKDQ

SEQ ID NO: 28407 - protein, 10 aa, Borrelia
NKKLDQKDQV

SEQ ID NO: 28408 - protein, 10 aa, Borrelia
KKLDQKDQVN

SEQ ID NO: 28409 - protein, 10 aa, Borrelia
KLDQKDQVNQ

SEQ ID NO: 28410 - protein, 10 aa, Borrelia
LDQKDQVNQA

SEQ ID NO: 28411 - protein, 10 aa, Borrelia
DQKDQVNQAL

SEQ ID NO: 28412 - protein, 10 aa, Borrelia
QKDQVNQALD

SEQ ID NO: 28413 - protein, 10 aa, Borrelia
KDQVNQALDT

SEQ ID NO: 28414 - protein, 10 aa, Borrelia
DQVNQALDTI

SEQ ID NO: 28415 - protein, 10 aa, Borrelia
QVNQALDTIN

SEQ ID NO: 28416 - protein, 10 aa, Borrelia
VNQALDTINK

SEQ ID NO: 28417 - protein, 10 aa, Borrelia
NQALDTINKV

SEQ ID NO: 28418 - protein, 10 aa, Borrelia
QALDTINKVT

SEQ ID NO: 28419 - protein, 10 aa, Borrelia
ALDTINKVTE

SEQ ID NO: 28420 - protein, 10 aa, Borrelia
LDTINKVTED

SEQ ID NO: 28421 - protein, 10 aa, Borrelia
DTINKVTEDV

SEQ ID NO: 28422 - protein, 10 aa, Borrelia
TINKVTEDVS

SEQ ID NO: 28423 - protein, 10 aa, Borrelia
INKVTEDVSS

SEQ ID NO: 28424 - protein, 10 aa, Borrelia
NKVTEDVSSK

SEQ ID NO: 28425 - protein, 10 aa, Borrelia
KVTEDVSSKL

SEQ ID NO: 28426 - protein, 10 aa, Borrelia
VTEDVSSKLE

SEQ ID NO: 28427 - protein, 10 aa, Borrelia
TEDVSSKLEG

SEQ ID NO: 28428 - protein, 10 aa, Borrelia
EDVSSKLEGV

SEQ ID NO: 28429 - protein, 10 aa, Borrelia
DVSSKLEGVR

SEQ ID NO: 28430 - protein, 10 aa, Borrelia
VSSKLEGVRE

SEQ ID NO: 28431 - protein, 10 aa, Borrelia
SSKLEGVRES

SEQ ID NO: 28432 - protein, 10 aa, Borrelia
SKLEGVRESS

SEQ ID NO: 28433 - protein, 10 aa, Borrelia
KLEGVRESSL

SEQ ID NO: 28434 - protein, 10 aa, Borrelia
LEGVRESSLE

SEQ ID NO: 28435 - protein, 10 aa, Borrelia
EGVRESSLEL

SEQ ID NO: 28436 - protein, 10 aa, Borrelia
GVRESSLELV

SEQ ID NO: 28437 - protein, 10 aa, Borrelia
VRESSLELVE

SEQ ID NO: 28438 - protein, 10 aa, Borrelia
RESSLELVES

SEQ ID NO: 28439 - protein, 10 aa, Borrelia
ESSLELVESN

SEQ ID NO: 28440 - protein, 10 aa, Borrelia
SSLELVESND

SEQ ID NO: 28441 - protein, 10 aa, Borrelia
SLELVESNDA

SEQ ID NO: 28442 - protein, 10 aa, Borrelia
LELVESNDAG

SEQ ID NO: 28443 - protein, 10 aa, Borrelia
ELVESNDAGV

SEQ ID NO: 28444 - protein, 10 aa, Borrelia
LVESNDAGVV

SEQ ID NO: 28445 - protein, 10 aa, Borrelia
VESNDAGVVK

SEQ ID NO: 28446 - protein, 10 aa, Borrelia
ESNDAGVVKK

SEQ ID NO: 28447 - protein, 10 aa, Borrelia
SNDAGVVKKF

SEQ ID NO: 28448 - protein, 10 aa, Borrelia
NDAGVVKKFV

SEQ ID NO: 28449 - protein, 10 aa, Borrelia
DAGVVKKFVG

SEQ ID NO: 28450 - protein, 10 aa, Borrelia
AGVVKKFVGS

SEQ ID NO: 28451 - protein, 10 aa, Borrelia
GVVKKFVGSM

SEQ ID NO: 28452 - protein, 10 aa, Borrelia
VVKKFVGSMS

SEQ ID NO: 28453 - protein, 10 aa, Borrelia
VKKFVGSMSL

SEQ ID NO: 28454 - protein, 10 aa, Borrelia
KKFVGSMSLM

SEQ ID NO: 28455 - protein, 10 aa, Borrelia
KFVGSMSLMS

SEQ ID NO: 28456 - protein, 10 aa, Borrelia
FVGSMSLMSD

SEQ ID NO: 28457 - protein, 10 aa, Borrelia
VGSMSLMSDV

SEQ ID NO: 28458 - protein, 10 aa, Borrelia
GSMSLMSDVA

SEQ ID NO: 28459 - protein, 10 aa, Borrelia
SMSLMSDVAK

SEQ ID NO: 28460 - protein, 10 aa, Borrelia
MSLMSDVAKG

SEQ ID NO: 28461 - protein, 10 aa, Borrelia
SLMSDVAKGT

SEQ ID NO: 28462 - protein, 10 aa, Borrelia
LMSDVAKGTV

SEQ ID NO: 28463 - protein, 10 aa, Borrelia
MSDVAKGTVV

SEQ ID NO: 28464 - protein, 10 aa, Borrelia
SDVAKGTVVA

SEQ ID NO: 28465 - protein, 10 aa, Borrelia
DVAKGTVVAS

SEQ ID NO: 28466 - protein, 10 aa, Borrelia
VAKGTVVASQ

SEQ ID NO: 28467 - protein, 10 aa, Borrelia
AKGTVVASQE

SEQ ID NO: 28468 - protein, 10 aa, Borrelia
KGTVVASQEA

SEQ ID NO: 28469 - protein, 10 aa, Borrelia
GTVVASQEAT

SEQ ID NO: 28470 - protein, 10 aa, Borrelia
TVVASQEATI

SEQ ID NO: 28471 - protein, 10 aa, Borrelia
VVASQEATIV

SEQ ID NO: 28472 - protein, 10 aa, Borrelia
VASQEATIVA

SEQ ID NO: 28473 - protein, 10 aa, Borrelia
ASQEATIVAK

SEQ ID NO: 28474 - protein, 10 aa, Borrelia
SQEATIVAKC

SEQ ID NO: 28475 - protein, 10 aa, Borrelia
QEATIVAKCS

SEQ ID NO: 28476 - protein, 10 aa, Borrelia
EATIVAKCSG

SEQ ID NO: 28477 - protein, 10 aa, Borrelia
ATIVAKCSGM

SEQ ID NO: 28478 - protein, 10 aa, Borrelia
TIVAKCSGMV

SEQ ID NO: 28479 - protein, 10 aa, Borrelia
IVAKCSGMVA

SEQ ID NO: 28480 - protein, 10 aa, Borrelia
VAKCSGMVAE

SEQ ID NO: 28481 - protein, 10 aa, Borrelia
AKCSGMVAEG

SEQ ID NO: 28482 - protein, 10 aa, Borrelia
KCSGMVAEGA

SEQ ID NO: 28483 - protein, 10 aa, Borrelia
CSGMVAEGAN

SEQ ID NO: 28484 - protein, 10 aa, Borrelia
SGMVAEGANK

SEQ ID NO: 28485 - protein, 10 aa, Borrelia
GMVAEGANKV

SEQ ID NO: 28486 - protein, 10 aa, Borrelia
MVAEGANKVV

SEQ ID NO: 28487 - protein, 10 aa, Borrelia
VAEGANKVVE

SEQ ID NO: 28488 - protein, 10 aa, Borrelia
AEGANKVVEM

SEQ ID NO: 28489 - protein, 10 aa, Borrelia
EGANKVVEMS

SEQ ID NO: 28490 - protein, 10 aa, Borrelia
GANKVVEMSK

SEQ ID NO: 28491 - protein, 10 aa, Borrelia
ANKVVEMSKK

SEQ ID NO: 28492 - protein, 10 aa, Borrelia
NKVVEMSKKA

SEQ ID NO: 28493 - protein, 10 aa, Borrelia
KVVEMSKKAV

SEQ ID NO: 28494 - protein, 10 aa, Borrelia
VVEMSKKAVQ

SEQ ID NO: 28495 - protein, 10 aa, Borrelia
VEMSKKAVQE

SEQ ID NO: 28496 - protein, 10 aa, Borrelia
EMSKKAVQET

SEQ ID NO: 28497 - protein, 10 aa, Borrelia
MSKKAVQETQ

SEQ ID NO: 28498 - protein, 10 aa, Borrelia
SKKAVQETQK

SEQ ID NO: 28499 - protein, 10 aa, Borrelia
KKAVQETQKA

SEQ ID NO: 28500 - protein, 10 aa, Borrelia
KAVQETQKAV

SEQ ID NO: 28501 - protein, 10 aa, Borrelia
AVQETQKAVS

SEQ ID NO: 28502 - protein, 10 aa, Borrelia
VQETQKAVSV

SEQ ID NO: 28503 - protein, 10 aa, Borrelia
QETQKAVSVA

SEQ ID NO: 28504 - protein, 10 aa, Borrelia
ETQKAVSVAG

SEQ ID NO: 28505 - protein, 10 aa, Borrelia
TQKAVSVAGE

SEQ ID NO: 28506 - protein, 10 aa, Borrelia
QKAVSVAGEA

SEQ ID NO: 28507 - protein, 10 aa, Borrelia
KAVSVAGEAT

SEQ ID NO: 28508 - protein, 10 aa, Borrelia
AVSVAGEATF

SEQ ID NO: 28509 - protein, 10 aa, Borrelia
VSVAGEATFL

SEQ ID NO: 28510 - protein, 10 aa, Borrelia
SVAGEATFLI

SEQ ID NO: 28511 - protein, 10 aa, Borrelia
VAGEATFLIE

SEQ ID NO: 28512 - protein, 10 aa, Borrelia
AGEATFLIEK

SEQ ID NO: 28513 - protein, 10 aa, Borrelia
GEATFLIEKQ

SEQ ID NO: 28514 - protein, 10 aa, Borrelia
EATFLIEKQI

SEQ ID NO: 28515 - protein, 10 aa, Borrelia
ATFLIEKQIM

SEQ ID NO: 28516 - protein, 10 aa, Borrelia
TFLIEKQIML

SEQ ID NO: 28517 - protein, 10 aa, Borrelia
FLIEKQIMLN

SEQ ID NO: 28518 - protein, 10 aa, Borrelia
LIEKQIMLNK

SEQ ID NO: 28519 - protein, 10 aa, Borrelia
IEKQIMLNKS

SEQ ID NO: 28520 - protein, 10 aa, Borrelia
EKQIMLNKSP

SEQ ID NO: 28521 - protein, 10 aa, Borrelia
KQIMLNKSPN

SEQ ID NO: 28522 - protein, 10 aa, Borrelia
QIMLNKSPNN

SEQ ID NO: 28523 - protein, 10 aa, Borrelia
IMLNKSPNNK

SEQ ID NO: 28524 - protein, 10 aa, Borrelia
MLNKSPNNKE

SEQ ID NO: 28525 - protein, 10 aa, Borrelia
LNKSPNNKEL

SEQ ID NO: 28526 - protein, 10 aa, Borrelia
NKSPNNKELE

SEQ ID NO: 28527 - protein, 10 aa, Borrelia
KSPNNKELEL

SEQ ID NO: 28528 - protein, 10 aa, Borrelia
SPNNKELELT

SEQ ID NO: 28529 - protein, 10 aa, Borrelia
PNNKELELTK

SEQ ID NO: 28530 - protein, 10 aa, Borrelia
NNKELELTKE

SEQ ID NO: 28531 - protein, 10 aa, Borrelia
NKELELTKEE

SEQ ID NO: 28532 - protein, 10 aa, Borrelia
KELELTKEEF

SEQ ID NO: 28533 - protein, 10 aa, Borrelia
ELELTKEEFA

SEQ ID NO: 28534 - protein, 10 aa, Borrelia
LELTKEEFAK

SEQ ID NO: 28535 - protein, 10 aa, Borrelia
ELTKEEFAKV

SEQ ID NO: 28536 - protein, 10 aa, Borrelia
LTKEEFAKVD

SEQ ID NO: 28537 - protein, 10 aa, Borrelia
TKEEFAKVDE

SEQ ID NO: 28538 - protein, 10 aa, Borrelia
KEEFAKVDEV

SEQ ID NO: 28539 - protein, 10 aa, Borrelia
EEFAKVDEVK

SEQ ID NO: 28540 - protein, 10 aa, Borrelia
EFAKVDEVKE

SEQ ID NO: 28541 - protein, 10 aa, Borrelia
FAKVDEVKET

SEQ ID NO: 28542 - protein, 10 aa, Borrelia
AKVDEVKETL

SEQ ID NO: 28543 - protein, 10 aa, Borrelia
KVDEVKETLM

SEQ ID NO: 28544 - protein, 10 aa, Borrelia
VDEVKETLMA

SEQ ID NO: 28545 - protein, 10 aa, Borrelia
DEVKETLMAS

SEQ ID NO: 28546 - protein, 10 aa, Borrelia
EVKETLMASE

SEQ ID NO: 28547 - protein, 10 aa, Borrelia
VKETLMASER

SEQ ID NO: 28548 - protein, 10 aa, Borrelia
KETLMASERA

SEQ ID NO: 28549 - protein, 10 aa, Borrelia
ETLMASERAL

SEQ ID NO: 28550 - protein, 10 aa, Borrelia
TLMASERALD

SEQ ID NO: 28551 - protein, 10 aa, Borrelia
LMASERALDE

SEQ ID NO: 28552 - protein, 10 aa, Borrelia
MASERALDET

SEQ ID NO: 28553 - protein, 10 aa, Borrelia
ASERALDETV

SEQ ID NO: 28554 - protein, 10 aa, Borrelia
SERALDETVQ

SEQ ID NO: 28555 - protein, 10 aa, Borrelia
ERALDETVQE

SEQ ID NO: 28556 - protein, 10 aa, Borrelia
RALDETVQEA

SEQ ID NO: 28557 - protein, 10 aa, Borrelia
ALDETVQEAQ

SEQ ID NO: 28558 - protein, 10 aa, Borrelia
LDETVQEAQK

SEQ ID NO: 28559 - protein, 10 aa, Borrelia
DETVQEAQKV

SEQ ID NO: 28560 - protein, 10 aa, Borrelia
ETVQEAQKVL

SEQ ID NO: 28561 - protein, 10 aa, Borrelia
TVQEAQKVLN

SEQ ID NO: 28562 - protein, 10 aa, Borrelia
VQEAQKVLNM

SEQ ID NO: 28563 - protein, 10 aa, Borrelia
QEAQKVLNMV

SEQ ID NO: 28564 - protein, 10 aa, Borrelia
EAQKVLNMVN

SEQ ID NO: 28565 - protein, 10 aa, Borrelia
AQKVLNMVNG

SEQ ID NO: 28566 - protein, 10 aa, Borrelia
QKVLNMVNGL

SEQ ID NO: 28567 - protein, 10 aa, Borrelia
KVLNMVNGLN

SEQ ID NO: 28568 - protein, 10 aa, Borrelia
VLNMVNGLNP

SEQ ID NO: 28569 - protein, 10 aa, Borrelia
LNMVNGLNPS

SEQ ID NO: 28570 - protein, 10 aa, Borrelia
NMVNGLNPSN

SEQ ID NO: 28571 - protein, 10 aa, Borrelia
MVNGLNPSNK

SEQ ID NO: 28572 - protein, 10 aa, Borrelia
VNGLNPSNKD

SEQ ID NO: 28573 - protein, 10 aa, Borrelia
NGLNPSNKDQ

SEQ ID NO: 28574 - protein, 10 aa, Borrelia
GLNPSNKDQV

SEQ ID NO: 28575 - protein, 10 aa, Borrelia
LNPSNKDQVL

SEQ ID NO: 28576 - protein, 10 aa, Borrelia
NPSNKDQVLA

SEQ ID NO: 28577 - protein, 10 aa, Borrelia
PSNKDQVLAK

SEQ ID NO: 28578 - protein, 10 aa, Borrelia
SNKDQVLAKK

SEQ ID NO: 28579 - protein, 10 aa, Borrelia
NKDQVLAKKD

SEQ ID NO: 28580 - protein, 10 aa, Borrelia
KDQVLAKKDV

SEQ ID NO: 28581 - protein, 10 aa, Borrelia
DQVLAKKDVR

SEQ ID NO: 28582 - protein, 10 aa, Borrelia
QVLAKKDVRK

SEQ ID NO: 28583 - protein, 10 aa, Borrelia
VLAKKDVRKA

SEQ ID NO: 28584 - protein, 10 aa, Borrelia
LAKKDVRKAI

SEQ ID NO: 28585 - protein, 10 aa, Borrelia
AKKDVRKAIS

SEQ ID NO: 28586 - protein, 10 aa, Borrelia
KKDVRKAISN

SEQ ID NO: 28587 - protein, 10 aa, Borrelia
KDVRKAISNV

SEQ ID NO: 28588 - protein, 10 aa, Borrelia
DVRKAISNVV

SEQ ID NO: 28589 - protein, 10 aa, Borrelia
VRKAISNVVK

SEQ ID NO: 28590 - protein, 10 aa, Borrelia
RKAISNVVKV

SEQ ID NO: 28591 - protein, 10 aa, Borrelia
KAISNVVKVA

SEQ ID NO: 28592 - protein, 10 aa, Borrelia
AISNVVKVAQ

SEQ ID NO: 28593 - protein, 10 aa, Borrelia
ISNVVKVAQG

SEQ ID NO: 28594 - protein, 10 aa, Borrelia
SNVVKVAQGA

SEQ ID NO: 28595 - protein, 10 aa, Borrelia
NVVKVAQGAR

SEQ ID NO: 28596 - protein, 10 aa, Borrelia
VVKVAQGARD

SEQ ID NO: 28597 - protein, 10 aa, Borrelia
VKVAQGARDL

SEQ ID NO: 28598 - protein, 10 aa, Borrelia
KVAQGARDLT

SEQ ID NO: 28599 - protein, 10 aa, Borrelia
VAQGARDLTK

SEQ ID NO: 28600 - protein, 10 aa, Borrelia
AQGARDLTKV

SEQ ID NO: 28601 - protein, 10 aa, Borrelia
QGARDLTKVM

SEQ ID NO: 28602 - protein, 10 aa, Borrelia
GARDLTKVMA

SEQ ID NO: 28603 - protein, 10 aa, Borrelia
ARDLTKVMAI

SEQ ID NO: 28604 - protein, 10 aa, Borrelia
RDLTKVMAIS

SEQ ID NO: 28605 - protein, 10 aa, Borrelia
DLTKVMAISL

SEQ ID NO: 28606 - protein, 10 aa, Borrelia
LTKVMAISLY

SEQ ID NO: 28607 - protein, 10 aa, Borrelia
TKVMAISLYM

SEQ ID NO: 28608 - protein, 10 aa, Borrelia
KVMAISLYMR

SEQ ID NO: 28609 - protein, 11 aa, Borrelia
MTKIFSNLIIN

SEQ ID NO: 28610 - protein, 11 aa, Borrelia
TKIFSNLIING

SEQ ID NO: 28611 - protein, 11 aa, Borrelia
KIFSNLIINGL

SEQ ID NO: 28612 - protein, 11 aa, Borrelia
IFSNLIINGLL

SEQ ID NO: 28613 - protein, 11 aa, Borrelia
FSNLIINGLLF

SEQ ID NO: 28614 - protein, 11 aa, Borrelia
SNLIINGLLFG

SEQ ID NO: 28615 - protein, 11 aa, Borrelia
NLIINGLLFGF

SEQ ID NO: 28616 - protein, 11 aa, Borrelia
LIINGLLFGFV

SEQ ID NO: 28617 - protein, 11 aa, Borrelia
IINGLLFGFVS

SEQ ID NO: 28618 - protein, 11 aa, Borrelia
INGLLFGFVSL

SEQ ID NO: 28619 - protein, 11 aa, Borrelia
NGLLFGFVSLN

SEQ ID NO: 28620 - protein, 11 aa, Borrelia
GLLFGFVSLNV

SEQ ID NO: 28621 - protein, 11 aa, Borrelia
LLFGFVSLNVF

SEQ ID NO: 28622 - protein, 11 aa, Borrelia
LFGFVSLNVFA

SEQ ID NO: 28623 - protein, 11 aa, Borrelia
FGFVSLNVFAD

SEQ ID NO: 28624 - protein, 11 aa, Borrelia
GFVSLNVFADS

SEQ ID NO: 28625 - protein, 11 aa, Borrelia
FVSLNVFADSN

SEQ ID NO: 28626 - protein, 11 aa, Borrelia
VSLNVFADSNN

SEQ ID NO: 28627 - protein, 11 aa, Borrelia
SLNVFADSNNA

SEQ ID NO: 28628 - protein, 11 aa, Borrelia
LNVFADSNNAN

SEQ ID NO: 28629 - protein, 11 aa, Borrelia
NVFADSNNANI

SEQ ID NO: 28630 - protein, 11 aa, Borrelia
VFADSNNANIL

SEQ ID NO: 28631 - protein, 11 aa, Borrelia
FADSNNANILK

SEQ ID NO: 28632 - protein, 11 aa, Borrelia
ADSNNANILKP

SEQ ID NO: 28633 - protein, 11 aa, Borrelia
DSNNANILKPQ

SEQ ID NO: 28634 - protein, 11 aa, Borrelia
SNNANILKPQS

SEQ ID NO: 28635 - protein, 11 aa, Borrelia
NNANILKPQSN

SEQ ID NO: 28636 - protein, 11 aa, Borrelia
NANILKPQSNV

SEQ ID NO: 28637 - protein, 11 aa, Borrelia
ANILKPQSNVL

SEQ ID NO: 28638 - protein, 11 aa, Borrelia
NILKPQSNVLE

SEQ ID NO: 28639 - protein, 11 aa, Borrelia
ILKPQSNVLEH

SEQ ID NO: 28640 - protein, 11 aa, Borrelia
LKPQSNVLEHS

SEQ ID NO: 28641 - protein, 11 aa, Borrelia
KPQSNVLEHSD

SEQ ID NO: 28642 - protein, 11 aa, Borrelia
PQSNVLEHSDQ

SEQ ID NO: 28643 - protein, 11 aa, Borrelia
QSNVLEHSDQK

SEQ ID NO: 28644 - protein, 11 aa, Borrelia
SNVLEHSDQKD

SEQ ID NO: 28645 - protein, 11 aa, Borrelia
NVLEHSDQKDN

SEQ ID NO: 28646 - protein, 11 aa, Borrelia
VLEHSDQKDNK

SEQ ID NO: 28647 - protein, 11 aa, Borrelia
LEHSDQKDNKK

SEQ ID NO: 28648 - protein, 11 aa, Borrelia
EHSDQKDNKKL

SEQ ID NO: 28649 - protein, 11 aa, Borrelia
HSDQKDNKKLD

SEQ ID NO: 28650 - protein, 11 aa, Borrelia
SDQKDNKKLDQ

SEQ ID NO: 28651 - protein, 11 aa, Borrelia
DQKDNKKLDQK

SEQ ID NO: 28652 - protein, 11 aa, Borrelia
QKDNKKLDQKD

SEQ ID NO: 28653 - protein, 11 aa, Borrelia
KDNKKLDQKDQ

SEQ ID NO: 28654 - protein, 11 aa, Borrelia
DNKKLDQKDQV

SEQ ID NO: 28655 - protein, 11 aa, Borrelia
NKKLDQKDQVN

SEQ ID NO: 28656 - protein, 11 aa, Borrelia
KKLDQKDQVNQ

SEQ ID NO: 28657 - protein, 11 aa, Borrelia
KLDQKDQVNQA

SEQ ID NO: 28658 - protein, 11 aa, Borrelia
LDQKDQVNQAL

SEQ ID NO: 28659 - protein, 11 aa, Borrelia
DQKDQVNQALD

SEQ ID NO: 28660 - protein, 11 aa, Borrelia
QKDQVNQALDT

SEQ ID NO: 28661 - protein, 11 aa, Borrelia
KDQVNQALDTI

SEQ ID NO: 28662 - protein, 11 aa, Borrelia
DQVNQALDTIN

SEQ ID NO: 28663 - protein, 11 aa, Borrelia
QVNQALDTINK

SEQ ID NO: 28664 - protein, 11 aa, Borrelia
VNQALDTINKV

SEQ ID NO: 28665 - protein, 11 aa, Borrelia
NQALDTINKVT

SEQ ID NO: 28666 - protein, 11 aa, Borrelia
QALDTINKVTE

SEQ ID NO: 28667 - protein, 11 aa, Borrelia
ALDTINKVTED

SEQ ID NO: 28668 - protein, 11 aa, Borrelia
LDTINKVTEDV

SEQ ID NO: 28669 - protein, 11 aa, Borrelia
DTINKVTEDVS

SEQ ID NO: 28670 - protein, 11 aa, Borrelia
TINKVTEDVSS

SEQ ID NO: 28671 - protein, 11 aa, Borrelia
INKVTEDVSSK

SEQ ID NO: 28672 - protein, 11 aa, Borrelia
NKVTEDVSSKL

SEQ ID NO: 28673 - protein, 11 aa, Borrelia
KVTEDVSSKLE

SEQ ID NO: 28674 - protein, 11 aa, Borrelia
VTEDVSSKLEG

SEQ ID NO: 28675 - protein, 11 aa, Borrelia
TEDVSSKLEGV

SEQ ID NO: 28676 - protein, 11 aa, Borrelia
EDVSSKLEGVR

SEQ ID NO: 28677 - protein, 11 aa, Borrelia
DVSSKLEGVRE

SEQ ID NO: 28678 - protein, 11 aa, Borrelia
VSSKLEGVRES

SEQ ID NO: 28679 - protein, 11 aa, Borrelia
SSKLEGVRESS

SEQ ID NO: 28680 - protein, 11 aa, Borrelia
SKLEGVRESSL

SEQ ID NO: 28681 - protein, 11 aa, Borrelia
KLEGVRESSLE

SEQ ID NO: 28682 - protein, 11 aa, Borrelia
LEGVRESSLEL

SEQ ID NO: 28683 - protein, 11 aa, Borrelia
EGVRESSLELV

SEQ ID NO: 28684 - protein, 11 aa, Borrelia
GVRESSLELVE

SEQ ID NO: 28685 - protein, 11 aa, Borrelia
VRESSLELVES

SEQ ID NO: 28686 - protein, 11 aa, Borrelia
RESSLELVESN

SEQ ID NO: 28687 - protein, 11 aa, Borrelia
ESSLELVESND

SEQ ID NO: 28688 - protein, 11 aa, Borrelia
SSLELVESNDA

SEQ ID NO: 28689 - protein, 11 aa, Borrelia
SLELVESNDAG

SEQ ID NO: 28690 - protein, 11 aa, Borrelia
LELVESNDAGV

SEQ ID NO: 28691 - protein, 11 aa, Borrelia
ELVESNDAGVV

SEQ ID NO: 28692 - protein, 11 aa, Borrelia
LVESNDAGVVK

SEQ ID NO: 28693 - protein, 11 aa, Borrelia
VESNDAGVVKK

SEQ ID NO: 28694 - protein, 11 aa, Borrelia
ESNDAGVVKKF

SEQ ID NO: 28695 - protein, 11 aa, Borrelia
SNDAGVVKKFV

SEQ ID NO: 28696 - protein, 11 aa, Borrelia
NDAGVVKKFVG

SEQ ID NO: 28697 - protein, 11 aa, Borrelia
DAGVVKKFVGS

SEQ ID NO: 28698 - protein, 11 aa, Borrelia
AGVVKKFVGSM

SEQ ID NO: 28699 - protein, 11 aa, Borrelia
GVVKKFVGSMS

SEQ ID NO: 28700 - protein, 11 aa, Borrelia
VVKKFVGSMSL

SEQ ID NO: 28701 - protein, 11 aa, Borrelia
VKKFVGSMSLM

SEQ ID NO: 28702 - protein, 11 aa, Borrelia
KKFVGSMSLMS

SEQ ID NO: 28703 - protein, 11 aa, Borrelia
KFVGSMSLMSD

SEQ ID NO: 28704 - protein, 11 aa, Borrelia
FVGSMSLMSDV

SEQ ID NO: 28705 - protein, 11 aa, Borrelia
VGSMSLMSDVA

SEQ ID NO: 28706 - protein, 11 aa, Borrelia
GSMSLMSDVAK

SEQ ID NO: 28707 - protein, 11 aa, Borrelia
SMSLMSDVAKG

SEQ ID NO: 28708 - protein, 11 aa, Borrelia
MSLMSDVAKGT

SEQ ID NO: 28709 - protein, 11 aa, Borrelia
SLMSDVAKGTV

SEQ ID NO: 28710 - protein, 11 aa, Borrelia
LMSDVAKGTVV

SEQ ID NO: 28711 - protein, 11 aa, Borrelia
MSDVAKGTVVA

SEQ ID NO: 28712 - protein, 11 aa, Borrelia
SDVAKGTVVAS

SEQ ID NO: 28713 - protein, 11 aa, Borrelia
DVAKGTVVASQ

SEQ ID NO: 28714 - protein, 11 aa, Borrelia
VAKGTVVASQE

SEQ ID NO: 28715 - protein, 11 aa, Borrelia
AKGTVVASQEA

SEQ ID NO: 28716 - protein, 11 aa, Borrelia
KGTVVASQEAT

SEQ ID NO: 28717 - protein, 11 aa, Borrelia
GTVVASQEATI

SEQ ID NO: 28718 - protein, 11 aa, Borrelia
TVVASQEATIV

SEQ ID NO: 28719 - protein, 11 aa, Borrelia
VVASQEATIVA

SEQ ID NO: 28720 - protein, 11 aa, Borrelia
VASQEATIVAK

SEQ ID NO: 28721 - protein, 11 aa, Borrelia
ASQEATIVAKC

SEQ ID NO: 28722 - protein, 11 aa, Borrelia
SQEATIVAKCS

SEQ ID NO: 28723 - protein, 11 aa, Borrelia
QEATIVAKCSG

SEQ ID NO: 28724 - protein, 11 aa, Borrelia
EATIVAKCSGM

SEQ ID NO: 28725 - protein, 11 aa, Borrelia
ATIVAKCSGMV

SEQ ID NO: 28726 - protein, 11 aa, Borrelia
TIVAKCSGMVA

SEQ ID NO: 28727 - protein, 11 aa, Borrelia
IVAKCSGMVAE

SEQ ID NO: 28728 - protein, 11 aa, Borrelia
VAKCSGMVAEG

SEQ ID NO: 28729 - protein, 11 aa, Borrelia
AKCSGMVAEGA

SEQ ID NO: 28730 - protein, 11 aa, Borrelia
KCSGMVAEGAN

SEQ ID NO: 28731 - protein, 11 aa, Borrelia
CSGMVAEGANK

SEQ ID NO: 28732 - protein, 11 aa, Borrelia
SGMVAEGANKV

SEQ ID NO: 28733 - protein, 11 aa, Borrelia
GMVAEGANKVV

SEQ ID NO: 28734 - protein, 11 aa, Borrelia
MVAEGANKVVE

SEQ ID NO: 28735 - protein, 11 aa, Borrelia
VAEGANKVVEM

SEQ ID NO: 28736 - protein, 11 aa, Borrelia
AEGANKVVEMS

SEQ ID NO: 28737 - protein, 11 aa, Borrelia
EGANKVVEMSK

SEQ ID NO: 28738 - protein, 11 aa, Borrelia
GANKVVEMSKK

SEQ ID NO: 28739 - protein, 11 aa, Borrelia
ANKVVEMSKKA

SEQ ID NO: 28740 - protein, 11 aa, Borrelia
NKVVEMSKKAV

SEQ ID NO: 28741 - protein, 11 aa, Borrelia
KVVEMSKKAVQ

SEQ ID NO: 28742 - protein, 11 aa, Borrelia
VVEMSKKAVQE

SEQ ID NO: 28743 - protein, 11 aa, Borrelia
VEMSKKAVQET

SEQ ID NO: 28744 - protein, 11 aa, Borrelia
EMSKKAVQETQ

SEQ ID NO: 28745 - protein, 11 aa, Borrelia
MSKKAVQETQK

SEQ ID NO: 28746 - protein, 11 aa, Borrelia
SKKAVQETQKA

SEQ ID NO: 28747 - protein, 11 aa, Borrelia
KKAVQETQKAV

SEQ ID NO: 28748 - protein, 11 aa, Borrelia
KAVQETQKAVS

SEQ ID NO: 28749 - protein, 11 aa, Borrelia
AVQETQKAVSV

SEQ ID NO: 28750 - protein, 11 aa, Borrelia
VQETQKAVSVA

SEQ ID NO: 28751 - protein, 11 aa, Borrelia
QETQKAVSVAG

SEQ ID NO: 28752 - protein, 11 aa, Borrelia
ETQKAVSVAGE

SEQ ID NO: 28753 - protein, 11 aa, Borrelia
TQKAVSVAGEA

SEQ ID NO: 28754 - protein, 11 aa, Borrelia
QKAVSVAGEAT

SEQ ID NO: 28755 - protein, 11 aa, Borrelia
KAVSVAGEATF

SEQ ID NO: 28756 - protein, 11 aa, Borrelia
AVSVAGEATFL

SEQ ID NO: 28757 - protein, 11 aa, Borrelia
VSVAGEATFLI

SEQ ID NO: 28758 - protein, 11 aa, Borrelia
SVAGEATFLIE

SEQ ID NO: 28759 - protein, 11 aa, Borrelia
VAGEATFLIEK

SEQ ID NO: 28760 - protein, 11 aa, Borrelia
AGEATFLIEKQ

SEQ ID NO: 28761 - protein, 11 aa, Borrelia
GEATFLIEKQI

SEQ ID NO: 28762 - protein, 11 aa, Borrelia
EATFLIEKQIM

SEQ ID NO: 28763 - protein, 11 aa, Borrelia
ATFLIEKQIML

SEQ ID NO: 28764 - protein, 11 aa, Borrelia
TFLIEKQIMLN

SEQ ID NO: 28765 - protein, 11 aa, Borrelia
FLIEKQIMLNK

SEQ ID NO: 28766 - protein, 11 aa, Borrelia
LIEKQIMLNKS

SEQ ID NO: 28767 - protein, 11 aa, Borrelia
IEKQIMLNKSP

SEQ ID NO: 28768 - protein, 11 aa, Borrelia
EKQIMLNKSPN

SEQ ID NO: 28769 - protein, 11 aa, Borrelia
KQIMLNKSPNN

SEQ ID NO: 28770 - protein, 11 aa, Borrelia
QIMLNKSPNNK

SEQ ID NO: 28771 - protein, 11 aa, Borrelia
IMLNKSPNNKE

SEQ ID NO: 28772 - protein, 11 aa, Borrelia
MLNKSPNNKEL

SEQ ID NO: 28773 - protein, 11 aa, Borrelia
LNKSPNNKELE

SEQ ID NO: 28774 - protein, 11 aa, Borrelia
NKSPNNKELEL

SEQ ID NO: 28775 - protein, 11 aa, Borrelia
KSPNNKELELT

SEQ ID NO: 28776 - protein, 11 aa, Borrelia
SPNNKELELTK

SEQ ID NO: 28777 - protein, 11 aa, Borrelia
PNNKELELTKE

SEQ ID NO: 28778 - protein, 11 aa, Borrelia
NNKELELTKEE

SEQ ID NO: 28779 - protein, 11 aa, Borrelia
NKELELTKEEF

SEQ ID NO: 28780 - protein, 11 aa, Borrelia
KELELTKEEFA

SEQ ID NO: 28781 - protein, 11 aa, Borrelia
ELELTKEEFAK

SEQ ID NO: 28782 - protein, 11 aa, Borrelia
LELTKEEFAKV

SEQ ID NO: 28783 - protein, 11 aa, Borrelia
ELTKEEFAKVD

SEQ ID NO: 28784 - protein, 11 aa, Borrelia
LTKEEFAKVDE

SEQ ID NO: 28785 - protein, 11 aa, Borrelia
TKEEFAKVDEV

SEQ ID NO: 28786 - protein, 11 aa, Borrelia
KEEFAKVDEVK

SEQ ID NO: 28787 - protein, 11 aa, Borrelia
EEFAKVDEVKE

SEQ ID NO: 28788 - protein, 11 aa, Borrelia
EFAKVDEVKET

SEQ ID NO: 28789 - protein, 11 aa, Borrelia
FAKVDEVKETL

SEQ ID NO: 28790 - protein, 11 aa, Borrelia
AKVDEVKETLM

SEQ ID NO: 28791 - protein, 11 aa, Borrelia
KVDEVKETLMA

SEQ ID NO: 28792 - protein, 11 aa, Borrelia
VDEVKETLMAS

SEQ ID NO: 28793 - protein, 11 aa, Borrelia
DEVKETLMASE

SEQ ID NO: 28794 - protein, 11 aa, Borrelia
EVKETLMASER

SEQ ID NO: 28795 - protein, 11 aa, Borrelia
VKETLMASERA

SEQ ID NO: 28796 - protein, 11 aa, Borrelia
KETLMASERAL

SEQ ID NO: 28797 - protein, 11 aa, Borrelia
ETLMASERALD

SEQ ID NO: 28798 - protein, 11 aa, Borrelia
TLMASERALDE

SEQ ID NO: 28799 - protein, 11 aa, Borrelia
LMASERALDET

SEQ ID NO: 28800 - protein, 11 aa, Borrelia
MASERALDETV

SEQ ID NO: 28801 - protein, 11 aa, Borrelia
ASERALDETVQ

SEQ ID NO: 28802 - protein, 11 aa, Borrelia
SERALDETVQE

SEQ ID NO: 28803 - protein, 11 aa, Borrelia
ERALDETVQEA

SEQ ID NO: 28804 - protein, 11 aa, Borrelia
RALDETVQEAQ

SEQ ID NO: 28805 - protein, 11 aa, Borrelia
ALDETVQEAQK

SEQ ID NO: 28806 - protein, 11 aa, Borrelia
LDETVQEAQKV

SEQ ID NO: 28807 - protein, 11 aa, Borrelia
DETVQEAQKVL

SEQ ID NO: 28808 - protein, 11 aa, Borrelia
ETVQEAQKVLN

SEQ ID NO: 28809 - protein, 11 aa, Borrelia
TVQEAQKVLNM

SEQ ID NO: 28810 - protein, 11 aa, Borrelia
VQEAQKVLNMV

SEQ ID NO: 28811 - protein, 11 aa, Borrelia
QEAQKVLNMVN

SEQ ID NO: 28812 - protein, 11 aa, Borrelia
EAQKVLNMVNG

SEQ ID NO: 28813 - protein, 11 aa, Borrelia
AQKVLNMVNGL

SEQ ID NO: 28814 - protein, 11 aa, Borrelia
QKVLNMVNGLN

SEQ ID NO: 28815 - protein, 11 aa, Borrelia
KVLNMVNGLNP

SEQ ID NO: 28816 - protein, 11 aa, Borrelia
VLNMVNGLNPS

SEQ ID NO: 28817 - protein, 11 aa, Borrelia
LNMVNGLNPSN

SEQ ID NO: 28818 - protein, 11 aa, Borrelia
NMVNGLNPSNK

SEQ ID NO: 28819 - protein, 11 aa, Borrelia
MVNGLNPSNKD

SEQ ID NO: 28820 - protein, 11 aa, Borrelia
VNGLNPSNKDQ

SEQ ID NO: 28821 - protein, 11 aa, Borrelia
NGLNPSNKDQV

SEQ ID NO: 28822 - protein, 11 aa, Borrelia
GLNPSNKDQVL

SEQ ID NO: 28823 - protein, 11 aa, Borrelia
LNPSNKDQVLA

SEQ ID NO: 28824 - protein, 11 aa, Borrelia
NPSNKDQVLAK

SEQ ID NO: 28825 - protein, 11 aa, Borrelia
PSNKDQVLAKK

SEQ ID NO: 28826 - protein, 11 aa, Borrelia
SNKDQVLAKKD

SEQ ID NO: 28827 - protein, 11 aa, Borrelia
NKDQVLAKKDV

SEQ ID NO: 28828 - protein, 11 aa, Borrelia
KDQVLAKKDVR

SEQ ID NO: 28829 - protein, 11 aa, Borrelia
DQVLAKKDVRK

SEQ ID NO: 28830 - protein, 11 aa, Borrelia
QVLAKKDVRKA

SEQ ID NO: 28831 - protein, 11 aa, Borrelia
VLAKKDVRKAI

SEQ ID NO: 28832 - protein, 11 aa, Borrelia
LAKKDVRKAIS

SEQ ID NO: 28833 - protein, 11 aa, Borrelia
AKKDVRKAISN

SEQ ID NO: 28834 - protein, 11 aa, Borrelia
KKDVRKAISNV

SEQ ID NO: 28835 - protein, 11 aa, Borrelia
KDVRKAISNVV

SEQ ID NO: 28836 - protein, 11 aa, Borrelia
DVRKAISNVVK

SEQ ID NO: 28837 - protein, 11 aa, Borrelia
VRKAISNVVKV

SEQ ID NO: 28838 - protein, 11 aa, Borrelia
RKAISNVVKVA

SEQ ID NO: 28839 - protein, 11 aa, Borrelia
KAISNVVKVAQ

SEQ ID NO: 28840 - protein, 11 aa, Borrelia
AISNVVKVAQG

SEQ ID NO: 28841 - protein, 11 aa, Borrelia
ISNVVKVAQGA

SEQ ID NO: 28842 - protein, 11 aa, Borrelia
SNVVKVAQGAR

SEQ ID NO: 28843 - protein, 11 aa, Borrelia
NVVKVAQGARD

SEQ ID NO: 28844 - protein, 11 aa, Borrelia
VVKVAQGARDL

SEQ ID NO: 28845 - protein, 11 aa, Borrelia
VKVAQGARDLT

SEQ ID NO: 28846 - protein, 11 aa, Borrelia
KVAQGARDLTK

SEQ ID NO: 28847 - protein, 11 aa, Borrelia
VAQGARDLTKV

SEQ ID NO: 28848 - protein, 11 aa, Borrelia
AQGARDLTKVM

SEQ ID NO: 28849 - protein, 11 aa, Borrelia
QGARDLTKVMA

SEQ ID NO: 28850 - protein, 11 aa, Borrelia
GARDLTKVMAI

SEQ ID NO: 28851 - protein, 11 aa, Borrelia
ARDLTKVMAIS

SEQ ID NO: 28852 - protein, 11 aa, Borrelia
RDLTKVMAISL

SEQ ID NO: 28853 - protein, 11 aa, Borrelia
DLTKVMAISLY

SEQ ID NO: 28854 - protein, 11 aa, Borrelia
LTKVMAISLYM

SEQ ID NO: 28855 - protein, 11 aa, Borrelia
TKVMAISLYMR

SEQ ID NO: 28856 - protein, 8 aa, Borrelia burgdorferi
MKKMLLIF

SEQ ID NO: 28857 - protein, 8 aa, Borrelia burgdorferi
KKMLLIFS

SEQ ID NO: 28858 - protein, 8 aa, Borrelia burgdorferi
KMLLIFSF

SEQ ID NO: 28859 - protein, 8 aa, Borrelia burgdorferi
MLLIFSFF

SEQ ID NO: 28860 - protein, 8 aa, Borrelia burgdorferi
LLIFSFFL

SEQ ID NO: 28861 - protein, 8 aa, Borrelia burgdorferi
LIFSFFLI

SEQ ID NO: 28862 - protein, 8 aa, Borrelia burgdorferi
IFSFFLIF

SEQ ID NO: 28863 - protein, 8 aa, Borrelia burgdorferi
FSFFLIFL

SEQ ID NO: 28864 - protein, 8 aa, Borrelia burgdorferi
SFFLIFLN

SEQ ID NO: 28865 - protein, 8 aa, Borrelia burgdorferi
FFLIFLNG

SEQ ID NO: 28866 - protein, 8 aa, Borrelia burgdorferi
FLIFLNGF

SEQ ID NO: 28867 - protein, 8 aa, Borrelia burgdorferi
LIFLNGFP

SEQ ID NO: 28868 - protein, 8 aa, Borrelia burgdorferi
IFLNGFPL

SEQ ID NO: 28869 - protein, 8 aa, Borrelia burgdorferi
FLNGFPLN

SEQ ID NO: 28870 - protein, 8 aa, Borrelia burgdorferi
LNGFPLNA

SEQ ID NO: 28871 - protein, 8 aa, Borrelia burgdorferi
NGFPLNAR

SEQ ID NO: 28872 - protein, 8 aa, Borrelia burgdorferi
GFPLNARK

SEQ ID NO: 28873 - protein, 8 aa, Borrelia burgdorferi
FPLNARKV

SEQ ID NO: 28874 - protein, 8 aa, Borrelia burgdorferi
PLNARKVD

SEQ ID NO: 28875 - protein, 8 aa, Borrelia burgdorferi
LNARKVDK

SEQ ID NO: 28876 - protein, 8 aa, Borrelia burgdorferi
NARKVDKE

SEQ ID NO: 28877 - protein, 8 aa, Borrelia burgdorferi
ARKVDKEK

SEQ ID NO: 28878 - protein, 8 aa, Borrelia burgdorferi
RKVDKEKL

SEQ ID NO: 28879 - protein, 8 aa, Borrelia burgdorferi
KVDKEKLK

SEQ ID NO: 28880 - protein, 8 aa, Borrelia burgdorferi
VDKEKLKD

SEQ ID NO: 28881 - protein, 8 aa, Borrelia burgdorferi
DKEKLKDF

SEQ ID NO: 28882 - protein, 8 aa, Borrelia burgdorferi
KEKLKDFV

SEQ ID NO: 28883 - protein, 8 aa, Borrelia burgdorferi
EKLKDFVN

SEQ ID NO: 28884 - protein, 8 aa, Borrelia burgdorferi
KLKDFVNM

SEQ ID NO: 28885 - protein, 8 aa, Borrelia burgdorferi
LKDFVNMD

SEQ ID NO: 28886 - protein, 8 aa, Borrelia burgdorferi
KDFVNMDL

SEQ ID NO: 28887 - protein, 8 aa, Borrelia burgdorferi
DFVNMDLE

SEQ ID NO: 28888 - protein, 8 aa, Borrelia burgdorferi
FVNMDLEF

SEQ ID NO: 28889 - protein, 8 aa, Borrelia burgdorferi
VNMDLEFV

SEQ ID NO: 28890 - protein, 8 aa, Borrelia burgdorferi
NMDLEFVN

SEQ ID NO: 28891 - protein, 8 aa, Borrelia burgdorferi
MDLEFVNY

SEQ ID NO: 28892 - protein, 8 aa, Borrelia burgdorferi
DLEFVNYK

SEQ ID NO: 28893 - protein, 8 aa, Borrelia burgdorferi
LEFVNYKG

SEQ ID NO: 28894 - protein, 8 aa, Borrelia burgdorferi
EFVNYKGP

SEQ ID NO: 28895 - protein, 8 aa, Borrelia burgdorferi
FVNYKGPY

SEQ ID NO: 28896 - protein, 8 aa, Borrelia burgdorferi
VNYKGPYD

SEQ ID NO: 28897 - protein, 8 aa, Borrelia burgdorferi
NYKGPYDS

SEQ ID NO: 28898 - protein, 8 aa, Borrelia burgdorferi
YKGPYDST

SEQ ID NO: 28899 - protein, 8 aa, Borrelia burgdorferi
KGPYDSTN

SEQ ID NO: 28900 - protein, 8 aa, Borrelia burgdorferi
GPYDSTNT

SEQ ID NO: 28901 - protein, 8 aa, Borrelia burgdorferi
PYDSTNTY

SEQ ID NO: 28902 - protein, 8 aa, Borrelia burgdorferi
YDSTNTYE

SEQ ID NO: 28903 - protein, 8 aa, Borrelia burgdorferi
DSTNTYEQ

SEQ ID NO: 28904 - protein, 8 aa, Borrelia burgdorferi
STNTYEQI

SEQ ID NO: 28905 - protein, 8 aa, Borrelia burgdorferi
TNTYEQIV

SEQ ID NO: 28906 - protein, 8 aa, Borrelia burgdorferi
NTYEQIVG

SEQ ID NO: 28907 - protein, 8 aa, Borrelia burgdorferi
TYEQIVGI

SEQ ID NO: 28908 - protein, 8 aa, Borrelia burgdorferi
YEQIVGIG

SEQ ID NO: 28909 - protein, 8 aa, Borrelia burgdorferi
EQIVGIGE

SEQ ID NO: 28910 - protein, 8 aa, Borrelia burgdorferi
QIVGIGEF

SEQ ID NO: 28911 - protein, 8 aa, Borrelia burgdorferi
IVGIGEFL

SEQ ID NO: 28912 - protein, 8 aa, Borrelia burgdorferi
VGIGEFLA

SEQ ID NO: 28913 - protein, 8 aa, Borrelia burgdorferi
GIGEFLAR

SEQ ID NO: 28914 - protein, 8 aa, Borrelia burgdorferi
IGEFLARP

SEQ ID NO: 28915 - protein, 8 aa, Borrelia burgdorferi
GEFLARPL

SEQ ID NO: 28916 - protein, 8 aa, Borrelia burgdorferi
EFLARPLT

SEQ ID NO: 28917 - protein, 8 aa, Borrelia burgdorferi
FLARPLTN

SEQ ID NO: 28918 - protein, 8 aa, Borrelia burgdorferi
LARPLTNS

SEQ ID NO: 28919 - protein, 8 aa, Borrelia burgdorferi
ARPLTNSN

SEQ ID NO: 28920 - protein, 8 aa, Borrelia burgdorferi
RPLTNSNS

SEQ ID NO: 28921 - protein, 8 aa, Borrelia burgdorferi
PLTNSNSN

SEQ ID NO: 28922 - protein, 8 aa, Borrelia burgdorferi
LTNSNSNS

SEQ ID NO: 28923 - protein, 8 aa, Borrelia burgdorferi
TNSNSNSS

SEQ ID NO: 28924 - protein, 8 aa, Borrelia burgdorferi
NSNSNSSY

SEQ ID NO: 28925 - protein, 8 aa, Borrelia burgdorferi
SNSNSSYY

SEQ ID NO: 28926 - protein, 8 aa, Borrelia burgdorferi
NSNSSYYG

SEQ ID NO: 28927 - protein, 8 aa, Borrelia burgdorferi
SNSSYYGK

SEQ ID NO: 28928 - protein, 8 aa, Borrelia burgdorferi
NSSYYGKY

SEQ ID NO: 28929 - protein, 8 aa, Borrelia burgdorferi
SSYYGKYF

SEQ ID NO: 28930 - protein, 8 aa, Borrelia burgdorferi
SYYGKYFI

SEQ ID NO: 28931 - protein, 8 aa, Borrelia burgdorferi
YYGKYFIN

SEQ ID NO: 28932 - protein, 8 aa, Borrelia burgdorferi
YGKYFINR

SEQ ID NO: 28933 - protein, 8 aa, Borrelia burgdorferi
GKYFINRF

SEQ ID NO: 28934 - protein, 8 aa, Borrelia burgdorferi
KYFINRFI

SEQ ID NO: 28935 - protein, 8 aa, Borrelia burgdorferi
YFINRFID

SEQ ID NO: 28936 - protein, 8 aa, Borrelia burgdorferi
FINRFIDD

SEQ ID NO: 28937 - protein, 8 aa, Borrelia burgdorferi
INRFIDDQ

SEQ ID NO: 28938 - protein, 8 aa, Borrelia burgdorferi
NRFIDDQD

SEQ ID NO: 28939 - protein, 8 aa, Borrelia burgdorferi
RFIDDQDK

SEQ ID NO: 28940 - protein, 8 aa, Borrelia burgdorferi
FIDDQDKK

SEQ ID NO: 28941 - protein, 8 aa, Borrelia burgdorferi
IDDQDKKA

SEQ ID NO: 28942 - protein, 8 aa, Borrelia burgdorferi
DDQDKKAS

SEQ ID NO: 28943 - protein, 8 aa, Borrelia burgdorferi
DQDKKASV

SEQ ID NO: 28944 - protein, 8 aa, Borrelia burgdorferi
QDKKASVD

SEQ ID NO: 28945 - protein, 8 aa, Borrelia burgdorferi
DKKASVDV

SEQ ID NO: 28946 - protein, 8 aa, Borrelia burgdorferi
KKASVDVF

SEQ ID NO: 28947 - protein, 8 aa, Borrelia burgdorferi
KASVDVFS

SEQ ID NO: 28948 - protein, 8 aa, Borrelia burgdorferi
ASVDVFSI

SEQ ID NO: 28949 - protein, 8 aa, Borrelia burgdorferi
SVDVFSIS

SEQ ID NO: 28950 - protein, 8 aa, Borrelia burgdorferi
VDVFSISS

SEQ ID NO: 28951 - protein, 8 aa, Borrelia burgdorferi
DVFSISSK

SEQ ID NO: 28952 - protein, 8 aa, Borrelia burgdorferi
VFSISSKS

SEQ ID NO: 28953 - protein, 8 aa, Borrelia burgdorferi
FSISSKSE

SEQ ID NO: 28954 - protein, 8 aa, Borrelia burgdorferi
SISSKSEL

SEQ ID NO: 28955 - protein, 8 aa, Borrelia burgdorferi
ISSKSELD

SEQ ID NO: 28956 - protein, 8 aa, Borrelia burgdorferi
SSKSELDS

SEQ ID NO: 28957 - protein, 8 aa, Borrelia burgdorferi
SKSELDSI

SEQ ID NO: 28958 - protein, 8 aa, Borrelia burgdorferi
KSELDSIL

SEQ ID NO: 28959 - protein, 8 aa, Borrelia burgdorferi
SELDSILN

SEQ ID NO: 28960 - protein, 8 aa, Borrelia burgdorferi
ELDSILNL

SEQ ID NO: 28961 - protein, 8 aa, Borrelia burgdorferi
LDSILNLR

SEQ ID NO: 28962 - protein, 8 aa, Borrelia burgdorferi
DSILNLRR

SEQ ID NO: 28963 - protein, 8 aa, Borrelia burgdorferi
SILNLRRI

SEQ ID NO: 28964 - protein, 8 aa, Borrelia burgdorferi
ILNLRRIL

SEQ ID NO: 28965 - protein, 8 aa, Borrelia burgdorferi
LNLRRILT

SEQ ID NO: 28966 - protein, 8 aa, Borrelia burgdorferi
NLRRILTG

SEQ ID NO: 28967 - protein, 8 aa, Borrelia burgdorferi
LRRILTGY

SEQ ID NO: 28968 - protein, 8 aa, Borrelia burgdorferi
RRILTGYI

SEQ ID NO: 28969 - protein, 8 aa, Borrelia burgdorferi
RILTGYII

SEQ ID NO: 28970 - protein, 8 aa, Borrelia burgdorferi
ILTGYIIK

SEQ ID NO: 28971 - protein, 8 aa, Borrelia burgdorferi
LTGYIIKS

SEQ ID NO: 28972 - protein, 8 aa, Borrelia burgdorferi
TGYIIKSF

SEQ ID NO: 28973 - protein, 8 aa, Borrelia burgdorferi
GYIIKSFD

SEQ ID NO: 28974 - protein, 8 aa, Borrelia burgdorferi
YIIKSFDY

SEQ ID NO: 28975 - protein, 8 aa, Borrelia burgdorferi
IIKSFDYD

SEQ ID NO: 28976 - protein, 8 aa, Borrelia burgdorferi
IKSFDYDR

SEQ ID NO: 28977 - protein, 8 aa, Borrelia burgdorferi
KSFDYDRS

SEQ ID NO: 28978 - protein, 8 aa, Borrelia burgdorferi
SFDYDRSS

SEQ ID NO: 28979 - protein, 8 aa, Borrelia burgdorferi
FDYDRSSA

SEQ ID NO: 28980 - protein, 8 aa, Borrelia burgdorferi
DYDRSSAE

SEQ ID NO: 28981 - protein, 8 aa, Borrelia burgdorferi
YDRSSAEL

SEQ ID NO: 28982 - protein, 8 aa, Borrelia burgdorferi
DRSSAELI

SEQ ID NO: 28983 - protein, 8 aa, Borrelia burgdorferi
RSSAELIA

SEQ ID NO: 28984 - protein, 8 aa, Borrelia burgdorferi
SSAELIAK

SEQ ID NO: 28985 - protein, 8 aa, Borrelia burgdorferi
SAELIAKV

SEQ ID NO: 28986 - protein, 8 aa, Borrelia burgdorferi
AELIAKVI

SEQ ID NO: 28987 - protein, 8 aa, Borrelia burgdorferi
ELIAKVIT

SEQ ID NO: 28988 - protein, 8 aa, Borrelia burgdorferi
LIAKVITI

SEQ ID NO: 28989 - protein, 8 aa, Borrelia burgdorferi
IAKVITIY

SEQ ID NO: 28990 - protein, 8 aa, Borrelia burgdorferi
AKVITIYN

SEQ ID NO: 28991 - protein, 8 aa, Borrelia burgdorferi
KVITIYNA

SEQ ID NO: 28992 - protein, 8 aa, Borrelia burgdorferi
VITIYNAV

SEQ ID NO: 28993 - protein, 8 aa, Borrelia burgdorferi
ITIYNAVY

SEQ ID NO: 28994 - protein, 8 aa, Borrelia burgdorferi
TIYNAVYR

SEQ ID NO: 28995 - protein, 8 aa, Borrelia burgdorferi
IYNAVYRG

SEQ ID NO: 28996 - protein, 8 aa, Borrelia burgdorferi
YNAVYRGD

SEQ ID NO: 28997 - protein, 8 aa, Borrelia burgdorferi
NAVYRGDL

SEQ ID NO: 28998 - protein, 8 aa, Borrelia burgdorferi
AVYRGDLD

SEQ ID NO: 28999 - protein, 8 aa, Borrelia burgdorferi
VYRGDLDY

SEQ ID NO: 29000 - protein, 8 aa, Borrelia burgdorferi
YRGDLDYY

SEQ ID NO: 29001 - protein, 8 aa, Borrelia burgdorferi
RGDLDYYK

SEQ ID NO: 29002 - protein, 8 aa, Borrelia burgdorferi
GDLDYYKG

SEQ ID NO: 29003 - protein, 8 aa, Borrelia burgdorferi
DLDYYKGF

SEQ ID NO: 29004 - protein, 8 aa, Borrelia burgdorferi
LDYYKGFY

SEQ ID NO: 29005 - protein, 8 aa, Borrelia burgdorferi
DYYKGFYI

SEQ ID NO: 29006 - protein, 8 aa, Borrelia burgdorferi
YYKGFYIE

SEQ ID NO: 29007 - protein, 8 aa, Borrelia burgdorferi
YKGFYIEP

SEQ ID NO: 29008 - protein, 8 aa, Borrelia burgdorferi
KGFYIEPA

SEQ ID NO: 29009 - protein, 8 aa, Borrelia burgdorferi
GFYIEPAL

SEQ ID NO: 29010 - protein, 8 aa, Borrelia burgdorferi
FYIEPALK

SEQ ID NO: 29011 - protein, 8 aa, Borrelia burgdorferi
YIEPALKS

SEQ ID NO: 29012 - protein, 8 aa, Borrelia burgdorferi
IEPALKSL

SEQ ID NO: 29013 - protein, 8 aa, Borrelia burgdorferi
EPALKSLT

SEQ ID NO: 29014 - protein, 8 aa, Borrelia burgdorferi
PALKSLTK

SEQ ID NO: 29015 - protein, 8 aa, Borrelia burgdorferi
ALKSLTKE

SEQ ID NO: 29016 - protein, 8 aa, Borrelia burgdorferi
LKSLTKEN

SEQ ID NO: 29017 - protein, 8 aa, Borrelia burgdorferi
KSLTKENA

SEQ ID NO: 29018 - protein, 8 aa, Borrelia burgdorferi
SLTKENAG

SEQ ID NO: 29019 - protein, 8 aa, Borrelia burgdorferi
LTKENAGL

SEQ ID NO: 29020 - protein, 8 aa, Borrelia burgdorferi
TKENAGLS

SEQ ID NO: 29021 - protein, 8 aa, Borrelia burgdorferi
KENAGLSR

SEQ ID NO: 29022 - protein, 8 aa, Borrelia burgdorferi
ENAGLSRV

SEQ ID NO: 29023 - protein, 8 aa, Borrelia burgdorferi
NAGLSRVY

SEQ ID NO: 29024 - protein, 8 aa, Borrelia burgdorferi
AGLSRVYS

SEQ ID NO: 29025 - protein, 8 aa, Borrelia burgdorferi
GLSRVYSQ

SEQ ID NO: 29026 - protein, 8 aa, Borrelia burgdorferi
LSRVYSQW

SEQ ID NO: 29027 - protein, 8 aa, Borrelia burgdorferi
SRVYSQWA

SEQ ID NO: 29028 - protein, 8 aa, Borrelia burgdorferi
RVYSQWAG

SEQ ID NO: 29029 - protein, 8 aa, Borrelia burgdorferi
VYSQWAGK

SEQ ID NO: 29030 - protein, 8 aa, Borrelia burgdorferi
YSQWAGKT

SEQ ID NO: 29031 - protein, 8 aa, Borrelia burgdorferi
SQWAGKTQ

SEQ ID NO: 29032 - protein, 8 aa, Borrelia burgdorferi
QWAGKTQI

SEQ ID NO: 29033 - protein, 8 aa, Borrelia burgdorferi
WAGKTQIF

SEQ ID NO: 29034 - protein, 8 aa, Borrelia burgdorferi
AGKTQIFI

SEQ ID NO: 29035 - protein, 8 aa, Borrelia burgdorferi
GKTQIFIP

SEQ ID NO: 29036 - protein, 8 aa, Borrelia burgdorferi
KTQIFIPL

SEQ ID NO: 29037 - protein, 8 aa, Borrelia burgdorferi
TQIFIPLK

SEQ ID NO: 29038 - protein, 8 aa, Borrelia burgdorferi
QIFIPLKK

SEQ ID NO: 29039 - protein, 8 aa, Borrelia burgdorferi
IFIPLKKD

SEQ ID NO: 29040 - protein, 8 aa, Borrelia burgdorferi
FIPLKKDI

SEQ ID NO: 29041 - protein, 8 aa, Borrelia burgdorferi
IPLKKDIL

SEQ ID NO: 29042 - protein, 8 aa, Borrelia burgdorferi
PLKKDILS

SEQ ID NO: 29043 - protein, 8 aa, Borrelia burgdorferi
LKKDILSG

SEQ ID NO: 29044 - protein, 8 aa, Borrelia burgdorferi
KKDILSGN

SEQ ID NO: 29045 - protein, 8 aa, Borrelia burgdorferi
KDILSGNI

SEQ ID NO: 29046 - protein, 8 aa, Borrelia burgdorferi
DILSGNIE

SEQ ID NO: 29047 - protein, 8 aa, Borrelia burgdorferi
ILSGNIES

SEQ ID NO: 29048 - protein, 8 aa, Borrelia burgdorferi
LSGNIESD

SEQ ID NO: 29049 - protein, 8 aa, Borrelia burgdorferi
SGNIESDI

SEQ ID NO: 29050 - protein, 8 aa, Borrelia burgdorferi
GNIESDID

SEQ ID NO: 29051 - protein, 8 aa, Borrelia burgdorferi
NIESDIDI

SEQ ID NO: 29052 - protein, 8 aa, Borrelia burgdorferi
IESDIDID

SEQ ID NO: 29053 - protein, 8 aa, Borrelia burgdorferi
ESDIDIDS

SEQ ID NO: 29054 - protein, 8 aa, Borrelia burgdorferi
SDIDIDSL

SEQ ID NO: 29055 - protein, 8 aa, Borrelia burgdorferi
DIDIDSLV

SEQ ID NO: 29056 - protein, 8 aa, Borrelia burgdorferi
IDIDSLVT

SEQ ID NO: 29057 - protein, 8 aa, Borrelia burgdorferi
DIDSLVTD

SEQ ID NO: 29058 - protein, 8 aa, Borrelia burgdorferi
IDSLVTDK

SEQ ID NO: 29059 - protein, 8 aa, Borrelia burgdorferi
DSLVTDKV

SEQ ID NO: 29060 - protein, 8 aa, Borrelia burgdorferi
SLVTDKVI

SEQ ID NO: 29061 - protein, 8 aa, Borrelia burgdorferi
LVTDKVIA

SEQ ID NO: 29062 - protein, 8 aa, Borrelia burgdorferi
VTDKVIAA

SEQ ID NO: 29063 - protein, 8 aa, Borrelia burgdorferi
TDKVIAAL

SEQ ID NO: 29064 - protein, 8 aa, Borrelia burgdorferi
DKVIAALL

SEQ ID NO: 29065 - protein, 8 aa, Borrelia burgdorferi
KVIAALLS

SEQ ID NO: 29066 - protein, 8 aa, Borrelia burgdorferi
VIAALLSE

SEQ ID NO: 29067 - protein, 8 aa, Borrelia burgdorferi
IAALLSEN

SEQ ID NO: 29068 - protein, 8 aa, Borrelia burgdorferi
AALLSENE

SEQ ID NO: 29069 - protein, 8 aa, Borrelia burgdorferi
ALLSENEA

SEQ ID NO: 29070 - protein, 8 aa, Borrelia burgdorferi
LLSENEAG

SEQ ID NO: 29071 - protein, 8 aa, Borrelia burgdorferi
LSENEAGV

SEQ ID NO: 29072 - protein, 8 aa, Borrelia burgdorferi
SENEAGVN

SEQ ID NO: 29073 - protein, 8 aa, Borrelia burgdorferi
ENEAGVNF

SEQ ID NO: 29074 - protein, 8 aa, Borrelia burgdorferi
NEAGVNFA

SEQ ID NO: 29075 - protein, 8 aa, Borrelia burgdorferi
EAGVNFAR

SEQ ID NO: 29076 - protein, 8 aa, Borrelia burgdorferi
AGVNFARD

SEQ ID NO: 29077 - protein, 8 aa, Borrelia burgdorferi
GVNFARDI

SEQ ID NO: 29078 - protein, 8 aa, Borrelia burgdorferi
VNFARDIT

SEQ ID NO: 29079 - protein, 8 aa, Borrelia burgdorferi
NFARDITD

SEQ ID NO: 29080 - protein, 8 aa, Borrelia burgdorferi
FARDITDI

SEQ ID NO: 29081 - protein, 8 aa, Borrelia burgdorferi
ARDITDIQ

SEQ ID NO: 29082 - protein, 8 aa, Borrelia burgdorferi
RDITDIQG

SEQ ID NO: 29083 - protein, 8 aa, Borrelia burgdorferi
DITDIQGE

SEQ ID NO: 29084 - protein, 8 aa, Borrelia burgdorferi
ITDIQGET

SEQ ID NO: 29085 - protein, 8 aa, Borrelia burgdorferi
TDIQGETH

SEQ ID NO: 29086 - protein, 8 aa, Borrelia burgdorferi
DIQGETHK

SEQ ID NO: 29087 - protein, 8 aa, Borrelia burgdorferi
IQGETHKA

SEQ ID NO: 29088 - protein, 8 aa, Borrelia burgdorferi
QGETHKAD

SEQ ID NO: 29089 - protein, 8 aa, Borrelia burgdorferi
GETHKADQ

SEQ ID NO: 29090 - protein, 8 aa, Borrelia burgdorferi
ETHKADQD

SEQ ID NO: 29091 - protein, 8 aa, Borrelia burgdorferi
THKADQDK

SEQ ID NO: 29092 - protein, 8 aa, Borrelia burgdorferi
HKADQDKI

SEQ ID NO: 29093 - protein, 8 aa, Borrelia burgdorferi
KADQDKID

SEQ ID NO: 29094 - protein, 8 aa, Borrelia burgdorferi
ADQDKIDT

SEQ ID NO: 29095 - protein, 8 aa, Borrelia burgdorferi
DQDKIDTE

SEQ ID NO: 29096 - protein, 8 aa, Borrelia burgdorferi
QDKIDTEL

SEQ ID NO: 29097 - protein, 8 aa, Borrelia burgdorferi
DKIDTELD

SEQ ID NO: 29098 - protein, 8 aa, Borrelia burgdorferi
KIDTELDN

SEQ ID NO: 29099 - protein, 8 aa, Borrelia burgdorferi
IDTELDNI

SEQ ID NO: 29100 - protein, 8 aa, Borrelia burgdorferi
DTELDNIH

SEQ ID NO: 29101 - protein, 8 aa, Borrelia burgdorferi
TELDNIHE

SEQ ID NO: 29102 - protein, 8 aa, Borrelia burgdorferi
ELDNIHES

SEQ ID NO: 29103 - protein, 8 aa, Borrelia burgdorferi
LDNIHESD

SEQ ID NO: 29104 - protein, 8 aa, Borrelia burgdorferi
DNIHESDS

SEQ ID NO: 29105 - protein, 8 aa, Borrelia burgdorferi
NIHESDSN

SEQ ID NO: 29106 - protein, 8 aa, Borrelia burgdorferi
IHESDSNI

SEQ ID NO: 29107 - protein, 8 aa, Borrelia burgdorferi
HESDSNIT

SEQ ID NO: 29108 - protein, 8 aa, Borrelia burgdorferi
ESDSNITE

SEQ ID NO: 29109 - protein, 8 aa, Borrelia burgdorferi
SDSNITET

SEQ ID NO: 29110 - protein, 8 aa, Borrelia burgdorferi
DSNITETI

SEQ ID NO: 29111 - protein, 8 aa, Borrelia burgdorferi
SNITETIE

SEQ ID NO: 29112 - protein, 8 aa, Borrelia burgdorferi
NITETIEN

SEQ ID NO: 29113 - protein, 8 aa, Borrelia burgdorferi
ITETIENL

SEQ ID NO: 29114 - protein, 8 aa, Borrelia burgdorferi
TETIENLR

SEQ ID NO: 29115 - protein, 8 aa, Borrelia burgdorferi
ETIENLRD

SEQ ID NO: 29116 - protein, 8 aa, Borrelia burgdorferi
TIENLRDQ

SEQ ID NO: 29117 - protein, 8 aa, Borrelia burgdorferi
IENLRDQL

SEQ ID NO: 29118 - protein, 8 aa, Borrelia burgdorferi
ENLRDQLE

SEQ ID NO: 29119 - protein, 8 aa, Borrelia burgdorferi
NLRDQLEK

SEQ ID NO: 29120 - protein, 8 aa, Borrelia burgdorferi
LRDQLEKA

SEQ ID NO: 29121 - protein, 8 aa, Borrelia burgdorferi
RDQLEKAT

SEQ ID NO: 29122 - protein, 8 aa, Borrelia burgdorferi
DQLEKATD

SEQ ID NO: 29123 - protein, 8 aa, Borrelia burgdorferi
QLEKATDE

SEQ ID NO: 29124 - protein, 8 aa, Borrelia burgdorferi
LEKATDEE

SEQ ID NO: 29125 - protein, 8 aa, Borrelia burgdorferi
EKATDEEH

SEQ ID NO: 29126 - protein, 8 aa, Borrelia burgdorferi
KATDEEHK

SEQ ID NO: 29127 - protein, 8 aa, Borrelia burgdorferi
ATDEEHKK

SEQ ID NO: 29128 - protein, 8 aa, Borrelia burgdorferi
TDEEHKKE

SEQ ID NO: 29129 - protein, 8 aa, Borrelia burgdorferi
DEEHKKEI

SEQ ID NO: 29130 - protein, 8 aa, Borrelia burgdorferi
EEHKKEIE

SEQ ID NO: 29131 - protein, 8 aa, Borrelia burgdorferi
EHKKEIES

SEQ ID NO: 29132 - protein, 8 aa, Borrelia burgdorferi
HKKEIESQ

SEQ ID NO: 29133 - protein, 8 aa, Borrelia burgdorferi
KKEIESQV

SEQ ID NO: 29134 - protein, 8 aa, Borrelia burgdorferi
KEIESQVD

SEQ ID NO: 29135 - protein, 8 aa, Borrelia burgdorferi
EIESQVDA

SEQ ID NO: 29136 - protein, 8 aa, Borrelia burgdorferi
IESQVDAK

SEQ ID NO: 29137 - protein, 8 aa, Borrelia burgdorferi
ESQVDAKK

SEQ ID NO: 29138 - protein, 8 aa, Borrelia burgdorferi
SQVDAKKK

SEQ ID NO: 29139 - protein, 8 aa, Borrelia burgdorferi
QVDAKKKE

SEQ ID NO: 29140 - protein, 8 aa, Borrelia burgdorferi
VDAKKKEK

SEQ ID NO: 29141 - protein, 8 aa, Borrelia burgdorferi
DAKKKEKE

SEQ ID NO: 29142 - protein, 8 aa, Borrelia burgdorferi
AKKKEKEE

SEQ ID NO: 29143 - protein, 8 aa, Borrelia burgdorferi
KKKEKEEL

SEQ ID NO: 29144 - protein, 8 aa, Borrelia burgdorferi
KKEKEELD

SEQ ID NO: 29145 - protein, 8 aa, Borrelia burgdorferi
KEKEELDK

SEQ ID NO: 29146 - protein, 8 aa, Borrelia burgdorferi
EKEELDKK

SEQ ID NO: 29147 - protein, 8 aa, Borrelia burgdorferi
KEELDKKA

SEQ ID NO: 29148 - protein, 8 aa, Borrelia burgdorferi
EELDKKAI

SEQ ID NO: 29149 - protein, 8 aa, Borrelia burgdorferi
ELDKKAIN

SEQ ID NO: 29150 - protein, 8 aa, Borrelia burgdorferi
LDKKAINL

SEQ ID NO: 29151 - protein, 8 aa, Borrelia burgdorferi
DKKAINLD

SEQ ID NO: 29152 - protein, 8 aa, Borrelia burgdorferi
KKAINLDK

SEQ ID NO: 29153 - protein, 8 aa, Borrelia burgdorferi
KAINLDKA

SEQ ID NO: 29154 - protein, 8 aa, Borrelia burgdorferi
AINLDKAQ

SEQ ID NO: 29155 - protein, 8 aa, Borrelia burgdorferi
INLDKAQQ

SEQ ID NO: 29156 - protein, 8 aa, Borrelia burgdorferi
NLDKAQQK

SEQ ID NO: 29157 - protein, 8 aa, Borrelia burgdorferi
LDKAQQKL

SEQ ID NO: 29158 - protein, 8 aa, Borrelia burgdorferi
DKAQQKLD

SEQ ID NO: 29159 - protein, 8 aa, Borrelia burgdorferi
KAQQKLDS

SEQ ID NO: 29160 - protein, 8 aa, Borrelia burgdorferi
AQQKLDSA

SEQ ID NO: 29161 - protein, 8 aa, Borrelia burgdorferi
QQKLDSAE

SEQ ID NO: 29162 - protein, 8 aa, Borrelia burgdorferi
QKLDSAED

SEQ ID NO: 29163 - protein, 8 aa, Borrelia burgdorferi
KLDSAEDN

SEQ ID NO: 29164 - protein, 8 aa, Borrelia burgdorferi
LDSAEDNL

SEQ ID NO: 29165 - protein, 8 aa, Borrelia burgdorferi
DSAEDNLD

SEQ ID NO: 29166 - protein, 8 aa, Borrelia burgdorferi
SAEDNLDV

SEQ ID NO: 29167 - protein, 8 aa, Borrelia burgdorferi
AEDNLDVQ

SEQ ID NO: 29168 - protein, 8 aa, Borrelia burgdorferi
EDNLDVQR

SEQ ID NO: 29169 - protein, 8 aa, Borrelia burgdorferi
DNLDVQRD

SEQ ID NO: 29170 - protein, 8 aa, Borrelia burgdorferi
NLDVQRDT

SEQ ID NO: 29171 - protein, 8 aa, Borrelia burgdorferi
LDVQRDTV

SEQ ID NO: 29172 - protein, 8 aa, Borrelia burgdorferi
DVQRDTVR

SEQ ID NO: 29173 - protein, 8 aa, Borrelia burgdorferi
VQRDTVRE

SEQ ID NO: 29174 - protein, 8 aa, Borrelia burgdorferi
QRDTVREK

SEQ ID NO: 29175 - protein, 8 aa, Borrelia burgdorferi
RDTVREKI

SEQ ID NO: 29176 - protein, 8 aa, Borrelia burgdorferi
DTVREKIQ

SEQ ID NO: 29177 - protein, 8 aa, Borrelia burgdorferi
TVREKIQE

SEQ ID NO: 29178 - protein, 8 aa, Borrelia burgdorferi
VREKIQED

SEQ ID NO: 29179 - protein, 8 aa, Borrelia burgdorferi
REKIQEDI

SEQ ID NO: 29180 - protein, 8 aa, Borrelia burgdorferi
EKIQEDIN

SEQ ID NO: 29181 - protein, 8 aa, Borrelia burgdorferi
KIQEDINE

SEQ ID NO: 29182 - protein, 8 aa, Borrelia burgdorferi
IQEDINEI

SEQ ID NO: 29183 - protein, 8 aa, Borrelia burgdorferi
QEDINEIN

SEQ ID NO: 29184 - protein, 8 aa, Borrelia burgdorferi
EDINEINK

SEQ ID NO: 29185 - protein, 8 aa, Borrelia burgdorferi
DINEINKE

SEQ ID NO: 29186 - protein, 8 aa, Borrelia burgdorferi
INEINKEK

SEQ ID NO: 29187 - protein, 8 aa, Borrelia burgdorferi
NEINKEKN

SEQ ID NO: 29188 - protein, 8 aa, Borrelia burgdorferi
EINKEKNL

SEQ ID NO: 29189 - protein, 8 aa, Borrelia burgdorferi
INKEKNLP

SEQ ID NO: 29190 - protein, 8 aa, Borrelia burgdorferi
NKEKNLPK

SEQ ID NO: 29191 - protein, 8 aa, Borrelia burgdorferi
KEKNLPKP

SEQ ID NO: 29192 - protein, 8 aa, Borrelia burgdorferi
EKNLPKPG

SEQ ID NO: 29193 - protein, 8 aa, Borrelia burgdorferi
KNLPKPGD

SEQ ID NO: 29194 - protein, 8 aa, Borrelia burgdorferi
NLPKPGDV

SEQ ID NO: 29195 - protein, 8 aa, Borrelia burgdorferi
LPKPGDVS

SEQ ID NO: 29196 - protein, 8 aa, Borrelia burgdorferi
PKPGDVSS

SEQ ID NO: 29197 - protein, 8 aa, Borrelia burgdorferi
KPGDVSSP

SEQ ID NO: 29198 - protein, 8 aa, Borrelia burgdorferi
PGDVSSPK

SEQ ID NO: 29199 - protein, 8 aa, Borrelia burgdorferi
GDVSSPKV

SEQ ID NO: 29200 - protein, 8 aa, Borrelia burgdorferi
DVSSPKVD

SEQ ID NO: 29201 - protein, 8 aa, Borrelia burgdorferi
VSSPKVDK

SEQ ID NO: 29202 - protein, 8 aa, Borrelia burgdorferi
SSPKVDKQ

SEQ ID NO: 29203 - protein, 8 aa, Borrelia burgdorferi
SPKVDKQL

SEQ ID NO: 29204 - protein, 8 aa, Borrelia burgdorferi
PKVDKQLQ

SEQ ID NO: 29205 - protein, 8 aa, Borrelia burgdorferi
KVDKQLQI

SEQ ID NO: 29206 - protein, 8 aa, Borrelia burgdorferi
VDKQLQIK

SEQ ID NO: 29207 - protein, 8 aa, Borrelia burgdorferi
DKQLQIKE

SEQ ID NO: 29208 - protein, 8 aa, Borrelia burgdorferi
KQLQIKES

SEQ ID NO: 29209 - protein, 8 aa, Borrelia burgdorferi
QLQIKESL

SEQ ID NO: 29210 - protein, 8 aa, Borrelia burgdorferi
LQIKESLE

SEQ ID NO: 29211 - protein, 8 aa, Borrelia burgdorferi
QIKESLED

SEQ ID NO: 29212 - protein, 8 aa, Borrelia burgdorferi
IKESLEDL

SEQ ID NO: 29213 - protein, 8 aa, Borrelia burgdorferi
KESLEDLQ

SEQ ID NO: 29214 - protein, 8 aa, Borrelia burgdorferi
ESLEDLQE

SEQ ID NO: 29215 - protein, 8 aa, Borrelia burgdorferi
SLEDLQEQ

SEQ ID NO: 29216 - protein, 8 aa, Borrelia burgdorferi
LEDLQEQL

SEQ ID NO: 29217 - protein, 8 aa, Borrelia burgdorferi
EDLQEQLK

SEQ ID NO: 29218 - protein, 8 aa, Borrelia burgdorferi
DLQEQLKE

SEQ ID NO: 29219 - protein, 8 aa, Borrelia burgdorferi
LQEQLKEA

SEQ ID NO: 29220 - protein, 8 aa, Borrelia burgdorferi
QEQLKEAG

SEQ ID NO: 29221 - protein, 8 aa, Borrelia burgdorferi
EQLKEAGD

SEQ ID NO: 29222 - protein, 8 aa, Borrelia burgdorferi
QLKEAGDE

SEQ ID NO: 29223 - protein, 8 aa, Borrelia burgdorferi
LKEAGDEN

SEQ ID NO: 29224 - protein, 8 aa, Borrelia burgdorferi
KEAGDENQ

SEQ ID NO: 29225 - protein, 8 aa, Borrelia burgdorferi
EAGDENQK

SEQ ID NO: 29226 - protein, 8 aa, Borrelia burgdorferi
AGDENQKR

SEQ ID NO: 29227 - protein, 8 aa, Borrelia burgdorferi
GDENQKRE

SEQ ID NO: 29228 - protein, 8 aa, Borrelia burgdorferi
DENQKREI

SEQ ID NO: 29229 - protein, 8 aa, Borrelia burgdorferi
ENQKREIE

SEQ ID NO: 29230 - protein, 8 aa, Borrelia burgdorferi
NQKREIEK

SEQ ID NO: 29231 - protein, 8 aa, Borrelia burgdorferi
QKREIEKQ

SEQ ID NO: 29232 - protein, 8 aa, Borrelia burgdorferi
KREIEKQI

SEQ ID NO: 29233 - protein, 8 aa, Borrelia burgdorferi
REIEKQIE

SEQ ID NO: 29234 - protein, 8 aa, Borrelia burgdorferi
EIEKQIEI

SEQ ID NO: 29235 - protein, 8 aa, Borrelia burgdorferi
IEKQIEIK

SEQ ID NO: 29236 - protein, 8 aa, Borrelia burgdorferi
EKQIEIKK

SEQ ID NO: 29237 - protein, 8 aa, Borrelia burgdorferi
KQIEIKKR

SEQ ID NO: 29238 - protein, 8 aa, Borrelia burgdorferi
QIEIKKRD

SEQ ID NO: 29239 - protein, 8 aa, Borrelia burgdorferi
IEIKKRDE

SEQ ID NO: 29240 - protein, 8 aa, Borrelia burgdorferi
EIKKRDEE

SEQ ID NO: 29241 - protein, 8 aa, Borrelia burgdorferi
IKKRDEEL

SEQ ID NO: 29242 - protein, 8 aa, Borrelia burgdorferi
KKRDEELL

SEQ ID NO: 29243 - protein, 8 aa, Borrelia burgdorferi
KRDEELLK

SEQ ID NO: 29244 - protein, 8 aa, Borrelia burgdorferi
RDEELLKS

SEQ ID NO: 29245 - protein, 8 aa, Borrelia burgdorferi
DEELLKSK

SEQ ID NO: 29246 - protein, 8 aa, Borrelia burgdorferi
EELLKSKD

SEQ ID NO: 29247 - protein, 8 aa, Borrelia burgdorferi
ELLKSKDG

SEQ ID NO: 29248 - protein, 8 aa, Borrelia burgdorferi
LLKSKDGK

SEQ ID NO: 29249 - protein, 8 aa, Borrelia burgdorferi
LKSKDGKV

SEQ ID NO: 29250 - protein, 8 aa, Borrelia burgdorferi
KSKDGKVS

SEQ ID NO: 29251 - protein, 8 aa, Borrelia burgdorferi
SKDGKVSK

SEQ ID NO: 29252 - protein, 8 aa, Borrelia burgdorferi
KDGKVSKD

SEQ ID NO: 29253 - protein, 8 aa, Borrelia burgdorferi
DGKVSKDY

SEQ ID NO: 29254 - protein, 8 aa, Borrelia burgdorferi
GKVSKDYE

SEQ ID NO: 29255 - protein, 8 aa, Borrelia burgdorferi
KVSKDYEA

SEQ ID NO: 29256 - protein, 8 aa, Borrelia burgdorferi
VSKDYEAL

SEQ ID NO: 29257 - protein, 8 aa, Borrelia burgdorferi
SKDYEALD

SEQ ID NO: 29258 - protein, 8 aa, Borrelia burgdorferi
KDYEALDL

SEQ ID NO: 29259 - protein, 8 aa, Borrelia burgdorferi
DYEALDLD

SEQ ID NO: 29260 - protein, 8 aa, Borrelia burgdorferi
YEALDLDR

SEQ ID NO: 29261 - protein, 8 aa, Borrelia burgdorferi
EALDLDRE

SEQ ID NO: 29262 - protein, 8 aa, Borrelia burgdorferi
ALDLDREL

SEQ ID NO: 29263 - protein, 8 aa, Borrelia burgdorferi
LDLDRELS

SEQ ID NO: 29264 - protein, 8 aa, Borrelia burgdorferi
DLDRELSK

SEQ ID NO: 29265 - protein, 8 aa, Borrelia burgdorferi
LDRELSKA

SEQ ID NO: 29266 - protein, 8 aa, Borrelia burgdorferi
DRELSKAS

SEQ ID NO: 29267 - protein, 8 aa, Borrelia burgdorferi
RELSKASS

SEQ ID NO: 29268 - protein, 8 aa, Borrelia burgdorferi
ELSKASSK

SEQ ID NO: 29269 - protein, 8 aa, Borrelia burgdorferi
LSKASSKE

SEQ ID NO: 29270 - protein, 8 aa, Borrelia burgdorferi
SKASSKEK

SEQ ID NO: 29271 - protein, 8 aa, Borrelia burgdorferi
KASSKEKS

SEQ ID NO: 29272 - protein, 8 aa, Borrelia burgdorferi
ASSKEKSK

SEQ ID NO: 29273 - protein, 8 aa, Borrelia burgdorferi
SSKEKSKV

SEQ ID NO: 29274 - protein, 8 aa, Borrelia burgdorferi
SKEKSKVK

SEQ ID NO: 29275 - protein, 8 aa, Borrelia burgdorferi
KEKSKVKE

SEQ ID NO: 29276 - protein, 8 aa, Borrelia burgdorferi
EKSKVKEE

SEQ ID NO: 29277 - protein, 8 aa, Borrelia burgdorferi
KSKVKEEE

SEQ ID NO: 29278 - protein, 8 aa, Borrelia burgdorferi
SKVKEEEI

SEQ ID NO: 29279 - protein, 8 aa, Borrelia burgdorferi
KVKEEEIT

SEQ ID NO: 29280 - protein, 8 aa, Borrelia burgdorferi
VKEEEITK

SEQ ID NO: 29281 - protein, 8 aa, Borrelia burgdorferi
KEEEITKG

SEQ ID NO: 29282 - protein, 8 aa, Borrelia burgdorferi
EEEITKGK

SEQ ID NO: 29283 - protein, 8 aa, Borrelia burgdorferi
EEITKGKS

SEQ ID NO: 29284 - protein, 8 aa, Borrelia burgdorferi
EITKGKSR

SEQ ID NO: 29285 - protein, 8 aa, Borrelia burgdorferi
ITKGKSRA

SEQ ID NO: 29286 - protein, 8 aa, Borrelia burgdorferi
TKGKSRAS

SEQ ID NO: 29287 - protein, 8 aa, Borrelia burgdorferi
KGKSRASL

SEQ ID NO: 29288 - protein, 8 aa, Borrelia burgdorferi
GKSRASLG

SEQ ID NO: 29289 - protein, 8 aa, Borrelia burgdorferi
KSRASLGD

SEQ ID NO: 29290 - protein, 8 aa, Borrelia burgdorferi
SRASLGDL

SEQ ID NO: 29291 - protein, 8 aa, Borrelia burgdorferi
RASLGDLN

SEQ ID NO: 29292 - protein, 8 aa, Borrelia burgdorferi
ASLGDLNN

SEQ ID NO: 29293 - protein, 8 aa, Borrelia burgdorferi
SLGDLNND

SEQ ID NO: 29294 - protein, 8 aa, Borrelia burgdorferi
LGDLNNDK

SEQ ID NO: 29295 - protein, 8 aa, Borrelia burgdorferi
GDLNNDKN

SEQ ID NO: 29296 - protein, 8 aa, Borrelia burgdorferi
DLNNDKNL

SEQ ID NO: 29297 - protein, 8 aa, Borrelia burgdorferi
LNNDKNLM

SEQ ID NO: 29298 - protein, 8 aa, Borrelia burgdorferi
NNDKNLML

SEQ ID NO: 29299 - protein, 8 aa, Borrelia burgdorferi
NDKNLMLP

SEQ ID NO: 29300 - protein, 8 aa, Borrelia burgdorferi
DKNLMLPE

SEQ ID NO: 29301 - protein, 8 aa, Borrelia burgdorferi
KNLMLPED

SEQ ID NO: 29302 - protein, 8 aa, Borrelia burgdorferi
NLMLPEDQ

SEQ ID NO: 29303 - protein, 8 aa, Borrelia burgdorferi
LMLPEDQK

SEQ ID NO: 29304 - protein, 8 aa, Borrelia burgdorferi
MLPEDQKL

SEQ ID NO: 29305 - protein, 8 aa, Borrelia burgdorferi
LPEDQKLP

SEQ ID NO: 29306 - protein, 8 aa, Borrelia burgdorferi
PEDQKLPE

SEQ ID NO: 29307 - protein, 8 aa, Borrelia burgdorferi
EDQKLPED

SEQ ID NO: 29308 - protein, 8 aa, Borrelia burgdorferi
DQKLPEDK

SEQ ID NO: 29309 - protein, 8 aa, Borrelia burgdorferi
QKLPEDKK

SEQ ID NO: 29310 - protein, 8 aa, Borrelia burgdorferi
KLPEDKKL

SEQ ID NO: 29311 - protein, 8 aa, Borrelia burgdorferi
LPEDKKLD

SEQ ID NO: 29312 - protein, 8 aa, Borrelia burgdorferi
PEDKKLDS

SEQ ID NO: 29313 - protein, 8 aa, Borrelia burgdorferi
EDKKLDSK

SEQ ID NO: 29314 - protein, 8 aa, Borrelia burgdorferi
DKKLDSKL

SEQ ID NO: 29315 - protein, 8 aa, Borrelia burgdorferi
KKLDSKLD

SEQ ID NO: 29316 - protein, 8 aa, Borrelia burgdorferi
KLDSKLDG

SEQ ID NO: 29317 - protein, 8 aa, Borrelia burgdorferi
LDSKLDGK

SEQ ID NO: 29318 - protein, 8 aa, Borrelia burgdorferi
DSKLDGKK

SEQ ID NO: 29319 - protein, 8 aa, Borrelia burgdorferi
SKLDGKKE

SEQ ID NO: 29320 - protein, 8 aa, Borrelia burgdorferi
KLDGKKEF

SEQ ID NO: 29321 - protein, 8 aa, Borrelia burgdorferi
LDGKKEFK

SEQ ID NO: 29322 - protein, 8 aa, Borrelia burgdorferi
DGKKEFKP

SEQ ID NO: 29323 - protein, 8 aa, Borrelia burgdorferi
GKKEFKPV

SEQ ID NO: 29324 - protein, 8 aa, Borrelia burgdorferi
KKEFKPVS

SEQ ID NO: 29325 - protein, 8 aa, Borrelia burgdorferi
KEFKPVSE

SEQ ID NO: 29326 - protein, 8 aa, Borrelia burgdorferi
EFKPVSEV

SEQ ID NO: 29327 - protein, 8 aa, Borrelia burgdorferi
FKPVSEVE

SEQ ID NO: 29328 - protein, 8 aa, Borrelia burgdorferi
KPVSEVEK

SEQ ID NO: 29329 - protein, 8 aa, Borrelia burgdorferi
PVSEVEKL

SEQ ID NO: 29330 - protein, 8 aa, Borrelia burgdorferi
VSEVEKLD

SEQ ID NO: 29331 - protein, 8 aa, Borrelia burgdorferi
SEVEKLDK

SEQ ID NO: 29332 - protein, 8 aa, Borrelia burgdorferi
EVEKLDKI

SEQ ID NO: 29333 - protein, 8 aa, Borrelia burgdorferi
VEKLDKIS

SEQ ID NO: 29334 - protein, 8 aa, Borrelia burgdorferi
EKLDKISK

SEQ ID NO: 29335 - protein, 8 aa, Borrelia burgdorferi
KLDKISKS

SEQ ID NO: 29336 - protein, 8 aa, Borrelia burgdorferi
LDKISKSN

SEQ ID NO: 29337 - protein, 8 aa, Borrelia burgdorferi
DKISKSNN

SEQ ID NO: 29338 - protein, 8 aa, Borrelia burgdorferi
KISKSNNN

SEQ ID NO: 29339 - protein, 8 aa, Borrelia burgdorferi
ISKSNNNE

SEQ ID NO: 29340 - protein, 8 aa, Borrelia burgdorferi
SKSNNNEV

SEQ ID NO: 29341 - protein, 8 aa, Borrelia burgdorferi
KSNNNEVG

SEQ ID NO: 29342 - protein, 8 aa, Borrelia burgdorferi
SNNNEVGK

SEQ ID NO: 29343 - protein, 8 aa, Borrelia burgdorferi
NNNEVGKL

SEQ ID NO: 29344 - protein, 8 aa, Borrelia burgdorferi
NNEVGKLS

SEQ ID NO: 29345 - protein, 8 aa, Borrelia burgdorferi
NEVGKLSP

SEQ ID NO: 29346 - protein, 8 aa, Borrelia burgdorferi
EVGKLSPL

SEQ ID NO: 29347 - protein, 8 aa, Borrelia burgdorferi
VGKLSPLD

SEQ ID NO: 29348 - protein, 8 aa, Borrelia burgdorferi
GKLSPLDK

SEQ ID NO: 29349 - protein, 8 aa, Borrelia burgdorferi
KLSPLDKP

SEQ ID NO: 29350 - protein, 8 aa, Borrelia burgdorferi
LSPLDKPS

SEQ ID NO: 29351 - protein, 8 aa, Borrelia burgdorferi
SPLDKPSY

SEQ ID NO: 29352 - protein, 8 aa, Borrelia burgdorferi
PLDKPSYD

SEQ ID NO: 29353 - protein, 8 aa, Borrelia burgdorferi
LDKPSYDD

SEQ ID NO: 29354 - protein, 8 aa, Borrelia burgdorferi
DKPSYDDI

SEQ ID NO: 29355 - protein, 8 aa, Borrelia burgdorferi
KPSYDDID

SEQ ID NO: 29356 - protein, 8 aa, Borrelia burgdorferi
PSYDDIDS

SEQ ID NO: 29357 - protein, 8 aa, Borrelia burgdorferi
SYDDIDSK

SEQ ID NO: 29358 - protein, 8 aa, Borrelia burgdorferi
YDDIDSKE

SEQ ID NO: 29359 - protein, 8 aa, Borrelia burgdorferi
DDIDSKEE

SEQ ID NO: 29360 - protein, 8 aa, Borrelia burgdorferi
DIDSKEEV

SEQ ID NO: 29361 - protein, 8 aa, Borrelia burgdorferi
IDSKEEVD

SEQ ID NO: 29362 - protein, 8 aa, Borrelia burgdorferi
DSKEEVDN

SEQ ID NO: 29363 - protein, 8 aa, Borrelia burgdorferi
SKEEVDNK

SEQ ID NO: 29364 - protein, 8 aa, Borrelia burgdorferi
KEEVDNKA

SEQ ID NO: 29365 - protein, 8 aa, Borrelia burgdorferi
EEVDNKAI

SEQ ID NO: 29366 - protein, 8 aa, Borrelia burgdorferi
EVDNKAIN

SEQ ID NO: 29367 - protein, 8 aa, Borrelia burgdorferi
VDNKAINL

SEQ ID NO: 29368 - protein, 8 aa, Borrelia burgdorferi
DNKAINLQ

SEQ ID NO: 29369 - protein, 8 aa, Borrelia burgdorferi
NKAINLQK

SEQ ID NO: 29370 - protein, 8 aa, Borrelia burgdorferi
KAINLQKI

SEQ ID NO: 29371 - protein, 8 aa, Borrelia burgdorferi
AINLQKID

SEQ ID NO: 29372 - protein, 8 aa, Borrelia burgdorferi
INLQKIDP

SEQ ID NO: 29373 - protein, 8 aa, Borrelia burgdorferi
NLQKIDPK

SEQ ID NO: 29374 - protein, 8 aa, Borrelia burgdorferi
LQKIDPKV

SEQ ID NO: 29375 - protein, 8 aa, Borrelia burgdorferi
QKIDPKVK

SEQ ID NO: 29376 - protein, 8 aa, Borrelia burgdorferi
KIDPKVKD

SEQ ID NO: 29377 - protein, 8 aa, Borrelia burgdorferi
IDPKVKDQ

SEQ ID NO: 29378 - protein, 8 aa, Borrelia burgdorferi
DPKVKDQT

SEQ ID NO: 29379 - protein, 8 aa, Borrelia burgdorferi
PKVKDQTT

SEQ ID NO: 29380 - protein, 8 aa, Borrelia burgdorferi
KVKDQTTS

SEQ ID NO: 29381 - protein, 8 aa, Borrelia burgdorferi
VKDQTTSL

SEQ ID NO: 29382 - protein, 8 aa, Borrelia burgdorferi
KDQTTSLN

SEQ ID NO: 29383 - protein, 8 aa, Borrelia burgdorferi
DQTTSLNE

SEQ ID NO: 29384 - protein, 8 aa, Borrelia burgdorferi
QTTSLNED

SEQ ID NO: 29385 - protein, 8 aa, Borrelia burgdorferi
TTSLNEDL

SEQ ID NO: 29386 - protein, 8 aa, Borrelia burgdorferi
TSLNEDLD

SEQ ID NO: 29387 - protein, 8 aa, Borrelia burgdorferi
SLNEDLDK

SEQ ID NO: 29388 - protein, 8 aa, Borrelia burgdorferi
LNEDLDKD

SEQ ID NO: 29389 - protein, 8 aa, Borrelia burgdorferi
NEDLDKDL

SEQ ID NO: 29390 - protein, 8 aa, Borrelia burgdorferi
EDLDKDLT

SEQ ID NO: 29391 - protein, 8 aa, Borrelia burgdorferi
DLDKDLTT

SEQ ID NO: 29392 - protein, 8 aa, Borrelia burgdorferi
LDKDLTTM

SEQ ID NO: 29393 - protein, 8 aa, Borrelia burgdorferi
DKDLTTMS

SEQ ID NO: 29394 - protein, 8 aa, Borrelia burgdorferi
KDLTTMSI

SEQ ID NO: 29395 - protein, 8 aa, Borrelia burgdorferi
DLTTMSID

SEQ ID NO: 29396 - protein, 8 aa, Borrelia burgdorferi
LTTMSIDS

SEQ ID NO: 29397 - protein, 8 aa, Borrelia burgdorferi
TTMSIDSS

SEQ ID NO: 29398 - protein, 8 aa, Borrelia burgdorferi
TMSIDSSS

SEQ ID NO: 29399 - protein, 8 aa, Borrelia burgdorferi
MSIDSSSP

SEQ ID NO: 29400 - protein, 8 aa, Borrelia burgdorferi
SIDSSSPV

SEQ ID NO: 29401 - protein, 8 aa, Borrelia burgdorferi
IDSSSPVF

SEQ ID NO: 29402 - protein, 8 aa, Borrelia burgdorferi
DSSSPVFL

SEQ ID NO: 29403 - protein, 8 aa, Borrelia burgdorferi
SSSPVFLE

SEQ ID NO: 29404 - protein, 8 aa, Borrelia burgdorferi
SSPVFLEV

SEQ ID NO: 29405 - protein, 8 aa, Borrelia burgdorferi
SPVFLEVI

SEQ ID NO: 29406 - protein, 8 aa, Borrelia burgdorferi
PVFLEVID

SEQ ID NO: 29407 - protein, 8 aa, Borrelia burgdorferi
VFLEVIDP

SEQ ID NO: 29408 - protein, 8 aa, Borrelia burgdorferi
FLEVIDPI

SEQ ID NO: 29409 - protein, 8 aa, Borrelia burgdorferi
LEVIDPIT

SEQ ID NO: 29410 - protein, 8 aa, Borrelia burgdorferi
EVIDPITN

SEQ ID NO: 29411 - protein, 8 aa, Borrelia burgdorferi
VIDPITNL

SEQ ID NO: 29412 - protein, 8 aa, Borrelia burgdorferi
IDPITNLG

SEQ ID NO: 29413 - protein, 8 aa, Borrelia burgdorferi
DPITNLGT

SEQ ID NO: 29414 - protein, 8 aa, Borrelia burgdorferi
PITNLGTL

SEQ ID NO: 29415 - protein, 8 aa, Borrelia burgdorferi
ITNLGTLQ

SEQ ID NO: 29416 - protein, 8 aa, Borrelia burgdorferi
TNLGTLQL

SEQ ID NO: 29417 - protein, 8 aa, Borrelia burgdorferi
NLGTLQLI

SEQ ID NO: 29418 - protein, 8 aa, Borrelia burgdorferi
LGTLQLID

SEQ ID NO: 29419 - protein, 8 aa, Borrelia burgdorferi
GTLQLIDL

SEQ ID NO: 29420 - protein, 8 aa, Borrelia burgdorferi
TLQLIDLN

SEQ ID NO: 29421 - protein, 8 aa, Borrelia burgdorferi
LQLIDLNT

SEQ ID NO: 29422 - protein, 8 aa, Borrelia burgdorferi
QLIDLNTG

SEQ ID NO: 29423 - protein, 8 aa, Borrelia burgdorferi
LIDLNTGV

SEQ ID NO: 29424 - protein, 8 aa, Borrelia burgdorferi
IDLNTGVR

SEQ ID NO: 29425 - protein, 8 aa, Borrelia burgdorferi
DLNTGVRL

SEQ ID NO: 29426 - protein, 8 aa, Borrelia burgdorferi
LNTGVRLK

SEQ ID NO: 29427 - protein, 8 aa, Borrelia burgdorferi
NTGVRLKE

SEQ ID NO: 29428 - protein, 8 aa, Borrelia burgdorferi
TGVRLKES

SEQ ID NO: 29429 - protein, 8 aa, Borrelia burgdorferi
GVRLKEST

SEQ ID NO: 29430 - protein, 8 aa, Borrelia burgdorferi
VRLKESTQ

SEQ ID NO: 29431 - protein, 8 aa, Borrelia burgdorferi
RLKESTQQ

SEQ ID NO: 29432 - protein, 8 aa, Borrelia burgdorferi
LKESTQQG

SEQ ID NO: 29433 - protein, 8 aa, Borrelia burgdorferi
KESTQQGI

SEQ ID NO: 29434 - protein, 8 aa, Borrelia burgdorferi
ESTQQGIQ

SEQ ID NO: 29435 - protein, 8 aa, Borrelia burgdorferi
STQQGIQR

SEQ ID NO: 29436 - protein, 8 aa, Borrelia burgdorferi
TQQGIQRY

SEQ ID NO: 29437 - protein, 8 aa, Borrelia burgdorferi
QQGIQRYG

SEQ ID NO: 29438 - protein, 8 aa, Borrelia burgdorferi
QGIQRYGI

SEQ ID NO: 29439 - protein, 8 aa, Borrelia burgdorferi
GIQRYGIY

SEQ ID NO: 29440 - protein, 8 aa, Borrelia burgdorferi
IQRYGIYE

SEQ ID NO: 29441 - protein, 8 aa, Borrelia burgdorferi
QRYGIYER

SEQ ID NO: 29442 - protein, 8 aa, Borrelia burgdorferi
RYGIYERE

SEQ ID NO: 29443 - protein, 8 aa, Borrelia burgdorferi
YGIYEREK

SEQ ID NO: 29444 - protein, 8 aa, Borrelia burgdorferi
GIYEREKD

SEQ ID NO: 29445 - protein, 8 aa, Borrelia burgdorferi
IYEREKDL

SEQ ID NO: 29446 - protein, 8 aa, Borrelia burgdorferi
YEREKDLV

SEQ ID NO: 29447 - protein, 8 aa, Borrelia burgdorferi
EREKDLVV

SEQ ID NO: 29448 - protein, 8 aa, Borrelia burgdorferi
REKDLVVI

SEQ ID NO: 29449 - protein, 8 aa, Borrelia burgdorferi
EKDLVVIK

SEQ ID NO: 29450 - protein, 8 aa, Borrelia burgdorferi
KDLVVIKM

SEQ ID NO: 29451 - protein, 8 aa, Borrelia burgdorferi
DLVVIKMD

SEQ ID NO: 29452 - protein, 8 aa, Borrelia burgdorferi
LVVIKMDS

SEQ ID NO: 29453 - protein, 8 aa, Borrelia burgdorferi
VVIKMDSG

SEQ ID NO: 29454 - protein, 8 aa, Borrelia burgdorferi
VIKMDSGK

SEQ ID NO: 29455 - protein, 8 aa, Borrelia burgdorferi
IKMDSGKA

SEQ ID NO: 29456 - protein, 8 aa, Borrelia burgdorferi
KMDSGKAK

SEQ ID NO: 29457 - protein, 8 aa, Borrelia burgdorferi
MDSGKAKL

SEQ ID NO: 29458 - protein, 8 aa, Borrelia burgdorferi
DSGKAKLQ

SEQ ID NO: 29459 - protein, 8 aa, Borrelia burgdorferi
SGKAKLQI

SEQ ID NO: 29460 - protein, 8 aa, Borrelia burgdorferi
GKAKLQIL

SEQ ID NO: 29461 - protein, 8 aa, Borrelia burgdorferi
KAKLQILN

SEQ ID NO: 29462 - protein, 8 aa, Borrelia burgdorferi
AKLQILNK

SEQ ID NO: 29463 - protein, 8 aa, Borrelia burgdorferi
KLQILNKL

SEQ ID NO: 29464 - protein, 8 aa, Borrelia burgdorferi
LQILNKLE

SEQ ID NO: 29465 - protein, 8 aa, Borrelia burgdorferi
QILNKLEN

SEQ ID NO: 29466 - protein, 8 aa, Borrelia burgdorferi
ILNKLENL

SEQ ID NO: 29467 - protein, 8 aa, Borrelia burgdorferi
LNKLENLK

SEQ ID NO: 29468 - protein, 8 aa, Borrelia burgdorferi
NKLENLKV

SEQ ID NO: 29469 - protein, 8 aa, Borrelia burgdorferi
KLENLKVV

SEQ ID NO: 29470 - protein, 8 aa, Borrelia burgdorferi
LENLKVVS

SEQ ID NO: 29471 - protein, 8 aa, Borrelia burgdorferi
ENLKVVSE

SEQ ID NO: 29472 - protein, 8 aa, Borrelia burgdorferi
NLKVVSES

SEQ ID NO: 29473 - protein, 8 aa, Borrelia burgdorferi
LKVVSESN

SEQ ID NO: 29474 - protein, 8 aa, Borrelia burgdorferi
KVVSESNF

SEQ ID NO: 29475 - protein, 8 aa, Borrelia burgdorferi
VVSESNFE

SEQ ID NO: 29476 - protein, 8 aa, Borrelia burgdorferi
VSESNFEI

SEQ ID NO: 29477 - protein, 8 aa, Borrelia burgdorferi
SESNFEIN

SEQ ID NO: 29478 - protein, 8 aa, Borrelia burgdorferi
ESNFEINK

SEQ ID NO: 29479 - protein, 8 aa, Borrelia burgdorferi
SNFEINKN

SEQ ID NO: 29480 - protein, 8 aa, Borrelia burgdorferi
NFEINKNS

SEQ ID NO: 29481 - protein, 8 aa, Borrelia burgdorferi
FEINKNSS

SEQ ID NO: 29482 - protein, 8 aa, Borrelia burgdorferi
EINKNSSL

SEQ ID NO: 29483 - protein, 8 aa, Borrelia burgdorferi
INKNSSLY

SEQ ID NO: 29484 - protein, 8 aa, Borrelia burgdorferi
NKNSSLYV

SEQ ID NO: 29485 - protein, 8 aa, Borrelia burgdorferi
KNSSLYVD

SEQ ID NO: 29486 - protein, 8 aa, Borrelia burgdorferi
NSSLYVDS

SEQ ID NO: 29487 - protein, 8 aa, Borrelia burgdorferi
SSLYVDSK

SEQ ID NO: 29488 - protein, 8 aa, Borrelia burgdorferi
SLYVDSKM

SEQ ID NO: 29489 - protein, 8 aa, Borrelia burgdorferi
LYVDSKMI

SEQ ID NO: 29490 - protein, 8 aa, Borrelia burgdorferi
YVDSKMIL

SEQ ID NO: 29491 - protein, 8 aa, Borrelia burgdorferi
VDSKMILA

SEQ ID NO: 29492 - protein, 8 aa, Borrelia burgdorferi
DSKMILAA

SEQ ID NO: 29493 - protein, 8 aa, Borrelia burgdorferi
SKMILAAV

SEQ ID NO: 29494 - protein, 8 aa, Borrelia burgdorferi
KMILAAVR

SEQ ID NO: 29495 - protein, 8 aa, Borrelia burgdorferi
MILAAVRD

SEQ ID NO: 29496 - protein, 8 aa, Borrelia burgdorferi
ILAAVRDK

SEQ ID NO: 29497 - protein, 8 aa, Borrelia burgdorferi
LAAVRDKD

SEQ ID NO: 29498 - protein, 8 aa, Borrelia burgdorferi
AAVRDKDD

SEQ ID NO: 29499 - protein, 8 aa, Borrelia burgdorferi
AVRDKDDS

SEQ ID NO: 29500 - protein, 8 aa, Borrelia burgdorferi
VRDKDDSN

SEQ ID NO: 29501 - protein, 8 aa, Borrelia burgdorferi
RDKDDSNA

SEQ ID NO: 29502 - protein, 8 aa, Borrelia burgdorferi
DKDDSNAW

SEQ ID NO: 29503 - protein, 8 aa, Borrelia burgdorferi
KDDSNAWR

SEQ ID NO: 29504 - protein, 8 aa, Borrelia burgdorferi
DDSNAWRL

SEQ ID NO: 29505 - protein, 8 aa, Borrelia burgdorferi
DSNAWRLA

SEQ ID NO: 29506 - protein, 8 aa, Borrelia burgdorferi
SNAWRLAK

SEQ ID NO: 29507 - protein, 8 aa, Borrelia burgdorferi
NAWRLAKF

SEQ ID NO: 29508 - protein, 8 aa, Borrelia burgdorferi
AWRLAKFS

SEQ ID NO: 29509 - protein, 8 aa, Borrelia burgdorferi
WRLAKFSP

SEQ ID NO: 29510 - protein, 8 aa, Borrelia burgdorferi
RLAKFSPK

SEQ ID NO: 29511 - protein, 8 aa, Borrelia burgdorferi
LAKFSPKN

SEQ ID NO: 29512 - protein, 8 aa, Borrelia burgdorferi
AKFSPKNL

SEQ ID NO: 29513 - protein, 8 aa, Borrelia burgdorferi
KFSPKNLD

SEQ ID NO: 29514 - protein, 8 aa, Borrelia burgdorferi
FSPKNLDE

SEQ ID NO: 29515 - protein, 8 aa, Borrelia burgdorferi
SPKNLDEF

SEQ ID NO: 29516 - protein, 8 aa, Borrelia burgdorferi
PKNLDEFI

SEQ ID NO: 29517 - protein, 8 aa, Borrelia burgdorferi
KNLDEFIL

SEQ ID NO: 29518 - protein, 8 aa, Borrelia burgdorferi
NLDEFILS

SEQ ID NO: 29519 - protein, 8 aa, Borrelia burgdorferi
LDEFILSE

SEQ ID NO: 29520 - protein, 8 aa, Borrelia burgdorferi
DEFILSEN

SEQ ID NO: 29521 - protein, 8 aa, Borrelia burgdorferi
EFILSENK

SEQ ID NO: 29522 - protein, 8 aa, Borrelia burgdorferi
FILSENKI

SEQ ID NO: 29523 - protein, 8 aa, Borrelia burgdorferi
ILSENKIL

SEQ ID NO: 29524 - protein, 8 aa, Borrelia burgdorferi
LSENKILP

SEQ ID NO: 29525 - protein, 8 aa, Borrelia burgdorferi
SENKILPF

SEQ ID NO: 29526 - protein, 8 aa, Borrelia burgdorferi
ENKILPFT

SEQ ID NO: 29527 - protein, 8 aa, Borrelia burgdorferi
NKILPFTS

SEQ ID NO: 29528 - protein, 8 aa, Borrelia burgdorferi
KILPFTSF

SEQ ID NO: 29529 - protein, 8 aa, Borrelia burgdorferi
ILPFTSFS

SEQ ID NO: 29530 - protein, 8 aa, Borrelia burgdorferi
LPFTSFSV

SEQ ID NO: 29531 - protein, 8 aa, Borrelia burgdorferi
PFTSFSVR

SEQ ID NO: 29532 - protein, 8 aa, Borrelia burgdorferi
FTSFSVRK

SEQ ID NO: 29533 - protein, 8 aa, Borrelia burgdorferi
TSFSVRKN

SEQ ID NO: 29534 - protein, 8 aa, Borrelia burgdorferi
SFSVRKNF

SEQ ID NO: 29535 - protein, 8 aa, Borrelia burgdorferi
FSVRKNFI

SEQ ID NO: 29536 - protein, 8 aa, Borrelia burgdorferi
SVRKNFIY

SEQ ID NO: 29537 - protein, 8 aa, Borrelia burgdorferi
VRKNFIYL

SEQ ID NO: 29538 - protein, 8 aa, Borrelia burgdorferi
RKNFIYLQ

SEQ ID NO: 29539 - protein, 8 aa, Borrelia burgdorferi
KNFIYLQD

SEQ ID NO: 29540 - protein, 8 aa, Borrelia burgdorferi
NFIYLQDE

SEQ ID NO: 29541 - protein, 8 aa, Borrelia burgdorferi
FIYLQDEL

SEQ ID NO: 29542 - protein, 8 aa, Borrelia burgdorferi
IYLQDELK

SEQ ID NO: 29543 - protein, 8 aa, Borrelia burgdorferi
YLQDELKN

SEQ ID NO: 29544 - protein, 8 aa, Borrelia burgdorferi
LQDELKNL

SEQ ID NO: 29545 - protein, 8 aa, Borrelia burgdorferi
QDELKNLV

SEQ ID NO: 29546 - protein, 8 aa, Borrelia burgdorferi
DELKNLVI

SEQ ID NO: 29547 - protein, 8 aa, Borrelia burgdorferi
ELKNLVIL

SEQ ID NO: 29548 - protein, 8 aa, Borrelia burgdorferi
LKNLVILD

SEQ ID NO: 29549 - protein, 8 aa, Borrelia burgdorferi
KNLVILDV

SEQ ID NO: 29550 - protein, 8 aa, Borrelia burgdorferi
NLVILDVN

SEQ ID NO: 29551 - protein, 8 aa, Borrelia burgdorferi
LVILDVNT

SEQ ID NO: 29552 - protein, 8 aa, Borrelia burgdorferi
VILDVNTL

SEQ ID NO: 29553 - protein, 8 aa, Borrelia burgdorferi
ILDVNTLK

SEQ ID NO: 29554 - protein, 8 aa, Borrelia burgdorferi
LDVNTLKK

SEQ ID NO: 29555 - protein, 8 aa, Borrelia burgdorferi
DVNTLKKV

SEQ ID NO: 29556 - protein, 8 aa, Borrelia burgdorferi
VNTLKKVK

SEQ ID NO: 29557 - protein, 9 aa, Borrelia burgdorferi
MKKMLLIFS

SEQ ID NO: 29558 - protein, 9 aa, Borrelia burgdorferi
KKMLLIFSF

SEQ ID NO: 29559 - protein, 9 aa, Borrelia burgdorferi
KMLLIFSFF

SEQ ID NO: 29560 - protein, 9 aa, Borrelia burgdorferi
MLLIFSFFL

SEQ ID NO: 29561 - protein, 9 aa, Borrelia burgdorferi
LLIFSFFLI

SEQ ID NO: 29562 - protein, 9 aa, Borrelia burgdorferi
LIFSFFLIF

SEQ ID NO: 29563 - protein, 9 aa, Borrelia burgdorferi
IFSFFLIFL

SEQ ID NO: 29564 - protein, 9 aa, Borrelia burgdorferi
FSFFLIFLN

SEQ ID NO: 29565 - protein, 9 aa, Borrelia burgdorferi
SFFLIFLNG

SEQ ID NO: 29566 - protein, 9 aa, Borrelia burgdorferi
FFLIFLNGF

SEQ ID NO: 29567 - protein, 9 aa, Borrelia burgdorferi
FLIFLNGFP

SEQ ID NO: 29568 - protein, 9 aa, Borrelia burgdorferi
LIFLNGFPL

SEQ ID NO: 29569 - protein, 9 aa, Borrelia burgdorferi
IFLNGFPLN

SEQ ID NO: 29570 - protein, 9 aa, Borrelia burgdorferi
FLNGFPLNA

SEQ ID NO: 29571 - protein, 9 aa, Borrelia burgdorferi
LNGFPLNAR

SEQ ID NO: 29572 - protein, 9 aa, Borrelia burgdorferi
NGFPLNARK

SEQ ID NO: 29573 - protein, 9 aa, Borrelia burgdorferi
GFPLNARKV

SEQ ID NO: 29574 - protein, 9 aa, Borrelia burgdorferi
FPLNARKVD

SEQ ID NO: 29575 - protein, 9 aa, Borrelia burgdorferi
PLNARKVDK

SEQ ID NO: 29576 - protein, 9 aa, Borrelia burgdorferi
LNARKVDKE

SEQ ID NO: 29577 - protein, 9 aa, Borrelia burgdorferi
NARKVDKEK

SEQ ID NO: 29578 - protein, 9 aa, Borrelia burgdorferi
ARKVDKEKL

SEQ ID NO: 29579 - protein, 9 aa, Borrelia burgdorferi
RKVDKEKLK

SEQ ID NO: 29580 - protein, 9 aa, Borrelia burgdorferi
KVDKEKLKD

SEQ ID NO: 29581 - protein, 9 aa, Borrelia burgdorferi
VDKEKLKDF

SEQ ID NO: 29582 - protein, 9 aa, Borrelia burgdorferi
DKEKLKDFV

SEQ ID NO: 29583 - protein, 9 aa, Borrelia burgdorferi
KEKLKDFVN

SEQ ID NO: 29584 - protein, 9 aa, Borrelia burgdorferi
EKLKDFVNM

SEQ ID NO: 29585 - protein, 9 aa, Borrelia burgdorferi
KLKDFVNMD

SEQ ID NO: 29586 - protein, 9 aa, Borrelia burgdorferi
LKDFVNMDL

SEQ ID NO: 29587 - protein, 9 aa, Borrelia burgdorferi
KDFVNMDLE

SEQ ID NO: 29588 - protein, 9 aa, Borrelia burgdorferi
DFVNMDLEF

SEQ ID NO: 29589 - protein, 9 aa, Borrelia burgdorferi
FVNMDLEFV

SEQ ID NO: 29590 - protein, 9 aa, Borrelia burgdorferi
VNMDLEFVN

SEQ ID NO: 29591 - protein, 9 aa, Borrelia burgdorferi
NMDLEFVNY

SEQ ID NO: 29592 - protein, 9 aa, Borrelia burgdorferi
MDLEFVNYK

SEQ ID NO: 29593 - protein, 9 aa, Borrelia burgdorferi
DLEFVNYKG

SEQ ID NO: 29594 - protein, 9 aa, Borrelia burgdorferi
LEFVNYKGP

SEQ ID NO: 29595 - protein, 9 aa, Borrelia burgdorferi
EFVNYKGPY

SEQ ID NO: 29596 - protein, 9 aa, Borrelia burgdorferi
FVNYKGPYD

SEQ ID NO: 29597 - protein, 9 aa, Borrelia burgdorferi
VNYKGPYDS

SEQ ID NO: 29598 - protein, 9 aa, Borrelia burgdorferi
NYKGPYDST

SEQ ID NO: 29599 - protein, 9 aa, Borrelia burgdorferi
YKGPYDSTN

SEQ ID NO: 29600 - protein, 9 aa, Borrelia burgdorferi
KGPYDSTNT

SEQ ID NO: 29601 - protein, 9 aa, Borrelia burgdorferi
GPYDSTNTY

SEQ ID NO: 29602 - protein, 9 aa, Borrelia burgdorferi
PYDSTNTYE

SEQ ID NO: 29603 - protein, 9 aa, Borrelia burgdorferi
YDSTNTYEQ

SEQ ID NO: 29604 - protein, 9 aa, Borrelia burgdorferi
DSTNTYEQI

SEQ ID NO: 29605 - protein, 9 aa, Borrelia burgdorferi
STNTYEQIV

SEQ ID NO: 29606 - protein, 9 aa, Borrelia burgdorferi
TNTYEQIVG

SEQ ID NO: 29607 - protein, 9 aa, Borrelia burgdorferi
NTYEQIVGI

SEQ ID NO: 29608 - protein, 9 aa, Borrelia burgdorferi
TYEQIVGIG

SEQ ID NO: 29609 - protein, 9 aa, Borrelia burgdorferi
YEQIVGIGE

SEQ ID NO: 29610 - protein, 9 aa, Borrelia burgdorferi
EQIVGIGEF

SEQ ID NO: 29611 - protein, 9 aa, Borrelia burgdorferi
QIVGIGEFL

SEQ ID NO: 29612 - protein, 9 aa, Borrelia burgdorferi
IVGIGEFLA

SEQ ID NO: 29613 - protein, 9 aa, Borrelia burgdorferi
VGIGEFLAR

SEQ ID NO: 29614 - protein, 9 aa, Borrelia burgdorferi
GIGEFLARP

SEQ ID NO: 29615 - protein, 9 aa, Borrelia burgdorferi
IGEFLARPL

SEQ ID NO: 29616 - protein, 9 aa, Borrelia burgdorferi
GEFLARPLT

SEQ ID NO: 29617 - protein, 9 aa, Borrelia burgdorferi
EFLARPLTN

SEQ ID NO: 29618 - protein, 9 aa, Borrelia burgdorferi
FLARPLTNS

SEQ ID NO: 29619 - protein, 9 aa, Borrelia burgdorferi
LARPLTNSN

SEQ ID NO: 29620 - protein, 9 aa, Borrelia burgdorferi
ARPLTNSNS

SEQ ID NO: 29621 - protein, 9 aa, Borrelia burgdorferi
RPLTNSNSN

SEQ ID NO: 29622 - protein, 9 aa, Borrelia burgdorferi
PLTNSNSNS

SEQ ID NO: 29623 - protein, 9 aa, Borrelia burgdorferi
LTNSNSNSS

SEQ ID NO: 29624 - protein, 9 aa, Borrelia burgdorferi
TNSNSNSSY

SEQ ID NO: 29625 - protein, 9 aa, Borrelia burgdorferi
NSNSNSSYY

SEQ ID NO: 29626 - protein, 9 aa, Borrelia burgdorferi
SNSNSSYYG

SEQ ID NO: 29627 - protein, 9 aa, Borrelia burgdorferi
NSNSSYYGK

SEQ ID NO: 29628 - protein, 9 aa, Borrelia burgdorferi
SNSSYYGKY

SEQ ID NO: 29629 - protein, 9 aa, Borrelia burgdorferi
NSSYYGKYF

SEQ ID NO: 29630 - protein, 9 aa, Borrelia burgdorferi
SSYYGKYFI

SEQ ID NO: 29631 - protein, 9 aa, Borrelia burgdorferi
SYYGKYFIN

SEQ ID NO: 29632 - protein, 9 aa, Borrelia burgdorferi
YYGKYFINR

SEQ ID NO: 29633 - protein, 9 aa, Borrelia burgdorferi
YGKYFINRF

SEQ ID NO: 29634 - protein, 9 aa, Borrelia burgdorferi
GKYFINRFI

SEQ ID NO: 29635 - protein, 9 aa, Borrelia burgdorferi
KYFINRFID

SEQ ID NO: 29636 - protein, 9 aa, Borrelia burgdorferi
YFINRFIDD

SEQ ID NO: 29637 - protein, 9 aa, Borrelia burgdorferi
FINRFIDDQ

SEQ ID NO: 29638 - protein, 9 aa, Borrelia burgdorferi
INRFIDDQD

SEQ ID NO: 29639 - protein, 9 aa, Borrelia burgdorferi
NRFIDDQDK

SEQ ID NO: 29640 - protein, 9 aa, Borrelia burgdorferi
RFIDDQDKK

SEQ ID NO: 29641 - protein, 9 aa, Borrelia burgdorferi
FIDDQDKKA

SEQ ID NO: 29642 - protein, 9 aa, Borrelia burgdorferi
IDDQDKKAS

SEQ ID NO: 29643 - protein, 9 aa, Borrelia burgdorferi
DDQDKKASV

SEQ ID NO: 29644 - protein, 9 aa, Borrelia burgdorferi
DQDKKASVD

SEQ ID NO: 29645 - protein, 9 aa, Borrelia burgdorferi
QDKKASVDV

SEQ ID NO: 29646 - protein, 9 aa, Borrelia burgdorferi
DKKASVDVF

SEQ ID NO: 29647 - protein, 9 aa, Borrelia burgdorferi
KKASVDVFS

SEQ ID NO: 29648 - protein, 9 aa, Borrelia burgdorferi
KASVDVFSI

SEQ ID NO: 29649 - protein, 9 aa, Borrelia burgdorferi
ASVDVFSIS

SEQ ID NO: 29650 - protein, 9 aa, Borrelia burgdorferi
SVDVFSISS

SEQ ID NO: 29651 - protein, 9 aa, Borrelia burgdorferi
VDVFSISSK

SEQ ID NO: 29652 - protein, 9 aa, Borrelia burgdorferi
DVFSISSKS

SEQ ID NO: 29653 - protein, 9 aa, Borrelia burgdorferi
VFSISSKSE

SEQ ID NO: 29654 - protein, 9 aa, Borrelia burgdorferi
FSISSKSEL

SEQ ID NO: 29655 - protein, 9 aa, Borrelia burgdorferi
SISSKSELD

SEQ ID NO: 29656 - protein, 9 aa, Borrelia burgdorferi
ISSKSELDS

SEQ ID NO: 29657 - protein, 9 aa, Borrelia burgdorferi
SSKSELDSI

SEQ ID NO: 29658 - protein, 9 aa, Borrelia burgdorferi
SKSELDSIL

SEQ ID NO: 29659 - protein, 9 aa, Borrelia burgdorferi
KSELDSILN

SEQ ID NO: 29660 - protein, 9 aa, Borrelia burgdorferi
SELDSILNL

SEQ ID NO: 29661 - protein, 9 aa, Borrelia burgdorferi
ELDSILNLR

SEQ ID NO: 29662 - protein, 9 aa, Borrelia burgdorferi
LDSILNLRR

SEQ ID NO: 29663 - protein, 9 aa, Borrelia burgdorferi
DSILNLRRI

SEQ ID NO: 29664 - protein, 9 aa, Borrelia burgdorferi
SILNLRRIL

SEQ ID NO: 29665 - protein, 9 aa, Borrelia burgdorferi
ILNLRRILT

SEQ ID NO: 29666 - protein, 9 aa, Borrelia burgdorferi
LNLRRILTG

SEQ ID NO: 29667 - protein, 9 aa, Borrelia burgdorferi
NLRRILTGY

SEQ ID NO: 29668 - protein, 9 aa, Borrelia burgdorferi
LRRILTGYI

SEQ ID NO: 29669 - protein, 9 aa, Borrelia burgdorferi
RRILTGYII

SEQ ID NO: 29670 - protein, 9 aa, Borrelia burgdorferi
RILTGYIIK

SEQ ID NO: 29671 - protein, 9 aa, Borrelia burgdorferi
ILTGYIIKS

SEQ ID NO: 29672 - protein, 9 aa, Borrelia burgdorferi
LTGYIIKSF

SEQ ID NO: 29673 - protein, 9 aa, Borrelia burgdorferi
TGYIIKSFD

SEQ ID NO: 29674 - protein, 9 aa, Borrelia burgdorferi
GYIIKSFDY

SEQ ID NO: 29675 - protein, 9 aa, Borrelia burgdorferi
YIIKSFDYD

SEQ ID NO: 29676 - protein, 9 aa, Borrelia burgdorferi
IIKSFDYDR

SEQ ID NO: 29677 - protein, 9 aa, Borrelia burgdorferi
IKSFDYDRS

SEQ ID NO: 29678 - protein, 9 aa, Borrelia burgdorferi
KSFDYDRSS

SEQ ID NO: 29679 - protein, 9 aa, Borrelia burgdorferi
SFDYDRSSA

SEQ ID NO: 29680 - protein, 9 aa, Borrelia burgdorferi
FDYDRSSAE

SEQ ID NO: 29681 - protein, 9 aa, Borrelia burgdorferi
DYDRSSAEL

SEQ ID NO: 29682 - protein, 9 aa, Borrelia burgdorferi
YDRSSAELI

SEQ ID NO: 29683 - protein, 9 aa, Borrelia burgdorferi
DRSSAELIA

SEQ ID NO: 29684 - protein, 9 aa, Borrelia burgdorferi
RSSAELIAK

SEQ ID NO: 29685 - protein, 9 aa, Borrelia burgdorferi
SSAELIAKV

SEQ ID NO: 29686 - protein, 9 aa, Borrelia burgdorferi
SAELIAKVI

SEQ ID NO: 29687 - protein, 9 aa, Borrelia burgdorferi
AELIAKVIT

SEQ ID NO: 29688 - protein, 9 aa, Borrelia burgdorferi
ELIAKVITI

SEQ ID NO: 29689 - protein, 9 aa, Borrelia burgdorferi
LIAKVITIY

SEQ ID NO: 29690 - protein, 9 aa, Borrelia burgdorferi
IAKVITIYN

SEQ ID NO: 29691 - protein, 9 aa, Borrelia burgdorferi
AKVITIYNA

SEQ ID NO: 29692 - protein, 9 aa, Borrelia burgdorferi
KVITIYNAV

SEQ ID NO: 29693 - protein, 9 aa, Borrelia burgdorferi
VITIYNAVY

SEQ ID NO: 29694 - protein, 9 aa, Borrelia burgdorferi
ITIYNAVYR

SEQ ID NO: 29695 - protein, 9 aa, Borrelia burgdorferi
TIYNAVYRG

SEQ ID NO: 29696 - protein, 9 aa, Borrelia burgdorferi
IYNAVYRGD

SEQ ID NO: 29697 - protein, 9 aa, Borrelia burgdorferi
YNAVYRGDL

SEQ ID NO: 29698 - protein, 9 aa, Borrelia burgdorferi
NAVYRGDLD

SEQ ID NO: 29699 - protein, 9 aa, Borrelia burgdorferi
AVYRGDLDY

SEQ ID NO: 29700 - protein, 9 aa, Borrelia burgdorferi
VYRGDLDYY

SEQ ID NO: 29701 - protein, 9 aa, Borrelia burgdorferi
YRGDLDYYK

SEQ ID NO: 29702 - protein, 9 aa, Borrelia burgdorferi
RGDLDYYKG

SEQ ID NO: 29703 - protein, 9 aa, Borrelia burgdorferi
GDLDYYKGF

SEQ ID NO: 29704 - protein, 9 aa, Borrelia burgdorferi
DLDYYKGFY

SEQ ID NO: 29705 - protein, 9 aa, Borrelia burgdorferi
LDYYKGFYI

SEQ ID NO: 29706 - protein, 9 aa, Borrelia burgdorferi
DYYKGFYIE

SEQ ID NO: 29707 - protein, 9 aa, Borrelia burgdorferi
YYKGFYIEP

SEQ ID NO: 29708 - protein, 9 aa, Borrelia burgdorferi
YKGFYIEPA

SEQ ID NO: 29709 - protein, 9 aa, Borrelia burgdorferi
KGFYIEPAL

SEQ ID NO: 29710 - protein, 9 aa, Borrelia burgdorferi
GFYIEPALK

SEQ ID NO: 29711 - protein, 9 aa, Borrelia burgdorferi
FYIEPALKS

SEQ ID NO: 29712 - protein, 9 aa, Borrelia burgdorferi
YIEPALKSL

SEQ ID NO: 29713 - protein, 9 aa, Borrelia burgdorferi
IEPALKSLT

SEQ ID NO: 29714 - protein, 9 aa, Borrelia burgdorferi
EPALKSLTK

SEQ ID NO: 29715 - protein, 9 aa, Borrelia burgdorferi
PALKSLTKE

SEQ ID NO: 29716 - protein, 9 aa, Borrelia burgdorferi
ALKSLTKEN

SEQ ID NO: 29717 - protein, 9 aa, Borrelia burgdorferi
LKSLTKENA

SEQ ID NO: 29718 - protein, 9 aa, Borrelia burgdorferi
KSLTKENAG

SEQ ID NO: 29719 - protein, 9 aa, Borrelia burgdorferi
SLTKENAGL

SEQ ID NO: 29720 - protein, 9 aa, Borrelia burgdorferi
LTKENAGLS

SEQ ID NO: 29721 - protein, 9 aa, Borrelia burgdorferi
TKENAGLSR

SEQ ID NO: 29722 - protein, 9 aa, Borrelia burgdorferi
KENAGLSRV

SEQ ID NO: 29723 - protein, 9 aa, Borrelia burgdorferi
ENAGLSRVY

SEQ ID NO: 29724 - protein, 9 aa, Borrelia burgdorferi
NAGLSRVYS

SEQ ID NO: 29725 - protein, 9 aa, Borrelia burgdorferi
AGLSRVYSQ

SEQ ID NO: 29726 - protein, 9 aa, Borrelia burgdorferi
GLSRVYSQW

SEQ ID NO: 29727 - protein, 9 aa, Borrelia burgdorferi
LSRVYSQWA

SEQ ID NO: 29728 - protein, 9 aa, Borrelia burgdorferi
SRVYSQWAG

SEQ ID NO: 29729 - protein, 9 aa, Borrelia burgdorferi
RVYSQWAGK

SEQ ID NO: 29730 - protein, 9 aa, Borrelia burgdorferi
VYSQWAGKT

SEQ ID NO: 29731 - protein, 9 aa, Borrelia burgdorferi
YSQWAGKTQ

SEQ ID NO: 29732 - protein, 9 aa, Borrelia burgdorferi
SQWAGKTQI

SEQ ID NO: 29733 - protein, 9 aa, Borrelia burgdorferi
QWAGKTQIF

SEQ ID NO: 29734 - protein, 9 aa, Borrelia burgdorferi
WAGKTQIFI

SEQ ID NO: 29735 - protein, 9 aa, Borrelia burgdorferi
AGKTQIFIP

SEQ ID NO: 29736 - protein, 9 aa, Borrelia burgdorferi
GKTQIFIPL

SEQ ID NO: 29737 - protein, 9 aa, Borrelia burgdorferi
KTQIFIPLK

SEQ ID NO: 29738 - protein, 9 aa, Borrelia burgdorferi
TQIFIPLKK

SEQ ID NO: 29739 - protein, 9 aa, Borrelia burgdorferi
QIFIPLKKD

SEQ ID NO: 29740 - protein, 9 aa, Borrelia burgdorferi
IFIPLKKDI

SEQ ID NO: 29741 - protein, 9 aa, Borrelia burgdorferi
FIPLKKDIL

SEQ ID NO: 29742 - protein, 9 aa, Borrelia burgdorferi
IPLKKDILS

SEQ ID NO: 29743 - protein, 9 aa, Borrelia burgdorferi
PLKKDILSG

SEQ ID NO: 29744 - protein, 9 aa, Borrelia burgdorferi
LKKDILSGN

SEQ ID NO: 29745 - protein, 9 aa, Borrelia burgdorferi
KKDILSGNI

SEQ ID NO: 29746 - protein, 9 aa, Borrelia burgdorferi
KDILSGNIE

SEQ ID NO: 29747 - protein, 9 aa, Borrelia burgdorferi
DILSGNIES

SEQ ID NO: 29748 - protein, 9 aa, Borrelia burgdorferi
ILSGNIESD

SEQ ID NO: 29749 - protein, 9 aa, Borrelia burgdorferi
LSGNIESDI

SEQ ID NO: 29750 - protein, 9 aa, Borrelia burgdorferi
SGNIESDID

SEQ ID NO: 29751 - protein, 9 aa, Borrelia burgdorferi
GNIESDIDI

SEQ ID NO: 29752 - protein, 9 aa, Borrelia burgdorferi
NIESDIDID

SEQ ID NO: 29753 - protein, 9 aa, Borrelia burgdorferi
IESDIDIDS

SEQ ID NO: 29754 - protein, 9 aa, Borrelia burgdorferi
ESDIDIDSL

SEQ ID NO: 29755 - protein, 9 aa, Borrelia burgdorferi
SDIDIDSLV

SEQ ID NO: 29756 - protein, 9 aa, Borrelia burgdorferi
DIDIDSLVT

SEQ ID NO: 29757 - protein, 9 aa, Borrelia burgdorferi
IDIDSLVTD

SEQ ID NO: 29758 - protein, 9 aa, Borrelia burgdorferi
DIDSLVTDK

SEQ ID NO: 29759 - protein, 9 aa, Borrelia burgdorferi
IDSLVTDKV

SEQ ID NO: 29760 - protein, 9 aa, Borrelia burgdorferi
DSLVTDKVI

SEQ ID NO: 29761 - protein, 9 aa, Borrelia burgdorferi
SLVTDKVIA

SEQ ID NO: 29762 - protein, 9 aa, Borrelia burgdorferi
LVTDKVIAA

SEQ ID NO: 29763 - protein, 9 aa, Borrelia burgdorferi
VTDKVIAAL

SEQ ID NO: 29764 - protein, 9 aa, Borrelia burgdorferi
TDKVIAALL

SEQ ID NO: 29765 - protein, 9 aa, Borrelia burgdorferi
DKVIAALLS

SEQ ID NO: 29766 - protein, 9 aa, Borrelia burgdorferi
KVIAALLSE

SEQ ID NO: 29767 - protein, 9 aa, Borrelia burgdorferi
VIAALLSEN

SEQ ID NO: 29768 - protein, 9 aa, Borrelia burgdorferi
IAALLSENE

SEQ ID NO: 29769 - protein, 9 aa, Borrelia burgdorferi
AALLSENEA

SEQ ID NO: 29770 - protein, 9 aa, Borrelia burgdorferi
ALLSENEAG

SEQ ID NO: 29771 - protein, 9 aa, Borrelia burgdorferi
LLSENEAGV

SEQ ID NO: 29772 - protein, 9 aa, Borrelia burgdorferi
LSENEAGVN

SEQ ID NO: 29773 - protein, 9 aa, Borrelia burgdorferi
SENEAGVNF

SEQ ID NO: 29774 - protein, 9 aa, Borrelia burgdorferi
ENEAGVNFA

SEQ ID NO: 29775 - protein, 9 aa, Borrelia burgdorferi
NEAGVNFAR

SEQ ID NO: 29776 - protein, 9 aa, Borrelia burgdorferi
EAGVNFARD

SEQ ID NO: 29777 - protein, 9 aa, Borrelia burgdorferi
AGVNFARDI

SEQ ID NO: 29778 - protein, 9 aa, Borrelia burgdorferi
GVNFARDIT

SEQ ID NO: 29779 - protein, 9 aa, Borrelia burgdorferi
VNFARDITD

SEQ ID NO: 29780 - protein, 9 aa, Borrelia burgdorferi
NFARDITDI

SEQ ID NO: 29781 - protein, 9 aa, Borrelia burgdorferi
FARDITDIQ

SEQ ID NO: 29782 - protein, 9 aa, Borrelia burgdorferi
ARDITDIQG

SEQ ID NO: 29783 - protein, 9 aa, Borrelia burgdorferi
RDITDIQGE

SEQ ID NO: 29784 - protein, 9 aa, Borrelia burgdorferi
DITDIQGET

SEQ ID NO: 29785 - protein, 9 aa, Borrelia burgdorferi
ITDIQGETH

SEQ ID NO: 29786 - protein, 9 aa, Borrelia burgdorferi
TDIQGETHK

SEQ ID NO: 29787 - protein, 9 aa, Borrelia burgdorferi
DIQGETHKA

SEQ ID NO: 29788 - protein, 9 aa, Borrelia burgdorferi
IQGETHKAD

SEQ ID NO: 29789 - protein, 9 aa, Borrelia burgdorferi
QGETHKADQ

SEQ ID NO: 29790 - protein, 9 aa, Borrelia burgdorferi
GETHKADQD

SEQ ID NO: 29791 - protein, 9 aa, Borrelia burgdorferi
ETHKADQDK

SEQ ID NO: 29792 - protein, 9 aa, Borrelia burgdorferi
THKADQDKI

SEQ ID NO: 29793 - protein, 9 aa, Borrelia burgdorferi
HKADQDKID

SEQ ID NO: 29794 - protein, 9 aa, Borrelia burgdorferi
KADQDKIDT

SEQ ID NO: 29795 - protein, 9 aa, Borrelia burgdorferi
ADQDKIDTE

SEQ ID NO: 29796 - protein, 9 aa, Borrelia burgdorferi
DQDKIDTEL

SEQ ID NO: 29797 - protein, 9 aa, Borrelia burgdorferi
QDKIDTELD

SEQ ID NO: 29798 - protein, 9 aa, Borrelia burgdorferi
DKIDTELDN

SEQ ID NO: 29799 - protein, 9 aa, Borrelia burgdorferi
KIDTELDNI

SEQ ID NO: 29800 - protein, 9 aa, Borrelia burgdorferi
IDTELDNIH

SEQ ID NO: 29801 - protein, 9 aa, Borrelia burgdorferi
DTELDNIHE

SEQ ID NO: 29802 - protein, 9 aa, Borrelia burgdorferi
TELDNIHES

SEQ ID NO: 29803 - protein, 9 aa, Borrelia burgdorferi
ELDNIHESD

SEQ ID NO: 29804 - protein, 9 aa, Borrelia burgdorferi
LDNIHESDS

SEQ ID NO: 29805 - protein, 9 aa, Borrelia burgdorferi
DNIHESDSN

SEQ ID NO: 29806 - protein, 9 aa, Borrelia burgdorferi
NIHESDSNI

SEQ ID NO: 29807 - protein, 9 aa, Borrelia burgdorferi
IHESDSNIT

SEQ ID NO: 29808 - protein, 9 aa, Borrelia burgdorferi
HESDSNITE

SEQ ID NO: 29809 - protein, 9 aa, Borrelia burgdorferi
ESDSNITET

SEQ ID NO: 29810 - protein, 9 aa, Borrelia burgdorferi
SDSNITETI

SEQ ID NO: 29811 - protein, 9 aa, Borrelia burgdorferi
DSNITETIE

SEQ ID NO: 29812 - protein, 9 aa, Borrelia burgdorferi
SNITETIEN

SEQ ID NO: 29813 - protein, 9 aa, Borrelia burgdorferi
NITETIENL

SEQ ID NO: 29814 - protein, 9 aa, Borrelia burgdorferi
ITETIENLR

SEQ ID NO: 29815 - protein, 9 aa, Borrelia burgdorferi
TETIENLRD

SEQ ID NO: 29816 - protein, 9 aa, Borrelia burgdorferi
ETIENLRDQ

SEQ ID NO: 29817 - protein, 9 aa, Borrelia burgdorferi
TIENLRDQL

SEQ ID NO: 29818 - protein, 9 aa, Borrelia burgdorferi
IENLRDQLE

SEQ ID NO: 29819 - protein, 9 aa, Borrelia burgdorferi
ENLRDQLEK

SEQ ID NO: 29820 - protein, 9 aa, Borrelia burgdorferi
NLRDQLEKA

SEQ ID NO: 29821 - protein, 9 aa, Borrelia burgdorferi
LRDQLEKAT

SEQ ID NO: 29822 - protein, 9 aa, Borrelia burgdorferi
RDQLEKATD

SEQ ID NO: 29823 - protein, 9 aa, Borrelia burgdorferi
DQLEKATDE

SEQ ID NO: 29824 - protein, 9 aa, Borrelia burgdorferi
QLEKATDEE

SEQ ID NO: 29825 - protein, 9 aa, Borrelia burgdorferi
LEKATDEEH

SEQ ID NO: 29826 - protein, 9 aa, Borrelia burgdorferi
EKATDEEHK

SEQ ID NO: 29827 - protein, 9 aa, Borrelia burgdorferi
KATDEEHKK

SEQ ID NO: 29828 - protein, 9 aa, Borrelia burgdorferi
ATDEEHKKE

SEQ ID NO: 29829 - protein, 9 aa, Borrelia burgdorferi
TDEEHKKEI

SEQ ID NO: 29830 - protein, 9 aa, Borrelia burgdorferi
DEEHKKEIE

SEQ ID NO: 29831 - protein, 9 aa, Borrelia burgdorferi
EEHKKEIES

SEQ ID NO: 29832 - protein, 9 aa, Borrelia burgdorferi
EHKKEIESQ

SEQ ID NO: 29833 - protein, 9 aa, Borrelia burgdorferi
HKKEIESQV

SEQ ID NO: 29834 - protein, 9 aa, Borrelia burgdorferi
KKEIESQVD

SEQ ID NO: 29835 - protein, 9 aa, Borrelia burgdorferi
KEIESQVDA

SEQ ID NO: 29836 - protein, 9 aa, Borrelia burgdorferi
EIESQVDAK

SEQ ID NO: 29837 - protein, 9 aa, Borrelia burgdorferi
IESQVDAKK

SEQ ID NO: 29838 - protein, 9 aa, Borrelia burgdorferi
ESQVDAKKK

SEQ ID NO: 29839 - protein, 9 aa, Borrelia burgdorferi
SQVDAKKKE

SEQ ID NO: 29840 - protein, 9 aa, Borrelia burgdorferi
QVDAKKKEK

SEQ ID NO: 29841 - protein, 9 aa, Borrelia burgdorferi
VDAKKKEKE

SEQ ID NO: 29842 - protein, 9 aa, Borrelia burgdorferi
DAKKKEKEE

SEQ ID NO: 29843 - protein, 9 aa, Borrelia burgdorferi
AKKKEKEEL

SEQ ID NO: 29844 - protein, 9 aa, Borrelia burgdorferi
KKKEKEELD

SEQ ID NO: 29845 - protein, 9 aa, Borrelia burgdorferi
KKEKEELDK

SEQ ID NO: 29846 - protein, 9 aa, Borrelia burgdorferi
KEKEELDKK

SEQ ID NO: 29847 - protein, 9 aa, Borrelia burgdorferi
EKEELDKKA

SEQ ID NO: 29848 - protein, 9 aa, Borrelia burgdorferi
KEELDKKAI

SEQ ID NO: 29849 - protein, 9 aa, Borrelia burgdorferi
EELDKKAIN

SEQ ID NO: 29850 - protein, 9 aa, Borrelia burgdorferi
ELDKKAINL

SEQ ID NO: 29851 - protein, 9 aa, Borrelia burgdorferi
LDKKAINLD

SEQ ID NO: 29852 - protein, 9 aa, Borrelia burgdorferi
DKKAINLDK

SEQ ID NO: 29853 - protein, 9 aa, Borrelia burgdorferi
KKAINLDKA

SEQ ID NO: 29854 - protein, 9 aa, Borrelia burgdorferi
KAINLDKAQ

SEQ ID NO: 29855 - protein, 9 aa, Borrelia burgdorferi
AINLDKAQQ

SEQ ID NO: 29856 - protein, 9 aa, Borrelia burgdorferi
INLDKAQQK

SEQ ID NO: 29857 - protein, 9 aa, Borrelia burgdorferi
NLDKAQQKL

SEQ ID NO: 29858 - protein, 9 aa, Borrelia burgdorferi
LDKAQQKLD

SEQ ID NO: 29859 - protein, 9 aa, Borrelia burgdorferi
DKAQQKLDS

SEQ ID NO: 29860 - protein, 9 aa, Borrelia burgdorferi
KAQQKLDSA

SEQ ID NO: 29861 - protein, 9 aa, Borrelia burgdorferi
AQQKLDSAE

SEQ ID NO: 29862 - protein, 9 aa, Borrelia burgdorferi
QQKLDSAED

SEQ ID NO: 29863 - protein, 9 aa, Borrelia burgdorferi
QKLDSAEDN

SEQ ID NO: 29864 - protein, 9 aa, Borrelia burgdorferi
KLDSAEDNL

SEQ ID NO: 29865 - protein, 9 aa, Borrelia burgdorferi
LDSAEDNLD

SEQ ID NO: 29866 - protein, 9 aa, Borrelia burgdorferi
DSAEDNLDV

SEQ ID NO: 29867 - protein, 9 aa, Borrelia burgdorferi
SAEDNLDVQ

SEQ ID NO: 29868 - protein, 9 aa, Borrelia burgdorferi
AEDNLDVQR

SEQ ID NO: 29869 - protein, 9 aa, Borrelia burgdorferi
EDNLDVQRD

SEQ ID NO: 29870 - protein, 9 aa, Borrelia burgdorferi
DNLDVQRDT

SEQ ID NO: 29871 - protein, 9 aa, Borrelia burgdorferi
NLDVQRDTV

SEQ ID NO: 29872 - protein, 9 aa, Borrelia burgdorferi
LDVQRDTVR

SEQ ID NO: 29873 - protein, 9 aa, Borrelia burgdorferi
DVQRDTVRE

SEQ ID NO: 29874 - protein, 9 aa, Borrelia burgdorferi
VQRDTVREK

SEQ ID NO: 29875 - protein, 9 aa, Borrelia burgdorferi
QRDTVREKI

SEQ ID NO: 29876 - protein, 9 aa, Borrelia burgdorferi
RDTVREKIQ

SEQ ID NO: 29877 - protein, 9 aa, Borrelia burgdorferi
DTVREKIQE

SEQ ID NO: 29878 - protein, 9 aa, Borrelia burgdorferi
TVREKIQED

SEQ ID NO: 29879 - protein, 9 aa, Borrelia burgdorferi
VREKIQEDI

SEQ ID NO: 29880 - protein, 9 aa, Borrelia burgdorferi
REKIQEDIN

SEQ ID NO: 29881 - protein, 9 aa, Borrelia burgdorferi
EKIQEDINE

SEQ ID NO: 29882 - protein, 9 aa, Borrelia burgdorferi
KIQEDINEI

SEQ ID NO: 29883 - protein, 9 aa, Borrelia burgdorferi
IQEDINEIN

SEQ ID NO: 29884 - protein, 9 aa, Borrelia burgdorferi
QEDINEINK

SEQ ID NO: 29885 - protein, 9 aa, Borrelia burgdorferi
EDINEINKE

SEQ ID NO: 29886 - protein, 9 aa, Borrelia burgdorferi
DINEINKEK

SEQ ID NO: 29887 - protein, 9 aa, Borrelia burgdorferi
INEINKEKN

SEQ ID NO: 29888 - protein, 9 aa, Borrelia burgdorferi
NEINKEKNL

SEQ ID NO: 29889 - protein, 9 aa, Borrelia burgdorferi
EINKEKNLP

SEQ ID NO: 29890 - protein, 9 aa, Borrelia burgdorferi
INKEKNLPK

SEQ ID NO: 29891 - protein, 9 aa, Borrelia burgdorferi
NKEKNLPKP

SEQ ID NO: 29892 - protein, 9 aa, Borrelia burgdorferi
KEKNLPKPG

SEQ ID NO: 29893 - protein, 9 aa, Borrelia burgdorferi
EKNLPKPGD

SEQ ID NO: 29894 - protein, 9 aa, Borrelia burgdorferi
KNLPKPGDV

SEQ ID NO: 29895 - protein, 9 aa, Borrelia burgdorferi
NLPKPGDVS

SEQ ID NO: 29896 - protein, 9 aa, Borrelia burgdorferi
LPKPGDVSS

SEQ ID NO: 29897 - protein, 9 aa, Borrelia burgdorferi
PKPGDVSSP

SEQ ID NO: 29898 - protein, 9 aa, Borrelia burgdorferi
KPGDVSSPK

SEQ ID NO: 29899 - protein, 9 aa, Borrelia burgdorferi
PGDVSSPKV

SEQ ID NO: 29900 - protein, 9 aa, Borrelia burgdorferi
GDVSSPKVD

SEQ ID NO: 29901 - protein, 9 aa, Borrelia burgdorferi
DVSSPKVDK

SEQ ID NO: 29902 - protein, 9 aa, Borrelia burgdorferi
VSSPKVDKQ

SEQ ID NO: 29903 - protein, 9 aa, Borrelia burgdorferi
SSPKVDKQL

SEQ ID NO: 29904 - protein, 9 aa, Borrelia burgdorferi
SPKVDKQLQ

SEQ ID NO: 29905 - protein, 9 aa, Borrelia burgdorferi
PKVDKQLQI

SEQ ID NO: 29906 - protein, 9 aa, Borrelia burgdorferi
KVDKQLQIK

SEQ ID NO: 29907 - protein, 9 aa, Borrelia burgdorferi
VDKQLQIKE

SEQ ID NO: 29908 - protein, 9 aa, Borrelia burgdorferi
DKQLQIKES

SEQ ID NO: 29909 - protein, 9 aa, Borrelia burgdorferi
KQLQIKESL

SEQ ID NO: 29910 - protein, 9 aa, Borrelia burgdorferi
QLQIKESLE

SEQ ID NO: 29911 - protein, 9 aa, Borrelia burgdorferi
LQIKESLED

SEQ ID NO: 29912 - protein, 9 aa, Borrelia burgdorferi
QIKESLEDL

SEQ ID NO: 29913 - protein, 9 aa, Borrelia burgdorferi
IKESLEDLQ

SEQ ID NO: 29914 - protein, 9 aa, Borrelia burgdorferi
KESLEDLQE

SEQ ID NO: 29915 - protein, 9 aa, Borrelia burgdorferi
ESLEDLQEQ

SEQ ID NO: 29916 - protein, 9 aa, Borrelia burgdorferi
SLEDLQEQL

SEQ ID NO: 29917 - protein, 9 aa, Borrelia burgdorferi
LEDLQEQLK

SEQ ID NO: 29918 - protein, 9 aa, Borrelia burgdorferi
EDLQEQLKE

SEQ ID NO: 29919 - protein, 9 aa, Borrelia burgdorferi
DLQEQLKEA

SEQ ID NO: 29920 - protein, 9 aa, Borrelia burgdorferi
LQEQLKEAG

SEQ ID NO: 29921 - protein, 9 aa, Borrelia burgdorferi
QEQLKEAGD

SEQ ID NO: 29922 - protein, 9 aa, Borrelia burgdorferi
EQLKEAGDE

SEQ ID NO: 29923 - protein, 9 aa, Borrelia burgdorferi
QLKEAGDEN

SEQ ID NO: 29924 - protein, 9 aa, Borrelia burgdorferi
LKEAGDENQ

SEQ ID NO: 29925 - protein, 9 aa, Borrelia burgdorferi
KEAGDENQK

SEQ ID NO: 29926 - protein, 9 aa, Borrelia burgdorferi
EAGDENQKR

SEQ ID NO: 29927 - protein, 9 aa, Borrelia burgdorferi
AGDENQKRE

SEQ ID NO: 29928 - protein, 9 aa, Borrelia burgdorferi
GDENQKREI

SEQ ID NO: 29929 - protein, 9 aa, Borrelia burgdorferi
DENQKREIE

SEQ ID NO: 29930 - protein, 9 aa, Borrelia burgdorferi
ENQKREIEK

SEQ ID NO: 29931 - protein, 9 aa, Borrelia burgdorferi
NQKREIEKQ

SEQ ID NO: 29932 - protein, 9 aa, Borrelia burgdorferi
QKREIEKQI

SEQ ID NO: 29933 - protein, 9 aa, Borrelia burgdorferi
KREIEKQIE

SEQ ID NO: 29934 - protein, 9 aa, Borrelia burgdorferi
REIEKQIEI

SEQ ID NO: 29935 - protein, 9 aa, Borrelia burgdorferi
EIEKQIEIK

SEQ ID NO: 29936 - protein, 9 aa, Borrelia burgdorferi
IEKQIEIKK

SEQ ID NO: 29937 - protein, 9 aa, Borrelia burgdorferi
EKQIEIKKR

SEQ ID NO: 29938 - protein, 9 aa, Borrelia burgdorferi
KQIEIKKRD

SEQ ID NO: 29939 - protein, 9 aa, Borrelia burgdorferi
QIEIKKRDE

SEQ ID NO: 29940 - protein, 9 aa, Borrelia burgdorferi
IEIKKRDEE

SEQ ID NO: 29941 - protein, 9 aa, Borrelia burgdorferi
EIKKRDEEL

SEQ ID NO: 29942 - protein, 9 aa, Borrelia burgdorferi
IKKRDEELL

SEQ ID NO: 29943 - protein, 9 aa, Borrelia burgdorferi
KKRDEELLK

SEQ ID NO: 29944 - protein, 9 aa, Borrelia burgdorferi
KRDEELLKS

SEQ ID NO: 29945 - protein, 9 aa, Borrelia burgdorferi
RDEELLKSK

SEQ ID NO: 29946 - protein, 9 aa, Borrelia burgdorferi
DEELLKSKD

SEQ ID NO: 29947 - protein, 9 aa, Borrelia burgdorferi
EELLKSKDG

SEQ ID NO: 29948 - protein, 9 aa, Borrelia burgdorferi
ELLKSKDGK

SEQ ID NO: 29949 - protein, 9 aa, Borrelia burgdorferi
LLKSKDGKV

SEQ ID NO: 29950 - protein, 9 aa, Borrelia burgdorferi
LKSKDGKVS

SEQ ID NO: 29951 - protein, 9 aa, Borrelia burgdorferi
KSKDGKVSK

SEQ ID NO: 29952 - protein, 9 aa, Borrelia burgdorferi
SKDGKVSKD

SEQ ID NO: 29953 - protein, 9 aa, Borrelia burgdorferi
KDGKVSKDY

SEQ ID NO: 29954 - protein, 9 aa, Borrelia burgdorferi
DGKVSKDYE

SEQ ID NO: 29955 - protein, 9 aa, Borrelia burgdorferi
GKVSKDYEA

SEQ ID NO: 29956 - protein, 9 aa, Borrelia burgdorferi
KVSKDYEAL

SEQ ID NO: 29957 - protein, 9 aa, Borrelia burgdorferi
VSKDYEALD

SEQ ID NO: 29958 - protein, 9 aa, Borrelia burgdorferi
SKDYEALDL

SEQ ID NO: 29959 - protein, 9 aa, Borrelia burgdorferi
KDYEALDLD

SEQ ID NO: 29960 - protein, 9 aa, Borrelia burgdorferi
DYEALDLDR

SEQ ID NO: 29961 - protein, 9 aa, Borrelia burgdorferi
YEALDLDRE

SEQ ID NO: 29962 - protein, 9 aa, Borrelia burgdorferi
EALDLDREL

SEQ ID NO: 29963 - protein, 9 aa, Borrelia burgdorferi
ALDLDRELS

SEQ ID NO: 29964 - protein, 9 aa, Borrelia burgdorferi
LDLDRELSK

SEQ ID NO: 29965 - protein, 9 aa, Borrelia burgdorferi
DLDRELSKA

SEQ ID NO: 29966 - protein, 9 aa, Borrelia burgdorferi
LDRELSKAS

SEQ ID NO: 29967 - protein, 9 aa, Borrelia burgdorferi
DRELSKASS

SEQ ID NO: 29968 - protein, 9 aa, Borrelia burgdorferi
RELSKASSK

SEQ ID NO: 29969 - protein, 9 aa, Borrelia burgdorferi
ELSKASSKE

SEQ ID NO: 29970 - protein, 9 aa, Borrelia burgdorferi
LSKASSKEK

SEQ ID NO: 29971 - protein, 9 aa, Borrelia burgdorferi
SKASSKEKS

SEQ ID NO: 29972 - protein, 9 aa, Borrelia burgdorferi
KASSKEKSK

SEQ ID NO: 29973 - protein, 9 aa, Borrelia burgdorferi
ASSKEKSKV

SEQ ID NO: 29974 - protein, 9 aa, Borrelia burgdorferi
SSKEKSKVK

SEQ ID NO: 29975 - protein, 9 aa, Borrelia burgdorferi
SKEKSKVKE

SEQ ID NO: 29976 - protein, 9 aa, Borrelia burgdorferi
KEKSKVKEE

SEQ ID NO: 29977 - protein, 9 aa, Borrelia burgdorferi
EKSKVKEEE

SEQ ID NO: 29978 - protein, 9 aa, Borrelia burgdorferi
KSKVKEEEI

SEQ ID NO: 29979 - protein, 9 aa, Borrelia burgdorferi
SKVKEEEIT

SEQ ID NO: 29980 - protein, 9 aa, Borrelia burgdorferi
KVKEEEITK

SEQ ID NO: 29981 - protein, 9 aa, Borrelia burgdorferi
VKEEEITKG

SEQ ID NO: 29982 - protein, 9 aa, Borrelia burgdorferi
KEEEITKGK

SEQ ID NO: 29983 - protein, 9 aa, Borrelia burgdorferi
EEEITKGKS

SEQ ID NO: 29984 - protein, 9 aa, Borrelia burgdorferi
EEITKGKSR

SEQ ID NO: 29985 - protein, 9 aa, Borrelia burgdorferi
EITKGKSRA

SEQ ID NO: 29986 - protein, 9 aa, Borrelia burgdorferi
ITKGKSRAS

SEQ ID NO: 29987 - protein, 9 aa, Borrelia burgdorferi
TKGKSRASL

SEQ ID NO: 29988 - protein, 9 aa, Borrelia burgdorferi
KGKSRASLG

SEQ ID NO: 29989 - protein, 9 aa, Borrelia burgdorferi
GKSRASLGD

SEQ ID NO: 29990 - protein, 9 aa, Borrelia burgdorferi
KSRASLGDL

SEQ ID NO: 29991 - protein, 9 aa, Borrelia burgdorferi
SRASLGDLN

SEQ ID NO: 29992 - protein, 9 aa, Borrelia burgdorferi
RASLGDLNN

SEQ ID NO: 29993 - protein, 9 aa, Borrelia burgdorferi
ASLGDLNND

SEQ ID NO: 29994 - protein, 9 aa, Borrelia burgdorferi
SLGDLNNDK

SEQ ID NO: 29995 - protein, 9 aa, Borrelia burgdorferi
LGDLNNDKN

SEQ ID NO: 29996 - protein, 9 aa, Borrelia burgdorferi
GDLNNDKNL

SEQ ID NO: 29997 - protein, 9 aa, Borrelia burgdorferi
DLNNDKNLM

SEQ ID NO: 29998 - protein, 9 aa, Borrelia burgdorferi
LNNDKNLML

SEQ ID NO: 29999 - protein, 9 aa, Borrelia burgdorferi
NNDKNLMLP

SEQ ID NO: 30000 - protein, 9 aa, Borrelia burgdorferi
NDKNLMLPE

SEQ ID NO: 30001 - protein, 9 aa, Borrelia burgdorferi
DKNLMLPED

SEQ ID NO: 30002 - protein, 9 aa, Borrelia burgdorferi
KNLMLPEDQ

SEQ ID NO: 30003 - protein, 9 aa, Borrelia burgdorferi
NLMLPEDQK

SEQ ID NO: 30004 - protein, 9 aa, Borrelia burgdorferi
LMLPEDQKL

SEQ ID NO: 30005 - protein, 9 aa, Borrelia burgdorferi
MLPEDQKLP

SEQ ID NO: 30006 - protein, 9 aa, Borrelia burgdorferi
LPEDQKLPE

SEQ ID NO: 30007 - protein, 9 aa, Borrelia burgdorferi
PEDQKLPED

SEQ ID NO: 30008 - protein, 9 aa, Borrelia burgdorferi
EDQKLPEDK

SEQ ID NO: 30009 - protein, 9 aa, Borrelia burgdorferi
DQKLPEDKK

SEQ ID NO: 30010 - protein, 9 aa, Borrelia burgdorferi
QKLPEDKKL

SEQ ID NO: 30011 - protein, 9 aa, Borrelia burgdorferi
KLPEDKKLD

SEQ ID NO: 30012 - protein, 9 aa, Borrelia burgdorferi
LPEDKKLDS

SEQ ID NO: 30013 - protein, 9 aa, Borrelia burgdorferi
PEDKKLDSK

SEQ ID NO: 30014 - protein, 9 aa, Borrelia burgdorferi
EDKKLDSKL

SEQ ID NO: 30015 - protein, 9 aa, Borrelia burgdorferi
DKKLDSKLD

SEQ ID NO: 30016 - protein, 9 aa, Borrelia burgdorferi
KKLDSKLDG

SEQ ID NO: 30017 - protein, 9 aa, Borrelia burgdorferi
KLDSKLDGK

SEQ ID NO: 30018 - protein, 9 aa, Borrelia burgdorferi
LDSKLDGKK

SEQ ID NO: 30019 - protein, 9 aa, Borrelia burgdorferi
DSKLDGKKE

SEQ ID NO: 30020 - protein, 9 aa, Borrelia burgdorferi
SKLDGKKEF

SEQ ID NO: 30021 - protein, 9 aa, Borrelia burgdorferi
KLDGKKEFK

SEQ ID NO: 30022 - protein, 9 aa, Borrelia burgdorferi
LDGKKEFKP

SEQ ID NO: 30023 - protein, 9 aa, Borrelia burgdorferi
DGKKEFKPV

SEQ ID NO: 30024 - protein, 9 aa, Borrelia burgdorferi
GKKEFKPVS

SEQ ID NO: 30025 - protein, 9 aa, Borrelia burgdorferi
KKEFKPVSE

SEQ ID NO: 30026 - protein, 9 aa, Borrelia burgdorferi
KEFKPVSEV

SEQ ID NO: 30027 - protein, 9 aa, Borrelia burgdorferi
EFKPVSEVE

SEQ ID NO: 30028 - protein, 9 aa, Borrelia burgdorferi
FKPVSEVEK

SEQ ID NO: 30029 - protein, 9 aa, Borrelia burgdorferi
KPVSEVEKL

SEQ ID NO: 30030 - protein, 9 aa, Borrelia burgdorferi
PVSEVEKLD

SEQ ID NO: 30031 - protein, 9 aa, Borrelia burgdorferi
VSEVEKLDK

SEQ ID NO: 30032 - protein, 9 aa, Borrelia burgdorferi
SEVEKLDKI

SEQ ID NO: 30033 - protein, 9 aa, Borrelia burgdorferi
EVEKLDKIS

SEQ ID NO: 30034 - protein, 9 aa, Borrelia burgdorferi
VEKLDKISK

SEQ ID NO: 30035 - protein, 9 aa, Borrelia burgdorferi
EKLDKISKS

SEQ ID NO: 30036 - protein, 9 aa, Borrelia burgdorferi
KLDKISKSN

SEQ ID NO: 30037 - protein, 9 aa, Borrelia burgdorferi
LDKISKSNN

SEQ ID NO: 30038 - protein, 9 aa, Borrelia burgdorferi
DKISKSNNN

SEQ ID NO: 30039 - protein, 9 aa, Borrelia burgdorferi
KISKSNNNE

SEQ ID NO: 30040 - protein, 9 aa, Borrelia burgdorferi
ISKSNNNEV

SEQ ID NO: 30041 - protein, 9 aa, Borrelia burgdorferi
SKSNNNEVG

SEQ ID NO: 30042 - protein, 9 aa, Borrelia burgdorferi
KSNNNEVGK

SEQ ID NO: 30043 - protein, 9 aa, Borrelia burgdorferi
SNNNEVGKL

SEQ ID NO: 30044 - protein, 9 aa, Borrelia burgdorferi
NNNEVGKLS

SEQ ID NO: 30045 - protein, 9 aa, Borrelia burgdorferi
NNEVGKLSP

SEQ ID NO: 30046 - protein, 9 aa, Borrelia burgdorferi
NEVGKLSPL

SEQ ID NO: 30047 - protein, 9 aa, Borrelia burgdorferi
EVGKLSPLD

SEQ ID NO: 30048 - protein, 9 aa, Borrelia burgdorferi
VGKLSPLDK

SEQ ID NO: 30049 - protein, 9 aa, Borrelia burgdorferi
GKLSPLDKP

SEQ ID NO: 30050 - protein, 9 aa, Borrelia burgdorferi
KLSPLDKPS

SEQ ID NO: 30051 - protein, 9 aa, Borrelia burgdorferi
LSPLDKPSY

SEQ ID NO: 30052 - protein, 9 aa, Borrelia burgdorferi
SPLDKPSYD

SEQ ID NO: 30053 - protein, 9 aa, Borrelia burgdorferi
PLDKPSYDD

SEQ ID NO: 30054 - protein, 9 aa, Borrelia burgdorferi
LDKPSYDDI

SEQ ID NO: 30055 - protein, 9 aa, Borrelia burgdorferi
DKPSYDDID

SEQ ID NO: 30056 - protein, 9 aa, Borrelia burgdorferi
KPSYDDIDS

SEQ ID NO: 30057 - protein, 9 aa, Borrelia burgdorferi
PSYDDIDSK

SEQ ID NO: 30058 - protein, 9 aa, Borrelia burgdorferi
SYDDIDSKE

SEQ ID NO: 30059 - protein, 9 aa, Borrelia burgdorferi
YDDIDSKEE

SEQ ID NO: 30060 - protein, 9 aa, Borrelia burgdorferi
DDIDSKEEV

SEQ ID NO: 30061 - protein, 9 aa, Borrelia burgdorferi
DIDSKEEVD

SEQ ID NO: 30062 - protein, 9 aa, Borrelia burgdorferi
IDSKEEVDN

SEQ ID NO: 30063 - protein, 9 aa, Borrelia burgdorferi
DSKEEVDNK

SEQ ID NO: 30064 - protein, 9 aa, Borrelia burgdorferi
SKEEVDNKA

SEQ ID NO: 30065 - protein, 9 aa, Borrelia burgdorferi
KEEVDNKAI

SEQ ID NO: 30066 - protein, 9 aa, Borrelia burgdorferi
EEVDNKAIN

SEQ ID NO: 30067 - protein, 9 aa, Borrelia burgdorferi
EVDNKAINL

SEQ ID NO: 30068 - protein, 9 aa, Borrelia burgdorferi
VDNKAINLQ

SEQ ID NO: 30069 - protein, 9 aa, Borrelia burgdorferi
DNKAINLQK

SEQ ID NO: 30070 - protein, 9 aa, Borrelia burgdorferi
NKAINLQKI

SEQ ID NO: 30071 - protein, 9 aa, Borrelia burgdorferi
KAINLQKID

SEQ ID NO: 30072 - protein, 9 aa, Borrelia burgdorferi
AINLQKIDP

SEQ ID NO: 30073 - protein, 9 aa, Borrelia burgdorferi
INLQKIDPK

SEQ ID NO: 30074 - protein, 9 aa, Borrelia burgdorferi
NLQKIDPKV

SEQ ID NO: 30075 - protein, 9 aa, Borrelia burgdorferi
LQKIDPKVK

SEQ ID NO: 30076 - protein, 9 aa, Borrelia burgdorferi
QKIDPKVKD

SEQ ID NO: 30077 - protein, 9 aa, Borrelia burgdorferi
KIDPKVKDQ

SEQ ID NO: 30078 - protein, 9 aa, Borrelia burgdorferi
IDPKVKDQT

SEQ ID NO: 30079 - protein, 9 aa, Borrelia burgdorferi
DPKVKDQTT

SEQ ID NO: 30080 - protein, 9 aa, Borrelia burgdorferi
PKVKDQTTS

SEQ ID NO: 30081 - protein, 9 aa, Borrelia burgdorferi
KVKDQTTSL

SEQ ID NO: 30082 - protein, 9 aa, Borrelia burgdorferi
VKDQTTSLN

SEQ ID NO: 30083 - protein, 9 aa, Borrelia burgdorferi
KDQTTSLNE

SEQ ID NO: 30084 - protein, 9 aa, Borrelia burgdorferi
DQTTSLNED

SEQ ID NO: 30085 - protein, 9 aa, Borrelia burgdorferi
QTTSLNEDL

SEQ ID NO: 30086 - protein, 9 aa, Borrelia burgdorferi
TTSLNEDLD

SEQ ID NO: 30087 - protein, 9 aa, Borrelia burgdorferi
TSLNEDLDK

SEQ ID NO: 30088 - protein, 9 aa, Borrelia burgdorferi
SLNEDLDKD

SEQ ID NO: 30089 - protein, 9 aa, Borrelia burgdorferi
LNEDLDKDL

SEQ ID NO: 30090 - protein, 9 aa, Borrelia burgdorferi
NEDLDKDLT

SEQ ID NO: 30091 - protein, 9 aa, Borrelia burgdorferi
EDLDKDLTT

SEQ ID NO: 30092 - protein, 9 aa, Borrelia burgdorferi
DLDKDLTTM

SEQ ID NO: 30093 - protein, 9 aa, Borrelia burgdorferi
LDKDLTTMS

SEQ ID NO: 30094 - protein, 9 aa, Borrelia burgdorferi
DKDLTTMSI

SEQ ID NO: 30095 - protein, 9 aa, Borrelia burgdorferi
KDLTTMSID

SEQ ID NO: 30096 - protein, 9 aa, Borrelia burgdorferi
DLTTMSIDS

SEQ ID NO: 30097 - protein, 9 aa, Borrelia burgdorferi
LTTMSIDSS

SEQ ID NO: 30098 - protein, 9 aa, Borrelia burgdorferi
TTMSIDSSS

SEQ ID NO: 30099 - protein, 9 aa, Borrelia burgdorferi
TMSIDSSSP

SEQ ID NO: 30100 - protein, 9 aa, Borrelia burgdorferi
MSIDSSSPV

SEQ ID NO: 30101 - protein, 9 aa, Borrelia burgdorferi
SIDSSSPVF

SEQ ID NO: 30102 - protein, 9 aa, Borrelia burgdorferi
IDSSSPVFL

SEQ ID NO: 30103 - protein, 9 aa, Borrelia burgdorferi
DSSSPVFLE

SEQ ID NO: 30104 - protein, 9 aa, Borrelia burgdorferi
SSSPVFLEV

SEQ ID NO: 30105 - protein, 9 aa, Borrelia burgdorferi
SSPVFLEVI

SEQ ID NO: 30106 - protein, 9 aa, Borrelia burgdorferi
SPVFLEVID

SEQ ID NO: 30107 - protein, 9 aa, Borrelia burgdorferi
PVFLEVIDP

SEQ ID NO: 30108 - protein, 9 aa, Borrelia burgdorferi
VFLEVIDPI

SEQ ID NO: 30109 - protein, 9 aa, Borrelia burgdorferi
FLEVIDPIT

SEQ ID NO: 30110 - protein, 9 aa, Borrelia burgdorferi
LEVIDPITN

SEQ ID NO: 30111 - protein, 9 aa, Borrelia burgdorferi
EVIDPITNL

SEQ ID NO: 30112 - protein, 9 aa, Borrelia burgdorferi
VIDPITNLG

SEQ ID NO: 30113 - protein, 9 aa, Borrelia burgdorferi
IDPITNLGT

SEQ ID NO: 30114 - protein, 9 aa, Borrelia burgdorferi
DPITNLGTL

SEQ ID NO: 30115 - protein, 9 aa, Borrelia burgdorferi
PITNLGTLQ

SEQ ID NO: 30116 - protein, 9 aa, Borrelia burgdorferi
ITNLGTLQL

SEQ ID NO: 30117 - protein, 9 aa, Borrelia burgdorferi
TNLGTLQLI

SEQ ID NO: 30118 - protein, 9 aa, Borrelia burgdorferi
NLGTLQLID

SEQ ID NO: 30119 - protein, 9 aa, Borrelia burgdorferi
LGTLQLIDL

SEQ ID NO: 30120 - protein, 9 aa, Borrelia burgdorferi
GTLQLIDLN

SEQ ID NO: 30121 - protein, 9 aa, Borrelia burgdorferi
TLQLIDLNT

SEQ ID NO: 30122 - protein, 9 aa, Borrelia burgdorferi
LQLIDLNTG

SEQ ID NO: 30123 - protein, 9 aa, Borrelia burgdorferi
QLIDLNTGV

SEQ ID NO: 30124 - protein, 9 aa, Borrelia burgdorferi
LIDLNTGVR

SEQ ID NO: 30125 - protein, 9 aa, Borrelia burgdorferi
IDLNTGVRL

SEQ ID NO: 30126 - protein, 9 aa, Borrelia burgdorferi
DLNTGVRLK

SEQ ID NO: 30127 - protein, 9 aa, Borrelia burgdorferi
LNTGVRLKE

SEQ ID NO: 30128 - protein, 9 aa, Borrelia burgdorferi
NTGVRLKES

SEQ ID NO: 30129 - protein, 9 aa, Borrelia burgdorferi
TGVRLKEST

SEQ ID NO: 30130 - protein, 9 aa, Borrelia burgdorferi
GVRLKESTQ

SEQ ID NO: 30131 - protein, 9 aa, Borrelia burgdorferi
VRLKESTQQ

SEQ ID NO: 30132 - protein, 9 aa, Borrelia burgdorferi
RLKESTQQG

SEQ ID NO: 30133 - protein, 9 aa, Borrelia burgdorferi
LKESTQQGI

SEQ ID NO: 30134 - protein, 9 aa, Borrelia burgdorferi
KESTQQGIQ

SEQ ID NO: 30135 - protein, 9 aa, Borrelia burgdorferi
ESTQQGIQR

SEQ ID NO: 30136 - protein, 9 aa, Borrelia burgdorferi
STQQGIQRY

SEQ ID NO: 30137 - protein, 9 aa, Borrelia burgdorferi
TQQGIQRYG

SEQ ID NO: 30138 - protein, 9 aa, Borrelia burgdorferi
QQGIQRYGI

SEQ ID NO: 30139 - protein, 9 aa, Borrelia burgdorferi
QGIQRYGIY

SEQ ID NO: 30140 - protein, 9 aa, Borrelia burgdorferi
GIQRYGIYE

SEQ ID NO: 30141 - protein, 9 aa, Borrelia burgdorferi
IQRYGIYER

SEQ ID NO: 30142 - protein, 9 aa, Borrelia burgdorferi
QRYGIYERE

SEQ ID NO: 30143 - protein, 9 aa, Borrelia burgdorferi
RYGIYEREK

SEQ ID NO: 30144 - protein, 9 aa, Borrelia burgdorferi
YGIYEREKD

SEQ ID NO: 30145 - protein, 9 aa, Borrelia burgdorferi
GIYEREKDL

SEQ ID NO: 30146 - protein, 9 aa, Borrelia burgdorferi
IYEREKDLV

SEQ ID NO: 30147 - protein, 9 aa, Borrelia burgdorferi
YEREKDLVV

SEQ ID NO: 30148 - protein, 9 aa, Borrelia burgdorferi
EREKDLVVI

SEQ ID NO: 30149 - protein, 9 aa, Borrelia burgdorferi
REKDLVVIK

SEQ ID NO: 30150 - protein, 9 aa, Borrelia burgdorferi
EKDLVVIKM

SEQ ID NO: 30151 - protein, 9 aa, Borrelia burgdorferi
KDLVVIKMD

SEQ ID NO: 30152 - protein, 9 aa, Borrelia burgdorferi
DLVVIKMDS

SEQ ID NO: 30153 - protein, 9 aa, Borrelia burgdorferi
LVVIKMDSG

SEQ ID NO: 30154 - protein, 9 aa, Borrelia burgdorferi
VVIKMDSGK

SEQ ID NO: 30155 - protein, 9 aa, Borrelia burgdorferi
VIKMDSGKA

SEQ ID NO: 30156 - protein, 9 aa, Borrelia burgdorferi
IKMDSGKAK

SEQ ID NO: 30157 - protein, 9 aa, Borrelia burgdorferi
KMDSGKAKL

SEQ ID NO: 30158 - protein, 9 aa, Borrelia burgdorferi
MDSGKAKLQ

SEQ ID NO: 30159 - protein, 9 aa, Borrelia burgdorferi
DSGKAKLQI

SEQ ID NO: 30160 - protein, 9 aa, Borrelia burgdorferi
SGKAKLQIL

SEQ ID NO: 30161 - protein, 9 aa, Borrelia burgdorferi
GKAKLQILN

SEQ ID NO: 30162 - protein, 9 aa, Borrelia burgdorferi
KAKLQILNK

SEQ ID NO: 30163 - protein, 9 aa, Borrelia burgdorferi
AKLQILNKL

SEQ ID NO: 30164 - protein, 9 aa, Borrelia burgdorferi
KLQILNKLE

SEQ ID NO: 30165 - protein, 9 aa, Borrelia burgdorferi
LQILNKLEN

SEQ ID NO: 30166 - protein, 9 aa, Borrelia burgdorferi
QILNKLENL

SEQ ID NO: 30167 - protein, 9 aa, Borrelia burgdorferi
ILNKLENLK

SEQ ID NO: 30168 - protein, 9 aa, Borrelia burgdorferi
LNKLENLKV

SEQ ID NO: 30169 - protein, 9 aa, Borrelia burgdorferi
NKLENLKVV

SEQ ID NO: 30170 - protein, 9 aa, Borrelia burgdorferi
KLENLKVVS

SEQ ID NO: 30171 - protein, 9 aa, Borrelia burgdorferi
LENLKVVSE

SEQ ID NO: 30172 - protein, 9 aa, Borrelia burgdorferi
ENLKVVSES

SEQ ID NO: 30173 - protein, 9 aa, Borrelia burgdorferi
NLKVVSESN

SEQ ID NO: 30174 - protein, 9 aa, Borrelia burgdorferi
LKVVSESNF

SEQ ID NO: 30175 - protein, 9 aa, Borrelia burgdorferi
KVVSESNFE

SEQ ID NO: 30176 - protein, 9 aa, Borrelia burgdorferi
VVSESNFEI

SEQ ID NO: 30177 - protein, 9 aa, Borrelia burgdorferi
VSESNFEIN

SEQ ID NO: 30178 - protein, 9 aa, Borrelia burgdorferi
SESNFEINK

SEQ ID NO: 30179 - protein, 9 aa, Borrelia burgdorferi
ESNFEINKN

SEQ ID NO: 30180 - protein, 9 aa, Borrelia burgdorferi
SNFEINKNS

SEQ ID NO: 30181 - protein, 9 aa, Borrelia burgdorferi
NFEINKNSS

SEQ ID NO: 30182 - protein, 9 aa, Borrelia burgdorferi
FEINKNSSL

SEQ ID NO: 30183 - protein, 9 aa, Borrelia burgdorferi
EINKNSSLY

SEQ ID NO: 30184 - protein, 9 aa, Borrelia burgdorferi
INKNSSLYV

SEQ ID NO: 30185 - protein, 9 aa, Borrelia burgdorferi
NKNSSLYVD

SEQ ID NO: 30186 - protein, 9 aa, Borrelia burgdorferi
KNSSLYVDS

SEQ ID NO: 30187 - protein, 9 aa, Borrelia burgdorferi
NSSLYVDSK

SEQ ID NO: 30188 - protein, 9 aa, Borrelia burgdorferi
SSLYVDSKM

SEQ ID NO: 30189 - protein, 9 aa, Borrelia burgdorferi
SLYVDSKMI

SEQ ID NO: 30190 - protein, 9 aa, Borrelia burgdorferi
LYVDSKMIL

SEQ ID NO: 30191 - protein, 9 aa, Borrelia burgdorferi
YVDSKMILA

SEQ ID NO: 30192 - protein, 9 aa, Borrelia burgdorferi
VDSKMILAA

SEQ ID NO: 30193 - protein, 9 aa, Borrelia burgdorferi
DSKMILAAV

SEQ ID NO: 30194 - protein, 9 aa, Borrelia burgdorferi
SKMILAAVR

SEQ ID NO: 30195 - protein, 9 aa, Borrelia burgdorferi
KMILAAVRD

SEQ ID NO: 30196 - protein, 9 aa, Borrelia burgdorferi
MILAAVRDK

SEQ ID NO: 30197 - protein, 9 aa, Borrelia burgdorferi
ILAAVRDKD

SEQ ID NO: 30198 - protein, 9 aa, Borrelia burgdorferi
LAAVRDKDD

SEQ ID NO: 30199 - protein, 9 aa, Borrelia burgdorferi
AAVRDKDDS

SEQ ID NO: 30200 - protein, 9 aa, Borrelia burgdorferi
AVRDKDDSN

SEQ ID NO: 30201 - protein, 9 aa, Borrelia burgdorferi
VRDKDDSNA

SEQ ID NO: 30202 - protein, 9 aa, Borrelia burgdorferi
RDKDDSNAW

SEQ ID NO: 30203 - protein, 9 aa, Borrelia burgdorferi
DKDDSNAWR

SEQ ID NO: 30204 - protein, 9 aa, Borrelia burgdorferi
KDDSNAWRL

SEQ ID NO: 30205 - protein, 9 aa, Borrelia burgdorferi
DDSNAWRLA

SEQ ID NO: 30206 - protein, 9 aa, Borrelia burgdorferi
DSNAWRLAK

SEQ ID NO: 30207 - protein, 9 aa, Borrelia burgdorferi
SNAWRLAKF

SEQ ID NO: 30208 - protein, 9 aa, Borrelia burgdorferi
NAWRLAKFS

SEQ ID NO: 30209 - protein, 9 aa, Borrelia burgdorferi
AWRLAKFSP

SEQ ID NO: 30210 - protein, 9 aa, Borrelia burgdorferi
WRLAKFSPK

SEQ ID NO: 30211 - protein, 9 aa, Borrelia burgdorferi
RLAKFSPKN

SEQ ID NO: 30212 - protein, 9 aa, Borrelia burgdorferi
LAKFSPKNL

SEQ ID NO: 30213 - protein, 9 aa, Borrelia burgdorferi
AKFSPKNLD

SEQ ID NO: 30214 - protein, 9 aa, Borrelia burgdorferi
KFSPKNLDE

SEQ ID NO: 30215 - protein, 9 aa, Borrelia burgdorferi
FSPKNLDEF

SEQ ID NO: 30216 - protein, 9 aa, Borrelia burgdorferi
SPKNLDEFI

SEQ ID NO: 30217 - protein, 9 aa, Borrelia burgdorferi
PKNLDEFIL

SEQ ID NO: 30218 - protein, 9 aa, Borrelia burgdorferi
KNLDEFILS

SEQ ID NO: 30219 - protein, 9 aa, Borrelia burgdorferi
NLDEFILSE

SEQ ID NO: 30220 - protein, 9 aa, Borrelia burgdorferi
LDEFILSEN

SEQ ID NO: 30221 - protein, 9 aa, Borrelia burgdorferi
DEFILSENK

SEQ ID NO: 30222 - protein, 9 aa, Borrelia burgdorferi
EFILSENKI

SEQ ID NO: 30223 - protein, 9 aa, Borrelia burgdorferi
FILSENKIL

SEQ ID NO: 30224 - protein, 9 aa, Borrelia burgdorferi
ILSENKILP

SEQ ID NO: 30225 - protein, 9 aa, Borrelia burgdorferi
LSENKILPF

SEQ ID NO: 30226 - protein, 9 aa, Borrelia burgdorferi
SENKILPFT

SEQ ID NO: 30227 - protein, 9 aa, Borrelia burgdorferi
ENKILPFTS

SEQ ID NO: 30228 - protein, 9 aa, Borrelia burgdorferi
NKILPFTSF

SEQ ID NO: 30229 - protein, 9 aa, Borrelia burgdorferi
KILPFTSFS

SEQ ID NO: 30230 - protein, 9 aa, Borrelia burgdorferi
ILPFTSFSV

SEQ ID NO: 30231 - protein, 9 aa, Borrelia burgdorferi
LPFTSFSVR

SEQ ID NO: 30232 - protein, 9 aa, Borrelia burgdorferi
PFTSFSVRK

SEQ ID NO: 30233 - protein, 9 aa, Borrelia burgdorferi
FTSFSVRKN

SEQ ID NO: 30234 - protein, 9 aa, Borrelia burgdorferi
TSFSVRKNF

SEQ ID NO: 30235 - protein, 9 aa, Borrelia burgdorferi
SFSVRKNFI

SEQ ID NO: 30236 - protein, 9 aa, Borrelia burgdorferi
FSVRKNFIY

SEQ ID NO: 30237 - protein, 9 aa, Borrelia burgdorferi
SVRKNFIYL

SEQ ID NO: 30238 - protein, 9 aa, Borrelia burgdorferi
VRKNFIYLQ

SEQ ID NO: 30239 - protein, 9 aa, Borrelia burgdorferi
RKNFIYLQD

SEQ ID NO: 30240 - protein, 9 aa, Borrelia burgdorferi
KNFIYLQDE

SEQ ID NO: 30241 - protein, 9 aa, Borrelia burgdorferi
NFIYLQDEL

SEQ ID NO: 30242 - protein, 9 aa, Borrelia burgdorferi
FIYLQDELK

SEQ ID NO: 30243 - protein, 9 aa, Borrelia burgdorferi
IYLQDELKN

SEQ ID NO: 30244 - protein, 9 aa, Borrelia burgdorferi
YLQDELKNL

SEQ ID NO: 30245 - protein, 9 aa, Borrelia burgdorferi
LQDELKNLV

SEQ ID NO: 30246 - protein, 9 aa, Borrelia burgdorferi
QDELKNLVI

SEQ ID NO: 30247 - protein, 9 aa, Borrelia burgdorferi
DELKNLVIL

SEQ ID NO: 30248 - protein, 9 aa, Borrelia burgdorferi
ELKNLVILD

SEQ ID NO: 30249 - protein, 9 aa, Borrelia burgdorferi
LKNLVILDV

SEQ ID NO: 30250 - protein, 9 aa, Borrelia burgdorferi
KNLVILDVN

SEQ ID NO: 30251 - protein, 9 aa, Borrelia burgdorferi
NLVILDVNT

SEQ ID NO: 30252 - protein, 9 aa, Borrelia burgdorferi
LVILDVNTL

SEQ ID NO: 30253 - protein, 9 aa, Borrelia burgdorferi
VILDVNTLK

SEQ ID NO: 30254 - protein, 9 aa, Borrelia burgdorferi
ILDVNTLKK

SEQ ID NO: 30255 - protein, 9 aa, Borrelia burgdorferi
LDVNTLKKV

SEQ ID NO: 30256 - protein, 9 aa, Borrelia burgdorferi
DVNTLKKVK

SEQ ID NO: 30257 - protein, 10 aa, Borrelia burgdorferi
MKKMLLIFSF

SEQ ID NO: 30258 - protein, 10 aa, Borrelia burgdorferi
KKMLLIFSFF

SEQ ID NO: 30259 - protein, 10 aa, Borrelia burgdorferi
KMLLIFSFFL

SEQ ID NO: 30260 - protein, 10 aa, Borrelia burgdorferi
MLLIFSFFLI

SEQ ID NO: 30261 - protein, 10 aa, Borrelia burgdorferi
LLIFSFFLIF

SEQ ID NO: 30262 - protein, 10 aa, Borrelia burgdorferi
LIFSFFLIFL

SEQ ID NO: 30263 - protein, 10 aa, Borrelia burgdorferi
IFSFFLIFLN

SEQ ID NO: 30264 - protein, 10 aa, Borrelia burgdorferi
FSFFLIFLNG

SEQ ID NO: 30265 - protein, 10 aa, Borrelia burgdorferi
SFFLIFLNGF

SEQ ID NO: 30266 - protein, 10 aa, Borrelia burgdorferi
FFLIFLNGFP

SEQ ID NO: 30267 - protein, 10 aa, Borrelia burgdorferi
FLIFLNGFPL

SEQ ID NO: 30268 - protein, 10 aa, Borrelia burgdorferi
LIFLNGFPLN

SEQ ID NO: 30269 - protein, 10 aa, Borrelia burgdorferi
IFLNGFPLNA

SEQ ID NO: 30270 - protein, 10 aa, Borrelia burgdorferi
FLNGFPLNAR

SEQ ID NO: 30271 - protein, 10 aa, Borrelia burgdorferi
LNGFPLNARK

SEQ ID NO: 30272 - protein, 10 aa, Borrelia burgdorferi
NGFPLNARKV

SEQ ID NO: 30273 - protein, 10 aa, Borrelia burgdorferi
GFPLNARKVD

SEQ ID NO: 30274 - protein, 10 aa, Borrelia burgdorferi
FPLNARKVDK

SEQ ID NO: 30275 - protein, 10 aa, Borrelia burgdorferi
PLNARKVDKE

SEQ ID NO: 30276 - protein, 10 aa, Borrelia burgdorferi
LNARKVDKEK

SEQ ID NO: 30277 - protein, 10 aa, Borrelia burgdorferi
NARKVDKEKL

SEQ ID NO: 30278 - protein, 10 aa, Borrelia burgdorferi
ARKVDKEKLK

SEQ ID NO: 30279 - protein, 10 aa, Borrelia burgdorferi
RKVDKEKLKD

SEQ ID NO: 30280 - protein, 10 aa, Borrelia burgdorferi
KVDKEKLKDF

SEQ ID NO: 30281 - protein, 10 aa, Borrelia burgdorferi
VDKEKLKDFV

SEQ ID NO: 30282 - protein, 10 aa, Borrelia burgdorferi
DKEKLKDFVN

SEQ ID NO: 30283 - protein, 10 aa, Borrelia burgdorferi
KEKLKDFVNM

SEQ ID NO: 30284 - protein, 10 aa, Borrelia burgdorferi
EKLKDFVNMD

SEQ ID NO: 30285 - protein, 10 aa, Borrelia burgdorferi
KLKDFVNMDL

SEQ ID NO: 30286 - protein, 10 aa, Borrelia burgdorferi
LKDFVNMDLE

SEQ ID NO: 30287 - protein, 10 aa, Borrelia burgdorferi
KDFVNMDLEF

SEQ ID NO: 30288 - protein, 10 aa, Borrelia burgdorferi
DFVNMDLEFV

SEQ ID NO: 30289 - protein, 10 aa, Borrelia burgdorferi
FVNMDLEFVN

SEQ ID NO: 30290 - protein, 10 aa, Borrelia burgdorferi
VNMDLEFVNY

SEQ ID NO: 30291 - protein, 10 aa, Borrelia burgdorferi
NMDLEFVNYK

SEQ ID NO: 30292 - protein, 10 aa, Borrelia burgdorferi
MDLEFVNYKG

SEQ ID NO: 30293 - protein, 10 aa, Borrelia burgdorferi
DLEFVNYKGP

SEQ ID NO: 30294 - protein, 10 aa, Borrelia burgdorferi
LEFVNYKGPY

SEQ ID NO: 30295 - protein, 10 aa, Borrelia burgdorferi
EFVNYKGPYD

SEQ ID NO: 30296 - protein, 10 aa, Borrelia burgdorferi
FVNYKGPYDS

SEQ ID NO: 30297 - protein, 10 aa, Borrelia burgdorferi
VNYKGPYDST

SEQ ID NO: 30298 - protein, 10 aa, Borrelia burgdorferi
NYKGPYDSTN

SEQ ID NO: 30299 - protein, 10 aa, Borrelia burgdorferi
YKGPYDSTNT

SEQ ID NO: 30300 - protein, 10 aa, Borrelia burgdorferi
KGPYDSTNTY

SEQ ID NO: 30301 - protein, 10 aa, Borrelia burgdorferi
GPYDSTNTYE

SEQ ID NO: 30302 - protein, 10 aa, Borrelia burgdorferi
PYDSTNTYEQ

SEQ ID NO: 30303 - protein, 10 aa, Borrelia burgdorferi
YDSTNTYEQI

SEQ ID NO: 30304 - protein, 10 aa, Borrelia burgdorferi
DSTNTYEQIV

SEQ ID NO: 30305 - protein, 10 aa, Borrelia burgdorferi
STNTYEQIVG

SEQ ID NO: 30306 - protein, 10 aa, Borrelia burgdorferi
TNTYEQIVGI

SEQ ID NO: 30307 - protein, 10 aa, Borrelia burgdorferi
NTYEQIVGIG

SEQ ID NO: 30308 - protein, 10 aa, Borrelia burgdorferi
TYEQIVGIGE

SEQ ID NO: 30309 - protein, 10 aa, Borrelia burgdorferi
YEQIVGIGEF

SEQ ID NO: 30310 - protein, 10 aa, Borrelia burgdorferi
EQIVGIGEFL

SEQ ID NO: 30311 - protein, 10 aa, Borrelia burgdorferi
QIVGIGEFLA

SEQ ID NO: 30312 - protein, 10 aa, Borrelia burgdorferi
IVGIGEFLAR

SEQ ID NO: 30313 - protein, 10 aa, Borrelia burgdorferi
VGIGEFLARP

SEQ ID NO: 30314 - protein, 10 aa, Borrelia burgdorferi
GIGEFLARPL

SEQ ID NO: 30315 - protein, 10 aa, Borrelia burgdorferi
IGEFLARPLT

SEQ ID NO: 30316 - protein, 10 aa, Borrelia burgdorferi
GEFLARPLTN

SEQ ID NO: 30317 - protein, 10 aa, Borrelia burgdorferi
EFLARPLTNS

SEQ ID NO: 30318 - protein, 10 aa, Borrelia burgdorferi
FLARPLTNSN

SEQ ID NO: 30319 - protein, 10 aa, Borrelia burgdorferi
LARPLTNSNS

SEQ ID NO: 30320 - protein, 10 aa, Borrelia burgdorferi
ARPLTNSNSN

SEQ ID NO: 30321 - protein, 10 aa, Borrelia burgdorferi
RPLTNSNSNS

SEQ ID NO: 30322 - protein, 10 aa, Borrelia burgdorferi
PLTNSNSNSS

SEQ ID NO: 30323 - protein, 10 aa, Borrelia burgdorferi
LTNSNSNSSY

SEQ ID NO: 30324 - protein, 10 aa, Borrelia burgdorferi
TNSNSNSSYY

SEQ ID NO: 30325 - protein, 10 aa, Borrelia burgdorferi
NSNSNSSYYG

SEQ ID NO: 30326 - protein, 10 aa, Borrelia burgdorferi
SNSNSSYYGK

SEQ ID NO: 30327 - protein, 10 aa, Borrelia burgdorferi
NSNSSYYGKY

SEQ ID NO: 30328 - protein, 10 aa, Borrelia burgdorferi
SNSSYYGKYF

SEQ ID NO: 30329 - protein, 10 aa, Borrelia burgdorferi
NSSYYGKYFI

SEQ ID NO: 30330 - protein, 10 aa, Borrelia burgdorferi
SSYYGKYFIN

SEQ ID NO: 30331 - protein, 10 aa, Borrelia burgdorferi
SYYGKYFINR

SEQ ID NO: 30332 - protein, 10 aa, Borrelia burgdorferi
YYGKYFINRF

SEQ ID NO: 30333 - protein, 10 aa, Borrelia burgdorferi
YGKYFINRFI

SEQ ID NO: 30334 - protein, 10 aa, Borrelia burgdorferi
GKYFINRFID

SEQ ID NO: 30335 - protein, 10 aa, Borrelia burgdorferi
KYFINRFIDD

SEQ ID NO: 30336 - protein, 10 aa, Borrelia burgdorferi
YFINRFIDDQ

SEQ ID NO: 30337 - protein, 10 aa, Borrelia burgdorferi
FINRFIDDQD

SEQ ID NO: 30338 - protein, 10 aa, Borrelia burgdorferi
INRFIDDQDK

SEQ ID NO: 30339 - protein, 10 aa, Borrelia burgdorferi
NRFIDDQDKK

SEQ ID NO: 30340 - protein, 10 aa, Borrelia burgdorferi
RFIDDQDKKA

SEQ ID NO: 30341 - protein, 10 aa, Borrelia burgdorferi
FIDDQDKKAS

SEQ ID NO: 30342 - protein, 10 aa, Borrelia burgdorferi
IDDQDKKASV

SEQ ID NO: 30343 - protein, 10 aa, Borrelia burgdorferi
DDQDKKASVD

SEQ ID NO: 30344 - protein, 10 aa, Borrelia burgdorferi
DQDKKASVDV

SEQ ID NO: 30345 - protein, 10 aa, Borrelia burgdorferi
QDKKASVDVF

SEQ ID NO: 30346 - protein, 10 aa, Borrelia burgdorferi
DKKASVDVFS

SEQ ID NO: 30347 - protein, 10 aa, Borrelia burgdorferi
KKASVDVFSI

SEQ ID NO: 30348 - protein, 10 aa, Borrelia burgdorferi
KASVDVFSIS

SEQ ID NO: 30349 - protein, 10 aa, Borrelia burgdorferi
ASVDVFSISS

SEQ ID NO: 30350 - protein, 10 aa, Borrelia burgdorferi
SVDVFSISSK

SEQ ID NO: 30351 - protein, 10 aa, Borrelia burgdorferi
VDVFSISSKS

SEQ ID NO: 30352 - protein, 10 aa, Borrelia burgdorferi
DVFSISSKSE

SEQ ID NO: 30353 - protein, 10 aa, Borrelia burgdorferi
VFSISSKSEL

SEQ ID NO: 30354 - protein, 10 aa, Borrelia burgdorferi
FSISSKSELD

SEQ ID NO: 30355 - protein, 10 aa, Borrelia burgdorferi
SISSKSELDS

SEQ ID NO: 30356 - protein, 10 aa, Borrelia burgdorferi
ISSKSELDSI

SEQ ID NO: 30357 - protein, 10 aa, Borrelia burgdorferi
SSKSELDSIL

SEQ ID NO: 30358 - protein, 10 aa, Borrelia burgdorferi
SKSELDSILN

SEQ ID NO: 30359 - protein, 10 aa, Borrelia burgdorferi
KSELDSILNL

SEQ ID NO: 30360 - protein, 10 aa, Borrelia burgdorferi
SELDSILNLR

SEQ ID NO: 30361 - protein, 10 aa, Borrelia burgdorferi
ELDSILNLRR

SEQ ID NO: 30362 - protein, 10 aa, Borrelia burgdorferi
LDSILNLRRI

SEQ ID NO: 30363 - protein, 10 aa, Borrelia burgdorferi
DSILNLRRIL

SEQ ID NO: 30364 - protein, 10 aa, Borrelia burgdorferi
SILNLRRILT

SEQ ID NO: 30365 - protein, 10 aa, Borrelia burgdorferi
ILNLRRILTG

SEQ ID NO: 30366 - protein, 10 aa, Borrelia burgdorferi
LNLRRILTGY

SEQ ID NO: 30367 - protein, 10 aa, Borrelia burgdorferi
NLRRILTGYI

SEQ ID NO: 30368 - protein, 10 aa, Borrelia burgdorferi
LRRILTGYII

SEQ ID NO: 30369 - protein, 10 aa, Borrelia burgdorferi
RRILTGYIIK

SEQ ID NO: 30370 - protein, 10 aa, Borrelia burgdorferi
RILTGYIIKS

SEQ ID NO: 30371 - protein, 10 aa, Borrelia burgdorferi
ILTGYIIKSF

SEQ ID NO: 30372 - protein, 10 aa, Borrelia burgdorferi
LTGYIIKSFD

SEQ ID NO: 30373 - protein, 10 aa, Borrelia burgdorferi
TGYIIKSFDY

SEQ ID NO: 30374 - protein, 10 aa, Borrelia burgdorferi
GYIIKSFDYD

SEQ ID NO: 30375 - protein, 10 aa, Borrelia burgdorferi
YIIKSFDYDR

SEQ ID NO: 30376 - protein, 10 aa, Borrelia burgdorferi
IIKSFDYDRS

SEQ ID NO: 30377 - protein, 10 aa, Borrelia burgdorferi
IKSFDYDRSS

SEQ ID NO: 30378 - protein, 10 aa, Borrelia burgdorferi
KSFDYDRSSA

SEQ ID NO: 30379 - protein, 10 aa, Borrelia burgdorferi
SFDYDRSSAE

SEQ ID NO: 30380 - protein, 10 aa, Borrelia burgdorferi
FDYDRSSAEL

SEQ ID NO: 30381 - protein, 10 aa, Borrelia burgdorferi
DYDRSSAELI

SEQ ID NO: 30382 - protein, 10 aa, Borrelia burgdorferi
YDRSSAELIA

SEQ ID NO: 30383 - protein, 10 aa, Borrelia burgdorferi
DRSSAELIAK

SEQ ID NO: 30384 - protein, 10 aa, Borrelia burgdorferi
RSSAELIAKV

SEQ ID NO: 30385 - protein, 10 aa, Borrelia burgdorferi
SSAELIAKVI

SEQ ID NO: 30386 - protein, 10 aa, Borrelia burgdorferi
SAELIAKVIT

SEQ ID NO: 30387 - protein, 10 aa, Borrelia burgdorferi
AELIAKVITI

SEQ ID NO: 30388 - protein, 10 aa, Borrelia burgdorferi
ELIAKVITIY

SEQ ID NO: 30389 - protein, 10 aa, Borrelia burgdorferi
LIAKVITIYN

SEQ ID NO: 30390 - protein, 10 aa, Borrelia burgdorferi
IAKVITIYNA

SEQ ID NO: 30391 - protein, 10 aa, Borrelia burgdorferi
AKVITIYNAV

SEQ ID NO: 30392 - protein, 10 aa, Borrelia burgdorferi
KVITIYNAVY

SEQ ID NO: 30393 - protein, 10 aa, Borrelia burgdorferi
VITIYNAVYR

SEQ ID NO: 30394 - protein, 10 aa, Borrelia burgdorferi
ITIYNAVYRG

SEQ ID NO: 30395 - protein, 10 aa, Borrelia burgdorferi
TIYNAVYRGD

SEQ ID NO: 30396 - protein, 10 aa, Borrelia burgdorferi
IYNAVYRGDL

SEQ ID NO: 30397 - protein, 10 aa, Borrelia burgdorferi
YNAVYRGDLD

SEQ ID NO: 30398 - protein, 10 aa, Borrelia burgdorferi
NAVYRGDLDY

SEQ ID NO: 30399 - protein, 10 aa, Borrelia burgdorferi
AVYRGDLDYY

SEQ ID NO: 30400 - protein, 10 aa, Borrelia burgdorferi
VYRGDLDYYK

SEQ ID NO: 30401 - protein, 10 aa, Borrelia burgdorferi
YRGDLDYYKG

SEQ ID NO: 30402 - protein, 10 aa, Borrelia burgdorferi
RGDLDYYKGF

SEQ ID NO: 30403 - protein, 10 aa, Borrelia burgdorferi
GDLDYYKGFY

SEQ ID NO: 30404 - protein, 10 aa, Borrelia burgdorferi
DLDYYKGFYI

SEQ ID NO: 30405 - protein, 10 aa, Borrelia burgdorferi
LDYYKGFYIE

SEQ ID NO: 30406 - protein, 10 aa, Borrelia burgdorferi
DYYKGFYIEP

SEQ ID NO: 30407 - protein, 10 aa, Borrelia burgdorferi
YYKGFYIEPA

SEQ ID NO: 30408 - protein, 10 aa, Borrelia burgdorferi
YKGFYIEPAL

SEQ ID NO: 30409 - protein, 10 aa, Borrelia burgdorferi
KGFYIEPALK

SEQ ID NO: 30410 - protein, 10 aa, Borrelia burgdorferi
GFYIEPALKS

SEQ ID NO: 30411 - protein, 10 aa, Borrelia burgdorferi
FYIEPALKSL

SEQ ID NO: 30412 - protein, 10 aa, Borrelia burgdorferi
YIEPALKSLT

SEQ ID NO: 30413 - protein, 10 aa, Borrelia burgdorferi
IEPALKSLTK

SEQ ID NO: 30414 - protein, 10 aa, Borrelia burgdorferi
EPALKSLTKE

SEQ ID NO: 30415 - protein, 10 aa, Borrelia burgdorferi
PALKSLTKEN

SEQ ID NO: 30416 - protein, 10 aa, Borrelia burgdorferi
ALKSLTKENA

SEQ ID NO: 30417 - protein, 10 aa, Borrelia burgdorferi
LKSLTKENAG

SEQ ID NO: 30418 - protein, 10 aa, Borrelia burgdorferi
KSLTKENAGL

SEQ ID NO: 30419 - protein, 10 aa, Borrelia burgdorferi
SLTKENAGLS

SEQ ID NO: 30420 - protein, 10 aa, Borrelia burgdorferi
LTKENAGLSR

SEQ ID NO: 30421 - protein, 10 aa, Borrelia burgdorferi
TKENAGLSRV

SEQ ID NO: 30422 - protein, 10 aa, Borrelia burgdorferi
KENAGLSRVY

SEQ ID NO: 30423 - protein, 10 aa, Borrelia burgdorferi
ENAGLSRVYS

SEQ ID NO: 30424 - protein, 10 aa, Borrelia burgdorferi
NAGLSRVYSQ

SEQ ID NO: 30425 - protein, 10 aa, Borrelia burgdorferi
AGLSRVYSQW

SEQ ID NO: 30426 - protein, 10 aa, Borrelia burgdorferi
GLSRVYSQWA

SEQ ID NO: 30427 - protein, 10 aa, Borrelia burgdorferi
LSRVYSQWAG

SEQ ID NO: 30428 - protein, 10 aa, Borrelia burgdorferi
SRVYSQWAGK

SEQ ID NO: 30429 - protein, 10 aa, Borrelia burgdorferi
RVYSQWAGKT

SEQ ID NO: 30430 - protein, 10 aa, Borrelia burgdorferi
VYSQWAGKTQ

SEQ ID NO: 30431 - protein, 10 aa, Borrelia burgdorferi
YSQWAGKTQI

SEQ ID NO: 30432 - protein, 10 aa, Borrelia burgdorferi
SQWAGKTQIF

SEQ ID NO: 30433 - protein, 10 aa, Borrelia burgdorferi
QWAGKTQIFI

SEQ ID NO: 30434 - protein, 10 aa, Borrelia burgdorferi
WAGKTQIFIP

SEQ ID NO: 30435 - protein, 10 aa, Borrelia burgdorferi
AGKTQIFIPL

SEQ ID NO: 30436 - protein, 10 aa, Borrelia burgdorferi
GKTQIFIPLK

SEQ ID NO: 30437 - protein, 10 aa, Borrelia burgdorferi
KTQIFIPLKK

SEQ ID NO: 30438 - protein, 10 aa, Borrelia burgdorferi
TQIFIPLKKD

SEQ ID NO: 30439 - protein, 10 aa, Borrelia burgdorferi
QIFIPLKKDI

SEQ ID NO: 30440 - protein, 10 aa, Borrelia burgdorferi
IFIPLKKDIL

SEQ ID NO: 30441 - protein, 10 aa, Borrelia burgdorferi
FIPLKKDILS

SEQ ID NO: 30442 - protein, 10 aa, Borrelia burgdorferi
IPLKKDILSG

SEQ ID NO: 30443 - protein, 10 aa, Borrelia burgdorferi
PLKKDILSGN

SEQ ID NO: 30444 - protein, 10 aa, Borrelia burgdorferi
LKKDILSGNI

SEQ ID NO: 30445 - protein, 10 aa, Borrelia burgdorferi
KKDILSGNIE

SEQ ID NO: 30446 - protein, 10 aa, Borrelia burgdorferi
KDILSGNIES

SEQ ID NO: 30447 - protein, 10 aa, Borrelia burgdorferi
DILSGNIESD

SEQ ID NO: 30448 - protein, 10 aa, Borrelia burgdorferi
ILSGNIESDI

SEQ ID NO: 30449 - protein, 10 aa, Borrelia burgdorferi
LSGNIESDID

SEQ ID NO: 30450 - protein, 10 aa, Borrelia burgdorferi
SGNIESDIDI

SEQ ID NO: 30451 - protein, 10 aa, Borrelia burgdorferi
GNIESDIDID

SEQ ID NO: 30452 - protein, 10 aa, Borrelia burgdorferi
NIESDIDIDS

SEQ ID NO: 30453 - protein, 10 aa, Borrelia burgdorferi
IESDIDIDSL

SEQ ID NO: 30454 - protein, 10 aa, Borrelia burgdorferi
ESDIDIDSLV

SEQ ID NO: 30455 - protein, 10 aa, Borrelia burgdorferi
SDIDIDSLVT

SEQ ID NO: 30456 - protein, 10 aa, Borrelia burgdorferi
DIDIDSLVTD

SEQ ID NO: 30457 - protein, 10 aa, Borrelia burgdorferi
IDIDSLVTDK

SEQ ID NO: 30458 - protein, 10 aa, Borrelia burgdorferi
DIDSLVTDKV

SEQ ID NO: 30459 - protein, 10 aa, Borrelia burgdorferi
IDSLVTDKVI

SEQ ID NO: 30460 - protein, 10 aa, Borrelia burgdorferi
DSLVTDKVIA

SEQ ID NO: 30461 - protein, 10 aa, Borrelia burgdorferi
SLVTDKVIAA

SEQ ID NO: 30462 - protein, 10 aa, Borrelia burgdorferi
LVTDKVIAAL

SEQ ID NO: 30463 - protein, 10 aa, Borrelia burgdorferi
VTDKVIAALL

SEQ ID NO: 30464 - protein, 10 aa, Borrelia burgdorferi
TDKVIAALLS

SEQ ID NO: 30465 - protein, 10 aa, Borrelia burgdorferi
DKVIAALLSE

SEQ ID NO: 30466 - protein, 10 aa, Borrelia burgdorferi
KVIAALLSEN

SEQ ID NO: 30467 - protein, 10 aa, Borrelia burgdorferi
VIAALLSENE

SEQ ID NO: 30468 - protein, 10 aa, Borrelia burgdorferi
IAALLSENEA

SEQ ID NO: 30469 - protein, 10 aa, Borrelia burgdorferi
AALLSENEAG

SEQ ID NO: 30470 - protein, 10 aa, Borrelia burgdorferi
ALLSENEAGV

SEQ ID NO: 30471 - protein, 10 aa, Borrelia burgdorferi
LLSENEAGVN

SEQ ID NO: 30472 - protein, 10 aa, Borrelia burgdorferi
LSENEAGVNF

SEQ ID NO: 30473 - protein, 10 aa, Borrelia burgdorferi
SENEAGVNFA

SEQ ID NO: 30474 - protein, 10 aa, Borrelia burgdorferi
ENEAGVNFAR

SEQ ID NO: 30475 - protein, 10 aa, Borrelia burgdorferi
NEAGVNFARD

SEQ ID NO: 30476 - protein, 10 aa, Borrelia burgdorferi
EAGVNFARDI

SEQ ID NO: 30477 - protein, 10 aa, Borrelia burgdorferi
AGVNFARDIT

SEQ ID NO: 30478 - protein, 10 aa, Borrelia burgdorferi
GVNFARDITD

SEQ ID NO: 30479 - protein, 10 aa, Borrelia burgdorferi
VNFARDITDI

SEQ ID NO: 30480 - protein, 10 aa, Borrelia burgdorferi
NFARDITDIQ

SEQ ID NO: 30481 - protein, 10 aa, Borrelia burgdorferi
FARDITDIQG

SEQ ID NO: 30482 - protein, 10 aa, Borrelia burgdorferi
ARDITDIQGE

SEQ ID NO: 30483 - protein, 10 aa, Borrelia burgdorferi
RDITDIQGET

SEQ ID NO: 30484 - protein, 10 aa, Borrelia burgdorferi
DITDIQGETH

SEQ ID NO: 30485 - protein, 10 aa, Borrelia burgdorferi
ITDIQGETHK

SEQ ID NO: 30486 - protein, 10 aa, Borrelia burgdorferi
TDIQGETHKA

SEQ ID NO: 30487 - protein, 10 aa, Borrelia burgdorferi
DIQGETHKAD

SEQ ID NO: 30488 - protein, 10 aa, Borrelia burgdorferi
IQGETHKADQ

SEQ ID NO: 30489 - protein, 10 aa, Borrelia burgdorferi
QGETHKADQD

SEQ ID NO: 30490 - protein, 10 aa, Borrelia burgdorferi
GETHKADQDK

SEQ ID NO: 30491 - protein, 10 aa, Borrelia burgdorferi
ETHKADQDKI

SEQ ID NO: 30492 - protein, 10 aa, Borrelia burgdorferi
THKADQDKID

SEQ ID NO: 30493 - protein, 10 aa, Borrelia burgdorferi
HKADQDKIDT

SEQ ID NO: 30494 - protein, 10 aa, Borrelia burgdorferi
KADQDKIDTE

SEQ ID NO: 30495 - protein, 10 aa, Borrelia burgdorferi
ADQDKIDTEL

SEQ ID NO: 30496 - protein, 10 aa, Borrelia burgdorferi
DQDKIDTELD

SEQ ID NO: 30497 - protein, 10 aa, Borrelia burgdorferi
QDKIDTELDN

SEQ ID NO: 30498 - protein, 10 aa, Borrelia burgdorferi
DKIDTELDNI

SEQ ID NO: 30499 - protein, 10 aa, Borrelia burgdorferi
KIDTELDNIH

SEQ ID NO: 30500 - protein, 10 aa, Borrelia burgdorferi
IDTELDNIHE

SEQ ID NO: 30501 - protein, 10 aa, Borrelia burgdorferi
DTELDNIHES

SEQ ID NO: 30502 - protein, 10 aa, Borrelia burgdorferi
TELDNIHESD

SEQ ID NO: 30503 - protein, 10 aa, Borrelia burgdorferi
ELDNIHESDS

SEQ ID NO: 30504 - protein, 10 aa, Borrelia burgdorferi
LDNIHESDSN

SEQ ID NO: 30505 - protein, 10 aa, Borrelia burgdorferi
DNIHESDSNI

SEQ ID NO: 30506 - protein, 10 aa, Borrelia burgdorferi
NIHESDSNIT

SEQ ID NO: 30507 - protein, 10 aa, Borrelia burgdorferi
IHESDSNITE

SEQ ID NO: 30508 - protein, 10 aa, Borrelia burgdorferi
HESDSNITET

SEQ ID NO: 30509 - protein, 10 aa, Borrelia burgdorferi
ESDSNITETI

SEQ ID NO: 30510 - protein, 10 aa, Borrelia burgdorferi
SDSNITETIE

SEQ ID NO: 30511 - protein, 10 aa, Borrelia burgdorferi
DSNITETIEN

SEQ ID NO: 30512 - protein, 10 aa, Borrelia burgdorferi
SNITETIENL

SEQ ID NO: 30513 - protein, 10 aa, Borrelia burgdorferi
NITETIENLR

SEQ ID NO: 30514 - protein, 10 aa, Borrelia burgdorferi
ITETIENLRD

SEQ ID NO: 30515 - protein, 10 aa, Borrelia burgdorferi
TETIENLRDQ

SEQ ID NO: 30516 - protein, 10 aa, Borrelia burgdorferi
ETIENLRDQL

SEQ ID NO: 30517 - protein, 10 aa, Borrelia burgdorferi
TIENLRDQLE

SEQ ID NO: 30518 - protein, 10 aa, Borrelia burgdorferi
IENLRDQLEK

SEQ ID NO: 30519 - protein, 10 aa, Borrelia burgdorferi
ENLRDQLEKA

SEQ ID NO: 30520 - protein, 10 aa, Borrelia burgdorferi
NLRDQLEKAT

SEQ ID NO: 30521 - protein, 10 aa, Borrelia burgdorferi
LRDQLEKATD

SEQ ID NO: 30522 - protein, 10 aa, Borrelia burgdorferi
RDQLEKATDE

SEQ ID NO: 30523 - protein, 10 aa, Borrelia burgdorferi
DQLEKATDEE

SEQ ID NO: 30524 - protein, 10 aa, Borrelia burgdorferi
QLEKATDEEH

SEQ ID NO: 30525 - protein, 10 aa, Borrelia burgdorferi
LEKATDEEHK

SEQ ID NO: 30526 - protein, 10 aa, Borrelia burgdorferi
EKATDEEHKK

SEQ ID NO: 30527 - protein, 10 aa, Borrelia burgdorferi
KATDEEHKKE

SEQ ID NO: 30528 - protein, 10 aa, Borrelia burgdorferi
ATDEEHKKEI

SEQ ID NO: 30529 - protein, 10 aa, Borrelia burgdorferi
TDEEHKKEIE

SEQ ID NO: 30530 - protein, 10 aa, Borrelia burgdorferi
DEEHKKEIES

SEQ ID NO: 30531 - protein, 10 aa, Borrelia burgdorferi
EEHKKEIESQ

SEQ ID NO: 30532 - protein, 10 aa, Borrelia burgdorferi
EHKKEIESQV

SEQ ID NO: 30533 - protein, 10 aa, Borrelia burgdorferi
HKKEIESQVD

SEQ ID NO: 30534 - protein, 10 aa, Borrelia burgdorferi
KKEIESQVDA

SEQ ID NO: 30535 - protein, 10 aa, Borrelia burgdorferi
KEIESQVDAK

SEQ ID NO: 30536 - protein, 10 aa, Borrelia burgdorferi
EIESQVDAKK

SEQ ID NO: 30537 - protein, 10 aa, Borrelia burgdorferi
IESQVDAKKK

SEQ ID NO: 30538 - protein, 10 aa, Borrelia burgdorferi
ESQVDAKKKE

SEQ ID NO: 30539 - protein, 10 aa, Borrelia burgdorferi
SQVDAKKKEK

SEQ ID NO: 30540 - protein, 10 aa, Borrelia burgdorferi
QVDAKKKEKE

SEQ ID NO: 30541 - protein, 10 aa, Borrelia burgdorferi
VDAKKKEKEE

SEQ ID NO: 30542 - protein, 10 aa, Borrelia burgdorferi
DAKKKEKEEL

SEQ ID NO: 30543 - protein, 10 aa, Borrelia burgdorferi
AKKKEKEELD

SEQ ID NO: 30544 - protein, 10 aa, Borrelia burgdorferi
KKKEKEELDK

SEQ ID NO: 30545 - protein, 10 aa, Borrelia burgdorferi
KKEKEELDKK

SEQ ID NO: 30546 - protein, 10 aa, Borrelia burgdorferi
KEKEELDKKA

SEQ ID NO: 30547 - protein, 10 aa, Borrelia burgdorferi
EKEELDKKAI

SEQ ID NO: 30548 - protein, 10 aa, Borrelia burgdorferi
KEELDKKAIN

SEQ ID NO: 30549 - protein, 10 aa, Borrelia burgdorferi
EELDKKAINL

SEQ ID NO: 30550 - protein, 10 aa, Borrelia burgdorferi
ELDKKAINLD

SEQ ID NO: 30551 - protein, 10 aa, Borrelia burgdorferi
LDKKAINLDK

SEQ ID NO: 30552 - protein, 10 aa, Borrelia burgdorferi
DKKAINLDKA

SEQ ID NO: 30553 - protein, 10 aa, Borrelia burgdorferi
KKAINLDKAQ

SEQ ID NO: 30554 - protein, 10 aa, Borrelia burgdorferi
KAINLDKAQQ

SEQ ID NO: 30555 - protein, 10 aa, Borrelia burgdorferi
AINLDKAQQK

SEQ ID NO: 30556 - protein, 10 aa, Borrelia burgdorferi
INLDKAQQKL

SEQ ID NO: 30557 - protein, 10 aa, Borrelia burgdorferi
NLDKAQQKLD

SEQ ID NO: 30558 - protein, 10 aa, Borrelia burgdorferi
LDKAQQKLDS

SEQ ID NO: 30559 - protein, 10 aa, Borrelia burgdorferi
DKAQQKLDSA

SEQ ID NO: 30560 - protein, 10 aa, Borrelia burgdorferi
KAQQKLDSAE

SEQ ID NO: 30561 - protein, 10 aa, Borrelia burgdorferi
AQQKLDSAED

SEQ ID NO: 30562 - protein, 10 aa, Borrelia burgdorferi
QQKLDSAEDN

SEQ ID NO: 30563 - protein, 10 aa, Borrelia burgdorferi
QKLDSAEDNL

SEQ ID NO: 30564 - protein, 10 aa, Borrelia burgdorferi
KLDSAEDNLD

SEQ ID NO: 30565 - protein, 10 aa, Borrelia burgdorferi
LDSAEDNLDV

SEQ ID NO: 30566 - protein, 10 aa, Borrelia burgdorferi
DSAEDNLDVQ

SEQ ID NO: 30567 - protein, 10 aa, Borrelia burgdorferi
SAEDNLDVQR

SEQ ID NO: 30568 - protein, 10 aa, Borrelia burgdorferi
AEDNLDVQRD

SEQ ID NO: 30569 - protein, 10 aa, Borrelia burgdorferi
EDNLDVQRDT

SEQ ID NO: 30570 - protein, 10 aa, Borrelia burgdorferi
DNLDVQRDTV

SEQ ID NO: 30571 - protein, 10 aa, Borrelia burgdorferi
NLDVQRDTVR

SEQ ID NO: 30572 - protein, 10 aa, Borrelia burgdorferi
LDVQRDTVRE

SEQ ID NO: 30573 - protein, 10 aa, Borrelia burgdorferi
DVQRDTVREK

SEQ ID NO: 30574 - protein, 10 aa, Borrelia burgdorferi
VQRDTVREKI

SEQ ID NO: 30575 - protein, 10 aa, Borrelia burgdorferi
QRDTVREKIQ

SEQ ID NO: 30576 - protein, 10 aa, Borrelia burgdorferi
RDTVREKIQE

SEQ ID NO: 30577 - protein, 10 aa, Borrelia burgdorferi
DTVREKIQED

SEQ ID NO: 30578 - protein, 10 aa, Borrelia burgdorferi
TVREKIQEDI

SEQ ID NO: 30579 - protein, 10 aa, Borrelia burgdorferi
VREKIQEDIN

SEQ ID NO: 30580 - protein, 10 aa, Borrelia burgdorferi
REKIQEDINE

SEQ ID NO: 30581 - protein, 10 aa, Borrelia burgdorferi
EKIQEDINEI

SEQ ID NO: 30582 - protein, 10 aa, Borrelia burgdorferi
KIQEDINEIN

SEQ ID NO: 30583 - protein, 10 aa, Borrelia burgdorferi
IQEDINEINK

SEQ ID NO: 30584 - protein, 10 aa, Borrelia burgdorferi
QEDINEINKE

SEQ ID NO: 30585 - protein, 10 aa, Borrelia burgdorferi
EDINEINKEK

SEQ ID NO: 30586 - protein, 10 aa, Borrelia burgdorferi
DINEINKEKN

SEQ ID NO: 30587 - protein, 10 aa, Borrelia burgdorferi
INEINKEKNL

SEQ ID NO: 30588 - protein, 10 aa, Borrelia burgdorferi
NEINKEKNLP

SEQ ID NO: 30589 - protein, 10 aa, Borrelia burgdorferi
EINKEKNLPK

SEQ ID NO: 30590 - protein, 10 aa, Borrelia burgdorferi
INKEKNLPKP

SEQ ID NO: 30591 - protein, 10 aa, Borrelia burgdorferi
NKEKNLPKPG

SEQ ID NO: 30592 - protein, 10 aa, Borrelia burgdorferi
KEKNLPKPGD

SEQ ID NO: 30593 - protein, 10 aa, Borrelia burgdorferi
EKNLPKPGDV

SEQ ID NO: 30594 - protein, 10 aa, Borrelia burgdorferi
KNLPKPGDVS

SEQ ID NO: 30595 - protein, 10 aa, Borrelia burgdorferi
NLPKPGDVSS

SEQ ID NO: 30596 - protein, 10 aa, Borrelia burgdorferi
LPKPGDVSSP

SEQ ID NO: 30597 - protein, 10 aa, Borrelia burgdorferi
PKPGDVSSPK

SEQ ID NO: 30598 - protein, 10 aa, Borrelia burgdorferi
KPGDVSSPKV

SEQ ID NO: 30599 - protein, 10 aa, Borrelia burgdorferi
PGDVSSPKVD

SEQ ID NO: 30600 - protein, 10 aa, Borrelia burgdorferi
GDVSSPKVDK

SEQ ID NO: 30601 - protein, 10 aa, Borrelia burgdorferi
DVSSPKVDKQ

SEQ ID NO: 30602 - protein, 10 aa, Borrelia burgdorferi
VSSPKVDKQL

SEQ ID NO: 30603 - protein, 10 aa, Borrelia burgdorferi
SSPKVDKQLQ

SEQ ID NO: 30604 - protein, 10 aa, Borrelia burgdorferi
SPKVDKQLQI

SEQ ID NO: 30605 - protein, 10 aa, Borrelia burgdorferi
PKVDKQLQIK

SEQ ID NO: 30606 - protein, 10 aa, Borrelia burgdorferi
KVDKQLQIKE

SEQ ID NO: 30607 - protein, 10 aa, Borrelia burgdorferi
VDKQLQIKES

SEQ ID NO: 30608 - protein, 10 aa, Borrelia burgdorferi
DKQLQIKESL

SEQ ID NO: 30609 - protein, 10 aa, Borrelia burgdorferi
KQLQIKESLE

SEQ ID NO: 30610 - protein, 10 aa, Borrelia burgdorferi
QLQIKESLED

SEQ ID NO: 30611 - protein, 10 aa, Borrelia burgdorferi
LQIKESLEDL

SEQ ID NO: 30612 - protein, 10 aa, Borrelia burgdorferi
QIKESLEDLQ

SEQ ID NO: 30613 - protein, 10 aa, Borrelia burgdorferi
IKESLEDLQE

SEQ ID NO: 30614 - protein, 10 aa, Borrelia burgdorferi
KESLEDLQEQ

SEQ ID NO: 30615 - protein, 10 aa, Borrelia burgdorferi
ESLEDLQEQL

SEQ ID NO: 30616 - protein, 10 aa, Borrelia burgdorferi
SLEDLQEQLK

SEQ ID NO: 30617 - protein, 10 aa, Borrelia burgdorferi
LEDLQEQLKE

SEQ ID NO: 30618 - protein, 10 aa, Borrelia burgdorferi
EDLQEQLKEA

SEQ ID NO: 30619 - protein, 10 aa, Borrelia burgdorferi
DLQEQLKEAG

SEQ ID NO: 30620 - protein, 10 aa, Borrelia burgdorferi
LQEQLKEAGD

SEQ ID NO: 30621 - protein, 10 aa, Borrelia burgdorferi
QEQLKEAGDE

SEQ ID NO: 30622 - protein, 10 aa, Borrelia burgdorferi
EQLKEAGDEN

SEQ ID NO: 30623 - protein, 10 aa, Borrelia burgdorferi
QLKEAGDENQ

SEQ ID NO: 30624 - protein, 10 aa, Borrelia burgdorferi
LKEAGDENQK

SEQ ID NO: 30625 - protein, 10 aa, Borrelia burgdorferi
KEAGDENQKR

SEQ ID NO: 30626 - protein, 10 aa, Borrelia burgdorferi
EAGDENQKRE

SEQ ID NO: 30627 - protein, 10 aa, Borrelia burgdorferi
AGDENQKREI

SEQ ID NO: 30628 - protein, 10 aa, Borrelia burgdorferi
GDENQKREIE

SEQ ID NO: 30629 - protein, 10 aa, Borrelia burgdorferi
DENQKREIEK

SEQ ID NO: 30630 - protein, 10 aa, Borrelia burgdorferi
ENQKREIEKQ

SEQ ID NO: 30631 - protein, 10 aa, Borrelia burgdorferi
NQKREIEKQI

SEQ ID NO: 30632 - protein, 10 aa, Borrelia burgdorferi
QKREIEKQIE

SEQ ID NO: 30633 - protein, 10 aa, Borrelia burgdorferi
KREIEKQIEI

SEQ ID NO: 30634 - protein, 10 aa, Borrelia burgdorferi
REIEKQIEIK

SEQ ID NO: 30635 - protein, 10 aa, Borrelia burgdorferi
EIEKQIEIKK

SEQ ID NO: 30636 - protein, 10 aa, Borrelia burgdorferi
IEKQIEIKKR

SEQ ID NO: 30637 - protein, 10 aa, Borrelia burgdorferi
EKQIEIKKRD

SEQ ID NO: 30638 - protein, 10 aa, Borrelia burgdorferi
KQIEIKKRDE

SEQ ID NO: 30639 - protein, 10 aa, Borrelia burgdorferi
QIEIKKRDEE

SEQ ID NO: 30640 - protein, 10 aa, Borrelia burgdorferi
IEIKKRDEEL

SEQ ID NO: 30641 - protein, 10 aa, Borrelia burgdorferi
EIKKRDEELL

SEQ ID NO: 30642 - protein, 10 aa, Borrelia burgdorferi
IKKRDEELLK

SEQ ID NO: 30643 - protein, 10 aa, Borrelia burgdorferi
KKRDEELLKS

SEQ ID NO: 30644 - protein, 10 aa, Borrelia burgdorferi
KRDEELLKSK

SEQ ID NO: 30645 - protein, 10 aa, Borrelia burgdorferi
RDEELLKSKD

SEQ ID NO: 30646 - protein, 10 aa, Borrelia burgdorferi
DEELLKSKDG

SEQ ID NO: 30647 - protein, 10 aa, Borrelia burgdorferi
EELLKSKDGK

SEQ ID NO: 30648 - protein, 10 aa, Borrelia burgdorferi
ELLKSKDGKV

SEQ ID NO: 30649 - protein, 10 aa, Borrelia burgdorferi
LLKSKDGKVS

SEQ ID NO: 30650 - protein, 10 aa, Borrelia burgdorferi
LKSKDGKVSK

SEQ ID NO: 30651 - protein, 10 aa, Borrelia burgdorferi
KSKDGKVSKD

SEQ ID NO: 30652 - protein, 10 aa, Borrelia burgdorferi
SKDGKVSKDY

SEQ ID NO: 30653 - protein, 10 aa, Borrelia burgdorferi
KDGKVSKDYE

SEQ ID NO: 30654 - protein, 10 aa, Borrelia burgdorferi
DGKVSKDYEA

SEQ ID NO: 30655 - protein, 10 aa, Borrelia burgdorferi
GKVSKDYEAL

SEQ ID NO: 30656 - protein, 10 aa, Borrelia burgdorferi
KVSKDYEALD

SEQ ID NO: 30657 - protein, 10 aa, Borrelia burgdorferi
VSKDYEALDL

SEQ ID NO: 30658 - protein, 10 aa, Borrelia burgdorferi
SKDYEALDLD

SEQ ID NO: 30659 - protein, 10 aa, Borrelia burgdorferi
KDYEALDLDR

SEQ ID NO: 30660 - protein, 10 aa, Borrelia burgdorferi
DYEALDLDRE

SEQ ID NO: 30661 - protein, 10 aa, Borrelia burgdorferi
YEALDLDREL

SEQ ID NO: 30662 - protein, 10 aa, Borrelia burgdorferi
EALDLDRELS

SEQ ID NO: 30663 - protein, 10 aa, Borrelia burgdorferi
ALDLDRELSK

SEQ ID NO: 30664 - protein, 10 aa, Borrelia burgdorferi
LDLDRELSKA

SEQ ID NO: 30665 - protein, 10 aa, Borrelia burgdorferi
DLDRELSKAS

SEQ ID NO: 30666 - protein, 10 aa, Borrelia burgdorferi
LDRELSKASS

SEQ ID NO: 30667 - protein, 10 aa, Borrelia burgdorferi
DRELSKASSK

SEQ ID NO: 30668 - protein, 10 aa, Borrelia burgdorferi
RELSKASSKE

SEQ ID NO: 30669 - protein, 10 aa, Borrelia burgdorferi
ELSKASSKEK

SEQ ID NO: 30670 - protein, 10 aa, Borrelia burgdorferi
LSKASSKEKS

SEQ ID NO: 30671 - protein, 10 aa, Borrelia burgdorferi
SKASSKEKSK

SEQ ID NO: 30672 - protein, 10 aa, Borrelia burgdorferi
KASSKEKSKV

SEQ ID NO: 30673 - protein, 10 aa, Borrelia burgdorferi
ASSKEKSKVK

SEQ ID NO: 30674 - protein, 10 aa, Borrelia burgdorferi
SSKEKSKVKE

SEQ ID NO: 30675 - protein, 10 aa, Borrelia burgdorferi
SKEKSKVKEE

SEQ ID NO: 30676 - protein, 10 aa, Borrelia burgdorferi
KEKSKVKEEE

SEQ ID NO: 30677 - protein, 10 aa, Borrelia burgdorferi
EKSKVKEEEI

SEQ ID NO: 30678 - protein, 10 aa, Borrelia burgdorferi
KSKVKEEEIT

SEQ ID NO: 30679 - protein, 10 aa, Borrelia burgdorferi
SKVKEEEITK

SEQ ID NO: 30680 - protein, 10 aa, Borrelia burgdorferi
KVKEEEITKG

SEQ ID NO: 30681 - protein, 10 aa, Borrelia burgdorferi
VKEEEITKGK

SEQ ID NO: 30682 - protein, 10 aa, Borrelia burgdorferi
KEEEITKGKS

SEQ ID NO: 30683 - protein, 10 aa, Borrelia burgdorferi
EEEITKGKSR

SEQ ID NO: 30684 - protein, 10 aa, Borrelia burgdorferi
EEITKGKSRA

SEQ ID NO: 30685 - protein, 10 aa, Borrelia burgdorferi
EITKGKSRAS

SEQ ID NO: 30686 - protein, 10 aa, Borrelia burgdorferi
ITKGKSRASL

SEQ ID NO: 30687 - protein, 10 aa, Borrelia burgdorferi
TKGKSRASLG

SEQ ID NO: 30688 - protein, 10 aa, Borrelia burgdorferi
KGKSRASLGD

SEQ ID NO: 30689 - protein, 10 aa, Borrelia burgdorferi
GKSRASLGDL

SEQ ID NO: 30690 - protein, 10 aa, Borrelia burgdorferi
KSRASLGDLN

SEQ ID NO: 30691 - protein, 10 aa, Borrelia burgdorferi
SRASLGDLNN

SEQ ID NO: 30692 - protein, 10 aa, Borrelia burgdorferi
RASLGDLNND

SEQ ID NO: 30693 - protein, 10 aa, Borrelia burgdorferi
ASLGDLNNDK

SEQ ID NO: 30694 - protein, 10 aa, Borrelia burgdorferi
SLGDLNNDKN

SEQ ID NO: 30695 - protein, 10 aa, Borrelia burgdorferi
LGDLNNDKNL

SEQ ID NO: 30696 - protein, 10 aa, Borrelia burgdorferi
GDLNNDKNLM

SEQ ID NO: 30697 - protein, 10 aa, Borrelia burgdorferi
DLNNDKNLML

SEQ ID NO: 30698 - protein, 10 aa, Borrelia burgdorferi
LNNDKNLMLP

SEQ ID NO: 30699 - protein, 10 aa, Borrelia burgdorferi
NNDKNLMLPE

SEQ ID NO: 30700 - protein, 10 aa, Borrelia burgdorferi
NDKNLMLPED

SEQ ID NO: 30701 - protein, 10 aa, Borrelia burgdorferi
DKNLMLPEDQ

SEQ ID NO: 30702 - protein, 10 aa, Borrelia burgdorferi
KNLMLPEDQK

SEQ ID NO: 30703 - protein, 10 aa, Borrelia burgdorferi
NLMLPEDQKL

SEQ ID NO: 30704 - protein, 10 aa, Borrelia burgdorferi
LMLPEDQKLP

SEQ ID NO: 30705 - protein, 10 aa, Borrelia burgdorferi
MLPEDQKLPE

SEQ ID NO: 30706 - protein, 10 aa, Borrelia burgdorferi
LPEDQKLPED

SEQ ID NO: 30707 - protein, 10 aa, Borrelia burgdorferi
PEDQKLPEDK

SEQ ID NO: 30708 - protein, 10 aa, Borrelia burgdorferi
EDQKLPEDKK

SEQ ID NO: 30709 - protein, 10 aa, Borrelia burgdorferi
DQKLPEDKKL

SEQ ID NO: 30710 - protein, 10 aa, Borrelia burgdorferi
QKLPEDKKLD

SEQ ID NO: 30711 - protein, 10 aa, Borrelia burgdorferi
KLPEDKKLDS

SEQ ID NO: 30712 - protein, 10 aa, Borrelia burgdorferi
LPEDKKLDSK

SEQ ID NO: 30713 - protein, 10 aa, Borrelia burgdorferi
PEDKKLDSKL

SEQ ID NO: 30714 - protein, 10 aa, Borrelia burgdorferi
EDKKLDSKLD

SEQ ID NO: 30715 - protein, 10 aa, Borrelia burgdorferi
DKKLDSKLDG

SEQ ID NO: 30716 - protein, 10 aa, Borrelia burgdorferi
KKLDSKLDGK

SEQ ID NO: 30717 - protein, 10 aa, Borrelia burgdorferi
KLDSKLDGKK

SEQ ID NO: 30718 - protein, 10 aa, Borrelia burgdorferi
LDSKLDGKKE

SEQ ID NO: 30719 - protein, 10 aa, Borrelia burgdorferi
DSKLDGKKEF

SEQ ID NO: 30720 - protein, 10 aa, Borrelia burgdorferi
SKLDGKKEFK

SEQ ID NO: 30721 - protein, 10 aa, Borrelia burgdorferi
KLDGKKEFKP

SEQ ID NO: 30722 - protein, 10 aa, Borrelia burgdorferi
LDGKKEFKPV

SEQ ID NO: 30723 - protein, 10 aa, Borrelia burgdorferi
DGKKEFKPVS

SEQ ID NO: 30724 - protein, 10 aa, Borrelia burgdorferi
GKKEFKPVSE

SEQ ID NO: 30725 - protein, 10 aa, Borrelia burgdorferi
KKEFKPVSEV

SEQ ID NO: 30726 - protein, 10 aa, Borrelia burgdorferi
KEFKPVSEVE

SEQ ID NO: 30727 - protein, 10 aa, Borrelia burgdorferi
EFKPVSEVEK

SEQ ID NO: 30728 - protein, 10 aa, Borrelia burgdorferi
FKPVSEVEKL

SEQ ID NO: 30729 - protein, 10 aa, Borrelia burgdorferi
KPVSEVEKLD

SEQ ID NO: 30730 - protein, 10 aa, Borrelia burgdorferi
PVSEVEKLDK

SEQ ID NO: 30731 - protein, 10 aa, Borrelia burgdorferi
VSEVEKLDKI

SEQ ID NO: 30732 - protein, 10 aa, Borrelia burgdorferi
SEVEKLDKIS

SEQ ID NO: 30733 - protein, 10 aa, Borrelia burgdorferi
EVEKLDKISK

SEQ ID NO: 30734 - protein, 10 aa, Borrelia burgdorferi
VEKLDKISKS

SEQ ID NO: 30735 - protein, 10 aa, Borrelia burgdorferi
EKLDKISKSN

SEQ ID NO: 30736 - protein, 10 aa, Borrelia burgdorferi
KLDKISKSNN

SEQ ID NO: 30737 - protein, 10 aa, Borrelia burgdorferi
LDKISKSNNN

SEQ ID NO: 30738 - protein, 10 aa, Borrelia burgdorferi
DKISKSNNNE

SEQ ID NO: 30739 - protein, 10 aa, Borrelia burgdorferi
KISKSNNNEV

SEQ ID NO: 30740 - protein, 10 aa, Borrelia burgdorferi
ISKSNNNEVG

SEQ ID NO: 30741 - protein, 10 aa, Borrelia burgdorferi
SKSNNNEVGK

SEQ ID NO: 30742 - protein, 10 aa, Borrelia burgdorferi
KSNNNEVGKL

SEQ ID NO: 30743 - protein, 10 aa, Borrelia burgdorferi
SNNNEVGKLS

SEQ ID NO: 30744 - protein, 10 aa, Borrelia burgdorferi
NNNEVGKLSP

SEQ ID NO: 30745 - protein, 10 aa, Borrelia burgdorferi
NNEVGKLSPL

SEQ ID NO: 30746 - protein, 10 aa, Borrelia burgdorferi
NEVGKLSPLD

SEQ ID NO: 30747 - protein, 10 aa, Borrelia burgdorferi
EVGKLSPLDK

SEQ ID NO: 30748 - protein, 10 aa, Borrelia burgdorferi
VGKLSPLDKP

SEQ ID NO: 30749 - protein, 10 aa, Borrelia burgdorferi
GKLSPLDKPS

SEQ ID NO: 30750 - protein, 10 aa, Borrelia burgdorferi
KLSPLDKPSY

SEQ ID NO: 30751 - protein, 10 aa, Borrelia burgdorferi
LSPLDKPSYD

SEQ ID NO: 30752 - protein, 10 aa, Borrelia burgdorferi
SPLDKPSYDD

SEQ ID NO: 30753 - protein, 10 aa, Borrelia burgdorferi
PLDKPSYDDI

SEQ ID NO: 30754 - protein, 10 aa, Borrelia burgdorferi
LDKPSYDDID

SEQ ID NO: 30755 - protein, 10 aa, Borrelia burgdorferi
DKPSYDDIDS

SEQ ID NO: 30756 - protein, 10 aa, Borrelia burgdorferi
KPSYDDIDSK

SEQ ID NO: 30757 - protein, 10 aa, Borrelia burgdorferi
PSYDDIDSKE

SEQ ID NO: 30758 - protein, 10 aa, Borrelia burgdorferi
SYDDIDSKEE

SEQ ID NO: 30759 - protein, 10 aa, Borrelia burgdorferi
YDDIDSKEEV

SEQ ID NO: 30760 - protein, 10 aa, Borrelia burgdorferi
DDIDSKEEVD

SEQ ID NO: 30761 - protein, 10 aa, Borrelia burgdorferi
DIDSKEEVDN

SEQ ID NO: 30762 - protein, 10 aa, Borrelia burgdorferi
IDSKEEVDNK

SEQ ID NO: 30763 - protein, 10 aa, Borrelia burgdorferi
DSKEEVDNKA

SEQ ID NO: 30764 - protein, 10 aa, Borrelia burgdorferi
SKEEVDNKAI

SEQ ID NO: 30765 - protein, 10 aa, Borrelia burgdorferi
KEEVDNKAIN

SEQ ID NO: 30766 - protein, 10 aa, Borrelia burgdorferi
EEVDNKAINL

SEQ ID NO: 30767 - protein, 10 aa, Borrelia burgdorferi
EVDNKAINLQ

SEQ ID NO: 30768 - protein, 10 aa, Borrelia burgdorferi
VDNKAINLQK

SEQ ID NO: 30769 - protein, 10 aa, Borrelia burgdorferi
DNKAINLQKI

SEQ ID NO: 30770 - protein, 10 aa, Borrelia burgdorferi
NKAINLQKID

SEQ ID NO: 30771 - protein, 10 aa, Borrelia burgdorferi
KAINLQKIDP

SEQ ID NO: 30772 - protein, 10 aa, Borrelia burgdorferi
AINLQKIDPK

SEQ ID NO: 30773 - protein, 10 aa, Borrelia burgdorferi
INLQKIDPKV

SEQ ID NO: 30774 - protein, 10 aa, Borrelia burgdorferi
NLQKIDPKVK

SEQ ID NO: 30775 - protein, 10 aa, Borrelia burgdorferi
LQKIDPKVKD

SEQ ID NO: 30776 - protein, 10 aa, Borrelia burgdorferi
QKIDPKVKDQ

SEQ ID NO: 30777 - protein, 10 aa, Borrelia burgdorferi
KIDPKVKDQT

SEQ ID NO: 30778 - protein, 10 aa, Borrelia burgdorferi
IDPKVKDQTT

SEQ ID NO: 30779 - protein, 10 aa, Borrelia burgdorferi
DPKVKDQTTS

SEQ ID NO: 30780 - protein, 10 aa, Borrelia burgdorferi
PKVKDQTTSL

SEQ ID NO: 30781 - protein, 10 aa, Borrelia burgdorferi
KVKDQTTSLN

SEQ ID NO: 30782 - protein, 10 aa, Borrelia burgdorferi
VKDQTTSLNE

SEQ ID NO: 30783 - protein, 10 aa, Borrelia burgdorferi
KDQTTSLNED

SEQ ID NO: 30784 - protein, 10 aa, Borrelia burgdorferi
DQTTSLNEDL

SEQ ID NO: 30785 - protein, 10 aa, Borrelia burgdorferi
QTTSLNEDLD

SEQ ID NO: 30786 - protein, 10 aa, Borrelia burgdorferi
TTSLNEDLDK

SEQ ID NO: 30787 - protein, 10 aa, Borrelia burgdorferi
TSLNEDLDKD

SEQ ID NO: 30788 - protein, 10 aa, Borrelia burgdorferi
SLNEDLDKDL

SEQ ID NO: 30789 - protein, 10 aa, Borrelia burgdorferi
LNEDLDKDLT

SEQ ID NO: 30790 - protein, 10 aa, Borrelia burgdorferi
NEDLDKDLTT

SEQ ID NO: 30791 - protein, 10 aa, Borrelia burgdorferi
EDLDKDLTTM

SEQ ID NO: 30792 - protein, 10 aa, Borrelia burgdorferi
DLDKDLTTMS

SEQ ID NO: 30793 - protein, 10 aa, Borrelia burgdorferi
LDKDLTTMSI

SEQ ID NO: 30794 - protein, 10 aa, Borrelia burgdorferi
DKDLTTMSID

SEQ ID NO: 30795 - protein, 10 aa, Borrelia burgdorferi
KDLTTMSIDS

SEQ ID NO: 30796 - protein, 10 aa, Borrelia burgdorferi
DLTTMSIDSS

SEQ ID NO: 30797 - protein, 10 aa, Borrelia burgdorferi
LTTMSIDSSS

SEQ ID NO: 30798 - protein, 10 aa, Borrelia burgdorferi
TTMSIDSSSP

SEQ ID NO: 30799 - protein, 10 aa, Borrelia burgdorferi
TMSIDSSSPV

SEQ ID NO: 30800 - protein, 10 aa, Borrelia burgdorferi
MSIDSSSPVF

SEQ ID NO: 30801 - protein, 10 aa, Borrelia burgdorferi
SIDSSSPVFL

SEQ ID NO: 30802 - protein, 10 aa, Borrelia burgdorferi
IDSSSPVFLE

SEQ ID NO: 30803 - protein, 10 aa, Borrelia burgdorferi
DSSSPVFLEV

SEQ ID NO: 30804 - protein, 10 aa, Borrelia burgdorferi
SSSPVFLEVI

SEQ ID NO: 30805 - protein, 10 aa, Borrelia burgdorferi
SSPVFLEVID

SEQ ID NO: 30806 - protein, 10 aa, Borrelia burgdorferi
SPVFLEVIDP

SEQ ID NO: 30807 - protein, 10 aa, Borrelia burgdorferi
PVFLEVIDPI

SEQ ID NO: 30808 - protein, 10 aa, Borrelia burgdorferi
VFLEVIDPIT

SEQ ID NO: 30809 - protein, 10 aa, Borrelia burgdorferi
FLEVIDPITN

SEQ ID NO: 30810 - protein, 10 aa, Borrelia burgdorferi
LEVIDPITNL

SEQ ID NO: 30811 - protein, 10 aa, Borrelia burgdorferi
EVIDPITNLG

SEQ ID NO: 30812 - protein, 10 aa, Borrelia burgdorferi
VIDPITNLGT

SEQ ID NO: 30813 - protein, 10 aa, Borrelia burgdorferi
IDPITNLGTL

SEQ ID NO: 30814 - protein, 10 aa, Borrelia burgdorferi
DPITNLGTLQ

SEQ ID NO: 30815 - protein, 10 aa, Borrelia burgdorferi
PITNLGTLQL

SEQ ID NO: 30816 - protein, 10 aa, Borrelia burgdorferi
ITNLGTLQLI

SEQ ID NO: 30817 - protein, 10 aa, Borrelia burgdorferi
TNLGTLQLID

SEQ ID NO: 30818 - protein, 10 aa, Borrelia burgdorferi
NLGTLQLIDL

SEQ ID NO: 30819 - protein, 10 aa, Borrelia burgdorferi
LGTLQLIDLN

SEQ ID NO: 30820 - protein, 10 aa, Borrelia burgdorferi
GTLQLIDLNT

SEQ ID NO: 30821 - protein, 10 aa, Borrelia burgdorferi
TLQLIDLNTG

SEQ ID NO: 30822 - protein, 10 aa, Borrelia burgdorferi
LQLIDLNTGV

SEQ ID NO: 30823 - protein, 10 aa, Borrelia burgdorferi
QLIDLNTGVR

SEQ ID NO: 30824 - protein, 10 aa, Borrelia burgdorferi
LIDLNTGVRL

SEQ ID NO: 30825 - protein, 10 aa, Borrelia burgdorferi
IDLNTGVRLK

SEQ ID NO: 30826 - protein, 10 aa, Borrelia burgdorferi
DLNTGVRLKE

SEQ ID NO: 30827 - protein, 10 aa, Borrelia burgdorferi
LNTGVRLKES

SEQ ID NO: 30828 - protein, 10 aa, Borrelia burgdorferi
NTGVRLKEST

SEQ ID NO: 30829 - protein, 10 aa, Borrelia burgdorferi
TGVRLKESTQ

SEQ ID NO: 30830 - protein, 10 aa, Borrelia burgdorferi
GVRLKESTQQ

SEQ ID NO: 30831 - protein, 10 aa, Borrelia burgdorferi
VRLKESTQQG

SEQ ID NO: 30832 - protein, 10 aa, Borrelia burgdorferi
RLKESTQQGI

SEQ ID NO: 30833 - protein, 10 aa, Borrelia burgdorferi
LKESTQQGIQ

SEQ ID NO: 30834 - protein, 10 aa, Borrelia burgdorferi
KESTQQGIQR

SEQ ID NO: 30835 - protein, 10 aa, Borrelia burgdorferi
ESTQQGIQRY

SEQ ID NO: 30836 - protein, 10 aa, Borrelia burgdorferi
STQQGIQRYG

SEQ ID NO: 30837 - protein, 10 aa, Borrelia burgdorferi
TQQGIQRYGI

SEQ ID NO: 30838 - protein, 10 aa, Borrelia burgdorferi
QQGIQRYGIY

SEQ ID NO: 30839 - protein, 10 aa, Borrelia burgdorferi
QGIQRYGIYE

SEQ ID NO: 30840 - protein, 10 aa, Borrelia burgdorferi
GIQRYGIYER

SEQ ID NO: 30841 - protein, 10 aa, Borrelia burgdorferi
IQRYGIYERE

SEQ ID NO: 30842 - protein, 10 aa, Borrelia burgdorferi
QRYGIYEREK

SEQ ID NO: 30843 - protein, 10 aa, Borrelia burgdorferi
RYGIYEREKD

SEQ ID NO: 30844 - protein, 10 aa, Borrelia burgdorferi
YGIYEREKDL

SEQ ID NO: 30845 - protein, 10 aa, Borrelia burgdorferi
GIYEREKDLV

SEQ ID NO: 30846 - protein, 10 aa, Borrelia burgdorferi
IYEREKDLVV

SEQ ID NO: 30847 - protein, 10 aa, Borrelia burgdorferi
YEREKDLVVI

SEQ ID NO: 30848 - protein, 10 aa, Borrelia burgdorferi
EREKDLVVIK

SEQ ID NO: 30849 - protein, 10 aa, Borrelia burgdorferi
REKDLVVIKM

SEQ ID NO: 30850 - protein, 10 aa, Borrelia burgdorferi
EKDLVVIKMD

SEQ ID NO: 30851 - protein, 10 aa, Borrelia burgdorferi
KDLVVIKMDS

SEQ ID NO: 30852 - protein, 10 aa, Borrelia burgdorferi
DLVVIKMDSG

SEQ ID NO: 30853 - protein, 10 aa, Borrelia burgdorferi
LVVIKMDSGK

SEQ ID NO: 30854 - protein, 10 aa, Borrelia burgdorferi
VVIKMDSGKA

SEQ ID NO: 30855 - protein, 10 aa, Borrelia burgdorferi
VIKMDSGKAK

SEQ ID NO: 30856 - protein, 10 aa, Borrelia burgdorferi
IKMDSGKAKL

SEQ ID NO: 30857 - protein, 10 aa, Borrelia burgdorferi
KMDSGKAKLQ

SEQ ID NO: 30858 - protein, 10 aa, Borrelia burgdorferi
MDSGKAKLQI

SEQ ID NO: 30859 - protein, 10 aa, Borrelia burgdorferi
DSGKAKLQIL

SEQ ID NO: 30860 - protein, 10 aa, Borrelia burgdorferi
SGKAKLQILN

SEQ ID NO: 30861 - protein, 10 aa, Borrelia burgdorferi
GKAKLQILNK

SEQ ID NO: 30862 - protein, 10 aa, Borrelia burgdorferi
KAKLQILNKL

SEQ ID NO: 30863 - protein, 10 aa, Borrelia burgdorferi
AKLQILNKLE

SEQ ID NO: 30864 - protein, 10 aa, Borrelia burgdorferi
KLQILNKLEN

SEQ ID NO: 30865 - protein, 10 aa, Borrelia burgdorferi
LQILNKLENL

SEQ ID NO: 30866 - protein, 10 aa, Borrelia burgdorferi
QILNKLENLK

SEQ ID NO: 30867 - protein, 10 aa, Borrelia burgdorferi
ILNKLENLKV

SEQ ID NO: 30868 - protein, 10 aa, Borrelia burgdorferi
LNKLENLKVV

SEQ ID NO: 30869 - protein, 10 aa, Borrelia burgdorferi
NKLENLKVVS

SEQ ID NO: 30870 - protein, 10 aa, Borrelia burgdorferi
KLENLKVVSE

SEQ ID NO: 30871 - protein, 10 aa, Borrelia burgdorferi
LENLKVVSES

SEQ ID NO: 30872 - protein, 10 aa, Borrelia burgdorferi
ENLKVVSESN

SEQ ID NO: 30873 - protein, 10 aa, Borrelia burgdorferi
NLKVVSESNF

SEQ ID NO: 30874 - protein, 10 aa, Borrelia burgdorferi
LKVVSESNFE

SEQ ID NO: 30875 - protein, 10 aa, Borrelia burgdorferi
KVVSESNFEI

SEQ ID NO: 30876 - protein, 10 aa, Borrelia burgdorferi
VVSESNFEIN

SEQ ID NO: 30877 - protein, 10 aa, Borrelia burgdorferi
VSESNFEINK

SEQ ID NO: 30878 - protein, 10 aa, Borrelia burgdorferi
SESNFEINKN

SEQ ID NO: 30879 - protein, 10 aa, Borrelia burgdorferi
ESNFEINKNS

SEQ ID NO: 30880 - protein, 10 aa, Borrelia burgdorferi
SNFEINKNSS

SEQ ID NO: 30881 - protein, 10 aa, Borrelia burgdorferi
NFEINKNSSL

SEQ ID NO: 30882 - protein, 10 aa, Borrelia burgdorferi
FEINKNSSLY

SEQ ID NO: 30883 - protein, 10 aa, Borrelia burgdorferi
EINKNSSLYV

SEQ ID NO: 30884 - protein, 10 aa, Borrelia burgdorferi
INKNSSLYVD

SEQ ID NO: 30885 - protein, 10 aa, Borrelia burgdorferi
NKNSSLYVDS

SEQ ID NO: 30886 - protein, 10 aa, Borrelia burgdorferi
KNSSLYVDSK

SEQ ID NO: 30887 - protein, 10 aa, Borrelia burgdorferi
NSSLYVDSKM

SEQ ID NO: 30888 - protein, 10 aa, Borrelia burgdorferi
SSLYVDSKMI

SEQ ID NO: 30889 - protein, 10 aa, Borrelia burgdorferi
SLYVDSKMIL

SEQ ID NO: 30890 - protein, 10 aa, Borrelia burgdorferi
LYVDSKMILA

SEQ ID NO: 30891 - protein, 10 aa, Borrelia burgdorferi
YVDSKMILAA

SEQ ID NO: 30892 - protein, 10 aa, Borrelia burgdorferi
VDSKMILAAV

SEQ ID NO: 30893 - protein, 10 aa, Borrelia burgdorferi
DSKMILAAVR

SEQ ID NO: 30894 - protein, 10 aa, Borrelia burgdorferi
SKMILAAVRD

SEQ ID NO: 30895 - protein, 10 aa, Borrelia burgdorferi
KMILAAVRDK

SEQ ID NO: 30896 - protein, 10 aa, Borrelia burgdorferi
MILAAVRDKD

SEQ ID NO: 30897 - protein, 10 aa, Borrelia burgdorferi
ILAAVRDKDD

SEQ ID NO: 30898 - protein, 10 aa, Borrelia burgdorferi
LAAVRDKDDS

SEQ ID NO: 30899 - protein, 10 aa, Borrelia burgdorferi
AAVRDKDDSN

SEQ ID NO: 30900 - protein, 10 aa, Borrelia burgdorferi
AVRDKDDSNA

SEQ ID NO: 30901 - protein, 10 aa, Borrelia burgdorferi
VRDKDDSNAW

SEQ ID NO: 30902 - protein, 10 aa, Borrelia burgdorferi
RDKDDSNAWR

SEQ ID NO: 30903 - protein, 10 aa, Borrelia burgdorferi
DKDDSNAWRL

SEQ ID NO: 30904 - protein, 10 aa, Borrelia burgdorferi
KDDSNAWRLA

SEQ ID NO: 30905 - protein, 10 aa, Borrelia burgdorferi
DDSNAWRLAK

SEQ ID NO: 30906 - protein, 10 aa, Borrelia burgdorferi
DSNAWRLAKF

SEQ ID NO: 30907 - protein, 10 aa, Borrelia burgdorferi
SNAWRLAKFS

SEQ ID NO: 30908 - protein, 10 aa, Borrelia burgdorferi
NAWRLAKFSP

SEQ ID NO: 30909 - protein, 10 aa, Borrelia burgdorferi
AWRLAKFSPK

SEQ ID NO: 30910 - protein, 10 aa, Borrelia burgdorferi
WRLAKFSPKN

SEQ ID NO: 30911 - protein, 10 aa, Borrelia burgdorferi
RLAKFSPKNL

SEQ ID NO: 30912 - protein, 10 aa, Borrelia burgdorferi
LAKFSPKNLD

SEQ ID NO: 30913 - protein, 10 aa, Borrelia burgdorferi
AKFSPKNLDE

SEQ ID NO: 30914 - protein, 10 aa, Borrelia burgdorferi
KFSPKNLDEF

SEQ ID NO: 30915 - protein, 10 aa, Borrelia burgdorferi
FSPKNLDEFI

SEQ ID NO: 30916 - protein, 10 aa, Borrelia burgdorferi
SPKNLDEFIL

SEQ ID NO: 30917 - protein, 10 aa, Borrelia burgdorferi
PKNLDEFILS

SEQ ID NO: 30918 - protein, 10 aa, Borrelia burgdorferi
KNLDEFILSE

SEQ ID NO: 30919 - protein, 10 aa, Borrelia burgdorferi
NLDEFILSEN

SEQ ID NO: 30920 - protein, 10 aa, Borrelia burgdorferi
LDEFILSENK

SEQ ID NO: 30921 - protein, 10 aa, Borrelia burgdorferi
DEFILSENKI

SEQ ID NO: 30922 - protein, 10 aa, Borrelia burgdorferi
EFILSENKIL

SEQ ID NO: 30923 - protein, 10 aa, Borrelia burgdorferi
FILSENKILP

SEQ ID NO: 30924 - protein, 10 aa, Borrelia burgdorferi
ILSENKILPF

SEQ ID NO: 30925 - protein, 10 aa, Borrelia burgdorferi
LSENKILPFT

SEQ ID NO: 30926 - protein, 10 aa, Borrelia burgdorferi
SENKILPFTS

SEQ ID NO: 30927 - protein, 10 aa, Borrelia burgdorferi
ENKILPFTSF

SEQ ID NO: 30928 - protein, 10 aa, Borrelia burgdorferi
NKILPFTSFS

SEQ ID NO: 30929 - protein, 10 aa, Borrelia burgdorferi
KILPFTSFSV

SEQ ID NO: 30930 - protein, 10 aa, Borrelia burgdorferi
ILPFTSFSVR

SEQ ID NO: 30931 - protein, 10 aa, Borrelia burgdorferi
LPFTSFSVRK

SEQ ID NO: 30932 - protein, 10 aa, Borrelia burgdorferi
PFTSFSVRKN

SEQ ID NO: 30933 - protein, 10 aa, Borrelia burgdorferi
FTSFSVRKNF

SEQ ID NO: 30934 - protein, 10 aa, Borrelia burgdorferi
TSFSVRKNFI

SEQ ID NO: 30935 - protein, 10 aa, Borrelia burgdorferi
SFSVRKNFIY

SEQ ID NO: 30936 - protein, 10 aa, Borrelia burgdorferi
FSVRKNFIYL

SEQ ID NO: 30937 - protein, 10 aa, Borrelia burgdorferi
SVRKNFIYLQ

SEQ ID NO: 30938 - protein, 10 aa, Borrelia burgdorferi
VRKNFIYLQD

SEQ ID NO: 30939 - protein, 10 aa, Borrelia burgdorferi
RKNFIYLQDE

SEQ ID NO: 30940 - protein, 10 aa, Borrelia burgdorferi
KNFIYLQDEL

SEQ ID NO: 30941 - protein, 10 aa, Borrelia burgdorferi
NFIYLQDELK

SEQ ID NO: 30942 - protein, 10 aa, Borrelia burgdorferi
FIYLQDELKN

SEQ ID NO: 30943 - protein, 10 aa, Borrelia burgdorferi
IYLQDELKNL

SEQ ID NO: 30944 - protein, 10 aa, Borrelia burgdorferi
YLQDELKNLV

SEQ ID NO: 30945 - protein, 10 aa, Borrelia burgdorferi
LQDELKNLVI

SEQ ID NO: 30946 - protein, 10 aa, Borrelia burgdorferi
QDELKNLVIL

SEQ ID NO: 30947 - protein, 10 aa, Borrelia burgdorferi
DELKNLVILD

SEQ ID NO: 30948 - protein, 10 aa, Borrelia burgdorferi
ELKNLVILDV

SEQ ID NO: 30949 - protein, 10 aa, Borrelia burgdorferi
LKNLVILDVN

SEQ ID NO: 30950 - protein, 10 aa, Borrelia burgdorferi
KNLVILDVNT

SEQ ID NO: 30951 - protein, 10 aa, Borrelia burgdorferi
NLVILDVNTL

SEQ ID NO: 30952 - protein, 10 aa, Borrelia burgdorferi
LVILDVNTLK

SEQ ID NO: 30953 - protein, 10 aa, Borrelia burgdorferi
VILDVNTLKK

SEQ ID NO: 30954 - protein, 10 aa, Borrelia burgdorferi
ILDVNTLKKV

SEQ ID NO: 30955 - protein, 10 aa, Borrelia burgdorferi
LDVNTLKKVK

SEQ ID NO: 30956 - protein, 11 aa, Borrelia burgdorferi
MKKMLLIFSFF

SEQ ID NO: 30957 - protein, 11 aa, Borrelia burgdorferi
KKMLLIFSFFL

SEQ ID NO: 30958 - protein, 11 aa, Borrelia burgdorferi
KMLLIFSFFLI

SEQ ID NO: 30959 - protein, 11 aa, Borrelia burgdorferi
MLLIFSFFLIF

SEQ ID NO: 30960 - protein, 11 aa, Borrelia burgdorferi
LLIFSFFLIFL

SEQ ID NO: 30961 - protein, 11 aa, Borrelia burgdorferi
LIFSFFLIFLN

SEQ ID NO: 30962 - protein, 11 aa, Borrelia burgdorferi
IFSFFLIFLNG

SEQ ID NO: 30963 - protein, 11 aa, Borrelia burgdorferi
FSFFLIFLNGF

SEQ ID NO: 30964 - protein, 11 aa, Borrelia burgdorferi
SFFLIFLNGFP

SEQ ID NO: 30965 - protein, 11 aa, Borrelia burgdorferi
FFLIFLNGFPL

SEQ ID NO: 30966 - protein, 11 aa, Borrelia burgdorferi
FLIFLNGFPLN

SEQ ID NO: 30967 - protein, 11 aa, Borrelia burgdorferi
LIFLNGFPLNA

SEQ ID NO: 30968 - protein, 11 aa, Borrelia burgdorferi
IFLNGFPLNAR

SEQ ID NO: 30969 - protein, 11 aa, Borrelia burgdorferi
FLNGFPLNARK

SEQ ID NO: 30970 - protein, 11 aa, Borrelia burgdorferi
LNGFPLNARKV

SEQ ID NO: 30971 - protein, 11 aa, Borrelia burgdorferi
NGFPLNARKVD

SEQ ID NO: 30972 - protein, 11 aa, Borrelia burgdorferi
GFPLNARKVDK

SEQ ID NO: 30973 - protein, 11 aa, Borrelia burgdorferi
FPLNARKVDKE

SEQ ID NO: 30974 - protein, 11 aa, Borrelia burgdorferi
PLNARKVDKEK

SEQ ID NO: 30975 - protein, 11 aa, Borrelia burgdorferi
LNARKVDKEKL

SEQ ID NO: 30976 - protein, 11 aa, Borrelia burgdorferi
NARKVDKEKLK

SEQ ID NO: 30977 - protein, 11 aa, Borrelia burgdorferi
ARKVDKEKLKD

SEQ ID NO: 30978 - protein, 11 aa, Borrelia burgdorferi
RKVDKEKLKDF

SEQ ID NO: 30979 - protein, 11 aa, Borrelia burgdorferi
KVDKEKLKDFV

SEQ ID NO: 30980 - protein, 11 aa, Borrelia burgdorferi
VDKEKLKDFVN

SEQ ID NO: 30981 - protein, 11 aa, Borrelia burgdorferi
DKEKLKDFVNM

SEQ ID NO: 30982 - protein, 11 aa, Borrelia burgdorferi
KEKLKDFVNMD

SEQ ID NO: 30983 - protein, 11 aa, Borrelia burgdorferi
EKLKDFVNMDL

SEQ ID NO: 30984 - protein, 11 aa, Borrelia burgdorferi
KLKDFVNMDLE

SEQ ID NO: 30985 - protein, 11 aa, Borrelia burgdorferi
LKDFVNMDLEF

SEQ ID NO: 30986 - protein, 11 aa, Borrelia burgdorferi
KDFVNMDLEFV

SEQ ID NO: 30987 - protein, 11 aa, Borrelia burgdorferi
DFVNMDLEFVN

SEQ ID NO: 30988 - protein, 11 aa, Borrelia burgdorferi
FVNMDLEFVNY

SEQ ID NO: 30989 - protein, 11 aa, Borrelia burgdorferi
VNMDLEFVNYK

SEQ ID NO: 30990 - protein, 11 aa, Borrelia burgdorferi
NMDLEFVNYKG

SEQ ID NO: 30991 - protein, 11 aa, Borrelia burgdorferi
MDLEFVNYKGP

SEQ ID NO: 30992 - protein, 11 aa, Borrelia burgdorferi
DLEFVNYKGPY

SEQ ID NO: 30993 - protein, 11 aa, Borrelia burgdorferi
LEFVNYKGPYD

SEQ ID NO: 30994 - protein, 11 aa, Borrelia burgdorferi
EFVNYKGPYDS

SEQ ID NO: 30995 - protein, 11 aa, Borrelia burgdorferi
FVNYKGPYDST

SEQ ID NO: 30996 - protein, 11 aa, Borrelia burgdorferi
VNYKGPYDSTN

SEQ ID NO: 30997 - protein, 11 aa, Borrelia burgdorferi
NYKGPYDSTNT

SEQ ID NO: 30998 - protein, 11 aa, Borrelia burgdorferi
YKGPYDSTNTY

SEQ ID NO: 30999 - protein, 11 aa, Borrelia burgdorferi
KGPYDSTNTYE

SEQ ID NO: 31000 - protein, 11 aa, Borrelia burgdorferi
GPYDSTNTYEQ

SEQ ID NO: 31001 - protein, 11 aa, Borrelia burgdorferi
PYDSTNTYEQI

SEQ ID NO: 31002 - protein, 11 aa, Borrelia burgdorferi
YDSTNTYEQIV

SEQ ID NO: 31003 - protein, 11 aa, Borrelia burgdorferi
DSTNTYEQIVG

SEQ ID NO: 31004 - protein, 11 aa, Borrelia burgdorferi
STNTYEQIVGI

SEQ ID NO: 31005 - protein, 11 aa, Borrelia burgdorferi
TNTYEQIVGIG

SEQ ID NO: 31006 - protein, 11 aa, Borrelia burgdorferi
NTYEQIVGIGE

SEQ ID NO: 31007 - protein, 11 aa, Borrelia burgdorferi
TYEQIVGIGEF

SEQ ID NO: 31008 - protein, 11 aa, Borrelia burgdorferi
YEQIVGIGEFL

SEQ ID NO: 31009 - protein, 11 aa, Borrelia burgdorferi
EQIVGIGEFLA

SEQ ID NO: 31010 - protein, 11 aa, Borrelia burgdorferi
QIVGIGEFLAR

SEQ ID NO: 31011 - protein, 11 aa, Borrelia burgdorferi
IVGIGEFLARP

SEQ ID NO: 31012 - protein, 11 aa, Borrelia burgdorferi
VGIGEFLARPL

SEQ ID NO: 31013 - protein, 11 aa, Borrelia burgdorferi
GIGEFLARPLT

SEQ ID NO: 31014 - protein, 11 aa, Borrelia burgdorferi
IGEFLARPLTN

SEQ ID NO: 31015 - protein, 11 aa, Borrelia burgdorferi
GEFLARPLTNS

SEQ ID NO: 31016 - protein, 11 aa, Borrelia burgdorferi
EFLARPLTNSN

SEQ ID NO: 31017 - protein, 11 aa, Borrelia burgdorferi
FLARPLTNSNS

SEQ ID NO: 31018 - protein, 11 aa, Borrelia burgdorferi
LARPLTNSNSN

SEQ ID NO: 31019 - protein, 11 aa, Borrelia burgdorferi
ARPLTNSNSNS

SEQ ID NO: 31020 - protein, 11 aa, Borrelia burgdorferi
RPLTNSNSNSS

SEQ ID NO: 31021 - protein, 11 aa, Borrelia burgdorferi
PLTNSNSNSSY

SEQ ID NO: 31022 - protein, 11 aa, Borrelia burgdorferi
LTNSNSNSSYY

SEQ ID NO: 31023 - protein, 11 aa, Borrelia burgdorferi
TNSNSNSSYYG

SEQ ID NO: 31024 - protein, 11 aa, Borrelia burgdorferi
NSNSNSSYYGK

SEQ ID NO: 31025 - protein, 11 aa, Borrelia burgdorferi
SNSNSSYYGKY

SEQ ID NO: 31026 - protein, 11 aa, Borrelia burgdorferi
NSNSSYYGKYF

SEQ ID NO: 31027 - protein, 11 aa, Borrelia burgdorferi
SNSSYYGKYFI

SEQ ID NO: 31028 - protein, 11 aa, Borrelia burgdorferi
NSSYYGKYFIN

SEQ ID NO: 31029 - protein, 11 aa, Borrelia burgdorferi
SSYYGKYFINR

SEQ ID NO: 31030 - protein, 11 aa, Borrelia burgdorferi
SYYGKYFINRF

SEQ ID NO: 31031 - protein, 11 aa, Borrelia burgdorferi
YYGKYFINRFI

SEQ ID NO: 31032 - protein, 11 aa, Borrelia burgdorferi
YGKYFINRFID

SEQ ID NO: 31033 - protein, 11 aa, Borrelia burgdorferi
GKYFINRFIDD

SEQ ID NO: 31034 - protein, 11 aa, Borrelia burgdorferi
KYFINRFIDDQ

SEQ ID NO: 31035 - protein, 11 aa, Borrelia burgdorferi
YFINRFIDDQD

SEQ ID NO: 31036 - protein, 11 aa, Borrelia burgdorferi
FINRFIDDQDK

SEQ ID NO: 31037 - protein, 11 aa, Borrelia burgdorferi
INRFIDDQDKK

SEQ ID NO: 31038 - protein, 11 aa, Borrelia burgdorferi
NRFIDDQDKKA

SEQ ID NO: 31039 - protein, 11 aa, Borrelia burgdorferi
RFIDDQDKKAS

SEQ ID NO: 31040 - protein, 11 aa, Borrelia burgdorferi
FIDDQDKKASV

SEQ ID NO: 31041 - protein, 11 aa, Borrelia burgdorferi
IDDQDKKASVD

SEQ ID NO: 31042 - protein, 11 aa, Borrelia burgdorferi
DDQDKKASVDV

SEQ ID NO: 31043 - protein, 11 aa, Borrelia burgdorferi
DQDKKASVDVF

SEQ ID NO: 31044 - protein, 11 aa, Borrelia burgdorferi
QDKKASVDVFS

SEQ ID NO: 31045 - protein, 11 aa, Borrelia burgdorferi
DKKASVDVFSI

SEQ ID NO: 31046 - protein, 11 aa, Borrelia burgdorferi
KKASVDVFSIS

SEQ ID NO: 31047 - protein, 11 aa, Borrelia burgdorferi
KASVDVFSISS

SEQ ID NO: 31048 - protein, 11 aa, Borrelia burgdorferi
ASVDVFSISSK

SEQ ID NO: 31049 - protein, 11 aa, Borrelia burgdorferi
SVDVFSISSKS

SEQ ID NO: 31050 - protein, 11 aa, Borrelia burgdorferi
VDVFSISSKSE

SEQ ID NO: 31051 - protein, 11 aa, Borrelia burgdorferi
DVFSISSKSEL

SEQ ID NO: 31052 - protein, 11 aa, Borrelia burgdorferi
VFSISSKSELD

SEQ ID NO: 31053 - protein, 11 aa, Borrelia burgdorferi
FSISSKSELDS

SEQ ID NO: 31054 - protein, 11 aa, Borrelia burgdorferi
SISSKSELDSI

SEQ ID NO: 31055 - protein, 11 aa, Borrelia burgdorferi
ISSKSELDSIL

SEQ ID NO: 31056 - protein, 11 aa, Borrelia burgdorferi
SSKSELDSILN

SEQ ID NO: 31057 - protein, 11 aa, Borrelia burgdorferi
SKSELDSILNL

SEQ ID NO: 31058 - protein, 11 aa, Borrelia burgdorferi
KSELDSILNLR

SEQ ID NO: 31059 - protein, 11 aa, Borrelia burgdorferi
SELDSILNLRR

SEQ ID NO: 31060 - protein, 11 aa, Borrelia burgdorferi
ELDSILNLRRI

SEQ ID NO: 31061 - protein, 11 aa, Borrelia burgdorferi
LDSILNLRRIL

SEQ ID NO: 31062 - protein, 11 aa, Borrelia burgdorferi
DSILNLRRILT

SEQ ID NO: 31063 - protein, 11 aa, Borrelia burgdorferi
SILNLRRILTG

SEQ ID NO: 31064 - protein, 11 aa, Borrelia burgdorferi
ILNLRRILTGY

SEQ ID NO: 31065 - protein, 11 aa, Borrelia burgdorferi
LNLRRILTGYI

SEQ ID NO: 31066 - protein, 11 aa, Borrelia burgdorferi
NLRRILTGYII

SEQ ID NO: 31067 - protein, 11 aa, Borrelia burgdorferi
LRRILTGYIIK

SEQ ID NO: 31068 - protein, 11 aa, Borrelia burgdorferi
RRILTGYIIKS

SEQ ID NO: 31069 - protein, 11 aa, Borrelia burgdorferi
RILTGYIIKSF

SEQ ID NO: 31070 - protein, 11 aa, Borrelia burgdorferi
ILTGYIIKSFD

SEQ ID NO: 31071 - protein, 11 aa, Borrelia burgdorferi
LTGYIIKSFDY

SEQ ID NO: 31072 - protein, 11 aa, Borrelia burgdorferi
TGYIIKSFDYD

SEQ ID NO: 31073 - protein, 11 aa, Borrelia burgdorferi
GYIIKSFDYDR

SEQ ID NO: 31074 - protein, 11 aa, Borrelia burgdorferi
YIIKSFDYDRS

SEQ ID NO: 31075 - protein, 11 aa, Borrelia burgdorferi
IIKSFDYDRSS

SEQ ID NO: 31076 - protein, 11 aa, Borrelia burgdorferi
IKSFDYDRSSA

SEQ ID NO: 31077 - protein, 11 aa, Borrelia burgdorferi
KSFDYDRSSAE

SEQ ID NO: 31078 - protein, 11 aa, Borrelia burgdorferi
SFDYDRSSAEL

SEQ ID NO: 31079 - protein, 11 aa, Borrelia burgdorferi
FDYDRSSAELI

SEQ ID NO: 31080 - protein, 11 aa, Borrelia burgdorferi
DYDRSSAELIA

SEQ ID NO: 31081 - protein, 11 aa, Borrelia burgdorferi
YDRSSAELIAK

SEQ ID NO: 31082 - protein, 11 aa, Borrelia burgdorferi
DRSSAELIAKV

SEQ ID NO: 31083 - protein, 11 aa, Borrelia burgdorferi
RSSAELIAKVI

SEQ ID NO: 31084 - protein, 11 aa, Borrelia burgdorferi
SSAELIAKVIT

SEQ ID NO: 31085 - protein, 11 aa, Borrelia burgdorferi
SAELIAKVITI

SEQ ID NO: 31086 - protein, 11 aa, Borrelia burgdorferi
AELIAKVITIY

SEQ ID NO: 31087 - protein, 11 aa, Borrelia burgdorferi
ELIAKVITIYN

SEQ ID NO: 31088 - protein, 11 aa, Borrelia burgdorferi
LIAKVITIYNA

SEQ ID NO: 31089 - protein, 11 aa, Borrelia burgdorferi
IAKVITIYNAV

SEQ ID NO: 31090 - protein, 11 aa, Borrelia burgdorferi
AKVITIYNAVY

SEQ ID NO: 31091 - protein, 11 aa, Borrelia burgdorferi
KVITIYNAVYR

SEQ ID NO: 31092 - protein, 11 aa, Borrelia burgdorferi
VITIYNAVYRG

SEQ ID NO: 31093 - protein, 11 aa, Borrelia burgdorferi
ITIYNAVYRGD

SEQ ID NO: 31094 - protein, 11 aa, Borrelia burgdorferi
TIYNAVYRGDL

SEQ ID NO: 31095 - protein, 11 aa, Borrelia burgdorferi
IYNAVYRGDLD

SEQ ID NO: 31096 - protein, 11 aa, Borrelia burgdorferi
YNAVYRGDLDY

SEQ ID NO: 31097 - protein, 11 aa, Borrelia burgdorferi
NAVYRGDLDYY

SEQ ID NO: 31098 - protein, 11 aa, Borrelia burgdorferi
AVYRGDLDYYK

SEQ ID NO: 31099 - protein, 11 aa, Borrelia burgdorferi
VYRGDLDYYKG

SEQ ID NO: 31100 - protein, 11 aa, Borrelia burgdorferi
YRGDLDYYKGF

SEQ ID NO: 31101 - protein, 11 aa, Borrelia burgdorferi
RGDLDYYKGFY

SEQ ID NO: 31102 - protein, 11 aa, Borrelia burgdorferi
GDLDYYKGFYI

SEQ ID NO: 31103 - protein, 11 aa, Borrelia burgdorferi
DLDYYKGFYIE

SEQ ID NO: 31104 - protein, 11 aa, Borrelia burgdorferi
LDYYKGFYIEP

SEQ ID NO: 31105 - protein, 11 aa, Borrelia burgdorferi
DYYKGFYIEPA

SEQ ID NO: 31106 - protein, 11 aa, Borrelia burgdorferi
YYKGFYIEPAL

SEQ ID NO: 31107 - protein, 11 aa, Borrelia burgdorferi
YKGFYIEPALK

SEQ ID NO: 31108 - protein, 11 aa, Borrelia burgdorferi
KGFYIEPALKS

SEQ ID NO: 31109 - protein, 11 aa, Borrelia burgdorferi
GFYIEPALKSL

SEQ ID NO: 31110 - protein, 11 aa, Borrelia burgdorferi
FYIEPALKSLT

SEQ ID NO: 31111 - protein, 11 aa, Borrelia burgdorferi
YIEPALKSLTK

SEQ ID NO: 31112 - protein, 11 aa, Borrelia burgdorferi
IEPALKSLTKE

SEQ ID NO: 31113 - protein, 11 aa, Borrelia burgdorferi
EPALKSLTKEN

SEQ ID NO: 31114 - protein, 11 aa, Borrelia burgdorferi
PALKSLTKENA

SEQ ID NO: 31115 - protein, 11 aa, Borrelia burgdorferi
ALKSLTKENAG

SEQ ID NO: 31116 - protein, 11 aa, Borrelia burgdorferi
LKSLTKENAGL

SEQ ID NO: 31117 - protein, 11 aa, Borrelia burgdorferi
KSLTKENAGLS

SEQ ID NO: 31118 - protein, 11 aa, Borrelia burgdorferi
SLTKENAGLSR

SEQ ID NO: 31119 - protein, 11 aa, Borrelia burgdorferi
LTKENAGLSRV

SEQ ID NO: 31120 - protein, 11 aa, Borrelia burgdorferi
TKENAGLSRVY

SEQ ID NO: 31121 - protein, 11 aa, Borrelia burgdorferi
KENAGLSRVYS

SEQ ID NO: 31122 - protein, 11 aa, Borrelia burgdorferi
ENAGLSRVYSQ

SEQ ID NO: 31123 - protein, 11 aa, Borrelia burgdorferi
NAGLSRVYSQW

SEQ ID NO: 31124 - protein, 11 aa, Borrelia burgdorferi
AGLSRVYSQWA

SEQ ID NO: 31125 - protein, 11 aa, Borrelia burgdorferi
GLSRVYSQWAG

SEQ ID NO: 31126 - protein, 11 aa, Borrelia burgdorferi
LSRVYSQWAGK

SEQ ID NO: 31127 - protein, 11 aa, Borrelia burgdorferi
SRVYSQWAGKT

SEQ ID NO: 31128 - protein, 11 aa, Borrelia burgdorferi
RVYSQWAGKTQ

SEQ ID NO: 31129 - protein, 11 aa, Borrelia burgdorferi
VYSQWAGKTQI

SEQ ID NO: 31130 - protein, 11 aa, Borrelia burgdorferi
YSQWAGKTQIF

SEQ ID NO: 31131 - protein, 11 aa, Borrelia burgdorferi
SQWAGKTQIFI

SEQ ID NO: 31132 - protein, 11 aa, Borrelia burgdorferi
QWAGKTQIFIP

SEQ ID NO: 31133 - protein, 11 aa, Borrelia burgdorferi
WAGKTQIFIPL

SEQ ID NO: 31134 - protein, 11 aa, Borrelia burgdorferi
AGKTQIFIPLK

SEQ ID NO: 31135 - protein, 11 aa, Borrelia burgdorferi
GKTQIFIPLKK

SEQ ID NO: 31136 - protein, 11 aa, Borrelia burgdorferi
KTQIFIPLKKD

SEQ ID NO: 31137 - protein, 11 aa, Borrelia burgdorferi
TQIFIPLKKDI

SEQ ID NO: 31138 - protein, 11 aa, Borrelia burgdorferi
QIFIPLKKDIL

SEQ ID NO: 31139 - protein, 11 aa, Borrelia burgdorferi
IFIPLKKDILS

SEQ ID NO: 31140 - protein, 11 aa, Borrelia burgdorferi
FIPLKKDILSG

SEQ ID NO: 31141 - protein, 11 aa, Borrelia burgdorferi
IPLKKDILSGN

SEQ ID NO: 31142 - protein, 11 aa, Borrelia burgdorferi
PLKKDILSGNI

SEQ ID NO: 31143 - protein, 11 aa, Borrelia burgdorferi
LKKDILSGNIE

SEQ ID NO: 31144 - protein, 11 aa, Borrelia burgdorferi
KKDILSGNIES

SEQ ID NO: 31145 - protein, 11 aa, Borrelia burgdorferi
KDILSGNIESD

SEQ ID NO: 31146 - protein, 11 aa, Borrelia burgdorferi
DILSGNIESDI

SEQ ID NO: 31147 - protein, 11 aa, Borrelia burgdorferi
ILSGNIESDID

SEQ ID NO: 31148 - protein, 11 aa, Borrelia burgdorferi
LSGNIESDIDI

SEQ ID NO: 31149 - protein, 11 aa, Borrelia burgdorferi
SGNIESDIDID

SEQ ID NO: 31150 - protein, 11 aa, Borrelia burgdorferi
GNIESDIDIDS

SEQ ID NO: 31151 - protein, 11 aa, Borrelia burgdorferi
NIESDIDIDSL

SEQ ID NO: 31152 - protein, 11 aa, Borrelia burgdorferi
IESDIDIDSLV

SEQ ID NO: 31153 - protein, 11 aa, Borrelia burgdorferi
ESDIDIDSLVT

SEQ ID NO: 31154 - protein, 11 aa, Borrelia burgdorferi
SDIDIDSLVTD

SEQ ID NO: 31155 - protein, 11 aa, Borrelia burgdorferi
DIDIDSLVTDK

SEQ ID NO: 31156 - protein, 11 aa, Borrelia burgdorferi
IDIDSLVTDKV

SEQ ID NO: 31157 - protein, 11 aa, Borrelia burgdorferi
DIDSLVTDKVI

SEQ ID NO: 31158 - protein, 11 aa, Borrelia burgdorferi
IDSLVTDKVIA

SEQ ID NO: 31159 - protein, 11 aa, Borrelia burgdorferi
DSLVTDKVIAA

SEQ ID NO: 31160 - protein, 11 aa, Borrelia burgdorferi
SLVTDKVIAAL

SEQ ID NO: 31161 - protein, 11 aa, Borrelia burgdorferi
LVTDKVIAALL

SEQ ID NO: 31162 - protein, 11 aa, Borrelia burgdorferi
VTDKVIAALLS

SEQ ID NO: 31163 - protein, 11 aa, Borrelia burgdorferi
TDKVIAALLSE

SEQ ID NO: 31164 - protein, 11 aa, Borrelia burgdorferi
DKVIAALLSEN

SEQ ID NO: 31165 - protein, 11 aa, Borrelia burgdorferi
KVIAALLSENE

SEQ ID NO: 31166 - protein, 11 aa, Borrelia burgdorferi
VIAALLSENEA

SEQ ID NO: 31167 - protein, 11 aa, Borrelia burgdorferi
IAALLSENEAG

SEQ ID NO: 31168 - protein, 11 aa, Borrelia burgdorferi
AALLSENEAGV

SEQ ID NO: 31169 - protein, 11 aa, Borrelia burgdorferi
ALLSENEAGVN

SEQ ID NO: 31170 - protein, 11 aa, Borrelia burgdorferi
LLSENEAGVNF

SEQ ID NO: 31171 - protein, 11 aa, Borrelia burgdorferi
LSENEAGVNFA

SEQ ID NO: 31172 - protein, 11 aa, Borrelia burgdorferi
SENEAGVNFAR

SEQ ID NO: 31173 - protein, 11 aa, Borrelia burgdorferi
ENEAGVNFARD

SEQ ID NO: 31174 - protein, 11 aa, Borrelia burgdorferi
NEAGVNFARDI

SEQ ID NO: 31175 - protein, 11 aa, Borrelia burgdorferi
EAGVNFARDIT

SEQ ID NO: 31176 - protein, 11 aa, Borrelia burgdorferi
AGVNFARDITD

SEQ ID NO: 31177 - protein, 11 aa, Borrelia burgdorferi
GVNFARDITDI

SEQ ID NO: 31178 - protein, 11 aa, Borrelia burgdorferi
VNFARDITDIQ

SEQ ID NO: 31179 - protein, 11 aa, Borrelia burgdorferi
NFARDITDIQG

SEQ ID NO: 31180 - protein, 11 aa, Borrelia burgdorferi
FARDITDIQGE

SEQ ID NO: 31181 - protein, 11 aa, Borrelia burgdorferi
ARDITDIQGET

SEQ ID NO: 31182 - protein, 11 aa, Borrelia burgdorferi
RDITDIQGETH

SEQ ID NO: 31183 - protein, 11 aa, Borrelia burgdorferi
DITDIQGETHK

SEQ ID NO: 31184 - protein, 11 aa, Borrelia burgdorferi
ITDIQGETHKA

SEQ ID NO: 31185 - protein, 11 aa, Borrelia burgdorferi
TDIQGETHKAD

SEQ ID NO: 31186 - protein, 11 aa, Borrelia burgdorferi
DIQGETHKADQ

SEQ ID NO: 31187 - protein, 11 aa, Borrelia burgdorferi
IQGETHKADQD

SEQ ID NO: 31188 - protein, 11 aa, Borrelia burgdorferi
QGETHKADQDK

SEQ ID NO: 31189 - protein, 11 aa, Borrelia burgdorferi
GETHKADQDKI

SEQ ID NO: 31190 - protein, 11 aa, Borrelia burgdorferi
ETHKADQDKID

SEQ ID NO: 31191 - protein, 11 aa, Borrelia burgdorferi
THKADQDKIDT

SEQ ID NO: 31192 - protein, 11 aa, Borrelia burgdorferi
HKADQDKIDTE

SEQ ID NO: 31193 - protein, 11 aa, Borrelia burgdorferi
KADQDKIDTEL

SEQ ID NO: 31194 - protein, 11 aa, Borrelia burgdorferi
ADQDKIDTELD

SEQ ID NO: 31195 - protein, 11 aa, Borrelia burgdorferi
DQDKIDTELDN

SEQ ID NO: 31196 - protein, 11 aa, Borrelia burgdorferi
QDKIDTELDNI

SEQ ID NO: 31197 - protein, 11 aa, Borrelia burgdorferi
DKIDTELDNIH

SEQ ID NO: 31198 - protein, 11 aa, Borrelia burgdorferi
KIDTELDNIHE

SEQ ID NO: 31199 - protein, 11 aa, Borrelia burgdorferi
IDTELDNIHES

SEQ ID NO: 31200 - protein, 11 aa, Borrelia burgdorferi
DTELDNIHESD

SEQ ID NO: 31201 - protein, 11 aa, Borrelia burgdorferi
TELDNIHESDS

SEQ ID NO: 31202 - protein, 11 aa, Borrelia burgdorferi
ELDNIHESDSN

SEQ ID NO: 31203 - protein, 11 aa, Borrelia burgdorferi
LDNIHESDSNI

SEQ ID NO: 31204 - protein, 11 aa, Borrelia burgdorferi
DNIHESDSNIT

SEQ ID NO: 31205 - protein, 11 aa, Borrelia burgdorferi
NIHESDSNITE

SEQ ID NO: 31206 - protein, 11 aa, Borrelia burgdorferi
IHESDSNITET

SEQ ID NO: 31207 - protein, 11 aa, Borrelia burgdorferi
HESDSNITETI

SEQ ID NO: 31208 - protein, 11 aa, Borrelia burgdorferi
ESDSNITETIE

SEQ ID NO: 31209 - protein, 11 aa, Borrelia burgdorferi
SDSNITETIEN

SEQ ID NO: 31210 - protein, 11 aa, Borrelia burgdorferi
DSNITETIENL

SEQ ID NO: 31211 - protein, 11 aa, Borrelia burgdorferi
SNITETIENLR

SEQ ID NO: 31212 - protein, 11 aa, Borrelia burgdorferi
NITETIENLRD

SEQ ID NO: 31213 - protein, 11 aa, Borrelia burgdorferi
ITETIENLRDQ

SEQ ID NO: 31214 - protein, 11 aa, Borrelia burgdorferi
TETIENLRDQL

SEQ ID NO: 31215 - protein, 11 aa, Borrelia burgdorferi
ETIENLRDQLE

SEQ ID NO: 31216 - protein, 11 aa, Borrelia burgdorferi
TIENLRDQLEK

SEQ ID NO: 31217 - protein, 11 aa, Borrelia burgdorferi
IENLRDQLEKA

SEQ ID NO: 31218 - protein, 11 aa, Borrelia burgdorferi
ENLRDQLEKAT

SEQ ID NO: 31219 - protein, 11 aa, Borrelia burgdorferi
NLRDQLEKATD

SEQ ID NO: 31220 - protein, 11 aa, Borrelia burgdorferi
LRDQLEKATDE

SEQ ID NO: 31221 - protein, 11 aa, Borrelia burgdorferi
RDQLEKATDEE

SEQ ID NO: 31222 - protein, 11 aa, Borrelia burgdorferi
DQLEKATDEEH

SEQ ID NO: 31223 - protein, 11 aa, Borrelia burgdorferi
QLEKATDEEHK

SEQ ID NO: 31224 - protein, 11 aa, Borrelia burgdorferi
LEKATDEEHKK

SEQ ID NO: 31225 - protein, 11 aa, Borrelia burgdorferi
EKATDEEHKKE

SEQ ID NO: 31226 - protein, 11 aa, Borrelia burgdorferi
KATDEEHKKEI

SEQ ID NO: 31227 - protein, 11 aa, Borrelia burgdorferi
ATDEEHKKEIE

SEQ ID NO: 31228 - protein, 11 aa, Borrelia burgdorferi
TDEEHKKEIES

SEQ ID NO: 31229 - protein, 11 aa, Borrelia burgdorferi
DEEHKKEIESQ

SEQ ID NO: 31230 - protein, 11 aa, Borrelia burgdorferi
EEHKKEIESQV

SEQ ID NO: 31231 - protein, 11 aa, Borrelia burgdorferi
EHKKEIESQVD

SEQ ID NO: 31232 - protein, 11 aa, Borrelia burgdorferi
HKKEIESQVDA

SEQ ID NO: 31233 - protein, 11 aa, Borrelia burgdorferi
KKEIESQVDAK

SEQ ID NO: 31234 - protein, 11 aa, Borrelia burgdorferi
KEIESQVDAKK

SEQ ID NO: 31235 - protein, 11 aa, Borrelia burgdorferi
EIESQVDAKKK

SEQ ID NO: 31236 - protein, 11 aa, Borrelia burgdorferi
IESQVDAKKKE

SEQ ID NO: 31237 - protein, 11 aa, Borrelia burgdorferi
ESQVDAKKKEK

SEQ ID NO: 31238 - protein, 11 aa, Borrelia burgdorferi
SQVDAKKKEKE

SEQ ID NO: 31239 - protein, 11 aa, Borrelia burgdorferi
QVDAKKKEKEE

SEQ ID NO: 31240 - protein, 11 aa, Borrelia burgdorferi
VDAKKKEKEEL

SEQ ID NO: 31241 - protein, 11 aa, Borrelia burgdorferi
DAKKKEKEELD

SEQ ID NO: 31242 - protein, 11 aa, Borrelia burgdorferi
AKKKEKEELDK

SEQ ID NO: 31243 - protein, 11 aa, Borrelia burgdorferi
KKKEKEELDKK

SEQ ID NO: 31244 - protein, 11 aa, Borrelia burgdorferi
KKEKEELDKKA

SEQ ID NO: 31245 - protein, 11 aa, Borrelia burgdorferi
KEKEELDKKAI

SEQ ID NO: 31246 - protein, 11 aa, Borrelia burgdorferi
EKEELDKKAIN

SEQ ID NO: 31247 - protein, 11 aa, Borrelia burgdorferi
KEELDKKAINL

SEQ ID NO: 31248 - protein, 11 aa, Borrelia burgdorferi
EELDKKAINLD

SEQ ID NO: 31249 - protein, 11 aa, Borrelia burgdorferi
ELDKKAINLDK

SEQ ID NO: 31250 - protein, 11 aa, Borrelia burgdorferi
LDKKAINLDKA

SEQ ID NO: 31251 - protein, 11 aa, Borrelia burgdorferi
DKKAINLDKAQ

SEQ ID NO: 31252 - protein, 11 aa, Borrelia burgdorferi
KKAINLDKAQQ

SEQ ID NO: 31253 - protein, 11 aa, Borrelia burgdorferi
KAINLDKAQQK

SEQ ID NO: 31254 - protein, 11 aa, Borrelia burgdorferi
AINLDKAQQKL

SEQ ID NO: 31255 - protein, 11 aa, Borrelia burgdorferi
INLDKAQQKLD

SEQ ID NO: 31256 - protein, 11 aa, Borrelia burgdorferi
NLDKAQQKLDS

SEQ ID NO: 31257 - protein, 11 aa, Borrelia burgdorferi
LDKAQQKLDSA

SEQ ID NO: 31258 - protein, 11 aa, Borrelia burgdorferi
DKAQQKLDSAE

SEQ ID NO: 31259 - protein, 11 aa, Borrelia burgdorferi
KAQQKLDSAED

SEQ ID NO: 31260 - protein, 11 aa, Borrelia burgdorferi
AQQKLDSAEDN

SEQ ID NO: 31261 - protein, 11 aa, Borrelia burgdorferi
QQKLDSAEDNL

SEQ ID NO: 31262 - protein, 11 aa, Borrelia burgdorferi
QKLDSAEDNLD

SEQ ID NO: 31263 - protein, 11 aa, Borrelia burgdorferi
KLDSAEDNLDV

SEQ ID NO: 31264 - protein, 11 aa, Borrelia burgdorferi
LDSAEDNLDVQ

SEQ ID NO: 31265 - protein, 11 aa, Borrelia burgdorferi
DSAEDNLDVQR

SEQ ID NO: 31266 - protein, 11 aa, Borrelia burgdorferi
SAEDNLDVQRD

SEQ ID NO: 31267 - protein, 11 aa, Borrelia burgdorferi
AEDNLDVQRDT

SEQ ID NO: 31268 - protein, 11 aa, Borrelia burgdorferi
EDNLDVQRDTV

SEQ ID NO: 31269 - protein, 11 aa, Borrelia burgdorferi
DNLDVQRDTVR

SEQ ID NO: 31270 - protein, 11 aa, Borrelia burgdorferi
NLDVQRDTVRE

SEQ ID NO: 31271 - protein, 11 aa, Borrelia burgdorferi
LDVQRDTVREK

SEQ ID NO: 31272 - protein, 11 aa, Borrelia burgdorferi
DVQRDTVREKI

SEQ ID NO: 31273 - protein, 11 aa, Borrelia burgdorferi
VQRDTVREKIQ

SEQ ID NO: 31274 - protein, 11 aa, Borrelia burgdorferi
QRDTVREKIQE

SEQ ID NO: 31275 - protein, 11 aa, Borrelia burgdorferi
RDTVREKIQED

SEQ ID NO: 31276 - protein, 11 aa, Borrelia burgdorferi
DTVREKIQEDI

SEQ ID NO: 31277 - protein, 11 aa, Borrelia burgdorferi
TVREKIQEDIN

SEQ ID NO: 31278 - protein, 11 aa, Borrelia burgdorferi
VREKIQEDINE

SEQ ID NO: 31279 - protein, 11 aa, Borrelia burgdorferi
REKIQEDINEI

SEQ ID NO: 31280 - protein, 11 aa, Borrelia burgdorferi
EKIQEDINEIN

SEQ ID NO: 31281 - protein, 11 aa, Borrelia burgdorferi
KIQEDINEINK

SEQ ID NO: 31282 - protein, 11 aa, Borrelia burgdorferi
IQEDINEINKE

SEQ ID NO: 31283 - protein, 11 aa, Borrelia burgdorferi
QEDINEINKEK

SEQ ID NO: 31284 - protein, 11 aa, Borrelia burgdorferi
EDINEINKEKN

SEQ ID NO: 31285 - protein, 11 aa, Borrelia burgdorferi
DINEINKEKNL

SEQ ID NO: 31286 - protein, 11 aa, Borrelia burgdorferi
INEINKEKNLP

SEQ ID NO: 31287 - protein, 11 aa, Borrelia burgdorferi
NEINKEKNLPK

SEQ ID NO: 31288 - protein, 11 aa, Borrelia burgdorferi
EINKEKNLPKP

SEQ ID NO: 31289 - protein, 11 aa, Borrelia burgdorferi
INKEKNLPKPG

SEQ ID NO: 31290 - protein, 11 aa, Borrelia burgdorferi
NKEKNLPKPGD

SEQ ID NO: 31291 - protein, 11 aa, Borrelia burgdorferi
KEKNLPKPGDV

SEQ ID NO: 31292 - protein, 11 aa, Borrelia burgdorferi
EKNLPKPGDVS

SEQ ID NO: 31293 - protein, 11 aa, Borrelia burgdorferi
KNLPKPGDVSS

SEQ ID NO: 31294 - protein, 11 aa, Borrelia burgdorferi
NLPKPGDVSSP

SEQ ID NO: 31295 - protein, 11 aa, Borrelia burgdorferi
LPKPGDVSSPK

SEQ ID NO: 31296 - protein, 11 aa, Borrelia burgdorferi
PKPGDVSSPKV

SEQ ID NO: 31297 - protein, 11 aa, Borrelia burgdorferi
KPGDVSSPKVD

SEQ ID NO: 31298 - protein, 11 aa, Borrelia burgdorferi
PGDVSSPKVDK

SEQ ID NO: 31299 - protein, 11 aa, Borrelia burgdorferi
GDVSSPKVDKQ

SEQ ID NO: 31300 - protein, 11 aa, Borrelia burgdorferi
DVSSPKVDKQL

SEQ ID NO: 31301 - protein, 11 aa, Borrelia burgdorferi
VSSPKVDKQLQ

SEQ ID NO: 31302 - protein, 11 aa, Borrelia burgdorferi
SSPKVDKQLQI

SEQ ID NO: 31303 - protein, 11 aa, Borrelia burgdorferi
SPKVDKQLQIK

SEQ ID NO: 31304 - protein, 11 aa, Borrelia burgdorferi
PKVDKQLQIKE

SEQ ID NO: 31305 - protein, 11 aa, Borrelia burgdorferi
KVDKQLQIKES

SEQ ID NO: 31306 - protein, 11 aa, Borrelia burgdorferi
VDKQLQIKESL

SEQ ID NO: 31307 - protein, 11 aa, Borrelia burgdorferi
DKQLQIKESLE

SEQ ID NO: 31308 - protein, 11 aa, Borrelia burgdorferi
KQLQIKESLED

SEQ ID NO: 31309 - protein, 11 aa, Borrelia burgdorferi
QLQIKESLEDL

SEQ ID NO: 31310 - protein, 11 aa, Borrelia burgdorferi
LQIKESLEDLQ

SEQ ID NO: 31311 - protein, 11 aa, Borrelia burgdorferi
QIKESLEDLQE

SEQ ID NO: 31312 - protein, 11 aa, Borrelia burgdorferi
IKESLEDLQEQ

SEQ ID NO: 31313 - protein, 11 aa, Borrelia burgdorferi
KESLEDLQEQL

SEQ ID NO: 31314 - protein, 11 aa, Borrelia burgdorferi
ESLEDLQEQLK

SEQ ID NO: 31315 - protein, 11 aa, Borrelia burgdorferi
SLEDLQEQLKE

SEQ ID NO: 31316 - protein, 11 aa, Borrelia burgdorferi
LEDLQEQLKEA

SEQ ID NO: 31317 - protein, 11 aa, Borrelia burgdorferi
EDLQEQLKEAG

SEQ ID NO: 31318 - protein, 11 aa, Borrelia burgdorferi
DLQEQLKEAGD

SEQ ID NO: 31319 - protein, 11 aa, Borrelia burgdorferi
LQEQLKEAGDE

SEQ ID NO: 31320 - protein, 11 aa, Borrelia burgdorferi
QEQLKEAGDEN

SEQ ID NO: 31321 - protein, 11 aa, Borrelia burgdorferi
EQLKEAGDENQ

SEQ ID NO: 31322 - protein, 11 aa, Borrelia burgdorferi
QLKEAGDENQK

SEQ ID NO: 31323 - protein, 11 aa, Borrelia burgdorferi
LKEAGDENQKR

SEQ ID NO: 31324 - protein, 11 aa, Borrelia burgdorferi
KEAGDENQKRE

SEQ ID NO: 31325 - protein, 11 aa, Borrelia burgdorferi
EAGDENQKREI

SEQ ID NO: 31326 - protein, 11 aa, Borrelia burgdorferi
AGDENQKREIE

SEQ ID NO: 31327 - protein, 11 aa, Borrelia burgdorferi
GDENQKREIEK

SEQ ID NO: 31328 - protein, 11 aa, Borrelia burgdorferi
DENQKREIEKQ

SEQ ID NO: 31329 - protein, 11 aa, Borrelia burgdorferi
ENQKREIEKQI

SEQ ID NO: 31330 - protein, 11 aa, Borrelia burgdorferi
NQKREIEKQIE

SEQ ID NO: 31331 - protein, 11 aa, Borrelia burgdorferi
QKREIEKQIEI

SEQ ID NO: 31332 - protein, 11 aa, Borrelia burgdorferi
KREIEKQIEIK

SEQ ID NO: 31333 - protein, 11 aa, Borrelia burgdorferi
REIEKQIEIKK

SEQ ID NO: 31334 - protein, 11 aa, Borrelia burgdorferi
EIEKQIEIKKR

SEQ ID NO: 31335 - protein, 11 aa, Borrelia burgdorferi
IEKQIEIKKRD

SEQ ID NO: 31336 - protein, 11 aa, Borrelia burgdorferi
EKQIEIKKRDE

SEQ ID NO: 31337 - protein, 11 aa, Borrelia burgdorferi
KQIEIKKRDEE

SEQ ID NO: 31338 - protein, 11 aa, Borrelia burgdorferi
QIEIKKRDEEL

SEQ ID NO: 31339 - protein, 11 aa, Borrelia burgdorferi
IEIKKRDEELL

SEQ ID NO: 31340 - protein, 11 aa, Borrelia burgdorferi
EIKKRDEELLK

SEQ ID NO: 31341 - protein, 11 aa, Borrelia burgdorferi
IKKRDEELLKS

SEQ ID NO: 31342 - protein, 11 aa, Borrelia burgdorferi
KKRDEELLKSK

SEQ ID NO: 31343 - protein, 11 aa, Borrelia burgdorferi
KRDEELLKSKD

SEQ ID NO: 31344 - protein, 11 aa, Borrelia burgdorferi
RDEELLKSKDG

SEQ ID NO: 31345 - protein, 11 aa, Borrelia burgdorferi
DEELLKSKDGK

SEQ ID NO: 31346 - protein, 11 aa, Borrelia burgdorferi
EELLKSKDGKV

SEQ ID NO: 31347 - protein, 11 aa, Borrelia burgdorferi
ELLKSKDGKVS

SEQ ID NO: 31348 - protein, 11 aa, Borrelia burgdorferi
LLKSKDGKVSK

SEQ ID NO: 31349 - protein, 11 aa, Borrelia burgdorferi
LKSKDGKVSKD

SEQ ID NO: 31350 - protein, 11 aa, Borrelia burgdorferi
KSKDGKVSKDY

SEQ ID NO: 31351 - protein, 11 aa, Borrelia burgdorferi
SKDGKVSKDYE

SEQ ID NO: 31352 - protein, 11 aa, Borrelia burgdorferi
KDGKVSKDYEA

SEQ ID NO: 31353 - protein, 11 aa, Borrelia burgdorferi
DGKVSKDYEAL

SEQ ID NO: 31354 - protein, 11 aa, Borrelia burgdorferi
GKVSKDYEALD

SEQ ID NO: 31355 - protein, 11 aa, Borrelia burgdorferi
KVSKDYEALDL

SEQ ID NO: 31356 - protein, 11 aa, Borrelia burgdorferi
VSKDYEALDLD

SEQ ID NO: 31357 - protein, 11 aa, Borrelia burgdorferi
SKDYEALDLDR

SEQ ID NO: 31358 - protein, 11 aa, Borrelia burgdorferi
KDYEALDLDRE

SEQ ID NO: 31359 - protein, 11 aa, Borrelia burgdorferi
DYEALDLDREL

SEQ ID NO: 31360 - protein, 11 aa, Borrelia burgdorferi
YEALDLDRELS

SEQ ID NO: 31361 - protein, 11 aa, Borrelia burgdorferi
EALDLDRELSK

SEQ ID NO: 31362 - protein, 11 aa, Borrelia burgdorferi
ALDLDRELSKA

SEQ ID NO: 31363 - protein, 11 aa, Borrelia burgdorferi
LDLDRELSKAS

SEQ ID NO: 31364 - protein, 11 aa, Borrelia burgdorferi
DLDRELSKASS

SEQ ID NO: 31365 - protein, 11 aa, Borrelia burgdorferi
LDRELSKASSK

SEQ ID NO: 31366 - protein, 11 aa, Borrelia burgdorferi
DRELSKASSKE

SEQ ID NO: 31367 - protein, 11 aa, Borrelia burgdorferi
RELSKASSKEK

SEQ ID NO: 31368 - protein, 11 aa, Borrelia burgdorferi
ELSKASSKEKS

SEQ ID NO: 31369 - protein, 11 aa, Borrelia burgdorferi
LSKASSKEKSK

SEQ ID NO: 31370 - protein, 11 aa, Borrelia burgdorferi
SKASSKEKSKV

SEQ ID NO: 31371 - protein, 11 aa, Borrelia burgdorferi
KASSKEKSKVK

SEQ ID NO: 31372 - protein, 11 aa, Borrelia burgdorferi
ASSKEKSKVKE

SEQ ID NO: 31373 - protein, 11 aa, Borrelia burgdorferi
SSKEKSKVKEE

SEQ ID NO: 31374 - protein, 11 aa, Borrelia burgdorferi
SKEKSKVKEEE

SEQ ID NO: 31375 - protein, 11 aa, Borrelia burgdorferi
KEKSKVKEEEI

SEQ ID NO: 31376 - protein, 11 aa, Borrelia burgdorferi
EKSKVKEEEIT

SEQ ID NO: 31377 - protein, 11 aa, Borrelia burgdorferi
KSKVKEEEITK

SEQ ID NO: 31378 - protein, 11 aa, Borrelia burgdorferi
SKVKEEEITKG

SEQ ID NO: 31379 - protein, 11 aa, Borrelia burgdorferi
KVKEEEITKGK

SEQ ID NO: 31380 - protein, 11 aa, Borrelia burgdorferi
VKEEEITKGKS

SEQ ID NO: 31381 - protein, 11 aa, Borrelia burgdorferi
KEEEITKGKSR

SEQ ID NO: 31382 - protein, 11 aa, Borrelia burgdorferi
EEEITKGKSRA

SEQ ID NO: 31383 - protein, 11 aa, Borrelia burgdorferi
EEITKGKSRAS

SEQ ID NO: 31384 - protein, 11 aa, Borrelia burgdorferi
EITKGKSRASL

SEQ ID NO: 31385 - protein, 11 aa, Borrelia burgdorferi
ITKGKSRASLG

SEQ ID NO: 31386 - protein, 11 aa, Borrelia burgdorferi
TKGKSRASLGD

SEQ ID NO: 31387 - protein, 11 aa, Borrelia burgdorferi
KGKSRASLGDL

SEQ ID NO: 31388 - protein, 11 aa, Borrelia burgdorferi
GKSRASLGDLN

SEQ ID NO: 31389 - protein, 11 aa, Borrelia burgdorferi
KSRASLGDLNN

SEQ ID NO: 31390 - protein, 11 aa, Borrelia burgdorferi
SRASLGDLNND

SEQ ID NO: 31391 - protein, 11 aa, Borrelia burgdorferi
RASLGDLNNDK

SEQ ID NO: 31392 - protein, 11 aa, Borrelia burgdorferi
ASLGDLNNDKN

SEQ ID NO: 31393 - protein, 11 aa, Borrelia burgdorferi
SLGDLNNDKNL

SEQ ID NO: 31394 - protein, 11 aa, Borrelia burgdorferi
LGDLNNDKNLM

SEQ ID NO: 31395 - protein, 11 aa, Borrelia burgdorferi
GDLNNDKNLML

SEQ ID NO: 31396 - protein, 11 aa, Borrelia burgdorferi
DLNNDKNLMLP

SEQ ID NO: 31397 - protein, 11 aa, Borrelia burgdorferi
LNNDKNLMLPE

SEQ ID NO: 31398 - protein, 11 aa, Borrelia burgdorferi
NNDKNLMLPED

SEQ ID NO: 31399 - protein, 11 aa, Borrelia burgdorferi
NDKNLMLPEDQ

SEQ ID NO: 31400 - protein, 11 aa, Borrelia burgdorferi
DKNLMLPEDQK

SEQ ID NO: 31401 - protein, 11 aa, Borrelia burgdorferi
KNLMLPEDQKL

SEQ ID NO: 31402 - protein, 11 aa, Borrelia burgdorferi
NLMLPEDQKLP

SEQ ID NO: 31403 - protein, 11 aa, Borrelia burgdorferi
LMLPEDQKLPE

SEQ ID NO: 31404 - protein, 11 aa, Borrelia burgdorferi
MLPEDQKLPED

SEQ ID NO: 31405 - protein, 11 aa, Borrelia burgdorferi
LPEDQKLPEDK

SEQ ID NO: 31406 - protein, 11 aa, Borrelia burgdorferi
PEDQKLPEDKK

SEQ ID NO: 31407 - protein, 11 aa, Borrelia burgdorferi
EDQKLPEDKKL

SEQ ID NO: 31408 - protein, 11 aa, Borrelia burgdorferi
DQKLPEDKKLD

SEQ ID NO: 31409 - protein, 11 aa, Borrelia burgdorferi
QKLPEDKKLDS

SEQ ID NO: 31410 - protein, 11 aa, Borrelia burgdorferi
KLPEDKKLDSK

SEQ ID NO: 31411 - protein, 11 aa, Borrelia burgdorferi
LPEDKKLDSKL

SEQ ID NO: 31412 - protein, 11 aa, Borrelia burgdorferi
PEDKKLDSKLD

SEQ ID NO: 31413 - protein, 11 aa, Borrelia burgdorferi
EDKKLDSKLDG

SEQ ID NO: 31414 - protein, 11 aa, Borrelia burgdorferi
DKKLDSKLDGK

SEQ ID NO: 31415 - protein, 11 aa, Borrelia burgdorferi
KKLDSKLDGKK

SEQ ID NO: 31416 - protein, 11 aa, Borrelia burgdorferi
KLDSKLDGKKE

SEQ ID NO: 31417 - protein, 11 aa, Borrelia burgdorferi
LDSKLDGKKEF

SEQ ID NO: 31418 - protein, 11 aa, Borrelia burgdorferi
DSKLDGKKEFK

SEQ ID NO: 31419 - protein, 11 aa, Borrelia burgdorferi
SKLDGKKEFKP

SEQ ID NO: 31420 - protein, 11 aa, Borrelia burgdorferi
KLDGKKEFKPV

SEQ ID NO: 31421 - protein, 11 aa, Borrelia burgdorferi
LDGKKEFKPVS

SEQ ID NO: 31422 - protein, 11 aa, Borrelia burgdorferi
DGKKEFKPVSE

SEQ ID NO: 31423 - protein, 11 aa, Borrelia burgdorferi
GKKEFKPVSEV

SEQ ID NO: 31424 - protein, 11 aa, Borrelia burgdorferi
KKEFKPVSEVE

SEQ ID NO: 31425 - protein, 11 aa, Borrelia burgdorferi
KEFKPVSEVEK

SEQ ID NO: 31426 - protein, 11 aa, Borrelia burgdorferi
EFKPVSEVEKL

SEQ ID NO: 31427 - protein, 11 aa, Borrelia burgdorferi
FKPVSEVEKLD

SEQ ID NO: 31428 - protein, 11 aa, Borrelia burgdorferi
KPVSEVEKLDK

SEQ ID NO: 31429 - protein, 11 aa, Borrelia burgdorferi
PVSEVEKLDKI

SEQ ID NO: 31430 - protein, 11 aa, Borrelia burgdorferi
VSEVEKLDKIS

SEQ ID NO: 31431 - protein, 11 aa, Borrelia burgdorferi
SEVEKLDKISK

SEQ ID NO: 31432 - protein, 11 aa, Borrelia burgdorferi
EVEKLDKISKS

SEQ ID NO: 31433 - protein, 11 aa, Borrelia burgdorferi
VEKLDKISKSN

SEQ ID NO: 31434 - protein, 11 aa, Borrelia burgdorferi
EKLDKISKSNN

SEQ ID NO: 31435 - protein, 11 aa, Borrelia burgdorferi
KLDKISKSNNN

SEQ ID NO: 31436 - protein, 11 aa, Borrelia burgdorferi
LDKISKSNNNE

SEQ ID NO: 31437 - protein, 11 aa, Borrelia burgdorferi
DKISKSNNNEV

SEQ ID NO: 31438 - protein, 11 aa, Borrelia burgdorferi
KISKSNNNEVG

SEQ ID NO: 31439 - protein, 11 aa, Borrelia burgdorferi
ISKSNNNEVGK

SEQ ID NO: 31440 - protein, 11 aa, Borrelia burgdorferi
SKSNNNEVGKL

SEQ ID NO: 31441 - protein, 11 aa, Borrelia burgdorferi
KSNNNEVGKLS

SEQ ID NO: 31442 - protein, 11 aa, Borrelia burgdorferi
SNNNEVGKLSP

SEQ ID NO: 31443 - protein, 11 aa, Borrelia burgdorferi
NNNEVGKLSPL

SEQ ID NO: 31444 - protein, 11 aa, Borrelia burgdorferi
NNEVGKLSPLD

SEQ ID NO: 31445 - protein, 11 aa, Borrelia burgdorferi
NEVGKLSPLDK

SEQ ID NO: 31446 - protein, 11 aa, Borrelia burgdorferi
EVGKLSPLDKP

SEQ ID NO: 31447 - protein, 11 aa, Borrelia burgdorferi
VGKLSPLDKPS

SEQ ID NO: 31448 - protein, 11 aa, Borrelia burgdorferi
GKLSPLDKPSY

SEQ ID NO: 31449 - protein, 11 aa, Borrelia burgdorferi
KLSPLDKPSYD

SEQ ID NO: 31450 - protein, 11 aa, Borrelia burgdorferi
LSPLDKPSYDD

SEQ ID NO: 31451 - protein, 11 aa, Borrelia burgdorferi
SPLDKPSYDDI

SEQ ID NO: 31452 - protein, 11 aa, Borrelia burgdorferi
PLDKPSYDDID

SEQ ID NO: 31453 - protein, 11 aa, Borrelia burgdorferi
LDKPSYDDIDS

SEQ ID NO: 31454 - protein, 11 aa, Borrelia burgdorferi
DKPSYDDIDSK

SEQ ID NO: 31455 - protein, 11 aa, Borrelia burgdorferi
KPSYDDIDSKE

SEQ ID NO: 31456 - protein, 11 aa, Borrelia burgdorferi
PSYDDIDSKEE

SEQ ID NO: 31457 - protein, 11 aa, Borrelia burgdorferi
SYDDIDSKEEV

SEQ ID NO: 31458 - protein, 11 aa, Borrelia burgdorferi
YDDIDSKEEVD

SEQ ID NO: 31459 - protein, 11 aa, Borrelia burgdorferi
DDIDSKEEVDN

SEQ ID NO: 31460 - protein, 11 aa, Borrelia burgdorferi
DIDSKEEVDNK

SEQ ID NO: 31461 - protein, 11 aa, Borrelia burgdorferi
IDSKEEVDNKA

SEQ ID NO: 31462 - protein, 11 aa, Borrelia burgdorferi
DSKEEVDNKAI

SEQ ID NO: 31463 - protein, 11 aa, Borrelia burgdorferi
SKEEVDNKAIN

SEQ ID NO: 31464 - protein, 11 aa, Borrelia burgdorferi
KEEVDNKAINL

SEQ ID NO: 31465 - protein, 11 aa, Borrelia burgdorferi
EEVDNKAINLQ

SEQ ID NO: 31466 - protein, 11 aa, Borrelia burgdorferi
EVDNKAINLQK

SEQ ID NO: 31467 - protein, 11 aa, Borrelia burgdorferi
VDNKAINLQKI

SEQ ID NO: 31468 - protein, 11 aa, Borrelia burgdorferi
DNKAINLQKID

SEQ ID NO: 31469 - protein, 11 aa, Borrelia burgdorferi
NKAINLQKIDP

SEQ ID NO: 31470 - protein, 11 aa, Borrelia burgdorferi
KAINLQKIDPK

SEQ ID NO: 31471 - protein, 11 aa, Borrelia burgdorferi
AINLQKIDPKV

SEQ ID NO: 31472 - protein, 11 aa, Borrelia burgdorferi
INLQKIDPKVK

SEQ ID NO: 31473 - protein, 11 aa, Borrelia burgdorferi
NLQKIDPKVKD

SEQ ID NO: 31474 - protein, 11 aa, Borrelia burgdorferi
LQKIDPKVKDQ

SEQ ID NO: 31475 - protein, 11 aa, Borrelia burgdorferi
QKIDPKVKDQT

SEQ ID NO: 31476 - protein, 11 aa, Borrelia burgdorferi
KIDPKVKDQTT

SEQ ID NO: 31477 - protein, 11 aa, Borrelia burgdorferi
IDPKVKDQTTS

SEQ ID NO: 31478 - protein, 11 aa, Borrelia burgdorferi
DPKVKDQTTSL

SEQ ID NO: 31479 - protein, 11 aa, Borrelia burgdorferi
PKVKDQTTSLN

SEQ ID NO: 31480 - protein, 11 aa, Borrelia burgdorferi
KVKDQTTSLNE

SEQ ID NO: 31481 - protein, 11 aa, Borrelia burgdorferi
VKDQTTSLNED

SEQ ID NO: 31482 - protein, 11 aa, Borrelia burgdorferi
KDQTTSLNEDL

SEQ ID NO: 31483 - protein, 11 aa, Borrelia burgdorferi
DQTTSLNEDLD

SEQ ID NO: 31484 - protein, 11 aa, Borrelia burgdorferi
QTTSLNEDLDK

SEQ ID NO: 31485 - protein, 11 aa, Borrelia burgdorferi
TTSLNEDLDKD

SEQ ID NO: 31486 - protein, 11 aa, Borrelia burgdorferi
TSLNEDLDKDL

SEQ ID NO: 31487 - protein, 11 aa, Borrelia burgdorferi
SLNEDLDKDLT

SEQ ID NO: 31488 - protein, 11 aa, Borrelia burgdorferi
LNEDLDKDLTT

SEQ ID NO: 31489 - protein, 11 aa, Borrelia burgdorferi
NEDLDKDLTTM

SEQ ID NO: 31490 - protein, 11 aa, Borrelia burgdorferi
EDLDKDLTTMS

SEQ ID NO: 31491 - protein, 11 aa, Borrelia burgdorferi
DLDKDLTTMSI

SEQ ID NO: 31492 - protein, 11 aa, Borrelia burgdorferi
LDKDLTTMSID

SEQ ID NO: 31493 - protein, 11 aa, Borrelia burgdorferi
DKDLTTMSIDS

SEQ ID NO: 31494 - protein, 11 aa, Borrelia burgdorferi
KDLTTMSIDSS

SEQ ID NO: 31495 - protein, 11 aa, Borrelia burgdorferi
DLTTMSIDSSS

SEQ ID NO: 31496 - protein, 11 aa, Borrelia burgdorferi
LTTMSIDSSSP

SEQ ID NO: 31497 - protein, 11 aa, Borrelia burgdorferi
TTMSIDSSSPV

SEQ ID NO: 31498 - protein, 11 aa, Borrelia burgdorferi
TMSIDSSSPVF

SEQ ID NO: 31499 - protein, 11 aa, Borrelia burgdorferi
MSIDSSSPVFL

SEQ ID NO: 31500 - protein, 11 aa, Borrelia burgdorferi
SIDSSSPVFLE

SEQ ID NO: 31501 - protein, 11 aa, Borrelia burgdorferi
IDSSSPVFLEV

SEQ ID NO: 31502 - protein, 11 aa, Borrelia burgdorferi
DSSSPVFLEVI

SEQ ID NO: 31503 - protein, 11 aa, Borrelia burgdorferi
SSSPVFLEVID

SEQ ID NO: 31504 - protein, 11 aa, Borrelia burgdorferi
SSPVFLEVIDP

SEQ ID NO: 31505 - protein, 11 aa, Borrelia burgdorferi
SPVFLEVIDPI

SEQ ID NO: 31506 - protein, 11 aa, Borrelia burgdorferi
PVFLEVIDPIT

SEQ ID NO: 31507 - protein, 11 aa, Borrelia burgdorferi
VFLEVIDPITN

SEQ ID NO: 31508 - protein, 11 aa, Borrelia burgdorferi
FLEVIDPITNL

SEQ ID NO: 31509 - protein, 11 aa, Borrelia burgdorferi
LEVIDPITNLG

SEQ ID NO: 31510 - protein, 11 aa, Borrelia burgdorferi
EVIDPITNLGT

SEQ ID NO: 31511 - protein, 11 aa, Borrelia burgdorferi
VIDPITNLGTL

SEQ ID NO: 31512 - protein, 11 aa, Borrelia burgdorferi
IDPITNLGTLQ

SEQ ID NO: 31513 - protein, 11 aa, Borrelia burgdorferi
DPITNLGTLQL

SEQ ID NO: 31514 - protein, 11 aa, Borrelia burgdorferi
PITNLGTLQLI

SEQ ID NO: 31515 - protein, 11 aa, Borrelia burgdorferi
ITNLGTLQLID

SEQ ID NO: 31516 - protein, 11 aa, Borrelia burgdorferi
TNLGTLQLIDL

SEQ ID NO: 31517 - protein, 11 aa, Borrelia burgdorferi
NLGTLQLIDLN

SEQ ID NO: 31518 - protein, 11 aa, Borrelia burgdorferi
LGTLQLIDLNT

SEQ ID NO: 31519 - protein, 11 aa, Borrelia burgdorferi
GTLQLIDLNTG

SEQ ID NO: 31520 - protein, 11 aa, Borrelia burgdorferi
TLQLIDLNTGV

SEQ ID NO: 31521 - protein, 11 aa, Borrelia burgdorferi
LQLIDLNTGVR

SEQ ID NO: 31522 - protein, 11 aa, Borrelia burgdorferi
QLIDLNTGVRL

SEQ ID NO: 31523 - protein, 11 aa, Borrelia burgdorferi
LIDLNTGVRLK

SEQ ID NO: 31524 - protein, 11 aa, Borrelia burgdorferi
IDLNTGVRLKE

SEQ ID NO: 31525 - protein, 11 aa, Borrelia burgdorferi
DLNTGVRLKES

SEQ ID NO: 31526 - protein, 11 aa, Borrelia burgdorferi
LNTGVRLKEST

SEQ ID NO: 31527 - protein, 11 aa, Borrelia burgdorferi
NTGVRLKESTQ

SEQ ID NO: 31528 - protein, 11 aa, Borrelia burgdorferi
TGVRLKESTQQ

SEQ ID NO: 31529 - protein, 11 aa, Borrelia burgdorferi
GVRLKESTQQG

SEQ ID NO: 31530 - protein, 11 aa, Borrelia burgdorferi
VRLKESTQQGI

SEQ ID NO: 31531 - protein, 11 aa, Borrelia burgdorferi
RLKESTQQGIQ

SEQ ID NO: 31532 - protein, 11 aa, Borrelia burgdorferi
LKESTQQGIQR

SEQ ID NO: 31533 - protein, 11 aa, Borrelia burgdorferi
KESTQQGIQRY

SEQ ID NO: 31534 - protein, 11 aa, Borrelia burgdorferi
ESTQQGIQRYG

SEQ ID NO: 31535 - protein, 11 aa, Borrelia burgdorferi
STQQGIQRYGI

SEQ ID NO: 31536 - protein, 11 aa, Borrelia burgdorferi
TQQGIQRYGIY

SEQ ID NO: 31537 - protein, 11 aa, Borrelia burgdorferi
QQGIQRYGIYE

SEQ ID NO: 31538 - protein, 11 aa, Borrelia burgdorferi
QGIQRYGIYER

SEQ ID NO: 31539 - protein, 11 aa, Borrelia burgdorferi
GIQRYGIYERE

SEQ ID NO: 31540 - protein, 11 aa, Borrelia burgdorferi
IQRYGIYEREK

SEQ ID NO: 31541 - protein, 11 aa, Borrelia burgdorferi
QRYGIYEREKD

SEQ ID NO: 31542 - protein, 11 aa, Borrelia burgdorferi
RYGIYEREKDL

SEQ ID NO: 31543 - protein, 11 aa, Borrelia burgdorferi
YGIYEREKDLV

SEQ ID NO: 31544 - protein, 11 aa, Borrelia burgdorferi
GIYEREKDLVV

SEQ ID NO: 31545 - protein, 11 aa, Borrelia burgdorferi
IYEREKDLVVI

SEQ ID NO: 31546 - protein, 11 aa, Borrelia burgdorferi
YEREKDLVVIK

SEQ ID NO: 31547 - protein, 11 aa, Borrelia burgdorferi
EREKDLVVIKM

SEQ ID NO: 31548 - protein, 11 aa, Borrelia burgdorferi
REKDLVVIKMD

SEQ ID NO: 31549 - protein, 11 aa, Borrelia burgdorferi
EKDLVVIKMDS

SEQ ID NO: 31550 - protein, 11 aa, Borrelia burgdorferi
KDLVVIKMDSG

SEQ ID NO: 31551 - protein, 11 aa, Borrelia burgdorferi
DLVVIKMDSGK

SEQ ID NO: 31552 - protein, 11 aa, Borrelia burgdorferi
LVVIKMDSGKA

SEQ ID NO: 31553 - protein, 11 aa, Borrelia burgdorferi
VVIKMDSGKAK

SEQ ID NO: 31554 - protein, 11 aa, Borrelia burgdorferi
VIKMDSGKAKL

SEQ ID NO: 31555 - protein, 11 aa, Borrelia burgdorferi
IKMDSGKAKLQ

SEQ ID NO: 31556 - protein, 11 aa, Borrelia burgdorferi
KMDSGKAKLQI

SEQ ID NO: 31557 - protein, 11 aa, Borrelia burgdorferi
MDSGKAKLQIL

SEQ ID NO: 31558 - protein, 11 aa, Borrelia burgdorferi
DSGKAKLQILN

SEQ ID NO: 31559 - protein, 11 aa, Borrelia burgdorferi
SGKAKLQILNK

SEQ ID NO: 31560 - protein, 11 aa, Borrelia burgdorferi
GKAKLQILNKL

SEQ ID NO: 31561 - protein, 11 aa, Borrelia burgdorferi
KAKLQILNKLE

SEQ ID NO: 31562 - protein, 11 aa, Borrelia burgdorferi
AKLQILNKLEN

SEQ ID NO: 31563 - protein, 11 aa, Borrelia burgdorferi
KLQILNKLENL

SEQ ID NO: 31564 - protein, 11 aa, Borrelia burgdorferi
LQILNKLENLK

SEQ ID NO: 31565 - protein, 11 aa, Borrelia burgdorferi
QILNKLENLKV

SEQ ID NO: 31566 - protein, 11 aa, Borrelia burgdorferi
ILNKLENLKVV

SEQ ID NO: 31567 - protein, 11 aa, Borrelia burgdorferi
LNKLENLKVVS

SEQ ID NO: 31568 - protein, 11 aa, Borrelia burgdorferi
NKLENLKVVSE

SEQ ID NO: 31569 - protein, 11 aa, Borrelia burgdorferi
KLENLKVVSES

SEQ ID NO: 31570 - protein, 11 aa, Borrelia burgdorferi
LENLKVVSESN

SEQ ID NO: 31571 - protein, 11 aa, Borrelia burgdorferi
ENLKVVSESNF

SEQ ID NO: 31572 - protein, 11 aa, Borrelia burgdorferi
NLKVVSESNFE

SEQ ID NO: 31573 - protein, 11 aa, Borrelia burgdorferi
LKVVSESNFEI

SEQ ID NO: 31574 - protein, 11 aa, Borrelia burgdorferi
KVVSESNFEIN

SEQ ID NO: 31575 - protein, 11 aa, Borrelia burgdorferi
VVSESNFEINK

SEQ ID NO: 31576 - protein, 11 aa, Borrelia burgdorferi
VSESNFEINKN

SEQ ID NO: 31577 - protein, 11 aa, Borrelia burgdorferi
SESNFEINKNS

SEQ ID NO: 31578 - protein, 11 aa, Borrelia burgdorferi
ESNFEINKNSS

SEQ ID NO: 31579 - protein, 11 aa, Borrelia burgdorferi
SNFEINKNSSL

SEQ ID NO: 31580 - protein, 11 aa, Borrelia burgdorferi
NFEINKNSSLY

SEQ ID NO: 31581 - protein, 11 aa, Borrelia burgdorferi
FEINKNSSLYV

SEQ ID NO: 31582 - protein, 11 aa, Borrelia burgdorferi
EINKNSSLYVD

SEQ ID NO: 31583 - protein, 11 aa, Borrelia burgdorferi
INKNSSLYVDS

SEQ ID NO: 31584 - protein, 11 aa, Borrelia burgdorferi
NKNSSLYVDSK

SEQ ID NO: 31585 - protein, 11 aa, Borrelia burgdorferi
KNSSLYVDSKM

SEQ ID NO: 31586 - protein, 11 aa, Borrelia burgdorferi
NSSLYVDSKMI

SEQ ID NO: 31587 - protein, 11 aa, Borrelia burgdorferi
SSLYVDSKMIL

SEQ ID NO: 31588 - protein, 11 aa, Borrelia burgdorferi
SLYVDSKMILA

SEQ ID NO: 31589 - protein, 11 aa, Borrelia burgdorferi
LYVDSKMILAA

SEQ ID NO: 31590 - protein, 11 aa, Borrelia burgdorferi
YVDSKMILAAV

SEQ ID NO: 31591 - protein, 11 aa, Borrelia burgdorferi
VDSKMILAAVR

SEQ ID NO: 31592 - protein, 11 aa, Borrelia burgdorferi
DSKMILAAVRD

SEQ ID NO: 31593 - protein, 11 aa, Borrelia burgdorferi
SKMILAAVRDK

SEQ ID NO: 31594 - protein, 11 aa, Borrelia burgdorferi
KMILAAVRDKD

SEQ ID NO: 31595 - protein, 11 aa, Borrelia burgdorferi
MILAAVRDKDD

SEQ ID NO: 31596 - protein, 11 aa, Borrelia burgdorferi
ILAAVRDKDDS

SEQ ID NO: 31597 - protein, 11 aa, Borrelia burgdorferi
LAAVRDKDDSN

SEQ ID NO: 31598 - protein, 11 aa, Borrelia burgdorferi
AAVRDKDDSNA

SEQ ID NO: 31599 - protein, 11 aa, Borrelia burgdorferi
AVRDKDDSNAW

SEQ ID NO: 31600 - protein, 11 aa, Borrelia burgdorferi
VRDKDDSNAWR

SEQ ID NO: 31601 - protein, 11 aa, Borrelia burgdorferi
RDKDDSNAWRL

SEQ ID NO: 31602 - protein, 11 aa, Borrelia burgdorferi
DKDDSNAWRLA

SEQ ID NO: 31603 - protein, 11 aa, Borrelia burgdorferi
KDDSNAWRLAK

SEQ ID NO: 31604 - protein, 11 aa, Borrelia burgdorferi
DDSNAWRLAKF

SEQ ID NO: 31605 - protein, 11 aa, Borrelia burgdorferi
DSNAWRLAKFS

SEQ ID NO: 31606 - protein, 11 aa, Borrelia burgdorferi
SNAWRLAKFSP

SEQ ID NO: 31607 - protein, 11 aa, Borrelia burgdorferi
NAWRLAKFSPK

SEQ ID NO: 31608 - protein, 11 aa, Borrelia burgdorferi
AWRLAKFSPKN

SEQ ID NO: 31609 - protein, 11 aa, Borrelia burgdorferi
WRLAKFSPKNL

SEQ ID NO: 31610 - protein, 11 aa, Borrelia burgdorferi
RLAKFSPKNLD

SEQ ID NO: 31611 - protein, 11 aa, Borrelia burgdorferi
LAKFSPKNLDE

SEQ ID NO: 31612 - protein, 11 aa, Borrelia burgdorferi
AKFSPKNLDEF

SEQ ID NO: 31613 - protein, 11 aa, Borrelia burgdorferi
KFSPKNLDEFI

SEQ ID NO: 31614 - protein, 11 aa, Borrelia burgdorferi
FSPKNLDEFIL

SEQ ID NO: 31615 - protein, 11 aa, Borrelia burgdorferi
SPKNLDEFILS

SEQ ID NO: 31616 - protein, 11 aa, Borrelia burgdorferi
PKNLDEFILSE

SEQ ID NO: 31617 - protein, 11 aa, Borrelia burgdorferi
KNLDEFILSEN

SEQ ID NO: 31618 - protein, 11 aa, Borrelia burgdorferi
NLDEFILSENK

SEQ ID NO: 31619 - protein, 11 aa, Borrelia burgdorferi
LDEFILSENKI

SEQ ID NO: 31620 - protein, 11 aa, Borrelia burgdorferi
DEFILSENKIL

SEQ ID NO: 31621 - protein, 11 aa, Borrelia burgdorferi
EFILSENKILP

SEQ ID NO: 31622 - protein, 11 aa, Borrelia burgdorferi
FILSENKILPF

SEQ ID NO: 31623 - protein, 11 aa, Borrelia burgdorferi
ILSENKILPFT

SEQ ID NO: 31624 - protein, 11 aa, Borrelia burgdorferi
LSENKILPFTS

SEQ ID NO: 31625 - protein, 11 aa, Borrelia burgdorferi
SENKILPFTSF

SEQ ID NO: 31626 - protein, 11 aa, Borrelia burgdorferi
ENKILPFTSFS

SEQ ID NO: 31627 - protein, 11 aa, Borrelia burgdorferi
NKILPFTSFSV

SEQ ID NO: 31628 - protein, 11 aa, Borrelia burgdorferi
KILPFTSFSVR

SEQ ID NO: 31629 - protein, 11 aa, Borrelia burgdorferi
ILPFTSFSVRK

SEQ ID NO: 31630 - protein, 11 aa, Borrelia burgdorferi
LPFTSFSVRKN

SEQ ID NO: 31631 - protein, 11 aa, Borrelia burgdorferi
PFTSFSVRKNF

SEQ ID NO: 31632 - protein, 11 aa, Borrelia burgdorferi
FTSFSVRKNFI

SEQ ID NO: 31633 - protein, 11 aa, Borrelia burgdorferi
TSFSVRKNFIY

SEQ ID NO: 31634 - protein, 11 aa, Borrelia burgdorferi
SFSVRKNFIYL

SEQ ID NO: 31635 - protein, 11 aa, Borrelia burgdorferi
FSVRKNFIYLQ

SEQ ID NO: 31636 - protein, 11 aa, Borrelia burgdorferi
SVRKNFIYLQD

SEQ ID NO: 31637 - protein, 11 aa, Borrelia burgdorferi
VRKNFIYLQDE

SEQ ID NO: 31638 - protein, 11 aa, Borrelia burgdorferi
RKNFIYLQDEL

SEQ ID NO: 31639 - protein, 11 aa, Borrelia burgdorferi
KNFIYLQDELK

SEQ ID NO: 31640 - protein, 11 aa, Borrelia burgdorferi
NFIYLQDELKN

SEQ ID NO: 31641 - protein, 11 aa, Borrelia burgdorferi
FIYLQDELKNL

SEQ ID NO: 31642 - protein, 11 aa, Borrelia burgdorferi
IYLQDELKNLV

SEQ ID NO: 31643 - protein, 11 aa, Borrelia burgdorferi
YLQDELKNLVI

SEQ ID NO: 31644 - protein, 11 aa, Borrelia burgdorferi
LQDELKNLVIL

SEQ ID NO: 31645 - protein, 11 aa, Borrelia burgdorferi
QDELKNLVILD

SEQ ID NO: 31646 - protein, 11 aa, Borrelia burgdorferi
DELKNLVILDV

SEQ ID NO: 31647 - protein, 11 aa, Borrelia burgdorferi
ELKNLVILDVN

SEQ ID NO: 31648 - protein, 11 aa, Borrelia burgdorferi
LKNLVILDVNT

SEQ ID NO: 31649 - protein, 11 aa, Borrelia burgdorferi
KNLVILDVNTL

SEQ ID NO: 31650 - protein, 11 aa, Borrelia burgdorferi
NLVILDVNTLK

SEQ ID NO: 31651 - protein, 11 aa, Borrelia burgdorferi
LVILDVNTLKK

SEQ ID NO: 31652 - protein, 11 aa, Borrelia burgdorferi
VILDVNTLKKV

SEQ ID NO: 31653 - protein, 11 aa, Borrelia burgdorferi
ILDVNTLKKVK

SEQ ID NO: 31654 - protein, 8 aa, Borrelia burgdorferi B31
MKYILSID

SEQ ID NO: 31655 - protein, 8 aa, Borrelia burgdorferi B31
KYILSIDQ

SEQ ID NO: 31656 - protein, 8 aa, Borrelia burgdorferi B31
YILSIDQG

SEQ ID NO: 31657 - protein, 8 aa, Borrelia burgdorferi B31
ILSIDQGT

SEQ ID NO: 31658 - protein, 8 aa, Borrelia burgdorferi B31
LSIDQGTT

SEQ ID NO: 31659 - protein, 8 aa, Borrelia burgdorferi B31
SIDQGTTS

SEQ ID NO: 31660 - protein, 8 aa, Borrelia burgdorferi B31
IDQGTTSS

SEQ ID NO: 31661 - protein, 8 aa, Borrelia burgdorferi B31
DQGTTSSR

SEQ ID NO: 31662 - protein, 8 aa, Borrelia burgdorferi B31
QGTTSSRA

SEQ ID NO: 31663 - protein, 8 aa, Borrelia burgdorferi B31
GTTSSRAM

SEQ ID NO: 31664 - protein, 8 aa, Borrelia burgdorferi B31
TTSSRAMV

SEQ ID NO: 31665 - protein, 8 aa, Borrelia burgdorferi B31
TSSRAMVF

SEQ ID NO: 31666 - protein, 8 aa, Borrelia burgdorferi B31
SSRAMVFD

SEQ ID NO: 31667 - protein, 8 aa, Borrelia burgdorferi B31
SRAMVFDK

SEQ ID NO: 31668 - protein, 8 aa, Borrelia burgdorferi B31
RAMVFDKN

SEQ ID NO: 31669 - protein, 8 aa, Borrelia burgdorferi B31
AMVFDKNA

SEQ ID NO: 31670 - protein, 8 aa, Borrelia burgdorferi B31
MVFDKNAN

SEQ ID NO: 31671 - protein, 8 aa, Borrelia burgdorferi B31
VFDKNANI

SEQ ID NO: 31672 - protein, 8 aa, Borrelia burgdorferi B31
FDKNANIK

SEQ ID NO: 31673 - protein, 8 aa, Borrelia burgdorferi B31
DKNANIKG

SEQ ID NO: 31674 - protein, 8 aa, Borrelia burgdorferi B31
KNANIKGF

SEQ ID NO: 31675 - protein, 8 aa, Borrelia burgdorferi B31
NANIKGFA

SEQ ID NO: 31676 - protein, 8 aa, Borrelia burgdorferi B31
ANIKGFAQ

SEQ ID NO: 31677 - protein, 8 aa, Borrelia burgdorferi B31
NIKGFAQK

SEQ ID NO: 31678 - protein, 8 aa, Borrelia burgdorferi B31
IKGFAQKE

SEQ ID NO: 31679 - protein, 8 aa, Borrelia burgdorferi B31
KGFAQKEF

SEQ ID NO: 31680 - protein, 8 aa, Borrelia burgdorferi B31
GFAQKEFT

SEQ ID NO: 31681 - protein, 8 aa, Borrelia burgdorferi B31
FAQKEFTQ

SEQ ID NO: 31682 - protein, 8 aa, Borrelia burgdorferi B31
AQKEFTQI

SEQ ID NO: 31683 - protein, 8 aa, Borrelia burgdorferi B31
QKEFTQIY

SEQ ID NO: 31684 - protein, 8 aa, Borrelia burgdorferi B31
KEFTQIYP

SEQ ID NO: 31685 - protein, 8 aa, Borrelia burgdorferi B31
EFTQIYPQ

SEQ ID NO: 31686 - protein, 8 aa, Borrelia burgdorferi B31
FTQIYPQP

SEQ ID NO: 31687 - protein, 8 aa, Borrelia burgdorferi B31
TQIYPQPS

SEQ ID NO: 31688 - protein, 8 aa, Borrelia burgdorferi B31
QIYPQPSW

SEQ ID NO: 31689 - protein, 8 aa, Borrelia burgdorferi B31
IYPQPSWV

SEQ ID NO: 31690 - protein, 8 aa, Borrelia burgdorferi B31
YPQPSWVE

SEQ ID NO: 31691 - protein, 8 aa, Borrelia burgdorferi B31
PQPSWVEH

SEQ ID NO: 31692 - protein, 8 aa, Borrelia burgdorferi B31
QPSWVEHD

SEQ ID NO: 31693 - protein, 8 aa, Borrelia burgdorferi B31
PSWVEHDP

SEQ ID NO: 31694 - protein, 8 aa, Borrelia burgdorferi B31
SWVEHDPT

SEQ ID NO: 31695 - protein, 8 aa, Borrelia burgdorferi B31
WVEHDPTE

SEQ ID NO: 31696 - protein, 8 aa, Borrelia burgdorferi B31
VEHDPTEI

SEQ ID NO: 31697 - protein, 8 aa, Borrelia burgdorferi B31
EHDPTEIW

SEQ ID NO: 31698 - protein, 8 aa, Borrelia burgdorferi B31
HDPTEIWG

SEQ ID NO: 31699 - protein, 8 aa, Borrelia burgdorferi B31
DPTEIWGS

SEQ ID NO: 31700 - protein, 8 aa, Borrelia burgdorferi B31
PTEIWGSQ

SEQ ID NO: 31701 - protein, 8 aa, Borrelia burgdorferi B31
TEIWGSQL

SEQ ID NO: 31702 - protein, 8 aa, Borrelia burgdorferi B31
EIWGSQLG

SEQ ID NO: 31703 - protein, 8 aa, Borrelia burgdorferi B31
IWGSQLGV

SEQ ID NO: 31704 - protein, 8 aa, Borrelia burgdorferi B31
WGSQLGVI

SEQ ID NO: 31705 - protein, 8 aa, Borrelia burgdorferi B31
GSQLGVIT

SEQ ID NO: 31706 - protein, 8 aa, Borrelia burgdorferi B31
SQLGVITE

SEQ ID NO: 31707 - protein, 8 aa, Borrelia burgdorferi B31
QLGVITEA

SEQ ID NO: 31708 - protein, 8 aa, Borrelia burgdorferi B31
LGVITEAM

SEQ ID NO: 31709 - protein, 8 aa, Borrelia burgdorferi B31
GVITEAMA

SEQ ID NO: 31710 - protein, 8 aa, Borrelia burgdorferi B31
VITEAMAN

SEQ ID NO: 31711 - protein, 8 aa, Borrelia burgdorferi B31
ITEAMANA

SEQ ID NO: 31712 - protein, 8 aa, Borrelia burgdorferi B31
TEAMANAR

SEQ ID NO: 31713 - protein, 8 aa, Borrelia burgdorferi B31
EAMANARI

SEQ ID NO: 31714 - protein, 8 aa, Borrelia burgdorferi B31
AMANARIL

SEQ ID NO: 31715 - protein, 8 aa, Borrelia burgdorferi B31
MANARILP

SEQ ID NO: 31716 - protein, 8 aa, Borrelia burgdorferi B31
ANARILPN

SEQ ID NO: 31717 - protein, 8 aa, Borrelia burgdorferi B31
NARILPNE

SEQ ID NO: 31718 - protein, 8 aa, Borrelia burgdorferi B31
ARILPNEI

SEQ ID NO: 31719 - protein, 8 aa, Borrelia burgdorferi B31
RILPNEID

SEQ ID NO: 31720 - protein, 8 aa, Borrelia burgdorferi B31
ILPNEIDA

SEQ ID NO: 31721 - protein, 8 aa, Borrelia burgdorferi B31
LPNEIDAI

SEQ ID NO: 31722 - protein, 8 aa, Borrelia burgdorferi B31
PNEIDAIG

SEQ ID NO: 31723 - protein, 8 aa, Borrelia burgdorferi B31
NEIDAIGI

SEQ ID NO: 31724 - protein, 8 aa, Borrelia burgdorferi B31
EIDAIGIT

SEQ ID NO: 31725 - protein, 8 aa, Borrelia burgdorferi B31
IDAIGITN

SEQ ID NO: 31726 - protein, 8 aa, Borrelia burgdorferi B31
DAIGITNQ

SEQ ID NO: 31727 - protein, 8 aa, Borrelia burgdorferi B31
AIGITNQR

SEQ ID NO: 31728 - protein, 8 aa, Borrelia burgdorferi B31
IGITNQRE

SEQ ID NO: 31729 - protein, 8 aa, Borrelia burgdorferi B31
GITNQRET

SEQ ID NO: 31730 - protein, 8 aa, Borrelia burgdorferi B31
ITNQRETT

SEQ ID NO: 31731 - protein, 8 aa, Borrelia burgdorferi B31
TNQRETTV

SEQ ID NO: 31732 - protein, 8 aa, Borrelia burgdorferi B31
NQRETTVI

SEQ ID NO: 31733 - protein, 8 aa, Borrelia burgdorferi B31
QRETTVIW

SEQ ID NO: 31734 - protein, 8 aa, Borrelia burgdorferi B31
RETTVIWE

SEQ ID NO: 31735 - protein, 8 aa, Borrelia burgdorferi B31
ETTVIWEK

SEQ ID NO: 31736 - protein, 8 aa, Borrelia burgdorferi B31
TTVIWEKN

SEQ ID NO: 31737 - protein, 8 aa, Borrelia burgdorferi B31
TVIWEKNT

SEQ ID NO: 31738 - protein, 8 aa, Borrelia burgdorferi B31
VIWEKNTG

SEQ ID NO: 31739 - protein, 8 aa, Borrelia burgdorferi B31
IWEKNTGK

SEQ ID NO: 31740 - protein, 8 aa, Borrelia burgdorferi B31
WEKNTGKP

SEQ ID NO: 31741 - protein, 8 aa, Borrelia burgdorferi B31
EKNTGKPI

SEQ ID NO: 31742 - protein, 8 aa, Borrelia burgdorferi B31
KNTGKPIY

SEQ ID NO: 31743 - protein, 8 aa, Borrelia burgdorferi B31
NTGKPIYN

SEQ ID NO: 31744 - protein, 8 aa, Borrelia burgdorferi B31
TGKPIYNA

SEQ ID NO: 31745 - protein, 8 aa, Borrelia burgdorferi B31
GKPIYNAI

SEQ ID NO: 31746 - protein, 8 aa, Borrelia burgdorferi B31
KPIYNAIV

SEQ ID NO: 31747 - protein, 8 aa, Borrelia burgdorferi B31
PIYNAIVW

SEQ ID NO: 31748 - protein, 8 aa, Borrelia burgdorferi B31
IYNAIVWQ

SEQ ID NO: 31749 - protein, 8 aa, Borrelia burgdorferi B31
YNAIVWQD

SEQ ID NO: 31750 - protein, 8 aa, Borrelia burgdorferi B31
NAIVWQDR

SEQ ID NO: 31751 - protein, 8 aa, Borrelia burgdorferi B31
AIVWQDRR

SEQ ID NO: 31752 - protein, 8 aa, Borrelia burgdorferi B31
IVWQDRRT

SEQ ID NO: 31753 - protein, 8 aa, Borrelia burgdorferi B31
VWQDRRTA

SEQ ID NO: 31754 - protein, 8 aa, Borrelia burgdorferi B31
WQDRRTAK

SEQ ID NO: 31755 - protein, 8 aa, Borrelia burgdorferi B31
QDRRTAKI

SEQ ID NO: 31756 - protein, 8 aa, Borrelia burgdorferi B31
DRRTAKIC

SEQ ID NO: 31757 - protein, 8 aa, Borrelia burgdorferi B31
RRTAKICD

SEQ ID NO: 31758 - protein, 8 aa, Borrelia burgdorferi B31
RTAKICDQ

SEQ ID NO: 31759 - protein, 8 aa, Borrelia burgdorferi B31
TAKICDQL

SEQ ID NO: 31760 - protein, 8 aa, Borrelia burgdorferi B31
AKICDQLK

SEQ ID NO: 31761 - protein, 8 aa, Borrelia burgdorferi B31
KICDQLKK

SEQ ID NO: 31762 - protein, 8 aa, Borrelia burgdorferi B31
ICDQLKKE

SEQ ID NO: 31763 - protein, 8 aa, Borrelia burgdorferi B31
CDQLKKEG

SEQ ID NO: 31764 - protein, 8 aa, Borrelia burgdorferi B31
DQLKKEGK

SEQ ID NO: 31765 - protein, 8 aa, Borrelia burgdorferi B31
QLKKEGKD

SEQ ID NO: 31766 - protein, 8 aa, Borrelia burgdorferi B31
LKKEGKDK

SEQ ID NO: 31767 - protein, 8 aa, Borrelia burgdorferi B31
KKEGKDKI

SEQ ID NO: 31768 - protein, 8 aa, Borrelia burgdorferi B31
KEGKDKII

SEQ ID NO: 31769 - protein, 8 aa, Borrelia burgdorferi B31
EGKDKIIL

SEQ ID NO: 31770 - protein, 8 aa, Borrelia burgdorferi B31
GKDKIILE

SEQ ID NO: 31771 - protein, 8 aa, Borrelia burgdorferi B31
KDKIILEK

SEQ ID NO: 31772 - protein, 8 aa, Borrelia burgdorferi B31
DKIILEKT

SEQ ID NO: 31773 - protein, 8 aa, Borrelia burgdorferi B31
KIILEKTG

SEQ ID NO: 31774 - protein, 8 aa, Borrelia burgdorferi B31
IILEKTGL

SEQ ID NO: 31775 - protein, 8 aa, Borrelia burgdorferi B31
ILEKTGLV

SEQ ID NO: 31776 - protein, 8 aa, Borrelia burgdorferi B31
LEKTGLVL

SEQ ID NO: 31777 - protein, 8 aa, Borrelia burgdorferi B31
EKTGLVLD

SEQ ID NO: 31778 - protein, 8 aa, Borrelia burgdorferi B31
KTGLVLDS

SEQ ID NO: 31779 - protein, 8 aa, Borrelia burgdorferi B31
TGLVLDSY

SEQ ID NO: 31780 - protein, 8 aa, Borrelia burgdorferi B31
GLVLDSYF

SEQ ID NO: 31781 - protein, 8 aa, Borrelia burgdorferi B31
LVLDSYFS

SEQ ID NO: 31782 - protein, 8 aa, Borrelia burgdorferi B31
VLDSYFSG

SEQ ID NO: 31783 - protein, 8 aa, Borrelia burgdorferi B31
LDSYFSGT

SEQ ID NO: 31784 - protein, 8 aa, Borrelia burgdorferi B31
DSYFSGTK

SEQ ID NO: 31785 - protein, 8 aa, Borrelia burgdorferi B31
SYFSGTKI

SEQ ID NO: 31786 - protein, 8 aa, Borrelia burgdorferi B31
YFSGTKIM

SEQ ID NO: 31787 - protein, 8 aa, Borrelia burgdorferi B31
FSGTKIMW

SEQ ID NO: 31788 - protein, 8 aa, Borrelia burgdorferi B31
SGTKIMWI

SEQ ID NO: 31789 - protein, 8 aa, Borrelia burgdorferi B31
GTKIMWIL

SEQ ID NO: 31790 - protein, 8 aa, Borrelia burgdorferi B31
TKIMWILD

SEQ ID NO: 31791 - protein, 8 aa, Borrelia burgdorferi B31
KIMWILDN

SEQ ID NO: 31792 - protein, 8 aa, Borrelia burgdorferi B31
IMWILDNV

SEQ ID NO: 31793 - protein, 8 aa, Borrelia burgdorferi B31
MWILDNVE

SEQ ID NO: 31794 - protein, 8 aa, Borrelia burgdorferi B31
WILDNVEG

SEQ ID NO: 31795 - protein, 8 aa, Borrelia burgdorferi B31
ILDNVEGA

SEQ ID NO: 31796 - protein, 8 aa, Borrelia burgdorferi B31
LDNVEGAR

SEQ ID NO: 31797 - protein, 8 aa, Borrelia burgdorferi B31
DNVEGARQ

SEQ ID NO: 31798 - protein, 8 aa, Borrelia burgdorferi B31
NVEGARQR

SEQ ID NO: 31799 - protein, 8 aa, Borrelia burgdorferi B31
VEGARQRA

SEQ ID NO: 31800 - protein, 8 aa, Borrelia burgdorferi B31
EGARQRAE

SEQ ID NO: 31801 - protein, 8 aa, Borrelia burgdorferi B31
GARQRAEN

SEQ ID NO: 31802 - protein, 8 aa, Borrelia burgdorferi B31
ARQRAENG

SEQ ID NO: 31803 - protein, 8 aa, Borrelia burgdorferi B31
RQRAENGE

SEQ ID NO: 31804 - protein, 8 aa, Borrelia burgdorferi B31
QRAENGEL

SEQ ID NO: 31805 - protein, 8 aa, Borrelia burgdorferi B31
RAENGELC

SEQ ID NO: 31806 - protein, 8 aa, Borrelia burgdorferi B31
AENGELCF

SEQ ID NO: 31807 - protein, 8 aa, Borrelia burgdorferi B31
ENGELCFG

SEQ ID NO: 31808 - protein, 8 aa, Borrelia burgdorferi B31
NGELCFGT

SEQ ID NO: 31809 - protein, 8 aa, Borrelia burgdorferi B31
GELCFGTI

SEQ ID NO: 31810 - protein, 8 aa, Borrelia burgdorferi B31
ELCFGTID

SEQ ID NO: 31811 - protein, 8 aa, Borrelia burgdorferi B31
LCFGTIDT

SEQ ID NO: 31812 - protein, 8 aa, Borrelia burgdorferi B31
CFGTIDTW

SEQ ID NO: 31813 - protein, 8 aa, Borrelia burgdorferi B31
FGTIDTWI

SEQ ID NO: 31814 - protein, 8 aa, Borrelia burgdorferi B31
GTIDTWIL

SEQ ID NO: 31815 - protein, 8 aa, Borrelia burgdorferi B31
TIDTWILW

SEQ ID NO: 31816 - protein, 8 aa, Borrelia burgdorferi B31
IDTWILWN

SEQ ID NO: 31817 - protein, 8 aa, Borrelia burgdorferi B31
DTWILWNL

SEQ ID NO: 31818 - protein, 8 aa, Borrelia burgdorferi B31
TWILWNLT

SEQ ID NO: 31819 - protein, 8 aa, Borrelia burgdorferi B31
WILWNLTQ

SEQ ID NO: 31820 - protein, 8 aa, Borrelia burgdorferi B31
ILWNLTQK

SEQ ID NO: 31821 - protein, 8 aa, Borrelia burgdorferi B31
LWNLTQKK

SEQ ID NO: 31822 - protein, 8 aa, Borrelia burgdorferi B31
WNLTQKKE

SEQ ID NO: 31823 - protein, 8 aa, Borrelia burgdorferi B31
NLTQKKEH

SEQ ID NO: 31824 - protein, 8 aa, Borrelia burgdorferi B31
LTQKKEHA

SEQ ID NO: 31825 - protein, 8 aa, Borrelia burgdorferi B31
TQKKEHAT

SEQ ID NO: 31826 - protein, 8 aa, Borrelia burgdorferi B31
QKKEHATD

SEQ ID NO: 31827 - protein, 8 aa, Borrelia burgdorferi B31
KKEHATDY

SEQ ID NO: 31828 - protein, 8 aa, Borrelia burgdorferi B31
KEHATDYS

SEQ ID NO: 31829 - protein, 8 aa, Borrelia burgdorferi B31
EHATDYSN

SEQ ID NO: 31830 - protein, 8 aa, Borrelia burgdorferi B31
HATDYSNA

SEQ ID NO: 31831 - protein, 8 aa, Borrelia burgdorferi B31
ATDYSNAS

SEQ ID NO: 31832 - protein, 8 aa, Borrelia burgdorferi B31
TDYSNASR

SEQ ID NO: 31833 - protein, 8 aa, Borrelia burgdorferi B31
DYSNASRT

SEQ ID NO: 31834 - protein, 8 aa, Borrelia burgdorferi B31
YSNASRTL

SEQ ID NO: 31835 - protein, 8 aa, Borrelia burgdorferi B31
SNASRTLL

SEQ ID NO: 31836 - protein, 8 aa, Borrelia burgdorferi B31
NASRTLLL

SEQ ID NO: 31837 - protein, 8 aa, Borrelia burgdorferi B31
ASRTLLLN

SEQ ID NO: 31838 - protein, 8 aa, Borrelia burgdorferi B31
SRTLLLNI

SEQ ID NO: 31839 - protein, 8 aa, Borrelia burgdorferi B31
RTLLLNIK

SEQ ID NO: 31840 - protein, 8 aa, Borrelia burgdorferi B31
TLLLNIKT

SEQ ID NO: 31841 - protein, 8 aa, Borrelia burgdorferi B31
LLLNIKTL

SEQ ID NO: 31842 - protein, 8 aa, Borrelia burgdorferi B31
LLNIKTLE

SEQ ID NO: 31843 - protein, 8 aa, Borrelia burgdorferi B31
LNIKTLEW

SEQ ID NO: 31844 - protein, 8 aa, Borrelia burgdorferi B31
NIKTLEWD

SEQ ID NO: 31845 - protein, 8 aa, Borrelia burgdorferi B31
IKTLEWDD

SEQ ID NO: 31846 - protein, 8 aa, Borrelia burgdorferi B31
KTLEWDDE

SEQ ID NO: 31847 - protein, 8 aa, Borrelia burgdorferi B31
TLEWDDEL

SEQ ID NO: 31848 - protein, 8 aa, Borrelia burgdorferi B31
LEWDDELL

SEQ ID NO: 31849 - protein, 8 aa, Borrelia burgdorferi B31
EWDDELLS

SEQ ID NO: 31850 - protein, 8 aa, Borrelia burgdorferi B31
WDDELLSI

SEQ ID NO: 31851 - protein, 8 aa, Borrelia burgdorferi B31
DDELLSIL

SEQ ID NO: 31852 - protein, 8 aa, Borrelia burgdorferi B31
DELLSILN

SEQ ID NO: 31853 - protein, 8 aa, Borrelia burgdorferi B31
ELLSILNV

SEQ ID NO: 31854 - protein, 8 aa, Borrelia burgdorferi B31
LLSILNVP

SEQ ID NO: 31855 - protein, 8 aa, Borrelia burgdorferi B31
LSILNVPR

SEQ ID NO: 31856 - protein, 8 aa, Borrelia burgdorferi B31
SILNVPRA

SEQ ID NO: 31857 - protein, 8 aa, Borrelia burgdorferi B31
ILNVPRAI

SEQ ID NO: 31858 - protein, 8 aa, Borrelia burgdorferi B31
LNVPRAIL

SEQ ID NO: 31859 - protein, 8 aa, Borrelia burgdorferi B31
NVPRAILP

SEQ ID NO: 31860 - protein, 8 aa, Borrelia burgdorferi B31
VPRAILPE

SEQ ID NO: 31861 - protein, 8 aa, Borrelia burgdorferi B31
PRAILPEL

SEQ ID NO: 31862 - protein, 8 aa, Borrelia burgdorferi B31
RAILPELK

SEQ ID NO: 31863 - protein, 8 aa, Borrelia burgdorferi B31
AILPELKE

SEQ ID NO: 31864 - protein, 8 aa, Borrelia burgdorferi B31
ILPELKES

SEQ ID NO: 31865 - protein, 8 aa, Borrelia burgdorferi B31
LPELKESS

SEQ ID NO: 31866 - protein, 8 aa, Borrelia burgdorferi B31
PELKESST

SEQ ID NO: 31867 - protein, 8 aa, Borrelia burgdorferi B31
ELKESSTI

SEQ ID NO: 31868 - protein, 8 aa, Borrelia burgdorferi B31
LKESSTIY

SEQ ID NO: 31869 - protein, 8 aa, Borrelia burgdorferi B31
KESSTIYG

SEQ ID NO: 31870 - protein, 8 aa, Borrelia burgdorferi B31
ESSTIYGK

SEQ ID NO: 31871 - protein, 8 aa, Borrelia burgdorferi B31
SSTIYGKT

SEQ ID NO: 31872 - protein, 8 aa, Borrelia burgdorferi B31
STIYGKTD

SEQ ID NO: 31873 - protein, 8 aa, Borrelia burgdorferi B31
TIYGKTDK

SEQ ID NO: 31874 - protein, 8 aa, Borrelia burgdorferi B31
IYGKTDKA

SEQ ID NO: 31875 - protein, 8 aa, Borrelia burgdorferi B31
YGKTDKAL

SEQ ID NO: 31876 - protein, 8 aa, Borrelia burgdorferi B31
GKTDKALF

SEQ ID NO: 31877 - protein, 8 aa, Borrelia burgdorferi B31
KTDKALFG

SEQ ID NO: 31878 - protein, 8 aa, Borrelia burgdorferi B31
TDKALFGA

SEQ ID NO: 31879 - protein, 8 aa, Borrelia burgdorferi B31
DKALFGAE

SEQ ID NO: 31880 - protein, 8 aa, Borrelia burgdorferi B31
KALFGAEI

SEQ ID NO: 31881 - protein, 8 aa, Borrelia burgdorferi B31
ALFGAEIP

SEQ ID NO: 31882 - protein, 8 aa, Borrelia burgdorferi B31
LFGAEIPI

SEQ ID NO: 31883 - protein, 8 aa, Borrelia burgdorferi B31
FGAEIPIA

SEQ ID NO: 31884 - protein, 8 aa, Borrelia burgdorferi B31
GAEIPIAG

SEQ ID NO: 31885 - protein, 8 aa, Borrelia burgdorferi B31
AEIPIAGI

SEQ ID NO: 31886 - protein, 8 aa, Borrelia burgdorferi B31
EIPIAGIA

SEQ ID NO: 31887 - protein, 8 aa, Borrelia burgdorferi B31
IPIAGIAG

SEQ ID NO: 31888 - protein, 8 aa, Borrelia burgdorferi B31
PIAGIAGD

SEQ ID NO: 31889 - protein, 8 aa, Borrelia burgdorferi B31
IAGIAGDQ

SEQ ID NO: 31890 - protein, 8 aa, Borrelia burgdorferi B31
AGIAGDQF

SEQ ID NO: 31891 - protein, 8 aa, Borrelia burgdorferi B31
GIAGDQFA

SEQ ID NO: 31892 - protein, 8 aa, Borrelia burgdorferi B31
IAGDQFAA

SEQ ID NO: 31893 - protein, 8 aa, Borrelia burgdorferi B31
AGDQFAAT

SEQ ID NO: 31894 - protein, 8 aa, Borrelia burgdorferi B31
GDQFAATF

SEQ ID NO: 31895 - protein, 8 aa, Borrelia burgdorferi B31
DQFAATFG

SEQ ID NO: 31896 - protein, 8 aa, Borrelia burgdorferi B31
QFAATFGQ

SEQ ID NO: 31897 - protein, 8 aa, Borrelia burgdorferi B31
FAATFGQA

SEQ ID NO: 31898 - protein, 8 aa, Borrelia burgdorferi B31
AATFGQAC

SEQ ID NO: 31899 - protein, 8 aa, Borrelia burgdorferi B31
ATFGQACL

SEQ ID NO: 31900 - protein, 8 aa, Borrelia burgdorferi B31
TFGQACLK

SEQ ID NO: 31901 - protein, 8 aa, Borrelia burgdorferi B31
FGQACLKK

SEQ ID NO: 31902 - protein, 8 aa, Borrelia burgdorferi B31
GQACLKKG

SEQ ID NO: 31903 - protein, 8 aa, Borrelia burgdorferi B31
QACLKKGM

SEQ ID NO: 31904 - protein, 8 aa, Borrelia burgdorferi B31
ACLKKGMA

SEQ ID NO: 31905 - protein, 8 aa, Borrelia burgdorferi B31
CLKKGMAK

SEQ ID NO: 31906 - protein, 8 aa, Borrelia burgdorferi B31
LKKGMAKN

SEQ ID NO: 31907 - protein, 8 aa, Borrelia burgdorferi B31
KKGMAKNT

SEQ ID NO: 31908 - protein, 8 aa, Borrelia burgdorferi B31
KGMAKNTY

SEQ ID NO: 31909 - protein, 8 aa, Borrelia burgdorferi B31
GMAKNTYG

SEQ ID NO: 31910 - protein, 8 aa, Borrelia burgdorferi B31
MAKNTYGT

SEQ ID NO: 31911 - protein, 8 aa, Borrelia burgdorferi B31
AKNTYGTG

SEQ ID NO: 31912 - protein, 8 aa, Borrelia burgdorferi B31
KNTYGTGC

SEQ ID NO: 31913 - protein, 8 aa, Borrelia burgdorferi B31
NTYGTGCF

SEQ ID NO: 31914 - protein, 8 aa, Borrelia burgdorferi B31
TYGTGCFL

SEQ ID NO: 31915 - protein, 8 aa, Borrelia burgdorferi B31
YGTGCFLT

SEQ ID NO: 31916 - protein, 8 aa, Borrelia burgdorferi B31
GTGCFLTV

SEQ ID NO: 31917 - protein, 8 aa, Borrelia burgdorferi B31
TGCFLTVN

SEQ ID NO: 31918 - protein, 8 aa, Borrelia burgdorferi B31
GCFLTVNI

SEQ ID NO: 31919 - protein, 8 aa, Borrelia burgdorferi B31
CFLTVNIG

SEQ ID NO: 31920 - protein, 8 aa, Borrelia burgdorferi B31
FLTVNIGK

SEQ ID NO: 31921 - protein, 8 aa, Borrelia burgdorferi B31
LTVNIGKE

SEQ ID NO: 31922 - protein, 8 aa, Borrelia burgdorferi B31
TVNIGKEP

SEQ ID NO: 31923 - protein, 8 aa, Borrelia burgdorferi B31
VNIGKEPI

SEQ ID NO: 31924 - protein, 8 aa, Borrelia burgdorferi B31
NIGKEPII

SEQ ID NO: 31925 - protein, 8 aa, Borrelia burgdorferi B31
IGKEPIIS

SEQ ID NO: 31926 - protein, 8 aa, Borrelia burgdorferi B31
GKEPIISH

SEQ ID NO: 31927 - protein, 8 aa, Borrelia burgdorferi B31
KEPIISHD

SEQ ID NO: 31928 - protein, 8 aa, Borrelia burgdorferi B31
EPIISHDK

SEQ ID NO: 31929 - protein, 8 aa, Borrelia burgdorferi B31
PIISHDKL

SEQ ID NO: 31930 - protein, 8 aa, Borrelia burgdorferi B31
IISHDKLL

SEQ ID NO: 31931 - protein, 8 aa, Borrelia burgdorferi B31
ISHDKLLT

SEQ ID NO: 31932 - protein, 8 aa, Borrelia burgdorferi B31
SHDKLLTS

SEQ ID NO: 31933 - protein, 8 aa, Borrelia burgdorferi B31
HDKLLTSI

SEQ ID NO: 31934 - protein, 8 aa, Borrelia burgdorferi B31
DKLLTSIA

SEQ ID NO: 31935 - protein, 8 aa, Borrelia burgdorferi B31
KLLTSIAW

SEQ ID NO: 31936 - protein, 8 aa, Borrelia burgdorferi B31
LLTSIAWG

SEQ ID NO: 31937 - protein, 8 aa, Borrelia burgdorferi B31
LTSIAWGR

SEQ ID NO: 31938 - protein, 8 aa, Borrelia burgdorferi B31
TSIAWGRK

SEQ ID NO: 31939 - protein, 8 aa, Borrelia burgdorferi B31
SIAWGRKK

SEQ ID NO: 31940 - protein, 8 aa, Borrelia burgdorferi B31
IAWGRKKS

SEQ ID NO: 31941 - protein, 8 aa, Borrelia burgdorferi B31
AWGRKKSV

SEQ ID NO: 31942 - protein, 8 aa, Borrelia burgdorferi B31
WGRKKSVT

SEQ ID NO: 31943 - protein, 8 aa, Borrelia burgdorferi B31
GRKKSVTY

SEQ ID NO: 31944 - protein, 8 aa, Borrelia burgdorferi B31
RKKSVTYV

SEQ ID NO: 31945 - protein, 8 aa, Borrelia burgdorferi B31
KKSVTYVL

SEQ ID NO: 31946 - protein, 8 aa, Borrelia burgdorferi B31
KSVTYVLE

SEQ ID NO: 31947 - protein, 8 aa, Borrelia burgdorferi B31
SVTYVLEG

SEQ ID NO: 31948 - protein, 8 aa, Borrelia burgdorferi B31
VTYVLEGS

SEQ ID NO: 31949 - protein, 8 aa, Borrelia burgdorferi B31
TYVLEGSV

SEQ ID NO: 31950 - protein, 8 aa, Borrelia burgdorferi B31
YVLEGSVF

SEQ ID NO: 31951 - protein, 8 aa, Borrelia burgdorferi B31
VLEGSVFI

SEQ ID NO: 31952 - protein, 8 aa, Borrelia burgdorferi B31
LEGSVFIG

SEQ ID NO: 31953 - protein, 8 aa, Borrelia burgdorferi B31
EGSVFIGG

SEQ ID NO: 31954 - protein, 8 aa, Borrelia burgdorferi B31
GSVFIGGA

SEQ ID NO: 31955 - protein, 8 aa, Borrelia burgdorferi B31
SVFIGGAV

SEQ ID NO: 31956 - protein, 8 aa, Borrelia burgdorferi B31
VFIGGAVI

SEQ ID NO: 31957 - protein, 8 aa, Borrelia burgdorferi B31
FIGGAVIQ

SEQ ID NO: 31958 - protein, 8 aa, Borrelia burgdorferi B31
IGGAVIQW

SEQ ID NO: 31959 - protein, 8 aa, Borrelia burgdorferi B31
GGAVIQWL

SEQ ID NO: 31960 - protein, 8 aa, Borrelia burgdorferi B31
GAVIQWLR

SEQ ID NO: 31961 - protein, 8 aa, Borrelia burgdorferi B31
AVIQWLRD

SEQ ID NO: 31962 - protein, 8 aa, Borrelia burgdorferi B31
VIQWLRDG

SEQ ID NO: 31963 - protein, 8 aa, Borrelia burgdorferi B31
IQWLRDGL

SEQ ID NO: 31964 - protein, 8 aa, Borrelia burgdorferi B31
QWLRDGLE

SEQ ID NO: 31965 - protein, 8 aa, Borrelia burgdorferi B31
WLRDGLEF

SEQ ID NO: 31966 - protein, 8 aa, Borrelia burgdorferi B31
LRDGLEFF

SEQ ID NO: 31967 - protein, 8 aa, Borrelia burgdorferi B31
RDGLEFFR

SEQ ID NO: 31968 - protein, 8 aa, Borrelia burgdorferi B31
DGLEFFRK

SEQ ID NO: 31969 - protein, 8 aa, Borrelia burgdorferi B31
GLEFFRKS

SEQ ID NO: 31970 - protein, 8 aa, Borrelia burgdorferi B31
LEFFRKSS

SEQ ID NO: 31971 - protein, 8 aa, Borrelia burgdorferi B31
EFFRKSSD

SEQ ID NO: 31972 - protein, 8 aa, Borrelia burgdorferi B31
FFRKSSDA

SEQ ID NO: 31973 - protein, 8 aa, Borrelia burgdorferi B31
FRKSSDAE

SEQ ID NO: 31974 - protein, 8 aa, Borrelia burgdorferi B31
RKSSDAEA

SEQ ID NO: 31975 - protein, 8 aa, Borrelia burgdorferi B31
KSSDAEAL

SEQ ID NO: 31976 - protein, 8 aa, Borrelia burgdorferi B31
SSDAEALA

SEQ ID NO: 31977 - protein, 8 aa, Borrelia burgdorferi B31
SDAEALAS

SEQ ID NO: 31978 - protein, 8 aa, Borrelia burgdorferi B31
DAEALASS

SEQ ID NO: 31979 - protein, 8 aa, Borrelia burgdorferi B31
AEALASSV

SEQ ID NO: 31980 - protein, 8 aa, Borrelia burgdorferi B31
EALASSVS

SEQ ID NO: 31981 - protein, 8 aa, Borrelia burgdorferi B31
ALASSVSD

SEQ ID NO: 31982 - protein, 8 aa, Borrelia burgdorferi B31
LASSVSDN

SEQ ID NO: 31983 - protein, 8 aa, Borrelia burgdorferi B31
ASSVSDNG

SEQ ID NO: 31984 - protein, 8 aa, Borrelia burgdorferi B31
SSVSDNGG

SEQ ID NO: 31985 - protein, 8 aa, Borrelia burgdorferi B31
SVSDNGGV

SEQ ID NO: 31986 - protein, 8 aa, Borrelia burgdorferi B31
VSDNGGVY

SEQ ID NO: 31987 - protein, 8 aa, Borrelia burgdorferi B31
SDNGGVYF

SEQ ID NO: 31988 - protein, 8 aa, Borrelia burgdorferi B31
DNGGVYFV

SEQ ID NO: 31989 - protein, 8 aa, Borrelia burgdorferi B31
NGGVYFVP

SEQ ID NO: 31990 - protein, 8 aa, Borrelia burgdorferi B31
GGVYFVPA

SEQ ID NO: 31991 - protein, 8 aa, Borrelia burgdorferi B31
GVYFVPAF

SEQ ID NO: 31992 - protein, 8 aa, Borrelia burgdorferi B31
VYFVPAFV

SEQ ID NO: 31993 - protein, 8 aa, Borrelia burgdorferi B31
YFVPAFVG

SEQ ID NO: 31994 - protein, 8 aa, Borrelia burgdorferi B31
FVPAFVGL

SEQ ID NO: 31995 - protein, 8 aa, Borrelia burgdorferi B31
VPAFVGLG

SEQ ID NO: 31996 - protein, 8 aa, Borrelia burgdorferi B31
PAFVGLGA

SEQ ID NO: 31997 - protein, 8 aa, Borrelia burgdorferi B31
AFVGLGAP

SEQ ID NO: 31998 - protein, 8 aa, Borrelia burgdorferi B31
FVGLGAPH

SEQ ID NO: 31999 - protein, 8 aa, Borrelia burgdorferi B31
VGLGAPHW

SEQ ID NO: 32000 - protein, 8 aa, Borrelia burgdorferi B31
GLGAPHWD

SEQ ID NO: 32001 - protein, 8 aa, Borrelia burgdorferi B31
LGAPHWDS

SEQ ID NO: 32002 - protein, 8 aa, Borrelia burgdorferi B31
GAPHWDSY

SEQ ID NO: 32003 - protein, 8 aa, Borrelia burgdorferi B31
APHWDSYA

SEQ ID NO: 32004 - protein, 8 aa, Borrelia burgdorferi B31
PHWDSYAR

SEQ ID NO: 32005 - protein, 8 aa, Borrelia burgdorferi B31
HWDSYARG

SEQ ID NO: 32006 - protein, 8 aa, Borrelia burgdorferi B31
WDSYARGT

SEQ ID NO: 32007 - protein, 8 aa, Borrelia burgdorferi B31
DSYARGTI

SEQ ID NO: 32008 - protein, 8 aa, Borrelia burgdorferi B31
SYARGTII

SEQ ID NO: 32009 - protein, 8 aa, Borrelia burgdorferi B31
YARGTIIG

SEQ ID NO: 32010 - protein, 8 aa, Borrelia burgdorferi B31
ARGTIIGI

SEQ ID NO: 32011 - protein, 8 aa, Borrelia burgdorferi B31
RGTIIGIT

SEQ ID NO: 32012 - protein, 8 aa, Borrelia burgdorferi B31
GTIIGITR

SEQ ID NO: 32013 - protein, 8 aa, Borrelia burgdorferi B31
TIIGITRG

SEQ ID NO: 32014 - protein, 8 aa, Borrelia burgdorferi B31
IIGITRGS

SEQ ID NO: 32015 - protein, 8 aa, Borrelia burgdorferi B31
IGITRGST

SEQ ID NO: 32016 - protein, 8 aa, Borrelia burgdorferi B31
GITRGSTK

SEQ ID NO: 32017 - protein, 8 aa, Borrelia burgdorferi B31
ITRGSTKA

SEQ ID NO: 32018 - protein, 8 aa, Borrelia burgdorferi B31
TRGSTKAH

SEQ ID NO: 32019 - protein, 8 aa, Borrelia burgdorferi B31
RGSTKAHI

SEQ ID NO: 32020 - protein, 8 aa, Borrelia burgdorferi B31
GSTKAHIT

SEQ ID NO: 32021 - protein, 8 aa, Borrelia burgdorferi B31
STKAHITR

SEQ ID NO: 32022 - protein, 8 aa, Borrelia burgdorferi B31
TKAHITRA

SEQ ID NO: 32023 - protein, 8 aa, Borrelia burgdorferi B31
KAHITRAA

SEQ ID NO: 32024 - protein, 8 aa, Borrelia burgdorferi B31
AHITRAAL

SEQ ID NO: 32025 - protein, 8 aa, Borrelia burgdorferi B31
HITRAALE

SEQ ID NO: 32026 - protein, 8 aa, Borrelia burgdorferi B31
ITRAALES

SEQ ID NO: 32027 - protein, 8 aa, Borrelia burgdorferi B31
TRAALESI

SEQ ID NO: 32028 - protein, 8 aa, Borrelia burgdorferi B31
RAALESIA

SEQ ID NO: 32029 - protein, 8 aa, Borrelia burgdorferi B31
AALESIAF

SEQ ID NO: 32030 - protein, 8 aa, Borrelia burgdorferi B31
ALESIAFQ

SEQ ID NO: 32031 - protein, 8 aa, Borrelia burgdorferi B31
LESIAFQS

SEQ ID NO: 32032 - protein, 8 aa, Borrelia burgdorferi B31
ESIAFQSF

SEQ ID NO: 32033 - protein, 8 aa, Borrelia burgdorferi B31
SIAFQSFD

SEQ ID NO: 32034 - protein, 8 aa, Borrelia burgdorferi B31
IAFQSFDI

SEQ ID NO: 32035 - protein, 8 aa, Borrelia burgdorferi B31
AFQSFDIL

SEQ ID NO: 32036 - protein, 8 aa, Borrelia burgdorferi B31
FQSFDILN

SEQ ID NO: 32037 - protein, 8 aa, Borrelia burgdorferi B31
QSFDILNT

SEQ ID NO: 32038 - protein, 8 aa, Borrelia burgdorferi B31
SFDILNTM

SEQ ID NO: 32039 - protein, 8 aa, Borrelia burgdorferi B31
FDILNTMK

SEQ ID NO: 32040 - protein, 8 aa, Borrelia burgdorferi B31
DILNTMKK

SEQ ID NO: 32041 - protein, 8 aa, Borrelia burgdorferi B31
ILNTMKKS

SEQ ID NO: 32042 - protein, 8 aa, Borrelia burgdorferi B31
LNTMKKSI

SEQ ID NO: 32043 - protein, 8 aa, Borrelia burgdorferi B31
NTMKKSIP

SEQ ID NO: 32044 - protein, 8 aa, Borrelia burgdorferi B31
TMKKSIPN

SEQ ID NO: 32045 - protein, 8 aa, Borrelia burgdorferi B31
MKKSIPNF

SEQ ID NO: 32046 - protein, 8 aa, Borrelia burgdorferi B31
KKSIPNFE

SEQ ID NO: 32047 - protein, 8 aa, Borrelia burgdorferi B31
KSIPNFEI

SEQ ID NO: 32048 - protein, 8 aa, Borrelia burgdorferi B31
SIPNFEIQ

SEQ ID NO: 32049 - protein, 8 aa, Borrelia burgdorferi B31
IPNFEIQE

SEQ ID NO: 32050 - protein, 8 aa, Borrelia burgdorferi B31
PNFEIQEL

SEQ ID NO: 32051 - protein, 8 aa, Borrelia burgdorferi B31
NFEIQELR

SEQ ID NO: 32052 - protein, 8 aa, Borrelia burgdorferi B31
FEIQELRV

SEQ ID NO: 32053 - protein, 8 aa, Borrelia burgdorferi B31
EIQELRVD

SEQ ID NO: 32054 - protein, 8 aa, Borrelia burgdorferi B31
IQELRVDG

SEQ ID NO: 32055 - protein, 8 aa, Borrelia burgdorferi B31
QELRVDGG

SEQ ID NO: 32056 - protein, 8 aa, Borrelia burgdorferi B31
ELRVDGGA

SEQ ID NO: 32057 - protein, 8 aa, Borrelia burgdorferi B31
LRVDGGAS

SEQ ID NO: 32058 - protein, 8 aa, Borrelia burgdorferi B31
RVDGGASQ

SEQ ID NO: 32059 - protein, 8 aa, Borrelia burgdorferi B31
VDGGASQN

SEQ ID NO: 32060 - protein, 8 aa, Borrelia burgdorferi B31
DGGASQNN

SEQ ID NO: 32061 - protein, 8 aa, Borrelia burgdorferi B31
GGASQNNL

SEQ ID NO: 32062 - protein, 8 aa, Borrelia burgdorferi B31
GASQNNLL

SEQ ID NO: 32063 - protein, 8 aa, Borrelia burgdorferi B31
ASQNNLLM

SEQ ID NO: 32064 - protein, 8 aa, Borrelia burgdorferi B31
SQNNLLMQ

SEQ ID NO: 32065 - protein, 8 aa, Borrelia burgdorferi B31
QNNLLMQF

SEQ ID NO: 32066 - protein, 8 aa, Borrelia burgdorferi B31
NNLLMQFQ

SEQ ID NO: 32067 - protein, 8 aa, Borrelia burgdorferi B31
NLLMQFQA

SEQ ID NO: 32068 - protein, 8 aa, Borrelia burgdorferi B31
LLMQFQAD

SEQ ID NO: 32069 - protein, 8 aa, Borrelia burgdorferi B31
LMQFQADL

SEQ ID NO: 32070 - protein, 8 aa, Borrelia burgdorferi B31
MQFQADLL

SEQ ID NO: 32071 - protein, 8 aa, Borrelia burgdorferi B31
QFQADLLE

SEQ ID NO: 32072 - protein, 8 aa, Borrelia burgdorferi B31
FQADLLEC

SEQ ID NO: 32073 - protein, 8 aa, Borrelia burgdorferi B31
QADLLECK

SEQ ID NO: 32074 - protein, 8 aa, Borrelia burgdorferi B31
ADLLECKV

SEQ ID NO: 32075 - protein, 8 aa, Borrelia burgdorferi B31
DLLECKVV

SEQ ID NO: 32076 - protein, 8 aa, Borrelia burgdorferi B31
LLECKVVR

SEQ ID NO: 32077 - protein, 8 aa, Borrelia burgdorferi B31
LECKVVRP

SEQ ID NO: 32078 - protein, 8 aa, Borrelia burgdorferi B31
ECKVVRPK

SEQ ID NO: 32079 - protein, 8 aa, Borrelia burgdorferi B31
CKVVRPKI

SEQ ID NO: 32080 - protein, 8 aa, Borrelia burgdorferi B31
KVVRPKIT

SEQ ID NO: 32081 - protein, 8 aa, Borrelia burgdorferi B31
VVRPKITE

SEQ ID NO: 32082 - protein, 8 aa, Borrelia burgdorferi B31
VRPKITET

SEQ ID NO: 32083 - protein, 8 aa, Borrelia burgdorferi B31
RPKITETT

SEQ ID NO: 32084 - protein, 8 aa, Borrelia burgdorferi B31
PKITETTA

SEQ ID NO: 32085 - protein, 8 aa, Borrelia burgdorferi B31
KITETTAL

SEQ ID NO: 32086 - protein, 8 aa, Borrelia burgdorferi B31
ITETTALG

SEQ ID NO: 32087 - protein, 8 aa, Borrelia burgdorferi B31
TETTALGA

SEQ ID NO: 32088 - protein, 8 aa, Borrelia burgdorferi B31
ETTALGAA

SEQ ID NO: 32089 - protein, 8 aa, Borrelia burgdorferi B31
TTALGAAY

SEQ ID NO: 32090 - protein, 8 aa, Borrelia burgdorferi B31
TALGAAYL

SEQ ID NO: 32091 - protein, 8 aa, Borrelia burgdorferi B31
ALGAAYLA

SEQ ID NO: 32092 - protein, 8 aa, Borrelia burgdorferi B31
LGAAYLAG

SEQ ID NO: 32093 - protein, 8 aa, Borrelia burgdorferi B31
GAAYLAGL

SEQ ID NO: 32094 - protein, 8 aa, Borrelia burgdorferi B31
AAYLAGLA

SEQ ID NO: 32095 - protein, 8 aa, Borrelia burgdorferi B31
AYLAGLAT

SEQ ID NO: 32096 - protein, 8 aa, Borrelia burgdorferi B31
YLAGLATG

SEQ ID NO: 32097 - protein, 8 aa, Borrelia burgdorferi B31
LAGLATGY

SEQ ID NO: 32098 - protein, 8 aa, Borrelia burgdorferi B31
AGLATGYW

SEQ ID NO: 32099 - protein, 8 aa, Borrelia burgdorferi B31
GLATGYWQ

SEQ ID NO: 32100 - protein, 8 aa, Borrelia burgdorferi B31
LATGYWQS

SEQ ID NO: 32101 - protein, 8 aa, Borrelia burgdorferi B31
ATGYWQSA

SEQ ID NO: 32102 - protein, 8 aa, Borrelia burgdorferi B31
TGYWQSAE

SEQ ID NO: 32103 - protein, 8 aa, Borrelia burgdorferi B31
GYWQSAEE

SEQ ID NO: 32104 - protein, 8 aa, Borrelia burgdorferi B31
YWQSAEEI

SEQ ID NO: 32105 - protein, 8 aa, Borrelia burgdorferi B31
WQSAEEIV

SEQ ID NO: 32106 - protein, 8 aa, Borrelia burgdorferi B31
QSAEEIVS

SEQ ID NO: 32107 - protein, 8 aa, Borrelia burgdorferi B31
SAEEIVSL

SEQ ID NO: 32108 - protein, 8 aa, Borrelia burgdorferi B31
AEEIVSLW

SEQ ID NO: 32109 - protein, 8 aa, Borrelia burgdorferi B31
EEIVSLWQ

SEQ ID NO: 32110 - protein, 8 aa, Borrelia burgdorferi B31
EIVSLWQV

SEQ ID NO: 32111 - protein, 8 aa, Borrelia burgdorferi B31
IVSLWQVD

SEQ ID NO: 32112 - protein, 8 aa, Borrelia burgdorferi B31
VSLWQVDK

SEQ ID NO: 32113 - protein, 8 aa, Borrelia burgdorferi B31
SLWQVDKI

SEQ ID NO: 32114 - protein, 8 aa, Borrelia burgdorferi B31
LWQVDKIF

SEQ ID NO: 32115 - protein, 8 aa, Borrelia burgdorferi B31
WQVDKIFE

SEQ ID NO: 32116 - protein, 8 aa, Borrelia burgdorferi B31
QVDKIFEP

SEQ ID NO: 32117 - protein, 8 aa, Borrelia burgdorferi B31
VDKIFEPS

SEQ ID NO: 32118 - protein, 8 aa, Borrelia burgdorferi B31
DKIFEPSM

SEQ ID NO: 32119 - protein, 8 aa, Borrelia burgdorferi B31
KIFEPSMP

SEQ ID NO: 32120 - protein, 8 aa, Borrelia burgdorferi B31
IFEPSMPK

SEQ ID NO: 32121 - protein, 8 aa, Borrelia burgdorferi B31
FEPSMPKN

SEQ ID NO: 32122 - protein, 8 aa, Borrelia burgdorferi B31
EPSMPKNQ

SEQ ID NO: 32123 - protein, 8 aa, Borrelia burgdorferi B31
PSMPKNQK

SEQ ID NO: 32124 - protein, 8 aa, Borrelia burgdorferi B31
SMPKNQKE

SEQ ID NO: 32125 - protein, 8 aa, Borrelia burgdorferi B31
MPKNQKEK

SEQ ID NO: 32126 - protein, 8 aa, Borrelia burgdorferi B31
PKNQKEKL

SEQ ID NO: 32127 - protein, 8 aa, Borrelia burgdorferi B31
KNQKEKLL

SEQ ID NO: 32128 - protein, 8 aa, Borrelia burgdorferi B31
NQKEKLLE

SEQ ID NO: 32129 - protein, 8 aa, Borrelia burgdorferi B31
QKEKLLEN

SEQ ID NO: 32130 - protein, 8 aa, Borrelia burgdorferi B31
KEKLLENW

SEQ ID NO: 32131 - protein, 8 aa, Borrelia burgdorferi B31
EKLLENWN

SEQ ID NO: 32132 - protein, 8 aa, Borrelia burgdorferi B31
KLLENWNK

SEQ ID NO: 32133 - protein, 8 aa, Borrelia burgdorferi B31
LLENWNKA

SEQ ID NO: 32134 - protein, 8 aa, Borrelia burgdorferi B31
LENWNKAV

SEQ ID NO: 32135 - protein, 8 aa, Borrelia burgdorferi B31
ENWNKAVG

SEQ ID NO: 32136 - protein, 8 aa, Borrelia burgdorferi B31
NWNKAVGK

SEQ ID NO: 32137 - protein, 8 aa, Borrelia burgdorferi B31
WNKAVGKA

SEQ ID NO: 32138 - protein, 8 aa, Borrelia burgdorferi B31
NKAVGKAK

SEQ ID NO: 32139 - protein, 8 aa, Borrelia burgdorferi B31
KAVGKAKS

SEQ ID NO: 32140 - protein, 8 aa, Borrelia burgdorferi B31
AVGKAKSW

SEQ ID NO: 32141 - protein, 8 aa, Borrelia burgdorferi B31
VGKAKSWI

SEQ ID NO: 32142 - protein, 8 aa, Borrelia burgdorferi B31
GKAKSWIQ

SEQ ID NO: 32143 - protein, 8 aa, Borrelia burgdorferi B31
KAKSWIQN

SEQ ID NO: 32144 - protein, 8 aa, Borrelia burgdorferi B31
AKSWIQNS

SEQ ID NO: 32145 - protein, 8 aa, Borrelia burgdorferi B31
KSWIQNSH

SEQ ID NO: 32146 - protein, 8 aa, Borrelia burgdorferi B31
SWIQNSHS

SEQ ID NO: 32147 - protein, 8 aa, Borrelia burgdorferi B31
WIQNSHSS

SEQ ID NO: 32148 - protein, 9 aa, Borrelia burgdorferi B31
MKYILSIDQ

SEQ ID NO: 32149 - protein, 9 aa, Borrelia burgdorferi B31
KYILSIDQG

SEQ ID NO: 32150 - protein, 9 aa, Borrelia burgdorferi B31
YILSIDQGT

SEQ ID NO: 32151 - protein, 9 aa, Borrelia burgdorferi B31
ILSIDQGTT

SEQ ID NO: 32152 - protein, 9 aa, Borrelia burgdorferi B31
LSIDQGTTS

SEQ ID NO: 32153 - protein, 9 aa, Borrelia burgdorferi B31
SIDQGTTSS

SEQ ID NO: 32154 - protein, 9 aa, Borrelia burgdorferi B31
IDQGTTSSR

SEQ ID NO: 32155 - protein, 9 aa, Borrelia burgdorferi B31
DQGTTSSRA

SEQ ID NO: 32156 - protein, 9 aa, Borrelia burgdorferi B31
QGTTSSRAM

SEQ ID NO: 32157 - protein, 9 aa, Borrelia burgdorferi B31
GTTSSRAMV

SEQ ID NO: 32158 - protein, 9 aa, Borrelia burgdorferi B31
TTSSRAMVF

SEQ ID NO: 32159 - protein, 9 aa, Borrelia burgdorferi B31
TSSRAMVFD

SEQ ID NO: 32160 - protein, 9 aa, Borrelia burgdorferi B31
SSRAMVFDK

SEQ ID NO: 32161 - protein, 9 aa, Borrelia burgdorferi B31
SRAMVFDKN

SEQ ID NO: 32162 - protein, 9 aa, Borrelia burgdorferi B31
RAMVFDKNA

SEQ ID NO: 32163 - protein, 9 aa, Borrelia burgdorferi B31
AMVFDKNAN

SEQ ID NO: 32164 - protein, 9 aa, Borrelia burgdorferi B31
MVFDKNANI

SEQ ID NO: 32165 - protein, 9 aa, Borrelia burgdorferi B31
VFDKNANIK

SEQ ID NO: 32166 - protein, 9 aa, Borrelia burgdorferi B31
FDKNANIKG

SEQ ID NO: 32167 - protein, 9 aa, Borrelia burgdorferi B31
DKNANIKGF

SEQ ID NO: 32168 - protein, 9 aa, Borrelia burgdorferi B31
KNANIKGFA

SEQ ID NO: 32169 - protein, 9 aa, Borrelia burgdorferi B31
NANIKGFAQ

SEQ ID NO: 32170 - protein, 9 aa, Borrelia burgdorferi B31
ANIKGFAQK

SEQ ID NO: 32171 - protein, 9 aa, Borrelia burgdorferi B31
NIKGFAQKE

SEQ ID NO: 32172 - protein, 9 aa, Borrelia burgdorferi B31
IKGFAQKEF

SEQ ID NO: 32173 - protein, 9 aa, Borrelia burgdorferi B31
KGFAQKEFT

SEQ ID NO: 32174 - protein, 9 aa, Borrelia burgdorferi B31
GFAQKEFTQ

SEQ ID NO: 32175 - protein, 9 aa, Borrelia burgdorferi B31
FAQKEFTQI

SEQ ID NO: 32176 - protein, 9 aa, Borrelia burgdorferi B31
AQKEFTQIY

SEQ ID NO: 32177 - protein, 9 aa, Borrelia burgdorferi B31
QKEFTQIYP

SEQ ID NO: 32178 - protein, 9 aa, Borrelia burgdorferi B31
KEFTQIYPQ

SEQ ID NO: 32179 - protein, 9 aa, Borrelia burgdorferi B31
EFTQIYPQP

SEQ ID NO: 32180 - protein, 9 aa, Borrelia burgdorferi B31
FTQIYPQPS

SEQ ID NO: 32181 - protein, 9 aa, Borrelia burgdorferi B31
TQIYPQPSW

SEQ ID NO: 32182 - protein, 9 aa, Borrelia burgdorferi B31
QIYPQPSWV

SEQ ID NO: 32183 - protein, 9 aa, Borrelia burgdorferi B31
IYPQPSWVE

SEQ ID NO: 32184 - protein, 9 aa, Borrelia burgdorferi B31
YPQPSWVEH

SEQ ID NO: 32185 - protein, 9 aa, Borrelia burgdorferi B31
PQPSWVEHD

SEQ ID NO: 32186 - protein, 9 aa, Borrelia burgdorferi B31
QPSWVEHDP

SEQ ID NO: 32187 - protein, 9 aa, Borrelia burgdorferi B31
PSWVEHDPT

SEQ ID NO: 32188 - protein, 9 aa, Borrelia burgdorferi B31
SWVEHDPTE

SEQ ID NO: 32189 - protein, 9 aa, Borrelia burgdorferi B31
WVEHDPTEI

SEQ ID NO: 32190 - protein, 9 aa, Borrelia burgdorferi B31
VEHDPTEIW

SEQ ID NO: 32191 - protein, 9 aa, Borrelia burgdorferi B31
EHDPTEIWG

SEQ ID NO: 32192 - protein, 9 aa, Borrelia burgdorferi B31
HDPTEIWGS

SEQ ID NO: 32193 - protein, 9 aa, Borrelia burgdorferi B31
DPTEIWGSQ

SEQ ID NO: 32194 - protein, 9 aa, Borrelia burgdorferi B31
PTEIWGSQL

SEQ ID NO: 32195 - protein, 9 aa, Borrelia burgdorferi B31
TEIWGSQLG

SEQ ID NO: 32196 - protein, 9 aa, Borrelia burgdorferi B31
EIWGSQLGV

SEQ ID NO: 32197 - protein, 9 aa, Borrelia burgdorferi B31
IWGSQLGVI

SEQ ID NO: 32198 - protein, 9 aa, Borrelia burgdorferi B31
WGSQLGVIT

SEQ ID NO: 32199 - protein, 9 aa, Borrelia burgdorferi B31
GSQLGVITE

SEQ ID NO: 32200 - protein, 9 aa, Borrelia burgdorferi B31
SQLGVITEA

SEQ ID NO: 32201 - protein, 9 aa, Borrelia burgdorferi B31
QLGVITEAM

SEQ ID NO: 32202 - protein, 9 aa, Borrelia burgdorferi B31
LGVITEAMA

SEQ ID NO: 32203 - protein, 9 aa, Borrelia burgdorferi B31
GVITEAMAN

SEQ ID NO: 32204 - protein, 9 aa, Borrelia burgdorferi B31
VITEAMANA

SEQ ID NO: 32205 - protein, 9 aa, Borrelia burgdorferi B31
ITEAMANAR

SEQ ID NO: 32206 - protein, 9 aa, Borrelia burgdorferi B31
TEAMANARI

SEQ ID NO: 32207 - protein, 9 aa, Borrelia burgdorferi B31
EAMANARIL

SEQ ID NO: 32208 - protein, 9 aa, Borrelia burgdorferi B31
AMANARILP

SEQ ID NO: 32209 - protein, 9 aa, Borrelia burgdorferi B31
MANARILPN

SEQ ID NO: 32210 - protein, 9 aa, Borrelia burgdorferi B31
ANARILPNE

SEQ ID NO: 32211 - protein, 9 aa, Borrelia burgdorferi B31
NARILPNEI

SEQ ID NO: 32212 - protein, 9 aa, Borrelia burgdorferi B31
ARILPNEID

SEQ ID NO: 32213 - protein, 9 aa, Borrelia burgdorferi B31
RILPNEIDA

SEQ ID NO: 32214 - protein, 9 aa, Borrelia burgdorferi B31
ILPNEIDAI

SEQ ID NO: 32215 - protein, 9 aa, Borrelia burgdorferi B31
LPNEIDAIG

SEQ ID NO: 32216 - protein, 9 aa, Borrelia burgdorferi B31
PNEIDAIGI

SEQ ID NO: 32217 - protein, 9 aa, Borrelia burgdorferi B31
NEIDAIGIT

SEQ ID NO: 32218 - protein, 9 aa, Borrelia burgdorferi B31
EIDAIGITN

SEQ ID NO: 32219 - protein, 9 aa, Borrelia burgdorferi B31
IDAIGITNQ

SEQ ID NO: 32220 - protein, 9 aa, Borrelia burgdorferi B31
DAIGITNQR

SEQ ID NO: 32221 - protein, 9 aa, Borrelia burgdorferi B31
AIGITNQRE

SEQ ID NO: 32222 - protein, 9 aa, Borrelia burgdorferi B31
IGITNQRET

SEQ ID NO: 32223 - protein, 9 aa, Borrelia burgdorferi B31
GITNQRETT

SEQ ID NO: 32224 - protein, 9 aa, Borrelia burgdorferi B31
ITNQRETTV

SEQ ID NO: 32225 - protein, 9 aa, Borrelia burgdorferi B31
TNQRETTVI

SEQ ID NO: 32226 - protein, 9 aa, Borrelia burgdorferi B31
NQRETTVIW

SEQ ID NO: 32227 - protein, 9 aa, Borrelia burgdorferi B31
QRETTVIWE

SEQ ID NO: 32228 - protein, 9 aa, Borrelia burgdorferi B31
RETTVIWEK

SEQ ID NO: 32229 - protein, 9 aa, Borrelia burgdorferi B31
ETTVIWEKN

SEQ ID NO: 32230 - protein, 9 aa, Borrelia burgdorferi B31
TTVIWEKNT

SEQ ID NO: 32231 - protein, 9 aa, Borrelia burgdorferi B31
TVIWEKNTG

SEQ ID NO: 32232 - protein, 9 aa, Borrelia burgdorferi B31
VIWEKNTGK

SEQ ID NO: 32233 - protein, 9 aa, Borrelia burgdorferi B31
IWEKNTGKP

SEQ ID NO: 32234 - protein, 9 aa, Borrelia burgdorferi B31
WEKNTGKPI

SEQ ID NO: 32235 - protein, 9 aa, Borrelia burgdorferi B31
EKNTGKPIY

SEQ ID NO: 32236 - protein, 9 aa, Borrelia burgdorferi B31
KNTGKPIYN

SEQ ID NO: 32237 - protein, 9 aa, Borrelia burgdorferi B31
NTGKPIYNA

SEQ ID NO: 32238 - protein, 9 aa, Borrelia burgdorferi B31
TGKPIYNAI

SEQ ID NO: 32239 - protein, 9 aa, Borrelia burgdorferi B31
GKPIYNAIV

SEQ ID NO: 32240 - protein, 9 aa, Borrelia burgdorferi B31
KPIYNAIVW

SEQ ID NO: 32241 - protein, 9 aa, Borrelia burgdorferi B31
PIYNAIVWQ

SEQ ID NO: 32242 - protein, 9 aa, Borrelia burgdorferi B31
IYNAIVWQD

SEQ ID NO: 32243 - protein, 9 aa, Borrelia burgdorferi B31
YNAIVWQDR

SEQ ID NO: 32244 - protein, 9 aa, Borrelia burgdorferi B31
NAIVWQDRR

SEQ ID NO: 32245 - protein, 9 aa, Borrelia burgdorferi B31
AIVWQDRRT

SEQ ID NO: 32246 - protein, 9 aa, Borrelia burgdorferi B31
IVWQDRRTA

SEQ ID NO: 32247 - protein, 9 aa, Borrelia burgdorferi B31
VWQDRRTAK

SEQ ID NO: 32248 - protein, 9 aa, Borrelia burgdorferi B31
WQDRRTAKI

SEQ ID NO: 32249 - protein, 9 aa, Borrelia burgdorferi B31
QDRRTAKIC

SEQ ID NO: 32250 - protein, 9 aa, Borrelia burgdorferi B31
DRRTAKICD

SEQ ID NO: 32251 - protein, 9 aa, Borrelia burgdorferi B31
RRTAKICDQ

SEQ ID NO: 32252 - protein, 9 aa, Borrelia burgdorferi B31
RTAKICDQL

SEQ ID NO: 32253 - protein, 9 aa, Borrelia burgdorferi B31
TAKICDQLK

SEQ ID NO: 32254 - protein, 9 aa, Borrelia burgdorferi B31
AKICDQLKK

SEQ ID NO: 32255 - protein, 9 aa, Borrelia burgdorferi B31
KICDQLKKE

SEQ ID NO: 32256 - protein, 9 aa, Borrelia burgdorferi B31
ICDQLKKEG

SEQ ID NO: 32257 - protein, 9 aa, Borrelia burgdorferi B31
CDQLKKEGK

SEQ ID NO: 32258 - protein, 9 aa, Borrelia burgdorferi B31
DQLKKEGKD

SEQ ID NO: 32259 - protein, 9 aa, Borrelia burgdorferi B31
QLKKEGKDK

SEQ ID NO: 32260 - protein, 9 aa, Borrelia burgdorferi B31
LKKEGKDKI

SEQ ID NO: 32261 - protein, 9 aa, Borrelia burgdorferi B31
KKEGKDKII

SEQ ID NO: 32262 - protein, 9 aa, Borrelia burgdorferi B31
KEGKDKIIL

SEQ ID NO: 32263 - protein, 9 aa, Borrelia burgdorferi B31
EGKDKIILE

SEQ ID NO: 32264 - protein, 9 aa, Borrelia burgdorferi B31
GKDKIILEK

SEQ ID NO: 32265 - protein, 9 aa, Borrelia burgdorferi B31
KDKIILEKT

SEQ ID NO: 32266 - protein, 9 aa, Borrelia burgdorferi B31
DKIILEKTG

SEQ ID NO: 32267 - protein, 9 aa, Borrelia burgdorferi B31
KIILEKTGL

SEQ ID NO: 32268 - protein, 9 aa, Borrelia burgdorferi B31
IILEKTGLV

SEQ ID NO: 32269 - protein, 9 aa, Borrelia burgdorferi B31
ILEKTGLVL

SEQ ID NO: 32270 - protein, 9 aa, Borrelia burgdorferi B31
LEKTGLVLD

SEQ ID NO: 32271 - protein, 9 aa, Borrelia burgdorferi B31
EKTGLVLDS

SEQ ID NO: 32272 - protein, 9 aa, Borrelia burgdorferi B31
KTGLVLDSY

SEQ ID NO: 32273 - protein, 9 aa, Borrelia burgdorferi B31
TGLVLDSYF

SEQ ID NO: 32274 - protein, 9 aa, Borrelia burgdorferi B31
GLVLDSYFS

SEQ ID NO: 32275 - protein, 9 aa, Borrelia burgdorferi B31
LVLDSYFSG

SEQ ID NO: 32276 - protein, 9 aa, Borrelia burgdorferi B31
VLDSYFSGT

SEQ ID NO: 32277 - protein, 9 aa, Borrelia burgdorferi B31
LDSYFSGTK

SEQ ID NO: 32278 - protein, 9 aa, Borrelia burgdorferi B31
DSYFSGTKI

SEQ ID NO: 32279 - protein, 9 aa, Borrelia burgdorferi B31
SYFSGTKIM

SEQ ID NO: 32280 - protein, 9 aa, Borrelia burgdorferi B31
YFSGTKIMW

SEQ ID NO: 32281 - protein, 9 aa, Borrelia burgdorferi B31
FSGTKIMWI

SEQ ID NO: 32282 - protein, 9 aa, Borrelia burgdorferi B31
SGTKIMWIL

SEQ ID NO: 32283 - protein, 9 aa, Borrelia burgdorferi B31
GTKIMWILD

SEQ ID NO: 32284 - protein, 9 aa, Borrelia burgdorferi B31
TKIMWILDN

SEQ ID NO: 32285 - protein, 9 aa, Borrelia burgdorferi B31
KIMWILDNV

SEQ ID NO: 32286 - protein, 9 aa, Borrelia burgdorferi B31
IMWILDNVE

SEQ ID NO: 32287 - protein, 9 aa, Borrelia burgdorferi B31
MWILDNVEG

SEQ ID NO: 32288 - protein, 9 aa, Borrelia burgdorferi B31
WILDNVEGA

SEQ ID NO: 32289 - protein, 9 aa, Borrelia burgdorferi B31
ILDNVEGAR

SEQ ID NO: 32290 - protein, 9 aa, Borrelia burgdorferi B31
LDNVEGARQ

SEQ ID NO: 32291 - protein, 9 aa, Borrelia burgdorferi B31
DNVEGARQR

SEQ ID NO: 32292 - protein, 9 aa, Borrelia burgdorferi B31
NVEGARQRA

SEQ ID NO: 32293 - protein, 9 aa, Borrelia burgdorferi B31
VEGARQRAE

SEQ ID NO: 32294 - protein, 9 aa, Borrelia burgdorferi B31
EGARQRAEN

SEQ ID NO: 32295 - protein, 9 aa, Borrelia burgdorferi B31
GARQRAENG

SEQ ID NO: 32296 - protein, 9 aa, Borrelia burgdorferi B31
ARQRAENGE

SEQ ID NO: 32297 - protein, 9 aa, Borrelia burgdorferi B31
RQRAENGEL

SEQ ID NO: 32298 - protein, 9 aa, Borrelia burgdorferi B31
QRAENGELC

SEQ ID NO: 32299 - protein, 9 aa, Borrelia burgdorferi B31
RAENGELCF

SEQ ID NO: 32300 - protein, 9 aa, Borrelia burgdorferi B31
AENGELCFG

SEQ ID NO: 32301 - protein, 9 aa, Borrelia burgdorferi B31
ENGELCFGT

SEQ ID NO: 32302 - protein, 9 aa, Borrelia burgdorferi B31
NGELCFGTI

SEQ ID NO: 32303 - protein, 9 aa, Borrelia burgdorferi B31
GELCFGTID

SEQ ID NO: 32304 - protein, 9 aa, Borrelia burgdorferi B31
ELCFGTIDT

SEQ ID NO: 32305 - protein, 9 aa, Borrelia burgdorferi B31
LCFGTIDTW

SEQ ID NO: 32306 - protein, 9 aa, Borrelia burgdorferi B31
CFGTIDTWI

SEQ ID NO: 32307 - protein, 9 aa, Borrelia burgdorferi B31
FGTIDTWIL

SEQ ID NO: 32308 - protein, 9 aa, Borrelia burgdorferi B31
GTIDTWILW

SEQ ID NO: 32309 - protein, 9 aa, Borrelia burgdorferi B31
TIDTWILWN

SEQ ID NO: 32310 - protein, 9 aa, Borrelia burgdorferi B31
IDTWILWNL

SEQ ID NO: 32311 - protein, 9 aa, Borrelia burgdorferi B31
DTWILWNLT

SEQ ID NO: 32312 - protein, 9 aa, Borrelia burgdorferi B31
TWILWNLTQ

SEQ ID NO: 32313 - protein, 9 aa, Borrelia burgdorferi B31
WILWNLTQK

SEQ ID NO: 32314 - protein, 9 aa, Borrelia burgdorferi B31
ILWNLTQKK

SEQ ID NO: 32315 - protein, 9 aa, Borrelia burgdorferi B31
LWNLTQKKE

SEQ ID NO: 32316 - protein, 9 aa, Borrelia burgdorferi B31
WNLTQKKEH

SEQ ID NO: 32317 - protein, 9 aa, Borrelia burgdorferi B31
NLTQKKEHA

SEQ ID NO: 32318 - protein, 9 aa, Borrelia burgdorferi B31
LTQKKEHAT

SEQ ID NO: 32319 - protein, 9 aa, Borrelia burgdorferi B31
TQKKEHATD

SEQ ID NO: 32320 - protein, 9 aa, Borrelia burgdorferi B31
QKKEHATDY

SEQ ID NO: 32321 - protein, 9 aa, Borrelia burgdorferi B31
KKEHATDYS

SEQ ID NO: 32322 - protein, 9 aa, Borrelia burgdorferi B31
KEHATDYSN

SEQ ID NO: 32323 - protein, 9 aa, Borrelia burgdorferi B31
EHATDYSNA

SEQ ID NO: 32324 - protein, 9 aa, Borrelia burgdorferi B31
HATDYSNAS

SEQ ID NO: 32325 - protein, 9 aa, Borrelia burgdorferi B31
ATDYSNASR

SEQ ID NO: 32326 - protein, 9 aa, Borrelia burgdorferi B31
TDYSNASRT

SEQ ID NO: 32327 - protein, 9 aa, Borrelia burgdorferi B31
DYSNASRTL

SEQ ID NO: 32328 - protein, 9 aa, Borrelia burgdorferi B31
YSNASRTLL

SEQ ID NO: 32329 - protein, 9 aa, Borrelia burgdorferi B31
SNASRTLLL

SEQ ID NO: 32330 - protein, 9 aa, Borrelia burgdorferi B31
NASRTLLLN

SEQ ID NO: 32331 - protein, 9 aa, Borrelia burgdorferi B31
ASRTLLLNI

SEQ ID NO: 32332 - protein, 9 aa, Borrelia burgdorferi B31
SRTLLLNIK

SEQ ID NO: 32333 - protein, 9 aa, Borrelia burgdorferi B31
RTLLLNIKT

SEQ ID NO: 32334 - protein, 9 aa, Borrelia burgdorferi B31
TLLLNIKTL

SEQ ID NO: 32335 - protein, 9 aa, Borrelia burgdorferi B31
LLLNIKTLE

SEQ ID NO: 32336 - protein, 9 aa, Borrelia burgdorferi B31
LLNIKTLEW

SEQ ID NO: 32337 - protein, 9 aa, Borrelia burgdorferi B31
LNIKTLEWD

SEQ ID NO: 32338 - protein, 9 aa, Borrelia burgdorferi B31
NIKTLEWDD

SEQ ID NO: 32339 - protein, 9 aa, Borrelia burgdorferi B31
IKTLEWDDE

SEQ ID NO: 32340 - protein, 9 aa, Borrelia burgdorferi B31
KTLEWDDEL

SEQ ID NO: 32341 - protein, 9 aa, Borrelia burgdorferi B31
TLEWDDELL

SEQ ID NO: 32342 - protein, 9 aa, Borrelia burgdorferi B31
LEWDDELLS

SEQ ID NO: 32343 - protein, 9 aa, Borrelia burgdorferi B31
EWDDELLSI

SEQ ID NO: 32344 - protein, 9 aa, Borrelia burgdorferi B31
WDDELLSIL

SEQ ID NO: 32345 - protein, 9 aa, Borrelia burgdorferi B31
DDELLSILN

SEQ ID NO: 32346 - protein, 9 aa, Borrelia burgdorferi B31
DELLSILNV

SEQ ID NO: 32347 - protein, 9 aa, Borrelia burgdorferi B31
ELLSILNVP

SEQ ID NO: 32348 - protein, 9 aa, Borrelia burgdorferi B31
LLSILNVPR

SEQ ID NO: 32349 - protein, 9 aa, Borrelia burgdorferi B31
LSILNVPRA

SEQ ID NO: 32350 - protein, 9 aa, Borrelia burgdorferi B31
SILNVPRAI

SEQ ID NO: 32351 - protein, 9 aa, Borrelia burgdorferi B31
ILNVPRAIL

SEQ ID NO: 32352 - protein, 9 aa, Borrelia burgdorferi B31
LNVPRAILP

SEQ ID NO: 32353 - protein, 9 aa, Borrelia burgdorferi B31
NVPRAILPE

SEQ ID NO: 32354 - protein, 9 aa, Borrelia burgdorferi B31
VPRAILPEL

SEQ ID NO: 32355 - protein, 9 aa, Borrelia burgdorferi B31
PRAILPELK

SEQ ID NO: 32356 - protein, 9 aa, Borrelia burgdorferi B31
RAILPELKE

SEQ ID NO: 32357 - protein, 9 aa, Borrelia burgdorferi B31
AILPELKES

SEQ ID NO: 32358 - protein, 9 aa, Borrelia burgdorferi B31
ILPELKESS

SEQ ID NO: 32359 - protein, 9 aa, Borrelia burgdorferi B31
LPELKESST

SEQ ID NO: 32360 - protein, 9 aa, Borrelia burgdorferi B31
PELKESSTI

SEQ ID NO: 32361 - protein, 9 aa, Borrelia burgdorferi B31
ELKESSTIY

SEQ ID NO: 32362 - protein, 9 aa, Borrelia burgdorferi B31
LKESSTIYG

SEQ ID NO: 32363 - protein, 9 aa, Borrelia burgdorferi B31
KESSTIYGK

SEQ ID NO: 32364 - protein, 9 aa, Borrelia burgdorferi B31
ESSTIYGKT

SEQ ID NO: 32365 - protein, 9 aa, Borrelia burgdorferi B31
SSTIYGKTD

SEQ ID NO: 32366 - protein, 9 aa, Borrelia burgdorferi B31
STIYGKTDK

SEQ ID NO: 32367 - protein, 9 aa, Borrelia burgdorferi B31
TIYGKTDKA

SEQ ID NO: 32368 - protein, 9 aa, Borrelia burgdorferi B31
IYGKTDKAL

SEQ ID NO: 32369 - protein, 9 aa, Borrelia burgdorferi B31
YGKTDKALF

SEQ ID NO: 32370 - protein, 9 aa, Borrelia burgdorferi B31
GKTDKALFG

SEQ ID NO: 32371 - protein, 9 aa, Borrelia burgdorferi B31
KTDKALFGA

SEQ ID NO: 32372 - protein, 9 aa, Borrelia burgdorferi B31
TDKALFGAE

SEQ ID NO: 32373 - protein, 9 aa, Borrelia burgdorferi B31
DKALFGAEI

SEQ ID NO: 32374 - protein, 9 aa, Borrelia burgdorferi B31
KALFGAEIP

SEQ ID NO: 32375 - protein, 9 aa, Borrelia burgdorferi B31
ALFGAEIPI

SEQ ID NO: 32376 - protein, 9 aa, Borrelia burgdorferi B31
LFGAEIPIA

SEQ ID NO: 32377 - protein, 9 aa, Borrelia burgdorferi B31
FGAEIPIAG

SEQ ID NO: 32378 - protein, 9 aa, Borrelia burgdorferi B31
GAEIPIAGI

SEQ ID NO: 32379 - protein, 9 aa, Borrelia burgdorferi B31
AEIPIAGIA

SEQ ID NO: 32380 - protein, 9 aa, Borrelia burgdorferi B31
EIPIAGIAG

SEQ ID NO: 32381 - protein, 9 aa, Borrelia burgdorferi B31
IPIAGIAGD

SEQ ID NO: 32382 - protein, 9 aa, Borrelia burgdorferi B31
PIAGIAGDQ

SEQ ID NO: 32383 - protein, 9 aa, Borrelia burgdorferi B31
IAGIAGDQF

SEQ ID NO: 32384 - protein, 9 aa, Borrelia burgdorferi B31
AGIAGDQFA

SEQ ID NO: 32385 - protein, 9 aa, Borrelia burgdorferi B31
GIAGDQFAA

SEQ ID NO: 32386 - protein, 9 aa, Borrelia burgdorferi B31
IAGDQFAAT

SEQ ID NO: 32387 - protein, 9 aa, Borrelia burgdorferi B31
AGDQFAATF

SEQ ID NO: 32388 - protein, 9 aa, Borrelia burgdorferi B31
GDQFAATFG

SEQ ID NO: 32389 - protein, 9 aa, Borrelia burgdorferi B31
DQFAATFGQ

SEQ ID NO: 32390 - protein, 9 aa, Borrelia burgdorferi B31
QFAATFGQA

SEQ ID NO: 32391 - protein, 9 aa, Borrelia burgdorferi B31
FAATFGQAC

SEQ ID NO: 32392 - protein, 9 aa, Borrelia burgdorferi B31
AATFGQACL

SEQ ID NO: 32393 - protein, 9 aa, Borrelia burgdorferi B31
ATFGQACLK

SEQ ID NO: 32394 - protein, 9 aa, Borrelia burgdorferi B31
TFGQACLKK

SEQ ID NO: 32395 - protein, 9 aa, Borrelia burgdorferi B31
FGQACLKKG

SEQ ID NO: 32396 - protein, 9 aa, Borrelia burgdorferi B31
GQACLKKGM

SEQ ID NO: 32397 - protein, 9 aa, Borrelia burgdorferi B31
QACLKKGMA

SEQ ID NO: 32398 - protein, 9 aa, Borrelia burgdorferi B31
ACLKKGMAK

SEQ ID NO: 32399 - protein, 9 aa, Borrelia burgdorferi B31
CLKKGMAKN

SEQ ID NO: 32400 - protein, 9 aa, Borrelia burgdorferi B31
LKKGMAKNT

SEQ ID NO: 32401 - protein, 9 aa, Borrelia burgdorferi B31
KKGMAKNTY

SEQ ID NO: 32402 - protein, 9 aa, Borrelia burgdorferi B31
KGMAKNTYG

SEQ ID NO: 32403 - protein, 9 aa, Borrelia burgdorferi B31
GMAKNTYGT

SEQ ID NO: 32404 - protein, 9 aa, Borrelia burgdorferi B31
MAKNTYGTG

SEQ ID NO: 32405 - protein, 9 aa, Borrelia burgdorferi B31
AKNTYGTGC

SEQ ID NO: 32406 - protein, 9 aa, Borrelia burgdorferi B31
KNTYGTGCF

SEQ ID NO: 32407 - protein, 9 aa, Borrelia burgdorferi B31
NTYGTGCFL

SEQ ID NO: 32408 - protein, 9 aa, Borrelia burgdorferi B31
TYGTGCFLT

SEQ ID NO: 32409 - protein, 9 aa, Borrelia burgdorferi B31
YGTGCFLTV

SEQ ID NO: 32410 - protein, 9 aa, Borrelia burgdorferi B31
GTGCFLTVN

SEQ ID NO: 32411 - protein, 9 aa, Borrelia burgdorferi B31
TGCFLTVNI

SEQ ID NO: 32412 - protein, 9 aa, Borrelia burgdorferi B31
GCFLTVNIG

SEQ ID NO: 32413 - protein, 9 aa, Borrelia burgdorferi B31
CFLTVNIGK

SEQ ID NO: 32414 - protein, 9 aa, Borrelia burgdorferi B31
FLTVNIGKE

SEQ ID NO: 32415 - protein, 9 aa, Borrelia burgdorferi B31
LTVNIGKEP

SEQ ID NO: 32416 - protein, 9 aa, Borrelia burgdorferi B31
TVNIGKEPI

SEQ ID NO: 32417 - protein, 9 aa, Borrelia burgdorferi B31
VNIGKEPII

SEQ ID NO: 32418 - protein, 9 aa, Borrelia burgdorferi B31
NIGKEPIIS

SEQ ID NO: 32419 - protein, 9 aa, Borrelia burgdorferi B31
IGKEPIISH

SEQ ID NO: 32420 - protein, 9 aa, Borrelia burgdorferi B31
GKEPIISHD

SEQ ID NO: 32421 - protein, 9 aa, Borrelia burgdorferi B31
KEPIISHDK

SEQ ID NO: 32422 - protein, 9 aa, Borrelia burgdorferi B31
EPIISHDKL

SEQ ID NO: 32423 - protein, 9 aa, Borrelia burgdorferi B31
PIISHDKLL

SEQ ID NO: 32424 - protein, 9 aa, Borrelia burgdorferi B31
IISHDKLLT

SEQ ID NO: 32425 - protein, 9 aa, Borrelia burgdorferi B31
ISHDKLLTS

SEQ ID NO: 32426 - protein, 9 aa, Borrelia burgdorferi B31
SHDKLLTSI

SEQ ID NO: 32427 - protein, 9 aa, Borrelia burgdorferi B31
HDKLLTSIA

SEQ ID NO: 32428 - protein, 9 aa, Borrelia burgdorferi B31
DKLLTSIAW

SEQ ID NO: 32429 - protein, 9 aa, Borrelia burgdorferi B31
KLLTSIAWG

SEQ ID NO: 32430 - protein, 9 aa, Borrelia burgdorferi B31
LLTSIAWGR

SEQ ID NO: 32431 - protein, 9 aa, Borrelia burgdorferi B31
LTSIAWGRK

SEQ ID NO: 32432 - protein, 9 aa, Borrelia burgdorferi B31
TSIAWGRKK

SEQ ID NO: 32433 - protein, 9 aa, Borrelia burgdorferi B31
SIAWGRKKS

SEQ ID NO: 32434 - protein, 9 aa, Borrelia burgdorferi B31
IAWGRKKSV

SEQ ID NO: 32435 - protein, 9 aa, Borrelia burgdorferi B31
AWGRKKSVT

SEQ ID NO: 32436 - protein, 9 aa, Borrelia burgdorferi B31
WGRKKSVTY

SEQ ID NO: 32437 - protein, 9 aa, Borrelia burgdorferi B31
GRKKSVTYV

SEQ ID NO: 32438 - protein, 9 aa, Borrelia burgdorferi B31
RKKSVTYVL

SEQ ID NO: 32439 - protein, 9 aa, Borrelia burgdorferi B31
KKSVTYVLE

SEQ ID NO: 32440 - protein, 9 aa, Borrelia burgdorferi B31
KSVTYVLEG

SEQ ID NO: 32441 - protein, 9 aa, Borrelia burgdorferi B31
SVTYVLEGS

SEQ ID NO: 32442 - protein, 9 aa, Borrelia burgdorferi B31
VTYVLEGSV

SEQ ID NO: 32443 - protein, 9 aa, Borrelia burgdorferi B31
TYVLEGSVF

SEQ ID NO: 32444 - protein, 9 aa, Borrelia burgdorferi B31
YVLEGSVFI

SEQ ID NO: 32445 - protein, 9 aa, Borrelia burgdorferi B31
VLEGSVFIG

SEQ ID NO: 32446 - protein, 9 aa, Borrelia burgdorferi B31
LEGSVFIGG

SEQ ID NO: 32447 - protein, 9 aa, Borrelia burgdorferi B31
EGSVFIGGA

SEQ ID NO: 32448 - protein, 9 aa, Borrelia burgdorferi B31
GSVFIGGAV

SEQ ID NO: 32449 - protein, 9 aa, Borrelia burgdorferi B31
SVFIGGAVI

SEQ ID NO: 32450 - protein, 9 aa, Borrelia burgdorferi B31
VFIGGAVIQ

SEQ ID NO: 32451 - protein, 9 aa, Borrelia burgdorferi B31
FIGGAVIQW

SEQ ID NO: 32452 - protein, 9 aa, Borrelia burgdorferi B31
IGGAVIQWL

SEQ ID NO: 32453 - protein, 9 aa, Borrelia burgdorferi B31
GGAVIQWLR

SEQ ID NO: 32454 - protein, 9 aa, Borrelia burgdorferi B31
GAVIQWLRD

SEQ ID NO: 32455 - protein, 9 aa, Borrelia burgdorferi B31
AVIQWLRDG

SEQ ID NO: 32456 - protein, 9 aa, Borrelia burgdorferi B31
VIQWLRDGL

SEQ ID NO: 32457 - protein, 9 aa, Borrelia burgdorferi B31
IQWLRDGLE

SEQ ID NO: 32458 - protein, 9 aa, Borrelia burgdorferi B31
QWLRDGLEF

SEQ ID NO: 32459 - protein, 9 aa, Borrelia burgdorferi B31
WLRDGLEFF

SEQ ID NO: 32460 - protein, 9 aa, Borrelia burgdorferi B31
LRDGLEFFR

SEQ ID NO: 32461 - protein, 9 aa, Borrelia burgdorferi B31
RDGLEFFRK

SEQ ID NO: 32462 - protein, 9 aa, Borrelia burgdorferi B31
DGLEFFRKS

SEQ ID NO: 32463 - protein, 9 aa, Borrelia burgdorferi B31
GLEFFRKSS

SEQ ID NO: 32464 - protein, 9 aa, Borrelia burgdorferi B31
LEFFRKSSD

SEQ ID NO: 32465 - protein, 9 aa, Borrelia burgdorferi B31
EFFRKSSDA

SEQ ID NO: 32466 - protein, 9 aa, Borrelia burgdorferi B31
FFRKSSDAE

SEQ ID NO: 32467 - protein, 9 aa, Borrelia burgdorferi B31
FRKSSDAEA

SEQ ID NO: 32468 - protein, 9 aa, Borrelia burgdorferi B31
RKSSDAEAL

SEQ ID NO: 32469 - protein, 9 aa, Borrelia burgdorferi B31
KSSDAEALA

SEQ ID NO: 32470 - protein, 9 aa, Borrelia burgdorferi B31
SSDAEALAS

SEQ ID NO: 32471 - protein, 9 aa, Borrelia burgdorferi B31
SDAEALASS

SEQ ID NO: 32472 - protein, 9 aa, Borrelia burgdorferi B31
DAEALASSV

SEQ ID NO: 32473 - protein, 9 aa, Borrelia burgdorferi B31
AEALASSVS

SEQ ID NO: 32474 - protein, 9 aa, Borrelia burgdorferi B31
EALASSVSD

SEQ ID NO: 32475 - protein, 9 aa, Borrelia burgdorferi B31
ALASSVSDN

SEQ ID NO: 32476 - protein, 9 aa, Borrelia burgdorferi B31
LASSVSDNG

SEQ ID NO: 32477 - protein, 9 aa, Borrelia burgdorferi B31
ASSVSDNGG

SEQ ID NO: 32478 - protein, 9 aa, Borrelia burgdorferi B31
SSVSDNGGV

SEQ ID NO: 32479 - protein, 9 aa, Borrelia burgdorferi B31
SVSDNGGVY

SEQ ID NO: 32480 - protein, 9 aa, Borrelia burgdorferi B31
VSDNGGVYF

SEQ ID NO: 32481 - protein, 9 aa, Borrelia burgdorferi B31
SDNGGVYFV

SEQ ID NO: 32482 - protein, 9 aa, Borrelia burgdorferi B31
DNGGVYFVP

SEQ ID NO: 32483 - protein, 9 aa, Borrelia burgdorferi B31
NGGVYFVPA

SEQ ID NO: 32484 - protein, 9 aa, Borrelia burgdorferi B31
GGVYFVPAF

SEQ ID NO: 32485 - protein, 9 aa, Borrelia burgdorferi B31
GVYFVPAFV

SEQ ID NO: 32486 - protein, 9 aa, Borrelia burgdorferi B31
VYFVPAFVG

SEQ ID NO: 32487 - protein, 9 aa, Borrelia burgdorferi B31
YFVPAFVGL

SEQ ID NO: 32488 - protein, 9 aa, Borrelia burgdorferi B31
FVPAFVGLG

SEQ ID NO: 32489 - protein, 9 aa, Borrelia burgdorferi B31
VPAFVGLGA

SEQ ID NO: 32490 - protein, 9 aa, Borrelia burgdorferi B31
PAFVGLGAP

SEQ ID NO: 32491 - protein, 9 aa, Borrelia burgdorferi B31
AFVGLGAPH

SEQ ID NO: 32492 - protein, 9 aa, Borrelia burgdorferi B31
FVGLGAPHW

SEQ ID NO: 32493 - protein, 9 aa, Borrelia burgdorferi B31
VGLGAPHWD

SEQ ID NO: 32494 - protein, 9 aa, Borrelia burgdorferi B31
GLGAPHWDS

SEQ ID NO: 32495 - protein, 9 aa, Borrelia burgdorferi B31
LGAPHWDSY

SEQ ID NO: 32496 - protein, 9 aa, Borrelia burgdorferi B31
GAPHWDSYA

SEQ ID NO: 32497 - protein, 9 aa, Borrelia burgdorferi B31
APHWDSYAR

SEQ ID NO: 32498 - protein, 9 aa, Borrelia burgdorferi B31
PHWDSYARG

SEQ ID NO: 32499 - protein, 9 aa, Borrelia burgdorferi B31
HWDSYARGT

SEQ ID NO: 32500 - protein, 9 aa, Borrelia burgdorferi B31
WDSYARGTI

SEQ ID NO: 32501 - protein, 9 aa, Borrelia burgdorferi B31
DSYARGTII

SEQ ID NO: 32502 - protein, 9 aa, Borrelia burgdorferi B31
SYARGTIIG

SEQ ID NO: 32503 - protein, 9 aa, Borrelia burgdorferi B31
YARGTIIGI

SEQ ID NO: 32504 - protein, 9 aa, Borrelia burgdorferi B31
ARGTIIGIT

SEQ ID NO: 32505 - protein, 9 aa, Borrelia burgdorferi B31
RGTIIGITR

SEQ ID NO: 32506 - protein, 9 aa, Borrelia burgdorferi B31
GTIIGITRG

SEQ ID NO: 32507 - protein, 9 aa, Borrelia burgdorferi B31
TIIGITRGS

SEQ ID NO: 32508 - protein, 9 aa, Borrelia burgdorferi B31
IIGITRGST

SEQ ID NO: 32509 - protein, 9 aa, Borrelia burgdorferi B31
IGITRGSTK

SEQ ID NO: 32510 - protein, 9 aa, Borrelia burgdorferi B31
GITRGSTKA

SEQ ID NO: 32511 - protein, 9 aa, Borrelia burgdorferi B31
ITRGSTKAH

SEQ ID NO: 32512 - protein, 9 aa, Borrelia burgdorferi B31
TRGSTKAHI

SEQ ID NO: 32513 - protein, 9 aa, Borrelia burgdorferi B31
RGSTKAHIT

SEQ ID NO: 32514 - protein, 9 aa, Borrelia burgdorferi B31
GSTKAHITR

SEQ ID NO: 32515 - protein, 9 aa, Borrelia burgdorferi B31
STKAHITRA

SEQ ID NO: 32516 - protein, 9 aa, Borrelia burgdorferi B31
TKAHITRAA

SEQ ID NO: 32517 - protein, 9 aa, Borrelia burgdorferi B31
KAHITRAAL

SEQ ID NO: 32518 - protein, 9 aa, Borrelia burgdorferi B31
AHITRAALE

SEQ ID NO: 32519 - protein, 9 aa, Borrelia burgdorferi B31
HITRAALES

SEQ ID NO: 32520 - protein, 9 aa, Borrelia burgdorferi B31
ITRAALESI

SEQ ID NO: 32521 - protein, 9 aa, Borrelia burgdorferi B31
TRAALESIA

SEQ ID NO: 32522 - protein, 9 aa, Borrelia burgdorferi B31
RAALESIAF

SEQ ID NO: 32523 - protein, 9 aa, Borrelia burgdorferi B31
AALESIAFQ

SEQ ID NO: 32524 - protein, 9 aa, Borrelia burgdorferi B31
ALESIAFQS

SEQ ID NO: 32525 - protein, 9 aa, Borrelia burgdorferi B31
LESIAFQSF

SEQ ID NO: 32526 - protein, 9 aa, Borrelia burgdorferi B31
ESIAFQSFD

SEQ ID NO: 32527 - protein, 9 aa, Borrelia burgdorferi B31
SIAFQSFDI

SEQ ID NO: 32528 - protein, 9 aa, Borrelia burgdorferi B31
IAFQSFDIL

SEQ ID NO: 32529 - protein, 9 aa, Borrelia burgdorferi B31
AFQSFDILN

SEQ ID NO: 32530 - protein, 9 aa, Borrelia burgdorferi B31
FQSFDILNT

SEQ ID NO: 32531 - protein, 9 aa, Borrelia burgdorferi B31
QSFDILNTM

SEQ ID NO: 32532 - protein, 9 aa, Borrelia burgdorferi B31
SFDILNTMK

SEQ ID NO: 32533 - protein, 9 aa, Borrelia burgdorferi B31
FDILNTMKK

SEQ ID NO: 32534 - protein, 9 aa, Borrelia burgdorferi B31
DILNTMKKS

SEQ ID NO: 32535 - protein, 9 aa, Borrelia burgdorferi B31
ILNTMKKSI

SEQ ID NO: 32536 - protein, 9 aa, Borrelia burgdorferi B31
LNTMKKSIP

SEQ ID NO: 32537 - protein, 9 aa, Borrelia burgdorferi B31
NTMKKSIPN

SEQ ID NO: 32538 - protein, 9 aa, Borrelia burgdorferi B31
TMKKSIPNF

SEQ ID NO: 32539 - protein, 9 aa, Borrelia burgdorferi B31
MKKSIPNFE

SEQ ID NO: 32540 - protein, 9 aa, Borrelia burgdorferi B31
KKSIPNFEI

SEQ ID NO: 32541 - protein, 9 aa, Borrelia burgdorferi B31
KSIPNFEIQ

SEQ ID NO: 32542 - protein, 9 aa, Borrelia burgdorferi B31
SIPNFEIQE

SEQ ID NO: 32543 - protein, 9 aa, Borrelia burgdorferi B31
IPNFEIQEL

SEQ ID NO: 32544 - protein, 9 aa, Borrelia burgdorferi B31
PNFEIQELR

SEQ ID NO: 32545 - protein, 9 aa, Borrelia burgdorferi B31
NFEIQELRV

SEQ ID NO: 32546 - protein, 9 aa, Borrelia burgdorferi B31
FEIQELRVD

SEQ ID NO: 32547 - protein, 9 aa, Borrelia burgdorferi B31
EIQELRVDG

SEQ ID NO: 32548 - protein, 9 aa, Borrelia burgdorferi B31
IQELRVDGG

SEQ ID NO: 32549 - protein, 9 aa, Borrelia burgdorferi B31
QELRVDGGA

SEQ ID NO: 32550 - protein, 9 aa, Borrelia burgdorferi B31
ELRVDGGAS

SEQ ID NO: 32551 - protein, 9 aa, Borrelia burgdorferi B31
LRVDGGASQ

SEQ ID NO: 32552 - protein, 9 aa, Borrelia burgdorferi B31
RVDGGASQN

SEQ ID NO: 32553 - protein, 9 aa, Borrelia burgdorferi B31
VDGGASQNN

SEQ ID NO: 32554 - protein, 9 aa, Borrelia burgdorferi B31
DGGASQNNL

SEQ ID NO: 32555 - protein, 9 aa, Borrelia burgdorferi B31
GGASQNNLL

SEQ ID NO: 32556 - protein, 9 aa, Borrelia burgdorferi B31
GASQNNLLM

SEQ ID NO: 32557 - protein, 9 aa, Borrelia burgdorferi B31
ASQNNLLMQ

SEQ ID NO: 32558 - protein, 9 aa, Borrelia burgdorferi B31
SQNNLLMQF

SEQ ID NO: 32559 - protein, 9 aa, Borrelia burgdorferi B31
QNNLLMQFQ

SEQ ID NO: 32560 - protein, 9 aa, Borrelia burgdorferi B31
NNLLMQFQA

SEQ ID NO: 32561 - protein, 9 aa, Borrelia burgdorferi B31
NLLMQFQAD

SEQ ID NO: 32562 - protein, 9 aa, Borrelia burgdorferi B31
LLMQFQADL

SEQ ID NO: 32563 - protein, 9 aa, Borrelia burgdorferi B31
LMQFQADLL

SEQ ID NO: 32564 - protein, 9 aa, Borrelia burgdorferi B31
MQFQADLLE

SEQ ID NO: 32565 - protein, 9 aa, Borrelia burgdorferi B31
QFQADLLEC

SEQ ID NO: 32566 - protein, 9 aa, Borrelia burgdorferi B31
FQADLLECK

SEQ ID NO: 32567 - protein, 9 aa, Borrelia burgdorferi B31
QADLLECKV

SEQ ID NO: 32568 - protein, 9 aa, Borrelia burgdorferi B31
ADLLECKVV

SEQ ID NO: 32569 - protein, 9 aa, Borrelia burgdorferi B31
DLLECKVVR

SEQ ID NO: 32570 - protein, 9 aa, Borrelia burgdorferi B31
LLECKVVRP

SEQ ID NO: 32571 - protein, 9 aa, Borrelia burgdorferi B31
LECKVVRPK

SEQ ID NO: 32572 - protein, 9 aa, Borrelia burgdorferi B31
ECKVVRPKI

SEQ ID NO: 32573 - protein, 9 aa, Borrelia burgdorferi B31
CKVVRPKIT

SEQ ID NO: 32574 - protein, 9 aa, Borrelia burgdorferi B31
KVVRPKITE

SEQ ID NO: 32575 - protein, 9 aa, Borrelia burgdorferi B31
VVRPKITET

SEQ ID NO: 32576 - protein, 9 aa, Borrelia burgdorferi B31
VRPKITETT

SEQ ID NO: 32577 - protein, 9 aa, Borrelia burgdorferi B31
RPKITETTA

SEQ ID NO: 32578 - protein, 9 aa, Borrelia burgdorferi B31
PKITETTAL

SEQ ID NO: 32579 - protein, 9 aa, Borrelia burgdorferi B31
KITETTALG

SEQ ID NO: 32580 - protein, 9 aa, Borrelia burgdorferi B31
ITETTALGA

SEQ ID NO: 32581 - protein, 9 aa, Borrelia burgdorferi B31
TETTALGAA

SEQ ID NO: 32582 - protein, 9 aa, Borrelia burgdorferi B31
ETTALGAAY

SEQ ID NO: 32583 - protein, 9 aa, Borrelia burgdorferi B31
TTALGAAYL

SEQ ID NO: 32584 - protein, 9 aa, Borrelia burgdorferi B31
TALGAAYLA

SEQ ID NO: 32585 - protein, 9 aa, Borrelia burgdorferi B31
ALGAAYLAG

SEQ ID NO: 32586 - protein, 9 aa, Borrelia burgdorferi B31
LGAAYLAGL

SEQ ID NO: 32587 - protein, 9 aa, Borrelia burgdorferi B31
GAAYLAGLA

SEQ ID NO: 32588 - protein, 9 aa, Borrelia burgdorferi B31
AAYLAGLAT

SEQ ID NO: 32589 - protein, 9 aa, Borrelia burgdorferi B31
AYLAGLATG

SEQ ID NO: 32590 - protein, 9 aa, Borrelia burgdorferi B31
YLAGLATGY

SEQ ID NO: 32591 - protein, 9 aa, Borrelia burgdorferi B31
LAGLATGYW

SEQ ID NO: 32592 - protein, 9 aa, Borrelia burgdorferi B31
AGLATGYWQ

SEQ ID NO: 32593 - protein, 9 aa, Borrelia burgdorferi B31
GLATGYWQS

SEQ ID NO: 32594 - protein, 9 aa, Borrelia burgdorferi B31
LATGYWQSA

SEQ ID NO: 32595 - protein, 9 aa, Borrelia burgdorferi B31
ATGYWQSAE

SEQ ID NO: 32596 - protein, 9 aa, Borrelia burgdorferi B31
TGYWQSAEE

SEQ ID NO: 32597 - protein, 9 aa, Borrelia burgdorferi B31
GYWQSAEEI

SEQ ID NO: 32598 - protein, 9 aa, Borrelia burgdorferi B31
YWQSAEEIV

SEQ ID NO: 32599 - protein, 9 aa, Borrelia burgdorferi B31
WQSAEEIVS

SEQ ID NO: 32600 - protein, 9 aa, Borrelia burgdorferi B31
QSAEEIVSL

SEQ ID NO: 32601 - protein, 9 aa, Borrelia burgdorferi B31
SAEEIVSLW

SEQ ID NO: 32602 - protein, 9 aa, Borrelia burgdorferi B31
AEEIVSLWQ

SEQ ID NO: 32603 - protein, 9 aa, Borrelia burgdorferi B31
EEIVSLWQV

SEQ ID NO: 32604 - protein, 9 aa, Borrelia burgdorferi B31
EIVSLWQVD

SEQ ID NO: 32605 - protein, 9 aa, Borrelia burgdorferi B31
IVSLWQVDK

SEQ ID NO: 32606 - protein, 9 aa, Borrelia burgdorferi B31
VSLWQVDKI

SEQ ID NO: 32607 - protein, 9 aa, Borrelia burgdorferi B31
SLWQVDKIF

SEQ ID NO: 32608 - protein, 9 aa, Borrelia burgdorferi B31
LWQVDKIFE

SEQ ID NO: 32609 - protein, 9 aa, Borrelia burgdorferi B31
WQVDKIFEP

SEQ ID NO: 32610 - protein, 9 aa, Borrelia burgdorferi B31
QVDKIFEPS

SEQ ID NO: 32611 - protein, 9 aa, Borrelia burgdorferi B31
VDKIFEPSM

SEQ ID NO: 32612 - protein, 9 aa, Borrelia burgdorferi B31
DKIFEPSMP

SEQ ID NO: 32613 - protein, 9 aa, Borrelia burgdorferi B31
KIFEPSMPK

SEQ ID NO: 32614 - protein, 9 aa, Borrelia burgdorferi B31
IFEPSMPKN

SEQ ID NO: 32615 - protein, 9 aa, Borrelia burgdorferi B31
FEPSMPKNQ

SEQ ID NO: 32616 - protein, 9 aa, Borrelia burgdorferi B31
EPSMPKNQK

SEQ ID NO: 32617 - protein, 9 aa, Borrelia burgdorferi B31
PSMPKNQKE

SEQ ID NO: 32618 - protein, 9 aa, Borrelia burgdorferi B31
SMPKNQKEK

SEQ ID NO: 32619 - protein, 9 aa, Borrelia burgdorferi B31
MPKNQKEKL

SEQ ID NO: 32620 - protein, 9 aa, Borrelia burgdorferi B31
PKNQKEKLL

SEQ ID NO: 32621 - protein, 9 aa, Borrelia burgdorferi B31
KNQKEKLLE

SEQ ID NO: 32622 - protein, 9 aa, Borrelia burgdorferi B31
NQKEKLLEN

SEQ ID NO: 32623 - protein, 9 aa, Borrelia burgdorferi B31
QKEKLLENW

SEQ ID NO: 32624 - protein, 9 aa, Borrelia burgdorferi B31
KEKLLENWN

SEQ ID NO: 32625 - protein, 9 aa, Borrelia burgdorferi B31
EKLLENWNK

SEQ ID NO: 32626 - protein, 9 aa, Borrelia burgdorferi B31
KLLENWNKA

SEQ ID NO: 32627 - protein, 9 aa, Borrelia burgdorferi B31
LLENWNKAV

SEQ ID NO: 32628 - protein, 9 aa, Borrelia burgdorferi B31
LENWNKAVG

SEQ ID NO: 32629 - protein, 9 aa, Borrelia burgdorferi B31
ENWNKAVGK

SEQ ID NO: 32630 - protein, 9 aa, Borrelia burgdorferi B31
NWNKAVGKA

SEQ ID NO: 32631 - protein, 9 aa, Borrelia burgdorferi B31
WNKAVGKAK

SEQ ID NO: 32632 - protein, 9 aa, Borrelia burgdorferi B31
NKAVGKAKS

SEQ ID NO: 32633 - protein, 9 aa, Borrelia burgdorferi B31
KAVGKAKSW

SEQ ID NO: 32634 - protein, 9 aa, Borrelia burgdorferi B31
AVGKAKSWI

SEQ ID NO: 32635 - protein, 9 aa, Borrelia burgdorferi B31
VGKAKSWIQ

SEQ ID NO: 32636 - protein, 9 aa, Borrelia burgdorferi B31
GKAKSWIQN

SEQ ID NO: 32637 - protein, 9 aa, Borrelia burgdorferi B31
KAKSWIQNS

SEQ ID NO: 32638 - protein, 9 aa, Borrelia burgdorferi B31
AKSWIQNSH

SEQ ID NO: 32639 - protein, 9 aa, Borrelia burgdorferi B31
KSWIQNSHS

SEQ ID NO: 32640 - protein, 9 aa, Borrelia burgdorferi B31
SWIQNSHSS

SEQ ID NO: 32641 - protein, 10 aa, Borrelia burgdorferi B31
MKYILSIDQG

SEQ ID NO: 32642 - protein, 10 aa, Borrelia burgdorferi B31
KYILSIDQGT

SEQ ID NO: 32643 - protein, 10 aa, Borrelia burgdorferi B31
YILSIDQGTT

SEQ ID NO: 32644 - protein, 10 aa, Borrelia burgdorferi B31
ILSIDQGTTS

SEQ ID NO: 32645 - protein, 10 aa, Borrelia burgdorferi B31
LSIDQGTTSS

SEQ ID NO: 32646 - protein, 10 aa, Borrelia burgdorferi B31
SIDQGTTSSR

SEQ ID NO: 32647 - protein, 10 aa, Borrelia burgdorferi B31
IDQGTTSSRA

SEQ ID NO: 32648 - protein, 10 aa, Borrelia burgdorferi B31
DQGTTSSRAM

SEQ ID NO: 32649 - protein, 10 aa, Borrelia burgdorferi B31
QGTTSSRAMV

SEQ ID NO: 32650 - protein, 10 aa, Borrelia burgdorferi B31
GTTSSRAMVF

SEQ ID NO: 32651 - protein, 10 aa, Borrelia burgdorferi B31
TTSSRAMVFD

SEQ ID NO: 32652 - protein, 10 aa, Borrelia burgdorferi B31
TSSRAMVFDK

SEQ ID NO: 32653 - protein, 10 aa, Borrelia burgdorferi B31
SSRAMVFDKN

SEQ ID NO: 32654 - protein, 10 aa, Borrelia burgdorferi B31
SRAMVFDKNA

SEQ ID NO: 32655 - protein, 10 aa, Borrelia burgdorferi B31
RAMVFDKNAN

SEQ ID NO: 32656 - protein, 10 aa, Borrelia burgdorferi B31
AMVFDKNANI

SEQ ID NO: 32657 - protein, 10 aa, Borrelia burgdorferi B31
MVFDKNANIK

SEQ ID NO: 32658 - protein, 10 aa, Borrelia burgdorferi B31
VFDKNANIKG

SEQ ID NO: 32659 - protein, 10 aa, Borrelia burgdorferi B31
FDKNANIKGF

SEQ ID NO: 32660 - protein, 10 aa, Borrelia burgdorferi B31
DKNANIKGFA

SEQ ID NO: 32661 - protein, 10 aa, Borrelia burgdorferi B31
KNANIKGFAQ

SEQ ID NO: 32662 - protein, 10 aa, Borrelia burgdorferi B31
NANIKGFAQK

SEQ ID NO: 32663 - protein, 10 aa, Borrelia burgdorferi B31
ANIKGFAQKE

SEQ ID NO: 32664 - protein, 10 aa, Borrelia burgdorferi B31
NIKGFAQKEF

SEQ ID NO: 32665 - protein, 10 aa, Borrelia burgdorferi B31
IKGFAQKEFT

SEQ ID NO: 32666 - protein, 10 aa, Borrelia burgdorferi B31
KGFAQKEFTQ

SEQ ID NO: 32667 - protein, 10 aa, Borrelia burgdorferi B31
GFAQKEFTQI

SEQ ID NO: 32668 - protein, 10 aa, Borrelia burgdorferi B31
FAQKEFTQIY

SEQ ID NO: 32669 - protein, 10 aa, Borrelia burgdorferi B31
AQKEFTQIYP

SEQ ID NO: 32670 - protein, 10 aa, Borrelia burgdorferi B31
QKEFTQIYPQ

SEQ ID NO: 32671 - protein, 10 aa, Borrelia burgdorferi B31
KEFTQIYPQP

SEQ ID NO: 32672 - protein, 10 aa, Borrelia burgdorferi B31
EFTQIYPQPS

SEQ ID NO: 32673 - protein, 10 aa, Borrelia burgdorferi B31
FTQIYPQPSW

SEQ ID NO: 32674 - protein, 10 aa, Borrelia burgdorferi B31
TQIYPQPSWV

SEQ ID NO: 32675 - protein, 10 aa, Borrelia burgdorferi B31
QIYPQPSWVE

SEQ ID NO: 32676 - protein, 10 aa, Borrelia burgdorferi B31
IYPQPSWVEH

SEQ ID NO: 32677 - protein, 10 aa, Borrelia burgdorferi B31
YPQPSWVEHD

SEQ ID NO: 32678 - protein, 10 aa, Borrelia burgdorferi B31
PQPSWVEHDP

SEQ ID NO: 32679 - protein, 10 aa, Borrelia burgdorferi B31
QPSWVEHDPT

SEQ ID NO: 32680 - protein, 10 aa, Borrelia burgdorferi B31
PSWVEHDPTE

SEQ ID NO: 32681 - protein, 10 aa, Borrelia burgdorferi B31
SWVEHDPTEI

SEQ ID NO: 32682 - protein, 10 aa, Borrelia burgdorferi B31
WVEHDPTEIW

SEQ ID NO: 32683 - protein, 10 aa, Borrelia burgdorferi B31
VEHDPTEIWG

SEQ ID NO: 32684 - protein, 10 aa, Borrelia burgdorferi B31
EHDPTEIWGS

SEQ ID NO: 32685 - protein, 10 aa, Borrelia burgdorferi B31
HDPTEIWGSQ

SEQ ID NO: 32686 - protein, 10 aa, Borrelia burgdorferi B31
DPTEIWGSQL

SEQ ID NO: 32687 - protein, 10 aa, Borrelia burgdorferi B31
PTEIWGSQLG

SEQ ID NO: 32688 - protein, 10 aa, Borrelia burgdorferi B31
TEIWGSQLGV

SEQ ID NO: 32689 - protein, 10 aa, Borrelia burgdorferi B31
EIWGSQLGVI

SEQ ID NO: 32690 - protein, 10 aa, Borrelia burgdorferi B31
IWGSQLGVIT

SEQ ID NO: 32691 - protein, 10 aa, Borrelia burgdorferi B31
WGSQLGVITE

SEQ ID NO: 32692 - protein, 10 aa, Borrelia burgdorferi B31
GSQLGVITEA

SEQ ID NO: 32693 - protein, 10 aa, Borrelia burgdorferi B31
SQLGVITEAM

SEQ ID NO: 32694 - protein, 10 aa, Borrelia burgdorferi B31
QLGVITEAMA

SEQ ID NO: 32695 - protein, 10 aa, Borrelia burgdorferi B31
LGVITEAMAN

SEQ ID NO: 32696 - protein, 10 aa, Borrelia burgdorferi B31
GVITEAMANA

SEQ ID NO: 32697 - protein, 10 aa, Borrelia burgdorferi B31
VITEAMANAR

SEQ ID NO: 32698 - protein, 10 aa, Borrelia burgdorferi B31
ITEAMANARI

SEQ ID NO: 32699 - protein, 10 aa, Borrelia burgdorferi B31
TEAMANARIL

SEQ ID NO: 32700 - protein, 10 aa, Borrelia burgdorferi B31
EAMANARILP

SEQ ID NO: 32701 - protein, 10 aa, Borrelia burgdorferi B31
AMANARILPN

SEQ ID NO: 32702 - protein, 10 aa, Borrelia burgdorferi B31
MANARILPNE

SEQ ID NO: 32703 - protein, 10 aa, Borrelia burgdorferi B31
ANARILPNEI

SEQ ID NO: 32704 - protein, 10 aa, Borrelia burgdorferi B31
NARILPNEID

SEQ ID NO: 32705 - protein, 10 aa, Borrelia burgdorferi B31
ARILPNEIDA

SEQ ID NO: 32706 - protein, 10 aa, Borrelia burgdorferi B31
RILPNEIDAI

SEQ ID NO: 32707 - protein, 10 aa, Borrelia burgdorferi B31
ILPNEIDAIG

SEQ ID NO: 32708 - protein, 10 aa, Borrelia burgdorferi B31
LPNEIDAIGI

SEQ ID NO: 32709 - protein, 10 aa, Borrelia burgdorferi B31
PNEIDAIGIT

SEQ ID NO: 32710 - protein, 10 aa, Borrelia burgdorferi B31
NEIDAIGITN

SEQ ID NO: 32711 - protein, 10 aa, Borrelia burgdorferi B31
EIDAIGITNQ

SEQ ID NO: 32712 - protein, 10 aa, Borrelia burgdorferi B31
IDAIGITNQR

SEQ ID NO: 32713 - protein, 10 aa, Borrelia burgdorferi B31
DAIGITNQRE

SEQ ID NO: 32714 - protein, 10 aa, Borrelia burgdorferi B31
AIGITNQRET

SEQ ID NO: 32715 - protein, 10 aa, Borrelia burgdorferi B31
IGITNQRETT

SEQ ID NO: 32716 - protein, 10 aa, Borrelia burgdorferi B31
GITNQRETTV

SEQ ID NO: 32717 - protein, 10 aa, Borrelia burgdorferi B31
ITNQRETTVI

SEQ ID NO: 32718 - protein, 10 aa, Borrelia burgdorferi B31
TNQRETTVIW

SEQ ID NO: 32719 - protein, 10 aa, Borrelia burgdorferi B31
NQRETTVIWE

SEQ ID NO: 32720 - protein, 10 aa, Borrelia burgdorferi B31
QRETTVIWEK

SEQ ID NO: 32721 - protein, 10 aa, Borrelia burgdorferi B31
RETTVIWEKN

SEQ ID NO: 32722 - protein, 10 aa, Borrelia burgdorferi B31
ETTVIWEKNT

SEQ ID NO: 32723 - protein, 10 aa, Borrelia burgdorferi B31
TTVIWEKNTG

SEQ ID NO: 32724 - protein, 10 aa, Borrelia burgdorferi B31
TVIWEKNTGK

SEQ ID NO: 32725 - protein, 10 aa, Borrelia burgdorferi B31
VIWEKNTGKP

SEQ ID NO: 32726 - protein, 10 aa, Borrelia burgdorferi B31
IWEKNTGKPI

SEQ ID NO: 32727 - protein, 10 aa, Borrelia burgdorferi B31
WEKNTGKPIY

SEQ ID NO: 32728 - protein, 10 aa, Borrelia burgdorferi B31
EKNTGKPIYN

SEQ ID NO: 32729 - protein, 10 aa, Borrelia burgdorferi B31
KNTGKPIYNA

SEQ ID NO: 32730 - protein, 10 aa, Borrelia burgdorferi B31
NTGKPIYNAI

SEQ ID NO: 32731 - protein, 10 aa, Borrelia burgdorferi B31
TGKPIYNAIV

SEQ ID NO: 32732 - protein, 10 aa, Borrelia burgdorferi B31
GKPIYNAIVW

SEQ ID NO: 32733 - protein, 10 aa, Borrelia burgdorferi B31
KPIYNAIVWQ

SEQ ID NO: 32734 - protein, 10 aa, Borrelia burgdorferi B31
PIYNAIVWQD

SEQ ID NO: 32735 - protein, 10 aa, Borrelia burgdorferi B31
IYNAIVWQDR

SEQ ID NO: 32736 - protein, 10 aa, Borrelia burgdorferi B31
YNAIVWQDRR

SEQ ID NO: 32737 - protein, 10 aa, Borrelia burgdorferi B31
NAIVWQDRRT

SEQ ID NO: 32738 - protein, 10 aa, Borrelia burgdorferi B31
AIVWQDRRTA

SEQ ID NO: 32739 - protein, 10 aa, Borrelia burgdorferi B31
IVWQDRRTAK

SEQ ID NO: 32740 - protein, 10 aa, Borrelia burgdorferi B31
VWQDRRTAKI

SEQ ID NO: 32741 - protein, 10 aa, Borrelia burgdorferi B31
WQDRRTAKIC

SEQ ID NO: 32742 - protein, 10 aa, Borrelia burgdorferi B31
QDRRTAKICD

SEQ ID NO: 32743 - protein, 10 aa, Borrelia burgdorferi B31
DRRTAKICDQ

SEQ ID NO: 32744 - protein, 10 aa, Borrelia burgdorferi B31
RRTAKICDQL

SEQ ID NO: 32745 - protein, 10 aa, Borrelia burgdorferi B31
RTAKICDQLK

SEQ ID NO: 32746 - protein, 10 aa, Borrelia burgdorferi B31
TAKICDQLKK

SEQ ID NO: 32747 - protein, 10 aa, Borrelia burgdorferi B31
AKICDQLKKE

SEQ ID NO: 32748 - protein, 10 aa, Borrelia burgdorferi B31
KICDQLKKEG

SEQ ID NO: 32749 - protein, 10 aa, Borrelia burgdorferi B31
ICDQLKKEGK

SEQ ID NO: 32750 - protein, 10 aa, Borrelia burgdorferi B31
CDQLKKEGKD

SEQ ID NO: 32751 - protein, 10 aa, Borrelia burgdorferi B31
DQLKKEGKDK

SEQ ID NO: 32752 - protein, 10 aa, Borrelia burgdorferi B31
QLKKEGKDKI

SEQ ID NO: 32753 - protein, 10 aa, Borrelia burgdorferi B31
LKKEGKDKII

SEQ ID NO: 32754 - protein, 10 aa, Borrelia burgdorferi B31
KKEGKDKIIL

SEQ ID NO: 32755 - protein, 10 aa, Borrelia burgdorferi B31
KEGKDKIILE

SEQ ID NO: 32756 - protein, 10 aa, Borrelia burgdorferi B31
EGKDKIILEK

SEQ ID NO: 32757 - protein, 10 aa, Borrelia burgdorferi B31
GKDKIILEKT

SEQ ID NO: 32758 - protein, 10 aa, Borrelia burgdorferi B31
KDKIILEKTG

SEQ ID NO: 32759 - protein, 10 aa, Borrelia burgdorferi B31
DKIILEKTGL

SEQ ID NO: 32760 - protein, 10 aa, Borrelia burgdorferi B31
KIILEKTGLV

SEQ ID NO: 32761 - protein, 10 aa, Borrelia burgdorferi B31
IILEKTGLVL

SEQ ID NO: 32762 - protein, 10 aa, Borrelia burgdorferi B31
ILEKTGLVLD

SEQ ID NO: 32763 - protein, 10 aa, Borrelia burgdorferi B31
LEKTGLVLDS

SEQ ID NO: 32764 - protein, 10 aa, Borrelia burgdorferi B31
EKTGLVLDSY

SEQ ID NO: 32765 - protein, 10 aa, Borrelia burgdorferi B31
KTGLVLDSYF

SEQ ID NO: 32766 - protein, 10 aa, Borrelia burgdorferi B31
TGLVLDSYFS

SEQ ID NO: 32767 - protein, 10 aa, Borrelia burgdorferi B31
GLVLDSYFSG

SEQ ID NO: 32768 - protein, 10 aa, Borrelia burgdorferi B31
LVLDSYFSGT

SEQ ID NO: 32769 - protein, 10 aa, Borrelia burgdorferi B31
VLDSYFSGTK

SEQ ID NO: 32770 - protein, 10 aa, Borrelia burgdorferi B31
LDSYFSGTKI

SEQ ID NO: 32771 - protein, 10 aa, Borrelia burgdorferi B31
DSYFSGTKIM

SEQ ID NO: 32772 - protein, 10 aa, Borrelia burgdorferi B31
SYFSGTKIMW

SEQ ID NO: 32773 - protein, 10 aa, Borrelia burgdorferi B31
YFSGTKIMWI

SEQ ID NO: 32774 - protein, 10 aa, Borrelia burgdorferi B31
FSGTKIMWIL

SEQ ID NO: 32775 - protein, 10 aa, Borrelia burgdorferi B31
SGTKIMWILD

SEQ ID NO: 32776 - protein, 10 aa, Borrelia burgdorferi B31
GTKIMWILDN

SEQ ID NO: 32777 - protein, 10 aa, Borrelia burgdorferi B31
TKIMWILDNV

SEQ ID NO: 32778 - protein, 10 aa, Borrelia burgdorferi B31
KIMWILDNVE

SEQ ID NO: 32779 - protein, 10 aa, Borrelia burgdorferi B31
IMWILDNVEG

SEQ ID NO: 32780 - protein, 10 aa, Borrelia burgdorferi B31
MWILDNVEGA

SEQ ID NO: 32781 - protein, 10 aa, Borrelia burgdorferi B31
WILDNVEGAR

SEQ ID NO: 32782 - protein, 10 aa, Borrelia burgdorferi B31
ILDNVEGARQ

SEQ ID NO: 32783 - protein, 10 aa, Borrelia burgdorferi B31
LDNVEGARQR

SEQ ID NO: 32784 - protein, 10 aa, Borrelia burgdorferi B31
DNVEGARQRA

SEQ ID NO: 32785 - protein, 10 aa, Borrelia burgdorferi B31
NVEGARQRAE

SEQ ID NO: 32786 - protein, 10 aa, Borrelia burgdorferi B31
VEGARQRAEN

SEQ ID NO: 32787 - protein, 10 aa, Borrelia burgdorferi B31
EGARQRAENG

SEQ ID NO: 32788 - protein, 10 aa, Borrelia burgdorferi B31
GARQRAENGE

SEQ ID NO: 32789 - protein, 10 aa, Borrelia burgdorferi B31
ARQRAENGEL

SEQ ID NO: 32790 - protein, 10 aa, Borrelia burgdorferi B31
RQRAENGELC

SEQ ID NO: 32791 - protein, 10 aa, Borrelia burgdorferi B31
QRAENGELCF

SEQ ID NO: 32792 - protein, 10 aa, Borrelia burgdorferi B31
RAENGELCFG

SEQ ID NO: 32793 - protein, 10 aa, Borrelia burgdorferi B31
AENGELCFGT

SEQ ID NO: 32794 - protein, 10 aa, Borrelia burgdorferi B31
ENGELCFGTI

SEQ ID NO: 32795 - protein, 10 aa, Borrelia burgdorferi B31
NGELCFGTID

SEQ ID NO: 32796 - protein, 10 aa, Borrelia burgdorferi B31
GELCFGTIDT

SEQ ID NO: 32797 - protein, 10 aa, Borrelia burgdorferi B31
ELCFGTIDTW

SEQ ID NO: 32798 - protein, 10 aa, Borrelia burgdorferi B31
LCFGTIDTWI

SEQ ID NO: 32799 - protein, 10 aa, Borrelia burgdorferi B31
CFGTIDTWIL

SEQ ID NO: 32800 - protein, 10 aa, Borrelia burgdorferi B31
FGTIDTWILW

SEQ ID NO: 32801 - protein, 10 aa, Borrelia burgdorferi B31
GTIDTWILWN

SEQ ID NO: 32802 - protein, 10 aa, Borrelia burgdorferi B31
TIDTWILWNL

SEQ ID NO: 32803 - protein, 10 aa, Borrelia burgdorferi B31
IDTWILWNLT

SEQ ID NO: 32804 - protein, 10 aa, Borrelia burgdorferi B31
DTWILWNLTQ

SEQ ID NO: 32805 - protein, 10 aa, Borrelia burgdorferi B31
TWILWNLTQK

SEQ ID NO: 32806 - protein, 10 aa, Borrelia burgdorferi B31
WILWNLTQKK

SEQ ID NO: 32807 - protein, 10 aa, Borrelia burgdorferi B31
ILWNLTQKKE

SEQ ID NO: 32808 - protein, 10 aa, Borrelia burgdorferi B31
LWNLTQKKEH

SEQ ID NO: 32809 - protein, 10 aa, Borrelia burgdorferi B31
WNLTQKKEHA

SEQ ID NO: 32810 - protein, 10 aa, Borrelia burgdorferi B31
NLTQKKEHAT

SEQ ID NO: 32811 - protein, 10 aa, Borrelia burgdorferi B31
LTQKKEHATD

SEQ ID NO: 32812 - protein, 10 aa, Borrelia burgdorferi B31
TQKKEHATDY

SEQ ID NO: 32813 - protein, 10 aa, Borrelia burgdorferi B31
QKKEHATDYS

SEQ ID NO: 32814 - protein, 10 aa, Borrelia burgdorferi B31
KKEHATDYSN

SEQ ID NO: 32815 - protein, 10 aa, Borrelia burgdorferi B31
KEHATDYSNA

SEQ ID NO: 32816 - protein, 10 aa, Borrelia burgdorferi B31
EHATDYSNAS

SEQ ID NO: 32817 - protein, 10 aa, Borrelia burgdorferi B31
HATDYSNASR

SEQ ID NO: 32818 - protein, 10 aa, Borrelia burgdorferi B31
ATDYSNASRT

SEQ ID NO: 32819 - protein, 10 aa, Borrelia burgdorferi B31
TDYSNASRTL

SEQ ID NO: 32820 - protein, 10 aa, Borrelia burgdorferi B31
DYSNASRTLL

SEQ ID NO: 32821 - protein, 10 aa, Borrelia burgdorferi B31
YSNASRTLLL

SEQ ID NO: 32822 - protein, 10 aa, Borrelia burgdorferi B31
SNASRTLLLN

SEQ ID NO: 32823 - protein, 10 aa, Borrelia burgdorferi B31
NASRTLLLNI

SEQ ID NO: 32824 - protein, 10 aa, Borrelia burgdorferi B31
ASRTLLLNIK

SEQ ID NO: 32825 - protein, 10 aa, Borrelia burgdorferi B31
SRTLLLNIKT

SEQ ID NO: 32826 - protein, 10 aa, Borrelia burgdorferi B31
RTLLLNIKTL

SEQ ID NO: 32827 - protein, 10 aa, Borrelia burgdorferi B31
TLLLNIKTLE

SEQ ID NO: 32828 - protein, 10 aa, Borrelia burgdorferi B31
LLLNIKTLEW

SEQ ID NO: 32829 - protein, 10 aa, Borrelia burgdorferi B31
LLNIKTLEWD

SEQ ID NO: 32830 - protein, 10 aa, Borrelia burgdorferi B31
LNIKTLEWDD

SEQ ID NO: 32831 - protein, 10 aa, Borrelia burgdorferi B31
NIKTLEWDDE

SEQ ID NO: 32832 - protein, 10 aa, Borrelia burgdorferi B31
IKTLEWDDEL

SEQ ID NO: 32833 - protein, 10 aa, Borrelia burgdorferi B31
KTLEWDDELL

SEQ ID NO: 32834 - protein, 10 aa, Borrelia burgdorferi B31
TLEWDDELLS

SEQ ID NO: 32835 - protein, 10 aa, Borrelia burgdorferi B31
LEWDDELLSI

SEQ ID NO: 32836 - protein, 10 aa, Borrelia burgdorferi B31
EWDDELLSIL

SEQ ID NO: 32837 - protein, 10 aa, Borrelia burgdorferi B31
WDDELLSILN

SEQ ID NO: 32838 - protein, 10 aa, Borrelia burgdorferi B31
DDELLSILNV

SEQ ID NO: 32839 - protein, 10 aa, Borrelia burgdorferi B31
DELLSILNVP

SEQ ID NO: 32840 - protein, 10 aa, Borrelia burgdorferi B31
ELLSILNVPR

SEQ ID NO: 32841 - protein, 10 aa, Borrelia burgdorferi B31
LLSILNVPRA

SEQ ID NO: 32842 - protein, 10 aa, Borrelia burgdorferi B31
LSILNVPRAI

SEQ ID NO: 32843 - protein, 10 aa, Borrelia burgdorferi B31
SILNVPRAIL

SEQ ID NO: 32844 - protein, 10 aa, Borrelia burgdorferi B31
ILNVPRAILP

SEQ ID NO: 32845 - protein, 10 aa, Borrelia burgdorferi B31
LNVPRAILPE

SEQ ID NO: 32846 - protein, 10 aa, Borrelia burgdorferi B31
NVPRAILPEL

SEQ ID NO: 32847 - protein, 10 aa, Borrelia burgdorferi B31
VPRAILPELK

SEQ ID NO: 32848 - protein, 10 aa, Borrelia burgdorferi B31
PRAILPELKE

SEQ ID NO: 32849 - protein, 10 aa, Borrelia burgdorferi B31
RAILPELKES

SEQ ID NO: 32850 - protein, 10 aa, Borrelia burgdorferi B31
AILPELKESS

SEQ ID NO: 32851 - protein, 10 aa, Borrelia burgdorferi B31
ILPELKESST

SEQ ID NO: 32852 - protein, 10 aa, Borrelia burgdorferi B31
LPELKESSTI

SEQ ID NO: 32853 - protein, 10 aa, Borrelia burgdorferi B31
PELKESSTIY

SEQ ID NO: 32854 - protein, 10 aa, Borrelia burgdorferi B31
ELKESSTIYG

SEQ ID NO: 32855 - protein, 10 aa, Borrelia burgdorferi B31
LKESSTIYGK

SEQ ID NO: 32856 - protein, 10 aa, Borrelia burgdorferi B31
KESSTIYGKT

SEQ ID NO: 32857 - protein, 10 aa, Borrelia burgdorferi B31
ESSTIYGKTD

SEQ ID NO: 32858 - protein, 10 aa, Borrelia burgdorferi B31
SSTIYGKTDK

SEQ ID NO: 32859 - protein, 10 aa, Borrelia burgdorferi B31
STIYGKTDKA

SEQ ID NO: 32860 - protein, 10 aa, Borrelia burgdorferi B31
TIYGKTDKAL

SEQ ID NO: 32861 - protein, 10 aa, Borrelia burgdorferi B31
IYGKTDKALF

SEQ ID NO: 32862 - protein, 10 aa, Borrelia burgdorferi B31
YGKTDKALFG

SEQ ID NO: 32863 - protein, 10 aa, Borrelia burgdorferi B31
GKTDKALFGA

SEQ ID NO: 32864 - protein, 10 aa, Borrelia burgdorferi B31
KTDKALFGAE

SEQ ID NO: 32865 - protein, 10 aa, Borrelia burgdorferi B31
TDKALFGAEI

SEQ ID NO: 32866 - protein, 10 aa, Borrelia burgdorferi B31
DKALFGAEIP

SEQ ID NO: 32867 - protein, 10 aa, Borrelia burgdorferi B31
KALFGAEIPI

SEQ ID NO: 32868 - protein, 10 aa, Borrelia burgdorferi B31
ALFGAEIPIA

SEQ ID NO: 32869 - protein, 10 aa, Borrelia burgdorferi B31
LFGAEIPIAG

SEQ ID NO: 32870 - protein, 10 aa, Borrelia burgdorferi B31
FGAEIPIAGI

SEQ ID NO: 32871 - protein, 10 aa, Borrelia burgdorferi B31
GAEIPIAGIA

SEQ ID NO: 32872 - protein, 10 aa, Borrelia burgdorferi B31
AEIPIAGIAG

SEQ ID NO: 32873 - protein, 10 aa, Borrelia burgdorferi B31
EIPIAGIAGD

SEQ ID NO: 32874 - protein, 10 aa, Borrelia burgdorferi B31
IPIAGIAGDQ

SEQ ID NO: 32875 - protein, 10 aa, Borrelia burgdorferi B31
PIAGIAGDQF

SEQ ID NO: 32876 - protein, 10 aa, Borrelia burgdorferi B31
IAGIAGDQFA

SEQ ID NO: 32877 - protein, 10 aa, Borrelia burgdorferi B31
AGIAGDQFAA

SEQ ID NO: 32878 - protein, 10 aa, Borrelia burgdorferi B31
GIAGDQFAAT

SEQ ID NO: 32879 - protein, 10 aa, Borrelia burgdorferi B31
IAGDQFAATF

SEQ ID NO: 32880 - protein, 10 aa, Borrelia burgdorferi B31
AGDQFAATFG

SEQ ID NO: 32881 - protein, 10 aa, Borrelia burgdorferi B31
GDQFAATFGQ

SEQ ID NO: 32882 - protein, 10 aa, Borrelia burgdorferi B31
DQFAATFGQA

SEQ ID NO: 32883 - protein, 10 aa, Borrelia burgdorferi B31
QFAATFGQAC

SEQ ID NO: 32884 - protein, 10 aa, Borrelia burgdorferi B31
FAATFGQACL

SEQ ID NO: 32885 - protein, 10 aa, Borrelia burgdorferi B31
AATFGQACLK

SEQ ID NO: 32886 - protein, 10 aa, Borrelia burgdorferi B31
ATFGQACLKK

SEQ ID NO: 32887 - protein, 10 aa, Borrelia burgdorferi B31
TFGQACLKKG

SEQ ID NO: 32888 - protein, 10 aa, Borrelia burgdorferi B31
FGQACLKKGM

SEQ ID NO: 32889 - protein, 10 aa, Borrelia burgdorferi B31
GQACLKKGMA

SEQ ID NO: 32890 - protein, 10 aa, Borrelia burgdorferi B31
QACLKKGMAK

SEQ ID NO: 32891 - protein, 10 aa, Borrelia burgdorferi B31
ACLKKGMAKN

SEQ ID NO: 32892 - protein, 10 aa, Borrelia burgdorferi B31
CLKKGMAKNT

SEQ ID NO: 32893 - protein, 10 aa, Borrelia burgdorferi B31
LKKGMAKNTY

SEQ ID NO: 32894 - protein, 10 aa, Borrelia burgdorferi B31
KKGMAKNTYG

SEQ ID NO: 32895 - protein, 10 aa, Borrelia burgdorferi B31
KGMAKNTYGT

SEQ ID NO: 32896 - protein, 10 aa, Borrelia burgdorferi B31
GMAKNTYGTG

SEQ ID NO: 32897 - protein, 10 aa, Borrelia burgdorferi B31
MAKNTYGTGC

SEQ ID NO: 32898 - protein, 10 aa, Borrelia burgdorferi B31
AKNTYGTGCF

SEQ ID NO: 32899 - protein, 10 aa, Borrelia burgdorferi B31
KNTYGTGCFL

SEQ ID NO: 32900 - protein, 10 aa, Borrelia burgdorferi B31
NTYGTGCFLT

SEQ ID NO: 32901 - protein, 10 aa, Borrelia burgdorferi B31
TYGTGCFLTV

SEQ ID NO: 32902 - protein, 10 aa, Borrelia burgdorferi B31
YGTGCFLTVN

SEQ ID NO: 32903 - protein, 10 aa, Borrelia burgdorferi B31
GTGCFLTVNI

SEQ ID NO: 32904 - protein, 10 aa, Borrelia burgdorferi B31
TGCFLTVNIG

SEQ ID NO: 32905 - protein, 10 aa, Borrelia burgdorferi B31
GCFLTVNIGK

SEQ ID NO: 32906 - protein, 10 aa, Borrelia burgdorferi B31
CFLTVNIGKE

SEQ ID NO: 32907 - protein, 10 aa, Borrelia burgdorferi B31
FLTVNIGKEP

SEQ ID NO: 32908 - protein, 10 aa, Borrelia burgdorferi B31
LTVNIGKEPI

SEQ ID NO: 32909 - protein, 10 aa, Borrelia burgdorferi B31
TVNIGKEPII

SEQ ID NO: 32910 - protein, 10 aa, Borrelia burgdorferi B31
VNIGKEPIIS

SEQ ID NO: 32911 - protein, 10 aa, Borrelia burgdorferi B31
NIGKEPIISH

SEQ ID NO: 32912 - protein, 10 aa, Borrelia burgdorferi B31
IGKEPIISHD

SEQ ID NO: 32913 - protein, 10 aa, Borrelia burgdorferi B31
GKEPIISHDK

SEQ ID NO: 32914 - protein, 10 aa, Borrelia burgdorferi B31
KEPIISHDKL

SEQ ID NO: 32915 - protein, 10 aa, Borrelia burgdorferi B31
EPIISHDKLL

SEQ ID NO: 32916 - protein, 10 aa, Borrelia burgdorferi B31
PIISHDKLLT

SEQ ID NO: 32917 - protein, 10 aa, Borrelia burgdorferi B31
IISHDKLLTS

SEQ ID NO: 32918 - protein, 10 aa, Borrelia burgdorferi B31
ISHDKLLTSI

SEQ ID NO: 32919 - protein, 10 aa, Borrelia burgdorferi B31
SHDKLLTSIA

SEQ ID NO: 32920 - protein, 10 aa, Borrelia burgdorferi B31
HDKLLTSIAW

SEQ ID NO: 32921 - protein, 10 aa, Borrelia burgdorferi B31
DKLLTSIAWG

SEQ ID NO: 32922 - protein, 10 aa, Borrelia burgdorferi B31
KLLTSIAWGR

SEQ ID NO: 32923 - protein, 10 aa, Borrelia burgdorferi B31
LLTSIAWGRK

SEQ ID NO: 32924 - protein, 10 aa, Borrelia burgdorferi B31
LTSIAWGRKK

SEQ ID NO: 32925 - protein, 10 aa, Borrelia burgdorferi B31
TSIAWGRKKS

SEQ ID NO: 32926 - protein, 10 aa, Borrelia burgdorferi B31
SIAWGRKKSV

SEQ ID NO: 32927 - protein, 10 aa, Borrelia burgdorferi B31
IAWGRKKSVT

SEQ ID NO: 32928 - protein, 10 aa, Borrelia burgdorferi B31
AWGRKKSVTY

SEQ ID NO: 32929 - protein, 10 aa, Borrelia burgdorferi B31
WGRKKSVTYV

SEQ ID NO: 32930 - protein, 10 aa, Borrelia burgdorferi B31
GRKKSVTYVL

SEQ ID NO: 32931 - protein, 10 aa, Borrelia burgdorferi B31
RKKSVTYVLE

SEQ ID NO: 32932 - protein, 10 aa, Borrelia burgdorferi B31
KKSVTYVLEG

SEQ ID NO: 32933 - protein, 10 aa, Borrelia burgdorferi B31
KSVTYVLEGS

SEQ ID NO: 32934 - protein, 10 aa, Borrelia burgdorferi B31
SVTYVLEGSV

SEQ ID NO: 32935 - protein, 10 aa, Borrelia burgdorferi B31
VTYVLEGSVF

SEQ ID NO: 32936 - protein, 10 aa, Borrelia burgdorferi B31
TYVLEGSVFI

SEQ ID NO: 32937 - protein, 10 aa, Borrelia burgdorferi B31
YVLEGSVFIG

SEQ ID NO: 32938 - protein, 10 aa, Borrelia burgdorferi B31
VLEGSVFIGG

SEQ ID NO: 32939 - protein, 10 aa, Borrelia burgdorferi B31
LEGSVFIGGA

SEQ ID NO: 32940 - protein, 10 aa, Borrelia burgdorferi B31
EGSVFIGGAV

SEQ ID NO: 32941 - protein, 10 aa, Borrelia burgdorferi B31
GSVFIGGAVI

SEQ ID NO: 32942 - protein, 10 aa, Borrelia burgdorferi B31
SVFIGGAVIQ

SEQ ID NO: 32943 - protein, 10 aa, Borrelia burgdorferi B31
VFIGGAVIQW

SEQ ID NO: 32944 - protein, 10 aa, Borrelia burgdorferi B31
FIGGAVIQWL

SEQ ID NO: 32945 - protein, 10 aa, Borrelia burgdorferi B31
IGGAVIQWLR

SEQ ID NO: 32946 - protein, 10 aa, Borrelia burgdorferi B31
GGAVIQWLRD

SEQ ID NO: 32947 - protein, 10 aa, Borrelia burgdorferi B31
GAVIQWLRDG

SEQ ID NO: 32948 - protein, 10 aa, Borrelia burgdorferi B31
AVIQWLRDGL

SEQ ID NO: 32949 - protein, 10 aa, Borrelia burgdorferi B31
VIQWLRDGLE

SEQ ID NO: 32950 - protein, 10 aa, Borrelia burgdorferi B31
IQWLRDGLEF

SEQ ID NO: 32951 - protein, 10 aa, Borrelia burgdorferi B31
QWLRDGLEFF

SEQ ID NO: 32952 - protein, 10 aa, Borrelia burgdorferi B31
WLRDGLEFFR

SEQ ID NO: 32953 - protein, 10 aa, Borrelia burgdorferi B31
LRDGLEFFRK

SEQ ID NO: 32954 - protein, 10 aa, Borrelia burgdorferi B31
RDGLEFFRKS

SEQ ID NO: 32955 - protein, 10 aa, Borrelia burgdorferi B31
DGLEFFRKSS

SEQ ID NO: 32956 - protein, 10 aa, Borrelia burgdorferi B31
GLEFFRKSSD

SEQ ID NO: 32957 - protein, 10 aa, Borrelia burgdorferi B31
LEFFRKSSDA

SEQ ID NO: 32958 - protein, 10 aa, Borrelia burgdorferi B31
EFFRKSSDAE

SEQ ID NO: 32959 - protein, 10 aa, Borrelia burgdorferi B31
FFRKSSDAEA

SEQ ID NO: 32960 - protein, 10 aa, Borrelia burgdorferi B31
FRKSSDAEAL

SEQ ID NO: 32961 - protein, 10 aa, Borrelia burgdorferi B31
RKSSDAEALA

SEQ ID NO: 32962 - protein, 10 aa, Borrelia burgdorferi B31
KSSDAEALAS

SEQ ID NO: 32963 - protein, 10 aa, Borrelia burgdorferi B31
SSDAEALASS

SEQ ID NO: 32964 - protein, 10 aa, Borrelia burgdorferi B31
SDAEALASSV

SEQ ID NO: 32965 - protein, 10 aa, Borrelia burgdorferi B31
DAEALASSVS

SEQ ID NO: 32966 - protein, 10 aa, Borrelia burgdorferi B31
AEALASSVSD

SEQ ID NO: 32967 - protein, 10 aa, Borrelia burgdorferi B31
EALASSVSDN

SEQ ID NO: 32968 - protein, 10 aa, Borrelia burgdorferi B31
ALASSVSDNG

SEQ ID NO: 32969 - protein, 10 aa, Borrelia burgdorferi B31
LASSVSDNGG

SEQ ID NO: 32970 - protein, 10 aa, Borrelia burgdorferi B31
ASSVSDNGGV

SEQ ID NO: 32971 - protein, 10 aa, Borrelia burgdorferi B31
SSVSDNGGVY

SEQ ID NO: 32972 - protein, 10 aa, Borrelia burgdorferi B31
SVSDNGGVYF

SEQ ID NO: 32973 - protein, 10 aa, Borrelia burgdorferi B31
VSDNGGVYFV

SEQ ID NO: 32974 - protein, 10 aa, Borrelia burgdorferi B31
SDNGGVYFVP

SEQ ID NO: 32975 - protein, 10 aa, Borrelia burgdorferi B31
DNGGVYFVPA

SEQ ID NO: 32976 - protein, 10 aa, Borrelia burgdorferi B31
NGGVYFVPAF

SEQ ID NO: 32977 - protein, 10 aa, Borrelia burgdorferi B31
GGVYFVPAFV

SEQ ID NO: 32978 - protein, 10 aa, Borrelia burgdorferi B31
GVYFVPAFVG

SEQ ID NO: 32979 - protein, 10 aa, Borrelia burgdorferi B31
VYFVPAFVGL

SEQ ID NO: 32980 - protein, 10 aa, Borrelia burgdorferi B31
YFVPAFVGLG

SEQ ID NO: 32981 - protein, 10 aa, Borrelia burgdorferi B31
FVPAFVGLGA

SEQ ID NO: 32982 - protein, 10 aa, Borrelia burgdorferi B31
VPAFVGLGAP

SEQ ID NO: 32983 - protein, 10 aa, Borrelia burgdorferi B31
PAFVGLGAPH

SEQ ID NO: 32984 - protein, 10 aa, Borrelia burgdorferi B31
AFVGLGAPHW

SEQ ID NO: 32985 - protein, 10 aa, Borrelia burgdorferi B31
FVGLGAPHWD

SEQ ID NO: 32986 - protein, 10 aa, Borrelia burgdorferi B31
VGLGAPHWDS

SEQ ID NO: 32987 - protein, 10 aa, Borrelia burgdorferi B31
GLGAPHWDSY

SEQ ID NO: 32988 - protein, 10 aa, Borrelia burgdorferi B31
LGAPHWDSYA

SEQ ID NO: 32989 - protein, 10 aa, Borrelia burgdorferi B31
GAPHWDSYAR

SEQ ID NO: 32990 - protein, 10 aa, Borrelia burgdorferi B31
APHWDSYARG

SEQ ID NO: 32991 - protein, 10 aa, Borrelia burgdorferi B31
PHWDSYARGT

SEQ ID NO: 32992 - protein, 10 aa, Borrelia burgdorferi B31
HWDSYARGTI

SEQ ID NO: 32993 - protein, 10 aa, Borrelia burgdorferi B31
WDSYARGTII

SEQ ID NO: 32994 - protein, 10 aa, Borrelia burgdorferi B31
DSYARGTIIG

SEQ ID NO: 32995 - protein, 10 aa, Borrelia burgdorferi B31
SYARGTIIGI

SEQ ID NO: 32996 - protein, 10 aa, Borrelia burgdorferi B31
YARGTIIGIT

SEQ ID NO: 32997 - protein, 10 aa, Borrelia burgdorferi B31
ARGTIIGITR

SEQ ID NO: 32998 - protein, 10 aa, Borrelia burgdorferi B31
RGTIIGITRG

SEQ ID NO: 32999 - protein, 10 aa, Borrelia burgdorferi B31
GTIIGITRGS

SEQ ID NO: 33000 - protein, 10 aa, Borrelia burgdorferi B31
TIIGITRGST

SEQ ID NO: 33001 - protein, 10 aa, Borrelia burgdorferi B31
IIGITRGSTK

SEQ ID NO: 33002 - protein, 10 aa, Borrelia burgdorferi B31
IGITRGSTKA

SEQ ID NO: 33003 - protein, 10 aa, Borrelia burgdorferi B31
GITRGSTKAH

SEQ ID NO: 33004 - protein, 10 aa, Borrelia burgdorferi B31
ITRGSTKAHI

SEQ ID NO: 33005 - protein, 10 aa, Borrelia burgdorferi B31
TRGSTKAHIT

SEQ ID NO: 33006 - protein, 10 aa, Borrelia burgdorferi B31
RGSTKAHITR

SEQ ID NO: 33007 - protein, 10 aa, Borrelia burgdorferi B31
GSTKAHITRA

SEQ ID NO: 33008 - protein, 10 aa, Borrelia burgdorferi B31
STKAHITRAA

SEQ ID NO: 33009 - protein, 10 aa, Borrelia burgdorferi B31
TKAHITRAAL

SEQ ID NO: 33010 - protein, 10 aa, Borrelia burgdorferi B31
KAHITRAALE

SEQ ID NO: 33011 - protein, 10 aa, Borrelia burgdorferi B31
AHITRAALES

SEQ ID NO: 33012 - protein, 10 aa, Borrelia burgdorferi B31
HITRAALESI

SEQ ID NO: 33013 - protein, 10 aa, Borrelia burgdorferi B31
ITRAALESIA

SEQ ID NO: 33014 - protein, 10 aa, Borrelia burgdorferi B31
TRAALESIAF

SEQ ID NO: 33015 - protein, 10 aa, Borrelia burgdorferi B31
RAALESIAFQ

SEQ ID NO: 33016 - protein, 10 aa, Borrelia burgdorferi B31
AALESIAFQS

SEQ ID NO: 33017 - protein, 10 aa, Borrelia burgdorferi B31
ALESIAFQSF

SEQ ID NO: 33018 - protein, 10 aa, Borrelia burgdorferi B31
LESIAFQSFD

SEQ ID NO: 33019 - protein, 10 aa, Borrelia burgdorferi B31
ESIAFQSFDI

SEQ ID NO: 33020 - protein, 10 aa, Borrelia burgdorferi B31
SIAFQSFDIL

SEQ ID NO: 33021 - protein, 10 aa, Borrelia burgdorferi B31
IAFQSFDILN

SEQ ID NO: 33022 - protein, 10 aa, Borrelia burgdorferi B31
AFQSFDILNT

SEQ ID NO: 33023 - protein, 10 aa, Borrelia burgdorferi B31
FQSFDILNTM

SEQ ID NO: 33024 - protein, 10 aa, Borrelia burgdorferi B31
QSFDILNTMK

SEQ ID NO: 33025 - protein, 10 aa, Borrelia burgdorferi B31
SFDILNTMKK

SEQ ID NO: 33026 - protein, 10 aa, Borrelia burgdorferi B31
FDILNTMKKS

SEQ ID NO: 33027 - protein, 10 aa, Borrelia burgdorferi B31
DILNTMKKSI

SEQ ID NO: 33028 - protein, 10 aa, Borrelia burgdorferi B31
ILNTMKKSIP

SEQ ID NO: 33029 - protein, 10 aa, Borrelia burgdorferi B31
LNTMKKSIPN

SEQ ID NO: 33030 - protein, 10 aa, Borrelia burgdorferi B31
NTMKKSIPNF

SEQ ID NO: 33031 - protein, 10 aa, Borrelia burgdorferi B31
TMKKSIPNFE

SEQ ID NO: 33032 - protein, 10 aa, Borrelia burgdorferi B31
MKKSIPNFEI

SEQ ID NO: 33033 - protein, 10 aa, Borrelia burgdorferi B31
KKSIPNFEIQ

SEQ ID NO: 33034 - protein, 10 aa, Borrelia burgdorferi B31
KSIPNFEIQE

SEQ ID NO: 33035 - protein, 10 aa, Borrelia burgdorferi B31
SIPNFEIQEL

SEQ ID NO: 33036 - protein, 10 aa, Borrelia burgdorferi B31
IPNFEIQELR

SEQ ID NO: 33037 - protein, 10 aa, Borrelia burgdorferi B31
PNFEIQELRV

SEQ ID NO: 33038 - protein, 10 aa, Borrelia burgdorferi B31
NFEIQELRVD

SEQ ID NO: 33039 - protein, 10 aa, Borrelia burgdorferi B31
FEIQELRVDG

SEQ ID NO: 33040 - protein, 10 aa, Borrelia burgdorferi B31
EIQELRVDGG

SEQ ID NO: 33041 - protein, 10 aa, Borrelia burgdorferi B31
IQELRVDGGA

SEQ ID NO: 33042 - protein, 10 aa, Borrelia burgdorferi B31
QELRVDGGAS

SEQ ID NO: 33043 - protein, 10 aa, Borrelia burgdorferi B31
ELRVDGGASQ

SEQ ID NO: 33044 - protein, 10 aa, Borrelia burgdorferi B31
LRVDGGASQN

SEQ ID NO: 33045 - protein, 10 aa, Borrelia burgdorferi B31
RVDGGASQNN

SEQ ID NO: 33046 - protein, 10 aa, Borrelia burgdorferi B31
VDGGASQNNL

SEQ ID NO: 33047 - protein, 10 aa, Borrelia burgdorferi B31
DGGASQNNLL

SEQ ID NO: 33048 - protein, 10 aa, Borrelia burgdorferi B31
GGASQNNLLM

SEQ ID NO: 33049 - protein, 10 aa, Borrelia burgdorferi B31
GASQNNLLMQ

SEQ ID NO: 33050 - protein, 10 aa, Borrelia burgdorferi B31
ASQNNLLMQF

SEQ ID NO: 33051 - protein, 10 aa, Borrelia burgdorferi B31
SQNNLLMQFQ

SEQ ID NO: 33052 - protein, 10 aa, Borrelia burgdorferi B31
QNNLLMQFQA

SEQ ID NO: 33053 - protein, 10 aa, Borrelia burgdorferi B31
NNLLMQFQAD

SEQ ID NO: 33054 - protein, 10 aa, Borrelia burgdorferi B31
NLLMQFQADL

SEQ ID NO: 33055 - protein, 10 aa, Borrelia burgdorferi B31
LLMQFQADLL

SEQ ID NO: 33056 - protein, 10 aa, Borrelia burgdorferi B31
LMQFQADLLE

SEQ ID NO: 33057 - protein, 10 aa, Borrelia burgdorferi B31
MQFQADLLEC

SEQ ID NO: 33058 - protein, 10 aa, Borrelia burgdorferi B31
QFQADLLECK

SEQ ID NO: 33059 - protein, 10 aa, Borrelia burgdorferi B31
FQADLLECKV

SEQ ID NO: 33060 - protein, 10 aa, Borrelia burgdorferi B31
QADLLECKVV

SEQ ID NO: 33061 - protein, 10 aa, Borrelia burgdorferi B31
ADLLECKVVR

SEQ ID NO: 33062 - protein, 10 aa, Borrelia burgdorferi B31
DLLECKVVRP

SEQ ID NO: 33063 - protein, 10 aa, Borrelia burgdorferi B31
LLECKVVRPK

SEQ ID NO: 33064 - protein, 10 aa, Borrelia burgdorferi B31
LECKVVRPKI

SEQ ID NO: 33065 - protein, 10 aa, Borrelia burgdorferi B31
ECKVVRPKIT

SEQ ID NO: 33066 - protein, 10 aa, Borrelia burgdorferi B31
CKVVRPKITE

SEQ ID NO: 33067 - protein, 10 aa, Borrelia burgdorferi B31
KVVRPKITET

SEQ ID NO: 33068 - protein, 10 aa, Borrelia burgdorferi B31
VVRPKITETT

SEQ ID NO: 33069 - protein, 10 aa, Borrelia burgdorferi B31
VRPKITETTA

SEQ ID NO: 33070 - protein, 10 aa, Borrelia burgdorferi B31
RPKITETTAL

SEQ ID NO: 33071 - protein, 10 aa, Borrelia burgdorferi B31
PKITETTALG

SEQ ID NO: 33072 - protein, 10 aa, Borrelia burgdorferi B31
KITETTALGA

SEQ ID NO: 33073 - protein, 10 aa, Borrelia burgdorferi B31
ITETTALGAA

SEQ ID NO: 33074 - protein, 10 aa, Borrelia burgdorferi B31
TETTALGAAY

SEQ ID NO: 33075 - protein, 10 aa, Borrelia burgdorferi B31
ETTALGAAYL

SEQ ID NO: 33076 - protein, 10 aa, Borrelia burgdorferi B31
TTALGAAYLA

SEQ ID NO: 33077 - protein, 10 aa, Borrelia burgdorferi B31
TALGAAYLAG

SEQ ID NO: 33078 - protein, 10 aa, Borrelia burgdorferi B31
ALGAAYLAGL

SEQ ID NO: 33079 - protein, 10 aa, Borrelia burgdorferi B31
LGAAYLAGLA

SEQ ID NO: 33080 - protein, 10 aa, Borrelia burgdorferi B31
GAAYLAGLAT

SEQ ID NO: 33081 - protein, 10 aa, Borrelia burgdorferi B31
AAYLAGLATG

SEQ ID NO: 33082 - protein, 10 aa, Borrelia burgdorferi B31
AYLAGLATGY

SEQ ID NO: 33083 - protein, 10 aa, Borrelia burgdorferi B31
YLAGLATGYW

SEQ ID NO: 33084 - protein, 10 aa, Borrelia burgdorferi B31
LAGLATGYWQ

SEQ ID NO: 33085 - protein, 10 aa, Borrelia burgdorferi B31
AGLATGYWQS

SEQ ID NO: 33086 - protein, 10 aa, Borrelia burgdorferi B31
GLATGYWQSA

SEQ ID NO: 33087 - protein, 10 aa, Borrelia burgdorferi B31
LATGYWQSAE

SEQ ID NO: 33088 - protein, 10 aa, Borrelia burgdorferi B31
ATGYWQSAEE

SEQ ID NO: 33089 - protein, 10 aa, Borrelia burgdorferi B31
TGYWQSAEEI

SEQ ID NO: 33090 - protein, 10 aa, Borrelia burgdorferi B31
GYWQSAEEIV

SEQ ID NO: 33091 - protein, 10 aa, Borrelia burgdorferi B31
YWQSAEEIVS

SEQ ID NO: 33092 - protein, 10 aa, Borrelia burgdorferi B31
WQSAEEIVSL

SEQ ID NO: 33093 - protein, 10 aa, Borrelia burgdorferi B31
QSAEEIVSLW

SEQ ID NO: 33094 - protein, 10 aa, Borrelia burgdorferi B31
SAEEIVSLWQ

SEQ ID NO: 33095 - protein, 10 aa, Borrelia burgdorferi B31
AEEIVSLWQV

SEQ ID NO: 33096 - protein, 10 aa, Borrelia burgdorferi B31
EEIVSLWQVD

SEQ ID NO: 33097 - protein, 10 aa, Borrelia burgdorferi B31
EIVSLWQVDK

SEQ ID NO: 33098 - protein, 10 aa, Borrelia burgdorferi B31
IVSLWQVDKI

SEQ ID NO: 33099 - protein, 10 aa, Borrelia burgdorferi B31
VSLWQVDKIF

SEQ ID NO: 33100 - protein, 10 aa, Borrelia burgdorferi B31
SLWQVDKIFE

SEQ ID NO: 33101 - protein, 10 aa, Borrelia burgdorferi B31
LWQVDKIFEP

SEQ ID NO: 33102 - protein, 10 aa, Borrelia burgdorferi B31
WQVDKIFEPS

SEQ ID NO: 33103 - protein, 10 aa, Borrelia burgdorferi B31
QVDKIFEPSM

SEQ ID NO: 33104 - protein, 10 aa, Borrelia burgdorferi B31
VDKIFEPSMP

SEQ ID NO: 33105 - protein, 10 aa, Borrelia burgdorferi B31
DKIFEPSMPK

SEQ ID NO: 33106 - protein, 10 aa, Borrelia burgdorferi B31
KIFEPSMPKN

SEQ ID NO: 33107 - protein, 10 aa, Borrelia burgdorferi B31
IFEPSMPKNQ

SEQ ID NO: 33108 - protein, 10 aa, Borrelia burgdorferi B31
FEPSMPKNQK

SEQ ID NO: 33109 - protein, 10 aa, Borrelia burgdorferi B31
EPSMPKNQKE

SEQ ID NO: 33110 - protein, 10 aa, Borrelia burgdorferi B31
PSMPKNQKEK

SEQ ID NO: 33111 - protein, 10 aa, Borrelia burgdorferi B31
SMPKNQKEKL

SEQ ID NO: 33112 - protein, 10 aa, Borrelia burgdorferi B31
MPKNQKEKLL

SEQ ID NO: 33113 - protein, 10 aa, Borrelia burgdorferi B31
PKNQKEKLLE

SEQ ID NO: 33114 - protein, 10 aa, Borrelia burgdorferi B31
KNQKEKLLEN

SEQ ID NO: 33115 - protein, 10 aa, Borrelia burgdorferi B31
NQKEKLLENW

SEQ ID NO: 33116 - protein, 10 aa, Borrelia burgdorferi B31
QKEKLLENWN

SEQ ID NO: 33117 - protein, 10 aa, Borrelia burgdorferi B31
KEKLLENWNK

SEQ ID NO: 33118 - protein, 10 aa, Borrelia burgdorferi B31
EKLLENWNKA

SEQ ID NO: 33119 - protein, 10 aa, Borrelia burgdorferi B31
KLLENWNKAV

SEQ ID NO: 33120 - protein, 10 aa, Borrelia burgdorferi B31
LLENWNKAVG

SEQ ID NO: 33121 - protein, 10 aa, Borrelia burgdorferi B31
LENWNKAVGK

SEQ ID NO: 33122 - protein, 10 aa, Borrelia burgdorferi B31
ENWNKAVGKA

SEQ ID NO: 33123 - protein, 10 aa, Borrelia burgdorferi B31
NWNKAVGKAK

SEQ ID NO: 33124 - protein, 10 aa, Borrelia burgdorferi B31
WNKAVGKAKS

SEQ ID NO: 33125 - protein, 10 aa, Borrelia burgdorferi B31
NKAVGKAKSW

SEQ ID NO: 33126 - protein, 10 aa, Borrelia burgdorferi B31
KAVGKAKSWI

SEQ ID NO: 33127 - protein, 10 aa, Borrelia burgdorferi B31
AVGKAKSWIQ

SEQ ID NO: 33128 - protein, 10 aa, Borrelia burgdorferi B31
VGKAKSWIQN

SEQ ID NO: 33129 - protein, 10 aa, Borrelia burgdorferi B31
GKAKSWIQNS

SEQ ID NO: 33130 - protein, 10 aa, Borrelia burgdorferi B31
KAKSWIQNSH

SEQ ID NO: 33131 - protein, 10 aa, Borrelia burgdorferi B31
AKSWIQNSHS

SEQ ID NO: 33132 - protein, 10 aa, Borrelia burgdorferi B31
KSWIQNSHSS

SEQ ID NO: 33133 - protein, 11 aa, Borrelia burgdorferi B31
MKYILSIDQGT

SEQ ID NO: 33134 - protein, 11 aa, Borrelia burgdorferi B31
KYILSIDQGTT

SEQ ID NO: 33135 - protein, 11 aa, Borrelia burgdorferi B31
YILSIDQGTTS

SEQ ID NO: 33136 - protein, 11 aa, Borrelia burgdorferi B31
ILSIDQGTTSS

SEQ ID NO: 33137 - protein, 11 aa, Borrelia burgdorferi B31
LSIDQGTTSSR

SEQ ID NO: 33138 - protein, 11 aa, Borrelia burgdorferi B31
SIDQGTTSSRA

SEQ ID NO: 33139 - protein, 11 aa, Borrelia burgdorferi B31
IDQGTTSSRAM

SEQ ID NO: 33140 - protein, 11 aa, Borrelia burgdorferi B31
DQGTTSSRAMV

SEQ ID NO: 33141 - protein, 11 aa, Borrelia burgdorferi B31
QGTTSSRAMVF

SEQ ID NO: 33142 - protein, 11 aa, Borrelia burgdorferi B31
GTTSSRAMVFD

SEQ ID NO: 33143 - protein, 11 aa, Borrelia burgdorferi B31
TTSSRAMVFDK

SEQ ID NO: 33144 - protein, 11 aa, Borrelia burgdorferi B31
TSSRAMVFDKN

SEQ ID NO: 33145 - protein, 11 aa, Borrelia burgdorferi B31
SSRAMVFDKNA

SEQ ID NO: 33146 - protein, 11 aa, Borrelia burgdorferi B31
SRAMVFDKNAN

SEQ ID NO: 33147 - protein, 11 aa, Borrelia burgdorferi B31
RAMVFDKNANI

SEQ ID NO: 33148 - protein, 11 aa, Borrelia burgdorferi B31
AMVFDKNANIK

SEQ ID NO: 33149 - protein, 11 aa, Borrelia burgdorferi B31
MVFDKNANIKG

SEQ ID NO: 33150 - protein, 11 aa, Borrelia burgdorferi B31
VFDKNANIKGF

SEQ ID NO: 33151 - protein, 11 aa, Borrelia burgdorferi B31
FDKNANIKGFA

SEQ ID NO: 33152 - protein, 11 aa, Borrelia burgdorferi B31
DKNANIKGFAQ

SEQ ID NO: 33153 - protein, 11 aa, Borrelia burgdorferi B31
KNANIKGFAQK

SEQ ID NO: 33154 - protein, 11 aa, Borrelia burgdorferi B31
NANIKGFAQKE

SEQ ID NO: 33155 - protein, 11 aa, Borrelia burgdorferi B31
ANIKGFAQKEF

SEQ ID NO: 33156 - protein, 11 aa, Borrelia burgdorferi B31
NIKGFAQKEFT

SEQ ID NO: 33157 - protein, 11 aa, Borrelia burgdorferi B31
IKGFAQKEFTQ

SEQ ID NO: 33158 - protein, 11 aa, Borrelia burgdorferi B31
KGFAQKEFTQI

SEQ ID NO: 33159 - protein, 11 aa, Borrelia burgdorferi B31
GFAQKEFTQIY

SEQ ID NO: 33160 - protein, 11 aa, Borrelia burgdorferi B31
FAQKEFTQIYP

SEQ ID NO: 33161 - protein, 11 aa, Borrelia burgdorferi B31
AQKEFTQIYPQ

SEQ ID NO: 33162 - protein, 11 aa, Borrelia burgdorferi B31
QKEFTQIYPQP

SEQ ID NO: 33163 - protein, 11 aa, Borrelia burgdorferi B31
KEFTQIYPQPS

SEQ ID NO: 33164 - protein, 11 aa, Borrelia burgdorferi B31
EFTQIYPQPSW

SEQ ID NO: 33165 - protein, 11 aa, Borrelia burgdorferi B31
FTQIYPQPSWV

SEQ ID NO: 33166 - protein, 11 aa, Borrelia burgdorferi B31
TQIYPQPSWVE

SEQ ID NO: 33167 - protein, 11 aa, Borrelia burgdorferi B31
QIYPQPSWVEH

SEQ ID NO: 33168 - protein, 11 aa, Borrelia burgdorferi B31
IYPQPSWVEHD

SEQ ID NO: 33169 - protein, 11 aa, Borrelia burgdorferi B31
YPQPSWVEHDP

SEQ ID NO: 33170 - protein, 11 aa, Borrelia burgdorferi B31
PQPSWVEHDPT

SEQ ID NO: 33171 - protein, 11 aa, Borrelia burgdorferi B31
QPSWVEHDPTE

SEQ ID NO: 33172 - protein, 11 aa, Borrelia burgdorferi B31
PSWVEHDPTEI

SEQ ID NO: 33173 - protein, 11 aa, Borrelia burgdorferi B31
SWVEHDPTEIW

SEQ ID NO: 33174 - protein, 11 aa, Borrelia burgdorferi B31
WVEHDPTEIWG

SEQ ID NO: 33175 - protein, 11 aa, Borrelia burgdorferi B31
VEHDPTEIWGS

SEQ ID NO: 33176 - protein, 11 aa, Borrelia burgdorferi B31
EHDPTEIWGSQ

SEQ ID NO: 33177 - protein, 11 aa, Borrelia burgdorferi B31
HDPTEIWGSQL

SEQ ID NO: 33178 - protein, 11 aa, Borrelia burgdorferi B31
DPTEIWGSQLG

SEQ ID NO: 33179 - protein, 11 aa, Borrelia burgdorferi B31
PTEIWGSQLGV

SEQ ID NO: 33180 - protein, 11 aa, Borrelia burgdorferi B31
TEIWGSQLGVI

SEQ ID NO: 33181 - protein, 11 aa, Borrelia burgdorferi B31
EIWGSQLGVIT

SEQ ID NO: 33182 - protein, 11 aa, Borrelia burgdorferi B31
IWGSQLGVITE

SEQ ID NO: 33183 - protein, 11 aa, Borrelia burgdorferi B31
WGSQLGVITEA

SEQ ID NO: 33184 - protein, 11 aa, Borrelia burgdorferi B31
GSQLGVITEAM

SEQ ID NO: 33185 - protein, 11 aa, Borrelia burgdorferi B31
SQLGVITEAMA

SEQ ID NO: 33186 - protein, 11 aa, Borrelia burgdorferi B31
QLGVITEAMAN

SEQ ID NO: 33187 - protein, 11 aa, Borrelia burgdorferi B31
LGVITEAMANA

SEQ ID NO: 33188 - protein, 11 aa, Borrelia burgdorferi B31
GVITEAMANAR

SEQ ID NO: 33189 - protein, 11 aa, Borrelia burgdorferi B31
VITEAMANARI

SEQ ID NO: 33190 - protein, 11 aa, Borrelia burgdorferi B31
ITEAMANARIL

SEQ ID NO: 33191 - protein, 11 aa, Borrelia burgdorferi B31
TEAMANARILP

SEQ ID NO: 33192 - protein, 11 aa, Borrelia burgdorferi B31
EAMANARILPN

SEQ ID NO: 33193 - protein, 11 aa, Borrelia burgdorferi B31
AMANARILPNE

SEQ ID NO: 33194 - protein, 11 aa, Borrelia burgdorferi B31
MANARILPNEI

SEQ ID NO: 33195 - protein, 11 aa, Borrelia burgdorferi B31
ANARILPNEID

SEQ ID NO: 33196 - protein, 11 aa, Borrelia burgdorferi B31
NARILPNEIDA

SEQ ID NO: 33197 - protein, 11 aa, Borrelia burgdorferi B31
ARILPNEIDAI

SEQ ID NO: 33198 - protein, 11 aa, Borrelia burgdorferi B31
RILPNEIDAIG

SEQ ID NO: 33199 - protein, 11 aa, Borrelia burgdorferi B31
ILPNEIDAIGI

SEQ ID NO: 33200 - protein, 11 aa, Borrelia burgdorferi B31
LPNEIDAIGIT

SEQ ID NO: 33201 - protein, 11 aa, Borrelia burgdorferi B31
PNEIDAIGITN

SEQ ID NO: 33202 - protein, 11 aa, Borrelia burgdorferi B31
NEIDAIGITNQ

SEQ ID NO: 33203 - protein, 11 aa, Borrelia burgdorferi B31
EIDAIGITNQR

SEQ ID NO: 33204 - protein, 11 aa, Borrelia burgdorferi B31
IDAIGITNQRE

SEQ ID NO: 33205 - protein, 11 aa, Borrelia burgdorferi B31
DAIGITNQRET

SEQ ID NO: 33206 - protein, 11 aa, Borrelia burgdorferi B31
AIGITNQRETT

SEQ ID NO: 33207 - protein, 11 aa, Borrelia burgdorferi B31
IGITNQRETTV

SEQ ID NO: 33208 - protein, 11 aa, Borrelia burgdorferi B31
GITNQRETTVI

SEQ ID NO: 33209 - protein, 11 aa, Borrelia burgdorferi B31
ITNQRETTVIW

SEQ ID NO: 33210 - protein, 11 aa, Borrelia burgdorferi B31
TNQRETTVIWE

SEQ ID NO: 33211 - protein, 11 aa, Borrelia burgdorferi B31
NQRETTVIWEK

SEQ ID NO: 33212 - protein, 11 aa, Borrelia burgdorferi B31
QRETTVIWEKN

SEQ ID NO: 33213 - protein, 11 aa, Borrelia burgdorferi B31
RETTVIWEKNT

SEQ ID NO: 33214 - protein, 11 aa, Borrelia burgdorferi B31
ETTVIWEKNTG

SEQ ID NO: 33215 - protein, 11 aa, Borrelia burgdorferi B31
TTVIWEKNTGK

SEQ ID NO: 33216 - protein, 11 aa, Borrelia burgdorferi B31
TVIWEKNTGKP

SEQ ID NO: 33217 - protein, 11 aa, Borrelia burgdorferi B31
VIWEKNTGKPI

SEQ ID NO: 33218 - protein, 11 aa, Borrelia burgdorferi B31
IWEKNTGKPIY

SEQ ID NO: 33219 - protein, 11 aa, Borrelia burgdorferi B31
WEKNTGKPIYN

SEQ ID NO: 33220 - protein, 11 aa, Borrelia burgdorferi B31
EKNTGKPIYNA

SEQ ID NO: 33221 - protein, 11 aa, Borrelia burgdorferi B31
KNTGKPIYNAI

SEQ ID NO: 33222 - protein, 11 aa, Borrelia burgdorferi B31
NTGKPIYNAIV

SEQ ID NO: 33223 - protein, 11 aa, Borrelia burgdorferi B31
TGKPIYNAIVW

SEQ ID NO: 33224 - protein, 11 aa, Borrelia burgdorferi B31
GKPIYNAIVWQ

SEQ ID NO: 33225 - protein, 11 aa, Borrelia burgdorferi B31
KPIYNAIVWQD

SEQ ID NO: 33226 - protein, 11 aa, Borrelia burgdorferi B31
PIYNAIVWQDR

SEQ ID NO: 33227 - protein, 11 aa, Borrelia burgdorferi B31
IYNAIVWQDRR

SEQ ID NO: 33228 - protein, 11 aa, Borrelia burgdorferi B31
YNAIVWQDRRT

SEQ ID NO: 33229 - protein, 11 aa, Borrelia burgdorferi B31
NAIVWQDRRTA

SEQ ID NO: 33230 - protein, 11 aa, Borrelia burgdorferi B31
AIVWQDRRTAK

SEQ ID NO: 33231 - protein, 11 aa, Borrelia burgdorferi B31
IVWQDRRTAKI

SEQ ID NO: 33232 - protein, 11 aa, Borrelia burgdorferi B31
VWQDRRTAKIC

SEQ ID NO: 33233 - protein, 11 aa, Borrelia burgdorferi B31
WQDRRTAKICD

SEQ ID NO: 33234 - protein, 11 aa, Borrelia burgdorferi B31
QDRRTAKICDQ

SEQ ID NO: 33235 - protein, 11 aa, Borrelia burgdorferi B31
DRRTAKICDQL

SEQ ID NO: 33236 - protein, 11 aa, Borrelia burgdorferi B31
RRTAKICDQLK

SEQ ID NO: 33237 - protein, 11 aa, Borrelia burgdorferi B31
RTAKICDQLKK

SEQ ID NO: 33238 - protein, 11 aa, Borrelia burgdorferi B31
TAKICDQLKKE

SEQ ID NO: 33239 - protein, 11 aa, Borrelia burgdorferi B31
AKICDQLKKEG

SEQ ID NO: 33240 - protein, 11 aa, Borrelia burgdorferi B31
KICDQLKKEGK

SEQ ID NO: 33241 - protein, 11 aa, Borrelia burgdorferi B31
ICDQLKKEGKD

SEQ ID NO: 33242 - protein, 11 aa, Borrelia burgdorferi B31
CDQLKKEGKDK

SEQ ID NO: 33243 - protein, 11 aa, Borrelia burgdorferi B31
DQLKKEGKDKI

SEQ ID NO: 33244 - protein, 11 aa, Borrelia burgdorferi B31
QLKKEGKDKII

SEQ ID NO: 33245 - protein, 11 aa, Borrelia burgdorferi B31
LKKEGKDKIIL

SEQ ID NO: 33246 - protein, 11 aa, Borrelia burgdorferi B31
KKEGKDKIILE

SEQ ID NO: 33247 - protein, 11 aa, Borrelia burgdorferi B31
KEGKDKIILEK

SEQ ID NO: 33248 - protein, 11 aa, Borrelia burgdorferi B31
EGKDKIILEKT

SEQ ID NO: 33249 - protein, 11 aa, Borrelia burgdorferi B31
GKDKIILEKTG

SEQ ID NO: 33250 - protein, 11 aa, Borrelia burgdorferi B31
KDKIILEKTGL

SEQ ID NO: 33251 - protein, 11 aa, Borrelia burgdorferi B31
DKIILEKTGLV

SEQ ID NO: 33252 - protein, 11 aa, Borrelia burgdorferi B31
KIILEKTGLVL

SEQ ID NO: 33253 - protein, 11 aa, Borrelia burgdorferi B31
IILEKTGLVLD

SEQ ID NO: 33254 - protein, 11 aa, Borrelia burgdorferi B31
ILEKTGLVLDS

SEQ ID NO: 33255 - protein, 11 aa, Borrelia burgdorferi B31
LEKTGLVLDSY

SEQ ID NO: 33256 - protein, 11 aa, Borrelia burgdorferi B31
EKTGLVLDSYF

SEQ ID NO: 33257 - protein, 11 aa, Borrelia burgdorferi B31
KTGLVLDSYFS

SEQ ID NO: 33258 - protein, 11 aa, Borrelia burgdorferi B31
TGLVLDSYFSG

SEQ ID NO: 33259 - protein, 11 aa, Borrelia burgdorferi B31
GLVLDSYFSGT

SEQ ID NO: 33260 - protein, 11 aa, Borrelia burgdorferi B31
LVLDSYFSGTK

SEQ ID NO: 33261 - protein, 11 aa, Borrelia burgdorferi B31
VLDSYFSGTKI

SEQ ID NO: 33262 - protein, 11 aa, Borrelia burgdorferi B31
LDSYFSGTKIM

SEQ ID NO: 33263 - protein, 11 aa, Borrelia burgdorferi B31
DSYFSGTKIMW

SEQ ID NO: 33264 - protein, 11 aa, Borrelia burgdorferi B31
SYFSGTKIMWI

SEQ ID NO: 33265 - protein, 11 aa, Borrelia burgdorferi B31
YFSGTKIMWIL

SEQ ID NO: 33266 - protein, 11 aa, Borrelia burgdorferi B31
FSGTKIMWILD

SEQ ID NO: 33267 - protein, 11 aa, Borrelia burgdorferi B31
SGTKIMWILDN

SEQ ID NO: 33268 - protein, 11 aa, Borrelia burgdorferi B31
GTKIMWILDNV

SEQ ID NO: 33269 - protein, 11 aa, Borrelia burgdorferi B31
TKIMWILDNVE

SEQ ID NO: 33270 - protein, 11 aa, Borrelia burgdorferi B31
KIMWILDNVEG

SEQ ID NO: 33271 - protein, 11 aa, Borrelia burgdorferi B31
IMWILDNVEGA

SEQ ID NO: 33272 - protein, 11 aa, Borrelia burgdorferi B31
MWILDNVEGAR

SEQ ID NO: 33273 - protein, 11 aa, Borrelia burgdorferi B31
WILDNVEGARQ

SEQ ID NO: 33274 - protein, 11 aa, Borrelia burgdorferi B31
ILDNVEGARQR

SEQ ID NO: 33275 - protein, 11 aa, Borrelia burgdorferi B31
LDNVEGARQRA

SEQ ID NO: 33276 - protein, 11 aa, Borrelia burgdorferi B31
DNVEGARQRAE

SEQ ID NO: 33277 - protein, 11 aa, Borrelia burgdorferi B31
NVEGARQRAEN

SEQ ID NO: 33278 - protein, 11 aa, Borrelia burgdorferi B31
VEGARQRAENG

SEQ ID NO: 33279 - protein, 11 aa, Borrelia burgdorferi B31
EGARQRAENGE

SEQ ID NO: 33280 - protein, 11 aa, Borrelia burgdorferi B31
GARQRAENGEL

SEQ ID NO: 33281 - protein, 11 aa, Borrelia burgdorferi B31
ARQRAENGELC

SEQ ID NO: 33282 - protein, 11 aa, Borrelia burgdorferi B31
RQRAENGELCF

SEQ ID NO: 33283 - protein, 11 aa, Borrelia burgdorferi B31
QRAENGELCFG

SEQ ID NO: 33284 - protein, 11 aa, Borrelia burgdorferi B31
RAENGELCFGT

SEQ ID NO: 33285 - protein, 11 aa, Borrelia burgdorferi B31
AENGELCFGTI

SEQ ID NO: 33286 - protein, 11 aa, Borrelia burgdorferi B31
ENGELCFGTID

SEQ ID NO: 33287 - protein, 11 aa, Borrelia burgdorferi B31
NGELCFGTIDT

SEQ ID NO: 33288 - protein, 11 aa, Borrelia burgdorferi B31
GELCFGTIDTW

SEQ ID NO: 33289 - protein, 11 aa, Borrelia burgdorferi B31
ELCFGTIDTWI

SEQ ID NO: 33290 - protein, 11 aa, Borrelia burgdorferi B31
LCFGTIDTWIL

SEQ ID NO: 33291 - protein, 11 aa, Borrelia burgdorferi B31
CFGTIDTWILW

SEQ ID NO: 33292 - protein, 11 aa, Borrelia burgdorferi B31
FGTIDTWILWN

SEQ ID NO: 33293 - protein, 11 aa, Borrelia burgdorferi B31
GTIDTWILWNL

SEQ ID NO: 33294 - protein, 11 aa, Borrelia burgdorferi B31
TIDTWILWNLT

SEQ ID NO: 33295 - protein, 11 aa, Borrelia burgdorferi B31
IDTWILWNLTQ

SEQ ID NO: 33296 - protein, 11 aa, Borrelia burgdorferi B31
DTWILWNLTQK

SEQ ID NO: 33297 - protein, 11 aa, Borrelia burgdorferi B31
TWILWNLTQKK

SEQ ID NO: 33298 - protein, 11 aa, Borrelia burgdorferi B31
WILWNLTQKKE

SEQ ID NO: 33299 - protein, 11 aa, Borrelia burgdorferi B31
ILWNLTQKKEH

SEQ ID NO: 33300 - protein, 11 aa, Borrelia burgdorferi B31
LWNLTQKKEHA

SEQ ID NO: 33301 - protein, 11 aa, Borrelia burgdorferi B31
WNLTQKKEHAT

SEQ ID NO: 33302 - protein, 11 aa, Borrelia burgdorferi B31
NLTQKKEHATD

SEQ ID NO: 33303 - protein, 11 aa, Borrelia burgdorferi B31
LTQKKEHATDY

SEQ ID NO: 33304 - protein, 11 aa, Borrelia burgdorferi B31
TQKKEHATDYS

SEQ ID NO: 33305 - protein, 11 aa, Borrelia burgdorferi B31
QKKEHATDYSN

SEQ ID NO: 33306 - protein, 11 aa, Borrelia burgdorferi B31
KKEHATDYSNA

SEQ ID NO: 33307 - protein, 11 aa, Borrelia burgdorferi B31
KEHATDYSNAS

SEQ ID NO: 33308 - protein, 11 aa, Borrelia burgdorferi B31
EHATDYSNASR

SEQ ID NO: 33309 - protein, 11 aa, Borrelia burgdorferi B31
HATDYSNASRT

SEQ ID NO: 33310 - protein, 11 aa, Borrelia burgdorferi B31
ATDYSNASRTL

SEQ ID NO: 33311 - protein, 11 aa, Borrelia burgdorferi B31
TDYSNASRTLL

SEQ ID NO: 33312 - protein, 11 aa, Borrelia burgdorferi B31
DYSNASRTLLL

SEQ ID NO: 33313 - protein, 11 aa, Borrelia burgdorferi B31
YSNASRTLLLN

SEQ ID NO: 33314 - protein, 11 aa, Borrelia burgdorferi B31
SNASRTLLLNI

SEQ ID NO: 33315 - protein, 11 aa, Borrelia burgdorferi B31
NASRTLLLNIK

SEQ ID NO: 33316 - protein, 11 aa, Borrelia burgdorferi B31
ASRTLLLNIKT

SEQ ID NO: 33317 - protein, 11 aa, Borrelia burgdorferi B31
SRTLLLNIKTL

SEQ ID NO: 33318 - protein, 11 aa, Borrelia burgdorferi B31
RTLLLNIKTLE

SEQ ID NO: 33319 - protein, 11 aa, Borrelia burgdorferi B31
TLLLNIKTLEW

SEQ ID NO: 33320 - protein, 11 aa, Borrelia burgdorferi B31
LLLNIKTLEWD

SEQ ID NO: 33321 - protein, 11 aa, Borrelia burgdorferi B31
LLNIKTLEWDD

SEQ ID NO: 33322 - protein, 11 aa, Borrelia burgdorferi B31
LNIKTLEWDDE

SEQ ID NO: 33323 - protein, 11 aa, Borrelia burgdorferi B31
NIKTLEWDDEL

SEQ ID NO: 33324 - protein, 11 aa, Borrelia burgdorferi B31
IKTLEWDDELL

SEQ ID NO: 33325 - protein, 11 aa, Borrelia burgdorferi B31
KTLEWDDELLS

SEQ ID NO: 33326 - protein, 11 aa, Borrelia burgdorferi B31
TLEWDDELLSI

SEQ ID NO: 33327 - protein, 11 aa, Borrelia burgdorferi B31
LEWDDELLSIL

SEQ ID NO: 33328 - protein, 11 aa, Borrelia burgdorferi B31
EWDDELLSILN

SEQ ID NO: 33329 - protein, 11 aa, Borrelia burgdorferi B31
WDDELLSILNV

SEQ ID NO: 33330 - protein, 11 aa, Borrelia burgdorferi B31
DDELLSILNVP

SEQ ID NO: 33331 - protein, 11 aa, Borrelia burgdorferi B31
DELLSILNVPR

SEQ ID NO: 33332 - protein, 11 aa, Borrelia burgdorferi B31
ELLSILNVPRA

SEQ ID NO: 33333 - protein, 11 aa, Borrelia burgdorferi B31
LLSILNVPRAI

SEQ ID NO: 33334 - protein, 11 aa, Borrelia burgdorferi B31
LSILNVPRAIL

SEQ ID NO: 33335 - protein, 11 aa, Borrelia burgdorferi B31
SILNVPRAILP

SEQ ID NO: 33336 - protein, 11 aa, Borrelia burgdorferi B31
ILNVPRAILPE

SEQ ID NO: 33337 - protein, 11 aa, Borrelia burgdorferi B31
LNVPRAILPEL

SEQ ID NO: 33338 - protein, 11 aa, Borrelia burgdorferi B31
NVPRAILPELK

SEQ ID NO: 33339 - protein, 11 aa, Borrelia burgdorferi B31
VPRAILPELKE

SEQ ID NO: 33340 - protein, 11 aa, Borrelia burgdorferi B31
PRAILPELKES

SEQ ID NO: 33341 - protein, 11 aa, Borrelia burgdorferi B31
RAILPELKESS

SEQ ID NO: 33342 - protein, 11 aa, Borrelia burgdorferi B31
AILPELKESST

SEQ ID NO: 33343 - protein, 11 aa, Borrelia burgdorferi B31
ILPELKESSTI

SEQ ID NO: 33344 - protein, 11 aa, Borrelia burgdorferi B31
LPELKESSTIY

SEQ ID NO: 33345 - protein, 11 aa, Borrelia burgdorferi B31
PELKESSTIYG

SEQ ID NO: 33346 - protein, 11 aa, Borrelia burgdorferi B31
ELKESSTIYGK

SEQ ID NO: 33347 - protein, 11 aa, Borrelia burgdorferi B31
LKESSTIYGKT

SEQ ID NO: 33348 - protein, 11 aa, Borrelia burgdorferi B31
KESSTIYGKTD

SEQ ID NO: 33349 - protein, 11 aa, Borrelia burgdorferi B31
ESSTIYGKTDK

SEQ ID NO: 33350 - protein, 11 aa, Borrelia burgdorferi B31
SSTIYGKTDKA

SEQ ID NO: 33351 - protein, 11 aa, Borrelia burgdorferi B31
STIYGKTDKAL

SEQ ID NO: 33352 - protein, 11 aa, Borrelia burgdorferi B31
TIYGKTDKALF

SEQ ID NO: 33353 - protein, 11 aa, Borrelia burgdorferi B31
IYGKTDKALFG

SEQ ID NO: 33354 - protein, 11 aa, Borrelia burgdorferi B31
YGKTDKALFGA

SEQ ID NO: 33355 - protein, 11 aa, Borrelia burgdorferi B31
GKTDKALFGAE

SEQ ID NO: 33356 - protein, 11 aa, Borrelia burgdorferi B31
KTDKALFGAEI

SEQ ID NO: 33357 - protein, 11 aa, Borrelia burgdorferi B31
TDKALFGAEIP

SEQ ID NO: 33358 - protein, 11 aa, Borrelia burgdorferi B31
DKALFGAEIPI

SEQ ID NO: 33359 - protein, 11 aa, Borrelia burgdorferi B31
KALFGAEIPIA

SEQ ID NO: 33360 - protein, 11 aa, Borrelia burgdorferi B31
ALFGAEIPIAG

SEQ ID NO: 33361 - protein, 11 aa, Borrelia burgdorferi B31
LFGAEIPIAGI

SEQ ID NO: 33362 - protein, 11 aa, Borrelia burgdorferi B31
FGAEIPIAGIA

SEQ ID NO: 33363 - protein, 11 aa, Borrelia burgdorferi B31
GAEIPIAGIAG

SEQ ID NO: 33364 - protein, 11 aa, Borrelia burgdorferi B31
AEIPIAGIAGD

SEQ ID NO: 33365 - protein, 11 aa, Borrelia burgdorferi B31
EIPIAGIAGDQ

SEQ ID NO: 33366 - protein, 11 aa, Borrelia burgdorferi B31
IPIAGIAGDQF

SEQ ID NO: 33367 - protein, 11 aa, Borrelia burgdorferi B31
PIAGIAGDQFA

SEQ ID NO: 33368 - protein, 11 aa, Borrelia burgdorferi B31
IAGIAGDQFAA

SEQ ID NO: 33369 - protein, 11 aa, Borrelia burgdorferi B31
AGIAGDQFAAT

SEQ ID NO: 33370 - protein, 11 aa, Borrelia burgdorferi B31
GIAGDQFAATF

SEQ ID NO: 33371 - protein, 11 aa, Borrelia burgdorferi B31
IAGDQFAATFG

SEQ ID NO: 33372 - protein, 11 aa, Borrelia burgdorferi B31
AGDQFAATFGQ

SEQ ID NO: 33373 - protein, 11 aa, Borrelia burgdorferi B31
GDQFAATFGQA

SEQ ID NO: 33374 - protein, 11 aa, Borrelia burgdorferi B31
DQFAATFGQAC

SEQ ID NO: 33375 - protein, 11 aa, Borrelia burgdorferi B31
QFAATFGQACL

SEQ ID NO: 33376 - protein, 11 aa, Borrelia burgdorferi B31
FAATFGQACLK

SEQ ID NO: 33377 - protein, 11 aa, Borrelia burgdorferi B31
AATFGQACLKK

SEQ ID NO: 33378 - protein, 11 aa, Borrelia burgdorferi B31
ATFGQACLKKG

SEQ ID NO: 33379 - protein, 11 aa, Borrelia burgdorferi B31
TFGQACLKKGM

SEQ ID NO: 33380 - protein, 11 aa, Borrelia burgdorferi B31
FGQACLKKGMA

SEQ ID NO: 33381 - protein, 11 aa, Borrelia burgdorferi B31
GQACLKKGMAK

SEQ ID NO: 33382 - protein, 11 aa, Borrelia burgdorferi B31
QACLKKGMAKN

SEQ ID NO: 33383 - protein, 11 aa, Borrelia burgdorferi B31
ACLKKGMAKNT

SEQ ID NO: 33384 - protein, 11 aa, Borrelia burgdorferi B31
CLKKGMAKNTY

SEQ ID NO: 33385 - protein, 11 aa, Borrelia burgdorferi B31
LKKGMAKNTYG

SEQ ID NO: 33386 - protein, 11 aa, Borrelia burgdorferi B31
KKGMAKNTYGT

SEQ ID NO: 33387 - protein, 11 aa, Borrelia burgdorferi B31
KGMAKNTYGTG

SEQ ID NO: 33388 - protein, 11 aa, Borrelia burgdorferi B31
GMAKNTYGTGC

SEQ ID NO: 33389 - protein, 11 aa, Borrelia burgdorferi B31
MAKNTYGTGCF

SEQ ID NO: 33390 - protein, 11 aa, Borrelia burgdorferi B31
AKNTYGTGCFL

SEQ ID NO: 33391 - protein, 11 aa, Borrelia burgdorferi B31
KNTYGTGCFLT

SEQ ID NO: 33392 - protein, 11 aa, Borrelia burgdorferi B31
NTYGTGCFLTV

SEQ ID NO: 33393 - protein, 11 aa, Borrelia burgdorferi B31
TYGTGCFLTVN

SEQ ID NO: 33394 - protein, 11 aa, Borrelia burgdorferi B31
YGTGCFLTVNI

SEQ ID NO: 33395 - protein, 11 aa, Borrelia burgdorferi B31
GTGCFLTVNIG

SEQ ID NO: 33396 - protein, 11 aa, Borrelia burgdorferi B31
TGCFLTVNIGK

SEQ ID NO: 33397 - protein, 11 aa, Borrelia burgdorferi B31
GCFLTVNIGKE

SEQ ID NO: 33398 - protein, 11 aa, Borrelia burgdorferi B31
CFLTVNIGKEP

SEQ ID NO: 33399 - protein, 11 aa, Borrelia burgdorferi B31
FLTVNIGKEPI

SEQ ID NO: 33400 - protein, 11 aa, Borrelia burgdorferi B31
LTVNIGKEPII

SEQ ID NO: 33401 - protein, 11 aa, Borrelia burgdorferi B31
TVNIGKEPIIS

SEQ ID NO: 33402 - protein, 11 aa, Borrelia burgdorferi B31
VNIGKEPIISH

SEQ ID NO: 33403 - protein, 11 aa, Borrelia burgdorferi B31
NIGKEPIISHD

SEQ ID NO: 33404 - protein, 11 aa, Borrelia burgdorferi B31
IGKEPIISHDK

SEQ ID NO: 33405 - protein, 11 aa, Borrelia burgdorferi B31
GKEPIISHDKL

SEQ ID NO: 33406 - protein, 11 aa, Borrelia burgdorferi B31
KEPIISHDKLL

SEQ ID NO: 33407 - protein, 11 aa, Borrelia burgdorferi B31
EPIISHDKLLT

SEQ ID NO: 33408 - protein, 11 aa, Borrelia burgdorferi B31
PIISHDKLLTS

SEQ ID NO: 33409 - protein, 11 aa, Borrelia burgdorferi B31
IISHDKLLTSI

SEQ ID NO: 33410 - protein, 11 aa, Borrelia burgdorferi B31
ISHDKLLTSIA

SEQ ID NO: 33411 - protein, 11 aa, Borrelia burgdorferi B31
SHDKLLTSIAW

SEQ ID NO: 33412 - protein, 11 aa, Borrelia burgdorferi B31
HDKLLTSIAWG

SEQ ID NO: 33413 - protein, 11 aa, Borrelia burgdorferi B31
DKLLTSIAWGR

SEQ ID NO: 33414 - protein, 11 aa, Borrelia burgdorferi B31
KLLTSIAWGRK

SEQ ID NO: 33415 - protein, 11 aa, Borrelia burgdorferi B31
LLTSIAWGRKK

SEQ ID NO: 33416 - protein, 11 aa, Borrelia burgdorferi B31
LTSIAWGRKKS

SEQ ID NO: 33417 - protein, 11 aa, Borrelia burgdorferi B31
TSIAWGRKKSV

SEQ ID NO: 33418 - protein, 11 aa, Borrelia burgdorferi B31
SIAWGRKKSVT

SEQ ID NO: 33419 - protein, 11 aa, Borrelia burgdorferi B31
IAWGRKKSVTY

SEQ ID NO: 33420 - protein, 11 aa, Borrelia burgdorferi B31
AWGRKKSVTYV

SEQ ID NO: 33421 - protein, 11 aa, Borrelia burgdorferi B31
WGRKKSVTYVL

SEQ ID NO: 33422 - protein, 11 aa, Borrelia burgdorferi B31
GRKKSVTYVLE

SEQ ID NO: 33423 - protein, 11 aa, Borrelia burgdorferi B31
RKKSVTYVLEG

SEQ ID NO: 33424 - protein, 11 aa, Borrelia burgdorferi B31
KKSVTYVLEGS

SEQ ID NO: 33425 - protein, 11 aa, Borrelia burgdorferi B31
KSVTYVLEGSV

SEQ ID NO: 33426 - protein, 11 aa, Borrelia burgdorferi B31
SVTYVLEGSVF

SEQ ID NO: 33427 - protein, 11 aa, Borrelia burgdorferi B31
VTYVLEGSVFI

SEQ ID NO: 33428 - protein, 11 aa, Borrelia burgdorferi B31
TYVLEGSVFIG

SEQ ID NO: 33429 - protein, 11 aa, Borrelia burgdorferi B31
YVLEGSVFIGG

SEQ ID NO: 33430 - protein, 11 aa, Borrelia burgdorferi B31
VLEGSVFIGGA

SEQ ID NO: 33431 - protein, 11 aa, Borrelia burgdorferi B31
LEGSVFIGGAV

SEQ ID NO: 33432 - protein, 11 aa, Borrelia burgdorferi B31
EGSVFIGGAVI

SEQ ID NO: 33433 - protein, 11 aa, Borrelia burgdorferi B31
GSVFIGGAVIQ

SEQ ID NO: 33434 - protein, 11 aa, Borrelia burgdorferi B31
SVFIGGAVIQW

SEQ ID NO: 33435 - protein, 11 aa, Borrelia burgdorferi B31
VFIGGAVIQWL

SEQ ID NO: 33436 - protein, 11 aa, Borrelia burgdorferi B31
FIGGAVIQWLR

SEQ ID NO: 33437 - protein, 11 aa, Borrelia burgdorferi B31
IGGAVIQWLRD

SEQ ID NO: 33438 - protein, 11 aa, Borrelia burgdorferi B31
GGAVIQWLRDG

SEQ ID NO: 33439 - protein, 11 aa, Borrelia burgdorferi B31
GAVIQWLRDGL

SEQ ID NO: 33440 - protein, 11 aa, Borrelia burgdorferi B31
AVIQWLRDGLE

SEQ ID NO: 33441 - protein, 11 aa, Borrelia burgdorferi B31
VIQWLRDGLEF

SEQ ID NO: 33442 - protein, 11 aa, Borrelia burgdorferi B31
IQWLRDGLEFF

SEQ ID NO: 33443 - protein, 11 aa, Borrelia burgdorferi B31
QWLRDGLEFFR

SEQ ID NO: 33444 - protein, 11 aa, Borrelia burgdorferi B31
WLRDGLEFFRK

SEQ ID NO: 33445 - protein, 11 aa, Borrelia burgdorferi B31
LRDGLEFFRKS

SEQ ID NO: 33446 - protein, 11 aa, Borrelia burgdorferi B31
RDGLEFFRKSS

SEQ ID NO: 33447 - protein, 11 aa, Borrelia burgdorferi B31
DGLEFFRKSSD

SEQ ID NO: 33448 - protein, 11 aa, Borrelia burgdorferi B31
GLEFFRKSSDA

SEQ ID NO: 33449 - protein, 11 aa, Borrelia burgdorferi B31
LEFFRKSSDAE

SEQ ID NO: 33450 - protein, 11 aa, Borrelia burgdorferi B31
EFFRKSSDAEA

SEQ ID NO: 33451 - protein, 11 aa, Borrelia burgdorferi B31
FFRKSSDAEAL

SEQ ID NO: 33452 - protein, 11 aa, Borrelia burgdorferi B31
FRKSSDAEALA

SEQ ID NO: 33453 - protein, 11 aa, Borrelia burgdorferi B31
RKSSDAEALAS

SEQ ID NO: 33454 - protein, 11 aa, Borrelia burgdorferi B31
KSSDAEALASS

SEQ ID NO: 33455 - protein, 11 aa, Borrelia burgdorferi B31
SSDAEALASSV

SEQ ID NO: 33456 - protein, 11 aa, Borrelia burgdorferi B31
SDAEALASSVS

SEQ ID NO: 33457 - protein, 11 aa, Borrelia burgdorferi B31
DAEALASSVSD

SEQ ID NO: 33458 - protein, 11 aa, Borrelia burgdorferi B31
AEALASSVSDN

SEQ ID NO: 33459 - protein, 11 aa, Borrelia burgdorferi B31
EALASSVSDNG

SEQ ID NO: 33460 - protein, 11 aa, Borrelia burgdorferi B31
ALASSVSDNGG

SEQ ID NO: 33461 - protein, 11 aa, Borrelia burgdorferi B31
LASSVSDNGGV

SEQ ID NO: 33462 - protein, 11 aa, Borrelia burgdorferi B31
ASSVSDNGGVY

SEQ ID NO: 33463 - protein, 11 aa, Borrelia burgdorferi B31
SSVSDNGGVYF

SEQ ID NO: 33464 - protein, 11 aa, Borrelia burgdorferi B31
SVSDNGGVYFV

SEQ ID NO: 33465 - protein, 11 aa, Borrelia burgdorferi B31
VSDNGGVYFVP

SEQ ID NO: 33466 - protein, 11 aa, Borrelia burgdorferi B31
SDNGGVYFVPA

SEQ ID NO: 33467 - protein, 11 aa, Borrelia burgdorferi B31
DNGGVYFVPAF

SEQ ID NO: 33468 - protein, 11 aa, Borrelia burgdorferi B31
NGGVYFVPAFV

SEQ ID NO: 33469 - protein, 11 aa, Borrelia burgdorferi B31
GGVYFVPAFVG

SEQ ID NO: 33470 - protein, 11 aa, Borrelia burgdorferi B31
GVYFVPAFVGL

SEQ ID NO: 33471 - protein, 11 aa, Borrelia burgdorferi B31
VYFVPAFVGLG

SEQ ID NO: 33472 - protein, 11 aa, Borrelia burgdorferi B31
YFVPAFVGLGA

SEQ ID NO: 33473 - protein, 11 aa, Borrelia burgdorferi B31
FVPAFVGLGAP

SEQ ID NO: 33474 - protein, 11 aa, Borrelia burgdorferi B31
VPAFVGLGAPH

SEQ ID NO: 33475 - protein, 11 aa, Borrelia burgdorferi B31
PAFVGLGAPHW

SEQ ID NO: 33476 - protein, 11 aa, Borrelia burgdorferi B31
AFVGLGAPHWD

SEQ ID NO: 33477 - protein, 11 aa, Borrelia burgdorferi B31
FVGLGAPHWDS

SEQ ID NO: 33478 - protein, 11 aa, Borrelia burgdorferi B31
VGLGAPHWDSY

SEQ ID NO: 33479 - protein, 11 aa, Borrelia burgdorferi B31
GLGAPHWDSYA

SEQ ID NO: 33480 - protein, 11 aa, Borrelia burgdorferi B31
LGAPHWDSYAR

SEQ ID NO: 33481 - protein, 11 aa, Borrelia burgdorferi B31
GAPHWDSYARG

SEQ ID NO: 33482 - protein, 11 aa, Borrelia burgdorferi B31
APHWDSYARGT

SEQ ID NO: 33483 - protein, 11 aa, Borrelia burgdorferi B31
PHWDSYARGTI

SEQ ID NO: 33484 - protein, 11 aa, Borrelia burgdorferi B31
HWDSYARGTII

SEQ ID NO: 33485 - protein, 11 aa, Borrelia burgdorferi B31
WDSYARGTIIG

SEQ ID NO: 33486 - protein, 11 aa, Borrelia burgdorferi B31
DSYARGTIIGI

SEQ ID NO: 33487 - protein, 11 aa, Borrelia burgdorferi B31
SYARGTIIGIT

SEQ ID NO: 33488 - protein, 11 aa, Borrelia burgdorferi B31
YARGTIIGITR

SEQ ID NO: 33489 - protein, 11 aa, Borrelia burgdorferi B31
ARGTIIGITRG

SEQ ID NO: 33490 - protein, 11 aa, Borrelia burgdorferi B31
RGTIIGITRGS

SEQ ID NO: 33491 - protein, 11 aa, Borrelia burgdorferi B31
GTIIGITRGST

SEQ ID NO: 33492 - protein, 11 aa, Borrelia burgdorferi B31
TIIGITRGSTK

SEQ ID NO: 33493 - protein, 11 aa, Borrelia burgdorferi B31
IIGITRGSTKA

SEQ ID NO: 33494 - protein, 11 aa, Borrelia burgdorferi B31
IGITRGSTKAH

SEQ ID NO: 33495 - protein, 11 aa, Borrelia burgdorferi B31
GITRGSTKAHI

SEQ ID NO: 33496 - protein, 11 aa, Borrelia burgdorferi B31
ITRGSTKAHIT

SEQ ID NO: 33497 - protein, 11 aa, Borrelia burgdorferi B31
TRGSTKAHITR

SEQ ID NO: 33498 - protein, 11 aa, Borrelia burgdorferi B31
RGSTKAHITRA

SEQ ID NO: 33499 - protein, 11 aa, Borrelia burgdorferi B31
GSTKAHITRAA

SEQ ID NO: 33500 - protein, 11 aa, Borrelia burgdorferi B31
STKAHITRAAL

SEQ ID NO: 33501 - protein, 11 aa, Borrelia burgdorferi B31
TKAHITRAALE

SEQ ID NO: 33502 - protein, 11 aa, Borrelia burgdorferi B31
KAHITRAALES

SEQ ID NO: 33503 - protein, 11 aa, Borrelia burgdorferi B31
AHITRAALESI

SEQ ID NO: 33504 - protein, 11 aa, Borrelia burgdorferi B31
HITRAALESIA

SEQ ID NO: 33505 - protein, 11 aa, Borrelia burgdorferi B31
ITRAALESIAF

SEQ ID NO: 33506 - protein, 11 aa, Borrelia burgdorferi B31
TRAALESIAFQ

SEQ ID NO: 33507 - protein, 11 aa, Borrelia burgdorferi B31
RAALESIAFQS

SEQ ID NO: 33508 - protein, 11 aa, Borrelia burgdorferi B31
AALESIAFQSF

SEQ ID NO: 33509 - protein, 11 aa, Borrelia burgdorferi B31
ALESIAFQSFD

SEQ ID NO: 33510 - protein, 11 aa, Borrelia burgdorferi B31
LESIAFQSFDI

SEQ ID NO: 33511 - protein, 11 aa, Borrelia burgdorferi B31
ESIAFQSFDIL

SEQ ID NO: 33512 - protein, 11 aa, Borrelia burgdorferi B31
SIAFQSFDILN

SEQ ID NO: 33513 - protein, 11 aa, Borrelia burgdorferi B31
IAFQSFDILNT

SEQ ID NO: 33514 - protein, 11 aa, Borrelia burgdorferi B31
AFQSFDILNTM

SEQ ID NO: 33515 - protein, 11 aa, Borrelia burgdorferi B31
FQSFDILNTMK

SEQ ID NO: 33516 - protein, 11 aa, Borrelia burgdorferi B31
QSFDILNTMKK

SEQ ID NO: 33517 - protein, 11 aa, Borrelia burgdorferi B31
SFDILNTMKKS

SEQ ID NO: 33518 - protein, 11 aa, Borrelia burgdorferi B31
FDILNTMKKSI

SEQ ID NO: 33519 - protein, 11 aa, Borrelia burgdorferi B31
DILNTMKKSIP

SEQ ID NO: 33520 - protein, 11 aa, Borrelia burgdorferi B31
ILNTMKKSIPN

SEQ ID NO: 33521 - protein, 11 aa, Borrelia burgdorferi B31
LNTMKKSIPNF

SEQ ID NO: 33522 - protein, 11 aa, Borrelia burgdorferi B31
NTMKKSIPNFE

SEQ ID NO: 33523 - protein, 11 aa, Borrelia burgdorferi B31
TMKKSIPNFEI

SEQ ID NO: 33524 - protein, 11 aa, Borrelia burgdorferi B31
MKKSIPNFEIQ

SEQ ID NO: 33525 - protein, 11 aa, Borrelia burgdorferi B31
KKSIPNFEIQE

SEQ ID NO: 33526 - protein, 11 aa, Borrelia burgdorferi B31
KSIPNFEIQEL

SEQ ID NO: 33527 - protein, 11 aa, Borrelia burgdorferi B31
SIPNFEIQELR

SEQ ID NO: 33528 - protein, 11 aa, Borrelia burgdorferi B31
IPNFEIQELRV

SEQ ID NO: 33529 - protein, 11 aa, Borrelia burgdorferi B31
PNFEIQELRVD

SEQ ID NO: 33530 - protein, 11 aa, Borrelia burgdorferi B31
NFEIQELRVDG

SEQ ID NO: 33531 - protein, 11 aa, Borrelia burgdorferi B31
FEIQELRVDGG

SEQ ID NO: 33532 - protein, 11 aa, Borrelia burgdorferi B31
EIQELRVDGGA

SEQ ID NO: 33533 - protein, 11 aa, Borrelia burgdorferi B31
IQELRVDGGAS

SEQ ID NO: 33534 - protein, 11 aa, Borrelia burgdorferi B31
QELRVDGGASQ

SEQ ID NO: 33535 - protein, 11 aa, Borrelia burgdorferi B31
ELRVDGGASQN

SEQ ID NO: 33536 - protein, 11 aa, Borrelia burgdorferi B31
LRVDGGASQNN

SEQ ID NO: 33537 - protein, 11 aa, Borrelia burgdorferi B31
RVDGGASQNNL

SEQ ID NO: 33538 - protein, 11 aa, Borrelia burgdorferi B31
VDGGASQNNLL

SEQ ID NO: 33539 - protein, 11 aa, Borrelia burgdorferi B31
DGGASQNNLLM

SEQ ID NO: 33540 - protein, 11 aa, Borrelia burgdorferi B31
GGASQNNLLMQ

SEQ ID NO: 33541 - protein, 11 aa, Borrelia burgdorferi B31
GASQNNLLMQF

SEQ ID NO: 33542 - protein, 11 aa, Borrelia burgdorferi B31
ASQNNLLMQFQ

SEQ ID NO: 33543 - protein, 11 aa, Borrelia burgdorferi B31
SQNNLLMQFQA

SEQ ID NO: 33544 - protein, 11 aa, Borrelia burgdorferi B31
QNNLLMQFQAD

SEQ ID NO: 33545 - protein, 11 aa, Borrelia burgdorferi B31
NNLLMQFQADL

SEQ ID NO: 33546 - protein, 11 aa, Borrelia burgdorferi B31
NLLMQFQADLL

SEQ ID NO: 33547 - protein, 11 aa, Borrelia burgdorferi B31
LLMQFQADLLE

SEQ ID NO: 33548 - protein, 11 aa, Borrelia burgdorferi B31
LMQFQADLLEC

SEQ ID NO: 33549 - protein, 11 aa, Borrelia burgdorferi B31
MQFQADLLECK

SEQ ID NO: 33550 - protein, 11 aa, Borrelia burgdorferi B31
QFQADLLECKV

SEQ ID NO: 33551 - protein, 11 aa, Borrelia burgdorferi B31
FQADLLECKVV

SEQ ID NO: 33552 - protein, 11 aa, Borrelia burgdorferi B31
QADLLECKVVR

SEQ ID NO: 33553 - protein, 11 aa, Borrelia burgdorferi B31
ADLLECKVVRP

SEQ ID NO: 33554 - protein, 11 aa, Borrelia burgdorferi B31
DLLECKVVRPK

SEQ ID NO: 33555 - protein, 11 aa, Borrelia burgdorferi B31
LLECKVVRPKI

SEQ ID NO: 33556 - protein, 11 aa, Borrelia burgdorferi B31
LECKVVRPKIT

SEQ ID NO: 33557 - protein, 11 aa, Borrelia burgdorferi B31
ECKVVRPKITE

SEQ ID NO: 33558 - protein, 11 aa, Borrelia burgdorferi B31
CKVVRPKITET

SEQ ID NO: 33559 - protein, 11 aa, Borrelia burgdorferi B31
KVVRPKITETT

SEQ ID NO: 33560 - protein, 11 aa, Borrelia burgdorferi B31
VVRPKITETTA

SEQ ID NO: 33561 - protein, 11 aa, Borrelia burgdorferi B31
VRPKITETTAL

SEQ ID NO: 33562 - protein, 11 aa, Borrelia burgdorferi B31
RPKITETTALG

SEQ ID NO: 33563 - protein, 11 aa, Borrelia burgdorferi B31
PKITETTALGA

SEQ ID NO: 33564 - protein, 11 aa, Borrelia burgdorferi B31
KITETTALGAA

SEQ ID NO: 33565 - protein, 11 aa, Borrelia burgdorferi B31
ITETTALGAAY

SEQ ID NO: 33566 - protein, 11 aa, Borrelia burgdorferi B31
TETTALGAAYL

SEQ ID NO: 33567 - protein, 11 aa, Borrelia burgdorferi B31
ETTALGAAYLA

SEQ ID NO: 33568 - protein, 11 aa, Borrelia burgdorferi B31
TTALGAAYLAG

SEQ ID NO: 33569 - protein, 11 aa, Borrelia burgdorferi B31
TALGAAYLAGL

SEQ ID NO: 33570 - protein, 11 aa, Borrelia burgdorferi B31
ALGAAYLAGLA

SEQ ID NO: 33571 - protein, 11 aa, Borrelia burgdorferi B31
LGAAYLAGLAT

SEQ ID NO: 33572 - protein, 11 aa, Borrelia burgdorferi B31
GAAYLAGLATG

SEQ ID NO: 33573 - protein, 11 aa, Borrelia burgdorferi B31
AAYLAGLATGY

SEQ ID NO: 33574 - protein, 11 aa, Borrelia burgdorferi B31
AYLAGLATGYW

SEQ ID NO: 33575 - protein, 11 aa, Borrelia burgdorferi B31
YLAGLATGYWQ

SEQ ID NO: 33576 - protein, 11 aa, Borrelia burgdorferi B31
LAGLATGYWQS

SEQ ID NO: 33577 - protein, 11 aa, Borrelia burgdorferi B31
AGLATGYWQSA

SEQ ID NO: 33578 - protein, 11 aa, Borrelia burgdorferi B31
GLATGYWQSAE

SEQ ID NO: 33579 - protein, 11 aa, Borrelia burgdorferi B31
LATGYWQSAEE

SEQ ID NO: 33580 - protein, 11 aa, Borrelia burgdorferi B31
ATGYWQSAEEI

SEQ ID NO: 33581 - protein, 11 aa, Borrelia burgdorferi B31
TGYWQSAEEIV

SEQ ID NO: 33582 - protein, 11 aa, Borrelia burgdorferi B31
GYWQSAEEIVS

SEQ ID NO: 33583 - protein, 11 aa, Borrelia burgdorferi B31
YWQSAEEIVSL

SEQ ID NO: 33584 - protein, 11 aa, Borrelia burgdorferi B31
WQSAEEIVSLW

SEQ ID NO: 33585 - protein, 11 aa, Borrelia burgdorferi B31
QSAEEIVSLWQ

SEQ ID NO: 33586 - protein, 11 aa, Borrelia burgdorferi B31
SAEEIVSLWQV

SEQ ID NO: 33587 - protein, 11 aa, Borrelia burgdorferi B31
AEEIVSLWQVD

SEQ ID NO: 33588 - protein, 11 aa, Borrelia burgdorferi B31
EEIVSLWQVDK

SEQ ID NO: 33589 - protein, 11 aa, Borrelia burgdorferi B31
EIVSLWQVDKI

SEQ ID NO: 33590 - protein, 11 aa, Borrelia burgdorferi B31
IVSLWQVDKIF

SEQ ID NO: 33591 - protein, 11 aa, Borrelia burgdorferi B31
VSLWQVDKIFE

SEQ ID NO: 33592 - protein, 11 aa, Borrelia burgdorferi B31
SLWQVDKIFEP

SEQ ID NO: 33593 - protein, 11 aa, Borrelia burgdorferi B31
LWQVDKIFEPS

SEQ ID NO: 33594 - protein, 11 aa, Borrelia burgdorferi B31
WQVDKIFEPSM

SEQ ID NO: 33595 - protein, 11 aa, Borrelia burgdorferi B31
QVDKIFEPSMP

SEQ ID NO: 33596 - protein, 11 aa, Borrelia burgdorferi B31
VDKIFEPSMPK

SEQ ID NO: 33597 - protein, 11 aa, Borrelia burgdorferi B31
DKIFEPSMPKN

SEQ ID NO: 33598 - protein, 11 aa, Borrelia burgdorferi B31
KIFEPSMPKNQ

SEQ ID NO: 33599 - protein, 11 aa, Borrelia burgdorferi B31
IFEPSMPKNQK

SEQ ID NO: 33600 - protein, 11 aa, Borrelia burgdorferi B31
FEPSMPKNQKE

SEQ ID NO: 33601 - protein, 11 aa, Borrelia burgdorferi B31
EPSMPKNQKEK

SEQ ID NO: 33602 - protein, 11 aa, Borrelia burgdorferi B31
PSMPKNQKEKL

SEQ ID NO: 33603 - protein, 11 aa, Borrelia burgdorferi B31
SMPKNQKEKLL

SEQ ID NO: 33604 - protein, 11 aa, Borrelia burgdorferi B31
MPKNQKEKLLE

SEQ ID NO: 33605 - protein, 11 aa, Borrelia burgdorferi B31
PKNQKEKLLEN

SEQ ID NO: 33606 - protein, 11 aa, Borrelia burgdorferi B31
KNQKEKLLENW

SEQ ID NO: 33607 - protein, 11 aa, Borrelia burgdorferi B31
NQKEKLLENWN

SEQ ID NO: 33608 - protein, 11 aa, Borrelia burgdorferi B31
QKEKLLENWNK

SEQ ID NO: 33609 - protein, 11 aa, Borrelia burgdorferi B31
KEKLLENWNKA

SEQ ID NO: 33610 - protein, 11 aa, Borrelia burgdorferi B31
EKLLENWNKAV

SEQ ID NO: 33611 - protein, 11 aa, Borrelia burgdorferi B31
KLLENWNKAVG

SEQ ID NO: 33612 - protein, 11 aa, Borrelia burgdorferi B31
LLENWNKAVGK

SEQ ID NO: 33613 - protein, 11 aa, Borrelia burgdorferi B31
LENWNKAVGKA

SEQ ID NO: 33614 - protein, 11 aa, Borrelia burgdorferi B31
ENWNKAVGKAK

SEQ ID NO: 33615 - protein, 11 aa, Borrelia burgdorferi B31
NWNKAVGKAKS

SEQ ID NO: 33616 - protein, 11 aa, Borrelia burgdorferi B31
WNKAVGKAKSW

SEQ ID NO: 33617 - protein, 11 aa, Borrelia burgdorferi B31
NKAVGKAKSWI

SEQ ID NO: 33618 - protein, 11 aa, Borrelia burgdorferi B31
KAVGKAKSWIQ

SEQ ID NO: 33619 - protein, 11 aa, Borrelia burgdorferi B31
AVGKAKSWIQN

SEQ ID NO: 33620 - protein, 11 aa, Borrelia burgdorferi B31
VGKAKSWIQNS

SEQ ID NO: 33621 - protein, 11 aa, Borrelia burgdorferi B31
GKAKSWIQNSH

SEQ ID NO: 33622 - protein, 11 aa, Borrelia burgdorferi B31
KAKSWIQNSHS

SEQ ID NO: 33623 - protein, 11 aa, Borrelia burgdorferi B31
AKSWIQNSHSS

SEQ ID NO: 33624 - protein, 8 aa, Borrelia burgdorferi B31
MKTIKKDS

SEQ ID NO: 33625 - protein, 8 aa, Borrelia burgdorferi B31
KTIKKDSE

SEQ ID NO: 33626 - protein, 8 aa, Borrelia burgdorferi B31
TIKKDSEF

SEQ ID NO: 33627 - protein, 8 aa, Borrelia burgdorferi B31
IKKDSEFY

SEQ ID NO: 33628 - protein, 8 aa, Borrelia burgdorferi B31
KKDSEFYD

SEQ ID NO: 33629 - protein, 8 aa, Borrelia burgdorferi B31
KDSEFYDS

SEQ ID NO: 33630 - protein, 8 aa, Borrelia burgdorferi B31
DSEFYDSL

SEQ ID NO: 33631 - protein, 8 aa, Borrelia burgdorferi B31
SEFYDSLA

SEQ ID NO: 33632 - protein, 8 aa, Borrelia burgdorferi B31
EFYDSLAT

SEQ ID NO: 33633 - protein, 8 aa, Borrelia burgdorferi B31
FYDSLATL

SEQ ID NO: 33634 - protein, 8 aa, Borrelia burgdorferi B31
YDSLATLK

SEQ ID NO: 33635 - protein, 8 aa, Borrelia burgdorferi B31
DSLATLKK

SEQ ID NO: 33636 - protein, 8 aa, Borrelia burgdorferi B31
SLATLKKH

SEQ ID NO: 33637 - protein, 8 aa, Borrelia burgdorferi B31
LATLKKHI

SEQ ID NO: 33638 - protein, 8 aa, Borrelia burgdorferi B31
ATLKKHIN

SEQ ID NO: 33639 - protein, 8 aa, Borrelia burgdorferi B31
TLKKHINK

SEQ ID NO: 33640 - protein, 8 aa, Borrelia burgdorferi B31
LKKHINKY

SEQ ID NO: 33641 - protein, 8 aa, Borrelia burgdorferi B31
KKHINKYI

SEQ ID NO: 33642 - protein, 8 aa, Borrelia burgdorferi B31
KHINKYIE

SEQ ID NO: 33643 - protein, 8 aa, Borrelia burgdorferi B31
HINKYIEE

SEQ ID NO: 33644 - protein, 8 aa, Borrelia burgdorferi B31
INKYIEEK

SEQ ID NO: 33645 - protein, 8 aa, Borrelia burgdorferi B31
NKYIEEKV

SEQ ID NO: 33646 - protein, 8 aa, Borrelia burgdorferi B31
KYIEEKVL

SEQ ID NO: 33647 - protein, 8 aa, Borrelia burgdorferi B31
YIEEKVLK

SEQ ID NO: 33648 - protein, 8 aa, Borrelia burgdorferi B31
IEEKVLKY

SEQ ID NO: 33649 - protein, 8 aa, Borrelia burgdorferi B31
EEKVLKYS

SEQ ID NO: 33650 - protein, 8 aa, Borrelia burgdorferi B31
EKVLKYSI

SEQ ID NO: 33651 - protein, 8 aa, Borrelia burgdorferi B31
KVLKYSIS

SEQ ID NO: 33652 - protein, 8 aa, Borrelia burgdorferi B31
VLKYSISS

SEQ ID NO: 33653 - protein, 8 aa, Borrelia burgdorferi B31
LKYSISSQ

SEQ ID NO: 33654 - protein, 8 aa, Borrelia burgdorferi B31
KYSISSQL

SEQ ID NO: 33655 - protein, 8 aa, Borrelia burgdorferi B31
YSISSQLY

SEQ ID NO: 33656 - protein, 8 aa, Borrelia burgdorferi B31
SISSQLYK

SEQ ID NO: 33657 - protein, 8 aa, Borrelia burgdorferi B31
ISSQLYKL

SEQ ID NO: 33658 - protein, 8 aa, Borrelia burgdorferi B31
SSQLYKLE

SEQ ID NO: 33659 - protein, 8 aa, Borrelia burgdorferi B31
SQLYKLEK

SEQ ID NO: 33660 - protein, 8 aa, Borrelia burgdorferi B31
QLYKLEKP

SEQ ID NO: 33661 - protein, 8 aa, Borrelia burgdorferi B31
LYKLEKPE

SEQ ID NO: 33662 - protein, 8 aa, Borrelia burgdorferi B31
YKLEKPEI

SEQ ID NO: 33663 - protein, 8 aa, Borrelia burgdorferi B31
KLEKPEII

SEQ ID NO: 33664 - protein, 8 aa, Borrelia burgdorferi B31
LEKPEIIE

SEQ ID NO: 33665 - protein, 8 aa, Borrelia burgdorferi B31
EKPEIIEL

SEQ ID NO: 33666 - protein, 8 aa, Borrelia burgdorferi B31
KPEIIELI

SEQ ID NO: 33667 - protein, 8 aa, Borrelia burgdorferi B31
PEIIELIK

SEQ ID NO: 33668 - protein, 8 aa, Borrelia burgdorferi B31
EIIELIKI

SEQ ID NO: 33669 - protein, 8 aa, Borrelia burgdorferi B31
IIELIKIS

SEQ ID NO: 33670 - protein, 8 aa, Borrelia burgdorferi B31
IELIKISN

SEQ ID NO: 33671 - protein, 8 aa, Borrelia burgdorferi B31
ELIKISND

SEQ ID NO: 33672 - protein, 8 aa, Borrelia burgdorferi B31
LIKISNDY

SEQ ID NO: 33673 - protein, 8 aa, Borrelia burgdorferi B31
IKISNDYE

SEQ ID NO: 33674 - protein, 8 aa, Borrelia burgdorferi B31
KISNDYEK

SEQ ID NO: 33675 - protein, 8 aa, Borrelia burgdorferi B31
ISNDYEKE

SEQ ID NO: 33676 - protein, 8 aa, Borrelia burgdorferi B31
SNDYEKEK

SEQ ID NO: 33677 - protein, 8 aa, Borrelia burgdorferi B31
NDYEKEKN

SEQ ID NO: 33678 - protein, 8 aa, Borrelia burgdorferi B31
DYEKEKNA

SEQ ID NO: 33679 - protein, 8 aa, Borrelia burgdorferi B31
YEKEKNAF

SEQ ID NO: 33680 - protein, 8 aa, Borrelia burgdorferi B31
EKEKNAFN

SEQ ID NO: 33681 - protein, 8 aa, Borrelia burgdorferi B31
KEKNAFNT

SEQ ID NO: 33682 - protein, 8 aa, Borrelia burgdorferi B31
EKNAFNTS

SEQ ID NO: 33683 - protein, 8 aa, Borrelia burgdorferi B31
KNAFNTSL

SEQ ID NO: 33684 - protein, 8 aa, Borrelia burgdorferi B31
NAFNTSLE

SEQ ID NO: 33685 - protein, 8 aa, Borrelia burgdorferi B31
AFNTSLEE

SEQ ID NO: 33686 - protein, 8 aa, Borrelia burgdorferi B31
FNTSLEEC

SEQ ID NO: 33687 - protein, 8 aa, Borrelia burgdorferi B31
NTSLEECY

SEQ ID NO: 33688 - protein, 8 aa, Borrelia burgdorferi B31
TSLEECYY

SEQ ID NO: 33689 - protein, 8 aa, Borrelia burgdorferi B31
SLEECYYK

SEQ ID NO: 33690 - protein, 8 aa, Borrelia burgdorferi B31
LEECYYKN

SEQ ID NO: 33691 - protein, 8 aa, Borrelia burgdorferi B31
EECYYKNT

SEQ ID NO: 33692 - protein, 8 aa, Borrelia burgdorferi B31
ECYYKNTQ

SEQ ID NO: 33693 - protein, 8 aa, Borrelia burgdorferi B31
CYYKNTQN

SEQ ID NO: 33694 - protein, 8 aa, Borrelia burgdorferi B31
YYKNTQNE

SEQ ID NO: 33695 - protein, 8 aa, Borrelia burgdorferi B31
YKNTQNEA

SEQ ID NO: 33696 - protein, 8 aa, Borrelia burgdorferi B31
KNTQNEAI

SEQ ID NO: 33697 - protein, 8 aa, Borrelia burgdorferi B31
NTQNEAIK

SEQ ID NO: 33698 - protein, 8 aa, Borrelia burgdorferi B31
TQNEAIKK

SEQ ID NO: 33699 - protein, 8 aa, Borrelia burgdorferi B31
QNEAIKKW

SEQ ID NO: 33700 - protein, 8 aa, Borrelia burgdorferi B31
NEAIKKWI

SEQ ID NO: 33701 - protein, 8 aa, Borrelia burgdorferi B31
EAIKKWIL

SEQ ID NO: 33702 - protein, 8 aa, Borrelia burgdorferi B31
AIKKWILE

SEQ ID NO: 33703 - protein, 8 aa, Borrelia burgdorferi B31
IKKWILEI

SEQ ID NO: 33704 - protein, 8 aa, Borrelia burgdorferi B31
KKWILEIV

SEQ ID NO: 33705 - protein, 8 aa, Borrelia burgdorferi B31
KWILEIVR

SEQ ID NO: 33706 - protein, 8 aa, Borrelia burgdorferi B31
WILEIVRN

SEQ ID NO: 33707 - protein, 8 aa, Borrelia burgdorferi B31
ILEIVRNK

SEQ ID NO: 33708 - protein, 8 aa, Borrelia burgdorferi B31
LEIVRNKN

SEQ ID NO: 33709 - protein, 8 aa, Borrelia burgdorferi B31
EIVRNKNF

SEQ ID NO: 33710 - protein, 8 aa, Borrelia burgdorferi B31
IVRNKNFI

SEQ ID NO: 33711 - protein, 8 aa, Borrelia burgdorferi B31
VRNKNFIQ

SEQ ID NO: 33712 - protein, 8 aa, Borrelia burgdorferi B31
RNKNFIQI

SEQ ID NO: 33713 - protein, 8 aa, Borrelia burgdorferi B31
NKNFIQIS

SEQ ID NO: 33714 - protein, 8 aa, Borrelia burgdorferi B31
KNFIQISK

SEQ ID NO: 33715 - protein, 8 aa, Borrelia burgdorferi B31
NFIQISKE

SEQ ID NO: 33716 - protein, 8 aa, Borrelia burgdorferi B31
FIQISKEA

SEQ ID NO: 33717 - protein, 8 aa, Borrelia burgdorferi B31
IQISKEAN

SEQ ID NO: 33718 - protein, 8 aa, Borrelia burgdorferi B31
QISKEANL

SEQ ID NO: 33719 - protein, 8 aa, Borrelia burgdorferi B31
ISKEANLN

SEQ ID NO: 33720 - protein, 8 aa, Borrelia burgdorferi B31
SKEANLNT

SEQ ID NO: 33721 - protein, 8 aa, Borrelia burgdorferi B31
KEANLNTK

SEQ ID NO: 33722 - protein, 8 aa, Borrelia burgdorferi B31
EANLNTKK

SEQ ID NO: 33723 - protein, 8 aa, Borrelia burgdorferi B31
ANLNTKKL

SEQ ID NO: 33724 - protein, 8 aa, Borrelia burgdorferi B31
NLNTKKLG

SEQ ID NO: 33725 - protein, 8 aa, Borrelia burgdorferi B31
LNTKKLGT

SEQ ID NO: 33726 - protein, 8 aa, Borrelia burgdorferi B31
NTKKLGTT

SEQ ID NO: 33727 - protein, 8 aa, Borrelia burgdorferi B31
TKKLGTTY

SEQ ID NO: 33728 - protein, 8 aa, Borrelia burgdorferi B31
KKLGTTYK

SEQ ID NO: 33729 - protein, 8 aa, Borrelia burgdorferi B31
KLGTTYKL

SEQ ID NO: 33730 - protein, 8 aa, Borrelia burgdorferi B31
LGTTYKLK

SEQ ID NO: 33731 - protein, 8 aa, Borrelia burgdorferi B31
GTTYKLKS

SEQ ID NO: 33732 - protein, 8 aa, Borrelia burgdorferi B31
TTYKLKSS

SEQ ID NO: 33733 - protein, 8 aa, Borrelia burgdorferi B31
TYKLKSSN

SEQ ID NO: 33734 - protein, 8 aa, Borrelia burgdorferi B31
YKLKSSNF

SEQ ID NO: 33735 - protein, 8 aa, Borrelia burgdorferi B31
KLKSSNFL

SEQ ID NO: 33736 - protein, 8 aa, Borrelia burgdorferi B31
LKSSNFLK

SEQ ID NO: 33737 - protein, 8 aa, Borrelia burgdorferi B31
KSSNFLKL

SEQ ID NO: 33738 - protein, 8 aa, Borrelia burgdorferi B31
SSNFLKLI

SEQ ID NO: 33739 - protein, 8 aa, Borrelia burgdorferi B31
SNFLKLIE

SEQ ID NO: 33740 - protein, 8 aa, Borrelia burgdorferi B31
NFLKLIEI

SEQ ID NO: 33741 - protein, 8 aa, Borrelia burgdorferi B31
FLKLIEIQ

SEQ ID NO: 33742 - protein, 8 aa, Borrelia burgdorferi B31
LKLIEIQN

SEQ ID NO: 33743 - protein, 8 aa, Borrelia burgdorferi B31
KLIEIQNS

SEQ ID NO: 33744 - protein, 8 aa, Borrelia burgdorferi B31
LIEIQNSP

SEQ ID NO: 33745 - protein, 8 aa, Borrelia burgdorferi B31
IEIQNSPY

SEQ ID NO: 33746 - protein, 8 aa, Borrelia burgdorferi B31
EIQNSPYY

SEQ ID NO: 33747 - protein, 8 aa, Borrelia burgdorferi B31
IQNSPYYS

SEQ ID NO: 33748 - protein, 8 aa, Borrelia burgdorferi B31
QNSPYYSQ

SEQ ID NO: 33749 - protein, 8 aa, Borrelia burgdorferi B31
NSPYYSQE

SEQ ID NO: 33750 - protein, 8 aa, Borrelia burgdorferi B31
SPYYSQEK

SEQ ID NO: 33751 - protein, 8 aa, Borrelia burgdorferi B31
PYYSQEKK

SEQ ID NO: 33752 - protein, 8 aa, Borrelia burgdorferi B31
YYSQEKKD

SEQ ID NO: 33753 - protein, 8 aa, Borrelia burgdorferi B31
YSQEKKDI

SEQ ID NO: 33754 - protein, 8 aa, Borrelia burgdorferi B31
SQEKKDIY

SEQ ID NO: 33755 - protein, 8 aa, Borrelia burgdorferi B31
QEKKDIYK

SEQ ID NO: 33756 - protein, 8 aa, Borrelia burgdorferi B31
EKKDIYKQ

SEQ ID NO: 33757 - protein, 8 aa, Borrelia burgdorferi B31
KKDIYKQI

SEQ ID NO: 33758 - protein, 8 aa, Borrelia burgdorferi B31
KDIYKQII

SEQ ID NO: 33759 - protein, 8 aa, Borrelia burgdorferi B31
DIYKQIIL

SEQ ID NO: 33760 - protein, 8 aa, Borrelia burgdorferi B31
IYKQIILN

SEQ ID NO: 33761 - protein, 8 aa, Borrelia burgdorferi B31
YKQIILNF

SEQ ID NO: 33762 - protein, 8 aa, Borrelia burgdorferi B31
KQIILNFS

SEQ ID NO: 33763 - protein, 8 aa, Borrelia burgdorferi B31
QIILNFSS

SEQ ID NO: 33764 - protein, 8 aa, Borrelia burgdorferi B31
IILNFSSN

SEQ ID NO: 33765 - protein, 8 aa, Borrelia burgdorferi B31
ILNFSSNI

SEQ ID NO: 33766 - protein, 8 aa, Borrelia burgdorferi B31
LNFSSNIN

SEQ ID NO: 33767 - protein, 8 aa, Borrelia burgdorferi B31
NFSSNINI

SEQ ID NO: 33768 - protein, 8 aa, Borrelia burgdorferi B31
FSSNINID

SEQ ID NO: 33769 - protein, 8 aa, Borrelia burgdorferi B31
SSNINIDS

SEQ ID NO: 33770 - protein, 8 aa, Borrelia burgdorferi B31
SNINIDSL

SEQ ID NO: 33771 - protein, 8 aa, Borrelia burgdorferi B31
NINIDSLE

SEQ ID NO: 33772 - protein, 8 aa, Borrelia burgdorferi B31
INIDSLEQ

SEQ ID NO: 33773 - protein, 8 aa, Borrelia burgdorferi B31
NIDSLEQT

SEQ ID NO: 33774 - protein, 8 aa, Borrelia burgdorferi B31
IDSLEQTI

SEQ ID NO: 33775 - protein, 8 aa, Borrelia burgdorferi B31
DSLEQTID

SEQ ID NO: 33776 - protein, 8 aa, Borrelia burgdorferi B31
SLEQTIDI

SEQ ID NO: 33777 - protein, 8 aa, Borrelia burgdorferi B31
LEQTIDIL

SEQ ID NO: 33778 - protein, 8 aa, Borrelia burgdorferi B31
EQTIDILV

SEQ ID NO: 33779 - protein, 8 aa, Borrelia burgdorferi B31
QTIDILVA

SEQ ID NO: 33780 - protein, 8 aa, Borrelia burgdorferi B31
TIDILVAV

SEQ ID NO: 33781 - protein, 8 aa, Borrelia burgdorferi B31
IDILVAVR

SEQ ID NO: 33782 - protein, 8 aa, Borrelia burgdorferi B31
DILVAVRN

SEQ ID NO: 33783 - protein, 8 aa, Borrelia burgdorferi B31
ILVAVRNR

SEQ ID NO: 33784 - protein, 8 aa, Borrelia burgdorferi B31
LVAVRNRN

SEQ ID NO: 33785 - protein, 8 aa, Borrelia burgdorferi B31
VAVRNRNK

SEQ ID NO: 33786 - protein, 8 aa, Borrelia burgdorferi B31
AVRNRNKI

SEQ ID NO: 33787 - protein, 8 aa, Borrelia burgdorferi B31
VRNRNKIK

SEQ ID NO: 33788 - protein, 8 aa, Borrelia burgdorferi B31
RNRNKIKI

SEQ ID NO: 33789 - protein, 8 aa, Borrelia burgdorferi B31
NRNKIKIL

SEQ ID NO: 33790 - protein, 8 aa, Borrelia burgdorferi B31
RNKIKILN

SEQ ID NO: 33791 - protein, 8 aa, Borrelia burgdorferi B31
NKIKILNI

SEQ ID NO: 33792 - protein, 8 aa, Borrelia burgdorferi B31
KIKILNIL

SEQ ID NO: 33793 - protein, 8 aa, Borrelia burgdorferi B31
IKILNILN

SEQ ID NO: 33794 - protein, 8 aa, Borrelia burgdorferi B31
KILNILNK

SEQ ID NO: 33795 - protein, 8 aa, Borrelia burgdorferi B31
ILNILNKN

SEQ ID NO: 33796 - protein, 8 aa, Borrelia burgdorferi B31
LNILNKNL

SEQ ID NO: 33797 - protein, 8 aa, Borrelia burgdorferi B31
NILNKNLK

SEQ ID NO: 33798 - protein, 8 aa, Borrelia burgdorferi B31
ILNKNLKY

SEQ ID NO: 33799 - protein, 8 aa, Borrelia burgdorferi B31
LNKNLKYR

SEQ ID NO: 33800 - protein, 8 aa, Borrelia burgdorferi B31
NKNLKYRP

SEQ ID NO: 33801 - protein, 8 aa, Borrelia burgdorferi B31
KNLKYRPE

SEQ ID NO: 33802 - protein, 8 aa, Borrelia burgdorferi B31
NLKYRPEN

SEQ ID NO: 33803 - protein, 8 aa, Borrelia burgdorferi B31
LKYRPENQ

SEQ ID NO: 33804 - protein, 8 aa, Borrelia burgdorferi B31
KYRPENQK

SEQ ID NO: 33805 - protein, 8 aa, Borrelia burgdorferi B31
YRPENQKV

SEQ ID NO: 33806 - protein, 8 aa, Borrelia burgdorferi B31
RPENQKVF

SEQ ID NO: 33807 - protein, 8 aa, Borrelia burgdorferi B31
PENQKVFK

SEQ ID NO: 33808 - protein, 8 aa, Borrelia burgdorferi B31
ENQKVFKS

SEQ ID NO: 33809 - protein, 8 aa, Borrelia burgdorferi B31
NQKVFKSS

SEQ ID NO: 33810 - protein, 8 aa, Borrelia burgdorferi B31
QKVFKSSL

SEQ ID NO: 33811 - protein, 8 aa, Borrelia burgdorferi B31
KVFKSSLT

SEQ ID NO: 33812 - protein, 8 aa, Borrelia burgdorferi B31
VFKSSLTN

SEQ ID NO: 33813 - protein, 8 aa, Borrelia burgdorferi B31
FKSSLTNK

SEQ ID NO: 33814 - protein, 8 aa, Borrelia burgdorferi B31
KSSLTNKE

SEQ ID NO: 33815 - protein, 8 aa, Borrelia burgdorferi B31
SSLTNKES

SEQ ID NO: 33816 - protein, 8 aa, Borrelia burgdorferi B31
SLTNKESR

SEQ ID NO: 33817 - protein, 8 aa, Borrelia burgdorferi B31
LTNKESRL

SEQ ID NO: 33818 - protein, 8 aa, Borrelia burgdorferi B31
TNKESRLI

SEQ ID NO: 33819 - protein, 8 aa, Borrelia burgdorferi B31
NKESRLIK

SEQ ID NO: 33820 - protein, 8 aa, Borrelia burgdorferi B31
KESRLIKL

SEQ ID NO: 33821 - protein, 8 aa, Borrelia burgdorferi B31
ESRLIKLK

SEQ ID NO: 33822 - protein, 8 aa, Borrelia burgdorferi B31
SRLIKLKR

SEQ ID NO: 33823 - protein, 8 aa, Borrelia burgdorferi B31
RLIKLKRM

SEQ ID NO: 33824 - protein, 8 aa, Borrelia burgdorferi B31
LIKLKRML

SEQ ID NO: 33825 - protein, 8 aa, Borrelia burgdorferi B31
IKLKRMLI

SEQ ID NO: 33826 - protein, 8 aa, Borrelia burgdorferi B31
KLKRMLIL

SEQ ID NO: 33827 - protein, 8 aa, Borrelia burgdorferi B31
LKRMLILT

SEQ ID NO: 33828 - protein, 8 aa, Borrelia burgdorferi B31
KRMLILTY

SEQ ID NO: 33829 - protein, 8 aa, Borrelia burgdorferi B31
RMLILTYW

SEQ ID NO: 33830 - protein, 8 aa, Borrelia burgdorferi B31
MLILTYWP

SEQ ID NO: 33831 - protein, 8 aa, Borrelia burgdorferi B31
LILTYWPV

SEQ ID NO: 33832 - protein, 8 aa, Borrelia burgdorferi B31
ILTYWPVG

SEQ ID NO: 33833 - protein, 8 aa, Borrelia burgdorferi B31
LTYWPVGC

SEQ ID NO: 33834 - protein, 8 aa, Borrelia burgdorferi B31
TYWPVGCL

SEQ ID NO: 33835 - protein, 8 aa, Borrelia burgdorferi B31
YWPVGCLS

SEQ ID NO: 33836 - protein, 8 aa, Borrelia burgdorferi B31
WPVGCLSK

SEQ ID NO: 33837 - protein, 8 aa, Borrelia burgdorferi B31
PVGCLSKN

SEQ ID NO: 33838 - protein, 8 aa, Borrelia burgdorferi B31
VGCLSKNI

SEQ ID NO: 33839 - protein, 8 aa, Borrelia burgdorferi B31
GCLSKNIF

SEQ ID NO: 33840 - protein, 8 aa, Borrelia burgdorferi B31
CLSKNIFI

SEQ ID NO: 33841 - protein, 8 aa, Borrelia burgdorferi B31
LSKNIFIK

SEQ ID NO: 33842 - protein, 8 aa, Borrelia burgdorferi B31
SKNIFIKI

SEQ ID NO: 33843 - protein, 8 aa, Borrelia burgdorferi B31
KNIFIKIL

SEQ ID NO: 33844 - protein, 8 aa, Borrelia burgdorferi B31
NIFIKILI

SEQ ID NO: 33845 - protein, 8 aa, Borrelia burgdorferi B31
IFIKILIK

SEQ ID NO: 33846 - protein, 8 aa, Borrelia burgdorferi B31
  Xaa can be any naturally occurring amino acid
  VARIANT 8: Xaa = Any Amino Acid
FIKILIKX

SEQ ID NO: 33847 - protein, 8 aa, Borrelia burgdorferi B31
  Xaa can be any naturally occurring amino acid
  VARIANT 7: Xaa = Any Amino Acid
IKILIKXY

SEQ ID NO: 33848 - protein, 8 aa, Borrelia burgdorferi B31
  Xaa can be any naturally occurring amino acid
  VARIANT 6: Xaa = Any Amino Acid
KILIKXYK

SEQ ID NO: 33849 - protein, 8 aa, Borrelia burgdorferi B31
  Xaa can be any naturally occurring amino acid
  VARIANT 5: Xaa = Any Amino Acid
ILIKXYKY

SEQ ID NO: 33850 - protein, 8 aa, Borrelia burgdorferi B31
  Xaa can be any naturally occurring amino acid
  VARIANT 4: Xaa = Any Amino Acid
LIKXYKYL

SEQ ID NO: 33851 - protein, 8 aa, Borrelia burgdorferi B31
  Xaa can be any naturally occurring amino acid
  VARIANT 3: Xaa = Any Amino Acid
IKXYKYLE

SEQ ID NO: 33852 - protein, 8 aa, Borrelia burgdorferi B31
  Xaa can be any naturally occurring amino acid
  VARIANT 2: Xaa = Any Amino Acid
KXYKYLEE

SEQ ID NO: 33853 - protein, 8 aa, Borrelia burgdorferi B31
  Xaa can be any naturally occurring amino acid
  VARIANT 1: Xaa = Any Amino Acid
XYKYLEEE

SEQ ID NO: 33854 - protein, 8 aa, Borrelia burgdorferi B31
YKYLEEEI

SEQ ID NO: 33855 - protein, 8 aa, Borrelia burgdorferi B31
KYLEEEIL

SEQ ID NO: 33856 - protein, 8 aa, Borrelia burgdorferi B31
YLEEEILA

SEQ ID NO: 33857 - protein, 8 aa, Borrelia burgdorferi B31
LEEEILAL

SEQ ID NO: 33858 - protein, 8 aa, Borrelia burgdorferi B31
EEEILALK

SEQ ID NO: 33859 - protein, 8 aa, Borrelia burgdorferi B31
EEILALKY

SEQ ID NO: 33860 - protein, 8 aa, Borrelia burgdorferi B31
EILALKYN

SEQ ID NO: 33861 - protein, 8 aa, Borrelia burgdorferi B31
ILALKYNE

SEQ ID NO: 33862 - protein, 8 aa, Borrelia burgdorferi B31
LALKYNEI

SEQ ID NO: 33863 - protein, 8 aa, Borrelia burgdorferi B31
ALKYNEIL

SEQ ID NO: 33864 - protein, 8 aa, Borrelia burgdorferi B31
LKYNEILN

SEQ ID NO: 33865 - protein, 8 aa, Borrelia burgdorferi B31
KYNEILNY

SEQ ID NO: 33866 - protein, 8 aa, Borrelia burgdorferi B31
YNEILNYL

SEQ ID NO: 33867 - protein, 8 aa, Borrelia burgdorferi B31
NEILNYLR

SEQ ID NO: 33868 - protein, 8 aa, Borrelia burgdorferi B31
EILNYLRA

SEQ ID NO: 33869 - protein, 8 aa, Borrelia burgdorferi B31
ILNYLRAL

SEQ ID NO: 33870 - protein, 8 aa, Borrelia burgdorferi B31
LNYLRALK

SEQ ID NO: 33871 - protein, 8 aa, Borrelia burgdorferi B31
NYLRALKT

SEQ ID NO: 33872 - protein, 8 aa, Borrelia burgdorferi B31
YLRALKTL

SEQ ID NO: 33873 - protein, 8 aa, Borrelia burgdorferi B31
LRALKTLS

SEQ ID NO: 33874 - protein, 8 aa, Borrelia burgdorferi B31
RALKTLSL

SEQ ID NO: 33875 - protein, 8 aa, Borrelia burgdorferi B31
ALKTLSLN

SEQ ID NO: 33876 - protein, 8 aa, Borrelia burgdorferi B31
LKTLSLNE

SEQ ID NO: 33877 - protein, 8 aa, Borrelia burgdorferi B31
KTLSLNEI

SEQ ID NO: 33878 - protein, 8 aa, Borrelia burgdorferi B31
TLSLNEIF

SEQ ID NO: 33879 - protein, 8 aa, Borrelia burgdorferi B31
LSLNEIFY

SEQ ID NO: 33880 - protein, 8 aa, Borrelia burgdorferi B31
SLNEIFYK

SEQ ID NO: 33881 - protein, 8 aa, Borrelia burgdorferi B31
LNEIFYKG

SEQ ID NO: 33882 - protein, 8 aa, Borrelia burgdorferi B31
NEIFYKGS

SEQ ID NO: 33883 - protein, 8 aa, Borrelia burgdorferi B31
EIFYKGSS

SEQ ID NO: 33884 - protein, 8 aa, Borrelia burgdorferi B31
IFYKGSSK

SEQ ID NO: 33885 - protein, 8 aa, Borrelia burgdorferi B31
FYKGSSKN

SEQ ID NO: 33886 - protein, 8 aa, Borrelia burgdorferi B31
YKGSSKNI

SEQ ID NO: 33887 - protein, 8 aa, Borrelia burgdorferi B31
KGSSKNIS

SEQ ID NO: 33888 - protein, 8 aa, Borrelia burgdorferi B31
GSSKNISF

SEQ ID NO: 33889 - protein, 8 aa, Borrelia burgdorferi B31
SSKNISFN

SEQ ID NO: 33890 - protein, 8 aa, Borrelia burgdorferi B31
SKNISFNY

SEQ ID NO: 33891 - protein, 8 aa, Borrelia burgdorferi B31
KNISFNYF

SEQ ID NO: 33892 - protein, 8 aa, Borrelia burgdorferi B31
NISFNYFF

SEQ ID NO: 33893 - protein, 8 aa, Borrelia burgdorferi B31
ISFNYFFS

SEQ ID NO: 33894 - protein, 8 aa, Borrelia burgdorferi B31
SFNYFFSD

SEQ ID NO: 33895 - protein, 8 aa, Borrelia burgdorferi B31
FNYFFSDF

SEQ ID NO: 33896 - protein, 8 aa, Borrelia burgdorferi B31
NYFFSDFT

SEQ ID NO: 33897 - protein, 8 aa, Borrelia burgdorferi B31
YFFSDFTQ

SEQ ID NO: 33898 - protein, 8 aa, Borrelia burgdorferi B31
FFSDFTQY

SEQ ID NO: 33899 - protein, 8 aa, Borrelia burgdorferi B31
FSDFTQYA

SEQ ID NO: 33900 - protein, 8 aa, Borrelia burgdorferi B31
SDFTQYAP

SEQ ID NO: 33901 - protein, 8 aa, Borrelia burgdorferi B31
DFTQYAPK

SEQ ID NO: 33902 - protein, 8 aa, Borrelia burgdorferi B31
FTQYAPKD

SEQ ID NO: 33903 - protein, 8 aa, Borrelia burgdorferi B31
TQYAPKDF

SEQ ID NO: 33904 - protein, 8 aa, Borrelia burgdorferi B31
QYAPKDFQ

SEQ ID NO: 33905 - protein, 8 aa, Borrelia burgdorferi B31
YAPKDFQD

SEQ ID NO: 33906 - protein, 8 aa, Borrelia burgdorferi B31
APKDFQDT

SEQ ID NO: 33907 - protein, 8 aa, Borrelia burgdorferi B31
PKDFQDTL

SEQ ID NO: 33908 - protein, 8 aa, Borrelia burgdorferi B31
KDFQDTLK

SEQ ID NO: 33909 - protein, 8 aa, Borrelia burgdorferi B31
DFQDTLKC

SEQ ID NO: 33910 - protein, 8 aa, Borrelia burgdorferi B31
FQDTLKCY

SEQ ID NO: 33911 - protein, 8 aa, Borrelia burgdorferi B31
QDTLKCYL

SEQ ID NO: 33912 - protein, 8 aa, Borrelia burgdorferi B31
DTLKCYLY

SEQ ID NO: 33913 - protein, 8 aa, Borrelia burgdorferi B31
TLKCYLYV

SEQ ID NO: 33914 - protein, 8 aa, Borrelia burgdorferi B31
LKCYLYVI

SEQ ID NO: 33915 - protein, 8 aa, Borrelia burgdorferi B31
KCYLYVIE

SEQ ID NO: 33916 - protein, 8 aa, Borrelia burgdorferi B31
CYLYVIEK

SEQ ID NO: 33917 - protein, 8 aa, Borrelia burgdorferi B31
YLYVIEKT

SEQ ID NO: 33918 - protein, 8 aa, Borrelia burgdorferi B31
LYVIEKTI

SEQ ID NO: 33919 - protein, 8 aa, Borrelia burgdorferi B31
YVIEKTIT

SEQ ID NO: 33920 - protein, 8 aa, Borrelia burgdorferi B31
VIEKTITK

SEQ ID NO: 33921 - protein, 8 aa, Borrelia burgdorferi B31
IEKTITKK

SEQ ID NO: 33922 - protein, 8 aa, Borrelia burgdorferi B31
EKTITKKY

SEQ ID NO: 33923 - protein, 8 aa, Borrelia burgdorferi B31
KTITKKYL

SEQ ID NO: 33924 - protein, 8 aa, Borrelia burgdorferi B31
TITKKYLT

SEQ ID NO: 33925 - protein, 8 aa, Borrelia burgdorferi B31
ITKKYLTW

SEQ ID NO: 33926 - protein, 8 aa, Borrelia burgdorferi B31
TKKYLTWF

SEQ ID NO: 33927 - protein, 8 aa, Borrelia burgdorferi B31
KKYLTWFF

SEQ ID NO: 33928 - protein, 8 aa, Borrelia burgdorferi B31
KYLTWFFK

SEQ ID NO: 33929 - protein, 8 aa, Borrelia burgdorferi B31
YLTWFFKD

SEQ ID NO: 33930 - protein, 8 aa, Borrelia burgdorferi B31
LTWFFKDK

SEQ ID NO: 33931 - protein, 8 aa, Borrelia burgdorferi B31
TWFFKDKI

SEQ ID NO: 33932 - protein, 8 aa, Borrelia burgdorferi B31
WFFKDKIS

SEQ ID NO: 33933 - protein, 8 aa, Borrelia burgdorferi B31
FFKDKISN

SEQ ID NO: 33934 - protein, 8 aa, Borrelia burgdorferi B31
FKDKISNN

SEQ ID NO: 33935 - protein, 8 aa, Borrelia burgdorferi B31
KDKISNNW

SEQ ID NO: 33936 - protein, 8 aa, Borrelia burgdorferi B31
DKISNNWE

SEQ ID NO: 33937 - protein, 8 aa, Borrelia burgdorferi B31
KISNNWES

SEQ ID NO: 33938 - protein, 8 aa, Borrelia burgdorferi B31
ISNNWESF

SEQ ID NO: 33939 - protein, 8 aa, Borrelia burgdorferi B31
SNNWESFI

SEQ ID NO: 33940 - protein, 8 aa, Borrelia burgdorferi B31
NNWESFID

SEQ ID NO: 33941 - protein, 8 aa, Borrelia burgdorferi B31
NWESFIDA

SEQ ID NO: 33942 - protein, 8 aa, Borrelia burgdorferi B31
WESFIDAL

SEQ ID NO: 33943 - protein, 8 aa, Borrelia burgdorferi B31
ESFIDALE

SEQ ID NO: 33944 - protein, 8 aa, Borrelia burgdorferi B31
SFIDALEY

SEQ ID NO: 33945 - protein, 8 aa, Borrelia burgdorferi B31
FIDALEYI

SEQ ID NO: 33946 - protein, 8 aa, Borrelia burgdorferi B31
IDALEYIE

SEQ ID NO: 33947 - protein, 8 aa, Borrelia burgdorferi B31
DALEYIEK

SEQ ID NO: 33948 - protein, 8 aa, Borrelia burgdorferi B31
ALEYIEKH

SEQ ID NO: 33949 - protein, 8 aa, Borrelia burgdorferi B31
LEYIEKHK

SEQ ID NO: 33950 - protein, 8 aa, Borrelia burgdorferi B31
EYIEKHKL

SEQ ID NO: 33951 - protein, 8 aa, Borrelia burgdorferi B31
YIEKHKLI

SEQ ID NO: 33952 - protein, 8 aa, Borrelia burgdorferi B31
IEKHKLIN

SEQ ID NO: 33953 - protein, 8 aa, Borrelia burgdorferi B31
EKHKLINI

SEQ ID NO: 33954 - protein, 8 aa, Borrelia burgdorferi B31
KHKLINIK

SEQ ID NO: 33955 - protein, 8 aa, Borrelia burgdorferi B31
HKLINIKE

SEQ ID NO: 33956 - protein, 8 aa, Borrelia burgdorferi B31
KLINIKEK

SEQ ID NO: 33957 - protein, 8 aa, Borrelia burgdorferi B31
LINIKEKI

SEQ ID NO: 33958 - protein, 8 aa, Borrelia burgdorferi B31
INIKEKIK

SEQ ID NO: 33959 - protein, 8 aa, Borrelia burgdorferi B31
NIKEKIKE

SEQ ID NO: 33960 - protein, 8 aa, Borrelia burgdorferi B31
IKEKIKEI

SEQ ID NO: 33961 - protein, 8 aa, Borrelia burgdorferi B31
KEKIKEII

SEQ ID NO: 33962 - protein, 8 aa, Borrelia burgdorferi B31
EKIKEIIT

SEQ ID NO: 33963 - protein, 8 aa, Borrelia burgdorferi B31
KIKEIITA

SEQ ID NO: 33964 - protein, 8 aa, Borrelia burgdorferi B31
IKEIITAK

SEQ ID NO: 33965 - protein, 8 aa, Borrelia burgdorferi B31
KEIITAKF

SEQ ID NO: 33966 - protein, 8 aa, Borrelia burgdorferi B31
EIITAKFQ

SEQ ID NO: 33967 - protein, 8 aa, Borrelia burgdorferi B31
IITAKFQT

SEQ ID NO: 33968 - protein, 8 aa, Borrelia burgdorferi B31
ITAKFQTE

SEQ ID NO: 33969 - protein, 8 aa, Borrelia burgdorferi B31
TAKFQTED

SEQ ID NO: 33970 - protein, 8 aa, Borrelia burgdorferi B31
AKFQTEDF

SEQ ID NO: 33971 - protein, 8 aa, Borrelia burgdorferi B31
KFQTEDFF

SEQ ID NO: 33972 - protein, 8 aa, Borrelia burgdorferi B31
FQTEDFFI

SEQ ID NO: 33973 - protein, 8 aa, Borrelia burgdorferi B31
QTEDFFIS

SEQ ID NO: 33974 - protein, 8 aa, Borrelia burgdorferi B31
TEDFFISF

SEQ ID NO: 33975 - protein, 8 aa, Borrelia burgdorferi B31
EDFFISFD

SEQ ID NO: 33976 - protein, 8 aa, Borrelia burgdorferi B31
DFFISFDK

SEQ ID NO: 33977 - protein, 8 aa, Borrelia burgdorferi B31
FFISFDKT

SEQ ID NO: 33978 - protein, 8 aa, Borrelia burgdorferi B31
FISFDKTN

SEQ ID NO: 33979 - protein, 8 aa, Borrelia burgdorferi B31
ISFDKTNF

SEQ ID NO: 33980 - protein, 8 aa, Borrelia burgdorferi B31
SFDKTNFN

SEQ ID NO: 33981 - protein, 8 aa, Borrelia burgdorferi B31
FDKTNFNP

SEQ ID NO: 33982 - protein, 8 aa, Borrelia burgdorferi B31
DKTNFNPY

SEQ ID NO: 33983 - protein, 8 aa, Borrelia burgdorferi B31
KTNFNPYE

SEQ ID NO: 33984 - protein, 8 aa, Borrelia burgdorferi B31
TNFNPYES

SEQ ID NO: 33985 - protein, 8 aa, Borrelia burgdorferi B31
NFNPYESS

SEQ ID NO: 33986 - protein, 8 aa, Borrelia burgdorferi B31
FNPYESSI

SEQ ID NO: 33987 - protein, 8 aa, Borrelia burgdorferi B31
NPYESSIF

SEQ ID NO: 33988 - protein, 8 aa, Borrelia burgdorferi B31
PYESSIFK

SEQ ID NO: 33989 - protein, 8 aa, Borrelia burgdorferi B31
YESSIFKE

SEQ ID NO: 33990 - protein, 8 aa, Borrelia burgdorferi B31
ESSIFKER

SEQ ID NO: 33991 - protein, 8 aa, Borrelia burgdorferi B31
SSIFKERY

SEQ ID NO: 33992 - protein, 8 aa, Borrelia burgdorferi B31
SIFKERYI

SEQ ID NO: 33993 - protein, 8 aa, Borrelia burgdorferi B31
IFKERYIK

SEQ ID NO: 33994 - protein, 8 aa, Borrelia burgdorferi B31
FKERYIKS

SEQ ID NO: 33995 - protein, 8 aa, Borrelia burgdorferi B31
KERYIKSA

SEQ ID NO: 33996 - protein, 8 aa, Borrelia burgdorferi B31
ERYIKSAF

SEQ ID NO: 33997 - protein, 8 aa, Borrelia burgdorferi B31
RYIKSAFL

SEQ ID NO: 33998 - protein, 8 aa, Borrelia burgdorferi B31
YIKSAFLE

SEQ ID NO: 33999 - protein, 8 aa, Borrelia burgdorferi B31
IKSAFLEI

SEQ ID NO: 34000 - protein, 8 aa, Borrelia burgdorferi B31
KSAFLEII

SEQ ID NO: 34001 - protein, 8 aa, Borrelia burgdorferi B31
SAFLEIIM

SEQ ID NO: 34002 - protein, 8 aa, Borrelia burgdorferi B31
AFLEIIMH

SEQ ID NO: 34003 - protein, 8 aa, Borrelia burgdorferi B31
FLEIIMHY

SEQ ID NO: 34004 - protein, 8 aa, Borrelia burgdorferi B31
LEIIMHYV

SEQ ID NO: 34005 - protein, 8 aa, Borrelia burgdorferi B31
EIIMHYVK

SEQ ID NO: 34006 - protein, 8 aa, Borrelia burgdorferi B31
IIMHYVKK

SEQ ID NO: 34007 - protein, 8 aa, Borrelia burgdorferi B31
IMHYVKKN

SEQ ID NO: 34008 - protein, 8 aa, Borrelia burgdorferi B31
MHYVKKNS

SEQ ID NO: 34009 - protein, 8 aa, Borrelia burgdorferi B31
HYVKKNSQ

SEQ ID NO: 34010 - protein, 8 aa, Borrelia burgdorferi B31
YVKKNSQN

SEQ ID NO: 34011 - protein, 8 aa, Borrelia burgdorferi B31
VKKNSQNI

SEQ ID NO: 34012 - protein, 8 aa, Borrelia burgdorferi B31
KKNSQNIE

SEQ ID NO: 34013 - protein, 8 aa, Borrelia burgdorferi B31
KNSQNIET

SEQ ID NO: 34014 - protein, 8 aa, Borrelia burgdorferi B31
NSQNIETY

SEQ ID NO: 34015 - protein, 8 aa, Borrelia burgdorferi B31
SQNIETYG

SEQ ID NO: 34016 - protein, 8 aa, Borrelia burgdorferi B31
QNIETYGW

SEQ ID NO: 34017 - protein, 8 aa, Borrelia burgdorferi B31
NIETYGWI

SEQ ID NO: 34018 - protein, 8 aa, Borrelia burgdorferi B31
IETYGWIA

SEQ ID NO: 34019 - protein, 8 aa, Borrelia burgdorferi B31
ETYGWIAF

SEQ ID NO: 34020 - protein, 8 aa, Borrelia burgdorferi B31
TYGWIAFY

SEQ ID NO: 34021 - protein, 8 aa, Borrelia burgdorferi B31
YGWIAFYI

SEQ ID NO: 34022 - protein, 8 aa, Borrelia burgdorferi B31
GWIAFYIY

SEQ ID NO: 34023 - protein, 8 aa, Borrelia burgdorferi B31
WIAFYIYA

SEQ ID NO: 34024 - protein, 8 aa, Borrelia burgdorferi B31
IAFYIYAD

SEQ ID NO: 34025 - protein, 8 aa, Borrelia burgdorferi B31
AFYIYADN

SEQ ID NO: 34026 - protein, 8 aa, Borrelia burgdorferi B31
FYIYADNK

SEQ ID NO: 34027 - protein, 8 aa, Borrelia burgdorferi B31
YIYADNKD

SEQ ID NO: 34028 - protein, 8 aa, Borrelia burgdorferi B31
IYADNKDK

SEQ ID NO: 34029 - protein, 8 aa, Borrelia burgdorferi B31
YADNKDKK

SEQ ID NO: 34030 - protein, 8 aa, Borrelia burgdorferi B31
ADNKDKKI

SEQ ID NO: 34031 - protein, 8 aa, Borrelia burgdorferi B31
DNKDKKIF

SEQ ID NO: 34032 - protein, 8 aa, Borrelia burgdorferi B31
NKDKKIFC

SEQ ID NO: 34033 - protein, 8 aa, Borrelia burgdorferi B31
KDKKIFCQ

SEQ ID NO: 34034 - protein, 8 aa, Borrelia burgdorferi B31
DKKIFCQR

SEQ ID NO: 34035 - protein, 8 aa, Borrelia burgdorferi B31
KKIFCQRM

SEQ ID NO: 34036 - protein, 8 aa, Borrelia burgdorferi B31
KIFCQRMK

SEQ ID NO: 34037 - protein, 8 aa, Borrelia burgdorferi B31
IFCQRMKE

SEQ ID NO: 34038 - protein, 8 aa, Borrelia burgdorferi B31
FCQRMKEF

SEQ ID NO: 34039 - protein, 8 aa, Borrelia burgdorferi B31
CQRMKEFF

SEQ ID NO: 34040 - protein, 8 aa, Borrelia burgdorferi B31
QRMKEFFK

SEQ ID NO: 34041 - protein, 8 aa, Borrelia burgdorferi B31
RMKEFFKS

SEQ ID NO: 34042 - protein, 8 aa, Borrelia burgdorferi B31
MKEFFKSK

SEQ ID NO: 34043 - protein, 8 aa, Borrelia burgdorferi B31
KEFFKSKT

SEQ ID NO: 34044 - protein, 8 aa, Borrelia burgdorferi B31
EFFKSKTF

SEQ ID NO: 34045 - protein, 8 aa, Borrelia burgdorferi B31
FFKSKTFE

SEQ ID NO: 34046 - protein, 8 aa, Borrelia burgdorferi B31
FKSKTFEI

SEQ ID NO: 34047 - protein, 8 aa, Borrelia burgdorferi B31
KSKTFEIQ

SEQ ID NO: 34048 - protein, 8 aa, Borrelia burgdorferi B31
SKTFEIQN

SEQ ID NO: 34049 - protein, 8 aa, Borrelia burgdorferi B31
KTFEIQNQ

SEQ ID NO: 34050 - protein, 8 aa, Borrelia burgdorferi B31
TFEIQNQI

SEQ ID NO: 34051 - protein, 8 aa, Borrelia burgdorferi B31
FEIQNQIF

SEQ ID NO: 34052 - protein, 8 aa, Borrelia burgdorferi B31
EIQNQIFV

SEQ ID NO: 34053 - protein, 8 aa, Borrelia burgdorferi B31
IQNQIFVY

SEQ ID NO: 34054 - protein, 8 aa, Borrelia burgdorferi B31
QNQIFVYF

SEQ ID NO: 34055 - protein, 8 aa, Borrelia burgdorferi B31
NQIFVYFL

SEQ ID NO: 34056 - protein, 8 aa, Borrelia burgdorferi B31
QIFVYFLS

SEQ ID NO: 34057 - protein, 8 aa, Borrelia burgdorferi B31
IFVYFLSF

SEQ ID NO: 34058 - protein, 8 aa, Borrelia burgdorferi B31
FVYFLSFY

SEQ ID NO: 34059 - protein, 8 aa, Borrelia burgdorferi B31
VYFLSFYP

SEQ ID NO: 34060 - protein, 8 aa, Borrelia burgdorferi B31
YFLSFYPN

SEQ ID NO: 34061 - protein, 8 aa, Borrelia burgdorferi B31
FLSFYPNI

SEQ ID NO: 34062 - protein, 8 aa, Borrelia burgdorferi B31
LSFYPNIE

SEQ ID NO: 34063 - protein, 8 aa, Borrelia burgdorferi B31
SFYPNIEY

SEQ ID NO: 34064 - protein, 8 aa, Borrelia burgdorferi B31
FYPNIEYK

SEQ ID NO: 34065 - protein, 8 aa, Borrelia burgdorferi B31
YPNIEYKH

SEQ ID NO: 34066 - protein, 8 aa, Borrelia burgdorferi B31
PNIEYKHF

SEQ ID NO: 34067 - protein, 8 aa, Borrelia burgdorferi B31
NIEYKHFK

SEQ ID NO: 34068 - protein, 8 aa, Borrelia burgdorferi B31
IEYKHFKF

SEQ ID NO: 34069 - protein, 8 aa, Borrelia burgdorferi B31
EYKHFKFI

SEQ ID NO: 34070 - protein, 8 aa, Borrelia burgdorferi B31
YKHFKFIS

SEQ ID NO: 34071 - protein, 8 aa, Borrelia burgdorferi B31
KHFKFISD

SEQ ID NO: 34072 - protein, 8 aa, Borrelia burgdorferi B31
HFKFISDI

SEQ ID NO: 34073 - protein, 8 aa, Borrelia burgdorferi B31
FKFISDIL

SEQ ID NO: 34074 - protein, 8 aa, Borrelia burgdorferi B31
KFISDILL

SEQ ID NO: 34075 - protein, 8 aa, Borrelia burgdorferi B31
FISDILLY

SEQ ID NO: 34076 - protein, 8 aa, Borrelia burgdorferi B31
ISDILLYL

SEQ ID NO: 34077 - protein, 8 aa, Borrelia burgdorferi B31
SDILLYLD

SEQ ID NO: 34078 - protein, 8 aa, Borrelia burgdorferi B31
DILLYLDE

SEQ ID NO: 34079 - protein, 8 aa, Borrelia burgdorferi B31
ILLYLDEN

SEQ ID NO: 34080 - protein, 8 aa, Borrelia burgdorferi B31
LLYLDENK

SEQ ID NO: 34081 - protein, 8 aa, Borrelia burgdorferi B31
LYLDENKI

SEQ ID NO: 34082 - protein, 8 aa, Borrelia burgdorferi B31
YLDENKIT

SEQ ID NO: 34083 - protein, 8 aa, Borrelia burgdorferi B31
LDENKITI

SEQ ID NO: 34084 - protein, 8 aa, Borrelia burgdorferi B31
DENKITIP

SEQ ID NO: 34085 - protein, 8 aa, Borrelia burgdorferi B31
ENKITIPK

SEQ ID NO: 34086 - protein, 8 aa, Borrelia burgdorferi B31
NKITIPKK

SEQ ID NO: 34087 - protein, 8 aa, Borrelia burgdorferi B31
KITIPKKI

SEQ ID NO: 34088 - protein, 8 aa, Borrelia burgdorferi B31
ITIPKKII

SEQ ID NO: 34089 - protein, 8 aa, Borrelia burgdorferi B31
TIPKKIIK

SEQ ID NO: 34090 - protein, 8 aa, Borrelia burgdorferi B31
IPKKIIKI

SEQ ID NO: 34091 - protein, 8 aa, Borrelia burgdorferi B31
PKKIIKIQ

SEQ ID NO: 34092 - protein, 8 aa, Borrelia burgdorferi B31
KKIIKIQK

SEQ ID NO: 34093 - protein, 8 aa, Borrelia burgdorferi B31
KIIKIQKI

SEQ ID NO: 34094 - protein, 8 aa, Borrelia burgdorferi B31
IIKIQKIN

SEQ ID NO: 34095 - protein, 8 aa, Borrelia burgdorferi B31
IKIQKINP

SEQ ID NO: 34096 - protein, 8 aa, Borrelia burgdorferi B31
KIQKINPN

SEQ ID NO: 34097 - protein, 8 aa, Borrelia burgdorferi B31
IQKINPNQ

SEQ ID NO: 34098 - protein, 8 aa, Borrelia burgdorferi B31
QKINPNQL

SEQ ID NO: 34099 - protein, 8 aa, Borrelia burgdorferi B31
KINPNQLD

SEQ ID NO: 34100 - protein, 8 aa, Borrelia burgdorferi B31
INPNQLDY

SEQ ID NO: 34101 - protein, 8 aa, Borrelia burgdorferi B31
NPNQLDYQ

SEQ ID NO: 34102 - protein, 8 aa, Borrelia burgdorferi B31
PNQLDYQK

SEQ ID NO: 34103 - protein, 8 aa, Borrelia burgdorferi B31
NQLDYQKS

SEQ ID NO: 34104 - protein, 8 aa, Borrelia burgdorferi B31
QLDYQKSY

SEQ ID NO: 34105 - protein, 8 aa, Borrelia burgdorferi B31
LDYQKSYL

SEQ ID NO: 34106 - protein, 8 aa, Borrelia burgdorferi B31
DYQKSYLL

SEQ ID NO: 34107 - protein, 8 aa, Borrelia burgdorferi B31
YQKSYLLI

SEQ ID NO: 34108 - protein, 8 aa, Borrelia burgdorferi B31
QKSYLLIK

SEQ ID NO: 34109 - protein, 8 aa, Borrelia burgdorferi B31
KSYLLIKS

SEQ ID NO: 34110 - protein, 8 aa, Borrelia burgdorferi B31
SYLLIKSL

SEQ ID NO: 34111 - protein, 8 aa, Borrelia burgdorferi B31
YLLIKSLK

SEQ ID NO: 34112 - protein, 8 aa, Borrelia burgdorferi B31
LLIKSLKT

SEQ ID NO: 34113 - protein, 8 aa, Borrelia burgdorferi B31
LIKSLKTR

SEQ ID NO: 34114 - protein, 8 aa, Borrelia burgdorferi B31
IKSLKTRS

SEQ ID NO: 34115 - protein, 8 aa, Borrelia burgdorferi B31
KSLKTRSR

SEQ ID NO: 34116 - protein, 8 aa, Borrelia burgdorferi B31
SLKTRSRI

SEQ ID NO: 34117 - protein, 8 aa, Borrelia burgdorferi B31
LKTRSRIL

SEQ ID NO: 34118 - protein, 8 aa, Borrelia burgdorferi B31
KTRSRILK

SEQ ID NO: 34119 - protein, 8 aa, Borrelia burgdorferi B31
TRSRILKI

SEQ ID NO: 34120 - protein, 8 aa, Borrelia burgdorferi B31
RSRILKII

SEQ ID NO: 34121 - protein, 8 aa, Borrelia burgdorferi B31
SRILKIII

SEQ ID NO: 34122 - protein, 8 aa, Borrelia burgdorferi B31
RILKIIIK

SEQ ID NO: 34123 - protein, 8 aa, Borrelia burgdorferi B31
ILKIIIKN

SEQ ID NO: 34124 - protein, 8 aa, Borrelia burgdorferi B31
LKIIIKNI

SEQ ID NO: 34125 - protein, 8 aa, Borrelia burgdorferi B31
KIIIKNIR

SEQ ID NO: 34126 - protein, 8 aa, Borrelia burgdorferi B31
IIIKNIRF

SEQ ID NO: 34127 - protein, 8 aa, Borrelia burgdorferi B31
IIKNIRFN

SEQ ID NO: 34128 - protein, 8 aa, Borrelia burgdorferi B31
IKNIRFNL

SEQ ID NO: 34129 - protein, 8 aa, Borrelia burgdorferi B31
KNIRFNLI

SEQ ID NO: 34130 - protein, 8 aa, Borrelia burgdorferi B31
NIRFNLIE

SEQ ID NO: 34131 - protein, 8 aa, Borrelia burgdorferi B31
IRFNLIEK

SEQ ID NO: 34132 - protein, 8 aa, Borrelia burgdorferi B31
RFNLIEKL

SEQ ID NO: 34133 - protein, 8 aa, Borrelia burgdorferi B31
FNLIEKLE

SEQ ID NO: 34134 - protein, 8 aa, Borrelia burgdorferi B31
NLIEKLED

SEQ ID NO: 34135 - protein, 8 aa, Borrelia burgdorferi B31
LIEKLEDE

SEQ ID NO: 34136 - protein, 8 aa, Borrelia burgdorferi B31
IEKLEDEN

SEQ ID NO: 34137 - protein, 8 aa, Borrelia burgdorferi B31
EKLEDENE

SEQ ID NO: 34138 - protein, 8 aa, Borrelia burgdorferi B31
KLEDENEK

SEQ ID NO: 34139 - protein, 8 aa, Borrelia burgdorferi B31
LEDENEKK

SEQ ID NO: 34140 - protein, 8 aa, Borrelia burgdorferi B31
EDENEKKL

SEQ ID NO: 34141 - protein, 8 aa, Borrelia burgdorferi B31
DENEKKLL

SEQ ID NO: 34142 - protein, 8 aa, Borrelia burgdorferi B31
ENEKKLLP

SEQ ID NO: 34143 - protein, 8 aa, Borrelia burgdorferi B31
NEKKLLPA

SEQ ID NO: 34144 - protein, 8 aa, Borrelia burgdorferi B31
EKKLLPAM

SEQ ID NO: 34145 - protein, 8 aa, Borrelia burgdorferi B31
KKLLPAMC

SEQ ID NO: 34146 - protein, 8 aa, Borrelia burgdorferi B31
KLLPAMCY

SEQ ID NO: 34147 - protein, 8 aa, Borrelia burgdorferi B31
LLPAMCYL

SEQ ID NO: 34148 - protein, 8 aa, Borrelia burgdorferi B31
LPAMCYLI

SEQ ID NO: 34149 - protein, 8 aa, Borrelia burgdorferi B31
PAMCYLIY

SEQ ID NO: 34150 - protein, 8 aa, Borrelia burgdorferi B31
AMCYLIYC

SEQ ID NO: 34151 - protein, 8 aa, Borrelia burgdorferi B31
MCYLIYCE

SEQ ID NO: 34152 - protein, 8 aa, Borrelia burgdorferi B31
CYLIYCEN

SEQ ID NO: 34153 - protein, 8 aa, Borrelia burgdorferi B31
YLIYCENL

SEQ ID NO: 34154 - protein, 8 aa, Borrelia burgdorferi B31
LIYCENLV

SEQ ID NO: 34155 - protein, 8 aa, Borrelia burgdorferi B31
IYCENLVE

SEQ ID NO: 34156 - protein, 8 aa, Borrelia burgdorferi B31
YCENLVEL

SEQ ID NO: 34157 - protein, 8 aa, Borrelia burgdorferi B31
CENLVELK

SEQ ID NO: 34158 - protein, 8 aa, Borrelia burgdorferi B31
ENLVELKN

SEQ ID NO: 34159 - protein, 8 aa, Borrelia burgdorferi B31
NLVELKNN

SEQ ID NO: 34160 - protein, 8 aa, Borrelia burgdorferi B31
LVELKNNR

SEQ ID NO: 34161 - protein, 8 aa, Borrelia burgdorferi B31
VELKNNRK

SEQ ID NO: 34162 - protein, 8 aa, Borrelia burgdorferi B31
ELKNNRKI

SEQ ID NO: 34163 - protein, 8 aa, Borrelia burgdorferi B31
LKNNRKIK

SEQ ID NO: 34164 - protein, 8 aa, Borrelia burgdorferi B31
KNNRKIKS

SEQ ID NO: 34165 - protein, 8 aa, Borrelia burgdorferi B31
NNRKIKSN

SEQ ID NO: 34166 - protein, 8 aa, Borrelia burgdorferi B31
NRKIKSNE

SEQ ID NO: 34167 - protein, 8 aa, Borrelia burgdorferi B31
RKIKSNEK

SEQ ID NO: 34168 - protein, 8 aa, Borrelia burgdorferi B31
KIKSNEKN

SEQ ID NO: 34169 - protein, 8 aa, Borrelia burgdorferi B31
IKSNEKNS

SEQ ID NO: 34170 - protein, 8 aa, Borrelia burgdorferi B31
KSNEKNSL

SEQ ID NO: 34171 - protein, 8 aa, Borrelia burgdorferi B31
SNEKNSLL

SEQ ID NO: 34172 - protein, 8 aa, Borrelia burgdorferi B31
NEKNSLLE

SEQ ID NO: 34173 - protein, 8 aa, Borrelia burgdorferi B31
EKNSLLEF

SEQ ID NO: 34174 - protein, 8 aa, Borrelia burgdorferi B31
KNSLLEFI

SEQ ID NO: 34175 - protein, 8 aa, Borrelia burgdorferi B31
NSLLEFIS

SEQ ID NO: 34176 - protein, 8 aa, Borrelia burgdorferi B31
SLLEFISF

SEQ ID NO: 34177 - protein, 8 aa, Borrelia burgdorferi B31
LLEFISFF

SEQ ID NO: 34178 - protein, 8 aa, Borrelia burgdorferi B31
LEFISFFK

SEQ ID NO: 34179 - protein, 8 aa, Borrelia burgdorferi B31
EFISFFKT

SEQ ID NO: 34180 - protein, 8 aa, Borrelia burgdorferi B31
FISFFKTK

SEQ ID NO: 34181 - protein, 8 aa, Borrelia burgdorferi B31
ISFFKTKL

SEQ ID NO: 34182 - protein, 8 aa, Borrelia burgdorferi B31
SFFKTKLK

SEQ ID NO: 34183 - protein, 8 aa, Borrelia burgdorferi B31
FFKTKLKQ

SEQ ID NO: 34184 - protein, 8 aa, Borrelia burgdorferi B31
FKTKLKQK

SEQ ID NO: 34185 - protein, 8 aa, Borrelia burgdorferi B31
KTKLKQKI

SEQ ID NO: 34186 - protein, 8 aa, Borrelia burgdorferi B31
TKLKQKIN

SEQ ID NO: 34187 - protein, 8 aa, Borrelia burgdorferi B31
KLKQKINF

SEQ ID NO: 34188 - protein, 8 aa, Borrelia burgdorferi B31
LKQKINFK

SEQ ID NO: 34189 - protein, 8 aa, Borrelia burgdorferi B31
KQKINFKK

SEQ ID NO: 34190 - protein, 8 aa, Borrelia burgdorferi B31
QKINFKKE

SEQ ID NO: 34191 - protein, 8 aa, Borrelia burgdorferi B31
KINFKKEL

SEQ ID NO: 34192 - protein, 8 aa, Borrelia burgdorferi B31
INFKKELM

SEQ ID NO: 34193 - protein, 8 aa, Borrelia burgdorferi B31
NFKKELMK

SEQ ID NO: 34194 - protein, 8 aa, Borrelia burgdorferi B31
FKKELMKS

SEQ ID NO: 34195 - protein, 8 aa, Borrelia burgdorferi B31
KKELMKSK

SEQ ID NO: 34196 - protein, 8 aa, Borrelia burgdorferi B31
KELMKSKG

SEQ ID NO: 34197 - protein, 8 aa, Borrelia burgdorferi B31
ELMKSKGI

SEQ ID NO: 34198 - protein, 9 aa, Borrelia burgdorferi B31
MKTIKKDSE

SEQ ID NO: 34199 - protein, 9 aa, Borrelia burgdorferi B31
KTIKKDSEF

SEQ ID NO: 34200 - protein, 9 aa, Borrelia burgdorferi B31
TIKKDSEFY

SEQ ID NO: 34201 - protein, 9 aa, Borrelia burgdorferi B31
IKKDSEFYD

SEQ ID NO: 34202 - protein, 9 aa, Borrelia burgdorferi B31
KKDSEFYDS

SEQ ID NO: 34203 - protein, 9 aa, Borrelia burgdorferi B31
KDSEFYDSL

SEQ ID NO: 34204 - protein, 9 aa, Borrelia burgdorferi B31
DSEFYDSLA

SEQ ID NO: 34205 - protein, 9 aa, Borrelia burgdorferi B31
SEFYDSLAT

SEQ ID NO: 34206 - protein, 9 aa, Borrelia burgdorferi B31
EFYDSLATL

SEQ ID NO: 34207 - protein, 9 aa, Borrelia burgdorferi B31
FYDSLATLK

SEQ ID NO: 34208 - protein, 9 aa, Borrelia burgdorferi B31
YDSLATLKK

SEQ ID NO: 34209 - protein, 9 aa, Borrelia burgdorferi B31
DSLATLKKH

SEQ ID NO: 34210 - protein, 9 aa, Borrelia burgdorferi B31
SLATLKKHI

SEQ ID NO: 34211 - protein, 9 aa, Borrelia burgdorferi B31
LATLKKHIN

SEQ ID NO: 34212 - protein, 9 aa, Borrelia burgdorferi B31
ATLKKHINK

SEQ ID NO: 34213 - protein, 9 aa, Borrelia burgdorferi B31
TLKKHINKY

SEQ ID NO: 34214 - protein, 9 aa, Borrelia burgdorferi B31
LKKHINKYI

SEQ ID NO: 34215 - protein, 9 aa, Borrelia burgdorferi B31
KKHINKYIE

SEQ ID NO: 34216 - protein, 9 aa, Borrelia burgdorferi B31
KHINKYIEE

SEQ ID NO: 34217 - protein, 9 aa, Borrelia burgdorferi B31
HINKYIEEK

SEQ ID NO: 34218 - protein, 9 aa, Borrelia burgdorferi B31
INKYIEEKV

SEQ ID NO: 34219 - protein, 9 aa, Borrelia burgdorferi B31
NKYIEEKVL

SEQ ID NO: 34220 - protein, 9 aa, Borrelia burgdorferi B31
KYIEEKVLK

SEQ ID NO: 34221 - protein, 9 aa, Borrelia burgdorferi B31
YIEEKVLKY

SEQ ID NO: 34222 - protein, 9 aa, Borrelia burgdorferi B31
IEEKVLKYS

SEQ ID NO: 34223 - protein, 9 aa, Borrelia burgdorferi B31
EEKVLKYSI

SEQ ID NO: 34224 - protein, 9 aa, Borrelia burgdorferi B31
EKVLKYSIS

SEQ ID NO: 34225 - protein, 9 aa, Borrelia burgdorferi B31
KVLKYSISS

SEQ ID NO: 34226 - protein, 9 aa, Borrelia burgdorferi B31
VLKYSISSQ

SEQ ID NO: 34227 - protein, 9 aa, Borrelia burgdorferi B31
LKYSISSQL

SEQ ID NO: 34228 - protein, 9 aa, Borrelia burgdorferi B31
KYSISSQLY

SEQ ID NO: 34229 - protein, 9 aa, Borrelia burgdorferi B31
YSISSQLYK

SEQ ID NO: 34230 - protein, 9 aa, Borrelia burgdorferi B31
SISSQLYKL

SEQ ID NO: 34231 - protein, 9 aa, Borrelia burgdorferi B31
ISSQLYKLE

SEQ ID NO: 34232 - protein, 9 aa, Borrelia burgdorferi B31
SSQLYKLEK

SEQ ID NO: 34233 - protein, 9 aa, Borrelia burgdorferi B31
SQLYKLEKP

SEQ ID NO: 34234 - protein, 9 aa, Borrelia burgdorferi B31
QLYKLEKPE

SEQ ID NO: 34235 - protein, 9 aa, Borrelia burgdorferi B31
LYKLEKPEI

SEQ ID NO: 34236 - protein, 9 aa, Borrelia burgdorferi B31
YKLEKPEII

SEQ ID NO: 34237 - protein, 9 aa, Borrelia burgdorferi B31
KLEKPEIIE

SEQ ID NO: 34238 - protein, 9 aa, Borrelia burgdorferi B31
LEKPEIIEL

SEQ ID NO: 34239 - protein, 9 aa, Borrelia burgdorferi B31
EKPEIIELI

SEQ ID NO: 34240 - protein, 9 aa, Borrelia burgdorferi B31
KPEIIELIK

SEQ ID NO: 34241 - protein, 9 aa, Borrelia burgdorferi B31
PEIIELIKI

SEQ ID NO: 34242 - protein, 9 aa, Borrelia burgdorferi B31
EIIELIKIS

SEQ ID NO: 34243 - protein, 9 aa, Borrelia burgdorferi B31
IIELIKISN

SEQ ID NO: 34244 - protein, 9 aa, Borrelia burgdorferi B31
IELIKISND

SEQ ID NO: 34245 - protein, 9 aa, Borrelia burgdorferi B31
ELIKISNDY

SEQ ID NO: 34246 - protein, 9 aa, Borrelia burgdorferi B31
LIKISNDYE

SEQ ID NO: 34247 - protein, 9 aa, Borrelia burgdorferi B31
IKISNDYEK

SEQ ID NO: 34248 - protein, 9 aa, Borrelia burgdorferi B31
KISNDYEKE

SEQ ID NO: 34249 - protein, 9 aa, Borrelia burgdorferi B31
ISNDYEKEK

SEQ ID NO: 34250 - protein, 9 aa, Borrelia burgdorferi B31
SNDYEKEKN

SEQ ID NO: 34251 - protein, 9 aa, Borrelia burgdorferi B31
NDYEKEKNA

SEQ ID NO: 34252 - protein, 9 aa, Borrelia burgdorferi B31
DYEKEKNAF

SEQ ID NO: 34253 - protein, 9 aa, Borrelia burgdorferi B31
YEKEKNAFN

SEQ ID NO: 34254 - protein, 9 aa, Borrelia burgdorferi B31
EKEKNAFNT

SEQ ID NO: 34255 - protein, 9 aa, Borrelia burgdorferi B31
KEKNAFNTS

SEQ ID NO: 34256 - protein, 9 aa, Borrelia burgdorferi B31
EKNAFNTSL

SEQ ID NO: 34257 - protein, 9 aa, Borrelia burgdorferi B31
KNAFNTSLE

SEQ ID NO: 34258 - protein, 9 aa, Borrelia burgdorferi B31
NAFNTSLEE

SEQ ID NO: 34259 - protein, 9 aa, Borrelia burgdorferi B31
AFNTSLEEC

SEQ ID NO: 34260 - protein, 9 aa, Borrelia burgdorferi B31
FNTSLEECY

SEQ ID NO: 34261 - protein, 9 aa, Borrelia burgdorferi B31
NTSLEECYY

SEQ ID NO: 34262 - protein, 9 aa, Borrelia burgdorferi B31
TSLEECYYK

SEQ ID NO: 34263 - protein, 9 aa, Borrelia burgdorferi B31
SLEECYYKN

SEQ ID NO: 34264 - protein, 9 aa, Borrelia burgdorferi B31
LEECYYKNT

SEQ ID NO: 34265 - protein, 9 aa, Borrelia burgdorferi B31
EECYYKNTQ

SEQ ID NO: 34266 - protein, 9 aa, Borrelia burgdorferi B31
ECYYKNTQN

SEQ ID NO: 34267 - protein, 9 aa, Borrelia burgdorferi B31
CYYKNTQNE

SEQ ID NO: 34268 - protein, 9 aa, Borrelia burgdorferi B31
YYKNTQNEA

SEQ ID NO: 34269 - protein, 9 aa, Borrelia burgdorferi B31
YKNTQNEAI

SEQ ID NO: 34270 - protein, 9 aa, Borrelia burgdorferi B31
KNTQNEAIK

SEQ ID NO: 34271 - protein, 9 aa, Borrelia burgdorferi B31
NTQNEAIKK

SEQ ID NO: 34272 - protein, 9 aa, Borrelia burgdorferi B31
TQNEAIKKW

SEQ ID NO: 34273 - protein, 9 aa, Borrelia burgdorferi B31
QNEAIKKWI

SEQ ID NO: 34274 - protein, 9 aa, Borrelia burgdorferi B31
NEAIKKWIL

SEQ ID NO: 34275 - protein, 9 aa, Borrelia burgdorferi B31
EAIKKWILE

SEQ ID NO: 34276 - protein, 9 aa, Borrelia burgdorferi B31
AIKKWILEI

SEQ ID NO: 34277 - protein, 9 aa, Borrelia burgdorferi B31
IKKWILEIV

SEQ ID NO: 34278 - protein, 9 aa, Borrelia burgdorferi B31
KKWILEIVR

SEQ ID NO: 34279 - protein, 9 aa, Borrelia burgdorferi B31
KWILEIVRN

SEQ ID NO: 34280 - protein, 9 aa, Borrelia burgdorferi B31
WILEIVRNK

SEQ ID NO: 34281 - protein, 9 aa, Borrelia burgdorferi B31
ILEIVRNKN

SEQ ID NO: 34282 - protein, 9 aa, Borrelia burgdorferi B31
LEIVRNKNF

SEQ ID NO: 34283 - protein, 9 aa, Borrelia burgdorferi B31
EIVRNKNFI

SEQ ID NO: 34284 - protein, 9 aa, Borrelia burgdorferi B31
IVRNKNFIQ

SEQ ID NO: 34285 - protein, 9 aa, Borrelia burgdorferi B31
VRNKNFIQI

SEQ ID NO: 34286 - protein, 9 aa, Borrelia burgdorferi B31
RNKNFIQIS

SEQ ID NO: 34287 - protein, 9 aa, Borrelia burgdorferi B31
NKNFIQISK

SEQ ID NO: 34288 - protein, 9 aa, Borrelia burgdorferi B31
KNFIQISKE

SEQ ID NO: 34289 - protein, 9 aa, Borrelia burgdorferi B31
NFIQISKEA

SEQ ID NO: 34290 - protein, 9 aa, Borrelia burgdorferi B31
FIQISKEAN

SEQ ID NO: 34291 - protein, 9 aa, Borrelia burgdorferi B31
IQISKEANL

SEQ ID NO: 34292 - protein, 9 aa, Borrelia burgdorferi B31
QISKEANLN

SEQ ID NO: 34293 - protein, 9 aa, Borrelia burgdorferi B31
ISKEANLNT

SEQ ID NO: 34294 - protein, 9 aa, Borrelia burgdorferi B31
SKEANLNTK

SEQ ID NO: 34295 - protein, 9 aa, Borrelia burgdorferi B31
KEANLNTKK

SEQ ID NO: 34296 - protein, 9 aa, Borrelia burgdorferi B31
EANLNTKKL

SEQ ID NO: 34297 - protein, 9 aa, Borrelia burgdorferi B31
ANLNTKKLG

SEQ ID NO: 34298 - protein, 9 aa, Borrelia burgdorferi B31
NLNTKKLGT

SEQ ID NO: 34299 - protein, 9 aa, Borrelia burgdorferi B31
LNTKKLGTT

SEQ ID NO: 34300 - protein, 9 aa, Borrelia burgdorferi B31
NTKKLGTTY

SEQ ID NO: 34301 - protein, 9 aa, Borrelia burgdorferi B31
TKKLGTTYK

SEQ ID NO: 34302 - protein, 9 aa, Borrelia burgdorferi B31
KKLGTTYKL

SEQ ID NO: 34303 - protein, 9 aa, Borrelia burgdorferi B31
KLGTTYKLK

SEQ ID NO: 34304 - protein, 9 aa, Borrelia burgdorferi B31
LGTTYKLKS

SEQ ID NO: 34305 - protein, 9 aa, Borrelia burgdorferi B31
GTTYKLKSS

SEQ ID NO: 34306 - protein, 9 aa, Borrelia burgdorferi B31
TTYKLKSSN

SEQ ID NO: 34307 - protein, 9 aa, Borrelia burgdorferi B31
TYKLKSSNF

SEQ ID NO: 34308 - protein, 9 aa, Borrelia burgdorferi B31
YKLKSSNFL

SEQ ID NO: 34309 - protein, 9 aa, Borrelia burgdorferi B31
KLKSSNFLK

SEQ ID NO: 34310 - protein, 9 aa, Borrelia burgdorferi B31
LKSSNFLKL

SEQ ID NO: 34311 - protein, 9 aa, Borrelia burgdorferi B31
KSSNFLKLI

SEQ ID NO: 34312 - protein, 9 aa, Borrelia burgdorferi B31
SSNFLKLIE

SEQ ID NO: 34313 - protein, 9 aa, Borrelia burgdorferi B31
SNFLKLIEI

SEQ ID NO: 34314 - protein, 9 aa, Borrelia burgdorferi B31
NFLKLIEIQ

SEQ ID NO: 34315 - protein, 9 aa, Borrelia burgdorferi B31
FLKLIEIQN

SEQ ID NO: 34316 - protein, 9 aa, Borrelia burgdorferi B31
LKLIEIQNS

SEQ ID NO: 34317 - protein, 9 aa, Borrelia burgdorferi B31
KLIEIQNSP

SEQ ID NO: 34318 - protein, 9 aa, Borrelia burgdorferi B31
LIEIQNSPY

SEQ ID NO: 34319 - protein, 9 aa, Borrelia burgdorferi B31
IEIQNSPYY

SEQ ID NO: 34320 - protein, 9 aa, Borrelia burgdorferi B31
EIQNSPYYS

SEQ ID NO: 34321 - protein, 9 aa, Borrelia burgdorferi B31
IQNSPYYSQ

SEQ ID NO: 34322 - protein, 9 aa, Borrelia burgdorferi B31
QNSPYYSQE

SEQ ID NO: 34323 - protein, 9 aa, Borrelia burgdorferi B31
NSPYYSQEK

SEQ ID NO: 34324 - protein, 9 aa, Borrelia burgdorferi B31
SPYYSQEKK

SEQ ID NO: 34325 - protein, 9 aa, Borrelia burgdorferi B31
PYYSQEKKD

SEQ ID NO: 34326 - protein, 9 aa, Borrelia burgdorferi B31
YYSQEKKDI

SEQ ID NO: 34327 - protein, 9 aa, Borrelia burgdorferi B31
YSQEKKDIY

SEQ ID NO: 34328 - protein, 9 aa, Borrelia burgdorferi B31
SQEKKDIYK

SEQ ID NO: 34329 - protein, 9 aa, Borrelia burgdorferi B31
QEKKDIYKQ

SEQ ID NO: 34330 - protein, 9 aa, Borrelia burgdorferi B31
EKKDIYKQI

SEQ ID NO: 34331 - protein, 9 aa, Borrelia burgdorferi B31
KKDIYKQII

SEQ ID NO: 34332 - protein, 9 aa, Borrelia burgdorferi B31
KDIYKQIIL

SEQ ID NO: 34333 - protein, 9 aa, Borrelia burgdorferi B31
DIYKQIILN

SEQ ID NO: 34334 - protein, 9 aa, Borrelia burgdorferi B31
IYKQIILNF

SEQ ID NO: 34335 - protein, 9 aa, Borrelia burgdorferi B31
YKQIILNFS

SEQ ID NO: 34336 - protein, 9 aa, Borrelia burgdorferi B31
KQIILNFSS

SEQ ID NO: 34337 - protein, 9 aa, Borrelia burgdorferi B31
QIILNFSSN

SEQ ID NO: 34338 - protein, 9 aa, Borrelia burgdorferi B31
IILNFSSNI

SEQ ID NO: 34339 - protein, 9 aa, Borrelia burgdorferi B31
ILNFSSNIN

SEQ ID NO: 34340 - protein, 9 aa, Borrelia burgdorferi B31
LNFSSNINI

SEQ ID NO: 34341 - protein, 9 aa, Borrelia burgdorferi B31
NFSSNINID

SEQ ID NO: 34342 - protein, 9 aa, Borrelia burgdorferi B31
FSSNINIDS

SEQ ID NO: 34343 - protein, 9 aa, Borrelia burgdorferi B31
SSNINIDSL

SEQ ID NO: 34344 - protein, 9 aa, Borrelia burgdorferi B31
SNINIDSLE

SEQ ID NO: 34345 - protein, 9 aa, Borrelia burgdorferi B31
NINIDSLEQ

SEQ ID NO: 34346 - protein, 9 aa, Borrelia burgdorferi B31
INIDSLEQT

SEQ ID NO: 34347 - protein, 9 aa, Borrelia burgdorferi B31
NIDSLEQTI

SEQ ID NO: 34348 - protein, 9 aa, Borrelia burgdorferi B31
IDSLEQTID

SEQ ID NO: 34349 - protein, 9 aa, Borrelia burgdorferi B31
DSLEQTIDI

SEQ ID NO: 34350 - protein, 9 aa, Borrelia burgdorferi B31
SLEQTIDIL

SEQ ID NO: 34351 - protein, 9 aa, Borrelia burgdorferi B31
LEQTIDILV

SEQ ID NO: 34352 - protein, 9 aa, Borrelia burgdorferi B31
EQTIDILVA

SEQ ID NO: 34353 - protein, 9 aa, Borrelia burgdorferi B31
QTIDILVAV

SEQ ID NO: 34354 - protein, 9 aa, Borrelia burgdorferi B31
TIDILVAVR

SEQ ID NO: 34355 - protein, 9 aa, Borrelia burgdorferi B31
IDILVAVRN

SEQ ID NO: 34356 - protein, 9 aa, Borrelia burgdorferi B31
DILVAVRNR

SEQ ID NO: 34357 - protein, 9 aa, Borrelia burgdorferi B31
ILVAVRNRN

SEQ ID NO: 34358 - protein, 9 aa, Borrelia burgdorferi B31
LVAVRNRNK

SEQ ID NO: 34359 - protein, 9 aa, Borrelia burgdorferi B31
VAVRNRNKI

SEQ ID NO: 34360 - protein, 9 aa, Borrelia burgdorferi B31
AVRNRNKIK

SEQ ID NO: 34361 - protein, 9 aa, Borrelia burgdorferi B31
VRNRNKIKI

SEQ ID NO: 34362 - protein, 9 aa, Borrelia burgdorferi B31
RNRNKIKIL

SEQ ID NO: 34363 - protein, 9 aa, Borrelia burgdorferi B31
NRNKIKILN

SEQ ID NO: 34364 - protein, 9 aa, Borrelia burgdorferi B31
RNKIKILNI

SEQ ID NO: 34365 - protein, 9 aa, Borrelia burgdorferi B31
NKIKILNIL

SEQ ID NO: 34366 - protein, 9 aa, Borrelia burgdorferi B31
KIKILNILN

SEQ ID NO: 34367 - protein, 9 aa, Borrelia burgdorferi B31
IKILNILNK

SEQ ID NO: 34368 - protein, 9 aa, Borrelia burgdorferi B31
KILNILNKN

SEQ ID NO: 34369 - protein, 9 aa, Borrelia burgdorferi B31
ILNILNKNL

SEQ ID NO: 34370 - protein, 9 aa, Borrelia burgdorferi B31
LNILNKNLK

SEQ ID NO: 34371 - protein, 9 aa, Borrelia burgdorferi B31
NILNKNLKY

SEQ ID NO: 34372 - protein, 9 aa, Borrelia burgdorferi B31
ILNKNLKYR

SEQ ID NO: 34373 - protein, 9 aa, Borrelia burgdorferi B31
LNKNLKYRP

SEQ ID NO: 34374 - protein, 9 aa, Borrelia burgdorferi B31
NKNLKYRPE

SEQ ID NO: 34375 - protein, 9 aa, Borrelia burgdorferi B31
KNLKYRPEN

SEQ ID NO: 34376 - protein, 9 aa, Borrelia burgdorferi B31
NLKYRPENQ

SEQ ID NO: 34377 - protein, 9 aa, Borrelia burgdorferi B31
LKYRPENQK

SEQ ID NO: 34378 - protein, 9 aa, Borrelia burgdorferi B31
KYRPENQKV

SEQ ID NO: 34379 - protein, 9 aa, Borrelia burgdorferi B31
YRPENQKVF

SEQ ID NO: 34380 - protein, 9 aa, Borrelia burgdorferi B31
RPENQKVFK

SEQ ID NO: 34381 - protein, 9 aa, Borrelia burgdorferi B31
PENQKVFKS

SEQ ID NO: 34382 - protein, 9 aa, Borrelia burgdorferi B31
ENQKVFKSS

SEQ ID NO: 34383 - protein, 9 aa, Borrelia burgdorferi B31
NQKVFKSSL

SEQ ID NO: 34384 - protein, 9 aa, Borrelia burgdorferi B31
QKVFKSSLT

SEQ ID NO: 34385 - protein, 9 aa, Borrelia burgdorferi B31
KVFKSSLTN

SEQ ID NO: 34386 - protein, 9 aa, Borrelia burgdorferi B31
VFKSSLTNK

SEQ ID NO: 34387 - protein, 9 aa, Borrelia burgdorferi B31
FKSSLTNKE

SEQ ID NO: 34388 - protein, 9 aa, Borrelia burgdorferi B31
KSSLTNKES

SEQ ID NO: 34389 - protein, 9 aa, Borrelia burgdorferi B31
SSLTNKESR

SEQ ID NO: 34390 - protein, 9 aa, Borrelia burgdorferi B31
SLTNKESRL

SEQ ID NO: 34391 - protein, 9 aa, Borrelia burgdorferi B31
LTNKESRLI

SEQ ID NO: 34392 - protein, 9 aa, Borrelia burgdorferi B31
TNKESRLIK

SEQ ID NO: 34393 - protein, 9 aa, Borrelia burgdorferi B31
NKESRLIKL

SEQ ID NO: 34394 - protein, 9 aa, Borrelia burgdorferi B31
KESRLIKLK

SEQ ID NO: 34395 - protein, 9 aa, Borrelia burgdorferi B31
ESRLIKLKR

SEQ ID NO: 34396 - protein, 9 aa, Borrelia burgdorferi B31
SRLIKLKRM

SEQ ID NO: 34397 - protein, 9 aa, Borrelia burgdorferi B31
RLIKLKRML

SEQ ID NO: 34398 - protein, 9 aa, Borrelia burgdorferi B31
LIKLKRMLI

SEQ ID NO: 34399 - protein, 9 aa, Borrelia burgdorferi B31
IKLKRMLIL

SEQ ID NO: 34400 - protein, 9 aa, Borrelia burgdorferi B31
KLKRMLILT

SEQ ID NO: 34401 - protein, 9 aa, Borrelia burgdorferi B31
LKRMLILTY

SEQ ID NO: 34402 - protein, 9 aa, Borrelia burgdorferi B31
KRMLILTYW

SEQ ID NO: 34403 - protein, 9 aa, Borrelia burgdorferi B31
RMLILTYWP

SEQ ID NO: 34404 - protein, 9 aa, Borrelia burgdorferi B31
MLILTYWPV

SEQ ID NO: 34405 - protein, 9 aa, Borrelia burgdorferi B31
LILTYWPVG

SEQ ID NO: 34406 - protein, 9 aa, Borrelia burgdorferi B31
ILTYWPVGC

SEQ ID NO: 34407 - protein, 9 aa, Borrelia burgdorferi B31
LTYWPVGCL

SEQ ID NO: 34408 - protein, 9 aa, Borrelia burgdorferi B31
TYWPVGCLS

SEQ ID NO: 34409 - protein, 9 aa, Borrelia burgdorferi B31
YWPVGCLSK

SEQ ID NO: 34410 - protein, 9 aa, Borrelia burgdorferi B31
WPVGCLSKN

SEQ ID NO: 34411 - protein, 9 aa, Borrelia burgdorferi B31
PVGCLSKNI

SEQ ID NO: 34412 - protein, 9 aa, Borrelia burgdorferi B31
VGCLSKNIF

SEQ ID NO: 34413 - protein, 9 aa, Borrelia burgdorferi B31
GCLSKNIFI

SEQ ID NO: 34414 - protein, 9 aa, Borrelia burgdorferi B31
CLSKNIFIK

SEQ ID NO: 34415 - protein, 9 aa, Borrelia burgdorferi B31
LSKNIFIKI

SEQ ID NO: 34416 - protein, 9 aa, Borrelia burgdorferi B31
SKNIFIKIL

SEQ ID NO: 34417 - protein, 9 aa, Borrelia burgdorferi B31
KNIFIKILI

SEQ ID NO: 34418 - protein, 9 aa, Borrelia burgdorferi B31
NIFIKILIK

SEQ ID NO: 34419 - protein, 9 aa, Borrelia burgdorferi B31
  Xaa can be any naturally occurring amino acid
  VARIANT 9: Xaa = Any Amino Acid
IFIKILIKX

SEQ ID NO: 34420 - protein, 9 aa, Borrelia burgdorferi B31
  Xaa can be any naturally occurring amino acid
  VARIANT 8: Xaa = Any Amino Acid
FIKILIKXY

SEQ ID NO: 34421 - protein, 9 aa, Borrelia burgdorferi B31
  Xaa can be any naturally occurring amino acid
  VARIANT 7: Xaa = Any Amino Acid
IKILIKXYK

SEQ ID NO: 34422 - protein, 9 aa, Borrelia burgdorferi B31
  Xaa can be any naturally occurring amino acid
  VARIANT 6: Xaa = Any Amino Acid
KILIKXYKY

SEQ ID NO: 34423 - protein, 9 aa, Borrelia burgdorferi B31
  Xaa can be any naturally occurring amino acid
  VARIANT 5: Xaa = Any Amino Acid
ILIKXYKYL

SEQ ID NO: 34424 - protein, 9 aa, Borrelia burgdorferi B31
  Xaa can be any naturally occurring amino acid
  VARIANT 4: Xaa = Any Amino Acid
LIKXYKYLE

SEQ ID NO: 34425 - protein, 9 aa, Borrelia burgdorferi B31
  Xaa can be any naturally occurring amino acid
  VARIANT 3: Xaa = Any Amino Acid
IKXYKYLEE

SEQ ID NO: 34426 - protein, 9 aa, Borrelia burgdorferi B31
  Xaa can be any naturally occurring amino acid
  VARIANT 2: Xaa = Any Amino Acid
KXYKYLEEE

SEQ ID NO: 34427 - protein, 9 aa, Borrelia burgdorferi B31
  Xaa can be any naturally occurring amino acid
  VARIANT 1: Xaa = Any Amino Acid
XYKYLEEEI

SEQ ID NO: 34428 - protein, 9 aa, Borrelia burgdorferi B31
YKYLEEEIL

SEQ ID NO: 34429 - protein, 9 aa, Borrelia burgdorferi B31
KYLEEEILA

SEQ ID NO: 34430 - protein, 9 aa, Borrelia burgdorferi B31
YLEEEILAL

SEQ ID NO: 34431 - protein, 9 aa, Borrelia burgdorferi B31
LEEEILALK

SEQ ID NO: 34432 - protein, 9 aa, Borrelia burgdorferi B31
EEEILALKY

SEQ ID NO: 34433 - protein, 9 aa, Borrelia burgdorferi B31
EEILALKYN

SEQ ID NO: 34434 - protein, 9 aa, Borrelia burgdorferi B31
EILALKYNE

SEQ ID NO: 34435 - protein, 9 aa, Borrelia burgdorferi B31
ILALKYNEI

SEQ ID NO: 34436 - protein, 9 aa, Borrelia burgdorferi B31
LALKYNEIL

SEQ ID NO: 34437 - protein, 9 aa, Borrelia burgdorferi B31
ALKYNEILN

SEQ ID NO: 34438 - protein, 9 aa, Borrelia burgdorferi B31
LKYNEILNY

SEQ ID NO: 34439 - protein, 9 aa, Borrelia burgdorferi B31
KYNEILNYL

SEQ ID NO: 34440 - protein, 9 aa, Borrelia burgdorferi B31
YNEILNYLR

SEQ ID NO: 34441 - protein, 9 aa, Borrelia burgdorferi B31
NEILNYLRA

SEQ ID NO: 34442 - protein, 9 aa, Borrelia burgdorferi B31
EILNYLRAL

SEQ ID NO: 34443 - protein, 9 aa, Borrelia burgdorferi B31
ILNYLRALK

SEQ ID NO: 34444 - protein, 9 aa, Borrelia burgdorferi B31
LNYLRALKT

SEQ ID NO: 34445 - protein, 9 aa, Borrelia burgdorferi B31
NYLRALKTL

SEQ ID NO: 34446 - protein, 9 aa, Borrelia burgdorferi B31
YLRALKTLS

SEQ ID NO: 34447 - protein, 9 aa, Borrelia burgdorferi B31
LRALKTLSL

SEQ ID NO: 34448 - protein, 9 aa, Borrelia burgdorferi B31
RALKTLSLN

SEQ ID NO: 34449 - protein, 9 aa, Borrelia burgdorferi B31
ALKTLSLNE

SEQ ID NO: 34450 - protein, 9 aa, Borrelia burgdorferi B31
LKTLSLNEI

SEQ ID NO: 34451 - protein, 9 aa, Borrelia burgdorferi B31
KTLSLNEIF

SEQ ID NO: 34452 - protein, 9 aa, Borrelia burgdorferi B31
TLSLNEIFY

SEQ ID NO: 34453 - protein, 9 aa, Borrelia burgdorferi B31
LSLNEIFYK

SEQ ID NO: 34454 - protein, 9 aa, Borrelia burgdorferi B31
SLNEIFYKG

SEQ ID NO: 34455 - protein, 9 aa, Borrelia burgdorferi B31
LNEIFYKGS

SEQ ID NO: 34456 - protein, 9 aa, Borrelia burgdorferi B31
NEIFYKGSS

SEQ ID NO: 34457 - protein, 9 aa, Borrelia burgdorferi B31
EIFYKGSSK

SEQ ID NO: 34458 - protein, 9 aa, Borrelia burgdorferi B31
IFYKGSSKN

SEQ ID NO: 34459 - protein, 9 aa, Borrelia burgdorferi B31
FYKGSSKNI

SEQ ID NO: 34460 - protein, 9 aa, Borrelia burgdorferi B31
YKGSSKNIS

SEQ ID NO: 34461 - protein, 9 aa, Borrelia burgdorferi B31
KGSSKNISF

SEQ ID NO: 34462 - protein, 9 aa, Borrelia burgdorferi B31
GSSKNISFN

SEQ ID NO: 34463 - protein, 9 aa, Borrelia burgdorferi B31
SSKNISFNY

SEQ ID NO: 34464 - protein, 9 aa, Borrelia burgdorferi B31
SKNISFNYF

SEQ ID NO: 34465 - protein, 9 aa, Borrelia burgdorferi B31
KNISFNYFF

SEQ ID NO: 34466 - protein, 9 aa, Borrelia burgdorferi B31
NISFNYFFS

SEQ ID NO: 34467 - protein, 9 aa, Borrelia burgdorferi B31
ISFNYFFSD

SEQ ID NO: 34468 - protein, 9 aa, Borrelia burgdorferi B31
SFNYFFSDF

SEQ ID NO: 34469 - protein, 9 aa, Borrelia burgdorferi B31
FNYFFSDFT

SEQ ID NO: 34470 - protein, 9 aa, Borrelia burgdorferi B31
NYFFSDFTQ

SEQ ID NO: 34471 - protein, 9 aa, Borrelia burgdorferi B31
YFFSDFTQY

SEQ ID NO: 34472 - protein, 9 aa, Borrelia burgdorferi B31
FFSDFTQYA

SEQ ID NO: 34473 - protein, 9 aa, Borrelia burgdorferi B31
FSDFTQYAP

SEQ ID NO: 34474 - protein, 9 aa, Borrelia burgdorferi B31
SDFTQYAPK

SEQ ID NO: 34475 - protein, 9 aa, Borrelia burgdorferi B31
DFTQYAPKD

SEQ ID NO: 34476 - protein, 9 aa, Borrelia burgdorferi B31
FTQYAPKDF

SEQ ID NO: 34477 - protein, 9 aa, Borrelia burgdorferi B31
TQYAPKDFQ

SEQ ID NO: 34478 - protein, 9 aa, Borrelia burgdorferi B31
QYAPKDFQD

SEQ ID NO: 34479 - protein, 9 aa, Borrelia burgdorferi B31
YAPKDFQDT

SEQ ID NO: 34480 - protein, 9 aa, Borrelia burgdorferi B31
APKDFQDTL

SEQ ID NO: 34481 - protein, 9 aa, Borrelia burgdorferi B31
PKDFQDTLK

SEQ ID NO: 34482 - protein, 9 aa, Borrelia burgdorferi B31
KDFQDTLKC

SEQ ID NO: 34483 - protein, 9 aa, Borrelia burgdorferi B31
DFQDTLKCY

SEQ ID NO: 34484 - protein, 9 aa, Borrelia burgdorferi B31
FQDTLKCYL

SEQ ID NO: 34485 - protein, 9 aa, Borrelia burgdorferi B31
QDTLKCYLY

SEQ ID NO: 34486 - protein, 9 aa, Borrelia burgdorferi B31
DTLKCYLYV

SEQ ID NO: 34487 - protein, 9 aa, Borrelia burgdorferi B31
TLKCYLYVI

SEQ ID NO: 34488 - protein, 9 aa, Borrelia burgdorferi B31
LKCYLYVIE

SEQ ID NO: 34489 - protein, 9 aa, Borrelia burgdorferi B31
KCYLYVIEK

SEQ ID NO: 34490 - protein, 9 aa, Borrelia burgdorferi B31
CYLYVIEKT

SEQ ID NO: 34491 - protein, 9 aa, Borrelia burgdorferi B31
YLYVIEKTI

SEQ ID NO: 34492 - protein, 9 aa, Borrelia burgdorferi B31
LYVIEKTIT

SEQ ID NO: 34493 - protein, 9 aa, Borrelia burgdorferi B31
YVIEKTITK

SEQ ID NO: 34494 - protein, 9 aa, Borrelia burgdorferi B31
VIEKTITKK

SEQ ID NO: 34495 - protein, 9 aa, Borrelia burgdorferi B31
IEKTITKKY

SEQ ID NO: 34496 - protein, 9 aa, Borrelia burgdorferi B31
EKTITKKYL

SEQ ID NO: 34497 - protein, 9 aa, Borrelia burgdorferi B31
KTITKKYLT

SEQ ID NO: 34498 - protein, 9 aa, Borrelia burgdorferi B31
TITKKYLTW

SEQ ID NO: 34499 - protein, 9 aa, Borrelia burgdorferi B31
ITKKYLTWF

SEQ ID NO: 34500 - protein, 9 aa, Borrelia burgdorferi B31
TKKYLTWFF

SEQ ID NO: 34501 - protein, 9 aa, Borrelia burgdorferi B31
KKYLTWFFK

SEQ ID NO: 34502 - protein, 9 aa, Borrelia burgdorferi B31
KYLTWFFKD

SEQ ID NO: 34503 - protein, 9 aa, Borrelia burgdorferi B31
YLTWFFKDK

SEQ ID NO: 34504 - protein, 9 aa, Borrelia burgdorferi B31
LTWFFKDKI

SEQ ID NO: 34505 - protein, 9 aa, Borrelia burgdorferi B31
TWFFKDKIS

SEQ ID NO: 34506 - protein, 9 aa, Borrelia burgdorferi B31
WFFKDKISN

SEQ ID NO: 34507 - protein, 9 aa, Borrelia burgdorferi B31
FFKDKISNN

SEQ ID NO: 34508 - protein, 9 aa, Borrelia burgdorferi B31
FKDKISNNW

SEQ ID NO: 34509 - protein, 9 aa, Borrelia burgdorferi B31
KDKISNNWE

SEQ ID NO: 34510 - protein, 9 aa, Borrelia burgdorferi B31
DKISNNWES

SEQ ID NO: 34511 - protein, 9 aa, Borrelia burgdorferi B31
KISNNWESF

SEQ ID NO: 34512 - protein, 9 aa, Borrelia burgdorferi B31
ISNNWESFI

SEQ ID NO: 34513 - protein, 9 aa, Borrelia burgdorferi B31
SNNWESFID

SEQ ID NO: 34514 - protein, 9 aa, Borrelia burgdorferi B31
NNWESFIDA

SEQ ID NO: 34515 - protein, 9 aa, Borrelia burgdorferi B31
NWESFIDAL

SEQ ID NO: 34516 - protein, 9 aa, Borrelia burgdorferi B31
WESFIDALE

SEQ ID NO: 34517 - protein, 9 aa, Borrelia burgdorferi B31
ESFIDALEY

SEQ ID NO: 34518 - protein, 9 aa, Borrelia burgdorferi B31
SFIDALEYI

SEQ ID NO: 34519 - protein, 9 aa, Borrelia burgdorferi B31
FIDALEYIE

SEQ ID NO: 34520 - protein, 9 aa, Borrelia burgdorferi B31
IDALEYIEK

SEQ ID NO: 34521 - protein, 9 aa, Borrelia burgdorferi B31
DALEYIEKH

SEQ ID NO: 34522 - protein, 9 aa, Borrelia burgdorferi B31
ALEYIEKHK

SEQ ID NO: 34523 - protein, 9 aa, Borrelia burgdorferi B31
LEYIEKHKL

SEQ ID NO: 34524 - protein, 9 aa, Borrelia burgdorferi B31
EYIEKHKLI

SEQ ID NO: 34525 - protein, 9 aa, Borrelia burgdorferi B31
YIEKHKLIN

SEQ ID NO: 34526 - protein, 9 aa, Borrelia burgdorferi B31
IEKHKLINI

SEQ ID NO: 34527 - protein, 9 aa, Borrelia burgdorferi B31
EKHKLINIK

SEQ ID NO: 34528 - protein, 9 aa, Borrelia burgdorferi B31
KHKLINIKE

SEQ ID NO: 34529 - protein, 9 aa, Borrelia burgdorferi B31
HKLINIKEK

SEQ ID NO: 34530 - protein, 9 aa, Borrelia burgdorferi B31
KLINIKEKI

SEQ ID NO: 34531 - protein, 9 aa, Borrelia burgdorferi B31
LINIKEKIK

SEQ ID NO: 34532 - protein, 9 aa, Borrelia burgdorferi B31
INIKEKIKE

SEQ ID NO: 34533 - protein, 9 aa, Borrelia burgdorferi B31
NIKEKIKEI

SEQ ID NO: 34534 - protein, 9 aa, Borrelia burgdorferi B31
IKEKIKEII

SEQ ID NO: 34535 - protein, 9 aa, Borrelia burgdorferi B31
KEKIKEIIT

SEQ ID NO: 34536 - protein, 9 aa, Borrelia burgdorferi B31
EKIKEIITA

SEQ ID NO: 34537 - protein, 9 aa, Borrelia burgdorferi B31
KIKEIITAK

SEQ ID NO: 34538 - protein, 9 aa, Borrelia burgdorferi B31
IKEIITAKF

SEQ ID NO: 34539 - protein, 9 aa, Borrelia burgdorferi B31
KEIITAKFQ

SEQ ID NO: 34540 - protein, 9 aa, Borrelia burgdorferi B31
EIITAKFQT

SEQ ID NO: 34541 - protein, 9 aa, Borrelia burgdorferi B31
IITAKFQTE

SEQ ID NO: 34542 - protein, 9 aa, Borrelia burgdorferi B31
ITAKFQTED

SEQ ID NO: 34543 - protein, 9 aa, Borrelia burgdorferi B31
TAKFQTEDF

SEQ ID NO: 34544 - protein, 9 aa, Borrelia burgdorferi B31
AKFQTEDFF

SEQ ID NO: 34545 - protein, 9 aa, Borrelia burgdorferi B31
KFQTEDFFI

SEQ ID NO: 34546 - protein, 9 aa, Borrelia burgdorferi B31
FQTEDFFIS

SEQ ID NO: 34547 - protein, 9 aa, Borrelia burgdorferi B31
QTEDFFISF

SEQ ID NO: 34548 - protein, 9 aa, Borrelia burgdorferi B31
TEDFFISFD

SEQ ID NO: 34549 - protein, 9 aa, Borrelia burgdorferi B31
EDFFISFDK

SEQ ID NO: 34550 - protein, 9 aa, Borrelia burgdorferi B31
DFFISFDKT

SEQ ID NO: 34551 - protein, 9 aa, Borrelia burgdorferi B31
FFISFDKTN

SEQ ID NO: 34552 - protein, 9 aa, Borrelia burgdorferi B31
FISFDKTNF

SEQ ID NO: 34553 - protein, 9 aa, Borrelia burgdorferi B31
ISFDKTNFN

SEQ ID NO: 34554 - protein, 9 aa, Borrelia burgdorferi B31
SFDKTNFNP

SEQ ID NO: 34555 - protein, 9 aa, Borrelia burgdorferi B31
FDKTNFNPY

SEQ ID NO: 34556 - protein, 9 aa, Borrelia burgdorferi B31
DKTNFNPYE

SEQ ID NO: 34557 - protein, 9 aa, Borrelia burgdorferi B31
KTNFNPYES

SEQ ID NO: 34558 - protein, 9 aa, Borrelia burgdorferi B31
TNFNPYESS

SEQ ID NO: 34559 - protein, 9 aa, Borrelia burgdorferi B31
NFNPYESSI

SEQ ID NO: 34560 - protein, 9 aa, Borrelia burgdorferi B31
FNPYESSIF

SEQ ID NO: 34561 - protein, 9 aa, Borrelia burgdorferi B31
NPYESSIFK

SEQ ID NO: 34562 - protein, 9 aa, Borrelia burgdorferi B31
PYESSIFKE

SEQ ID NO: 34563 - protein, 9 aa, Borrelia burgdorferi B31
YESSIFKER

SEQ ID NO: 34564 - protein, 9 aa, Borrelia burgdorferi B31
ESSIFKERY

SEQ ID NO: 34565 - protein, 9 aa, Borrelia burgdorferi B31
SSIFKERYI

SEQ ID NO: 34566 - protein, 9 aa, Borrelia burgdorferi B31
SIFKERYIK

SEQ ID NO: 34567 - protein, 9 aa, Borrelia burgdorferi B31
IFKERYIKS

SEQ ID NO: 34568 - protein, 9 aa, Borrelia burgdorferi B31
FKERYIKSA

SEQ ID NO: 34569 - protein, 9 aa, Borrelia burgdorferi B31
KERYIKSAF

SEQ ID NO: 34570 - protein, 9 aa, Borrelia burgdorferi B31
ERYIKSAFL

SEQ ID NO: 34571 - protein, 9 aa, Borrelia burgdorferi B31
RYIKSAFLE

SEQ ID NO: 34572 - protein, 9 aa, Borrelia burgdorferi B31
YIKSAFLEI

SEQ ID NO: 34573 - protein, 9 aa, Borrelia burgdorferi B31
IKSAFLEII

SEQ ID NO: 34574 - protein, 9 aa, Borrelia burgdorferi B31
KSAFLEIIM

SEQ ID NO: 34575 - protein, 9 aa, Borrelia burgdorferi B31
SAFLEIIMH

SEQ ID NO: 34576 - protein, 9 aa, Borrelia burgdorferi B31
AFLEIIMHY

SEQ ID NO: 34577 - protein, 9 aa, Borrelia burgdorferi B31
FLEIIMHYV

SEQ ID NO: 34578 - protein, 9 aa, Borrelia burgdorferi B31
LEIIMHYVK

SEQ ID NO: 34579 - protein, 9 aa, Borrelia burgdorferi B31
EIIMHYVKK

SEQ ID NO: 34580 - protein, 9 aa, Borrelia burgdorferi B31
IIMHYVKKN

SEQ ID NO: 34581 - protein, 9 aa, Borrelia burgdorferi B31
IMHYVKKNS

SEQ ID NO: 34582 - protein, 9 aa, Borrelia burgdorferi B31
MHYVKKNSQ

SEQ ID NO: 34583 - protein, 9 aa, Borrelia burgdorferi B31
HYVKKNSQN

SEQ ID NO: 34584 - protein, 9 aa, Borrelia burgdorferi B31
YVKKNSQNI

SEQ ID NO: 34585 - protein, 9 aa, Borrelia burgdorferi B31
VKKNSQNIE

SEQ ID NO: 34586 - protein, 9 aa, Borrelia burgdorferi B31
KKNSQNIET

SEQ ID NO: 34587 - protein, 9 aa, Borrelia burgdorferi B31
KNSQNIETY

SEQ ID NO: 34588 - protein, 9 aa, Borrelia burgdorferi B31
NSQNIETYG

SEQ ID NO: 34589 - protein, 9 aa, Borrelia burgdorferi B31
SQNIETYGW

SEQ ID NO: 34590 - protein, 9 aa, Borrelia burgdorferi B31
QNIETYGWI

SEQ ID NO: 34591 - protein, 9 aa, Borrelia burgdorferi B31
NIETYGWIA

SEQ ID NO: 34592 - protein, 9 aa, Borrelia burgdorferi B31
IETYGWIAF

SEQ ID NO: 34593 - protein, 9 aa, Borrelia burgdorferi B31
ETYGWIAFY

SEQ ID NO: 34594 - protein, 9 aa, Borrelia burgdorferi B31
TYGWIAFYI

SEQ ID NO: 34595 - protein, 9 aa, Borrelia burgdorferi B31
YGWIAFYIY

SEQ ID NO: 34596 - protein, 9 aa, Borrelia burgdorferi B31
GWIAFYIYA

SEQ ID NO: 34597 - protein, 9 aa, Borrelia burgdorferi B31
WIAFYIYAD

SEQ ID NO: 34598 - protein, 9 aa, Borrelia burgdorferi B31
IAFYIYADN

SEQ ID NO: 34599 - protein, 9 aa, Borrelia burgdorferi B31
AFYIYADNK

SEQ ID NO: 34600 - protein, 9 aa, Borrelia burgdorferi B31
FYIYADNKD

SEQ ID NO: 34601 - protein, 9 aa, Borrelia burgdorferi B31
YIYADNKDK

SEQ ID NO: 34602 - protein, 9 aa, Borrelia burgdorferi B31
IYADNKDKK

SEQ ID NO: 34603 - protein, 9 aa, Borrelia burgdorferi B31
YADNKDKKI

SEQ ID NO: 34604 - protein, 9 aa, Borrelia burgdorferi B31
ADNKDKKIF

SEQ ID NO: 34605 - protein, 9 aa, Borrelia burgdorferi B31
DNKDKKIFC

SEQ ID NO: 34606 - protein, 9 aa, Borrelia burgdorferi B31
NKDKKIFCQ

SEQ ID NO: 34607 - protein, 9 aa, Borrelia burgdorferi B31
KDKKIFCQR

SEQ ID NO: 34608 - protein, 9 aa, Borrelia burgdorferi B31
DKKIFCQRM

SEQ ID NO: 34609 - protein, 9 aa, Borrelia burgdorferi B31
KKIFCQRMK

SEQ ID NO: 34610 - protein, 9 aa, Borrelia burgdorferi B31
KIFCQRMKE

SEQ ID NO: 34611 - protein, 9 aa, Borrelia burgdorferi B31
IFCQRMKEF

SEQ ID NO: 34612 - protein, 9 aa, Borrelia burgdorferi B31
FCQRMKEFF

SEQ ID NO: 34613 - protein, 9 aa, Borrelia burgdorferi B31
CQRMKEFFK

SEQ ID NO: 34614 - protein, 9 aa, Borrelia burgdorferi B31
QRMKEFFKS

SEQ ID NO: 34615 - protein, 9 aa, Borrelia burgdorferi B31
RMKEFFKSK

SEQ ID NO: 34616 - protein, 9 aa, Borrelia burgdorferi B31
MKEFFKSKT

SEQ ID NO: 34617 - protein, 9 aa, Borrelia burgdorferi B31
KEFFKSKTF

SEQ ID NO: 34618 - protein, 9 aa, Borrelia burgdorferi B31
EFFKSKTFE

SEQ ID NO: 34619 - protein, 9 aa, Borrelia burgdorferi B31
FFKSKTFEI

SEQ ID NO: 34620 - protein, 9 aa, Borrelia burgdorferi B31
FKSKTFEIQ

SEQ ID NO: 34621 - protein, 9 aa, Borrelia burgdorferi B31
KSKTFEIQN

SEQ ID NO: 34622 - protein, 9 aa, Borrelia burgdorferi B31
SKTFEIQNQ

SEQ ID NO: 34623 - protein, 9 aa, Borrelia burgdorferi B31
KTFEIQNQI

SEQ ID NO: 34624 - protein, 9 aa, Borrelia burgdorferi B31
TFEIQNQIF

SEQ ID NO: 34625 - protein, 9 aa, Borrelia burgdorferi B31
FEIQNQIFV

SEQ ID NO: 34626 - protein, 9 aa, Borrelia burgdorferi B31
EIQNQIFVY

SEQ ID NO: 34627 - protein, 9 aa, Borrelia burgdorferi B31
IQNQIFVYF

SEQ ID NO: 34628 - protein, 9 aa, Borrelia burgdorferi B31
QNQIFVYFL

SEQ ID NO: 34629 - protein, 9 aa, Borrelia burgdorferi B31
NQIFVYFLS

SEQ ID NO: 34630 - protein, 9 aa, Borrelia burgdorferi B31
QIFVYFLSF

SEQ ID NO: 34631 - protein, 9 aa, Borrelia burgdorferi B31
IFVYFLSFY

SEQ ID NO: 34632 - protein, 9 aa, Borrelia burgdorferi B31
FVYFLSFYP

SEQ ID NO: 34633 - protein, 9 aa, Borrelia burgdorferi B31
VYFLSFYPN

SEQ ID NO: 34634 - protein, 9 aa, Borrelia burgdorferi B31
YFLSFYPNI

SEQ ID NO: 34635 - protein, 9 aa, Borrelia burgdorferi B31
FLSFYPNIE

SEQ ID NO: 34636 - protein, 9 aa, Borrelia burgdorferi B31
LSFYPNIEY

SEQ ID NO: 34637 - protein, 9 aa, Borrelia burgdorferi B31
SFYPNIEYK

SEQ ID NO: 34638 - protein, 9 aa, Borrelia burgdorferi B31
FYPNIEYKH

SEQ ID NO: 34639 - protein, 9 aa, Borrelia burgdorferi B31
YPNIEYKHF

SEQ ID NO: 34640 - protein, 9 aa, Borrelia burgdorferi B31
PNIEYKHFK

SEQ ID NO: 34641 - protein, 9 aa, Borrelia burgdorferi B31
NIEYKHFKF

SEQ ID NO: 34642 - protein, 9 aa, Borrelia burgdorferi B31
IEYKHFKFI

SEQ ID NO: 34643 - protein, 9 aa, Borrelia burgdorferi B31
EYKHFKFIS

SEQ ID NO: 34644 - protein, 9 aa, Borrelia burgdorferi B31
YKHFKFISD

SEQ ID NO: 34645 - protein, 9 aa, Borrelia burgdorferi B31
KHFKFISDI

SEQ ID NO: 34646 - protein, 9 aa, Borrelia burgdorferi B31
HFKFISDIL

SEQ ID NO: 34647 - protein, 9 aa, Borrelia burgdorferi B31
FKFISDILL

SEQ ID NO: 34648 - protein, 9 aa, Borrelia burgdorferi B31
KFISDILLY

SEQ ID NO: 34649 - protein, 9 aa, Borrelia burgdorferi B31
FISDILLYL

SEQ ID NO: 34650 - protein, 9 aa, Borrelia burgdorferi B31
ISDILLYLD

SEQ ID NO: 34651 - protein, 9 aa, Borrelia burgdorferi B31
SDILLYLDE

SEQ ID NO: 34652 - protein, 9 aa, Borrelia burgdorferi B31
DILLYLDEN

SEQ ID NO: 34653 - protein, 9 aa, Borrelia burgdorferi B31
ILLYLDENK

SEQ ID NO: 34654 - protein, 9 aa, Borrelia burgdorferi B31
LLYLDENKI

SEQ ID NO: 34655 - protein, 9 aa, Borrelia burgdorferi B31
LYLDENKIT

SEQ ID NO: 34656 - protein, 9 aa, Borrelia burgdorferi B31
YLDENKITI

SEQ ID NO: 34657 - protein, 9 aa, Borrelia burgdorferi B31
LDENKITIP

SEQ ID NO: 34658 - protein, 9 aa, Borrelia burgdorferi B31
DENKITIPK

SEQ ID NO: 34659 - protein, 9 aa, Borrelia burgdorferi B31
ENKITIPKK

SEQ ID NO: 34660 - protein, 9 aa, Borrelia burgdorferi B31
NKITIPKKI

SEQ ID NO: 34661 - protein, 9 aa, Borrelia burgdorferi B31
KITIPKKII

SEQ ID NO: 34662 - protein, 9 aa, Borrelia burgdorferi B31
ITIPKKIIK

SEQ ID NO: 34663 - protein, 9 aa, Borrelia burgdorferi B31
TIPKKIIKI

SEQ ID NO: 34664 - protein, 9 aa, Borrelia burgdorferi B31
IPKKIIKIQ

SEQ ID NO: 34665 - protein, 9 aa, Borrelia burgdorferi B31
PKKIIKIQK

SEQ ID NO: 34666 - protein, 9 aa, Borrelia burgdorferi B31
KKIIKIQKI

SEQ ID NO: 34667 - protein, 9 aa, Borrelia burgdorferi B31
KIIKIQKIN

SEQ ID NO: 34668 - protein, 9 aa, Borrelia burgdorferi B31
IIKIQKINP

SEQ ID NO: 34669 - protein, 9 aa, Borrelia burgdorferi B31
IKIQKINPN

SEQ ID NO: 34670 - protein, 9 aa, Borrelia burgdorferi B31
KIQKINPNQ

SEQ ID NO: 34671 - protein, 9 aa, Borrelia burgdorferi B31
IQKINPNQL

SEQ ID NO: 34672 - protein, 9 aa, Borrelia burgdorferi B31
QKINPNQLD

SEQ ID NO: 34673 - protein, 9 aa, Borrelia burgdorferi B31
KINPNQLDY

SEQ ID NO: 34674 - protein, 9 aa, Borrelia burgdorferi B31
INPNQLDYQ

SEQ ID NO: 34675 - protein, 9 aa, Borrelia burgdorferi B31
NPNQLDYQK

SEQ ID NO: 34676 - protein, 9 aa, Borrelia burgdorferi B31
PNQLDYQKS

SEQ ID NO: 34677 - protein, 9 aa, Borrelia burgdorferi B31
NQLDYQKSY

SEQ ID NO: 34678 - protein, 9 aa, Borrelia burgdorferi B31
QLDYQKSYL

SEQ ID NO: 34679 - protein, 9 aa, Borrelia burgdorferi B31
LDYQKSYLL

SEQ ID NO: 34680 - protein, 9 aa, Borrelia burgdorferi B31
DYQKSYLLI

SEQ ID NO: 34681 - protein, 9 aa, Borrelia burgdorferi B31
YQKSYLLIK

SEQ ID NO: 34682 - protein, 9 aa, Borrelia burgdorferi B31
QKSYLLIKS

SEQ ID NO: 34683 - protein, 9 aa, Borrelia burgdorferi B31
KSYLLIKSL

SEQ ID NO: 34684 - protein, 9 aa, Borrelia burgdorferi B31
SYLLIKSLK

SEQ ID NO: 34685 - protein, 9 aa, Borrelia burgdorferi B31
YLLIKSLKT

SEQ ID NO: 34686 - protein, 9 aa, Borrelia burgdorferi B31
LLIKSLKTR

SEQ ID NO: 34687 - protein, 9 aa, Borrelia burgdorferi B31
LIKSLKTRS

SEQ ID NO: 34688 - protein, 9 aa, Borrelia burgdorferi B31
IKSLKTRSR

SEQ ID NO: 34689 - protein, 9 aa, Borrelia burgdorferi B31
KSLKTRSRI

SEQ ID NO: 34690 - protein, 9 aa, Borrelia burgdorferi B31
SLKTRSRIL

SEQ ID NO: 34691 - protein, 9 aa, Borrelia burgdorferi B31
LKTRSRILK

SEQ ID NO: 34692 - protein, 9 aa, Borrelia burgdorferi B31
KTRSRILKI

SEQ ID NO: 34693 - protein, 9 aa, Borrelia burgdorferi B31
TRSRILKII

SEQ ID NO: 34694 - protein, 9 aa, Borrelia burgdorferi B31
RSRILKIII

SEQ ID NO: 34695 - protein, 9 aa, Borrelia burgdorferi B31
SRILKIIIK

SEQ ID NO: 34696 - protein, 9 aa, Borrelia burgdorferi B31
RILKIIIKN

SEQ ID NO: 34697 - protein, 9 aa, Borrelia burgdorferi B31
ILKIIIKNI

SEQ ID NO: 34698 - protein, 9 aa, Borrelia burgdorferi B31
LKIIIKNIR

SEQ ID NO: 34699 - protein, 9 aa, Borrelia burgdorferi B31
KIIIKNIRF

SEQ ID NO: 34700 - protein, 9 aa, Borrelia burgdorferi B31
IIIKNIRFN

SEQ ID NO: 34701 - protein, 9 aa, Borrelia burgdorferi B31
IIKNIRFNL

SEQ ID NO: 34702 - protein, 9 aa, Borrelia burgdorferi B31
IKNIRFNLI

SEQ ID NO: 34703 - protein, 9 aa, Borrelia burgdorferi B31
KNIRFNLIE

SEQ ID NO: 34704 - protein, 9 aa, Borrelia burgdorferi B31
NIRFNLIEK

SEQ ID NO: 34705 - protein, 9 aa, Borrelia burgdorferi B31
IRFNLIEKL

SEQ ID NO: 34706 - protein, 9 aa, Borrelia burgdorferi B31
RFNLIEKLE

SEQ ID NO: 34707 - protein, 9 aa, Borrelia burgdorferi B31
FNLIEKLED

SEQ ID NO: 34708 - protein, 9 aa, Borrelia burgdorferi B31
NLIEKLEDE

SEQ ID NO: 34709 - protein, 9 aa, Borrelia burgdorferi B31
LIEKLEDEN

SEQ ID NO: 34710 - protein, 9 aa, Borrelia burgdorferi B31
IEKLEDENE

SEQ ID NO: 34711 - protein, 9 aa, Borrelia burgdorferi B31
EKLEDENEK

SEQ ID NO: 34712 - protein, 9 aa, Borrelia burgdorferi B31
KLEDENEKK

SEQ ID NO: 34713 - protein, 9 aa, Borrelia burgdorferi B31
LEDENEKKL

SEQ ID NO: 34714 - protein, 9 aa, Borrelia burgdorferi B31
EDENEKKLL

SEQ ID NO: 34715 - protein, 9 aa, Borrelia burgdorferi B31
DENEKKLLP

SEQ ID NO: 34716 - protein, 9 aa, Borrelia burgdorferi B31
ENEKKLLPA

SEQ ID NO: 34717 - protein, 9 aa, Borrelia burgdorferi B31
NEKKLLPAM

SEQ ID NO: 34718 - protein, 9 aa, Borrelia burgdorferi B31
EKKLLPAMC

SEQ ID NO: 34719 - protein, 9 aa, Borrelia burgdorferi B31
KKLLPAMCY

SEQ ID NO: 34720 - protein, 9 aa, Borrelia burgdorferi B31
KLLPAMCYL

SEQ ID NO: 34721 - protein, 9 aa, Borrelia burgdorferi B31
LLPAMCYLI

SEQ ID NO: 34722 - protein, 9 aa, Borrelia burgdorferi B31
LPAMCYLIY

SEQ ID NO: 34723 - protein, 9 aa, Borrelia burgdorferi B31
PAMCYLIYC

SEQ ID NO: 34724 - protein, 9 aa, Borrelia burgdorferi B31
AMCYLIYCE

SEQ ID NO: 34725 - protein, 9 aa, Borrelia burgdorferi B31
MCYLIYCEN

SEQ ID NO: 34726 - protein, 9 aa, Borrelia burgdorferi B31
CYLIYCENL

SEQ ID NO: 34727 - protein, 9 aa, Borrelia burgdorferi B31
YLIYCENLV

SEQ ID NO: 34728 - protein, 9 aa, Borrelia burgdorferi B31
LIYCENLVE

SEQ ID NO: 34729 - protein, 9 aa, Borrelia burgdorferi B31
IYCENLVEL

SEQ ID NO: 34730 - protein, 9 aa, Borrelia burgdorferi B31
YCENLVELK

SEQ ID NO: 34731 - protein, 9 aa, Borrelia burgdorferi B31
CENLVELKN

SEQ ID NO: 34732 - protein, 9 aa, Borrelia burgdorferi B31
ENLVELKNN

SEQ ID NO: 34733 - protein, 9 aa, Borrelia burgdorferi B31
NLVELKNNR

SEQ ID NO: 34734 - protein, 9 aa, Borrelia burgdorferi B31
LVELKNNRK

SEQ ID NO: 34735 - protein, 9 aa, Borrelia burgdorferi B31
VELKNNRKI

SEQ ID NO: 34736 - protein, 9 aa, Borrelia burgdorferi B31
ELKNNRKIK

SEQ ID NO: 34737 - protein, 9 aa, Borrelia burgdorferi B31
LKNNRKIKS

SEQ ID NO: 34738 - protein, 9 aa, Borrelia burgdorferi B31
KNNRKIKSN

SEQ ID NO: 34739 - protein, 9 aa, Borrelia burgdorferi B31
NNRKIKSNE

SEQ ID NO: 34740 - protein, 9 aa, Borrelia burgdorferi B31
NRKIKSNEK

SEQ ID NO: 34741 - protein, 9 aa, Borrelia burgdorferi B31
RKIKSNEKN

SEQ ID NO: 34742 - protein, 9 aa, Borrelia burgdorferi B31
KIKSNEKNS

SEQ ID NO: 34743 - protein, 9 aa, Borrelia burgdorferi B31
IKSNEKNSL

SEQ ID NO: 34744 - protein, 9 aa, Borrelia burgdorferi B31
KSNEKNSLL

SEQ ID NO: 34745 - protein, 9 aa, Borrelia burgdorferi B31
SNEKNSLLE

SEQ ID NO: 34746 - protein, 9 aa, Borrelia burgdorferi B31
NEKNSLLEF

SEQ ID NO: 34747 - protein, 9 aa, Borrelia burgdorferi B31
EKNSLLEFI

SEQ ID NO: 34748 - protein, 9 aa, Borrelia burgdorferi B31
KNSLLEFIS

SEQ ID NO: 34749 - protein, 9 aa, Borrelia burgdorferi B31
NSLLEFISF

SEQ ID NO: 34750 - protein, 9 aa, Borrelia burgdorferi B31
SLLEFISFF

SEQ ID NO: 34751 - protein, 9 aa, Borrelia burgdorferi B31
LLEFISFFK

SEQ ID NO: 34752 - protein, 9 aa, Borrelia burgdorferi B31
LEFISFFKT

SEQ ID NO: 34753 - protein, 9 aa, Borrelia burgdorferi B31
EFISFFKTK

SEQ ID NO: 34754 - protein, 9 aa, Borrelia burgdorferi B31
FISFFKTKL

SEQ ID NO: 34755 - protein, 9 aa, Borrelia burgdorferi B31
ISFFKTKLK

SEQ ID NO: 34756 - protein, 9 aa, Borrelia burgdorferi B31
SFFKTKLKQ

SEQ ID NO: 34757 - protein, 9 aa, Borrelia burgdorferi B31
FFKTKLKQK

SEQ ID NO: 34758 - protein, 9 aa, Borrelia burgdorferi B31
FKTKLKQKI

SEQ ID NO: 34759 - protein, 9 aa, Borrelia burgdorferi B31
KTKLKQKIN

SEQ ID NO: 34760 - protein, 9 aa, Borrelia burgdorferi B31
TKLKQKINF

SEQ ID NO: 34761 - protein, 9 aa, Borrelia burgdorferi B31
KLKQKINFK

SEQ ID NO: 34762 - protein, 9 aa, Borrelia burgdorferi B31
LKQKINFKK

SEQ ID NO: 34763 - protein, 9 aa, Borrelia burgdorferi B31
KQKINFKKE

SEQ ID NO: 34764 - protein, 9 aa, Borrelia burgdorferi B31
QKINFKKEL

SEQ ID NO: 34765 - protein, 9 aa, Borrelia burgdorferi B31
KINFKKELM

SEQ ID NO: 34766 - protein, 9 aa, Borrelia burgdorferi B31
INFKKELMK

SEQ ID NO: 34767 - protein, 9 aa, Borrelia burgdorferi B31
NFKKELMKS

SEQ ID NO: 34768 - protein, 9 aa, Borrelia burgdorferi B31
FKKELMKSK

SEQ ID NO: 34769 - protein, 9 aa, Borrelia burgdorferi B31
KKELMKSKG

SEQ ID NO: 34770 - protein, 9 aa, Borrelia burgdorferi B31
KELMKSKGI

SEQ ID NO: 34771 - protein, 10 aa, Borrelia burgdorferi B31
MKTIKKDSEF

SEQ ID NO: 34772 - protein, 10 aa, Borrelia burgdorferi B31
KTIKKDSEFY

SEQ ID NO: 34773 - protein, 10 aa, Borrelia burgdorferi B31
TIKKDSEFYD

SEQ ID NO: 34774 - protein, 10 aa, Borrelia burgdorferi B31
IKKDSEFYDS

SEQ ID NO: 34775 - protein, 10 aa, Borrelia burgdorferi B31
KKDSEFYDSL

SEQ ID NO: 34776 - protein, 10 aa, Borrelia burgdorferi B31
KDSEFYDSLA

SEQ ID NO: 34777 - protein, 10 aa, Borrelia burgdorferi B31
DSEFYDSLAT

SEQ ID NO: 34778 - protein, 10 aa, Borrelia burgdorferi B31
SEFYDSLATL

SEQ ID NO: 34779 - protein, 10 aa, Borrelia burgdorferi B31
EFYDSLATLK

SEQ ID NO: 34780 - protein, 10 aa, Borrelia burgdorferi B31
FYDSLATLKK

SEQ ID NO: 34781 - protein, 10 aa, Borrelia burgdorferi B31
YDSLATLKKH

SEQ ID NO: 34782 - protein, 10 aa, Borrelia burgdorferi B31
DSLATLKKHI

SEQ ID NO: 34783 - protein, 10 aa, Borrelia burgdorferi B31
SLATLKKHIN

SEQ ID NO: 34784 - protein, 10 aa, Borrelia burgdorferi B31
LATLKKHINK

SEQ ID NO: 34785 - protein, 10 aa, Borrelia burgdorferi B31
ATLKKHINKY

SEQ ID NO: 34786 - protein, 10 aa, Borrelia burgdorferi B31
TLKKHINKYI

SEQ ID NO: 34787 - protein, 10 aa, Borrelia burgdorferi B31
LKKHINKYIE

SEQ ID NO: 34788 - protein, 10 aa, Borrelia burgdorferi B31
KKHINKYIEE

SEQ ID NO: 34789 - protein, 10 aa, Borrelia burgdorferi B31
KHINKYIEEK

SEQ ID NO: 34790 - protein, 10 aa, Borrelia burgdorferi B31
HINKYIEEKV

SEQ ID NO: 34791 - protein, 10 aa, Borrelia burgdorferi B31
INKYIEEKVL

SEQ ID NO: 34792 - protein, 10 aa, Borrelia burgdorferi B31
NKYIEEKVLK

SEQ ID NO: 34793 - protein, 10 aa, Borrelia burgdorferi B31
KYIEEKVLKY

SEQ ID NO: 34794 - protein, 10 aa, Borrelia burgdorferi B31
YIEEKVLKYS

SEQ ID NO: 34795 - protein, 10 aa, Borrelia burgdorferi B31
IEEKVLKYSI

SEQ ID NO: 34796 - protein, 10 aa, Borrelia burgdorferi B31
EEKVLKYSIS

SEQ ID NO: 34797 - protein, 10 aa, Borrelia burgdorferi B31
EKVLKYSISS

SEQ ID NO: 34798 - protein, 10 aa, Borrelia burgdorferi B31
KVLKYSISSQ

SEQ ID NO: 34799 - protein, 10 aa, Borrelia burgdorferi B31
VLKYSISSQL

SEQ ID NO: 34800 - protein, 10 aa, Borrelia burgdorferi B31
LKYSISSQLY

SEQ ID NO: 34801 - protein, 10 aa, Borrelia burgdorferi B31
KYSISSQLYK

SEQ ID NO: 34802 - protein, 10 aa, Borrelia burgdorferi B31
YSISSQLYKL

SEQ ID NO: 34803 - protein, 10 aa, Borrelia burgdorferi B31
SISSQLYKLE

SEQ ID NO: 34804 - protein, 10 aa, Borrelia burgdorferi B31
ISSQLYKLEK

SEQ ID NO: 34805 - protein, 10 aa, Borrelia burgdorferi B31
SSQLYKLEKP

SEQ ID NO: 34806 - protein, 10 aa, Borrelia burgdorferi B31
SQLYKLEKPE

SEQ ID NO: 34807 - protein, 10 aa, Borrelia burgdorferi B31
QLYKLEKPEI

SEQ ID NO: 34808 - protein, 10 aa, Borrelia burgdorferi B31
LYKLEKPEII

SEQ ID NO: 34809 - protein, 10 aa, Borrelia burgdorferi B31
YKLEKPEIIE

SEQ ID NO: 34810 - protein, 10 aa, Borrelia burgdorferi B31
KLEKPEIIEL

SEQ ID NO: 34811 - protein, 10 aa, Borrelia burgdorferi B31
LEKPEIIELI

SEQ ID NO: 34812 - protein, 10 aa, Borrelia burgdorferi B31
EKPEIIELIK

SEQ ID NO: 34813 - protein, 10 aa, Borrelia burgdorferi B31
KPEIIELIKI

SEQ ID NO: 34814 - protein, 10 aa, Borrelia burgdorferi B31
PEIIELIKIS

SEQ ID NO: 34815 - protein, 10 aa, Borrelia burgdorferi B31
EIIELIKISN

SEQ ID NO: 34816 - protein, 10 aa, Borrelia burgdorferi B31
IIELIKISND

SEQ ID NO: 34817 - protein, 10 aa, Borrelia burgdorferi B31
IELIKISNDY

SEQ ID NO: 34818 - protein, 10 aa, Borrelia burgdorferi B31
ELIKISNDYE

SEQ ID NO: 34819 - protein, 10 aa, Borrelia burgdorferi B31
LIKISNDYEK

SEQ ID NO: 34820 - protein, 10 aa, Borrelia burgdorferi B31
IKISNDYEKE

SEQ ID NO: 34821 - protein, 10 aa, Borrelia burgdorferi B31
KISNDYEKEK

SEQ ID NO: 34822 - protein, 10 aa, Borrelia burgdorferi B31
ISNDYEKEKN

SEQ ID NO: 34823 - protein, 10 aa, Borrelia burgdorferi B31
SNDYEKEKNA

SEQ ID NO: 34824 - protein, 10 aa, Borrelia burgdorferi B31
NDYEKEKNAF

SEQ ID NO: 34825 - protein, 10 aa, Borrelia burgdorferi B31
DYEKEKNAFN

SEQ ID NO: 34826 - protein, 10 aa, Borrelia burgdorferi B31
YEKEKNAFNT

SEQ ID NO: 34827 - protein, 10 aa, Borrelia burgdorferi B31
EKEKNAFNTS

SEQ ID NO: 34828 - protein, 10 aa, Borrelia burgdorferi B31
KEKNAFNTSL

SEQ ID NO: 34829 - protein, 10 aa, Borrelia burgdorferi B31
EKNAFNTSLE

SEQ ID NO: 34830 - protein, 10 aa, Borrelia burgdorferi B31
KNAFNTSLEE

SEQ ID NO: 34831 - protein, 10 aa, Borrelia burgdorferi B31
NAFNTSLEEC

SEQ ID NO: 34832 - protein, 10 aa, Borrelia burgdorferi B31
AFNTSLEECY

SEQ ID NO: 34833 - protein, 10 aa, Borrelia burgdorferi B31
FNTSLEECYY

SEQ ID NO: 34834 - protein, 10 aa, Borrelia burgdorferi B31
NTSLEECYYK

SEQ ID NO: 34835 - protein, 10 aa, Borrelia burgdorferi B31
TSLEECYYKN

SEQ ID NO: 34836 - protein, 10 aa, Borrelia burgdorferi B31
SLEECYYKNT

SEQ ID NO: 34837 - protein, 10 aa, Borrelia burgdorferi B31
LEECYYKNTQ

SEQ ID NO: 34838 - protein, 10 aa, Borrelia burgdorferi B31
EECYYKNTQN

SEQ ID NO: 34839 - protein, 10 aa, Borrelia burgdorferi B31
ECYYKNTQNE

SEQ ID NO: 34840 - protein, 10 aa, Borrelia burgdorferi B31
CYYKNTQNEA

SEQ ID NO: 34841 - protein, 10 aa, Borrelia burgdorferi B31
YYKNTQNEAI

SEQ ID NO: 34842 - protein, 10 aa, Borrelia burgdorferi B31
YKNTQNEAIK

SEQ ID NO: 34843 - protein, 10 aa, Borrelia burgdorferi B31
KNTQNEAIKK

SEQ ID NO: 34844 - protein, 10 aa, Borrelia burgdorferi B31
NTQNEAIKKW

SEQ ID NO: 34845 - protein, 10 aa, Borrelia burgdorferi B31
TQNEAIKKWI

SEQ ID NO: 34846 - protein, 10 aa, Borrelia burgdorferi B31
QNEAIKKWIL

SEQ ID NO: 34847 - protein, 10 aa, Borrelia burgdorferi B31
NEAIKKWILE

SEQ ID NO: 34848 - protein, 10 aa, Borrelia burgdorferi B31
EAIKKWILEI

SEQ ID NO: 34849 - protein, 10 aa, Borrelia burgdorferi B31
AIKKWILEIV

SEQ ID NO: 34850 - protein, 10 aa, Borrelia burgdorferi B31
IKKWILEIVR

SEQ ID NO: 34851 - protein, 10 aa, Borrelia burgdorferi B31
KKWILEIVRN

SEQ ID NO: 34852 - protein, 10 aa, Borrelia burgdorferi B31
KWILEIVRNK

SEQ ID NO: 34853 - protein, 10 aa, Borrelia burgdorferi B31
WILEIVRNKN

SEQ ID NO: 34854 - protein, 10 aa, Borrelia burgdorferi B31
ILEIVRNKNF

SEQ ID NO: 34855 - protein, 10 aa, Borrelia burgdorferi B31
LEIVRNKNFI

SEQ ID NO: 34856 - protein, 10 aa, Borrelia burgdorferi B31
EIVRNKNFIQ

SEQ ID NO: 34857 - protein, 10 aa, Borrelia burgdorferi B31
IVRNKNFIQI

SEQ ID NO: 34858 - protein, 10 aa, Borrelia burgdorferi B31
VRNKNFIQIS

SEQ ID NO: 34859 - protein, 10 aa, Borrelia burgdorferi B31
RNKNFIQISK

SEQ ID NO: 34860 - protein, 10 aa, Borrelia burgdorferi B31
NKNFIQISKE

SEQ ID NO: 34861 - protein, 10 aa, Borrelia burgdorferi B31
KNFIQISKEA

SEQ ID NO: 34862 - protein, 10 aa, Borrelia burgdorferi B31
NFIQISKEAN

SEQ ID NO: 34863 - protein, 10 aa, Borrelia burgdorferi B31
FIQISKEANL

SEQ ID NO: 34864 - protein, 10 aa, Borrelia burgdorferi B31
IQISKEANLN

SEQ ID NO: 34865 - protein, 10 aa, Borrelia burgdorferi B31
QISKEANLNT

SEQ ID NO: 34866 - protein, 10 aa, Borrelia burgdorferi B31
ISKEANLNTK

SEQ ID NO: 34867 - protein, 10 aa, Borrelia burgdorferi B31
SKEANLNTKK

SEQ ID NO: 34868 - protein, 10 aa, Borrelia burgdorferi B31
KEANLNTKKL

SEQ ID NO: 34869 - protein, 10 aa, Borrelia burgdorferi B31
EANLNTKKLG

SEQ ID NO: 34870 - protein, 10 aa, Borrelia burgdorferi B31
ANLNTKKLGT

SEQ ID NO: 34871 - protein, 10 aa, Borrelia burgdorferi B31
NLNTKKLGTT

SEQ ID NO: 34872 - protein, 10 aa, Borrelia burgdorferi B31
LNTKKLGTTY

SEQ ID NO: 34873 - protein, 10 aa, Borrelia burgdorferi B31
NTKKLGTTYK

SEQ ID NO: 34874 - protein, 10 aa, Borrelia burgdorferi B31
TKKLGTTYKL

SEQ ID NO: 34875 - protein, 10 aa, Borrelia burgdorferi B31
KKLGTTYKLK

SEQ ID NO: 34876 - protein, 10 aa, Borrelia burgdorferi B31
KLGTTYKLKS

SEQ ID NO: 34877 - protein, 10 aa, Borrelia burgdorferi B31
LGTTYKLKSS

SEQ ID NO: 34878 - protein, 10 aa, Borrelia burgdorferi B31
GTTYKLKSSN

SEQ ID NO: 34879 - protein, 10 aa, Borrelia burgdorferi B31
TTYKLKSSNF

SEQ ID NO: 34880 - protein, 10 aa, Borrelia burgdorferi B31
TYKLKSSNFL

SEQ ID NO: 34881 - protein, 10 aa, Borrelia burgdorferi B31
YKLKSSNFLK

SEQ ID NO: 34882 - protein, 10 aa, Borrelia burgdorferi B31
KLKSSNFLKL

SEQ ID NO: 34883 - protein, 10 aa, Borrelia burgdorferi B31
LKSSNFLKLI

SEQ ID NO: 34884 - protein, 10 aa, Borrelia burgdorferi B31
KSSNFLKLIE

SEQ ID NO: 34885 - protein, 10 aa, Borrelia burgdorferi B31
SSNFLKLIEI

SEQ ID NO: 34886 - protein, 10 aa, Borrelia burgdorferi B31
SNFLKLIEIQ

SEQ ID NO: 34887 - protein, 10 aa, Borrelia burgdorferi B31
NFLKLIEIQN

SEQ ID NO: 34888 - protein, 10 aa, Borrelia burgdorferi B31
FLKLIEIQNS

SEQ ID NO: 34889 - protein, 10 aa, Borrelia burgdorferi B31
LKLIEIQNSP

SEQ ID NO: 34890 - protein, 10 aa, Borrelia burgdorferi B31
KLIEIQNSPY

SEQ ID NO: 34891 - protein, 10 aa, Borrelia burgdorferi B31
LIEIQNSPYY

SEQ ID NO: 34892 - protein, 10 aa, Borrelia burgdorferi B31
IEIQNSPYYS

SEQ ID NO: 34893 - protein, 10 aa, Borrelia burgdorferi B31
EIQNSPYYSQ

SEQ ID NO: 34894 - protein, 10 aa, Borrelia burgdorferi B31
IQNSPYYSQE

SEQ ID NO: 34895 - protein, 10 aa, Borrelia burgdorferi B31
QNSPYYSQEK

SEQ ID NO: 34896 - protein, 10 aa, Borrelia burgdorferi B31
NSPYYSQEKK

SEQ ID NO: 34897 - protein, 10 aa, Borrelia burgdorferi B31
SPYYSQEKKD

SEQ ID NO: 34898 - protein, 10 aa, Borrelia burgdorferi B31
PYYSQEKKDI

SEQ ID NO: 34899 - protein, 10 aa, Borrelia burgdorferi B31
YYSQEKKDIY

SEQ ID NO: 34900 - protein, 10 aa, Borrelia burgdorferi B31
YSQEKKDIYK

SEQ ID NO: 34901 - protein, 10 aa, Borrelia burgdorferi B31
SQEKKDIYKQ

SEQ ID NO: 34902 - protein, 10 aa, Borrelia burgdorferi B31
QEKKDIYKQI

SEQ ID NO: 34903 - protein, 10 aa, Borrelia burgdorferi B31
EKKDIYKQII

SEQ ID NO: 34904 - protein, 10 aa, Borrelia burgdorferi B31
KKDIYKQIIL

SEQ ID NO: 34905 - protein, 10 aa, Borrelia burgdorferi B31
KDIYKQIILN

SEQ ID NO: 34906 - protein, 10 aa, Borrelia burgdorferi B31
DIYKQIILNF

SEQ ID NO: 34907 - protein, 10 aa, Borrelia burgdorferi B31
IYKQIILNFS

SEQ ID NO: 34908 - protein, 10 aa, Borrelia burgdorferi B31
YKQIILNFSS

SEQ ID NO: 34909 - protein, 10 aa, Borrelia burgdorferi B31
KQIILNFSSN

SEQ ID NO: 34910 - protein, 10 aa, Borrelia burgdorferi B31
QIILNFSSNI

SEQ ID NO: 34911 - protein, 10 aa, Borrelia burgdorferi B31
IILNFSSNIN

SEQ ID NO: 34912 - protein, 10 aa, Borrelia burgdorferi B31
ILNFSSNINI

SEQ ID NO: 34913 - protein, 10 aa, Borrelia burgdorferi B31
LNFSSNINID

SEQ ID NO: 34914 - protein, 10 aa, Borrelia burgdorferi B31
NFSSNINIDS

SEQ ID NO: 34915 - protein, 10 aa, Borrelia burgdorferi B31
FSSNINIDSL

SEQ ID NO: 34916 - protein, 10 aa, Borrelia burgdorferi B31
SSNINIDSLE

SEQ ID NO: 34917 - protein, 10 aa, Borrelia burgdorferi B31
SNINIDSLEQ

SEQ ID NO: 34918 - protein, 10 aa, Borrelia burgdorferi B31
NINIDSLEQT

SEQ ID NO: 34919 - protein, 10 aa, Borrelia burgdorferi B31
INIDSLEQTI

SEQ ID NO: 34920 - protein, 10 aa, Borrelia burgdorferi B31
NIDSLEQTID

SEQ ID NO: 34921 - protein, 10 aa, Borrelia burgdorferi B31
IDSLEQTIDI

SEQ ID NO: 34922 - protein, 10 aa, Borrelia burgdorferi B31
DSLEQTIDIL

SEQ ID NO: 34923 - protein, 10 aa, Borrelia burgdorferi B31
SLEQTIDILV

SEQ ID NO: 34924 - protein, 10 aa, Borrelia burgdorferi B31
LEQTIDILVA

SEQ ID NO: 34925 - protein, 10 aa, Borrelia burgdorferi B31
EQTIDILVAV

SEQ ID NO: 34926 - protein, 10 aa, Borrelia burgdorferi B31
QTIDILVAVR

SEQ ID NO: 34927 - protein, 10 aa, Borrelia burgdorferi B31
TIDILVAVRN

SEQ ID NO: 34928 - protein, 10 aa, Borrelia burgdorferi B31
IDILVAVRNR

SEQ ID NO: 34929 - protein, 10 aa, Borrelia burgdorferi B31
DILVAVRNRN

SEQ ID NO: 34930 - protein, 10 aa, Borrelia burgdorferi B31
ILVAVRNRNK

SEQ ID NO: 34931 - protein, 10 aa, Borrelia burgdorferi B31
LVAVRNRNKI

SEQ ID NO: 34932 - protein, 10 aa, Borrelia burgdorferi B31
VAVRNRNKIK

SEQ ID NO: 34933 - protein, 10 aa, Borrelia burgdorferi B31
AVRNRNKIKI

SEQ ID NO: 34934 - protein, 10 aa, Borrelia burgdorferi B31
VRNRNKIKIL

SEQ ID NO: 34935 - protein, 10 aa, Borrelia burgdorferi B31
RNRNKIKILN

SEQ ID NO: 34936 - protein, 10 aa, Borrelia burgdorferi B31
NRNKIKILNI

SEQ ID NO: 34937 - protein, 10 aa, Borrelia burgdorferi B31
RNKIKILNIL

SEQ ID NO: 34938 - protein, 10 aa, Borrelia burgdorferi B31
NKIKILNILN

SEQ ID NO: 34939 - protein, 10 aa, Borrelia burgdorferi B31
KIKILNILNK

SEQ ID NO: 34940 - protein, 10 aa, Borrelia burgdorferi B31
IKILNILNKN

SEQ ID NO: 34941 - protein, 10 aa, Borrelia burgdorferi B31
KILNILNKNL

SEQ ID NO: 34942 - protein, 10 aa, Borrelia burgdorferi B31
ILNILNKNLK

SEQ ID NO: 34943 - protein, 10 aa, Borrelia burgdorferi B31
LNILNKNLKY

SEQ ID NO: 34944 - protein, 10 aa, Borrelia burgdorferi B31
NILNKNLKYR

SEQ ID NO: 34945 - protein, 10 aa, Borrelia burgdorferi B31
ILNKNLKYRP

SEQ ID NO: 34946 - protein, 10 aa, Borrelia burgdorferi B31
LNKNLKYRPE

SEQ ID NO: 34947 - protein, 10 aa, Borrelia burgdorferi B31
NKNLKYRPEN

SEQ ID NO: 34948 - protein, 10 aa, Borrelia burgdorferi B31
KNLKYRPENQ

SEQ ID NO: 34949 - protein, 10 aa, Borrelia burgdorferi B31
NLKYRPENQK

SEQ ID NO: 34950 - protein, 10 aa, Borrelia burgdorferi B31
LKYRPENQKV

SEQ ID NO: 34951 - protein, 10 aa, Borrelia burgdorferi B31
KYRPENQKVF

SEQ ID NO: 34952 - protein, 10 aa, Borrelia burgdorferi B31
YRPENQKVFK

SEQ ID NO: 34953 - protein, 10 aa, Borrelia burgdorferi B31
RPENQKVFKS

SEQ ID NO: 34954 - protein, 10 aa, Borrelia burgdorferi B31
PENQKVFKSS

SEQ ID NO: 34955 - protein, 10 aa, Borrelia burgdorferi B31
ENQKVFKSSL

SEQ ID NO: 34956 - protein, 10 aa, Borrelia burgdorferi B31
NQKVFKSSLT

SEQ ID NO: 34957 - protein, 10 aa, Borrelia burgdorferi B31
QKVFKSSLTN

SEQ ID NO: 34958 - protein, 10 aa, Borrelia burgdorferi B31
KVFKSSLTNK

SEQ ID NO: 34959 - protein, 10 aa, Borrelia burgdorferi B31
VFKSSLTNKE

SEQ ID NO: 34960 - protein, 10 aa, Borrelia burgdorferi B31
FKSSLTNKES

SEQ ID NO: 34961 - protein, 10 aa, Borrelia burgdorferi B31
KSSLTNKESR

SEQ ID NO: 34962 - protein, 10 aa, Borrelia burgdorferi B31
SSLTNKESRL

SEQ ID NO: 34963 - protein, 10 aa, Borrelia burgdorferi B31
SLTNKESRLI

SEQ ID NO: 34964 - protein, 10 aa, Borrelia burgdorferi B31
LTNKESRLIK

SEQ ID NO: 34965 - protein, 10 aa, Borrelia burgdorferi B31
TNKESRLIKL

SEQ ID NO: 34966 - protein, 10 aa, Borrelia burgdorferi B31
NKESRLIKLK

SEQ ID NO: 34967 - protein, 10 aa, Borrelia burgdorferi B31
KESRLIKLKR

SEQ ID NO: 34968 - protein, 10 aa, Borrelia burgdorferi B31
ESRLIKLKRM

SEQ ID NO: 34969 - protein, 10 aa, Borrelia burgdorferi B31
SRLIKLKRML

SEQ ID NO: 34970 - protein, 10 aa, Borrelia burgdorferi B31
RLIKLKRMLI

SEQ ID NO: 34971 - protein, 10 aa, Borrelia burgdorferi B31
LIKLKRMLIL

SEQ ID NO: 34972 - protein, 10 aa, Borrelia burgdorferi B31
IKLKRMLILT

SEQ ID NO: 34973 - protein, 10 aa, Borrelia burgdorferi B31
KLKRMLILTY

SEQ ID NO: 34974 - protein, 10 aa, Borrelia burgdorferi B31
LKRMLILTYW

SEQ ID NO: 34975 - protein, 10 aa, Borrelia burgdorferi B31
KRMLILTYWP

SEQ ID NO: 34976 - protein, 10 aa, Borrelia burgdorferi B31
RMLILTYWPV

SEQ ID NO: 34977 - protein, 10 aa, Borrelia burgdorferi B31
MLILTYWPVG

SEQ ID NO: 34978 - protein, 10 aa, Borrelia burgdorferi B31
LILTYWPVGC

SEQ ID NO: 34979 - protein, 10 aa, Borrelia burgdorferi B31
ILTYWPVGCL

SEQ ID NO: 34980 - protein, 10 aa, Borrelia burgdorferi B31
LTYWPVGCLS

SEQ ID NO: 34981 - protein, 10 aa, Borrelia burgdorferi B31
TYWPVGCLSK

SEQ ID NO: 34982 - protein, 10 aa, Borrelia burgdorferi B31
YWPVGCLSKN

SEQ ID NO: 34983 - protein, 10 aa, Borrelia burgdorferi B31
WPVGCLSKNI

SEQ ID NO: 34984 - protein, 10 aa, Borrelia burgdorferi B31
PVGCLSKNIF

SEQ ID NO: 34985 - protein, 10 aa, Borrelia burgdorferi B31
VGCLSKNIFI

SEQ ID NO: 34986 - protein, 10 aa, Borrelia burgdorferi B31
GCLSKNIFIK

SEQ ID NO: 34987 - protein, 10 aa, Borrelia burgdorferi B31
CLSKNIFIKI

SEQ ID NO: 34988 - protein, 10 aa, Borrelia burgdorferi B31
LSKNIFIKIL

SEQ ID NO: 34989 - protein, 10 aa, Borrelia burgdorferi B31
SKNIFIKILI

SEQ ID NO: 34990 - protein, 10 aa, Borrelia burgdorferi B31
KNIFIKILIK

SEQ ID NO: 34991 - protein, 10 aa, Borrelia burgdorferi B31
  Xaa can be any naturally occurring amino acid
  VARIANT 10: Xaa = Any Amino Acid
NIFIKILIKX

SEQ ID NO: 34992 - protein, 10 aa, Borrelia burgdorferi B31
  Xaa can be any naturally occurring amino acid
  VARIANT 9: Xaa = Any Amino Acid
IFIKILIKXY

SEQ ID NO: 34993 - protein, 10 aa, Borrelia burgdorferi B31
  Xaa can be any naturally occurring amino acid
  VARIANT 8: Xaa = Any Amino Acid
FIKILIKXYK

SEQ ID NO: 34994 - protein, 10 aa, Borrelia burgdorferi B31
  Xaa can be any naturally occurring amino acid
  VARIANT 7: Xaa = Any Amino Acid
IKILIKXYKY

SEQ ID NO: 34995 - protein, 10 aa, Borrelia burgdorferi B31
  Xaa can be any naturally occurring amino acid
  VARIANT 6: Xaa = Any Amino Acid
KILIKXYKYL

SEQ ID NO: 34996 - protein, 10 aa, Borrelia burgdorferi B31
  Xaa can be any naturally occurring amino acid
  VARIANT 5: Xaa = Any Amino Acid
ILIKXYKYLE

SEQ ID NO: 34997 - protein, 10 aa, Borrelia burgdorferi B31
  Xaa can be any naturally occurring amino acid
  VARIANT 4: Xaa = Any Amino Acid
LIKXYKYLEE

SEQ ID NO: 34998 - protein, 10 aa, Borrelia burgdorferi B31
  Xaa can be any naturally occurring amino acid
  VARIANT 3: Xaa = Any Amino Acid
IKXYKYLEEE

SEQ ID NO: 34999 - protein, 10 aa, Borrelia burgdorferi B31
  Xaa can be any naturally occurring amino acid
  VARIANT 2: Xaa = Any Amino Acid
KXYKYLEEEI

SEQ ID NO: 35000 - protein, 10 aa, Borrelia burgdorferi B31
  Xaa can be any naturally occurring amino acid
  VARIANT 1: Xaa = Any Amino Acid
XYKYLEEEIL

SEQ ID NO: 35001 - protein, 10 aa, Borrelia burgdorferi B31
YKYLEEEILA

SEQ ID NO: 35002 - protein, 10 aa, Borrelia burgdorferi B31
KYLEEEILAL

SEQ ID NO: 35003 - protein, 10 aa, Borrelia burgdorferi B31
YLEEEILALK

SEQ ID NO: 35004 - protein, 10 aa, Borrelia burgdorferi B31
LEEEILALKY

SEQ ID NO: 35005 - protein, 10 aa, Borrelia burgdorferi B31
EEEILALKYN

SEQ ID NO: 35006 - protein, 10 aa, Borrelia burgdorferi B31
EEILALKYNE

SEQ ID NO: 35007 - protein, 10 aa, Borrelia burgdorferi B31
EILALKYNEI

SEQ ID NO: 35008 - protein, 10 aa, Borrelia burgdorferi B31
ILALKYNEIL

SEQ ID NO: 35009 - protein, 10 aa, Borrelia burgdorferi B31
LALKYNEILN

SEQ ID NO: 35010 - protein, 10 aa, Borrelia burgdorferi B31
ALKYNEILNY

SEQ ID NO: 35011 - protein, 10 aa, Borrelia burgdorferi B31
LKYNEILNYL

SEQ ID NO: 35012 - protein, 10 aa, Borrelia burgdorferi B31
KYNEILNYLR

SEQ ID NO: 35013 - protein, 10 aa, Borrelia burgdorferi B31
YNEILNYLRA

SEQ ID NO: 35014 - protein, 10 aa, Borrelia burgdorferi B31
NEILNYLRAL

SEQ ID NO: 35015 - protein, 10 aa, Borrelia burgdorferi B31
EILNYLRALK

SEQ ID NO: 35016 - protein, 10 aa, Borrelia burgdorferi B31
ILNYLRALKT

SEQ ID NO: 35017 - protein, 10 aa, Borrelia burgdorferi B31
LNYLRALKTL

SEQ ID NO: 35018 - protein, 10 aa, Borrelia burgdorferi B31
NYLRALKTLS

SEQ ID NO: 35019 - protein, 10 aa, Borrelia burgdorferi B31
YLRALKTLSL

SEQ ID NO: 35020 - protein, 10 aa, Borrelia burgdorferi B31
LRALKTLSLN

SEQ ID NO: 35021 - protein, 10 aa, Borrelia burgdorferi B31
RALKTLSLNE

SEQ ID NO: 35022 - protein, 10 aa, Borrelia burgdorferi B31
ALKTLSLNEI

SEQ ID NO: 35023 - protein, 10 aa, Borrelia burgdorferi B31
LKTLSLNEIF

SEQ ID NO: 35024 - protein, 10 aa, Borrelia burgdorferi B31
KTLSLNEIFY

SEQ ID NO: 35025 - protein, 10 aa, Borrelia burgdorferi B31
TLSLNEIFYK

SEQ ID NO: 35026 - protein, 10 aa, Borrelia burgdorferi B31
LSLNEIFYKG

SEQ ID NO: 35027 - protein, 10 aa, Borrelia burgdorferi B31
SLNEIFYKGS

SEQ ID NO: 35028 - protein, 10 aa, Borrelia burgdorferi B31
LNEIFYKGSS

SEQ ID NO: 35029 - protein, 10 aa, Borrelia burgdorferi B31
NEIFYKGSSK

SEQ ID NO: 35030 - protein, 10 aa, Borrelia burgdorferi B31
EIFYKGSSKN

SEQ ID NO: 35031 - protein, 10 aa, Borrelia burgdorferi B31
IFYKGSSKNI

SEQ ID NO: 35032 - protein, 10 aa, Borrelia burgdorferi B31
FYKGSSKNIS

SEQ ID NO: 35033 - protein, 10 aa, Borrelia burgdorferi B31
YKGSSKNISF

SEQ ID NO: 35034 - protein, 10 aa, Borrelia burgdorferi B31
KGSSKNISFN

SEQ ID NO: 35035 - protein, 10 aa, Borrelia burgdorferi B31
GSSKNISFNY

SEQ ID NO: 35036 - protein, 10 aa, Borrelia burgdorferi B31
SSKNISFNYF

SEQ ID NO: 35037 - protein, 10 aa, Borrelia burgdorferi B31
SKNISFNYFF

SEQ ID NO: 35038 - protein, 10 aa, Borrelia burgdorferi B31
KNISFNYFFS

SEQ ID NO: 35039 - protein, 10 aa, Borrelia burgdorferi B31
NISFNYFFSD

SEQ ID NO: 35040 - protein, 10 aa, Borrelia burgdorferi B31
ISFNYFFSDF

SEQ ID NO: 35041 - protein, 10 aa, Borrelia burgdorferi B31
SFNYFFSDFT

SEQ ID NO: 35042 - protein, 10 aa, Borrelia burgdorferi B31
FNYFFSDFTQ

SEQ ID NO: 35043 - protein, 10 aa, Borrelia burgdorferi B31
NYFFSDFTQY

SEQ ID NO: 35044 - protein, 10 aa, Borrelia burgdorferi B31
YFFSDFTQYA

SEQ ID NO: 35045 - protein, 10 aa, Borrelia burgdorferi B31
FFSDFTQYAP

SEQ ID NO: 35046 - protein, 10 aa, Borrelia burgdorferi B31
FSDFTQYAPK

SEQ ID NO: 35047 - protein, 10 aa, Borrelia burgdorferi B31
SDFTQYAPKD

SEQ ID NO: 35048 - protein, 10 aa, Borrelia burgdorferi B31
DFTQYAPKDF

SEQ ID NO: 35049 - protein, 10 aa, Borrelia burgdorferi B31
FTQYAPKDFQ

SEQ ID NO: 35050 - protein, 10 aa, Borrelia burgdorferi B31
TQYAPKDFQD

SEQ ID NO: 35051 - protein, 10 aa, Borrelia burgdorferi B31
QYAPKDFQDT

SEQ ID NO: 35052 - protein, 10 aa, Borrelia burgdorferi B31
YAPKDFQDTL

SEQ ID NO: 35053 - protein, 10 aa, Borrelia burgdorferi B31
APKDFQDTLK

SEQ ID NO: 35054 - protein, 10 aa, Borrelia burgdorferi B31
PKDFQDTLKC

SEQ ID NO: 35055 - protein, 10 aa, Borrelia burgdorferi B31
KDFQDTLKCY

SEQ ID NO: 35056 - protein, 10 aa, Borrelia burgdorferi B31
DFQDTLKCYL

SEQ ID NO: 35057 - protein, 10 aa, Borrelia burgdorferi B31
FQDTLKCYLY

SEQ ID NO: 35058 - protein, 10 aa, Borrelia burgdorferi B31
QDTLKCYLYV

SEQ ID NO: 35059 - protein, 10 aa, Borrelia burgdorferi B31
DTLKCYLYVI

SEQ ID NO: 35060 - protein, 10 aa, Borrelia burgdorferi B31
TLKCYLYVIE

SEQ ID NO: 35061 - protein, 10 aa, Borrelia burgdorferi B31
LKCYLYVIEK

SEQ ID NO: 35062 - protein, 10 aa, Borrelia burgdorferi B31
KCYLYVIEKT

SEQ ID NO: 35063 - protein, 10 aa, Borrelia burgdorferi B31
CYLYVIEKTI

SEQ ID NO: 35064 - protein, 10 aa, Borrelia burgdorferi B31
YLYVIEKTIT

SEQ ID NO: 35065 - protein, 10 aa, Borrelia burgdorferi B31
LYVIEKTITK

SEQ ID NO: 35066 - protein, 10 aa, Borrelia burgdorferi B31
YVIEKTITKK

SEQ ID NO: 35067 - protein, 10 aa, Borrelia burgdorferi B31
VIEKTITKKY

SEQ ID NO: 35068 - protein, 10 aa, Borrelia burgdorferi B31
IEKTITKKYL

SEQ ID NO: 35069 - protein, 10 aa, Borrelia burgdorferi B31
EKTITKKYLT

SEQ ID NO: 35070 - protein, 10 aa, Borrelia burgdorferi B31
KTITKKYLTW

SEQ ID NO: 35071 - protein, 10 aa, Borrelia burgdorferi B31
TITKKYLTWF

SEQ ID NO: 35072 - protein, 10 aa, Borrelia burgdorferi B31
ITKKYLTWFF

SEQ ID NO: 35073 - protein, 10 aa, Borrelia burgdorferi B31
TKKYLTWFFK

SEQ ID NO: 35074 - protein, 10 aa, Borrelia burgdorferi B31
KKYLTWFFKD

SEQ ID NO: 35075 - protein, 10 aa, Borrelia burgdorferi B31
KYLTWFFKDK

SEQ ID NO: 35076 - protein, 10 aa, Borrelia burgdorferi B31
YLTWFFKDKI

SEQ ID NO: 35077 - protein, 10 aa, Borrelia burgdorferi B31
LTWFFKDKIS

SEQ ID NO: 35078 - protein, 10 aa, Borrelia burgdorferi B31
TWFFKDKISN

SEQ ID NO: 35079 - protein, 10 aa, Borrelia burgdorferi B31
WFFKDKISNN

SEQ ID NO: 35080 - protein, 10 aa, Borrelia burgdorferi B31
FFKDKISNNW

SEQ ID NO: 35081 - protein, 10 aa, Borrelia burgdorferi B31
FKDKISNNWE

SEQ ID NO: 35082 - protein, 10 aa, Borrelia burgdorferi B31
KDKISNNWES

SEQ ID NO: 35083 - protein, 10 aa, Borrelia burgdorferi B31
DKISNNWESF

SEQ ID NO: 35084 - protein, 10 aa, Borrelia burgdorferi B31
KISNNWESFI

SEQ ID NO: 35085 - protein, 10 aa, Borrelia burgdorferi B31
ISNNWESFID

SEQ ID NO: 35086 - protein, 10 aa, Borrelia burgdorferi B31
SNNWESFIDA

SEQ ID NO: 35087 - protein, 10 aa, Borrelia burgdorferi B31
NNWESFIDAL

SEQ ID NO: 35088 - protein, 10 aa, Borrelia burgdorferi B31
NWESFIDALE

SEQ ID NO: 35089 - protein, 10 aa, Borrelia burgdorferi B31
WESFIDALEY

SEQ ID NO: 35090 - protein, 10 aa, Borrelia burgdorferi B31
ESFIDALEYI

SEQ ID NO: 35091 - protein, 10 aa, Borrelia burgdorferi B31
SFIDALEYIE

SEQ ID NO: 35092 - protein, 10 aa, Borrelia burgdorferi B31
FIDALEYIEK

SEQ ID NO: 35093 - protein, 10 aa, Borrelia burgdorferi B31
IDALEYIEKH

SEQ ID NO: 35094 - protein, 10 aa, Borrelia burgdorferi B31
DALEYIEKHK

SEQ ID NO: 35095 - protein, 10 aa, Borrelia burgdorferi B31
ALEYIEKHKL

SEQ ID NO: 35096 - protein, 10 aa, Borrelia burgdorferi B31
LEYIEKHKLI

SEQ ID NO: 35097 - protein, 10 aa, Borrelia burgdorferi B31
EYIEKHKLIN

SEQ ID NO: 35098 - protein, 10 aa, Borrelia burgdorferi B31
YIEKHKLINI

SEQ ID NO: 35099 - protein, 10 aa, Borrelia burgdorferi B31
IEKHKLINIK

SEQ ID NO: 35100 - protein, 10 aa, Borrelia burgdorferi B31
EKHKLINIKE

SEQ ID NO: 35101 - protein, 10 aa, Borrelia burgdorferi B31
KHKLINIKEK

SEQ ID NO: 35102 - protein, 10 aa, Borrelia burgdorferi B31
HKLINIKEKI

SEQ ID NO: 35103 - protein, 10 aa, Borrelia burgdorferi B31
KLINIKEKIK

SEQ ID NO: 35104 - protein, 10 aa, Borrelia burgdorferi B31
LINIKEKIKE

SEQ ID NO: 35105 - protein, 10 aa, Borrelia burgdorferi B31
INIKEKIKEI

SEQ ID NO: 35106 - protein, 10 aa, Borrelia burgdorferi B31
NIKEKIKEII

SEQ ID NO: 35107 - protein, 10 aa, Borrelia burgdorferi B31
IKEKIKEIIT

SEQ ID NO: 35108 - protein, 10 aa, Borrelia burgdorferi B31
KEKIKEIITA

SEQ ID NO: 35109 - protein, 10 aa, Borrelia burgdorferi B31
EKIKEIITAK

SEQ ID NO: 35110 - protein, 10 aa, Borrelia burgdorferi B31
KIKEIITAKF

SEQ ID NO: 35111 - protein, 10 aa, Borrelia burgdorferi B31
IKEIITAKFQ

SEQ ID NO: 35112 - protein, 10 aa, Borrelia burgdorferi B31
KEIITAKFQT

SEQ ID NO: 35113 - protein, 10 aa, Borrelia burgdorferi B31
EIITAKFQTE

SEQ ID NO: 35114 - protein, 10 aa, Borrelia burgdorferi B31
IITAKFQTED

SEQ ID NO: 35115 - protein, 10 aa, Borrelia burgdorferi B31
ITAKFQTEDF

SEQ ID NO: 35116 - protein, 10 aa, Borrelia burgdorferi B31
TAKFQTEDFF

SEQ ID NO: 35117 - protein, 10 aa, Borrelia burgdorferi B31
AKFQTEDFFI

SEQ ID NO: 35118 - protein, 10 aa, Borrelia burgdorferi B31
KFQTEDFFIS

SEQ ID NO: 35119 - protein, 10 aa, Borrelia burgdorferi B31
FQTEDFFISF

SEQ ID NO: 35120 - protein, 10 aa, Borrelia burgdorferi B31
QTEDFFISFD

SEQ ID NO: 35121 - protein, 10 aa, Borrelia burgdorferi B31
TEDFFISFDK

SEQ ID NO: 35122 - protein, 10 aa, Borrelia burgdorferi B31
EDFFISFDKT

SEQ ID NO: 35123 - protein, 10 aa, Borrelia burgdorferi B31
DFFISFDKTN

SEQ ID NO: 35124 - protein, 10 aa, Borrelia burgdorferi B31
FFISFDKTNF

SEQ ID NO: 35125 - protein, 10 aa, Borrelia burgdorferi B31
FISFDKTNFN

SEQ ID NO: 35126 - protein, 10 aa, Borrelia burgdorferi B31
ISFDKTNFNP

SEQ ID NO: 35127 - protein, 10 aa, Borrelia burgdorferi B31
SFDKTNFNPY

SEQ ID NO: 35128 - protein, 10 aa, Borrelia burgdorferi B31
FDKTNFNPYE

SEQ ID NO: 35129 - protein, 10 aa, Borrelia burgdorferi B31
DKTNFNPYES

SEQ ID NO: 35130 - protein, 10 aa, Borrelia burgdorferi B31
KTNFNPYESS

SEQ ID NO: 35131 - protein, 10 aa, Borrelia burgdorferi B31
TNFNPYESSI

SEQ ID NO: 35132 - protein, 10 aa, Borrelia burgdorferi B31
NFNPYESSIF

SEQ ID NO: 35133 - protein, 10 aa, Borrelia burgdorferi B31
FNPYESSIFK

SEQ ID NO: 35134 - protein, 10 aa, Borrelia burgdorferi B31
NPYESSIFKE

SEQ ID NO: 35135 - protein, 10 aa, Borrelia burgdorferi B31
PYESSIFKER

SEQ ID NO: 35136 - protein, 10 aa, Borrelia burgdorferi B31
YESSIFKERY

SEQ ID NO: 35137 - protein, 10 aa, Borrelia burgdorferi B31
ESSIFKERYI

SEQ ID NO: 35138 - protein, 10 aa, Borrelia burgdorferi B31
SSIFKERYIK

SEQ ID NO: 35139 - protein, 10 aa, Borrelia burgdorferi B31
SIFKERYIKS

SEQ ID NO: 35140 - protein, 10 aa, Borrelia burgdorferi B31
IFKERYIKSA

SEQ ID NO: 35141 - protein, 10 aa, Borrelia burgdorferi B31
FKERYIKSAF

SEQ ID NO: 35142 - protein, 10 aa, Borrelia burgdorferi B31
KERYIKSAFL

SEQ ID NO: 35143 - protein, 10 aa, Borrelia burgdorferi B31
ERYIKSAFLE

SEQ ID NO: 35144 - protein, 10 aa, Borrelia burgdorferi B31
RYIKSAFLEI

SEQ ID NO: 35145 - protein, 10 aa, Borrelia burgdorferi B31
YIKSAFLEII

SEQ ID NO: 35146 - protein, 10 aa, Borrelia burgdorferi B31
IKSAFLEIIM

SEQ ID NO: 35147 - protein, 10 aa, Borrelia burgdorferi B31
KSAFLEIIMH

SEQ ID NO: 35148 - protein, 10 aa, Borrelia burgdorferi B31
SAFLEIIMHY

SEQ ID NO: 35149 - protein, 10 aa, Borrelia burgdorferi B31
AFLEIIMHYV

SEQ ID NO: 35150 - protein, 10 aa, Borrelia burgdorferi B31
FLEIIMHYVK

SEQ ID NO: 35151 - protein, 10 aa, Borrelia burgdorferi B31
LEIIMHYVKK

SEQ ID NO: 35152 - protein, 10 aa, Borrelia burgdorferi B31
EIIMHYVKKN

SEQ ID NO: 35153 - protein, 10 aa, Borrelia burgdorferi B31
IIMHYVKKNS

SEQ ID NO: 35154 - protein, 10 aa, Borrelia burgdorferi B31
IMHYVKKNSQ

SEQ ID NO: 35155 - protein, 10 aa, Borrelia burgdorferi B31
MHYVKKNSQN

SEQ ID NO: 35156 - protein, 10 aa, Borrelia burgdorferi B31
HYVKKNSQNI

SEQ ID NO: 35157 - protein, 10 aa, Borrelia burgdorferi B31
YVKKNSQNIE

SEQ ID NO: 35158 - protein, 10 aa, Borrelia burgdorferi B31
VKKNSQNIET

SEQ ID NO: 35159 - protein, 10 aa, Borrelia burgdorferi B31
KKNSQNIETY

SEQ ID NO: 35160 - protein, 10 aa, Borrelia burgdorferi B31
KNSQNIETYG

SEQ ID NO: 35161 - protein, 10 aa, Borrelia burgdorferi B31
NSQNIETYGW

SEQ ID NO: 35162 - protein, 10 aa, Borrelia burgdorferi B31
SQNIETYGWI

SEQ ID NO: 35163 - protein, 10 aa, Borrelia burgdorferi B31
QNIETYGWIA

SEQ ID NO: 35164 - protein, 10 aa, Borrelia burgdorferi B31
NIETYGWIAF

SEQ ID NO: 35165 - protein, 10 aa, Borrelia burgdorferi B31
IETYGWIAFY

SEQ ID NO: 35166 - protein, 10 aa, Borrelia burgdorferi B31
ETYGWIAFYI

SEQ ID NO: 35167 - protein, 10 aa, Borrelia burgdorferi B31
TYGWIAFYIY

SEQ ID NO: 35168 - protein, 10 aa, Borrelia burgdorferi B31
YGWIAFYIYA

SEQ ID NO: 35169 - protein, 10 aa, Borrelia burgdorferi B31
GWIAFYIYAD

SEQ ID NO: 35170 - protein, 10 aa, Borrelia burgdorferi B31
WIAFYIYADN

SEQ ID NO: 35171 - protein, 10 aa, Borrelia burgdorferi B31
IAFYIYADNK

SEQ ID NO: 35172 - protein, 10 aa, Borrelia burgdorferi B31
AFYIYADNKD

SEQ ID NO: 35173 - protein, 10 aa, Borrelia burgdorferi B31
FYIYADNKDK

SEQ ID NO: 35174 - protein, 10 aa, Borrelia burgdorferi B31
YIYADNKDKK

SEQ ID NO: 35175 - protein, 10 aa, Borrelia burgdorferi B31
IYADNKDKKI

SEQ ID NO: 35176 - protein, 10 aa, Borrelia burgdorferi B31
YADNKDKKIF

SEQ ID NO: 35177 - protein, 10 aa, Borrelia burgdorferi B31
ADNKDKKIFC

SEQ ID NO: 35178 - protein, 10 aa, Borrelia burgdorferi B31
DNKDKKIFCQ

SEQ ID NO: 35179 - protein, 10 aa, Borrelia burgdorferi B31
NKDKKIFCQR

SEQ ID NO: 35180 - protein, 10 aa, Borrelia burgdorferi B31
KDKKIFCQRM

SEQ ID NO: 35181 - protein, 10 aa, Borrelia burgdorferi B31
DKKIFCQRMK

SEQ ID NO: 35182 - protein, 10 aa, Borrelia burgdorferi B31
KKIFCQRMKE

SEQ ID NO: 35183 - protein, 10 aa, Borrelia burgdorferi B31
KIFCQRMKEF

SEQ ID NO: 35184 - protein, 10 aa, Borrelia burgdorferi B31
IFCQRMKEFF

SEQ ID NO: 35185 - protein, 10 aa, Borrelia burgdorferi B31
FCQRMKEFFK

SEQ ID NO: 35186 - protein, 10 aa, Borrelia burgdorferi B31
CQRMKEFFKS

SEQ ID NO: 35187 - protein, 10 aa, Borrelia burgdorferi B31
QRMKEFFKSK

SEQ ID NO: 35188 - protein, 10 aa, Borrelia burgdorferi B31
RMKEFFKSKT

SEQ ID NO: 35189 - protein, 10 aa, Borrelia burgdorferi B31
MKEFFKSKTF

SEQ ID NO: 35190 - protein, 10 aa, Borrelia burgdorferi B31
KEFFKSKTFE

SEQ ID NO: 35191 - protein, 10 aa, Borrelia burgdorferi B31
EFFKSKTFEI

SEQ ID NO: 35192 - protein, 10 aa, Borrelia burgdorferi B31
FFKSKTFEIQ

SEQ ID NO: 35193 - protein, 10 aa, Borrelia burgdorferi B31
FKSKTFEIQN

SEQ ID NO: 35194 - protein, 10 aa, Borrelia burgdorferi B31
KSKTFEIQNQ

SEQ ID NO: 35195 - protein, 10 aa, Borrelia burgdorferi B31
SKTFEIQNQI

SEQ ID NO: 35196 - protein, 10 aa, Borrelia burgdorferi B31
KTFEIQNQIF

SEQ ID NO: 35197 - protein, 10 aa, Borrelia burgdorferi B31
TFEIQNQIFV

SEQ ID NO: 35198 - protein, 10 aa, Borrelia burgdorferi B31
FEIQNQIFVY

SEQ ID NO: 35199 - protein, 10 aa, Borrelia burgdorferi B31
EIQNQIFVYF

SEQ ID NO: 35200 - protein, 10 aa, Borrelia burgdorferi B31
IQNQIFVYFL

SEQ ID NO: 35201 - protein, 10 aa, Borrelia burgdorferi B31
QNQIFVYFLS

SEQ ID NO: 35202 - protein, 10 aa, Borrelia burgdorferi B31
NQIFVYFLSF

SEQ ID NO: 35203 - protein, 10 aa, Borrelia burgdorferi B31
QIFVYFLSFY

SEQ ID NO: 35204 - protein, 10 aa, Borrelia burgdorferi B31
IFVYFLSFYP

SEQ ID NO: 35205 - protein, 10 aa, Borrelia burgdorferi B31
FVYFLSFYPN

SEQ ID NO: 35206 - protein, 10 aa, Borrelia burgdorferi B31
VYFLSFYPNI

SEQ ID NO: 35207 - protein, 10 aa, Borrelia burgdorferi B31
YFLSFYPNIE

SEQ ID NO: 35208 - protein, 10 aa, Borrelia burgdorferi B31
FLSFYPNIEY

SEQ ID NO: 35209 - protein, 10 aa, Borrelia burgdorferi B31
LSFYPNIEYK

SEQ ID NO: 35210 - protein, 10 aa, Borrelia burgdorferi B31
SFYPNIEYKH

SEQ ID NO: 35211 - protein, 10 aa, Borrelia burgdorferi B31
FYPNIEYKHF

SEQ ID NO: 35212 - protein, 10 aa, Borrelia burgdorferi B31
YPNIEYKHFK

SEQ ID NO: 35213 - protein, 10 aa, Borrelia burgdorferi B31
PNIEYKHFKF

SEQ ID NO: 35214 - protein, 10 aa, Borrelia burgdorferi B31
NIEYKHFKFI

SEQ ID NO: 35215 - protein, 10 aa, Borrelia burgdorferi B31
IEYKHFKFIS

SEQ ID NO: 35216 - protein, 10 aa, Borrelia burgdorferi B31
EYKHFKFISD

SEQ ID NO: 35217 - protein, 10 aa, Borrelia burgdorferi B31
YKHFKFISDI

SEQ ID NO: 35218 - protein, 10 aa, Borrelia burgdorferi B31
KHFKFISDIL

SEQ ID NO: 35219 - protein, 10 aa, Borrelia burgdorferi B31
HFKFISDILL

SEQ ID NO: 35220 - protein, 10 aa, Borrelia burgdorferi B31
FKFISDILLY

SEQ ID NO: 35221 - protein, 10 aa, Borrelia burgdorferi B31
KFISDILLYL

SEQ ID NO: 35222 - protein, 10 aa, Borrelia burgdorferi B31
FISDILLYLD

SEQ ID NO: 35223 - protein, 10 aa, Borrelia burgdorferi B31
ISDILLYLDE

SEQ ID NO: 35224 - protein, 10 aa, Borrelia burgdorferi B31
SDILLYLDEN

SEQ ID NO: 35225 - protein, 10 aa, Borrelia burgdorferi B31
DILLYLDENK

SEQ ID NO: 35226 - protein, 10 aa, Borrelia burgdorferi B31
ILLYLDENKI

SEQ ID NO: 35227 - protein, 10 aa, Borrelia burgdorferi B31
LLYLDENKIT

SEQ ID NO: 35228 - protein, 10 aa, Borrelia burgdorferi B31
LYLDENKITI

SEQ ID NO: 35229 - protein, 10 aa, Borrelia burgdorferi B31
YLDENKITIP

SEQ ID NO: 35230 - protein, 10 aa, Borrelia burgdorferi B31
LDENKITIPK

SEQ ID NO: 35231 - protein, 10 aa, Borrelia burgdorferi B31
DENKITIPKK

SEQ ID NO: 35232 - protein, 10 aa, Borrelia burgdorferi B31
ENKITIPKKI

SEQ ID NO: 35233 - protein, 10 aa, Borrelia burgdorferi B31
NKITIPKKII

SEQ ID NO: 35234 - protein, 10 aa, Borrelia burgdorferi B31
KITIPKKIIK

SEQ ID NO: 35235 - protein, 10 aa, Borrelia burgdorferi B31
ITIPKKIIKI

SEQ ID NO: 35236 - protein, 10 aa, Borrelia burgdorferi B31
TIPKKIIKIQ

SEQ ID NO: 35237 - protein, 10 aa, Borrelia burgdorferi B31
IPKKIIKIQK

SEQ ID NO: 35238 - protein, 10 aa, Borrelia burgdorferi B31
PKKIIKIQKI

SEQ ID NO: 35239 - protein, 10 aa, Borrelia burgdorferi B31
KKIIKIQKIN

SEQ ID NO: 35240 - protein, 10 aa, Borrelia burgdorferi B31
KIIKIQKINP

SEQ ID NO: 35241 - protein, 10 aa, Borrelia burgdorferi B31
IIKIQKINPN

SEQ ID NO: 35242 - protein, 10 aa, Borrelia burgdorferi B31
IKIQKINPNQ

SEQ ID NO: 35243 - protein, 10 aa, Borrelia burgdorferi B31
KIQKINPNQL

SEQ ID NO: 35244 - protein, 10 aa, Borrelia burgdorferi B31
IQKINPNQLD

SEQ ID NO: 35245 - protein, 10 aa, Borrelia burgdorferi B31
QKINPNQLDY

SEQ ID NO: 35246 - protein, 10 aa, Borrelia burgdorferi B31
KINPNQLDYQ

SEQ ID NO: 35247 - protein, 10 aa, Borrelia burgdorferi B31
INPNQLDYQK

SEQ ID NO: 35248 - protein, 10 aa, Borrelia burgdorferi B31
NPNQLDYQKS

SEQ ID NO: 35249 - protein, 10 aa, Borrelia burgdorferi B31
PNQLDYQKSY

SEQ ID NO: 35250 - protein, 10 aa, Borrelia burgdorferi B31
NQLDYQKSYL

SEQ ID NO: 35251 - protein, 10 aa, Borrelia burgdorferi B31
QLDYQKSYLL

SEQ ID NO: 35252 - protein, 10 aa, Borrelia burgdorferi B31
LDYQKSYLLI

SEQ ID NO: 35253 - protein, 10 aa, Borrelia burgdorferi B31
DYQKSYLLIK

SEQ ID NO: 35254 - protein, 10 aa, Borrelia burgdorferi B31
YQKSYLLIKS

SEQ ID NO: 35255 - protein, 10 aa, Borrelia burgdorferi B31
QKSYLLIKSL

SEQ ID NO: 35256 - protein, 10 aa, Borrelia burgdorferi B31
KSYLLIKSLK

SEQ ID NO: 35257 - protein, 10 aa, Borrelia burgdorferi B31
SYLLIKSLKT

SEQ ID NO: 35258 - protein, 10 aa, Borrelia burgdorferi B31
YLLIKSLKTR

SEQ ID NO: 35259 - protein, 10 aa, Borrelia burgdorferi B31
LLIKSLKTRS

SEQ ID NO: 35260 - protein, 10 aa, Borrelia burgdorferi B31
LIKSLKTRSR

SEQ ID NO: 35261 - protein, 10 aa, Borrelia burgdorferi B31
IKSLKTRSRI

SEQ ID NO: 35262 - protein, 10 aa, Borrelia burgdorferi B31
KSLKTRSRIL

SEQ ID NO: 35263 - protein, 10 aa, Borrelia burgdorferi B31
SLKTRSRILK

SEQ ID NO: 35264 - protein, 10 aa, Borrelia burgdorferi B31
LKTRSRILKI

SEQ ID NO: 35265 - protein, 10 aa, Borrelia burgdorferi B31
KTRSRILKII

SEQ ID NO: 35266 - protein, 10 aa, Borrelia burgdorferi B31
TRSRILKIII

SEQ ID NO: 35267 - protein, 10 aa, Borrelia burgdorferi B31
RSRILKIIIK

SEQ ID NO: 35268 - protein, 10 aa, Borrelia burgdorferi B31
SRILKIIIKN

SEQ ID NO: 35269 - protein, 10 aa, Borrelia burgdorferi B31
RILKIIIKNI

SEQ ID NO: 35270 - protein, 10 aa, Borrelia burgdorferi B31
ILKIIIKNIR

SEQ ID NO: 35271 - protein, 10 aa, Borrelia burgdorferi B31
LKIIIKNIRF

SEQ ID NO: 35272 - protein, 10 aa, Borrelia burgdorferi B31
KIIIKNIRFN

SEQ ID NO: 35273 - protein, 10 aa, Borrelia burgdorferi B31
IIIKNIRFNL

SEQ ID NO: 35274 - protein, 10 aa, Borrelia burgdorferi B31
IIKNIRFNLI

SEQ ID NO: 35275 - protein, 10 aa, Borrelia burgdorferi B31
IKNIRFNLIE

SEQ ID NO: 35276 - protein, 10 aa, Borrelia burgdorferi B31
KNIRFNLIEK

SEQ ID NO: 35277 - protein, 10 aa, Borrelia burgdorferi B31
NIRFNLIEKL

SEQ ID NO: 35278 - protein, 10 aa, Borrelia burgdorferi B31
IRFNLIEKLE

SEQ ID NO: 35279 - protein, 10 aa, Borrelia burgdorferi B31
RFNLIEKLED

SEQ ID NO: 35280 - protein, 10 aa, Borrelia burgdorferi B31
FNLIEKLEDE

SEQ ID NO: 35281 - protein, 10 aa, Borrelia burgdorferi B31
NLIEKLEDEN

SEQ ID NO: 35282 - protein, 10 aa, Borrelia burgdorferi B31
LIEKLEDENE

SEQ ID NO: 35283 - protein, 10 aa, Borrelia burgdorferi B31
IEKLEDENEK

SEQ ID NO: 35284 - protein, 10 aa, Borrelia burgdorferi B31
EKLEDENEKK

SEQ ID NO: 35285 - protein, 10 aa, Borrelia burgdorferi B31
KLEDENEKKL

SEQ ID NO: 35286 - protein, 10 aa, Borrelia burgdorferi B31
LEDENEKKLL

SEQ ID NO: 35287 - protein, 10 aa, Borrelia burgdorferi B31
EDENEKKLLP

SEQ ID NO: 35288 - protein, 10 aa, Borrelia burgdorferi B31
DENEKKLLPA

SEQ ID NO: 35289 - protein, 10 aa, Borrelia burgdorferi B31
ENEKKLLPAM

SEQ ID NO: 35290 - protein, 10 aa, Borrelia burgdorferi B31
NEKKLLPAMC

SEQ ID NO: 35291 - protein, 10 aa, Borrelia burgdorferi B31
EKKLLPAMCY

SEQ ID NO: 35292 - protein, 10 aa, Borrelia burgdorferi B31
KKLLPAMCYL

SEQ ID NO: 35293 - protein, 10 aa, Borrelia burgdorferi B31
KLLPAMCYLI

SEQ ID NO: 35294 - protein, 10 aa, Borrelia burgdorferi B31
LLPAMCYLIY

SEQ ID NO: 35295 - protein, 10 aa, Borrelia burgdorferi B31
LPAMCYLIYC

SEQ ID NO: 35296 - protein, 10 aa, Borrelia burgdorferi B31
PAMCYLIYCE

SEQ ID NO: 35297 - protein, 10 aa, Borrelia burgdorferi B31
AMCYLIYCEN

SEQ ID NO: 35298 - protein, 10 aa, Borrelia burgdorferi B31
MCYLIYCENL

SEQ ID NO: 35299 - protein, 10 aa, Borrelia burgdorferi B31
CYLIYCENLV

SEQ ID NO: 35300 - protein, 10 aa, Borrelia burgdorferi B31
YLIYCENLVE

SEQ ID NO: 35301 - protein, 10 aa, Borrelia burgdorferi B31
LIYCENLVEL

SEQ ID NO: 35302 - protein, 10 aa, Borrelia burgdorferi B31
IYCENLVELK

SEQ ID NO: 35303 - protein, 10 aa, Borrelia burgdorferi B31
YCENLVELKN

SEQ ID NO: 35304 - protein, 10 aa, Borrelia burgdorferi B31
CENLVELKNN

SEQ ID NO: 35305 - protein, 10 aa, Borrelia burgdorferi B31
ENLVELKNNR

SEQ ID NO: 35306 - protein, 10 aa, Borrelia burgdorferi B31
NLVELKNNRK

SEQ ID NO: 35307 - protein, 10 aa, Borrelia burgdorferi B31
LVELKNNRKI

SEQ ID NO: 35308 - protein, 10 aa, Borrelia burgdorferi B31
VELKNNRKIK

SEQ ID NO: 35309 - protein, 10 aa, Borrelia burgdorferi B31
ELKNNRKIKS

SEQ ID NO: 35310 - protein, 10 aa, Borrelia burgdorferi B31
LKNNRKIKSN

SEQ ID NO: 35311 - protein, 10 aa, Borrelia burgdorferi B31
KNNRKIKSNE

SEQ ID NO: 35312 - protein, 10 aa, Borrelia burgdorferi B31
NNRKIKSNEK

SEQ ID NO: 35313 - protein, 10 aa, Borrelia burgdorferi B31
NRKIKSNEKN

SEQ ID NO: 35314 - protein, 10 aa, Borrelia burgdorferi B31
RKIKSNEKNS

SEQ ID NO: 35315 - protein, 10 aa, Borrelia burgdorferi B31
KIKSNEKNSL

SEQ ID NO: 35316 - protein, 10 aa, Borrelia burgdorferi B31
IKSNEKNSLL

SEQ ID NO: 35317 - protein, 10 aa, Borrelia burgdorferi B31
KSNEKNSLLE

SEQ ID NO: 35318 - protein, 10 aa, Borrelia burgdorferi B31
SNEKNSLLEF

SEQ ID NO: 35319 - protein, 10 aa, Borrelia burgdorferi B31
NEKNSLLEFI

SEQ ID NO: 35320 - protein, 10 aa, Borrelia burgdorferi B31
EKNSLLEFIS

SEQ ID NO: 35321 - protein, 10 aa, Borrelia burgdorferi B31
KNSLLEFISF

SEQ ID NO: 35322 - protein, 10 aa, Borrelia burgdorferi B31
NSLLEFISFF

SEQ ID NO: 35323 - protein, 10 aa, Borrelia burgdorferi B31
SLLEFISFFK

SEQ ID NO: 35324 - protein, 10 aa, Borrelia burgdorferi B31
LLEFISFFKT

SEQ ID NO: 35325 - protein, 10 aa, Borrelia burgdorferi B31
LEFISFFKTK

SEQ ID NO: 35326 - protein, 10 aa, Borrelia burgdorferi B31
EFISFFKTKL

SEQ ID NO: 35327 - protein, 10 aa, Borrelia burgdorferi B31
FISFFKTKLK

SEQ ID NO: 35328 - protein, 10 aa, Borrelia burgdorferi B31
ISFFKTKLKQ

SEQ ID NO: 35329 - protein, 10 aa, Borrelia burgdorferi B31
SFFKTKLKQK

SEQ ID NO: 35330 - protein, 10 aa, Borrelia burgdorferi B31
FFKTKLKQKI

SEQ ID NO: 35331 - protein, 10 aa, Borrelia burgdorferi B31
FKTKLKQKIN

SEQ ID NO: 35332 - protein, 10 aa, Borrelia burgdorferi B31
KTKLKQKINF

SEQ ID NO: 35333 - protein, 10 aa, Borrelia burgdorferi B31
TKLKQKINFK

SEQ ID NO: 35334 - protein, 10 aa, Borrelia burgdorferi B31
KLKQKINFKK

SEQ ID NO: 35335 - protein, 10 aa, Borrelia burgdorferi B31
LKQKINFKKE

SEQ ID NO: 35336 - protein, 10 aa, Borrelia burgdorferi B31
KQKINFKKEL

SEQ ID NO: 35337 - protein, 10 aa, Borrelia burgdorferi B31
QKINFKKELM

SEQ ID NO: 35338 - protein, 10 aa, Borrelia burgdorferi B31
KINFKKELMK

SEQ ID NO: 35339 - protein, 10 aa, Borrelia burgdorferi B31
INFKKELMKS

SEQ ID NO: 35340 - protein, 10 aa, Borrelia burgdorferi B31
NFKKELMKSK

SEQ ID NO: 35341 - protein, 10 aa, Borrelia burgdorferi B31
FKKELMKSKG

SEQ ID NO: 35342 - protein, 10 aa, Borrelia burgdorferi B31
KKELMKSKGI

SEQ ID NO: 35343 - protein, 11 aa, Borrelia burgdorferi B31
MKTIKKDSEFY

SEQ ID NO: 35344 - protein, 11 aa, Borrelia burgdorferi B31
KTIKKDSEFYD

SEQ ID NO: 35345 - protein, 11 aa, Borrelia burgdorferi B31
TIKKDSEFYDS

SEQ ID NO: 35346 - protein, 11 aa, Borrelia burgdorferi B31
IKKDSEFYDSL

SEQ ID NO: 35347 - protein, 11 aa, Borrelia burgdorferi B31
KKDSEFYDSLA

SEQ ID NO: 35348 - protein, 11 aa, Borrelia burgdorferi B31
KDSEFYDSLAT

SEQ ID NO: 35349 - protein, 11 aa, Borrelia burgdorferi B31
DSEFYDSLATL

SEQ ID NO: 35350 - protein, 11 aa, Borrelia burgdorferi B31
SEFYDSLATLK

SEQ ID NO: 35351 - protein, 11 aa, Borrelia burgdorferi B31
EFYDSLATLKK

SEQ ID NO: 35352 - protein, 11 aa, Borrelia burgdorferi B31
FYDSLATLKKH

SEQ ID NO: 35353 - protein, 11 aa, Borrelia burgdorferi B31
YDSLATLKKHI

SEQ ID NO: 35354 - protein, 11 aa, Borrelia burgdorferi B31
DSLATLKKHIN

SEQ ID NO: 35355 - protein, 11 aa, Borrelia burgdorferi B31
SLATLKKHINK

SEQ ID NO: 35356 - protein, 11 aa, Borrelia burgdorferi B31
LATLKKHINKY

SEQ ID NO: 35357 - protein, 11 aa, Borrelia burgdorferi B31
ATLKKHINKYI

SEQ ID NO: 35358 - protein, 11 aa, Borrelia burgdorferi B31
TLKKHINKYIE

SEQ ID NO: 35359 - protein, 11 aa, Borrelia burgdorferi B31
LKKHINKYIEE

SEQ ID NO: 35360 - protein, 11 aa, Borrelia burgdorferi B31
KKHINKYIEEK

SEQ ID NO: 35361 - protein, 11 aa, Borrelia burgdorferi B31
KHINKYIEEKV

SEQ ID NO: 35362 - protein, 11 aa, Borrelia burgdorferi B31
HINKYIEEKVL

SEQ ID NO: 35363 - protein, 11 aa, Borrelia burgdorferi B31
INKYIEEKVLK

SEQ ID NO: 35364 - protein, 11 aa, Borrelia burgdorferi B31
NKYIEEKVLKY

SEQ ID NO: 35365 - protein, 11 aa, Borrelia burgdorferi B31
KYIEEKVLKYS

SEQ ID NO: 35366 - protein, 11 aa, Borrelia burgdorferi B31
YIEEKVLKYSI

SEQ ID NO: 35367 - protein, 11 aa, Borrelia burgdorferi B31
IEEKVLKYSIS

SEQ ID NO: 35368 - protein, 11 aa, Borrelia burgdorferi B31
EEKVLKYSISS

SEQ ID NO: 35369 - protein, 11 aa, Borrelia burgdorferi B31
EKVLKYSISSQ

SEQ ID NO: 35370 - protein, 11 aa, Borrelia burgdorferi B31
KVLKYSISSQL

SEQ ID NO: 35371 - protein, 11 aa, Borrelia burgdorferi B31
VLKYSISSQLY

SEQ ID NO: 35372 - protein, 11 aa, Borrelia burgdorferi B31
LKYSISSQLYK

SEQ ID NO: 35373 - protein, 11 aa, Borrelia burgdorferi B31
KYSISSQLYKL

SEQ ID NO: 35374 - protein, 11 aa, Borrelia burgdorferi B31
YSISSQLYKLE

SEQ ID NO: 35375 - protein, 11 aa, Borrelia burgdorferi B31
SISSQLYKLEK

SEQ ID NO: 35376 - protein, 11 aa, Borrelia burgdorferi B31
ISSQLYKLEKP

SEQ ID NO: 35377 - protein, 11 aa, Borrelia burgdorferi B31
SSQLYKLEKPE

SEQ ID NO: 35378 - protein, 11 aa, Borrelia burgdorferi B31
SQLYKLEKPEI

SEQ ID NO: 35379 - protein, 11 aa, Borrelia burgdorferi B31
QLYKLEKPEII

SEQ ID NO: 35380 - protein, 11 aa, Borrelia burgdorferi B31
LYKLEKPEIIE

SEQ ID NO: 35381 - protein, 11 aa, Borrelia burgdorferi B31
YKLEKPEIIEL

SEQ ID NO: 35382 - protein, 11 aa, Borrelia burgdorferi B31
KLEKPEIIELI

SEQ ID NO: 35383 - protein, 11 aa, Borrelia burgdorferi B31
LEKPEIIELIK

SEQ ID NO: 35384 - protein, 11 aa, Borrelia burgdorferi B31
EKPEIIELIKI

SEQ ID NO: 35385 - protein, 11 aa, Borrelia burgdorferi B31
KPEIIELIKIS

SEQ ID NO: 35386 - protein, 11 aa, Borrelia burgdorferi B31
PEIIELIKISN

SEQ ID NO: 35387 - protein, 11 aa, Borrelia burgdorferi B31
EIIELIKISND

SEQ ID NO: 35388 - protein, 11 aa, Borrelia burgdorferi B31
IIELIKISNDY

SEQ ID NO: 35389 - protein, 11 aa, Borrelia burgdorferi B31
IELIKISNDYE

SEQ ID NO: 35390 - protein, 11 aa, Borrelia burgdorferi B31
ELIKISNDYEK

SEQ ID NO: 35391 - protein, 11 aa, Borrelia burgdorferi B31
LIKISNDYEKE

SEQ ID NO: 35392 - protein, 11 aa, Borrelia burgdorferi B31
IKISNDYEKEK

SEQ ID NO: 35393 - protein, 11 aa, Borrelia burgdorferi B31
KISNDYEKEKN

SEQ ID NO: 35394 - protein, 11 aa, Borrelia burgdorferi B31
ISNDYEKEKNA

SEQ ID NO: 35395 - protein, 11 aa, Borrelia burgdorferi B31
SNDYEKEKNAF

SEQ ID NO: 35396 - protein, 11 aa, Borrelia burgdorferi B31
NDYEKEKNAFN

SEQ ID NO: 35397 - protein, 11 aa, Borrelia burgdorferi B31
DYEKEKNAFNT

SEQ ID NO: 35398 - protein, 11 aa, Borrelia burgdorferi B31
YEKEKNAFNTS

SEQ ID NO: 35399 - protein, 11 aa, Borrelia burgdorferi B31
EKEKNAFNTSL

SEQ ID NO: 35400 - protein, 11 aa, Borrelia burgdorferi B31
KEKNAFNTSLE

SEQ ID NO: 35401 - protein, 11 aa, Borrelia burgdorferi B31
EKNAFNTSLEE

SEQ ID NO: 35402 - protein, 11 aa, Borrelia burgdorferi B31
KNAFNTSLEEC

SEQ ID NO: 35403 - protein, 11 aa, Borrelia burgdorferi B31
NAFNTSLEECY

SEQ ID NO: 35404 - protein, 11 aa, Borrelia burgdorferi B31
AFNTSLEECYY

SEQ ID NO: 35405 - protein, 11 aa, Borrelia burgdorferi B31
FNTSLEECYYK

SEQ ID NO: 35406 - protein, 11 aa, Borrelia burgdorferi B31
NTSLEECYYKN

SEQ ID NO: 35407 - protein, 11 aa, Borrelia burgdorferi B31
TSLEECYYKNT

SEQ ID NO: 35408 - protein, 11 aa, Borrelia burgdorferi B31
SLEECYYKNTQ

SEQ ID NO: 35409 - protein, 11 aa, Borrelia burgdorferi B31
LEECYYKNTQN

SEQ ID NO: 35410 - protein, 11 aa, Borrelia burgdorferi B31
EECYYKNTQNE

SEQ ID NO: 35411 - protein, 11 aa, Borrelia burgdorferi B31
ECYYKNTQNEA

SEQ ID NO: 35412 - protein, 11 aa, Borrelia burgdorferi B31
CYYKNTQNEAI

SEQ ID NO: 35413 - protein, 11 aa, Borrelia burgdorferi B31
YYKNTQNEAIK

SEQ ID NO: 35414 - protein, 11 aa, Borrelia burgdorferi B31
YKNTQNEAIKK

SEQ ID NO: 35415 - protein, 11 aa, Borrelia burgdorferi B31
KNTQNEAIKKW

SEQ ID NO: 35416 - protein, 11 aa, Borrelia burgdorferi B31
NTQNEAIKKWI

SEQ ID NO: 35417 - protein, 11 aa, Borrelia burgdorferi B31
TQNEAIKKWIL

SEQ ID NO: 35418 - protein, 11 aa, Borrelia burgdorferi B31
QNEAIKKWILE

SEQ ID NO: 35419 - protein, 11 aa, Borrelia burgdorferi B31
NEAIKKWILEI

SEQ ID NO: 35420 - protein, 11 aa, Borrelia burgdorferi B31
EAIKKWILEIV

SEQ ID NO: 35421 - protein, 11 aa, Borrelia burgdorferi B31
AIKKWILEIVR

SEQ ID NO: 35422 - protein, 11 aa, Borrelia burgdorferi B31
IKKWILEIVRN

SEQ ID NO: 35423 - protein, 11 aa, Borrelia burgdorferi B31
KKWILEIVRNK

SEQ ID NO: 35424 - protein, 11 aa, Borrelia burgdorferi B31
KWILEIVRNKN

SEQ ID NO: 35425 - protein, 11 aa, Borrelia burgdorferi B31
WILEIVRNKNF

SEQ ID NO: 35426 - protein, 11 aa, Borrelia burgdorferi B31
ILEIVRNKNFI

SEQ ID NO: 35427 - protein, 11 aa, Borrelia burgdorferi B31
LEIVRNKNFIQ

SEQ ID NO: 35428 - protein, 11 aa, Borrelia burgdorferi B31
EIVRNKNFIQI

SEQ ID NO: 35429 - protein, 11 aa, Borrelia burgdorferi B31
IVRNKNFIQIS

SEQ ID NO: 35430 - protein, 11 aa, Borrelia burgdorferi B31
VRNKNFIQISK

SEQ ID NO: 35431 - protein, 11 aa, Borrelia burgdorferi B31
RNKNFIQISKE

SEQ ID NO: 35432 - protein, 11 aa, Borrelia burgdorferi B31
NKNFIQISKEA

SEQ ID NO: 35433 - protein, 11 aa, Borrelia burgdorferi B31
KNFIQISKEAN

SEQ ID NO: 35434 - protein, 11 aa, Borrelia burgdorferi B31
NFIQISKEANL

SEQ ID NO: 35435 - protein, 11 aa, Borrelia burgdorferi B31
FIQISKEANLN

SEQ ID NO: 35436 - protein, 11 aa, Borrelia burgdorferi B31
IQISKEANLNT

SEQ ID NO: 35437 - protein, 11 aa, Borrelia burgdorferi B31
QISKEANLNTK

SEQ ID NO: 35438 - protein, 11 aa, Borrelia burgdorferi B31
ISKEANLNTKK

SEQ ID NO: 35439 - protein, 11 aa, Borrelia burgdorferi B31
SKEANLNTKKL

SEQ ID NO: 35440 - protein, 11 aa, Borrelia burgdorferi B31
KEANLNTKKLG

SEQ ID NO: 35441 - protein, 11 aa, Borrelia burgdorferi B31
EANLNTKKLGT

SEQ ID NO: 35442 - protein, 11 aa, Borrelia burgdorferi B31
ANLNTKKLGTT

SEQ ID NO: 35443 - protein, 11 aa, Borrelia burgdorferi B31
NLNTKKLGTTY

SEQ ID NO: 35444 - protein, 11 aa, Borrelia burgdorferi B31
LNTKKLGTTYK

SEQ ID NO: 35445 - protein, 11 aa, Borrelia burgdorferi B31
NTKKLGTTYKL

SEQ ID NO: 35446 - protein, 11 aa, Borrelia burgdorferi B31
TKKLGTTYKLK

SEQ ID NO: 35447 - protein, 11 aa, Borrelia burgdorferi B31
KKLGTTYKLKS

SEQ ID NO: 35448 - protein, 11 aa, Borrelia burgdorferi B31
KLGTTYKLKSS

SEQ ID NO: 35449 - protein, 11 aa, Borrelia burgdorferi B31
LGTTYKLKSSN

SEQ ID NO: 35450 - protein, 11 aa, Borrelia burgdorferi B31
GTTYKLKSSNF

SEQ ID NO: 35451 - protein, 11 aa, Borrelia burgdorferi B31
TTYKLKSSNFL

SEQ ID NO: 35452 - protein, 11 aa, Borrelia burgdorferi B31
TYKLKSSNFLK

SEQ ID NO: 35453 - protein, 11 aa, Borrelia burgdorferi B31
YKLKSSNFLKL

SEQ ID NO: 35454 - protein, 11 aa, Borrelia burgdorferi B31
KLKSSNFLKLI

SEQ ID NO: 35455 - protein, 11 aa, Borrelia burgdorferi B31
LKSSNFLKLIE

SEQ ID NO: 35456 - protein, 11 aa, Borrelia burgdorferi B31
KSSNFLKLIEI

SEQ ID NO: 35457 - protein, 11 aa, Borrelia burgdorferi B31
SSNFLKLIEIQ

SEQ ID NO: 35458 - protein, 11 aa, Borrelia burgdorferi B31
SNFLKLIEIQN

SEQ ID NO: 35459 - protein, 11 aa, Borrelia burgdorferi B31
NFLKLIEIQNS

SEQ ID NO: 35460 - protein, 11 aa, Borrelia burgdorferi B31
FLKLIEIQNSP

SEQ ID NO: 35461 - protein, 11 aa, Borrelia burgdorferi B31
LKLIEIQNSPY

SEQ ID NO: 35462 - protein, 11 aa, Borrelia burgdorferi B31
KLIEIQNSPYY

SEQ ID NO: 35463 - protein, 11 aa, Borrelia burgdorferi B31
LIEIQNSPYYS

SEQ ID NO: 35464 - protein, 11 aa, Borrelia burgdorferi B31
IEIQNSPYYSQ

SEQ ID NO: 35465 - protein, 11 aa, Borrelia burgdorferi B31
EIQNSPYYSQE

SEQ ID NO: 35466 - protein, 11 aa, Borrelia burgdorferi B31
IQNSPYYSQEK

SEQ ID NO: 35467 - protein, 11 aa, Borrelia burgdorferi B31
QNSPYYSQEKK

SEQ ID NO: 35468 - protein, 11 aa, Borrelia burgdorferi B31
NSPYYSQEKKD

SEQ ID NO: 35469 - protein, 11 aa, Borrelia burgdorferi B31
SPYYSQEKKDI

SEQ ID NO: 35470 - protein, 11 aa, Borrelia burgdorferi B31
PYYSQEKKDIY

SEQ ID NO: 35471 - protein, 11 aa, Borrelia burgdorferi B31
YYSQEKKDIYK

SEQ ID NO: 35472 - protein, 11 aa, Borrelia burgdorferi B31
YSQEKKDIYKQ

SEQ ID NO: 35473 - protein, 11 aa, Borrelia burgdorferi B31
SQEKKDIYKQI

SEQ ID NO: 35474 - protein, 11 aa, Borrelia burgdorferi B31
QEKKDIYKQII

SEQ ID NO: 35475 - protein, 11 aa, Borrelia burgdorferi B31
EKKDIYKQIIL

SEQ ID NO: 35476 - protein, 11 aa, Borrelia burgdorferi B31
KKDIYKQIILN

SEQ ID NO: 35477 - protein, 11 aa, Borrelia burgdorferi B31
KDIYKQIILNF

SEQ ID NO: 35478 - protein, 11 aa, Borrelia burgdorferi B31
DIYKQIILNFS

SEQ ID NO: 35479 - protein, 11 aa, Borrelia burgdorferi B31
IYKQIILNFSS

SEQ ID NO: 35480 - protein, 11 aa, Borrelia burgdorferi B31
YKQIILNFSSN

SEQ ID NO: 35481 - protein, 11 aa, Borrelia burgdorferi B31
KQIILNFSSNI

SEQ ID NO: 35482 - protein, 11 aa, Borrelia burgdorferi B31
QIILNFSSNIN

SEQ ID NO: 35483 - protein, 11 aa, Borrelia burgdorferi B31
IILNFSSNINI

SEQ ID NO: 35484 - protein, 11 aa, Borrelia burgdorferi B31
ILNFSSNINID

SEQ ID NO: 35485 - protein, 11 aa, Borrelia burgdorferi B31
LNFSSNINIDS

SEQ ID NO: 35486 - protein, 11 aa, Borrelia burgdorferi B31
NFSSNINIDSL

SEQ ID NO: 35487 - protein, 11 aa, Borrelia burgdorferi B31
FSSNINIDSLE

SEQ ID NO: 35488 - protein, 11 aa, Borrelia burgdorferi B31
SSNINIDSLEQ

SEQ ID NO: 35489 - protein, 11 aa, Borrelia burgdorferi B31
SNINIDSLEQT

SEQ ID NO: 35490 - protein, 11 aa, Borrelia burgdorferi B31
NINIDSLEQTI

SEQ ID NO: 35491 - protein, 11 aa, Borrelia burgdorferi B31
INIDSLEQTID

SEQ ID NO: 35492 - protein, 11 aa, Borrelia burgdorferi B31
NIDSLEQTIDI

SEQ ID NO: 35493 - protein, 11 aa, Borrelia burgdorferi B31
IDSLEQTIDIL

SEQ ID NO: 35494 - protein, 11 aa, Borrelia burgdorferi B31
DSLEQTIDILV

SEQ ID NO: 35495 - protein, 11 aa, Borrelia burgdorferi B31
SLEQTIDILVA

SEQ ID NO: 35496 - protein, 11 aa, Borrelia burgdorferi B31
LEQTIDILVAV

SEQ ID NO: 35497 - protein, 11 aa, Borrelia burgdorferi B31
EQTIDILVAVR

SEQ ID NO: 35498 - protein, 11 aa, Borrelia burgdorferi B31
QTIDILVAVRN

SEQ ID NO: 35499 - protein, 11 aa, Borrelia burgdorferi B31
TIDILVAVRNR

SEQ ID NO: 35500 - protein, 11 aa, Borrelia burgdorferi B31
IDILVAVRNRN

SEQ ID NO: 35501 - protein, 11 aa, Borrelia burgdorferi B31
DILVAVRNRNK

SEQ ID NO: 35502 - protein, 11 aa, Borrelia burgdorferi B31
ILVAVRNRNKI

SEQ ID NO: 35503 - protein, 11 aa, Borrelia burgdorferi B31
LVAVRNRNKIK

SEQ ID NO: 35504 - protein, 11 aa, Borrelia burgdorferi B31
VAVRNRNKIKI

SEQ ID NO: 35505 - protein, 11 aa, Borrelia burgdorferi B31
AVRNRNKIKIL

SEQ ID NO: 35506 - protein, 11 aa, Borrelia burgdorferi B31
VRNRNKIKILN

SEQ ID NO: 35507 - protein, 11 aa, Borrelia burgdorferi B31
RNRNKIKILNI

SEQ ID NO: 35508 - protein, 11 aa, Borrelia burgdorferi B31
NRNKIKILNIL

SEQ ID NO: 35509 - protein, 11 aa, Borrelia burgdorferi B31
RNKIKILNILN

SEQ ID NO: 35510 - protein, 11 aa, Borrelia burgdorferi B31
NKIKILNILNK

SEQ ID NO: 35511 - protein, 11 aa, Borrelia burgdorferi B31
KIKILNILNKN

SEQ ID NO: 35512 - protein, 11 aa, Borrelia burgdorferi B31
IKILNILNKNL

SEQ ID NO: 35513 - protein, 11 aa, Borrelia burgdorferi B31
KILNILNKNLK

SEQ ID NO: 35514 - protein, 11 aa, Borrelia burgdorferi B31
ILNILNKNLKY

SEQ ID NO: 35515 - protein, 11 aa, Borrelia burgdorferi B31
LNILNKNLKYR

SEQ ID NO: 35516 - protein, 11 aa, Borrelia burgdorferi B31
NILNKNLKYRP

SEQ ID NO: 35517 - protein, 11 aa, Borrelia burgdorferi B31
ILNKNLKYRPE

SEQ ID NO: 35518 - protein, 11 aa, Borrelia burgdorferi B31
LNKNLKYRPEN

SEQ ID NO: 35519 - protein, 11 aa, Borrelia burgdorferi B31
NKNLKYRPENQ

SEQ ID NO: 35520 - protein, 11 aa, Borrelia burgdorferi B31
KNLKYRPENQK

SEQ ID NO: 35521 - protein, 11 aa, Borrelia burgdorferi B31
NLKYRPENQKV

SEQ ID NO: 35522 - protein, 11 aa, Borrelia burgdorferi B31
LKYRPENQKVF

SEQ ID NO: 35523 - protein, 11 aa, Borrelia burgdorferi B31
KYRPENQKVFK

SEQ ID NO: 35524 - protein, 11 aa, Borrelia burgdorferi B31
YRPENQKVFKS

SEQ ID NO: 35525 - protein, 11 aa, Borrelia burgdorferi B31
RPENQKVFKSS

SEQ ID NO: 35526 - protein, 11 aa, Borrelia burgdorferi B31
PENQKVFKSSL

SEQ ID NO: 35527 - protein, 11 aa, Borrelia burgdorferi B31
ENQKVFKSSLT

SEQ ID NO: 35528 - protein, 11 aa, Borrelia burgdorferi B31
NQKVFKSSLTN

SEQ ID NO: 35529 - protein, 11 aa, Borrelia burgdorferi B31
QKVFKSSLTNK

SEQ ID NO: 35530 - protein, 11 aa, Borrelia burgdorferi B31
KVFKSSLTNKE

SEQ ID NO: 35531 - protein, 11 aa, Borrelia burgdorferi B31
VFKSSLTNKES

SEQ ID NO: 35532 - protein, 11 aa, Borrelia burgdorferi B31
FKSSLTNKESR

SEQ ID NO: 35533 - protein, 11 aa, Borrelia burgdorferi B31
KSSLTNKESRL

SEQ ID NO: 35534 - protein, 11 aa, Borrelia burgdorferi B31
SSLTNKESRLI

SEQ ID NO: 35535 - protein, 11 aa, Borrelia burgdorferi B31
SLTNKESRLIK

SEQ ID NO: 35536 - protein, 11 aa, Borrelia burgdorferi B31
LTNKESRLIKL

SEQ ID NO: 35537 - protein, 11 aa, Borrelia burgdorferi B31
TNKESRLIKLK

SEQ ID NO: 35538 - protein, 11 aa, Borrelia burgdorferi B31
NKESRLIKLKR

SEQ ID NO: 35539 - protein, 11 aa, Borrelia burgdorferi B31
KESRLIKLKRM

SEQ ID NO: 35540 - protein, 11 aa, Borrelia burgdorferi B31
ESRLIKLKRML

SEQ ID NO: 35541 - protein, 11 aa, Borrelia burgdorferi B31
SRLIKLKRMLI

SEQ ID NO: 35542 - protein, 11 aa, Borrelia burgdorferi B31
RLIKLKRMLIL

SEQ ID NO: 35543 - protein, 11 aa, Borrelia burgdorferi B31
LIKLKRMLILT

SEQ ID NO: 35544 - protein, 11 aa, Borrelia burgdorferi B31
IKLKRMLILTY

SEQ ID NO: 35545 - protein, 11 aa, Borrelia burgdorferi B31
KLKRMLILTYW

SEQ ID NO: 35546 - protein, 11 aa, Borrelia burgdorferi B31
LKRMLILTYWP

SEQ ID NO: 35547 - protein, 11 aa, Borrelia burgdorferi B31
KRMLILTYWPV

SEQ ID NO: 35548 - protein, 11 aa, Borrelia burgdorferi B31
RMLILTYWPVG

SEQ ID NO: 35549 - protein, 11 aa, Borrelia burgdorferi B31
MLILTYWPVGC

SEQ ID NO: 35550 - protein, 11 aa, Borrelia burgdorferi B31
LILTYWPVGCL

SEQ ID NO: 35551 - protein, 11 aa, Borrelia burgdorferi B31
ILTYWPVGCLS

SEQ ID NO: 35552 - protein, 11 aa, Borrelia burgdorferi B31
LTYWPVGCLSK

SEQ ID NO: 35553 - protein, 11 aa, Borrelia burgdorferi B31
TYWPVGCLSKN

SEQ ID NO: 35554 - protein, 11 aa, Borrelia burgdorferi B31
YWPVGCLSKNI

SEQ ID NO: 35555 - protein, 11 aa, Borrelia burgdorferi B31
WPVGCLSKNIF

SEQ ID NO: 35556 - protein, 11 aa, Borrelia burgdorferi B31
PVGCLSKNIFI

SEQ ID NO: 35557 - protein, 11 aa, Borrelia burgdorferi B31
VGCLSKNIFIK

SEQ ID NO: 35558 - protein, 11 aa, Borrelia burgdorferi B31
GCLSKNIFIKI

SEQ ID NO: 35559 - protein, 11 aa, Borrelia burgdorferi B31
CLSKNIFIKIL

SEQ ID NO: 35560 - protein, 11 aa, Borrelia burgdorferi B31
LSKNIFIKILI

SEQ ID NO: 35561 - protein, 11 aa, Borrelia burgdorferi B31
SKNIFIKILIK

SEQ ID NO: 35562 - protein, 11 aa, Borrelia burgdorferi B31
  Xaa can be any naturally occurring amino acid
  VARIANT 11: Xaa = Any Amino Acid
KNIFIKILIKX

SEQ ID NO: 35563 - protein, 11 aa, Borrelia burgdorferi B31
  Xaa can be any naturally occurring amino acid
  VARIANT 10: Xaa = Any Amino Acid
NIFIKILIKXY

SEQ ID NO: 35564 - protein, 11 aa, Borrelia burgdorferi B31
  Xaa can be any naturally occurring amino acid
  VARIANT 9: Xaa = Any Amino Acid
IFIKILIKXYK

SEQ ID NO: 35565 - protein, 11 aa, Borrelia burgdorferi B31
  Xaa can be any naturally occurring amino acid
  VARIANT 8: Xaa = Any Amino Acid
FIKILIKXYKY

SEQ ID NO: 35566 - protein, 11 aa, Borrelia burgdorferi B31
  Xaa can be any naturally occurring amino acid
  VARIANT 7: Xaa = Any Amino Acid
IKILIKXYKYL

SEQ ID NO: 35567 - protein, 11 aa, Borrelia burgdorferi B31
  Xaa can be any naturally occurring amino acid
  VARIANT 6: Xaa = Any Amino Acid
KILIKXYKYLE

SEQ ID NO: 35568 - protein, 11 aa, Borrelia burgdorferi B31
  Xaa can be any naturally occurring amino acid
  VARIANT 5: Xaa = Any Amino Acid
ILIKXYKYLEE

SEQ ID NO: 35569 - protein, 11 aa, Borrelia burgdorferi B31
  Xaa can be any naturally occurring amino acid
  VARIANT 4: Xaa = Any Amino Acid
LIKXYKYLEEE

SEQ ID NO: 35570 - protein, 11 aa, Borrelia burgdorferi B31
  Xaa can be any naturally occurring amino acid
  VARIANT 3: Xaa = Any Amino Acid
IKXYKYLEEEI

SEQ ID NO: 35571 - protein, 11 aa, Borrelia burgdorferi B31
  Xaa can be any naturally occurring amino acid
  VARIANT 2: Xaa = Any Amino Acid
KXYKYLEEEIL

SEQ ID NO: 35572 - protein, 11 aa, Borrelia burgdorferi B31
  Xaa can be any naturally occurring amino acid
  VARIANT 1: Xaa = Any Amino Acid
XYKYLEEEILA

SEQ ID NO: 35573 - protein, 11 aa, Borrelia burgdorferi B31
YKYLEEEILAL

SEQ ID NO: 35574 - protein, 11 aa, Borrelia burgdorferi B31
KYLEEEILALK

SEQ ID NO: 35575 - protein, 11 aa, Borrelia burgdorferi B31
YLEEEILALKY

SEQ ID NO: 35576 - protein, 11 aa, Borrelia burgdorferi B31
LEEEILALKYN

SEQ ID NO: 35577 - protein, 11 aa, Borrelia burgdorferi B31
EEEILALKYNE

SEQ ID NO: 35578 - protein, 11 aa, Borrelia burgdorferi B31
EEILALKYNEI

SEQ ID NO: 35579 - protein, 11 aa, Borrelia burgdorferi B31
EILALKYNEIL

SEQ ID NO: 35580 - protein, 11 aa, Borrelia burgdorferi B31
ILALKYNEILN

SEQ ID NO: 35581 - protein, 11 aa, Borrelia burgdorferi B31
LALKYNEILNY

SEQ ID NO: 35582 - protein, 11 aa, Borrelia burgdorferi B31
ALKYNEILNYL

SEQ ID NO: 35583 - protein, 11 aa, Borrelia burgdorferi B31
LKYNEILNYLR

SEQ ID NO: 35584 - protein, 11 aa, Borrelia burgdorferi B31
KYNEILNYLRA

SEQ ID NO: 35585 - protein, 11 aa, Borrelia burgdorferi B31
YNEILNYLRAL

SEQ ID NO: 35586 - protein, 11 aa, Borrelia burgdorferi B31
NEILNYLRALK

SEQ ID NO: 35587 - protein, 11 aa, Borrelia burgdorferi B31
EILNYLRALKT

SEQ ID NO: 35588 - protein, 11 aa, Borrelia burgdorferi B31
ILNYLRALKTL

SEQ ID NO: 35589 - protein, 11 aa, Borrelia burgdorferi B31
LNYLRALKTLS

SEQ ID NO: 35590 - protein, 11 aa, Borrelia burgdorferi B31
NYLRALKTLSL

SEQ ID NO: 35591 - protein, 11 aa, Borrelia burgdorferi B31
YLRALKTLSLN

SEQ ID NO: 35592 - protein, 11 aa, Borrelia burgdorferi B31
LRALKTLSLNE

SEQ ID NO: 35593 - protein, 11 aa, Borrelia burgdorferi B31
RALKTLSLNEI

SEQ ID NO: 35594 - protein, 11 aa, Borrelia burgdorferi B31
ALKTLSLNEIF

SEQ ID NO: 35595 - protein, 11 aa, Borrelia burgdorferi B31
LKTLSLNEIFY

SEQ ID NO: 35596 - protein, 11 aa, Borrelia burgdorferi B31
KTLSLNEIFYK

SEQ ID NO: 35597 - protein, 11 aa, Borrelia burgdorferi B31
TLSLNEIFYKG

SEQ ID NO: 35598 - protein, 11 aa, Borrelia burgdorferi B31
LSLNEIFYKGS

SEQ ID NO: 35599 - protein, 11 aa, Borrelia burgdorferi B31
SLNEIFYKGSS

SEQ ID NO: 35600 - protein, 11 aa, Borrelia burgdorferi B31
LNEIFYKGSSK

SEQ ID NO: 35601 - protein, 11 aa, Borrelia burgdorferi B31
NEIFYKGSSKN

SEQ ID NO: 35602 - protein, 11 aa, Borrelia burgdorferi B31
EIFYKGSSKNI

SEQ ID NO: 35603 - protein, 11 aa, Borrelia burgdorferi B31
IFYKGSSKNIS

SEQ ID NO: 35604 - protein, 11 aa, Borrelia burgdorferi B31
FYKGSSKNISF

SEQ ID NO: 35605 - protein, 11 aa, Borrelia burgdorferi B31
YKGSSKNISFN

SEQ ID NO: 35606 - protein, 11 aa, Borrelia burgdorferi B31
KGSSKNISFNY

SEQ ID NO: 35607 - protein, 11 aa, Borrelia burgdorferi B31
GSSKNISFNYF

SEQ ID NO: 35608 - protein, 11 aa, Borrelia burgdorferi B31
SSKNISFNYFF

SEQ ID NO: 35609 - protein, 11 aa, Borrelia burgdorferi B31
SKNISFNYFFS

SEQ ID NO: 35610 - protein, 11 aa, Borrelia burgdorferi B31
KNISFNYFFSD

SEQ ID NO: 35611 - protein, 11 aa, Borrelia burgdorferi B31
NISFNYFFSDF

SEQ ID NO: 35612 - protein, 11 aa, Borrelia burgdorferi B31
ISFNYFFSDFT

SEQ ID NO: 35613 - protein, 11 aa, Borrelia burgdorferi B31
SFNYFFSDFTQ

SEQ ID NO: 35614 - protein, 11 aa, Borrelia burgdorferi B31
FNYFFSDFTQY

SEQ ID NO: 35615 - protein, 11 aa, Borrelia burgdorferi B31
NYFFSDFTQYA

SEQ ID NO: 35616 - protein, 11 aa, Borrelia burgdorferi B31
YFFSDFTQYAP

SEQ ID NO: 35617 - protein, 11 aa, Borrelia burgdorferi B31
FFSDFTQYAPK

SEQ ID NO: 35618 - protein, 11 aa, Borrelia burgdorferi B31
FSDFTQYAPKD

SEQ ID NO: 35619 - protein, 11 aa, Borrelia burgdorferi B31
SDFTQYAPKDF

SEQ ID NO: 35620 - protein, 11 aa, Borrelia burgdorferi B31
DFTQYAPKDFQ

SEQ ID NO: 35621 - protein, 11 aa, Borrelia burgdorferi B31
FTQYAPKDFQD

SEQ ID NO: 35622 - protein, 11 aa, Borrelia burgdorferi B31
TQYAPKDFQDT

SEQ ID NO: 35623 - protein, 11 aa, Borrelia burgdorferi B31
QYAPKDFQDTL

SEQ ID NO: 35624 - protein, 11 aa, Borrelia burgdorferi B31
YAPKDFQDTLK

SEQ ID NO: 35625 - protein, 11 aa, Borrelia burgdorferi B31
APKDFQDTLKC

SEQ ID NO: 35626 - protein, 11 aa, Borrelia burgdorferi B31
PKDFQDTLKCY

SEQ ID NO: 35627 - protein, 11 aa, Borrelia burgdorferi B31
KDFQDTLKCYL

SEQ ID NO: 35628 - protein, 11 aa, Borrelia burgdorferi B31
DFQDTLKCYLY

SEQ ID NO: 35629 - protein, 11 aa, Borrelia burgdorferi B31
FQDTLKCYLYV

SEQ ID NO: 35630 - protein, 11 aa, Borrelia burgdorferi B31
QDTLKCYLYVI

SEQ ID NO: 35631 - protein, 11 aa, Borrelia burgdorferi B31
DTLKCYLYVIE

SEQ ID NO: 35632 - protein, 11 aa, Borrelia burgdorferi B31
TLKCYLYVIEK

SEQ ID NO: 35633 - protein, 11 aa, Borrelia burgdorferi B31
LKCYLYVIEKT

SEQ ID NO: 35634 - protein, 11 aa, Borrelia burgdorferi B31
KCYLYVIEKTI

SEQ ID NO: 35635 - protein, 11 aa, Borrelia burgdorferi B31
CYLYVIEKTIT

SEQ ID NO: 35636 - protein, 11 aa, Borrelia burgdorferi B31
YLYVIEKTITK

SEQ ID NO: 35637 - protein, 11 aa, Borrelia burgdorferi B31
LYVIEKTITKK

SEQ ID NO: 35638 - protein, 11 aa, Borrelia burgdorferi B31
YVIEKTITKKY

SEQ ID NO: 35639 - protein, 11 aa, Borrelia burgdorferi B31
VIEKTITKKYL

SEQ ID NO: 35640 - protein, 11 aa, Borrelia burgdorferi B31
IEKTITKKYLT

SEQ ID NO: 35641 - protein, 11 aa, Borrelia burgdorferi B31
EKTITKKYLTW

SEQ ID NO: 35642 - protein, 11 aa, Borrelia burgdorferi B31
KTITKKYLTWF

SEQ ID NO: 35643 - protein, 11 aa, Borrelia burgdorferi B31
TITKKYLTWFF

SEQ ID NO: 35644 - protein, 11 aa, Borrelia burgdorferi B31
ITKKYLTWFFK

SEQ ID NO: 35645 - protein, 11 aa, Borrelia burgdorferi B31
TKKYLTWFFKD

SEQ ID NO: 35646 - protein, 11 aa, Borrelia burgdorferi B31
KKYLTWFFKDK

SEQ ID NO: 35647 - protein, 11 aa, Borrelia burgdorferi B31
KYLTWFFKDKI

SEQ ID NO: 35648 - protein, 11 aa, Borrelia burgdorferi B31
YLTWFFKDKIS

SEQ ID NO: 35649 - protein, 11 aa, Borrelia burgdorferi B31
LTWFFKDKISN

SEQ ID NO: 35650 - protein, 11 aa, Borrelia burgdorferi B31
TWFFKDKISNN

SEQ ID NO: 35651 - protein, 11 aa, Borrelia burgdorferi B31
WFFKDKISNNW

SEQ ID NO: 35652 - protein, 11 aa, Borrelia burgdorferi B31
FFKDKISNNWE

SEQ ID NO: 35653 - protein, 11 aa, Borrelia burgdorferi B31
FKDKISNNWES

SEQ ID NO: 35654 - protein, 11 aa, Borrelia burgdorferi B31
KDKISNNWESF

SEQ ID NO: 35655 - protein, 11 aa, Borrelia burgdorferi B31
DKISNNWESFI

SEQ ID NO: 35656 - protein, 11 aa, Borrelia burgdorferi B31
KISNNWESFID

SEQ ID NO: 35657 - protein, 11 aa, Borrelia burgdorferi B31
ISNNWESFIDA

SEQ ID NO: 35658 - protein, 11 aa, Borrelia burgdorferi B31
SNNWESFIDAL

SEQ ID NO: 35659 - protein, 11 aa, Borrelia burgdorferi B31
NNWESFIDALE

SEQ ID NO: 35660 - protein, 11 aa, Borrelia burgdorferi B31
NWESFIDALEY

SEQ ID NO: 35661 - protein, 11 aa, Borrelia burgdorferi B31
WESFIDALEYI

SEQ ID NO: 35662 - protein, 11 aa, Borrelia burgdorferi B31
ESFIDALEYIE

SEQ ID NO: 35663 - protein, 11 aa, Borrelia burgdorferi B31
SFIDALEYIEK

SEQ ID NO: 35664 - protein, 11 aa, Borrelia burgdorferi B31
FIDALEYIEKH

SEQ ID NO: 35665 - protein, 11 aa, Borrelia burgdorferi B31
IDALEYIEKHK

SEQ ID NO: 35666 - protein, 11 aa, Borrelia burgdorferi B31
DALEYIEKHKL

SEQ ID NO: 35667 - protein, 11 aa, Borrelia burgdorferi B31
ALEYIEKHKLI

SEQ ID NO: 35668 - protein, 11 aa, Borrelia burgdorferi B31
LEYIEKHKLIN

SEQ ID NO: 35669 - protein, 11 aa, Borrelia burgdorferi B31
EYIEKHKLINI

SEQ ID NO: 35670 - protein, 11 aa, Borrelia burgdorferi B31
YIEKHKLINIK

SEQ ID NO: 35671 - protein, 11 aa, Borrelia burgdorferi B31
IEKHKLINIKE

SEQ ID NO: 35672 - protein, 11 aa, Borrelia burgdorferi B31
EKHKLINIKEK

SEQ ID NO: 35673 - protein, 11 aa, Borrelia burgdorferi B31
KHKLINIKEKI

SEQ ID NO: 35674 - protein, 11 aa, Borrelia burgdorferi B31
HKLINIKEKIK

SEQ ID NO: 35675 - protein, 11 aa, Borrelia burgdorferi B31
KLINIKEKIKE

SEQ ID NO: 35676 - protein, 11 aa, Borrelia burgdorferi B31
LINIKEKIKEI

SEQ ID NO: 35677 - protein, 11 aa, Borrelia burgdorferi B31
INIKEKIKEII

SEQ ID NO: 35678 - protein, 11 aa, Borrelia burgdorferi B31
NIKEKIKEIIT

SEQ ID NO: 35679 - protein, 11 aa, Borrelia burgdorferi B31
IKEKIKEIITA

SEQ ID NO: 35680 - protein, 11 aa, Borrelia burgdorferi B31
KEKIKEIITAK

SEQ ID NO: 35681 - protein, 11 aa, Borrelia burgdorferi B31
EKIKEIITAKF

SEQ ID NO: 35682 - protein, 11 aa, Borrelia burgdorferi B31
KIKEIITAKFQ

SEQ ID NO: 35683 - protein, 11 aa, Borrelia burgdorferi B31
IKEIITAKFQT

SEQ ID NO: 35684 - protein, 11 aa, Borrelia burgdorferi B31
KEIITAKFQTE

SEQ ID NO: 35685 - protein, 11 aa, Borrelia burgdorferi B31
EIITAKFQTED

SEQ ID NO: 35686 - protein, 11 aa, Borrelia burgdorferi B31
IITAKFQTEDF

SEQ ID NO: 35687 - protein, 11 aa, Borrelia burgdorferi B31
ITAKFQTEDFF

SEQ ID NO: 35688 - protein, 11 aa, Borrelia burgdorferi B31
TAKFQTEDFFI

SEQ ID NO: 35689 - protein, 11 aa, Borrelia burgdorferi B31
AKFQTEDFFIS

SEQ ID NO: 35690 - protein, 11 aa, Borrelia burgdorferi B31
KFQTEDFFISF

SEQ ID NO: 35691 - protein, 11 aa, Borrelia burgdorferi B31
FQTEDFFISFD

SEQ ID NO: 35692 - protein, 11 aa, Borrelia burgdorferi B31
QTEDFFISFDK

SEQ ID NO: 35693 - protein, 11 aa, Borrelia burgdorferi B31
TEDFFISFDKT

SEQ ID NO: 35694 - protein, 11 aa, Borrelia burgdorferi B31
EDFFISFDKTN

SEQ ID NO: 35695 - protein, 11 aa, Borrelia burgdorferi B31
DFFISFDKTNF

SEQ ID NO: 35696 - protein, 11 aa, Borrelia burgdorferi B31
FFISFDKTNFN

SEQ ID NO: 35697 - protein, 11 aa, Borrelia burgdorferi B31
FISFDKTNFNP

SEQ ID NO: 35698 - protein, 11 aa, Borrelia burgdorferi B31
ISFDKTNFNPY

SEQ ID NO: 35699 - protein, 11 aa, Borrelia burgdorferi B31
SFDKTNFNPYE

SEQ ID NO: 35700 - protein, 11 aa, Borrelia burgdorferi B31
FDKTNFNPYES

SEQ ID NO: 35701 - protein, 11 aa, Borrelia burgdorferi B31
DKTNFNPYESS

SEQ ID NO: 35702 - protein, 11 aa, Borrelia burgdorferi B31
KTNFNPYESSI

SEQ ID NO: 35703 - protein, 11 aa, Borrelia burgdorferi B31
TNFNPYESSIF

SEQ ID NO: 35704 - protein, 11 aa, Borrelia burgdorferi B31
NFNPYESSIFK

SEQ ID NO: 35705 - protein, 11 aa, Borrelia burgdorferi B31
FNPYESSIFKE

SEQ ID NO: 35706 - protein, 11 aa, Borrelia burgdorferi B31
NPYESSIFKER

SEQ ID NO: 35707 - protein, 11 aa, Borrelia burgdorferi B31
PYESSIFKERY

SEQ ID NO: 35708 - protein, 11 aa, Borrelia burgdorferi B31
YESSIFKERYI

SEQ ID NO: 35709 - protein, 11 aa, Borrelia burgdorferi B31
ESSIFKERYIK

SEQ ID NO: 35710 - protein, 11 aa, Borrelia burgdorferi B31
SSIFKERYIKS

SEQ ID NO: 35711 - protein, 11 aa, Borrelia burgdorferi B31
SIFKERYIKSA

SEQ ID NO: 35712 - protein, 11 aa, Borrelia burgdorferi B31
IFKERYIKSAF

SEQ ID NO: 35713 - protein, 11 aa, Borrelia burgdorferi B31
FKERYIKSAFL

SEQ ID NO: 35714 - protein, 11 aa, Borrelia burgdorferi B31
KERYIKSAFLE

SEQ ID NO: 35715 - protein, 11 aa, Borrelia burgdorferi B31
ERYIKSAFLEI

SEQ ID NO: 35716 - protein, 11 aa, Borrelia burgdorferi B31
RYIKSAFLEII

SEQ ID NO: 35717 - protein, 11 aa, Borrelia burgdorferi B31
YIKSAFLEIIM

SEQ ID NO: 35718 - protein, 11 aa, Borrelia burgdorferi B31
IKSAFLEIIMH

SEQ ID NO: 35719 - protein, 11 aa, Borrelia burgdorferi B31
KSAFLEIIMHY

SEQ ID NO: 35720 - protein, 11 aa, Borrelia burgdorferi B31
SAFLEIIMHYV

SEQ ID NO: 35721 - protein, 11 aa, Borrelia burgdorferi B31
AFLEIIMHYVK

SEQ ID NO: 35722 - protein, 11 aa, Borrelia burgdorferi B31
FLEIIMHYVKK

SEQ ID NO: 35723 - protein, 11 aa, Borrelia burgdorferi B31
LEIIMHYVKKN

SEQ ID NO: 35724 - protein, 11 aa, Borrelia burgdorferi B31
EIIMHYVKKNS

SEQ ID NO: 35725 - protein, 11 aa, Borrelia burgdorferi B31
IIMHYVKKNSQ

SEQ ID NO: 35726 - protein, 11 aa, Borrelia burgdorferi B31
IMHYVKKNSQN

SEQ ID NO: 35727 - protein, 11 aa, Borrelia burgdorferi B31
MHYVKKNSQNI

SEQ ID NO: 35728 - protein, 11 aa, Borrelia burgdorferi B31
HYVKKNSQNIE

SEQ ID NO: 35729 - protein, 11 aa, Borrelia burgdorferi B31
YVKKNSQNIET

SEQ ID NO: 35730 - protein, 11 aa, Borrelia burgdorferi B31
VKKNSQNIETY

SEQ ID NO: 35731 - protein, 11 aa, Borrelia burgdorferi B31
KKNSQNIETYG

SEQ ID NO: 35732 - protein, 11 aa, Borrelia burgdorferi B31
KNSQNIETYGW

SEQ ID NO: 35733 - protein, 11 aa, Borrelia burgdorferi B31
NSQNIETYGWI

SEQ ID NO: 35734 - protein, 11 aa, Borrelia burgdorferi B31
SQNIETYGWIA

SEQ ID NO: 35735 - protein, 11 aa, Borrelia burgdorferi B31
QNIETYGWIAF

SEQ ID NO: 35736 - protein, 11 aa, Borrelia burgdorferi B31
NIETYGWIAFY

SEQ ID NO: 35737 - protein, 11 aa, Borrelia burgdorferi B31
IETYGWIAFYI

SEQ ID NO: 35738 - protein, 11 aa, Borrelia burgdorferi B31
ETYGWIAFYIY

SEQ ID NO: 35739 - protein, 11 aa, Borrelia burgdorferi B31
TYGWIAFYIYA

SEQ ID NO: 35740 - protein, 11 aa, Borrelia burgdorferi B31
YGWIAFYIYAD

SEQ ID NO: 35741 - protein, 11 aa, Borrelia burgdorferi B31
GWIAFYIYADN

SEQ ID NO: 35742 - protein, 11 aa, Borrelia burgdorferi B31
WIAFYIYADNK

SEQ ID NO: 35743 - protein, 11 aa, Borrelia burgdorferi B31
IAFYIYADNKD

SEQ ID NO: 35744 - protein, 11 aa, Borrelia burgdorferi B31
AFYIYADNKDK

SEQ ID NO: 35745 - protein, 11 aa, Borrelia burgdorferi B31
FYIYADNKDKK

SEQ ID NO: 35746 - protein, 11 aa, Borrelia burgdorferi B31
YIYADNKDKKI

SEQ ID NO: 35747 - protein, 11 aa, Borrelia burgdorferi B31
IYADNKDKKIF

SEQ ID NO: 35748 - protein, 11 aa, Borrelia burgdorferi B31
YADNKDKKIFC

SEQ ID NO: 35749 - protein, 11 aa, Borrelia burgdorferi B31
ADNKDKKIFCQ

SEQ ID NO: 35750 - protein, 11 aa, Borrelia burgdorferi B31
DNKDKKIFCQR

SEQ ID NO: 35751 - protein, 11 aa, Borrelia burgdorferi B31
NKDKKIFCQRM

SEQ ID NO: 35752 - protein, 11 aa, Borrelia burgdorferi B31
KDKKIFCQRMK

SEQ ID NO: 35753 - protein, 11 aa, Borrelia burgdorferi B31
DKKIFCQRMKE

SEQ ID NO: 35754 - protein, 11 aa, Borrelia burgdorferi B31
KKIFCQRMKEF

SEQ ID NO: 35755 - protein, 11 aa, Borrelia burgdorferi B31
KIFCQRMKEFF

SEQ ID NO: 35756 - protein, 11 aa, Borrelia burgdorferi B31
IFCQRMKEFFK

SEQ ID NO: 35757 - protein, 11 aa, Borrelia burgdorferi B31
FCQRMKEFFKS

SEQ ID NO: 35758 - protein, 11 aa, Borrelia burgdorferi B31
CQRMKEFFKSK

SEQ ID NO: 35759 - protein, 11 aa, Borrelia burgdorferi B31
QRMKEFFKSKT

SEQ ID NO: 35760 - protein, 11 aa, Borrelia burgdorferi B31
RMKEFFKSKTF

SEQ ID NO: 35761 - protein, 11 aa, Borrelia burgdorferi B31
MKEFFKSKTFE

SEQ ID NO: 35762 - protein, 11 aa, Borrelia burgdorferi B31
KEFFKSKTFEI

SEQ ID NO: 35763 - protein, 11 aa, Borrelia burgdorferi B31
EFFKSKTFEIQ

SEQ ID NO: 35764 - protein, 11 aa, Borrelia burgdorferi B31
FFKSKTFEIQN

SEQ ID NO: 35765 - protein, 11 aa, Borrelia burgdorferi B31
FKSKTFEIQNQ

SEQ ID NO: 35766 - protein, 11 aa, Borrelia burgdorferi B31
KSKTFEIQNQI

SEQ ID NO: 35767 - protein, 11 aa, Borrelia burgdorferi B31
SKTFEIQNQIF

SEQ ID NO: 35768 - protein, 11 aa, Borrelia burgdorferi B31
KTFEIQNQIFV

SEQ ID NO: 35769 - protein, 11 aa, Borrelia burgdorferi B31
TFEIQNQIFVY

SEQ ID NO: 35770 - protein, 11 aa, Borrelia burgdorferi B31
FEIQNQIFVYF

SEQ ID NO: 35771 - protein, 11 aa, Borrelia burgdorferi B31
EIQNQIFVYFL

SEQ ID NO: 35772 - protein, 11 aa, Borrelia burgdorferi B31
IQNQIFVYFLS

SEQ ID NO: 35773 - protein, 11 aa, Borrelia burgdorferi B31
QNQIFVYFLSF

SEQ ID NO: 35774 - protein, 11 aa, Borrelia burgdorferi B31
NQIFVYFLSFY

SEQ ID NO: 35775 - protein, 11 aa, Borrelia burgdorferi B31
QIFVYFLSFYP

SEQ ID NO: 35776 - protein, 11 aa, Borrelia burgdorferi B31
IFVYFLSFYPN

SEQ ID NO: 35777 - protein, 11 aa, Borrelia burgdorferi B31
FVYFLSFYPNI

SEQ ID NO: 35778 - protein, 11 aa, Borrelia burgdorferi B31
VYFLSFYPNIE

SEQ ID NO: 35779 - protein, 11 aa, Borrelia burgdorferi B31
YFLSFYPNIEY

SEQ ID NO: 35780 - protein, 11 aa, Borrelia burgdorferi B31
FLSFYPNIEYK

SEQ ID NO: 35781 - protein, 11 aa, Borrelia burgdorferi B31
LSFYPNIEYKH

SEQ ID NO: 35782 - protein, 11 aa, Borrelia burgdorferi B31
SFYPNIEYKHF

SEQ ID NO: 35783 - protein, 11 aa, Borrelia burgdorferi B31
FYPNIEYKHFK

SEQ ID NO: 35784 - protein, 11 aa, Borrelia burgdorferi B31
YPNIEYKHFKF

SEQ ID NO: 35785 - protein, 11 aa, Borrelia burgdorferi B31
PNIEYKHFKFI

SEQ ID NO: 35786 - protein, 11 aa, Borrelia burgdorferi B31
NIEYKHFKFIS

SEQ ID NO: 35787 - protein, 11 aa, Borrelia burgdorferi B31
IEYKHFKFISD

SEQ ID NO: 35788 - protein, 11 aa, Borrelia burgdorferi B31
EYKHFKFISDI

SEQ ID NO: 35789 - protein, 11 aa, Borrelia burgdorferi B31
YKHFKFISDIL

SEQ ID NO: 35790 - protein, 11 aa, Borrelia burgdorferi B31
KHFKFISDILL

SEQ ID NO: 35791 - protein, 11 aa, Borrelia burgdorferi B31
HFKFISDILLY

SEQ ID NO: 35792 - protein, 11 aa, Borrelia burgdorferi B31
FKFISDILLYL

SEQ ID NO: 35793 - protein, 11 aa, Borrelia burgdorferi B31
KFISDILLYLD

SEQ ID NO: 35794 - protein, 11 aa, Borrelia burgdorferi B31
FISDILLYLDE

SEQ ID NO: 35795 - protein, 11 aa, Borrelia burgdorferi B31
ISDILLYLDEN

SEQ ID NO: 35796 - protein, 11 aa, Borrelia burgdorferi B31
SDILLYLDENK

SEQ ID NO: 35797 - protein, 11 aa, Borrelia burgdorferi B31
DILLYLDENKI

SEQ ID NO: 35798 - protein, 11 aa, Borrelia burgdorferi B31
ILLYLDENKIT

SEQ ID NO: 35799 - protein, 11 aa, Borrelia burgdorferi B31
LLYLDENKITI

SEQ ID NO: 35800 - protein, 11 aa, Borrelia burgdorferi B31
LYLDENKITIP

SEQ ID NO: 35801 - protein, 11 aa, Borrelia burgdorferi B31
YLDENKITIPK

SEQ ID NO: 35802 - protein, 11 aa, Borrelia burgdorferi B31
LDENKITIPKK

SEQ ID NO: 35803 - protein, 11 aa, Borrelia burgdorferi B31
DENKITIPKKI

SEQ ID NO: 35804 - protein, 11 aa, Borrelia burgdorferi B31
ENKITIPKKII

SEQ ID NO: 35805 - protein, 11 aa, Borrelia burgdorferi B31
NKITIPKKIIK

SEQ ID NO: 35806 - protein, 11 aa, Borrelia burgdorferi B31
KITIPKKIIKI

SEQ ID NO: 35807 - protein, 11 aa, Borrelia burgdorferi B31
ITIPKKIIKIQ

SEQ ID NO: 35808 - protein, 11 aa, Borrelia burgdorferi B31
TIPKKIIKIQK

SEQ ID NO: 35809 - protein, 11 aa, Borrelia burgdorferi B31
IPKKIIKIQKI

SEQ ID NO: 35810 - protein, 11 aa, Borrelia burgdorferi B31
PKKIIKIQKIN

SEQ ID NO: 35811 - protein, 11 aa, Borrelia burgdorferi B31
KKIIKIQKINP

SEQ ID NO: 35812 - protein, 11 aa, Borrelia burgdorferi B31
KIIKIQKINPN

SEQ ID NO: 35813 - protein, 11 aa, Borrelia burgdorferi B31
IIKIQKINPNQ

SEQ ID NO: 35814 - protein, 11 aa, Borrelia burgdorferi B31
IKIQKINPNQL

SEQ ID NO: 35815 - protein, 11 aa, Borrelia burgdorferi B31
KIQKINPNQLD

SEQ ID NO: 35816 - protein, 11 aa, Borrelia burgdorferi B31
IQKINPNQLDY

SEQ ID NO: 35817 - protein, 11 aa, Borrelia burgdorferi B31
QKINPNQLDYQ

SEQ ID NO: 35818 - protein, 11 aa, Borrelia burgdorferi B31
KINPNQLDYQK

SEQ ID NO: 35819 - protein, 11 aa, Borrelia burgdorferi B31
INPNQLDYQKS

SEQ ID NO: 35820 - protein, 11 aa, Borrelia burgdorferi B31
NPNQLDYQKSY

SEQ ID NO: 35821 - protein, 11 aa, Borrelia burgdorferi B31
PNQLDYQKSYL

SEQ ID NO: 35822 - protein, 11 aa, Borrelia burgdorferi B31
NQLDYQKSYLL

SEQ ID NO: 35823 - protein, 11 aa, Borrelia burgdorferi B31
QLDYQKSYLLI

SEQ ID NO: 35824 - protein, 11 aa, Borrelia burgdorferi B31
LDYQKSYLLIK

SEQ ID NO: 35825 - protein, 11 aa, Borrelia burgdorferi B31
DYQKSYLLIKS

SEQ ID NO: 35826 - protein, 11 aa, Borrelia burgdorferi B31
YQKSYLLIKSL

SEQ ID NO: 35827 - protein, 11 aa, Borrelia burgdorferi B31
QKSYLLIKSLK

SEQ ID NO: 35828 - protein, 11 aa, Borrelia burgdorferi B31
KSYLLIKSLKT

SEQ ID NO: 35829 - protein, 11 aa, Borrelia burgdorferi B31
SYLLIKSLKTR

SEQ ID NO: 35830 - protein, 11 aa, Borrelia burgdorferi B31
YLLIKSLKTRS

SEQ ID NO: 35831 - protein, 11 aa, Borrelia burgdorferi B31
LLIKSLKTRSR

SEQ ID NO: 35832 - protein, 11 aa, Borrelia burgdorferi B31
LIKSLKTRSRI

SEQ ID NO: 35833 - protein, 11 aa, Borrelia burgdorferi B31
IKSLKTRSRIL

SEQ ID NO: 35834 - protein, 11 aa, Borrelia burgdorferi B31
KSLKTRSRILK

SEQ ID NO: 35835 - protein, 11 aa, Borrelia burgdorferi B31
SLKTRSRILKI

SEQ ID NO: 35836 - protein, 11 aa, Borrelia burgdorferi B31
LKTRSRILKII

SEQ ID NO: 35837 - protein, 11 aa, Borrelia burgdorferi B31
KTRSRILKIII

SEQ ID NO: 35838 - protein, 11 aa, Borrelia burgdorferi B31
TRSRILKIIIK

SEQ ID NO: 35839 - protein, 11 aa, Borrelia burgdorferi B31
RSRILKIIIKN

SEQ ID NO: 35840 - protein, 11 aa, Borrelia burgdorferi B31
SRILKIIIKNI

SEQ ID NO: 35841 - protein, 11 aa, Borrelia burgdorferi B31
RILKIIIKNIR

SEQ ID NO: 35842 - protein, 11 aa, Borrelia burgdorferi B31
ILKIIIKNIRF

SEQ ID NO: 35843 - protein, 11 aa, Borrelia burgdorferi B31
LKIIIKNIRFN

SEQ ID NO: 35844 - protein, 11 aa, Borrelia burgdorferi B31
KIIIKNIRFNL

SEQ ID NO: 35845 - protein, 11 aa, Borrelia burgdorferi B31
IIIKNIRFNLI

SEQ ID NO: 35846 - protein, 11 aa, Borrelia burgdorferi B31
IIKNIRFNLIE

SEQ ID NO: 35847 - protein, 11 aa, Borrelia burgdorferi B31
IKNIRFNLIEK

SEQ ID NO: 35848 - protein, 11 aa, Borrelia burgdorferi B31
KNIRFNLIEKL

SEQ ID NO: 35849 - protein, 11 aa, Borrelia burgdorferi B31
NIRFNLIEKLE

SEQ ID NO: 35850 - protein, 11 aa, Borrelia burgdorferi B31
IRFNLIEKLED

SEQ ID NO: 35851 - protein, 11 aa, Borrelia burgdorferi B31
RFNLIEKLEDE

SEQ ID NO: 35852 - protein, 11 aa, Borrelia burgdorferi B31
FNLIEKLEDEN

SEQ ID NO: 35853 - protein, 11 aa, Borrelia burgdorferi B31
NLIEKLEDENE

SEQ ID NO: 35854 - protein, 11 aa, Borrelia burgdorferi B31
LIEKLEDENEK

SEQ ID NO: 35855 - protein, 11 aa, Borrelia burgdorferi B31
IEKLEDENEKK

SEQ ID NO: 35856 - protein, 11 aa, Borrelia burgdorferi B31
EKLEDENEKKL

SEQ ID NO: 35857 - protein, 11 aa, Borrelia burgdorferi B31
KLEDENEKKLL

SEQ ID NO: 35858 - protein, 11 aa, Borrelia burgdorferi B31
LEDENEKKLLP

SEQ ID NO: 35859 - protein, 11 aa, Borrelia burgdorferi B31
EDENEKKLLPA

SEQ ID NO: 35860 - protein, 11 aa, Borrelia burgdorferi B31
DENEKKLLPAM

SEQ ID NO: 35861 - protein, 11 aa, Borrelia burgdorferi B31
ENEKKLLPAMC

SEQ ID NO: 35862 - protein, 11 aa, Borrelia burgdorferi B31
NEKKLLPAMCY

SEQ ID NO: 35863 - protein, 11 aa, Borrelia burgdorferi B31
EKKLLPAMCYL

SEQ ID NO: 35864 - protein, 11 aa, Borrelia burgdorferi B31
KKLLPAMCYLI

SEQ ID NO: 35865 - protein, 11 aa, Borrelia burgdorferi B31
KLLPAMCYLIY

SEQ ID NO: 35866 - protein, 11 aa, Borrelia burgdorferi B31
LLPAMCYLIYC

SEQ ID NO: 35867 - protein, 11 aa, Borrelia burgdorferi B31
LPAMCYLIYCE

SEQ ID NO: 35868 - protein, 11 aa, Borrelia burgdorferi B31
PAMCYLIYCEN

SEQ ID NO: 35869 - protein, 11 aa, Borrelia burgdorferi B31
AMCYLIYCENL

SEQ ID NO: 35870 - protein, 11 aa, Borrelia burgdorferi B31
MCYLIYCENLV

SEQ ID NO: 35871 - protein, 11 aa, Borrelia burgdorferi B31
CYLIYCENLVE

SEQ ID NO: 35872 - protein, 11 aa, Borrelia burgdorferi B31
YLIYCENLVEL

SEQ ID NO: 35873 - protein, 11 aa, Borrelia burgdorferi B31
LIYCENLVELK

SEQ ID NO: 35874 - protein, 11 aa, Borrelia burgdorferi B31
IYCENLVELKN

SEQ ID NO: 35875 - protein, 11 aa, Borrelia burgdorferi B31
YCENLVELKNN

SEQ ID NO: 35876 - protein, 11 aa, Borrelia burgdorferi B31
CENLVELKNNR

SEQ ID NO: 35877 - protein, 11 aa, Borrelia burgdorferi B31
ENLVELKNNRK

SEQ ID NO: 35878 - protein, 11 aa, Borrelia burgdorferi B31
NLVELKNNRKI

SEQ ID NO: 35879 - protein, 11 aa, Borrelia burgdorferi B31
LVELKNNRKIK

SEQ ID NO: 35880 - protein, 11 aa, Borrelia burgdorferi B31
VELKNNRKIKS

SEQ ID NO: 35881 - protein, 11 aa, Borrelia burgdorferi B31
ELKNNRKIKSN

SEQ ID NO: 35882 - protein, 11 aa, Borrelia burgdorferi B31
LKNNRKIKSNE

SEQ ID NO: 35883 - protein, 11 aa, Borrelia burgdorferi B31
KNNRKIKSNEK

SEQ ID NO: 35884 - protein, 11 aa, Borrelia burgdorferi B31
NNRKIKSNEKN

SEQ ID NO: 35885 - protein, 11 aa, Borrelia burgdorferi B31
NRKIKSNEKNS

SEQ ID NO: 35886 - protein, 11 aa, Borrelia burgdorferi B31
RKIKSNEKNSL

SEQ ID NO: 35887 - protein, 11 aa, Borrelia burgdorferi B31
KIKSNEKNSLL

SEQ ID NO: 35888 - protein, 11 aa, Borrelia burgdorferi B31
IKSNEKNSLLE

SEQ ID NO: 35889 - protein, 11 aa, Borrelia burgdorferi B31
KSNEKNSLLEF

SEQ ID NO: 35890 - protein, 11 aa, Borrelia burgdorferi B31
SNEKNSLLEFI

SEQ ID NO: 35891 - protein, 11 aa, Borrelia burgdorferi B31
NEKNSLLEFIS

SEQ ID NO: 35892 - protein, 11 aa, Borrelia burgdorferi B31
EKNSLLEFISF

SEQ ID NO: 35893 - protein, 11 aa, Borrelia burgdorferi B31
KNSLLEFISFF

SEQ ID NO: 35894 - protein, 11 aa, Borrelia burgdorferi B31
NSLLEFISFFK

SEQ ID NO: 35895 - protein, 11 aa, Borrelia burgdorferi B31
SLLEFISFFKT

SEQ ID NO: 35896 - protein, 11 aa, Borrelia burgdorferi B31
LLEFISFFKTK

SEQ ID NO: 35897 - protein, 11 aa, Borrelia burgdorferi B31
LEFISFFKTKL

SEQ ID NO: 35898 - protein, 11 aa, Borrelia burgdorferi B31
EFISFFKTKLK

SEQ ID NO: 35899 - protein, 11 aa, Borrelia burgdorferi B31
FISFFKTKLKQ

SEQ ID NO: 35900 - protein, 11 aa, Borrelia burgdorferi B31
ISFFKTKLKQK

SEQ ID NO: 35901 - protein, 11 aa, Borrelia burgdorferi B31
SFFKTKLKQKI

SEQ ID NO: 35902 - protein, 11 aa, Borrelia burgdorferi B31
FFKTKLKQKIN

SEQ ID NO: 35903 - protein, 11 aa, Borrelia burgdorferi B31
FKTKLKQKINF

SEQ ID NO: 35904 - protein, 11 aa, Borrelia burgdorferi B31
KTKLKQKINFK

SEQ ID NO: 35905 - protein, 11 aa, Borrelia burgdorferi B31
TKLKQKINFKK

SEQ ID NO: 35906 - protein, 11 aa, Borrelia burgdorferi B31
KLKQKINFKKE

SEQ ID NO: 35907 - protein, 11 aa, Borrelia burgdorferi B31
LKQKINFKKEL

SEQ ID NO: 35908 - protein, 11 aa, Borrelia burgdorferi B31
KQKINFKKELM

SEQ ID NO: 35909 - protein, 11 aa, Borrelia burgdorferi B31
QKINFKKELMK

SEQ ID NO: 35910 - protein, 11 aa, Borrelia burgdorferi B31
KINFKKELMKS

SEQ ID NO: 35911 - protein, 11 aa, Borrelia burgdorferi B31
INFKKELMKSK

SEQ ID NO: 35912 - protein, 11 aa, Borrelia burgdorferi B31
NFKKELMKSKG

SEQ ID NO: 35913 - protein, 11 aa, Borrelia burgdorferi B31
FKKELMKSKGI

SEQ ID NO: 35914 - protein, 8 aa, Borrelia burgdorferi B31
MITQQDYT

SEQ ID NO: 35915 - protein, 8 aa, Borrelia burgdorferi B31
ITQQDYTE

SEQ ID NO: 35916 - protein, 8 aa, Borrelia burgdorferi B31
TQQDYTEI

SEQ ID NO: 35917 - protein, 8 aa, Borrelia burgdorferi B31
QQDYTEIK

SEQ ID NO: 35918 - protein, 8 aa, Borrelia burgdorferi B31
QDYTEIKK

SEQ ID NO: 35919 - protein, 8 aa, Borrelia burgdorferi B31
DYTEIKKK

SEQ ID NO: 35920 - protein, 8 aa, Borrelia burgdorferi B31
YTEIKKKL

SEQ ID NO: 35921 - protein, 8 aa, Borrelia burgdorferi B31
TEIKKKLE

SEQ ID NO: 35922 - protein, 8 aa, Borrelia burgdorferi B31
EIKKKLEN

SEQ ID NO: 35923 - protein, 8 aa, Borrelia burgdorferi B31
IKKKLENT

SEQ ID NO: 35924 - protein, 8 aa, Borrelia burgdorferi B31
KKKLENTK

SEQ ID NO: 35925 - protein, 8 aa, Borrelia burgdorferi B31
KKLENTKT

SEQ ID NO: 35926 - protein, 8 aa, Borrelia burgdorferi B31
KLENTKTR

SEQ ID NO: 35927 - protein, 8 aa, Borrelia burgdorferi B31
LENTKTRI

SEQ ID NO: 35928 - protein, 8 aa, Borrelia burgdorferi B31
ENTKTRIQ

SEQ ID NO: 35929 - protein, 8 aa, Borrelia burgdorferi B31
NTKTRIQF

SEQ ID NO: 35930 - protein, 8 aa, Borrelia burgdorferi B31
TKTRIQFR

SEQ ID NO: 35931 - protein, 8 aa, Borrelia burgdorferi B31
KTRIQFRN

SEQ ID NO: 35932 - protein, 8 aa, Borrelia burgdorferi B31
TRIQFRNG

SEQ ID NO: 35933 - protein, 8 aa, Borrelia burgdorferi B31
RIQFRNGN

SEQ ID NO: 35934 - protein, 8 aa, Borrelia burgdorferi B31
IQFRNGNK

SEQ ID NO: 35935 - protein, 8 aa, Borrelia burgdorferi B31
QFRNGNKI

SEQ ID NO: 35936 - protein, 8 aa, Borrelia burgdorferi B31
FRNGNKID

SEQ ID NO: 35937 - protein, 8 aa, Borrelia burgdorferi B31
RNGNKIDS

SEQ ID NO: 35938 - protein, 8 aa, Borrelia burgdorferi B31
NGNKIDSL

SEQ ID NO: 35939 - protein, 8 aa, Borrelia burgdorferi B31
GNKIDSLG

SEQ ID NO: 35940 - protein, 8 aa, Borrelia burgdorferi B31
NKIDSLGY

SEQ ID NO: 35941 - protein, 8 aa, Borrelia burgdorferi B31
KIDSLGYQ

SEQ ID NO: 35942 - protein, 8 aa, Borrelia burgdorferi B31
IDSLGYQG

SEQ ID NO: 35943 - protein, 8 aa, Borrelia burgdorferi B31
DSLGYQGS

SEQ ID NO: 35944 - protein, 8 aa, Borrelia burgdorferi B31
SLGYQGSL

SEQ ID NO: 35945 - protein, 8 aa, Borrelia burgdorferi B31
LGYQGSLG

SEQ ID NO: 35946 - protein, 8 aa, Borrelia burgdorferi B31
GYQGSLGE

SEQ ID NO: 35947 - protein, 8 aa, Borrelia burgdorferi B31
YQGSLGEP

SEQ ID NO: 35948 - protein, 8 aa, Borrelia burgdorferi B31
QGSLGEPI

SEQ ID NO: 35949 - protein, 8 aa, Borrelia burgdorferi B31
GSLGEPIL

SEQ ID NO: 35950 - protein, 8 aa, Borrelia burgdorferi B31
SLGEPILL

SEQ ID NO: 35951 - protein, 8 aa, Borrelia burgdorferi B31
LGEPILLK

SEQ ID NO: 35952 - protein, 8 aa, Borrelia burgdorferi B31
GEPILLKD

SEQ ID NO: 35953 - protein, 8 aa, Borrelia burgdorferi B31
EPILLKDK

SEQ ID NO: 35954 - protein, 8 aa, Borrelia burgdorferi B31
PILLKDKL

SEQ ID NO: 35955 - protein, 8 aa, Borrelia burgdorferi B31
ILLKDKLT

SEQ ID NO: 35956 - protein, 8 aa, Borrelia burgdorferi B31
LLKDKLTF

SEQ ID NO: 35957 - protein, 8 aa, Borrelia burgdorferi B31
LKDKLTFS

SEQ ID NO: 35958 - protein, 8 aa, Borrelia burgdorferi B31
KDKLTFSI

SEQ ID NO: 35959 - protein, 8 aa, Borrelia burgdorferi B31
DKLTFSIC

SEQ ID NO: 35960 - protein, 8 aa, Borrelia burgdorferi B31
KLTFSICD

SEQ ID NO: 35961 - protein, 8 aa, Borrelia burgdorferi B31
LTFSICDG

SEQ ID NO: 35962 - protein, 8 aa, Borrelia burgdorferi B31
TFSICDGK

SEQ ID NO: 35963 - protein, 8 aa, Borrelia burgdorferi B31
FSICDGKN

SEQ ID NO: 35964 - protein, 8 aa, Borrelia burgdorferi B31
SICDGKNI

SEQ ID NO: 35965 - protein, 8 aa, Borrelia burgdorferi B31
ICDGKNID

SEQ ID NO: 35966 - protein, 8 aa, Borrelia burgdorferi B31
CDGKNIDN

SEQ ID NO: 35967 - protein, 8 aa, Borrelia burgdorferi B31
DGKNIDNR

SEQ ID NO: 35968 - protein, 8 aa, Borrelia burgdorferi B31
GKNIDNRK

SEQ ID NO: 35969 - protein, 8 aa, Borrelia burgdorferi B31
KNIDNRKE

SEQ ID NO: 35970 - protein, 8 aa, Borrelia burgdorferi B31
NIDNRKEY

SEQ ID NO: 35971 - protein, 8 aa, Borrelia burgdorferi B31
IDNRKEYE

SEQ ID NO: 35972 - protein, 8 aa, Borrelia burgdorferi B31
DNRKEYEI

SEQ ID NO: 35973 - protein, 8 aa, Borrelia burgdorferi B31
NRKEYEIT

SEQ ID NO: 35974 - protein, 8 aa, Borrelia burgdorferi B31
RKEYEITK

SEQ ID NO: 35975 - protein, 8 aa, Borrelia burgdorferi B31
KEYEITKN

SEQ ID NO: 35976 - protein, 8 aa, Borrelia burgdorferi B31
EYEITKNA

SEQ ID NO: 35977 - protein, 8 aa, Borrelia burgdorferi B31
YEITKNAP

SEQ ID NO: 35978 - protein, 8 aa, Borrelia burgdorferi B31
EITKNAPS

SEQ ID NO: 35979 - protein, 8 aa, Borrelia burgdorferi B31
ITKNAPSL

SEQ ID NO: 35980 - protein, 8 aa, Borrelia burgdorferi B31
TKNAPSLD

SEQ ID NO: 35981 - protein, 8 aa, Borrelia burgdorferi B31
KNAPSLDS

SEQ ID NO: 35982 - protein, 8 aa, Borrelia burgdorferi B31
NAPSLDSL

SEQ ID NO: 35983 - protein, 8 aa, Borrelia burgdorferi B31
APSLDSLI

SEQ ID NO: 35984 - protein, 8 aa, Borrelia burgdorferi B31
PSLDSLIE

SEQ ID NO: 35985 - protein, 8 aa, Borrelia burgdorferi B31
SLDSLIEY

SEQ ID NO: 35986 - protein, 8 aa, Borrelia burgdorferi B31
LDSLIEYL

SEQ ID NO: 35987 - protein, 8 aa, Borrelia burgdorferi B31
DSLIEYLE

SEQ ID NO: 35988 - protein, 8 aa, Borrelia burgdorferi B31
SLIEYLEH

SEQ ID NO: 35989 - protein, 8 aa, Borrelia burgdorferi B31
LIEYLEHM

SEQ ID NO: 35990 - protein, 8 aa, Borrelia burgdorferi B31
IEYLEHMI

SEQ ID NO: 35991 - protein, 8 aa, Borrelia burgdorferi B31
EYLEHMIL

SEQ ID NO: 35992 - protein, 8 aa, Borrelia burgdorferi B31
YLEHMILF

SEQ ID NO: 35993 - protein, 8 aa, Borrelia burgdorferi B31
LEHMILFF

SEQ ID NO: 35994 - protein, 8 aa, Borrelia burgdorferi B31
EHMILFFL

SEQ ID NO: 35995 - protein, 8 aa, Borrelia burgdorferi B31
HMILFFLE

SEQ ID NO: 35996 - protein, 8 aa, Borrelia burgdorferi B31
MILFFLEK

SEQ ID NO: 35997 - protein, 8 aa, Borrelia burgdorferi B31
ILFFLEKT

SEQ ID NO: 35998 - protein, 8 aa, Borrelia burgdorferi B31
LFFLEKTP

SEQ ID NO: 35999 - protein, 8 aa, Borrelia burgdorferi B31
FFLEKTPV

SEQ ID NO: 36000 - protein, 8 aa, Borrelia burgdorferi B31
FLEKTPVG

SEQ ID NO: 36001 - protein, 8 aa, Borrelia burgdorferi B31
LEKTPVGT

SEQ ID NO: 36002 - protein, 8 aa, Borrelia burgdorferi B31
EKTPVGTL

SEQ ID NO: 36003 - protein, 8 aa, Borrelia burgdorferi B31
KTPVGTLT

SEQ ID NO: 36004 - protein, 8 aa, Borrelia burgdorferi B31
TPVGTLTA

SEQ ID NO: 36005 - protein, 8 aa, Borrelia burgdorferi B31
PVGTLTAK

SEQ ID NO: 36006 - protein, 8 aa, Borrelia burgdorferi B31
VGTLTAKF

SEQ ID NO: 36007 - protein, 8 aa, Borrelia burgdorferi B31
GTLTAKFA

SEQ ID NO: 36008 - protein, 8 aa, Borrelia burgdorferi B31
TLTAKFAM

SEQ ID NO: 36009 - protein, 8 aa, Borrelia burgdorferi B31
LTAKFAME

SEQ ID NO: 36010 - protein, 8 aa, Borrelia burgdorferi B31
TAKFAMEG

SEQ ID NO: 36011 - protein, 8 aa, Borrelia burgdorferi B31
AKFAMEGS

SEQ ID NO: 36012 - protein, 8 aa, Borrelia burgdorferi B31
KFAMEGSI

SEQ ID NO: 36013 - protein, 8 aa, Borrelia burgdorferi B31
FAMEGSIL

SEQ ID NO: 36014 - protein, 8 aa, Borrelia burgdorferi B31
AMEGSILT

SEQ ID NO: 36015 - protein, 8 aa, Borrelia burgdorferi B31
MEGSILTR

SEQ ID NO: 36016 - protein, 8 aa, Borrelia burgdorferi B31
EGSILTRS

SEQ ID NO: 36017 - protein, 8 aa, Borrelia burgdorferi B31
GSILTRSK

SEQ ID NO: 36018 - protein, 8 aa, Borrelia burgdorferi B31
SILTRSKL

SEQ ID NO: 36019 - protein, 8 aa, Borrelia burgdorferi B31
ILTRSKLI

SEQ ID NO: 36020 - protein, 8 aa, Borrelia burgdorferi B31
LTRSKLIQ

SEQ ID NO: 36021 - protein, 8 aa, Borrelia burgdorferi B31
TRSKLIQA

SEQ ID NO: 36022 - protein, 8 aa, Borrelia burgdorferi B31
RSKLIQAF

SEQ ID NO: 36023 - protein, 8 aa, Borrelia burgdorferi B31
SKLIQAFT

SEQ ID NO: 36024 - protein, 8 aa, Borrelia burgdorferi B31
KLIQAFTN

SEQ ID NO: 36025 - protein, 8 aa, Borrelia burgdorferi B31
LIQAFTNT

SEQ ID NO: 36026 - protein, 8 aa, Borrelia burgdorferi B31
IQAFTNTN

SEQ ID NO: 36027 - protein, 8 aa, Borrelia burgdorferi B31
QAFTNTNK

SEQ ID NO: 36028 - protein, 8 aa, Borrelia burgdorferi B31
AFTNTNKF

SEQ ID NO: 36029 - protein, 8 aa, Borrelia burgdorferi B31
FTNTNKFC

SEQ ID NO: 36030 - protein, 8 aa, Borrelia burgdorferi B31
TNTNKFCI

SEQ ID NO: 36031 - protein, 8 aa, Borrelia burgdorferi B31
NTNKFCIP

SEQ ID NO: 36032 - protein, 8 aa, Borrelia burgdorferi B31
TNKFCIPD

SEQ ID NO: 36033 - protein, 8 aa, Borrelia burgdorferi B31
NKFCIPDG

SEQ ID NO: 36034 - protein, 8 aa, Borrelia burgdorferi B31
KFCIPDGR

SEQ ID NO: 36035 - protein, 8 aa, Borrelia burgdorferi B31
FCIPDGRS

SEQ ID NO: 36036 - protein, 8 aa, Borrelia burgdorferi B31
CIPDGRSL

SEQ ID NO: 36037 - protein, 8 aa, Borrelia burgdorferi B31
IPDGRSLP

SEQ ID NO: 36038 - protein, 8 aa, Borrelia burgdorferi B31
PDGRSLPS

SEQ ID NO: 36039 - protein, 8 aa, Borrelia burgdorferi B31
DGRSLPSN

SEQ ID NO: 36040 - protein, 8 aa, Borrelia burgdorferi B31
GRSLPSNC

SEQ ID NO: 36041 - protein, 8 aa, Borrelia burgdorferi B31
RSLPSNCY

SEQ ID NO: 36042 - protein, 8 aa, Borrelia burgdorferi B31
SLPSNCYA

SEQ ID NO: 36043 - protein, 8 aa, Borrelia burgdorferi B31
LPSNCYAY

SEQ ID NO: 36044 - protein, 8 aa, Borrelia burgdorferi B31
PSNCYAYK

SEQ ID NO: 36045 - protein, 8 aa, Borrelia burgdorferi B31
SNCYAYKV

SEQ ID NO: 36046 - protein, 8 aa, Borrelia burgdorferi B31
NCYAYKVL

SEQ ID NO: 36047 - protein, 8 aa, Borrelia burgdorferi B31
CYAYKVLG

SEQ ID NO: 36048 - protein, 8 aa, Borrelia burgdorferi B31
YAYKVLGI

SEQ ID NO: 36049 - protein, 8 aa, Borrelia burgdorferi B31
AYKVLGIS

SEQ ID NO: 36050 - protein, 8 aa, Borrelia burgdorferi B31
YKVLGISS

SEQ ID NO: 36051 - protein, 8 aa, Borrelia burgdorferi B31
KVLGISSA

SEQ ID NO: 36052 - protein, 8 aa, Borrelia burgdorferi B31
VLGISSAP

SEQ ID NO: 36053 - protein, 8 aa, Borrelia burgdorferi B31
LGISSAPK

SEQ ID NO: 36054 - protein, 8 aa, Borrelia burgdorferi B31
GISSAPKL

SEQ ID NO: 36055 - protein, 8 aa, Borrelia burgdorferi B31
ISSAPKLS

SEQ ID NO: 36056 - protein, 8 aa, Borrelia burgdorferi B31
SSAPKLSG

SEQ ID NO: 36057 - protein, 8 aa, Borrelia burgdorferi B31
SAPKLSGR

SEQ ID NO: 36058 - protein, 8 aa, Borrelia burgdorferi B31
APKLSGRF

SEQ ID NO: 36059 - protein, 8 aa, Borrelia burgdorferi B31
PKLSGRFL

SEQ ID NO: 36060 - protein, 8 aa, Borrelia burgdorferi B31
KLSGRFLR

SEQ ID NO: 36061 - protein, 8 aa, Borrelia burgdorferi B31
LSGRFLRH

SEQ ID NO: 36062 - protein, 8 aa, Borrelia burgdorferi B31
SGRFLRHY

SEQ ID NO: 36063 - protein, 8 aa, Borrelia burgdorferi B31
GRFLRHYD

SEQ ID NO: 36064 - protein, 8 aa, Borrelia burgdorferi B31
RFLRHYDS

SEQ ID NO: 36065 - protein, 8 aa, Borrelia burgdorferi B31
FLRHYDSG

SEQ ID NO: 36066 - protein, 8 aa, Borrelia burgdorferi B31
LRHYDSGG

SEQ ID NO: 36067 - protein, 8 aa, Borrelia burgdorferi B31
RHYDSGGS

SEQ ID NO: 36068 - protein, 8 aa, Borrelia burgdorferi B31
HYDSGGST

SEQ ID NO: 36069 - protein, 8 aa, Borrelia burgdorferi B31
YDSGGSTD

SEQ ID NO: 36070 - protein, 8 aa, Borrelia burgdorferi B31
DSGGSTDS

SEQ ID NO: 36071 - protein, 8 aa, Borrelia burgdorferi B31
SGGSTDSD

SEQ ID NO: 36072 - protein, 8 aa, Borrelia burgdorferi B31
GGSTDSDG

SEQ ID NO: 36073 - protein, 8 aa, Borrelia burgdorferi B31
GSTDSDGT

SEQ ID NO: 36074 - protein, 8 aa, Borrelia burgdorferi B31
STDSDGTR

SEQ ID NO: 36075 - protein, 8 aa, Borrelia burgdorferi B31
TDSDGTRS

SEQ ID NO: 36076 - protein, 8 aa, Borrelia burgdorferi B31
DSDGTRSL

SEQ ID NO: 36077 - protein, 8 aa, Borrelia burgdorferi B31
SDGTRSLG

SEQ ID NO: 36078 - protein, 8 aa, Borrelia burgdorferi B31
DGTRSLGH

SEQ ID NO: 36079 - protein, 8 aa, Borrelia burgdorferi B31
GTRSLGHT

SEQ ID NO: 36080 - protein, 8 aa, Borrelia burgdorferi B31
TRSLGHTQ

SEQ ID NO: 36081 - protein, 8 aa, Borrelia burgdorferi B31
RSLGHTQE

SEQ ID NO: 36082 - protein, 8 aa, Borrelia burgdorferi B31
SLGHTQED

SEQ ID NO: 36083 - protein, 8 aa, Borrelia burgdorferi B31
LGHTQEDS

SEQ ID NO: 36084 - protein, 8 aa, Borrelia burgdorferi B31
GHTQEDSY

SEQ ID NO: 36085 - protein, 8 aa, Borrelia burgdorferi B31
HTQEDSYK

SEQ ID NO: 36086 - protein, 8 aa, Borrelia burgdorferi B31
TQEDSYKN

SEQ ID NO: 36087 - protein, 8 aa, Borrelia burgdorferi B31
QEDSYKNH

SEQ ID NO: 36088 - protein, 8 aa, Borrelia burgdorferi B31
EDSYKNHD

SEQ ID NO: 36089 - protein, 8 aa, Borrelia burgdorferi B31
DSYKNHDH

SEQ ID NO: 36090 - protein, 8 aa, Borrelia burgdorferi B31
SYKNHDHD

SEQ ID NO: 36091 - protein, 8 aa, Borrelia burgdorferi B31
YKNHDHDL

SEQ ID NO: 36092 - protein, 8 aa, Borrelia burgdorferi B31
KNHDHDLD

SEQ ID NO: 36093 - protein, 8 aa, Borrelia burgdorferi B31
NHDHDLDF

SEQ ID NO: 36094 - protein, 8 aa, Borrelia burgdorferi B31
HDHDLDFS

SEQ ID NO: 36095 - protein, 8 aa, Borrelia burgdorferi B31
DHDLDFSR

SEQ ID NO: 36096 - protein, 8 aa, Borrelia burgdorferi B31
HDLDFSRI

SEQ ID NO: 36097 - protein, 8 aa, Borrelia burgdorferi B31
DLDFSRIN

SEQ ID NO: 36098 - protein, 8 aa, Borrelia burgdorferi B31
LDFSRINF

SEQ ID NO: 36099 - protein, 8 aa, Borrelia burgdorferi B31
DFSRINFK

SEQ ID NO: 36100 - protein, 8 aa, Borrelia burgdorferi B31
FSRINFKG

SEQ ID NO: 36101 - protein, 8 aa, Borrelia burgdorferi B31
SRINFKGK

SEQ ID NO: 36102 - protein, 8 aa, Borrelia burgdorferi B31
RINFKGKL

SEQ ID NO: 36103 - protein, 8 aa, Borrelia burgdorferi B31
INFKGKLV

SEQ ID NO: 36104 - protein, 8 aa, Borrelia burgdorferi B31
NFKGKLVK

SEQ ID NO: 36105 - protein, 8 aa, Borrelia burgdorferi B31
FKGKLVKR

SEQ ID NO: 36106 - protein, 8 aa, Borrelia burgdorferi B31
KGKLVKRM

SEQ ID NO: 36107 - protein, 8 aa, Borrelia burgdorferi B31
GKLVKRMT

SEQ ID NO: 36108 - protein, 8 aa, Borrelia burgdorferi B31
KLVKRMTM

SEQ ID NO: 36109 - protein, 8 aa, Borrelia burgdorferi B31
LVKRMTMI

SEQ ID NO: 36110 - protein, 8 aa, Borrelia burgdorferi B31
VKRMTMIY

SEQ ID NO: 36111 - protein, 8 aa, Borrelia burgdorferi B31
KRMTMIYR

SEQ ID NO: 36112 - protein, 8 aa, Borrelia burgdorferi B31
RMTMIYRS

SEQ ID NO: 36113 - protein, 8 aa, Borrelia burgdorferi B31
MTMIYRSA

SEQ ID NO: 36114 - protein, 8 aa, Borrelia burgdorferi B31
TMIYRSAD

SEQ ID NO: 36115 - protein, 8 aa, Borrelia burgdorferi B31
MIYRSADT

SEQ ID NO: 36116 - protein, 8 aa, Borrelia burgdorferi B31
IYRSADTW

SEQ ID NO: 36117 - protein, 8 aa, Borrelia burgdorferi B31
YRSADTWY

SEQ ID NO: 36118 - protein, 8 aa, Borrelia burgdorferi B31
RSADTWYT

SEQ ID NO: 36119 - protein, 8 aa, Borrelia burgdorferi B31
SADTWYTW

SEQ ID NO: 36120 - protein, 8 aa, Borrelia burgdorferi B31
ADTWYTWY

SEQ ID NO: 36121 - protein, 8 aa, Borrelia burgdorferi B31
DTWYTWYW

SEQ ID NO: 36122 - protein, 8 aa, Borrelia burgdorferi B31
TWYTWYWA

SEQ ID NO: 36123 - protein, 8 aa, Borrelia burgdorferi B31
WYTWYWAE

SEQ ID NO: 36124 - protein, 8 aa, Borrelia burgdorferi B31
YTWYWAEE

SEQ ID NO: 36125 - protein, 8 aa, Borrelia burgdorferi B31
TWYWAEEI

SEQ ID NO: 36126 - protein, 8 aa, Borrelia burgdorferi B31
WYWAEEIM

SEQ ID NO: 36127 - protein, 8 aa, Borrelia burgdorferi B31
YWAEEIMS

SEQ ID NO: 36128 - protein, 8 aa, Borrelia burgdorferi B31
WAEEIMSP

SEQ ID NO: 36129 - protein, 8 aa, Borrelia burgdorferi B31
AEEIMSPF

SEQ ID NO: 36130 - protein, 8 aa, Borrelia burgdorferi B31
EEIMSPFI

SEQ ID NO: 36131 - protein, 8 aa, Borrelia burgdorferi B31
EIMSPFIT

SEQ ID NO: 36132 - protein, 8 aa, Borrelia burgdorferi B31
IMSPFITG

SEQ ID NO: 36133 - protein, 8 aa, Borrelia burgdorferi B31
MSPFITGY

SEQ ID NO: 36134 - protein, 8 aa, Borrelia burgdorferi B31
SPFITGYS

SEQ ID NO: 36135 - protein, 8 aa, Borrelia burgdorferi B31
PFITGYSY

SEQ ID NO: 36136 - protein, 8 aa, Borrelia burgdorferi B31
FITGYSYE

SEQ ID NO: 36137 - protein, 8 aa, Borrelia burgdorferi B31
ITGYSYEE

SEQ ID NO: 36138 - protein, 8 aa, Borrelia burgdorferi B31
TGYSYEEI

SEQ ID NO: 36139 - protein, 8 aa, Borrelia burgdorferi B31
GYSYEEID

SEQ ID NO: 36140 - protein, 8 aa, Borrelia burgdorferi B31
YSYEEIDP

SEQ ID NO: 36141 - protein, 8 aa, Borrelia burgdorferi B31
SYEEIDPE

SEQ ID NO: 36142 - protein, 8 aa, Borrelia burgdorferi B31
YEEIDPEY

SEQ ID NO: 36143 - protein, 8 aa, Borrelia burgdorferi B31
EEIDPEYL

SEQ ID NO: 36144 - protein, 8 aa, Borrelia burgdorferi B31
EIDPEYLL

SEQ ID NO: 36145 - protein, 8 aa, Borrelia burgdorferi B31
IDPEYLLP

SEQ ID NO: 36146 - protein, 8 aa, Borrelia burgdorferi B31
DPEYLLPP

SEQ ID NO: 36147 - protein, 8 aa, Borrelia burgdorferi B31
PEYLLPPF

SEQ ID NO: 36148 - protein, 8 aa, Borrelia burgdorferi B31
EYLLPPFT

SEQ ID NO: 36149 - protein, 8 aa, Borrelia burgdorferi B31
YLLPPFTS

SEQ ID NO: 36150 - protein, 8 aa, Borrelia burgdorferi B31
LLPPFTSQ

SEQ ID NO: 36151 - protein, 8 aa, Borrelia burgdorferi B31
LPPFTSQS

SEQ ID NO: 36152 - protein, 8 aa, Borrelia burgdorferi B31
PPFTSQSG

SEQ ID NO: 36153 - protein, 8 aa, Borrelia burgdorferi B31
PFTSQSGS

SEQ ID NO: 36154 - protein, 8 aa, Borrelia burgdorferi B31
FTSQSGSK

SEQ ID NO: 36155 - protein, 8 aa, Borrelia burgdorferi B31
TSQSGSKE

SEQ ID NO: 36156 - protein, 8 aa, Borrelia burgdorferi B31
SQSGSKET

SEQ ID NO: 36157 - protein, 8 aa, Borrelia burgdorferi B31
QSGSKETK

SEQ ID NO: 36158 - protein, 8 aa, Borrelia burgdorferi B31
SGSKETKP

SEQ ID NO: 36159 - protein, 8 aa, Borrelia burgdorferi B31
GSKETKPK

SEQ ID NO: 36160 - protein, 8 aa, Borrelia burgdorferi B31
SKETKPKN

SEQ ID NO: 36161 - protein, 8 aa, Borrelia burgdorferi B31
KETKPKNT

SEQ ID NO: 36162 - protein, 8 aa, Borrelia burgdorferi B31
ETKPKNTC

SEQ ID NO: 36163 - protein, 8 aa, Borrelia burgdorferi B31
TKPKNTCY

SEQ ID NO: 36164 - protein, 8 aa, Borrelia burgdorferi B31
KPKNTCYI

SEQ ID NO: 36165 - protein, 8 aa, Borrelia burgdorferi B31
PKNTCYIS

SEQ ID NO: 36166 - protein, 8 aa, Borrelia burgdorferi B31
KNTCYISF

SEQ ID NO: 36167 - protein, 8 aa, Borrelia burgdorferi B31
NTCYISFY

SEQ ID NO: 36168 - protein, 8 aa, Borrelia burgdorferi B31
TCYISFYR

SEQ ID NO: 36169 - protein, 8 aa, Borrelia burgdorferi B31
CYISFYRY

SEQ ID NO: 36170 - protein, 8 aa, Borrelia burgdorferi B31
YISFYRYD

SEQ ID NO: 36171 - protein, 8 aa, Borrelia burgdorferi B31
ISFYRYDL

SEQ ID NO: 36172 - protein, 9 aa, Borrelia burgdorferi B31
MITQQDYTE

SEQ ID NO: 36173 - protein, 9 aa, Borrelia burgdorferi B31
ITQQDYTEI

SEQ ID NO: 36174 - protein, 9 aa, Borrelia burgdorferi B31
TQQDYTEIK

SEQ ID NO: 36175 - protein, 9 aa, Borrelia burgdorferi B31
QQDYTEIKK

SEQ ID NO: 36176 - protein, 9 aa, Borrelia burgdorferi B31
QDYTEIKKK

SEQ ID NO: 36177 - protein, 9 aa, Borrelia burgdorferi B31
DYTEIKKKL

SEQ ID NO: 36178 - protein, 9 aa, Borrelia burgdorferi B31
YTEIKKKLE

SEQ ID NO: 36179 - protein, 9 aa, Borrelia burgdorferi B31
TEIKKKLEN

SEQ ID NO: 36180 - protein, 9 aa, Borrelia burgdorferi B31
EIKKKLENT

SEQ ID NO: 36181 - protein, 9 aa, Borrelia burgdorferi B31
IKKKLENTK

SEQ ID NO: 36182 - protein, 9 aa, Borrelia burgdorferi B31
KKKLENTKT

SEQ ID NO: 36183 - protein, 9 aa, Borrelia burgdorferi B31
KKLENTKTR

SEQ ID NO: 36184 - protein, 9 aa, Borrelia burgdorferi B31
KLENTKTRI

SEQ ID NO: 36185 - protein, 9 aa, Borrelia burgdorferi B31
LENTKTRIQ

SEQ ID NO: 36186 - protein, 9 aa, Borrelia burgdorferi B31
ENTKTRIQF

SEQ ID NO: 36187 - protein, 9 aa, Borrelia burgdorferi B31
NTKTRIQFR

SEQ ID NO: 36188 - protein, 9 aa, Borrelia burgdorferi B31
TKTRIQFRN

SEQ ID NO: 36189 - protein, 9 aa, Borrelia burgdorferi B31
KTRIQFRNG

SEQ ID NO: 36190 - protein, 9 aa, Borrelia burgdorferi B31
TRIQFRNGN

SEQ ID NO: 36191 - protein, 9 aa, Borrelia burgdorferi B31
RIQFRNGNK

SEQ ID NO: 36192 - protein, 9 aa, Borrelia burgdorferi B31
IQFRNGNKI

SEQ ID NO: 36193 - protein, 9 aa, Borrelia burgdorferi B31
QFRNGNKID

SEQ ID NO: 36194 - protein, 9 aa, Borrelia burgdorferi B31
FRNGNKIDS

SEQ ID NO: 36195 - protein, 9 aa, Borrelia burgdorferi B31
RNGNKIDSL

SEQ ID NO: 36196 - protein, 9 aa, Borrelia burgdorferi B31
NGNKIDSLG

SEQ ID NO: 36197 - protein, 9 aa, Borrelia burgdorferi B31
GNKIDSLGY

SEQ ID NO: 36198 - protein, 9 aa, Borrelia burgdorferi B31
NKIDSLGYQ

SEQ ID NO: 36199 - protein, 9 aa, Borrelia burgdorferi B31
KIDSLGYQG

SEQ ID NO: 36200 - protein, 9 aa, Borrelia burgdorferi B31
IDSLGYQGS

SEQ ID NO: 36201 - protein, 9 aa, Borrelia burgdorferi B31
DSLGYQGSL

SEQ ID NO: 36202 - protein, 9 aa, Borrelia burgdorferi B31
SLGYQGSLG

SEQ ID NO: 36203 - protein, 9 aa, Borrelia burgdorferi B31
LGYQGSLGE

SEQ ID NO: 36204 - protein, 9 aa, Borrelia burgdorferi B31
GYQGSLGEP

SEQ ID NO: 36205 - protein, 9 aa, Borrelia burgdorferi B31
YQGSLGEPI

SEQ ID NO: 36206 - protein, 9 aa, Borrelia burgdorferi B31
QGSLGEPIL

SEQ ID NO: 36207 - protein, 9 aa, Borrelia burgdorferi B31
GSLGEPILL

SEQ ID NO: 36208 - protein, 9 aa, Borrelia burgdorferi B31
SLGEPILLK

SEQ ID NO: 36209 - protein, 9 aa, Borrelia burgdorferi B31
LGEPILLKD

SEQ ID NO: 36210 - protein, 9 aa, Borrelia burgdorferi B31
GEPILLKDK

SEQ ID NO: 36211 - protein, 9 aa, Borrelia burgdorferi B31
EPILLKDKL

SEQ ID NO: 36212 - protein, 9 aa, Borrelia burgdorferi B31
PILLKDKLT

SEQ ID NO: 36213 - protein, 9 aa, Borrelia burgdorferi B31
ILLKDKLTF

SEQ ID NO: 36214 - protein, 9 aa, Borrelia burgdorferi B31
LLKDKLTFS

SEQ ID NO: 36215 - protein, 9 aa, Borrelia burgdorferi B31
LKDKLTFSI

SEQ ID NO: 36216 - protein, 9 aa, Borrelia burgdorferi B31
KDKLTFSIC

SEQ ID NO: 36217 - protein, 9 aa, Borrelia burgdorferi B31
DKLTFSICD

SEQ ID NO: 36218 - protein, 9 aa, Borrelia burgdorferi B31
KLTFSICDG

SEQ ID NO: 36219 - protein, 9 aa, Borrelia burgdorferi B31
LTFSICDGK

SEQ ID NO: 36220 - protein, 9 aa, Borrelia burgdorferi B31
TFSICDGKN

SEQ ID NO: 36221 - protein, 9 aa, Borrelia burgdorferi B31
FSICDGKNI

SEQ ID NO: 36222 - protein, 9 aa, Borrelia burgdorferi B31
SICDGKNID

SEQ ID NO: 36223 - protein, 9 aa, Borrelia burgdorferi B31
ICDGKNIDN

SEQ ID NO: 36224 - protein, 9 aa, Borrelia burgdorferi B31
CDGKNIDNR

SEQ ID NO: 36225 - protein, 9 aa, Borrelia burgdorferi B31
DGKNIDNRK

SEQ ID NO: 36226 - protein, 9 aa, Borrelia burgdorferi B31
GKNIDNRKE

SEQ ID NO: 36227 - protein, 9 aa, Borrelia burgdorferi B31
KNIDNRKEY

SEQ ID NO: 36228 - protein, 9 aa, Borrelia burgdorferi B31
NIDNRKEYE

SEQ ID NO: 36229 - protein, 9 aa, Borrelia burgdorferi B31
IDNRKEYEI

SEQ ID NO: 36230 - protein, 9 aa, Borrelia burgdorferi B31
DNRKEYEIT

SEQ ID NO: 36231 - protein, 9 aa, Borrelia burgdorferi B31
NRKEYEITK

SEQ ID NO: 36232 - protein, 9 aa, Borrelia burgdorferi B31
RKEYEITKN

SEQ ID NO: 36233 - protein, 9 aa, Borrelia burgdorferi B31
KEYEITKNA

SEQ ID NO: 36234 - protein, 9 aa, Borrelia burgdorferi B31
EYEITKNAP

SEQ ID NO: 36235 - protein, 9 aa, Borrelia burgdorferi B31
YEITKNAPS

SEQ ID NO: 36236 - protein, 9 aa, Borrelia burgdorferi B31
EITKNAPSL

SEQ ID NO: 36237 - protein, 9 aa, Borrelia burgdorferi B31
ITKNAPSLD

SEQ ID NO: 36238 - protein, 9 aa, Borrelia burgdorferi B31
TKNAPSLDS

SEQ ID NO: 36239 - protein, 9 aa, Borrelia burgdorferi B31
KNAPSLDSL

SEQ ID NO: 36240 - protein, 9 aa, Borrelia burgdorferi B31
NAPSLDSLI

SEQ ID NO: 36241 - protein, 9 aa, Borrelia burgdorferi B31
APSLDSLIE

SEQ ID NO: 36242 - protein, 9 aa, Borrelia burgdorferi B31
PSLDSLIEY

SEQ ID NO: 36243 - protein, 9 aa, Borrelia burgdorferi B31
SLDSLIEYL

SEQ ID NO: 36244 - protein, 9 aa, Borrelia burgdorferi B31
LDSLIEYLE

SEQ ID NO: 36245 - protein, 9 aa, Borrelia burgdorferi B31
DSLIEYLEH

SEQ ID NO: 36246 - protein, 9 aa, Borrelia burgdorferi B31
SLIEYLEHM

SEQ ID NO: 36247 - protein, 9 aa, Borrelia burgdorferi B31
LIEYLEHMI

SEQ ID NO: 36248 - protein, 9 aa, Borrelia burgdorferi B31
IEYLEHMIL

SEQ ID NO: 36249 - protein, 9 aa, Borrelia burgdorferi B31
EYLEHMILF

SEQ ID NO: 36250 - protein, 9 aa, Borrelia burgdorferi B31
YLEHMILFF

SEQ ID NO: 36251 - protein, 9 aa, Borrelia burgdorferi B31
LEHMILFFL

SEQ ID NO: 36252 - protein, 9 aa, Borrelia burgdorferi B31
EHMILFFLE

SEQ ID NO: 36253 - protein, 9 aa, Borrelia burgdorferi B31
HMILFFLEK

SEQ ID NO: 36254 - protein, 9 aa, Borrelia burgdorferi B31
MILFFLEKT

SEQ ID NO: 36255 - protein, 9 aa, Borrelia burgdorferi B31
ILFFLEKTP

SEQ ID NO: 36256 - protein, 9 aa, Borrelia burgdorferi B31
LFFLEKTPV

SEQ ID NO: 36257 - protein, 9 aa, Borrelia burgdorferi B31
FFLEKTPVG

SEQ ID NO: 36258 - protein, 9 aa, Borrelia burgdorferi B31
FLEKTPVGT

SEQ ID NO: 36259 - protein, 9 aa, Borrelia burgdorferi B31
LEKTPVGTL

SEQ ID NO: 36260 - protein, 9 aa, Borrelia burgdorferi B31
EKTPVGTLT

SEQ ID NO: 36261 - protein, 9 aa, Borrelia burgdorferi B31
KTPVGTLTA

SEQ ID NO: 36262 - protein, 9 aa, Borrelia burgdorferi B31
TPVGTLTAK

SEQ ID NO: 36263 - protein, 9 aa, Borrelia burgdorferi B31
PVGTLTAKF

SEQ ID NO: 36264 - protein, 9 aa, Borrelia burgdorferi B31
VGTLTAKFA

SEQ ID NO: 36265 - protein, 9 aa, Borrelia burgdorferi B31
GTLTAKFAM

SEQ ID NO: 36266 - protein, 9 aa, Borrelia burgdorferi B31
TLTAKFAME

SEQ ID NO: 36267 - protein, 9 aa, Borrelia burgdorferi B31
LTAKFAMEG

SEQ ID NO: 36268 - protein, 9 aa, Borrelia burgdorferi B31
TAKFAMEGS

SEQ ID NO: 36269 - protein, 9 aa, Borrelia burgdorferi B31
AKFAMEGSI

SEQ ID NO: 36270 - protein, 9 aa, Borrelia burgdorferi B31
KFAMEGSIL

SEQ ID NO: 36271 - protein, 9 aa, Borrelia burgdorferi B31
FAMEGSILT

SEQ ID NO: 36272 - protein, 9 aa, Borrelia burgdorferi B31
AMEGSILTR

SEQ ID NO: 36273 - protein, 9 aa, Borrelia burgdorferi B31
MEGSILTRS

SEQ ID NO: 36274 - protein, 9 aa, Borrelia burgdorferi B31
EGSILTRSK

SEQ ID NO: 36275 - protein, 9 aa, Borrelia burgdorferi B31
GSILTRSKL

SEQ ID NO: 36276 - protein, 9 aa, Borrelia burgdorferi B31
SILTRSKLI

SEQ ID NO: 36277 - protein, 9 aa, Borrelia burgdorferi B31
ILTRSKLIQ

SEQ ID NO: 36278 - protein, 9 aa, Borrelia burgdorferi B31
LTRSKLIQA

SEQ ID NO: 36279 - protein, 9 aa, Borrelia burgdorferi B31
TRSKLIQAF

SEQ ID NO: 36280 - protein, 9 aa, Borrelia burgdorferi B31
RSKLIQAFT

SEQ ID NO: 36281 - protein, 9 aa, Borrelia burgdorferi B31
SKLIQAFTN

SEQ ID NO: 36282 - protein, 9 aa, Borrelia burgdorferi B31
KLIQAFTNT

SEQ ID NO: 36283 - protein, 9 aa, Borrelia burgdorferi B31
LIQAFTNTN

SEQ ID NO: 36284 - protein, 9 aa, Borrelia burgdorferi B31
IQAFTNTNK

SEQ ID NO: 36285 - protein, 9 aa, Borrelia burgdorferi B31
QAFTNTNKF

SEQ ID NO: 36286 - protein, 9 aa, Borrelia burgdorferi B31
AFTNTNKFC

SEQ ID NO: 36287 - protein, 9 aa, Borrelia burgdorferi B31
FTNTNKFCI

SEQ ID NO: 36288 - protein, 9 aa, Borrelia burgdorferi B31
TNTNKFCIP

SEQ ID NO: 36289 - protein, 9 aa, Borrelia burgdorferi B31
NTNKFCIPD

SEQ ID NO: 36290 - protein, 9 aa, Borrelia burgdorferi B31
TNKFCIPDG

SEQ ID NO: 36291 - protein, 9 aa, Borrelia burgdorferi B31
NKFCIPDGR

SEQ ID NO: 36292 - protein, 9 aa, Borrelia burgdorferi B31
KFCIPDGRS

SEQ ID NO: 36293 - protein, 9 aa, Borrelia burgdorferi B31
FCIPDGRSL

SEQ ID NO: 36294 - protein, 9 aa, Borrelia burgdorferi B31
CIPDGRSLP

SEQ ID NO: 36295 - protein, 9 aa, Borrelia burgdorferi B31
IPDGRSLPS

SEQ ID NO: 36296 - protein, 9 aa, Borrelia burgdorferi B31
PDGRSLPSN

SEQ ID NO: 36297 - protein, 9 aa, Borrelia burgdorferi B31
DGRSLPSNC

SEQ ID NO: 36298 - protein, 9 aa, Borrelia burgdorferi B31
GRSLPSNCY

SEQ ID NO: 36299 - protein, 9 aa, Borrelia burgdorferi B31
RSLPSNCYA

SEQ ID NO: 36300 - protein, 9 aa, Borrelia burgdorferi B31
SLPSNCYAY

SEQ ID NO: 36301 - protein, 9 aa, Borrelia burgdorferi B31
LPSNCYAYK

SEQ ID NO: 36302 - protein, 9 aa, Borrelia burgdorferi B31
PSNCYAYKV

SEQ ID NO: 36303 - protein, 9 aa, Borrelia burgdorferi B31
SNCYAYKVL

SEQ ID NO: 36304 - protein, 9 aa, Borrelia burgdorferi B31
NCYAYKVLG

SEQ ID NO: 36305 - protein, 9 aa, Borrelia burgdorferi B31
CYAYKVLGI

SEQ ID NO: 36306 - protein, 9 aa, Borrelia burgdorferi B31
YAYKVLGIS

SEQ ID NO: 36307 - protein, 9 aa, Borrelia burgdorferi B31
AYKVLGISS

SEQ ID NO: 36308 - protein, 9 aa, Borrelia burgdorferi B31
YKVLGISSA

SEQ ID NO: 36309 - protein, 9 aa, Borrelia burgdorferi B31
KVLGISSAP

SEQ ID NO: 36310 - protein, 9 aa, Borrelia burgdorferi B31
VLGISSAPK

SEQ ID NO: 36311 - protein, 9 aa, Borrelia burgdorferi B31
LGISSAPKL

SEQ ID NO: 36312 - protein, 9 aa, Borrelia burgdorferi B31
GISSAPKLS

SEQ ID NO: 36313 - protein, 9 aa, Borrelia burgdorferi B31
ISSAPKLSG

SEQ ID NO: 36314 - protein, 9 aa, Borrelia burgdorferi B31
SSAPKLSGR

SEQ ID NO: 36315 - protein, 9 aa, Borrelia burgdorferi B31
SAPKLSGRF

SEQ ID NO: 36316 - protein, 9 aa, Borrelia burgdorferi B31
APKLSGRFL

SEQ ID NO: 36317 - protein, 9 aa, Borrelia burgdorferi B31
PKLSGRFLR

SEQ ID NO: 36318 - protein, 9 aa, Borrelia burgdorferi B31
KLSGRFLRH

SEQ ID NO: 36319 - protein, 9 aa, Borrelia burgdorferi B31
LSGRFLRHY

SEQ ID NO: 36320 - protein, 9 aa, Borrelia burgdorferi B31
SGRFLRHYD

SEQ ID NO: 36321 - protein, 9 aa, Borrelia burgdorferi B31
GRFLRHYDS

SEQ ID NO: 36322 - protein, 9 aa, Borrelia burgdorferi B31
RFLRHYDSG

SEQ ID NO: 36323 - protein, 9 aa, Borrelia burgdorferi B31
FLRHYDSGG

SEQ ID NO: 36324 - protein, 9 aa, Borrelia burgdorferi B31
LRHYDSGGS

SEQ ID NO: 36325 - protein, 9 aa, Borrelia burgdorferi B31
RHYDSGGST

SEQ ID NO: 36326 - protein, 9 aa, Borrelia burgdorferi B31
HYDSGGSTD

SEQ ID NO: 36327 - protein, 9 aa, Borrelia burgdorferi B31
YDSGGSTDS

SEQ ID NO: 36328 - protein, 9 aa, Borrelia burgdorferi B31
DSGGSTDSD

SEQ ID NO: 36329 - protein, 9 aa, Borrelia burgdorferi B31
SGGSTDSDG

SEQ ID NO: 36330 - protein, 9 aa, Borrelia burgdorferi B31
GGSTDSDGT

SEQ ID NO: 36331 - protein, 9 aa, Borrelia burgdorferi B31
GSTDSDGTR

SEQ ID NO: 36332 - protein, 9 aa, Borrelia burgdorferi B31
STDSDGTRS

SEQ ID NO: 36333 - protein, 9 aa, Borrelia burgdorferi B31
TDSDGTRSL

SEQ ID NO: 36334 - protein, 9 aa, Borrelia burgdorferi B31
DSDGTRSLG

SEQ ID NO: 36335 - protein, 9 aa, Borrelia burgdorferi B31
SDGTRSLGH

SEQ ID NO: 36336 - protein, 9 aa, Borrelia burgdorferi B31
DGTRSLGHT

SEQ ID NO: 36337 - protein, 9 aa, Borrelia burgdorferi B31
GTRSLGHTQ

SEQ ID NO: 36338 - protein, 9 aa, Borrelia burgdorferi B31
TRSLGHTQE

SEQ ID NO: 36339 - protein, 9 aa, Borrelia burgdorferi B31
RSLGHTQED

SEQ ID NO: 36340 - protein, 9 aa, Borrelia burgdorferi B31
SLGHTQEDS

SEQ ID NO: 36341 - protein, 9 aa, Borrelia burgdorferi B31
LGHTQEDSY

SEQ ID NO: 36342 - protein, 9 aa, Borrelia burgdorferi B31
GHTQEDSYK

SEQ ID NO: 36343 - protein, 9 aa, Borrelia burgdorferi B31
HTQEDSYKN

SEQ ID NO: 36344 - protein, 9 aa, Borrelia burgdorferi B31
TQEDSYKNH

SEQ ID NO: 36345 - protein, 9 aa, Borrelia burgdorferi B31
QEDSYKNHD

SEQ ID NO: 36346 - protein, 9 aa, Borrelia burgdorferi B31
EDSYKNHDH

SEQ ID NO: 36347 - protein, 9 aa, Borrelia burgdorferi B31
DSYKNHDHD

SEQ ID NO: 36348 - protein, 9 aa, Borrelia burgdorferi B31
SYKNHDHDL

SEQ ID NO: 36349 - protein, 9 aa, Borrelia burgdorferi B31
YKNHDHDLD

SEQ ID NO: 36350 - protein, 9 aa, Borrelia burgdorferi B31
KNHDHDLDF

SEQ ID NO: 36351 - protein, 9 aa, Borrelia burgdorferi B31
NHDHDLDFS

SEQ ID NO: 36352 - protein, 9 aa, Borrelia burgdorferi B31
HDHDLDFSR

SEQ ID NO: 36353 - protein, 9 aa, Borrelia burgdorferi B31
DHDLDFSRI

SEQ ID NO: 36354 - protein, 9 aa, Borrelia burgdorferi B31
HDLDFSRIN

SEQ ID NO: 36355 - protein, 9 aa, Borrelia burgdorferi B31
DLDFSRINF

SEQ ID NO: 36356 - protein, 9 aa, Borrelia burgdorferi B31
LDFSRINFK

SEQ ID NO: 36357 - protein, 9 aa, Borrelia burgdorferi B31
DFSRINFKG

SEQ ID NO: 36358 - protein, 9 aa, Borrelia burgdorferi B31
FSRINFKGK

SEQ ID NO: 36359 - protein, 9 aa, Borrelia burgdorferi B31
SRINFKGKL

SEQ ID NO: 36360 - protein, 9 aa, Borrelia burgdorferi B31
RINFKGKLV

SEQ ID NO: 36361 - protein, 9 aa, Borrelia burgdorferi B31
INFKGKLVK

SEQ ID NO: 36362 - protein, 9 aa, Borrelia burgdorferi B31
NFKGKLVKR

SEQ ID NO: 36363 - protein, 9 aa, Borrelia burgdorferi B31
FKGKLVKRM

SEQ ID NO: 36364 - protein, 9 aa, Borrelia burgdorferi B31
KGKLVKRMT

SEQ ID NO: 36365 - protein, 9 aa, Borrelia burgdorferi B31
GKLVKRMTM

SEQ ID NO: 36366 - protein, 9 aa, Borrelia burgdorferi B31
KLVKRMTMI

SEQ ID NO: 36367 - protein, 9 aa, Borrelia burgdorferi B31
LVKRMTMIY

SEQ ID NO: 36368 - protein, 9 aa, Borrelia burgdorferi B31
VKRMTMIYR

SEQ ID NO: 36369 - protein, 9 aa, Borrelia burgdorferi B31
KRMTMIYRS

SEQ ID NO: 36370 - protein, 9 aa, Borrelia burgdorferi B31
RMTMIYRSA

SEQ ID NO: 36371 - protein, 9 aa, Borrelia burgdorferi B31
MTMIYRSAD

SEQ ID NO: 36372 - protein, 9 aa, Borrelia burgdorferi B31
TMIYRSADT

SEQ ID NO: 36373 - protein, 9 aa, Borrelia burgdorferi B31
MIYRSADTW

SEQ ID NO: 36374 - protein, 9 aa, Borrelia burgdorferi B31
IYRSADTWY

SEQ ID NO: 36375 - protein, 9 aa, Borrelia burgdorferi B31
YRSADTWYT

SEQ ID NO: 36376 - protein, 9 aa, Borrelia burgdorferi B31
RSADTWYTW

SEQ ID NO: 36377 - protein, 9 aa, Borrelia burgdorferi B31
SADTWYTWY

SEQ ID NO: 36378 - protein, 9 aa, Borrelia burgdorferi B31
ADTWYTWYW

SEQ ID NO: 36379 - protein, 9 aa, Borrelia burgdorferi B31
DTWYTWYWA

SEQ ID NO: 36380 - protein, 9 aa, Borrelia burgdorferi B31
TWYTWYWAE

SEQ ID NO: 36381 - protein, 9 aa, Borrelia burgdorferi B31
WYTWYWAEE

SEQ ID NO: 36382 - protein, 9 aa, Borrelia burgdorferi B31
YTWYWAEEI

SEQ ID NO: 36383 - protein, 9 aa, Borrelia burgdorferi B31
TWYWAEEIM

SEQ ID NO: 36384 - protein, 9 aa, Borrelia burgdorferi B31
WYWAEEIMS

SEQ ID NO: 36385 - protein, 9 aa, Borrelia burgdorferi B31
YWAEEIMSP

SEQ ID NO: 36386 - protein, 9 aa, Borrelia burgdorferi B31
WAEEIMSPF

SEQ ID NO: 36387 - protein, 9 aa, Borrelia burgdorferi B31
AEEIMSPFI

SEQ ID NO: 36388 - protein, 9 aa, Borrelia burgdorferi B31
EEIMSPFIT

SEQ ID NO: 36389 - protein, 9 aa, Borrelia burgdorferi B31
EIMSPFITG

SEQ ID NO: 36390 - protein, 9 aa, Borrelia burgdorferi B31
IMSPFITGY

SEQ ID NO: 36391 - protein, 9 aa, Borrelia burgdorferi B31
MSPFITGYS

SEQ ID NO: 36392 - protein, 9 aa, Borrelia burgdorferi B31
SPFITGYSY

SEQ ID NO: 36393 - protein, 9 aa, Borrelia burgdorferi B31
PFITGYSYE

SEQ ID NO: 36394 - protein, 9 aa, Borrelia burgdorferi B31
FITGYSYEE

SEQ ID NO: 36395 - protein, 9 aa, Borrelia burgdorferi B31
ITGYSYEEI

SEQ ID NO: 36396 - protein, 9 aa, Borrelia burgdorferi B31
TGYSYEEID

SEQ ID NO: 36397 - protein, 9 aa, Borrelia burgdorferi B31
GYSYEEIDP

SEQ ID NO: 36398 - protein, 9 aa, Borrelia burgdorferi B31
YSYEEIDPE

SEQ ID NO: 36399 - protein, 9 aa, Borrelia burgdorferi B31
SYEEIDPEY

SEQ ID NO: 36400 - protein, 9 aa, Borrelia burgdorferi B31
YEEIDPEYL

SEQ ID NO: 36401 - protein, 9 aa, Borrelia burgdorferi B31
EEIDPEYLL

SEQ ID NO: 36402 - protein, 9 aa, Borrelia burgdorferi B31
EIDPEYLLP

SEQ ID NO: 36403 - protein, 9 aa, Borrelia burgdorferi B31
IDPEYLLPP

SEQ ID NO: 36404 - protein, 9 aa, Borrelia burgdorferi B31
DPEYLLPPF

SEQ ID NO: 36405 - protein, 9 aa, Borrelia burgdorferi B31
PEYLLPPFT

SEQ ID NO: 36406 - protein, 9 aa, Borrelia burgdorferi B31
EYLLPPFTS

SEQ ID NO: 36407 - protein, 9 aa, Borrelia burgdorferi B31
YLLPPFTSQ

SEQ ID NO: 36408 - protein, 9 aa, Borrelia burgdorferi B31
LLPPFTSQS

SEQ ID NO: 36409 - protein, 9 aa, Borrelia burgdorferi B31
LPPFTSQSG

SEQ ID NO: 36410 - protein, 9 aa, Borrelia burgdorferi B31
PPFTSQSGS

SEQ ID NO: 36411 - protein, 9 aa, Borrelia burgdorferi B31
PFTSQSGSK

SEQ ID NO: 36412 - protein, 9 aa, Borrelia burgdorferi B31
FTSQSGSKE

SEQ ID NO: 36413 - protein, 9 aa, Borrelia burgdorferi B31
TSQSGSKET

SEQ ID NO: 36414 - protein, 9 aa, Borrelia burgdorferi B31
SQSGSKETK

SEQ ID NO: 36415 - protein, 9 aa, Borrelia burgdorferi B31
QSGSKETKP

SEQ ID NO: 36416 - protein, 9 aa, Borrelia burgdorferi B31
SGSKETKPK

SEQ ID NO: 36417 - protein, 9 aa, Borrelia burgdorferi B31
GSKETKPKN

SEQ ID NO: 36418 - protein, 9 aa, Borrelia burgdorferi B31
SKETKPKNT

SEQ ID NO: 36419 - protein, 9 aa, Borrelia burgdorferi B31
KETKPKNTC

SEQ ID NO: 36420 - protein, 9 aa, Borrelia burgdorferi B31
ETKPKNTCY

SEQ ID NO: 36421 - protein, 9 aa, Borrelia burgdorferi B31
TKPKNTCYI

SEQ ID NO: 36422 - protein, 9 aa, Borrelia burgdorferi B31
KPKNTCYIS

SEQ ID NO: 36423 - protein, 9 aa, Borrelia burgdorferi B31
PKNTCYISF

SEQ ID NO: 36424 - protein, 9 aa, Borrelia burgdorferi B31
KNTCYISFY

SEQ ID NO: 36425 - protein, 9 aa, Borrelia burgdorferi B31
NTCYISFYR

SEQ ID NO: 36426 - protein, 9 aa, Borrelia burgdorferi B31
TCYISFYRY

SEQ ID NO: 36427 - protein, 9 aa, Borrelia burgdorferi B31
CYISFYRYD

SEQ ID NO: 36428 - protein, 9 aa, Borrelia burgdorferi B31
YISFYRYDL

SEQ ID NO: 36429 - protein, 10 aa, Borrelia burgdorferi B31
MITQQDYTEI

SEQ ID NO: 36430 - protein, 10 aa, Borrelia burgdorferi B31
ITQQDYTEIK

SEQ ID NO: 36431 - protein, 10 aa, Borrelia burgdorferi B31
TQQDYTEIKK

SEQ ID NO: 36432 - protein, 10 aa, Borrelia burgdorferi B31
QQDYTEIKKK

SEQ ID NO: 36433 - protein, 10 aa, Borrelia burgdorferi B31
QDYTEIKKKL

SEQ ID NO: 36434 - protein, 10 aa, Borrelia burgdorferi B31
DYTEIKKKLE

SEQ ID NO: 36435 - protein, 10 aa, Borrelia burgdorferi B31
YTEIKKKLEN

SEQ ID NO: 36436 - protein, 10 aa, Borrelia burgdorferi B31
TEIKKKLENT

SEQ ID NO: 36437 - protein, 10 aa, Borrelia burgdorferi B31
EIKKKLENTK

SEQ ID NO: 36438 - protein, 10 aa, Borrelia burgdorferi B31
IKKKLENTKT

SEQ ID NO: 36439 - protein, 10 aa, Borrelia burgdorferi B31
KKKLENTKTR

SEQ ID NO: 36440 - protein, 10 aa, Borrelia burgdorferi B31
KKLENTKTRI

SEQ ID NO: 36441 - protein, 10 aa, Borrelia burgdorferi B31
KLENTKTRIQ

SEQ ID NO: 36442 - protein, 10 aa, Borrelia burgdorferi B31
LENTKTRIQF

SEQ ID NO: 36443 - protein, 10 aa, Borrelia burgdorferi B31
ENTKTRIQFR

SEQ ID NO: 36444 - protein, 10 aa, Borrelia burgdorferi B31
NTKTRIQFRN

SEQ ID NO: 36445 - protein, 10 aa, Borrelia burgdorferi B31
TKTRIQFRNG

SEQ ID NO: 36446 - protein, 10 aa, Borrelia burgdorferi B31
KTRIQFRNGN

SEQ ID NO: 36447 - protein, 10 aa, Borrelia burgdorferi B31
TRIQFRNGNK

SEQ ID NO: 36448 - protein, 10 aa, Borrelia burgdorferi B31
RIQFRNGNKI

SEQ ID NO: 36449 - protein, 10 aa, Borrelia burgdorferi B31
IQFRNGNKID

SEQ ID NO: 36450 - protein, 10 aa, Borrelia burgdorferi B31
QFRNGNKIDS

SEQ ID NO: 36451 - protein, 10 aa, Borrelia burgdorferi B31
FRNGNKIDSL

SEQ ID NO: 36452 - protein, 10 aa, Borrelia burgdorferi B31
RNGNKIDSLG

SEQ ID NO: 36453 - protein, 10 aa, Borrelia burgdorferi B31
NGNKIDSLGY

SEQ ID NO: 36454 - protein, 10 aa, Borrelia burgdorferi B31
GNKIDSLGYQ

SEQ ID NO: 36455 - protein, 10 aa, Borrelia burgdorferi B31
NKIDSLGYQG

SEQ ID NO: 36456 - protein, 10 aa, Borrelia burgdorferi B31
KIDSLGYQGS

SEQ ID NO: 36457 - protein, 10 aa, Borrelia burgdorferi B31
IDSLGYQGSL

SEQ ID NO: 36458 - protein, 10 aa, Borrelia burgdorferi B31
DSLGYQGSLG

SEQ ID NO: 36459 - protein, 10 aa, Borrelia burgdorferi B31
SLGYQGSLGE

SEQ ID NO: 36460 - protein, 10 aa, Borrelia burgdorferi B31
LGYQGSLGEP

SEQ ID NO: 36461 - protein, 10 aa, Borrelia burgdorferi B31
GYQGSLGEPI

SEQ ID NO: 36462 - protein, 10 aa, Borrelia burgdorferi B31
YQGSLGEPIL

SEQ ID NO: 36463 - protein, 10 aa, Borrelia burgdorferi B31
QGSLGEPILL

SEQ ID NO: 36464 - protein, 10 aa, Borrelia burgdorferi B31
GSLGEPILLK

SEQ ID NO: 36465 - protein, 10 aa, Borrelia burgdorferi B31
SLGEPILLKD

SEQ ID NO: 36466 - protein, 10 aa, Borrelia burgdorferi B31
LGEPILLKDK

SEQ ID NO: 36467 - protein, 10 aa, Borrelia burgdorferi B31
GEPILLKDKL

SEQ ID NO: 36468 - protein, 10 aa, Borrelia burgdorferi B31
EPILLKDKLT

SEQ ID NO: 36469 - protein, 10 aa, Borrelia burgdorferi B31
PILLKDKLTF

SEQ ID NO: 36470 - protein, 10 aa, Borrelia burgdorferi B31
ILLKDKLTFS

SEQ ID NO: 36471 - protein, 10 aa, Borrelia burgdorferi B31
LLKDKLTFSI

SEQ ID NO: 36472 - protein, 10 aa, Borrelia burgdorferi B31
LKDKLTFSIC

SEQ ID NO: 36473 - protein, 10 aa, Borrelia burgdorferi B31
KDKLTFSICD

SEQ ID NO: 36474 - protein, 10 aa, Borrelia burgdorferi B31
DKLTFSICDG

SEQ ID NO: 36475 - protein, 10 aa, Borrelia burgdorferi B31
KLTFSICDGK

SEQ ID NO: 36476 - protein, 10 aa, Borrelia burgdorferi B31
LTFSICDGKN

SEQ ID NO: 36477 - protein, 10 aa, Borrelia burgdorferi B31
TFSICDGKNI

SEQ ID NO: 36478 - protein, 10 aa, Borrelia burgdorferi B31
FSICDGKNID

SEQ ID NO: 36479 - protein, 10 aa, Borrelia burgdorferi B31
SICDGKNIDN

SEQ ID NO: 36480 - protein, 10 aa, Borrelia burgdorferi B31
ICDGKNIDNR

SEQ ID NO: 36481 - protein, 10 aa, Borrelia burgdorferi B31
CDGKNIDNRK

SEQ ID NO: 36482 - protein, 10 aa, Borrelia burgdorferi B31
DGKNIDNRKE

SEQ ID NO: 36483 - protein, 10 aa, Borrelia burgdorferi B31
GKNIDNRKEY

SEQ ID NO: 36484 - protein, 10 aa, Borrelia burgdorferi B31
KNIDNRKEYE

SEQ ID NO: 36485 - protein, 10 aa, Borrelia burgdorferi B31
NIDNRKEYEI

SEQ ID NO: 36486 - protein, 10 aa, Borrelia burgdorferi B31
IDNRKEYEIT

SEQ ID NO: 36487 - protein, 10 aa, Borrelia burgdorferi B31
DNRKEYEITK

SEQ ID NO: 36488 - protein, 10 aa, Borrelia burgdorferi B31
NRKEYEITKN

SEQ ID NO: 36489 - protein, 10 aa, Borrelia burgdorferi B31
RKEYEITKNA

SEQ ID NO: 36490 - protein, 10 aa, Borrelia burgdorferi B31
KEYEITKNAP

SEQ ID NO: 36491 - protein, 10 aa, Borrelia burgdorferi B31
EYEITKNAPS

SEQ ID NO: 36492 - protein, 10 aa, Borrelia burgdorferi B31
YEITKNAPSL

SEQ ID NO: 36493 - protein, 10 aa, Borrelia burgdorferi B31
EITKNAPSLD

SEQ ID NO: 36494 - protein, 10 aa, Borrelia burgdorferi B31
ITKNAPSLDS

SEQ ID NO: 36495 - protein, 10 aa, Borrelia burgdorferi B31
TKNAPSLDSL

SEQ ID NO: 36496 - protein, 10 aa, Borrelia burgdorferi B31
KNAPSLDSLI

SEQ ID NO: 36497 - protein, 10 aa, Borrelia burgdorferi B31
NAPSLDSLIE

SEQ ID NO: 36498 - protein, 10 aa, Borrelia burgdorferi B31
APSLDSLIEY

SEQ ID NO: 36499 - protein, 10 aa, Borrelia burgdorferi B31
PSLDSLIEYL

SEQ ID NO: 36500 - protein, 10 aa, Borrelia burgdorferi B31
SLDSLIEYLE

SEQ ID NO: 36501 - protein, 10 aa, Borrelia burgdorferi B31
LDSLIEYLEH

SEQ ID NO: 36502 - protein, 10 aa, Borrelia burgdorferi B31
DSLIEYLEHM

SEQ ID NO: 36503 - protein, 10 aa, Borrelia burgdorferi B31
SLIEYLEHMI

SEQ ID NO: 36504 - protein, 10 aa, Borrelia burgdorferi B31
LIEYLEHMIL

SEQ ID NO: 36505 - protein, 10 aa, Borrelia burgdorferi B31
IEYLEHMILF

SEQ ID NO: 36506 - protein, 10 aa, Borrelia burgdorferi B31
EYLEHMILFF

SEQ ID NO: 36507 - protein, 10 aa, Borrelia burgdorferi B31
YLEHMILFFL

SEQ ID NO: 36508 - protein, 10 aa, Borrelia burgdorferi B31
LEHMILFFLE

SEQ ID NO: 36509 - protein, 10 aa, Borrelia burgdorferi B31
EHMILFFLEK

SEQ ID NO: 36510 - protein, 10 aa, Borrelia burgdorferi B31
HMILFFLEKT

SEQ ID NO: 36511 - protein, 10 aa, Borrelia burgdorferi B31
MILFFLEKTP

SEQ ID NO: 36512 - protein, 10 aa, Borrelia burgdorferi B31
ILFFLEKTPV

SEQ ID NO: 36513 - protein, 10 aa, Borrelia burgdorferi B31
LFFLEKTPVG

SEQ ID NO: 36514 - protein, 10 aa, Borrelia burgdorferi B31
FFLEKTPVGT

SEQ ID NO: 36515 - protein, 10 aa, Borrelia burgdorferi B31
FLEKTPVGTL

SEQ ID NO: 36516 - protein, 10 aa, Borrelia burgdorferi B31
LEKTPVGTLT

SEQ ID NO: 36517 - protein, 10 aa, Borrelia burgdorferi B31
EKTPVGTLTA

SEQ ID NO: 36518 - protein, 10 aa, Borrelia burgdorferi B31
KTPVGTLTAK

SEQ ID NO: 36519 - protein, 10 aa, Borrelia burgdorferi B31
TPVGTLTAKF

SEQ ID NO: 36520 - protein, 10 aa, Borrelia burgdorferi B31
PVGTLTAKFA

SEQ ID NO: 36521 - protein, 10 aa, Borrelia burgdorferi B31
VGTLTAKFAM

SEQ ID NO: 36522 - protein, 10 aa, Borrelia burgdorferi B31
GTLTAKFAME

SEQ ID NO: 36523 - protein, 10 aa, Borrelia burgdorferi B31
TLTAKFAMEG

SEQ ID NO: 36524 - protein, 10 aa, Borrelia burgdorferi B31
LTAKFAMEGS

SEQ ID NO: 36525 - protein, 10 aa, Borrelia burgdorferi B31
TAKFAMEGSI

SEQ ID NO: 36526 - protein, 10 aa, Borrelia burgdorferi B31
AKFAMEGSIL

SEQ ID NO: 36527 - protein, 10 aa, Borrelia burgdorferi B31
KFAMEGSILT

SEQ ID NO: 36528 - protein, 10 aa, Borrelia burgdorferi B31
FAMEGSILTR

SEQ ID NO: 36529 - protein, 10 aa, Borrelia burgdorferi B31
AMEGSILTRS

SEQ ID NO: 36530 - protein, 10 aa, Borrelia burgdorferi B31
MEGSILTRSK

SEQ ID NO: 36531 - protein, 10 aa, Borrelia burgdorferi B31
EGSILTRSKL

SEQ ID NO: 36532 - protein, 10 aa, Borrelia burgdorferi B31
GSILTRSKLI

SEQ ID NO: 36533 - protein, 10 aa, Borrelia burgdorferi B31
SILTRSKLIQ

SEQ ID NO: 36534 - protein, 10 aa, Borrelia burgdorferi B31
ILTRSKLIQA

SEQ ID NO: 36535 - protein, 10 aa, Borrelia burgdorferi B31
LTRSKLIQAF

SEQ ID NO: 36536 - protein, 10 aa, Borrelia burgdorferi B31
TRSKLIQAFT

SEQ ID NO: 36537 - protein, 10 aa, Borrelia burgdorferi B31
RSKLIQAFTN

SEQ ID NO: 36538 - protein, 10 aa, Borrelia burgdorferi B31
SKLIQAFTNT

SEQ ID NO: 36539 - protein, 10 aa, Borrelia burgdorferi B31
KLIQAFTNTN

SEQ ID NO: 36540 - protein, 10 aa, Borrelia burgdorferi B31
LIQAFTNTNK

SEQ ID NO: 36541 - protein, 10 aa, Borrelia burgdorferi B31
IQAFTNTNKF

SEQ ID NO: 36542 - protein, 10 aa, Borrelia burgdorferi B31
QAFTNTNKFC

SEQ ID NO: 36543 - protein, 10 aa, Borrelia burgdorferi B31
AFTNTNKFCI

SEQ ID NO: 36544 - protein, 10 aa, Borrelia burgdorferi B31
FTNTNKFCIP

SEQ ID NO: 36545 - protein, 10 aa, Borrelia burgdorferi B31
TNTNKFCIPD

SEQ ID NO: 36546 - protein, 10 aa, Borrelia burgdorferi B31
NTNKFCIPDG

SEQ ID NO: 36547 - protein, 10 aa, Borrelia burgdorferi B31
TNKFCIPDGR

SEQ ID NO: 36548 - protein, 10 aa, Borrelia burgdorferi B31
NKFCIPDGRS

SEQ ID NO: 36549 - protein, 10 aa, Borrelia burgdorferi B31
KFCIPDGRSL

SEQ ID NO: 36550 - protein, 10 aa, Borrelia burgdorferi B31
FCIPDGRSLP

SEQ ID NO: 36551 - protein, 10 aa, Borrelia burgdorferi B31
CIPDGRSLPS

SEQ ID NO: 36552 - protein, 10 aa, Borrelia burgdorferi B31
IPDGRSLPSN

SEQ ID NO: 36553 - protein, 10 aa, Borrelia burgdorferi B31
PDGRSLPSNC

SEQ ID NO: 36554 - protein, 10 aa, Borrelia burgdorferi B31
DGRSLPSNCY

SEQ ID NO: 36555 - protein, 10 aa, Borrelia burgdorferi B31
GRSLPSNCYA

SEQ ID NO: 36556 - protein, 10 aa, Borrelia burgdorferi B31
RSLPSNCYAY

SEQ ID NO: 36557 - protein, 10 aa, Borrelia burgdorferi B31
SLPSNCYAYK

SEQ ID NO: 36558 - protein, 10 aa, Borrelia burgdorferi B31
LPSNCYAYKV

SEQ ID NO: 36559 - protein, 10 aa, Borrelia burgdorferi B31
PSNCYAYKVL

SEQ ID NO: 36560 - protein, 10 aa, Borrelia burgdorferi B31
SNCYAYKVLG

SEQ ID NO: 36561 - protein, 10 aa, Borrelia burgdorferi B31
NCYAYKVLGI

SEQ ID NO: 36562 - protein, 10 aa, Borrelia burgdorferi B31
CYAYKVLGIS

SEQ ID NO: 36563 - protein, 10 aa, Borrelia burgdorferi B31
YAYKVLGISS

SEQ ID NO: 36564 - protein, 10 aa, Borrelia burgdorferi B31
AYKVLGISSA

SEQ ID NO: 36565 - protein, 10 aa, Borrelia burgdorferi B31
YKVLGISSAP

SEQ ID NO: 36566 - protein, 10 aa, Borrelia burgdorferi B31
KVLGISSAPK

SEQ ID NO: 36567 - protein, 10 aa, Borrelia burgdorferi B31
VLGISSAPKL

SEQ ID NO: 36568 - protein, 10 aa, Borrelia burgdorferi B31
LGISSAPKLS

SEQ ID NO: 36569 - protein, 10 aa, Borrelia burgdorferi B31
GISSAPKLSG

SEQ ID NO: 36570 - protein, 10 aa, Borrelia burgdorferi B31
ISSAPKLSGR

SEQ ID NO: 36571 - protein, 10 aa, Borrelia burgdorferi B31
SSAPKLSGRF

SEQ ID NO: 36572 - protein, 10 aa, Borrelia burgdorferi B31
SAPKLSGRFL

SEQ ID NO: 36573 - protein, 10 aa, Borrelia burgdorferi B31
APKLSGRFLR

SEQ ID NO: 36574 - protein, 10 aa, Borrelia burgdorferi B31
PKLSGRFLRH

SEQ ID NO: 36575 - protein, 10 aa, Borrelia burgdorferi B31
KLSGRFLRHY

SEQ ID NO: 36576 - protein, 10 aa, Borrelia burgdorferi B31
LSGRFLRHYD

SEQ ID NO: 36577 - protein, 10 aa, Borrelia burgdorferi B31
SGRFLRHYDS

SEQ ID NO: 36578 - protein, 10 aa, Borrelia burgdorferi B31
GRFLRHYDSG

SEQ ID NO: 36579 - protein, 10 aa, Borrelia burgdorferi B31
RFLRHYDSGG

SEQ ID NO: 36580 - protein, 10 aa, Borrelia burgdorferi B31
FLRHYDSGGS

SEQ ID NO: 36581 - protein, 10 aa, Borrelia burgdorferi B31
LRHYDSGGST

SEQ ID NO: 36582 - protein, 10 aa, Borrelia burgdorferi B31
RHYDSGGSTD

SEQ ID NO: 36583 - protein, 10 aa, Borrelia burgdorferi B31
HYDSGGSTDS

SEQ ID NO: 36584 - protein, 10 aa, Borrelia burgdorferi B31
YDSGGSTDSD

SEQ ID NO: 36585 - protein, 10 aa, Borrelia burgdorferi B31
DSGGSTDSDG

SEQ ID NO: 36586 - protein, 10 aa, Borrelia burgdorferi B31
SGGSTDSDGT

SEQ ID NO: 36587 - protein, 10 aa, Borrelia burgdorferi B31
GGSTDSDGTR

SEQ ID NO: 36588 - protein, 10 aa, Borrelia burgdorferi B31
GSTDSDGTRS

SEQ ID NO: 36589 - protein, 10 aa, Borrelia burgdorferi B31
STDSDGTRSL

SEQ ID NO: 36590 - protein, 10 aa, Borrelia burgdorferi B31
TDSDGTRSLG

SEQ ID NO: 36591 - protein, 10 aa, Borrelia burgdorferi B31
DSDGTRSLGH

SEQ ID NO: 36592 - protein, 10 aa, Borrelia burgdorferi B31
SDGTRSLGHT

SEQ ID NO: 36593 - protein, 10 aa, Borrelia burgdorferi B31
DGTRSLGHTQ

SEQ ID NO: 36594 - protein, 10 aa, Borrelia burgdorferi B31
GTRSLGHTQE

SEQ ID NO: 36595 - protein, 10 aa, Borrelia burgdorferi B31
TRSLGHTQED

SEQ ID NO: 36596 - protein, 10 aa, Borrelia burgdorferi B31
RSLGHTQEDS

SEQ ID NO: 36597 - protein, 10 aa, Borrelia burgdorferi B31
SLGHTQEDSY

SEQ ID NO: 36598 - protein, 10 aa, Borrelia burgdorferi B31
LGHTQEDSYK

SEQ ID NO: 36599 - protein, 10 aa, Borrelia burgdorferi B31
GHTQEDSYKN

SEQ ID NO: 36600 - protein, 10 aa, Borrelia burgdorferi B31
HTQEDSYKNH

SEQ ID NO: 36601 - protein, 10 aa, Borrelia burgdorferi B31
TQEDSYKNHD

SEQ ID NO: 36602 - protein, 10 aa, Borrelia burgdorferi B31
QEDSYKNHDH

SEQ ID NO: 36603 - protein, 10 aa, Borrelia burgdorferi B31
EDSYKNHDHD

SEQ ID NO: 36604 - protein, 10 aa, Borrelia burgdorferi B31
DSYKNHDHDL

SEQ ID NO: 36605 - protein, 10 aa, Borrelia burgdorferi B31
SYKNHDHDLD

SEQ ID NO: 36606 - protein, 10 aa, Borrelia burgdorferi B31
YKNHDHDLDF

SEQ ID NO: 36607 - protein, 10 aa, Borrelia burgdorferi B31
KNHDHDLDFS

SEQ ID NO: 36608 - protein, 10 aa, Borrelia burgdorferi B31
NHDHDLDFSR

SEQ ID NO: 36609 - protein, 10 aa, Borrelia burgdorferi B31
HDHDLDFSRI

SEQ ID NO: 36610 - protein, 10 aa, Borrelia burgdorferi B31
DHDLDFSRIN

SEQ ID NO: 36611 - protein, 10 aa, Borrelia burgdorferi B31
HDLDFSRINF

SEQ ID NO: 36612 - protein, 10 aa, Borrelia burgdorferi B31
DLDFSRINFK

SEQ ID NO: 36613 - protein, 10 aa, Borrelia burgdorferi B31
LDFSRINFKG

SEQ ID NO: 36614 - protein, 10 aa, Borrelia burgdorferi B31
DFSRINFKGK

SEQ ID NO: 36615 - protein, 10 aa, Borrelia burgdorferi B31
FSRINFKGKL

SEQ ID NO: 36616 - protein, 10 aa, Borrelia burgdorferi B31
SRINFKGKLV

SEQ ID NO: 36617 - protein, 10 aa, Borrelia burgdorferi B31
RINFKGKLVK

SEQ ID NO: 36618 - protein, 10 aa, Borrelia burgdorferi B31
INFKGKLVKR

SEQ ID NO: 36619 - protein, 10 aa, Borrelia burgdorferi B31
NFKGKLVKRM

SEQ ID NO: 36620 - protein, 10 aa, Borrelia burgdorferi B31
FKGKLVKRMT

SEQ ID NO: 36621 - protein, 10 aa, Borrelia burgdorferi B31
KGKLVKRMTM

SEQ ID NO: 36622 - protein, 10 aa, Borrelia burgdorferi B31
GKLVKRMTMI

SEQ ID NO: 36623 - protein, 10 aa, Borrelia burgdorferi B31
KLVKRMTMIY

SEQ ID NO: 36624 - protein, 10 aa, Borrelia burgdorferi B31
LVKRMTMIYR

SEQ ID NO: 36625 - protein, 10 aa, Borrelia burgdorferi B31
VKRMTMIYRS

SEQ ID NO: 36626 - protein, 10 aa, Borrelia burgdorferi B31
KRMTMIYRSA

SEQ ID NO: 36627 - protein, 10 aa, Borrelia burgdorferi B31
RMTMIYRSAD

SEQ ID NO: 36628 - protein, 10 aa, Borrelia burgdorferi B31
MTMIYRSADT

SEQ ID NO: 36629 - protein, 10 aa, Borrelia burgdorferi B31
TMIYRSADTW

SEQ ID NO: 36630 - protein, 10 aa, Borrelia burgdorferi B31
MIYRSADTWY

SEQ ID NO: 36631 - protein, 10 aa, Borrelia burgdorferi B31
IYRSADTWYT

SEQ ID NO: 36632 - protein, 10 aa, Borrelia burgdorferi B31
YRSADTWYTW

SEQ ID NO: 36633 - protein, 10 aa, Borrelia burgdorferi B31
RSADTWYTWY

SEQ ID NO: 36634 - protein, 10 aa, Borrelia burgdorferi B31
SADTWYTWYW

SEQ ID NO: 36635 - protein, 10 aa, Borrelia burgdorferi B31
ADTWYTWYWA

SEQ ID NO: 36636 - protein, 10 aa, Borrelia burgdorferi B31
DTWYTWYWAE

SEQ ID NO: 36637 - protein, 10 aa, Borrelia burgdorferi B31
TWYTWYWAEE

SEQ ID NO: 36638 - protein, 10 aa, Borrelia burgdorferi B31
WYTWYWAEEI

SEQ ID NO: 36639 - protein, 10 aa, Borrelia burgdorferi B31
YTWYWAEEIM

SEQ ID NO: 36640 - protein, 10 aa, Borrelia burgdorferi B31
TWYWAEEIMS

SEQ ID NO: 36641 - protein, 10 aa, Borrelia burgdorferi B31
WYWAEEIMSP

SEQ ID NO: 36642 - protein, 10 aa, Borrelia burgdorferi B31
YWAEEIMSPF

SEQ ID NO: 36643 - protein, 10 aa, Borrelia burgdorferi B31
WAEEIMSPFI

SEQ ID NO: 36644 - protein, 10 aa, Borrelia burgdorferi B31
AEEIMSPFIT

SEQ ID NO: 36645 - protein, 10 aa, Borrelia burgdorferi B31
EEIMSPFITG

SEQ ID NO: 36646 - protein, 10 aa, Borrelia burgdorferi B31
EIMSPFITGY

SEQ ID NO: 36647 - protein, 10 aa, Borrelia burgdorferi B31
IMSPFITGYS

SEQ ID NO: 36648 - protein, 10 aa, Borrelia burgdorferi B31
MSPFITGYSY

SEQ ID NO: 36649 - protein, 10 aa, Borrelia burgdorferi B31
SPFITGYSYE

SEQ ID NO: 36650 - protein, 10 aa, Borrelia burgdorferi B31
PFITGYSYEE

SEQ ID NO: 36651 - protein, 10 aa, Borrelia burgdorferi B31
FITGYSYEEI

SEQ ID NO: 36652 - protein, 10 aa, Borrelia burgdorferi B31
ITGYSYEEID

SEQ ID NO: 36653 - protein, 10 aa, Borrelia burgdorferi B31
TGYSYEEIDP

SEQ ID NO: 36654 - protein, 10 aa, Borrelia burgdorferi B31
GYSYEEIDPE

SEQ ID NO: 36655 - protein, 10 aa, Borrelia burgdorferi B31
YSYEEIDPEY

SEQ ID NO: 36656 - protein, 10 aa, Borrelia burgdorferi B31
SYEEIDPEYL

SEQ ID NO: 36657 - protein, 10 aa, Borrelia burgdorferi B31
YEEIDPEYLL

SEQ ID NO: 36658 - protein, 10 aa, Borrelia burgdorferi B31
EEIDPEYLLP

SEQ ID NO: 36659 - protein, 10 aa, Borrelia burgdorferi B31
EIDPEYLLPP

SEQ ID NO: 36660 - protein, 10 aa, Borrelia burgdorferi B31
IDPEYLLPPF

SEQ ID NO: 36661 - protein, 10 aa, Borrelia burgdorferi B31
DPEYLLPPFT

SEQ ID NO: 36662 - protein, 10 aa, Borrelia burgdorferi B31
PEYLLPPFTS

SEQ ID NO: 36663 - protein, 10 aa, Borrelia burgdorferi B31
EYLLPPFTSQ

SEQ ID NO: 36664 - protein, 10 aa, Borrelia burgdorferi B31
YLLPPFTSQS

SEQ ID NO: 36665 - protein, 10 aa, Borrelia burgdorferi B31
LLPPFTSQSG

SEQ ID NO: 36666 - protein, 10 aa, Borrelia burgdorferi B31
LPPFTSQSGS

SEQ ID NO: 36667 - protein, 10 aa, Borrelia burgdorferi B31
PPFTSQSGSK

SEQ ID NO: 36668 - protein, 10 aa, Borrelia burgdorferi B31
PFTSQSGSKE

SEQ ID NO: 36669 - protein, 10 aa, Borrelia burgdorferi B31
FTSQSGSKET

SEQ ID NO: 36670 - protein, 10 aa, Borrelia burgdorferi B31
TSQSGSKETK

SEQ ID NO: 36671 - protein, 10 aa, Borrelia burgdorferi B31
SQSGSKETKP

SEQ ID NO: 36672 - protein, 10 aa, Borrelia burgdorferi B31
QSGSKETKPK

SEQ ID NO: 36673 - protein, 10 aa, Borrelia burgdorferi B31
SGSKETKPKN

SEQ ID NO: 36674 - protein, 10 aa, Borrelia burgdorferi B31
GSKETKPKNT

SEQ ID NO: 36675 - protein, 10 aa, Borrelia burgdorferi B31
SKETKPKNTC

SEQ ID NO: 36676 - protein, 10 aa, Borrelia burgdorferi B31
KETKPKNTCY

SEQ ID NO: 36677 - protein, 10 aa, Borrelia burgdorferi B31
ETKPKNTCYI

SEQ ID NO: 36678 - protein, 10 aa, Borrelia burgdorferi B31
TKPKNTCYIS

SEQ ID NO: 36679 - protein, 10 aa, Borrelia burgdorferi B31
KPKNTCYISF

SEQ ID NO: 36680 - protein, 10 aa, Borrelia burgdorferi B31
PKNTCYISFY

SEQ ID NO: 36681 - protein, 10 aa, Borrelia burgdorferi B31
KNTCYISFYR

SEQ ID NO: 36682 - protein, 10 aa, Borrelia burgdorferi B31
NTCYISFYRY

SEQ ID NO: 36683 - protein, 10 aa, Borrelia burgdorferi B31
TCYISFYRYD

SEQ ID NO: 36684 - protein, 10 aa, Borrelia burgdorferi B31
CYISFYRYDL

SEQ ID NO: 36685 - protein, 11 aa, Borrelia burgdorferi B31
MITQQDYTEIK

SEQ ID NO: 36686 - protein, 11 aa, Borrelia burgdorferi B31
ITQQDYTEIKK

SEQ ID NO: 36687 - protein, 11 aa, Borrelia burgdorferi B31
TQQDYTEIKKK

SEQ ID NO: 36688 - protein, 11 aa, Borrelia burgdorferi B31
QQDYTEIKKKL

SEQ ID NO: 36689 - protein, 11 aa, Borrelia burgdorferi B31
QDYTEIKKKLE

SEQ ID NO: 36690 - protein, 11 aa, Borrelia burgdorferi B31
DYTEIKKKLEN

SEQ ID NO: 36691 - protein, 11 aa, Borrelia burgdorferi B31
YTEIKKKLENT

SEQ ID NO: 36692 - protein, 11 aa, Borrelia burgdorferi B31
TEIKKKLENTK

SEQ ID NO: 36693 - protein, 11 aa, Borrelia burgdorferi B31
EIKKKLENTKT

SEQ ID NO: 36694 - protein, 11 aa, Borrelia burgdorferi B31
IKKKLENTKTR

SEQ ID NO: 36695 - protein, 11 aa, Borrelia burgdorferi B31
KKKLENTKTRI

SEQ ID NO: 36696 - protein, 11 aa, Borrelia burgdorferi B31
KKLENTKTRIQ

SEQ ID NO: 36697 - protein, 11 aa, Borrelia burgdorferi B31
KLENTKTRIQF

SEQ ID NO: 36698 - protein, 11 aa, Borrelia burgdorferi B31
LENTKTRIQFR

SEQ ID NO: 36699 - protein, 11 aa, Borrelia burgdorferi B31
ENTKTRIQFRN

SEQ ID NO: 36700 - protein, 11 aa, Borrelia burgdorferi B31
NTKTRIQFRNG

SEQ ID NO: 36701 - protein, 11 aa, Borrelia burgdorferi B31
TKTRIQFRNGN

SEQ ID NO: 36702 - protein, 11 aa, Borrelia burgdorferi B31
KTRIQFRNGNK

SEQ ID NO: 36703 - protein, 11 aa, Borrelia burgdorferi B31
TRIQFRNGNKI

SEQ ID NO: 36704 - protein, 11 aa, Borrelia burgdorferi B31
RIQFRNGNKID

SEQ ID NO: 36705 - protein, 11 aa, Borrelia burgdorferi B31
IQFRNGNKIDS

SEQ ID NO: 36706 - protein, 11 aa, Borrelia burgdorferi B31
QFRNGNKIDSL

SEQ ID NO: 36707 - protein, 11 aa, Borrelia burgdorferi B31
FRNGNKIDSLG

SEQ ID NO: 36708 - protein, 11 aa, Borrelia burgdorferi B31
RNGNKIDSLGY

SEQ ID NO: 36709 - protein, 11 aa, Borrelia burgdorferi B31
NGNKIDSLGYQ

SEQ ID NO: 36710 - protein, 11 aa, Borrelia burgdorferi B31
GNKIDSLGYQG

SEQ ID NO: 36711 - protein, 11 aa, Borrelia burgdorferi B31
NKIDSLGYQGS

SEQ ID NO: 36712 - protein, 11 aa, Borrelia burgdorferi B31
KIDSLGYQGSL

SEQ ID NO: 36713 - protein, 11 aa, Borrelia burgdorferi B31
IDSLGYQGSLG

SEQ ID NO: 36714 - protein, 11 aa, Borrelia burgdorferi B31
DSLGYQGSLGE

SEQ ID NO: 36715 - protein, 11 aa, Borrelia burgdorferi B31
SLGYQGSLGEP

SEQ ID NO: 36716 - protein, 11 aa, Borrelia burgdorferi B31
LGYQGSLGEPI

SEQ ID NO: 36717 - protein, 11 aa, Borrelia burgdorferi B31
GYQGSLGEPIL

SEQ ID NO: 36718 - protein, 11 aa, Borrelia burgdorferi B31
YQGSLGEPILL

SEQ ID NO: 36719 - protein, 11 aa, Borrelia burgdorferi B31
QGSLGEPILLK

SEQ ID NO: 36720 - protein, 11 aa, Borrelia burgdorferi B31
GSLGEPILLKD

SEQ ID NO: 36721 - protein, 11 aa, Borrelia burgdorferi B31
SLGEPILLKDK

SEQ ID NO: 36722 - protein, 11 aa, Borrelia burgdorferi B31
LGEPILLKDKL

SEQ ID NO: 36723 - protein, 11 aa, Borrelia burgdorferi B31
GEPILLKDKLT

SEQ ID NO: 36724 - protein, 11 aa, Borrelia burgdorferi B31
EPILLKDKLTF

SEQ ID NO: 36725 - protein, 11 aa, Borrelia burgdorferi B31
PILLKDKLTFS

SEQ ID NO: 36726 - protein, 11 aa, Borrelia burgdorferi B31
ILLKDKLTFSI

SEQ ID NO: 36727 - protein, 11 aa, Borrelia burgdorferi B31
LLKDKLTFSIC

SEQ ID NO: 36728 - protein, 11 aa, Borrelia burgdorferi B31
LKDKLTFSICD

SEQ ID NO: 36729 - protein, 11 aa, Borrelia burgdorferi B31
KDKLTFSICDG

SEQ ID NO: 36730 - protein, 11 aa, Borrelia burgdorferi B31
DKLTFSICDGK

SEQ ID NO: 36731 - protein, 11 aa, Borrelia burgdorferi B31
KLTFSICDGKN

SEQ ID NO: 36732 - protein, 11 aa, Borrelia burgdorferi B31
LTFSICDGKNI

SEQ ID NO: 36733 - protein, 11 aa, Borrelia burgdorferi B31
TFSICDGKNID

SEQ ID NO: 36734 - protein, 11 aa, Borrelia burgdorferi B31
FSICDGKNIDN

SEQ ID NO: 36735 - protein, 11 aa, Borrelia burgdorferi B31
SICDGKNIDNR

SEQ ID NO: 36736 - protein, 11 aa, Borrelia burgdorferi B31
ICDGKNIDNRK

SEQ ID NO: 36737 - protein, 11 aa, Borrelia burgdorferi B31
CDGKNIDNRKE

SEQ ID NO: 36738 - protein, 11 aa, Borrelia burgdorferi B31
DGKNIDNRKEY

SEQ ID NO: 36739 - protein, 11 aa, Borrelia burgdorferi B31
GKNIDNRKEYE

SEQ ID NO: 36740 - protein, 11 aa, Borrelia burgdorferi B31
KNIDNRKEYEI

SEQ ID NO: 36741 - protein, 11 aa, Borrelia burgdorferi B31
NIDNRKEYEIT

SEQ ID NO: 36742 - protein, 11 aa, Borrelia burgdorferi B31
IDNRKEYEITK

SEQ ID NO: 36743 - protein, 11 aa, Borrelia burgdorferi B31
DNRKEYEITKN

SEQ ID NO: 36744 - protein, 11 aa, Borrelia burgdorferi B31
NRKEYEITKNA

SEQ ID NO: 36745 - protein, 11 aa, Borrelia burgdorferi B31
RKEYEITKNAP

SEQ ID NO: 36746 - protein, 11 aa, Borrelia burgdorferi B31
KEYEITKNAPS

SEQ ID NO: 36747 - protein, 11 aa, Borrelia burgdorferi B31
EYEITKNAPSL

SEQ ID NO: 36748 - protein, 11 aa, Borrelia burgdorferi B31
YEITKNAPSLD

SEQ ID NO: 36749 - protein, 11 aa, Borrelia burgdorferi B31
EITKNAPSLDS

SEQ ID NO: 36750 - protein, 11 aa, Borrelia burgdorferi B31
ITKNAPSLDSL

SEQ ID NO: 36751 - protein, 11 aa, Borrelia burgdorferi B31
TKNAPSLDSLI

SEQ ID NO: 36752 - protein, 11 aa, Borrelia burgdorferi B31
KNAPSLDSLIE

SEQ ID NO: 36753 - protein, 11 aa, Borrelia burgdorferi B31
NAPSLDSLIEY

SEQ ID NO: 36754 - protein, 11 aa, Borrelia burgdorferi B31
APSLDSLIEYL

SEQ ID NO: 36755 - protein, 11 aa, Borrelia burgdorferi B31
PSLDSLIEYLE

SEQ ID NO: 36756 - protein, 11 aa, Borrelia burgdorferi B31
SLDSLIEYLEH

SEQ ID NO: 36757 - protein, 11 aa, Borrelia burgdorferi B31
LDSLIEYLEHM

SEQ ID NO: 36758 - protein, 11 aa, Borrelia burgdorferi B31
DSLIEYLEHMI

SEQ ID NO: 36759 - protein, 11 aa, Borrelia burgdorferi B31
SLIEYLEHMIL

SEQ ID NO: 36760 - protein, 11 aa, Borrelia burgdorferi B31
LIEYLEHMILF

SEQ ID NO: 36761 - protein, 11 aa, Borrelia burgdorferi B31
IEYLEHMILFF

SEQ ID NO: 36762 - protein, 11 aa, Borrelia burgdorferi B31
EYLEHMILFFL

SEQ ID NO: 36763 - protein, 11 aa, Borrelia burgdorferi B31
YLEHMILFFLE

SEQ ID NO: 36764 - protein, 11 aa, Borrelia burgdorferi B31
LEHMILFFLEK

SEQ ID NO: 36765 - protein, 11 aa, Borrelia burgdorferi B31
EHMILFFLEKT

SEQ ID NO: 36766 - protein, 11 aa, Borrelia burgdorferi B31
HMILFFLEKTP

SEQ ID NO: 36767 - protein, 11 aa, Borrelia burgdorferi B31
MILFFLEKTPV

SEQ ID NO: 36768 - protein, 11 aa, Borrelia burgdorferi B31
ILFFLEKTPVG

SEQ ID NO: 36769 - protein, 11 aa, Borrelia burgdorferi B31
LFFLEKTPVGT

SEQ ID NO: 36770 - protein, 11 aa, Borrelia burgdorferi B31
FFLEKTPVGTL

SEQ ID NO: 36771 - protein, 11 aa, Borrelia burgdorferi B31
FLEKTPVGTLT

SEQ ID NO: 36772 - protein, 11 aa, Borrelia burgdorferi B31
LEKTPVGTLTA

SEQ ID NO: 36773 - protein, 11 aa, Borrelia burgdorferi B31
EKTPVGTLTAK

SEQ ID NO: 36774 - protein, 11 aa, Borrelia burgdorferi B31
KTPVGTLTAKF

SEQ ID NO: 36775 - protein, 11 aa, Borrelia burgdorferi B31
TPVGTLTAKFA

SEQ ID NO: 36776 - protein, 11 aa, Borrelia burgdorferi B31
PVGTLTAKFAM

SEQ ID NO: 36777 - protein, 11 aa, Borrelia burgdorferi B31
VGTLTAKFAME

SEQ ID NO: 36778 - protein, 11 aa, Borrelia burgdorferi B31
GTLTAKFAMEG

SEQ ID NO: 36779 - protein, 11 aa, Borrelia burgdorferi B31
TLTAKFAMEGS

SEQ ID NO: 36780 - protein, 11 aa, Borrelia burgdorferi B31
LTAKFAMEGSI

SEQ ID NO: 36781 - protein, 11 aa, Borrelia burgdorferi B31
TAKFAMEGSIL

SEQ ID NO: 36782 - protein, 11 aa, Borrelia burgdorferi B31
AKFAMEGSILT

SEQ ID NO: 36783 - protein, 11 aa, Borrelia burgdorferi B31
KFAMEGSILTR

SEQ ID NO: 36784 - protein, 11 aa, Borrelia burgdorferi B31
FAMEGSILTRS

SEQ ID NO: 36785 - protein, 11 aa, Borrelia burgdorferi B31
AMEGSILTRSK

SEQ ID NO: 36786 - protein, 11 aa, Borrelia burgdorferi B31
MEGSILTRSKL

SEQ ID NO: 36787 - protein, 11 aa, Borrelia burgdorferi B31
EGSILTRSKLI

SEQ ID NO: 36788 - protein, 11 aa, Borrelia burgdorferi B31
GSILTRSKLIQ

SEQ ID NO: 36789 - protein, 11 aa, Borrelia burgdorferi B31
SILTRSKLIQA

SEQ ID NO: 36790 - protein, 11 aa, Borrelia burgdorferi B31
ILTRSKLIQAF

SEQ ID NO: 36791 - protein, 11 aa, Borrelia burgdorferi B31
LTRSKLIQAFT

SEQ ID NO: 36792 - protein, 11 aa, Borrelia burgdorferi B31
TRSKLIQAFTN

SEQ ID NO: 36793 - protein, 11 aa, Borrelia burgdorferi B31
RSKLIQAFTNT

SEQ ID NO: 36794 - protein, 11 aa, Borrelia burgdorferi B31
SKLIQAFTNTN

SEQ ID NO: 36795 - protein, 11 aa, Borrelia burgdorferi B31
KLIQAFTNTNK

SEQ ID NO: 36796 - protein, 11 aa, Borrelia burgdorferi B31
LIQAFTNTNKF

SEQ ID NO: 36797 - protein, 11 aa, Borrelia burgdorferi B31
IQAFTNTNKFC

SEQ ID NO: 36798 - protein, 11 aa, Borrelia burgdorferi B31
QAFTNTNKFCI

SEQ ID NO: 36799 - protein, 11 aa, Borrelia burgdorferi B31
AFTNTNKFCIP

SEQ ID NO: 36800 - protein, 11 aa, Borrelia burgdorferi B31
FTNTNKFCIPD

SEQ ID NO: 36801 - protein, 11 aa, Borrelia burgdorferi B31
TNTNKFCIPDG

SEQ ID NO: 36802 - protein, 11 aa, Borrelia burgdorferi B31
NTNKFCIPDGR

SEQ ID NO: 36803 - protein, 11 aa, Borrelia burgdorferi B31
TNKFCIPDGRS

SEQ ID NO: 36804 - protein, 11 aa, Borrelia burgdorferi B31
NKFCIPDGRSL

SEQ ID NO: 36805 - protein, 11 aa, Borrelia burgdorferi B31
KFCIPDGRSLP

SEQ ID NO: 36806 - protein, 11 aa, Borrelia burgdorferi B31
FCIPDGRSLPS

SEQ ID NO: 36807 - protein, 11 aa, Borrelia burgdorferi B31
CIPDGRSLPSN

SEQ ID NO: 36808 - protein, 11 aa, Borrelia burgdorferi B31
IPDGRSLPSNC

SEQ ID NO: 36809 - protein, 11 aa, Borrelia burgdorferi B31
PDGRSLPSNCY

SEQ ID NO: 36810 - protein, 11 aa, Borrelia burgdorferi B31
DGRSLPSNCYA

SEQ ID NO: 36811 - protein, 11 aa, Borrelia burgdorferi B31
GRSLPSNCYAY

SEQ ID NO: 36812 - protein, 11 aa, Borrelia burgdorferi B31
RSLPSNCYAYK

SEQ ID NO: 36813 - protein, 11 aa, Borrelia burgdorferi B31
SLPSNCYAYKV

SEQ ID NO: 36814 - protein, 11 aa, Borrelia burgdorferi B31
LPSNCYAYKVL

SEQ ID NO: 36815 - protein, 11 aa, Borrelia burgdorferi B31
PSNCYAYKVLG

SEQ ID NO: 36816 - protein, 11 aa, Borrelia burgdorferi B31
SNCYAYKVLGI

SEQ ID NO: 36817 - protein, 11 aa, Borrelia burgdorferi B31
NCYAYKVLGIS

SEQ ID NO: 36818 - protein, 11 aa, Borrelia burgdorferi B31
CYAYKVLGISS

SEQ ID NO: 36819 - protein, 11 aa, Borrelia burgdorferi B31
YAYKVLGISSA

SEQ ID NO: 36820 - protein, 11 aa, Borrelia burgdorferi B31
AYKVLGISSAP

SEQ ID NO: 36821 - protein, 11 aa, Borrelia burgdorferi B31
YKVLGISSAPK

SEQ ID NO: 36822 - protein, 11 aa, Borrelia burgdorferi B31
KVLGISSAPKL

SEQ ID NO: 36823 - protein, 11 aa, Borrelia burgdorferi B31
VLGISSAPKLS

SEQ ID NO: 36824 - protein, 11 aa, Borrelia burgdorferi B31
LGISSAPKLSG

SEQ ID NO: 36825 - protein, 11 aa, Borrelia burgdorferi B31
GISSAPKLSGR

SEQ ID NO: 36826 - protein, 11 aa, Borrelia burgdorferi B31
ISSAPKLSGRF

SEQ ID NO: 36827 - protein, 11 aa, Borrelia burgdorferi B31
SSAPKLSGRFL

SEQ ID NO: 36828 - protein, 11 aa, Borrelia burgdorferi B31
SAPKLSGRFLR

SEQ ID NO: 36829 - protein, 11 aa, Borrelia burgdorferi B31
APKLSGRFLRH

SEQ ID NO: 36830 - protein, 11 aa, Borrelia burgdorferi B31
PKLSGRFLRHY

SEQ ID NO: 36831 - protein, 11 aa, Borrelia burgdorferi B31
KLSGRFLRHYD

SEQ ID NO: 36832 - protein, 11 aa, Borrelia burgdorferi B31
LSGRFLRHYDS

SEQ ID NO: 36833 - protein, 11 aa, Borrelia burgdorferi B31
SGRFLRHYDSG

SEQ ID NO: 36834 - protein, 11 aa, Borrelia burgdorferi B31
GRFLRHYDSGG

SEQ ID NO: 36835 - protein, 11 aa, Borrelia burgdorferi B31
RFLRHYDSGGS

SEQ ID NO: 36836 - protein, 11 aa, Borrelia burgdorferi B31
FLRHYDSGGST

SEQ ID NO: 36837 - protein, 11 aa, Borrelia burgdorferi B31
LRHYDSGGSTD

SEQ ID NO: 36838 - protein, 11 aa, Borrelia burgdorferi B31
RHYDSGGSTDS

SEQ ID NO: 36839 - protein, 11 aa, Borrelia burgdorferi B31
HYDSGGSTDSD

SEQ ID NO: 36840 - protein, 11 aa, Borrelia burgdorferi B31
YDSGGSTDSDG

SEQ ID NO: 36841 - protein, 11 aa, Borrelia burgdorferi B31
DSGGSTDSDGT

SEQ ID NO: 36842 - protein, 11 aa, Borrelia burgdorferi B31
SGGSTDSDGTR

SEQ ID NO: 36843 - protein, 11 aa, Borrelia burgdorferi B31
GGSTDSDGTRS

SEQ ID NO: 36844 - protein, 11 aa, Borrelia burgdorferi B31
GSTDSDGTRSL

SEQ ID NO: 36845 - protein, 11 aa, Borrelia burgdorferi B31
STDSDGTRSLG

SEQ ID NO: 36846 - protein, 11 aa, Borrelia burgdorferi B31
TDSDGTRSLGH

SEQ ID NO: 36847 - protein, 11 aa, Borrelia burgdorferi B31
DSDGTRSLGHT

SEQ ID NO: 36848 - protein, 11 aa, Borrelia burgdorferi B31
SDGTRSLGHTQ

SEQ ID NO: 36849 - protein, 11 aa, Borrelia burgdorferi B31
DGTRSLGHTQE

SEQ ID NO: 36850 - protein, 11 aa, Borrelia burgdorferi B31
GTRSLGHTQED

SEQ ID NO: 36851 - protein, 11 aa, Borrelia burgdorferi B31
TRSLGHTQEDS

SEQ ID NO: 36852 - protein, 11 aa, Borrelia burgdorferi B31
RSLGHTQEDSY

SEQ ID NO: 36853 - protein, 11 aa, Borrelia burgdorferi B31
SLGHTQEDSYK

SEQ ID NO: 36854 - protein, 11 aa, Borrelia burgdorferi B31
LGHTQEDSYKN

SEQ ID NO: 36855 - protein, 11 aa, Borrelia burgdorferi B31
GHTQEDSYKNH

SEQ ID NO: 36856 - protein, 11 aa, Borrelia burgdorferi B31
HTQEDSYKNHD

SEQ ID NO: 36857 - protein, 11 aa, Borrelia burgdorferi B31
TQEDSYKNHDH

SEQ ID NO: 36858 - protein, 11 aa, Borrelia burgdorferi B31
QEDSYKNHDHD

SEQ ID NO: 36859 - protein, 11 aa, Borrelia burgdorferi B31
EDSYKNHDHDL

SEQ ID NO: 36860 - protein, 11 aa, Borrelia burgdorferi B31
DSYKNHDHDLD

SEQ ID NO: 36861 - protein, 11 aa, Borrelia burgdorferi B31
SYKNHDHDLDF

SEQ ID NO: 36862 - protein, 11 aa, Borrelia burgdorferi B31
YKNHDHDLDFS

SEQ ID NO: 36863 - protein, 11 aa, Borrelia burgdorferi B31
KNHDHDLDFSR

SEQ ID NO: 36864 - protein, 11 aa, Borrelia burgdorferi B31
NHDHDLDFSRI

SEQ ID NO: 36865 - protein, 11 aa, Borrelia burgdorferi B31
HDHDLDFSRIN

SEQ ID NO: 36866 - protein, 11 aa, Borrelia burgdorferi B31
DHDLDFSRINF

SEQ ID NO: 36867 - protein, 11 aa, Borrelia burgdorferi B31
HDLDFSRINFK

SEQ ID NO: 36868 - protein, 11 aa, Borrelia burgdorferi B31
DLDFSRINFKG

SEQ ID NO: 36869 - protein, 11 aa, Borrelia burgdorferi B31
LDFSRINFKGK

SEQ ID NO: 36870 - protein, 11 aa, Borrelia burgdorferi B31
DFSRINFKGKL

SEQ ID NO: 36871 - protein, 11 aa, Borrelia burgdorferi B31
FSRINFKGKLV

SEQ ID NO: 36872 - protein, 11 aa, Borrelia burgdorferi B31
SRINFKGKLVK

SEQ ID NO: 36873 - protein, 11 aa, Borrelia burgdorferi B31
RINFKGKLVKR

SEQ ID NO: 36874 - protein, 11 aa, Borrelia burgdorferi B31
INFKGKLVKRM

SEQ ID NO: 36875 - protein, 11 aa, Borrelia burgdorferi B31
NFKGKLVKRMT

SEQ ID NO: 36876 - protein, 11 aa, Borrelia burgdorferi B31
FKGKLVKRMTM

SEQ ID NO: 36877 - protein, 11 aa, Borrelia burgdorferi B31
KGKLVKRMTMI

SEQ ID NO: 36878 - protein, 11 aa, Borrelia burgdorferi B31
GKLVKRMTMIY

SEQ ID NO: 36879 - protein, 11 aa, Borrelia burgdorferi B31
KLVKRMTMIYR

SEQ ID NO: 36880 - protein, 11 aa, Borrelia burgdorferi B31
LVKRMTMIYRS

SEQ ID NO: 36881 - protein, 11 aa, Borrelia burgdorferi B31
VKRMTMIYRSA

SEQ ID NO: 36882 - protein, 11 aa, Borrelia burgdorferi B31
KRMTMIYRSAD

SEQ ID NO: 36883 - protein, 11 aa, Borrelia burgdorferi B31
RMTMIYRSADT

SEQ ID NO: 36884 - protein, 11 aa, Borrelia burgdorferi B31
MTMIYRSADTW

SEQ ID NO: 36885 - protein, 11 aa, Borrelia burgdorferi B31
TMIYRSADTWY

SEQ ID NO: 36886 - protein, 11 aa, Borrelia burgdorferi B31
MIYRSADTWYT

SEQ ID NO: 36887 - protein, 11 aa, Borrelia burgdorferi B31
IYRSADTWYTW

SEQ ID NO: 36888 - protein, 11 aa, Borrelia burgdorferi B31
YRSADTWYTWY

SEQ ID NO: 36889 - protein, 11 aa, Borrelia burgdorferi B31
RSADTWYTWYW

SEQ ID NO: 36890 - protein, 11 aa, Borrelia burgdorferi B31
SADTWYTWYWA

SEQ ID NO: 36891 - protein, 11 aa, Borrelia burgdorferi B31
ADTWYTWYWAE

SEQ ID NO: 36892 - protein, 11 aa, Borrelia burgdorferi B31
DTWYTWYWAEE

SEQ ID NO: 36893 - protein, 11 aa, Borrelia burgdorferi B31
TWYTWYWAEEI

SEQ ID NO: 36894 - protein, 11 aa, Borrelia burgdorferi B31
WYTWYWAEEIM

SEQ ID NO: 36895 - protein, 11 aa, Borrelia burgdorferi B31
YTWYWAEEIMS

SEQ ID NO: 36896 - protein, 11 aa, Borrelia burgdorferi B31
TWYWAEEIMSP

SEQ ID NO: 36897 - protein, 11 aa, Borrelia burgdorferi B31
WYWAEEIMSPF

SEQ ID NO: 36898 - protein, 11 aa, Borrelia burgdorferi B31
YWAEEIMSPFI

SEQ ID NO: 36899 - protein, 11 aa, Borrelia burgdorferi B31
WAEEIMSPFIT

SEQ ID NO: 36900 - protein, 11 aa, Borrelia burgdorferi B31
AEEIMSPFITG

SEQ ID NO: 36901 - protein, 11 aa, Borrelia burgdorferi B31
EEIMSPFITGY

SEQ ID NO: 36902 - protein, 11 aa, Borrelia burgdorferi B31
EIMSPFITGYS

SEQ ID NO: 36903 - protein, 11 aa, Borrelia burgdorferi B31
IMSPFITGYSY

SEQ ID NO: 36904 - protein, 11 aa, Borrelia burgdorferi B31
MSPFITGYSYE

SEQ ID NO: 36905 - protein, 11 aa, Borrelia burgdorferi B31
SPFITGYSYEE

SEQ ID NO: 36906 - protein, 11 aa, Borrelia burgdorferi B31
PFITGYSYEEI

SEQ ID NO: 36907 - protein, 11 aa, Borrelia burgdorferi B31
FITGYSYEEID

SEQ ID NO: 36908 - protein, 11 aa, Borrelia burgdorferi B31
ITGYSYEEIDP

SEQ ID NO: 36909 - protein, 11 aa, Borrelia burgdorferi B31
TGYSYEEIDPE

SEQ ID NO: 36910 - protein, 11 aa, Borrelia burgdorferi B31
GYSYEEIDPEY

SEQ ID NO: 36911 - protein, 11 aa, Borrelia burgdorferi B31
YSYEEIDPEYL

SEQ ID NO: 36912 - protein, 11 aa, Borrelia burgdorferi B31
SYEEIDPEYLL

SEQ ID NO: 36913 - protein, 11 aa, Borrelia burgdorferi B31
YEEIDPEYLLP

SEQ ID NO: 36914 - protein, 11 aa, Borrelia burgdorferi B31
EEIDPEYLLPP

SEQ ID NO: 36915 - protein, 11 aa, Borrelia burgdorferi B31
EIDPEYLLPPF

SEQ ID NO: 36916 - protein, 11 aa, Borrelia burgdorferi B31
IDPEYLLPPFT

SEQ ID NO: 36917 - protein, 11 aa, Borrelia burgdorferi B31
DPEYLLPPFTS

SEQ ID NO: 36918 - protein, 11 aa, Borrelia burgdorferi B31
PEYLLPPFTSQ

SEQ ID NO: 36919 - protein, 11 aa, Borrelia burgdorferi B31
EYLLPPFTSQS

SEQ ID NO: 36920 - protein, 11 aa, Borrelia burgdorferi B31
YLLPPFTSQSG

SEQ ID NO: 36921 - protein, 11 aa, Borrelia burgdorferi B31
LLPPFTSQSGS

SEQ ID NO: 36922 - protein, 11 aa, Borrelia burgdorferi B31
LPPFTSQSGSK

SEQ ID NO: 36923 - protein, 11 aa, Borrelia burgdorferi B31
PPFTSQSGSKE

SEQ ID NO: 36924 - protein, 11 aa, Borrelia burgdorferi B31
PFTSQSGSKET

SEQ ID NO: 36925 - protein, 11 aa, Borrelia burgdorferi B31
FTSQSGSKETK

SEQ ID NO: 36926 - protein, 11 aa, Borrelia burgdorferi B31
TSQSGSKETKP

SEQ ID NO: 36927 - protein, 11 aa, Borrelia burgdorferi B31
SQSGSKETKPK

SEQ ID NO: 36928 - protein, 11 aa, Borrelia burgdorferi B31
QSGSKETKPKN

SEQ ID NO: 36929 - protein, 11 aa, Borrelia burgdorferi B31
SGSKETKPKNT

SEQ ID NO: 36930 - protein, 11 aa, Borrelia burgdorferi B31
GSKETKPKNTC

SEQ ID NO: 36931 - protein, 11 aa, Borrelia burgdorferi B31
SKETKPKNTCY

SEQ ID NO: 36932 - protein, 11 aa, Borrelia burgdorferi B31
KETKPKNTCYI

SEQ ID NO: 36933 - protein, 11 aa, Borrelia burgdorferi B31
ETKPKNTCYIS

SEQ ID NO: 36934 - protein, 11 aa, Borrelia burgdorferi B31
TKPKNTCYISF

SEQ ID NO: 36935 - protein, 11 aa, Borrelia burgdorferi B31
KPKNTCYISFY

SEQ ID NO: 36936 - protein, 11 aa, Borrelia burgdorferi B31
PKNTCYISFYR

SEQ ID NO: 36937 - protein, 11 aa, Borrelia burgdorferi B31
KNTCYISFYRY

SEQ ID NO: 36938 - protein, 11 aa, Borrelia burgdorferi B31
NTCYISFYRYD

SEQ ID NO: 36939 - protein, 11 aa, Borrelia burgdorferi B31
TCYISFYRYDL

SEQ ID NO: 36940 - protein, 8 aa, Borrelia burgdorferi B31
MDLLDLLE

SEQ ID NO: 36941 - protein, 8 aa, Borrelia burgdorferi B31
DLLDLLEK

SEQ ID NO: 36942 - protein, 8 aa, Borrelia burgdorferi B31
LLDLLEKE

SEQ ID NO: 36943 - protein, 8 aa, Borrelia burgdorferi B31
LDLLEKEK

SEQ ID NO: 36944 - protein, 8 aa, Borrelia burgdorferi B31
DLLEKEKQ

SEQ ID NO: 36945 - protein, 8 aa, Borrelia burgdorferi B31
LLEKEKQI

SEQ ID NO: 36946 - protein, 8 aa, Borrelia burgdorferi B31
LEKEKQIN

SEQ ID NO: 36947 - protein, 8 aa, Borrelia burgdorferi B31
EKEKQINK

SEQ ID NO: 36948 - protein, 8 aa, Borrelia burgdorferi B31
KEKQINKN

SEQ ID NO: 36949 - protein, 8 aa, Borrelia burgdorferi B31
EKQINKNK

SEQ ID NO: 36950 - protein, 8 aa, Borrelia burgdorferi B31
KQINKNKG

SEQ ID NO: 36951 - protein, 8 aa, Borrelia burgdorferi B31
QINKNKGV

SEQ ID NO: 36952 - protein, 8 aa, Borrelia burgdorferi B31
INKNKGVF

SEQ ID NO: 36953 - protein, 8 aa, Borrelia burgdorferi B31
NKNKGVFM

SEQ ID NO: 36954 - protein, 8 aa, Borrelia burgdorferi B31
KNKGVFMT

SEQ ID NO: 36955 - protein, 8 aa, Borrelia burgdorferi B31
NKGVFMTK

SEQ ID NO: 36956 - protein, 8 aa, Borrelia burgdorferi B31
KGVFMTKP

SEQ ID NO: 36957 - protein, 8 aa, Borrelia burgdorferi B31
GVFMTKPK

SEQ ID NO: 36958 - protein, 8 aa, Borrelia burgdorferi B31
VFMTKPKI

SEQ ID NO: 36959 - protein, 8 aa, Borrelia burgdorferi B31
FMTKPKIF

SEQ ID NO: 36960 - protein, 8 aa, Borrelia burgdorferi B31
MTKPKIFS

SEQ ID NO: 36961 - protein, 8 aa, Borrelia burgdorferi B31
TKPKIFSI

SEQ ID NO: 36962 - protein, 8 aa, Borrelia burgdorferi B31
KPKIFSIN

SEQ ID NO: 36963 - protein, 8 aa, Borrelia burgdorferi B31
PKIFSINK

SEQ ID NO: 36964 - protein, 8 aa, Borrelia burgdorferi B31
KIFSINKE

SEQ ID NO: 36965 - protein, 8 aa, Borrelia burgdorferi B31
IFSINKEK

SEQ ID NO: 36966 - protein, 8 aa, Borrelia burgdorferi B31
FSINKEKI

SEQ ID NO: 36967 - protein, 8 aa, Borrelia burgdorferi B31
SINKEKIK

SEQ ID NO: 36968 - protein, 8 aa, Borrelia burgdorferi B31
INKEKIKI

SEQ ID NO: 36969 - protein, 8 aa, Borrelia burgdorferi B31
NKEKIKIL

SEQ ID NO: 36970 - protein, 8 aa, Borrelia burgdorferi B31
KEKIKILI

SEQ ID NO: 36971 - protein, 8 aa, Borrelia burgdorferi B31
EKIKILII

SEQ ID NO: 36972 - protein, 8 aa, Borrelia burgdorferi B31
KIKILIIV

SEQ ID NO: 36973 - protein, 8 aa, Borrelia burgdorferi B31
IKILIIVV

SEQ ID NO: 36974 - protein, 8 aa, Borrelia burgdorferi B31
KILIIVVL

SEQ ID NO: 36975 - protein, 8 aa, Borrelia burgdorferi B31
ILIIVVLT

SEQ ID NO: 36976 - protein, 8 aa, Borrelia burgdorferi B31
LIIVVLTS

SEQ ID NO: 36977 - protein, 8 aa, Borrelia burgdorferi B31
IIVVLTST

SEQ ID NO: 36978 - protein, 8 aa, Borrelia burgdorferi B31
IVVLTSTF

SEQ ID NO: 36979 - protein, 8 aa, Borrelia burgdorferi B31
VVLTSTFL

SEQ ID NO: 36980 - protein, 8 aa, Borrelia burgdorferi B31
VLTSTFLL

SEQ ID NO: 36981 - protein, 8 aa, Borrelia burgdorferi B31
LTSTFLLG

SEQ ID NO: 36982 - protein, 8 aa, Borrelia burgdorferi B31
TSTFLLGI

SEQ ID NO: 36983 - protein, 8 aa, Borrelia burgdorferi B31
STFLLGII

SEQ ID NO: 36984 - protein, 8 aa, Borrelia burgdorferi B31
TFLLGIIF

SEQ ID NO: 36985 - protein, 8 aa, Borrelia burgdorferi B31
FLLGIIFS

SEQ ID NO: 36986 - protein, 8 aa, Borrelia burgdorferi B31
LLGIIFSN

SEQ ID NO: 36987 - protein, 8 aa, Borrelia burgdorferi B31
LGIIFSNE

SEQ ID NO: 36988 - protein, 8 aa, Borrelia burgdorferi B31
GIIFSNEN

SEQ ID NO: 36989 - protein, 8 aa, Borrelia burgdorferi B31
IIFSNENK

SEQ ID NO: 36990 - protein, 8 aa, Borrelia burgdorferi B31
IFSNENKV

SEQ ID NO: 36991 - protein, 8 aa, Borrelia burgdorferi B31
FSNENKVA

SEQ ID NO: 36992 - protein, 8 aa, Borrelia burgdorferi B31
SNENKVAR

SEQ ID NO: 36993 - protein, 8 aa, Borrelia burgdorferi B31
NENKVARI

SEQ ID NO: 36994 - protein, 8 aa, Borrelia burgdorferi B31
ENKVARIL

SEQ ID NO: 36995 - protein, 8 aa, Borrelia burgdorferi B31
NKVARILE

SEQ ID NO: 36996 - protein, 8 aa, Borrelia burgdorferi B31
KVARILEE

SEQ ID NO: 36997 - protein, 8 aa, Borrelia burgdorferi B31
VARILEEK

SEQ ID NO: 36998 - protein, 8 aa, Borrelia burgdorferi B31
ARILEEKF

SEQ ID NO: 36999 - protein, 8 aa, Borrelia burgdorferi B31
RILEEKFF

SEQ ID NO: 37000 - protein, 8 aa, Borrelia burgdorferi B31
ILEEKFFD

SEQ ID NO: 37001 - protein, 8 aa, Borrelia burgdorferi B31
LEEKFFDF

SEQ ID NO: 37002 - protein, 8 aa, Borrelia burgdorferi B31
EEKFFDFD

SEQ ID NO: 37003 - protein, 8 aa, Borrelia burgdorferi B31
EKFFDFDF

SEQ ID NO: 37004 - protein, 8 aa, Borrelia burgdorferi B31
KFFDFDFN

SEQ ID NO: 37005 - protein, 8 aa, Borrelia burgdorferi B31
FFDFDFNL

SEQ ID NO: 37006 - protein, 8 aa, Borrelia burgdorferi B31
FDFDFNLI

SEQ ID NO: 37007 - protein, 8 aa, Borrelia burgdorferi B31
DFDFNLIS

SEQ ID NO: 37008 - protein, 8 aa, Borrelia burgdorferi B31
FDFNLISK

SEQ ID NO: 37009 - protein, 8 aa, Borrelia burgdorferi B31
DFNLISKI

SEQ ID NO: 37010 - protein, 8 aa, Borrelia burgdorferi B31
FNLISKIE

SEQ ID NO: 37011 - protein, 8 aa, Borrelia burgdorferi B31
NLISKIET

SEQ ID NO: 37012 - protein, 8 aa, Borrelia burgdorferi B31
LISKIETE

SEQ ID NO: 37013 - protein, 8 aa, Borrelia burgdorferi B31
ISKIETEL

SEQ ID NO: 37014 - protein, 8 aa, Borrelia burgdorferi B31
SKIETELE

SEQ ID NO: 37015 - protein, 8 aa, Borrelia burgdorferi B31
KIETELEG

SEQ ID NO: 37016 - protein, 8 aa, Borrelia burgdorferi B31
IETELEGT

SEQ ID NO: 37017 - protein, 8 aa, Borrelia burgdorferi B31
ETELEGTL

SEQ ID NO: 37018 - protein, 8 aa, Borrelia burgdorferi B31
TELEGTLT

SEQ ID NO: 37019 - protein, 8 aa, Borrelia burgdorferi B31
ELEGTLTK

SEQ ID NO: 37020 - protein, 8 aa, Borrelia burgdorferi B31
LEGTLTKL

SEQ ID NO: 37021 - protein, 8 aa, Borrelia burgdorferi B31
EGTLTKLG

SEQ ID NO: 37022 - protein, 8 aa, Borrelia burgdorferi B31
GTLTKLGK

SEQ ID NO: 37023 - protein, 8 aa, Borrelia burgdorferi B31
TLTKLGKD

SEQ ID NO: 37024 - protein, 8 aa, Borrelia burgdorferi B31
LTKLGKDW

SEQ ID NO: 37025 - protein, 8 aa, Borrelia burgdorferi B31
TKLGKDWI

SEQ ID NO: 37026 - protein, 8 aa, Borrelia burgdorferi B31
KLGKDWIL

SEQ ID NO: 37027 - protein, 8 aa, Borrelia burgdorferi B31
LGKDWILT

SEQ ID NO: 37028 - protein, 8 aa, Borrelia burgdorferi B31
GKDWILTY

SEQ ID NO: 37029 - protein, 8 aa, Borrelia burgdorferi B31
KDWILTYN

SEQ ID NO: 37030 - protein, 8 aa, Borrelia burgdorferi B31
DWILTYNK

SEQ ID NO: 37031 - protein, 8 aa, Borrelia burgdorferi B31
WILTYNKQ

SEQ ID NO: 37032 - protein, 8 aa, Borrelia burgdorferi B31
ILTYNKQN

SEQ ID NO: 37033 - protein, 8 aa, Borrelia burgdorferi B31
LTYNKQNI

SEQ ID NO: 37034 - protein, 8 aa, Borrelia burgdorferi B31
TYNKQNIP

SEQ ID NO: 37035 - protein, 8 aa, Borrelia burgdorferi B31
YNKQNIPV

SEQ ID NO: 37036 - protein, 8 aa, Borrelia burgdorferi B31
NKQNIPVD

SEQ ID NO: 37037 - protein, 8 aa, Borrelia burgdorferi B31
KQNIPVDN

SEQ ID NO: 37038 - protein, 8 aa, Borrelia burgdorferi B31
QNIPVDNK

SEQ ID NO: 37039 - protein, 8 aa, Borrelia burgdorferi B31
NIPVDNKK

SEQ ID NO: 37040 - protein, 8 aa, Borrelia burgdorferi B31
IPVDNKKV

SEQ ID NO: 37041 - protein, 8 aa, Borrelia burgdorferi B31
PVDNKKVN

SEQ ID NO: 37042 - protein, 8 aa, Borrelia burgdorferi B31
VDNKKVNS

SEQ ID NO: 37043 - protein, 8 aa, Borrelia burgdorferi B31
DNKKVNSL

SEQ ID NO: 37044 - protein, 8 aa, Borrelia burgdorferi B31
NKKVNSLI

SEQ ID NO: 37045 - protein, 8 aa, Borrelia burgdorferi B31
KKVNSLIK

SEQ ID NO: 37046 - protein, 8 aa, Borrelia burgdorferi B31
KVNSLIKA

SEQ ID NO: 37047 - protein, 8 aa, Borrelia burgdorferi B31
VNSLIKAL

SEQ ID NO: 37048 - protein, 8 aa, Borrelia burgdorferi B31
NSLIKALD

SEQ ID NO: 37049 - protein, 8 aa, Borrelia burgdorferi B31
SLIKALDE

SEQ ID NO: 37050 - protein, 8 aa, Borrelia burgdorferi B31
LIKALDEL

SEQ ID NO: 37051 - protein, 8 aa, Borrelia burgdorferi B31
IKALDELQ

SEQ ID NO: 37052 - protein, 8 aa, Borrelia burgdorferi B31
KALDELQK

SEQ ID NO: 37053 - protein, 8 aa, Borrelia burgdorferi B31
ALDELQKN

SEQ ID NO: 37054 - protein, 8 aa, Borrelia burgdorferi B31
LDELQKNK

SEQ ID NO: 37055 - protein, 8 aa, Borrelia burgdorferi B31
DELQKNKL

SEQ ID NO: 37056 - protein, 8 aa, Borrelia burgdorferi B31
ELQKNKLV

SEQ ID NO: 37057 - protein, 8 aa, Borrelia burgdorferi B31
LQKNKLVS

SEQ ID NO: 37058 - protein, 8 aa, Borrelia burgdorferi B31
QKNKLVSR

SEQ ID NO: 37059 - protein, 8 aa, Borrelia burgdorferi B31
KNKLVSRD

SEQ ID NO: 37060 - protein, 8 aa, Borrelia burgdorferi B31
NKLVSRDQ

SEQ ID NO: 37061 - protein, 8 aa, Borrelia burgdorferi B31
KLVSRDQK

SEQ ID NO: 37062 - protein, 8 aa, Borrelia burgdorferi B31
LVSRDQKK

SEQ ID NO: 37063 - protein, 8 aa, Borrelia burgdorferi B31
VSRDQKKH

SEQ ID NO: 37064 - protein, 8 aa, Borrelia burgdorferi B31
SRDQKKHK

SEQ ID NO: 37065 - protein, 8 aa, Borrelia burgdorferi B31
RDQKKHKE

SEQ ID NO: 37066 - protein, 8 aa, Borrelia burgdorferi B31
DQKKHKEL

SEQ ID NO: 37067 - protein, 8 aa, Borrelia burgdorferi B31
QKKHKELG

SEQ ID NO: 37068 - protein, 8 aa, Borrelia burgdorferi B31
KKHKELGI

SEQ ID NO: 37069 - protein, 8 aa, Borrelia burgdorferi B31
KHKELGIG

SEQ ID NO: 37070 - protein, 8 aa, Borrelia burgdorferi B31
HKELGIGE

SEQ ID NO: 37071 - protein, 8 aa, Borrelia burgdorferi B31
KELGIGEN

SEQ ID NO: 37072 - protein, 8 aa, Borrelia burgdorferi B31
ELGIGENP

SEQ ID NO: 37073 - protein, 8 aa, Borrelia burgdorferi B31
LGIGENPS

SEQ ID NO: 37074 - protein, 8 aa, Borrelia burgdorferi B31
GIGENPSF

SEQ ID NO: 37075 - protein, 8 aa, Borrelia burgdorferi B31
IGENPSFK

SEQ ID NO: 37076 - protein, 8 aa, Borrelia burgdorferi B31
GENPSFKL

SEQ ID NO: 37077 - protein, 8 aa, Borrelia burgdorferi B31
ENPSFKLF

SEQ ID NO: 37078 - protein, 8 aa, Borrelia burgdorferi B31
NPSFKLFD

SEQ ID NO: 37079 - protein, 8 aa, Borrelia burgdorferi B31
PSFKLFDN

SEQ ID NO: 37080 - protein, 8 aa, Borrelia burgdorferi B31
SFKLFDNN

SEQ ID NO: 37081 - protein, 8 aa, Borrelia burgdorferi B31
FKLFDNNN

SEQ ID NO: 37082 - protein, 8 aa, Borrelia burgdorferi B31
KLFDNNNK

SEQ ID NO: 37083 - protein, 8 aa, Borrelia burgdorferi B31
LFDNNNKL

SEQ ID NO: 37084 - protein, 8 aa, Borrelia burgdorferi B31
FDNNNKLL

SEQ ID NO: 37085 - protein, 8 aa, Borrelia burgdorferi B31
DNNNKLLT

SEQ ID NO: 37086 - protein, 8 aa, Borrelia burgdorferi B31
NNNKLLTE

SEQ ID NO: 37087 - protein, 8 aa, Borrelia burgdorferi B31
NNKLLTEI

SEQ ID NO: 37088 - protein, 8 aa, Borrelia burgdorferi B31
NKLLTEIF

SEQ ID NO: 37089 - protein, 8 aa, Borrelia burgdorferi B31
KLLTEIFV

SEQ ID NO: 37090 - protein, 8 aa, Borrelia burgdorferi B31
LLTEIFVG

SEQ ID NO: 37091 - protein, 8 aa, Borrelia burgdorferi B31
LTEIFVGK

SEQ ID NO: 37092 - protein, 8 aa, Borrelia burgdorferi B31
TEIFVGKS

SEQ ID NO: 37093 - protein, 8 aa, Borrelia burgdorferi B31
EIFVGKSG

SEQ ID NO: 37094 - protein, 8 aa, Borrelia burgdorferi B31
IFVGKSGE

SEQ ID NO: 37095 - protein, 8 aa, Borrelia burgdorferi B31
FVGKSGEG

SEQ ID NO: 37096 - protein, 8 aa, Borrelia burgdorferi B31
VGKSGEGD

SEQ ID NO: 37097 - protein, 8 aa, Borrelia burgdorferi B31
GKSGEGDS

SEQ ID NO: 37098 - protein, 8 aa, Borrelia burgdorferi B31
KSGEGDSR

SEQ ID NO: 37099 - protein, 8 aa, Borrelia burgdorferi B31
SGEGDSRL

SEQ ID NO: 37100 - protein, 8 aa, Borrelia burgdorferi B31
GEGDSRLA

SEQ ID NO: 37101 - protein, 8 aa, Borrelia burgdorferi B31
EGDSRLAY

SEQ ID NO: 37102 - protein, 8 aa, Borrelia burgdorferi B31
GDSRLAYI

SEQ ID NO: 37103 - protein, 8 aa, Borrelia burgdorferi B31
DSRLAYIK

SEQ ID NO: 37104 - protein, 8 aa, Borrelia burgdorferi B31
SRLAYIKG

SEQ ID NO: 37105 - protein, 8 aa, Borrelia burgdorferi B31
RLAYIKGS

SEQ ID NO: 37106 - protein, 8 aa, Borrelia burgdorferi B31
LAYIKGSD

SEQ ID NO: 37107 - protein, 8 aa, Borrelia burgdorferi B31
AYIKGSDE

SEQ ID NO: 37108 - protein, 8 aa, Borrelia burgdorferi B31
YIKGSDEN

SEQ ID NO: 37109 - protein, 8 aa, Borrelia burgdorferi B31
IKGSDENV

SEQ ID NO: 37110 - protein, 8 aa, Borrelia burgdorferi B31
KGSDENVY

SEQ ID NO: 37111 - protein, 8 aa, Borrelia burgdorferi B31
GSDENVYL

SEQ ID NO: 37112 - protein, 8 aa, Borrelia burgdorferi B31
SDENVYLT

SEQ ID NO: 37113 - protein, 8 aa, Borrelia burgdorferi B31
DENVYLTK

SEQ ID NO: 37114 - protein, 8 aa, Borrelia burgdorferi B31
ENVYLTKN

SEQ ID NO: 37115 - protein, 8 aa, Borrelia burgdorferi B31
NVYLTKNI

SEQ ID NO: 37116 - protein, 8 aa, Borrelia burgdorferi B31
VYLTKNIF

SEQ ID NO: 37117 - protein, 8 aa, Borrelia burgdorferi B31
YLTKNIFL

SEQ ID NO: 37118 - protein, 8 aa, Borrelia burgdorferi B31
LTKNIFLS

SEQ ID NO: 37119 - protein, 8 aa, Borrelia burgdorferi B31
TKNIFLSY

SEQ ID NO: 37120 - protein, 8 aa, Borrelia burgdorferi B31
KNIFLSYK

SEQ ID NO: 37121 - protein, 8 aa, Borrelia burgdorferi B31
NIFLSYKG

SEQ ID NO: 37122 - protein, 8 aa, Borrelia burgdorferi B31
IFLSYKGN

SEQ ID NO: 37123 - protein, 8 aa, Borrelia burgdorferi B31
FLSYKGNS

SEQ ID NO: 37124 - protein, 8 aa, Borrelia burgdorferi B31
LSYKGNSY

SEQ ID NO: 37125 - protein, 8 aa, Borrelia burgdorferi B31
SYKGNSYN

SEQ ID NO: 37126 - protein, 8 aa, Borrelia burgdorferi B31
YKGNSYNT

SEQ ID NO: 37127 - protein, 8 aa, Borrelia burgdorferi B31
KGNSYNTF

SEQ ID NO: 37128 - protein, 8 aa, Borrelia burgdorferi B31
GNSYNTFS

SEQ ID NO: 37129 - protein, 8 aa, Borrelia burgdorferi B31
NSYNTFSD

SEQ ID NO: 37130 - protein, 8 aa, Borrelia burgdorferi B31
SYNTFSDT

SEQ ID NO: 37131 - protein, 8 aa, Borrelia burgdorferi B31
YNTFSDTT

SEQ ID NO: 37132 - protein, 8 aa, Borrelia burgdorferi B31
NTFSDTTL

SEQ ID NO: 37133 - protein, 8 aa, Borrelia burgdorferi B31
TFSDTTLF

SEQ ID NO: 37134 - protein, 8 aa, Borrelia burgdorferi B31
FSDTTLFQ

SEQ ID NO: 37135 - protein, 8 aa, Borrelia burgdorferi B31
SDTTLFQE

SEQ ID NO: 37136 - protein, 8 aa, Borrelia burgdorferi B31
DTTLFQEK

SEQ ID NO: 37137 - protein, 8 aa, Borrelia burgdorferi B31
TTLFQEKN

SEQ ID NO: 37138 - protein, 8 aa, Borrelia burgdorferi B31
TLFQEKNT

SEQ ID NO: 37139 - protein, 8 aa, Borrelia burgdorferi B31
LFQEKNTK

SEQ ID NO: 37140 - protein, 8 aa, Borrelia burgdorferi B31
FQEKNTKL

SEQ ID NO: 37141 - protein, 8 aa, Borrelia burgdorferi B31
QEKNTKLE

SEQ ID NO: 37142 - protein, 8 aa, Borrelia burgdorferi B31
EKNTKLEN

SEQ ID NO: 37143 - protein, 8 aa, Borrelia burgdorferi B31
KNTKLENL

SEQ ID NO: 37144 - protein, 8 aa, Borrelia burgdorferi B31
NTKLENLS

SEQ ID NO: 37145 - protein, 8 aa, Borrelia burgdorferi B31
TKLENLSF

SEQ ID NO: 37146 - protein, 8 aa, Borrelia burgdorferi B31
KLENLSFK

SEQ ID NO: 37147 - protein, 8 aa, Borrelia burgdorferi B31
LENLSFKI

SEQ ID NO: 37148 - protein, 8 aa, Borrelia burgdorferi B31
ENLSFKII

SEQ ID NO: 37149 - protein, 8 aa, Borrelia burgdorferi B31
NLSFKIIR

SEQ ID NO: 37150 - protein, 8 aa, Borrelia burgdorferi B31
LSFKIIRK

SEQ ID NO: 37151 - protein, 8 aa, Borrelia burgdorferi B31
SFKIIRKL

SEQ ID NO: 37152 - protein, 8 aa, Borrelia burgdorferi B31
FKIIRKLN

SEQ ID NO: 37153 - protein, 8 aa, Borrelia burgdorferi B31
KIIRKLNK

SEQ ID NO: 37154 - protein, 8 aa, Borrelia burgdorferi B31
IIRKLNKE

SEQ ID NO: 37155 - protein, 8 aa, Borrelia burgdorferi B31
IRKLNKEN

SEQ ID NO: 37156 - protein, 8 aa, Borrelia burgdorferi B31
RKLNKENE

SEQ ID NO: 37157 - protein, 8 aa, Borrelia burgdorferi B31
KLNKENEN

SEQ ID NO: 37158 - protein, 8 aa, Borrelia burgdorferi B31
LNKENENN

SEQ ID NO: 37159 - protein, 8 aa, Borrelia burgdorferi B31
NKENENNI

SEQ ID NO: 37160 - protein, 8 aa, Borrelia burgdorferi B31
KENENNIN

SEQ ID NO: 37161 - protein, 8 aa, Borrelia burgdorferi B31
ENENNINN

SEQ ID NO: 37162 - protein, 8 aa, Borrelia burgdorferi B31
NENNINNN

SEQ ID NO: 37163 - protein, 8 aa, Borrelia burgdorferi B31
ENNINNNY

SEQ ID NO: 37164 - protein, 8 aa, Borrelia burgdorferi B31
NNINNNYE

SEQ ID NO: 37165 - protein, 8 aa, Borrelia burgdorferi B31
NINNNYEI

SEQ ID NO: 37166 - protein, 8 aa, Borrelia burgdorferi B31
INNNYEII

SEQ ID NO: 37167 - protein, 8 aa, Borrelia burgdorferi B31
NNNYEIIS

SEQ ID NO: 37168 - protein, 8 aa, Borrelia burgdorferi B31
NNYEIISK

SEQ ID NO: 37169 - protein, 8 aa, Borrelia burgdorferi B31
NYEIISKD

SEQ ID NO: 37170 - protein, 8 aa, Borrelia burgdorferi B31
YEIISKDG

SEQ ID NO: 37171 - protein, 8 aa, Borrelia burgdorferi B31
EIISKDGL

SEQ ID NO: 37172 - protein, 8 aa, Borrelia burgdorferi B31
IISKDGLY

SEQ ID NO: 37173 - protein, 8 aa, Borrelia burgdorferi B31
ISKDGLYF

SEQ ID NO: 37174 - protein, 8 aa, Borrelia burgdorferi B31
SKDGLYFL

SEQ ID NO: 37175 - protein, 8 aa, Borrelia burgdorferi B31
KDGLYFLN

SEQ ID NO: 37176 - protein, 8 aa, Borrelia burgdorferi B31
DGLYFLNN

SEQ ID NO: 37177 - protein, 8 aa, Borrelia burgdorferi B31
GLYFLNNQ

SEQ ID NO: 37178 - protein, 8 aa, Borrelia burgdorferi B31
LYFLNNQK

SEQ ID NO: 37179 - protein, 8 aa, Borrelia burgdorferi B31
YFLNNQKM

SEQ ID NO: 37180 - protein, 8 aa, Borrelia burgdorferi B31
FLNNQKMT

SEQ ID NO: 37181 - protein, 8 aa, Borrelia burgdorferi B31
LNNQKMTK

SEQ ID NO: 37182 - protein, 8 aa, Borrelia burgdorferi B31
NNQKMTKE

SEQ ID NO: 37183 - protein, 8 aa, Borrelia burgdorferi B31
NQKMTKER

SEQ ID NO: 37184 - protein, 8 aa, Borrelia burgdorferi B31
QKMTKERP

SEQ ID NO: 37185 - protein, 8 aa, Borrelia burgdorferi B31
KMTKERPL

SEQ ID NO: 37186 - protein, 8 aa, Borrelia burgdorferi B31
MTKERPLN

SEQ ID NO: 37187 - protein, 8 aa, Borrelia burgdorferi B31
TKERPLNI

SEQ ID NO: 37188 - protein, 8 aa, Borrelia burgdorferi B31
KERPLNII

SEQ ID NO: 37189 - protein, 8 aa, Borrelia burgdorferi B31
ERPLNIIA

SEQ ID NO: 37190 - protein, 8 aa, Borrelia burgdorferi B31
RPLNIIAE

SEQ ID NO: 37191 - protein, 8 aa, Borrelia burgdorferi B31
PLNIIAEF

SEQ ID NO: 37192 - protein, 8 aa, Borrelia burgdorferi B31
LNIIAEFK

SEQ ID NO: 37193 - protein, 8 aa, Borrelia burgdorferi B31
NIIAEFKA

SEQ ID NO: 37194 - protein, 8 aa, Borrelia burgdorferi B31
IIAEFKAD

SEQ ID NO: 37195 - protein, 8 aa, Borrelia burgdorferi B31
IAEFKADG

SEQ ID NO: 37196 - protein, 8 aa, Borrelia burgdorferi B31
AEFKADGL

SEQ ID NO: 37197 - protein, 8 aa, Borrelia burgdorferi B31
EFKADGLE

SEQ ID NO: 37198 - protein, 8 aa, Borrelia burgdorferi B31
FKADGLEI

SEQ ID NO: 37199 - protein, 8 aa, Borrelia burgdorferi B31
KADGLEID

SEQ ID NO: 37200 - protein, 8 aa, Borrelia burgdorferi B31
ADGLEIDK

SEQ ID NO: 37201 - protein, 8 aa, Borrelia burgdorferi B31
DGLEIDKS

SEQ ID NO: 37202 - protein, 8 aa, Borrelia burgdorferi B31
GLEIDKSK

SEQ ID NO: 37203 - protein, 8 aa, Borrelia burgdorferi B31
LEIDKSKI

SEQ ID NO: 37204 - protein, 8 aa, Borrelia burgdorferi B31
EIDKSKID

SEQ ID NO: 37205 - protein, 8 aa, Borrelia burgdorferi B31
IDKSKIDD

SEQ ID NO: 37206 - protein, 8 aa, Borrelia burgdorferi B31
DKSKIDDY

SEQ ID NO: 37207 - protein, 8 aa, Borrelia burgdorferi B31
KSKIDDYN

SEQ ID NO: 37208 - protein, 8 aa, Borrelia burgdorferi B31
SKIDDYNL

SEQ ID NO: 37209 - protein, 8 aa, Borrelia burgdorferi B31
KIDDYNLQ

SEQ ID NO: 37210 - protein, 8 aa, Borrelia burgdorferi B31
IDDYNLQY

SEQ ID NO: 37211 - protein, 8 aa, Borrelia burgdorferi B31
DDYNLQYK

SEQ ID NO: 37212 - protein, 8 aa, Borrelia burgdorferi B31
DYNLQYKI

SEQ ID NO: 37213 - protein, 8 aa, Borrelia burgdorferi B31
YNLQYKIE

SEQ ID NO: 37214 - protein, 8 aa, Borrelia burgdorferi B31
NLQYKIEV

SEQ ID NO: 37215 - protein, 8 aa, Borrelia burgdorferi B31
LQYKIEVK

SEQ ID NO: 37216 - protein, 8 aa, Borrelia burgdorferi B31
QYKIEVKW

SEQ ID NO: 37217 - protein, 8 aa, Borrelia burgdorferi B31
YKIEVKWS

SEQ ID NO: 37218 - protein, 8 aa, Borrelia burgdorferi B31
KIEVKWSN

SEQ ID NO: 37219 - protein, 8 aa, Borrelia burgdorferi B31
IEVKWSNK

SEQ ID NO: 37220 - protein, 8 aa, Borrelia burgdorferi B31
EVKWSNKS

SEQ ID NO: 37221 - protein, 8 aa, Borrelia burgdorferi B31
VKWSNKSV

SEQ ID NO: 37222 - protein, 8 aa, Borrelia burgdorferi B31
KWSNKSVN

SEQ ID NO: 37223 - protein, 8 aa, Borrelia burgdorferi B31
WSNKSVNN

SEQ ID NO: 37224 - protein, 8 aa, Borrelia burgdorferi B31
SNKSVNNI

SEQ ID NO: 37225 - protein, 8 aa, Borrelia burgdorferi B31
NKSVNNIE

SEQ ID NO: 37226 - protein, 8 aa, Borrelia burgdorferi B31
KSVNNIEV

SEQ ID NO: 37227 - protein, 8 aa, Borrelia burgdorferi B31
SVNNIEVY

SEQ ID NO: 37228 - protein, 8 aa, Borrelia burgdorferi B31
VNNIEVYF

SEQ ID NO: 37229 - protein, 8 aa, Borrelia burgdorferi B31
NNIEVYFN

SEQ ID NO: 37230 - protein, 8 aa, Borrelia burgdorferi B31
NIEVYFNK

SEQ ID NO: 37231 - protein, 8 aa, Borrelia burgdorferi B31
IEVYFNKN

SEQ ID NO: 37232 - protein, 8 aa, Borrelia burgdorferi B31
EVYFNKNE

SEQ ID NO: 37233 - protein, 8 aa, Borrelia burgdorferi B31
VYFNKNEE

SEQ ID NO: 37234 - protein, 8 aa, Borrelia burgdorferi B31
YFNKNEEN

SEQ ID NO: 37235 - protein, 8 aa, Borrelia burgdorferi B31
FNKNEEND

SEQ ID NO: 37236 - protein, 8 aa, Borrelia burgdorferi B31
NKNEENDK

SEQ ID NO: 37237 - protein, 8 aa, Borrelia burgdorferi B31
KNEENDKD

SEQ ID NO: 37238 - protein, 8 aa, Borrelia burgdorferi B31
NEENDKDI

SEQ ID NO: 37239 - protein, 8 aa, Borrelia burgdorferi B31
EENDKDIL

SEQ ID NO: 37240 - protein, 8 aa, Borrelia burgdorferi B31
ENDKDILI

SEQ ID NO: 37241 - protein, 8 aa, Borrelia burgdorferi B31
NDKDILIK

SEQ ID NO: 37242 - protein, 8 aa, Borrelia burgdorferi B31
DKDILIKK

SEQ ID NO: 37243 - protein, 8 aa, Borrelia burgdorferi B31
KDILIKKD

SEQ ID NO: 37244 - protein, 8 aa, Borrelia burgdorferi B31
DILIKKDK

SEQ ID NO: 37245 - protein, 8 aa, Borrelia burgdorferi B31
ILIKKDKD

SEQ ID NO: 37246 - protein, 8 aa, Borrelia burgdorferi B31
LIKKDKDE

SEQ ID NO: 37247 - protein, 8 aa, Borrelia burgdorferi B31
IKKDKDEY

SEQ ID NO: 37248 - protein, 8 aa, Borrelia burgdorferi B31
KKDKDEYY

SEQ ID NO: 37249 - protein, 8 aa, Borrelia burgdorferi B31
KDKDEYYY

SEQ ID NO: 37250 - protein, 8 aa, Borrelia burgdorferi B31
DKDEYYYT

SEQ ID NO: 37251 - protein, 8 aa, Borrelia burgdorferi B31
KDEYYYTT

SEQ ID NO: 37252 - protein, 8 aa, Borrelia burgdorferi B31
DEYYYTTS

SEQ ID NO: 37253 - protein, 8 aa, Borrelia burgdorferi B31
EYYYTTSK

SEQ ID NO: 37254 - protein, 8 aa, Borrelia burgdorferi B31
YYYTTSKW

SEQ ID NO: 37255 - protein, 8 aa, Borrelia burgdorferi B31
YYTTSKWT

SEQ ID NO: 37256 - protein, 8 aa, Borrelia burgdorferi B31
YTTSKWTF

SEQ ID NO: 37257 - protein, 8 aa, Borrelia burgdorferi B31
TTSKWTFF

SEQ ID NO: 37258 - protein, 8 aa, Borrelia burgdorferi B31
TSKWTFFD

SEQ ID NO: 37259 - protein, 8 aa, Borrelia burgdorferi B31
SKWTFFDV

SEQ ID NO: 37260 - protein, 8 aa, Borrelia burgdorferi B31
KWTFFDVF

SEQ ID NO: 37261 - protein, 8 aa, Borrelia burgdorferi B31
WTFFDVFD

SEQ ID NO: 37262 - protein, 8 aa, Borrelia burgdorferi B31
TFFDVFDL

SEQ ID NO: 37263 - protein, 8 aa, Borrelia burgdorferi B31
FFDVFDLE

SEQ ID NO: 37264 - protein, 8 aa, Borrelia burgdorferi B31
FDVFDLEK

SEQ ID NO: 37265 - protein, 8 aa, Borrelia burgdorferi B31
DVFDLEKK

SEQ ID NO: 37266 - protein, 8 aa, Borrelia burgdorferi B31
VFDLEKKL

SEQ ID NO: 37267 - protein, 8 aa, Borrelia burgdorferi B31
FDLEKKLT

SEQ ID NO: 37268 - protein, 8 aa, Borrelia burgdorferi B31
DLEKKLTE

SEQ ID NO: 37269 - protein, 8 aa, Borrelia burgdorferi B31
LEKKLTEK

SEQ ID NO: 37270 - protein, 8 aa, Borrelia burgdorferi B31
EKKLTEKD

SEQ ID NO: 37271 - protein, 8 aa, Borrelia burgdorferi B31
KKLTEKDD

SEQ ID NO: 37272 - protein, 8 aa, Borrelia burgdorferi B31
KLTEKDDI

SEQ ID NO: 37273 - protein, 8 aa, Borrelia burgdorferi B31
LTEKDDIS

SEQ ID NO: 37274 - protein, 8 aa, Borrelia burgdorferi B31
TEKDDISS

SEQ ID NO: 37275 - protein, 8 aa, Borrelia burgdorferi B31
EKDDISSN

SEQ ID NO: 37276 - protein, 8 aa, Borrelia burgdorferi B31
KDDISSND

SEQ ID NO: 37277 - protein, 8 aa, Borrelia burgdorferi B31
DDISSNDN

SEQ ID NO: 37278 - protein, 8 aa, Borrelia burgdorferi B31
DISSNDNQ

SEQ ID NO: 37279 - protein, 8 aa, Borrelia burgdorferi B31
ISSNDNQE

SEQ ID NO: 37280 - protein, 8 aa, Borrelia burgdorferi B31
SSNDNQED

SEQ ID NO: 37281 - protein, 8 aa, Borrelia burgdorferi B31
SNDNQEDH

SEQ ID NO: 37282 - protein, 8 aa, Borrelia burgdorferi B31
NDNQEDHH

SEQ ID NO: 37283 - protein, 8 aa, Borrelia burgdorferi B31
DNQEDHHE

SEQ ID NO: 37284 - protein, 8 aa, Borrelia burgdorferi B31
NQEDHHEH

SEQ ID NO: 37285 - protein, 8 aa, Borrelia burgdorferi B31
QEDHHEHH

SEQ ID NO: 37286 - protein, 8 aa, Borrelia burgdorferi B31
EDHHEHHN

SEQ ID NO: 37287 - protein, 8 aa, Borrelia burgdorferi B31
DHHEHHNN

SEQ ID NO: 37288 - protein, 8 aa, Borrelia burgdorferi B31
HHEHHNNA

SEQ ID NO: 37289 - protein, 8 aa, Borrelia burgdorferi B31
HEHHNNAD

SEQ ID NO: 37290 - protein, 9 aa, Borrelia burgdorferi B31
MDLLDLLEK

SEQ ID NO: 37291 - protein, 9 aa, Borrelia burgdorferi B31
DLLDLLEKE

SEQ ID NO: 37292 - protein, 9 aa, Borrelia burgdorferi B31
LLDLLEKEK

SEQ ID NO: 37293 - protein, 9 aa, Borrelia burgdorferi B31
LDLLEKEKQ

SEQ ID NO: 37294 - protein, 9 aa, Borrelia burgdorferi B31
DLLEKEKQI

SEQ ID NO: 37295 - protein, 9 aa, Borrelia burgdorferi B31
LLEKEKQIN

SEQ ID NO: 37296 - protein, 9 aa, Borrelia burgdorferi B31
LEKEKQINK

SEQ ID NO: 37297 - protein, 9 aa, Borrelia burgdorferi B31
EKEKQINKN

SEQ ID NO: 37298 - protein, 9 aa, Borrelia burgdorferi B31
KEKQINKNK

SEQ ID NO: 37299 - protein, 9 aa, Borrelia burgdorferi B31
EKQINKNKG

SEQ ID NO: 37300 - protein, 9 aa, Borrelia burgdorferi B31
KQINKNKGV

SEQ ID NO: 37301 - protein, 9 aa, Borrelia burgdorferi B31
QINKNKGVF

SEQ ID NO: 37302 - protein, 9 aa, Borrelia burgdorferi B31
INKNKGVFM

SEQ ID NO: 37303 - protein, 9 aa, Borrelia burgdorferi B31
NKNKGVFMT

SEQ ID NO: 37304 - protein, 9 aa, Borrelia burgdorferi B31
KNKGVFMTK

SEQ ID NO: 37305 - protein, 9 aa, Borrelia burgdorferi B31
NKGVFMTKP

SEQ ID NO: 37306 - protein, 9 aa, Borrelia burgdorferi B31
KGVFMTKPK

SEQ ID NO: 37307 - protein, 9 aa, Borrelia burgdorferi B31
GVFMTKPKI

SEQ ID NO: 37308 - protein, 9 aa, Borrelia burgdorferi B31
VFMTKPKIF

SEQ ID NO: 37309 - protein, 9 aa, Borrelia burgdorferi B31
FMTKPKIFS

SEQ ID NO: 37310 - protein, 9 aa, Borrelia burgdorferi B31
MTKPKIFSI

SEQ ID NO: 37311 - protein, 9 aa, Borrelia burgdorferi B31
TKPKIFSIN

SEQ ID NO: 37312 - protein, 9 aa, Borrelia burgdorferi B31
KPKIFSINK

SEQ ID NO: 37313 - protein, 9 aa, Borrelia burgdorferi B31
PKIFSINKE

SEQ ID NO: 37314 - protein, 9 aa, Borrelia burgdorferi B31
KIFSINKEK

SEQ ID NO: 37315 - protein, 9 aa, Borrelia burgdorferi B31
IFSINKEKI

SEQ ID NO: 37316 - protein, 9 aa, Borrelia burgdorferi B31
FSINKEKIK

SEQ ID NO: 37317 - protein, 9 aa, Borrelia burgdorferi B31
SINKEKIKI

SEQ ID NO: 37318 - protein, 9 aa, Borrelia burgdorferi B31
INKEKIKIL

SEQ ID NO: 37319 - protein, 9 aa, Borrelia burgdorferi B31
NKEKIKILI

SEQ ID NO: 37320 - protein, 9 aa, Borrelia burgdorferi B31
KEKIKILII

SEQ ID NO: 37321 - protein, 9 aa, Borrelia burgdorferi B31
EKIKILIIV

SEQ ID NO: 37322 - protein, 9 aa, Borrelia burgdorferi B31
KIKILIIVV

SEQ ID NO: 37323 - protein, 9 aa, Borrelia burgdorferi B31
IKILIIVVL

SEQ ID NO: 37324 - protein, 9 aa, Borrelia burgdorferi B31
KILIIVVLT

SEQ ID NO: 37325 - protein, 9 aa, Borrelia burgdorferi B31
ILIIVVLTS

SEQ ID NO: 37326 - protein, 9 aa, Borrelia burgdorferi B31
LIIVVLTST

SEQ ID NO: 37327 - protein, 9 aa, Borrelia burgdorferi B31
IIVVLTSTF

SEQ ID NO: 37328 - protein, 9 aa, Borrelia burgdorferi B31
IVVLTSTFL

SEQ ID NO: 37329 - protein, 9 aa, Borrelia burgdorferi B31
VVLTSTFLL

SEQ ID NO: 37330 - protein, 9 aa, Borrelia burgdorferi B31
VLTSTFLLG

SEQ ID NO: 37331 - protein, 9 aa, Borrelia burgdorferi B31
LTSTFLLGI

SEQ ID NO: 37332 - protein, 9 aa, Borrelia burgdorferi B31
TSTFLLGII

SEQ ID NO: 37333 - protein, 9 aa, Borrelia burgdorferi B31
STFLLGIIF

SEQ ID NO: 37334 - protein, 9 aa, Borrelia burgdorferi B31
TFLLGIIFS

SEQ ID NO: 37335 - protein, 9 aa, Borrelia burgdorferi B31
FLLGIIFSN

SEQ ID NO: 37336 - protein, 9 aa, Borrelia burgdorferi B31
LLGIIFSNE

SEQ ID NO: 37337 - protein, 9 aa, Borrelia burgdorferi B31
LGIIFSNEN

SEQ ID NO: 37338 - protein, 9 aa, Borrelia burgdorferi B31
GIIFSNENK

SEQ ID NO: 37339 - protein, 9 aa, Borrelia burgdorferi B31
IIFSNENKV

SEQ ID NO: 37340 - protein, 9 aa, Borrelia burgdorferi B31
IFSNENKVA

SEQ ID NO: 37341 - protein, 9 aa, Borrelia burgdorferi B31
FSNENKVAR

SEQ ID NO: 37342 - protein, 9 aa, Borrelia burgdorferi B31
SNENKVARI

SEQ ID NO: 37343 - protein, 9 aa, Borrelia burgdorferi B31
NENKVARIL

SEQ ID NO: 37344 - protein, 9 aa, Borrelia burgdorferi B31
ENKVARILE

SEQ ID NO: 37345 - protein, 9 aa, Borrelia burgdorferi B31
NKVARILEE

SEQ ID NO: 37346 - protein, 9 aa, Borrelia burgdorferi B31
KVARILEEK

SEQ ID NO: 37347 - protein, 9 aa, Borrelia burgdorferi B31
VARILEEKF

SEQ ID NO: 37348 - protein, 9 aa, Borrelia burgdorferi B31
ARILEEKFF

SEQ ID NO: 37349 - protein, 9 aa, Borrelia burgdorferi B31
RILEEKFFD

SEQ ID NO: 37350 - protein, 9 aa, Borrelia burgdorferi B31
ILEEKFFDF

SEQ ID NO: 37351 - protein, 9 aa, Borrelia burgdorferi B31
LEEKFFDFD

SEQ ID NO: 37352 - protein, 9 aa, Borrelia burgdorferi B31
EEKFFDFDF

SEQ ID NO: 37353 - protein, 9 aa, Borrelia burgdorferi B31
EKFFDFDFN

SEQ ID NO: 37354 - protein, 9 aa, Borrelia burgdorferi B31
KFFDFDFNL

SEQ ID NO: 37355 - protein, 9 aa, Borrelia burgdorferi B31
FFDFDFNLI

SEQ ID NO: 37356 - protein, 9 aa, Borrelia burgdorferi B31
FDFDFNLIS

SEQ ID NO: 37357 - protein, 9 aa, Borrelia burgdorferi B31
DFDFNLISK

SEQ ID NO: 37358 - protein, 9 aa, Borrelia burgdorferi B31
FDFNLISKI

SEQ ID NO: 37359 - protein, 9 aa, Borrelia burgdorferi B31
DFNLISKIE

SEQ ID NO: 37360 - protein, 9 aa, Borrelia burgdorferi B31
FNLISKIET

SEQ ID NO: 37361 - protein, 9 aa, Borrelia burgdorferi B31
NLISKIETE

SEQ ID NO: 37362 - protein, 9 aa, Borrelia burgdorferi B31
LISKIETEL

SEQ ID NO: 37363 - protein, 9 aa, Borrelia burgdorferi B31
ISKIETELE

SEQ ID NO: 37364 - protein, 9 aa, Borrelia burgdorferi B31
SKIETELEG

SEQ ID NO: 37365 - protein, 9 aa, Borrelia burgdorferi B31
KIETELEGT

SEQ ID NO: 37366 - protein, 9 aa, Borrelia burgdorferi B31
IETELEGTL

SEQ ID NO: 37367 - protein, 9 aa, Borrelia burgdorferi B31
ETELEGTLT

SEQ ID NO: 37368 - protein, 9 aa, Borrelia burgdorferi B31
TELEGTLTK

SEQ ID NO: 37369 - protein, 9 aa, Borrelia burgdorferi B31
ELEGTLTKL

SEQ ID NO: 37370 - protein, 9 aa, Borrelia burgdorferi B31
LEGTLTKLG

SEQ ID NO: 37371 - protein, 9 aa, Borrelia burgdorferi B31
EGTLTKLGK

SEQ ID NO: 37372 - protein, 9 aa, Borrelia burgdorferi B31
GTLTKLGKD

SEQ ID NO: 37373 - protein, 9 aa, Borrelia burgdorferi B31
TLTKLGKDW

SEQ ID NO: 37374 - protein, 9 aa, Borrelia burgdorferi B31
LTKLGKDWI

SEQ ID NO: 37375 - protein, 9 aa, Borrelia burgdorferi B31
TKLGKDWIL

SEQ ID NO: 37376 - protein, 9 aa, Borrelia burgdorferi B31
KLGKDWILT

SEQ ID NO: 37377 - protein, 9 aa, Borrelia burgdorferi B31
LGKDWILTY

SEQ ID NO: 37378 - protein, 9 aa, Borrelia burgdorferi B31
GKDWILTYN

SEQ ID NO: 37379 - protein, 9 aa, Borrelia burgdorferi B31
KDWILTYNK

SEQ ID NO: 37380 - protein, 9 aa, Borrelia burgdorferi B31
DWILTYNKQ

SEQ ID NO: 37381 - protein, 9 aa, Borrelia burgdorferi B31
WILTYNKQN

SEQ ID NO: 37382 - protein, 9 aa, Borrelia burgdorferi B31
ILTYNKQNI

SEQ ID NO: 37383 - protein, 9 aa, Borrelia burgdorferi B31
LTYNKQNIP

SEQ ID NO: 37384 - protein, 9 aa, Borrelia burgdorferi B31
TYNKQNIPV

SEQ ID NO: 37385 - protein, 9 aa, Borrelia burgdorferi B31
YNKQNIPVD

SEQ ID NO: 37386 - protein, 9 aa, Borrelia burgdorferi B31
NKQNIPVDN

SEQ ID NO: 37387 - protein, 9 aa, Borrelia burgdorferi B31
KQNIPVDNK

SEQ ID NO: 37388 - protein, 9 aa, Borrelia burgdorferi B31
QNIPVDNKK

SEQ ID NO: 37389 - protein, 9 aa, Borrelia burgdorferi B31
NIPVDNKKV

SEQ ID NO: 37390 - protein, 9 aa, Borrelia burgdorferi B31
IPVDNKKVN

SEQ ID NO: 37391 - protein, 9 aa, Borrelia burgdorferi B31
PVDNKKVNS

SEQ ID NO: 37392 - protein, 9 aa, Borrelia burgdorferi B31
VDNKKVNSL

SEQ ID NO: 37393 - protein, 9 aa, Borrelia burgdorferi B31
DNKKVNSLI

SEQ ID NO: 37394 - protein, 9 aa, Borrelia burgdorferi B31
NKKVNSLIK

SEQ ID NO: 37395 - protein, 9 aa, Borrelia burgdorferi B31
KKVNSLIKA

SEQ ID NO: 37396 - protein, 9 aa, Borrelia burgdorferi B31
KVNSLIKAL

SEQ ID NO: 37397 - protein, 9 aa, Borrelia burgdorferi B31
VNSLIKALD

SEQ ID NO: 37398 - protein, 9 aa, Borrelia burgdorferi B31
NSLIKALDE

SEQ ID NO: 37399 - protein, 9 aa, Borrelia burgdorferi B31
SLIKALDEL

SEQ ID NO: 37400 - protein, 9 aa, Borrelia burgdorferi B31
LIKALDELQ

SEQ ID NO: 37401 - protein, 9 aa, Borrelia burgdorferi B31
IKALDELQK

SEQ ID NO: 37402 - protein, 9 aa, Borrelia burgdorferi B31
KALDELQKN

SEQ ID NO: 37403 - protein, 9 aa, Borrelia burgdorferi B31
ALDELQKNK

SEQ ID NO: 37404 - protein, 9 aa, Borrelia burgdorferi B31
LDELQKNKL

SEQ ID NO: 37405 - protein, 9 aa, Borrelia burgdorferi B31
DELQKNKLV

SEQ ID NO: 37406 - protein, 9 aa, Borrelia burgdorferi B31
ELQKNKLVS

SEQ ID NO: 37407 - protein, 9 aa, Borrelia burgdorferi B31
LQKNKLVSR

SEQ ID NO: 37408 - protein, 9 aa, Borrelia burgdorferi B31
QKNKLVSRD

SEQ ID NO: 37409 - protein, 9 aa, Borrelia burgdorferi B31
KNKLVSRDQ

SEQ ID NO: 37410 - protein, 9 aa, Borrelia burgdorferi B31
NKLVSRDQK

SEQ ID NO: 37411 - protein, 9 aa, Borrelia burgdorferi B31
KLVSRDQKK

SEQ ID NO: 37412 - protein, 9 aa, Borrelia burgdorferi B31
LVSRDQKKH

SEQ ID NO: 37413 - protein, 9 aa, Borrelia burgdorferi B31
VSRDQKKHK

SEQ ID NO: 37414 - protein, 9 aa, Borrelia burgdorferi B31
SRDQKKHKE

SEQ ID NO: 37415 - protein, 9 aa, Borrelia burgdorferi B31
RDQKKHKEL

SEQ ID NO: 37416 - protein, 9 aa, Borrelia burgdorferi B31
DQKKHKELG

SEQ ID NO: 37417 - protein, 9 aa, Borrelia burgdorferi B31
QKKHKELGI

SEQ ID NO: 37418 - protein, 9 aa, Borrelia burgdorferi B31
KKHKELGIG

SEQ ID NO: 37419 - protein, 9 aa, Borrelia burgdorferi B31
KHKELGIGE

SEQ ID NO: 37420 - protein, 9 aa, Borrelia burgdorferi B31
HKELGIGEN

SEQ ID NO: 37421 - protein, 9 aa, Borrelia burgdorferi B31
KELGIGENP

SEQ ID NO: 37422 - protein, 9 aa, Borrelia burgdorferi B31
ELGIGENPS

SEQ ID NO: 37423 - protein, 9 aa, Borrelia burgdorferi B31
LGIGENPSF

SEQ ID NO: 37424 - protein, 9 aa, Borrelia burgdorferi B31
GIGENPSFK

SEQ ID NO: 37425 - protein, 9 aa, Borrelia burgdorferi B31
IGENPSFKL

SEQ ID NO: 37426 - protein, 9 aa, Borrelia burgdorferi B31
GENPSFKLF

SEQ ID NO: 37427 - protein, 9 aa, Borrelia burgdorferi B31
ENPSFKLFD

SEQ ID NO: 37428 - protein, 9 aa, Borrelia burgdorferi B31
NPSFKLFDN

SEQ ID NO: 37429 - protein, 9 aa, Borrelia burgdorferi B31
PSFKLFDNN

SEQ ID NO: 37430 - protein, 9 aa, Borrelia burgdorferi B31
SFKLFDNNN

SEQ ID NO: 37431 - protein, 9 aa, Borrelia burgdorferi B31
FKLFDNNNK

SEQ ID NO: 37432 - protein, 9 aa, Borrelia burgdorferi B31
KLFDNNNKL

SEQ ID NO: 37433 - protein, 9 aa, Borrelia burgdorferi B31
LFDNNNKLL

SEQ ID NO: 37434 - protein, 9 aa, Borrelia burgdorferi B31
FDNNNKLLT

SEQ ID NO: 37435 - protein, 9 aa, Borrelia burgdorferi B31
DNNNKLLTE

SEQ ID NO: 37436 - protein, 9 aa, Borrelia burgdorferi B31
NNNKLLTEI

SEQ ID NO: 37437 - protein, 9 aa, Borrelia burgdorferi B31
NNKLLTEIF

SEQ ID NO: 37438 - protein, 9 aa, Borrelia burgdorferi B31
NKLLTEIFV

SEQ ID NO: 37439 - protein, 9 aa, Borrelia burgdorferi B31
KLLTEIFVG

SEQ ID NO: 37440 - protein, 9 aa, Borrelia burgdorferi B31
LLTEIFVGK

SEQ ID NO: 37441 - protein, 9 aa, Borrelia burgdorferi B31
LTEIFVGKS

SEQ ID NO: 37442 - protein, 9 aa, Borrelia burgdorferi B31
TEIFVGKSG

SEQ ID NO: 37443 - protein, 9 aa, Borrelia burgdorferi B31
EIFVGKSGE

SEQ ID NO: 37444 - protein, 9 aa, Borrelia burgdorferi B31
IFVGKSGEG

SEQ ID NO: 37445 - protein, 9 aa, Borrelia burgdorferi B31
FVGKSGEGD

SEQ ID NO: 37446 - protein, 9 aa, Borrelia burgdorferi B31
VGKSGEGDS

SEQ ID NO: 37447 - protein, 9 aa, Borrelia burgdorferi B31
GKSGEGDSR

SEQ ID NO: 37448 - protein, 9 aa, Borrelia burgdorferi B31
KSGEGDSRL

SEQ ID NO: 37449 - protein, 9 aa, Borrelia burgdorferi B31
SGEGDSRLA

SEQ ID NO: 37450 - protein, 9 aa, Borrelia burgdorferi B31
GEGDSRLAY

SEQ ID NO: 37451 - protein, 9 aa, Borrelia burgdorferi B31
EGDSRLAYI

SEQ ID NO: 37452 - protein, 9 aa, Borrelia burgdorferi B31
GDSRLAYIK

SEQ ID NO: 37453 - protein, 9 aa, Borrelia burgdorferi B31
DSRLAYIKG

SEQ ID NO: 37454 - protein, 9 aa, Borrelia burgdorferi B31
SRLAYIKGS

SEQ ID NO: 37455 - protein, 9 aa, Borrelia burgdorferi B31
RLAYIKGSD

SEQ ID NO: 37456 - protein, 9 aa, Borrelia burgdorferi B31
LAYIKGSDE

SEQ ID NO: 37457 - protein, 9 aa, Borrelia burgdorferi B31
AYIKGSDEN

SEQ ID NO: 37458 - protein, 9 aa, Borrelia burgdorferi B31
YIKGSDENV

SEQ ID NO: 37459 - protein, 9 aa, Borrelia burgdorferi B31
IKGSDENVY

SEQ ID NO: 37460 - protein, 9 aa, Borrelia burgdorferi B31
KGSDENVYL

SEQ ID NO: 37461 - protein, 9 aa, Borrelia burgdorferi B31
GSDENVYLT

SEQ ID NO: 37462 - protein, 9 aa, Borrelia burgdorferi B31
SDENVYLTK

SEQ ID NO: 37463 - protein, 9 aa, Borrelia burgdorferi B31
DENVYLTKN

SEQ ID NO: 37464 - protein, 9 aa, Borrelia burgdorferi B31
ENVYLTKNI

SEQ ID NO: 37465 - protein, 9 aa, Borrelia burgdorferi B31
NVYLTKNIF

SEQ ID NO: 37466 - protein, 9 aa, Borrelia burgdorferi B31
VYLTKNIFL

SEQ ID NO: 37467 - protein, 9 aa, Borrelia burgdorferi B31
YLTKNIFLS

SEQ ID NO: 37468 - protein, 9 aa, Borrelia burgdorferi B31
LTKNIFLSY

SEQ ID NO: 37469 - protein, 9 aa, Borrelia burgdorferi B31
TKNIFLSYK

SEQ ID NO: 37470 - protein, 9 aa, Borrelia burgdorferi B31
KNIFLSYKG

SEQ ID NO: 37471 - protein, 9 aa, Borrelia burgdorferi B31
NIFLSYKGN

SEQ ID NO: 37472 - protein, 9 aa, Borrelia burgdorferi B31
IFLSYKGNS

SEQ ID NO: 37473 - protein, 9 aa, Borrelia burgdorferi B31
FLSYKGNSY

SEQ ID NO: 37474 - protein, 9 aa, Borrelia burgdorferi B31
LSYKGNSYN

SEQ ID NO: 37475 - protein, 9 aa, Borrelia burgdorferi B31
SYKGNSYNT

SEQ ID NO: 37476 - protein, 9 aa, Borrelia burgdorferi B31
YKGNSYNTF

SEQ ID NO: 37477 - protein, 9 aa, Borrelia burgdorferi B31
KGNSYNTFS

SEQ ID NO: 37478 - protein, 9 aa, Borrelia burgdorferi B31
GNSYNTFSD

SEQ ID NO: 37479 - protein, 9 aa, Borrelia burgdorferi B31
NSYNTFSDT

SEQ ID NO: 37480 - protein, 9 aa, Borrelia burgdorferi B31
SYNTFSDTT

SEQ ID NO: 37481 - protein, 9 aa, Borrelia burgdorferi B31
YNTFSDTTL

SEQ ID NO: 37482 - protein, 9 aa, Borrelia burgdorferi B31
NTFSDTTLF

SEQ ID NO: 37483 - protein, 9 aa, Borrelia burgdorferi B31
TFSDTTLFQ

SEQ ID NO: 37484 - protein, 9 aa, Borrelia burgdorferi B31
FSDTTLFQE

SEQ ID NO: 37485 - protein, 9 aa, Borrelia burgdorferi B31
SDTTLFQEK

SEQ ID NO: 37486 - protein, 9 aa, Borrelia burgdorferi B31
DTTLFQEKN

SEQ ID NO: 37487 - protein, 9 aa, Borrelia burgdorferi B31
TTLFQEKNT

SEQ ID NO: 37488 - protein, 9 aa, Borrelia burgdorferi B31
TLFQEKNTK

SEQ ID NO: 37489 - protein, 9 aa, Borrelia burgdorferi B31
LFQEKNTKL

SEQ ID NO: 37490 - protein, 9 aa, Borrelia burgdorferi B31
FQEKNTKLE

SEQ ID NO: 37491 - protein, 9 aa, Borrelia burgdorferi B31
QEKNTKLEN

SEQ ID NO: 37492 - protein, 9 aa, Borrelia burgdorferi B31
EKNTKLENL

SEQ ID NO: 37493 - protein, 9 aa, Borrelia burgdorferi B31
KNTKLENLS

SEQ ID NO: 37494 - protein, 9 aa, Borrelia burgdorferi B31
NTKLENLSF

SEQ ID NO: 37495 - protein, 9 aa, Borrelia burgdorferi B31
TKLENLSFK

SEQ ID NO: 37496 - protein, 9 aa, Borrelia burgdorferi B31
KLENLSFKI

SEQ ID NO: 37497 - protein, 9 aa, Borrelia burgdorferi B31
LENLSFKII

SEQ ID NO: 37498 - protein, 9 aa, Borrelia burgdorferi B31
ENLSFKIIR

SEQ ID NO: 37499 - protein, 9 aa, Borrelia burgdorferi B31
NLSFKIIRK

SEQ ID NO: 37500 - protein, 9 aa, Borrelia burgdorferi B31
LSFKIIRKL

SEQ ID NO: 37501 - protein, 9 aa, Borrelia burgdorferi B31
SFKIIRKLN

SEQ ID NO: 37502 - protein, 9 aa, Borrelia burgdorferi B31
FKIIRKLNK

SEQ ID NO: 37503 - protein, 9 aa, Borrelia burgdorferi B31
KIIRKLNKE

SEQ ID NO: 37504 - protein, 9 aa, Borrelia burgdorferi B31
IIRKLNKEN

SEQ ID NO: 37505 - protein, 9 aa, Borrelia burgdorferi B31
IRKLNKENE

SEQ ID NO: 37506 - protein, 9 aa, Borrelia burgdorferi B31
RKLNKENEN

SEQ ID NO: 37507 - protein, 9 aa, Borrelia burgdorferi B31
KLNKENENN

SEQ ID NO: 37508 - protein, 9 aa, Borrelia burgdorferi B31
LNKENENNI

SEQ ID NO: 37509 - protein, 9 aa, Borrelia burgdorferi B31
NKENENNIN

SEQ ID NO: 37510 - protein, 9 aa, Borrelia burgdorferi B31
KENENNINN

SEQ ID NO: 37511 - protein, 9 aa, Borrelia burgdorferi B31
ENENNINNN

SEQ ID NO: 37512 - protein, 9 aa, Borrelia burgdorferi B31
NENNINNNY

SEQ ID NO: 37513 - protein, 9 aa, Borrelia burgdorferi B31
ENNINNNYE

SEQ ID NO: 37514 - protein, 9 aa, Borrelia burgdorferi B31
NNINNNYEI

SEQ ID NO: 37515 - protein, 9 aa, Borrelia burgdorferi B31
NINNNYEII

SEQ ID NO: 37516 - protein, 9 aa, Borrelia burgdorferi B31
INNNYEIIS

SEQ ID NO: 37517 - protein, 9 aa, Borrelia burgdorferi B31
NNNYEIISK

SEQ ID NO: 37518 - protein, 9 aa, Borrelia burgdorferi B31
NNYEIISKD

SEQ ID NO: 37519 - protein, 9 aa, Borrelia burgdorferi B31
NYEIISKDG

SEQ ID NO: 37520 - protein, 9 aa, Borrelia burgdorferi B31
YEIISKDGL

SEQ ID NO: 37521 - protein, 9 aa, Borrelia burgdorferi B31
EIISKDGLY

SEQ ID NO: 37522 - protein, 9 aa, Borrelia burgdorferi B31
IISKDGLYF

SEQ ID NO: 37523 - protein, 9 aa, Borrelia burgdorferi B31
ISKDGLYFL

SEQ ID NO: 37524 - protein, 9 aa, Borrelia burgdorferi B31
SKDGLYFLN

SEQ ID NO: 37525 - protein, 9 aa, Borrelia burgdorferi B31
KDGLYFLNN

SEQ ID NO: 37526 - protein, 9 aa, Borrelia burgdorferi B31
DGLYFLNNQ

SEQ ID NO: 37527 - protein, 9 aa, Borrelia burgdorferi B31
GLYFLNNQK

SEQ ID NO: 37528 - protein, 9 aa, Borrelia burgdorferi B31
LYFLNNQKM

SEQ ID NO: 37529 - protein, 9 aa, Borrelia burgdorferi B31
YFLNNQKMT

SEQ ID NO: 37530 - protein, 9 aa, Borrelia burgdorferi B31
FLNNQKMTK

SEQ ID NO: 37531 - protein, 9 aa, Borrelia burgdorferi B31
LNNQKMTKE

SEQ ID NO: 37532 - protein, 9 aa, Borrelia burgdorferi B31
NNQKMTKER

SEQ ID NO: 37533 - protein, 9 aa, Borrelia burgdorferi B31
NQKMTKERP

SEQ ID NO: 37534 - protein, 9 aa, Borrelia burgdorferi B31
QKMTKERPL

SEQ ID NO: 37535 - protein, 9 aa, Borrelia burgdorferi B31
KMTKERPLN

SEQ ID NO: 37536 - protein, 9 aa, Borrelia burgdorferi B31
MTKERPLNI

SEQ ID NO: 37537 - protein, 9 aa, Borrelia burgdorferi B31
TKERPLNII

SEQ ID NO: 37538 - protein, 9 aa, Borrelia burgdorferi B31
KERPLNIIA

SEQ ID NO: 37539 - protein, 9 aa, Borrelia burgdorferi B31
ERPLNIIAE

SEQ ID NO: 37540 - protein, 9 aa, Borrelia burgdorferi B31
RPLNIIAEF

SEQ ID NO: 37541 - protein, 9 aa, Borrelia burgdorferi B31
PLNIIAEFK

SEQ ID NO: 37542 - protein, 9 aa, Borrelia burgdorferi B31
LNIIAEFKA

SEQ ID NO: 37543 - protein, 9 aa, Borrelia burgdorferi B31
NIIAEFKAD

SEQ ID NO: 37544 - protein, 9 aa, Borrelia burgdorferi B31
IIAEFKADG

SEQ ID NO: 37545 - protein, 9 aa, Borrelia burgdorferi B31
IAEFKADGL

SEQ ID NO: 37546 - protein, 9 aa, Borrelia burgdorferi B31
AEFKADGLE

SEQ ID NO: 37547 - protein, 9 aa, Borrelia burgdorferi B31
EFKADGLEI

SEQ ID NO: 37548 - protein, 9 aa, Borrelia burgdorferi B31
FKADGLEID

SEQ ID NO: 37549 - protein, 9 aa, Borrelia burgdorferi B31
KADGLEIDK

SEQ ID NO: 37550 - protein, 9 aa, Borrelia burgdorferi B31
ADGLEIDKS

SEQ ID NO: 37551 - protein, 9 aa, Borrelia burgdorferi B31
DGLEIDKSK

SEQ ID NO: 37552 - protein, 9 aa, Borrelia burgdorferi B31
GLEIDKSKI

SEQ ID NO: 37553 - protein, 9 aa, Borrelia burgdorferi B31
LEIDKSKID

SEQ ID NO: 37554 - protein, 9 aa, Borrelia burgdorferi B31
EIDKSKIDD

SEQ ID NO: 37555 - protein, 9 aa, Borrelia burgdorferi B31
IDKSKIDDY

SEQ ID NO: 37556 - protein, 9 aa, Borrelia burgdorferi B31
DKSKIDDYN

SEQ ID NO: 37557 - protein, 9 aa, Borrelia burgdorferi B31
KSKIDDYNL

SEQ ID NO: 37558 - protein, 9 aa, Borrelia burgdorferi B31
SKIDDYNLQ

SEQ ID NO: 37559 - protein, 9 aa, Borrelia burgdorferi B31
KIDDYNLQY

SEQ ID NO: 37560 - protein, 9 aa, Borrelia burgdorferi B31
IDDYNLQYK

SEQ ID NO: 37561 - protein, 9 aa, Borrelia burgdorferi B31
DDYNLQYKI

SEQ ID NO: 37562 - protein, 9 aa, Borrelia burgdorferi B31
DYNLQYKIE

SEQ ID NO: 37563 - protein, 9 aa, Borrelia burgdorferi B31
YNLQYKIEV

SEQ ID NO: 37564 - protein, 9 aa, Borrelia burgdorferi B31
NLQYKIEVK

SEQ ID NO: 37565 - protein, 9 aa, Borrelia burgdorferi B31
LQYKIEVKW

SEQ ID NO: 37566 - protein, 9 aa, Borrelia burgdorferi B31
QYKIEVKWS

SEQ ID NO: 37567 - protein, 9 aa, Borrelia burgdorferi B31
YKIEVKWSN

SEQ ID NO: 37568 - protein, 9 aa, Borrelia burgdorferi B31
KIEVKWSNK

SEQ ID NO: 37569 - protein, 9 aa, Borrelia burgdorferi B31
IEVKWSNKS

SEQ ID NO: 37570 - protein, 9 aa, Borrelia burgdorferi B31
EVKWSNKSV

SEQ ID NO: 37571 - protein, 9 aa, Borrelia burgdorferi B31
VKWSNKSVN

SEQ ID NO: 37572 - protein, 9 aa, Borrelia burgdorferi B31
KWSNKSVNN

SEQ ID NO: 37573 - protein, 9 aa, Borrelia burgdorferi B31
WSNKSVNNI

SEQ ID NO: 37574 - protein, 9 aa, Borrelia burgdorferi B31
SNKSVNNIE

SEQ ID NO: 37575 - protein, 9 aa, Borrelia burgdorferi B31
NKSVNNIEV

SEQ ID NO: 37576 - protein, 9 aa, Borrelia burgdorferi B31
KSVNNIEVY

SEQ ID NO: 37577 - protein, 9 aa, Borrelia burgdorferi B31
SVNNIEVYF

SEQ ID NO: 37578 - protein, 9 aa, Borrelia burgdorferi B31
VNNIEVYFN

SEQ ID NO: 37579 - protein, 9 aa, Borrelia burgdorferi B31
NNIEVYFNK

SEQ ID NO: 37580 - protein, 9 aa, Borrelia burgdorferi B31
NIEVYFNKN

SEQ ID NO: 37581 - protein, 9 aa, Borrelia burgdorferi B31
IEVYFNKNE

SEQ ID NO: 37582 - protein, 9 aa, Borrelia burgdorferi B31
EVYFNKNEE

SEQ ID NO: 37583 - protein, 9 aa, Borrelia burgdorferi B31
VYFNKNEEN

SEQ ID NO: 37584 - protein, 9 aa, Borrelia burgdorferi B31
YFNKNEEND

SEQ ID NO: 37585 - protein, 9 aa, Borrelia burgdorferi B31
FNKNEENDK

SEQ ID NO: 37586 - protein, 9 aa, Borrelia burgdorferi B31
NKNEENDKD

SEQ ID NO: 37587 - protein, 9 aa, Borrelia burgdorferi B31
KNEENDKDI

SEQ ID NO: 37588 - protein, 9 aa, Borrelia burgdorferi B31
NEENDKDIL

SEQ ID NO: 37589 - protein, 9 aa, Borrelia burgdorferi B31
EENDKDILI

SEQ ID NO: 37590 - protein, 9 aa, Borrelia burgdorferi B31
ENDKDILIK

SEQ ID NO: 37591 - protein, 9 aa, Borrelia burgdorferi B31
NDKDILIKK

SEQ ID NO: 37592 - protein, 9 aa, Borrelia burgdorferi B31
DKDILIKKD

SEQ ID NO: 37593 - protein, 9 aa, Borrelia burgdorferi B31
KDILIKKDK

SEQ ID NO: 37594 - protein, 9 aa, Borrelia burgdorferi B31
DILIKKDKD

SEQ ID NO: 37595 - protein, 9 aa, Borrelia burgdorferi B31
ILIKKDKDE

SEQ ID NO: 37596 - protein, 9 aa, Borrelia burgdorferi B31
LIKKDKDEY

SEQ ID NO: 37597 - protein, 9 aa, Borrelia burgdorferi B31
IKKDKDEYY

SEQ ID NO: 37598 - protein, 9 aa, Borrelia burgdorferi B31
KKDKDEYYY

SEQ ID NO: 37599 - protein, 9 aa, Borrelia burgdorferi B31
KDKDEYYYT

SEQ ID NO: 37600 - protein, 9 aa, Borrelia burgdorferi B31
DKDEYYYTT

SEQ ID NO: 37601 - protein, 9 aa, Borrelia burgdorferi B31
KDEYYYTTS

SEQ ID NO: 37602 - protein, 9 aa, Borrelia burgdorferi B31
DEYYYTTSK

SEQ ID NO: 37603 - protein, 9 aa, Borrelia burgdorferi B31
EYYYTTSKW

SEQ ID NO: 37604 - protein, 9 aa, Borrelia burgdorferi B31
YYYTTSKWT

SEQ ID NO: 37605 - protein, 9 aa, Borrelia burgdorferi B31
YYTTSKWTF

SEQ ID NO: 37606 - protein, 9 aa, Borrelia burgdorferi B31
YTTSKWTFF

SEQ ID NO: 37607 - protein, 9 aa, Borrelia burgdorferi B31
TTSKWTFFD

SEQ ID NO: 37608 - protein, 9 aa, Borrelia burgdorferi B31
TSKWTFFDV

SEQ ID NO: 37609 - protein, 9 aa, Borrelia burgdorferi B31
SKWTFFDVF

SEQ ID NO: 37610 - protein, 9 aa, Borrelia burgdorferi B31
KWTFFDVFD

SEQ ID NO: 37611 - protein, 9 aa, Borrelia burgdorferi B31
WTFFDVFDL

SEQ ID NO: 37612 - protein, 9 aa, Borrelia burgdorferi B31
TFFDVFDLE

SEQ ID NO: 37613 - protein, 9 aa, Borrelia burgdorferi B31
FFDVFDLEK

SEQ ID NO: 37614 - protein, 9 aa, Borrelia burgdorferi B31
FDVFDLEKK

SEQ ID NO: 37615 - protein, 9 aa, Borrelia burgdorferi B31
DVFDLEKKL

SEQ ID NO: 37616 - protein, 9 aa, Borrelia burgdorferi B31
VFDLEKKLT

SEQ ID NO: 37617 - protein, 9 aa, Borrelia burgdorferi B31
FDLEKKLTE

SEQ ID NO: 37618 - protein, 9 aa, Borrelia burgdorferi B31
DLEKKLTEK

SEQ ID NO: 37619 - protein, 9 aa, Borrelia burgdorferi B31
LEKKLTEKD

SEQ ID NO: 37620 - protein, 9 aa, Borrelia burgdorferi B31
EKKLTEKDD

SEQ ID NO: 37621 - protein, 9 aa, Borrelia burgdorferi B31
KKLTEKDDI

SEQ ID NO: 37622 - protein, 9 aa, Borrelia burgdorferi B31
KLTEKDDIS

SEQ ID NO: 37623 - protein, 9 aa, Borrelia burgdorferi B31
LTEKDDISS

SEQ ID NO: 37624 - protein, 9 aa, Borrelia burgdorferi B31
TEKDDISSN

SEQ ID NO: 37625 - protein, 9 aa, Borrelia burgdorferi B31
EKDDISSND

SEQ ID NO: 37626 - protein, 9 aa, Borrelia burgdorferi B31
KDDISSNDN

SEQ ID NO: 37627 - protein, 9 aa, Borrelia burgdorferi B31
DDISSNDNQ

SEQ ID NO: 37628 - protein, 9 aa, Borrelia burgdorferi B31
DISSNDNQE

SEQ ID NO: 37629 - protein, 9 aa, Borrelia burgdorferi B31
ISSNDNQED

SEQ ID NO: 37630 - protein, 9 aa, Borrelia burgdorferi B31
SSNDNQEDH

SEQ ID NO: 37631 - protein, 9 aa, Borrelia burgdorferi B31
SNDNQEDHH

SEQ ID NO: 37632 - protein, 9 aa, Borrelia burgdorferi B31
NDNQEDHHE

SEQ ID NO: 37633 - protein, 9 aa, Borrelia burgdorferi B31
DNQEDHHEH

SEQ ID NO: 37634 - protein, 9 aa, Borrelia burgdorferi B31
NQEDHHEHH

SEQ ID NO: 37635 - protein, 9 aa, Borrelia burgdorferi B31
QEDHHEHHN

SEQ ID NO: 37636 - protein, 9 aa, Borrelia burgdorferi B31
EDHHEHHNN

SEQ ID NO: 37637 - protein, 9 aa, Borrelia burgdorferi B31
DHHEHHNNA

SEQ ID NO: 37638 - protein, 9 aa, Borrelia burgdorferi B31
HHEHHNNAD

SEQ ID NO: 37639 - protein, 10 aa, Borrelia burgdorferi B31
MDLLDLLEKE

SEQ ID NO: 37640 - protein, 10 aa, Borrelia burgdorferi B31
DLLDLLEKEK

SEQ ID NO: 37641 - protein, 10 aa, Borrelia burgdorferi B31
LLDLLEKEKQ

SEQ ID NO: 37642 - protein, 10 aa, Borrelia burgdorferi B31
LDLLEKEKQI

SEQ ID NO: 37643 - protein, 10 aa, Borrelia burgdorferi B31
DLLEKEKQIN

SEQ ID NO: 37644 - protein, 10 aa, Borrelia burgdorferi B31
LLEKEKQINK

SEQ ID NO: 37645 - protein, 10 aa, Borrelia burgdorferi B31
LEKEKQINKN

SEQ ID NO: 37646 - protein, 10 aa, Borrelia burgdorferi B31
EKEKQINKNK

SEQ ID NO: 37647 - protein, 10 aa, Borrelia burgdorferi B31
KEKQINKNKG

SEQ ID NO: 37648 - protein, 10 aa, Borrelia burgdorferi B31
EKQINKNKGV

SEQ ID NO: 37649 - protein, 10 aa, Borrelia burgdorferi B31
KQINKNKGVF

SEQ ID NO: 37650 - protein, 10 aa, Borrelia burgdorferi B31
QINKNKGVFM

SEQ ID NO: 37651 - protein, 10 aa, Borrelia burgdorferi B31
INKNKGVFMT

SEQ ID NO: 37652 - protein, 10 aa, Borrelia burgdorferi B31
NKNKGVFMTK

SEQ ID NO: 37653 - protein, 10 aa, Borrelia burgdorferi B31
KNKGVFMTKP

SEQ ID NO: 37654 - protein, 10 aa, Borrelia burgdorferi B31
NKGVFMTKPK

SEQ ID NO: 37655 - protein, 10 aa, Borrelia burgdorferi B31
KGVFMTKPKI

SEQ ID NO: 37656 - protein, 10 aa, Borrelia burgdorferi B31
GVFMTKPKIF

SEQ ID NO: 37657 - protein, 10 aa, Borrelia burgdorferi B31
VFMTKPKIFS

SEQ ID NO: 37658 - protein, 10 aa, Borrelia burgdorferi B31
FMTKPKIFSI

SEQ ID NO: 37659 - protein, 10 aa, Borrelia burgdorferi B31
MTKPKIFSIN

SEQ ID NO: 37660 - protein, 10 aa, Borrelia burgdorferi B31
TKPKIFSINK

SEQ ID NO: 37661 - protein, 10 aa, Borrelia burgdorferi B31
KPKIFSINKE

SEQ ID NO: 37662 - protein, 10 aa, Borrelia burgdorferi B31
PKIFSINKEK

SEQ ID NO: 37663 - protein, 10 aa, Borrelia burgdorferi B31
KIFSINKEKI

SEQ ID NO: 37664 - protein, 10 aa, Borrelia burgdorferi B31
IFSINKEKIK

SEQ ID NO: 37665 - protein, 10 aa, Borrelia burgdorferi B31
FSINKEKIKI

SEQ ID NO: 37666 - protein, 10 aa, Borrelia burgdorferi B31
SINKEKIKIL

SEQ ID NO: 37667 - protein, 10 aa, Borrelia burgdorferi B31
INKEKIKILI

SEQ ID NO: 37668 - protein, 10 aa, Borrelia burgdorferi B31
NKEKIKILII

SEQ ID NO: 37669 - protein, 10 aa, Borrelia burgdorferi B31
KEKIKILIIV

SEQ ID NO: 37670 - protein, 10 aa, Borrelia burgdorferi B31
EKIKILIIVV

SEQ ID NO: 37671 - protein, 10 aa, Borrelia burgdorferi B31
KIKILIIVVL

SEQ ID NO: 37672 - protein, 10 aa, Borrelia burgdorferi B31
IKILIIVVLT

SEQ ID NO: 37673 - protein, 10 aa, Borrelia burgdorferi B31
KILIIVVLTS

SEQ ID NO: 37674 - protein, 10 aa, Borrelia burgdorferi B31
ILIIVVLTST

SEQ ID NO: 37675 - protein, 10 aa, Borrelia burgdorferi B31
LIIVVLTSTF

SEQ ID NO: 37676 - protein, 10 aa, Borrelia burgdorferi B31
IIVVLTSTFL

SEQ ID NO: 37677 - protein, 10 aa, Borrelia burgdorferi B31
IVVLTSTFLL

SEQ ID NO: 37678 - protein, 10 aa, Borrelia burgdorferi B31
VVLTSTFLLG

SEQ ID NO: 37679 - protein, 10 aa, Borrelia burgdorferi B31
VLTSTFLLGI

SEQ ID NO: 37680 - protein, 10 aa, Borrelia burgdorferi B31
LTSTFLLGII

SEQ ID NO: 37681 - protein, 10 aa, Borrelia burgdorferi B31
TSTFLLGIIF

SEQ ID NO: 37682 - protein, 10 aa, Borrelia burgdorferi B31
STFLLGIIFS

SEQ ID NO: 37683 - protein, 10 aa, Borrelia burgdorferi B31
TFLLGIIFSN

SEQ ID NO: 37684 - protein, 10 aa, Borrelia burgdorferi B31
FLLGIIFSNE

SEQ ID NO: 37685 - protein, 10 aa, Borrelia burgdorferi B31
LLGIIFSNEN

SEQ ID NO: 37686 - protein, 10 aa, Borrelia burgdorferi B31
LGIIFSNENK

SEQ ID NO: 37687 - protein, 10 aa, Borrelia burgdorferi B31
GIIFSNENKV

SEQ ID NO: 37688 - protein, 10 aa, Borrelia burgdorferi B31
IIFSNENKVA

SEQ ID NO: 37689 - protein, 10 aa, Borrelia burgdorferi B31
IFSNENKVAR

SEQ ID NO: 37690 - protein, 10 aa, Borrelia burgdorferi B31
FSNENKVARI

SEQ ID NO: 37691 - protein, 10 aa, Borrelia burgdorferi B31
SNENKVARIL

SEQ ID NO: 37692 - protein, 10 aa, Borrelia burgdorferi B31
NENKVARILE

SEQ ID NO: 37693 - protein, 10 aa, Borrelia burgdorferi B31
ENKVARILEE

SEQ ID NO: 37694 - protein, 10 aa, Borrelia burgdorferi B31
NKVARILEEK

SEQ ID NO: 37695 - protein, 10 aa, Borrelia burgdorferi B31
KVARILEEKF

SEQ ID NO: 37696 - protein, 10 aa, Borrelia burgdorferi B31
VARILEEKFF

SEQ ID NO: 37697 - protein, 10 aa, Borrelia burgdorferi B31
ARILEEKFFD

SEQ ID NO: 37698 - protein, 10 aa, Borrelia burgdorferi B31
RILEEKFFDF

SEQ ID NO: 37699 - protein, 10 aa, Borrelia burgdorferi B31
ILEEKFFDFD

SEQ ID NO: 37700 - protein, 10 aa, Borrelia burgdorferi B31
LEEKFFDFDF

SEQ ID NO: 37701 - protein, 10 aa, Borrelia burgdorferi B31
EEKFFDFDFN

SEQ ID NO: 37702 - protein, 10 aa, Borrelia burgdorferi B31
EKFFDFDFNL

SEQ ID NO: 37703 - protein, 10 aa, Borrelia burgdorferi B31
KFFDFDFNLI

SEQ ID NO: 37704 - protein, 10 aa, Borrelia burgdorferi B31
FFDFDFNLIS

SEQ ID NO: 37705 - protein, 10 aa, Borrelia burgdorferi B31
FDFDFNLISK

SEQ ID NO: 37706 - protein, 10 aa, Borrelia burgdorferi B31
DFDFNLISKI

SEQ ID NO: 37707 - protein, 10 aa, Borrelia burgdorferi B31
FDFNLISKIE

SEQ ID NO: 37708 - protein, 10 aa, Borrelia burgdorferi B31
DFNLISKIET

SEQ ID NO: 37709 - protein, 10 aa, Borrelia burgdorferi B31
FNLISKIETE

SEQ ID NO: 37710 - protein, 10 aa, Borrelia burgdorferi B31
NLISKIETEL

SEQ ID NO: 37711 - protein, 10 aa, Borrelia burgdorferi B31
LISKIETELE

SEQ ID NO: 37712 - protein, 10 aa, Borrelia burgdorferi B31
ISKIETELEG

SEQ ID NO: 37713 - protein, 10 aa, Borrelia burgdorferi B31
SKIETELEGT

SEQ ID NO: 37714 - protein, 10 aa, Borrelia burgdorferi B31
KIETELEGTL

SEQ ID NO: 37715 - protein, 10 aa, Borrelia burgdorferi B31
IETELEGTLT

SEQ ID NO: 37716 - protein, 10 aa, Borrelia burgdorferi B31
ETELEGTLTK

SEQ ID NO: 37717 - protein, 10 aa, Borrelia burgdorferi B31
TELEGTLTKL

SEQ ID NO: 37718 - protein, 10 aa, Borrelia burgdorferi B31
ELEGTLTKLG

SEQ ID NO: 37719 - protein, 10 aa, Borrelia burgdorferi B31
LEGTLTKLGK

SEQ ID NO: 37720 - protein, 10 aa, Borrelia burgdorferi B31
EGTLTKLGKD

SEQ ID NO: 37721 - protein, 10 aa, Borrelia burgdorferi B31
GTLTKLGKDW

SEQ ID NO: 37722 - protein, 10 aa, Borrelia burgdorferi B31
TLTKLGKDWI

SEQ ID NO: 37723 - protein, 10 aa, Borrelia burgdorferi B31
LTKLGKDWIL

SEQ ID NO: 37724 - protein, 10 aa, Borrelia burgdorferi B31
TKLGKDWILT

SEQ ID NO: 37725 - protein, 10 aa, Borrelia burgdorferi B31
KLGKDWILTY

SEQ ID NO: 37726 - protein, 10 aa, Borrelia burgdorferi B31
LGKDWILTYN

SEQ ID NO: 37727 - protein, 10 aa, Borrelia burgdorferi B31
GKDWILTYNK

SEQ ID NO: 37728 - protein, 10 aa, Borrelia burgdorferi B31
KDWILTYNKQ

SEQ ID NO: 37729 - protein, 10 aa, Borrelia burgdorferi B31
DWILTYNKQN

SEQ ID NO: 37730 - protein, 10 aa, Borrelia burgdorferi B31
WILTYNKQNI

SEQ ID NO: 37731 - protein, 10 aa, Borrelia burgdorferi B31
ILTYNKQNIP

SEQ ID NO: 37732 - protein, 10 aa, Borrelia burgdorferi B31
LTYNKQNIPV

SEQ ID NO: 37733 - protein, 10 aa, Borrelia burgdorferi B31
TYNKQNIPVD

SEQ ID NO: 37734 - protein, 10 aa, Borrelia burgdorferi B31
YNKQNIPVDN

SEQ ID NO: 37735 - protein, 10 aa, Borrelia burgdorferi B31
NKQNIPVDNK

SEQ ID NO: 37736 - protein, 10 aa, Borrelia burgdorferi B31
KQNIPVDNKK

SEQ ID NO: 37737 - protein, 10 aa, Borrelia burgdorferi B31
QNIPVDNKKV

SEQ ID NO: 37738 - protein, 10 aa, Borrelia burgdorferi B31
NIPVDNKKVN

SEQ ID NO: 37739 - protein, 10 aa, Borrelia burgdorferi B31
IPVDNKKVNS

SEQ ID NO: 37740 - protein, 10 aa, Borrelia burgdorferi B31
PVDNKKVNSL

SEQ ID NO: 37741 - protein, 10 aa, Borrelia burgdorferi B31
VDNKKVNSLI

SEQ ID NO: 37742 - protein, 10 aa, Borrelia burgdorferi B31
DNKKVNSLIK

SEQ ID NO: 37743 - protein, 10 aa, Borrelia burgdorferi B31
NKKVNSLIKA

SEQ ID NO: 37744 - protein, 10 aa, Borrelia burgdorferi B31
KKVNSLIKAL

SEQ ID NO: 37745 - protein, 10 aa, Borrelia burgdorferi B31
KVNSLIKALD

SEQ ID NO: 37746 - protein, 10 aa, Borrelia burgdorferi B31
VNSLIKALDE

SEQ ID NO: 37747 - protein, 10 aa, Borrelia burgdorferi B31
NSLIKALDEL

SEQ ID NO: 37748 - protein, 10 aa, Borrelia burgdorferi B31
SLIKALDELQ

SEQ ID NO: 37749 - protein, 10 aa, Borrelia burgdorferi B31
LIKALDELQK

SEQ ID NO: 37750 - protein, 10 aa, Borrelia burgdorferi B31
IKALDELQKN

SEQ ID NO: 37751 - protein, 10 aa, Borrelia burgdorferi B31
KALDELQKNK

SEQ ID NO: 37752 - protein, 10 aa, Borrelia burgdorferi B31
ALDELQKNKL

SEQ ID NO: 37753 - protein, 10 aa, Borrelia burgdorferi B31
LDELQKNKLV

SEQ ID NO: 37754 - protein, 10 aa, Borrelia burgdorferi B31
DELQKNKLVS

SEQ ID NO: 37755 - protein, 10 aa, Borrelia burgdorferi B31
ELQKNKLVSR

SEQ ID NO: 37756 - protein, 10 aa, Borrelia burgdorferi B31
LQKNKLVSRD

SEQ ID NO: 37757 - protein, 10 aa, Borrelia burgdorferi B31
QKNKLVSRDQ

SEQ ID NO: 37758 - protein, 10 aa, Borrelia burgdorferi B31
KNKLVSRDQK

SEQ ID NO: 37759 - protein, 10 aa, Borrelia burgdorferi B31
NKLVSRDQKK

SEQ ID NO: 37760 - protein, 10 aa, Borrelia burgdorferi B31
KLVSRDQKKH

SEQ ID NO: 37761 - protein, 10 aa, Borrelia burgdorferi B31
LVSRDQKKHK

SEQ ID NO: 37762 - protein, 10 aa, Borrelia burgdorferi B31
VSRDQKKHKE

SEQ ID NO: 37763 - protein, 10 aa, Borrelia burgdorferi B31
SRDQKKHKEL

SEQ ID NO: 37764 - protein, 10 aa, Borrelia burgdorferi B31
RDQKKHKELG

SEQ ID NO: 37765 - protein, 10 aa, Borrelia burgdorferi B31
DQKKHKELGI

SEQ ID NO: 37766 - protein, 10 aa, Borrelia burgdorferi B31
QKKHKELGIG

SEQ ID NO: 37767 - protein, 10 aa, Borrelia burgdorferi B31
KKHKELGIGE

SEQ ID NO: 37768 - protein, 10 aa, Borrelia burgdorferi B31
KHKELGIGEN

SEQ ID NO: 37769 - protein, 10 aa, Borrelia burgdorferi B31
HKELGIGENP

SEQ ID NO: 37770 - protein, 10 aa, Borrelia burgdorferi B31
KELGIGENPS

SEQ ID NO: 37771 - protein, 10 aa, Borrelia burgdorferi B31
ELGIGENPSF

SEQ ID NO: 37772 - protein, 10 aa, Borrelia burgdorferi B31
LGIGENPSFK

SEQ ID NO: 37773 - protein, 10 aa, Borrelia burgdorferi B31
GIGENPSFKL

SEQ ID NO: 37774 - protein, 10 aa, Borrelia burgdorferi B31
IGENPSFKLF

SEQ ID NO: 37775 - protein, 10 aa, Borrelia burgdorferi B31
GENPSFKLFD

SEQ ID NO: 37776 - protein, 10 aa, Borrelia burgdorferi B31
ENPSFKLFDN

SEQ ID NO: 37777 - protein, 10 aa, Borrelia burgdorferi B31
NPSFKLFDNN

SEQ ID NO: 37778 - protein, 10 aa, Borrelia burgdorferi B31
PSFKLFDNNN

SEQ ID NO: 37779 - protein, 10 aa, Borrelia burgdorferi B31
SFKLFDNNNK

SEQ ID NO: 37780 - protein, 10 aa, Borrelia burgdorferi B31
FKLFDNNNKL

SEQ ID NO: 37781 - protein, 10 aa, Borrelia burgdorferi B31
KLFDNNNKLL

SEQ ID NO: 37782 - protein, 10 aa, Borrelia burgdorferi B31
LFDNNNKLLT

SEQ ID NO: 37783 - protein, 10 aa, Borrelia burgdorferi B31
FDNNNKLLTE

SEQ ID NO: 37784 - protein, 10 aa, Borrelia burgdorferi B31
DNNNKLLTEI

SEQ ID NO: 37785 - protein, 10 aa, Borrelia burgdorferi B31
NNNKLLTEIF

SEQ ID NO: 37786 - protein, 10 aa, Borrelia burgdorferi B31
NNKLLTEIFV

SEQ ID NO: 37787 - protein, 10 aa, Borrelia burgdorferi B31
NKLLTEIFVG

SEQ ID NO: 37788 - protein, 10 aa, Borrelia burgdorferi B31
KLLTEIFVGK

SEQ ID NO: 37789 - protein, 10 aa, Borrelia burgdorferi B31
LLTEIFVGKS

SEQ ID NO: 37790 - protein, 10 aa, Borrelia burgdorferi B31
LTEIFVGKSG

SEQ ID NO: 37791 - protein, 10 aa, Borrelia burgdorferi B31
TEIFVGKSGE

SEQ ID NO: 37792 - protein, 10 aa, Borrelia burgdorferi B31
EIFVGKSGEG

SEQ ID NO: 37793 - protein, 10 aa, Borrelia burgdorferi B31
IFVGKSGEGD

SEQ ID NO: 37794 - protein, 10 aa, Borrelia burgdorferi B31
FVGKSGEGDS

SEQ ID NO: 37795 - protein, 10 aa, Borrelia burgdorferi B31
VGKSGEGDSR

SEQ ID NO: 37796 - protein, 10 aa, Borrelia burgdorferi B31
GKSGEGDSRL

SEQ ID NO: 37797 - protein, 10 aa, Borrelia burgdorferi B31
KSGEGDSRLA

SEQ ID NO: 37798 - protein, 10 aa, Borrelia burgdorferi B31
SGEGDSRLAY

SEQ ID NO: 37799 - protein, 10 aa, Borrelia burgdorferi B31
GEGDSRLAYI

SEQ ID NO: 37800 - protein, 10 aa, Borrelia burgdorferi B31
EGDSRLAYIK

SEQ ID NO: 37801 - protein, 10 aa, Borrelia burgdorferi B31
GDSRLAYIKG

SEQ ID NO: 37802 - protein, 10 aa, Borrelia burgdorferi B31
DSRLAYIKGS

SEQ ID NO: 37803 - protein, 10 aa, Borrelia burgdorferi B31
SRLAYIKGSD

SEQ ID NO: 37804 - protein, 10 aa, Borrelia burgdorferi B31
RLAYIKGSDE

SEQ ID NO: 37805 - protein, 10 aa, Borrelia burgdorferi B31
LAYIKGSDEN

SEQ ID NO: 37806 - protein, 10 aa, Borrelia burgdorferi B31
AYIKGSDENV

SEQ ID NO: 37807 - protein, 10 aa, Borrelia burgdorferi B31
YIKGSDENVY

SEQ ID NO: 37808 - protein, 10 aa, Borrelia burgdorferi B31
IKGSDENVYL

SEQ ID NO: 37809 - protein, 10 aa, Borrelia burgdorferi B31
KGSDENVYLT

SEQ ID NO: 37810 - protein, 10 aa, Borrelia burgdorferi B31
GSDENVYLTK

SEQ ID NO: 37811 - protein, 10 aa, Borrelia burgdorferi B31
SDENVYLTKN

SEQ ID NO: 37812 - protein, 10 aa, Borrelia burgdorferi B31
DENVYLTKNI

SEQ ID NO: 37813 - protein, 10 aa, Borrelia burgdorferi B31
ENVYLTKNIF

SEQ ID NO: 37814 - protein, 10 aa, Borrelia burgdorferi B31
NVYLTKNIFL

SEQ ID NO: 37815 - protein, 10 aa, Borrelia burgdorferi B31
VYLTKNIFLS

SEQ ID NO: 37816 - protein, 10 aa, Borrelia burgdorferi B31
YLTKNIFLSY

SEQ ID NO: 37817 - protein, 10 aa, Borrelia burgdorferi B31
LTKNIFLSYK

SEQ ID NO: 37818 - protein, 10 aa, Borrelia burgdorferi B31
TKNIFLSYKG

SEQ ID NO: 37819 - protein, 10 aa, Borrelia burgdorferi B31
KNIFLSYKGN

SEQ ID NO: 37820 - protein, 10 aa, Borrelia burgdorferi B31
NIFLSYKGNS

SEQ ID NO: 37821 - protein, 10 aa, Borrelia burgdorferi B31
IFLSYKGNSY

SEQ ID NO: 37822 - protein, 10 aa, Borrelia burgdorferi B31
FLSYKGNSYN

SEQ ID NO: 37823 - protein, 10 aa, Borrelia burgdorferi B31
LSYKGNSYNT

SEQ ID NO: 37824 - protein, 10 aa, Borrelia burgdorferi B31
SYKGNSYNTF

SEQ ID NO: 37825 - protein, 10 aa, Borrelia burgdorferi B31
YKGNSYNTFS

SEQ ID NO: 37826 - protein, 10 aa, Borrelia burgdorferi B31
KGNSYNTFSD

SEQ ID NO: 37827 - protein, 10 aa, Borrelia burgdorferi B31
GNSYNTFSDT

SEQ ID NO: 37828 - protein, 10 aa, Borrelia burgdorferi B31
NSYNTFSDTT

SEQ ID NO: 37829 - protein, 10 aa, Borrelia burgdorferi B31
SYNTFSDTTL

SEQ ID NO: 37830 - protein, 10 aa, Borrelia burgdorferi B31
YNTFSDTTLF

SEQ ID NO: 37831 - protein, 10 aa, Borrelia burgdorferi B31
NTFSDTTLFQ

SEQ ID NO: 37832 - protein, 10 aa, Borrelia burgdorferi B31
TFSDTTLFQE

SEQ ID NO: 37833 - protein, 10 aa, Borrelia burgdorferi B31
FSDTTLFQEK

SEQ ID NO: 37834 - protein, 10 aa, Borrelia burgdorferi B31
SDTTLFQEKN

SEQ ID NO: 37835 - protein, 10 aa, Borrelia burgdorferi B31
DTTLFQEKNT

SEQ ID NO: 37836 - protein, 10 aa, Borrelia burgdorferi B31
TTLFQEKNTK

SEQ ID NO: 37837 - protein, 10 aa, Borrelia burgdorferi B31
TLFQEKNTKL

SEQ ID NO: 37838 - protein, 10 aa, Borrelia burgdorferi B31
LFQEKNTKLE

SEQ ID NO: 37839 - protein, 10 aa, Borrelia burgdorferi B31
FQEKNTKLEN

SEQ ID NO: 37840 - protein, 10 aa, Borrelia burgdorferi B31
QEKNTKLENL

SEQ ID NO: 37841 - protein, 10 aa, Borrelia burgdorferi B31
EKNTKLENLS

SEQ ID NO: 37842 - protein, 10 aa, Borrelia burgdorferi B31
KNTKLENLSF

SEQ ID NO: 37843 - protein, 10 aa, Borrelia burgdorferi B31
NTKLENLSFK

SEQ ID NO: 37844 - protein, 10 aa, Borrelia burgdorferi B31
TKLENLSFKI

SEQ ID NO: 37845 - protein, 10 aa, Borrelia burgdorferi B31
KLENLSFKII

SEQ ID NO: 37846 - protein, 10 aa, Borrelia burgdorferi B31
LENLSFKIIR

SEQ ID NO: 37847 - protein, 10 aa, Borrelia burgdorferi B31
ENLSFKIIRK

SEQ ID NO: 37848 - protein, 10 aa, Borrelia burgdorferi B31
NLSFKIIRKL

SEQ ID NO: 37849 - protein, 10 aa, Borrelia burgdorferi B31
LSFKIIRKLN

SEQ ID NO: 37850 - protein, 10 aa, Borrelia burgdorferi B31
SFKIIRKLNK

SEQ ID NO: 37851 - protein, 10 aa, Borrelia burgdorferi B31
FKIIRKLNKE

SEQ ID NO: 37852 - protein, 10 aa, Borrelia burgdorferi B31
KIIRKLNKEN

SEQ ID NO: 37853 - protein, 10 aa, Borrelia burgdorferi B31
IIRKLNKENE

SEQ ID NO: 37854 - protein, 10 aa, Borrelia burgdorferi B31
IRKLNKENEN

SEQ ID NO: 37855 - protein, 10 aa, Borrelia burgdorferi B31
RKLNKENENN

SEQ ID NO: 37856 - protein, 10 aa, Borrelia burgdorferi B31
KLNKENENNI

SEQ ID NO: 37857 - protein, 10 aa, Borrelia burgdorferi B31
LNKENENNIN

SEQ ID NO: 37858 - protein, 10 aa, Borrelia burgdorferi B31
NKENENNINN

SEQ ID NO: 37859 - protein, 10 aa, Borrelia burgdorferi B31
KENENNINNN

SEQ ID NO: 37860 - protein, 10 aa, Borrelia burgdorferi B31
ENENNINNNY

SEQ ID NO: 37861 - protein, 10 aa, Borrelia burgdorferi B31
NENNINNNYE

SEQ ID NO: 37862 - protein, 10 aa, Borrelia burgdorferi B31
ENNINNNYEI

SEQ ID NO: 37863 - protein, 10 aa, Borrelia burgdorferi B31
NNINNNYEII

SEQ ID NO: 37864 - protein, 10 aa, Borrelia burgdorferi B31
NINNNYEIIS

SEQ ID NO: 37865 - protein, 10 aa, Borrelia burgdorferi B31
INNNYEIISK

SEQ ID NO: 37866 - protein, 10 aa, Borrelia burgdorferi B31
NNNYEIISKD

SEQ ID NO: 37867 - protein, 10 aa, Borrelia burgdorferi B31
NNYEIISKDG

SEQ ID NO: 37868 - protein, 10 aa, Borrelia burgdorferi B31
NYEIISKDGL

SEQ ID NO: 37869 - protein, 10 aa, Borrelia burgdorferi B31
YEIISKDGLY

SEQ ID NO: 37870 - protein, 10 aa, Borrelia burgdorferi B31
EIISKDGLYF

SEQ ID NO: 37871 - protein, 10 aa, Borrelia burgdorferi B31
IISKDGLYFL

SEQ ID NO: 37872 - protein, 10 aa, Borrelia burgdorferi B31
ISKDGLYFLN

SEQ ID NO: 37873 - protein, 10 aa, Borrelia burgdorferi B31
SKDGLYFLNN

SEQ ID NO: 37874 - protein, 10 aa, Borrelia burgdorferi B31
KDGLYFLNNQ

SEQ ID NO: 37875 - protein, 10 aa, Borrelia burgdorferi B31
DGLYFLNNQK

SEQ ID NO: 37876 - protein, 10 aa, Borrelia burgdorferi B31
GLYFLNNQKM

SEQ ID NO: 37877 - protein, 10 aa, Borrelia burgdorferi B31
LYFLNNQKMT

SEQ ID NO: 37878 - protein, 10 aa, Borrelia burgdorferi B31
YFLNNQKMTK

SEQ ID NO: 37879 - protein, 10 aa, Borrelia burgdorferi B31
FLNNQKMTKE

SEQ ID NO: 37880 - protein, 10 aa, Borrelia burgdorferi B31
LNNQKMTKER

SEQ ID NO: 37881 - protein, 10 aa, Borrelia burgdorferi B31
NNQKMTKERP

SEQ ID NO: 37882 - protein, 10 aa, Borrelia burgdorferi B31
NQKMTKERPL

SEQ ID NO: 37883 - protein, 10 aa, Borrelia burgdorferi B31
QKMTKERPLN

SEQ ID NO: 37884 - protein, 10 aa, Borrelia burgdorferi B31
KMTKERPLNI

SEQ ID NO: 37885 - protein, 10 aa, Borrelia burgdorferi B31
MTKERPLNII

SEQ ID NO: 37886 - protein, 10 aa, Borrelia burgdorferi B31
TKERPLNIIA

SEQ ID NO: 37887 - protein, 10 aa, Borrelia burgdorferi B31
KERPLNIIAE

SEQ ID NO: 37888 - protein, 10 aa, Borrelia burgdorferi B31
ERPLNIIAEF

SEQ ID NO: 37889 - protein, 10 aa, Borrelia burgdorferi B31
RPLNIIAEFK

SEQ ID NO: 37890 - protein, 10 aa, Borrelia burgdorferi B31
PLNIIAEFKA

SEQ ID NO: 37891 - protein, 10 aa, Borrelia burgdorferi B31
LNIIAEFKAD

SEQ ID NO: 37892 - protein, 10 aa, Borrelia burgdorferi B31
NIIAEFKADG

SEQ ID NO: 37893 - protein, 10 aa, Borrelia burgdorferi B31
IIAEFKADGL

SEQ ID NO: 37894 - protein, 10 aa, Borrelia burgdorferi B31
IAEFKADGLE

SEQ ID NO: 37895 - protein, 10 aa, Borrelia burgdorferi B31
AEFKADGLEI

SEQ ID NO: 37896 - protein, 10 aa, Borrelia burgdorferi B31
EFKADGLEID

SEQ ID NO: 37897 - protein, 10 aa, Borrelia burgdorferi B31
FKADGLEIDK

SEQ ID NO: 37898 - protein, 10 aa, Borrelia burgdorferi B31
KADGLEIDKS

SEQ ID NO: 37899 - protein, 10 aa, Borrelia burgdorferi B31
ADGLEIDKSK

SEQ ID NO: 37900 - protein, 10 aa, Borrelia burgdorferi B31
DGLEIDKSKI

SEQ ID NO: 37901 - protein, 10 aa, Borrelia burgdorferi B31
GLEIDKSKID

SEQ ID NO: 37902 - protein, 10 aa, Borrelia burgdorferi B31
LEIDKSKIDD

SEQ ID NO: 37903 - protein, 10 aa, Borrelia burgdorferi B31
EIDKSKIDDY

SEQ ID NO: 37904 - protein, 10 aa, Borrelia burgdorferi B31
IDKSKIDDYN

SEQ ID NO: 37905 - protein, 10 aa, Borrelia burgdorferi B31
DKSKIDDYNL

SEQ ID NO: 37906 - protein, 10 aa, Borrelia burgdorferi B31
KSKIDDYNLQ

SEQ ID NO: 37907 - protein, 10 aa, Borrelia burgdorferi B31
SKIDDYNLQY

SEQ ID NO: 37908 - protein, 10 aa, Borrelia burgdorferi B31
KIDDYNLQYK

SEQ ID NO: 37909 - protein, 10 aa, Borrelia burgdorferi B31
IDDYNLQYKI

SEQ ID NO: 37910 - protein, 10 aa, Borrelia burgdorferi B31
DDYNLQYKIE

SEQ ID NO: 37911 - protein, 10 aa, Borrelia burgdorferi B31
DYNLQYKIEV

SEQ ID NO: 37912 - protein, 10 aa, Borrelia burgdorferi B31
YNLQYKIEVK

SEQ ID NO: 37913 - protein, 10 aa, Borrelia burgdorferi B31
NLQYKIEVKW

SEQ ID NO: 37914 - protein, 10 aa, Borrelia burgdorferi B31
LQYKIEVKWS

SEQ ID NO: 37915 - protein, 10 aa, Borrelia burgdorferi B31
QYKIEVKWSN

SEQ ID NO: 37916 - protein, 10 aa, Borrelia burgdorferi B31
YKIEVKWSNK

SEQ ID NO: 37917 - protein, 10 aa, Borrelia burgdorferi B31
KIEVKWSNKS

SEQ ID NO: 37918 - protein, 10 aa, Borrelia burgdorferi B31
IEVKWSNKSV

SEQ ID NO: 37919 - protein, 10 aa, Borrelia burgdorferi B31
EVKWSNKSVN

SEQ ID NO: 37920 - protein, 10 aa, Borrelia burgdorferi B31
VKWSNKSVNN

SEQ ID NO: 37921 - protein, 10 aa, Borrelia burgdorferi B31
KWSNKSVNNI

SEQ ID NO: 37922 - protein, 10 aa, Borrelia burgdorferi B31
WSNKSVNNIE

SEQ ID NO: 37923 - protein, 10 aa, Borrelia burgdorferi B31
SNKSVNNIEV

SEQ ID NO: 37924 - protein, 10 aa, Borrelia burgdorferi B31
NKSVNNIEVY

SEQ ID NO: 37925 - protein, 10 aa, Borrelia burgdorferi B31
KSVNNIEVYF

SEQ ID NO: 37926 - protein, 10 aa, Borrelia burgdorferi B31
SVNNIEVYFN

SEQ ID NO: 37927 - protein, 10 aa, Borrelia burgdorferi B31
VNNIEVYFNK

SEQ ID NO: 37928 - protein, 10 aa, Borrelia burgdorferi B31
NNIEVYFNKN

SEQ ID NO: 37929 - protein, 10 aa, Borrelia burgdorferi B31
NIEVYFNKNE

SEQ ID NO: 37930 - protein, 10 aa, Borrelia burgdorferi B31
IEVYFNKNEE

SEQ ID NO: 37931 - protein, 10 aa, Borrelia burgdorferi B31
EVYFNKNEEN

SEQ ID NO: 37932 - protein, 10 aa, Borrelia burgdorferi B31
VYFNKNEEND

SEQ ID NO: 37933 - protein, 10 aa, Borrelia burgdorferi B31
YFNKNEENDK

SEQ ID NO: 37934 - protein, 10 aa, Borrelia burgdorferi B31
FNKNEENDKD

SEQ ID NO: 37935 - protein, 10 aa, Borrelia burgdorferi B31
NKNEENDKDI

SEQ ID NO: 37936 - protein, 10 aa, Borrelia burgdorferi B31
KNEENDKDIL

SEQ ID NO: 37937 - protein, 10 aa, Borrelia burgdorferi B31
NEENDKDILI

SEQ ID NO: 37938 - protein, 10 aa, Borrelia burgdorferi B31
EENDKDILIK

SEQ ID NO: 37939 - protein, 10 aa, Borrelia burgdorferi B31
ENDKDILIKK

SEQ ID NO: 37940 - protein, 10 aa, Borrelia burgdorferi B31
NDKDILIKKD

SEQ ID NO: 37941 - protein, 10 aa, Borrelia burgdorferi B31
DKDILIKKDK

SEQ ID NO: 37942 - protein, 10 aa, Borrelia burgdorferi B31
KDILIKKDKD

SEQ ID NO: 37943 - protein, 10 aa, Borrelia burgdorferi B31
DILIKKDKDE

SEQ ID NO: 37944 - protein, 10 aa, Borrelia burgdorferi B31
ILIKKDKDEY

SEQ ID NO: 37945 - protein, 10 aa, Borrelia burgdorferi B31
LIKKDKDEYY

SEQ ID NO: 37946 - protein, 10 aa, Borrelia burgdorferi B31
IKKDKDEYYY

SEQ ID NO: 37947 - protein, 10 aa, Borrelia burgdorferi B31
KKDKDEYYYT

SEQ ID NO: 37948 - protein, 10 aa, Borrelia burgdorferi B31
KDKDEYYYTT

SEQ ID NO: 37949 - protein, 10 aa, Borrelia burgdorferi B31
DKDEYYYTTS

SEQ ID NO: 37950 - protein, 10 aa, Borrelia burgdorferi B31
KDEYYYTTSK

SEQ ID NO: 37951 - protein, 10 aa, Borrelia burgdorferi B31
DEYYYTTSKW

SEQ ID NO: 37952 - protein, 10 aa, Borrelia burgdorferi B31
EYYYTTSKWT

SEQ ID NO: 37953 - protein, 10 aa, Borrelia burgdorferi B31
YYYTTSKWTF

SEQ ID NO: 37954 - protein, 10 aa, Borrelia burgdorferi B31
YYTTSKWTFF

SEQ ID NO: 37955 - protein, 10 aa, Borrelia burgdorferi B31
YTTSKWTFFD

SEQ ID NO: 37956 - protein, 10 aa, Borrelia burgdorferi B31
TTSKWTFFDV

SEQ ID NO: 37957 - protein, 10 aa, Borrelia burgdorferi B31
TSKWTFFDVF

SEQ ID NO: 37958 - protein, 10 aa, Borrelia burgdorferi B31
SKWTFFDVFD

SEQ ID NO: 37959 - protein, 10 aa, Borrelia burgdorferi B31
KWTFFDVFDL

SEQ ID NO: 37960 - protein, 10 aa, Borrelia burgdorferi B31
WTFFDVFDLE

SEQ ID NO: 37961 - protein, 10 aa, Borrelia burgdorferi B31
TFFDVFDLEK

SEQ ID NO: 37962 - protein, 10 aa, Borrelia burgdorferi B31
FFDVFDLEKK

SEQ ID NO: 37963 - protein, 10 aa, Borrelia burgdorferi B31
FDVFDLEKKL

SEQ ID NO: 37964 - protein, 10 aa, Borrelia burgdorferi B31
DVFDLEKKLT

SEQ ID NO: 37965 - protein, 10 aa, Borrelia burgdorferi B31
VFDLEKKLTE

SEQ ID NO: 37966 - protein, 10 aa, Borrelia burgdorferi B31
FDLEKKLTEK

SEQ ID NO: 37967 - protein, 10 aa, Borrelia burgdorferi B31
DLEKKLTEKD

SEQ ID NO: 37968 - protein, 10 aa, Borrelia burgdorferi B31
LEKKLTEKDD

SEQ ID NO: 37969 - protein, 10 aa, Borrelia burgdorferi B31
EKKLTEKDDI

SEQ ID NO: 37970 - protein, 10 aa, Borrelia burgdorferi B31
KKLTEKDDIS

SEQ ID NO: 37971 - protein, 10 aa, Borrelia burgdorferi B31
KLTEKDDISS

SEQ ID NO: 37972 - protein, 10 aa, Borrelia burgdorferi B31
LTEKDDISSN

SEQ ID NO: 37973 - protein, 10 aa, Borrelia burgdorferi B31
TEKDDISSND

SEQ ID NO: 37974 - protein, 10 aa, Borrelia burgdorferi B31
EKDDISSNDN

SEQ ID NO: 37975 - protein, 10 aa, Borrelia burgdorferi B31
KDDISSNDNQ

SEQ ID NO: 37976 - protein, 10 aa, Borrelia burgdorferi B31
DDISSNDNQE

SEQ ID NO: 37977 - protein, 10 aa, Borrelia burgdorferi B31
DISSNDNQED

SEQ ID NO: 37978 - protein, 10 aa, Borrelia burgdorferi B31
ISSNDNQEDH

SEQ ID NO: 37979 - protein, 10 aa, Borrelia burgdorferi B31
SSNDNQEDHH

SEQ ID NO: 37980 - protein, 10 aa, Borrelia burgdorferi B31
SNDNQEDHHE

SEQ ID NO: 37981 - protein, 10 aa, Borrelia burgdorferi B31
NDNQEDHHEH

SEQ ID NO: 37982 - protein, 10 aa, Borrelia burgdorferi B31
DNQEDHHEHH

SEQ ID NO: 37983 - protein, 10 aa, Borrelia burgdorferi B31
NQEDHHEHHN

SEQ ID NO: 37984 - protein, 10 aa, Borrelia burgdorferi B31
QEDHHEHHNN

SEQ ID NO: 37985 - protein, 10 aa, Borrelia burgdorferi B31
EDHHEHHNNA

SEQ ID NO: 37986 - protein, 10 aa, Borrelia burgdorferi B31
DHHEHHNNAD

SEQ ID NO: 37987 - protein, 11 aa, Borrelia burgdorferi B31
MDLLDLLEKEK

SEQ ID NO: 37988 - protein, 11 aa, Borrelia burgdorferi B31
DLLDLLEKEKQ

SEQ ID NO: 37989 - protein, 11 aa, Borrelia burgdorferi B31
LLDLLEKEKQI

SEQ ID NO: 37990 - protein, 11 aa, Borrelia burgdorferi B31
LDLLEKEKQIN

SEQ ID NO: 37991 - protein, 11 aa, Borrelia burgdorferi B31
DLLEKEKQINK

SEQ ID NO: 37992 - protein, 11 aa, Borrelia burgdorferi B31
LLEKEKQINKN

SEQ ID NO: 37993 - protein, 11 aa, Borrelia burgdorferi B31
LEKEKQINKNK

SEQ ID NO: 37994 - protein, 11 aa, Borrelia burgdorferi B31
EKEKQINKNKG

SEQ ID NO: 37995 - protein, 11 aa, Borrelia burgdorferi B31
KEKQINKNKGV

SEQ ID NO: 37996 - protein, 11 aa, Borrelia burgdorferi B31
EKQINKNKGVF

SEQ ID NO: 37997 - protein, 11 aa, Borrelia burgdorferi B31
KQINKNKGVFM

SEQ ID NO: 37998 - protein, 11 aa, Borrelia burgdorferi B31
QINKNKGVFMT

SEQ ID NO: 37999 - protein, 11 aa, Borrelia burgdorferi B31
INKNKGVFMTK

SEQ ID NO: 38000 - protein, 11 aa, Borrelia burgdorferi B31
NKNKGVFMTKP

SEQ ID NO: 38001 - protein, 11 aa, Borrelia burgdorferi B31
KNKGVFMTKPK

SEQ ID NO: 38002 - protein, 11 aa, Borrelia burgdorferi B31
NKGVFMTKPKI

SEQ ID NO: 38003 - protein, 11 aa, Borrelia burgdorferi B31
KGVFMTKPKIF

SEQ ID NO: 38004 - protein, 11 aa, Borrelia burgdorferi B31
GVFMTKPKIFS

SEQ ID NO: 38005 - protein, 11 aa, Borrelia burgdorferi B31
VFMTKPKIFSI

SEQ ID NO: 38006 - protein, 11 aa, Borrelia burgdorferi B31
FMTKPKIFSIN

SEQ ID NO: 38007 - protein, 11 aa, Borrelia burgdorferi B31
MTKPKIFSINK

SEQ ID NO: 38008 - protein, 11 aa, Borrelia burgdorferi B31
TKPKIFSINKE

SEQ ID NO: 38009 - protein, 11 aa, Borrelia burgdorferi B31
KPKIFSINKEK

SEQ ID NO: 38010 - protein, 11 aa, Borrelia burgdorferi B31
PKIFSINKEKI

SEQ ID NO: 38011 - protein, 11 aa, Borrelia burgdorferi B31
KIFSINKEKIK

SEQ ID NO: 38012 - protein, 11 aa, Borrelia burgdorferi B31
IFSINKEKIKI

SEQ ID NO: 38013 - protein, 11 aa, Borrelia burgdorferi B31
FSINKEKIKIL

SEQ ID NO: 38014 - protein, 11 aa, Borrelia burgdorferi B31
SINKEKIKILI

SEQ ID NO: 38015 - protein, 11 aa, Borrelia burgdorferi B31
INKEKIKILII

SEQ ID NO: 38016 - protein, 11 aa, Borrelia burgdorferi B31
NKEKIKILIIV

SEQ ID NO: 38017 - protein, 11 aa, Borrelia burgdorferi B31
KEKIKILIIVV

SEQ ID NO: 38018 - protein, 11 aa, Borrelia burgdorferi B31
EKIKILIIVVL

SEQ ID NO: 38019 - protein, 11 aa, Borrelia burgdorferi B31
KIKILIIVVLT

SEQ ID NO: 38020 - protein, 11 aa, Borrelia burgdorferi B31
IKILIIVVLTS

SEQ ID NO: 38021 - protein, 11 aa, Borrelia burgdorferi B31
KILIIVVLTST

SEQ ID NO: 38022 - protein, 11 aa, Borrelia burgdorferi B31
ILIIVVLTSTF

SEQ ID NO: 38023 - protein, 11 aa, Borrelia burgdorferi B31
LIIVVLTSTFL

SEQ ID NO: 38024 - protein, 11 aa, Borrelia burgdorferi B31
IIVVLTSTFLL

SEQ ID NO: 38025 - protein, 11 aa, Borrelia burgdorferi B31
IVVLTSTFLLG

SEQ ID NO: 38026 - protein, 11 aa, Borrelia burgdorferi B31
VVLTSTFLLGI

SEQ ID NO: 38027 - protein, 11 aa, Borrelia burgdorferi B31
VLTSTFLLGII

SEQ ID NO: 38028 - protein, 11 aa, Borrelia burgdorferi B31
LTSTFLLGIIF

SEQ ID NO: 38029 - protein, 11 aa, Borrelia burgdorferi B31
TSTFLLGIIFS

SEQ ID NO: 38030 - protein, 11 aa, Borrelia burgdorferi B31
STFLLGIIFSN

SEQ ID NO: 38031 - protein, 11 aa, Borrelia burgdorferi B31
TFLLGIIFSNE

SEQ ID NO: 38032 - protein, 11 aa, Borrelia burgdorferi B31
FLLGIIFSNEN

SEQ ID NO: 38033 - protein, 11 aa, Borrelia burgdorferi B31
LLGIIFSNENK

SEQ ID NO: 38034 - protein, 11 aa, Borrelia burgdorferi B31
LGIIFSNENKV

SEQ ID NO: 38035 - protein, 11 aa, Borrelia burgdorferi B31
GIIFSNENKVA

SEQ ID NO: 38036 - protein, 11 aa, Borrelia burgdorferi B31
IIFSNENKVAR

SEQ ID NO: 38037 - protein, 11 aa, Borrelia burgdorferi B31
IFSNENKVARI

SEQ ID NO: 38038 - protein, 11 aa, Borrelia burgdorferi B31
FSNENKVARIL

SEQ ID NO: 38039 - protein, 11 aa, Borrelia burgdorferi B31
SNENKVARILE

SEQ ID NO: 38040 - protein, 11 aa, Borrelia burgdorferi B31
NENKVARILEE

SEQ ID NO: 38041 - protein, 11 aa, Borrelia burgdorferi B31
ENKVARILEEK

SEQ ID NO: 38042 - protein, 11 aa, Borrelia burgdorferi B31
NKVARILEEKF

SEQ ID NO: 38043 - protein, 11 aa, Borrelia burgdorferi B31
KVARILEEKFF

SEQ ID NO: 38044 - protein, 11 aa, Borrelia burgdorferi B31
VARILEEKFFD

SEQ ID NO: 38045 - protein, 11 aa, Borrelia burgdorferi B31
ARILEEKFFDF

SEQ ID NO: 38046 - protein, 11 aa, Borrelia burgdorferi B31
RILEEKFFDFD

SEQ ID NO: 38047 - protein, 11 aa, Borrelia burgdorferi B31
ILEEKFFDFDF

SEQ ID NO: 38048 - protein, 11 aa, Borrelia burgdorferi B31
LEEKFFDFDFN

SEQ ID NO: 38049 - protein, 11 aa, Borrelia burgdorferi B31
EEKFFDFDFNL

SEQ ID NO: 38050 - protein, 11 aa, Borrelia burgdorferi B31
EKFFDFDFNLI

SEQ ID NO: 38051 - protein, 11 aa, Borrelia burgdorferi B31
KFFDFDFNLIS

SEQ ID NO: 38052 - protein, 11 aa, Borrelia burgdorferi B31
FFDFDFNLISK

SEQ ID NO: 38053 - protein, 11 aa, Borrelia burgdorferi B31
FDFDFNLISKI

SEQ ID NO: 38054 - protein, 11 aa, Borrelia burgdorferi B31
DFDFNLISKIE

SEQ ID NO: 38055 - protein, 11 aa, Borrelia burgdorferi B31
FDFNLISKIET

SEQ ID NO: 38056 - protein, 11 aa, Borrelia burgdorferi B31
DFNLISKIETE

SEQ ID NO: 38057 - protein, 11 aa, Borrelia burgdorferi B31
FNLISKIETEL

SEQ ID NO: 38058 - protein, 11 aa, Borrelia burgdorferi B31
NLISKIETELE

SEQ ID NO: 38059 - protein, 11 aa, Borrelia burgdorferi B31
LISKIETELEG

SEQ ID NO: 38060 - protein, 11 aa, Borrelia burgdorferi B31
ISKIETELEGT

SEQ ID NO: 38061 - protein, 11 aa, Borrelia burgdorferi B31
SKIETELEGTL

SEQ ID NO: 38062 - protein, 11 aa, Borrelia burgdorferi B31
KIETELEGTLT

SEQ ID NO: 38063 - protein, 11 aa, Borrelia burgdorferi B31
IETELEGTLTK

SEQ ID NO: 38064 - protein, 11 aa, Borrelia burgdorferi B31
ETELEGTLTKL

SEQ ID NO: 38065 - protein, 11 aa, Borrelia burgdorferi B31
TELEGTLTKLG

SEQ ID NO: 38066 - protein, 11 aa, Borrelia burgdorferi B31
ELEGTLTKLGK

SEQ ID NO: 38067 - protein, 11 aa, Borrelia burgdorferi B31
LEGTLTKLGKD

SEQ ID NO: 38068 - protein, 11 aa, Borrelia burgdorferi B31
EGTLTKLGKDW

SEQ ID NO: 38069 - protein, 11 aa, Borrelia burgdorferi B31
GTLTKLGKDWI

SEQ ID NO: 38070 - protein, 11 aa, Borrelia burgdorferi B31
TLTKLGKDWIL

SEQ ID NO: 38071 - protein, 11 aa, Borrelia burgdorferi B31
LTKLGKDWILT

SEQ ID NO: 38072 - protein, 11 aa, Borrelia burgdorferi B31
TKLGKDWILTY

SEQ ID NO: 38073 - protein, 11 aa, Borrelia burgdorferi B31
KLGKDWILTYN

SEQ ID NO: 38074 - protein, 11 aa, Borrelia burgdorferi B31
LGKDWILTYNK

SEQ ID NO: 38075 - protein, 11 aa, Borrelia burgdorferi B31
GKDWILTYNKQ

SEQ ID NO: 38076 - protein, 11 aa, Borrelia burgdorferi B31
KDWILTYNKQN

SEQ ID NO: 38077 - protein, 11 aa, Borrelia burgdorferi B31
DWILTYNKQNI

SEQ ID NO: 38078 - protein, 11 aa, Borrelia burgdorferi B31
WILTYNKQNIP

SEQ ID NO: 38079 - protein, 11 aa, Borrelia burgdorferi B31
ILTYNKQNIPV

SEQ ID NO: 38080 - protein, 11 aa, Borrelia burgdorferi B31
LTYNKQNIPVD

SEQ ID NO: 38081 - protein, 11 aa, Borrelia burgdorferi B31
TYNKQNIPVDN

SEQ ID NO: 38082 - protein, 11 aa, Borrelia burgdorferi B31
YNKQNIPVDNK

SEQ ID NO: 38083 - protein, 11 aa, Borrelia burgdorferi B31
NKQNIPVDNKK

SEQ ID NO: 38084 - protein, 11 aa, Borrelia burgdorferi B31
KQNIPVDNKKV

SEQ ID NO: 38085 - protein, 11 aa, Borrelia burgdorferi B31
QNIPVDNKKVN

SEQ ID NO: 38086 - protein, 11 aa, Borrelia burgdorferi B31
NIPVDNKKVNS

SEQ ID NO: 38087 - protein, 11 aa, Borrelia burgdorferi B31
IPVDNKKVNSL

SEQ ID NO: 38088 - protein, 11 aa, Borrelia burgdorferi B31
PVDNKKVNSLI

SEQ ID NO: 38089 - protein, 11 aa, Borrelia burgdorferi B31
VDNKKVNSLIK

SEQ ID NO: 38090 - protein, 11 aa, Borrelia burgdorferi B31
DNKKVNSLIKA

SEQ ID NO: 38091 - protein, 11 aa, Borrelia burgdorferi B31
NKKVNSLIKAL

SEQ ID NO: 38092 - protein, 11 aa, Borrelia burgdorferi B31
KKVNSLIKALD

SEQ ID NO: 38093 - protein, 11 aa, Borrelia burgdorferi B31
KVNSLIKALDE

SEQ ID NO: 38094 - protein, 11 aa, Borrelia burgdorferi B31
VNSLIKALDEL

SEQ ID NO: 38095 - protein, 11 aa, Borrelia burgdorferi B31
NSLIKALDELQ

SEQ ID NO: 38096 - protein, 11 aa, Borrelia burgdorferi B31
SLIKALDELQK

SEQ ID NO: 38097 - protein, 11 aa, Borrelia burgdorferi B31
LIKALDELQKN

SEQ ID NO: 38098 - protein, 11 aa, Borrelia burgdorferi B31
IKALDELQKNK

SEQ ID NO: 38099 - protein, 11 aa, Borrelia burgdorferi B31
KALDELQKNKL

SEQ ID NO: 38100 - protein, 11 aa, Borrelia burgdorferi B31
ALDELQKNKLV

SEQ ID NO: 38101 - protein, 11 aa, Borrelia burgdorferi B31
LDELQKNKLVS

SEQ ID NO: 38102 - protein, 11 aa, Borrelia burgdorferi B31
DELQKNKLVSR

SEQ ID NO: 38103 - protein, 11 aa, Borrelia burgdorferi B31
ELQKNKLVSRD

SEQ ID NO: 38104 - protein, 11 aa, Borrelia burgdorferi B31
LQKNKLVSRDQ

SEQ ID NO: 38105 - protein, 11 aa, Borrelia burgdorferi B31
QKNKLVSRDQK

SEQ ID NO: 38106 - protein, 11 aa, Borrelia burgdorferi B31
KNKLVSRDQKK

SEQ ID NO: 38107 - protein, 11 aa, Borrelia burgdorferi B31
NKLVSRDQKKH

SEQ ID NO: 38108 - protein, 11 aa, Borrelia burgdorferi B31
KLVSRDQKKHK

SEQ ID NO: 38109 - protein, 11 aa, Borrelia burgdorferi B31
LVSRDQKKHKE

SEQ ID NO: 38110 - protein, 11 aa, Borrelia burgdorferi B31
VSRDQKKHKEL

SEQ ID NO: 38111 - protein, 11 aa, Borrelia burgdorferi B31
SRDQKKHKELG

SEQ ID NO: 38112 - protein, 11 aa, Borrelia burgdorferi B31
RDQKKHKELGI

SEQ ID NO: 38113 - protein, 11 aa, Borrelia burgdorferi B31
DQKKHKELGIG

SEQ ID NO: 38114 - protein, 11 aa, Borrelia burgdorferi B31
QKKHKELGIGE

SEQ ID NO: 38115 - protein, 11 aa, Borrelia burgdorferi B31
KKHKELGIGEN

SEQ ID NO: 38116 - protein, 11 aa, Borrelia burgdorferi B31
KHKELGIGENP

SEQ ID NO: 38117 - protein, 11 aa, Borrelia burgdorferi B31
HKELGIGENPS

SEQ ID NO: 38118 - protein, 11 aa, Borrelia burgdorferi B31
KELGIGENPSF

SEQ ID NO: 38119 - protein, 11 aa, Borrelia burgdorferi B31
ELGIGENPSFK

SEQ ID NO: 38120 - protein, 11 aa, Borrelia burgdorferi B31
LGIGENPSFKL

SEQ ID NO: 38121 - protein, 11 aa, Borrelia burgdorferi B31
GIGENPSFKLF

SEQ ID NO: 38122 - protein, 11 aa, Borrelia burgdorferi B31
IGENPSFKLFD

SEQ ID NO: 38123 - protein, 11 aa, Borrelia burgdorferi B31
GENPSFKLFDN

SEQ ID NO: 38124 - protein, 11 aa, Borrelia burgdorferi B31
ENPSFKLFDNN

SEQ ID NO: 38125 - protein, 11 aa, Borrelia burgdorferi B31
NPSFKLFDNNN

SEQ ID NO: 38126 - protein, 11 aa, Borrelia burgdorferi B31
PSFKLFDNNNK

SEQ ID NO: 38127 - protein, 11 aa, Borrelia burgdorferi B31
SFKLFDNNNKL

SEQ ID NO: 38128 - protein, 11 aa, Borrelia burgdorferi B31
FKLFDNNNKLL

SEQ ID NO: 38129 - protein, 11 aa, Borrelia burgdorferi B31
KLFDNNNKLLT

SEQ ID NO: 38130 - protein, 11 aa, Borrelia burgdorferi B31
LFDNNNKLLTE

SEQ ID NO: 38131 - protein, 11 aa, Borrelia burgdorferi B31
FDNNNKLLTEI

SEQ ID NO: 38132 - protein, 11 aa, Borrelia burgdorferi B31
DNNNKLLTEIF

SEQ ID NO: 38133 - protein, 11 aa, Borrelia burgdorferi B31
NNNKLLTEIFV

SEQ ID NO: 38134 - protein, 11 aa, Borrelia burgdorferi B31
NNKLLTEIFVG

SEQ ID NO: 38135 - protein, 11 aa, Borrelia burgdorferi B31
NKLLTEIFVGK

SEQ ID NO: 38136 - protein, 11 aa, Borrelia burgdorferi B31
KLLTEIFVGKS

SEQ ID NO: 38137 - protein, 11 aa, Borrelia burgdorferi B31
LLTEIFVGKSG

SEQ ID NO: 38138 - protein, 11 aa, Borrelia burgdorferi B31
LTEIFVGKSGE

SEQ ID NO: 38139 - protein, 11 aa, Borrelia burgdorferi B31
TEIFVGKSGEG

SEQ ID NO: 38140 - protein, 11 aa, Borrelia burgdorferi B31
EIFVGKSGEGD

SEQ ID NO: 38141 - protein, 11 aa, Borrelia burgdorferi B31
IFVGKSGEGDS

SEQ ID NO: 38142 - protein, 11 aa, Borrelia burgdorferi B31
FVGKSGEGDSR

SEQ ID NO: 38143 - protein, 11 aa, Borrelia burgdorferi B31
VGKSGEGDSRL

SEQ ID NO: 38144 - protein, 11 aa, Borrelia burgdorferi B31
GKSGEGDSRLA

SEQ ID NO: 38145 - protein, 11 aa, Borrelia burgdorferi B31
KSGEGDSRLAY

SEQ ID NO: 38146 - protein, 11 aa, Borrelia burgdorferi B31
SGEGDSRLAYI

SEQ ID NO: 38147 - protein, 11 aa, Borrelia burgdorferi B31
GEGDSRLAYIK

SEQ ID NO: 38148 - protein, 11 aa, Borrelia burgdorferi B31
EGDSRLAYIKG

SEQ ID NO: 38149 - protein, 11 aa, Borrelia burgdorferi B31
GDSRLAYIKGS

SEQ ID NO: 38150 - protein, 11 aa, Borrelia burgdorferi B31
DSRLAYIKGSD

SEQ ID NO: 38151 - protein, 11 aa, Borrelia burgdorferi B31
SRLAYIKGSDE

SEQ ID NO: 38152 - protein, 11 aa, Borrelia burgdorferi B31
RLAYIKGSDEN

SEQ ID NO: 38153 - protein, 11 aa, Borrelia burgdorferi B31
LAYIKGSDENV

SEQ ID NO: 38154 - protein, 11 aa, Borrelia burgdorferi B31
AYIKGSDENVY

SEQ ID NO: 38155 - protein, 11 aa, Borrelia burgdorferi B31
YIKGSDENVYL

SEQ ID NO: 38156 - protein, 11 aa, Borrelia burgdorferi B31
IKGSDENVYLT

SEQ ID NO: 38157 - protein, 11 aa, Borrelia burgdorferi B31
KGSDENVYLTK

SEQ ID NO: 38158 - protein, 11 aa, Borrelia burgdorferi B31
GSDENVYLTKN

SEQ ID NO: 38159 - protein, 11 aa, Borrelia burgdorferi B31
SDENVYLTKNI

SEQ ID NO: 38160 - protein, 11 aa, Borrelia burgdorferi B31
DENVYLTKNIF

SEQ ID NO: 38161 - protein, 11 aa, Borrelia burgdorferi B31
ENVYLTKNIFL

SEQ ID NO: 38162 - protein, 11 aa, Borrelia burgdorferi B31
NVYLTKNIFLS

SEQ ID NO: 38163 - protein, 11 aa, Borrelia burgdorferi B31
VYLTKNIFLSY

SEQ ID NO: 38164 - protein, 11 aa, Borrelia burgdorferi B31
YLTKNIFLSYK

SEQ ID NO: 38165 - protein, 11 aa, Borrelia burgdorferi B31
LTKNIFLSYKG

SEQ ID NO: 38166 - protein, 11 aa, Borrelia burgdorferi B31
TKNIFLSYKGN

SEQ ID NO: 38167 - protein, 11 aa, Borrelia burgdorferi B31
KNIFLSYKGNS

SEQ ID NO: 38168 - protein, 11 aa, Borrelia burgdorferi B31
NIFLSYKGNSY

SEQ ID NO: 38169 - protein, 11 aa, Borrelia burgdorferi B31
IFLSYKGNSYN

SEQ ID NO: 38170 - protein, 11 aa, Borrelia burgdorferi B31
FLSYKGNSYNT

SEQ ID NO: 38171 - protein, 11 aa, Borrelia burgdorferi B31
LSYKGNSYNTF

SEQ ID NO: 38172 - protein, 11 aa, Borrelia burgdorferi B31
SYKGNSYNTFS

SEQ ID NO: 38173 - protein, 11 aa, Borrelia burgdorferi B31
YKGNSYNTFSD

SEQ ID NO: 38174 - protein, 11 aa, Borrelia burgdorferi B31
KGNSYNTFSDT

SEQ ID NO: 38175 - protein, 11 aa, Borrelia burgdorferi B31
GNSYNTFSDTT

SEQ ID NO: 38176 - protein, 11 aa, Borrelia burgdorferi B31
NSYNTFSDTTL

SEQ ID NO: 38177 - protein, 11 aa, Borrelia burgdorferi B31
SYNTFSDTTLF

SEQ ID NO: 38178 - protein, 11 aa, Borrelia burgdorferi B31
YNTFSDTTLFQ

SEQ ID NO: 38179 - protein, 11 aa, Borrelia burgdorferi B31
NTFSDTTLFQE

SEQ ID NO: 38180 - protein, 11 aa, Borrelia burgdorferi B31
TFSDTTLFQEK

SEQ ID NO: 38181 - protein, 11 aa, Borrelia burgdorferi B31
FSDTTLFQEKN

SEQ ID NO: 38182 - protein, 11 aa, Borrelia burgdorferi B31
SDTTLFQEKNT

SEQ ID NO: 38183 - protein, 11 aa, Borrelia burgdorferi B31
DTTLFQEKNTK

SEQ ID NO: 38184 - protein, 11 aa, Borrelia burgdorferi B31
TTLFQEKNTKL

SEQ ID NO: 38185 - protein, 11 aa, Borrelia burgdorferi B31
TLFQEKNTKLE

SEQ ID NO: 38186 - protein, 11 aa, Borrelia burgdorferi B31
LFQEKNTKLEN

SEQ ID NO: 38187 - protein, 11 aa, Borrelia burgdorferi B31
FQEKNTKLENL

SEQ ID NO: 38188 - protein, 11 aa, Borrelia burgdorferi B31
QEKNTKLENLS

SEQ ID NO: 38189 - protein, 11 aa, Borrelia burgdorferi B31
EKNTKLENLSF

SEQ ID NO: 38190 - protein, 11 aa, Borrelia burgdorferi B31
KNTKLENLSFK

SEQ ID NO: 38191 - protein, 11 aa, Borrelia burgdorferi B31
NTKLENLSFKI

SEQ ID NO: 38192 - protein, 11 aa, Borrelia burgdorferi B31
TKLENLSFKII

SEQ ID NO: 38193 - protein, 11 aa, Borrelia burgdorferi B31
KLENLSFKIIR

SEQ ID NO: 38194 - protein, 11 aa, Borrelia burgdorferi B31
LENLSFKIIRK

SEQ ID NO: 38195 - protein, 11 aa, Borrelia burgdorferi B31
ENLSFKIIRKL

SEQ ID NO: 38196 - protein, 11 aa, Borrelia burgdorferi B31
NLSFKIIRKLN

SEQ ID NO: 38197 - protein, 11 aa, Borrelia burgdorferi B31
LSFKIIRKLNK

SEQ ID NO: 38198 - protein, 11 aa, Borrelia burgdorferi B31
SFKIIRKLNKE

SEQ ID NO: 38199 - protein, 11 aa, Borrelia burgdorferi B31
FKIIRKLNKEN

SEQ ID NO: 38200 - protein, 11 aa, Borrelia burgdorferi B31
KIIRKLNKENE

SEQ ID NO: 38201 - protein, 11 aa, Borrelia burgdorferi B31
IIRKLNKENEN

SEQ ID NO: 38202 - protein, 11 aa, Borrelia burgdorferi B31
IRKLNKENENN

SEQ ID NO: 38203 - protein, 11 aa, Borrelia burgdorferi B31
RKLNKENENNI

SEQ ID NO: 38204 - protein, 11 aa, Borrelia burgdorferi B31
KLNKENENNIN

SEQ ID NO: 38205 - protein, 11 aa, Borrelia burgdorferi B31
LNKENENNINN

SEQ ID NO: 38206 - protein, 11 aa, Borrelia burgdorferi B31
NKENENNINNN

SEQ ID NO: 38207 - protein, 11 aa, Borrelia burgdorferi B31
KENENNINNNY

SEQ ID NO: 38208 - protein, 11 aa, Borrelia burgdorferi B31
ENENNINNNYE

SEQ ID NO: 38209 - protein, 11 aa, Borrelia burgdorferi B31
NENNINNNYEI

SEQ ID NO: 38210 - protein, 11 aa, Borrelia burgdorferi B31
ENNINNNYEII

SEQ ID NO: 38211 - protein, 11 aa, Borrelia burgdorferi B31
NNINNNYEIIS

SEQ ID NO: 38212 - protein, 11 aa, Borrelia burgdorferi B31
NINNNYEIISK

SEQ ID NO: 38213 - protein, 11 aa, Borrelia burgdorferi B31
INNNYEIISKD

SEQ ID NO: 38214 - protein, 11 aa, Borrelia burgdorferi B31
NNNYEIISKDG

SEQ ID NO: 38215 - protein, 11 aa, Borrelia burgdorferi B31
NNYEIISKDGL

SEQ ID NO: 38216 - protein, 11 aa, Borrelia burgdorferi B31
NYEIISKDGLY

SEQ ID NO: 38217 - protein, 11 aa, Borrelia burgdorferi B31
YEIISKDGLYF

SEQ ID NO: 38218 - protein, 11 aa, Borrelia burgdorferi B31
EIISKDGLYFL

SEQ ID NO: 38219 - protein, 11 aa, Borrelia burgdorferi B31
IISKDGLYFLN

SEQ ID NO: 38220 - protein, 11 aa, Borrelia burgdorferi B31
ISKDGLYFLNN

SEQ ID NO: 38221 - protein, 11 aa, Borrelia burgdorferi B31
SKDGLYFLNNQ

SEQ ID NO: 38222 - protein, 11 aa, Borrelia burgdorferi B31
KDGLYFLNNQK

SEQ ID NO: 38223 - protein, 11 aa, Borrelia burgdorferi B31
DGLYFLNNQKM

SEQ ID NO: 38224 - protein, 11 aa, Borrelia burgdorferi B31
GLYFLNNQKMT

SEQ ID NO: 38225 - protein, 11 aa, Borrelia burgdorferi B31
LYFLNNQKMTK

SEQ ID NO: 38226 - protein, 11 aa, Borrelia burgdorferi B31
YFLNNQKMTKE

SEQ ID NO: 38227 - protein, 11 aa, Borrelia burgdorferi B31
FLNNQKMTKER

SEQ ID NO: 38228 - protein, 11 aa, Borrelia burgdorferi B31
LNNQKMTKERP

SEQ ID NO: 38229 - protein, 11 aa, Borrelia burgdorferi B31
NNQKMTKERPL

SEQ ID NO: 38230 - protein, 11 aa, Borrelia burgdorferi B31
NQKMTKERPLN

SEQ ID NO: 38231 - protein, 11 aa, Borrelia burgdorferi B31
QKMTKERPLNI

SEQ ID NO: 38232 - protein, 11 aa, Borrelia burgdorferi B31
KMTKERPLNII

SEQ ID NO: 38233 - protein, 11 aa, Borrelia burgdorferi B31
MTKERPLNIIA

SEQ ID NO: 38234 - protein, 11 aa, Borrelia burgdorferi B31
TKERPLNIIAE

SEQ ID NO: 38235 - protein, 11 aa, Borrelia burgdorferi B31
KERPLNIIAEF

SEQ ID NO: 38236 - protein, 11 aa, Borrelia burgdorferi B31
ERPLNIIAEFK

SEQ ID NO: 38237 - protein, 11 aa, Borrelia burgdorferi B31
RPLNIIAEFKA

SEQ ID NO: 38238 - protein, 11 aa, Borrelia burgdorferi B31
PLNIIAEFKAD

SEQ ID NO: 38239 - protein, 11 aa, Borrelia burgdorferi B31
LNIIAEFKADG

SEQ ID NO: 38240 - protein, 11 aa, Borrelia burgdorferi B31
NIIAEFKADGL

SEQ ID NO: 38241 - protein, 11 aa, Borrelia burgdorferi B31
IIAEFKADGLE

SEQ ID NO: 38242 - protein, 11 aa, Borrelia burgdorferi B31
IAEFKADGLEI

SEQ ID NO: 38243 - protein, 11 aa, Borrelia burgdorferi B31
AEFKADGLEID

SEQ ID NO: 38244 - protein, 11 aa, Borrelia burgdorferi B31
EFKADGLEIDK

SEQ ID NO: 38245 - protein, 11 aa, Borrelia burgdorferi B31
FKADGLEIDKS

SEQ ID NO: 38246 - protein, 11 aa, Borrelia burgdorferi B31
KADGLEIDKSK

SEQ ID NO: 38247 - protein, 11 aa, Borrelia burgdorferi B31
ADGLEIDKSKI

SEQ ID NO: 38248 - protein, 11 aa, Borrelia burgdorferi B31
DGLEIDKSKID

SEQ ID NO: 38249 - protein, 11 aa, Borrelia burgdorferi B31
GLEIDKSKIDD

SEQ ID NO: 38250 - protein, 11 aa, Borrelia burgdorferi B31
LEIDKSKIDDY

SEQ ID NO: 38251 - protein, 11 aa, Borrelia burgdorferi B31
EIDKSKIDDYN

SEQ ID NO: 38252 - protein, 11 aa, Borrelia burgdorferi B31
IDKSKIDDYNL

SEQ ID NO: 38253 - protein, 11 aa, Borrelia burgdorferi B31
DKSKIDDYNLQ

SEQ ID NO: 38254 - protein, 11 aa, Borrelia burgdorferi B31
KSKIDDYNLQY

SEQ ID NO: 38255 - protein, 11 aa, Borrelia burgdorferi B31
SKIDDYNLQYK

SEQ ID NO: 38256 - protein, 11 aa, Borrelia burgdorferi B31
KIDDYNLQYKI

SEQ ID NO: 38257 - protein, 11 aa, Borrelia burgdorferi B31
IDDYNLQYKIE

SEQ ID NO: 38258 - protein, 11 aa, Borrelia burgdorferi B31
DDYNLQYKIEV

SEQ ID NO: 38259 - protein, 11 aa, Borrelia burgdorferi B31
DYNLQYKIEVK

SEQ ID NO: 38260 - protein, 11 aa, Borrelia burgdorferi B31
YNLQYKIEVKW

SEQ ID NO: 38261 - protein, 11 aa, Borrelia burgdorferi B31
NLQYKIEVKWS

SEQ ID NO: 38262 - protein, 11 aa, Borrelia burgdorferi B31
LQYKIEVKWSN

SEQ ID NO: 38263 - protein, 11 aa, Borrelia burgdorferi B31
QYKIEVKWSNK

SEQ ID NO: 38264 - protein, 11 aa, Borrelia burgdorferi B31
YKIEVKWSNKS

SEQ ID NO: 38265 - protein, 11 aa, Borrelia burgdorferi B31
KIEVKWSNKSV

SEQ ID NO: 38266 - protein, 11 aa, Borrelia burgdorferi B31
IEVKWSNKSVN

SEQ ID NO: 38267 - protein, 11 aa, Borrelia burgdorferi B31
EVKWSNKSVNN

SEQ ID NO: 38268 - protein, 11 aa, Borrelia burgdorferi B31
VKWSNKSVNNI

SEQ ID NO: 38269 - protein, 11 aa, Borrelia burgdorferi B31
KWSNKSVNNIE

SEQ ID NO: 38270 - protein, 11 aa, Borrelia burgdorferi B31
WSNKSVNNIEV

SEQ ID NO: 38271 - protein, 11 aa, Borrelia burgdorferi B31
SNKSVNNIEVY

SEQ ID NO: 38272 - protein, 11 aa, Borrelia burgdorferi B31
NKSVNNIEVYF

SEQ ID NO: 38273 - protein, 11 aa, Borrelia burgdorferi B31
KSVNNIEVYFN

SEQ ID NO: 38274 - protein, 11 aa, Borrelia burgdorferi B31
SVNNIEVYFNK

SEQ ID NO: 38275 - protein, 11 aa, Borrelia burgdorferi B31
VNNIEVYFNKN

SEQ ID NO: 38276 - protein, 11 aa, Borrelia burgdorferi B31
NNIEVYFNKNE

SEQ ID NO: 38277 - protein, 11 aa, Borrelia burgdorferi B31
NIEVYFNKNEE

SEQ ID NO: 38278 - protein, 11 aa, Borrelia burgdorferi B31
IEVYFNKNEEN

SEQ ID NO: 38279 - protein, 11 aa, Borrelia burgdorferi B31
EVYFNKNEEND

SEQ ID NO: 38280 - protein, 11 aa, Borrelia burgdorferi B31
VYFNKNEENDK

SEQ ID NO: 38281 - protein, 11 aa, Borrelia burgdorferi B31
YFNKNEENDKD

SEQ ID NO: 38282 - protein, 11 aa, Borrelia burgdorferi B31
FNKNEENDKDI

SEQ ID NO: 38283 - protein, 11 aa, Borrelia burgdorferi B31
NKNEENDKDIL

SEQ ID NO: 38284 - protein, 11 aa, Borrelia burgdorferi B31
KNEENDKDILI

SEQ ID NO: 38285 - protein, 11 aa, Borrelia burgdorferi B31
NEENDKDILIK

SEQ ID NO: 38286 - protein, 11 aa, Borrelia burgdorferi B31
EENDKDILIKK

SEQ ID NO: 38287 - protein, 11 aa, Borrelia burgdorferi B31
ENDKDILIKKD

SEQ ID NO: 38288 - protein, 11 aa, Borrelia burgdorferi B31
NDKDILIKKDK

SEQ ID NO: 38289 - protein, 11 aa, Borrelia burgdorferi B31
DKDILIKKDKD

SEQ ID NO: 38290 - protein, 11 aa, Borrelia burgdorferi B31
KDILIKKDKDE

SEQ ID NO: 38291 - protein, 11 aa, Borrelia burgdorferi B31
DILIKKDKDEY

SEQ ID NO: 38292 - protein, 11 aa, Borrelia burgdorferi B31
ILIKKDKDEYY

SEQ ID NO: 38293 - protein, 11 aa, Borrelia burgdorferi B31
LIKKDKDEYYY

SEQ ID NO: 38294 - protein, 11 aa, Borrelia burgdorferi B31
IKKDKDEYYYT

SEQ ID NO: 38295 - protein, 11 aa, Borrelia burgdorferi B31
KKDKDEYYYTT

SEQ ID NO: 38296 - protein, 11 aa, Borrelia burgdorferi B31
KDKDEYYYTTS

SEQ ID NO: 38297 - protein, 11 aa, Borrelia burgdorferi B31
DKDEYYYTTSK

SEQ ID NO: 38298 - protein, 11 aa, Borrelia burgdorferi B31
KDEYYYTTSKW

SEQ ID NO: 38299 - protein, 11 aa, Borrelia burgdorferi B31
DEYYYTTSKWT

SEQ ID NO: 38300 - protein, 11 aa, Borrelia burgdorferi B31
EYYYTTSKWTF

SEQ ID NO: 38301 - protein, 11 aa, Borrelia burgdorferi B31
YYYTTSKWTFF

SEQ ID NO: 38302 - protein, 11 aa, Borrelia burgdorferi B31
YYTTSKWTFFD

SEQ ID NO: 38303 - protein, 11 aa, Borrelia burgdorferi B31
YTTSKWTFFDV

SEQ ID NO: 38304 - protein, 11 aa, Borrelia burgdorferi B31
TTSKWTFFDVF

SEQ ID NO: 38305 - protein, 11 aa, Borrelia burgdorferi B31
TSKWTFFDVFD

SEQ ID NO: 38306 - protein, 11 aa, Borrelia burgdorferi B31
SKWTFFDVFDL

SEQ ID NO: 38307 - protein, 11 aa, Borrelia burgdorferi B31
KWTFFDVFDLE

SEQ ID NO: 38308 - protein, 11 aa, Borrelia burgdorferi B31
WTFFDVFDLEK

SEQ ID NO: 38309 - protein, 11 aa, Borrelia burgdorferi B31
TFFDVFDLEKK

SEQ ID NO: 38310 - protein, 11 aa, Borrelia burgdorferi B31
FFDVFDLEKKL

SEQ ID NO: 38311 - protein, 11 aa, Borrelia burgdorferi B31
FDVFDLEKKLT

SEQ ID NO: 38312 - protein, 11 aa, Borrelia burgdorferi B31
DVFDLEKKLTE

SEQ ID NO: 38313 - protein, 11 aa, Borrelia burgdorferi B31
VFDLEKKLTEK

SEQ ID NO: 38314 - protein, 11 aa, Borrelia burgdorferi B31
FDLEKKLTEKD

SEQ ID NO: 38315 - protein, 11 aa, Borrelia burgdorferi B31
DLEKKLTEKDD

SEQ ID NO: 38316 - protein, 11 aa, Borrelia burgdorferi B31
LEKKLTEKDDI

SEQ ID NO: 38317 - protein, 11 aa, Borrelia burgdorferi B31
EKKLTEKDDIS

SEQ ID NO: 38318 - protein, 11 aa, Borrelia burgdorferi B31
KKLTEKDDISS

SEQ ID NO: 38319 - protein, 11 aa, Borrelia burgdorferi B31
KLTEKDDISSN

SEQ ID NO: 38320 - protein, 11 aa, Borrelia burgdorferi B31
LTEKDDISSND

SEQ ID NO: 38321 - protein, 11 aa, Borrelia burgdorferi B31
TEKDDISSNDN

SEQ ID NO: 38322 - protein, 11 aa, Borrelia burgdorferi B31
EKDDISSNDNQ

SEQ ID NO: 38323 - protein, 11 aa, Borrelia burgdorferi B31
KDDISSNDNQE

SEQ ID NO: 38324 - protein, 11 aa, Borrelia burgdorferi B31
DDISSNDNQED

SEQ ID NO: 38325 - protein, 11 aa, Borrelia burgdorferi B31
DISSNDNQEDH

SEQ ID NO: 38326 - protein, 11 aa, Borrelia burgdorferi B31
ISSNDNQEDHH

SEQ ID NO: 38327 - protein, 11 aa, Borrelia burgdorferi B31
SSNDNQEDHHE

SEQ ID NO: 38328 - protein, 11 aa, Borrelia burgdorferi B31
SNDNQEDHHEH

SEQ ID NO: 38329 - protein, 11 aa, Borrelia burgdorferi B31
NDNQEDHHEHH

SEQ ID NO: 38330 - protein, 11 aa, Borrelia burgdorferi B31
DNQEDHHEHHN

SEQ ID NO: 38331 - protein, 11 aa, Borrelia burgdorferi B31
NQEDHHEHHNN

SEQ ID NO: 38332 - protein, 11 aa, Borrelia burgdorferi B31
QEDHHEHHNNA

SEQ ID NO: 38333 - protein, 11 aa, Borrelia burgdorferi B31
EDHHEHHNNAD

SEQ ID NO: 38334 - protein, 8 aa, Borrelia burgdorferi B31
MKKLIIIF

SEQ ID NO: 38335 - protein, 8 aa, Borrelia burgdorferi B31
KKLIIIFT

SEQ ID NO: 38336 - protein, 8 aa, Borrelia burgdorferi B31
KLIIIFTL

SEQ ID NO: 38337 - protein, 8 aa, Borrelia burgdorferi B31
LIIIFTLF

SEQ ID NO: 38338 - protein, 8 aa, Borrelia burgdorferi B31
IIIFTLFL

SEQ ID NO: 38339 - protein, 8 aa, Borrelia burgdorferi B31
IIFTLFLS

SEQ ID NO: 38340 - protein, 8 aa, Borrelia burgdorferi B31
IFTLFLSQ

SEQ ID NO: 38341 - protein, 8 aa, Borrelia burgdorferi B31
FTLFLSQA

SEQ ID NO: 38342 - protein, 8 aa, Borrelia burgdorferi B31
TLFLSQAC

SEQ ID NO: 38343 - protein, 8 aa, Borrelia burgdorferi B31
LFLSQACN

SEQ ID NO: 38344 - protein, 8 aa, Borrelia burgdorferi B31
FLSQACNL

SEQ ID NO: 38345 - protein, 8 aa, Borrelia burgdorferi B31
LSQACNLS

SEQ ID NO: 38346 - protein, 8 aa, Borrelia burgdorferi B31
SQACNLST

SEQ ID NO: 38347 - protein, 8 aa, Borrelia burgdorferi B31
QACNLSTM

SEQ ID NO: 38348 - protein, 8 aa, Borrelia burgdorferi B31
ACNLSTMH

SEQ ID NO: 38349 - protein, 8 aa, Borrelia burgdorferi B31
CNLSTMHK

SEQ ID NO: 38350 - protein, 8 aa, Borrelia burgdorferi B31
NLSTMHKI

SEQ ID NO: 38351 - protein, 8 aa, Borrelia burgdorferi B31
LSTMHKID

SEQ ID NO: 38352 - protein, 8 aa, Borrelia burgdorferi B31
STMHKIDT

SEQ ID NO: 38353 - protein, 8 aa, Borrelia burgdorferi B31
TMHKIDTK

SEQ ID NO: 38354 - protein, 8 aa, Borrelia burgdorferi B31
MHKIDTKE

SEQ ID NO: 38355 - protein, 8 aa, Borrelia burgdorferi B31
HKIDTKED

SEQ ID NO: 38356 - protein, 8 aa, Borrelia burgdorferi B31
KIDTKEDM

SEQ ID NO: 38357 - protein, 8 aa, Borrelia burgdorferi B31
IDTKEDMK

SEQ ID NO: 38358 - protein, 8 aa, Borrelia burgdorferi B31
DTKEDMKI

SEQ ID NO: 38359 - protein, 8 aa, Borrelia burgdorferi B31
TKEDMKIL

SEQ ID NO: 38360 - protein, 8 aa, Borrelia burgdorferi B31
KEDMKILY

SEQ ID NO: 38361 - protein, 8 aa, Borrelia burgdorferi B31
EDMKILYS

SEQ ID NO: 38362 - protein, 8 aa, Borrelia burgdorferi B31
DMKILYSE

SEQ ID NO: 38363 - protein, 8 aa, Borrelia burgdorferi B31
MKILYSEI

SEQ ID NO: 38364 - protein, 8 aa, Borrelia burgdorferi B31
KILYSEIA

SEQ ID NO: 38365 - protein, 8 aa, Borrelia burgdorferi B31
ILYSEIAE

SEQ ID NO: 38366 - protein, 8 aa, Borrelia burgdorferi B31
LYSEIAEL

SEQ ID NO: 38367 - protein, 8 aa, Borrelia burgdorferi B31
YSEIAELR

SEQ ID NO: 38368 - protein, 8 aa, Borrelia burgdorferi B31
SEIAELRK

SEQ ID NO: 38369 - protein, 8 aa, Borrelia burgdorferi B31
EIAELRKK

SEQ ID NO: 38370 - protein, 8 aa, Borrelia burgdorferi B31
IAELRKKL

SEQ ID NO: 38371 - protein, 8 aa, Borrelia burgdorferi B31
AELRKKLN

SEQ ID NO: 38372 - protein, 8 aa, Borrelia burgdorferi B31
ELRKKLNL

SEQ ID NO: 38373 - protein, 8 aa, Borrelia burgdorferi B31
LRKKLNLN

SEQ ID NO: 38374 - protein, 8 aa, Borrelia burgdorferi B31
RKKLNLNH

SEQ ID NO: 38375 - protein, 8 aa, Borrelia burgdorferi B31
KKLNLNHL

SEQ ID NO: 38376 - protein, 8 aa, Borrelia burgdorferi B31
KLNLNHLE

SEQ ID NO: 38377 - protein, 8 aa, Borrelia burgdorferi B31
LNLNHLEI

SEQ ID NO: 38378 - protein, 8 aa, Borrelia burgdorferi B31
NLNHLEID

SEQ ID NO: 38379 - protein, 8 aa, Borrelia burgdorferi B31
LNHLEIDD

SEQ ID NO: 38380 - protein, 8 aa, Borrelia burgdorferi B31
NHLEIDDT

SEQ ID NO: 38381 - protein, 8 aa, Borrelia burgdorferi B31
HLEIDDTL

SEQ ID NO: 38382 - protein, 8 aa, Borrelia burgdorferi B31
LEIDDTLE

SEQ ID NO: 38383 - protein, 8 aa, Borrelia burgdorferi B31
EIDDTLEK

SEQ ID NO: 38384 - protein, 8 aa, Borrelia burgdorferi B31
IDDTLEKV

SEQ ID NO: 38385 - protein, 8 aa, Borrelia burgdorferi B31
DDTLEKVA

SEQ ID NO: 38386 - protein, 8 aa, Borrelia burgdorferi B31
DTLEKVAK

SEQ ID NO: 38387 - protein, 8 aa, Borrelia burgdorferi B31
TLEKVAKE

SEQ ID NO: 38388 - protein, 8 aa, Borrelia burgdorferi B31
LEKVAKEY

SEQ ID NO: 38389 - protein, 8 aa, Borrelia burgdorferi B31
EKVAKEYA

SEQ ID NO: 38390 - protein, 8 aa, Borrelia burgdorferi B31
KVAKEYAI

SEQ ID NO: 38391 - protein, 8 aa, Borrelia burgdorferi B31
VAKEYAIK

SEQ ID NO: 38392 - protein, 8 aa, Borrelia burgdorferi B31
AKEYAIKL

SEQ ID NO: 38393 - protein, 8 aa, Borrelia burgdorferi B31
KEYAIKLG

SEQ ID NO: 38394 - protein, 8 aa, Borrelia burgdorferi B31
EYAIKLGE

SEQ ID NO: 38395 - protein, 8 aa, Borrelia burgdorferi B31
YAIKLGEN

SEQ ID NO: 38396 - protein, 8 aa, Borrelia burgdorferi B31
AIKLGENR

SEQ ID NO: 38397 - protein, 8 aa, Borrelia burgdorferi B31
IKLGENRT

SEQ ID NO: 38398 - protein, 8 aa, Borrelia burgdorferi B31
KLGENRTI

SEQ ID NO: 38399 - protein, 8 aa, Borrelia burgdorferi B31
LGENRTIT

SEQ ID NO: 38400 - protein, 8 aa, Borrelia burgdorferi B31
GENRTITH

SEQ ID NO: 38401 - protein, 8 aa, Borrelia burgdorferi B31
ENRTITHT

SEQ ID NO: 38402 - protein, 8 aa, Borrelia burgdorferi B31
NRTITHTL

SEQ ID NO: 38403 - protein, 8 aa, Borrelia burgdorferi B31
RTITHTLF

SEQ ID NO: 38404 - protein, 8 aa, Borrelia burgdorferi B31
TITHTLFG

SEQ ID NO: 38405 - protein, 8 aa, Borrelia burgdorferi B31
ITHTLFGT

SEQ ID NO: 38406 - protein, 8 aa, Borrelia burgdorferi B31
THTLFGTT

SEQ ID NO: 38407 - protein, 8 aa, Borrelia burgdorferi B31
HTLFGTTP

SEQ ID NO: 38408 - protein, 8 aa, Borrelia burgdorferi B31
TLFGTTPM

SEQ ID NO: 38409 - protein, 8 aa, Borrelia burgdorferi B31
LFGTTPMQ

SEQ ID NO: 38410 - protein, 8 aa, Borrelia burgdorferi B31
FGTTPMQR

SEQ ID NO: 38411 - protein, 8 aa, Borrelia burgdorferi B31
GTTPMQRI

SEQ ID NO: 38412 - protein, 8 aa, Borrelia burgdorferi B31
TTPMQRIH

SEQ ID NO: 38413 - protein, 8 aa, Borrelia burgdorferi B31
TPMQRIHK

SEQ ID NO: 38414 - protein, 8 aa, Borrelia burgdorferi B31
PMQRIHKY

SEQ ID NO: 38415 - protein, 8 aa, Borrelia burgdorferi B31
MQRIHKYD

SEQ ID NO: 38416 - protein, 8 aa, Borrelia burgdorferi B31
QRIHKYDQ

SEQ ID NO: 38417 - protein, 8 aa, Borrelia burgdorferi B31
RIHKYDQS

SEQ ID NO: 38418 - protein, 8 aa, Borrelia burgdorferi B31
IHKYDQSF

SEQ ID NO: 38419 - protein, 8 aa, Borrelia burgdorferi B31
HKYDQSFN

SEQ ID NO: 38420 - protein, 8 aa, Borrelia burgdorferi B31
KYDQSFNL

SEQ ID NO: 38421 - protein, 8 aa, Borrelia burgdorferi B31
YDQSFNLT

SEQ ID NO: 38422 - protein, 8 aa, Borrelia burgdorferi B31
DQSFNLTR

SEQ ID NO: 38423 - protein, 8 aa, Borrelia burgdorferi B31
QSFNLTRE

SEQ ID NO: 38424 - protein, 8 aa, Borrelia burgdorferi B31
SFNLTREI

SEQ ID NO: 38425 - protein, 8 aa, Borrelia burgdorferi B31
FNLTREIL

SEQ ID NO: 38426 - protein, 8 aa, Borrelia burgdorferi B31
NLTREILA

SEQ ID NO: 38427 - protein, 8 aa, Borrelia burgdorferi B31
LTREILAS

SEQ ID NO: 38428 - protein, 8 aa, Borrelia burgdorferi B31
TREILASG

SEQ ID NO: 38429 - protein, 8 aa, Borrelia burgdorferi B31
REILASGI

SEQ ID NO: 38430 - protein, 8 aa, Borrelia burgdorferi B31
EILASGIE

SEQ ID NO: 38431 - protein, 8 aa, Borrelia burgdorferi B31
ILASGIEL

SEQ ID NO: 38432 - protein, 8 aa, Borrelia burgdorferi B31
LASGIELN

SEQ ID NO: 38433 - protein, 8 aa, Borrelia burgdorferi B31
ASGIELNR

SEQ ID NO: 38434 - protein, 8 aa, Borrelia burgdorferi B31
SGIELNRV

SEQ ID NO: 38435 - protein, 8 aa, Borrelia burgdorferi B31
GIELNRVV

SEQ ID NO: 38436 - protein, 8 aa, Borrelia burgdorferi B31
IELNRVVN

SEQ ID NO: 38437 - protein, 8 aa, Borrelia burgdorferi B31
ELNRVVNA

SEQ ID NO: 38438 - protein, 8 aa, Borrelia burgdorferi B31
LNRVVNAW

SEQ ID NO: 38439 - protein, 8 aa, Borrelia burgdorferi B31
NRVVNAWL

SEQ ID NO: 38440 - protein, 8 aa, Borrelia burgdorferi B31
RVVNAWLN

SEQ ID NO: 38441 - protein, 8 aa, Borrelia burgdorferi B31
VVNAWLNS

SEQ ID NO: 38442 - protein, 8 aa, Borrelia burgdorferi B31
VNAWLNSP

SEQ ID NO: 38443 - protein, 8 aa, Borrelia burgdorferi B31
NAWLNSPS

SEQ ID NO: 38444 - protein, 8 aa, Borrelia burgdorferi B31
AWLNSPSH

SEQ ID NO: 38445 - protein, 8 aa, Borrelia burgdorferi B31
WLNSPSHK

SEQ ID NO: 38446 - protein, 8 aa, Borrelia burgdorferi B31
LNSPSHKE

SEQ ID NO: 38447 - protein, 8 aa, Borrelia burgdorferi B31
NSPSHKEA

SEQ ID NO: 38448 - protein, 8 aa, Borrelia burgdorferi B31
SPSHKEAL

SEQ ID NO: 38449 - protein, 8 aa, Borrelia burgdorferi B31
PSHKEALI

SEQ ID NO: 38450 - protein, 8 aa, Borrelia burgdorferi B31
SHKEALIN

SEQ ID NO: 38451 - protein, 8 aa, Borrelia burgdorferi B31
HKEALINT

SEQ ID NO: 38452 - protein, 8 aa, Borrelia burgdorferi B31
KEALINTD

SEQ ID NO: 38453 - protein, 8 aa, Borrelia burgdorferi B31
EALINTDT

SEQ ID NO: 38454 - protein, 8 aa, Borrelia burgdorferi B31
ALINTDTD

SEQ ID NO: 38455 - protein, 8 aa, Borrelia burgdorferi B31
LINTDTDK

SEQ ID NO: 38456 - protein, 8 aa, Borrelia burgdorferi B31
INTDTDKI

SEQ ID NO: 38457 - protein, 8 aa, Borrelia burgdorferi B31
NTDTDKIG

SEQ ID NO: 38458 - protein, 8 aa, Borrelia burgdorferi B31
TDTDKIGG

SEQ ID NO: 38459 - protein, 8 aa, Borrelia burgdorferi B31
DTDKIGGY

SEQ ID NO: 38460 - protein, 8 aa, Borrelia burgdorferi B31
TDKIGGYR

SEQ ID NO: 38461 - protein, 8 aa, Borrelia burgdorferi B31
DKIGGYRL

SEQ ID NO: 38462 - protein, 8 aa, Borrelia burgdorferi B31
KIGGYRLK

SEQ ID NO: 38463 - protein, 8 aa, Borrelia burgdorferi B31
IGGYRLKT

SEQ ID NO: 38464 - protein, 8 aa, Borrelia burgdorferi B31
GGYRLKTT

SEQ ID NO: 38465 - protein, 8 aa, Borrelia burgdorferi B31
GYRLKTTD

SEQ ID NO: 38466 - protein, 8 aa, Borrelia burgdorferi B31
YRLKTTDN

SEQ ID NO: 38467 - protein, 8 aa, Borrelia burgdorferi B31
RLKTTDNI

SEQ ID NO: 38468 - protein, 8 aa, Borrelia burgdorferi B31
LKTTDNID

SEQ ID NO: 38469 - protein, 8 aa, Borrelia burgdorferi B31
KTTDNIDI

SEQ ID NO: 38470 - protein, 8 aa, Borrelia burgdorferi B31
TTDNIDIF

SEQ ID NO: 38471 - protein, 8 aa, Borrelia burgdorferi B31
TDNIDIFV

SEQ ID NO: 38472 - protein, 8 aa, Borrelia burgdorferi B31
DNIDIFVV

SEQ ID NO: 38473 - protein, 8 aa, Borrelia burgdorferi B31
NIDIFVVL

SEQ ID NO: 38474 - protein, 8 aa, Borrelia burgdorferi B31
IDIFVVLF

SEQ ID NO: 38475 - protein, 8 aa, Borrelia burgdorferi B31
DIFVVLFG

SEQ ID NO: 38476 - protein, 8 aa, Borrelia burgdorferi B31
IFVVLFGK

SEQ ID NO: 38477 - protein, 8 aa, Borrelia burgdorferi B31
FVVLFGKR

SEQ ID NO: 38478 - protein, 8 aa, Borrelia burgdorferi B31
VVLFGKRK

SEQ ID NO: 38479 - protein, 8 aa, Borrelia burgdorferi B31
VLFGKRKY

SEQ ID NO: 38480 - protein, 8 aa, Borrelia burgdorferi B31
LFGKRKYK

SEQ ID NO: 38481 - protein, 8 aa, Borrelia burgdorferi B31
FGKRKYKN

SEQ ID NO: 38482 - protein, 9 aa, Borrelia burgdorferi B31
MKKLIIIFT

SEQ ID NO: 38483 - protein, 9 aa, Borrelia burgdorferi B31
KKLIIIFTL

SEQ ID NO: 38484 - protein, 9 aa, Borrelia burgdorferi B31
KLIIIFTLF

SEQ ID NO: 38485 - protein, 9 aa, Borrelia burgdorferi B31
LIIIFTLFL

SEQ ID NO: 38486 - protein, 9 aa, Borrelia burgdorferi B31
IIIFTLFLS

SEQ ID NO: 38487 - protein, 9 aa, Borrelia burgdorferi B31
IIFTLFLSQ

SEQ ID NO: 38488 - protein, 9 aa, Borrelia burgdorferi B31
IFTLFLSQA

SEQ ID NO: 38489 - protein, 9 aa, Borrelia burgdorferi B31
FTLFLSQAC

SEQ ID NO: 38490 - protein, 9 aa, Borrelia burgdorferi B31
TLFLSQACN

SEQ ID NO: 38491 - protein, 9 aa, Borrelia burgdorferi B31
LFLSQACNL

SEQ ID NO: 38492 - protein, 9 aa, Borrelia burgdorferi B31
FLSQACNLS

SEQ ID NO: 38493 - protein, 9 aa, Borrelia burgdorferi B31
LSQACNLST

SEQ ID NO: 38494 - protein, 9 aa, Borrelia burgdorferi B31
SQACNLSTM

SEQ ID NO: 38495 - protein, 9 aa, Borrelia burgdorferi B31
QACNLSTMH

SEQ ID NO: 38496 - protein, 9 aa, Borrelia burgdorferi B31
ACNLSTMHK

SEQ ID NO: 38497 - protein, 9 aa, Borrelia burgdorferi B31
CNLSTMHKI

SEQ ID NO: 38498 - protein, 9 aa, Borrelia burgdorferi B31
NLSTMHKID

SEQ ID NO: 38499 - protein, 9 aa, Borrelia burgdorferi B31
LSTMHKIDT

SEQ ID NO: 38500 - protein, 9 aa, Borrelia burgdorferi B31
STMHKIDTK

SEQ ID NO: 38501 - protein, 9 aa, Borrelia burgdorferi B31
TMHKIDTKE

SEQ ID NO: 38502 - protein, 9 aa, Borrelia burgdorferi B31
MHKIDTKED

SEQ ID NO: 38503 - protein, 9 aa, Borrelia burgdorferi B31
HKIDTKEDM

SEQ ID NO: 38504 - protein, 9 aa, Borrelia burgdorferi B31
KIDTKEDMK

SEQ ID NO: 38505 - protein, 9 aa, Borrelia burgdorferi B31
IDTKEDMKI

SEQ ID NO: 38506 - protein, 9 aa, Borrelia burgdorferi B31
DTKEDMKIL

SEQ ID NO: 38507 - protein, 9 aa, Borrelia burgdorferi B31
TKEDMKILY

SEQ ID NO: 38508 - protein, 9 aa, Borrelia burgdorferi B31
KEDMKILYS

SEQ ID NO: 38509 - protein, 9 aa, Borrelia burgdorferi B31
EDMKILYSE

SEQ ID NO: 38510 - protein, 9 aa, Borrelia burgdorferi B31
DMKILYSEI

SEQ ID NO: 38511 - protein, 9 aa, Borrelia burgdorferi B31
MKILYSEIA

SEQ ID NO: 38512 - protein, 9 aa, Borrelia burgdorferi B31
KILYSEIAE

SEQ ID NO: 38513 - protein, 9 aa, Borrelia burgdorferi B31
ILYSEIAEL

SEQ ID NO: 38514 - protein, 9 aa, Borrelia burgdorferi B31
LYSEIAELR

SEQ ID NO: 38515 - protein, 9 aa, Borrelia burgdorferi B31
YSEIAELRK

SEQ ID NO: 38516 - protein, 9 aa, Borrelia burgdorferi B31
SEIAELRKK

SEQ ID NO: 38517 - protein, 9 aa, Borrelia burgdorferi B31
EIAELRKKL

SEQ ID NO: 38518 - protein, 9 aa, Borrelia burgdorferi B31
IAELRKKLN

SEQ ID NO: 38519 - protein, 9 aa, Borrelia burgdorferi B31
AELRKKLNL

SEQ ID NO: 38520 - protein, 9 aa, Borrelia burgdorferi B31
ELRKKLNLN

SEQ ID NO: 38521 - protein, 9 aa, Borrelia burgdorferi B31
LRKKLNLNH

SEQ ID NO: 38522 - protein, 9 aa, Borrelia burgdorferi B31
RKKLNLNHL

SEQ ID NO: 38523 - protein, 9 aa, Borrelia burgdorferi B31
KKLNLNHLE

SEQ ID NO: 38524 - protein, 9 aa, Borrelia burgdorferi B31
KLNLNHLEI

SEQ ID NO: 38525 - protein, 9 aa, Borrelia burgdorferi B31
LNLNHLEID

SEQ ID NO: 38526 - protein, 9 aa, Borrelia burgdorferi B31
NLNHLEIDD

SEQ ID NO: 38527 - protein, 9 aa, Borrelia burgdorferi B31
LNHLEIDDT

SEQ ID NO: 38528 - protein, 9 aa, Borrelia burgdorferi B31
NHLEIDDTL

SEQ ID NO: 38529 - protein, 9 aa, Borrelia burgdorferi B31
HLEIDDTLE

SEQ ID NO: 38530 - protein, 9 aa, Borrelia burgdorferi B31
LEIDDTLEK

SEQ ID NO: 38531 - protein, 9 aa, Borrelia burgdorferi B31
EIDDTLEKV

SEQ ID NO: 38532 - protein, 9 aa, Borrelia burgdorferi B31
IDDTLEKVA

SEQ ID NO: 38533 - protein, 9 aa, Borrelia burgdorferi B31
DDTLEKVAK

SEQ ID NO: 38534 - protein, 9 aa, Borrelia burgdorferi B31
DTLEKVAKE

SEQ ID NO: 38535 - protein, 9 aa, Borrelia burgdorferi B31
TLEKVAKEY

SEQ ID NO: 38536 - protein, 9 aa, Borrelia burgdorferi B31
LEKVAKEYA

SEQ ID NO: 38537 - protein, 9 aa, Borrelia burgdorferi B31
EKVAKEYAI

SEQ ID NO: 38538 - protein, 9 aa, Borrelia burgdorferi B31
KVAKEYAIK

SEQ ID NO: 38539 - protein, 9 aa, Borrelia burgdorferi B31
VAKEYAIKL

SEQ ID NO: 38540 - protein, 9 aa, Borrelia burgdorferi B31
AKEYAIKLG

SEQ ID NO: 38541 - protein, 9 aa, Borrelia burgdorferi B31
KEYAIKLGE

SEQ ID NO: 38542 - protein, 9 aa, Borrelia burgdorferi B31
EYAIKLGEN

SEQ ID NO: 38543 - protein, 9 aa, Borrelia burgdorferi B31
YAIKLGENR

SEQ ID NO: 38544 - protein, 9 aa, Borrelia burgdorferi B31
AIKLGENRT

SEQ ID NO: 38545 - protein, 9 aa, Borrelia burgdorferi B31
IKLGENRTI

SEQ ID NO: 38546 - protein, 9 aa, Borrelia burgdorferi B31
KLGENRTIT

SEQ ID NO: 38547 - protein, 9 aa, Borrelia burgdorferi B31
LGENRTITH

SEQ ID NO: 38548 - protein, 9 aa, Borrelia burgdorferi B31
GENRTITHT

SEQ ID NO: 38549 - protein, 9 aa, Borrelia burgdorferi B31
ENRTITHTL

SEQ ID NO: 38550 - protein, 9 aa, Borrelia burgdorferi B31
NRTITHTLF

SEQ ID NO: 38551 - protein, 9 aa, Borrelia burgdorferi B31
RTITHTLFG

SEQ ID NO: 38552 - protein, 9 aa, Borrelia burgdorferi B31
TITHTLFGT

SEQ ID NO: 38553 - protein, 9 aa, Borrelia burgdorferi B31
ITHTLFGTT

SEQ ID NO: 38554 - protein, 9 aa, Borrelia burgdorferi B31
THTLFGTTP

SEQ ID NO: 38555 - protein, 9 aa, Borrelia burgdorferi B31
HTLFGTTPM

SEQ ID NO: 38556 - protein, 9 aa, Borrelia burgdorferi B31
TLFGTTPMQ

SEQ ID NO: 38557 - protein, 9 aa, Borrelia burgdorferi B31
LFGTTPMQR

SEQ ID NO: 38558 - protein, 9 aa, Borrelia burgdorferi B31
FGTTPMQRI

SEQ ID NO: 38559 - protein, 9 aa, Borrelia burgdorferi B31
GTTPMQRIH

SEQ ID NO: 38560 - protein, 9 aa, Borrelia burgdorferi B31
TTPMQRIHK

SEQ ID NO: 38561 - protein, 9 aa, Borrelia burgdorferi B31
TPMQRIHKY

SEQ ID NO: 38562 - protein, 9 aa, Borrelia burgdorferi B31
PMQRIHKYD

SEQ ID NO: 38563 - protein, 9 aa, Borrelia burgdorferi B31
MQRIHKYDQ

SEQ ID NO: 38564 - protein, 9 aa, Borrelia burgdorferi B31
QRIHKYDQS

SEQ ID NO: 38565 - protein, 9 aa, Borrelia burgdorferi B31
RIHKYDQSF

SEQ ID NO: 38566 - protein, 9 aa, Borrelia burgdorferi B31
IHKYDQSFN

SEQ ID NO: 38567 - protein, 9 aa, Borrelia burgdorferi B31
HKYDQSFNL

SEQ ID NO: 38568 - protein, 9 aa, Borrelia burgdorferi B31
KYDQSFNLT

SEQ ID NO: 38569 - protein, 9 aa, Borrelia burgdorferi B31
YDQSFNLTR

SEQ ID NO: 38570 - protein, 9 aa, Borrelia burgdorferi B31
DQSFNLTRE

SEQ ID NO: 38571 - protein, 9 aa, Borrelia burgdorferi B31
QSFNLTREI

SEQ ID NO: 38572 - protein, 9 aa, Borrelia burgdorferi B31
SFNLTREIL

SEQ ID NO: 38573 - protein, 9 aa, Borrelia burgdorferi B31
FNLTREILA

SEQ ID NO: 38574 - protein, 9 aa, Borrelia burgdorferi B31
NLTREILAS

SEQ ID NO: 38575 - protein, 9 aa, Borrelia burgdorferi B31
LTREILASG

SEQ ID NO: 38576 - protein, 9 aa, Borrelia burgdorferi B31
TREILASGI

SEQ ID NO: 38577 - protein, 9 aa, Borrelia burgdorferi B31
REILASGIE

SEQ ID NO: 38578 - protein, 9 aa, Borrelia burgdorferi B31
EILASGIEL

SEQ ID NO: 38579 - protein, 9 aa, Borrelia burgdorferi B31
ILASGIELN

SEQ ID NO: 38580 - protein, 9 aa, Borrelia burgdorferi B31
LASGIELNR

SEQ ID NO: 38581 - protein, 9 aa, Borrelia burgdorferi B31
ASGIELNRV

SEQ ID NO: 38582 - protein, 9 aa, Borrelia burgdorferi B31
SGIELNRVV

SEQ ID NO: 38583 - protein, 9 aa, Borrelia burgdorferi B31
GIELNRVVN

SEQ ID NO: 38584 - protein, 9 aa, Borrelia burgdorferi B31
IELNRVVNA

SEQ ID NO: 38585 - protein, 9 aa, Borrelia burgdorferi B31
ELNRVVNAW

SEQ ID NO: 38586 - protein, 9 aa, Borrelia burgdorferi B31
LNRVVNAWL

SEQ ID NO: 38587 - protein, 9 aa, Borrelia burgdorferi B31
NRVVNAWLN

SEQ ID NO: 38588 - protein, 9 aa, Borrelia burgdorferi B31
RVVNAWLNS

SEQ ID NO: 38589 - protein, 9 aa, Borrelia burgdorferi B31
VVNAWLNSP

SEQ ID NO: 38590 - protein, 9 aa, Borrelia burgdorferi B31
VNAWLNSPS

SEQ ID NO: 38591 - protein, 9 aa, Borrelia burgdorferi B31
NAWLNSPSH

SEQ ID NO: 38592 - protein, 9 aa, Borrelia burgdorferi B31
AWLNSPSHK

SEQ ID NO: 38593 - protein, 9 aa, Borrelia burgdorferi B31
WLNSPSHKE

SEQ ID NO: 38594 - protein, 9 aa, Borrelia burgdorferi B31
LNSPSHKEA

SEQ ID NO: 38595 - protein, 9 aa, Borrelia burgdorferi B31
NSPSHKEAL

SEQ ID NO: 38596 - protein, 9 aa, Borrelia burgdorferi B31
SPSHKEALI

SEQ ID NO: 38597 - protein, 9 aa, Borrelia burgdorferi B31
PSHKEALIN

SEQ ID NO: 38598 - protein, 9 aa, Borrelia burgdorferi B31
SHKEALINT

SEQ ID NO: 38599 - protein, 9 aa, Borrelia burgdorferi B31
HKEALINTD

SEQ ID NO: 38600 - protein, 9 aa, Borrelia burgdorferi B31
KEALINTDT

SEQ ID NO: 38601 - protein, 9 aa, Borrelia burgdorferi B31
EALINTDTD

SEQ ID NO: 38602 - protein, 9 aa, Borrelia burgdorferi B31
ALINTDTDK

SEQ ID NO: 38603 - protein, 9 aa, Borrelia burgdorferi B31
LINTDTDKI

SEQ ID NO: 38604 - protein, 9 aa, Borrelia burgdorferi B31
INTDTDKIG

SEQ ID NO: 38605 - protein, 9 aa, Borrelia burgdorferi B31
NTDTDKIGG

SEQ ID NO: 38606 - protein, 9 aa, Borrelia burgdorferi B31
TDTDKIGGY

SEQ ID NO: 38607 - protein, 9 aa, Borrelia burgdorferi B31
DTDKIGGYR

SEQ ID NO: 38608 - protein, 9 aa, Borrelia burgdorferi B31
TDKIGGYRL

SEQ ID NO: 38609 - protein, 9 aa, Borrelia burgdorferi B31
DKIGGYRLK

SEQ ID NO: 38610 - protein, 9 aa, Borrelia burgdorferi B31
KIGGYRLKT

SEQ ID NO: 38611 - protein, 9 aa, Borrelia burgdorferi B31
IGGYRLKTT

SEQ ID NO: 38612 - protein, 9 aa, Borrelia burgdorferi B31
GGYRLKTTD

SEQ ID NO: 38613 - protein, 9 aa, Borrelia burgdorferi B31
GYRLKTTDN

SEQ ID NO: 38614 - protein, 9 aa, Borrelia burgdorferi B31
YRLKTTDNI

SEQ ID NO: 38615 - protein, 9 aa, Borrelia burgdorferi B31
RLKTTDNID

SEQ ID NO: 38616 - protein, 9 aa, Borrelia burgdorferi B31
LKTTDNIDI

SEQ ID NO: 38617 - protein, 9 aa, Borrelia burgdorferi B31
KTTDNIDIF

SEQ ID NO: 38618 - protein, 9 aa, Borrelia burgdorferi B31
TTDNIDIFV

SEQ ID NO: 38619 - protein, 9 aa, Borrelia burgdorferi B31
TDNIDIFVV

SEQ ID NO: 38620 - protein, 9 aa, Borrelia burgdorferi B31
DNIDIFVVL

SEQ ID NO: 38621 - protein, 9 aa, Borrelia burgdorferi B31
NIDIFVVLF

SEQ ID NO: 38622 - protein, 9 aa, Borrelia burgdorferi B31
IDIFVVLFG

SEQ ID NO: 38623 - protein, 9 aa, Borrelia burgdorferi B31
DIFVVLFGK

SEQ ID NO: 38624 - protein, 9 aa, Borrelia burgdorferi B31
IFVVLFGKR

SEQ ID NO: 38625 - protein, 9 aa, Borrelia burgdorferi B31
FVVLFGKRK

SEQ ID NO: 38626 - protein, 9 aa, Borrelia burgdorferi B31
VVLFGKRKY

SEQ ID NO: 38627 - protein, 9 aa, Borrelia burgdorferi B31
VLFGKRKYK

SEQ ID NO: 38628 - protein, 9 aa, Borrelia burgdorferi B31
LFGKRKYKN

SEQ ID NO: 38629 - protein, 10 aa, Borrelia burgdorferi B31
MKKLIIIFTL

SEQ ID NO: 38630 - protein, 10 aa, Borrelia burgdorferi B31
KKLIIIFTLF

SEQ ID NO: 38631 - protein, 10 aa, Borrelia burgdorferi B31
KLIIIFTLFL

SEQ ID NO: 38632 - protein, 10 aa, Borrelia burgdorferi B31
LIIIFTLFLS

SEQ ID NO: 38633 - protein, 10 aa, Borrelia burgdorferi B31
IIIFTLFLSQ

SEQ ID NO: 38634 - protein, 10 aa, Borrelia burgdorferi B31
IIFTLFLSQA

SEQ ID NO: 38635 - protein, 10 aa, Borrelia burgdorferi B31
IFTLFLSQAC

SEQ ID NO: 38636 - protein, 10 aa, Borrelia burgdorferi B31
FTLFLSQACN

SEQ ID NO: 38637 - protein, 10 aa, Borrelia burgdorferi B31
TLFLSQACNL

SEQ ID NO: 38638 - protein, 10 aa, Borrelia burgdorferi B31
LFLSQACNLS

SEQ ID NO: 38639 - protein, 10 aa, Borrelia burgdorferi B31
FLSQACNLST

SEQ ID NO: 38640 - protein, 10 aa, Borrelia burgdorferi B31
LSQACNLSTM

SEQ ID NO: 38641 - protein, 10 aa, Borrelia burgdorferi B31
SQACNLSTMH

SEQ ID NO: 38642 - protein, 10 aa, Borrelia burgdorferi B31
QACNLSTMHK

SEQ ID NO: 38643 - protein, 10 aa, Borrelia burgdorferi B31
ACNLSTMHKI

SEQ ID NO: 38644 - protein, 10 aa, Borrelia burgdorferi B31
CNLSTMHKID

SEQ ID NO: 38645 - protein, 10 aa, Borrelia burgdorferi B31
NLSTMHKIDT

SEQ ID NO: 38646 - protein, 10 aa, Borrelia burgdorferi B31
LSTMHKIDTK

SEQ ID NO: 38647 - protein, 10 aa, Borrelia burgdorferi B31
STMHKIDTKE

SEQ ID NO: 38648 - protein, 10 aa, Borrelia burgdorferi B31
TMHKIDTKED

SEQ ID NO: 38649 - protein, 10 aa, Borrelia burgdorferi B31
MHKIDTKEDM

SEQ ID NO: 38650 - protein, 10 aa, Borrelia burgdorferi B31
HKIDTKEDMK

SEQ ID NO: 38651 - protein, 10 aa, Borrelia burgdorferi B31
KIDTKEDMKI

SEQ ID NO: 38652 - protein, 10 aa, Borrelia burgdorferi B31
IDTKEDMKIL

SEQ ID NO: 38653 - protein, 10 aa, Borrelia burgdorferi B31
DTKEDMKILY

SEQ ID NO: 38654 - protein, 10 aa, Borrelia burgdorferi B31
TKEDMKILYS

SEQ ID NO: 38655 - protein, 10 aa, Borrelia burgdorferi B31
KEDMKILYSE

SEQ ID NO: 38656 - protein, 10 aa, Borrelia burgdorferi B31
EDMKILYSEI

SEQ ID NO: 38657 - protein, 10 aa, Borrelia burgdorferi B31
DMKILYSEIA

SEQ ID NO: 38658 - protein, 10 aa, Borrelia burgdorferi B31
MKILYSEIAE

SEQ ID NO: 38659 - protein, 10 aa, Borrelia burgdorferi B31
KILYSEIAEL

SEQ ID NO: 38660 - protein, 10 aa, Borrelia burgdorferi B31
ILYSEIAELR

SEQ ID NO: 38661 - protein, 10 aa, Borrelia burgdorferi B31
LYSEIAELRK

SEQ ID NO: 38662 - protein, 10 aa, Borrelia burgdorferi B31
YSEIAELRKK

SEQ ID NO: 38663 - protein, 10 aa, Borrelia burgdorferi B31
SEIAELRKKL

SEQ ID NO: 38664 - protein, 10 aa, Borrelia burgdorferi B31
EIAELRKKLN

SEQ ID NO: 38665 - protein, 10 aa, Borrelia burgdorferi B31
IAELRKKLNL

SEQ ID NO: 38666 - protein, 10 aa, Borrelia burgdorferi B31
AELRKKLNLN

SEQ ID NO: 38667 - protein, 10 aa, Borrelia burgdorferi B31
ELRKKLNLNH

SEQ ID NO: 38668 - protein, 10 aa, Borrelia burgdorferi B31
LRKKLNLNHL

SEQ ID NO: 38669 - protein, 10 aa, Borrelia burgdorferi B31
RKKLNLNHLE

SEQ ID NO: 38670 - protein, 10 aa, Borrelia burgdorferi B31
KKLNLNHLEI

SEQ ID NO: 38671 - protein, 10 aa, Borrelia burgdorferi B31
KLNLNHLEID

SEQ ID NO: 38672 - protein, 10 aa, Borrelia burgdorferi B31
LNLNHLEIDD

SEQ ID NO: 38673 - protein, 10 aa, Borrelia burgdorferi B31
NLNHLEIDDT

SEQ ID NO: 38674 - protein, 10 aa, Borrelia burgdorferi B31
LNHLEIDDTL

SEQ ID NO: 38675 - protein, 10 aa, Borrelia burgdorferi B31
NHLEIDDTLE

SEQ ID NO: 38676 - protein, 10 aa, Borrelia burgdorferi B31
HLEIDDTLEK

SEQ ID NO: 38677 - protein, 10 aa, Borrelia burgdorferi B31
LEIDDTLEKV

SEQ ID NO: 38678 - protein, 10 aa, Borrelia burgdorferi B31
EIDDTLEKVA

SEQ ID NO: 38679 - protein, 10 aa, Borrelia burgdorferi B31
IDDTLEKVAK

SEQ ID NO: 38680 - protein, 10 aa, Borrelia burgdorferi B31
DDTLEKVAKE

SEQ ID NO: 38681 - protein, 10 aa, Borrelia burgdorferi B31
DTLEKVAKEY

SEQ ID NO: 38682 - protein, 10 aa, Borrelia burgdorferi B31
TLEKVAKEYA

SEQ ID NO: 38683 - protein, 10 aa, Borrelia burgdorferi B31
LEKVAKEYAI

SEQ ID NO: 38684 - protein, 10 aa, Borrelia burgdorferi B31
EKVAKEYAIK

SEQ ID NO: 38685 - protein, 10 aa, Borrelia burgdorferi B31
KVAKEYAIKL

SEQ ID NO: 38686 - protein, 10 aa, Borrelia burgdorferi B31
VAKEYAIKLG

SEQ ID NO: 38687 - protein, 10 aa, Borrelia burgdorferi B31
AKEYAIKLGE

SEQ ID NO: 38688 - protein, 10 aa, Borrelia burgdorferi B31
KEYAIKLGEN

SEQ ID NO: 38689 - protein, 10 aa, Borrelia burgdorferi B31
EYAIKLGENR

SEQ ID NO: 38690 - protein, 10 aa, Borrelia burgdorferi B31
YAIKLGENRT

SEQ ID NO: 38691 - protein, 10 aa, Borrelia burgdorferi B31
AIKLGENRTI

SEQ ID NO: 38692 - protein, 10 aa, Borrelia burgdorferi B31
IKLGENRTIT

SEQ ID NO: 38693 - protein, 10 aa, Borrelia burgdorferi B31
KLGENRTITH

SEQ ID NO: 38694 - protein, 10 aa, Borrelia burgdorferi B31
LGENRTITHT

SEQ ID NO: 38695 - protein, 10 aa, Borrelia burgdorferi B31
GENRTITHTL

SEQ ID NO: 38696 - protein, 10 aa, Borrelia burgdorferi B31
ENRTITHTLF

SEQ ID NO: 38697 - protein, 10 aa, Borrelia burgdorferi B31
NRTITHTLFG

SEQ ID NO: 38698 - protein, 10 aa, Borrelia burgdorferi B31
RTITHTLFGT

SEQ ID NO: 38699 - protein, 10 aa, Borrelia burgdorferi B31
TITHTLFGTT

SEQ ID NO: 38700 - protein, 10 aa, Borrelia burgdorferi B31
ITHTLFGTTP

SEQ ID NO: 38701 - protein, 10 aa, Borrelia burgdorferi B31
THTLFGTTPM

SEQ ID NO: 38702 - protein, 10 aa, Borrelia burgdorferi B31
HTLFGTTPMQ

SEQ ID NO: 38703 - protein, 10 aa, Borrelia burgdorferi B31
TLFGTTPMQR

SEQ ID NO: 38704 - protein, 10 aa, Borrelia burgdorferi B31
LFGTTPMQRI

SEQ ID NO: 38705 - protein, 10 aa, Borrelia burgdorferi B31
FGTTPMQRIH

SEQ ID NO: 38706 - protein, 10 aa, Borrelia burgdorferi B31
GTTPMQRIHK

SEQ ID NO: 38707 - protein, 10 aa, Borrelia burgdorferi B31
TTPMQRIHKY

SEQ ID NO: 38708 - protein, 10 aa, Borrelia burgdorferi B31
TPMQRIHKYD

SEQ ID NO: 38709 - protein, 10 aa, Borrelia burgdorferi B31
PMQRIHKYDQ

SEQ ID NO: 38710 - protein, 10 aa, Borrelia burgdorferi B31
MQRIHKYDQS

SEQ ID NO: 38711 - protein, 10 aa, Borrelia burgdorferi B31
QRIHKYDQSF

SEQ ID NO: 38712 - protein, 10 aa, Borrelia burgdorferi B31
RIHKYDQSFN

SEQ ID NO: 38713 - protein, 10 aa, Borrelia burgdorferi B31
IHKYDQSFNL

SEQ ID NO: 38714 - protein, 10 aa, Borrelia burgdorferi B31
HKYDQSFNLT

SEQ ID NO: 38715 - protein, 10 aa, Borrelia burgdorferi B31
KYDQSFNLTR

SEQ ID NO: 38716 - protein, 10 aa, Borrelia burgdorferi B31
YDQSFNLTRE

SEQ ID NO: 38717 - protein, 10 aa, Borrelia burgdorferi B31
DQSFNLTREI

SEQ ID NO: 38718 - protein, 10 aa, Borrelia burgdorferi B31
QSFNLTREIL

SEQ ID NO: 38719 - protein, 10 aa, Borrelia burgdorferi B31
SFNLTREILA

SEQ ID NO: 38720 - protein, 10 aa, Borrelia burgdorferi B31
FNLTREILAS

SEQ ID NO: 38721 - protein, 10 aa, Borrelia burgdorferi B31
NLTREILASG

SEQ ID NO: 38722 - protein, 10 aa, Borrelia burgdorferi B31
LTREILASGI

SEQ ID NO: 38723 - protein, 10 aa, Borrelia burgdorferi B31
TREILASGIE

SEQ ID NO: 38724 - protein, 10 aa, Borrelia burgdorferi B31
REILASGIEL

SEQ ID NO: 38725 - protein, 10 aa, Borrelia burgdorferi B31
EILASGIELN

SEQ ID NO: 38726 - protein, 10 aa, Borrelia burgdorferi B31
ILASGIELNR

SEQ ID NO: 38727 - protein, 10 aa, Borrelia burgdorferi B31
LASGIELNRV

SEQ ID NO: 38728 - protein, 10 aa, Borrelia burgdorferi B31
ASGIELNRVV

SEQ ID NO: 38729 - protein, 10 aa, Borrelia burgdorferi B31
SGIELNRVVN

SEQ ID NO: 38730 - protein, 10 aa, Borrelia burgdorferi B31
GIELNRVVNA

SEQ ID NO: 38731 - protein, 10 aa, Borrelia burgdorferi B31
IELNRVVNAW

SEQ ID NO: 38732 - protein, 10 aa, Borrelia burgdorferi B31
ELNRVVNAWL

SEQ ID NO: 38733 - protein, 10 aa, Borrelia burgdorferi B31
LNRVVNAWLN

SEQ ID NO: 38734 - protein, 10 aa, Borrelia burgdorferi B31
NRVVNAWLNS

SEQ ID NO: 38735 - protein, 10 aa, Borrelia burgdorferi B31
RVVNAWLNSP

SEQ ID NO: 38736 - protein, 10 aa, Borrelia burgdorferi B31
VVNAWLNSPS

SEQ ID NO: 38737 - protein, 10 aa, Borrelia burgdorferi B31
VNAWLNSPSH

SEQ ID NO: 38738 - protein, 10 aa, Borrelia burgdorferi B31
NAWLNSPSHK

SEQ ID NO: 38739 - protein, 10 aa, Borrelia burgdorferi B31
AWLNSPSHKE

SEQ ID NO: 38740 - protein, 10 aa, Borrelia burgdorferi B31
WLNSPSHKEA

SEQ ID NO: 38741 - protein, 10 aa, Borrelia burgdorferi B31
LNSPSHKEAL

SEQ ID NO: 38742 - protein, 10 aa, Borrelia burgdorferi B31
NSPSHKEALI

SEQ ID NO: 38743 - protein, 10 aa, Borrelia burgdorferi B31
SPSHKEALIN

SEQ ID NO: 38744 - protein, 10 aa, Borrelia burgdorferi B31
PSHKEALINT

SEQ ID NO: 38745 - protein, 10 aa, Borrelia burgdorferi B31
SHKEALINTD

SEQ ID NO: 38746 - protein, 10 aa, Borrelia burgdorferi B31
HKEALINTDT

SEQ ID NO: 38747 - protein, 10 aa, Borrelia burgdorferi B31
KEALINTDTD

SEQ ID NO: 38748 - protein, 10 aa, Borrelia burgdorferi B31
EALINTDTDK

SEQ ID NO: 38749 - protein, 10 aa, Borrelia burgdorferi B31
ALINTDTDKI

SEQ ID NO: 38750 - protein, 10 aa, Borrelia burgdorferi B31
LINTDTDKIG

SEQ ID NO: 38751 - protein, 10 aa, Borrelia burgdorferi B31
INTDTDKIGG

SEQ ID NO: 38752 - protein, 10 aa, Borrelia burgdorferi B31
NTDTDKIGGY

SEQ ID NO: 38753 - protein, 10 aa, Borrelia burgdorferi B31
TDTDKIGGYR

SEQ ID NO: 38754 - protein, 10 aa, Borrelia burgdorferi B31
DTDKIGGYRL

SEQ ID NO: 38755 - protein, 10 aa, Borrelia burgdorferi B31
TDKIGGYRLK

SEQ ID NO: 38756 - protein, 10 aa, Borrelia burgdorferi B31
DKIGGYRLKT

SEQ ID NO: 38757 - protein, 10 aa, Borrelia burgdorferi B31
KIGGYRLKTT

SEQ ID NO: 38758 - protein, 10 aa, Borrelia burgdorferi B31
IGGYRLKTTD

SEQ ID NO: 38759 - protein, 10 aa, Borrelia burgdorferi B31
GGYRLKTTDN

SEQ ID NO: 38760 - protein, 10 aa, Borrelia burgdorferi B31
GYRLKTTDNI

SEQ ID NO: 38761 - protein, 10 aa, Borrelia burgdorferi B31
YRLKTTDNID

SEQ ID NO: 38762 - protein, 10 aa, Borrelia burgdorferi B31
RLKTTDNIDI

SEQ ID NO: 38763 - protein, 10 aa, Borrelia burgdorferi B31
LKTTDNIDIF

SEQ ID NO: 38764 - protein, 10 aa, Borrelia burgdorferi B31
KTTDNIDIFV

SEQ ID NO: 38765 - protein, 10 aa, Borrelia burgdorferi B31
TTDNIDIFVV

SEQ ID NO: 38766 - protein, 10 aa, Borrelia burgdorferi B31
TDNIDIFVVL

SEQ ID NO: 38767 - protein, 10 aa, Borrelia burgdorferi B31
DNIDIFVVLF

SEQ ID NO: 38768 - protein, 10 aa, Borrelia burgdorferi B31
NIDIFVVLFG

SEQ ID NO: 38769 - protein, 10 aa, Borrelia burgdorferi B31
IDIFVVLFGK

SEQ ID NO: 38770 - protein, 10 aa, Borrelia burgdorferi B31
DIFVVLFGKR

SEQ ID NO: 38771 - protein, 10 aa, Borrelia burgdorferi B31
IFVVLFGKRK

SEQ ID NO: 38772 - protein, 10 aa, Borrelia burgdorferi B31
FVVLFGKRKY

SEQ ID NO: 38773 - protein, 10 aa, Borrelia burgdorferi B31
VVLFGKRKYK

SEQ ID NO: 38774 - protein, 10 aa, Borrelia burgdorferi B31
VLFGKRKYKN

SEQ ID NO: 38775 - protein, 11 aa, Borrelia burgdorferi B31
MKKLIIIFTLF

SEQ ID NO: 38776 - protein, 11 aa, Borrelia burgdorferi B31
KKLIIIFTLFL

SEQ ID NO: 38777 - protein, 11 aa, Borrelia burgdorferi B31
KLIIIFTLFLS

SEQ ID NO: 38778 - protein, 11 aa, Borrelia burgdorferi B31
LIIIFTLFLSQ

SEQ ID NO: 38779 - protein, 11 aa, Borrelia burgdorferi B31
IIIFTLFLSQA

SEQ ID NO: 38780 - protein, 11 aa, Borrelia burgdorferi B31
IIFTLFLSQAC

SEQ ID NO: 38781 - protein, 11 aa, Borrelia burgdorferi B31
IFTLFLSQACN

SEQ ID NO: 38782 - protein, 11 aa, Borrelia burgdorferi B31
FTLFLSQACNL

SEQ ID NO: 38783 - protein, 11 aa, Borrelia burgdorferi B31
TLFLSQACNLS

SEQ ID NO: 38784 - protein, 11 aa, Borrelia burgdorferi B31
LFLSQACNLST

SEQ ID NO: 38785 - protein, 11 aa, Borrelia burgdorferi B31
FLSQACNLSTM

SEQ ID NO: 38786 - protein, 11 aa, Borrelia burgdorferi B31
LSQACNLSTMH

SEQ ID NO: 38787 - protein, 11 aa, Borrelia burgdorferi B31
SQACNLSTMHK

SEQ ID NO: 38788 - protein, 11 aa, Borrelia burgdorferi B31
QACNLSTMHKI

SEQ ID NO: 38789 - protein, 11 aa, Borrelia burgdorferi B31
ACNLSTMHKID

SEQ ID NO: 38790 - protein, 11 aa, Borrelia burgdorferi B31
CNLSTMHKIDT

SEQ ID NO: 38791 - protein, 11 aa, Borrelia burgdorferi B31
NLSTMHKIDTK

SEQ ID NO: 38792 - protein, 11 aa, Borrelia burgdorferi B31
LSTMHKIDTKE

SEQ ID NO: 38793 - protein, 11 aa, Borrelia burgdorferi B31
STMHKIDTKED

SEQ ID NO: 38794 - protein, 11 aa, Borrelia burgdorferi B31
TMHKIDTKEDM

SEQ ID NO: 38795 - protein, 11 aa, Borrelia burgdorferi B31
MHKIDTKEDMK

SEQ ID NO: 38796 - protein, 11 aa, Borrelia burgdorferi B31
HKIDTKEDMKI

SEQ ID NO: 38797 - protein, 11 aa, Borrelia burgdorferi B31
KIDTKEDMKIL

SEQ ID NO: 38798 - protein, 11 aa, Borrelia burgdorferi B31
IDTKEDMKILY

SEQ ID NO: 38799 - protein, 11 aa, Borrelia burgdorferi B31
DTKEDMKILYS

SEQ ID NO: 38800 - protein, 11 aa, Borrelia burgdorferi B31
TKEDMKILYSE

SEQ ID NO: 38801 - protein, 11 aa, Borrelia burgdorferi B31
KEDMKILYSEI

SEQ ID NO: 38802 - protein, 11 aa, Borrelia burgdorferi B31
EDMKILYSEIA

SEQ ID NO: 38803 - protein, 11 aa, Borrelia burgdorferi B31
DMKILYSEIAE

SEQ ID NO: 38804 - protein, 11 aa, Borrelia burgdorferi B31
MKILYSEIAEL

SEQ ID NO: 38805 - protein, 11 aa, Borrelia burgdorferi B31
KILYSEIAELR

SEQ ID NO: 38806 - protein, 11 aa, Borrelia burgdorferi B31
ILYSEIAELRK

SEQ ID NO: 38807 - protein, 11 aa, Borrelia burgdorferi B31
LYSEIAELRKK

SEQ ID NO: 38808 - protein, 11 aa, Borrelia burgdorferi B31
YSEIAELRKKL

SEQ ID NO: 38809 - protein, 11 aa, Borrelia burgdorferi B31
SEIAELRKKLN

SEQ ID NO: 38810 - protein, 11 aa, Borrelia burgdorferi B31
EIAELRKKLNL

SEQ ID NO: 38811 - protein, 11 aa, Borrelia burgdorferi B31
IAELRKKLNLN

SEQ ID NO: 38812 - protein, 11 aa, Borrelia burgdorferi B31
AELRKKLNLNH

SEQ ID NO: 38813 - protein, 11 aa, Borrelia burgdorferi B31
ELRKKLNLNHL

SEQ ID NO: 38814 - protein, 11 aa, Borrelia burgdorferi B31
LRKKLNLNHLE

SEQ ID NO: 38815 - protein, 11 aa, Borrelia burgdorferi B31
RKKLNLNHLEI

SEQ ID NO: 38816 - protein, 11 aa, Borrelia burgdorferi B31
KKLNLNHLEID

SEQ ID NO: 38817 - protein, 11 aa, Borrelia burgdorferi B31
KLNLNHLEIDD

SEQ ID NO: 38818 - protein, 11 aa, Borrelia burgdorferi B31
LNLNHLEIDDT

SEQ ID NO: 38819 - protein, 11 aa, Borrelia burgdorferi B31
NLNHLEIDDTL

SEQ ID NO: 38820 - protein, 11 aa, Borrelia burgdorferi B31
LNHLEIDDTLE

SEQ ID NO: 38821 - protein, 11 aa, Borrelia burgdorferi B31
NHLEIDDTLEK

SEQ ID NO: 38822 - protein, 11 aa, Borrelia burgdorferi B31
HLEIDDTLEKV

SEQ ID NO: 38823 - protein, 11 aa, Borrelia burgdorferi B31
LEIDDTLEKVA

SEQ ID NO: 38824 - protein, 11 aa, Borrelia burgdorferi B31
EIDDTLEKVAK

SEQ ID NO: 38825 - protein, 11 aa, Borrelia burgdorferi B31
IDDTLEKVAKE

SEQ ID NO: 38826 - protein, 11 aa, Borrelia burgdorferi B31
DDTLEKVAKEY

SEQ ID NO: 38827 - protein, 11 aa, Borrelia burgdorferi B31
DTLEKVAKEYA

SEQ ID NO: 38828 - protein, 11 aa, Borrelia burgdorferi B31
TLEKVAKEYAI

SEQ ID NO: 38829 - protein, 11 aa, Borrelia burgdorferi B31
LEKVAKEYAIK

SEQ ID NO: 38830 - protein, 11 aa, Borrelia burgdorferi B31
EKVAKEYAIKL

SEQ ID NO: 38831 - protein, 11 aa, Borrelia burgdorferi B31
KVAKEYAIKLG

SEQ ID NO: 38832 - protein, 11 aa, Borrelia burgdorferi B31
VAKEYAIKLGE

SEQ ID NO: 38833 - protein, 11 aa, Borrelia burgdorferi B31
AKEYAIKLGEN

SEQ ID NO: 38834 - protein, 11 aa, Borrelia burgdorferi B31
KEYAIKLGENR

SEQ ID NO: 38835 - protein, 11 aa, Borrelia burgdorferi B31
EYAIKLGENRT

SEQ ID NO: 38836 - protein, 11 aa, Borrelia burgdorferi B31
YAIKLGENRTI

SEQ ID NO: 38837 - protein, 11 aa, Borrelia burgdorferi B31
AIKLGENRTIT

SEQ ID NO: 38838 - protein, 11 aa, Borrelia burgdorferi B31
IKLGENRTITH

SEQ ID NO: 38839 - protein, 11 aa, Borrelia burgdorferi B31
KLGENRTITHT

SEQ ID NO: 38840 - protein, 11 aa, Borrelia burgdorferi B31
LGENRTITHTL

SEQ ID NO: 38841 - protein, 11 aa, Borrelia burgdorferi B31
GENRTITHTLF

SEQ ID NO: 38842 - protein, 11 aa, Borrelia burgdorferi B31
ENRTITHTLFG

SEQ ID NO: 38843 - protein, 11 aa, Borrelia burgdorferi B31
NRTITHTLFGT

SEQ ID NO: 38844 - protein, 11 aa, Borrelia burgdorferi B31
RTITHTLFGTT

SEQ ID NO: 38845 - protein, 11 aa, Borrelia burgdorferi B31
TITHTLFGTTP

SEQ ID NO: 38846 - protein, 11 aa, Borrelia burgdorferi B31
ITHTLFGTTPM

SEQ ID NO: 38847 - protein, 11 aa, Borrelia burgdorferi B31
THTLFGTTPMQ

SEQ ID NO: 38848 - protein, 11 aa, Borrelia burgdorferi B31
HTLFGTTPMQR

SEQ ID NO: 38849 - protein, 11 aa, Borrelia burgdorferi B31
TLFGTTPMQRI

SEQ ID NO: 38850 - protein, 11 aa, Borrelia burgdorferi B31
LFGTTPMQRIH

SEQ ID NO: 38851 - protein, 11 aa, Borrelia burgdorferi B31
FGTTPMQRIHK

SEQ ID NO: 38852 - protein, 11 aa, Borrelia burgdorferi B31
GTTPMQRIHKY

SEQ ID NO: 38853 - protein, 11 aa, Borrelia burgdorferi B31
TTPMQRIHKYD

SEQ ID NO: 38854 - protein, 11 aa, Borrelia burgdorferi B31
TPMQRIHKYDQ

SEQ ID NO: 38855 - protein, 11 aa, Borrelia burgdorferi B31
PMQRIHKYDQS

SEQ ID NO: 38856 - protein, 11 aa, Borrelia burgdorferi B31
MQRIHKYDQSF

SEQ ID NO: 38857 - protein, 11 aa, Borrelia burgdorferi B31
QRIHKYDQSFN

SEQ ID NO: 38858 - protein, 11 aa, Borrelia burgdorferi B31
RIHKYDQSFNL

SEQ ID NO: 38859 - protein, 11 aa, Borrelia burgdorferi B31
IHKYDQSFNLT

SEQ ID NO: 38860 - protein, 11 aa, Borrelia burgdorferi B31
HKYDQSFNLTR

SEQ ID NO: 38861 - protein, 11 aa, Borrelia burgdorferi B31
KYDQSFNLTRE

SEQ ID NO: 38862 - protein, 11 aa, Borrelia burgdorferi B31
YDQSFNLTREI

SEQ ID NO: 38863 - protein, 11 aa, Borrelia burgdorferi B31
DQSFNLTREIL

SEQ ID NO: 38864 - protein, 11 aa, Borrelia burgdorferi B31
QSFNLTREILA

SEQ ID NO: 38865 - protein, 11 aa, Borrelia burgdorferi B31
SFNLTREILAS

SEQ ID NO: 38866 - protein, 11 aa, Borrelia burgdorferi B31
FNLTREILASG

SEQ ID NO: 38867 - protein, 11 aa, Borrelia burgdorferi B31
NLTREILASGI

SEQ ID NO: 38868 - protein, 11 aa, Borrelia burgdorferi B31
LTREILASGIE

SEQ ID NO: 38869 - protein, 11 aa, Borrelia burgdorferi B31
TREILASGIEL

SEQ ID NO: 38870 - protein, 11 aa, Borrelia burgdorferi B31
REILASGIELN

SEQ ID NO: 38871 - protein, 11 aa, Borrelia burgdorferi B31
EILASGIELNR

SEQ ID NO: 38872 - protein, 11 aa, Borrelia burgdorferi B31
ILASGIELNRV

SEQ ID NO: 38873 - protein, 11 aa, Borrelia burgdorferi B31
LASGIELNRVV

SEQ ID NO: 38874 - protein, 11 aa, Borrelia burgdorferi B31
ASGIELNRVVN

SEQ ID NO: 38875 - protein, 11 aa, Borrelia burgdorferi B31
SGIELNRVVNA

SEQ ID NO: 38876 - protein, 11 aa, Borrelia burgdorferi B31
GIELNRVVNAW

SEQ ID NO: 38877 - protein, 11 aa, Borrelia burgdorferi B31
IELNRVVNAWL

SEQ ID NO: 38878 - protein, 11 aa, Borrelia burgdorferi B31
ELNRVVNAWLN

SEQ ID NO: 38879 - protein, 11 aa, Borrelia burgdorferi B31
LNRVVNAWLNS

SEQ ID NO: 38880 - protein, 11 aa, Borrelia burgdorferi B31
NRVVNAWLNSP

SEQ ID NO: 38881 - protein, 11 aa, Borrelia burgdorferi B31
RVVNAWLNSPS

SEQ ID NO: 38882 - protein, 11 aa, Borrelia burgdorferi B31
VVNAWLNSPSH

SEQ ID NO: 38883 - protein, 11 aa, Borrelia burgdorferi B31
VNAWLNSPSHK

SEQ ID NO: 38884 - protein, 11 aa, Borrelia burgdorferi B31
NAWLNSPSHKE

SEQ ID NO: 38885 - protein, 11 aa, Borrelia burgdorferi B31
AWLNSPSHKEA

SEQ ID NO: 38886 - protein, 11 aa, Borrelia burgdorferi B31
WLNSPSHKEAL

SEQ ID NO: 38887 - protein, 11 aa, Borrelia burgdorferi B31
LNSPSHKEALI

SEQ ID NO: 38888 - protein, 11 aa, Borrelia burgdorferi B31
NSPSHKEALIN

SEQ ID NO: 38889 - protein, 11 aa, Borrelia burgdorferi B31
SPSHKEALINT

SEQ ID NO: 38890 - protein, 11 aa, Borrelia burgdorferi B31
PSHKEALINTD

SEQ ID NO: 38891 - protein, 11 aa, Borrelia burgdorferi B31
SHKEALINTDT

SEQ ID NO: 38892 - protein, 11 aa, Borrelia burgdorferi B31
HKEALINTDTD

SEQ ID NO: 38893 - protein, 11 aa, Borrelia burgdorferi B31
KEALINTDTDK

SEQ ID NO: 38894 - protein, 11 aa, Borrelia burgdorferi B31
EALINTDTDKI

SEQ ID NO: 38895 - protein, 11 aa, Borrelia burgdorferi B31
ALINTDTDKIG

SEQ ID NO: 38896 - protein, 11 aa, Borrelia burgdorferi B31
LINTDTDKIGG

SEQ ID NO: 38897 - protein, 11 aa, Borrelia burgdorferi B31
INTDTDKIGGY

SEQ ID NO: 38898 - protein, 11 aa, Borrelia burgdorferi B31
NTDTDKIGGYR

SEQ ID NO: 38899 - protein, 11 aa, Borrelia burgdorferi B31
TDTDKIGGYRL

SEQ ID NO: 38900 - protein, 11 aa, Borrelia burgdorferi B31
DTDKIGGYRLK

SEQ ID NO: 38901 - protein, 11 aa, Borrelia burgdorferi B31
TDKIGGYRLKT

SEQ ID NO: 38902 - protein, 11 aa, Borrelia burgdorferi B31
DKIGGYRLKTT

SEQ ID NO: 38903 - protein, 11 aa, Borrelia burgdorferi B31
KIGGYRLKTTD

SEQ ID NO: 38904 - protein, 11 aa, Borrelia burgdorferi B31
IGGYRLKTTDN

SEQ ID NO: 38905 - protein, 11 aa, Borrelia burgdorferi B31
GGYRLKTTDNI

SEQ ID NO: 38906 - protein, 11 aa, Borrelia burgdorferi B31
GYRLKTTDNID

SEQ ID NO: 38907 - protein, 11 aa, Borrelia burgdorferi B31
YRLKTTDNIDI

SEQ ID NO: 38908 - protein, 11 aa, Borrelia burgdorferi B31
RLKTTDNIDIF

SEQ ID NO: 38909 - protein, 11 aa, Borrelia burgdorferi B31
LKTTDNIDIFV

SEQ ID NO: 38910 - protein, 11 aa, Borrelia burgdorferi B31
KTTDNIDIFVV

SEQ ID NO: 38911 - protein, 11 aa, Borrelia burgdorferi B31
TTDNIDIFVVL

SEQ ID NO: 38912 - protein, 11 aa, Borrelia burgdorferi B31
TDNIDIFVVLF

SEQ ID NO: 38913 - protein, 11 aa, Borrelia burgdorferi B31
DNIDIFVVLFG

SEQ ID NO: 38914 - protein, 11 aa, Borrelia burgdorferi B31
NIDIFVVLFGK

SEQ ID NO: 38915 - protein, 11 aa, Borrelia burgdorferi B31
IDIFVVLFGKR

SEQ ID NO: 38916 - protein, 11 aa, Borrelia burgdorferi B31
DIFVVLFGKRK

SEQ ID NO: 38917 - protein, 11 aa, Borrelia burgdorferi B31
IFVVLFGKRKY

SEQ ID NO: 38918 - protein, 11 aa, Borrelia burgdorferi B31
FVVLFGKRKYK

SEQ ID NO: 38919 - protein, 11 aa, Borrelia burgdorferi B31
VVLFGKRKYKN

SEQ ID NO: 38920 - protein, 8 aa, Borrelia burgdorferi B31
MMQRISIL

SEQ ID NO: 38921 - protein, 8 aa, Borrelia burgdorferi B31
MQRISILL

SEQ ID NO: 38922 - protein, 8 aa, Borrelia burgdorferi B31
QRISILLM

SEQ ID NO: 38923 - protein, 8 aa, Borrelia burgdorferi B31
RISILLML

SEQ ID NO: 38924 - protein, 8 aa, Borrelia burgdorferi B31
ISILLMLL

SEQ ID NO: 38925 - protein, 8 aa, Borrelia burgdorferi B31
SILLMLLA

SEQ ID NO: 38926 - protein, 8 aa, Borrelia burgdorferi B31
ILLMLLAV

SEQ ID NO: 38927 - protein, 8 aa, Borrelia burgdorferi B31
LLMLLAVF

SEQ ID NO: 38928 - protein, 8 aa, Borrelia burgdorferi B31
LMLLAVFS

SEQ ID NO: 38929 - protein, 8 aa, Borrelia burgdorferi B31
MLLAVFSC

SEQ ID NO: 38930 - protein, 8 aa, Borrelia burgdorferi B31
LLAVFSCK

SEQ ID NO: 38931 - protein, 8 aa, Borrelia burgdorferi B31
LAVFSCKQ

SEQ ID NO: 38932 - protein, 8 aa, Borrelia burgdorferi B31
AVFSCKQF

SEQ ID NO: 38933 - protein, 8 aa, Borrelia burgdorferi B31
VFSCKQFG

SEQ ID NO: 38934 - protein, 8 aa, Borrelia burgdorferi B31
FSCKQFGD

SEQ ID NO: 38935 - protein, 8 aa, Borrelia burgdorferi B31
SCKQFGDV

SEQ ID NO: 38936 - protein, 8 aa, Borrelia burgdorferi B31
CKQFGDVK

SEQ ID NO: 38937 - protein, 8 aa, Borrelia burgdorferi B31
KQFGDVKS

SEQ ID NO: 38938 - protein, 8 aa, Borrelia burgdorferi B31
QFGDVKSL

SEQ ID NO: 38939 - protein, 8 aa, Borrelia burgdorferi B31
FGDVKSLT

SEQ ID NO: 38940 - protein, 8 aa, Borrelia burgdorferi B31
GDVKSLTE

SEQ ID NO: 38941 - protein, 8 aa, Borrelia burgdorferi B31
DVKSLTEI

SEQ ID NO: 38942 - protein, 8 aa, Borrelia burgdorferi B31
VKSLTEID

SEQ ID NO: 38943 - protein, 8 aa, Borrelia burgdorferi B31
KSLTEIDS

SEQ ID NO: 38944 - protein, 8 aa, Borrelia burgdorferi B31
SLTEIDSG

SEQ ID NO: 38945 - protein, 8 aa, Borrelia burgdorferi B31
LTEIDSGN

SEQ ID NO: 38946 - protein, 8 aa, Borrelia burgdorferi B31
TEIDSGNG

SEQ ID NO: 38947 - protein, 8 aa, Borrelia burgdorferi B31
EIDSGNGI

SEQ ID NO: 38948 - protein, 8 aa, Borrelia burgdorferi B31
IDSGNGIP

SEQ ID NO: 38949 - protein, 8 aa, Borrelia burgdorferi B31
DSGNGIPL

SEQ ID NO: 38950 - protein, 8 aa, Borrelia burgdorferi B31
SGNGIPLV

SEQ ID NO: 38951 - protein, 8 aa, Borrelia burgdorferi B31
GNGIPLVV

SEQ ID NO: 38952 - protein, 8 aa, Borrelia burgdorferi B31
NGIPLVVS

SEQ ID NO: 38953 - protein, 8 aa, Borrelia burgdorferi B31
GIPLVVSD

SEQ ID NO: 38954 - protein, 8 aa, Borrelia burgdorferi B31
IPLVVSDV

SEQ ID NO: 38955 - protein, 8 aa, Borrelia burgdorferi B31
PLVVSDVV

SEQ ID NO: 38956 - protein, 8 aa, Borrelia burgdorferi B31
LVVSDVVK

SEQ ID NO: 38957 - protein, 8 aa, Borrelia burgdorferi B31
VVSDVVKD

SEQ ID NO: 38958 - protein, 8 aa, Borrelia burgdorferi B31
VSDVVKDL

SEQ ID NO: 38959 - protein, 8 aa, Borrelia burgdorferi B31
SDVVKDLI

SEQ ID NO: 38960 - protein, 8 aa, Borrelia burgdorferi B31
DVVKDLIP

SEQ ID NO: 38961 - protein, 8 aa, Borrelia burgdorferi B31
VVKDLIPK

SEQ ID NO: 38962 - protein, 8 aa, Borrelia burgdorferi B31
VKDLIPKE

SEQ ID NO: 38963 - protein, 8 aa, Borrelia burgdorferi B31
KDLIPKEI

SEQ ID NO: 38964 - protein, 8 aa, Borrelia burgdorferi B31
DLIPKEIS

SEQ ID NO: 38965 - protein, 8 aa, Borrelia burgdorferi B31
LIPKEISL

SEQ ID NO: 38966 - protein, 8 aa, Borrelia burgdorferi B31
IPKEISLT

SEQ ID NO: 38967 - protein, 8 aa, Borrelia burgdorferi B31
PKEISLTP

SEQ ID NO: 38968 - protein, 8 aa, Borrelia burgdorferi B31
KEISLTPE

SEQ ID NO: 38969 - protein, 8 aa, Borrelia burgdorferi B31
EISLTPEE

SEQ ID NO: 38970 - protein, 8 aa, Borrelia burgdorferi B31
ISLTPEEA

SEQ ID NO: 38971 - protein, 8 aa, Borrelia burgdorferi B31
SLTPEEAE

SEQ ID NO: 38972 - protein, 8 aa, Borrelia burgdorferi B31
LTPEEAEK

SEQ ID NO: 38973 - protein, 8 aa, Borrelia burgdorferi B31
TPEEAEKL

SEQ ID NO: 38974 - protein, 8 aa, Borrelia burgdorferi B31
PEEAEKLE

SEQ ID NO: 38975 - protein, 8 aa, Borrelia burgdorferi B31
EEAEKLES

SEQ ID NO: 38976 - protein, 8 aa, Borrelia burgdorferi B31
EAEKLESL

SEQ ID NO: 38977 - protein, 8 aa, Borrelia burgdorferi B31
AEKLESLK

SEQ ID NO: 38978 - protein, 8 aa, Borrelia burgdorferi B31
EKLESLKV

SEQ ID NO: 38979 - protein, 8 aa, Borrelia burgdorferi B31
KLESLKVF

SEQ ID NO: 38980 - protein, 8 aa, Borrelia burgdorferi B31
LESLKVFL

SEQ ID NO: 38981 - protein, 8 aa, Borrelia burgdorferi B31
ESLKVFLK

SEQ ID NO: 38982 - protein, 8 aa, Borrelia burgdorferi B31
SLKVFLKD

SEQ ID NO: 38983 - protein, 8 aa, Borrelia burgdorferi B31
LKVFLKDA

SEQ ID NO: 38984 - protein, 8 aa, Borrelia burgdorferi B31
KVFLKDAM

SEQ ID NO: 38985 - protein, 8 aa, Borrelia burgdorferi B31
VFLKDAMS

SEQ ID NO: 38986 - protein, 8 aa, Borrelia burgdorferi B31
FLKDAMSV

SEQ ID NO: 38987 - protein, 8 aa, Borrelia burgdorferi B31
LKDAMSVN

SEQ ID NO: 38988 - protein, 8 aa, Borrelia burgdorferi B31
KDAMSVNG

SEQ ID NO: 38989 - protein, 8 aa, Borrelia burgdorferi B31
DAMSVNGR

SEQ ID NO: 38990 - protein, 8 aa, Borrelia burgdorferi B31
AMSVNGRE

SEQ ID NO: 38991 - protein, 8 aa, Borrelia burgdorferi B31
MSVNGREE

SEQ ID NO: 38992 - protein, 8 aa, Borrelia burgdorferi B31
SVNGREEA

SEQ ID NO: 38993 - protein, 8 aa, Borrelia burgdorferi B31
VNGREEAL

SEQ ID NO: 38994 - protein, 8 aa, Borrelia burgdorferi B31
NGREEALK

SEQ ID NO: 38995 - protein, 8 aa, Borrelia burgdorferi B31
GREEALKA

SEQ ID NO: 38996 - protein, 8 aa, Borrelia burgdorferi B31
REEALKAE

SEQ ID NO: 38997 - protein, 8 aa, Borrelia burgdorferi B31
EEALKAEY

SEQ ID NO: 38998 - protein, 8 aa, Borrelia burgdorferi B31
EALKAEYE

SEQ ID NO: 38999 - protein, 8 aa, Borrelia burgdorferi B31
ALKAEYEK

SEQ ID NO: 39000 - protein, 8 aa, Borrelia burgdorferi B31
LKAEYEKS

SEQ ID NO: 39001 - protein, 8 aa, Borrelia burgdorferi B31
KAEYEKSY

SEQ ID NO: 39002 - protein, 8 aa, Borrelia burgdorferi B31
AEYEKSYK

SEQ ID NO: 39003 - protein, 8 aa, Borrelia burgdorferi B31
EYEKSYKE

SEQ ID NO: 39004 - protein, 8 aa, Borrelia burgdorferi B31
YEKSYKEF

SEQ ID NO: 39005 - protein, 8 aa, Borrelia burgdorferi B31
EKSYKEFF

SEQ ID NO: 39006 - protein, 8 aa, Borrelia burgdorferi B31
KSYKEFFD

SEQ ID NO: 39007 - protein, 8 aa, Borrelia burgdorferi B31
SYKEFFDW

SEQ ID NO: 39008 - protein, 8 aa, Borrelia burgdorferi B31
YKEFFDWL

SEQ ID NO: 39009 - protein, 8 aa, Borrelia burgdorferi B31
KEFFDWLS

SEQ ID NO: 39010 - protein, 8 aa, Borrelia burgdorferi B31
EFFDWLSK

SEQ ID NO: 39011 - protein, 8 aa, Borrelia burgdorferi B31
FFDWLSKD

SEQ ID NO: 39012 - protein, 8 aa, Borrelia burgdorferi B31
FDWLSKDV

SEQ ID NO: 39013 - protein, 8 aa, Borrelia burgdorferi B31
DWLSKDVN

SEQ ID NO: 39014 - protein, 8 aa, Borrelia burgdorferi B31
WLSKDVNR

SEQ ID NO: 39015 - protein, 8 aa, Borrelia burgdorferi B31
LSKDVNRQ

SEQ ID NO: 39016 - protein, 8 aa, Borrelia burgdorferi B31
SKDVNRQK

SEQ ID NO: 39017 - protein, 8 aa, Borrelia burgdorferi B31
KDVNRQKE

SEQ ID NO: 39018 - protein, 8 aa, Borrelia burgdorferi B31
DVNRQKEF

SEQ ID NO: 39019 - protein, 8 aa, Borrelia burgdorferi B31
VNRQKEFI

SEQ ID NO: 39020 - protein, 8 aa, Borrelia burgdorferi B31
NRQKEFIS

SEQ ID NO: 39021 - protein, 8 aa, Borrelia burgdorferi B31
RQKEFISS

SEQ ID NO: 39022 - protein, 8 aa, Borrelia burgdorferi B31
QKEFISSF

SEQ ID NO: 39023 - protein, 8 aa, Borrelia burgdorferi B31
KEFISSFD

SEQ ID NO: 39024 - protein, 8 aa, Borrelia burgdorferi B31
EFISSFDN

SEQ ID NO: 39025 - protein, 8 aa, Borrelia burgdorferi B31
FISSFDNI

SEQ ID NO: 39026 - protein, 8 aa, Borrelia burgdorferi B31
ISSFDNIS

SEQ ID NO: 39027 - protein, 8 aa, Borrelia burgdorferi B31
SSFDNISS

SEQ ID NO: 39028 - protein, 8 aa, Borrelia burgdorferi B31
SFDNISSI

SEQ ID NO: 39029 - protein, 8 aa, Borrelia burgdorferi B31
FDNISSIV

SEQ ID NO: 39030 - protein, 8 aa, Borrelia burgdorferi B31
DNISSIVS

SEQ ID NO: 39031 - protein, 8 aa, Borrelia burgdorferi B31
NISSIVSK

SEQ ID NO: 39032 - protein, 8 aa, Borrelia burgdorferi B31
ISSIVSKA

SEQ ID NO: 39033 - protein, 8 aa, Borrelia burgdorferi B31
SSIVSKAV

SEQ ID NO: 39034 - protein, 8 aa, Borrelia burgdorferi B31
SIVSKAVD

SEQ ID NO: 39035 - protein, 8 aa, Borrelia burgdorferi B31
IVSKAVDA

SEQ ID NO: 39036 - protein, 8 aa, Borrelia burgdorferi B31
VSKAVDAS

SEQ ID NO: 39037 - protein, 8 aa, Borrelia burgdorferi B31
SKAVDASK

SEQ ID NO: 39038 - protein, 8 aa, Borrelia burgdorferi B31
KAVDASKK

SEQ ID NO: 39039 - protein, 8 aa, Borrelia burgdorferi B31
AVDASKKR

SEQ ID NO: 39040 - protein, 8 aa, Borrelia burgdorferi B31
VDASKKRR

SEQ ID NO: 39041 - protein, 8 aa, Borrelia burgdorferi B31
DASKKRRP

SEQ ID NO: 39042 - protein, 8 aa, Borrelia burgdorferi B31
ASKKRRPT

SEQ ID NO: 39043 - protein, 8 aa, Borrelia burgdorferi B31
SKKRRPTE

SEQ ID NO: 39044 - protein, 8 aa, Borrelia burgdorferi B31
KKRRPTEQ

SEQ ID NO: 39045 - protein, 8 aa, Borrelia burgdorferi B31
KRRPTEQQ

SEQ ID NO: 39046 - protein, 8 aa, Borrelia burgdorferi B31
RRPTEQQS

SEQ ID NO: 39047 - protein, 8 aa, Borrelia burgdorferi B31
RPTEQQSL

SEQ ID NO: 39048 - protein, 8 aa, Borrelia burgdorferi B31
PTEQQSLG

SEQ ID NO: 39049 - protein, 8 aa, Borrelia burgdorferi B31
TEQQSLGF

SEQ ID NO: 39050 - protein, 8 aa, Borrelia burgdorferi B31
EQQSLGFK

SEQ ID NO: 39051 - protein, 8 aa, Borrelia burgdorferi B31
QQSLGFKE

SEQ ID NO: 39052 - protein, 8 aa, Borrelia burgdorferi B31
QSLGFKEY

SEQ ID NO: 39053 - protein, 8 aa, Borrelia burgdorferi B31
SLGFKEYV

SEQ ID NO: 39054 - protein, 8 aa, Borrelia burgdorferi B31
LGFKEYVC

SEQ ID NO: 39055 - protein, 8 aa, Borrelia burgdorferi B31
GFKEYVCY

SEQ ID NO: 39056 - protein, 8 aa, Borrelia burgdorferi B31
FKEYVCYK

SEQ ID NO: 39057 - protein, 8 aa, Borrelia burgdorferi B31
KEYVCYKI

SEQ ID NO: 39058 - protein, 8 aa, Borrelia burgdorferi B31
EYVCYKIK

SEQ ID NO: 39059 - protein, 8 aa, Borrelia burgdorferi B31
YVCYKIKN

SEQ ID NO: 39060 - protein, 8 aa, Borrelia burgdorferi B31
VCYKIKNS

SEQ ID NO: 39061 - protein, 8 aa, Borrelia burgdorferi B31
CYKIKNSK

SEQ ID NO: 39062 - protein, 8 aa, Borrelia burgdorferi B31
YKIKNSKG

SEQ ID NO: 39063 - protein, 8 aa, Borrelia burgdorferi B31
KIKNSKGE

SEQ ID NO: 39064 - protein, 8 aa, Borrelia burgdorferi B31
IKNSKGEA

SEQ ID NO: 39065 - protein, 8 aa, Borrelia burgdorferi B31
KNSKGEAL

SEQ ID NO: 39066 - protein, 8 aa, Borrelia burgdorferi B31
NSKGEALS

SEQ ID NO: 39067 - protein, 8 aa, Borrelia burgdorferi B31
SKGEALSL

SEQ ID NO: 39068 - protein, 8 aa, Borrelia burgdorferi B31
KGEALSLF

SEQ ID NO: 39069 - protein, 8 aa, Borrelia burgdorferi B31
GEALSLFF

SEQ ID NO: 39070 - protein, 8 aa, Borrelia burgdorferi B31
EALSLFFQ

SEQ ID NO: 39071 - protein, 8 aa, Borrelia burgdorferi B31
ALSLFFQK

SEQ ID NO: 39072 - protein, 8 aa, Borrelia burgdorferi B31
LSLFFQKV

SEQ ID NO: 39073 - protein, 8 aa, Borrelia burgdorferi B31
SLFFQKVV

SEQ ID NO: 39074 - protein, 8 aa, Borrelia burgdorferi B31
LFFQKVVD

SEQ ID NO: 39075 - protein, 8 aa, Borrelia burgdorferi B31
FFQKVVDA

SEQ ID NO: 39076 - protein, 8 aa, Borrelia burgdorferi B31
FQKVVDAF

SEQ ID NO: 39077 - protein, 8 aa, Borrelia burgdorferi B31
QKVVDAFG

SEQ ID NO: 39078 - protein, 8 aa, Borrelia burgdorferi B31
KVVDAFGA

SEQ ID NO: 39079 - protein, 8 aa, Borrelia burgdorferi B31
VVDAFGAD

SEQ ID NO: 39080 - protein, 8 aa, Borrelia burgdorferi B31
VDAFGADP

SEQ ID NO: 39081 - protein, 8 aa, Borrelia burgdorferi B31
DAFGADPY

SEQ ID NO: 39082 - protein, 8 aa, Borrelia burgdorferi B31
AFGADPYK

SEQ ID NO: 39083 - protein, 8 aa, Borrelia burgdorferi B31
FGADPYKK

SEQ ID NO: 39084 - protein, 8 aa, Borrelia burgdorferi B31
GADPYKKD

SEQ ID NO: 39085 - protein, 8 aa, Borrelia burgdorferi B31
ADPYKKDN

SEQ ID NO: 39086 - protein, 8 aa, Borrelia burgdorferi B31
DPYKKDND

SEQ ID NO: 39087 - protein, 8 aa, Borrelia burgdorferi B31
PYKKDNDE

SEQ ID NO: 39088 - protein, 8 aa, Borrelia burgdorferi B31
YKKDNDES

SEQ ID NO: 39089 - protein, 8 aa, Borrelia burgdorferi B31
KKDNDESV

SEQ ID NO: 39090 - protein, 8 aa, Borrelia burgdorferi B31
KDNDESVQ

SEQ ID NO: 39091 - protein, 8 aa, Borrelia burgdorferi B31
DNDESVQK

SEQ ID NO: 39092 - protein, 8 aa, Borrelia burgdorferi B31
NDESVQKP

SEQ ID NO: 39093 - protein, 8 aa, Borrelia burgdorferi B31
DESVQKPV

SEQ ID NO: 39094 - protein, 8 aa, Borrelia burgdorferi B31
ESVQKPVK

SEQ ID NO: 39095 - protein, 8 aa, Borrelia burgdorferi B31
SVQKPVKC

SEQ ID NO: 39096 - protein, 8 aa, Borrelia burgdorferi B31
VQKPVKCN

SEQ ID NO: 39097 - protein, 8 aa, Borrelia burgdorferi B31
QKPVKCNE

SEQ ID NO: 39098 - protein, 8 aa, Borrelia burgdorferi B31
KPVKCNEE

SEQ ID NO: 39099 - protein, 8 aa, Borrelia burgdorferi B31
PVKCNEEI

SEQ ID NO: 39100 - protein, 8 aa, Borrelia burgdorferi B31
VKCNEEIF

SEQ ID NO: 39101 - protein, 8 aa, Borrelia burgdorferi B31
KCNEEIFK

SEQ ID NO: 39102 - protein, 8 aa, Borrelia burgdorferi B31
CNEEIFKV

SEQ ID NO: 39103 - protein, 8 aa, Borrelia burgdorferi B31
NEEIFKVI

SEQ ID NO: 39104 - protein, 8 aa, Borrelia burgdorferi B31
EEIFKVIK

SEQ ID NO: 39105 - protein, 8 aa, Borrelia burgdorferi B31
EIFKVIKK

SEQ ID NO: 39106 - protein, 8 aa, Borrelia burgdorferi B31
IFKVIKKV

SEQ ID NO: 39107 - protein, 8 aa, Borrelia burgdorferi B31
FKVIKKVL

SEQ ID NO: 39108 - protein, 8 aa, Borrelia burgdorferi B31
KVIKKVLT

SEQ ID NO: 39109 - protein, 8 aa, Borrelia burgdorferi B31
VIKKVLTE

SEQ ID NO: 39110 - protein, 8 aa, Borrelia burgdorferi B31
IKKVLTES

SEQ ID NO: 39111 - protein, 8 aa, Borrelia burgdorferi B31
KKVLTESE

SEQ ID NO: 39112 - protein, 8 aa, Borrelia burgdorferi B31
KVLTESES

SEQ ID NO: 39113 - protein, 8 aa, Borrelia burgdorferi B31
VLTESESN

SEQ ID NO: 39114 - protein, 8 aa, Borrelia burgdorferi B31
LTESESNN

SEQ ID NO: 39115 - protein, 8 aa, Borrelia burgdorferi B31
TESESNNE

SEQ ID NO: 39116 - protein, 8 aa, Borrelia burgdorferi B31
ESESNNEL

SEQ ID NO: 39117 - protein, 8 aa, Borrelia burgdorferi B31
SESNNELK

SEQ ID NO: 39118 - protein, 8 aa, Borrelia burgdorferi B31
ESNNELKN

SEQ ID NO: 39119 - protein, 8 aa, Borrelia burgdorferi B31
SNNELKNL

SEQ ID NO: 39120 - protein, 8 aa, Borrelia burgdorferi B31
NNELKNLK

SEQ ID NO: 39121 - protein, 8 aa, Borrelia burgdorferi B31
NELKNLKN

SEQ ID NO: 39122 - protein, 8 aa, Borrelia burgdorferi B31
ELKNLKNY

SEQ ID NO: 39123 - protein, 8 aa, Borrelia burgdorferi B31
LKNLKNYG

SEQ ID NO: 39124 - protein, 8 aa, Borrelia burgdorferi B31
KNLKNYGN

SEQ ID NO: 39125 - protein, 8 aa, Borrelia burgdorferi B31
NLKNYGNV

SEQ ID NO: 39126 - protein, 9 aa, Borrelia burgdorferi B31
MMQRISILL

SEQ ID NO: 39127 - protein, 9 aa, Borrelia burgdorferi B31
MQRISILLM

SEQ ID NO: 39128 - protein, 9 aa, Borrelia burgdorferi B31
QRISILLML

SEQ ID NO: 39129 - protein, 9 aa, Borrelia burgdorferi B31
RISILLMLL

SEQ ID NO: 39130 - protein, 9 aa, Borrelia burgdorferi B31
ISILLMLLA

SEQ ID NO: 39131 - protein, 9 aa, Borrelia burgdorferi B31
SILLMLLAV

SEQ ID NO: 39132 - protein, 9 aa, Borrelia burgdorferi B31
ILLMLLAVF

SEQ ID NO: 39133 - protein, 9 aa, Borrelia burgdorferi B31
LLMLLAVFS

SEQ ID NO: 39134 - protein, 9 aa, Borrelia burgdorferi B31
LMLLAVFSC

SEQ ID NO: 39135 - protein, 9 aa, Borrelia burgdorferi B31
MLLAVFSCK

SEQ ID NO: 39136 - protein, 9 aa, Borrelia burgdorferi B31
LLAVFSCKQ

SEQ ID NO: 39137 - protein, 9 aa, Borrelia burgdorferi B31
LAVFSCKQF

SEQ ID NO: 39138 - protein, 9 aa, Borrelia burgdorferi B31
AVFSCKQFG

SEQ ID NO: 39139 - protein, 9 aa, Borrelia burgdorferi B31
VFSCKQFGD

SEQ ID NO: 39140 - protein, 9 aa, Borrelia burgdorferi B31
FSCKQFGDV

SEQ ID NO: 39141 - protein, 9 aa, Borrelia burgdorferi B31
SCKQFGDVK

SEQ ID NO: 39142 - protein, 9 aa, Borrelia burgdorferi B31
CKQFGDVKS

SEQ ID NO: 39143 - protein, 9 aa, Borrelia burgdorferi B31
KQFGDVKSL

SEQ ID NO: 39144 - protein, 9 aa, Borrelia burgdorferi B31
QFGDVKSLT

SEQ ID NO: 39145 - protein, 9 aa, Borrelia burgdorferi B31
FGDVKSLTE

SEQ ID NO: 39146 - protein, 9 aa, Borrelia burgdorferi B31
GDVKSLTEI

SEQ ID NO: 39147 - protein, 9 aa, Borrelia burgdorferi B31
DVKSLTEID

SEQ ID NO: 39148 - protein, 9 aa, Borrelia burgdorferi B31
VKSLTEIDS

SEQ ID NO: 39149 - protein, 9 aa, Borrelia burgdorferi B31
KSLTEIDSG

SEQ ID NO: 39150 - protein, 9 aa, Borrelia burgdorferi B31
SLTEIDSGN

SEQ ID NO: 39151 - protein, 9 aa, Borrelia burgdorferi B31
LTEIDSGNG

SEQ ID NO: 39152 - protein, 9 aa, Borrelia burgdorferi B31
TEIDSGNGI

SEQ ID NO: 39153 - protein, 9 aa, Borrelia burgdorferi B31
EIDSGNGIP

SEQ ID NO: 39154 - protein, 9 aa, Borrelia burgdorferi B31
IDSGNGIPL

SEQ ID NO: 39155 - protein, 9 aa, Borrelia burgdorferi B31
DSGNGIPLV

SEQ ID NO: 39156 - protein, 9 aa, Borrelia burgdorferi B31
SGNGIPLVV

SEQ ID NO: 39157 - protein, 9 aa, Borrelia burgdorferi B31
GNGIPLVVS

SEQ ID NO: 39158 - protein, 9 aa, Borrelia burgdorferi B31
NGIPLVVSD

SEQ ID NO: 39159 - protein, 9 aa, Borrelia burgdorferi B31
GIPLVVSDV

SEQ ID NO: 39160 - protein, 9 aa, Borrelia burgdorferi B31
IPLVVSDVV

SEQ ID NO: 39161 - protein, 9 aa, Borrelia burgdorferi B31
PLVVSDVVK

SEQ ID NO: 39162 - protein, 9 aa, Borrelia burgdorferi B31
LVVSDVVKD

SEQ ID NO: 39163 - protein, 9 aa, Borrelia burgdorferi B31
VVSDVVKDL

SEQ ID NO: 39164 - protein, 9 aa, Borrelia burgdorferi B31
VSDVVKDLI

SEQ ID NO: 39165 - protein, 9 aa, Borrelia burgdorferi B31
SDVVKDLIP

SEQ ID NO: 39166 - protein, 9 aa, Borrelia burgdorferi B31
DVVKDLIPK

SEQ ID NO: 39167 - protein, 9 aa, Borrelia burgdorferi B31
VVKDLIPKE

SEQ ID NO: 39168 - protein, 9 aa, Borrelia burgdorferi B31
VKDLIPKEI

SEQ ID NO: 39169 - protein, 9 aa, Borrelia burgdorferi B31
KDLIPKEIS

SEQ ID NO: 39170 - protein, 9 aa, Borrelia burgdorferi B31
DLIPKEISL

SEQ ID NO: 39171 - protein, 9 aa, Borrelia burgdorferi B31
LIPKEISLT

SEQ ID NO: 39172 - protein, 9 aa, Borrelia burgdorferi B31
IPKEISLTP

SEQ ID NO: 39173 - protein, 9 aa, Borrelia burgdorferi B31
PKEISLTPE

SEQ ID NO: 39174 - protein, 9 aa, Borrelia burgdorferi B31
KEISLTPEE

SEQ ID NO: 39175 - protein, 9 aa, Borrelia burgdorferi B31
EISLTPEEA

SEQ ID NO: 39176 - protein, 9 aa, Borrelia burgdorferi B31
ISLTPEEAE

SEQ ID NO: 39177 - protein, 9 aa, Borrelia burgdorferi B31
SLTPEEAEK

SEQ ID NO: 39178 - protein, 9 aa, Borrelia burgdorferi B31
LTPEEAEKL

SEQ ID NO: 39179 - protein, 9 aa, Borrelia burgdorferi B31
TPEEAEKLE

SEQ ID NO: 39180 - protein, 9 aa, Borrelia burgdorferi B31
PEEAEKLES

SEQ ID NO: 39181 - protein, 9 aa, Borrelia burgdorferi B31
EEAEKLESL

SEQ ID NO: 39182 - protein, 9 aa, Borrelia burgdorferi B31
EAEKLESLK

SEQ ID NO: 39183 - protein, 9 aa, Borrelia burgdorferi B31
AEKLESLKV

SEQ ID NO: 39184 - protein, 9 aa, Borrelia burgdorferi B31
EKLESLKVF

SEQ ID NO: 39185 - protein, 9 aa, Borrelia burgdorferi B31
KLESLKVFL

SEQ ID NO: 39186 - protein, 9 aa, Borrelia burgdorferi B31
LESLKVFLK

SEQ ID NO: 39187 - protein, 9 aa, Borrelia burgdorferi B31
ESLKVFLKD

SEQ ID NO: 39188 - protein, 9 aa, Borrelia burgdorferi B31
SLKVFLKDA

SEQ ID NO: 39189 - protein, 9 aa, Borrelia burgdorferi B31
LKVFLKDAM

SEQ ID NO: 39190 - protein, 9 aa, Borrelia burgdorferi B31
KVFLKDAMS

SEQ ID NO: 39191 - protein, 9 aa, Borrelia burgdorferi B31
VFLKDAMSV

SEQ ID NO: 39192 - protein, 9 aa, Borrelia burgdorferi B31
FLKDAMSVN

SEQ ID NO: 39193 - protein, 9 aa, Borrelia burgdorferi B31
LKDAMSVNG

SEQ ID NO: 39194 - protein, 9 aa, Borrelia burgdorferi B31
KDAMSVNGR

SEQ ID NO: 39195 - protein, 9 aa, Borrelia burgdorferi B31
DAMSVNGRE

SEQ ID NO: 39196 - protein, 9 aa, Borrelia burgdorferi B31
AMSVNGREE

SEQ ID NO: 39197 - protein, 9 aa, Borrelia burgdorferi B31
MSVNGREEA

SEQ ID NO: 39198 - protein, 9 aa, Borrelia burgdorferi B31
SVNGREEAL

SEQ ID NO: 39199 - protein, 9 aa, Borrelia burgdorferi B31
VNGREEALK

SEQ ID NO: 39200 - protein, 9 aa, Borrelia burgdorferi B31
NGREEALKA

SEQ ID NO: 39201 - protein, 9 aa, Borrelia burgdorferi B31
GREEALKAE

SEQ ID NO: 39202 - protein, 9 aa, Borrelia burgdorferi B31
REEALKAEY

SEQ ID NO: 39203 - protein, 9 aa, Borrelia burgdorferi B31
EEALKAEYE

SEQ ID NO: 39204 - protein, 9 aa, Borrelia burgdorferi B31
EALKAEYEK

SEQ ID NO: 39205 - protein, 9 aa, Borrelia burgdorferi B31
ALKAEYEKS

SEQ ID NO: 39206 - protein, 9 aa, Borrelia burgdorferi B31
LKAEYEKSY

SEQ ID NO: 39207 - protein, 9 aa, Borrelia burgdorferi B31
KAEYEKSYK

SEQ ID NO: 39208 - protein, 9 aa, Borrelia burgdorferi B31
AEYEKSYKE

SEQ ID NO: 39209 - protein, 9 aa, Borrelia burgdorferi B31
EYEKSYKEF

SEQ ID NO: 39210 - protein, 9 aa, Borrelia burgdorferi B31
YEKSYKEFF

SEQ ID NO: 39211 - protein, 9 aa, Borrelia burgdorferi B31
EKSYKEFFD

SEQ ID NO: 39212 - protein, 9 aa, Borrelia burgdorferi B31
KSYKEFFDW

SEQ ID NO: 39213 - protein, 9 aa, Borrelia burgdorferi B31
SYKEFFDWL

SEQ ID NO: 39214 - protein, 9 aa, Borrelia burgdorferi B31
YKEFFDWLS

SEQ ID NO: 39215 - protein, 9 aa, Borrelia burgdorferi B31
KEFFDWLSK

SEQ ID NO: 39216 - protein, 9 aa, Borrelia burgdorferi B31
EFFDWLSKD

SEQ ID NO: 39217 - protein, 9 aa, Borrelia burgdorferi B31
FFDWLSKDV

SEQ ID NO: 39218 - protein, 9 aa, Borrelia burgdorferi B31
FDWLSKDVN

SEQ ID NO: 39219 - protein, 9 aa, Borrelia burgdorferi B31
DWLSKDVNR

SEQ ID NO: 39220 - protein, 9 aa, Borrelia burgdorferi B31
WLSKDVNRQ

SEQ ID NO: 39221 - protein, 9 aa, Borrelia burgdorferi B31
LSKDVNRQK

SEQ ID NO: 39222 - protein, 9 aa, Borrelia burgdorferi B31
SKDVNRQKE

SEQ ID NO: 39223 - protein, 9 aa, Borrelia burgdorferi B31
KDVNRQKEF

SEQ ID NO: 39224 - protein, 9 aa, Borrelia burgdorferi B31
DVNRQKEFI

SEQ ID NO: 39225 - protein, 9 aa, Borrelia burgdorferi B31
VNRQKEFIS

SEQ ID NO: 39226 - protein, 9 aa, Borrelia burgdorferi B31
NRQKEFISS

SEQ ID NO: 39227 - protein, 9 aa, Borrelia burgdorferi B31
RQKEFISSF

SEQ ID NO: 39228 - protein, 9 aa, Borrelia burgdorferi B31
QKEFISSFD

SEQ ID NO: 39229 - protein, 9 aa, Borrelia burgdorferi B31
KEFISSFDN

SEQ ID NO: 39230 - protein, 9 aa, Borrelia burgdorferi B31
EFISSFDNI

SEQ ID NO: 39231 - protein, 9 aa, Borrelia burgdorferi B31
FISSFDNIS

SEQ ID NO: 39232 - protein, 9 aa, Borrelia burgdorferi B31
ISSFDNISS

SEQ ID NO: 39233 - protein, 9 aa, Borrelia burgdorferi B31
SSFDNISSI

SEQ ID NO: 39234 - protein, 9 aa, Borrelia burgdorferi B31
SFDNISSIV

SEQ ID NO: 39235 - protein, 9 aa, Borrelia burgdorferi B31
FDNISSIVS

SEQ ID NO: 39236 - protein, 9 aa, Borrelia burgdorferi B31
DNISSIVSK

SEQ ID NO: 39237 - protein, 9 aa, Borrelia burgdorferi B31
NISSIVSKA

SEQ ID NO: 39238 - protein, 9 aa, Borrelia burgdorferi B31
ISSIVSKAV

SEQ ID NO: 39239 - protein, 9 aa, Borrelia burgdorferi B31
SSIVSKAVD

SEQ ID NO: 39240 - protein, 9 aa, Borrelia burgdorferi B31
SIVSKAVDA

SEQ ID NO: 39241 - protein, 9 aa, Borrelia burgdorferi B31
IVSKAVDAS

SEQ ID NO: 39242 - protein, 9 aa, Borrelia burgdorferi B31
VSKAVDASK

SEQ ID NO: 39243 - protein, 9 aa, Borrelia burgdorferi B31
SKAVDASKK

SEQ ID NO: 39244 - protein, 9 aa, Borrelia burgdorferi B31
KAVDASKKR

SEQ ID NO: 39245 - protein, 9 aa, Borrelia burgdorferi B31
AVDASKKRR

SEQ ID NO: 39246 - protein, 9 aa, Borrelia burgdorferi B31
VDASKKRRP

SEQ ID NO: 39247 - protein, 9 aa, Borrelia burgdorferi B31
DASKKRRPT

SEQ ID NO: 39248 - protein, 9 aa, Borrelia burgdorferi B31
ASKKRRPTE

SEQ ID NO: 39249 - protein, 9 aa, Borrelia burgdorferi B31
SKKRRPTEQ

SEQ ID NO: 39250 - protein, 9 aa, Borrelia burgdorferi B31
KKRRPTEQQ

SEQ ID NO: 39251 - protein, 9 aa, Borrelia burgdorferi B31
KRRPTEQQS

SEQ ID NO: 39252 - protein, 9 aa, Borrelia burgdorferi B31
RRPTEQQSL

SEQ ID NO: 39253 - protein, 9 aa, Borrelia burgdorferi B31
RPTEQQSLG

SEQ ID NO: 39254 - protein, 9 aa, Borrelia burgdorferi B31
PTEQQSLGF

SEQ ID NO: 39255 - protein, 9 aa, Borrelia burgdorferi B31
TEQQSLGFK

SEQ ID NO: 39256 - protein, 9 aa, Borrelia burgdorferi B31
EQQSLGFKE

SEQ ID NO: 39257 - protein, 9 aa, Borrelia burgdorferi B31
QQSLGFKEY

SEQ ID NO: 39258 - protein, 9 aa, Borrelia burgdorferi B31
QSLGFKEYV

SEQ ID NO: 39259 - protein, 9 aa, Borrelia burgdorferi B31
SLGFKEYVC

SEQ ID NO: 39260 - protein, 9 aa, Borrelia burgdorferi B31
LGFKEYVCY

SEQ ID NO: 39261 - protein, 9 aa, Borrelia burgdorferi B31
GFKEYVCYK

SEQ ID NO: 39262 - protein, 9 aa, Borrelia burgdorferi B31
FKEYVCYKI

SEQ ID NO: 39263 - protein, 9 aa, Borrelia burgdorferi B31
KEYVCYKIK

SEQ ID NO: 39264 - protein, 9 aa, Borrelia burgdorferi B31
EYVCYKIKN

SEQ ID NO: 39265 - protein, 9 aa, Borrelia burgdorferi B31
YVCYKIKNS

SEQ ID NO: 39266 - protein, 9 aa, Borrelia burgdorferi B31
VCYKIKNSK

SEQ ID NO: 39267 - protein, 9 aa, Borrelia burgdorferi B31
CYKIKNSKG

SEQ ID NO: 39268 - protein, 9 aa, Borrelia burgdorferi B31
YKIKNSKGE

SEQ ID NO: 39269 - protein, 9 aa, Borrelia burgdorferi B31
KIKNSKGEA

SEQ ID NO: 39270 - protein, 9 aa, Borrelia burgdorferi B31
IKNSKGEAL

SEQ ID NO: 39271 - protein, 9 aa, Borrelia burgdorferi B31
KNSKGEALS

SEQ ID NO: 39272 - protein, 9 aa, Borrelia burgdorferi B31
NSKGEALSL

SEQ ID NO: 39273 - protein, 9 aa, Borrelia burgdorferi B31
SKGEALSLF

SEQ ID NO: 39274 - protein, 9 aa, Borrelia burgdorferi B31
KGEALSLFF

SEQ ID NO: 39275 - protein, 9 aa, Borrelia burgdorferi B31
GEALSLFFQ

SEQ ID NO: 39276 - protein, 9 aa, Borrelia burgdorferi B31
EALSLFFQK

SEQ ID NO: 39277 - protein, 9 aa, Borrelia burgdorferi B31
ALSLFFQKV

SEQ ID NO: 39278 - protein, 9 aa, Borrelia burgdorferi B31
LSLFFQKVV

SEQ ID NO: 39279 - protein, 9 aa, Borrelia burgdorferi B31
SLFFQKVVD

SEQ ID NO: 39280 - protein, 9 aa, Borrelia burgdorferi B31
LFFQKVVDA

SEQ ID NO: 39281 - protein, 9 aa, Borrelia burgdorferi B31
FFQKVVDAF

SEQ ID NO: 39282 - protein, 9 aa, Borrelia burgdorferi B31
FQKVVDAFG

SEQ ID NO: 39283 - protein, 9 aa, Borrelia burgdorferi B31
QKVVDAFGA

SEQ ID NO: 39284 - protein, 9 aa, Borrelia burgdorferi B31
KVVDAFGAD

SEQ ID NO: 39285 - protein, 9 aa, Borrelia burgdorferi B31
VVDAFGADP

SEQ ID NO: 39286 - protein, 9 aa, Borrelia burgdorferi B31
VDAFGADPY

SEQ ID NO: 39287 - protein, 9 aa, Borrelia burgdorferi B31
DAFGADPYK

SEQ ID NO: 39288 - protein, 9 aa, Borrelia burgdorferi B31
AFGADPYKK

SEQ ID NO: 39289 - protein, 9 aa, Borrelia burgdorferi B31
FGADPYKKD

SEQ ID NO: 39290 - protein, 9 aa, Borrelia burgdorferi B31
GADPYKKDN

SEQ ID NO: 39291 - protein, 9 aa, Borrelia burgdorferi B31
ADPYKKDND

SEQ ID NO: 39292 - protein, 9 aa, Borrelia burgdorferi B31
DPYKKDNDE

SEQ ID NO: 39293 - protein, 9 aa, Borrelia burgdorferi B31
PYKKDNDES

SEQ ID NO: 39294 - protein, 9 aa, Borrelia burgdorferi B31
YKKDNDESV

SEQ ID NO: 39295 - protein, 9 aa, Borrelia burgdorferi B31
KKDNDESVQ

SEQ ID NO: 39296 - protein, 9 aa, Borrelia burgdorferi B31
KDNDESVQK

SEQ ID NO: 39297 - protein, 9 aa, Borrelia burgdorferi B31
DNDESVQKP

SEQ ID NO: 39298 - protein, 9 aa, Borrelia burgdorferi B31
NDESVQKPV

SEQ ID NO: 39299 - protein, 9 aa, Borrelia burgdorferi B31
DESVQKPVK

SEQ ID NO: 39300 - protein, 9 aa, Borrelia burgdorferi B31
ESVQKPVKC

SEQ ID NO: 39301 - protein, 9 aa, Borrelia burgdorferi B31
SVQKPVKCN

SEQ ID NO: 39302 - protein, 9 aa, Borrelia burgdorferi B31
VQKPVKCNE

SEQ ID NO: 39303 - protein, 9 aa, Borrelia burgdorferi B31
QKPVKCNEE

SEQ ID NO: 39304 - protein, 9 aa, Borrelia burgdorferi B31
KPVKCNEEI

SEQ ID NO: 39305 - protein, 9 aa, Borrelia burgdorferi B31
PVKCNEEIF

SEQ ID NO: 39306 - protein, 9 aa, Borrelia burgdorferi B31
VKCNEEIFK

SEQ ID NO: 39307 - protein, 9 aa, Borrelia burgdorferi B31
KCNEEIFKV

SEQ ID NO: 39308 - protein, 9 aa, Borrelia burgdorferi B31
CNEEIFKVI

SEQ ID NO: 39309 - protein, 9 aa, Borrelia burgdorferi B31
NEEIFKVIK

SEQ ID NO: 39310 - protein, 9 aa, Borrelia burgdorferi B31
EEIFKVIKK

SEQ ID NO: 39311 - protein, 9 aa, Borrelia burgdorferi B31
EIFKVIKKV

SEQ ID NO: 39312 - protein, 9 aa, Borrelia burgdorferi B31
IFKVIKKVL

SEQ ID NO: 39313 - protein, 9 aa, Borrelia burgdorferi B31
FKVIKKVLT

SEQ ID NO: 39314 - protein, 9 aa, Borrelia burgdorferi B31
KVIKKVLTE

SEQ ID NO: 39315 - protein, 9 aa, Borrelia burgdorferi B31
VIKKVLTES

SEQ ID NO: 39316 - protein, 9 aa, Borrelia burgdorferi B31
IKKVLTESE

SEQ ID NO: 39317 - protein, 9 aa, Borrelia burgdorferi B31
KKVLTESES

SEQ ID NO: 39318 - protein, 9 aa, Borrelia burgdorferi B31
KVLTESESN

SEQ ID NO: 39319 - protein, 9 aa, Borrelia burgdorferi B31
VLTESESNN

SEQ ID NO: 39320 - protein, 9 aa, Borrelia burgdorferi B31
LTESESNNE

SEQ ID NO: 39321 - protein, 9 aa, Borrelia burgdorferi B31
TESESNNEL

SEQ ID NO: 39322 - protein, 9 aa, Borrelia burgdorferi B31
ESESNNELK

SEQ ID NO: 39323 - protein, 9 aa, Borrelia burgdorferi B31
SESNNELKN

SEQ ID NO: 39324 - protein, 9 aa, Borrelia burgdorferi B31
ESNNELKNL

SEQ ID NO: 39325 - protein, 9 aa, Borrelia burgdorferi B31
SNNELKNLK

SEQ ID NO: 39326 - protein, 9 aa, Borrelia burgdorferi B31
NNELKNLKN

SEQ ID NO: 39327 - protein, 9 aa, Borrelia burgdorferi B31
NELKNLKNY

SEQ ID NO: 39328 - protein, 9 aa, Borrelia burgdorferi B31
ELKNLKNYG

SEQ ID NO: 39329 - protein, 9 aa, Borrelia burgdorferi B31
LKNLKNYGN

SEQ ID NO: 39330 - protein, 9 aa, Borrelia burgdorferi B31
KNLKNYGNV

SEQ ID NO: 39331 - protein, 10 aa, Borrelia burgdorferi B31
MMQRISILLM

SEQ ID NO: 39332 - protein, 10 aa, Borrelia burgdorferi B31
MQRISILLML

SEQ ID NO: 39333 - protein, 10 aa, Borrelia burgdorferi B31
QRISILLMLL

SEQ ID NO: 39334 - protein, 10 aa, Borrelia burgdorferi B31
RISILLMLLA

SEQ ID NO: 39335 - protein, 10 aa, Borrelia burgdorferi B31
ISILLMLLAV

SEQ ID NO: 39336 - protein, 10 aa, Borrelia burgdorferi B31
SILLMLLAVF

SEQ ID NO: 39337 - protein, 10 aa, Borrelia burgdorferi B31
ILLMLLAVFS

SEQ ID NO: 39338 - protein, 10 aa, Borrelia burgdorferi B31
LLMLLAVFSC

SEQ ID NO: 39339 - protein, 10 aa, Borrelia burgdorferi B31
LMLLAVFSCK

SEQ ID NO: 39340 - protein, 10 aa, Borrelia burgdorferi B31
MLLAVFSCKQ

SEQ ID NO: 39341 - protein, 10 aa, Borrelia burgdorferi B31
LLAVFSCKQF

SEQ ID NO: 39342 - protein, 10 aa, Borrelia burgdorferi B31
LAVFSCKQFG

SEQ ID NO: 39343 - protein, 10 aa, Borrelia burgdorferi B31
AVFSCKQFGD

SEQ ID NO: 39344 - protein, 10 aa, Borrelia burgdorferi B31
VFSCKQFGDV

SEQ ID NO: 39345 - protein, 10 aa, Borrelia burgdorferi B31
FSCKQFGDVK

SEQ ID NO: 39346 - protein, 10 aa, Borrelia burgdorferi B31
SCKQFGDVKS

SEQ ID NO: 39347 - protein, 10 aa, Borrelia burgdorferi B31
CKQFGDVKSL

SEQ ID NO: 39348 - protein, 10 aa, Borrelia burgdorferi B31
KQFGDVKSLT

SEQ ID NO: 39349 - protein, 10 aa, Borrelia burgdorferi B31
QFGDVKSLTE

SEQ ID NO: 39350 - protein, 10 aa, Borrelia burgdorferi B31
FGDVKSLTEI

SEQ ID NO: 39351 - protein, 10 aa, Borrelia burgdorferi B31
GDVKSLTEID

SEQ ID NO: 39352 - protein, 10 aa, Borrelia burgdorferi B31
DVKSLTEIDS

SEQ ID NO: 39353 - protein, 10 aa, Borrelia burgdorferi B31
VKSLTEIDSG

SEQ ID NO: 39354 - protein, 10 aa, Borrelia burgdorferi B31
KSLTEIDSGN

SEQ ID NO: 39355 - protein, 10 aa, Borrelia burgdorferi B31
SLTEIDSGNG

SEQ ID NO: 39356 - protein, 10 aa, Borrelia burgdorferi B31
LTEIDSGNGI

SEQ ID NO: 39357 - protein, 10 aa, Borrelia burgdorferi B31
TEIDSGNGIP

SEQ ID NO: 39358 - protein, 10 aa, Borrelia burgdorferi B31
EIDSGNGIPL

SEQ ID NO: 39359 - protein, 10 aa, Borrelia burgdorferi B31
IDSGNGIPLV

SEQ ID NO: 39360 - protein, 10 aa, Borrelia burgdorferi B31
DSGNGIPLVV

SEQ ID NO: 39361 - protein, 10 aa, Borrelia burgdorferi B31
SGNGIPLVVS

SEQ ID NO: 39362 - protein, 10 aa, Borrelia burgdorferi B31
GNGIPLVVSD

SEQ ID NO: 39363 - protein, 10 aa, Borrelia burgdorferi B31
NGIPLVVSDV

SEQ ID NO: 39364 - protein, 10 aa, Borrelia burgdorferi B31
GIPLVVSDVV

SEQ ID NO: 39365 - protein, 10 aa, Borrelia burgdorferi B31
IPLVVSDVVK

SEQ ID NO: 39366 - protein, 10 aa, Borrelia burgdorferi B31
PLVVSDVVKD

SEQ ID NO: 39367 - protein, 10 aa, Borrelia burgdorferi B31
LVVSDVVKDL

SEQ ID NO: 39368 - protein, 10 aa, Borrelia burgdorferi B31
VVSDVVKDLI

SEQ ID NO: 39369 - protein, 10 aa, Borrelia burgdorferi B31
VSDVVKDLIP

SEQ ID NO: 39370 - protein, 10 aa, Borrelia burgdorferi B31
SDVVKDLIPK

SEQ ID NO: 39371 - protein, 10 aa, Borrelia burgdorferi B31
DVVKDLIPKE

SEQ ID NO: 39372 - protein, 10 aa, Borrelia burgdorferi B31
VVKDLIPKEI

SEQ ID NO: 39373 - protein, 10 aa, Borrelia burgdorferi B31
VKDLIPKEIS

SEQ ID NO: 39374 - protein, 10 aa, Borrelia burgdorferi B31
KDLIPKEISL

SEQ ID NO: 39375 - protein, 10 aa, Borrelia burgdorferi B31
DLIPKEISLT

SEQ ID NO: 39376 - protein, 10 aa, Borrelia burgdorferi B31
LIPKEISLTP

SEQ ID NO: 39377 - protein, 10 aa, Borrelia burgdorferi B31
IPKEISLTPE

SEQ ID NO: 39378 - protein, 10 aa, Borrelia burgdorferi B31
PKEISLTPEE

SEQ ID NO: 39379 - protein, 10 aa, Borrelia burgdorferi B31
KEISLTPEEA

SEQ ID NO: 39380 - protein, 10 aa, Borrelia burgdorferi B31
EISLTPEEAE

SEQ ID NO: 39381 - protein, 10 aa, Borrelia burgdorferi B31
ISLTPEEAEK

SEQ ID NO: 39382 - protein, 10 aa, Borrelia burgdorferi B31
SLTPEEAEKL

SEQ ID NO: 39383 - protein, 10 aa, Borrelia burgdorferi B31
LTPEEAEKLE

SEQ ID NO: 39384 - protein, 10 aa, Borrelia burgdorferi B31
TPEEAEKLES

SEQ ID NO: 39385 - protein, 10 aa, Borrelia burgdorferi B31
PEEAEKLESL

SEQ ID NO: 39386 - protein, 10 aa, Borrelia burgdorferi B31
EEAEKLESLK

SEQ ID NO: 39387 - protein, 10 aa, Borrelia burgdorferi B31
EAEKLESLKV

SEQ ID NO: 39388 - protein, 10 aa, Borrelia burgdorferi B31
AEKLESLKVF

SEQ ID NO: 39389 - protein, 10 aa, Borrelia burgdorferi B31
EKLESLKVFL

SEQ ID NO: 39390 - protein, 10 aa, Borrelia burgdorferi B31
KLESLKVFLK

SEQ ID NO: 39391 - protein, 10 aa, Borrelia burgdorferi B31
LESLKVFLKD

SEQ ID NO: 39392 - protein, 10 aa, Borrelia burgdorferi B31
ESLKVFLKDA

SEQ ID NO: 39393 - protein, 10 aa, Borrelia burgdorferi B31
SLKVFLKDAM

SEQ ID NO: 39394 - protein, 10 aa, Borrelia burgdorferi B31
LKVFLKDAMS

SEQ ID NO: 39395 - protein, 10 aa, Borrelia burgdorferi B31
KVFLKDAMSV

SEQ ID NO: 39396 - protein, 10 aa, Borrelia burgdorferi B31
VFLKDAMSVN

SEQ ID NO: 39397 - protein, 10 aa, Borrelia burgdorferi B31
FLKDAMSVNG

SEQ ID NO: 39398 - protein, 10 aa, Borrelia burgdorferi B31
LKDAMSVNGR

SEQ ID NO: 39399 - protein, 10 aa, Borrelia burgdorferi B31
KDAMSVNGRE

SEQ ID NO: 39400 - protein, 10 aa, Borrelia burgdorferi B31
DAMSVNGREE

SEQ ID NO: 39401 - protein, 10 aa, Borrelia burgdorferi B31
AMSVNGREEA

SEQ ID NO: 39402 - protein, 10 aa, Borrelia burgdorferi B31
MSVNGREEAL

SEQ ID NO: 39403 - protein, 10 aa, Borrelia burgdorferi B31
SVNGREEALK

SEQ ID NO: 39404 - protein, 10 aa, Borrelia burgdorferi B31
VNGREEALKA

SEQ ID NO: 39405 - protein, 10 aa, Borrelia burgdorferi B31
NGREEALKAE

SEQ ID NO: 39406 - protein, 10 aa, Borrelia burgdorferi B31
GREEALKAEY

SEQ ID NO: 39407 - protein, 10 aa, Borrelia burgdorferi B31
REEALKAEYE

SEQ ID NO: 39408 - protein, 10 aa, Borrelia burgdorferi B31
EEALKAEYEK

SEQ ID NO: 39409 - protein, 10 aa, Borrelia burgdorferi B31
EALKAEYEKS

SEQ ID NO: 39410 - protein, 10 aa, Borrelia burgdorferi B31
ALKAEYEKSY

SEQ ID NO: 39411 - protein, 10 aa, Borrelia burgdorferi B31
LKAEYEKSYK

SEQ ID NO: 39412 - protein, 10 aa, Borrelia burgdorferi B31
KAEYEKSYKE

SEQ ID NO: 39413 - protein, 10 aa, Borrelia burgdorferi B31
AEYEKSYKEF

SEQ ID NO: 39414 - protein, 10 aa, Borrelia burgdorferi B31
EYEKSYKEFF

SEQ ID NO: 39415 - protein, 10 aa, Borrelia burgdorferi B31
YEKSYKEFFD

SEQ ID NO: 39416 - protein, 10 aa, Borrelia burgdorferi B31
EKSYKEFFDW

SEQ ID NO: 39417 - protein, 10 aa, Borrelia burgdorferi B31
KSYKEFFDWL

SEQ ID NO: 39418 - protein, 10 aa, Borrelia burgdorferi B31
SYKEFFDWLS

SEQ ID NO: 39419 - protein, 10 aa, Borrelia burgdorferi B31
YKEFFDWLSK

SEQ ID NO: 39420 - protein, 10 aa, Borrelia burgdorferi B31
KEFFDWLSKD

SEQ ID NO: 39421 - protein, 10 aa, Borrelia burgdorferi B31
EFFDWLSKDV

SEQ ID NO: 39422 - protein, 10 aa, Borrelia burgdorferi B31
FFDWLSKDVN

SEQ ID NO: 39423 - protein, 10 aa, Borrelia burgdorferi B31
FDWLSKDVNR

SEQ ID NO: 39424 - protein, 10 aa, Borrelia burgdorferi B31
DWLSKDVNRQ

SEQ ID NO: 39425 - protein, 10 aa, Borrelia burgdorferi B31
WLSKDVNRQK

SEQ ID NO: 39426 - protein, 10 aa, Borrelia burgdorferi B31
LSKDVNRQKE

SEQ ID NO: 39427 - protein, 10 aa, Borrelia burgdorferi B31
SKDVNRQKEF

SEQ ID NO: 39428 - protein, 10 aa, Borrelia burgdorferi B31
KDVNRQKEFI

SEQ ID NO: 39429 - protein, 10 aa, Borrelia burgdorferi B31
DVNRQKEFIS

SEQ ID NO: 39430 - protein, 10 aa, Borrelia burgdorferi B31
VNRQKEFISS

SEQ ID NO: 39431 - protein, 10 aa, Borrelia burgdorferi B31
NRQKEFISSF

SEQ ID NO: 39432 - protein, 10 aa, Borrelia burgdorferi B31
RQKEFISSFD

SEQ ID NO: 39433 - protein, 10 aa, Borrelia burgdorferi B31
QKEFISSFDN

SEQ ID NO: 39434 - protein, 10 aa, Borrelia burgdorferi B31
KEFISSFDNI

SEQ ID NO: 39435 - protein, 10 aa, Borrelia burgdorferi B31
EFISSFDNIS

SEQ ID NO: 39436 - protein, 10 aa, Borrelia burgdorferi B31
FISSFDNISS

SEQ ID NO: 39437 - protein, 10 aa, Borrelia burgdorferi B31
ISSFDNISSI

SEQ ID NO: 39438 - protein, 10 aa, Borrelia burgdorferi B31
SSFDNISSIV

SEQ ID NO: 39439 - protein, 10 aa, Borrelia burgdorferi B31
SFDNISSIVS

SEQ ID NO: 39440 - protein, 10 aa, Borrelia burgdorferi B31
FDNISSIVSK

SEQ ID NO: 39441 - protein, 10 aa, Borrelia burgdorferi B31
DNISSIVSKA

SEQ ID NO: 39442 - protein, 10 aa, Borrelia burgdorferi B31
NISSIVSKAV

SEQ ID NO: 39443 - protein, 10 aa, Borrelia burgdorferi B31
ISSIVSKAVD

SEQ ID NO: 39444 - protein, 10 aa, Borrelia burgdorferi B31
SSIVSKAVDA

SEQ ID NO: 39445 - protein, 10 aa, Borrelia burgdorferi B31
SIVSKAVDAS

SEQ ID NO: 39446 - protein, 10 aa, Borrelia burgdorferi B31
IVSKAVDASK

SEQ ID NO: 39447 - protein, 10 aa, Borrelia burgdorferi B31
VSKAVDASKK

SEQ ID NO: 39448 - protein, 10 aa, Borrelia burgdorferi B31
SKAVDASKKR

SEQ ID NO: 39449 - protein, 10 aa, Borrelia burgdorferi B31
KAVDASKKRR

SEQ ID NO: 39450 - protein, 10 aa, Borrelia burgdorferi B31
AVDASKKRRP

SEQ ID NO: 39451 - protein, 10 aa, Borrelia burgdorferi B31
VDASKKRRPT

SEQ ID NO: 39452 - protein, 10 aa, Borrelia burgdorferi B31
DASKKRRPTE

SEQ ID NO: 39453 - protein, 10 aa, Borrelia burgdorferi B31
ASKKRRPTEQ

SEQ ID NO: 39454 - protein, 10 aa, Borrelia burgdorferi B31
SKKRRPTEQQ

SEQ ID NO: 39455 - protein, 10 aa, Borrelia burgdorferi B31
KKRRPTEQQS

SEQ ID NO: 39456 - protein, 10 aa, Borrelia burgdorferi B31
KRRPTEQQSL

SEQ ID NO: 39457 - protein, 10 aa, Borrelia burgdorferi B31
RRPTEQQSLG

SEQ ID NO: 39458 - protein, 10 aa, Borrelia burgdorferi B31
RPTEQQSLGF

SEQ ID NO: 39459 - protein, 10 aa, Borrelia burgdorferi B31
PTEQQSLGFK

SEQ ID NO: 39460 - protein, 10 aa, Borrelia burgdorferi B31
TEQQSLGFKE

SEQ ID NO: 39461 - protein, 10 aa, Borrelia burgdorferi B31
EQQSLGFKEY

SEQ ID NO: 39462 - protein, 10 aa, Borrelia burgdorferi B31
QQSLGFKEYV

SEQ ID NO: 39463 - protein, 10 aa, Borrelia burgdorferi B31
QSLGFKEYVC

SEQ ID NO: 39464 - protein, 10 aa, Borrelia burgdorferi B31
SLGFKEYVCY

SEQ ID NO: 39465 - protein, 10 aa, Borrelia burgdorferi B31
LGFKEYVCYK

SEQ ID NO: 39466 - protein, 10 aa, Borrelia burgdorferi B31
GFKEYVCYKI

SEQ ID NO: 39467 - protein, 10 aa, Borrelia burgdorferi B31
FKEYVCYKIK

SEQ ID NO: 39468 - protein, 10 aa, Borrelia burgdorferi B31
KEYVCYKIKN

SEQ ID NO: 39469 - protein, 10 aa, Borrelia burgdorferi B31
EYVCYKIKNS

SEQ ID NO: 39470 - protein, 10 aa, Borrelia burgdorferi B31
YVCYKIKNSK

SEQ ID NO: 39471 - protein, 10 aa, Borrelia burgdorferi B31
VCYKIKNSKG

SEQ ID NO: 39472 - protein, 10 aa, Borrelia burgdorferi B31
CYKIKNSKGE

SEQ ID NO: 39473 - protein, 10 aa, Borrelia burgdorferi B31
YKIKNSKGEA

SEQ ID NO: 39474 - protein, 10 aa, Borrelia burgdorferi B31
KIKNSKGEAL

SEQ ID NO: 39475 - protein, 10 aa, Borrelia burgdorferi B31
IKNSKGEALS

SEQ ID NO: 39476 - protein, 10 aa, Borrelia burgdorferi B31
KNSKGEALSL

SEQ ID NO: 39477 - protein, 10 aa, Borrelia burgdorferi B31
NSKGEALSLF

SEQ ID NO: 39478 - protein, 10 aa, Borrelia burgdorferi B31
SKGEALSLFF

SEQ ID NO: 39479 - protein, 10 aa, Borrelia burgdorferi B31
KGEALSLFFQ

SEQ ID NO: 39480 - protein, 10 aa, Borrelia burgdorferi B31
GEALSLFFQK

SEQ ID NO: 39481 - protein, 10 aa, Borrelia burgdorferi B31
EALSLFFQKV

SEQ ID NO: 39482 - protein, 10 aa, Borrelia burgdorferi B31
ALSLFFQKVV

SEQ ID NO: 39483 - protein, 10 aa, Borrelia burgdorferi B31
LSLFFQKVVD

SEQ ID NO: 39484 - protein, 10 aa, Borrelia burgdorferi B31
SLFFQKVVDA

SEQ ID NO: 39485 - protein, 10 aa, Borrelia burgdorferi B31
LFFQKVVDAF

SEQ ID NO: 39486 - protein, 10 aa, Borrelia burgdorferi B31
FFQKVVDAFG

SEQ ID NO: 39487 - protein, 10 aa, Borrelia burgdorferi B31
FQKVVDAFGA

SEQ ID NO: 39488 - protein, 10 aa, Borrelia burgdorferi B31
QKVVDAFGAD

SEQ ID NO: 39489 - protein, 10 aa, Borrelia burgdorferi B31
KVVDAFGADP

SEQ ID NO: 39490 - protein, 10 aa, Borrelia burgdorferi B31
VVDAFGADPY

SEQ ID NO: 39491 - protein, 10 aa, Borrelia burgdorferi B31
VDAFGADPYK

SEQ ID NO: 39492 - protein, 10 aa, Borrelia burgdorferi B31
DAFGADPYKK

SEQ ID NO: 39493 - protein, 10 aa, Borrelia burgdorferi B31
AFGADPYKKD

SEQ ID NO: 39494 - protein, 10 aa, Borrelia burgdorferi B31
FGADPYKKDN

SEQ ID NO: 39495 - protein, 10 aa, Borrelia burgdorferi B31
GADPYKKDND

SEQ ID NO: 39496 - protein, 10 aa, Borrelia burgdorferi B31
ADPYKKDNDE

SEQ ID NO: 39497 - protein, 10 aa, Borrelia burgdorferi B31
DPYKKDNDES

SEQ ID NO: 39498 - protein, 10 aa, Borrelia burgdorferi B31
PYKKDNDESV

SEQ ID NO: 39499 - protein, 10 aa, Borrelia burgdorferi B31
YKKDNDESVQ

SEQ ID NO: 39500 - protein, 10 aa, Borrelia burgdorferi B31
KKDNDESVQK

SEQ ID NO: 39501 - protein, 10 aa, Borrelia burgdorferi B31
KDNDESVQKP

SEQ ID NO: 39502 - protein, 10 aa, Borrelia burgdorferi B31
DNDESVQKPV

SEQ ID NO: 39503 - protein, 10 aa, Borrelia burgdorferi B31
NDESVQKPVK

SEQ ID NO: 39504 - protein, 10 aa, Borrelia burgdorferi B31
DESVQKPVKC

SEQ ID NO: 39505 - protein, 10 aa, Borrelia burgdorferi B31
ESVQKPVKCN

SEQ ID NO: 39506 - protein, 10 aa, Borrelia burgdorferi B31
SVQKPVKCNE

SEQ ID NO: 39507 - protein, 10 aa, Borrelia burgdorferi B31
VQKPVKCNEE

SEQ ID NO: 39508 - protein, 10 aa, Borrelia burgdorferi B31
QKPVKCNEEI

SEQ ID NO: 39509 - protein, 10 aa, Borrelia burgdorferi B31
KPVKCNEEIF

SEQ ID NO: 39510 - protein, 10 aa, Borrelia burgdorferi B31
PVKCNEEIFK

SEQ ID NO: 39511 - protein, 10 aa, Borrelia burgdorferi B31
VKCNEEIFKV

SEQ ID NO: 39512 - protein, 10 aa, Borrelia burgdorferi B31
KCNEEIFKVI

SEQ ID NO: 39513 - protein, 10 aa, Borrelia burgdorferi B31
CNEEIFKVIK

SEQ ID NO: 39514 - protein, 10 aa, Borrelia burgdorferi B31
NEEIFKVIKK

SEQ ID NO: 39515 - protein, 10 aa, Borrelia burgdorferi B31
EEIFKVIKKV

SEQ ID NO: 39516 - protein, 10 aa, Borrelia burgdorferi B31
EIFKVIKKVL

SEQ ID NO: 39517 - protein, 10 aa, Borrelia burgdorferi B31
IFKVIKKVLT

SEQ ID NO: 39518 - protein, 10 aa, Borrelia burgdorferi B31
FKVIKKVLTE

SEQ ID NO: 39519 - protein, 10 aa, Borrelia burgdorferi B31
KVIKKVLTES

SEQ ID NO: 39520 - protein, 10 aa, Borrelia burgdorferi B31
VIKKVLTESE

SEQ ID NO: 39521 - protein, 10 aa, Borrelia burgdorferi B31
IKKVLTESES

SEQ ID NO: 39522 - protein, 10 aa, Borrelia burgdorferi B31
KKVLTESESN

SEQ ID NO: 39523 - protein, 10 aa, Borrelia burgdorferi B31
KVLTESESNN

SEQ ID NO: 39524 - protein, 10 aa, Borrelia burgdorferi B31
VLTESESNNE

SEQ ID NO: 39525 - protein, 10 aa, Borrelia burgdorferi B31
LTESESNNEL

SEQ ID NO: 39526 - protein, 10 aa, Borrelia burgdorferi B31
TESESNNELK

SEQ ID NO: 39527 - protein, 10 aa, Borrelia burgdorferi B31
ESESNNELKN

SEQ ID NO: 39528 - protein, 10 aa, Borrelia burgdorferi B31
SESNNELKNL

SEQ ID NO: 39529 - protein, 10 aa, Borrelia burgdorferi B31
ESNNELKNLK

SEQ ID NO: 39530 - protein, 10 aa, Borrelia burgdorferi B31
SNNELKNLKN

SEQ ID NO: 39531 - protein, 10 aa, Borrelia burgdorferi B31
NNELKNLKNY

SEQ ID NO: 39532 - protein, 10 aa, Borrelia burgdorferi B31
NELKNLKNYG

SEQ ID NO: 39533 - protein, 10 aa, Borrelia burgdorferi B31
ELKNLKNYGN

SEQ ID NO: 39534 - protein, 10 aa, Borrelia burgdorferi B31
LKNLKNYGNV

SEQ ID NO: 39535 - protein, 11 aa, Borrelia burgdorferi B31
MMQRISILLML

SEQ ID NO: 39536 - protein, 11 aa, Borrelia burgdorferi B31
MQRISILLMLL

SEQ ID NO: 39537 - protein, 11 aa, Borrelia burgdorferi B31
QRISILLMLLA

SEQ ID NO: 39538 - protein, 11 aa, Borrelia burgdorferi B31
RISILLMLLAV

SEQ ID NO: 39539 - protein, 11 aa, Borrelia burgdorferi B31
ISILLMLLAVF

SEQ ID NO: 39540 - protein, 11 aa, Borrelia burgdorferi B31
SILLMLLAVFS

SEQ ID NO: 39541 - protein, 11 aa, Borrelia burgdorferi B31
ILLMLLAVFSC

SEQ ID NO: 39542 - protein, 11 aa, Borrelia burgdorferi B31
LLMLLAVFSCK

SEQ ID NO: 39543 - protein, 11 aa, Borrelia burgdorferi B31
LMLLAVFSCKQ

SEQ ID NO: 39544 - protein, 11 aa, Borrelia burgdorferi B31
MLLAVFSCKQF

SEQ ID NO: 39545 - protein, 11 aa, Borrelia burgdorferi B31
LLAVFSCKQFG

SEQ ID NO: 39546 - protein, 11 aa, Borrelia burgdorferi B31
LAVFSCKQFGD

SEQ ID NO: 39547 - protein, 11 aa, Borrelia burgdorferi B31
AVFSCKQFGDV

SEQ ID NO: 39548 - protein, 11 aa, Borrelia burgdorferi B31
VFSCKQFGDVK

SEQ ID NO: 39549 - protein, 11 aa, Borrelia burgdorferi B31
FSCKQFGDVKS

SEQ ID NO: 39550 - protein, 11 aa, Borrelia burgdorferi B31
SCKQFGDVKSL

SEQ ID NO: 39551 - protein, 11 aa, Borrelia burgdorferi B31
CKQFGDVKSLT

SEQ ID NO: 39552 - protein, 11 aa, Borrelia burgdorferi B31
KQFGDVKSLTE

SEQ ID NO: 39553 - protein, 11 aa, Borrelia burgdorferi B31
QFGDVKSLTEI

SEQ ID NO: 39554 - protein, 11 aa, Borrelia burgdorferi B31
FGDVKSLTEID

SEQ ID NO: 39555 - protein, 11 aa, Borrelia burgdorferi B31
GDVKSLTEIDS

SEQ ID NO: 39556 - protein, 11 aa, Borrelia burgdorferi B31
DVKSLTEIDSG

SEQ ID NO: 39557 - protein, 11 aa, Borrelia burgdorferi B31
VKSLTEIDSGN

SEQ ID NO: 39558 - protein, 11 aa, Borrelia burgdorferi B31
KSLTEIDSGNG

SEQ ID NO: 39559 - protein, 11 aa, Borrelia burgdorferi B31
SLTEIDSGNGI

SEQ ID NO: 39560 - protein, 11 aa, Borrelia burgdorferi B31
LTEIDSGNGIP

SEQ ID NO: 39561 - protein, 11 aa, Borrelia burgdorferi B31
TEIDSGNGIPL

SEQ ID NO: 39562 - protein, 11 aa, Borrelia burgdorferi B31
EIDSGNGIPLV

SEQ ID NO: 39563 - protein, 11 aa, Borrelia burgdorferi B31
IDSGNGIPLVV

SEQ ID NO: 39564 - protein, 11 aa, Borrelia burgdorferi B31
DSGNGIPLVVS

SEQ ID NO: 39565 - protein, 11 aa, Borrelia burgdorferi B31
SGNGIPLVVSD

SEQ ID NO: 39566 - protein, 11 aa, Borrelia burgdorferi B31
GNGIPLVVSDV

SEQ ID NO: 39567 - protein, 11 aa, Borrelia burgdorferi B31
NGIPLVVSDVV

SEQ ID NO: 39568 - protein, 11 aa, Borrelia burgdorferi B31
GIPLVVSDVVK

SEQ ID NO: 39569 - protein, 11 aa, Borrelia burgdorferi B31
IPLVVSDVVKD

SEQ ID NO: 39570 - protein, 11 aa, Borrelia burgdorferi B31
PLVVSDVVKDL

SEQ ID NO: 39571 - protein, 11 aa, Borrelia burgdorferi B31
LVVSDVVKDLI

SEQ ID NO: 39572 - protein, 11 aa, Borrelia burgdorferi B31
VVSDVVKDLIP

SEQ ID NO: 39573 - protein, 11 aa, Borrelia burgdorferi B31
VSDVVKDLIPK

SEQ ID NO: 39574 - protein, 11 aa, Borrelia burgdorferi B31
SDVVKDLIPKE

SEQ ID NO: 39575 - protein, 11 aa, Borrelia burgdorferi B31
DVVKDLIPKEI

SEQ ID NO: 39576 - protein, 11 aa, Borrelia burgdorferi B31
VVKDLIPKEIS

SEQ ID NO: 39577 - protein, 11 aa, Borrelia burgdorferi B31
VKDLIPKEISL

SEQ ID NO: 39578 - protein, 11 aa, Borrelia burgdorferi B31
KDLIPKEISLT

SEQ ID NO: 39579 - protein, 11 aa, Borrelia burgdorferi B31
DLIPKEISLTP

SEQ ID NO: 39580 - protein, 11 aa, Borrelia burgdorferi B31
LIPKEISLTPE

SEQ ID NO: 39581 - protein, 11 aa, Borrelia burgdorferi B31
IPKEISLTPEE

SEQ ID NO: 39582 - protein, 11 aa, Borrelia burgdorferi B31
PKEISLTPEEA

SEQ ID NO: 39583 - protein, 11 aa, Borrelia burgdorferi B31
KEISLTPEEAE

SEQ ID NO: 39584 - protein, 11 aa, Borrelia burgdorferi B31
EISLTPEEAEK

SEQ ID NO: 39585 - protein, 11 aa, Borrelia burgdorferi B31
ISLTPEEAEKL

SEQ ID NO: 39586 - protein, 11 aa, Borrelia burgdorferi B31
SLTPEEAEKLE

SEQ ID NO: 39587 - protein, 11 aa, Borrelia burgdorferi B31
LTPEEAEKLES

SEQ ID NO: 39588 - protein, 11 aa, Borrelia burgdorferi B31
TPEEAEKLESL

SEQ ID NO: 39589 - protein, 11 aa, Borrelia burgdorferi B31
PEEAEKLESLK

SEQ ID NO: 39590 - protein, 11 aa, Borrelia burgdorferi B31
EEAEKLESLKV

SEQ ID NO: 39591 - protein, 11 aa, Borrelia burgdorferi B31
EAEKLESLKVF

SEQ ID NO: 39592 - protein, 11 aa, Borrelia burgdorferi B31
AEKLESLKVFL

SEQ ID NO: 39593 - protein, 11 aa, Borrelia burgdorferi B31
EKLESLKVFLK

SEQ ID NO: 39594 - protein, 11 aa, Borrelia burgdorferi B31
KLESLKVFLKD

SEQ ID NO: 39595 - protein, 11 aa, Borrelia burgdorferi B31
LESLKVFLKDA

SEQ ID NO: 39596 - protein, 11 aa, Borrelia burgdorferi B31
ESLKVFLKDAM

SEQ ID NO: 39597 - protein, 11 aa, Borrelia burgdorferi B31
SLKVFLKDAMS

SEQ ID NO: 39598 - protein, 11 aa, Borrelia burgdorferi B31
LKVFLKDAMSV

SEQ ID NO: 39599 - protein, 11 aa, Borrelia burgdorferi B31
KVFLKDAMSVN

SEQ ID NO: 39600 - protein, 11 aa, Borrelia burgdorferi B31
VFLKDAMSVNG

SEQ ID NO: 39601 - protein, 11 aa, Borrelia burgdorferi B31
FLKDAMSVNGR

SEQ ID NO: 39602 - protein, 11 aa, Borrelia burgdorferi B31
LKDAMSVNGRE

SEQ ID NO: 39603 - protein, 11 aa, Borrelia burgdorferi B31
KDAMSVNGREE

SEQ ID NO: 39604 - protein, 11 aa, Borrelia burgdorferi B31
DAMSVNGREEA

SEQ ID NO: 39605 - protein, 11 aa, Borrelia burgdorferi B31
AMSVNGREEAL

SEQ ID NO: 39606 - protein, 11 aa, Borrelia burgdorferi B31
MSVNGREEALK

SEQ ID NO: 39607 - protein, 11 aa, Borrelia burgdorferi B31
SVNGREEALKA

SEQ ID NO: 39608 - protein, 11 aa, Borrelia burgdorferi B31
VNGREEALKAE

SEQ ID NO: 39609 - protein, 11 aa, Borrelia burgdorferi B31
NGREEALKAEY

SEQ ID NO: 39610 - protein, 11 aa, Borrelia burgdorferi B31
GREEALKAEYE

SEQ ID NO: 39611 - protein, 11 aa, Borrelia burgdorferi B31
REEALKAEYEK

SEQ ID NO: 39612 - protein, 11 aa, Borrelia burgdorferi B31
EEALKAEYEKS

SEQ ID NO: 39613 - protein, 11 aa, Borrelia burgdorferi B31
EALKAEYEKSY

SEQ ID NO: 39614 - protein, 11 aa, Borrelia burgdorferi B31
ALKAEYEKSYK

SEQ ID NO: 39615 - protein, 11 aa, Borrelia burgdorferi B31
LKAEYEKSYKE

SEQ ID NO: 39616 - protein, 11 aa, Borrelia burgdorferi B31
KAEYEKSYKEF

SEQ ID NO: 39617 - protein, 11 aa, Borrelia burgdorferi B31
AEYEKSYKEFF

SEQ ID NO: 39618 - protein, 11 aa, Borrelia burgdorferi B31
EYEKSYKEFFD

SEQ ID NO: 39619 - protein, 11 aa, Borrelia burgdorferi B31
YEKSYKEFFDW

SEQ ID NO: 39620 - protein, 11 aa, Borrelia burgdorferi B31
EKSYKEFFDWL

SEQ ID NO: 39621 - protein, 11 aa, Borrelia burgdorferi B31
KSYKEFFDWLS

SEQ ID NO: 39622 - protein, 11 aa, Borrelia burgdorferi B31
SYKEFFDWLSK

SEQ ID NO: 39623 - protein, 11 aa, Borrelia burgdorferi B31
YKEFFDWLSKD

SEQ ID NO: 39624 - protein, 11 aa, Borrelia burgdorferi B31
KEFFDWLSKDV

SEQ ID NO: 39625 - protein, 11 aa, Borrelia burgdorferi B31
EFFDWLSKDVN

SEQ ID NO: 39626 - protein, 11 aa, Borrelia burgdorferi B31
FFDWLSKDVNR

SEQ ID NO: 39627 - protein, 11 aa, Borrelia burgdorferi B31
FDWLSKDVNRQ

SEQ ID NO: 39628 - protein, 11 aa, Borrelia burgdorferi B31
DWLSKDVNRQK

SEQ ID NO: 39629 - protein, 11 aa, Borrelia burgdorferi B31
WLSKDVNRQKE

SEQ ID NO: 39630 - protein, 11 aa, Borrelia burgdorferi B31
LSKDVNRQKEF

SEQ ID NO: 39631 - protein, 11 aa, Borrelia burgdorferi B31
SKDVNRQKEFI

SEQ ID NO: 39632 - protein, 11 aa, Borrelia burgdorferi B31
KDVNRQKEFIS

SEQ ID NO: 39633 - protein, 11 aa, Borrelia burgdorferi B31
DVNRQKEFISS

SEQ ID NO: 39634 - protein, 11 aa, Borrelia burgdorferi B31
VNRQKEFISSF

SEQ ID NO: 39635 - protein, 11 aa, Borrelia burgdorferi B31
NRQKEFISSFD

SEQ ID NO: 39636 - protein, 11 aa, Borrelia burgdorferi B31
RQKEFISSFDN

SEQ ID NO: 39637 - protein, 11 aa, Borrelia burgdorferi B31
QKEFISSFDNI

SEQ ID NO: 39638 - protein, 11 aa, Borrelia burgdorferi B31
KEFISSFDNIS

SEQ ID NO: 39639 - protein, 11 aa, Borrelia burgdorferi B31
EFISSFDNISS

SEQ ID NO: 39640 - protein, 11 aa, Borrelia burgdorferi B31
FISSFDNISSI

SEQ ID NO: 39641 - protein, 11 aa, Borrelia burgdorferi B31
ISSFDNISSIV

SEQ ID NO: 39642 - protein, 11 aa, Borrelia burgdorferi B31
SSFDNISSIVS

SEQ ID NO: 39643 - protein, 11 aa, Borrelia burgdorferi B31
SFDNISSIVSK

SEQ ID NO: 39644 - protein, 11 aa, Borrelia burgdorferi B31
FDNISSIVSKA

SEQ ID NO: 39645 - protein, 11 aa, Borrelia burgdorferi B31
DNISSIVSKAV

SEQ ID NO: 39646 - protein, 11 aa, Borrelia burgdorferi B31
NISSIVSKAVD

SEQ ID NO: 39647 - protein, 11 aa, Borrelia burgdorferi B31
ISSIVSKAVDA

SEQ ID NO: 39648 - protein, 11 aa, Borrelia burgdorferi B31
SSIVSKAVDAS

SEQ ID NO: 39649 - protein, 11 aa, Borrelia burgdorferi B31
SIVSKAVDASK

SEQ ID NO: 39650 - protein, 11 aa, Borrelia burgdorferi B31
IVSKAVDASKK

SEQ ID NO: 39651 - protein, 11 aa, Borrelia burgdorferi B31
VSKAVDASKKR

SEQ ID NO: 39652 - protein, 11 aa, Borrelia burgdorferi B31
SKAVDASKKRR

SEQ ID NO: 39653 - protein, 11 aa, Borrelia burgdorferi B31
KAVDASKKRRP

SEQ ID NO: 39654 - protein, 11 aa, Borrelia burgdorferi B31
AVDASKKRRPT

SEQ ID NO: 39655 - protein, 11 aa, Borrelia burgdorferi B31
VDASKKRRPTE

SEQ ID NO: 39656 - protein, 11 aa, Borrelia burgdorferi B31
DASKKRRPTEQ

SEQ ID NO: 39657 - protein, 11 aa, Borrelia burgdorferi B31
ASKKRRPTEQQ

SEQ ID NO: 39658 - protein, 11 aa, Borrelia burgdorferi B31
SKKRRPTEQQS

SEQ ID NO: 39659 - protein, 11 aa, Borrelia burgdorferi B31
KKRRPTEQQSL

SEQ ID NO: 39660 - protein, 11 aa, Borrelia burgdorferi B31
KRRPTEQQSLG

SEQ ID NO: 39661 - protein, 11 aa, Borrelia burgdorferi B31
RRPTEQQSLGF

SEQ ID NO: 39662 - protein, 11 aa, Borrelia burgdorferi B31
RPTEQQSLGFK

SEQ ID NO: 39663 - protein, 11 aa, Borrelia burgdorferi B31
PTEQQSLGFKE

SEQ ID NO: 39664 - protein, 11 aa, Borrelia burgdorferi B31
TEQQSLGFKEY

SEQ ID NO: 39665 - protein, 11 aa, Borrelia burgdorferi B31
EQQSLGFKEYV

SEQ ID NO: 39666 - protein, 11 aa, Borrelia burgdorferi B31
QQSLGFKEYVC

SEQ ID NO: 39667 - protein, 11 aa, Borrelia burgdorferi B31
QSLGFKEYVCY

SEQ ID NO: 39668 - protein, 11 aa, Borrelia burgdorferi B31
SLGFKEYVCYK

SEQ ID NO: 39669 - protein, 11 aa, Borrelia burgdorferi B31
LGFKEYVCYKI

SEQ ID NO: 39670 - protein, 11 aa, Borrelia burgdorferi B31
GFKEYVCYKIK

SEQ ID NO: 39671 - protein, 11 aa, Borrelia burgdorferi B31
FKEYVCYKIKN

SEQ ID NO: 39672 - protein, 11 aa, Borrelia burgdorferi B31
KEYVCYKIKNS

SEQ ID NO: 39673 - protein, 11 aa, Borrelia burgdorferi B31
EYVCYKIKNSK

SEQ ID NO: 39674 - protein, 11 aa, Borrelia burgdorferi B31
YVCYKIKNSKG

SEQ ID NO: 39675 - protein, 11 aa, Borrelia burgdorferi B31
VCYKIKNSKGE

SEQ ID NO: 39676 - protein, 11 aa, Borrelia burgdorferi B31
CYKIKNSKGEA

SEQ ID NO: 39677 - protein, 11 aa, Borrelia burgdorferi B31
YKIKNSKGEAL

SEQ ID NO: 39678 - protein, 11 aa, Borrelia burgdorferi B31
KIKNSKGEALS

SEQ ID NO: 39679 - protein, 11 aa, Borrelia burgdorferi B31
IKNSKGEALSL

SEQ ID NO: 39680 - protein, 11 aa, Borrelia burgdorferi B31
KNSKGEALSLF

SEQ ID NO: 39681 - protein, 11 aa, Borrelia burgdorferi B31
NSKGEALSLFF

SEQ ID NO: 39682 - protein, 11 aa, Borrelia burgdorferi B31
SKGEALSLFFQ

SEQ ID NO: 39683 - protein, 11 aa, Borrelia burgdorferi B31
KGEALSLFFQK

SEQ ID NO: 39684 - protein, 11 aa, Borrelia burgdorferi B31
GEALSLFFQKV

SEQ ID NO: 39685 - protein, 11 aa, Borrelia burgdorferi B31
EALSLFFQKVV

SEQ ID NO: 39686 - protein, 11 aa, Borrelia burgdorferi B31
ALSLFFQKVVD

SEQ ID NO: 39687 - protein, 11 aa, Borrelia burgdorferi B31
LSLFFQKVVDA

SEQ ID NO: 39688 - protein, 11 aa, Borrelia burgdorferi B31
SLFFQKVVDAF

SEQ ID NO: 39689 - protein, 11 aa, Borrelia burgdorferi B31
LFFQKVVDAFG

SEQ ID NO: 39690 - protein, 11 aa, Borrelia burgdorferi B31
FFQKVVDAFGA

SEQ ID NO: 39691 - protein, 11 aa, Borrelia burgdorferi B31
FQKVVDAFGAD

SEQ ID NO: 39692 - protein, 11 aa, Borrelia burgdorferi B31
QKVVDAFGADP

SEQ ID NO: 39693 - protein, 11 aa, Borrelia burgdorferi B31
KVVDAFGADPY

SEQ ID NO: 39694 - protein, 11 aa, Borrelia burgdorferi B31
VVDAFGADPYK

SEQ ID NO: 39695 - protein, 11 aa, Borrelia burgdorferi B31
VDAFGADPYKK

SEQ ID NO: 39696 - protein, 11 aa, Borrelia burgdorferi B31
DAFGADPYKKD

SEQ ID NO: 39697 - protein, 11 aa, Borrelia burgdorferi B31
AFGADPYKKDN

SEQ ID NO: 39698 - protein, 11 aa, Borrelia burgdorferi B31
FGADPYKKDND

SEQ ID NO: 39699 - protein, 11 aa, Borrelia burgdorferi B31
GADPYKKDNDE

SEQ ID NO: 39700 - protein, 11 aa, Borrelia burgdorferi B31
ADPYKKDNDES

SEQ ID NO: 39701 - protein, 11 aa, Borrelia burgdorferi B31
DPYKKDNDESV

SEQ ID NO: 39702 - protein, 11 aa, Borrelia burgdorferi B31
PYKKDNDESVQ

SEQ ID NO: 39703 - protein, 11 aa, Borrelia burgdorferi B31
YKKDNDESVQK

SEQ ID NO: 39704 - protein, 11 aa, Borrelia burgdorferi B31
KKDNDESVQKP

SEQ ID NO: 39705 - protein, 11 aa, Borrelia burgdorferi B31
KDNDESVQKPV

SEQ ID NO: 39706 - protein, 11 aa, Borrelia burgdorferi B31
DNDESVQKPVK

SEQ ID NO: 39707 - protein, 11 aa, Borrelia burgdorferi B31
NDESVQKPVKC

SEQ ID NO: 39708 - protein, 11 aa, Borrelia burgdorferi B31
DESVQKPVKCN

SEQ ID NO: 39709 - protein, 11 aa, Borrelia burgdorferi B31
ESVQKPVKCNE

SEQ ID NO: 39710 - protein, 11 aa, Borrelia burgdorferi B31
SVQKPVKCNEE

SEQ ID NO: 39711 - protein, 11 aa, Borrelia burgdorferi B31
VQKPVKCNEEI

SEQ ID NO: 39712 - protein, 11 aa, Borrelia burgdorferi B31
QKPVKCNEEIF

SEQ ID NO: 39713 - protein, 11 aa, Borrelia burgdorferi B31
KPVKCNEEIFK

SEQ ID NO: 39714 - protein, 11 aa, Borrelia burgdorferi B31
PVKCNEEIFKV

SEQ ID NO: 39715 - protein, 11 aa, Borrelia burgdorferi B31
VKCNEEIFKVI

SEQ ID NO: 39716 - protein, 11 aa, Borrelia burgdorferi B31
KCNEEIFKVIK

SEQ ID NO: 39717 - protein, 11 aa, Borrelia burgdorferi B31
CNEEIFKVIKK

SEQ ID NO: 39718 - protein, 11 aa, Borrelia burgdorferi B31
NEEIFKVIKKV

SEQ ID NO: 39719 - protein, 11 aa, Borrelia burgdorferi B31
EEIFKVIKKVL

SEQ ID NO: 39720 - protein, 11 aa, Borrelia burgdorferi B31
EIFKVIKKVLT

SEQ ID NO: 39721 - protein, 11 aa, Borrelia burgdorferi B31
IFKVIKKVLTE

SEQ ID NO: 39722 - protein, 11 aa, Borrelia burgdorferi B31
FKVIKKVLTES

SEQ ID NO: 39723 - protein, 11 aa, Borrelia burgdorferi B31
KVIKKVLTESE

SEQ ID NO: 39724 - protein, 11 aa, Borrelia burgdorferi B31
VIKKVLTESES

SEQ ID NO: 39725 - protein, 11 aa, Borrelia burgdorferi B31
IKKVLTESESN

SEQ ID NO: 39726 - protein, 11 aa, Borrelia burgdorferi B31
KKVLTESESNN

SEQ ID NO: 39727 - protein, 11 aa, Borrelia burgdorferi B31
KVLTESESNNE

SEQ ID NO: 39728 - protein, 11 aa, Borrelia burgdorferi B31
VLTESESNNEL

SEQ ID NO: 39729 - protein, 11 aa, Borrelia burgdorferi B31
LTESESNNELK

SEQ ID NO: 39730 - protein, 11 aa, Borrelia burgdorferi B31
TESESNNELKN

SEQ ID NO: 39731 - protein, 11 aa, Borrelia burgdorferi B31
ESESNNELKNL

SEQ ID NO: 39732 - protein, 11 aa, Borrelia burgdorferi B31
SESNNELKNLK

SEQ ID NO: 39733 - protein, 11 aa, Borrelia burgdorferi B31
ESNNELKNLKN

SEQ ID NO: 39734 - protein, 11 aa, Borrelia burgdorferi B31
SNNELKNLKNY

SEQ ID NO: 39735 - protein, 11 aa, Borrelia burgdorferi B31
NNELKNLKNYG

SEQ ID NO: 39736 - protein, 11 aa, Borrelia burgdorferi B31
NELKNLKNYGN

SEQ ID NO: 39737 - protein, 11 aa, Borrelia burgdorferi B31
ELKNLKNYGNV

SEQ ID NO: 39738 - protein, 8 aa, Borrelia garinii PBi
MKRISILS

SEQ ID NO: 39739 - protein, 8 aa, Borrelia garinii PBi
KRISILSI

SEQ ID NO: 39740 - protein, 8 aa, Borrelia garinii PBi
RISILSIL

SEQ ID NO: 39741 - protein, 8 aa, Borrelia garinii PBi
ISILSILL

SEQ ID NO: 39742 - protein, 8 aa, Borrelia garinii PBi
SILSILLL

SEQ ID NO: 39743 - protein, 8 aa, Borrelia garinii PBi
ILSILLLL

SEQ ID NO: 39744 - protein, 8 aa, Borrelia garinii PBi
LSILLLLL

SEQ ID NO: 39745 - protein, 8 aa, Borrelia garinii PBi
SILLLLLL

SEQ ID NO: 39746 - protein, 8 aa, Borrelia garinii PBi
ILLLLLLF

SEQ ID NO: 39747 - protein, 8 aa, Borrelia garinii PBi
LLLLLLFS

SEQ ID NO: 39748 - protein, 8 aa, Borrelia garinii PBi
LLLLLFSC

SEQ ID NO: 39749 - protein, 8 aa, Borrelia garinii PBi
LLLLFSCK

SEQ ID NO: 39750 - protein, 8 aa, Borrelia garinii PBi
LLLFSCKQ

SEQ ID NO: 39751 - protein, 8 aa, Borrelia garinii PBi
LLFSCKQY

SEQ ID NO: 39752 - protein, 8 aa, Borrelia garinii PBi
LFSCKQYG

SEQ ID NO: 39753 - protein, 8 aa, Borrelia garinii PBi
FSCKQYGD

SEQ ID NO: 39754 - protein, 8 aa, Borrelia garinii PBi
SCKQYGDV

SEQ ID NO: 39755 - protein, 8 aa, Borrelia garinii PBi
CKQYGDVK

SEQ ID NO: 39756 - protein, 8 aa, Borrelia garinii PBi
KQYGDVKS

SEQ ID NO: 39757 - protein, 8 aa, Borrelia garinii PBi
QYGDVKSL

SEQ ID NO: 39758 - protein, 8 aa, Borrelia garinii PBi
YGDVKSLT

SEQ ID NO: 39759 - protein, 8 aa, Borrelia garinii PBi
GDVKSLTE

SEQ ID NO: 39760 - protein, 8 aa, Borrelia garinii PBi
DVKSLTEV

SEQ ID NO: 39761 - protein, 8 aa, Borrelia garinii PBi
VKSLTEVA

SEQ ID NO: 39762 - protein, 8 aa, Borrelia garinii PBi
KSLTEVAT

SEQ ID NO: 39763 - protein, 8 aa, Borrelia garinii PBi
SLTEVATD

SEQ ID NO: 39764 - protein, 8 aa, Borrelia garinii PBi
LTEVATDL

SEQ ID NO: 39765 - protein, 8 aa, Borrelia garinii PBi
TEVATDLE

SEQ ID NO: 39766 - protein, 8 aa, Borrelia garinii PBi
EVATDLED

SEQ ID NO: 39767 - protein, 8 aa, Borrelia garinii PBi
VATDLEDD

SEQ ID NO: 39768 - protein, 8 aa, Borrelia garinii PBi
ATDLEDDN

SEQ ID NO: 39769 - protein, 8 aa, Borrelia garinii PBi
TDLEDDNS

SEQ ID NO: 39770 - protein, 8 aa, Borrelia garinii PBi
DLEDDNSF

SEQ ID NO: 39771 - protein, 8 aa, Borrelia garinii PBi
LEDDNSFA

SEQ ID NO: 39772 - protein, 8 aa, Borrelia garinii PBi
EDDNSFAS

SEQ ID NO: 39773 - protein, 8 aa, Borrelia garinii PBi
DDNSFASG

SEQ ID NO: 39774 - protein, 8 aa, Borrelia garinii PBi
DNSFASGS

SEQ ID NO: 39775 - protein, 8 aa, Borrelia garinii PBi
NSFASGSV

SEQ ID NO: 39776 - protein, 8 aa, Borrelia garinii PBi
SFASGSVE

SEQ ID NO: 39777 - protein, 8 aa, Borrelia garinii PBi
FASGSVES

SEQ ID NO: 39778 - protein, 8 aa, Borrelia garinii PBi
ASGSVESK

SEQ ID NO: 39779 - protein, 8 aa, Borrelia garinii PBi
SGSVESKD

SEQ ID NO: 39780 - protein, 8 aa, Borrelia garinii PBi
GSVESKDQ

SEQ ID NO: 39781 - protein, 8 aa, Borrelia garinii PBi
SVESKDQI

SEQ ID NO: 39782 - protein, 8 aa, Borrelia garinii PBi
VESKDQII

SEQ ID NO: 39783 - protein, 8 aa, Borrelia garinii PBi
ESKDQIIE

SEQ ID NO: 39784 - protein, 8 aa, Borrelia garinii PBi
SKDQIIEK

SEQ ID NO: 39785 - protein, 8 aa, Borrelia garinii PBi
KDQIIEKG

SEQ ID NO: 39786 - protein, 8 aa, Borrelia garinii PBi
DQIIEKGP

SEQ ID NO: 39787 - protein, 8 aa, Borrelia garinii PBi
QIIEKGPV

SEQ ID NO: 39788 - protein, 8 aa, Borrelia garinii PBi
IIEKGPVL

SEQ ID NO: 39789 - protein, 8 aa, Borrelia garinii PBi
IEKGPVLT

SEQ ID NO: 39790 - protein, 8 aa, Borrelia garinii PBi
EKGPVLTS

SEQ ID NO: 39791 - protein, 8 aa, Borrelia garinii PBi
KGPVLTSE

SEQ ID NO: 39792 - protein, 8 aa, Borrelia garinii PBi
GPVLTSEE

SEQ ID NO: 39793 - protein, 8 aa, Borrelia garinii PBi
PVLTSEEF

SEQ ID NO: 39794 - protein, 8 aa, Borrelia garinii PBi
VLTSEEFE

SEQ ID NO: 39795 - protein, 8 aa, Borrelia garinii PBi
LTSEEFER

SEQ ID NO: 39796 - protein, 8 aa, Borrelia garinii PBi
TSEEFERL

SEQ ID NO: 39797 - protein, 8 aa, Borrelia garinii PBi
SEEFERLE

SEQ ID NO: 39798 - protein, 8 aa, Borrelia garinii PBi
EEFERLEA

SEQ ID NO: 39799 - protein, 8 aa, Borrelia garinii PBi
EFERLEAL

SEQ ID NO: 39800 - protein, 8 aa, Borrelia garinii PBi
FERLEALK

SEQ ID NO: 39801 - protein, 8 aa, Borrelia garinii PBi
ERLEALKT

SEQ ID NO: 39802 - protein, 8 aa, Borrelia garinii PBi
RLEALKTF

SEQ ID NO: 39803 - protein, 8 aa, Borrelia garinii PBi
LEALKTFL

SEQ ID NO: 39804 - protein, 8 aa, Borrelia garinii PBi
EALKTFLK

SEQ ID NO: 39805 - protein, 8 aa, Borrelia garinii PBi
ALKTFLKD

SEQ ID NO: 39806 - protein, 8 aa, Borrelia garinii PBi
LKTFLKDA

SEQ ID NO: 39807 - protein, 8 aa, Borrelia garinii PBi
KTFLKDAM

SEQ ID NO: 39808 - protein, 8 aa, Borrelia garinii PBi
TFLKDAMG

SEQ ID NO: 39809 - protein, 8 aa, Borrelia garinii PBi
FLKDAMGV

SEQ ID NO: 39810 - protein, 8 aa, Borrelia garinii PBi
LKDAMGVN

SEQ ID NO: 39811 - protein, 8 aa, Borrelia garinii PBi
KDAMGVNG

SEQ ID NO: 39812 - protein, 8 aa, Borrelia garinii PBi
DAMGVNGR

SEQ ID NO: 39813 - protein, 8 aa, Borrelia garinii PBi
AMGVNGRE

SEQ ID NO: 39814 - protein, 8 aa, Borrelia garinii PBi
MGVNGREG

SEQ ID NO: 39815 - protein, 8 aa, Borrelia garinii PBi
GVNGREGD

SEQ ID NO: 39816 - protein, 8 aa, Borrelia garinii PBi
VNGREGDT

SEQ ID NO: 39817 - protein, 8 aa, Borrelia garinii PBi
NGREGDTK

SEQ ID NO: 39818 - protein, 8 aa, Borrelia garinii PBi
GREGDTKA

SEQ ID NO: 39819 - protein, 8 aa, Borrelia garinii PBi
REGDTKAE

SEQ ID NO: 39820 - protein, 8 aa, Borrelia garinii PBi
EGDTKAEY

SEQ ID NO: 39821 - protein, 8 aa, Borrelia garinii PBi
GDTKAEYE

SEQ ID NO: 39822 - protein, 8 aa, Borrelia garinii PBi
DTKAEYEK

SEQ ID NO: 39823 - protein, 8 aa, Borrelia garinii PBi
TKAEYEKS

SEQ ID NO: 39824 - protein, 8 aa, Borrelia garinii PBi
KAEYEKSY

SEQ ID NO: 39825 - protein, 8 aa, Borrelia garinii PBi
AEYEKSYK

SEQ ID NO: 39826 - protein, 8 aa, Borrelia garinii PBi
EYEKSYKE

SEQ ID NO: 39827 - protein, 8 aa, Borrelia garinii PBi
YEKSYKEF

SEQ ID NO: 39828 - protein, 8 aa, Borrelia garinii PBi
EKSYKEFF

SEQ ID NO: 39829 - protein, 8 aa, Borrelia garinii PBi
KSYKEFFD

SEQ ID NO: 39830 - protein, 8 aa, Borrelia garinii PBi
SYKEFFDW

SEQ ID NO: 39831 - protein, 8 aa, Borrelia garinii PBi
YKEFFDWL

SEQ ID NO: 39832 - protein, 8 aa, Borrelia garinii PBi
KEFFDWLS

SEQ ID NO: 39833 - protein, 8 aa, Borrelia garinii PBi
EFFDWLSK

SEQ ID NO: 39834 - protein, 8 aa, Borrelia garinii PBi
FFDWLSKD

SEQ ID NO: 39835 - protein, 8 aa, Borrelia garinii PBi
FDWLSKDV

SEQ ID NO: 39836 - protein, 8 aa, Borrelia garinii PBi
DWLSKDVN

SEQ ID NO: 39837 - protein, 8 aa, Borrelia garinii PBi
WLSKDVNR

SEQ ID NO: 39838 - protein, 8 aa, Borrelia garinii PBi
LSKDVNRQ

SEQ ID NO: 39839 - protein, 8 aa, Borrelia garinii PBi
SKDVNRQK

SEQ ID NO: 39840 - protein, 8 aa, Borrelia garinii PBi
KDVNRQKE

SEQ ID NO: 39841 - protein, 8 aa, Borrelia garinii PBi
DVNRQKEF

SEQ ID NO: 39842 - protein, 8 aa, Borrelia garinii PBi
VNRQKEFV

SEQ ID NO: 39843 - protein, 8 aa, Borrelia garinii PBi
NRQKEFVS

SEQ ID NO: 39844 - protein, 8 aa, Borrelia garinii PBi
RQKEFVSF

SEQ ID NO: 39845 - protein, 8 aa, Borrelia garinii PBi
QKEFVSFF

SEQ ID NO: 39846 - protein, 8 aa, Borrelia garinii PBi
KEFVSFFN

SEQ ID NO: 39847 - protein, 8 aa, Borrelia garinii PBi
EFVSFFNN

SEQ ID NO: 39848 - protein, 8 aa, Borrelia garinii PBi
FVSFFNNI

SEQ ID NO: 39849 - protein, 8 aa, Borrelia garinii PBi
VSFFNNIC

SEQ ID NO: 39850 - protein, 8 aa, Borrelia garinii PBi
SFFNNICG

SEQ ID NO: 39851 - protein, 8 aa, Borrelia garinii PBi
FFNNICGI

SEQ ID NO: 39852 - protein, 8 aa, Borrelia garinii PBi
FNNICGII

SEQ ID NO: 39853 - protein, 8 aa, Borrelia garinii PBi
NNICGIIT

SEQ ID NO: 39854 - protein, 8 aa, Borrelia garinii PBi
NICGIITK

SEQ ID NO: 39855 - protein, 8 aa, Borrelia garinii PBi
ICGIITKA

SEQ ID NO: 39856 - protein, 8 aa, Borrelia garinii PBi
CGIITKAV

SEQ ID NO: 39857 - protein, 8 aa, Borrelia garinii PBi
GIITKAVD

SEQ ID NO: 39858 - protein, 8 aa, Borrelia garinii PBi
IITKAVDA

SEQ ID NO: 39859 - protein, 8 aa, Borrelia garinii PBi
ITKAVDAS

SEQ ID NO: 39860 - protein, 8 aa, Borrelia garinii PBi
TKAVDASK

SEQ ID NO: 39861 - protein, 8 aa, Borrelia garinii PBi
KAVDASKK

SEQ ID NO: 39862 - protein, 8 aa, Borrelia garinii PBi
AVDASKKR

SEQ ID NO: 39863 - protein, 8 aa, Borrelia garinii PBi
VDASKKRY

SEQ ID NO: 39864 - protein, 8 aa, Borrelia garinii PBi
DASKKRYN

SEQ ID NO: 39865 - protein, 8 aa, Borrelia garinii PBi
ASKKRYNS

SEQ ID NO: 39866 - protein, 8 aa, Borrelia garinii PBi
SKKRYNSN

SEQ ID NO: 39867 - protein, 8 aa, Borrelia garinii PBi
KKRYNSNP

SEQ ID NO: 39868 - protein, 8 aa, Borrelia garinii PBi
KRYNSNPK

SEQ ID NO: 39869 - protein, 8 aa, Borrelia garinii PBi
RYNSNPKS

SEQ ID NO: 39870 - protein, 8 aa, Borrelia garinii PBi
YNSNPKSL

SEQ ID NO: 39871 - protein, 8 aa, Borrelia garinii PBi
NSNPKSLG

SEQ ID NO: 39872 - protein, 8 aa, Borrelia garinii PBi
SNPKSLGF

SEQ ID NO: 39873 - protein, 8 aa, Borrelia garinii PBi
NPKSLGFN

SEQ ID NO: 39874 - protein, 8 aa, Borrelia garinii PBi
PKSLGFNE

SEQ ID NO: 39875 - protein, 8 aa, Borrelia garinii PBi
KSLGFNEY

SEQ ID NO: 39876 - protein, 8 aa, Borrelia garinii PBi
SLGFNEYV

SEQ ID NO: 39877 - protein, 8 aa, Borrelia garinii PBi
LGFNEYVC

SEQ ID NO: 39878 - protein, 8 aa, Borrelia garinii PBi
GFNEYVCY

SEQ ID NO: 39879 - protein, 8 aa, Borrelia garinii PBi
FNEYVCYD

SEQ ID NO: 39880 - protein, 8 aa, Borrelia garinii PBi
NEYVCYDI

SEQ ID NO: 39881 - protein, 8 aa, Borrelia garinii PBi
EYVCYDIK

SEQ ID NO: 39882 - protein, 8 aa, Borrelia garinii PBi
YVCYDIKT

SEQ ID NO: 39883 - protein, 8 aa, Borrelia garinii PBi
VCYDIKTR

SEQ ID NO: 39884 - protein, 8 aa, Borrelia garinii PBi
CYDIKTRT

SEQ ID NO: 39885 - protein, 8 aa, Borrelia garinii PBi
YDIKTRTG

SEQ ID NO: 39886 - protein, 8 aa, Borrelia garinii PBi
DIKTRTGD

SEQ ID NO: 39887 - protein, 8 aa, Borrelia garinii PBi
IKTRTGDD

SEQ ID NO: 39888 - protein, 8 aa, Borrelia garinii PBi
KTRTGDDL

SEQ ID NO: 39889 - protein, 8 aa, Borrelia garinii PBi
TRTGDDLS

SEQ ID NO: 39890 - protein, 8 aa, Borrelia garinii PBi
RTGDDLSL

SEQ ID NO: 39891 - protein, 8 aa, Borrelia garinii PBi
TGDDLSLF

SEQ ID NO: 39892 - protein, 8 aa, Borrelia garinii PBi
GDDLSLFF

SEQ ID NO: 39893 - protein, 8 aa, Borrelia garinii PBi
DDLSLFFQ

SEQ ID NO: 39894 - protein, 8 aa, Borrelia garinii PBi
DLSLFFQK

SEQ ID NO: 39895 - protein, 8 aa, Borrelia garinii PBi
LSLFFQKV

SEQ ID NO: 39896 - protein, 8 aa, Borrelia garinii PBi
SLFFQKVA

SEQ ID NO: 39897 - protein, 8 aa, Borrelia garinii PBi
LFFQKVAD

SEQ ID NO: 39898 - protein, 8 aa, Borrelia garinii PBi
FFQKVADA

SEQ ID NO: 39899 - protein, 8 aa, Borrelia garinii PBi
FQKVADAF

SEQ ID NO: 39900 - protein, 8 aa, Borrelia garinii PBi
QKVADAFG

SEQ ID NO: 39901 - protein, 8 aa, Borrelia garinii PBi
KVADAFGT

SEQ ID NO: 39902 - protein, 8 aa, Borrelia garinii PBi
VADAFGTQ

SEQ ID NO: 39903 - protein, 8 aa, Borrelia garinii PBi
ADAFGTQE

SEQ ID NO: 39904 - protein, 8 aa, Borrelia garinii PBi
DAFGTQEY

SEQ ID NO: 39905 - protein, 8 aa, Borrelia garinii PBi
AFGTQEYK

SEQ ID NO: 39906 - protein, 8 aa, Borrelia garinii PBi
FGTQEYKN

SEQ ID NO: 39907 - protein, 8 aa, Borrelia garinii PBi
GTQEYKNK

SEQ ID NO: 39908 - protein, 8 aa, Borrelia garinii PBi
TQEYKNKD

SEQ ID NO: 39909 - protein, 8 aa, Borrelia garinii PBi
QEYKNKDE

SEQ ID NO: 39910 - protein, 8 aa, Borrelia garinii PBi
EYKNKDED

SEQ ID NO: 39911 - protein, 8 aa, Borrelia garinii PBi
YKNKDEDD

SEQ ID NO: 39912 - protein, 8 aa, Borrelia garinii PBi
KNKDEDDE

SEQ ID NO: 39913 - protein, 8 aa, Borrelia garinii PBi
NKDEDDEN

SEQ ID NO: 39914 - protein, 8 aa, Borrelia garinii PBi
KDEDDENN

SEQ ID NO: 39915 - protein, 8 aa, Borrelia garinii PBi
DEDDENNQ

SEQ ID NO: 39916 - protein, 8 aa, Borrelia garinii PBi
EDDENNQK

SEQ ID NO: 39917 - protein, 8 aa, Borrelia garinii PBi
DDENNQKP

SEQ ID NO: 39918 - protein, 8 aa, Borrelia garinii PBi
DENNQKPE

SEQ ID NO: 39919 - protein, 8 aa, Borrelia garinii PBi
ENNQKPEK

SEQ ID NO: 39920 - protein, 8 aa, Borrelia garinii PBi
NNQKPEKC

SEQ ID NO: 39921 - protein, 8 aa, Borrelia garinii PBi
NQKPEKCN

SEQ ID NO: 39922 - protein, 8 aa, Borrelia garinii PBi
QKPEKCNE

SEQ ID NO: 39923 - protein, 8 aa, Borrelia garinii PBi
KPEKCNEE

SEQ ID NO: 39924 - protein, 8 aa, Borrelia garinii PBi
PEKCNEEI

SEQ ID NO: 39925 - protein, 8 aa, Borrelia garinii PBi
EKCNEEIF

SEQ ID NO: 39926 - protein, 8 aa, Borrelia garinii PBi
KCNEEIFK

SEQ ID NO: 39927 - protein, 8 aa, Borrelia garinii PBi
CNEEIFKV

SEQ ID NO: 39928 - protein, 8 aa, Borrelia garinii PBi
NEEIFKVI

SEQ ID NO: 39929 - protein, 8 aa, Borrelia garinii PBi
EEIFKVIK

SEQ ID NO: 39930 - protein, 8 aa, Borrelia garinii PBi
EIFKVIKR

SEQ ID NO: 39931 - protein, 8 aa, Borrelia garinii PBi
IFKVIKRV

SEQ ID NO: 39932 - protein, 8 aa, Borrelia garinii PBi
FKVIKRVF

SEQ ID NO: 39933 - protein, 8 aa, Borrelia garinii PBi
KVIKRVFT

SEQ ID NO: 39934 - protein, 8 aa, Borrelia garinii PBi
VIKRVFTE

SEQ ID NO: 39935 - protein, 8 aa, Borrelia garinii PBi
IKRVFTES

SEQ ID NO: 39936 - protein, 8 aa, Borrelia garinii PBi
KRVFTESE

SEQ ID NO: 39937 - protein, 8 aa, Borrelia garinii PBi
RVFTESEN

SEQ ID NO: 39938 - protein, 8 aa, Borrelia garinii PBi
VFTESENN

SEQ ID NO: 39939 - protein, 8 aa, Borrelia garinii PBi
FTESENNN

SEQ ID NO: 39940 - protein, 8 aa, Borrelia garinii PBi
TESENNNE

SEQ ID NO: 39941 - protein, 8 aa, Borrelia garinii PBi
ESENNNEL

SEQ ID NO: 39942 - protein, 8 aa, Borrelia garinii PBi
SENNNELA

SEQ ID NO: 39943 - protein, 8 aa, Borrelia garinii PBi
ENNNELAN

SEQ ID NO: 39944 - protein, 8 aa, Borrelia garinii PBi
NNNELANL

SEQ ID NO: 39945 - protein, 8 aa, Borrelia garinii PBi
NNELANLK

SEQ ID NO: 39946 - protein, 8 aa, Borrelia garinii PBi
NELANLKN

SEQ ID NO: 39947 - protein, 8 aa, Borrelia garinii PBi
ELANLKNL

SEQ ID NO: 39948 - protein, 8 aa, Borrelia garinii PBi
LANLKNLN

SEQ ID NO: 39949 - protein, 8 aa, Borrelia garinii PBi
ANLKNLNS

SEQ ID NO: 39950 - protein, 8 aa, Borrelia garinii PBi
NLKNLNSY

SEQ ID NO: 39951 - protein, 8 aa, Borrelia garinii PBi
LKNLNSYN

SEQ ID NO: 39952 - protein, 8 aa, Borrelia garinii PBi
KNLNSYNL

SEQ ID NO: 39953 - protein, 8 aa, Borrelia garinii PBi
NLNSYNLN

SEQ ID NO: 39954 - protein, 8 aa, Borrelia garinii PBi
LNSYNLNS

SEQ ID NO: 39955 - protein, 8 aa, Borrelia garinii PBi
NSYNLNSN

SEQ ID NO: 39956 - protein, 8 aa, Borrelia garinii PBi
SYNLNSNN

SEQ ID NO: 39957 - protein, 8 aa, Borrelia garinii PBi
YNLNSNNK

SEQ ID NO: 39958 - protein, 9 aa, Borrelia garinii PBi
MKRISILSI

SEQ ID NO: 39959 - protein, 9 aa, Borrelia garinii PBi
KRISILSIL

SEQ ID NO: 39960 - protein, 9 aa, Borrelia garinii PBi
RISILSILL

SEQ ID NO: 39961 - protein, 9 aa, Borrelia garinii PBi
ISILSILLL

SEQ ID NO: 39962 - protein, 9 aa, Borrelia garinii PBi
SILSILLLL

SEQ ID NO: 39963 - protein, 9 aa, Borrelia garinii PBi
ILSILLLLL

SEQ ID NO: 39964 - protein, 9 aa, Borrelia garinii PBi
LSILLLLLL

SEQ ID NO: 39965 - protein, 9 aa, Borrelia garinii PBi
SILLLLLLF

SEQ ID NO: 39966 - protein, 9 aa, Borrelia garinii PBi
ILLLLLLFS

SEQ ID NO: 39967 - protein, 9 aa, Borrelia garinii PBi
LLLLLLFSC

SEQ ID NO: 39968 - protein, 9 aa, Borrelia garinii PBi
LLLLLFSCK

SEQ ID NO: 39969 - protein, 9 aa, Borrelia garinii PBi
LLLLFSCKQ

SEQ ID NO: 39970 - protein, 9 aa, Borrelia garinii PBi
LLLFSCKQY

SEQ ID NO: 39971 - protein, 9 aa, Borrelia garinii PBi
LLFSCKQYG

SEQ ID NO: 39972 - protein, 9 aa, Borrelia garinii PBi
LFSCKQYGD

SEQ ID NO: 39973 - protein, 9 aa, Borrelia garinii PBi
FSCKQYGDV

SEQ ID NO: 39974 - protein, 9 aa, Borrelia garinii PBi
SCKQYGDVK

SEQ ID NO: 39975 - protein, 9 aa, Borrelia garinii PBi
CKQYGDVKS

SEQ ID NO: 39976 - protein, 9 aa, Borrelia garinii PBi
KQYGDVKSL

SEQ ID NO: 39977 - protein, 9 aa, Borrelia garinii PBi
QYGDVKSLT

SEQ ID NO: 39978 - protein, 9 aa, Borrelia garinii PBi
YGDVKSLTE

SEQ ID NO: 39979 - protein, 9 aa, Borrelia garinii PBi
GDVKSLTEV

SEQ ID NO: 39980 - protein, 9 aa, Borrelia garinii PBi
DVKSLTEVA

SEQ ID NO: 39981 - protein, 9 aa, Borrelia garinii PBi
VKSLTEVAT

SEQ ID NO: 39982 - protein, 9 aa, Borrelia garinii PBi
KSLTEVATD

SEQ ID NO: 39983 - protein, 9 aa, Borrelia garinii PBi
SLTEVATDL

SEQ ID NO: 39984 - protein, 9 aa, Borrelia garinii PBi
LTEVATDLE

SEQ ID NO: 39985 - protein, 9 aa, Borrelia garinii PBi
TEVATDLED

SEQ ID NO: 39986 - protein, 9 aa, Borrelia garinii PBi
EVATDLEDD

SEQ ID NO: 39987 - protein, 9 aa, Borrelia garinii PBi
VATDLEDDN

SEQ ID NO: 39988 - protein, 9 aa, Borrelia garinii PBi
ATDLEDDNS

SEQ ID NO: 39989 - protein, 9 aa, Borrelia garinii PBi
TDLEDDNSF

SEQ ID NO: 39990 - protein, 9 aa, Borrelia garinii PBi
DLEDDNSFA

SEQ ID NO: 39991 - protein, 9 aa, Borrelia garinii PBi
LEDDNSFAS

SEQ ID NO: 39992 - protein, 9 aa, Borrelia garinii PBi
EDDNSFASG

SEQ ID NO: 39993 - protein, 9 aa, Borrelia garinii PBi
DDNSFASGS

SEQ ID NO: 39994 - protein, 9 aa, Borrelia garinii PBi
DNSFASGSV

SEQ ID NO: 39995 - protein, 9 aa, Borrelia garinii PBi
NSFASGSVE

SEQ ID NO: 39996 - protein, 9 aa, Borrelia garinii PBi
SFASGSVES

SEQ ID NO: 39997 - protein, 9 aa, Borrelia garinii PBi
FASGSVESK

SEQ ID NO: 39998 - protein, 9 aa, Borrelia garinii PBi
ASGSVESKD

SEQ ID NO: 39999 - protein, 9 aa, Borrelia garinii PBi
SGSVESKDQ

SEQ ID NO: 40000 - protein, 9 aa, Borrelia garinii PBi
GSVESKDQI

SEQ ID NO: 40001 - protein, 9 aa, Borrelia garinii PBi
SVESKDQII

SEQ ID NO: 40002 - protein, 9 aa, Borrelia garinii PBi
VESKDQIIE

SEQ ID NO: 40003 - protein, 9 aa, Borrelia garinii PBi
ESKDQIIEK

SEQ ID NO: 40004 - protein, 9 aa, Borrelia garinii PBi
SKDQIIEKG

SEQ ID NO: 40005 - protein, 9 aa, Borrelia garinii PBi
KDQIIEKGP

SEQ ID NO: 40006 - protein, 9 aa, Borrelia garinii PBi
DQIIEKGPV

SEQ ID NO: 40007 - protein, 9 aa, Borrelia garinii PBi
QIIEKGPVL

SEQ ID NO: 40008 - protein, 9 aa, Borrelia garinii PBi
IIEKGPVLT

SEQ ID NO: 40009 - protein, 9 aa, Borrelia garinii PBi
IEKGPVLTS

SEQ ID NO: 40010 - protein, 9 aa, Borrelia garinii PBi
EKGPVLTSE

SEQ ID NO: 40011 - protein, 9 aa, Borrelia garinii PBi
KGPVLTSEE

SEQ ID NO: 40012 - protein, 9 aa, Borrelia garinii PBi
GPVLTSEEF

SEQ ID NO: 40013 - protein, 9 aa, Borrelia garinii PBi
PVLTSEEFE

SEQ ID NO: 40014 - protein, 9 aa, Borrelia garinii PBi
VLTSEEFER

SEQ ID NO: 40015 - protein, 9 aa, Borrelia garinii PBi
LTSEEFERL

SEQ ID NO: 40016 - protein, 9 aa, Borrelia garinii PBi
TSEEFERLE

SEQ ID NO: 40017 - protein, 9 aa, Borrelia garinii PBi
SEEFERLEA

SEQ ID NO: 40018 - protein, 9 aa, Borrelia garinii PBi
EEFERLEAL

SEQ ID NO: 40019 - protein, 9 aa, Borrelia garinii PBi
EFERLEALK

SEQ ID NO: 40020 - protein, 9 aa, Borrelia garinii PBi
FERLEALKT

SEQ ID NO: 40021 - protein, 9 aa, Borrelia garinii PBi
ERLEALKTF

SEQ ID NO: 40022 - protein, 9 aa, Borrelia garinii PBi
RLEALKTFL

SEQ ID NO: 40023 - protein, 9 aa, Borrelia garinii PBi
LEALKTFLK

SEQ ID NO: 40024 - protein, 9 aa, Borrelia garinii PBi
EALKTFLKD

SEQ ID NO: 40025 - protein, 9 aa, Borrelia garinii PBi
ALKTFLKDA

SEQ ID NO: 40026 - protein, 9 aa, Borrelia garinii PBi
LKTFLKDAM

SEQ ID NO: 40027 - protein, 9 aa, Borrelia garinii PBi
KTFLKDAMG

SEQ ID NO: 40028 - protein, 9 aa, Borrelia garinii PBi
TFLKDAMGV

SEQ ID NO: 40029 - protein, 9 aa, Borrelia garinii PBi
FLKDAMGVN

SEQ ID NO: 40030 - protein, 9 aa, Borrelia garinii PBi
LKDAMGVNG

SEQ ID NO: 40031 - protein, 9 aa, Borrelia garinii PBi
KDAMGVNGR

SEQ ID NO: 40032 - protein, 9 aa, Borrelia garinii PBi
DAMGVNGRE

SEQ ID NO: 40033 - protein, 9 aa, Borrelia garinii PBi
AMGVNGREG

SEQ ID NO: 40034 - protein, 9 aa, Borrelia garinii PBi
MGVNGREGD

SEQ ID NO: 40035 - protein, 9 aa, Borrelia garinii PBi
GVNGREGDT

SEQ ID NO: 40036 - protein, 9 aa, Borrelia garinii PBi
VNGREGDTK

SEQ ID NO: 40037 - protein, 9 aa, Borrelia garinii PBi
NGREGDTKA

SEQ ID NO: 40038 - protein, 9 aa, Borrelia garinii PBi
GREGDTKAE

SEQ ID NO: 40039 - protein, 9 aa, Borrelia garinii PBi
REGDTKAEY

SEQ ID NO: 40040 - protein, 9 aa, Borrelia garinii PBi
EGDTKAEYE

SEQ ID NO: 40041 - protein, 9 aa, Borrelia garinii PBi
GDTKAEYEK

SEQ ID NO: 40042 - protein, 9 aa, Borrelia garinii PBi
DTKAEYEKS

SEQ ID NO: 40043 - protein, 9 aa, Borrelia garinii PBi
TKAEYEKSY

SEQ ID NO: 40044 - protein, 9 aa, Borrelia garinii PBi
KAEYEKSYK

SEQ ID NO: 40045 - protein, 9 aa, Borrelia garinii PBi
AEYEKSYKE

SEQ ID NO: 40046 - protein, 9 aa, Borrelia garinii PBi
EYEKSYKEF

SEQ ID NO: 40047 - protein, 9 aa, Borrelia garinii PBi
YEKSYKEFF

SEQ ID NO: 40048 - protein, 9 aa, Borrelia garinii PBi
EKSYKEFFD

SEQ ID NO: 40049 - protein, 9 aa, Borrelia garinii PBi
KSYKEFFDW

SEQ ID NO: 40050 - protein, 9 aa, Borrelia garinii PBi
SYKEFFDWL

SEQ ID NO: 40051 - protein, 9 aa, Borrelia garinii PBi
YKEFFDWLS

SEQ ID NO: 40052 - protein, 9 aa, Borrelia garinii PBi
KEFFDWLSK

SEQ ID NO: 40053 - protein, 9 aa, Borrelia garinii PBi
EFFDWLSKD

SEQ ID NO: 40054 - protein, 9 aa, Borrelia garinii PBi
FFDWLSKDV

SEQ ID NO: 40055 - protein, 9 aa, Borrelia garinii PBi
FDWLSKDVN

SEQ ID NO: 40056 - protein, 9 aa, Borrelia garinii PBi
DWLSKDVNR

SEQ ID NO: 40057 - protein, 9 aa, Borrelia garinii PBi
WLSKDVNRQ

SEQ ID NO: 40058 - protein, 9 aa, Borrelia garinii PBi
LSKDVNRQK

SEQ ID NO: 40059 - protein, 9 aa, Borrelia garinii PBi
SKDVNRQKE

SEQ ID NO: 40060 - protein, 9 aa, Borrelia garinii PBi
KDVNRQKEF

SEQ ID NO: 40061 - protein, 9 aa, Borrelia garinii PBi
DVNRQKEFV

SEQ ID NO: 40062 - protein, 9 aa, Borrelia garinii PBi
VNRQKEFVS

SEQ ID NO: 40063 - protein, 9 aa, Borrelia garinii PBi
NRQKEFVSF

SEQ ID NO: 40064 - protein, 9 aa, Borrelia garinii PBi
RQKEFVSFF

SEQ ID NO: 40065 - protein, 9 aa, Borrelia garinii PBi
QKEFVSFFN

SEQ ID NO: 40066 - protein, 9 aa, Borrelia garinii PBi
KEFVSFFNN

SEQ ID NO: 40067 - protein, 9 aa, Borrelia garinii PBi
EFVSFFNNI

SEQ ID NO: 40068 - protein, 9 aa, Borrelia garinii PBi
FVSFFNNIC

SEQ ID NO: 40069 - protein, 9 aa, Borrelia garinii PBi
VSFFNNICG

SEQ ID NO: 40070 - protein, 9 aa, Borrelia garinii PBi
SFFNNICGI

SEQ ID NO: 40071 - protein, 9 aa, Borrelia garinii PBi
FFNNICGII

SEQ ID NO: 40072 - protein, 9 aa, Borrelia garinii PBi
FNNICGIIT

SEQ ID NO: 40073 - protein, 9 aa, Borrelia garinii PBi
NNICGIITK

SEQ ID NO: 40074 - protein, 9 aa, Borrelia garinii PBi
NICGIITKA

SEQ ID NO: 40075 - protein, 9 aa, Borrelia garinii PBi
ICGIITKAV

SEQ ID NO: 40076 - protein, 9 aa, Borrelia garinii PBi
CGIITKAVD

SEQ ID NO: 40077 - protein, 9 aa, Borrelia garinii PBi
GIITKAVDA

SEQ ID NO: 40078 - protein, 9 aa, Borrelia garinii PBi
IITKAVDAS

SEQ ID NO: 40079 - protein, 9 aa, Borrelia garinii PBi
ITKAVDASK

SEQ ID NO: 40080 - protein, 9 aa, Borrelia garinii PBi
TKAVDASKK

SEQ ID NO: 40081 - protein, 9 aa, Borrelia garinii PBi
KAVDASKKR

SEQ ID NO: 40082 - protein, 9 aa, Borrelia garinii PBi
AVDASKKRY

SEQ ID NO: 40083 - protein, 9 aa, Borrelia garinii PBi
VDASKKRYN

SEQ ID NO: 40084 - protein, 9 aa, Borrelia garinii PBi
DASKKRYNS

SEQ ID NO: 40085 - protein, 9 aa, Borrelia garinii PBi
ASKKRYNSN

SEQ ID NO: 40086 - protein, 9 aa, Borrelia garinii PBi
SKKRYNSNP

SEQ ID NO: 40087 - protein, 9 aa, Borrelia garinii PBi
KKRYNSNPK

SEQ ID NO: 40088 - protein, 9 aa, Borrelia garinii PBi
KRYNSNPKS

SEQ ID NO: 40089 - protein, 9 aa, Borrelia garinii PBi
RYNSNPKSL

SEQ ID NO: 40090 - protein, 9 aa, Borrelia garinii PBi
YNSNPKSLG

SEQ ID NO: 40091 - protein, 9 aa, Borrelia garinii PBi
NSNPKSLGF

SEQ ID NO: 40092 - protein, 9 aa, Borrelia garinii PBi
SNPKSLGFN

SEQ ID NO: 40093 - protein, 9 aa, Borrelia garinii PBi
NPKSLGFNE

SEQ ID NO: 40094 - protein, 9 aa, Borrelia garinii PBi
PKSLGFNEY

SEQ ID NO: 40095 - protein, 9 aa, Borrelia garinii PBi
KSLGFNEYV

SEQ ID NO: 40096 - protein, 9 aa, Borrelia garinii PBi
SLGFNEYVC

SEQ ID NO: 40097 - protein, 9 aa, Borrelia garinii PBi
LGFNEYVCY

SEQ ID NO: 40098 - protein, 9 aa, Borrelia garinii PBi
GFNEYVCYD

SEQ ID NO: 40099 - protein, 9 aa, Borrelia garinii PBi
FNEYVCYDI

SEQ ID NO: 40100 - protein, 9 aa, Borrelia garinii PBi
NEYVCYDIK

SEQ ID NO: 40101 - protein, 9 aa, Borrelia garinii PBi
EYVCYDIKT

SEQ ID NO: 40102 - protein, 9 aa, Borrelia garinii PBi
YVCYDIKTR

SEQ ID NO: 40103 - protein, 9 aa, Borrelia garinii PBi
VCYDIKTRT

SEQ ID NO: 40104 - protein, 9 aa, Borrelia garinii PBi
CYDIKTRTG

SEQ ID NO: 40105 - protein, 9 aa, Borrelia garinii PBi
YDIKTRTGD

SEQ ID NO: 40106 - protein, 9 aa, Borrelia garinii PBi
DIKTRTGDD

SEQ ID NO: 40107 - protein, 9 aa, Borrelia garinii PBi
IKTRTGDDL

SEQ ID NO: 40108 - protein, 9 aa, Borrelia garinii PBi
KTRTGDDLS

SEQ ID NO: 40109 - protein, 9 aa, Borrelia garinii PBi
TRTGDDLSL

SEQ ID NO: 40110 - protein, 9 aa, Borrelia garinii PBi
RTGDDLSLF

SEQ ID NO: 40111 - protein, 9 aa, Borrelia garinii PBi
TGDDLSLFF

SEQ ID NO: 40112 - protein, 9 aa, Borrelia garinii PBi
GDDLSLFFQ

SEQ ID NO: 40113 - protein, 9 aa, Borrelia garinii PBi
DDLSLFFQK

SEQ ID NO: 40114 - protein, 9 aa, Borrelia garinii PBi
DLSLFFQKV

SEQ ID NO: 40115 - protein, 9 aa, Borrelia garinii PBi
LSLFFQKVA

SEQ ID NO: 40116 - protein, 9 aa, Borrelia garinii PBi
SLFFQKVAD

SEQ ID NO: 40117 - protein, 9 aa, Borrelia garinii PBi
LFFQKVADA

SEQ ID NO: 40118 - protein, 9 aa, Borrelia garinii PBi
FFQKVADAF

SEQ ID NO: 40119 - protein, 9 aa, Borrelia garinii PBi
FQKVADAFG

SEQ ID NO: 40120 - protein, 9 aa, Borrelia garinii PBi
QKVADAFGT

SEQ ID NO: 40121 - protein, 9 aa, Borrelia garinii PBi
KVADAFGTQ

SEQ ID NO: 40122 - protein, 9 aa, Borrelia garinii PBi
VADAFGTQE

SEQ ID NO: 40123 - protein, 9 aa, Borrelia garinii PBi
ADAFGTQEY

SEQ ID NO: 40124 - protein, 9 aa, Borrelia garinii PBi
DAFGTQEYK

SEQ ID NO: 40125 - protein, 9 aa, Borrelia garinii PBi
AFGTQEYKN

SEQ ID NO: 40126 - protein, 9 aa, Borrelia garinii PBi
FGTQEYKNK

SEQ ID NO: 40127 - protein, 9 aa, Borrelia garinii PBi
GTQEYKNKD

SEQ ID NO: 40128 - protein, 9 aa, Borrelia garinii PBi
TQEYKNKDE

SEQ ID NO: 40129 - protein, 9 aa, Borrelia garinii PBi
QEYKNKDED

SEQ ID NO: 40130 - protein, 9 aa, Borrelia garinii PBi
EYKNKDEDD

SEQ ID NO: 40131 - protein, 9 aa, Borrelia garinii PBi
YKNKDEDDE

SEQ ID NO: 40132 - protein, 9 aa, Borrelia garinii PBi
KNKDEDDEN

SEQ ID NO: 40133 - protein, 9 aa, Borrelia garinii PBi
NKDEDDENN

SEQ ID NO: 40134 - protein, 9 aa, Borrelia garinii PBi
KDEDDENNQ

SEQ ID NO: 40135 - protein, 9 aa, Borrelia garinii PBi
DEDDENNQK

SEQ ID NO: 40136 - protein, 9 aa, Borrelia garinii PBi
EDDENNQKP

SEQ ID NO: 40137 - protein, 9 aa, Borrelia garinii PBi
DDENNQKPE

SEQ ID NO: 40138 - protein, 9 aa, Borrelia garinii PBi
DENNQKPEK

SEQ ID NO: 40139 - protein, 9 aa, Borrelia garinii PBi
ENNQKPEKC

SEQ ID NO: 40140 - protein, 9 aa, Borrelia garinii PBi
NNQKPEKCN

SEQ ID NO: 40141 - protein, 9 aa, Borrelia garinii PBi
NQKPEKCNE

SEQ ID NO: 40142 - protein, 9 aa, Borrelia garinii PBi
QKPEKCNEE

SEQ ID NO: 40143 - protein, 9 aa, Borrelia garinii PBi
KPEKCNEEI

SEQ ID NO: 40144 - protein, 9 aa, Borrelia garinii PBi
PEKCNEEIF

SEQ ID NO: 40145 - protein, 9 aa, Borrelia garinii PBi
EKCNEEIFK

SEQ ID NO: 40146 - protein, 9 aa, Borrelia garinii PBi
KCNEEIFKV

SEQ ID NO: 40147 - protein, 9 aa, Borrelia garinii PBi
CNEEIFKVI

SEQ ID NO: 40148 - protein, 9 aa, Borrelia garinii PBi
NEEIFKVIK

SEQ ID NO: 40149 - protein, 9 aa, Borrelia garinii PBi
EEIFKVIKR

SEQ ID NO: 40150 - protein, 9 aa, Borrelia garinii PBi
EIFKVIKRV

SEQ ID NO: 40151 - protein, 9 aa, Borrelia garinii PBi
IFKVIKRVF

SEQ ID NO: 40152 - protein, 9 aa, Borrelia garinii PBi
FKVIKRVFT

SEQ ID NO: 40153 - protein, 9 aa, Borrelia garinii PBi
KVIKRVFTE

SEQ ID NO: 40154 - protein, 9 aa, Borrelia garinii PBi
VIKRVFTES

SEQ ID NO: 40155 - protein, 9 aa, Borrelia garinii PBi
IKRVFTESE

SEQ ID NO: 40156 - protein, 9 aa, Borrelia garinii PBi
KRVFTESEN

SEQ ID NO: 40157 - protein, 9 aa, Borrelia garinii PBi
RVFTESENN

SEQ ID NO: 40158 - protein, 9 aa, Borrelia garinii PBi
VFTESENNN

SEQ ID NO: 40159 - protein, 9 aa, Borrelia garinii PBi
FTESENNNE

SEQ ID NO: 40160 - protein, 9 aa, Borrelia garinii PBi
TESENNNEL

SEQ ID NO: 40161 - protein, 9 aa, Borrelia garinii PBi
ESENNNELA

SEQ ID NO: 40162 - protein, 9 aa, Borrelia garinii PBi
SENNNELAN

SEQ ID NO: 40163 - protein, 9 aa, Borrelia garinii PBi
ENNNELANL

SEQ ID NO: 40164 - protein, 9 aa, Borrelia garinii PBi
NNNELANLK

SEQ ID NO: 40165 - protein, 9 aa, Borrelia garinii PBi
NNELANLKN

SEQ ID NO: 40166 - protein, 9 aa, Borrelia garinii PBi
NELANLKNL

SEQ ID NO: 40167 - protein, 9 aa, Borrelia garinii PBi
ELANLKNLN

SEQ ID NO: 40168 - protein, 9 aa, Borrelia garinii PBi
LANLKNLNS

SEQ ID NO: 40169 - protein, 9 aa, Borrelia garinii PBi
ANLKNLNSY

SEQ ID NO: 40170 - protein, 9 aa, Borrelia garinii PBi
NLKNLNSYN

SEQ ID NO: 40171 - protein, 9 aa, Borrelia garinii PBi
LKNLNSYNL

SEQ ID NO: 40172 - protein, 9 aa, Borrelia garinii PBi
KNLNSYNLN

SEQ ID NO: 40173 - protein, 9 aa, Borrelia garinii PBi
NLNSYNLNS

SEQ ID NO: 40174 - protein, 9 aa, Borrelia garinii PBi
LNSYNLNSN

SEQ ID NO: 40175 - protein, 9 aa, Borrelia garinii PBi
NSYNLNSNN

SEQ ID NO: 40176 - protein, 9 aa, Borrelia garinii PBi
SYNLNSNNK

SEQ ID NO: 40177 - protein, 10 aa, Borrelia garinii PBi
MKRISILSIL

SEQ ID NO: 40178 - protein, 10 aa, Borrelia garinii PBi
KRISILSILL

SEQ ID NO: 40179 - protein, 10 aa, Borrelia garinii PBi
RISILSILLL

SEQ ID NO: 40180 - protein, 10 aa, Borrelia garinii PBi
ISILSILLLL

SEQ ID NO: 40181 - protein, 10 aa, Borrelia garinii PBi
SILSILLLLL

SEQ ID NO: 40182 - protein, 10 aa, Borrelia garinii PBi
ILSILLLLLL

SEQ ID NO: 40183 - protein, 10 aa, Borrelia garinii PBi
LSILLLLLLF

SEQ ID NO: 40184 - protein, 10 aa, Borrelia garinii PBi
SILLLLLLFS

SEQ ID NO: 40185 - protein, 10 aa, Borrelia garinii PBi
ILLLLLLFSC

SEQ ID NO: 40186 - protein, 10 aa, Borrelia garinii PBi
LLLLLLFSCK

SEQ ID NO: 40187 - protein, 10 aa, Borrelia garinii PBi
LLLLLFSCKQ

SEQ ID NO: 40188 - protein, 10 aa, Borrelia garinii PBi
LLLLFSCKQY

SEQ ID NO: 40189 - protein, 10 aa, Borrelia garinii PBi
LLLFSCKQYG

SEQ ID NO: 40190 - protein, 10 aa, Borrelia garinii PBi
LLFSCKQYGD

SEQ ID NO: 40191 - protein, 10 aa, Borrelia garinii PBi
LFSCKQYGDV

SEQ ID NO: 40192 - protein, 10 aa, Borrelia garinii PBi
FSCKQYGDVK

SEQ ID NO: 40193 - protein, 10 aa, Borrelia garinii PBi
SCKQYGDVKS

SEQ ID NO: 40194 - protein, 10 aa, Borrelia garinii PBi
CKQYGDVKSL

SEQ ID NO: 40195 - protein, 10 aa, Borrelia garinii PBi
KQYGDVKSLT

SEQ ID NO: 40196 - protein, 10 aa, Borrelia garinii PBi
QYGDVKSLTE

SEQ ID NO: 40197 - protein, 10 aa, Borrelia garinii PBi
YGDVKSLTEV

SEQ ID NO: 40198 - protein, 10 aa, Borrelia garinii PBi
GDVKSLTEVA

SEQ ID NO: 40199 - protein, 10 aa, Borrelia garinii PBi
DVKSLTEVAT

SEQ ID NO: 40200 - protein, 10 aa, Borrelia garinii PBi
VKSLTEVATD

SEQ ID NO: 40201 - protein, 10 aa, Borrelia garinii PBi
KSLTEVATDL

SEQ ID NO: 40202 - protein, 10 aa, Borrelia garinii PBi
SLTEVATDLE

SEQ ID NO: 40203 - protein, 10 aa, Borrelia garinii PBi
LTEVATDLED

SEQ ID NO: 40204 - protein, 10 aa, Borrelia garinii PBi
TEVATDLEDD

SEQ ID NO: 40205 - protein, 10 aa, Borrelia garinii PBi
EVATDLEDDN

SEQ ID NO: 40206 - protein, 10 aa, Borrelia garinii PBi
VATDLEDDNS

SEQ ID NO: 40207 - protein, 10 aa, Borrelia garinii PBi
ATDLEDDNSF

SEQ ID NO: 40208 - protein, 10 aa, Borrelia garinii PBi
TDLEDDNSFA

SEQ ID NO: 40209 - protein, 10 aa, Borrelia garinii PBi
DLEDDNSFAS

SEQ ID NO: 40210 - protein, 10 aa, Borrelia garinii PBi
LEDDNSFASG

SEQ ID NO: 40211 - protein, 10 aa, Borrelia garinii PBi
EDDNSFASGS

SEQ ID NO: 40212 - protein, 10 aa, Borrelia garinii PBi
DDNSFASGSV

SEQ ID NO: 40213 - protein, 10 aa, Borrelia garinii PBi
DNSFASGSVE

SEQ ID NO: 40214 - protein, 10 aa, Borrelia garinii PBi
NSFASGSVES

SEQ ID NO: 40215 - protein, 10 aa, Borrelia garinii PBi
SFASGSVESK

SEQ ID NO: 40216 - protein, 10 aa, Borrelia garinii PBi
FASGSVESKD

SEQ ID NO: 40217 - protein, 10 aa, Borrelia garinii PBi
ASGSVESKDQ

SEQ ID NO: 40218 - protein, 10 aa, Borrelia garinii PBi
SGSVESKDQI

SEQ ID NO: 40219 - protein, 10 aa, Borrelia garinii PBi
GSVESKDQII

SEQ ID NO: 40220 - protein, 10 aa, Borrelia garinii PBi
SVESKDQIIE

SEQ ID NO: 40221 - protein, 10 aa, Borrelia garinii PBi
VESKDQIIEK

SEQ ID NO: 40222 - protein, 10 aa, Borrelia garinii PBi
ESKDQIIEKG

SEQ ID NO: 40223 - protein, 10 aa, Borrelia garinii PBi
SKDQIIEKGP

SEQ ID NO: 40224 - protein, 10 aa, Borrelia garinii PBi
KDQIIEKGPV

SEQ ID NO: 40225 - protein, 10 aa, Borrelia garinii PBi
DQIIEKGPVL

SEQ ID NO: 40226 - protein, 10 aa, Borrelia garinii PBi
QIIEKGPVLT

SEQ ID NO: 40227 - protein, 10 aa, Borrelia garinii PBi
IIEKGPVLTS

SEQ ID NO: 40228 - protein, 10 aa, Borrelia garinii PBi
IEKGPVLTSE

SEQ ID NO: 40229 - protein, 10 aa, Borrelia garinii PBi
EKGPVLTSEE

SEQ ID NO: 40230 - protein, 10 aa, Borrelia garinii PBi
KGPVLTSEEF

SEQ ID NO: 40231 - protein, 10 aa, Borrelia garinii PBi
GPVLTSEEFE

SEQ ID NO: 40232 - protein, 10 aa, Borrelia garinii PBi
PVLTSEEFER

SEQ ID NO: 40233 - protein, 10 aa, Borrelia garinii PBi
VLTSEEFERL

SEQ ID NO: 40234 - protein, 10 aa, Borrelia garinii PBi
LTSEEFERLE

SEQ ID NO: 40235 - protein, 10 aa, Borrelia garinii PBi
TSEEFERLEA

SEQ ID NO: 40236 - protein, 10 aa, Borrelia garinii PBi
SEEFERLEAL

SEQ ID NO: 40237 - protein, 10 aa, Borrelia garinii PBi
EEFERLEALK

SEQ ID NO: 40238 - protein, 10 aa, Borrelia garinii PBi
EFERLEALKT

SEQ ID NO: 40239 - protein, 10 aa, Borrelia garinii PBi
FERLEALKTF

SEQ ID NO: 40240 - protein, 10 aa, Borrelia garinii PBi
ERLEALKTFL

SEQ ID NO: 40241 - protein, 10 aa, Borrelia garinii PBi
RLEALKTFLK

SEQ ID NO: 40242 - protein, 10 aa, Borrelia garinii PBi
LEALKTFLKD

SEQ ID NO: 40243 - protein, 10 aa, Borrelia garinii PBi
EALKTFLKDA

SEQ ID NO: 40244 - protein, 10 aa, Borrelia garinii PBi
ALKTFLKDAM

SEQ ID NO: 40245 - protein, 10 aa, Borrelia garinii PBi
LKTFLKDAMG

SEQ ID NO: 40246 - protein, 10 aa, Borrelia garinii PBi
KTFLKDAMGV

SEQ ID NO: 40247 - protein, 10 aa, Borrelia garinii PBi
TFLKDAMGVN

SEQ ID NO: 40248 - protein, 10 aa, Borrelia garinii PBi
FLKDAMGVNG

SEQ ID NO: 40249 - protein, 10 aa, Borrelia garinii PBi
LKDAMGVNGR

SEQ ID NO: 40250 - protein, 10 aa, Borrelia garinii PBi
KDAMGVNGRE

SEQ ID NO: 40251 - protein, 10 aa, Borrelia garinii PBi
DAMGVNGREG

SEQ ID NO: 40252 - protein, 10 aa, Borrelia garinii PBi
AMGVNGREGD

SEQ ID NO: 40253 - protein, 10 aa, Borrelia garinii PBi
MGVNGREGDT

SEQ ID NO: 40254 - protein, 10 aa, Borrelia garinii PBi
GVNGREGDTK

SEQ ID NO: 40255 - protein, 10 aa, Borrelia garinii PBi
VNGREGDTKA

SEQ ID NO: 40256 - protein, 10 aa, Borrelia garinii PBi
NGREGDTKAE

SEQ ID NO: 40257 - protein, 10 aa, Borrelia garinii PBi
GREGDTKAEY

SEQ ID NO: 40258 - protein, 10 aa, Borrelia garinii PBi
REGDTKAEYE

SEQ ID NO: 40259 - protein, 10 aa, Borrelia garinii PBi
EGDTKAEYEK

SEQ ID NO: 40260 - protein, 10 aa, Borrelia garinii PBi
GDTKAEYEKS

SEQ ID NO: 40261 - protein, 10 aa, Borrelia garinii PBi
DTKAEYEKSY

SEQ ID NO: 40262 - protein, 10 aa, Borrelia garinii PBi
TKAEYEKSYK

SEQ ID NO: 40263 - protein, 10 aa, Borrelia garinii PBi
KAEYEKSYKE

SEQ ID NO: 40264 - protein, 10 aa, Borrelia garinii PBi
AEYEKSYKEF

SEQ ID NO: 40265 - protein, 10 aa, Borrelia garinii PBi
EYEKSYKEFF

SEQ ID NO: 40266 - protein, 10 aa, Borrelia garinii PBi
YEKSYKEFFD

SEQ ID NO: 40267 - protein, 10 aa, Borrelia garinii PBi
EKSYKEFFDW

SEQ ID NO: 40268 - protein, 10 aa, Borrelia garinii PBi
KSYKEFFDWL

SEQ ID NO: 40269 - protein, 10 aa, Borrelia garinii PBi
SYKEFFDWLS

SEQ ID NO: 40270 - protein, 10 aa, Borrelia garinii PBi
YKEFFDWLSK

SEQ ID NO: 40271 - protein, 10 aa, Borrelia garinii PBi
KEFFDWLSKD

SEQ ID NO: 40272 - protein, 10 aa, Borrelia garinii PBi
EFFDWLSKDV

SEQ ID NO: 40273 - protein, 10 aa, Borrelia garinii PBi
FFDWLSKDVN

SEQ ID NO: 40274 - protein, 10 aa, Borrelia garinii PBi
FDWLSKDVNR

SEQ ID NO: 40275 - protein, 10 aa, Borrelia garinii PBi
DWLSKDVNRQ

SEQ ID NO: 40276 - protein, 10 aa, Borrelia garinii PBi
WLSKDVNRQK

SEQ ID NO: 40277 - protein, 10 aa, Borrelia garinii PBi
LSKDVNRQKE

SEQ ID NO: 40278 - protein, 10 aa, Borrelia garinii PBi
SKDVNRQKEF

SEQ ID NO: 40279 - protein, 10 aa, Borrelia garinii PBi
KDVNRQKEFV

SEQ ID NO: 40280 - protein, 10 aa, Borrelia garinii PBi
DVNRQKEFVS

SEQ ID NO: 40281 - protein, 10 aa, Borrelia garinii PBi
VNRQKEFVSF

SEQ ID NO: 40282 - protein, 10 aa, Borrelia garinii PBi
NRQKEFVSFF

SEQ ID NO: 40283 - protein, 10 aa, Borrelia garinii PBi
RQKEFVSFFN

SEQ ID NO: 40284 - protein, 10 aa, Borrelia garinii PBi
QKEFVSFFNN

SEQ ID NO: 40285 - protein, 10 aa, Borrelia garinii PBi
KEFVSFFNNI

SEQ ID NO: 40286 - protein, 10 aa, Borrelia garinii PBi
EFVSFFNNIC

SEQ ID NO: 40287 - protein, 10 aa, Borrelia garinii PBi
FVSFFNNICG

SEQ ID NO: 40288 - protein, 10 aa, Borrelia garinii PBi
VSFFNNICGI

SEQ ID NO: 40289 - protein, 10 aa, Borrelia garinii PBi
SFFNNICGII

SEQ ID NO: 40290 - protein, 10 aa, Borrelia garinii PBi
FFNNICGIIT

SEQ ID NO: 40291 - protein, 10 aa, Borrelia garinii PBi
FNNICGIITK

SEQ ID NO: 40292 - protein, 10 aa, Borrelia garinii PBi
NNICGIITKA

SEQ ID NO: 40293 - protein, 10 aa, Borrelia garinii PBi
NICGIITKAV

SEQ ID NO: 40294 - protein, 10 aa, Borrelia garinii PBi
ICGIITKAVD

SEQ ID NO: 40295 - protein, 10 aa, Borrelia garinii PBi
CGIITKAVDA

SEQ ID NO: 40296 - protein, 10 aa, Borrelia garinii PBi
GIITKAVDAS

SEQ ID NO: 40297 - protein, 10 aa, Borrelia garinii PBi
IITKAVDASK

SEQ ID NO: 40298 - protein, 10 aa, Borrelia garinii PBi
ITKAVDASKK

SEQ ID NO: 40299 - protein, 10 aa, Borrelia garinii PBi
TKAVDASKKR

SEQ ID NO: 40300 - protein, 10 aa, Borrelia garinii PBi
KAVDASKKRY

SEQ ID NO: 40301 - protein, 10 aa, Borrelia garinii PBi
AVDASKKRYN

SEQ ID NO: 40302 - protein, 10 aa, Borrelia garinii PBi
VDASKKRYNS

SEQ ID NO: 40303 - protein, 10 aa, Borrelia garinii PBi
DASKKRYNSN

SEQ ID NO: 40304 - protein, 10 aa, Borrelia garinii PBi
ASKKRYNSNP

SEQ ID NO: 40305 - protein, 10 aa, Borrelia garinii PBi
SKKRYNSNPK

SEQ ID NO: 40306 - protein, 10 aa, Borrelia garinii PBi
KKRYNSNPKS

SEQ ID NO: 40307 - protein, 10 aa, Borrelia garinii PBi
KRYNSNPKSL

SEQ ID NO: 40308 - protein, 10 aa, Borrelia garinii PBi
RYNSNPKSLG

SEQ ID NO: 40309 - protein, 10 aa, Borrelia garinii PBi
YNSNPKSLGF

SEQ ID NO: 40310 - protein, 10 aa, Borrelia garinii PBi
NSNPKSLGFN

SEQ ID NO: 40311 - protein, 10 aa, Borrelia garinii PBi
SNPKSLGFNE

SEQ ID NO: 40312 - protein, 10 aa, Borrelia garinii PBi
NPKSLGFNEY

SEQ ID NO: 40313 - protein, 10 aa, Borrelia garinii PBi
PKSLGFNEYV

SEQ ID NO: 40314 - protein, 10 aa, Borrelia garinii PBi
KSLGFNEYVC

SEQ ID NO: 40315 - protein, 10 aa, Borrelia garinii PBi
SLGFNEYVCY

SEQ ID NO: 40316 - protein, 10 aa, Borrelia garinii PBi
LGFNEYVCYD

SEQ ID NO: 40317 - protein, 10 aa, Borrelia garinii PBi
GFNEYVCYDI

SEQ ID NO: 40318 - protein, 10 aa, Borrelia garinii PBi
FNEYVCYDIK

SEQ ID NO: 40319 - protein, 10 aa, Borrelia garinii PBi
NEYVCYDIKT

SEQ ID NO: 40320 - protein, 10 aa, Borrelia garinii PBi
EYVCYDIKTR

SEQ ID NO: 40321 - protein, 10 aa, Borrelia garinii PBi
YVCYDIKTRT

SEQ ID NO: 40322 - protein, 10 aa, Borrelia garinii PBi
VCYDIKTRTG

SEQ ID NO: 40323 - protein, 10 aa, Borrelia garinii PBi
CYDIKTRTGD

SEQ ID NO: 40324 - protein, 10 aa, Borrelia garinii PBi
YDIKTRTGDD

SEQ ID NO: 40325 - protein, 10 aa, Borrelia garinii PBi
DIKTRTGDDL

SEQ ID NO: 40326 - protein, 10 aa, Borrelia garinii PBi
IKTRTGDDLS

SEQ ID NO: 40327 - protein, 10 aa, Borrelia garinii PBi
KTRTGDDLSL

SEQ ID NO: 40328 - protein, 10 aa, Borrelia garinii PBi
TRTGDDLSLF

SEQ ID NO: 40329 - protein, 10 aa, Borrelia garinii PBi
RTGDDLSLFF

SEQ ID NO: 40330 - protein, 10 aa, Borrelia garinii PBi
TGDDLSLFFQ

SEQ ID NO: 40331 - protein, 10 aa, Borrelia garinii PBi
GDDLSLFFQK

SEQ ID NO: 40332 - protein, 10 aa, Borrelia garinii PBi
DDLSLFFQKV

SEQ ID NO: 40333 - protein, 10 aa, Borrelia garinii PBi
DLSLFFQKVA

SEQ ID NO: 40334 - protein, 10 aa, Borrelia garinii PBi
LSLFFQKVAD

SEQ ID NO: 40335 - protein, 10 aa, Borrelia garinii PBi
SLFFQKVADA

SEQ ID NO: 40336 - protein, 10 aa, Borrelia garinii PBi
LFFQKVADAF

SEQ ID NO: 40337 - protein, 10 aa, Borrelia garinii PBi
FFQKVADAFG

SEQ ID NO: 40338 - protein, 10 aa, Borrelia garinii PBi
FQKVADAFGT

SEQ ID NO: 40339 - protein, 10 aa, Borrelia garinii PBi
QKVADAFGTQ

SEQ ID NO: 40340 - protein, 10 aa, Borrelia garinii PBi
KVADAFGTQE

SEQ ID NO: 40341 - protein, 10 aa, Borrelia garinii PBi
VADAFGTQEY

SEQ ID NO: 40342 - protein, 10 aa, Borrelia garinii PBi
ADAFGTQEYK

SEQ ID NO: 40343 - protein, 10 aa, Borrelia garinii PBi
DAFGTQEYKN

SEQ ID NO: 40344 - protein, 10 aa, Borrelia garinii PBi
AFGTQEYKNK

SEQ ID NO: 40345 - protein, 10 aa, Borrelia garinii PBi
FGTQEYKNKD

SEQ ID NO: 40346 - protein, 10 aa, Borrelia garinii PBi
GTQEYKNKDE

SEQ ID NO: 40347 - protein, 10 aa, Borrelia garinii PBi
TQEYKNKDED

SEQ ID NO: 40348 - protein, 10 aa, Borrelia garinii PBi
QEYKNKDEDD

SEQ ID NO: 40349 - protein, 10 aa, Borrelia garinii PBi
EYKNKDEDDE

SEQ ID NO: 40350 - protein, 10 aa, Borrelia garinii PBi
YKNKDEDDEN

SEQ ID NO: 40351 - protein, 10 aa, Borrelia garinii PBi
KNKDEDDENN

SEQ ID NO: 40352 - protein, 10 aa, Borrelia garinii PBi
NKDEDDENNQ

SEQ ID NO: 40353 - protein, 10 aa, Borrelia garinii PBi
KDEDDENNQK

SEQ ID NO: 40354 - protein, 10 aa, Borrelia garinii PBi
DEDDENNQKP

SEQ ID NO: 40355 - protein, 10 aa, Borrelia garinii PBi
EDDENNQKPE

SEQ ID NO: 40356 - protein, 10 aa, Borrelia garinii PBi
DDENNQKPEK

SEQ ID NO: 40357 - protein, 10 aa, Borrelia garinii PBi
DENNQKPEKC

SEQ ID NO: 40358 - protein, 10 aa, Borrelia garinii PBi
ENNQKPEKCN

SEQ ID NO: 40359 - protein, 10 aa, Borrelia garinii PBi
NNQKPEKCNE

SEQ ID NO: 40360 - protein, 10 aa, Borrelia garinii PBi
NQKPEKCNEE

SEQ ID NO: 40361 - protein, 10 aa, Borrelia garinii PBi
QKPEKCNEEI

SEQ ID NO: 40362 - protein, 10 aa, Borrelia garinii PBi
KPEKCNEEIF

SEQ ID NO: 40363 - protein, 10 aa, Borrelia garinii PBi
PEKCNEEIFK

SEQ ID NO: 40364 - protein, 10 aa, Borrelia garinii PBi
EKCNEEIFKV

SEQ ID NO: 40365 - protein, 10 aa, Borrelia garinii PBi
KCNEEIFKVI

SEQ ID NO: 40366 - protein, 10 aa, Borrelia garinii PBi
CNEEIFKVIK

SEQ ID NO: 40367 - protein, 10 aa, Borrelia garinii PBi
NEEIFKVIKR

SEQ ID NO: 40368 - protein, 10 aa, Borrelia garinii PBi
EEIFKVIKRV

SEQ ID NO: 40369 - protein, 10 aa, Borrelia garinii PBi
EIFKVIKRVF

SEQ ID NO: 40370 - protein, 10 aa, Borrelia garinii PBi
IFKVIKRVFT

SEQ ID NO: 40371 - protein, 10 aa, Borrelia garinii PBi
FKVIKRVFTE

SEQ ID NO: 40372 - protein, 10 aa, Borrelia garinii PBi
KVIKRVFTES

SEQ ID NO: 40373 - protein, 10 aa, Borrelia garinii PBi
VIKRVFTESE

SEQ ID NO: 40374 - protein, 10 aa, Borrelia garinii PBi
IKRVFTESEN

SEQ ID NO: 40375 - protein, 10 aa, Borrelia garinii PBi
KRVFTESENN

SEQ ID NO: 40376 - protein, 10 aa, Borrelia garinii PBi
RVFTESENNN

SEQ ID NO: 40377 - protein, 10 aa, Borrelia garinii PBi
VFTESENNNE

SEQ ID NO: 40378 - protein, 10 aa, Borrelia garinii PBi
FTESENNNEL

SEQ ID NO: 40379 - protein, 10 aa, Borrelia garinii PBi
TESENNNELA

SEQ ID NO: 40380 - protein, 10 aa, Borrelia garinii PBi
ESENNNELAN

SEQ ID NO: 40381 - protein, 10 aa, Borrelia garinii PBi
SENNNELANL

SEQ ID NO: 40382 - protein, 10 aa, Borrelia garinii PBi
ENNNELANLK

SEQ ID NO: 40383 - protein, 10 aa, Borrelia garinii PBi
NNNELANLKN

SEQ ID NO: 40384 - protein, 10 aa, Borrelia garinii PBi
NNELANLKNL

SEQ ID NO: 40385 - protein, 10 aa, Borrelia garinii PBi
NELANLKNLN

SEQ ID NO: 40386 - protein, 10 aa, Borrelia garinii PBi
ELANLKNLNS

SEQ ID NO: 40387 - protein, 10 aa, Borrelia garinii PBi
LANLKNLNSY

SEQ ID NO: 40388 - protein, 10 aa, Borrelia garinii PBi
ANLKNLNSYN

SEQ ID NO: 40389 - protein, 10 aa, Borrelia garinii PBi
NLKNLNSYNL

SEQ ID NO: 40390 - protein, 10 aa, Borrelia garinii PBi
LKNLNSYNLN

SEQ ID NO: 40391 - protein, 10 aa, Borrelia garinii PBi
KNLNSYNLNS

SEQ ID NO: 40392 - protein, 10 aa, Borrelia garinii PBi
NLNSYNLNSN

SEQ ID NO: 40393 - protein, 10 aa, Borrelia garinii PBi
LNSYNLNSNN

SEQ ID NO: 40394 - protein, 10 aa, Borrelia garinii PBi
NSYNLNSNNK

SEQ ID NO: 40395 - protein, 11 aa, Borrelia garinii PBi
MKRISILSILL

SEQ ID NO: 40396 - protein, 11 aa, Borrelia garinii PBi
KRISILSILLL

SEQ ID NO: 40397 - protein, 11 aa, Borrelia garinii PBi
RISILSILLLL

SEQ ID NO: 40398 - protein, 11 aa, Borrelia garinii PBi
ISILSILLLLL

SEQ ID NO: 40399 - protein, 11 aa, Borrelia garinii PBi
SILSILLLLLL

SEQ ID NO: 40400 - protein, 11 aa, Borrelia garinii PBi
ILSILLLLLLF

SEQ ID NO: 40401 - protein, 11 aa, Borrelia garinii PBi
LSILLLLLLFS

SEQ ID NO: 40402 - protein, 11 aa, Borrelia garinii PBi
SILLLLLLFSC

SEQ ID NO: 40403 - protein, 11 aa, Borrelia garinii PBi
ILLLLLLFSCK

SEQ ID NO: 40404 - protein, 11 aa, Borrelia garinii PBi
LLLLLLFSCKQ

SEQ ID NO: 40405 - protein, 11 aa, Borrelia garinii PBi
LLLLLFSCKQY

SEQ ID NO: 40406 - protein, 11 aa, Borrelia garinii PBi
LLLLFSCKQYG

SEQ ID NO: 40407 - protein, 11 aa, Borrelia garinii PBi
LLLFSCKQYGD

SEQ ID NO: 40408 - protein, 11 aa, Borrelia garinii PBi
LLFSCKQYGDV

SEQ ID NO: 40409 - protein, 11 aa, Borrelia garinii PBi
LFSCKQYGDVK

SEQ ID NO: 40410 - protein, 11 aa, Borrelia garinii PBi
FSCKQYGDVKS

SEQ ID NO: 40411 - protein, 11 aa, Borrelia garinii PBi
SCKQYGDVKSL

SEQ ID NO: 40412 - protein, 11 aa, Borrelia garinii PBi
CKQYGDVKSLT

SEQ ID NO: 40413 - protein, 11 aa, Borrelia garinii PBi
KQYGDVKSLTE

SEQ ID NO: 40414 - protein, 11 aa, Borrelia garinii PBi
QYGDVKSLTEV

SEQ ID NO: 40415 - protein, 11 aa, Borrelia garinii PBi
YGDVKSLTEVA

SEQ ID NO: 40416 - protein, 11 aa, Borrelia garinii PBi
GDVKSLTEVAT

SEQ ID NO: 40417 - protein, 11 aa, Borrelia garinii PBi
DVKSLTEVATD

SEQ ID NO: 40418 - protein, 11 aa, Borrelia garinii PBi
VKSLTEVATDL

SEQ ID NO: 40419 - protein, 11 aa, Borrelia garinii PBi
KSLTEVATDLE

SEQ ID NO: 40420 - protein, 11 aa, Borrelia garinii PBi
SLTEVATDLED

SEQ ID NO: 40421 - protein, 11 aa, Borrelia garinii PBi
LTEVATDLEDD

SEQ ID NO: 40422 - protein, 11 aa, Borrelia garinii PBi
TEVATDLEDDN

SEQ ID NO: 40423 - protein, 11 aa, Borrelia garinii PBi
EVATDLEDDNS

SEQ ID NO: 40424 - protein, 11 aa, Borrelia garinii PBi
VATDLEDDNSF

SEQ ID NO: 40425 - protein, 11 aa, Borrelia garinii PBi
ATDLEDDNSFA

SEQ ID NO: 40426 - protein, 11 aa, Borrelia garinii PBi
TDLEDDNSFAS

SEQ ID NO: 40427 - protein, 11 aa, Borrelia garinii PBi
DLEDDNSFASG

SEQ ID NO: 40428 - protein, 11 aa, Borrelia garinii PBi
LEDDNSFASGS

SEQ ID NO: 40429 - protein, 11 aa, Borrelia garinii PBi
EDDNSFASGSV

SEQ ID NO: 40430 - protein, 11 aa, Borrelia garinii PBi
DDNSFASGSVE

SEQ ID NO: 40431 - protein, 11 aa, Borrelia garinii PBi
DNSFASGSVES

SEQ ID NO: 40432 - protein, 11 aa, Borrelia garinii PBi
NSFASGSVESK

SEQ ID NO: 40433 - protein, 11 aa, Borrelia garinii PBi
SFASGSVESKD

SEQ ID NO: 40434 - protein, 11 aa, Borrelia garinii PBi
FASGSVESKDQ

SEQ ID NO: 40435 - protein, 11 aa, Borrelia garinii PBi
ASGSVESKDQI

SEQ ID NO: 40436 - protein, 11 aa, Borrelia garinii PBi
SGSVESKDQII

SEQ ID NO: 40437 - protein, 11 aa, Borrelia garinii PBi
GSVESKDQIIE

SEQ ID NO: 40438 - protein, 11 aa, Borrelia garinii PBi
SVESKDQIIEK

SEQ ID NO: 40439 - protein, 11 aa, Borrelia garinii PBi
VESKDQIIEKG

SEQ ID NO: 40440 - protein, 11 aa, Borrelia garinii PBi
ESKDQIIEKGP

SEQ ID NO: 40441 - protein, 11 aa, Borrelia garinii PBi
SKDQIIEKGPV

SEQ ID NO: 40442 - protein, 11 aa, Borrelia garinii PBi
KDQIIEKGPVL

SEQ ID NO: 40443 - protein, 11 aa, Borrelia garinii PBi
DQIIEKGPVLT

SEQ ID NO: 40444 - protein, 11 aa, Borrelia garinii PBi
QIIEKGPVLTS

SEQ ID NO: 40445 - protein, 11 aa, Borrelia garinii PBi
IIEKGPVLTSE

SEQ ID NO: 40446 - protein, 11 aa, Borrelia garinii PBi
IEKGPVLTSEE

SEQ ID NO: 40447 - protein, 11 aa, Borrelia garinii PBi
EKGPVLTSEEF

SEQ ID NO: 40448 - protein, 11 aa, Borrelia garinii PBi
KGPVLTSEEFE

SEQ ID NO: 40449 - protein, 11 aa, Borrelia garinii PBi
GPVLTSEEFER

SEQ ID NO: 40450 - protein, 11 aa, Borrelia garinii PBi
PVLTSEEFERL

SEQ ID NO: 40451 - protein, 11 aa, Borrelia garinii PBi
VLTSEEFERLE

SEQ ID NO: 40452 - protein, 11 aa, Borrelia garinii PBi
LTSEEFERLEA

SEQ ID NO: 40453 - protein, 11 aa, Borrelia garinii PBi
TSEEFERLEAL

SEQ ID NO: 40454 - protein, 11 aa, Borrelia garinii PBi
SEEFERLEALK

SEQ ID NO: 40455 - protein, 11 aa, Borrelia garinii PBi
EEFERLEALKT

SEQ ID NO: 40456 - protein, 11 aa, Borrelia garinii PBi
EFERLEALKTF

SEQ ID NO: 40457 - protein, 11 aa, Borrelia garinii PBi
FERLEALKTFL

SEQ ID NO: 40458 - protein, 11 aa, Borrelia garinii PBi
ERLEALKTFLK

SEQ ID NO: 40459 - protein, 11 aa, Borrelia garinii PBi
RLEALKTFLKD

SEQ ID NO: 40460 - protein, 11 aa, Borrelia garinii PBi
LEALKTFLKDA

SEQ ID NO: 40461 - protein, 11 aa, Borrelia garinii PBi
EALKTFLKDAM

SEQ ID NO: 40462 - protein, 11 aa, Borrelia garinii PBi
ALKTFLKDAMG

SEQ ID NO: 40463 - protein, 11 aa, Borrelia garinii PBi
LKTFLKDAMGV

SEQ ID NO: 40464 - protein, 11 aa, Borrelia garinii PBi
KTFLKDAMGVN

SEQ ID NO: 40465 - protein, 11 aa, Borrelia garinii PBi
TFLKDAMGVNG

SEQ ID NO: 40466 - protein, 11 aa, Borrelia garinii PBi
FLKDAMGVNGR

SEQ ID NO: 40467 - protein, 11 aa, Borrelia garinii PBi
LKDAMGVNGRE

SEQ ID NO: 40468 - protein, 11 aa, Borrelia garinii PBi
KDAMGVNGREG

SEQ ID NO: 40469 - protein, 11 aa, Borrelia garinii PBi
DAMGVNGREGD

SEQ ID NO: 40470 - protein, 11 aa, Borrelia garinii PBi
AMGVNGREGDT

SEQ ID NO: 40471 - protein, 11 aa, Borrelia garinii PBi
MGVNGREGDTK

SEQ ID NO: 40472 - protein, 11 aa, Borrelia garinii PBi
GVNGREGDTKA

SEQ ID NO: 40473 - protein, 11 aa, Borrelia garinii PBi
VNGREGDTKAE

SEQ ID NO: 40474 - protein, 11 aa, Borrelia garinii PBi
NGREGDTKAEY

SEQ ID NO: 40475 - protein, 11 aa, Borrelia garinii PBi
GREGDTKAEYE

SEQ ID NO: 40476 - protein, 11 aa, Borrelia garinii PBi
REGDTKAEYEK

SEQ ID NO: 40477 - protein, 11 aa, Borrelia garinii PBi
EGDTKAEYEKS

SEQ ID NO: 40478 - protein, 11 aa, Borrelia garinii PBi
GDTKAEYEKSY

SEQ ID NO: 40479 - protein, 11 aa, Borrelia garinii PBi
DTKAEYEKSYK

SEQ ID NO: 40480 - protein, 11 aa, Borrelia garinii PBi
TKAEYEKSYKE

SEQ ID NO: 40481 - protein, 11 aa, Borrelia garinii PBi
KAEYEKSYKEF

SEQ ID NO: 40482 - protein, 11 aa, Borrelia garinii PBi
AEYEKSYKEFF

SEQ ID NO: 40483 - protein, 11 aa, Borrelia garinii PBi
EYEKSYKEFFD

SEQ ID NO: 40484 - protein, 11 aa, Borrelia garinii PBi
YEKSYKEFFDW

SEQ ID NO: 40485 - protein, 11 aa, Borrelia garinii PBi
EKSYKEFFDWL

SEQ ID NO: 40486 - protein, 11 aa, Borrelia garinii PBi
KSYKEFFDWLS

SEQ ID NO: 40487 - protein, 11 aa, Borrelia garinii PBi
SYKEFFDWLSK

SEQ ID NO: 40488 - protein, 11 aa, Borrelia garinii PBi
YKEFFDWLSKD

SEQ ID NO: 40489 - protein, 11 aa, Borrelia garinii PBi
KEFFDWLSKDV

SEQ ID NO: 40490 - protein, 11 aa, Borrelia garinii PBi
EFFDWLSKDVN

SEQ ID NO: 40491 - protein, 11 aa, Borrelia garinii PBi
FFDWLSKDVNR

SEQ ID NO: 40492 - protein, 11 aa, Borrelia garinii PBi
FDWLSKDVNRQ

SEQ ID NO: 40493 - protein, 11 aa, Borrelia garinii PBi
DWLSKDVNRQK

SEQ ID NO: 40494 - protein, 11 aa, Borrelia garinii PBi
WLSKDVNRQKE

SEQ ID NO: 40495 - protein, 11 aa, Borrelia garinii PBi
LSKDVNRQKEF

SEQ ID NO: 40496 - protein, 11 aa, Borrelia garinii PBi
SKDVNRQKEFV

SEQ ID NO: 40497 - protein, 11 aa, Borrelia garinii PBi
KDVNRQKEFVS

SEQ ID NO: 40498 - protein, 11 aa, Borrelia garinii PBi
DVNRQKEFVSF

SEQ ID NO: 40499 - protein, 11 aa, Borrelia garinii PBi
VNRQKEFVSFF

SEQ ID NO: 40500 - protein, 11 aa, Borrelia garinii PBi
NRQKEFVSFFN

SEQ ID NO: 40501 - protein, 11 aa, Borrelia garinii PBi
RQKEFVSFFNN

SEQ ID NO: 40502 - protein, 11 aa, Borrelia garinii PBi
QKEFVSFFNNI

SEQ ID NO: 40503 - protein, 11 aa, Borrelia garinii PBi
KEFVSFFNNIC

SEQ ID NO: 40504 - protein, 11 aa, Borrelia garinii PBi
EFVSFFNNICG

SEQ ID NO: 40505 - protein, 11 aa, Borrelia garinii PBi
FVSFFNNICGI

SEQ ID NO: 40506 - protein, 11 aa, Borrelia garinii PBi
VSFFNNICGII

SEQ ID NO: 40507 - protein, 11 aa, Borrelia garinii PBi
SFFNNICGIIT

SEQ ID NO: 40508 - protein, 11 aa, Borrelia garinii PBi
FFNNICGIITK

SEQ ID NO: 40509 - protein, 11 aa, Borrelia garinii PBi
FNNICGIITKA

SEQ ID NO: 40510 - protein, 11 aa, Borrelia garinii PBi
NNICGIITKAV

SEQ ID NO: 40511 - protein, 11 aa, Borrelia garinii PBi
NICGIITKAVD

SEQ ID NO: 40512 - protein, 11 aa, Borrelia garinii PBi
ICGIITKAVDA

SEQ ID NO: 40513 - protein, 11 aa, Borrelia garinii PBi
CGIITKAVDAS

SEQ ID NO: 40514 - protein, 11 aa, Borrelia garinii PBi
GIITKAVDASK

SEQ ID NO: 40515 - protein, 11 aa, Borrelia garinii PBi
IITKAVDASKK

SEQ ID NO: 40516 - protein, 11 aa, Borrelia garinii PBi
ITKAVDASKKR

SEQ ID NO: 40517 - protein, 11 aa, Borrelia garinii PBi
TKAVDASKKRY

SEQ ID NO: 40518 - protein, 11 aa, Borrelia garinii PBi
KAVDASKKRYN

SEQ ID NO: 40519 - protein, 11 aa, Borrelia garinii PBi
AVDASKKRYNS

SEQ ID NO: 40520 - protein, 11 aa, Borrelia garinii PBi
VDASKKRYNSN

SEQ ID NO: 40521 - protein, 11 aa, Borrelia garinii PBi
DASKKRYNSNP

SEQ ID NO: 40522 - protein, 11 aa, Borrelia garinii PBi
ASKKRYNSNPK

SEQ ID NO: 40523 - protein, 11 aa, Borrelia garinii PBi
SKKRYNSNPKS

SEQ ID NO: 40524 - protein, 11 aa, Borrelia garinii PBi
KKRYNSNPKSL

SEQ ID NO: 40525 - protein, 11 aa, Borrelia garinii PBi
KRYNSNPKSLG

SEQ ID NO: 40526 - protein, 11 aa, Borrelia garinii PBi
RYNSNPKSLGF

SEQ ID NO: 40527 - protein, 11 aa, Borrelia garinii PBi
YNSNPKSLGFN

SEQ ID NO: 40528 - protein, 11 aa, Borrelia garinii PBi
NSNPKSLGFNE

SEQ ID NO: 40529 - protein, 11 aa, Borrelia garinii PBi
SNPKSLGFNEY

SEQ ID NO: 40530 - protein, 11 aa, Borrelia garinii PBi
NPKSLGFNEYV

SEQ ID NO: 40531 - protein, 11 aa, Borrelia garinii PBi
PKSLGFNEYVC

SEQ ID NO: 40532 - protein, 11 aa, Borrelia garinii PBi
KSLGFNEYVCY

SEQ ID NO: 40533 - protein, 11 aa, Borrelia garinii PBi
SLGFNEYVCYD

SEQ ID NO: 40534 - protein, 11 aa, Borrelia garinii PBi
LGFNEYVCYDI

SEQ ID NO: 40535 - protein, 11 aa, Borrelia garinii PBi
GFNEYVCYDIK

SEQ ID NO: 40536 - protein, 11 aa, Borrelia garinii PBi
FNEYVCYDIKT

SEQ ID NO: 40537 - protein, 11 aa, Borrelia garinii PBi
NEYVCYDIKTR

SEQ ID NO: 40538 - protein, 11 aa, Borrelia garinii PBi
EYVCYDIKTRT

SEQ ID NO: 40539 - protein, 11 aa, Borrelia garinii PBi
YVCYDIKTRTG

SEQ ID NO: 40540 - protein, 11 aa, Borrelia garinii PBi
VCYDIKTRTGD

SEQ ID NO: 40541 - protein, 11 aa, Borrelia garinii PBi
CYDIKTRTGDD

SEQ ID NO: 40542 - protein, 11 aa, Borrelia garinii PBi
YDIKTRTGDDL

SEQ ID NO: 40543 - protein, 11 aa, Borrelia garinii PBi
DIKTRTGDDLS

SEQ ID NO: 40544 - protein, 11 aa, Borrelia garinii PBi
IKTRTGDDLSL

SEQ ID NO: 40545 - protein, 11 aa, Borrelia garinii PBi
KTRTGDDLSLF

SEQ ID NO: 40546 - protein, 11 aa, Borrelia garinii PBi
TRTGDDLSLFF

SEQ ID NO: 40547 - protein, 11 aa, Borrelia garinii PBi
RTGDDLSLFFQ

SEQ ID NO: 40548 - protein, 11 aa, Borrelia garinii PBi
TGDDLSLFFQK

SEQ ID NO: 40549 - protein, 11 aa, Borrelia garinii PBi
GDDLSLFFQKV

SEQ ID NO: 40550 - protein, 11 aa, Borrelia garinii PBi
DDLSLFFQKVA

SEQ ID NO: 40551 - protein, 11 aa, Borrelia garinii PBi
DLSLFFQKVAD

SEQ ID NO: 40552 - protein, 11 aa, Borrelia garinii PBi
LSLFFQKVADA

SEQ ID NO: 40553 - protein, 11 aa, Borrelia garinii PBi
SLFFQKVADAF

SEQ ID NO: 40554 - protein, 11 aa, Borrelia garinii PBi
LFFQKVADAFG

SEQ ID NO: 40555 - protein, 11 aa, Borrelia garinii PBi
FFQKVADAFGT

SEQ ID NO: 40556 - protein, 11 aa, Borrelia garinii PBi
FQKVADAFGTQ

SEQ ID NO: 40557 - protein, 11 aa, Borrelia garinii PBi
QKVADAFGTQE

SEQ ID NO: 40558 - protein, 11 aa, Borrelia garinii PBi
KVADAFGTQEY

SEQ ID NO: 40559 - protein, 11 aa, Borrelia garinii PBi
VADAFGTQEYK

SEQ ID NO: 40560 - protein, 11 aa, Borrelia garinii PBi
ADAFGTQEYKN

SEQ ID NO: 40561 - protein, 11 aa, Borrelia garinii PBi
DAFGTQEYKNK

SEQ ID NO: 40562 - protein, 11 aa, Borrelia garinii PBi
AFGTQEYKNKD

SEQ ID NO: 40563 - protein, 11 aa, Borrelia garinii PBi
FGTQEYKNKDE

SEQ ID NO: 40564 - protein, 11 aa, Borrelia garinii PBi
GTQEYKNKDED

SEQ ID NO: 40565 - protein, 11 aa, Borrelia garinii PBi
TQEYKNKDEDD

SEQ ID NO: 40566 - protein, 11 aa, Borrelia garinii PBi
QEYKNKDEDDE

SEQ ID NO: 40567 - protein, 11 aa, Borrelia garinii PBi
EYKNKDEDDEN

SEQ ID NO: 40568 - protein, 11 aa, Borrelia garinii PBi
YKNKDEDDENN

SEQ ID NO: 40569 - protein, 11 aa, Borrelia garinii PBi
KNKDEDDENNQ

SEQ ID NO: 40570 - protein, 11 aa, Borrelia garinii PBi
NKDEDDENNQK

SEQ ID NO: 40571 - protein, 11 aa, Borrelia garinii PBi
KDEDDENNQKP

SEQ ID NO: 40572 - protein, 11 aa, Borrelia garinii PBi
DEDDENNQKPE

SEQ ID NO: 40573 - protein, 11 aa, Borrelia garinii PBi
EDDENNQKPEK

SEQ ID NO: 40574 - protein, 11 aa, Borrelia garinii PBi
DDENNQKPEKC

SEQ ID NO: 40575 - protein, 11 aa, Borrelia garinii PBi
DENNQKPEKCN

SEQ ID NO: 40576 - protein, 11 aa, Borrelia garinii PBi
ENNQKPEKCNE

SEQ ID NO: 40577 - protein, 11 aa, Borrelia garinii PBi
NNQKPEKCNEE

SEQ ID NO: 40578 - protein, 11 aa, Borrelia garinii PBi
NQKPEKCNEEI

SEQ ID NO: 40579 - protein, 11 aa, Borrelia garinii PBi
QKPEKCNEEIF

SEQ ID NO: 40580 - protein, 11 aa, Borrelia garinii PBi
KPEKCNEEIFK

SEQ ID NO: 40581 - protein, 11 aa, Borrelia garinii PBi
PEKCNEEIFKV

SEQ ID NO: 40582 - protein, 11 aa, Borrelia garinii PBi
EKCNEEIFKVI

SEQ ID NO: 40583 - protein, 11 aa, Borrelia garinii PBi
KCNEEIFKVIK

SEQ ID NO: 40584 - protein, 11 aa, Borrelia garinii PBi
CNEEIFKVIKR

SEQ ID NO: 40585 - protein, 11 aa, Borrelia garinii PBi
NEEIFKVIKRV

SEQ ID NO: 40586 - protein, 11 aa, Borrelia garinii PBi
EEIFKVIKRVF

SEQ ID NO: 40587 - protein, 11 aa, Borrelia garinii PBi
EIFKVIKRVFT

SEQ ID NO: 40588 - protein, 11 aa, Borrelia garinii PBi
IFKVIKRVFTE

SEQ ID NO: 40589 - protein, 11 aa, Borrelia garinii PBi
FKVIKRVFTES

SEQ ID NO: 40590 - protein, 11 aa, Borrelia garinii PBi
KVIKRVFTESE

SEQ ID NO: 40591 - protein, 11 aa, Borrelia garinii PBi
VIKRVFTESEN

SEQ ID NO: 40592 - protein, 11 aa, Borrelia garinii PBi
IKRVFTESENN

SEQ ID NO: 40593 - protein, 11 aa, Borrelia garinii PBi
KRVFTESENNN

SEQ ID NO: 40594 - protein, 11 aa, Borrelia garinii PBi
RVFTESENNNE

SEQ ID NO: 40595 - protein, 11 aa, Borrelia garinii PBi
VFTESENNNEL

SEQ ID NO: 40596 - protein, 11 aa, Borrelia garinii PBi
FTESENNNELA

SEQ ID NO: 40597 - protein, 11 aa, Borrelia garinii PBi
TESENNNELAN

SEQ ID NO: 40598 - protein, 11 aa, Borrelia garinii PBi
ESENNNELANL

SEQ ID NO: 40599 - protein, 11 aa, Borrelia garinii PBi
SENNNELANLK

SEQ ID NO: 40600 - protein, 11 aa, Borrelia garinii PBi
ENNNELANLKN

SEQ ID NO: 40601 - protein, 11 aa, Borrelia garinii PBi
NNNELANLKNL

SEQ ID NO: 40602 - protein, 11 aa, Borrelia garinii PBi
NNELANLKNLN

SEQ ID NO: 40603 - protein, 11 aa, Borrelia garinii PBi
NELANLKNLNS

SEQ ID NO: 40604 - protein, 11 aa, Borrelia garinii PBi
ELANLKNLNSY

SEQ ID NO: 40605 - protein, 11 aa, Borrelia garinii PBi
LANLKNLNSYN

SEQ ID NO: 40606 - protein, 11 aa, Borrelia garinii PBi
ANLKNLNSYNL

SEQ ID NO: 40607 - protein, 11 aa, Borrelia garinii PBi
NLKNLNSYNLN

SEQ ID NO: 40608 - protein, 11 aa, Borrelia garinii PBi
LKNLNSYNLNS

SEQ ID NO: 40609 - protein, 11 aa, Borrelia garinii PBi
KNLNSYNLNSN

SEQ ID NO: 40610 - protein, 11 aa, Borrelia garinii PBi
NLNSYNLNSNN

SEQ ID NO: 40611 - protein, 11 aa, Borrelia garinii PBi
LNSYNLNSNNK

SEQ ID NO: 40612 - protein, 8 aa, Borrelia burgdorferi B31
MKIKPLIQ

SEQ ID NO: 40613 - protein, 8 aa, Borrelia burgdorferi B31
KIKPLIQL

SEQ ID NO: 40614 - protein, 8 aa, Borrelia burgdorferi B31
IKPLIQLK

SEQ ID NO: 40615 - protein, 8 aa, Borrelia burgdorferi B31
KPLIQLKL

SEQ ID NO: 40616 - protein, 8 aa, Borrelia burgdorferi B31
PLIQLKLL

SEQ ID NO: 40617 - protein, 8 aa, Borrelia burgdorferi B31
LIQLKLLG

SEQ ID NO: 40618 - protein, 8 aa, Borrelia burgdorferi B31
IQLKLLGL

SEQ ID NO: 40619 - protein, 8 aa, Borrelia burgdorferi B31
QLKLLGLF

SEQ ID NO: 40620 - protein, 8 aa, Borrelia burgdorferi B31
LKLLGLFL

SEQ ID NO: 40621 - protein, 8 aa, Borrelia burgdorferi B31
KLLGLFLF

SEQ ID NO: 40622 - protein, 8 aa, Borrelia burgdorferi B31
LLGLFLFS

SEQ ID NO: 40623 - protein, 8 aa, Borrelia burgdorferi B31
LGLFLFSC

SEQ ID NO: 40624 - protein, 8 aa, Borrelia burgdorferi B31
GLFLFSCT

SEQ ID NO: 40625 - protein, 8 aa, Borrelia burgdorferi B31
LFLFSCTI

SEQ ID NO: 40626 - protein, 8 aa, Borrelia burgdorferi B31
FLFSCTID

SEQ ID NO: 40627 - protein, 8 aa, Borrelia burgdorferi B31
LFSCTIDA

SEQ ID NO: 40628 - protein, 8 aa, Borrelia burgdorferi B31
FSCTIDAN

SEQ ID NO: 40629 - protein, 8 aa, Borrelia burgdorferi B31
SCTIDANL

SEQ ID NO: 40630 - protein, 8 aa, Borrelia burgdorferi B31
CTIDANLN

SEQ ID NO: 40631 - protein, 8 aa, Borrelia burgdorferi B31
TIDANLNE

SEQ ID NO: 40632 - protein, 8 aa, Borrelia burgdorferi B31
IDANLNED

SEQ ID NO: 40633 - protein, 8 aa, Borrelia burgdorferi B31
DANLNEDY

SEQ ID NO: 40634 - protein, 8 aa, Borrelia burgdorferi B31
ANLNEDYK

SEQ ID NO: 40635 - protein, 8 aa, Borrelia burgdorferi B31
NLNEDYKN

SEQ ID NO: 40636 - protein, 8 aa, Borrelia burgdorferi B31
LNEDYKNK

SEQ ID NO: 40637 - protein, 8 aa, Borrelia burgdorferi B31
NEDYKNKV

SEQ ID NO: 40638 - protein, 8 aa, Borrelia burgdorferi B31
EDYKNKVK

SEQ ID NO: 40639 - protein, 8 aa, Borrelia burgdorferi B31
DYKNKVKG

SEQ ID NO: 40640 - protein, 8 aa, Borrelia burgdorferi B31
YKNKVKGI

SEQ ID NO: 40641 - protein, 8 aa, Borrelia burgdorferi B31
KNKVKGIL

SEQ ID NO: 40642 - protein, 8 aa, Borrelia burgdorferi B31
NKVKGILN

SEQ ID NO: 40643 - protein, 8 aa, Borrelia burgdorferi B31
KVKGILNK

SEQ ID NO: 40644 - protein, 8 aa, Borrelia burgdorferi B31
VKGILNKA

SEQ ID NO: 40645 - protein, 8 aa, Borrelia burgdorferi B31
KGILNKAA

SEQ ID NO: 40646 - protein, 8 aa, Borrelia burgdorferi B31
GILNKAAD

SEQ ID NO: 40647 - protein, 8 aa, Borrelia burgdorferi B31
ILNKAADD

SEQ ID NO: 40648 - protein, 8 aa, Borrelia burgdorferi B31
LNKAADDQ

SEQ ID NO: 40649 - protein, 8 aa, Borrelia burgdorferi B31
NKAADDQE

SEQ ID NO: 40650 - protein, 8 aa, Borrelia burgdorferi B31
KAADDQET

SEQ ID NO: 40651 - protein, 8 aa, Borrelia burgdorferi B31
AADDQETT

SEQ ID NO: 40652 - protein, 8 aa, Borrelia burgdorferi B31
ADDQETTS

SEQ ID NO: 40653 - protein, 8 aa, Borrelia burgdorferi B31
DDQETTSA

SEQ ID NO: 40654 - protein, 8 aa, Borrelia burgdorferi B31
DQETTSAD

SEQ ID NO: 40655 - protein, 8 aa, Borrelia burgdorferi B31
QETTSADT

SEQ ID NO: 40656 - protein, 8 aa, Borrelia burgdorferi B31
ETTSADTN

SEQ ID NO: 40657 - protein, 8 aa, Borrelia burgdorferi B31
TTSADTNS

SEQ ID NO: 40658 - protein, 8 aa, Borrelia burgdorferi B31
TSADTNSN

SEQ ID NO: 40659 - protein, 8 aa, Borrelia burgdorferi B31
SADTNSNA

SEQ ID NO: 40660 - protein, 8 aa, Borrelia burgdorferi B31
ADTNSNAA

SEQ ID NO: 40661 - protein, 8 aa, Borrelia burgdorferi B31
DTNSNAAK

SEQ ID NO: 40662 - protein, 8 aa, Borrelia burgdorferi B31
TNSNAAKN

SEQ ID NO: 40663 - protein, 8 aa, Borrelia burgdorferi B31
NSNAAKNI

SEQ ID NO: 40664 - protein, 8 aa, Borrelia burgdorferi B31
SNAAKNIP

SEQ ID NO: 40665 - protein, 8 aa, Borrelia burgdorferi B31
NAAKNIPI

SEQ ID NO: 40666 - protein, 8 aa, Borrelia burgdorferi B31
AAKNIPIA

SEQ ID NO: 40667 - protein, 8 aa, Borrelia burgdorferi B31
AKNIPIAD

SEQ ID NO: 40668 - protein, 8 aa, Borrelia burgdorferi B31
KNIPIADN

SEQ ID NO: 40669 - protein, 8 aa, Borrelia burgdorferi B31
NIPIADND

SEQ ID NO: 40670 - protein, 8 aa, Borrelia burgdorferi B31
IPIADNDK

SEQ ID NO: 40671 - protein, 8 aa, Borrelia burgdorferi B31
PIADNDKV

SEQ ID NO: 40672 - protein, 8 aa, Borrelia burgdorferi B31
IADNDKVA

SEQ ID NO: 40673 - protein, 8 aa, Borrelia burgdorferi B31
ADNDKVAA

SEQ ID NO: 40674 - protein, 8 aa, Borrelia burgdorferi B31
DNDKVAAE

SEQ ID NO: 40675 - protein, 8 aa, Borrelia burgdorferi B31
NDKVAAEL

SEQ ID NO: 40676 - protein, 8 aa, Borrelia burgdorferi B31
DKVAAELK

SEQ ID NO: 40677 - protein, 8 aa, Borrelia burgdorferi B31
KVAAELKK

SEQ ID NO: 40678 - protein, 8 aa, Borrelia burgdorferi B31
VAAELKKQ

SEQ ID NO: 40679 - protein, 8 aa, Borrelia burgdorferi B31
AAELKKQS

SEQ ID NO: 40680 - protein, 8 aa, Borrelia burgdorferi B31
AELKKQSQ

SEQ ID NO: 40681 - protein, 8 aa, Borrelia burgdorferi B31
ELKKQSQA

SEQ ID NO: 40682 - protein, 8 aa, Borrelia burgdorferi B31
LKKQSQAA

SEQ ID NO: 40683 - protein, 8 aa, Borrelia burgdorferi B31
KKQSQAAK

SEQ ID NO: 40684 - protein, 8 aa, Borrelia burgdorferi B31
KQSQAAKT

SEQ ID NO: 40685 - protein, 8 aa, Borrelia burgdorferi B31
QSQAAKTV

SEQ ID NO: 40686 - protein, 8 aa, Borrelia burgdorferi B31
SQAAKTVA

SEQ ID NO: 40687 - protein, 8 aa, Borrelia burgdorferi B31
QAAKTVAA

SEQ ID NO: 40688 - protein, 8 aa, Borrelia burgdorferi B31
AAKTVAAA

SEQ ID NO: 40689 - protein, 8 aa, Borrelia burgdorferi B31
AKTVAAAP

SEQ ID NO: 40690 - protein, 8 aa, Borrelia burgdorferi B31
KTVAAAPN

SEQ ID NO: 40691 - protein, 8 aa, Borrelia burgdorferi B31
TVAAAPNK

SEQ ID NO: 40692 - protein, 8 aa, Borrelia burgdorferi B31
VAAAPNKG

SEQ ID NO: 40693 - protein, 8 aa, Borrelia burgdorferi B31
AAAPNKGS

SEQ ID NO: 40694 - protein, 8 aa, Borrelia burgdorferi B31
AAPNKGSQ

SEQ ID NO: 40695 - protein, 8 aa, Borrelia burgdorferi B31
APNKGSQN

SEQ ID NO: 40696 - protein, 8 aa, Borrelia burgdorferi B31
PNKGSQNQ

SEQ ID NO: 40697 - protein, 8 aa, Borrelia burgdorferi B31
NKGSQNQP

SEQ ID NO: 40698 - protein, 8 aa, Borrelia burgdorferi B31
KGSQNQPQ

SEQ ID NO: 40699 - protein, 8 aa, Borrelia burgdorferi B31
GSQNQPQT

SEQ ID NO: 40700 - protein, 8 aa, Borrelia burgdorferi B31
SQNQPQTT

SEQ ID NO: 40701 - protein, 8 aa, Borrelia burgdorferi B31
QNQPQTTP

SEQ ID NO: 40702 - protein, 8 aa, Borrelia burgdorferi B31
NQPQTTPN

SEQ ID NO: 40703 - protein, 8 aa, Borrelia burgdorferi B31
QPQTTPNK

SEQ ID NO: 40704 - protein, 8 aa, Borrelia burgdorferi B31
PQTTPNKG

SEQ ID NO: 40705 - protein, 8 aa, Borrelia burgdorferi B31
QTTPNKGS

SEQ ID NO: 40706 - protein, 8 aa, Borrelia burgdorferi B31
TTPNKGSQ

SEQ ID NO: 40707 - protein, 8 aa, Borrelia burgdorferi B31
TPNKGSQN

SEQ ID NO: 40708 - protein, 8 aa, Borrelia burgdorferi B31
PNKGSQNQ

SEQ ID NO: 40709 - protein, 8 aa, Borrelia burgdorferi B31
NKGSQNQQ

SEQ ID NO: 40710 - protein, 8 aa, Borrelia burgdorferi B31
KGSQNQQA

SEQ ID NO: 40711 - protein, 8 aa, Borrelia burgdorferi B31
GSQNQQAA

SEQ ID NO: 40712 - protein, 8 aa, Borrelia burgdorferi B31
SQNQQAAP

SEQ ID NO: 40713 - protein, 8 aa, Borrelia burgdorferi B31
QNQQAAPS

SEQ ID NO: 40714 - protein, 8 aa, Borrelia burgdorferi B31
NQQAAPSP

SEQ ID NO: 40715 - protein, 8 aa, Borrelia burgdorferi B31
QQAAPSPQ

SEQ ID NO: 40716 - protein, 8 aa, Borrelia burgdorferi B31
QAAPSPQL

SEQ ID NO: 40717 - protein, 8 aa, Borrelia burgdorferi B31
AAPSPQLQ

SEQ ID NO: 40718 - protein, 8 aa, Borrelia burgdorferi B31
APSPQLQS

SEQ ID NO: 40719 - protein, 8 aa, Borrelia burgdorferi B31
PSPQLQSL

SEQ ID NO: 40720 - protein, 8 aa, Borrelia burgdorferi B31
SPQLQSLS

SEQ ID NO: 40721 - protein, 8 aa, Borrelia burgdorferi B31
PQLQSLSF

SEQ ID NO: 40722 - protein, 8 aa, Borrelia burgdorferi B31
QLQSLSFS

SEQ ID NO: 40723 - protein, 8 aa, Borrelia burgdorferi B31
LQSLSFSA

SEQ ID NO: 40724 - protein, 8 aa, Borrelia burgdorferi B31
QSLSFSAD

SEQ ID NO: 40725 - protein, 8 aa, Borrelia burgdorferi B31
SLSFSADL

SEQ ID NO: 40726 - protein, 8 aa, Borrelia burgdorferi B31
LSFSADLS

SEQ ID NO: 40727 - protein, 8 aa, Borrelia burgdorferi B31
SFSADLSN

SEQ ID NO: 40728 - protein, 8 aa, Borrelia burgdorferi B31
FSADLSNL

SEQ ID NO: 40729 - protein, 8 aa, Borrelia burgdorferi B31
SADLSNLP

SEQ ID NO: 40730 - protein, 8 aa, Borrelia burgdorferi B31
ADLSNLPK

SEQ ID NO: 40731 - protein, 8 aa, Borrelia burgdorferi B31
DLSNLPKT

SEQ ID NO: 40732 - protein, 8 aa, Borrelia burgdorferi B31
LSNLPKTT

SEQ ID NO: 40733 - protein, 8 aa, Borrelia burgdorferi B31
SNLPKTTA

SEQ ID NO: 40734 - protein, 8 aa, Borrelia burgdorferi B31
NLPKTTAA

SEQ ID NO: 40735 - protein, 8 aa, Borrelia burgdorferi B31
LPKTTAAR

SEQ ID NO: 40736 - protein, 8 aa, Borrelia burgdorferi B31
PKTTAARA

SEQ ID NO: 40737 - protein, 8 aa, Borrelia burgdorferi B31
KTTAARAA

SEQ ID NO: 40738 - protein, 8 aa, Borrelia burgdorferi B31
TTAARAAS

SEQ ID NO: 40739 - protein, 8 aa, Borrelia burgdorferi B31
TAARAASL

SEQ ID NO: 40740 - protein, 8 aa, Borrelia burgdorferi B31
AARAASLT

SEQ ID NO: 40741 - protein, 8 aa, Borrelia burgdorferi B31
ARAASLTK

SEQ ID NO: 40742 - protein, 8 aa, Borrelia burgdorferi B31
RAASLTKQ

SEQ ID NO: 40743 - protein, 8 aa, Borrelia burgdorferi B31
AASLTKQR

SEQ ID NO: 40744 - protein, 8 aa, Borrelia burgdorferi B31
ASLTKQRI

SEQ ID NO: 40745 - protein, 8 aa, Borrelia burgdorferi B31
SLTKQRIP

SEQ ID NO: 40746 - protein, 8 aa, Borrelia burgdorferi B31
LTKQRIPI

SEQ ID NO: 40747 - protein, 8 aa, Borrelia burgdorferi B31
TKQRIPIQ

SEQ ID NO: 40748 - protein, 8 aa, Borrelia burgdorferi B31
KQRIPIQA

SEQ ID NO: 40749 - protein, 8 aa, Borrelia burgdorferi B31
QRIPIQAV

SEQ ID NO: 40750 - protein, 8 aa, Borrelia burgdorferi B31
RIPIQAVT

SEQ ID NO: 40751 - protein, 8 aa, Borrelia burgdorferi B31
IPIQAVTT

SEQ ID NO: 40752 - protein, 8 aa, Borrelia burgdorferi B31
PIQAVTTV

SEQ ID NO: 40753 - protein, 8 aa, Borrelia burgdorferi B31
IQAVTTVP

SEQ ID NO: 40754 - protein, 8 aa, Borrelia burgdorferi B31
QAVTTVPG

SEQ ID NO: 40755 - protein, 8 aa, Borrelia burgdorferi B31
AVTTVPGN

SEQ ID NO: 40756 - protein, 8 aa, Borrelia burgdorferi B31
VTTVPGNT

SEQ ID NO: 40757 - protein, 8 aa, Borrelia burgdorferi B31
TTVPGNTR

SEQ ID NO: 40758 - protein, 8 aa, Borrelia burgdorferi B31
TVPGNTRT

SEQ ID NO: 40759 - protein, 8 aa, Borrelia burgdorferi B31
VPGNTRTF

SEQ ID NO: 40760 - protein, 8 aa, Borrelia burgdorferi B31
PGNTRTFN

SEQ ID NO: 40761 - protein, 8 aa, Borrelia burgdorferi B31
GNTRTFNS

SEQ ID NO: 40762 - protein, 8 aa, Borrelia burgdorferi B31
NTRTFNSR

SEQ ID NO: 40763 - protein, 8 aa, Borrelia burgdorferi B31
TRTFNSRN

SEQ ID NO: 40764 - protein, 8 aa, Borrelia burgdorferi B31
RTFNSRNS

SEQ ID NO: 40765 - protein, 8 aa, Borrelia burgdorferi B31
TFNSRNSG

SEQ ID NO: 40766 - protein, 8 aa, Borrelia burgdorferi B31
FNSRNSGL

SEQ ID NO: 40767 - protein, 8 aa, Borrelia burgdorferi B31
NSRNSGLP

SEQ ID NO: 40768 - protein, 8 aa, Borrelia burgdorferi B31
SRNSGLPT

SEQ ID NO: 40769 - protein, 8 aa, Borrelia burgdorferi B31
RNSGLPTF

SEQ ID NO: 40770 - protein, 8 aa, Borrelia burgdorferi B31
NSGLPTFA

SEQ ID NO: 40771 - protein, 8 aa, Borrelia burgdorferi B31
SGLPTFAL

SEQ ID NO: 40772 - protein, 8 aa, Borrelia burgdorferi B31
GLPTFALN

SEQ ID NO: 40773 - protein, 8 aa, Borrelia burgdorferi B31
LPTFALNY

SEQ ID NO: 40774 - protein, 8 aa, Borrelia burgdorferi B31
PTFALNYS

SEQ ID NO: 40775 - protein, 8 aa, Borrelia burgdorferi B31
TFALNYSF

SEQ ID NO: 40776 - protein, 8 aa, Borrelia burgdorferi B31
FALNYSFS

SEQ ID NO: 40777 - protein, 8 aa, Borrelia burgdorferi B31
ALNYSFSQ

SEQ ID NO: 40778 - protein, 8 aa, Borrelia burgdorferi B31
LNYSFSQP

SEQ ID NO: 40779 - protein, 8 aa, Borrelia burgdorferi B31
NYSFSQPT

SEQ ID NO: 40780 - protein, 8 aa, Borrelia burgdorferi B31
YSFSQPTR

SEQ ID NO: 40781 - protein, 8 aa, Borrelia burgdorferi B31
SFSQPTRQ

SEQ ID NO: 40782 - protein, 8 aa, Borrelia burgdorferi B31
FSQPTRQQ

SEQ ID NO: 40783 - protein, 8 aa, Borrelia burgdorferi B31
SQPTRQQT

SEQ ID NO: 40784 - protein, 8 aa, Borrelia burgdorferi B31
QPTRQQTN

SEQ ID NO: 40785 - protein, 8 aa, Borrelia burgdorferi B31
PTRQQTNS

SEQ ID NO: 40786 - protein, 8 aa, Borrelia burgdorferi B31
TRQQTNSS

SEQ ID NO: 40787 - protein, 8 aa, Borrelia burgdorferi B31
RQQTNSSS

SEQ ID NO: 40788 - protein, 8 aa, Borrelia burgdorferi B31
QQTNSSSA

SEQ ID NO: 40789 - protein, 8 aa, Borrelia burgdorferi B31
QTNSSSAV

SEQ ID NO: 40790 - protein, 8 aa, Borrelia burgdorferi B31
TNSSSAVQ

SEQ ID NO: 40791 - protein, 8 aa, Borrelia burgdorferi B31
NSSSAVQT

SEQ ID NO: 40792 - protein, 8 aa, Borrelia burgdorferi B31
SSSAVQTT

SEQ ID NO: 40793 - protein, 8 aa, Borrelia burgdorferi B31
SSAVQTTT

SEQ ID NO: 40794 - protein, 8 aa, Borrelia burgdorferi B31
SAVQTTTS

SEQ ID NO: 40795 - protein, 8 aa, Borrelia burgdorferi B31
AVQTTTSS

SEQ ID NO: 40796 - protein, 8 aa, Borrelia burgdorferi B31
VQTTTSSG

SEQ ID NO: 40797 - protein, 8 aa, Borrelia burgdorferi B31
QTTTSSGS

SEQ ID NO: 40798 - protein, 8 aa, Borrelia burgdorferi B31
TTTSSGSK

SEQ ID NO: 40799 - protein, 8 aa, Borrelia burgdorferi B31
TTSSGSKL

SEQ ID NO: 40800 - protein, 8 aa, Borrelia burgdorferi B31
TSSGSKLQ

SEQ ID NO: 40801 - protein, 8 aa, Borrelia burgdorferi B31
SSGSKLQT

SEQ ID NO: 40802 - protein, 8 aa, Borrelia burgdorferi B31
SGSKLQTL

SEQ ID NO: 40803 - protein, 8 aa, Borrelia burgdorferi B31
GSKLQTLK

SEQ ID NO: 40804 - protein, 8 aa, Borrelia burgdorferi B31
SKLQTLKN

SEQ ID NO: 40805 - protein, 8 aa, Borrelia burgdorferi B31
KLQTLKNE

SEQ ID NO: 40806 - protein, 8 aa, Borrelia burgdorferi B31
LQTLKNEL

SEQ ID NO: 40807 - protein, 8 aa, Borrelia burgdorferi B31
QTLKNELI

SEQ ID NO: 40808 - protein, 8 aa, Borrelia burgdorferi B31
TLKNELIR

SEQ ID NO: 40809 - protein, 8 aa, Borrelia burgdorferi B31
LKNELIRA

SEQ ID NO: 40810 - protein, 8 aa, Borrelia burgdorferi B31
KNELIRAI

SEQ ID NO: 40811 - protein, 8 aa, Borrelia burgdorferi B31
NELIRAIS

SEQ ID NO: 40812 - protein, 8 aa, Borrelia burgdorferi B31
ELIRAISE

SEQ ID NO: 40813 - protein, 8 aa, Borrelia burgdorferi B31
LIRAISEE

SEQ ID NO: 40814 - protein, 8 aa, Borrelia burgdorferi B31
IRAISEEK

SEQ ID NO: 40815 - protein, 8 aa, Borrelia burgdorferi B31
RAISEEKN

SEQ ID NO: 40816 - protein, 8 aa, Borrelia burgdorferi B31
AISEEKNK

SEQ ID NO: 40817 - protein, 8 aa, Borrelia burgdorferi B31
ISEEKNKT

SEQ ID NO: 40818 - protein, 8 aa, Borrelia burgdorferi B31
SEEKNKTQ

SEQ ID NO: 40819 - protein, 8 aa, Borrelia burgdorferi B31
EEKNKTQN

SEQ ID NO: 40820 - protein, 8 aa, Borrelia burgdorferi B31
EKNKTQNN

SEQ ID NO: 40821 - protein, 8 aa, Borrelia burgdorferi B31
KNKTQNNF

SEQ ID NO: 40822 - protein, 8 aa, Borrelia burgdorferi B31
NKTQNNFG

SEQ ID NO: 40823 - protein, 8 aa, Borrelia burgdorferi B31
KTQNNFGF

SEQ ID NO: 40824 - protein, 8 aa, Borrelia burgdorferi B31
TQNNFGFR

SEQ ID NO: 40825 - protein, 8 aa, Borrelia burgdorferi B31
QNNFGFRE

SEQ ID NO: 40826 - protein, 8 aa, Borrelia burgdorferi B31
NNFGFRET

SEQ ID NO: 40827 - protein, 8 aa, Borrelia burgdorferi B31
NFGFRETY

SEQ ID NO: 40828 - protein, 8 aa, Borrelia burgdorferi B31
FGFRETYD

SEQ ID NO: 40829 - protein, 8 aa, Borrelia burgdorferi B31
GFRETYDQ

SEQ ID NO: 40830 - protein, 8 aa, Borrelia burgdorferi B31
FRETYDQF

SEQ ID NO: 40831 - protein, 8 aa, Borrelia burgdorferi B31
RETYDQFK

SEQ ID NO: 40832 - protein, 8 aa, Borrelia burgdorferi B31
ETYDQFKM

SEQ ID NO: 40833 - protein, 8 aa, Borrelia burgdorferi B31
TYDQFKMK

SEQ ID NO: 40834 - protein, 8 aa, Borrelia burgdorferi B31
YDQFKMKD

SEQ ID NO: 40835 - protein, 8 aa, Borrelia burgdorferi B31
DQFKMKDS

SEQ ID NO: 40836 - protein, 8 aa, Borrelia burgdorferi B31
QFKMKDSA

SEQ ID NO: 40837 - protein, 8 aa, Borrelia burgdorferi B31
FKMKDSAF

SEQ ID NO: 40838 - protein, 8 aa, Borrelia burgdorferi B31
KMKDSAFE

SEQ ID NO: 40839 - protein, 8 aa, Borrelia burgdorferi B31
MKDSAFEL

SEQ ID NO: 40840 - protein, 8 aa, Borrelia burgdorferi B31
KDSAFELL

SEQ ID NO: 40841 - protein, 8 aa, Borrelia burgdorferi B31
DSAFELLD

SEQ ID NO: 40842 - protein, 8 aa, Borrelia burgdorferi B31
SAFELLDV

SEQ ID NO: 40843 - protein, 8 aa, Borrelia burgdorferi B31
AFELLDVI

SEQ ID NO: 40844 - protein, 8 aa, Borrelia burgdorferi B31
FELLDVIS

SEQ ID NO: 40845 - protein, 8 aa, Borrelia burgdorferi B31
ELLDVISS

SEQ ID NO: 40846 - protein, 8 aa, Borrelia burgdorferi B31
LLDVISSA

SEQ ID NO: 40847 - protein, 8 aa, Borrelia burgdorferi B31
LDVISSAK

SEQ ID NO: 40848 - protein, 8 aa, Borrelia burgdorferi B31
DVISSAKV

SEQ ID NO: 40849 - protein, 8 aa, Borrelia burgdorferi B31
VISSAKVY

SEQ ID NO: 40850 - protein, 8 aa, Borrelia burgdorferi B31
ISSAKVYD

SEQ ID NO: 40851 - protein, 8 aa, Borrelia burgdorferi B31
SSAKVYDR

SEQ ID NO: 40852 - protein, 8 aa, Borrelia burgdorferi B31
SAKVYDRS

SEQ ID NO: 40853 - protein, 8 aa, Borrelia burgdorferi B31
AKVYDRSY

SEQ ID NO: 40854 - protein, 8 aa, Borrelia burgdorferi B31
KVYDRSYA

SEQ ID NO: 40855 - protein, 8 aa, Borrelia burgdorferi B31
VYDRSYAP

SEQ ID NO: 40856 - protein, 8 aa, Borrelia burgdorferi B31
YDRSYAPQ

SEQ ID NO: 40857 - protein, 8 aa, Borrelia burgdorferi B31
DRSYAPQL

SEQ ID NO: 40858 - protein, 8 aa, Borrelia burgdorferi B31
RSYAPQLN

SEQ ID NO: 40859 - protein, 8 aa, Borrelia burgdorferi B31
SYAPQLNS

SEQ ID NO: 40860 - protein, 8 aa, Borrelia burgdorferi B31
YAPQLNSN

SEQ ID NO: 40861 - protein, 8 aa, Borrelia burgdorferi B31
APQLNSNT

SEQ ID NO: 40862 - protein, 8 aa, Borrelia burgdorferi B31
PQLNSNTP

SEQ ID NO: 40863 - protein, 8 aa, Borrelia burgdorferi B31
QLNSNTPE

SEQ ID NO: 40864 - protein, 8 aa, Borrelia burgdorferi B31
LNSNTPEA

SEQ ID NO: 40865 - protein, 8 aa, Borrelia burgdorferi B31
NSNTPEAE

SEQ ID NO: 40866 - protein, 8 aa, Borrelia burgdorferi B31
SNTPEAEN

SEQ ID NO: 40867 - protein, 8 aa, Borrelia burgdorferi B31
NTPEAENE

SEQ ID NO: 40868 - protein, 8 aa, Borrelia burgdorferi B31
TPEAENER

SEQ ID NO: 40869 - protein, 8 aa, Borrelia burgdorferi B31
PEAENERN

SEQ ID NO: 40870 - protein, 8 aa, Borrelia burgdorferi B31
EAENERNK

SEQ ID NO: 40871 - protein, 8 aa, Borrelia burgdorferi B31
AENERNKF

SEQ ID NO: 40872 - protein, 8 aa, Borrelia burgdorferi B31
ENERNKFY

SEQ ID NO: 40873 - protein, 8 aa, Borrelia burgdorferi B31
NERNKFYA

SEQ ID NO: 40874 - protein, 8 aa, Borrelia burgdorferi B31
ERNKFYAL

SEQ ID NO: 40875 - protein, 8 aa, Borrelia burgdorferi B31
RNKFYALM

SEQ ID NO: 40876 - protein, 8 aa, Borrelia burgdorferi B31
NKFYALMD

SEQ ID NO: 40877 - protein, 8 aa, Borrelia burgdorferi B31
KFYALMDF

SEQ ID NO: 40878 - protein, 8 aa, Borrelia burgdorferi B31
FYALMDFD

SEQ ID NO: 40879 - protein, 8 aa, Borrelia burgdorferi B31
YALMDFDQ

SEQ ID NO: 40880 - protein, 8 aa, Borrelia burgdorferi B31
ALMDFDQY

SEQ ID NO: 40881 - protein, 8 aa, Borrelia burgdorferi B31
LMDFDQYK

SEQ ID NO: 40882 - protein, 8 aa, Borrelia burgdorferi B31
MDFDQYKI

SEQ ID NO: 40883 - protein, 8 aa, Borrelia burgdorferi B31
DFDQYKIE

SEQ ID NO: 40884 - protein, 8 aa, Borrelia burgdorferi B31
FDQYKIEQ

SEQ ID NO: 40885 - protein, 8 aa, Borrelia burgdorferi B31
DQYKIEQF

SEQ ID NO: 40886 - protein, 8 aa, Borrelia burgdorferi B31
QYKIEQFG

SEQ ID NO: 40887 - protein, 8 aa, Borrelia burgdorferi B31
YKIEQFGS

SEQ ID NO: 40888 - protein, 8 aa, Borrelia burgdorferi B31
KIEQFGSI

SEQ ID NO: 40889 - protein, 8 aa, Borrelia burgdorferi B31
IEQFGSIM

SEQ ID NO: 40890 - protein, 8 aa, Borrelia burgdorferi B31
EQFGSIME

SEQ ID NO: 40891 - protein, 8 aa, Borrelia burgdorferi B31
QFGSIMEA

SEQ ID NO: 40892 - protein, 8 aa, Borrelia burgdorferi B31
FGSIMEAL

SEQ ID NO: 40893 - protein, 8 aa, Borrelia burgdorferi B31
GSIMEALY

SEQ ID NO: 40894 - protein, 8 aa, Borrelia burgdorferi B31
SIMEALYN

SEQ ID NO: 40895 - protein, 8 aa, Borrelia burgdorferi B31
IMEALYNE

SEQ ID NO: 40896 - protein, 8 aa, Borrelia burgdorferi B31
MEALYNEN

SEQ ID NO: 40897 - protein, 8 aa, Borrelia burgdorferi B31
EALYNENQ

SEQ ID NO: 40898 - protein, 8 aa, Borrelia burgdorferi B31
ALYNENQN

SEQ ID NO: 40899 - protein, 8 aa, Borrelia burgdorferi B31
LYNENQNH

SEQ ID NO: 40900 - protein, 8 aa, Borrelia burgdorferi B31
YNENQNHS

SEQ ID NO: 40901 - protein, 8 aa, Borrelia burgdorferi B31
NENQNHSL

SEQ ID NO: 40902 - protein, 8 aa, Borrelia burgdorferi B31
ENQNHSLI

SEQ ID NO: 40903 - protein, 8 aa, Borrelia burgdorferi B31
NQNHSLIR

SEQ ID NO: 40904 - protein, 8 aa, Borrelia burgdorferi B31
QNHSLIRE

SEQ ID NO: 40905 - protein, 8 aa, Borrelia burgdorferi B31
NHSLIREL

SEQ ID NO: 40906 - protein, 8 aa, Borrelia burgdorferi B31
HSLIRELM

SEQ ID NO: 40907 - protein, 8 aa, Borrelia burgdorferi B31
SLIRELMI

SEQ ID NO: 40908 - protein, 8 aa, Borrelia burgdorferi B31
LIRELMIS

SEQ ID NO: 40909 - protein, 8 aa, Borrelia burgdorferi B31
IRELMISG

SEQ ID NO: 40910 - protein, 8 aa, Borrelia burgdorferi B31
RELMISGL

SEQ ID NO: 40911 - protein, 8 aa, Borrelia burgdorferi B31
ELMISGLG

SEQ ID NO: 40912 - protein, 8 aa, Borrelia burgdorferi B31
LMISGLGT

SEQ ID NO: 40913 - protein, 8 aa, Borrelia burgdorferi B31
MISGLGTQ

SEQ ID NO: 40914 - protein, 8 aa, Borrelia burgdorferi B31
ISGLGTQI

SEQ ID NO: 40915 - protein, 8 aa, Borrelia burgdorferi B31
SGLGTQIS

SEQ ID NO: 40916 - protein, 8 aa, Borrelia burgdorferi B31
GLGTQISF

SEQ ID NO: 40917 - protein, 8 aa, Borrelia burgdorferi B31
LGTQISFE

SEQ ID NO: 40918 - protein, 8 aa, Borrelia burgdorferi B31
GTQISFEL

SEQ ID NO: 40919 - protein, 8 aa, Borrelia burgdorferi B31
TQISFELA

SEQ ID NO: 40920 - protein, 8 aa, Borrelia burgdorferi B31
QISFELAL

SEQ ID NO: 40921 - protein, 8 aa, Borrelia burgdorferi B31
ISFELALE

SEQ ID NO: 40922 - protein, 8 aa, Borrelia burgdorferi B31
SFELALEE

SEQ ID NO: 40923 - protein, 8 aa, Borrelia burgdorferi B31
FELALEEI

SEQ ID NO: 40924 - protein, 8 aa, Borrelia burgdorferi B31
ELALEEIN

SEQ ID NO: 40925 - protein, 8 aa, Borrelia burgdorferi B31
LALEEINK

SEQ ID NO: 40926 - protein, 8 aa, Borrelia burgdorferi B31
ALEEINKK

SEQ ID NO: 40927 - protein, 8 aa, Borrelia burgdorferi B31
LEEINKKI

SEQ ID NO: 40928 - protein, 8 aa, Borrelia burgdorferi B31
EEINKKIE

SEQ ID NO: 40929 - protein, 8 aa, Borrelia burgdorferi B31
EINKKIEI

SEQ ID NO: 40930 - protein, 8 aa, Borrelia burgdorferi B31
INKKIEIF

SEQ ID NO: 40931 - protein, 8 aa, Borrelia burgdorferi B31
NKKIEIFN

SEQ ID NO: 40932 - protein, 8 aa, Borrelia burgdorferi B31
KKIEIFNQ

SEQ ID NO: 40933 - protein, 8 aa, Borrelia burgdorferi B31
KIEIFNQD

SEQ ID NO: 40934 - protein, 8 aa, Borrelia burgdorferi B31
IEIFNQDY

SEQ ID NO: 40935 - protein, 8 aa, Borrelia burgdorferi B31
EIFNQDYL

SEQ ID NO: 40936 - protein, 8 aa, Borrelia burgdorferi B31
IFNQDYLN

SEQ ID NO: 40937 - protein, 8 aa, Borrelia burgdorferi B31
FNQDYLNA

SEQ ID NO: 40938 - protein, 8 aa, Borrelia burgdorferi B31
NQDYLNAK

SEQ ID NO: 40939 - protein, 8 aa, Borrelia burgdorferi B31
QDYLNAKI

SEQ ID NO: 40940 - protein, 8 aa, Borrelia burgdorferi B31
DYLNAKIN

SEQ ID NO: 40941 - protein, 8 aa, Borrelia burgdorferi B31
YLNAKINS

SEQ ID NO: 40942 - protein, 8 aa, Borrelia burgdorferi B31
LNAKINSF

SEQ ID NO: 40943 - protein, 8 aa, Borrelia burgdorferi B31
NAKINSFD

SEQ ID NO: 40944 - protein, 8 aa, Borrelia burgdorferi B31
AKINSFDF

SEQ ID NO: 40945 - protein, 8 aa, Borrelia burgdorferi B31
KINSFDFT

SEQ ID NO: 40946 - protein, 8 aa, Borrelia burgdorferi B31
INSFDFTM

SEQ ID NO: 40947 - protein, 8 aa, Borrelia burgdorferi B31
NSFDFTMK

SEQ ID NO: 40948 - protein, 8 aa, Borrelia burgdorferi B31
SFDFTMKL

SEQ ID NO: 40949 - protein, 8 aa, Borrelia burgdorferi B31
FDFTMKLK

SEQ ID NO: 40950 - protein, 8 aa, Borrelia burgdorferi B31
DFTMKLKE

SEQ ID NO: 40951 - protein, 8 aa, Borrelia burgdorferi B31
FTMKLKEL

SEQ ID NO: 40952 - protein, 8 aa, Borrelia burgdorferi B31
TMKLKELK

SEQ ID NO: 40953 - protein, 8 aa, Borrelia burgdorferi B31
MKLKELKS

SEQ ID NO: 40954 - protein, 8 aa, Borrelia burgdorferi B31
KLKELKSK

SEQ ID NO: 40955 - protein, 8 aa, Borrelia burgdorferi B31
LKELKSKL

SEQ ID NO: 40956 - protein, 8 aa, Borrelia burgdorferi B31
KELKSKLN

SEQ ID NO: 40957 - protein, 8 aa, Borrelia burgdorferi B31
ELKSKLNQ

SEQ ID NO: 40958 - protein, 8 aa, Borrelia burgdorferi B31
LKSKLNQI

SEQ ID NO: 40959 - protein, 8 aa, Borrelia burgdorferi B31
KSKLNQIL

SEQ ID NO: 40960 - protein, 8 aa, Borrelia burgdorferi B31
SKLNQILD

SEQ ID NO: 40961 - protein, 8 aa, Borrelia burgdorferi B31
KLNQILDK

SEQ ID NO: 40962 - protein, 8 aa, Borrelia burgdorferi B31
LNQILDKR

SEQ ID NO: 40963 - protein, 8 aa, Borrelia burgdorferi B31
NQILDKRK

SEQ ID NO: 40964 - protein, 8 aa, Borrelia burgdorferi B31
QILDKRKE

SEQ ID NO: 40965 - protein, 8 aa, Borrelia burgdorferi B31
ILDKRKEW

SEQ ID NO: 40966 - protein, 8 aa, Borrelia burgdorferi B31
LDKRKEWS

SEQ ID NO: 40967 - protein, 8 aa, Borrelia burgdorferi B31
DKRKEWSR

SEQ ID NO: 40968 - protein, 8 aa, Borrelia burgdorferi B31
KRKEWSRQ

SEQ ID NO: 40969 - protein, 8 aa, Borrelia burgdorferi B31
RKEWSRQA

SEQ ID NO: 40970 - protein, 8 aa, Borrelia burgdorferi B31
KEWSRQAD

SEQ ID NO: 40971 - protein, 8 aa, Borrelia burgdorferi B31
EWSRQADG

SEQ ID NO: 40972 - protein, 8 aa, Borrelia burgdorferi B31
WSRQADGL

SEQ ID NO: 40973 - protein, 8 aa, Borrelia burgdorferi B31
SRQADGLI

SEQ ID NO: 40974 - protein, 8 aa, Borrelia burgdorferi B31
RQADGLIA

SEQ ID NO: 40975 - protein, 8 aa, Borrelia burgdorferi B31
QADGLIAN

SEQ ID NO: 40976 - protein, 8 aa, Borrelia burgdorferi B31
ADGLIANA

SEQ ID NO: 40977 - protein, 8 aa, Borrelia burgdorferi B31
DGLIANAS

SEQ ID NO: 40978 - protein, 8 aa, Borrelia burgdorferi B31
GLIANASS

SEQ ID NO: 40979 - protein, 8 aa, Borrelia burgdorferi B31
LIANASSN

SEQ ID NO: 40980 - protein, 8 aa, Borrelia burgdorferi B31
IANASSNS

SEQ ID NO: 40981 - protein, 8 aa, Borrelia burgdorferi B31
ANASSNSS

SEQ ID NO: 40982 - protein, 8 aa, Borrelia burgdorferi B31
NASSNSSL

SEQ ID NO: 40983 - protein, 8 aa, Borrelia burgdorferi B31
ASSNSSLS

SEQ ID NO: 40984 - protein, 8 aa, Borrelia burgdorferi B31
SSNSSLSD

SEQ ID NO: 40985 - protein, 8 aa, Borrelia burgdorferi B31
SNSSLSDS

SEQ ID NO: 40986 - protein, 8 aa, Borrelia burgdorferi B31
NSSLSDSK

SEQ ID NO: 40987 - protein, 8 aa, Borrelia burgdorferi B31
SSLSDSKS

SEQ ID NO: 40988 - protein, 8 aa, Borrelia burgdorferi B31
SLSDSKSL

SEQ ID NO: 40989 - protein, 8 aa, Borrelia burgdorferi B31
LSDSKSLA

SEQ ID NO: 40990 - protein, 8 aa, Borrelia burgdorferi B31
SDSKSLAE

SEQ ID NO: 40991 - protein, 8 aa, Borrelia burgdorferi B31
DSKSLAEY

SEQ ID NO: 40992 - protein, 8 aa, Borrelia burgdorferi B31
SKSLAEYI

SEQ ID NO: 40993 - protein, 8 aa, Borrelia burgdorferi B31
KSLAEYIK

SEQ ID NO: 40994 - protein, 8 aa, Borrelia burgdorferi B31
SLAEYIKK

SEQ ID NO: 40995 - protein, 8 aa, Borrelia burgdorferi B31
LAEYIKKR

SEQ ID NO: 40996 - protein, 8 aa, Borrelia burgdorferi B31
AEYIKKRY

SEQ ID NO: 40997 - protein, 8 aa, Borrelia burgdorferi B31
EYIKKRYL

SEQ ID NO: 40998 - protein, 8 aa, Borrelia burgdorferi B31
YIKKRYLD

SEQ ID NO: 40999 - protein, 8 aa, Borrelia burgdorferi B31
IKKRYLDN

SEQ ID NO: 41000 - protein, 8 aa, Borrelia burgdorferi B31
KKRYLDNM

SEQ ID NO: 41001 - protein, 8 aa, Borrelia burgdorferi B31
KRYLDNMQ

SEQ ID NO: 41002 - protein, 8 aa, Borrelia burgdorferi B31
RYLDNMQN

SEQ ID NO: 41003 - protein, 8 aa, Borrelia burgdorferi B31
YLDNMQNA

SEQ ID NO: 41004 - protein, 8 aa, Borrelia burgdorferi B31
LDNMQNAR

SEQ ID NO: 41005 - protein, 8 aa, Borrelia burgdorferi B31
DNMQNARQ

SEQ ID NO: 41006 - protein, 8 aa, Borrelia burgdorferi B31
NMQNARQS

SEQ ID NO: 41007 - protein, 8 aa, Borrelia burgdorferi B31
MQNARQSV

SEQ ID NO: 41008 - protein, 8 aa, Borrelia burgdorferi B31
QNARQSVL

SEQ ID NO: 41009 - protein, 8 aa, Borrelia burgdorferi B31
NARQSVLE

SEQ ID NO: 41010 - protein, 8 aa, Borrelia burgdorferi B31
ARQSVLEA

SEQ ID NO: 41011 - protein, 8 aa, Borrelia burgdorferi B31
RQSVLEAY

SEQ ID NO: 41012 - protein, 8 aa, Borrelia burgdorferi B31
QSVLEAYI

SEQ ID NO: 41013 - protein, 8 aa, Borrelia burgdorferi B31
SVLEAYIS

SEQ ID NO: 41014 - protein, 8 aa, Borrelia burgdorferi B31
VLEAYISI

SEQ ID NO: 41015 - protein, 8 aa, Borrelia burgdorferi B31
LEAYISIM

SEQ ID NO: 41016 - protein, 9 aa, Borrelia burgdorferi B31
MKIKPLIQL

SEQ ID NO: 41017 - protein, 9 aa, Borrelia burgdorferi B31
KIKPLIQLK

SEQ ID NO: 41018 - protein, 9 aa, Borrelia burgdorferi B31
IKPLIQLKL

SEQ ID NO: 41019 - protein, 9 aa, Borrelia burgdorferi B31
KPLIQLKLL

SEQ ID NO: 41020 - protein, 9 aa, Borrelia burgdorferi B31
PLIQLKLLG

SEQ ID NO: 41021 - protein, 9 aa, Borrelia burgdorferi B31
LIQLKLLGL

SEQ ID NO: 41022 - protein, 9 aa, Borrelia burgdorferi B31
IQLKLLGLF

SEQ ID NO: 41023 - protein, 9 aa, Borrelia burgdorferi B31
QLKLLGLFL

SEQ ID NO: 41024 - protein, 9 aa, Borrelia burgdorferi B31
LKLLGLFLF

SEQ ID NO: 41025 - protein, 9 aa, Borrelia burgdorferi B31
KLLGLFLFS

SEQ ID NO: 41026 - protein, 9 aa, Borrelia burgdorferi B31
LLGLFLFSC

SEQ ID NO: 41027 - protein, 9 aa, Borrelia burgdorferi B31
LGLFLFSCT

SEQ ID NO: 41028 - protein, 9 aa, Borrelia burgdorferi B31
GLFLFSCTI

SEQ ID NO: 41029 - protein, 9 aa, Borrelia burgdorferi B31
LFLFSCTID

SEQ ID NO: 41030 - protein, 9 aa, Borrelia burgdorferi B31
FLFSCTIDA

SEQ ID NO: 41031 - protein, 9 aa, Borrelia burgdorferi B31
LFSCTIDAN

SEQ ID NO: 41032 - protein, 9 aa, Borrelia burgdorferi B31
FSCTIDANL

SEQ ID NO: 41033 - protein, 9 aa, Borrelia burgdorferi B31
SCTIDANLN

SEQ ID NO: 41034 - protein, 9 aa, Borrelia burgdorferi B31
CTIDANLNE

SEQ ID NO: 41035 - protein, 9 aa, Borrelia burgdorferi B31
TIDANLNED

SEQ ID NO: 41036 - protein, 9 aa, Borrelia burgdorferi B31
IDANLNEDY

SEQ ID NO: 41037 - protein, 9 aa, Borrelia burgdorferi B31
DANLNEDYK

SEQ ID NO: 41038 - protein, 9 aa, Borrelia burgdorferi B31
ANLNEDYKN

SEQ ID NO: 41039 - protein, 9 aa, Borrelia burgdorferi B31
NLNEDYKNK

SEQ ID NO: 41040 - protein, 9 aa, Borrelia burgdorferi B31
LNEDYKNKV

SEQ ID NO: 41041 - protein, 9 aa, Borrelia burgdorferi B31
NEDYKNKVK

SEQ ID NO: 41042 - protein, 9 aa, Borrelia burgdorferi B31
EDYKNKVKG

SEQ ID NO: 41043 - protein, 9 aa, Borrelia burgdorferi B31
DYKNKVKGI

SEQ ID NO: 41044 - protein, 9 aa, Borrelia burgdorferi B31
YKNKVKGIL

SEQ ID NO: 41045 - protein, 9 aa, Borrelia burgdorferi B31
KNKVKGILN

SEQ ID NO: 41046 - protein, 9 aa, Borrelia burgdorferi B31
NKVKGILNK

SEQ ID NO: 41047 - protein, 9 aa, Borrelia burgdorferi B31
KVKGILNKA

SEQ ID NO: 41048 - protein, 9 aa, Borrelia burgdorferi B31
VKGILNKAA

SEQ ID NO: 41049 - protein, 9 aa, Borrelia burgdorferi B31
KGILNKAAD

SEQ ID NO: 41050 - protein, 9 aa, Borrelia burgdorferi B31
GILNKAADD

SEQ ID NO: 41051 - protein, 9 aa, Borrelia burgdorferi B31
ILNKAADDQ

SEQ ID NO: 41052 - protein, 9 aa, Borrelia burgdorferi B31
LNKAADDQE

SEQ ID NO: 41053 - protein, 9 aa, Borrelia burgdorferi B31
NKAADDQET

SEQ ID NO: 41054 - protein, 9 aa, Borrelia burgdorferi B31
KAADDQETT

SEQ ID NO: 41055 - protein, 9 aa, Borrelia burgdorferi B31
AADDQETTS

SEQ ID NO: 41056 - protein, 9 aa, Borrelia burgdorferi B31
ADDQETTSA

SEQ ID NO: 41057 - protein, 9 aa, Borrelia burgdorferi B31
DDQETTSAD

SEQ ID NO: 41058 - protein, 9 aa, Borrelia burgdorferi B31
DQETTSADT

SEQ ID NO: 41059 - protein, 9 aa, Borrelia burgdorferi B31
QETTSADTN

SEQ ID NO: 41060 - protein, 9 aa, Borrelia burgdorferi B31
ETTSADTNS

SEQ ID NO: 41061 - protein, 9 aa, Borrelia burgdorferi B31
TTSADTNSN

SEQ ID NO: 41062 - protein, 9 aa, Borrelia burgdorferi B31
TSADTNSNA

SEQ ID NO: 41063 - protein, 9 aa, Borrelia burgdorferi B31
SADTNSNAA

SEQ ID NO: 41064 - protein, 9 aa, Borrelia burgdorferi B31
ADTNSNAAK

SEQ ID NO: 41065 - protein, 9 aa, Borrelia burgdorferi B31
DTNSNAAKN

SEQ ID NO: 41066 - protein, 9 aa, Borrelia burgdorferi B31
TNSNAAKNI

SEQ ID NO: 41067 - protein, 9 aa, Borrelia burgdorferi B31
NSNAAKNIP

SEQ ID NO: 41068 - protein, 9 aa, Borrelia burgdorferi B31
SNAAKNIPI

SEQ ID NO: 41069 - protein, 9 aa, Borrelia burgdorferi B31
NAAKNIPIA

SEQ ID NO: 41070 - protein, 9 aa, Borrelia burgdorferi B31
AAKNIPIAD

SEQ ID NO: 41071 - protein, 9 aa, Borrelia burgdorferi B31
AKNIPIADN

SEQ ID NO: 41072 - protein, 9 aa, Borrelia burgdorferi B31
KNIPIADND

SEQ ID NO: 41073 - protein, 9 aa, Borrelia burgdorferi B31
NIPIADNDK

SEQ ID NO: 41074 - protein, 9 aa, Borrelia burgdorferi B31
IPIADNDKV

SEQ ID NO: 41075 - protein, 9 aa, Borrelia burgdorferi B31
PIADNDKVA

SEQ ID NO: 41076 - protein, 9 aa, Borrelia burgdorferi B31
IADNDKVAA

SEQ ID NO: 41077 - protein, 9 aa, Borrelia burgdorferi B31
ADNDKVAAE

SEQ ID NO: 41078 - protein, 9 aa, Borrelia burgdorferi B31
DNDKVAAEL

SEQ ID NO: 41079 - protein, 9 aa, Borrelia burgdorferi B31
NDKVAAELK

SEQ ID NO: 41080 - protein, 9 aa, Borrelia burgdorferi B31
DKVAAELKK

SEQ ID NO: 41081 - protein, 9 aa, Borrelia burgdorferi B31
KVAAELKKQ

SEQ ID NO: 41082 - protein, 9 aa, Borrelia burgdorferi B31
VAAELKKQS

SEQ ID NO: 41083 - protein, 9 aa, Borrelia burgdorferi B31
AAELKKQSQ

SEQ ID NO: 41084 - protein, 9 aa, Borrelia burgdorferi B31
AELKKQSQA

SEQ ID NO: 41085 - protein, 9 aa, Borrelia burgdorferi B31
ELKKQSQAA

SEQ ID NO: 41086 - protein, 9 aa, Borrelia burgdorferi B31
LKKQSQAAK

SEQ ID NO: 41087 - protein, 9 aa, Borrelia burgdorferi B31
KKQSQAAKT

SEQ ID NO: 41088 - protein, 9 aa, Borrelia burgdorferi B31
KQSQAAKTV

SEQ ID NO: 41089 - protein, 9 aa, Borrelia burgdorferi B31
QSQAAKTVA

SEQ ID NO: 41090 - protein, 9 aa, Borrelia burgdorferi B31
SQAAKTVAA

SEQ ID NO: 41091 - protein, 9 aa, Borrelia burgdorferi B31
QAAKTVAAA

SEQ ID NO: 41092 - protein, 9 aa, Borrelia burgdorferi B31
AAKTVAAAP

SEQ ID NO: 41093 - protein, 9 aa, Borrelia burgdorferi B31
AKTVAAAPN

SEQ ID NO: 41094 - protein, 9 aa, Borrelia burgdorferi B31
KTVAAAPNK

SEQ ID NO: 41095 - protein, 9 aa, Borrelia burgdorferi B31
TVAAAPNKG

SEQ ID NO: 41096 - protein, 9 aa, Borrelia burgdorferi B31
VAAAPNKGS

SEQ ID NO: 41097 - protein, 9 aa, Borrelia burgdorferi B31
AAAPNKGSQ

SEQ ID NO: 41098 - protein, 9 aa, Borrelia burgdorferi B31
AAPNKGSQN

SEQ ID NO: 41099 - protein, 9 aa, Borrelia burgdorferi B31
APNKGSQNQ

SEQ ID NO: 41100 - protein, 9 aa, Borrelia burgdorferi B31
PNKGSQNQP

SEQ ID NO: 41101 - protein, 9 aa, Borrelia burgdorferi B31
NKGSQNQPQ

SEQ ID NO: 41102 - protein, 9 aa, Borrelia burgdorferi B31
KGSQNQPQT

SEQ ID NO: 41103 - protein, 9 aa, Borrelia burgdorferi B31
GSQNQPQTT

SEQ ID NO: 41104 - protein, 9 aa, Borrelia burgdorferi B31
SQNQPQTTP

SEQ ID NO: 41105 - protein, 9 aa, Borrelia burgdorferi B31
QNQPQTTPN

SEQ ID NO: 41106 - protein, 9 aa, Borrelia burgdorferi B31
NQPQTTPNK

SEQ ID NO: 41107 - protein, 9 aa, Borrelia burgdorferi B31
QPQTTPNKG

SEQ ID NO: 41108 - protein, 9 aa, Borrelia burgdorferi B31
PQTTPNKGS

SEQ ID NO: 41109 - protein, 9 aa, Borrelia burgdorferi B31
QTTPNKGSQ

SEQ ID NO: 41110 - protein, 9 aa, Borrelia burgdorferi B31
TTPNKGSQN

SEQ ID NO: 41111 - protein, 9 aa, Borrelia burgdorferi B31
TPNKGSQNQ

SEQ ID NO: 41112 - protein, 9 aa, Borrelia burgdorferi B31
PNKGSQNQQ

SEQ ID NO: 41113 - protein, 9 aa, Borrelia burgdorferi B31
NKGSQNQQA

SEQ ID NO: 41114 - protein, 9 aa, Borrelia burgdorferi B31
KGSQNQQAA

SEQ ID NO: 41115 - protein, 9 aa, Borrelia burgdorferi B31
GSQNQQAAP

SEQ ID NO: 41116 - protein, 9 aa, Borrelia burgdorferi B31
SQNQQAAPS

SEQ ID NO: 41117 - protein, 9 aa, Borrelia burgdorferi B31
QNQQAAPSP

SEQ ID NO: 41118 - protein, 9 aa, Borrelia burgdorferi B31
NQQAAPSPQ

SEQ ID NO: 41119 - protein, 9 aa, Borrelia burgdorferi B31
QQAAPSPQL

SEQ ID NO: 41120 - protein, 9 aa, Borrelia burgdorferi B31
QAAPSPQLQ

SEQ ID NO: 41121 - protein, 9 aa, Borrelia burgdorferi B31
AAPSPQLQS

SEQ ID NO: 41122 - protein, 9 aa, Borrelia burgdorferi B31
APSPQLQSL

SEQ ID NO: 41123 - protein, 9 aa, Borrelia burgdorferi B31
PSPQLQSLS

SEQ ID NO: 41124 - protein, 9 aa, Borrelia burgdorferi B31
SPQLQSLSF

SEQ ID NO: 41125 - protein, 9 aa, Borrelia burgdorferi B31
PQLQSLSFS

SEQ ID NO: 41126 - protein, 9 aa, Borrelia burgdorferi B31
QLQSLSFSA

SEQ ID NO: 41127 - protein, 9 aa, Borrelia burgdorferi B31
LQSLSFSAD

SEQ ID NO: 41128 - protein, 9 aa, Borrelia burgdorferi B31
QSLSFSADL

SEQ ID NO: 41129 - protein, 9 aa, Borrelia burgdorferi B31
SLSFSADLS

SEQ ID NO: 41130 - protein, 9 aa, Borrelia burgdorferi B31
LSFSADLSN

SEQ ID NO: 41131 - protein, 9 aa, Borrelia burgdorferi B31
SFSADLSNL

SEQ ID NO: 41132 - protein, 9 aa, Borrelia burgdorferi B31
FSADLSNLP

SEQ ID NO: 41133 - protein, 9 aa, Borrelia burgdorferi B31
SADLSNLPK

SEQ ID NO: 41134 - protein, 9 aa, Borrelia burgdorferi B31
ADLSNLPKT

SEQ ID NO: 41135 - protein, 9 aa, Borrelia burgdorferi B31
DLSNLPKTT

SEQ ID NO: 41136 - protein, 9 aa, Borrelia burgdorferi B31
LSNLPKTTA

SEQ ID NO: 41137 - protein, 9 aa, Borrelia burgdorferi B31
SNLPKTTAA

SEQ ID NO: 41138 - protein, 9 aa, Borrelia burgdorferi B31
NLPKTTAAR

SEQ ID NO: 41139 - protein, 9 aa, Borrelia burgdorferi B31
LPKTTAARA

SEQ ID NO: 41140 - protein, 9 aa, Borrelia burgdorferi B31
PKTTAARAA

SEQ ID NO: 41141 - protein, 9 aa, Borrelia burgdorferi B31
KTTAARAAS

SEQ ID NO: 41142 - protein, 9 aa, Borrelia burgdorferi B31
TTAARAASL

SEQ ID NO: 41143 - protein, 9 aa, Borrelia burgdorferi B31
TAARAASLT

SEQ ID NO: 41144 - protein, 9 aa, Borrelia burgdorferi B31
AARAASLTK

SEQ ID NO: 41145 - protein, 9 aa, Borrelia burgdorferi B31
ARAASLTKQ

SEQ ID NO: 41146 - protein, 9 aa, Borrelia burgdorferi B31
RAASLTKQR

SEQ ID NO: 41147 - protein, 9 aa, Borrelia burgdorferi B31
AASLTKQRI

SEQ ID NO: 41148 - protein, 9 aa, Borrelia burgdorferi B31
ASLTKQRIP

SEQ ID NO: 41149 - protein, 9 aa, Borrelia burgdorferi B31
SLTKQRIPI

SEQ ID NO: 41150 - protein, 9 aa, Borrelia burgdorferi B31
LTKQRIPIQ

SEQ ID NO: 41151 - protein, 9 aa, Borrelia burgdorferi B31
TKQRIPIQA

SEQ ID NO: 41152 - protein, 9 aa, Borrelia burgdorferi B31
KQRIPIQAV

SEQ ID NO: 41153 - protein, 9 aa, Borrelia burgdorferi B31
QRIPIQAVT

SEQ ID NO: 41154 - protein, 9 aa, Borrelia burgdorferi B31
RIPIQAVTT

SEQ ID NO: 41155 - protein, 9 aa, Borrelia burgdorferi B31
IPIQAVTTV

SEQ ID NO: 41156 - protein, 9 aa, Borrelia burgdorferi B31
PIQAVTTVP

SEQ ID NO: 41157 - protein, 9 aa, Borrelia burgdorferi B31
IQAVTTVPG

SEQ ID NO: 41158 - protein, 9 aa, Borrelia burgdorferi B31
QAVTTVPGN

SEQ ID NO: 41159 - protein, 9 aa, Borrelia burgdorferi B31
AVTTVPGNT

SEQ ID NO: 41160 - protein, 9 aa, Borrelia burgdorferi B31
VTTVPGNTR

SEQ ID NO: 41161 - protein, 9 aa, Borrelia burgdorferi B31
TTVPGNTRT

SEQ ID NO: 41162 - protein, 9 aa, Borrelia burgdorferi B31
TVPGNTRTF

SEQ ID NO: 41163 - protein, 9 aa, Borrelia burgdorferi B31
VPGNTRTFN

SEQ ID NO: 41164 - protein, 9 aa, Borrelia burgdorferi B31
PGNTRTFNS

SEQ ID NO: 41165 - protein, 9 aa, Borrelia burgdorferi B31
GNTRTFNSR

SEQ ID NO: 41166 - protein, 9 aa, Borrelia burgdorferi B31
NTRTFNSRN

SEQ ID NO: 41167 - protein, 9 aa, Borrelia burgdorferi B31
TRTFNSRNS

SEQ ID NO: 41168 - protein, 9 aa, Borrelia burgdorferi B31
RTFNSRNSG

SEQ ID NO: 41169 - protein, 9 aa, Borrelia burgdorferi B31
TFNSRNSGL

SEQ ID NO: 41170 - protein, 9 aa, Borrelia burgdorferi B31
FNSRNSGLP

SEQ ID NO: 41171 - protein, 9 aa, Borrelia burgdorferi B31
NSRNSGLPT

SEQ ID NO: 41172 - protein, 9 aa, Borrelia burgdorferi B31
SRNSGLPTF

SEQ ID NO: 41173 - protein, 9 aa, Borrelia burgdorferi B31
RNSGLPTFA

SEQ ID NO: 41174 - protein, 9 aa, Borrelia burgdorferi B31
NSGLPTFAL

SEQ ID NO: 41175 - protein, 9 aa, Borrelia burgdorferi B31
SGLPTFALN

SEQ ID NO: 41176 - protein, 9 aa, Borrelia burgdorferi B31
GLPTFALNY

SEQ ID NO: 41177 - protein, 9 aa, Borrelia burgdorferi B31
LPTFALNYS

SEQ ID NO: 41178 - protein, 9 aa, Borrelia burgdorferi B31
PTFALNYSF

SEQ ID NO: 41179 - protein, 9 aa, Borrelia burgdorferi B31
TFALNYSFS

SEQ ID NO: 41180 - protein, 9 aa, Borrelia burgdorferi B31
FALNYSFSQ

SEQ ID NO: 41181 - protein, 9 aa, Borrelia burgdorferi B31
ALNYSFSQP

SEQ ID NO: 41182 - protein, 9 aa, Borrelia burgdorferi B31
LNYSFSQPT

SEQ ID NO: 41183 - protein, 9 aa, Borrelia burgdorferi B31
NYSFSQPTR

SEQ ID NO: 41184 - protein, 9 aa, Borrelia burgdorferi B31
YSFSQPTRQ

SEQ ID NO: 41185 - protein, 9 aa, Borrelia burgdorferi B31
SFSQPTRQQ

SEQ ID NO: 41186 - protein, 9 aa, Borrelia burgdorferi B31
FSQPTRQQT

SEQ ID NO: 41187 - protein, 9 aa, Borrelia burgdorferi B31
SQPTRQQTN

SEQ ID NO: 41188 - protein, 9 aa, Borrelia burgdorferi B31
QPTRQQTNS

SEQ ID NO: 41189 - protein, 9 aa, Borrelia burgdorferi B31
PTRQQTNSS

SEQ ID NO: 41190 - protein, 9 aa, Borrelia burgdorferi B31
TRQQTNSSS

SEQ ID NO: 41191 - protein, 9 aa, Borrelia burgdorferi B31
RQQTNSSSA

SEQ ID NO: 41192 - protein, 9 aa, Borrelia burgdorferi B31
QQTNSSSAV

SEQ ID NO: 41193 - protein, 9 aa, Borrelia burgdorferi B31
QTNSSSAVQ

SEQ ID NO: 41194 - protein, 9 aa, Borrelia burgdorferi B31
TNSSSAVQT

SEQ ID NO: 41195 - protein, 9 aa, Borrelia burgdorferi B31
NSSSAVQTT

SEQ ID NO: 41196 - protein, 9 aa, Borrelia burgdorferi B31
SSSAVQTTT

SEQ ID NO: 41197 - protein, 9 aa, Borrelia burgdorferi B31
SSAVQTTTS

SEQ ID NO: 41198 - protein, 9 aa, Borrelia burgdorferi B31
SAVQTTTSS

SEQ ID NO: 41199 - protein, 9 aa, Borrelia burgdorferi B31
AVQTTTSSG

SEQ ID NO: 41200 - protein, 9 aa, Borrelia burgdorferi B31
VQTTTSSGS

SEQ ID NO: 41201 - protein, 9 aa, Borrelia burgdorferi B31
QTTTSSGSK

SEQ ID NO: 41202 - protein, 9 aa, Borrelia burgdorferi B31
TTTSSGSKL

SEQ ID NO: 41203 - protein, 9 aa, Borrelia burgdorferi B31
TTSSGSKLQ

SEQ ID NO: 41204 - protein, 9 aa, Borrelia burgdorferi B31
TSSGSKLQT

SEQ ID NO: 41205 - protein, 9 aa, Borrelia burgdorferi B31
SSGSKLQTL

SEQ ID NO: 41206 - protein, 9 aa, Borrelia burgdorferi B31
SGSKLQTLK

SEQ ID NO: 41207 - protein, 9 aa, Borrelia burgdorferi B31
GSKLQTLKN

SEQ ID NO: 41208 - protein, 9 aa, Borrelia burgdorferi B31
SKLQTLKNE

SEQ ID NO: 41209 - protein, 9 aa, Borrelia burgdorferi B31
KLQTLKNEL

SEQ ID NO: 41210 - protein, 9 aa, Borrelia burgdorferi B31
LQTLKNELI

SEQ ID NO: 41211 - protein, 9 aa, Borrelia burgdorferi B31
QTLKNELIR

SEQ ID NO: 41212 - protein, 9 aa, Borrelia burgdorferi B31
TLKNELIRA

SEQ ID NO: 41213 - protein, 9 aa, Borrelia burgdorferi B31
LKNELIRAI

SEQ ID NO: 41214 - protein, 9 aa, Borrelia burgdorferi B31
KNELIRAIS

SEQ ID NO: 41215 - protein, 9 aa, Borrelia burgdorferi B31
NELIRAISE

SEQ ID NO: 41216 - protein, 9 aa, Borrelia burgdorferi B31
ELIRAISEE

SEQ ID NO: 41217 - protein, 9 aa, Borrelia burgdorferi B31
LIRAISEEK

SEQ ID NO: 41218 - protein, 9 aa, Borrelia burgdorferi B31
IRAISEEKN

SEQ ID NO: 41219 - protein, 9 aa, Borrelia burgdorferi B31
RAISEEKNK

SEQ ID NO: 41220 - protein, 9 aa, Borrelia burgdorferi B31
AISEEKNKT

SEQ ID NO: 41221 - protein, 9 aa, Borrelia burgdorferi B31
ISEEKNKTQ

SEQ ID NO: 41222 - protein, 9 aa, Borrelia burgdorferi B31
SEEKNKTQN

SEQ ID NO: 41223 - protein, 9 aa, Borrelia burgdorferi B31
EEKNKTQNN

SEQ ID NO: 41224 - protein, 9 aa, Borrelia burgdorferi B31
EKNKTQNNF

SEQ ID NO: 41225 - protein, 9 aa, Borrelia burgdorferi B31
KNKTQNNFG

SEQ ID NO: 41226 - protein, 9 aa, Borrelia burgdorferi B31
NKTQNNFGF

SEQ ID NO: 41227 - protein, 9 aa, Borrelia burgdorferi B31
KTQNNFGFR

SEQ ID NO: 41228 - protein, 9 aa, Borrelia burgdorferi B31
TQNNFGFRE

SEQ ID NO: 41229 - protein, 9 aa, Borrelia burgdorferi B31
QNNFGFRET

SEQ ID NO: 41230 - protein, 9 aa, Borrelia burgdorferi B31
NNFGFRETY

SEQ ID NO: 41231 - protein, 9 aa, Borrelia burgdorferi B31
NFGFRETYD

SEQ ID NO: 41232 - protein, 9 aa, Borrelia burgdorferi B31
FGFRETYDQ

SEQ ID NO: 41233 - protein, 9 aa, Borrelia burgdorferi B31
GFRETYDQF

SEQ ID NO: 41234 - protein, 9 aa, Borrelia burgdorferi B31
FRETYDQFK

SEQ ID NO: 41235 - protein, 9 aa, Borrelia burgdorferi B31
RETYDQFKM

SEQ ID NO: 41236 - protein, 9 aa, Borrelia burgdorferi B31
ETYDQFKMK

SEQ ID NO: 41237 - protein, 9 aa, Borrelia burgdorferi B31
TYDQFKMKD

SEQ ID NO: 41238 - protein, 9 aa, Borrelia burgdorferi B31
YDQFKMKDS

SEQ ID NO: 41239 - protein, 9 aa, Borrelia burgdorferi B31
DQFKMKDSA

SEQ ID NO: 41240 - protein, 9 aa, Borrelia burgdorferi B31
QFKMKDSAF

SEQ ID NO: 41241 - protein, 9 aa, Borrelia burgdorferi B31
FKMKDSAFE

SEQ ID NO: 41242 - protein, 9 aa, Borrelia burgdorferi B31
KMKDSAFEL

SEQ ID NO: 41243 - protein, 9 aa, Borrelia burgdorferi B31
MKDSAFELL

SEQ ID NO: 41244 - protein, 9 aa, Borrelia burgdorferi B31
KDSAFELLD

SEQ ID NO: 41245 - protein, 9 aa, Borrelia burgdorferi B31
DSAFELLDV

SEQ ID NO: 41246 - protein, 9 aa, Borrelia burgdorferi B31
SAFELLDVI

SEQ ID NO: 41247 - protein, 9 aa, Borrelia burgdorferi B31
AFELLDVIS

SEQ ID NO: 41248 - protein, 9 aa, Borrelia burgdorferi B31
FELLDVISS

SEQ ID NO: 41249 - protein, 9 aa, Borrelia burgdorferi B31
ELLDVISSA

SEQ ID NO: 41250 - protein, 9 aa, Borrelia burgdorferi B31
LLDVISSAK

SEQ ID NO: 41251 - protein, 9 aa, Borrelia burgdorferi B31
LDVISSAKV

SEQ ID NO: 41252 - protein, 9 aa, Borrelia burgdorferi B31
DVISSAKVY

SEQ ID NO: 41253 - protein, 9 aa, Borrelia burgdorferi B31
VISSAKVYD

SEQ ID NO: 41254 - protein, 9 aa, Borrelia burgdorferi B31
ISSAKVYDR

SEQ ID NO: 41255 - protein, 9 aa, Borrelia burgdorferi B31
SSAKVYDRS

SEQ ID NO: 41256 - protein, 9 aa, Borrelia burgdorferi B31
SAKVYDRSY

SEQ ID NO: 41257 - protein, 9 aa, Borrelia burgdorferi B31
AKVYDRSYA

SEQ ID NO: 41258 - protein, 9 aa, Borrelia burgdorferi B31
KVYDRSYAP

SEQ ID NO: 41259 - protein, 9 aa, Borrelia burgdorferi B31
VYDRSYAPQ

SEQ ID NO: 41260 - protein, 9 aa, Borrelia burgdorferi B31
YDRSYAPQL

SEQ ID NO: 41261 - protein, 9 aa, Borrelia burgdorferi B31
DRSYAPQLN

SEQ ID NO: 41262 - protein, 9 aa, Borrelia burgdorferi B31
RSYAPQLNS

SEQ ID NO: 41263 - protein, 9 aa, Borrelia burgdorferi B31
SYAPQLNSN

SEQ ID NO: 41264 - protein, 9 aa, Borrelia burgdorferi B31
YAPQLNSNT

SEQ ID NO: 41265 - protein, 9 aa, Borrelia burgdorferi B31
APQLNSNTP

SEQ ID NO: 41266 - protein, 9 aa, Borrelia burgdorferi B31
PQLNSNTPE

SEQ ID NO: 41267 - protein, 9 aa, Borrelia burgdorferi B31
QLNSNTPEA

SEQ ID NO: 41268 - protein, 9 aa, Borrelia burgdorferi B31
LNSNTPEAE

SEQ ID NO: 41269 - protein, 9 aa, Borrelia burgdorferi B31
NSNTPEAEN

SEQ ID NO: 41270 - protein, 9 aa, Borrelia burgdorferi B31
SNTPEAENE

SEQ ID NO: 41271 - protein, 9 aa, Borrelia burgdorferi B31
NTPEAENER

SEQ ID NO: 41272 - protein, 9 aa, Borrelia burgdorferi B31
TPEAENERN

SEQ ID NO: 41273 - protein, 9 aa, Borrelia burgdorferi B31
PEAENERNK

SEQ ID NO: 41274 - protein, 9 aa, Borrelia burgdorferi B31
EAENERNKF

SEQ ID NO: 41275 - protein, 9 aa, Borrelia burgdorferi B31
AENERNKFY

SEQ ID NO: 41276 - protein, 9 aa, Borrelia burgdorferi B31
ENERNKFYA

SEQ ID NO: 41277 - protein, 9 aa, Borrelia burgdorferi B31
NERNKFYAL

SEQ ID NO: 41278 - protein, 9 aa, Borrelia burgdorferi B31
ERNKFYALM

SEQ ID NO: 41279 - protein, 9 aa, Borrelia burgdorferi B31
RNKFYALMD

SEQ ID NO: 41280 - protein, 9 aa, Borrelia burgdorferi B31
NKFYALMDF

SEQ ID NO: 41281 - protein, 9 aa, Borrelia burgdorferi B31
KFYALMDFD

SEQ ID NO: 41282 - protein, 9 aa, Borrelia burgdorferi B31
FYALMDFDQ

SEQ ID NO: 41283 - protein, 9 aa, Borrelia burgdorferi B31
YALMDFDQY

SEQ ID NO: 41284 - protein, 9 aa, Borrelia burgdorferi B31
ALMDFDQYK

SEQ ID NO: 41285 - protein, 9 aa, Borrelia burgdorferi B31
LMDFDQYKI

SEQ ID NO: 41286 - protein, 9 aa, Borrelia burgdorferi B31
MDFDQYKIE

SEQ ID NO: 41287 - protein, 9 aa, Borrelia burgdorferi B31
DFDQYKIEQ

SEQ ID NO: 41288 - protein, 9 aa, Borrelia burgdorferi B31
FDQYKIEQF

SEQ ID NO: 41289 - protein, 9 aa, Borrelia burgdorferi B31
DQYKIEQFG

SEQ ID NO: 41290 - protein, 9 aa, Borrelia burgdorferi B31
QYKIEQFGS

SEQ ID NO: 41291 - protein, 9 aa, Borrelia burgdorferi B31
YKIEQFGSI

SEQ ID NO: 41292 - protein, 9 aa, Borrelia burgdorferi B31
KIEQFGSIM

SEQ ID NO: 41293 - protein, 9 aa, Borrelia burgdorferi B31
IEQFGSIME

SEQ ID NO: 41294 - protein, 9 aa, Borrelia burgdorferi B31
EQFGSIMEA

SEQ ID NO: 41295 - protein, 9 aa, Borrelia burgdorferi B31
QFGSIMEAL

SEQ ID NO: 41296 - protein, 9 aa, Borrelia burgdorferi B31
FGSIMEALY

SEQ ID NO: 41297 - protein, 9 aa, Borrelia burgdorferi B31
GSIMEALYN

SEQ ID NO: 41298 - protein, 9 aa, Borrelia burgdorferi B31
SIMEALYNE

SEQ ID NO: 41299 - protein, 9 aa, Borrelia burgdorferi B31
IMEALYNEN

SEQ ID NO: 41300 - protein, 9 aa, Borrelia burgdorferi B31
MEALYNENQ

SEQ ID NO: 41301 - protein, 9 aa, Borrelia burgdorferi B31
EALYNENQN

SEQ ID NO: 41302 - protein, 9 aa, Borrelia burgdorferi B31
ALYNENQNH

SEQ ID NO: 41303 - protein, 9 aa, Borrelia burgdorferi B31
LYNENQNHS

SEQ ID NO: 41304 - protein, 9 aa, Borrelia burgdorferi B31
YNENQNHSL

SEQ ID NO: 41305 - protein, 9 aa, Borrelia burgdorferi B31
NENQNHSLI

SEQ ID NO: 41306 - protein, 9 aa, Borrelia burgdorferi B31
ENQNHSLIR

SEQ ID NO: 41307 - protein, 9 aa, Borrelia burgdorferi B31
NQNHSLIRE

SEQ ID NO: 41308 - protein, 9 aa, Borrelia burgdorferi B31
QNHSLIREL

SEQ ID NO: 41309 - protein, 9 aa, Borrelia burgdorferi B31
NHSLIRELM

SEQ ID NO: 41310 - protein, 9 aa, Borrelia burgdorferi B31
HSLIRELMI

SEQ ID NO: 41311 - protein, 9 aa, Borrelia burgdorferi B31
SLIRELMIS

SEQ ID NO: 41312 - protein, 9 aa, Borrelia burgdorferi B31
LIRELMISG

SEQ ID NO: 41313 - protein, 9 aa, Borrelia burgdorferi B31
IRELMISGL

SEQ ID NO: 41314 - protein, 9 aa, Borrelia burgdorferi B31
RELMISGLG

SEQ ID NO: 41315 - protein, 9 aa, Borrelia burgdorferi B31
ELMISGLGT

SEQ ID NO: 41316 - protein, 9 aa, Borrelia burgdorferi B31
LMISGLGTQ

SEQ ID NO: 41317 - protein, 9 aa, Borrelia burgdorferi B31
MISGLGTQI

SEQ ID NO: 41318 - protein, 9 aa, Borrelia burgdorferi B31
ISGLGTQIS

SEQ ID NO: 41319 - protein, 9 aa, Borrelia burgdorferi B31
SGLGTQISF

SEQ ID NO: 41320 - protein, 9 aa, Borrelia burgdorferi B31
GLGTQISFE

SEQ ID NO: 41321 - protein, 9 aa, Borrelia burgdorferi B31
LGTQISFEL

SEQ ID NO: 41322 - protein, 9 aa, Borrelia burgdorferi B31
GTQISFELA

SEQ ID NO: 41323 - protein, 9 aa, Borrelia burgdorferi B31
TQISFELAL

SEQ ID NO: 41324 - protein, 9 aa, Borrelia burgdorferi B31
QISFELALE

SEQ ID NO: 41325 - protein, 9 aa, Borrelia burgdorferi B31
ISFELALEE

SEQ ID NO: 41326 - protein, 9 aa, Borrelia burgdorferi B31
SFELALEEI

SEQ ID NO: 41327 - protein, 9 aa, Borrelia burgdorferi B31
FELALEEIN

SEQ ID NO: 41328 - protein, 9 aa, Borrelia burgdorferi B31
ELALEEINK

SEQ ID NO: 41329 - protein, 9 aa, Borrelia burgdorferi B31
LALEEINKK

SEQ ID NO: 41330 - protein, 9 aa, Borrelia burgdorferi B31
ALEEINKKI

SEQ ID NO: 41331 - protein, 9 aa, Borrelia burgdorferi B31
LEEINKKIE

SEQ ID NO: 41332 - protein, 9 aa, Borrelia burgdorferi B31
EEINKKIEI

SEQ ID NO: 41333 - protein, 9 aa, Borrelia burgdorferi B31
EINKKIEIF

SEQ ID NO: 41334 - protein, 9 aa, Borrelia burgdorferi B31
INKKIEIFN

SEQ ID NO: 41335 - protein, 9 aa, Borrelia burgdorferi B31
NKKIEIFNQ

SEQ ID NO: 41336 - protein, 9 aa, Borrelia burgdorferi B31
KKIEIFNQD

SEQ ID NO: 41337 - protein, 9 aa, Borrelia burgdorferi B31
KIEIFNQDY

SEQ ID NO: 41338 - protein, 9 aa, Borrelia burgdorferi B31
IEIFNQDYL

SEQ ID NO: 41339 - protein, 9 aa, Borrelia burgdorferi B31
EIFNQDYLN

SEQ ID NO: 41340 - protein, 9 aa, Borrelia burgdorferi B31
IFNQDYLNA

SEQ ID NO: 41341 - protein, 9 aa, Borrelia burgdorferi B31
FNQDYLNAK

SEQ ID NO: 41342 - protein, 9 aa, Borrelia burgdorferi B31
NQDYLNAKI

SEQ ID NO: 41343 - protein, 9 aa, Borrelia burgdorferi B31
QDYLNAKIN

SEQ ID NO: 41344 - protein, 9 aa, Borrelia burgdorferi B31
DYLNAKINS

SEQ ID NO: 41345 - protein, 9 aa, Borrelia burgdorferi B31
YLNAKINSF

SEQ ID NO: 41346 - protein, 9 aa, Borrelia burgdorferi B31
LNAKINSFD

SEQ ID NO: 41347 - protein, 9 aa, Borrelia burgdorferi B31
NAKINSFDF

SEQ ID NO: 41348 - protein, 9 aa, Borrelia burgdorferi B31
AKINSFDFT

SEQ ID NO: 41349 - protein, 9 aa, Borrelia burgdorferi B31
KINSFDFTM

SEQ ID NO: 41350 - protein, 9 aa, Borrelia burgdorferi B31
INSFDFTMK

SEQ ID NO: 41351 - protein, 9 aa, Borrelia burgdorferi B31
NSFDFTMKL

SEQ ID NO: 41352 - protein, 9 aa, Borrelia burgdorferi B31
SFDFTMKLK

SEQ ID NO: 41353 - protein, 9 aa, Borrelia burgdorferi B31
FDFTMKLKE

SEQ ID NO: 41354 - protein, 9 aa, Borrelia burgdorferi B31
DFTMKLKEL

SEQ ID NO: 41355 - protein, 9 aa, Borrelia burgdorferi B31
FTMKLKELK

SEQ ID NO: 41356 - protein, 9 aa, Borrelia burgdorferi B31
TMKLKELKS

SEQ ID NO: 41357 - protein, 9 aa, Borrelia burgdorferi B31
MKLKELKSK

SEQ ID NO: 41358 - protein, 9 aa, Borrelia burgdorferi B31
KLKELKSKL

SEQ ID NO: 41359 - protein, 9 aa, Borrelia burgdorferi B31
LKELKSKLN

SEQ ID NO: 41360 - protein, 9 aa, Borrelia burgdorferi B31
KELKSKLNQ

SEQ ID NO: 41361 - protein, 9 aa, Borrelia burgdorferi B31
ELKSKLNQI

SEQ ID NO: 41362 - protein, 9 aa, Borrelia burgdorferi B31
LKSKLNQIL

SEQ ID NO: 41363 - protein, 9 aa, Borrelia burgdorferi B31
KSKLNQILD

SEQ ID NO: 41364 - protein, 9 aa, Borrelia burgdorferi B31
SKLNQILDK

SEQ ID NO: 41365 - protein, 9 aa, Borrelia burgdorferi B31
KLNQILDKR

SEQ ID NO: 41366 - protein, 9 aa, Borrelia burgdorferi B31
LNQILDKRK

SEQ ID NO: 41367 - protein, 9 aa, Borrelia burgdorferi B31
NQILDKRKE

SEQ ID NO: 41368 - protein, 9 aa, Borrelia burgdorferi B31
QILDKRKEW

SEQ ID NO: 41369 - protein, 9 aa, Borrelia burgdorferi B31
ILDKRKEWS

SEQ ID NO: 41370 - protein, 9 aa, Borrelia burgdorferi B31
LDKRKEWSR

SEQ ID NO: 41371 - protein, 9 aa, Borrelia burgdorferi B31
DKRKEWSRQ

SEQ ID NO: 41372 - protein, 9 aa, Borrelia burgdorferi B31
KRKEWSRQA

SEQ ID NO: 41373 - protein, 9 aa, Borrelia burgdorferi B31
RKEWSRQAD

SEQ ID NO: 41374 - protein, 9 aa, Borrelia burgdorferi B31
KEWSRQADG

SEQ ID NO: 41375 - protein, 9 aa, Borrelia burgdorferi B31
EWSRQADGL

SEQ ID NO: 41376 - protein, 9 aa, Borrelia burgdorferi B31
WSRQADGLI

SEQ ID NO: 41377 - protein, 9 aa, Borrelia burgdorferi B31
SRQADGLIA

SEQ ID NO: 41378 - protein, 9 aa, Borrelia burgdorferi B31
RQADGLIAN

SEQ ID NO: 41379 - protein, 9 aa, Borrelia burgdorferi B31
QADGLIANA

SEQ ID NO: 41380 - protein, 9 aa, Borrelia burgdorferi B31
ADGLIANAS

SEQ ID NO: 41381 - protein, 9 aa, Borrelia burgdorferi B31
DGLIANASS

SEQ ID NO: 41382 - protein, 9 aa, Borrelia burgdorferi B31
GLIANASSN

SEQ ID NO: 41383 - protein, 9 aa, Borrelia burgdorferi B31
LIANASSNS

SEQ ID NO: 41384 - protein, 9 aa, Borrelia burgdorferi B31
IANASSNSS

SEQ ID NO: 41385 - protein, 9 aa, Borrelia burgdorferi B31
ANASSNSSL

SEQ ID NO: 41386 - protein, 9 aa, Borrelia burgdorferi B31
NASSNSSLS

SEQ ID NO: 41387 - protein, 9 aa, Borrelia burgdorferi B31
ASSNSSLSD

SEQ ID NO: 41388 - protein, 9 aa, Borrelia burgdorferi B31
SSNSSLSDS

SEQ ID NO: 41389 - protein, 9 aa, Borrelia burgdorferi B31
SNSSLSDSK

SEQ ID NO: 41390 - protein, 9 aa, Borrelia burgdorferi B31
NSSLSDSKS

SEQ ID NO: 41391 - protein, 9 aa, Borrelia burgdorferi B31
SSLSDSKSL

SEQ ID NO: 41392 - protein, 9 aa, Borrelia burgdorferi B31
SLSDSKSLA

SEQ ID NO: 41393 - protein, 9 aa, Borrelia burgdorferi B31
LSDSKSLAE

SEQ ID NO: 41394 - protein, 9 aa, Borrelia burgdorferi B31
SDSKSLAEY

SEQ ID NO: 41395 - protein, 9 aa, Borrelia burgdorferi B31
DSKSLAEYI

SEQ ID NO: 41396 - protein, 9 aa, Borrelia burgdorferi B31
SKSLAEYIK

SEQ ID NO: 41397 - protein, 9 aa, Borrelia burgdorferi B31
KSLAEYIKK

SEQ ID NO: 41398 - protein, 9 aa, Borrelia burgdorferi B31
SLAEYIKKR

SEQ ID NO: 41399 - protein, 9 aa, Borrelia burgdorferi B31
LAEYIKKRY

SEQ ID NO: 41400 - protein, 9 aa, Borrelia burgdorferi B31
AEYIKKRYL

SEQ ID NO: 41401 - protein, 9 aa, Borrelia burgdorferi B31
EYIKKRYLD

SEQ ID NO: 41402 - protein, 9 aa, Borrelia burgdorferi B31
YIKKRYLDN

SEQ ID NO: 41403 - protein, 9 aa, Borrelia burgdorferi B31
IKKRYLDNM

SEQ ID NO: 41404 - protein, 9 aa, Borrelia burgdorferi B31
KKRYLDNMQ

SEQ ID NO: 41405 - protein, 9 aa, Borrelia burgdorferi B31
KRYLDNMQN

SEQ ID NO: 41406 - protein, 9 aa, Borrelia burgdorferi B31
RYLDNMQNA

SEQ ID NO: 41407 - protein, 9 aa, Borrelia burgdorferi B31
YLDNMQNAR

SEQ ID NO: 41408 - protein, 9 aa, Borrelia burgdorferi B31
LDNMQNARQ

SEQ ID NO: 41409 - protein, 9 aa, Borrelia burgdorferi B31
DNMQNARQS

SEQ ID NO: 41410 - protein, 9 aa, Borrelia burgdorferi B31
NMQNARQSV

SEQ ID NO: 41411 - protein, 9 aa, Borrelia burgdorferi B31
MQNARQSVL

SEQ ID NO: 41412 - protein, 9 aa, Borrelia burgdorferi B31
QNARQSVLE

SEQ ID NO: 41413 - protein, 9 aa, Borrelia burgdorferi B31
NARQSVLEA

SEQ ID NO: 41414 - protein, 9 aa, Borrelia burgdorferi B31
ARQSVLEAY

SEQ ID NO: 41415 - protein, 9 aa, Borrelia burgdorferi B31
RQSVLEAYI

SEQ ID NO: 41416 - protein, 9 aa, Borrelia burgdorferi B31
QSVLEAYIS

SEQ ID NO: 41417 - protein, 9 aa, Borrelia burgdorferi B31
SVLEAYISI

SEQ ID NO: 41418 - protein, 9 aa, Borrelia burgdorferi B31
VLEAYISIM

SEQ ID NO: 41419 - protein, 10 aa, Borrelia burgdorferi B31
MKIKPLIQLK

SEQ ID NO: 41420 - protein, 10 aa, Borrelia burgdorferi B31
KIKPLIQLKL

SEQ ID NO: 41421 - protein, 10 aa, Borrelia burgdorferi B31
IKPLIQLKLL

SEQ ID NO: 41422 - protein, 10 aa, Borrelia burgdorferi B31
KPLIQLKLLG

SEQ ID NO: 41423 - protein, 10 aa, Borrelia burgdorferi B31
PLIQLKLLGL

SEQ ID NO: 41424 - protein, 10 aa, Borrelia burgdorferi B31
LIQLKLLGLF

SEQ ID NO: 41425 - protein, 10 aa, Borrelia burgdorferi B31
IQLKLLGLFL

SEQ ID NO: 41426 - protein, 10 aa, Borrelia burgdorferi B31
QLKLLGLFLF

SEQ ID NO: 41427 - protein, 10 aa, Borrelia burgdorferi B31
LKLLGLFLFS

SEQ ID NO: 41428 - protein, 10 aa, Borrelia burgdorferi B31
KLLGLFLFSC

SEQ ID NO: 41429 - protein, 10 aa, Borrelia burgdorferi B31
LLGLFLFSCT

SEQ ID NO: 41430 - protein, 10 aa, Borrelia burgdorferi B31
LGLFLFSCTI

SEQ ID NO: 41431 - protein, 10 aa, Borrelia burgdorferi B31
GLFLFSCTID

SEQ ID NO: 41432 - protein, 10 aa, Borrelia burgdorferi B31
LFLFSCTIDA

SEQ ID NO: 41433 - protein, 10 aa, Borrelia burgdorferi B31
FLFSCTIDAN

SEQ ID NO: 41434 - protein, 10 aa, Borrelia burgdorferi B31
LFSCTIDANL

SEQ ID NO: 41435 - protein, 10 aa, Borrelia burgdorferi B31
FSCTIDANLN

SEQ ID NO: 41436 - protein, 10 aa, Borrelia burgdorferi B31
SCTIDANLNE

SEQ ID NO: 41437 - protein, 10 aa, Borrelia burgdorferi B31
CTIDANLNED

SEQ ID NO: 41438 - protein, 10 aa, Borrelia burgdorferi B31
TIDANLNEDY

SEQ ID NO: 41439 - protein, 10 aa, Borrelia burgdorferi B31
IDANLNEDYK

SEQ ID NO: 41440 - protein, 10 aa, Borrelia burgdorferi B31
DANLNEDYKN

SEQ ID NO: 41441 - protein, 10 aa, Borrelia burgdorferi B31
ANLNEDYKNK

SEQ ID NO: 41442 - protein, 10 aa, Borrelia burgdorferi B31
NLNEDYKNKV

SEQ ID NO: 41443 - protein, 10 aa, Borrelia burgdorferi B31
LNEDYKNKVK

SEQ ID NO: 41444 - protein, 10 aa, Borrelia burgdorferi B31
NEDYKNKVKG

SEQ ID NO: 41445 - protein, 10 aa, Borrelia burgdorferi B31
EDYKNKVKGI

SEQ ID NO: 41446 - protein, 10 aa, Borrelia burgdorferi B31
DYKNKVKGIL

SEQ ID NO: 41447 - protein, 10 aa, Borrelia burgdorferi B31
YKNKVKGILN

SEQ ID NO: 41448 - protein, 10 aa, Borrelia burgdorferi B31
KNKVKGILNK

SEQ ID NO: 41449 - protein, 10 aa, Borrelia burgdorferi B31
NKVKGILNKA

SEQ ID NO: 41450 - protein, 10 aa, Borrelia burgdorferi B31
KVKGILNKAA

SEQ ID NO: 41451 - protein, 10 aa, Borrelia burgdorferi B31
VKGILNKAAD

SEQ ID NO: 41452 - protein, 10 aa, Borrelia burgdorferi B31
KGILNKAADD

SEQ ID NO: 41453 - protein, 10 aa, Borrelia burgdorferi B31
GILNKAADDQ

SEQ ID NO: 41454 - protein, 10 aa, Borrelia burgdorferi B31
ILNKAADDQE

SEQ ID NO: 41455 - protein, 10 aa, Borrelia burgdorferi B31
LNKAADDQET

SEQ ID NO: 41456 - protein, 10 aa, Borrelia burgdorferi B31
NKAADDQETT

SEQ ID NO: 41457 - protein, 10 aa, Borrelia burgdorferi B31
KAADDQETTS

SEQ ID NO: 41458 - protein, 10 aa, Borrelia burgdorferi B31
AADDQETTSA

SEQ ID NO: 41459 - protein, 10 aa, Borrelia burgdorferi B31
ADDQETTSAD

SEQ ID NO: 41460 - protein, 10 aa, Borrelia burgdorferi B31
DDQETTSADT

SEQ ID NO: 41461 - protein, 10 aa, Borrelia burgdorferi B31
DQETTSADTN

SEQ ID NO: 41462 - protein, 10 aa, Borrelia burgdorferi B31
QETTSADTNS

SEQ ID NO: 41463 - protein, 10 aa, Borrelia burgdorferi B31
ETTSADTNSN

SEQ ID NO: 41464 - protein, 10 aa, Borrelia burgdorferi B31
TTSADTNSNA

SEQ ID NO: 41465 - protein, 10 aa, Borrelia burgdorferi B31
TSADTNSNAA

SEQ ID NO: 41466 - protein, 10 aa, Borrelia burgdorferi B31
SADTNSNAAK

SEQ ID NO: 41467 - protein, 10 aa, Borrelia burgdorferi B31
ADTNSNAAKN

SEQ ID NO: 41468 - protein, 10 aa, Borrelia burgdorferi B31
DTNSNAAKNI

SEQ ID NO: 41469 - protein, 10 aa, Borrelia burgdorferi B31
TNSNAAKNIP

SEQ ID NO: 41470 - protein, 10 aa, Borrelia burgdorferi B31
NSNAAKNIPI

SEQ ID NO: 41471 - protein, 10 aa, Borrelia burgdorferi B31
SNAAKNIPIA

SEQ ID NO: 41472 - protein, 10 aa, Borrelia burgdorferi B31
NAAKNIPIAD

SEQ ID NO: 41473 - protein, 10 aa, Borrelia burgdorferi B31
AAKNIPIADN

SEQ ID NO: 41474 - protein, 10 aa, Borrelia burgdorferi B31
AKNIPIADND

SEQ ID NO: 41475 - protein, 10 aa, Borrelia burgdorferi B31
KNIPIADNDK

SEQ ID NO: 41476 - protein, 10 aa, Borrelia burgdorferi B31
NIPIADNDKV

SEQ ID NO: 41477 - protein, 10 aa, Borrelia burgdorferi B31
IPIADNDKVA

SEQ ID NO: 41478 - protein, 10 aa, Borrelia burgdorferi B31
PIADNDKVAA

SEQ ID NO: 41479 - protein, 10 aa, Borrelia burgdorferi B31
IADNDKVAAE

SEQ ID NO: 41480 - protein, 10 aa, Borrelia burgdorferi B31
ADNDKVAAEL

SEQ ID NO: 41481 - protein, 10 aa, Borrelia burgdorferi B31
DNDKVAAELK

SEQ ID NO: 41482 - protein, 10 aa, Borrelia burgdorferi B31
NDKVAAELKK

SEQ ID NO: 41483 - protein, 10 aa, Borrelia burgdorferi B31
DKVAAELKKQ

SEQ ID NO: 41484 - protein, 10 aa, Borrelia burgdorferi B31
KVAAELKKQS

SEQ ID NO: 41485 - protein, 10 aa, Borrelia burgdorferi B31
VAAELKKQSQ

SEQ ID NO: 41486 - protein, 10 aa, Borrelia burgdorferi B31
AAELKKQSQA

SEQ ID NO: 41487 - protein, 10 aa, Borrelia burgdorferi B31
AELKKQSQAA

SEQ ID NO: 41488 - protein, 10 aa, Borrelia burgdorferi B31
ELKKQSQAAK

SEQ ID NO: 41489 - protein, 10 aa, Borrelia burgdorferi B31
LKKQSQAAKT

SEQ ID NO: 41490 - protein, 10 aa, Borrelia burgdorferi B31
KKQSQAAKTV

SEQ ID NO: 41491 - protein, 10 aa, Borrelia burgdorferi B31
KQSQAAKTVA

SEQ ID NO: 41492 - protein, 10 aa, Borrelia burgdorferi B31
QSQAAKTVAA

SEQ ID NO: 41493 - protein, 10 aa, Borrelia burgdorferi B31
SQAAKTVAAA

SEQ ID NO: 41494 - protein, 10 aa, Borrelia burgdorferi B31
QAAKTVAAAP

SEQ ID NO: 41495 - protein, 10 aa, Borrelia burgdorferi B31
AAKTVAAAPN

SEQ ID NO: 41496 - protein, 10 aa, Borrelia burgdorferi B31
AKTVAAAPNK

SEQ ID NO: 41497 - protein, 10 aa, Borrelia burgdorferi B31
KTVAAAPNKG

SEQ ID NO: 41498 - protein, 10 aa, Borrelia burgdorferi B31
TVAAAPNKGS

SEQ ID NO: 41499 - protein, 10 aa, Borrelia burgdorferi B31
VAAAPNKGSQ

SEQ ID NO: 41500 - protein, 10 aa, Borrelia burgdorferi B31
AAAPNKGSQN

SEQ ID NO: 41501 - protein, 10 aa, Borrelia burgdorferi B31
AAPNKGSQNQ

SEQ ID NO: 41502 - protein, 10 aa, Borrelia burgdorferi B31
APNKGSQNQP

SEQ ID NO: 41503 - protein, 10 aa, Borrelia burgdorferi B31
PNKGSQNQPQ

SEQ ID NO: 41504 - protein, 10 aa, Borrelia burgdorferi B31
NKGSQNQPQT

SEQ ID NO: 41505 - protein, 10 aa, Borrelia burgdorferi B31
KGSQNQPQTT

SEQ ID NO: 41506 - protein, 10 aa, Borrelia burgdorferi B31
GSQNQPQTTP

SEQ ID NO: 41507 - protein, 10 aa, Borrelia burgdorferi B31
SQNQPQTTPN

SEQ ID NO: 41508 - protein, 10 aa, Borrelia burgdorferi B31
QNQPQTTPNK

SEQ ID NO: 41509 - protein, 10 aa, Borrelia burgdorferi B31
NQPQTTPNKG

SEQ ID NO: 41510 - protein, 10 aa, Borrelia burgdorferi B31
QPQTTPNKGS

SEQ ID NO: 41511 - protein, 10 aa, Borrelia burgdorferi B31
PQTTPNKGSQ

SEQ ID NO: 41512 - protein, 10 aa, Borrelia burgdorferi B31
QTTPNKGSQN

SEQ ID NO: 41513 - protein, 10 aa, Borrelia burgdorferi B31
TTPNKGSQNQ

SEQ ID NO: 41514 - protein, 10 aa, Borrelia burgdorferi B31
TPNKGSQNQQ

SEQ ID NO: 41515 - protein, 10 aa, Borrelia burgdorferi B31
PNKGSQNQQA

SEQ ID NO: 41516 - protein, 10 aa, Borrelia burgdorferi B31
NKGSQNQQAA

SEQ ID NO: 41517 - protein, 10 aa, Borrelia burgdorferi B31
KGSQNQQAAP

SEQ ID NO: 41518 - protein, 10 aa, Borrelia burgdorferi B31
GSQNQQAAPS

SEQ ID NO: 41519 - protein, 10 aa, Borrelia burgdorferi B31
SQNQQAAPSP

SEQ ID NO: 41520 - protein, 10 aa, Borrelia burgdorferi B31
QNQQAAPSPQ

SEQ ID NO: 41521 - protein, 10 aa, Borrelia burgdorferi B31
NQQAAPSPQL

SEQ ID NO: 41522 - protein, 10 aa, Borrelia burgdorferi B31
QQAAPSPQLQ

SEQ ID NO: 41523 - protein, 10 aa, Borrelia burgdorferi B31
QAAPSPQLQS

SEQ ID NO: 41524 - protein, 10 aa, Borrelia burgdorferi B31
AAPSPQLQSL

SEQ ID NO: 41525 - protein, 10 aa, Borrelia burgdorferi B31
APSPQLQSLS

SEQ ID NO: 41526 - protein, 10 aa, Borrelia burgdorferi B31
PSPQLQSLSF

SEQ ID NO: 41527 - protein, 10 aa, Borrelia burgdorferi B31
SPQLQSLSFS

SEQ ID NO: 41528 - protein, 10 aa, Borrelia burgdorferi B31
PQLQSLSFSA

SEQ ID NO: 41529 - protein, 10 aa, Borrelia burgdorferi B31
QLQSLSFSAD

SEQ ID NO: 41530 - protein, 10 aa, Borrelia burgdorferi B31
LQSLSFSADL

SEQ ID NO: 41531 - protein, 10 aa, Borrelia burgdorferi B31
QSLSFSADLS

SEQ ID NO: 41532 - protein, 10 aa, Borrelia burgdorferi B31
SLSFSADLSN

SEQ ID NO: 41533 - protein, 10 aa, Borrelia burgdorferi B31
LSFSADLSNL

SEQ ID NO: 41534 - protein, 10 aa, Borrelia burgdorferi B31
SFSADLSNLP

SEQ ID NO: 41535 - protein, 10 aa, Borrelia burgdorferi B31
FSADLSNLPK

SEQ ID NO: 41536 - protein, 10 aa, Borrelia burgdorferi B31
SADLSNLPKT

SEQ ID NO: 41537 - protein, 10 aa, Borrelia burgdorferi B31
ADLSNLPKTT

SEQ ID NO: 41538 - protein, 10 aa, Borrelia burgdorferi B31
DLSNLPKTTA

SEQ ID NO: 41539 - protein, 10 aa, Borrelia burgdorferi B31
LSNLPKTTAA

SEQ ID NO: 41540 - protein, 10 aa, Borrelia burgdorferi B31
SNLPKTTAAR

SEQ ID NO: 41541 - protein, 10 aa, Borrelia burgdorferi B31
NLPKTTAARA

SEQ ID NO: 41542 - protein, 10 aa, Borrelia burgdorferi B31
LPKTTAARAA

SEQ ID NO: 41543 - protein, 10 aa, Borrelia burgdorferi B31
PKTTAARAAS

SEQ ID NO: 41544 - protein, 10 aa, Borrelia burgdorferi B31
KTTAARAASL

SEQ ID NO: 41545 - protein, 10 aa, Borrelia burgdorferi B31
TTAARAASLT

SEQ ID NO: 41546 - protein, 10 aa, Borrelia burgdorferi B31
TAARAASLTK

SEQ ID NO: 41547 - protein, 10 aa, Borrelia burgdorferi B31
AARAASLTKQ

SEQ ID NO: 41548 - protein, 10 aa, Borrelia burgdorferi B31
ARAASLTKQR

SEQ ID NO: 41549 - protein, 10 aa, Borrelia burgdorferi B31
RAASLTKQRI

SEQ ID NO: 41550 - protein, 10 aa, Borrelia burgdorferi B31
AASLTKQRIP

SEQ ID NO: 41551 - protein, 10 aa, Borrelia burgdorferi B31
ASLTKQRIPI

SEQ ID NO: 41552 - protein, 10 aa, Borrelia burgdorferi B31
SLTKQRIPIQ

SEQ ID NO: 41553 - protein, 10 aa, Borrelia burgdorferi B31
LTKQRIPIQA

SEQ ID NO: 41554 - protein, 10 aa, Borrelia burgdorferi B31
TKQRIPIQAV

SEQ ID NO: 41555 - protein, 10 aa, Borrelia burgdorferi B31
KQRIPIQAVT

SEQ ID NO: 41556 - protein, 10 aa, Borrelia burgdorferi B31
QRIPIQAVTT

SEQ ID NO: 41557 - protein, 10 aa, Borrelia burgdorferi B31
RIPIQAVTTV

SEQ ID NO: 41558 - protein, 10 aa, Borrelia burgdorferi B31
IPIQAVTTVP

SEQ ID NO: 41559 - protein, 10 aa, Borrelia burgdorferi B31
PIQAVTTVPG

SEQ ID NO: 41560 - protein, 10 aa, Borrelia burgdorferi B31
IQAVTTVPGN

SEQ ID NO: 41561 - protein, 10 aa, Borrelia burgdorferi B31
QAVTTVPGNT

SEQ ID NO: 41562 - protein, 10 aa, Borrelia burgdorferi B31
AVTTVPGNTR

SEQ ID NO: 41563 - protein, 10 aa, Borrelia burgdorferi B31
VTTVPGNTRT

SEQ ID NO: 41564 - protein, 10 aa, Borrelia burgdorferi B31
TTVPGNTRTF

SEQ ID NO: 41565 - protein, 10 aa, Borrelia burgdorferi B31
TVPGNTRTFN

SEQ ID NO: 41566 - protein, 10 aa, Borrelia burgdorferi B31
VPGNTRTFNS

SEQ ID NO: 41567 - protein, 10 aa, Borrelia burgdorferi B31
PGNTRTFNSR

SEQ ID NO: 41568 - protein, 10 aa, Borrelia burgdorferi B31
GNTRTFNSRN

SEQ ID NO: 41569 - protein, 10 aa, Borrelia burgdorferi B31
NTRTFNSRNS

SEQ ID NO: 41570 - protein, 10 aa, Borrelia burgdorferi B31
TRTFNSRNSG

SEQ ID NO: 41571 - protein, 10 aa, Borrelia burgdorferi B31
RTFNSRNSGL

SEQ ID NO: 41572 - protein, 10 aa, Borrelia burgdorferi B31
TFNSRNSGLP

SEQ ID NO: 41573 - protein, 10 aa, Borrelia burgdorferi B31
FNSRNSGLPT

SEQ ID NO: 41574 - protein, 10 aa, Borrelia burgdorferi B31
NSRNSGLPTF

SEQ ID NO: 41575 - protein, 10 aa, Borrelia burgdorferi B31
SRNSGLPTFA

SEQ ID NO: 41576 - protein, 10 aa, Borrelia burgdorferi B31
RNSGLPTFAL

SEQ ID NO: 41577 - protein, 10 aa, Borrelia burgdorferi B31
NSGLPTFALN

SEQ ID NO: 41578 - protein, 10 aa, Borrelia burgdorferi B31
SGLPTFALNY

SEQ ID NO: 41579 - protein, 10 aa, Borrelia burgdorferi B31
GLPTFALNYS

SEQ ID NO: 41580 - protein, 10 aa, Borrelia burgdorferi B31
LPTFALNYSF

SEQ ID NO: 41581 - protein, 10 aa, Borrelia burgdorferi B31
PTFALNYSFS

SEQ ID NO: 41582 - protein, 10 aa, Borrelia burgdorferi B31
TFALNYSFSQ

SEQ ID NO: 41583 - protein, 10 aa, Borrelia burgdorferi B31
FALNYSFSQP

SEQ ID NO: 41584 - protein, 10 aa, Borrelia burgdorferi B31
ALNYSFSQPT

SEQ ID NO: 41585 - protein, 10 aa, Borrelia burgdorferi B31
LNYSFSQPTR

SEQ ID NO: 41586 - protein, 10 aa, Borrelia burgdorferi B31
NYSFSQPTRQ

SEQ ID NO: 41587 - protein, 10 aa, Borrelia burgdorferi B31
YSFSQPTRQQ

SEQ ID NO: 41588 - protein, 10 aa, Borrelia burgdorferi B31
SFSQPTRQQT

SEQ ID NO: 41589 - protein, 10 aa, Borrelia burgdorferi B31
FSQPTRQQTN

SEQ ID NO: 41590 - protein, 10 aa, Borrelia burgdorferi B31
SQPTRQQTNS

SEQ ID NO: 41591 - protein, 10 aa, Borrelia burgdorferi B31
QPTRQQTNSS

SEQ ID NO: 41592 - protein, 10 aa, Borrelia burgdorferi B31
PTRQQTNSSS

SEQ ID NO: 41593 - protein, 10 aa, Borrelia burgdorferi B31
TRQQTNSSSA

SEQ ID NO: 41594 - protein, 10 aa, Borrelia burgdorferi B31
RQQTNSSSAV

SEQ ID NO: 41595 - protein, 10 aa, Borrelia burgdorferi B31
QQTNSSSAVQ

SEQ ID NO: 41596 - protein, 10 aa, Borrelia burgdorferi B31
QTNSSSAVQT

SEQ ID NO: 41597 - protein, 10 aa, Borrelia burgdorferi B31
TNSSSAVQTT

SEQ ID NO: 41598 - protein, 10 aa, Borrelia burgdorferi B31
NSSSAVQTTT

SEQ ID NO: 41599 - protein, 10 aa, Borrelia burgdorferi B31
SSSAVQTTTS

SEQ ID NO: 41600 - protein, 10 aa, Borrelia burgdorferi B31
SSAVQTTTSS

SEQ ID NO: 41601 - protein, 10 aa, Borrelia burgdorferi B31
SAVQTTTSSG

SEQ ID NO: 41602 - protein, 10 aa, Borrelia burgdorferi B31
AVQTTTSSGS

SEQ ID NO: 41603 - protein, 10 aa, Borrelia burgdorferi B31
VQTTTSSGSK

SEQ ID NO: 41604 - protein, 10 aa, Borrelia burgdorferi B31
QTTTSSGSKL

SEQ ID NO: 41605 - protein, 10 aa, Borrelia burgdorferi B31
TTTSSGSKLQ

SEQ ID NO: 41606 - protein, 10 aa, Borrelia burgdorferi B31
TTSSGSKLQT

SEQ ID NO: 41607 - protein, 10 aa, Borrelia burgdorferi B31
TSSGSKLQTL

SEQ ID NO: 41608 - protein, 10 aa, Borrelia burgdorferi B31
SSGSKLQTLK

SEQ ID NO: 41609 - protein, 10 aa, Borrelia burgdorferi B31
SGSKLQTLKN

SEQ ID NO: 41610 - protein, 10 aa, Borrelia burgdorferi B31
GSKLQTLKNE

SEQ ID NO: 41611 - protein, 10 aa, Borrelia burgdorferi B31
SKLQTLKNEL

SEQ ID NO: 41612 - protein, 10 aa, Borrelia burgdorferi B31
KLQTLKNELI

SEQ ID NO: 41613 - protein, 10 aa, Borrelia burgdorferi B31
LQTLKNELIR

SEQ ID NO: 41614 - protein, 10 aa, Borrelia burgdorferi B31
QTLKNELIRA

SEQ ID NO: 41615 - protein, 10 aa, Borrelia burgdorferi B31
TLKNELIRAI

SEQ ID NO: 41616 - protein, 10 aa, Borrelia burgdorferi B31
LKNELIRAIS

SEQ ID NO: 41617 - protein, 10 aa, Borrelia burgdorferi B31
KNELIRAISE

SEQ ID NO: 41618 - protein, 10 aa, Borrelia burgdorferi B31
NELIRAISEE

SEQ ID NO: 41619 - protein, 10 aa, Borrelia burgdorferi B31
ELIRAISEEK

SEQ ID NO: 41620 - protein, 10 aa, Borrelia burgdorferi B31
LIRAISEEKN

SEQ ID NO: 41621 - protein, 10 aa, Borrelia burgdorferi B31
IRAISEEKNK

SEQ ID NO: 41622 - protein, 10 aa, Borrelia burgdorferi B31
RAISEEKNKT

SEQ ID NO: 41623 - protein, 10 aa, Borrelia burgdorferi B31
AISEEKNKTQ

SEQ ID NO: 41624 - protein, 10 aa, Borrelia burgdorferi B31
ISEEKNKTQN

SEQ ID NO: 41625 - protein, 10 aa, Borrelia burgdorferi B31
SEEKNKTQNN

SEQ ID NO: 41626 - protein, 10 aa, Borrelia burgdorferi B31
EEKNKTQNNF

SEQ ID NO: 41627 - protein, 10 aa, Borrelia burgdorferi B31
EKNKTQNNFG

SEQ ID NO: 41628 - protein, 10 aa, Borrelia burgdorferi B31
KNKTQNNFGF

SEQ ID NO: 41629 - protein, 10 aa, Borrelia burgdorferi B31
NKTQNNFGFR

SEQ ID NO: 41630 - protein, 10 aa, Borrelia burgdorferi B31
KTQNNFGFRE

SEQ ID NO: 41631 - protein, 10 aa, Borrelia burgdorferi B31
TQNNFGFRET

SEQ ID NO: 41632 - protein, 10 aa, Borrelia burgdorferi B31
QNNFGFRETY

SEQ ID NO: 41633 - protein, 10 aa, Borrelia burgdorferi B31
NNFGFRETYD

SEQ ID NO: 41634 - protein, 10 aa, Borrelia burgdorferi B31
NFGFRETYDQ

SEQ ID NO: 41635 - protein, 10 aa, Borrelia burgdorferi B31
FGFRETYDQF

SEQ ID NO: 41636 - protein, 10 aa, Borrelia burgdorferi B31
GFRETYDQFK

SEQ ID NO: 41637 - protein, 10 aa, Borrelia burgdorferi B31
FRETYDQFKM

SEQ ID NO: 41638 - protein, 10 aa, Borrelia burgdorferi B31
RETYDQFKMK

SEQ ID NO: 41639 - protein, 10 aa, Borrelia burgdorferi B31
ETYDQFKMKD

SEQ ID NO: 41640 - protein, 10 aa, Borrelia burgdorferi B31
TYDQFKMKDS

SEQ ID NO: 41641 - protein, 10 aa, Borrelia burgdorferi B31
YDQFKMKDSA

SEQ ID NO: 41642 - protein, 10 aa, Borrelia burgdorferi B31
DQFKMKDSAF

SEQ ID NO: 41643 - protein, 10 aa, Borrelia burgdorferi B31
QFKMKDSAFE

SEQ ID NO: 41644 - protein, 10 aa, Borrelia burgdorferi B31
FKMKDSAFEL

SEQ ID NO: 41645 - protein, 10 aa, Borrelia burgdorferi B31
KMKDSAFELL

SEQ ID NO: 41646 - protein, 10 aa, Borrelia burgdorferi B31
MKDSAFELLD

SEQ ID NO: 41647 - protein, 10 aa, Borrelia burgdorferi B31
KDSAFELLDV

SEQ ID NO: 41648 - protein, 10 aa, Borrelia burgdorferi B31
DSAFELLDVI

SEQ ID NO: 41649 - protein, 10 aa, Borrelia burgdorferi B31
SAFELLDVIS

SEQ ID NO: 41650 - protein, 10 aa, Borrelia burgdorferi B31
AFELLDVISS

SEQ ID NO: 41651 - protein, 10 aa, Borrelia burgdorferi B31
FELLDVISSA

SEQ ID NO: 41652 - protein, 10 aa, Borrelia burgdorferi B31
ELLDVISSAK

SEQ ID NO: 41653 - protein, 10 aa, Borrelia burgdorferi B31
LLDVISSAKV

SEQ ID NO: 41654 - protein, 10 aa, Borrelia burgdorferi B31
LDVISSAKVY

SEQ ID NO: 41655 - protein, 10 aa, Borrelia burgdorferi B31
DVISSAKVYD

SEQ ID NO: 41656 - protein, 10 aa, Borrelia burgdorferi B31
VISSAKVYDR

SEQ ID NO: 41657 - protein, 10 aa, Borrelia burgdorferi B31
ISSAKVYDRS

SEQ ID NO: 41658 - protein, 10 aa, Borrelia burgdorferi B31
SSAKVYDRSY

SEQ ID NO: 41659 - protein, 10 aa, Borrelia burgdorferi B31
SAKVYDRSYA

SEQ ID NO: 41660 - protein, 10 aa, Borrelia burgdorferi B31
AKVYDRSYAP

SEQ ID NO: 41661 - protein, 10 aa, Borrelia burgdorferi B31
KVYDRSYAPQ

SEQ ID NO: 41662 - protein, 10 aa, Borrelia burgdorferi B31
VYDRSYAPQL

SEQ ID NO: 41663 - protein, 10 aa, Borrelia burgdorferi B31
YDRSYAPQLN

SEQ ID NO: 41664 - protein, 10 aa, Borrelia burgdorferi B31
DRSYAPQLNS

SEQ ID NO: 41665 - protein, 10 aa, Borrelia burgdorferi B31
RSYAPQLNSN

SEQ ID NO: 41666 - protein, 10 aa, Borrelia burgdorferi B31
SYAPQLNSNT

SEQ ID NO: 41667 - protein, 10 aa, Borrelia burgdorferi B31
YAPQLNSNTP

SEQ ID NO: 41668 - protein, 10 aa, Borrelia burgdorferi B31
APQLNSNTPE

SEQ ID NO: 41669 - protein, 10 aa, Borrelia burgdorferi B31
PQLNSNTPEA

SEQ ID NO: 41670 - protein, 10 aa, Borrelia burgdorferi B31
QLNSNTPEAE

SEQ ID NO: 41671 - protein, 10 aa, Borrelia burgdorferi B31
LNSNTPEAEN

SEQ ID NO: 41672 - protein, 10 aa, Borrelia burgdorferi B31
NSNTPEAENE

SEQ ID NO: 41673 - protein, 10 aa, Borrelia burgdorferi B31
SNTPEAENER

SEQ ID NO: 41674 - protein, 10 aa, Borrelia burgdorferi B31
NTPEAENERN

SEQ ID NO: 41675 - protein, 10 aa, Borrelia burgdorferi B31
TPEAENERNK

SEQ ID NO: 41676 - protein, 10 aa, Borrelia burgdorferi B31
PEAENERNKF

SEQ ID NO: 41677 - protein, 10 aa, Borrelia burgdorferi B31
EAENERNKFY

SEQ ID NO: 41678 - protein, 10 aa, Borrelia burgdorferi B31
AENERNKFYA

SEQ ID NO: 41679 - protein, 10 aa, Borrelia burgdorferi B31
ENERNKFYAL

SEQ ID NO: 41680 - protein, 10 aa, Borrelia burgdorferi B31
NERNKFYALM

SEQ ID NO: 41681 - protein, 10 aa, Borrelia burgdorferi B31
ERNKFYALMD

SEQ ID NO: 41682 - protein, 10 aa, Borrelia burgdorferi B31
RNKFYALMDF

SEQ ID NO: 41683 - protein, 10 aa, Borrelia burgdorferi B31
NKFYALMDFD

SEQ ID NO: 41684 - protein, 10 aa, Borrelia burgdorferi B31
KFYALMDFDQ

SEQ ID NO: 41685 - protein, 10 aa, Borrelia burgdorferi B31
FYALMDFDQY

SEQ ID NO: 41686 - protein, 10 aa, Borrelia burgdorferi B31
YALMDFDQYK

SEQ ID NO: 41687 - protein, 10 aa, Borrelia burgdorferi B31
ALMDFDQYKI

SEQ ID NO: 41688 - protein, 10 aa, Borrelia burgdorferi B31
LMDFDQYKIE

SEQ ID NO: 41689 - protein, 10 aa, Borrelia burgdorferi B31
MDFDQYKIEQ

SEQ ID NO: 41690 - protein, 10 aa, Borrelia burgdorferi B31
DFDQYKIEQF

SEQ ID NO: 41691 - protein, 10 aa, Borrelia burgdorferi B31
FDQYKIEQFG

SEQ ID NO: 41692 - protein, 10 aa, Borrelia burgdorferi B31
DQYKIEQFGS

SEQ ID NO: 41693 - protein, 10 aa, Borrelia burgdorferi B31
QYKIEQFGSI

SEQ ID NO: 41694 - protein, 10 aa, Borrelia burgdorferi B31
YKIEQFGSIM

SEQ ID NO: 41695 - protein, 10 aa, Borrelia burgdorferi B31
KIEQFGSIME

SEQ ID NO: 41696 - protein, 10 aa, Borrelia burgdorferi B31
IEQFGSIMEA

SEQ ID NO: 41697 - protein, 10 aa, Borrelia burgdorferi B31
EQFGSIMEAL

SEQ ID NO: 41698 - protein, 10 aa, Borrelia burgdorferi B31
QFGSIMEALY

SEQ ID NO: 41699 - protein, 10 aa, Borrelia burgdorferi B31
FGSIMEALYN

SEQ ID NO: 41700 - protein, 10 aa, Borrelia burgdorferi B31
GSIMEALYNE

SEQ ID NO: 41701 - protein, 10 aa, Borrelia burgdorferi B31
SIMEALYNEN

SEQ ID NO: 41702 - protein, 10 aa, Borrelia burgdorferi B31
IMEALYNENQ

SEQ ID NO: 41703 - protein, 10 aa, Borrelia burgdorferi B31
MEALYNENQN

SEQ ID NO: 41704 - protein, 10 aa, Borrelia burgdorferi B31
EALYNENQNH

SEQ ID NO: 41705 - protein, 10 aa, Borrelia burgdorferi B31
ALYNENQNHS

SEQ ID NO: 41706 - protein, 10 aa, Borrelia burgdorferi B31
LYNENQNHSL

SEQ ID NO: 41707 - protein, 10 aa, Borrelia burgdorferi B31
YNENQNHSLI

SEQ ID NO: 41708 - protein, 10 aa, Borrelia burgdorferi B31
NENQNHSLIR

SEQ ID NO: 41709 - protein, 10 aa, Borrelia burgdorferi B31
ENQNHSLIRE

SEQ ID NO: 41710 - protein, 10 aa, Borrelia burgdorferi B31
NQNHSLIREL

SEQ ID NO: 41711 - protein, 10 aa, Borrelia burgdorferi B31
QNHSLIRELM

SEQ ID NO: 41712 - protein, 10 aa, Borrelia burgdorferi B31
NHSLIRELMI

SEQ ID NO: 41713 - protein, 10 aa, Borrelia burgdorferi B31
HSLIRELMIS

SEQ ID NO: 41714 - protein, 10 aa, Borrelia burgdorferi B31
SLIRELMISG

SEQ ID NO: 41715 - protein, 10 aa, Borrelia burgdorferi B31
LIRELMISGL

SEQ ID NO: 41716 - protein, 10 aa, Borrelia burgdorferi B31
IRELMISGLG

SEQ ID NO: 41717 - protein, 10 aa, Borrelia burgdorferi B31
RELMISGLGT

SEQ ID NO: 41718 - protein, 10 aa, Borrelia burgdorferi B31
ELMISGLGTQ

SEQ ID NO: 41719 - protein, 10 aa, Borrelia burgdorferi B31
LMISGLGTQI

SEQ ID NO: 41720 - protein, 10 aa, Borrelia burgdorferi B31
MISGLGTQIS

SEQ ID NO: 41721 - protein, 10 aa, Borrelia burgdorferi B31
ISGLGTQISF

SEQ ID NO: 41722 - protein, 10 aa, Borrelia burgdorferi B31
SGLGTQISFE

SEQ ID NO: 41723 - protein, 10 aa, Borrelia burgdorferi B31
GLGTQISFEL

SEQ ID NO: 41724 - protein, 10 aa, Borrelia burgdorferi B31
LGTQISFELA

SEQ ID NO: 41725 - protein, 10 aa, Borrelia burgdorferi B31
GTQISFELAL

SEQ ID NO: 41726 - protein, 10 aa, Borrelia burgdorferi B31
TQISFELALE

SEQ ID NO: 41727 - protein, 10 aa, Borrelia burgdorferi B31
QISFELALEE

SEQ ID NO: 41728 - protein, 10 aa, Borrelia burgdorferi B31
ISFELALEEI

SEQ ID NO: 41729 - protein, 10 aa, Borrelia burgdorferi B31
SFELALEEIN

SEQ ID NO: 41730 - protein, 10 aa, Borrelia burgdorferi B31
FELALEEINK

SEQ ID NO: 41731 - protein, 10 aa, Borrelia burgdorferi B31
ELALEEINKK

SEQ ID NO: 41732 - protein, 10 aa, Borrelia burgdorferi B31
LALEEINKKI

SEQ ID NO: 41733 - protein, 10 aa, Borrelia burgdorferi B31
ALEEINKKIE

SEQ ID NO: 41734 - protein, 10 aa, Borrelia burgdorferi B31
LEEINKKIEI

SEQ ID NO: 41735 - protein, 10 aa, Borrelia burgdorferi B31
EEINKKIEIF

SEQ ID NO: 41736 - protein, 10 aa, Borrelia burgdorferi B31
EINKKIEIFN

SEQ ID NO: 41737 - protein, 10 aa, Borrelia burgdorferi B31
INKKIEIFNQ

SEQ ID NO: 41738 - protein, 10 aa, Borrelia burgdorferi B31
NKKIEIFNQD

SEQ ID NO: 41739 - protein, 10 aa, Borrelia burgdorferi B31
KKIEIFNQDY

SEQ ID NO: 41740 - protein, 10 aa, Borrelia burgdorferi B31
KIEIFNQDYL

SEQ ID NO: 41741 - protein, 10 aa, Borrelia burgdorferi B31
IEIFNQDYLN

SEQ ID NO: 41742 - protein, 10 aa, Borrelia burgdorferi B31
EIFNQDYLNA

SEQ ID NO: 41743 - protein, 10 aa, Borrelia burgdorferi B31
IFNQDYLNAK

SEQ ID NO: 41744 - protein, 10 aa, Borrelia burgdorferi B31
FNQDYLNAKI

SEQ ID NO: 41745 - protein, 10 aa, Borrelia burgdorferi B31
NQDYLNAKIN

SEQ ID NO: 41746 - protein, 10 aa, Borrelia burgdorferi B31
QDYLNAKINS

SEQ ID NO: 41747 - protein, 10 aa, Borrelia burgdorferi B31
DYLNAKINSF

SEQ ID NO: 41748 - protein, 10 aa, Borrelia burgdorferi B31
YLNAKINSFD

SEQ ID NO: 41749 - protein, 10 aa, Borrelia burgdorferi B31
LNAKINSFDF

SEQ ID NO: 41750 - protein, 10 aa, Borrelia burgdorferi B31
NAKINSFDFT

SEQ ID NO: 41751 - protein, 10 aa, Borrelia burgdorferi B31
AKINSFDFTM

SEQ ID NO: 41752 - protein, 10 aa, Borrelia burgdorferi B31
KINSFDFTMK

SEQ ID NO: 41753 - protein, 10 aa, Borrelia burgdorferi B31
INSFDFTMKL

SEQ ID NO: 41754 - protein, 10 aa, Borrelia burgdorferi B31
NSFDFTMKLK

SEQ ID NO: 41755 - protein, 10 aa, Borrelia burgdorferi B31
SFDFTMKLKE

SEQ ID NO: 41756 - protein, 10 aa, Borrelia burgdorferi B31
FDFTMKLKEL

SEQ ID NO: 41757 - protein, 10 aa, Borrelia burgdorferi B31
DFTMKLKELK

SEQ ID NO: 41758 - protein, 10 aa, Borrelia burgdorferi B31
FTMKLKELKS

SEQ ID NO: 41759 - protein, 10 aa, Borrelia burgdorferi B31
TMKLKELKSK

SEQ ID NO: 41760 - protein, 10 aa, Borrelia burgdorferi B31
MKLKELKSKL

SEQ ID NO: 41761 - protein, 10 aa, Borrelia burgdorferi B31
KLKELKSKLN

SEQ ID NO: 41762 - protein, 10 aa, Borrelia burgdorferi B31
LKELKSKLNQ

SEQ ID NO: 41763 - protein, 10 aa, Borrelia burgdorferi B31
KELKSKLNQI

SEQ ID NO: 41764 - protein, 10 aa, Borrelia burgdorferi B31
ELKSKLNQIL

SEQ ID NO: 41765 - protein, 10 aa, Borrelia burgdorferi B31
LKSKLNQILD

SEQ ID NO: 41766 - protein, 10 aa, Borrelia burgdorferi B31
KSKLNQILDK

SEQ ID NO: 41767 - protein, 10 aa, Borrelia burgdorferi B31
SKLNQILDKR

SEQ ID NO: 41768 - protein, 10 aa, Borrelia burgdorferi B31
KLNQILDKRK

SEQ ID NO: 41769 - protein, 10 aa, Borrelia burgdorferi B31
LNQILDKRKE

SEQ ID NO: 41770 - protein, 10 aa, Borrelia burgdorferi B31
NQILDKRKEW

SEQ ID NO: 41771 - protein, 10 aa, Borrelia burgdorferi B31
QILDKRKEWS

SEQ ID NO: 41772 - protein, 10 aa, Borrelia burgdorferi B31
ILDKRKEWSR

SEQ ID NO: 41773 - protein, 10 aa, Borrelia burgdorferi B31
LDKRKEWSRQ

SEQ ID NO: 41774 - protein, 10 aa, Borrelia burgdorferi B31
DKRKEWSRQA

SEQ ID NO: 41775 - protein, 10 aa, Borrelia burgdorferi B31
KRKEWSRQAD

SEQ ID NO: 41776 - protein, 10 aa, Borrelia burgdorferi B31
RKEWSRQADG

SEQ ID NO: 41777 - protein, 10 aa, Borrelia burgdorferi B31
KEWSRQADGL

SEQ ID NO: 41778 - protein, 10 aa, Borrelia burgdorferi B31
EWSRQADGLI

SEQ ID NO: 41779 - protein, 10 aa, Borrelia burgdorferi B31
WSRQADGLIA

SEQ ID NO: 41780 - protein, 10 aa, Borrelia burgdorferi B31
SRQADGLIAN

SEQ ID NO: 41781 - protein, 10 aa, Borrelia burgdorferi B31
RQADGLIANA

SEQ ID NO: 41782 - protein, 10 aa, Borrelia burgdorferi B31
QADGLIANAS

SEQ ID NO: 41783 - protein, 10 aa, Borrelia burgdorferi B31
ADGLIANASS

SEQ ID NO: 41784 - protein, 10 aa, Borrelia burgdorferi B31
DGLIANASSN

SEQ ID NO: 41785 - protein, 10 aa, Borrelia burgdorferi B31
GLIANASSNS

SEQ ID NO: 41786 - protein, 10 aa, Borrelia burgdorferi B31
LIANASSNSS

SEQ ID NO: 41787 - protein, 10 aa, Borrelia burgdorferi B31
IANASSNSSL

SEQ ID NO: 41788 - protein, 10 aa, Borrelia burgdorferi B31
ANASSNSSLS

SEQ ID NO: 41789 - protein, 10 aa, Borrelia burgdorferi B31
NASSNSSLSD

SEQ ID NO: 41790 - protein, 10 aa, Borrelia burgdorferi B31
ASSNSSLSDS

SEQ ID NO: 41791 - protein, 10 aa, Borrelia burgdorferi B31
SSNSSLSDSK

SEQ ID NO: 41792 - protein, 10 aa, Borrelia burgdorferi B31
SNSSLSDSKS

SEQ ID NO: 41793 - protein, 10 aa, Borrelia burgdorferi B31
NSSLSDSKSL

SEQ ID NO: 41794 - protein, 10 aa, Borrelia burgdorferi B31
SSLSDSKSLA

SEQ ID NO: 41795 - protein, 10 aa, Borrelia burgdorferi B31
SLSDSKSLAE

SEQ ID NO: 41796 - protein, 10 aa, Borrelia burgdorferi B31
LSDSKSLAEY

SEQ ID NO: 41797 - protein, 10 aa, Borrelia burgdorferi B31
SDSKSLAEYI

SEQ ID NO: 41798 - protein, 10 aa, Borrelia burgdorferi B31
DSKSLAEYIK

SEQ ID NO: 41799 - protein, 10 aa, Borrelia burgdorferi B31
SKSLAEYIKK

SEQ ID NO: 41800 - protein, 10 aa, Borrelia burgdorferi B31
KSLAEYIKKR

SEQ ID NO: 41801 - protein, 10 aa, Borrelia burgdorferi B31
SLAEYIKKRY

SEQ ID NO: 41802 - protein, 10 aa, Borrelia burgdorferi B31
LAEYIKKRYL

SEQ ID NO: 41803 - protein, 10 aa, Borrelia burgdorferi B31
AEYIKKRYLD

SEQ ID NO: 41804 - protein, 10 aa, Borrelia burgdorferi B31
EYIKKRYLDN

SEQ ID NO: 41805 - protein, 10 aa, Borrelia burgdorferi B31
YIKKRYLDNM

SEQ ID NO: 41806 - protein, 10 aa, Borrelia burgdorferi B31
IKKRYLDNMQ

SEQ ID NO: 41807 - protein, 10 aa, Borrelia burgdorferi B31
KKRYLDNMQN

SEQ ID NO: 41808 - protein, 10 aa, Borrelia burgdorferi B31
KRYLDNMQNA

SEQ ID NO: 41809 - protein, 10 aa, Borrelia burgdorferi B31
RYLDNMQNAR

SEQ ID NO: 41810 - protein, 10 aa, Borrelia burgdorferi B31
YLDNMQNARQ

SEQ ID NO: 41811 - protein, 10 aa, Borrelia burgdorferi B31
LDNMQNARQS

SEQ ID NO: 41812 - protein, 10 aa, Borrelia burgdorferi B31
DNMQNARQSV

SEQ ID NO: 41813 - protein, 10 aa, Borrelia burgdorferi B31
NMQNARQSVL

SEQ ID NO: 41814 - protein, 10 aa, Borrelia burgdorferi B31
MQNARQSVLE

SEQ ID NO: 41815 - protein, 10 aa, Borrelia burgdorferi B31
QNARQSVLEA

SEQ ID NO: 41816 - protein, 10 aa, Borrelia burgdorferi B31
NARQSVLEAY

SEQ ID NO: 41817 - protein, 10 aa, Borrelia burgdorferi B31
ARQSVLEAYI

SEQ ID NO: 41818 - protein, 10 aa, Borrelia burgdorferi B31
RQSVLEAYIS

SEQ ID NO: 41819 - protein, 10 aa, Borrelia burgdorferi B31
QSVLEAYISI

SEQ ID NO: 41820 - protein, 11 aa, Borrelia burgdorferi B31
MKIKPLIQLKL

SEQ ID NO: 41821 - protein, 11 aa, Borrelia burgdorferi B31
KIKPLIQLKLL

SEQ ID NO: 41822 - protein, 11 aa, Borrelia burgdorferi B31
IKPLIQLKLLG

SEQ ID NO: 41823 - protein, 11 aa, Borrelia burgdorferi B31
KPLIQLKLLGL

SEQ ID NO: 41824 - protein, 11 aa, Borrelia burgdorferi B31
PLIQLKLLGLF

SEQ ID NO: 41825 - protein, 11 aa, Borrelia burgdorferi B31
LIQLKLLGLFL

SEQ ID NO: 41826 - protein, 11 aa, Borrelia burgdorferi B31
IQLKLLGLFLF

SEQ ID NO: 41827 - protein, 11 aa, Borrelia burgdorferi B31
QLKLLGLFLFS

SEQ ID NO: 41828 - protein, 11 aa, Borrelia burgdorferi B31
LKLLGLFLFSC

SEQ ID NO: 41829 - protein, 11 aa, Borrelia burgdorferi B31
KLLGLFLFSCT

SEQ ID NO: 41830 - protein, 11 aa, Borrelia burgdorferi B31
LLGLFLFSCTI

SEQ ID NO: 41831 - protein, 11 aa, Borrelia burgdorferi B31
LGLFLFSCTID

SEQ ID NO: 41832 - protein, 11 aa, Borrelia burgdorferi B31
GLFLFSCTIDA

SEQ ID NO: 41833 - protein, 11 aa, Borrelia burgdorferi B31
LFLFSCTIDAN

SEQ ID NO: 41834 - protein, 11 aa, Borrelia burgdorferi B31
FLFSCTIDANL

SEQ ID NO: 41835 - protein, 11 aa, Borrelia burgdorferi B31
LFSCTIDANLN

SEQ ID NO: 41836 - protein, 11 aa, Borrelia burgdorferi B31
FSCTIDANLNE

SEQ ID NO: 41837 - protein, 11 aa, Borrelia burgdorferi B31
SCTIDANLNED

SEQ ID NO: 41838 - protein, 11 aa, Borrelia burgdorferi B31
CTIDANLNEDY

SEQ ID NO: 41839 - protein, 11 aa, Borrelia burgdorferi B31
TIDANLNEDYK

SEQ ID NO: 41840 - protein, 11 aa, Borrelia burgdorferi B31
IDANLNEDYKN

SEQ ID NO: 41841 - protein, 11 aa, Borrelia burgdorferi B31
DANLNEDYKNK

SEQ ID NO: 41842 - protein, 11 aa, Borrelia burgdorferi B31
ANLNEDYKNKV

SEQ ID NO: 41843 - protein, 11 aa, Borrelia burgdorferi B31
NLNEDYKNKVK

SEQ ID NO: 41844 - protein, 11 aa, Borrelia burgdorferi B31
LNEDYKNKVKG

SEQ ID NO: 41845 - protein, 11 aa, Borrelia burgdorferi B31
NEDYKNKVKGI

SEQ ID NO: 41846 - protein, 11 aa, Borrelia burgdorferi B31
EDYKNKVKGIL

SEQ ID NO: 41847 - protein, 11 aa, Borrelia burgdorferi B31
DYKNKVKGILN

SEQ ID NO: 41848 - protein, 11 aa, Borrelia burgdorferi B31
YKNKVKGILNK

SEQ ID NO: 41849 - protein, 11 aa, Borrelia burgdorferi B31
KNKVKGILNKA

SEQ ID NO: 41850 - protein, 11 aa, Borrelia burgdorferi B31
NKVKGILNKAA

SEQ ID NO: 41851 - protein, 11 aa, Borrelia burgdorferi B31
KVKGILNKAAD

SEQ ID NO: 41852 - protein, 11 aa, Borrelia burgdorferi B31
VKGILNKAADD

SEQ ID NO: 41853 - protein, 11 aa, Borrelia burgdorferi B31
KGILNKAADDQ

SEQ ID NO: 41854 - protein, 11 aa, Borrelia burgdorferi B31
GILNKAADDQE

SEQ ID NO: 41855 - protein, 11 aa, Borrelia burgdorferi B31
ILNKAADDQET

SEQ ID NO: 41856 - protein, 11 aa, Borrelia burgdorferi B31
LNKAADDQETT

SEQ ID NO: 41857 - protein, 11 aa, Borrelia burgdorferi B31
NKAADDQETTS

SEQ ID NO: 41858 - protein, 11 aa, Borrelia burgdorferi B31
KAADDQETTSA

SEQ ID NO: 41859 - protein, 11 aa, Borrelia burgdorferi B31
AADDQETTSAD

SEQ ID NO: 41860 - protein, 11 aa, Borrelia burgdorferi B31
ADDQETTSADT

SEQ ID NO: 41861 - protein, 11 aa, Borrelia burgdorferi B31
DDQETTSADTN

SEQ ID NO: 41862 - protein, 11 aa, Borrelia burgdorferi B31
DQETTSADTNS

SEQ ID NO: 41863 - protein, 11 aa, Borrelia burgdorferi B31
QETTSADTNSN

SEQ ID NO: 41864 - protein, 11 aa, Borrelia burgdorferi B31
ETTSADTNSNA

SEQ ID NO: 41865 - protein, 11 aa, Borrelia burgdorferi B31
TTSADTNSNAA

SEQ ID NO: 41866 - protein, 11 aa, Borrelia burgdorferi B31
TSADTNSNAAK

SEQ ID NO: 41867 - protein, 11 aa, Borrelia burgdorferi B31
SADTNSNAAKN

SEQ ID NO: 41868 - protein, 11 aa, Borrelia burgdorferi B31
ADTNSNAAKNI

SEQ ID NO: 41869 - protein, 11 aa, Borrelia burgdorferi B31
DTNSNAAKNIP

SEQ ID NO: 41870 - protein, 11 aa, Borrelia burgdorferi B31
TNSNAAKNIPI

SEQ ID NO: 41871 - protein, 11 aa, Borrelia burgdorferi B31
NSNAAKNIPIA

SEQ ID NO: 41872 - protein, 11 aa, Borrelia burgdorferi B31
SNAAKNIPIAD

SEQ ID NO: 41873 - protein, 11 aa, Borrelia burgdorferi B31
NAAKNIPIADN

SEQ ID NO: 41874 - protein, 11 aa, Borrelia burgdorferi B31
AAKNIPIADND

SEQ ID NO: 41875 - protein, 11 aa, Borrelia burgdorferi B31
AKNIPIADNDK

SEQ ID NO: 41876 - protein, 11 aa, Borrelia burgdorferi B31
KNIPIADNDKV

SEQ ID NO: 41877 - protein, 11 aa, Borrelia burgdorferi B31
NIPIADNDKVA

SEQ ID NO: 41878 - protein, 11 aa, Borrelia burgdorferi B31
IPIADNDKVAA

SEQ ID NO: 41879 - protein, 11 aa, Borrelia burgdorferi B31
PIADNDKVAAE

SEQ ID NO: 41880 - protein, 11 aa, Borrelia burgdorferi B31
IADNDKVAAEL

SEQ ID NO: 41881 - protein, 11 aa, Borrelia burgdorferi B31
ADNDKVAAELK

SEQ ID NO: 41882 - protein, 11 aa, Borrelia burgdorferi B31
DNDKVAAELKK

SEQ ID NO: 41883 - protein, 11 aa, Borrelia burgdorferi B31
NDKVAAELKKQ

SEQ ID NO: 41884 - protein, 11 aa, Borrelia burgdorferi B31
DKVAAELKKQS

SEQ ID NO: 41885 - protein, 11 aa, Borrelia burgdorferi B31
KVAAELKKQSQ

SEQ ID NO: 41886 - protein, 11 aa, Borrelia burgdorferi B31
VAAELKKQSQA

SEQ ID NO: 41887 - protein, 11 aa, Borrelia burgdorferi B31
AAELKKQSQAA

SEQ ID NO: 41888 - protein, 11 aa, Borrelia burgdorferi B31
AELKKQSQAAK

SEQ ID NO: 41889 - protein, 11 aa, Borrelia burgdorferi B31
ELKKQSQAAKT

SEQ ID NO: 41890 - protein, 11 aa, Borrelia burgdorferi B31
LKKQSQAAKTV

SEQ ID NO: 41891 - protein, 11 aa, Borrelia burgdorferi B31
KKQSQAAKTVA

SEQ ID NO: 41892 - protein, 11 aa, Borrelia burgdorferi B31
KQSQAAKTVAA

SEQ ID NO: 41893 - protein, 11 aa, Borrelia burgdorferi B31
QSQAAKTVAAA

SEQ ID NO: 41894 - protein, 11 aa, Borrelia burgdorferi B31
SQAAKTVAAAP

SEQ ID NO: 41895 - protein, 11 aa, Borrelia burgdorferi B31
QAAKTVAAAPN

SEQ ID NO: 41896 - protein, 11 aa, Borrelia burgdorferi B31
AAKTVAAAPNK

SEQ ID NO: 41897 - protein, 11 aa, Borrelia burgdorferi B31
AKTVAAAPNKG

SEQ ID NO: 41898 - protein, 11 aa, Borrelia burgdorferi B31
KTVAAAPNKGS

SEQ ID NO: 41899 - protein, 11 aa, Borrelia burgdorferi B31
TVAAAPNKGSQ

SEQ ID NO: 41900 - protein, 11 aa, Borrelia burgdorferi B31
VAAAPNKGSQN

SEQ ID NO: 41901 - protein, 11 aa, Borrelia burgdorferi B31
AAAPNKGSQNQ

SEQ ID NO: 41902 - protein, 11 aa, Borrelia burgdorferi B31
AAPNKGSQNQP

SEQ ID NO: 41903 - protein, 11 aa, Borrelia burgdorferi B31
APNKGSQNQPQ

SEQ ID NO: 41904 - protein, 11 aa, Borrelia burgdorferi B31
PNKGSQNQPQT

SEQ ID NO: 41905 - protein, 11 aa, Borrelia burgdorferi B31
NKGSQNQPQTT

SEQ ID NO: 41906 - protein, 11 aa, Borrelia burgdorferi B31
KGSQNQPQTTP

SEQ ID NO: 41907 - protein, 11 aa, Borrelia burgdorferi B31
GSQNQPQTTPN

SEQ ID NO: 41908 - protein, 11 aa, Borrelia burgdorferi B31
SQNQPQTTPNK

SEQ ID NO: 41909 - protein, 11 aa, Borrelia burgdorferi B31
QNQPQTTPNKG

SEQ ID NO: 41910 - protein, 11 aa, Borrelia burgdorferi B31
NQPQTTPNKGS

SEQ ID NO: 41911 - protein, 11 aa, Borrelia burgdorferi B31
QPQTTPNKGSQ

SEQ ID NO: 41912 - protein, 11 aa, Borrelia burgdorferi B31
PQTTPNKGSQN

SEQ ID NO: 41913 - protein, 11 aa, Borrelia burgdorferi B31
QTTPNKGSQNQ

SEQ ID NO: 41914 - protein, 11 aa, Borrelia burgdorferi B31
TTPNKGSQNQQ

SEQ ID NO: 41915 - protein, 11 aa, Borrelia burgdorferi B31
TPNKGSQNQQA

SEQ ID NO: 41916 - protein, 11 aa, Borrelia burgdorferi B31
PNKGSQNQQAA

SEQ ID NO: 41917 - protein, 11 aa, Borrelia burgdorferi B31
NKGSQNQQAAP

SEQ ID NO: 41918 - protein, 11 aa, Borrelia burgdorferi B31
KGSQNQQAAPS

SEQ ID NO: 41919 - protein, 11 aa, Borrelia burgdorferi B31
GSQNQQAAPSP

SEQ ID NO: 41920 - protein, 11 aa, Borrelia burgdorferi B31
SQNQQAAPSPQ

SEQ ID NO: 41921 - protein, 11 aa, Borrelia burgdorferi B31
QNQQAAPSPQL

SEQ ID NO: 41922 - protein, 11 aa, Borrelia burgdorferi B31
NQQAAPSPQLQ

SEQ ID NO: 41923 - protein, 11 aa, Borrelia burgdorferi B31
QQAAPSPQLQS

SEQ ID NO: 41924 - protein, 11 aa, Borrelia burgdorferi B31
QAAPSPQLQSL

SEQ ID NO: 41925 - protein, 11 aa, Borrelia burgdorferi B31
AAPSPQLQSLS

SEQ ID NO: 41926 - protein, 11 aa, Borrelia burgdorferi B31
APSPQLQSLSF

SEQ ID NO: 41927 - protein, 11 aa, Borrelia burgdorferi B31
PSPQLQSLSFS

SEQ ID NO: 41928 - protein, 11 aa, Borrelia burgdorferi B31
SPQLQSLSFSA

SEQ ID NO: 41929 - protein, 11 aa, Borrelia burgdorferi B31
PQLQSLSFSAD

SEQ ID NO: 41930 - protein, 11 aa, Borrelia burgdorferi B31
QLQSLSFSADL

SEQ ID NO: 41931 - protein, 11 aa, Borrelia burgdorferi B31
LQSLSFSADLS

SEQ ID NO: 41932 - protein, 11 aa, Borrelia burgdorferi B31
QSLSFSADLSN

SEQ ID NO: 41933 - protein, 11 aa, Borrelia burgdorferi B31
SLSFSADLSNL

SEQ ID NO: 41934 - protein, 11 aa, Borrelia burgdorferi B31
LSFSADLSNLP

SEQ ID NO: 41935 - protein, 11 aa, Borrelia burgdorferi B31
SFSADLSNLPK

SEQ ID NO: 41936 - protein, 11 aa, Borrelia burgdorferi B31
FSADLSNLPKT

SEQ ID NO: 41937 - protein, 11 aa, Borrelia burgdorferi B31
SADLSNLPKTT

SEQ ID NO: 41938 - protein, 11 aa, Borrelia burgdorferi B31
ADLSNLPKTTA

SEQ ID NO: 41939 - protein, 11 aa, Borrelia burgdorferi B31
DLSNLPKTTAA

SEQ ID NO: 41940 - protein, 11 aa, Borrelia burgdorferi B31
LSNLPKTTAAR

SEQ ID NO: 41941 - protein, 11 aa, Borrelia burgdorferi B31
SNLPKTTAARA

SEQ ID NO: 41942 - protein, 11 aa, Borrelia burgdorferi B31
NLPKTTAARAA

SEQ ID NO: 41943 - protein, 11 aa, Borrelia burgdorferi B31
LPKTTAARAAS

SEQ ID NO: 41944 - protein, 11 aa, Borrelia burgdorferi B31
PKTTAARAASL

SEQ ID NO: 41945 - protein, 11 aa, Borrelia burgdorferi B31
KTTAARAASLT

SEQ ID NO: 41946 - protein, 11 aa, Borrelia burgdorferi B31
TTAARAASLTK

SEQ ID NO: 41947 - protein, 11 aa, Borrelia burgdorferi B31
TAARAASLTKQ

SEQ ID NO: 41948 - protein, 11 aa, Borrelia burgdorferi B31
AARAASLTKQR

SEQ ID NO: 41949 - protein, 11 aa, Borrelia burgdorferi B31
ARAASLTKQRI

SEQ ID NO: 41950 - protein, 11 aa, Borrelia burgdorferi B31
RAASLTKQRIP

SEQ ID NO: 41951 - protein, 11 aa, Borrelia burgdorferi B31
AASLTKQRIPI

SEQ ID NO: 41952 - protein, 11 aa, Borrelia burgdorferi B31
ASLTKQRIPIQ

SEQ ID NO: 41953 - protein, 11 aa, Borrelia burgdorferi B31
SLTKQRIPIQA

SEQ ID NO: 41954 - protein, 11 aa, Borrelia burgdorferi B31
LTKQRIPIQAV

SEQ ID NO: 41955 - protein, 11 aa, Borrelia burgdorferi B31
TKQRIPIQAVT

SEQ ID NO: 41956 - protein, 11 aa, Borrelia burgdorferi B31
KQRIPIQAVTT

SEQ ID NO: 41957 - protein, 11 aa, Borrelia burgdorferi B31
QRIPIQAVTTV

SEQ ID NO: 41958 - protein, 11 aa, Borrelia burgdorferi B31
RIPIQAVTTVP

SEQ ID NO: 41959 - protein, 11 aa, Borrelia burgdorferi B31
IPIQAVTTVPG

SEQ ID NO: 41960 - protein, 11 aa, Borrelia burgdorferi B31
PIQAVTTVPGN

SEQ ID NO: 41961 - protein, 11 aa, Borrelia burgdorferi B31
IQAVTTVPGNT

SEQ ID NO: 41962 - protein, 11 aa, Borrelia burgdorferi B31
QAVTTVPGNTR

SEQ ID NO: 41963 - protein, 11 aa, Borrelia burgdorferi B31
AVTTVPGNTRT

SEQ ID NO: 41964 - protein, 11 aa, Borrelia burgdorferi B31
VTTVPGNTRTF

SEQ ID NO: 41965 - protein, 11 aa, Borrelia burgdorferi B31
TTVPGNTRTFN

SEQ ID NO: 41966 - protein, 11 aa, Borrelia burgdorferi B31
TVPGNTRTFNS

SEQ ID NO: 41967 - protein, 11 aa, Borrelia burgdorferi B31
VPGNTRTFNSR

SEQ ID NO: 41968 - protein, 11 aa, Borrelia burgdorferi B31
PGNTRTFNSRN

SEQ ID NO: 41969 - protein, 11 aa, Borrelia burgdorferi B31
GNTRTFNSRNS

SEQ ID NO: 41970 - protein, 11 aa, Borrelia burgdorferi B31
NTRTFNSRNSG

SEQ ID NO: 41971 - protein, 11 aa, Borrelia burgdorferi B31
TRTFNSRNSGL

SEQ ID NO: 41972 - protein, 11 aa, Borrelia burgdorferi B31
RTFNSRNSGLP

SEQ ID NO: 41973 - protein, 11 aa, Borrelia burgdorferi B31
TFNSRNSGLPT

SEQ ID NO: 41974 - protein, 11 aa, Borrelia burgdorferi B31
FNSRNSGLPTF

SEQ ID NO: 41975 - protein, 11 aa, Borrelia burgdorferi B31
NSRNSGLPTFA

SEQ ID NO: 41976 - protein, 11 aa, Borrelia burgdorferi B31
SRNSGLPTFAL

SEQ ID NO: 41977 - protein, 11 aa, Borrelia burgdorferi B31
RNSGLPTFALN

SEQ ID NO: 41978 - protein, 11 aa, Borrelia burgdorferi B31
NSGLPTFALNY

SEQ ID NO: 41979 - protein, 11 aa, Borrelia burgdorferi B31
SGLPTFALNYS

SEQ ID NO: 41980 - protein, 11 aa, Borrelia burgdorferi B31
GLPTFALNYSF

SEQ ID NO: 41981 - protein, 11 aa, Borrelia burgdorferi B31
LPTFALNYSFS

SEQ ID NO: 41982 - protein, 11 aa, Borrelia burgdorferi B31
PTFALNYSFSQ

SEQ ID NO: 41983 - protein, 11 aa, Borrelia burgdorferi B31
TFALNYSFSQP

SEQ ID NO: 41984 - protein, 11 aa, Borrelia burgdorferi B31
FALNYSFSQPT

SEQ ID NO: 41985 - protein, 11 aa, Borrelia burgdorferi B31
ALNYSFSQPTR

SEQ ID NO: 41986 - protein, 11 aa, Borrelia burgdorferi B31
LNYSFSQPTRQ

SEQ ID NO: 41987 - protein, 11 aa, Borrelia burgdorferi B31
NYSFSQPTRQQ

SEQ ID NO: 41988 - protein, 11 aa, Borrelia burgdorferi B31
YSFSQPTRQQT

SEQ ID NO: 41989 - protein, 11 aa, Borrelia burgdorferi B31
SFSQPTRQQTN

SEQ ID NO: 41990 - protein, 11 aa, Borrelia burgdorferi B31
FSQPTRQQTNS

SEQ ID NO: 41991 - protein, 11 aa, Borrelia burgdorferi B31
SQPTRQQTNSS

SEQ ID NO: 41992 - protein, 11 aa, Borrelia burgdorferi B31
QPTRQQTNSSS

SEQ ID NO: 41993 - protein, 11 aa, Borrelia burgdorferi B31
PTRQQTNSSSA

SEQ ID NO: 41994 - protein, 11 aa, Borrelia burgdorferi B31
TRQQTNSSSAV

SEQ ID NO: 41995 - protein, 11 aa, Borrelia burgdorferi B31
RQQTNSSSAVQ

SEQ ID NO: 41996 - protein, 11 aa, Borrelia burgdorferi B31
QQTNSSSAVQT

SEQ ID NO: 41997 - protein, 11 aa, Borrelia burgdorferi B31
QTNSSSAVQTT

SEQ ID NO: 41998 - protein, 11 aa, Borrelia burgdorferi B31
TNSSSAVQTTT

SEQ ID NO: 41999 - protein, 11 aa, Borrelia burgdorferi B31
NSSSAVQTTTS

SEQ ID NO: 42000 - protein, 11 aa, Borrelia burgdorferi B31
SSSAVQTTTSS

SEQ ID NO: 42001 - protein, 11 aa, Borrelia burgdorferi B31
SSAVQTTTSSG

SEQ ID NO: 42002 - protein, 11 aa, Borrelia burgdorferi B31
SAVQTTTSSGS

SEQ ID NO: 42003 - protein, 11 aa, Borrelia burgdorferi B31
AVQTTTSSGSK

SEQ ID NO: 42004 - protein, 11 aa, Borrelia burgdorferi B31
VQTTTSSGSKL

SEQ ID NO: 42005 - protein, 11 aa, Borrelia burgdorferi B31
QTTTSSGSKLQ

SEQ ID NO: 42006 - protein, 11 aa, Borrelia burgdorferi B31
TTTSSGSKLQT

SEQ ID NO: 42007 - protein, 11 aa, Borrelia burgdorferi B31
TTSSGSKLQTL

SEQ ID NO: 42008 - protein, 11 aa, Borrelia burgdorferi B31
TSSGSKLQTLK

SEQ ID NO: 42009 - protein, 11 aa, Borrelia burgdorferi B31
SSGSKLQTLKN

SEQ ID NO: 42010 - protein, 11 aa, Borrelia burgdorferi B31
SGSKLQTLKNE

SEQ ID NO: 42011 - protein, 11 aa, Borrelia burgdorferi B31
GSKLQTLKNEL

SEQ ID NO: 42012 - protein, 11 aa, Borrelia burgdorferi B31
SKLQTLKNELI

SEQ ID NO: 42013 - protein, 11 aa, Borrelia burgdorferi B31
KLQTLKNELIR

SEQ ID NO: 42014 - protein, 11 aa, Borrelia burgdorferi B31
LQTLKNELIRA

SEQ ID NO: 42015 - protein, 11 aa, Borrelia burgdorferi B31
QTLKNELIRAI

SEQ ID NO: 42016 - protein, 11 aa, Borrelia burgdorferi B31
TLKNELIRAIS

SEQ ID NO: 42017 - protein, 11 aa, Borrelia burgdorferi B31
LKNELIRAISE

SEQ ID NO: 42018 - protein, 11 aa, Borrelia burgdorferi B31
KNELIRAISEE

SEQ ID NO: 42019 - protein, 11 aa, Borrelia burgdorferi B31
NELIRAISEEK

SEQ ID NO: 42020 - protein, 11 aa, Borrelia burgdorferi B31
ELIRAISEEKN

SEQ ID NO: 42021 - protein, 11 aa, Borrelia burgdorferi B31
LIRAISEEKNK

SEQ ID NO: 42022 - protein, 11 aa, Borrelia burgdorferi B31
IRAISEEKNKT

SEQ ID NO: 42023 - protein, 11 aa, Borrelia burgdorferi B31
RAISEEKNKTQ

SEQ ID NO: 42024 - protein, 11 aa, Borrelia burgdorferi B31
AISEEKNKTQN

SEQ ID NO: 42025 - protein, 11 aa, Borrelia burgdorferi B31
ISEEKNKTQNN

SEQ ID NO: 42026 - protein, 11 aa, Borrelia burgdorferi B31
SEEKNKTQNNF

SEQ ID NO: 42027 - protein, 11 aa, Borrelia burgdorferi B31
EEKNKTQNNFG

SEQ ID NO: 42028 - protein, 11 aa, Borrelia burgdorferi B31
EKNKTQNNFGF

SEQ ID NO: 42029 - protein, 11 aa, Borrelia burgdorferi B31
KNKTQNNFGFR

SEQ ID NO: 42030 - protein, 11 aa, Borrelia burgdorferi B31
NKTQNNFGFRE

SEQ ID NO: 42031 - protein, 11 aa, Borrelia burgdorferi B31
KTQNNFGFRET

SEQ ID NO: 42032 - protein, 11 aa, Borrelia burgdorferi B31
TQNNFGFRETY

SEQ ID NO: 42033 - protein, 11 aa, Borrelia burgdorferi B31
QNNFGFRETYD

SEQ ID NO: 42034 - protein, 11 aa, Borrelia burgdorferi B31
NNFGFRETYDQ

SEQ ID NO: 42035 - protein, 11 aa, Borrelia burgdorferi B31
NFGFRETYDQF

SEQ ID NO: 42036 - protein, 11 aa, Borrelia burgdorferi B31
FGFRETYDQFK

SEQ ID NO: 42037 - protein, 11 aa, Borrelia burgdorferi B31
GFRETYDQFKM

SEQ ID NO: 42038 - protein, 11 aa, Borrelia burgdorferi B31
FRETYDQFKMK

SEQ ID NO: 42039 - protein, 11 aa, Borrelia burgdorferi B31
RETYDQFKMKD

SEQ ID NO: 42040 - protein, 11 aa, Borrelia burgdorferi B31
ETYDQFKMKDS

SEQ ID NO: 42041 - protein, 11 aa, Borrelia burgdorferi B31
TYDQFKMKDSA

SEQ ID NO: 42042 - protein, 11 aa, Borrelia burgdorferi B31
YDQFKMKDSAF

SEQ ID NO: 42043 - protein, 11 aa, Borrelia burgdorferi B31
DQFKMKDSAFE

SEQ ID NO: 42044 - protein, 11 aa, Borrelia burgdorferi B31
QFKMKDSAFEL

SEQ ID NO: 42045 - protein, 11 aa, Borrelia burgdorferi B31
FKMKDSAFELL

SEQ ID NO: 42046 - protein, 11 aa, Borrelia burgdorferi B31
KMKDSAFELLD

SEQ ID NO: 42047 - protein, 11 aa, Borrelia burgdorferi B31
MKDSAFELLDV

SEQ ID NO: 42048 - protein, 11 aa, Borrelia burgdorferi B31
KDSAFELLDVI

SEQ ID NO: 42049 - protein, 11 aa, Borrelia burgdorferi B31
DSAFELLDVIS

SEQ ID NO: 42050 - protein, 11 aa, Borrelia burgdorferi B31
SAFELLDVISS

SEQ ID NO: 42051 - protein, 11 aa, Borrelia burgdorferi B31
AFELLDVISSA

SEQ ID NO: 42052 - protein, 11 aa, Borrelia burgdorferi B31
FELLDVISSAK

SEQ ID NO: 42053 - protein, 11 aa, Borrelia burgdorferi B31
ELLDVISSAKV

SEQ ID NO: 42054 - protein, 11 aa, Borrelia burgdorferi B31
LLDVISSAKVY

SEQ ID NO: 42055 - protein, 11 aa, Borrelia burgdorferi B31
LDVISSAKVYD

SEQ ID NO: 42056 - protein, 11 aa, Borrelia burgdorferi B31
DVISSAKVYDR

SEQ ID NO: 42057 - protein, 11 aa, Borrelia burgdorferi B31
VISSAKVYDRS

SEQ ID NO: 42058 - protein, 11 aa, Borrelia burgdorferi B31
ISSAKVYDRSY

SEQ ID NO: 42059 - protein, 11 aa, Borrelia burgdorferi B31
SSAKVYDRSYA

SEQ ID NO: 42060 - protein, 11 aa, Borrelia burgdorferi B31
SAKVYDRSYAP

SEQ ID NO: 42061 - protein, 11 aa, Borrelia burgdorferi B31
AKVYDRSYAPQ

SEQ ID NO: 42062 - protein, 11 aa, Borrelia burgdorferi B31
KVYDRSYAPQL

SEQ ID NO: 42063 - protein, 11 aa, Borrelia burgdorferi B31
VYDRSYAPQLN

SEQ ID NO: 42064 - protein, 11 aa, Borrelia burgdorferi B31
YDRSYAPQLNS

SEQ ID NO: 42065 - protein, 11 aa, Borrelia burgdorferi B31
DRSYAPQLNSN

SEQ ID NO: 42066 - protein, 11 aa, Borrelia burgdorferi B31
RSYAPQLNSNT

SEQ ID NO: 42067 - protein, 11 aa, Borrelia burgdorferi B31
SYAPQLNSNTP

SEQ ID NO: 42068 - protein, 11 aa, Borrelia burgdorferi B31
YAPQLNSNTPE

SEQ ID NO: 42069 - protein, 11 aa, Borrelia burgdorferi B31
APQLNSNTPEA

SEQ ID NO: 42070 - protein, 11 aa, Borrelia burgdorferi B31
PQLNSNTPEAE

SEQ ID NO: 42071 - protein, 11 aa, Borrelia burgdorferi B31
QLNSNTPEAEN

SEQ ID NO: 42072 - protein, 11 aa, Borrelia burgdorferi B31
LNSNTPEAENE

SEQ ID NO: 42073 - protein, 11 aa, Borrelia burgdorferi B31
NSNTPEAENER

SEQ ID NO: 42074 - protein, 11 aa, Borrelia burgdorferi B31
SNTPEAENERN

SEQ ID NO: 42075 - protein, 11 aa, Borrelia burgdorferi B31
NTPEAENERNK

SEQ ID NO: 42076 - protein, 11 aa, Borrelia burgdorferi B31
TPEAENERNKF

SEQ ID NO: 42077 - protein, 11 aa, Borrelia burgdorferi B31
PEAENERNKFY

SEQ ID NO: 42078 - protein, 11 aa, Borrelia burgdorferi B31
EAENERNKFYA

SEQ ID NO: 42079 - protein, 11 aa, Borrelia burgdorferi B31
AENERNKFYAL

SEQ ID NO: 42080 - protein, 11 aa, Borrelia burgdorferi B31
ENERNKFYALM

SEQ ID NO: 42081 - protein, 11 aa, Borrelia burgdorferi B31
NERNKFYALMD

SEQ ID NO: 42082 - protein, 11 aa, Borrelia burgdorferi B31
ERNKFYALMDF

SEQ ID NO: 42083 - protein, 11 aa, Borrelia burgdorferi B31
RNKFYALMDFD

SEQ ID NO: 42084 - protein, 11 aa, Borrelia burgdorferi B31
NKFYALMDFDQ

SEQ ID NO: 42085 - protein, 11 aa, Borrelia burgdorferi B31
KFYALMDFDQY

SEQ ID NO: 42086 - protein, 11 aa, Borrelia burgdorferi B31
FYALMDFDQYK

SEQ ID NO: 42087 - protein, 11 aa, Borrelia burgdorferi B31
YALMDFDQYKI

SEQ ID NO: 42088 - protein, 11 aa, Borrelia burgdorferi B31
ALMDFDQYKIE

SEQ ID NO: 42089 - protein, 11 aa, Borrelia burgdorferi B31
LMDFDQYKIEQ

SEQ ID NO: 42090 - protein, 11 aa, Borrelia burgdorferi B31
MDFDQYKIEQF

SEQ ID NO: 42091 - protein, 11 aa, Borrelia burgdorferi B31
DFDQYKIEQFG

SEQ ID NO: 42092 - protein, 11 aa, Borrelia burgdorferi B31
FDQYKIEQFGS

SEQ ID NO: 42093 - protein, 11 aa, Borrelia burgdorferi B31
DQYKIEQFGSI

SEQ ID NO: 42094 - protein, 11 aa, Borrelia burgdorferi B31
QYKIEQFGSIM

SEQ ID NO: 42095 - protein, 11 aa, Borrelia burgdorferi B31
YKIEQFGSIME

SEQ ID NO: 42096 - protein, 11 aa, Borrelia burgdorferi B31
KIEQFGSIMEA

SEQ ID NO: 42097 - protein, 11 aa, Borrelia burgdorferi B31
IEQFGSIMEAL

SEQ ID NO: 42098 - protein, 11 aa, Borrelia burgdorferi B31
EQFGSIMEALY

SEQ ID NO: 42099 - protein, 11 aa, Borrelia burgdorferi B31
QFGSIMEALYN

SEQ ID NO: 42100 - protein, 11 aa, Borrelia burgdorferi B31
FGSIMEALYNE

SEQ ID NO: 42101 - protein, 11 aa, Borrelia burgdorferi B31
GSIMEALYNEN

SEQ ID NO: 42102 - protein, 11 aa, Borrelia burgdorferi B31
SIMEALYNENQ

SEQ ID NO: 42103 - protein, 11 aa, Borrelia burgdorferi B31
IMEALYNENQN

SEQ ID NO: 42104 - protein, 11 aa, Borrelia burgdorferi B31
MEALYNENQNH

SEQ ID NO: 42105 - protein, 11 aa, Borrelia burgdorferi B31
EALYNENQNHS

SEQ ID NO: 42106 - protein, 11 aa, Borrelia burgdorferi B31
ALYNENQNHSL

SEQ ID NO: 42107 - protein, 11 aa, Borrelia burgdorferi B31
LYNENQNHSLI

SEQ ID NO: 42108 - protein, 11 aa, Borrelia burgdorferi B31
YNENQNHSLIR

SEQ ID NO: 42109 - protein, 11 aa, Borrelia burgdorferi B31
NENQNHSLIRE

SEQ ID NO: 42110 - protein, 11 aa, Borrelia burgdorferi B31
ENQNHSLIREL

SEQ ID NO: 42111 - protein, 11 aa, Borrelia burgdorferi B31
NQNHSLIRELM

SEQ ID NO: 42112 - protein, 11 aa, Borrelia burgdorferi B31
QNHSLIRELMI

SEQ ID NO: 42113 - protein, 11 aa, Borrelia burgdorferi B31
NHSLIRELMIS

SEQ ID NO: 42114 - protein, 11 aa, Borrelia burgdorferi B31
HSLIRELMISG

SEQ ID NO: 42115 - protein, 11 aa, Borrelia burgdorferi B31
SLIRELMISGL

SEQ ID NO: 42116 - protein, 11 aa, Borrelia burgdorferi B31
LIRELMISGLG

SEQ ID NO: 42117 - protein, 11 aa, Borrelia burgdorferi B31
IRELMISGLGT

SEQ ID NO: 42118 - protein, 11 aa, Borrelia burgdorferi B31
RELMISGLGTQ

SEQ ID NO: 42119 - protein, 11 aa, Borrelia burgdorferi B31
ELMISGLGTQI

SEQ ID NO: 42120 - protein, 11 aa, Borrelia burgdorferi B31
LMISGLGTQIS

SEQ ID NO: 42121 - protein, 11 aa, Borrelia burgdorferi B31
MISGLGTQISF

SEQ ID NO: 42122 - protein, 11 aa, Borrelia burgdorferi B31
ISGLGTQISFE

SEQ ID NO: 42123 - protein, 11 aa, Borrelia burgdorferi B31
SGLGTQISFEL

SEQ ID NO: 42124 - protein, 11 aa, Borrelia burgdorferi B31
GLGTQISFELA

SEQ ID NO: 42125 - protein, 11 aa, Borrelia burgdorferi B31
LGTQISFELAL

SEQ ID NO: 42126 - protein, 11 aa, Borrelia burgdorferi B31
GTQISFELALE

SEQ ID NO: 42127 - protein, 11 aa, Borrelia burgdorferi B31
TQISFELALEE

SEQ ID NO: 42128 - protein, 11 aa, Borrelia burgdorferi B31
QISFELALEEI

SEQ ID NO: 42129 - protein, 11 aa, Borrelia burgdorferi B31
ISFELALEEIN

SEQ ID NO: 42130 - protein, 11 aa, Borrelia burgdorferi B31
SFELALEEINK

SEQ ID NO: 42131 - protein, 11 aa, Borrelia burgdorferi B31
FELALEEINKK

SEQ ID NO: 42132 - protein, 11 aa, Borrelia burgdorferi B31
ELALEEINKKI

SEQ ID NO: 42133 - protein, 11 aa, Borrelia burgdorferi B31
LALEEINKKIE

SEQ ID NO: 42134 - protein, 11 aa, Borrelia burgdorferi B31
ALEEINKKIEI

SEQ ID NO: 42135 - protein, 11 aa, Borrelia burgdorferi B31
LEEINKKIEIF

SEQ ID NO: 42136 - protein, 11 aa, Borrelia burgdorferi B31
EEINKKIEIFN

SEQ ID NO: 42137 - protein, 11 aa, Borrelia burgdorferi B31
EINKKIEIFNQ

SEQ ID NO: 42138 - protein, 11 aa, Borrelia burgdorferi B31
INKKIEIFNQD

SEQ ID NO: 42139 - protein, 11 aa, Borrelia burgdorferi B31
NKKIEIFNQDY

SEQ ID NO: 42140 - protein, 11 aa, Borrelia burgdorferi B31
KKIEIFNQDYL

SEQ ID NO: 42141 - protein, 11 aa, Borrelia burgdorferi B31
KIEIFNQDYLN

SEQ ID NO: 42142 - protein, 11 aa, Borrelia burgdorferi B31
IEIFNQDYLNA

SEQ ID NO: 42143 - protein, 11 aa, Borrelia burgdorferi B31
EIFNQDYLNAK

SEQ ID NO: 42144 - protein, 11 aa, Borrelia burgdorferi B31
IFNQDYLNAKI

SEQ ID NO: 42145 - protein, 11 aa, Borrelia burgdorferi B31
FNQDYLNAKIN

SEQ ID NO: 42146 - protein, 11 aa, Borrelia burgdorferi B31
NQDYLNAKINS

SEQ ID NO: 42147 - protein, 11 aa, Borrelia burgdorferi B31
QDYLNAKINSF

SEQ ID NO: 42148 - protein, 11 aa, Borrelia burgdorferi B31
DYLNAKINSFD

SEQ ID NO: 42149 - protein, 11 aa, Borrelia burgdorferi B31
YLNAKINSFDF

SEQ ID NO: 42150 - protein, 11 aa, Borrelia burgdorferi B31
LNAKINSFDFT

SEQ ID NO: 42151 - protein, 11 aa, Borrelia burgdorferi B31
NAKINSFDFTM

SEQ ID NO: 42152 - protein, 11 aa, Borrelia burgdorferi B31
AKINSFDFTMK

SEQ ID NO: 42153 - protein, 11 aa, Borrelia burgdorferi B31
KINSFDFTMKL

SEQ ID NO: 42154 - protein, 11 aa, Borrelia burgdorferi B31
INSFDFTMKLK

SEQ ID NO: 42155 - protein, 11 aa, Borrelia burgdorferi B31
NSFDFTMKLKE

SEQ ID NO: 42156 - protein, 11 aa, Borrelia burgdorferi B31
SFDFTMKLKEL

SEQ ID NO: 42157 - protein, 11 aa, Borrelia burgdorferi B31
FDFTMKLKELK

SEQ ID NO: 42158 - protein, 11 aa, Borrelia burgdorferi B31
DFTMKLKELKS

SEQ ID NO: 42159 - protein, 11 aa, Borrelia burgdorferi B31
FTMKLKELKSK

SEQ ID NO: 42160 - protein, 11 aa, Borrelia burgdorferi B31
TMKLKELKSKL

SEQ ID NO: 42161 - protein, 11 aa, Borrelia burgdorferi B31
MKLKELKSKLN

SEQ ID NO: 42162 - protein, 11 aa, Borrelia burgdorferi B31
KLKELKSKLNQ

SEQ ID NO: 42163 - protein, 11 aa, Borrelia burgdorferi B31
LKELKSKLNQI

SEQ ID NO: 42164 - protein, 11 aa, Borrelia burgdorferi B31
KELKSKLNQIL

SEQ ID NO: 42165 - protein, 11 aa, Borrelia burgdorferi B31
ELKSKLNQILD

SEQ ID NO: 42166 - protein, 11 aa, Borrelia burgdorferi B31
LKSKLNQILDK

SEQ ID NO: 42167 - protein, 11 aa, Borrelia burgdorferi B31
KSKLNQILDKR

SEQ ID NO: 42168 - protein, 11 aa, Borrelia burgdorferi B31
SKLNQILDKRK

SEQ ID NO: 42169 - protein, 11 aa, Borrelia burgdorferi B31
KLNQILDKRKE

SEQ ID NO: 42170 - protein, 11 aa, Borrelia burgdorferi B31
LNQILDKRKEW

SEQ ID NO: 42171 - protein, 11 aa, Borrelia burgdorferi B31
NQILDKRKEWS

SEQ ID NO: 42172 - protein, 11 aa, Borrelia burgdorferi B31
QILDKRKEWSR

SEQ ID NO: 42173 - protein, 11 aa, Borrelia burgdorferi B31
ILDKRKEWSRQ

SEQ ID NO: 42174 - protein, 11 aa, Borrelia burgdorferi B31
LDKRKEWSRQA

SEQ ID NO: 42175 - protein, 11 aa, Borrelia burgdorferi B31
DKRKEWSRQAD

SEQ ID NO: 42176 - protein, 11 aa, Borrelia burgdorferi B31
KRKEWSRQADG

SEQ ID NO: 42177 - protein, 11 aa, Borrelia burgdorferi B31
RKEWSRQADGL

SEQ ID NO: 42178 - protein, 11 aa, Borrelia burgdorferi B31
KEWSRQADGLI

SEQ ID NO: 42179 - protein, 11 aa, Borrelia burgdorferi B31
EWSRQADGLIA

SEQ ID NO: 42180 - protein, 11 aa, Borrelia burgdorferi B31
WSRQADGLIAN

SEQ ID NO: 42181 - protein, 11 aa, Borrelia burgdorferi B31
SRQADGLIANA

SEQ ID NO: 42182 - protein, 11 aa, Borrelia burgdorferi B31
RQADGLIANAS

SEQ ID NO: 42183 - protein, 11 aa, Borrelia burgdorferi B31
QADGLIANASS

SEQ ID NO: 42184 - protein, 11 aa, Borrelia burgdorferi B31
ADGLIANASSN

SEQ ID NO: 42185 - protein, 11 aa, Borrelia burgdorferi B31
DGLIANASSNS

SEQ ID NO: 42186 - protein, 11 aa, Borrelia burgdorferi B31
GLIANASSNSS

SEQ ID NO: 42187 - protein, 11 aa, Borrelia burgdorferi B31
LIANASSNSSL

SEQ ID NO: 42188 - protein, 11 aa, Borrelia burgdorferi B31
IANASSNSSLS

SEQ ID NO: 42189 - protein, 11 aa, Borrelia burgdorferi B31
ANASSNSSLSD

SEQ ID NO: 42190 - protein, 11 aa, Borrelia burgdorferi B31
NASSNSSLSDS

SEQ ID NO: 42191 - protein, 11 aa, Borrelia burgdorferi B31
ASSNSSLSDSK

SEQ ID NO: 42192 - protein, 11 aa, Borrelia burgdorferi B31
SSNSSLSDSKS

SEQ ID NO: 42193 - protein, 11 aa, Borrelia burgdorferi B31
SNSSLSDSKSL

SEQ ID NO: 42194 - protein, 11 aa, Borrelia burgdorferi B31
NSSLSDSKSLA

SEQ ID NO: 42195 - protein, 11 aa, Borrelia burgdorferi B31
SSLSDSKSLAE

SEQ ID NO: 42196 - protein, 11 aa, Borrelia burgdorferi B31
SLSDSKSLAEY

SEQ ID NO: 42197 - protein, 11 aa, Borrelia burgdorferi B31
LSDSKSLAEYI

SEQ ID NO: 42198 - protein, 11 aa, Borrelia burgdorferi B31
SDSKSLAEYIK

SEQ ID NO: 42199 - protein, 11 aa, Borrelia burgdorferi B31
DSKSLAEYIKK

SEQ ID NO: 42200 - protein, 11 aa, Borrelia burgdorferi B31
SKSLAEYIKKR

SEQ ID NO: 42201 - protein, 11 aa, Borrelia burgdorferi B31
KSLAEYIKKRY

SEQ ID NO: 42202 - protein, 11 aa, Borrelia burgdorferi B31
SLAEYIKKRYL

SEQ ID NO: 42203 - protein, 11 aa, Borrelia burgdorferi B31
LAEYIKKRYLD

SEQ ID NO: 42204 - protein, 11 aa, Borrelia burgdorferi B31
AEYIKKRYLDN

SEQ ID NO: 42205 - protein, 11 aa, Borrelia burgdorferi B31
EYIKKRYLDNM

SEQ ID NO: 42206 - protein, 11 aa, Borrelia burgdorferi B31
YIKKRYLDNMQ

SEQ ID NO: 42207 - protein, 11 aa, Borrelia burgdorferi B31
IKKRYLDNMQN

SEQ ID NO: 42208 - protein, 11 aa, Borrelia burgdorferi B31
KKRYLDNMQNA

SEQ ID NO: 42209 - protein, 11 aa, Borrelia burgdorferi B31
KRYLDNMQNAR

SEQ ID NO: 42210 - protein, 11 aa, Borrelia burgdorferi B31
RYLDNMQNARQ

SEQ ID NO: 42211 - protein, 11 aa, Borrelia burgdorferi B31
YLDNMQNARQS

SEQ ID NO: 42212 - protein, 11 aa, Borrelia burgdorferi B31
LDNMQNARQSV

SEQ ID NO: 42213 - protein, 11 aa, Borrelia burgdorferi B31
DNMQNARQSVL

SEQ ID NO: 42214 - protein, 11 aa, Borrelia burgdorferi B31
NMQNARQSVLE

SEQ ID NO: 42215 - protein, 11 aa, Borrelia burgdorferi B31
MQNARQSVLEA

SEQ ID NO: 42216 - protein, 11 aa, Borrelia burgdorferi B31
QNARQSVLEAY

SEQ ID NO: 42217 - protein, 11 aa, Borrelia burgdorferi B31
NARQSVLEAYI

SEQ ID NO: 42218 - protein, 11 aa, Borrelia burgdorferi B31
ARQSVLEAYIS

SEQ ID NO: 42219 - protein, 11 aa, Borrelia burgdorferi B31
RQSVLEAYISI

SEQ ID NO: 42220 - protein, 11 aa, Borrelia burgdorferi B31
QSVLEAYISIM

SEQ ID NO: 42221 - protein, 8 aa, Borrelia garinii PBi
MSSCTIDA

SEQ ID NO: 42222 - protein, 8 aa, Borrelia garinii PBi
SSCTIDAN

SEQ ID NO: 42223 - protein, 8 aa, Borrelia garinii PBi
SCTIDANL

SEQ ID NO: 42224 - protein, 8 aa, Borrelia garinii PBi
CTIDANLN

SEQ ID NO: 42225 - protein, 8 aa, Borrelia garinii PBi
TIDANLNK

SEQ ID NO: 42226 - protein, 8 aa, Borrelia garinii PBi
IDANLNKD

SEQ ID NO: 42227 - protein, 8 aa, Borrelia garinii PBi
DANLNKDY

SEQ ID NO: 42228 - protein, 8 aa, Borrelia garinii PBi
ANLNKDYK

SEQ ID NO: 42229 - protein, 8 aa, Borrelia garinii PBi
NLNKDYKN

SEQ ID NO: 42230 - protein, 8 aa, Borrelia garinii PBi
LNKDYKNK

SEQ ID NO: 42231 - protein, 8 aa, Borrelia garinii PBi
NKDYKNKV

SEQ ID NO: 42232 - protein, 8 aa, Borrelia garinii PBi
KDYKNKVE

SEQ ID NO: 42233 - protein, 8 aa, Borrelia garinii PBi
DYKNKVEE

SEQ ID NO: 42234 - protein, 8 aa, Borrelia garinii PBi
YKNKVEEL

SEQ ID NO: 42235 - protein, 8 aa, Borrelia garinii PBi
KNKVEELL

SEQ ID NO: 42236 - protein, 8 aa, Borrelia garinii PBi
NKVEELLN

SEQ ID NO: 42237 - protein, 8 aa, Borrelia garinii PBi
KVEELLNS

SEQ ID NO: 42238 - protein, 8 aa, Borrelia garinii PBi
VEELLNSS

SEQ ID NO: 42239 - protein, 8 aa, Borrelia garinii PBi
EELLNSST

SEQ ID NO: 42240 - protein, 8 aa, Borrelia garinii PBi
ELLNSSTD

SEQ ID NO: 42241 - protein, 8 aa, Borrelia garinii PBi
LLNSSTDD

SEQ ID NO: 42242 - protein, 8 aa, Borrelia garinii PBi
LNSSTDDQ

SEQ ID NO: 42243 - protein, 8 aa, Borrelia garinii PBi
NSSTDDQA

SEQ ID NO: 42244 - protein, 8 aa, Borrelia garinii PBi
SSTDDQAK

SEQ ID NO: 42245 - protein, 8 aa, Borrelia garinii PBi
STDDQAKI

SEQ ID NO: 42246 - protein, 8 aa, Borrelia garinii PBi
TDDQAKIS

SEQ ID NO: 42247 - protein, 8 aa, Borrelia garinii PBi
DDQAKISI

SEQ ID NO: 42248 - protein, 8 aa, Borrelia garinii PBi
DQAKISIN

SEQ ID NO: 42249 - protein, 8 aa, Borrelia garinii PBi
QAKISINT

SEQ ID NO: 42250 - protein, 8 aa, Borrelia garinii PBi
AKISINTG

SEQ ID NO: 42251 - protein, 8 aa, Borrelia garinii PBi
KISINTGS

SEQ ID NO: 42252 - protein, 8 aa, Borrelia garinii PBi
ISINTGSN

SEQ ID NO: 42253 - protein, 8 aa, Borrelia garinii PBi
SINTGSNA

SEQ ID NO: 42254 - protein, 8 aa, Borrelia garinii PBi
INTGSNAT

SEQ ID NO: 42255 - protein, 8 aa, Borrelia garinii PBi
NTGSNATK

SEQ ID NO: 42256 - protein, 8 aa, Borrelia garinii PBi
TGSNATKN

SEQ ID NO: 42257 - protein, 8 aa, Borrelia garinii PBi
GSNATKNK

SEQ ID NO: 42258 - protein, 8 aa, Borrelia garinii PBi
SNATKNKT

SEQ ID NO: 42259 - protein, 8 aa, Borrelia garinii PBi
NATKNKTN

SEQ ID NO: 42260 - protein, 8 aa, Borrelia garinii PBi
ATKNKTNI

SEQ ID NO: 42261 - protein, 8 aa, Borrelia garinii PBi
TKNKTNIK

SEQ ID NO: 42262 - protein, 8 aa, Borrelia garinii PBi
KNKTNIKV

SEQ ID NO: 42263 - protein, 8 aa, Borrelia garinii PBi
NKTNIKVA

SEQ ID NO: 42264 - protein, 8 aa, Borrelia garinii PBi
KTNIKVAG

SEQ ID NO: 42265 - protein, 8 aa, Borrelia garinii PBi
TNIKVAGL

SEQ ID NO: 42266 - protein, 8 aa, Borrelia garinii PBi
NIKVAGLQ

SEQ ID NO: 42267 - protein, 8 aa, Borrelia garinii PBi
IKVAGLQK

SEQ ID NO: 42268 - protein, 8 aa, Borrelia garinii PBi
KVAGLQKN

SEQ ID NO: 42269 - protein, 8 aa, Borrelia garinii PBi
VAGLQKNT

SEQ ID NO: 42270 - protein, 8 aa, Borrelia garinii PBi
AGLQKNTQ

SEQ ID NO: 42271 - protein, 8 aa, Borrelia garinii PBi
GLQKNTQS

SEQ ID NO: 42272 - protein, 8 aa, Borrelia garinii PBi
LQKNTQSK

SEQ ID NO: 42273 - protein, 8 aa, Borrelia garinii PBi
QKNTQSKK

SEQ ID NO: 42274 - protein, 8 aa, Borrelia garinii PBi
KNTQSKKN

SEQ ID NO: 42275 - protein, 8 aa, Borrelia garinii PBi
NTQSKKNN

SEQ ID NO: 42276 - protein, 8 aa, Borrelia garinii PBi
TQSKKNNN

SEQ ID NO: 42277 - protein, 8 aa, Borrelia garinii PBi
QSKKNNNL

SEQ ID NO: 42278 - protein, 8 aa, Borrelia garinii PBi
SKKNNNLQ

SEQ ID NO: 42279 - protein, 8 aa, Borrelia garinii PBi
KKNNNLQG

SEQ ID NO: 42280 - protein, 8 aa, Borrelia garinii PBi
KNNNLQGL

SEQ ID NO: 42281 - protein, 8 aa, Borrelia garinii PBi
NNNLQGLN

SEQ ID NO: 42282 - protein, 8 aa, Borrelia garinii PBi
NNLQGLNP

SEQ ID NO: 42283 - protein, 8 aa, Borrelia garinii PBi
NLQGLNPA

SEQ ID NO: 42284 - protein, 8 aa, Borrelia garinii PBi
LQGLNPAN

SEQ ID NO: 42285 - protein, 8 aa, Borrelia garinii PBi
QGLNPANQ

SEQ ID NO: 42286 - protein, 8 aa, Borrelia garinii PBi
GLNPANQV

SEQ ID NO: 42287 - protein, 8 aa, Borrelia garinii PBi
LNPANQVN

SEQ ID NO: 42288 - protein, 8 aa, Borrelia garinii PBi
NPANQVNP

SEQ ID NO: 42289 - protein, 8 aa, Borrelia garinii PBi
PANQVNPG

SEQ ID NO: 42290 - protein, 8 aa, Borrelia garinii PBi
ANQVNPGN

SEQ ID NO: 42291 - protein, 8 aa, Borrelia garinii PBi
NQVNPGNP

SEQ ID NO: 42292 - protein, 8 aa, Borrelia garinii PBi
QVNPGNPM

SEQ ID NO: 42293 - protein, 8 aa, Borrelia garinii PBi
VNPGNPMQ

SEQ ID NO: 42294 - protein, 8 aa, Borrelia garinii PBi
NPGNPMQI

SEQ ID NO: 42295 - protein, 8 aa, Borrelia garinii PBi
PGNPMQIA

SEQ ID NO: 42296 - protein, 8 aa, Borrelia garinii PBi
GNPMQIAN

SEQ ID NO: 42297 - protein, 8 aa, Borrelia garinii PBi
NPMQIANQ

SEQ ID NO: 42298 - protein, 8 aa, Borrelia garinii PBi
PMQIANQA

SEQ ID NO: 42299 - protein, 8 aa, Borrelia garinii PBi
MQIANQAN

SEQ ID NO: 42300 - protein, 8 aa, Borrelia garinii PBi
QIANQANQ

SEQ ID NO: 42301 - protein, 8 aa, Borrelia garinii PBi
IANQANQA

SEQ ID NO: 42302 - protein, 8 aa, Borrelia garinii PBi
ANQANQAN

SEQ ID NO: 42303 - protein, 8 aa, Borrelia garinii PBi
NQANQANQ

SEQ ID NO: 42304 - protein, 8 aa, Borrelia garinii PBi
QANQANQA

SEQ ID NO: 42305 - protein, 8 aa, Borrelia garinii PBi
ANQANQAN

SEQ ID NO: 42306 - protein, 8 aa, Borrelia garinii PBi
NQANQANQ

SEQ ID NO: 42307 - protein, 8 aa, Borrelia garinii PBi
QANQANQA

SEQ ID NO: 42308 - protein, 8 aa, Borrelia garinii PBi
ANQANQAN

SEQ ID NO: 42309 - protein, 8 aa, Borrelia garinii PBi
NQANQANQ

SEQ ID NO: 42310 - protein, 8 aa, Borrelia garinii PBi
QANQANQA

SEQ ID NO: 42311 - protein, 8 aa, Borrelia garinii PBi
ANQANQAN

SEQ ID NO: 42312 - protein, 8 aa, Borrelia garinii PBi
NQANQANQ

SEQ ID NO: 42313 - protein, 8 aa, Borrelia garinii PBi
QANQANQA

SEQ ID NO: 42314 - protein, 8 aa, Borrelia garinii PBi
ANQANQAS

SEQ ID NO: 42315 - protein, 8 aa, Borrelia garinii PBi
NQANQASQ

SEQ ID NO: 42316 - protein, 8 aa, Borrelia garinii PBi
QANQASQA

SEQ ID NO: 42317 - protein, 8 aa, Borrelia garinii PBi
ANQASQAS

SEQ ID NO: 42318 - protein, 8 aa, Borrelia garinii PBi
NQASQASQ

SEQ ID NO: 42319 - protein, 8 aa, Borrelia garinii PBi
QASQASQA

SEQ ID NO: 42320 - protein, 8 aa, Borrelia garinii PBi
ASQASQAS

SEQ ID NO: 42321 - protein, 8 aa, Borrelia garinii PBi
SQASQASQ

SEQ ID NO: 42322 - protein, 8 aa, Borrelia garinii PBi
QASQASQV

SEQ ID NO: 42323 - protein, 8 aa, Borrelia garinii PBi
ASQASQVA

SEQ ID NO: 42324 - protein, 8 aa, Borrelia garinii PBi
SQASQVAS

SEQ ID NO: 42325 - protein, 8 aa, Borrelia garinii PBi
QASQVASS

SEQ ID NO: 42326 - protein, 8 aa, Borrelia garinii PBi
ASQVASSA

SEQ ID NO: 42327 - protein, 8 aa, Borrelia garinii PBi
SQVASSAS

SEQ ID NO: 42328 - protein, 8 aa, Borrelia garinii PBi
QVASSASQ

SEQ ID NO: 42329 - protein, 8 aa, Borrelia garinii PBi
VASSASQA

SEQ ID NO: 42330 - protein, 8 aa, Borrelia garinii PBi
ASSASQAS

SEQ ID NO: 42331 - protein, 8 aa, Borrelia garinii PBi
SSASQASP

SEQ ID NO: 42332 - protein, 8 aa, Borrelia garinii PBi
SASQASPV

SEQ ID NO: 42333 - protein, 8 aa, Borrelia garinii PBi
ASQASPVA

SEQ ID NO: 42334 - protein, 8 aa, Borrelia garinii PBi
SQASPVAS

SEQ ID NO: 42335 - protein, 8 aa, Borrelia garinii PBi
QASPVASP

SEQ ID NO: 42336 - protein, 8 aa, Borrelia garinii PBi
ASPVASPA

SEQ ID NO: 42337 - protein, 8 aa, Borrelia garinii PBi
SPVASPAT

SEQ ID NO: 42338 - protein, 8 aa, Borrelia garinii PBi
PVASPATN

SEQ ID NO: 42339 - protein, 8 aa, Borrelia garinii PBi
VASPATNV

SEQ ID NO: 42340 - protein, 8 aa, Borrelia garinii PBi
ASPATNVQ

SEQ ID NO: 42341 - protein, 8 aa, Borrelia garinii PBi
SPATNVQA

SEQ ID NO: 42342 - protein, 8 aa, Borrelia garinii PBi
PATNVQAT

SEQ ID NO: 42343 - protein, 8 aa, Borrelia garinii PBi
ATNVQATP

SEQ ID NO: 42344 - protein, 8 aa, Borrelia garinii PBi
TNVQATPP

SEQ ID NO: 42345 - protein, 8 aa, Borrelia garinii PBi
NVQATPPK

SEQ ID NO: 42346 - protein, 8 aa, Borrelia garinii PBi
VQATPPKQ

SEQ ID NO: 42347 - protein, 8 aa, Borrelia garinii PBi
QATPPKQI

SEQ ID NO: 42348 - protein, 8 aa, Borrelia garinii PBi
ATPPKQIA

SEQ ID NO: 42349 - protein, 8 aa, Borrelia garinii PBi
TPPKQIAS

SEQ ID NO: 42350 - protein, 8 aa, Borrelia garinii PBi
PPKQIASA

SEQ ID NO: 42351 - protein, 8 aa, Borrelia garinii PBi
PKQIASAQ

SEQ ID NO: 42352 - protein, 8 aa, Borrelia garinii PBi
KQIASAQA

SEQ ID NO: 42353 - protein, 8 aa, Borrelia garinii PBi
QIASAQAI

SEQ ID NO: 42354 - protein, 8 aa, Borrelia garinii PBi
IASAQAIQ

SEQ ID NO: 42355 - protein, 8 aa, Borrelia garinii PBi
ASAQAIQT

SEQ ID NO: 42356 - protein, 8 aa, Borrelia garinii PBi
SAQAIQTV

SEQ ID NO: 42357 - protein, 8 aa, Borrelia garinii PBi
AQAIQTVP

SEQ ID NO: 42358 - protein, 8 aa, Borrelia garinii PBi
QAIQTVPN

SEQ ID NO: 42359 - protein, 8 aa, Borrelia garinii PBi
AIQTVPNN

SEQ ID NO: 42360 - protein, 8 aa, Borrelia garinii PBi
IQTVPNNT

SEQ ID NO: 42361 - protein, 8 aa, Borrelia garinii PBi
QTVPNNTS

SEQ ID NO: 42362 - protein, 8 aa, Borrelia garinii PBi
TVPNNTST

SEQ ID NO: 42363 - protein, 8 aa, Borrelia garinii PBi
VPNNTSTP

SEQ ID NO: 42364 - protein, 8 aa, Borrelia garinii PBi
PNNTSTPN

SEQ ID NO: 42365 - protein, 8 aa, Borrelia garinii PBi
NNTSTPNQ

SEQ ID NO: 42366 - protein, 8 aa, Borrelia garinii PBi
NTSTPNQS

SEQ ID NO: 42367 - protein, 8 aa, Borrelia garinii PBi
TSTPNQSI

SEQ ID NO: 42368 - protein, 8 aa, Borrelia garinii PBi
STPNQSII

SEQ ID NO: 42369 - protein, 8 aa, Borrelia garinii PBi
TPNQSIIK

SEQ ID NO: 42370 - protein, 8 aa, Borrelia garinii PBi
PNQSIIKP

SEQ ID NO: 42371 - protein, 8 aa, Borrelia garinii PBi
NQSIIKPQ

SEQ ID NO: 42372 - protein, 8 aa, Borrelia garinii PBi
QSIIKPQQ

SEQ ID NO: 42373 - protein, 8 aa, Borrelia garinii PBi
SIIKPQQY

SEQ ID NO: 42374 - protein, 8 aa, Borrelia garinii PBi
IIKPQQYT

SEQ ID NO: 42375 - protein, 8 aa, Borrelia garinii PBi
IKPQQYTF

SEQ ID NO: 42376 - protein, 8 aa, Borrelia garinii PBi
KPQQYTFS

SEQ ID NO: 42377 - protein, 8 aa, Borrelia garinii PBi
PQQYTFSS

SEQ ID NO: 42378 - protein, 8 aa, Borrelia garinii PBi
QQYTFSSS

SEQ ID NO: 42379 - protein, 8 aa, Borrelia garinii PBi
QYTFSSSF

SEQ ID NO: 42380 - protein, 8 aa, Borrelia garinii PBi
YTFSSSFS

SEQ ID NO: 42381 - protein, 8 aa, Borrelia garinii PBi
TFSSSFSQ

SEQ ID NO: 42382 - protein, 8 aa, Borrelia garinii PBi
FSSSFSQP

SEQ ID NO: 42383 - protein, 8 aa, Borrelia garinii PBi
SSSFSQPT

SEQ ID NO: 42384 - protein, 8 aa, Borrelia garinii PBi
SSFSQPTS

SEQ ID NO: 42385 - protein, 8 aa, Borrelia garinii PBi
SFSQPTSQ

SEQ ID NO: 42386 - protein, 8 aa, Borrelia garinii PBi
FSQPTSQT

SEQ ID NO: 42387 - protein, 8 aa, Borrelia garinii PBi
SQPTSQTN

SEQ ID NO: 42388 - protein, 8 aa, Borrelia garinii PBi
QPTSQTNF

SEQ ID NO: 42389 - protein, 8 aa, Borrelia garinii PBi
PTSQTNFN

SEQ ID NO: 42390 - protein, 8 aa, Borrelia garinii PBi
TSQTNFNN

SEQ ID NO: 42391 - protein, 8 aa, Borrelia garinii PBi
SQTNFNNS

SEQ ID NO: 42392 - protein, 8 aa, Borrelia garinii PBi
QTNFNNSQ

SEQ ID NO: 42393 - protein, 8 aa, Borrelia garinii PBi
TNFNNSQS

SEQ ID NO: 42394 - protein, 8 aa, Borrelia garinii PBi
NFNNSQSN

SEQ ID NO: 42395 - protein, 8 aa, Borrelia garinii PBi
FNNSQSNN

SEQ ID NO: 42396 - protein, 8 aa, Borrelia garinii PBi
NNSQSNNV

SEQ ID NO: 42397 - protein, 8 aa, Borrelia garinii PBi
NSQSNNVL

SEQ ID NO: 42398 - protein, 8 aa, Borrelia garinii PBi
SQSNNVLT

SEQ ID NO: 42399 - protein, 8 aa, Borrelia garinii PBi
QSNNVLTN

SEQ ID NO: 42400 - protein, 8 aa, Borrelia garinii PBi
SNNVLTNY

SEQ ID NO: 42401 - protein, 8 aa, Borrelia garinii PBi
NNVLTNYR

SEQ ID NO: 42402 - protein, 8 aa, Borrelia garinii PBi
NVLTNYRH

SEQ ID NO: 42403 - protein, 8 aa, Borrelia garinii PBi
VLTNYRHQ

SEQ ID NO: 42404 - protein, 8 aa, Borrelia garinii PBi
LTNYRHQT

SEQ ID NO: 42405 - protein, 8 aa, Borrelia garinii PBi
TNYRHQTQ

SEQ ID NO: 42406 - protein, 8 aa, Borrelia garinii PBi
NYRHQTQP

SEQ ID NO: 42407 - protein, 8 aa, Borrelia garinii PBi
YRHQTQPS

SEQ ID NO: 42408 - protein, 8 aa, Borrelia garinii PBi
RHQTQPSF

SEQ ID NO: 42409 - protein, 8 aa, Borrelia garinii PBi
HQTQPSFV

SEQ ID NO: 42410 - protein, 8 aa, Borrelia garinii PBi
QTQPSFVV

SEQ ID NO: 42411 - protein, 8 aa, Borrelia garinii PBi
TQPSFVVP

SEQ ID NO: 42412 - protein, 8 aa, Borrelia garinii PBi
QPSFVVPV

SEQ ID NO: 42413 - protein, 8 aa, Borrelia garinii PBi
PSFVVPVY

SEQ ID NO: 42414 - protein, 8 aa, Borrelia garinii PBi
SFVVPVYS

SEQ ID NO: 42415 - protein, 8 aa, Borrelia garinii PBi
FVVPVYSG

SEQ ID NO: 42416 - protein, 8 aa, Borrelia garinii PBi
VVPVYSGN

SEQ ID NO: 42417 - protein, 8 aa, Borrelia garinii PBi
VPVYSGNS

SEQ ID NO: 42418 - protein, 8 aa, Borrelia garinii PBi
PVYSGNSP

SEQ ID NO: 42419 - protein, 8 aa, Borrelia garinii PBi
VYSGNSPL

SEQ ID NO: 42420 - protein, 8 aa, Borrelia garinii PBi
YSGNSPLQ

SEQ ID NO: 42421 - protein, 8 aa, Borrelia garinii PBi
SGNSPLQK

SEQ ID NO: 42422 - protein, 8 aa, Borrelia garinii PBi
GNSPLQKL

SEQ ID NO: 42423 - protein, 8 aa, Borrelia garinii PBi
NSPLQKLK

SEQ ID NO: 42424 - protein, 8 aa, Borrelia garinii PBi
SPLQKLKN

SEQ ID NO: 42425 - protein, 8 aa, Borrelia garinii PBi
PLQKLKNN

SEQ ID NO: 42426 - protein, 8 aa, Borrelia garinii PBi
LQKLKNNL

SEQ ID NO: 42427 - protein, 8 aa, Borrelia garinii PBi
QKLKNNLL

SEQ ID NO: 42428 - protein, 8 aa, Borrelia garinii PBi
KLKNNLLR

SEQ ID NO: 42429 - protein, 8 aa, Borrelia garinii PBi
LKNNLLRR

SEQ ID NO: 42430 - protein, 8 aa, Borrelia garinii PBi
KNNLLRRI

SEQ ID NO: 42431 - protein, 8 aa, Borrelia garinii PBi
NNLLRRIA

SEQ ID NO: 42432 - protein, 8 aa, Borrelia garinii PBi
NLLRRIAE

SEQ ID NO: 42433 - protein, 8 aa, Borrelia garinii PBi
LLRRIAEE

SEQ ID NO: 42434 - protein, 8 aa, Borrelia garinii PBi
LRRIAEEK

SEQ ID NO: 42435 - protein, 8 aa, Borrelia garinii PBi
RRIAEEKN

SEQ ID NO: 42436 - protein, 8 aa, Borrelia garinii PBi
RIAEEKNK

SEQ ID NO: 42437 - protein, 8 aa, Borrelia garinii PBi
IAEEKNKT

SEQ ID NO: 42438 - protein, 8 aa, Borrelia garinii PBi
AEEKNKTH

SEQ ID NO: 42439 - protein, 8 aa, Borrelia garinii PBi
EEKNKTHN

SEQ ID NO: 42440 - protein, 8 aa, Borrelia garinii PBi
EKNKTHNH

SEQ ID NO: 42441 - protein, 8 aa, Borrelia garinii PBi
KNKTHNHG

SEQ ID NO: 42442 - protein, 8 aa, Borrelia garinii PBi
NKTHNHGF

SEQ ID NO: 42443 - protein, 8 aa, Borrelia garinii PBi
KTHNHGFR

SEQ ID NO: 42444 - protein, 8 aa, Borrelia garinii PBi
THNHGFRE

SEQ ID NO: 42445 - protein, 8 aa, Borrelia garinii PBi
HNHGFRET

SEQ ID NO: 42446 - protein, 8 aa, Borrelia garinii PBi
NHGFRETY

SEQ ID NO: 42447 - protein, 8 aa, Borrelia garinii PBi
HGFRETYD

SEQ ID NO: 42448 - protein, 8 aa, Borrelia garinii PBi
GFRETYDQ

SEQ ID NO: 42449 - protein, 8 aa, Borrelia garinii PBi
FRETYDQF

SEQ ID NO: 42450 - protein, 8 aa, Borrelia garinii PBi
RETYDQFK

SEQ ID NO: 42451 - protein, 8 aa, Borrelia garinii PBi
ETYDQFKM

SEQ ID NO: 42452 - protein, 8 aa, Borrelia garinii PBi
TYDQFKMK

SEQ ID NO: 42453 - protein, 8 aa, Borrelia garinii PBi
YDQFKMKD

SEQ ID NO: 42454 - protein, 8 aa, Borrelia garinii PBi
DQFKMKDS

SEQ ID NO: 42455 - protein, 8 aa, Borrelia garinii PBi
QFKMKDSA

SEQ ID NO: 42456 - protein, 8 aa, Borrelia garinii PBi
FKMKDSAF

SEQ ID NO: 42457 - protein, 8 aa, Borrelia garinii PBi
KMKDSAFT

SEQ ID NO: 42458 - protein, 8 aa, Borrelia garinii PBi
MKDSAFTL

SEQ ID NO: 42459 - protein, 8 aa, Borrelia garinii PBi
KDSAFTLL

SEQ ID NO: 42460 - protein, 8 aa, Borrelia garinii PBi
DSAFTLLD

SEQ ID NO: 42461 - protein, 8 aa, Borrelia garinii PBi
SAFTLLDV

SEQ ID NO: 42462 - protein, 8 aa, Borrelia garinii PBi
AFTLLDVI

SEQ ID NO: 42463 - protein, 8 aa, Borrelia garinii PBi
FTLLDVIS

SEQ ID NO: 42464 - protein, 8 aa, Borrelia garinii PBi
TLLDVISN

SEQ ID NO: 42465 - protein, 8 aa, Borrelia garinii PBi
LLDVISNI

SEQ ID NO: 42466 - protein, 8 aa, Borrelia garinii PBi
LDVISNIS

SEQ ID NO: 42467 - protein, 8 aa, Borrelia garinii PBi
DVISNISV

SEQ ID NO: 42468 - protein, 8 aa, Borrelia garinii PBi
VISNISVF

SEQ ID NO: 42469 - protein, 8 aa, Borrelia garinii PBi
ISNISVFD

SEQ ID NO: 42470 - protein, 8 aa, Borrelia garinii PBi
SNISVFDR

SEQ ID NO: 42471 - protein, 8 aa, Borrelia garinii PBi
NISVFDRG

SEQ ID NO: 42472 - protein, 8 aa, Borrelia garinii PBi
ISVFDRGS

SEQ ID NO: 42473 - protein, 8 aa, Borrelia garinii PBi
SVFDRGSA

SEQ ID NO: 42474 - protein, 8 aa, Borrelia garinii PBi
VFDRGSAP

SEQ ID NO: 42475 - protein, 8 aa, Borrelia garinii PBi
FDRGSAPQ

SEQ ID NO: 42476 - protein, 8 aa, Borrelia garinii PBi
DRGSAPQL

SEQ ID NO: 42477 - protein, 8 aa, Borrelia garinii PBi
RGSAPQLS

SEQ ID NO: 42478 - protein, 8 aa, Borrelia garinii PBi
GSAPQLSS

SEQ ID NO: 42479 - protein, 8 aa, Borrelia garinii PBi
SAPQLSSN

SEQ ID NO: 42480 - protein, 8 aa, Borrelia garinii PBi
APQLSSNT

SEQ ID NO: 42481 - protein, 8 aa, Borrelia garinii PBi
PQLSSNTP

SEQ ID NO: 42482 - protein, 8 aa, Borrelia garinii PBi
QLSSNTPE

SEQ ID NO: 42483 - protein, 8 aa, Borrelia garinii PBi
LSSNTPEA

SEQ ID NO: 42484 - protein, 8 aa, Borrelia garinii PBi
SSNTPEAE

SEQ ID NO: 42485 - protein, 8 aa, Borrelia garinii PBi
SNTPEAES

SEQ ID NO: 42486 - protein, 8 aa, Borrelia garinii PBi
NTPEAESE

SEQ ID NO: 42487 - protein, 8 aa, Borrelia garinii PBi
TPEAESER

SEQ ID NO: 42488 - protein, 8 aa, Borrelia garinii PBi
PEAESERN

SEQ ID NO: 42489 - protein, 8 aa, Borrelia garinii PBi
EAESERNR

SEQ ID NO: 42490 - protein, 8 aa, Borrelia garinii PBi
AESERNRL

SEQ ID NO: 42491 - protein, 8 aa, Borrelia garinii PBi
ESERNRLY

SEQ ID NO: 42492 - protein, 8 aa, Borrelia garinii PBi
SERNRLYA

SEQ ID NO: 42493 - protein, 8 aa, Borrelia garinii PBi
ERNRLYAM

SEQ ID NO: 42494 - protein, 8 aa, Borrelia garinii PBi
RNRLYAMM

SEQ ID NO: 42495 - protein, 8 aa, Borrelia garinii PBi
NRLYAMMD

SEQ ID NO: 42496 - protein, 8 aa, Borrelia garinii PBi
RLYAMMDF

SEQ ID NO: 42497 - protein, 8 aa, Borrelia garinii PBi
LYAMMDFD

SEQ ID NO: 42498 - protein, 8 aa, Borrelia garinii PBi
YAMMDFDQ

SEQ ID NO: 42499 - protein, 8 aa, Borrelia garinii PBi
AMMDFDQA

SEQ ID NO: 42500 - protein, 8 aa, Borrelia garinii PBi
MMDFDQAK

SEQ ID NO: 42501 - protein, 8 aa, Borrelia garinii PBi
MDFDQAKT

SEQ ID NO: 42502 - protein, 8 aa, Borrelia garinii PBi
DFDQAKTT

SEQ ID NO: 42503 - protein, 8 aa, Borrelia garinii PBi
FDQAKTTE

SEQ ID NO: 42504 - protein, 8 aa, Borrelia garinii PBi
DQAKTTEF

SEQ ID NO: 42505 - protein, 8 aa, Borrelia garinii PBi
QAKTTEFG

SEQ ID NO: 42506 - protein, 8 aa, Borrelia garinii PBi
AKTTEFGS

SEQ ID NO: 42507 - protein, 8 aa, Borrelia garinii PBi
KTTEFGSI

SEQ ID NO: 42508 - protein, 8 aa, Borrelia garinii PBi
TTEFGSIM

SEQ ID NO: 42509 - protein, 8 aa, Borrelia garinii PBi
TEFGSIMN

SEQ ID NO: 42510 - protein, 8 aa, Borrelia garinii PBi
EFGSIMNI

SEQ ID NO: 42511 - protein, 8 aa, Borrelia garinii PBi
FGSIMNIL

SEQ ID NO: 42512 - protein, 8 aa, Borrelia garinii PBi
GSIMNILY

SEQ ID NO: 42513 - protein, 8 aa, Borrelia garinii PBi
SIMNILYQ

SEQ ID NO: 42514 - protein, 8 aa, Borrelia garinii PBi
IMNILYQE

SEQ ID NO: 42515 - protein, 8 aa, Borrelia garinii PBi
MNILYQEN

SEQ ID NO: 42516 - protein, 8 aa, Borrelia garinii PBi
NILYQENQ

SEQ ID NO: 42517 - protein, 8 aa, Borrelia garinii PBi
ILYQENQN

SEQ ID NO: 42518 - protein, 8 aa, Borrelia garinii PBi
LYQENQNH

SEQ ID NO: 42519 - protein, 8 aa, Borrelia garinii PBi
YQENQNHS

SEQ ID NO: 42520 - protein, 8 aa, Borrelia garinii PBi
QENQNHSL

SEQ ID NO: 42521 - protein, 8 aa, Borrelia garinii PBi
ENQNHSLI

SEQ ID NO: 42522 - protein, 8 aa, Borrelia garinii PBi
NQNHSLIR

SEQ ID NO: 42523 - protein, 8 aa, Borrelia garinii PBi
QNHSLIRS

SEQ ID NO: 42524 - protein, 8 aa, Borrelia garinii PBi
NHSLIRSL

SEQ ID NO: 42525 - protein, 8 aa, Borrelia garinii PBi
HSLIRSLI

SEQ ID NO: 42526 - protein, 8 aa, Borrelia garinii PBi
SLIRSLII

SEQ ID NO: 42527 - protein, 8 aa, Borrelia garinii PBi
LIRSLIIS

SEQ ID NO: 42528 - protein, 8 aa, Borrelia garinii PBi
IRSLIISG

SEQ ID NO: 42529 - protein, 8 aa, Borrelia garinii PBi
RSLIISGL

SEQ ID NO: 42530 - protein, 8 aa, Borrelia garinii PBi
SLIISGLG

SEQ ID NO: 42531 - protein, 8 aa, Borrelia garinii PBi
LIISGLGI

SEQ ID NO: 42532 - protein, 8 aa, Borrelia garinii PBi
IISGLGIQ

SEQ ID NO: 42533 - protein, 8 aa, Borrelia garinii PBi
ISGLGIQI

SEQ ID NO: 42534 - protein, 8 aa, Borrelia garinii PBi
SGLGIQIS

SEQ ID NO: 42535 - protein, 8 aa, Borrelia garinii PBi
GLGIQISL

SEQ ID NO: 42536 - protein, 8 aa, Borrelia garinii PBi
LGIQISLE

SEQ ID NO: 42537 - protein, 8 aa, Borrelia garinii PBi
GIQISLES

SEQ ID NO: 42538 - protein, 8 aa, Borrelia garinii PBi
IQISLEST

SEQ ID NO: 42539 - protein, 8 aa, Borrelia garinii PBi
QISLESTL

SEQ ID NO: 42540 - protein, 8 aa, Borrelia garinii PBi
ISLESTLE

SEQ ID NO: 42541 - protein, 8 aa, Borrelia garinii PBi
SLESTLEE

SEQ ID NO: 42542 - protein, 8 aa, Borrelia garinii PBi
LESTLEEI

SEQ ID NO: 42543 - protein, 8 aa, Borrelia garinii PBi
ESTLEEIE

SEQ ID NO: 42544 - protein, 8 aa, Borrelia garinii PBi
STLEEIEK

SEQ ID NO: 42545 - protein, 8 aa, Borrelia garinii PBi
TLEEIEKK

SEQ ID NO: 42546 - protein, 8 aa, Borrelia garinii PBi
LEEIEKKI

SEQ ID NO: 42547 - protein, 8 aa, Borrelia garinii PBi
EEIEKKIE

SEQ ID NO: 42548 - protein, 8 aa, Borrelia garinii PBi
EIEKKIES

SEQ ID NO: 42549 - protein, 8 aa, Borrelia garinii PBi
IEKKIESF

SEQ ID NO: 42550 - protein, 8 aa, Borrelia garinii PBi
EKKIESFN

SEQ ID NO: 42551 - protein, 8 aa, Borrelia garinii PBi
KKIESFNT

SEQ ID NO: 42552 - protein, 8 aa, Borrelia garinii PBi
KIESFNTQ

SEQ ID NO: 42553 - protein, 8 aa, Borrelia garinii PBi
IESFNTQY

SEQ ID NO: 42554 - protein, 8 aa, Borrelia garinii PBi
ESFNTQYL

SEQ ID NO: 42555 - protein, 8 aa, Borrelia garinii PBi
SFNTQYLN

SEQ ID NO: 42556 - protein, 8 aa, Borrelia garinii PBi
FNTQYLNT

SEQ ID NO: 42557 - protein, 8 aa, Borrelia garinii PBi
NTQYLNTI

SEQ ID NO: 42558 - protein, 8 aa, Borrelia garinii PBi
TQYLNTII

SEQ ID NO: 42559 - protein, 8 aa, Borrelia garinii PBi
QYLNTIIN

SEQ ID NO: 42560 - protein, 8 aa, Borrelia garinii PBi
YLNTIINS

SEQ ID NO: 42561 - protein, 8 aa, Borrelia garinii PBi
LNTIINSY

SEQ ID NO: 42562 - protein, 8 aa, Borrelia garinii PBi
NTIINSYT

SEQ ID NO: 42563 - protein, 8 aa, Borrelia garinii PBi
TIINSYTF

SEQ ID NO: 42564 - protein, 8 aa, Borrelia garinii PBi
IINSYTFK

SEQ ID NO: 42565 - protein, 8 aa, Borrelia garinii PBi
INSYTFKD

SEQ ID NO: 42566 - protein, 8 aa, Borrelia garinii PBi
NSYTFKDK

SEQ ID NO: 42567 - protein, 8 aa, Borrelia garinii PBi
SYTFKDKL

SEQ ID NO: 42568 - protein, 8 aa, Borrelia garinii PBi
YTFKDKLK

SEQ ID NO: 42569 - protein, 8 aa, Borrelia garinii PBi
TFKDKLKE

SEQ ID NO: 42570 - protein, 8 aa, Borrelia garinii PBi
FKDKLKEL

SEQ ID NO: 42571 - protein, 8 aa, Borrelia garinii PBi
KDKLKELE

SEQ ID NO: 42572 - protein, 8 aa, Borrelia garinii PBi
DKLKELES

SEQ ID NO: 42573 - protein, 8 aa, Borrelia garinii PBi
KLKELESK

SEQ ID NO: 42574 - protein, 8 aa, Borrelia garinii PBi
LKELESKL

SEQ ID NO: 42575 - protein, 8 aa, Borrelia garinii PBi
KELESKLN

SEQ ID NO: 42576 - protein, 8 aa, Borrelia garinii PBi
ELESKLNS

SEQ ID NO: 42577 - protein, 8 aa, Borrelia garinii PBi
LESKLNSI

SEQ ID NO: 42578 - protein, 8 aa, Borrelia garinii PBi
ESKLNSIL

SEQ ID NO: 42579 - protein, 8 aa, Borrelia garinii PBi
SKLNSILA

SEQ ID NO: 42580 - protein, 8 aa, Borrelia garinii PBi
KLNSILAE

SEQ ID NO: 42581 - protein, 8 aa, Borrelia garinii PBi
LNSILAEK

SEQ ID NO: 42582 - protein, 8 aa, Borrelia garinii PBi
NSILAEKK

SEQ ID NO: 42583 - protein, 8 aa, Borrelia garinii PBi
SILAEKKE

SEQ ID NO: 42584 - protein, 8 aa, Borrelia garinii PBi
ILAEKKEW

SEQ ID NO: 42585 - protein, 8 aa, Borrelia garinii PBi
LAEKKEWL

SEQ ID NO: 42586 - protein, 8 aa, Borrelia garinii PBi
AEKKEWLN

SEQ ID NO: 42587 - protein, 8 aa, Borrelia garinii PBi
EKKEWLNY

SEQ ID NO: 42588 - protein, 8 aa, Borrelia garinii PBi
KKEWLNYA

SEQ ID NO: 42589 - protein, 8 aa, Borrelia garinii PBi
KEWLNYAD

SEQ ID NO: 42590 - protein, 8 aa, Borrelia garinii PBi
EWLNYADA

SEQ ID NO: 42591 - protein, 8 aa, Borrelia garinii PBi
WLNYADAI

SEQ ID NO: 42592 - protein, 8 aa, Borrelia garinii PBi
LNYADAII

SEQ ID NO: 42593 - protein, 8 aa, Borrelia garinii PBi
NYADAIIT

SEQ ID NO: 42594 - protein, 8 aa, Borrelia garinii PBi
YADAIITN

SEQ ID NO: 42595 - protein, 8 aa, Borrelia garinii PBi
ADAIITNT

SEQ ID NO: 42596 - protein, 8 aa, Borrelia garinii PBi
DAIITNTS

SEQ ID NO: 42597 - protein, 8 aa, Borrelia garinii PBi
AIITNTSS

SEQ ID NO: 42598 - protein, 8 aa, Borrelia garinii PBi
IITNTSSN

SEQ ID NO: 42599 - protein, 8 aa, Borrelia garinii PBi
ITNTSSNS

SEQ ID NO: 42600 - protein, 8 aa, Borrelia garinii PBi
TNTSSNSK

SEQ ID NO: 42601 - protein, 8 aa, Borrelia garinii PBi
NTSSNSKR

SEQ ID NO: 42602 - protein, 8 aa, Borrelia garinii PBi
TSSNSKRN

SEQ ID NO: 42603 - protein, 8 aa, Borrelia garinii PBi
SSNSKRND

SEQ ID NO: 42604 - protein, 8 aa, Borrelia garinii PBi
SNSKRNDP

SEQ ID NO: 42605 - protein, 8 aa, Borrelia garinii PBi
NSKRNDPQ

SEQ ID NO: 42606 - protein, 8 aa, Borrelia garinii PBi
SKRNDPQS

SEQ ID NO: 42607 - protein, 8 aa, Borrelia garinii PBi
KRNDPQSL

SEQ ID NO: 42608 - protein, 8 aa, Borrelia garinii PBi
RNDPQSLG

SEQ ID NO: 42609 - protein, 8 aa, Borrelia garinii PBi
NDPQSLGQ

SEQ ID NO: 42610 - protein, 8 aa, Borrelia garinii PBi
DPQSLGQY

SEQ ID NO: 42611 - protein, 8 aa, Borrelia garinii PBi
PQSLGQYI

SEQ ID NO: 42612 - protein, 8 aa, Borrelia garinii PBi
QSLGQYIK

SEQ ID NO: 42613 - protein, 8 aa, Borrelia garinii PBi
SLGQYIKN

SEQ ID NO: 42614 - protein, 8 aa, Borrelia garinii PBi
LGQYIKNK

SEQ ID NO: 42615 - protein, 8 aa, Borrelia garinii PBi
GQYIKNKY

SEQ ID NO: 42616 - protein, 8 aa, Borrelia garinii PBi
QYIKNKYL

SEQ ID NO: 42617 - protein, 8 aa, Borrelia garinii PBi
YIKNKYLD

SEQ ID NO: 42618 - protein, 8 aa, Borrelia garinii PBi
IKNKYLDK

SEQ ID NO: 42619 - protein, 8 aa, Borrelia garinii PBi
KNKYLDKM

SEQ ID NO: 42620 - protein, 8 aa, Borrelia garinii PBi
NKYLDKMQ

SEQ ID NO: 42621 - protein, 8 aa, Borrelia garinii PBi
KYLDKMQD

SEQ ID NO: 42622 - protein, 8 aa, Borrelia garinii PBi
YLDKMQDA

SEQ ID NO: 42623 - protein, 8 aa, Borrelia garinii PBi
LDKMQDAR

SEQ ID NO: 42624 - protein, 8 aa, Borrelia garinii PBi
DKMQDARQ

SEQ ID NO: 42625 - protein, 8 aa, Borrelia garinii PBi
KMQDARQS

SEQ ID NO: 42626 - protein, 8 aa, Borrelia garinii PBi
MQDARQSA

SEQ ID NO: 42627 - protein, 8 aa, Borrelia garinii PBi
QDARQSAL

SEQ ID NO: 42628 - protein, 8 aa, Borrelia garinii PBi
DARQSALD

SEQ ID NO: 42629 - protein, 8 aa, Borrelia garinii PBi
ARQSALDL

SEQ ID NO: 42630 - protein, 8 aa, Borrelia garinii PBi
RQSALDLY

SEQ ID NO: 42631 - protein, 8 aa, Borrelia garinii PBi
QSALDLYL

SEQ ID NO: 42632 - protein, 8 aa, Borrelia garinii PBi
SALDLYLN

SEQ ID NO: 42633 - protein, 8 aa, Borrelia garinii PBi
ALDLYLNI

SEQ ID NO: 42634 - protein, 8 aa, Borrelia garinii PBi
LDLYLNIT

SEQ ID NO: 42635 - protein, 8 aa, Borrelia garinii PBi
DLYLNITE

SEQ ID NO: 42636 - protein, 8 aa, Borrelia garinii PBi
LYLNITEI

SEQ ID NO: 42637 - protein, 9 aa, Borrelia garinii PBi
MSSCTIDAN

SEQ ID NO: 42638 - protein, 9 aa, Borrelia garinii PBi
SSCTIDANL

SEQ ID NO: 42639 - protein, 9 aa, Borrelia garinii PBi
SCTIDANLN

SEQ ID NO: 42640 - protein, 9 aa, Borrelia garinii PBi
CTIDANLNK

SEQ ID NO: 42641 - protein, 9 aa, Borrelia garinii PBi
TIDANLNKD

SEQ ID NO: 42642 - protein, 9 aa, Borrelia garinii PBi
IDANLNKDY

SEQ ID NO: 42643 - protein, 9 aa, Borrelia garinii PBi
DANLNKDYK

SEQ ID NO: 42644 - protein, 9 aa, Borrelia garinii PBi
ANLNKDYKN

SEQ ID NO: 42645 - protein, 9 aa, Borrelia garinii PBi
NLNKDYKNK

SEQ ID NO: 42646 - protein, 9 aa, Borrelia garinii PBi
LNKDYKNKV

SEQ ID NO: 42647 - protein, 9 aa, Borrelia garinii PBi
NKDYKNKVE

SEQ ID NO: 42648 - protein, 9 aa, Borrelia garinii PBi
KDYKNKVEE

SEQ ID NO: 42649 - protein, 9 aa, Borrelia garinii PBi
DYKNKVEEL

SEQ ID NO: 42650 - protein, 9 aa, Borrelia garinii PBi
YKNKVEELL

SEQ ID NO: 42651 - protein, 9 aa, Borrelia garinii PBi
KNKVEELLN

SEQ ID NO: 42652 - protein, 9 aa, Borrelia garinii PBi
NKVEELLNS

SEQ ID NO: 42653 - protein, 9 aa, Borrelia garinii PBi
KVEELLNSS

SEQ ID NO: 42654 - protein, 9 aa, Borrelia garinii PBi
VEELLNSST

SEQ ID NO: 42655 - protein, 9 aa, Borrelia garinii PBi
EELLNSSTD

SEQ ID NO: 42656 - protein, 9 aa, Borrelia garinii PBi
ELLNSSTDD

SEQ ID NO: 42657 - protein, 9 aa, Borrelia garinii PBi
LLNSSTDDQ

SEQ ID NO: 42658 - protein, 9 aa, Borrelia garinii PBi
LNSSTDDQA

SEQ ID NO: 42659 - protein, 9 aa, Borrelia garinii PBi
NSSTDDQAK

SEQ ID NO: 42660 - protein, 9 aa, Borrelia garinii PBi
SSTDDQAKI

SEQ ID NO: 42661 - protein, 9 aa, Borrelia garinii PBi
STDDQAKIS

SEQ ID NO: 42662 - protein, 9 aa, Borrelia garinii PBi
TDDQAKISI

SEQ ID NO: 42663 - protein, 9 aa, Borrelia garinii PBi
DDQAKISIN

SEQ ID NO: 42664 - protein, 9 aa, Borrelia garinii PBi
DQAKISINT

SEQ ID NO: 42665 - protein, 9 aa, Borrelia garinii PBi
QAKISINTG

SEQ ID NO: 42666 - protein, 9 aa, Borrelia garinii PBi
AKISINTGS

SEQ ID NO: 42667 - protein, 9 aa, Borrelia garinii PBi
KISINTGSN

SEQ ID NO: 42668 - protein, 9 aa, Borrelia garinii PBi
ISINTGSNA

SEQ ID NO: 42669 - protein, 9 aa, Borrelia garinii PBi
SINTGSNAT

SEQ ID NO: 42670 - protein, 9 aa, Borrelia garinii PBi
INTGSNATK

SEQ ID NO: 42671 - protein, 9 aa, Borrelia garinii PBi
NTGSNATKN

SEQ ID NO: 42672 - protein, 9 aa, Borrelia garinii PBi
TGSNATKNK

SEQ ID NO: 42673 - protein, 9 aa, Borrelia garinii PBi
GSNATKNKT

SEQ ID NO: 42674 - protein, 9 aa, Borrelia garinii PBi
SNATKNKTN

SEQ ID NO: 42675 - protein, 9 aa, Borrelia garinii PBi
NATKNKTNI

SEQ ID NO: 42676 - protein, 9 aa, Borrelia garinii PBi
ATKNKTNIK

SEQ ID NO: 42677 - protein, 9 aa, Borrelia garinii PBi
TKNKTNIKV

SEQ ID NO: 42678 - protein, 9 aa, Borrelia garinii PBi
KNKTNIKVA

SEQ ID NO: 42679 - protein, 9 aa, Borrelia garinii PBi
NKTNIKVAG

SEQ ID NO: 42680 - protein, 9 aa, Borrelia garinii PBi
KTNIKVAGL

SEQ ID NO: 42681 - protein, 9 aa, Borrelia garinii PBi
TNIKVAGLQ

SEQ ID NO: 42682 - protein, 9 aa, Borrelia garinii PBi
NIKVAGLQK

SEQ ID NO: 42683 - protein, 9 aa, Borrelia garinii PBi
IKVAGLQKN

SEQ ID NO: 42684 - protein, 9 aa, Borrelia garinii PBi
KVAGLQKNT

SEQ ID NO: 42685 - protein, 9 aa, Borrelia garinii PBi
VAGLQKNTQ

SEQ ID NO: 42686 - protein, 9 aa, Borrelia garinii PBi
AGLQKNTQS

SEQ ID NO: 42687 - protein, 9 aa, Borrelia garinii PBi
GLQKNTQSK

SEQ ID NO: 42688 - protein, 9 aa, Borrelia garinii PBi
LQKNTQSKK

SEQ ID NO: 42689 - protein, 9 aa, Borrelia garinii PBi
QKNTQSKKN

SEQ ID NO: 42690 - protein, 9 aa, Borrelia garinii PBi
KNTQSKKNN

SEQ ID NO: 42691 - protein, 9 aa, Borrelia garinii PBi
NTQSKKNNN

SEQ ID NO: 42692 - protein, 9 aa, Borrelia garinii PBi
TQSKKNNNL

SEQ ID NO: 42693 - protein, 9 aa, Borrelia garinii PBi
QSKKNNNLQ

SEQ ID NO: 42694 - protein, 9 aa, Borrelia garinii PBi
SKKNNNLQG

SEQ ID NO: 42695 - protein, 9 aa, Borrelia garinii PBi
KKNNNLQGL

SEQ ID NO: 42696 - protein, 9 aa, Borrelia garinii PBi
KNNNLQGLN

SEQ ID NO: 42697 - protein, 9 aa, Borrelia garinii PBi
NNNLQGLNP

SEQ ID NO: 42698 - protein, 9 aa, Borrelia garinii PBi
NNLQGLNPA

SEQ ID NO: 42699 - protein, 9 aa, Borrelia garinii PBi
NLQGLNPAN

SEQ ID NO: 42700 - protein, 9 aa, Borrelia garinii PBi
LQGLNPANQ

SEQ ID NO: 42701 - protein, 9 aa, Borrelia garinii PBi
QGLNPANQV

SEQ ID NO: 42702 - protein, 9 aa, Borrelia garinii PBi
GLNPANQVN

SEQ ID NO: 42703 - protein, 9 aa, Borrelia garinii PBi
LNPANQVNP

SEQ ID NO: 42704 - protein, 9 aa, Borrelia garinii PBi
NPANQVNPG

SEQ ID NO: 42705 - protein, 9 aa, Borrelia garinii PBi
PANQVNPGN

SEQ ID NO: 42706 - protein, 9 aa, Borrelia garinii PBi
ANQVNPGNP

SEQ ID NO: 42707 - protein, 9 aa, Borrelia garinii PBi
NQVNPGNPM

SEQ ID NO: 42708 - protein, 9 aa, Borrelia garinii PBi
QVNPGNPMQ

SEQ ID NO: 42709 - protein, 9 aa, Borrelia garinii PBi
VNPGNPMQI

SEQ ID NO: 42710 - protein, 9 aa, Borrelia garinii PBi
NPGNPMQIA

SEQ ID NO: 42711 - protein, 9 aa, Borrelia garinii PBi
PGNPMQIAN

SEQ ID NO: 42712 - protein, 9 aa, Borrelia garinii PBi
GNPMQIANQ

SEQ ID NO: 42713 - protein, 9 aa, Borrelia garinii PBi
NPMQIANQA

SEQ ID NO: 42714 - protein, 9 aa, Borrelia garinii PBi
PMQIANQAN

SEQ ID NO: 42715 - protein, 9 aa, Borrelia garinii PBi
MQIANQANQ

SEQ ID NO: 42716 - protein, 9 aa, Borrelia garinii PBi
QIANQANQA

SEQ ID NO: 42717 - protein, 9 aa, Borrelia garinii PBi
IANQANQAN

SEQ ID NO: 42718 - protein, 9 aa, Borrelia garinii PBi
ANQANQANQ

SEQ ID NO: 42719 - protein, 9 aa, Borrelia garinii PBi
NQANQANQA

SEQ ID NO: 42720 - protein, 9 aa, Borrelia garinii PBi
QANQANQAN

SEQ ID NO: 42721 - protein, 9 aa, Borrelia garinii PBi
ANQANQANQ

SEQ ID NO: 42722 - protein, 9 aa, Borrelia garinii PBi
NQANQANQA

SEQ ID NO: 42723 - protein, 9 aa, Borrelia garinii PBi
QANQANQAN

SEQ ID NO: 42724 - protein, 9 aa, Borrelia garinii PBi
ANQANQANQ

SEQ ID NO: 42725 - protein, 9 aa, Borrelia garinii PBi
NQANQANQA

SEQ ID NO: 42726 - protein, 9 aa, Borrelia garinii PBi
QANQANQAN

SEQ ID NO: 42727 - protein, 9 aa, Borrelia garinii PBi
ANQANQANQ

SEQ ID NO: 42728 - protein, 9 aa, Borrelia garinii PBi
NQANQANQA

SEQ ID NO: 42729 - protein, 9 aa, Borrelia garinii PBi
QANQANQAS

SEQ ID NO: 42730 - protein, 9 aa, Borrelia garinii PBi
ANQANQASQ

SEQ ID NO: 42731 - protein, 9 aa, Borrelia garinii PBi
NQANQASQA

SEQ ID NO: 42732 - protein, 9 aa, Borrelia garinii PBi
QANQASQAS

SEQ ID NO: 42733 - protein, 9 aa, Borrelia garinii PBi
ANQASQASQ

SEQ ID NO: 42734 - protein, 9 aa, Borrelia garinii PBi
NQASQASQA

SEQ ID NO: 42735 - protein, 9 aa, Borrelia garinii PBi
QASQASQAS

SEQ ID NO: 42736 - protein, 9 aa, Borrelia garinii PBi
ASQASQASQ

SEQ ID NO: 42737 - protein, 9 aa, Borrelia garinii PBi
SQASQASQV

SEQ ID NO: 42738 - protein, 9 aa, Borrelia garinii PBi
QASQASQVA

SEQ ID NO: 42739 - protein, 9 aa, Borrelia garinii PBi
ASQASQVAS

SEQ ID NO: 42740 - protein, 9 aa, Borrelia garinii PBi
SQASQVASS

SEQ ID NO: 42741 - protein, 9 aa, Borrelia garinii PBi
QASQVASSA

SEQ ID NO: 42742 - protein, 9 aa, Borrelia garinii PBi
ASQVASSAS

SEQ ID NO: 42743 - protein, 9 aa, Borrelia garinii PBi
SQVASSASQ

SEQ ID NO: 42744 - protein, 9 aa, Borrelia garinii PBi
QVASSASQA

SEQ ID NO: 42745 - protein, 9 aa, Borrelia garinii PBi
VASSASQAS

SEQ ID NO: 42746 - protein, 9 aa, Borrelia garinii PBi
ASSASQASP

SEQ ID NO: 42747 - protein, 9 aa, Borrelia garinii PBi
SSASQASPV

SEQ ID NO: 42748 - protein, 9 aa, Borrelia garinii PBi
SASQASPVA

SEQ ID NO: 42749 - protein, 9 aa, Borrelia garinii PBi
ASQASPVAS

SEQ ID NO: 42750 - protein, 9 aa, Borrelia garinii PBi
SQASPVASP

SEQ ID NO: 42751 - protein, 9 aa, Borrelia garinii PBi
QASPVASPA

SEQ ID NO: 42752 - protein, 9 aa, Borrelia garinii PBi
ASPVASPAT

SEQ ID NO: 42753 - protein, 9 aa, Borrelia garinii PBi
SPVASPATN

SEQ ID NO: 42754 - protein, 9 aa, Borrelia garinii PBi
PVASPATNV

SEQ ID NO: 42755 - protein, 9 aa, Borrelia garinii PBi
VASPATNVQ

SEQ ID NO: 42756 - protein, 9 aa, Borrelia garinii PBi
ASPATNVQA

SEQ ID NO: 42757 - protein, 9 aa, Borrelia garinii PBi
SPATNVQAT

SEQ ID NO: 42758 - protein, 9 aa, Borrelia garinii PBi
PATNVQATP

SEQ ID NO: 42759 - protein, 9 aa, Borrelia garinii PBi
ATNVQATPP

SEQ ID NO: 42760 - protein, 9 aa, Borrelia garinii PBi
TNVQATPPK

SEQ ID NO: 42761 - protein, 9 aa, Borrelia garinii PBi
NVQATPPKQ

SEQ ID NO: 42762 - protein, 9 aa, Borrelia garinii PBi
VQATPPKQI

SEQ ID NO: 42763 - protein, 9 aa, Borrelia garinii PBi
QATPPKQIA

SEQ ID NO: 42764 - protein, 9 aa, Borrelia garinii PBi
ATPPKQIAS

SEQ ID NO: 42765 - protein, 9 aa, Borrelia garinii PBi
TPPKQIASA

SEQ ID NO: 42766 - protein, 9 aa, Borrelia garinii PBi
PPKQIASAQ

SEQ ID NO: 42767 - protein, 9 aa, Borrelia garinii PBi
PKQIASAQA

SEQ ID NO: 42768 - protein, 9 aa, Borrelia garinii PBi
KQIASAQAI

SEQ ID NO: 42769 - protein, 9 aa, Borrelia garinii PBi
QIASAQAIQ

SEQ ID NO: 42770 - protein, 9 aa, Borrelia garinii PBi
IASAQAIQT

SEQ ID NO: 42771 - protein, 9 aa, Borrelia garinii PBi
ASAQAIQTV

SEQ ID NO: 42772 - protein, 9 aa, Borrelia garinii PBi
SAQAIQTVP

SEQ ID NO: 42773 - protein, 9 aa, Borrelia garinii PBi
AQAIQTVPN

SEQ ID NO: 42774 - protein, 9 aa, Borrelia garinii PBi
QAIQTVPNN

SEQ ID NO: 42775 - protein, 9 aa, Borrelia garinii PBi
AIQTVPNNT

SEQ ID NO: 42776 - protein, 9 aa, Borrelia garinii PBi
IQTVPNNTS

SEQ ID NO: 42777 - protein, 9 aa, Borrelia garinii PBi
QTVPNNTST

SEQ ID NO: 42778 - protein, 9 aa, Borrelia garinii PBi
TVPNNTSTP

SEQ ID NO: 42779 - protein, 9 aa, Borrelia garinii PBi
VPNNTSTPN

SEQ ID NO: 42780 - protein, 9 aa, Borrelia garinii PBi
PNNTSTPNQ

SEQ ID NO: 42781 - protein, 9 aa, Borrelia garinii PBi
NNTSTPNQS

SEQ ID NO: 42782 - protein, 9 aa, Borrelia garinii PBi
NTSTPNQSI

SEQ ID NO: 42783 - protein, 9 aa, Borrelia garinii PBi
TSTPNQSII

SEQ ID NO: 42784 - protein, 9 aa, Borrelia garinii PBi
STPNQSIIK

SEQ ID NO: 42785 - protein, 9 aa, Borrelia garinii PBi
TPNQSIIKP

SEQ ID NO: 42786 - protein, 9 aa, Borrelia garinii PBi
PNQSIIKPQ

SEQ ID NO: 42787 - protein, 9 aa, Borrelia garinii PBi
NQSIIKPQQ

SEQ ID NO: 42788 - protein, 9 aa, Borrelia garinii PBi
QSIIKPQQY

SEQ ID NO: 42789 - protein, 9 aa, Borrelia garinii PBi
SIIKPQQYT

SEQ ID NO: 42790 - protein, 9 aa, Borrelia garinii PBi
IIKPQQYTF

SEQ ID NO: 42791 - protein, 9 aa, Borrelia garinii PBi
IKPQQYTFS

SEQ ID NO: 42792 - protein, 9 aa, Borrelia garinii PBi
KPQQYTFSS

SEQ ID NO: 42793 - protein, 9 aa, Borrelia garinii PBi
PQQYTFSSS

SEQ ID NO: 42794 - protein, 9 aa, Borrelia garinii PBi
QQYTFSSSF

SEQ ID NO: 42795 - protein, 9 aa, Borrelia garinii PBi
QYTFSSSFS

SEQ ID NO: 42796 - protein, 9 aa, Borrelia garinii PBi
YTFSSSFSQ

SEQ ID NO: 42797 - protein, 9 aa, Borrelia garinii PBi
TFSSSFSQP

SEQ ID NO: 42798 - protein, 9 aa, Borrelia garinii PBi
FSSSFSQPT

SEQ ID NO: 42799 - protein, 9 aa, Borrelia garinii PBi
SSSFSQPTS

SEQ ID NO: 42800 - protein, 9 aa, Borrelia garinii PBi
SSFSQPTSQ

SEQ ID NO: 42801 - protein, 9 aa, Borrelia garinii PBi
SFSQPTSQT

SEQ ID NO: 42802 - protein, 9 aa, Borrelia garinii PBi
FSQPTSQTN

SEQ ID NO: 42803 - protein, 9 aa, Borrelia garinii PBi
SQPTSQTNF

SEQ ID NO: 42804 - protein, 9 aa, Borrelia garinii PBi
QPTSQTNFN

SEQ ID NO: 42805 - protein, 9 aa, Borrelia garinii PBi
PTSQTNFNN

SEQ ID NO: 42806 - protein, 9 aa, Borrelia garinii PBi
TSQTNFNNS

SEQ ID NO: 42807 - protein, 9 aa, Borrelia garinii PBi
SQTNFNNSQ

SEQ ID NO: 42808 - protein, 9 aa, Borrelia garinii PBi
QTNFNNSQS

SEQ ID NO: 42809 - protein, 9 aa, Borrelia garinii PBi
TNFNNSQSN

SEQ ID NO: 42810 - protein, 9 aa, Borrelia garinii PBi
NFNNSQSNN

SEQ ID NO: 42811 - protein, 9 aa, Borrelia garinii PBi
FNNSQSNNV

SEQ ID NO: 42812 - protein, 9 aa, Borrelia garinii PBi
NNSQSNNVL

SEQ ID NO: 42813 - protein, 9 aa, Borrelia garinii PBi
NSQSNNVLT

SEQ ID NO: 42814 - protein, 9 aa, Borrelia garinii PBi
SQSNNVLTN

SEQ ID NO: 42815 - protein, 9 aa, Borrelia garinii PBi
QSNNVLTNY

SEQ ID NO: 42816 - protein, 9 aa, Borrelia garinii PBi
SNNVLTNYR

SEQ ID NO: 42817 - protein, 9 aa, Borrelia garinii PBi
NNVLTNYRH

SEQ ID NO: 42818 - protein, 9 aa, Borrelia garinii PBi
NVLTNYRHQ

SEQ ID NO: 42819 - protein, 9 aa, Borrelia garinii PBi
VLTNYRHQT

SEQ ID NO: 42820 - protein, 9 aa, Borrelia garinii PBi
LTNYRHQTQ

SEQ ID NO: 42821 - protein, 9 aa, Borrelia garinii PBi
TNYRHQTQP

SEQ ID NO: 42822 - protein, 9 aa, Borrelia garinii PBi
NYRHQTQPS

SEQ ID NO: 42823 - protein, 9 aa, Borrelia garinii PBi
YRHQTQPSF

SEQ ID NO: 42824 - protein, 9 aa, Borrelia garinii PBi
RHQTQPSFV

SEQ ID NO: 42825 - protein, 9 aa, Borrelia garinii PBi
HQTQPSFVV

SEQ ID NO: 42826 - protein, 9 aa, Borrelia garinii PBi
QTQPSFVVP

SEQ ID NO: 42827 - protein, 9 aa, Borrelia garinii PBi
TQPSFVVPV

SEQ ID NO: 42828 - protein, 9 aa, Borrelia garinii PBi
QPSFVVPVY

SEQ ID NO: 42829 - protein, 9 aa, Borrelia garinii PBi
PSFVVPVYS

SEQ ID NO: 42830 - protein, 9 aa, Borrelia garinii PBi
SFVVPVYSG

SEQ ID NO: 42831 - protein, 9 aa, Borrelia garinii PBi
FVVPVYSGN

SEQ ID NO: 42832 - protein, 9 aa, Borrelia garinii PBi
VVPVYSGNS

SEQ ID NO: 42833 - protein, 9 aa, Borrelia garinii PBi
VPVYSGNSP

SEQ ID NO: 42834 - protein, 9 aa, Borrelia garinii PBi
PVYSGNSPL

SEQ ID NO: 42835 - protein, 9 aa, Borrelia garinii PBi
VYSGNSPLQ

SEQ ID NO: 42836 - protein, 9 aa, Borrelia garinii PBi
YSGNSPLQK

SEQ ID NO: 42837 - protein, 9 aa, Borrelia garinii PBi
SGNSPLQKL

SEQ ID NO: 42838 - protein, 9 aa, Borrelia garinii PBi
GNSPLQKLK

SEQ ID NO: 42839 - protein, 9 aa, Borrelia garinii PBi
NSPLQKLKN

SEQ ID NO: 42840 - protein, 9 aa, Borrelia garinii PBi
SPLQKLKNN

SEQ ID NO: 42841 - protein, 9 aa, Borrelia garinii PBi
PLQKLKNNL

SEQ ID NO: 42842 - protein, 9 aa, Borrelia garinii PBi
LQKLKNNLL

SEQ ID NO: 42843 - protein, 9 aa, Borrelia garinii PBi
QKLKNNLLR

SEQ ID NO: 42844 - protein, 9 aa, Borrelia garinii PBi
KLKNNLLRR

SEQ ID NO: 42845 - protein, 9 aa, Borrelia garinii PBi
LKNNLLRRI

SEQ ID NO: 42846 - protein, 9 aa, Borrelia garinii PBi
KNNLLRRIA

SEQ ID NO: 42847 - protein, 9 aa, Borrelia garinii PBi
NNLLRRIAE

SEQ ID NO: 42848 - protein, 9 aa, Borrelia garinii PBi
NLLRRIAEE

SEQ ID NO: 42849 - protein, 9 aa, Borrelia garinii PBi
LLRRIAEEK

SEQ ID NO: 42850 - protein, 9 aa, Borrelia garinii PBi
LRRIAEEKN

SEQ ID NO: 42851 - protein, 9 aa, Borrelia garinii PBi
RRIAEEKNK

SEQ ID NO: 42852 - protein, 9 aa, Borrelia garinii PBi
RIAEEKNKT

SEQ ID NO: 42853 - protein, 9 aa, Borrelia garinii PBi
IAEEKNKTH

SEQ ID NO: 42854 - protein, 9 aa, Borrelia garinii PBi
AEEKNKTHN

SEQ ID NO: 42855 - protein, 9 aa, Borrelia garinii PBi
EEKNKTHNH

SEQ ID NO: 42856 - protein, 9 aa, Borrelia garinii PBi
EKNKTHNHG

SEQ ID NO: 42857 - protein, 9 aa, Borrelia garinii PBi
KNKTHNHGF

SEQ ID NO: 42858 - protein, 9 aa, Borrelia garinii PBi
NKTHNHGFR

SEQ ID NO: 42859 - protein, 9 aa, Borrelia garinii PBi
KTHNHGFRE

SEQ ID NO: 42860 - protein, 9 aa, Borrelia garinii PBi
THNHGFRET

SEQ ID NO: 42861 - protein, 9 aa, Borrelia garinii PBi
HNHGFRETY

SEQ ID NO: 42862 - protein, 9 aa, Borrelia garinii PBi
NHGFRETYD

SEQ ID NO: 42863 - protein, 9 aa, Borrelia garinii PBi
HGFRETYDQ

SEQ ID NO: 42864 - protein, 9 aa, Borrelia garinii PBi
GFRETYDQF

SEQ ID NO: 42865 - protein, 9 aa, Borrelia garinii PBi
FRETYDQFK

SEQ ID NO: 42866 - protein, 9 aa, Borrelia garinii PBi
RETYDQFKM

SEQ ID NO: 42867 - protein, 9 aa, Borrelia garinii PBi
ETYDQFKMK

SEQ ID NO: 42868 - protein, 9 aa, Borrelia garinii PBi
TYDQFKMKD

SEQ ID NO: 42869 - protein, 9 aa, Borrelia garinii PBi
YDQFKMKDS

SEQ ID NO: 42870 - protein, 9 aa, Borrelia garinii PBi
DQFKMKDSA

SEQ ID NO: 42871 - protein, 9 aa, Borrelia garinii PBi
QFKMKDSAF

SEQ ID NO: 42872 - protein, 9 aa, Borrelia garinii PBi
FKMKDSAFT

SEQ ID NO: 42873 - protein, 9 aa, Borrelia garinii PBi
KMKDSAFTL

SEQ ID NO: 42874 - protein, 9 aa, Borrelia garinii PBi
MKDSAFTLL

SEQ ID NO: 42875 - protein, 9 aa, Borrelia garinii PBi
KDSAFTLLD

SEQ ID NO: 42876 - protein, 9 aa, Borrelia garinii PBi
DSAFTLLDV

SEQ ID NO: 42877 - protein, 9 aa, Borrelia garinii PBi
SAFTLLDVI

SEQ ID NO: 42878 - protein, 9 aa, Borrelia garinii PBi
AFTLLDVIS

SEQ ID NO: 42879 - protein, 9 aa, Borrelia garinii PBi
FTLLDVISN

SEQ ID NO: 42880 - protein, 9 aa, Borrelia garinii PBi
TLLDVISNI

SEQ ID NO: 42881 - protein, 9 aa, Borrelia garinii PBi
LLDVISNIS

SEQ ID NO: 42882 - protein, 9 aa, Borrelia garinii PBi
LDVISNISV

SEQ ID NO: 42883 - protein, 9 aa, Borrelia garinii PBi
DVISNISVF

SEQ ID NO: 42884 - protein, 9 aa, Borrelia garinii PBi
VISNISVFD

SEQ ID NO: 42885 - protein, 9 aa, Borrelia garinii PBi
ISNISVFDR

SEQ ID NO: 42886 - protein, 9 aa, Borrelia garinii PBi
SNISVFDRG

SEQ ID NO: 42887 - protein, 9 aa, Borrelia garinii PBi
NISVFDRGS

SEQ ID NO: 42888 - protein, 9 aa, Borrelia garinii PBi
ISVFDRGSA

SEQ ID NO: 42889 - protein, 9 aa, Borrelia garinii PBi
SVFDRGSAP

SEQ ID NO: 42890 - protein, 9 aa, Borrelia garinii PBi
VFDRGSAPQ

SEQ ID NO: 42891 - protein, 9 aa, Borrelia garinii PBi
FDRGSAPQL

SEQ ID NO: 42892 - protein, 9 aa, Borrelia garinii PBi
DRGSAPQLS

SEQ ID NO: 42893 - protein, 9 aa, Borrelia garinii PBi
RGSAPQLSS

SEQ ID NO: 42894 - protein, 9 aa, Borrelia garinii PBi
GSAPQLSSN

SEQ ID NO: 42895 - protein, 9 aa, Borrelia garinii PBi
SAPQLSSNT

SEQ ID NO: 42896 - protein, 9 aa, Borrelia garinii PBi
APQLSSNTP

SEQ ID NO: 42897 - protein, 9 aa, Borrelia garinii PBi
PQLSSNTPE

SEQ ID NO: 42898 - protein, 9 aa, Borrelia garinii PBi
QLSSNTPEA

SEQ ID NO: 42899 - protein, 9 aa, Borrelia garinii PBi
LSSNTPEAE

SEQ ID NO: 42900 - protein, 9 aa, Borrelia garinii PBi
SSNTPEAES

SEQ ID NO: 42901 - protein, 9 aa, Borrelia garinii PBi
SNTPEAESE

SEQ ID NO: 42902 - protein, 9 aa, Borrelia garinii PBi
NTPEAESER

SEQ ID NO: 42903 - protein, 9 aa, Borrelia garinii PBi
TPEAESERN

SEQ ID NO: 42904 - protein, 9 aa, Borrelia garinii PBi
PEAESERNR

SEQ ID NO: 42905 - protein, 9 aa, Borrelia garinii PBi
EAESERNRL

SEQ ID NO: 42906 - protein, 9 aa, Borrelia garinii PBi
AESERNRLY

SEQ ID NO: 42907 - protein, 9 aa, Borrelia garinii PBi
ESERNRLYA

SEQ ID NO: 42908 - protein, 9 aa, Borrelia garinii PBi
SERNRLYAM

SEQ ID NO: 42909 - protein, 9 aa, Borrelia garinii PBi
ERNRLYAMM

SEQ ID NO: 42910 - protein, 9 aa, Borrelia garinii PBi
RNRLYAMMD

SEQ ID NO: 42911 - protein, 9 aa, Borrelia garinii PBi
NRLYAMMDF

SEQ ID NO: 42912 - protein, 9 aa, Borrelia garinii PBi
RLYAMMDFD

SEQ ID NO: 42913 - protein, 9 aa, Borrelia garinii PBi
LYAMMDFDQ

SEQ ID NO: 42914 - protein, 9 aa, Borrelia garinii PBi
YAMMDFDQA

SEQ ID NO: 42915 - protein, 9 aa, Borrelia garinii PBi
AMMDFDQAK

SEQ ID NO: 42916 - protein, 9 aa, Borrelia garinii PBi
MMDFDQAKT

SEQ ID NO: 42917 - protein, 9 aa, Borrelia garinii PBi
MDFDQAKTT

SEQ ID NO: 42918 - protein, 9 aa, Borrelia garinii PBi
DFDQAKTTE

SEQ ID NO: 42919 - protein, 9 aa, Borrelia garinii PBi
FDQAKTTEF

SEQ ID NO: 42920 - protein, 9 aa, Borrelia garinii PBi
DQAKTTEFG

SEQ ID NO: 42921 - protein, 9 aa, Borrelia garinii PBi
QAKTTEFGS

SEQ ID NO: 42922 - protein, 9 aa, Borrelia garinii PBi
AKTTEFGSI

SEQ ID NO: 42923 - protein, 9 aa, Borrelia garinii PBi
KTTEFGSIM

SEQ ID NO: 42924 - protein, 9 aa, Borrelia garinii PBi
TTEFGSIMN

SEQ ID NO: 42925 - protein, 9 aa, Borrelia garinii PBi
TEFGSIMNI

SEQ ID NO: 42926 - protein, 9 aa, Borrelia garinii PBi
EFGSIMNIL

SEQ ID NO: 42927 - protein, 9 aa, Borrelia garinii PBi
FGSIMNILY

SEQ ID NO: 42928 - protein, 9 aa, Borrelia garinii PBi
GSIMNILYQ

SEQ ID NO: 42929 - protein, 9 aa, Borrelia garinii PBi
SIMNILYQE

SEQ ID NO: 42930 - protein, 9 aa, Borrelia garinii PBi
IMNILYQEN

SEQ ID NO: 42931 - protein, 9 aa, Borrelia garinii PBi
MNILYQENQ

SEQ ID NO: 42932 - protein, 9 aa, Borrelia garinii PBi
NILYQENQN

SEQ ID NO: 42933 - protein, 9 aa, Borrelia garinii PBi
ILYQENQNH

SEQ ID NO: 42934 - protein, 9 aa, Borrelia garinii PBi
LYQENQNHS

SEQ ID NO: 42935 - protein, 9 aa, Borrelia garinii PBi
YQENQNHSL

SEQ ID NO: 42936 - protein, 9 aa, Borrelia garinii PBi
QENQNHSLI

SEQ ID NO: 42937 - protein, 9 aa, Borrelia garinii PBi
ENQNHSLIR

SEQ ID NO: 42938 - protein, 9 aa, Borrelia garinii PBi
NQNHSLIRS

SEQ ID NO: 42939 - protein, 9 aa, Borrelia garinii PBi
QNHSLIRSL

SEQ ID NO: 42940 - protein, 9 aa, Borrelia garinii PBi
NHSLIRSLI

SEQ ID NO: 42941 - protein, 9 aa, Borrelia garinii PBi
HSLIRSLII

SEQ ID NO: 42942 - protein, 9 aa, Borrelia garinii PBi
SLIRSLIIS

SEQ ID NO: 42943 - protein, 9 aa, Borrelia garinii PBi
LIRSLIISG

SEQ ID NO: 42944 - protein, 9 aa, Borrelia garinii PBi
IRSLIISGL

SEQ ID NO: 42945 - protein, 9 aa, Borrelia garinii PBi
RSLIISGLG

SEQ ID NO: 42946 - protein, 9 aa, Borrelia garinii PBi
SLIISGLGI

SEQ ID NO: 42947 - protein, 9 aa, Borrelia garinii PBi
LIISGLGIQ

SEQ ID NO: 42948 - protein, 9 aa, Borrelia garinii PBi
IISGLGIQI

SEQ ID NO: 42949 - protein, 9 aa, Borrelia garinii PBi
ISGLGIQIS

SEQ ID NO: 42950 - protein, 9 aa, Borrelia garinii PBi
SGLGIQISL

SEQ ID NO: 42951 - protein, 9 aa, Borrelia garinii PBi
GLGIQISLE

SEQ ID NO: 42952 - protein, 9 aa, Borrelia garinii PBi
LGIQISLES

SEQ ID NO: 42953 - protein, 9 aa, Borrelia garinii PBi
GIQISLEST

SEQ ID NO: 42954 - protein, 9 aa, Borrelia garinii PBi
IQISLESTL

SEQ ID NO: 42955 - protein, 9 aa, Borrelia garinii PBi
QISLESTLE

SEQ ID NO: 42956 - protein, 9 aa, Borrelia garinii PBi
ISLESTLEE

SEQ ID NO: 42957 - protein, 9 aa, Borrelia garinii PBi
SLESTLEEI

SEQ ID NO: 42958 - protein, 9 aa, Borrelia garinii PBi
LESTLEEIE

SEQ ID NO: 42959 - protein, 9 aa, Borrelia garinii PBi
ESTLEEIEK

SEQ ID NO: 42960 - protein, 9 aa, Borrelia garinii PBi
STLEEIEKK

SEQ ID NO: 42961 - protein, 9 aa, Borrelia garinii PBi
TLEEIEKKI

SEQ ID NO: 42962 - protein, 9 aa, Borrelia garinii PBi
LEEIEKKIE

SEQ ID NO: 42963 - protein, 9 aa, Borrelia garinii PBi
EEIEKKIES

SEQ ID NO: 42964 - protein, 9 aa, Borrelia garinii PBi
EIEKKIESF

SEQ ID NO: 42965 - protein, 9 aa, Borrelia garinii PBi
IEKKIESFN

SEQ ID NO: 42966 - protein, 9 aa, Borrelia garinii PBi
EKKIESFNT

SEQ ID NO: 42967 - protein, 9 aa, Borrelia garinii PBi
KKIESFNTQ

SEQ ID NO: 42968 - protein, 9 aa, Borrelia garinii PBi
KIESFNTQY

SEQ ID NO: 42969 - protein, 9 aa, Borrelia garinii PBi
IESFNTQYL

SEQ ID NO: 42970 - protein, 9 aa, Borrelia garinii PBi
ESFNTQYLN

SEQ ID NO: 42971 - protein, 9 aa, Borrelia garinii PBi
SFNTQYLNT

SEQ ID NO: 42972 - protein, 9 aa, Borrelia garinii PBi
FNTQYLNTI

SEQ ID NO: 42973 - protein, 9 aa, Borrelia garinii PBi
NTQYLNTII

SEQ ID NO: 42974 - protein, 9 aa, Borrelia garinii PBi
TQYLNTIIN

SEQ ID NO: 42975 - protein, 9 aa, Borrelia garinii PBi
QYLNTIINS

SEQ ID NO: 42976 - protein, 9 aa, Borrelia garinii PBi
YLNTIINSY

SEQ ID NO: 42977 - protein, 9 aa, Borrelia garinii PBi
LNTIINSYT

SEQ ID NO: 42978 - protein, 9 aa, Borrelia garinii PBi
NTIINSYTF

SEQ ID NO: 42979 - protein, 9 aa, Borrelia garinii PBi
TIINSYTFK

SEQ ID NO: 42980 - protein, 9 aa, Borrelia garinii PBi
IINSYTFKD

SEQ ID NO: 42981 - protein, 9 aa, Borrelia garinii PBi
INSYTFKDK

SEQ ID NO: 42982 - protein, 9 aa, Borrelia garinii PBi
NSYTFKDKL

SEQ ID NO: 42983 - protein, 9 aa, Borrelia garinii PBi
SYTFKDKLK

SEQ ID NO: 42984 - protein, 9 aa, Borrelia garinii PBi
YTFKDKLKE

SEQ ID NO: 42985 - protein, 9 aa, Borrelia garinii PBi
TFKDKLKEL

SEQ ID NO: 42986 - protein, 9 aa, Borrelia garinii PBi
FKDKLKELE

SEQ ID NO: 42987 - protein, 9 aa, Borrelia garinii PBi
KDKLKELES

SEQ ID NO: 42988 - protein, 9 aa, Borrelia garinii PBi
DKLKELESK

SEQ ID NO: 42989 - protein, 9 aa, Borrelia garinii PBi
KLKELESKL

SEQ ID NO: 42990 - protein, 9 aa, Borrelia garinii PBi
LKELESKLN

SEQ ID NO: 42991 - protein, 9 aa, Borrelia garinii PBi
KELESKLNS

SEQ ID NO: 42992 - protein, 9 aa, Borrelia garinii PBi
ELESKLNSI

SEQ ID NO: 42993 - protein, 9 aa, Borrelia garinii PBi
LESKLNSIL

SEQ ID NO: 42994 - protein, 9 aa, Borrelia garinii PBi
ESKLNSILA

SEQ ID NO: 42995 - protein, 9 aa, Borrelia garinii PBi
SKLNSILAE

SEQ ID NO: 42996 - protein, 9 aa, Borrelia garinii PBi
KLNSILAEK

SEQ ID NO: 42997 - protein, 9 aa, Borrelia garinii PBi
LNSILAEKK

SEQ ID NO: 42998 - protein, 9 aa, Borrelia garinii PBi
NSILAEKKE

SEQ ID NO: 42999 - protein, 9 aa, Borrelia garinii PBi
SILAEKKEW

SEQ ID NO: 43000 - protein, 9 aa, Borrelia garinii PBi
ILAEKKEWL

SEQ ID NO: 43001 - protein, 9 aa, Borrelia garinii PBi
LAEKKEWLN

SEQ ID NO: 43002 - protein, 9 aa, Borrelia garinii PBi
AEKKEWLNY

SEQ ID NO: 43003 - protein, 9 aa, Borrelia garinii PBi
EKKEWLNYA

SEQ ID NO: 43004 - protein, 9 aa, Borrelia garinii PBi
KKEWLNYAD

SEQ ID NO: 43005 - protein, 9 aa, Borrelia garinii PBi
KEWLNYADA

SEQ ID NO: 43006 - protein, 9 aa, Borrelia garinii PBi
EWLNYADAI

SEQ ID NO: 43007 - protein, 9 aa, Borrelia garinii PBi
WLNYADAII

SEQ ID NO: 43008 - protein, 9 aa, Borrelia garinii PBi
LNYADAIIT

SEQ ID NO: 43009 - protein, 9 aa, Borrelia garinii PBi
NYADAIITN

SEQ ID NO: 43010 - protein, 9 aa, Borrelia garinii PBi
YADAIITNT

SEQ ID NO: 43011 - protein, 9 aa, Borrelia garinii PBi
ADAIITNTS

SEQ ID NO: 43012 - protein, 9 aa, Borrelia garinii PBi
DAIITNTSS

SEQ ID NO: 43013 - protein, 9 aa, Borrelia garinii PBi
AIITNTSSN

SEQ ID NO: 43014 - protein, 9 aa, Borrelia garinii PBi
IITNTSSNS

SEQ ID NO: 43015 - protein, 9 aa, Borrelia garinii PBi
ITNTSSNSK

SEQ ID NO: 43016 - protein, 9 aa, Borrelia garinii PBi
TNTSSNSKR

SEQ ID NO: 43017 - protein, 9 aa, Borrelia garinii PBi
NTSSNSKRN

SEQ ID NO: 43018 - protein, 9 aa, Borrelia garinii PBi
TSSNSKRND

SEQ ID NO: 43019 - protein, 9 aa, Borrelia garinii PBi
SSNSKRNDP

SEQ ID NO: 43020 - protein, 9 aa, Borrelia garinii PBi
SNSKRNDPQ

SEQ ID NO: 43021 - protein, 9 aa, Borrelia garinii PBi
NSKRNDPQS

SEQ ID NO: 43022 - protein, 9 aa, Borrelia garinii PBi
SKRNDPQSL

SEQ ID NO: 43023 - protein, 9 aa, Borrelia garinii PBi
KRNDPQSLG

SEQ ID NO: 43024 - protein, 9 aa, Borrelia garinii PBi
RNDPQSLGQ

SEQ ID NO: 43025 - protein, 9 aa, Borrelia garinii PBi
NDPQSLGQY

SEQ ID NO: 43026 - protein, 9 aa, Borrelia garinii PBi
DPQSLGQYI

SEQ ID NO: 43027 - protein, 9 aa, Borrelia garinii PBi
PQSLGQYIK

SEQ ID NO: 43028 - protein, 9 aa, Borrelia garinii PBi
QSLGQYIKN

SEQ ID NO: 43029 - protein, 9 aa, Borrelia garinii PBi
SLGQYIKNK

SEQ ID NO: 43030 - protein, 9 aa, Borrelia garinii PBi
LGQYIKNKY

SEQ ID NO: 43031 - protein, 9 aa, Borrelia garinii PBi
GQYIKNKYL

SEQ ID NO: 43032 - protein, 9 aa, Borrelia garinii PBi
QYIKNKYLD

SEQ ID NO: 43033 - protein, 9 aa, Borrelia garinii PBi
YIKNKYLDK

SEQ ID NO: 43034 - protein, 9 aa, Borrelia garinii PBi
IKNKYLDKM

SEQ ID NO: 43035 - protein, 9 aa, Borrelia garinii PBi
KNKYLDKMQ

SEQ ID NO: 43036 - protein, 9 aa, Borrelia garinii PBi
NKYLDKMQD

SEQ ID NO: 43037 - protein, 9 aa, Borrelia garinii PBi
KYLDKMQDA

SEQ ID NO: 43038 - protein, 9 aa, Borrelia garinii PBi
YLDKMQDAR

SEQ ID NO: 43039 - protein, 9 aa, Borrelia garinii PBi
LDKMQDARQ

SEQ ID NO: 43040 - protein, 9 aa, Borrelia garinii PBi
DKMQDARQS

SEQ ID NO: 43041 - protein, 9 aa, Borrelia garinii PBi
KMQDARQSA

SEQ ID NO: 43042 - protein, 9 aa, Borrelia garinii PBi
MQDARQSAL

SEQ ID NO: 43043 - protein, 9 aa, Borrelia garinii PBi
QDARQSALD

SEQ ID NO: 43044 - protein, 9 aa, Borrelia garinii PBi
DARQSALDL

SEQ ID NO: 43045 - protein, 9 aa, Borrelia garinii PBi
ARQSALDLY

SEQ ID NO: 43046 - protein, 9 aa, Borrelia garinii PBi
RQSALDLYL

SEQ ID NO: 43047 - protein, 9 aa, Borrelia garinii PBi
QSALDLYLN

SEQ ID NO: 43048 - protein, 9 aa, Borrelia garinii PBi
SALDLYLNI

SEQ ID NO: 43049 - protein, 9 aa, Borrelia garinii PBi
ALDLYLNIT

SEQ ID NO: 43050 - protein, 9 aa, Borrelia garinii PBi
LDLYLNITE

SEQ ID NO: 43051 - protein, 9 aa, Borrelia garinii PBi
DLYLNITEI

SEQ ID NO: 43052 - protein, 10 aa, Borrelia garinii PBi
MSSCTIDANL

SEQ ID NO: 43053 - protein, 10 aa, Borrelia garinii PBi
SSCTIDANLN

SEQ ID NO: 43054 - protein, 10 aa, Borrelia garinii PBi
SCTIDANLNK

SEQ ID NO: 43055 - protein, 10 aa, Borrelia garinii PBi
CTIDANLNKD

SEQ ID NO: 43056 - protein, 10 aa, Borrelia garinii PBi
TIDANLNKDY

SEQ ID NO: 43057 - protein, 10 aa, Borrelia garinii PBi
IDANLNKDYK

SEQ ID NO: 43058 - protein, 10 aa, Borrelia garinii PBi
DANLNKDYKN

SEQ ID NO: 43059 - protein, 10 aa, Borrelia garinii PBi
ANLNKDYKNK

SEQ ID NO: 43060 - protein, 10 aa, Borrelia garinii PBi
NLNKDYKNKV

SEQ ID NO: 43061 - protein, 10 aa, Borrelia garinii PBi
LNKDYKNKVE

SEQ ID NO: 43062 - protein, 10 aa, Borrelia garinii PBi
NKDYKNKVEE

SEQ ID NO: 43063 - protein, 10 aa, Borrelia garinii PBi
KDYKNKVEEL

SEQ ID NO: 43064 - protein, 10 aa, Borrelia garinii PBi
DYKNKVEELL

SEQ ID NO: 43065 - protein, 10 aa, Borrelia garinii PBi
YKNKVEELLN

SEQ ID NO: 43066 - protein, 10 aa, Borrelia garinii PBi
KNKVEELLNS

SEQ ID NO: 43067 - protein, 10 aa, Borrelia garinii PBi
NKVEELLNSS

SEQ ID NO: 43068 - protein, 10 aa, Borrelia garinii PBi
KVEELLNSST

SEQ ID NO: 43069 - protein, 10 aa, Borrelia garinii PBi
VEELLNSSTD

SEQ ID NO: 43070 - protein, 10 aa, Borrelia garinii PBi
EELLNSSTDD

SEQ ID NO: 43071 - protein, 10 aa, Borrelia garinii PBi
ELLNSSTDDQ

SEQ ID NO: 43072 - protein, 10 aa, Borrelia garinii PBi
LLNSSTDDQA

SEQ ID NO: 43073 - protein, 10 aa, Borrelia garinii PBi
LNSSTDDQAK

SEQ ID NO: 43074 - protein, 10 aa, Borrelia garinii PBi
NSSTDDQAKI

SEQ ID NO: 43075 - protein, 10 aa, Borrelia garinii PBi
SSTDDQAKIS

SEQ ID NO: 43076 - protein, 10 aa, Borrelia garinii PBi
STDDQAKISI

SEQ ID NO: 43077 - protein, 10 aa, Borrelia garinii PBi
TDDQAKISIN

SEQ ID NO: 43078 - protein, 10 aa, Borrelia garinii PBi
DDQAKISINT

SEQ ID NO: 43079 - protein, 10 aa, Borrelia garinii PBi
DQAKISINTG

SEQ ID NO: 43080 - protein, 10 aa, Borrelia garinii PBi
QAKISINTGS

SEQ ID NO: 43081 - protein, 10 aa, Borrelia garinii PBi
AKISINTGSN

SEQ ID NO: 43082 - protein, 10 aa, Borrelia garinii PBi
KISINTGSNA

SEQ ID NO: 43083 - protein, 10 aa, Borrelia garinii PBi
ISINTGSNAT

SEQ ID NO: 43084 - protein, 10 aa, Borrelia garinii PBi
SINTGSNATK

SEQ ID NO: 43085 - protein, 10 aa, Borrelia garinii PBi
INTGSNATKN

SEQ ID NO: 43086 - protein, 10 aa, Borrelia garinii PBi
NTGSNATKNK

SEQ ID NO: 43087 - protein, 10 aa, Borrelia garinii PBi
TGSNATKNKT

SEQ ID NO: 43088 - protein, 10 aa, Borrelia garinii PBi
GSNATKNKTN

SEQ ID NO: 43089 - protein, 10 aa, Borrelia garinii PBi
SNATKNKTNI

SEQ ID NO: 43090 - protein, 10 aa, Borrelia garinii PBi
NATKNKTNIK

SEQ ID NO: 43091 - protein, 10 aa, Borrelia garinii PBi
ATKNKTNIKV

SEQ ID NO: 43092 - protein, 10 aa, Borrelia garinii PBi
TKNKTNIKVA

SEQ ID NO: 43093 - protein, 10 aa, Borrelia garinii PBi
KNKTNIKVAG

SEQ ID NO: 43094 - protein, 10 aa, Borrelia garinii PBi
NKTNIKVAGL

SEQ ID NO: 43095 - protein, 10 aa, Borrelia garinii PBi
KTNIKVAGLQ

SEQ ID NO: 43096 - protein, 10 aa, Borrelia garinii PBi
TNIKVAGLQK

SEQ ID NO: 43097 - protein, 10 aa, Borrelia garinii PBi
NIKVAGLQKN

SEQ ID NO: 43098 - protein, 10 aa, Borrelia garinii PBi
IKVAGLQKNT

SEQ ID NO: 43099 - protein, 10 aa, Borrelia garinii PBi
KVAGLQKNTQ

SEQ ID NO: 43100 - protein, 10 aa, Borrelia garinii PBi
VAGLQKNTQS

SEQ ID NO: 43101 - protein, 10 aa, Borrelia garinii PBi
AGLQKNTQSK

SEQ ID NO: 43102 - protein, 10 aa, Borrelia garinii PBi
GLQKNTQSKK

SEQ ID NO: 43103 - protein, 10 aa, Borrelia garinii PBi
LQKNTQSKKN

SEQ ID NO: 43104 - protein, 10 aa, Borrelia garinii PBi
QKNTQSKKNN

SEQ ID NO: 43105 - protein, 10 aa, Borrelia garinii PBi
KNTQSKKNNN

SEQ ID NO: 43106 - protein, 10 aa, Borrelia garinii PBi
NTQSKKNNNL

SEQ ID NO: 43107 - protein, 10 aa, Borrelia garinii PBi
TQSKKNNNLQ

SEQ ID NO: 43108 - protein, 10 aa, Borrelia garinii PBi
QSKKNNNLQG

SEQ ID NO: 43109 - protein, 10 aa, Borrelia garinii PBi
SKKNNNLQGL

SEQ ID NO: 43110 - protein, 10 aa, Borrelia garinii PBi
KKNNNLQGLN

SEQ ID NO: 43111 - protein, 10 aa, Borrelia garinii PBi
KNNNLQGLNP

SEQ ID NO: 43112 - protein, 10 aa, Borrelia garinii PBi
NNNLQGLNPA

SEQ ID NO: 43113 - protein, 10 aa, Borrelia garinii PBi
NNLQGLNPAN

SEQ ID NO: 43114 - protein, 10 aa, Borrelia garinii PBi
NLQGLNPANQ

SEQ ID NO: 43115 - protein, 10 aa, Borrelia garinii PBi
LQGLNPANQV

SEQ ID NO: 43116 - protein, 10 aa, Borrelia garinii PBi
QGLNPANQVN

SEQ ID NO: 43117 - protein, 10 aa, Borrelia garinii PBi
GLNPANQVNP

SEQ ID NO: 43118 - protein, 10 aa, Borrelia garinii PBi
LNPANQVNPG

SEQ ID NO: 43119 - protein, 10 aa, Borrelia garinii PBi
NPANQVNPGN

SEQ ID NO: 43120 - protein, 10 aa, Borrelia garinii PBi
PANQVNPGNP

SEQ ID NO: 43121 - protein, 10 aa, Borrelia garinii PBi
ANQVNPGNPM

SEQ ID NO: 43122 - protein, 10 aa, Borrelia garinii PBi
NQVNPGNPMQ

SEQ ID NO: 43123 - protein, 10 aa, Borrelia garinii PBi
QVNPGNPMQI

SEQ ID NO: 43124 - protein, 10 aa, Borrelia garinii PBi
VNPGNPMQIA

SEQ ID NO: 43125 - protein, 10 aa, Borrelia garinii PBi
NPGNPMQIAN

SEQ ID NO: 43126 - protein, 10 aa, Borrelia garinii PBi
PGNPMQIANQ

SEQ ID NO: 43127 - protein, 10 aa, Borrelia garinii PBi
GNPMQIANQA

SEQ ID NO: 43128 - protein, 10 aa, Borrelia garinii PBi
NPMQIANQAN

SEQ ID NO: 43129 - protein, 10 aa, Borrelia garinii PBi
PMQIANQANQ

SEQ ID NO: 43130 - protein, 10 aa, Borrelia garinii PBi
MQIANQANQA

SEQ ID NO: 43131 - protein, 10 aa, Borrelia garinii PBi
QIANQANQAN

SEQ ID NO: 43132 - protein, 10 aa, Borrelia garinii PBi
IANQANQANQ

SEQ ID NO: 43133 - protein, 10 aa, Borrelia garinii PBi
ANQANQANQA

SEQ ID NO: 43134 - protein, 10 aa, Borrelia garinii PBi
NQANQANQAN

SEQ ID NO: 43135 - protein, 10 aa, Borrelia garinii PBi
QANQANQANQ

SEQ ID NO: 43136 - protein, 10 aa, Borrelia garinii PBi
ANQANQANQA

SEQ ID NO: 43137 - protein, 10 aa, Borrelia garinii PBi
NQANQANQAN

SEQ ID NO: 43138 - protein, 10 aa, Borrelia garinii PBi
QANQANQANQ

SEQ ID NO: 43139 - protein, 10 aa, Borrelia garinii PBi
ANQANQANQA

SEQ ID NO: 43140 - protein, 10 aa, Borrelia garinii PBi
NQANQANQAN

SEQ ID NO: 43141 - protein, 10 aa, Borrelia garinii PBi
QANQANQANQ

SEQ ID NO: 43142 - protein, 10 aa, Borrelia garinii PBi
ANQANQANQA

SEQ ID NO: 43143 - protein, 10 aa, Borrelia garinii PBi
NQANQANQAS

SEQ ID NO: 43144 - protein, 10 aa, Borrelia garinii PBi
QANQANQASQ

SEQ ID NO: 43145 - protein, 10 aa, Borrelia garinii PBi
ANQANQASQA

SEQ ID NO: 43146 - protein, 10 aa, Borrelia garinii PBi
NQANQASQAS

SEQ ID NO: 43147 - protein, 10 aa, Borrelia garinii PBi
QANQASQASQ

SEQ ID NO: 43148 - protein, 10 aa, Borrelia garinii PBi
ANQASQASQA

SEQ ID NO: 43149 - protein, 10 aa, Borrelia garinii PBi
NQASQASQAS

SEQ ID NO: 43150 - protein, 10 aa, Borrelia garinii PBi
QASQASQASQ

SEQ ID NO: 43151 - protein, 10 aa, Borrelia garinii PBi
ASQASQASQV

SEQ ID NO: 43152 - protein, 10 aa, Borrelia garinii PBi
SQASQASQVA

SEQ ID NO: 43153 - protein, 10 aa, Borrelia garinii PBi
QASQASQVAS

SEQ ID NO: 43154 - protein, 10 aa, Borrelia garinii PBi
ASQASQVASS

SEQ ID NO: 43155 - protein, 10 aa, Borrelia garinii PBi
SQASQVASSA

SEQ ID NO: 43156 - protein, 10 aa, Borrelia garinii PBi
QASQVASSAS

SEQ ID NO: 43157 - protein, 10 aa, Borrelia garinii PBi
ASQVASSASQ

SEQ ID NO: 43158 - protein, 10 aa, Borrelia garinii PBi
SQVASSASQA

SEQ ID NO: 43159 - protein, 10 aa, Borrelia garinii PBi
QVASSASQAS

SEQ ID NO: 43160 - protein, 10 aa, Borrelia garinii PBi
VASSASQASP

SEQ ID NO: 43161 - protein, 10 aa, Borrelia garinii PBi
ASSASQASPV

SEQ ID NO: 43162 - protein, 10 aa, Borrelia garinii PBi
SSASQASPVA

SEQ ID NO: 43163 - protein, 10 aa, Borrelia garinii PBi
SASQASPVAS

SEQ ID NO: 43164 - protein, 10 aa, Borrelia garinii PBi
ASQASPVASP

SEQ ID NO: 43165 - protein, 10 aa, Borrelia garinii PBi
SQASPVASPA

SEQ ID NO: 43166 - protein, 10 aa, Borrelia garinii PBi
QASPVASPAT

SEQ ID NO: 43167 - protein, 10 aa, Borrelia garinii PBi
ASPVASPATN

SEQ ID NO: 43168 - protein, 10 aa, Borrelia garinii PBi
SPVASPATNV

SEQ ID NO: 43169 - protein, 10 aa, Borrelia garinii PBi
PVASPATNVQ

SEQ ID NO: 43170 - protein, 10 aa, Borrelia garinii PBi
VASPATNVQA

SEQ ID NO: 43171 - protein, 10 aa, Borrelia garinii PBi
ASPATNVQAT

SEQ ID NO: 43172 - protein, 10 aa, Borrelia garinii PBi
SPATNVQATP

SEQ ID NO: 43173 - protein, 10 aa, Borrelia garinii PBi
PATNVQATPP

SEQ ID NO: 43174 - protein, 10 aa, Borrelia garinii PBi
ATNVQATPPK

SEQ ID NO: 43175 - protein, 10 aa, Borrelia garinii PBi
TNVQATPPKQ

SEQ ID NO: 43176 - protein, 10 aa, Borrelia garinii PBi
NVQATPPKQI

SEQ ID NO: 43177 - protein, 10 aa, Borrelia garinii PBi
VQATPPKQIA

SEQ ID NO: 43178 - protein, 10 aa, Borrelia garinii PBi
QATPPKQIAS

SEQ ID NO: 43179 - protein, 10 aa, Borrelia garinii PBi
ATPPKQIASA

SEQ ID NO: 43180 - protein, 10 aa, Borrelia garinii PBi
TPPKQIASAQ

SEQ ID NO: 43181 - protein, 10 aa, Borrelia garinii PBi
PPKQIASAQA

SEQ ID NO: 43182 - protein, 10 aa, Borrelia garinii PBi
PKQIASAQAI

SEQ ID NO: 43183 - protein, 10 aa, Borrelia garinii PBi
KQIASAQAIQ

SEQ ID NO: 43184 - protein, 10 aa, Borrelia garinii PBi
QIASAQAIQT

SEQ ID NO: 43185 - protein, 10 aa, Borrelia garinii PBi
IASAQAIQTV

SEQ ID NO: 43186 - protein, 10 aa, Borrelia garinii PBi
ASAQAIQTVP

SEQ ID NO: 43187 - protein, 10 aa, Borrelia garinii PBi
SAQAIQTVPN

SEQ ID NO: 43188 - protein, 10 aa, Borrelia garinii PBi
AQAIQTVPNN

SEQ ID NO: 43189 - protein, 10 aa, Borrelia garinii PBi
QAIQTVPNNT

SEQ ID NO: 43190 - protein, 10 aa, Borrelia garinii PBi
AIQTVPNNTS

SEQ ID NO: 43191 - protein, 10 aa, Borrelia garinii PBi
IQTVPNNTST

SEQ ID NO: 43192 - protein, 10 aa, Borrelia garinii PBi
QTVPNNTSTP

SEQ ID NO: 43193 - protein, 10 aa, Borrelia garinii PBi
TVPNNTSTPN

SEQ ID NO: 43194 - protein, 10 aa, Borrelia garinii PBi
VPNNTSTPNQ

SEQ ID NO: 43195 - protein, 10 aa, Borrelia garinii PBi
PNNTSTPNQS

SEQ ID NO: 43196 - protein, 10 aa, Borrelia garinii PBi
NNTSTPNQSI

SEQ ID NO: 43197 - protein, 10 aa, Borrelia garinii PBi
NTSTPNQSII

SEQ ID NO: 43198 - protein, 10 aa, Borrelia garinii PBi
TSTPNQSIIK

SEQ ID NO: 43199 - protein, 10 aa, Borrelia garinii PBi
STPNQSIIKP

SEQ ID NO: 43200 - protein, 10 aa, Borrelia garinii PBi
TPNQSIIKPQ

SEQ ID NO: 43201 - protein, 10 aa, Borrelia garinii PBi
PNQSIIKPQQ

SEQ ID NO: 43202 - protein, 10 aa, Borrelia garinii PBi
NQSIIKPQQY

SEQ ID NO: 43203 - protein, 10 aa, Borrelia garinii PBi
QSIIKPQQYT

SEQ ID NO: 43204 - protein, 10 aa, Borrelia garinii PBi
SIIKPQQYTF

SEQ ID NO: 43205 - protein, 10 aa, Borrelia garinii PBi
IIKPQQYTFS

SEQ ID NO: 43206 - protein, 10 aa, Borrelia garinii PBi
IKPQQYTFSS

SEQ ID NO: 43207 - protein, 10 aa, Borrelia garinii PBi
KPQQYTFSSS

SEQ ID NO: 43208 - protein, 10 aa, Borrelia garinii PBi
PQQYTFSSSF

SEQ ID NO: 43209 - protein, 10 aa, Borrelia garinii PBi
QQYTFSSSFS

SEQ ID NO: 43210 - protein, 10 aa, Borrelia garinii PBi
QYTFSSSFSQ

SEQ ID NO: 43211 - protein, 10 aa, Borrelia garinii PBi
YTFSSSFSQP

SEQ ID NO: 43212 - protein, 10 aa, Borrelia garinii PBi
TFSSSFSQPT

SEQ ID NO: 43213 - protein, 10 aa, Borrelia garinii PBi
FSSSFSQPTS

SEQ ID NO: 43214 - protein, 10 aa, Borrelia garinii PBi
SSSFSQPTSQ

SEQ ID NO: 43215 - protein, 10 aa, Borrelia garinii PBi
SSFSQPTSQT

SEQ ID NO: 43216 - protein, 10 aa, Borrelia garinii PBi
SFSQPTSQTN

SEQ ID NO: 43217 - protein, 10 aa, Borrelia garinii PBi
FSQPTSQTNF

SEQ ID NO: 43218 - protein, 10 aa, Borrelia garinii PBi
SQPTSQTNFN

SEQ ID NO: 43219 - protein, 10 aa, Borrelia garinii PBi
QPTSQTNFNN

SEQ ID NO: 43220 - protein, 10 aa, Borrelia garinii PBi
PTSQTNFNNS

SEQ ID NO: 43221 - protein, 10 aa, Borrelia garinii PBi
TSQTNFNNSQ

SEQ ID NO: 43222 - protein, 10 aa, Borrelia garinii PBi
SQTNFNNSQS

SEQ ID NO: 43223 - protein, 10 aa, Borrelia garinii PBi
QTNFNNSQSN

SEQ ID NO: 43224 - protein, 10 aa, Borrelia garinii PBi
TNFNNSQSNN

SEQ ID NO: 43225 - protein, 10 aa, Borrelia garinii PBi
NFNNSQSNNV

SEQ ID NO: 43226 - protein, 10 aa, Borrelia garinii PBi
FNNSQSNNVL

SEQ ID NO: 43227 - protein, 10 aa, Borrelia garinii PBi
NNSQSNNVLT

SEQ ID NO: 43228 - protein, 10 aa, Borrelia garinii PBi
NSQSNNVLTN

SEQ ID NO: 43229 - protein, 10 aa, Borrelia garinii PBi
SQSNNVLTNY

SEQ ID NO: 43230 - protein, 10 aa, Borrelia garinii PBi
QSNNVLTNYR

SEQ ID NO: 43231 - protein, 10 aa, Borrelia garinii PBi
SNNVLTNYRH

SEQ ID NO: 43232 - protein, 10 aa, Borrelia garinii PBi
NNVLTNYRHQ

SEQ ID NO: 43233 - protein, 10 aa, Borrelia garinii PBi
NVLTNYRHQT

SEQ ID NO: 43234 - protein, 10 aa, Borrelia garinii PBi
VLTNYRHQTQ

SEQ ID NO: 43235 - protein, 10 aa, Borrelia garinii PBi
LTNYRHQTQP

SEQ ID NO: 43236 - protein, 10 aa, Borrelia garinii PBi
TNYRHQTQPS

SEQ ID NO: 43237 - protein, 10 aa, Borrelia garinii PBi
NYRHQTQPSF

SEQ ID NO: 43238 - protein, 10 aa, Borrelia garinii PBi
YRHQTQPSFV

SEQ ID NO: 43239 - protein, 10 aa, Borrelia garinii PBi
RHQTQPSFVV

SEQ ID NO: 43240 - protein, 10 aa, Borrelia garinii PBi
HQTQPSFVVP

SEQ ID NO: 43241 - protein, 10 aa, Borrelia garinii PBi
QTQPSFVVPV

SEQ ID NO: 43242 - protein, 10 aa, Borrelia garinii PBi
TQPSFVVPVY

SEQ ID NO: 43243 - protein, 10 aa, Borrelia garinii PBi
QPSFVVPVYS

SEQ ID NO: 43244 - protein, 10 aa, Borrelia garinii PBi
PSFVVPVYSG

SEQ ID NO: 43245 - protein, 10 aa, Borrelia garinii PBi
SFVVPVYSGN

SEQ ID NO: 43246 - protein, 10 aa, Borrelia garinii PBi
FVVPVYSGNS

SEQ ID NO: 43247 - protein, 10 aa, Borrelia garinii PBi
VVPVYSGNSP

SEQ ID NO: 43248 - protein, 10 aa, Borrelia garinii PBi
VPVYSGNSPL

SEQ ID NO: 43249 - protein, 10 aa, Borrelia garinii PBi
PVYSGNSPLQ

SEQ ID NO: 43250 - protein, 10 aa, Borrelia garinii PBi
VYSGNSPLQK

SEQ ID NO: 43251 - protein, 10 aa, Borrelia garinii PBi
YSGNSPLQKL

SEQ ID NO: 43252 - protein, 10 aa, Borrelia garinii PBi
SGNSPLQKLK

SEQ ID NO: 43253 - protein, 10 aa, Borrelia garinii PBi
GNSPLQKLKN

SEQ ID NO: 43254 - protein, 10 aa, Borrelia garinii PBi
NSPLQKLKNN

SEQ ID NO: 43255 - protein, 10 aa, Borrelia garinii PBi
SPLQKLKNNL

SEQ ID NO: 43256 - protein, 10 aa, Borrelia garinii PBi
PLQKLKNNLL

SEQ ID NO: 43257 - protein, 10 aa, Borrelia garinii PBi
LQKLKNNLLR

SEQ ID NO: 43258 - protein, 10 aa, Borrelia garinii PBi
QKLKNNLLRR

SEQ ID NO: 43259 - protein, 10 aa, Borrelia garinii PBi
KLKNNLLRRI

SEQ ID NO: 43260 - protein, 10 aa, Borrelia garinii PBi
LKNNLLRRIA

SEQ ID NO: 43261 - protein, 10 aa, Borrelia garinii PBi
KNNLLRRIAE

SEQ ID NO: 43262 - protein, 10 aa, Borrelia garinii PBi
NNLLRRIAEE

SEQ ID NO: 43263 - protein, 10 aa, Borrelia garinii PBi
NLLRRIAEEK

SEQ ID NO: 43264 - protein, 10 aa, Borrelia garinii PBi
LLRRIAEEKN

SEQ ID NO: 43265 - protein, 10 aa, Borrelia garinii PBi
LRRIAEEKNK

SEQ ID NO: 43266 - protein, 10 aa, Borrelia garinii PBi
RRIAEEKNKT

SEQ ID NO: 43267 - protein, 10 aa, Borrelia garinii PBi
RIAEEKNKTH

SEQ ID NO: 43268 - protein, 10 aa, Borrelia garinii PBi
IAEEKNKTHN

SEQ ID NO: 43269 - protein, 10 aa, Borrelia garinii PBi
AEEKNKTHNH

SEQ ID NO: 43270 - protein, 10 aa, Borrelia garinii PBi
EEKNKTHNHG

SEQ ID NO: 43271 - protein, 10 aa, Borrelia garinii PBi
EKNKTHNHGF

SEQ ID NO: 43272 - protein, 10 aa, Borrelia garinii PBi
KNKTHNHGFR

SEQ ID NO: 43273 - protein, 10 aa, Borrelia garinii PBi
NKTHNHGFRE

SEQ ID NO: 43274 - protein, 10 aa, Borrelia garinii PBi
KTHNHGFRET

SEQ ID NO: 43275 - protein, 10 aa, Borrelia garinii PBi
THNHGFRETY

SEQ ID NO: 43276 - protein, 10 aa, Borrelia garinii PBi
HNHGFRETYD

SEQ ID NO: 43277 - protein, 10 aa, Borrelia garinii PBi
NHGFRETYDQ

SEQ ID NO: 43278 - protein, 10 aa, Borrelia garinii PBi
HGFRETYDQF

SEQ ID NO: 43279 - protein, 10 aa, Borrelia garinii PBi
GFRETYDQFK

SEQ ID NO: 43280 - protein, 10 aa, Borrelia garinii PBi
FRETYDQFKM

SEQ ID NO: 43281 - protein, 10 aa, Borrelia garinii PBi
RETYDQFKMK

SEQ ID NO: 43282 - protein, 10 aa, Borrelia garinii PBi
ETYDQFKMKD

SEQ ID NO: 43283 - protein, 10 aa, Borrelia garinii PBi
TYDQFKMKDS

SEQ ID NO: 43284 - protein, 10 aa, Borrelia garinii PBi
YDQFKMKDSA

SEQ ID NO: 43285 - protein, 10 aa, Borrelia garinii PBi
DQFKMKDSAF

SEQ ID NO: 43286 - protein, 10 aa, Borrelia garinii PBi
QFKMKDSAFT

SEQ ID NO: 43287 - protein, 10 aa, Borrelia garinii PBi
FKMKDSAFTL

SEQ ID NO: 43288 - protein, 10 aa, Borrelia garinii PBi
KMKDSAFTLL

SEQ ID NO: 43289 - protein, 10 aa, Borrelia garinii PBi
MKDSAFTLLD

SEQ ID NO: 43290 - protein, 10 aa, Borrelia garinii PBi
KDSAFTLLDV

SEQ ID NO: 43291 - protein, 10 aa, Borrelia garinii PBi
DSAFTLLDVI

SEQ ID NO: 43292 - protein, 10 aa, Borrelia garinii PBi
SAFTLLDVIS

SEQ ID NO: 43293 - protein, 10 aa, Borrelia garinii PBi
AFTLLDVISN

SEQ ID NO: 43294 - protein, 10 aa, Borrelia garinii PBi
FTLLDVISNI

SEQ ID NO: 43295 - protein, 10 aa, Borrelia garinii PBi
TLLDVISNIS

SEQ ID NO: 43296 - protein, 10 aa, Borrelia garinii PBi
LLDVISNISV

SEQ ID NO: 43297 - protein, 10 aa, Borrelia garinii PBi
LDVISNISVF

SEQ ID NO: 43298 - protein, 10 aa, Borrelia garinii PBi
DVISNISVFD

SEQ ID NO: 43299 - protein, 10 aa, Borrelia garinii PBi
VISNISVFDR

SEQ ID NO: 43300 - protein, 10 aa, Borrelia garinii PBi
ISNISVFDRG

SEQ ID NO: 43301 - protein, 10 aa, Borrelia garinii PBi
SNISVFDRGS

SEQ ID NO: 43302 - protein, 10 aa, Borrelia garinii PBi
NISVFDRGSA

SEQ ID NO: 43303 - protein, 10 aa, Borrelia garinii PBi
ISVFDRGSAP

SEQ ID NO: 43304 - protein, 10 aa, Borrelia garinii PBi
SVFDRGSAPQ

SEQ ID NO: 43305 - protein, 10 aa, Borrelia garinii PBi
VFDRGSAPQL

SEQ ID NO: 43306 - protein, 10 aa, Borrelia garinii PBi
FDRGSAPQLS

SEQ ID NO: 43307 - protein, 10 aa, Borrelia garinii PBi
DRGSAPQLSS

SEQ ID NO: 43308 - protein, 10 aa, Borrelia garinii PBi
RGSAPQLSSN

SEQ ID NO: 43309 - protein, 10 aa, Borrelia garinii PBi
GSAPQLSSNT

SEQ ID NO: 43310 - protein, 10 aa, Borrelia garinii PBi
SAPQLSSNTP

SEQ ID NO: 43311 - protein, 10 aa, Borrelia garinii PBi
APQLSSNTPE

SEQ ID NO: 43312 - protein, 10 aa, Borrelia garinii PBi
PQLSSNTPEA

SEQ ID NO: 43313 - protein, 10 aa, Borrelia garinii PBi
QLSSNTPEAE

SEQ ID NO: 43314 - protein, 10 aa, Borrelia garinii PBi
LSSNTPEAES

SEQ ID NO: 43315 - protein, 10 aa, Borrelia garinii PBi
SSNTPEAESE

SEQ ID NO: 43316 - protein, 10 aa, Borrelia garinii PBi
SNTPEAESER

SEQ ID NO: 43317 - protein, 10 aa, Borrelia garinii PBi
NTPEAESERN

SEQ ID NO: 43318 - protein, 10 aa, Borrelia garinii PBi
TPEAESERNR

SEQ ID NO: 43319 - protein, 10 aa, Borrelia garinii PBi
PEAESERNRL

SEQ ID NO: 43320 - protein, 10 aa, Borrelia garinii PBi
EAESERNRLY

SEQ ID NO: 43321 - protein, 10 aa, Borrelia garinii PBi
AESERNRLYA

SEQ ID NO: 43322 - protein, 10 aa, Borrelia garinii PBi
ESERNRLYAM

SEQ ID NO: 43323 - protein, 10 aa, Borrelia garinii PBi
SERNRLYAMM

SEQ ID NO: 43324 - protein, 10 aa, Borrelia garinii PBi
ERNRLYAMMD

SEQ ID NO: 43325 - protein, 10 aa, Borrelia garinii PBi
RNRLYAMMDF

SEQ ID NO: 43326 - protein, 10 aa, Borrelia garinii PBi
NRLYAMMDFD

SEQ ID NO: 43327 - protein, 10 aa, Borrelia garinii PBi
RLYAMMDFDQ

SEQ ID NO: 43328 - protein, 10 aa, Borrelia garinii PBi
LYAMMDFDQA

SEQ ID NO: 43329 - protein, 10 aa, Borrelia garinii PBi
YAMMDFDQAK

SEQ ID NO: 43330 - protein, 10 aa, Borrelia garinii PBi
AMMDFDQAKT

SEQ ID NO: 43331 - protein, 10 aa, Borrelia garinii PBi
MMDFDQAKTT

SEQ ID NO: 43332 - protein, 10 aa, Borrelia garinii PBi
MDFDQAKTTE

SEQ ID NO: 43333 - protein, 10 aa, Borrelia garinii PBi
DFDQAKTTEF

SEQ ID NO: 43334 - protein, 10 aa, Borrelia garinii PBi
FDQAKTTEFG

SEQ ID NO: 43335 - protein, 10 aa, Borrelia garinii PBi
DQAKTTEFGS

SEQ ID NO: 43336 - protein, 10 aa, Borrelia garinii PBi
QAKTTEFGSI

SEQ ID NO: 43337 - protein, 10 aa, Borrelia garinii PBi
AKTTEFGSIM

SEQ ID NO: 43338 - protein, 10 aa, Borrelia garinii PBi
KTTEFGSIMN

SEQ ID NO: 43339 - protein, 10 aa, Borrelia garinii PBi
TTEFGSIMNI

SEQ ID NO: 43340 - protein, 10 aa, Borrelia garinii PBi
TEFGSIMNIL

SEQ ID NO: 43341 - protein, 10 aa, Borrelia garinii PBi
EFGSIMNILY

SEQ ID NO: 43342 - protein, 10 aa, Borrelia garinii PBi
FGSIMNILYQ

SEQ ID NO: 43343 - protein, 10 aa, Borrelia garinii PBi
GSIMNILYQE

SEQ ID NO: 43344 - protein, 10 aa, Borrelia garinii PBi
SIMNILYQEN

SEQ ID NO: 43345 - protein, 10 aa, Borrelia garinii PBi
IMNILYQENQ

SEQ ID NO: 43346 - protein, 10 aa, Borrelia garinii PBi
MNILYQENQN

SEQ ID NO: 43347 - protein, 10 aa, Borrelia garinii PBi
NILYQENQNH

SEQ ID NO: 43348 - protein, 10 aa, Borrelia garinii PBi
ILYQENQNHS

SEQ ID NO: 43349 - protein, 10 aa, Borrelia garinii PBi
LYQENQNHSL

SEQ ID NO: 43350 - protein, 10 aa, Borrelia garinii PBi
YQENQNHSLI

SEQ ID NO: 43351 - protein, 10 aa, Borrelia garinii PBi
QENQNHSLIR

SEQ ID NO: 43352 - protein, 10 aa, Borrelia garinii PBi
ENQNHSLIRS

SEQ ID NO: 43353 - protein, 10 aa, Borrelia garinii PBi
NQNHSLIRSL

SEQ ID NO: 43354 - protein, 10 aa, Borrelia garinii PBi
QNHSLIRSLI

SEQ ID NO: 43355 - protein, 10 aa, Borrelia garinii PBi
NHSLIRSLII

SEQ ID NO: 43356 - protein, 10 aa, Borrelia garinii PBi
HSLIRSLIIS

SEQ ID NO: 43357 - protein, 10 aa, Borrelia garinii PBi
SLIRSLIISG

SEQ ID NO: 43358 - protein, 10 aa, Borrelia garinii PBi
LIRSLIISGL

SEQ ID NO: 43359 - protein, 10 aa, Borrelia garinii PBi
IRSLIISGLG

SEQ ID NO: 43360 - protein, 10 aa, Borrelia garinii PBi
RSLIISGLGI

SEQ ID NO: 43361 - protein, 10 aa, Borrelia garinii PBi
SLIISGLGIQ

SEQ ID NO: 43362 - protein, 10 aa, Borrelia garinii PBi
LIISGLGIQI

SEQ ID NO: 43363 - protein, 10 aa, Borrelia garinii PBi
IISGLGIQIS

SEQ ID NO: 43364 - protein, 10 aa, Borrelia garinii PBi
ISGLGIQISL

SEQ ID NO: 43365 - protein, 10 aa, Borrelia garinii PBi
SGLGIQISLE

SEQ ID NO: 43366 - protein, 10 aa, Borrelia garinii PBi
GLGIQISLES

SEQ ID NO: 43367 - protein, 10 aa, Borrelia garinii PBi
LGIQISLEST

SEQ ID NO: 43368 - protein, 10 aa, Borrelia garinii PBi
GIQISLESTL

SEQ ID NO: 43369 - protein, 10 aa, Borrelia garinii PBi
IQISLESTLE

SEQ ID NO: 43370 - protein, 10 aa, Borrelia garinii PBi
QISLESTLEE

SEQ ID NO: 43371 - protein, 10 aa, Borrelia garinii PBi
ISLESTLEEI

SEQ ID NO: 43372 - protein, 10 aa, Borrelia garinii PBi
SLESTLEEIE

SEQ ID NO: 43373 - protein, 10 aa, Borrelia garinii PBi
LESTLEEIEK

SEQ ID NO: 43374 - protein, 10 aa, Borrelia garinii PBi
ESTLEEIEKK

SEQ ID NO: 43375 - protein, 10 aa, Borrelia garinii PBi
STLEEIEKKI

SEQ ID NO: 43376 - protein, 10 aa, Borrelia garinii PBi
TLEEIEKKIE

SEQ ID NO: 43377 - protein, 10 aa, Borrelia garinii PBi
LEEIEKKIES

SEQ ID NO: 43378 - protein, 10 aa, Borrelia garinii PBi
EEIEKKIESF

SEQ ID NO: 43379 - protein, 10 aa, Borrelia garinii PBi
EIEKKIESFN

SEQ ID NO: 43380 - protein, 10 aa, Borrelia garinii PBi
IEKKIESFNT

SEQ ID NO: 43381 - protein, 10 aa, Borrelia garinii PBi
EKKIESFNTQ

SEQ ID NO: 43382 - protein, 10 aa, Borrelia garinii PBi
KKIESFNTQY

SEQ ID NO: 43383 - protein, 10 aa, Borrelia garinii PBi
KIESFNTQYL

SEQ ID NO: 43384 - protein, 10 aa, Borrelia garinii PBi
IESFNTQYLN

SEQ ID NO: 43385 - protein, 10 aa, Borrelia garinii PBi
ESFNTQYLNT

SEQ ID NO: 43386 - protein, 10 aa, Borrelia garinii PBi
SFNTQYLNTI

SEQ ID NO: 43387 - protein, 10 aa, Borrelia garinii PBi
FNTQYLNTII

SEQ ID NO: 43388 - protein, 10 aa, Borrelia garinii PBi
NTQYLNTIIN

SEQ ID NO: 43389 - protein, 10 aa, Borrelia garinii PBi
TQYLNTIINS

SEQ ID NO: 43390 - protein, 10 aa, Borrelia garinii PBi
QYLNTIINSY

SEQ ID NO: 43391 - protein, 10 aa, Borrelia garinii PBi
YLNTIINSYT

SEQ ID NO: 43392 - protein, 10 aa, Borrelia garinii PBi
LNTIINSYTF

SEQ ID NO: 43393 - protein, 10 aa, Borrelia garinii PBi
NTIINSYTFK

SEQ ID NO: 43394 - protein, 10 aa, Borrelia garinii PBi
TIINSYTFKD

SEQ ID NO: 43395 - protein, 10 aa, Borrelia garinii PBi
IINSYTFKDK

SEQ ID NO: 43396 - protein, 10 aa, Borrelia garinii PBi
INSYTFKDKL

SEQ ID NO: 43397 - protein, 10 aa, Borrelia garinii PBi
NSYTFKDKLK

SEQ ID NO: 43398 - protein, 10 aa, Borrelia garinii PBi
SYTFKDKLKE

SEQ ID NO: 43399 - protein, 10 aa, Borrelia garinii PBi
YTFKDKLKEL

SEQ ID NO: 43400 - protein, 10 aa, Borrelia garinii PBi
TFKDKLKELE

SEQ ID NO: 43401 - protein, 10 aa, Borrelia garinii PBi
FKDKLKELES

SEQ ID NO: 43402 - protein, 10 aa, Borrelia garinii PBi
KDKLKELESK

SEQ ID NO: 43403 - protein, 10 aa, Borrelia garinii PBi
DKLKELESKL

SEQ ID NO: 43404 - protein, 10 aa, Borrelia garinii PBi
KLKELESKLN

SEQ ID NO: 43405 - protein, 10 aa, Borrelia garinii PBi
LKELESKLNS

SEQ ID NO: 43406 - protein, 10 aa, Borrelia garinii PBi
KELESKLNSI

SEQ ID NO: 43407 - protein, 10 aa, Borrelia garinii PBi
ELESKLNSIL

SEQ ID NO: 43408 - protein, 10 aa, Borrelia garinii PBi
LESKLNSILA

SEQ ID NO: 43409 - protein, 10 aa, Borrelia garinii PBi
ESKLNSILAE

SEQ ID NO: 43410 - protein, 10 aa, Borrelia garinii PBi
SKLNSILAEK

SEQ ID NO: 43411 - protein, 10 aa, Borrelia garinii PBi
KLNSILAEKK

SEQ ID NO: 43412 - protein, 10 aa, Borrelia garinii PBi
LNSILAEKKE

SEQ ID NO: 43413 - protein, 10 aa, Borrelia garinii PBi
NSILAEKKEW

SEQ ID NO: 43414 - protein, 10 aa, Borrelia garinii PBi
SILAEKKEWL

SEQ ID NO: 43415 - protein, 10 aa, Borrelia garinii PBi
ILAEKKEWLN

SEQ ID NO: 43416 - protein, 10 aa, Borrelia garinii PBi
LAEKKEWLNY

SEQ ID NO: 43417 - protein, 10 aa, Borrelia garinii PBi
AEKKEWLNYA

SEQ ID NO: 43418 - protein, 10 aa, Borrelia garinii PBi
EKKEWLNYAD

SEQ ID NO: 43419 - protein, 10 aa, Borrelia garinii PBi
KKEWLNYADA

SEQ ID NO: 43420 - protein, 10 aa, Borrelia garinii PBi
KEWLNYADAI

SEQ ID NO: 43421 - protein, 10 aa, Borrelia garinii PBi
EWLNYADAII

SEQ ID NO: 43422 - protein, 10 aa, Borrelia garinii PBi
WLNYADAIIT

SEQ ID NO: 43423 - protein, 10 aa, Borrelia garinii PBi
LNYADAIITN

SEQ ID NO: 43424 - protein, 10 aa, Borrelia garinii PBi
NYADAIITNT

SEQ ID NO: 43425 - protein, 10 aa, Borrelia garinii PBi
YADAIITNTS

SEQ ID NO: 43426 - protein, 10 aa, Borrelia garinii PBi
ADAIITNTSS

SEQ ID NO: 43427 - protein, 10 aa, Borrelia garinii PBi
DAIITNTSSN

SEQ ID NO: 43428 - protein, 10 aa, Borrelia garinii PBi
AIITNTSSNS

SEQ ID NO: 43429 - protein, 10 aa, Borrelia garinii PBi
IITNTSSNSK

SEQ ID NO: 43430 - protein, 10 aa, Borrelia garinii PBi
ITNTSSNSKR

SEQ ID NO: 43431 - protein, 10 aa, Borrelia garinii PBi
TNTSSNSKRN

SEQ ID NO: 43432 - protein, 10 aa, Borrelia garinii PBi
NTSSNSKRND

SEQ ID NO: 43433 - protein, 10 aa, Borrelia garinii PBi
TSSNSKRNDP

SEQ ID NO: 43434 - protein, 10 aa, Borrelia garinii PBi
SSNSKRNDPQ

SEQ ID NO: 43435 - protein, 10 aa, Borrelia garinii PBi
SNSKRNDPQS

SEQ ID NO: 43436 - protein, 10 aa, Borrelia garinii PBi
NSKRNDPQSL

SEQ ID NO: 43437 - protein, 10 aa, Borrelia garinii PBi
SKRNDPQSLG

SEQ ID NO: 43438 - protein, 10 aa, Borrelia garinii PBi
KRNDPQSLGQ

SEQ ID NO: 43439 - protein, 10 aa, Borrelia garinii PBi
RNDPQSLGQY

SEQ ID NO: 43440 - protein, 10 aa, Borrelia garinii PBi
NDPQSLGQYI

SEQ ID NO: 43441 - protein, 10 aa, Borrelia garinii PBi
DPQSLGQYIK

SEQ ID NO: 43442 - protein, 10 aa, Borrelia garinii PBi
PQSLGQYIKN

SEQ ID NO: 43443 - protein, 10 aa, Borrelia garinii PBi
QSLGQYIKNK

SEQ ID NO: 43444 - protein, 10 aa, Borrelia garinii PBi
SLGQYIKNKY

SEQ ID NO: 43445 - protein, 10 aa, Borrelia garinii PBi
LGQYIKNKYL

SEQ ID NO: 43446 - protein, 10 aa, Borrelia garinii PBi
GQYIKNKYLD

SEQ ID NO: 43447 - protein, 10 aa, Borrelia garinii PBi
QYIKNKYLDK

SEQ ID NO: 43448 - protein, 10 aa, Borrelia garinii PBi
YIKNKYLDKM

SEQ ID NO: 43449 - protein, 10 aa, Borrelia garinii PBi
IKNKYLDKMQ

SEQ ID NO: 43450 - protein, 10 aa, Borrelia garinii PBi
KNKYLDKMQD

SEQ ID NO: 43451 - protein, 10 aa, Borrelia garinii PBi
NKYLDKMQDA

SEQ ID NO: 43452 - protein, 10 aa, Borrelia garinii PBi
KYLDKMQDAR

SEQ ID NO: 43453 - protein, 10 aa, Borrelia garinii PBi
YLDKMQDARQ

SEQ ID NO: 43454 - protein, 10 aa, Borrelia garinii PBi
LDKMQDARQS

SEQ ID NO: 43455 - protein, 10 aa, Borrelia garinii PBi
DKMQDARQSA

SEQ ID NO: 43456 - protein, 10 aa, Borrelia garinii PBi
KMQDARQSAL

SEQ ID NO: 43457 - protein, 10 aa, Borrelia garinii PBi
MQDARQSALD

SEQ ID NO: 43458 - protein, 10 aa, Borrelia garinii PBi
QDARQSALDL

SEQ ID NO: 43459 - protein, 10 aa, Borrelia garinii PBi
DARQSALDLY

SEQ ID NO: 43460 - protein, 10 aa, Borrelia garinii PBi
ARQSALDLYL

SEQ ID NO: 43461 - protein, 10 aa, Borrelia garinii PBi
RQSALDLYLN

SEQ ID NO: 43462 - protein, 10 aa, Borrelia garinii PBi
QSALDLYLNI

SEQ ID NO: 43463 - protein, 10 aa, Borrelia garinii PBi
SALDLYLNIT

SEQ ID NO: 43464 - protein, 10 aa, Borrelia garinii PBi
ALDLYLNITE

SEQ ID NO: 43465 - protein, 10 aa, Borrelia garinii PBi
LDLYLNITEI

SEQ ID NO: 43466 - protein, 10 aa, Borrelia garinii PBi
DLYLNITEIR

SEQ ID NO: 43467 - protein, 11 aa, Borrelia garinii PBi
MSSCTIDANLN

SEQ ID NO: 43468 - protein, 11 aa, Borrelia garinii PBi
SSCTIDANLNK

SEQ ID NO: 43469 - protein, 11 aa, Borrelia garinii PBi
SCTIDANLNKD

SEQ ID NO: 43470 - protein, 11 aa, Borrelia garinii PBi
CTIDANLNKDY

SEQ ID NO: 43471 - protein, 11 aa, Borrelia garinii PBi
TIDANLNKDYK

SEQ ID NO: 43472 - protein, 11 aa, Borrelia garinii PBi
IDANLNKDYKN

SEQ ID NO: 43473 - protein, 11 aa, Borrelia garinii PBi
DANLNKDYKNK

SEQ ID NO: 43474 - protein, 11 aa, Borrelia garinii PBi
ANLNKDYKNKV

SEQ ID NO: 43475 - protein, 11 aa, Borrelia garinii PBi
NLNKDYKNKVE

SEQ ID NO: 43476 - protein, 11 aa, Borrelia garinii PBi
LNKDYKNKVEE

SEQ ID NO: 43477 - protein, 11 aa, Borrelia garinii PBi
NKDYKNKVEEL

SEQ ID NO: 43478 - protein, 11 aa, Borrelia garinii PBi
KDYKNKVEELL

SEQ ID NO: 43479 - protein, 11 aa, Borrelia garinii PBi
DYKNKVEELLN

SEQ ID NO: 43480 - protein, 11 aa, Borrelia garinii PBi
YKNKVEELLNS

SEQ ID NO: 43481 - protein, 11 aa, Borrelia garinii PBi
KNKVEELLNSS

SEQ ID NO: 43482 - protein, 11 aa, Borrelia garinii PBi
NKVEELLNSST

SEQ ID NO: 43483 - protein, 11 aa, Borrelia garinii PBi
KVEELLNSSTD

SEQ ID NO: 43484 - protein, 11 aa, Borrelia garinii PBi
VEELLNSSTDD

SEQ ID NO: 43485 - protein, 11 aa, Borrelia garinii PBi
EELLNSSTDDQ

SEQ ID NO: 43486 - protein, 11 aa, Borrelia garinii PBi
ELLNSSTDDQA

SEQ ID NO: 43487 - protein, 11 aa, Borrelia garinii PBi
LLNSSTDDQAK

SEQ ID NO: 43488 - protein, 11 aa, Borrelia garinii PBi
LNSSTDDQAKI

SEQ ID NO: 43489 - protein, 11 aa, Borrelia garinii PBi
NSSTDDQAKIS

SEQ ID NO: 43490 - protein, 11 aa, Borrelia garinii PBi
SSTDDQAKISI

SEQ ID NO: 43491 - protein, 11 aa, Borrelia garinii PBi
STDDQAKISIN

SEQ ID NO: 43492 - protein, 11 aa, Borrelia garinii PBi
TDDQAKISINT

SEQ ID NO: 43493 - protein, 11 aa, Borrelia garinii PBi
DDQAKISINTG

SEQ ID NO: 43494 - protein, 11 aa, Borrelia garinii PBi
DQAKISINTGS

SEQ ID NO: 43495 - protein, 11 aa, Borrelia garinii PBi
QAKISINTGSN

SEQ ID NO: 43496 - protein, 11 aa, Borrelia garinii PBi
AKISINTGSNA

SEQ ID NO: 43497 - protein, 11 aa, Borrelia garinii PBi
KISINTGSNAT

SEQ ID NO: 43498 - protein, 11 aa, Borrelia garinii PBi
ISINTGSNATK

SEQ ID NO: 43499 - protein, 11 aa, Borrelia garinii PBi
SINTGSNATKN

SEQ ID NO: 43500 - protein, 11 aa, Borrelia garinii PBi
INTGSNATKNK

SEQ ID NO: 43501 - protein, 11 aa, Borrelia garinii PBi
NTGSNATKNKT

SEQ ID NO: 43502 - protein, 11 aa, Borrelia garinii PBi
TGSNATKNKTN

SEQ ID NO: 43503 - protein, 11 aa, Borrelia garinii PBi
GSNATKNKTNI

SEQ ID NO: 43504 - protein, 11 aa, Borrelia garinii PBi
SNATKNKTNIK

SEQ ID NO: 43505 - protein, 11 aa, Borrelia garinii PBi
NATKNKTNIKV

SEQ ID NO: 43506 - protein, 11 aa, Borrelia garinii PBi
ATKNKTNIKVA

SEQ ID NO: 43507 - protein, 11 aa, Borrelia garinii PBi
TKNKTNIKVAG

SEQ ID NO: 43508 - protein, 11 aa, Borrelia garinii PBi
KNKTNIKVAGL

SEQ ID NO: 43509 - protein, 11 aa, Borrelia garinii PBi
NKTNIKVAGLQ

SEQ ID NO: 43510 - protein, 11 aa, Borrelia garinii PBi
KTNIKVAGLQK

SEQ ID NO: 43511 - protein, 11 aa, Borrelia garinii PBi
TNIKVAGLQKN

SEQ ID NO: 43512 - protein, 11 aa, Borrelia garinii PBi
NIKVAGLQKNT

SEQ ID NO: 43513 - protein, 11 aa, Borrelia garinii PBi
IKVAGLQKNTQ

SEQ ID NO: 43514 - protein, 11 aa, Borrelia garinii PBi
KVAGLQKNTQS

SEQ ID NO: 43515 - protein, 11 aa, Borrelia garinii PBi
VAGLQKNTQSK

SEQ ID NO: 43516 - protein, 11 aa, Borrelia garinii PBi
AGLQKNTQSKK

SEQ ID NO: 43517 - protein, 11 aa, Borrelia garinii PBi
GLQKNTQSKKN

SEQ ID NO: 43518 - protein, 11 aa, Borrelia garinii PBi
LQKNTQSKKNN

SEQ ID NO: 43519 - protein, 11 aa, Borrelia garinii PBi
QKNTQSKKNNN

SEQ ID NO: 43520 - protein, 11 aa, Borrelia garinii PBi
KNTQSKKNNNL

SEQ ID NO: 43521 - protein, 11 aa, Borrelia garinii PBi
NTQSKKNNNLQ

SEQ ID NO: 43522 - protein, 11 aa, Borrelia garinii PBi
TQSKKNNNLQG

SEQ ID NO: 43523 - protein, 11 aa, Borrelia garinii PBi
QSKKNNNLQGL

SEQ ID NO: 43524 - protein, 11 aa, Borrelia garinii PBi
SKKNNNLQGLN

SEQ ID NO: 43525 - protein, 11 aa, Borrelia garinii PBi
KKNNNLQGLNP

SEQ ID NO: 43526 - protein, 11 aa, Borrelia garinii PBi
KNNNLQGLNPA

SEQ ID NO: 43527 - protein, 11 aa, Borrelia garinii PBi
NNNLQGLNPAN

SEQ ID NO: 43528 - protein, 11 aa, Borrelia garinii PBi
NNLQGLNPANQ

SEQ ID NO: 43529 - protein, 11 aa, Borrelia garinii PBi
NLQGLNPANQV

SEQ ID NO: 43530 - protein, 11 aa, Borrelia garinii PBi
LQGLNPANQVN

SEQ ID NO: 43531 - protein, 11 aa, Borrelia garinii PBi
QGLNPANQVNP

SEQ ID NO: 43532 - protein, 11 aa, Borrelia garinii PBi
GLNPANQVNPG

SEQ ID NO: 43533 - protein, 11 aa, Borrelia garinii PBi
LNPANQVNPGN

SEQ ID NO: 43534 - protein, 11 aa, Borrelia garinii PBi
NPANQVNPGNP

SEQ ID NO: 43535 - protein, 11 aa, Borrelia garinii PBi
PANQVNPGNPM

SEQ ID NO: 43536 - protein, 11 aa, Borrelia garinii PBi
ANQVNPGNPMQ

SEQ ID NO: 43537 - protein, 11 aa, Borrelia garinii PBi
NQVNPGNPMQI

SEQ ID NO: 43538 - protein, 11 aa, Borrelia garinii PBi
QVNPGNPMQIA

SEQ ID NO: 43539 - protein, 11 aa, Borrelia garinii PBi
VNPGNPMQIAN

SEQ ID NO: 43540 - protein, 11 aa, Borrelia garinii PBi
NPGNPMQIANQ

SEQ ID NO: 43541 - protein, 11 aa, Borrelia garinii PBi
PGNPMQIANQA

SEQ ID NO: 43542 - protein, 11 aa, Borrelia garinii PBi
GNPMQIANQAN

SEQ ID NO: 43543 - protein, 11 aa, Borrelia garinii PBi
NPMQIANQANQ

SEQ ID NO: 43544 - protein, 11 aa, Borrelia garinii PBi
PMQIANQANQA

SEQ ID NO: 43545 - protein, 11 aa, Borrelia garinii PBi
MQIANQANQAN

SEQ ID NO: 43546 - protein, 11 aa, Borrelia garinii PBi
QIANQANQANQ

SEQ ID NO: 43547 - protein, 11 aa, Borrelia garinii PBi
IANQANQANQA

SEQ ID NO: 43548 - protein, 11 aa, Borrelia garinii PBi
ANQANQANQAN

SEQ ID NO: 43549 - protein, 11 aa, Borrelia garinii PBi
NQANQANQANQ

SEQ ID NO: 43550 - protein, 11 aa, Borrelia garinii PBi
QANQANQANQA

SEQ ID NO: 43551 - protein, 11 aa, Borrelia garinii PBi
ANQANQANQAN

SEQ ID NO: 43552 - protein, 11 aa, Borrelia garinii PBi
NQANQANQANQ

SEQ ID NO: 43553 - protein, 11 aa, Borrelia garinii PBi
QANQANQANQA

SEQ ID NO: 43554 - protein, 11 aa, Borrelia garinii PBi
ANQANQANQAN

SEQ ID NO: 43555 - protein, 11 aa, Borrelia garinii PBi
NQANQANQANQ

SEQ ID NO: 43556 - protein, 11 aa, Borrelia garinii PBi
QANQANQANQA

SEQ ID NO: 43557 - protein, 11 aa, Borrelia garinii PBi
ANQANQANQAS

SEQ ID NO: 43558 - protein, 11 aa, Borrelia garinii PBi
NQANQANQASQ

SEQ ID NO: 43559 - protein, 11 aa, Borrelia garinii PBi
QANQANQASQA

SEQ ID NO: 43560 - protein, 11 aa, Borrelia garinii PBi
ANQANQASQAS

SEQ ID NO: 43561 - protein, 11 aa, Borrelia garinii PBi
NQANQASQASQ

SEQ ID NO: 43562 - protein, 11 aa, Borrelia garinii PBi
QANQASQASQA

SEQ ID NO: 43563 - protein, 11 aa, Borrelia garinii PBi
ANQASQASQAS

SEQ ID NO: 43564 - protein, 11 aa, Borrelia garinii PBi
NQASQASQASQ

SEQ ID NO: 43565 - protein, 11 aa, Borrelia garinii PBi
QASQASQASQV

SEQ ID NO: 43566 - protein, 11 aa, Borrelia garinii PBi
ASQASQASQVA

SEQ ID NO: 43567 - protein, 11 aa, Borrelia garinii PBi
SQASQASQVAS

SEQ ID NO: 43568 - protein, 11 aa, Borrelia garinii PBi
QASQASQVASS

SEQ ID NO: 43569 - protein, 11 aa, Borrelia garinii PBi
ASQASQVASSA

SEQ ID NO: 43570 - protein, 11 aa, Borrelia garinii PBi
SQASQVASSAS

SEQ ID NO: 43571 - protein, 11 aa, Borrelia garinii PBi
QASQVASSASQ

SEQ ID NO: 43572 - protein, 11 aa, Borrelia garinii PBi
ASQVASSASQA

SEQ ID NO: 43573 - protein, 11 aa, Borrelia garinii PBi
SQVASSASQAS

SEQ ID NO: 43574 - protein, 11 aa, Borrelia garinii PBi
QVASSASQASP

SEQ ID NO: 43575 - protein, 11 aa, Borrelia garinii PBi
VASSASQASPV

SEQ ID NO: 43576 - protein, 11 aa, Borrelia garinii PBi
ASSASQASPVA

SEQ ID NO: 43577 - protein, 11 aa, Borrelia garinii PBi
SSASQASPVAS

SEQ ID NO: 43578 - protein, 11 aa, Borrelia garinii PBi
SASQASPVASP

SEQ ID NO: 43579 - protein, 11 aa, Borrelia garinii PBi
ASQASPVASPA

SEQ ID NO: 43580 - protein, 11 aa, Borrelia garinii PBi
SQASPVASPAT

SEQ ID NO: 43581 - protein, 11 aa, Borrelia garinii PBi
QASPVASPATN

SEQ ID NO: 43582 - protein, 11 aa, Borrelia garinii PBi
ASPVASPATNV

SEQ ID NO: 43583 - protein, 11 aa, Borrelia garinii PBi
SPVASPATNVQ

SEQ ID NO: 43584 - protein, 11 aa, Borrelia garinii PBi
PVASPATNVQA

SEQ ID NO: 43585 - protein, 11 aa, Borrelia garinii PBi
VASPATNVQAT

SEQ ID NO: 43586 - protein, 11 aa, Borrelia garinii PBi
ASPATNVQATP

SEQ ID NO: 43587 - protein, 11 aa, Borrelia garinii PBi
SPATNVQATPP

SEQ ID NO: 43588 - protein, 11 aa, Borrelia garinii PBi
PATNVQATPPK

SEQ ID NO: 43589 - protein, 11 aa, Borrelia garinii PBi
ATNVQATPPKQ

SEQ ID NO: 43590 - protein, 11 aa, Borrelia garinii PBi
TNVQATPPKQI

SEQ ID NO: 43591 - protein, 11 aa, Borrelia garinii PBi
NVQATPPKQIA

SEQ ID NO: 43592 - protein, 11 aa, Borrelia garinii PBi
VQATPPKQIAS

SEQ ID NO: 43593 - protein, 11 aa, Borrelia garinii PBi
QATPPKQIASA

SEQ ID NO: 43594 - protein, 11 aa, Borrelia garinii PBi
ATPPKQIASAQ

SEQ ID NO: 43595 - protein, 11 aa, Borrelia garinii PBi
TPPKQIASAQA

SEQ ID NO: 43596 - protein, 11 aa, Borrelia garinii PBi
PPKQIASAQAI

SEQ ID NO: 43597 - protein, 11 aa, Borrelia garinii PBi
PKQIASAQAIQ

SEQ ID NO: 43598 - protein, 11 aa, Borrelia garinii PBi
KQIASAQAIQT

SEQ ID NO: 43599 - protein, 11 aa, Borrelia garinii PBi
QIASAQAIQTV

SEQ ID NO: 43600 - protein, 11 aa, Borrelia garinii PBi
IASAQAIQTVP

SEQ ID NO: 43601 - protein, 11 aa, Borrelia garinii PBi
ASAQAIQTVPN

SEQ ID NO: 43602 - protein, 11 aa, Borrelia garinii PBi
SAQAIQTVPNN

SEQ ID NO: 43603 - protein, 11 aa, Borrelia garinii PBi
AQAIQTVPNNT

SEQ ID NO: 43604 - protein, 11 aa, Borrelia garinii PBi
QAIQTVPNNTS

SEQ ID NO: 43605 - protein, 11 aa, Borrelia garinii PBi
AIQTVPNNTST

SEQ ID NO: 43606 - protein, 11 aa, Borrelia garinii PBi
IQTVPNNTSTP

SEQ ID NO: 43607 - protein, 11 aa, Borrelia garinii PBi
QTVPNNTSTPN

SEQ ID NO: 43608 - protein, 11 aa, Borrelia garinii PBi
TVPNNTSTPNQ

SEQ ID NO: 43609 - protein, 11 aa, Borrelia garinii PBi
VPNNTSTPNQS

SEQ ID NO: 43610 - protein, 11 aa, Borrelia garinii PBi
PNNTSTPNQSI

SEQ ID NO: 43611 - protein, 11 aa, Borrelia garinii PBi
NNTSTPNQSII

SEQ ID NO: 43612 - protein, 11 aa, Borrelia garinii PBi
NTSTPNQSIIK

SEQ ID NO: 43613 - protein, 11 aa, Borrelia garinii PBi
TSTPNQSIIKP

SEQ ID NO: 43614 - protein, 11 aa, Borrelia garinii PBi
STPNQSIIKPQ

SEQ ID NO: 43615 - protein, 11 aa, Borrelia garinii PBi
TPNQSIIKPQQ

SEQ ID NO: 43616 - protein, 11 aa, Borrelia garinii PBi
PNQSIIKPQQY

SEQ ID NO: 43617 - protein, 11 aa, Borrelia garinii PBi
NQSIIKPQQYT

SEQ ID NO: 43618 - protein, 11 aa, Borrelia garinii PBi
QSIIKPQQYTF

SEQ ID NO: 43619 - protein, 11 aa, Borrelia garinii PBi
SIIKPQQYTFS

SEQ ID NO: 43620 - protein, 11 aa, Borrelia garinii PBi
IIKPQQYTFSS

SEQ ID NO: 43621 - protein, 11 aa, Borrelia garinii PBi
IKPQQYTFSSS

SEQ ID NO: 43622 - protein, 11 aa, Borrelia garinii PBi
KPQQYTFSSSF

SEQ ID NO: 43623 - protein, 11 aa, Borrelia garinii PBi
PQQYTFSSSFS

SEQ ID NO: 43624 - protein, 11 aa, Borrelia garinii PBi
QQYTFSSSFSQ

SEQ ID NO: 43625 - protein, 11 aa, Borrelia garinii PBi
QYTFSSSFSQP

SEQ ID NO: 43626 - protein, 11 aa, Borrelia garinii PBi
YTFSSSFSQPT

SEQ ID NO: 43627 - protein, 11 aa, Borrelia garinii PBi
TFSSSFSQPTS

SEQ ID NO: 43628 - protein, 11 aa, Borrelia garinii PBi
FSSSFSQPTSQ

SEQ ID NO: 43629 - protein, 11 aa, Borrelia garinii PBi
SSSFSQPTSQT

SEQ ID NO: 43630 - protein, 11 aa, Borrelia garinii PBi
SSFSQPTSQTN

SEQ ID NO: 43631 - protein, 11 aa, Borrelia garinii PBi
SFSQPTSQTNF

SEQ ID NO: 43632 - protein, 11 aa, Borrelia garinii PBi
FSQPTSQTNFN

SEQ ID NO: 43633 - protein, 11 aa, Borrelia garinii PBi
SQPTSQTNFNN

SEQ ID NO: 43634 - protein, 11 aa, Borrelia garinii PBi
QPTSQTNFNNS

SEQ ID NO: 43635 - protein, 11 aa, Borrelia garinii PBi
PTSQTNFNNSQ

SEQ ID NO: 43636 - protein, 11 aa, Borrelia garinii PBi
TSQTNFNNSQS

SEQ ID NO: 43637 - protein, 11 aa, Borrelia garinii PBi
SQTNFNNSQSN

SEQ ID NO: 43638 - protein, 11 aa, Borrelia garinii PBi
QTNFNNSQSNN

SEQ ID NO: 43639 - protein, 11 aa, Borrelia garinii PBi
TNFNNSQSNNV

SEQ ID NO: 43640 - protein, 11 aa, Borrelia garinii PBi
NFNNSQSNNVL

SEQ ID NO: 43641 - protein, 11 aa, Borrelia garinii PBi
FNNSQSNNVLT

SEQ ID NO: 43642 - protein, 11 aa, Borrelia garinii PBi
NNSQSNNVLTN

SEQ ID NO: 43643 - protein, 11 aa, Borrelia garinii PBi
NSQSNNVLTNY

SEQ ID NO: 43644 - protein, 11 aa, Borrelia garinii PBi
SQSNNVLTNYR

SEQ ID NO: 43645 - protein, 11 aa, Borrelia garinii PBi
QSNNVLTNYRH

SEQ ID NO: 43646 - protein, 11 aa, Borrelia garinii PBi
SNNVLTNYRHQ

SEQ ID NO: 43647 - protein, 11 aa, Borrelia garinii PBi
NNVLTNYRHQT

SEQ ID NO: 43648 - protein, 11 aa, Borrelia garinii PBi
NVLTNYRHQTQ

SEQ ID NO: 43649 - protein, 11 aa, Borrelia garinii PBi
VLTNYRHQTQP

SEQ ID NO: 43650 - protein, 11 aa, Borrelia garinii PBi
LTNYRHQTQPS

SEQ ID NO: 43651 - protein, 11 aa, Borrelia garinii PBi
TNYRHQTQPSF

SEQ ID NO: 43652 - protein, 11 aa, Borrelia garinii PBi
NYRHQTQPSFV

SEQ ID NO: 43653 - protein, 11 aa, Borrelia garinii PBi
YRHQTQPSFVV

SEQ ID NO: 43654 - protein, 11 aa, Borrelia garinii PBi
RHQTQPSFVVP

SEQ ID NO: 43655 - protein, 11 aa, Borrelia garinii PBi
HQTQPSFVVPV

SEQ ID NO: 43656 - protein, 11 aa, Borrelia garinii PBi
QTQPSFVVPVY

SEQ ID NO: 43657 - protein, 11 aa, Borrelia garinii PBi
TQPSFVVPVYS

SEQ ID NO: 43658 - protein, 11 aa, Borrelia garinii PBi
QPSFVVPVYSG

SEQ ID NO: 43659 - protein, 11 aa, Borrelia garinii PBi
PSFVVPVYSGN

SEQ ID NO: 43660 - protein, 11 aa, Borrelia garinii PBi
SFVVPVYSGNS

SEQ ID NO: 43661 - protein, 11 aa, Borrelia garinii PBi
FVVPVYSGNSP

SEQ ID NO: 43662 - protein, 11 aa, Borrelia garinii PBi
VVPVYSGNSPL

SEQ ID NO: 43663 - protein, 11 aa, Borrelia garinii PBi
VPVYSGNSPLQ

SEQ ID NO: 43664 - protein, 11 aa, Borrelia garinii PBi
PVYSGNSPLQK

SEQ ID NO: 43665 - protein, 11 aa, Borrelia garinii PBi
VYSGNSPLQKL

SEQ ID NO: 43666 - protein, 11 aa, Borrelia garinii PBi
YSGNSPLQKLK

SEQ ID NO: 43667 - protein, 11 aa, Borrelia garinii PBi
SGNSPLQKLKN

SEQ ID NO: 43668 - protein, 11 aa, Borrelia garinii PBi
GNSPLQKLKNN

SEQ ID NO: 43669 - protein, 11 aa, Borrelia garinii PBi
NSPLQKLKNNL

SEQ ID NO: 43670 - protein, 11 aa, Borrelia garinii PBi
SPLQKLKNNLL

SEQ ID NO: 43671 - protein, 11 aa, Borrelia garinii PBi
PLQKLKNNLLR

SEQ ID NO: 43672 - protein, 11 aa, Borrelia garinii PBi
LQKLKNNLLRR

SEQ ID NO: 43673 - protein, 11 aa, Borrelia garinii PBi
QKLKNNLLRRI

SEQ ID NO: 43674 - protein, 11 aa, Borrelia garinii PBi
KLKNNLLRRIA

SEQ ID NO: 43675 - protein, 11 aa, Borrelia garinii PBi
LKNNLLRRIAE

SEQ ID NO: 43676 - protein, 11 aa, Borrelia garinii PBi
KNNLLRRIAEE

SEQ ID NO: 43677 - protein, 11 aa, Borrelia garinii PBi
NNLLRRIAEEK

SEQ ID NO: 43678 - protein, 11 aa, Borrelia garinii PBi
NLLRRIAEEKN

SEQ ID NO: 43679 - protein, 11 aa, Borrelia garinii PBi
LLRRIAEEKNK

SEQ ID NO: 43680 - protein, 11 aa, Borrelia garinii PBi
LRRIAEEKNKT

SEQ ID NO: 43681 - protein, 11 aa, Borrelia garinii PBi
RRIAEEKNKTH

SEQ ID NO: 43682 - protein, 11 aa, Borrelia garinii PBi
RIAEEKNKTHN

SEQ ID NO: 43683 - protein, 11 aa, Borrelia garinii PBi
IAEEKNKTHNH

SEQ ID NO: 43684 - protein, 11 aa, Borrelia garinii PBi
AEEKNKTHNHG

SEQ ID NO: 43685 - protein, 11 aa, Borrelia garinii PBi
EEKNKTHNHGF

SEQ ID NO: 43686 - protein, 11 aa, Borrelia garinii PBi
EKNKTHNHGFR

SEQ ID NO: 43687 - protein, 11 aa, Borrelia garinii PBi
KNKTHNHGFRE

SEQ ID NO: 43688 - protein, 11 aa, Borrelia garinii PBi
NKTHNHGFRET

SEQ ID NO: 43689 - protein, 11 aa, Borrelia garinii PBi
KTHNHGFRETY

SEQ ID NO: 43690 - protein, 11 aa, Borrelia garinii PBi
THNHGFRETYD

SEQ ID NO: 43691 - protein, 11 aa, Borrelia garinii PBi
HNHGFRETYDQ

SEQ ID NO: 43692 - protein, 11 aa, Borrelia garinii PBi
NHGFRETYDQF

SEQ ID NO: 43693 - protein, 11 aa, Borrelia garinii PBi
HGFRETYDQFK

SEQ ID NO: 43694 - protein, 11 aa, Borrelia garinii PBi
GFRETYDQFKM

SEQ ID NO: 43695 - protein, 11 aa, Borrelia garinii PBi
FRETYDQFKMK

SEQ ID NO: 43696 - protein, 11 aa, Borrelia garinii PBi
RETYDQFKMKD

SEQ ID NO: 43697 - protein, 11 aa, Borrelia garinii PBi
ETYDQFKMKDS

SEQ ID NO: 43698 - protein, 11 aa, Borrelia garinii PBi
TYDQFKMKDSA

SEQ ID NO: 43699 - protein, 11 aa, Borrelia garinii PBi
YDQFKMKDSAF

SEQ ID NO: 43700 - protein, 11 aa, Borrelia garinii PBi
DQFKMKDSAFT

SEQ ID NO: 43701 - protein, 11 aa, Borrelia garinii PBi
QFKMKDSAFTL

SEQ ID NO: 43702 - protein, 11 aa, Borrelia garinii PBi
FKMKDSAFTLL

SEQ ID NO: 43703 - protein, 11 aa, Borrelia garinii PBi
KMKDSAFTLLD

SEQ ID NO: 43704 - protein, 11 aa, Borrelia garinii PBi
MKDSAFTLLDV

SEQ ID NO: 43705 - protein, 11 aa, Borrelia garinii PBi
KDSAFTLLDVI

SEQ ID NO: 43706 - protein, 11 aa, Borrelia garinii PBi
DSAFTLLDVIS

SEQ ID NO: 43707 - protein, 11 aa, Borrelia garinii PBi
SAFTLLDVISN

SEQ ID NO: 43708 - protein, 11 aa, Borrelia garinii PBi
AFTLLDVISNI

SEQ ID NO: 43709 - protein, 11 aa, Borrelia garinii PBi
FTLLDVISNIS

SEQ ID NO: 43710 - protein, 11 aa, Borrelia garinii PBi
TLLDVISNISV

SEQ ID NO: 43711 - protein, 11 aa, Borrelia garinii PBi
LLDVISNISVF

SEQ ID NO: 43712 - protein, 11 aa, Borrelia garinii PBi
LDVISNISVFD

SEQ ID NO: 43713 - protein, 11 aa, Borrelia garinii PBi
DVISNISVFDR

SEQ ID NO: 43714 - protein, 11 aa, Borrelia garinii PBi
VISNISVFDRG

SEQ ID NO: 43715 - protein, 11 aa, Borrelia garinii PBi
ISNISVFDRGS

SEQ ID NO: 43716 - protein, 11 aa, Borrelia garinii PBi
SNISVFDRGSA

SEQ ID NO: 43717 - protein, 11 aa, Borrelia garinii PBi
NISVFDRGSAP

SEQ ID NO: 43718 - protein, 11 aa, Borrelia garinii PBi
ISVFDRGSAPQ

SEQ ID NO: 43719 - protein, 11 aa, Borrelia garinii PBi
SVFDRGSAPQL

SEQ ID NO: 43720 - protein, 11 aa, Borrelia garinii PBi
VFDRGSAPQLS

SEQ ID NO: 43721 - protein, 11 aa, Borrelia garinii PBi
FDRGSAPQLSS

SEQ ID NO: 43722 - protein, 11 aa, Borrelia garinii PBi
DRGSAPQLSSN

SEQ ID NO: 43723 - protein, 11 aa, Borrelia garinii PBi
RGSAPQLSSNT

SEQ ID NO: 43724 - protein, 11 aa, Borrelia garinii PBi
GSAPQLSSNTP

SEQ ID NO: 43725 - protein, 11 aa, Borrelia garinii PBi
SAPQLSSNTPE

SEQ ID NO: 43726 - protein, 11 aa, Borrelia garinii PBi
APQLSSNTPEA

SEQ ID NO: 43727 - protein, 11 aa, Borrelia garinii PBi
PQLSSNTPEAE

SEQ ID NO: 43728 - protein, 11 aa, Borrelia garinii PBi
QLSSNTPEAES

SEQ ID NO: 43729 - protein, 11 aa, Borrelia garinii PBi
LSSNTPEAESE

SEQ ID NO: 43730 - protein, 11 aa, Borrelia garinii PBi
SSNTPEAESER

SEQ ID NO: 43731 - protein, 11 aa, Borrelia garinii PBi
SNTPEAESERN

SEQ ID NO: 43732 - protein, 11 aa, Borrelia garinii PBi
NTPEAESERNR

SEQ ID NO: 43733 - protein, 11 aa, Borrelia garinii PBi
TPEAESERNRL

SEQ ID NO: 43734 - protein, 11 aa, Borrelia garinii PBi
PEAESERNRLY

SEQ ID NO: 43735 - protein, 11 aa, Borrelia garinii PBi
EAESERNRLYA

SEQ ID NO: 43736 - protein, 11 aa, Borrelia garinii PBi
AESERNRLYAM

SEQ ID NO: 43737 - protein, 11 aa, Borrelia garinii PBi
ESERNRLYAMM

SEQ ID NO: 43738 - protein, 11 aa, Borrelia garinii PBi
SERNRLYAMMD

SEQ ID NO: 43739 - protein, 11 aa, Borrelia garinii PBi
ERNRLYAMMDF

SEQ ID NO: 43740 - protein, 11 aa, Borrelia garinii PBi
RNRLYAMMDFD

SEQ ID NO: 43741 - protein, 11 aa, Borrelia garinii PBi
NRLYAMMDFDQ

SEQ ID NO: 43742 - protein, 11 aa, Borrelia garinii PBi
RLYAMMDFDQA

SEQ ID NO: 43743 - protein, 11 aa, Borrelia garinii PBi
LYAMMDFDQAK

SEQ ID NO: 43744 - protein, 11 aa, Borrelia garinii PBi
YAMMDFDQAKT

SEQ ID NO: 43745 - protein, 11 aa, Borrelia garinii PBi
AMMDFDQAKTT

SEQ ID NO: 43746 - protein, 11 aa, Borrelia garinii PBi
MMDFDQAKTTE

SEQ ID NO: 43747 - protein, 11 aa, Borrelia garinii PBi
MDFDQAKTTEF

SEQ ID NO: 43748 - protein, 11 aa, Borrelia garinii PBi
DFDQAKTTEFG

SEQ ID NO: 43749 - protein, 11 aa, Borrelia garinii PBi
FDQAKTTEFGS

SEQ ID NO: 43750 - protein, 11 aa, Borrelia garinii PBi
DQAKTTEFGSI

SEQ ID NO: 43751 - protein, 11 aa, Borrelia garinii PBi
QAKTTEFGSIM

SEQ ID NO: 43752 - protein, 11 aa, Borrelia garinii PBi
AKTTEFGSIMN

SEQ ID NO: 43753 - protein, 11 aa, Borrelia garinii PBi
KTTEFGSIMNI

SEQ ID NO: 43754 - protein, 11 aa, Borrelia garinii PBi
TTEFGSIMNIL

SEQ ID NO: 43755 - protein, 11 aa, Borrelia garinii PBi
TEFGSIMNILY

SEQ ID NO: 43756 - protein, 11 aa, Borrelia garinii PBi
EFGSIMNILYQ

SEQ ID NO: 43757 - protein, 11 aa, Borrelia garinii PBi
FGSIMNILYQE

SEQ ID NO: 43758 - protein, 11 aa, Borrelia garinii PBi
GSIMNILYQEN

SEQ ID NO: 43759 - protein, 11 aa, Borrelia garinii PBi
SIMNILYQENQ

SEQ ID NO: 43760 - protein, 11 aa, Borrelia garinii PBi
IMNILYQENQN

SEQ ID NO: 43761 - protein, 11 aa, Borrelia garinii PBi
MNILYQENQNH

SEQ ID NO: 43762 - protein, 11 aa, Borrelia garinii PBi
NILYQENQNHS

SEQ ID NO: 43763 - protein, 11 aa, Borrelia garinii PBi
ILYQENQNHSL

SEQ ID NO: 43764 - protein, 11 aa, Borrelia garinii PBi
LYQENQNHSLI

SEQ ID NO: 43765 - protein, 11 aa, Borrelia garinii PBi
YQENQNHSLIR

SEQ ID NO: 43766 - protein, 11 aa, Borrelia garinii PBi
QENQNHSLIRS

SEQ ID NO: 43767 - protein, 11 aa, Borrelia garinii PBi
ENQNHSLIRSL

SEQ ID NO: 43768 - protein, 11 aa, Borrelia garinii PBi
NQNHSLIRSLI

SEQ ID NO: 43769 - protein, 11 aa, Borrelia garinii PBi
QNHSLIRSLII

SEQ ID NO: 43770 - protein, 11 aa, Borrelia garinii PBi
NHSLIRSLIIS

SEQ ID NO: 43771 - protein, 11 aa, Borrelia garinii PBi
HSLIRSLIISG

SEQ ID NO: 43772 - protein, 11 aa, Borrelia garinii PBi
SLIRSLIISGL

SEQ ID NO: 43773 - protein, 11 aa, Borrelia garinii PBi
LIRSLIISGLG

SEQ ID NO: 43774 - protein, 11 aa, Borrelia garinii PBi
IRSLIISGLGI

SEQ ID NO: 43775 - protein, 11 aa, Borrelia garinii PBi
RSLIISGLGIQ

SEQ ID NO: 43776 - protein, 11 aa, Borrelia garinii PBi
SLIISGLGIQI

SEQ ID NO: 43777 - protein, 11 aa, Borrelia garinii PBi
LIISGLGIQIS

SEQ ID NO: 43778 - protein, 11 aa, Borrelia garinii PBi
IISGLGIQISL

SEQ ID NO: 43779 - protein, 11 aa, Borrelia garinii PBi
ISGLGIQISLE

SEQ ID NO: 43780 - protein, 11 aa, Borrelia garinii PBi
SGLGIQISLES

SEQ ID NO: 43781 - protein, 11 aa, Borrelia garinii PBi
GLGIQISLEST

SEQ ID NO: 43782 - protein, 11 aa, Borrelia garinii PBi
LGIQISLESTL

SEQ ID NO: 43783 - protein, 11 aa, Borrelia garinii PBi
GIQISLESTLE

SEQ ID NO: 43784 - protein, 11 aa, Borrelia garinii PBi
IQISLESTLEE

SEQ ID NO: 43785 - protein, 11 aa, Borrelia garinii PBi
QISLESTLEEI

SEQ ID NO: 43786 - protein, 11 aa, Borrelia garinii PBi
ISLESTLEEIE

SEQ ID NO: 43787 - protein, 11 aa, Borrelia garinii PBi
SLESTLEEIEK

SEQ ID NO: 43788 - protein, 11 aa, Borrelia garinii PBi
LESTLEEIEKK

SEQ ID NO: 43789 - protein, 11 aa, Borrelia garinii PBi
ESTLEEIEKKI

SEQ ID NO: 43790 - protein, 11 aa, Borrelia garinii PBi
STLEEIEKKIE

SEQ ID NO: 43791 - protein, 11 aa, Borrelia garinii PBi
TLEEIEKKIES

SEQ ID NO: 43792 - protein, 11 aa, Borrelia garinii PBi
LEEIEKKIESF

SEQ ID NO: 43793 - protein, 11 aa, Borrelia garinii PBi
EEIEKKIESFN

SEQ ID NO: 43794 - protein, 11 aa, Borrelia garinii PBi
EIEKKIESFNT

SEQ ID NO: 43795 - protein, 11 aa, Borrelia garinii PBi
IEKKIESFNTQ

SEQ ID NO: 43796 - protein, 11 aa, Borrelia garinii PBi
EKKIESFNTQY

SEQ ID NO: 43797 - protein, 11 aa, Borrelia garinii PBi
KKIESFNTQYL

SEQ ID NO: 43798 - protein, 11 aa, Borrelia garinii PBi
KIESFNTQYLN

SEQ ID NO: 43799 - protein, 11 aa, Borrelia garinii PBi
IESFNTQYLNT

SEQ ID NO: 43800 - protein, 11 aa, Borrelia garinii PBi
ESFNTQYLNTI

SEQ ID NO: 43801 - protein, 11 aa, Borrelia garinii PBi
SFNTQYLNTII

SEQ ID NO: 43802 - protein, 11 aa, Borrelia garinii PBi
FNTQYLNTIIN

SEQ ID NO: 43803 - protein, 11 aa, Borrelia garinii PBi
NTQYLNTIINS

SEQ ID NO: 43804 - protein, 11 aa, Borrelia garinii PBi
TQYLNTIINSY

SEQ ID NO: 43805 - protein, 11 aa, Borrelia garinii PBi
QYLNTIINSYT

SEQ ID NO: 43806 - protein, 11 aa, Borrelia garinii PBi
YLNTIINSYTF

SEQ ID NO: 43807 - protein, 11 aa, Borrelia garinii PBi
LNTIINSYTFK

SEQ ID NO: 43808 - protein, 11 aa, Borrelia garinii PBi
NTIINSYTFKD

SEQ ID NO: 43809 - protein, 11 aa, Borrelia garinii PBi
TIINSYTFKDK

SEQ ID NO: 43810 - protein, 11 aa, Borrelia garinii PBi
IINSYTFKDKL

SEQ ID NO: 43811 - protein, 11 aa, Borrelia garinii PBi
INSYTFKDKLK

SEQ ID NO: 43812 - protein, 11 aa, Borrelia garinii PBi
NSYTFKDKLKE

SEQ ID NO: 43813 - protein, 11 aa, Borrelia garinii PBi
SYTFKDKLKEL

SEQ ID NO: 43814 - protein, 11 aa, Borrelia garinii PBi
YTFKDKLKELE

SEQ ID NO: 43815 - protein, 11 aa, Borrelia garinii PBi
TFKDKLKELES

SEQ ID NO: 43816 - protein, 11 aa, Borrelia garinii PBi
FKDKLKELESK

SEQ ID NO: 43817 - protein, 11 aa, Borrelia garinii PBi
KDKLKELESKL

SEQ ID NO: 43818 - protein, 11 aa, Borrelia garinii PBi
DKLKELESKLN

SEQ ID NO: 43819 - protein, 11 aa, Borrelia garinii PBi
KLKELESKLNS

SEQ ID NO: 43820 - protein, 11 aa, Borrelia garinii PBi
LKELESKLNSI

SEQ ID NO: 43821 - protein, 11 aa, Borrelia garinii PBi
KELESKLNSIL

SEQ ID NO: 43822 - protein, 11 aa, Borrelia garinii PBi
ELESKLNSILA

SEQ ID NO: 43823 - protein, 11 aa, Borrelia garinii PBi
LESKLNSILAE

SEQ ID NO: 43824 - protein, 11 aa, Borrelia garinii PBi
ESKLNSILAEK

SEQ ID NO: 43825 - protein, 11 aa, Borrelia garinii PBi
SKLNSILAEKK

SEQ ID NO: 43826 - protein, 11 aa, Borrelia garinii PBi
KLNSILAEKKE

SEQ ID NO: 43827 - protein, 11 aa, Borrelia garinii PBi
LNSILAEKKEW

SEQ ID NO: 43828 - protein, 11 aa, Borrelia garinii PBi
NSILAEKKEWL

SEQ ID NO: 43829 - protein, 11 aa, Borrelia garinii PBi
SILAEKKEWLN

SEQ ID NO: 43830 - protein, 11 aa, Borrelia garinii PBi
ILAEKKEWLNY

SEQ ID NO: 43831 - protein, 11 aa, Borrelia garinii PBi
LAEKKEWLNYA

SEQ ID NO: 43832 - protein, 11 aa, Borrelia garinii PBi
AEKKEWLNYAD

SEQ ID NO: 43833 - protein, 11 aa, Borrelia garinii PBi
EKKEWLNYADA

SEQ ID NO: 43834 - protein, 11 aa, Borrelia garinii PBi
KKEWLNYADAI

SEQ ID NO: 43835 - protein, 11 aa, Borrelia garinii PBi
KEWLNYADAII

SEQ ID NO: 43836 - protein, 11 aa, Borrelia garinii PBi
EWLNYADAIIT

SEQ ID NO: 43837 - protein, 11 aa, Borrelia garinii PBi
WLNYADAIITN

SEQ ID NO: 43838 - protein, 11 aa, Borrelia garinii PBi
LNYADAIITNT

SEQ ID NO: 43839 - protein, 11 aa, Borrelia garinii PBi
NYADAIITNTS

SEQ ID NO: 43840 - protein, 11 aa, Borrelia garinii PBi
YADAIITNTSS

SEQ ID NO: 43841 - protein, 11 aa, Borrelia garinii PBi
ADAIITNTSSN

SEQ ID NO: 43842 - protein, 11 aa, Borrelia garinii PBi
DAIITNTSSNS

SEQ ID NO: 43843 - protein, 11 aa, Borrelia garinii PBi
AIITNTSSNSK

SEQ ID NO: 43844 - protein, 11 aa, Borrelia garinii PBi
IITNTSSNSKR

SEQ ID NO: 43845 - protein, 11 aa, Borrelia garinii PBi
ITNTSSNSKRN

SEQ ID NO: 43846 - protein, 11 aa, Borrelia garinii PBi
TNTSSNSKRND

SEQ ID NO: 43847 - protein, 11 aa, Borrelia garinii PBi
NTSSNSKRNDP

SEQ ID NO: 43848 - protein, 11 aa, Borrelia garinii PBi
TSSNSKRNDPQ

SEQ ID NO: 43849 - protein, 11 aa, Borrelia garinii PBi
SSNSKRNDPQS

SEQ ID NO: 43850 - protein, 11 aa, Borrelia garinii PBi
SNSKRNDPQSL

SEQ ID NO: 43851 - protein, 11 aa, Borrelia garinii PBi
NSKRNDPQSLG

SEQ ID NO: 43852 - protein, 11 aa, Borrelia garinii PBi
SKRNDPQSLGQ

SEQ ID NO: 43853 - protein, 11 aa, Borrelia garinii PBi
KRNDPQSLGQY

SEQ ID NO: 43854 - protein, 11 aa, Borrelia garinii PBi
RNDPQSLGQYI

SEQ ID NO: 43855 - protein, 11 aa, Borrelia garinii PBi
NDPQSLGQYIK

SEQ ID NO: 43856 - protein, 11 aa, Borrelia garinii PBi
DPQSLGQYIKN

SEQ ID NO: 43857 - protein, 11 aa, Borrelia garinii PBi
PQSLGQYIKNK

SEQ ID NO: 43858 - protein, 11 aa, Borrelia garinii PBi
QSLGQYIKNKY

SEQ ID NO: 43859 - protein, 11 aa, Borrelia garinii PBi
SLGQYIKNKYL

SEQ ID NO: 43860 - protein, 11 aa, Borrelia garinii PBi
LGQYIKNKYLD

SEQ ID NO: 43861 - protein, 11 aa, Borrelia garinii PBi
GQYIKNKYLDK

SEQ ID NO: 43862 - protein, 11 aa, Borrelia garinii PBi
QYIKNKYLDKM

SEQ ID NO: 43863 - protein, 11 aa, Borrelia garinii PBi
YIKNKYLDKMQ

SEQ ID NO: 43864 - protein, 11 aa, Borrelia garinii PBi
IKNKYLDKMQD

SEQ ID NO: 43865 - protein, 11 aa, Borrelia garinii PBi
KNKYLDKMQDA

SEQ ID NO: 43866 - protein, 11 aa, Borrelia garinii PBi
NKYLDKMQDAR

SEQ ID NO: 43867 - protein, 11 aa, Borrelia garinii PBi
KYLDKMQDARQ

SEQ ID NO: 43868 - protein, 11 aa, Borrelia garinii PBi
YLDKMQDARQS

SEQ ID NO: 43869 - protein, 11 aa, Borrelia garinii PBi
LDKMQDARQSA

SEQ ID NO: 43870 - protein, 11 aa, Borrelia garinii PBi
DKMQDARQSAL

SEQ ID NO: 43871 - protein, 11 aa, Borrelia garinii PBi
KMQDARQSALD

SEQ ID NO: 43872 - protein, 11 aa, Borrelia garinii PBi
MQDARQSALDL

SEQ ID NO: 43873 - protein, 11 aa, Borrelia garinii PBi
QDARQSALDLY

SEQ ID NO: 43874 - protein, 11 aa, Borrelia garinii PBi
DARQSALDLYL

SEQ ID NO: 43875 - protein, 11 aa, Borrelia garinii PBi
ARQSALDLYLN

SEQ ID NO: 43876 - protein, 11 aa, Borrelia garinii PBi
RQSALDLYLNI

SEQ ID NO: 43877 - protein, 11 aa, Borrelia garinii PBi
QSALDLYLNIT

SEQ ID NO: 43878 - protein, 11 aa, Borrelia garinii PBi
SALDLYLNITE

SEQ ID NO: 43879 - protein, 11 aa, Borrelia garinii PBi
ALDLYLNITEI

SEQ ID NO: 43880 - protein, 11 aa, Borrelia garinii PBi
LDLYLNITEIR

SEQ ID NO: 43881 - protein, 8 aa, Borrelia burgdorferi B31
MKKAKLNI

SEQ ID NO: 43882 - protein, 8 aa, Borrelia burgdorferi B31
KKAKLNII

SEQ ID NO: 43883 - protein, 8 aa, Borrelia burgdorferi B31
KAKLNIIK

SEQ ID NO: 43884 - protein, 8 aa, Borrelia burgdorferi B31
AKLNIIKI

SEQ ID NO: 43885 - protein, 8 aa, Borrelia burgdorferi B31
KLNIIKIN

SEQ ID NO: 43886 - protein, 8 aa, Borrelia burgdorferi B31
LNIIKINI

SEQ ID NO: 43887 - protein, 8 aa, Borrelia burgdorferi B31
NIIKINII

SEQ ID NO: 43888 - protein, 8 aa, Borrelia burgdorferi B31
IIKINIIT

SEQ ID NO: 43889 - protein, 8 aa, Borrelia burgdorferi B31
IKINIITM

SEQ ID NO: 43890 - protein, 8 aa, Borrelia burgdorferi B31
KINIITMI

SEQ ID NO: 43891 - protein, 8 aa, Borrelia burgdorferi B31
INIITMIL

SEQ ID NO: 43892 - protein, 8 aa, Borrelia burgdorferi B31
NIITMILT

SEQ ID NO: 43893 - protein, 8 aa, Borrelia burgdorferi B31
IITMILTL

SEQ ID NO: 43894 - protein, 8 aa, Borrelia burgdorferi B31
ITMILTLI

SEQ ID NO: 43895 - protein, 8 aa, Borrelia burgdorferi B31
TMILTLIC

SEQ ID NO: 43896 - protein, 8 aa, Borrelia burgdorferi B31
MILTLICI

SEQ ID NO: 43897 - protein, 8 aa, Borrelia burgdorferi B31
ILTLICIS

SEQ ID NO: 43898 - protein, 8 aa, Borrelia burgdorferi B31
LTLICISC

SEQ ID NO: 43899 - protein, 8 aa, Borrelia burgdorferi B31
TLICISCA

SEQ ID NO: 43900 - protein, 8 aa, Borrelia burgdorferi B31
LICISCAP

SEQ ID NO: 43901 - protein, 8 aa, Borrelia burgdorferi B31
ICISCAPF

SEQ ID NO: 43902 - protein, 8 aa, Borrelia burgdorferi B31
CISCAPFN

SEQ ID NO: 43903 - protein, 8 aa, Borrelia burgdorferi B31
ISCAPFNK

SEQ ID NO: 43904 - protein, 8 aa, Borrelia burgdorferi B31
SCAPFNKI

SEQ ID NO: 43905 - protein, 8 aa, Borrelia burgdorferi B31
CAPFNKIN

SEQ ID NO: 43906 - protein, 8 aa, Borrelia burgdorferi B31
APFNKINP

SEQ ID NO: 43907 - protein, 8 aa, Borrelia burgdorferi B31
PFNKINPK

SEQ ID NO: 43908 - protein, 8 aa, Borrelia burgdorferi B31
FNKINPKA

SEQ ID NO: 43909 - protein, 8 aa, Borrelia burgdorferi B31
NKINPKAN

SEQ ID NO: 43910 - protein, 8 aa, Borrelia burgdorferi B31
KINPKANE

SEQ ID NO: 43911 - protein, 8 aa, Borrelia burgdorferi B31
INPKANEN

SEQ ID NO: 43912 - protein, 8 aa, Borrelia burgdorferi B31
NPKANENT

SEQ ID NO: 43913 - protein, 8 aa, Borrelia burgdorferi B31
PKANENTK

SEQ ID NO: 43914 - protein, 8 aa, Borrelia burgdorferi B31
KANENTKL

SEQ ID NO: 43915 - protein, 8 aa, Borrelia burgdorferi B31
ANENTKLK

SEQ ID NO: 43916 - protein, 8 aa, Borrelia burgdorferi B31
NENTKLKK

SEQ ID NO: 43917 - protein, 8 aa, Borrelia burgdorferi B31
ENTKLKKN

SEQ ID NO: 43918 - protein, 8 aa, Borrelia burgdorferi B31
NTKLKKNT

SEQ ID NO: 43919 - protein, 8 aa, Borrelia burgdorferi B31
TKLKKNTR

SEQ ID NO: 43920 - protein, 8 aa, Borrelia burgdorferi B31
KLKKNTRL

SEQ ID NO: 43921 - protein, 8 aa, Borrelia burgdorferi B31
LKKNTRLK

SEQ ID NO: 43922 - protein, 8 aa, Borrelia burgdorferi B31
KKNTRLKK

SEQ ID NO: 43923 - protein, 8 aa, Borrelia burgdorferi B31
KNTRLKKP

SEQ ID NO: 43924 - protein, 8 aa, Borrelia burgdorferi B31
NTRLKKPA

SEQ ID NO: 43925 - protein, 8 aa, Borrelia burgdorferi B31
TRLKKPAN

SEQ ID NO: 43926 - protein, 8 aa, Borrelia burgdorferi B31
RLKKPANP

SEQ ID NO: 43927 - protein, 8 aa, Borrelia burgdorferi B31
LKKPANPG

SEQ ID NO: 43928 - protein, 8 aa, Borrelia burgdorferi B31
KKPANPGE

SEQ ID NO: 43929 - protein, 8 aa, Borrelia burgdorferi B31
KPANPGEN

SEQ ID NO: 43930 - protein, 8 aa, Borrelia burgdorferi B31
PANPGENI

SEQ ID NO: 43931 - protein, 8 aa, Borrelia burgdorferi B31
ANPGENIQ

SEQ ID NO: 43932 - protein, 8 aa, Borrelia burgdorferi B31
NPGENIQN

SEQ ID NO: 43933 - protein, 8 aa, Borrelia burgdorferi B31
PGENIQNF

SEQ ID NO: 43934 - protein, 8 aa, Borrelia burgdorferi B31
GENIQNFK

SEQ ID NO: 43935 - protein, 8 aa, Borrelia burgdorferi B31
ENIQNFKD

SEQ ID NO: 43936 - protein, 8 aa, Borrelia burgdorferi B31
NIQNFKDK

SEQ ID NO: 43937 - protein, 8 aa, Borrelia burgdorferi B31
IQNFKDKS

SEQ ID NO: 43938 - protein, 8 aa, Borrelia burgdorferi B31
QNFKDKSG

SEQ ID NO: 43939 - protein, 8 aa, Borrelia burgdorferi B31
NFKDKSGD

SEQ ID NO: 43940 - protein, 8 aa, Borrelia burgdorferi B31
FKDKSGDL

SEQ ID NO: 43941 - protein, 8 aa, Borrelia burgdorferi B31
KDKSGDLG

SEQ ID NO: 43942 - protein, 8 aa, Borrelia burgdorferi B31
DKSGDLGA

SEQ ID NO: 43943 - protein, 8 aa, Borrelia burgdorferi B31
KSGDLGAS

SEQ ID NO: 43944 - protein, 8 aa, Borrelia burgdorferi B31
SGDLGASD

SEQ ID NO: 43945 - protein, 8 aa, Borrelia burgdorferi B31
GDLGASDE

SEQ ID NO: 43946 - protein, 8 aa, Borrelia burgdorferi B31
DLGASDEK

SEQ ID NO: 43947 - protein, 8 aa, Borrelia burgdorferi B31
LGASDEKF

SEQ ID NO: 43948 - protein, 8 aa, Borrelia burgdorferi B31
GASDEKFM

SEQ ID NO: 43949 - protein, 8 aa, Borrelia burgdorferi B31
ASDEKFMG

SEQ ID NO: 43950 - protein, 8 aa, Borrelia burgdorferi B31
SDEKFMGT

SEQ ID NO: 43951 - protein, 8 aa, Borrelia burgdorferi B31
DEKFMGTT

SEQ ID NO: 43952 - protein, 8 aa, Borrelia burgdorferi B31
EKFMGTTA

SEQ ID NO: 43953 - protein, 8 aa, Borrelia burgdorferi B31
KFMGTTAS

SEQ ID NO: 43954 - protein, 8 aa, Borrelia burgdorferi B31
FMGTTASE

SEQ ID NO: 43955 - protein, 8 aa, Borrelia burgdorferi B31
MGTTASEL

SEQ ID NO: 43956 - protein, 8 aa, Borrelia burgdorferi B31
GTTASELK

SEQ ID NO: 43957 - protein, 8 aa, Borrelia burgdorferi B31
TTASELKA

SEQ ID NO: 43958 - protein, 8 aa, Borrelia burgdorferi B31
TASELKAI

SEQ ID NO: 43959 - protein, 8 aa, Borrelia burgdorferi B31
ASELKAIG

SEQ ID NO: 43960 - protein, 8 aa, Borrelia burgdorferi B31
SELKAIGK

SEQ ID NO: 43961 - protein, 8 aa, Borrelia burgdorferi B31
ELKAIGKE

SEQ ID NO: 43962 - protein, 8 aa, Borrelia burgdorferi B31
LKAIGKEL

SEQ ID NO: 43963 - protein, 8 aa, Borrelia burgdorferi B31
KAIGKELE

SEQ ID NO: 43964 - protein, 8 aa, Borrelia burgdorferi B31
AIGKELED

SEQ ID NO: 43965 - protein, 8 aa, Borrelia burgdorferi B31
IGKELEDR

SEQ ID NO: 43966 - protein, 8 aa, Borrelia burgdorferi B31
GKELEDRK

SEQ ID NO: 43967 - protein, 8 aa, Borrelia burgdorferi B31
KELEDRKN

SEQ ID NO: 43968 - protein, 8 aa, Borrelia burgdorferi B31
ELEDRKNQ

SEQ ID NO: 43969 - protein, 8 aa, Borrelia burgdorferi B31
LEDRKNQY

SEQ ID NO: 43970 - protein, 8 aa, Borrelia burgdorferi B31
EDRKNQYD

SEQ ID NO: 43971 - protein, 8 aa, Borrelia burgdorferi B31
DRKNQYDI

SEQ ID NO: 43972 - protein, 8 aa, Borrelia burgdorferi B31
RKNQYDIQ

SEQ ID NO: 43973 - protein, 8 aa, Borrelia burgdorferi B31
KNQYDIQI

SEQ ID NO: 43974 - protein, 8 aa, Borrelia burgdorferi B31
NQYDIQIA

SEQ ID NO: 43975 - protein, 8 aa, Borrelia burgdorferi B31
QYDIQIAK

SEQ ID NO: 43976 - protein, 8 aa, Borrelia burgdorferi B31
YDIQIAKI

SEQ ID NO: 43977 - protein, 8 aa, Borrelia burgdorferi B31
DIQIAKIT

SEQ ID NO: 43978 - protein, 8 aa, Borrelia burgdorferi B31
IQIAKITN

SEQ ID NO: 43979 - protein, 8 aa, Borrelia burgdorferi B31
QIAKITNE

SEQ ID NO: 43980 - protein, 8 aa, Borrelia burgdorferi B31
IAKITNEE

SEQ ID NO: 43981 - protein, 8 aa, Borrelia burgdorferi B31
AKITNEES

SEQ ID NO: 43982 - protein, 8 aa, Borrelia burgdorferi B31
KITNEESN

SEQ ID NO: 43983 - protein, 8 aa, Borrelia burgdorferi B31
ITNEESNL

SEQ ID NO: 43984 - protein, 8 aa, Borrelia burgdorferi B31
TNEESNLL

SEQ ID NO: 43985 - protein, 8 aa, Borrelia burgdorferi B31
NEESNLLD

SEQ ID NO: 43986 - protein, 8 aa, Borrelia burgdorferi B31
EESNLLDT

SEQ ID NO: 43987 - protein, 8 aa, Borrelia burgdorferi B31
ESNLLDTY

SEQ ID NO: 43988 - protein, 8 aa, Borrelia burgdorferi B31
SNLLDTYI

SEQ ID NO: 43989 - protein, 8 aa, Borrelia burgdorferi B31
NLLDTYIR

SEQ ID NO: 43990 - protein, 8 aa, Borrelia burgdorferi B31
LLDTYIRA

SEQ ID NO: 43991 - protein, 8 aa, Borrelia burgdorferi B31
LDTYIRAY

SEQ ID NO: 43992 - protein, 8 aa, Borrelia burgdorferi B31
DTYIRAYE

SEQ ID NO: 43993 - protein, 8 aa, Borrelia burgdorferi B31
TYIRAYEL

SEQ ID NO: 43994 - protein, 8 aa, Borrelia burgdorferi B31
YIRAYELA

SEQ ID NO: 43995 - protein, 8 aa, Borrelia burgdorferi B31
IRAYELAN

SEQ ID NO: 43996 - protein, 8 aa, Borrelia burgdorferi B31
RAYELANE

SEQ ID NO: 43997 - protein, 8 aa, Borrelia burgdorferi B31
AYELANEN

SEQ ID NO: 43998 - protein, 8 aa, Borrelia burgdorferi B31
YELANENE

SEQ ID NO: 43999 - protein, 8 aa, Borrelia burgdorferi B31
ELANENEK

SEQ ID NO: 44000 - protein, 8 aa, Borrelia burgdorferi B31
LANENEKM

SEQ ID NO: 44001 - protein, 8 aa, Borrelia burgdorferi B31
ANENEKML

SEQ ID NO: 44002 - protein, 8 aa, Borrelia burgdorferi B31
NENEKMLL

SEQ ID NO: 44003 - protein, 8 aa, Borrelia burgdorferi B31
ENEKMLLK

SEQ ID NO: 44004 - protein, 8 aa, Borrelia burgdorferi B31
NEKMLLKR

SEQ ID NO: 44005 - protein, 8 aa, Borrelia burgdorferi B31
EKMLLKRF

SEQ ID NO: 44006 - protein, 8 aa, Borrelia burgdorferi B31
KMLLKRFL

SEQ ID NO: 44007 - protein, 8 aa, Borrelia burgdorferi B31
MLLKRFLL

SEQ ID NO: 44008 - protein, 8 aa, Borrelia burgdorferi B31
LLKRFLLS

SEQ ID NO: 44009 - protein, 8 aa, Borrelia burgdorferi B31
LKRFLLSS

SEQ ID NO: 44010 - protein, 8 aa, Borrelia burgdorferi B31
KRFLLSSL

SEQ ID NO: 44011 - protein, 8 aa, Borrelia burgdorferi B31
RFLLSSLD

SEQ ID NO: 44012 - protein, 8 aa, Borrelia burgdorferi B31
FLLSSLDY

SEQ ID NO: 44013 - protein, 8 aa, Borrelia burgdorferi B31
LLSSLDYK

SEQ ID NO: 44014 - protein, 8 aa, Borrelia burgdorferi B31
LSSLDYKK

SEQ ID NO: 44015 - protein, 8 aa, Borrelia burgdorferi B31
SSLDYKKE

SEQ ID NO: 44016 - protein, 8 aa, Borrelia burgdorferi B31
SLDYKKEN

SEQ ID NO: 44017 - protein, 8 aa, Borrelia burgdorferi B31
LDYKKENI

SEQ ID NO: 44018 - protein, 8 aa, Borrelia burgdorferi B31
DYKKENIE

SEQ ID NO: 44019 - protein, 8 aa, Borrelia burgdorferi B31
YKKENIET

SEQ ID NO: 44020 - protein, 8 aa, Borrelia burgdorferi B31
KKENIETL

SEQ ID NO: 44021 - protein, 8 aa, Borrelia burgdorferi B31
KENIETLK

SEQ ID NO: 44022 - protein, 8 aa, Borrelia burgdorferi B31
ENIETLKE

SEQ ID NO: 44023 - protein, 8 aa, Borrelia burgdorferi B31
NIETLKEI

SEQ ID NO: 44024 - protein, 8 aa, Borrelia burgdorferi B31
IETLKEIL

SEQ ID NO: 44025 - protein, 8 aa, Borrelia burgdorferi B31
ETLKEILE

SEQ ID NO: 44026 - protein, 8 aa, Borrelia burgdorferi B31
TLKEILEK

SEQ ID NO: 44027 - protein, 8 aa, Borrelia burgdorferi B31
LKEILEKL

SEQ ID NO: 44028 - protein, 8 aa, Borrelia burgdorferi B31
KEILEKLI

SEQ ID NO: 44029 - protein, 8 aa, Borrelia burgdorferi B31
EILEKLIN

SEQ ID NO: 44030 - protein, 8 aa, Borrelia burgdorferi B31
ILEKLINN

SEQ ID NO: 44031 - protein, 8 aa, Borrelia burgdorferi B31
LEKLINNY

SEQ ID NO: 44032 - protein, 8 aa, Borrelia burgdorferi B31
EKLINNYE

SEQ ID NO: 44033 - protein, 8 aa, Borrelia burgdorferi B31
KLINNYEN

SEQ ID NO: 44034 - protein, 8 aa, Borrelia burgdorferi B31
LINNYEND

SEQ ID NO: 44035 - protein, 8 aa, Borrelia burgdorferi B31
INNYENDP

SEQ ID NO: 44036 - protein, 8 aa, Borrelia burgdorferi B31
NNYENDPK

SEQ ID NO: 44037 - protein, 8 aa, Borrelia burgdorferi B31
NYENDPKI

SEQ ID NO: 44038 - protein, 8 aa, Borrelia burgdorferi B31
YENDPKIA

SEQ ID NO: 44039 - protein, 8 aa, Borrelia burgdorferi B31
ENDPKIAA

SEQ ID NO: 44040 - protein, 8 aa, Borrelia burgdorferi B31
NDPKIAAN

SEQ ID NO: 44041 - protein, 8 aa, Borrelia burgdorferi B31
DPKIAANF

SEQ ID NO: 44042 - protein, 8 aa, Borrelia burgdorferi B31
PKIAANFL

SEQ ID NO: 44043 - protein, 8 aa, Borrelia burgdorferi B31
KIAANFLY

SEQ ID NO: 44044 - protein, 8 aa, Borrelia burgdorferi B31
IAANFLYR

SEQ ID NO: 44045 - protein, 8 aa, Borrelia burgdorferi B31
AANFLYRI

SEQ ID NO: 44046 - protein, 8 aa, Borrelia burgdorferi B31
ANFLYRIA

SEQ ID NO: 44047 - protein, 8 aa, Borrelia burgdorferi B31
NFLYRIAL

SEQ ID NO: 44048 - protein, 8 aa, Borrelia burgdorferi B31
FLYRIALD

SEQ ID NO: 44049 - protein, 8 aa, Borrelia burgdorferi B31
LYRIALDI

SEQ ID NO: 44050 - protein, 8 aa, Borrelia burgdorferi B31
YRIALDIQ

SEQ ID NO: 44051 - protein, 8 aa, Borrelia burgdorferi B31
RIALDIQL

SEQ ID NO: 44052 - protein, 8 aa, Borrelia burgdorferi B31
IALDIQLK

SEQ ID NO: 44053 - protein, 8 aa, Borrelia burgdorferi B31
ALDIQLKL

SEQ ID NO: 44054 - protein, 8 aa, Borrelia burgdorferi B31
LDIQLKLE

SEQ ID NO: 44055 - protein, 8 aa, Borrelia burgdorferi B31
DIQLKLEK

SEQ ID NO: 44056 - protein, 8 aa, Borrelia burgdorferi B31
IQLKLEKH

SEQ ID NO: 44057 - protein, 8 aa, Borrelia burgdorferi B31
QLKLEKHL

SEQ ID NO: 44058 - protein, 8 aa, Borrelia burgdorferi B31
LKLEKHLK

SEQ ID NO: 44059 - protein, 8 aa, Borrelia burgdorferi B31
KLEKHLKS

SEQ ID NO: 44060 - protein, 8 aa, Borrelia burgdorferi B31
LEKHLKSI

SEQ ID NO: 44061 - protein, 8 aa, Borrelia burgdorferi B31
EKHLKSIN

SEQ ID NO: 44062 - protein, 8 aa, Borrelia burgdorferi B31
KHLKSINE

SEQ ID NO: 44063 - protein, 8 aa, Borrelia burgdorferi B31
HLKSINEK

SEQ ID NO: 44064 - protein, 8 aa, Borrelia burgdorferi B31
LKSINEKL

SEQ ID NO: 44065 - protein, 8 aa, Borrelia burgdorferi B31
KSINEKLD

SEQ ID NO: 44066 - protein, 8 aa, Borrelia burgdorferi B31
SINEKLDT

SEQ ID NO: 44067 - protein, 8 aa, Borrelia burgdorferi B31
INEKLDTL

SEQ ID NO: 44068 - protein, 8 aa, Borrelia burgdorferi B31
NEKLDTLS

SEQ ID NO: 44069 - protein, 8 aa, Borrelia burgdorferi B31
EKLDTLSK

SEQ ID NO: 44070 - protein, 8 aa, Borrelia burgdorferi B31
KLDTLSKE

SEQ ID NO: 44071 - protein, 8 aa, Borrelia burgdorferi B31
LDTLSKEN

SEQ ID NO: 44072 - protein, 8 aa, Borrelia burgdorferi B31
DTLSKENS

SEQ ID NO: 44073 - protein, 8 aa, Borrelia burgdorferi B31
TLSKENSK

SEQ ID NO: 44074 - protein, 8 aa, Borrelia burgdorferi B31
LSKENSKE

SEQ ID NO: 44075 - protein, 8 aa, Borrelia burgdorferi B31
SKENSKED

SEQ ID NO: 44076 - protein, 8 aa, Borrelia burgdorferi B31
KENSKEDL

SEQ ID NO: 44077 - protein, 8 aa, Borrelia burgdorferi B31
ENSKEDLE

SEQ ID NO: 44078 - protein, 8 aa, Borrelia burgdorferi B31
NSKEDLEA

SEQ ID NO: 44079 - protein, 8 aa, Borrelia burgdorferi B31
SKEDLEAL

SEQ ID NO: 44080 - protein, 8 aa, Borrelia burgdorferi B31
KEDLEALL

SEQ ID NO: 44081 - protein, 8 aa, Borrelia burgdorferi B31
EDLEALLE

SEQ ID NO: 44082 - protein, 8 aa, Borrelia burgdorferi B31
DLEALLEQ

SEQ ID NO: 44083 - protein, 8 aa, Borrelia burgdorferi B31
LEALLEQV

SEQ ID NO: 44084 - protein, 8 aa, Borrelia burgdorferi B31
EALLEQVK

SEQ ID NO: 44085 - protein, 8 aa, Borrelia burgdorferi B31
ALLEQVKS

SEQ ID NO: 44086 - protein, 8 aa, Borrelia burgdorferi B31
LLEQVKSA

SEQ ID NO: 44087 - protein, 8 aa, Borrelia burgdorferi B31
LEQVKSAL

SEQ ID NO: 44088 - protein, 8 aa, Borrelia burgdorferi B31
EQVKSALQ

SEQ ID NO: 44089 - protein, 8 aa, Borrelia burgdorferi B31
QVKSALQL

SEQ ID NO: 44090 - protein, 8 aa, Borrelia burgdorferi B31
VKSALQLQ

SEQ ID NO: 44091 - protein, 8 aa, Borrelia burgdorferi B31
KSALQLQE

SEQ ID NO: 44092 - protein, 8 aa, Borrelia burgdorferi B31
SALQLQEK

SEQ ID NO: 44093 - protein, 8 aa, Borrelia burgdorferi B31
ALQLQEKF

SEQ ID NO: 44094 - protein, 8 aa, Borrelia burgdorferi B31
LQLQEKFK

SEQ ID NO: 44095 - protein, 8 aa, Borrelia burgdorferi B31
QLQEKFKK

SEQ ID NO: 44096 - protein, 8 aa, Borrelia burgdorferi B31
LQEKFKKT

SEQ ID NO: 44097 - protein, 8 aa, Borrelia burgdorferi B31
QEKFKKTL

SEQ ID NO: 44098 - protein, 8 aa, Borrelia burgdorferi B31
EKFKKTLN

SEQ ID NO: 44099 - protein, 8 aa, Borrelia burgdorferi B31
KFKKTLNK

SEQ ID NO: 44100 - protein, 8 aa, Borrelia burgdorferi B31
FKKTLNKT

SEQ ID NO: 44101 - protein, 8 aa, Borrelia burgdorferi B31
KKTLNKTL

SEQ ID NO: 44102 - protein, 8 aa, Borrelia burgdorferi B31
KTLNKTLE

SEQ ID NO: 44103 - protein, 8 aa, Borrelia burgdorferi B31
TLNKTLED

SEQ ID NO: 44104 - protein, 8 aa, Borrelia burgdorferi B31
LNKTLEDY

SEQ ID NO: 44105 - protein, 8 aa, Borrelia burgdorferi B31
NKTLEDYR

SEQ ID NO: 44106 - protein, 8 aa, Borrelia burgdorferi B31
KTLEDYRK

SEQ ID NO: 44107 - protein, 8 aa, Borrelia burgdorferi B31
TLEDYRKN

SEQ ID NO: 44108 - protein, 8 aa, Borrelia burgdorferi B31
LEDYRKNT

SEQ ID NO: 44109 - protein, 8 aa, Borrelia burgdorferi B31
EDYRKNTN

SEQ ID NO: 44110 - protein, 8 aa, Borrelia burgdorferi B31
DYRKNTNN

SEQ ID NO: 44111 - protein, 8 aa, Borrelia burgdorferi B31
YRKNTNNI

SEQ ID NO: 44112 - protein, 8 aa, Borrelia burgdorferi B31
RKNTNNIQ

SEQ ID NO: 44113 - protein, 8 aa, Borrelia burgdorferi B31
KNTNNIQE

SEQ ID NO: 44114 - protein, 8 aa, Borrelia burgdorferi B31
NTNNIQEN

SEQ ID NO: 44115 - protein, 8 aa, Borrelia burgdorferi B31
TNNIQENK

SEQ ID NO: 44116 - protein, 8 aa, Borrelia burgdorferi B31
NNIQENKV

SEQ ID NO: 44117 - protein, 8 aa, Borrelia burgdorferi B31
NIQENKVL

SEQ ID NO: 44118 - protein, 8 aa, Borrelia burgdorferi B31
IQENKVLA

SEQ ID NO: 44119 - protein, 8 aa, Borrelia burgdorferi B31
QENKVLAE

SEQ ID NO: 44120 - protein, 8 aa, Borrelia burgdorferi B31
ENKVLAEH

SEQ ID NO: 44121 - protein, 8 aa, Borrelia burgdorferi B31
NKVLAEHF

SEQ ID NO: 44122 - protein, 8 aa, Borrelia burgdorferi B31
KVLAEHFN

SEQ ID NO: 44123 - protein, 8 aa, Borrelia burgdorferi B31
VLAEHFNK

SEQ ID NO: 44124 - protein, 8 aa, Borrelia burgdorferi B31
LAEHFNKY

SEQ ID NO: 44125 - protein, 8 aa, Borrelia burgdorferi B31
AEHFNKYY

SEQ ID NO: 44126 - protein, 8 aa, Borrelia burgdorferi B31
EHFNKYYK

SEQ ID NO: 44127 - protein, 8 aa, Borrelia burgdorferi B31
HFNKYYKD

SEQ ID NO: 44128 - protein, 8 aa, Borrelia burgdorferi B31
FNKYYKDS

SEQ ID NO: 44129 - protein, 8 aa, Borrelia burgdorferi B31
NKYYKDSD

SEQ ID NO: 44130 - protein, 8 aa, Borrelia burgdorferi B31
KYYKDSDS

SEQ ID NO: 44131 - protein, 8 aa, Borrelia burgdorferi B31
YYKDSDSL

SEQ ID NO: 44132 - protein, 8 aa, Borrelia burgdorferi B31
YKDSDSLQ

SEQ ID NO: 44133 - protein, 8 aa, Borrelia burgdorferi B31
KDSDSLQS

SEQ ID NO: 44134 - protein, 8 aa, Borrelia burgdorferi B31
DSDSLQSA

SEQ ID NO: 44135 - protein, 8 aa, Borrelia burgdorferi B31
SDSLQSAF

SEQ ID NO: 44136 - protein, 8 aa, Borrelia burgdorferi B31
DSLQSAFY

SEQ ID NO: 44137 - protein, 9 aa, Borrelia burgdorferi B31
MKKAKLNII

SEQ ID NO: 44138 - protein, 9 aa, Borrelia burgdorferi B31
KKAKLNIIK

SEQ ID NO: 44139 - protein, 9 aa, Borrelia burgdorferi B31
KAKLNIIKI

SEQ ID NO: 44140 - protein, 9 aa, Borrelia burgdorferi B31
AKLNIIKIN

SEQ ID NO: 44141 - protein, 9 aa, Borrelia burgdorferi B31
KLNIIKINI

SEQ ID NO: 44142 - protein, 9 aa, Borrelia burgdorferi B31
LNIIKINII

SEQ ID NO: 44143 - protein, 9 aa, Borrelia burgdorferi B31
NIIKINIIT

SEQ ID NO: 44144 - protein, 9 aa, Borrelia burgdorferi B31
IIKINIITM

SEQ ID NO: 44145 - protein, 9 aa, Borrelia burgdorferi B31
IKINIITMI

SEQ ID NO: 44146 - protein, 9 aa, Borrelia burgdorferi B31
KINIITMIL

SEQ ID NO: 44147 - protein, 9 aa, Borrelia burgdorferi B31
INIITMILT

SEQ ID NO: 44148 - protein, 9 aa, Borrelia burgdorferi B31
NIITMILTL

SEQ ID NO: 44149 - protein, 9 aa, Borrelia burgdorferi B31
IITMILTLI

SEQ ID NO: 44150 - protein, 9 aa, Borrelia burgdorferi B31
ITMILTLIC

SEQ ID NO: 44151 - protein, 9 aa, Borrelia burgdorferi B31
TMILTLICI

SEQ ID NO: 44152 - protein, 9 aa, Borrelia burgdorferi B31
MILTLICIS

SEQ ID NO: 44153 - protein, 9 aa, Borrelia burgdorferi B31
ILTLICISC

SEQ ID NO: 44154 - protein, 9 aa, Borrelia burgdorferi B31
LTLICISCA

SEQ ID NO: 44155 - protein, 9 aa, Borrelia burgdorferi B31
TLICISCAP

SEQ ID NO: 44156 - protein, 9 aa, Borrelia burgdorferi B31
LICISCAPF

SEQ ID NO: 44157 - protein, 9 aa, Borrelia burgdorferi B31
ICISCAPFN

SEQ ID NO: 44158 - protein, 9 aa, Borrelia burgdorferi B31
CISCAPFNK

SEQ ID NO: 44159 - protein, 9 aa, Borrelia burgdorferi B31
ISCAPFNKI

SEQ ID NO: 44160 - protein, 9 aa, Borrelia burgdorferi B31
SCAPFNKIN

SEQ ID NO: 44161 - protein, 9 aa, Borrelia burgdorferi B31
CAPFNKINP

SEQ ID NO: 44162 - protein, 9 aa, Borrelia burgdorferi B31
APFNKINPK

SEQ ID NO: 44163 - protein, 9 aa, Borrelia burgdorferi B31
PFNKINPKA

SEQ ID NO: 44164 - protein, 9 aa, Borrelia burgdorferi B31
FNKINPKAN

SEQ ID NO: 44165 - protein, 9 aa, Borrelia burgdorferi B31
NKINPKANE

SEQ ID NO: 44166 - protein, 9 aa, Borrelia burgdorferi B31
KINPKANEN

SEQ ID NO: 44167 - protein, 9 aa, Borrelia burgdorferi B31
INPKANENT

SEQ ID NO: 44168 - protein, 9 aa, Borrelia burgdorferi B31
NPKANENTK

SEQ ID NO: 44169 - protein, 9 aa, Borrelia burgdorferi B31
PKANENTKL

SEQ ID NO: 44170 - protein, 9 aa, Borrelia burgdorferi B31
KANENTKLK

SEQ ID NO: 44171 - protein, 9 aa, Borrelia burgdorferi B31
ANENTKLKK

SEQ ID NO: 44172 - protein, 9 aa, Borrelia burgdorferi B31
NENTKLKKN

SEQ ID NO: 44173 - protein, 9 aa, Borrelia burgdorferi B31
ENTKLKKNT

SEQ ID NO: 44174 - protein, 9 aa, Borrelia burgdorferi B31
NTKLKKNTR

SEQ ID NO: 44175 - protein, 9 aa, Borrelia burgdorferi B31
TKLKKNTRL

SEQ ID NO: 44176 - protein, 9 aa, Borrelia burgdorferi B31
KLKKNTRLK

SEQ ID NO: 44177 - protein, 9 aa, Borrelia burgdorferi B31
LKKNTRLKK

SEQ ID NO: 44178 - protein, 9 aa, Borrelia burgdorferi B31
KKNTRLKKP

SEQ ID NO: 44179 - protein, 9 aa, Borrelia burgdorferi B31
KNTRLKKPA

SEQ ID NO: 44180 - protein, 9 aa, Borrelia burgdorferi B31
NTRLKKPAN

SEQ ID NO: 44181 - protein, 9 aa, Borrelia burgdorferi B31
TRLKKPANP

SEQ ID NO: 44182 - protein, 9 aa, Borrelia burgdorferi B31
RLKKPANPG

SEQ ID NO: 44183 - protein, 9 aa, Borrelia burgdorferi B31
LKKPANPGE

SEQ ID NO: 44184 - protein, 9 aa, Borrelia burgdorferi B31
KKPANPGEN

SEQ ID NO: 44185 - protein, 9 aa, Borrelia burgdorferi B31
KPANPGENI

SEQ ID NO: 44186 - protein, 9 aa, Borrelia burgdorferi B31
PANPGENIQ

SEQ ID NO: 44187 - protein, 9 aa, Borrelia burgdorferi B31
ANPGENIQN

SEQ ID NO: 44188 - protein, 9 aa, Borrelia burgdorferi B31
NPGENIQNF

SEQ ID NO: 44189 - protein, 9 aa, Borrelia burgdorferi B31
PGENIQNFK

SEQ ID NO: 44190 - protein, 9 aa, Borrelia burgdorferi B31
GENIQNFKD

SEQ ID NO: 44191 - protein, 9 aa, Borrelia burgdorferi B31
ENIQNFKDK

SEQ ID NO: 44192 - protein, 9 aa, Borrelia burgdorferi B31
NIQNFKDKS

SEQ ID NO: 44193 - protein, 9 aa, Borrelia burgdorferi B31
IQNFKDKSG

SEQ ID NO: 44194 - protein, 9 aa, Borrelia burgdorferi B31
QNFKDKSGD

SEQ ID NO: 44195 - protein, 9 aa, Borrelia burgdorferi B31
NFKDKSGDL

SEQ ID NO: 44196 - protein, 9 aa, Borrelia burgdorferi B31
FKDKSGDLG

SEQ ID NO: 44197 - protein, 9 aa, Borrelia burgdorferi B31
KDKSGDLGA

SEQ ID NO: 44198 - protein, 9 aa, Borrelia burgdorferi B31
DKSGDLGAS

SEQ ID NO: 44199 - protein, 9 aa, Borrelia burgdorferi B31
KSGDLGASD

SEQ ID NO: 44200 - protein, 9 aa, Borrelia burgdorferi B31
SGDLGASDE

SEQ ID NO: 44201 - protein, 9 aa, Borrelia burgdorferi B31
GDLGASDEK

SEQ ID NO: 44202 - protein, 9 aa, Borrelia burgdorferi B31
DLGASDEKF

SEQ ID NO: 44203 - protein, 9 aa, Borrelia burgdorferi B31
LGASDEKFM

SEQ ID NO: 44204 - protein, 9 aa, Borrelia burgdorferi B31
GASDEKFMG

SEQ ID NO: 44205 - protein, 9 aa, Borrelia burgdorferi B31
ASDEKFMGT

SEQ ID NO: 44206 - protein, 9 aa, Borrelia burgdorferi B31
SDEKFMGTT

SEQ ID NO: 44207 - protein, 9 aa, Borrelia burgdorferi B31
DEKFMGTTA

SEQ ID NO: 44208 - protein, 9 aa, Borrelia burgdorferi B31
EKFMGTTAS

SEQ ID NO: 44209 - protein, 9 aa, Borrelia burgdorferi B31
KFMGTTASE

SEQ ID NO: 44210 - protein, 9 aa, Borrelia burgdorferi B31
FMGTTASEL

SEQ ID NO: 44211 - protein, 9 aa, Borrelia burgdorferi B31
MGTTASELK

SEQ ID NO: 44212 - protein, 9 aa, Borrelia burgdorferi B31
GTTASELKA

SEQ ID NO: 44213 - protein, 9 aa, Borrelia burgdorferi B31
TTASELKAI

SEQ ID NO: 44214 - protein, 9 aa, Borrelia burgdorferi B31
TASELKAIG

SEQ ID NO: 44215 - protein, 9 aa, Borrelia burgdorferi B31
ASELKAIGK

SEQ ID NO: 44216 - protein, 9 aa, Borrelia burgdorferi B31
SELKAIGKE

SEQ ID NO: 44217 - protein, 9 aa, Borrelia burgdorferi B31
ELKAIGKEL

SEQ ID NO: 44218 - protein, 9 aa, Borrelia burgdorferi B31
LKAIGKELE

SEQ ID NO: 44219 - protein, 9 aa, Borrelia burgdorferi B31
KAIGKELED

SEQ ID NO: 44220 - protein, 9 aa, Borrelia burgdorferi B31
AIGKELEDR

SEQ ID NO: 44221 - protein, 9 aa, Borrelia burgdorferi B31
IGKELEDRK

SEQ ID NO: 44222 - protein, 9 aa, Borrelia burgdorferi B31
GKELEDRKN

SEQ ID NO: 44223 - protein, 9 aa, Borrelia burgdorferi B31
KELEDRKNQ

SEQ ID NO: 44224 - protein, 9 aa, Borrelia burgdorferi B31
ELEDRKNQY

SEQ ID NO: 44225 - protein, 9 aa, Borrelia burgdorferi B31
LEDRKNQYD

SEQ ID NO: 44226 - protein, 9 aa, Borrelia burgdorferi B31
EDRKNQYDI

SEQ ID NO: 44227 - protein, 9 aa, Borrelia burgdorferi B31
DRKNQYDIQ

SEQ ID NO: 44228 - protein, 9 aa, Borrelia burgdorferi B31
RKNQYDIQI

SEQ ID NO: 44229 - protein, 9 aa, Borrelia burgdorferi B31
KNQYDIQIA

SEQ ID NO: 44230 - protein, 9 aa, Borrelia burgdorferi B31
NQYDIQIAK

SEQ ID NO: 44231 - protein, 9 aa, Borrelia burgdorferi B31
QYDIQIAKI

SEQ ID NO: 44232 - protein, 9 aa, Borrelia burgdorferi B31
YDIQIAKIT

SEQ ID NO: 44233 - protein, 9 aa, Borrelia burgdorferi B31
DIQIAKITN

SEQ ID NO: 44234 - protein, 9 aa, Borrelia burgdorferi B31
IQIAKITNE

SEQ ID NO: 44235 - protein, 9 aa, Borrelia burgdorferi B31
QIAKITNEE

SEQ ID NO: 44236 - protein, 9 aa, Borrelia burgdorferi B31
IAKITNEES

SEQ ID NO: 44237 - protein, 9 aa, Borrelia burgdorferi B31
AKITNEESN

SEQ ID NO: 44238 - protein, 9 aa, Borrelia burgdorferi B31
KITNEESNL

SEQ ID NO: 44239 - protein, 9 aa, Borrelia burgdorferi B31
ITNEESNLL

SEQ ID NO: 44240 - protein, 9 aa, Borrelia burgdorferi B31
TNEESNLLD

SEQ ID NO: 44241 - protein, 9 aa, Borrelia burgdorferi B31
NEESNLLDT

SEQ ID NO: 44242 - protein, 9 aa, Borrelia burgdorferi B31
EESNLLDTY

SEQ ID NO: 44243 - protein, 9 aa, Borrelia burgdorferi B31
ESNLLDTYI

SEQ ID NO: 44244 - protein, 9 aa, Borrelia burgdorferi B31
SNLLDTYIR

SEQ ID NO: 44245 - protein, 9 aa, Borrelia burgdorferi B31
NLLDTYIRA

SEQ ID NO: 44246 - protein, 9 aa, Borrelia burgdorferi B31
LLDTYIRAY

SEQ ID NO: 44247 - protein, 9 aa, Borrelia burgdorferi B31
LDTYIRAYE

SEQ ID NO: 44248 - protein, 9 aa, Borrelia burgdorferi B31
DTYIRAYEL

SEQ ID NO: 44249 - protein, 9 aa, Borrelia burgdorferi B31
TYIRAYELA

SEQ ID NO: 44250 - protein, 9 aa, Borrelia burgdorferi B31
YIRAYELAN

SEQ ID NO: 44251 - protein, 9 aa, Borrelia burgdorferi B31
IRAYELANE

SEQ ID NO: 44252 - protein, 9 aa, Borrelia burgdorferi B31
RAYELANEN

SEQ ID NO: 44253 - protein, 9 aa, Borrelia burgdorferi B31
AYELANENE

SEQ ID NO: 44254 - protein, 9 aa, Borrelia burgdorferi B31
YELANENEK

SEQ ID NO: 44255 - protein, 9 aa, Borrelia burgdorferi B31
ELANENEKM

SEQ ID NO: 44256 - protein, 9 aa, Borrelia burgdorferi B31
LANENEKML

SEQ ID NO: 44257 - protein, 9 aa, Borrelia burgdorferi B31
ANENEKMLL

SEQ ID NO: 44258 - protein, 9 aa, Borrelia burgdorferi B31
NENEKMLLK

SEQ ID NO: 44259 - protein, 9 aa, Borrelia burgdorferi B31
ENEKMLLKR

SEQ ID NO: 44260 - protein, 9 aa, Borrelia burgdorferi B31
NEKMLLKRF

SEQ ID NO: 44261 - protein, 9 aa, Borrelia burgdorferi B31
EKMLLKRFL

SEQ ID NO: 44262 - protein, 9 aa, Borrelia burgdorferi B31
KMLLKRFLL

SEQ ID NO: 44263 - protein, 9 aa, Borrelia burgdorferi B31
MLLKRFLLS

SEQ ID NO: 44264 - protein, 9 aa, Borrelia burgdorferi B31
LLKRFLLSS

SEQ ID NO: 44265 - protein, 9 aa, Borrelia burgdorferi B31
LKRFLLSSL

SEQ ID NO: 44266 - protein, 9 aa, Borrelia burgdorferi B31
KRFLLSSLD

SEQ ID NO: 44267 - protein, 9 aa, Borrelia burgdorferi B31
RFLLSSLDY

SEQ ID NO: 44268 - protein, 9 aa, Borrelia burgdorferi B31
FLLSSLDYK

SEQ ID NO: 44269 - protein, 9 aa, Borrelia burgdorferi B31
LLSSLDYKK

SEQ ID NO: 44270 - protein, 9 aa, Borrelia burgdorferi B31
LSSLDYKKE

SEQ ID NO: 44271 - protein, 9 aa, Borrelia burgdorferi B31
SSLDYKKEN

SEQ ID NO: 44272 - protein, 9 aa, Borrelia burgdorferi B31
SLDYKKENI

SEQ ID NO: 44273 - protein, 9 aa, Borrelia burgdorferi B31
LDYKKENIE

SEQ ID NO: 44274 - protein, 9 aa, Borrelia burgdorferi B31
DYKKENIET

SEQ ID NO: 44275 - protein, 9 aa, Borrelia burgdorferi B31
YKKENIETL

SEQ ID NO: 44276 - protein, 9 aa, Borrelia burgdorferi B31
KKENIETLK

SEQ ID NO: 44277 - protein, 9 aa, Borrelia burgdorferi B31
KENIETLKE

SEQ ID NO: 44278 - protein, 9 aa, Borrelia burgdorferi B31
ENIETLKEI

SEQ ID NO: 44279 - protein, 9 aa, Borrelia burgdorferi B31
NIETLKEIL

SEQ ID NO: 44280 - protein, 9 aa, Borrelia burgdorferi B31
IETLKEILE

SEQ ID NO: 44281 - protein, 9 aa, Borrelia burgdorferi B31
ETLKEILEK

SEQ ID NO: 44282 - protein, 9 aa, Borrelia burgdorferi B31
TLKEILEKL

SEQ ID NO: 44283 - protein, 9 aa, Borrelia burgdorferi B31
LKEILEKLI

SEQ ID NO: 44284 - protein, 9 aa, Borrelia burgdorferi B31
KEILEKLIN

SEQ ID NO: 44285 - protein, 9 aa, Borrelia burgdorferi B31
EILEKLINN

SEQ ID NO: 44286 - protein, 9 aa, Borrelia burgdorferi B31
ILEKLINNY

SEQ ID NO: 44287 - protein, 9 aa, Borrelia burgdorferi B31
LEKLINNYE

SEQ ID NO: 44288 - protein, 9 aa, Borrelia burgdorferi B31
EKLINNYEN

SEQ ID NO: 44289 - protein, 9 aa, Borrelia burgdorferi B31
KLINNYEND

SEQ ID NO: 44290 - protein, 9 aa, Borrelia burgdorferi B31
LINNYENDP

SEQ ID NO: 44291 - protein, 9 aa, Borrelia burgdorferi B31
INNYENDPK

SEQ ID NO: 44292 - protein, 9 aa, Borrelia burgdorferi B31
NNYENDPKI

SEQ ID NO: 44293 - protein, 9 aa, Borrelia burgdorferi B31
NYENDPKIA

SEQ ID NO: 44294 - protein, 9 aa, Borrelia burgdorferi B31
YENDPKIAA

SEQ ID NO: 44295 - protein, 9 aa, Borrelia burgdorferi B31
ENDPKIAAN

SEQ ID NO: 44296 - protein, 9 aa, Borrelia burgdorferi B31
NDPKIAANF

SEQ ID NO: 44297 - protein, 9 aa, Borrelia burgdorferi B31
DPKIAANFL

SEQ ID NO: 44298 - protein, 9 aa, Borrelia burgdorferi B31
PKIAANFLY

SEQ ID NO: 44299 - protein, 9 aa, Borrelia burgdorferi B31
KIAANFLYR

SEQ ID NO: 44300 - protein, 9 aa, Borrelia burgdorferi B31
IAANFLYRI

SEQ ID NO: 44301 - protein, 9 aa, Borrelia burgdorferi B31
AANFLYRIA

SEQ ID NO: 44302 - protein, 9 aa, Borrelia burgdorferi B31
ANFLYRIAL

SEQ ID NO: 44303 - protein, 9 aa, Borrelia burgdorferi B31
NFLYRIALD

SEQ ID NO: 44304 - protein, 9 aa, Borrelia burgdorferi B31
FLYRIALDI

SEQ ID NO: 44305 - protein, 9 aa, Borrelia burgdorferi B31
LYRIALDIQ

SEQ ID NO: 44306 - protein, 9 aa, Borrelia burgdorferi B31
YRIALDIQL

SEQ ID NO: 44307 - protein, 9 aa, Borrelia burgdorferi B31
RIALDIQLK

SEQ ID NO: 44308 - protein, 9 aa, Borrelia burgdorferi B31
IALDIQLKL

SEQ ID NO: 44309 - protein, 9 aa, Borrelia burgdorferi B31
ALDIQLKLE

SEQ ID NO: 44310 - protein, 9 aa, Borrelia burgdorferi B31
LDIQLKLEK

SEQ ID NO: 44311 - protein, 9 aa, Borrelia burgdorferi B31
DIQLKLEKH

SEQ ID NO: 44312 - protein, 9 aa, Borrelia burgdorferi B31
IQLKLEKHL

SEQ ID NO: 44313 - protein, 9 aa, Borrelia burgdorferi B31
QLKLEKHLK

SEQ ID NO: 44314 - protein, 9 aa, Borrelia burgdorferi B31
LKLEKHLKS

SEQ ID NO: 44315 - protein, 9 aa, Borrelia burgdorferi B31
KLEKHLKSI

SEQ ID NO: 44316 - protein, 9 aa, Borrelia burgdorferi B31
LEKHLKSIN

SEQ ID NO: 44317 - protein, 9 aa, Borrelia burgdorferi B31
EKHLKSINE

SEQ ID NO: 44318 - protein, 9 aa, Borrelia burgdorferi B31
KHLKSINEK

SEQ ID NO: 44319 - protein, 9 aa, Borrelia burgdorferi B31
HLKSINEKL

SEQ ID NO: 44320 - protein, 9 aa, Borrelia burgdorferi B31
LKSINEKLD

SEQ ID NO: 44321 - protein, 9 aa, Borrelia burgdorferi B31
KSINEKLDT

SEQ ID NO: 44322 - protein, 9 aa, Borrelia burgdorferi B31
SINEKLDTL

SEQ ID NO: 44323 - protein, 9 aa, Borrelia burgdorferi B31
INEKLDTLS

SEQ ID NO: 44324 - protein, 9 aa, Borrelia burgdorferi B31
NEKLDTLSK

SEQ ID NO: 44325 - protein, 9 aa, Borrelia burgdorferi B31
EKLDTLSKE

SEQ ID NO: 44326 - protein, 9 aa, Borrelia burgdorferi B31
KLDTLSKEN

SEQ ID NO: 44327 - protein, 9 aa, Borrelia burgdorferi B31
LDTLSKENS

SEQ ID NO: 44328 - protein, 9 aa, Borrelia burgdorferi B31
DTLSKENSK

SEQ ID NO: 44329 - protein, 9 aa, Borrelia burgdorferi B31
TLSKENSKE

SEQ ID NO: 44330 - protein, 9 aa, Borrelia burgdorferi B31
LSKENSKED

SEQ ID NO: 44331 - protein, 9 aa, Borrelia burgdorferi B31
SKENSKEDL

SEQ ID NO: 44332 - protein, 9 aa, Borrelia burgdorferi B31
KENSKEDLE

SEQ ID NO: 44333 - protein, 9 aa, Borrelia burgdorferi B31
ENSKEDLEA

SEQ ID NO: 44334 - protein, 9 aa, Borrelia burgdorferi B31
NSKEDLEAL

SEQ ID NO: 44335 - protein, 9 aa, Borrelia burgdorferi B31
SKEDLEALL

SEQ ID NO: 44336 - protein, 9 aa, Borrelia burgdorferi B31
KEDLEALLE

SEQ ID NO: 44337 - protein, 9 aa, Borrelia burgdorferi B31
EDLEALLEQ

SEQ ID NO: 44338 - protein, 9 aa, Borrelia burgdorferi B31
DLEALLEQV

SEQ ID NO: 44339 - protein, 9 aa, Borrelia burgdorferi B31
LEALLEQVK

SEQ ID NO: 44340 - protein, 9 aa, Borrelia burgdorferi B31
EALLEQVKS

SEQ ID NO: 44341 - protein, 9 aa, Borrelia burgdorferi B31
ALLEQVKSA

SEQ ID NO: 44342 - protein, 9 aa, Borrelia burgdorferi B31
LLEQVKSAL

SEQ ID NO: 44343 - protein, 9 aa, Borrelia burgdorferi B31
LEQVKSALQ

SEQ ID NO: 44344 - protein, 9 aa, Borrelia burgdorferi B31
EQVKSALQL

SEQ ID NO: 44345 - protein, 9 aa, Borrelia burgdorferi B31
QVKSALQLQ

SEQ ID NO: 44346 - protein, 9 aa, Borrelia burgdorferi B31
VKSALQLQE

SEQ ID NO: 44347 - protein, 9 aa, Borrelia burgdorferi B31
KSALQLQEK

SEQ ID NO: 44348 - protein, 9 aa, Borrelia burgdorferi B31
SALQLQEKF

SEQ ID NO: 44349 - protein, 9 aa, Borrelia burgdorferi B31
ALQLQEKFK

SEQ ID NO: 44350 - protein, 9 aa, Borrelia burgdorferi B31
LQLQEKFKK

SEQ ID NO: 44351 - protein, 9 aa, Borrelia burgdorferi B31
QLQEKFKKT

SEQ ID NO: 44352 - protein, 9 aa, Borrelia burgdorferi B31
LQEKFKKTL

SEQ ID NO: 44353 - protein, 9 aa, Borrelia burgdorferi B31
QEKFKKTLN

SEQ ID NO: 44354 - protein, 9 aa, Borrelia burgdorferi B31
EKFKKTLNK

SEQ ID NO: 44355 - protein, 9 aa, Borrelia burgdorferi B31
KFKKTLNKT

SEQ ID NO: 44356 - protein, 9 aa, Borrelia burgdorferi B31
FKKTLNKTL

SEQ ID NO: 44357 - protein, 9 aa, Borrelia burgdorferi B31
KKTLNKTLE

SEQ ID NO: 44358 - protein, 9 aa, Borrelia burgdorferi B31
KTLNKTLED

SEQ ID NO: 44359 - protein, 9 aa, Borrelia burgdorferi B31
TLNKTLEDY

SEQ ID NO: 44360 - protein, 9 aa, Borrelia burgdorferi B31
LNKTLEDYR

SEQ ID NO: 44361 - protein, 9 aa, Borrelia burgdorferi B31
NKTLEDYRK

SEQ ID NO: 44362 - protein, 9 aa, Borrelia burgdorferi B31
KTLEDYRKN

SEQ ID NO: 44363 - protein, 9 aa, Borrelia burgdorferi B31
TLEDYRKNT

SEQ ID NO: 44364 - protein, 9 aa, Borrelia burgdorferi B31
LEDYRKNTN

SEQ ID NO: 44365 - protein, 9 aa, Borrelia burgdorferi B31
EDYRKNTNN

SEQ ID NO: 44366 - protein, 9 aa, Borrelia burgdorferi B31
DYRKNTNNI

SEQ ID NO: 44367 - protein, 9 aa, Borrelia burgdorferi B31
YRKNTNNIQ

SEQ ID NO: 44368 - protein, 9 aa, Borrelia burgdorferi B31
RKNTNNIQE

SEQ ID NO: 44369 - protein, 9 aa, Borrelia burgdorferi B31
KNTNNIQEN

SEQ ID NO: 44370 - protein, 9 aa, Borrelia burgdorferi B31
NTNNIQENK

SEQ ID NO: 44371 - protein, 9 aa, Borrelia burgdorferi B31
TNNIQENKV

SEQ ID NO: 44372 - protein, 9 aa, Borrelia burgdorferi B31
NNIQENKVL

SEQ ID NO: 44373 - protein, 9 aa, Borrelia burgdorferi B31
NIQENKVLA

SEQ ID NO: 44374 - protein, 9 aa, Borrelia burgdorferi B31
IQENKVLAE

SEQ ID NO: 44375 - protein, 9 aa, Borrelia burgdorferi B31
QENKVLAEH

SEQ ID NO: 44376 - protein, 9 aa, Borrelia burgdorferi B31
ENKVLAEHF

SEQ ID NO: 44377 - protein, 9 aa, Borrelia burgdorferi B31
NKVLAEHFN

SEQ ID NO: 44378 - protein, 9 aa, Borrelia burgdorferi B31
KVLAEHFNK

SEQ ID NO: 44379 - protein, 9 aa, Borrelia burgdorferi B31
VLAEHFNKY

SEQ ID NO: 44380 - protein, 9 aa, Borrelia burgdorferi B31
LAEHFNKYY

SEQ ID NO: 44381 - protein, 9 aa, Borrelia burgdorferi B31
AEHFNKYYK

SEQ ID NO: 44382 - protein, 9 aa, Borrelia burgdorferi B31
EHFNKYYKD

SEQ ID NO: 44383 - protein, 9 aa, Borrelia burgdorferi B31
HFNKYYKDS

SEQ ID NO: 44384 - protein, 9 aa, Borrelia burgdorferi B31
FNKYYKDSD

SEQ ID NO: 44385 - protein, 9 aa, Borrelia burgdorferi B31
NKYYKDSDS

SEQ ID NO: 44386 - protein, 9 aa, Borrelia burgdorferi B31
KYYKDSDSL

SEQ ID NO: 44387 - protein, 9 aa, Borrelia burgdorferi B31
YYKDSDSLQ

SEQ ID NO: 44388 - protein, 9 aa, Borrelia burgdorferi B31
YKDSDSLQS

SEQ ID NO: 44389 - protein, 9 aa, Borrelia burgdorferi B31
KDSDSLQSA

SEQ ID NO: 44390 - protein, 9 aa, Borrelia burgdorferi B31
DSDSLQSAF

SEQ ID NO: 44391 - protein, 9 aa, Borrelia burgdorferi B31
SDSLQSAFY

SEQ ID NO: 44392 - protein, 10 aa, Borrelia burgdorferi B31
MKKAKLNIIK

SEQ ID NO: 44393 - protein, 10 aa, Borrelia burgdorferi B31
KKAKLNIIKI

SEQ ID NO: 44394 - protein, 10 aa, Borrelia burgdorferi B31
KAKLNIIKIN

SEQ ID NO: 44395 - protein, 10 aa, Borrelia burgdorferi B31
AKLNIIKINI

SEQ ID NO: 44396 - protein, 10 aa, Borrelia burgdorferi B31
KLNIIKINII

SEQ ID NO: 44397 - protein, 10 aa, Borrelia burgdorferi B31
LNIIKINIIT

SEQ ID NO: 44398 - protein, 10 aa, Borrelia burgdorferi B31
NIIKINIITM

SEQ ID NO: 44399 - protein, 10 aa, Borrelia burgdorferi B31
IIKINIITMI

SEQ ID NO: 44400 - protein, 10 aa, Borrelia burgdorferi B31
IKINIITMIL

SEQ ID NO: 44401 - protein, 10 aa, Borrelia burgdorferi B31
KINIITMILT

SEQ ID NO: 44402 - protein, 10 aa, Borrelia burgdorferi B31
INIITMILTL

SEQ ID NO: 44403 - protein, 10 aa, Borrelia burgdorferi B31
NIITMILTLI

SEQ ID NO: 44404 - protein, 10 aa, Borrelia burgdorferi B31
IITMILTLIC

SEQ ID NO: 44405 - protein, 10 aa, Borrelia burgdorferi B31
ITMILTLICI

SEQ ID NO: 44406 - protein, 10 aa, Borrelia burgdorferi B31
TMILTLICIS

SEQ ID NO: 44407 - protein, 10 aa, Borrelia burgdorferi B31
MILTLICISC

SEQ ID NO: 44408 - protein, 10 aa, Borrelia burgdorferi B31
ILTLICISCA

SEQ ID NO: 44409 - protein, 10 aa, Borrelia burgdorferi B31
LTLICISCAP

SEQ ID NO: 44410 - protein, 10 aa, Borrelia burgdorferi B31
TLICISCAPF

SEQ ID NO: 44411 - protein, 10 aa, Borrelia burgdorferi B31
LICISCAPFN

SEQ ID NO: 44412 - protein, 10 aa, Borrelia burgdorferi B31
ICISCAPFNK

SEQ ID NO: 44413 - protein, 10 aa, Borrelia burgdorferi B31
CISCAPFNKI

SEQ ID NO: 44414 - protein, 10 aa, Borrelia burgdorferi B31
ISCAPFNKIN

SEQ ID NO: 44415 - protein, 10 aa, Borrelia burgdorferi B31
SCAPFNKINP

SEQ ID NO: 44416 - protein, 10 aa, Borrelia burgdorferi B31
CAPFNKINPK

SEQ ID NO: 44417 - protein, 10 aa, Borrelia burgdorferi B31
APFNKINPKA

SEQ ID NO: 44418 - protein, 10 aa, Borrelia burgdorferi B31
PFNKINPKAN

SEQ ID NO: 44419 - protein, 10 aa, Borrelia burgdorferi B31
FNKINPKANE

SEQ ID NO: 44420 - protein, 10 aa, Borrelia burgdorferi B31
NKINPKANEN

SEQ ID NO: 44421 - protein, 10 aa, Borrelia burgdorferi B31
KINPKANENT

SEQ ID NO: 44422 - protein, 10 aa, Borrelia burgdorferi B31
INPKANENTK

SEQ ID NO: 44423 - protein, 10 aa, Borrelia burgdorferi B31
NPKANENTKL

SEQ ID NO: 44424 - protein, 10 aa, Borrelia burgdorferi B31
PKANENTKLK

SEQ ID NO: 44425 - protein, 10 aa, Borrelia burgdorferi B31
KANENTKLKK

SEQ ID NO: 44426 - protein, 10 aa, Borrelia burgdorferi B31
ANENTKLKKN

SEQ ID NO: 44427 - protein, 10 aa, Borrelia burgdorferi B31
NENTKLKKNT

SEQ ID NO: 44428 - protein, 10 aa, Borrelia burgdorferi B31
ENTKLKKNTR

SEQ ID NO: 44429 - protein, 10 aa, Borrelia burgdorferi B31
NTKLKKNTRL

SEQ ID NO: 44430 - protein, 10 aa, Borrelia burgdorferi B31
TKLKKNTRLK

SEQ ID NO: 44431 - protein, 10 aa, Borrelia burgdorferi B31
KLKKNTRLKK

SEQ ID NO: 44432 - protein, 10 aa, Borrelia burgdorferi B31
LKKNTRLKKP

SEQ ID NO: 44433 - protein, 10 aa, Borrelia burgdorferi B31
KKNTRLKKPA

SEQ ID NO: 44434 - protein, 10 aa, Borrelia burgdorferi B31
KNTRLKKPAN

SEQ ID NO: 44435 - protein, 10 aa, Borrelia burgdorferi B31
NTRLKKPANP

SEQ ID NO: 44436 - protein, 10 aa, Borrelia burgdorferi B31
TRLKKPANPG

SEQ ID NO: 44437 - protein, 10 aa, Borrelia burgdorferi B31
RLKKPANPGE

SEQ ID NO: 44438 - protein, 10 aa, Borrelia burgdorferi B31
LKKPANPGEN

SEQ ID NO: 44439 - protein, 10 aa, Borrelia burgdorferi B31
KKPANPGENI

SEQ ID NO: 44440 - protein, 10 aa, Borrelia burgdorferi B31
KPANPGENIQ

SEQ ID NO: 44441 - protein, 10 aa, Borrelia burgdorferi B31
PANPGENIQN

SEQ ID NO: 44442 - protein, 10 aa, Borrelia burgdorferi B31
ANPGENIQNF

SEQ ID NO: 44443 - protein, 10 aa, Borrelia burgdorferi B31
NPGENIQNFK

SEQ ID NO: 44444 - protein, 10 aa, Borrelia burgdorferi B31
PGENIQNFKD

SEQ ID NO: 44445 - protein, 10 aa, Borrelia burgdorferi B31
GENIQNFKDK

SEQ ID NO: 44446 - protein, 10 aa, Borrelia burgdorferi B31
ENIQNFKDKS

SEQ ID NO: 44447 - protein, 10 aa, Borrelia burgdorferi B31
NIQNFKDKSG

SEQ ID NO: 44448 - protein, 10 aa, Borrelia burgdorferi B31
IQNFKDKSGD

SEQ ID NO: 44449 - protein, 10 aa, Borrelia burgdorferi B31
QNFKDKSGDL

SEQ ID NO: 44450 - protein, 10 aa, Borrelia burgdorferi B31
NFKDKSGDLG

SEQ ID NO: 44451 - protein, 10 aa, Borrelia burgdorferi B31
FKDKSGDLGA

SEQ ID NO: 44452 - protein, 10 aa, Borrelia burgdorferi B31
KDKSGDLGAS

SEQ ID NO: 44453 - protein, 10 aa, Borrelia burgdorferi B31
DKSGDLGASD

SEQ ID NO: 44454 - protein, 10 aa, Borrelia burgdorferi B31
KSGDLGASDE

SEQ ID NO: 44455 - protein, 10 aa, Borrelia burgdorferi B31
SGDLGASDEK

SEQ ID NO: 44456 - protein, 10 aa, Borrelia burgdorferi B31
GDLGASDEKF

SEQ ID NO: 44457 - protein, 10 aa, Borrelia burgdorferi B31
DLGASDEKFM

SEQ ID NO: 44458 - protein, 10 aa, Borrelia burgdorferi B31
LGASDEKFMG

SEQ ID NO: 44459 - protein, 10 aa, Borrelia burgdorferi B31
GASDEKFMGT

SEQ ID NO: 44460 - protein, 10 aa, Borrelia burgdorferi B31
ASDEKFMGTT

SEQ ID NO: 44461 - protein, 10 aa, Borrelia burgdorferi B31
SDEKFMGTTA

SEQ ID NO: 44462 - protein, 10 aa, Borrelia burgdorferi B31
DEKFMGTTAS

SEQ ID NO: 44463 - protein, 10 aa, Borrelia burgdorferi B31
EKFMGTTASE

SEQ ID NO: 44464 - protein, 10 aa, Borrelia burgdorferi B31
KFMGTTASEL

SEQ ID NO: 44465 - protein, 10 aa, Borrelia burgdorferi B31
FMGTTASELK

SEQ ID NO: 44466 - protein, 10 aa, Borrelia burgdorferi B31
MGTTASELKA

SEQ ID NO: 44467 - protein, 10 aa, Borrelia burgdorferi B31
GTTASELKAI

SEQ ID NO: 44468 - protein, 10 aa, Borrelia burgdorferi B31
TTASELKAIG

SEQ ID NO: 44469 - protein, 10 aa, Borrelia burgdorferi B31
TASELKAIGK

SEQ ID NO: 44470 - protein, 10 aa, Borrelia burgdorferi B31
ASELKAIGKE

SEQ ID NO: 44471 - protein, 10 aa, Borrelia burgdorferi B31
SELKAIGKEL

SEQ ID NO: 44472 - protein, 10 aa, Borrelia burgdorferi B31
ELKAIGKELE

SEQ ID NO: 44473 - protein, 10 aa, Borrelia burgdorferi B31
LKAIGKELED

SEQ ID NO: 44474 - protein, 10 aa, Borrelia burgdorferi B31
KAIGKELEDR

SEQ ID NO: 44475 - protein, 10 aa, Borrelia burgdorferi B31
AIGKELEDRK

SEQ ID NO: 44476 - protein, 10 aa, Borrelia burgdorferi B31
IGKELEDRKN

SEQ ID NO: 44477 - protein, 10 aa, Borrelia burgdorferi B31
GKELEDRKNQ

SEQ ID NO: 44478 - protein, 10 aa, Borrelia burgdorferi B31
KELEDRKNQY

SEQ ID NO: 44479 - protein, 10 aa, Borrelia burgdorferi B31
ELEDRKNQYD

SEQ ID NO: 44480 - protein, 10 aa, Borrelia burgdorferi B31
LEDRKNQYDI

SEQ ID NO: 44481 - protein, 10 aa, Borrelia burgdorferi B31
EDRKNQYDIQ

SEQ ID NO: 44482 - protein, 10 aa, Borrelia burgdorferi B31
DRKNQYDIQI

SEQ ID NO: 44483 - protein, 10 aa, Borrelia burgdorferi B31
RKNQYDIQIA

SEQ ID NO: 44484 - protein, 10 aa, Borrelia burgdorferi B31
KNQYDIQIAK

SEQ ID NO: 44485 - protein, 10 aa, Borrelia burgdorferi B31
NQYDIQIAKI

SEQ ID NO: 44486 - protein, 10 aa, Borrelia burgdorferi B31
QYDIQIAKIT

SEQ ID NO: 44487 - protein, 10 aa, Borrelia burgdorferi B31
YDIQIAKITN

SEQ ID NO: 44488 - protein, 10 aa, Borrelia burgdorferi B31
DIQIAKITNE

SEQ ID NO: 44489 - protein, 10 aa, Borrelia burgdorferi B31
IQIAKITNEE

SEQ ID NO: 44490 - protein, 10 aa, Borrelia burgdorferi B31
QIAKITNEES

SEQ ID NO: 44491 - protein, 10 aa, Borrelia burgdorferi B31
IAKITNEESN

SEQ ID NO: 44492 - protein, 10 aa, Borrelia burgdorferi B31
AKITNEESNL

SEQ ID NO: 44493 - protein, 10 aa, Borrelia burgdorferi B31
KITNEESNLL

SEQ ID NO: 44494 - protein, 10 aa, Borrelia burgdorferi B31
ITNEESNLLD

SEQ ID NO: 44495 - protein, 10 aa, Borrelia burgdorferi B31
TNEESNLLDT

SEQ ID NO: 44496 - protein, 10 aa, Borrelia burgdorferi B31
NEESNLLDTY

SEQ ID NO: 44497 - protein, 10 aa, Borrelia burgdorferi B31
EESNLLDTYI

SEQ ID NO: 44498 - protein, 10 aa, Borrelia burgdorferi B31
ESNLLDTYIR

SEQ ID NO: 44499 - protein, 10 aa, Borrelia burgdorferi B31
SNLLDTYIRA

SEQ ID NO: 44500 - protein, 10 aa, Borrelia burgdorferi B31
NLLDTYIRAY

SEQ ID NO: 44501 - protein, 10 aa, Borrelia burgdorferi B31
LLDTYIRAYE

SEQ ID NO: 44502 - protein, 10 aa, Borrelia burgdorferi B31
LDTYIRAYEL

SEQ ID NO: 44503 - protein, 10 aa, Borrelia burgdorferi B31
DTYIRAYELA

SEQ ID NO: 44504 - protein, 10 aa, Borrelia burgdorferi B31
TYIRAYELAN

SEQ ID NO: 44505 - protein, 10 aa, Borrelia burgdorferi B31
YIRAYELANE

SEQ ID NO: 44506 - protein, 10 aa, Borrelia burgdorferi B31
IRAYELANEN

SEQ ID NO: 44507 - protein, 10 aa, Borrelia burgdorferi B31
RAYELANENE

SEQ ID NO: 44508 - protein, 10 aa, Borrelia burgdorferi B31
AYELANENEK

SEQ ID NO: 44509 - protein, 10 aa, Borrelia burgdorferi B31
YELANENEKM

SEQ ID NO: 44510 - protein, 10 aa, Borrelia burgdorferi B31
ELANENEKML

SEQ ID NO: 44511 - protein, 10 aa, Borrelia burgdorferi B31
LANENEKMLL

SEQ ID NO: 44512 - protein, 10 aa, Borrelia burgdorferi B31
ANENEKMLLK

SEQ ID NO: 44513 - protein, 10 aa, Borrelia burgdorferi B31
NENEKMLLKR

SEQ ID NO: 44514 - protein, 10 aa, Borrelia burgdorferi B31
ENEKMLLKRF

SEQ ID NO: 44515 - protein, 10 aa, Borrelia burgdorferi B31
NEKMLLKRFL

SEQ ID NO: 44516 - protein, 10 aa, Borrelia burgdorferi B31
EKMLLKRFLL

SEQ ID NO: 44517 - protein, 10 aa, Borrelia burgdorferi B31
KMLLKRFLLS

SEQ ID NO: 44518 - protein, 10 aa, Borrelia burgdorferi B31
MLLKRFLLSS

SEQ ID NO: 44519 - protein, 10 aa, Borrelia burgdorferi B31
LLKRFLLSSL

SEQ ID NO: 44520 - protein, 10 aa, Borrelia burgdorferi B31
LKRFLLSSLD

SEQ ID NO: 44521 - protein, 10 aa, Borrelia burgdorferi B31
KRFLLSSLDY

SEQ ID NO: 44522 - protein, 10 aa, Borrelia burgdorferi B31
RFLLSSLDYK

SEQ ID NO: 44523 - protein, 10 aa, Borrelia burgdorferi B31
FLLSSLDYKK

SEQ ID NO: 44524 - protein, 10 aa, Borrelia burgdorferi B31
LLSSLDYKKE

SEQ ID NO: 44525 - protein, 10 aa, Borrelia burgdorferi B31
LSSLDYKKEN

SEQ ID NO: 44526 - protein, 10 aa, Borrelia burgdorferi B31
SSLDYKKENI

SEQ ID NO: 44527 - protein, 10 aa, Borrelia burgdorferi B31
SLDYKKENIE

SEQ ID NO: 44528 - protein, 10 aa, Borrelia burgdorferi B31
LDYKKENIET

SEQ ID NO: 44529 - protein, 10 aa, Borrelia burgdorferi B31
DYKKENIETL

SEQ ID NO: 44530 - protein, 10 aa, Borrelia burgdorferi B31
YKKENIETLK

SEQ ID NO: 44531 - protein, 10 aa, Borrelia burgdorferi B31
KKENIETLKE

SEQ ID NO: 44532 - protein, 10 aa, Borrelia burgdorferi B31
KENIETLKEI

SEQ ID NO: 44533 - protein, 10 aa, Borrelia burgdorferi B31
ENIETLKEIL

SEQ ID NO: 44534 - protein, 10 aa, Borrelia burgdorferi B31
NIETLKEILE

SEQ ID NO: 44535 - protein, 10 aa, Borrelia burgdorferi B31
IETLKEILEK

SEQ ID NO: 44536 - protein, 10 aa, Borrelia burgdorferi B31
ETLKEILEKL

SEQ ID NO: 44537 - protein, 10 aa, Borrelia burgdorferi B31
TLKEILEKLI

SEQ ID NO: 44538 - protein, 10 aa, Borrelia burgdorferi B31
LKEILEKLIN

SEQ ID NO: 44539 - protein, 10 aa, Borrelia burgdorferi B31
KEILEKLINN

SEQ ID NO: 44540 - protein, 10 aa, Borrelia burgdorferi B31
EILEKLINNY

SEQ ID NO: 44541 - protein, 10 aa, Borrelia burgdorferi B31
ILEKLINNYE

SEQ ID NO: 44542 - protein, 10 aa, Borrelia burgdorferi B31
LEKLINNYEN

SEQ ID NO: 44543 - protein, 10 aa, Borrelia burgdorferi B31
EKLINNYEND

SEQ ID NO: 44544 - protein, 10 aa, Borrelia burgdorferi B31
KLINNYENDP

SEQ ID NO: 44545 - protein, 10 aa, Borrelia burgdorferi B31
LINNYENDPK

SEQ ID NO: 44546 - protein, 10 aa, Borrelia burgdorferi B31
INNYENDPKI

SEQ ID NO: 44547 - protein, 10 aa, Borrelia burgdorferi B31
NNYENDPKIA

SEQ ID NO: 44548 - protein, 10 aa, Borrelia burgdorferi B31
NYENDPKIAA

SEQ ID NO: 44549 - protein, 10 aa, Borrelia burgdorferi B31
YENDPKIAAN

SEQ ID NO: 44550 - protein, 10 aa, Borrelia burgdorferi B31
ENDPKIAANF

SEQ ID NO: 44551 - protein, 10 aa, Borrelia burgdorferi B31
NDPKIAANFL

SEQ ID NO: 44552 - protein, 10 aa, Borrelia burgdorferi B31
DPKIAANFLY

SEQ ID NO: 44553 - protein, 10 aa, Borrelia burgdorferi B31
PKIAANFLYR

SEQ ID NO: 44554 - protein, 10 aa, Borrelia burgdorferi B31
KIAANFLYRI

SEQ ID NO: 44555 - protein, 10 aa, Borrelia burgdorferi B31
IAANFLYRIA

SEQ ID NO: 44556 - protein, 10 aa, Borrelia burgdorferi B31
AANFLYRIAL

SEQ ID NO: 44557 - protein, 10 aa, Borrelia burgdorferi B31
ANFLYRIALD

SEQ ID NO: 44558 - protein, 10 aa, Borrelia burgdorferi B31
NFLYRIALDI

SEQ ID NO: 44559 - protein, 10 aa, Borrelia burgdorferi B31
FLYRIALDIQ

SEQ ID NO: 44560 - protein, 10 aa, Borrelia burgdorferi B31
LYRIALDIQL

SEQ ID NO: 44561 - protein, 10 aa, Borrelia burgdorferi B31
YRIALDIQLK

SEQ ID NO: 44562 - protein, 10 aa, Borrelia burgdorferi B31
RIALDIQLKL

SEQ ID NO: 44563 - protein, 10 aa, Borrelia burgdorferi B31
IALDIQLKLE

SEQ ID NO: 44564 - protein, 10 aa, Borrelia burgdorferi B31
ALDIQLKLEK

SEQ ID NO: 44565 - protein, 10 aa, Borrelia burgdorferi B31
LDIQLKLEKH

SEQ ID NO: 44566 - protein, 10 aa, Borrelia burgdorferi B31
DIQLKLEKHL

SEQ ID NO: 44567 - protein, 10 aa, Borrelia burgdorferi B31
IQLKLEKHLK

SEQ ID NO: 44568 - protein, 10 aa, Borrelia burgdorferi B31
QLKLEKHLKS

SEQ ID NO: 44569 - protein, 10 aa, Borrelia burgdorferi B31
LKLEKHLKSI

SEQ ID NO: 44570 - protein, 10 aa, Borrelia burgdorferi B31
KLEKHLKSIN

SEQ ID NO: 44571 - protein, 10 aa, Borrelia burgdorferi B31
LEKHLKSINE

SEQ ID NO: 44572 - protein, 10 aa, Borrelia burgdorferi B31
EKHLKSINEK

SEQ ID NO: 44573 - protein, 10 aa, Borrelia burgdorferi B31
KHLKSINEKL

SEQ ID NO: 44574 - protein, 10 aa, Borrelia burgdorferi B31
HLKSINEKLD

SEQ ID NO: 44575 - protein, 10 aa, Borrelia burgdorferi B31
LKSINEKLDT

SEQ ID NO: 44576 - protein, 10 aa, Borrelia burgdorferi B31
KSINEKLDTL

SEQ ID NO: 44577 - protein, 10 aa, Borrelia burgdorferi B31
SINEKLDTLS

SEQ ID NO: 44578 - protein, 10 aa, Borrelia burgdorferi B31
INEKLDTLSK

SEQ ID NO: 44579 - protein, 10 aa, Borrelia burgdorferi B31
NEKLDTLSKE

SEQ ID NO: 44580 - protein, 10 aa, Borrelia burgdorferi B31
EKLDTLSKEN

SEQ ID NO: 44581 - protein, 10 aa, Borrelia burgdorferi B31
KLDTLSKENS

SEQ ID NO: 44582 - protein, 10 aa, Borrelia burgdorferi B31
LDTLSKENSK

SEQ ID NO: 44583 - protein, 10 aa, Borrelia burgdorferi B31
DTLSKENSKE

SEQ ID NO: 44584 - protein, 10 aa, Borrelia burgdorferi B31
TLSKENSKED

SEQ ID NO: 44585 - protein, 10 aa, Borrelia burgdorferi B31
LSKENSKEDL

SEQ ID NO: 44586 - protein, 10 aa, Borrelia burgdorferi B31
SKENSKEDLE

SEQ ID NO: 44587 - protein, 10 aa, Borrelia burgdorferi B31
KENSKEDLEA

SEQ ID NO: 44588 - protein, 10 aa, Borrelia burgdorferi B31
ENSKEDLEAL

SEQ ID NO: 44589 - protein, 10 aa, Borrelia burgdorferi B31
NSKEDLEALL

SEQ ID NO: 44590 - protein, 10 aa, Borrelia burgdorferi B31
SKEDLEALLE

SEQ ID NO: 44591 - protein, 10 aa, Borrelia burgdorferi B31
KEDLEALLEQ

SEQ ID NO: 44592 - protein, 10 aa, Borrelia burgdorferi B31
EDLEALLEQV

SEQ ID NO: 44593 - protein, 10 aa, Borrelia burgdorferi B31
DLEALLEQVK

SEQ ID NO: 44594 - protein, 10 aa, Borrelia burgdorferi B31
LEALLEQVKS

SEQ ID NO: 44595 - protein, 10 aa, Borrelia burgdorferi B31
EALLEQVKSA

SEQ ID NO: 44596 - protein, 10 aa, Borrelia burgdorferi B31
ALLEQVKSAL

SEQ ID NO: 44597 - protein, 10 aa, Borrelia burgdorferi B31
LLEQVKSALQ

SEQ ID NO: 44598 - protein, 10 aa, Borrelia burgdorferi B31
LEQVKSALQL

SEQ ID NO: 44599 - protein, 10 aa, Borrelia burgdorferi B31
EQVKSALQLQ

SEQ ID NO: 44600 - protein, 10 aa, Borrelia burgdorferi B31
QVKSALQLQE

SEQ ID NO: 44601 - protein, 10 aa, Borrelia burgdorferi B31
VKSALQLQEK

SEQ ID NO: 44602 - protein, 10 aa, Borrelia burgdorferi B31
KSALQLQEKF

SEQ ID NO: 44603 - protein, 10 aa, Borrelia burgdorferi B31
SALQLQEKFK

SEQ ID NO: 44604 - protein, 10 aa, Borrelia burgdorferi B31
ALQLQEKFKK

SEQ ID NO: 44605 - protein, 10 aa, Borrelia burgdorferi B31
LQLQEKFKKT

SEQ ID NO: 44606 - protein, 10 aa, Borrelia burgdorferi B31
QLQEKFKKTL

SEQ ID NO: 44607 - protein, 10 aa, Borrelia burgdorferi B31
LQEKFKKTLN

SEQ ID NO: 44608 - protein, 10 aa, Borrelia burgdorferi B31
QEKFKKTLNK

SEQ ID NO: 44609 - protein, 10 aa, Borrelia burgdorferi B31
EKFKKTLNKT

SEQ ID NO: 44610 - protein, 10 aa, Borrelia burgdorferi B31
KFKKTLNKTL

SEQ ID NO: 44611 - protein, 10 aa, Borrelia burgdorferi B31
FKKTLNKTLE

SEQ ID NO: 44612 - protein, 10 aa, Borrelia burgdorferi B31
KKTLNKTLED

SEQ ID NO: 44613 - protein, 10 aa, Borrelia burgdorferi B31
KTLNKTLEDY

SEQ ID NO: 44614 - protein, 10 aa, Borrelia burgdorferi B31
TLNKTLEDYR

SEQ ID NO: 44615 - protein, 10 aa, Borrelia burgdorferi B31
LNKTLEDYRK

SEQ ID NO: 44616 - protein, 10 aa, Borrelia burgdorferi B31
NKTLEDYRKN

SEQ ID NO: 44617 - protein, 10 aa, Borrelia burgdorferi B31
KTLEDYRKNT

SEQ ID NO: 44618 - protein, 10 aa, Borrelia burgdorferi B31
TLEDYRKNTN

SEQ ID NO: 44619 - protein, 10 aa, Borrelia burgdorferi B31
LEDYRKNTNN

SEQ ID NO: 44620 - protein, 10 aa, Borrelia burgdorferi B31
EDYRKNTNNI

SEQ ID NO: 44621 - protein, 10 aa, Borrelia burgdorferi B31
DYRKNTNNIQ

SEQ ID NO: 44622 - protein, 10 aa, Borrelia burgdorferi B31
YRKNTNNIQE

SEQ ID NO: 44623 - protein, 10 aa, Borrelia burgdorferi B31
RKNTNNIQEN

SEQ ID NO: 44624 - protein, 10 aa, Borrelia burgdorferi B31
KNTNNIQENK

SEQ ID NO: 44625 - protein, 10 aa, Borrelia burgdorferi B31
NTNNIQENKV

SEQ ID NO: 44626 - protein, 10 aa, Borrelia burgdorferi B31
TNNIQENKVL

SEQ ID NO: 44627 - protein, 10 aa, Borrelia burgdorferi B31
NNIQENKVLA

SEQ ID NO: 44628 - protein, 10 aa, Borrelia burgdorferi B31
NIQENKVLAE

SEQ ID NO: 44629 - protein, 10 aa, Borrelia burgdorferi B31
IQENKVLAEH

SEQ ID NO: 44630 - protein, 10 aa, Borrelia burgdorferi B31
QENKVLAEHF

SEQ ID NO: 44631 - protein, 10 aa, Borrelia burgdorferi B31
ENKVLAEHFN

SEQ ID NO: 44632 - protein, 10 aa, Borrelia burgdorferi B31
NKVLAEHFNK

SEQ ID NO: 44633 - protein, 10 aa, Borrelia burgdorferi B31
KVLAEHFNKY

SEQ ID NO: 44634 - protein, 10 aa, Borrelia burgdorferi B31
VLAEHFNKYY

SEQ ID NO: 44635 - protein, 10 aa, Borrelia burgdorferi B31
LAEHFNKYYK

SEQ ID NO: 44636 - protein, 10 aa, Borrelia burgdorferi B31
AEHFNKYYKD

SEQ ID NO: 44637 - protein, 10 aa, Borrelia burgdorferi B31
EHFNKYYKDS

SEQ ID NO: 44638 - protein, 10 aa, Borrelia burgdorferi B31
HFNKYYKDSD

SEQ ID NO: 44639 - protein, 10 aa, Borrelia burgdorferi B31
FNKYYKDSDS

SEQ ID NO: 44640 - protein, 10 aa, Borrelia burgdorferi B31
NKYYKDSDSL

SEQ ID NO: 44641 - protein, 10 aa, Borrelia burgdorferi B31
KYYKDSDSLQ

SEQ ID NO: 44642 - protein, 10 aa, Borrelia burgdorferi B31
YYKDSDSLQS

SEQ ID NO: 44643 - protein, 10 aa, Borrelia burgdorferi B31
YKDSDSLQSA

SEQ ID NO: 44644 - protein, 10 aa, Borrelia burgdorferi B31
KDSDSLQSAF

SEQ ID NO: 44645 - protein, 10 aa, Borrelia burgdorferi B31
DSDSLQSAFY

SEQ ID NO: 44646 - protein, 11 aa, Borrelia burgdorferi B31
MKKAKLNIIKI

SEQ ID NO: 44647 - protein, 11 aa, Borrelia burgdorferi B31
KKAKLNIIKIN

SEQ ID NO: 44648 - protein, 11 aa, Borrelia burgdorferi B31
KAKLNIIKINI

SEQ ID NO: 44649 - protein, 11 aa, Borrelia burgdorferi B31
AKLNIIKINII

SEQ ID NO: 44650 - protein, 11 aa, Borrelia burgdorferi B31
KLNIIKINIIT

SEQ ID NO: 44651 - protein, 11 aa, Borrelia burgdorferi B31
LNIIKINIITM

SEQ ID NO: 44652 - protein, 11 aa, Borrelia burgdorferi B31
NIIKINIITMI

SEQ ID NO: 44653 - protein, 11 aa, Borrelia burgdorferi B31
IIKINIITMIL

SEQ ID NO: 44654 - protein, 11 aa, Borrelia burgdorferi B31
IKINIITMILT

SEQ ID NO: 44655 - protein, 11 aa, Borrelia burgdorferi B31
KINIITMILTL

SEQ ID NO: 44656 - protein, 11 aa, Borrelia burgdorferi B31
INIITMILTLI

SEQ ID NO: 44657 - protein, 11 aa, Borrelia burgdorferi B31
NIITMILTLIC

SEQ ID NO: 44658 - protein, 11 aa, Borrelia burgdorferi B31
IITMILTLICI

SEQ ID NO: 44659 - protein, 11 aa, Borrelia burgdorferi B31
ITMILTLICIS

SEQ ID NO: 44660 - protein, 11 aa, Borrelia burgdorferi B31
TMILTLICISC

SEQ ID NO: 44661 - protein, 11 aa, Borrelia burgdorferi B31
MILTLICISCA

SEQ ID NO: 44662 - protein, 11 aa, Borrelia burgdorferi B31
ILTLICISCAP

SEQ ID NO: 44663 - protein, 11 aa, Borrelia burgdorferi B31
LTLICISCAPF

SEQ ID NO: 44664 - protein, 11 aa, Borrelia burgdorferi B31
TLICISCAPFN

SEQ ID NO: 44665 - protein, 11 aa, Borrelia burgdorferi B31
LICISCAPFNK

SEQ ID NO: 44666 - protein, 11 aa, Borrelia burgdorferi B31
ICISCAPFNKI

SEQ ID NO: 44667 - protein, 11 aa, Borrelia burgdorferi B31
CISCAPFNKIN

SEQ ID NO: 44668 - protein, 11 aa, Borrelia burgdorferi B31
ISCAPFNKINP

SEQ ID NO: 44669 - protein, 11 aa, Borrelia burgdorferi B31
SCAPFNKINPK

SEQ ID NO: 44670 - protein, 11 aa, Borrelia burgdorferi B31
CAPFNKINPKA

SEQ ID NO: 44671 - protein, 11 aa, Borrelia burgdorferi B31
APFNKINPKAN

SEQ ID NO: 44672 - protein, 11 aa, Borrelia burgdorferi B31
PFNKINPKANE

SEQ ID NO: 44673 - protein, 11 aa, Borrelia burgdorferi B31
FNKINPKANEN

SEQ ID NO: 44674 - protein, 11 aa, Borrelia burgdorferi B31
NKINPKANENT

SEQ ID NO: 44675 - protein, 11 aa, Borrelia burgdorferi B31
KINPKANENTK

SEQ ID NO: 44676 - protein, 11 aa, Borrelia burgdorferi B31
INPKANENTKL

SEQ ID NO: 44677 - protein, 11 aa, Borrelia burgdorferi B31
NPKANENTKLK

SEQ ID NO: 44678 - protein, 11 aa, Borrelia burgdorferi B31
PKANENTKLKK

SEQ ID NO: 44679 - protein, 11 aa, Borrelia burgdorferi B31
KANENTKLKKN

SEQ ID NO: 44680 - protein, 11 aa, Borrelia burgdorferi B31
ANENTKLKKNT

SEQ ID NO: 44681 - protein, 11 aa, Borrelia burgdorferi B31
NENTKLKKNTR

SEQ ID NO: 44682 - protein, 11 aa, Borrelia burgdorferi B31
ENTKLKKNTRL

SEQ ID NO: 44683 - protein, 11 aa, Borrelia burgdorferi B31
NTKLKKNTRLK

SEQ ID NO: 44684 - protein, 11 aa, Borrelia burgdorferi B31
TKLKKNTRLKK

SEQ ID NO: 44685 - protein, 11 aa, Borrelia burgdorferi B31
KLKKNTRLKKP

SEQ ID NO: 44686 - protein, 11 aa, Borrelia burgdorferi B31
LKKNTRLKKPA

SEQ ID NO: 44687 - protein, 11 aa, Borrelia burgdorferi B31
KKNTRLKKPAN

SEQ ID NO: 44688 - protein, 11 aa, Borrelia burgdorferi B31
KNTRLKKPANP

SEQ ID NO: 44689 - protein, 11 aa, Borrelia burgdorferi B31
NTRLKKPANPG

SEQ ID NO: 44690 - protein, 11 aa, Borrelia burgdorferi B31
TRLKKPANPGE

SEQ ID NO: 44691 - protein, 11 aa, Borrelia burgdorferi B31
RLKKPANPGEN

SEQ ID NO: 44692 - protein, 11 aa, Borrelia burgdorferi B31
LKKPANPGENI

SEQ ID NO: 44693 - protein, 11 aa, Borrelia burgdorferi B31
KKPANPGENIQ

SEQ ID NO: 44694 - protein, 11 aa, Borrelia burgdorferi B31
KPANPGENIQN

SEQ ID NO: 44695 - protein, 11 aa, Borrelia burgdorferi B31
PANPGENIQNF

SEQ ID NO: 44696 - protein, 11 aa, Borrelia burgdorferi B31
ANPGENIQNFK

SEQ ID NO: 44697 - protein, 11 aa, Borrelia burgdorferi B31
NPGENIQNFKD

SEQ ID NO: 44698 - protein, 11 aa, Borrelia burgdorferi B31
PGENIQNFKDK

SEQ ID NO: 44699 - protein, 11 aa, Borrelia burgdorferi B31
GENIQNFKDKS

SEQ ID NO: 44700 - protein, 11 aa, Borrelia burgdorferi B31
ENIQNFKDKSG

SEQ ID NO: 44701 - protein, 11 aa, Borrelia burgdorferi B31
NIQNFKDKSGD

SEQ ID NO: 44702 - protein, 11 aa, Borrelia burgdorferi B31
IQNFKDKSGDL

SEQ ID NO: 44703 - protein, 11 aa, Borrelia burgdorferi B31
QNFKDKSGDLG

SEQ ID NO: 44704 - protein, 11 aa, Borrelia burgdorferi B31
NFKDKSGDLGA

SEQ ID NO: 44705 - protein, 11 aa, Borrelia burgdorferi B31
FKDKSGDLGAS

SEQ ID NO: 44706 - protein, 11 aa, Borrelia burgdorferi B31
KDKSGDLGASD

SEQ ID NO: 44707 - protein, 11 aa, Borrelia burgdorferi B31
DKSGDLGASDE

SEQ ID NO: 44708 - protein, 11 aa, Borrelia burgdorferi B31
KSGDLGASDEK

SEQ ID NO: 44709 - protein, 11 aa, Borrelia burgdorferi B31
SGDLGASDEKF

SEQ ID NO: 44710 - protein, 11 aa, Borrelia burgdorferi B31
GDLGASDEKFM

SEQ ID NO: 44711 - protein, 11 aa, Borrelia burgdorferi B31
DLGASDEKFMG

SEQ ID NO: 44712 - protein, 11 aa, Borrelia burgdorferi B31
LGASDEKFMGT

SEQ ID NO: 44713 - protein, 11 aa, Borrelia burgdorferi B31
GASDEKFMGTT

SEQ ID NO: 44714 - protein, 11 aa, Borrelia burgdorferi B31
ASDEKFMGTTA

SEQ ID NO: 44715 - protein, 11 aa, Borrelia burgdorferi B31
SDEKFMGTTAS

SEQ ID NO: 44716 - protein, 11 aa, Borrelia burgdorferi B31
DEKFMGTTASE

SEQ ID NO: 44717 - protein, 11 aa, Borrelia burgdorferi B31
EKFMGTTASEL

SEQ ID NO: 44718 - protein, 11 aa, Borrelia burgdorferi B31
KFMGTTASELK

SEQ ID NO: 44719 - protein, 11 aa, Borrelia burgdorferi B31
FMGTTASELKA

SEQ ID NO: 44720 - protein, 11 aa, Borrelia burgdorferi B31
MGTTASELKAI

SEQ ID NO: 44721 - protein, 11 aa, Borrelia burgdorferi B31
GTTASELKAIG

SEQ ID NO: 44722 - protein, 11 aa, Borrelia burgdorferi B31
TTASELKAIGK

SEQ ID NO: 44723 - protein, 11 aa, Borrelia burgdorferi B31
TASELKAIGKE

SEQ ID NO: 44724 - protein, 11 aa, Borrelia burgdorferi B31
ASELKAIGKEL

SEQ ID NO: 44725 - protein, 11 aa, Borrelia burgdorferi B31
SELKAIGKELE

SEQ ID NO: 44726 - protein, 11 aa, Borrelia burgdorferi B31
ELKAIGKELED

SEQ ID NO: 44727 - protein, 11 aa, Borrelia burgdorferi B31
LKAIGKELEDR

SEQ ID NO: 44728 - protein, 11 aa, Borrelia burgdorferi B31
KAIGKELEDRK

SEQ ID NO: 44729 - protein, 11 aa, Borrelia burgdorferi B31
AIGKELEDRKN

SEQ ID NO: 44730 - protein, 11 aa, Borrelia burgdorferi B31
IGKELEDRKNQ

SEQ ID NO: 44731 - protein, 11 aa, Borrelia burgdorferi B31
GKELEDRKNQY

SEQ ID NO: 44732 - protein, 11 aa, Borrelia burgdorferi B31
KELEDRKNQYD

SEQ ID NO: 44733 - protein, 11 aa, Borrelia burgdorferi B31
ELEDRKNQYDI

SEQ ID NO: 44734 - protein, 11 aa, Borrelia burgdorferi B31
LEDRKNQYDIQ

SEQ ID NO: 44735 - protein, 11 aa, Borrelia burgdorferi B31
EDRKNQYDIQI

SEQ ID NO: 44736 - protein, 11 aa, Borrelia burgdorferi B31
DRKNQYDIQIA

SEQ ID NO: 44737 - protein, 11 aa, Borrelia burgdorferi B31
RKNQYDIQIAK

SEQ ID NO: 44738 - protein, 11 aa, Borrelia burgdorferi B31
KNQYDIQIAKI

SEQ ID NO: 44739 - protein, 11 aa, Borrelia burgdorferi B31
NQYDIQIAKIT

SEQ ID NO: 44740 - protein, 11 aa, Borrelia burgdorferi B31
QYDIQIAKITN

SEQ ID NO: 44741 - protein, 11 aa, Borrelia burgdorferi B31
YDIQIAKITNE

SEQ ID NO: 44742 - protein, 11 aa, Borrelia burgdorferi B31
DIQIAKITNEE

SEQ ID NO: 44743 - protein, 11 aa, Borrelia burgdorferi B31
IQIAKITNEES

SEQ ID NO: 44744 - protein, 11 aa, Borrelia burgdorferi B31
QIAKITNEESN

SEQ ID NO: 44745 - protein, 11 aa, Borrelia burgdorferi B31
IAKITNEESNL

SEQ ID NO: 44746 - protein, 11 aa, Borrelia burgdorferi B31
AKITNEESNLL

SEQ ID NO: 44747 - protein, 11 aa, Borrelia burgdorferi B31
KITNEESNLLD

SEQ ID NO: 44748 - protein, 11 aa, Borrelia burgdorferi B31
ITNEESNLLDT

SEQ ID NO: 44749 - protein, 11 aa, Borrelia burgdorferi B31
TNEESNLLDTY

SEQ ID NO: 44750 - protein, 11 aa, Borrelia burgdorferi B31
NEESNLLDTYI

SEQ ID NO: 44751 - protein, 11 aa, Borrelia burgdorferi B31
EESNLLDTYIR

SEQ ID NO: 44752 - protein, 11 aa, Borrelia burgdorferi B31
ESNLLDTYIRA

SEQ ID NO: 44753 - protein, 11 aa, Borrelia burgdorferi B31
SNLLDTYIRAY

SEQ ID NO: 44754 - protein, 11 aa, Borrelia burgdorferi B31
NLLDTYIRAYE

SEQ ID NO: 44755 - protein, 11 aa, Borrelia burgdorferi B31
LLDTYIRAYEL

SEQ ID NO: 44756 - protein, 11 aa, Borrelia burgdorferi B31
LDTYIRAYELA

SEQ ID NO: 44757 - protein, 11 aa, Borrelia burgdorferi B31
DTYIRAYELAN

SEQ ID NO: 44758 - protein, 11 aa, Borrelia burgdorferi B31
TYIRAYELANE

SEQ ID NO: 44759 - protein, 11 aa, Borrelia burgdorferi B31
YIRAYELANEN

SEQ ID NO: 44760 - protein, 11 aa, Borrelia burgdorferi B31
IRAYELANENE

SEQ ID NO: 44761 - protein, 11 aa, Borrelia burgdorferi B31
RAYELANENEK

SEQ ID NO: 44762 - protein, 11 aa, Borrelia burgdorferi B31
AYELANENEKM

SEQ ID NO: 44763 - protein, 11 aa, Borrelia burgdorferi B31
YELANENEKML

SEQ ID NO: 44764 - protein, 11 aa, Borrelia burgdorferi B31
ELANENEKMLL

SEQ ID NO: 44765 - protein, 11 aa, Borrelia burgdorferi B31
LANENEKMLLK

SEQ ID NO: 44766 - protein, 11 aa, Borrelia burgdorferi B31
ANENEKMLLKR

SEQ ID NO: 44767 - protein, 11 aa, Borrelia burgdorferi B31
NENEKMLLKRF

SEQ ID NO: 44768 - protein, 11 aa, Borrelia burgdorferi B31
ENEKMLLKRFL

SEQ ID NO: 44769 - protein, 11 aa, Borrelia burgdorferi B31
NEKMLLKRFLL

SEQ ID NO: 44770 - protein, 11 aa, Borrelia burgdorferi B31
EKMLLKRFLLS

SEQ ID NO: 44771 - protein, 11 aa, Borrelia burgdorferi B31
KMLLKRFLLSS

SEQ ID NO: 44772 - protein, 11 aa, Borrelia burgdorferi B31
MLLKRFLLSSL

SEQ ID NO: 44773 - protein, 11 aa, Borrelia burgdorferi B31
LLKRFLLSSLD

SEQ ID NO: 44774 - protein, 11 aa, Borrelia burgdorferi B31
LKRFLLSSLDY

SEQ ID NO: 44775 - protein, 11 aa, Borrelia burgdorferi B31
KRFLLSSLDYK

SEQ ID NO: 44776 - protein, 11 aa, Borrelia burgdorferi B31
RFLLSSLDYKK

SEQ ID NO: 44777 - protein, 11 aa, Borrelia burgdorferi B31
FLLSSLDYKKE

SEQ ID NO: 44778 - protein, 11 aa, Borrelia burgdorferi B31
LLSSLDYKKEN

SEQ ID NO: 44779 - protein, 11 aa, Borrelia burgdorferi B31
LSSLDYKKENI

SEQ ID NO: 44780 - protein, 11 aa, Borrelia burgdorferi B31
SSLDYKKENIE

SEQ ID NO: 44781 - protein, 11 aa, Borrelia burgdorferi B31
SLDYKKENIET

SEQ ID NO: 44782 - protein, 11 aa, Borrelia burgdorferi B31
LDYKKENIETL

SEQ ID NO: 44783 - protein, 11 aa, Borrelia burgdorferi B31
DYKKENIETLK

SEQ ID NO: 44784 - protein, 11 aa, Borrelia burgdorferi B31
YKKENIETLKE

SEQ ID NO: 44785 - protein, 11 aa, Borrelia burgdorferi B31
KKENIETLKEI

SEQ ID NO: 44786 - protein, 11 aa, Borrelia burgdorferi B31
KENIETLKEIL

SEQ ID NO: 44787 - protein, 11 aa, Borrelia burgdorferi B31
ENIETLKEILE

SEQ ID NO: 44788 - protein, 11 aa, Borrelia burgdorferi B31
NIETLKEILEK

SEQ ID NO: 44789 - protein, 11 aa, Borrelia burgdorferi B31
IETLKEILEKL

SEQ ID NO: 44790 - protein, 11 aa, Borrelia burgdorferi B31
ETLKEILEKLI

SEQ ID NO: 44791 - protein, 11 aa, Borrelia burgdorferi B31
TLKEILEKLIN

SEQ ID NO: 44792 - protein, 11 aa, Borrelia burgdorferi B31
LKEILEKLINN

SEQ ID NO: 44793 - protein, 11 aa, Borrelia burgdorferi B31
KEILEKLINNY

SEQ ID NO: 44794 - protein, 11 aa, Borrelia burgdorferi B31
EILEKLINNYE

SEQ ID NO: 44795 - protein, 11 aa, Borrelia burgdorferi B31
ILEKLINNYEN

SEQ ID NO: 44796 - protein, 11 aa, Borrelia burgdorferi B31
LEKLINNYEND

SEQ ID NO: 44797 - protein, 11 aa, Borrelia burgdorferi B31
EKLINNYENDP

SEQ ID NO: 44798 - protein, 11 aa, Borrelia burgdorferi B31
KLINNYENDPK

SEQ ID NO: 44799 - protein, 11 aa, Borrelia burgdorferi B31
LINNYENDPKI

SEQ ID NO: 44800 - protein, 11 aa, Borrelia burgdorferi B31
INNYENDPKIA

SEQ ID NO: 44801 - protein, 11 aa, Borrelia burgdorferi B31
NNYENDPKIAA

SEQ ID NO: 44802 - protein, 11 aa, Borrelia burgdorferi B31
NYENDPKIAAN

SEQ ID NO: 44803 - protein, 11 aa, Borrelia burgdorferi B31
YENDPKIAANF

SEQ ID NO: 44804 - protein, 11 aa, Borrelia burgdorferi B31
ENDPKIAANFL

SEQ ID NO: 44805 - protein, 11 aa, Borrelia burgdorferi B31
NDPKIAANFLY

SEQ ID NO: 44806 - protein, 11 aa, Borrelia burgdorferi B31
DPKIAANFLYR

SEQ ID NO: 44807 - protein, 11 aa, Borrelia burgdorferi B31
PKIAANFLYRI

SEQ ID NO: 44808 - protein, 11 aa, Borrelia burgdorferi B31
KIAANFLYRIA

SEQ ID NO: 44809 - protein, 11 aa, Borrelia burgdorferi B31
IAANFLYRIAL

SEQ ID NO: 44810 - protein, 11 aa, Borrelia burgdorferi B31
AANFLYRIALD

SEQ ID NO: 44811 - protein, 11 aa, Borrelia burgdorferi B31
ANFLYRIALDI

SEQ ID NO: 44812 - protein, 11 aa, Borrelia burgdorferi B31
NFLYRIALDIQ

SEQ ID NO: 44813 - protein, 11 aa, Borrelia burgdorferi B31
FLYRIALDIQL

SEQ ID NO: 44814 - protein, 11 aa, Borrelia burgdorferi B31
LYRIALDIQLK

SEQ ID NO: 44815 - protein, 11 aa, Borrelia burgdorferi B31
YRIALDIQLKL

SEQ ID NO: 44816 - protein, 11 aa, Borrelia burgdorferi B31
RIALDIQLKLE

SEQ ID NO: 44817 - protein, 11 aa, Borrelia burgdorferi B31
IALDIQLKLEK

SEQ ID NO: 44818 - protein, 11 aa, Borrelia burgdorferi B31
ALDIQLKLEKH

SEQ ID NO: 44819 - protein, 11 aa, Borrelia burgdorferi B31
LDIQLKLEKHL

SEQ ID NO: 44820 - protein, 11 aa, Borrelia burgdorferi B31
DIQLKLEKHLK

SEQ ID NO: 44821 - protein, 11 aa, Borrelia burgdorferi B31
IQLKLEKHLKS

SEQ ID NO: 44822 - protein, 11 aa, Borrelia burgdorferi B31
QLKLEKHLKSI

SEQ ID NO: 44823 - protein, 11 aa, Borrelia burgdorferi B31
LKLEKHLKSIN

SEQ ID NO: 44824 - protein, 11 aa, Borrelia burgdorferi B31
KLEKHLKSINE

SEQ ID NO: 44825 - protein, 11 aa, Borrelia burgdorferi B31
LEKHLKSINEK

SEQ ID NO: 44826 - protein, 11 aa, Borrelia burgdorferi B31
EKHLKSINEKL

SEQ ID NO: 44827 - protein, 11 aa, Borrelia burgdorferi B31
KHLKSINEKLD

SEQ ID NO: 44828 - protein, 11 aa, Borrelia burgdorferi B31
HLKSINEKLDT

SEQ ID NO: 44829 - protein, 11 aa, Borrelia burgdorferi B31
LKSINEKLDTL

SEQ ID NO: 44830 - protein, 11 aa, Borrelia burgdorferi B31
KSINEKLDTLS

SEQ ID NO: 44831 - protein, 11 aa, Borrelia burgdorferi B31
SINEKLDTLSK

SEQ ID NO: 44832 - protein, 11 aa, Borrelia burgdorferi B31
INEKLDTLSKE

SEQ ID NO: 44833 - protein, 11 aa, Borrelia burgdorferi B31
NEKLDTLSKEN

SEQ ID NO: 44834 - protein, 11 aa, Borrelia burgdorferi B31
EKLDTLSKENS

SEQ ID NO: 44835 - protein, 11 aa, Borrelia burgdorferi B31
KLDTLSKENSK

SEQ ID NO: 44836 - protein, 11 aa, Borrelia burgdorferi B31
LDTLSKENSKE

SEQ ID NO: 44837 - protein, 11 aa, Borrelia burgdorferi B31
DTLSKENSKED

SEQ ID NO: 44838 - protein, 11 aa, Borrelia burgdorferi B31
TLSKENSKEDL

SEQ ID NO: 44839 - protein, 11 aa, Borrelia burgdorferi B31
LSKENSKEDLE

SEQ ID NO: 44840 - protein, 11 aa, Borrelia burgdorferi B31
SKENSKEDLEA

SEQ ID NO: 44841 - protein, 11 aa, Borrelia burgdorferi B31
KENSKEDLEAL

SEQ ID NO: 44842 - protein, 11 aa, Borrelia burgdorferi B31
ENSKEDLEALL

SEQ ID NO: 44843 - protein, 11 aa, Borrelia burgdorferi B31
NSKEDLEALLE

SEQ ID NO: 44844 - protein, 11 aa, Borrelia burgdorferi B31
SKEDLEALLEQ

SEQ ID NO: 44845 - protein, 11 aa, Borrelia burgdorferi B31
KEDLEALLEQV

SEQ ID NO: 44846 - protein, 11 aa, Borrelia burgdorferi B31
EDLEALLEQVK

SEQ ID NO: 44847 - protein, 11 aa, Borrelia burgdorferi B31
DLEALLEQVKS

SEQ ID NO: 44848 - protein, 11 aa, Borrelia burgdorferi B31
LEALLEQVKSA

SEQ ID NO: 44849 - protein, 11 aa, Borrelia burgdorferi B31
EALLEQVKSAL

SEQ ID NO: 44850 - protein, 11 aa, Borrelia burgdorferi B31
ALLEQVKSALQ

SEQ ID NO: 44851 - protein, 11 aa, Borrelia burgdorferi B31
LLEQVKSALQL

SEQ ID NO: 44852 - protein, 11 aa, Borrelia burgdorferi B31
LEQVKSALQLQ

SEQ ID NO: 44853 - protein, 11 aa, Borrelia burgdorferi B31
EQVKSALQLQE

SEQ ID NO: 44854 - protein, 11 aa, Borrelia burgdorferi B31
QVKSALQLQEK

SEQ ID NO: 44855 - protein, 11 aa, Borrelia burgdorferi B31
VKSALQLQEKF

SEQ ID NO: 44856 - protein, 11 aa, Borrelia burgdorferi B31
KSALQLQEKFK

SEQ ID NO: 44857 - protein, 11 aa, Borrelia burgdorferi B31
SALQLQEKFKK

SEQ ID NO: 44858 - protein, 11 aa, Borrelia burgdorferi B31
ALQLQEKFKKT

SEQ ID NO: 44859 - protein, 11 aa, Borrelia burgdorferi B31
LQLQEKFKKTL

SEQ ID NO: 44860 - protein, 11 aa, Borrelia burgdorferi B31
QLQEKFKKTLN

SEQ ID NO: 44861 - protein, 11 aa, Borrelia burgdorferi B31
LQEKFKKTLNK

SEQ ID NO: 44862 - protein, 11 aa, Borrelia burgdorferi B31
QEKFKKTLNKT

SEQ ID NO: 44863 - protein, 11 aa, Borrelia burgdorferi B31
EKFKKTLNKTL

SEQ ID NO: 44864 - protein, 11 aa, Borrelia burgdorferi B31
KFKKTLNKTLE

SEQ ID NO: 44865 - protein, 11 aa, Borrelia burgdorferi B31
FKKTLNKTLED

SEQ ID NO: 44866 - protein, 11 aa, Borrelia burgdorferi B31
KKTLNKTLEDY

SEQ ID NO: 44867 - protein, 11 aa, Borrelia burgdorferi B31
KTLNKTLEDYR

SEQ ID NO: 44868 - protein, 11 aa, Borrelia burgdorferi B31
TLNKTLEDYRK

SEQ ID NO: 44869 - protein, 11 aa, Borrelia burgdorferi B31
LNKTLEDYRKN

SEQ ID NO: 44870 - protein, 11 aa, Borrelia burgdorferi B31
NKTLEDYRKNT

SEQ ID NO: 44871 - protein, 11 aa, Borrelia burgdorferi B31
KTLEDYRKNTN

SEQ ID NO: 44872 - protein, 11 aa, Borrelia burgdorferi B31
TLEDYRKNTNN

SEQ ID NO: 44873 - protein, 11 aa, Borrelia burgdorferi B31
LEDYRKNTNNI

SEQ ID NO: 44874 - protein, 11 aa, Borrelia burgdorferi B31
EDYRKNTNNIQ

SEQ ID NO: 44875 - protein, 11 aa, Borrelia burgdorferi B31
DYRKNTNNIQE

SEQ ID NO: 44876 - protein, 11 aa, Borrelia burgdorferi B31
YRKNTNNIQEN

SEQ ID NO: 44877 - protein, 11 aa, Borrelia burgdorferi B31
RKNTNNIQENK

SEQ ID NO: 44878 - protein, 11 aa, Borrelia burgdorferi B31
KNTNNIQENKV

SEQ ID NO: 44879 - protein, 11 aa, Borrelia burgdorferi B31
NTNNIQENKVL

SEQ ID NO: 44880 - protein, 11 aa, Borrelia burgdorferi B31
TNNIQENKVLA

SEQ ID NO: 44881 - protein, 11 aa, Borrelia burgdorferi B31
NNIQENKVLAE

SEQ ID NO: 44882 - protein, 11 aa, Borrelia burgdorferi B31
NIQENKVLAEH

SEQ ID NO: 44883 - protein, 11 aa, Borrelia burgdorferi B31
IQENKVLAEHF

SEQ ID NO: 44884 - protein, 11 aa, Borrelia burgdorferi B31
QENKVLAEHFN

SEQ ID NO: 44885 - protein, 11 aa, Borrelia burgdorferi B31
ENKVLAEHFNK

SEQ ID NO: 44886 - protein, 11 aa, Borrelia burgdorferi B31
NKVLAEHFNKY

SEQ ID NO: 44887 - protein, 11 aa, Borrelia burgdorferi B31
KVLAEHFNKYY

SEQ ID NO: 44888 - protein, 11 aa, Borrelia burgdorferi B31
VLAEHFNKYYK

SEQ ID NO: 44889 - protein, 11 aa, Borrelia burgdorferi B31
LAEHFNKYYKD

SEQ ID NO: 44890 - protein, 11 aa, Borrelia burgdorferi B31
AEHFNKYYKDS

SEQ ID NO: 44891 - protein, 11 aa, Borrelia burgdorferi B31
EHFNKYYKDSD

SEQ ID NO: 44892 - protein, 11 aa, Borrelia burgdorferi B31
HFNKYYKDSDS

SEQ ID NO: 44893 - protein, 11 aa, Borrelia burgdorferi B31
FNKYYKDSDSL

SEQ ID NO: 44894 - protein, 11 aa, Borrelia burgdorferi B31
NKYYKDSDSLQ

SEQ ID NO: 44895 - protein, 11 aa, Borrelia burgdorferi B31
KYYKDSDSLQS

SEQ ID NO: 44896 - protein, 11 aa, Borrelia burgdorferi B31
YYKDSDSLQSA

SEQ ID NO: 44897 - protein, 11 aa, Borrelia burgdorferi B31
YKDSDSLQSAF

SEQ ID NO: 44898 - protein, 11 aa, Borrelia burgdorferi B31
KDSDSLQSAFY

SEQ ID NO: 44899 - protein, 8 aa, Borrelia garinii PBi
MKKTKLNI

SEQ ID NO: 44900 - protein, 8 aa, Borrelia garinii PBi
KKTKLNII

SEQ ID NO: 44901 - protein, 8 aa, Borrelia garinii PBi
KTKLNIIK

SEQ ID NO: 44902 - protein, 8 aa, Borrelia garinii PBi
TKLNIIKL

SEQ ID NO: 44903 - protein, 8 aa, Borrelia garinii PBi
KLNIIKLN

SEQ ID NO: 44904 - protein, 8 aa, Borrelia garinii PBi
LNIIKLNI

SEQ ID NO: 44905 - protein, 8 aa, Borrelia garinii PBi
NIIKLNIL

SEQ ID NO: 44906 - protein, 8 aa, Borrelia garinii PBi
IIKLNILT

SEQ ID NO: 44907 - protein, 8 aa, Borrelia garinii PBi
IKLNILTT

SEQ ID NO: 44908 - protein, 8 aa, Borrelia garinii PBi
KLNILTTT

SEQ ID NO: 44909 - protein, 8 aa, Borrelia garinii PBi
LNILTTTL

SEQ ID NO: 44910 - protein, 8 aa, Borrelia garinii PBi
NILTTTLT

SEQ ID NO: 44911 - protein, 8 aa, Borrelia garinii PBi
ILTTTLTL

SEQ ID NO: 44912 - protein, 8 aa, Borrelia garinii PBi
LTTTLTLI

SEQ ID NO: 44913 - protein, 8 aa, Borrelia garinii PBi
TTTLTLIC

SEQ ID NO: 44914 - protein, 8 aa, Borrelia garinii PBi
TTLTLICI

SEQ ID NO: 44915 - protein, 8 aa, Borrelia garinii PBi
TLTLICIS

SEQ ID NO: 44916 - protein, 8 aa, Borrelia garinii PBi
LTLICISC

SEQ ID NO: 44917 - protein, 8 aa, Borrelia garinii PBi
TLICISCA

SEQ ID NO: 44918 - protein, 8 aa, Borrelia garinii PBi
LICISCAV

SEQ ID NO: 44919 - protein, 8 aa, Borrelia garinii PBi
ICISCAVN

SEQ ID NO: 44920 - protein, 8 aa, Borrelia garinii PBi
CISCAVNK

SEQ ID NO: 44921 - protein, 8 aa, Borrelia garinii PBi
ISCAVNKI

SEQ ID NO: 44922 - protein, 8 aa, Borrelia garinii PBi
SCAVNKID

SEQ ID NO: 44923 - protein, 8 aa, Borrelia garinii PBi
CAVNKIDP

SEQ ID NO: 44924 - protein, 8 aa, Borrelia garinii PBi
AVNKIDPE

SEQ ID NO: 44925 - protein, 8 aa, Borrelia garinii PBi
VNKIDPEP

SEQ ID NO: 44926 - protein, 8 aa, Borrelia garinii PBi
NKIDPEPK

SEQ ID NO: 44927 - protein, 8 aa, Borrelia garinii PBi
KIDPEPKS

SEQ ID NO: 44928 - protein, 8 aa, Borrelia garinii PBi
IDPEPKSK

SEQ ID NO: 44929 - protein, 8 aa, Borrelia garinii PBi
DPEPKSKT

SEQ ID NO: 44930 - protein, 8 aa, Borrelia garinii PBi
PEPKSKTN

SEQ ID NO: 44931 - protein, 8 aa, Borrelia garinii PBi
EPKSKTNK

SEQ ID NO: 44932 - protein, 8 aa, Borrelia garinii PBi
PKSKTNKK

SEQ ID NO: 44933 - protein, 8 aa, Borrelia garinii PBi
KSKTNKKE

SEQ ID NO: 44934 - protein, 8 aa, Borrelia garinii PBi
SKTNKKEN

SEQ ID NO: 44935 - protein, 8 aa, Borrelia garinii PBi
KTNKKENI

SEQ ID NO: 44936 - protein, 8 aa, Borrelia garinii PBi
TNKKENIK

SEQ ID NO: 44937 - protein, 8 aa, Borrelia garinii PBi
NKKENIKN

SEQ ID NO: 44938 - protein, 8 aa, Borrelia garinii PBi
KKENIKNF

SEQ ID NO: 44939 - protein, 8 aa, Borrelia garinii PBi
KENIKNFV

SEQ ID NO: 44940 - protein, 8 aa, Borrelia garinii PBi
ENIKNFVN

SEQ ID NO: 44941 - protein, 8 aa, Borrelia garinii PBi
NIKNFVNK

SEQ ID NO: 44942 - protein, 8 aa, Borrelia garinii PBi
IKNFVNKF

SEQ ID NO: 44943 - protein, 8 aa, Borrelia garinii PBi
KNFVNKFQ

SEQ ID NO: 44944 - protein, 8 aa, Borrelia garinii PBi
NFVNKFQD

SEQ ID NO: 44945 - protein, 8 aa, Borrelia garinii PBi
FVNKFQDL

SEQ ID NO: 44946 - protein, 8 aa, Borrelia garinii PBi
VNKFQDLE

SEQ ID NO: 44947 - protein, 8 aa, Borrelia garinii PBi
NKFQDLEP

SEQ ID NO: 44948 - protein, 8 aa, Borrelia garinii PBi
KFQDLEPS

SEQ ID NO: 44949 - protein, 8 aa, Borrelia garinii PBi
FQDLEPSK

SEQ ID NO: 44950 - protein, 8 aa, Borrelia garinii PBi
QDLEPSKK

SEQ ID NO: 44951 - protein, 8 aa, Borrelia garinii PBi
DLEPSKKQ

SEQ ID NO: 44952 - protein, 8 aa, Borrelia garinii PBi
LEPSKKQN

SEQ ID NO: 44953 - protein, 8 aa, Borrelia garinii PBi
EPSKKQNK

SEQ ID NO: 44954 - protein, 8 aa, Borrelia garinii PBi
PSKKQNKD

SEQ ID NO: 44955 - protein, 8 aa, Borrelia garinii PBi
SKKQNKDL

SEQ ID NO: 44956 - protein, 8 aa, Borrelia garinii PBi
KKQNKDLE

SEQ ID NO: 44957 - protein, 8 aa, Borrelia garinii PBi
KQNKDLEP

SEQ ID NO: 44958 - protein, 8 aa, Borrelia garinii PBi
QNKDLEPL

SEQ ID NO: 44959 - protein, 8 aa, Borrelia garinii PBi
NKDLEPLR

SEQ ID NO: 44960 - protein, 8 aa, Borrelia garinii PBi
KDLEPLRE

SEQ ID NO: 44961 - protein, 8 aa, Borrelia garinii PBi
DLEPLREK

SEQ ID NO: 44962 - protein, 8 aa, Borrelia garinii PBi
LEPLREKY

SEQ ID NO: 44963 - protein, 8 aa, Borrelia garinii PBi
EPLREKYP

SEQ ID NO: 44964 - protein, 8 aa, Borrelia garinii PBi
PLREKYPE

SEQ ID NO: 44965 - protein, 8 aa, Borrelia garinii PBi
LREKYPEA

SEQ ID NO: 44966 - protein, 8 aa, Borrelia garinii PBi
REKYPEAT

SEQ ID NO: 44967 - protein, 8 aa, Borrelia garinii PBi
EKYPEATA

SEQ ID NO: 44968 - protein, 8 aa, Borrelia garinii PBi
KYPEATAS

SEQ ID NO: 44969 - protein, 8 aa, Borrelia garinii PBi
YPEATASK

SEQ ID NO: 44970 - protein, 8 aa, Borrelia garinii PBi
PEATASKL

SEQ ID NO: 44971 - protein, 8 aa, Borrelia garinii PBi
EATASKLE

SEQ ID NO: 44972 - protein, 8 aa, Borrelia garinii PBi
ATASKLET

SEQ ID NO: 44973 - protein, 8 aa, Borrelia garinii PBi
TASKLETT

SEQ ID NO: 44974 - protein, 8 aa, Borrelia garinii PBi
ASKLETTL

SEQ ID NO: 44975 - protein, 8 aa, Borrelia garinii PBi
SKLETTLK

SEQ ID NO: 44976 - protein, 8 aa, Borrelia garinii PBi
KLETTLKI

SEQ ID NO: 44977 - protein, 8 aa, Borrelia garinii PBi
LETTLKIL

SEQ ID NO: 44978 - protein, 8 aa, Borrelia garinii PBi
ETTLKILE

SEQ ID NO: 44979 - protein, 8 aa, Borrelia garinii PBi
TTLKILEA

SEQ ID NO: 44980 - protein, 8 aa, Borrelia garinii PBi
TLKILEAQ

SEQ ID NO: 44981 - protein, 8 aa, Borrelia garinii PBi
LKILEAQK

SEQ ID NO: 44982 - protein, 8 aa, Borrelia garinii PBi
KILEAQKE

SEQ ID NO: 44983 - protein, 8 aa, Borrelia garinii PBi
ILEAQKEK

SEQ ID NO: 44984 - protein, 8 aa, Borrelia garinii PBi
LEAQKEKE

SEQ ID NO: 44985 - protein, 8 aa, Borrelia garinii PBi
EAQKEKEN

SEQ ID NO: 44986 - protein, 8 aa, Borrelia garinii PBi
AQKEKENI

SEQ ID NO: 44987 - protein, 8 aa, Borrelia garinii PBi
QKEKENIE

SEQ ID NO: 44988 - protein, 8 aa, Borrelia garinii PBi
KEKENIEI

SEQ ID NO: 44989 - protein, 8 aa, Borrelia garinii PBi
EKENIEIA

SEQ ID NO: 44990 - protein, 8 aa, Borrelia garinii PBi
KENIEIAK

SEQ ID NO: 44991 - protein, 8 aa, Borrelia garinii PBi
ENIEIAKI

SEQ ID NO: 44992 - protein, 8 aa, Borrelia garinii PBi
NIEIAKID

SEQ ID NO: 44993 - protein, 8 aa, Borrelia garinii PBi
IEIAKIDN

SEQ ID NO: 44994 - protein, 8 aa, Borrelia garinii PBi
EIAKIDNT

SEQ ID NO: 44995 - protein, 8 aa, Borrelia garinii PBi
IAKIDNTQ

SEQ ID NO: 44996 - protein, 8 aa, Borrelia garinii PBi
AKIDNTQI

SEQ ID NO: 44997 - protein, 8 aa, Borrelia garinii PBi
KIDNTQID

SEQ ID NO: 44998 - protein, 8 aa, Borrelia garinii PBi
IDNTQIDF

SEQ ID NO: 44999 - protein, 8 aa, Borrelia garinii PBi
DNTQIDFL

SEQ ID NO: 45000 - protein, 8 aa, Borrelia garinii PBi
NTQIDFLK

SEQ ID NO: 45001 - protein, 8 aa, Borrelia garinii PBi
TQIDFLKT

SEQ ID NO: 45002 - protein, 8 aa, Borrelia garinii PBi
QIDFLKTF

SEQ ID NO: 45003 - protein, 8 aa, Borrelia garinii PBi
IDFLKTFK

SEQ ID NO: 45004 - protein, 8 aa, Borrelia garinii PBi
DFLKTFKT

SEQ ID NO: 45005 - protein, 8 aa, Borrelia garinii PBi
FLKTFKTD

SEQ ID NO: 45006 - protein, 8 aa, Borrelia garinii PBi
LKTFKTDP

SEQ ID NO: 45007 - protein, 8 aa, Borrelia garinii PBi
KTFKTDPH

SEQ ID NO: 45008 - protein, 8 aa, Borrelia garinii PBi
TFKTDPHD

SEQ ID NO: 45009 - protein, 8 aa, Borrelia garinii PBi
FKTDPHDS

SEQ ID NO: 45010 - protein, 8 aa, Borrelia garinii PBi
KTDPHDSL

SEQ ID NO: 45011 - protein, 8 aa, Borrelia garinii PBi
TDPHDSLP

SEQ ID NO: 45012 - protein, 8 aa, Borrelia garinii PBi
DPHDSLPE

SEQ ID NO: 45013 - protein, 8 aa, Borrelia garinii PBi
PHDSLPED

SEQ ID NO: 45014 - protein, 8 aa, Borrelia garinii PBi
HDSLPEDE

SEQ ID NO: 45015 - protein, 8 aa, Borrelia garinii PBi
DSLPEDEK

SEQ ID NO: 45016 - protein, 8 aa, Borrelia garinii PBi
SLPEDEKM

SEQ ID NO: 45017 - protein, 8 aa, Borrelia garinii PBi
LPEDEKMQ

SEQ ID NO: 45018 - protein, 8 aa, Borrelia garinii PBi
PEDEKMQM

SEQ ID NO: 45019 - protein, 8 aa, Borrelia garinii PBi
EDEKMQMK

SEQ ID NO: 45020 - protein, 8 aa, Borrelia garinii PBi
DEKMQMKK

SEQ ID NO: 45021 - protein, 8 aa, Borrelia garinii PBi
EKMQMKKI

SEQ ID NO: 45022 - protein, 8 aa, Borrelia garinii PBi
KMQMKKII

SEQ ID NO: 45023 - protein, 8 aa, Borrelia garinii PBi
MQMKKIIY

SEQ ID NO: 45024 - protein, 8 aa, Borrelia garinii PBi
QMKKIIYS

SEQ ID NO: 45025 - protein, 8 aa, Borrelia garinii PBi
MKKIIYSS

SEQ ID NO: 45026 - protein, 8 aa, Borrelia garinii PBi
KKIIYSSL

SEQ ID NO: 45027 - protein, 8 aa, Borrelia garinii PBi
KIIYSSLN

SEQ ID NO: 45028 - protein, 8 aa, Borrelia garinii PBi
IIYSSLNY

SEQ ID NO: 45029 - protein, 8 aa, Borrelia garinii PBi
IYSSLNYE

SEQ ID NO: 45030 - protein, 8 aa, Borrelia garinii PBi
YSSLNYET

SEQ ID NO: 45031 - protein, 8 aa, Borrelia garinii PBi
SSLNYETE

SEQ ID NO: 45032 - protein, 8 aa, Borrelia garinii PBi
SLNYETEK

SEQ ID NO: 45033 - protein, 8 aa, Borrelia garinii PBi
LNYETEKI

SEQ ID NO: 45034 - protein, 8 aa, Borrelia garinii PBi
NYETEKIK

SEQ ID NO: 45035 - protein, 8 aa, Borrelia garinii PBi
YETEKIKI

SEQ ID NO: 45036 - protein, 8 aa, Borrelia garinii PBi
ETEKIKIL

SEQ ID NO: 45037 - protein, 8 aa, Borrelia garinii PBi
TEKIKILQ

SEQ ID NO: 45038 - protein, 8 aa, Borrelia garinii PBi
EKIKILQE

SEQ ID NO: 45039 - protein, 8 aa, Borrelia garinii PBi
KIKILQEI

SEQ ID NO: 45040 - protein, 8 aa, Borrelia garinii PBi
IKILQEIL

SEQ ID NO: 45041 - protein, 8 aa, Borrelia garinii PBi
KILQEILE

SEQ ID NO: 45042 - protein, 8 aa, Borrelia garinii PBi
ILQEILEK

SEQ ID NO: 45043 - protein, 8 aa, Borrelia garinii PBi
LQEILEKL

SEQ ID NO: 45044 - protein, 8 aa, Borrelia garinii PBi
QEILEKLD

SEQ ID NO: 45045 - protein, 8 aa, Borrelia garinii PBi
EILEKLDK

SEQ ID NO: 45046 - protein, 8 aa, Borrelia garinii PBi
ILEKLDKN

SEQ ID NO: 45047 - protein, 8 aa, Borrelia garinii PBi
LEKLDKNL

SEQ ID NO: 45048 - protein, 8 aa, Borrelia garinii PBi
EKLDKNLQ

SEQ ID NO: 45049 - protein, 8 aa, Borrelia garinii PBi
KLDKNLQH

SEQ ID NO: 45050 - protein, 8 aa, Borrelia garinii PBi
LDKNLQHK

SEQ ID NO: 45051 - protein, 8 aa, Borrelia garinii PBi
DKNLQHKK

SEQ ID NO: 45052 - protein, 8 aa, Borrelia garinii PBi
KNLQHKKI

SEQ ID NO: 45053 - protein, 8 aa, Borrelia garinii PBi
NLQHKKIA

SEQ ID NO: 45054 - protein, 8 aa, Borrelia garinii PBi
LQHKKIAK

SEQ ID NO: 45055 - protein, 8 aa, Borrelia garinii PBi
QHKKIAKN

SEQ ID NO: 45056 - protein, 8 aa, Borrelia garinii PBi
HKKIAKNF

SEQ ID NO: 45057 - protein, 8 aa, Borrelia garinii PBi
KKIAKNFI

SEQ ID NO: 45058 - protein, 8 aa, Borrelia garinii PBi
KIAKNFIY

SEQ ID NO: 45059 - protein, 8 aa, Borrelia garinii PBi
IAKNFIYD

SEQ ID NO: 45060 - protein, 8 aa, Borrelia garinii PBi
AKNFIYDI

SEQ ID NO: 45061 - protein, 8 aa, Borrelia garinii PBi
KNFIYDIP

SEQ ID NO: 45062 - protein, 8 aa, Borrelia garinii PBi
NFIYDIPI

SEQ ID NO: 45063 - protein, 8 aa, Borrelia garinii PBi
FIYDIPII

SEQ ID NO: 45064 - protein, 8 aa, Borrelia garinii PBi
IYDIPIII

SEQ ID NO: 45065 - protein, 8 aa, Borrelia garinii PBi
YDIPIIIQ

SEQ ID NO: 45066 - protein, 8 aa, Borrelia garinii PBi
DIPIIIQS

SEQ ID NO: 45067 - protein, 8 aa, Borrelia garinii PBi
IPIIIQSR

SEQ ID NO: 45068 - protein, 8 aa, Borrelia garinii PBi
PIIIQSRL

SEQ ID NO: 45069 - protein, 8 aa, Borrelia garinii PBi
IIIQSRLD

SEQ ID NO: 45070 - protein, 8 aa, Borrelia garinii PBi
IIQSRLDI

SEQ ID NO: 45071 - protein, 8 aa, Borrelia garinii PBi
IQSRLDII

SEQ ID NO: 45072 - protein, 8 aa, Borrelia garinii PBi
QSRLDIIS

SEQ ID NO: 45073 - protein, 8 aa, Borrelia garinii PBi
SRLDIISK

SEQ ID NO: 45074 - protein, 8 aa, Borrelia garinii PBi
RLDIISKV

SEQ ID NO: 45075 - protein, 8 aa, Borrelia garinii PBi
LDIISKVI

SEQ ID NO: 45076 - protein, 8 aa, Borrelia garinii PBi
DIISKVIK

SEQ ID NO: 45077 - protein, 8 aa, Borrelia garinii PBi
IISKVIKN

SEQ ID NO: 45078 - protein, 8 aa, Borrelia garinii PBi
ISKVIKNP

SEQ ID NO: 45079 - protein, 8 aa, Borrelia garinii PBi
SKVIKNPI

SEQ ID NO: 45080 - protein, 8 aa, Borrelia garinii PBi
KVIKNPIK

SEQ ID NO: 45081 - protein, 8 aa, Borrelia garinii PBi
VIKNPIKD

SEQ ID NO: 45082 - protein, 8 aa, Borrelia garinii PBi
IKNPIKDE

SEQ ID NO: 45083 - protein, 8 aa, Borrelia garinii PBi
KNPIKDEL

SEQ ID NO: 45084 - protein, 8 aa, Borrelia garinii PBi
NPIKDELQ

SEQ ID NO: 45085 - protein, 8 aa, Borrelia garinii PBi
PIKDELQI

SEQ ID NO: 45086 - protein, 8 aa, Borrelia garinii PBi
IKDELQIL

SEQ ID NO: 45087 - protein, 8 aa, Borrelia garinii PBi
KDELQILN

SEQ ID NO: 45088 - protein, 8 aa, Borrelia garinii PBi
DELQILNQ

SEQ ID NO: 45089 - protein, 8 aa, Borrelia garinii PBi
ELQILNQK

SEQ ID NO: 45090 - protein, 8 aa, Borrelia garinii PBi
LQILNQKE

SEQ ID NO: 45091 - protein, 8 aa, Borrelia garinii PBi
QILNQKEI

SEQ ID NO: 45092 - protein, 8 aa, Borrelia garinii PBi
ILNQKEIE

SEQ ID NO: 45093 - protein, 8 aa, Borrelia garinii PBi
LNQKEIEE

SEQ ID NO: 45094 - protein, 8 aa, Borrelia garinii PBi
NQKEIEEL

SEQ ID NO: 45095 - protein, 8 aa, Borrelia garinii PBi
QKEIEELL

SEQ ID NO: 45096 - protein, 8 aa, Borrelia garinii PBi
KEIEELLM

SEQ ID NO: 45097 - protein, 8 aa, Borrelia garinii PBi
EIEELLMR

SEQ ID NO: 45098 - protein, 8 aa, Borrelia garinii PBi
IEELLMRI

SEQ ID NO: 45099 - protein, 8 aa, Borrelia garinii PBi
EELLMRIE

SEQ ID NO: 45100 - protein, 8 aa, Borrelia garinii PBi
ELLMRIES

SEQ ID NO: 45101 - protein, 8 aa, Borrelia garinii PBi
LLMRIESE

SEQ ID NO: 45102 - protein, 8 aa, Borrelia garinii PBi
LMRIESEL

SEQ ID NO: 45103 - protein, 8 aa, Borrelia garinii PBi
MRIESELK

SEQ ID NO: 45104 - protein, 8 aa, Borrelia garinii PBi
RIESELKI

SEQ ID NO: 45105 - protein, 8 aa, Borrelia garinii PBi
IESELKIK

SEQ ID NO: 45106 - protein, 8 aa, Borrelia garinii PBi
ESELKIKE

SEQ ID NO: 45107 - protein, 8 aa, Borrelia garinii PBi
SELKIKEN

SEQ ID NO: 45108 - protein, 8 aa, Borrelia garinii PBi
ELKIKENF

SEQ ID NO: 45109 - protein, 8 aa, Borrelia garinii PBi
LKIKENFK

SEQ ID NO: 45110 - protein, 8 aa, Borrelia garinii PBi
KIKENFKK

SEQ ID NO: 45111 - protein, 8 aa, Borrelia garinii PBi
IKENFKKA

SEQ ID NO: 45112 - protein, 8 aa, Borrelia garinii PBi
KENFKKAL

SEQ ID NO: 45113 - protein, 8 aa, Borrelia garinii PBi
ENFKKALN

SEQ ID NO: 45114 - protein, 8 aa, Borrelia garinii PBi
NFKKALNK

SEQ ID NO: 45115 - protein, 8 aa, Borrelia garinii PBi
FKKALNKT

SEQ ID NO: 45116 - protein, 8 aa, Borrelia garinii PBi
KKALNKTI

SEQ ID NO: 45117 - protein, 8 aa, Borrelia garinii PBi
KALNKTID

SEQ ID NO: 45118 - protein, 8 aa, Borrelia garinii PBi
ALNKTIDA

SEQ ID NO: 45119 - protein, 8 aa, Borrelia garinii PBi
LNKTIDAY

SEQ ID NO: 45120 - protein, 8 aa, Borrelia garinii PBi
NKTIDAYN

SEQ ID NO: 45121 - protein, 8 aa, Borrelia garinii PBi
KTIDAYNQ

SEQ ID NO: 45122 - protein, 8 aa, Borrelia garinii PBi
TIDAYNQD

SEQ ID NO: 45123 - protein, 8 aa, Borrelia garinii PBi
IDAYNQDS

SEQ ID NO: 45124 - protein, 8 aa, Borrelia garinii PBi
DAYNQDSE

SEQ ID NO: 45125 - protein, 8 aa, Borrelia garinii PBi
AYNQDSEN

SEQ ID NO: 45126 - protein, 8 aa, Borrelia garinii PBi
YNQDSENI

SEQ ID NO: 45127 - protein, 8 aa, Borrelia garinii PBi
NQDSENIK

SEQ ID NO: 45128 - protein, 8 aa, Borrelia garinii PBi
QDSENIKT

SEQ ID NO: 45129 - protein, 8 aa, Borrelia garinii PBi
DSENIKTS

SEQ ID NO: 45130 - protein, 8 aa, Borrelia garinii PBi
SENIKTSA

SEQ ID NO: 45131 - protein, 8 aa, Borrelia garinii PBi
ENIKTSAE

SEQ ID NO: 45132 - protein, 8 aa, Borrelia garinii PBi
NIKTSAEQ

SEQ ID NO: 45133 - protein, 8 aa, Borrelia garinii PBi
IKTSAEQL

SEQ ID NO: 45134 - protein, 8 aa, Borrelia garinii PBi
KTSAEQLE

SEQ ID NO: 45135 - protein, 8 aa, Borrelia garinii PBi
TSAEQLEK

SEQ ID NO: 45136 - protein, 8 aa, Borrelia garinii PBi
SAEQLEKH

SEQ ID NO: 45137 - protein, 8 aa, Borrelia garinii PBi
AEQLEKHI

SEQ ID NO: 45138 - protein, 8 aa, Borrelia garinii PBi
EQLEKHIN

SEQ ID NO: 45139 - protein, 8 aa, Borrelia garinii PBi
QLEKHINE

SEQ ID NO: 45140 - protein, 8 aa, Borrelia garinii PBi
LEKHINEN

SEQ ID NO: 45141 - protein, 8 aa, Borrelia garinii PBi
EKHINENY

SEQ ID NO: 45142 - protein, 8 aa, Borrelia garinii PBi
KHINENYK

SEQ ID NO: 45143 - protein, 8 aa, Borrelia garinii PBi
HINENYKE

SEQ ID NO: 45144 - protein, 8 aa, Borrelia garinii PBi
INENYKEF

SEQ ID NO: 45145 - protein, 8 aa, Borrelia garinii PBi
NENYKEFN

SEQ ID NO: 45146 - protein, 8 aa, Borrelia garinii PBi
ENYKEFNS

SEQ ID NO: 45147 - protein, 8 aa, Borrelia garinii PBi
NYKEFNSL

SEQ ID NO: 45148 - protein, 8 aa, Borrelia garinii PBi
YKEFNSLK

SEQ ID NO: 45149 - protein, 8 aa, Borrelia garinii PBi
KEFNSLKP

SEQ ID NO: 45150 - protein, 8 aa, Borrelia garinii PBi
EFNSLKPI

SEQ ID NO: 45151 - protein, 8 aa, Borrelia garinii PBi
FNSLKPIY

SEQ ID NO: 45152 - protein, 9 aa, Borrelia garinii PBi
MKKTKLNII

SEQ ID NO: 45153 - protein, 9 aa, Borrelia garinii PBi
KKTKLNIIK

SEQ ID NO: 45154 - protein, 9 aa, Borrelia garinii PBi
KTKLNIIKL

SEQ ID NO: 45155 - protein, 9 aa, Borrelia garinii PBi
TKLNIIKLN

SEQ ID NO: 45156 - protein, 9 aa, Borrelia garinii PBi
KLNIIKLNI

SEQ ID NO: 45157 - protein, 9 aa, Borrelia garinii PBi
LNIIKLNIL

SEQ ID NO: 45158 - protein, 9 aa, Borrelia garinii PBi
NIIKLNILT

SEQ ID NO: 45159 - protein, 9 aa, Borrelia garinii PBi
IIKLNILTT

SEQ ID NO: 45160 - protein, 9 aa, Borrelia garinii PBi
IKLNILTTT

SEQ ID NO: 45161 - protein, 9 aa, Borrelia garinii PBi
KLNILTTTL

SEQ ID NO: 45162 - protein, 9 aa, Borrelia garinii PBi
LNILTTTLT

SEQ ID NO: 45163 - protein, 9 aa, Borrelia garinii PBi
NILTTTLTL

SEQ ID NO: 45164 - protein, 9 aa, Borrelia garinii PBi
ILTTTLTLI

SEQ ID NO: 45165 - protein, 9 aa, Borrelia garinii PBi
LTTTLTLIC

SEQ ID NO: 45166 - protein, 9 aa, Borrelia garinii PBi
TTTLTLICI

SEQ ID NO: 45167 - protein, 9 aa, Borrelia garinii PBi
TTLTLICIS

SEQ ID NO: 45168 - protein, 9 aa, Borrelia garinii PBi
TLTLICISC

SEQ ID NO: 45169 - protein, 9 aa, Borrelia garinii PBi
LTLICISCA

SEQ ID NO: 45170 - protein, 9 aa, Borrelia garinii PBi
TLICISCAV

SEQ ID NO: 45171 - protein, 9 aa, Borrelia garinii PBi
LICISCAVN

SEQ ID NO: 45172 - protein, 9 aa, Borrelia garinii PBi
ICISCAVNK

SEQ ID NO: 45173 - protein, 9 aa, Borrelia garinii PBi
CISCAVNKI

SEQ ID NO: 45174 - protein, 9 aa, Borrelia garinii PBi
ISCAVNKID

SEQ ID NO: 45175 - protein, 9 aa, Borrelia garinii PBi
SCAVNKIDP

SEQ ID NO: 45176 - protein, 9 aa, Borrelia garinii PBi
CAVNKIDPE

SEQ ID NO: 45177 - protein, 9 aa, Borrelia garinii PBi
AVNKIDPEP

SEQ ID NO: 45178 - protein, 9 aa, Borrelia garinii PBi
VNKIDPEPK

SEQ ID NO: 45179 - protein, 9 aa, Borrelia garinii PBi
NKIDPEPKS

SEQ ID NO: 45180 - protein, 9 aa, Borrelia garinii PBi
KIDPEPKSK

SEQ ID NO: 45181 - protein, 9 aa, Borrelia garinii PBi
IDPEPKSKT

SEQ ID NO: 45182 - protein, 9 aa, Borrelia garinii PBi
DPEPKSKTN

SEQ ID NO: 45183 - protein, 9 aa, Borrelia garinii PBi
PEPKSKTNK

SEQ ID NO: 45184 - protein, 9 aa, Borrelia garinii PBi
EPKSKTNKK

SEQ ID NO: 45185 - protein, 9 aa, Borrelia garinii PBi
PKSKTNKKE

SEQ ID NO: 45186 - protein, 9 aa, Borrelia garinii PBi
KSKTNKKEN

SEQ ID NO: 45187 - protein, 9 aa, Borrelia garinii PBi
SKTNKKENI

SEQ ID NO: 45188 - protein, 9 aa, Borrelia garinii PBi
KTNKKENIK

SEQ ID NO: 45189 - protein, 9 aa, Borrelia garinii PBi
TNKKENIKN

SEQ ID NO: 45190 - protein, 9 aa, Borrelia garinii PBi
NKKENIKNF

SEQ ID NO: 45191 - protein, 9 aa, Borrelia garinii PBi
KKENIKNFV

SEQ ID NO: 45192 - protein, 9 aa, Borrelia garinii PBi
KENIKNFVN

SEQ ID NO: 45193 - protein, 9 aa, Borrelia garinii PBi
ENIKNFVNK

SEQ ID NO: 45194 - protein, 9 aa, Borrelia garinii PBi
NIKNFVNKF

SEQ ID NO: 45195 - protein, 9 aa, Borrelia garinii PBi
IKNFVNKFQ

SEQ ID NO: 45196 - protein, 9 aa, Borrelia garinii PBi
KNFVNKFQD

SEQ ID NO: 45197 - protein, 9 aa, Borrelia garinii PBi
NFVNKFQDL

SEQ ID NO: 45198 - protein, 9 aa, Borrelia garinii PBi
FVNKFQDLE

SEQ ID NO: 45199 - protein, 9 aa, Borrelia garinii PBi
VNKFQDLEP

SEQ ID NO: 45200 - protein, 9 aa, Borrelia garinii PBi
NKFQDLEPS

SEQ ID NO: 45201 - protein, 9 aa, Borrelia garinii PBi
KFQDLEPSK

SEQ ID NO: 45202 - protein, 9 aa, Borrelia garinii PBi
FQDLEPSKK

SEQ ID NO: 45203 - protein, 9 aa, Borrelia garinii PBi
QDLEPSKKQ

SEQ ID NO: 45204 - protein, 9 aa, Borrelia garinii PBi
DLEPSKKQN

SEQ ID NO: 45205 - protein, 9 aa, Borrelia garinii PBi
LEPSKKQNK

SEQ ID NO: 45206 - protein, 9 aa, Borrelia garinii PBi
EPSKKQNKD

SEQ ID NO: 45207 - protein, 9 aa, Borrelia garinii PBi
PSKKQNKDL

SEQ ID NO: 45208 - protein, 9 aa, Borrelia garinii PBi
SKKQNKDLE

SEQ ID NO: 45209 - protein, 9 aa, Borrelia garinii PBi
KKQNKDLEP

SEQ ID NO: 45210 - protein, 9 aa, Borrelia garinii PBi
KQNKDLEPL

SEQ ID NO: 45211 - protein, 9 aa, Borrelia garinii PBi
QNKDLEPLR

SEQ ID NO: 45212 - protein, 9 aa, Borrelia garinii PBi
NKDLEPLRE

SEQ ID NO: 45213 - protein, 9 aa, Borrelia garinii PBi
KDLEPLREK

SEQ ID NO: 45214 - protein, 9 aa, Borrelia garinii PBi
DLEPLREKY

SEQ ID NO: 45215 - protein, 9 aa, Borrelia garinii PBi
LEPLREKYP

SEQ ID NO: 45216 - protein, 9 aa, Borrelia garinii PBi
EPLREKYPE

SEQ ID NO: 45217 - protein, 9 aa, Borrelia garinii PBi
PLREKYPEA

SEQ ID NO: 45218 - protein, 9 aa, Borrelia garinii PBi
LREKYPEAT

SEQ ID NO: 45219 - protein, 9 aa, Borrelia garinii PBi
REKYPEATA

SEQ ID NO: 45220 - protein, 9 aa, Borrelia garinii PBi
EKYPEATAS

SEQ ID NO: 45221 - protein, 9 aa, Borrelia garinii PBi
KYPEATASK

SEQ ID NO: 45222 - protein, 9 aa, Borrelia garinii PBi
YPEATASKL

SEQ ID NO: 45223 - protein, 9 aa, Borrelia garinii PBi
PEATASKLE

SEQ ID NO: 45224 - protein, 9 aa, Borrelia garinii PBi
EATASKLET

SEQ ID NO: 45225 - protein, 9 aa, Borrelia garinii PBi
ATASKLETT

SEQ ID NO: 45226 - protein, 9 aa, Borrelia garinii PBi
TASKLETTL

SEQ ID NO: 45227 - protein, 9 aa, Borrelia garinii PBi
ASKLETTLK

SEQ ID NO: 45228 - protein, 9 aa, Borrelia garinii PBi
SKLETTLKI

SEQ ID NO: 45229 - protein, 9 aa, Borrelia garinii PBi
KLETTLKIL

SEQ ID NO: 45230 - protein, 9 aa, Borrelia garinii PBi
LETTLKILE

SEQ ID NO: 45231 - protein, 9 aa, Borrelia garinii PBi
ETTLKILEA

SEQ ID NO: 45232 - protein, 9 aa, Borrelia garinii PBi
TTLKILEAQ

SEQ ID NO: 45233 - protein, 9 aa, Borrelia garinii PBi
TLKILEAQK

SEQ ID NO: 45234 - protein, 9 aa, Borrelia garinii PBi
LKILEAQKE

SEQ ID NO: 45235 - protein, 9 aa, Borrelia garinii PBi
KILEAQKEK

SEQ ID NO: 45236 - protein, 9 aa, Borrelia garinii PBi
ILEAQKEKE

SEQ ID NO: 45237 - protein, 9 aa, Borrelia garinii PBi
LEAQKEKEN

SEQ ID NO: 45238 - protein, 9 aa, Borrelia garinii PBi
EAQKEKENI

SEQ ID NO: 45239 - protein, 9 aa, Borrelia garinii PBi
AQKEKENIE

SEQ ID NO: 45240 - protein, 9 aa, Borrelia garinii PBi
QKEKENIEI

SEQ ID NO: 45241 - protein, 9 aa, Borrelia garinii PBi
KEKENIEIA

SEQ ID NO: 45242 - protein, 9 aa, Borrelia garinii PBi
EKENIEIAK

SEQ ID NO: 45243 - protein, 9 aa, Borrelia garinii PBi
KENIEIAKI

SEQ ID NO: 45244 - protein, 9 aa, Borrelia garinii PBi
ENIEIAKID

SEQ ID NO: 45245 - protein, 9 aa, Borrelia garinii PBi
NIEIAKIDN

SEQ ID NO: 45246 - protein, 9 aa, Borrelia garinii PBi
IEIAKIDNT

SEQ ID NO: 45247 - protein, 9 aa, Borrelia garinii PBi
EIAKIDNTQ

SEQ ID NO: 45248 - protein, 9 aa, Borrelia garinii PBi
IAKIDNTQI

SEQ ID NO: 45249 - protein, 9 aa, Borrelia garinii PBi
AKIDNTQID

SEQ ID NO: 45250 - protein, 9 aa, Borrelia garinii PBi
KIDNTQIDF

SEQ ID NO: 45251 - protein, 9 aa, Borrelia garinii PBi
IDNTQIDFL

SEQ ID NO: 45252 - protein, 9 aa, Borrelia garinii PBi
DNTQIDFLK

SEQ ID NO: 45253 - protein, 9 aa, Borrelia garinii PBi
NTQIDFLKT

SEQ ID NO: 45254 - protein, 9 aa, Borrelia garinii PBi
TQIDFLKTF

SEQ ID NO: 45255 - protein, 9 aa, Borrelia garinii PBi
QIDFLKTFK

SEQ ID NO: 45256 - protein, 9 aa, Borrelia garinii PBi
IDFLKTFKT

SEQ ID NO: 45257 - protein, 9 aa, Borrelia garinii PBi
DFLKTFKTD

SEQ ID NO: 45258 - protein, 9 aa, Borrelia garinii PBi
FLKTFKTDP

SEQ ID NO: 45259 - protein, 9 aa, Borrelia garinii PBi
LKTFKTDPH

SEQ ID NO: 45260 - protein, 9 aa, Borrelia garinii PBi
KTFKTDPHD

SEQ ID NO: 45261 - protein, 9 aa, Borrelia garinii PBi
TFKTDPHDS

SEQ ID NO: 45262 - protein, 9 aa, Borrelia garinii PBi
FKTDPHDSL

SEQ ID NO: 45263 - protein, 9 aa, Borrelia garinii PBi
KTDPHDSLP

SEQ ID NO: 45264 - protein, 9 aa, Borrelia garinii PBi
TDPHDSLPE

SEQ ID NO: 45265 - protein, 9 aa, Borrelia garinii PBi
DPHDSLPED

SEQ ID NO: 45266 - protein, 9 aa, Borrelia garinii PBi
PHDSLPEDE

SEQ ID NO: 45267 - protein, 9 aa, Borrelia garinii PBi
HDSLPEDEK

SEQ ID NO: 45268 - protein, 9 aa, Borrelia garinii PBi
DSLPEDEKM

SEQ ID NO: 45269 - protein, 9 aa, Borrelia garinii PBi
SLPEDEKMQ

SEQ ID NO: 45270 - protein, 9 aa, Borrelia garinii PBi
LPEDEKMQM

SEQ ID NO: 45271 - protein, 9 aa, Borrelia garinii PBi
PEDEKMQMK

SEQ ID NO: 45272 - protein, 9 aa, Borrelia garinii PBi
EDEKMQMKK

SEQ ID NO: 45273 - protein, 9 aa, Borrelia garinii PBi
DEKMQMKKI

SEQ ID NO: 45274 - protein, 9 aa, Borrelia garinii PBi
EKMQMKKII

SEQ ID NO: 45275 - protein, 9 aa, Borrelia garinii PBi
KMQMKKIIY

SEQ ID NO: 45276 - protein, 9 aa, Borrelia garinii PBi
MQMKKIIYS

SEQ ID NO: 45277 - protein, 9 aa, Borrelia garinii PBi
QMKKIIYSS

SEQ ID NO: 45278 - protein, 9 aa, Borrelia garinii PBi
MKKIIYSSL

SEQ ID NO: 45279 - protein, 9 aa, Borrelia garinii PBi
KKIIYSSLN

SEQ ID NO: 45280 - protein, 9 aa, Borrelia garinii PBi
KIIYSSLNY

SEQ ID NO: 45281 - protein, 9 aa, Borrelia garinii PBi
IIYSSLNYE

SEQ ID NO: 45282 - protein, 9 aa, Borrelia garinii PBi
IYSSLNYET

SEQ ID NO: 45283 - protein, 9 aa, Borrelia garinii PBi
YSSLNYETE

SEQ ID NO: 45284 - protein, 9 aa, Borrelia garinii PBi
SSLNYETEK

SEQ ID NO: 45285 - protein, 9 aa, Borrelia garinii PBi
SLNYETEKI

SEQ ID NO: 45286 - protein, 9 aa, Borrelia garinii PBi
LNYETEKIK

SEQ ID NO: 45287 - protein, 9 aa, Borrelia garinii PBi
NYETEKIKI

SEQ ID NO: 45288 - protein, 9 aa, Borrelia garinii PBi
YETEKIKIL

SEQ ID NO: 45289 - protein, 9 aa, Borrelia garinii PBi
ETEKIKILQ

SEQ ID NO: 45290 - protein, 9 aa, Borrelia garinii PBi
TEKIKILQE

SEQ ID NO: 45291 - protein, 9 aa, Borrelia garinii PBi
EKIKILQEI

SEQ ID NO: 45292 - protein, 9 aa, Borrelia garinii PBi
KIKILQEIL

SEQ ID NO: 45293 - protein, 9 aa, Borrelia garinii PBi
IKILQEILE

SEQ ID NO: 45294 - protein, 9 aa, Borrelia garinii PBi
KILQEILEK

SEQ ID NO: 45295 - protein, 9 aa, Borrelia garinii PBi
ILQEILEKL

SEQ ID NO: 45296 - protein, 9 aa, Borrelia garinii PBi
LQEILEKLD

SEQ ID NO: 45297 - protein, 9 aa, Borrelia garinii PBi
QEILEKLDK

SEQ ID NO: 45298 - protein, 9 aa, Borrelia garinii PBi
EILEKLDKN

SEQ ID NO: 45299 - protein, 9 aa, Borrelia garinii PBi
ILEKLDKNL

SEQ ID NO: 45300 - protein, 9 aa, Borrelia garinii PBi
LEKLDKNLQ

SEQ ID NO: 45301 - protein, 9 aa, Borrelia garinii PBi
EKLDKNLQH

SEQ ID NO: 45302 - protein, 9 aa, Borrelia garinii PBi
KLDKNLQHK

SEQ ID NO: 45303 - protein, 9 aa, Borrelia garinii PBi
LDKNLQHKK

SEQ ID NO: 45304 - protein, 9 aa, Borrelia garinii PBi
DKNLQHKKI

SEQ ID NO: 45305 - protein, 9 aa, Borrelia garinii PBi
KNLQHKKIA

SEQ ID NO: 45306 - protein, 9 aa, Borrelia garinii PBi
NLQHKKIAK

SEQ ID NO: 45307 - protein, 9 aa, Borrelia garinii PBi
LQHKKIAKN

SEQ ID NO: 45308 - protein, 9 aa, Borrelia garinii PBi
QHKKIAKNF

SEQ ID NO: 45309 - protein, 9 aa, Borrelia garinii PBi
HKKIAKNFI

SEQ ID NO: 45310 - protein, 9 aa, Borrelia garinii PBi
KKIAKNFIY

SEQ ID NO: 45311 - protein, 9 aa, Borrelia garinii PBi
KIAKNFIYD

SEQ ID NO: 45312 - protein, 9 aa, Borrelia garinii PBi
IAKNFIYDI

SEQ ID NO: 45313 - protein, 9 aa, Borrelia garinii PBi
AKNFIYDIP

SEQ ID NO: 45314 - protein, 9 aa, Borrelia garinii PBi
KNFIYDIPI

SEQ ID NO: 45315 - protein, 9 aa, Borrelia garinii PBi
NFIYDIPII

SEQ ID NO: 45316 - protein, 9 aa, Borrelia garinii PBi
FIYDIPIII

SEQ ID NO: 45317 - protein, 9 aa, Borrelia garinii PBi
IYDIPIIIQ

SEQ ID NO: 45318 - protein, 9 aa, Borrelia garinii PBi
YDIPIIIQS

SEQ ID NO: 45319 - protein, 9 aa, Borrelia garinii PBi
DIPIIIQSR

SEQ ID NO: 45320 - protein, 9 aa, Borrelia garinii PBi
IPIIIQSRL

SEQ ID NO: 45321 - protein, 9 aa, Borrelia garinii PBi
PIIIQSRLD

SEQ ID NO: 45322 - protein, 9 aa, Borrelia garinii PBi
IIIQSRLDI

SEQ ID NO: 45323 - protein, 9 aa, Borrelia garinii PBi
IIQSRLDII

SEQ ID NO: 45324 - protein, 9 aa, Borrelia garinii PBi
IQSRLDIIS

SEQ ID NO: 45325 - protein, 9 aa, Borrelia garinii PBi
QSRLDIISK

SEQ ID NO: 45326 - protein, 9 aa, Borrelia garinii PBi
SRLDIISKV

SEQ ID NO: 45327 - protein, 9 aa, Borrelia garinii PBi
RLDIISKVI

SEQ ID NO: 45328 - protein, 9 aa, Borrelia garinii PBi
LDIISKVIK

SEQ ID NO: 45329 - protein, 9 aa, Borrelia garinii PBi
DIISKVIKN

SEQ ID NO: 45330 - protein, 9 aa, Borrelia garinii PBi
IISKVIKNP

SEQ ID NO: 45331 - protein, 9 aa, Borrelia garinii PBi
ISKVIKNPI

SEQ ID NO: 45332 - protein, 9 aa, Borrelia garinii PBi
SKVIKNPIK

SEQ ID NO: 45333 - protein, 9 aa, Borrelia garinii PBi
KVIKNPIKD

SEQ ID NO: 45334 - protein, 9 aa, Borrelia garinii PBi
VIKNPIKDE

SEQ ID NO: 45335 - protein, 9 aa, Borrelia garinii PBi
IKNPIKDEL

SEQ ID NO: 45336 - protein, 9 aa, Borrelia garinii PBi
KNPIKDELQ

SEQ ID NO: 45337 - protein, 9 aa, Borrelia garinii PBi
NPIKDELQI

SEQ ID NO: 45338 - protein, 9 aa, Borrelia garinii PBi
PIKDELQIL

SEQ ID NO: 45339 - protein, 9 aa, Borrelia garinii PBi
IKDELQILN

SEQ ID NO: 45340 - protein, 9 aa, Borrelia garinii PBi
KDELQILNQ

SEQ ID NO: 45341 - protein, 9 aa, Borrelia garinii PBi
DELQILNQK

SEQ ID NO: 45342 - protein, 9 aa, Borrelia garinii PBi
ELQILNQKE

SEQ ID NO: 45343 - protein, 9 aa, Borrelia garinii PBi
LQILNQKEI

SEQ ID NO: 45344 - protein, 9 aa, Borrelia garinii PBi
QILNQKEIE

SEQ ID NO: 45345 - protein, 9 aa, Borrelia garinii PBi
ILNQKEIEE

SEQ ID NO: 45346 - protein, 9 aa, Borrelia garinii PBi
LNQKEIEEL

SEQ ID NO: 45347 - protein, 9 aa, Borrelia garinii PBi
NQKEIEELL

SEQ ID NO: 45348 - protein, 9 aa, Borrelia garinii PBi
QKEIEELLM

SEQ ID NO: 45349 - protein, 9 aa, Borrelia garinii PBi
KEIEELLMR

SEQ ID NO: 45350 - protein, 9 aa, Borrelia garinii PBi
EIEELLMRI

SEQ ID NO: 45351 - protein, 9 aa, Borrelia garinii PBi
IEELLMRIE

SEQ ID NO: 45352 - protein, 9 aa, Borrelia garinii PBi
EELLMRIES

SEQ ID NO: 45353 - protein, 9 aa, Borrelia garinii PBi
ELLMRIESE

SEQ ID NO: 45354 - protein, 9 aa, Borrelia garinii PBi
LLMRIESEL

SEQ ID NO: 45355 - protein, 9 aa, Borrelia garinii PBi
LMRIESELK

SEQ ID NO: 45356 - protein, 9 aa, Borrelia garinii PBi
MRIESELKI

SEQ ID NO: 45357 - protein, 9 aa, Borrelia garinii PBi
RIESELKIK

SEQ ID NO: 45358 - protein, 9 aa, Borrelia garinii PBi
IESELKIKE

SEQ ID NO: 45359 - protein, 9 aa, Borrelia garinii PBi
ESELKIKEN

SEQ ID NO: 45360 - protein, 9 aa, Borrelia garinii PBi
SELKIKENF

SEQ ID NO: 45361 - protein, 9 aa, Borrelia garinii PBi
ELKIKENFK

SEQ ID NO: 45362 - protein, 9 aa, Borrelia garinii PBi
LKIKENFKK

SEQ ID NO: 45363 - protein, 9 aa, Borrelia garinii PBi
KIKENFKKA

SEQ ID NO: 45364 - protein, 9 aa, Borrelia garinii PBi
IKENFKKAL

SEQ ID NO: 45365 - protein, 9 aa, Borrelia garinii PBi
KENFKKALN

SEQ ID NO: 45366 - protein, 9 aa, Borrelia garinii PBi
ENFKKALNK

SEQ ID NO: 45367 - protein, 9 aa, Borrelia garinii PBi
NFKKALNKT

SEQ ID NO: 45368 - protein, 9 aa, Borrelia garinii PBi
FKKALNKTI

SEQ ID NO: 45369 - protein, 9 aa, Borrelia garinii PBi
KKALNKTID

SEQ ID NO: 45370 - protein, 9 aa, Borrelia garinii PBi
KALNKTIDA

SEQ ID NO: 45371 - protein, 9 aa, Borrelia garinii PBi
ALNKTIDAY

SEQ ID NO: 45372 - protein, 9 aa, Borrelia garinii PBi
LNKTIDAYN

SEQ ID NO: 45373 - protein, 9 aa, Borrelia garinii PBi
NKTIDAYNQ

SEQ ID NO: 45374 - protein, 9 aa, Borrelia garinii PBi
KTIDAYNQD

SEQ ID NO: 45375 - protein, 9 aa, Borrelia garinii PBi
TIDAYNQDS

SEQ ID NO: 45376 - protein, 9 aa, Borrelia garinii PBi
IDAYNQDSE

SEQ ID NO: 45377 - protein, 9 aa, Borrelia garinii PBi
DAYNQDSEN

SEQ ID NO: 45378 - protein, 9 aa, Borrelia garinii PBi
AYNQDSENI

SEQ ID NO: 45379 - protein, 9 aa, Borrelia garinii PBi
YNQDSENIK

SEQ ID NO: 45380 - protein, 9 aa, Borrelia garinii PBi
NQDSENIKT

SEQ ID NO: 45381 - protein, 9 aa, Borrelia garinii PBi
QDSENIKTS

SEQ ID NO: 45382 - protein, 9 aa, Borrelia garinii PBi
DSENIKTSA

SEQ ID NO: 45383 - protein, 9 aa, Borrelia garinii PBi
SENIKTSAE

SEQ ID NO: 45384 - protein, 9 aa, Borrelia garinii PBi
ENIKTSAEQ

SEQ ID NO: 45385 - protein, 9 aa, Borrelia garinii PBi
NIKTSAEQL

SEQ ID NO: 45386 - protein, 9 aa, Borrelia garinii PBi
IKTSAEQLE

SEQ ID NO: 45387 - protein, 9 aa, Borrelia garinii PBi
KTSAEQLEK

SEQ ID NO: 45388 - protein, 9 aa, Borrelia garinii PBi
TSAEQLEKH

SEQ ID NO: 45389 - protein, 9 aa, Borrelia garinii PBi
SAEQLEKHI

SEQ ID NO: 45390 - protein, 9 aa, Borrelia garinii PBi
AEQLEKHIN

SEQ ID NO: 45391 - protein, 9 aa, Borrelia garinii PBi
EQLEKHINE

SEQ ID NO: 45392 - protein, 9 aa, Borrelia garinii PBi
QLEKHINEN

SEQ ID NO: 45393 - protein, 9 aa, Borrelia garinii PBi
LEKHINENY

SEQ ID NO: 45394 - protein, 9 aa, Borrelia garinii PBi
EKHINENYK

SEQ ID NO: 45395 - protein, 9 aa, Borrelia garinii PBi
KHINENYKE

SEQ ID NO: 45396 - protein, 9 aa, Borrelia garinii PBi
HINENYKEF

SEQ ID NO: 45397 - protein, 9 aa, Borrelia garinii PBi
INENYKEFN

SEQ ID NO: 45398 - protein, 9 aa, Borrelia garinii PBi
NENYKEFNS

SEQ ID NO: 45399 - protein, 9 aa, Borrelia garinii PBi
ENYKEFNSL

SEQ ID NO: 45400 - protein, 9 aa, Borrelia garinii PBi
NYKEFNSLK

SEQ ID NO: 45401 - protein, 9 aa, Borrelia garinii PBi
YKEFNSLKP

SEQ ID NO: 45402 - protein, 9 aa, Borrelia garinii PBi
KEFNSLKPI

SEQ ID NO: 45403 - protein, 9 aa, Borrelia garinii PBi
EFNSLKPIY

SEQ ID NO: 45404 - protein, 10 aa, Borrelia garinii PBi
MKKTKLNIIK

SEQ ID NO: 45405 - protein, 10 aa, Borrelia garinii PBi
KKTKLNIIKL

SEQ ID NO: 45406 - protein, 10 aa, Borrelia garinii PBi
KTKLNIIKLN

SEQ ID NO: 45407 - protein, 10 aa, Borrelia garinii PBi
TKLNIIKLNI

SEQ ID NO: 45408 - protein, 10 aa, Borrelia garinii PBi
KLNIIKLNIL

SEQ ID NO: 45409 - protein, 10 aa, Borrelia garinii PBi
LNIIKLNILT

SEQ ID NO: 45410 - protein, 10 aa, Borrelia garinii PBi
NIIKLNILTT

SEQ ID NO: 45411 - protein, 10 aa, Borrelia garinii PBi
IIKLNILTTT

SEQ ID NO: 45412 - protein, 10 aa, Borrelia garinii PBi
IKLNILTTTL

SEQ ID NO: 45413 - protein, 10 aa, Borrelia garinii PBi
KLNILTTTLT

SEQ ID NO: 45414 - protein, 10 aa, Borrelia garinii PBi
LNILTTTLTL

SEQ ID NO: 45415 - protein, 10 aa, Borrelia garinii PBi
NILTTTLTLI

SEQ ID NO: 45416 - protein, 10 aa, Borrelia garinii PBi
ILTTTLTLIC

SEQ ID NO: 45417 - protein, 10 aa, Borrelia garinii PBi
LTTTLTLICI

SEQ ID NO: 45418 - protein, 10 aa, Borrelia garinii PBi
TTTLTLICIS

SEQ ID NO: 45419 - protein, 10 aa, Borrelia garinii PBi
TTLTLICISC

SEQ ID NO: 45420 - protein, 10 aa, Borrelia garinii PBi
TLTLICISCA

SEQ ID NO: 45421 - protein, 10 aa, Borrelia garinii PBi
LTLICISCAV

SEQ ID NO: 45422 - protein, 10 aa, Borrelia garinii PBi
TLICISCAVN

SEQ ID NO: 45423 - protein, 10 aa, Borrelia garinii PBi
LICISCAVNK

SEQ ID NO: 45424 - protein, 10 aa, Borrelia garinii PBi
ICISCAVNKI

SEQ ID NO: 45425 - protein, 10 aa, Borrelia garinii PBi
CISCAVNKID

SEQ ID NO: 45426 - protein, 10 aa, Borrelia garinii PBi
ISCAVNKIDP

SEQ ID NO: 45427 - protein, 10 aa, Borrelia garinii PBi
SCAVNKIDPE

SEQ ID NO: 45428 - protein, 10 aa, Borrelia garinii PBi
CAVNKIDPEP

SEQ ID NO: 45429 - protein, 10 aa, Borrelia garinii PBi
AVNKIDPEPK

SEQ ID NO: 45430 - protein, 10 aa, Borrelia garinii PBi
VNKIDPEPKS

SEQ ID NO: 45431 - protein, 10 aa, Borrelia garinii PBi
NKIDPEPKSK

SEQ ID NO: 45432 - protein, 10 aa, Borrelia garinii PBi
KIDPEPKSKT

SEQ ID NO: 45433 - protein, 10 aa, Borrelia garinii PBi
IDPEPKSKTN

SEQ ID NO: 45434 - protein, 10 aa, Borrelia garinii PBi
DPEPKSKTNK

SEQ ID NO: 45435 - protein, 10 aa, Borrelia garinii PBi
PEPKSKTNKK

SEQ ID NO: 45436 - protein, 10 aa, Borrelia garinii PBi
EPKSKTNKKE

SEQ ID NO: 45437 - protein, 10 aa, Borrelia garinii PBi
PKSKTNKKEN

SEQ ID NO: 45438 - protein, 10 aa, Borrelia garinii PBi
KSKTNKKENI

SEQ ID NO: 45439 - protein, 10 aa, Borrelia garinii PBi
SKTNKKENIK

SEQ ID NO: 45440 - protein, 10 aa, Borrelia garinii PBi
KTNKKENIKN

SEQ ID NO: 45441 - protein, 10 aa, Borrelia garinii PBi
TNKKENIKNF

SEQ ID NO: 45442 - protein, 10 aa, Borrelia garinii PBi
NKKENIKNFV

SEQ ID NO: 45443 - protein, 10 aa, Borrelia garinii PBi
KKENIKNFVN

SEQ ID NO: 45444 - protein, 10 aa, Borrelia garinii PBi
KENIKNFVNK

SEQ ID NO: 45445 - protein, 10 aa, Borrelia garinii PBi
ENIKNFVNKF

SEQ ID NO: 45446 - protein, 10 aa, Borrelia garinii PBi
NIKNFVNKFQ

SEQ ID NO: 45447 - protein, 10 aa, Borrelia garinii PBi
IKNFVNKFQD

SEQ ID NO: 45448 - protein, 10 aa, Borrelia garinii PBi
KNFVNKFQDL

SEQ ID NO: 45449 - protein, 10 aa, Borrelia garinii PBi
NFVNKFQDLE

SEQ ID NO: 45450 - protein, 10 aa, Borrelia garinii PBi
FVNKFQDLEP

SEQ ID NO: 45451 - protein, 10 aa, Borrelia garinii PBi
VNKFQDLEPS

SEQ ID NO: 45452 - protein, 10 aa, Borrelia garinii PBi
NKFQDLEPSK

SEQ ID NO: 45453 - protein, 10 aa, Borrelia garinii PBi
KFQDLEPSKK

SEQ ID NO: 45454 - protein, 10 aa, Borrelia garinii PBi
FQDLEPSKKQ

SEQ ID NO: 45455 - protein, 10 aa, Borrelia garinii PBi
QDLEPSKKQN

SEQ ID NO: 45456 - protein, 10 aa, Borrelia garinii PBi
DLEPSKKQNK

SEQ ID NO: 45457 - protein, 10 aa, Borrelia garinii PBi
LEPSKKQNKD

SEQ ID NO: 45458 - protein, 10 aa, Borrelia garinii PBi
EPSKKQNKDL

SEQ ID NO: 45459 - protein, 10 aa, Borrelia garinii PBi
PSKKQNKDLE

SEQ ID NO: 45460 - protein, 10 aa, Borrelia garinii PBi
SKKQNKDLEP

SEQ ID NO: 45461 - protein, 10 aa, Borrelia garinii PBi
KKQNKDLEPL

SEQ ID NO: 45462 - protein, 10 aa, Borrelia garinii PBi
KQNKDLEPLR

SEQ ID NO: 45463 - protein, 10 aa, Borrelia garinii PBi
QNKDLEPLRE

SEQ ID NO: 45464 - protein, 10 aa, Borrelia garinii PBi
NKDLEPLREK

SEQ ID NO: 45465 - protein, 10 aa, Borrelia garinii PBi
KDLEPLREKY

SEQ ID NO: 45466 - protein, 10 aa, Borrelia garinii PBi
DLEPLREKYP

SEQ ID NO: 45467 - protein, 10 aa, Borrelia garinii PBi
LEPLREKYPE

SEQ ID NO: 45468 - protein, 10 aa, Borrelia garinii PBi
EPLREKYPEA

SEQ ID NO: 45469 - protein, 10 aa, Borrelia garinii PBi
PLREKYPEAT

SEQ ID NO: 45470 - protein, 10 aa, Borrelia garinii PBi
LREKYPEATA

SEQ ID NO: 45471 - protein, 10 aa, Borrelia garinii PBi
REKYPEATAS

SEQ ID NO: 45472 - protein, 10 aa, Borrelia garinii PBi
EKYPEATASK

SEQ ID NO: 45473 - protein, 10 aa, Borrelia garinii PBi
KYPEATASKL

SEQ ID NO: 45474 - protein, 10 aa, Borrelia garinii PBi
YPEATASKLE

SEQ ID NO: 45475 - protein, 10 aa, Borrelia garinii PBi
PEATASKLET

SEQ ID NO: 45476 - protein, 10 aa, Borrelia garinii PBi
EATASKLETT

SEQ ID NO: 45477 - protein, 10 aa, Borrelia garinii PBi
ATASKLETTL

SEQ ID NO: 45478 - protein, 10 aa, Borrelia garinii PBi
TASKLETTLK

SEQ ID NO: 45479 - protein, 10 aa, Borrelia garinii PBi
ASKLETTLKI

SEQ ID NO: 45480 - protein, 10 aa, Borrelia garinii PBi
SKLETTLKIL

SEQ ID NO: 45481 - protein, 10 aa, Borrelia garinii PBi
KLETTLKILE

SEQ ID NO: 45482 - protein, 10 aa, Borrelia garinii PBi
LETTLKILEA

SEQ ID NO: 45483 - protein, 10 aa, Borrelia garinii PBi
ETTLKILEAQ

SEQ ID NO: 45484 - protein, 10 aa, Borrelia garinii PBi
TTLKILEAQK

SEQ ID NO: 45485 - protein, 10 aa, Borrelia garinii PBi
TLKILEAQKE

SEQ ID NO: 45486 - protein, 10 aa, Borrelia garinii PBi
LKILEAQKEK

SEQ ID NO: 45487 - protein, 10 aa, Borrelia garinii PBi
KILEAQKEKE

SEQ ID NO: 45488 - protein, 10 aa, Borrelia garinii PBi
ILEAQKEKEN

SEQ ID NO: 45489 - protein, 10 aa, Borrelia garinii PBi
LEAQKEKENI

SEQ ID NO: 45490 - protein, 10 aa, Borrelia garinii PBi
EAQKEKENIE

SEQ ID NO: 45491 - protein, 10 aa, Borrelia garinii PBi
AQKEKENIEI

SEQ ID NO: 45492 - protein, 10 aa, Borrelia garinii PBi
QKEKENIEIA

SEQ ID NO: 45493 - protein, 10 aa, Borrelia garinii PBi
KEKENIEIAK

SEQ ID NO: 45494 - protein, 10 aa, Borrelia garinii PBi
EKENIEIAKI

SEQ ID NO: 45495 - protein, 10 aa, Borrelia garinii PBi
KENIEIAKID

SEQ ID NO: 45496 - protein, 10 aa, Borrelia garinii PBi
ENIEIAKIDN

SEQ ID NO: 45497 - protein, 10 aa, Borrelia garinii PBi
NIEIAKIDNT

SEQ ID NO: 45498 - protein, 10 aa, Borrelia garinii PBi
IEIAKIDNTQ

SEQ ID NO: 45499 - protein, 10 aa, Borrelia garinii PBi
EIAKIDNTQI

SEQ ID NO: 45500 - protein, 10 aa, Borrelia garinii PBi
IAKIDNTQID

SEQ ID NO: 45501 - protein, 10 aa, Borrelia garinii PBi
AKIDNTQIDF

SEQ ID NO: 45502 - protein, 10 aa, Borrelia garinii PBi
KIDNTQIDFL

SEQ ID NO: 45503 - protein, 10 aa, Borrelia garinii PBi
IDNTQIDFLK

SEQ ID NO: 45504 - protein, 10 aa, Borrelia garinii PBi
DNTQIDFLKT

SEQ ID NO: 45505 - protein, 10 aa, Borrelia garinii PBi
NTQIDFLKTF

SEQ ID NO: 45506 - protein, 10 aa, Borrelia garinii PBi
TQIDFLKTFK

SEQ ID NO: 45507 - protein, 10 aa, Borrelia garinii PBi
QIDFLKTFKT

SEQ ID NO: 45508 - protein, 10 aa, Borrelia garinii PBi
IDFLKTFKTD

SEQ ID NO: 45509 - protein, 10 aa, Borrelia garinii PBi
DFLKTFKTDP

SEQ ID NO: 45510 - protein, 10 aa, Borrelia garinii PBi
FLKTFKTDPH

SEQ ID NO: 45511 - protein, 10 aa, Borrelia garinii PBi
LKTFKTDPHD

SEQ ID NO: 45512 - protein, 10 aa, Borrelia garinii PBi
KTFKTDPHDS

SEQ ID NO: 45513 - protein, 10 aa, Borrelia garinii PBi
TFKTDPHDSL

SEQ ID NO: 45514 - protein, 10 aa, Borrelia garinii PBi
FKTDPHDSLP

SEQ ID NO: 45515 - protein, 10 aa, Borrelia garinii PBi
KTDPHDSLPE

SEQ ID NO: 45516 - protein, 10 aa, Borrelia garinii PBi
TDPHDSLPED

SEQ ID NO: 45517 - protein, 10 aa, Borrelia garinii PBi
DPHDSLPEDE

SEQ ID NO: 45518 - protein, 10 aa, Borrelia garinii PBi
PHDSLPEDEK

SEQ ID NO: 45519 - protein, 10 aa, Borrelia garinii PBi
HDSLPEDEKM

SEQ ID NO: 45520 - protein, 10 aa, Borrelia garinii PBi
DSLPEDEKMQ

SEQ ID NO: 45521 - protein, 10 aa, Borrelia garinii PBi
SLPEDEKMQM

SEQ ID NO: 45522 - protein, 10 aa, Borrelia garinii PBi
LPEDEKMQMK

SEQ ID NO: 45523 - protein, 10 aa, Borrelia garinii PBi
PEDEKMQMKK

SEQ ID NO: 45524 - protein, 10 aa, Borrelia garinii PBi
EDEKMQMKKI

SEQ ID NO: 45525 - protein, 10 aa, Borrelia garinii PBi
DEKMQMKKII

SEQ ID NO: 45526 - protein, 10 aa, Borrelia garinii PBi
EKMQMKKIIY

SEQ ID NO: 45527 - protein, 10 aa, Borrelia garinii PBi
KMQMKKIIYS

SEQ ID NO: 45528 - protein, 10 aa, Borrelia garinii PBi
MQMKKIIYSS

SEQ ID NO: 45529 - protein, 10 aa, Borrelia garinii PBi
QMKKIIYSSL

SEQ ID NO: 45530 - protein, 10 aa, Borrelia garinii PBi
MKKIIYSSLN

SEQ ID NO: 45531 - protein, 10 aa, Borrelia garinii PBi
KKIIYSSLNY

SEQ ID NO: 45532 - protein, 10 aa, Borrelia garinii PBi
KIIYSSLNYE

SEQ ID NO: 45533 - protein, 10 aa, Borrelia garinii PBi
IIYSSLNYET

SEQ ID NO: 45534 - protein, 10 aa, Borrelia garinii PBi
IYSSLNYETE

SEQ ID NO: 45535 - protein, 10 aa, Borrelia garinii PBi
YSSLNYETEK

SEQ ID NO: 45536 - protein, 10 aa, Borrelia garinii PBi
SSLNYETEKI

SEQ ID NO: 45537 - protein, 10 aa, Borrelia garinii PBi
SLNYETEKIK

SEQ ID NO: 45538 - protein, 10 aa, Borrelia garinii PBi
LNYETEKIKI

SEQ ID NO: 45539 - protein, 10 aa, Borrelia garinii PBi
NYETEKIKIL

SEQ ID NO: 45540 - protein, 10 aa, Borrelia garinii PBi
YETEKIKILQ

SEQ ID NO: 45541 - protein, 10 aa, Borrelia garinii PBi
ETEKIKILQE

SEQ ID NO: 45542 - protein, 10 aa, Borrelia garinii PBi
TEKIKILQEI

SEQ ID NO: 45543 - protein, 10 aa, Borrelia garinii PBi
EKIKILQEIL

SEQ ID NO: 45544 - protein, 10 aa, Borrelia garinii PBi
KIKILQEILE

SEQ ID NO: 45545 - protein, 10 aa, Borrelia garinii PBi
IKILQEILEK

SEQ ID NO: 45546 - protein, 10 aa, Borrelia garinii PBi
KILQEILEKL

SEQ ID NO: 45547 - protein, 10 aa, Borrelia garinii PBi
ILQEILEKLD

SEQ ID NO: 45548 - protein, 10 aa, Borrelia garinii PBi
LQEILEKLDK

SEQ ID NO: 45549 - protein, 10 aa, Borrelia garinii PBi
QEILEKLDKN

SEQ ID NO: 45550 - protein, 10 aa, Borrelia garinii PBi
EILEKLDKNL

SEQ ID NO: 45551 - protein, 10 aa, Borrelia garinii PBi
ILEKLDKNLQ

SEQ ID NO: 45552 - protein, 10 aa, Borrelia garinii PBi
LEKLDKNLQH

SEQ ID NO: 45553 - protein, 10 aa, Borrelia garinii PBi
EKLDKNLQHK

SEQ ID NO: 45554 - protein, 10 aa, Borrelia garinii PBi
KLDKNLQHKK

SEQ ID NO: 45555 - protein, 10 aa, Borrelia garinii PBi
LDKNLQHKKI

SEQ ID NO: 45556 - protein, 10 aa, Borrelia garinii PBi
DKNLQHKKIA

SEQ ID NO: 45557 - protein, 10 aa, Borrelia garinii PBi
KNLQHKKIAK

SEQ ID NO: 45558 - protein, 10 aa, Borrelia garinii PBi
NLQHKKIAKN

SEQ ID NO: 45559 - protein, 10 aa, Borrelia garinii PBi
LQHKKIAKNF

SEQ ID NO: 45560 - protein, 10 aa, Borrelia garinii PBi
QHKKIAKNFI

SEQ ID NO: 45561 - protein, 10 aa, Borrelia garinii PBi
HKKIAKNFIY

SEQ ID NO: 45562 - protein, 10 aa, Borrelia garinii PBi
KKIAKNFIYD

SEQ ID NO: 45563 - protein, 10 aa, Borrelia garinii PBi
KIAKNFIYDI

SEQ ID NO: 45564 - protein, 10 aa, Borrelia garinii PBi
IAKNFIYDIP

SEQ ID NO: 45565 - protein, 10 aa, Borrelia garinii PBi
AKNFIYDIPI

SEQ ID NO: 45566 - protein, 10 aa, Borrelia garinii PBi
KNFIYDIPII

SEQ ID NO: 45567 - protein, 10 aa, Borrelia garinii PBi
NFIYDIPIII

SEQ ID NO: 45568 - protein, 10 aa, Borrelia garinii PBi
FIYDIPIIIQ

SEQ ID NO: 45569 - protein, 10 aa, Borrelia garinii PBi
IYDIPIIIQS

SEQ ID NO: 45570 - protein, 10 aa, Borrelia garinii PBi
YDIPIIIQSR

SEQ ID NO: 45571 - protein, 10 aa, Borrelia garinii PBi
DIPIIIQSRL

SEQ ID NO: 45572 - protein, 10 aa, Borrelia garinii PBi
IPIIIQSRLD

SEQ ID NO: 45573 - protein, 10 aa, Borrelia garinii PBi
PIIIQSRLDI

SEQ ID NO: 45574 - protein, 10 aa, Borrelia garinii PBi
IIIQSRLDII

SEQ ID NO: 45575 - protein, 10 aa, Borrelia garinii PBi
IIQSRLDIIS

SEQ ID NO: 45576 - protein, 10 aa, Borrelia garinii PBi
IQSRLDIISK

SEQ ID NO: 45577 - protein, 10 aa, Borrelia garinii PBi
QSRLDIISKV

SEQ ID NO: 45578 - protein, 10 aa, Borrelia garinii PBi
SRLDIISKVI

SEQ ID NO: 45579 - protein, 10 aa, Borrelia garinii PBi
RLDIISKVIK

SEQ ID NO: 45580 - protein, 10 aa, Borrelia garinii PBi
LDIISKVIKN

SEQ ID NO: 45581 - protein, 10 aa, Borrelia garinii PBi
DIISKVIKNP

SEQ ID NO: 45582 - protein, 10 aa, Borrelia garinii PBi
IISKVIKNPI

SEQ ID NO: 45583 - protein, 10 aa, Borrelia garinii PBi
ISKVIKNPIK

SEQ ID NO: 45584 - protein, 10 aa, Borrelia garinii PBi
SKVIKNPIKD

SEQ ID NO: 45585 - protein, 10 aa, Borrelia garinii PBi
KVIKNPIKDE

SEQ ID NO: 45586 - protein, 10 aa, Borrelia garinii PBi
VIKNPIKDEL

SEQ ID NO: 45587 - protein, 10 aa, Borrelia garinii PBi
IKNPIKDELQ

SEQ ID NO: 45588 - protein, 10 aa, Borrelia garinii PBi
KNPIKDELQI

SEQ ID NO: 45589 - protein, 10 aa, Borrelia garinii PBi
NPIKDELQIL

SEQ ID NO: 45590 - protein, 10 aa, Borrelia garinii PBi
PIKDELQILN

SEQ ID NO: 45591 - protein, 10 aa, Borrelia garinii PBi
IKDELQILNQ

SEQ ID NO: 45592 - protein, 10 aa, Borrelia garinii PBi
KDELQILNQK

SEQ ID NO: 45593 - protein, 10 aa, Borrelia garinii PBi
DELQILNQKE

SEQ ID NO: 45594 - protein, 10 aa, Borrelia garinii PBi
ELQILNQKEI

SEQ ID NO: 45595 - protein, 10 aa, Borrelia garinii PBi
LQILNQKEIE

SEQ ID NO: 45596 - protein, 10 aa, Borrelia garinii PBi
QILNQKEIEE

SEQ ID NO: 45597 - protein, 10 aa, Borrelia garinii PBi
ILNQKEIEEL

SEQ ID NO: 45598 - protein, 10 aa, Borrelia garinii PBi
LNQKEIEELL

SEQ ID NO: 45599 - protein, 10 aa, Borrelia garinii PBi
NQKEIEELLM

SEQ ID NO: 45600 - protein, 10 aa, Borrelia garinii PBi
QKEIEELLMR

SEQ ID NO: 45601 - protein, 10 aa, Borrelia garinii PBi
KEIEELLMRI

SEQ ID NO: 45602 - protein, 10 aa, Borrelia garinii PBi
EIEELLMRIE

SEQ ID NO: 45603 - protein, 10 aa, Borrelia garinii PBi
IEELLMRIES

SEQ ID NO: 45604 - protein, 10 aa, Borrelia garinii PBi
EELLMRIESE

SEQ ID NO: 45605 - protein, 10 aa, Borrelia garinii PBi
ELLMRIESEL

SEQ ID NO: 45606 - protein, 10 aa, Borrelia garinii PBi
LLMRIESELK

SEQ ID NO: 45607 - protein, 10 aa, Borrelia garinii PBi
LMRIESELKI

SEQ ID NO: 45608 - protein, 10 aa, Borrelia garinii PBi
MRIESELKIK

SEQ ID NO: 45609 - protein, 10 aa, Borrelia garinii PBi
RIESELKIKE

SEQ ID NO: 45610 - protein, 10 aa, Borrelia garinii PBi
IESELKIKEN

SEQ ID NO: 45611 - protein, 10 aa, Borrelia garinii PBi
ESELKIKENF

SEQ ID NO: 45612 - protein, 10 aa, Borrelia garinii PBi
SELKIKENFK

SEQ ID NO: 45613 - protein, 10 aa, Borrelia garinii PBi
ELKIKENFKK

SEQ ID NO: 45614 - protein, 10 aa, Borrelia garinii PBi
LKIKENFKKA

SEQ ID NO: 45615 - protein, 10 aa, Borrelia garinii PBi
KIKENFKKAL

SEQ ID NO: 45616 - protein, 10 aa, Borrelia garinii PBi
IKENFKKALN

SEQ ID NO: 45617 - protein, 10 aa, Borrelia garinii PBi
KENFKKALNK

SEQ ID NO: 45618 - protein, 10 aa, Borrelia garinii PBi
ENFKKALNKT

SEQ ID NO: 45619 - protein, 10 aa, Borrelia garinii PBi
NFKKALNKTI

SEQ ID NO: 45620 - protein, 10 aa, Borrelia garinii PBi
FKKALNKTID

SEQ ID NO: 45621 - protein, 10 aa, Borrelia garinii PBi
KKALNKTIDA

SEQ ID NO: 45622 - protein, 10 aa, Borrelia garinii PBi
KALNKTIDAY

SEQ ID NO: 45623 - protein, 10 aa, Borrelia garinii PBi
ALNKTIDAYN

SEQ ID NO: 45624 - protein, 10 aa, Borrelia garinii PBi
LNKTIDAYNQ

SEQ ID NO: 45625 - protein, 10 aa, Borrelia garinii PBi
NKTIDAYNQD

SEQ ID NO: 45626 - protein, 10 aa, Borrelia garinii PBi
KTIDAYNQDS

SEQ ID NO: 45627 - protein, 10 aa, Borrelia garinii PBi
TIDAYNQDSE

SEQ ID NO: 45628 - protein, 10 aa, Borrelia garinii PBi
IDAYNQDSEN

SEQ ID NO: 45629 - protein, 10 aa, Borrelia garinii PBi
DAYNQDSENI

SEQ ID NO: 45630 - protein, 10 aa, Borrelia garinii PBi
AYNQDSENIK

SEQ ID NO: 45631 - protein, 10 aa, Borrelia garinii PBi
YNQDSENIKT

SEQ ID NO: 45632 - protein, 10 aa, Borrelia garinii PBi
NQDSENIKTS

SEQ ID NO: 45633 - protein, 10 aa, Borrelia garinii PBi
QDSENIKTSA

SEQ ID NO: 45634 - protein, 10 aa, Borrelia garinii PBi
DSENIKTSAE

SEQ ID NO: 45635 - protein, 10 aa, Borrelia garinii PBi
SENIKTSAEQ

SEQ ID NO: 45636 - protein, 10 aa, Borrelia garinii PBi
ENIKTSAEQL

SEQ ID NO: 45637 - protein, 10 aa, Borrelia garinii PBi
NIKTSAEQLE

SEQ ID NO: 45638 - protein, 10 aa, Borrelia garinii PBi
IKTSAEQLEK

SEQ ID NO: 45639 - protein, 10 aa, Borrelia garinii PBi
KTSAEQLEKH

SEQ ID NO: 45640 - protein, 10 aa, Borrelia garinii PBi
TSAEQLEKHI

SEQ ID NO: 45641 - protein, 10 aa, Borrelia garinii PBi
SAEQLEKHIN

SEQ ID NO: 45642 - protein, 10 aa, Borrelia garinii PBi
AEQLEKHINE

SEQ ID NO: 45643 - protein, 10 aa, Borrelia garinii PBi
EQLEKHINEN

SEQ ID NO: 45644 - protein, 10 aa, Borrelia garinii PBi
QLEKHINENY

SEQ ID NO: 45645 - protein, 10 aa, Borrelia garinii PBi
LEKHINENYK

SEQ ID NO: 45646 - protein, 10 aa, Borrelia garinii PBi
EKHINENYKE

SEQ ID NO: 45647 - protein, 10 aa, Borrelia garinii PBi
KHINENYKEF

SEQ ID NO: 45648 - protein, 10 aa, Borrelia garinii PBi
HINENYKEFN

SEQ ID NO: 45649 - protein, 10 aa, Borrelia garinii PBi
INENYKEFNS

SEQ ID NO: 45650 - protein, 10 aa, Borrelia garinii PBi
NENYKEFNSL

SEQ ID NO: 45651 - protein, 10 aa, Borrelia garinii PBi
ENYKEFNSLK

SEQ ID NO: 45652 - protein, 10 aa, Borrelia garinii PBi
NYKEFNSLKP

SEQ ID NO: 45653 - protein, 10 aa, Borrelia garinii PBi
YKEFNSLKPI

SEQ ID NO: 45654 - protein, 10 aa, Borrelia garinii PBi
KEFNSLKPIY

SEQ ID NO: 45655 - protein, 11 aa, Borrelia garinii PBi
MKKTKLNIIKL

SEQ ID NO: 45656 - protein, 11 aa, Borrelia garinii PBi
KKTKLNIIKLN

SEQ ID NO: 45657 - protein, 11 aa, Borrelia garinii PBi
KTKLNIIKLNI

SEQ ID NO: 45658 - protein, 11 aa, Borrelia garinii PBi
TKLNIIKLNIL

SEQ ID NO: 45659 - protein, 11 aa, Borrelia garinii PBi
KLNIIKLNILT

SEQ ID NO: 45660 - protein, 11 aa, Borrelia garinii PBi
LNIIKLNILTT

SEQ ID NO: 45661 - protein, 11 aa, Borrelia garinii PBi
NIIKLNILTTT

SEQ ID NO: 45662 - protein, 11 aa, Borrelia garinii PBi
IIKLNILTTTL

SEQ ID NO: 45663 - protein, 11 aa, Borrelia garinii PBi
IKLNILTTTLT

SEQ ID NO: 45664 - protein, 11 aa, Borrelia garinii PBi
KLNILTTTLTL

SEQ ID NO: 45665 - protein, 11 aa, Borrelia garinii PBi
LNILTTTLTLI

SEQ ID NO: 45666 - protein, 11 aa, Borrelia garinii PBi
NILTTTLTLIC

SEQ ID NO: 45667 - protein, 11 aa, Borrelia garinii PBi
ILTTTLTLICI

SEQ ID NO: 45668 - protein, 11 aa, Borrelia garinii PBi
LTTTLTLICIS

SEQ ID NO: 45669 - protein, 11 aa, Borrelia garinii PBi
TTTLTLICISC

SEQ ID NO: 45670 - protein, 11 aa, Borrelia garinii PBi
TTLTLICISCA

SEQ ID NO: 45671 - protein, 11 aa, Borrelia garinii PBi
TLTLICISCAV

SEQ ID NO: 45672 - protein, 11 aa, Borrelia garinii PBi
LTLICISCAVN

SEQ ID NO: 45673 - protein, 11 aa, Borrelia garinii PBi
TLICISCAVNK

SEQ ID NO: 45674 - protein, 11 aa, Borrelia garinii PBi
LICISCAVNKI

SEQ ID NO: 45675 - protein, 11 aa, Borrelia garinii PBi
ICISCAVNKID

SEQ ID NO: 45676 - protein, 11 aa, Borrelia garinii PBi
CISCAVNKIDP

SEQ ID NO: 45677 - protein, 11 aa, Borrelia garinii PBi
ISCAVNKIDPE

SEQ ID NO: 45678 - protein, 11 aa, Borrelia garinii PBi
SCAVNKIDPEP

SEQ ID NO: 45679 - protein, 11 aa, Borrelia garinii PBi
CAVNKIDPEPK

SEQ ID NO: 45680 - protein, 11 aa, Borrelia garinii PBi
AVNKIDPEPKS

SEQ ID NO: 45681 - protein, 11 aa, Borrelia garinii PBi
VNKIDPEPKSK

SEQ ID NO: 45682 - protein, 11 aa, Borrelia garinii PBi
NKIDPEPKSKT

SEQ ID NO: 45683 - protein, 11 aa, Borrelia garinii PBi
KIDPEPKSKTN

SEQ ID NO: 45684 - protein, 11 aa, Borrelia garinii PBi
IDPEPKSKTNK

SEQ ID NO: 45685 - protein, 11 aa, Borrelia garinii PBi
DPEPKSKTNKK

SEQ ID NO: 45686 - protein, 11 aa, Borrelia garinii PBi
PEPKSKTNKKE

SEQ ID NO: 45687 - protein, 11 aa, Borrelia garinii PBi
EPKSKTNKKEN

SEQ ID NO: 45688 - protein, 11 aa, Borrelia garinii PBi
PKSKTNKKENI

SEQ ID NO: 45689 - protein, 11 aa, Borrelia garinii PBi
KSKTNKKENIK

SEQ ID NO: 45690 - protein, 11 aa, Borrelia garinii PBi
SKTNKKENIKN

SEQ ID NO: 45691 - protein, 11 aa, Borrelia garinii PBi
KTNKKENIKNF

SEQ ID NO: 45692 - protein, 11 aa, Borrelia garinii PBi
TNKKENIKNFV

SEQ ID NO: 45693 - protein, 11 aa, Borrelia garinii PBi
NKKENIKNFVN

SEQ ID NO: 45694 - protein, 11 aa, Borrelia garinii PBi
KKENIKNFVNK

SEQ ID NO: 45695 - protein, 11 aa, Borrelia garinii PBi
KENIKNFVNKF

SEQ ID NO: 45696 - protein, 11 aa, Borrelia garinii PBi
ENIKNFVNKFQ

SEQ ID NO: 45697 - protein, 11 aa, Borrelia garinii PBi
NIKNFVNKFQD

SEQ ID NO: 45698 - protein, 11 aa, Borrelia garinii PBi
IKNFVNKFQDL

SEQ ID NO: 45699 - protein, 11 aa, Borrelia garinii PBi
KNFVNKFQDLE

SEQ ID NO: 45700 - protein, 11 aa, Borrelia garinii PBi
NFVNKFQDLEP

SEQ ID NO: 45701 - protein, 11 aa, Borrelia garinii PBi
FVNKFQDLEPS

SEQ ID NO: 45702 - protein, 11 aa, Borrelia garinii PBi
VNKFQDLEPSK

SEQ ID NO: 45703 - protein, 11 aa, Borrelia garinii PBi
NKFQDLEPSKK

SEQ ID NO: 45704 - protein, 11 aa, Borrelia garinii PBi
KFQDLEPSKKQ

SEQ ID NO: 45705 - protein, 11 aa, Borrelia garinii PBi
FQDLEPSKKQN

SEQ ID NO: 45706 - protein, 11 aa, Borrelia garinii PBi
QDLEPSKKQNK

SEQ ID NO: 45707 - protein, 11 aa, Borrelia garinii PBi
DLEPSKKQNKD

SEQ ID NO: 45708 - protein, 11 aa, Borrelia garinii PBi
LEPSKKQNKDL

SEQ ID NO: 45709 - protein, 11 aa, Borrelia garinii PBi
EPSKKQNKDLE

SEQ ID NO: 45710 - protein, 11 aa, Borrelia garinii PBi
PSKKQNKDLEP

SEQ ID NO: 45711 - protein, 11 aa, Borrelia garinii PBi
SKKQNKDLEPL

SEQ ID NO: 45712 - protein, 11 aa, Borrelia garinii PBi
KKQNKDLEPLR

SEQ ID NO: 45713 - protein, 11 aa, Borrelia garinii PBi
KQNKDLEPLRE

SEQ ID NO: 45714 - protein, 11 aa, Borrelia garinii PBi
QNKDLEPLREK

SEQ ID NO: 45715 - protein, 11 aa, Borrelia garinii PBi
NKDLEPLREKY

SEQ ID NO: 45716 - protein, 11 aa, Borrelia garinii PBi
KDLEPLREKYP

SEQ ID NO: 45717 - protein, 11 aa, Borrelia garinii PBi
DLEPLREKYPE

SEQ ID NO: 45718 - protein, 11 aa, Borrelia garinii PBi
LEPLREKYPEA

SEQ ID NO: 45719 - protein, 11 aa, Borrelia garinii PBi
EPLREKYPEAT

SEQ ID NO: 45720 - protein, 11 aa, Borrelia garinii PBi
PLREKYPEATA

SEQ ID NO: 45721 - protein, 11 aa, Borrelia garinii PBi
LREKYPEATAS

SEQ ID NO: 45722 - protein, 11 aa, Borrelia garinii PBi
REKYPEATASK

SEQ ID NO: 45723 - protein, 11 aa, Borrelia garinii PBi
EKYPEATASKL

SEQ ID NO: 45724 - protein, 11 aa, Borrelia garinii PBi
KYPEATASKLE

SEQ ID NO: 45725 - protein, 11 aa, Borrelia garinii PBi
YPEATASKLET

SEQ ID NO: 45726 - protein, 11 aa, Borrelia garinii PBi
PEATASKLETT

SEQ ID NO: 45727 - protein, 11 aa, Borrelia garinii PBi
EATASKLETTL

SEQ ID NO: 45728 - protein, 11 aa, Borrelia garinii PBi
ATASKLETTLK

SEQ ID NO: 45729 - protein, 11 aa, Borrelia garinii PBi
TASKLETTLKI

SEQ ID NO: 45730 - protein, 11 aa, Borrelia garinii PBi
ASKLETTLKIL

SEQ ID NO: 45731 - protein, 11 aa, Borrelia garinii PBi
SKLETTLKILE

SEQ ID NO: 45732 - protein, 11 aa, Borrelia garinii PBi
KLETTLKILEA

SEQ ID NO: 45733 - protein, 11 aa, Borrelia garinii PBi
LETTLKILEAQ

SEQ ID NO: 45734 - protein, 11 aa, Borrelia garinii PBi
ETTLKILEAQK

SEQ ID NO: 45735 - protein, 11 aa, Borrelia garinii PBi
TTLKILEAQKE

SEQ ID NO: 45736 - protein, 11 aa, Borrelia garinii PBi
TLKILEAQKEK

SEQ ID NO: 45737 - protein, 11 aa, Borrelia garinii PBi
LKILEAQKEKE

SEQ ID NO: 45738 - protein, 11 aa, Borrelia garinii PBi
KILEAQKEKEN

SEQ ID NO: 45739 - protein, 11 aa, Borrelia garinii PBi
ILEAQKEKENI

SEQ ID NO: 45740 - protein, 11 aa, Borrelia garinii PBi
LEAQKEKENIE

SEQ ID NO: 45741 - protein, 11 aa, Borrelia garinii PBi
EAQKEKENIEI

SEQ ID NO: 45742 - protein, 11 aa, Borrelia garinii PBi
AQKEKENIEIA

SEQ ID NO: 45743 - protein, 11 aa, Borrelia garinii PBi
QKEKENIEIAK

SEQ ID NO: 45744 - protein, 11 aa, Borrelia garinii PBi
KEKENIEIAKI

SEQ ID NO: 45745 - protein, 11 aa, Borrelia garinii PBi
EKENIEIAKID

SEQ ID NO: 45746 - protein, 11 aa, Borrelia garinii PBi
KENIEIAKIDN

SEQ ID NO: 45747 - protein, 11 aa, Borrelia garinii PBi
ENIEIAKIDNT

SEQ ID NO: 45748 - protein, 11 aa, Borrelia garinii PBi
NIEIAKIDNTQ

SEQ ID NO: 45749 - protein, 11 aa, Borrelia garinii PBi
IEIAKIDNTQI

SEQ ID NO: 45750 - protein, 11 aa, Borrelia garinii PBi
EIAKIDNTQID

SEQ ID NO: 45751 - protein, 11 aa, Borrelia garinii PBi
IAKIDNTQIDF

SEQ ID NO: 45752 - protein, 11 aa, Borrelia garinii PBi
AKIDNTQIDFL

SEQ ID NO: 45753 - protein, 11 aa, Borrelia garinii PBi
KIDNTQIDFLK

SEQ ID NO: 45754 - protein, 11 aa, Borrelia garinii PBi
IDNTQIDFLKT

SEQ ID NO: 45755 - protein, 11 aa, Borrelia garinii PBi
DNTQIDFLKTF

SEQ ID NO: 45756 - protein, 11 aa, Borrelia garinii PBi
NTQIDFLKTFK

SEQ ID NO: 45757 - protein, 11 aa, Borrelia garinii PBi
TQIDFLKTFKT

SEQ ID NO: 45758 - protein, 11 aa, Borrelia garinii PBi
QIDFLKTFKTD

SEQ ID NO: 45759 - protein, 11 aa, Borrelia garinii PBi
IDFLKTFKTDP

SEQ ID NO: 45760 - protein, 11 aa, Borrelia garinii PBi
DFLKTFKTDPH

SEQ ID NO: 45761 - protein, 11 aa, Borrelia garinii PBi
FLKTFKTDPHD

SEQ ID NO: 45762 - protein, 11 aa, Borrelia garinii PBi
LKTFKTDPHDS

SEQ ID NO: 45763 - protein, 11 aa, Borrelia garinii PBi
KTFKTDPHDSL

SEQ ID NO: 45764 - protein, 11 aa, Borrelia garinii PBi
TFKTDPHDSLP

SEQ ID NO: 45765 - protein, 11 aa, Borrelia garinii PBi
FKTDPHDSLPE

SEQ ID NO: 45766 - protein, 11 aa, Borrelia garinii PBi
KTDPHDSLPED

SEQ ID NO: 45767 - protein, 11 aa, Borrelia garinii PBi
TDPHDSLPEDE

SEQ ID NO: 45768 - protein, 11 aa, Borrelia garinii PBi
DPHDSLPEDEK

SEQ ID NO: 45769 - protein, 11 aa, Borrelia garinii PBi
PHDSLPEDEKM

SEQ ID NO: 45770 - protein, 11 aa, Borrelia garinii PBi
HDSLPEDEKMQ

SEQ ID NO: 45771 - protein, 11 aa, Borrelia garinii PBi
DSLPEDEKMQM

SEQ ID NO: 45772 - protein, 11 aa, Borrelia garinii PBi
SLPEDEKMQMK

SEQ ID NO: 45773 - protein, 11 aa, Borrelia garinii PBi
LPEDEKMQMKK

SEQ ID NO: 45774 - protein, 11 aa, Borrelia garinii PBi
PEDEKMQMKKI

SEQ ID NO: 45775 - protein, 11 aa, Borrelia garinii PBi
EDEKMQMKKII

SEQ ID NO: 45776 - protein, 11 aa, Borrelia garinii PBi
DEKMQMKKIIY

SEQ ID NO: 45777 - protein, 11 aa, Borrelia garinii PBi
EKMQMKKIIYS

SEQ ID NO: 45778 - protein, 11 aa, Borrelia garinii PBi
KMQMKKIIYSS

SEQ ID NO: 45779 - protein, 11 aa, Borrelia garinii PBi
MQMKKIIYSSL

SEQ ID NO: 45780 - protein, 11 aa, Borrelia garinii PBi
QMKKIIYSSLN

SEQ ID NO: 45781 - protein, 11 aa, Borrelia garinii PBi
MKKIIYSSLNY

SEQ ID NO: 45782 - protein, 11 aa, Borrelia garinii PBi
KKIIYSSLNYE

SEQ ID NO: 45783 - protein, 11 aa, Borrelia garinii PBi
KIIYSSLNYET

SEQ ID NO: 45784 - protein, 11 aa, Borrelia garinii PBi
IIYSSLNYETE

SEQ ID NO: 45785 - protein, 11 aa, Borrelia garinii PBi
IYSSLNYETEK

SEQ ID NO: 45786 - protein, 11 aa, Borrelia garinii PBi
YSSLNYETEKI

SEQ ID NO: 45787 - protein, 11 aa, Borrelia garinii PBi
SSLNYETEKIK

SEQ ID NO: 45788 - protein, 11 aa, Borrelia garinii PBi
SLNYETEKIKI

SEQ ID NO: 45789 - protein, 11 aa, Borrelia garinii PBi
LNYETEKIKIL

SEQ ID NO: 45790 - protein, 11 aa, Borrelia garinii PBi
NYETEKIKILQ

SEQ ID NO: 45791 - protein, 11 aa, Borrelia garinii PBi
YETEKIKILQE

SEQ ID NO: 45792 - protein, 11 aa, Borrelia garinii PBi
ETEKIKILQEI

SEQ ID NO: 45793 - protein, 11 aa, Borrelia garinii PBi
TEKIKILQEIL

SEQ ID NO: 45794 - protein, 11 aa, Borrelia garinii PBi
EKIKILQEILE

SEQ ID NO: 45795 - protein, 11 aa, Borrelia garinii PBi
KIKILQEILEK

SEQ ID NO: 45796 - protein, 11 aa, Borrelia garinii PBi
IKILQEILEKL

SEQ ID NO: 45797 - protein, 11 aa, Borrelia garinii PBi
KILQEILEKLD

SEQ ID NO: 45798 - protein, 11 aa, Borrelia garinii PBi
ILQEILEKLDK

SEQ ID NO: 45799 - protein, 11 aa, Borrelia garinii PBi
LQEILEKLDKN

SEQ ID NO: 45800 - protein, 11 aa, Borrelia garinii PBi
QEILEKLDKNL

SEQ ID NO: 45801 - protein, 11 aa, Borrelia garinii PBi
EILEKLDKNLQ

SEQ ID NO: 45802 - protein, 11 aa, Borrelia garinii PBi
ILEKLDKNLQH

SEQ ID NO: 45803 - protein, 11 aa, Borrelia garinii PBi
LEKLDKNLQHK

SEQ ID NO: 45804 - protein, 11 aa, Borrelia garinii PBi
EKLDKNLQHKK

SEQ ID NO: 45805 - protein, 11 aa, Borrelia garinii PBi
KLDKNLQHKKI

SEQ ID NO: 45806 - protein, 11 aa, Borrelia garinii PBi
LDKNLQHKKIA

SEQ ID NO: 45807 - protein, 11 aa, Borrelia garinii PBi
DKNLQHKKIAK

SEQ ID NO: 45808 - protein, 11 aa, Borrelia garinii PBi
KNLQHKKIAKN

SEQ ID NO: 45809 - protein, 11 aa, Borrelia garinii PBi
NLQHKKIAKNF

SEQ ID NO: 45810 - protein, 11 aa, Borrelia garinii PBi
LQHKKIAKNFI

SEQ ID NO: 45811 - protein, 11 aa, Borrelia garinii PBi
QHKKIAKNFIY

SEQ ID NO: 45812 - protein, 11 aa, Borrelia garinii PBi
HKKIAKNFIYD

SEQ ID NO: 45813 - protein, 11 aa, Borrelia garinii PBi
KKIAKNFIYDI

SEQ ID NO: 45814 - protein, 11 aa, Borrelia garinii PBi
KIAKNFIYDIP

SEQ ID NO: 45815 - protein, 11 aa, Borrelia garinii PBi
IAKNFIYDIPI

SEQ ID NO: 45816 - protein, 11 aa, Borrelia garinii PBi
AKNFIYDIPII

SEQ ID NO: 45817 - protein, 11 aa, Borrelia garinii PBi
KNFIYDIPIII

SEQ ID NO: 45818 - protein, 11 aa, Borrelia garinii PBi
NFIYDIPIIIQ

SEQ ID NO: 45819 - protein, 11 aa, Borrelia garinii PBi
FIYDIPIIIQS

SEQ ID NO: 45820 - protein, 11 aa, Borrelia garinii PBi
IYDIPIIIQSR

SEQ ID NO: 45821 - protein, 11 aa, Borrelia garinii PBi
YDIPIIIQSRL

SEQ ID NO: 45822 - protein, 11 aa, Borrelia garinii PBi
DIPIIIQSRLD

SEQ ID NO: 45823 - protein, 11 aa, Borrelia garinii PBi
IPIIIQSRLDI

SEQ ID NO: 45824 - protein, 11 aa, Borrelia garinii PBi
PIIIQSRLDII

SEQ ID NO: 45825 - protein, 11 aa, Borrelia garinii PBi
IIIQSRLDIIS

SEQ ID NO: 45826 - protein, 11 aa, Borrelia garinii PBi
IIQSRLDIISK

SEQ ID NO: 45827 - protein, 11 aa, Borrelia garinii PBi
IQSRLDIISKV

SEQ ID NO: 45828 - protein, 11 aa, Borrelia garinii PBi
QSRLDIISKVI

SEQ ID NO: 45829 - protein, 11 aa, Borrelia garinii PBi
SRLDIISKVIK

SEQ ID NO: 45830 - protein, 11 aa, Borrelia garinii PBi
RLDIISKVIKN

SEQ ID NO: 45831 - protein, 11 aa, Borrelia garinii PBi
LDIISKVIKNP

SEQ ID NO: 45832 - protein, 11 aa, Borrelia garinii PBi
DIISKVIKNPI

SEQ ID NO: 45833 - protein, 11 aa, Borrelia garinii PBi
IISKVIKNPIK

SEQ ID NO: 45834 - protein, 11 aa, Borrelia garinii PBi
ISKVIKNPIKD

SEQ ID NO: 45835 - protein, 11 aa, Borrelia garinii PBi
SKVIKNPIKDE

SEQ ID NO: 45836 - protein, 11 aa, Borrelia garinii PBi
KVIKNPIKDEL

SEQ ID NO: 45837 - protein, 11 aa, Borrelia garinii PBi
VIKNPIKDELQ

SEQ ID NO: 45838 - protein, 11 aa, Borrelia garinii PBi
IKNPIKDELQI

SEQ ID NO: 45839 - protein, 11 aa, Borrelia garinii PBi
KNPIKDELQIL

SEQ ID NO: 45840 - protein, 11 aa, Borrelia garinii PBi
NPIKDELQILN

SEQ ID NO: 45841 - protein, 11 aa, Borrelia garinii PBi
PIKDELQILNQ

SEQ ID NO: 45842 - protein, 11 aa, Borrelia garinii PBi
IKDELQILNQK

SEQ ID NO: 45843 - protein, 11 aa, Borrelia garinii PBi
KDELQILNQKE

SEQ ID NO: 45844 - protein, 11 aa, Borrelia garinii PBi
DELQILNQKEI

SEQ ID NO: 45845 - protein, 11 aa, Borrelia garinii PBi
ELQILNQKEIE

SEQ ID NO: 45846 - protein, 11 aa, Borrelia garinii PBi
LQILNQKEIEE

SEQ ID NO: 45847 - protein, 11 aa, Borrelia garinii PBi
QILNQKEIEEL

SEQ ID NO: 45848 - protein, 11 aa, Borrelia garinii PBi
ILNQKEIEELL

SEQ ID NO: 45849 - protein, 11 aa, Borrelia garinii PBi
LNQKEIEELLM

SEQ ID NO: 45850 - protein, 11 aa, Borrelia garinii PBi
NQKEIEELLMR

SEQ ID NO: 45851 - protein, 11 aa, Borrelia garinii PBi
QKEIEELLMRI

SEQ ID NO: 45852 - protein, 11 aa, Borrelia garinii PBi
KEIEELLMRIE

SEQ ID NO: 45853 - protein, 11 aa, Borrelia garinii PBi
EIEELLMRIES

SEQ ID NO: 45854 - protein, 11 aa, Borrelia garinii PBi
IEELLMRIESE

SEQ ID NO: 45855 - protein, 11 aa, Borrelia garinii PBi
EELLMRIESEL

SEQ ID NO: 45856 - protein, 11 aa, Borrelia garinii PBi
ELLMRIESELK

SEQ ID NO: 45857 - protein, 11 aa, Borrelia garinii PBi
LLMRIESELKI

SEQ ID NO: 45858 - protein, 11 aa, Borrelia garinii PBi
LMRIESELKIK

SEQ ID NO: 45859 - protein, 11 aa, Borrelia garinii PBi
MRIESELKIKE

SEQ ID NO: 45860 - protein, 11 aa, Borrelia garinii PBi
RIESELKIKEN

SEQ ID NO: 45861 - protein, 11 aa, Borrelia garinii PBi
IESELKIKENF

SEQ ID NO: 45862 - protein, 11 aa, Borrelia garinii PBi
ESELKIKENFK

SEQ ID NO: 45863 - protein, 11 aa, Borrelia garinii PBi
SELKIKENFKK

SEQ ID NO: 45864 - protein, 11 aa, Borrelia garinii PBi
ELKIKENFKKA

SEQ ID NO: 45865 - protein, 11 aa, Borrelia garinii PBi
LKIKENFKKAL

SEQ ID NO: 45866 - protein, 11 aa, Borrelia garinii PBi
KIKENFKKALN

SEQ ID NO: 45867 - protein, 11 aa, Borrelia garinii PBi
IKENFKKALNK

SEQ ID NO: 45868 - protein, 11 aa, Borrelia garinii PBi
KENFKKALNKT

SEQ ID NO: 45869 - protein, 11 aa, Borrelia garinii PBi
ENFKKALNKTI

SEQ ID NO: 45870 - protein, 11 aa, Borrelia garinii PBi
NFKKALNKTID

SEQ ID NO: 45871 - protein, 11 aa, Borrelia garinii PBi
FKKALNKTIDA

SEQ ID NO: 45872 - protein, 11 aa, Borrelia garinii PBi
KKALNKTIDAY

SEQ ID NO: 45873 - protein, 11 aa, Borrelia garinii PBi
KALNKTIDAYN

SEQ ID NO: 45874 - protein, 11 aa, Borrelia garinii PBi
ALNKTIDAYNQ

SEQ ID NO: 45875 - protein, 11 aa, Borrelia garinii PBi
LNKTIDAYNQD

SEQ ID NO: 45876 - protein, 11 aa, Borrelia garinii PBi
NKTIDAYNQDS

SEQ ID NO: 45877 - protein, 11 aa, Borrelia garinii PBi
KTIDAYNQDSE

SEQ ID NO: 45878 - protein, 11 aa, Borrelia garinii PBi
TIDAYNQDSEN

SEQ ID NO: 45879 - protein, 11 aa, Borrelia garinii PBi
IDAYNQDSENI

SEQ ID NO: 45880 - protein, 11 aa, Borrelia garinii PBi
DAYNQDSENIK

SEQ ID NO: 45881 - protein, 11 aa, Borrelia garinii PBi
AYNQDSENIKT

SEQ ID NO: 45882 - protein, 11 aa, Borrelia garinii PBi
YNQDSENIKTS

SEQ ID NO: 45883 - protein, 11 aa, Borrelia garinii PBi
NQDSENIKTSA

SEQ ID NO: 45884 - protein, 11 aa, Borrelia garinii PBi
QDSENIKTSAE

SEQ ID NO: 45885 - protein, 11 aa, Borrelia garinii PBi
DSENIKTSAEQ

SEQ ID NO: 45886 - protein, 11 aa, Borrelia garinii PBi
SENIKTSAEQL

SEQ ID NO: 45887 - protein, 11 aa, Borrelia garinii PBi
ENIKTSAEQLE

SEQ ID NO: 45888 - protein, 11 aa, Borrelia garinii PBi
NIKTSAEQLEK

SEQ ID NO: 45889 - protein, 11 aa, Borrelia garinii PBi
IKTSAEQLEKH

SEQ ID NO: 45890 - protein, 11 aa, Borrelia garinii PBi
KTSAEQLEKHI

SEQ ID NO: 45891 - protein, 11 aa, Borrelia garinii PBi
TSAEQLEKHIN

SEQ ID NO: 45892 - protein, 11 aa, Borrelia garinii PBi
SAEQLEKHINE

SEQ ID NO: 45893 - protein, 11 aa, Borrelia garinii PBi
AEQLEKHINEN

SEQ ID NO: 45894 - protein, 11 aa, Borrelia garinii PBi
EQLEKHINENY

SEQ ID NO: 45895 - protein, 11 aa, Borrelia garinii PBi
QLEKHINENYK

SEQ ID NO: 45896 - protein, 11 aa, Borrelia garinii PBi
LEKHINENYKE

SEQ ID NO: 45897 - protein, 11 aa, Borrelia garinii PBi
EKHINENYKEF

SEQ ID NO: 45898 - protein, 11 aa, Borrelia garinii PBi
KHINENYKEFN

SEQ ID NO: 45899 - protein, 11 aa, Borrelia garinii PBi
HINENYKEFNS

SEQ ID NO: 45900 - protein, 11 aa, Borrelia garinii PBi
INENYKEFNSL

SEQ ID NO: 45901 - protein, 11 aa, Borrelia garinii PBi
NENYKEFNSLK

SEQ ID NO: 45902 - protein, 11 aa, Borrelia garinii PBi
ENYKEFNSLKP

SEQ ID NO: 45903 - protein, 11 aa, Borrelia garinii PBi
NYKEFNSLKPI

SEQ ID NO: 45904 - protein, 11 aa, Borrelia garinii PBi
YKEFNSLKPIY

SEQ ID NO: 45905 - protein, 8 aa, Borrelia burgdorferi B31
MRILVGVC

SEQ ID NO: 45906 - protein, 8 aa, Borrelia burgdorferi B31
RILVGVCI

SEQ ID NO: 45907 - protein, 8 aa, Borrelia burgdorferi B31
ILVGVCII

SEQ ID NO: 45908 - protein, 8 aa, Borrelia burgdorferi B31
LVGVCIIA

SEQ ID NO: 45909 - protein, 8 aa, Borrelia burgdorferi B31
VGVCIIAL

SEQ ID NO: 45910 - protein, 8 aa, Borrelia burgdorferi B31
GVCIIALA

SEQ ID NO: 45911 - protein, 8 aa, Borrelia burgdorferi B31
VCIIALAL

SEQ ID NO: 45912 - protein, 8 aa, Borrelia burgdorferi B31
CIIALALL

SEQ ID NO: 45913 - protein, 8 aa, Borrelia burgdorferi B31
IIALALLG

SEQ ID NO: 45914 - protein, 8 aa, Borrelia burgdorferi B31
IALALLGC

SEQ ID NO: 45915 - protein, 8 aa, Borrelia burgdorferi B31
ALALLGCY

SEQ ID NO: 45916 - protein, 8 aa, Borrelia burgdorferi B31
LALLGCYL

SEQ ID NO: 45917 - protein, 8 aa, Borrelia burgdorferi B31
ALLGCYLP

SEQ ID NO: 45918 - protein, 8 aa, Borrelia burgdorferi B31
LLGCYLPD

SEQ ID NO: 45919 - protein, 8 aa, Borrelia burgdorferi B31
LGCYLPDN

SEQ ID NO: 45920 - protein, 8 aa, Borrelia burgdorferi B31
GCYLPDNQ

SEQ ID NO: 45921 - protein, 8 aa, Borrelia burgdorferi B31
CYLPDNQE

SEQ ID NO: 45922 - protein, 8 aa, Borrelia burgdorferi B31
YLPDNQEQ

SEQ ID NO: 45923 - protein, 8 aa, Borrelia burgdorferi B31
LPDNQEQA

SEQ ID NO: 45924 - protein, 8 aa, Borrelia burgdorferi B31
PDNQEQAV

SEQ ID NO: 45925 - protein, 8 aa, Borrelia burgdorferi B31
DNQEQAVQ

SEQ ID NO: 45926 - protein, 8 aa, Borrelia burgdorferi B31
NQEQAVQT

SEQ ID NO: 45927 - protein, 8 aa, Borrelia burgdorferi B31
QEQAVQTF

SEQ ID NO: 45928 - protein, 8 aa, Borrelia burgdorferi B31
EQAVQTFF

SEQ ID NO: 45929 - protein, 8 aa, Borrelia burgdorferi B31
QAVQTFFE

SEQ ID NO: 45930 - protein, 8 aa, Borrelia burgdorferi B31
AVQTFFEN

SEQ ID NO: 45931 - protein, 8 aa, Borrelia burgdorferi B31
VQTFFENS

SEQ ID NO: 45932 - protein, 8 aa, Borrelia burgdorferi B31
QTFFENSE

SEQ ID NO: 45933 - protein, 8 aa, Borrelia burgdorferi B31
TFFENSES

SEQ ID NO: 45934 - protein, 8 aa, Borrelia burgdorferi B31
FFENSESS

SEQ ID NO: 45935 - protein, 8 aa, Borrelia burgdorferi B31
FENSESSD

SEQ ID NO: 45936 - protein, 8 aa, Borrelia burgdorferi B31
ENSESSDM

SEQ ID NO: 45937 - protein, 8 aa, Borrelia burgdorferi B31
NSESSDMG

SEQ ID NO: 45938 - protein, 8 aa, Borrelia burgdorferi B31
SESSDMGS

SEQ ID NO: 45939 - protein, 8 aa, Borrelia burgdorferi B31
ESSDMGSD

SEQ ID NO: 45940 - protein, 8 aa, Borrelia burgdorferi B31
SSDMGSDE

SEQ ID NO: 45941 - protein, 8 aa, Borrelia burgdorferi B31
SDMGSDEI

SEQ ID NO: 45942 - protein, 8 aa, Borrelia burgdorferi B31
DMGSDEIV

SEQ ID NO: 45943 - protein, 8 aa, Borrelia burgdorferi B31
MGSDEIVT

SEQ ID NO: 45944 - protein, 8 aa, Borrelia burgdorferi B31
GSDEIVTE

SEQ ID NO: 45945 - protein, 8 aa, Borrelia burgdorferi B31
SDEIVTEG

SEQ ID NO: 45946 - protein, 8 aa, Borrelia burgdorferi B31
DEIVTEGI

SEQ ID NO: 45947 - protein, 8 aa, Borrelia burgdorferi B31
EIVTEGIF

SEQ ID NO: 45948 - protein, 8 aa, Borrelia burgdorferi B31
IVTEGIFS

SEQ ID NO: 45949 - protein, 8 aa, Borrelia burgdorferi B31
VTEGIFSS

SEQ ID NO: 45950 - protein, 8 aa, Borrelia burgdorferi B31
TEGIFSSL

SEQ ID NO: 45951 - protein, 8 aa, Borrelia burgdorferi B31
EGIFSSLK

SEQ ID NO: 45952 - protein, 8 aa, Borrelia burgdorferi B31
GIFSSLKL

SEQ ID NO: 45953 - protein, 8 aa, Borrelia burgdorferi B31
IFSSLKLY

SEQ ID NO: 45954 - protein, 8 aa, Borrelia burgdorferi B31
FSSLKLYA

SEQ ID NO: 45955 - protein, 8 aa, Borrelia burgdorferi B31
SSLKLYAS

SEQ ID NO: 45956 - protein, 8 aa, Borrelia burgdorferi B31
SLKLYASE

SEQ ID NO: 45957 - protein, 8 aa, Borrelia burgdorferi B31
LKLYASEH

SEQ ID NO: 45958 - protein, 8 aa, Borrelia burgdorferi B31
KLYASEHR

SEQ ID NO: 45959 - protein, 8 aa, Borrelia burgdorferi B31
LYASEHRL

SEQ ID NO: 45960 - protein, 8 aa, Borrelia burgdorferi B31
YASEHRLL

SEQ ID NO: 45961 - protein, 8 aa, Borrelia burgdorferi B31
ASEHRLLV

SEQ ID NO: 45962 - protein, 8 aa, Borrelia burgdorferi B31
SEHRLLVE

SEQ ID NO: 45963 - protein, 8 aa, Borrelia burgdorferi B31
EHRLLVEI

SEQ ID NO: 45964 - protein, 8 aa, Borrelia burgdorferi B31
HRLLVEIK

SEQ ID NO: 45965 - protein, 8 aa, Borrelia burgdorferi B31
RLLVEIKK

SEQ ID NO: 45966 - protein, 8 aa, Borrelia burgdorferi B31
LLVEIKKT

SEQ ID NO: 45967 - protein, 8 aa, Borrelia burgdorferi B31
LVEIKKTL

SEQ ID NO: 45968 - protein, 8 aa, Borrelia burgdorferi B31
VEIKKTLI

SEQ ID NO: 45969 - protein, 8 aa, Borrelia burgdorferi B31
EIKKTLIS

SEQ ID NO: 45970 - protein, 8 aa, Borrelia burgdorferi B31
IKKTLISL

SEQ ID NO: 45971 - protein, 8 aa, Borrelia burgdorferi B31
KKTLISLK

SEQ ID NO: 45972 - protein, 8 aa, Borrelia burgdorferi B31
KTLISLKD

SEQ ID NO: 45973 - protein, 8 aa, Borrelia burgdorferi B31
TLISLKDP

SEQ ID NO: 45974 - protein, 8 aa, Borrelia burgdorferi B31
LISLKDPN

SEQ ID NO: 45975 - protein, 8 aa, Borrelia burgdorferi B31
ISLKDPNY

SEQ ID NO: 45976 - protein, 8 aa, Borrelia burgdorferi B31
SLKDPNYR

SEQ ID NO: 45977 - protein, 8 aa, Borrelia burgdorferi B31
LKDPNYRG

SEQ ID NO: 45978 - protein, 8 aa, Borrelia burgdorferi B31
KDPNYRGV

SEQ ID NO: 45979 - protein, 8 aa, Borrelia burgdorferi B31
DPNYRGVV

SEQ ID NO: 45980 - protein, 8 aa, Borrelia burgdorferi B31
PNYRGVVL

SEQ ID NO: 45981 - protein, 8 aa, Borrelia burgdorferi B31
NYRGVVLP

SEQ ID NO: 45982 - protein, 8 aa, Borrelia burgdorferi B31
YRGVVLPV

SEQ ID NO: 45983 - protein, 8 aa, Borrelia burgdorferi B31
RGVVLPVS

SEQ ID NO: 45984 - protein, 8 aa, Borrelia burgdorferi B31
GVVLPVSD

SEQ ID NO: 45985 - protein, 8 aa, Borrelia burgdorferi B31
VVLPVSDY

SEQ ID NO: 45986 - protein, 8 aa, Borrelia burgdorferi B31
VLPVSDYN

SEQ ID NO: 45987 - protein, 8 aa, Borrelia burgdorferi B31
LPVSDYNE

SEQ ID NO: 45988 - protein, 8 aa, Borrelia burgdorferi B31
PVSDYNEE

SEQ ID NO: 45989 - protein, 8 aa, Borrelia burgdorferi B31
VSDYNEEY

SEQ ID NO: 45990 - protein, 8 aa, Borrelia burgdorferi B31
SDYNEEYF

SEQ ID NO: 45991 - protein, 8 aa, Borrelia burgdorferi B31
DYNEEYFN

SEQ ID NO: 45992 - protein, 8 aa, Borrelia burgdorferi B31
YNEEYFNK

SEQ ID NO: 45993 - protein, 8 aa, Borrelia burgdorferi B31
NEEYFNKF

SEQ ID NO: 45994 - protein, 8 aa, Borrelia burgdorferi B31
EEYFNKFF

SEQ ID NO: 45995 - protein, 8 aa, Borrelia burgdorferi B31
EYFNKFFL

SEQ ID NO: 45996 - protein, 8 aa, Borrelia burgdorferi B31
YFNKFFLD

SEQ ID NO: 45997 - protein, 8 aa, Borrelia burgdorferi B31
FNKFFLDL

SEQ ID NO: 45998 - protein, 8 aa, Borrelia burgdorferi B31
NKFFLDLG

SEQ ID NO: 45999 - protein, 8 aa, Borrelia burgdorferi B31
KFFLDLGS

SEQ ID NO: 46000 - protein, 8 aa, Borrelia burgdorferi B31
FFLDLGSE

SEQ ID NO: 46001 - protein, 8 aa, Borrelia burgdorferi B31
FLDLGSEQ

SEQ ID NO: 46002 - protein, 8 aa, Borrelia burgdorferi B31
LDLGSEQS

SEQ ID NO: 46003 - protein, 8 aa, Borrelia burgdorferi B31
DLGSEQSK

SEQ ID NO: 46004 - protein, 8 aa, Borrelia burgdorferi B31
LGSEQSKD

SEQ ID NO: 46005 - protein, 8 aa, Borrelia burgdorferi B31
GSEQSKDL

SEQ ID NO: 46006 - protein, 8 aa, Borrelia burgdorferi B31
SEQSKDLI

SEQ ID NO: 46007 - protein, 8 aa, Borrelia burgdorferi B31
EQSKDLIK

SEQ ID NO: 46008 - protein, 8 aa, Borrelia burgdorferi B31
QSKDLIKL

SEQ ID NO: 46009 - protein, 8 aa, Borrelia burgdorferi B31
SKDLIKLF

SEQ ID NO: 46010 - protein, 8 aa, Borrelia burgdorferi B31
KDLIKLFI

SEQ ID NO: 46011 - protein, 8 aa, Borrelia burgdorferi B31
DLIKLFIM

SEQ ID NO: 46012 - protein, 8 aa, Borrelia burgdorferi B31
LIKLFIMV

SEQ ID NO: 46013 - protein, 8 aa, Borrelia burgdorferi B31
IKLFIMVK

SEQ ID NO: 46014 - protein, 8 aa, Borrelia burgdorferi B31
KLFIMVKN

SEQ ID NO: 46015 - protein, 8 aa, Borrelia burgdorferi B31
LFIMVKNE

SEQ ID NO: 46016 - protein, 8 aa, Borrelia burgdorferi B31
FIMVKNEQ

SEQ ID NO: 46017 - protein, 8 aa, Borrelia burgdorferi B31
IMVKNEQN

SEQ ID NO: 46018 - protein, 8 aa, Borrelia burgdorferi B31
MVKNEQNN

SEQ ID NO: 46019 - protein, 8 aa, Borrelia burgdorferi B31
VKNEQNNN

SEQ ID NO: 46020 - protein, 8 aa, Borrelia burgdorferi B31
KNEQNNNK

SEQ ID NO: 46021 - protein, 8 aa, Borrelia burgdorferi B31
NEQNNNKF

SEQ ID NO: 46022 - protein, 8 aa, Borrelia burgdorferi B31
EQNNNKFM

SEQ ID NO: 46023 - protein, 8 aa, Borrelia burgdorferi B31
QNNNKFMR

SEQ ID NO: 46024 - protein, 8 aa, Borrelia burgdorferi B31
NNNKFMRI

SEQ ID NO: 46025 - protein, 8 aa, Borrelia burgdorferi B31
NNKFMRIV

SEQ ID NO: 46026 - protein, 8 aa, Borrelia burgdorferi B31
NKFMRIVR

SEQ ID NO: 46027 - protein, 8 aa, Borrelia burgdorferi B31
KFMRIVRW

SEQ ID NO: 46028 - protein, 8 aa, Borrelia burgdorferi B31
FMRIVRWL

SEQ ID NO: 46029 - protein, 8 aa, Borrelia burgdorferi B31
MRIVRWLY

SEQ ID NO: 46030 - protein, 8 aa, Borrelia burgdorferi B31
RIVRWLYS

SEQ ID NO: 46031 - protein, 8 aa, Borrelia burgdorferi B31
IVRWLYSC

SEQ ID NO: 46032 - protein, 8 aa, Borrelia burgdorferi B31
VRWLYSCI

SEQ ID NO: 46033 - protein, 8 aa, Borrelia burgdorferi B31
RWLYSCIE

SEQ ID NO: 46034 - protein, 8 aa, Borrelia burgdorferi B31
WLYSCIEE

SEQ ID NO: 46035 - protein, 8 aa, Borrelia burgdorferi B31
LYSCIEEL

SEQ ID NO: 46036 - protein, 8 aa, Borrelia burgdorferi B31
YSCIEELY

SEQ ID NO: 46037 - protein, 8 aa, Borrelia burgdorferi B31
SCIEELYS

SEQ ID NO: 46038 - protein, 8 aa, Borrelia burgdorferi B31
CIEELYSP

SEQ ID NO: 46039 - protein, 8 aa, Borrelia burgdorferi B31
IEELYSPD

SEQ ID NO: 46040 - protein, 8 aa, Borrelia burgdorferi B31
EELYSPDI

SEQ ID NO: 46041 - protein, 8 aa, Borrelia burgdorferi B31
ELYSPDIK

SEQ ID NO: 46042 - protein, 8 aa, Borrelia burgdorferi B31
LYSPDIKY

SEQ ID NO: 46043 - protein, 8 aa, Borrelia burgdorferi B31
YSPDIKYS

SEQ ID NO: 46044 - protein, 8 aa, Borrelia burgdorferi B31
SPDIKYSG

SEQ ID NO: 46045 - protein, 8 aa, Borrelia burgdorferi B31
PDIKYSGE

SEQ ID NO: 46046 - protein, 8 aa, Borrelia burgdorferi B31
DIKYSGEE

SEQ ID NO: 46047 - protein, 8 aa, Borrelia burgdorferi B31
IKYSGEEG

SEQ ID NO: 46048 - protein, 8 aa, Borrelia burgdorferi B31
KYSGEEGS

SEQ ID NO: 46049 - protein, 8 aa, Borrelia burgdorferi B31
YSGEEGSP

SEQ ID NO: 46050 - protein, 8 aa, Borrelia burgdorferi B31
SGEEGSPE

SEQ ID NO: 46051 - protein, 8 aa, Borrelia burgdorferi B31
GEEGSPEY

SEQ ID NO: 46052 - protein, 8 aa, Borrelia burgdorferi B31
EEGSPEYY

SEQ ID NO: 46053 - protein, 8 aa, Borrelia burgdorferi B31
EGSPEYYR

SEQ ID NO: 46054 - protein, 8 aa, Borrelia burgdorferi B31
GSPEYYRN

SEQ ID NO: 46055 - protein, 8 aa, Borrelia burgdorferi B31
SPEYYRNM

SEQ ID NO: 46056 - protein, 8 aa, Borrelia burgdorferi B31
PEYYRNMP

SEQ ID NO: 46057 - protein, 8 aa, Borrelia burgdorferi B31
EYYRNMPR

SEQ ID NO: 46058 - protein, 8 aa, Borrelia burgdorferi B31
YYRNMPRP

SEQ ID NO: 46059 - protein, 8 aa, Borrelia burgdorferi B31
YRNMPRPT

SEQ ID NO: 46060 - protein, 8 aa, Borrelia burgdorferi B31
RNMPRPTA

SEQ ID NO: 46061 - protein, 8 aa, Borrelia burgdorferi B31
NMPRPTAY

SEQ ID NO: 46062 - protein, 8 aa, Borrelia burgdorferi B31
MPRPTAYQ

SEQ ID NO: 46063 - protein, 8 aa, Borrelia burgdorferi B31
PRPTAYQQ

SEQ ID NO: 46064 - protein, 8 aa, Borrelia burgdorferi B31
RPTAYQQY

SEQ ID NO: 46065 - protein, 8 aa, Borrelia burgdorferi B31
PTAYQQYL

SEQ ID NO: 46066 - protein, 8 aa, Borrelia burgdorferi B31
TAYQQYLK

SEQ ID NO: 46067 - protein, 8 aa, Borrelia burgdorferi B31
AYQQYLKV

SEQ ID NO: 46068 - protein, 8 aa, Borrelia burgdorferi B31
YQQYLKVK

SEQ ID NO: 46069 - protein, 8 aa, Borrelia burgdorferi B31
QQYLKVKR

SEQ ID NO: 46070 - protein, 8 aa, Borrelia burgdorferi B31
QYLKVKRY

SEQ ID NO: 46071 - protein, 8 aa, Borrelia burgdorferi B31
YLKVKRYD

SEQ ID NO: 46072 - protein, 8 aa, Borrelia burgdorferi B31
LKVKRYDY

SEQ ID NO: 46073 - protein, 8 aa, Borrelia burgdorferi B31
KVKRYDYN

SEQ ID NO: 46074 - protein, 8 aa, Borrelia burgdorferi B31
VKRYDYNR

SEQ ID NO: 46075 - protein, 8 aa, Borrelia burgdorferi B31
KRYDYNRP

SEQ ID NO: 46076 - protein, 8 aa, Borrelia burgdorferi B31
RYDYNRPV

SEQ ID NO: 46077 - protein, 8 aa, Borrelia burgdorferi B31
YDYNRPVP

SEQ ID NO: 46078 - protein, 8 aa, Borrelia burgdorferi B31
DYNRPVPI

SEQ ID NO: 46079 - protein, 8 aa, Borrelia burgdorferi B31
YNRPVPIL

SEQ ID NO: 46080 - protein, 8 aa, Borrelia burgdorferi B31
NRPVPILP

SEQ ID NO: 46081 - protein, 8 aa, Borrelia burgdorferi B31
RPVPILPT

SEQ ID NO: 46082 - protein, 9 aa, Borrelia burgdorferi B31
MRILVGVCI

SEQ ID NO: 46083 - protein, 9 aa, Borrelia burgdorferi B31
RILVGVCII

SEQ ID NO: 46084 - protein, 9 aa, Borrelia burgdorferi B31
ILVGVCIIA

SEQ ID NO: 46085 - protein, 9 aa, Borrelia burgdorferi B31
LVGVCIIAL

SEQ ID NO: 46086 - protein, 9 aa, Borrelia burgdorferi B31
VGVCIIALA

SEQ ID NO: 46087 - protein, 9 aa, Borrelia burgdorferi B31
GVCIIALAL

SEQ ID NO: 46088 - protein, 9 aa, Borrelia burgdorferi B31
VCIIALALL

SEQ ID NO: 46089 - protein, 9 aa, Borrelia burgdorferi B31
CIIALALLG

SEQ ID NO: 46090 - protein, 9 aa, Borrelia burgdorferi B31
IIALALLGC

SEQ ID NO: 46091 - protein, 9 aa, Borrelia burgdorferi B31
IALALLGCY

SEQ ID NO: 46092 - protein, 9 aa, Borrelia burgdorferi B31
ALALLGCYL

SEQ ID NO: 46093 - protein, 9 aa, Borrelia burgdorferi B31
LALLGCYLP

SEQ ID NO: 46094 - protein, 9 aa, Borrelia burgdorferi B31
ALLGCYLPD

SEQ ID NO: 46095 - protein, 9 aa, Borrelia burgdorferi B31
LLGCYLPDN

SEQ ID NO: 46096 - protein, 9 aa, Borrelia burgdorferi B31
LGCYLPDNQ

SEQ ID NO: 46097 - protein, 9 aa, Borrelia burgdorferi B31
GCYLPDNQE

SEQ ID NO: 46098 - protein, 9 aa, Borrelia burgdorferi B31
CYLPDNQEQ

SEQ ID NO: 46099 - protein, 9 aa, Borrelia burgdorferi B31
YLPDNQEQA

SEQ ID NO: 46100 - protein, 9 aa, Borrelia burgdorferi B31
LPDNQEQAV

SEQ ID NO: 46101 - protein, 9 aa, Borrelia burgdorferi B31
PDNQEQAVQ

SEQ ID NO: 46102 - protein, 9 aa, Borrelia burgdorferi B31
DNQEQAVQT

SEQ ID NO: 46103 - protein, 9 aa, Borrelia burgdorferi B31
NQEQAVQTF

SEQ ID NO: 46104 - protein, 9 aa, Borrelia burgdorferi B31
QEQAVQTFF

SEQ ID NO: 46105 - protein, 9 aa, Borrelia burgdorferi B31
EQAVQTFFE

SEQ ID NO: 46106 - protein, 9 aa, Borrelia burgdorferi B31
QAVQTFFEN

SEQ ID NO: 46107 - protein, 9 aa, Borrelia burgdorferi B31
AVQTFFENS

SEQ ID NO: 46108 - protein, 9 aa, Borrelia burgdorferi B31
VQTFFENSE

SEQ ID NO: 46109 - protein, 9 aa, Borrelia burgdorferi B31
QTFFENSES

SEQ ID NO: 46110 - protein, 9 aa, Borrelia burgdorferi B31
TFFENSESS

SEQ ID NO: 46111 - protein, 9 aa, Borrelia burgdorferi B31
FFENSESSD

SEQ ID NO: 46112 - protein, 9 aa, Borrelia burgdorferi B31
FENSESSDM

SEQ ID NO: 46113 - protein, 9 aa, Borrelia burgdorferi B31
ENSESSDMG

SEQ ID NO: 46114 - protein, 9 aa, Borrelia burgdorferi B31
NSESSDMGS

SEQ ID NO: 46115 - protein, 9 aa, Borrelia burgdorferi B31
SESSDMGSD

SEQ ID NO: 46116 - protein, 9 aa, Borrelia burgdorferi B31
ESSDMGSDE

SEQ ID NO: 46117 - protein, 9 aa, Borrelia burgdorferi B31
SSDMGSDEI

SEQ ID NO: 46118 - protein, 9 aa, Borrelia burgdorferi B31
SDMGSDEIV

SEQ ID NO: 46119 - protein, 9 aa, Borrelia burgdorferi B31
DMGSDEIVT

SEQ ID NO: 46120 - protein, 9 aa, Borrelia burgdorferi B31
MGSDEIVTE

SEQ ID NO: 46121 - protein, 9 aa, Borrelia burgdorferi B31
GSDEIVTEG

SEQ ID NO: 46122 - protein, 9 aa, Borrelia burgdorferi B31
SDEIVTEGI

SEQ ID NO: 46123 - protein, 9 aa, Borrelia burgdorferi B31
DEIVTEGIF

SEQ ID NO: 46124 - protein, 9 aa, Borrelia burgdorferi B31
EIVTEGIFS

SEQ ID NO: 46125 - protein, 9 aa, Borrelia burgdorferi B31
IVTEGIFSS

SEQ ID NO: 46126 - protein, 9 aa, Borrelia burgdorferi B31
VTEGIFSSL

SEQ ID NO: 46127 - protein, 9 aa, Borrelia burgdorferi B31
TEGIFSSLK

SEQ ID NO: 46128 - protein, 9 aa, Borrelia burgdorferi B31
EGIFSSLKL

SEQ ID NO: 46129 - protein, 9 aa, Borrelia burgdorferi B31
GIFSSLKLY

SEQ ID NO: 46130 - protein, 9 aa, Borrelia burgdorferi B31
IFSSLKLYA

SEQ ID NO: 46131 - protein, 9 aa, Borrelia burgdorferi B31
FSSLKLYAS

SEQ ID NO: 46132 - protein, 9 aa, Borrelia burgdorferi B31
SSLKLYASE

SEQ ID NO: 46133 - protein, 9 aa, Borrelia burgdorferi B31
SLKLYASEH

SEQ ID NO: 46134 - protein, 9 aa, Borrelia burgdorferi B31
LKLYASEHR

SEQ ID NO: 46135 - protein, 9 aa, Borrelia burgdorferi B31
KLYASEHRL

SEQ ID NO: 46136 - protein, 9 aa, Borrelia burgdorferi B31
LYASEHRLL

SEQ ID NO: 46137 - protein, 9 aa, Borrelia burgdorferi B31
YASEHRLLV

SEQ ID NO: 46138 - protein, 9 aa, Borrelia burgdorferi B31
ASEHRLLVE

SEQ ID NO: 46139 - protein, 9 aa, Borrelia burgdorferi B31
SEHRLLVEI

SEQ ID NO: 46140 - protein, 9 aa, Borrelia burgdorferi B31
EHRLLVEIK

SEQ ID NO: 46141 - protein, 9 aa, Borrelia burgdorferi B31
HRLLVEIKK

SEQ ID NO: 46142 - protein, 9 aa, Borrelia burgdorferi B31
RLLVEIKKT

SEQ ID NO: 46143 - protein, 9 aa, Borrelia burgdorferi B31
LLVEIKKTL

SEQ ID NO: 46144 - protein, 9 aa, Borrelia burgdorferi B31
LVEIKKTLI

SEQ ID NO: 46145 - protein, 9 aa, Borrelia burgdorferi B31
VEIKKTLIS

SEQ ID NO: 46146 - protein, 9 aa, Borrelia burgdorferi B31
EIKKTLISL

SEQ ID NO: 46147 - protein, 9 aa, Borrelia burgdorferi B31
IKKTLISLK

SEQ ID NO: 46148 - protein, 9 aa, Borrelia burgdorferi B31
KKTLISLKD

SEQ ID NO: 46149 - protein, 9 aa, Borrelia burgdorferi B31
KTLISLKDP

SEQ ID NO: 46150 - protein, 9 aa, Borrelia burgdorferi B31
TLISLKDPN

SEQ ID NO: 46151 - protein, 9 aa, Borrelia burgdorferi B31
LISLKDPNY

SEQ ID NO: 46152 - protein, 9 aa, Borrelia burgdorferi B31
ISLKDPNYR

SEQ ID NO: 46153 - protein, 9 aa, Borrelia burgdorferi B31
SLKDPNYRG

SEQ ID NO: 46154 - protein, 9 aa, Borrelia burgdorferi B31
LKDPNYRGV

SEQ ID NO: 46155 - protein, 9 aa, Borrelia burgdorferi B31
KDPNYRGVV

SEQ ID NO: 46156 - protein, 9 aa, Borrelia burgdorferi B31
DPNYRGVVL

SEQ ID NO: 46157 - protein, 9 aa, Borrelia burgdorferi B31
PNYRGVVLP

SEQ ID NO: 46158 - protein, 9 aa, Borrelia burgdorferi B31
NYRGVVLPV

SEQ ID NO: 46159 - protein, 9 aa, Borrelia burgdorferi B31
YRGVVLPVS

SEQ ID NO: 46160 - protein, 9 aa, Borrelia burgdorferi B31
RGVVLPVSD

SEQ ID NO: 46161 - protein, 9 aa, Borrelia burgdorferi B31
GVVLPVSDY

SEQ ID NO: 46162 - protein, 9 aa, Borrelia burgdorferi B31
VVLPVSDYN

SEQ ID NO: 46163 - protein, 9 aa, Borrelia burgdorferi B31
VLPVSDYNE

SEQ ID NO: 46164 - protein, 9 aa, Borrelia burgdorferi B31
LPVSDYNEE

SEQ ID NO: 46165 - protein, 9 aa, Borrelia burgdorferi B31
PVSDYNEEY

SEQ ID NO: 46166 - protein, 9 aa, Borrelia burgdorferi B31
VSDYNEEYF

SEQ ID NO: 46167 - protein, 9 aa, Borrelia burgdorferi B31
SDYNEEYFN

SEQ ID NO: 46168 - protein, 9 aa, Borrelia burgdorferi B31
DYNEEYFNK

SEQ ID NO: 46169 - protein, 9 aa, Borrelia burgdorferi B31
YNEEYFNKF

SEQ ID NO: 46170 - protein, 9 aa, Borrelia burgdorferi B31
NEEYFNKFF

SEQ ID NO: 46171 - protein, 9 aa, Borrelia burgdorferi B31
EEYFNKFFL

SEQ ID NO: 46172 - protein, 9 aa, Borrelia burgdorferi B31
EYFNKFFLD

SEQ ID NO: 46173 - protein, 9 aa, Borrelia burgdorferi B31
YFNKFFLDL

SEQ ID NO: 46174 - protein, 9 aa, Borrelia burgdorferi B31
FNKFFLDLG

SEQ ID NO: 46175 - protein, 9 aa, Borrelia burgdorferi B31
NKFFLDLGS

SEQ ID NO: 46176 - protein, 9 aa, Borrelia burgdorferi B31
KFFLDLGSE

SEQ ID NO: 46177 - protein, 9 aa, Borrelia burgdorferi B31
FFLDLGSEQ

SEQ ID NO: 46178 - protein, 9 aa, Borrelia burgdorferi B31
FLDLGSEQS

SEQ ID NO: 46179 - protein, 9 aa, Borrelia burgdorferi B31
LDLGSEQSK

SEQ ID NO: 46180 - protein, 9 aa, Borrelia burgdorferi B31
DLGSEQSKD

SEQ ID NO: 46181 - protein, 9 aa, Borrelia burgdorferi B31
LGSEQSKDL

SEQ ID NO: 46182 - protein, 9 aa, Borrelia burgdorferi B31
GSEQSKDLI

SEQ ID NO: 46183 - protein, 9 aa, Borrelia burgdorferi B31
SEQSKDLIK

SEQ ID NO: 46184 - protein, 9 aa, Borrelia burgdorferi B31
EQSKDLIKL

SEQ ID NO: 46185 - protein, 9 aa, Borrelia burgdorferi B31
QSKDLIKLF

SEQ ID NO: 46186 - protein, 9 aa, Borrelia burgdorferi B31
SKDLIKLFI

SEQ ID NO: 46187 - protein, 9 aa, Borrelia burgdorferi B31
KDLIKLFIM

SEQ ID NO: 46188 - protein, 9 aa, Borrelia burgdorferi B31
DLIKLFIMV

SEQ ID NO: 46189 - protein, 9 aa, Borrelia burgdorferi B31
LIKLFIMVK

SEQ ID NO: 46190 - protein, 9 aa, Borrelia burgdorferi B31
IKLFIMVKN

SEQ ID NO: 46191 - protein, 9 aa, Borrelia burgdorferi B31
KLFIMVKNE

SEQ ID NO: 46192 - protein, 9 aa, Borrelia burgdorferi B31
LFIMVKNEQ

SEQ ID NO: 46193 - protein, 9 aa, Borrelia burgdorferi B31
FIMVKNEQN

SEQ ID NO: 46194 - protein, 9 aa, Borrelia burgdorferi B31
IMVKNEQNN

SEQ ID NO: 46195 - protein, 9 aa, Borrelia burgdorferi B31
MVKNEQNNN

SEQ ID NO: 46196 - protein, 9 aa, Borrelia burgdorferi B31
VKNEQNNNK

SEQ ID NO: 46197 - protein, 9 aa, Borrelia burgdorferi B31
KNEQNNNKF

SEQ ID NO: 46198 - protein, 9 aa, Borrelia burgdorferi B31
NEQNNNKFM

SEQ ID NO: 46199 - protein, 9 aa, Borrelia burgdorferi B31
EQNNNKFMR

SEQ ID NO: 46200 - protein, 9 aa, Borrelia burgdorferi B31
QNNNKFMRI

SEQ ID NO: 46201 - protein, 9 aa, Borrelia burgdorferi B31
NNNKFMRIV

SEQ ID NO: 46202 - protein, 9 aa, Borrelia burgdorferi B31
NNKFMRIVR

SEQ ID NO: 46203 - protein, 9 aa, Borrelia burgdorferi B31
NKFMRIVRW

SEQ ID NO: 46204 - protein, 9 aa, Borrelia burgdorferi B31
KFMRIVRWL

SEQ ID NO: 46205 - protein, 9 aa, Borrelia burgdorferi B31
FMRIVRWLY

SEQ ID NO: 46206 - protein, 9 aa, Borrelia burgdorferi B31
MRIVRWLYS

SEQ ID NO: 46207 - protein, 9 aa, Borrelia burgdorferi B31
RIVRWLYSC

SEQ ID NO: 46208 - protein, 9 aa, Borrelia burgdorferi B31
IVRWLYSCI

SEQ ID NO: 46209 - protein, 9 aa, Borrelia burgdorferi B31
VRWLYSCIE

SEQ ID NO: 46210 - protein, 9 aa, Borrelia burgdorferi B31
RWLYSCIEE

SEQ ID NO: 46211 - protein, 9 aa, Borrelia burgdorferi B31
WLYSCIEEL

SEQ ID NO: 46212 - protein, 9 aa, Borrelia burgdorferi B31
LYSCIEELY

SEQ ID NO: 46213 - protein, 9 aa, Borrelia burgdorferi B31
YSCIEELYS

SEQ ID NO: 46214 - protein, 9 aa, Borrelia burgdorferi B31
SCIEELYSP

SEQ ID NO: 46215 - protein, 9 aa, Borrelia burgdorferi B31
CIEELYSPD

SEQ ID NO: 46216 - protein, 9 aa, Borrelia burgdorferi B31
IEELYSPDI

SEQ ID NO: 46217 - protein, 9 aa, Borrelia burgdorferi B31
EELYSPDIK

SEQ ID NO: 46218 - protein, 9 aa, Borrelia burgdorferi B31
ELYSPDIKY

SEQ ID NO: 46219 - protein, 9 aa, Borrelia burgdorferi B31
LYSPDIKYS

SEQ ID NO: 46220 - protein, 9 aa, Borrelia burgdorferi B31
YSPDIKYSG

SEQ ID NO: 46221 - protein, 9 aa, Borrelia burgdorferi B31
SPDIKYSGE

SEQ ID NO: 46222 - protein, 9 aa, Borrelia burgdorferi B31
PDIKYSGEE

SEQ ID NO: 46223 - protein, 9 aa, Borrelia burgdorferi B31
DIKYSGEEG

SEQ ID NO: 46224 - protein, 9 aa, Borrelia burgdorferi B31
IKYSGEEGS

SEQ ID NO: 46225 - protein, 9 aa, Borrelia burgdorferi B31
KYSGEEGSP

SEQ ID NO: 46226 - protein, 9 aa, Borrelia burgdorferi B31
YSGEEGSPE

SEQ ID NO: 46227 - protein, 9 aa, Borrelia burgdorferi B31
SGEEGSPEY

SEQ ID NO: 46228 - protein, 9 aa, Borrelia burgdorferi B31
GEEGSPEYY

SEQ ID NO: 46229 - protein, 9 aa, Borrelia burgdorferi B31
EEGSPEYYR

SEQ ID NO: 46230 - protein, 9 aa, Borrelia burgdorferi B31
EGSPEYYRN

SEQ ID NO: 46231 - protein, 9 aa, Borrelia burgdorferi B31
GSPEYYRNM

SEQ ID NO: 46232 - protein, 9 aa, Borrelia burgdorferi B31
SPEYYRNMP

SEQ ID NO: 46233 - protein, 9 aa, Borrelia burgdorferi B31
PEYYRNMPR

SEQ ID NO: 46234 - protein, 9 aa, Borrelia burgdorferi B31
EYYRNMPRP

SEQ ID NO: 46235 - protein, 9 aa, Borrelia burgdorferi B31
YYRNMPRPT

SEQ ID NO: 46236 - protein, 9 aa, Borrelia burgdorferi B31
YRNMPRPTA

SEQ ID NO: 46237 - protein, 9 aa, Borrelia burgdorferi B31
RNMPRPTAY

SEQ ID NO: 46238 - protein, 9 aa, Borrelia burgdorferi B31
NMPRPTAYQ

SEQ ID NO: 46239 - protein, 9 aa, Borrelia burgdorferi B31
MPRPTAYQQ

SEQ ID NO: 46240 - protein, 9 aa, Borrelia burgdorferi B31
PRPTAYQQY

SEQ ID NO: 46241 - protein, 9 aa, Borrelia burgdorferi B31
RPTAYQQYL

SEQ ID NO: 46242 - protein, 9 aa, Borrelia burgdorferi B31
PTAYQQYLK

SEQ ID NO: 46243 - protein, 9 aa, Borrelia burgdorferi B31
TAYQQYLKV

SEQ ID NO: 46244 - protein, 9 aa, Borrelia burgdorferi B31
AYQQYLKVK

SEQ ID NO: 46245 - protein, 9 aa, Borrelia burgdorferi B31
YQQYLKVKR

SEQ ID NO: 46246 - protein, 9 aa, Borrelia burgdorferi B31
QQYLKVKRY

SEQ ID NO: 46247 - protein, 9 aa, Borrelia burgdorferi B31
QYLKVKRYD

SEQ ID NO: 46248 - protein, 9 aa, Borrelia burgdorferi B31
YLKVKRYDY

SEQ ID NO: 46249 - protein, 9 aa, Borrelia burgdorferi B31
LKVKRYDYN

SEQ ID NO: 46250 - protein, 9 aa, Borrelia burgdorferi B31
KVKRYDYNR

SEQ ID NO: 46251 - protein, 9 aa, Borrelia burgdorferi B31
VKRYDYNRP

SEQ ID NO: 46252 - protein, 9 aa, Borrelia burgdorferi B31
KRYDYNRPV

SEQ ID NO: 46253 - protein, 9 aa, Borrelia burgdorferi B31
RYDYNRPVP

SEQ ID NO: 46254 - protein, 9 aa, Borrelia burgdorferi B31
YDYNRPVPI

SEQ ID NO: 46255 - protein, 9 aa, Borrelia burgdorferi B31
DYNRPVPIL

SEQ ID NO: 46256 - protein, 9 aa, Borrelia burgdorferi B31
YNRPVPILP

SEQ ID NO: 46257 - protein, 9 aa, Borrelia burgdorferi B31
NRPVPILPT

SEQ ID NO: 46258 - protein, 10 aa, Borrelia burgdorferi B31
MRILVGVCII

SEQ ID NO: 46259 - protein, 10 aa, Borrelia burgdorferi B31
RILVGVCIIA

SEQ ID NO: 46260 - protein, 10 aa, Borrelia burgdorferi B31
ILVGVCIIAL

SEQ ID NO: 46261 - protein, 10 aa, Borrelia burgdorferi B31
LVGVCIIALA

SEQ ID NO: 46262 - protein, 10 aa, Borrelia burgdorferi B31
VGVCIIALAL

SEQ ID NO: 46263 - protein, 10 aa, Borrelia burgdorferi B31
GVCIIALALL

SEQ ID NO: 46264 - protein, 10 aa, Borrelia burgdorferi B31
VCIIALALLG

SEQ ID NO: 46265 - protein, 10 aa, Borrelia burgdorferi B31
CIIALALLGC

SEQ ID NO: 46266 - protein, 10 aa, Borrelia burgdorferi B31
IIALALLGCY

SEQ ID NO: 46267 - protein, 10 aa, Borrelia burgdorferi B31
IALALLGCYL

SEQ ID NO: 46268 - protein, 10 aa, Borrelia burgdorferi B31
ALALLGCYLP

SEQ ID NO: 46269 - protein, 10 aa, Borrelia burgdorferi B31
LALLGCYLPD

SEQ ID NO: 46270 - protein, 10 aa, Borrelia burgdorferi B31
ALLGCYLPDN

SEQ ID NO: 46271 - protein, 10 aa, Borrelia burgdorferi B31
LLGCYLPDNQ

SEQ ID NO: 46272 - protein, 10 aa, Borrelia burgdorferi B31
LGCYLPDNQE

SEQ ID NO: 46273 - protein, 10 aa, Borrelia burgdorferi B31
GCYLPDNQEQ

SEQ ID NO: 46274 - protein, 10 aa, Borrelia burgdorferi B31
CYLPDNQEQA

SEQ ID NO: 46275 - protein, 10 aa, Borrelia burgdorferi B31
YLPDNQEQAV

SEQ ID NO: 46276 - protein, 10 aa, Borrelia burgdorferi B31
LPDNQEQAVQ

SEQ ID NO: 46277 - protein, 10 aa, Borrelia burgdorferi B31
PDNQEQAVQT

SEQ ID NO: 46278 - protein, 10 aa, Borrelia burgdorferi B31
DNQEQAVQTF

SEQ ID NO: 46279 - protein, 10 aa, Borrelia burgdorferi B31
NQEQAVQTFF

SEQ ID NO: 46280 - protein, 10 aa, Borrelia burgdorferi B31
QEQAVQTFFE

SEQ ID NO: 46281 - protein, 10 aa, Borrelia burgdorferi B31
EQAVQTFFEN

SEQ ID NO: 46282 - protein, 10 aa, Borrelia burgdorferi B31
QAVQTFFENS

SEQ ID NO: 46283 - protein, 10 aa, Borrelia burgdorferi B31
AVQTFFENSE

SEQ ID NO: 46284 - protein, 10 aa, Borrelia burgdorferi B31
VQTFFENSES

SEQ ID NO: 46285 - protein, 10 aa, Borrelia burgdorferi B31
QTFFENSESS

SEQ ID NO: 46286 - protein, 10 aa, Borrelia burgdorferi B31
TFFENSESSD

SEQ ID NO: 46287 - protein, 10 aa, Borrelia burgdorferi B31
FFENSESSDM

SEQ ID NO: 46288 - protein, 10 aa, Borrelia burgdorferi B31
FENSESSDMG

SEQ ID NO: 46289 - protein, 10 aa, Borrelia burgdorferi B31
ENSESSDMGS

SEQ ID NO: 46290 - protein, 10 aa, Borrelia burgdorferi B31
NSESSDMGSD

SEQ ID NO: 46291 - protein, 10 aa, Borrelia burgdorferi B31
SESSDMGSDE

SEQ ID NO: 46292 - protein, 10 aa, Borrelia burgdorferi B31
ESSDMGSDEI

SEQ ID NO: 46293 - protein, 10 aa, Borrelia burgdorferi B31
SSDMGSDEIV

SEQ ID NO: 46294 - protein, 10 aa, Borrelia burgdorferi B31
SDMGSDEIVT

SEQ ID NO: 46295 - protein, 10 aa, Borrelia burgdorferi B31
DMGSDEIVTE

SEQ ID NO: 46296 - protein, 10 aa, Borrelia burgdorferi B31
MGSDEIVTEG

SEQ ID NO: 46297 - protein, 10 aa, Borrelia burgdorferi B31
GSDEIVTEGI

SEQ ID NO: 46298 - protein, 10 aa, Borrelia burgdorferi B31
SDEIVTEGIF

SEQ ID NO: 46299 - protein, 10 aa, Borrelia burgdorferi B31
DEIVTEGIFS

SEQ ID NO: 46300 - protein, 10 aa, Borrelia burgdorferi B31
EIVTEGIFSS

SEQ ID NO: 46301 - protein, 10 aa, Borrelia burgdorferi B31
IVTEGIFSSL

SEQ ID NO: 46302 - protein, 10 aa, Borrelia burgdorferi B31
VTEGIFSSLK

SEQ ID NO: 46303 - protein, 10 aa, Borrelia burgdorferi B31
TEGIFSSLKL

SEQ ID NO: 46304 - protein, 10 aa, Borrelia burgdorferi B31
EGIFSSLKLY

SEQ ID NO: 46305 - protein, 10 aa, Borrelia burgdorferi B31
GIFSSLKLYA

SEQ ID NO: 46306 - protein, 10 aa, Borrelia burgdorferi B31
IFSSLKLYAS

SEQ ID NO: 46307 - protein, 10 aa, Borrelia burgdorferi B31
FSSLKLYASE

SEQ ID NO: 46308 - protein, 10 aa, Borrelia burgdorferi B31
SSLKLYASEH

SEQ ID NO: 46309 - protein, 10 aa, Borrelia burgdorferi B31
SLKLYASEHR

SEQ ID NO: 46310 - protein, 10 aa, Borrelia burgdorferi B31
LKLYASEHRL

SEQ ID NO: 46311 - protein, 10 aa, Borrelia burgdorferi B31
KLYASEHRLL

SEQ ID NO: 46312 - protein, 10 aa, Borrelia burgdorferi B31
LYASEHRLLV

SEQ ID NO: 46313 - protein, 10 aa, Borrelia burgdorferi B31
YASEHRLLVE

SEQ ID NO: 46314 - protein, 10 aa, Borrelia burgdorferi B31
ASEHRLLVEI

SEQ ID NO: 46315 - protein, 10 aa, Borrelia burgdorferi B31
SEHRLLVEIK

SEQ ID NO: 46316 - protein, 10 aa, Borrelia burgdorferi B31
EHRLLVEIKK

SEQ ID NO: 46317 - protein, 10 aa, Borrelia burgdorferi B31
HRLLVEIKKT

SEQ ID NO: 46318 - protein, 10 aa, Borrelia burgdorferi B31
RLLVEIKKTL

SEQ ID NO: 46319 - protein, 10 aa, Borrelia burgdorferi B31
LLVEIKKTLI

SEQ ID NO: 46320 - protein, 10 aa, Borrelia burgdorferi B31
LVEIKKTLIS

SEQ ID NO: 46321 - protein, 10 aa, Borrelia burgdorferi B31
VEIKKTLISL

SEQ ID NO: 46322 - protein, 10 aa, Borrelia burgdorferi B31
EIKKTLISLK

SEQ ID NO: 46323 - protein, 10 aa, Borrelia burgdorferi B31
IKKTLISLKD

SEQ ID NO: 46324 - protein, 10 aa, Borrelia burgdorferi B31
KKTLISLKDP

SEQ ID NO: 46325 - protein, 10 aa, Borrelia burgdorferi B31
KTLISLKDPN

SEQ ID NO: 46326 - protein, 10 aa, Borrelia burgdorferi B31
TLISLKDPNY

SEQ ID NO: 46327 - protein, 10 aa, Borrelia burgdorferi B31
LISLKDPNYR

SEQ ID NO: 46328 - protein, 10 aa, Borrelia burgdorferi B31
ISLKDPNYRG

SEQ ID NO: 46329 - protein, 10 aa, Borrelia burgdorferi B31
SLKDPNYRGV

SEQ ID NO: 46330 - protein, 10 aa, Borrelia burgdorferi B31
LKDPNYRGVV

SEQ ID NO: 46331 - protein, 10 aa, Borrelia burgdorferi B31
KDPNYRGVVL

SEQ ID NO: 46332 - protein, 10 aa, Borrelia burgdorferi B31
DPNYRGVVLP

SEQ ID NO: 46333 - protein, 10 aa, Borrelia burgdorferi B31
PNYRGVVLPV

SEQ ID NO: 46334 - protein, 10 aa, Borrelia burgdorferi B31
NYRGVVLPVS

SEQ ID NO: 46335 - protein, 10 aa, Borrelia burgdorferi B31
YRGVVLPVSD

SEQ ID NO: 46336 - protein, 10 aa, Borrelia burgdorferi B31
RGVVLPVSDY

SEQ ID NO: 46337 - protein, 10 aa, Borrelia burgdorferi B31
GVVLPVSDYN

SEQ ID NO: 46338 - protein, 10 aa, Borrelia burgdorferi B31
VVLPVSDYNE

SEQ ID NO: 46339 - protein, 10 aa, Borrelia burgdorferi B31
VLPVSDYNEE

SEQ ID NO: 46340 - protein, 10 aa, Borrelia burgdorferi B31
LPVSDYNEEY

SEQ ID NO: 46341 - protein, 10 aa, Borrelia burgdorferi B31
PVSDYNEEYF

SEQ ID NO: 46342 - protein, 10 aa, Borrelia burgdorferi B31
VSDYNEEYFN

SEQ ID NO: 46343 - protein, 10 aa, Borrelia burgdorferi B31
SDYNEEYFNK

SEQ ID NO: 46344 - protein, 10 aa, Borrelia burgdorferi B31
DYNEEYFNKF

SEQ ID NO: 46345 - protein, 10 aa, Borrelia burgdorferi B31
YNEEYFNKFF

SEQ ID NO: 46346 - protein, 10 aa, Borrelia burgdorferi B31
NEEYFNKFFL

SEQ ID NO: 46347 - protein, 10 aa, Borrelia burgdorferi B31
EEYFNKFFLD

SEQ ID NO: 46348 - protein, 10 aa, Borrelia burgdorferi B31
EYFNKFFLDL

SEQ ID NO: 46349 - protein, 10 aa, Borrelia burgdorferi B31
YFNKFFLDLG

SEQ ID NO: 46350 - protein, 10 aa, Borrelia burgdorferi B31
FNKFFLDLGS

SEQ ID NO: 46351 - protein, 10 aa, Borrelia burgdorferi B31
NKFFLDLGSE

SEQ ID NO: 46352 - protein, 10 aa, Borrelia burgdorferi B31
KFFLDLGSEQ

SEQ ID NO: 46353 - protein, 10 aa, Borrelia burgdorferi B31
FFLDLGSEQS

SEQ ID NO: 46354 - protein, 10 aa, Borrelia burgdorferi B31
FLDLGSEQSK

SEQ ID NO: 46355 - protein, 10 aa, Borrelia burgdorferi B31
LDLGSEQSKD

SEQ ID NO: 46356 - protein, 10 aa, Borrelia burgdorferi B31
DLGSEQSKDL

SEQ ID NO: 46357 - protein, 10 aa, Borrelia burgdorferi B31
LGSEQSKDLI

SEQ ID NO: 46358 - protein, 10 aa, Borrelia burgdorferi B31
GSEQSKDLIK

SEQ ID NO: 46359 - protein, 10 aa, Borrelia burgdorferi B31
SEQSKDLIKL

SEQ ID NO: 46360 - protein, 10 aa, Borrelia burgdorferi B31
EQSKDLIKLF

SEQ ID NO: 46361 - protein, 10 aa, Borrelia burgdorferi B31
QSKDLIKLFI

SEQ ID NO: 46362 - protein, 10 aa, Borrelia burgdorferi B31
SKDLIKLFIM

SEQ ID NO: 46363 - protein, 10 aa, Borrelia burgdorferi B31
KDLIKLFIMV

SEQ ID NO: 46364 - protein, 10 aa, Borrelia burgdorferi B31
DLIKLFIMVK

SEQ ID NO: 46365 - protein, 10 aa, Borrelia burgdorferi B31
LIKLFIMVKN

SEQ ID NO: 46366 - protein, 10 aa, Borrelia burgdorferi B31
IKLFIMVKNE

SEQ ID NO: 46367 - protein, 10 aa, Borrelia burgdorferi B31
KLFIMVKNEQ

SEQ ID NO: 46368 - protein, 10 aa, Borrelia burgdorferi B31
LFIMVKNEQN

SEQ ID NO: 46369 - protein, 10 aa, Borrelia burgdorferi B31
FIMVKNEQNN

SEQ ID NO: 46370 - protein, 10 aa, Borrelia burgdorferi B31
IMVKNEQNNN

SEQ ID NO: 46371 - protein, 10 aa, Borrelia burgdorferi B31
MVKNEQNNNK

SEQ ID NO: 46372 - protein, 10 aa, Borrelia burgdorferi B31
VKNEQNNNKF

SEQ ID NO: 46373 - protein, 10 aa, Borrelia burgdorferi B31
KNEQNNNKFM

SEQ ID NO: 46374 - protein, 10 aa, Borrelia burgdorferi B31
NEQNNNKFMR

SEQ ID NO: 46375 - protein, 10 aa, Borrelia burgdorferi B31
EQNNNKFMRI

SEQ ID NO: 46376 - protein, 10 aa, Borrelia burgdorferi B31
QNNNKFMRIV

SEQ ID NO: 46377 - protein, 10 aa, Borrelia burgdorferi B31
NNNKFMRIVR

SEQ ID NO: 46378 - protein, 10 aa, Borrelia burgdorferi B31
NNKFMRIVRW

SEQ ID NO: 46379 - protein, 10 aa, Borrelia burgdorferi B31
NKFMRIVRWL

SEQ ID NO: 46380 - protein, 10 aa, Borrelia burgdorferi B31
KFMRIVRWLY

SEQ ID NO: 46381 - protein, 10 aa, Borrelia burgdorferi B31
FMRIVRWLYS

SEQ ID NO: 46382 - protein, 10 aa, Borrelia burgdorferi B31
MRIVRWLYSC

SEQ ID NO: 46383 - protein, 10 aa, Borrelia burgdorferi B31
RIVRWLYSCI

SEQ ID NO: 46384 - protein, 10 aa, Borrelia burgdorferi B31
IVRWLYSCIE

SEQ ID NO: 46385 - protein, 10 aa, Borrelia burgdorferi B31
VRWLYSCIEE

SEQ ID NO: 46386 - protein, 10 aa, Borrelia burgdorferi B31
RWLYSCIEEL

SEQ ID NO: 46387 - protein, 10 aa, Borrelia burgdorferi B31
WLYSCIEELY

SEQ ID NO: 46388 - protein, 10 aa, Borrelia burgdorferi B31
LYSCIEELYS

SEQ ID NO: 46389 - protein, 10 aa, Borrelia burgdorferi B31
YSCIEELYSP

SEQ ID NO: 46390 - protein, 10 aa, Borrelia burgdorferi B31
SCIEELYSPD

SEQ ID NO: 46391 - protein, 10 aa, Borrelia burgdorferi B31
CIEELYSPDI

SEQ ID NO: 46392 - protein, 10 aa, Borrelia burgdorferi B31
IEELYSPDIK

SEQ ID NO: 46393 - protein, 10 aa, Borrelia burgdorferi B31
EELYSPDIKY

SEQ ID NO: 46394 - protein, 10 aa, Borrelia burgdorferi B31
ELYSPDIKYS

SEQ ID NO: 46395 - protein, 10 aa, Borrelia burgdorferi B31
LYSPDIKYSG

SEQ ID NO: 46396 - protein, 10 aa, Borrelia burgdorferi B31
YSPDIKYSGE

SEQ ID NO: 46397 - protein, 10 aa, Borrelia burgdorferi B31
SPDIKYSGEE

SEQ ID NO: 46398 - protein, 10 aa, Borrelia burgdorferi B31
PDIKYSGEEG

SEQ ID NO: 46399 - protein, 10 aa, Borrelia burgdorferi B31
DIKYSGEEGS

SEQ ID NO: 46400 - protein, 10 aa, Borrelia burgdorferi B31
IKYSGEEGSP

SEQ ID NO: 46401 - protein, 10 aa, Borrelia burgdorferi B31
KYSGEEGSPE

SEQ ID NO: 46402 - protein, 10 aa, Borrelia burgdorferi B31
YSGEEGSPEY

SEQ ID NO: 46403 - protein, 10 aa, Borrelia burgdorferi B31
SGEEGSPEYY

SEQ ID NO: 46404 - protein, 10 aa, Borrelia burgdorferi B31
GEEGSPEYYR

SEQ ID NO: 46405 - protein, 10 aa, Borrelia burgdorferi B31
EEGSPEYYRN

SEQ ID NO: 46406 - protein, 10 aa, Borrelia burgdorferi B31
EGSPEYYRNM

SEQ ID NO: 46407 - protein, 10 aa, Borrelia burgdorferi B31
GSPEYYRNMP

SEQ ID NO: 46408 - protein, 10 aa, Borrelia burgdorferi B31
SPEYYRNMPR

SEQ ID NO: 46409 - protein, 10 aa, Borrelia burgdorferi B31
PEYYRNMPRP

SEQ ID NO: 46410 - protein, 10 aa, Borrelia burgdorferi B31
EYYRNMPRPT

SEQ ID NO: 46411 - protein, 10 aa, Borrelia burgdorferi B31
YYRNMPRPTA

SEQ ID NO: 46412 - protein, 10 aa, Borrelia burgdorferi B31
YRNMPRPTAY

SEQ ID NO: 46413 - protein, 10 aa, Borrelia burgdorferi B31
RNMPRPTAYQ

SEQ ID NO: 46414 - protein, 10 aa, Borrelia burgdorferi B31
NMPRPTAYQQ

SEQ ID NO: 46415 - protein, 10 aa, Borrelia burgdorferi B31
MPRPTAYQQY

SEQ ID NO: 46416 - protein, 10 aa, Borrelia burgdorferi B31
PRPTAYQQYL

SEQ ID NO: 46417 - protein, 10 aa, Borrelia burgdorferi B31
RPTAYQQYLK

SEQ ID NO: 46418 - protein, 10 aa, Borrelia burgdorferi B31
PTAYQQYLKV

SEQ ID NO: 46419 - protein, 10 aa, Borrelia burgdorferi B31
TAYQQYLKVK

SEQ ID NO: 46420 - protein, 10 aa, Borrelia burgdorferi B31
AYQQYLKVKR

SEQ ID NO: 46421 - protein, 10 aa, Borrelia burgdorferi B31
YQQYLKVKRY

SEQ ID NO: 46422 - protein, 10 aa, Borrelia burgdorferi B31
QQYLKVKRYD

SEQ ID NO: 46423 - protein, 10 aa, Borrelia burgdorferi B31
QYLKVKRYDY

SEQ ID NO: 46424 - protein, 10 aa, Borrelia burgdorferi B31
YLKVKRYDYN

SEQ ID NO: 46425 - protein, 10 aa, Borrelia burgdorferi B31
LKVKRYDYNR

SEQ ID NO: 46426 - protein, 10 aa, Borrelia burgdorferi B31
KVKRYDYNRP

SEQ ID NO: 46427 - protein, 10 aa, Borrelia burgdorferi B31
VKRYDYNRPV

SEQ ID NO: 46428 - protein, 10 aa, Borrelia burgdorferi B31
KRYDYNRPVP

SEQ ID NO: 46429 - protein, 10 aa, Borrelia burgdorferi B31
RYDYNRPVPI

SEQ ID NO: 46430 - protein, 10 aa, Borrelia burgdorferi B31
YDYNRPVPIL

SEQ ID NO: 46431 - protein, 10 aa, Borrelia burgdorferi B31
DYNRPVPILP

SEQ ID NO: 46432 - protein, 10 aa, Borrelia burgdorferi B31
YNRPVPILPT

SEQ ID NO: 46433 - protein, 11 aa, Borrelia burgdorferi B31
MRILVGVCIIA

SEQ ID NO: 46434 - protein, 11 aa, Borrelia burgdorferi B31
RILVGVCIIAL

SEQ ID NO: 46435 - protein, 11 aa, Borrelia burgdorferi B31
ILVGVCIIALA

SEQ ID NO: 46436 - protein, 11 aa, Borrelia burgdorferi B31
LVGVCIIALAL

SEQ ID NO: 46437 - protein, 11 aa, Borrelia burgdorferi B31
VGVCIIALALL

SEQ ID NO: 46438 - protein, 11 aa, Borrelia burgdorferi B31
GVCIIALALLG

SEQ ID NO: 46439 - protein, 11 aa, Borrelia burgdorferi B31
VCIIALALLGC

SEQ ID NO: 46440 - protein, 11 aa, Borrelia burgdorferi B31
CIIALALLGCY

SEQ ID NO: 46441 - protein, 11 aa, Borrelia burgdorferi B31
IIALALLGCYL

SEQ ID NO: 46442 - protein, 11 aa, Borrelia burgdorferi B31
IALALLGCYLP

SEQ ID NO: 46443 - protein, 11 aa, Borrelia burgdorferi B31
ALALLGCYLPD

SEQ ID NO: 46444 - protein, 11 aa, Borrelia burgdorferi B31
LALLGCYLPDN

SEQ ID NO: 46445 - protein, 11 aa, Borrelia burgdorferi B31
ALLGCYLPDNQ

SEQ ID NO: 46446 - protein, 11 aa, Borrelia burgdorferi B31
LLGCYLPDNQE

SEQ ID NO: 46447 - protein, 11 aa, Borrelia burgdorferi B31
LGCYLPDNQEQ

SEQ ID NO: 46448 - protein, 11 aa, Borrelia burgdorferi B31
GCYLPDNQEQA

SEQ ID NO: 46449 - protein, 11 aa, Borrelia burgdorferi B31
CYLPDNQEQAV

SEQ ID NO: 46450 - protein, 11 aa, Borrelia burgdorferi B31
YLPDNQEQAVQ

SEQ ID NO: 46451 - protein, 11 aa, Borrelia burgdorferi B31
LPDNQEQAVQT

SEQ ID NO: 46452 - protein, 11 aa, Borrelia burgdorferi B31
PDNQEQAVQTF

SEQ ID NO: 46453 - protein, 11 aa, Borrelia burgdorferi B31
DNQEQAVQTFF

SEQ ID NO: 46454 - protein, 11 aa, Borrelia burgdorferi B31
NQEQAVQTFFE

SEQ ID NO: 46455 - protein, 11 aa, Borrelia burgdorferi B31
QEQAVQTFFEN

SEQ ID NO: 46456 - protein, 11 aa, Borrelia burgdorferi B31
EQAVQTFFENS

SEQ ID NO: 46457 - protein, 11 aa, Borrelia burgdorferi B31
QAVQTFFENSE

SEQ ID NO: 46458 - protein, 11 aa, Borrelia burgdorferi B31
AVQTFFENSES

SEQ ID NO: 46459 - protein, 11 aa, Borrelia burgdorferi B31
VQTFFENSESS

SEQ ID NO: 46460 - protein, 11 aa, Borrelia burgdorferi B31
QTFFENSESSD

SEQ ID NO: 46461 - protein, 11 aa, Borrelia burgdorferi B31
TFFENSESSDM

SEQ ID NO: 46462 - protein, 11 aa, Borrelia burgdorferi B31
FFENSESSDMG

SEQ ID NO: 46463 - protein, 11 aa, Borrelia burgdorferi B31
FENSESSDMGS

SEQ ID NO: 46464 - protein, 11 aa, Borrelia burgdorferi B31
ENSESSDMGSD

SEQ ID NO: 46465 - protein, 11 aa, Borrelia burgdorferi B31
NSESSDMGSDE

SEQ ID NO: 46466 - protein, 11 aa, Borrelia burgdorferi B31
SESSDMGSDEI

SEQ ID NO: 46467 - protein, 11 aa, Borrelia burgdorferi B31
ESSDMGSDEIV

SEQ ID NO: 46468 - protein, 11 aa, Borrelia burgdorferi B31
SSDMGSDEIVT

SEQ ID NO: 46469 - protein, 11 aa, Borrelia burgdorferi B31
SDMGSDEIVTE

SEQ ID NO: 46470 - protein, 11 aa, Borrelia burgdorferi B31
DMGSDEIVTEG

SEQ ID NO: 46471 - protein, 11 aa, Borrelia burgdorferi B31
MGSDEIVTEGI

SEQ ID NO: 46472 - protein, 11 aa, Borrelia burgdorferi B31
GSDEIVTEGIF

SEQ ID NO: 46473 - protein, 11 aa, Borrelia burgdorferi B31
SDEIVTEGIFS

SEQ ID NO: 46474 - protein, 11 aa, Borrelia burgdorferi B31
DEIVTEGIFSS

SEQ ID NO: 46475 - protein, 11 aa, Borrelia burgdorferi B31
EIVTEGIFSSL

SEQ ID NO: 46476 - protein, 11 aa, Borrelia burgdorferi B31
IVTEGIFSSLK

SEQ ID NO: 46477 - protein, 11 aa, Borrelia burgdorferi B31
VTEGIFSSLKL

SEQ ID NO: 46478 - protein, 11 aa, Borrelia burgdorferi B31
TEGIFSSLKLY

SEQ ID NO: 46479 - protein, 11 aa, Borrelia burgdorferi B31
EGIFSSLKLYA

SEQ ID NO: 46480 - protein, 11 aa, Borrelia burgdorferi B31
GIFSSLKLYAS

SEQ ID NO: 46481 - protein, 11 aa, Borrelia burgdorferi B31
IFSSLKLYASE

SEQ ID NO: 46482 - protein, 11 aa, Borrelia burgdorferi B31
FSSLKLYASEH

SEQ ID NO: 46483 - protein, 11 aa, Borrelia burgdorferi B31
SSLKLYASEHR

SEQ ID NO: 46484 - protein, 11 aa, Borrelia burgdorferi B31
SLKLYASEHRL

SEQ ID NO: 46485 - protein, 11 aa, Borrelia burgdorferi B31
LKLYASEHRLL

SEQ ID NO: 46486 - protein, 11 aa, Borrelia burgdorferi B31
KLYASEHRLLV

SEQ ID NO: 46487 - protein, 11 aa, Borrelia burgdorferi B31
LYASEHRLLVE

SEQ ID NO: 46488 - protein, 11 aa, Borrelia burgdorferi B31
YASEHRLLVEI

SEQ ID NO: 46489 - protein, 11 aa, Borrelia burgdorferi B31
ASEHRLLVEIK

SEQ ID NO: 46490 - protein, 11 aa, Borrelia burgdorferi B31
SEHRLLVEIKK

SEQ ID NO: 46491 - protein, 11 aa, Borrelia burgdorferi B31
EHRLLVEIKKT

SEQ ID NO: 46492 - protein, 11 aa, Borrelia burgdorferi B31
HRLLVEIKKTL

SEQ ID NO: 46493 - protein, 11 aa, Borrelia burgdorferi B31
RLLVEIKKTLI

SEQ ID NO: 46494 - protein, 11 aa, Borrelia burgdorferi B31
LLVEIKKTLIS

SEQ ID NO: 46495 - protein, 11 aa, Borrelia burgdorferi B31
LVEIKKTLISL

SEQ ID NO: 46496 - protein, 11 aa, Borrelia burgdorferi B31
VEIKKTLISLK

SEQ ID NO: 46497 - protein, 11 aa, Borrelia burgdorferi B31
EIKKTLISLKD

SEQ ID NO: 46498 - protein, 11 aa, Borrelia burgdorferi B31
IKKTLISLKDP

SEQ ID NO: 46499 - protein, 11 aa, Borrelia burgdorferi B31
KKTLISLKDPN

SEQ ID NO: 46500 - protein, 11 aa, Borrelia burgdorferi B31
KTLISLKDPNY

SEQ ID NO: 46501 - protein, 11 aa, Borrelia burgdorferi B31
TLISLKDPNYR

SEQ ID NO: 46502 - protein, 11 aa, Borrelia burgdorferi B31
LISLKDPNYRG

SEQ ID NO: 46503 - protein, 11 aa, Borrelia burgdorferi B31
ISLKDPNYRGV

SEQ ID NO: 46504 - protein, 11 aa, Borrelia burgdorferi B31
SLKDPNYRGVV

SEQ ID NO: 46505 - protein, 11 aa, Borrelia burgdorferi B31
LKDPNYRGVVL

SEQ ID NO: 46506 - protein, 11 aa, Borrelia burgdorferi B31
KDPNYRGVVLP

SEQ ID NO: 46507 - protein, 11 aa, Borrelia burgdorferi B31
DPNYRGVVLPV

SEQ ID NO: 46508 - protein, 11 aa, Borrelia burgdorferi B31
PNYRGVVLPVS

SEQ ID NO: 46509 - protein, 11 aa, Borrelia burgdorferi B31
NYRGVVLPVSD

SEQ ID NO: 46510 - protein, 11 aa, Borrelia burgdorferi B31
YRGVVLPVSDY

SEQ ID NO: 46511 - protein, 11 aa, Borrelia burgdorferi B31
RGVVLPVSDYN

SEQ ID NO: 46512 - protein, 11 aa, Borrelia burgdorferi B31
GVVLPVSDYNE

SEQ ID NO: 46513 - protein, 11 aa, Borrelia burgdorferi B31
VVLPVSDYNEE

SEQ ID NO: 46514 - protein, 11 aa, Borrelia burgdorferi B31
VLPVSDYNEEY

SEQ ID NO: 46515 - protein, 11 aa, Borrelia burgdorferi B31
LPVSDYNEEYF

SEQ ID NO: 46516 - protein, 11 aa, Borrelia burgdorferi B31
PVSDYNEEYFN

SEQ ID NO: 46517 - protein, 11 aa, Borrelia burgdorferi B31
VSDYNEEYFNK

SEQ ID NO: 46518 - protein, 11 aa, Borrelia burgdorferi B31
SDYNEEYFNKF

SEQ ID NO: 46519 - protein, 11 aa, Borrelia burgdorferi B31
DYNEEYFNKFF

SEQ ID NO: 46520 - protein, 11 aa, Borrelia burgdorferi B31
YNEEYFNKFFL

SEQ ID NO: 46521 - protein, 11 aa, Borrelia burgdorferi B31
NEEYFNKFFLD

SEQ ID NO: 46522 - protein, 11 aa, Borrelia burgdorferi B31
EEYFNKFFLDL

SEQ ID NO: 46523 - protein, 11 aa, Borrelia burgdorferi B31
EYFNKFFLDLG

SEQ ID NO: 46524 - protein, 11 aa, Borrelia burgdorferi B31
YFNKFFLDLGS

SEQ ID NO: 46525 - protein, 11 aa, Borrelia burgdorferi B31
FNKFFLDLGSE

SEQ ID NO: 46526 - protein, 11 aa, Borrelia burgdorferi B31
NKFFLDLGSEQ

SEQ ID NO: 46527 - protein, 11 aa, Borrelia burgdorferi B31
KFFLDLGSEQS

SEQ ID NO: 46528 - protein, 11 aa, Borrelia burgdorferi B31
FFLDLGSEQSK

SEQ ID NO: 46529 - protein, 11 aa, Borrelia burgdorferi B31
FLDLGSEQSKD

SEQ ID NO: 46530 - protein, 11 aa, Borrelia burgdorferi B31
LDLGSEQSKDL

SEQ ID NO: 46531 - protein, 11 aa, Borrelia burgdorferi B31
DLGSEQSKDLI

SEQ ID NO: 46532 - protein, 11 aa, Borrelia burgdorferi B31
LGSEQSKDLIK

SEQ ID NO: 46533 - protein, 11 aa, Borrelia burgdorferi B31
GSEQSKDLIKL

SEQ ID NO: 46534 - protein, 11 aa, Borrelia burgdorferi B31
SEQSKDLIKLF

SEQ ID NO: 46535 - protein, 11 aa, Borrelia burgdorferi B31
EQSKDLIKLFI

SEQ ID NO: 46536 - protein, 11 aa, Borrelia burgdorferi B31
QSKDLIKLFIM

SEQ ID NO: 46537 - protein, 11 aa, Borrelia burgdorferi B31
SKDLIKLFIMV

SEQ ID NO: 46538 - protein, 11 aa, Borrelia burgdorferi B31
KDLIKLFIMVK

SEQ ID NO: 46539 - protein, 11 aa, Borrelia burgdorferi B31
DLIKLFIMVKN

SEQ ID NO: 46540 - protein, 11 aa, Borrelia burgdorferi B31
LIKLFIMVKNE

SEQ ID NO: 46541 - protein, 11 aa, Borrelia burgdorferi B31
IKLFIMVKNEQ

SEQ ID NO: 46542 - protein, 11 aa, Borrelia burgdorferi B31
KLFIMVKNEQN

SEQ ID NO: 46543 - protein, 11 aa, Borrelia burgdorferi B31
LFIMVKNEQNN

SEQ ID NO: 46544 - protein, 11 aa, Borrelia burgdorferi B31
FIMVKNEQNNN

SEQ ID NO: 46545 - protein, 11 aa, Borrelia burgdorferi B31
IMVKNEQNNNK

SEQ ID NO: 46546 - protein, 11 aa, Borrelia burgdorferi B31
MVKNEQNNNKF

SEQ ID NO: 46547 - protein, 11 aa, Borrelia burgdorferi B31
VKNEQNNNKFM

SEQ ID NO: 46548 - protein, 11 aa, Borrelia burgdorferi B31
KNEQNNNKFMR

SEQ ID NO: 46549 - protein, 11 aa, Borrelia burgdorferi B31
NEQNNNKFMRI

SEQ ID NO: 46550 - protein, 11 aa, Borrelia burgdorferi B31
EQNNNKFMRIV

SEQ ID NO: 46551 - protein, 11 aa, Borrelia burgdorferi B31
QNNNKFMRIVR

SEQ ID NO: 46552 - protein, 11 aa, Borrelia burgdorferi B31
NNNKFMRIVRW

SEQ ID NO: 46553 - protein, 11 aa, Borrelia burgdorferi B31
NNKFMRIVRWL

SEQ ID NO: 46554 - protein, 11 aa, Borrelia burgdorferi B31
NKFMRIVRWLY

SEQ ID NO: 46555 - protein, 11 aa, Borrelia burgdorferi B31
KFMRIVRWLYS

SEQ ID NO: 46556 - protein, 11 aa, Borrelia burgdorferi B31
FMRIVRWLYSC

SEQ ID NO: 46557 - protein, 11 aa, Borrelia burgdorferi B31
MRIVRWLYSCI

SEQ ID NO: 46558 - protein, 11 aa, Borrelia burgdorferi B31
RIVRWLYSCIE

SEQ ID NO: 46559 - protein, 11 aa, Borrelia burgdorferi B31
IVRWLYSCIEE

SEQ ID NO: 46560 - protein, 11 aa, Borrelia burgdorferi B31
VRWLYSCIEEL

SEQ ID NO: 46561 - protein, 11 aa, Borrelia burgdorferi B31
RWLYSCIEELY

SEQ ID NO: 46562 - protein, 11 aa, Borrelia burgdorferi B31
WLYSCIEELYS

SEQ ID NO: 46563 - protein, 11 aa, Borrelia burgdorferi B31
LYSCIEELYSP

SEQ ID NO: 46564 - protein, 11 aa, Borrelia burgdorferi B31
YSCIEELYSPD

SEQ ID NO: 46565 - protein, 11 aa, Borrelia burgdorferi B31
SCIEELYSPDI

SEQ ID NO: 46566 - protein, 11 aa, Borrelia burgdorferi B31
CIEELYSPDIK

SEQ ID NO: 46567 - protein, 11 aa, Borrelia burgdorferi B31
IEELYSPDIKY

SEQ ID NO: 46568 - protein, 11 aa, Borrelia burgdorferi B31
EELYSPDIKYS

SEQ ID NO: 46569 - protein, 11 aa, Borrelia burgdorferi B31
ELYSPDIKYSG

SEQ ID NO: 46570 - protein, 11 aa, Borrelia burgdorferi B31
LYSPDIKYSGE

SEQ ID NO: 46571 - protein, 11 aa, Borrelia burgdorferi B31
YSPDIKYSGEE

SEQ ID NO: 46572 - protein, 11 aa, Borrelia burgdorferi B31
SPDIKYSGEEG

SEQ ID NO: 46573 - protein, 11 aa, Borrelia burgdorferi B31
PDIKYSGEEGS

SEQ ID NO: 46574 - protein, 11 aa, Borrelia burgdorferi B31
DIKYSGEEGSP

SEQ ID NO: 46575 - protein, 11 aa, Borrelia burgdorferi B31
IKYSGEEGSPE

SEQ ID NO: 46576 - protein, 11 aa, Borrelia burgdorferi B31
KYSGEEGSPEY

SEQ ID NO: 46577 - protein, 11 aa, Borrelia burgdorferi B31
YSGEEGSPEYY

SEQ ID NO: 46578 - protein, 11 aa, Borrelia burgdorferi B31
SGEEGSPEYYR

SEQ ID NO: 46579 - protein, 11 aa, Borrelia burgdorferi B31
GEEGSPEYYRN

SEQ ID NO: 46580 - protein, 11 aa, Borrelia burgdorferi B31
EEGSPEYYRNM

SEQ ID NO: 46581 - protein, 11 aa, Borrelia burgdorferi B31
EGSPEYYRNMP

SEQ ID NO: 46582 - protein, 11 aa, Borrelia burgdorferi B31
GSPEYYRNMPR

SEQ ID NO: 46583 - protein, 11 aa, Borrelia burgdorferi B31
SPEYYRNMPRP

SEQ ID NO: 46584 - protein, 11 aa, Borrelia burgdorferi B31
PEYYRNMPRPT

SEQ ID NO: 46585 - protein, 11 aa, Borrelia burgdorferi B31
EYYRNMPRPTA

SEQ ID NO: 46586 - protein, 11 aa, Borrelia burgdorferi B31
YYRNMPRPTAY

SEQ ID NO: 46587 - protein, 11 aa, Borrelia burgdorferi B31
YRNMPRPTAYQ

SEQ ID NO: 46588 - protein, 11 aa, Borrelia burgdorferi B31
RNMPRPTAYQQ

SEQ ID NO: 46589 - protein, 11 aa, Borrelia burgdorferi B31
NMPRPTAYQQY

SEQ ID NO: 46590 - protein, 11 aa, Borrelia burgdorferi B31
MPRPTAYQQYL

SEQ ID NO: 46591 - protein, 11 aa, Borrelia burgdorferi B31
PRPTAYQQYLK

SEQ ID NO: 46592 - protein, 11 aa, Borrelia burgdorferi B31
RPTAYQQYLKV

SEQ ID NO: 46593 - protein, 11 aa, Borrelia burgdorferi B31
PTAYQQYLKVK

SEQ ID NO: 46594 - protein, 11 aa, Borrelia burgdorferi B31
TAYQQYLKVKR

SEQ ID NO: 46595 - protein, 11 aa, Borrelia burgdorferi B31
AYQQYLKVKRY

SEQ ID NO: 46596 - protein, 11 aa, Borrelia burgdorferi B31
YQQYLKVKRYD

SEQ ID NO: 46597 - protein, 11 aa, Borrelia burgdorferi B31
QQYLKVKRYDY

SEQ ID NO: 46598 - protein, 11 aa, Borrelia burgdorferi B31
QYLKVKRYDYN

SEQ ID NO: 46599 - protein, 11 aa, Borrelia burgdorferi B31
YLKVKRYDYNR

SEQ ID NO: 46600 - protein, 11 aa, Borrelia burgdorferi B31
LKVKRYDYNRP

SEQ ID NO: 46601 - protein, 11 aa, Borrelia burgdorferi B31
KVKRYDYNRPV

SEQ ID NO: 46602 - protein, 11 aa, Borrelia burgdorferi B31
VKRYDYNRPVP

SEQ ID NO: 46603 - protein, 11 aa, Borrelia burgdorferi B31
KRYDYNRPVPI

SEQ ID NO: 46604 - protein, 11 aa, Borrelia burgdorferi B31
RYDYNRPVPIL

SEQ ID NO: 46605 - protein, 11 aa, Borrelia burgdorferi B31
YDYNRPVPILP

SEQ ID NO: 46606 - protein, 11 aa, Borrelia burgdorferi B31
DYNRPVPILPT

SEQ ID NO: 46607 - protein, 8 aa, Borrelia burgdorferi B31
MRNKNIFK

SEQ ID NO: 46608 - protein, 8 aa, Borrelia burgdorferi B31
RNKNIFKL

SEQ ID NO: 46609 - protein, 8 aa, Borrelia burgdorferi B31
NKNIFKLF

SEQ ID NO: 46610 - protein, 8 aa, Borrelia burgdorferi B31
KNIFKLFF

SEQ ID NO: 46611 - protein, 8 aa, Borrelia burgdorferi B31
NIFKLFFA

SEQ ID NO: 46612 - protein, 8 aa, Borrelia burgdorferi B31
IFKLFFAS

SEQ ID NO: 46613 - protein, 8 aa, Borrelia burgdorferi B31
FKLFFASM

SEQ ID NO: 46614 - protein, 8 aa, Borrelia burgdorferi B31
KLFFASML

SEQ ID NO: 46615 - protein, 8 aa, Borrelia burgdorferi B31
LFFASMLF

SEQ ID NO: 46616 - protein, 8 aa, Borrelia burgdorferi B31
FFASMLFV

SEQ ID NO: 46617 - protein, 8 aa, Borrelia burgdorferi B31
FASMLFVM

SEQ ID NO: 46618 - protein, 8 aa, Borrelia burgdorferi B31
ASMLFVMA

SEQ ID NO: 46619 - protein, 8 aa, Borrelia burgdorferi B31
SMLFVMAC

SEQ ID NO: 46620 - protein, 8 aa, Borrelia burgdorferi B31
MLFVMACK

SEQ ID NO: 46621 - protein, 8 aa, Borrelia burgdorferi B31
LFVMACKA

SEQ ID NO: 46622 - protein, 8 aa, Borrelia burgdorferi B31
FVMACKAY

SEQ ID NO: 46623 - protein, 8 aa, Borrelia burgdorferi B31
VMACKAYV

SEQ ID NO: 46624 - protein, 8 aa, Borrelia burgdorferi B31
MACKAYVE

SEQ ID NO: 46625 - protein, 8 aa, Borrelia burgdorferi B31
ACKAYVEE

SEQ ID NO: 46626 - protein, 8 aa, Borrelia burgdorferi B31
CKAYVEEK

SEQ ID NO: 46627 - protein, 8 aa, Borrelia burgdorferi B31
KAYVEEKK

SEQ ID NO: 46628 - protein, 8 aa, Borrelia burgdorferi B31
AYVEEKKE

SEQ ID NO: 46629 - protein, 8 aa, Borrelia burgdorferi B31
YVEEKKEI

SEQ ID NO: 46630 - protein, 8 aa, Borrelia burgdorferi B31
VEEKKEID

SEQ ID NO: 46631 - protein, 8 aa, Borrelia burgdorferi B31
EEKKEIDS

SEQ ID NO: 46632 - protein, 8 aa, Borrelia burgdorferi B31
EKKEIDSL

SEQ ID NO: 46633 - protein, 8 aa, Borrelia burgdorferi B31
KKEIDSLM

SEQ ID NO: 46634 - protein, 8 aa, Borrelia burgdorferi B31
KEIDSLME

SEQ ID NO: 46635 - protein, 8 aa, Borrelia burgdorferi B31
EIDSLMED

SEQ ID NO: 46636 - protein, 8 aa, Borrelia burgdorferi B31
IDSLMEDV

SEQ ID NO: 46637 - protein, 8 aa, Borrelia burgdorferi B31
DSLMEDVL

SEQ ID NO: 46638 - protein, 8 aa, Borrelia burgdorferi B31
SLMEDVLA

SEQ ID NO: 46639 - protein, 8 aa, Borrelia burgdorferi B31
LMEDVLAL

SEQ ID NO: 46640 - protein, 8 aa, Borrelia burgdorferi B31
MEDVLALV

SEQ ID NO: 46641 - protein, 8 aa, Borrelia burgdorferi B31
EDVLALVN

SEQ ID NO: 46642 - protein, 8 aa, Borrelia burgdorferi B31
DVLALVND

SEQ ID NO: 46643 - protein, 8 aa, Borrelia burgdorferi B31
VLALVNDS

SEQ ID NO: 46644 - protein, 8 aa, Borrelia burgdorferi B31
LALVNDSS

SEQ ID NO: 46645 - protein, 8 aa, Borrelia burgdorferi B31
ALVNDSSG

SEQ ID NO: 46646 - protein, 8 aa, Borrelia burgdorferi B31
LVNDSSGG

SEQ ID NO: 46647 - protein, 8 aa, Borrelia burgdorferi B31
VNDSSGGK

SEQ ID NO: 46648 - protein, 8 aa, Borrelia burgdorferi B31
NDSSGGKF

SEQ ID NO: 46649 - protein, 8 aa, Borrelia burgdorferi B31
DSSGGKFK

SEQ ID NO: 46650 - protein, 8 aa, Borrelia burgdorferi B31
SSGGKFKD

SEQ ID NO: 46651 - protein, 8 aa, Borrelia burgdorferi B31
SGGKFKDY

SEQ ID NO: 46652 - protein, 8 aa, Borrelia burgdorferi B31
GGKFKDYK

SEQ ID NO: 46653 - protein, 8 aa, Borrelia burgdorferi B31
GKFKDYKD

SEQ ID NO: 46654 - protein, 8 aa, Borrelia burgdorferi B31
KFKDYKDK

SEQ ID NO: 46655 - protein, 8 aa, Borrelia burgdorferi B31
FKDYKDKI

SEQ ID NO: 46656 - protein, 8 aa, Borrelia burgdorferi B31
KDYKDKIN

SEQ ID NO: 46657 - protein, 8 aa, Borrelia burgdorferi B31
DYKDKINE

SEQ ID NO: 46658 - protein, 8 aa, Borrelia burgdorferi B31
YKDKINEL

SEQ ID NO: 46659 - protein, 8 aa, Borrelia burgdorferi B31
KDKINELK

SEQ ID NO: 46660 - protein, 8 aa, Borrelia burgdorferi B31
DKINELKE

SEQ ID NO: 46661 - protein, 8 aa, Borrelia burgdorferi B31
KINELKEN

SEQ ID NO: 46662 - protein, 8 aa, Borrelia burgdorferi B31
INELKENL

SEQ ID NO: 46663 - protein, 8 aa, Borrelia burgdorferi B31
NELKENLK

SEQ ID NO: 46664 - protein, 8 aa, Borrelia burgdorferi B31
ELKENLKD

SEQ ID NO: 46665 - protein, 8 aa, Borrelia burgdorferi B31
LKENLKDI

SEQ ID NO: 46666 - protein, 8 aa, Borrelia burgdorferi B31
KENLKDIG

SEQ ID NO: 46667 - protein, 8 aa, Borrelia burgdorferi B31
ENLKDIGN

SEQ ID NO: 46668 - protein, 8 aa, Borrelia burgdorferi B31
NLKDIGNA

SEQ ID NO: 46669 - protein, 8 aa, Borrelia burgdorferi B31
LKDIGNAE

SEQ ID NO: 46670 - protein, 8 aa, Borrelia burgdorferi B31
KDIGNAEL

SEQ ID NO: 46671 - protein, 8 aa, Borrelia burgdorferi B31
DIGNAELK

SEQ ID NO: 46672 - protein, 8 aa, Borrelia burgdorferi B31
IGNAELKE

SEQ ID NO: 46673 - protein, 8 aa, Borrelia burgdorferi B31
GNAELKEK

SEQ ID NO: 46674 - protein, 8 aa, Borrelia burgdorferi B31
NAELKEKL

SEQ ID NO: 46675 - protein, 8 aa, Borrelia burgdorferi B31
AELKEKLL

SEQ ID NO: 46676 - protein, 8 aa, Borrelia burgdorferi B31
ELKEKLLN

SEQ ID NO: 46677 - protein, 8 aa, Borrelia burgdorferi B31
LKEKLLNL

SEQ ID NO: 46678 - protein, 8 aa, Borrelia burgdorferi B31
KEKLLNLQ

SEQ ID NO: 46679 - protein, 8 aa, Borrelia burgdorferi B31
EKLLNLQN

SEQ ID NO: 46680 - protein, 8 aa, Borrelia burgdorferi B31
KLLNLQNS

SEQ ID NO: 46681 - protein, 8 aa, Borrelia burgdorferi B31
LLNLQNSF

SEQ ID NO: 46682 - protein, 8 aa, Borrelia burgdorferi B31
LNLQNSFQ

SEQ ID NO: 46683 - protein, 8 aa, Borrelia burgdorferi B31
NLQNSFQD

SEQ ID NO: 46684 - protein, 8 aa, Borrelia burgdorferi B31
LQNSFQDK

SEQ ID NO: 46685 - protein, 8 aa, Borrelia burgdorferi B31
QNSFQDKL

SEQ ID NO: 46686 - protein, 8 aa, Borrelia burgdorferi B31
NSFQDKLA

SEQ ID NO: 46687 - protein, 8 aa, Borrelia burgdorferi B31
SFQDKLAA

SEQ ID NO: 46688 - protein, 8 aa, Borrelia burgdorferi B31
FQDKLAAK

SEQ ID NO: 46689 - protein, 8 aa, Borrelia burgdorferi B31
QDKLAAKL

SEQ ID NO: 46690 - protein, 8 aa, Borrelia burgdorferi B31
DKLAAKLA

SEQ ID NO: 46691 - protein, 8 aa, Borrelia burgdorferi B31
KLAAKLAA

SEQ ID NO: 46692 - protein, 8 aa, Borrelia burgdorferi B31
LAAKLAAL

SEQ ID NO: 46693 - protein, 8 aa, Borrelia burgdorferi B31
AAKLAALK

SEQ ID NO: 46694 - protein, 8 aa, Borrelia burgdorferi B31
AKLAALKA

SEQ ID NO: 46695 - protein, 8 aa, Borrelia burgdorferi B31
KLAALKAA

SEQ ID NO: 46696 - protein, 8 aa, Borrelia burgdorferi B31
LAALKAAK

SEQ ID NO: 46697 - protein, 8 aa, Borrelia burgdorferi B31
AALKAAKN

SEQ ID NO: 46698 - protein, 8 aa, Borrelia burgdorferi B31
ALKAAKNT

SEQ ID NO: 46699 - protein, 8 aa, Borrelia burgdorferi B31
LKAAKNTI

SEQ ID NO: 46700 - protein, 8 aa, Borrelia burgdorferi B31
KAAKNTIE

SEQ ID NO: 46701 - protein, 8 aa, Borrelia burgdorferi B31
AAKNTIEN

SEQ ID NO: 46702 - protein, 8 aa, Borrelia burgdorferi B31
AKNTIENI

SEQ ID NO: 46703 - protein, 8 aa, Borrelia burgdorferi B31
KNTIENIT

SEQ ID NO: 46704 - protein, 8 aa, Borrelia burgdorferi B31
NTIENITD

SEQ ID NO: 46705 - protein, 8 aa, Borrelia burgdorferi B31
TIENITDK

SEQ ID NO: 46706 - protein, 8 aa, Borrelia burgdorferi B31
IENITDKD

SEQ ID NO: 46707 - protein, 8 aa, Borrelia burgdorferi B31
ENITDKDQ

SEQ ID NO: 46708 - protein, 8 aa, Borrelia burgdorferi B31
NITDKDQD

SEQ ID NO: 46709 - protein, 8 aa, Borrelia burgdorferi B31
ITDKDQDI

SEQ ID NO: 46710 - protein, 8 aa, Borrelia burgdorferi B31
TDKDQDIS

SEQ ID NO: 46711 - protein, 8 aa, Borrelia burgdorferi B31
DKDQDISK

SEQ ID NO: 46712 - protein, 8 aa, Borrelia burgdorferi B31
KDQDISKR

SEQ ID NO: 46713 - protein, 8 aa, Borrelia burgdorferi B31
DQDISKRK

SEQ ID NO: 46714 - protein, 8 aa, Borrelia burgdorferi B31
QDISKRKI

SEQ ID NO: 46715 - protein, 8 aa, Borrelia burgdorferi B31
DISKRKIW

SEQ ID NO: 46716 - protein, 8 aa, Borrelia burgdorferi B31
ISKRKIWS

SEQ ID NO: 46717 - protein, 8 aa, Borrelia burgdorferi B31
SKRKIWSE

SEQ ID NO: 46718 - protein, 8 aa, Borrelia burgdorferi B31
KRKIWSEA

SEQ ID NO: 46719 - protein, 8 aa, Borrelia burgdorferi B31
RKIWSEAK

SEQ ID NO: 46720 - protein, 8 aa, Borrelia burgdorferi B31
KIWSEAKL

SEQ ID NO: 46721 - protein, 8 aa, Borrelia burgdorferi B31
IWSEAKLV

SEQ ID NO: 46722 - protein, 8 aa, Borrelia burgdorferi B31
WSEAKLVG

SEQ ID NO: 46723 - protein, 8 aa, Borrelia burgdorferi B31
SEAKLVGV

SEQ ID NO: 46724 - protein, 8 aa, Borrelia burgdorferi B31
EAKLVGVT

SEQ ID NO: 46725 - protein, 8 aa, Borrelia burgdorferi B31
AKLVGVTV

SEQ ID NO: 46726 - protein, 8 aa, Borrelia burgdorferi B31
KLVGVTVP

SEQ ID NO: 46727 - protein, 8 aa, Borrelia burgdorferi B31
LVGVTVPL

SEQ ID NO: 46728 - protein, 8 aa, Borrelia burgdorferi B31
VGVTVPLL

SEQ ID NO: 46729 - protein, 8 aa, Borrelia burgdorferi B31
GVTVPLLG

SEQ ID NO: 46730 - protein, 8 aa, Borrelia burgdorferi B31
VTVPLLGS

SEQ ID NO: 46731 - protein, 8 aa, Borrelia burgdorferi B31
TVPLLGSN

SEQ ID NO: 46732 - protein, 8 aa, Borrelia burgdorferi B31
VPLLGSNT

SEQ ID NO: 46733 - protein, 8 aa, Borrelia burgdorferi B31
PLLGSNTS

SEQ ID NO: 46734 - protein, 8 aa, Borrelia burgdorferi B31
LLGSNTSG

SEQ ID NO: 46735 - protein, 8 aa, Borrelia burgdorferi B31
LGSNTSGN

SEQ ID NO: 46736 - protein, 8 aa, Borrelia burgdorferi B31
GSNTSGNG

SEQ ID NO: 46737 - protein, 8 aa, Borrelia burgdorferi B31
SNTSGNGD

SEQ ID NO: 46738 - protein, 8 aa, Borrelia burgdorferi B31
NTSGNGDK

SEQ ID NO: 46739 - protein, 8 aa, Borrelia burgdorferi B31
TSGNGDKM

SEQ ID NO: 46740 - protein, 8 aa, Borrelia burgdorferi B31
SGNGDKMS

SEQ ID NO: 46741 - protein, 8 aa, Borrelia burgdorferi B31
GNGDKMSK

SEQ ID NO: 46742 - protein, 8 aa, Borrelia burgdorferi B31
NGDKMSKN

SEQ ID NO: 46743 - protein, 8 aa, Borrelia burgdorferi B31
GDKMSKNA

SEQ ID NO: 46744 - protein, 8 aa, Borrelia burgdorferi B31
DKMSKNAV

SEQ ID NO: 46745 - protein, 8 aa, Borrelia burgdorferi B31
KMSKNAVE

SEQ ID NO: 46746 - protein, 8 aa, Borrelia burgdorferi B31
MSKNAVEQ

SEQ ID NO: 46747 - protein, 8 aa, Borrelia burgdorferi B31
SKNAVEQI

SEQ ID NO: 46748 - protein, 8 aa, Borrelia burgdorferi B31
KNAVEQID

SEQ ID NO: 46749 - protein, 8 aa, Borrelia burgdorferi B31
NAVEQIDK

SEQ ID NO: 46750 - protein, 8 aa, Borrelia burgdorferi B31
AVEQIDKV

SEQ ID NO: 46751 - protein, 8 aa, Borrelia burgdorferi B31
VEQIDKVI

SEQ ID NO: 46752 - protein, 8 aa, Borrelia burgdorferi B31
EQIDKVIK

SEQ ID NO: 46753 - protein, 8 aa, Borrelia burgdorferi B31
QIDKVIKF

SEQ ID NO: 46754 - protein, 8 aa, Borrelia burgdorferi B31
IDKVIKFL

SEQ ID NO: 46755 - protein, 8 aa, Borrelia burgdorferi B31
DKVIKFLE

SEQ ID NO: 46756 - protein, 8 aa, Borrelia burgdorferi B31
KVIKFLEE

SEQ ID NO: 46757 - protein, 8 aa, Borrelia burgdorferi B31
VIKFLEEG

SEQ ID NO: 46758 - protein, 8 aa, Borrelia burgdorferi B31
IKFLEEGT

SEQ ID NO: 46759 - protein, 8 aa, Borrelia burgdorferi B31
KFLEEGTN

SEQ ID NO: 46760 - protein, 9 aa, Borrelia burgdorferi B31
MRNKNIFKL

SEQ ID NO: 46761 - protein, 9 aa, Borrelia burgdorferi B31
RNKNIFKLF

SEQ ID NO: 46762 - protein, 9 aa, Borrelia burgdorferi B31
NKNIFKLFF

SEQ ID NO: 46763 - protein, 9 aa, Borrelia burgdorferi B31
KNIFKLFFA

SEQ ID NO: 46764 - protein, 9 aa, Borrelia burgdorferi B31
NIFKLFFAS

SEQ ID NO: 46765 - protein, 9 aa, Borrelia burgdorferi B31
IFKLFFASM

SEQ ID NO: 46766 - protein, 9 aa, Borrelia burgdorferi B31
FKLFFASML

SEQ ID NO: 46767 - protein, 9 aa, Borrelia burgdorferi B31
KLFFASMLF

SEQ ID NO: 46768 - protein, 9 aa, Borrelia burgdorferi B31
LFFASMLFV

SEQ ID NO: 46769 - protein, 9 aa, Borrelia burgdorferi B31
FFASMLFVM

SEQ ID NO: 46770 - protein, 9 aa, Borrelia burgdorferi B31
FASMLFVMA

SEQ ID NO: 46771 - protein, 9 aa, Borrelia burgdorferi B31
ASMLFVMAC

SEQ ID NO: 46772 - protein, 9 aa, Borrelia burgdorferi B31
SMLFVMACK

SEQ ID NO: 46773 - protein, 9 aa, Borrelia burgdorferi B31
MLFVMACKA

SEQ ID NO: 46774 - protein, 9 aa, Borrelia burgdorferi B31
LFVMACKAY

SEQ ID NO: 46775 - protein, 9 aa, Borrelia burgdorferi B31
FVMACKAYV

SEQ ID NO: 46776 - protein, 9 aa, Borrelia burgdorferi B31
VMACKAYVE

SEQ ID NO: 46777 - protein, 9 aa, Borrelia burgdorferi B31
MACKAYVEE

SEQ ID NO: 46778 - protein, 9 aa, Borrelia burgdorferi B31
ACKAYVEEK

SEQ ID NO: 46779 - protein, 9 aa, Borrelia burgdorferi B31
CKAYVEEKK

SEQ ID NO: 46780 - protein, 9 aa, Borrelia burgdorferi B31
KAYVEEKKE

SEQ ID NO: 46781 - protein, 9 aa, Borrelia burgdorferi B31
AYVEEKKEI

SEQ ID NO: 46782 - protein, 9 aa, Borrelia burgdorferi B31
YVEEKKEID

SEQ ID NO: 46783 - protein, 9 aa, Borrelia burgdorferi B31
VEEKKEIDS

SEQ ID NO: 46784 - protein, 9 aa, Borrelia burgdorferi B31
EEKKEIDSL

SEQ ID NO: 46785 - protein, 9 aa, Borrelia burgdorferi B31
EKKEIDSLM

SEQ ID NO: 46786 - protein, 9 aa, Borrelia burgdorferi B31
KKEIDSLME

SEQ ID NO: 46787 - protein, 9 aa, Borrelia burgdorferi B31
KEIDSLMED

SEQ ID NO: 46788 - protein, 9 aa, Borrelia burgdorferi B31
EIDSLMEDV

SEQ ID NO: 46789 - protein, 9 aa, Borrelia burgdorferi B31
IDSLMEDVL

SEQ ID NO: 46790 - protein, 9 aa, Borrelia burgdorferi B31
DSLMEDVLA

SEQ ID NO: 46791 - protein, 9 aa, Borrelia burgdorferi B31
SLMEDVLAL

SEQ ID NO: 46792 - protein, 9 aa, Borrelia burgdorferi B31
LMEDVLALV

SEQ ID NO: 46793 - protein, 9 aa, Borrelia burgdorferi B31
MEDVLALVN

SEQ ID NO: 46794 - protein, 9 aa, Borrelia burgdorferi B31
EDVLALVND

SEQ ID NO: 46795 - protein, 9 aa, Borrelia burgdorferi B31
DVLALVNDS

SEQ ID NO: 46796 - protein, 9 aa, Borrelia burgdorferi B31
VLALVNDSS

SEQ ID NO: 46797 - protein, 9 aa, Borrelia burgdorferi B31
LALVNDSSG

SEQ ID NO: 46798 - protein, 9 aa, Borrelia burgdorferi B31
ALVNDSSGG

SEQ ID NO: 46799 - protein, 9 aa, Borrelia burgdorferi B31
LVNDSSGGK

SEQ ID NO: 46800 - protein, 9 aa, Borrelia burgdorferi B31
VNDSSGGKF

SEQ ID NO: 46801 - protein, 9 aa, Borrelia burgdorferi B31
NDSSGGKFK

SEQ ID NO: 46802 - protein, 9 aa, Borrelia burgdorferi B31
DSSGGKFKD

SEQ ID NO: 46803 - protein, 9 aa, Borrelia burgdorferi B31
SSGGKFKDY

SEQ ID NO: 46804 - protein, 9 aa, Borrelia burgdorferi B31
SGGKFKDYK

SEQ ID NO: 46805 - protein, 9 aa, Borrelia burgdorferi B31
GGKFKDYKD

SEQ ID NO: 46806 - protein, 9 aa, Borrelia burgdorferi B31
GKFKDYKDK

SEQ ID NO: 46807 - protein, 9 aa, Borrelia burgdorferi B31
KFKDYKDKI

SEQ ID NO: 46808 - protein, 9 aa, Borrelia burgdorferi B31
FKDYKDKIN

SEQ ID NO: 46809 - protein, 9 aa, Borrelia burgdorferi B31
KDYKDKINE

SEQ ID NO: 46810 - protein, 9 aa, Borrelia burgdorferi B31
DYKDKINEL

SEQ ID NO: 46811 - protein, 9 aa, Borrelia burgdorferi B31
YKDKINELK

SEQ ID NO: 46812 - protein, 9 aa, Borrelia burgdorferi B31
KDKINELKE

SEQ ID NO: 46813 - protein, 9 aa, Borrelia burgdorferi B31
DKINELKEN

SEQ ID NO: 46814 - protein, 9 aa, Borrelia burgdorferi B31
KINELKENL

SEQ ID NO: 46815 - protein, 9 aa, Borrelia burgdorferi B31
INELKENLK

SEQ ID NO: 46816 - protein, 9 aa, Borrelia burgdorferi B31
NELKENLKD

SEQ ID NO: 46817 - protein, 9 aa, Borrelia burgdorferi B31
ELKENLKDI

SEQ ID NO: 46818 - protein, 9 aa, Borrelia burgdorferi B31
LKENLKDIG

SEQ ID NO: 46819 - protein, 9 aa, Borrelia burgdorferi B31
KENLKDIGN

SEQ ID NO: 46820 - protein, 9 aa, Borrelia burgdorferi B31
ENLKDIGNA

SEQ ID NO: 46821 - protein, 9 aa, Borrelia burgdorferi B31
NLKDIGNAE

SEQ ID NO: 46822 - protein, 9 aa, Borrelia burgdorferi B31
LKDIGNAEL

SEQ ID NO: 46823 - protein, 9 aa, Borrelia burgdorferi B31
KDIGNAELK

SEQ ID NO: 46824 - protein, 9 aa, Borrelia burgdorferi B31
DIGNAELKE

SEQ ID NO: 46825 - protein, 9 aa, Borrelia burgdorferi B31
IGNAELKEK

SEQ ID NO: 46826 - protein, 9 aa, Borrelia burgdorferi B31
GNAELKEKL

SEQ ID NO: 46827 - protein, 9 aa, Borrelia burgdorferi B31
NAELKEKLL

SEQ ID NO: 46828 - protein, 9 aa, Borrelia burgdorferi B31
AELKEKLLN

SEQ ID NO: 46829 - protein, 9 aa, Borrelia burgdorferi B31
ELKEKLLNL

SEQ ID NO: 46830 - protein, 9 aa, Borrelia burgdorferi B31
LKEKLLNLQ

SEQ ID NO: 46831 - protein, 9 aa, Borrelia burgdorferi B31
KEKLLNLQN

SEQ ID NO: 46832 - protein, 9 aa, Borrelia burgdorferi B31
EKLLNLQNS

SEQ ID NO: 46833 - protein, 9 aa, Borrelia burgdorferi B31
KLLNLQNSF

SEQ ID NO: 46834 - protein, 9 aa, Borrelia burgdorferi B31
LLNLQNSFQ

SEQ ID NO: 46835 - protein, 9 aa, Borrelia burgdorferi B31
LNLQNSFQD

SEQ ID NO: 46836 - protein, 9 aa, Borrelia burgdorferi B31
NLQNSFQDK

SEQ ID NO: 46837 - protein, 9 aa, Borrelia burgdorferi B31
LQNSFQDKL

SEQ ID NO: 46838 - protein, 9 aa, Borrelia burgdorferi B31
QNSFQDKLA

SEQ ID NO: 46839 - protein, 9 aa, Borrelia burgdorferi B31
NSFQDKLAA

SEQ ID NO: 46840 - protein, 9 aa, Borrelia burgdorferi B31
SFQDKLAAK

SEQ ID NO: 46841 - protein, 9 aa, Borrelia burgdorferi B31
FQDKLAAKL

SEQ ID NO: 46842 - protein, 9 aa, Borrelia burgdorferi B31
QDKLAAKLA

SEQ ID NO: 46843 - protein, 9 aa, Borrelia burgdorferi B31
DKLAAKLAA

SEQ ID NO: 46844 - protein, 9 aa, Borrelia burgdorferi B31
KLAAKLAAL

SEQ ID NO: 46845 - protein, 9 aa, Borrelia burgdorferi B31
LAAKLAALK

SEQ ID NO: 46846 - protein, 9 aa, Borrelia burgdorferi B31
AAKLAALKA

SEQ ID NO: 46847 - protein, 9 aa, Borrelia burgdorferi B31
AKLAALKAA

SEQ ID NO: 46848 - protein, 9 aa, Borrelia burgdorferi B31
KLAALKAAK

SEQ ID NO: 46849 - protein, 9 aa, Borrelia burgdorferi B31
LAALKAAKN

SEQ ID NO: 46850 - protein, 9 aa, Borrelia burgdorferi B31
AALKAAKNT

SEQ ID NO: 46851 - protein, 9 aa, Borrelia burgdorferi B31
ALKAAKNTI

SEQ ID NO: 46852 - protein, 9 aa, Borrelia burgdorferi B31
LKAAKNTIE

SEQ ID NO: 46853 - protein, 9 aa, Borrelia burgdorferi B31
KAAKNTIEN

SEQ ID NO: 46854 - protein, 9 aa, Borrelia burgdorferi B31
AAKNTIENI

SEQ ID NO: 46855 - protein, 9 aa, Borrelia burgdorferi B31
AKNTIENIT

SEQ ID NO: 46856 - protein, 9 aa, Borrelia burgdorferi B31
KNTIENITD

SEQ ID NO: 46857 - protein, 9 aa, Borrelia burgdorferi B31
NTIENITDK

SEQ ID NO: 46858 - protein, 9 aa, Borrelia burgdorferi B31
TIENITDKD

SEQ ID NO: 46859 - protein, 9 aa, Borrelia burgdorferi B31
IENITDKDQ

SEQ ID NO: 46860 - protein, 9 aa, Borrelia burgdorferi B31
ENITDKDQD

SEQ ID NO: 46861 - protein, 9 aa, Borrelia burgdorferi B31
NITDKDQDI

SEQ ID NO: 46862 - protein, 9 aa, Borrelia burgdorferi B31
ITDKDQDIS

SEQ ID NO: 46863 - protein, 9 aa, Borrelia burgdorferi B31
TDKDQDISK

SEQ ID NO: 46864 - protein, 9 aa, Borrelia burgdorferi B31
DKDQDISKR

SEQ ID NO: 46865 - protein, 9 aa, Borrelia burgdorferi B31
KDQDISKRK

SEQ ID NO: 46866 - protein, 9 aa, Borrelia burgdorferi B31
DQDISKRKI

SEQ ID NO: 46867 - protein, 9 aa, Borrelia burgdorferi B31
QDISKRKIW

SEQ ID NO: 46868 - protein, 9 aa, Borrelia burgdorferi B31
DISKRKIWS

SEQ ID NO: 46869 - protein, 9 aa, Borrelia burgdorferi B31
ISKRKIWSE

SEQ ID NO: 46870 - protein, 9 aa, Borrelia burgdorferi B31
SKRKIWSEA

SEQ ID NO: 46871 - protein, 9 aa, Borrelia burgdorferi B31
KRKIWSEAK

SEQ ID NO: 46872 - protein, 9 aa, Borrelia burgdorferi B31
RKIWSEAKL

SEQ ID NO: 46873 - protein, 9 aa, Borrelia burgdorferi B31
KIWSEAKLV

SEQ ID NO: 46874 - protein, 9 aa, Borrelia burgdorferi B31
IWSEAKLVG

SEQ ID NO: 46875 - protein, 9 aa, Borrelia burgdorferi B31
WSEAKLVGV

SEQ ID NO: 46876 - protein, 9 aa, Borrelia burgdorferi B31
SEAKLVGVT

SEQ ID NO: 46877 - protein, 9 aa, Borrelia burgdorferi B31
EAKLVGVTV

SEQ ID NO: 46878 - protein, 9 aa, Borrelia burgdorferi B31
AKLVGVTVP

SEQ ID NO: 46879 - protein, 9 aa, Borrelia burgdorferi B31
KLVGVTVPL

SEQ ID NO: 46880 - protein, 9 aa, Borrelia burgdorferi B31
LVGVTVPLL

SEQ ID NO: 46881 - protein, 9 aa, Borrelia burgdorferi B31
VGVTVPLLG

SEQ ID NO: 46882 - protein, 9 aa, Borrelia burgdorferi B31
GVTVPLLGS

SEQ ID NO: 46883 - protein, 9 aa, Borrelia burgdorferi B31
VTVPLLGSN

SEQ ID NO: 46884 - protein, 9 aa, Borrelia burgdorferi B31
TVPLLGSNT

SEQ ID NO: 46885 - protein, 9 aa, Borrelia burgdorferi B31
VPLLGSNTS

SEQ ID NO: 46886 - protein, 9 aa, Borrelia burgdorferi B31
PLLGSNTSG

SEQ ID NO: 46887 - protein, 9 aa, Borrelia burgdorferi B31
LLGSNTSGN

SEQ ID NO: 46888 - protein, 9 aa, Borrelia burgdorferi B31
LGSNTSGNG

SEQ ID NO: 46889 - protein, 9 aa, Borrelia burgdorferi B31
GSNTSGNGD

SEQ ID NO: 46890 - protein, 9 aa, Borrelia burgdorferi B31
SNTSGNGDK

SEQ ID NO: 46891 - protein, 9 aa, Borrelia burgdorferi B31
NTSGNGDKM

SEQ ID NO: 46892 - protein, 9 aa, Borrelia burgdorferi B31
TSGNGDKMS

SEQ ID NO: 46893 - protein, 9 aa, Borrelia burgdorferi B31
SGNGDKMSK

SEQ ID NO: 46894 - protein, 9 aa, Borrelia burgdorferi B31
GNGDKMSKN

SEQ ID NO: 46895 - protein, 9 aa, Borrelia burgdorferi B31
NGDKMSKNA

SEQ ID NO: 46896 - protein, 9 aa, Borrelia burgdorferi B31
GDKMSKNAV

SEQ ID NO: 46897 - protein, 9 aa, Borrelia burgdorferi B31
DKMSKNAVE

SEQ ID NO: 46898 - protein, 9 aa, Borrelia burgdorferi B31
KMSKNAVEQ

SEQ ID NO: 46899 - protein, 9 aa, Borrelia burgdorferi B31
MSKNAVEQI

SEQ ID NO: 46900 - protein, 9 aa, Borrelia burgdorferi B31
SKNAVEQID

SEQ ID NO: 46901 - protein, 9 aa, Borrelia burgdorferi B31
KNAVEQIDK

SEQ ID NO: 46902 - protein, 9 aa, Borrelia burgdorferi B31
NAVEQIDKV

SEQ ID NO: 46903 - protein, 9 aa, Borrelia burgdorferi B31
AVEQIDKVI

SEQ ID NO: 46904 - protein, 9 aa, Borrelia burgdorferi B31
VEQIDKVIK

SEQ ID NO: 46905 - protein, 9 aa, Borrelia burgdorferi B31
EQIDKVIKF

SEQ ID NO: 46906 - protein, 9 aa, Borrelia burgdorferi B31
QIDKVIKFL

SEQ ID NO: 46907 - protein, 9 aa, Borrelia burgdorferi B31
IDKVIKFLE

SEQ ID NO: 46908 - protein, 9 aa, Borrelia burgdorferi B31
DKVIKFLEE

SEQ ID NO: 46909 - protein, 9 aa, Borrelia burgdorferi B31
KVIKFLEEG

SEQ ID NO: 46910 - protein, 9 aa, Borrelia burgdorferi B31
VIKFLEEGT

SEQ ID NO: 46911 - protein, 9 aa, Borrelia burgdorferi B31
IKFLEEGTN

SEQ ID NO: 46912 - protein, 10 aa, Borrelia burgdorferi B31
MRNKNIFKLF

SEQ ID NO: 46913 - protein, 10 aa, Borrelia burgdorferi B31
RNKNIFKLFF

SEQ ID NO: 46914 - protein, 10 aa, Borrelia burgdorferi B31
NKNIFKLFFA

SEQ ID NO: 46915 - protein, 10 aa, Borrelia burgdorferi B31
KNIFKLFFAS

SEQ ID NO: 46916 - protein, 10 aa, Borrelia burgdorferi B31
NIFKLFFASM

SEQ ID NO: 46917 - protein, 10 aa, Borrelia burgdorferi B31
IFKLFFASML

SEQ ID NO: 46918 - protein, 10 aa, Borrelia burgdorferi B31
FKLFFASMLF

SEQ ID NO: 46919 - protein, 10 aa, Borrelia burgdorferi B31
KLFFASMLFV

SEQ ID NO: 46920 - protein, 10 aa, Borrelia burgdorferi B31
LFFASMLFVM

SEQ ID NO: 46921 - protein, 10 aa, Borrelia burgdorferi B31
FFASMLFVMA

SEQ ID NO: 46922 - protein, 10 aa, Borrelia burgdorferi B31
FASMLFVMAC

SEQ ID NO: 46923 - protein, 10 aa, Borrelia burgdorferi B31
ASMLFVMACK

SEQ ID NO: 46924 - protein, 10 aa, Borrelia burgdorferi B31
SMLFVMACKA

SEQ ID NO: 46925 - protein, 10 aa, Borrelia burgdorferi B31
MLFVMACKAY

SEQ ID NO: 46926 - protein, 10 aa, Borrelia burgdorferi B31
LFVMACKAYV

SEQ ID NO: 46927 - protein, 10 aa, Borrelia burgdorferi B31
FVMACKAYVE

SEQ ID NO: 46928 - protein, 10 aa, Borrelia burgdorferi B31
VMACKAYVEE

SEQ ID NO: 46929 - protein, 10 aa, Borrelia burgdorferi B31
MACKAYVEEK

SEQ ID NO: 46930 - protein, 10 aa, Borrelia burgdorferi B31
ACKAYVEEKK

SEQ ID NO: 46931 - protein, 10 aa, Borrelia burgdorferi B31
CKAYVEEKKE

SEQ ID NO: 46932 - protein, 10 aa, Borrelia burgdorferi B31
KAYVEEKKEI

SEQ ID NO: 46933 - protein, 10 aa, Borrelia burgdorferi B31
AYVEEKKEID

SEQ ID NO: 46934 - protein, 10 aa, Borrelia burgdorferi B31
YVEEKKEIDS

SEQ ID NO: 46935 - protein, 10 aa, Borrelia burgdorferi B31
VEEKKEIDSL

SEQ ID NO: 46936 - protein, 10 aa, Borrelia burgdorferi B31
EEKKEIDSLM

SEQ ID NO: 46937 - protein, 10 aa, Borrelia burgdorferi B31
EKKEIDSLME

SEQ ID NO: 46938 - protein, 10 aa, Borrelia burgdorferi B31
KKEIDSLMED

SEQ ID NO: 46939 - protein, 10 aa, Borrelia burgdorferi B31
KEIDSLMEDV

SEQ ID NO: 46940 - protein, 10 aa, Borrelia burgdorferi B31
EIDSLMEDVL

SEQ ID NO: 46941 - protein, 10 aa, Borrelia burgdorferi B31
IDSLMEDVLA

SEQ ID NO: 46942 - protein, 10 aa, Borrelia burgdorferi B31
DSLMEDVLAL

SEQ ID NO: 46943 - protein, 10 aa, Borrelia burgdorferi B31
SLMEDVLALV

SEQ ID NO: 46944 - protein, 10 aa, Borrelia burgdorferi B31
LMEDVLALVN

SEQ ID NO: 46945 - protein, 10 aa, Borrelia burgdorferi B31
MEDVLALVND

SEQ ID NO: 46946 - protein, 10 aa, Borrelia burgdorferi B31
EDVLALVNDS

SEQ ID NO: 46947 - protein, 10 aa, Borrelia burgdorferi B31
DVLALVNDSS

SEQ ID NO: 46948 - protein, 10 aa, Borrelia burgdorferi B31
VLALVNDSSG

SEQ ID NO: 46949 - protein, 10 aa, Borrelia burgdorferi B31
LALVNDSSGG

SEQ ID NO: 46950 - protein, 10 aa, Borrelia burgdorferi B31
ALVNDSSGGK

SEQ ID NO: 46951 - protein, 10 aa, Borrelia burgdorferi B31
LVNDSSGGKF

SEQ ID NO: 46952 - protein, 10 aa, Borrelia burgdorferi B31
VNDSSGGKFK

SEQ ID NO: 46953 - protein, 10 aa, Borrelia burgdorferi B31
NDSSGGKFKD

SEQ ID NO: 46954 - protein, 10 aa, Borrelia burgdorferi B31
DSSGGKFKDY

SEQ ID NO: 46955 - protein, 10 aa, Borrelia burgdorferi B31
SSGGKFKDYK

SEQ ID NO: 46956 - protein, 10 aa, Borrelia burgdorferi B31
SGGKFKDYKD

SEQ ID NO: 46957 - protein, 10 aa, Borrelia burgdorferi B31
GGKFKDYKDK

SEQ ID NO: 46958 - protein, 10 aa, Borrelia burgdorferi B31
GKFKDYKDKI

SEQ ID NO: 46959 - protein, 10 aa, Borrelia burgdorferi B31
KFKDYKDKIN

SEQ ID NO: 46960 - protein, 10 aa, Borrelia burgdorferi B31
FKDYKDKINE

SEQ ID NO: 46961 - protein, 10 aa, Borrelia burgdorferi B31
KDYKDKINEL

SEQ ID NO: 46962 - protein, 10 aa, Borrelia burgdorferi B31
DYKDKINELK

SEQ ID NO: 46963 - protein, 10 aa, Borrelia burgdorferi B31
YKDKINELKE

SEQ ID NO: 46964 - protein, 10 aa, Borrelia burgdorferi B31
KDKINELKEN

SEQ ID NO: 46965 - protein, 10 aa, Borrelia burgdorferi B31
DKINELKENL

SEQ ID NO: 46966 - protein, 10 aa, Borrelia burgdorferi B31
KINELKENLK

SEQ ID NO: 46967 - protein, 10 aa, Borrelia burgdorferi B31
INELKENLKD

SEQ ID NO: 46968 - protein, 10 aa, Borrelia burgdorferi B31
NELKENLKDI

SEQ ID NO: 46969 - protein, 10 aa, Borrelia burgdorferi B31
ELKENLKDIG

SEQ ID NO: 46970 - protein, 10 aa, Borrelia burgdorferi B31
LKENLKDIGN

SEQ ID NO: 46971 - protein, 10 aa, Borrelia burgdorferi B31
KENLKDIGNA

SEQ ID NO: 46972 - protein, 10 aa, Borrelia burgdorferi B31
ENLKDIGNAE

SEQ ID NO: 46973 - protein, 10 aa, Borrelia burgdorferi B31
NLKDIGNAEL

SEQ ID NO: 46974 - protein, 10 aa, Borrelia burgdorferi B31
LKDIGNAELK

SEQ ID NO: 46975 - protein, 10 aa, Borrelia burgdorferi B31
KDIGNAELKE

SEQ ID NO: 46976 - protein, 10 aa, Borrelia burgdorferi B31
DIGNAELKEK

SEQ ID NO: 46977 - protein, 10 aa, Borrelia burgdorferi B31
IGNAELKEKL

SEQ ID NO: 46978 - protein, 10 aa, Borrelia burgdorferi B31
GNAELKEKLL

SEQ ID NO: 46979 - protein, 10 aa, Borrelia burgdorferi B31
NAELKEKLLN

SEQ ID NO: 46980 - protein, 10 aa, Borrelia burgdorferi B31
AELKEKLLNL

SEQ ID NO: 46981 - protein, 10 aa, Borrelia burgdorferi B31
ELKEKLLNLQ

SEQ ID NO: 46982 - protein, 10 aa, Borrelia burgdorferi B31
LKEKLLNLQN

SEQ ID NO: 46983 - protein, 10 aa, Borrelia burgdorferi B31
KEKLLNLQNS

SEQ ID NO: 46984 - protein, 10 aa, Borrelia burgdorferi B31
EKLLNLQNSF

SEQ ID NO: 46985 - protein, 10 aa, Borrelia burgdorferi B31
KLLNLQNSFQ

SEQ ID NO: 46986 - protein, 10 aa, Borrelia burgdorferi B31
LLNLQNSFQD

SEQ ID NO: 46987 - protein, 10 aa, Borrelia burgdorferi B31
LNLQNSFQDK

SEQ ID NO: 46988 - protein, 10 aa, Borrelia burgdorferi B31
NLQNSFQDKL

SEQ ID NO: 46989 - protein, 10 aa, Borrelia burgdorferi B31
LQNSFQDKLA

SEQ ID NO: 46990 - protein, 10 aa, Borrelia burgdorferi B31
QNSFQDKLAA

SEQ ID NO: 46991 - protein, 10 aa, Borrelia burgdorferi B31
NSFQDKLAAK

SEQ ID NO: 46992 - protein, 10 aa, Borrelia burgdorferi B31
SFQDKLAAKL

SEQ ID NO: 46993 - protein, 10 aa, Borrelia burgdorferi B31
FQDKLAAKLA

SEQ ID NO: 46994 - protein, 10 aa, Borrelia burgdorferi B31
QDKLAAKLAA

SEQ ID NO: 46995 - protein, 10 aa, Borrelia burgdorferi B31
DKLAAKLAAL

SEQ ID NO: 46996 - protein, 10 aa, Borrelia burgdorferi B31
KLAAKLAALK

SEQ ID NO: 46997 - protein, 10 aa, Borrelia burgdorferi B31
LAAKLAALKA

SEQ ID NO: 46998 - protein, 10 aa, Borrelia burgdorferi B31
AAKLAALKAA

SEQ ID NO: 46999 - protein, 10 aa, Borrelia burgdorferi B31
AKLAALKAAK

SEQ ID NO: 47000 - protein, 10 aa, Borrelia burgdorferi B31
KLAALKAAKN

SEQ ID NO: 47001 - protein, 10 aa, Borrelia burgdorferi B31
LAALKAAKNT

SEQ ID NO: 47002 - protein, 10 aa, Borrelia burgdorferi B31
AALKAAKNTI

SEQ ID NO: 47003 - protein, 10 aa, Borrelia burgdorferi B31
ALKAAKNTIE

SEQ ID NO: 47004 - protein, 10 aa, Borrelia burgdorferi B31
LKAAKNTIEN

SEQ ID NO: 47005 - protein, 10 aa, Borrelia burgdorferi B31
KAAKNTIENI

SEQ ID NO: 47006 - protein, 10 aa, Borrelia burgdorferi B31
AAKNTIENIT

SEQ ID NO: 47007 - protein, 10 aa, Borrelia burgdorferi B31
AKNTIENITD

SEQ ID NO: 47008 - protein, 10 aa, Borrelia burgdorferi B31
KNTIENITDK

SEQ ID NO: 47009 - protein, 10 aa, Borrelia burgdorferi B31
NTIENITDKD

SEQ ID NO: 47010 - protein, 10 aa, Borrelia burgdorferi B31
TIENITDKDQ

SEQ ID NO: 47011 - protein, 10 aa, Borrelia burgdorferi B31
IENITDKDQD

SEQ ID NO: 47012 - protein, 10 aa, Borrelia burgdorferi B31
ENITDKDQDI

SEQ ID NO: 47013 - protein, 10 aa, Borrelia burgdorferi B31
NITDKDQDIS

SEQ ID NO: 47014 - protein, 10 aa, Borrelia burgdorferi B31
ITDKDQDISK

SEQ ID NO: 47015 - protein, 10 aa, Borrelia burgdorferi B31
TDKDQDISKR

SEQ ID NO: 47016 - protein, 10 aa, Borrelia burgdorferi B31
DKDQDISKRK

SEQ ID NO: 47017 - protein, 10 aa, Borrelia burgdorferi B31
KDQDISKRKI

SEQ ID NO: 47018 - protein, 10 aa, Borrelia burgdorferi B31
DQDISKRKIW

SEQ ID NO: 47019 - protein, 10 aa, Borrelia burgdorferi B31
QDISKRKIWS

SEQ ID NO: 47020 - protein, 10 aa, Borrelia burgdorferi B31
DISKRKIWSE

SEQ ID NO: 47021 - protein, 10 aa, Borrelia burgdorferi B31
ISKRKIWSEA

SEQ ID NO: 47022 - protein, 10 aa, Borrelia burgdorferi B31
SKRKIWSEAK

SEQ ID NO: 47023 - protein, 10 aa, Borrelia burgdorferi B31
KRKIWSEAKL

SEQ ID NO: 47024 - protein, 10 aa, Borrelia burgdorferi B31
RKIWSEAKLV

SEQ ID NO: 47025 - protein, 10 aa, Borrelia burgdorferi B31
KIWSEAKLVG

SEQ ID NO: 47026 - protein, 10 aa, Borrelia burgdorferi B31
IWSEAKLVGV

SEQ ID NO: 47027 - protein, 10 aa, Borrelia burgdorferi B31
WSEAKLVGVT

SEQ ID NO: 47028 - protein, 10 aa, Borrelia burgdorferi B31
SEAKLVGVTV

SEQ ID NO: 47029 - protein, 10 aa, Borrelia burgdorferi B31
EAKLVGVTVP

SEQ ID NO: 47030 - protein, 10 aa, Borrelia burgdorferi B31
AKLVGVTVPL

SEQ ID NO: 47031 - protein, 10 aa, Borrelia burgdorferi B31
KLVGVTVPLL

SEQ ID NO: 47032 - protein, 10 aa, Borrelia burgdorferi B31
LVGVTVPLLG

SEQ ID NO: 47033 - protein, 10 aa, Borrelia burgdorferi B31
VGVTVPLLGS

SEQ ID NO: 47034 - protein, 10 aa, Borrelia burgdorferi B31
GVTVPLLGSN

SEQ ID NO: 47035 - protein, 10 aa, Borrelia burgdorferi B31
VTVPLLGSNT

SEQ ID NO: 47036 - protein, 10 aa, Borrelia burgdorferi B31
TVPLLGSNTS

SEQ ID NO: 47037 - protein, 10 aa, Borrelia burgdorferi B31
VPLLGSNTSG

SEQ ID NO: 47038 - protein, 10 aa, Borrelia burgdorferi B31
PLLGSNTSGN

SEQ ID NO: 47039 - protein, 10 aa, Borrelia burgdorferi B31
LLGSNTSGNG

SEQ ID NO: 47040 - protein, 10 aa, Borrelia burgdorferi B31
LGSNTSGNGD

SEQ ID NO: 47041 - protein, 10 aa, Borrelia burgdorferi B31
GSNTSGNGDK

SEQ ID NO: 47042 - protein, 10 aa, Borrelia burgdorferi B31
SNTSGNGDKM

SEQ ID NO: 47043 - protein, 10 aa, Borrelia burgdorferi B31
NTSGNGDKMS

SEQ ID NO: 47044 - protein, 10 aa, Borrelia burgdorferi B31
TSGNGDKMSK

SEQ ID NO: 47045 - protein, 10 aa, Borrelia burgdorferi B31
SGNGDKMSKN

SEQ ID NO: 47046 - protein, 10 aa, Borrelia burgdorferi B31
GNGDKMSKNA

SEQ ID NO: 47047 - protein, 10 aa, Borrelia burgdorferi B31
NGDKMSKNAV

SEQ ID NO: 47048 - protein, 10 aa, Borrelia burgdorferi B31
GDKMSKNAVE

SEQ ID NO: 47049 - protein, 10 aa, Borrelia burgdorferi B31
DKMSKNAVEQ

SEQ ID NO: 47050 - protein, 10 aa, Borrelia burgdorferi B31
KMSKNAVEQI

SEQ ID NO: 47051 - protein, 10 aa, Borrelia burgdorferi B31
MSKNAVEQID

SEQ ID NO: 47052 - protein, 10 aa, Borrelia burgdorferi B31
SKNAVEQIDK

SEQ ID NO: 47053 - protein, 10 aa, Borrelia burgdorferi B31
KNAVEQIDKV

SEQ ID NO: 47054 - protein, 10 aa, Borrelia burgdorferi B31
NAVEQIDKVI

SEQ ID NO: 47055 - protein, 10 aa, Borrelia burgdorferi B31
AVEQIDKVIK

SEQ ID NO: 47056 - protein, 10 aa, Borrelia burgdorferi B31
VEQIDKVIKF

SEQ ID NO: 47057 - protein, 10 aa, Borrelia burgdorferi B31
EQIDKVIKFL

SEQ ID NO: 47058 - protein, 10 aa, Borrelia burgdorferi B31
QIDKVIKFLE

SEQ ID NO: 47059 - protein, 10 aa, Borrelia burgdorferi B31
IDKVIKFLEE

SEQ ID NO: 47060 - protein, 10 aa, Borrelia burgdorferi B31
DKVIKFLEEG

SEQ ID NO: 47061 - protein, 10 aa, Borrelia burgdorferi B31
KVIKFLEEGT

SEQ ID NO: 47062 - protein, 10 aa, Borrelia burgdorferi B31
VIKFLEEGTN

SEQ ID NO: 47063 - protein, 11 aa, Borrelia burgdorferi B31
MRNKNIFKLFF

SEQ ID NO: 47064 - protein, 11 aa, Borrelia burgdorferi B31
RNKNIFKLFFA

SEQ ID NO: 47065 - protein, 11 aa, Borrelia burgdorferi B31
NKNIFKLFFAS

SEQ ID NO: 47066 - protein, 11 aa, Borrelia burgdorferi B31
KNIFKLFFASM

SEQ ID NO: 47067 - protein, 11 aa, Borrelia burgdorferi B31
NIFKLFFASML

SEQ ID NO: 47068 - protein, 11 aa, Borrelia burgdorferi B31
IFKLFFASMLF

SEQ ID NO: 47069 - protein, 11 aa, Borrelia burgdorferi B31
FKLFFASMLFV

SEQ ID NO: 47070 - protein, 11 aa, Borrelia burgdorferi B31
KLFFASMLFVM

SEQ ID NO: 47071 - protein, 11 aa, Borrelia burgdorferi B31
LFFASMLFVMA

SEQ ID NO: 47072 - protein, 11 aa, Borrelia burgdorferi B31
FFASMLFVMAC

SEQ ID NO: 47073 - protein, 11 aa, Borrelia burgdorferi B31
FASMLFVMACK

SEQ ID NO: 47074 - protein, 11 aa, Borrelia burgdorferi B31
ASMLFVMACKA

SEQ ID NO: 47075 - protein, 11 aa, Borrelia burgdorferi B31
SMLFVMACKAY

SEQ ID NO: 47076 - protein, 11 aa, Borrelia burgdorferi B31
MLFVMACKAYV

SEQ ID NO: 47077 - protein, 11 aa, Borrelia burgdorferi B31
LFVMACKAYVE

SEQ ID NO: 47078 - protein, 11 aa, Borrelia burgdorferi B31
FVMACKAYVEE

SEQ ID NO: 47079 - protein, 11 aa, Borrelia burgdorferi B31
VMACKAYVEEK

SEQ ID NO: 47080 - protein, 11 aa, Borrelia burgdorferi B31
MACKAYVEEKK

SEQ ID NO: 47081 - protein, 11 aa, Borrelia burgdorferi B31
ACKAYVEEKKE

SEQ ID NO: 47082 - protein, 11 aa, Borrelia burgdorferi B31
CKAYVEEKKEI

SEQ ID NO: 47083 - protein, 11 aa, Borrelia burgdorferi B31
KAYVEEKKEID

SEQ ID NO: 47084 - protein, 11 aa, Borrelia burgdorferi B31
AYVEEKKEIDS

SEQ ID NO: 47085 - protein, 11 aa, Borrelia burgdorferi B31
YVEEKKEIDSL

SEQ ID NO: 47086 - protein, 11 aa, Borrelia burgdorferi B31
VEEKKEIDSLM

SEQ ID NO: 47087 - protein, 11 aa, Borrelia burgdorferi B31
EEKKEIDSLME

SEQ ID NO: 47088 - protein, 11 aa, Borrelia burgdorferi B31
EKKEIDSLMED

SEQ ID NO: 47089 - protein, 11 aa, Borrelia burgdorferi B31
KKEIDSLMEDV

SEQ ID NO: 47090 - protein, 11 aa, Borrelia burgdorferi B31
KEIDSLMEDVL

SEQ ID NO: 47091 - protein, 11 aa, Borrelia burgdorferi B31
EIDSLMEDVLA

SEQ ID NO: 47092 - protein, 11 aa, Borrelia burgdorferi B31
IDSLMEDVLAL

SEQ ID NO: 47093 - protein, 11 aa, Borrelia burgdorferi B31
DSLMEDVLALV

SEQ ID NO: 47094 - protein, 11 aa, Borrelia burgdorferi B31
SLMEDVLALVN

SEQ ID NO: 47095 - protein, 11 aa, Borrelia burgdorferi B31
LMEDVLALVND

SEQ ID NO: 47096 - protein, 11 aa, Borrelia burgdorferi B31
MEDVLALVNDS

SEQ ID NO: 47097 - protein, 11 aa, Borrelia burgdorferi B31
EDVLALVNDSS

SEQ ID NO: 47098 - protein, 11 aa, Borrelia burgdorferi B31
DVLALVNDSSG

SEQ ID NO: 47099 - protein, 11 aa, Borrelia burgdorferi B31
VLALVNDSSGG

SEQ ID NO: 47100 - protein, 11 aa, Borrelia burgdorferi B31
LALVNDSSGGK

SEQ ID NO: 47101 - protein, 11 aa, Borrelia burgdorferi B31
ALVNDSSGGKF

SEQ ID NO: 47102 - protein, 11 aa, Borrelia burgdorferi B31
LVNDSSGGKFK

SEQ ID NO: 47103 - protein, 11 aa, Borrelia burgdorferi B31
VNDSSGGKFKD

SEQ ID NO: 47104 - protein, 11 aa, Borrelia burgdorferi B31
NDSSGGKFKDY

SEQ ID NO: 47105 - protein, 11 aa, Borrelia burgdorferi B31
DSSGGKFKDYK

SEQ ID NO: 47106 - protein, 11 aa, Borrelia burgdorferi B31
SSGGKFKDYKD

SEQ ID NO: 47107 - protein, 11 aa, Borrelia burgdorferi B31
SGGKFKDYKDK

SEQ ID NO: 47108 - protein, 11 aa, Borrelia burgdorferi B31
GGKFKDYKDKI

SEQ ID NO: 47109 - protein, 11 aa, Borrelia burgdorferi B31
GKFKDYKDKIN

SEQ ID NO: 47110 - protein, 11 aa, Borrelia burgdorferi B31
KFKDYKDKINE

SEQ ID NO: 47111 - protein, 11 aa, Borrelia burgdorferi B31
FKDYKDKINEL

SEQ ID NO: 47112 - protein, 11 aa, Borrelia burgdorferi B31
KDYKDKINELK

SEQ ID NO: 47113 - protein, 11 aa, Borrelia burgdorferi B31
DYKDKINELKE

SEQ ID NO: 47114 - protein, 11 aa, Borrelia burgdorferi B31
YKDKINELKEN

SEQ ID NO: 47115 - protein, 11 aa, Borrelia burgdorferi B31
KDKINELKENL

SEQ ID NO: 47116 - protein, 11 aa, Borrelia burgdorferi B31
DKINELKENLK

SEQ ID NO: 47117 - protein, 11 aa, Borrelia burgdorferi B31
KINELKENLKD

SEQ ID NO: 47118 - protein, 11 aa, Borrelia burgdorferi B31
INELKENLKDI

SEQ ID NO: 47119 - protein, 11 aa, Borrelia burgdorferi B31
NELKENLKDIG

SEQ ID NO: 47120 - protein, 11 aa, Borrelia burgdorferi B31
ELKENLKDIGN

SEQ ID NO: 47121 - protein, 11 aa, Borrelia burgdorferi B31
LKENLKDIGNA

SEQ ID NO: 47122 - protein, 11 aa, Borrelia burgdorferi B31
KENLKDIGNAE

SEQ ID NO: 47123 - protein, 11 aa, Borrelia burgdorferi B31
ENLKDIGNAEL

SEQ ID NO: 47124 - protein, 11 aa, Borrelia burgdorferi B31
NLKDIGNAELK

SEQ ID NO: 47125 - protein, 11 aa, Borrelia burgdorferi B31
LKDIGNAELKE

SEQ ID NO: 47126 - protein, 11 aa, Borrelia burgdorferi B31
KDIGNAELKEK

SEQ ID NO: 47127 - protein, 11 aa, Borrelia burgdorferi B31
DIGNAELKEKL

SEQ ID NO: 47128 - protein, 11 aa, Borrelia burgdorferi B31
IGNAELKEKLL

SEQ ID NO: 47129 - protein, 11 aa, Borrelia burgdorferi B31
GNAELKEKLLN

SEQ ID NO: 47130 - protein, 11 aa, Borrelia burgdorferi B31
NAELKEKLLNL

SEQ ID NO: 47131 - protein, 11 aa, Borrelia burgdorferi B31
AELKEKLLNLQ

SEQ ID NO: 47132 - protein, 11 aa, Borrelia burgdorferi B31
ELKEKLLNLQN

SEQ ID NO: 47133 - protein, 11 aa, Borrelia burgdorferi B31
LKEKLLNLQNS

SEQ ID NO: 47134 - protein, 11 aa, Borrelia burgdorferi B31
KEKLLNLQNSF

SEQ ID NO: 47135 - protein, 11 aa, Borrelia burgdorferi B31
EKLLNLQNSFQ

SEQ ID NO: 47136 - protein, 11 aa, Borrelia burgdorferi B31
KLLNLQNSFQD

SEQ ID NO: 47137 - protein, 11 aa, Borrelia burgdorferi B31
LLNLQNSFQDK

SEQ ID NO: 47138 - protein, 11 aa, Borrelia burgdorferi B31
LNLQNSFQDKL

SEQ ID NO: 47139 - protein, 11 aa, Borrelia burgdorferi B31
NLQNSFQDKLA

SEQ ID NO: 47140 - protein, 11 aa, Borrelia burgdorferi B31
LQNSFQDKLAA

SEQ ID NO: 47141 - protein, 11 aa, Borrelia burgdorferi B31
QNSFQDKLAAK

SEQ ID NO: 47142 - protein, 11 aa, Borrelia burgdorferi B31
NSFQDKLAAKL

SEQ ID NO: 47143 - protein, 11 aa, Borrelia burgdorferi B31
SFQDKLAAKLA

SEQ ID NO: 47144 - protein, 11 aa, Borrelia burgdorferi B31
FQDKLAAKLAA

SEQ ID NO: 47145 - protein, 11 aa, Borrelia burgdorferi B31
QDKLAAKLAAL

SEQ ID NO: 47146 - protein, 11 aa, Borrelia burgdorferi B31
DKLAAKLAALK

SEQ ID NO: 47147 - protein, 11 aa, Borrelia burgdorferi B31
KLAAKLAALKA

SEQ ID NO: 47148 - protein, 11 aa, Borrelia burgdorferi B31
LAAKLAALKAA

SEQ ID NO: 47149 - protein, 11 aa, Borrelia burgdorferi B31
AAKLAALKAAK

SEQ ID NO: 47150 - protein, 11 aa, Borrelia burgdorferi B31
AKLAALKAAKN

SEQ ID NO: 47151 - protein, 11 aa, Borrelia burgdorferi B31
KLAALKAAKNT

SEQ ID NO: 47152 - protein, 11 aa, Borrelia burgdorferi B31
LAALKAAKNTI

SEQ ID NO: 47153 - protein, 11 aa, Borrelia burgdorferi B31
AALKAAKNTIE

SEQ ID NO: 47154 - protein, 11 aa, Borrelia burgdorferi B31
ALKAAKNTIEN

SEQ ID NO: 47155 - protein, 11 aa, Borrelia burgdorferi B31
LKAAKNTIENI

SEQ ID NO: 47156 - protein, 11 aa, Borrelia burgdorferi B31
KAAKNTIENIT

SEQ ID NO: 47157 - protein, 11 aa, Borrelia burgdorferi B31
AAKNTIENITD

SEQ ID NO: 47158 - protein, 11 aa, Borrelia burgdorferi B31
AKNTIENITDK

SEQ ID NO: 47159 - protein, 11 aa, Borrelia burgdorferi B31
KNTIENITDKD

SEQ ID NO: 47160 - protein, 11 aa, Borrelia burgdorferi B31
NTIENITDKDQ

SEQ ID NO: 47161 - protein, 11 aa, Borrelia burgdorferi B31
TIENITDKDQD

SEQ ID NO: 47162 - protein, 11 aa, Borrelia burgdorferi B31
IENITDKDQDI

SEQ ID NO: 47163 - protein, 11 aa, Borrelia burgdorferi B31
ENITDKDQDIS

SEQ ID NO: 47164 - protein, 11 aa, Borrelia burgdorferi B31
NITDKDQDISK

SEQ ID NO: 47165 - protein, 11 aa, Borrelia burgdorferi B31
ITDKDQDISKR

SEQ ID NO: 47166 - protein, 11 aa, Borrelia burgdorferi B31
TDKDQDISKRK

SEQ ID NO: 47167 - protein, 11 aa, Borrelia burgdorferi B31
DKDQDISKRKI

SEQ ID NO: 47168 - protein, 11 aa, Borrelia burgdorferi B31
KDQDISKRKIW

SEQ ID NO: 47169 - protein, 11 aa, Borrelia burgdorferi B31
DQDISKRKIWS

SEQ ID NO: 47170 - protein, 11 aa, Borrelia burgdorferi B31
QDISKRKIWSE

SEQ ID NO: 47171 - protein, 11 aa, Borrelia burgdorferi B31
DISKRKIWSEA

SEQ ID NO: 47172 - protein, 11 aa, Borrelia burgdorferi B31
ISKRKIWSEAK

SEQ ID NO: 47173 - protein, 11 aa, Borrelia burgdorferi B31
SKRKIWSEAKL

SEQ ID NO: 47174 - protein, 11 aa, Borrelia burgdorferi B31
KRKIWSEAKLV

SEQ ID NO: 47175 - protein, 11 aa, Borrelia burgdorferi B31
RKIWSEAKLVG

SEQ ID NO: 47176 - protein, 11 aa, Borrelia burgdorferi B31
KIWSEAKLVGV

SEQ ID NO: 47177 - protein, 11 aa, Borrelia burgdorferi B31
IWSEAKLVGVT

SEQ ID NO: 47178 - protein, 11 aa, Borrelia burgdorferi B31
WSEAKLVGVTV

SEQ ID NO: 47179 - protein, 11 aa, Borrelia burgdorferi B31
SEAKLVGVTVP

SEQ ID NO: 47180 - protein, 11 aa, Borrelia burgdorferi B31
EAKLVGVTVPL

SEQ ID NO: 47181 - protein, 11 aa, Borrelia burgdorferi B31
AKLVGVTVPLL

SEQ ID NO: 47182 - protein, 11 aa, Borrelia burgdorferi B31
KLVGVTVPLLG

SEQ ID NO: 47183 - protein, 11 aa, Borrelia burgdorferi B31
LVGVTVPLLGS

SEQ ID NO: 47184 - protein, 11 aa, Borrelia burgdorferi B31
VGVTVPLLGSN

SEQ ID NO: 47185 - protein, 11 aa, Borrelia burgdorferi B31
GVTVPLLGSNT

SEQ ID NO: 47186 - protein, 11 aa, Borrelia burgdorferi B31
VTVPLLGSNTS

SEQ ID NO: 47187 - protein, 11 aa, Borrelia burgdorferi B31
TVPLLGSNTSG

SEQ ID NO: 47188 - protein, 11 aa, Borrelia burgdorferi B31
VPLLGSNTSGN

SEQ ID NO: 47189 - protein, 11 aa, Borrelia burgdorferi B31
PLLGSNTSGNG

SEQ ID NO: 47190 - protein, 11 aa, Borrelia burgdorferi B31
LLGSNTSGNGD

SEQ ID NO: 47191 - protein, 11 aa, Borrelia burgdorferi B31
LGSNTSGNGDK

SEQ ID NO: 47192 - protein, 11 aa, Borrelia burgdorferi B31
GSNTSGNGDKM

SEQ ID NO: 47193 - protein, 11 aa, Borrelia burgdorferi B31
SNTSGNGDKMS

SEQ ID NO: 47194 - protein, 11 aa, Borrelia burgdorferi B31
NTSGNGDKMSK

SEQ ID NO: 47195 - protein, 11 aa, Borrelia burgdorferi B31
TSGNGDKMSKN

SEQ ID NO: 47196 - protein, 11 aa, Borrelia burgdorferi B31
SGNGDKMSKNA

SEQ ID NO: 47197 - protein, 11 aa, Borrelia burgdorferi B31
GNGDKMSKNAV

SEQ ID NO: 47198 - protein, 11 aa, Borrelia burgdorferi B31
NGDKMSKNAVE

SEQ ID NO: 47199 - protein, 11 aa, Borrelia burgdorferi B31
GDKMSKNAVEQ

SEQ ID NO: 47200 - protein, 11 aa, Borrelia burgdorferi B31
DKMSKNAVEQI

SEQ ID NO: 47201 - protein, 11 aa, Borrelia burgdorferi B31
KMSKNAVEQID

SEQ ID NO: 47202 - protein, 11 aa, Borrelia burgdorferi B31
MSKNAVEQIDK

SEQ ID NO: 47203 - protein, 11 aa, Borrelia burgdorferi B31
SKNAVEQIDKV

SEQ ID NO: 47204 - protein, 11 aa, Borrelia burgdorferi B31
KNAVEQIDKVI

SEQ ID NO: 47205 - protein, 11 aa, Borrelia burgdorferi B31
NAVEQIDKVIK

SEQ ID NO: 47206 - protein, 11 aa, Borrelia burgdorferi B31
AVEQIDKVIKF

SEQ ID NO: 47207 - protein, 11 aa, Borrelia burgdorferi B31
VEQIDKVIKFL

SEQ ID NO: 47208 - protein, 11 aa, Borrelia burgdorferi B31
EQIDKVIKFLE

SEQ ID NO: 47209 - protein, 11 aa, Borrelia burgdorferi B31
QIDKVIKFLEE

SEQ ID NO: 47210 - protein, 11 aa, Borrelia burgdorferi B31
IDKVIKFLEEG

SEQ ID NO: 47211 - protein, 11 aa, Borrelia burgdorferi B31
DKVIKFLEEGT

SEQ ID NO: 47212 - protein, 11 aa, Borrelia burgdorferi B31
KVIKFLEEGTN

SEQ ID NO: 47213 - protein, 8 aa, Borrelia burgdorferi B31
MKDNILKN

SEQ ID NO: 47214 - protein, 8 aa, Borrelia burgdorferi B31
KDNILKNN

SEQ ID NO: 47215 - protein, 8 aa, Borrelia burgdorferi B31
DNILKNNK

SEQ ID NO: 47216 - protein, 8 aa, Borrelia burgdorferi B31
NILKNNKL

SEQ ID NO: 47217 - protein, 8 aa, Borrelia burgdorferi B31
ILKNNKLI

SEQ ID NO: 47218 - protein, 8 aa, Borrelia burgdorferi B31
LKNNKLIA

SEQ ID NO: 47219 - protein, 8 aa, Borrelia burgdorferi B31
KNNKLIAI

SEQ ID NO: 47220 - protein, 8 aa, Borrelia burgdorferi B31
NNKLIAIF

SEQ ID NO: 47221 - protein, 8 aa, Borrelia burgdorferi B31
NKLIAIFL

SEQ ID NO: 47222 - protein, 8 aa, Borrelia burgdorferi B31
KLIAIFLL

SEQ ID NO: 47223 - protein, 8 aa, Borrelia burgdorferi B31
LIAIFLLH

SEQ ID NO: 47224 - protein, 8 aa, Borrelia burgdorferi B31
IAIFLLHV

SEQ ID NO: 47225 - protein, 8 aa, Borrelia burgdorferi B31
AIFLLHVL

SEQ ID NO: 47226 - protein, 8 aa, Borrelia burgdorferi B31
IFLLHVLT

SEQ ID NO: 47227 - protein, 8 aa, Borrelia burgdorferi B31
FLLHVLTV

SEQ ID NO: 47228 - protein, 8 aa, Borrelia burgdorferi B31
LLHVLTVL

SEQ ID NO: 47229 - protein, 8 aa, Borrelia burgdorferi B31
LHVLTVLI

SEQ ID NO: 47230 - protein, 8 aa, Borrelia burgdorferi B31
HVLTVLIL

SEQ ID NO: 47231 - protein, 8 aa, Borrelia burgdorferi B31
VLTVLILI

SEQ ID NO: 47232 - protein, 8 aa, Borrelia burgdorferi B31
LTVLILIS

SEQ ID NO: 47233 - protein, 8 aa, Borrelia burgdorferi B31
TVLILISC

SEQ ID NO: 47234 - protein, 8 aa, Borrelia burgdorferi B31
VLILISCS

SEQ ID NO: 47235 - protein, 8 aa, Borrelia burgdorferi B31
LILISCSL

SEQ ID NO: 47236 - protein, 8 aa, Borrelia burgdorferi B31
ILISCSLE

SEQ ID NO: 47237 - protein, 8 aa, Borrelia burgdorferi B31
LISCSLEV

SEQ ID NO: 47238 - protein, 8 aa, Borrelia burgdorferi B31
ISCSLEVK

SEQ ID NO: 47239 - protein, 8 aa, Borrelia burgdorferi B31
SCSLEVKD

SEQ ID NO: 47240 - protein, 8 aa, Borrelia burgdorferi B31
CSLEVKDS

SEQ ID NO: 47241 - protein, 8 aa, Borrelia burgdorferi B31
SLEVKDSN

SEQ ID NO: 47242 - protein, 8 aa, Borrelia burgdorferi B31
LEVKDSNE

SEQ ID NO: 47243 - protein, 8 aa, Borrelia burgdorferi B31
EVKDSNES

SEQ ID NO: 47244 - protein, 8 aa, Borrelia burgdorferi B31
VKDSNESK

SEQ ID NO: 47245 - protein, 8 aa, Borrelia burgdorferi B31
KDSNESKK

SEQ ID NO: 47246 - protein, 8 aa, Borrelia burgdorferi B31
DSNESKKH

SEQ ID NO: 47247 - protein, 8 aa, Borrelia burgdorferi B31
SNESKKHK

SEQ ID NO: 47248 - protein, 8 aa, Borrelia burgdorferi B31
NESKKHKK

SEQ ID NO: 47249 - protein, 8 aa, Borrelia burgdorferi B31
ESKKHKKE

SEQ ID NO: 47250 - protein, 8 aa, Borrelia burgdorferi B31
SKKHKKEK

SEQ ID NO: 47251 - protein, 8 aa, Borrelia burgdorferi B31
KKHKKEKR

SEQ ID NO: 47252 - protein, 8 aa, Borrelia burgdorferi B31
KHKKEKRK

SEQ ID NO: 47253 - protein, 8 aa, Borrelia burgdorferi B31
HKKEKRKG

SEQ ID NO: 47254 - protein, 8 aa, Borrelia burgdorferi B31
KKEKRKGK

SEQ ID NO: 47255 - protein, 8 aa, Borrelia burgdorferi B31
KEKRKGKV

SEQ ID NO: 47256 - protein, 8 aa, Borrelia burgdorferi B31
EKRKGKVE

SEQ ID NO: 47257 - protein, 8 aa, Borrelia burgdorferi B31
KRKGKVEN

SEQ ID NO: 47258 - protein, 8 aa, Borrelia burgdorferi B31
RKGKVENL

SEQ ID NO: 47259 - protein, 8 aa, Borrelia burgdorferi B31
KGKVENLL

SEQ ID NO: 47260 - protein, 8 aa, Borrelia burgdorferi B31
GKVENLLV

SEQ ID NO: 47261 - protein, 8 aa, Borrelia burgdorferi B31
KVENLLVA

SEQ ID NO: 47262 - protein, 8 aa, Borrelia burgdorferi B31
VENLLVAI

SEQ ID NO: 47263 - protein, 8 aa, Borrelia burgdorferi B31
ENLLVAIN

SEQ ID NO: 47264 - protein, 8 aa, Borrelia burgdorferi B31
NLLVAINN

SEQ ID NO: 47265 - protein, 8 aa, Borrelia burgdorferi B31
LLVAINNL

SEQ ID NO: 47266 - protein, 8 aa, Borrelia burgdorferi B31
LVAINNLK

SEQ ID NO: 47267 - protein, 8 aa, Borrelia burgdorferi B31
VAINNLKN

SEQ ID NO: 47268 - protein, 8 aa, Borrelia burgdorferi B31
AINNLKNP

SEQ ID NO: 47269 - protein, 8 aa, Borrelia burgdorferi B31
INNLKNPT

SEQ ID NO: 47270 - protein, 8 aa, Borrelia burgdorferi B31
NNLKNPTK

SEQ ID NO: 47271 - protein, 8 aa, Borrelia burgdorferi B31
NLKNPTKP

SEQ ID NO: 47272 - protein, 8 aa, Borrelia burgdorferi B31
LKNPTKPA

SEQ ID NO: 47273 - protein, 8 aa, Borrelia burgdorferi B31
KNPTKPAA

SEQ ID NO: 47274 - protein, 8 aa, Borrelia burgdorferi B31
NPTKPAAG

SEQ ID NO: 47275 - protein, 8 aa, Borrelia burgdorferi B31
PTKPAAGK

SEQ ID NO: 47276 - protein, 8 aa, Borrelia burgdorferi B31
TKPAAGKN

SEQ ID NO: 47277 - protein, 8 aa, Borrelia burgdorferi B31
KPAAGKNK

SEQ ID NO: 47278 - protein, 8 aa, Borrelia burgdorferi B31
PAAGKNKA

SEQ ID NO: 47279 - protein, 8 aa, Borrelia burgdorferi B31
AAGKNKAN

SEQ ID NO: 47280 - protein, 8 aa, Borrelia burgdorferi B31
AGKNKANS

SEQ ID NO: 47281 - protein, 8 aa, Borrelia burgdorferi B31
GKNKANSK

SEQ ID NO: 47282 - protein, 8 aa, Borrelia burgdorferi B31
KNKANSKA

SEQ ID NO: 47283 - protein, 8 aa, Borrelia burgdorferi B31
NKANSKAS

SEQ ID NO: 47284 - protein, 8 aa, Borrelia burgdorferi B31
KANSKASK

SEQ ID NO: 47285 - protein, 8 aa, Borrelia burgdorferi B31
ANSKASKQ

SEQ ID NO: 47286 - protein, 8 aa, Borrelia burgdorferi B31
NSKASKQK

SEQ ID NO: 47287 - protein, 8 aa, Borrelia burgdorferi B31
SKASKQKN

SEQ ID NO: 47288 - protein, 8 aa, Borrelia burgdorferi B31
KASKQKNN

SEQ ID NO: 47289 - protein, 8 aa, Borrelia burgdorferi B31
ASKQKNNP

SEQ ID NO: 47290 - protein, 8 aa, Borrelia burgdorferi B31
SKQKNNPN

SEQ ID NO: 47291 - protein, 8 aa, Borrelia burgdorferi B31
KQKNNPNA

SEQ ID NO: 47292 - protein, 8 aa, Borrelia burgdorferi B31
QKNNPNAN

SEQ ID NO: 47293 - protein, 8 aa, Borrelia burgdorferi B31
KNNPNANA

SEQ ID NO: 47294 - protein, 8 aa, Borrelia burgdorferi B31
NNPNANAN

SEQ ID NO: 47295 - protein, 8 aa, Borrelia burgdorferi B31
NPNANANN

SEQ ID NO: 47296 - protein, 8 aa, Borrelia burgdorferi B31
PNANANNA

SEQ ID NO: 47297 - protein, 8 aa, Borrelia burgdorferi B31
NANANNAP

SEQ ID NO: 47298 - protein, 8 aa, Borrelia burgdorferi B31
ANANNAPK

SEQ ID NO: 47299 - protein, 8 aa, Borrelia burgdorferi B31
NANNAPKK

SEQ ID NO: 47300 - protein, 8 aa, Borrelia burgdorferi B31
ANNAPKKI

SEQ ID NO: 47301 - protein, 8 aa, Borrelia burgdorferi B31
NNAPKKIL

SEQ ID NO: 47302 - protein, 8 aa, Borrelia burgdorferi B31
NAPKKILD

SEQ ID NO: 47303 - protein, 8 aa, Borrelia burgdorferi B31
APKKILDP

SEQ ID NO: 47304 - protein, 8 aa, Borrelia burgdorferi B31
PKKILDPE

SEQ ID NO: 47305 - protein, 8 aa, Borrelia burgdorferi B31
KKILDPEV

SEQ ID NO: 47306 - protein, 8 aa, Borrelia burgdorferi B31
KILDPEVA

SEQ ID NO: 47307 - protein, 8 aa, Borrelia burgdorferi B31
ILDPEVAK

SEQ ID NO: 47308 - protein, 8 aa, Borrelia burgdorferi B31
LDPEVAKL

SEQ ID NO: 47309 - protein, 8 aa, Borrelia burgdorferi B31
DPEVAKLI

SEQ ID NO: 47310 - protein, 8 aa, Borrelia burgdorferi B31
PEVAKLIQ

SEQ ID NO: 47311 - protein, 8 aa, Borrelia burgdorferi B31
EVAKLIQK

SEQ ID NO: 47312 - protein, 8 aa, Borrelia burgdorferi B31
VAKLIQKI

SEQ ID NO: 47313 - protein, 8 aa, Borrelia burgdorferi B31
AKLIQKIL

SEQ ID NO: 47314 - protein, 8 aa, Borrelia burgdorferi B31
KLIQKILD

SEQ ID NO: 47315 - protein, 8 aa, Borrelia burgdorferi B31
LIQKILDR

SEQ ID NO: 47316 - protein, 8 aa, Borrelia burgdorferi B31
IQKILDRS

SEQ ID NO: 47317 - protein, 8 aa, Borrelia burgdorferi B31
QKILDRSE

SEQ ID NO: 47318 - protein, 8 aa, Borrelia burgdorferi B31
KILDRSEN

SEQ ID NO: 47319 - protein, 8 aa, Borrelia burgdorferi B31
ILDRSENI

SEQ ID NO: 47320 - protein, 8 aa, Borrelia burgdorferi B31
LDRSENII

SEQ ID NO: 47321 - protein, 8 aa, Borrelia burgdorferi B31
DRSENIIQ

SEQ ID NO: 47322 - protein, 8 aa, Borrelia burgdorferi B31
RSENIIQI

SEQ ID NO: 47323 - protein, 8 aa, Borrelia burgdorferi B31
SENIIQIS

SEQ ID NO: 47324 - protein, 8 aa, Borrelia burgdorferi B31
ENIIQISE

SEQ ID NO: 47325 - protein, 8 aa, Borrelia burgdorferi B31
NIIQISEM

SEQ ID NO: 47326 - protein, 8 aa, Borrelia burgdorferi B31
IIQISEMD

SEQ ID NO: 47327 - protein, 8 aa, Borrelia burgdorferi B31
IQISEMDS

SEQ ID NO: 47328 - protein, 8 aa, Borrelia burgdorferi B31
QISEMDSS

SEQ ID NO: 47329 - protein, 8 aa, Borrelia burgdorferi B31
ISEMDSSR

SEQ ID NO: 47330 - protein, 8 aa, Borrelia burgdorferi B31
SEMDSSRG

SEQ ID NO: 47331 - protein, 8 aa, Borrelia burgdorferi B31
EMDSSRGE

SEQ ID NO: 47332 - protein, 8 aa, Borrelia burgdorferi B31
MDSSRGEP

SEQ ID NO: 47333 - protein, 8 aa, Borrelia burgdorferi B31
DSSRGEPN

SEQ ID NO: 47334 - protein, 8 aa, Borrelia burgdorferi B31
SSRGEPND

SEQ ID NO: 47335 - protein, 8 aa, Borrelia burgdorferi B31
SRGEPNDQ

SEQ ID NO: 47336 - protein, 8 aa, Borrelia burgdorferi B31
RGEPNDQF

SEQ ID NO: 47337 - protein, 8 aa, Borrelia burgdorferi B31
GEPNDQFG

SEQ ID NO: 47338 - protein, 8 aa, Borrelia burgdorferi B31
EPNDQFGM

SEQ ID NO: 47339 - protein, 8 aa, Borrelia burgdorferi B31
PNDQFGMR

SEQ ID NO: 47340 - protein, 8 aa, Borrelia burgdorferi B31
NDQFGMRA

SEQ ID NO: 47341 - protein, 8 aa, Borrelia burgdorferi B31
DQFGMRAE

SEQ ID NO: 47342 - protein, 8 aa, Borrelia burgdorferi B31
QFGMRAEI

SEQ ID NO: 47343 - protein, 8 aa, Borrelia burgdorferi B31
FGMRAEIF

SEQ ID NO: 47344 - protein, 8 aa, Borrelia burgdorferi B31
GMRAEIFS

SEQ ID NO: 47345 - protein, 8 aa, Borrelia burgdorferi B31
MRAEIFSK

SEQ ID NO: 47346 - protein, 8 aa, Borrelia burgdorferi B31
RAEIFSKI

SEQ ID NO: 47347 - protein, 8 aa, Borrelia burgdorferi B31
AEIFSKIF

SEQ ID NO: 47348 - protein, 8 aa, Borrelia burgdorferi B31
EIFSKIFF

SEQ ID NO: 47349 - protein, 8 aa, Borrelia burgdorferi B31
IFSKIFFN

SEQ ID NO: 47350 - protein, 8 aa, Borrelia burgdorferi B31
FSKIFFNA

SEQ ID NO: 47351 - protein, 8 aa, Borrelia burgdorferi B31
SKIFFNAN

SEQ ID NO: 47352 - protein, 8 aa, Borrelia burgdorferi B31
KIFFNANS

SEQ ID NO: 47353 - protein, 8 aa, Borrelia burgdorferi B31
IFFNANST

SEQ ID NO: 47354 - protein, 8 aa, Borrelia burgdorferi B31
FFNANSTV

SEQ ID NO: 47355 - protein, 8 aa, Borrelia burgdorferi B31
FNANSTVH

SEQ ID NO: 47356 - protein, 8 aa, Borrelia burgdorferi B31
NANSTVHF

SEQ ID NO: 47357 - protein, 8 aa, Borrelia burgdorferi B31
ANSTVHFD

SEQ ID NO: 47358 - protein, 8 aa, Borrelia burgdorferi B31
NSTVHFDS

SEQ ID NO: 47359 - protein, 8 aa, Borrelia burgdorferi B31
STVHFDSH

SEQ ID NO: 47360 - protein, 8 aa, Borrelia burgdorferi B31
TVHFDSHE

SEQ ID NO: 47361 - protein, 8 aa, Borrelia burgdorferi B31
VHFDSHEY

SEQ ID NO: 47362 - protein, 8 aa, Borrelia burgdorferi B31
HFDSHEYT

SEQ ID NO: 47363 - protein, 8 aa, Borrelia burgdorferi B31
FDSHEYTE

SEQ ID NO: 47364 - protein, 8 aa, Borrelia burgdorferi B31
DSHEYTEE

SEQ ID NO: 47365 - protein, 8 aa, Borrelia burgdorferi B31
SHEYTEER

SEQ ID NO: 47366 - protein, 8 aa, Borrelia burgdorferi B31
HEYTEERR

SEQ ID NO: 47367 - protein, 8 aa, Borrelia burgdorferi B31
EYTEERRM

SEQ ID NO: 47368 - protein, 8 aa, Borrelia burgdorferi B31
YTEERRML

SEQ ID NO: 47369 - protein, 8 aa, Borrelia burgdorferi B31
TEERRMLY

SEQ ID NO: 47370 - protein, 8 aa, Borrelia burgdorferi B31
EERRMLYT

SEQ ID NO: 47371 - protein, 8 aa, Borrelia burgdorferi B31
ERRMLYTS

SEQ ID NO: 47372 - protein, 8 aa, Borrelia burgdorferi B31
RRMLYTSL

SEQ ID NO: 47373 - protein, 8 aa, Borrelia burgdorferi B31
RMLYTSLN

SEQ ID NO: 47374 - protein, 8 aa, Borrelia burgdorferi B31
MLYTSLNF

SEQ ID NO: 47375 - protein, 8 aa, Borrelia burgdorferi B31
LYTSLNFN

SEQ ID NO: 47376 - protein, 8 aa, Borrelia burgdorferi B31
YTSLNFNE

SEQ ID NO: 47377 - protein, 8 aa, Borrelia burgdorferi B31
TSLNFNEG

SEQ ID NO: 47378 - protein, 8 aa, Borrelia burgdorferi B31
SLNFNEGK

SEQ ID NO: 47379 - protein, 8 aa, Borrelia burgdorferi B31
LNFNEGKI

SEQ ID NO: 47380 - protein, 8 aa, Borrelia burgdorferi B31
NFNEGKIF

SEQ ID NO: 47381 - protein, 8 aa, Borrelia burgdorferi B31
FNEGKIFN

SEQ ID NO: 47382 - protein, 8 aa, Borrelia burgdorferi B31
NEGKIFNL

SEQ ID NO: 47383 - protein, 8 aa, Borrelia burgdorferi B31
EGKIFNLG

SEQ ID NO: 47384 - protein, 8 aa, Borrelia burgdorferi B31
GKIFNLGQ

SEQ ID NO: 47385 - protein, 8 aa, Borrelia burgdorferi B31
KIFNLGQI

SEQ ID NO: 47386 - protein, 8 aa, Borrelia burgdorferi B31
IFNLGQIL

SEQ ID NO: 47387 - protein, 8 aa, Borrelia burgdorferi B31
FNLGQILS

SEQ ID NO: 47388 - protein, 8 aa, Borrelia burgdorferi B31
NLGQILSK

SEQ ID NO: 47389 - protein, 8 aa, Borrelia burgdorferi B31
LGQILSKL

SEQ ID NO: 47390 - protein, 8 aa, Borrelia burgdorferi B31
GQILSKLS

SEQ ID NO: 47391 - protein, 8 aa, Borrelia burgdorferi B31
QILSKLSQ

SEQ ID NO: 47392 - protein, 8 aa, Borrelia burgdorferi B31
ILSKLSQD

SEQ ID NO: 47393 - protein, 8 aa, Borrelia burgdorferi B31
LSKLSQDS

SEQ ID NO: 47394 - protein, 8 aa, Borrelia burgdorferi B31
SKLSQDSN

SEQ ID NO: 47395 - protein, 8 aa, Borrelia burgdorferi B31
KLSQDSNY

SEQ ID NO: 47396 - protein, 8 aa, Borrelia burgdorferi B31
LSQDSNYR

SEQ ID NO: 47397 - protein, 8 aa, Borrelia burgdorferi B31
SQDSNYRG

SEQ ID NO: 47398 - protein, 8 aa, Borrelia burgdorferi B31
QDSNYRGL

SEQ ID NO: 47399 - protein, 8 aa, Borrelia burgdorferi B31
DSNYRGLV

SEQ ID NO: 47400 - protein, 8 aa, Borrelia burgdorferi B31
SNYRGLVK

SEQ ID NO: 47401 - protein, 8 aa, Borrelia burgdorferi B31
NYRGLVKE

SEQ ID NO: 47402 - protein, 8 aa, Borrelia burgdorferi B31
YRGLVKET

SEQ ID NO: 47403 - protein, 8 aa, Borrelia burgdorferi B31
RGLVKETL

SEQ ID NO: 47404 - protein, 8 aa, Borrelia burgdorferi B31
GLVKETLI

SEQ ID NO: 47405 - protein, 8 aa, Borrelia burgdorferi B31
LVKETLIN

SEQ ID NO: 47406 - protein, 8 aa, Borrelia burgdorferi B31
VKETLINR

SEQ ID NO: 47407 - protein, 8 aa, Borrelia burgdorferi B31
KETLINRG

SEQ ID NO: 47408 - protein, 8 aa, Borrelia burgdorferi B31
ETLINRGF

SEQ ID NO: 47409 - protein, 8 aa, Borrelia burgdorferi B31
TLINRGFS

SEQ ID NO: 47410 - protein, 8 aa, Borrelia burgdorferi B31
LINRGFSI

SEQ ID NO: 47411 - protein, 8 aa, Borrelia burgdorferi B31
INRGFSIQ

SEQ ID NO: 47412 - protein, 8 aa, Borrelia burgdorferi B31
NRGFSIQL

SEQ ID NO: 47413 - protein, 8 aa, Borrelia burgdorferi B31
RGFSIQLA

SEQ ID NO: 47414 - protein, 8 aa, Borrelia burgdorferi B31
GFSIQLAM

SEQ ID NO: 47415 - protein, 8 aa, Borrelia burgdorferi B31
FSIQLAME

SEQ ID NO: 47416 - protein, 8 aa, Borrelia burgdorferi B31
SIQLAMEE

SEQ ID NO: 47417 - protein, 8 aa, Borrelia burgdorferi B31
IQLAMEEI

SEQ ID NO: 47418 - protein, 8 aa, Borrelia burgdorferi B31
QLAMEEIS

SEQ ID NO: 47419 - protein, 8 aa, Borrelia burgdorferi B31
LAMEEISA

SEQ ID NO: 47420 - protein, 8 aa, Borrelia burgdorferi B31
AMEEISAK

SEQ ID NO: 47421 - protein, 8 aa, Borrelia burgdorferi B31
MEEISAKI

SEQ ID NO: 47422 - protein, 8 aa, Borrelia burgdorferi B31
EEISAKIL

SEQ ID NO: 47423 - protein, 8 aa, Borrelia burgdorferi B31
EISAKILN

SEQ ID NO: 47424 - protein, 8 aa, Borrelia burgdorferi B31
ISAKILNV

SEQ ID NO: 47425 - protein, 8 aa, Borrelia burgdorferi B31
SAKILNVK

SEQ ID NO: 47426 - protein, 8 aa, Borrelia burgdorferi B31
AKILNVKD

SEQ ID NO: 47427 - protein, 8 aa, Borrelia burgdorferi B31
KILNVKDK

SEQ ID NO: 47428 - protein, 8 aa, Borrelia burgdorferi B31
ILNVKDKL

SEQ ID NO: 47429 - protein, 8 aa, Borrelia burgdorferi B31
LNVKDKLQ

SEQ ID NO: 47430 - protein, 8 aa, Borrelia burgdorferi B31
NVKDKLQQ

SEQ ID NO: 47431 - protein, 8 aa, Borrelia burgdorferi B31
VKDKLQQL

SEQ ID NO: 47432 - protein, 8 aa, Borrelia burgdorferi B31
KDKLQQLN

SEQ ID NO: 47433 - protein, 8 aa, Borrelia burgdorferi B31
DKLQQLNK

SEQ ID NO: 47434 - protein, 8 aa, Borrelia burgdorferi B31
KLQQLNKP

SEQ ID NO: 47435 - protein, 8 aa, Borrelia burgdorferi B31
LQQLNKPN

SEQ ID NO: 47436 - protein, 8 aa, Borrelia burgdorferi B31
QQLNKPNL

SEQ ID NO: 47437 - protein, 8 aa, Borrelia burgdorferi B31
QLNKPNLE

SEQ ID NO: 47438 - protein, 8 aa, Borrelia burgdorferi B31
LNKPNLET

SEQ ID NO: 47439 - protein, 8 aa, Borrelia burgdorferi B31
NKPNLETL

SEQ ID NO: 47440 - protein, 8 aa, Borrelia burgdorferi B31
KPNLETLY

SEQ ID NO: 47441 - protein, 8 aa, Borrelia burgdorferi B31
PNLETLYN

SEQ ID NO: 47442 - protein, 8 aa, Borrelia burgdorferi B31
NLETLYND

SEQ ID NO: 47443 - protein, 8 aa, Borrelia burgdorferi B31
LETLYNDF

SEQ ID NO: 47444 - protein, 8 aa, Borrelia burgdorferi B31
ETLYNDFE

SEQ ID NO: 47445 - protein, 8 aa, Borrelia burgdorferi B31
TLYNDFEK

SEQ ID NO: 47446 - protein, 8 aa, Borrelia burgdorferi B31
LYNDFEKL

SEQ ID NO: 47447 - protein, 8 aa, Borrelia burgdorferi B31
YNDFEKLT

SEQ ID NO: 47448 - protein, 8 aa, Borrelia burgdorferi B31
NDFEKLTS

SEQ ID NO: 47449 - protein, 8 aa, Borrelia burgdorferi B31
DFEKLTSL

SEQ ID NO: 47450 - protein, 8 aa, Borrelia burgdorferi B31
FEKLTSLK

SEQ ID NO: 47451 - protein, 8 aa, Borrelia burgdorferi B31
EKLTSLKE

SEQ ID NO: 47452 - protein, 8 aa, Borrelia burgdorferi B31
KLTSLKEK

SEQ ID NO: 47453 - protein, 8 aa, Borrelia burgdorferi B31
LTSLKEKW

SEQ ID NO: 47454 - protein, 8 aa, Borrelia burgdorferi B31
TSLKEKWL

SEQ ID NO: 47455 - protein, 8 aa, Borrelia burgdorferi B31
SLKEKWLK

SEQ ID NO: 47456 - protein, 8 aa, Borrelia burgdorferi B31
LKEKWLKD

SEQ ID NO: 47457 - protein, 8 aa, Borrelia burgdorferi B31
KEKWLKDT

SEQ ID NO: 47458 - protein, 8 aa, Borrelia burgdorferi B31
EKWLKDTD

SEQ ID NO: 47459 - protein, 8 aa, Borrelia burgdorferi B31
KWLKDTDD

SEQ ID NO: 47460 - protein, 8 aa, Borrelia burgdorferi B31
WLKDTDDL

SEQ ID NO: 47461 - protein, 8 aa, Borrelia burgdorferi B31
LKDTDDLI

SEQ ID NO: 47462 - protein, 8 aa, Borrelia burgdorferi B31
KDTDDLID

SEQ ID NO: 47463 - protein, 8 aa, Borrelia burgdorferi B31
DTDDLIDE

SEQ ID NO: 47464 - protein, 8 aa, Borrelia burgdorferi B31
TDDLIDEY

SEQ ID NO: 47465 - protein, 8 aa, Borrelia burgdorferi B31
DDLIDEYN

SEQ ID NO: 47466 - protein, 8 aa, Borrelia burgdorferi B31
DLIDEYNT

SEQ ID NO: 47467 - protein, 8 aa, Borrelia burgdorferi B31
LIDEYNTN

SEQ ID NO: 47468 - protein, 8 aa, Borrelia burgdorferi B31
IDEYNTNP

SEQ ID NO: 47469 - protein, 8 aa, Borrelia burgdorferi B31
DEYNTNPD

SEQ ID NO: 47470 - protein, 8 aa, Borrelia burgdorferi B31
EYNTNPDL

SEQ ID NO: 47471 - protein, 8 aa, Borrelia burgdorferi B31
YNTNPDLQ

SEQ ID NO: 47472 - protein, 8 aa, Borrelia burgdorferi B31
NTNPDLQT

SEQ ID NO: 47473 - protein, 8 aa, Borrelia burgdorferi B31
TNPDLQTD

SEQ ID NO: 47474 - protein, 8 aa, Borrelia burgdorferi B31
NPDLQTDV

SEQ ID NO: 47475 - protein, 8 aa, Borrelia burgdorferi B31
PDLQTDVS

SEQ ID NO: 47476 - protein, 8 aa, Borrelia burgdorferi B31
DLQTDVSK

SEQ ID NO: 47477 - protein, 8 aa, Borrelia burgdorferi B31
LQTDVSKL

SEQ ID NO: 47478 - protein, 8 aa, Borrelia burgdorferi B31
QTDVSKLN

SEQ ID NO: 47479 - protein, 8 aa, Borrelia burgdorferi B31
TDVSKLND

SEQ ID NO: 47480 - protein, 8 aa, Borrelia burgdorferi B31
DVSKLNDT

SEQ ID NO: 47481 - protein, 8 aa, Borrelia burgdorferi B31
VSKLNDTL

SEQ ID NO: 47482 - protein, 8 aa, Borrelia burgdorferi B31
SKLNDTLR

SEQ ID NO: 47483 - protein, 8 aa, Borrelia burgdorferi B31
KLNDTLRS

SEQ ID NO: 47484 - protein, 8 aa, Borrelia burgdorferi B31
LNDTLRSK

SEQ ID NO: 47485 - protein, 8 aa, Borrelia burgdorferi B31
NDTLRSKN

SEQ ID NO: 47486 - protein, 8 aa, Borrelia burgdorferi B31
DTLRSKNS

SEQ ID NO: 47487 - protein, 8 aa, Borrelia burgdorferi B31
TLRSKNSR

SEQ ID NO: 47488 - protein, 8 aa, Borrelia burgdorferi B31
LRSKNSRA

SEQ ID NO: 47489 - protein, 8 aa, Borrelia burgdorferi B31
RSKNSRAQ

SEQ ID NO: 47490 - protein, 8 aa, Borrelia burgdorferi B31
SKNSRAQF

SEQ ID NO: 47491 - protein, 8 aa, Borrelia burgdorferi B31
KNSRAQFA

SEQ ID NO: 47492 - protein, 8 aa, Borrelia burgdorferi B31
NSRAQFAN

SEQ ID NO: 47493 - protein, 8 aa, Borrelia burgdorferi B31
SRAQFANI

SEQ ID NO: 47494 - protein, 8 aa, Borrelia burgdorferi B31
RAQFANIH

SEQ ID NO: 47495 - protein, 8 aa, Borrelia burgdorferi B31
AQFANIHD

SEQ ID NO: 47496 - protein, 8 aa, Borrelia burgdorferi B31
QFANIHDI

SEQ ID NO: 47497 - protein, 8 aa, Borrelia burgdorferi B31
FANIHDII

SEQ ID NO: 47498 - protein, 8 aa, Borrelia burgdorferi B31
ANIHDIIL

SEQ ID NO: 47499 - protein, 8 aa, Borrelia burgdorferi B31
NIHDIILD

SEQ ID NO: 47500 - protein, 8 aa, Borrelia burgdorferi B31
IHDIILDL

SEQ ID NO: 47501 - protein, 8 aa, Borrelia burgdorferi B31
HDIILDLV

SEQ ID NO: 47502 - protein, 8 aa, Borrelia burgdorferi B31
DIILDLVN

SEQ ID NO: 47503 - protein, 8 aa, Borrelia burgdorferi B31
IILDLVNT

SEQ ID NO: 47504 - protein, 8 aa, Borrelia burgdorferi B31
ILDLVNTT

SEQ ID NO: 47505 - protein, 8 aa, Borrelia burgdorferi B31
LDLVNTTT
